United States Patent 7,888,497 (BIOINFORMATICALLY DETECTABLE GROUP OF NOVEL REGULATORY OLIGONUCLEOTIDES AND USES THEREOF) - sequence listing, part 59

SEQ ID NO: 2479684 - DNA, 16 bp, Homo sapiens
aatgaaacaaagagtt

SEQ ID NO: 2479685 - DNA, 17 bp, Homo sapiens
aatgaacaagagaagca

SEQ ID NO: 2479686 - DNA, 22 bp, Homo sapiens
aatgaacaagagaagcattctc

SEQ ID NO: 2479687 - DNA, 15 bp, Homo sapiens
aatgaacagaacata

SEQ ID NO: 2479688 - DNA, 11 bp, Homo sapiens
aatgaagaaag

SEQ ID NO: 2479689 - DNA, 24 bp, Homo sapiens
aatgaagatctaaataaaatgcta

SEQ ID NO: 2479690 - DNA, 19 bp, Homo sapiens
aatgacatgaattttagct

SEQ ID NO: 2479691 - DNA, 14 bp, Homo sapiens
aatgagaaccaaca

SEQ ID NO: 2479692 - DNA, 15 bp, Homo sapiens
aatgagattgaattt

SEQ ID NO: 2479693 - DNA, 14 bp, Homo sapiens
aatgagcatgttta

SEQ ID NO: 2479694 - DNA, 22 bp, Homo sapiens
aatgagcatgtttagactttaa

SEQ ID NO: 2479695 - DNA, 12 bp, Homo sapiens
aatgagctttct

SEQ ID NO: 2479696 - DNA, 14 bp, Homo sapiens
aatgagctttctga

SEQ ID NO: 2479697 - DNA, 15 bp, Homo sapiens
aatgagctttctgaa

SEQ ID NO: 2479698 - DNA, 16 bp, Homo sapiens
aatgagctttctgaac

SEQ ID NO: 2479699 - DNA, 22 bp, Homo sapiens
aatgagctttctgaacagctgg

SEQ ID NO: 2479700 - DNA, 16 bp, Homo sapiens
aatgaggccatggact

SEQ ID NO: 2479701 - DNA, 22 bp, Homo sapiens
aatgaggccatggactctgtcc

SEQ ID NO: 2479702 - DNA, 23 bp, Homo sapiens
aatgatgatcaattatagtttct

SEQ ID NO: 2479703 - DNA, 15 bp, Homo sapiens
aatgattgtagtaat

SEQ ID NO: 2479704 - DNA, 17 bp, Homo sapiens
aatgatttttctttaca

SEQ ID NO: 2479705 - DNA, 18 bp, Homo sapiens
aatgatttttctttacaa

SEQ ID NO: 2479706 - DNA, 17 bp, Homo sapiens
aatgcaaaaactctttg

SEQ ID NO: 2479707 - DNA, 13 bp, Homo sapiens
aatgcaaataaca

SEQ ID NO: 2479708 - DNA, 14 bp, Homo sapiens
aatgcaaataacaa

SEQ ID NO: 2479709 - DNA, 16 bp, Homo sapiens
aatgcaaataacaaat

SEQ ID NO: 2479710 - DNA, 13 bp, Homo sapiens
aatgcaaccattt

SEQ ID NO: 2479711 - DNA, 17 bp, Homo sapiens
aatgcaaccatttgaaa

SEQ ID NO: 2479712 - DNA, 19 bp, Homo sapiens
aatgcagttgtctctgttt

SEQ ID NO: 2479713 - DNA, 15 bp, Homo sapiens
aatgccatcatctcc

SEQ ID NO: 2479714 - DNA, 22 bp, Homo sapiens
aatgccatgatgcctctgtctt

SEQ ID NO: 2479715 - DNA, 13 bp, Homo sapiens
aatgcccttcact

SEQ ID NO: 2479716 - DNA, 22 bp, Homo sapiens
aatgcctgactagggagccatg

SEQ ID NO: 2479717 - DNA, 23 bp, Homo sapiens
aatgctggctatagatgtctttt

SEQ ID NO: 2479718 - DNA, 23 bp, Homo sapiens
aatgctgtacatctattttggat

SEQ ID NO: 2479719 - DNA, 22 bp, Homo sapiens
aatgcttaatcagatagatatt

SEQ ID NO: 2479720 - DNA, 15 bp, Homo sapiens
aatgcttagaaattc

SEQ ID NO: 2479721 - DNA, 21 bp, Homo sapiens
aatgcttctaagtaaatacaa

SEQ ID NO: 2479722 - DNA, 20 bp, Homo sapiens
aatgctttttatttctgcat

SEQ ID NO: 2479723 - DNA, 21 bp, Homo sapiens
aatggaccggagagtgggggt

SEQ ID NO: 2479724 - DNA, 17 bp, Homo sapiens
aatggactggaagggga

SEQ ID NO: 2479725 - DNA, 16 bp, Homo sapiens
aatggatcacaagatg

SEQ ID NO: 2479726 - DNA, 18 bp, Homo sapiens
aatggatttttctttaac

SEQ ID NO: 2479727 - DNA, 19 bp, Homo sapiens
aatggcagcaggggttggg

SEQ ID NO: 2479728 - DNA, 20 bp, Homo sapiens
aatggcagttatattttgca

SEQ ID NO: 2479729 - DNA, 19 bp, Homo sapiens
aatggctgataattttaaa

SEQ ID NO: 2479730 - DNA, 18 bp, Homo sapiens
aatggctttggtctcttg

SEQ ID NO: 2479731 - DNA, 21 bp, Homo sapiens
aatggctttggtctcttgctt

SEQ ID NO: 2479732 - DNA, 14 bp, Homo sapiens
aatgggctcaaact

SEQ ID NO: 2479733 - DNA, 13 bp, Homo sapiens
aatggggccagat

SEQ ID NO: 2479734 - DNA, 17 bp, Homo sapiens
aatggggccagatccag

SEQ ID NO: 2479735 - DNA, 22 bp, Homo sapiens
aatggggccagatccagcctgg

SEQ ID NO: 2479736 - DNA, 18 bp, Homo sapiens
aatggtactgactttgct

SEQ ID NO: 2479737 - DNA, 14 bp, Homo sapiens
aatggtgtgggaga

SEQ ID NO: 2479738 - DNA, 15 bp, Homo sapiens
aatgtaaagccatgc

SEQ ID NO: 2479739 - DNA, 22 bp, Homo sapiens
aatgtaaatattttaaagaatt

SEQ ID NO: 2479740 - DNA, 14 bp, Homo sapiens
aatgtaaatttgta

SEQ ID NO: 2479741 - DNA, 17 bp, Homo sapiens
aatgtaaatttgtacta

SEQ ID NO: 2479742 - DNA, 19 bp, Homo sapiens
aatgtaagattatagattc

SEQ ID NO: 2479743 - DNA, 22 bp, Homo sapiens
aatgtaagattatagattctaa

SEQ ID NO: 2479744 - DNA, 22 bp, Homo sapiens
aatgtaaggctgtgtaagattt

SEQ ID NO: 2479745 - DNA, 17 bp, Homo sapiens
aatgtacatctggcctt

SEQ ID NO: 2479746 - DNA, 15 bp, Homo sapiens
aatgtagataagtgt

SEQ ID NO: 2479747 - DNA, 23 bp, Homo sapiens
aatgtagttctgctccagacagg

SEQ ID NO: 2479748 - DNA, 13 bp, Homo sapiens
aatgtatagtaaa

SEQ ID NO: 2479749 - DNA, 18 bp, Homo sapiens
aatgtattttatgttata

SEQ ID NO: 2479750 - DNA, 20 bp, Homo sapiens
aatgtattttatgttatata

SEQ ID NO: 2479751 - DNA, 20 bp, Homo sapiens
aatgtcactttttgaggcaa

SEQ ID NO: 2479752 - DNA, 17 bp, Homo sapiens
aatgtcatgctgcctta

SEQ ID NO: 2479753 - DNA, 13 bp, Homo sapiens
aatgtctggagac

SEQ ID NO: 2479754 - DNA, 13 bp, Homo sapiens
aatgtcttgagct

SEQ ID NO: 2479755 - DNA, 20 bp, Homo sapiens
aatgtctttaatgcaatata

SEQ ID NO: 2479756 - DNA, 12 bp, Homo sapiens
aatgtgatgaat

SEQ ID NO: 2479757 - DNA, 16 bp, Homo sapiens
aatgtgatgaatactg

SEQ ID NO: 2479758 - DNA, 12 bp, Homo sapiens
aatgtggcttga

SEQ ID NO: 2479759 - DNA, 17 bp, Homo sapiens
aatgtgtgtatatggac

SEQ ID NO: 2479760 - DNA, 23 bp, Homo sapiens
aatgtgttgttccaaatactaat

SEQ ID NO: 2479761 - DNA, 23 bp, Homo sapiens
aatgtgtttcacagtttgaaata

SEQ ID NO: 2479762 - DNA, 13 bp, Homo sapiens
aatgttaaaatgt

SEQ ID NO: 2479763 - DNA, 15 bp, Homo sapiens
aatgttaaaatgtgt

SEQ ID NO: 2479764 - DNA, 22 bp, Homo sapiens
aatgttatcttctcaagttcta

SEQ ID NO: 2479765 - DNA, 23 bp, Homo sapiens
aatgttatcttctcaagttctaa

SEQ ID NO: 2479766 - DNA, 19 bp, Homo sapiens
aatgttattttttaattat

SEQ ID NO: 2479767 - DNA, 19 bp, Homo sapiens
aatgttctaagtttctaag

SEQ ID NO: 2479768 - DNA, 19 bp, Homo sapiens
aatgttgattacagtgcag

SEQ ID NO: 2479769 - DNA, 13 bp, Homo sapiens
aatgttgctgaaa

SEQ ID NO: 2479770 - DNA, 16 bp, Homo sapiens
aatgtttctggatttc

SEQ ID NO: 2479771 - DNA, 22 bp, Homo sapiens
aatgtttcttctaggttctaaa

SEQ ID NO: 2479772 - DNA, 22 bp, Homo sapiens
aatgtttttaataaaagaaaat

SEQ ID NO: 2479773 - DNA, 15 bp, Homo sapiens
aattaaaaaagataa

SEQ ID NO: 2479774 - DNA, 20 bp, Homo sapiens
aattaaaaaagataaacaca

SEQ ID NO: 2479775 - DNA, 24 bp, Homo sapiens
aattaaaaaagataaacacaagat

SEQ ID NO: 2479776 - DNA, 16 bp, Homo sapiens
aattaaagtactttaa

SEQ ID NO: 2479777 - DNA, 13 bp, Homo sapiens
aattaagaaggca

SEQ ID NO: 2479778 - DNA, 19 bp, Homo sapiens
aattaagaaggcaaaaatg

SEQ ID NO: 2479779 - DNA, 23 bp, Homo sapiens
aattaagaaggcaaaaatgtaaa

SEQ ID NO: 2479780 - DNA, 21 bp, Homo sapiens
aattaatatccctacatgtat

SEQ ID NO: 2479781 - DNA, 22 bp, Homo sapiens
aattaattatcttttcaaaggt

SEQ ID NO: 2479782 - DNA, 17 bp, Homo sapiens
aattacagaaatttaat

SEQ ID NO: 2479783 - DNA, 23 bp, Homo sapiens
aattactttggggctaatttaac

SEQ ID NO: 2479784 - DNA, 16 bp, Homo sapiens
aattagacactttgga

SEQ ID NO: 2479785 - DNA, 20 bp, Homo sapiens
aattagactgtgattcagaa

SEQ ID NO: 2479786 - DNA, 23 bp, Homo sapiens
aattagactgtgattcagaaaat

SEQ ID NO: 2479787 - DNA, 19 bp, Homo sapiens
aattaggctgtaactactt

SEQ ID NO: 2479788 - DNA, 20 bp, Homo sapiens
aattagtgccacttaatgta

SEQ ID NO: 2479789 - DNA, 14 bp, Homo sapiens
aattagtttccttt

SEQ ID NO: 2479790 - DNA, 15 bp, Homo sapiens
aattagtttcctttt

SEQ ID NO: 2479791 - DNA, 23 bp, Homo sapiens
aattagtttcctttttaatatgc

SEQ ID NO: 2479792 - DNA, 13 bp, Homo sapiens
aattataaatgac

SEQ ID NO: 2479793 - DNA, 16 bp, Homo sapiens
aattataatatactat

SEQ ID NO: 2479794 - DNA, 16 bp, Homo sapiens
aattatagtttctgag

SEQ ID NO: 2479795 - DNA, 14 bp, Homo sapiens
aattatataactgt

SEQ ID NO: 2479796 - DNA, 15 bp, Homo sapiens
aattatctaatttat

SEQ ID NO: 2479797 - DNA, 16 bp, Homo sapiens
aattatcttttcaaag

SEQ ID NO: 2479798 - DNA, 17 bp, Homo sapiens
aattatcttttcaaagg

SEQ ID NO: 2479799 - DNA, 12 bp, Homo sapiens
aattatgtagct

SEQ ID NO: 2479800 - DNA, 22 bp, Homo sapiens
aattatgtagctctttgtcagg

SEQ ID NO: 2479801 - DNA, 18 bp, Homo sapiens
aattattacagtgtttat

SEQ ID NO: 2479802 - DNA, 13 bp, Homo sapiens
aattattatttat

SEQ ID NO: 2479803 - DNA, 18 bp, Homo sapiens
aattattatttatatatg

SEQ ID NO: 2479804 - DNA, 14 bp, Homo sapiens
aattattcaattta

SEQ ID NO: 2479805 - DNA, 22 bp, Homo sapiens
aattatttcatgattagaaatt

SEQ ID NO: 2479806 - DNA, 12 bp, Homo sapiens
aattatttgcat

SEQ ID NO: 2479807 - DNA, 13 bp, Homo sapiens
aattattttcatc

SEQ ID NO: 2479808 - DNA, 16 bp, Homo sapiens
aattcaaaagttccaa

SEQ ID NO: 2479809 - DNA, 23 bp, Homo sapiens
aattcaaaagttccaagagtcta

SEQ ID NO: 2479810 - DNA, 22 bp, Homo sapiens
aattcaaagctgtgtgtttgga

SEQ ID NO: 2479811 - DNA, 17 bp, Homo sapiens
aattcaaataaaaatcc

SEQ ID NO: 2479812 - DNA, 13 bp, Homo sapiens
aattcaattcaaa

SEQ ID NO: 2479813 - DNA, 15 bp, Homo sapiens
aattcaattcaaagc

SEQ ID NO: 2479814 - DNA, 20 bp, Homo sapiens
aattcacagtgctcttttct

SEQ ID NO: 2479815 - DNA, 12 bp, Homo sapiens
aattcactctga

SEQ ID NO: 2479816 - DNA, 13 bp, Homo sapiens
aattcactgtact

SEQ ID NO: 2479817 - DNA, 15 bp, Homo sapiens
aattcaggtttttcc

SEQ ID NO: 2479818 - DNA, 13 bp, Homo sapiens
aattcagtttcat

SEQ ID NO: 2479819 - DNA, 12 bp, Homo sapiens
aattccaaagtc

SEQ ID NO: 2479820 - DNA, 13 bp, Homo sapiens
aattccaaagtct

SEQ ID NO: 2479821 - DNA, 16 bp, Homo sapiens
aattccacacctttta

SEQ ID NO: 2479822 - DNA, 20 bp, Homo sapiens
aattccctcactcgtctccc

SEQ ID NO: 2479823 - DNA, 15 bp, Homo sapiens
aattcggtgtgcacc

SEQ ID NO: 2479824 - DNA, 22 bp, Homo sapiens
aattcgtgtgtttttttatgaa

SEQ ID NO: 2479825 - DNA, 13 bp, Homo sapiens
aattctaaatgaa

SEQ ID NO: 2479826 - DNA, 22 bp, Homo sapiens
aattctataaggccataaaaca

SEQ ID NO: 2479827 - DNA, 15 bp, Homo sapiens
aattctattaaagtg

SEQ ID NO: 2479828 - DNA, 12 bp, Homo sapiens
aattctcctgga

SEQ ID NO: 2479829 - DNA, 15 bp, Homo sapiens
aattctcctggaggt

SEQ ID NO: 2479830 - DNA, 23 bp, Homo sapiens
aattctgagttttgtgtttgttg

SEQ ID NO: 2479831 - DNA, 19 bp, Homo sapiens
aattcttggttgaggaaac

SEQ ID NO: 2479832 - DNA, 17 bp, Homo sapiens
aattctttcaatacaga

SEQ ID NO: 2479833 - DNA, 12 bp, Homo sapiens
aattgaaatgta

SEQ ID NO: 2479834 - DNA, 13 bp, Homo sapiens
aattgaaatgtaa

SEQ ID NO: 2479835 - DNA, 24 bp, Homo sapiens
aattgaaatgtaaggctgtgtaag

SEQ ID NO: 2479836 - DNA, 12 bp, Homo sapiens
aattgaaccttt

SEQ ID NO: 2479837 - DNA, 13 bp, Homo sapiens
aattgaacctttg

SEQ ID NO: 2479838 - DNA, 17 bp, Homo sapiens
aattgaagtaaactttt

SEQ ID NO: 2479839 - DNA, 18 bp, Homo sapiens
aattgagtgtttaaagtt

SEQ ID NO: 2479840 - DNA, 17 bp, Homo sapiens
aattgagttttcagtgg

SEQ ID NO: 2479841 - DNA, 14 bp, Homo sapiens
aattgatttgcatt

SEQ ID NO: 2479842 - DNA, 23 bp, Homo sapiens
aattgatttgcattgaacacaaa

SEQ ID NO: 2479843 - DNA, 20 bp, Homo sapiens
aattgatttttataaatact

SEQ ID NO: 2479844 - DNA, 22 bp, Homo sapiens
aattgatttttctcttcatttt

SEQ ID NO: 2479845 - DNA, 14 bp, Homo sapiens
aattgcaaatcttg

SEQ ID NO: 2479846 - DNA, 18 bp, Homo sapiens
aattgcaaatcttgaaat

SEQ ID NO: 2479847 - DNA, 11 bp, Homo sapiens
aattgcattga

SEQ ID NO: 2479848 - DNA, 23 bp, Homo sapiens
aattgcattgactttccccacca

SEQ ID NO: 2479849 - DNA, 21 bp, Homo sapiens
aattgccaaaaagtgaaataa

SEQ ID NO: 2479850 - DNA, 19 bp, Homo sapiens
aattgctgactgtagcttt

SEQ ID NO: 2479851 - DNA, 16 bp, Homo sapiens
aattgtcccttaaaca

SEQ ID NO: 2479852 - DNA, 15 bp, Homo sapiens
aattgtgtggattct

SEQ ID NO: 2479853 - DNA, 19 bp, Homo sapiens
aatttaaaataattatata

SEQ ID NO: 2479854 - DNA, 10 bp, Homo sapiens
aatttaaaca

SEQ ID NO: 2479855 - DNA, 20 bp, Homo sapiens
aatttaaagcaggttcttgt

SEQ ID NO: 2479856 - DNA, 21 bp, Homo sapiens
aatttacaaaaatataaaata

SEQ ID NO: 2479857 - DNA, 14 bp, Homo sapiens
aatttacctaagat

SEQ ID NO: 2479858 - DNA, 16 bp, Homo sapiens
aatttacctaagatta

SEQ ID NO: 2479859 - DNA, 20 bp, Homo sapiens
aatttagaaatcattttgca

SEQ ID NO: 2479860 - DNA, 16 bp, Homo sapiens
aacccttgctgcttta

SEQ ID NO: 2479861 - DNA, 15 bp, Homo sapiens
aaccgccagctctgt

SEQ ID NO: 2479862 - DNA, 17 bp, Homo sapiens
aaccgccagctctgttc

SEQ ID NO: 2479863 - DNA, 16 bp, Homo sapiens
aaccgctaaaagaaac

SEQ ID NO: 2479864 - DNA, 17 bp, Homo sapiens
aaccgtggcccttcctg

SEQ ID NO: 2479865 - DNA, 18 bp, Homo sapiens
aaccgtggcccttcctgg

SEQ ID NO: 2479866 - DNA, 19 bp, Homo sapiens
aaccgtggcccttcctgga

SEQ ID NO: 2479867 - DNA, 17 bp, Homo sapiens
aaccgttttgaagctac

SEQ ID NO: 2479868 - DNA, 11 bp, Homo sapiens
aacctcagcct

SEQ ID NO: 2479869 - DNA, 20 bp, Homo sapiens
aacctcagcctggccagaca

SEQ ID NO: 2479870 - DNA, 18 bp, Homo sapiens
aacctcagtaatttagaa

SEQ ID NO: 2479871 - DNA, 16 bp, Homo sapiens
aacctcatcttcttca

SEQ ID NO: 2479872 - DNA, 14 bp, Homo sapiens
aacctcgctggact

SEQ ID NO: 2479873 - DNA, 21 bp, Homo sapiens
aacctgagatttattaaagaa

SEQ ID NO: 2479874 - DNA, 22 bp, Homo sapiens
aacctgagatttattaaagaaa

SEQ ID NO: 2479875 - DNA, 19 bp, Homo sapiens
aacctgcctgacatttgga

SEQ ID NO: 2479876 - DNA, 11 bp, Homo sapiens
aacctggcctt

SEQ ID NO: 2479877 - DNA, 12 bp, Homo sapiens
aacctggccttc

SEQ ID NO: 2479878 - DNA, 19 bp, Homo sapiens
aacctgggttgcagacagg

SEQ ID NO: 2479879 - DNA, 13 bp, Homo sapiens
aaccttaagacct

SEQ ID NO: 2479880 - DNA, 13 bp, Homo sapiens
aaccttaagatac

SEQ ID NO: 2479881 - DNA, 23 bp, Homo sapiens
aaccttagatgttctaagtcttt

SEQ ID NO: 2479882 - DNA, 17 bp, Homo sapiens
aaccttgaaaaaaaaca

SEQ ID NO: 2479883 - DNA, 20 bp, Homo sapiens
aaccttgaaaaaaaacagtg

SEQ ID NO: 2479884 - DNA, 13 bp, Homo sapiens
aaccttgcctggt

SEQ ID NO: 2479885 - DNA, 21 bp, Homo sapiens
aaccttgggttagacctacag

SEQ ID NO: 2479886 - DNA, 15 bp, Homo sapiens
aaccttgttttggac

SEQ ID NO: 2479887 - DNA, 23 bp, Homo sapiens
aaccttgttttggacagtttacc

SEQ ID NO: 2479888 - DNA, 12 bp, Homo sapiens
aacctttttaaa

SEQ ID NO: 2479889 - DNA, 16 bp, Homo sapiens
aacgaaaatgaaagct

SEQ ID NO: 2479890 - DNA, 16 bp, Homo sapiens
aacgagactttccatt

SEQ ID NO: 2479891 - DNA, 21 bp, Homo sapiens
aacgagactttccattacaag

SEQ ID NO: 2479892 - DNA, 15 bp, Homo sapiens
aacgatttttaaaat

SEQ ID NO: 2479893 - DNA, 18 bp, Homo sapiens
aacgatttttaaaatgta

SEQ ID NO: 2479894 - DNA, 11 bp, Homo sapiens
aacgcctgagc

SEQ ID NO: 2479895 - DNA, 13 bp, Homo sapiens
aacgcctgagccc

SEQ ID NO: 2479896 - DNA, 20 bp, Homo sapiens
aacgtttaagccaaaacaat

SEQ ID NO: 2479897 - DNA, 13 bp, Homo sapiens
aacgttttctaat

SEQ ID NO: 2479898 - DNA, 21 bp, Homo sapiens
aacgttttctaattgcttatt

SEQ ID NO: 2479899 - DNA, 23 bp, Homo sapiens
aactaaactcttaccatatgttt

SEQ ID NO: 2479900 - DNA, 20 bp, Homo sapiens
aactaaagtgctgcactcaa

SEQ ID NO: 2479901 - DNA, 15 bp, Homo sapiens
aactaacatgtcctg

SEQ ID NO: 2479902 - DNA, 14 bp, Homo sapiens
aactaataattgca

SEQ ID NO: 2479903 - DNA, 15 bp, Homo sapiens
aactaatttagtaat

SEQ ID NO: 2479904 - DNA, 18 bp, Homo sapiens
aactacaaaggtttaaat

SEQ ID NO: 2479905 - DNA, 21 bp, Homo sapiens
aactacaaaggtttaaatgaa

SEQ ID NO: 2479906 - DNA, 17 bp, Homo sapiens
aactactgtgttatgca

SEQ ID NO: 2479907 - DNA, 13 bp, Homo sapiens
aactactttataa

SEQ ID NO: 2479908 - DNA, 16 bp, Homo sapiens
aactactttgctgcta

SEQ ID NO: 2479909 - DNA, 16 bp, Homo sapiens
aactagaatttgatta

SEQ ID NO: 2479910 - DNA, 20 bp, Homo sapiens
aactagaggtgagaaattta

SEQ ID NO: 2479911 - DNA, 21 bp, Homo sapiens
aactagaggtgagaaatttaa

SEQ ID NO: 2479912 - DNA, 13 bp, Homo sapiens
aactagcccctgg

SEQ ID NO: 2479913 - DNA, 24 bp, Homo sapiens
aactatatataatcatcaagtaat

SEQ ID NO: 2479914 - DNA, 16 bp, Homo sapiens
aactatgattattaac

SEQ ID NO: 2479915 - DNA, 18 bp, Homo sapiens
aactattttcaaagactt

SEQ ID NO: 2479916 - DNA, 16 bp, Homo sapiens
aactattttcagatgt

SEQ ID NO: 2479917 - DNA, 20 bp, Homo sapiens
aactattttcagatgtgaac

SEQ ID NO: 2479918 - DNA, 18 bp, Homo sapiens
aactcaaatggggccaga

SEQ ID NO: 2479919 - DNA, 13 bp, Homo sapiens
aactcagatccag

SEQ ID NO: 2479920 - DNA, 15 bp, Homo sapiens
aactcagatccaggg

SEQ ID NO: 2479921 - DNA, 19 bp, Homo sapiens
aactcctagttctagaaaa

SEQ ID NO: 2479922 - DNA, 21 bp, Homo sapiens
aactcctagttctagaaaaac

SEQ ID NO: 2479923 - DNA, 11 bp, Homo sapiens
aactcctccca

SEQ ID NO: 2479924 - DNA, 18 bp, Homo sapiens
aactcctgacctcaggca

SEQ ID NO: 2479925 - DNA, 16 bp, Homo sapiens
aactcgaatctgtgtg

SEQ ID NO: 2479926 - DNA, 19 bp, Homo sapiens
aactcgtatagcatgcatc

SEQ ID NO: 2479927 - DNA, 23 bp, Homo sapiens
aactctatattgttcagcatgca

SEQ ID NO: 2479928 - DNA, 18 bp, Homo sapiens
aactctcttattgcctca

SEQ ID NO: 2479929 - DNA, 16 bp, Homo sapiens
aactctgcattctagt

SEQ ID NO: 2479930 - DNA, 23 bp, Homo sapiens
aactcttcactcttcaaatgcct

SEQ ID NO: 2479931 - DNA, 23 bp, Homo sapiens
aactcttccccctctcccagttg

SEQ ID NO: 2479932 - DNA, 13 bp, Homo sapiens
aactctttgctgc

SEQ ID NO: 2479933 - DNA, 13 bp, Homo sapiens
aactgaaaattat

SEQ ID NO: 2479934 - DNA, 21 bp, Homo sapiens
aactgaacaccattgaaggct

SEQ ID NO: 2479935 - DNA, 22 bp, Homo sapiens
aactgaacaccattgaaggctt

SEQ ID NO: 2479936 - DNA, 20 bp, Homo sapiens
aactgactattcttgatgta

SEQ ID NO: 2479937 - DNA, 16 bp, Homo sapiens
aactgcaggccctggc

SEQ ID NO: 2479938 - DNA, 17 bp, Homo sapiens
aactgcaggccctggcc

SEQ ID NO: 2479939 - DNA, 20 bp, Homo sapiens
aactgcaggccctggcctcc

SEQ ID NO: 2479940 - DNA, 17 bp, Homo sapiens
aactgcatgcccagaga

SEQ ID NO: 2479941 - DNA, 14 bp, Homo sapiens
aactgccaggctct

SEQ ID NO: 2479942 - DNA, 13 bp, Homo sapiens
aactgcctagaaa

SEQ ID NO: 2479943 - DNA, 20 bp, Homo sapiens
aactgcctcgaaacacagaa

SEQ ID NO: 2479944 - DNA, 17 bp, Homo sapiens
aactgctttctgttcca

SEQ ID NO: 2479945 - DNA, 13 bp, Homo sapiens
aactggaaagaag

SEQ ID NO: 2479946 - DNA, 16 bp, Homo sapiens
aactggccaagctgag

SEQ ID NO: 2479947 - DNA, 18 bp, Homo sapiens
aactgggaacccctttcc

SEQ ID NO: 2479948 - DNA, 13 bp, Homo sapiens
aactgtaatacaa

SEQ ID NO: 2479949 - DNA, 13 bp, Homo sapiens
aactgtggatatt

SEQ ID NO: 2479950 - DNA, 14 bp, Homo sapiens
aactgtggatattg

SEQ ID NO: 2479951 - DNA, 13 bp, Homo sapiens
aactgtgtaactg

SEQ ID NO: 2479952 - DNA, 22 bp, Homo sapiens
aactgtgtaactgcccaaagca

SEQ ID NO: 2479953 - DNA, 17 bp, Homo sapiens
aactgtttttgaacctg

SEQ ID NO: 2479954 - DNA, 13 bp, Homo sapiens
aactgttttttaa

SEQ ID NO: 2479955 - DNA, 15 bp, Homo sapiens
aacttaaatgttatt

SEQ ID NO: 2479956 - DNA, 21 bp, Homo sapiens
aacttaaatgttattatctgg

SEQ ID NO: 2479957 - DNA, 14 bp, Homo sapiens
aacttcagaaagac

SEQ ID NO: 2479958 - DNA, 19 bp, Homo sapiens
aacttcagtttcacagaaa

SEQ ID NO: 2479959 - DNA, 24 bp, Homo sapiens
aacttcttatggaattgatttgca

SEQ ID NO: 2479960 - DNA, 19 bp, Homo sapiens
aacttgaccctgagctgac

SEQ ID NO: 2479961 - DNA, 19 bp, Homo sapiens
aacttgatccatttctaat

SEQ ID NO: 2479962 - DNA, 17 bp, Homo sapiens
aacttggatacttggat

SEQ ID NO: 2479963 - DNA, 21 bp, Homo sapiens
aacttggctcgaatctctgtg

SEQ ID NO: 2479964 - DNA, 22 bp, Homo sapiens
aacttggctcgaatctctgtgc

SEQ ID NO: 2479965 - DNA, 20 bp, Homo sapiens
agtctgaggtcctgagcact

SEQ ID NO: 2479966 - DNA, 13 bp, Homo sapiens
agtctgtccttga

SEQ ID NO: 2479967 - DNA, 17 bp, Homo sapiens
agtctgtttactgcaag

SEQ ID NO: 2479968 - DNA, 16 bp, Homo sapiens
agtcttacgaatactt

SEQ ID NO: 2479969 - DNA, 18 bp, Homo sapiens
agtctttggttctaagga

SEQ ID NO: 2479970 - DNA, 14 bp, Homo sapiens
agtcttttgctttt

SEQ ID NO: 2479971 - DNA, 18 bp, Homo sapiens
agtcttttgcttttggca

SEQ ID NO: 2479972 - DNA, 19 bp, Homo sapiens
agtcttttgcttttggcaa

SEQ ID NO: 2479973 - DNA, 22 bp, Homo sapiens
agtgaagaatacttctcatttt

SEQ ID NO: 2479974 - DNA, 12 bp, Homo sapiens
agtgaagacaga

SEQ ID NO: 2479975 - DNA, 20 bp, Homo sapiens
agtgaagacagaaccacagg

SEQ ID NO: 2479976 - DNA, 19 bp, Homo sapiens
agtgaatgctgggactcag

SEQ ID NO: 2479977 - DNA, 16 bp, Homo sapiens
agtgaattccctcact

SEQ ID NO: 2479978 - DNA, 16 bp, Homo sapiens
agtgaccctggctcct

SEQ ID NO: 2479979 - DNA, 16 bp, Homo sapiens
agtgactaatggcatg

SEQ ID NO: 2479980 - DNA, 13 bp, Homo sapiens
agtgagacagact

SEQ ID NO: 2479981 - DNA, 13 bp, Homo sapiens
agtgaggcagccg

SEQ ID NO: 2479982 - DNA, 19 bp, Homo sapiens
agtgagggagggctgtcat

SEQ ID NO: 2479983 - DNA, 17 bp, Homo sapiens
agtgatagtcttttgct

SEQ ID NO: 2479984 - DNA, 14 bp, Homo sapiens
agtgatataaatca

SEQ ID NO: 2479985 - DNA, 15 bp, Homo sapiens
agtgatattggaact

SEQ ID NO: 2479986 - DNA, 13 bp, Homo sapiens
agtgcaacactgg

SEQ ID NO: 2479987 - DNA, 14 bp, Homo sapiens
agtgcatctggaga

SEQ ID NO: 2479988 - DNA, 16 bp, Homo sapiens
agtgccacttaatgta

SEQ ID NO: 2479989 - DNA, 16 bp, Homo sapiens
agtgcccccactgacc

SEQ ID NO: 2479990 - DNA, 19 bp, Homo sapiens
agtgccctctcccaccctc

SEQ ID NO: 2479991 - DNA, 23 bp, Homo sapiens
agtgccctctcccaccctcttcc

SEQ ID NO: 2479992 - DNA, 13 bp, Homo sapiens
agtgccctgagcc

SEQ ID NO: 2479993 - DNA, 20 bp, Homo sapiens
agtgccctgagccagggtct

SEQ ID NO: 2479994 - DNA, 21 bp, Homo sapiens
agtgccttcaacacagcttgt

SEQ ID NO: 2479995 - DNA, 15 bp, Homo sapiens
agtgcgtccacgagc

SEQ ID NO: 2479996 - DNA, 17 bp, Homo sapiens
agtgctaaggttctaag

SEQ ID NO: 2479997 - DNA, 18 bp, Homo sapiens
agtgctaaggttctaagg

SEQ ID NO: 2479998 - DNA, 11 bp, Homo sapiens
agtgctctgat

SEQ ID NO: 2479999 - DNA, 14 bp, Homo sapiens
agtgctcttttctc

SEQ ID NO: 2480000 - DNA, 15 bp, Homo sapiens
agtgctgagattaca

SEQ ID NO: 2480001 - DNA, 21 bp, Homo sapiens
aggtttatgaaaaagaagaat

SEQ ID NO: 2480002 - DNA, 17 bp, Homo sapiens
aggttttaatttagtaa

SEQ ID NO: 2480003 - DNA, 14 bp, Homo sapiens
aggttttaggttct

SEQ ID NO: 2480004 - DNA, 19 bp, Homo sapiens
aggttttaggttctaaagt

SEQ ID NO: 2480005 - DNA, 12 bp, Homo sapiens
aggtttttcctt

SEQ ID NO: 2480006 - DNA, 16 bp, Homo sapiens
agtaaagaattatttt

SEQ ID NO: 2480007 - DNA, 16 bp, Homo sapiens
agtaaagtcaaggaga

SEQ ID NO: 2480008 - DNA, 16 bp, Homo sapiens
agtaacactaatatat

SEQ ID NO: 2480009 - DNA, 17 bp, Homo sapiens
agtaacactaatatatt

SEQ ID NO: 2480010 - DNA, 17 bp, Homo sapiens
agtaacatttgctgttt

SEQ ID NO: 2480011 - DNA, 23 bp, Homo sapiens
agtaactgttttttaagtctctc

SEQ ID NO: 2480012 - DNA, 14 bp, Homo sapiens
agtaagaggtgtta

SEQ ID NO: 2480013 - DNA, 14 bp, Homo sapiens
agtaatagcctggg

SEQ ID NO: 2480014 - DNA, 22 bp, Homo sapiens
agtaatggtgtagaacactaat

SEQ ID NO: 2480015 - DNA, 23 bp, Homo sapiens
agtaatggtgtagaacactaatt

SEQ ID NO: 2480016 - DNA, 18 bp, Homo sapiens
agtaattgacatgtgcca

SEQ ID NO: 2480017 - DNA, 23 bp, Homo sapiens
agtaatttagaaatcattttgca

SEQ ID NO: 2480018 - DNA, 15 bp, Homo sapiens
agtacactctgctgt

SEQ ID NO: 2480019 - DNA, 12 bp, Homo sapiens
agtacagagaag

SEQ ID NO: 2480020 - DNA, 15 bp, Homo sapiens
agtaccaatcatttt

SEQ ID NO: 2480021 - DNA, 14 bp, Homo sapiens
agtaccagactaga

SEQ ID NO: 2480022 - DNA, 23 bp, Homo sapiens
agtacccactctggagcatttct

SEQ ID NO: 2480023 - DNA, 18 bp, Homo sapiens
agtaccctctcagctcca

SEQ ID NO: 2480024 - DNA, 13 bp, Homo sapiens
agtacctgagggt

SEQ ID NO: 2480025 - DNA, 21 bp, Homo sapiens
agtacctgagggtctgtaggt

SEQ ID NO: 2480026 - DNA, 14 bp, Homo sapiens
agtactccacactg

SEQ ID NO: 2480027 - DNA, 20 bp, Homo sapiens
agtactccacactgcacaat

SEQ ID NO: 2480028 - DNA, 16 bp, Homo sapiens
agtactgggattacag

SEQ ID NO: 2480029 - DNA, 23 bp, Homo sapiens
agtacttagctagttttattctt

SEQ ID NO: 2480030 - DNA, 23 bp, Homo sapiens
agtacttgggagacctgtaatca

SEQ ID NO: 2480031 - DNA, 19 bp, Homo sapiens
agtagaagtctcttccagt

SEQ ID NO: 2480032 - DNA, 14 bp, Homo sapiens
agtagaatctcagt

SEQ ID NO: 2480033 - DNA, 17 bp, Homo sapiens
agccagcgtcctcctct

SEQ ID NO: 2480034 - DNA, 18 bp, Homo sapiens
agccagcgtcctcctctg

SEQ ID NO: 2480035 - DNA, 23 bp, Homo sapiens
agccagcgtcctcctctgtgacc

SEQ ID NO: 2480036 - DNA, 20 bp, Homo sapiens
agccagcgtcggtctgtgcc

SEQ ID NO: 2480037 - DNA, 23 bp, Homo sapiens
agccagctaaggggtggggctgc

SEQ ID NO: 2480038 - DNA, 19 bp, Homo sapiens
agccagcttgtttacatgc

SEQ ID NO: 2480039 - DNA, 19 bp, Homo sapiens
agccaggaatttcccagga

SEQ ID NO: 2480040 - DNA, 22 bp, Homo sapiens
agccaggaatttcccaggaccc

SEQ ID NO: 2480041 - DNA, 13 bp, Homo sapiens
agccaggcccagc

SEQ ID NO: 2480042 - DNA, 17 bp, Homo sapiens
agccagggagagcccag

SEQ ID NO: 2480043 - DNA, 18 bp, Homo sapiens
agccagggagagcccagg

SEQ ID NO: 2480044 - DNA, 19 bp, Homo sapiens
agccagggagagcccagga

SEQ ID NO: 2480045 - DNA, 20 bp, Homo sapiens
agccagggagagcccaggag

SEQ ID NO: 2480046 - DNA, 18 bp, Homo sapiens
agccaggggagcagaggg

SEQ ID NO: 2480047 - DNA, 15 bp, Homo sapiens
agccaggtccctctc

SEQ ID NO: 2480048 - DNA, 15 bp, Homo sapiens
agccagtgccctgag

SEQ ID NO: 2480049 - DNA, 17 bp, Homo sapiens
agccagtgccctgagcc

SEQ ID NO: 2480050 - DNA, 18 bp, Homo sapiens
agccagtgccctgagcca

SEQ ID NO: 2480051 - DNA, 23 bp, Homo sapiens
agccagtgccctgagccagggtc

SEQ ID NO: 2480052 - DNA, 23 bp, Homo sapiens
agccagtttgggtaaaatacttt

SEQ ID NO: 2480053 - DNA, 10 bp, Homo sapiens
agccatagtg

SEQ ID NO: 2480054 - DNA, 16 bp, Homo sapiens
agccatatttgtaaaa

SEQ ID NO: 2480055 - DNA, 14 bp, Homo sapiens
agccatcaaaatgc

SEQ ID NO: 2480056 - DNA, 19 bp, Homo sapiens
agccatcacctcagatggc

SEQ ID NO: 2480057 - DNA, 21 bp, Homo sapiens
agccatgagatgatacatcca

SEQ ID NO: 2480058 - DNA, 15 bp, Homo sapiens
agccatgtcttctcc

SEQ ID NO: 2480059 - DNA, 16 bp, Homo sapiens
agccatgtcttctccc

SEQ ID NO: 2480060 - DNA, 17 bp, Homo sapiens
agccatgtcttctccct

SEQ ID NO: 2480061 - DNA, 14 bp, Homo sapiens
agcccactgtcctg

SEQ ID NO: 2480062 - DNA, 17 bp, Homo sapiens
agcccactgtcctgggc

SEQ ID NO: 2480063 - DNA, 18 bp, Homo sapiens
agcccactgtcctgggcc

SEQ ID NO: 2480064 - DNA, 23 bp, Homo sapiens
agcccactgtcctgggcctgcag

SEQ ID NO: 2480065 - DNA, 10 bp, Homo sapiens
agcccagaga

SEQ ID NO: 2480066 - DNA, 22 bp, Homo sapiens
agcccagagacatacttgaagg

SEQ ID NO: 2480067 - DNA, 12 bp, Homo sapiens
agcccagccagc

SEQ ID NO: 2480068 - DNA, 12 bp, Homo sapiens
agcccagctcca

SEQ ID NO: 2480069 - DNA, 13 bp, Homo sapiens
agcccagctgggt

SEQ ID NO: 2480070 - DNA, 15 bp, Homo sapiens
agcccagctgggtca

SEQ ID NO: 2480071 - DNA, 21 bp, Homo sapiens
agcccagctgggtcaggcagg

SEQ ID NO: 2480072 - DNA, 14 bp, Homo sapiens
agcccaggagctcc

SEQ ID NO: 2480073 - DNA, 13 bp, Homo sapiens
agcccaggccagg

SEQ ID NO: 2480074 - DNA, 19 bp, Homo sapiens
agcccaggccaggactctg

SEQ ID NO: 2480075 - DNA, 22 bp, Homo sapiens
agcccaggccaggactctgcag

SEQ ID NO: 2480076 - DNA, 23 bp, Homo sapiens
agcccaggccaggactctgcagc

SEQ ID NO: 2480077 - DNA, 14 bp, Homo sapiens
agcccagggctcct

SEQ ID NO: 2480078 - DNA, 15 bp, Homo sapiens
agcccagggctcctg

SEQ ID NO: 2480079 - DNA, 15 bp, Homo sapiens
agcccagtagacctt

SEQ ID NO: 2480080 - DNA, 17 bp, Homo sapiens
agcccatcctgaccagc

SEQ ID NO: 2480081 - DNA, 21 bp, Homo sapiens
agcccatggagattgacctgg

SEQ ID NO: 2480082 - DNA, 22 bp, Homo sapiens
agcccatggagattgacctgga

SEQ ID NO: 2480083 - DNA, 19 bp, Homo sapiens
agcccattgtggcctaaga

SEQ ID NO: 2480084 - DNA, 16 bp, Homo sapiens
agccccacccaggcca

SEQ ID NO: 2480085 - DNA, 23 bp, Homo sapiens
agccccaccccagggcagccagg

SEQ ID NO: 2480086 - DNA, 16 bp, Homo sapiens
agccccaccctggcct

SEQ ID NO: 2480087 - DNA, 13 bp, Homo sapiens
agccccactcctc

SEQ ID NO: 2480088 - DNA, 21 bp, Homo sapiens
agccccagcccagccccactc

SEQ ID NO: 2480089 - DNA, 13 bp, Homo sapiens
agccccattcctg

SEQ ID NO: 2480090 - DNA, 13 bp, Homo sapiens
agcccccaccctg

SEQ ID NO: 2480091 - DNA, 19 bp, Homo sapiens
agcccccaccctgttcctg

SEQ ID NO: 2480092 - DNA, 15 bp, Homo sapiens
agcccccagcctgtc

SEQ ID NO: 2480093 - DNA, 12 bp, Homo sapiens
agcccccagcta

SEQ ID NO: 2480094 - DNA, 19 bp, Homo sapiens
agcccccagctaagaacct

SEQ ID NO: 2480095 - DNA, 17 bp, Homo sapiens
agcccccagctcccacc

SEQ ID NO: 2480096 - DNA, 23 bp, Homo sapiens
agccccctcacagtattgctcac

SEQ ID NO: 2480097 - DNA, 21 bp, Homo sapiens
agccccctgaccactcagaga

SEQ ID NO: 2480098 - DNA, 22 bp, Homo sapiens
agcccctctggtcgctcctgcc

SEQ ID NO: 2480099 - DNA, 15 bp, Homo sapiens
agcccctcttggaga

SEQ ID NO: 2480100 - DNA, 20 bp, Homo sapiens
agcccctcttggagaagtct

SEQ ID NO: 2480101 - DNA, 21 bp, Homo sapiens
agcccctggggtggccaccag

SEQ ID NO: 2480102 - DNA, 16 bp, Homo sapiens
agccccttctgctcag

SEQ ID NO: 2480103 - DNA, 14 bp, Homo sapiens
agcccgaggaggtg

SEQ ID NO: 2480104 - DNA, 14 bp, Homo sapiens
agcccgtctcagtg

SEQ ID NO: 2480105 - DNA, 15 bp, Homo sapiens
agcccgtctcagtgt

SEQ ID NO: 2480106 - DNA, 15 bp, Homo sapiens
agccctaaacatcat

SEQ ID NO: 2480107 - DNA, 23 bp, Homo sapiens
agccctcacacaccctgtctgcc

SEQ ID NO: 2480108 - DNA, 17 bp, Homo sapiens
agccctcctctgcactc

SEQ ID NO: 2480109 - DNA, 20 bp, Homo sapiens
agccctgcaccatgctgctg

SEQ ID NO: 2480110 - DNA, 22 bp, Homo sapiens
agccctgcaccatgctgctggg

SEQ ID NO: 2480111 - DNA, 13 bp, Homo sapiens
agccctgcctgga

SEQ ID NO: 2480112 - DNA, 15 bp, Homo sapiens
agccctgcctggagg

SEQ ID NO: 2480113 - DNA, 20 bp, Homo sapiens
agccctgcctggaggacctg

SEQ ID NO: 2480114 - DNA, 21 bp, Homo sapiens
agccctgcctggaggacctga

SEQ ID NO: 2480115 - DNA, 23 bp, Homo sapiens
agctagtcttttgcttttgccca

SEQ ID NO: 2480116 - DNA, 17 bp, Homo sapiens
agctagtgacccacatg

SEQ ID NO: 2480117 - DNA, 22 bp, Homo sapiens
agctataaagcagtatttttct

SEQ ID NO: 2480118 - DNA, 15 bp, Homo sapiens
agctatttgatgtaa

SEQ ID NO: 2480119 - DNA, 20 bp, Homo sapiens
agctatttgatgtaatactt

SEQ ID NO: 2480120 - DNA, 14 bp, Homo sapiens
agctatttttctaa

SEQ ID NO: 2480121 - DNA, 23 bp, Homo sapiens
agctcaaaggtttggaaggagca

SEQ ID NO: 2480122 - DNA, 14 bp, Homo sapiens
agctcaactctctt

SEQ ID NO: 2480123 - DNA, 19 bp, Homo sapiens
agctcactccccaaccccc

SEQ ID NO: 2480124 - DNA, 21 bp, Homo sapiens
agctcatccatgcctcagaag

SEQ ID NO: 2480125 - DNA, 13 bp, Homo sapiens
agctccaacctgc

SEQ ID NO: 2480126 - DNA, 15 bp, Homo sapiens
agctccaagccccat

SEQ ID NO: 2480127 - DNA, 15 bp, Homo sapiens
agctccaccctggcc

SEQ ID NO: 2480128 - DNA, 22 bp, Homo sapiens
agctccactctgcttctctgac

SEQ ID NO: 2480129 - DNA, 15 bp, Homo sapiens
agctccagcctgaca

SEQ ID NO: 2480130 - DNA, 16 bp, Homo sapiens
agctccagcctgacat

SEQ ID NO: 2480131 - DNA, 18 bp, Homo sapiens
agctcccacaagcctctg

SEQ ID NO: 2480132 - DNA, 20 bp, Homo sapiens
agctcccacaagcctctgcc

SEQ ID NO: 2480133 - DNA, 17 bp, Homo sapiens
agctcccacaagcctga

SEQ ID NO: 2480134 - DNA, 23 bp, Homo sapiens
agctcccccagcaaagcccccag

SEQ ID NO: 2480135 - DNA, 16 bp, Homo sapiens
agctcccttcttccct

SEQ ID NO: 2480136 - DNA, 12 bp, Homo sapiens
agctcctcccac

SEQ ID NO: 2480137 - DNA, 14 bp, Homo sapiens
agctcctcccctgg

SEQ ID NO: 2480138 - DNA, 16 bp, Homo sapiens
agctcctctccccagc

SEQ ID NO: 2480139 - DNA, 19 bp, Homo sapiens
agctcctctccccagccca

SEQ ID NO: 2480140 - DNA, 20 bp, Homo sapiens
agctcctctccccagcccag

SEQ ID NO: 2480141 - DNA, 23 bp, Homo sapiens
agctcctctccccagcccagaga

SEQ ID NO: 2480142 - DNA, 24 bp, Homo sapiens
agctcctctccccagcccagagac

SEQ ID NO: 2480143 - DNA, 15 bp, Homo sapiens
agctcctcttccatg

SEQ ID NO: 2480144 - DNA, 18 bp, Homo sapiens
agctcctgacactgctgg

SEQ ID NO: 2480145 - DNA, 15 bp, Homo sapiens
agctcctgaccagtt

SEQ ID NO: 2480146 - DNA, 16 bp, Homo sapiens
agctcctgaccagttg

SEQ ID NO: 2480147 - DNA, 17 bp, Homo sapiens
agctcctgtcccctgct

SEQ ID NO: 2480148 - DNA, 18 bp, Homo sapiens
agctcctgtcccctgcta

SEQ ID NO: 2480149 - DNA, 13 bp, Homo sapiens
agctcctgtggcc

SEQ ID NO: 2480150 - DNA, 13 bp, Homo sapiens
agctccttcctgg

SEQ ID NO: 2480151 - DNA, 19 bp, Homo sapiens
agctccttcctggagactg

SEQ ID NO: 2480152 - DNA, 22 bp, Homo sapiens
agctcctttgggcttcagctgc

SEQ ID NO: 2480153 - DNA, 22 bp, Homo sapiens
agctcgatgtggtcacagctgt

SEQ ID NO: 2480154 - DNA, 17 bp, Homo sapiens
agctctactgcctcaac

SEQ ID NO: 2480155 - DNA, 15 bp, Homo sapiens
agctctagaatctgc

SEQ ID NO: 2480156 - DNA, 13 bp, Homo sapiens
agctctctgccct

SEQ ID NO: 2480157 - DNA, 15 bp, Homo sapiens
agctctgagaggccc

SEQ ID NO: 2480158 - DNA, 18 bp, Homo sapiens
agctctgagaggccctgg

SEQ ID NO: 2480159 - DNA, 13 bp, Homo sapiens
agctctgagctgt

SEQ ID NO: 2480160 - DNA, 23 bp, Homo sapiens
agctctgctattaggccagcaag

SEQ ID NO: 2480161 - DNA, 17 bp, Homo sapiens
agctctggaggggaggg

SEQ ID NO: 2480162 - DNA, 19 bp, Homo sapiens
agctctggaggggaggggg

SEQ ID NO: 2480163 - DNA, 20 bp, Homo sapiens
agctctggggtgggcagttt

SEQ ID NO: 2480164 - DNA, 22 bp, Homo sapiens
agctctgtatcaggacccagag

SEQ ID NO: 2480165 - DNA, 18 bp, Homo sapiens
agctctgttcttcctcag

SEQ ID NO: 2480166 - DNA, 21 bp, Homo sapiens
agctcttccttactcccaggc

SEQ ID NO: 2480167 - DNA, 23 bp, Homo sapiens
agctgaaggttgtggcctttgcg

SEQ ID NO: 2480168 - DNA, 15 bp, Homo sapiens
agctgaatgtttttc

SEQ ID NO: 2480169 - DNA, 18 bp, Homo sapiens
agctgaatgtttttctaa

SEQ ID NO: 2480170 - DNA, 22 bp, Homo sapiens
agctgaccagccgtgagcatgt

SEQ ID NO: 2480171 - DNA, 23 bp, Homo sapiens
agctgactaaactttttttctgt

SEQ ID NO: 2480172 - DNA, 17 bp, Homo sapiens
agctgacttggctggtg

SEQ ID NO: 2480173 - DNA, 19 bp, Homo sapiens
agctgacttggctggtgtg

SEQ ID NO: 2480174 - DNA, 14 bp, Homo sapiens
agctgagcgccagg

SEQ ID NO: 2480175 - DNA, 15 bp, Homo sapiens
agctgagcgccagga

SEQ ID NO: 2480176 - DNA, 21 bp, Homo sapiens
agctgagctcacaaggcagca

SEQ ID NO: 2480177 - DNA, 15 bp, Homo sapiens
agctgaggtgcccag

SEQ ID NO: 2480178 - DNA, 18 bp, Homo sapiens
agctgaggtgcccaggag

SEQ ID NO: 2480179 - DNA, 22 bp, Homo sapiens
agctgagtattaaaatgtatgc

SEQ ID NO: 2480180 - DNA, 14 bp, Homo sapiens
agctgagtttccta

SEQ ID NO: 2480181 - DNA, 11 bp, Homo sapiens
agctgcactga

SEQ ID NO: 2480182 - DNA, 20 bp, Homo sapiens
agctgcactgatgctgcccc

SEQ ID NO: 2480183 - DNA, 15 bp, Homo sapiens
agctgccagtgtcct

SEQ ID NO: 2480184 - DNA, 19 bp, Homo sapiens
agctgccccggcccctccc

SEQ ID NO: 2480185 - DNA, 16 bp, Homo sapiens
agctgccggtcgccct

SEQ ID NO: 2480186 - DNA, 23 bp, Homo sapiens
agctgcctcccctctccttcctg

SEQ ID NO: 2480187 - DNA, 18 bp, Homo sapiens
agctgctccgaggaccca

SEQ ID NO: 2480188 - DNA, 14 bp, Homo sapiens
agctgcttccagtg

SEQ ID NO: 2480189 - DNA, 13 bp, Homo sapiens
agctggaggcagg

SEQ ID NO: 2480190 - DNA, 22 bp, Homo sapiens
agctggaggcaggggcttcctg

SEQ ID NO: 2480191 - DNA, 23 bp, Homo sapiens
agctggcggctggggtcccagca

SEQ ID NO: 2480192 - DNA, 22 bp, Homo sapiens
agctggggatccctccccccca

SEQ ID NO: 2480193 - DNA, 15 bp, Homo sapiens
agctggggtgcaggg

SEQ ID NO: 2480194 - DNA, 23 bp, Homo sapiens
agctggggtgcagggatgtgggt

SEQ ID NO: 2480195 - DNA, 16 bp, Homo sapiens
agctgggtcaggcagg

SEQ ID NO: 2480196 - DNA, 19 bp, Homo sapiens
agacaacgtgctctttgtt

SEQ ID NO: 2480197 - DNA, 17 bp, Homo sapiens
agacaagcctggcctac

SEQ ID NO: 2480198 - DNA, 13 bp, Homo sapiens
agacacaggccct

SEQ ID NO: 2480199 - DNA, 13 bp, Homo sapiens
agacacatgaagg

SEQ ID NO: 2480200 - DNA, 12 bp, Homo sapiens
agacaccaaagt

SEQ ID NO: 2480201 - DNA, 14 bp, Homo sapiens
agacaccaaagttc

SEQ ID NO: 2480202 - DNA, 12 bp, Homo sapiens
agacacccagga

SEQ ID NO: 2480203 - DNA, 15 bp, Homo sapiens
agacacccaggactt

SEQ ID NO: 2480204 - DNA, 16 bp, Homo sapiens
agacacccaggactta

SEQ ID NO: 2480205 - DNA, 20 bp, Homo sapiens
agacactccccgaagtcttt

SEQ ID NO: 2480206 - DNA, 13 bp, Homo sapiens
agacactggcccc

SEQ ID NO: 2480207 - DNA, 14 bp, Homo sapiens
agacagaacaccta

SEQ ID NO: 2480208 - DNA, 18 bp, Homo sapiens
agacagaacacctatgca

SEQ ID NO: 2480209 - DNA, 15 bp, Homo sapiens
agacagagaggactg

SEQ ID NO: 2480210 - DNA, 14 bp, Homo sapiens
agacagagccagga

SEQ ID NO: 2480211 - DNA, 16 bp, Homo sapiens
agacagagccaggaga

SEQ ID NO: 2480212 - DNA, 19 bp, Homo sapiens
agacagagccaggagaagc

SEQ ID NO: 2480213 - DNA, 19 bp, Homo sapiens
agacagagccctgtgaggc

SEQ ID NO: 2480214 - DNA, 15 bp, Homo sapiens
agacagaggccctca

SEQ ID NO: 2480215 - DNA, 15 bp, Homo sapiens
agacaggctcttagc

SEQ ID NO: 2480216 - DNA, 16 bp, Homo sapiens
agacataaaggaaaag

SEQ ID NO: 2480217 - DNA, 18 bp, Homo sapiens
agacataaccactgcttc

SEQ ID NO: 2480218 - DNA, 17 bp, Homo sapiens
agacatacttgaagggc

SEQ ID NO: 2480219 - DNA, 14 bp, Homo sapiens
agacatcagccctt

SEQ ID NO: 2480220 - DNA, 15 bp, Homo sapiens
agacatgatttcctt

SEQ ID NO: 2480221 - DNA, 14 bp, Homo sapiens
agacatgcagagat

SEQ ID NO: 2480222 - DNA, 15 bp, Homo sapiens
agacatgcagagatt

SEQ ID NO: 2480223 - DNA, 15 bp, Homo sapiens
agacatggaggttct

SEQ ID NO: 2480224 - DNA, 16 bp, Homo sapiens
agacatggaggttcta

SEQ ID NO: 2480225 - DNA, 23 bp, Homo sapiens
agaccaccagggcatctctgggc

SEQ ID NO: 2480226 - DNA, 14 bp, Homo sapiens
agaccaccccgcct

SEQ ID NO: 2480227 - DNA, 21 bp, Homo sapiens
agaccacgcccgtcctgcctg

SEQ ID NO: 2480228 - DNA, 15 bp, Homo sapiens
agaccagcagacaga

SEQ ID NO: 2480229 - DNA, 21 bp, Homo sapiens
agaccagcagacagagccagg

SEQ ID NO: 2480230 - DNA, 12 bp, Homo sapiens
agaccagggctc

SEQ ID NO: 2480231 - DNA, 13 bp, Homo sapiens
agaccataatgtt

SEQ ID NO: 2480232 - DNA, 14 bp, Homo sapiens
agaccctggaggcc

SEQ ID NO: 2480233 - DNA, 15 bp, Homo sapiens
agaccggcctgccag

SEQ ID NO: 2480234 - DNA, 20 bp, Homo sapiens
agaccggcctgccaggagga

SEQ ID NO: 2480235 - DNA, 22 bp, Homo sapiens
agacctacagggggtctggctg

SEQ ID NO: 2480236 - DNA, 23 bp, Homo sapiens
agacctacagggggtctggctgg

SEQ ID NO: 2480237 - DNA, 16 bp, Homo sapiens
agacctactgttctaa

SEQ ID NO: 2480238 - DNA, 14 bp, Homo sapiens
agacctgatcctgg

SEQ ID NO: 2480239 - DNA, 15 bp, Homo sapiens
agacctgatcctgga

SEQ ID NO: 2480240 - DNA, 16 bp, Homo sapiens
agacctgatcctggag

SEQ ID NO: 2480241 - DNA, 21 bp, Homo sapiens
agacctgatcctggaggccca

SEQ ID NO: 2480242 - DNA, 18 bp, Homo sapiens
agacctgttagcagacag

SEQ ID NO: 2480243 - DNA, 21 bp, Homo sapiens
agaccttgttacttctgaggt

SEQ ID NO: 2480244 - DNA, 14 bp, Homo sapiens
agacgcctggctgc

SEQ ID NO: 2480245 - DNA, 15 bp, Homo sapiens
agacgcctggctgct

SEQ ID NO: 2480246 - DNA, 20 bp, Homo sapiens
agacggaagggtaaacaata

SEQ ID NO: 2480247 - DNA, 22 bp, Homo sapiens
agacggagccctggcatgtcaa

SEQ ID NO: 2480248 - DNA, 22 bp, Homo sapiens
agacgttttataagcatcatta

SEQ ID NO: 2480249 - DNA, 16 bp, Homo sapiens
agactagatgtagtat

SEQ ID NO: 2480250 - DNA, 23 bp, Homo sapiens
agactagatgtagtattttttgt

SEQ ID NO: 2480251 - DNA, 16 bp, Homo sapiens
agactcaaatgttcta

SEQ ID NO: 2480252 - DNA, 23 bp, Homo sapiens
agactcaggccaagaaacgtctt

SEQ ID NO: 2480253 - DNA, 14 bp, Homo sapiens
agactccagacctg

SEQ ID NO: 2480254 - DNA, 18 bp, Homo sapiens
agactccagacctgaggc

SEQ ID NO: 2480255 - DNA, 17 bp, Homo sapiens
agactcctagctgtcct

SEQ ID NO: 2480256 - DNA, 22 bp, Homo sapiens
agactcctagctgtcctttttc

SEQ ID NO: 2480257 - DNA, 17 bp, Homo sapiens
agactccttcaacaatt

SEQ ID NO: 2480258 - DNA, 17 bp, Homo sapiens
agactctaagaaagaac

SEQ ID NO: 2480259 - DNA, 19 bp, Homo sapiens
agactctacccatattaca

SEQ ID NO: 2480260 - DNA, 13 bp, Homo sapiens
agactctggtgtt

SEQ ID NO: 2480261 - DNA, 21 bp, Homo sapiens
agactgaatagatatgaaagc

SEQ ID NO: 2480262 - DNA, 20 bp, Homo sapiens
agactgccatattaaatttt

SEQ ID NO: 2480263 - DNA, 21 bp, Homo sapiens
agactgccatattaaattttt

SEQ ID NO: 2480264 - DNA, 19 bp, Homo sapiens
agactgctgtggccaggag

SEQ ID NO: 2480265 - DNA, 20 bp, Homo sapiens
agactgctgtggccaggagg

SEQ ID NO: 2480266 - DNA, 19 bp, Homo sapiens
agactggaagctaatttgc

SEQ ID NO: 2480267 - DNA, 11 bp, Homo sapiens
agactggcttt

SEQ ID NO: 2480268 - DNA, 21 bp, Homo sapiens
agactgggaaggcttgggatt

SEQ ID NO: 2480269 - DNA, 22 bp, Homo sapiens
agactgtgtgtgccctctgggc

SEQ ID NO: 2480270 - DNA, 17 bp, Homo sapiens
agacttagggcaccagg

SEQ ID NO: 2480271 - DNA, 18 bp, Homo sapiens
agacttctctttgcctca

SEQ ID NO: 2480272 - DNA, 21 bp, Homo sapiens
agacttggttggtagggtggg

SEQ ID NO: 2480273 - DNA, 20 bp, Homo sapiens
agagaaaaagcagaggccaa

SEQ ID NO: 2480274 - DNA, 20 bp, Homo sapiens
agagaaaatgcggttataaa

SEQ ID NO: 2480275 - DNA, 12 bp, Homo sapiens
agagaaaccagc

SEQ ID NO: 2480276 - DNA, 13 bp, Homo sapiens
agagaaaccagct

SEQ ID NO: 2480277 - DNA, 15 bp, Homo sapiens
agagaaaccagcttc

SEQ ID NO: 2480278 - DNA, 21 bp, Homo sapiens
agagaaaccagcttccttcag

SEQ ID NO: 2480279 - DNA, 18 bp, Homo sapiens
agagaacccagcccaccc

SEQ ID NO: 2480280 - DNA, 19 bp, Homo sapiens
agagaagtcacagggcagt

SEQ ID NO: 2480281 - DNA, 23 bp, Homo sapiens
agagaagtcacagggcagtacct

SEQ ID NO: 2480282 - DNA, 12 bp, Homo sapiens
agagaatcaaca

SEQ ID NO: 2480283 - DNA, 15 bp, Homo sapiens
agagaatcaacattt

SEQ ID NO: 2480284 - DNA, 15 bp, Homo sapiens
agagacactggtggg

SEQ ID NO: 2480285 - DNA, 16 bp, Homo sapiens
agagacactggtgggg

SEQ ID NO: 2480286 - DNA, 22 bp, Homo sapiens
agagacatacttgaagggccag

SEQ ID NO: 2480287 - DNA, 15 bp, Homo sapiens
agagacatgcagaga

SEQ ID NO: 2480288 - DNA, 22 bp, Homo sapiens
agagactgaatagatatgaaag

SEQ ID NO: 2480289 - DNA, 15 bp, Homo sapiens
agagagcagtgcttt

SEQ ID NO: 2480290 - DNA, 16 bp, Homo sapiens
agagagcagtgctttt

SEQ ID NO: 2480291 - DNA, 18 bp, Homo sapiens
agagagcccgaggaggtg

SEQ ID NO: 2480292 - DNA, 15 bp, Homo sapiens
agagatcaaagatga

SEQ ID NO: 2480293 - DNA, 21 bp, Homo sapiens
agagatcccaagtagaatctc

SEQ ID NO: 2480294 - DNA, 24 bp, Homo sapiens
agagatgtgtgttgatactgttgc

SEQ ID NO: 2480295 - DNA, 15 bp, Homo sapiens
agagcactgccacca

SEQ ID NO: 2480296 - DNA, 16 bp, Homo sapiens
agagcagcacctcctc

SEQ ID NO: 2480297 - DNA, 21 bp, Homo sapiens
agagcaggactccaggcccaa

SEQ ID NO: 2480298 - DNA, 22 bp, Homo sapiens
agagcaggactccaggcccaag

SEQ ID NO: 2480299 - DNA, 17 bp, Homo sapiens
agagcaggactgatgtc

SEQ ID NO: 2480300 - DNA, 18 bp, Homo sapiens
actaacactcagaagcct

SEQ ID NO: 2480301 - DNA, 19 bp, Homo sapiens
actaacactcagaagcctg

SEQ ID NO: 2480302 - DNA, 17 bp, Homo sapiens
actaacatataatgttg

SEQ ID NO: 2480303 - DNA, 21 bp, Homo sapiens
actaaccaagctgagtttcct

SEQ ID NO: 2480304 - DNA, 22 bp, Homo sapiens
actaaccaagctgagtttccta

SEQ ID NO: 2480305 - DNA, 23 bp, Homo sapiens
actaactatgcatggtgccccag

SEQ ID NO: 2480306 - DNA, 17 bp, Homo sapiens
actaagagaagttgtaa

SEQ ID NO: 2480307 - DNA, 14 bp, Homo sapiens
actaatagaaaagt

SEQ ID NO: 2480308 - DNA, 16 bp, Homo sapiens
actaatagaaaagtat

SEQ ID NO: 2480309 - DNA, 17 bp, Homo sapiens
actaatagaataaaggc

SEQ ID NO: 2480310 - DNA, 20 bp, Homo sapiens
actaatagaataaaggcagt

SEQ ID NO: 2480311 - DNA, 19 bp, Homo sapiens
actaatatatttaaaaata

SEQ ID NO: 2480312 - DNA, 20 bp, Homo sapiens
actaatatatttaaaaataa

SEQ ID NO: 2480313 - DNA, 18 bp, Homo sapiens
actaatgaaaacagaatg

SEQ ID NO: 2480314 - DNA, 13 bp, Homo sapiens
actaatggcatga

SEQ ID NO: 2480315 - DNA, 16 bp, Homo sapiens
actaatggcatgagaa

SEQ ID NO: 2480316 - DNA, 15 bp, Homo sapiens
actaattccacacct

SEQ ID NO: 2480317 - DNA, 19 bp, Homo sapiens
actacaaatcaagtatttg

SEQ ID NO: 2480318 - DNA, 16 bp, Homo sapiens
actacaaccaatggaa

SEQ ID NO: 2480319 - DNA, 13 bp, Homo sapiens
actacacacagta

SEQ ID NO: 2480320 - DNA, 22 bp, Homo sapiens
actacacactgtgtactgcagt

SEQ ID NO: 2480321 - DNA, 18 bp, Homo sapiens
actacagctggggtgcag

SEQ ID NO: 2480322 - DNA, 23 bp, Homo sapiens
actacagctggggtgcagggatg

SEQ ID NO: 2480323 - DNA, 17 bp, Homo sapiens
actacagcttcagtgat

SEQ ID NO: 2480324 - DNA, 17 bp, Homo sapiens
actacaggcgtgagcca

SEQ ID NO: 2480325 - DNA, 13 bp, Homo sapiens
actacattcattt

SEQ ID NO: 2480326 - DNA, 19 bp, Homo sapiens
actacccaggttaagaaaa

SEQ ID NO: 2480327 - DNA, 18 bp, Homo sapiens
actaccgaatgtgtcttt

SEQ ID NO: 2480328 - DNA, 22 bp, Homo sapiens
actacctgtaatgacaggcctg

SEQ ID NO: 2480329 - DNA, 21 bp, Homo sapiens
actagacaagccagaacttga

SEQ ID NO: 2480330 - DNA, 20 bp, Homo sapiens
actagacaccaaagttctaa

SEQ ID NO: 2480331 - DNA, 14 bp, Homo sapiens
actagaggtgagaa

SEQ ID NO: 2480332 - DNA, 21 bp, Homo sapiens
actagaggtgagaaatttaaa

SEQ ID NO: 2480333 - DNA, 18 bp, Homo sapiens
actagatggacctgcctg

SEQ ID NO: 2480334 - DNA, 16 bp, Homo sapiens
actagatgtagtattt

SEQ ID NO: 2480335 - DNA, 16 bp, Homo sapiens
actagccaaacctcac

SEQ ID NO: 2480336 - DNA, 19 bp, Homo sapiens
actagccaaacctcaccaa

SEQ ID NO: 2480337 - DNA, 22 bp, Homo sapiens
actaggagctttgactcaggag

SEQ ID NO: 2480338 - DNA, 20 bp, Homo sapiens
actaggcccccacttgcctc

SEQ ID NO: 2480339 - DNA, 19 bp, Homo sapiens
actagggagccatttgaga

SEQ ID NO: 2480340 - DNA, 18 bp, Homo sapiens
actagggatccctcatct

SEQ ID NO: 2480341 - DNA, 19 bp, Homo sapiens
actagggatccctcatctg

SEQ ID NO: 2480342 - DNA, 19 bp, Homo sapiens
actataagaactttgagct

SEQ ID NO: 2480343 - DNA, 20 bp, Homo sapiens
actataagcaagaaggcaaa

SEQ ID NO: 2480344 - DNA, 13 bp, Homo sapiens
actatatgtatgg

SEQ ID NO: 2480345 - DNA, 22 bp, Homo sapiens
actatatttgggcctgctccag

SEQ ID NO: 2480346 - DNA, 20 bp, Homo sapiens
actatgcatggtgccccagg

SEQ ID NO: 2480347 - DNA, 14 bp, Homo sapiens
actattgttacatt

SEQ ID NO: 2480348 - DNA, 16 bp, Homo sapiens
actcaaatgagtaaca

SEQ ID NO: 2480349 - DNA, 17 bp, Homo sapiens
actcaaatggggccaga

SEQ ID NO: 2480350 - DNA, 23 bp, Homo sapiens
actcaagaagtgaagaatgcaca

SEQ ID NO: 2480351 - DNA, 18 bp, Homo sapiens
actcaaggcggtgcttga

SEQ ID NO: 2480352 - DNA, 22 bp, Homo sapiens
actcacacaggcatttcctggg

SEQ ID NO: 2480353 - DNA, 21 bp, Homo sapiens
actcacacctgaactgaacac

SEQ ID NO: 2480354 - DNA, 20 bp, Homo sapiens
actcactaattcattaatct

SEQ ID NO: 2480355 - DNA, 21 bp, Homo sapiens
actcactaggcccccacttgc

SEQ ID NO: 2480356 - DNA, 19 bp, Homo sapiens
actcactccttttaaagaa

SEQ ID NO: 2480357 - DNA, 13 bp, Homo sapiens
actcagaaattca

SEQ ID NO: 2480358 - DNA, 12 bp, Homo sapiens
actcagacctga

SEQ ID NO: 2480359 - DNA, 11 bp, Homo sapiens
actcagatcca

SEQ ID NO: 2480360 - DNA, 17 bp, Homo sapiens
actcagatccagggaca

SEQ ID NO: 2480361 - DNA, 17 bp, Homo sapiens
actcagcacttggccct

SEQ ID NO: 2480362 - DNA, 18 bp, Homo sapiens
actcagccaccctgagtt

SEQ ID NO: 2480363 - DNA, 11 bp, Homo sapiens
actcagccttc

SEQ ID NO: 2480364 - DNA, 15 bp, Homo sapiens
actcaggtggcccta

SEQ ID NO: 2480365 - DNA, 19 bp, Homo sapiens
actcatataattatatgtt

SEQ ID NO: 2480366 - DNA, 16 bp, Homo sapiens
actcattcattagtca

SEQ ID NO: 2480367 - DNA, 14 bp, Homo sapiens
actccaactcttcc

SEQ ID NO: 2480368 - DNA, 13 bp, Homo sapiens
actccacactgca

SEQ ID NO: 2480369 - DNA, 21 bp, Homo sapiens
actccacactgcacaataact

SEQ ID NO: 2480370 - DNA, 13 bp, Homo sapiens
actccaggcccaa

SEQ ID NO: 2480371 - DNA, 19 bp, Homo sapiens
actccatctggtagaaggg

SEQ ID NO: 2480372 - DNA, 15 bp, Homo sapiens
actccccaaccccca

SEQ ID NO: 2480373 - DNA, 16 bp, Homo sapiens
actccccaacccccaa

SEQ ID NO: 2480374 - DNA, 17 bp, Homo sapiens
actccccgaagtctttt

SEQ ID NO: 2480375 - DNA, 15 bp, Homo sapiens
actccctcacaagtg

SEQ ID NO: 2480376 - DNA, 22 bp, Homo sapiens
actccgagaggtgggccagtct

SEQ ID NO: 2480377 - DNA, 17 bp, Homo sapiens
actccgttggccactcc

SEQ ID NO: 2480378 - DNA, 20 bp, Homo sapiens
actcctagttctagaaaaac

SEQ ID NO: 2480379 - DNA, 19 bp, Homo sapiens
actcctcattgtaaacaaa

SEQ ID NO: 2480380 - DNA, 13 bp, Homo sapiens
actcctcccaggg

SEQ ID NO: 2480381 - DNA, 16 bp, Homo sapiens
actcctcctttttcca

SEQ ID NO: 2480382 - DNA, 14 bp, Homo sapiens
actcctgaaaaaaa

SEQ ID NO: 2480383 - DNA, 16 bp, Homo sapiens
actcctgaaaaaaaac

SEQ ID NO: 2480384 - DNA, 17 bp, Homo sapiens
actcctgacctcaggca

SEQ ID NO: 2480385 - DNA, 15 bp, Homo sapiens
actcctgtgggagcc

SEQ ID NO: 2480386 - DNA, 17 bp, Homo sapiens
actcctgtgggagcctc

SEQ ID NO: 2480387 - DNA, 20 bp, Homo sapiens
actccttcaacaattctaaa

SEQ ID NO: 2480388 - DNA, 22 bp, Homo sapiens
actccttcaacaattctaaaat

SEQ ID NO: 2480389 - DNA, 14 bp, Homo sapiens
actccttttaaaga

SEQ ID NO: 2480390 - DNA, 23 bp, Homo sapiens
actccttttaaagaaaaaaattg

SEQ ID NO: 2480391 - DNA, 23 bp, Homo sapiens
actcgctagcagtggcaggcaga

SEQ ID NO: 2480392 - DNA, 14 bp, Homo sapiens
actcggtttctcca

SEQ ID NO: 2480393 - DNA, 14 bp, Homo sapiens
actcgttttttaca

SEQ ID NO: 2480394 - DNA, 21 bp, Homo sapiens
actctaaaattataaatgaca

SEQ ID NO: 2480395 - DNA, 13 bp, Homo sapiens
actctaaagcaaa

SEQ ID NO: 2480396 - DNA, 14 bp, Homo sapiens
actctaaagcaaat

SEQ ID NO: 2480397 - DNA, 19 bp, Homo sapiens
acttgtcaggagtgtgtgt

SEQ ID NO: 2480398 - DNA, 21 bp, Homo sapiens
acttgtcaggagtgtgtgtga

SEQ ID NO: 2480399 - DNA, 24 bp, Homo sapiens
acttgtcattgttatataatcatt

SEQ ID NO: 2480400 - DNA, 17 bp, Homo sapiens
acttgtcctagcacaga

SEQ ID NO: 2480401 - DNA, 20 bp, Homo sapiens
acttgtccttagcctggacc

SEQ ID NO: 2480402 - DNA, 16 bp, Homo sapiens
actttaacataagcta

SEQ ID NO: 2480403 - DNA, 18 bp, Homo sapiens
actttaacataagctatt

SEQ ID NO: 2480404 - DNA, 18 bp, Homo sapiens
acatcaacccgagtcatt

SEQ ID NO: 2480405 - DNA, 14 bp, Homo sapiens
acatcaatctttaa

SEQ ID NO: 2480406 - DNA, 16 bp, Homo sapiens
acatcaggtttttccc

SEQ ID NO: 2480407 - DNA, 15 bp, Homo sapiens
acatcattactataa

SEQ ID NO: 2480408 - DNA, 15 bp, Homo sapiens
acatcattcttgaga

SEQ ID NO: 2480409 - DNA, 12 bp, Homo sapiens
acatcatttctt

SEQ ID NO: 2480410 - DNA, 13 bp, Homo sapiens
acatcatttcttt

SEQ ID NO: 2480411 - DNA, 15 bp, Homo sapiens
acatccaaagcagac

SEQ ID NO: 2480412 - DNA, 19 bp, Homo sapiens
acatccaaagcagacagct

SEQ ID NO: 2480413 - DNA, 15 bp, Homo sapiens
acatcggaaaaataa

SEQ ID NO: 2480414 - DNA, 16 bp, Homo sapiens
acatctaacctcatct

SEQ ID NO: 2480415 - DNA, 18 bp, Homo sapiens
acatctattttggattgt

SEQ ID NO: 2480416 - DNA, 19 bp, Homo sapiens
acatctattttggattgta

SEQ ID NO: 2480417 - DNA, 22 bp, Homo sapiens
acatctcaacaggcctcagggc

SEQ ID NO: 2480418 - DNA, 19 bp, Homo sapiens
acatctgtaaatctacaca

SEQ ID NO: 2480419 - DNA, 17 bp, Homo sapiens
acatctttgaaattatg

SEQ ID NO: 2480420 - DNA, 19 bp, Homo sapiens
acatgaacttagattttac

SEQ ID NO: 2480421 - DNA, 13 bp, Homo sapiens
acatgaagaagct

SEQ ID NO: 2480422 - DNA, 13 bp, Homo sapiens
acatgaaggtaaa

SEQ ID NO: 2480423 - DNA, 15 bp, Homo sapiens
acatgaattttagct

SEQ ID NO: 2480424 - DNA, 18 bp, Homo sapiens
acatgaattttagctttt

SEQ ID NO: 2480425 - DNA, 15 bp, Homo sapiens
acatgagaacaaaca

SEQ ID NO: 2480426 - DNA, 20 bp, Homo sapiens
acatgaggactctattcttt

SEQ ID NO: 2480427 - DNA, 16 bp, Homo sapiens
acatgatttccttgaa

SEQ ID NO: 2480428 - DNA, 23 bp, Homo sapiens
acatgatttccttgaatgtggct

SEQ ID NO: 2480429 - DNA, 18 bp, Homo sapiens
acatgccatttgtactga

SEQ ID NO: 2480430 - DNA, 17 bp, Homo sapiens
acatgcggtagccagca

SEQ ID NO: 2480431 - DNA, 22 bp, Homo sapiens
acatgcggtagccagcacacag

SEQ ID NO: 2480432 - DNA, 17 bp, Homo sapiens
acatgctaagagaagta

SEQ ID NO: 2480433 - DNA, 24 bp, Homo sapiens
acatgctaagagaagtagaaatca

SEQ ID NO: 2480434 - DNA, 19 bp, Homo sapiens
acatgcttagcagtcccct

SEQ ID NO: 2480435 - DNA, 15 bp, Homo sapiens
acatggaggttctaa

SEQ ID NO: 2480436 - DNA, 13 bp, Homo sapiens
acatggcacagag

SEQ ID NO: 2480437 - DNA, 16 bp, Homo sapiens
acatggtgctgggaga

SEQ ID NO: 2480438 - DNA, 18 bp, Homo sapiens
acatggtgggtccatggg

SEQ ID NO: 2480439 - DNA, 19 bp, Homo sapiens
acatgtattgcacattgta

SEQ ID NO: 2480440 - DNA, 16 bp, Homo sapiens
acatgtgacatttata

SEQ ID NO: 2480441 - DNA, 21 bp, Homo sapiens
acatgtgacatttatatattg

SEQ ID NO: 2480442 - DNA, 18 bp, Homo sapiens
acatgtgctgccctacag

SEQ ID NO: 2480443 - DNA, 16 bp, Homo sapiens
acatgtggggccaggt

SEQ ID NO: 2480444 - DNA, 14 bp, Homo sapiens
acatgttatttgta

SEQ ID NO: 2480445 - DNA, 20 bp, Homo sapiens
acatgttgggaaacttggct

SEQ ID NO: 2480446 - DNA, 21 bp, Homo sapiens
acatgtttccagcattcccag

SEQ ID NO: 2480447 - DNA, 22 bp, Homo sapiens
acatgtttccagcattcccagg

SEQ ID NO: 2480448 - DNA, 11 bp, Homo sapiens
acatgtttcct

SEQ ID NO: 2480449 - DNA, 22 bp, Homo sapiens
acattaaagaagggttgagctg

SEQ ID NO: 2480450 - DNA, 21 bp, Homo sapiens
acattagaagacaattgacaa

SEQ ID NO: 2480451 - DNA, 19 bp, Homo sapiens
acattaggaaaagttgcta

SEQ ID NO: 2480452 - DNA, 14 bp, Homo sapiens
acattcacctgccc

SEQ ID NO: 2480453 - DNA, 19 bp, Homo sapiens
acattcaggaattcttgga

SEQ ID NO: 2480454 - DNA, 22 bp, Homo sapiens
acattcatagtctttggagaaa

SEQ ID NO: 2480455 - DNA, 15 bp, Homo sapiens
acattccaactcgta

SEQ ID NO: 2480456 - DNA, 16 bp, Homo sapiens
acattccaagactcta

SEQ ID NO: 2480457 - DNA, 21 bp, Homo sapiens
acattcctcatgaatgtaaat

SEQ ID NO: 2480458 - DNA, 15 bp, Homo sapiens
acattctgaatgctt

SEQ ID NO: 2480459 - DNA, 21 bp, Homo sapiens
acattctgaatgcttctaagt

SEQ ID NO: 2480460 - DNA, 17 bp, Homo sapiens
acattgcatcaaagcat

SEQ ID NO: 2480461 - DNA, 21 bp, Homo sapiens
acattggcacctaatccaggc

SEQ ID NO: 2480462 - DNA, 22 bp, Homo sapiens
acattggttctttcatttgctt

SEQ ID NO: 2480463 - DNA, 14 bp, Homo sapiens
acattgttgagcta

SEQ ID NO: 2480464 - DNA, 18 bp, Homo sapiens
acatttaaaacattaaaa

SEQ ID NO: 2480465 - DNA, 17 bp, Homo sapiens
acatttacaaactgaag

SEQ ID NO: 2480466 - DNA, 15 bp, Homo sapiens
acatttatttcctcc

SEQ ID NO: 2480467 - DNA, 16 bp, Homo sapiens
acatttattttgacat

SEQ ID NO: 2480468 - DNA, 13 bp, Homo sapiens
acatttctcaggc

SEQ ID NO: 2480469 - DNA, 15 bp, Homo sapiens
acatttggaatactt

SEQ ID NO: 2480470 - DNA, 16 bp, Homo sapiens
acatttggaatacttt

SEQ ID NO: 2480471 - DNA, 17 bp, Homo sapiens
acatttgggagacatgt

SEQ ID NO: 2480472 - DNA, 20 bp, Homo sapiens
acatttgggagacatgtgac

SEQ ID NO: 2480473 - DNA, 16 bp, Homo sapiens
acattttaaacacatt

SEQ ID NO: 2480474 - DNA, 21 bp, Homo sapiens
acattttgaaagtctgtcctt

SEQ ID NO: 2480475 - DNA, 16 bp, Homo sapiens
acattttttaggaaat

SEQ ID NO: 2480476 - DNA, 14 bp, Homo sapiens
accaaaagaagtaa

SEQ ID NO: 2480477 - DNA, 17 bp, Homo sapiens
accaaagggagtctgcc

SEQ ID NO: 2480478 - DNA, 19 bp, Homo sapiens
accaaagggagtctgccag

SEQ ID NO: 2480479 - DNA, 20 bp, Homo sapiens
accaaagggagtctgccagg

SEQ ID NO: 2480480 - DNA, 12 bp, Homo sapiens
accaaagttcta

SEQ ID NO: 2480481 - DNA, 15 bp, Homo sapiens
accaaagttctaata

SEQ ID NO: 2480482 - DNA, 23 bp, Homo sapiens
accaaagttctaataatttctaa

SEQ ID NO: 2480483 - DNA, 20 bp, Homo sapiens
accaaatcaaaatctctcca

SEQ ID NO: 2480484 - DNA, 20 bp, Homo sapiens
accaacaatcttcctgttta

SEQ ID NO: 2480485 - DNA, 15 bp, Homo sapiens
accaaccctcagggc

SEQ ID NO: 2480486 - DNA, 16 bp, Homo sapiens
accaaccctcagggca

SEQ ID NO: 2480487 - DNA, 17 bp, Homo sapiens
accaactcctagttcta

SEQ ID NO: 2480488 - DNA, 23 bp, Homo sapiens
accaactcctagttctagaaaaa

SEQ ID NO: 2480489 - DNA, 22 bp, Homo sapiens
accaacttttctattaaaagtg

SEQ ID NO: 2480490 - DNA, 15 bp, Homo sapiens
accaagatacttaag

SEQ ID NO: 2480491 - DNA, 14 bp, Homo sapiens
accaagcacagcag

SEQ ID NO: 2480492 - DNA, 14 bp, Homo sapiens
accaagctgagttt

SEQ ID NO: 2480493 - DNA, 13 bp, Homo sapiens
accaatcatttta

SEQ ID NO: 2480494 - DNA, 17 bp, Homo sapiens
accaatcctatgcatgg

SEQ ID NO: 2480495 - DNA, 13 bp, Homo sapiens
accaatgtcttga

SEQ ID NO: 2480496 - DNA, 22 bp, Homo sapiens
accaattgctgctacttatata

SEQ ID NO: 2480497 - DNA, 20 bp, Homo sapiens
accacaactattttcagatg

SEQ ID NO: 2480498 - DNA, 20 bp, Homo sapiens
accacagccagcacctggca

SEQ ID NO: 2480499 - DNA, 15 bp, Homo sapiens
accacaggctcaggc

SEQ ID NO: 2480500 - DNA, 16 bp, Homo sapiens
accacaggctcaggca

SEQ ID NO: 2480501 - DNA, 22 bp, Homo sapiens
accacaggttcatgccaccatg

SEQ ID NO: 2480502 - DNA, 22 bp, Homo sapiens
accacatgccccatcccatgct

SEQ ID NO: 2480503 - DNA, 16 bp, Homo sapiens
accaccaagccaaggg

SEQ ID NO: 2480504 - DNA, 13 bp, Homo sapiens
acatatggaattt

SEQ ID NO: 2480505 - DNA, 21 bp, Homo sapiens
acatatgtgctggaattctaa

SEQ ID NO: 2480506 - DNA, 12 bp, Homo sapiens
acatcaaagagg

SEQ ID NO: 2480507 - DNA, 20 bp, Homo sapiens
aatttagacttggattcttt

SEQ ID NO: 2480508 - DNA, 16 bp, Homo sapiens
aatttagtgtatccat

SEQ ID NO: 2480509 - DNA, 23 bp, Homo sapiens
aatttatttgaatgatttttctt

SEQ ID NO: 2480510 - DNA, 13 bp, Homo sapiens
aatttattttctt

SEQ ID NO: 2480511 - DNA, 13 bp, Homo sapiens
aggggctccctcc

SEQ ID NO: 2480512 - DNA, 14 bp, Homo sapiens
aggggctccctccg

SEQ ID NO: 2480513 - DNA, 21 bp, Homo sapiens
aggggctgcccgagtctgttt

SEQ ID NO: 2480514 - DNA, 14 bp, Homo sapiens
aggggctgggaaca

SEQ ID NO: 2480515 - DNA, 12 bp, Homo sapiens
aggggcttcagg

SEQ ID NO: 2480516 - DNA, 20 bp, Homo sapiens
agggggatccgactgctttg

SEQ ID NO: 2480517 - DNA, 12 bp, Homo sapiens
agggggcggcct

SEQ ID NO: 2480518 - DNA, 20 bp, Homo sapiens
agggggctgctgctgggctc

SEQ ID NO: 2480519 - DNA, 13 bp, Homo sapiens
aggggggagggaa

SEQ ID NO: 2480520 - DNA, 16 bp, Homo sapiens
agggggggctccctgg

SEQ ID NO: 2480521 - DNA, 15 bp, Homo sapiens
agggggtctggctgg

SEQ ID NO: 2480522 - DNA, 15 bp, Homo sapiens
aggggtaggggctgg

SEQ ID NO: 2480523 - DNA, 19 bp, Homo sapiens
aggggtaggggctgggaac

SEQ ID NO: 2480524 - DNA, 21 bp, Homo sapiens
aggggtcaagttattaatttc

SEQ ID NO: 2480525 - DNA, 22 bp, Homo sapiens
aggggtgtcttgggcagagctg

SEQ ID NO: 2480526 - DNA, 24 bp, Homo sapiens
aggggtgtcttgggcagagctggc

SEQ ID NO: 2480527 - DNA, 15 bp, Homo sapiens
aggggttagagcagg

SEQ ID NO: 2480528 - DNA, 13 bp, Homo sapiens
agggtaaacaata

SEQ ID NO: 2480529 - DNA, 11 bp, Homo sapiens
agggtaaatca

SEQ ID NO: 2480530 - DNA, 12 bp, Homo sapiens
agggtaagtatt

SEQ ID NO: 2480531 - DNA, 14 bp, Homo sapiens
agggtacatggtgc

SEQ ID NO: 2480532 - DNA, 23 bp, Homo sapiens
agggtagaattctggctggtaga

SEQ ID NO: 2480533 - DNA, 13 bp, Homo sapiens
agggtaggcagga

SEQ ID NO: 2480534 - DNA, 22 bp, Homo sapiens
agggtcaggcctttgagctcag

SEQ ID NO: 2480535 - DNA, 14 bp, Homo sapiens
agggtccctctgtg

SEQ ID NO: 2480536 - DNA, 22 bp, Homo sapiens
agggtccttttgacactgctct

SEQ ID NO: 2480537 - DNA, 15 bp, Homo sapiens
agggtcgaaagctct

SEQ ID NO: 2480538 - DNA, 16 bp, Homo sapiens
agggtcgaaagctcta

SEQ ID NO: 2480539 - DNA, 22 bp, Homo sapiens
agggtcgaaagctctagaatct

SEQ ID NO: 2480540 - DNA, 19 bp, Homo sapiens
caaactagggccaagccca

SEQ ID NO: 2480541 - DNA, 14 bp, Homo sapiens
caaactctttggtc

SEQ ID NO: 2480542 - DNA, 22 bp, Homo sapiens
caaactgggaacccctttccca

SEQ ID NO: 2480543 - DNA, 12 bp, Homo sapiens
caaactgtaaat

SEQ ID NO: 2480544 - DNA, 14 bp, Homo sapiens
caaactgtaaataa

SEQ ID NO: 2480545 - DNA, 18 bp, Homo sapiens
caaactgtgtaactgccc

SEQ ID NO: 2480546 - DNA, 20 bp, Homo sapiens
caaactgtgtaactgcccaa

SEQ ID NO: 2480547 - DNA, 12 bp, Homo sapiens
caaactttgcat

SEQ ID NO: 2480548 - DNA, 16 bp, Homo sapiens
caaagaaacaaagatg

SEQ ID NO: 2480549 - DNA, 13 bp, Homo sapiens
caaagaggctgcc

SEQ ID NO: 2480550 - DNA, 20 bp, Homo sapiens
caaagatctgtcctcagcct

SEQ ID NO: 2480551 - DNA, 21 bp, Homo sapiens
caaagatctgtcctcagcctt

SEQ ID NO: 2480552 - DNA, 12 bp, Homo sapiens
caaagatgaaaa

SEQ ID NO: 2480553 - DNA, 16 bp, Homo sapiens
caaagatgctgtgagt

SEQ ID NO: 2480554 - DNA, 13 bp, Homo sapiens
caaagatttaatc

SEQ ID NO: 2480555 - DNA, 14 bp, Homo sapiens
caaagcaagaccct

SEQ ID NO: 2480556 - DNA, 13 bp, Homo sapiens
caaagcagacagc

SEQ ID NO: 2480557 - DNA, 16 bp, Homo sapiens
caaagcagacagctcc

SEQ ID NO: 2480558 - DNA, 19 bp, Homo sapiens
caaagcagacagctccacc

SEQ ID NO: 2480559 - DNA, 21 bp, Homo sapiens
caaagccagcgtcctcctctg

SEQ ID NO: 2480560 - DNA, 22 bp, Homo sapiens
caaagccagcgtcctcctctgt

SEQ ID NO: 2480561 - DNA, 17 bp, Homo sapiens
caaagccaggtccctct

SEQ ID NO: 2480562 - DNA, 19 bp, Homo sapiens
caaagcccccagagcccag

SEQ ID NO: 2480563 - DNA, 22 bp, Homo sapiens
caaagcccccagagcccaggct

SEQ ID NO: 2480564 - DNA, 22 bp, Homo sapiens
caaagcctgttcatggcagatg

SEQ ID NO: 2480565 - DNA, 21 bp, Homo sapiens
caaagctgcctgtccctaccc

SEQ ID NO: 2480566 - DNA, 13 bp, Homo sapiens
caaagctttcctg

SEQ ID NO: 2480567 - DNA, 23 bp, Homo sapiens
caaagctttcctgccccaggcct

SEQ ID NO: 2480568 - DNA, 15 bp, Homo sapiens
caaaggcaagcactt

SEQ ID NO: 2480569 - DNA, 17 bp, Homo sapiens
caaagggagtctgccag

SEQ ID NO: 2480570 - DNA, 17 bp, Homo sapiens
caaaggggacctggaag

SEQ ID NO: 2480571 - DNA, 19 bp, Homo sapiens
caaaggttctaggtttcaa

SEQ ID NO: 2480572 - DNA, 13 bp, Homo sapiens
caaaggtttaaat

SEQ ID NO: 2480573 - DNA, 17 bp, Homo sapiens
caaaggtttggaaggag

SEQ ID NO: 2480574 - DNA, 14 bp, Homo sapiens
caaagtcctttttt

SEQ ID NO: 2480575 - DNA, 19 bp, Homo sapiens
caaagtcctttttttccat

SEQ ID NO: 2480576 - DNA, 12 bp, Homo sapiens
caaagtctctaa

SEQ ID NO: 2480577 - DNA, 15 bp, Homo sapiens
caaagtctctaattc

SEQ ID NO: 2480578 - DNA, 16 bp, Homo sapiens
caaagtgctgagatta

SEQ ID NO: 2480579 - DNA, 19 bp, Homo sapiens
caaagtgctgggattacag

SEQ ID NO: 2480580 - DNA, 11 bp, Homo sapiens
caaagtggaac

SEQ ID NO: 2480581 - DNA, 13 bp, Homo sapiens
caaagtttaataa

SEQ ID NO: 2480582 - DNA, 19 bp, Homo sapiens
caaagtttaccagaaagca

SEQ ID NO: 2480583 - DNA, 12 bp, Homo sapiens
caaataagactt

SEQ ID NO: 2480584 - DNA, 13 bp, Homo sapiens
caaataagacttc

SEQ ID NO: 2480585 - DNA, 16 bp, Homo sapiens
caaatagaaaatggtc

SEQ ID NO: 2480586 - DNA, 15 bp, Homo sapiens
caaatatgtcctggg

SEQ ID NO: 2480587 - DNA, 18 bp, Homo sapiens
caaatcaaaatctctcca

SEQ ID NO: 2480588 - DNA, 19 bp, Homo sapiens
caaatcaccacaaactgta

SEQ ID NO: 2480589 - DNA, 14 bp, Homo sapiens
caaatcagaagtca

SEQ ID NO: 2480590 - DNA, 22 bp, Homo sapiens
caaatcagaagtcatcttgcta

SEQ ID NO: 2480591 - DNA, 13 bp, Homo sapiens
caaatcaggcttt

SEQ ID NO: 2480592 - DNA, 13 bp, Homo sapiens
caaatcatttgtt

SEQ ID NO: 2480593 - DNA, 18 bp, Homo sapiens
caaatctaccactgtatg

SEQ ID NO: 2480594 - DNA, 12 bp, Homo sapiens
caaatcttgaaa

SEQ ID NO: 2480595 - DNA, 19 bp, Homo sapiens
caaatgcaaaaactctttg

SEQ ID NO: 2480596 - DNA, 17 bp, Homo sapiens
caagcacatctgcattt

SEQ ID NO: 2480597 - DNA, 19 bp, Homo sapiens
caagcacctccaaccaaat

SEQ ID NO: 2480598 - DNA, 21 bp, Homo sapiens
caagcagcctgagcaactctt

SEQ ID NO: 2480599 - DNA, 20 bp, Homo sapiens
caagcagcttagagttggcc

SEQ ID NO: 2480600 - DNA, 16 bp, Homo sapiens
caagcagtcgtgcctg

SEQ ID NO: 2480601 - DNA, 19 bp, Homo sapiens
caagcagtcgtgcctgtgt

SEQ ID NO: 2480602 - DNA, 21 bp, Homo sapiens
caagcatggctattttatatt

SEQ ID NO: 2480603 - DNA, 23 bp, Homo sapiens
caagcatggtcccacatccctgg

SEQ ID NO: 2480604 - DNA, 18 bp, Homo sapiens
caagccaagggaacctgt

SEQ ID NO: 2480605 - DNA, 13 bp, Homo sapiens
caagcctgaggga

SEQ ID NO: 2480606 - DNA, 22 bp, Homo sapiens
caagcctgagggaaaggccagc

SEQ ID NO: 2480607 - DNA, 21 bp, Homo sapiens
caagcgattctcttgcctcaa

SEQ ID NO: 2480608 - DNA, 22 bp, Homo sapiens
caagctaagcactgccactggg

SEQ ID NO: 2480609 - DNA, 19 bp, Homo sapiens
caagctccaagccccatct

SEQ ID NO: 2480610 - DNA, 23 bp, Homo sapiens
caagctgagtttcctatgggaac

SEQ ID NO: 2480611 - DNA, 15 bp, Homo sapiens
caagctgattaaatg

SEQ ID NO: 2480612 - DNA, 21 bp, Homo sapiens
caagcttctgtcctgccccca

SEQ ID NO: 2480613 - DNA, 13 bp, Homo sapiens
caaggaaaggcac

SEQ ID NO: 2480614 - DNA, 21 bp, Homo sapiens
caaggaatttcttaacttctt

SEQ ID NO: 2480615 - DNA, 19 bp, Homo sapiens
caaggacttcctgtccagc

SEQ ID NO: 2480616 - DNA, 21 bp, Homo sapiens
caaggacttcctgtccagctc

SEQ ID NO: 2480617 - DNA, 16 bp, Homo sapiens
caaggactttgcagcc

SEQ ID NO: 2480618 - DNA, 16 bp, Homo sapiens
caaggagtcagacatt

SEQ ID NO: 2480619 - DNA, 20 bp, Homo sapiens
caaggatagatgctggccca

SEQ ID NO: 2480620 - DNA, 22 bp, Homo sapiens
caaggatagatgctggcccagg

SEQ ID NO: 2480621 - DNA, 14 bp, Homo sapiens
caaggcactctaga

SEQ ID NO: 2480622 - DNA, 18 bp, Homo sapiens
caaggcacttgaggggga

SEQ ID NO: 2480623 - DNA, 20 bp, Homo sapiens
caaggcacttgagggggaag

SEQ ID NO: 2480624 - DNA, 19 bp, Homo sapiens
caaggcagaggcctgggct

SEQ ID NO: 2480625 - DNA, 16 bp, Homo sapiens
caaggcagcaaggccc

SEQ ID NO: 2480626 - DNA, 17 bp, Homo sapiens
caaggcagcaaggcccg

SEQ ID NO: 2480627 - DNA, 13 bp, Homo sapiens
caaggcagccgtg

SEQ ID NO: 2480628 - DNA, 17 bp, Homo sapiens
caaggccatctgggctc

SEQ ID NO: 2480629 - DNA, 13 bp, Homo sapiens
caaggcggtgctt

SEQ ID NO: 2480630 - DNA, 16 bp, Homo sapiens
caaggcggtgcttgat

SEQ ID NO: 2480631 - DNA, 20 bp, Homo sapiens
caaggctgtggaccatggag

SEQ ID NO: 2480632 - DNA, 16 bp, Homo sapiens
caagggaggctgctgc

SEQ ID NO: 2480633 - DNA, 18 bp, Homo sapiens
caaggggaatcagaactc

SEQ ID NO: 2480634 - DNA, 21 bp, Homo sapiens
caaggggatttttatgtctgg

SEQ ID NO: 2480635 - DNA, 16 bp, Homo sapiens
caaggggcctgagcag

SEQ ID NO: 2480636 - DNA, 21 bp, Homo sapiens
caaggggcctgagcagtcctt

SEQ ID NO: 2480637 - DNA, 20 bp, Homo sapiens
caaggtgtcctacagaaaaa

SEQ ID NO: 2480638 - DNA, 13 bp, Homo sapiens
caaggttctaacc

SEQ ID NO: 2480639 - DNA, 20 bp, Homo sapiens
caaggtttaaagagtctaga

SEQ ID NO: 2480640 - DNA, 22 bp, Homo sapiens
caaggtttaaagagtctagatt

SEQ ID NO: 2480641 - DNA, 19 bp, Homo sapiens
caagtacaaccacacccac

SEQ ID NO: 2480642 - DNA, 23 bp, Homo sapiens
caaccgtggcccttcctggacag

SEQ ID NO: 2480643 - DNA, 24 bp, Homo sapiens
caacctgaatacccttttctgacc

SEQ ID NO: 2480644 - DNA, 18 bp, Homo sapiens
caacctgtagagtggcca

SEQ ID NO: 2480645 - DNA, 18 bp, Homo sapiens
caaccttagatgttctaa

SEQ ID NO: 2480646 - DNA, 18 bp, Homo sapiens
caacgtgctctttgtttt

SEQ ID NO: 2480647 - DNA, 23 bp, Homo sapiens
caacgtggctttttttttttccc

SEQ ID NO: 2480648 - DNA, 15 bp, Homo sapiens
caactacagtctaaa

SEQ ID NO: 2480649 - DNA, 19 bp, Homo sapiens
caactacagtctaaagctg

SEQ ID NO: 2480650 - DNA, 19 bp, Homo sapiens
caactacccccagctgtgc

SEQ ID NO: 2480651 - DNA, 22 bp, Homo sapiens
caactcactccttttaaagaaa

SEQ ID NO: 2480652 - DNA, 17 bp, Homo sapiens
caactccttccagctag

SEQ ID NO: 2480653 - DNA, 19 bp, Homo sapiens
caactcgtatagcatgcat

SEQ ID NO: 2480654 - DNA, 22 bp, Homo sapiens
caactctcttattgcctcactt

SEQ ID NO: 2480655 - DNA, 16 bp, Homo sapiens
caactcttgattatcc

SEQ ID NO: 2480656 - DNA, 18 bp, Homo sapiens
caactctttgttatttga

SEQ ID NO: 2480657 - DNA, 21 bp, Homo sapiens
caactgcctcgaaacacagaa

SEQ ID NO: 2480658 - DNA, 11 bp, Homo sapiens
caactgctccc

SEQ ID NO: 2480659 - DNA, 14 bp, Homo sapiens
caactgctcccacc

SEQ ID NO: 2480660 - DNA, 17 bp, Homo sapiens
caactgctcccacctcc

SEQ ID NO: 2480661 - DNA, 18 bp, Homo sapiens
caactgctcccacctcct

SEQ ID NO: 2480662 - DNA, 21 bp, Homo sapiens
caactgtctcctacctctgct

SEQ ID NO: 2480663 - DNA, 20 bp, Homo sapiens
caacttgagcatgttactga

SEQ ID NO: 2480664 - DNA, 14 bp, Homo sapiens
caacttgcttatca

SEQ ID NO: 2480665 - DNA, 13 bp, Homo sapiens
caacttgtcctag

SEQ ID NO: 2480666 - DNA, 12 bp, Homo sapiens
caactttactgt

SEQ ID NO: 2480667 - DNA, 23 bp, Homo sapiens
caagaaaaataaagaaaagatgc

SEQ ID NO: 2480668 - DNA, 15 bp, Homo sapiens
caagaaaacaggcac

SEQ ID NO: 2480669 - DNA, 20 bp, Homo sapiens
caagaaaacaggcactgccc

SEQ ID NO: 2480670 - DNA, 21 bp, Homo sapiens
caagaaaacaggcactgccct

SEQ ID NO: 2480671 - DNA, 23 bp, Homo sapiens
caagaaaacaggcactgccctgg

SEQ ID NO: 2480672 - DNA, 19 bp, Homo sapiens
caagaaataaaaggaagcc

SEQ ID NO: 2480673 - DNA, 19 bp, Homo sapiens
caagaagaagggcacccta

SEQ ID NO: 2480674 - DNA, 14 bp, Homo sapiens
caagaagtgaagaa

SEQ ID NO: 2480675 - DNA, 21 bp, Homo sapiens
caagaatggatcacaagatgg

SEQ ID NO: 2480676 - DNA, 16 bp, Homo sapiens
caagacccccagcact

SEQ ID NO: 2480677 - DNA, 17 bp, Homo sapiens
caagactctagagtcca

SEQ ID NO: 2480678 - DNA, 12 bp, Homo sapiens
caagactgctgt

SEQ ID NO: 2480679 - DNA, 19 bp, Homo sapiens
caagactgctgtggccagg

SEQ ID NO: 2480680 - DNA, 22 bp, Homo sapiens
caagactgctgtggccaggagg

SEQ ID NO: 2480681 - DNA, 21 bp, Homo sapiens
caagacttctctttgcctcaa

SEQ ID NO: 2480682 - DNA, 19 bp, Homo sapiens
caagagcatcatgcctctg

SEQ ID NO: 2480683 - DNA, 19 bp, Homo sapiens
caagagctacataatttag

SEQ ID NO: 2480684 - DNA, 14 bp, Homo sapiens
caagaggagccccc

SEQ ID NO: 2480685 - DNA, 19 bp, Homo sapiens
caagaggccgtggctgctg

SEQ ID NO: 2480686 - DNA, 17 bp, Homo sapiens
caagagggacgcctggg

SEQ ID NO: 2480687 - DNA, 15 bp, Homo sapiens
caagatggcccatcc

SEQ ID NO: 2480688 - DNA, 16 bp, Homo sapiens
caagatgggcatcttt

SEQ ID NO: 2480689 - DNA, 17 bp, Homo sapiens
caagatgggcatctttt

SEQ ID NO: 2480690 - DNA, 21 bp, Homo sapiens
caagatgggcatcttttgtat

SEQ ID NO: 2480691 - DNA, 22 bp, Homo sapiens
caagattccggatcctaagcat

SEQ ID NO: 2480692 - DNA, 14 bp, Homo sapiens
caagattctagatg

SEQ ID NO: 2480693 - DNA, 16 bp, Homo sapiens
caagattgagctctct

SEQ ID NO: 2480694 - DNA, 20 bp, Homo sapiens
caagattgagctctctgccc

SEQ ID NO: 2480695 - DNA, 23 bp, Homo sapiens
caagattgagctctctgcccttg

SEQ ID NO: 2480696 - DNA, 21 bp, Homo sapiens
caagattggtgtttttttcta

SEQ ID NO: 2480697 - DNA, 22 bp, Homo sapiens
caagattgttcctgcttttccc

SEQ ID NO: 2480698 - DNA, 14 bp, Homo sapiens
caagcacagcagcc

SEQ ID NO: 2480699 - DNA, 14 bp, Homo sapiens
caagcacagccctt

SEQ ID NO: 2480700 - DNA, 19 bp, Homo sapiens
atttcccaggaccctgaag

SEQ ID NO: 2480701 - DNA, 15 bp, Homo sapiens
atttctaattatgta

SEQ ID NO: 2480702 - DNA, 21 bp, Homo sapiens
atttctaattatgtagctctt

SEQ ID NO: 2480703 - DNA, 17 bp, Homo sapiens
atttctatagccaaaaa

SEQ ID NO: 2480704 - DNA, 11 bp, Homo sapiens
atttctattaa

SEQ ID NO: 2480705 - DNA, 20 bp, Homo sapiens
atttctcaggctaggccagc

SEQ ID NO: 2480706 - DNA, 21 bp, Homo sapiens
atttctgaggtgcactgggag

SEQ ID NO: 2480707 - DNA, 23 bp, Homo sapiens
atttctgcatatgttgaatactt

SEQ ID NO: 2480708 - DNA, 14 bp, Homo sapiens
atttcttaaacact

SEQ ID NO: 2480709 - DNA, 19 bp, Homo sapiens
atttcttaacttcttgctt

SEQ ID NO: 2480710 - DNA, 20 bp, Homo sapiens
atttcttcctaccaagtcaa

SEQ ID NO: 2480711 - DNA, 23 bp, Homo sapiens
atttcttcctaccaagtcaaact

SEQ ID NO: 2480712 - DNA, 15 bp, Homo sapiens
atttctttgaaaaaa

SEQ ID NO: 2480713 - DNA, 17 bp, Homo sapiens
atttgaatgatttttct

SEQ ID NO: 2480714 - DNA, 15 bp, Homo sapiens
atttgacttttctgt

SEQ ID NO: 2480715 - DNA, 16 bp, Homo sapiens
atttgacttttctgta

SEQ ID NO: 2480716 - DNA, 14 bp, Homo sapiens
atttgagtgctctg

SEQ ID NO: 2480717 - DNA, 19 bp, Homo sapiens
atttgcattaaattcacaa

SEQ ID NO: 2480718 - DNA, 12 bp, Homo sapiens
atttgcatttgt

SEQ ID NO: 2480719 - DNA, 13 bp, Homo sapiens
atttgcatttgtt

SEQ ID NO: 2480720 - DNA, 22 bp, Homo sapiens
atttgcatttgtttatgtaatt

SEQ ID NO: 2480721 - DNA, 23 bp, Homo sapiens
atttgcatttgtttatgtaattt

SEQ ID NO: 2480722 - DNA, 14 bp, Homo sapiens
atttgctaattttt

SEQ ID NO: 2480723 - DNA, 14 bp, Homo sapiens
atttgctttggaag

SEQ ID NO: 2480724 - DNA, 15 bp, Homo sapiens
atttgctttggaagt

SEQ ID NO: 2480725 - DNA, 11 bp, Homo sapiens
atttgcttttt

SEQ ID NO: 2480726 - DNA, 17 bp, Homo sapiens
atttggaaataaagtca

SEQ ID NO: 2480727 - DNA, 14 bp, Homo sapiens
atttggaatacttt

SEQ ID NO: 2480728 - DNA, 19 bp, Homo sapiens
atttggagggaagctcttg

SEQ ID NO: 2480729 - DNA, 15 bp, Homo sapiens
atttggatcctgtgt

SEQ ID NO: 2480730 - DNA, 18 bp, Homo sapiens
atttggatttaaaagcct

SEQ ID NO: 2480731 - DNA, 16 bp, Homo sapiens
atttggcatccctggg

SEQ ID NO: 2480732 - DNA, 18 bp, Homo sapiens
atttgggaagtgaagact

SEQ ID NO: 2480733 - DNA, 19 bp, Homo sapiens
atttgggcctgctccagac

SEQ ID NO: 2480734 - DNA, 22 bp, Homo sapiens
atttgggcctgctccagacctg

SEQ ID NO: 2480735 - DNA, 16 bp, Homo sapiens
atttgggtccaggagg

SEQ ID NO: 2480736 - DNA, 22 bp, Homo sapiens
atttgtaaaatgacaatcatgt

SEQ ID NO: 2480737 - DNA, 17 bp, Homo sapiens
atttgtaaatctgccac

SEQ ID NO: 2480738 - DNA, 22 bp, Homo sapiens
atttgtaatagatgtttgatag

SEQ ID NO: 2480739 - DNA, 19 bp, Homo sapiens
atttgtaattaaaagcaaa

SEQ ID NO: 2480740 - DNA, 23 bp, Homo sapiens
atttgtaattaaaagcaaatcat

SEQ ID NO: 2480741 - DNA, 19 bp, Homo sapiens
atttgtgcccccaaccatt

SEQ ID NO: 2480742 - DNA, 20 bp, Homo sapiens
atttgtgttttaatttaaac

SEQ ID NO: 2480743 - DNA, 21 bp, Homo sapiens
atttgtgttttaatttaaaca

SEQ ID NO: 2480744 - DNA, 17 bp, Homo sapiens
atttgttattttgcaac

SEQ ID NO: 2480745 - DNA, 16 bp, Homo sapiens
atttgttcttgtattt

SEQ ID NO: 2480746 - DNA, 11 bp, Homo sapiens
atttgttgcat

SEQ ID NO: 2480747 - DNA, 20 bp, Homo sapiens
atttgtttatggtaaaaaat

SEQ ID NO: 2480748 - DNA, 13 bp, Homo sapiens
atttgtttatgta

SEQ ID NO: 2480749 - DNA, 17 bp, Homo sapiens
atttgtttatgtaattt

SEQ ID NO: 2480750 - DNA, 18 bp, Homo sapiens
atttgtttctttctctga

SEQ ID NO: 2480751 - DNA, 22 bp, Homo sapiens
atttgtttttaaactgtacagt

SEQ ID NO: 2480752 - DNA, 22 bp, Homo sapiens
attttaaaatagcgttcttgta

SEQ ID NO: 2480753 - DNA, 23 bp, Homo sapiens
attttaaaatagcgttcttgtaa

SEQ ID NO: 2480754 - DNA, 13 bp, Homo sapiens
attttaaaatttg

SEQ ID NO: 2480755 - DNA, 14 bp, Homo sapiens
attttaaaatttgt

SEQ ID NO: 2480756 - DNA, 17 bp, Homo sapiens
attttaaaatttgttct

SEQ ID NO: 2480757 - DNA, 14 bp, Homo sapiens
attttaaacacatt

SEQ ID NO: 2480758 - DNA, 15 bp, Homo sapiens
attttaaagacccct

SEQ ID NO: 2480759 - DNA, 13 bp, Homo sapiens
attttaaagttag

SEQ ID NO: 2480760 - DNA, 23 bp, Homo sapiens
attttaatgaagaaagtggaaaa

SEQ ID NO: 2480761 - DNA, 12 bp, Homo sapiens
attttaattctc

SEQ ID NO: 2480762 - DNA, 21 bp, Homo sapiens
attttacacgcttttgtgatg

SEQ ID NO: 2480763 - DNA, 18 bp, Homo sapiens
attttaggagctaaggct

SEQ ID NO: 2480764 - DNA, 19 bp, Homo sapiens
attttaggagctaaggctc

SEQ ID NO: 2480765 - DNA, 20 bp, Homo sapiens
attttagtttttcattaaat

SEQ ID NO: 2480766 - DNA, 16 bp, Homo sapiens
attttatggtgcatta

SEQ ID NO: 2480767 - DNA, 15 bp, Homo sapiens
attttatgttatata

SEQ ID NO: 2480768 - DNA, 23 bp, Homo sapiens
attttattatgaagaaggtgaat

SEQ ID NO: 2480769 - DNA, 22 bp, Homo sapiens
attttatttacccctcccctat

SEQ ID NO: 2480770 - DNA, 15 bp, Homo sapiens
attttcaaaaccagg

SEQ ID NO: 2480771 - DNA, 17 bp, Homo sapiens
attttcaaaaccaggtc

SEQ ID NO: 2480772 - DNA, 16 bp, Homo sapiens
attttcaaagacttaa

SEQ ID NO: 2480773 - DNA, 20 bp, Homo sapiens
attttcataagtatttcaaa

SEQ ID NO: 2480774 - DNA, 22 bp, Homo sapiens
attttcataagtatttcaaatt

SEQ ID NO: 2480775 - DNA, 14 bp, Homo sapiens
attttccaaagagt

SEQ ID NO: 2480776 - DNA, 15 bp, Homo sapiens
attttccaggcttct

SEQ ID NO: 2480777 - DNA, 17 bp, Homo sapiens
attttctaagaaacatt

SEQ ID NO: 2480778 - DNA, 18 bp, Homo sapiens
attttctggccagtgttt

SEQ ID NO: 2480779 - DNA, 15 bp, Homo sapiens
attttctggttctaa

SEQ ID NO: 2480780 - DNA, 20 bp, Homo sapiens
attttgaaagtctgtccttg

SEQ ID NO: 2480781 - DNA, 22 bp, Homo sapiens
attttgaagtgctgtttattaa

SEQ ID NO: 2480782 - DNA, 17 bp, Homo sapiens
attttgaatcaataata

SEQ ID NO: 2480783 - DNA, 18 bp, Homo sapiens
attttgatgtaaagatgt

SEQ ID NO: 2480784 - DNA, 19 bp, Homo sapiens
attttgccaagggcataaa

SEQ ID NO: 2480785 - DNA, 21 bp, Homo sapiens
attttggagagtttcctgaaa

SEQ ID NO: 2480786 - DNA, 17 bp, Homo sapiens
attttggattttgcaag

SEQ ID NO: 2480787 - DNA, 19 bp, Homo sapiens
attttgtaataataaagaa

SEQ ID NO: 2480788 - DNA, 16 bp, Homo sapiens
attttgtatcttgatg

SEQ ID NO: 2480789 - DNA, 19 bp, Homo sapiens
attttgtattgtttcaatt

SEQ ID NO: 2480790 - DNA, 23 bp, Homo sapiens
attttgtggttttcgagattatc

SEQ ID NO: 2480791 - DNA, 16 bp, Homo sapiens
attttgtgtaagaaat

SEQ ID NO: 2480792 - DNA, 17 bp, Homo sapiens
attttgtgtaagaaata

SEQ ID NO: 2480793 - DNA, 15 bp, Homo sapiens
attttgttggcatag

SEQ ID NO: 2480794 - DNA, 14 bp, Homo sapiens
atttttaaacaagt

SEQ ID NO: 2480795 - DNA, 22 bp, Homo sapiens
atttttaattaattgggccagc

SEQ ID NO: 2480796 - DNA, 21 bp, Homo sapiens
atttttagatagttagaacct

SEQ ID NO: 2480797 - DNA, 14 bp, Homo sapiens
atttttatatttaa

SEQ ID NO: 2480798 - DNA, 17 bp, Homo sapiens
atttttattaattttag

SEQ ID NO: 2480799 - DNA, 22 bp, Homo sapiens
atttttattaattttagttttt

SEQ ID NO: 2480800 - DNA, 13 bp, Homo sapiens
atttttccaacta

SEQ ID NO: 2480801 - DNA, 21 bp, Homo sapiens
atttttccaactactaataga

SEQ ID NO: 2480802 - DNA, 10 bp, Homo sapiens
atttttccta

SEQ ID NO: 2480803 - DNA, 12 bp, Homo sapiens
atttttctaact

SEQ ID NO: 2480804 - DNA, 13 bp, Homo sapiens
cagaccaccccgc

SEQ ID NO: 2480805 - DNA, 15 bp, Homo sapiens
cagaccaccccgcct

SEQ ID NO: 2480806 - DNA, 22 bp, Homo sapiens
cagaccaccccgcctgccctca

SEQ ID NO: 2480807 - DNA, 24 bp, Homo sapiens
cagaccacgcccgtcctgcctgtg

SEQ ID NO: 2480808 - DNA, 11 bp, Homo sapiens
cagaccctgga

SEQ ID NO: 2480809 - DNA, 18 bp, Homo sapiens
cagaccctggaggcccca

SEQ ID NO: 2480810 - DNA, 22 bp, Homo sapiens
cagacctgatcctggaggccca

SEQ ID NO: 2480811 - DNA, 16 bp, Homo sapiens
cagacgcctggctgct

SEQ ID NO: 2480812 - DNA, 17 bp, Homo sapiens
cagacgcctggctgctg

SEQ ID NO: 2480813 - DNA, 14 bp, Homo sapiens
cagactaagccagc

SEQ ID NO: 2480814 - DNA, 21 bp, Homo sapiens
cagactaagccagcaccggac

SEQ ID NO: 2480815 - DNA, 23 bp, Homo sapiens
cagactaagccagcaccggacca

SEQ ID NO: 2480816 - DNA, 14 bp, Homo sapiens
cagactagatgtag

SEQ ID NO: 2480817 - DNA, 15 bp, Homo sapiens
cagactagatgtagt

SEQ ID NO: 2480818 - DNA, 14 bp, Homo sapiens
cagactcagacatt

SEQ ID NO: 2480819 - DNA, 13 bp, Homo sapiens
cagactcttgcct

SEQ ID NO: 2480820 - DNA, 18 bp, Homo sapiens
cagactcttgcctgtttc

SEQ ID NO: 2480821 - DNA, 18 bp, Homo sapiens
cagactctttatgcttgc

SEQ ID NO: 2480822 - DNA, 15 bp, Homo sapiens
cagagaaaccagctt

SEQ ID NO: 2480823 - DNA, 16 bp, Homo sapiens
cagagaaaccagcttc

SEQ ID NO: 2480824 - DNA, 21 bp, Homo sapiens
cagagaaaccagcttccttca

SEQ ID NO: 2480825 - DNA, 23 bp, Homo sapiens
cagagaaaccagcttccttcaga

SEQ ID NO: 2480826 - DNA, 19 bp, Homo sapiens
cagagaaaggggagcccac

SEQ ID NO: 2480827 - DNA, 11 bp, Homo sapiens
cagagaaccca

SEQ ID NO: 2480828 - DNA, 22 bp, Homo sapiens
cagagaacccagcccacccccg

SEQ ID NO: 2480829 - DNA, 18 bp, Homo sapiens
cagagaagccatcacctc

SEQ ID NO: 2480830 - DNA, 19 bp, Homo sapiens
cagagaagccatcacctca

SEQ ID NO: 2480831 - DNA, 14 bp, Homo sapiens
cagagaagccttca

SEQ ID NO: 2480832 - DNA, 15 bp, Homo sapiens
cagagaagccttcaa

SEQ ID NO: 2480833 - DNA, 21 bp, Homo sapiens
cagagaagccttcaagctctg

SEQ ID NO: 2480834 - DNA, 16 bp, Homo sapiens
cagagacatgcagaga

SEQ ID NO: 2480835 - DNA, 18 bp, Homo sapiens
cagagacatgcagagatt

SEQ ID NO: 2480836 - DNA, 13 bp, Homo sapiens
cagagaccagggc

SEQ ID NO: 2480837 - DNA, 15 bp, Homo sapiens
cagagaccagggctc

SEQ ID NO: 2480838 - DNA, 11 bp, Homo sapiens
cagagagcagt

SEQ ID NO: 2480839 - DNA, 20 bp, Homo sapiens
cagagaggactgtagggagg

SEQ ID NO: 2480840 - DNA, 20 bp, Homo sapiens
cagagaggtttgcagtccca

SEQ ID NO: 2480841 - DNA, 18 bp, Homo sapiens
cagagcacctgctgtctg

SEQ ID NO: 2480842 - DNA, 21 bp, Homo sapiens
cagagcacctgctgtctgggt

SEQ ID NO: 2480843 - DNA, 20 bp, Homo sapiens
cagagccaaggggcttcagg

SEQ ID NO: 2480844 - DNA, 21 bp, Homo sapiens
cagagccaaggggcttcaggt

SEQ ID NO: 2480845 - DNA, 17 bp, Homo sapiens
cagagccaggagaagct

SEQ ID NO: 2480846 - DNA, 23 bp, Homo sapiens
cagagccaggagaagctcagctg

SEQ ID NO: 2480847 - DNA, 21 bp, Homo sapiens
cagagccatgtcttctccctg

SEQ ID NO: 2480848 - DNA, 13 bp, Homo sapiens
cagagcccagctc

SEQ ID NO: 2480849 - DNA, 17 bp, Homo sapiens
cagagcccaggctcggc

SEQ ID NO: 2480850 - DNA, 23 bp, Homo sapiens
cagagcccaggctcggcctgccc

SEQ ID NO: 2480851 - DNA, 22 bp, Homo sapiens
cagagccggggtggggtggctg

SEQ ID NO: 2480852 - DNA, 16 bp, Homo sapiens
cagagcctggggctct

SEQ ID NO: 2480853 - DNA, 19 bp, Homo sapiens
cagagctggtgcggctggc

SEQ ID NO: 2480854 - DNA, 19 bp, Homo sapiens
cagaggagccaccagttct

SEQ ID NO: 2480855 - DNA, 20 bp, Homo sapiens
cagaggagccaccagttctc

SEQ ID NO: 2480856 - DNA, 21 bp, Homo sapiens
cagaggattgctgccccatca

SEQ ID NO: 2480857 - DNA, 21 bp, Homo sapiens
cagaggcagcccgcacacctg

SEQ ID NO: 2480858 - DNA, 14 bp, Homo sapiens
cagaggccaaggag

SEQ ID NO: 2480859 - DNA, 20 bp, Homo sapiens
cagaggcccacattggaaga

SEQ ID NO: 2480860 - DNA, 14 bp, Homo sapiens
cagaggcccaggct

SEQ ID NO: 2480861 - DNA, 16 bp, Homo sapiens
cagaggcccaggctgc

SEQ ID NO: 2480862 - DNA, 14 bp, Homo sapiens
cagaggccccagcc

SEQ ID NO: 2480863 - DNA, 16 bp, Homo sapiens
cagaggccccagcctc

SEQ ID NO: 2480864 - DNA, 24 bp, Homo sapiens
cagaggcccccagcccagggctcc

SEQ ID NO: 2480865 - DNA, 21 bp, Homo sapiens
cagaggccctcaagtctttct

SEQ ID NO: 2480866 - DNA, 19 bp, Homo sapiens
cagaggccctcgctgccag

SEQ ID NO: 2480867 - DNA, 20 bp, Homo sapiens
cagaggccctcgctgccagc

SEQ ID NO: 2480868 - DNA, 16 bp, Homo sapiens
cagaggcctgcagggc

SEQ ID NO: 2480869 - DNA, 18 bp, Homo sapiens
cagaggcctgcagggcct

SEQ ID NO: 2480870 - DNA, 19 bp, Homo sapiens
cagaggcctgcagggcctc

SEQ ID NO: 2480871 - DNA, 20 bp, Homo sapiens
cagaggcctgcagggcctct

SEQ ID NO: 2480872 - DNA, 14 bp, Homo sapiens
cagaggcctgggct

SEQ ID NO: 2480873 - DNA, 17 bp, Homo sapiens
cagaggcgcactgtgac

SEQ ID NO: 2480874 - DNA, 12 bp, Homo sapiens
cagagggctgga

SEQ ID NO: 2480875 - DNA, 13 bp, Homo sapiens
cagagggctggag

SEQ ID NO: 2480876 - DNA, 14 bp, Homo sapiens
cagagggctggagg

SEQ ID NO: 2480877 - DNA, 20 bp, Homo sapiens
cagagggctggaggcccagg

SEQ ID NO: 2480878 - DNA, 21 bp, Homo sapiens
cagagggctggaggcccaggc

SEQ ID NO: 2480879 - DNA, 14 bp, Homo sapiens
cagaggggcctgcc

SEQ ID NO: 2480880 - DNA, 17 bp, Homo sapiens
cagaggggcctgccacc

SEQ ID NO: 2480881 - DNA, 20 bp, Homo sapiens
cagagtgacatccaggagga

SEQ ID NO: 2480882 - DNA, 17 bp, Homo sapiens
cagagttacagttctgt

SEQ ID NO: 2480883 - DNA, 23 bp, Homo sapiens
cagagttctttttgaagtattta

SEQ ID NO: 2480884 - DNA, 22 bp, Homo sapiens
cagataactgaaaattatttaa

SEQ ID NO: 2480885 - DNA, 20 bp, Homo sapiens
cagataaggtaaaatgccat

SEQ ID NO: 2480886 - DNA, 16 bp, Homo sapiens
cagataatgtgaaaat

SEQ ID NO: 2480887 - DNA, 21 bp, Homo sapiens
cagatacggacagagaccaag

SEQ ID NO: 2480888 - DNA, 18 bp, Homo sapiens
cagatatattttctttct

SEQ ID NO: 2480889 - DNA, 16 bp, Homo sapiens
cagatcagtaaagaac

SEQ ID NO: 2480890 - DNA, 12 bp, Homo sapiens
cagatccagcct

SEQ ID NO: 2480891 - DNA, 13 bp, Homo sapiens
cagatccagcctg

SEQ ID NO: 2480892 - DNA, 14 bp, Homo sapiens
cagatccagcctgg

SEQ ID NO: 2480893 - DNA, 15 bp, Homo sapiens
cagatccagcctggg

SEQ ID NO: 2480894 - DNA, 23 bp, Homo sapiens
cagatccagggacagaggcccca

SEQ ID NO: 2480895 - DNA, 14 bp, Homo sapiens
cagatcctcctcat

SEQ ID NO: 2480896 - DNA, 21 bp, Homo sapiens
cagatctagtcaatcaagtct

SEQ ID NO: 2480897 - DNA, 21 bp, Homo sapiens
cagatctggaacctcagcctg

SEQ ID NO: 2480898 - DNA, 21 bp, Homo sapiens
cagatgacctcgtactcagga

SEQ ID NO: 2480899 - DNA, 22 bp, Homo sapiens
cagatgacctcgtactcaggag

SEQ ID NO: 2480900 - DNA, 17 bp, Homo sapiens
cagatgcccctttctgg

SEQ ID NO: 2480901 - DNA, 12 bp, Homo sapiens
cagatgcctcct

SEQ ID NO: 2480902 - DNA, 20 bp, Homo sapiens
cagatgctccaagattctag

SEQ ID NO: 2480903 - DNA, 16 bp, Homo sapiens
cagatggcagctttta

SEQ ID NO: 2480904 - DNA, 18 bp, Homo sapiens
cagatgtaggagggactg

SEQ ID NO: 2480905 - DNA, 17 bp, Homo sapiens
cagattcagaaatgagg

SEQ ID NO: 2480906 - DNA, 18 bp, Homo sapiens
cagatttggcttgacaaa

SEQ ID NO: 2480907 - DNA, 14 bp, Homo sapiens
cagcaaaccggggc

SEQ ID NO: 2480908 - DNA, 20 bp, Homo sapiens
cactgggtggtggcctggtc

SEQ ID NO: 2480909 - DNA, 21 bp, Homo sapiens
cactggtctgctgttccagtg

SEQ ID NO: 2480910 - DNA, 21 bp, Homo sapiens
cactggtggggataggccagc

SEQ ID NO: 2480911 - DNA, 19 bp, Homo sapiens
cactgtagtaaataatgct

SEQ ID NO: 2480912 - DNA, 20 bp, Homo sapiens
cactgtagtaaataatgctt

SEQ ID NO: 2480913 - DNA, 21 bp, Homo sapiens
cactgtagtaaataatgcttt

SEQ ID NO: 2480914 - DNA, 23 bp, Homo sapiens
cactgtagtaaataatgctttga

SEQ ID NO: 2480915 - DNA, 16 bp, Homo sapiens
cactgtagttctaaga

SEQ ID NO: 2480916 - DNA, 17 bp, Homo sapiens
cactgtagttctaagac

SEQ ID NO: 2480917 - DNA, 20 bp, Homo sapiens
cactgtagttctaagactca

SEQ ID NO: 2480918 - DNA, 15 bp, Homo sapiens
cactgtcctgggcct

SEQ ID NO: 2480919 - DNA, 18 bp, Homo sapiens
cactgtctttaattctgt

SEQ ID NO: 2480920 - DNA, 13 bp, Homo sapiens
cactgtgaaggac

SEQ ID NO: 2480921 - DNA, 14 bp, Homo sapiens
cactgtgaaggacc

SEQ ID NO: 2480922 - DNA, 17 bp, Homo sapiens
cactgtgaaggaccctt

SEQ ID NO: 2480923 - DNA, 17 bp, Homo sapiens
cactgtgcctcagagac

SEQ ID NO: 2480924 - DNA, 20 bp, Homo sapiens
cactgtgcctcagagaccag

SEQ ID NO: 2480925 - DNA, 13 bp, Homo sapiens
cactgtgtgaatc

SEQ ID NO: 2480926 - DNA, 17 bp, Homo sapiens
cactgttccccctgtgc

SEQ ID NO: 2480927 - DNA, 19 bp, Homo sapiens
cactgttccccctgtgcag

SEQ ID NO: 2480928 - DNA, 23 bp, Homo sapiens
cactgttcttagctcaatgagca

SEQ ID NO: 2480929 - DNA, 17 bp, Homo sapiens
cactgttgaattttctc

SEQ ID NO: 2480930 - DNA, 21 bp, Homo sapiens
cactgtttatacactgtgtaa

SEQ ID NO: 2480931 - DNA, 22 bp, Homo sapiens
cactgtttgtttacaaaatcag

SEQ ID NO: 2480932 - DNA, 16 bp, Homo sapiens
cacttacttgcttatt

SEQ ID NO: 2480933 - DNA, 16 bp, Homo sapiens
cacttatagcctctgt

SEQ ID NO: 2480934 - DNA, 17 bp, Homo sapiens
cacttatctgatcagaa

SEQ ID NO: 2480935 - DNA, 11 bp, Homo sapiens
cacttcaaact

SEQ ID NO: 2480936 - DNA, 19 bp, Homo sapiens
cacttcaggtatacctcac

SEQ ID NO: 2480937 - DNA, 18 bp, Homo sapiens
cacttccctgcttaaatt

SEQ ID NO: 2480938 - DNA, 14 bp, Homo sapiens
cacttctcaggaca

SEQ ID NO: 2480939 - DNA, 15 bp, Homo sapiens
cacttctcaggacac

SEQ ID NO: 2480940 - DNA, 23 bp, Homo sapiens
cacttctcaggacacaggcctgt

SEQ ID NO: 2480941 - DNA, 11 bp, Homo sapiens
cacttctgcac

SEQ ID NO: 2480942 - DNA, 14 bp, Homo sapiens
cacttctgcacttg

SEQ ID NO: 2480943 - DNA, 18 bp, Homo sapiens
cacttcttgttccccact

SEQ ID NO: 2480944 - DNA, 12 bp, Homo sapiens
cacttgcaacct

SEQ ID NO: 2480945 - DNA, 20 bp, Homo sapiens
caatttctactttgaagtca

SEQ ID NO: 2480946 - DNA, 23 bp, Homo sapiens
caatttggatttaaaagcctgct

SEQ ID NO: 2480947 - DNA, 21 bp, Homo sapiens
caattttttaagtgaaaatat

SEQ ID NO: 2480948 - DNA, 17 bp, Homo sapiens
caattttttttattagt

SEQ ID NO: 2480949 - DNA, 13 bp, Homo sapiens
cacaaactgtaaa

SEQ ID NO: 2480950 - DNA, 17 bp, Homo sapiens
cacaaactgtaatacaa

SEQ ID NO: 2480951 - DNA, 19 bp, Homo sapiens
cacaaacttttatactctt

SEQ ID NO: 2480952 - DNA, 15 bp, Homo sapiens
cacaaagaccctggc

SEQ ID NO: 2480953 - DNA, 20 bp, Homo sapiens
cacaaagaccctggctttca

SEQ ID NO: 2480954 - DNA, 12 bp, Homo sapiens
cacaaggacttc

SEQ ID NO: 2480955 - DNA, 14 bp, Homo sapiens
cacaaggacttcct

SEQ ID NO: 2480956 - DNA, 22 bp, Homo sapiens
cacaaggacttcctgtccagct

SEQ ID NO: 2480957 - DNA, 22 bp, Homo sapiens
cacaaggatagatgctggccca

SEQ ID NO: 2480958 - DNA, 11 bp, Homo sapiens
cacaaggcagc

SEQ ID NO: 2480959 - DNA, 16 bp, Homo sapiens
cacaaggcagcaaggc

SEQ ID NO: 2480960 - DNA, 18 bp, Homo sapiens
cacaaggcagcaaggccc

SEQ ID NO: 2480961 - DNA, 22 bp, Homo sapiens
cacaaggcagcaaggcccgagc

SEQ ID NO: 2480962 - DNA, 19 bp, Homo sapiens
cacaagtgggtacccccag

SEQ ID NO: 2480963 - DNA, 22 bp, Homo sapiens
cacaagtgggtacccccaggac

SEQ ID NO: 2480964 - DNA, 20 bp, Homo sapiens
cacaataactcctcccaggg

SEQ ID NO: 2480965 - DNA, 14 bp, Homo sapiens
cacaatagaattat

SEQ ID NO: 2480966 - DNA, 23 bp, Homo sapiens
cacacaaaagggaacccagctct

SEQ ID NO: 2480967 - DNA, 15 bp, Homo sapiens
cacacagactatttt

SEQ ID NO: 2480968 - DNA, 13 bp, Homo sapiens
cacacagtatttt

SEQ ID NO: 2480969 - DNA, 18 bp, Homo sapiens
cacacagtgctcaaggcc

SEQ ID NO: 2480970 - DNA, 18 bp, Homo sapiens
cacacatacgtgcacagg

SEQ ID NO: 2480971 - DNA, 13 bp, Homo sapiens
cacacattgctgt

SEQ ID NO: 2480972 - DNA, 14 bp, Homo sapiens
cacaccactagcct

SEQ ID NO: 2480973 - DNA, 19 bp, Homo sapiens
cacaccactagcctcaggg

SEQ ID NO: 2480974 - DNA, 16 bp, Homo sapiens
cacactaccgaatgtg

SEQ ID NO: 2480975 - DNA, 20 bp, Homo sapiens
cacactcagatcctcctcat

SEQ ID NO: 2480976 - DNA, 14 bp, Homo sapiens
cacactgatgctta

SEQ ID NO: 2480977 - DNA, 22 bp, Homo sapiens
cacactgggtggtggcctggtc

SEQ ID NO: 2480978 - DNA, 14 bp, Homo sapiens
cacacttctcagga

SEQ ID NO: 2480979 - DNA, 17 bp, Homo sapiens
cacacttctcaggacac

SEQ ID NO: 2480980 - DNA, 23 bp, Homo sapiens
cacacttctcaggacacaggcct

SEQ ID NO: 2480981 - DNA, 23 bp, Homo sapiens
cacagacggaagggtaaacaata

SEQ ID NO: 2480982 - DNA, 13 bp, Homo sapiens
cacagactatttt

SEQ ID NO: 2480983 - DNA, 15 bp, Homo sapiens
cacagaggacacaga

SEQ ID NO: 2480984 - DNA, 19 bp, Homo sapiens
cacagaggacacagagaag

SEQ ID NO: 2480985 - DNA, 16 bp, Homo sapiens
cacagagggcgtgtgc

SEQ ID NO: 2480986 - DNA, 22 bp, Homo sapiens
cacagataactgaaaattattt

SEQ ID NO: 2480987 - DNA, 17 bp, Homo sapiens
cacagcaaccccaggct

SEQ ID NO: 2480988 - DNA, 18 bp, Homo sapiens
cacagcacaaattagtta

SEQ ID NO: 2480989 - DNA, 17 bp, Homo sapiens
cactaatatatttaaaa

SEQ ID NO: 2480990 - DNA, 21 bp, Homo sapiens
cactaatatatttaaaaataa

SEQ ID NO: 2480991 - DNA, 22 bp, Homo sapiens
cactaattcattaatctgcctc

SEQ ID NO: 2480992 - DNA, 19 bp, Homo sapiens
cactagacaagccagaact

SEQ ID NO: 2480993 - DNA, 22 bp, Homo sapiens
cactagccaaacctcaccaact

SEQ ID NO: 2480994 - DNA, 12 bp, Homo sapiens
cactagctcttg

SEQ ID NO: 2480995 - DNA, 22 bp, Homo sapiens
cactagctcttgttgagccgtg

SEQ ID NO: 2480996 - DNA, 17 bp, Homo sapiens
cactaggcccccacttg

SEQ ID NO: 2480997 - DNA, 22 bp, Homo sapiens
cactaggcccccacttgcctct

SEQ ID NO: 2480998 - DNA, 12 bp, Homo sapiens
cactcacctgca

SEQ ID NO: 2480999 - DNA, 17 bp, Homo sapiens
cactcagaagcctgggg

SEQ ID NO: 2481000 - DNA, 19 bp, Homo sapiens
cactcagaagcctgggggc

SEQ ID NO: 2481001 - DNA, 23 bp, Homo sapiens
cactcagaagcctgggggcctgg

SEQ ID NO: 2481002 - DNA, 20 bp, Homo sapiens
cactcagagacatgcagaga

SEQ ID NO: 2481003 - DNA, 12 bp, Homo sapiens
cactcagcacaa

SEQ ID NO: 2481004 - DNA, 15 bp, Homo sapiens
cactcagcacaaggc

SEQ ID NO: 2481005 - DNA, 22 bp, Homo sapiens
cactcagcacaaggccatctgg

SEQ ID NO: 2481006 - DNA, 17 bp, Homo sapiens
cactcagcacttggccc

SEQ ID NO: 2481007 - DNA, 16 bp, Homo sapiens
cactcagccaccctga

SEQ ID NO: 2481008 - DNA, 18 bp, Homo sapiens
cactcagccaccctgagt

SEQ ID NO: 2481009 - DNA, 17 bp, Homo sapiens
cactcccacctgacaca

SEQ ID NO: 2481010 - DNA, 13 bp, Homo sapiens
cactcccttgggc

SEQ ID NO: 2481011 - DNA, 16 bp, Homo sapiens
cactcccttgggctcc

SEQ ID NO: 2481012 - DNA, 13 bp, Homo sapiens
cactcctcatagc

SEQ ID NO: 2481013 - DNA, 13 bp, Homo sapiens
cactcctctgact

SEQ ID NO: 2481014 - DNA, 21 bp, Homo sapiens
cactcctctgactcagggctc

SEQ ID NO: 2481015 - DNA, 13 bp, Homo sapiens
cactccttcctgc

SEQ ID NO: 2481016 - DNA, 15 bp, Homo sapiens
cactccttcctgccc

SEQ ID NO: 2481017 - DNA, 17 bp, Homo sapiens
cactccttcctgcccca

SEQ ID NO: 2481018 - DNA, 16 bp, Homo sapiens
cactcgctagcagtgg

SEQ ID NO: 2481019 - DNA, 13 bp, Homo sapiens
cactcgtctcccc

SEQ ID NO: 2481020 - DNA, 12 bp, Homo sapiens
cactctgctctg

SEQ ID NO: 2481021 - DNA, 13 bp, Homo sapiens
cactctgctctga

SEQ ID NO: 2481022 - DNA, 15 bp, Homo sapiens
cactctgctctgatg

SEQ ID NO: 2481023 - DNA, 12 bp, Homo sapiens
cactctgctgtt

SEQ ID NO: 2481024 - DNA, 12 bp, Homo sapiens
cactctggcagc

SEQ ID NO: 2481025 - DNA, 15 bp, Homo sapiens
cactctttgtaagag

SEQ ID NO: 2481026 - DNA, 23 bp, Homo sapiens
cactcttttgctttattccagaa

SEQ ID NO: 2481027 - DNA, 17 bp, Homo sapiens
cactgaaaaaatatatg

SEQ ID NO: 2481028 - DNA, 23 bp, Homo sapiens
cactgaaaaatctaagtgatata

SEQ ID NO: 2481029 - DNA, 13 bp, Homo sapiens
cactgacagcctc

SEQ ID NO: 2481030 - DNA, 13 bp, Homo sapiens
cactgaccagaac

SEQ ID NO: 2481031 - DNA, 15 bp, Homo sapiens
cactgaccagaacta

SEQ ID NO: 2481032 - DNA, 17 bp, Homo sapiens
cactgatgctgcccctc

SEQ ID NO: 2481033 - DNA, 15 bp, Homo sapiens
cactgatgcttagat

SEQ ID NO: 2481034 - DNA, 20 bp, Homo sapiens
cactgcaaaccgccacctcc

SEQ ID NO: 2481035 - DNA, 20 bp, Homo sapiens
cactgcaattggcaccgaag

SEQ ID NO: 2481036 - DNA, 18 bp, Homo sapiens
cactgcacaataactcct

SEQ ID NO: 2481037 - DNA, 22 bp, Homo sapiens
cactgcacaataactcctccca

SEQ ID NO: 2481038 - DNA, 14 bp, Homo sapiens
cactgcacctgcct

SEQ ID NO: 2481039 - DNA, 17 bp, Homo sapiens
cactgcactcaacctta

SEQ ID NO: 2481040 - DNA, 12 bp, Homo sapiens
cactgccaggag

SEQ ID NO: 2481041 - DNA, 18 bp, Homo sapiens
cactgccatatgatttac

SEQ ID NO: 2481042 - DNA, 19 bp, Homo sapiens
cactgccccctgctgccat

SEQ ID NO: 2481043 - DNA, 19 bp, Homo sapiens
cactgccctggtggccctc

SEQ ID NO: 2481044 - DNA, 13 bp, Homo sapiens
cactgcctgctcc

SEQ ID NO: 2481045 - DNA, 17 bp, Homo sapiens
cactgctggagaggccc

SEQ ID NO: 2481046 - DNA, 14 bp, Homo sapiens
cactgcttgaggaa

SEQ ID NO: 2481047 - DNA, 13 bp, Homo sapiens
cactgcttttccc

SEQ ID NO: 2481048 - DNA, 12 bp, Homo sapiens
cactggagcaca

SEQ ID NO: 2481049 - DNA, 18 bp, Homo sapiens
cactgggaggctcccctt

SEQ ID NO: 2481050 - DNA, 20 bp, Homo sapiens
cactgggaggctccccttct

SEQ ID NO: 2481051 - DNA, 20 bp, Homo sapiens
cactggggacttggcctctc

SEQ ID NO: 2481052 - DNA, 22 bp, Homo sapiens
cactggggagcccgtctcagtg

SEQ ID NO: 2481053 - DNA, 22 bp, Homo sapiens
cactggggctcagagccggggt

SEQ ID NO: 2481054 - DNA, 22 bp, Homo sapiens
catactggcctggactgttttc

SEQ ID NO: 2481055 - DNA, 21 bp, Homo sapiens
catacttgaacgttttctaat

SEQ ID NO: 2481056 - DNA, 22 bp, Homo sapiens
catacttgaacgttttctaatt

SEQ ID NO: 2481057 - DNA, 18 bp, Homo sapiens
catacttgaagggccaga

SEQ ID NO: 2481058 - DNA, 22 bp, Homo sapiens
catacttgaagggccagagcca

SEQ ID NO: 2481059 - DNA, 19 bp, Homo sapiens
catagacagaagaaacaag

SEQ ID NO: 2481060 - DNA, 20 bp, Homo sapiens
catagacagaagaaacaagg

SEQ ID NO: 2481061 - DNA, 20 bp, Homo sapiens
catagagccgggtgtcccca

SEQ ID NO: 2481062 - DNA, 22 bp, Homo sapiens
catagagccgggtgtccccaac

SEQ ID NO: 2481063 - DNA, 23 bp, Homo sapiens
catagatcagcaaaccggggcct

SEQ ID NO: 2481064 - DNA, 13 bp, Homo sapiens
catagctctgggg

SEQ ID NO: 2481065 - DNA, 20 bp, Homo sapiens
catagctctggggtgggcag

SEQ ID NO: 2481066 - DNA, 18 bp, Homo sapiens
cataggacctttccacca

SEQ ID NO: 2481067 - DNA, 16 bp, Homo sapiens
cataggagtttggagg

SEQ ID NO: 2481068 - DNA, 17 bp, Homo sapiens
cataggagtttggagga

SEQ ID NO: 2481069 - DNA, 19 bp, Homo sapiens
cataggagtttggaggaag

SEQ ID NO: 2481070 - DNA, 20 bp, Homo sapiens
cataggtgatccatgtaact

SEQ ID NO: 2481071 - DNA, 23 bp, Homo sapiens
catagtaacttcttatggaattg

SEQ ID NO: 2481072 - DNA, 18 bp, Homo sapiens
catataatgttgttattt

SEQ ID NO: 2481073 - DNA, 16 bp, Homo sapiens
catataattatatgtt

SEQ ID NO: 2481074 - DNA, 13 bp, Homo sapiens
catattgtaaaac

SEQ ID NO: 2481075 - DNA, 19 bp, Homo sapiens
catattgttgcattgcttt

SEQ ID NO: 2481076 - DNA, 16 bp, Homo sapiens
catatttacctcagcc

SEQ ID NO: 2481077 - DNA, 18 bp, Homo sapiens
catatttacctcagcctg

SEQ ID NO: 2481078 - DNA, 14 bp, Homo sapiens
catatttgtaaaat

SEQ ID NO: 2481079 - DNA, 15 bp, Homo sapiens
catatttgtaaaatg

SEQ ID NO: 2481080 - DNA, 23 bp, Homo sapiens
catatttgtttatggtaaaaaat

SEQ ID NO: 2481081 - DNA, 19 bp, Homo sapiens
catattttaaaatttgttc

SEQ ID NO: 2481082 - DNA, 18 bp, Homo sapiens
catattttcaccatttga

SEQ ID NO: 2481083 - DNA, 18 bp, Homo sapiens
catcaaaaactttggagt

SEQ ID NO: 2481084 - DNA, 20 bp, Homo sapiens
catcaaggacacgggcctgt

SEQ ID NO: 2481085 - DNA, 13 bp, Homo sapiens
catcacagcccag

SEQ ID NO: 2481086 - DNA, 14 bp, Homo sapiens
catcacagcccagc

SEQ ID NO: 2481087 - DNA, 17 bp, Homo sapiens
catcacagcccagcccg

SEQ ID NO: 2481088 - DNA, 14 bp, Homo sapiens
catcacctactcac

SEQ ID NO: 2481089 - DNA, 21 bp, Homo sapiens
catcacctactcacacaggca

SEQ ID NO: 2481090 - DNA, 16 bp, Homo sapiens
catcacctcagatggc

SEQ ID NO: 2481091 - DNA, 19 bp, Homo sapiens
catcacgttagctgtccca

SEQ ID NO: 2481092 - DNA, 15 bp, Homo sapiens
catcactttgaccta

SEQ ID NO: 2481093 - DNA, 18 bp, Homo sapiens
catcagaaagggagggct

SEQ ID NO: 2481094 - DNA, 21 bp, Homo sapiens
catcagaaagggagggctctg

SEQ ID NO: 2481095 - DNA, 22 bp, Homo sapiens
catcagaaagggagggctctga

SEQ ID NO: 2481096 - DNA, 19 bp, Homo sapiens
catcagactgtgaacccca

SEQ ID NO: 2481097 - DNA, 15 bp, Homo sapiens
catcaggctttcttt

SEQ ID NO: 2481098 - DNA, 16 bp, Homo sapiens
catcagtgctccctca

SEQ ID NO: 2481099 - DNA, 15 bp, Homo sapiens
catcatcatggccag

SEQ ID NO: 2481100 - DNA, 13 bp, Homo sapiens
catcatcctctgg

SEQ ID NO: 2481101 - DNA, 14 bp, Homo sapiens
catcatgcctctga

SEQ ID NO: 2481102 - DNA, 21 bp, Homo sapiens
catcatggccagctggaggca

SEQ ID NO: 2481103 - DNA, 15 bp, Homo sapiens
catcattctctgtct

SEQ ID NO: 2481104 - DNA, 16 bp, Homo sapiens
catcattctctgtctc

SEQ ID NO: 2481105 - DNA, 17 bp, Homo sapiens
catcattctctgtctca

SEQ ID NO: 2481106 - DNA, 14 bp, Homo sapiens
catcattttttact

SEQ ID NO: 2481107 - DNA, 23 bp, Homo sapiens
catccaaaatagttaagacatga

SEQ ID NO: 2481108 - DNA, 23 bp, Homo sapiens
catccaaaatcttgatcagttaa

SEQ ID NO: 2481109 - DNA, 18 bp, Homo sapiens
catccaaagcagacagct

SEQ ID NO: 2481110 - DNA, 21 bp, Homo sapiens
catccaaggccaggttctccg

SEQ ID NO: 2481111 - DNA, 20 bp, Homo sapiens
catccacataccctgacctg

SEQ ID NO: 2481112 - DNA, 14 bp, Homo sapiens
catccatcatcatg

SEQ ID NO: 2481113 - DNA, 14 bp, Homo sapiens
catccatggccagc

SEQ ID NO: 2481114 - DNA, 18 bp, Homo sapiens
catccatggccagcagca

SEQ ID NO: 2481115 - DNA, 21 bp, Homo sapiens
catccatggccagcagcacct

SEQ ID NO: 2481116 - DNA, 22 bp, Homo sapiens
catccatggccagcagcacctg

SEQ ID NO: 2481117 - DNA, 17 bp, Homo sapiens
catcccgagcacctcca

SEQ ID NO: 2481118 - DNA, 16 bp, Homo sapiens
catcccgtcttctcca

SEQ ID NO: 2481119 - DNA, 21 bp, Homo sapiens
catcccgtgttctccttttcc

SEQ ID NO: 2481120 - DNA, 12 bp, Homo sapiens
catccctggccc

SEQ ID NO: 2481121 - DNA, 21 bp, Homo sapiens
catccctggccccctccctgg

SEQ ID NO: 2481122 - DNA, 15 bp, Homo sapiens
catccctgggcctgc

SEQ ID NO: 2481123 - DNA, 18 bp, Homo sapiens
catccctgggcctgctgc

SEQ ID NO: 2481124 - DNA, 22 bp, Homo sapiens
catccctgggcctgctgctgag

SEQ ID NO: 2481125 - DNA, 22 bp, Homo sapiens
catccctgggccttgggctccg

SEQ ID NO: 2481126 - DNA, 15 bp, Homo sapiens
catccctttttcaat

SEQ ID NO: 2481127 - DNA, 14 bp, Homo sapiens
catccgcaggtgct

SEQ ID NO: 2481128 - DNA, 15 bp, Homo sapiens
catcctaccgtcttt

SEQ ID NO: 2481129 - DNA, 17 bp, Homo sapiens
catcctaggctgacacc

SEQ ID NO: 2481130 - DNA, 22 bp, Homo sapiens
catcctcaaagaaagtgtattg

SEQ ID NO: 2481131 - DNA, 20 bp, Homo sapiens
catcctccacgttctgctca

SEQ ID NO: 2481132 - DNA, 13 bp, Homo sapiens
catcctccagccc

SEQ ID NO: 2481133 - DNA, 14 bp, Homo sapiens
catcctccagcccc

SEQ ID NO: 2481134 - DNA, 18 bp, Homo sapiens
catcctctggagccagcc

SEQ ID NO: 2481135 - DNA, 19 bp, Homo sapiens
catcctctggagccagccg

SEQ ID NO: 2481136 - DNA, 22 bp, Homo sapiens
catccttgtcttattcccttcc

SEQ ID NO: 2481137 - DNA, 21 bp, Homo sapiens
catcgaatctactaattccac

SEQ ID NO: 2481138 - DNA, 14 bp, Homo sapiens
catcggaaaaataa

SEQ ID NO: 2481139 - DNA, 18 bp, Homo sapiens
catctaacctcatcttct

SEQ ID NO: 2481140 - DNA, 16 bp, Homo sapiens
catctcaaaacagagg

SEQ ID NO: 2481141 - DNA, 18 bp, Homo sapiens
catctcaaaacagagggc

SEQ ID NO: 2481142 - DNA, 22 bp, Homo sapiens
catctcaaaacagagggctgca

SEQ ID NO: 2481143 - DNA, 22 bp, Homo sapiens
catctcaacaggcctcagggct

SEQ ID NO: 2481144 - DNA, 17 bp, Homo sapiens
catctcaggccagagcc

SEQ ID NO: 2481145 - DNA, 22 bp, Homo sapiens
catctcatgcccctggctggga

SEQ ID NO: 2481146 - DNA, 18 bp, Homo sapiens
catctctaccttctcccc

SEQ ID NO: 2481147 - DNA, 15 bp, Homo sapiens
catctctccctcccc

SEQ ID NO: 2481148 - DNA, 20 bp, Homo sapiens
catctctccctcccctgcca

SEQ ID NO: 2481149 - DNA, 14 bp, Homo sapiens
catctctgggctgg

SEQ ID NO: 2481150 - DNA, 23 bp, Homo sapiens
catctctgggctggatgagctcc

SEQ ID NO: 2481151 - DNA, 15 bp, Homo sapiens
catctcttcaggttc

SEQ ID NO: 2481152 - DNA, 20 bp, Homo sapiens
catctgcattttcaccccac

SEQ ID NO: 2481153 - DNA, 18 bp, Homo sapiens
catctgcgtgacaataaa

SEQ ID NO: 2481154 - DNA, 23 bp, Homo sapiens
catctgcgtgacaataaaacatt

SEQ ID NO: 2481155 - DNA, 18 bp, Homo sapiens
catctgggccttggcctg

SEQ ID NO: 2481156 - DNA, 20 bp, Homo sapiens
catctgggccttggcctgga

SEQ ID NO: 2481157 - DNA, 23 bp, Homo sapiens
catctggtagaagggaaagccca

SEQ ID NO: 2481158 - DNA, 23 bp, Homo sapiens
cagtataattgagttttcagtgg

SEQ ID NO: 2481159 - DNA, 13 bp, Homo sapiens
cagtatcatgccc

SEQ ID NO: 2481160 - DNA, 18 bp, Homo sapiens
cagtatgggggttgtaaa

SEQ ID NO: 2481161 - DNA, 20 bp, Homo sapiens
cagtatgggggttgtaaatt

SEQ ID NO: 2481162 - DNA, 21 bp, Homo sapiens
cagtatgggggttgtaaattg

SEQ ID NO: 2481163 - DNA, 15 bp, Homo sapiens
cagtattatatgtac

SEQ ID NO: 2481164 - DNA, 16 bp, Homo sapiens
cagtatttagaagcca

SEQ ID NO: 2481165 - DNA, 23 bp, Homo sapiens
cagtatttgtaattaaaagcaaa

SEQ ID NO: 2481166 - DNA, 13 bp, Homo sapiens
cagtatttttgcc

SEQ ID NO: 2481167 - DNA, 13 bp, Homo sapiens
cagtccacaaaat

SEQ ID NO: 2481168 - DNA, 18 bp, Homo sapiens
cagtccacttctgacagc

SEQ ID NO: 2481169 - DNA, 20 bp, Homo sapiens
cagtccacttctgacagcct

SEQ ID NO: 2481170 - DNA, 20 bp, Homo sapiens
cagtccagtcctatctgggc

SEQ ID NO: 2481171 - DNA, 21 bp, Homo sapiens
cagtccagtcctatctgggct

SEQ ID NO: 2481172 - DNA, 20 bp, Homo sapiens
cagtcccagcggtgggacct

SEQ ID NO: 2481173 - DNA, 13 bp, Homo sapiens
cagtccccttccc

SEQ ID NO: 2481174 - DNA, 19 bp, Homo sapiens
cagtccccttccctccaag

SEQ ID NO: 2481175 - DNA, 21 bp, Homo sapiens
cagtcctatctgggcttcctg

SEQ ID NO: 2481176 - DNA, 17 bp, Homo sapiens
cagtcctgcctcagcct

SEQ ID NO: 2481177 - DNA, 12 bp, Homo sapiens
cagtcctgtcct

SEQ ID NO: 2481178 - DNA, 19 bp, Homo sapiens
cagtccttggcctgctaag

SEQ ID NO: 2481179 - DNA, 15 bp, Homo sapiens
cagtcgatagagctg

SEQ ID NO: 2481180 - DNA, 14 bp, Homo sapiens
cagtcgtgcctgtg

SEQ ID NO: 2481181 - DNA, 17 bp, Homo sapiens
cagtctattcacagaag

SEQ ID NO: 2481182 - DNA, 13 bp, Homo sapiens
cagtctcgtctct

SEQ ID NO: 2481183 - DNA, 22 bp, Homo sapiens
cagtctctcttctctccagctg

SEQ ID NO: 2481184 - DNA, 15 bp, Homo sapiens
cagtctgtggatcag

SEQ ID NO: 2481185 - DNA, 23 bp, Homo sapiens
cagtgaagttgctgcttctccca

SEQ ID NO: 2481186 - DNA, 17 bp, Homo sapiens
cagtgaatgattcagtg

SEQ ID NO: 2481187 - DNA, 16 bp, Homo sapiens
cagtgacttctgagat

SEQ ID NO: 2481188 - DNA, 21 bp, Homo sapiens
cagtgagggagggctgtcatc

SEQ ID NO: 2481189 - DNA, 20 bp, Homo sapiens
cagtgcccccactgaccaga

SEQ ID NO: 2481190 - DNA, 14 bp, Homo sapiens
cagtgctcttttct

SEQ ID NO: 2481191 - DNA, 19 bp, Homo sapiens
cagtgctgatgtagcatgc

SEQ ID NO: 2481192 - DNA, 12 bp, Homo sapiens
cagtgcttttgg

SEQ ID NO: 2481193 - DNA, 20 bp, Homo sapiens
cagtggaggaagagggacag

SEQ ID NO: 2481194 - DNA, 17 bp, Homo sapiens
cagtggatcacaaagtg

SEQ ID NO: 2481195 - DNA, 14 bp, Homo sapiens
cagtggcaggcaga

SEQ ID NO: 2481196 - DNA, 18 bp, Homo sapiens
cagtggctggtccagggc

SEQ ID NO: 2481197 - DNA, 20 bp, Homo sapiens
cagtggctggtccagggcta

SEQ ID NO: 2481198 - DNA, 21 bp, Homo sapiens
cagtggggcagaggcagtacc

SEQ ID NO: 2481199 - DNA, 16 bp, Homo sapiens
cagtgtcatttctcat

SEQ ID NO: 2481200 - DNA, 22 bp, Homo sapiens
cagtgtcatttctcatccacat

SEQ ID NO: 2481201 - DNA, 15 bp, Homo sapiens
cagtgtcctgagctc

SEQ ID NO: 2481202 - DNA, 19 bp, Homo sapiens
cagtgtcctgagctcagcg

SEQ ID NO: 2481203 - DNA, 12 bp, Homo sapiens
cagtgtcttttt

SEQ ID NO: 2481204 - DNA, 14 bp, Homo sapiens
cagtgtgcaaggca

SEQ ID NO: 2481205 - DNA, 18 bp, Homo sapiens
cagtgtgcaaggcagccg

SEQ ID NO: 2481206 - DNA, 18 bp, Homo sapiens
cagtgtggaggccactgt

SEQ ID NO: 2481207 - DNA, 20 bp, Homo sapiens
cagtgtggaggccactgttt

SEQ ID NO: 2481208 - DNA, 14 bp, Homo sapiens
cagtgttaaatgtg

SEQ ID NO: 2481209 - DNA, 18 bp, Homo sapiens
cagtgttgagccttttcc

SEQ ID NO: 2481210 - DNA, 15 bp, Homo sapiens
cagttaagaaatttc

SEQ ID NO: 2481211 - DNA, 15 bp, Homo sapiens
cagttaatcttgctt

SEQ ID NO: 2481212 - DNA, 19 bp, Homo sapiens
cagttaatttttccaacta

SEQ ID NO: 2481213 - DNA, 22 bp, Homo sapiens
cagttacataattcactctgag

SEQ ID NO: 2481214 - DNA, 15 bp, Homo sapiens
cagttatattttgca

SEQ ID NO: 2481215 - DNA, 18 bp, Homo sapiens
cagttatattttgcagtt

SEQ ID NO: 2481216 - DNA, 20 bp, Homo sapiens
cagttcattagaaatatttt

SEQ ID NO: 2481217 - DNA, 15 bp, Homo sapiens
cagttcattgcactt

SEQ ID NO: 2481218 - DNA, 18 bp, Homo sapiens
cagttcccacattaaaga

SEQ ID NO: 2481219 - DNA, 21 bp, Homo sapiens
cagttcgactctgtgctggcc

SEQ ID NO: 2481220 - DNA, 13 bp, Homo sapiens
cagttcgcagcca

SEQ ID NO: 2481221 - DNA, 20 bp, Homo sapiens
cagttctgtggtttcatgtt

SEQ ID NO: 2481222 - DNA, 22 bp, Homo sapiens
cagttctttgggccagacatgc

SEQ ID NO: 2481223 - DNA, 19 bp, Homo sapiens
cagttgaagggaggggctg

SEQ ID NO: 2481224 - DNA, 16 bp, Homo sapiens
cagttgagacaagaaa

SEQ ID NO: 2481225 - DNA, 18 bp, Homo sapiens
cagttgagacaagaaaat

SEQ ID NO: 2481226 - DNA, 14 bp, Homo sapiens
cagttgcagtcact

SEQ ID NO: 2481227 - DNA, 21 bp, Homo sapiens
cagttggagctccagcctgac

SEQ ID NO: 2481228 - DNA, 15 bp, Homo sapiens
cagttgtctctgatg

SEQ ID NO: 2481229 - DNA, 17 bp, Homo sapiens
cagttgtctctgatgca

SEQ ID NO: 2481230 - DNA, 13 bp, Homo sapiens
cagttgttctttt

SEQ ID NO: 2481231 - DNA, 14 bp, Homo sapiens
cagtttaaaagcac

SEQ ID NO: 2481232 - DNA, 18 bp, Homo sapiens
cagtttaatgaagatcta

SEQ ID NO: 2481233 - DNA, 19 bp, Homo sapiens
cagtttatatttaactctc

SEQ ID NO: 2481234 - DNA, 19 bp, Homo sapiens
cagtttatcattcaagtgt

SEQ ID NO: 2481235 - DNA, 14 bp, Homo sapiens
cagtttcacagaaa

SEQ ID NO: 2481236 - DNA, 17 bp, Homo sapiens
cagtttctaaactggag

SEQ ID NO: 2481237 - DNA, 17 bp, Homo sapiens
cagtttgcaaaaaatgt

SEQ ID NO: 2481238 - DNA, 22 bp, Homo sapiens
cagtttgggtaaaatactttta

SEQ ID NO: 2481239 - DNA, 21 bp, Homo sapiens
cagtttgtgtgtcttaattat

SEQ ID NO: 2481240 - DNA, 13 bp, Homo sapiens
cagttttaactgt

SEQ ID NO: 2481241 - DNA, 16 bp, Homo sapiens
cagttttaactgtgga

SEQ ID NO: 2481242 - DNA, 18 bp, Homo sapiens
cagttttaactgtggata

SEQ ID NO: 2481243 - DNA, 20 bp, Homo sapiens
cagttttaactgtggatatt

SEQ ID NO: 2481244 - DNA, 15 bp, Homo sapiens
cagttttatcatttt

SEQ ID NO: 2481245 - DNA, 15 bp, Homo sapiens
cataaaggaaaagac

SEQ ID NO: 2481246 - DNA, 19 bp, Homo sapiens
cataaaggaaaagacacat

SEQ ID NO: 2481247 - DNA, 11 bp, Homo sapiens
cataaattatt

SEQ ID NO: 2481248 - DNA, 13 bp, Homo sapiens
cataaccactgct

SEQ ID NO: 2481249 - DNA, 17 bp, Homo sapiens
cataagctatttttcta

SEQ ID NO: 2481250 - DNA, 15 bp, Homo sapiens
cataatcactctaat

SEQ ID NO: 2481251 - DNA, 20 bp, Homo sapiens
cataatgcattcttctctgt

SEQ ID NO: 2481252 - DNA, 21 bp, Homo sapiens
cataattatccaggaagggaa

SEQ ID NO: 2481253 - DNA, 21 bp, Homo sapiens
cataattcactctgagtgttt

SEQ ID NO: 2481254 - DNA, 23 bp, Homo sapiens
cataattcactctgagtgtttta

SEQ ID NO: 2481255 - DNA, 15 bp, Homo sapiens
cataatttggaggga

SEQ ID NO: 2481256 - DNA, 12 bp, Homo sapiens
catacagagaag

SEQ ID NO: 2481257 - DNA, 16 bp, Homo sapiens
catacattttctaaga

SEQ ID NO: 2481258 - DNA, 14 bp, Homo sapiens
cataccctgacctg

SEQ ID NO: 2481259 - DNA, 16 bp, Homo sapiens
cataccctgacctggc

SEQ ID NO: 2481260 - DNA, 19 bp, Homo sapiens
cataccctgacctggcccc

SEQ ID NO: 2481261 - DNA, 21 bp, Homo sapiens
catacctcctatgggttgtca

SEQ ID NO: 2481262 - DNA, 18 bp, Homo sapiens
catactggcctggactgt

SEQ ID NO: 2481263 - DNA, 11 bp, Homo sapiens
cagcagggcta

SEQ ID NO: 2481264 - DNA, 20 bp, Homo sapiens
cagcagtgtgaggccagggc

SEQ ID NO: 2481265 - DNA, 22 bp, Homo sapiens
cagcagtgtgaggccagggcag

SEQ ID NO: 2481266 - DNA, 12 bp, Homo sapiens
cagcatccgcag

SEQ ID NO: 2481267 - DNA, 22 bp, Homo sapiens
cagcatcggacaagacccccag

SEQ ID NO: 2481268 - DNA, 17 bp, Homo sapiens
cagcatctctaccttct

SEQ ID NO: 2481269 - DNA, 21 bp, Homo sapiens
cagcatctctaccttctcccc

SEQ ID NO: 2481270 - DNA, 15 bp, Homo sapiens
cagcatggcatccaa

SEQ ID NO: 2481271 - DNA, 14 bp, Homo sapiens
cagcattcccaggt

SEQ ID NO: 2481272 - DNA, 20 bp, Homo sapiens
cagcattcccaggtaggcca

SEQ ID NO: 2481273 - DNA, 16 bp, Homo sapiens
cagcattgtatatgtg

SEQ ID NO: 2481274 - DNA, 17 bp, Homo sapiens
cagccaaaccctgtctg

SEQ ID NO: 2481275 - DNA, 19 bp, Homo sapiens
cagccaacacgcacctgcc

SEQ ID NO: 2481276 - DNA, 22 bp, Homo sapiens
cagccaacacgcacctgcctca

SEQ ID NO: 2481277 - DNA, 18 bp, Homo sapiens
cagccaactagcccctgg

SEQ ID NO: 2481278 - DNA, 15 bp, Homo sapiens
cagccaagcacctcc

SEQ ID NO: 2481279 - DNA, 14 bp, Homo sapiens
cagccacacttctc

SEQ ID NO: 2481280 - DNA, 17 bp, Homo sapiens
cagccacacttctcagg

SEQ ID NO: 2481281 - DNA, 20 bp, Homo sapiens
cagccacacttctcaggaca

SEQ ID NO: 2481282 - DNA, 21 bp, Homo sapiens
cagccacacttctcaggacac

SEQ ID NO: 2481283 - DNA, 14 bp, Homo sapiens
cagccaccctgagg

SEQ ID NO: 2481284 - DNA, 20 bp, Homo sapiens
cagccaccctgaggagtctg

SEQ ID NO: 2481285 - DNA, 16 bp, Homo sapiens
cagccaccctgagttg

SEQ ID NO: 2481286 - DNA, 16 bp, Homo sapiens
cagccaccgtttcttc

SEQ ID NO: 2481287 - DNA, 22 bp, Homo sapiens
cagccaccgtttcttcctgcca

SEQ ID NO: 2481288 - DNA, 13 bp, Homo sapiens
cagccagcacctg

SEQ ID NO: 2481289 - DNA, 16 bp, Homo sapiens
cagccagcacctggca

SEQ ID NO: 2481290 - DNA, 14 bp, Homo sapiens
cagccagcatctgg

SEQ ID NO: 2481291 - DNA, 15 bp, Homo sapiens
cagccagcatctggg

SEQ ID NO: 2481292 - DNA, 12 bp, Homo sapiens
cagccagccctg

SEQ ID NO: 2481293 - DNA, 17 bp, Homo sapiens
cagccagccctgcctgg

SEQ ID NO: 2481294 - DNA, 19 bp, Homo sapiens
cagccagccctgcctggag

SEQ ID NO: 2481295 - DNA, 21 bp, Homo sapiens
cagccagccctgcctggagga

SEQ ID NO: 2481296 - DNA, 17 bp, Homo sapiens
cagccaggcccagccga

SEQ ID NO: 2481297 - DNA, 24 bp, Homo sapiens
cagccagggagagcccaggagctc

SEQ ID NO: 2481298 - DNA, 15 bp, Homo sapiens
cagccaggggagcag

SEQ ID NO: 2481299 - DNA, 17 bp, Homo sapiens
cagccaggggagcagag

SEQ ID NO: 2481300 - DNA, 22 bp, Homo sapiens
cagccagtcccgtttcatttag

SEQ ID NO: 2481301 - DNA, 17 bp, Homo sapiens
cagccagtgccctgagc

SEQ ID NO: 2481302 - DNA, 22 bp, Homo sapiens
cagccattggctatttaaaact

SEQ ID NO: 2481303 - DNA, 23 bp, Homo sapiens
cagcccaagtgaggcagccgagg

SEQ ID NO: 2481304 - DNA, 12 bp, Homo sapiens
cagcccaccccc

SEQ ID NO: 2481305 - DNA, 17 bp, Homo sapiens
cagcccacccccggcag

SEQ ID NO: 2481306 - DNA, 22 bp, Homo sapiens
cagcccacccccggcagcagcc

SEQ ID NO: 2481307 - DNA, 12 bp, Homo sapiens
cagcccagagac

SEQ ID NO: 2481308 - DNA, 21 bp, Homo sapiens
cagcccagagacatacttgaa

SEQ ID NO: 2481309 - DNA, 12 bp, Homo sapiens
cagcccagccag

SEQ ID NO: 2481310 - DNA, 13 bp, Homo sapiens
cagcccagccagc

SEQ ID NO: 2481311 - DNA, 14 bp, Homo sapiens
cagcccagccagcg

SEQ ID NO: 2481312 - DNA, 16 bp, Homo sapiens
cagcccagccccactc

SEQ ID NO: 2481313 - DNA, 12 bp, Homo sapiens
cagcccaggaag

SEQ ID NO: 2481314 - DNA, 22 bp, Homo sapiens
cagcccaggaagtctcatctgg

SEQ ID NO: 2481315 - DNA, 16 bp, Homo sapiens
cagcccagggctcctg

SEQ ID NO: 2481316 - DNA, 17 bp, Homo sapiens
cagcccagggctcctgc

SEQ ID NO: 2481317 - DNA, 19 bp, Homo sapiens
cagcccagggctcctgcac

SEQ ID NO: 2481318 - DNA, 13 bp, Homo sapiens
cagcccatggaga

SEQ ID NO: 2481319 - DNA, 13 bp, Homo sapiens
cagccccacacca

SEQ ID NO: 2481320 - DNA, 18 bp, Homo sapiens
cagccccaccccagggca

SEQ ID NO: 2481321 - DNA, 15 bp, Homo sapiens
cagccccaccctggc

SEQ ID NO: 2481322 - DNA, 18 bp, Homo sapiens
cagcccccagctcccacc

SEQ ID NO: 2481323 - DNA, 19 bp, Homo sapiens
cagccccctaagagagcac

SEQ ID NO: 2481324 - DNA, 12 bp, Homo sapiens
cagccccctgac

SEQ ID NO: 2481325 - DNA, 13 bp, Homo sapiens
cagccccctgacc

SEQ ID NO: 2481326 - DNA, 14 bp, Homo sapiens
cagccccctgacca

SEQ ID NO: 2481327 - DNA, 20 bp, Homo sapiens
cagccccctgaccactcaga

SEQ ID NO: 2481328 - DNA, 22 bp, Homo sapiens
cagccccctgaccactcagaga

SEQ ID NO: 2481329 - DNA, 16 bp, Homo sapiens
cagcccctctggtcgc

SEQ ID NO: 2481330 - DNA, 20 bp, Homo sapiens
cagcccctcttggagaagtc

SEQ ID NO: 2481331 - DNA, 23 bp, Homo sapiens
cagcccctcttggagaagtctca

SEQ ID NO: 2481332 - DNA, 24 bp, Homo sapiens
cagcccctcttggagaagtctcag

SEQ ID NO: 2481333 - DNA, 13 bp, Homo sapiens
cagcccctggccc

SEQ ID NO: 2481334 - DNA, 21 bp, Homo sapiens
cagcccctggccccaggacct

SEQ ID NO: 2481335 - DNA, 18 bp, Homo sapiens
cagctgcactgatgctgc

SEQ ID NO: 2481336 - DNA, 17 bp, Homo sapiens
cagctgccccggcccct

SEQ ID NO: 2481337 - DNA, 19 bp, Homo sapiens
cagctgccccggcccctcc

SEQ ID NO: 2481338 - DNA, 23 bp, Homo sapiens
cagctgctccgaggacccaggaa

SEQ ID NO: 2481339 - DNA, 23 bp, Homo sapiens
cagctggaccctgaccagctccc

SEQ ID NO: 2481340 - DNA, 15 bp, Homo sapiens
cagctggaggcaggg

SEQ ID NO: 2481341 - DNA, 23 bp, Homo sapiens
cagctggatgagaatttgagtgc

SEQ ID NO: 2481342 - DNA, 12 bp, Homo sapiens
cagctggctcta

SEQ ID NO: 2481343 - DNA, 16 bp, Homo sapiens
cagctggctctacttc

SEQ ID NO: 2481344 - DNA, 22 bp, Homo sapiens
cagctggctctacttccccatg

SEQ ID NO: 2481345 - DNA, 15 bp, Homo sapiens
cagctgggctctgca

SEQ ID NO: 2481346 - DNA, 16 bp, Homo sapiens
cagctgggctctgcaa

SEQ ID NO: 2481347 - DNA, 16 bp, Homo sapiens
cagctggggtgcaggg

SEQ ID NO: 2481348 - DNA, 18 bp, Homo sapiens
cagctgggtcaggcaggg

SEQ ID NO: 2481349 - DNA, 20 bp, Homo sapiens
cagctgggtcaggcagggtg

SEQ ID NO: 2481350 - DNA, 22 bp, Homo sapiens
cagctggtgtagctacagagaa

SEQ ID NO: 2481351 - DNA, 14 bp, Homo sapiens
cagctgtatagctg

SEQ ID NO: 2481352 - DNA, 16 bp, Homo sapiens
cagctgtcaaggctca

SEQ ID NO: 2481353 - DNA, 16 bp, Homo sapiens
cagctgtccccccact

SEQ ID NO: 2481354 - DNA, 18 bp, Homo sapiens
cagctgtcttttggagga

SEQ ID NO: 2481355 - DNA, 11 bp, Homo sapiens
cagctgtgcct

SEQ ID NO: 2481356 - DNA, 11 bp, Homo sapiens
cagctgtgctt

SEQ ID NO: 2481357 - DNA, 16 bp, Homo sapiens
cagctgttttgttgac

SEQ ID NO: 2481358 - DNA, 17 bp, Homo sapiens
cagctgttttgttgaca

SEQ ID NO: 2481359 - DNA, 19 bp, Homo sapiens
cagctgttttgttgacatt

SEQ ID NO: 2481360 - DNA, 18 bp, Homo sapiens
cagcttagagttggccat

SEQ ID NO: 2481361 - DNA, 14 bp, Homo sapiens
cagcttagatttca

SEQ ID NO: 2481362 - DNA, 15 bp, Homo sapiens
cagcttagatttcat

SEQ ID NO: 2481363 - DNA, 14 bp, Homo sapiens
cagcttcaggtgac

SEQ ID NO: 2481364 - DNA, 20 bp, Homo sapiens
cagcttccttcagagagcag

SEQ ID NO: 2481365 - DNA, 21 bp, Homo sapiens
cagcttccttcagagagcagt

SEQ ID NO: 2481366 - DNA, 14 bp, Homo sapiens
cagcttctgccccc

SEQ ID NO: 2481367 - DNA, 17 bp, Homo sapiens
cagcttgacctgaggct

SEQ ID NO: 2481368 - DNA, 15 bp, Homo sapiens
cagcttgtagccagc

SEQ ID NO: 2481369 - DNA, 19 bp, Homo sapiens
cagcttgtagccagccggg

SEQ ID NO: 2481370 - DNA, 16 bp, Homo sapiens
cagcttgtctcttgcc

SEQ ID NO: 2481371 - DNA, 23 bp, Homo sapiens
cagcttgtctcttgcctgccact

SEQ ID NO: 2481372 - DNA, 15 bp, Homo sapiens
cagcttgtttacatg

SEQ ID NO: 2481373 - DNA, 14 bp, Homo sapiens
cagctttcctgtat

SEQ ID NO: 2481374 - DNA, 16 bp, Homo sapiens
caggaaaaggcctggg

SEQ ID NO: 2481375 - DNA, 18 bp, Homo sapiens
caggaaaaggcctggggt

SEQ ID NO: 2481376 - DNA, 13 bp, Homo sapiens
caggaaaattgaa

SEQ ID NO: 2481377 - DNA, 20 bp, Homo sapiens
caggaaatgaaaatgtcttg

SEQ ID NO: 2481378 - DNA, 16 bp, Homo sapiens
caggaaggagctgcct

SEQ ID NO: 2481379 - DNA, 21 bp, Homo sapiens
caggaaggagctgcctggacc

SEQ ID NO: 2481380 - DNA, 16 bp, Homo sapiens
caggaatcagtttaaa

SEQ ID NO: 2481381 - DNA, 14 bp, Homo sapiens
caggaatggctgca

SEQ ID NO: 2481382 - DNA, 16 bp, Homo sapiens
caggaatttcccagga

SEQ ID NO: 2481383 - DNA, 17 bp, Homo sapiens
caggaatttcccaggac

SEQ ID NO: 2481384 - DNA, 19 bp, Homo sapiens
caggaatttcccaggaccc

SEQ ID NO: 2481385 - DNA, 16 bp, Homo sapiens
caggacacaggcctgt

SEQ ID NO: 2481386 - DNA, 18 bp, Homo sapiens
caggacacaggcctgtgt

SEQ ID NO: 2481387 - DNA, 20 bp, Homo sapiens
caggacacaggcctgtgtag

SEQ ID NO: 2481388 - DNA, 22 bp, Homo sapiens
caggacacaggcctgtgtagct

SEQ ID NO: 2481389 - DNA, 18 bp, Homo sapiens
caggacatgcggtagcca

SEQ ID NO: 2481390 - DNA, 20 bp, Homo sapiens
caggacatgcggtagccagc

SEQ ID NO: 2481391 - DNA, 12 bp, Homo sapiens
caggaccacagg

SEQ ID NO: 2481392 - DNA, 16 bp, Homo sapiens
caggaccacaggctca

SEQ ID NO: 2481393 - DNA, 17 bp, Homo sapiens
caggaccacaggctcag

SEQ ID NO: 2481394 - DNA, 23 bp, Homo sapiens
caggaccacaggctcaggcaggg

SEQ ID NO: 2481395 - DNA, 12 bp, Homo sapiens
caggaccagctc

SEQ ID NO: 2481396 - DNA, 13 bp, Homo sapiens
caggaccagctca

SEQ ID NO: 2481397 - DNA, 17 bp, Homo sapiens
caggaccagctcaggac

SEQ ID NO: 2481398 - DNA, 19 bp, Homo sapiens
caggaccagtcccagagca

SEQ ID NO: 2481399 - DNA, 20 bp, Homo sapiens
caggaccagtcccagagcag

SEQ ID NO: 2481400 - DNA, 13 bp, Homo sapiens
caggacccagagg

SEQ ID NO: 2481401 - DNA, 15 bp, Homo sapiens
caggacccagaggaa

SEQ ID NO: 2481402 - DNA, 13 bp, Homo sapiens
caggaccctgaag

SEQ ID NO: 2481403 - DNA, 14 bp, Homo sapiens
caggaccctgaagg

SEQ ID NO: 2481404 - DNA, 15 bp, Homo sapiens
caggaccctgaaggg

SEQ ID NO: 2481405 - DNA, 14 bp, Homo sapiens
caggaccctggacc

SEQ ID NO: 2481406 - DNA, 17 bp, Homo sapiens
caggaccctggacccag

SEQ ID NO: 2481407 - DNA, 22 bp, Homo sapiens
caggaccctggacccagccaga

SEQ ID NO: 2481408 - DNA, 14 bp, Homo sapiens
caggacctggctgc

SEQ ID NO: 2481409 - DNA, 21 bp, Homo sapiens
caggaccttcgggctgtgccc

SEQ ID NO: 2481410 - DNA, 21 bp, Homo sapiens
caggactaacactcagaagcc

SEQ ID NO: 2481411 - DNA, 17 bp, Homo sapiens
caggactccaggcccaa

SEQ ID NO: 2481412 - DNA, 16 bp, Homo sapiens
caggactctgcagcct

SEQ ID NO: 2481413 - DNA, 19 bp, Homo sapiens
caggactctgcagcctcag

SEQ ID NO: 2481414 - DNA, 18 bp, Homo sapiens
caggactgatgtctccta

SEQ ID NO: 2481415 - DNA, 13 bp, Homo sapiens
caggactgggagc

SEQ ID NO: 2481416 - DNA, 18 bp, Homo sapiens
caggactgggagccccca

SEQ ID NO: 2481417 - DNA, 22 bp, Homo sapiens
caggactgggagcccccagcct

SEQ ID NO: 2481418 - DNA, 16 bp, Homo sapiens
caggagaagctcagct

SEQ ID NO: 2481419 - DNA, 19 bp, Homo sapiens
caggagaaggccaattcct

SEQ ID NO: 2481420 - DNA, 21 bp, Homo sapiens
caggagaaggccaattcctat

SEQ ID NO: 2481421 - DNA, 17 bp, Homo sapiens
caggagcacggctctgt

SEQ ID NO: 2481422 - DNA, 19 bp, Homo sapiens
caggagcacggctctgtcc

SEQ ID NO: 2481423 - DNA, 11 bp, Homo sapiens
caggagcctgt

SEQ ID NO: 2481424 - DNA, 22 bp, Homo sapiens
caggagctccagtgtcctgagc

SEQ ID NO: 2481425 - DNA, 13 bp, Homo sapiens
caggagctcccct

SEQ ID NO: 2481426 - DNA, 21 bp, Homo sapiens
caggagctcccctccccaact

SEQ ID NO: 2481427 - DNA, 19 bp, Homo sapiens
caggaggacccagggctct

SEQ ID NO: 2481428 - DNA, 15 bp, Homo sapiens
caggaggcaggacct

SEQ ID NO: 2481429 - DNA, 14 bp, Homo sapiens
caggaggcctagga

SEQ ID NO: 2481430 - DNA, 18 bp, Homo sapiens
caggagggacaaaggagc

SEQ ID NO: 2481431 - DNA, 24 bp, Homo sapiens
caggagggacaaaggagcctgtga

SEQ ID NO: 2481432 - DNA, 23 bp, Homo sapiens
caggaggggggagggaagggagc

SEQ ID NO: 2481433 - DNA, 23 bp, Homo sapiens
caggagggggtcgtggagagcta

SEQ ID NO: 2481434 - DNA, 14 bp, Homo sapiens
caggagtagctgag

SEQ ID NO: 2481435 - DNA, 20 bp, Homo sapiens
caggagtagctgagctcaca

SEQ ID NO: 2481436 - DNA, 14 bp, Homo sapiens
caggagtccacttt

SEQ ID NO: 2481437 - DNA, 21 bp, Homo sapiens
caggagtgtcctcttccctct

SEQ ID NO: 2481438 - DNA, 16 bp, Homo sapiens
caggatagagactgga

SEQ ID NO: 2481439 - DNA, 17 bp, Homo sapiens
caggatccaagctaagc

SEQ ID NO: 2481440 - DNA, 19 bp, Homo sapiens
caggatctatttttggagg

SEQ ID NO: 2481441 - DNA, 21 bp, Homo sapiens
caggatctatttttggaggtt

SEQ ID NO: 2481442 - DNA, 18 bp, Homo sapiens
caggatctcaccaggcag

SEQ ID NO: 2481443 - DNA, 19 bp, Homo sapiens
caggatctcaccaggcagc

SEQ ID NO: 2481444 - DNA, 22 bp, Homo sapiens
caggatgagggaaaagaaaaag

SEQ ID NO: 2481445 - DNA, 18 bp, Homo sapiens
caggattgcgagagatgt

SEQ ID NO: 2481446 - DNA, 19 bp, Homo sapiens
caggattgcgagagatgtg

SEQ ID NO: 2481447 - DNA, 20 bp, Homo sapiens
caggattgcgagagatgtgt

SEQ ID NO: 2481448 - DNA, 14 bp, Homo sapiens
caggattggggaag

SEQ ID NO: 2481449 - DNA, 13 bp, Homo sapiens
caggcaaggctgt

SEQ ID NO: 2481450 - DNA, 15 bp, Homo sapiens
caggcaccaaaagaa

SEQ ID NO: 2481451 - DNA, 14 bp, Homo sapiens
caggcactgcaaac

SEQ ID NO: 2481452 - DNA, 21 bp, Homo sapiens
caggcactgcaaaccgccacc

SEQ ID NO: 2481453 - DNA, 15 bp, Homo sapiens
caggcactgccctgg

SEQ ID NO: 2481454 - DNA, 18 bp, Homo sapiens
caggcactgggcatgagg

SEQ ID NO: 2481455 - DNA, 21 bp, Homo sapiens
caggcacttggcagccttgtg

SEQ ID NO: 2481456 - DNA, 15 bp, Homo sapiens
caggcagaggcccag

SEQ ID NO: 2481457 - DNA, 18 bp, Homo sapiens
caggcagaggcccaggct

SEQ ID NO: 2481458 - DNA, 15 bp, Homo sapiens
caggcagatccagga

SEQ ID NO: 2481459 - DNA, 15 bp, Homo sapiens
caggcagatgacctc

SEQ ID NO: 2481460 - DNA, 14 bp, Homo sapiens
caggcagccagcat

SEQ ID NO: 2481461 - DNA, 16 bp, Homo sapiens
caggcagccagcatct

SEQ ID NO: 2481462 - DNA, 12 bp, Homo sapiens
caggcagccagt

SEQ ID NO: 2481463 - DNA, 15 bp, Homo sapiens
caggcagccagtgcc

SEQ ID NO: 2481464 - DNA, 13 bp, Homo sapiens
caggcagcctctg

SEQ ID NO: 2481465 - DNA, 16 bp, Homo sapiens
caggcagcctctgggg

SEQ ID NO: 2481466 - DNA, 14 bp, Homo sapiens
caggcagggctctc

SEQ ID NO: 2481467 - DNA, 19 bp, Homo sapiens
caggcagggctctcctggc

SEQ ID NO: 2481468 - DNA, 20 bp, Homo sapiens
caggcagggctctcctggct

SEQ ID NO: 2481469 - DNA, 13 bp, Homo sapiens
caggcaggggcct

SEQ ID NO: 2481470 - DNA, 15 bp, Homo sapiens
caggcaggggcctcc

SEQ ID NO: 2481471 - DNA, 21 bp, Homo sapiens
caggcaggggcctccatgggc

SEQ ID NO: 2481472 - DNA, 12 bp, Homo sapiens
caggcatcctcc

SEQ ID NO: 2481473 - DNA, 16 bp, Homo sapiens
caggcatttcctgggt

SEQ ID NO: 2481474 - DNA, 21 bp, Homo sapiens
caggccaaaggggacctggaa

SEQ ID NO: 2481475 - DNA, 16 bp, Homo sapiens
caggccacacttcaaa

SEQ ID NO: 2481476 - DNA, 20 bp, Homo sapiens
caggccacctccccagcatt

SEQ ID NO: 2481477 - DNA, 13 bp, Homo sapiens
caggccagagcca

SEQ ID NO: 2481478 - DNA, 12 bp, Homo sapiens
caggccagctgt

SEQ ID NO: 2481479 - DNA, 13 bp, Homo sapiens
caggccaggactc

SEQ ID NO: 2481480 - DNA, 18 bp, Homo sapiens
caggccaggactctgcag

SEQ ID NO: 2481481 - DNA, 20 bp, Homo sapiens
caggccaggactctgcagcc

SEQ ID NO: 2481482 - DNA, 23 bp, Homo sapiens
caggccaggactctgcagcctca

SEQ ID NO: 2481483 - DNA, 12 bp, Homo sapiens
caggccaggcat

SEQ ID NO: 2481484 - DNA, 20 bp, Homo sapiens
caggcccagccgaccccctc

SEQ ID NO: 2481485 - DNA, 20 bp, Homo sapiens
caggccccactccttcctga

SEQ ID NO: 2481486 - DNA, 23 bp, Homo sapiens
caggccccactccttcctgattg

SEQ ID NO: 2481487 - DNA, 15 bp, Homo sapiens
caggccccaggaaag

SEQ ID NO: 2481488 - DNA, 14 bp, Homo sapiens
caggccccatgacc

SEQ ID NO: 2481489 - DNA, 19 bp, Homo sapiens
caggccccatgacctccag

SEQ ID NO: 2481490 - DNA, 22 bp, Homo sapiens
caggccccatgacctccagctt

SEQ ID NO: 2481491 - DNA, 21 bp, Homo sapiens
caggcccccgccttggcctgt

SEQ ID NO: 2481492 - DNA, 18 bp, Homo sapiens
caggcccggatgcagagg

SEQ ID NO: 2481493 - DNA, 22 bp, Homo sapiens
caggccctccctgttccccaga

SEQ ID NO: 2481494 - DNA, 23 bp, Homo sapiens
caggccctccctgttccccagag

SEQ ID NO: 2481495 - DNA, 22 bp, Homo sapiens
caggcctctccctcctccagga

SEQ ID NO: 2481496 - DNA, 22 bp, Homo sapiens
caggcctgaaagaggctgaggc

SEQ ID NO: 2481497 - DNA, 16 bp, Homo sapiens
caggcctgtgtagctg

SEQ ID NO: 2481498 - DNA, 19 bp, Homo sapiens
caggcctgtgtagctgtga

SEQ ID NO: 2481499 - DNA, 20 bp, Homo sapiens
caggcctgtgtagctgtgac

SEQ ID NO: 2481500 - DNA, 17 bp, Homo sapiens
caggcctttgagctcag

SEQ ID NO: 2481501 - DNA, 22 bp, Homo sapiens
caggcgaggcccttggcgggca

SEQ ID NO: 2481502 - DNA, 19 bp, Homo sapiens
caggcgatccacctgtctc

SEQ ID NO: 2481503 - DNA, 15 bp, Homo sapiens
caggcgctaattcaa

SEQ ID NO: 2481504 - DNA, 22 bp, Homo sapiens
caggctaatttttttgtatttt

SEQ ID NO: 2481505 - DNA, 15 bp, Homo sapiens
caggctaggccagca

SEQ ID NO: 2481506 - DNA, 22 bp, Homo sapiens
caggctaggccagcaggggctg

SEQ ID NO: 2481507 - DNA, 21 bp, Homo sapiens
caggctcaggcaggggcctcc

SEQ ID NO: 2481508 - DNA, 19 bp, Homo sapiens
caggctcccagggacacct

SEQ ID NO: 2481509 - DNA, 22 bp, Homo sapiens
caggctcccagggacacctggg

SEQ ID NO: 2481510 - DNA, 23 bp, Homo sapiens
caggctcggcctgcccccacccc

SEQ ID NO: 2481511 - DNA, 21 bp, Homo sapiens
caggctcgtggactgagtggg

SEQ ID NO: 2481512 - DNA, 17 bp, Homo sapiens
caggctgaccacagcac

SEQ ID NO: 2481513 - DNA, 22 bp, Homo sapiens
caggctgaccacagcacagcca

SEQ ID NO: 2481514 - DNA, 15 bp, Homo sapiens
caggctgcctgagtc

SEQ ID NO: 2481515 - DNA, 20 bp, Homo sapiens
caggctggaagatagctgtg

SEQ ID NO: 2481516 - DNA, 12 bp, Homo sapiens
caggctggccag

SEQ ID NO: 2481517 - DNA, 16 bp, Homo sapiens
caggctggccagtcca

SEQ ID NO: 2481518 - DNA, 20 bp, Homo sapiens
caggctggctccagatgcag

SEQ ID NO: 2481519 - DNA, 13 bp, Homo sapiens
caggctgggccat

SEQ ID NO: 2481520 - DNA, 23 bp, Homo sapiens
caggctgggccatgtccaaagag

SEQ ID NO: 2481521 - DNA, 21 bp, Homo sapiens
caggctgtaggaaatctagtt

SEQ ID NO: 2481522 - DNA, 16 bp, Homo sapiens
caggcttctgagcagc

SEQ ID NO: 2481523 - DNA, 21 bp, Homo sapiens
caggcttctgagcagcgagcc

SEQ ID NO: 2481524 - DNA, 15 bp, Homo sapiens
cagggaaaataggca

SEQ ID NO: 2481525 - DNA, 20 bp, Homo sapiens
cagggaaaattatttgcata

SEQ ID NO: 2481526 - DNA, 15 bp, Homo sapiens
cagggaaggaggagc

SEQ ID NO: 2481527 - DNA, 15 bp, Homo sapiens
cagggaaggcaggca

SEQ ID NO: 2481528 - DNA, 20 bp, Homo sapiens
cagggaaggcaggcagggct

SEQ ID NO: 2481529 - DNA, 18 bp, Homo sapiens
cagggaattaggccccca

SEQ ID NO: 2481530 - DNA, 16 bp, Homo sapiens
cagggacagaggcccc

SEQ ID NO: 2481531 - DNA, 21 bp, Homo sapiens
cagggacagaggccccagcct

SEQ ID NO: 2481532 - DNA, 23 bp, Homo sapiens
cagggacagaggccccagcctcc

SEQ ID NO: 2481533 - DNA, 13 bp, Homo sapiens
cagggagaagctc

SEQ ID NO: 2481534 - DNA, 16 bp, Homo sapiens
cagggagagcccagga

SEQ ID NO: 2481535 - DNA, 21 bp, Homo sapiens
cagggagcggccggccagccc

SEQ ID NO: 2481536 - DNA, 17 bp, Homo sapiens
cagggagctgggcttcc

SEQ ID NO: 2481537 - DNA, 15 bp, Homo sapiens
cagggaggccgaagc

SEQ ID NO: 2481538 - DNA, 16 bp, Homo sapiens
cagggaggctggtcct

SEQ ID NO: 2481539 - DNA, 20 bp, Homo sapiens
cagggatgtgggttccacag

SEQ ID NO: 2481540 - DNA, 22 bp, Homo sapiens
cagggatgtgggttccacagac

SEQ ID NO: 2481541 - DNA, 18 bp, Homo sapiens
cagggcaaagccaggtcc

SEQ ID NO: 2481542 - DNA, 20 bp, Homo sapiens
cagggcaaagccaggtccct

SEQ ID NO: 2481543 - DNA, 18 bp, Homo sapiens
cagggcaatgatgaatga

SEQ ID NO: 2481544 - DNA, 13 bp, Homo sapiens
cagggcacaggag

SEQ ID NO: 2481545 - DNA, 14 bp, Homo sapiens
cagggcacaggagc

SEQ ID NO: 2481546 - DNA, 15 bp, Homo sapiens
cagggcacaggagct

SEQ ID NO: 2481547 - DNA, 16 bp, Homo sapiens
cagggcagccagggag

SEQ ID NO: 2481548 - DNA, 15 bp, Homo sapiens
cagggcagcgccagg

SEQ ID NO: 2481549 - DNA, 16 bp, Homo sapiens
cagggcagcgccaggc

SEQ ID NO: 2481550 - DNA, 14 bp, Homo sapiens
cagggcagtacctg

SEQ ID NO: 2481551 - DNA, 19 bp, Homo sapiens
cagggcagtacctgagggt

SEQ ID NO: 2481552 - DNA, 16 bp, Homo sapiens
cagggcatctctgggc

SEQ ID NO: 2481553 - DNA, 15 bp, Homo sapiens
cagggcatgccacgt

SEQ ID NO: 2481554 - DNA, 18 bp, Homo sapiens
cagggccacgctccagct

SEQ ID NO: 2481555 - DNA, 14 bp, Homo sapiens
cagggccagcctct

SEQ ID NO: 2481556 - DNA, 17 bp, Homo sapiens
cagggccaggcctctcc

SEQ ID NO: 2481557 - DNA, 22 bp, Homo sapiens
cagggccatgctgaggcctggg

SEQ ID NO: 2481558 - DNA, 23 bp, Homo sapiens
cagggccatgctgaggcctgggc

SEQ ID NO: 2481559 - DNA, 12 bp, Homo sapiens
cagggcccagag

SEQ ID NO: 2481560 - DNA, 13 bp, Homo sapiens
cagggcccagagc

SEQ ID NO: 2481561 - DNA, 15 bp, Homo sapiens
cagggcccagagccc

SEQ ID NO: 2481562 - DNA, 18 bp, Homo sapiens
cagggcccagagcccagc

SEQ ID NO: 2481563 - DNA, 16 bp, Homo sapiens
cagggcccccatctca

SEQ ID NO: 2481564 - DNA, 18 bp, Homo sapiens
cagggcccctcaccctgc

SEQ ID NO: 2481565 - DNA, 22 bp, Homo sapiens
cagggccggggaactggccaag

SEQ ID NO: 2481566 - DNA, 23 bp, Homo sapiens
cagggcctctgtcaattgtacgc

SEQ ID NO: 2481567 - DNA, 14 bp, Homo sapiens
cagggcctgtctca

SEQ ID NO: 2481568 - DNA, 16 bp, Homo sapiens
cagggcgggcagaggg

SEQ ID NO: 2481569 - DNA, 15 bp, Homo sapiens
cagggcgggggtggc

SEQ ID NO: 2481570 - DNA, 16 bp, Homo sapiens
cagggctaccctgagc

SEQ ID NO: 2481571 - DNA, 22 bp, Homo sapiens
cagggctaccctgagctgaggc

SEQ ID NO: 2481572 - DNA, 14 bp, Homo sapiens
cagggctagtgact

SEQ ID NO: 2481573 - DNA, 15 bp, Homo sapiens
cagggctagtgactt

SEQ ID NO: 2481574 - DNA, 12 bp, Homo sapiens
cagggctcctgg

SEQ ID NO: 2481575 - DNA, 13 bp, Homo sapiens
cagggctcctggg

SEQ ID NO: 2481576 - DNA, 14 bp, Homo sapiens
cagggctccttgtg

SEQ ID NO: 2481577 - DNA, 23 bp, Homo sapiens
cagggctccttgtgggcctgggc

SEQ ID NO: 2481578 - DNA, 15 bp, Homo sapiens
cagggctctcctggc

SEQ ID NO: 2481579 - DNA, 16 bp, Homo sapiens
cagggctctcctggct

SEQ ID NO: 2481580 - DNA, 22 bp, Homo sapiens
cagggctttactccgtaacaga

SEQ ID NO: 2481581 - DNA, 17 bp, Homo sapiens
caggggaacactgggga

SEQ ID NO: 2481582 - DNA, 21 bp, Homo sapiens
caggggagcagaggggcagag

SEQ ID NO: 2481583 - DNA, 22 bp, Homo sapiens
caggggcctggagatcctcctg

SEQ ID NO: 2481584 - DNA, 16 bp, Homo sapiens
caggggcttcctggtg

SEQ ID NO: 2481585 - DNA, 19 bp, Homo sapiens
cagggggagctgggcctgg

SEQ ID NO: 2481586 - DNA, 12 bp, Homo sapiens
cagggggctgct

SEQ ID NO: 2481587 - DNA, 14 bp, Homo sapiens
cagggggctgctgc

SEQ ID NO: 2481588 - DNA, 16 bp, Homo sapiens
cagggggtctggctgg

SEQ ID NO: 2481589 - DNA, 20 bp, Homo sapiens
cagggggtctggctggtgtt

SEQ ID NO: 2481590 - DNA, 19 bp, Homo sapiens
caggggtctgagctccagc

SEQ ID NO: 2481591 - DNA, 15 bp, Homo sapiens
caggggttagagcag

SEQ ID NO: 2481592 - DNA, 13 bp, Homo sapiens
cagggtatgaaga

SEQ ID NO: 2481593 - DNA, 16 bp, Homo sapiens
cagggtccctctgtgt

SEQ ID NO: 2481594 - DNA, 23 bp, Homo sapiens
cagggtccttttgacactgctct

SEQ ID NO: 2481595 - DNA, 18 bp, Homo sapiens
cagggtctccagaaagcc

SEQ ID NO: 2481596 - DNA, 19 bp, Homo sapiens
cagggtctccagaaagccc

SEQ ID NO: 2481597 - DNA, 14 bp, Homo sapiens
cagggtctgctctt

SEQ ID NO: 2481598 - DNA, 13 bp, Homo sapiens
cagggtgtgtgct

SEQ ID NO: 2481599 - DNA, 19 bp, Homo sapiens
cagggttgaccccagagga

SEQ ID NO: 2481600 - DNA, 20 bp, Homo sapiens
cagggttgaccccagaggat

SEQ ID NO: 2481601 - DNA, 19 bp, Homo sapiens
cagggtttcaccatgttgc

SEQ ID NO: 2481602 - DNA, 16 bp, Homo sapiens
cagggttttaactttg

SEQ ID NO: 2481603 - DNA, 17 bp, Homo sapiens
cagggttttaactttgt

SEQ ID NO: 2481604 - DNA, 22 bp, Homo sapiens
caggtagaattatctaatttat

SEQ ID NO: 2481605 - DNA, 23 bp, Homo sapiens
caggtagaattatctaatttata

SEQ ID NO: 2481606 - DNA, 18 bp, Homo sapiens
caggtagctgaaagggga

SEQ ID NO: 2481607 - DNA, 14 bp, Homo sapiens
caggtaggccaagg

SEQ ID NO: 2481608 - DNA, 18 bp, Homo sapiens
caggtaggggcccctctc

SEQ ID NO: 2481609 - DNA, 19 bp, Homo sapiens
caggtaggggcccctctca

SEQ ID NO: 2481610 - DNA, 23 bp, Homo sapiens
caggtaggggcccctctcagccc

SEQ ID NO: 2481611 - DNA, 16 bp, Homo sapiens
caggtatacctcactt

SEQ ID NO: 2481612 - DNA, 15 bp, Homo sapiens
caggtatatactttg

SEQ ID NO: 2481613 - DNA, 16 bp, Homo sapiens
caggtcagccactgtt

SEQ ID NO: 2481614 - DNA, 21 bp, Homo sapiens
caggtccaatgagctttctga

SEQ ID NO: 2481615 - DNA, 13 bp, Homo sapiens
caggtccagctct

SEQ ID NO: 2481616 - DNA, 16 bp, Homo sapiens
caggtccctccccttc

SEQ ID NO: 2481617 - DNA, 23 bp, Homo sapiens
caggtctgggtggggcccaggcc

SEQ ID NO: 2481618 - DNA, 17 bp, Homo sapiens
caggtgaaaggaaatta

SEQ ID NO: 2481619 - DNA, 21 bp, Homo sapiens
caggtgctacacccttttcca

SEQ ID NO: 2481620 - DNA, 13 bp, Homo sapiens
caggtgctggggc

SEQ ID NO: 2481621 - DNA, 18 bp, Homo sapiens
caggtgctggggcctggt

SEQ ID NO: 2481622 - DNA, 15 bp, Homo sapiens
caggtgctggtcccg

SEQ ID NO: 2481623 - DNA, 22 bp, Homo sapiens
caggtggatctatttcatgttt

SEQ ID NO: 2481624 - DNA, 15 bp, Homo sapiens
caggtggccctactg

SEQ ID NO: 2481625 - DNA, 14 bp, Homo sapiens
caggttcccaagct

SEQ ID NO: 2481626 - DNA, 15 bp, Homo sapiens
caggttcccaagctc

SEQ ID NO: 2481627 - DNA, 14 bp, Homo sapiens
caggttcccactta

SEQ ID NO: 2481628 - DNA, 16 bp, Homo sapiens
caggttccctcccaga

SEQ ID NO: 2481629 - DNA, 24 bp, Homo sapiens
caggttctccgttagctcctgtgg

SEQ ID NO: 2481630 - DNA, 12 bp, Homo sapiens
caggttcttgtt

SEQ ID NO: 2481631 - DNA, 21 bp, Homo sapiens
caggttggctctgccagtcct

SEQ ID NO: 2481632 - DNA, 13 bp, Homo sapiens
caggtttttcctt

SEQ ID NO: 2481633 - DNA, 15 bp, Homo sapiens
caggtttttcctttt

SEQ ID NO: 2481634 - DNA, 18 bp, Homo sapiens
cagtaaaccactgaaaaa

SEQ ID NO: 2481635 - DNA, 16 bp, Homo sapiens
cagtaaataactggaa

SEQ ID NO: 2481636 - DNA, 18 bp, Homo sapiens
cagtaaataactggaaaa

SEQ ID NO: 2481637 - DNA, 22 bp, Homo sapiens
cagtaaataactggaaaacaga

SEQ ID NO: 2481638 - DNA, 19 bp, Homo sapiens
cagtaacgcgtcttcctga

SEQ ID NO: 2481639 - DNA, 20 bp, Homo sapiens
cagtaacgcgtcttcctgag

SEQ ID NO: 2481640 - DNA, 21 bp, Homo sapiens
cagtaacgcgtcttcctgagt

SEQ ID NO: 2481641 - DNA, 23 bp, Homo sapiens
cagtaccccatggagctgggcta

SEQ ID NO: 2481642 - DNA, 20 bp, Homo sapiens
cagtaccctctcagctccag

SEQ ID NO: 2481643 - DNA, 22 bp, Homo sapiens
cagtaccctctcagctccaggt

SEQ ID NO: 2481644 - DNA, 15 bp, Homo sapiens
cagtacctgagggtc

SEQ ID NO: 2481645 - DNA, 23 bp, Homo sapiens
cagtacctgagggtctgtaggtt

SEQ ID NO: 2481646 - DNA, 23 bp, Homo sapiens
cagtagaggctatggacagggca

SEQ ID NO: 2481647 - DNA, 15 bp, Homo sapiens
cagtaggagcccagc

SEQ ID NO: 2481648 - DNA, 14 bp, Homo sapiens
cagtagttcacata

SEQ ID NO: 2481649 - DNA, 17 bp, Homo sapiens
cccaggctcggcctgcc

SEQ ID NO: 2481650 - DNA, 17 bp, Homo sapiens
cccaggctcgtggactg

SEQ ID NO: 2481651 - DNA, 21 bp, Homo sapiens
cccaggctgggaactcatctg

SEQ ID NO: 2481652 - DNA, 16 bp, Homo sapiens
cccaggctggtctcaa

SEQ ID NO: 2481653 - DNA, 17 bp, Homo sapiens
cccagggaagcagcagc

SEQ ID NO: 2481654 - DNA, 23 bp, Homo sapiens
cccagggaagcagcagcctcgcc

SEQ ID NO: 2481655 - DNA, 18 bp, Homo sapiens
cccagggaggccgaagct

SEQ ID NO: 2481656 - DNA, 15 bp, Homo sapiens
cccagggcacaggag

SEQ ID NO: 2481657 - DNA, 18 bp, Homo sapiens
cccagggcacaggagcta

SEQ ID NO: 2481658 - DNA, 22 bp, Homo sapiens
cccagggcacaggagctacctg

SEQ ID NO: 2481659 - DNA, 13 bp, Homo sapiens
cccagggcagcca

SEQ ID NO: 2481660 - DNA, 15 bp, Homo sapiens
cccagggcagccagg

SEQ ID NO: 2481661 - DNA, 14 bp, Homo sapiens
cccagggcccagag

SEQ ID NO: 2481662 - DNA, 22 bp, Homo sapiens
cccagggcccagagcccagctc

SEQ ID NO: 2481663 - DNA, 16 bp, Homo sapiens
cccagggctctgtaag

SEQ ID NO: 2481664 - DNA, 21 bp, Homo sapiens
cccagggctgggaggaaggac

SEQ ID NO: 2481665 - DNA, 23 bp, Homo sapiens
cccagggctgtaactgccaggct

SEQ ID NO: 2481666 - DNA, 23 bp, Homo sapiens
cccaggtaggggcccctctcagc

SEQ ID NO: 2481667 - DNA, 14 bp, Homo sapiens
cccaggtctgggtg

SEQ ID NO: 2481668 - DNA, 22 bp, Homo sapiens
cccaggtctgggtggggcccag

SEQ ID NO: 2481669 - DNA, 14 bp, Homo sapiens
cccaggttggctct

SEQ ID NO: 2481670 - DNA, 21 bp, Homo sapiens
cccaggttggctctgccagtc

SEQ ID NO: 2481671 - DNA, 22 bp, Homo sapiens
cccagtacacaggggcttgact

SEQ ID NO: 2481672 - DNA, 20 bp, Homo sapiens
cccagtgcccccactgacca

SEQ ID NO: 2481673 - DNA, 22 bp, Homo sapiens
cccagtgcccccactgaccaga

SEQ ID NO: 2481674 - DNA, 14 bp, Homo sapiens
cccagtgccctctc

SEQ ID NO: 2481675 - DNA, 18 bp, Homo sapiens
cccagtgccctctcccct

SEQ ID NO: 2481676 - DNA, 12 bp, Homo sapiens
cccagtgtggct

SEQ ID NO: 2481677 - DNA, 14 bp, Homo sapiens
cccagttaatcttg

SEQ ID NO: 2481678 - DNA, 14 bp, Homo sapiens
cccagttcaccctg

SEQ ID NO: 2481679 - DNA, 18 bp, Homo sapiens
cccagttcctgtggctcc

SEQ ID NO: 2481680 - DNA, 20 bp, Homo sapiens
cccagttgcactcaggtgac

SEQ ID NO: 2481681 - DNA, 17 bp, Homo sapiens
cccagttgccatctgcg

SEQ ID NO: 2481682 - DNA, 21 bp, Homo sapiens
cccagtttctaaactggagac

SEQ ID NO: 2481683 - DNA, 22 bp, Homo sapiens
cccagtttctaaactggagact

SEQ ID NO: 2481684 - DNA, 22 bp, Homo sapiens
cccatcacctactcacacaggc

SEQ ID NO: 2481685 - DNA, 16 bp, Homo sapiens
cccatcatcctctggc

SEQ ID NO: 2481686 - DNA, 15 bp, Homo sapiens
cccatcccacaccct

SEQ ID NO: 2481687 - DNA, 18 bp, Homo sapiens
cccatccccagcgattcc

SEQ ID NO: 2481688 - DNA, 15 bp, Homo sapiens
cccatcctgaccagc

SEQ ID NO: 2481689 - DNA, 23 bp, Homo sapiens
cccatctcaggccagagccaagg

SEQ ID NO: 2481690 - DNA, 13 bp, Homo sapiens
cccatctctccct

SEQ ID NO: 2481691 - DNA, 18 bp, Homo sapiens
cccatctctccctcccct

SEQ ID NO: 2481692 - DNA, 23 bp, Homo sapiens
cccatctctccctcccctgccat

SEQ ID NO: 2481693 - DNA, 18 bp, Homo sapiens
cccatgaccccaaagcca

SEQ ID NO: 2481694 - DNA, 14 bp, Homo sapiens
cccatgacctccag

SEQ ID NO: 2481695 - DNA, 15 bp, Homo sapiens
cccatgacctccagc

SEQ ID NO: 2481696 - DNA, 16 bp, Homo sapiens
cccatgacctccagct

SEQ ID NO: 2481697 - DNA, 14 bp, Homo sapiens
cccatgcactgtga

SEQ ID NO: 2481698 - DNA, 18 bp, Homo sapiens
cccatgcactgtgaagga

SEQ ID NO: 2481699 - DNA, 19 bp, Homo sapiens
cccatgcactgtgaaggac

SEQ ID NO: 2481700 - DNA, 15 bp, Homo sapiens
cccatggacaggctg

SEQ ID NO: 2481701 - DNA, 21 bp, Homo sapiens
cccatggagattgacctggat

SEQ ID NO: 2481702 - DNA, 23 bp, Homo sapiens
cccatggagattgacctggatgg

SEQ ID NO: 2481703 - DNA, 15 bp, Homo sapiens
cccatggcattttat

SEQ ID NO: 2481704 - DNA, 12 bp, Homo sapiens
cccattcctgaa

SEQ ID NO: 2481705 - DNA, 13 bp, Homo sapiens
cccattcctgaag

SEQ ID NO: 2481706 - DNA, 19 bp, Homo sapiens
cccatttatagatggggga

SEQ ID NO: 2481707 - DNA, 17 bp, Homo sapiens
cccattttgaatcacat

SEQ ID NO: 2481708 - DNA, 12 bp, Homo sapiens
cccatttttcct

SEQ ID NO: 2481709 - DNA, 22 bp, Homo sapiens
ccccaaacaccttccagctcct

SEQ ID NO: 2481710 - DNA, 19 bp, Homo sapiens
ccccaaagctttcctgccc

SEQ ID NO: 2481711 - DNA, 17 bp, Homo sapiens
ccccaacagcgcccaaa

SEQ ID NO: 2481712 - DNA, 13 bp, Homo sapiens
ccccaacagctgg

SEQ ID NO: 2481713 - DNA, 21 bp, Homo sapiens
ccccaacagctggaccctgac

SEQ ID NO: 2481714 - DNA, 16 bp, Homo sapiens
ccccaacatgcactga

SEQ ID NO: 2481715 - DNA, 23 bp, Homo sapiens
ccccaacccgtggaggctgctcg

SEQ ID NO: 2481716 - DNA, 22 bp, Homo sapiens
ccccaactccttccagctagtg

SEQ ID NO: 2481717 - DNA, 13 bp, Homo sapiens
ccccaaggttctc

SEQ ID NO: 2481718 - DNA, 20 bp, Homo sapiens
ccccacaccagggccagcct

SEQ ID NO: 2481719 - DNA, 21 bp, Homo sapiens
ccccacccaccaaccctcagg

SEQ ID NO: 2481720 - DNA, 16 bp, Homo sapiens
ccccaccccagggcag

SEQ ID NO: 2481721 - DNA, 17 bp, Homo sapiens
ccccacccccagctcaa

SEQ ID NO: 2481722 - DNA, 17 bp, Homo sapiens
ccccaccctgttcctgc

SEQ ID NO: 2481723 - DNA, 20 bp, Homo sapiens
ccccaccctgttcctgctgc

SEQ ID NO: 2481724 - DNA, 21 bp, Homo sapiens
ccccaccctgttcctgctgct

SEQ ID NO: 2481725 - DNA, 22 bp, Homo sapiens
ccccaccgttgtctcatgccag

SEQ ID NO: 2481726 - DNA, 15 bp, Homo sapiens
ccccacgagggctgg

SEQ ID NO: 2481727 - DNA, 15 bp, Homo sapiens
ccccactccctcaca

SEQ ID NO: 2481728 - DNA, 12 bp, Homo sapiens
ccccactcctct

SEQ ID NO: 2481729 - DNA, 13 bp, Homo sapiens
ccccactctgctc

SEQ ID NO: 2481730 - DNA, 21 bp, Homo sapiens
ccccactgacagcctcccacc

SEQ ID NO: 2481731 - DNA, 14 bp, Homo sapiens
ccccactgaccaga

SEQ ID NO: 2481732 - DNA, 13 bp, Homo sapiens
ccccactggagca

SEQ ID NO: 2481733 - DNA, 14 bp, Homo sapiens
ccccactgtatcta

SEQ ID NO: 2481734 - DNA, 16 bp, Homo sapiens
ccccacttgcctcttc

SEQ ID NO: 2481735 - DNA, 19 bp, Homo sapiens
ccccacttgtccttagcct

SEQ ID NO: 2481736 - DNA, 16 bp, Homo sapiens
ccccagagcccaggct

SEQ ID NO: 2481737 - DNA, 16 bp, Homo sapiens
ccccagagcccccggg

SEQ ID NO: 2481738 - DNA, 22 bp, Homo sapiens
ccccagcaaagcccccagagcc

SEQ ID NO: 2481739 - DNA, 18 bp, Homo sapiens
ccccagcaggtgctgact

SEQ ID NO: 2481740 - DNA, 12 bp, Homo sapiens
ccccagcccaga

SEQ ID NO: 2481741 - DNA, 14 bp, Homo sapiens
ccccagcccagggc

SEQ ID NO: 2481742 - DNA, 21 bp, Homo sapiens
ccccagcccagggctcctgca

SEQ ID NO: 2481743 - DNA, 13 bp, Homo sapiens
ccccagcctccct

SEQ ID NO: 2481744 - DNA, 15 bp, Homo sapiens
ccccagcctccctga

SEQ ID NO: 2481745 - DNA, 14 bp, Homo sapiens
ccccagcctctggc

SEQ ID NO: 2481746 - DNA, 12 bp, Homo sapiens
ccccagcctggg

SEQ ID NO: 2481747 - DNA, 11 bp, Homo sapiens
ccccagcctgt

SEQ ID NO: 2481748 - DNA, 19 bp, Homo sapiens
ccccagctaagaacctgga

SEQ ID NO: 2481749 - DNA, 14 bp, Homo sapiens
ccccagctcaatgg

SEQ ID NO: 2481750 - DNA, 13 bp, Homo sapiens
ccccagctccggc

SEQ ID NO: 2481751 - DNA, 18 bp, Homo sapiens
ccccaggaccagaagctc

SEQ ID NO: 2481752 - DNA, 20 bp, Homo sapiens
ccccaggaccagaagctccc

SEQ ID NO: 2481753 - DNA, 17 bp, Homo sapiens
ccccaggacctggctgc

SEQ ID NO: 2481754 - DNA, 13 bp, Homo sapiens
ccctgtgttgtct

SEQ ID NO: 2481755 - DNA, 17 bp, Homo sapiens
ccctgtgttgtctctag

SEQ ID NO: 2481756 - DNA, 18 bp, Homo sapiens
ccctgtgttgtctctaga

SEQ ID NO: 2481757 - DNA, 14 bp, Homo sapiens
ccctgttcctgctg

SEQ ID NO: 2481758 - DNA, 16 bp, Homo sapiens
ccctgttcctgctgct

SEQ ID NO: 2481759 - DNA, 16 bp, Homo sapiens
ccctgttttcccccca

SEQ ID NO: 2481760 - DNA, 20 bp, Homo sapiens
ccctgttttccccccaaggg

SEQ ID NO: 2481761 - DNA, 14 bp, Homo sapiens
cccttaaaggggag

SEQ ID NO: 2481762 - DNA, 22 bp, Homo sapiens
cccttagacagaggccctcaag

SEQ ID NO: 2481763 - DNA, 19 bp, Homo sapiens
cccttatgcggttaatttt

SEQ ID NO: 2481764 - DNA, 16 bp, Homo sapiens
cccttccactgagggc

SEQ ID NO: 2481765 - DNA, 13 bp, Homo sapiens
cccttccctcacc

SEQ ID NO: 2481766 - DNA, 17 bp, Homo sapiens
cccttcctggacagctg

SEQ ID NO: 2481767 - DNA, 19 bp, Homo sapiens
cccttcctggacagctgtg

SEQ ID NO: 2481768 - DNA, 22 bp, Homo sapiens
cccttcctggacagctgtgcct

SEQ ID NO: 2481769 - DNA, 15 bp, Homo sapiens
cccttgaggtctcag

SEQ ID NO: 2481770 - DNA, 16 bp, Homo sapiens
cccttgagtccccatt

SEQ ID NO: 2481771 - DNA, 17 bp, Homo sapiens
cccttgcccccctggcc

SEQ ID NO: 2481772 - DNA, 18 bp, Homo sapiens
cccttgcccccctggcct

SEQ ID NO: 2481773 - DNA, 15 bp, Homo sapiens
cccttgcctgtgcca

SEQ ID NO: 2481774 - DNA, 19 bp, Homo sapiens
cccttgcctgtgccaggtg

SEQ ID NO: 2481775 - DNA, 20 bp, Homo sapiens
cccttgcctgtgccaggtga

SEQ ID NO: 2481776 - DNA, 14 bp, Homo sapiens
cccttggacacgct

SEQ ID NO: 2481777 - DNA, 14 bp, Homo sapiens
cccttgggcccaca

SEQ ID NO: 2481778 - DNA, 15 bp, Homo sapiens
cccttgggcccacac

SEQ ID NO: 2481779 - DNA, 21 bp, Homo sapiens
cccttgggggtcctcctccag

SEQ ID NO: 2481780 - DNA, 23 bp, Homo sapiens
cccttgggggtcctcctccaggg

SEQ ID NO: 2481781 - DNA, 15 bp, Homo sapiens
ccctttcacaggcag

SEQ ID NO: 2481782 - DNA, 17 bp, Homo sapiens
ccctttcccaccccaac

SEQ ID NO: 2481783 - DNA, 16 bp, Homo sapiens
ccctttctagaccaat

SEQ ID NO: 2481784 - DNA, 17 bp, Homo sapiens
ccctttctagaccaata

SEQ ID NO: 2481785 - DNA, 14 bp, Homo sapiens
ccctttgccttcat

SEQ ID NO: 2481786 - DNA, 21 bp, Homo sapiens
ccgaagctaacagggaaggca

SEQ ID NO: 2481787 - DNA, 23 bp, Homo sapiens
ccgaaggtgaggagcttgaaacc

SEQ ID NO: 2481788 - DNA, 23 bp, Homo sapiens
ccgaatctctttttgctttcgaa

SEQ ID NO: 2481789 - DNA, 14 bp, Homo sapiens
ccgactcacaccac

SEQ ID NO: 2481790 - DNA, 17 bp, Homo sapiens
ccgactgctttggacct

SEQ ID NO: 2481791 - DNA, 15 bp, Homo sapiens
ccgactggggcaggg

SEQ ID NO: 2481792 - DNA, 15 bp, Homo sapiens
ccgagaggtgggcca

SEQ ID NO: 2481793 - DNA, 18 bp, Homo sapiens
ccgagcaaccgtggccct

SEQ ID NO: 2481794 - DNA, 12 bp, Homo sapiens
ccgagcagctga

SEQ ID NO: 2481795 - DNA, 14 bp, Homo sapiens
ccgagcagctgagc

SEQ ID NO: 2481796 - DNA, 15 bp, Homo sapiens
ccgagcagctgagca

SEQ ID NO: 2481797 - DNA, 16 bp, Homo sapiens
ccgagcagctgagcag

SEQ ID NO: 2481798 - DNA, 17 bp, Homo sapiens
ccgagctcctcttccat

SEQ ID NO: 2481799 - DNA, 13 bp, Homo sapiens
ccgaggacccagg

SEQ ID NO: 2481800 - DNA, 21 bp, Homo sapiens
ccgaggaggtgtctcaggctg

SEQ ID NO: 2481801 - DNA, 15 bp, Homo sapiens
ccgagtccaagctgg

SEQ ID NO: 2481802 - DNA, 14 bp, Homo sapiens
ccgccactggggct

SEQ ID NO: 2481803 - DNA, 20 bp, Homo sapiens
ccgccactggggctcagagc

SEQ ID NO: 2481804 - DNA, 13 bp, Homo sapiens
ccgccagctctgt

SEQ ID NO: 2481805 - DNA, 15 bp, Homo sapiens
ccgccagctctgttc

SEQ ID NO: 2481806 - DNA, 23 bp, Homo sapiens
ccgcccacaggaagcctgcagtc

SEQ ID NO: 2481807 - DNA, 22 bp, Homo sapiens
ccgcccagagacccaagctgcc

SEQ ID NO: 2481808 - DNA, 12 bp, Homo sapiens
ccgccctgccac

SEQ ID NO: 2481809 - DNA, 15 bp, Homo sapiens
ccgccctgccactca

SEQ ID NO: 2481810 - DNA, 17 bp, Homo sapiens
ccgcgggacagccaagc

SEQ ID NO: 2481811 - DNA, 13 bp, Homo sapiens
ccgcgtctaccct

SEQ ID NO: 2481812 - DNA, 15 bp, Homo sapiens
ccgcgtctaccctgg

SEQ ID NO: 2481813 - DNA, 14 bp, Homo sapiens
ccgctaaaagaaac

SEQ ID NO: 2481814 - DNA, 18 bp, Homo sapiens
ccgctctacatcttctgc

SEQ ID NO: 2481815 - DNA, 15 bp, Homo sapiens
ccgcttggagcagag

SEQ ID NO: 2481816 - DNA, 20 bp, Homo sapiens
ccgcttggagctattttcca

SEQ ID NO: 2481817 - DNA, 11 bp, Homo sapiens
ccggaaagaag

SEQ ID NO: 2481818 - DNA, 13 bp, Homo sapiens
ccggaccagcctg

SEQ ID NO: 2481819 - DNA, 14 bp, Homo sapiens
ccggaccagcctgg

SEQ ID NO: 2481820 - DNA, 18 bp, Homo sapiens
ccggaccagcctggccca

SEQ ID NO: 2481821 - DNA, 23 bp, Homo sapiens
ccggacttagaaaaccagctcag

SEQ ID NO: 2481822 - DNA, 15 bp, Homo sapiens
ccggacttttctgca

SEQ ID NO: 2481823 - DNA, 14 bp, Homo sapiens
ccggagaggaccgg

SEQ ID NO: 2481824 - DNA, 14 bp, Homo sapiens
ccggatgcagaggc

SEQ ID NO: 2481825 - DNA, 17 bp, Homo sapiens
ccggcaccccctgcagc

SEQ ID NO: 2481826 - DNA, 19 bp, Homo sapiens
ccggcaccccctgcagctt

SEQ ID NO: 2481827 - DNA, 20 bp, Homo sapiens
ccggcaccccctgcagcttg

SEQ ID NO: 2481828 - DNA, 18 bp, Homo sapiens
ccggcagcttctgccccc

SEQ ID NO: 2481829 - DNA, 11 bp, Homo sapiens
ccggcagggcg

SEQ ID NO: 2481830 - DNA, 16 bp, Homo sapiens
ccggcagggcgggcag

SEQ ID NO: 2481831 - DNA, 14 bp, Homo sapiens
ccggcctgccagga

SEQ ID NO: 2481832 - DNA, 11 bp, Homo sapiens
ccggctggtga

SEQ ID NO: 2481833 - DNA, 20 bp, Homo sapiens
ccggctgtgcagtcctgggt

SEQ ID NO: 2481834 - DNA, 21 bp, Homo sapiens
ccgggaagtgagggctcactc

SEQ ID NO: 2481835 - DNA, 18 bp, Homo sapiens
ccgggccactccttcctg

SEQ ID NO: 2481836 - DNA, 19 bp, Homo sapiens
ccgggccactccttcctgc

SEQ ID NO: 2481837 - DNA, 15 bp, Homo sapiens
ccggggaaaggcaag

SEQ ID NO: 2481838 - DNA, 15 bp, Homo sapiens
ccggggaactggcca

SEQ ID NO: 2481839 - DNA, 14 bp, Homo sapiens
ccggggcagccccc

SEQ ID NO: 2481840 - DNA, 22 bp, Homo sapiens
ccgggtgtccccaacagcgccc

SEQ ID NO: 2481841 - DNA, 22 bp, Homo sapiens
ccggtcgccctttgctgcatgg

SEQ ID NO: 2481842 - DNA, 13 bp, Homo sapiens
ccgtaatttaact

SEQ ID NO: 2481843 - DNA, 14 bp, Homo sapiens
ccgtaatttaactt

SEQ ID NO: 2481844 - DNA, 12 bp, Homo sapiens
ccgtcagtgctg

SEQ ID NO: 2481845 - DNA, 13 bp, Homo sapiens
ccgtcctgcctgt

SEQ ID NO: 2481846 - DNA, 19 bp, Homo sapiens
ccgtctttcttttatactg

SEQ ID NO: 2481847 - DNA, 16 bp, Homo sapiens
ccgtcttttcctgttt

SEQ ID NO: 2481848 - DNA, 22 bp, Homo sapiens
ccgtgagccaatccctcacctt

SEQ ID NO: 2481849 - DNA, 14 bp, Homo sapiens
ccgtgccaagtcca

SEQ ID NO: 2481850 - DNA, 20 bp, Homo sapiens
ccgtgccaagtccaggtcct

SEQ ID NO: 2481851 - DNA, 16 bp, Homo sapiens
ccgtgctcgccccagc

SEQ ID NO: 2481852 - DNA, 17 bp, Homo sapiens
ccgtgctcgccccagca

SEQ ID NO: 2481853 - DNA, 16 bp, Homo sapiens
ccgtggaggctgctcg

SEQ ID NO: 2481854 - DNA, 19 bp, Homo sapiens
ccgtggattgcacgtggcc

SEQ ID NO: 2481855 - DNA, 20 bp, Homo sapiens
ccgtggattgcacgtggcct

SEQ ID NO: 2481856 - DNA, 20 bp, Homo sapiens
ccgtggcccttcctggacag

SEQ ID NO: 2481857 - DNA, 17 bp, Homo sapiens
ccgtggctgctgtggga

SEQ ID NO: 2481858 - DNA, 19 bp, Homo sapiens
ccgtgggccccaccctcgg

SEQ ID NO: 2481859 - DNA, 17 bp, Homo sapiens
ccgtggggccgccgcct

SEQ ID NO: 2481860 - DNA, 13 bp, Homo sapiens
cccaacccgtgga

SEQ ID NO: 2481861 - DNA, 19 bp, Homo sapiens
cccaacccgtggaggctgc

SEQ ID NO: 2481862 - DNA, 16 bp, Homo sapiens
cccaactccttccagc

SEQ ID NO: 2481863 - DNA, 23 bp, Homo sapiens
cccaactcttgcacagtcactgc

SEQ ID NO: 2481864 - DNA, 17 bp, Homo sapiens
cccaagattgagctctc

SEQ ID NO: 2481865 - DNA, 21 bp, Homo sapiens
cccaagattgagctctctgcc

SEQ ID NO: 2481866 - DNA, 16 bp, Homo sapiens
cccaagccagaggctg

SEQ ID NO: 2481867 - DNA, 12 bp, Homo sapiens
cccaagctcaga

SEQ ID NO: 2481868 - DNA, 14 bp, Homo sapiens
cccaaggaggcagc

SEQ ID NO: 2481869 - DNA, 19 bp, Homo sapiens
cccaaggctcccggaattc

SEQ ID NO: 2481870 - DNA, 17 bp, Homo sapiens
cccaaggtaccatccta

SEQ ID NO: 2481871 - DNA, 13 bp, Homo sapiens
cccaagtgagtct

SEQ ID NO: 2481872 - DNA, 14 bp, Homo sapiens
cccaatccagtgga

SEQ ID NO: 2481873 - DNA, 14 bp, Homo sapiens
cccaattgctggag

SEQ ID NO: 2481874 - DNA, 20 bp, Homo sapiens
cccacaagcctctgcccagg

SEQ ID NO: 2481875 - DNA, 21 bp, Homo sapiens
cccacaagtgccctccaggct

SEQ ID NO: 2481876 - DNA, 12 bp, Homo sapiens
cccacactcaga

SEQ ID NO: 2481877 - DNA, 22 bp, Homo sapiens
cccacaggaagcctgcagtcct

SEQ ID NO: 2481878 - DNA, 19 bp, Homo sapiens
cccacagtgtcaggcactg

SEQ ID NO: 2481879 - DNA, 17 bp, Homo sapiens
cccacatcccatcgtct

SEQ ID NO: 2481880 - DNA, 13 bp, Homo sapiens
cccacatccctgg

SEQ ID NO: 2481881 - DNA, 21 bp, Homo sapiens
cccacatccctgggcctgctg

SEQ ID NO: 2481882 - DNA, 22 bp, Homo sapiens
cccacatccctgggcctgctgc

SEQ ID NO: 2481883 - DNA, 22 bp, Homo sapiens
cccacattggaagagcagcacc

SEQ ID NO: 2481884 - DNA, 17 bp, Homo sapiens
cccacccaggccaggca

SEQ ID NO: 2481885 - DNA, 15 bp, Homo sapiens
cccaccccagggcag

SEQ ID NO: 2481886 - DNA, 12 bp, Homo sapiens
cccacccccatc

SEQ ID NO: 2481887 - DNA, 14 bp, Homo sapiens
cccacccccggcag

SEQ ID NO: 2481888 - DNA, 15 bp, Homo sapiens
cccaccctcttccta

SEQ ID NO: 2481889 - DNA, 13 bp, Homo sapiens
cccaccctgggcc

SEQ ID NO: 2481890 - DNA, 12 bp, Homo sapiens
cccaccctgttc

SEQ ID NO: 2481891 - DNA, 14 bp, Homo sapiens
cccaccctgttcct

SEQ ID NO: 2481892 - DNA, 17 bp, Homo sapiens
cccaccctgttcctgct

SEQ ID NO: 2481893 - DNA, 13 bp, Homo sapiens
cccacgagggctg

SEQ ID NO: 2481894 - DNA, 15 bp, Homo sapiens
cccacgagggctggc

SEQ ID NO: 2481895 - DNA, 22 bp, Homo sapiens
cccactagctcttgttgagccg

SEQ ID NO: 2481896 - DNA, 14 bp, Homo sapiens
cccactctcctagg

SEQ ID NO: 2481897 - DNA, 19 bp, Homo sapiens
cccactctgctctgatgca

SEQ ID NO: 2481898 - DNA, 15 bp, Homo sapiens
cccactgagaggaca

SEQ ID NO: 2481899 - DNA, 12 bp, Homo sapiens
cccactggagca

SEQ ID NO: 2481900 - DNA, 19 bp, Homo sapiens
cccactgtatctaggcaac

SEQ ID NO: 2481901 - DNA, 22 bp, Homo sapiens
cccactgtcctgggcctgcaga

SEQ ID NO: 2481902 - DNA, 14 bp, Homo sapiens
cccacttacattta

SEQ ID NO: 2481903 - DNA, 13 bp, Homo sapiens
cccacttgcctct

SEQ ID NO: 2481904 - DNA, 15 bp, Homo sapiens
cccacttgcctcttc

SEQ ID NO: 2481905 - DNA, 21 bp, Homo sapiens
cccacttgcctcttccttgaa

SEQ ID NO: 2481906 - DNA, 17 bp, Homo sapiens
cccagacataaaggaaa

SEQ ID NO: 2481907 - DNA, 21 bp, Homo sapiens
cccagacctgttagcagacag

SEQ ID NO: 2481908 - DNA, 15 bp, Homo sapiens
cccagacgcctggct

SEQ ID NO: 2481909 - DNA, 19 bp, Homo sapiens
cccagacgcctggctgctg

SEQ ID NO: 2481910 - DNA, 20 bp, Homo sapiens
cccagactagatgtagtatt

SEQ ID NO: 2481911 - DNA, 23 bp, Homo sapiens
cccagacttgttggcgtaggcta

SEQ ID NO: 2481912 - DNA, 22 bp, Homo sapiens
cccagagaaaggggagcccact

SEQ ID NO: 2481913 - DNA, 13 bp, Homo sapiens
cccagagacccag

SEQ ID NO: 2481914 - DNA, 14 bp, Homo sapiens
cccagagacccagc

SEQ ID NO: 2481915 - DNA, 15 bp, Homo sapiens
cccagagacccagcg

SEQ ID NO: 2481916 - DNA, 15 bp, Homo sapiens
cccagagagcccgag

SEQ ID NO: 2481917 - DNA, 13 bp, Homo sapiens
cccagagcccagc

SEQ ID NO: 2481918 - DNA, 14 bp, Homo sapiens
cccagagcccaggc

SEQ ID NO: 2481919 - DNA, 15 bp, Homo sapiens
cccagagcccaggct

SEQ ID NO: 2481920 - DNA, 23 bp, Homo sapiens
cccagaggaaggggccagaggct

SEQ ID NO: 2481921 - DNA, 15 bp, Homo sapiens
cccagaggggcctgc

SEQ ID NO: 2481922 - DNA, 20 bp, Homo sapiens
cccagaggggcctgccacct

SEQ ID NO: 2481923 - DNA, 17 bp, Homo sapiens
cccagccaaaccctgtc

SEQ ID NO: 2481924 - DNA, 13 bp, Homo sapiens
cccagccaggccc

SEQ ID NO: 2481925 - DNA, 17 bp, Homo sapiens
cccagccaggcccagcc

SEQ ID NO: 2481926 - DNA, 16 bp, Homo sapiens
cccagccagggctcaa

SEQ ID NO: 2481927 - DNA, 21 bp, Homo sapiens
cccagccagggctcaatctct

SEQ ID NO: 2481928 - DNA, 14 bp, Homo sapiens
cccagcccagagac

SEQ ID NO: 2481929 - DNA, 12 bp, Homo sapiens
cccagccccagc

SEQ ID NO: 2481930 - DNA, 18 bp, Homo sapiens
cccagccccctaagagag

SEQ ID NO: 2481931 - DNA, 16 bp, Homo sapiens
cccagcctccctgaag

SEQ ID NO: 2481932 - DNA, 18 bp, Homo sapiens
cccagcctgtcagatcca

SEQ ID NO: 2481933 - DNA, 22 bp, Homo sapiens
cccagcctgtcagatccaggag

SEQ ID NO: 2481934 - DNA, 21 bp, Homo sapiens
cccagcgattccctctcccag

SEQ ID NO: 2481935 - DNA, 23 bp, Homo sapiens
cccagcgattccctctcccaggc

SEQ ID NO: 2481936 - DNA, 16 bp, Homo sapiens
cccagcggcatcaggc

SEQ ID NO: 2481937 - DNA, 22 bp, Homo sapiens
cccagctaccctttttctccag

SEQ ID NO: 2481938 - DNA, 12 bp, Homo sapiens
cccagctcccac

SEQ ID NO: 2481939 - DNA, 13 bp, Homo sapiens
cccagctcccagg

SEQ ID NO: 2481940 - DNA, 14 bp, Homo sapiens
cccagctcccagga

SEQ ID NO: 2481941 - DNA, 17 bp, Homo sapiens
cccagctccggcctgtc

SEQ ID NO: 2481942 - DNA, 11 bp, Homo sapiens
cccagctcctg

SEQ ID NO: 2481943 - DNA, 12 bp, Homo sapiens
cccagctcctga

SEQ ID NO: 2481944 - DNA, 20 bp, Homo sapiens
cccagctcctgacactgctg

SEQ ID NO: 2481945 - DNA, 22 bp, Homo sapiens
cccagctcctgacactgctgga

SEQ ID NO: 2481946 - DNA, 22 bp, Homo sapiens
cccaggaagtctcatctgggga

SEQ ID NO: 2481947 - DNA, 21 bp, Homo sapiens
cccaggaccacaggctcaggc

SEQ ID NO: 2481948 - DNA, 12 bp, Homo sapiens
cccaggaccaga

SEQ ID NO: 2481949 - DNA, 23 bp, Homo sapiens
cccaggaccagaagctcccccag

SEQ ID NO: 2481950 - DNA, 14 bp, Homo sapiens
cccaggaccagctc

SEQ ID NO: 2481951 - DNA, 21 bp, Homo sapiens
cccaggaccagctcaggacag

SEQ ID NO: 2481952 - DNA, 13 bp, Homo sapiens
cccaggaccctga

SEQ ID NO: 2481953 - DNA, 19 bp, Homo sapiens
cccaggaccctggacccag

SEQ ID NO: 2481954 - DNA, 23 bp, Homo sapiens
cccaggaccctggacccagccag

SEQ ID NO: 2481955 - DNA, 20 bp, Homo sapiens
cccaggagctcccctcccca

SEQ ID NO: 2481956 - DNA, 19 bp, Homo sapiens
cccaggcaaggctgtggac

SEQ ID NO: 2481957 - DNA, 15 bp, Homo sapiens
cccaggccaggactc

SEQ ID NO: 2481958 - DNA, 19 bp, Homo sapiens
cccaggccaggactctgca

SEQ ID NO: 2481959 - DNA, 20 bp, Homo sapiens
cccaggccaggactctgcag

SEQ ID NO: 2481960 - DNA, 21 bp, Homo sapiens
cccaggccaggactctgcagc

SEQ ID NO: 2481961 - DNA, 11 bp, Homo sapiens
cccaggcccac

SEQ ID NO: 2481962 - DNA, 16 bp, Homo sapiens
cccaggccccatgacc

SEQ ID NO: 2481963 - DNA, 17 bp, Homo sapiens
cccaggccccatgacct

SEQ ID NO: 2481964 - DNA, 21 bp, Homo sapiens
cccaggccccatgacctccag

SEQ ID NO: 2481965 - DNA, 15 bp, Homo sapiens
ccccaggctcgtgga

SEQ ID NO: 2481966 - DNA, 18 bp, Homo sapiens
ccccagggaagcagcagc

SEQ ID NO: 2481967 - DNA, 20 bp, Homo sapiens
ccccagggaagcagcagcct

SEQ ID NO: 2481968 - DNA, 15 bp, Homo sapiens
ccccagggcacagga

SEQ ID NO: 2481969 - DNA, 16 bp, Homo sapiens
ccccagggcacaggag

SEQ ID NO: 2481970 - DNA, 17 bp, Homo sapiens
ccccagggcacaggagc

SEQ ID NO: 2481971 - DNA, 18 bp, Homo sapiens
ccccagggcacaggagct

SEQ ID NO: 2481972 - DNA, 22 bp, Homo sapiens
ccccagggcacaggagctacct

SEQ ID NO: 2481973 - DNA, 16 bp, Homo sapiens
ccccagggcagccagg

SEQ ID NO: 2481974 - DNA, 22 bp, Homo sapiens
ccccagggcagccagggagagc

SEQ ID NO: 2481975 - DNA, 17 bp, Homo sapiens
ccccagggtcctgggag

SEQ ID NO: 2481976 - DNA, 17 bp, Homo sapiens
ccccaggtccagctctg

SEQ ID NO: 2481977 - DNA, 14 bp, Homo sapiens
ccccagtacacagg

SEQ ID NO: 2481978 - DNA, 20 bp, Homo sapiens
ccccatcagtgctccctcac

SEQ ID NO: 2481979 - DNA, 14 bp, Homo sapiens
ccccatctcaggcc

SEQ ID NO: 2481980 - DNA, 21 bp, Homo sapiens
ccccatctcatgcccctggct

SEQ ID NO: 2481981 - DNA, 23 bp, Homo sapiens
ccccatctcatgcccctggctgg

SEQ ID NO: 2481982 - DNA, 13 bp, Homo sapiens
ccccatgacctcc

SEQ ID NO: 2481983 - DNA, 13 bp, Homo sapiens
ccccatgcactgt

SEQ ID NO: 2481984 - DNA, 23 bp, Homo sapiens
ccccatgcactgtgaaggaccct

SEQ ID NO: 2481985 - DNA, 17 bp, Homo sapiens
ccccatggccctgagcg

SEQ ID NO: 2481986 - DNA, 15 bp, Homo sapiens
ccccatgttctgtcc

SEQ ID NO: 2481987 - DNA, 18 bp, Homo sapiens
cccccaaggttctccaac

SEQ ID NO: 2481988 - DNA, 14 bp, Homo sapiens
cccccacccccagc

SEQ ID NO: 2481989 - DNA, 15 bp, Homo sapiens
cccccacccccagct

SEQ ID NO: 2481990 - DNA, 11 bp, Homo sapiens
cccccaccctg

SEQ ID NO: 2481991 - DNA, 16 bp, Homo sapiens
cccccagagcccaggc

SEQ ID NO: 2481992 - DNA, 12 bp, Homo sapiens
cccccagcactt

SEQ ID NO: 2481993 - DNA, 12 bp, Homo sapiens
cccccagcctgg

SEQ ID NO: 2481994 - DNA, 13 bp, Homo sapiens
cccccagcctggg

SEQ ID NO: 2481995 - DNA, 14 bp, Homo sapiens
cccccaggaccaga

SEQ ID NO: 2481996 - DNA, 14 bp, Homo sapiens
cccccatgcactgt

SEQ ID NO: 2481997 - DNA, 13 bp, Homo sapiens
ccccccagcctct

SEQ ID NO: 2481998 - DNA, 14 bp, Homo sapiens
ccccccatgcactg

SEQ ID NO: 2481999 - DNA, 14 bp, Homo sapiens
ccccctctcccagt

SEQ ID NO: 2482000 - DNA, 17 bp, Homo sapiens
ccccctctccctgcatg

SEQ ID NO: 2482001 - DNA, 16 bp, Homo sapiens
ccccctctgtcttgtg

SEQ ID NO: 2482002 - DNA, 17 bp, Homo sapiens
ccccctgaccactcaga

SEQ ID NO: 2482003 - DNA, 14 bp, Homo sapiens
ccccctgcaggaag

SEQ ID NO: 2482004 - DNA, 17 bp, Homo sapiens
ccccctggcctccccca

SEQ ID NO: 2482005 - DNA, 15 bp, Homo sapiens
ccccctggtcccctc

SEQ ID NO: 2482006 - DNA, 12 bp, Homo sapiens
ccccctgtgcag

SEQ ID NO: 2482007 - DNA, 16 bp, Homo sapiens
cccccttcaagcctgt

SEQ ID NO: 2482008 - DNA, 21 bp, Homo sapiens
ccccctttagatctctgaagc

SEQ ID NO: 2482009 - DNA, 22 bp, Homo sapiens
ccccctttcacaggcagccagt

SEQ ID NO: 2482010 - DNA, 20 bp, Homo sapiens
ccccctttcctggacactca

SEQ ID NO: 2482011 - DNA, 18 bp, Homo sapiens
ccccgcctgccctcatgg

SEQ ID NO: 2482012 - DNA, 22 bp, Homo sapiens
ccccggcacctcccttgggcac

SEQ ID NO: 2482013 - DNA, 13 bp, Homo sapiens
ccccggcagcagc

SEQ ID NO: 2482014 - DNA, 15 bp, Homo sapiens
ccccgtcaagagtga

SEQ ID NO: 2482015 - DNA, 14 bp, Homo sapiens
ccccgtttctggtg

SEQ ID NO: 2482016 - DNA, 19 bp, Homo sapiens
cccctaaagcctcaaaaca

SEQ ID NO: 2482017 - DNA, 23 bp, Homo sapiens
cccctaaccctttgtgtgctctc

SEQ ID NO: 2482018 - DNA, 13 bp, Homo sapiens
cccctcacccctc

SEQ ID NO: 2482019 - DNA, 20 bp, Homo sapiens
cccctcatctctctgcccaa

SEQ ID NO: 2482020 - DNA, 16 bp, Homo sapiens
cccctccgccctgcca

SEQ ID NO: 2482021 - DNA, 18 bp, Homo sapiens
cccctccgccctgccact

SEQ ID NO: 2482022 - DNA, 14 bp, Homo sapiens
cccctccttcccaa

SEQ ID NO: 2482023 - DNA, 12 bp, Homo sapiens
cccctctcacca

SEQ ID NO: 2482024 - DNA, 14 bp, Homo sapiens
cccctctccctgca

SEQ ID NO: 2482025 - DNA, 22 bp, Homo sapiens
cccctctcccttgggctctgat

SEQ ID NO: 2482026 - DNA, 14 bp, Homo sapiens
cccctctccttcct

SEQ ID NO: 2482027 - DNA, 16 bp, Homo sapiens
cccctctgctgctgtc

SEQ ID NO: 2482028 - DNA, 23 bp, Homo sapiens
cccctctggtcgctcctgcccac

SEQ ID NO: 2482029 - DNA, 14 bp, Homo sapiens
cccctctgtccagg

SEQ ID NO: 2482030 - DNA, 17 bp, Homo sapiens
cccctgaccactcagag

SEQ ID NO: 2482031 - DNA, 22 bp, Homo sapiens
cccctgaccactcagagacatg

SEQ ID NO: 2482032 - DNA, 15 bp, Homo sapiens
cccctgacctgtgag

SEQ ID NO: 2482033 - DNA, 16 bp, Homo sapiens
cccctgcactgtaaaa

SEQ ID NO: 2482034 - DNA, 23 bp, Homo sapiens
cccctgcaggaaggagctgcctg

SEQ ID NO: 2482035 - DNA, 22 bp, Homo sapiens
cccctgcattggaactggaggc

SEQ ID NO: 2482036 - DNA, 20 bp, Homo sapiens
cccctgccaccaggccacct

SEQ ID NO: 2482037 - DNA, 23 bp, Homo sapiens
cccctgccagggcagggccccag

SEQ ID NO: 2482038 - DNA, 17 bp, Homo sapiens
cccctgccccctgcagg

SEQ ID NO: 2482039 - DNA, 19 bp, Homo sapiens
cccctgcctgccctggtga

SEQ ID NO: 2482040 - DNA, 14 bp, Homo sapiens
cccctgctttgggc

SEQ ID NO: 2482041 - DNA, 22 bp, Homo sapiens
cccctggcagagatgcctccct

SEQ ID NO: 2482042 - DNA, 23 bp, Homo sapiens
cccctggctgggacgtggctcag

SEQ ID NO: 2482043 - DNA, 19 bp, Homo sapiens
cccctggggtggccaccag

SEQ ID NO: 2482044 - DNA, 15 bp, Homo sapiens
cccctgtaggcctca

SEQ ID NO: 2482045 - DNA, 22 bp, Homo sapiens
cccctgtctctcagggccaggc

SEQ ID NO: 2482046 - DNA, 18 bp, Homo sapiens
ccccttctatttggggct

SEQ ID NO: 2482047 - DNA, 16 bp, Homo sapiens
ccccttgcctgtgcca

SEQ ID NO: 2482048 - DNA, 16 bp, Homo sapiens
ccccttgggcccacac

SEQ ID NO: 2482049 - DNA, 18 bp, Homo sapiens
ccccttgtcctttccctt

SEQ ID NO: 2482050 - DNA, 16 bp, Homo sapiens
cccctttcacaggcag

SEQ ID NO: 2482051 - DNA, 21 bp, Homo sapiens
cccctttcacaggcagccagt

SEQ ID NO: 2482052 - DNA, 10 bp, Homo sapiens
cccctttcct

SEQ ID NO: 2482053 - DNA, 22 bp, Homo sapiens
cccctttcctggacactcagac

SEQ ID NO: 2482054 - DNA, 23 bp, Homo sapiens
cccctttcctggacactcagacc

SEQ ID NO: 2482055 - DNA, 22 bp, Homo sapiens
ccccttttcggccccatgtatc

SEQ ID NO: 2482056 - DNA, 14 bp, Homo sapiens
cccgagctcctctt

SEQ ID NO: 2482057 - DNA, 23 bp, Homo sapiens
cccgagtcattcgttctgtggag

SEQ ID NO: 2482058 - DNA, 15 bp, Homo sapiens
cccgcagacaccttg

SEQ ID NO: 2482059 - DNA, 23 bp, Homo sapiens
cccgcagtgggagcaaactgcat

SEQ ID NO: 2482060 - DNA, 12 bp, Homo sapiens
cccgcctgccct

SEQ ID NO: 2482061 - DNA, 17 bp, Homo sapiens
cccgcctgccctcatgg

SEQ ID NO: 2482062 - DNA, 14 bp, Homo sapiens
cccgccttggcctg

SEQ ID NO: 2482063 - DNA, 23 bp, Homo sapiens
cccggagaagtgtgccttctctc

SEQ ID NO: 2482064 - DNA, 16 bp, Homo sapiens
cccggcaccccctgca

SEQ ID NO: 2482065 - DNA, 14 bp, Homo sapiens
cccggcagggcggg

SEQ ID NO: 2482066 - DNA, 22 bp, Homo sapiens
cccggctcctggtcacctagga

SEQ ID NO: 2482067 - DNA, 21 bp, Homo sapiens
cccggctgcagaggccagagg

SEQ ID NO: 2482068 - DNA, 22 bp, Homo sapiens
cccggggaaaggcaaggtccgg

SEQ ID NO: 2482069 - DNA, 21 bp, Homo sapiens
cccggggtgcccacaggccgc

SEQ ID NO: 2482070 - DNA, 17 bp, Homo sapiens
cccgtcctgcctgtggc

SEQ ID NO: 2482071 - DNA, 12 bp, Homo sapiens
cccgtctcagtg

SEQ ID NO: 2482072 - DNA, 18 bp, Homo sapiens
cccgtgtaaatatgtaca

SEQ ID NO: 2482073 - DNA, 16 bp, Homo sapiens
cccgtttctccaccta

SEQ ID NO: 2482074 - DNA, 13 bp, Homo sapiens
cccgttttgtcac

SEQ ID NO: 2482075 - DNA, 14 bp, Homo sapiens
ccctacatgtattg

SEQ ID NO: 2482076 - DNA, 14 bp, Homo sapiens
ccctacctgcccca

SEQ ID NO: 2482077 - DNA, 12 bp, Homo sapiens
ccctaggtgttt

SEQ ID NO: 2482078 - DNA, 19 bp, Homo sapiens
ccctatactgtagtattct

SEQ ID NO: 2482079 - DNA, 18 bp, Homo sapiens
ccctatttattgactttg

SEQ ID NO: 2482080 - DNA, 16 bp, Homo sapiens
ccctcaccctgcctta

SEQ ID NO: 2482081 - DNA, 21 bp, Homo sapiens
ccctcacctgtagcagccagt

SEQ ID NO: 2482082 - DNA, 17 bp, Homo sapiens
ccctcactcgtctcccc

SEQ ID NO: 2482083 - DNA, 15 bp, Homo sapiens
ccctcagactggggc

SEQ ID NO: 2482084 - DNA, 20 bp, Homo sapiens
ccctcagcctgtaccggttt

SEQ ID NO: 2482085 - DNA, 19 bp, Homo sapiens
ccctcagggcaaagccagg

SEQ ID NO: 2482086 - DNA, 17 bp, Homo sapiens
ccctcatctctctgccc

SEQ ID NO: 2482087 - DNA, 14 bp, Homo sapiens
ccctcatctgtccc

SEQ ID NO: 2482088 - DNA, 16 bp, Homo sapiens
ccctcatggcccctct

SEQ ID NO: 2482089 - DNA, 17 bp, Homo sapiens
ccctcatggcccctctg

SEQ ID NO: 2482090 - DNA, 21 bp, Homo sapiens
ccctcatggcccctctgacct

SEQ ID NO: 2482091 - DNA, 22 bp, Homo sapiens
ccctccaagtggtccacaagct

SEQ ID NO: 2482092 - DNA, 13 bp, Homo sapiens
ccctccccctgag

SEQ ID NO: 2482093 - DNA, 12 bp, Homo sapiens
ccctcccccttg

SEQ ID NO: 2482094 - DNA, 15 bp, Homo sapiens
ccctccgccctgcca

SEQ ID NO: 2482095 - DNA, 19 bp, Homo sapiens
ccctcctctagctgtgggg

SEQ ID NO: 2482096 - DNA, 13 bp, Homo sapiens
ccctcctggctct

SEQ ID NO: 2482097 - DNA, 17 bp, Homo sapiens
ccctcctggtgccacct

SEQ ID NO: 2482098 - DNA, 20 bp, Homo sapiens
ccctcctgttgggagagggc

SEQ ID NO: 2482099 - DNA, 13 bp, Homo sapiens
ccctccttcccaa

SEQ ID NO: 2482100 - DNA, 13 bp, Homo sapiens
ccctctcaccaaa

SEQ ID NO: 2482101 - DNA, 17 bp, Homo sapiens
ccctctcagctccaggt

SEQ ID NO: 2482102 - DNA, 11 bp, Homo sapiens
ccctctcccac

SEQ ID NO: 2482103 - DNA, 12 bp, Homo sapiens
ccctctcccacc

SEQ ID NO: 2482104 - DNA, 13 bp, Homo sapiens
ccctctcccaccc

SEQ ID NO: 2482105 - DNA, 17 bp, Homo sapiens
ccctctcccaccctctt

SEQ ID NO: 2482106 - DNA, 13 bp, Homo sapiens
ccctctccctgca

SEQ ID NO: 2482107 - DNA, 15 bp, Homo sapiens
ccctctctgctctgc

SEQ ID NO: 2482108 - DNA, 14 bp, Homo sapiens
ccctctgacctgca

SEQ ID NO: 2482109 - DNA, 15 bp, Homo sapiens
ccctctgacctgcac

SEQ ID NO: 2482110 - DNA, 16 bp, Homo sapiens
ccctctgacctgcact

SEQ ID NO: 2482111 - DNA, 19 bp, Homo sapiens
ccctctgacctgcactggg

SEQ ID NO: 2482112 - DNA, 14 bp, Homo sapiens
ccctctgctgctgt

SEQ ID NO: 2482113 - DNA, 15 bp, Homo sapiens
ccctctgctgctgtc

SEQ ID NO: 2482114 - DNA, 12 bp, Homo sapiens
ccctctggaggg

SEQ ID NO: 2482115 - DNA, 10 bp, Homo sapiens
ccctctgggc

SEQ ID NO: 2482116 - DNA, 18 bp, Homo sapiens
ccctctggtcgctcctgc

SEQ ID NO: 2482117 - DNA, 20 bp, Homo sapiens
ccctctgtccaggcactgag

SEQ ID NO: 2482118 - DNA, 20 bp, Homo sapiens
ccctctgtgtatttgctttt

SEQ ID NO: 2482119 - DNA, 17 bp, Homo sapiens
ccctgaaggggccatga

SEQ ID NO: 2482120 - DNA, 22 bp, Homo sapiens
ccctgaccactcagagacatgc

SEQ ID NO: 2482121 - DNA, 16 bp, Homo sapiens
ccctgaccagctcccc

SEQ ID NO: 2482122 - DNA, 20 bp, Homo sapiens
ccctgacctgtgagcccagc

SEQ ID NO: 2482123 - DNA, 18 bp, Homo sapiens
ccctgagccagggtctcc

SEQ ID NO: 2482124 - DNA, 19 bp, Homo sapiens
ccctgagccagggtctcca

SEQ ID NO: 2482125 - DNA, 12 bp, Homo sapiens
ccctgagccggc

SEQ ID NO: 2482126 - DNA, 20 bp, Homo sapiens
ccctgagctagaaccctctg

SEQ ID NO: 2482127 - DNA, 14 bp, Homo sapiens
ccctgagctgacca

SEQ ID NO: 2482128 - DNA, 14 bp, Homo sapiens
ccctgaggagtctg

SEQ ID NO: 2482129 - DNA, 22 bp, Homo sapiens
ccctgaggagtctgaggtcctg

SEQ ID NO: 2482130 - DNA, 22 bp, Homo sapiens
ccctgcacagtgacttctgaga

SEQ ID NO: 2482131 - DNA, 17 bp, Homo sapiens
ccctgcactgtaaaatg

SEQ ID NO: 2482132 - DNA, 20 bp, Homo sapiens
ccctgcactgtaaaatgtgg

SEQ ID NO: 2482133 - DNA, 14 bp, Homo sapiens
ccctgcagaccctg

SEQ ID NO: 2482134 - DNA, 16 bp, Homo sapiens
ccctgcagaccctgcc

SEQ ID NO: 2482135 - DNA, 19 bp, Homo sapiens
ccctgcagaccctgccctt

SEQ ID NO: 2482136 - DNA, 19 bp, Homo sapiens
ccctgcagcttgtagccag

SEQ ID NO: 2482137 - DNA, 18 bp, Homo sapiens
ccctgcaggaaggagctg

SEQ ID NO: 2482138 - DNA, 19 bp, Homo sapiens
ccctgcaggaaggagctgc

SEQ ID NO: 2482139 - DNA, 21 bp, Homo sapiens
ccctgcaggaaggagctgcct

SEQ ID NO: 2482140 - DNA, 23 bp, Homo sapiens
ccctgcaggaaggagctgcctgg

SEQ ID NO: 2482141 - DNA, 22 bp, Homo sapiens
ccctgcattggaactggaggca

SEQ ID NO: 2482142 - DNA, 15 bp, Homo sapiens
ccctgccaccaggcc

SEQ ID NO: 2482143 - DNA, 18 bp, Homo sapiens
ccctgccactcactaggc

SEQ ID NO: 2482144 - DNA, 12 bp, Homo sapiens
ccctgcccccca

SEQ ID NO: 2482145 - DNA, 19 bp, Homo sapiens
ccctgccccccagcctctg

SEQ ID NO: 2482146 - DNA, 21 bp, Homo sapiens
ccctgccccccagcctctggc

SEQ ID NO: 2482147 - DNA, 17 bp, Homo sapiens
ccctgccccctgcagga

SEQ ID NO: 2482148 - DNA, 23 bp, Homo sapiens
ccctgcccttgtttggggcagga

SEQ ID NO: 2482149 - DNA, 19 bp, Homo sapiens
ccctgcctctcccaggcag

SEQ ID NO: 2482150 - DNA, 12 bp, Homo sapiens
ccctgcctggag

SEQ ID NO: 2482151 - DNA, 16 bp, Homo sapiens
ccctgcctggaggacc

SEQ ID NO: 2482152 - DNA, 22 bp, Homo sapiens
ccctgccttatcttgcacccca

SEQ ID NO: 2482153 - DNA, 22 bp, Homo sapiens
ccctgcgggtgaacaaagcagc

SEQ ID NO: 2482154 - DNA, 18 bp, Homo sapiens
ccctgctgccagcttcag

SEQ ID NO: 2482155 - DNA, 13 bp, Homo sapiens
ccctgctgccatg

SEQ ID NO: 2482156 - DNA, 10 bp, Homo sapiens
ccctgctttt

SEQ ID NO: 2482157 - DNA, 16 bp, Homo sapiens
ccctggacccagccag

SEQ ID NO: 2482158 - DNA, 21 bp, Homo sapiens
ccctggagggggaatggcagc

SEQ ID NO: 2482159 - DNA, 9 bp, Homo sapiens
ccctggccc

SEQ ID NO: 2482160 - DNA, 20 bp, Homo sapiens
ccctggccccctccctggat

SEQ ID NO: 2482161 - DNA, 20 bp, Homo sapiens
ccctggccgagtccaagctg

SEQ ID NO: 2482162 - DNA, 13 bp, Homo sapiens
ccctggcctcccc

SEQ ID NO: 2482163 - DNA, 24 bp, Homo sapiens
ccctggctttcattttctctcagg

SEQ ID NO: 2482164 - DNA, 22 bp, Homo sapiens
ccctgggagaatcgctcctgca

SEQ ID NO: 2482165 - DNA, 23 bp, Homo sapiens
ccctgggagggacatgcttagca

SEQ ID NO: 2482166 - DNA, 13 bp, Homo sapiens
ccctgggccttgg

SEQ ID NO: 2482167 - DNA, 13 bp, Homo sapiens
ccctgggctggaa

SEQ ID NO: 2482168 - DNA, 13 bp, Homo sapiens
ccctggggcctgt

SEQ ID NO: 2482169 - DNA, 14 bp, Homo sapiens
ccctggtcccctcc

SEQ ID NO: 2482170 - DNA, 23 bp, Homo sapiens
ccctggtgggccaacaaagaaca

SEQ ID NO: 2482171 - DNA, 11 bp, Homo sapiens
ccctgtaactt

SEQ ID NO: 2482172 - DNA, 18 bp, Homo sapiens
ccctgtacacaactcact

SEQ ID NO: 2482173 - DNA, 14 bp, Homo sapiens
ccctgtcctggtgg

SEQ ID NO: 2482174 - DNA, 17 bp, Homo sapiens
ccctgtccttagcctag

SEQ ID NO: 2482175 - DNA, 17 bp, Homo sapiens
ccctgtgcctcctccct

SEQ ID NO: 2482176 - DNA, 14 bp, Homo sapiens
ccaggaagtctcat

SEQ ID NO: 2482177 - DNA, 15 bp, Homo sapiens
ccaggaagtctcatc

SEQ ID NO: 2482178 - DNA, 12 bp, Homo sapiens
ccaggaccacag

SEQ ID NO: 2482179 - DNA, 21 bp, Homo sapiens
ccaggaccacaggctcaggca

SEQ ID NO: 2482180 - DNA, 20 bp, Homo sapiens
ccaggaccagctcaggacag

SEQ ID NO: 2482181 - DNA, 14 bp, Homo sapiens
ccaggaccctgaag

SEQ ID NO: 2482182 - DNA, 16 bp, Homo sapiens
ccaggaccctgaaggg

SEQ ID NO: 2482183 - DNA, 18 bp, Homo sapiens
ccaggaccctggacccag

SEQ ID NO: 2482184 - DNA, 19 bp, Homo sapiens
ccaggaccctggacccagc

SEQ ID NO: 2482185 - DNA, 17 bp, Homo sapiens
ccaggacctggctgcca

SEQ ID NO: 2482186 - DNA, 15 bp, Homo sapiens
ccaggagaagaaaga

SEQ ID NO: 2482187 - DNA, 11 bp, Homo sapiens
ccaggagaagc

SEQ ID NO: 2482188 - DNA, 19 bp, Homo sapiens
ccaggagcacggctctgtc

SEQ ID NO: 2482189 - DNA, 17 bp, Homo sapiens
ccaggagctccagtgtc

SEQ ID NO: 2482190 - DNA, 20 bp, Homo sapiens
ccaggagctccagtgtcctg

SEQ ID NO: 2482191 - DNA, 20 bp, Homo sapiens
ccaggagctcccctccccaa

SEQ ID NO: 2482192 - DNA, 15 bp, Homo sapiens
ccaggaggacccagg

SEQ ID NO: 2482193 - DNA, 22 bp, Homo sapiens
ccaggagggacaaaggagcctg

SEQ ID NO: 2482194 - DNA, 16 bp, Homo sapiens
ccaggatagagactgg

SEQ ID NO: 2482195 - DNA, 16 bp, Homo sapiens
ccaggcaaggctgtgg

SEQ ID NO: 2482196 - DNA, 17 bp, Homo sapiens
ccaggcaccaaaagaag

SEQ ID NO: 2482197 - DNA, 15 bp, Homo sapiens
ccaggcagatccagg

SEQ ID NO: 2482198 - DNA, 16 bp, Homo sapiens
ccaggcagatccagga

SEQ ID NO: 2482199 - DNA, 14 bp, Homo sapiens
ccaggcagcctctg

SEQ ID NO: 2482200 - DNA, 16 bp, Homo sapiens
ccaggcattgccaagg

SEQ ID NO: 2482201 - DNA, 13 bp, Homo sapiens
ccaggccacctcc

SEQ ID NO: 2482202 - DNA, 17 bp, Homo sapiens
ccaggccacctccccag

SEQ ID NO: 2482203 - DNA, 21 bp, Homo sapiens
ccaggccacctccccagcatt

SEQ ID NO: 2482204 - DNA, 13 bp, Homo sapiens
ccaggccaggact

SEQ ID NO: 2482205 - DNA, 17 bp, Homo sapiens
ccaggccaggactctgc

SEQ ID NO: 2482206 - DNA, 18 bp, Homo sapiens
ccaggccaggactctgca

SEQ ID NO: 2482207 - DNA, 20 bp, Homo sapiens
ccaggccaggactctgcagc

SEQ ID NO: 2482208 - DNA, 18 bp, Homo sapiens
ccaggccaggcatgtggc

SEQ ID NO: 2482209 - DNA, 18 bp, Homo sapiens
ccaggcccaaggctcccg

SEQ ID NO: 2482210 - DNA, 15 bp, Homo sapiens
ccaggccccatgacc

SEQ ID NO: 2482211 - DNA, 18 bp, Homo sapiens
ccaggccccatgacctcc

SEQ ID NO: 2482212 - DNA, 21 bp, Homo sapiens
ccaggccccatgacctccagc

SEQ ID NO: 2482213 - DNA, 22 bp, Homo sapiens
ccaggccccatgacctccagct

SEQ ID NO: 2482214 - DNA, 16 bp, Homo sapiens
ccaggcgctaattcaa

SEQ ID NO: 2482215 - DNA, 17 bp, Homo sapiens
ccaggctcggcctgccc

SEQ ID NO: 2482216 - DNA, 20 bp, Homo sapiens
ccaggctgaagcaggttccc

SEQ ID NO: 2482217 - DNA, 17 bp, Homo sapiens
ccaggctgaccacagca

SEQ ID NO: 2482218 - DNA, 14 bp, Homo sapiens
ccaggctgccgtcc

SEQ ID NO: 2482219 - DNA, 21 bp, Homo sapiens
ccaggctgccgtcccctagag

SEQ ID NO: 2482220 - DNA, 14 bp, Homo sapiens
ccaggctgccgtgg

SEQ ID NO: 2482221 - DNA, 18 bp, Homo sapiens
ccaggctgccgtggggcc

SEQ ID NO: 2482222 - DNA, 17 bp, Homo sapiens
ccaggctggtctaaaac

SEQ ID NO: 2482223 - DNA, 13 bp, Homo sapiens
ccaggcttctgct

SEQ ID NO: 2482224 - DNA, 15 bp, Homo sapiens
ccaggcttctgctgg

SEQ ID NO: 2482225 - DNA, 23 bp, Homo sapiens
ccaggcttctgctggggcctggg

SEQ ID NO: 2482226 - DNA, 20 bp, Homo sapiens
ccagggacacctgggagaaa

SEQ ID NO: 2482227 - DNA, 18 bp, Homo sapiens
ccagggacagaggcccca

SEQ ID NO: 2482228 - DNA, 20 bp, Homo sapiens
ccagggacagaggccccagc

SEQ ID NO: 2482229 - DNA, 15 bp, Homo sapiens
ccagggactctgccg

SEQ ID NO: 2482230 - DNA, 13 bp, Homo sapiens
ccagggagaagct

SEQ ID NO: 2482231 - DNA, 14 bp, Homo sapiens
ccagggagagccca

SEQ ID NO: 2482232 - DNA, 13 bp, Homo sapiens
ccagggagagggg

SEQ ID NO: 2482233 - DNA, 17 bp, Homo sapiens
ccagggcacaggagcta

SEQ ID NO: 2482234 - DNA, 20 bp, Homo sapiens
ccagggcatctctgggctgg

SEQ ID NO: 2482235 - DNA, 14 bp, Homo sapiens
ccagggccacgctc

SEQ ID NO: 2482236 - DNA, 13 bp, Homo sapiens
ccagggcccagag

SEQ ID NO: 2482237 - DNA, 16 bp, Homo sapiens
ccagggcccagagccc

SEQ ID NO: 2482238 - DNA, 17 bp, Homo sapiens
ccagggcccagagccca

SEQ ID NO: 2482239 - DNA, 22 bp, Homo sapiens
ccagggcccagagcccagctcc

SEQ ID NO: 2482240 - DNA, 22 bp, Homo sapiens
ccagggcccctcaccctgcctt

SEQ ID NO: 2482241 - DNA, 15 bp, Homo sapiens
ccagggcccctctcc

SEQ ID NO: 2482242 - DNA, 16 bp, Homo sapiens
ccagggctagtgactt

SEQ ID NO: 2482243 - DNA, 12 bp, Homo sapiens
ccagggctccag

SEQ ID NO: 2482244 - DNA, 14 bp, Homo sapiens
ccagggctccagcc

SEQ ID NO: 2482245 - DNA, 19 bp, Homo sapiens
ccagggctccagcccctct

SEQ ID NO: 2482246 - DNA, 15 bp, Homo sapiens
ccagggctgggagga

SEQ ID NO: 2482247 - DNA, 21 bp, Homo sapiens
ccagggctgggaggaaggact

SEQ ID NO: 2482248 - DNA, 19 bp, Homo sapiens
ccagggctgtaactgccag

SEQ ID NO: 2482249 - DNA, 19 bp, Homo sapiens
ccaggggaacactggggac

SEQ ID NO: 2482250 - DNA, 19 bp, Homo sapiens
ccaggggagcagaggggca

SEQ ID NO: 2482251 - DNA, 22 bp, Homo sapiens
ccaggggctgcttcctcctgga

SEQ ID NO: 2482252 - DNA, 16 bp, Homo sapiens
ccagggtccctctgtg

SEQ ID NO: 2482253 - DNA, 18 bp, Homo sapiens
ccagggtccctctgtgta

SEQ ID NO: 2482254 - DNA, 13 bp, Homo sapiens
ccagggtctccag

SEQ ID NO: 2482255 - DNA, 17 bp, Homo sapiens
ccagggtctccagaaag

SEQ ID NO: 2482256 - DNA, 21 bp, Homo sapiens
ccagggttgaccccagaggat

SEQ ID NO: 2482257 - DNA, 21 bp, Homo sapiens
ccagggttttgccccaagtcc

SEQ ID NO: 2482258 - DNA, 15 bp, Homo sapiens
ccaggtaggccaagg

SEQ ID NO: 2482259 - DNA, 21 bp, Homo sapiens
ccaggtaggccaaggtgtcct

SEQ ID NO: 2482260 - DNA, 20 bp, Homo sapiens
ccaggtcaccctttgctgtg

SEQ ID NO: 2482261 - DNA, 19 bp, Homo sapiens
ccaggtccaatgagctttc

SEQ ID NO: 2482262 - DNA, 20 bp, Homo sapiens
ccaggtccaatgagctttct

SEQ ID NO: 2482263 - DNA, 15 bp, Homo sapiens
ccaggtcctggtggg

SEQ ID NO: 2482264 - DNA, 20 bp, Homo sapiens
ccaggtctccctggatcaga

SEQ ID NO: 2482265 - DNA, 15 bp, Homo sapiens
ccaggtgaggtcagc

SEQ ID NO: 2482266 - DNA, 19 bp, Homo sapiens
ccaggtgaggtcagcacat

SEQ ID NO: 2482267 - DNA, 21 bp, Homo sapiens
ccaggttctccgttagctcct

SEQ ID NO: 2482268 - DNA, 24 bp, Homo sapiens
ccaggttctccgttagctcctgtg

SEQ ID NO: 2482269 - DNA, 14 bp, Homo sapiens
ccaggttggctctg

SEQ ID NO: 2482270 - DNA, 16 bp, Homo sapiens
ccaggttggctctgcc

SEQ ID NO: 2482271 - DNA, 17 bp, Homo sapiens
ccaggttggctctgcca

SEQ ID NO: 2482272 - DNA, 18 bp, Homo sapiens
ccaggttggctctgccag

SEQ ID NO: 2482273 - DNA, 24 bp, Homo sapiens
ccaggttggctctgccagtcctgt

SEQ ID NO: 2482274 - DNA, 21 bp, Homo sapiens
ccagtaacgcgtcttcctgag

SEQ ID NO: 2482275 - DNA, 14 bp, Homo sapiens
ccagtcaacctggg

SEQ ID NO: 2482276 - DNA, 13 bp, Homo sapiens
ccagtccaggctg

SEQ ID NO: 2482277 - DNA, 14 bp, Homo sapiens
ccagtccaggctgc

SEQ ID NO: 2482278 - DNA, 15 bp, Homo sapiens
ccagtccaggctgcc

SEQ ID NO: 2482279 - DNA, 19 bp, Homo sapiens
ccagtccaggctgccgtgg

SEQ ID NO: 2482280 - DNA, 15 bp, Homo sapiens
ccagtcccagagcag

SEQ ID NO: 2482281 - DNA, 22 bp, Homo sapiens
ccaacccgtctggcccaccagg

SEQ ID NO: 2482282 - DNA, 21 bp, Homo sapiens
ccaacccgtggaggctgctcg

SEQ ID NO: 2482283 - DNA, 17 bp, Homo sapiens
ccaacctgcaaagatct

SEQ ID NO: 2482284 - DNA, 18 bp, Homo sapiens
ccaacctgcaaagatctg

SEQ ID NO: 2482285 - DNA, 12 bp, Homo sapiens
ccaacctgctct

SEQ ID NO: 2482286 - DNA, 16 bp, Homo sapiens
ccaacctgctctcctc

SEQ ID NO: 2482287 - DNA, 18 bp, Homo sapiens
ccaacctgctctcctctt

SEQ ID NO: 2482288 - DNA, 22 bp, Homo sapiens
ccaactactaatagaataaagg

SEQ ID NO: 2482289 - DNA, 14 bp, Homo sapiens
ccaactatgattat

SEQ ID NO: 2482290 - DNA, 15 bp, Homo sapiens
ccaactcctagttct

SEQ ID NO: 2482291 - DNA, 15 bp, Homo sapiens
ccaactccttccagc

SEQ ID NO: 2482292 - DNA, 17 bp, Homo sapiens
ccaacttggctgcagga

SEQ ID NO: 2482293 - DNA, 18 bp, Homo sapiens
ccaagaatccacatttct

SEQ ID NO: 2482294 - DNA, 21 bp, Homo sapiens
ccaagactctagagtccaagg

SEQ ID NO: 2482295 - DNA, 22 bp, Homo sapiens
ccaagactgctgtggccaggag

SEQ ID NO: 2482296 - DNA, 18 bp, Homo sapiens
ccaagatgggcatctttt

SEQ ID NO: 2482297 - DNA, 13 bp, Homo sapiens
ccaagattccgga

SEQ ID NO: 2482298 - DNA, 20 bp, Homo sapiens
ccaagattccggatcctaag

SEQ ID NO: 2482299 - DNA, 14 bp, Homo sapiens
ccaagcacagcagc

SEQ ID NO: 2482300 - DNA, 18 bp, Homo sapiens
ccaagcacttctttttct

SEQ ID NO: 2482301 - DNA, 21 bp, Homo sapiens
ccaagcagttgggactacagg

SEQ ID NO: 2482302 - DNA, 22 bp, Homo sapiens
ccaagcatcttgggggggtggc

SEQ ID NO: 2482303 - DNA, 23 bp, Homo sapiens
ccaagcatcttgggggggtggcc

SEQ ID NO: 2482304 - DNA, 22 bp, Homo sapiens
ccaagccaagggaacctgtgtc

SEQ ID NO: 2482305 - DNA, 15 bp, Homo sapiens
ccaagcccagcccat

SEQ ID NO: 2482306 - DNA, 15 bp, Homo sapiens
ccaagctgaggtgcc

SEQ ID NO: 2482307 - DNA, 23 bp, Homo sapiens
ccaagctgaggtgcccaggagaa

SEQ ID NO: 2482308 - DNA, 17 bp, Homo sapiens
ccaagctgagtttccta

SEQ ID NO: 2482309 - DNA, 18 bp, Homo sapiens
ccaagctgagtttcctat

SEQ ID NO: 2482310 - DNA, 23 bp, Homo sapiens
ccaagctgcctcccctctccttc

SEQ ID NO: 2482311 - DNA, 14 bp, Homo sapiens
ccaaggaaaggcac

SEQ ID NO: 2482312 - DNA, 14 bp, Homo sapiens
ccaaggacctgaga

SEQ ID NO: 2482313 - DNA, 22 bp, Homo sapiens
ccaaggcagaggcctgggctgg

SEQ ID NO: 2482314 - DNA, 17 bp, Homo sapiens
ccaagggaacctgtgtc

SEQ ID NO: 2482315 - DNA, 18 bp, Homo sapiens
ccaagggatggacatctt

SEQ ID NO: 2482316 - DNA, 22 bp, Homo sapiens
ccaaggggatttttatgtctgg

SEQ ID NO: 2482317 - DNA, 15 bp, Homo sapiens
ccaaggggcctgagc

SEQ ID NO: 2482318 - DNA, 16 bp, Homo sapiens
ccaaggtgtcctacag

SEQ ID NO: 2482319 - DNA, 17 bp, Homo sapiens
ccaaggtgtcctacaga

SEQ ID NO: 2482320 - DNA, 18 bp, Homo sapiens
ccaaggtgtcctacagaa

SEQ ID NO: 2482321 - DNA, 19 bp, Homo sapiens
ccaaggtgtcctacagaaa

SEQ ID NO: 2482322 - DNA, 21 bp, Homo sapiens
ccaaggtgtcctacagaaaaa

SEQ ID NO: 2482323 - DNA, 22 bp, Homo sapiens
ccaagtagaatctcagttgatt

SEQ ID NO: 2482324 - DNA, 15 bp, Homo sapiens
ccaagtccaggtcct

SEQ ID NO: 2482325 - DNA, 18 bp, Homo sapiens
ccaagtccaggtcctggt

SEQ ID NO: 2482326 - DNA, 17 bp, Homo sapiens
ccaagtgaggcagccga

SEQ ID NO: 2482327 - DNA, 18 bp, Homo sapiens
ccaagtgaggcagccgag

SEQ ID NO: 2482328 - DNA, 14 bp, Homo sapiens
ccaatcctatgttt

SEQ ID NO: 2482329 - DNA, 20 bp, Homo sapiens
ccaatgagctttctgaacag

SEQ ID NO: 2482330 - DNA, 23 bp, Homo sapiens
ccaatgagctttctgaacagctg

SEQ ID NO: 2482331 - DNA, 20 bp, Homo sapiens
ccaatgggtttttccctgta

SEQ ID NO: 2482332 - DNA, 15 bp, Homo sapiens
ccaattagtttcctt

SEQ ID NO: 2482333 - DNA, 16 bp, Homo sapiens
ccaatttcagactccc

SEQ ID NO: 2482334 - DNA, 21 bp, Homo sapiens
ccaatttcggattttttccaa

SEQ ID NO: 2482335 - DNA, 12 bp, Homo sapiens
ccacaacatgag

SEQ ID NO: 2482336 - DNA, 16 bp, Homo sapiens
ccacaacatgaggcca

SEQ ID NO: 2482337 - DNA, 15 bp, Homo sapiens
ccacaactattttca

SEQ ID NO: 2482338 - DNA, 14 bp, Homo sapiens
ccacaagcctgagg

SEQ ID NO: 2482339 - DNA, 17 bp, Homo sapiens
ccacaaggacttcctgt

SEQ ID NO: 2482340 - DNA, 16 bp, Homo sapiens
ccacaagtgccctcca

SEQ ID NO: 2482341 - DNA, 20 bp, Homo sapiens
ccacaagtgccctccaggct

SEQ ID NO: 2482342 - DNA, 19 bp, Homo sapiens
ccacaccctgtactgttct

SEQ ID NO: 2482343 - DNA, 15 bp, Homo sapiens
ccacacctccttccc

SEQ ID NO: 2482344 - DNA, 19 bp, Homo sapiens
ccacactcagatcctcctc

SEQ ID NO: 2482345 - DNA, 14 bp, Homo sapiens
ccacactcagcaca

SEQ ID NO: 2482346 - DNA, 17 bp, Homo sapiens
ccacacttctcaggaca

SEQ ID NO: 2482347 - DNA, 24 bp, Homo sapiens
ccacacttctcaggacacaggcct

SEQ ID NO: 2482348 - DNA, 22 bp, Homo sapiens
ccacagacggaagggtaaacaa

SEQ ID NO: 2482349 - DNA, 23 bp, Homo sapiens
ccacagacggaagggtaaacaat

SEQ ID NO: 2482350 - DNA, 16 bp, Homo sapiens
ccacagataactgaaa

SEQ ID NO: 2482351 - DNA, 17 bp, Homo sapiens
ccacagccagcacctgg

SEQ ID NO: 2482352 - DNA, 19 bp, Homo sapiens
ccacagccagcacctggca

SEQ ID NO: 2482353 - DNA, 22 bp, Homo sapiens
ccacagccagcacctggcatcg

SEQ ID NO: 2482354 - DNA, 14 bp, Homo sapiens
ccacagccctgtca

SEQ ID NO: 2482355 - DNA, 16 bp, Homo sapiens
ccacagcctcccctgc

SEQ ID NO: 2482356 - DNA, 19 bp, Homo sapiens
ccacagcctcccctgccag

SEQ ID NO: 2482357 - DNA, 15 bp, Homo sapiens
ccacagcttttgcaa

SEQ ID NO: 2482358 - DNA, 23 bp, Homo sapiens
ccacaggaagcctgcagtcctgg

SEQ ID NO: 2482359 - DNA, 17 bp, Homo sapiens
ccacaggccgccctgcg

SEQ ID NO: 2482360 - DNA, 17 bp, Homo sapiens
ccacaggctcaggcagg

SEQ ID NO: 2482361 - DNA, 21 bp, Homo sapiens
ccacaggctcaggcaggggcc

SEQ ID NO: 2482362 - DNA, 19 bp, Homo sapiens
ccacagggtcccacagcca

SEQ ID NO: 2482363 - DNA, 21 bp, Homo sapiens
ccacagggtcccacagccacg

SEQ ID NO: 2482364 - DNA, 14 bp, Homo sapiens
ccacaggtctagac

SEQ ID NO: 2482365 - DNA, 22 bp, Homo sapiens
ccacaggttcatgccaccatgg

SEQ ID NO: 2482366 - DNA, 17 bp, Homo sapiens
ccacagtagtcttgatg

SEQ ID NO: 2482367 - DNA, 19 bp, Homo sapiens
ccacagtgtcaggcactgg

SEQ ID NO: 2482368 - DNA, 13 bp, Homo sapiens
ccacatccctggg

SEQ ID NO: 2482369 - DNA, 16 bp, Homo sapiens
ccacatccctgggcct

SEQ ID NO: 2482370 - DNA, 17 bp, Homo sapiens
ccacatccctgggcctg

SEQ ID NO: 2482371 - DNA, 19 bp, Homo sapiens
ccacatccctgggcctgct

SEQ ID NO: 2482372 - DNA, 15 bp, Homo sapiens
ccacatggcacagag

SEQ ID NO: 2482373 - DNA, 16 bp, Homo sapiens
ccacatgggaggctca

SEQ ID NO: 2482374 - DNA, 19 bp, Homo sapiens
ccacattggaagagcagca

SEQ ID NO: 2482375 - DNA, 19 bp, Homo sapiens
ccacatttggaatactttt

SEQ ID NO: 2482376 - DNA, 17 bp, Homo sapiens
ccaccaagacttgtttt

SEQ ID NO: 2482377 - DNA, 15 bp, Homo sapiens
ccaccacagccagca

SEQ ID NO: 2482378 - DNA, 12 bp, Homo sapiens
ccaccagatgct

SEQ ID NO: 2482379 - DNA, 14 bp, Homo sapiens
ccaccagctgtgtc

SEQ ID NO: 2482380 - DNA, 21 bp, Homo sapiens
ccaccaggccacctccccagc

SEQ ID NO: 2482381 - DNA, 16 bp, Homo sapiens
ccaccagggcatctct

SEQ ID NO: 2482382 - DNA, 19 bp, Homo sapiens
ccaccagggcatctctggg

SEQ ID NO: 2482383 - DNA, 21 bp, Homo sapiens
ccaccagggcatctctgggct

SEQ ID NO: 2482384 - DNA, 21 bp, Homo sapiens
ccaccatggccagccaacttt

SEQ ID NO: 2482385 - DNA, 21 bp, Homo sapiens
catctgtataccctctgtttc

SEQ ID NO: 2482386 - DNA, 12 bp, Homo sapiens
catctgtccccc

SEQ ID NO: 2482387 - DNA, 13 bp, Homo sapiens
catctgtccccct

SEQ ID NO: 2482388 - DNA, 23 bp, Homo sapiens
catctgtctgccaacctaaaact

SEQ ID NO: 2482389 - DNA, 17 bp, Homo sapiens
catctgtgcactgccca

SEQ ID NO: 2482390 - DNA, 21 bp, Homo sapiens
catctgtgcactgcccatgga

SEQ ID NO: 2482391 - DNA, 14 bp, Homo sapiens
catcttcagttgtc

SEQ ID NO: 2482392 - DNA, 23 bp, Homo sapiens
catcttcagttgtctctgatgca

SEQ ID NO: 2482393 - DNA, 16 bp, Homo sapiens
catcttgctaccagta

SEQ ID NO: 2482394 - DNA, 14 bp, Homo sapiens
catcttgcttccct

SEQ ID NO: 2482395 - DNA, 12 bp, Homo sapiens
catctttgaaat

SEQ ID NO: 2482396 - DNA, 18 bp, Homo sapiens
catctttgaaattatgta

SEQ ID NO: 2482397 - DNA, 22 bp, Homo sapiens
catcttttgtattaagaaagga

SEQ ID NO: 2482398 - DNA, 20 bp, Homo sapiens
catgaaaaatcatgggccag

SEQ ID NO: 2482399 - DNA, 17 bp, Homo sapiens
catgaaggtaaataaaa

SEQ ID NO: 2482400 - DNA, 20 bp, Homo sapiens
catgaaggtaaataaaaaga

SEQ ID NO: 2482401 - DNA, 21 bp, Homo sapiens
catgaaggtaaataaaaagaa

SEQ ID NO: 2482402 - DNA, 22 bp, Homo sapiens
catgaaggtaaataaaaagaaa

SEQ ID NO: 2482403 - DNA, 21 bp, Homo sapiens
catgaagtattttttcagtat

SEQ ID NO: 2482404 - DNA, 16 bp, Homo sapiens
catgaatgtaaatttg

SEQ ID NO: 2482405 - DNA, 17 bp, Homo sapiens
catgaatgtaaatttgt

SEQ ID NO: 2482406 - DNA, 18 bp, Homo sapiens
catgaattattacagtgt

SEQ ID NO: 2482407 - DNA, 18 bp, Homo sapiens
catgaatttgtaatgtct

SEQ ID NO: 2482408 - DNA, 15 bp, Homo sapiens
catgaattttagctt

SEQ ID NO: 2482409 - DNA, 16 bp, Homo sapiens
catgaattttagcttt

SEQ ID NO: 2482410 - DNA, 14 bp, Homo sapiens
catgacagcctcca

SEQ ID NO: 2482411 - DNA, 15 bp, Homo sapiens
catgaccctgcctct

SEQ ID NO: 2482412 - DNA, 13 bp, Homo sapiens
catgacctccagc

SEQ ID NO: 2482413 - DNA, 13 bp, Homo sapiens
catgagaaataca

SEQ ID NO: 2482414 - DNA, 22 bp, Homo sapiens
catgagaaatacaaaaatactc

SEQ ID NO: 2482415 - DNA, 16 bp, Homo sapiens
catgagaacaaacaga

SEQ ID NO: 2482416 - DNA, 19 bp, Homo sapiens
catgagaccactgttatca

SEQ ID NO: 2482417 - DNA, 20 bp, Homo sapiens
catgaggactctattcttta

SEQ ID NO: 2482418 - DNA, 19 bp, Homo sapiens
catgaggagattctgcctt

SEQ ID NO: 2482419 - DNA, 20 bp, Homo sapiens
catgaggagattctgccttt

SEQ ID NO: 2482420 - DNA, 21 bp, Homo sapiens
catgaggggttcctcccctcc

SEQ ID NO: 2482421 - DNA, 14 bp, Homo sapiens
catgagtgaataaa

SEQ ID NO: 2482422 - DNA, 20 bp, Homo sapiens
catgagttccagaaagtaaa

SEQ ID NO: 2482423 - DNA, 19 bp, Homo sapiens
catgataccacctttactg

SEQ ID NO: 2482424 - DNA, 21 bp, Homo sapiens
catgataccacctttactgtg

SEQ ID NO: 2482425 - DNA, 16 bp, Homo sapiens
catgatgcctctgtct

SEQ ID NO: 2482426 - DNA, 13 bp, Homo sapiens
catgattccttta

SEQ ID NO: 2482427 - DNA, 14 bp, Homo sapiens
catgatttccttga

SEQ ID NO: 2482428 - DNA, 16 bp, Homo sapiens
catgatttccttgaat

SEQ ID NO: 2482429 - DNA, 21 bp, Homo sapiens
catgattttaagtttctctgc

SEQ ID NO: 2482430 - DNA, 17 bp, Homo sapiens
catgcacagtatttgta

SEQ ID NO: 2482431 - DNA, 22 bp, Homo sapiens
catgcacagtatttgtaattaa

SEQ ID NO: 2482432 - DNA, 14 bp, Homo sapiens
catgcactgatgtt

SEQ ID NO: 2482433 - DNA, 10 bp, Homo sapiens
catgcactgt

SEQ ID NO: 2482434 - DNA, 16 bp, Homo sapiens
catgcactgtgaagga

SEQ ID NO: 2482435 - DNA, 20 bp, Homo sapiens
catgcactgtgaaggaccct

SEQ ID NO: 2482436 - DNA, 21 bp, Homo sapiens
catgccagctacttcctcctc

SEQ ID NO: 2482437 - DNA, 19 bp, Homo sapiens
catgccagtaacaggctca

SEQ ID NO: 2482438 - DNA, 17 bp, Homo sapiens
catgccatttgtactga

SEQ ID NO: 2482439 - DNA, 17 bp, Homo sapiens
catgcccagagacccag

SEQ ID NO: 2482440 - DNA, 14 bp, Homo sapiens
catgccctgtgcaa

SEQ ID NO: 2482441 - DNA, 18 bp, Homo sapiens
catgccctgtgcaacctc

SEQ ID NO: 2482442 - DNA, 18 bp, Homo sapiens
catgcctcagaagtgcat

SEQ ID NO: 2482443 - DNA, 13 bp, Homo sapiens
catgcctctgagg

SEQ ID NO: 2482444 - DNA, 17 bp, Homo sapiens
catgcctctgaggccag

SEQ ID NO: 2482445 - DNA, 21 bp, Homo sapiens
catgcctctgaggccagcctg

SEQ ID NO: 2482446 - DNA, 17 bp, Homo sapiens
catgcgatgacacttgt

SEQ ID NO: 2482447 - DNA, 15 bp, Homo sapiens
catgcgctcagggcc

SEQ ID NO: 2482448 - DNA, 13 bp, Homo sapiens
catgcggtagcca

SEQ ID NO: 2482449 - DNA, 19 bp, Homo sapiens
catgcggtagccagcacac

SEQ ID NO: 2482450 - DNA, 17 bp, Homo sapiens
catgctaagagaagtag

SEQ ID NO: 2482451 - DNA, 21 bp, Homo sapiens
catgctaagagaagtagaaat

SEQ ID NO: 2482452 - DNA, 18 bp, Homo sapiens
catgctcatctgctggtc

SEQ ID NO: 2482453 - DNA, 17 bp, Homo sapiens
catgctcctcttcccca

SEQ ID NO: 2482454 - DNA, 18 bp, Homo sapiens
catgctcctcttccccag

SEQ ID NO: 2482455 - DNA, 17 bp, Homo sapiens
catgctgaggcctgggc

SEQ ID NO: 2482456 - DNA, 16 bp, Homo sapiens
catgctgctggggaag

SEQ ID NO: 2482457 - DNA, 17 bp, Homo sapiens
catgctgctggggaaga

SEQ ID NO: 2482458 - DNA, 17 bp, Homo sapiens
catgcttattccatgac

SEQ ID NO: 2482459 - DNA, 15 bp, Homo sapiens
catggaaatttaaag

SEQ ID NO: 2482460 - DNA, 17 bp, Homo sapiens
catggaaatttaaagca

SEQ ID NO: 2482461 - DNA, 15 bp, Homo sapiens
catggaacacttcga

SEQ ID NO: 2482462 - DNA, 23 bp, Homo sapiens
catggacaatggaccggagagtg

SEQ ID NO: 2482463 - DNA, 16 bp, Homo sapiens
catggacaggctggct

SEQ ID NO: 2482464 - DNA, 14 bp, Homo sapiens
catggagaaagctg

SEQ ID NO: 2482465 - DNA, 15 bp, Homo sapiens
catggagaaagctga

SEQ ID NO: 2482466 - DNA, 20 bp, Homo sapiens
catggagaaagctgacttgg

SEQ ID NO: 2482467 - DNA, 19 bp, Homo sapiens
catggaggaggagggaggc

SEQ ID NO: 2482468 - DNA, 23 bp, Homo sapiens
catggaggaggagggaggcgctg

SEQ ID NO: 2482469 - DNA, 13 bp, Homo sapiens
catggagtggcag

SEQ ID NO: 2482470 - DNA, 23 bp, Homo sapiens
catggagtggcagcccagccagc

SEQ ID NO: 2482471 - DNA, 19 bp, Homo sapiens
catggatgggggaactcag

SEQ ID NO: 2482472 - DNA, 22 bp, Homo sapiens
catggcacagagattctgaact

SEQ ID NO: 2482473 - DNA, 19 bp, Homo sapiens
catggcagatgtaggaggg

SEQ ID NO: 2482474 - DNA, 20 bp, Homo sapiens
catggcagatgtaggaggga

SEQ ID NO: 2482475 - DNA, 13 bp, Homo sapiens
catggcagggggc

SEQ ID NO: 2482476 - DNA, 18 bp, Homo sapiens
catggcagggggctgctg

SEQ ID NO: 2482477 - DNA, 19 bp, Homo sapiens
catggcagggggctgctgc

SEQ ID NO: 2482478 - DNA, 16 bp, Homo sapiens
catggcatcctccagc

SEQ ID NO: 2482479 - DNA, 18 bp, Homo sapiens
catggcatcctccagccc

SEQ ID NO: 2482480 - DNA, 13 bp, Homo sapiens
catggccagcagc

SEQ ID NO: 2482481 - DNA, 23 bp, Homo sapiens
catggccagcagcacctgcccta

SEQ ID NO: 2482482 - DNA, 14 bp, Homo sapiens
catggccagctgga

SEQ ID NO: 2482483 - DNA, 15 bp, Homo sapiens
catggccctgagcga

SEQ ID NO: 2482484 - DNA, 16 bp, Homo sapiens
catggcctgcaaactg

SEQ ID NO: 2482485 - DNA, 20 bp, Homo sapiens
catggcgtggaggaggaggg

SEQ ID NO: 2482486 - DNA, 17 bp, Homo sapiens
catggctattttatatt

SEQ ID NO: 2482487 - DNA, 22 bp, Homo sapiens
catgggagccgggtctgcctct

SEQ ID NO: 2482488 - DNA, 14 bp, Homo sapiens
catgggaggctcac

SEQ ID NO: 2482489 - DNA, 22 bp, Homo sapiens
catgggccagagcctcggccct

SEQ ID NO: 2482490 - DNA, 11 bp, Homo sapiens
catggggaggg

SEQ ID NO: 2482491 - DNA, 20 bp, Homo sapiens
catggggagggattctggtt

SEQ ID NO: 2482492 - DNA, 14 bp, Homo sapiens
catggtcacacact

SEQ ID NO: 2482493 - DNA, 16 bp, Homo sapiens
catggtctgccctctg

SEQ ID NO: 2482494 - DNA, 18 bp, Homo sapiens
catggtgccccaggacca

SEQ ID NO: 2482495 - DNA, 20 bp, Homo sapiens
catggtgccccaggaccagc

SEQ ID NO: 2482496 - DNA, 21 bp, Homo sapiens
catggtgggtccatgggcaga

SEQ ID NO: 2482497 - DNA, 14 bp, Homo sapiens
catggtgttctcct

SEQ ID NO: 2482498 - DNA, 19 bp, Homo sapiens
catggttaagagtccaaga

SEQ ID NO: 2482499 - DNA, 15 bp, Homo sapiens
catggtttcagcact

SEQ ID NO: 2482500 - DNA, 16 bp, Homo sapiens
catggtttcagcacta

SEQ ID NO: 2482501 - DNA, 14 bp, Homo sapiens
catgtaaataatac

SEQ ID NO: 2482502 - DNA, 14 bp, Homo sapiens
catgtaactgccta

SEQ ID NO: 2482503 - DNA, 20 bp, Homo sapiens
catgtaactgcctagaaaca

SEQ ID NO: 2482504 - DNA, 22 bp, Homo sapiens
catgtactgagccttgtaattc

SEQ ID NO: 2482505 - DNA, 18 bp, Homo sapiens
catgtaggaagtaggaag

SEQ ID NO: 2482506 - DNA, 19 bp, Homo sapiens
catgtagtaacactaatat

SEQ ID NO: 2482507 - DNA, 21 bp, Homo sapiens
catgtagtaacactaatatat

SEQ ID NO: 2482508 - DNA, 21 bp, Homo sapiens
catgtattgcacattgtaaaa

SEQ ID NO: 2482509 - DNA, 15 bp, Homo sapiens
catgtatttggtgat

SEQ ID NO: 2482510 - DNA, 20 bp, Homo sapiens
catgtatttggtgattacat

SEQ ID NO: 2482511 - DNA, 18 bp, Homo sapiens
catgtcaagggttcaaga

SEQ ID NO: 2482512 - DNA, 13 bp, Homo sapiens
catgtccaaagag

SEQ ID NO: 2482513 - DNA, 14 bp, Homo sapiens
catgtccaaagagg

SEQ ID NO: 2482514 - DNA, 18 bp, Homo sapiens
catgtccaaagaggctgc

SEQ ID NO: 2482515 - DNA, 21 bp, Homo sapiens
catgtccaaagaggctgcccc

SEQ ID NO: 2482516 - DNA, 13 bp, Homo sapiens
catgtcctgccta

SEQ ID NO: 2482517 - DNA, 22 bp, Homo sapiens
catgtcctgcctattatctgtc

SEQ ID NO: 2482518 - DNA, 14 bp, Homo sapiens
catgtcttctccct

SEQ ID NO: 2482519 - DNA, 15 bp, Homo sapiens
catgtcttctccctg

SEQ ID NO: 2482520 - DNA, 12 bp, Homo sapiens
catgtgacattt

SEQ ID NO: 2482521 - DNA, 20 bp, Homo sapiens
catgtgagcatgtcacttcc

SEQ ID NO: 2482522 - DNA, 22 bp, Homo sapiens
catgtgccagggcaatgatgaa

SEQ ID NO: 2482523 - DNA, 18 bp, Homo sapiens
catgtgctgccctacagc

SEQ ID NO: 2482524 - DNA, 24 bp, Homo sapiens
catgtgctgccctacagcaccctg

SEQ ID NO: 2482525 - DNA, 14 bp, Homo sapiens
catgtggggccagg

SEQ ID NO: 2482526 - DNA, 14 bp, Homo sapiens
catgtgtataaaaa

SEQ ID NO: 2482527 - DNA, 18 bp, Homo sapiens
catgtgtgcaacagggta

SEQ ID NO: 2482528 - DNA, 23 bp, Homo sapiens
catgtgtgtccacgactgtctcc

SEQ ID NO: 2482529 - DNA, 23 bp, Homo sapiens
catgtgtgttaacccagtgcttt

SEQ ID NO: 2482530 - DNA, 15 bp, Homo sapiens
catgtgttatgtttt

SEQ ID NO: 2482531 - DNA, 16 bp, Homo sapiens
catgtgttatgttttc

SEQ ID NO: 2482532 - DNA, 22 bp, Homo sapiens
catgttagttaccttatagtta

SEQ ID NO: 2482533 - DNA, 24 bp, Homo sapiens
catgttagttaccttatagttact

SEQ ID NO: 2482534 - DNA, 14 bp, Homo sapiens
catgttctgtccct

SEQ ID NO: 2482535 - DNA, 19 bp, Homo sapiens
catgttgaagccactgcct

SEQ ID NO: 2482536 - DNA, 21 bp, Homo sapiens
catgttggccaggctggtcta

SEQ ID NO: 2482537 - DNA, 21 bp, Homo sapiens
catgttgggaaacttggctcg

SEQ ID NO: 2482538 - DNA, 15 bp, Homo sapiens
catgtttagacttta

SEQ ID NO: 2482539 - DNA, 21 bp, Homo sapiens
catgtttagtgaatgactttt

SEQ ID NO: 2482540 - DNA, 15 bp, Homo sapiens
catgtttatttttct

SEQ ID NO: 2482541 - DNA, 20 bp, Homo sapiens
catgtttatttttcttgtct

SEQ ID NO: 2482542 - DNA, 15 bp, Homo sapiens
catgtttccagcatt

SEQ ID NO: 2482543 - DNA, 16 bp, Homo sapiens
catgtttccagcattc

SEQ ID NO: 2482544 - DNA, 20 bp, Homo sapiens
catgtttccagcattcccag

SEQ ID NO: 2482545 - DNA, 22 bp, Homo sapiens
catgtttccagcattcccaggt

SEQ ID NO: 2482546 - DNA, 13 bp, Homo sapiens
catgtttcctcta

SEQ ID NO: 2482547 - DNA, 22 bp, Homo sapiens
cattaaacgatttttaaaatgt

SEQ ID NO: 2482548 - DNA, 15 bp, Homo sapiens
cattaaagaagacct

SEQ ID NO: 2482549 - DNA, 11 bp, Homo sapiens
cattaaataaa

SEQ ID NO: 2482550 - DNA, 18 bp, Homo sapiens
cattaatctgcctccctc

SEQ ID NO: 2482551 - DNA, 23 bp, Homo sapiens
cattactataagaactttgagct

SEQ ID NO: 2482552 - DNA, 23 bp, Homo sapiens
cattactgtacagggttatctgc

SEQ ID NO: 2482553 - DNA, 15 bp, Homo sapiens
cattagaaatatttt

SEQ ID NO: 2482554 - DNA, 19 bp, Homo sapiens
cattagaagacaattgaca

SEQ ID NO: 2482555 - DNA, 20 bp, Homo sapiens
cattagggatgcctcctttc

SEQ ID NO: 2482556 - DNA, 22 bp, Homo sapiens
cattagtcatgtttatctgctt

SEQ ID NO: 2482557 - DNA, 14 bp, Homo sapiens
cattataatgaatt

SEQ ID NO: 2482558 - DNA, 15 bp, Homo sapiens
cattataatgaattt

SEQ ID NO: 2482559 - DNA, 21 bp, Homo sapiens
cattatcgagcagcattttat

SEQ ID NO: 2482560 - DNA, 16 bp, Homo sapiens
cattattacttttgct

SEQ ID NO: 2482561 - DNA, 22 bp, Homo sapiens
cattattcgtagatattggaca

SEQ ID NO: 2482562 - DNA, 18 bp, Homo sapiens
cattattggaatataatt

SEQ ID NO: 2482563 - DNA, 22 bp, Homo sapiens
cattatttatgtattgtgcaat

SEQ ID NO: 2482564 - DNA, 13 bp, Homo sapiens
cattcaggaattc

SEQ ID NO: 2482565 - DNA, 17 bp, Homo sapiens
cattcatttttgttgtt

SEQ ID NO: 2482566 - DNA, 17 bp, Homo sapiens
cattccaagactctaga

SEQ ID NO: 2482567 - DNA, 13 bp, Homo sapiens
cattccagcccct

SEQ ID NO: 2482568 - DNA, 15 bp, Homo sapiens
cattccagcccctct

SEQ ID NO: 2482569 - DNA, 18 bp, Homo sapiens
cattccagcccctctggt

SEQ ID NO: 2482570 - DNA, 16 bp, Homo sapiens
cattccatgtgcccag

SEQ ID NO: 2482571 - DNA, 19 bp, Homo sapiens
cattcccgcagtgggagca

SEQ ID NO: 2482572 - DNA, 20 bp, Homo sapiens
cattcccgcagtgggagcaa

SEQ ID NO: 2482573 - DNA, 17 bp, Homo sapiens
cattcctgaagaaccag

SEQ ID NO: 2482574 - DNA, 20 bp, Homo sapiens
cattcctgaagaaccagtcc

SEQ ID NO: 2482575 - DNA, 22 bp, Homo sapiens
cattccttcccagaggggcctg

SEQ ID NO: 2482576 - DNA, 21 bp, Homo sapiens
cattcgacctataagaagcct

SEQ ID NO: 2482577 - DNA, 23 bp, Homo sapiens
cattcgacctataagaagcctta

SEQ ID NO: 2482578 - DNA, 22 bp, Homo sapiens
cattcgctactatgatttaatt

SEQ ID NO: 2482579 - DNA, 22 bp, Homo sapiens
cattctcattggaaatttagca

SEQ ID NO: 2482580 - DNA, 14 bp, Homo sapiens
cattctctgtctca

SEQ ID NO: 2482581 - DNA, 19 bp, Homo sapiens
cattctctgtctcatccat

SEQ ID NO: 2482582 - DNA, 11 bp, Homo sapiens
cattctgaatg

SEQ ID NO: 2482583 - DNA, 18 bp, Homo sapiens
cattctgaatgcttctaa

SEQ ID NO: 2482584 - DNA, 17 bp, Homo sapiens
cattctgcaagtatact

SEQ ID NO: 2482585 - DNA, 21 bp, Homo sapiens
cattcttctctgttgtcgtaa

SEQ ID NO: 2482586 - DNA, 14 bp, Homo sapiens
cattgaacacaaac

SEQ ID NO: 2482587 - DNA, 15 bp, Homo sapiens
cattgaacacaaact

SEQ ID NO: 2482588 - DNA, 16 bp, Homo sapiens
cattgagttggttact

SEQ ID NO: 2482589 - DNA, 18 bp, Homo sapiens
cattgagttggttacttc

SEQ ID NO: 2482590 - DNA, 16 bp, Homo sapiens
cattgcatcaaagcat

SEQ ID NO: 2482591 - DNA, 14 bp, Homo sapiens
cattgctgtgaaca

SEQ ID NO: 2482592 - DNA, 11 bp, Homo sapiens
cattgcttttc

SEQ ID NO: 2482593 - DNA, 19 bp, Homo sapiens
cattggaaatttagcattg

SEQ ID NO: 2482594 - DNA, 21 bp, Homo sapiens
cattggaaatttagcattgta

SEQ ID NO: 2482595 - DNA, 15 bp, Homo sapiens
cattggaactggagg

SEQ ID NO: 2482596 - DNA, 19 bp, Homo sapiens
cattggaactggaggcagg

SEQ ID NO: 2482597 - DNA, 18 bp, Homo sapiens
cattggaatgttctcaga

SEQ ID NO: 2482598 - DNA, 16 bp, Homo sapiens
cattggacccttccat

SEQ ID NO: 2482599 - DNA, 18 bp, Homo sapiens
cattggctatttaaaact

SEQ ID NO: 2482600 - DNA, 20 bp, Homo sapiens
cattgtaaaagcattttgta

SEQ ID NO: 2482601 - DNA, 23 bp, Homo sapiens
cattgtaaaagcattttgtaata

SEQ ID NO: 2482602 - DNA, 18 bp, Homo sapiens
cattgtagtgctttgaga

SEQ ID NO: 2482603 - DNA, 21 bp, Homo sapiens
cattgtccaatcctatgtttt

SEQ ID NO: 2482604 - DNA, 17 bp, Homo sapiens
cattgtttcgtaacaca

SEQ ID NO: 2482605 - DNA, 21 bp, Homo sapiens
catttaaaacattaaaatata

SEQ ID NO: 2482606 - DNA, 12 bp, Homo sapiens
catttaaaagca

SEQ ID NO: 2482607 - DNA, 20 bp, Homo sapiens
catttaacccccctgtacac

SEQ ID NO: 2482608 - DNA, 17 bp, Homo sapiens
catttagcctgtcctgt

SEQ ID NO: 2482609 - DNA, 22 bp, Homo sapiens
catttagctaaacggattccaa

SEQ ID NO: 2482610 - DNA, 12 bp, Homo sapiens
catttatatatt

SEQ ID NO: 2482611 - DNA, 14 bp, Homo sapiens
catttatctataat

SEQ ID NO: 2482612 - DNA, 21 bp, Homo sapiens
catttatctataatttaccta

SEQ ID NO: 2482613 - DNA, 22 bp, Homo sapiens
catttcagagttctttttgaag

SEQ ID NO: 2482614 - DNA, 23 bp, Homo sapiens
catttcctatcacctatttccat

SEQ ID NO: 2482615 - DNA, 12 bp, Homo sapiens
catttcctgggt

SEQ ID NO: 2482616 - DNA, 21 bp, Homo sapiens
catttcctgggtggctactct

SEQ ID NO: 2482617 - DNA, 23 bp, Homo sapiens
catttctaattatgtagctcttt

SEQ ID NO: 2482618 - DNA, 13 bp, Homo sapiens
catttctgaggtg

SEQ ID NO: 2482619 - DNA, 18 bp, Homo sapiens
catttctgaggtgcactg

SEQ ID NO: 2482620 - DNA, 22 bp, Homo sapiens
catttgcaagggaaaagtctct

SEQ ID NO: 2482621 - DNA, 13 bp, Homo sapiens
catttgcatttgt

SEQ ID NO: 2482622 - DNA, 16 bp, Homo sapiens
catttgctgttttaaa

SEQ ID NO: 2482623 - DNA, 15 bp, Homo sapiens
catttgctttttgtg

SEQ ID NO: 2482624 - DNA, 18 bp, Homo sapiens
catttggcatccctgggc

SEQ ID NO: 2482625 - DNA, 18 bp, Homo sapiens
catttgggagacatgtga

SEQ ID NO: 2482626 - DNA, 23 bp, Homo sapiens
catttgggagtttttatgagaaa

SEQ ID NO: 2482627 - DNA, 15 bp, Homo sapiens
catttgggtccagga

SEQ ID NO: 2482628 - DNA, 21 bp, Homo sapiens
catttgtcagtatttttgccg

SEQ ID NO: 2482629 - DNA, 17 bp, Homo sapiens
catttgtttatgtaatt

SEQ ID NO: 2482630 - DNA, 18 bp, Homo sapiens
catttgtttatgtaattt

SEQ ID NO: 2482631 - DNA, 23 bp, Homo sapiens
catttgtttctttctctgaggac

SEQ ID NO: 2482632 - DNA, 17 bp, Homo sapiens
catttgttttgtttaca

SEQ ID NO: 2482633 - DNA, 14 bp, Homo sapiens
cattttaattctct

SEQ ID NO: 2482634 - DNA, 17 bp, Homo sapiens
cattttcaccccaccct

SEQ ID NO: 2482635 - DNA, 14 bp, Homo sapiens
cattttctaagaaa

SEQ ID NO: 2482636 - DNA, 17 bp, Homo sapiens
cattttctaagaaacat

SEQ ID NO: 2482637 - DNA, 14 bp, Homo sapiens
cattttctctcagg

SEQ ID NO: 2482638 - DNA, 14 bp, Homo sapiens
cattttggtacttt

SEQ ID NO: 2482639 - DNA, 16 bp, Homo sapiens
catttttacaatgtaa

SEQ ID NO: 2482640 - DNA, 19 bp, Homo sapiens
catttttacaatgtaatta

SEQ ID NO: 2482641 - DNA, 20 bp, Homo sapiens
catttttactattgttacat

SEQ ID NO: 2482642 - DNA, 17 bp, Homo sapiens
catttttcaatagcaca

SEQ ID NO: 2482643 - DNA, 16 bp, Homo sapiens
catttttcatgataat

SEQ ID NO: 2482644 - DNA, 18 bp, Homo sapiens
catttttttccttgcaaa

SEQ ID NO: 2482645 - DNA, 15 bp, Homo sapiens
cattttttttctttg

SEQ ID NO: 2482646 - DNA, 17 bp, Homo sapiens
cattttttttctttgaa

SEQ ID NO: 2482647 - DNA, 15 bp, Homo sapiens
catttttttttcaat

SEQ ID NO: 2482648 - DNA, 13 bp, Homo sapiens
ccaaaaatagcta

SEQ ID NO: 2482649 - DNA, 15 bp, Homo sapiens
ccaaaaccgccagct

SEQ ID NO: 2482650 - DNA, 17 bp, Homo sapiens
ccaaaaccgccagctct

SEQ ID NO: 2482651 - DNA, 18 bp, Homo sapiens
ccaaaaccgccagctctg

SEQ ID NO: 2482652 - DNA, 21 bp, Homo sapiens
ccaaaaccgccagctctgttc

SEQ ID NO: 2482653 - DNA, 23 bp, Homo sapiens
ccaaaataaataaggaaaagctt

SEQ ID NO: 2482654 - DNA, 15 bp, Homo sapiens
ccaaaatgtgcctat

SEQ ID NO: 2482655 - DNA, 17 bp, Homo sapiens
ccaaaatgttgctgaaa

SEQ ID NO: 2482656 - DNA, 22 bp, Homo sapiens
ccaaacaccttccagctcctgt

SEQ ID NO: 2482657 - DNA, 14 bp, Homo sapiens
ccaaaccctgtctg

SEQ ID NO: 2482658 - DNA, 16 bp, Homo sapiens
ccaaacctcaccaact

SEQ ID NO: 2482659 - DNA, 21 bp, Homo sapiens
ccaaacgccctttcctcctca

SEQ ID NO: 2482660 - DNA, 17 bp, Homo sapiens
ccaaactgatccagtat

SEQ ID NO: 2482661 - DNA, 14 bp, Homo sapiens
ccaaagaggctgcc

SEQ ID NO: 2482662 - DNA, 17 bp, Homo sapiens
ccaaagaggctgcccct

SEQ ID NO: 2482663 - DNA, 20 bp, Homo sapiens
ccaaagaggctgcccctctc

SEQ ID NO: 2482664 - DNA, 16 bp, Homo sapiens
ccaaagcaagcaagag

SEQ ID NO: 2482665 - DNA, 13 bp, Homo sapiens
ccaaagctttcct

SEQ ID NO: 2482666 - DNA, 14 bp, Homo sapiens
ccaaagctttcctg

SEQ ID NO: 2482667 - DNA, 15 bp, Homo sapiens
ccaaagctttcctgc

SEQ ID NO: 2482668 - DNA, 17 bp, Homo sapiens
ccaaagctttcctgccc

SEQ ID NO: 2482669 - DNA, 19 bp, Homo sapiens
ccaaagctttcctgcccca

SEQ ID NO: 2482670 - DNA, 17 bp, Homo sapiens
ccaaaggacagccgcct

SEQ ID NO: 2482671 - DNA, 18 bp, Homo sapiens
ccaaagggagtctgccag

SEQ ID NO: 2482672 - DNA, 17 bp, Homo sapiens
ccaaagtcataattgca

SEQ ID NO: 2482673 - DNA, 15 bp, Homo sapiens
ccaaagtctctaatt

SEQ ID NO: 2482674 - DNA, 16 bp, Homo sapiens
ccaaagtctctaattc

SEQ ID NO: 2482675 - DNA, 18 bp, Homo sapiens
ccaaagtctctaattcta

SEQ ID NO: 2482676 - DNA, 12 bp, Homo sapiens
ccaaagttctaa

SEQ ID NO: 2482677 - DNA, 19 bp, Homo sapiens
ccaaagttctaataatttc

SEQ ID NO: 2482678 - DNA, 20 bp, Homo sapiens
ccaaagttctaataatttct

SEQ ID NO: 2482679 - DNA, 23 bp, Homo sapiens
ccaaagttgttgtaacctgctgt

SEQ ID NO: 2482680 - DNA, 13 bp, Homo sapiens
ccaaatatgtcct

SEQ ID NO: 2482681 - DNA, 15 bp, Homo sapiens
ccaaatcccctaagc

SEQ ID NO: 2482682 - DNA, 17 bp, Homo sapiens
ccaaattaaaaaagata

SEQ ID NO: 2482683 - DNA, 13 bp, Homo sapiens
ccaaattcagttt

SEQ ID NO: 2482684 - DNA, 15 bp, Homo sapiens
ccaaattcagtttca

SEQ ID NO: 2482685 - DNA, 19 bp, Homo sapiens
ccaaattcagtttcataaa

SEQ ID NO: 2482686 - DNA, 18 bp, Homo sapiens
ccaaatttaaaactgttg

SEQ ID NO: 2482687 - DNA, 19 bp, Homo sapiens
ccaacaaagaacactaact

SEQ ID NO: 2482688 - DNA, 13 bp, Homo sapiens
ccaacaccaagca

SEQ ID NO: 2482689 - DNA, 19 bp, Homo sapiens
ccaacaccaagcacagcag

SEQ ID NO: 2482690 - DNA, 22 bp, Homo sapiens
ccaacaccaagcacagcagcct

SEQ ID NO: 2482691 - DNA, 23 bp, Homo sapiens
ccaacaccaagcacagcagcctg

SEQ ID NO: 2482692 - DNA, 17 bp, Homo sapiens
ccaacacgcacctgcct

SEQ ID NO: 2482693 - DNA, 22 bp, Homo sapiens
ccaacagctggaccctgaccag

SEQ ID NO: 2482694 - DNA, 15 bp, Homo sapiens
ccaacataaaaatga

SEQ ID NO: 2482695 - DNA, 17 bp, Homo sapiens
ccaacatcacagcccag

SEQ ID NO: 2482696 - DNA, 15 bp, Homo sapiens
ccaaccaaataagac

SEQ ID NO: 2482697 - DNA, 13 bp, Homo sapiens
ccaaccatttcct

SEQ ID NO: 2482698 - DNA, 19 bp, Homo sapiens
ttgtttttaaactgtacag

SEQ ID NO: 2482699 - DNA, 13 bp, Homo sapiens
tttaaaaaagctt

SEQ ID NO: 2482700 - DNA, 20 bp, Homo sapiens
tttaaaaataagtcaacagt

SEQ ID NO: 2482701 - DNA, 21 bp, Homo sapiens
tttaaaaataagtcaacagta

SEQ ID NO: 2482702 - DNA, 15 bp, Homo sapiens
tttaaaactgttgga

SEQ ID NO: 2482703 - DNA, 11 bp, Homo sapiens
tttaaaacttg

SEQ ID NO: 2482704 - DNA, 17 bp, Homo sapiens
tttaaaagatgctttta

SEQ ID NO: 2482705 - DNA, 13 bp, Homo sapiens
tttaaaagcacga

SEQ ID NO: 2482706 - DNA, 14 bp, Homo sapiens
tttaaaagcctgct

SEQ ID NO: 2482707 - DNA, 18 bp, Homo sapiens
tttaaaagtgtcaagctg

SEQ ID NO: 2482708 - DNA, 17 bp, Homo sapiens
tttaaaatagcgttctt

SEQ ID NO: 2482709 - DNA, 23 bp, Homo sapiens
tttaaaatagcgttcttgtaatt

SEQ ID NO: 2482710 - DNA, 15 bp, Homo sapiens
tttaaacattaatag

SEQ ID NO: 2482711 - DNA, 17 bp, Homo sapiens
tttaaaccgctaaaaga

SEQ ID NO: 2482712 - DNA, 22 bp, Homo sapiens
tttaaaccgctaaaagaaactt

SEQ ID NO: 2482713 - DNA, 16 bp, Homo sapiens
tttaaactgtacagtg

SEQ ID NO: 2482714 - DNA, 21 bp, Homo sapiens
tttaaagaaaaaaattgaaat

SEQ ID NO: 2482715 - DNA, 13 bp, Homo sapiens
tttaaagagtcta

SEQ ID NO: 2482716 - DNA, 15 bp, Homo sapiens
tttaaagagtctaga

SEQ ID NO: 2482717 - DNA, 18 bp, Homo sapiens
tttaaagagtctagattc

SEQ ID NO: 2482718 - DNA, 22 bp, Homo sapiens
tttaaagttagtatcttttgat

SEQ ID NO: 2482719 - DNA, 14 bp, Homo sapiens
tttaacaacatgtt

SEQ ID NO: 2482720 - DNA, 12 bp, Homo sapiens
tttaacagaaat

SEQ ID NO: 2482721 - DNA, 14 bp, Homo sapiens
tttaacagaaattg

SEQ ID NO: 2482722 - DNA, 13 bp, Homo sapiens
tttaacataagct

SEQ ID NO: 2482723 - DNA, 22 bp, Homo sapiens
tttaacattcctcatgaatgta

SEQ ID NO: 2482724 - DNA, 23 bp, Homo sapiens
tttaacattcctcatgaatgtaa

SEQ ID NO: 2482725 - DNA, 16 bp, Homo sapiens
tttaacctttgataga

SEQ ID NO: 2482726 - DNA, 23 bp, Homo sapiens
tttaactgactattcttgatgta

SEQ ID NO: 2482727 - DNA, 13 bp, Homo sapiens
tttaactgtggat

SEQ ID NO: 2482728 - DNA, 18 bp, Homo sapiens
tttaactgtggatattgt

SEQ ID NO: 2482729 - DNA, 14 bp, Homo sapiens
tttaacttaaatag

SEQ ID NO: 2482730 - DNA, 12 bp, Homo sapiens
tttaactttgtt

SEQ ID NO: 2482731 - DNA, 21 bp, Homo sapiens
tttaagaatatctgtaatggt

SEQ ID NO: 2482732 - DNA, 15 bp, Homo sapiens
tttaagaattgagta

SEQ ID NO: 2482733 - DNA, 20 bp, Homo sapiens
tttaagaattgagtaatggt

SEQ ID NO: 2482734 - DNA, 14 bp, Homo sapiens
tttaagataattat

SEQ ID NO: 2482735 - DNA, 15 bp, Homo sapiens
tttaagtctctcgta

SEQ ID NO: 2482736 - DNA, 12 bp, Homo sapiens
tttaataaaaga

SEQ ID NO: 2482737 - DNA, 11 bp, Homo sapiens
tttaataattt

SEQ ID NO: 2482738 - DNA, 17 bp, Homo sapiens
tttaatagcaaagaatt

SEQ ID NO: 2482739 - DNA, 18 bp, Homo sapiens
tttaatagcaaagaattg

SEQ ID NO: 2482740 - DNA, 23 bp, Homo sapiens
tttaatataaagtagtcctgtga

SEQ ID NO: 2482741 - DNA, 17 bp, Homo sapiens
tttaatcaaatttgtag

SEQ ID NO: 2482742 - DNA, 23 bp, Homo sapiens
tttaattattattcttcataaca

SEQ ID NO: 2482743 - DNA, 18 bp, Homo sapiens
tttaatttagtaaaccaa

SEQ ID NO: 2482744 - DNA, 22 bp, Homo sapiens
tttaatttagtaaaccaatcct

SEQ ID NO: 2482745 - DNA, 15 bp, Homo sapiens
tttacaaaaatataa

SEQ ID NO: 2482746 - DNA, 18 bp, Homo sapiens
tttacaaaacaaactcat

SEQ ID NO: 2482747 - DNA, 19 bp, Homo sapiens
tttacaaaactacatgaga

SEQ ID NO: 2482748 - DNA, 13 bp, Homo sapiens
tttacaaactgaa

SEQ ID NO: 2482749 - DNA, 20 bp, Homo sapiens
tttacaaatgttaaaatgtg

SEQ ID NO: 2482750 - DNA, 21 bp, Homo sapiens
tttacaaatgttaaaatgtgt

SEQ ID NO: 2482751 - DNA, 15 bp, Homo sapiens
tttacaatgtaatta

SEQ ID NO: 2482752 - DNA, 16 bp, Homo sapiens
tttacaatgtaattat

SEQ ID NO: 2482753 - DNA, 13 bp, Homo sapiens
tttacagaatttt

SEQ ID NO: 2482754 - DNA, 14 bp, Homo sapiens
tttacaggaacttc

SEQ ID NO: 2482755 - DNA, 15 bp, Homo sapiens
tttacatgaagtatt

SEQ ID NO: 2482756 - DNA, 20 bp, Homo sapiens
tttaccctggcccctctccc

SEQ ID NO: 2482757 - DNA, 12 bp, Homo sapiens
tttacctcagcc

SEQ ID NO: 2482758 - DNA, 13 bp, Homo sapiens
tttaccttgtata

SEQ ID NO: 2482759 - DNA, 13 bp, Homo sapiens
tttacgctttgat

SEQ ID NO: 2482760 - DNA, 23 bp, Homo sapiens
tttactagggatccctcatctgt

SEQ ID NO: 2482761 - DNA, 17 bp, Homo sapiens
tttactccgtaacagat

SEQ ID NO: 2482762 - DNA, 13 bp, Homo sapiens
tttactctgccta

SEQ ID NO: 2482763 - DNA, 13 bp, Homo sapiens
tttacttttgttt

SEQ ID NO: 2482764 - DNA, 16 bp, Homo sapiens
tttagaaaactttaaa

SEQ ID NO: 2482765 - DNA, 15 bp, Homo sapiens
tttagaaagataatt

SEQ ID NO: 2482766 - DNA, 13 bp, Homo sapiens
tttagaaatcatt

SEQ ID NO: 2482767 - DNA, 16 bp, Homo sapiens
tttagaaatcattttg

SEQ ID NO: 2482768 - DNA, 22 bp, Homo sapiens
tttagacttggattctttccat

SEQ ID NO: 2482769 - DNA, 15 bp, Homo sapiens
tttagactttaacat

SEQ ID NO: 2482770 - DNA, 22 bp, Homo sapiens
tttagagataagagttggctgg

SEQ ID NO: 2482771 - DNA, 22 bp, Homo sapiens
tttagatagccctgtcctggtg

SEQ ID NO: 2482772 - DNA, 17 bp, Homo sapiens
tttagatgtaattttgt

SEQ ID NO: 2482773 - DNA, 19 bp, Homo sapiens
tttagattttcttttgcct

SEQ ID NO: 2482774 - DNA, 14 bp, Homo sapiens
tttagcatgttgtt

SEQ ID NO: 2482775 - DNA, 12 bp, Homo sapiens
tttagcattgta

SEQ ID NO: 2482776 - DNA, 14 bp, Homo sapiens
tttagcctgtcctg

SEQ ID NO: 2482777 - DNA, 13 bp, Homo sapiens
ttctaggtttcaa

SEQ ID NO: 2482778 - DNA, 14 bp, Homo sapiens
ttctatagccaaaa

SEQ ID NO: 2482779 - DNA, 15 bp, Homo sapiens
ttctatagccaaaaa

SEQ ID NO: 2482780 - DNA, 17 bp, Homo sapiens
ttctatagccaaaaata

SEQ ID NO: 2482781 - DNA, 13 bp, Homo sapiens
ttctattaaaaga

SEQ ID NO: 2482782 - DNA, 14 bp, Homo sapiens
ttctattaaaagac

SEQ ID NO: 2482783 - DNA, 15 bp, Homo sapiens
ttctattaaaagact

SEQ ID NO: 2482784 - DNA, 17 bp, Homo sapiens
ttctattaaaagactca

SEQ ID NO: 2482785 - DNA, 19 bp, Homo sapiens
ttctattaaaagactcatc

SEQ ID NO: 2482786 - DNA, 19 bp, Homo sapiens
tttatgataatagattctc

SEQ ID NO: 2482787 - DNA, 13 bp, Homo sapiens
tttatgcttgcaa

SEQ ID NO: 2482788 - DNA, 17 bp, Homo sapiens
tttatgttatatataaa

SEQ ID NO: 2482789 - DNA, 21 bp, Homo sapiens
tttatgttatatataaatata

SEQ ID NO: 2482790 - DNA, 22 bp, Homo sapiens
tttatgttatatataaatatat

SEQ ID NO: 2482791 - DNA, 12 bp, Homo sapiens
tttattaaagaa

SEQ ID NO: 2482792 - DNA, 12 bp, Homo sapiens
tttattaatgca

SEQ ID NO: 2482793 - DNA, 15 bp, Homo sapiens
tttattatgaagaag

SEQ ID NO: 2482794 - DNA, 17 bp, Homo sapiens
tttattatgcattatat

SEQ ID NO: 2482795 - DNA, 19 bp, Homo sapiens
tttattccagaatgctgta

SEQ ID NO: 2482796 - DNA, 15 bp, Homo sapiens
tttattcttctagag

SEQ ID NO: 2482797 - DNA, 18 bp, Homo sapiens
tttattcttctagagttc

SEQ ID NO: 2482798 - DNA, 17 bp, Homo sapiens
tttattggttttgcaga

SEQ ID NO: 2482799 - DNA, 13 bp, Homo sapiens
tttattgtattct

SEQ ID NO: 2482800 - DNA, 18 bp, Homo sapiens
tttattgtattctggggt

SEQ ID NO: 2482801 - DNA, 22 bp, Homo sapiens
tttatttaaaaaactaaaaact

SEQ ID NO: 2482802 - DNA, 12 bp, Homo sapiens
tttatttttcat

SEQ ID NO: 2482803 - DNA, 13 bp, Homo sapiens
tttcaaaaccagg

SEQ ID NO: 2482804 - DNA, 21 bp, Homo sapiens
tttcaaattggagcttcatgg

SEQ ID NO: 2482805 - DNA, 17 bp, Homo sapiens
tttcaacagtgaagaca

SEQ ID NO: 2482806 - DNA, 23 bp, Homo sapiens
tttcaacggaaagtgctgtctta

SEQ ID NO: 2482807 - DNA, 22 bp, Homo sapiens
tttcaagcagtcgtgcctgtgt

SEQ ID NO: 2482808 - DNA, 23 bp, Homo sapiens
tttcaagcagtcgtgcctgtgtc

SEQ ID NO: 2482809 - DNA, 19 bp, Homo sapiens
tttcaaggcactctagatt

SEQ ID NO: 2482810 - DNA, 21 bp, Homo sapiens
tttcaaggcactctagattcc

SEQ ID NO: 2482811 - DNA, 22 bp, Homo sapiens
tttcaaggcactctagattcca

SEQ ID NO: 2482812 - DNA, 22 bp, Homo sapiens
tttcaataaaagataaattatt

SEQ ID NO: 2482813 - DNA, 13 bp, Homo sapiens
tttcaatagccac

SEQ ID NO: 2482814 - DNA, 22 bp, Homo sapiens
tttcaattccacctgcaatcaa

SEQ ID NO: 2482815 - DNA, 17 bp, Homo sapiens
tttcacagaaaataagg

SEQ ID NO: 2482816 - DNA, 22 bp, Homo sapiens
tttcagagttctttttgaagta

SEQ ID NO: 2482817 - DNA, 23 bp, Homo sapiens
tttcagatatcttggacaaatca

SEQ ID NO: 2482818 - DNA, 18 bp, Homo sapiens
tttcagatgtgaaccatt

SEQ ID NO: 2482819 - DNA, 12 bp, Homo sapiens
tttcagcactag

SEQ ID NO: 2482820 - DNA, 21 bp, Homo sapiens
tttcagctcctgaccagttgc

SEQ ID NO: 2482821 - DNA, 19 bp, Homo sapiens
tttcaggaggaatactgaa

SEQ ID NO: 2482822 - DNA, 22 bp, Homo sapiens
tttcaggaggaatactgaacat

SEQ ID NO: 2482823 - DNA, 21 bp, Homo sapiens
tttcagtggggcagtcattat

SEQ ID NO: 2482824 - DNA, 15 bp, Homo sapiens
tttcagttctaggaa

SEQ ID NO: 2482825 - DNA, 14 bp, Homo sapiens
tttcatagttcaga

SEQ ID NO: 2482826 - DNA, 15 bp, Homo sapiens
tttcatagttcagaa

SEQ ID NO: 2482827 - DNA, 17 bp, Homo sapiens
tttcatattttaaacag

SEQ ID NO: 2482828 - DNA, 17 bp, Homo sapiens
tttcatccataactgaa

SEQ ID NO: 2482829 - DNA, 19 bp, Homo sapiens
tttcatccataactgaaca

SEQ ID NO: 2482830 - DNA, 17 bp, Homo sapiens
tttcatcttcagttgtc

SEQ ID NO: 2482831 - DNA, 23 bp, Homo sapiens
tttcatgcgatgacacttgtaca

SEQ ID NO: 2482832 - DNA, 19 bp, Homo sapiens
tttcatgtaaactgtgcac

SEQ ID NO: 2482833 - DNA, 18 bp, Homo sapiens
tttcatgtacaagatgaa

SEQ ID NO: 2482834 - DNA, 14 bp, Homo sapiens
tttcattaaataaa

SEQ ID NO: 2482835 - DNA, 15 bp, Homo sapiens
tttcattaaataaat

SEQ ID NO: 2482836 - DNA, 18 bp, Homo sapiens
tttcattaaataaatttg

SEQ ID NO: 2482837 - DNA, 21 bp, Homo sapiens
tttcattccttcagatttggc

SEQ ID NO: 2482838 - DNA, 19 bp, Homo sapiens
tttcatttagtcatgtgac

SEQ ID NO: 2482839 - DNA, 19 bp, Homo sapiens
tttcatttggttcattaat

SEQ ID NO: 2482840 - DNA, 18 bp, Homo sapiens
tttccaactactaataga

SEQ ID NO: 2482841 - DNA, 19 bp, Homo sapiens
tttccaccacagccagcac

SEQ ID NO: 2482842 - DNA, 20 bp, Homo sapiens
tttccagcattcccaggtag

SEQ ID NO: 2482843 - DNA, 12 bp, Homo sapiens
tttccatcttta

SEQ ID NO: 2482844 - DNA, 19 bp, Homo sapiens
tttccatgggaccacaact

SEQ ID NO: 2482845 - DNA, 21 bp, Homo sapiens
tttccatttgcatttgtttat

SEQ ID NO: 2482846 - DNA, 22 bp, Homo sapiens
tttcccaaagcatccctcttag

SEQ ID NO: 2482847 - DNA, 12 bp, Homo sapiens
tttcccaattca

SEQ ID NO: 2482848 - DNA, 23 bp, Homo sapiens
tttcccaccccaacctgctctcc

SEQ ID NO: 2482849 - DNA, 11 bp, Homo sapiens
tttcccaggac

SEQ ID NO: 2482850 - DNA, 16 bp, Homo sapiens
tttcccaggaccctga

SEQ ID NO: 2482851 - DNA, 22 bp, Homo sapiens
tttcccaggcccactgtgcctc

SEQ ID NO: 2482852 - DNA, 16 bp, Homo sapiens
tttccctaccctctag

SEQ ID NO: 2482853 - DNA, 12 bp, Homo sapiens
tttccctggtcc

SEQ ID NO: 2482854 - DNA, 16 bp, Homo sapiens
tttcccttcagtaccc

SEQ ID NO: 2482855 - DNA, 20 bp, Homo sapiens
tttcccttcagtaccctctc

SEQ ID NO: 2482856 - DNA, 20 bp, Homo sapiens
tttcccttgtagctcctccc

SEQ ID NO: 2482857 - DNA, 19 bp, Homo sapiens
tttcctcagactctaagaa

SEQ ID NO: 2482858 - DNA, 22 bp, Homo sapiens
tttcctcctgaggctttggatt

SEQ ID NO: 2482859 - DNA, 19 bp, Homo sapiens
ttttccaggcttctgctgg

SEQ ID NO: 2482860 - DNA, 20 bp, Homo sapiens
ttttccaggcttctgctggg

SEQ ID NO: 2482861 - DNA, 18 bp, Homo sapiens
ttttcccaaaatgttgaa

SEQ ID NO: 2482862 - DNA, 17 bp, Homo sapiens
ttttcccactccaagcc

SEQ ID NO: 2482863 - DNA, 14 bp, Homo sapiens
ttttccctttgcct

SEQ ID NO: 2482864 - DNA, 20 bp, Homo sapiens
ttttcctaataaagttctgt

SEQ ID NO: 2482865 - DNA, 16 bp, Homo sapiens
ttttcctcctgagtgc

SEQ ID NO: 2482866 - DNA, 16 bp, Homo sapiens
ttttcctctccacaca

SEQ ID NO: 2482867 - DNA, 22 bp, Homo sapiens
ttttcctgtcctctttcagctc

SEQ ID NO: 2482868 - DNA, 16 bp, Homo sapiens
ttttccttcaaagttt

SEQ ID NO: 2482869 - DNA, 15 bp, Homo sapiens
ttttcgaaaatcaaa

SEQ ID NO: 2482870 - DNA, 19 bp, Homo sapiens
ttttcggccccatgtatct

SEQ ID NO: 2482871 - DNA, 13 bp, Homo sapiens
ttttctattaaaa

SEQ ID NO: 2482872 - DNA, 14 bp, Homo sapiens
ttttctattaaaag

SEQ ID NO: 2482873 - DNA, 11 bp, Homo sapiens
ttttctttctc

SEQ ID NO: 2482874 - DNA, 14 bp, Homo sapiens
ttttgaaggcaaaa

SEQ ID NO: 2482875 - DNA, 14 bp, Homo sapiens
ttttgaagtattta

SEQ ID NO: 2482876 - DNA, 13 bp, Homo sapiens
ttttgagatatta

SEQ ID NO: 2482877 - DNA, 15 bp, Homo sapiens
ttttgaggagcccca

SEQ ID NO: 2482878 - DNA, 20 bp, Homo sapiens
ttttgatttaatgttttcag

SEQ ID NO: 2482879 - DNA, 20 bp, Homo sapiens
ttttgcacatgtttcctcta

SEQ ID NO: 2482880 - DNA, 14 bp, Homo sapiens
ttttgcagtaactg

SEQ ID NO: 2482881 - DNA, 15 bp, Homo sapiens
ttttgcagtaactgt

SEQ ID NO: 2482882 - DNA, 17 bp, Homo sapiens
ttttgcccattttgaat

SEQ ID NO: 2482883 - DNA, 19 bp, Homo sapiens
ttttgcccattttgaatca

SEQ ID NO: 2482884 - DNA, 21 bp, Homo sapiens
ttttgcggttcaggaaaattg

SEQ ID NO: 2482885 - DNA, 21 bp, Homo sapiens
ttttgcttttggcaaaactct

SEQ ID NO: 2482886 - DNA, 21 bp, Homo sapiens
ttttggtccaagttgtgctta

SEQ ID NO: 2482887 - DNA, 17 bp, Homo sapiens
ttttgtaataataaaga

SEQ ID NO: 2482888 - DNA, 24 bp, Homo sapiens
ttttgtataattggatttcctaat

SEQ ID NO: 2482889 - DNA, 13 bp, Homo sapiens
ttttgttgacatt

SEQ ID NO: 2482890 - DNA, 20 bp, Homo sapiens
ttttgttgacattctgaatg

SEQ ID NO: 2482891 - DNA, 21 bp, Homo sapiens
ttttgttggcatagctctggg

SEQ ID NO: 2482892 - DNA, 17 bp, Homo sapiens
ttttgtttttcattcag

SEQ ID NO: 2482893 - DNA, 17 bp, Homo sapiens
tttttaaaaaagcttaa

SEQ ID NO: 2482894 - DNA, 24 bp, Homo sapiens
tgtcctgccacccagccccagcca

SEQ ID NO: 2482895 - DNA, 24 bp, Homo sapiens
tgtcctgcctattatctgtcagct

SEQ ID NO: 2482896 - DNA, 16 bp, Homo sapiens
tgtcctgcctgtggcc

SEQ ID NO: 2482897 - DNA, 13 bp, Homo sapiens
tgtcctggtggta

SEQ ID NO: 2482898 - DNA, 19 bp, Homo sapiens
tgtcctggtggtattttca

SEQ ID NO: 2482899 - DNA, 15 bp, Homo sapiens
tgtcctggttcccgt

SEQ ID NO: 2482900 - DNA, 17 bp, Homo sapiens
tgtccttagcctggacc

SEQ ID NO: 2482901 - DNA, 12 bp, Homo sapiens
tgtcgctgcttc

SEQ ID NO: 2482902 - DNA, 20 bp, Homo sapiens
tgtcgtggacacacacagac

SEQ ID NO: 2482903 - DNA, 23 bp, Homo sapiens
tgtctaagaaattgaatactttg

SEQ ID NO: 2482904 - DNA, 14 bp, Homo sapiens
tgtctaagattcta

SEQ ID NO: 2482905 - DNA, 15 bp, Homo sapiens
tgtctaagattctag

SEQ ID NO: 2482906 - DNA, 17 bp, Homo sapiens
tgtctaagattctagat

SEQ ID NO: 2482907 - DNA, 14 bp, Homo sapiens
tgtctataaagcat

SEQ ID NO: 2482908 - DNA, 16 bp, Homo sapiens
tgtctcacctggactt

SEQ ID NO: 2482909 - DNA, 11 bp, Homo sapiens
tgtctcatcca

SEQ ID NO: 2482910 - DNA, 16 bp, Homo sapiens
tgtctcatccatcatc

SEQ ID NO: 2482911 - DNA, 16 bp, Homo sapiens
tgtctcctaagcacct

SEQ ID NO: 2482912 - DNA, 17 bp, Homo sapiens
tgtctcgagcgccctgc

SEQ ID NO: 2482913 - DNA, 16 bp, Homo sapiens
tgtctctcctgcccct

SEQ ID NO: 2482914 - DNA, 19 bp, Homo sapiens
tgtctctgatgcagcttat

SEQ ID NO: 2482915 - DNA, 22 bp, Homo sapiens
tgtctcttgcctgccactgtgt

SEQ ID NO: 2482916 - DNA, 16 bp, Homo sapiens
tgtctgaacttgcatt

SEQ ID NO: 2482917 - DNA, 18 bp, Homo sapiens
tgtctgaacttgcattgt

SEQ ID NO: 2482918 - DNA, 19 bp, Homo sapiens
tgtctgccaacctaaaact

SEQ ID NO: 2482919 - DNA, 15 bp, Homo sapiens
tgtctggcaatgcca

SEQ ID NO: 2482920 - DNA, 16 bp, Homo sapiens
tgtctgggtgctactg

SEQ ID NO: 2482921 - DNA, 16 bp, Homo sapiens
tgtctggtggccccgt

SEQ ID NO: 2482922 - DNA, 14 bp, Homo sapiens
tgtctggttctcaa

SEQ ID NO: 2482923 - DNA, 20 bp, Homo sapiens
tgtcttaaactaaatgtgca

SEQ ID NO: 2482924 - DNA, 15 bp, Homo sapiens
tgtcttaattattat

SEQ ID NO: 2482925 - DNA, 13 bp, Homo sapiens
tgtcttgggcaga

SEQ ID NO: 2482926 - DNA, 17 bp, Homo sapiens
tgtctttagatagccct

SEQ ID NO: 2482927 - DNA, 16 bp, Homo sapiens
tgtctttttttgtata

SEQ ID NO: 2482928 - DNA, 14 bp, Homo sapiens
tgtgaacccaggac

SEQ ID NO: 2482929 - DNA, 16 bp, Homo sapiens
tgtgaacccaggacaa

SEQ ID NO: 2482930 - DNA, 21 bp, Homo sapiens
tgtgaagccaattcagacagg

SEQ ID NO: 2482931 - DNA, 23 bp, Homo sapiens
tgtgaagccatgagttccagaaa

SEQ ID NO: 2482932 - DNA, 12 bp, Homo sapiens
tgtgaagccttc

SEQ ID NO: 2482933 - DNA, 23 bp, Homo sapiens
tgtgaaggtgatttaagggccca

SEQ ID NO: 2482934 - DNA, 22 bp, Homo sapiens
tgtgaatcaagggtcaggcctt

SEQ ID NO: 2482935 - DNA, 14 bp, Homo sapiens
tgtgaatgaacact

SEQ ID NO: 2482936 - DNA, 17 bp, Homo sapiens
tgtgaatgaacactctt

SEQ ID NO: 2482937 - DNA, 17 bp, Homo sapiens
tgtgaatgccactgcct

SEQ ID NO: 2482938 - DNA, 16 bp, Homo sapiens
tgtgaattaagcccaa

SEQ ID NO: 2482939 - DNA, 19 bp, Homo sapiens
tgtgaattaggctgtaact

SEQ ID NO: 2482940 - DNA, 12 bp, Homo sapiens
tgtgacagggcg

SEQ ID NO: 2482941 - DNA, 17 bp, Homo sapiens
tgtgacatttatatatt

SEQ ID NO: 2482942 - DNA, 15 bp, Homo sapiens
tgtgacccccagctc

SEQ ID NO: 2482943 - DNA, 17 bp, Homo sapiens
tgtgacctgctgagctc

SEQ ID NO: 2482944 - DNA, 20 bp, Homo sapiens
tgtgactggctaaagctcga

SEQ ID NO: 2482945 - DNA, 23 bp, Homo sapiens
tgtgacttctattttaaagacaa

SEQ ID NO: 2482946 - DNA, 18 bp, Homo sapiens
tgtgagcccagctgggtc

SEQ ID NO: 2482947 - DNA, 14 bp, Homo sapiens
tgtgaggccagggc

SEQ ID NO: 2482948 - DNA, 15 bp, Homo sapiens
tgtgaggccagggca

SEQ ID NO: 2482949 - DNA, 22 bp, Homo sapiens
tgtgaggccagggcagagtgag

SEQ ID NO: 2482950 - DNA, 16 bp, Homo sapiens
tgtgagtcaatacata

SEQ ID NO: 2482951 - DNA, 21 bp, Homo sapiens
tgtgagtctttggttctaagg

SEQ ID NO: 2482952 - DNA, 17 bp, Homo sapiens
tgtgagtgtttttatct

SEQ ID NO: 2482953 - DNA, 13 bp, Homo sapiens
tgtgatatataag

SEQ ID NO: 2482954 - DNA, 14 bp, Homo sapiens
tgtgatattctaag

SEQ ID NO: 2482955 - DNA, 18 bp, Homo sapiens
tgtgatgtaccagtttgt

SEQ ID NO: 2482956 - DNA, 22 bp, Homo sapiens
tgtgatgtaccagtttgtccat

SEQ ID NO: 2482957 - DNA, 18 bp, Homo sapiens
tgtgatgtcatacagaga

SEQ ID NO: 2482958 - DNA, 13 bp, Homo sapiens
tgtgatgttctaa

SEQ ID NO: 2482959 - DNA, 16 bp, Homo sapiens
tgtgatgttctaaggc

SEQ ID NO: 2482960 - DNA, 18 bp, Homo sapiens
tgtgatgttctaaggctc

SEQ ID NO: 2482961 - DNA, 14 bp, Homo sapiens
tgtgattggcctgt

SEQ ID NO: 2482962 - DNA, 15 bp, Homo sapiens
tgtgattggcctgta

SEQ ID NO: 2482963 - DNA, 17 bp, Homo sapiens
tgtgattgtggaatgga

SEQ ID NO: 2482964 - DNA, 15 bp, Homo sapiens
tgtgcaaggcagccg

SEQ ID NO: 2482965 - DNA, 13 bp, Homo sapiens
tgtgcaatagaag

SEQ ID NO: 2482966 - DNA, 17 bp, Homo sapiens
tgtgcaatgtaaatatt

SEQ ID NO: 2482967 - DNA, 11 bp, Homo sapiens
tgtgcaatgtg

SEQ ID NO: 2482968 - DNA, 14 bp, Homo sapiens
tgtgcaatgtgtat

SEQ ID NO: 2482969 - DNA, 21 bp, Homo sapiens
tgtgcacatctgtgtcttgtt

SEQ ID NO: 2482970 - DNA, 14 bp, Homo sapiens
tgtgcaccagggtt

SEQ ID NO: 2482971 - DNA, 20 bp, Homo sapiens
tgtgcacgtaaagtacttgt

SEQ ID NO: 2482972 - DNA, 21 bp, Homo sapiens
tgtgcactgcccatggacagg

SEQ ID NO: 2482973 - DNA, 20 bp, Homo sapiens
tgtgcactggcaccaagtgc

SEQ ID NO: 2482974 - DNA, 18 bp, Homo sapiens
tgtgcaggagcggcagat

SEQ ID NO: 2482975 - DNA, 14 bp, Homo sapiens
tgtgcaggttccca

SEQ ID NO: 2482976 - DNA, 17 bp, Homo sapiens
tgtgcagtcctgggtcc

SEQ ID NO: 2482977 - DNA, 12 bp, Homo sapiens
tgtgcagtgttg

SEQ ID NO: 2482978 - DNA, 13 bp, Homo sapiens
tgtgcatcaggct

SEQ ID NO: 2482979 - DNA, 14 bp, Homo sapiens
tgtgccagagcctg

SEQ ID NO: 2482980 - DNA, 17 bp, Homo sapiens
tgtgccagagcctgggg

SEQ ID NO: 2482981 - DNA, 21 bp, Homo sapiens
tgtgccagggcaatgatgaat

SEQ ID NO: 2482982 - DNA, 13 bp, Homo sapiens
tgtgccctccctg

SEQ ID NO: 2482983 - DNA, 13 bp, Homo sapiens
tgtgccctctggg

SEQ ID NO: 2482984 - DNA, 15 bp, Homo sapiens
tgtgccctctgggct

SEQ ID NO: 2482985 - DNA, 18 bp, Homo sapiens
tgtgccctctgggctctg

SEQ ID NO: 2482986 - DNA, 13 bp, Homo sapiens
tgtgcctcctccc

SEQ ID NO: 2482987 - DNA, 14 bp, Homo sapiens
tgtgccttcgtctt

SEQ ID NO: 2482988 - DNA, 23 bp, Homo sapiens
tgtgccttcgtctttcccatggg

SEQ ID NO: 2482989 - DNA, 17 bp, Homo sapiens
tgtgcggctgtgtgtgc

SEQ ID NO: 2482990 - DNA, 18 bp, Homo sapiens
tgtgctatggtgctctgt

SEQ ID NO: 2482991 - DNA, 12 bp, Homo sapiens
tgtgctcagccc

SEQ ID NO: 2482992 - DNA, 18 bp, Homo sapiens
tgtgctggaattctaaca

SEQ ID NO: 2482993 - DNA, 10 bp, Homo sapiens
tgtgctggga

SEQ ID NO: 2482994 - DNA, 21 bp, Homo sapiens
tgtgctgggagctccactctg

SEQ ID NO: 2482995 - DNA, 19 bp, Homo sapiens
tgtgctgtgctatggtgct

SEQ ID NO: 2482996 - DNA, 13 bp, Homo sapiens
tgtgcttattttt

SEQ ID NO: 2482997 - DNA, 19 bp, Homo sapiens
tgtgcttcgggcccttccc

SEQ ID NO: 2482998 - DNA, 16 bp, Homo sapiens
tgtgctttttttgtgt

SEQ ID NO: 2482999 - DNA, 15 bp, Homo sapiens
tgtggaactgctgcc

SEQ ID NO: 2483000 - DNA, 17 bp, Homo sapiens
tgtggatcagagatgca

SEQ ID NO: 2483001 - DNA, 20 bp, Homo sapiens
tgtggcagagttacagttct

SEQ ID NO: 2483002 - DNA, 21 bp, Homo sapiens
tgtggcagagttacagttctg

SEQ ID NO: 2483003 - DNA, 11 bp, Homo sapiens
tgtggccagga

SEQ ID NO: 2483004 - DNA, 23 bp, Homo sapiens
tgtggccatgaccctgcctctcc

SEQ ID NO: 2483005 - DNA, 13 bp, Homo sapiens
tgtggccccaccc

SEQ ID NO: 2483006 - DNA, 23 bp, Homo sapiens
tgtggccccaccctgggccctgg

SEQ ID NO: 2483007 - DNA, 19 bp, Homo sapiens
tgtggcctaagaggctgcc

SEQ ID NO: 2483008 - DNA, 19 bp, Homo sapiens
tgtggcgccgtctccaggg

SEQ ID NO: 2483009 - DNA, 12 bp, Homo sapiens
tgtgggagcctc

SEQ ID NO: 2483010 - DNA, 22 bp, Homo sapiens
tgtgggatgttcagcactgtcc

SEQ ID NO: 2483011 - DNA, 16 bp, Homo sapiens
tgtgggattatgggtc

SEQ ID NO: 2483012 - DNA, 18 bp, Homo sapiens
tgtgggattatgggtcac

SEQ ID NO: 2483013 - DNA, 23 bp, Homo sapiens
tgtgggattatgggtcacaggaa

SEQ ID NO: 2483014 - DNA, 19 bp, Homo sapiens
tgtgggcctgggctcctgg

SEQ ID NO: 2483015 - DNA, 15 bp, Homo sapiens
tgtgggttccacaga

SEQ ID NO: 2483016 - DNA, 20 bp, Homo sapiens
tgtggtaagcaacatggctt

SEQ ID NO: 2483017 - DNA, 15 bp, Homo sapiens
tgtggtacagagaag

SEQ ID NO: 2483018 - DNA, 18 bp, Homo sapiens
tgtggtacagagaagcca

SEQ ID NO: 2483019 - DNA, 16 bp, Homo sapiens
tgtggtacatggtgtt

SEQ ID NO: 2483020 - DNA, 15 bp, Homo sapiens
tgtggtcacagctgt

SEQ ID NO: 2483021 - DNA, 23 bp, Homo sapiens
tgtggtcacagctgtatagctgc

SEQ ID NO: 2483022 - DNA, 23 bp, Homo sapiens
tgtggtgtgtccccctctgtcca

SEQ ID NO: 2483023 - DNA, 15 bp, Homo sapiens
tgtggtttatatatt

SEQ ID NO: 2483024 - DNA, 17 bp, Homo sapiens
tgtggtttcatgttagt

SEQ ID NO: 2483025 - DNA, 19 bp, Homo sapiens
tgtggttttcttttgccat

SEQ ID NO: 2483026 - DNA, 21 bp, Homo sapiens
tgtgtaattagtgccacttaa

SEQ ID NO: 2483027 - DNA, 12 bp, Homo sapiens
tgtgtagccttt

SEQ ID NO: 2483028 - DNA, 14 bp, Homo sapiens
tgtgtagccttttt

SEQ ID NO: 2483029 - DNA, 21 bp, Homo sapiens
tgtgtataaaaataaaaaaga

SEQ ID NO: 2483030 - DNA, 14 bp, Homo sapiens
tgtgtataaacaag

SEQ ID NO: 2483031 - DNA, 13 bp, Homo sapiens
tgtgtatatggac

SEQ ID NO: 2483032 - DNA, 19 bp, Homo sapiens
tgtgtatgcacatgaactt

SEQ ID NO: 2483033 - DNA, 15 bp, Homo sapiens
tgtgtatttgctaat

SEQ ID NO: 2483034 - DNA, 23 bp, Homo sapiens
tgtgtccaaaaccgccagctctg

SEQ ID NO: 2483035 - DNA, 20 bp, Homo sapiens
tgtgtccatgcgctcagggc

SEQ ID NO: 2483036 - DNA, 23 bp, Homo sapiens
tgtgtcccagaagatgactgagg

SEQ ID NO: 2483037 - DNA, 20 bp, Homo sapiens
tgtgtcccatgatccctgtg

SEQ ID NO: 2483038 - DNA, 21 bp, Homo sapiens
tgtgtccccctctgtccaggc

SEQ ID NO: 2483039 - DNA, 14 bp, Homo sapiens
tgtgtcctgacact

SEQ ID NO: 2483040 - DNA, 17 bp, Homo sapiens
tgtgtctaagattctag

SEQ ID NO: 2483041 - DNA, 18 bp, Homo sapiens
tgtgtctaagattctaga

SEQ ID NO: 2483042 - DNA, 19 bp, Homo sapiens
tgtgtctaagattctagat

SEQ ID NO: 2483043 - DNA, 22 bp, Homo sapiens
tgtgtgaatgaacactcttttg

SEQ ID NO: 2483044 - DNA, 22 bp, Homo sapiens
tgtgtgcaacagggtatggact

SEQ ID NO: 2483045 - DNA, 15 bp, Homo sapiens
tgtgtgcatcaggct

SEQ ID NO: 2483046 - DNA, 22 bp, Homo sapiens
tgtgtgcatcaggctttctttt

SEQ ID NO: 2483047 - DNA, 22 bp, Homo sapiens
tgtgtggagagggaatgtgaaa

SEQ ID NO: 2483048 - DNA, 14 bp, Homo sapiens
tgtgtggattcttt

SEQ ID NO: 2483049 - DNA, 22 bp, Homo sapiens
tgtgtgtccacgactgtctcca

SEQ ID NO: 2483050 - DNA, 13 bp, Homo sapiens
tgtgtgtgtgaat

SEQ ID NO: 2483051 - DNA, 20 bp, Homo sapiens
tgtgtgttaagctctgctat

SEQ ID NO: 2483052 - DNA, 15 bp, Homo sapiens
tgtgttgatactgtt

SEQ ID NO: 2483053 - DNA, 16 bp, Homo sapiens
tgtgttgatactgttg

SEQ ID NO: 2483054 - DNA, 20 bp, Homo sapiens
tgtgttgatactgttgcacg

SEQ ID NO: 2483055 - DNA, 13 bp, Homo sapiens
tgtgttgccaagc

SEQ ID NO: 2483056 - DNA, 16 bp, Homo sapiens
tgtgttgccaagctcc

SEQ ID NO: 2483057 - DNA, 12 bp, Homo sapiens
tgtgttggctgt

SEQ ID NO: 2483058 - DNA, 13 bp, Homo sapiens
tgtgttgtctcta

SEQ ID NO: 2483059 - DNA, 19 bp, Homo sapiens
tgtgtttcacagtttgaaa

SEQ ID NO: 2483060 - DNA, 23 bp, Homo sapiens
tgtgtttcacagtttgaaataag

SEQ ID NO: 2483061 - DNA, 15 bp, Homo sapiens
tgtgtttgctttctg

SEQ ID NO: 2483062 - DNA, 17 bp, Homo sapiens
tgtgtttggaagactat

SEQ ID NO: 2483063 - DNA, 15 bp, Homo sapiens
tgtgtttttaacatg

SEQ ID NO: 2483064 - DNA, 15 bp, Homo sapiens
tgtgtttttctatta

SEQ ID NO: 2483065 - DNA, 16 bp, Homo sapiens
tgtgtttttctattaa

SEQ ID NO: 2483066 - DNA, 19 bp, Homo sapiens
tgttaaaaaaataagaaga

SEQ ID NO: 2483067 - DNA, 23 bp, Homo sapiens
tgttaaaaaaataagaagaatgc

SEQ ID NO: 2483068 - DNA, 13 bp, Homo sapiens
tgttaacagaagg

SEQ ID NO: 2483069 - DNA, 21 bp, Homo sapiens
tgttaacagaagggagggcag

SEQ ID NO: 2483070 - DNA, 15 bp, Homo sapiens
tgttaagtattttca

SEQ ID NO: 2483071 - DNA, 17 bp, Homo sapiens
tgttaagtattttcata

SEQ ID NO: 2483072 - DNA, 15 bp, Homo sapiens
tgttacctgaaaaca

SEQ ID NO: 2483073 - DNA, 20 bp, Homo sapiens
tgttactaaaaaaaagatga

SEQ ID NO: 2483074 - DNA, 12 bp, Homo sapiens
tgttactgtaat

SEQ ID NO: 2483075 - DNA, 14 bp, Homo sapiens
tgttactgtaattc

SEQ ID NO: 2483076 - DNA, 15 bp, Homo sapiens
tgttactgtaattcc

SEQ ID NO: 2483077 - DNA, 15 bp, Homo sapiens
tgttagtcatttgct

SEQ ID NO: 2483078 - DNA, 12 bp, Homo sapiens
tgttatataatt

SEQ ID NO: 2483079 - DNA, 15 bp, Homo sapiens
tgttatataatttag

SEQ ID NO: 2483080 - DNA, 16 bp, Homo sapiens
tgttatatataaatat

SEQ ID NO: 2483081 - DNA, 20 bp, Homo sapiens
tgttatcttctcaagttcta

SEQ ID NO: 2483082 - DNA, 23 bp, Homo sapiens
tgttatcttctcaagttctaaga

SEQ ID NO: 2483083 - DNA, 23 bp, Homo sapiens
tgttattagagattacctcctga

SEQ ID NO: 2483084 - DNA, 14 bp, Homo sapiens
tgttatttaaagaa

SEQ ID NO: 2483085 - DNA, 14 bp, Homo sapiens
tgttattttgcaac

SEQ ID NO: 2483086 - DNA, 22 bp, Homo sapiens
tgttcaaagccagcgtcctcct

SEQ ID NO: 2483087 - DNA, 14 bp, Homo sapiens
tgttcagcactgtc

SEQ ID NO: 2483088 - DNA, 17 bp, Homo sapiens
tgttcagcactgtccct

SEQ ID NO: 2483089 - DNA, 20 bp, Homo sapiens
tgttccaaattcagtttcat

SEQ ID NO: 2483090 - DNA, 22 bp, Homo sapiens
tgttccaaattcagtttcataa

SEQ ID NO: 2483091 - DNA, 18 bp, Homo sapiens
tgttccagtaatctaata

SEQ ID NO: 2483092 - DNA, 15 bp, Homo sapiens
tgttccattaaacga

SEQ ID NO: 2483093 - DNA, 22 bp, Homo sapiens
tgttccccactgacagcctccc

SEQ ID NO: 2483094 - DNA, 15 bp, Homo sapiens
tgttccccactggag

SEQ ID NO: 2483095 - DNA, 14 bp, Homo sapiens
tgttccccttccac

SEQ ID NO: 2483096 - DNA, 20 bp, Homo sapiens
tgttccccttccactgaggg

SEQ ID NO: 2483097 - DNA, 23 bp, Homo sapiens
tgttccccttccactgagggcag

SEQ ID NO: 2483098 - DNA, 16 bp, Homo sapiens
tgttctaacctttaca

SEQ ID NO: 2483099 - DNA, 13 bp, Homo sapiens
tgttctaagatgt

SEQ ID NO: 2483100 - DNA, 12 bp, Homo sapiens
tgttctaaggct

SEQ ID NO: 2483101 - DNA, 19 bp, Homo sapiens
tgttctaaggctctgagag

SEQ ID NO: 2483102 - DNA, 14 bp, Homo sapiens
tgttctaagtttct

SEQ ID NO: 2483103 - DNA, 18 bp, Homo sapiens
tgttctaagtttctaaga

SEQ ID NO: 2483104 - DNA, 23 bp, Homo sapiens
tgttctaagtttctaagattcta

SEQ ID NO: 2483105 - DNA, 14 bp, Homo sapiens
tgttctagtttttt

SEQ ID NO: 2483106 - DNA, 22 bp, Homo sapiens
tgttctcctgctgctccctcag

SEQ ID NO: 2483107 - DNA, 23 bp, Homo sapiens
tgttctcctgctgctccctcaga

SEQ ID NO: 2483108 - DNA, 21 bp, Homo sapiens
tgttctccttttcctctctcc

SEQ ID NO: 2483109 - DNA, 23 bp, Homo sapiens
tgttctcttgggaactgaactca

SEQ ID NO: 2483110 - DNA, 17 bp, Homo sapiens
tgttctgttaactgaat

SEQ ID NO: 2483111 - DNA, 19 bp, Homo sapiens
tgttctgttaactgaatac

SEQ ID NO: 2483112 - DNA, 13 bp, Homo sapiens
tgttctgttttgt

SEQ ID NO: 2483113 - DNA, 18 bp, Homo sapiens
tgttcttagctcaatgag

SEQ ID NO: 2483114 - DNA, 10 bp, Homo sapiens
tgttcttcct

SEQ ID NO: 2483115 - DNA, 12 bp, Homo sapiens
tgttgacattag

SEQ ID NO: 2483116 - DNA, 22 bp, Homo sapiens
tgttgagaatcccaaatttgat

SEQ ID NO: 2483117 - DNA, 13 bp, Homo sapiens
tgttgagacagag

SEQ ID NO: 2483118 - DNA, 15 bp, Homo sapiens
tgttgatactgttgc

SEQ ID NO: 2483119 - DNA, 16 bp, Homo sapiens
tgttgatactgttgca

SEQ ID NO: 2483120 - DNA, 17 bp, Homo sapiens
tgttgcaagtgcaataa

SEQ ID NO: 2483121 - DNA, 22 bp, Homo sapiens
tgttgccaaatatgtcctgggg

SEQ ID NO: 2483122 - DNA, 21 bp, Homo sapiens
tgttggacaagcttctgagac

SEQ ID NO: 2483123 - DNA, 22 bp, Homo sapiens
tgttggacaagcttctgagacg

SEQ ID NO: 2483124 - DNA, 14 bp, Homo sapiens
tgttgggactgcta

SEQ ID NO: 2483125 - DNA, 21 bp, Homo sapiens
tgttgtagattgattgtattg

SEQ ID NO: 2483126 - DNA, 16 bp, Homo sapiens
tgttgtcaagaatagc

SEQ ID NO: 2483127 - DNA, 13 bp, Homo sapiens
tgttgtcaccaga

SEQ ID NO: 2483128 - DNA, 22 bp, Homo sapiens
tgttgtccttttcataggtctg

SEQ ID NO: 2483129 - DNA, 18 bp, Homo sapiens
tgttgtcgtaaagatttg

SEQ ID NO: 2483130 - DNA, 13 bp, Homo sapiens
tgttgttatttaa

SEQ ID NO: 2483131 - DNA, 13 bp, Homo sapiens
tgttgttctgtta

SEQ ID NO: 2483132 - DNA, 12 bp, Homo sapiens
tgtttaaaactt

SEQ ID NO: 2483133 - DNA, 18 bp, Homo sapiens
tgtttacactctttgtaa

SEQ ID NO: 2483134 - DNA, 19 bp, Homo sapiens
tgtttacactctttgtaag

SEQ ID NO: 2483135 - DNA, 22 bp, Homo sapiens
tgtttacagataattacctact

SEQ ID NO: 2483136 - DNA, 13 bp, Homo sapiens
tgtttacatgctt

SEQ ID NO: 2483137 - DNA, 16 bp, Homo sapiens
tgtttacatgcttatt

SEQ ID NO: 2483138 - DNA, 21 bp, Homo sapiens
tgtttacatgcttattccatg

SEQ ID NO: 2483139 - DNA, 15 bp, Homo sapiens
tgtttactgcaaggt

SEQ ID NO: 2483140 - DNA, 13 bp, Homo sapiens
tgtttagacttta

SEQ ID NO: 2483141 - DNA, 16 bp, Homo sapiens
tgtttatcctttcata

SEQ ID NO: 2483142 - DNA, 16 bp, Homo sapiens
tgtttatgtaatttca

SEQ ID NO: 2483143 - DNA, 16 bp, Homo sapiens
tgtttattcttctaga

SEQ ID NO: 2483144 - DNA, 12 bp, Homo sapiens
tgtttcaagagg

SEQ ID NO: 2483145 - DNA, 22 bp, Homo sapiens
tgtttcaagaggagcccccacc

SEQ ID NO: 2483146 - DNA, 20 bp, Homo sapiens
tgtttcaaggcactctagat

SEQ ID NO: 2483147 - DNA, 16 bp, Homo sapiens
tgtttcaattgcatct

SEQ ID NO: 2483148 - DNA, 13 bp, Homo sapiens
tgtttcacaaggt

SEQ ID NO: 2483149 - DNA, 16 bp, Homo sapiens
tgtttcacaaggtctt

SEQ ID NO: 2483150 - DNA, 20 bp, Homo sapiens
tgtttcacagtttgaaataa

SEQ ID NO: 2483151 - DNA, 15 bp, Homo sapiens
tgtttccagcattcc

SEQ ID NO: 2483152 - DNA, 18 bp, Homo sapiens
tgtttccagcattcccag

SEQ ID NO: 2483153 - DNA, 20 bp, Homo sapiens
tgtttccctttcactggcat

SEQ ID NO: 2483154 - DNA, 16 bp, Homo sapiens
tgtttcctttttcaga

SEQ ID NO: 2483155 - DNA, 13 bp, Homo sapiens
tgtttctccccca

SEQ ID NO: 2483156 - DNA, 11 bp, Homo sapiens
tgtttctgtaa

SEQ ID NO: 2483157 - DNA, 15 bp, Homo sapiens
tgtttgaggaaagca

SEQ ID NO: 2483158 - DNA, 13 bp, Homo sapiens
tgtttgatagatt

SEQ ID NO: 2483159 - DNA, 15 bp, Homo sapiens
tgtttgcttcaactg

SEQ ID NO: 2483160 - DNA, 12 bp, Homo sapiens
tgtttggaaata

SEQ ID NO: 2483161 - DNA, 18 bp, Homo sapiens
tgtttggaatattgtcca

SEQ ID NO: 2483162 - DNA, 12 bp, Homo sapiens
tgtttggctggg

SEQ ID NO: 2483163 - DNA, 15 bp, Homo sapiens
tgtttggggcaggag

SEQ ID NO: 2483164 - DNA, 14 bp, Homo sapiens
tgtttgtgctgtgg

SEQ ID NO: 2483165 - DNA, 15 bp, Homo sapiens
tgtttgtgctgtggt

SEQ ID NO: 2483166 - DNA, 11 bp, Homo sapiens
tgtttgttggt

SEQ ID NO: 2483167 - DNA, 14 bp, Homo sapiens
tgttttatgagaaa

SEQ ID NO: 2483168 - DNA, 17 bp, Homo sapiens
tgttttcttttggtaaa

SEQ ID NO: 2483169 - DNA, 18 bp, Homo sapiens
tgttttgcacagccaaat

SEQ ID NO: 2483170 - DNA, 14 bp, Homo sapiens
tgttttgctaaagg

SEQ ID NO: 2483171 - DNA, 18 bp, Homo sapiens
tgttttggctgaaattct

SEQ ID NO: 2483172 - DNA, 12 bp, Homo sapiens
tgttttgttgac

SEQ ID NO: 2483173 - DNA, 13 bp, Homo sapiens
tgttttgttgaca

SEQ ID NO: 2483174 - DNA, 15 bp, Homo sapiens
tgttttgttgacatt

SEQ ID NO: 2483175 - DNA, 21 bp, Homo sapiens
tgttttgttgacattctgaat

SEQ ID NO: 2483176 - DNA, 15 bp, Homo sapiens
tgtttttaaactgta

SEQ ID NO: 2483177 - DNA, 19 bp, Homo sapiens
tgtttttaaactgtacagt

SEQ ID NO: 2483178 - DNA, 16 bp, Homo sapiens
tgtttttatcttttta

SEQ ID NO: 2483179 - DNA, 11 bp, Homo sapiens
tgtttttcatt

SEQ ID NO: 2483180 - DNA, 16 bp, Homo sapiens
tgtttttccttccaat

SEQ ID NO: 2483181 - DNA, 13 bp, Homo sapiens
tgtttttctaaag

SEQ ID NO: 2483182 - DNA, 16 bp, Homo sapiens
tgtttttgcacatgtt

SEQ ID NO: 2483183 - DNA, 15 bp, Homo sapiens
tgttttttgccacag

SEQ ID NO: 2483184 - DNA, 18 bp, Homo sapiens
tgttttttgccacagctt

SEQ ID NO: 2483185 - DNA, 15 bp, Homo sapiens
tgtttttttgtttgt

SEQ ID NO: 2483186 - DNA, 12 bp, Homo sapiens
ttaaaaaaataa

SEQ ID NO: 2483187 - DNA, 15 bp, Homo sapiens
ttaaaaaagataaac

SEQ ID NO: 2483188 - DNA, 12 bp, Homo sapiens
ttaaaaaagctt

SEQ ID NO: 2483189 - DNA, 19 bp, Homo sapiens
ttaaaaaagcttaaaactt

SEQ ID NO: 2483190 - DNA, 13 bp, Homo sapiens
ttaaaaagccagt

SEQ ID NO: 2483191 - DNA, 20 bp, Homo sapiens
ttaaaaaggcagtttgcaaa

SEQ ID NO: 2483192 - DNA, 22 bp, Homo sapiens
ttaaaaaggcagtttgcaaaaa

SEQ ID NO: 2483193 - DNA, 20 bp, Homo sapiens
ttaaaaagttataaccaact

SEQ ID NO: 2483194 - DNA, 21 bp, Homo sapiens
ttaaaaataagtcaacagtaa

SEQ ID NO: 2483195 - DNA, 17 bp, Homo sapiens
ttaaaaattcagcaaag

SEQ ID NO: 2483196 - DNA, 18 bp, Homo sapiens
ttaaaagcaaatcatttg

SEQ ID NO: 2483197 - DNA, 15 bp, Homo sapiens
ttaaaataattatat

SEQ ID NO: 2483198 - DNA, 22 bp, Homo sapiens
ttaaaatagcaaaagaagaagt

SEQ ID NO: 2483199 - DNA, 22 bp, Homo sapiens
ttaaaatagcgttcttgtaatt

SEQ ID NO: 2483200 - DNA, 23 bp, Homo sapiens
ttaaaatagcgttcttgtaattt

SEQ ID NO: 2483201 - DNA, 12 bp, Homo sapiens
ttaaaatcctca

SEQ ID NO: 2483202 - DNA, 13 bp, Homo sapiens
ttaaaatcctcaa

SEQ ID NO: 2483203 - DNA, 13 bp, Homo sapiens
ttaaaatgttcac

SEQ ID NO: 2483204 - DNA, 19 bp, Homo sapiens
ttaaaatttgttcttgtat

SEQ ID NO: 2483205 - DNA, 13 bp, Homo sapiens
ttaaacacctcct

SEQ ID NO: 2483206 - DNA, 23 bp, Homo sapiens
ttaaacattaatagcagcctttc

SEQ ID NO: 2483207 - DNA, 14 bp, Homo sapiens
ttaaaccatctccc

SEQ ID NO: 2483208 - DNA, 17 bp, Homo sapiens
ttaaaccatctccctgg

SEQ ID NO: 2483209 - DNA, 23 bp, Homo sapiens
ttaaacgctctaggtacgatgac

SEQ ID NO: 2483210 - DNA, 14 bp, Homo sapiens
ttaaactaaatgtg

SEQ ID NO: 2483211 - DNA, 22 bp, Homo sapiens
ttaaactaggagaaccaaatct

SEQ ID NO: 2483212 - DNA, 13 bp, Homo sapiens
ttaaactgtacag

SEQ ID NO: 2483213 - DNA, 15 bp, Homo sapiens
ttaaactgtacagtg

SEQ ID NO: 2483214 - DNA, 16 bp, Homo sapiens
ttaaactgtacagtgt

SEQ ID NO: 2483215 - DNA, 17 bp, Homo sapiens
ttaaacttttaattcat

SEQ ID NO: 2483216 - DNA, 18 bp, Homo sapiens
ttaaacttttaattcatt

SEQ ID NO: 2483217 - DNA, 18 bp, Homo sapiens
ttaaagaaaaaaatgtat

SEQ ID NO: 2483218 - DNA, 16 bp, Homo sapiens
ttaaagaatatgaaac

SEQ ID NO: 2483219 - DNA, 18 bp, Homo sapiens
ttaaagagtctagattca

SEQ ID NO: 2483220 - DNA, 20 bp, Homo sapiens
ttaaagcaggttcttgttgg

SEQ ID NO: 2483221 - DNA, 21 bp, Homo sapiens
ttaaaggggagacctcagaag

SEQ ID NO: 2483222 - DNA, 13 bp, Homo sapiens
ttaaagtattctt

SEQ ID NO: 2483223 - DNA, 20 bp, Homo sapiens
ttaaagtgactaatggcatg

SEQ ID NO: 2483224 - DNA, 21 bp, Homo sapiens
ttaaagtgactaatggcatga

SEQ ID NO: 2483225 - DNA, 17 bp, Homo sapiens
ttaaataaatttgactt

SEQ ID NO: 2483226 - DNA, 22 bp, Homo sapiens
ttaaataaatttgacttttctg

SEQ ID NO: 2483227 - DNA, 15 bp, Homo sapiens
ttaaataagaaactt

SEQ ID NO: 2483228 - DNA, 17 bp, Homo sapiens
ttaaataagaaactttt

SEQ ID NO: 2483229 - DNA, 14 bp, Homo sapiens
ttaaataagattct

SEQ ID NO: 2483230 - DNA, 17 bp, Homo sapiens
ttaaataagattctaac

SEQ ID NO: 2483231 - DNA, 18 bp, Homo sapiens
ttaaataagattctaacg

SEQ ID NO: 2483232 - DNA, 20 bp, Homo sapiens
ttaaatacaggaaacagttg

SEQ ID NO: 2483233 - DNA, 13 bp, Homo sapiens
ttaaatacagtct

SEQ ID NO: 2483234 - DNA, 16 bp, Homo sapiens
ttaaatctcattgctt

SEQ ID NO: 2483235 - DNA, 17 bp, Homo sapiens
ttaaatgaacaagagaa

SEQ ID NO: 2483236 - DNA, 20 bp, Homo sapiens
ttaaatgcaaccatttgaaa

SEQ ID NO: 2483237 - DNA, 13 bp, Homo sapiens
ttaaattacagaa

SEQ ID NO: 2483238 - DNA, 22 bp, Homo sapiens
ttaaattcccgttttgtcactt

SEQ ID NO: 2483239 - DNA, 22 bp, Homo sapiens
ttaacaacatgtttccagcatt

SEQ ID NO: 2483240 - DNA, 17 bp, Homo sapiens
ttaacaattaggcagac

SEQ ID NO: 2483241 - DNA, 17 bp, Homo sapiens
ttaacagaaactttcaa

SEQ ID NO: 2483242 - DNA, 15 bp, Homo sapiens
ttaacagaaattgta

SEQ ID NO: 2483243 - DNA, 20 bp, Homo sapiens
ttaacagaagggagggcaga

SEQ ID NO: 2483244 - DNA, 15 bp, Homo sapiens
ttaacagttgtattt

SEQ ID NO: 2483245 - DNA, 14 bp, Homo sapiens
ttaacataagctat

SEQ ID NO: 2483246 - DNA, 23 bp, Homo sapiens
ttaacattcctcatgaatgtaaa

SEQ ID NO: 2483247 - DNA, 18 bp, Homo sapiens
ttaacccccctgtacaca

SEQ ID NO: 2483248 - DNA, 21 bp, Homo sapiens
ttaactgaataccactctgta

SEQ ID NO: 2483249 - DNA, 14 bp, Homo sapiens
ttaacttcttgctt

SEQ ID NO: 2483250 - DNA, 21 bp, Homo sapiens
ttaacttcttgcttctttcta

SEQ ID NO: 2483251 - DNA, 22 bp, Homo sapiens
ttaagaaatagacagcatgaga

SEQ ID NO: 2483252 - DNA, 20 bp, Homo sapiens
ttaagacactgaaaaatcta

SEQ ID NO: 2483253 - DNA, 18 bp, Homo sapiens
ttaagacatgatttcctt

SEQ ID NO: 2483254 - DNA, 18 bp, Homo sapiens
ttaagacctactgttcta

SEQ ID NO: 2483255 - DNA, 20 bp, Homo sapiens
ttaagacctactgttctaaa

SEQ ID NO: 2483256 - DNA, 13 bp, Homo sapiens
ttaagagtccaag

SEQ ID NO: 2483257 - DNA, 18 bp, Homo sapiens
ttaagatcacagtgaact

SEQ ID NO: 2483258 - DNA, 22 bp, Homo sapiens
ttaagcatctggctctaattca

SEQ ID NO: 2483259 - DNA, 16 bp, Homo sapiens
ttaagccaaaacaatg

SEQ ID NO: 2483260 - DNA, 20 bp, Homo sapiens
ttaagcccagtgcactgaaa

SEQ ID NO: 2483261 - DNA, 14 bp, Homo sapiens
ttaaggtgtagcca

SEQ ID NO: 2483262 - DNA, 22 bp, Homo sapiens
ttaagttatagtgaatactgct

SEQ ID NO: 2483263 - DNA, 21 bp, Homo sapiens
ttaagttgagatagttttcat

SEQ ID NO: 2483264 - DNA, 22 bp, Homo sapiens
ttaagttgagatagttttcatc

SEQ ID NO: 2483265 - DNA, 18 bp, Homo sapiens
ttaagttgctgatgaact

SEQ ID NO: 2483266 - DNA, 14 bp, Homo sapiens
ttaataaaaataat

SEQ ID NO: 2483267 - DNA, 16 bp, Homo sapiens
ttaatagcaaagaatt

SEQ ID NO: 2483268 - DNA, 18 bp, Homo sapiens
ttaatagcaaagaattga

SEQ ID NO: 2483269 - DNA, 15 bp, Homo sapiens
ttaatagcagccttt

SEQ ID NO: 2483270 - DNA, 22 bp, Homo sapiens
ttaatagcagcctttctctctt

SEQ ID NO: 2483271 - DNA, 22 bp, Homo sapiens
ttaatataaagttttatatatt

SEQ ID NO: 2483272 - DNA, 17 bp, Homo sapiens
ttaatataaatgcaaat

SEQ ID NO: 2483273 - DNA, 19 bp, Homo sapiens
ttaatatccctacatgtat

SEQ ID NO: 2483274 - DNA, 17 bp, Homo sapiens
ttaatatcctaaacatc

SEQ ID NO: 2483275 - DNA, 17 bp, Homo sapiens
ttaatcagatagatatt

SEQ ID NO: 2483276 - DNA, 15 bp, Homo sapiens
ttaatcatcaagaga

SEQ ID NO: 2483277 - DNA, 16 bp, Homo sapiens
ttaatcttagtgtatg

SEQ ID NO: 2483278 - DNA, 21 bp, Homo sapiens
ttaatcttagtgtatgattac

SEQ ID NO: 2483279 - DNA, 18 bp, Homo sapiens
ttaatgaagaaagtggaa

SEQ ID NO: 2483280 - DNA, 14 bp, Homo sapiens
ttaatgcactttct

SEQ ID NO: 2483281 - DNA, 13 bp, Homo sapiens
ttaatgcccagac

SEQ ID NO: 2483282 - DNA, 16 bp, Homo sapiens
ttaatggctgataatt

SEQ ID NO: 2483283 - DNA, 19 bp, Homo sapiens
ttaatgtatagtaaatcac

SEQ ID NO: 2483284 - DNA, 13 bp, Homo sapiens
ttaatgtatgtta

SEQ ID NO: 2483285 - DNA, 17 bp, Homo sapiens
ttaatgtatgttaccaa

SEQ ID NO: 2483286 - DNA, 17 bp, Homo sapiens
ttaattattattcttca

SEQ ID NO: 2483287 - DNA, 14 bp, Homo sapiens
ttaattattattta

SEQ ID NO: 2483288 - DNA, 21 bp, Homo sapiens
ttaattcagaaccccaactac

SEQ ID NO: 2483289 - DNA, 19 bp, Homo sapiens
ttaattgccacctctaaca

SEQ ID NO: 2483290 - DNA, 21 bp, Homo sapiens
ttaattgggccagcttttcaa

SEQ ID NO: 2483291 - DNA, 22 bp, Homo sapiens
ttaattgggccagcttttcaaa

SEQ ID NO: 2483292 - DNA, 17 bp, Homo sapiens
ttaatttagtaaaccaa

SEQ ID NO: 2483293 - DNA, 17 bp, Homo sapiens
ttaattttagtttttca

SEQ ID NO: 2483294 - DNA, 21 bp, Homo sapiens
ttaattttagtttttcattaa

SEQ ID NO: 2483295 - DNA, 13 bp, Homo sapiens
ttaatttttccta

SEQ ID NO: 2483296 - DNA, 13 bp, Homo sapiens
ttaatttttgata

SEQ ID NO: 2483297 - DNA, 17 bp, Homo sapiens
ttacaaaacaaactcat

SEQ ID NO: 2483298 - DNA, 18 bp, Homo sapiens
ttacaaaacaaactcatt

SEQ ID NO: 2483299 - DNA, 18 bp, Homo sapiens
ttacaaaactacatgaga

SEQ ID NO: 2483300 - DNA, 16 bp, Homo sapiens
ttacaaactgaagagt

SEQ ID NO: 2483301 - DNA, 16 bp, Homo sapiens
ttacaaatcagaagtc

SEQ ID NO: 2483302 - DNA, 19 bp, Homo sapiens
ttacaaatgttaaaatgtg

SEQ ID NO: 2483303 - DNA, 22 bp, Homo sapiens
ttacaactgcctcgaaacacag

SEQ ID NO: 2483304 - DNA, 21 bp, Homo sapiens
ttacaataaaactttgctgcc

SEQ ID NO: 2483305 - DNA, 15 bp, Homo sapiens
ttacaatgtaattat

SEQ ID NO: 2483306 - DNA, 19 bp, Homo sapiens
ttacaatgtaattatttat

SEQ ID NO: 2483307 - DNA, 22 bp, Homo sapiens
ttacactacacactgtgtactg

SEQ ID NO: 2483308 - DNA, 15 bp, Homo sapiens
ttacactctttgtaa

SEQ ID NO: 2483309 - DNA, 16 bp, Homo sapiens
ttacactttttggaag

SEQ ID NO: 2483310 - DNA, 19 bp, Homo sapiens
ttacagacgctgctgtcac

SEQ ID NO: 2483311 - DNA, 19 bp, Homo sapiens
ttacagtaggagcccagct

SEQ ID NO: 2483312 - DNA, 12 bp, Homo sapiens
ttacagttctgt

SEQ ID NO: 2483313 - DNA, 22 bp, Homo sapiens
ttacagttctgtggtttcatgt

SEQ ID NO: 2483314 - DNA, 14 bp, Homo sapiens
ttacatcatttctt

SEQ ID NO: 2483315 - DNA, 14 bp, Homo sapiens
ttacatgaagtatt

SEQ ID NO: 2483316 - DNA, 13 bp, Homo sapiens
ttacatgcttatt

SEQ ID NO: 2483317 - DNA, 20 bp, Homo sapiens
ttacatgcttattccatgac

SEQ ID NO: 2483318 - DNA, 18 bp, Homo sapiens
ttcaccattataatgaat

SEQ ID NO: 2483319 - DNA, 12 bp, Homo sapiens
ttccccagagaa

SEQ ID NO: 2483320 - DNA, 23 bp, Homo sapiens
ttcccccaccaccaaaactgctc

SEQ ID NO: 2483321 - DNA, 17 bp, Homo sapiens
ttccccctctcccagtt

SEQ ID NO: 2483322 - DNA, 20 bp, Homo sapiens
ttccccttatcctccctgta

SEQ ID NO: 2483323 - DNA, 20 bp, Homo sapiens
ttcccgcagtgggagcaaac

SEQ ID NO: 2483324 - DNA, 20 bp, Homo sapiens
tggtgctgggagaggcagcc

SEQ ID NO: 2483325 - DNA, 13 bp, Homo sapiens
tggtggagggcca

SEQ ID NO: 2483326 - DNA, 16 bp, Homo sapiens
tggtggccctctcccc

SEQ ID NO: 2483327 - DNA, 19 bp, Homo sapiens
tggtggccctctcccctgc

SEQ ID NO: 2483328 - DNA, 21 bp, Homo sapiens
tggtggccctctcccctgccc

SEQ ID NO: 2483329 - DNA, 22 bp, Homo sapiens
tggtggccctctcccctgcccc

SEQ ID NO: 2483330 - DNA, 16 bp, Homo sapiens
tggtggcctggtccct

SEQ ID NO: 2483331 - DNA, 20 bp, Homo sapiens
tggtgggccaacaaagaaca

SEQ ID NO: 2483332 - DNA, 23 bp, Homo sapiens
tggtgggccaacaaagaacacta

SEQ ID NO: 2483333 - DNA, 14 bp, Homo sapiens
tggtggggcagctc

SEQ ID NO: 2483334 - DNA, 15 bp, Homo sapiens
tggtggtctgttggc

SEQ ID NO: 2483335 - DNA, 15 bp, Homo sapiens
tggtgtagaacacta

SEQ ID NO: 2483336 - DNA, 21 bp, Homo sapiens
tggtgtagaacactaattcat

SEQ ID NO: 2483337 - DNA, 15 bp, Homo sapiens
tggtgtagctacaga

SEQ ID NO: 2483338 - DNA, 17 bp, Homo sapiens
tggtgtagctacagaga

SEQ ID NO: 2483339 - DNA, 18 bp, Homo sapiens
tggtgtagctacagagaa

SEQ ID NO: 2483340 - DNA, 21 bp, Homo sapiens
tggtgtccagacagagccctg

SEQ ID NO: 2483341 - DNA, 20 bp, Homo sapiens
tggtgtggtacagagaagcc

SEQ ID NO: 2483342 - DNA, 14 bp, Homo sapiens
tggtgttctcctgc

SEQ ID NO: 2483343 - DNA, 17 bp, Homo sapiens
tggtgttctcctgctgc

SEQ ID NO: 2483344 - DNA, 13 bp, Homo sapiens
tggttaagagtcc

SEQ ID NO: 2483345 - DNA, 15 bp, Homo sapiens
tggttcacactgacc

SEQ ID NO: 2483346 - DNA, 20 bp, Homo sapiens
tggttcagaattaaactttt

SEQ ID NO: 2483347 - DNA, 21 bp, Homo sapiens
tggttccagggtccctctgtg

SEQ ID NO: 2483348 - DNA, 18 bp, Homo sapiens
tggttcccgtttctccac

SEQ ID NO: 2483349 - DNA, 22 bp, Homo sapiens
tggttcttgaggggaccaggag

SEQ ID NO: 2483350 - DNA, 14 bp, Homo sapiens
tggttgatgccaaa

SEQ ID NO: 2483351 - DNA, 16 bp, Homo sapiens
tggtttaaagaaagtg

SEQ ID NO: 2483352 - DNA, 13 bp, Homo sapiens
tggtttcagcact

SEQ ID NO: 2483353 - DNA, 20 bp, Homo sapiens
tggtttcagcactagccaaa

SEQ ID NO: 2483354 - DNA, 15 bp, Homo sapiens
tggtttcatgttagt

SEQ ID NO: 2483355 - DNA, 13 bp, Homo sapiens
tggtttcccaaga

SEQ ID NO: 2483356 - DNA, 17 bp, Homo sapiens
tggtttgccttccagaa

SEQ ID NO: 2483357 - DNA, 18 bp, Homo sapiens
tggttttcttttgccatg

SEQ ID NO: 2483358 - DNA, 19 bp, Homo sapiens
tggttttcttttgccatga

SEQ ID NO: 2483359 - DNA, 22 bp, Homo sapiens
tgtaaaacaggtagaattatct

SEQ ID NO: 2483360 - DNA, 17 bp, Homo sapiens
tgtaaaagcattttgta

SEQ ID NO: 2483361 - DNA, 18 bp, Homo sapiens
tgtaaaagcattttgtaa

SEQ ID NO: 2483362 - DNA, 16 bp, Homo sapiens
tgtaaaataattctga

SEQ ID NO: 2483363 - DNA, 16 bp, Homo sapiens
tgtaaaatcttgtcat

SEQ ID NO: 2483364 - DNA, 22 bp, Homo sapiens
tgtaaaatcttgtcatgtgtat

SEQ ID NO: 2483365 - DNA, 18 bp, Homo sapiens
tgtaaactttatcactta

SEQ ID NO: 2483366 - DNA, 11 bp, Homo sapiens
tgtaaagatgt

SEQ ID NO: 2483367 - DNA, 13 bp, Homo sapiens
tgtaaagccatgc

SEQ ID NO: 2483368 - DNA, 16 bp, Homo sapiens
tgtaaaggagtcaaaa

SEQ ID NO: 2483369 - DNA, 15 bp, Homo sapiens
tgtaaatacccatat

SEQ ID NO: 2483370 - DNA, 17 bp, Homo sapiens
tgtaaatataaagacgt

SEQ ID NO: 2483371 - DNA, 18 bp, Homo sapiens
tgtaaatatgtacatttc

SEQ ID NO: 2483372 - DNA, 17 bp, Homo sapiens
tgtaaatattttaaaga

SEQ ID NO: 2483373 - DNA, 22 bp, Homo sapiens
tgtaaatattttaaagaattgt

SEQ ID NO: 2483374 - DNA, 15 bp, Homo sapiens
tgtaaatctacacac

SEQ ID NO: 2483375 - DNA, 13 bp, Homo sapiens
tgtaaatctgcca

SEQ ID NO: 2483376 - DNA, 14 bp, Homo sapiens
tgtaaatctgccac

SEQ ID NO: 2483377 - DNA, 14 bp, Homo sapiens
tgtaaatttgtact

SEQ ID NO: 2483378 - DNA, 15 bp, Homo sapiens
tgtaacaattgtgta

SEQ ID NO: 2483379 - DNA, 16 bp, Homo sapiens
tgtaacaattgtgtag

SEQ ID NO: 2483380 - DNA, 19 bp, Homo sapiens
tgtaacaattgtgtagcct

SEQ ID NO: 2483381 - DNA, 17 bp, Homo sapiens
tgtaacatactggcctg

SEQ ID NO: 2483382 - DNA, 19 bp, Homo sapiens
tgtaacctcttcagaggcc

SEQ ID NO: 2483383 - DNA, 19 bp, Homo sapiens
tgtaacgcaagttcccagt

SEQ ID NO: 2483384 - DNA, 23 bp, Homo sapiens
tgtaactaaaataattttgtaat

SEQ ID NO: 2483385 - DNA, 16 bp, Homo sapiens
tgtaactactttataa

SEQ ID NO: 2483386 - DNA, 17 bp, Homo sapiens
tgtaactactttataac

SEQ ID NO: 2483387 - DNA, 18 bp, Homo sapiens
tgtaagattatagattct

SEQ ID NO: 2483388 - DNA, 20 bp, Homo sapiens
tgtaagattatagattctaa

SEQ ID NO: 2483389 - DNA, 21 bp, Homo sapiens
tgtaagattatagattctaaa

SEQ ID NO: 2483390 - DNA, 23 bp, Homo sapiens
tgtaagattatagattctaaaga

SEQ ID NO: 2483391 - DNA, 21 bp, Homo sapiens
tgtaaggatccggaaagaaga

SEQ ID NO: 2483392 - DNA, 17 bp, Homo sapiens
tgtaaggatgggcatgg

SEQ ID NO: 2483393 - DNA, 15 bp, Homo sapiens
tgtaaggctctagat

SEQ ID NO: 2483394 - DNA, 18 bp, Homo sapiens
tgtaagggccagaaatat

SEQ ID NO: 2483395 - DNA, 16 bp, Homo sapiens
tgtaagttgaagcaaa

SEQ ID NO: 2483396 - DNA, 19 bp, Homo sapiens
tgtaagttgggcttgctat

SEQ ID NO: 2483397 - DNA, 17 bp, Homo sapiens
tgtaataaactttaata

SEQ ID NO: 2483398 - DNA, 19 bp, Homo sapiens
tgtaataataaagaatagc

SEQ ID NO: 2483399 - DNA, 17 bp, Homo sapiens
tgtaatataaagtattc

SEQ ID NO: 2483400 - DNA, 23 bp, Homo sapiens
tgtaatataaagtattcaacaat

SEQ ID NO: 2483401 - DNA, 17 bp, Homo sapiens
tgtaatggcagttatat

SEQ ID NO: 2483402 - DNA, 21 bp, Homo sapiens
tgtaatggtactgactttgct

SEQ ID NO: 2483403 - DNA, 23 bp, Homo sapiens
tgtaatgtatcaaatacatttaa

SEQ ID NO: 2483404 - DNA, 19 bp, Homo sapiens
tgtaatgtcttgagctcta

SEQ ID NO: 2483405 - DNA, 19 bp, Homo sapiens
tgtaattaaaagcaaatca

SEQ ID NO: 2483406 - DNA, 19 bp, Homo sapiens
tgtaatttcaggaggaata

SEQ ID NO: 2483407 - DNA, 18 bp, Homo sapiens
tgtacagtatgttcaaag

SEQ ID NO: 2483408 - DNA, 12 bp, Homo sapiens
tgtacagtgtta

SEQ ID NO: 2483409 - DNA, 15 bp, Homo sapiens
tgtacatatgtgctg

SEQ ID NO: 2483410 - DNA, 20 bp, Homo sapiens
tgtacatatgtgctggaatt

SEQ ID NO: 2483411 - DNA, 19 bp, Homo sapiens
tgtacatctattttggatt

SEQ ID NO: 2483412 - DNA, 16 bp, Homo sapiens
tgtacatttgggagtt

SEQ ID NO: 2483413 - DNA, 14 bp, Homo sapiens
tgtaccagttaatt

SEQ ID NO: 2483414 - DNA, 21 bp, Homo sapiens
tgtaccagttaatttttccaa

SEQ ID NO: 2483415 - DNA, 22 bp, Homo sapiens
tgtaccagttaatttttccaac

SEQ ID NO: 2483416 - DNA, 12 bp, Homo sapiens
tgtaccatgtac

SEQ ID NO: 2483417 - DNA, 18 bp, Homo sapiens
tgtaccattttaaagtta

SEQ ID NO: 2483418 - DNA, 12 bp, Homo sapiens
tgtacccagttt

SEQ ID NO: 2483419 - DNA, 21 bp, Homo sapiens
tgtaccgcgtctaccctggga

SEQ ID NO: 2483420 - DNA, 22 bp, Homo sapiens
tgtaccgcgtctaccctgggat

SEQ ID NO: 2483421 - DNA, 14 bp, Homo sapiens
tgtacgcgccaccg

SEQ ID NO: 2483422 - DNA, 22 bp, Homo sapiens
tgtacgcgccaccgagtgcctt

SEQ ID NO: 2483423 - DNA, 18 bp, Homo sapiens
tgtacggattttcagtta

SEQ ID NO: 2483424 - DNA, 16 bp, Homo sapiens
tgtactaaagccaaac

SEQ ID NO: 2483425 - DNA, 20 bp, Homo sapiens
tgtactaaagccaaacatat

SEQ ID NO: 2483426 - DNA, 15 bp, Homo sapiens
tgtactatttaactg

SEQ ID NO: 2483427 - DNA, 18 bp, Homo sapiens
tgtactatttaactgact

SEQ ID NO: 2483428 - DNA, 19 bp, Homo sapiens
tgtactgagccttgtaatt

SEQ ID NO: 2483429 - DNA, 22 bp, Homo sapiens
tgtactgagccttgtaattcta

SEQ ID NO: 2483430 - DNA, 16 bp, Homo sapiens
tgtactgttctgtgtc

SEQ ID NO: 2483431 - DNA, 19 bp, Homo sapiens
tgtactgttctgtgtcttt

SEQ ID NO: 2483432 - DNA, 13 bp, Homo sapiens
tgtagagttgctg

SEQ ID NO: 2483433 - DNA, 13 bp, Homo sapiens
tgtagataagtgt

SEQ ID NO: 2483434 - DNA, 22 bp, Homo sapiens
tgtagattgattgtattgttga

SEQ ID NO: 2483435 - DNA, 20 bp, Homo sapiens
tgtagcaactacagtctaaa

SEQ ID NO: 2483436 - DNA, 19 bp, Homo sapiens
tgtagcacttactggtagg

SEQ ID NO: 2483437 - DNA, 23 bp, Homo sapiens
tgtagctacagagaaaccagctt

SEQ ID NO: 2483438 - DNA, 11 bp, Homo sapiens
tgtagctcctc

SEQ ID NO: 2483439 - DNA, 17 bp, Homo sapiens
tgtagctcctcccctgg

SEQ ID NO: 2483440 - DNA, 17 bp, Homo sapiens
tgtaggcttagtttgtg

SEQ ID NO: 2483441 - DNA, 21 bp, Homo sapiens
tgtaggggaggggctcctttc

SEQ ID NO: 2483442 - DNA, 15 bp, Homo sapiens
tgtaggttgcacact

SEQ ID NO: 2483443 - DNA, 16 bp, Homo sapiens
tgtagtaaataatgct

SEQ ID NO: 2483444 - DNA, 16 bp, Homo sapiens
tgtagtaattgacatg

SEQ ID NO: 2483445 - DNA, 19 bp, Homo sapiens
tgtagtattttttgtataa

SEQ ID NO: 2483446 - DNA, 20 bp, Homo sapiens
tgtagtattttttgtataat

SEQ ID NO: 2483447 - DNA, 15 bp, Homo sapiens
tgtagtgctacaggg

SEQ ID NO: 2483448 - DNA, 14 bp, Homo sapiens
tgtagttcatgtaa

SEQ ID NO: 2483449 - DNA, 19 bp, Homo sapiens
tgtagtttttatatgttgt

SEQ ID NO: 2483450 - DNA, 13 bp, Homo sapiens
tgtatatactttt

SEQ ID NO: 2483451 - DNA, 16 bp, Homo sapiens
tgtatcccctgcaggc

SEQ ID NO: 2483452 - DNA, 16 bp, Homo sapiens
tgtatgactgcacatg

SEQ ID NO: 2483453 - DNA, 23 bp, Homo sapiens
tgtatggtttttgagatattaat

SEQ ID NO: 2483454 - DNA, 20 bp, Homo sapiens
tgtattaagaaaggaagcat

SEQ ID NO: 2483455 - DNA, 18 bp, Homo sapiens
tgtattcagacagatgag

SEQ ID NO: 2483456 - DNA, 19 bp, Homo sapiens
tgtattctctgagctgtgc

SEQ ID NO: 2483457 - DNA, 14 bp, Homo sapiens
tgtattgcacattg

SEQ ID NO: 2483458 - DNA, 15 bp, Homo sapiens
tgtattgcacattgt

SEQ ID NO: 2483459 - DNA, 15 bp, Homo sapiens
tgtattgtgcaatgt

SEQ ID NO: 2483460 - DNA, 15 bp, Homo sapiens
tgtatttaacagaaa

SEQ ID NO: 2483461 - DNA, 16 bp, Homo sapiens
tgtatttaacagaaat

SEQ ID NO: 2483462 - DNA, 21 bp, Homo sapiens
tgtatttaacagaaattgtat

SEQ ID NO: 2483463 - DNA, 20 bp, Homo sapiens
tgtatttacgctttgattca

SEQ ID NO: 2483464 - DNA, 23 bp, Homo sapiens
tgtatttacgctttgattcatag

SEQ ID NO: 2483465 - DNA, 14 bp, Homo sapiens
tgtatttataaata

SEQ ID NO: 2483466 - DNA, 13 bp, Homo sapiens
tgtatttgctaat

SEQ ID NO: 2483467 - DNA, 14 bp, Homo sapiens
tgtattttatgtta

SEQ ID NO: 2483468 - DNA, 17 bp, Homo sapiens
tgtattttatgttatat

SEQ ID NO: 2483469 - DNA, 15 bp, Homo sapiens
tgtcaactctttgtt

SEQ ID NO: 2483470 - DNA, 16 bp, Homo sapiens
tgtcaatttctgtgtt

SEQ ID NO: 2483471 - DNA, 18 bp, Homo sapiens
tgtcaccaccctgctcat

SEQ ID NO: 2483472 - DNA, 15 bp, Homo sapiens
tgtcaccagatctga

SEQ ID NO: 2483473 - DNA, 22 bp, Homo sapiens
tgtcactcaaggcggtgcttga

SEQ ID NO: 2483474 - DNA, 16 bp, Homo sapiens
tgtcactttttctgat

SEQ ID NO: 2483475 - DNA, 18 bp, Homo sapiens
tgtcactttttgaggcaa

SEQ ID NO: 2483476 - DNA, 19 bp, Homo sapiens
tgtcactttttgaggcaaa

SEQ ID NO: 2483477 - DNA, 19 bp, Homo sapiens
tgtcagagaaaatgaattt

SEQ ID NO: 2483478 - DNA, 18 bp, Homo sapiens
tgtcagatccaggagctc

SEQ ID NO: 2483479 - DNA, 24 bp, Homo sapiens
tgtcagatccaggagctccagtgt

SEQ ID NO: 2483480 - DNA, 16 bp, Homo sapiens
tgtcaggagtgtgtgt

SEQ ID NO: 2483481 - DNA, 19 bp, Homo sapiens
tgtcaggattgcgagagat

SEQ ID NO: 2483482 - DNA, 15 bp, Homo sapiens
tgtcagtcacagcca

SEQ ID NO: 2483483 - DNA, 16 bp, Homo sapiens
tgtcagtcacagccac

SEQ ID NO: 2483484 - DNA, 22 bp, Homo sapiens
tgtcagtcacagccacccctga

SEQ ID NO: 2483485 - DNA, 14 bp, Homo sapiens
tgtcatacagagaa

SEQ ID NO: 2483486 - DNA, 15 bp, Homo sapiens
tgtcatacagagaag

SEQ ID NO: 2483487 - DNA, 16 bp, Homo sapiens
tgtcatacagagaagt

SEQ ID NO: 2483488 - DNA, 17 bp, Homo sapiens
tgtcatcatcatggcca

SEQ ID NO: 2483489 - DNA, 18 bp, Homo sapiens
tgtcatcatcatggccag

SEQ ID NO: 2483490 - DNA, 16 bp, Homo sapiens
tgtcatcctcaaagaa

SEQ ID NO: 2483491 - DNA, 19 bp, Homo sapiens
tgtcatcctcaaagaaagt

SEQ ID NO: 2483492 - DNA, 14 bp, Homo sapiens
tgtcatcctcacag

SEQ ID NO: 2483493 - DNA, 13 bp, Homo sapiens
tgtcatctgtgca

SEQ ID NO: 2483494 - DNA, 23 bp, Homo sapiens
tgtcattcgctactatgatttaa

SEQ ID NO: 2483495 - DNA, 16 bp, Homo sapiens
tgtcattgaaaaacta

SEQ ID NO: 2483496 - DNA, 12 bp, Homo sapiens
tgtcattgttat

SEQ ID NO: 2483497 - DNA, 23 bp, Homo sapiens
tgtcattgttatataatcattat

SEQ ID NO: 2483498 - DNA, 15 bp, Homo sapiens
tgtcatttcagaagt

SEQ ID NO: 2483499 - DNA, 18 bp, Homo sapiens
tgtccaaaaccgccagct

SEQ ID NO: 2483500 - DNA, 21 bp, Homo sapiens
tgtccaaaaccgccagctctg

SEQ ID NO: 2483501 - DNA, 22 bp, Homo sapiens
tgtccaaaaccgccagctctgt

SEQ ID NO: 2483502 - DNA, 11 bp, Homo sapiens
tgtccaaagag

SEQ ID NO: 2483503 - DNA, 21 bp, Homo sapiens
tgtccaaagaggctgcccctc

SEQ ID NO: 2483504 - DNA, 14 bp, Homo sapiens
tgtccaatcctatg

SEQ ID NO: 2483505 - DNA, 16 bp, Homo sapiens
tgtccacaggcttctg

SEQ ID NO: 2483506 - DNA, 18 bp, Homo sapiens
tgtccacaggcttctgag

SEQ ID NO: 2483507 - DNA, 11 bp, Homo sapiens
tgtccaccccc

SEQ ID NO: 2483508 - DNA, 13 bp, Homo sapiens
tgtccacccccat

SEQ ID NO: 2483509 - DNA, 16 bp, Homo sapiens
tgtccagctccaacct

SEQ ID NO: 2483510 - DNA, 20 bp, Homo sapiens
tgtccagctccaacctgcaa

SEQ ID NO: 2483511 - DNA, 20 bp, Homo sapiens
tgtccatgcgctcagggcca

SEQ ID NO: 2483512 - DNA, 16 bp, Homo sapiens
tgtcccagaagatgac

SEQ ID NO: 2483513 - DNA, 12 bp, Homo sapiens
tgtccccagcag

SEQ ID NO: 2483514 - DNA, 15 bp, Homo sapiens
tgtccccccactccc

SEQ ID NO: 2483515 - DNA, 17 bp, Homo sapiens
tgtcccgattgtaactc

SEQ ID NO: 2483516 - DNA, 14 bp, Homo sapiens
tgtccctccccctt

SEQ ID NO: 2483517 - DNA, 16 bp, Homo sapiens
tgtcccttaaacaaaa

SEQ ID NO: 2483518 - DNA, 21 bp, Homo sapiens
tgtcccttgcccccctggcct

SEQ ID NO: 2483519 - DNA, 20 bp, Homo sapiens
tgtccgctgggtggtaccct

SEQ ID NO: 2483520 - DNA, 12 bp, Homo sapiens
tgtcctacagaa

SEQ ID NO: 2483521 - DNA, 14 bp, Homo sapiens
tgtcctagcacaga

SEQ ID NO: 2483522 - DNA, 21 bp, Homo sapiens
tgtcctagcacagatggccag

SEQ ID NO: 2483523 - DNA, 22 bp, Homo sapiens
tgtcctagcacagatggccagc

SEQ ID NO: 2483524 - DNA, 12 bp, Homo sapiens
tgtcctcagcct

SEQ ID NO: 2483525 - DNA, 20 bp, Homo sapiens
tgtcctcagccttgccagag

SEQ ID NO: 2483526 - DNA, 21 bp, Homo sapiens
tgtcctcagccttgccagaga

SEQ ID NO: 2483527 - DNA, 23 bp, Homo sapiens
tgtcctccaacaccaagcacagc

SEQ ID NO: 2483528 - DNA, 21 bp, Homo sapiens
tgtcctcccgagctcctcttc

SEQ ID NO: 2483529 - DNA, 14 bp, Homo sapiens
tgtcctctttcagc

SEQ ID NO: 2483530 - DNA, 12 bp, Homo sapiens
tgtcctgaaggc

SEQ ID NO: 2483531 - DNA, 15 bp, Homo sapiens
tgtcctgaaggcctg

SEQ ID NO: 2483532 - DNA, 14 bp, Homo sapiens
tgtcctgagcccca

SEQ ID NO: 2483533 - DNA, 17 bp, Homo sapiens
tgagtaatggtgtagaa

SEQ ID NO: 2483534 - DNA, 17 bp, Homo sapiens
tgagtaattttggattt

SEQ ID NO: 2483535 - DNA, 20 bp, Homo sapiens
tgagtagagagcaagggaag

SEQ ID NO: 2483536 - DNA, 20 bp, Homo sapiens
tgagtccccattgaggcttg

SEQ ID NO: 2483537 - DNA, 19 bp, Homo sapiens
tgagtcctggatgatacta

SEQ ID NO: 2483538 - DNA, 15 bp, Homo sapiens
tgagtctagatgttt

SEQ ID NO: 2483539 - DNA, 21 bp, Homo sapiens
tgagtctttggttctaaggac

SEQ ID NO: 2483540 - DNA, 15 bp, Homo sapiens
tgagtgcagtcctga

SEQ ID NO: 2483541 - DNA, 12 bp, Homo sapiens
tgagtgctctga

SEQ ID NO: 2483542 - DNA, 13 bp, Homo sapiens
tgagtggcagggg

SEQ ID NO: 2483543 - DNA, 21 bp, Homo sapiens
tgagtggggttatctctgtgt

SEQ ID NO: 2483544 - DNA, 22 bp, Homo sapiens
tgagtggggttatctctgtgtt

SEQ ID NO: 2483545 - DNA, 18 bp, Homo sapiens
tgagttccagaaagtaaa

SEQ ID NO: 2483546 - DNA, 15 bp, Homo sapiens
tgagttctccctgta

SEQ ID NO: 2483547 - DNA, 17 bp, Homo sapiens
tgagttggggtctggca

SEQ ID NO: 2483548 - DNA, 21 bp, Homo sapiens
tgagttggggtctggcagcct

SEQ ID NO: 2483549 - DNA, 23 bp, Homo sapiens
tgagtttaccttgtatactgtag

SEQ ID NO: 2483550 - DNA, 17 bp, Homo sapiens
tgagttttgtgtttgtt

SEQ ID NO: 2483551 - DNA, 18 bp, Homo sapiens
tgagttttgtgtttgttg

SEQ ID NO: 2483552 - DNA, 19 bp, Homo sapiens
tgataaagattttttaata

SEQ ID NO: 2483553 - DNA, 20 bp, Homo sapiens
tgataaagattttttaataa

SEQ ID NO: 2483554 - DNA, 13 bp, Homo sapiens
tgataaagcctca

SEQ ID NO: 2483555 - DNA, 18 bp, Homo sapiens
tgataagagaatcaacat

SEQ ID NO: 2483556 - DNA, 18 bp, Homo sapiens
tgataatgaacagaacat

SEQ ID NO: 2483557 - DNA, 16 bp, Homo sapiens
tgatacatccaaagca

SEQ ID NO: 2483558 - DNA, 17 bp, Homo sapiens
tgataccacctttactg

SEQ ID NO: 2483559 - DNA, 14 bp, Homo sapiens
tgatactaataaac

SEQ ID NO: 2483560 - DNA, 16 bp, Homo sapiens
tgatactaataaacta

SEQ ID NO: 2483561 - DNA, 11 bp, Homo sapiens
tgatactgttg

SEQ ID NO: 2483562 - DNA, 22 bp, Homo sapiens
tgataggaagaggggaagcaga

SEQ ID NO: 2483563 - DNA, 19 bp, Homo sapiens
tgatagggtttgtgacagg

SEQ ID NO: 2483564 - DNA, 16 bp, Homo sapiens
tgatatagaagtataa

SEQ ID NO: 2483565 - DNA, 21 bp, Homo sapiens
tgatatagaagtataaagaat

SEQ ID NO: 2483566 - DNA, 23 bp, Homo sapiens
tgatatgcacaatgtagataagt

SEQ ID NO: 2483567 - DNA, 22 bp, Homo sapiens
tgatcagagccgtggtcctttg

SEQ ID NO: 2483568 - DNA, 23 bp, Homo sapiens
tgatcagagccgtggtcctttgg

SEQ ID NO: 2483569 - DNA, 20 bp, Homo sapiens
tgatcagttaagaaatttca

SEQ ID NO: 2483570 - DNA, 14 bp, Homo sapiens
tgatccatttctaa

SEQ ID NO: 2483571 - DNA, 16 bp, Homo sapiens
tgatccatttctaatt

SEQ ID NO: 2483572 - DNA, 17 bp, Homo sapiens
tgatccatttctaatta

SEQ ID NO: 2483573 - DNA, 18 bp, Homo sapiens
tgatccatttctaattat

SEQ ID NO: 2483574 - DNA, 19 bp, Homo sapiens
tgatccctgtgttgtctct

SEQ ID NO: 2483575 - DNA, 18 bp, Homo sapiens
tgatcctggaggcccagt

SEQ ID NO: 2483576 - DNA, 21 bp, Homo sapiens
tgatcctgtattcagacagat

SEQ ID NO: 2483577 - DNA, 20 bp, Homo sapiens
tgatctgatagggtttgtga

SEQ ID NO: 2483578 - DNA, 13 bp, Homo sapiens
tgatctggaaccc

SEQ ID NO: 2483579 - DNA, 21 bp, Homo sapiens
tgatcttggcttactgcagcc

SEQ ID NO: 2483580 - DNA, 15 bp, Homo sapiens
tgatgacccttttca

SEQ ID NO: 2483581 - DNA, 16 bp, Homo sapiens
tgatgaggccctccac

SEQ ID NO: 2483582 - DNA, 21 bp, Homo sapiens
tgatgcagcttatacgaaata

SEQ ID NO: 2483583 - DNA, 17 bp, Homo sapiens
tgatgcatgcactgttc

SEQ ID NO: 2483584 - DNA, 21 bp, Homo sapiens
tgatgccaaaaaaaaatacat

SEQ ID NO: 2483585 - DNA, 21 bp, Homo sapiens
tgatgcctctgtcttctggac

SEQ ID NO: 2483586 - DNA, 14 bp, Homo sapiens
tgatggagtgctgt

SEQ ID NO: 2483587 - DNA, 16 bp, Homo sapiens
tgatggcaacagatct

SEQ ID NO: 2483588 - DNA, 23 bp, Homo sapiens
tgatggcaacagatctggaacct

SEQ ID NO: 2483589 - DNA, 20 bp, Homo sapiens
tgatggcagccatagtgcat

SEQ ID NO: 2483590 - DNA, 17 bp, Homo sapiens
tgatgggggagagggtg

SEQ ID NO: 2483591 - DNA, 11 bp, Homo sapiens
tgatgtaaaat

SEQ ID NO: 2483592 - DNA, 15 bp, Homo sapiens
tgatgtaaaatcttg

SEQ ID NO: 2483593 - DNA, 21 bp, Homo sapiens
tgatgtaaaatcttgtcatgt

SEQ ID NO: 2483594 - DNA, 23 bp, Homo sapiens
tgatgtaaaatcttgtcatgtgt

SEQ ID NO: 2483595 - DNA, 21 bp, Homo sapiens
tgatgtaaggatgggcatggt

SEQ ID NO: 2483596 - DNA, 20 bp, Homo sapiens
tgatgtcatacagagaagtc

SEQ ID NO: 2483597 - DNA, 13 bp, Homo sapiens
tgatgttccttcc

SEQ ID NO: 2483598 - DNA, 12 bp, Homo sapiens
tgatgttctaag

SEQ ID NO: 2483599 - DNA, 19 bp, Homo sapiens
tgattaaataagattctaa

SEQ ID NO: 2483600 - DNA, 13 bp, Homo sapiens
tgattaaatgaca

SEQ ID NO: 2483601 - DNA, 14 bp, Homo sapiens
tgattacagtgcag

SEQ ID NO: 2483602 - DNA, 23 bp, Homo sapiens
tgattagaaattacctgtggata

SEQ ID NO: 2483603 - DNA, 15 bp, Homo sapiens
tgattagacagaaca

SEQ ID NO: 2483604 - DNA, 16 bp, Homo sapiens
tgattattcagtgtca

SEQ ID NO: 2483605 - DNA, 19 bp, Homo sapiens
tgattcagaaaatgttctg

SEQ ID NO: 2483606 - DNA, 21 bp, Homo sapiens
tgattcagtgttaaatgtgat

SEQ ID NO: 2483607 - DNA, 24 bp, Homo sapiens
tgattcagtgttaaatgtgatgaa

SEQ ID NO: 2483608 - DNA, 21 bp, Homo sapiens
tgattctatttatatgtacat

SEQ ID NO: 2483609 - DNA, 22 bp, Homo sapiens
tgattctgcagtaaatctttta

SEQ ID NO: 2483610 - DNA, 21 bp, Homo sapiens
tgattggcctgtagagttgct

SEQ ID NO: 2483611 - DNA, 14 bp, Homo sapiens
tgattgtttacagt

SEQ ID NO: 2483612 - DNA, 16 bp, Homo sapiens
tgatttaatgttttca

SEQ ID NO: 2483613 - DNA, 12 bp, Homo sapiens
tgcaggaaggag

SEQ ID NO: 2483614 - DNA, 16 bp, Homo sapiens
tgcaggaaggagctgc

SEQ ID NO: 2483615 - DNA, 17 bp, Homo sapiens
tgcaggaaggagctgcc

SEQ ID NO: 2483616 - DNA, 21 bp, Homo sapiens
tgcaggaaggagctgcctgga

SEQ ID NO: 2483617 - DNA, 22 bp, Homo sapiens
tgcaggaaggagctgcctggac

SEQ ID NO: 2483618 - DNA, 23 bp, Homo sapiens
tgcaggaaggagctgcctggacc

SEQ ID NO: 2483619 - DNA, 20 bp, Homo sapiens
tgcaggccctggcctcccct

SEQ ID NO: 2483620 - DNA, 15 bp, Homo sapiens
tgcagggaaaattat

SEQ ID NO: 2483621 - DNA, 23 bp, Homo sapiens
tgcagggagctgggcttccagaa

SEQ ID NO: 2483622 - DNA, 16 bp, Homo sapiens
tgcagggatgtgggtt

SEQ ID NO: 2483623 - DNA, 13 bp, Homo sapiens
tgcagggcagtca

SEQ ID NO: 2483624 - DNA, 21 bp, Homo sapiens
tgcagtaaatcttttacaact

SEQ ID NO: 2483625 - DNA, 11 bp, Homo sapiens
tgcagtaactg

SEQ ID NO: 2483626 - DNA, 16 bp, Homo sapiens
tgcagtaactgttttt

SEQ ID NO: 2483627 - DNA, 20 bp, Homo sapiens
tgcagtcccaagcggtgtct

SEQ ID NO: 2483628 - DNA, 17 bp, Homo sapiens
tgcagttgtctctgttt

SEQ ID NO: 2483629 - DNA, 17 bp, Homo sapiens
tgcataatgtttctgga

SEQ ID NO: 2483630 - DNA, 18 bp, Homo sapiens
tgcataatgtttctggat

SEQ ID NO: 2483631 - DNA, 20 bp, Homo sapiens
tgcatagtaccaatcatttt

SEQ ID NO: 2483632 - DNA, 17 bp, Homo sapiens
tgcatatgttgaatact

SEQ ID NO: 2483633 - DNA, 18 bp, Homo sapiens
tgcatcagaaagggaggg

SEQ ID NO: 2483634 - DNA, 22 bp, Homo sapiens
tgcatcccaaaccacgcctctt

SEQ ID NO: 2483635 - DNA, 18 bp, Homo sapiens
tgcatgcccagagaccca

SEQ ID NO: 2483636 - DNA, 20 bp, Homo sapiens
tgcatgcccagagacccagc

SEQ ID NO: 2483637 - DNA, 20 bp, Homo sapiens
tgcatggatttctttgaaaa

SEQ ID NO: 2483638 - DNA, 18 bp, Homo sapiens
tgcatggcatcctccagc

SEQ ID NO: 2483639 - DNA, 18 bp, Homo sapiens
tgcatggtgccccaggac

SEQ ID NO: 2483640 - DNA, 14 bp, Homo sapiens
tgcatggtttcagc

SEQ ID NO: 2483641 - DNA, 16 bp, Homo sapiens
tagctcaatgagcatg

SEQ ID NO: 2483642 - DNA, 17 bp, Homo sapiens
tagctcaatgagcatgt

SEQ ID NO: 2483643 - DNA, 21 bp, Homo sapiens
tagctcaatgagcatgtttag

SEQ ID NO: 2483644 - DNA, 12 bp, Homo sapiens
tagctcctcccc

SEQ ID NO: 2483645 - DNA, 22 bp, Homo sapiens
tagctcctgtggccccaccctg

SEQ ID NO: 2483646 - DNA, 12 bp, Homo sapiens
tagctctgagaa

SEQ ID NO: 2483647 - DNA, 15 bp, Homo sapiens
tagctgaatgttttt

SEQ ID NO: 2483648 - DNA, 21 bp, Homo sapiens
tagctgagctcacaaggcagc

SEQ ID NO: 2483649 - DNA, 20 bp, Homo sapiens
tagctgtgacctgctgagct

SEQ ID NO: 2483650 - DNA, 22 bp, Homo sapiens
tagctttaacttaaatagtatt

SEQ ID NO: 2483651 - DNA, 17 bp, Homo sapiens
tagctttggaagtttag

SEQ ID NO: 2483652 - DNA, 13 bp, Homo sapiens
taggaaaataaaa

SEQ ID NO: 2483653 - DNA, 18 bp, Homo sapiens
taggaagagcaggactcc

SEQ ID NO: 2483654 - DNA, 16 bp, Homo sapiens
taggaagtaaattata

SEQ ID NO: 2483655 - DNA, 15 bp, Homo sapiens
taggaatagcatgtc

SEQ ID NO: 2483656 - DNA, 18 bp, Homo sapiens
taggaccaagcatcttgg

SEQ ID NO: 2483657 - DNA, 19 bp, Homo sapiens
taggacctttccaccacag

SEQ ID NO: 2483658 - DNA, 15 bp, Homo sapiens
taggagaagccagga

SEQ ID NO: 2483659 - DNA, 16 bp, Homo sapiens
taggagaagccaggaa

SEQ ID NO: 2483660 - DNA, 23 bp, Homo sapiens
taggagctttgactcaggagcct

SEQ ID NO: 2483661 - DNA, 12 bp, Homo sapiens
taggagggactg

SEQ ID NO: 2483662 - DNA, 14 bp, Homo sapiens
taggagggactgtc

SEQ ID NO: 2483663 - DNA, 13 bp, Homo sapiens
taggagggtcctc

SEQ ID NO: 2483664 - DNA, 20 bp, Homo sapiens
taggcactgtagttctaaga

SEQ ID NO: 2483665 - DNA, 22 bp, Homo sapiens
taggcactgtagttctaagact

SEQ ID NO: 2483666 - DNA, 23 bp, Homo sapiens
taggccagcaagcggggatgtcc

SEQ ID NO: 2483667 - DNA, 19 bp, Homo sapiens
taggcctcaggtgaaactc

SEQ ID NO: 2483668 - DNA, 23 bp, Homo sapiens
taggccttgcggctcctcaggga

SEQ ID NO: 2483669 - DNA, 12 bp, Homo sapiens
taggctacagag

SEQ ID NO: 2483670 - DNA, 13 bp, Homo sapiens
taggctacagaga

SEQ ID NO: 2483671 - DNA, 17 bp, Homo sapiens
taggctacagagaagcc

SEQ ID NO: 2483672 - DNA, 21 bp, Homo sapiens
taggctacagagaagccttca

SEQ ID NO: 2483673 - DNA, 20 bp, Homo sapiens
taggctatttgtaaatctgc

SEQ ID NO: 2483674 - DNA, 21 bp, Homo sapiens
taggctgacacctaactcttc

SEQ ID NO: 2483675 - DNA, 19 bp, Homo sapiens
taggctgtaactactttat

SEQ ID NO: 2483676 - DNA, 15 bp, Homo sapiens
tagggaacaatttgg

SEQ ID NO: 2483677 - DNA, 23 bp, Homo sapiens
tagggccaagcccagcactgctt

SEQ ID NO: 2483678 - DNA, 23 bp, Homo sapiens
taggggcccctctcagccctcac

SEQ ID NO: 2483679 - DNA, 11 bp, Homo sapiens
taggggctggg

SEQ ID NO: 2483680 - DNA, 20 bp, Homo sapiens
tagggggctggaggagccca

SEQ ID NO: 2483681 - DNA, 15 bp, Homo sapiens
tagggtacatggtgc

SEQ ID NO: 2483682 - DNA, 19 bp, Homo sapiens
tagggtttgtgacagggcg

SEQ ID NO: 2483683 - DNA, 16 bp, Homo sapiens
taggtagtaccaaaat

SEQ ID NO: 2483684 - DNA, 16 bp, Homo sapiens
taggtctcatctcttc

SEQ ID NO: 2483685 - DNA, 12 bp, Homo sapiens
taggtctgaaat

SEQ ID NO: 2483686 - DNA, 22 bp, Homo sapiens
taggtctgaaatttttcttctt

SEQ ID NO: 2483687 - DNA, 22 bp, Homo sapiens
taggtgatccatgtaactgcct

SEQ ID NO: 2483688 - DNA, 19 bp, Homo sapiens
taggtgctatttgtcatct

SEQ ID NO: 2483689 - DNA, 21 bp, Homo sapiens
taggtgttttgttcaccatta

SEQ ID NO: 2483690 - DNA, 22 bp, Homo sapiens
taggttattttgatgtaaagat

SEQ ID NO: 2483691 - DNA, 13 bp, Homo sapiens
taggttctaaagt

SEQ ID NO: 2483692 - DNA, 20 bp, Homo sapiens
taggttctaaagttctaaga

SEQ ID NO: 2483693 - DNA, 18 bp, Homo sapiens
taggttctttgctgcatt

SEQ ID NO: 2483694 - DNA, 18 bp, Homo sapiens
taggttgcacactttggt

SEQ ID NO: 2483695 - DNA, 14 bp, Homo sapiens
taggtttcaaagat

SEQ ID NO: 2483696 - DNA, 17 bp, Homo sapiens
tagtaaaccaatcctat

SEQ ID NO: 2483697 - DNA, 17 bp, Homo sapiens
tagtaaagtcaaggaga

SEQ ID NO: 2483698 - DNA, 17 bp, Homo sapiens
tagtaaataatgctttg

SEQ ID NO: 2483699 - DNA, 19 bp, Homo sapiens
tagtaacttcttatggaat

SEQ ID NO: 2483700 - DNA, 20 bp, Homo sapiens
tagtaccttttatatcccat

SEQ ID NO: 2483701 - DNA, 20 bp, Homo sapiens
tagtagcagtgattgtctta

SEQ ID NO: 2483702 - DNA, 17 bp, Homo sapiens
tagtatggcctgtgtca

SEQ ID NO: 2483703 - DNA, 16 bp, Homo sapiens
tagtattgttgtcctt

SEQ ID NO: 2483704 - DNA, 19 bp, Homo sapiens
tagtcaatcaagtctgttt

SEQ ID NO: 2483705 - DNA, 18 bp, Homo sapiens
tagtcaatgacatgaatt

SEQ ID NO: 2483706 - DNA, 15 bp, Homo sapiens
tagtcatgtttatct

SEQ ID NO: 2483707 - DNA, 17 bp, Homo sapiens
tagtctcagtgaagact

SEQ ID NO: 2483708 - DNA, 22 bp, Homo sapiens
tagtctcagtttgtgtgtctta

SEQ ID NO: 2483709 - DNA, 15 bp, Homo sapiens
tagtctttggagaaa

SEQ ID NO: 2483710 - DNA, 14 bp, Homo sapiens
tagtgaacttgaaa

SEQ ID NO: 2483711 - DNA, 21 bp, Homo sapiens
tagtgaaggcttctctctgtg

SEQ ID NO: 2483712 - DNA, 15 bp, Homo sapiens
tagtgctacagggtc

SEQ ID NO: 2483713 - DNA, 14 bp, Homo sapiens
tagttaacacacta

SEQ ID NO: 2483714 - DNA, 20 bp, Homo sapiens
tagttaacacactaccgaat

SEQ ID NO: 2483715 - DNA, 21 bp, Homo sapiens
tagttaccttatagttactgt

SEQ ID NO: 2483716 - DNA, 18 bp, Homo sapiens
tagttactgtgtaattag

SEQ ID NO: 2483717 - DNA, 22 bp, Homo sapiens
tagttagctaataaaaagcttt

SEQ ID NO: 2483718 - DNA, 16 bp, Homo sapiens
tagttcagaatttagt

SEQ ID NO: 2483719 - DNA, 23 bp, Homo sapiens
tagttcagaatttagtgtatcca

SEQ ID NO: 2483720 - DNA, 22 bp, Homo sapiens
tagttcagcatccgcaggtgct

SEQ ID NO: 2483721 - DNA, 14 bp, Homo sapiens
tagttcatgtaaat

SEQ ID NO: 2483722 - DNA, 15 bp, Homo sapiens
tagttccactgagac

SEQ ID NO: 2483723 - DNA, 21 bp, Homo sapiens
tagttcctgctaaaacaatga

SEQ ID NO: 2483724 - DNA, 13 bp, Homo sapiens
tagttctagaaaa

SEQ ID NO: 2483725 - DNA, 22 bp, Homo sapiens
tagttctagaaaaacaggcact

SEQ ID NO: 2483726 - DNA, 15 bp, Homo sapiens
tagttctaggcactg

SEQ ID NO: 2483727 - DNA, 18 bp, Homo sapiens
tagttctgctccagacag

SEQ ID NO: 2483728 - DNA, 15 bp, Homo sapiens
tagttgtgtttcaac

SEQ ID NO: 2483729 - DNA, 21 bp, Homo sapiens
tagtttcagtagattgcagaa

SEQ ID NO: 2483730 - DNA, 11 bp, Homo sapiens
tagtttggata

SEQ ID NO: 2483731 - DNA, 15 bp, Homo sapiens
tagtttttatatgtt

SEQ ID NO: 2483732 - DNA, 14 bp, Homo sapiens
tagttttttcatct

SEQ ID NO: 2483733 - DNA, 14 bp, Homo sapiens
tataaaaaatggtt

SEQ ID NO: 2483734 - DNA, 21 bp, Homo sapiens
tataaaaaatggttcagaatt

SEQ ID NO: 2483735 - DNA, 19 bp, Homo sapiens
tataaaaataaaaaagatc

SEQ ID NO: 2483736 - DNA, 12 bp, Homo sapiens
tataaaatacag

SEQ ID NO: 2483737 - DNA, 12 bp, Homo sapiens
tataaaatagac

SEQ ID NO: 2483738 - DNA, 23 bp, Homo sapiens
tataaaatatgaagacataaacc

SEQ ID NO: 2483739 - DNA, 13 bp, Homo sapiens
tataaacaagaaa

SEQ ID NO: 2483740 - DNA, 21 bp, Homo sapiens
tataaagacgttttataagca

SEQ ID NO: 2483741 - DNA, 17 bp, Homo sapiens
tataaagttttatatat

SEQ ID NO: 2483742 - DNA, 22 bp, Homo sapiens
tataaagttttatatattatat

SEQ ID NO: 2483743 - DNA, 18 bp, Homo sapiens
tataaatgcaaataacaa

SEQ ID NO: 2483744 - DNA, 16 bp, Homo sapiens
tataaccagacacata

SEQ ID NO: 2483745 - DNA, 20 bp, Homo sapiens
tacttctcattttttaaaaa

SEQ ID NO: 2483746 - DNA, 17 bp, Homo sapiens
tacttctgtaattgtgt

SEQ ID NO: 2483747 - DNA, 20 bp, Homo sapiens
tacttctgtaattgtgtgga

SEQ ID NO: 2483748 - DNA, 21 bp, Homo sapiens
tacttgaacgttttctaattg

SEQ ID NO: 2483749 - DNA, 11 bp, Homo sapiens
tacttgaaggg

SEQ ID NO: 2483750 - DNA, 12 bp, Homo sapiens
tacttgaagggc

SEQ ID NO: 2483751 - DNA, 15 bp, Homo sapiens
tacttgaagggccag

SEQ ID NO: 2483752 - DNA, 16 bp, Homo sapiens
tacttgctcaggtact

SEQ ID NO: 2483753 - DNA, 20 bp, Homo sapiens
tacttggagggcccagccca

SEQ ID NO: 2483754 - DNA, 15 bp, Homo sapiens
tacttgtaaatataa

SEQ ID NO: 2483755 - DNA, 16 bp, Homo sapiens
tacttgtaaatataaa

SEQ ID NO: 2483756 - DNA, 21 bp, Homo sapiens
tactttagaagcctgcataat

SEQ ID NO: 2483757 - DNA, 19 bp, Homo sapiens
tactttataactaacatgt

SEQ ID NO: 2483758 - DNA, 20 bp, Homo sapiens
tactttataactaacatgtc

SEQ ID NO: 2483759 - DNA, 15 bp, Homo sapiens
tactttccctaccct

SEQ ID NO: 2483760 - DNA, 19 bp, Homo sapiens
tactttccctaccctctag

SEQ ID NO: 2483761 - DNA, 14 bp, Homo sapiens
tactttgaagtcat

SEQ ID NO: 2483762 - DNA, 18 bp, Homo sapiens
tactttgaagtcatacca

SEQ ID NO: 2483763 - DNA, 20 bp, Homo sapiens
tactttgaatgtgtttcaca

SEQ ID NO: 2483764 - DNA, 20 bp, Homo sapiens
tactttgacagtgtttttag

SEQ ID NO: 2483765 - DNA, 17 bp, Homo sapiens
tactttggaattcttag

SEQ ID NO: 2483766 - DNA, 14 bp, Homo sapiens
tactttttatatat

SEQ ID NO: 2483767 - DNA, 14 bp, Homo sapiens
gtcccacatccctg

SEQ ID NO: 2483768 - DNA, 12 bp, Homo sapiens
gtcccagagcag

SEQ ID NO: 2483769 - DNA, 16 bp, Homo sapiens
gtcccaggttggctct

SEQ ID NO: 2483770 - DNA, 21 bp, Homo sapiens
gtcccattttagccaagctta

SEQ ID NO: 2483771 - DNA, 14 bp, Homo sapiens
gtccccagcagaga

SEQ ID NO: 2483772 - DNA, 12 bp, Homo sapiens
gtccccccactc

SEQ ID NO: 2483773 - DNA, 17 bp, Homo sapiens
gtccccgagtgcctagg

SEQ ID NO: 2483774 - DNA, 12 bp, Homo sapiens
gtcccctcacct

SEQ ID NO: 2483775 - DNA, 16 bp, Homo sapiens
gtcccgattgtaactc

SEQ ID NO: 2483776 - DNA, 18 bp, Homo sapiens
gtcccggaggcggtgggc

SEQ ID NO: 2483777 - DNA, 21 bp, Homo sapiens
gtcccggggccagcacttcca

SEQ ID NO: 2483778 - DNA, 21 bp, Homo sapiens
gtccctaccccatggtgctag

SEQ ID NO: 2483779 - DNA, 11 bp, Homo sapiens
gtccctctgtg

SEQ ID NO: 2483780 - DNA, 17 bp, Homo sapiens
gtccctgctgccagctt

SEQ ID NO: 2483781 - DNA, 13 bp, Homo sapiens
gtcccttgccccc

SEQ ID NO: 2483782 - DNA, 15 bp, Homo sapiens
gtcccttgcccccct

SEQ ID NO: 2483783 - DNA, 13 bp, Homo sapiens
gtcccttgcctca

SEQ ID NO: 2483784 - DNA, 15 bp, Homo sapiens
gtccggcagcttctg

SEQ ID NO: 2483785 - DNA, 17 bp, Homo sapiens
gtccggtgttctaagat

SEQ ID NO: 2483786 - DNA, 15 bp, Homo sapiens
gtcctacagaaaaac

SEQ ID NO: 2483787 - DNA, 21 bp, Homo sapiens
gtcctagcacagatggccagc

SEQ ID NO: 2483788 - DNA, 16 bp, Homo sapiens
gtcctagttgttcagc

SEQ ID NO: 2483789 - DNA, 20 bp, Homo sapiens
gtcctatctgggcttcctgg

SEQ ID NO: 2483790 - DNA, 14 bp, Homo sapiens
gtcctcagccttgc

SEQ ID NO: 2483791 - DNA, 22 bp, Homo sapiens
gtcctcccgagctcctcttcca

SEQ ID NO: 2483792 - DNA, 17 bp, Homo sapiens
gtcctcctccagggaca

SEQ ID NO: 2483793 - DNA, 15 bp, Homo sapiens
gtcctctgagactcc

SEQ ID NO: 2483794 - DNA, 23 bp, Homo sapiens
gtcctctgtcagtcacagccacc

SEQ ID NO: 2483795 - DNA, 13 bp, Homo sapiens
gtcctctttcagc

SEQ ID NO: 2483796 - DNA, 15 bp, Homo sapiens
gtcctctttcagctc

SEQ ID NO: 2483797 - DNA, 17 bp, Homo sapiens
gtcctctttcagctcct

SEQ ID NO: 2483798 - DNA, 20 bp, Homo sapiens
gtcctctttcagctcctgac

SEQ ID NO: 2483799 - DNA, 17 bp, Homo sapiens
gtcctgagcactgccag

SEQ ID NO: 2483800 - DNA, 22 bp, Homo sapiens
gtcctgagcactgccaggaggg

SEQ ID NO: 2483801 - DNA, 14 bp, Homo sapiens
gtcctgagctcagc

SEQ ID NO: 2483802 - DNA, 16 bp, Homo sapiens
gtcctgagctcagcgt

SEQ ID NO: 2483803 - DNA, 18 bp, Homo sapiens
gtcctgagctcagcgtgg

SEQ ID NO: 2483804 - DNA, 13 bp, Homo sapiens
gtcctgcctgtgg

SEQ ID NO: 2483805 - DNA, 14 bp, Homo sapiens
gtcctgcctgtggc

SEQ ID NO: 2483806 - DNA, 19 bp, Homo sapiens
gtcctggagcagaccaccc

SEQ ID NO: 2483807 - DNA, 17 bp, Homo sapiens
gtcctggatgatactaa

SEQ ID NO: 2483808 - DNA, 19 bp, Homo sapiens
gtcctggatgatactaata

SEQ ID NO: 2483809 - DNA, 15 bp, Homo sapiens
gtcctgggaggagag

SEQ ID NO: 2483810 - DNA, 16 bp, Homo sapiens
gtcctgggaggagaga

SEQ ID NO: 2483811 - DNA, 17 bp, Homo sapiens
gtcctgggcctgcagaa

SEQ ID NO: 2483812 - DNA, 16 bp, Homo sapiens
gtcctggtggggcagc

SEQ ID NO: 2483813 - DNA, 17 bp, Homo sapiens
gtcctggtggggcagct

SEQ ID NO: 2483814 - DNA, 19 bp, Homo sapiens
gtcctgtgaatgccactgc

SEQ ID NO: 2483815 - DNA, 13 bp, Homo sapiens
gtccttactcctg

SEQ ID NO: 2483816 - DNA, 22 bp, Homo sapiens
gtccttactcctgtgggagcct

SEQ ID NO: 2483817 - DNA, 14 bp, Homo sapiens
gtccttggcctgct

SEQ ID NO: 2483818 - DNA, 21 bp, Homo sapiens
gtccttgtgatgtgcacgtaa

SEQ ID NO: 2483819 - DNA, 16 bp, Homo sapiens
gtccttttgacactgc

SEQ ID NO: 2483820 - DNA, 19 bp, Homo sapiens
gtccttttgacactgctct

SEQ ID NO: 2483821 - DNA, 20 bp, Homo sapiens
gtccttttgacactgctcta

SEQ ID NO: 2483822 - DNA, 19 bp, Homo sapiens
gtcctttttttccatcttt

SEQ ID NO: 2483823 - DNA, 22 bp, Homo sapiens
gtcgagaaagaggcaccaggaa

SEQ ID NO: 2483824 - DNA, 15 bp, Homo sapiens
gtcgaggagtaacaa

SEQ ID NO: 2483825 - DNA, 14 bp, Homo sapiens
gtcgatagagctgt

SEQ ID NO: 2483826 - DNA, 13 bp, Homo sapiens
gtcgccaggctag

SEQ ID NO: 2483827 - DNA, 15 bp, Homo sapiens
gtcgctcctgcccac

SEQ ID NO: 2483828 - DNA, 18 bp, Homo sapiens
gtcggggcatctggcctg

SEQ ID NO: 2483829 - DNA, 14 bp, Homo sapiens
gtcggtgccttcaa

SEQ ID NO: 2483830 - DNA, 13 bp, Homo sapiens
gtcgtgcctgtgt

SEQ ID NO: 2483831 - DNA, 24 bp, Homo sapiens
gtcgtggagagctaggagcaaagc

SEQ ID NO: 2483832 - DNA, 21 bp, Homo sapiens
gtctaaagatggagtttctaa

SEQ ID NO: 2483833 - DNA, 23 bp, Homo sapiens
gtctaaagatggagtttctaagg

SEQ ID NO: 2483834 - DNA, 13 bp, Homo sapiens
gtctaagattcta

SEQ ID NO: 2483835 - DNA, 16 bp, Homo sapiens
gtctaagattctagat

SEQ ID NO: 2483836 - DNA, 18 bp, Homo sapiens
gtctaagattctagatca

SEQ ID NO: 2483837 - DNA, 17 bp, Homo sapiens
gtctacacaccctgcat

SEQ ID NO: 2483838 - DNA, 22 bp, Homo sapiens
gtctaccctgggattcaggaaa

SEQ ID NO: 2483839 - DNA, 19 bp, Homo sapiens
gtctagattcaaaggttct

SEQ ID NO: 2483840 - DNA, 19 bp, Homo sapiens
gtctcacagtgttgcccag

SEQ ID NO: 2483841 - DNA, 18 bp, Homo sapiens
gtctcaccggctctcacc

SEQ ID NO: 2483842 - DNA, 19 bp, Homo sapiens
gtctcaccggctctcacct

SEQ ID NO: 2483843 - DNA, 20 bp, Homo sapiens
gtctcaccggctctcacctg

SEQ ID NO: 2483844 - DNA, 20 bp, Homo sapiens
gtttcaagaggagcccccac

SEQ ID NO: 2483845 - DNA, 19 bp, Homo sapiens
gtttcaaggcactctagat

SEQ ID NO: 2483846 - DNA, 23 bp, Homo sapiens
gtttcacagcctataaccagaca

SEQ ID NO: 2483847 - DNA, 16 bp, Homo sapiens
gtttcacagtttgaaa

SEQ ID NO: 2483848 - DNA, 18 bp, Homo sapiens
gtttcacagtttgaaata

SEQ ID NO: 2483849 - DNA, 12 bp, Homo sapiens
gtttcagcacta

SEQ ID NO: 2483850 - DNA, 18 bp, Homo sapiens
gtttcagcgactccgttg

SEQ ID NO: 2483851 - DNA, 15 bp, Homo sapiens
taaaatcttgtcatg

SEQ ID NO: 2483852 - DNA, 17 bp, Homo sapiens
taaaatgacaatcatgt

SEQ ID NO: 2483853 - DNA, 14 bp, Homo sapiens
taaaatgctaggtt

SEQ ID NO: 2483854 - DNA, 20 bp, Homo sapiens
taaaatgctaggttctacct

SEQ ID NO: 2483855 - DNA, 17 bp, Homo sapiens
taaatgcaaataacaaa

SEQ ID NO: 2483856 - DNA, 19 bp, Homo sapiens
taaatgcaaccatttgaaa

SEQ ID NO: 2483857 - DNA, 22 bp, Homo sapiens
taaatggcctcatgtggctgga

SEQ ID NO: 2483858 - DNA, 13 bp, Homo sapiens
taaatggctgtaa

SEQ ID NO: 2483859 - DNA, 17 bp, Homo sapiens
taaatgtaaagacaaaa

SEQ ID NO: 2483860 - DNA, 19 bp, Homo sapiens
taaatgtctttaatgcaat

SEQ ID NO: 2483861 - DNA, 19 bp, Homo sapiens
taaatgtgcaatagaaggt

SEQ ID NO: 2483862 - DNA, 13 bp, Homo sapiens
taaattatgtaaa

SEQ ID NO: 2483863 - DNA, 18 bp, Homo sapiens
taaattattgtttttctt

SEQ ID NO: 2483864 - DNA, 13 bp, Homo sapiens
taaattggaaagc

SEQ ID NO: 2483865 - DNA, 20 bp, Homo sapiens
taaattggcatggaaattta

SEQ ID NO: 2483866 - DNA, 17 bp, Homo sapiens
taaattgtacagccggc

SEQ ID NO: 2483867 - DNA, 15 bp, Homo sapiens
taaatttattttctt

SEQ ID NO: 2483868 - DNA, 19 bp, Homo sapiens
taaatttgacttttctgta

SEQ ID NO: 2483869 - DNA, 22 bp, Homo sapiens
taaatttgtactatttaactga

SEQ ID NO: 2483870 - DNA, 23 bp, Homo sapiens
taaattttcctgtcctctttcag

SEQ ID NO: 2483871 - DNA, 24 bp, Homo sapiens
taaattttcctgtcctctttcagc

SEQ ID NO: 2483872 - DNA, 20 bp, Homo sapiens
taacaaatgccaaattaaaa

SEQ ID NO: 2483873 - DNA, 17 bp, Homo sapiens
taacaatacaaatggat

SEQ ID NO: 2483874 - DNA, 14 bp, Homo sapiens
taacaatcagctcc

SEQ ID NO: 2483875 - DNA, 16 bp, Homo sapiens
taacaattaggcagac

SEQ ID NO: 2483876 - DNA, 14 bp, Homo sapiens
taacaattcctcta

SEQ ID NO: 2483877 - DNA, 20 bp, Homo sapiens
taacacactaccgaatgtgt

SEQ ID NO: 2483878 - DNA, 22 bp, Homo sapiens
taacacactaccgaatgtgtct

SEQ ID NO: 2483879 - DNA, 20 bp, Homo sapiens
taacactaatatatttaaaa

SEQ ID NO: 2483880 - DNA, 22 bp, Homo sapiens
taacactaatatatttaaaaat

SEQ ID NO: 2483881 - DNA, 21 bp, Homo sapiens
taacactcagaagcctggggg

SEQ ID NO: 2483882 - DNA, 19 bp, Homo sapiens
taacagaagggagggcaga

SEQ ID NO: 2483883 - DNA, 15 bp, Homo sapiens
taacaggccaaagag

SEQ ID NO: 2483884 - DNA, 19 bp, Homo sapiens
taacaggctcaaacaatga

SEQ ID NO: 2483885 - DNA, 14 bp, Homo sapiens
taacagggaaggca

SEQ ID NO: 2483886 - DNA, 22 bp, Homo sapiens
taacagggaaggcaggcagggc

SEQ ID NO: 2483887 - DNA, 17 bp, Homo sapiens
taacagtggacaaagtt

SEQ ID NO: 2483888 - DNA, 14 bp, Homo sapiens
taacagtgtttaaa

SEQ ID NO: 2483889 - DNA, 19 bp, Homo sapiens
taacagttgtatttaacag

SEQ ID NO: 2483890 - DNA, 20 bp, Homo sapiens
taacatctaaaaatagactt

SEQ ID NO: 2483891 - DNA, 15 bp, Homo sapiens
taacatgtaggaagt

SEQ ID NO: 2483892 - DNA, 22 bp, Homo sapiens
taacattatctagttcattgaa

SEQ ID NO: 2483893 - DNA, 21 bp, Homo sapiens
taacattcaggaattcttgga

SEQ ID NO: 2483894 - DNA, 18 bp, Homo sapiens
taacattccaagactcta

SEQ ID NO: 2483895 - DNA, 22 bp, Homo sapiens
taacattccaagactctagagt

SEQ ID NO: 2483896 - DNA, 16 bp, Homo sapiens
taaccaagctgagttt

SEQ ID NO: 2483897 - DNA, 19 bp, Homo sapiens
taaccaagctgagtttcct

SEQ ID NO: 2483898 - DNA, 12 bp, Homo sapiens
taaccactgctt

SEQ ID NO: 2483899 - DNA, 20 bp, Homo sapiens
taaccagacacatactcatt

SEQ ID NO: 2483900 - DNA, 22 bp, Homo sapiens
taaccagacacatactcatttt

SEQ ID NO: 2483901 - DNA, 22 bp, Homo sapiens
taaccagatctagtcaatcaag

SEQ ID NO: 2483902 - DNA, 17 bp, Homo sapiens
taacccactgagaggac

SEQ ID NO: 2483903 - DNA, 23 bp, Homo sapiens
taaccgagatcagtatttaacta

SEQ ID NO: 2483904 - DNA, 16 bp, Homo sapiens
taacctcgggcctgct

SEQ ID NO: 2483905 - DNA, 14 bp, Homo sapiens
taacctctgcacta

SEQ ID NO: 2483906 - DNA, 18 bp, Homo sapiens
taacctgtctcacctgga

SEQ ID NO: 2483907 - DNA, 14 bp, Homo sapiens
taacctttacatga

SEQ ID NO: 2483908 - DNA, 20 bp, Homo sapiens
taacgtttaagccaaaacaa

SEQ ID NO: 2483909 - DNA, 18 bp, Homo sapiens
taactaactgcatacact

SEQ ID NO: 2483910 - DNA, 16 bp, Homo sapiens
taactcctcccagggt

SEQ ID NO: 2483911 - DNA, 18 bp, Homo sapiens
taactcctcccagggttt

SEQ ID NO: 2483912 - DNA, 20 bp, Homo sapiens
taactgaaaattatttaaac

SEQ ID NO: 2483913 - DNA, 15 bp, Homo sapiens
taactgaataccact

SEQ ID NO: 2483914 - DNA, 19 bp, Homo sapiens
taactgaataccactctgt

SEQ ID NO: 2483915 - DNA, 22 bp, Homo sapiens
taactgaataccactctgtaat

SEQ ID NO: 2483916 - DNA, 21 bp, Homo sapiens
taactgcccaaagcagcactt

SEQ ID NO: 2483917 - DNA, 15 bp, Homo sapiens
taactgcctagaaac

SEQ ID NO: 2483918 - DNA, 16 bp, Homo sapiens
taactgcctagaaaca

SEQ ID NO: 2483919 - DNA, 19 bp, Homo sapiens
taactggaaaacagaacac

SEQ ID NO: 2483920 - DNA, 21 bp, Homo sapiens
taactggaaaacagaacactt

SEQ ID NO: 2483921 - DNA, 22 bp, Homo sapiens
taactggaaaacagaacactta

SEQ ID NO: 2483922 - DNA, 14 bp, Homo sapiens
taactggaaagaag

SEQ ID NO: 2483923 - DNA, 15 bp, Homo sapiens
taactgtaaagatgt

SEQ ID NO: 2483924 - DNA, 22 bp, Homo sapiens
taactgtatttgaaataagaat

SEQ ID NO: 2483925 - DNA, 16 bp, Homo sapiens
taacttaaatagtatt

SEQ ID NO: 2483926 - DNA, 17 bp, Homo sapiens
taacttaaatagtattt

SEQ ID NO: 2483927 - DNA, 23 bp, Homo sapiens
taacttccacagggtcccacagc

SEQ ID NO: 2483928 - DNA, 17 bp, Homo sapiens
taacttcttatggaatt

SEQ ID NO: 2483929 - DNA, 19 bp, Homo sapiens
taacttcttgcttctttct

SEQ ID NO: 2483930 - DNA, 12 bp, Homo sapiens
taactttgtttt

SEQ ID NO: 2483931 - DNA, 18 bp, Homo sapiens
taactttgttttattttc

SEQ ID NO: 2483932 - DNA, 21 bp, Homo sapiens
taactttgttttattttcaaa

SEQ ID NO: 2483933 - DNA, 11 bp, Homo sapiens
taagaaaaaag

SEQ ID NO: 2483934 - DNA, 15 bp, Homo sapiens
taagaaaataaatgt

SEQ ID NO: 2483935 - DNA, 23 bp, Homo sapiens
taagaaacctactgcccaggcac

SEQ ID NO: 2483936 - DNA, 20 bp, Homo sapiens
taagaaacttttttatttaa

SEQ ID NO: 2483937 - DNA, 14 bp, Homo sapiens
taagaaagcctgag

SEQ ID NO: 2483938 - DNA, 21 bp, Homo sapiens
taagaaaggaagcattgtaaa

SEQ ID NO: 2483939 - DNA, 13 bp, Homo sapiens
taagaaatagaat

SEQ ID NO: 2483940 - DNA, 14 bp, Homo sapiens
taagaaattgaata

SEQ ID NO: 2483941 - DNA, 13 bp, Homo sapiens
taagaaggcaaaa

SEQ ID NO: 2483942 - DNA, 15 bp, Homo sapiens
taagaattcagacat

SEQ ID NO: 2483943 - DNA, 20 bp, Homo sapiens
taagaattgagtaatggtgt

SEQ ID NO: 2483944 - DNA, 20 bp, Homo sapiens
taagacactgaaaaatctaa

SEQ ID NO: 2483945 - DNA, 17 bp, Homo sapiens
taagacatgatttcctt

SEQ ID NO: 2483946 - DNA, 20 bp, Homo sapiens
taagacatgatttccttgaa

SEQ ID NO: 2483947 - DNA, 19 bp, Homo sapiens
taagacctactgttctaaa

SEQ ID NO: 2483948 - DNA, 17 bp, Homo sapiens
taagacctggcagctct

SEQ ID NO: 2483949 - DNA, 15 bp, Homo sapiens
taagactcaaatgtt

SEQ ID NO: 2483950 - DNA, 21 bp, Homo sapiens
taagactcaaatgttctaagt

SEQ ID NO: 2483951 - DNA, 12 bp, Homo sapiens
taagagaagtag

SEQ ID NO: 2483952 - DNA, 22 bp, Homo sapiens
taagagctcaggatgagggaaa

SEQ ID NO: 2483953 - DNA, 16 bp, Homo sapiens
taagaggctgccctcc

SEQ ID NO: 2483954 - DNA, 20 bp, Homo sapiens
taagaggctgccctcctgtg

SEQ ID NO: 2483955 - DNA, 20 bp, Homo sapiens
taagatgtgatattctaaga

SEQ ID NO: 2483956 - DNA, 21 bp, Homo sapiens
taagatgtgatattctaagac

SEQ ID NO: 2483957 - DNA, 22 bp, Homo sapiens
taagatgtgatattctaagact

SEQ ID NO: 2483958 - DNA, 23 bp, Homo sapiens
taagatgtgatattctaagactt

SEQ ID NO: 2483959 - DNA, 22 bp, Homo sapiens
taagattatagattctaaagat

SEQ ID NO: 2483960 - DNA, 10 bp, Homo sapiens
taagattcta

SEQ ID NO: 2483961 - DNA, 14 bp, Homo sapiens
taagattctaaagg

SEQ ID NO: 2483962 - DNA, 12 bp, Homo sapiens
taagattctaac

SEQ ID NO: 2483963 - DNA, 13 bp, Homo sapiens
taagattctaatg

SEQ ID NO: 2483964 - DNA, 11 bp, Homo sapiens
taagattctag

SEQ ID NO: 2483965 - DNA, 14 bp, Homo sapiens
taagattctgattt

SEQ ID NO: 2483966 - DNA, 19 bp, Homo sapiens
taagatttgtttttaaact

SEQ ID NO: 2483967 - DNA, 22 bp, Homo sapiens
taagatttgtttttaaactgta

SEQ ID NO: 2483968 - DNA, 23 bp, Homo sapiens
taagatttgtttttaaactgtac

SEQ ID NO: 2483969 - DNA, 16 bp, Homo sapiens
taagcaacatggcttt

SEQ ID NO: 2483970 - DNA, 22 bp, Homo sapiens
taagcacctgtaatgtgcgagg

SEQ ID NO: 2483971 - DNA, 13 bp, Homo sapiens
taagcagaaagtg

SEQ ID NO: 2483972 - DNA, 15 bp, Homo sapiens
taagcagaaagtgcc

SEQ ID NO: 2483973 - DNA, 22 bp, Homo sapiens
taagcaggtggatctatttcat

SEQ ID NO: 2483974 - DNA, 18 bp, Homo sapiens
taagcagtgtctgtgttt

SEQ ID NO: 2483975 - DNA, 23 bp, Homo sapiens
taagcataaaagatgaaagagca

SEQ ID NO: 2483976 - DNA, 14 bp, Homo sapiens
taagcatcattatt

SEQ ID NO: 2483977 - DNA, 22 bp, Homo sapiens
taagcatcattatttatgtatt

SEQ ID NO: 2483978 - DNA, 23 bp, Homo sapiens
taagcatcattatttatgtattg

SEQ ID NO: 2483979 - DNA, 18 bp, Homo sapiens
taagcatctggctctaat

SEQ ID NO: 2483980 - DNA, 20 bp, Homo sapiens
taagccacttaaaatgttca

SEQ ID NO: 2483981 - DNA, 23 bp, Homo sapiens
taagccagcaccggaccagcctg

SEQ ID NO: 2483982 - DNA, 21 bp, Homo sapiens
taagctatttgatgtaatact

SEQ ID NO: 2483983 - DNA, 23 bp, Homo sapiens
taagctatttgatgtaatacttc

SEQ ID NO: 2483984 - DNA, 14 bp, Homo sapiens
taagctatttttct

SEQ ID NO: 2483985 - DNA, 19 bp, Homo sapiens
taaggaaatcaacttgctt

SEQ ID NO: 2483986 - DNA, 14 bp, Homo sapiens
taaggaaccaacaa

SEQ ID NO: 2483987 - DNA, 18 bp, Homo sapiens
taaggatccggaaagaag

SEQ ID NO: 2483988 - DNA, 20 bp, Homo sapiens
taaggcaacaaaagaagccc

SEQ ID NO: 2483989 - DNA, 16 bp, Homo sapiens
taaggcctgtgggggg

SEQ ID NO: 2483990 - DNA, 14 bp, Homo sapiens
taaggctctagatc

SEQ ID NO: 2483991 - DNA, 24 bp, Homo sapiens
taaggctctgagagtctagattct

SEQ ID NO: 2483992 - DNA, 13 bp, Homo sapiens
taaggctgtgtaa

SEQ ID NO: 2483993 - DNA, 14 bp, Homo sapiens
taagggcactgacg

SEQ ID NO: 2483994 - DNA, 16 bp, Homo sapiens
taagggcccaggtcag

SEQ ID NO: 2483995 - DNA, 17 bp, Homo sapiens
taaggtccggtgttcta

SEQ ID NO: 2483996 - DNA, 21 bp, Homo sapiens
taaggtccggtgttctaagat

SEQ ID NO: 2483997 - DNA, 21 bp, Homo sapiens
taaggtgtagccacaccagga

SEQ ID NO: 2483998 - DNA, 15 bp, Homo sapiens
taaggttctaaggcc

SEQ ID NO: 2483999 - DNA, 11 bp, Homo sapiens
taagtacagag

SEQ ID NO: 2484000 - DNA, 17 bp, Homo sapiens
taagtcaacagtaaacc

SEQ ID NO: 2484001 - DNA, 15 bp, Homo sapiens
taagtcaacctgcct

SEQ ID NO: 2484002 - DNA, 14 bp, Homo sapiens
taagtccagtccag

SEQ ID NO: 2484003 - DNA, 14 bp, Homo sapiens
taagtgccctctcc

SEQ ID NO: 2484004 - DNA, 15 bp, Homo sapiens
taagtgccctctccc

SEQ ID NO: 2484005 - DNA, 16 bp, Homo sapiens
taagtgccctctccca

SEQ ID NO: 2484006 - DNA, 21 bp, Homo sapiens
taagtgccctctcccaccctc

SEQ ID NO: 2484007 - DNA, 21 bp, Homo sapiens
taagttgagatagttttcatc

SEQ ID NO: 2484008 - DNA, 22 bp, Homo sapiens
taagttgagatagttttcatcc

SEQ ID NO: 2484009 - DNA, 13 bp, Homo sapiens
taagttgggcttg

SEQ ID NO: 2484010 - DNA, 14 bp, Homo sapiens
taagtttctgggac

SEQ ID NO: 2484011 - DNA, 15 bp, Homo sapiens
taataaaaagctttt

SEQ ID NO: 2484012 - DNA, 11 bp, Homo sapiens
taataaaagaa

SEQ ID NO: 2484013 - DNA, 12 bp, Homo sapiens
taataaaagaaa

SEQ ID NO: 2484014 - DNA, 13 bp, Homo sapiens
taataaaagaaaa

SEQ ID NO: 2484015 - DNA, 20 bp, Homo sapiens
taataaactaataattgcag

SEQ ID NO: 2484016 - DNA, 17 bp, Homo sapiens
taataaatgtacattaa

SEQ ID NO: 2484017 - DNA, 19 bp, Homo sapiens
taataaatgtacattaatt

SEQ ID NO: 2484018 - DNA, 13 bp, Homo sapiens
taataaggtttta

SEQ ID NO: 2484019 - DNA, 16 bp, Homo sapiens
taataaggttttaatt

SEQ ID NO: 2484020 - DNA, 16 bp, Homo sapiens
taatacattatatttc

SEQ ID NO: 2484021 - DNA, 21 bp, Homo sapiens
taatactcaaatgagtaacat

SEQ ID NO: 2484022 - DNA, 14 bp, Homo sapiens
taatactgctgaga

SEQ ID NO: 2484023 - DNA, 23 bp, Homo sapiens
taatactgctgagatacatacag

SEQ ID NO: 2484024 - DNA, 14 bp, Homo sapiens
taatagatgtttga

SEQ ID NO: 2484025 - DNA, 22 bp, Homo sapiens
taatagatgtttgatagatttt

SEQ ID NO: 2484026 - DNA, 15 bp, Homo sapiens
taatagcaaagaatt

SEQ ID NO: 2484027 - DNA, 12 bp, Homo sapiens
taatagttcctg

SEQ ID NO: 2484028 - DNA, 15 bp, Homo sapiens
taatataaagtttta

SEQ ID NO: 2484029 - DNA, 22 bp, Homo sapiens
taatataaatgcaaataacaaa

SEQ ID NO: 2484030 - DNA, 16 bp, Homo sapiens
taatatatattatctt

SEQ ID NO: 2484031 - DNA, 18 bp, Homo sapiens
taatatccctacatgtat

SEQ ID NO: 2484032 - DNA, 17 bp, Homo sapiens
taatatcctaaacatca

SEQ ID NO: 2484033 - DNA, 18 bp, Homo sapiens
taatattgacttgtatat

SEQ ID NO: 2484034 - DNA, 17 bp, Homo sapiens
taatcaaaagctattta

SEQ ID NO: 2484035 - DNA, 17 bp, Homo sapiens
taatctgaataaagtgt

SEQ ID NO: 2484036 - DNA, 20 bp, Homo sapiens
taatctgaataaagtgtaac

SEQ ID NO: 2484037 - DNA, 21 bp, Homo sapiens
taatctgaataaagtgtaaca

SEQ ID NO: 2484038 - DNA, 21 bp, Homo sapiens
taatgaaaacagaatgtctct

SEQ ID NO: 2484039 - DNA, 17 bp, Homo sapiens
taatgaaacaaagagtt

SEQ ID NO: 2484040 - DNA, 22 bp, Homo sapiens
taatgaagaaagtggaaaacaa

SEQ ID NO: 2484041 - DNA, 15 bp, Homo sapiens
taatgacaggcctgt

SEQ ID NO: 2484042 - DNA, 15 bp, Homo sapiens
taatgatatgcttgt

SEQ ID NO: 2484043 - DNA, 18 bp, Homo sapiens
taatgcattcttctctgt

SEQ ID NO: 2484044 - DNA, 12 bp, Homo sapiens
taatgcccagac

SEQ ID NO: 2484045 - DNA, 15 bp, Homo sapiens
taatggcatgagaaa

SEQ ID NO: 2484046 - DNA, 21 bp, Homo sapiens
taatggctgataattttaaat

SEQ ID NO: 2484047 - DNA, 15 bp, Homo sapiens
taatgggattttctt

SEQ ID NO: 2484048 - DNA, 13 bp, Homo sapiens
taatggtgtagaa

SEQ ID NO: 2484049 - DNA, 13 bp, Homo sapiens
taatgtcttgagc

SEQ ID NO: 2484050 - DNA, 15 bp, Homo sapiens
taatgtcttgagctc

SEQ ID NO: 2484051 - DNA, 16 bp, Homo sapiens
taatgttaatattgat

SEQ ID NO: 2484052 - DNA, 14 bp, Homo sapiens
taatgttgttattt

SEQ ID NO: 2484053 - DNA, 18 bp, Homo sapiens
taatgttgttatttaaag

SEQ ID NO: 2484054 - DNA, 14 bp, Homo sapiens
taattaattgtaat

SEQ ID NO: 2484055 - DNA, 17 bp, Homo sapiens
tatattttagcatttta

SEQ ID NO: 2484056 - DNA, 21 bp, Homo sapiens
tatatttttttttaagctctg

SEQ ID NO: 2484057 - DNA, 14 bp, Homo sapiens
tatcaacttcctaa

SEQ ID NO: 2484058 - DNA, 21 bp, Homo sapiens
tatcaaggtcgtttttttcat

SEQ ID NO: 2484059 - DNA, 18 bp, Homo sapiens
tatcacatgttttctctg

SEQ ID NO: 2484060 - DNA, 20 bp, Homo sapiens
tatcaggacccagaggaagg

SEQ ID NO: 2484061 - DNA, 19 bp, Homo sapiens
tatcaggcaaatttgcatt

SEQ ID NO: 2484062 - DNA, 21 bp, Homo sapiens
tatcagtcaatatttttagat

SEQ ID NO: 2484063 - DNA, 11 bp, Homo sapiens
tatcagtgctt

SEQ ID NO: 2484064 - DNA, 13 bp, Homo sapiens
tatcagtgcttcc

SEQ ID NO: 2484065 - DNA, 17 bp, Homo sapiens
tatcatctacctagatt

SEQ ID NO: 2484066 - DNA, 14 bp, Homo sapiens
tatcattcaagtgt

SEQ ID NO: 2484067 - DNA, 21 bp, Homo sapiens
tatccaggtaatccaagatat

SEQ ID NO: 2484068 - DNA, 22 bp, Homo sapiens
tatccatattgagtcaaatggt

SEQ ID NO: 2484069 - DNA, 20 bp, Homo sapiens
tatcccacctccatcccaga

SEQ ID NO: 2484070 - DNA, 14 bp, Homo sapiens
tatcccagctgcct

SEQ ID NO: 2484071 - DNA, 19 bp, Homo sapiens
tatccctcctgttgggaga

SEQ ID NO: 2484072 - DNA, 16 bp, Homo sapiens
tatcctaaacatcatt

SEQ ID NO: 2484073 - DNA, 15 bp, Homo sapiens
tatcctccaccgtct

SEQ ID NO: 2484074 - DNA, 12 bp, Homo sapiens
tatcctccctgt

SEQ ID NO: 2484075 - DNA, 15 bp, Homo sapiens
tatcctctcttcctc

SEQ ID NO: 2484076 - DNA, 23 bp, Homo sapiens
tatcgacttgtttttgcacatgt

SEQ ID NO: 2484077 - DNA, 16 bp, Homo sapiens
tatcgatctcttattt

SEQ ID NO: 2484078 - DNA, 17 bp, Homo sapiens
tatcgctgggaaatgag

SEQ ID NO: 2484079 - DNA, 22 bp, Homo sapiens
tatctaaatatggactgctcag

SEQ ID NO: 2484080 - DNA, 13 bp, Homo sapiens
tatctaatttata

SEQ ID NO: 2484081 - DNA, 17 bp, Homo sapiens
tatctaggcaacatagt

SEQ ID NO: 2484082 - DNA, 19 bp, Homo sapiens
tatctataatttacctaag

SEQ ID NO: 2484083 - DNA, 10 bp, Homo sapiens
tatctcagaa

SEQ ID NO: 2484084 - DNA, 13 bp, Homo sapiens
tatctcagaaagt

SEQ ID NO: 2484085 - DNA, 20 bp, Homo sapiens
tatctcagaaagtgcctgac

SEQ ID NO: 2484086 - DNA, 13 bp, Homo sapiens
tatctgatcagaa

SEQ ID NO: 2484087 - DNA, 22 bp, Homo sapiens
tatctgcaagtgaggtgtgtca

SEQ ID NO: 2484088 - DNA, 15 bp, Homo sapiens
tatctggcctctgct

SEQ ID NO: 2484089 - DNA, 15 bp, Homo sapiens
tcactctgagtgttt

SEQ ID NO: 2484090 - DNA, 17 bp, Homo sapiens
tcactgagttttccatg

SEQ ID NO: 2484091 - DNA, 14 bp, Homo sapiens
tcactgcaacctcc

SEQ ID NO: 2484092 - DNA, 11 bp, Homo sapiens
tcactggagca

SEQ ID NO: 2484093 - DNA, 20 bp, Homo sapiens
tcactggcgacacgtagcag

SEQ ID NO: 2484094 - DNA, 13 bp, Homo sapiens
tcactggctctcc

SEQ ID NO: 2484095 - DNA, 17 bp, Homo sapiens
tcactttttctgataaa

SEQ ID NO: 2484096 - DNA, 15 bp, Homo sapiens
tcagaaaccagactc

SEQ ID NO: 2484097 - DNA, 20 bp, Homo sapiens
tcagaaaggaaaaacaaact

SEQ ID NO: 2484098 - DNA, 18 bp, Homo sapiens
tcagaaagggagggctct

SEQ ID NO: 2484099 - DNA, 19 bp, Homo sapiens
tcagaaagggagggctctg

SEQ ID NO: 2484100 - DNA, 22 bp, Homo sapiens
tcagaaagggagggctctgagg

SEQ ID NO: 2484101 - DNA, 23 bp, Homo sapiens
tcagaaagtgcctgacacactaa

SEQ ID NO: 2484102 - DNA, 14 bp, Homo sapiens
tcagaagcctgggg

SEQ ID NO: 2484103 - DNA, 16 bp, Homo sapiens
tcagaagcctgggggc

SEQ ID NO: 2484104 - DNA, 21 bp, Homo sapiens
tcagaagcctgggggcctggc

SEQ ID NO: 2484105 - DNA, 15 bp, Homo sapiens
tcagaagtcatcttg

SEQ ID NO: 2484106 - DNA, 17 bp, Homo sapiens
tcagaagttagtttgta

SEQ ID NO: 2484107 - DNA, 15 bp, Homo sapiens
tcagaatatgtcagt

SEQ ID NO: 2484108 - DNA, 20 bp, Homo sapiens
tcagaattaaacttttaatt

SEQ ID NO: 2484109 - DNA, 23 bp, Homo sapiens
tcagaattaaacttttaattcat

SEQ ID NO: 2484110 - DNA, 21 bp, Homo sapiens
tcagaatttagtgtatccata

SEQ ID NO: 2484111 - DNA, 23 bp, Homo sapiens
tcagaccataatgttacattatt

SEQ ID NO: 2484112 - DNA, 12 bp, Homo sapiens
tcagaccctgga

SEQ ID NO: 2484113 - DNA, 15 bp, Homo sapiens
tcagagagcagtgct

SEQ ID NO: 2484114 - DNA, 22 bp, Homo sapiens
tcagagatgcaccaccaagcca

SEQ ID NO: 2484115 - DNA, 20 bp, Homo sapiens
tcagagccgtggtcctttgg

SEQ ID NO: 2484116 - DNA, 19 bp, Homo sapiens
tcagagttctttttgaagt

SEQ ID NO: 2484117 - DNA, 21 bp, Homo sapiens
tcagatatcttggacaaatca

SEQ ID NO: 2484118 - DNA, 22 bp, Homo sapiens
tcagatatcttggacaaatcac

SEQ ID NO: 2484119 - DNA, 23 bp, Homo sapiens
tcagatatcttggacaaatcaca

SEQ ID NO: 2484120 - DNA, 16 bp, Homo sapiens
tcagatccagggacag

SEQ ID NO: 2484121 - DNA, 13 bp, Homo sapiens
tcagatcctcctc

SEQ ID NO: 2484122 - DNA, 14 bp, Homo sapiens
tcagatgctccaag

SEQ ID NO: 2484123 - DNA, 12 bp, Homo sapiens
tcagatggaaaa

SEQ ID NO: 2484124 - DNA, 19 bp, Homo sapiens
tcagatggaaaattcattt

SEQ ID NO: 2484125 - DNA, 16 bp, Homo sapiens
tcagatggcagctttt

SEQ ID NO: 2484126 - DNA, 17 bp, Homo sapiens
tcagatggcagctttta

SEQ ID NO: 2484127 - DNA, 15 bp, Homo sapiens
tcagattccttccca

SEQ ID NO: 2484128 - DNA, 16 bp, Homo sapiens
tcagattccttcccat

SEQ ID NO: 2484129 - DNA, 19 bp, Homo sapiens
tcagatttctggttgttat

SEQ ID NO: 2484130 - DNA, 18 bp, Homo sapiens
tcagcaaagtggttccct

SEQ ID NO: 2484131 - DNA, 13 bp, Homo sapiens
tcagcacaaggcc

SEQ ID NO: 2484132 - DNA, 14 bp, Homo sapiens
tcagcactagccaa

SEQ ID NO: 2484133 - DNA, 15 bp, Homo sapiens
tcagcactgcctgct

SEQ ID NO: 2484134 - DNA, 22 bp, Homo sapiens
tcagcactgcctgctcccatcc

SEQ ID NO: 2484135 - DNA, 21 bp, Homo sapiens
tcagcactgtcccttgcctca

SEQ ID NO: 2484136 - DNA, 14 bp, Homo sapiens
tcagcacttggccc

SEQ ID NO: 2484137 - DNA, 19 bp, Homo sapiens
tcagcacttggcccttcta

SEQ ID NO: 2484138 - DNA, 14 bp, Homo sapiens
tcagcatgaatttg

SEQ ID NO: 2484139 - DNA, 14 bp, Homo sapiens
tcagccagcacttg

SEQ ID NO: 2484140 - DNA, 13 bp, Homo sapiens
tcagccagcctcg

SEQ ID NO: 2484141 - DNA, 21 bp, Homo sapiens
tcagtgttaaatgtgatgaat

SEQ ID NO: 2484142 - DNA, 15 bp, Homo sapiens
tcagttgttcttttt

SEQ ID NO: 2484143 - DNA, 17 bp, Homo sapiens
tcagttttatcattttc

SEQ ID NO: 2484144 - DNA, 13 bp, Homo sapiens
tcagttttcattt

SEQ ID NO: 2484145 - DNA, 15 bp, Homo sapiens
tcataaggcttcaaa

SEQ ID NO: 2484146 - DNA, 20 bp, Homo sapiens
tcataaggcttcaaaatgtt

SEQ ID NO: 2484147 - DNA, 13 bp, Homo sapiens
tcatacagagaag

SEQ ID NO: 2484148 - DNA, 16 bp, Homo sapiens
tcatacagagaagtca

SEQ ID NO: 2484149 - DNA, 15 bp, Homo sapiens
tcatacttgaacgtt

SEQ ID NO: 2484150 - DNA, 23 bp, Homo sapiens
tcatacttgaacgttttctaatt

SEQ ID NO: 2484151 - DNA, 15 bp, Homo sapiens
tcatagcaatacttg

SEQ ID NO: 2484152 - DNA, 15 bp, Homo sapiens
tcataggtctgaaat

SEQ ID NO: 2484153 - DNA, 18 bp, Homo sapiens
tcatagttcagaatttag

SEQ ID NO: 2484154 - DNA, 13 bp, Homo sapiens
tcatagtttaatt

SEQ ID NO: 2484155 - DNA, 18 bp, Homo sapiens
tcatataaagtatcatca

SEQ ID NO: 2484156 - DNA, 20 bp, Homo sapiens
tcatatagttagctaataaa

SEQ ID NO: 2484157 - DNA, 13 bp, Homo sapiens
tcatatcatccac

SEQ ID NO: 2484158 - DNA, 14 bp, Homo sapiens
tcatatcatccaca

SEQ ID NO: 2484159 - DNA, 21 bp, Homo sapiens
tcatcaagagaatttggggct

SEQ ID NO: 2484160 - DNA, 19 bp, Homo sapiens
tcatcagaaaggaaaaaca

SEQ ID NO: 2484161 - DNA, 17 bp, Homo sapiens
tcatcatcatggccagc

SEQ ID NO: 2484162 - DNA, 14 bp, Homo sapiens
tcatcatggccagc

SEQ ID NO: 2484163 - DNA, 18 bp, Homo sapiens
tcatcattctctgtctca

SEQ ID NO: 2484164 - DNA, 17 bp, Homo sapiens
tcatccaagttaaatgt

SEQ ID NO: 2484165 - DNA, 12 bp, Homo sapiens
tcatccacccca

SEQ ID NO: 2484166 - DNA, 20 bp, Homo sapiens
tcatccaccccatccctccc

SEQ ID NO: 2484167 - DNA, 15 bp, Homo sapiens
tcatccataactgaa

SEQ ID NO: 2484168 - DNA, 12 bp, Homo sapiens
tcatcccactcc

SEQ ID NO: 2484169 - DNA, 23 bp, Homo sapiens
tcatcctcaaagaaagtgtattg

SEQ ID NO: 2484170 - DNA, 23 bp, Homo sapiens
tcatcctcacagtgaacactcag

SEQ ID NO: 2484171 - DNA, 14 bp, Homo sapiens
tcatccttgtctta

SEQ ID NO: 2484172 - DNA, 14 bp, Homo sapiens
tcatcgaatctact

SEQ ID NO: 2484173 - DNA, 20 bp, Homo sapiens
tcatctaccattttctggtt

SEQ ID NO: 2484174 - DNA, 14 bp, Homo sapiens
tcatctaggatttt

SEQ ID NO: 2484175 - DNA, 15 bp, Homo sapiens
tcatctcctgccttc

SEQ ID NO: 2484176 - DNA, 21 bp, Homo sapiens
tcatctcctgccttcctcctg

SEQ ID NO: 2484177 - DNA, 14 bp, Homo sapiens
tcatctgctggtcc

SEQ ID NO: 2484178 - DNA, 18 bp, Homo sapiens
tcatcttcagttgtctct

SEQ ID NO: 2484179 - DNA, 21 bp, Homo sapiens
tcatcttgctaccagtattta

SEQ ID NO: 2484180 - DNA, 22 bp, Homo sapiens
tcatgaggagattctgcctttg

SEQ ID NO: 2484181 - DNA, 18 bp, Homo sapiens
tcatgagtgaataaatgt

SEQ ID NO: 2484182 - DNA, 21 bp, Homo sapiens
tcatgataatgaacagaacat

SEQ ID NO: 2484183 - DNA, 18 bp, Homo sapiens
tcatgataccacctttac

SEQ ID NO: 2484184 - DNA, 20 bp, Homo sapiens
tcatgataccacctttactg

SEQ ID NO: 2484185 - DNA, 23 bp, Homo sapiens
tcatgattagaaattacctgtgg

SEQ ID NO: 2484186 - DNA, 22 bp, Homo sapiens
tcatgattttaagtttctctgc

SEQ ID NO: 2484187 - DNA, 14 bp, Homo sapiens
tcatgcaaactctt

SEQ ID NO: 2484188 - DNA, 21 bp, Homo sapiens
tcatgccagctacttcctcct

SEQ ID NO: 2484189 - DNA, 20 bp, Homo sapiens
tccaagattctagatgatta

SEQ ID NO: 2484190 - DNA, 14 bp, Homo sapiens
tccaagcagcttag

SEQ ID NO: 2484191 - DNA, 22 bp, Homo sapiens
tccaagcagcttagagttggcc

SEQ ID NO: 2484192 - DNA, 19 bp, Homo sapiens
tccaagcccagcccatgga

SEQ ID NO: 2484193 - DNA, 14 bp, Homo sapiens
tccaagctaagcac

SEQ ID NO: 2484194 - DNA, 22 bp, Homo sapiens
tccaagctgggagattcaaggg

SEQ ID NO: 2484195 - DNA, 22 bp, Homo sapiens
tccaaggtttaaagagtctaga

SEQ ID NO: 2484196 - DNA, 16 bp, Homo sapiens
tccaagttaaatgtag

SEQ ID NO: 2484197 - DNA, 17 bp, Homo sapiens
tccaagttaaatgtaga

SEQ ID NO: 2484198 - DNA, 22 bp, Homo sapiens
tccaagttgttcgggccaagga

SEQ ID NO: 2484199 - DNA, 19 bp, Homo sapiens
tccaatcaatcttgcatgt

SEQ ID NO: 2484200 - DNA, 16 bp, Homo sapiens
tccaatcctatgtttt

SEQ ID NO: 2484201 - DNA, 16 bp, Homo sapiens
tccaatgagctttctg

SEQ ID NO: 2484202 - DNA, 15 bp, Homo sapiens
tccaattagtttcct

SEQ ID NO: 2484203 - DNA, 23 bp, Homo sapiens
tccaattagtttcctttttaata

SEQ ID NO: 2484204 - DNA, 12 bp, Homo sapiens
tccacaaaataa

SEQ ID NO: 2484205 - DNA, 20 bp, Homo sapiens
tccacaaattattaatgaaa

SEQ ID NO: 2484206 - DNA, 19 bp, Homo sapiens
tccacacagtgctcaaggc

SEQ ID NO: 2484207 - DNA, 13 bp, Homo sapiens
tccacacctgcgg

SEQ ID NO: 2484208 - DNA, 10 bp, Homo sapiens
tccacagacg

SEQ ID NO: 2484209 - DNA, 19 bp, Homo sapiens
tccacagaggacacagaga

SEQ ID NO: 2484210 - DNA, 19 bp, Homo sapiens
tccacagcaaccccaggct

SEQ ID NO: 2484211 - DNA, 16 bp, Homo sapiens
tccacaggcttctgag

SEQ ID NO: 2484212 - DNA, 18 bp, Homo sapiens
tccacagggtcccacagc

SEQ ID NO: 2484213 - DNA, 19 bp, Homo sapiens
tccacataccctgacctgg

SEQ ID NO: 2484214 - DNA, 19 bp, Homo sapiens
tccacatcctccacgttct

SEQ ID NO: 2484215 - DNA, 13 bp, Homo sapiens
tccacatttctaa

SEQ ID NO: 2484216 - DNA, 14 bp, Homo sapiens
tccacatttctaaa

SEQ ID NO: 2484217 - DNA, 12 bp, Homo sapiens
tccaccccatcc

SEQ ID NO: 2484218 - DNA, 17 bp, Homo sapiens
tccacctgtctcagcct

SEQ ID NO: 2484219 - DNA, 14 bp, Homo sapiens
tccacgactgtctc

SEQ ID NO: 2484220 - DNA, 22 bp, Homo sapiens
tccacgagctgtttactaggga

SEQ ID NO: 2484221 - DNA, 14 bp, Homo sapiens
tccactctgcttct

SEQ ID NO: 2484222 - DNA, 19 bp, Homo sapiens
tccactgtgcaggttccca

SEQ ID NO: 2484223 - DNA, 20 bp, Homo sapiens
tccacttatagcctctgtct

SEQ ID NO: 2484224 - DNA, 22 bp, Homo sapiens
tccacttatagcctctgtctgg

SEQ ID NO: 2484225 - DNA, 23 bp, Homo sapiens
tccacttatagcctctgtctggc

SEQ ID NO: 2484226 - DNA, 18 bp, Homo sapiens
tccactttcagctgtctt

SEQ ID NO: 2484227 - DNA, 19 bp, Homo sapiens
tccactttgtttcgtgggg

SEQ ID NO: 2484228 - DNA, 23 bp, Homo sapiens
tccactttgtttcgtggggaggt

SEQ ID NO: 2484229 - DNA, 18 bp, Homo sapiens
tccagaatgctgtacatc

SEQ ID NO: 2484230 - DNA, 15 bp, Homo sapiens
tccagacctgaggcg

SEQ ID NO: 2484231 - DNA, 19 bp, Homo sapiens
tccagacctgatcctggag

SEQ ID NO: 2484232 - DNA, 18 bp, Homo sapiens
tccagatgcagggcagtc

SEQ ID NO: 2484233 - DNA, 23 bp, Homo sapiens
tccagcccctctggtcgctcctg

SEQ ID NO: 2484234 - DNA, 16 bp, Homo sapiens
tccagccgccggctgt

SEQ ID NO: 2484235 - DNA, 24 bp, Homo sapiens
tccagccgccggctgtgcagtcct

SEQ ID NO: 2484236 - DNA, 17 bp, Homo sapiens
tccagcctggggtctgg

SEQ ID NO: 2484237 - DNA, 16 bp, Homo sapiens
tccagctccaacctgc

SEQ ID NO: 2484238 - DNA, 19 bp, Homo sapiens
tccagctccctgtgccccc

SEQ ID NO: 2484239 - DNA, 13 bp, Homo sapiens
tccagctcctgta

SEQ ID NO: 2484240 - DNA, 16 bp, Homo sapiens
tccagctcctttgggc

SEQ ID NO: 2484241 - DNA, 23 bp, Homo sapiens
tccaggagaaggccaattcctat

SEQ ID NO: 2484242 - DNA, 20 bp, Homo sapiens
tccaggagctccagtgtcct

SEQ ID NO: 2484243 - DNA, 21 bp, Homo sapiens
tccaggagctccagtgtcctg

SEQ ID NO: 2484244 - DNA, 24 bp, Homo sapiens
tccaggagctccagtgtcctgagc

SEQ ID NO: 2484245 - DNA, 16 bp, Homo sapiens
tccaggcactgagata

SEQ ID NO: 2484246 - DNA, 13 bp, Homo sapiens
tccaggcagatcc

SEQ ID NO: 2484247 - DNA, 14 bp, Homo sapiens
tccaggcagatcca

SEQ ID NO: 2484248 - DNA, 20 bp, Homo sapiens
tccaggcagatccaggacta

SEQ ID NO: 2484249 - DNA, 21 bp, Homo sapiens
tccaggcagatccaggactat

SEQ ID NO: 2484250 - DNA, 16 bp, Homo sapiens
tccaggctgccgtggg

SEQ ID NO: 2484251 - DNA, 23 bp, Homo sapiens
tccaggcttctgctggggcctgg

SEQ ID NO: 2484252 - DNA, 14 bp, Homo sapiens
tccagggacagagg

SEQ ID NO: 2484253 - DNA, 23 bp, Homo sapiens
tccaggggctgcttcctcctgga

SEQ ID NO: 2484254 - DNA, 16 bp, Homo sapiens
tccagggtccctctgt

SEQ ID NO: 2484255 - DNA, 20 bp, Homo sapiens
tccaggttccctcccagagg

SEQ ID NO: 2484256 - DNA, 15 bp, Homo sapiens
tccagtgtcctgagc

SEQ ID NO: 2484257 - DNA, 22 bp, Homo sapiens
tccagtgtcctgagctcagcgt

SEQ ID NO: 2484258 - DNA, 19 bp, Homo sapiens
tccagttaaaaaaaatttt

SEQ ID NO: 2484259 - DNA, 22 bp, Homo sapiens
tccagttaaaaaaaattttaat

SEQ ID NO: 2484260 - DNA, 18 bp, Homo sapiens
tccataatgcattcttct

SEQ ID NO: 2484261 - DNA, 13 bp, Homo sapiens
tccatatcacaca

SEQ ID NO: 2484262 - DNA, 13 bp, Homo sapiens
tccatcatcatgt

SEQ ID NO: 2484263 - DNA, 21 bp, Homo sapiens
tccatccaaggccaggttctc

SEQ ID NO: 2484264 - DNA, 16 bp, Homo sapiens
tccatccatggccagc

SEQ ID NO: 2484265 - DNA, 14 bp, Homo sapiens
tccatccctggccc

SEQ ID NO: 2484266 - DNA, 15 bp, Homo sapiens
tccatccctggcccc

SEQ ID NO: 2484267 - DNA, 20 bp, Homo sapiens
tccatccctggccccctccc

SEQ ID NO: 2484268 - DNA, 14 bp, Homo sapiens
tccatgacatcaag

SEQ ID NO: 2484269 - DNA, 19 bp, Homo sapiens
tccatgactgcttgcccta

SEQ ID NO: 2484270 - DNA, 22 bp, Homo sapiens
tccatgactgcttgccctaagc

SEQ ID NO: 2484271 - DNA, 21 bp, Homo sapiens
tccatgctgtgcgcccagggc

SEQ ID NO: 2484272 - DNA, 17 bp, Homo sapiens
tccatgggcagagccca

SEQ ID NO: 2484273 - DNA, 22 bp, Homo sapiens
tccatgggcagagcccaaggga

SEQ ID NO: 2484274 - DNA, 23 bp, Homo sapiens
tccatgggcagagcccaagggaa

SEQ ID NO: 2484275 - DNA, 16 bp, Homo sapiens
tccattggatctcatt

SEQ ID NO: 2484276 - DNA, 16 bp, Homo sapiens
tccattggtccaagat

SEQ ID NO: 2484277 - DNA, 18 bp, Homo sapiens
tccattggtccaagattc

SEQ ID NO: 2484278 - DNA, 12 bp, Homo sapiens
tccatttctaat

SEQ ID NO: 2484279 - DNA, 12 bp, Homo sapiens
tccatttgcaag

SEQ ID NO: 2484280 - DNA, 24 bp, Homo sapiens
tcccaaacgccctttcctcctcag

SEQ ID NO: 2484281 - DNA, 14 bp, Homo sapiens
tcccaaagcaagca

SEQ ID NO: 2484282 - DNA, 23 bp, Homo sapiens
tcccaaagtgctgagattacagg

SEQ ID NO: 2484283 - DNA, 16 bp, Homo sapiens
tcccaagcggtgtctc

SEQ ID NO: 2484284 - DNA, 18 bp, Homo sapiens
tcccaaggggcctgagca

SEQ ID NO: 2484285 - DNA, 23 bp, Homo sapiens
tcccaagtagctgggattacagg

SEQ ID NO: 2484286 - DNA, 17 bp, Homo sapiens
tcccaatttcagactcc

SEQ ID NO: 2484287 - DNA, 16 bp, Homo sapiens
tcccacagccacgtgt

SEQ ID NO: 2484288 - DNA, 17 bp, Homo sapiens
tcccacaggacatttct

SEQ ID NO: 2484289 - DNA, 17 bp, Homo sapiens
tcccacatccctgggcc

SEQ ID NO: 2484290 - DNA, 13 bp, Homo sapiens
tcccacatgggcc

SEQ ID NO: 2484291 - DNA, 18 bp, Homo sapiens
tcccacccccacccccag

SEQ ID NO: 2484292 - DNA, 22 bp, Homo sapiens
tcccacccccacccccagctca

SEQ ID NO: 2484293 - DNA, 22 bp, Homo sapiens
tccttagcctggacctctgaca

SEQ ID NO: 2484294 - DNA, 20 bp, Homo sapiens
tccttcagagagcagtgctt

SEQ ID NO: 2484295 - DNA, 23 bp, Homo sapiens
tccttcagagagcagtgcttttg

SEQ ID NO: 2484296 - DNA, 19 bp, Homo sapiens
tccttcatgacagcctcca

SEQ ID NO: 2484297 - DNA, 20 bp, Homo sapiens
tccttccaatgtctggagac

SEQ ID NO: 2484298 - DNA, 19 bp, Homo sapiens
tccttccctgtgcctcctc

SEQ ID NO: 2484299 - DNA, 23 bp, Homo sapiens
tccttccgcttggagctattttc

SEQ ID NO: 2484300 - DNA, 14 bp, Homo sapiens
tccttcctgcccca

SEQ ID NO: 2484301 - DNA, 16 bp, Homo sapiens
tccttctgagctcctg

SEQ ID NO: 2484302 - DNA, 20 bp, Homo sapiens
tccttgaagaactgcaggcc

SEQ ID NO: 2484303 - DNA, 23 bp, Homo sapiens
tccttgaagaactgcaggccctg

SEQ ID NO: 2484304 - DNA, 21 bp, Homo sapiens
tccttgaaggactaatagaaa

SEQ ID NO: 2484305 - DNA, 17 bp, Homo sapiens
tccttgtgatgtgcacg

SEQ ID NO: 2484306 - DNA, 19 bp, Homo sapiens
tccttgtgatgtgcacgta

SEQ ID NO: 2484307 - DNA, 14 bp, Homo sapiens
tctaatatggccac

SEQ ID NO: 2484308 - DNA, 19 bp, Homo sapiens
tctaattatgtagctcttt

SEQ ID NO: 2484309 - DNA, 21 bp, Homo sapiens
tctaattatgtagctctttgt

SEQ ID NO: 2484310 - DNA, 13 bp, Homo sapiens
tctaattgccatg

SEQ ID NO: 2484311 - DNA, 15 bp, Homo sapiens
tctaattgccatgta

SEQ ID NO: 2484312 - DNA, 14 bp, Homo sapiens
tctaattgcttatt

SEQ ID NO: 2484313 - DNA, 17 bp, Homo sapiens
tctacaactcatacact

SEQ ID NO: 2484314 - DNA, 16 bp, Homo sapiens
tctacatatgatctgt

SEQ ID NO: 2484315 - DNA, 21 bp, Homo sapiens
tctacatatgatctgtctgtg

SEQ ID NO: 2484316 - DNA, 17 bp, Homo sapiens
tctaccattttctggtt

SEQ ID NO: 2484317 - DNA, 15 bp, Homo sapiens
tctacccatattaca

SEQ ID NO: 2484318 - DNA, 19 bp, Homo sapiens
tctacctagatttaatata

SEQ ID NO: 2484319 - DNA, 18 bp, Homo sapiens
tctaccttctccccagct

SEQ ID NO: 2484320 - DNA, 15 bp, Homo sapiens
tctactaattccaca

SEQ ID NO: 2484321 - DNA, 20 bp, Homo sapiens
tctactcacttttcccactc

SEQ ID NO: 2484322 - DNA, 15 bp, Homo sapiens
tctactttccctctg

SEQ ID NO: 2484323 - DNA, 18 bp, Homo sapiens
tctactttccctctggga

SEQ ID NO: 2484324 - DNA, 17 bp, Homo sapiens
tctagaaaaacaggcac

SEQ ID NO: 2484325 - DNA, 19 bp, Homo sapiens
tctagaaagagaaacagtt

SEQ ID NO: 2484326 - DNA, 22 bp, Homo sapiens
tctagacatggaggttctaagg

SEQ ID NO: 2484327 - DNA, 14 bp, Homo sapiens
tctagagcactgcc

SEQ ID NO: 2484328 - DNA, 15 bp, Homo sapiens
tctagagcactgcca

SEQ ID NO: 2484329 - DNA, 13 bp, Homo sapiens
tctagagtccaag

SEQ ID NO: 2484330 - DNA, 16 bp, Homo sapiens
tctagatcagatgctc

SEQ ID NO: 2484331 - DNA, 18 bp, Homo sapiens
tctagatcagatgctcca

SEQ ID NO: 2484332 - DNA, 22 bp, Homo sapiens
tctagatcagatgctccaagat

SEQ ID NO: 2484333 - DNA, 21 bp, Homo sapiens
tctagatgtttattcttctag

SEQ ID NO: 2484334 - DNA, 19 bp, Homo sapiens
tctagattccattggtcca

SEQ ID NO: 2484335 - DNA, 22 bp, Homo sapiens
tctagattccattggtccaaga

SEQ ID NO: 2484336 - DNA, 23 bp, Homo sapiens
tctagcgcagttttttttttctt

SEQ ID NO: 2484337 - DNA, 14 bp, Homo sapiens
tctaggaaatctag

SEQ ID NO: 2484338 - DNA, 24 bp, Homo sapiens
tctaggcactgtagttctaagact

SEQ ID NO: 2484339 - DNA, 20 bp, Homo sapiens
tctaggtaggggcccacttc

SEQ ID NO: 2484340 - DNA, 22 bp, Homo sapiens
tctagtacttgggagacctgta

SEQ ID NO: 2484341 - DNA, 20 bp, Homo sapiens
tctagtcaatgacatgaatt

SEQ ID NO: 2484342 - DNA, 22 bp, Homo sapiens
tctagtcaatgacatgaatttt

SEQ ID NO: 2484343 - DNA, 21 bp, Homo sapiens
tctataaactataacctctcc

SEQ ID NO: 2484344 - DNA, 12 bp, Homo sapiens
tctataaagcat

SEQ ID NO: 2484345 - DNA, 16 bp, Homo sapiens
tctataaggccataaa

SEQ ID NO: 2484346 - DNA, 17 bp, Homo sapiens
tctatagaactgaatga

SEQ ID NO: 2484347 - DNA, 14 bp, Homo sapiens
tctatcctctgtaa

SEQ ID NO: 2484348 - DNA, 14 bp, Homo sapiens
tctatgagtctaga

SEQ ID NO: 2484349 - DNA, 13 bp, Homo sapiens
tctatgcctgtct

SEQ ID NO: 2484350 - DNA, 13 bp, Homo sapiens
tctattaaaagac

SEQ ID NO: 2484351 - DNA, 15 bp, Homo sapiens
tctattatgaatgtg

SEQ ID NO: 2484352 - DNA, 22 bp, Homo sapiens
tctattatgaatgtgaagcctt

SEQ ID NO: 2484353 - DNA, 23 bp, Homo sapiens
tctattatgaatgtgaagccttc

SEQ ID NO: 2484354 - DNA, 13 bp, Homo sapiens
tctattctttaac

SEQ ID NO: 2484355 - DNA, 13 bp, Homo sapiens
tctatttatatgt

SEQ ID NO: 2484356 - DNA, 16 bp, Homo sapiens
tctatttcatgttttt

SEQ ID NO: 2484357 - DNA, 20 bp, Homo sapiens
tctatttctcctccatggga

SEQ ID NO: 2484358 - DNA, 16 bp, Homo sapiens
tctatttctgcctccc

SEQ ID NO: 2484359 - DNA, 14 bp, Homo sapiens
tctattttaaagac

SEQ ID NO: 2484360 - DNA, 20 bp, Homo sapiens
tctattttaataaaaataat

SEQ ID NO: 2484361 - DNA, 15 bp, Homo sapiens
tctatttttggaggt

SEQ ID NO: 2484362 - DNA, 18 bp, Homo sapiens
tctatttttggaggttta

SEQ ID NO: 2484363 - DNA, 16 bp, Homo sapiens
tctcaaaacagagggc

SEQ ID NO: 2484364 - DNA, 23 bp, Homo sapiens
tctcaaactcctgacctcaggca

SEQ ID NO: 2484365 - DNA, 16 bp, Homo sapiens
tctcaaaggagcgagc

SEQ ID NO: 2484366 - DNA, 14 bp, Homo sapiens
tctcaacacccagt

SEQ ID NO: 2484367 - DNA, 15 bp, Homo sapiens
tctcaagctcttcct

SEQ ID NO: 2484368 - DNA, 14 bp, Homo sapiens
tctcaagttctaag

SEQ ID NO: 2484369 - DNA, 16 bp, Homo sapiens
tctcaagttctaagat

SEQ ID NO: 2484370 - DNA, 15 bp, Homo sapiens
tctcaattccaacag

SEQ ID NO: 2484371 - DNA, 16 bp, Homo sapiens
tctcaattccaacagt

SEQ ID NO: 2484372 - DNA, 23 bp, Homo sapiens
tctcaattccaacagtttaatga

SEQ ID NO: 2484373 - DNA, 19 bp, Homo sapiens
tctcacactggtctgctgt

SEQ ID NO: 2484374 - DNA, 17 bp, Homo sapiens
tctcaccaggcagcctc

SEQ ID NO: 2484375 - DNA, 18 bp, Homo sapiens
tctcaccaggcagcctct

SEQ ID NO: 2484376 - DNA, 19 bp, Homo sapiens
tctcaccaggcagcctctg

SEQ ID NO: 2484377 - DNA, 22 bp, Homo sapiens
tctcaccaggcagcctctgggg

SEQ ID NO: 2484378 - DNA, 15 bp, Homo sapiens
tctcaccccatccca

SEQ ID NO: 2484379 - DNA, 19 bp, Homo sapiens
tctcaccccatcccacacc

SEQ ID NO: 2484380 - DNA, 19 bp, Homo sapiens
tctcaccctggaggcacct

SEQ ID NO: 2484381 - DNA, 14 bp, Homo sapiens
tctcaccggctctc

SEQ ID NO: 2484382 - DNA, 18 bp, Homo sapiens
tctcaccggctctcacct

SEQ ID NO: 2484383 - DNA, 21 bp, Homo sapiens
tctcaccggctctcacctggc

SEQ ID NO: 2484384 - DNA, 12 bp, Homo sapiens
tctcacctggcc

SEQ ID NO: 2484385 - DNA, 21 bp, Homo sapiens
tctcacctggccctgcttcct

SEQ ID NO: 2484386 - DNA, 20 bp, Homo sapiens
tctcacggccacacagctgc

SEQ ID NO: 2484387 - DNA, 11 bp, Homo sapiens
tctcagaaagt

SEQ ID NO: 2484388 - DNA, 12 bp, Homo sapiens
tctcagaatccc

SEQ ID NO: 2484389 - DNA, 21 bp, Homo sapiens
tctcagaatcccttaacagtt

SEQ ID NO: 2484390 - DNA, 12 bp, Homo sapiens
tctcagccctca

SEQ ID NO: 2484391 - DNA, 15 bp, Homo sapiens
tctcagctaagctca

SEQ ID NO: 2484392 - DNA, 15 bp, Homo sapiens
tctcaggacacaggc

SEQ ID NO: 2484393 - DNA, 16 bp, Homo sapiens
tctcaggacacaggcc

SEQ ID NO: 2484394 - DNA, 20 bp, Homo sapiens
tctcaggacacaggcctgtg

SEQ ID NO: 2484395 - DNA, 16 bp, Homo sapiens
tctcaggctgcctgag

SEQ ID NO: 2484396 - DNA, 17 bp, Homo sapiens
tctcaggctgcctgagt

SEQ ID NO: 2484397 - DNA, 22 bp, Homo sapiens
tctcagtgttgagccttttccc

SEQ ID NO: 2484398 - DNA, 17 bp, Homo sapiens
tctcagtttgtgtgtct

SEQ ID NO: 2484399 - DNA, 14 bp, Homo sapiens
tctcatctcttcag

SEQ ID NO: 2484400 - DNA, 22 bp, Homo sapiens
tctcatctggggagcaggcagc

SEQ ID NO: 2484401 - DNA, 23 bp, Homo sapiens
tctcatgataccacctttactgt

SEQ ID NO: 2484402 - DNA, 18 bp, Homo sapiens
tctgaataaagtgtaaca

SEQ ID NO: 2484403 - DNA, 22 bp, Homo sapiens
tctgaatgcttctaagtaaata

SEQ ID NO: 2484404 - DNA, 15 bp, Homo sapiens
tctgaatttttaaac

SEQ ID NO: 2484405 - DNA, 22 bp, Homo sapiens
tctgacccagtgcccccactga

SEQ ID NO: 2484406 - DNA, 13 bp, Homo sapiens
tctgactcagggc

SEQ ID NO: 2484407 - DNA, 20 bp, Homo sapiens
tctgactcagggctcctggg

SEQ ID NO: 2484408 - DNA, 20 bp, Homo sapiens
tctgactcggtttctccaaa

SEQ ID NO: 2484409 - DNA, 15 bp, Homo sapiens
tctgacttctgcctg

SEQ ID NO: 2484410 - DNA, 17 bp, Homo sapiens
tctgacttctgcctgga

SEQ ID NO: 2484411 - DNA, 19 bp, Homo sapiens
tctgacttctgcctggaga

SEQ ID NO: 2484412 - DNA, 20 bp, Homo sapiens
tctgactttcttttttgata

SEQ ID NO: 2484413 - DNA, 23 bp, Homo sapiens
tctgactttcttttttgatatag

SEQ ID NO: 2484414 - DNA, 13 bp, Homo sapiens
tctgagaggccct

SEQ ID NO: 2484415 - DNA, 21 bp, Homo sapiens
tctgagagtctagattctctg

SEQ ID NO: 2484416 - DNA, 22 bp, Homo sapiens
tctgagagtctagattctctgg

SEQ ID NO: 2484417 - DNA, 22 bp, Homo sapiens
tctgagatggctcccaggggct

SEQ ID NO: 2484418 - DNA, 17 bp, Homo sapiens
tctgagcagcgagcctg

SEQ ID NO: 2484419 - DNA, 18 bp, Homo sapiens
tctgagcagcgagcctgc

SEQ ID NO: 2484420 - DNA, 19 bp, Homo sapiens
tctgagcagcgagcctgct

SEQ ID NO: 2484421 - DNA, 14 bp, Homo sapiens
tctgagcgcctcca

SEQ ID NO: 2484422 - DNA, 12 bp, Homo sapiens
tctgagctcctg

SEQ ID NO: 2484423 - DNA, 17 bp, Homo sapiens
tctgaggacaagagaaa

SEQ ID NO: 2484424 - DNA, 13 bp, Homo sapiens
tctgaggccagcc

SEQ ID NO: 2484425 - DNA, 20 bp, Homo sapiens
tctgaggccagcctggcctc

SEQ ID NO: 2484426 - DNA, 21 bp, Homo sapiens
tctgaggtcctgagcactgcc

SEQ ID NO: 2484427 - DNA, 23 bp, Homo sapiens
tctgagtgttttatgagaaagcc

SEQ ID NO: 2484428 - DNA, 20 bp, Homo sapiens
tctgagttttgtgtttgttg

SEQ ID NO: 2484429 - DNA, 21 bp, Homo sapiens
tctgatgaaaaattgctgact

SEQ ID NO: 2484430 - DNA, 16 bp, Homo sapiens
tctgatgcagcttata

SEQ ID NO: 2484431 - DNA, 24 bp, Homo sapiens
tctgcaaacaccaacatgttggga

SEQ ID NO: 2484432 - DNA, 16 bp, Homo sapiens
tctgcaattcaaaagt

SEQ ID NO: 2484433 - DNA, 18 bp, Homo sapiens
tctgcaattcccctctgc

SEQ ID NO: 2484434 - DNA, 21 bp, Homo sapiens
tctgcaattcccctctgctgc

SEQ ID NO: 2484435 - DNA, 22 bp, Homo sapiens
tctgcaattcccctctgctgct

SEQ ID NO: 2484436 - DNA, 22 bp, Homo sapiens
tctgcacatctgtaaatctaca

SEQ ID NO: 2484437 - DNA, 18 bp, Homo sapiens
tctgcactactgacatgt

SEQ ID NO: 2484438 - DNA, 21 bp, Homo sapiens
tctgcactcccacctgacaca

SEQ ID NO: 2484439 - DNA, 18 bp, Homo sapiens
tctgcagacttcccagct

SEQ ID NO: 2484440 - DNA, 16 bp, Homo sapiens
tctgcatatgttgaat

SEQ ID NO: 2484441 - DNA, 18 bp, Homo sapiens
tctgcatatgttgaatac

SEQ ID NO: 2484442 - DNA, 19 bp, Homo sapiens
tctgccaaaggatgtgata

SEQ ID NO: 2484443 - DNA, 17 bp, Homo sapiens
tctgccaacctaaaact

SEQ ID NO: 2484444 - DNA, 18 bp, Homo sapiens
tctgccaacctaaaactc

SEQ ID NO: 2484445 - DNA, 19 bp, Homo sapiens
tctgccagggcccctctcc

SEQ ID NO: 2484446 - DNA, 23 bp, Homo sapiens
tctgccagtgacagacaggctct

SEQ ID NO: 2484447 - DNA, 22 bp, Homo sapiens
tctgcccaggcactgctaggct

SEQ ID NO: 2484448 - DNA, 14 bp, Homo sapiens
tctgccccctgcag

SEQ ID NO: 2484449 - DNA, 16 bp, Homo sapiens
tctgccccctgcagaa

SEQ ID NO: 2484450 - DNA, 21 bp, Homo sapiens
tctgcctacagaacttcagaa

SEQ ID NO: 2484451 - DNA, 22 bp, Homo sapiens
tctgcctccccttaaaggggag

SEQ ID NO: 2484452 - DNA, 12 bp, Homo sapiens
tctgcctggagt

SEQ ID NO: 2484453 - DNA, 13 bp, Homo sapiens
tctgcctggagtg

SEQ ID NO: 2484454 - DNA, 21 bp, Homo sapiens
tctgcctggagtgtatgactg

SEQ ID NO: 2484455 - DNA, 15 bp, Homo sapiens
tctgccttagtctca

SEQ ID NO: 2484456 - DNA, 19 bp, Homo sapiens
tctgccttagtctcagttt

SEQ ID NO: 2484457 - DNA, 16 bp, Homo sapiens
tctgcgtgacaataaa

SEQ ID NO: 2484458 - DNA, 20 bp, Homo sapiens
tctgcgtgtcacctgtgctt

SEQ ID NO: 2484459 - DNA, 14 bp, Homo sapiens
tctgctcagctctg

SEQ ID NO: 2484460 - DNA, 16 bp, Homo sapiens
tctgctcagctctggg

SEQ ID NO: 2484461 - DNA, 12 bp, Homo sapiens
tctgctcatcat

SEQ ID NO: 2484462 - DNA, 15 bp, Homo sapiens
tctgctcatcattct

SEQ ID NO: 2484463 - DNA, 11 bp, Homo sapiens
tctgctcccaa

SEQ ID NO: 2484464 - DNA, 12 bp, Homo sapiens
tctgctcccaag

SEQ ID NO: 2484465 - DNA, 13 bp, Homo sapiens
tctgctcccaagg

SEQ ID NO: 2484466 - DNA, 19 bp, Homo sapiens
tctgctcccaaggggcctg

SEQ ID NO: 2484467 - DNA, 22 bp, Homo sapiens
tctgctcccaaggggcctgagc

SEQ ID NO: 2484468 - DNA, 23 bp, Homo sapiens
tctgctcccaaggggcctgagca

SEQ ID NO: 2484469 - DNA, 11 bp, Homo sapiens
tctgctctgat

SEQ ID NO: 2484470 - DNA, 20 bp, Homo sapiens
tctgctctttctctgccagt

SEQ ID NO: 2484471 - DNA, 15 bp, Homo sapiens
tctgctgacctgctg

SEQ ID NO: 2484472 - DNA, 20 bp, Homo sapiens
tctgctgacctgctgacctg

SEQ ID NO: 2484473 - DNA, 19 bp, Homo sapiens
tctgctgcctccctctgct

SEQ ID NO: 2484474 - DNA, 23 bp, Homo sapiens
tctgctggagtttcatgtacaag

SEQ ID NO: 2484475 - DNA, 19 bp, Homo sapiens
tctgctggcctctgcgagt

SEQ ID NO: 2484476 - DNA, 19 bp, Homo sapiens
tctgctggggcctgggaca

SEQ ID NO: 2484477 - DNA, 16 bp, Homo sapiens
tctgctgttccagtgg

SEQ ID NO: 2484478 - DNA, 14 bp, Homo sapiens
tctgcttctctgac

SEQ ID NO: 2484479 - DNA, 17 bp, Homo sapiens
tctgctttctcctttaa

SEQ ID NO: 2484480 - DNA, 13 bp, Homo sapiens
tctggaacccaga

SEQ ID NO: 2484481 - DNA, 14 bp, Homo sapiens
tctggaacccagac

SEQ ID NO: 2484482 - DNA, 16 bp, Homo sapiens
tctggaacccagactc

SEQ ID NO: 2484483 - DNA, 17 bp, Homo sapiens
tctggaacccagactca

SEQ ID NO: 2484484 - DNA, 15 bp, Homo sapiens
tctggaacctcagcc

SEQ ID NO: 2484485 - DNA, 16 bp, Homo sapiens
tctggaacctcagcct

SEQ ID NO: 2484486 - DNA, 18 bp, Homo sapiens
tctggaacctcagcctgg

SEQ ID NO: 2484487 - DNA, 23 bp, Homo sapiens
tctggaagatggggaccagcagc

SEQ ID NO: 2484488 - DNA, 15 bp, Homo sapiens
tctggaatgtaatca

SEQ ID NO: 2484489 - DNA, 18 bp, Homo sapiens
tctggaatgtaatcaatg

SEQ ID NO: 2484490 - DNA, 22 bp, Homo sapiens
tctggaatgtaatcaatgtttc

SEQ ID NO: 2484491 - DNA, 20 bp, Homo sapiens
tctggacagccccaccctgg

SEQ ID NO: 2484492 - DNA, 16 bp, Homo sapiens
tctggagaccaccagg

SEQ ID NO: 2484493 - DNA, 19 bp, Homo sapiens
tctggagaccaccagggca

SEQ ID NO: 2484494 - DNA, 22 bp, Homo sapiens
tctggagccagccgagcaggag

SEQ ID NO: 2484495 - DNA, 21 bp, Homo sapiens
tctggagttgatctggaaccc

SEQ ID NO: 2484496 - DNA, 12 bp, Homo sapiens
tctggcaaggac

SEQ ID NO: 2484497 - DNA, 20 bp, Homo sapiens
tctggcaatgccacagccct

SEQ ID NO: 2484498 - DNA, 21 bp, Homo sapiens
tctggcaatgccacagccctg

SEQ ID NO: 2484499 - DNA, 22 bp, Homo sapiens
tctggcagccacacttctcagg

SEQ ID NO: 2484500 - DNA, 14 bp, Homo sapiens
tctggcccaccagg

SEQ ID NO: 2484501 - DNA, 23 bp, Homo sapiens
tctggcccttgcttacctctcag

SEQ ID NO: 2484502 - DNA, 15 bp, Homo sapiens
tctggcctctgcttt

SEQ ID NO: 2484503 - DNA, 19 bp, Homo sapiens
tctggcctggccagtgccc

SEQ ID NO: 2484504 - DNA, 20 bp, Homo sapiens
tcttctggggcaggctgggc

SEQ ID NO: 2484505 - DNA, 21 bp, Homo sapiens
tcttgaatttaataatctgta

SEQ ID NO: 2484506 - DNA, 14 bp, Homo sapiens
tcttgagcagtggc

SEQ ID NO: 2484507 - DNA, 16 bp, Homo sapiens
tcttgagctctattat

SEQ ID NO: 2484508 - DNA, 13 bp, Homo sapiens
tcttgagtttgtc

SEQ ID NO: 2484509 - DNA, 12 bp, Homo sapiens
tcttgatgacca

SEQ ID NO: 2484510 - DNA, 22 bp, Homo sapiens
tcttgatgtaaaatcttgtcat

SEQ ID NO: 2484511 - DNA, 14 bp, Homo sapiens
tcttgattatccat

SEQ ID NO: 2484512 - DNA, 17 bp, Homo sapiens
tcttgcattatgcaatt

SEQ ID NO: 2484513 - DNA, 16 bp, Homo sapiens
tcttgcctcaacctcc

SEQ ID NO: 2484514 - DNA, 14 bp, Homo sapiens
tcttgcctctgtgc

SEQ ID NO: 2484515 - DNA, 20 bp, Homo sapiens
tcttgcctgccactgtgtga

SEQ ID NO: 2484516 - DNA, 16 bp, Homo sapiens
tcttgcctgtttccca

SEQ ID NO: 2484517 - DNA, 23 bp, Homo sapiens
tcttgcctgtttcccaggcccac

SEQ ID NO: 2484518 - DNA, 18 bp, Homo sapiens
tcttgcttccctaatcta

SEQ ID NO: 2484519 - DNA, 14 bp, Homo sapiens
tcttgctttctttg

SEQ ID NO: 2484520 - DNA, 16 bp, Homo sapiens
tcttggaacttgcctg

SEQ ID NO: 2484521 - DNA, 12 bp, Homo sapiens
tcttggagaagt

SEQ ID NO: 2484522 - DNA, 17 bp, Homo sapiens
tcttggagaagtctcag

SEQ ID NO: 2484523 - DNA, 19 bp, Homo sapiens
tcttggagaagtctcagct

SEQ ID NO: 2484524 - DNA, 14 bp, Homo sapiens
tcttggagctgtga

SEQ ID NO: 2484525 - DNA, 15 bp, Homo sapiens
tcttggagctgtgag

SEQ ID NO: 2484526 - DNA, 23 bp, Homo sapiens
tcttggagctgtgagttctccct

SEQ ID NO: 2484527 - DNA, 13 bp, Homo sapiens
tcttgggaactga

SEQ ID NO: 2484528 - DNA, 15 bp, Homo sapiens
tcttggttgaggaaa

SEQ ID NO: 2484529 - DNA, 13 bp, Homo sapiens
tcttgtaatttta

SEQ ID NO: 2484530 - DNA, 20 bp, Homo sapiens
tcttgtataagatcctagat

SEQ ID NO: 2484531 - DNA, 21 bp, Homo sapiens
tcttgtataagatcctagatc

SEQ ID NO: 2484532 - DNA, 15 bp, Homo sapiens
tcttgtatttattgg

SEQ ID NO: 2484533 - DNA, 22 bp, Homo sapiens
tcttgtatttattggttttgca

SEQ ID NO: 2484534 - DNA, 17 bp, Homo sapiens
tcttgtcatgtgtataa

SEQ ID NO: 2484535 - DNA, 13 bp, Homo sapiens
tcttgtcattttt

SEQ ID NO: 2484536 - DNA, 12 bp, Homo sapiens
tcttgtctataa

SEQ ID NO: 2484537 - DNA, 22 bp, Homo sapiens
tcttgtgcactggcaccaagtg

SEQ ID NO: 2484538 - DNA, 13 bp, Homo sapiens
tcttgttgagccg

SEQ ID NO: 2484539 - DNA, 16 bp, Homo sapiens
tcttgttggtgcacag

SEQ ID NO: 2484540 - DNA, 20 bp, Homo sapiens
tctttaaaatgtaaagccat

SEQ ID NO: 2484541 - DNA, 20 bp, Homo sapiens
tctttaactgccgtaattta

SEQ ID NO: 2484542 - DNA, 13 bp, Homo sapiens
tctttaattctgt

SEQ ID NO: 2484543 - DNA, 17 bp, Homo sapiens
tctttataagaaagcct

SEQ ID NO: 2484544 - DNA, 14 bp, Homo sapiens
tctttatacagctg

SEQ ID NO: 2484545 - DNA, 16 bp, Homo sapiens
tctttatacagctgta

SEQ ID NO: 2484546 - DNA, 23 bp, Homo sapiens
tctttattttaacctttgataga

SEQ ID NO: 2484547 - DNA, 20 bp, Homo sapiens
tctttcaaaaccttttgaaa

SEQ ID NO: 2484548 - DNA, 21 bp, Homo sapiens
tctttcaaaaccttttgaaat

SEQ ID NO: 2484549 - DNA, 21 bp, Homo sapiens
tctttcaagcagtcgtgcctg

SEQ ID NO: 2484550 - DNA, 19 bp, Homo sapiens
tctttcaatacagatatat

SEQ ID NO: 2484551 - DNA, 20 bp, Homo sapiens
tctttcaatacagatatatt

SEQ ID NO: 2484552 - DNA, 19 bp, Homo sapiens
tctttcacagctcctccca

SEQ ID NO: 2484553 - DNA, 15 bp, Homo sapiens
tctttcagctcctga

SEQ ID NO: 2484554 - DNA, 16 bp, Homo sapiens
tctttcatttcttcta

SEQ ID NO: 2484555 - DNA, 13 bp, Homo sapiens
tctttccatttgc

SEQ ID NO: 2484556 - DNA, 22 bp, Homo sapiens
tctttccatttgcatttgttta

SEQ ID NO: 2484557 - DNA, 14 bp, Homo sapiens
tctttccctggtcc

SEQ ID NO: 2484558 - DNA, 18 bp, Homo sapiens
tctttctcactaaatctt

SEQ ID NO: 2484559 - DNA, 13 bp, Homo sapiens
tctttctctgagg

SEQ ID NO: 2484560 - DNA, 13 bp, Homo sapiens
tctttctctgcca

SEQ ID NO: 2484561 - DNA, 17 bp, Homo sapiens
tctttctctttccctgg

SEQ ID NO: 2484562 - DNA, 15 bp, Homo sapiens
tctttgaaattatgt

SEQ ID NO: 2484563 - DNA, 20 bp, Homo sapiens
tctttgaataaatgtcactt

SEQ ID NO: 2484564 - DNA, 16 bp, Homo sapiens
tctttggaaagtacac

SEQ ID NO: 2484565 - DNA, 15 bp, Homo sapiens
tctttgggccagaca

SEQ ID NO: 2484566 - DNA, 21 bp, Homo sapiens
tctttggttctaaggacctga

SEQ ID NO: 2484567 - DNA, 16 bp, Homo sapiens
tctttgttcatagccc

SEQ ID NO: 2484568 - DNA, 12 bp, Homo sapiens
tcttttacaact

SEQ ID NO: 2484569 - DNA, 14 bp, Homo sapiens
tcttttataggatt

SEQ ID NO: 2484570 - DNA, 16 bp, Homo sapiens
tcttttcccatttatc

SEQ ID NO: 2484571 - DNA, 20 bp, Homo sapiens
tcttttcccatttatctaaa

SEQ ID NO: 2484572 - DNA, 23 bp, Homo sapiens
tcttttgccttttgcaaccagga

SEQ ID NO: 2484573 - DNA, 13 bp, Homo sapiens
tcttttgcttttg

SEQ ID NO: 2484574 - DNA, 19 bp, Homo sapiens
tcttttgcttttgcccatt

SEQ ID NO: 2484575 - DNA, 22 bp, Homo sapiens
tcttttggtaaagactggcttt

SEQ ID NO: 2484576 - DNA, 12 bp, Homo sapiens
tcttttgtatta

SEQ ID NO: 2484577 - DNA, 20 bp, Homo sapiens
tcttttgttcgcatggtcac

SEQ ID NO: 2484578 - DNA, 19 bp, Homo sapiens
tctttttgggagagacttg

SEQ ID NO: 2484579 - DNA, 20 bp, Homo sapiens
tctttttgtagctggggctt

SEQ ID NO: 2484580 - DNA, 13 bp, Homo sapiens
tcttttttcgttt

SEQ ID NO: 2484581 - DNA, 15 bp, Homo sapiens
tctttttttgtatag

SEQ ID NO: 2484582 - DNA, 20 bp, Homo sapiens
tcttttttttctatttcact

SEQ ID NO: 2484583 - DNA, 21 bp, Homo sapiens
tgaaaaaaaacctgagattta

SEQ ID NO: 2484584 - DNA, 16 bp, Homo sapiens
tgaaaaaaaataaatt

SEQ ID NO: 2484585 - DNA, 12 bp, Homo sapiens
tgaaaaaatata

SEQ ID NO: 2484586 - DNA, 13 bp, Homo sapiens
tgaaaaaatatat

SEQ ID NO: 2484587 - DNA, 13 bp, Homo sapiens
tgaaaaagaagaa

SEQ ID NO: 2484588 - DNA, 13 bp, Homo sapiens
tgaaaaagcgaaa

SEQ ID NO: 2484589 - DNA, 14 bp, Homo sapiens
tgaaaaattgctga

SEQ ID NO: 2484590 - DNA, 19 bp, Homo sapiens
tgaaaacacatttgctttt

SEQ ID NO: 2484591 - DNA, 18 bp, Homo sapiens
tgaaaacactgtgcacat

SEQ ID NO: 2484592 - DNA, 13 bp, Homo sapiens
tgaaaagaattgt

SEQ ID NO: 2484593 - DNA, 21 bp, Homo sapiens
tgaaaagtatattgataacct

SEQ ID NO: 2484594 - DNA, 17 bp, Homo sapiens
tgaaaagtgaagacaga

SEQ ID NO: 2484595 - DNA, 16 bp, Homo sapiens
tgaaaataagaataga

SEQ ID NO: 2484596 - DNA, 16 bp, Homo sapiens
tgaaaatataaccagc

SEQ ID NO: 2484597 - DNA, 13 bp, Homo sapiens
tgaaaatgctggc

SEQ ID NO: 2484598 - DNA, 16 bp, Homo sapiens
tgaaaatgtccaggaa

SEQ ID NO: 2484599 - DNA, 13 bp, Homo sapiens
tgaaaatgtcctt

SEQ ID NO: 2484600 - DNA, 18 bp, Homo sapiens
tgaaaatgtccttgtgat

SEQ ID NO: 2484601 - DNA, 14 bp, Homo sapiens
tgaaaatgtcttgt

SEQ ID NO: 2484602 - DNA, 17 bp, Homo sapiens
tgaaaattatttaaacc

SEQ ID NO: 2484603 - DNA, 17 bp, Homo sapiens
tgaaacaagaagccaca

SEQ ID NO: 2484604 - DNA, 12 bp, Homo sapiens
tgaaacagaaaa

SEQ ID NO: 2484605 - DNA, 20 bp, Homo sapiens
tgaaaccagtgttagggaag

SEQ ID NO: 2484606 - DNA, 19 bp, Homo sapiens
tgaaagaggctgaggcctg

SEQ ID NO: 2484607 - DNA, 12 bp, Homo sapiens
tgaaaggaaatt

SEQ ID NO: 2484608 - DNA, 19 bp, Homo sapiens
tgaaaggttagagaataaa

SEQ ID NO: 2484609 - DNA, 17 bp, Homo sapiens
tgaaaggttttttttca

SEQ ID NO: 2484610 - DNA, 16 bp, Homo sapiens
tgaatgtttttctaaa

SEQ ID NO: 2484611 - DNA, 17 bp, Homo sapiens
tgaatgtttttctaaag

SEQ ID NO: 2484612 - DNA, 18 bp, Homo sapiens
tgaattaagcccaattaa

SEQ ID NO: 2484613 - DNA, 16 bp, Homo sapiens
tgaattaatatcccta

SEQ ID NO: 2484614 - DNA, 19 bp, Homo sapiens
tgaattaatatccctacat

SEQ ID NO: 2484615 - DNA, 20 bp, Homo sapiens
tgaattaggctgtaactact

SEQ ID NO: 2484616 - DNA, 22 bp, Homo sapiens
tgaattaggctgtaactacttt

SEQ ID NO: 2484617 - DNA, 13 bp, Homo sapiens
tgaattccctcac

SEQ ID NO: 2484618 - DNA, 22 bp, Homo sapiens
tgaattccctcactcgtctccc

SEQ ID NO: 2484619 - DNA, 21 bp, Homo sapiens
tgaattcttggttgaggaaac

SEQ ID NO: 2484620 - DNA, 17 bp, Homo sapiens
tgaatttagtgagcata

SEQ ID NO: 2484621 - DNA, 21 bp, Homo sapiens
tgaatttagtgagcataggtg

SEQ ID NO: 2484622 - DNA, 12 bp, Homo sapiens
tctggctctaat

SEQ ID NO: 2484623 - DNA, 18 bp, Homo sapiens
tctggctggtagagcagg

SEQ ID NO: 2484624 - DNA, 12 bp, Homo sapiens
tctggctggtgt

SEQ ID NO: 2484625 - DNA, 20 bp, Homo sapiens
tctggctggtgttaacagaa

SEQ ID NO: 2484626 - DNA, 18 bp, Homo sapiens
tctggctgtaaggctcta

SEQ ID NO: 2484627 - DNA, 22 bp, Homo sapiens
tctggctgtaaggctctagatc

SEQ ID NO: 2484628 - DNA, 19 bp, Homo sapiens
tctggcttctggccaggaa

SEQ ID NO: 2484629 - DNA, 20 bp, Homo sapiens
tctggcttctggccaggaag

SEQ ID NO: 2484630 - DNA, 20 bp, Homo sapiens
tctggcttggccacagccag

SEQ ID NO: 2484631 - DNA, 21 bp, Homo sapiens
tctggcttggccacagccagg

SEQ ID NO: 2484632 - DNA, 21 bp, Homo sapiens
tctgggagggcagcagggcta

SEQ ID NO: 2484633 - DNA, 17 bp, Homo sapiens
tctgggagtcacacagt

SEQ ID NO: 2484634 - DNA, 14 bp, Homo sapiens
tctgggccttggcc

SEQ ID NO: 2484635 - DNA, 19 bp, Homo sapiens
tctgggccttggcctggag

SEQ ID NO: 2484636 - DNA, 21 bp, Homo sapiens
tctgggccttggcctggagca

SEQ ID NO: 2484637 - DNA, 21 bp, Homo sapiens
tctgggcttatatctggcctc

SEQ ID NO: 2484638 - DNA, 16 bp, Homo sapiens
tctgggcttcctggag

SEQ ID NO: 2484639 - DNA, 22 bp, Homo sapiens
tctggggagcaggcagccagca

SEQ ID NO: 2484640 - DNA, 19 bp, Homo sapiens
tctggggcaggctgggcca

SEQ ID NO: 2484641 - DNA, 19 bp, Homo sapiens
tctgggggcacaagactga

SEQ ID NO: 2484642 - DNA, 13 bp, Homo sapiens
tctggggggtggc

SEQ ID NO: 2484643 - DNA, 18 bp, Homo sapiens
tctgggtgctactgggga

SEQ ID NO: 2484644 - DNA, 14 bp, Homo sapiens
tctgggtggctcac

SEQ ID NO: 2484645 - DNA, 22 bp, Homo sapiens
tctgggtggctcactcagcact

SEQ ID NO: 2484646 - DNA, 16 bp, Homo sapiens
tctgggtggggcccag

SEQ ID NO: 2484647 - DNA, 21 bp, Homo sapiens
tctggtaatattgacttgtat

SEQ ID NO: 2484648 - DNA, 22 bp, Homo sapiens
tctggtaatattgacttgtata

SEQ ID NO: 2484649 - DNA, 21 bp, Homo sapiens
tctggtagaagggaaagccca

SEQ ID NO: 2484650 - DNA, 12 bp, Homo sapiens
tctggttccagg

SEQ ID NO: 2484651 - DNA, 17 bp, Homo sapiens
tctggttctcaattcca

SEQ ID NO: 2484652 - DNA, 17 bp, Homo sapiens
tctggttgtttctgttc

SEQ ID NO: 2484653 - DNA, 22 bp, Homo sapiens
tctgtaagaaacctactgccca

SEQ ID NO: 2484654 - DNA, 20 bp, Homo sapiens
tctgtaattcaggtttttcc

SEQ ID NO: 2484655 - DNA, 12 bp, Homo sapiens
tctgtaattgca

SEQ ID NO: 2484656 - DNA, 17 bp, Homo sapiens
tctgtaattgtgtgtga

SEQ ID NO: 2484657 - DNA, 22 bp, Homo sapiens
tctgtagggatttttggctaca

SEQ ID NO: 2484658 - DNA, 20 bp, Homo sapiens
tctgtaggttgcacactttg

SEQ ID NO: 2484659 - DNA, 21 bp, Homo sapiens
tctgtaggttgcacactttgg

SEQ ID NO: 2484660 - DNA, 13 bp, Homo sapiens
tctgtcagtcaca

SEQ ID NO: 2484661 - DNA, 17 bp, Homo sapiens
tctgtcagtcacagcca

SEQ ID NO: 2484662 - DNA, 21 bp, Homo sapiens
tctgtctcatccatcatcatg

SEQ ID NO: 2484663 - DNA, 21 bp, Homo sapiens
tctgtctcgagcgccctgcag

SEQ ID NO: 2484664 - DNA, 22 bp, Homo sapiens
tctgtctcgagcgccctgcaga

SEQ ID NO: 2484665 - DNA, 17 bp, Homo sapiens
tctgtctggtggccccg

SEQ ID NO: 2484666 - DNA, 14 bp, Homo sapiens
tctgtcttctggac

SEQ ID NO: 2484667 - DNA, 20 bp, Homo sapiens
tctgtgaaatgctggcattt

SEQ ID NO: 2484668 - DNA, 16 bp, Homo sapiens
tctgtgaccaatgtct

SEQ ID NO: 2484669 - DNA, 19 bp, Homo sapiens
tctgtgaccaatgtcttga

SEQ ID NO: 2484670 - DNA, 15 bp, Homo sapiens
tctgtgccagagcct

SEQ ID NO: 2484671 - DNA, 19 bp, Homo sapiens
tctgtgccagagcctgggg

SEQ ID NO: 2484672 - DNA, 22 bp, Homo sapiens
tctgtgccagagcctggggctc

SEQ ID NO: 2484673 - DNA, 18 bp, Homo sapiens
tctgtgccccttccgcca

SEQ ID NO: 2484674 - DNA, 20 bp, Homo sapiens
tctgtgccccttccgccact

SEQ ID NO: 2484675 - DNA, 17 bp, Homo sapiens
tctgtgccttgtttttt

SEQ ID NO: 2484676 - DNA, 13 bp, Homo sapiens
tctgtgctggcca

SEQ ID NO: 2484677 - DNA, 19 bp, Homo sapiens
tctgtggaggtggaaaagc

SEQ ID NO: 2484678 - DNA, 16 bp, Homo sapiens
tctgtgttgccaagct

SEQ ID NO: 2484679 - DNA, 16 bp, Homo sapiens
tctgttaactgaatac

SEQ ID NO: 2484680 - DNA, 12 bp, Homo sapiens
tctgttccaaat

SEQ ID NO: 2484681 - DNA, 13 bp, Homo sapiens
tctgttccaaatg

SEQ ID NO: 2484682 - DNA, 14 bp, Homo sapiens
tctgttccaaattc

SEQ ID NO: 2484683 - DNA, 19 bp, Homo sapiens
tctgttccaaattcagttt

SEQ ID NO: 2484684 - DNA, 22 bp, Homo sapiens
tctgttccaaattcagtttcat

SEQ ID NO: 2484685 - DNA, 23 bp, Homo sapiens
tctgttccaaattcagtttcata

SEQ ID NO: 2484686 - DNA, 18 bp, Homo sapiens
tctgttcttcctcagcca

SEQ ID NO: 2484687 - DNA, 15 bp, Homo sapiens
tctgttggcaggctg

SEQ ID NO: 2484688 - DNA, 14 bp, Homo sapiens
tctgttttacaagt

SEQ ID NO: 2484689 - DNA, 22 bp, Homo sapiens
tcttaaaaagttataaccaact

SEQ ID NO: 2484690 - DNA, 22 bp, Homo sapiens
tcttaaagtattcttctcttcc

SEQ ID NO: 2484691 - DNA, 18 bp, Homo sapiens
tcttaaataagaaacttt

SEQ ID NO: 2484692 - DNA, 12 bp, Homo sapiens
tcttaacttctt

SEQ ID NO: 2484693 - DNA, 12 bp, Homo sapiens
tcttaattatta

SEQ ID NO: 2484694 - DNA, 11 bp, Homo sapiens
tcttaattgcc

SEQ ID NO: 2484695 - DNA, 15 bp, Homo sapiens
tcttactatttcaca

SEQ ID NO: 2484696 - DNA, 12 bp, Homo sapiens
tcttactgcttg

SEQ ID NO: 2484697 - DNA, 21 bp, Homo sapiens
tcttagattctctgtgtctaa

SEQ ID NO: 2484698 - DNA, 16 bp, Homo sapiens
tcttagcagcttccag

SEQ ID NO: 2484699 - DNA, 15 bp, Homo sapiens
tcttagctcaatgag

SEQ ID NO: 2484700 - DNA, 22 bp, Homo sapiens
tcttagctcaatgagcatgttt

SEQ ID NO: 2484701 - DNA, 13 bp, Homo sapiens
tcttatagttcta

SEQ ID NO: 2484702 - DNA, 16 bp, Homo sapiens
tcttatcctccaccgt

SEQ ID NO: 2484703 - DNA, 15 bp, Homo sapiens
tcttatggaattgat

SEQ ID NO: 2484704 - DNA, 12 bp, Homo sapiens
tcttatggatgt

SEQ ID NO: 2484705 - DNA, 20 bp, Homo sapiens
tcttattcccttcctgccag

SEQ ID NO: 2484706 - DNA, 16 bp, Homo sapiens
tcttcaccaaatcttg

SEQ ID NO: 2484707 - DNA, 16 bp, Homo sapiens
tcttcaggttctcatg

SEQ ID NO: 2484708 - DNA, 15 bp, Homo sapiens
tcttcagttgtctct

SEQ ID NO: 2484709 - DNA, 13 bp, Homo sapiens
tcttccatttgca

SEQ ID NO: 2484710 - DNA, 18 bp, Homo sapiens
tcttccccctctcccagt

SEQ ID NO: 2484711 - DNA, 23 bp, Homo sapiens
tcttccggcccctcccctccaaa

SEQ ID NO: 2484712 - DNA, 20 bp, Homo sapiens
tcttcctaccaagtcaaact

SEQ ID NO: 2484713 - DNA, 21 bp, Homo sapiens
tcttcctaccaagtcaaactt

SEQ ID NO: 2484714 - DNA, 12 bp, Homo sapiens
tcttcctcagcc

SEQ ID NO: 2484715 - DNA, 15 bp, Homo sapiens
tcttcctcagccagc

SEQ ID NO: 2484716 - DNA, 16 bp, Homo sapiens
tcttcctcagccagcc

SEQ ID NO: 2484717 - DNA, 16 bp, Homo sapiens
tcttcctcttccccca

SEQ ID NO: 2484718 - DNA, 22 bp, Homo sapiens
tcttctaaacttccccatcttc

SEQ ID NO: 2484719 - DNA, 18 bp, Homo sapiens
tcttctacaactcataca

SEQ ID NO: 2484720 - DNA, 17 bp, Homo sapiens
tcttctcaagttctaag

SEQ ID NO: 2484721 - DNA, 18 bp, Homo sapiens
tcttctcaagttctaaga

SEQ ID NO: 2484722 - DNA, 19 bp, Homo sapiens
tcttctcaagttctaagat

SEQ ID NO: 2484723 - DNA, 22 bp, Homo sapiens
tgagaagtgaatgctgggactc

SEQ ID NO: 2484724 - DNA, 20 bp, Homo sapiens
tgagaatttgagtgctctga

SEQ ID NO: 2484725 - DNA, 14 bp, Homo sapiens
tgagaccactgtta

SEQ ID NO: 2484726 - DNA, 18 bp, Homo sapiens
tgagacccagccctcatc

SEQ ID NO: 2484727 - DNA, 17 bp, Homo sapiens
tgagactccagacctga

SEQ ID NO: 2484728 - DNA, 12 bp, Homo sapiens
tgagaggccctg

SEQ ID NO: 2484729 - DNA, 16 bp, Homo sapiens
tgagaggccctggatc

SEQ ID NO: 2484730 - DNA, 22 bp, Homo sapiens
tgagaggtttgactagatgatg

SEQ ID NO: 2484731 - DNA, 13 bp, Homo sapiens
tgagagtctagat

SEQ ID NO: 2484732 - DNA, 17 bp, Homo sapiens
tgagagtctagattctc

SEQ ID NO: 2484733 - DNA, 15 bp, Homo sapiens
tgagatacatacaga

SEQ ID NO: 2484734 - DNA, 21 bp, Homo sapiens
tgagataccagcgaggaggct

SEQ ID NO: 2484735 - DNA, 21 bp, Homo sapiens
tgagatagttttcatccataa

SEQ ID NO: 2484736 - DNA, 20 bp, Homo sapiens
tgagatgatacatccaaagc

SEQ ID NO: 2484737 - DNA, 12 bp, Homo sapiens
tgagatgctggc

SEQ ID NO: 2484738 - DNA, 18 bp, Homo sapiens
tgagatggagtcttgctc

SEQ ID NO: 2484739 - DNA, 22 bp, Homo sapiens
tgagatgggcttcccaagggct

SEQ ID NO: 2484740 - DNA, 16 bp, Homo sapiens
tgagatggtgaggctg

SEQ ID NO: 2484741 - DNA, 16 bp, Homo sapiens
tgagattacaggcatg

SEQ ID NO: 2484742 - DNA, 16 bp, Homo sapiens
tgagatttattaaaga

SEQ ID NO: 2484743 - DNA, 21 bp, Homo sapiens
tgagatttattaaagaaaaaa

SEQ ID NO: 2484744 - DNA, 18 bp, Homo sapiens
tgagcaactcttgattat

SEQ ID NO: 2484745 - DNA, 17 bp, Homo sapiens
tgagcacagcctagggc

SEQ ID NO: 2484746 - DNA, 18 bp, Homo sapiens
tgagcactgccaggaggg

SEQ ID NO: 2484747 - DNA, 22 bp, Homo sapiens
tgagcactgccaggagggacaa

SEQ ID NO: 2484748 - DNA, 22 bp, Homo sapiens
tgagcactgtttatacactgtg

SEQ ID NO: 2484749 - DNA, 17 bp, Homo sapiens
tgagcagcgagcctgct

SEQ ID NO: 2484750 - DNA, 20 bp, Homo sapiens
tgagcagggccggggaactg

SEQ ID NO: 2484751 - DNA, 20 bp, Homo sapiens
tgagcagtccttggcctgct

SEQ ID NO: 2484752 - DNA, 13 bp, Homo sapiens
tgagcataggtga

SEQ ID NO: 2484753 - DNA, 16 bp, Homo sapiens
tgagcatctgtccccc

SEQ ID NO: 2484754 - DNA, 14 bp, Homo sapiens
tgagcatgtttaga

SEQ ID NO: 2484755 - DNA, 23 bp, Homo sapiens
tgagcatgtttagactttaacat

SEQ ID NO: 2484756 - DNA, 17 bp, Homo sapiens
tgagcccagctgggtca

SEQ ID NO: 2484757 - DNA, 13 bp, Homo sapiens
tgagcccagggag

SEQ ID NO: 2484758 - DNA, 13 bp, Homo sapiens
tgagcctgccgag

SEQ ID NO: 2484759 - DNA, 16 bp, Homo sapiens
tgagccttttccctct

SEQ ID NO: 2484760 - DNA, 21 bp, Homo sapiens
tgagcgagtggagtctgccac

SEQ ID NO: 2484761 - DNA, 12 bp, Homo sapiens
tgagcgccagga

SEQ ID NO: 2484762 - DNA, 20 bp, Homo sapiens
tgagcgcctccatccaaggc

SEQ ID NO: 2484763 - DNA, 23 bp, Homo sapiens
tgagcgcctccatccaaggccag

SEQ ID NO: 2484764 - DNA, 16 bp, Homo sapiens
tgagctagaaccctct

SEQ ID NO: 2484765 - DNA, 16 bp, Homo sapiens
tgagctattgctgttc

SEQ ID NO: 2484766 - DNA, 19 bp, Homo sapiens
tgagctcacaaggcagcaa

SEQ ID NO: 2484767 - DNA, 23 bp, Homo sapiens
tgagctcacaaggcagcaaggcc

SEQ ID NO: 2484768 - DNA, 23 bp, Homo sapiens
tgagctcagaaaatatccctcct

SEQ ID NO: 2484769 - DNA, 18 bp, Homo sapiens
tgagctcccacaagcctg

SEQ ID NO: 2484770 - DNA, 17 bp, Homo sapiens
tgagctctgagaggccc

SEQ ID NO: 2484771 - DNA, 21 bp, Homo sapiens
tgagctctgagaggccctgga

SEQ ID NO: 2484772 - DNA, 22 bp, Homo sapiens
tgagctctgagaggccctggat

SEQ ID NO: 2484773 - DNA, 22 bp, Homo sapiens
tgagctggggacctggtaccct

SEQ ID NO: 2484774 - DNA, 17 bp, Homo sapiens
tgagcttaaaatacaag

SEQ ID NO: 2484775 - DNA, 17 bp, Homo sapiens
tgagctttctgaacagc

SEQ ID NO: 2484776 - DNA, 18 bp, Homo sapiens
tgagctttctgaacagct

SEQ ID NO: 2484777 - DNA, 19 bp, Homo sapiens
tgagctttctgaacagctg

SEQ ID NO: 2484778 - DNA, 22 bp, Homo sapiens
tgagctttctgaacagctggtg

SEQ ID NO: 2484779 - DNA, 18 bp, Homo sapiens
tgaggaaagcaagaatca

SEQ ID NO: 2484780 - DNA, 15 bp, Homo sapiens
tgaggacagatgcct

SEQ ID NO: 2484781 - DNA, 18 bp, Homo sapiens
tgaggacagatgcctcct

SEQ ID NO: 2484782 - DNA, 20 bp, Homo sapiens
tgaggacagatgcctccttc

SEQ ID NO: 2484783 - DNA, 17 bp, Homo sapiens
tgaggactgatttcaga

SEQ ID NO: 2484784 - DNA, 18 bp, Homo sapiens
tgaggagattctgccttt

SEQ ID NO: 2484785 - DNA, 16 bp, Homo sapiens
tgaggagccccagcta

SEQ ID NO: 2484786 - DNA, 13 bp, Homo sapiens
tgaggagctgggg

SEQ ID NO: 2484787 - DNA, 16 bp, Homo sapiens
tgaggagcttgaaacc

SEQ ID NO: 2484788 - DNA, 14 bp, Homo sapiens
tgaggagtctgagg

SEQ ID NO: 2484789 - DNA, 22 bp, Homo sapiens
tgaggatgtaaagatcaataaa

SEQ ID NO: 2484790 - DNA, 14 bp, Homo sapiens
tgaggcaaaagaag

SEQ ID NO: 2484791 - DNA, 23 bp, Homo sapiens
tgaggccacactcagcacaaggc

SEQ ID NO: 2484792 - DNA, 16 bp, Homo sapiens
tgaggccagggcagag

SEQ ID NO: 2484793 - DNA, 23 bp, Homo sapiens
tgaggccatggactctgtcctga

SEQ ID NO: 2484794 - DNA, 19 bp, Homo sapiens
tgaggccctccacacctgc

SEQ ID NO: 2484795 - DNA, 22 bp, Homo sapiens
tgaggccctccacacctgcggc

SEQ ID NO: 2484796 - DNA, 12 bp, Homo sapiens
tgaggcctgggc

SEQ ID NO: 2484797 - DNA, 22 bp, Homo sapiens
tgaggcctgggccgctgccacg

SEQ ID NO: 2484798 - DNA, 23 bp, Homo sapiens
tgaggcgccccaacccgtggagg

SEQ ID NO: 2484799 - DNA, 12 bp, Homo sapiens
tgaggctgtcct

SEQ ID NO: 2484800 - DNA, 14 bp, Homo sapiens
tgaggctgtcctgt

SEQ ID NO: 2484801 - DNA, 11 bp, Homo sapiens
tgaggctgtgg

SEQ ID NO: 2484802 - DNA, 14 bp, Homo sapiens
tgaggctttccatg

SEQ ID NO: 2484803 - DNA, 19 bp, Homo sapiens
tgaggctttccatgggacc

SEQ ID NO: 2484804 - DNA, 15 bp, Homo sapiens
tgagggcagcagcca

SEQ ID NO: 2484805 - DNA, 16 bp, Homo sapiens
tgagggcagcagccag

SEQ ID NO: 2484806 - DNA, 23 bp, Homo sapiens
tgagggcagcagccagccctgcc

SEQ ID NO: 2484807 - DNA, 23 bp, Homo sapiens
ggctggacccagccaggcccagc

SEQ ID NO: 2484808 - DNA, 15 bp, Homo sapiens
ggctggaggagccca

SEQ ID NO: 2484809 - DNA, 16 bp, Homo sapiens
ggctggaggagcccag

SEQ ID NO: 2484810 - DNA, 15 bp, Homo sapiens
ggctggaggcccagg

SEQ ID NO: 2484811 - DNA, 14 bp, Homo sapiens
ggctggatgagctc

SEQ ID NO: 2484812 - DNA, 18 bp, Homo sapiens
ggctggatgagctcccac

SEQ ID NO: 2484813 - DNA, 13 bp, Homo sapiens
ggctggcacagga

SEQ ID NO: 2484814 - DNA, 14 bp, Homo sapiens
ggctggcacaggac

SEQ ID NO: 2484815 - DNA, 19 bp, Homo sapiens
ggctggccatggagaaagc

SEQ ID NO: 2484816 - DNA, 23 bp, Homo sapiens
ggctggcctcacccacccctgca

SEQ ID NO: 2484817 - DNA, 15 bp, Homo sapiens
ggctggctggcctca

SEQ ID NO: 2484818 - DNA, 11 bp, Homo sapiens
ggctgggccat

SEQ ID NO: 2484819 - DNA, 17 bp, Homo sapiens
ggctggggtcccagcag

SEQ ID NO: 2484820 - DNA, 21 bp, Homo sapiens
ggctggggtcccagcagctgc

SEQ ID NO: 2484821 - DNA, 16 bp, Homo sapiens
ggctggtatctcagaa

SEQ ID NO: 2484822 - DNA, 20 bp, Homo sapiens
ggctggtgggctggccgctg

SEQ ID NO: 2484823 - DNA, 17 bp, Homo sapiens
ggctggtgtggtacaga

SEQ ID NO: 2484824 - DNA, 18 bp, Homo sapiens
ggctggtgtggtacagag

SEQ ID NO: 2484825 - DNA, 21 bp, Homo sapiens
ggctggtgttaacagaaggga

SEQ ID NO: 2484826 - DNA, 17 bp, Homo sapiens
ggctgtaactgccaggc

SEQ ID NO: 2484827 - DNA, 18 bp, Homo sapiens
ggctgtaactgccaggct

SEQ ID NO: 2484828 - DNA, 17 bp, Homo sapiens
ggctgtcccggaggcgg

SEQ ID NO: 2484829 - DNA, 22 bp, Homo sapiens
ggctgtgcagtcctgggtcctc

SEQ ID NO: 2484830 - DNA, 23 bp, Homo sapiens
ggctgtggaccatggagtggcag

SEQ ID NO: 2484831 - DNA, 20 bp, Homo sapiens
ggctgtgtaagatttgtttt

SEQ ID NO: 2484832 - DNA, 22 bp, Homo sapiens
ggctgtgtaagatttgttttta

SEQ ID NO: 2484833 - DNA, 18 bp, Homo sapiens
ggctgtgtttccatctca

SEQ ID NO: 2484834 - DNA, 18 bp, Homo sapiens
ggcttatatctggcctct

SEQ ID NO: 2484835 - DNA, 13 bp, Homo sapiens
ggcttcaggtcca

SEQ ID NO: 2484836 - DNA, 16 bp, Homo sapiens
ggcttcaggtccaggc

SEQ ID NO: 2484837 - DNA, 12 bp, Homo sapiens
ggcttcctggag

SEQ ID NO: 2484838 - DNA, 13 bp, Homo sapiens
ggcttcctggagc

SEQ ID NO: 2484839 - DNA, 13 bp, Homo sapiens
ggcttcctggtgc

SEQ ID NO: 2484840 - DNA, 20 bp, Homo sapiens
ggcttctgctggggcctggg

SEQ ID NO: 2484841 - DNA, 20 bp, Homo sapiens
ggcttgagcccccgcgccca

SEQ ID NO: 2484842 - DNA, 12 bp, Homo sapiens
ggcttgggattt

SEQ ID NO: 2484843 - DNA, 22 bp, Homo sapiens
ggcttggggctcacacacctgt

SEQ ID NO: 2484844 - DNA, 14 bp, Homo sapiens
ggcttgtggggcct

SEQ ID NO: 2484845 - DNA, 19 bp, Homo sapiens
ggctttcattttctctcag

SEQ ID NO: 2484846 - DNA, 14 bp, Homo sapiens
gggaaacttggctc

SEQ ID NO: 2484847 - DNA, 16 bp, Homo sapiens
gggaaagcccctgccc

SEQ ID NO: 2484848 - DNA, 14 bp, Homo sapiens
gggaacaatttggc

SEQ ID NO: 2484849 - DNA, 22 bp, Homo sapiens
gggaacactggggacttggcct

SEQ ID NO: 2484850 - DNA, 16 bp, Homo sapiens
gggaacatggggagga

SEQ ID NO: 2484851 - DNA, 19 bp, Homo sapiens
gggaaccctgcccactccc

SEQ ID NO: 2484852 - DNA, 16 bp, Homo sapiens
gggaactcagatccag

SEQ ID NO: 2484853 - DNA, 18 bp, Homo sapiens
gggaactggccaagctga

SEQ ID NO: 2484854 - DNA, 14 bp, Homo sapiens
gggaagacagtggc

SEQ ID NO: 2484855 - DNA, 22 bp, Homo sapiens
gggaagacccattccttcccag

SEQ ID NO: 2484856 - DNA, 12 bp, Homo sapiens
gggaagaggcct

SEQ ID NO: 2484857 - DNA, 18 bp, Homo sapiens
gggaagcccatcctgacc

SEQ ID NO: 2484858 - DNA, 19 bp, Homo sapiens
gggaagcccatcctgacca

SEQ ID NO: 2484859 - DNA, 21 bp, Homo sapiens
gggaaggattctgctggcctc

SEQ ID NO: 2484860 - DNA, 14 bp, Homo sapiens
gggaaggcaggcag

SEQ ID NO: 2484861 - DNA, 14 bp, Homo sapiens
gggaagggacacac

SEQ ID NO: 2484862 - DNA, 14 bp, Homo sapiens
gggaagggagccaa

SEQ ID NO: 2484863 - DNA, 21 bp, Homo sapiens
gggaagggagccaagggatgg

SEQ ID NO: 2484864 - DNA, 16 bp, Homo sapiens
gggaagggcctgccca

SEQ ID NO: 2484865 - DNA, 12 bp, Homo sapiens
gggagggctctg

SEQ ID NO: 2484866 - DNA, 16 bp, Homo sapiens
gggagggctctgaggc

SEQ ID NO: 2484867 - DNA, 20 bp, Homo sapiens
gggagggctctgaggcgccc

SEQ ID NO: 2484868 - DNA, 13 bp, Homo sapiens
gggagggggcaga

SEQ ID NO: 2484869 - DNA, 15 bp, Homo sapiens
gggagggggcagaag

SEQ ID NO: 2484870 - DNA, 16 bp, Homo sapiens
gggagggtaggcagga

SEQ ID NO: 2484871 - DNA, 14 bp, Homo sapiens
gggaggtcattttg

SEQ ID NO: 2484872 - DNA, 14 bp, Homo sapiens
gggagtctgccagg

SEQ ID NO: 2484873 - DNA, 17 bp, Homo sapiens
gggagtctgccagggcc

SEQ ID NO: 2484874 - DNA, 12 bp, Homo sapiens
gggagtgttccc

SEQ ID NO: 2484875 - DNA, 17 bp, Homo sapiens
gggagttaagacctggc

SEQ ID NO: 2484876 - DNA, 16 bp, Homo sapiens
gggatggacatcttgt

SEQ ID NO: 2484877 - DNA, 21 bp, Homo sapiens
gggattcaggaaaaggcctgg

SEQ ID NO: 2484878 - DNA, 17 bp, Homo sapiens
gggcacaggagctacct

SEQ ID NO: 2484879 - DNA, 18 bp, Homo sapiens
gggcacccccagcctggg

SEQ ID NO: 2484880 - DNA, 19 bp, Homo sapiens
gggcagagctggctctgag

SEQ ID NO: 2484881 - DNA, 16 bp, Homo sapiens
gggcagagctggtgcg

SEQ ID NO: 2484882 - DNA, 15 bp, Homo sapiens
gggcagcagccagcc

SEQ ID NO: 2484883 - DNA, 22 bp, Homo sapiens
gggcagcagccagccctgcctg

SEQ ID NO: 2484884 - DNA, 11 bp, Homo sapiens
gggcagccagg

SEQ ID NO: 2484885 - DNA, 22 bp, Homo sapiens
gggcagccagggagagcccagg

SEQ ID NO: 2484886 - DNA, 13 bp, Homo sapiens
gggcagcgccagg

SEQ ID NO: 2484887 - DNA, 20 bp, Homo sapiens
gggcaggagtagctgagctc

SEQ ID NO: 2484888 - DNA, 14 bp, Homo sapiens
gggcaggctgggcc

SEQ ID NO: 2484889 - DNA, 23 bp, Homo sapiens
gggcagttcgcagccaccctgag

SEQ ID NO: 2484890 - DNA, 15 bp, Homo sapiens
gggcatctctgggct

SEQ ID NO: 2484891 - DNA, 17 bp, Homo sapiens
gggcatctctgggctgg

SEQ ID NO: 2484892 - DNA, 22 bp, Homo sapiens
gggcatctctgggctggatgag

SEQ ID NO: 2484893 - DNA, 21 bp, Homo sapiens
gggcatctggcctggccagtg

SEQ ID NO: 2484894 - DNA, 16 bp, Homo sapiens
gggcatggcgtggagg

SEQ ID NO: 2484895 - DNA, 13 bp, Homo sapiens
gggccaagcccag

SEQ ID NO: 2484896 - DNA, 19 bp, Homo sapiens
gggccacatgggaggctca

SEQ ID NO: 2484897 - DNA, 17 bp, Homo sapiens
gggccactccttcctgc

SEQ ID NO: 2484898 - DNA, 20 bp, Homo sapiens
gggccactccttcctgcccc

SEQ ID NO: 2484899 - DNA, 21 bp, Homo sapiens
gggccactccttcctgcccca

SEQ ID NO: 2484900 - DNA, 14 bp, Homo sapiens
gggccagagccagg

SEQ ID NO: 2484901 - DNA, 14 bp, Homo sapiens
gggccagatccagc

SEQ ID NO: 2484902 - DNA, 11 bp, Homo sapiens
gggccagcctc

SEQ ID NO: 2484903 - DNA, 22 bp, Homo sapiens
gggccatgatggcaacagatct

SEQ ID NO: 2484904 - DNA, 14 bp, Homo sapiens
gggccatgctgagg

SEQ ID NO: 2484905 - DNA, 15 bp, Homo sapiens
gggccatgctgaggc

SEQ ID NO: 2484906 - DNA, 16 bp, Homo sapiens
gggccatgtccaaaga

SEQ ID NO: 2484907 - DNA, 18 bp, Homo sapiens
gggccattctccacagca

SEQ ID NO: 2484908 - DNA, 13 bp, Homo sapiens
gggcccacacctc

SEQ ID NO: 2484909 - DNA, 15 bp, Homo sapiens
gggcccagagcccag

SEQ ID NO: 2484910 - DNA, 16 bp, Homo sapiens
gggcccagagcccagc

SEQ ID NO: 2484911 - DNA, 17 bp, Homo sapiens
gggcccagagcccagct

SEQ ID NO: 2484912 - DNA, 14 bp, Homo sapiens
gggcccccatctca

SEQ ID NO: 2484913 - DNA, 19 bp, Homo sapiens
gggcccctcaccctgcctt

SEQ ID NO: 2484914 - DNA, 12 bp, Homo sapiens
gggcccctctcc

SEQ ID NO: 2484915 - DNA, 13 bp, Homo sapiens
gggccctgggctg

SEQ ID NO: 2484916 - DNA, 15 bp, Homo sapiens
gggccctggggcctg

SEQ ID NO: 2484917 - DNA, 17 bp, Homo sapiens
gggccctggggcctgta

SEQ ID NO: 2484918 - DNA, 17 bp, Homo sapiens
gggccctttgagtgcag

SEQ ID NO: 2484919 - DNA, 20 bp, Homo sapiens
gggccggggaactggccaag

SEQ ID NO: 2484920 - DNA, 14 bp, Homo sapiens
gggcctatggagag

SEQ ID NO: 2484921 - DNA, 20 bp, Homo sapiens
gggcctccatgggccccagg

SEQ ID NO: 2484922 - DNA, 12 bp, Homo sapiens
gggcctgagcag

SEQ ID NO: 2484923 - DNA, 20 bp, Homo sapiens
gggcctgagcagtccttggc

SEQ ID NO: 2484924 - DNA, 11 bp, Homo sapiens
gggcctgccac

SEQ ID NO: 2484925 - DNA, 14 bp, Homo sapiens
gggcctgcctcacc

SEQ ID NO: 2484926 - DNA, 15 bp, Homo sapiens
gggcctgcctcacca

SEQ ID NO: 2484927 - DNA, 13 bp, Homo sapiens
gggcctgctccag

SEQ ID NO: 2484928 - DNA, 15 bp, Homo sapiens
gggcctgctccagac

SEQ ID NO: 2484929 - DNA, 16 bp, Homo sapiens
gggcctgctgctgaga

SEQ ID NO: 2484930 - DNA, 17 bp, Homo sapiens
gggcctgctgctgagaa

SEQ ID NO: 2484931 - DNA, 13 bp, Homo sapiens
gggcctggctggc

SEQ ID NO: 2484932 - DNA, 16 bp, Homo sapiens
gggcctggctggctga

SEQ ID NO: 2484933 - DNA, 16 bp, Homo sapiens
gggcctgggctcctgg

SEQ ID NO: 2484934 - DNA, 17 bp, Homo sapiens
gggcctgggctcctgga

SEQ ID NO: 2484935 - DNA, 21 bp, Homo sapiens
gggcctggtctcaccctggag

SEQ ID NO: 2484936 - DNA, 23 bp, Homo sapiens
gggcctggtctcaccctggaggc

SEQ ID NO: 2484937 - DNA, 23 bp, Homo sapiens
gggcctggttaaataaggcaggg

SEQ ID NO: 2484938 - DNA, 15 bp, Homo sapiens
gggcctgtactgcct

SEQ ID NO: 2484939 - DNA, 13 bp, Homo sapiens
gggccttgggctc

SEQ ID NO: 2484940 - DNA, 13 bp, Homo sapiens
gggcgcctgtggt

SEQ ID NO: 2484941 - DNA, 14 bp, Homo sapiens
gggcgggggtggcg

SEQ ID NO: 2484942 - DNA, 22 bp, Homo sapiens
gggcgggtacagcgcggaggag

SEQ ID NO: 2484943 - DNA, 13 bp, Homo sapiens
gggctaatttaac

SEQ ID NO: 2484944 - DNA, 16 bp, Homo sapiens
gggctaccctgagctg

SEQ ID NO: 2484945 - DNA, 20 bp, Homo sapiens
gggctaccctgagctgaggc

SEQ ID NO: 2484946 - DNA, 22 bp, Homo sapiens
gggctaccctgagctgaggcag

SEQ ID NO: 2484947 - DNA, 14 bp, Homo sapiens
gggctcacacacct

SEQ ID NO: 2484948 - DNA, 23 bp, Homo sapiens
gggctccctccgcccccaggtag

SEQ ID NO: 2484949 - DNA, 17 bp, Homo sapiens
gggctccgtgtgggaga

SEQ ID NO: 2484950 - DNA, 22 bp, Homo sapiens
gggctcctgcacttacttgctt

SEQ ID NO: 2484951 - DNA, 18 bp, Homo sapiens
gggctcgaggggtgggct

SEQ ID NO: 2484952 - DNA, 20 bp, Homo sapiens
gggctctaacgcctgagccc

SEQ ID NO: 2484953 - DNA, 10 bp, Homo sapiens
gggctctgat

SEQ ID NO: 2484954 - DNA, 20 bp, Homo sapiens
gggctctgcaattcccctct

SEQ ID NO: 2484955 - DNA, 23 bp, Homo sapiens
gggctctgcaattcccctctgct

SEQ ID NO: 2484956 - DNA, 21 bp, Homo sapiens
gggctgctgctgggctcagtg

SEQ ID NO: 2484957 - DNA, 16 bp, Homo sapiens
gggctggaggagccca

SEQ ID NO: 2484958 - DNA, 18 bp, Homo sapiens
gggctggatgagctccca

SEQ ID NO: 2484959 - DNA, 14 bp, Homo sapiens
gggctggccgctgt

SEQ ID NO: 2484960 - DNA, 23 bp, Homo sapiens
gggctggccgctgtgccaggcga

SEQ ID NO: 2484961 - DNA, 13 bp, Homo sapiens
gggctgggaagtc

SEQ ID NO: 2484962 - DNA, 14 bp, Homo sapiens
gggctggttctgta

SEQ ID NO: 2484963 - DNA, 23 bp, Homo sapiens
gggctggttctgtaattgtgtgt

SEQ ID NO: 2484964 - DNA, 16 bp, Homo sapiens
gggctgtaactgccag

SEQ ID NO: 2484965 - DNA, 14 bp, Homo sapiens
gggcttcctggagc

SEQ ID NO: 2484966 - DNA, 16 bp, Homo sapiens
gggcttcctggagcag

SEQ ID NO: 2484967 - DNA, 15 bp, Homo sapiens
gggcttgggcctagg

SEQ ID NO: 2484968 - DNA, 21 bp, Homo sapiens
ggggaactggccaagctgagg

SEQ ID NO: 2484969 - DNA, 12 bp, Homo sapiens
ggggaagacagt

SEQ ID NO: 2484970 - DNA, 18 bp, Homo sapiens
ggtgtgatcgtctgactg

SEQ ID NO: 2484971 - DNA, 16 bp, Homo sapiens
ggtgtgcaccagggtt

SEQ ID NO: 2484972 - DNA, 22 bp, Homo sapiens
ggtgtgctgggagctccactct

SEQ ID NO: 2484973 - DNA, 16 bp, Homo sapiens
ggtgtggagccgaggc

SEQ ID NO: 2484974 - DNA, 12 bp, Homo sapiens
ggtgtggctcct

SEQ ID NO: 2484975 - DNA, 15 bp, Homo sapiens
ggtgtggtacagaga

SEQ ID NO: 2484976 - DNA, 21 bp, Homo sapiens
ggtgtggtacagagaagccag

SEQ ID NO: 2484977 - DNA, 23 bp, Homo sapiens
ggtgtgtccccctctgtccaggc

SEQ ID NO: 2484978 - DNA, 20 bp, Homo sapiens
ggttagacctacagggggtc

SEQ ID NO: 2484979 - DNA, 22 bp, Homo sapiens
ggttcacaaacttcatttcaga

SEQ ID NO: 2484980 - DNA, 18 bp, Homo sapiens
ggttcagaattaaacttt

SEQ ID NO: 2484981 - DNA, 13 bp, Homo sapiens
ggttcaggcccgg

SEQ ID NO: 2484982 - DNA, 12 bp, Homo sapiens
ggttccacagac

SEQ ID NO: 2484983 - DNA, 15 bp, Homo sapiens
ggttccgcttggagc

SEQ ID NO: 2484984 - DNA, 22 bp, Homo sapiens
ggttccgcttggagcagagggg

SEQ ID NO: 2484985 - DNA, 18 bp, Homo sapiens
ggttcctcccctccagct

SEQ ID NO: 2484986 - DNA, 14 bp, Homo sapiens
ggttctaaaaggtg

SEQ ID NO: 2484987 - DNA, 13 bp, Homo sapiens
ggttctaaagttc

SEQ ID NO: 2484988 - DNA, 15 bp, Homo sapiens
ggttctaaagttcta

SEQ ID NO: 2484989 - DNA, 23 bp, Homo sapiens
ggttctaaggcctaggattctaa

SEQ ID NO: 2484990 - DNA, 22 bp, Homo sapiens
ggttctcaattccaacagttta

SEQ ID NO: 2484991 - DNA, 18 bp, Homo sapiens
ggttctgagatggctccc

SEQ ID NO: 2484992 - DNA, 20 bp, Homo sapiens
ggttctgcctgccagctgca

SEQ ID NO: 2484993 - DNA, 19 bp, Homo sapiens
ggttcttgaggggaccagg

SEQ ID NO: 2484994 - DNA, 21 bp, Homo sapiens
ggttcttgaggggaccaggag

SEQ ID NO: 2484995 - DNA, 18 bp, Homo sapiens
ggttctttcatttgcttt

SEQ ID NO: 2484996 - DNA, 16 bp, Homo sapiens
ggttgaactctggtgg

SEQ ID NO: 2484997 - DNA, 16 bp, Homo sapiens
ggttggctctgccagt

SEQ ID NO: 2484998 - DNA, 13 bp, Homo sapiens
ggttggtagggtg

SEQ ID NO: 2484999 - DNA, 15 bp, Homo sapiens
ggtttaaagagtcta

SEQ ID NO: 2485000 - DNA, 12 bp, Homo sapiens
ggtttaaatgaa

SEQ ID NO: 2485001 - DNA, 17 bp, Homo sapiens
ggtttaaatgaacaaga

SEQ ID NO: 2485002 - DNA, 17 bp, Homo sapiens
ggtttaagaaatagaat

SEQ ID NO: 2485003 - DNA, 13 bp, Homo sapiens
ggtttaatgtttt

SEQ ID NO: 2485004 - DNA, 19 bp, Homo sapiens
ggtttaatgttttggccaa

SEQ ID NO: 2485005 - DNA, 17 bp, Homo sapiens
ggtttcagcactagcca

SEQ ID NO: 2485006 - DNA, 19 bp, Homo sapiens
ggtttccctactgaagccc

SEQ ID NO: 2485007 - DNA, 22 bp, Homo sapiens
ggtttggtttgcagcgactggc

SEQ ID NO: 2485008 - DNA, 14 bp, Homo sapiens
ggttttaactttgt

SEQ ID NO: 2485009 - DNA, 15 bp, Homo sapiens
ggttttaactttgtt

SEQ ID NO: 2485010 - DNA, 15 bp, Homo sapiens
ggttttaggttctaa

SEQ ID NO: 2485011 - DNA, 16 bp, Homo sapiens
ggttttaggttctaaa

SEQ ID NO: 2485012 - DNA, 17 bp, Homo sapiens
ggttttgtattctctga

SEQ ID NO: 2485013 - DNA, 18 bp, Homo sapiens
ggttttgtattctctgag

SEQ ID NO: 2485014 - DNA, 16 bp, Homo sapiens
ggtttttaaaacccag

SEQ ID NO: 2485015 - DNA, 20 bp, Homo sapiens
ggtttttactgctctgagaa

SEQ ID NO: 2485016 - DNA, 20 bp, Homo sapiens
ggtttttggacttctggggt

SEQ ID NO: 2485017 - DNA, 19 bp, Homo sapiens
gtaaaagcaaaaaagaaaa

SEQ ID NO: 2485018 - DNA, 13 bp, Homo sapiens
gtaaaatactttt

SEQ ID NO: 2485019 - DNA, 22 bp, Homo sapiens
gtaaaatacttttactctgcct

SEQ ID NO: 2485020 - DNA, 18 bp, Homo sapiens
gtaaaatattttgaatca

SEQ ID NO: 2485021 - DNA, 16 bp, Homo sapiens
gtaaaatgacaatcat

SEQ ID NO: 2485022 - DNA, 22 bp, Homo sapiens
gtaaaatgacaatcatgtgtgt

SEQ ID NO: 2485023 - DNA, 18 bp, Homo sapiens
gtaaaatgtgggattatg

SEQ ID NO: 2485024 - DNA, 11 bp, Homo sapiens
gtaaacaatat

SEQ ID NO: 2485025 - DNA, 20 bp, Homo sapiens
gtaaacagatggcactttga

SEQ ID NO: 2485026 - DNA, 19 bp, Homo sapiens
gtaaaccactgaaaaaata

SEQ ID NO: 2485027 - DNA, 24 bp, Homo sapiens
gtaaactgtgcaccaagcaggaaa

SEQ ID NO: 2485028 - DNA, 17 bp, Homo sapiens
gtaaactttatcactta

SEQ ID NO: 2485029 - DNA, 19 bp, Homo sapiens
gtaaactttatcacttaaa

SEQ ID NO: 2485030 - DNA, 14 bp, Homo sapiens
gtaaagaattattt

SEQ ID NO: 2485031 - DNA, 19 bp, Homo sapiens
gtaaagactggcttttatt

SEQ ID NO: 2485032 - DNA, 15 bp, Homo sapiens
gtaaagtacttgtag

SEQ ID NO: 2485033 - DNA, 16 bp, Homo sapiens
gtaaagtacttgtagt

SEQ ID NO: 2485034 - DNA, 15 bp, Homo sapiens
gtaaagtatgtatta

SEQ ID NO: 2485035 - DNA, 20 bp, Homo sapiens
gtaaataactggaaaacaga

SEQ ID NO: 2485036 - DNA, 16 bp, Homo sapiens
gtaaataatgctttga

SEQ ID NO: 2485037 - DNA, 17 bp, Homo sapiens
gtaatggtgtagaacac

SEQ ID NO: 2485038 - DNA, 19 bp, Homo sapiens
gtaatgtatcaaatacatt

SEQ ID NO: 2485039 - DNA, 19 bp, Homo sapiens
gtaattaaaagcaaatcat

SEQ ID NO: 2485040 - DNA, 20 bp, Homo sapiens
gtaattaaaagcaaatcatt

SEQ ID NO: 2485041 - DNA, 15 bp, Homo sapiens
gtaattagtaacatg

SEQ ID NO: 2485042 - DNA, 12 bp, Homo sapiens
gtaattctaaat

SEQ ID NO: 2485043 - DNA, 12 bp, Homo sapiens
gtaatttaactt

SEQ ID NO: 2485044 - DNA, 14 bp, Homo sapiens
gtaattttgtgtaa

SEQ ID NO: 2485045 - DNA, 21 bp, Homo sapiens
gtaatttttttaatttacaaa

SEQ ID NO: 2485046 - DNA, 23 bp, Homo sapiens
gtacaaccacacccacactcaga

SEQ ID NO: 2485047 - DNA, 15 bp, Homo sapiens
gtacaagaagcattt

SEQ ID NO: 2485048 - DNA, 21 bp, Homo sapiens
gtacaattaattatcttttca

SEQ ID NO: 2485049 - DNA, 18 bp, Homo sapiens
gtacagagaagccagctt

SEQ ID NO: 2485050 - DNA, 19 bp, Homo sapiens
gtacagagaagccagcttg

SEQ ID NO: 2485051 - DNA, 23 bp, Homo sapiens
gtacagagaagccagcttgttta

SEQ ID NO: 2485052 - DNA, 14 bp, Homo sapiens
gtacagctggctct

SEQ ID NO: 2485053 - DNA, 22 bp, Homo sapiens
gtacagtatgggggttgtaaat

SEQ ID NO: 2485054 - DNA, 12 bp, Homo sapiens
gtacagtgttac

SEQ ID NO: 2485055 - DNA, 22 bp, Homo sapiens
gtacataccctggccgccccct

SEQ ID NO: 2485056 - DNA, 20 bp, Homo sapiens
gtacatctattttggattgt

SEQ ID NO: 2485057 - DNA, 13 bp, Homo sapiens
gtacatttctcag

SEQ ID NO: 2485058 - DNA, 15 bp, Homo sapiens
gtaccaatcatttta

SEQ ID NO: 2485059 - DNA, 21 bp, Homo sapiens
gtaccaatcattttaattatt

SEQ ID NO: 2485060 - DNA, 16 bp, Homo sapiens
gtaccagataactttt

SEQ ID NO: 2485061 - DNA, 11 bp, Homo sapiens
gtaccagttaa

SEQ ID NO: 2485062 - DNA, 22 bp, Homo sapiens
gtaccatttaatggggaggaca

SEQ ID NO: 2485063 - DNA, 13 bp, Homo sapiens
gtacccccaggac

SEQ ID NO: 2485064 - DNA, 14 bp, Homo sapiens
gtacccccaggacc

SEQ ID NO: 2485065 - DNA, 12 bp, Homo sapiens
gtacctgagggt

SEQ ID NO: 2485066 - DNA, 15 bp, Homo sapiens
gtactcaaatgtagc

SEQ ID NO: 2485067 - DNA, 20 bp, Homo sapiens
gtactccctctcaggatcca

SEQ ID NO: 2485068 - DNA, 19 bp, Homo sapiens
gtactgaccccatcaccta

SEQ ID NO: 2485069 - DNA, 14 bp, Homo sapiens
gtactgactttgct

SEQ ID NO: 2485070 - DNA, 17 bp, Homo sapiens
gtactgactttgcttgc

SEQ ID NO: 2485071 - DNA, 18 bp, Homo sapiens
gtactgactttgcttgct

SEQ ID NO: 2485072 - DNA, 20 bp, Homo sapiens
gtactgtacagctggctcta

SEQ ID NO: 2485073 - DNA, 15 bp, Homo sapiens
gtactgttctgtgtc

SEQ ID NO: 2485074 - DNA, 15 bp, Homo sapiens
gtagaaactgcaggg

SEQ ID NO: 2485075 - DNA, 19 bp, Homo sapiens
gtagaaactgcagggaaaa

SEQ ID NO: 2485076 - DNA, 15 bp, Homo sapiens
gtagaattgcattga

SEQ ID NO: 2485077 - DNA, 19 bp, Homo sapiens
gtagaccttgttacttctg

SEQ ID NO: 2485078 - DNA, 15 bp, Homo sapiens
gtagagttgctgaga

SEQ ID NO: 2485079 - DNA, 23 bp, Homo sapiens
gtagagttgctgagagggctcga

SEQ ID NO: 2485080 - DNA, 15 bp, Homo sapiens
gtagatgcatttggg

SEQ ID NO: 2485081 - DNA, 17 bp, Homo sapiens
gtagatgggagggaggc

SEQ ID NO: 2485082 - DNA, 21 bp, Homo sapiens
gtagatgggagggaggctcag

SEQ ID NO: 2485083 - DNA, 15 bp, Homo sapiens
gtagattgattgtat

SEQ ID NO: 2485084 - DNA, 15 bp, Homo sapiens
gtagccagccggggc

SEQ ID NO: 2485085 - DNA, 21 bp, Homo sapiens
gtagcctcaatcgagtgagac

SEQ ID NO: 2485086 - DNA, 11 bp, Homo sapiens
gtagccttttt

SEQ ID NO: 2485087 - DNA, 18 bp, Homo sapiens
gtagcctttttgtataaa

SEQ ID NO: 2485088 - DNA, 13 bp, Homo sapiens
gtagctacagaga

SEQ ID NO: 2485089 - DNA, 23 bp, Homo sapiens
gtagctacagagaaaccagcttc

SEQ ID NO: 2485090 - DNA, 10 bp, Homo sapiens
gtagctcctc

SEQ ID NO: 2485091 - DNA, 19 bp, Homo sapiens
gtagctctttgtcagggag

SEQ ID NO: 2485092 - DNA, 20 bp, Homo sapiens
gtagctctttgtcagggagt

SEQ ID NO: 2485093 - DNA, 11 bp, Homo sapiens
gtagctgagct

SEQ ID NO: 2485094 - DNA, 21 bp, Homo sapiens
gtagctgagctcacaaggcag

SEQ ID NO: 2485095 - DNA, 17 bp, Homo sapiens
gtagctgggactacagg

SEQ ID NO: 2485096 - DNA, 20 bp, Homo sapiens
gtagctgtgacctgctgagc

SEQ ID NO: 2485097 - DNA, 12 bp, Homo sapiens
gtaggccaaggt

SEQ ID NO: 2485098 - DNA, 18 bp, Homo sapiens
gtaggccaaggtgtccta

SEQ ID NO: 2485099 - DNA, 22 bp, Homo sapiens
gtaggccaaggtgtcctacaga

SEQ ID NO: 2485100 - DNA, 23 bp, Homo sapiens
gtaggccaaggtgtcctacagaa

SEQ ID NO: 2485101 - DNA, 18 bp, Homo sapiens
gtaggctacagagaagcc

SEQ ID NO: 2485102 - DNA, 22 bp, Homo sapiens
gtaggctacagagaagccttca

SEQ ID NO: 2485103 - DNA, 13 bp, Homo sapiens
gtagggagggcgg

SEQ ID NO: 2485104 - DNA, 17 bp, Homo sapiens
gtagggggctggaggag

SEQ ID NO: 2485105 - DNA, 20 bp, Homo sapiens
gtagggggctggaggagccc

SEQ ID NO: 2485106 - DNA, 15 bp, Homo sapiens
gtagggtgggagtgg

SEQ ID NO: 2485107 - DNA, 15 bp, Homo sapiens
gtaggttcagccaag

SEQ ID NO: 2485108 - DNA, 14 bp, Homo sapiens
gtaggttgcacact

SEQ ID NO: 2485109 - DNA, 21 bp, Homo sapiens
gtagtaaataatgctttgaaa

SEQ ID NO: 2485110 - DNA, 16 bp, Homo sapiens
gtagtaccaaaataaa

SEQ ID NO: 2485111 - DNA, 20 bp, Homo sapiens
gtagtattttttgtataatt

SEQ ID NO: 2485112 - DNA, 23 bp, Homo sapiens
gtagtattttttgtataattgga

SEQ ID NO: 2485113 - DNA, 12 bp, Homo sapiens
gtagtcttgatg

SEQ ID NO: 2485114 - DNA, 16 bp, Homo sapiens
gtagtcttgatgacca

SEQ ID NO: 2485115 - DNA, 16 bp, Homo sapiens
gtagttctgctccaga

SEQ ID NO: 2485116 - DNA, 16 bp, Homo sapiens
gtagttgtctttcctg

SEQ ID NO: 2485117 - DNA, 13 bp, Homo sapiens
gtagttttttcat

SEQ ID NO: 2485118 - DNA, 15 bp, Homo sapiens
gtagttttttcatct

SEQ ID NO: 2485119 - DNA, 23 bp, Homo sapiens
gtataaacaagaaaaataaagaa

SEQ ID NO: 2485120 - DNA, 17 bp, Homo sapiens
gtataaagaattgtggt

SEQ ID NO: 2485121 - DNA, 18 bp, Homo sapiens
gtataagatcctagatcc

SEQ ID NO: 2485122 - DNA, 22 bp, Homo sapiens
gtataagatcctagatcctaag

SEQ ID NO: 2485123 - DNA, 19 bp, Homo sapiens
gtataattggatttcctaa

SEQ ID NO: 2485124 - DNA, 20 bp, Homo sapiens
gtataattggatttcctaat

SEQ ID NO: 2485125 - DNA, 15 bp, Homo sapiens
gtatactgtaggcac

SEQ ID NO: 2485126 - DNA, 18 bp, Homo sapiens
gtatagcatgcatctgtt

SEQ ID NO: 2485127 - DNA, 23 bp, Homo sapiens
gtatatactttgaaaggagatgt

SEQ ID NO: 2485128 - DNA, 12 bp, Homo sapiens
gtatatactttt

SEQ ID NO: 2485129 - DNA, 13 bp, Homo sapiens
gtatatacttttt

SEQ ID NO: 2485130 - DNA, 17 bp, Homo sapiens
gtatatattttttttta

SEQ ID NO: 2485131 - DNA, 23 bp, Homo sapiens
gtatattcaggacttgaaagaaa

SEQ ID NO: 2485132 - DNA, 19 bp, Homo sapiens
gtatcaaatacatttaaaa

SEQ ID NO: 2485133 - DNA, 18 bp, Homo sapiens
gtatcaggacccagagga

SEQ ID NO: 2485134 - DNA, 21 bp, Homo sapiens
gtatcaggacccagaggaagg

SEQ ID NO: 2485135 - DNA, 13 bp, Homo sapiens
gtatcatcagtgt

SEQ ID NO: 2485136 - DNA, 18 bp, Homo sapiens
gtatcatgccctgtgcaa

SEQ ID NO: 2485137 - DNA, 18 bp, Homo sapiens
gtatccccccatcttgct

SEQ ID NO: 2485138 - DNA, 18 bp, Homo sapiens
gtatctaggcaacatagt

SEQ ID NO: 2485139 - DNA, 21 bp, Homo sapiens
gtatctcagaaagtgcctgac

SEQ ID NO: 2485140 - DNA, 19 bp, Homo sapiens
gtatgaaactaaagccttt

SEQ ID NO: 2485141 - DNA, 14 bp, Homo sapiens
gtatgaattattca

SEQ ID NO: 2485142 - DNA, 16 bp, Homo sapiens
gtatgatacttcgaca

SEQ ID NO: 2485143 - DNA, 19 bp, Homo sapiens
gtatgcacatgaacttaga

SEQ ID NO: 2485144 - DNA, 12 bp, Homo sapiens
gtatgcatgttg

SEQ ID NO: 2485145 - DNA, 20 bp, Homo sapiens
gtatggcgtaagtacagaga

SEQ ID NO: 2485146 - DNA, 15 bp, Homo sapiens
gtatggtgcaatgtg

SEQ ID NO: 2485147 - DNA, 13 bp, Homo sapiens
gtatgtattattt

SEQ ID NO: 2485148 - DNA, 14 bp, Homo sapiens
gtatgtctggttct

SEQ ID NO: 2485149 - DNA, 14 bp, Homo sapiens
gtattaaaatgtat

SEQ ID NO: 2485150 - DNA, 14 bp, Homo sapiens
gtattaagaaagga

SEQ ID NO: 2485151 - DNA, 15 bp, Homo sapiens
gtattaagaaaggaa

SEQ ID NO: 2485152 - DNA, 21 bp, Homo sapiens
gtattcatccaagttaaatgt

SEQ ID NO: 2485153 - DNA, 21 bp, Homo sapiens
gtattcccaaaaattactttg

SEQ ID NO: 2485154 - DNA, 19 bp, Homo sapiens
gtattctctgagctgtgca

SEQ ID NO: 2485155 - DNA, 14 bp, Homo sapiens
gtattgcacattgt

SEQ ID NO: 2485156 - DNA, 21 bp, Homo sapiens
gtattgcacattgtaaaaagt

SEQ ID NO: 2485157 - DNA, 14 bp, Homo sapiens
gtattgtgcaatgt

SEQ ID NO: 2485158 - DNA, 17 bp, Homo sapiens
gtattgtgcaatgtgta

SEQ ID NO: 2485159 - DNA, 22 bp, Homo sapiens
gtattgtgcaatgtgtataaac

SEQ ID NO: 2485160 - DNA, 19 bp, Homo sapiens
gtattgttgtccttttcat

SEQ ID NO: 2485161 - DNA, 21 bp, Homo sapiens
gtattgttgtccttttcatag

SEQ ID NO: 2485162 - DNA, 17 bp, Homo sapiens
gtatttaacagaaattg

SEQ ID NO: 2485163 - DNA, 20 bp, Homo sapiens
gtatttaacagaaattgtat

SEQ ID NO: 2485164 - DNA, 19 bp, Homo sapiens
gtatttacgctttgattca

SEQ ID NO: 2485165 - DNA, 13 bp, Homo sapiens
gtatttataaata

SEQ ID NO: 2485166 - DNA, 11 bp, Homo sapiens
gtatttgctaa

SEQ ID NO: 2485167 - DNA, 22 bp, Homo sapiens
gtatttgcttttttgttttggc

SEQ ID NO: 2485168 - DNA, 20 bp, Homo sapiens
gtatttggaaataaagtcag

SEQ ID NO: 2485169 - DNA, 21 bp, Homo sapiens
gtatttggaaataaagtcaga

SEQ ID NO: 2485170 - DNA, 18 bp, Homo sapiens
gtatttgttaatttagaa

SEQ ID NO: 2485171 - DNA, 18 bp, Homo sapiens
gtattttaaaatagcgtt

SEQ ID NO: 2485172 - DNA, 20 bp, Homo sapiens
gtattttagtgaacttgaaa

SEQ ID NO: 2485173 - DNA, 13 bp, Homo sapiens
gtattttatgtta

SEQ ID NO: 2485174 - DNA, 16 bp, Homo sapiens
gtattttatgttatat

SEQ ID NO: 2485175 - DNA, 18 bp, Homo sapiens
gtcaaaatagtgccacta

SEQ ID NO: 2485176 - DNA, 22 bp, Homo sapiens
gtcaaatgcatacaagtttcat

SEQ ID NO: 2485177 - DNA, 14 bp, Homo sapiens
gtcaacagtaaacc

SEQ ID NO: 2485178 - DNA, 19 bp, Homo sapiens
gtcaacctgggcaaagcct

SEQ ID NO: 2485179 - DNA, 17 bp, Homo sapiens
gtcaactctttgttatt

SEQ ID NO: 2485180 - DNA, 21 bp, Homo sapiens
gtcaagaatagcattgtaaaa

SEQ ID NO: 2485181 - DNA, 20 bp, Homo sapiens
gtcaagagtgaattccctca

SEQ ID NO: 2485182 - DNA, 22 bp, Homo sapiens
gtcaagctgagtattaaaatgt

SEQ ID NO: 2485183 - DNA, 14 bp, Homo sapiens
gtcaagtctctgct

SEQ ID NO: 2485184 - DNA, 19 bp, Homo sapiens
gtcaattgtacgcgccacc

SEQ ID NO: 2485185 - DNA, 20 bp, Homo sapiens
gtcacaatgagattgaattt

SEQ ID NO: 2485186 - DNA, 22 bp, Homo sapiens
gtcacagcatggaggaggaggg

SEQ ID NO: 2485187 - DNA, 17 bp, Homo sapiens
gtcacagggcagtacct

SEQ ID NO: 2485188 - DNA, 16 bp, Homo sapiens
gtcaccacgactggcc

SEQ ID NO: 2485189 - DNA, 17 bp, Homo sapiens
gtcaccacgactggcca

SEQ ID NO: 2485190 - DNA, 19 bp, Homo sapiens
gtcaccacgactggccagg

SEQ ID NO: 2485191 - DNA, 21 bp, Homo sapiens
gtcaccacgactggccagggc

SEQ ID NO: 2485192 - DNA, 13 bp, Homo sapiens
gtcaccaggtact

SEQ ID NO: 2485193 - DNA, 21 bp, Homo sapiens
gtcacctaggaagcctcagat

SEQ ID NO: 2485194 - DNA, 18 bp, Homo sapiens
gtcacggatttgtgtctg

SEQ ID NO: 2485195 - DNA, 14 bp, Homo sapiens
gtcactttttctga

SEQ ID NO: 2485196 - DNA, 14 bp, Homo sapiens
gtcagaccctggag

SEQ ID NO: 2485197 - DNA, 14 bp, Homo sapiens
gtcagatccaggag

SEQ ID NO: 2485198 - DNA, 18 bp, Homo sapiens
gtcagatccaggagctcc

SEQ ID NO: 2485199 - DNA, 20 bp, Homo sapiens
gtcagatccaggagctccag

SEQ ID NO: 2485200 - DNA, 14 bp, Homo sapiens
gtcagcatgaattt

SEQ ID NO: 2485201 - DNA, 21 bp, Homo sapiens
gtcaggattgcgagagatgtg

SEQ ID NO: 2485202 - DNA, 13 bp, Homo sapiens
gtcaggcagggtg

SEQ ID NO: 2485203 - DNA, 14 bp, Homo sapiens
gtcagtcacagcca

SEQ ID NO: 2485204 - DNA, 18 bp, Homo sapiens
gtcataactaaataaagc

SEQ ID NO: 2485205 - DNA, 15 bp, Homo sapiens
gtcatacagagaagt

SEQ ID NO: 2485206 - DNA, 16 bp, Homo sapiens
gtcatacagagaagtc

SEQ ID NO: 2485207 - DNA, 17 bp, Homo sapiens
gtcatcatcatggccag

SEQ ID NO: 2485208 - DNA, 18 bp, Homo sapiens
gtcatcatcatggccagc

SEQ ID NO: 2485209 - DNA, 21 bp, Homo sapiens
gtcatcatcatggccagctgg

SEQ ID NO: 2485210 - DNA, 19 bp, Homo sapiens
gtcatcctcaaagaaagtg

SEQ ID NO: 2485211 - DNA, 18 bp, Homo sapiens
gtcatcctcacagtgaac

SEQ ID NO: 2485212 - DNA, 12 bp, Homo sapiens
gtcatcttgcta

SEQ ID NO: 2485213 - DNA, 20 bp, Homo sapiens
gtcatgaggagattctgcct

SEQ ID NO: 2485214 - DNA, 24 bp, Homo sapiens
gctattttccaggcttctgctggg

SEQ ID NO: 2485215 - DNA, 13 bp, Homo sapiens
gctattttgtgaa

SEQ ID NO: 2485216 - DNA, 21 bp, Homo sapiens
gctcaaacaatgacaaagcag

SEQ ID NO: 2485217 - DNA, 22 bp, Homo sapiens
gctcaaacaatgacaaagcaga

SEQ ID NO: 2485218 - DNA, 21 bp, Homo sapiens
gctcaagcagcgaccgccccc

SEQ ID NO: 2485219 - DNA, 16 bp, Homo sapiens
gctcaatccctgagga

SEQ ID NO: 2485220 - DNA, 13 bp, Homo sapiens
gctcaatgagcat

SEQ ID NO: 2485221 - DNA, 15 bp, Homo sapiens
gctcacaaggcagca

SEQ ID NO: 2485222 - DNA, 20 bp, Homo sapiens
gctcacaaggcagcaaggcc

SEQ ID NO: 2485223 - DNA, 21 bp, Homo sapiens
gctcacaaggcagcaaggccc

SEQ ID NO: 2485224 - DNA, 22 bp, Homo sapiens
gctcacaaggcagcaaggcccg

SEQ ID NO: 2485225 - DNA, 23 bp, Homo sapiens
gctcactcatcaatggggccagt

SEQ ID NO: 2485226 - DNA, 19 bp, Homo sapiens
gctcagaggcgcactgtga

SEQ ID NO: 2485227 - DNA, 21 bp, Homo sapiens
gctcagaggcgcactgtgacc

SEQ ID NO: 2485228 - DNA, 22 bp, Homo sapiens
gctcagatcggccacagggcgg

SEQ ID NO: 2485229 - DNA, 17 bp, Homo sapiens
gctcagcactgcctgct

SEQ ID NO: 2485230 - DNA, 18 bp, Homo sapiens
gctcagcactgcctgctc

SEQ ID NO: 2485231 - DNA, 20 bp, Homo sapiens
gctcagcactgcctgctccc

SEQ ID NO: 2485232 - DNA, 18 bp, Homo sapiens
gctcagctcatccatgcc

SEQ ID NO: 2485233 - DNA, 17 bp, Homo sapiens
gctcagctctgggccat

SEQ ID NO: 2485234 - DNA, 12 bp, Homo sapiens
gctcagctgcat

SEQ ID NO: 2485235 - DNA, 17 bp, Homo sapiens
gctcaggacagatgcca

SEQ ID NO: 2485236 - DNA, 12 bp, Homo sapiens
gctcaggcaggg

SEQ ID NO: 2485237 - DNA, 16 bp, Homo sapiens
gctcaggcaggggcct

SEQ ID NO: 2485238 - DNA, 22 bp, Homo sapiens
gctcaggcaggggcctccatgg

SEQ ID NO: 2485239 - DNA, 19 bp, Homo sapiens
gctcaggcgatccacctgt

SEQ ID NO: 2485240 - DNA, 17 bp, Homo sapiens
gctcagtgaagttgctg

SEQ ID NO: 2485241 - DNA, 17 bp, Homo sapiens
gctcagtggggcagagg

SEQ ID NO: 2485242 - DNA, 16 bp, Homo sapiens
gctcatcattctctgt

SEQ ID NO: 2485243 - DNA, 16 bp, Homo sapiens
gctcatctgctggtcc

SEQ ID NO: 2485244 - DNA, 22 bp, Homo sapiens
gctcatgtgtgcaacagggtat

SEQ ID NO: 2485245 - DNA, 15 bp, Homo sapiens
gctccaacctgcaaa

SEQ ID NO: 2485246 - DNA, 18 bp, Homo sapiens
gctccaacctgcaaagat

SEQ ID NO: 2485247 - DNA, 20 bp, Homo sapiens
gctccaaggggaatcagaac

SEQ ID NO: 2485248 - DNA, 16 bp, Homo sapiens
gctccaccctggccga

SEQ ID NO: 2485249 - DNA, 15 bp, Homo sapiens
gctccactctgcttc

SEQ ID NO: 2485250 - DNA, 17 bp, Homo sapiens
gctccactctgcttctc

SEQ ID NO: 2485251 - DNA, 19 bp, Homo sapiens
gctccactctgcttctctg

SEQ ID NO: 2485252 - DNA, 23 bp, Homo sapiens
gctccactctgcttctctgactt

SEQ ID NO: 2485253 - DNA, 14 bp, Homo sapiens
gctccagacaggga

SEQ ID NO: 2485254 - DNA, 12 bp, Homo sapiens
gctccagacctg

SEQ ID NO: 2485255 - DNA, 20 bp, Homo sapiens
gctccagagggcactctgct

SEQ ID NO: 2485256 - DNA, 19 bp, Homo sapiens
gctccagatgcagggcagt

SEQ ID NO: 2485257 - DNA, 16 bp, Homo sapiens
gctccagcccctcttg

SEQ ID NO: 2485258 - DNA, 12 bp, Homo sapiens
gctccagctgcc

SEQ ID NO: 2485259 - DNA, 13 bp, Homo sapiens
gctccagctgccc

SEQ ID NO: 2485260 - DNA, 16 bp, Homo sapiens
gctccagctgccccgg

SEQ ID NO: 2485261 - DNA, 21 bp, Homo sapiens
gctccaggtggctctgaggtg

SEQ ID NO: 2485262 - DNA, 15 bp, Homo sapiens
gctccagtgtcctga

SEQ ID NO: 2485263 - DNA, 17 bp, Homo sapiens
gctccagtgtcctgagc

SEQ ID NO: 2485264 - DNA, 22 bp, Homo sapiens
gctccagtgtcctgagctcagc

SEQ ID NO: 2485265 - DNA, 19 bp, Homo sapiens
gctcccaaggggcctgagc

SEQ ID NO: 2485266 - DNA, 20 bp, Homo sapiens
gctcccaaggggcctgagca

SEQ ID NO: 2485267 - DNA, 15 bp, Homo sapiens
gctcccacaagcctg

SEQ ID NO: 2485268 - DNA, 16 bp, Homo sapiens
gctcccacaagcctga

SEQ ID NO: 2485269 - DNA, 19 bp, Homo sapiens
gctcccacaagcctgaggg

SEQ ID NO: 2485270 - DNA, 22 bp, Homo sapiens
gctcccagggacacctgggaga

SEQ ID NO: 2485271 - DNA, 19 bp, Homo sapiens
gctcccaggggctccctcc

SEQ ID NO: 2485272 - DNA, 17 bp, Homo sapiens
gctccccactctgctct

SEQ ID NO: 2485273 - DNA, 18 bp, Homo sapiens
gctccccactctgctctg

SEQ ID NO: 2485274 - DNA, 22 bp, Homo sapiens
gctccccactctgctctgatgc

SEQ ID NO: 2485275 - DNA, 12 bp, Homo sapiens
gctccccatgtg

SEQ ID NO: 2485276 - DNA, 14 bp, Homo sapiens
gctcccctccccaa

SEQ ID NO: 2485277 - DNA, 10 bp, Homo sapiens
gctccctcag

SEQ ID NO: 2485278 - DNA, 22 bp, Homo sapiens
gctccgtgtgggagaccggcct

SEQ ID NO: 2485279 - DNA, 23 bp, Homo sapiens
gctccgtgtgggagaccggcctg

SEQ ID NO: 2485280 - DNA, 14 bp, Homo sapiens
gctcctccctctca

SEQ ID NO: 2485281 - DNA, 16 bp, Homo sapiens
gctcctctccccagcc

SEQ ID NO: 2485282 - DNA, 17 bp, Homo sapiens
gctcctctgtctcgagc

SEQ ID NO: 2485283 - DNA, 21 bp, Homo sapiens
gctcctctgtctcgagcgccc

SEQ ID NO: 2485284 - DNA, 15 bp, Homo sapiens
gctcctcttccccag

SEQ ID NO: 2485285 - DNA, 23 bp, Homo sapiens
gctcctcttccccagacgcctgg

SEQ ID NO: 2485286 - DNA, 16 bp, Homo sapiens
gctcctgacactgctg

SEQ ID NO: 2485287 - DNA, 17 bp, Homo sapiens
gctcctgacactgctgg

SEQ ID NO: 2485288 - DNA, 19 bp, Homo sapiens
gctcctgacactgctggag

SEQ ID NO: 2485289 - DNA, 20 bp, Homo sapiens
gctcctgcacttacttgctt

SEQ ID NO: 2485290 - DNA, 12 bp, Homo sapiens
gctcctgcccac

SEQ ID NO: 2485291 - DNA, 11 bp, Homo sapiens
gctcctggacc

SEQ ID NO: 2485292 - DNA, 19 bp, Homo sapiens
gctcctggacccccctttc

SEQ ID NO: 2485293 - DNA, 17 bp, Homo sapiens
gctcctggcccagcctt

SEQ ID NO: 2485294 - DNA, 21 bp, Homo sapiens
gctcctggtcacctaggaagc

SEQ ID NO: 2485295 - DNA, 15 bp, Homo sapiens
gctcctgtggcccca

SEQ ID NO: 2485296 - DNA, 20 bp, Homo sapiens
gctcctgtggccccaccctg

SEQ ID NO: 2485297 - DNA, 15 bp, Homo sapiens
gctccttgtgccaga

SEQ ID NO: 2485298 - DNA, 22 bp, Homo sapiens
gctccttgtgggcctgggctcc

SEQ ID NO: 2485299 - DNA, 20 bp, Homo sapiens
gctcgagcagtcctgcctca

SEQ ID NO: 2485300 - DNA, 21 bp, Homo sapiens
gctcgagcagtcctgcctcag

SEQ ID NO: 2485301 - DNA, 20 bp, Homo sapiens
gctcgatgtggtcacagctg

SEQ ID NO: 2485302 - DNA, 22 bp, Homo sapiens
gctcgatgtggtcacagctgta

SEQ ID NO: 2485303 - DNA, 13 bp, Homo sapiens
gctcgctccctgc

SEQ ID NO: 2485304 - DNA, 16 bp, Homo sapiens
gctcggggtgcacagg

SEQ ID NO: 2485305 - DNA, 18 bp, Homo sapiens
gctcggggtgcacaggag

SEQ ID NO: 2485306 - DNA, 21 bp, Homo sapiens
gctcggggtgcacaggagggg

SEQ ID NO: 2485307 - DNA, 15 bp, Homo sapiens
gctctaacagccctc

SEQ ID NO: 2485308 - DNA, 15 bp, Homo sapiens
gctctaacgcctgag

SEQ ID NO: 2485309 - DNA, 23 bp, Homo sapiens
gctctacttccccatggccctga

SEQ ID NO: 2485310 - DNA, 20 bp, Homo sapiens
gctctagatcataaggcttc

SEQ ID NO: 2485311 - DNA, 21 bp, Homo sapiens
gctctatgagtctagatgttt

SEQ ID NO: 2485312 - DNA, 11 bp, Homo sapiens
ggaccaggagt

SEQ ID NO: 2485313 - DNA, 18 bp, Homo sapiens
ggaccaggcaccaggcag

SEQ ID NO: 2485314 - DNA, 19 bp, Homo sapiens
ggaccagtcaacctgggca

SEQ ID NO: 2485315 - DNA, 17 bp, Homo sapiens
ggaccagtcccagagca

SEQ ID NO: 2485316 - DNA, 21 bp, Homo sapiens
ggaccatggagtggcagccca

SEQ ID NO: 2485317 - DNA, 20 bp, Homo sapiens
ggacccagccaggcccagcc

SEQ ID NO: 2485318 - DNA, 13 bp, Homo sapiens
ggacccagctaat

SEQ ID NO: 2485319 - DNA, 21 bp, Homo sapiens
ggaccctccgctctgtagtgc

SEQ ID NO: 2485320 - DNA, 15 bp, Homo sapiens
ggaccctgtgagccg

SEQ ID NO: 2485321 - DNA, 21 bp, Homo sapiens
ggaccgctacaccactctggc

SEQ ID NO: 2485322 - DNA, 18 bp, Homo sapiens
ggaccggagagtgggggt

SEQ ID NO: 2485323 - DNA, 19 bp, Homo sapiens
ggaccggagagtgggggtg

SEQ ID NO: 2485324 - DNA, 16 bp, Homo sapiens
ggacctctgacagcag

SEQ ID NO: 2485325 - DNA, 17 bp, Homo sapiens
ggacctgagcctgccga

SEQ ID NO: 2485326 - DNA, 13 bp, Homo sapiens
ggacctgcctgca

SEQ ID NO: 2485327 - DNA, 14 bp, Homo sapiens
ggacctggctgcca

SEQ ID NO: 2485328 - DNA, 17 bp, Homo sapiens
ggaccttcgggctgtgc

SEQ ID NO: 2485329 - DNA, 18 bp, Homo sapiens
ggacctttccaccacagc

SEQ ID NO: 2485330 - DNA, 19 bp, Homo sapiens
ggacctttccaccacagcc

SEQ ID NO: 2485331 - DNA, 22 bp, Homo sapiens
ggacctttccaccacagccagc

SEQ ID NO: 2485332 - DNA, 19 bp, Homo sapiens
ggacgcctgggggtgccag

SEQ ID NO: 2485333 - DNA, 19 bp, Homo sapiens
ggacggtgcccaagccaga

SEQ ID NO: 2485334 - DNA, 19 bp, Homo sapiens
ggacgtggctcagccagca

SEQ ID NO: 2485335 - DNA, 14 bp, Homo sapiens
ggacgttgttttgg

SEQ ID NO: 2485336 - DNA, 15 bp, Homo sapiens
ggactcagccttcag

SEQ ID NO: 2485337 - DNA, 20 bp, Homo sapiens
ggactcaggtggccctactg

SEQ ID NO: 2485338 - DNA, 21 bp, Homo sapiens
ggactctcagtctctgagcag

SEQ ID NO: 2485339 - DNA, 13 bp, Homo sapiens
ggactctgcagcc

SEQ ID NO: 2485340 - DNA, 17 bp, Homo sapiens
ggactctgcagcctcag

SEQ ID NO: 2485341 - DNA, 15 bp, Homo sapiens
ggactgagtgggaag

SEQ ID NO: 2485342 - DNA, 18 bp, Homo sapiens
ggactgctaaataaaatt

SEQ ID NO: 2485343 - DNA, 18 bp, Homo sapiens
ggactgggagcccccagc

SEQ ID NO: 2485344 - DNA, 16 bp, Homo sapiens
ggaggcggtgggcctg

SEQ ID NO: 2485345 - DNA, 15 bp, Homo sapiens
ggaggctccagaggg

SEQ ID NO: 2485346 - DNA, 12 bp, Homo sapiens
ggaggctgctcg

SEQ ID NO: 2485347 - DNA, 23 bp, Homo sapiens
ggaggctgctcggggtgcacagg

SEQ ID NO: 2485348 - DNA, 18 bp, Homo sapiens
ggagggaagggagccaag

SEQ ID NO: 2485349 - DNA, 19 bp, Homo sapiens
ggagggacaaaggagcctg

SEQ ID NO: 2485350 - DNA, 20 bp, Homo sapiens
ggagggacaaaggagcctgt

SEQ ID NO: 2485351 - DNA, 12 bp, Homo sapiens
ggagggaggctg

SEQ ID NO: 2485352 - DNA, 10 bp, Homo sapiens
ggagggcaga

SEQ ID NO: 2485353 - DNA, 16 bp, Homo sapiens
ggagggcagagctggt

SEQ ID NO: 2485354 - DNA, 16 bp, Homo sapiens
ggagggcagcagggct

SEQ ID NO: 2485355 - DNA, 23 bp, Homo sapiens
ggagggccacatgggaggctcac

SEQ ID NO: 2485356 - DNA, 13 bp, Homo sapiens
ggagggcccagcc

SEQ ID NO: 2485357 - DNA, 12 bp, Homo sapiens
ggagggctctga

SEQ ID NO: 2485358 - DNA, 16 bp, Homo sapiens
ggagggctctgaggcg

SEQ ID NO: 2485359 - DNA, 18 bp, Homo sapiens
ggagggctctgaggcgcc

SEQ ID NO: 2485360 - DNA, 21 bp, Homo sapiens
ggagggctctgaggcgcccca

SEQ ID NO: 2485361 - DNA, 16 bp, Homo sapiens
ggaggggggagggaag

SEQ ID NO: 2485362 - DNA, 15 bp, Homo sapiens
ggaggggtaggggct

SEQ ID NO: 2485363 - DNA, 16 bp, Homo sapiens
ggaggggtaggggctg

SEQ ID NO: 2485364 - DNA, 13 bp, Homo sapiens
ggaggtgtctcag

SEQ ID NO: 2485365 - DNA, 17 bp, Homo sapiens
ggagtagctgagctcac

SEQ ID NO: 2485366 - DNA, 13 bp, Homo sapiens
ggagtcacacagt

SEQ ID NO: 2485367 - DNA, 18 bp, Homo sapiens
ggagtctgaggtcctgag

SEQ ID NO: 2485368 - DNA, 20 bp, Homo sapiens
ggagtctgaggtcctgagca

SEQ ID NO: 2485369 - DNA, 21 bp, Homo sapiens
ggagtctgaggtcctgagcac

SEQ ID NO: 2485370 - DNA, 17 bp, Homo sapiens
ggagtctgccacccagg

SEQ ID NO: 2485371 - DNA, 14 bp, Homo sapiens
ggagtctgccaggg

SEQ ID NO: 2485372 - DNA, 16 bp, Homo sapiens
ggagtctgccagggcc

SEQ ID NO: 2485373 - DNA, 12 bp, Homo sapiens
ggagtcttgctc

SEQ ID NO: 2485374 - DNA, 20 bp, Homo sapiens
ggagtggcagcccagccagc

SEQ ID NO: 2485375 - DNA, 20 bp, Homo sapiens
ggagtgtatgactgcacatg

SEQ ID NO: 2485376 - DNA, 15 bp, Homo sapiens
ggagttaagacctgg

SEQ ID NO: 2485377 - DNA, 23 bp, Homo sapiens
ggagttaagacctggcagctctg

SEQ ID NO: 2485378 - DNA, 16 bp, Homo sapiens
ggccatgtccaaagag

SEQ ID NO: 2485379 - DNA, 22 bp, Homo sapiens
ggccatgtccaaagaggctgcc

SEQ ID NO: 2485380 - DNA, 20 bp, Homo sapiens
ggccattctccacagcaacc

SEQ ID NO: 2485381 - DNA, 19 bp, Homo sapiens
ggcccaccccacccacttc

SEQ ID NO: 2485382 - DNA, 23 bp, Homo sapiens
ggcccactgtgcctcagagacca

SEQ ID NO: 2485383 - DNA, 13 bp, Homo sapiens
ggcccagagccca

SEQ ID NO: 2485384 - DNA, 17 bp, Homo sapiens
ggcccagagcccagctc

SEQ ID NO: 2485385 - DNA, 22 bp, Homo sapiens
ggcccaggcccggatgcagagg

SEQ ID NO: 2485386 - DNA, 13 bp, Homo sapiens
ggcccaggctgcc

SEQ ID NO: 2485387 - DNA, 14 bp, Homo sapiens
ggcccaggctggga

SEQ ID NO: 2485388 - DNA, 18 bp, Homo sapiens
ggcccagggcccagagcc

SEQ ID NO: 2485389 - DNA, 19 bp, Homo sapiens
ggcccagggcccagagccc

SEQ ID NO: 2485390 - DNA, 21 bp, Homo sapiens
ggcccagggcccagagcccag

SEQ ID NO: 2485391 - DNA, 18 bp, Homo sapiens
ggccccaaccctgtcctc

SEQ ID NO: 2485392 - DNA, 15 bp, Homo sapiens
ggccccaccctgggc

SEQ ID NO: 2485393 - DNA, 17 bp, Homo sapiens
ggccccaccctgggccc

SEQ ID NO: 2485394 - DNA, 16 bp, Homo sapiens
ggccccatgacctcca

SEQ ID NO: 2485395 - DNA, 15 bp, Homo sapiens
ggcccccacttgcct

SEQ ID NO: 2485396 - DNA, 14 bp, Homo sapiens
ggcccccagcccag

SEQ ID NO: 2485397 - DNA, 17 bp, Homo sapiens
ggcccccagcccagggc

SEQ ID NO: 2485398 - DNA, 15 bp, Homo sapiens
ggcccccctggtccc

SEQ ID NO: 2485399 - DNA, 23 bp, Homo sapiens
ggcccccgccttggcctgtgttc

SEQ ID NO: 2485400 - DNA, 13 bp, Homo sapiens
ggccccctccctg

SEQ ID NO: 2485401 - DNA, 14 bp, Homo sapiens
ggcccctcccctcc

SEQ ID NO: 2485402 - DNA, 12 bp, Homo sapiens
ggcccctctcag

SEQ ID NO: 2485403 - DNA, 14 bp, Homo sapiens
ggcccctctcagcc

SEQ ID NO: 2485404 - DNA, 15 bp, Homo sapiens
ggcccctctcagccc

SEQ ID NO: 2485405 - DNA, 16 bp, Homo sapiens
ggcccctctcagccct

SEQ ID NO: 2485406 - DNA, 20 bp, Homo sapiens
ggcccctctcagccctcaca

SEQ ID NO: 2485407 - DNA, 12 bp, Homo sapiens
ggcccctctccc

SEQ ID NO: 2485408 - DNA, 18 bp, Homo sapiens
ggcccggatgcagaggcc

SEQ ID NO: 2485409 - DNA, 14 bp, Homo sapiens
ggcccgtgtaaata

SEQ ID NO: 2485410 - DNA, 13 bp, Homo sapiens
ggccctagcattg

SEQ ID NO: 2485411 - DNA, 15 bp, Homo sapiens
ggccctccacacctg

SEQ ID NO: 2485412 - DNA, 16 bp, Homo sapiens
ggccctccacacctgc

SEQ ID NO: 2485413 - DNA, 17 bp, Homo sapiens
ggccctccacacctgcg

SEQ ID NO: 2485414 - DNA, 19 bp, Homo sapiens
ggccctccacacctgcggc

SEQ ID NO: 2485415 - DNA, 21 bp, Homo sapiens
ggccctccctgttccccagag

SEQ ID NO: 2485416 - DNA, 23 bp, Homo sapiens
ggccctccctgttccccagagaa

SEQ ID NO: 2485417 - DNA, 22 bp, Homo sapiens
ggccttccctgttttcccccca

SEQ ID NO: 2485418 - DNA, 13 bp, Homo sapiens
ggccttgttctgt

SEQ ID NO: 2485419 - DNA, 13 bp, Homo sapiens
ggcctttgagctc

SEQ ID NO: 2485420 - DNA, 14 bp, Homo sapiens
ggcctttgcgctcc

SEQ ID NO: 2485421 - DNA, 15 bp, Homo sapiens
ggcctttttcattta

SEQ ID NO: 2485422 - DNA, 18 bp, Homo sapiens
ggcgagaagggctgcttc

SEQ ID NO: 2485423 - DNA, 20 bp, Homo sapiens
ggcgaggcccttggcgggca

SEQ ID NO: 2485424 - DNA, 17 bp, Homo sapiens
ggcgatccacctgtctc

SEQ ID NO: 2485425 - DNA, 14 bp, Homo sapiens
ggcgcaggccgtga

SEQ ID NO: 2485426 - DNA, 19 bp, Homo sapiens
ggcgccccaacccgtggag

SEQ ID NO: 2485427 - DNA, 22 bp, Homo sapiens
ggcgcgatctcggctcactgca

SEQ ID NO: 2485428 - DNA, 22 bp, Homo sapiens
ggcggcctatgacttgggcacc

SEQ ID NO: 2485429 - DNA, 17 bp, Homo sapiens
ggcgggcagagggctgg

SEQ ID NO: 2485430 - DNA, 18 bp, Homo sapiens
ggcgggcagagggctgga

SEQ ID NO: 2485431 - DNA, 16 bp, Homo sapiens
ggcggggaggaggaaa

SEQ ID NO: 2485432 - DNA, 19 bp, Homo sapiens
ggcgtaagtacagagaagc

SEQ ID NO: 2485433 - DNA, 15 bp, Homo sapiens
ggcgtaggctacaga

SEQ ID NO: 2485434 - DNA, 17 bp, Homo sapiens
ggcgtaggctacagaga

SEQ ID NO: 2485435 - DNA, 19 bp, Homo sapiens
ggcgtaggctacagagaag

SEQ ID NO: 2485436 - DNA, 14 bp, Homo sapiens
ggcgtggaggagga

SEQ ID NO: 2485437 - DNA, 11 bp, Homo sapiens
ggctacagaga

SEQ ID NO: 2485438 - DNA, 13 bp, Homo sapiens
ggctacagagaag

SEQ ID NO: 2485439 - DNA, 16 bp, Homo sapiens
ggctacagagaagcct

SEQ ID NO: 2485440 - DNA, 15 bp, Homo sapiens
ggctactctgtgcca

SEQ ID NO: 2485441 - DNA, 18 bp, Homo sapiens
ggctactctgtgccagag

SEQ ID NO: 2485442 - DNA, 22 bp, Homo sapiens
ggctactctgtgccagagcctg

SEQ ID NO: 2485443 - DNA, 23 bp, Homo sapiens
ggctactctgtgccagagcctgg

SEQ ID NO: 2485444 - DNA, 23 bp, Homo sapiens
ggctacttcggggctgggaagtc

SEQ ID NO: 2485445 - DNA, 14 bp, Homo sapiens
ggctaggccagcag

SEQ ID NO: 2485446 - DNA, 23 bp, Homo sapiens
ggctagtgacttgtgtcccatga

SEQ ID NO: 2485447 - DNA, 22 bp, Homo sapiens
ggctcagccccaccccagggca

SEQ ID NO: 2485448 - DNA, 15 bp, Homo sapiens
ggctcaggcaggggc

SEQ ID NO: 2485449 - DNA, 17 bp, Homo sapiens
ggctccagatgcagggc

SEQ ID NO: 2485450 - DNA, 19 bp, Homo sapiens
ggctccagatgcagggcag

SEQ ID NO: 2485451 - DNA, 15 bp, Homo sapiens
ggctccagcccctct

SEQ ID NO: 2485452 - DNA, 23 bp, Homo sapiens
ggctccagcccctcttggagaag

SEQ ID NO: 2485453 - DNA, 17 bp, Homo sapiens
ggctcccagggacacct

SEQ ID NO: 2485454 - DNA, 22 bp, Homo sapiens
ggctcccaggggctccctccgc

SEQ ID NO: 2485455 - DNA, 13 bp, Homo sapiens
ggctccctccgcc

SEQ ID NO: 2485456 - DNA, 17 bp, Homo sapiens
ggctccctgactgggag

SEQ ID NO: 2485457 - DNA, 15 bp, Homo sapiens
ccagtccccccaccc

SEQ ID NO: 2485458 - DNA, 12 bp, Homo sapiens
ccagtctgtgga

SEQ ID NO: 2485459 - DNA, 16 bp, Homo sapiens
ccagtctgtggatcag

SEQ ID NO: 2485460 - DNA, 17 bp, Homo sapiens
ccagtgccctgagccag

SEQ ID NO: 2485461 - DNA, 18 bp, Homo sapiens
ccagtgccctgatcccag

SEQ ID NO: 2485462 - DNA, 24 bp, Homo sapiens
ccagtgccctgatcccagagagcc

SEQ ID NO: 2485463 - DNA, 23 bp, Homo sapiens
ccagtgtcctgagccccagggag

SEQ ID NO: 2485464 - DNA, 18 bp, Homo sapiens
ccagtgtcctgagctcag

SEQ ID NO: 2485465 - DNA, 19 bp, Homo sapiens
ccagtgtcctgagctcagc

SEQ ID NO: 2485466 - DNA, 16 bp, Homo sapiens
ccagttaatttttcca

SEQ ID NO: 2485467 - DNA, 18 bp, Homo sapiens
ccagttaatttttccaac

SEQ ID NO: 2485468 - DNA, 18 bp, Homo sapiens
ccagttcattgcactttg

SEQ ID NO: 2485469 - DNA, 13 bp, Homo sapiens
ccagtttgctttg

SEQ ID NO: 2485470 - DNA, 14 bp, Homo sapiens
ccagtttttattaa

SEQ ID NO: 2485471 - DNA, 18 bp, Homo sapiens
ccatatccttaccctcct

SEQ ID NO: 2485472 - DNA, 18 bp, Homo sapiens
ccatatgctaccaccagc

SEQ ID NO: 2485473 - DNA, 12 bp, Homo sapiens
ccatattaaatt

SEQ ID NO: 2485474 - DNA, 20 bp, Homo sapiens
ccatattaaattttttgttg

SEQ ID NO: 2485475 - DNA, 15 bp, Homo sapiens
ccatatttacctcag

SEQ ID NO: 2485476 - DNA, 20 bp, Homo sapiens
ccatatttacctcagcctgg

SEQ ID NO: 2485477 - DNA, 14 bp, Homo sapiens
ccatatttgtaaaa

SEQ ID NO: 2485478 - DNA, 16 bp, Homo sapiens
ccatatttgtaaaatg

SEQ ID NO: 2485479 - DNA, 17 bp, Homo sapiens
ccatatttgtaaaatga

SEQ ID NO: 2485480 - DNA, 16 bp, Homo sapiens
ccatcaaaatgctttt

SEQ ID NO: 2485481 - DNA, 16 bp, Homo sapiens
ccatcaagttgtgcca

SEQ ID NO: 2485482 - DNA, 16 bp, Homo sapiens
ccatcatcatgtgtgt

SEQ ID NO: 2485483 - DNA, 15 bp, Homo sapiens
ccatcatcctctggc

SEQ ID NO: 2485484 - DNA, 15 bp, Homo sapiens
ccatccaaggccagg

SEQ ID NO: 2485485 - DNA, 17 bp, Homo sapiens
ccatccacctttcccaa

SEQ ID NO: 2485486 - DNA, 12 bp, Homo sapiens
ccatcccacacc

SEQ ID NO: 2485487 - DNA, 13 bp, Homo sapiens
ccatccccagcga

SEQ ID NO: 2485488 - DNA, 16 bp, Homo sapiens
ccatcccccggcacct

SEQ ID NO: 2485489 - DNA, 16 bp, Homo sapiens
ccatccctccccagtt

SEQ ID NO: 2485490 - DNA, 22 bp, Homo sapiens
ccatccctggccccctccctgg

SEQ ID NO: 2485491 - DNA, 16 bp, Homo sapiens
ccatcctaggctgaca

SEQ ID NO: 2485492 - DNA, 17 bp, Homo sapiens
ccatctccctggtgctt

SEQ ID NO: 2485493 - DNA, 20 bp, Homo sapiens
ccatctccctggtgcttatg

SEQ ID NO: 2485494 - DNA, 23 bp, Homo sapiens
ccatctctccctcccctgccatt

SEQ ID NO: 2485495 - DNA, 20 bp, Homo sapiens
ccatctgcgtgacaataaaa

SEQ ID NO: 2485496 - DNA, 12 bp, Homo sapiens
ccatctgctcct

SEQ ID NO: 2485497 - DNA, 15 bp, Homo sapiens
ccatctgctcctgga

SEQ ID NO: 2485498 - DNA, 12 bp, Homo sapiens
ccatctgggctc

SEQ ID NO: 2485499 - DNA, 22 bp, Homo sapiens
ccatgacaacttctaattgcca

SEQ ID NO: 2485500 - DNA, 14 bp, Homo sapiens
ccatgacatcaaga

SEQ ID NO: 2485501 - DNA, 15 bp, Homo sapiens
ccatgaccctgcctc

SEQ ID NO: 2485502 - DNA, 16 bp, Homo sapiens
ccatgaccctgcctct

SEQ ID NO: 2485503 - DNA, 15 bp, Homo sapiens
ccatgacctccagct

SEQ ID NO: 2485504 - DNA, 19 bp, Homo sapiens
ccatgactgcttgccctaa

SEQ ID NO: 2485505 - DNA, 23 bp, Homo sapiens
ccatgagatgatacatccaaagc

SEQ ID NO: 2485506 - DNA, 14 bp, Homo sapiens
ccatgatccctgtg

SEQ ID NO: 2485507 - DNA, 20 bp, Homo sapiens
ccatgatgcctctgtcttct

SEQ ID NO: 2485508 - DNA, 14 bp, Homo sapiens
ccatgatggcaaca

SEQ ID NO: 2485509 - DNA, 19 bp, Homo sapiens
ccatgatggcaacagatct

SEQ ID NO: 2485510 - DNA, 19 bp, Homo sapiens
ccatgcactgtgaaggacc

SEQ ID NO: 2485511 - DNA, 21 bp, Homo sapiens
ccatgcactgtgaaggaccct

SEQ ID NO: 2485512 - DNA, 21 bp, Homo sapiens
ccatgcccggctaatttttgt

SEQ ID NO: 2485513 - DNA, 20 bp, Homo sapiens
ccatgcgccccctccgccct

SEQ ID NO: 2485514 - DNA, 16 bp, Homo sapiens
ccatgcgctcagggcc

SEQ ID NO: 2485515 - DNA, 22 bp, Homo sapiens
ccatgcgctcagggccatgctg

SEQ ID NO: 2485516 - DNA, 18 bp, Homo sapiens
ccatgctcatctgctggt

SEQ ID NO: 2485517 - DNA, 20 bp, Homo sapiens
ccatgctcatctgctggtcc

SEQ ID NO: 2485518 - DNA, 18 bp, Homo sapiens
ccatgctcctcttcccca

SEQ ID NO: 2485519 - DNA, 20 bp, Homo sapiens
ccatgctgaggcctgggccg

SEQ ID NO: 2485520 - DNA, 14 bp, Homo sapiens
ccatgctgctgggg

SEQ ID NO: 2485521 - DNA, 22 bp, Homo sapiens
ccatgctgtgcgcccagggctg

SEQ ID NO: 2485522 - DNA, 19 bp, Homo sapiens
ccatggacaggctggctcc

SEQ ID NO: 2485523 - DNA, 14 bp, Homo sapiens
ccatggagaaagct

SEQ ID NO: 2485524 - DNA, 18 bp, Homo sapiens
ccatggagaaagctgact

SEQ ID NO: 2485525 - DNA, 20 bp, Homo sapiens
ccatggagaaagctgacttg

SEQ ID NO: 2485526 - DNA, 23 bp, Homo sapiens
ccatggagaaagctgacttggct

SEQ ID NO: 2485527 - DNA, 19 bp, Homo sapiens
ccatggagattgacctgga

SEQ ID NO: 2485528 - DNA, 20 bp, Homo sapiens
ccatggagtggcagcccagc

SEQ ID NO: 2485529 - DNA, 13 bp, Homo sapiens
ccatggccagcag

SEQ ID NO: 2485530 - DNA, 22 bp, Homo sapiens
ccatggcctgcaaactgggaac

SEQ ID NO: 2485531 - DNA, 11 bp, Homo sapiens
ccatgggacca

SEQ ID NO: 2485532 - DNA, 18 bp, Homo sapiens
ccatggggagggattctg

SEQ ID NO: 2485533 - DNA, 20 bp, Homo sapiens
ccatggggagggattctggt

SEQ ID NO: 2485534 - DNA, 17 bp, Homo sapiens
ccatggtgctaggaaga

SEQ ID NO: 2485535 - DNA, 19 bp, Homo sapiens
ccatggtgtgatcgtctga

SEQ ID NO: 2485536 - DNA, 17 bp, Homo sapiens
ccatgtaactgcctaga

SEQ ID NO: 2485537 - DNA, 17 bp, Homo sapiens
ccatgtccaaagaggct

SEQ ID NO: 2485538 - DNA, 16 bp, Homo sapiens
ccatgtcttctccctg

SEQ ID NO: 2485539 - DNA, 13 bp, Homo sapiens
ccatgtttcaaat

SEQ ID NO: 2485540 - DNA, 19 bp, Homo sapiens
ccattaaaccatctccctg

SEQ ID NO: 2485541 - DNA, 12 bp, Homo sapiens
ccattaaagaat

SEQ ID NO: 2485542 - DNA, 14 bp, Homo sapiens
ccattaaagaatat

SEQ ID NO: 2485543 - DNA, 16 bp, Homo sapiens
ccattaaagaatatga

SEQ ID NO: 2485544 - DNA, 20 bp, Homo sapiens
ccattataatgaatttagtg

SEQ ID NO: 2485545 - DNA, 13 bp, Homo sapiens
ccattcctgaaga

SEQ ID NO: 2485546 - DNA, 13 bp, Homo sapiens
ccattctccacag

SEQ ID NO: 2485547 - DNA, 22 bp, Homo sapiens
ccatttacatgttttaaagaaa

SEQ ID NO: 2485548 - DNA, 14 bp, Homo sapiens
ccatttctaattat

SEQ ID NO: 2485549 - DNA, 12 bp, Homo sapiens
ccatttgcattt

SEQ ID NO: 2485550 - DNA, 23 bp, Homo sapiens
ccatttggatcctgtgtggagag

SEQ ID NO: 2485551 - DNA, 16 bp, Homo sapiens
ccatttggcatccctg

SEQ ID NO: 2485552 - DNA, 18 bp, Homo sapiens
ccatttggcatccctggg

SEQ ID NO: 2485553 - DNA, 21 bp, Homo sapiens
ccatttgtgtacacagtcagc

SEQ ID NO: 2485554 - DNA, 14 bp, Homo sapiens
ccattttctggttc

SEQ ID NO: 2485555 - DNA, 21 bp, Homo sapiens
cccaaacaccttccagctcct

SEQ ID NO: 2485556 - DNA, 17 bp, Homo sapiens
cccaaagctttcctgcc

SEQ ID NO: 2485557 - DNA, 18 bp, Homo sapiens
cccaaaggacgcactgag

SEQ ID NO: 2485558 - DNA, 19 bp, Homo sapiens
cccaaaggacgcactgagc

SEQ ID NO: 2485559 - DNA, 23 bp, Homo sapiens
cccaaagttgttgtaacctgctg

SEQ ID NO: 2485560 - DNA, 17 bp, Homo sapiens
cccaaccatttcctcag

SEQ ID NO: 2485561 - DNA, 18 bp, Homo sapiens
cccaaccatttcctcaga

SEQ ID NO: 2485562 - DNA, 23 bp, Homo sapiens
gccgggtgtccccaacagcgccc

SEQ ID NO: 2485563 - DNA, 23 bp, Homo sapiens
gccgtcctaacctcgggcctgct

SEQ ID NO: 2485564 - DNA, 23 bp, Homo sapiens
gccgtgggcaattgtctgaaaag

SEQ ID NO: 2485565 - DNA, 18 bp, Homo sapiens
gccgtgggccccaccctc

SEQ ID NO: 2485566 - DNA, 16 bp, Homo sapiens
gccgtggtcctttggg

SEQ ID NO: 2485567 - DNA, 23 bp, Homo sapiens
gcctaaaagtgggcttgattctg

SEQ ID NO: 2485568 - DNA, 15 bp, Homo sapiens
gcctaaccgagatca

SEQ ID NO: 2485569 - DNA, 20 bp, Homo sapiens
gcctacagaacttcagaaag

SEQ ID NO: 2485570 - DNA, 14 bp, Homo sapiens
gcctaccccgcaga

SEQ ID NO: 2485571 - DNA, 17 bp, Homo sapiens
gcctaccccgcagacac

SEQ ID NO: 2485572 - DNA, 20 bp, Homo sapiens
gcctagaaacaacactgtag

SEQ ID NO: 2485573 - DNA, 23 bp, Homo sapiens
gcctagaccagcagacagagcca

SEQ ID NO: 2485574 - DNA, 16 bp, Homo sapiens
gcctaggagggtcctc

SEQ ID NO: 2485575 - DNA, 12 bp, Homo sapiens
gcctaggattct

SEQ ID NO: 2485576 - DNA, 16 bp, Homo sapiens
gcctaggattctaaaa

SEQ ID NO: 2485577 - DNA, 17 bp, Homo sapiens
gcctaggcctagtcctg

SEQ ID NO: 2485578 - DNA, 12 bp, Homo sapiens
gcctaggcctgg

SEQ ID NO: 2485579 - DNA, 16 bp, Homo sapiens
gcctaggcctgggcag

SEQ ID NO: 2485580 - DNA, 16 bp, Homo sapiens
gcctatgacttgggca

SEQ ID NO: 2485581 - DNA, 17 bp, Homo sapiens
gcctatgacttgggcac

SEQ ID NO: 2485582 - DNA, 13 bp, Homo sapiens
gcctatggagagc

SEQ ID NO: 2485583 - DNA, 20 bp, Homo sapiens
gcctatggagagccctggga

SEQ ID NO: 2485584 - DNA, 17 bp, Homo sapiens
gcctattgctagagctc

SEQ ID NO: 2485585 - DNA, 20 bp, Homo sapiens
gcctcaaataaaaagtgctt

SEQ ID NO: 2485586 - DNA, 15 bp, Homo sapiens
gcctcaacctcccaa

SEQ ID NO: 2485587 - DNA, 21 bp, Homo sapiens
gcctcaaggttttaggttcta

SEQ ID NO: 2485588 - DNA, 18 bp, Homo sapiens
gcctcacccacccctgca

SEQ ID NO: 2485589 - DNA, 15 bp, Homo sapiens
gcctcagattccttc

SEQ ID NO: 2485590 - DNA, 16 bp, Homo sapiens
gcctcagattccttcc

SEQ ID NO: 2485591 - DNA, 16 bp, Homo sapiens
gcctcagctcccacaa

SEQ ID NO: 2485592 - DNA, 17 bp, Homo sapiens
gcctcagctcccacaag

SEQ ID NO: 2485593 - DNA, 21 bp, Homo sapiens
gcctcagctcccacaagcctc

SEQ ID NO: 2485594 - DNA, 16 bp, Homo sapiens
gcctcaggactgggag

SEQ ID NO: 2485595 - DNA, 17 bp, Homo sapiens
gcctcaggactgggagc

SEQ ID NO: 2485596 - DNA, 18 bp, Homo sapiens
gcctcaggactgggagcc

SEQ ID NO: 2485597 - DNA, 16 bp, Homo sapiens
gcctcaggggtctgag

SEQ ID NO: 2485598 - DNA, 18 bp, Homo sapiens
gcctcatgtggctggaag

SEQ ID NO: 2485599 - DNA, 13 bp, Homo sapiens
gcctccatgggcc

SEQ ID NO: 2485600 - DNA, 13 bp, Homo sapiens
gcctcccaaagtg

SEQ ID NO: 2485601 - DNA, 17 bp, Homo sapiens
gcctcccacccccatct

SEQ ID NO: 2485602 - DNA, 22 bp, Homo sapiens
gcctcccatccagggcccccat

SEQ ID NO: 2485603 - DNA, 14 bp, Homo sapiens
gcctcccctgccag

SEQ ID NO: 2485604 - DNA, 17 bp, Homo sapiens
gcctcccctgccagggc

SEQ ID NO: 2485605 - DNA, 18 bp, Homo sapiens
gcctcccctgccagggca

SEQ ID NO: 2485606 - DNA, 13 bp, Homo sapiens
gcctccctgaagc

SEQ ID NO: 2485607 - DNA, 13 bp, Homo sapiens
gcctccctgagct

SEQ ID NO: 2485608 - DNA, 12 bp, Homo sapiens
gcctcctcatcc

SEQ ID NO: 2485609 - DNA, 22 bp, Homo sapiens
gcctcctcatcccgtgttctcc

SEQ ID NO: 2485610 - DNA, 13 bp, Homo sapiens
gcctcctccctcc

SEQ ID NO: 2485611 - DNA, 16 bp, Homo sapiens
gcctcctccctccctc

SEQ ID NO: 2485612 - DNA, 17 bp, Homo sapiens
gcctcctccctccctct

SEQ ID NO: 2485613 - DNA, 13 bp, Homo sapiens
gcctcctgcctct

SEQ ID NO: 2485614 - DNA, 13 bp, Homo sapiens
gcctccttcctct

SEQ ID NO: 2485615 - DNA, 21 bp, Homo sapiens
gcctccttctgagctcctgtc

SEQ ID NO: 2485616 - DNA, 23 bp, Homo sapiens
gcctcgcaacccgtgccaagtcc

SEQ ID NO: 2485617 - DNA, 16 bp, Homo sapiens
gcctcgcccctggcag

SEQ ID NO: 2485618 - DNA, 20 bp, Homo sapiens
gcctcgctccccactctgct

SEQ ID NO: 2485619 - DNA, 23 bp, Homo sapiens
gcctcgctccccactctgctctg

SEQ ID NO: 2485620 - DNA, 17 bp, Homo sapiens
gcctcggcctcccaaag

SEQ ID NO: 2485621 - DNA, 23 bp, Homo sapiens
gcctctacctgacactcccttgg

SEQ ID NO: 2485622 - DNA, 18 bp, Homo sapiens
gcctctactgggaaggct

SEQ ID NO: 2485623 - DNA, 22 bp, Homo sapiens
gcctctagagcagactacagct

SEQ ID NO: 2485624 - DNA, 14 bp, Homo sapiens
gcctctcccaggca

SEQ ID NO: 2485625 - DNA, 17 bp, Homo sapiens
gcctctcccaggcaggg

SEQ ID NO: 2485626 - DNA, 20 bp, Homo sapiens
gcctctccccaggtccagct

SEQ ID NO: 2485627 - DNA, 16 bp, Homo sapiens
gcctctcccctgcctg

SEQ ID NO: 2485628 - DNA, 17 bp, Homo sapiens
gcctctcccctgcctgc

SEQ ID NO: 2485629 - DNA, 22 bp, Homo sapiens
gcctctcgctcctcaacccctc

SEQ ID NO: 2485630 - DNA, 20 bp, Homo sapiens
gcctctctatcctctcttcc

SEQ ID NO: 2485631 - DNA, 14 bp, Homo sapiens
gcctctgaggccag

SEQ ID NO: 2485632 - DNA, 16 bp, Homo sapiens
gcctctgaggccagcc

SEQ ID NO: 2485633 - DNA, 18 bp, Homo sapiens
gcctctgaggccagcctg

SEQ ID NO: 2485634 - DNA, 20 bp, Homo sapiens
gcctctgaggccagcctggc

SEQ ID NO: 2485635 - DNA, 21 bp, Homo sapiens
gcctctgcccaggcactgcta

SEQ ID NO: 2485636 - DNA, 20 bp, Homo sapiens
gcctctggggggtggccagg

SEQ ID NO: 2485637 - DNA, 20 bp, Homo sapiens
gcctctgtctggcaatgcca

SEQ ID NO: 2485638 - DNA, 12 bp, Homo sapiens
gcctctgtgctg

SEQ ID NO: 2485639 - DNA, 14 bp, Homo sapiens
gcctctgtgctgtg

SEQ ID NO: 2485640 - DNA, 14 bp, Homo sapiens
gcctcttctgggag

SEQ ID NO: 2485641 - DNA, 15 bp, Homo sapiens
gcctcttctgggagg

SEQ ID NO: 2485642 - DNA, 13 bp, Homo sapiens
gcctcttgaccag

SEQ ID NO: 2485643 - DNA, 17 bp, Homo sapiens
gcctcttgaccaggctg

SEQ ID NO: 2485644 - DNA, 18 bp, Homo sapiens
gcctcttgagcagtggct

SEQ ID NO: 2485645 - DNA, 20 bp, Homo sapiens
gcctcttgagcagtggctgg

SEQ ID NO: 2485646 - DNA, 22 bp, Homo sapiens
gcctgacacactaaccaagctg

SEQ ID NO: 2485647 - DNA, 20 bp, Homo sapiens
gcctgactagggagccatgt

SEQ ID NO: 2485648 - DNA, 14 bp, Homo sapiens
gcctgagggaaagg

SEQ ID NO: 2485649 - DNA, 17 bp, Homo sapiens
gcctgagggaaaggcca

SEQ ID NO: 2485650 - DNA, 18 bp, Homo sapiens
gcctgagggaaaggccag

SEQ ID NO: 2485651 - DNA, 20 bp, Homo sapiens
gcctgagggaaaggccagca

SEQ ID NO: 2485652 - DNA, 21 bp, Homo sapiens
gcctgaggtcaggagttcaag

SEQ ID NO: 2485653 - DNA, 16 bp, Homo sapiens
gcctgaggttactgga

SEQ ID NO: 2485654 - DNA, 23 bp, Homo sapiens
gcctgagtcgtgacctgctaggc

SEQ ID NO: 2485655 - DNA, 20 bp, Homo sapiens
gcctgatcagaccacggctc

SEQ ID NO: 2485656 - DNA, 14 bp, Homo sapiens
gcctgcaaactggg

SEQ ID NO: 2485657 - DNA, 13 bp, Homo sapiens
gcctgcagggcct

SEQ ID NO: 2485658 - DNA, 14 bp, Homo sapiens
gcctgcaggggagc

SEQ ID NO: 2485659 - DNA, 17 bp, Homo sapiens
gcctgcagtcctggaag

SEQ ID NO: 2485660 - DNA, 22 bp, Homo sapiens
gcctgcataggagtttggagga

SEQ ID NO: 2485661 - DNA, 21 bp, Homo sapiens
gcctgcatccattctcctgag

SEQ ID NO: 2485662 - DNA, 21 bp, Homo sapiens
gcctgccacctccccccacaa

SEQ ID NO: 2485663 - DNA, 13 bp, Homo sapiens
gcctgccacctgg

SEQ ID NO: 2485664 - DNA, 22 bp, Homo sapiens
gcctgccacctggacccctgca

SEQ ID NO: 2485665 - DNA, 23 bp, Homo sapiens
gcctgccacctggacccctgcat

SEQ ID NO: 2485666 - DNA, 16 bp, Homo sapiens
gccagtgccctgagcc

SEQ ID NO: 2485667 - DNA, 18 bp, Homo sapiens
gccagtgccctgagccag

SEQ ID NO: 2485668 - DNA, 14 bp, Homo sapiens
gccatattaaattt

SEQ ID NO: 2485669 - DNA, 16 bp, Homo sapiens
gccatatttacctcag

SEQ ID NO: 2485670 - DNA, 19 bp, Homo sapiens
gccatcacctcagatggca

SEQ ID NO: 2485671 - DNA, 23 bp, Homo sapiens
gccatcatctcctgccttcctcc

SEQ ID NO: 2485672 - DNA, 17 bp, Homo sapiens
gccatcccgtcttctcc

SEQ ID NO: 2485673 - DNA, 19 bp, Homo sapiens
gccatgacaacttctaatt

SEQ ID NO: 2485674 - DNA, 16 bp, Homo sapiens
gccatgaccctgcctc

SEQ ID NO: 2485675 - DNA, 18 bp, Homo sapiens
gccatgaccctgcctctc

SEQ ID NO: 2485676 - DNA, 20 bp, Homo sapiens
gccatgagttccagaaagta

SEQ ID NO: 2485677 - DNA, 15 bp, Homo sapiens
gccatgatgcctctg

SEQ ID NO: 2485678 - DNA, 18 bp, Homo sapiens
gccatgatgcctctgtct

SEQ ID NO: 2485679 - DNA, 21 bp, Homo sapiens
gccatgatggcaacagatctg

SEQ ID NO: 2485680 - DNA, 18 bp, Homo sapiens
gccatgctcctcttcccc

SEQ ID NO: 2485681 - DNA, 13 bp, Homo sapiens
gccatgctgaggc

SEQ ID NO: 2485682 - DNA, 17 bp, Homo sapiens
gccatgctgaggcctgg

SEQ ID NO: 2485683 - DNA, 19 bp, Homo sapiens
gccatgctgaggcctgggc

SEQ ID NO: 2485684 - DNA, 21 bp, Homo sapiens
gccatgctgaggcctgggccg

SEQ ID NO: 2485685 - DNA, 18 bp, Homo sapiens
gccatggactctgtcctg

SEQ ID NO: 2485686 - DNA, 22 bp, Homo sapiens
gccatggactctgtcctgaagg

SEQ ID NO: 2485687 - DNA, 18 bp, Homo sapiens
gccatgtccaaagaggct

SEQ ID NO: 2485688 - DNA, 17 bp, Homo sapiens
gccattctccacagcaa

SEQ ID NO: 2485689 - DNA, 14 bp, Homo sapiens
gccatttgtactga

SEQ ID NO: 2485690 - DNA, 21 bp, Homo sapiens
gcccaaaggacgcactgagca

SEQ ID NO: 2485691 - DNA, 18 bp, Homo sapiens
gcccaagccagaggctgg

SEQ ID NO: 2485692 - DNA, 21 bp, Homo sapiens
gcccaagccagaggctgggtt

SEQ ID NO: 2485693 - DNA, 19 bp, Homo sapiens
gcccaagttcatgcagctg

SEQ ID NO: 2485694 - DNA, 21 bp, Homo sapiens
gcccacacctccttccctctc

SEQ ID NO: 2485695 - DNA, 21 bp, Homo sapiens
gcccaccatttggcatccctg

SEQ ID NO: 2485696 - DNA, 21 bp, Homo sapiens
gcccaccccacccacttctgc

SEQ ID NO: 2485697 - DNA, 18 bp, Homo sapiens
gcccactccatctggtag

SEQ ID NO: 2485698 - DNA, 19 bp, Homo sapiens
gcccactccatctggtaga

SEQ ID NO: 2485699 - DNA, 17 bp, Homo sapiens
gcccactgtcctgggcc

SEQ ID NO: 2485700 - DNA, 21 bp, Homo sapiens
gcccactgtcctgggcctgca

SEQ ID NO: 2485701 - DNA, 24 bp, Homo sapiens
gcccactgtcctgggcctgcagaa

SEQ ID NO: 2485702 - DNA, 22 bp, Homo sapiens
gcccactgtgcctcagagacca

SEQ ID NO: 2485703 - DNA, 10 bp, Homo sapiens
gcccagagac

SEQ ID NO: 2485704 - DNA, 16 bp, Homo sapiens
gcccagagacccagcg

SEQ ID NO: 2485705 - DNA, 15 bp, Homo sapiens
gcccagagggtctgg

SEQ ID NO: 2485706 - DNA, 18 bp, Homo sapiens
gcccagagggtctggggg

SEQ ID NO: 2485707 - DNA, 19 bp, Homo sapiens
gcccagagggtctgggggc

SEQ ID NO: 2485708 - DNA, 21 bp, Homo sapiens
gcccagcactgcttgaggaaa

SEQ ID NO: 2485709 - DNA, 23 bp, Homo sapiens
gcccagccccactcctctgctga

SEQ ID NO: 2485710 - DNA, 13 bp, Homo sapiens
gcccagccgaccc

SEQ ID NO: 2485711 - DNA, 23 bp, Homo sapiens
gcccagcctttgttccccactgg

SEQ ID NO: 2485712 - DNA, 12 bp, Homo sapiens
gcccagctcctg

SEQ ID NO: 2485713 - DNA, 14 bp, Homo sapiens
gcccagctcctgac

SEQ ID NO: 2485714 - DNA, 13 bp, Homo sapiens
gcccagctctgaa

SEQ ID NO: 2485715 - DNA, 13 bp, Homo sapiens
gcccagctgggtc

SEQ ID NO: 2485716 - DNA, 14 bp, Homo sapiens
gcccagctgggtca

SEQ ID NO: 2485717 - DNA, 20 bp, Homo sapiens
gcccagctgggtcaggcagg

SEQ ID NO: 2485718 - DNA, 18 bp, Homo sapiens
gcccaggaagtctcatct

SEQ ID NO: 2485719 - DNA, 21 bp, Homo sapiens
gcccaggaagtctcatctggg

SEQ ID NO: 2485720 - DNA, 15 bp, Homo sapiens
gcccaggagctcccc

SEQ ID NO: 2485721 - DNA, 24 bp, Homo sapiens
gcccaggagctcccctccccaact

SEQ ID NO: 2485722 - DNA, 16 bp, Homo sapiens
gcccaggcactgcaaa

SEQ ID NO: 2485723 - DNA, 16 bp, Homo sapiens
gcccaggccaggactc

SEQ ID NO: 2485724 - DNA, 13 bp, Homo sapiens
gcccaggcccgga

SEQ ID NO: 2485725 - DNA, 19 bp, Homo sapiens
gcccaggctcggcctgccc

SEQ ID NO: 2485726 - DNA, 13 bp, Homo sapiens
gcccagggaggcc

SEQ ID NO: 2485727 - DNA, 15 bp, Homo sapiens
gcccagggcccagag

SEQ ID NO: 2485728 - DNA, 19 bp, Homo sapiens
gcccagggcccagagccca

SEQ ID NO: 2485729 - DNA, 15 bp, Homo sapiens
gcccagggctcctgc

SEQ ID NO: 2485730 - DNA, 18 bp, Homo sapiens
gcccagggctcctgcact

SEQ ID NO: 2485731 - DNA, 17 bp, Homo sapiens
gcccagggctgggagga

SEQ ID NO: 2485732 - DNA, 15 bp, Homo sapiens
gcccagtagaccttg

SEQ ID NO: 2485733 - DNA, 19 bp, Homo sapiens
gcccagttcaccctgattt

SEQ ID NO: 2485734 - DNA, 14 bp, Homo sapiens
gcccatcctgacca

SEQ ID NO: 2485735 - DNA, 18 bp, Homo sapiens
gcccatcctgaccagctg

SEQ ID NO: 2485736 - DNA, 19 bp, Homo sapiens
gcccatcctgtggtcactg

SEQ ID NO: 2485737 - DNA, 19 bp, Homo sapiens
gcccatggacaggctggct

SEQ ID NO: 2485738 - DNA, 19 bp, Homo sapiens
gccccaacccgtggaggct

SEQ ID NO: 2485739 - DNA, 22 bp, Homo sapiens
gccccaacccgtggaggctgct

SEQ ID NO: 2485740 - DNA, 21 bp, Homo sapiens
gccccaactccttccagctag

SEQ ID NO: 2485741 - DNA, 21 bp, Homo sapiens
gccccaactctcccctgacct

SEQ ID NO: 2485742 - DNA, 14 bp, Homo sapiens
gccccaagtcctca

SEQ ID NO: 2485743 - DNA, 16 bp, Homo sapiens
gccccacccaggccag

SEQ ID NO: 2485744 - DNA, 21 bp, Homo sapiens
gccccaccccagggcagccag

SEQ ID NO: 2485745 - DNA, 22 bp, Homo sapiens
gccccaccccagggcagccagg

SEQ ID NO: 2485746 - DNA, 13 bp, Homo sapiens
gccccaccctcgg

SEQ ID NO: 2485747 - DNA, 22 bp, Homo sapiens
gccccaccctcggggatgtgtc

SEQ ID NO: 2485748 - DNA, 14 bp, Homo sapiens
gccccaccctgggc

SEQ ID NO: 2485749 - DNA, 17 bp, Homo sapiens
gccccacttgtccttag

SEQ ID NO: 2485750 - DNA, 18 bp, Homo sapiens
gccccacttgtccttagc

SEQ ID NO: 2485751 - DNA, 15 bp, Homo sapiens
gccccaggaaaggcc

SEQ ID NO: 2485752 - DNA, 11 bp, Homo sapiens
gccccaggacc

SEQ ID NO: 2485753 - DNA, 14 bp, Homo sapiens
gccccaggaccagc

SEQ ID NO: 2485754 - DNA, 15 bp, Homo sapiens
gccccaggaccagct

SEQ ID NO: 2485755 - DNA, 17 bp, Homo sapiens
gccccaggaccagctca

SEQ ID NO: 2485756 - DNA, 22 bp, Homo sapiens
gccccaggacctggctgccata

SEQ ID NO: 2485757 - DNA, 12 bp, Homo sapiens
gccccaggcctg

SEQ ID NO: 2485758 - DNA, 15 bp, Homo sapiens
gccccaggcctgaaa

SEQ ID NO: 2485759 - DNA, 19 bp, Homo sapiens
gccccaggggaacactggg

SEQ ID NO: 2485760 - DNA, 14 bp, Homo sapiens
gccccatcagtgct

SEQ ID NO: 2485761 - DNA, 15 bp, Homo sapiens
gccccatgacctcca

SEQ ID NO: 2485762 - DNA, 15 bp, Homo sapiens
gccccattcctggga

SEQ ID NO: 2485763 - DNA, 17 bp, Homo sapiens
gcccccaaggaggcagc

SEQ ID NO: 2485764 - DNA, 14 bp, Homo sapiens
gcccccaccctgtt

SEQ ID NO: 2485765 - DNA, 22 bp, Homo sapiens
gcccccaccctgttcctgctgc

SEQ ID NO: 2485766 - DNA, 17 bp, Homo sapiens
gcccccaccgtgggcag

SEQ ID NO: 2485767 - DNA, 20 bp, Homo sapiens
gcccccaccgtgggcaggga

SEQ ID NO: 2485768 - DNA, 16 bp, Homo sapiens
gcccccacttgcctct

SEQ ID NO: 2485769 - DNA, 17 bp, Homo sapiens
gcccccagagcccaggc

SEQ ID NO: 2485770 - DNA, 19 bp, Homo sapiens
gcagtccacttctgacagc

SEQ ID NO: 2485771 - DNA, 22 bp, Homo sapiens
gcagtccacttctgacagcctc

SEQ ID NO: 2485772 - DNA, 17 bp, Homo sapiens
gcagtcctgcctcagcc

SEQ ID NO: 2485773 - DNA, 18 bp, Homo sapiens
gcagtcctgcctcagcct

SEQ ID NO: 2485774 - DNA, 16 bp, Homo sapiens
gcagtcgtgcctgtgt

SEQ ID NO: 2485775 - DNA, 18 bp, Homo sapiens
gcagtgtctgtgttttga

SEQ ID NO: 2485776 - DNA, 16 bp, Homo sapiens
gcagttcgcagccacc

SEQ ID NO: 2485777 - DNA, 17 bp, Homo sapiens
gcagttcgcagccaccc

SEQ ID NO: 2485778 - DNA, 18 bp, Homo sapiens
gcagttcgcagccaccct

SEQ ID NO: 2485779 - DNA, 15 bp, Homo sapiens
gcagtttatatttaa

SEQ ID NO: 2485780 - DNA, 13 bp, Homo sapiens
gcagtttgcaaaa

SEQ ID NO: 2485781 - DNA, 12 bp, Homo sapiens
gcagttttttga

SEQ ID NO: 2485782 - DNA, 20 bp, Homo sapiens
gcagttttttttttcttgtc

SEQ ID NO: 2485783 - DNA, 16 bp, Homo sapiens
gcataacaattcctct

SEQ ID NO: 2485784 - DNA, 14 bp, Homo sapiens
gcataacctgtctc

SEQ ID NO: 2485785 - DNA, 18 bp, Homo sapiens
gcatacctcctatgggtt

SEQ ID NO: 2485786 - DNA, 15 bp, Homo sapiens
gcatagctctggggt

SEQ ID NO: 2485787 - DNA, 19 bp, Homo sapiens
gcataggacctttccacca

SEQ ID NO: 2485788 - DNA, 18 bp, Homo sapiens
gcataggagtttggagga

SEQ ID NO: 2485789 - DNA, 21 bp, Homo sapiens
gcataggagtttggaggaagt

SEQ ID NO: 2485790 - DNA, 14 bp, Homo sapiens
gcatatgttgaata

SEQ ID NO: 2485791 - DNA, 17 bp, Homo sapiens
gcatatgttgaatactt

SEQ ID NO: 2485792 - DNA, 17 bp, Homo sapiens
gcatcagaaagaggcag

SEQ ID NO: 2485793 - DNA, 21 bp, Homo sapiens
gcatcagaaagggagggctct

SEQ ID NO: 2485794 - DNA, 23 bp, Homo sapiens
gcatcagaaagggagggctctga

SEQ ID NO: 2485795 - DNA, 12 bp, Homo sapiens
gcatcagggtta

SEQ ID NO: 2485796 - DNA, 15 bp, Homo sapiens
gcatcatgcctctga

SEQ ID NO: 2485797 - DNA, 17 bp, Homo sapiens
gcatcatgcctctgagg

SEQ ID NO: 2485798 - DNA, 17 bp, Homo sapiens
gcatccctgggccttgg

SEQ ID NO: 2485799 - DNA, 15 bp, Homo sapiens
gcatcctccagcccc

SEQ ID NO: 2485800 - DNA, 23 bp, Homo sapiens
gcatcgtcatgcacagtatttgt

SEQ ID NO: 2485801 - DNA, 19 bp, Homo sapiens
gcatctaagttataagact

SEQ ID NO: 2485802 - DNA, 22 bp, Homo sapiens
gcatctaagttataagactctc

SEQ ID NO: 2485803 - DNA, 22 bp, Homo sapiens
gcatctcaaaacagagggctgc

SEQ ID NO: 2485804 - DNA, 22 bp, Homo sapiens
gcatctctaccttctccccagc

SEQ ID NO: 2485805 - DNA, 16 bp, Homo sapiens
gcatctggcctggcca

SEQ ID NO: 2485806 - DNA, 12 bp, Homo sapiens
gcatctgggcct

SEQ ID NO: 2485807 - DNA, 14 bp, Homo sapiens
gcatctgggccttg

SEQ ID NO: 2485808 - DNA, 22 bp, Homo sapiens
gcatctgggccttggcctggag

SEQ ID NO: 2485809 - DNA, 13 bp, Homo sapiens
gcatctgtttatt

SEQ ID NO: 2485810 - DNA, 22 bp, Homo sapiens
gcatgaatttgtaatgtcttga

SEQ ID NO: 2485811 - DNA, 19 bp, Homo sapiens
gcatgaggggttcctcccc

SEQ ID NO: 2485812 - DNA, 23 bp, Homo sapiens
gcatgcactgttccccctgtgca

SEQ ID NO: 2485813 - DNA, 12 bp, Homo sapiens
gcatgcccagag

SEQ ID NO: 2485814 - DNA, 18 bp, Homo sapiens
gcatgcccagagacccag

SEQ ID NO: 2485815 - DNA, 16 bp, Homo sapiens
gcatggatttctttga

SEQ ID NO: 2485816 - DNA, 18 bp, Homo sapiens
gcatggatttctttgaaa

SEQ ID NO: 2485817 - DNA, 18 bp, Homo sapiens
gcatggcagggggctgct

SEQ ID NO: 2485818 - DNA, 19 bp, Homo sapiens
gcatggcagggggctgctg

SEQ ID NO: 2485819 - DNA, 17 bp, Homo sapiens
gcatggcatcctccagc

SEQ ID NO: 2485820 - DNA, 22 bp, Homo sapiens
gcatggctcagatcggccacag

SEQ ID NO: 2485821 - DNA, 15 bp, Homo sapiens
gcatggtcacacact

SEQ ID NO: 2485822 - DNA, 18 bp, Homo sapiens
gcatggtcacacactgat

SEQ ID NO: 2485823 - DNA, 21 bp, Homo sapiens
gcatggtcccacatccctggg

SEQ ID NO: 2485824 - DNA, 23 bp, Homo sapiens
gcatggtgccccaggaccagctc

SEQ ID NO: 2485825 - DNA, 16 bp, Homo sapiens
gcatggtgttctcctg

SEQ ID NO: 2485826 - DNA, 21 bp, Homo sapiens
gcatgtacggattttcagtta

SEQ ID NO: 2485827 - DNA, 23 bp, Homo sapiens
gcatgtagtaacactaatatatt

SEQ ID NO: 2485828 - DNA, 24 bp, Homo sapiens
gcatgtagtaacactaatatattt

SEQ ID NO: 2485829 - DNA, 14 bp, Homo sapiens
gcattaaattacag

SEQ ID NO: 2485830 - DNA, 15 bp, Homo sapiens
gcattaaattacaga

SEQ ID NO: 2485831 - DNA, 22 bp, Homo sapiens
gcattaaattcacaaactttta

SEQ ID NO: 2485832 - DNA, 18 bp, Homo sapiens
gcattagggatgcctcct

SEQ ID NO: 2485833 - DNA, 19 bp, Homo sapiens
gcattatgcaatttttata

SEQ ID NO: 2485834 - DNA, 22 bp, Homo sapiens
gcattattggaatataattgtt

SEQ ID NO: 2485835 - DNA, 23 bp, Homo sapiens
gcattattggaatataattgttt

SEQ ID NO: 2485836 - DNA, 16 bp, Homo sapiens
gcattccagcccctct

SEQ ID NO: 2485837 - DNA, 21 bp, Homo sapiens
gcattcccaggtaggccaagg

SEQ ID NO: 2485838 - DNA, 19 bp, Homo sapiens
gcattctggacctctgggt

SEQ ID NO: 2485839 - DNA, 21 bp, Homo sapiens
gcattgaacacaaactgtaaa

SEQ ID NO: 2485840 - DNA, 23 bp, Homo sapiens
gcattgaacacaaactgtaaata

SEQ ID NO: 2485841 - DNA, 22 bp, Homo sapiens
gcattgaccgcgactaatttca

SEQ ID NO: 2485842 - DNA, 15 bp, Homo sapiens
gcattgactttcccc

SEQ ID NO: 2485843 - DNA, 17 bp, Homo sapiens
gcattgactttccccac

SEQ ID NO: 2485844 - DNA, 16 bp, Homo sapiens
gcattgccaagggctt

SEQ ID NO: 2485845 - DNA, 16 bp, Homo sapiens
gcattgtaaaataatt

SEQ ID NO: 2485846 - DNA, 22 bp, Homo sapiens
gcatttaacccccctgtacaca

SEQ ID NO: 2485847 - DNA, 12 bp, Homo sapiens
gcatttcctggg

SEQ ID NO: 2485848 - DNA, 15 bp, Homo sapiens
gcatttgggtccagg

SEQ ID NO: 2485849 - DNA, 20 bp, Homo sapiens
gcatttgtttatgtaatttc

SEQ ID NO: 2485850 - DNA, 18 bp, Homo sapiens
gcattttcaccccaccct

SEQ ID NO: 2485851 - DNA, 12 bp, Homo sapiens
gcattttgtaat

SEQ ID NO: 2485852 - DNA, 19 bp, Homo sapiens
gccaaaggggacctggaag

SEQ ID NO: 2485853 - DNA, 18 bp, Homo sapiens
gccaaattaaaaaagata

SEQ ID NO: 2485854 - DNA, 23 bp, Homo sapiens
gccaaattaaaaaagataaacac

SEQ ID NO: 2485855 - DNA, 17 bp, Homo sapiens
gccaacacgcacctgcc

SEQ ID NO: 2485856 - DNA, 16 bp, Homo sapiens
gccaactagcccctgg

SEQ ID NO: 2485857 - DNA, 17 bp, Homo sapiens
gccaactagcccctggg

SEQ ID NO: 2485858 - DNA, 20 bp, Homo sapiens
gccaactagcccctggggtg

SEQ ID NO: 2485859 - DNA, 20 bp, Homo sapiens
gccaagaagcagtggcctta

SEQ ID NO: 2485860 - DNA, 23 bp, Homo sapiens
gccaagactgctgtggccaggag

SEQ ID NO: 2485861 - DNA, 16 bp, Homo sapiens
gccaagctccaagccc

SEQ ID NO: 2485862 - DNA, 22 bp, Homo sapiens
gccaagctgaggtgcccaggag

SEQ ID NO: 2485863 - DNA, 23 bp, Homo sapiens
gccaagctgaggtgcccaggaga

SEQ ID NO: 2485864 - DNA, 14 bp, Homo sapiens
gccaaggaaaggca

SEQ ID NO: 2485865 - DNA, 16 bp, Homo sapiens
gccaaggcagaggcct

SEQ ID NO: 2485866 - DNA, 21 bp, Homo sapiens
gccaaggcagaggcctgggct

SEQ ID NO: 2485867 - DNA, 14 bp, Homo sapiens
gccaaggtgtccta

SEQ ID NO: 2485868 - DNA, 21 bp, Homo sapiens
gccaaggtgtcctacagaaaa

SEQ ID NO: 2485869 - DNA, 20 bp, Homo sapiens
gccaaggttttataaggctg

SEQ ID NO: 2485870 - DNA, 16 bp, Homo sapiens
gccaagttcctctaac

SEQ ID NO: 2485871 - DNA, 22 bp, Homo sapiens
gccaatccctcaccttctgagt

SEQ ID NO: 2485872 - DNA, 17 bp, Homo sapiens
gccaattcagacaggca

SEQ ID NO: 2485873 - DNA, 18 bp, Homo sapiens
gccaattcagacaggcaa

SEQ ID NO: 2485874 - DNA, 17 bp, Homo sapiens
gccacaaggacttcctg

SEQ ID NO: 2485875 - DNA, 13 bp, Homo sapiens
gccacacagctgc

SEQ ID NO: 2485876 - DNA, 21 bp, Homo sapiens
gccacaccaggatagagactg

SEQ ID NO: 2485877 - DNA, 17 bp, Homo sapiens
gccacacttctcaggac

SEQ ID NO: 2485878 - DNA, 22 bp, Homo sapiens
gccacacttctcaggacacagg

SEQ ID NO: 2485879 - DNA, 15 bp, Homo sapiens
gccacagccctgtca

SEQ ID NO: 2485880 - DNA, 16 bp, Homo sapiens
gccacagcctcccctg

SEQ ID NO: 2485881 - DNA, 10 bp, Homo sapiens
gccacagctt

SEQ ID NO: 2485882 - DNA, 15 bp, Homo sapiens
gccacagcttttgca

SEQ ID NO: 2485883 - DNA, 18 bp, Homo sapiens
gccacagtagtcttgatg

SEQ ID NO: 2485884 - DNA, 22 bp, Homo sapiens
gccacatttggaatactttttg

SEQ ID NO: 2485885 - DNA, 14 bp, Homo sapiens
gccaccacgtccag

SEQ ID NO: 2485886 - DNA, 12 bp, Homo sapiens
gccaccaggcca

SEQ ID NO: 2485887 - DNA, 13 bp, Homo sapiens
gccaccagttctc

SEQ ID NO: 2485888 - DNA, 19 bp, Homo sapiens
gccaccagttctcatgggt

SEQ ID NO: 2485889 - DNA, 12 bp, Homo sapiens
ccgtgtaaatat

SEQ ID NO: 2485890 - DNA, 23 bp, Homo sapiens
ccgtgtgagaagtgaatgctggg

SEQ ID NO: 2485891 - DNA, 20 bp, Homo sapiens
ccgtgtgggagaccggcctg

SEQ ID NO: 2485892 - DNA, 21 bp, Homo sapiens
ccgtgtggtaagcaacatggc

SEQ ID NO: 2485893 - DNA, 13 bp, Homo sapiens
ccgttagctcctg

SEQ ID NO: 2485894 - DNA, 12 bp, Homo sapiens
ccgttgcatttg

SEQ ID NO: 2485895 - DNA, 14 bp, Homo sapiens
ccgttttgtcactt

SEQ ID NO: 2485896 - DNA, 22 bp, Homo sapiens
cctaaaagtgggcttgattctg

SEQ ID NO: 2485897 - DNA, 22 bp, Homo sapiens
cctaacaacattgtagcctcaa

SEQ ID NO: 2485898 - DNA, 14 bp, Homo sapiens
cctaactcttcttt

SEQ ID NO: 2485899 - DNA, 15 bp, Homo sapiens
cctaactcttctttc

SEQ ID NO: 2485900 - DNA, 15 bp, Homo sapiens
cctaagaggctgccc

SEQ ID NO: 2485901 - DNA, 16 bp, Homo sapiens
cctaagaggctgccct

SEQ ID NO: 2485902 - DNA, 19 bp, Homo sapiens
cctaagcagaaagtgcctt

SEQ ID NO: 2485903 - DNA, 23 bp, Homo sapiens
cctaagcagaaagtgcctttcag

SEQ ID NO: 2485904 - DNA, 16 bp, Homo sapiens
cctaagcatctaagtt

SEQ ID NO: 2485905 - DNA, 23 bp, Homo sapiens
cctaagggtcgaaagctctagaa

SEQ ID NO: 2485906 - DNA, 21 bp, Homo sapiens
cctaatccaggcagatccagg

SEQ ID NO: 2485907 - DNA, 20 bp, Homo sapiens
cctaatctatggtcgggaga

SEQ ID NO: 2485908 - DNA, 16 bp, Homo sapiens
cctaattcaattcaaa

SEQ ID NO: 2485909 - DNA, 20 bp, Homo sapiens
cctaattcaattcaaagctg

SEQ ID NO: 2485910 - DNA, 17 bp, Homo sapiens
cctaattctatgcctgt

SEQ ID NO: 2485911 - DNA, 14 bp, Homo sapiens
cctacagaaaaacc

SEQ ID NO: 2485912 - DNA, 20 bp, Homo sapiens
cctacagaacttcagaaaga

SEQ ID NO: 2485913 - DNA, 21 bp, Homo sapiens
cctacagggggtctggctggt

SEQ ID NO: 2485914 - DNA, 19 bp, Homo sapiens
cctacagttttaactgtgg

SEQ ID NO: 2485915 - DNA, 20 bp, Homo sapiens
cctacagttttaactgtgga

SEQ ID NO: 2485916 - DNA, 22 bp, Homo sapiens
cctaccccatggtgctaggaag

SEQ ID NO: 2485917 - DNA, 21 bp, Homo sapiens
cctaccccgcagacaccttgg

SEQ ID NO: 2485918 - DNA, 16 bp, Homo sapiens
cctactcacacaggca

SEQ ID NO: 2485919 - DNA, 15 bp, Homo sapiens
cctactgttctaaag

SEQ ID NO: 2485920 - DNA, 17 bp, Homo sapiens
cctagagaagacaggct

SEQ ID NO: 2485921 - DNA, 24 bp, Homo sapiens
cctagagaagacaggctggaagat

SEQ ID NO: 2485922 - DNA, 21 bp, Homo sapiens
cctagagtcccaggttggctc

SEQ ID NO: 2485923 - DNA, 14 bp, Homo sapiens
cctagatcctaagg

SEQ ID NO: 2485924 - DNA, 16 bp, Homo sapiens
cctagatcctaagggt

SEQ ID NO: 2485925 - DNA, 20 bp, Homo sapiens
cctagcagcaccgttctgtg

SEQ ID NO: 2485926 - DNA, 21 bp, Homo sapiens
cctagcgctatctccctgcct

SEQ ID NO: 2485927 - DNA, 20 bp, Homo sapiens
cctagctgtcctttttcctc

SEQ ID NO: 2485928 - DNA, 17 bp, Homo sapiens
cctaggaagcctcagat

SEQ ID NO: 2485929 - DNA, 22 bp, Homo sapiens
cctaggaagcctcagattcctt

SEQ ID NO: 2485930 - DNA, 11 bp, Homo sapiens
cctaggattct

SEQ ID NO: 2485931 - DNA, 14 bp, Homo sapiens
cctaggattctaaa

SEQ ID NO: 2485932 - DNA, 13 bp, Homo sapiens
cctaggcctgggc

SEQ ID NO: 2485933 - DNA, 15 bp, Homo sapiens
cctaggcctgggcag

SEQ ID NO: 2485934 - DNA, 21 bp, Homo sapiens
cctagtgaaggcttctctctg

SEQ ID NO: 2485935 - DNA, 18 bp, Homo sapiens
cctagttctagaaaaaca

SEQ ID NO: 2485936 - DNA, 14 bp, Homo sapiens
cctataagaagcct

SEQ ID NO: 2485937 - DNA, 22 bp, Homo sapiens
cctatacgcagcgtgctttaaa

SEQ ID NO: 2485938 - DNA, 20 bp, Homo sapiens
cctatctccagcggccctgt

SEQ ID NO: 2485939 - DNA, 17 bp, Homo sapiens
cctatctgggcttcctg

SEQ ID NO: 2485940 - DNA, 18 bp, Homo sapiens
cctatctgggcttcctgg

SEQ ID NO: 2485941 - DNA, 19 bp, Homo sapiens
cctatctgggcttcctgga

SEQ ID NO: 2485942 - DNA, 20 bp, Homo sapiens
cctatctgggcttcctggag

SEQ ID NO: 2485943 - DNA, 22 bp, Homo sapiens
cctatgacttgggcacccccag

SEQ ID NO: 2485944 - DNA, 14 bp, Homo sapiens
cctatgcatggttt

SEQ ID NO: 2485945 - DNA, 22 bp, Homo sapiens
cctatgcatggtttcagcacta

SEQ ID NO: 2485946 - DNA, 14 bp, Homo sapiens
cctatggagagccc

SEQ ID NO: 2485947 - DNA, 19 bp, Homo sapiens
cctatggagagccctggga

SEQ ID NO: 2485948 - DNA, 16 bp, Homo sapiens
cctattaacctagaga

SEQ ID NO: 2485949 - DNA, 12 bp, Homo sapiens
cctattatccca

SEQ ID NO: 2485950 - DNA, 17 bp, Homo sapiens
cctattatcccagctgc

SEQ ID NO: 2485951 - DNA, 14 bp, Homo sapiens
cctatttattgact

SEQ ID NO: 2485952 - DNA, 16 bp, Homo sapiens
cctcaaaggcccgctc

SEQ ID NO: 2485953 - DNA, 22 bp, Homo sapiens
cctcaaataaaaagtgcttttg

SEQ ID NO: 2485954 - DNA, 14 bp, Homo sapiens
cctcaacctcccaa

SEQ ID NO: 2485955 - DNA, 17 bp, Homo sapiens
cctcaagatgaaggcaa

SEQ ID NO: 2485956 - DNA, 14 bp, Homo sapiens
cctcaagtctttct

SEQ ID NO: 2485957 - DNA, 13 bp, Homo sapiens
cctcaatccagct

SEQ ID NO: 2485958 - DNA, 22 bp, Homo sapiens
cctcacagtattgctcacccag

SEQ ID NO: 2485959 - DNA, 12 bp, Homo sapiens
cctcaccattcc

SEQ ID NO: 2485960 - DNA, 21 bp, Homo sapiens
cctcacccacccctgcacagt

SEQ ID NO: 2485961 - DNA, 14 bp, Homo sapiens
cctcacctcctcta

SEQ ID NO: 2485962 - DNA, 17 bp, Homo sapiens
cctcactggctctcctg

SEQ ID NO: 2485963 - DNA, 18 bp, Homo sapiens
cctcactggctctcctgg

SEQ ID NO: 2485964 - DNA, 19 bp, Homo sapiens
cctcactggctctcctggc

SEQ ID NO: 2485965 - DNA, 19 bp, Homo sapiens
cctcagactctaagaaaga

SEQ ID NO: 2485966 - DNA, 21 bp, Homo sapiens
cctcagactctaagaaagaac

SEQ ID NO: 2485967 - DNA, 21 bp, Homo sapiens
cctcagattccttcccatgga

SEQ ID NO: 2485968 - DNA, 18 bp, Homo sapiens
cctcagccacttgcctgt

SEQ ID NO: 2485969 - DNA, 13 bp, Homo sapiens
cctcagccagcct

SEQ ID NO: 2485970 - DNA, 19 bp, Homo sapiens
cctcagcctcccaaagtgc

SEQ ID NO: 2485971 - DNA, 21 bp, Homo sapiens
cctcagcctgaaccccagggc

SEQ ID NO: 2485972 - DNA, 22 bp, Homo sapiens
cctcagcctgaaccccagggct

SEQ ID NO: 2485973 - DNA, 14 bp, Homo sapiens
cctcagcctggcca

SEQ ID NO: 2485974 - DNA, 15 bp, Homo sapiens
cctcagcctggccag

SEQ ID NO: 2485975 - DNA, 18 bp, Homo sapiens
cctcagcctggccagaca

SEQ ID NO: 2485976 - DNA, 20 bp, Homo sapiens
cctcagcctggccagacaca

SEQ ID NO: 2485977 - DNA, 21 bp, Homo sapiens
cctcagcctggccagacacag

SEQ ID NO: 2485978 - DNA, 22 bp, Homo sapiens
cctcagcctggccagacacagg

SEQ ID NO: 2485979 - DNA, 21 bp, Homo sapiens
cctcagcctgggcgctggtcc

SEQ ID NO: 2485980 - DNA, 15 bp, Homo sapiens
cctcagctcccacaa

SEQ ID NO: 2485981 - DNA, 16 bp, Homo sapiens
cctcaggactgggagc

SEQ ID NO: 2485982 - DNA, 22 bp, Homo sapiens
cctcaggcaatctgcccgcctg

SEQ ID NO: 2485983 - DNA, 16 bp, Homo sapiens
cctcagggactcaggt

SEQ ID NO: 2485984 - DNA, 22 bp, Homo sapiens
cctcagggcaaagccaggtccc

SEQ ID NO: 2485985 - DNA, 16 bp, Homo sapiens
cctcagggctccttgt

SEQ ID NO: 2485986 - DNA, 22 bp, Homo sapiens
cctcagggctccttgtgggcct

SEQ ID NO: 2485987 - DNA, 23 bp, Homo sapiens
cctcagggctccttgtgggcctg

SEQ ID NO: 2485988 - DNA, 13 bp, Homo sapiens
cctcaggggtctg

SEQ ID NO: 2485989 - DNA, 23 bp, Homo sapiens
cctcaggggtctgagctccagct

SEQ ID NO: 2485990 - DNA, 18 bp, Homo sapiens
cctcagtagtccctgcac

SEQ ID NO: 2485991 - DNA, 23 bp, Homo sapiens
cctcagtagtccctgcacagtga

SEQ ID NO: 2485992 - DNA, 18 bp, Homo sapiens
cctcagtgaccctggctc

SEQ ID NO: 2485993 - DNA, 20 bp, Homo sapiens
gcagatgacctcgtactcag

SEQ ID NO: 2485994 - DNA, 14 bp, Homo sapiens
gcagatgtaggagg

SEQ ID NO: 2485995 - DNA, 21 bp, Homo sapiens
gcagattcagaaatgaggcca

SEQ ID NO: 2485996 - DNA, 19 bp, Homo sapiens
gcagattctcccttgctct

SEQ ID NO: 2485997 - DNA, 21 bp, Homo sapiens
gcagattctcccttgctctgc

SEQ ID NO: 2485998 - DNA, 16 bp, Homo sapiens
gcagcaacttgtccta

SEQ ID NO: 2485999 - DNA, 18 bp, Homo sapiens
gcagcaacttgtcctagc

SEQ ID NO: 2486000 - DNA, 16 bp, Homo sapiens
gcagcaaggcccgagc

SEQ ID NO: 2486001 - DNA, 17 bp, Homo sapiens
gcagcaaggcccgagca

SEQ ID NO: 2486002 - DNA, 15 bp, Homo sapiens
gcagcacagctgaga

SEQ ID NO: 2486003 - DNA, 15 bp, Homo sapiens
gcagcacctcctcag

SEQ ID NO: 2486004 - DNA, 17 bp, Homo sapiens
gcagcacctcctcagcc

SEQ ID NO: 2486005 - DNA, 20 bp, Homo sapiens
gcagcacctcctcagcctga

SEQ ID NO: 2486006 - DNA, 13 bp, Homo sapiens
gcagcacctgccc

SEQ ID NO: 2486007 - DNA, 17 bp, Homo sapiens
gcagcacctgccctacc

SEQ ID NO: 2486008 - DNA, 13 bp, Homo sapiens
gcagcagccagcc

SEQ ID NO: 2486009 - DNA, 14 bp, Homo sapiens
gcagcagccagccc

SEQ ID NO: 2486010 - DNA, 19 bp, Homo sapiens
gcagcagccagccctgcct

SEQ ID NO: 2486011 - DNA, 22 bp, Homo sapiens
gcagcagccagccctgcctgga

SEQ ID NO: 2486012 - DNA, 13 bp, Homo sapiens
gcagcaggagggg

SEQ ID NO: 2486013 - DNA, 14 bp, Homo sapiens
gcagcaggaggggg

SEQ ID NO: 2486014 - DNA, 15 bp, Homo sapiens
gcagcaggagggggg

SEQ ID NO: 2486015 - DNA, 21 bp, Homo sapiens
gcagcaggaggggggagggaa

SEQ ID NO: 2486016 - DNA, 12 bp, Homo sapiens
gcagcagggcta

SEQ ID NO: 2486017 - DNA, 17 bp, Homo sapiens
gcagcagggctaccctg

SEQ ID NO: 2486018 - DNA, 13 bp, Homo sapiens
gcagcaggggttg

SEQ ID NO: 2486019 - DNA, 14 bp, Homo sapiens
gcagcatctctacc

SEQ ID NO: 2486020 - DNA, 14 bp, Homo sapiens
gcagccaccctgag

SEQ ID NO: 2486021 - DNA, 15 bp, Homo sapiens
gcagccaccctgagg

SEQ ID NO: 2486022 - DNA, 21 bp, Homo sapiens
gcagccaccctgaggagtctg

SEQ ID NO: 2486023 - DNA, 15 bp, Homo sapiens
gcagccagcatctgg

SEQ ID NO: 2486024 - DNA, 17 bp, Homo sapiens
gcagccagcatctgggc

SEQ ID NO: 2486025 - DNA, 11 bp, Homo sapiens
gcagccagccc

SEQ ID NO: 2486026 - DNA, 14 bp, Homo sapiens
gcagccagccctgc

SEQ ID NO: 2486027 - DNA, 16 bp, Homo sapiens
gcagccagccctgcct

SEQ ID NO: 2486028 - DNA, 17 bp, Homo sapiens
gcagccagccctgcctg

SEQ ID NO: 2486029 - DNA, 18 bp, Homo sapiens
gcagccagccctgcctgg

SEQ ID NO: 2486030 - DNA, 22 bp, Homo sapiens
gcagccagccctgcctggagga

SEQ ID NO: 2486031 - DNA, 20 bp, Homo sapiens
gcagccagggagagcccagg

SEQ ID NO: 2486032 - DNA, 21 bp, Homo sapiens
gcagccagggagagcccagga

SEQ ID NO: 2486033 - DNA, 18 bp, Homo sapiens
gcagccagtgccctgagc

SEQ ID NO: 2486034 - DNA, 14 bp, Homo sapiens
gcagcccagccagc

SEQ ID NO: 2486035 - DNA, 14 bp, Homo sapiens
gcagcccttccaaa

SEQ ID NO: 2486036 - DNA, 22 bp, Homo sapiens
gcagccgaggtccctgctgcca

SEQ ID NO: 2486037 - DNA, 16 bp, Homo sapiens
gcagccgctgagcgag

SEQ ID NO: 2486038 - DNA, 17 bp, Homo sapiens
gcagccgctgagcgagg

SEQ ID NO: 2486039 - DNA, 21 bp, Homo sapiens
gcagcctcgcccctggcagag

SEQ ID NO: 2486040 - DNA, 20 bp, Homo sapiens
gcagcctctccccaggtcca

SEQ ID NO: 2486041 - DNA, 15 bp, Homo sapiens
gcagcctctgggggg

SEQ ID NO: 2486042 - DNA, 23 bp, Homo sapiens
gcagcctgcgccaccgcccagag

SEQ ID NO: 2486043 - DNA, 10 bp, Homo sapiens
gcagcctggg

SEQ ID NO: 2486044 - DNA, 15 bp, Homo sapiens
gcagcgagcctgcta

SEQ ID NO: 2486045 - DNA, 13 bp, Homo sapiens
gcagcgccaggct

SEQ ID NO: 2486046 - DNA, 13 bp, Homo sapiens
gcagctcctctgt

SEQ ID NO: 2486047 - DNA, 16 bp, Homo sapiens
gcagctcctctgtctc

SEQ ID NO: 2486048 - DNA, 12 bp, Homo sapiens
gcagctgagcag

SEQ ID NO: 2486049 - DNA, 17 bp, Homo sapiens
gcagctgttttgttgac

SEQ ID NO: 2486050 - DNA, 20 bp, Homo sapiens
gcagctgttttgttgacatt

SEQ ID NO: 2486051 - DNA, 12 bp, Homo sapiens
gcagcttccaga

SEQ ID NO: 2486052 - DNA, 21 bp, Homo sapiens
gcagcttctgccccctgcaga

SEQ ID NO: 2486053 - DNA, 15 bp, Homo sapiens
gcagcttgtagccag

SEQ ID NO: 2486054 - DNA, 17 bp, Homo sapiens
gcagcttgtagccagcc

SEQ ID NO: 2486055 - DNA, 18 bp, Homo sapiens
gcagcttgtagccagccg

SEQ ID NO: 2486056 - DNA, 23 bp, Homo sapiens
gcagcttgtagccagccggggcg

SEQ ID NO: 2486057 - DNA, 23 bp, Homo sapiens
gcaggaaatgaaaatgtcttgtg

SEQ ID NO: 2486058 - DNA, 14 bp, Homo sapiens
gcaggaaggagctg

SEQ ID NO: 2486059 - DNA, 21 bp, Homo sapiens
gcaggaaggagctgcctggac

SEQ ID NO: 2486060 - DNA, 23 bp, Homo sapiens
gcaggaaggagctgcctggaccc

SEQ ID NO: 2486061 - DNA, 21 bp, Homo sapiens
gcaggagcggcagatggggag

SEQ ID NO: 2486062 - DNA, 20 bp, Homo sapiens
gcaggatctcaccaggcagc

SEQ ID NO: 2486063 - DNA, 17 bp, Homo sapiens
gcaggcaggctcccagg

SEQ ID NO: 2486064 - DNA, 19 bp, Homo sapiens
gcaggcagggctctcctgg

SEQ ID NO: 2486065 - DNA, 20 bp, Homo sapiens
gcaggcagggctctcctggc

SEQ ID NO: 2486066 - DNA, 20 bp, Homo sapiens
gcaggccacacttcaaacta

SEQ ID NO: 2486067 - DNA, 21 bp, Homo sapiens
gcaggccacacttcaaactac

SEQ ID NO: 2486068 - DNA, 23 bp, Homo sapiens
gcaggccacacttcaaactactt

SEQ ID NO: 2486069 - DNA, 22 bp, Homo sapiens
gcaggccacctggctctcacct

SEQ ID NO: 2486070 - DNA, 15 bp, Homo sapiens
gcaggccctggcctc

SEQ ID NO: 2486071 - DNA, 16 bp, Homo sapiens
gcaggccctggcctcc

SEQ ID NO: 2486072 - DNA, 20 bp, Homo sapiens
gcaggccgtgacgtctgggt

SEQ ID NO: 2486073 - DNA, 22 bp, Homo sapiens
gcaggctggccagtccaggctg

SEQ ID NO: 2486074 - DNA, 13 bp, Homo sapiens
gcaggctgggcca

SEQ ID NO: 2486075 - DNA, 16 bp, Homo sapiens
gcagggagctgggctt

SEQ ID NO: 2486076 - DNA, 17 bp, Homo sapiens
gcagggagctgggcttc

SEQ ID NO: 2486077 - DNA, 13 bp, Homo sapiens
gcagggcagtcat

SEQ ID NO: 2486078 - DNA, 22 bp, Homo sapiens
gcagggccggggaactggccaa

SEQ ID NO: 2486079 - DNA, 14 bp, Homo sapiens
gcagggcctctgtc

SEQ ID NO: 2486080 - DNA, 18 bp, Homo sapiens
gcagggcgggcagagggc

SEQ ID NO: 2486081 - DNA, 21 bp, Homo sapiens
gcagggcgggcagagggctgg

SEQ ID NO: 2486082 - DNA, 23 bp, Homo sapiens
gcagggctaccctgagctgaggc

SEQ ID NO: 2486083 - DNA, 15 bp, Homo sapiens
gcagggctctcctgg

SEQ ID NO: 2486084 - DNA, 14 bp, Homo sapiens
gcaggggcctggag

SEQ ID NO: 2486085 - DNA, 13 bp, Homo sapiens
gcaggggcttcct

SEQ ID NO: 2486086 - DNA, 14 bp, Homo sapiens
gcaggggcttcctg

SEQ ID NO: 2486087 - DNA, 15 bp, Homo sapiens
gcagggggctgctgc

SEQ ID NO: 2486088 - DNA, 22 bp, Homo sapiens
gcagggggctgctgctgggctc

SEQ ID NO: 2486089 - DNA, 19 bp, Homo sapiens
gcaggggttggggaaacag

SEQ ID NO: 2486090 - DNA, 22 bp, Homo sapiens
gcagggtgcagtatcatgccct

SEQ ID NO: 2486091 - DNA, 22 bp, Homo sapiens
gcagggtgggcttgtggggcct

SEQ ID NO: 2486092 - DNA, 15 bp, Homo sapiens
gcaggttcccaagct

SEQ ID NO: 2486093 - DNA, 16 bp, Homo sapiens
gcaggttcccaagctc

SEQ ID NO: 2486094 - DNA, 17 bp, Homo sapiens
gcaggttcttgttggtg

SEQ ID NO: 2486095 - DNA, 23 bp, Homo sapiens
gcaggttcttgttggtgcacagc

SEQ ID NO: 2486096 - DNA, 19 bp, Homo sapiens
gcagtacctgggcaagctg

SEQ ID NO: 2486097 - DNA, 18 bp, Homo sapiens
gcagtccacttctgacag

SEQ ID NO: 2486098 - DNA, 18 bp, Homo sapiens
actgttgcacgtgtgttt

SEQ ID NO: 2486099 - DNA, 19 bp, Homo sapiens
actgtttatacactgtgta

SEQ ID NO: 2486100 - DNA, 20 bp, Homo sapiens
actgtttgtttacaaaatca

SEQ ID NO: 2486101 - DNA, 22 bp, Homo sapiens
actgttttctctcggctcccca

SEQ ID NO: 2486102 - DNA, 23 bp, Homo sapiens
actgttttctctcggctccccat

SEQ ID NO: 2486103 - DNA, 15 bp, Homo sapiens
actgttttttaagtc

SEQ ID NO: 2486104 - DNA, 22 bp, Homo sapiens
acttaaagctttcagaatatgt

SEQ ID NO: 2486105 - DNA, 16 bp, Homo sapiens
acttaaatagtatttc

SEQ ID NO: 2486106 - DNA, 18 bp, Homo sapiens
acttaatactaccttgaa

SEQ ID NO: 2486107 - DNA, 19 bp, Homo sapiens
acttaatactaccttgaaa

SEQ ID NO: 2486108 - DNA, 21 bp, Homo sapiens
acttaatactaccttgaaaat

SEQ ID NO: 2486109 - DNA, 19 bp, Homo sapiens
acttaatactcaaatgagt

SEQ ID NO: 2486110 - DNA, 14 bp, Homo sapiens
acttacatttacaa

SEQ ID NO: 2486111 - DNA, 21 bp, Homo sapiens
acttaccaggcaccaaaagaa

SEQ ID NO: 2486112 - DNA, 22 bp, Homo sapiens
acttaccaggcaccaaaagaag

SEQ ID NO: 2486113 - DNA, 20 bp, Homo sapiens
acttagaaaaccagctcagc

SEQ ID NO: 2486114 - DNA, 16 bp, Homo sapiens
acttatctgatcagaa

SEQ ID NO: 2486115 - DNA, 21 bp, Homo sapiens
acttcaaactactttgctgct

SEQ ID NO: 2486116 - DNA, 23 bp, Homo sapiens
acttcaagcatggctattttata

SEQ ID NO: 2486117 - DNA, 16 bp, Homo sapiens
acttcagaaagacttg

SEQ ID NO: 2486118 - DNA, 18 bp, Homo sapiens
acttcaggtatacctcac

SEQ ID NO: 2486119 - DNA, 19 bp, Homo sapiens
acttccaaatcccctaagc

SEQ ID NO: 2486120 - DNA, 16 bp, Homo sapiens
acttccacagggtccc

SEQ ID NO: 2486121 - DNA, 12 bp, Homo sapiens
acttccctgtgt

SEQ ID NO: 2486122 - DNA, 15 bp, Homo sapiens
acttcctcctcccca

SEQ ID NO: 2486123 - DNA, 14 bp, Homo sapiens
acttcgacactgtt

SEQ ID NO: 2486124 - DNA, 16 bp, Homo sapiens
acttcgacactgttct

SEQ ID NO: 2486125 - DNA, 23 bp, Homo sapiens
acttcgacactgttcttagctca

SEQ ID NO: 2486126 - DNA, 17 bp, Homo sapiens
acttcggggctgggaag

SEQ ID NO: 2486127 - DNA, 17 bp, Homo sapiens
acttctaattgccatgt

SEQ ID NO: 2486128 - DNA, 17 bp, Homo sapiens
acttctcactaatttgt

SEQ ID NO: 2486129 - DNA, 18 bp, Homo sapiens
acttctcaggacacaggc

SEQ ID NO: 2486130 - DNA, 20 bp, Homo sapiens
acttctcaggacacaggcct

SEQ ID NO: 2486131 - DNA, 21 bp, Homo sapiens
acttctcaggacacaggcctg

SEQ ID NO: 2486132 - DNA, 20 bp, Homo sapiens
acttctcattttttaaaaaa

SEQ ID NO: 2486133 - DNA, 14 bp, Homo sapiens
acttctctttgcct

SEQ ID NO: 2486134 - DNA, 16 bp, Homo sapiens
acttctgacagcctca

SEQ ID NO: 2486135 - DNA, 20 bp, Homo sapiens
acttcttatggaattgattt

SEQ ID NO: 2486136 - DNA, 23 bp, Homo sapiens
acttcttatggaattgatttgca

SEQ ID NO: 2486137 - DNA, 18 bp, Homo sapiens
acttcttgcttctttcta

SEQ ID NO: 2486138 - DNA, 20 bp, Homo sapiens
acttgaaatatcctgcttga

SEQ ID NO: 2486139 - DNA, 20 bp, Homo sapiens
acttgaacgttttctaattg

SEQ ID NO: 2486140 - DNA, 21 bp, Homo sapiens
acttgaacgttttctaattgc

SEQ ID NO: 2486141 - DNA, 15 bp, Homo sapiens
acttgaagggccaga

SEQ ID NO: 2486142 - DNA, 18 bp, Homo sapiens
acttgaagggccagagcc

SEQ ID NO: 2486143 - DNA, 19 bp, Homo sapiens
acttgaagggccagagcca

SEQ ID NO: 2486144 - DNA, 19 bp, Homo sapiens
acttgacccccttgagggt

SEQ ID NO: 2486145 - DNA, 20 bp, Homo sapiens
acttgatccatttctaatta

SEQ ID NO: 2486146 - DNA, 19 bp, Homo sapiens
acttgccaaatttagattt

SEQ ID NO: 2486147 - DNA, 18 bp, Homo sapiens
acttgcctgcctttccat

SEQ ID NO: 2486148 - DNA, 17 bp, Homo sapiens
acttgcgagaaattcgt

SEQ ID NO: 2486149 - DNA, 23 bp, Homo sapiens
acttggaactgaagggggcggcc

SEQ ID NO: 2486150 - DNA, 14 bp, Homo sapiens
acttggagggccca

SEQ ID NO: 2486151 - DNA, 20 bp, Homo sapiens
acttggatttagtttcagta

SEQ ID NO: 2486152 - DNA, 14 bp, Homo sapiens
acttggcagccttg

SEQ ID NO: 2486153 - DNA, 22 bp, Homo sapiens
acttggctggtgtggtacagag

SEQ ID NO: 2486154 - DNA, 13 bp, Homo sapiens
acttgggcacccc

SEQ ID NO: 2486155 - DNA, 21 bp, Homo sapiens
acttggggagttaagacctgg

SEQ ID NO: 2486156 - DNA, 23 bp, Homo sapiens
acttggggagttaagacctggca

SEQ ID NO: 2486157 - DNA, 19 bp, Homo sapiens
acttgggggttcaggcccg

SEQ ID NO: 2486158 - DNA, 17 bp, Homo sapiens
acttgtaaatataaaga

SEQ ID NO: 2486159 - DNA, 19 bp, Homo sapiens
acttgtaaatataaagacg

SEQ ID NO: 2486160 - DNA, 16 bp, Homo sapiens
acttgtaattatggag

SEQ ID NO: 2486161 - DNA, 14 bp, Homo sapiens
acttgtatatttta

SEQ ID NO: 2486162 - DNA, 18 bp, Homo sapiens
acttgtcctagcacagat

SEQ ID NO: 2486163 - DNA, 23 bp, Homo sapiens
acttgttggcgtaggctacagag

SEQ ID NO: 2486164 - DNA, 17 bp, Homo sapiens
acttgttttatgctcag

SEQ ID NO: 2486165 - DNA, 13 bp, Homo sapiens
actttaaattgtg

SEQ ID NO: 2486166 - DNA, 14 bp, Homo sapiens
actttaacataagc

SEQ ID NO: 2486167 - DNA, 18 bp, Homo sapiens
actttacacaatagaatt

SEQ ID NO: 2486168 - DNA, 16 bp, Homo sapiens
actttataactaacat

SEQ ID NO: 2486169 - DNA, 18 bp, Homo sapiens
actttataactaacatgt

SEQ ID NO: 2486170 - DNA, 15 bp, Homo sapiens
actttatcacttaaa

SEQ ID NO: 2486171 - DNA, 18 bp, Homo sapiens
actttcattccttcagat

SEQ ID NO: 2486172 - DNA, 17 bp, Homo sapiens
actcacaccactagcct

SEQ ID NO: 2486173 - DNA, 18 bp, Homo sapiens
actcacaccactagcctc

SEQ ID NO: 2486174 - DNA, 16 bp, Homo sapiens
actcacagtgctttta

SEQ ID NO: 2486175 - DNA, 14 bp, Homo sapiens
actcactaggcccc

SEQ ID NO: 2486176 - DNA, 17 bp, Homo sapiens
actcactaggcccccac

SEQ ID NO: 2486177 - DNA, 22 bp, Homo sapiens
actcactaggcccccacttgcc

SEQ ID NO: 2486178 - DNA, 14 bp, Homo sapiens
actcacttttccca

SEQ ID NO: 2486179 - DNA, 15 bp, Homo sapiens
actcacttttcccac

SEQ ID NO: 2486180 - DNA, 14 bp, Homo sapiens
actcagaagcctgg

SEQ ID NO: 2486181 - DNA, 14 bp, Homo sapiens
actcagagacatgc

SEQ ID NO: 2486182 - DNA, 17 bp, Homo sapiens
actcagagacatgcaga

SEQ ID NO: 2486183 - DNA, 22 bp, Homo sapiens
actcagataaggtaaaatgcca

SEQ ID NO: 2486184 - DNA, 11 bp, Homo sapiens
actcaggagcc

SEQ ID NO: 2486185 - DNA, 21 bp, Homo sapiens
actcagggcagcgccaggctg

SEQ ID NO: 2486186 - DNA, 16 bp, Homo sapiens
actcagggctcctggg

SEQ ID NO: 2486187 - DNA, 19 bp, Homo sapiens
actcagtctctcttctctc

SEQ ID NO: 2486188 - DNA, 23 bp, Homo sapiens
actcagtctctcttctctccagc

SEQ ID NO: 2486189 - DNA, 20 bp, Homo sapiens
actcatcaatggggccagtc

SEQ ID NO: 2486190 - DNA, 13 bp, Homo sapiens
actcattcattag

SEQ ID NO: 2486191 - DNA, 19 bp, Homo sapiens
actcattctgaaggagccc

SEQ ID NO: 2486192 - DNA, 20 bp, Homo sapiens
actcatttttcatgataatg

SEQ ID NO: 2486193 - DNA, 23 bp, Homo sapiens
actcatttttcatgataatgaac

SEQ ID NO: 2486194 - DNA, 15 bp, Homo sapiens
actccaagcccagcc

SEQ ID NO: 2486195 - DNA, 19 bp, Homo sapiens
actccaggcccaaggctcc

SEQ ID NO: 2486196 - DNA, 18 bp, Homo sapiens
actccagttaaaaaaaat

SEQ ID NO: 2486197 - DNA, 16 bp, Homo sapiens
actcccattcctgaag

SEQ ID NO: 2486198 - DNA, 20 bp, Homo sapiens
actcccattcctgaagaacc

SEQ ID NO: 2486199 - DNA, 18 bp, Homo sapiens
actccctcctaacctaga

SEQ ID NO: 2486200 - DNA, 21 bp, Homo sapiens
actccctctcaggatccaagc

SEQ ID NO: 2486201 - DNA, 14 bp, Homo sapiens
actcccttgggctc

SEQ ID NO: 2486202 - DNA, 23 bp, Homo sapiens
actccgagaggtgggccagtctg

SEQ ID NO: 2486203 - DNA, 15 bp, Homo sapiens
actccgttggccact

SEQ ID NO: 2486204 - DNA, 18 bp, Homo sapiens
actccgttggccactccg

SEQ ID NO: 2486205 - DNA, 21 bp, Homo sapiens
actccgttggccactccgaga

SEQ ID NO: 2486206 - DNA, 16 bp, Homo sapiens
actcctagctgtcctt

SEQ ID NO: 2486207 - DNA, 18 bp, Homo sapiens
actcctagttctagaaaa

SEQ ID NO: 2486208 - DNA, 15 bp, Homo sapiens
actcctcccagggtt

SEQ ID NO: 2486209 - DNA, 22 bp, Homo sapiens
actcctcccagggttttaactt

SEQ ID NO: 2486210 - DNA, 16 bp, Homo sapiens
actcctctgctgacct

SEQ ID NO: 2486211 - DNA, 13 bp, Homo sapiens
actcctgaaaaaa

SEQ ID NO: 2486212 - DNA, 19 bp, Homo sapiens
actcctgaaaaaaaacctg

SEQ ID NO: 2486213 - DNA, 14 bp, Homo sapiens
actcctgacctcag

SEQ ID NO: 2486214 - DNA, 18 bp, Homo sapiens
actcctgtgggagcctcg

SEQ ID NO: 2486215 - DNA, 13 bp, Homo sapiens
actccttccagct

SEQ ID NO: 2486216 - DNA, 11 bp, Homo sapiens
actccttcctg

SEQ ID NO: 2486217 - DNA, 12 bp, Homo sapiens
actccttcctgc

SEQ ID NO: 2486218 - DNA, 13 bp, Homo sapiens
actccttcctgcc

SEQ ID NO: 2486219 - DNA, 16 bp, Homo sapiens
actcgctagcagtggc

SEQ ID NO: 2486220 - DNA, 22 bp, Homo sapiens
actcggcagcccttccaaactc

SEQ ID NO: 2486221 - DNA, 21 bp, Homo sapiens
actcggcctcccaaagtgctg

SEQ ID NO: 2486222 - DNA, 12 bp, Homo sapiens
actcggtttctc

SEQ ID NO: 2486223 - DNA, 19 bp, Homo sapiens
actcgtatagcatgcatct

SEQ ID NO: 2486224 - DNA, 15 bp, Homo sapiens
actctaaaattataa

SEQ ID NO: 2486225 - DNA, 14 bp, Homo sapiens
actctaaagtctgt

SEQ ID NO: 2486226 - DNA, 17 bp, Homo sapiens
actctacccatattaca

SEQ ID NO: 2486227 - DNA, 19 bp, Homo sapiens
actctacttaatccaatgg

SEQ ID NO: 2486228 - DNA, 21 bp, Homo sapiens
actctacttaatccaatgggt

SEQ ID NO: 2486229 - DNA, 14 bp, Homo sapiens
actctagagtccaa

SEQ ID NO: 2486230 - DNA, 22 bp, Homo sapiens
actctagatgaagttttacatt

SEQ ID NO: 2486231 - DNA, 12 bp, Homo sapiens
actctattcttt

SEQ ID NO: 2486232 - DNA, 13 bp, Homo sapiens
actctattcttta

SEQ ID NO: 2486233 - DNA, 14 bp, Homo sapiens
actctattctttaa

SEQ ID NO: 2486234 - DNA, 22 bp, Homo sapiens
actctcaggaccaaagctttca

SEQ ID NO: 2486235 - DNA, 17 bp, Homo sapiens
actctcagtctctgagc

SEQ ID NO: 2486236 - DNA, 18 bp, Homo sapiens
actctcagtctctgagca

SEQ ID NO: 2486237 - DNA, 19 bp, Homo sapiens
actctccccacgagggctg

SEQ ID NO: 2486238 - DNA, 20 bp, Homo sapiens
actctccccacgagggctgg

SEQ ID NO: 2486239 - DNA, 20 bp, Homo sapiens
actctcctaggcattctgga

SEQ ID NO: 2486240 - DNA, 14 bp, Homo sapiens
actctcctgccttg

SEQ ID NO: 2486241 - DNA, 23 bp, Homo sapiens
actctcctgccttgaaaaagaca

SEQ ID NO: 2486242 - DNA, 21 bp, Homo sapiens
actctgagtgttttatgagaa

SEQ ID NO: 2486243 - DNA, 16 bp, Homo sapiens
actctgcagcctcaga

SEQ ID NO: 2486244 - DNA, 19 bp, Homo sapiens
actctgcctacagaacttc

SEQ ID NO: 2486245 - DNA, 14 bp, Homo sapiens
actctgctctgatg

SEQ ID NO: 2486246 - DNA, 15 bp, Homo sapiens
actctgctctgatgc

SEQ ID NO: 2486247 - DNA, 16 bp, Homo sapiens
actctgcttctctgac

SEQ ID NO: 2486248 - DNA, 17 bp, Homo sapiens
actctgcttctctgact

SEQ ID NO: 2486249 - DNA, 22 bp, Homo sapiens
actctgcttctctgacttctgc

SEQ ID NO: 2486250 - DNA, 13 bp, Homo sapiens
actctgcttgtta

SEQ ID NO: 2486251 - DNA, 14 bp, Homo sapiens
actctggcagccac

SEQ ID NO: 2486252 - DNA, 20 bp, Homo sapiens
actctggtgagtcaccactt

SEQ ID NO: 2486253 - DNA, 23 bp, Homo sapiens
actttttttctgtaccagttaat

SEQ ID NO: 2486254 - DNA, 19 bp, Homo sapiens
agaaaaaaaaattcacatg

SEQ ID NO: 2486255 - DNA, 16 bp, Homo sapiens
agaaaaaaatgtattt

SEQ ID NO: 2486256 - DNA, 15 bp, Homo sapiens
agaaaaaagtgttga

SEQ ID NO: 2486257 - DNA, 15 bp, Homo sapiens
agaaaaacaggcact

SEQ ID NO: 2486258 - DNA, 14 bp, Homo sapiens
agaaaaagaagcaa

SEQ ID NO: 2486259 - DNA, 13 bp, Homo sapiens
agaaaacaaaact

SEQ ID NO: 2486260 - DNA, 20 bp, Homo sapiens
agaaaacaggcactgccctg

SEQ ID NO: 2486261 - DNA, 15 bp, Homo sapiens
agaaaacatgcctct

SEQ ID NO: 2486262 - DNA, 16 bp, Homo sapiens
agaaaaccagctcagc

SEQ ID NO: 2486263 - DNA, 21 bp, Homo sapiens
agaaaaccagctcagcactgc

SEQ ID NO: 2486264 - DNA, 16 bp, Homo sapiens
agaaaacctttcttca

SEQ ID NO: 2486265 - DNA, 16 bp, Homo sapiens
agaaaagatgcacttt

SEQ ID NO: 2486266 - DNA, 19 bp, Homo sapiens
agaaaagatgcactttgct

SEQ ID NO: 2486267 - DNA, 15 bp, Homo sapiens
agaaaattagactgt

SEQ ID NO: 2486268 - DNA, 17 bp, Homo sapiens
agaaacaactctttgag

SEQ ID NO: 2486269 - DNA, 13 bp, Homo sapiens
agaaacactcaag

SEQ ID NO: 2486270 - DNA, 18 bp, Homo sapiens
agaaacagttggtaactt

SEQ ID NO: 2486271 - DNA, 21 bp, Homo sapiens
agaaacagttggtaacttttg

SEQ ID NO: 2486272 - DNA, 15 bp, Homo sapiens
agaaacatttatatt

SEQ ID NO: 2486273 - DNA, 22 bp, Homo sapiens
agaaaccagcttccttcagaga

SEQ ID NO: 2486274 - DNA, 16 bp, Homo sapiens
agaaacctactgccca

SEQ ID NO: 2486275 - DNA, 15 bp, Homo sapiens
agaaacgtcttctaa

SEQ ID NO: 2486276 - DNA, 21 bp, Homo sapiens
agaaacgtcttctaaacttcc

SEQ ID NO: 2486277 - DNA, 18 bp, Homo sapiens
agaaacttaaatgttatt

SEQ ID NO: 2486278 - DNA, 14 bp, Homo sapiens
agaaacttccaaat

SEQ ID NO: 2486279 - DNA, 19 bp, Homo sapiens
agaaacttccaaatcccct

SEQ ID NO: 2486280 - DNA, 15 bp, Homo sapiens
agaaactttctttct

SEQ ID NO: 2486281 - DNA, 15 bp, Homo sapiens
agaaacttttttatt

SEQ ID NO: 2486282 - DNA, 19 bp, Homo sapiens
agaaacttttttatttaaa

SEQ ID NO: 2486283 - DNA, 19 bp, Homo sapiens
agaaagaggtgaccccagg

SEQ ID NO: 2486284 - DNA, 23 bp, Homo sapiens
agaaagaggtgaccccagggcac

SEQ ID NO: 2486285 - DNA, 18 bp, Homo sapiens
agaaagccccacccaggc

SEQ ID NO: 2486286 - DNA, 21 bp, Homo sapiens
agaaagcctgggtgacatttg

SEQ ID NO: 2486287 - DNA, 17 bp, Homo sapiens
agaaagctgacttggct

SEQ ID NO: 2486288 - DNA, 22 bp, Homo sapiens
agaaagctgacttggctggtgt

SEQ ID NO: 2486289 - DNA, 17 bp, Homo sapiens
agaaaggaagcattgta

SEQ ID NO: 2486290 - DNA, 18 bp, Homo sapiens
agaaaggaagcattgtaa

SEQ ID NO: 2486291 - DNA, 15 bp, Homo sapiens
agaaaggctgttaaa

SEQ ID NO: 2486292 - DNA, 16 bp, Homo sapiens
agaaagggagggctct

SEQ ID NO: 2486293 - DNA, 18 bp, Homo sapiens
agaaagggagggctctga

SEQ ID NO: 2486294 - DNA, 22 bp, Homo sapiens
agaaagggccctgggcctgcct

SEQ ID NO: 2486295 - DNA, 16 bp, Homo sapiens
agaaagtgcctttcag

SEQ ID NO: 2486296 - DNA, 18 bp, Homo sapiens
agaaagtgcctttcagga

SEQ ID NO: 2486297 - DNA, 19 bp, Homo sapiens
agaaagtggaaaacaagga

SEQ ID NO: 2486298 - DNA, 11 bp, Homo sapiens
agaaagtgtat

SEQ ID NO: 2486299 - DNA, 16 bp, Homo sapiens
agaaagtgtatttgga

SEQ ID NO: 2486300 - DNA, 17 bp, Homo sapiens
agaaagtgtatttggaa

SEQ ID NO: 2486301 - DNA, 19 bp, Homo sapiens
agaaataagtgccctctcc

SEQ ID NO: 2486302 - DNA, 14 bp, Homo sapiens
agaaataagttttt

SEQ ID NO: 2486303 - DNA, 14 bp, Homo sapiens
agaaatgccaagca

SEQ ID NO: 2486304 - DNA, 20 bp, Homo sapiens
agaaattacctgtggatatt

SEQ ID NO: 2486305 - DNA, 18 bp, Homo sapiens
agaaattgaatactttga

SEQ ID NO: 2486306 - DNA, 22 bp, Homo sapiens
agaaattgaatactttgaatgt

SEQ ID NO: 2486307 - DNA, 21 bp, Homo sapiens
agaaattgtatattgtaattt

SEQ ID NO: 2486308 - DNA, 20 bp, Homo sapiens
agaaatttaaactataagca

SEQ ID NO: 2486309 - DNA, 11 bp, Homo sapiens
agaacactaat

SEQ ID NO: 2486310 - DNA, 20 bp, Homo sapiens
agaacagggaaaataggcag

SEQ ID NO: 2486311 - DNA, 19 bp, Homo sapiens
agaacatagacagaagaaa

SEQ ID NO: 2486312 - DNA, 19 bp, Homo sapiens
agaaccgtagatgatttca

SEQ ID NO: 2486313 - DNA, 19 bp, Homo sapiens
agaacctaattcaattcaa

SEQ ID NO: 2486314 - DNA, 13 bp, Homo sapiens
agaacctggaact

SEQ ID NO: 2486315 - DNA, 20 bp, Homo sapiens
agaacctggaacttggggag

SEQ ID NO: 2486316 - DNA, 17 bp, Homo sapiens
agaactagaatttgatt

SEQ ID NO: 2486317 - DNA, 19 bp, Homo sapiens
agaactcaaatggggccag

SEQ ID NO: 2486318 - DNA, 15 bp, Homo sapiens
agaactgaatgagaa

SEQ ID NO: 2486319 - DNA, 18 bp, Homo sapiens
agaactgcaggccctggc

SEQ ID NO: 2486320 - DNA, 15 bp, Homo sapiens
agaacttcagaaaga

SEQ ID NO: 2486321 - DNA, 17 bp, Homo sapiens
agaacttcagaaagact

SEQ ID NO: 2486322 - DNA, 15 bp, Homo sapiens
agaagaaaaagaagc

SEQ ID NO: 2486323 - DNA, 16 bp, Homo sapiens
agaagaaagaggtgac

SEQ ID NO: 2486324 - DNA, 24 bp, Homo sapiens
agaagagcgagagatcaaagatga

SEQ ID NO: 2486325 - DNA, 12 bp, Homo sapiens
agagctggtgcg

SEQ ID NO: 2486326 - DNA, 15 bp, Homo sapiens
agagctggtgcggct

SEQ ID NO: 2486327 - DNA, 17 bp, Homo sapiens
agagctgtattaagcca

SEQ ID NO: 2486328 - DNA, 16 bp, Homo sapiens
agagcttccctgactc

SEQ ID NO: 2486329 - DNA, 14 bp, Homo sapiens
agaggacgggaggc

SEQ ID NO: 2486330 - DNA, 21 bp, Homo sapiens
agaggatggtcttacagcagg

SEQ ID NO: 2486331 - DNA, 13 bp, Homo sapiens
agaggcaccagga

SEQ ID NO: 2486332 - DNA, 15 bp, Homo sapiens
agaggcaggtagggg

SEQ ID NO: 2486333 - DNA, 15 bp, Homo sapiens
agaggcccaggctgc

SEQ ID NO: 2486334 - DNA, 16 bp, Homo sapiens
agaggcccaggctgcc

SEQ ID NO: 2486335 - DNA, 19 bp, Homo sapiens
agaggcccaggctgccgtc

SEQ ID NO: 2486336 - DNA, 16 bp, Homo sapiens
agaggccccagcctcc

SEQ ID NO: 2486337 - DNA, 23 bp, Homo sapiens
agaggccccagcctccctgaagc

SEQ ID NO: 2486338 - DNA, 21 bp, Homo sapiens
agaggcccccagcccagggct

SEQ ID NO: 2486339 - DNA, 22 bp, Homo sapiens
agaggcccccagcccagggctc

SEQ ID NO: 2486340 - DNA, 12 bp, Homo sapiens
agaggccctgga

SEQ ID NO: 2486341 - DNA, 20 bp, Homo sapiens
agaggccctggatcagcgtg

SEQ ID NO: 2486342 - DNA, 24 bp, Homo sapiens
agaggccctggatcagcgtggcct

SEQ ID NO: 2486343 - DNA, 22 bp, Homo sapiens
agaggccgtggctgctgtggga

SEQ ID NO: 2486344 - DNA, 22 bp, Homo sapiens
agaggctcgttgactggctgtg

SEQ ID NO: 2486345 - DNA, 14 bp, Homo sapiens
agaggctgaggcct

SEQ ID NO: 2486346 - DNA, 19 bp, Homo sapiens
agaggctgcccctctcacc

SEQ ID NO: 2486347 - DNA, 14 bp, Homo sapiens
agaggctgggttca

SEQ ID NO: 2486348 - DNA, 14 bp, Homo sapiens
agaggctgtctgtt

SEQ ID NO: 2486349 - DNA, 12 bp, Homo sapiens
agagggaatgtg

SEQ ID NO: 2486350 - DNA, 15 bp, Homo sapiens
agagggaatgtgaaa

SEQ ID NO: 2486351 - DNA, 12 bp, Homo sapiens
agagggacagat

SEQ ID NO: 2486352 - DNA, 21 bp, Homo sapiens
agagggacgcctgggggtgcc

SEQ ID NO: 2486353 - DNA, 16 bp, Homo sapiens
agagggcactctgctt

SEQ ID NO: 2486354 - DNA, 16 bp, Homo sapiens
agagggcgcaggccgt

SEQ ID NO: 2486355 - DNA, 20 bp, Homo sapiens
agagggctcgaggggtgggc

SEQ ID NO: 2486356 - DNA, 12 bp, Homo sapiens
agagggctggag

SEQ ID NO: 2486357 - DNA, 17 bp, Homo sapiens
agaggggcctgccacct

SEQ ID NO: 2486358 - DNA, 20 bp, Homo sapiens
agaggggcctgccacctgga

SEQ ID NO: 2486359 - DNA, 19 bp, Homo sapiens
agagggggctggtgggtgc

SEQ ID NO: 2486360 - DNA, 16 bp, Homo sapiens
agaggtgaccccaggg

SEQ ID NO: 2486361 - DNA, 15 bp, Homo sapiens
agaggtttgcagtcc

SEQ ID NO: 2486362 - DNA, 17 bp, Homo sapiens
agaggtttgcagtccca

SEQ ID NO: 2486363 - DNA, 20 bp, Homo sapiens
agcggtgtctctcctgcccc

SEQ ID NO: 2486364 - DNA, 14 bp, Homo sapiens
agcgtggaggggta

SEQ ID NO: 2486365 - DNA, 20 bp, Homo sapiens
agcgtggaggggtaggggct

SEQ ID NO: 2486366 - DNA, 18 bp, Homo sapiens
agcgtggccttgttctgt

SEQ ID NO: 2486367 - DNA, 12 bp, Homo sapiens
agcgttcttgta

SEQ ID NO: 2486368 - DNA, 17 bp, Homo sapiens
agctaaacggattccaa

SEQ ID NO: 2486369 - DNA, 20 bp, Homo sapiens
agctaaatacctcaatcagt

SEQ ID NO: 2486370 - DNA, 13 bp, Homo sapiens
agctaaatccttt

SEQ ID NO: 2486371 - DNA, 18 bp, Homo sapiens
agctaacagggaaggcag

SEQ ID NO: 2486372 - DNA, 19 bp, Homo sapiens
agctaacagggaaggcagg

SEQ ID NO: 2486373 - DNA, 12 bp, Homo sapiens
agctaagaacct

SEQ ID NO: 2486374 - DNA, 14 bp, Homo sapiens
agctaagaacctgg

SEQ ID NO: 2486375 - DNA, 17 bp, Homo sapiens
agctaagaacctggaac

SEQ ID NO: 2486376 - DNA, 13 bp, Homo sapiens
agctaaggctcta

SEQ ID NO: 2486377 - DNA, 18 bp, Homo sapiens
agctaaggggtggggctg

SEQ ID NO: 2486378 - DNA, 19 bp, Homo sapiens
agctaaggggtggggctgc

SEQ ID NO: 2486379 - DNA, 19 bp, Homo sapiens
agctaaggtttagataaat

SEQ ID NO: 2486380 - DNA, 18 bp, Homo sapiens
agctaataacatgtgaaa

SEQ ID NO: 2486381 - DNA, 13 bp, Homo sapiens
agctacagagaaa

SEQ ID NO: 2486382 - DNA, 16 bp, Homo sapiens
agctacagagaaacca

SEQ ID NO: 2486383 - DNA, 22 bp, Homo sapiens
agctacagagaaaccagcttcc

SEQ ID NO: 2486384 - DNA, 16 bp, Homo sapiens
agctacgtatttaata

SEQ ID NO: 2486385 - DNA, 20 bp, Homo sapiens
agctactgtgtgtgtgaatg

SEQ ID NO: 2486386 - DNA, 23 bp, Homo sapiens
agctactgtgtgtgtgaatgaac

SEQ ID NO: 2486387 - DNA, 15 bp, Homo sapiens
agctacttcctcctc

SEQ ID NO: 2486388 - DNA, 18 bp, Homo sapiens
agctaggaagagcaggac

SEQ ID NO: 2486389 - DNA, 19 bp, Homo sapiens
agctaggagcaaagcctgt

SEQ ID NO: 2486390 - DNA, 16 bp, Homo sapiens
agctagtcttttgctt

SEQ ID NO: 2486391 - DNA, 22 bp, Homo sapiens
agctagttttattcttggtttt

SEQ ID NO: 2486392 - DNA, 20 bp, Homo sapiens
agctatgtcccaggaatcag

SEQ ID NO: 2486393 - DNA, 18 bp, Homo sapiens
agctatgttatattgaaa

SEQ ID NO: 2486394 - DNA, 12 bp, Homo sapiens
agctattttcca

SEQ ID NO: 2486395 - DNA, 13 bp, Homo sapiens
agctatttttcta

SEQ ID NO: 2486396 - DNA, 21 bp, Homo sapiens
agctcaaaggtttggaaggag

SEQ ID NO: 2486397 - DNA, 22 bp, Homo sapiens
agctcaactctcttattgcctc

SEQ ID NO: 2486398 - DNA, 20 bp, Homo sapiens
agctcacaaggcagcaaggc

SEQ ID NO: 2486399 - DNA, 19 bp, Homo sapiens
agctcagaaaatatccctc

SEQ ID NO: 2486400 - DNA, 22 bp, Homo sapiens
agctcagaggcgcactgtgacc

SEQ ID NO: 2486401 - DNA, 17 bp, Homo sapiens
agctcagcactgcctgc

SEQ ID NO: 2486402 - DNA, 20 bp, Homo sapiens
agctcagcactgcctgctcc

SEQ ID NO: 2486403 - DNA, 18 bp, Homo sapiens
agctcaggacagatgcca

SEQ ID NO: 2486404 - DNA, 22 bp, Homo sapiens
agctcaggatgagggaaaagaa

SEQ ID NO: 2486405 - DNA, 14 bp, Homo sapiens
agctccaacctgca

SEQ ID NO: 2486406 - DNA, 15 bp, Homo sapiens
agctccaacctgcaa

SEQ ID NO: 2486407 - DNA, 13 bp, Homo sapiens
agctccactctgc

SEQ ID NO: 2486408 - DNA, 14 bp, Homo sapiens
agctccactctgct

SEQ ID NO: 2486409 - DNA, 16 bp, Homo sapiens
agctccactctgcttc

SEQ ID NO: 2486410 - DNA, 17 bp, Homo sapiens
agctccactctgcttct

SEQ ID NO: 2486411 - DNA, 19 bp, Homo sapiens
agctccactctgcttctct

SEQ ID NO: 2486412 - DNA, 23 bp, Homo sapiens
agctccactctgcttctctgact

SEQ ID NO: 2486413 - DNA, 19 bp, Homo sapiens
agctccagctcctttgggc

SEQ ID NO: 2486414 - DNA, 18 bp, Homo sapiens
agctccagtgtcctgagc

SEQ ID NO: 2486415 - DNA, 21 bp, Homo sapiens
agctccagtgtcctgagctca

SEQ ID NO: 2486416 - DNA, 22 bp, Homo sapiens
agctccagtgtcctgagctcag

SEQ ID NO: 2486417 - DNA, 14 bp, Homo sapiens
agctcccacctccc

SEQ ID NO: 2486418 - DNA, 23 bp, Homo sapiens
agctcccaggaccacaggctcag

SEQ ID NO: 2486419 - DNA, 15 bp, Homo sapiens
agctccccctccctc

SEQ ID NO: 2486420 - DNA, 14 bp, Homo sapiens
agctcccctcccca

SEQ ID NO: 2486421 - DNA, 15 bp, Homo sapiens
agctcccctccccaa

SEQ ID NO: 2486422 - DNA, 21 bp, Homo sapiens
agctccctgtgcccccagggt

SEQ ID NO: 2486423 - DNA, 14 bp, Homo sapiens
agctcctccctctc

SEQ ID NO: 2486424 - DNA, 17 bp, Homo sapiens
agctcctctccccagcc

SEQ ID NO: 2486425 - DNA, 18 bp, Homo sapiens
agctcctctccccagccc

SEQ ID NO: 2486426 - DNA, 18 bp, Homo sapiens
agctcctctgtctcgagc

SEQ ID NO: 2486427 - DNA, 13 bp, Homo sapiens
agctcctcttcca

SEQ ID NO: 2486428 - DNA, 14 bp, Homo sapiens
agctcctcttccat

SEQ ID NO: 2486429 - DNA, 24 bp, Homo sapiens
agctcctgaccagttgcagtcact

SEQ ID NO: 2486430 - DNA, 16 bp, Homo sapiens
agctcctgtcccctgc

SEQ ID NO: 2486431 - DNA, 16 bp, Homo sapiens
agctcctgtggcccca

SEQ ID NO: 2486432 - DNA, 19 bp, Homo sapiens
agctcctgtggccccaccc

SEQ ID NO: 2486433 - DNA, 13 bp, Homo sapiens
agctctagaatct

SEQ ID NO: 2486434 - DNA, 16 bp, Homo sapiens
agctctattatgaatg

SEQ ID NO: 2486435 - DNA, 19 bp, Homo sapiens
agctctattatgaatgtga

SEQ ID NO: 2486436 - DNA, 10 bp, Homo sapiens
agctctgaga

SEQ ID NO: 2486437 - DNA, 13 bp, Homo sapiens
agctctgagaggc

SEQ ID NO: 2486438 - DNA, 12 bp, Homo sapiens
agctctgaggga

SEQ ID NO: 2486439 - DNA, 18 bp, Homo sapiens
agctctggacagccccac

SEQ ID NO: 2486440 - DNA, 12 bp, Homo sapiens
agctctggaggg

SEQ ID NO: 2486441 - DNA, 21 bp, Homo sapiens
agctctggggtgggcagtttt

SEQ ID NO: 2486442 - DNA, 12 bp, Homo sapiens
agctctgtatca

SEQ ID NO: 2486443 - DNA, 20 bp, Homo sapiens
agctctgttcttcctcagcc

SEQ ID NO: 2486444 - DNA, 22 bp, Homo sapiens
agctctgttcttcctcagccag

SEQ ID NO: 2486445 - DNA, 16 bp, Homo sapiens
agctgaatgtttttct

SEQ ID NO: 2486446 - DNA, 22 bp, Homo sapiens
agctgaatgtttttctaaagga

SEQ ID NO: 2486447 - DNA, 16 bp, Homo sapiens
agctgaccagccgtga

SEQ ID NO: 2486448 - DNA, 13 bp, Homo sapiens
agctgactcacac

SEQ ID NO: 2486449 - DNA, 20 bp, Homo sapiens
agctgagcaaatcaccacaa

SEQ ID NO: 2486450 - DNA, 13 bp, Homo sapiens
agctgagcagggc

SEQ ID NO: 2486451 - DNA, 17 bp, Homo sapiens
agctgagcgccaggatg

SEQ ID NO: 2486452 - DNA, 19 bp, Homo sapiens
agctgagctcacaaggcag

SEQ ID NO: 2486453 - DNA, 22 bp, Homo sapiens
agctgagctcacaaggcagcaa

SEQ ID NO: 2486454 - DNA, 17 bp, Homo sapiens
agctgaggcagcagtgt

SEQ ID NO: 2486455 - DNA, 19 bp, Homo sapiens
agctgaggtgcccaggaga

SEQ ID NO: 2486456 - DNA, 22 bp, Homo sapiens
agctgaggtgcccaggagaaga

SEQ ID NO: 2486457 - DNA, 21 bp, Homo sapiens
agctgagtttcctatgggaac

SEQ ID NO: 2486458 - DNA, 16 bp, Homo sapiens
agctgattaaatgaca

SEQ ID NO: 2486459 - DNA, 21 bp, Homo sapiens
agctgcaaggtactctggtga

SEQ ID NO: 2486460 - DNA, 17 bp, Homo sapiens
agctgcactgatgctgc

SEQ ID NO: 2486461 - DNA, 15 bp, Homo sapiens
agctgcctggacccg

SEQ ID NO: 2486462 - DNA, 19 bp, Homo sapiens
agctgctccgaggacccag

SEQ ID NO: 2486463 - DNA, 15 bp, Homo sapiens
agctgcttccagtgt

SEQ ID NO: 2486464 - DNA, 15 bp, Homo sapiens
agctggaccctgacc

SEQ ID NO: 2486465 - DNA, 17 bp, Homo sapiens
agctggaggcaggggct

SEQ ID NO: 2486466 - DNA, 14 bp, Homo sapiens
agctggatgagaat

SEQ ID NO: 2486467 - DNA, 19 bp, Homo sapiens
agctggctctgagcgcctc

SEQ ID NO: 2486468 - DNA, 20 bp, Homo sapiens
agctggctctgagcgcctcc

SEQ ID NO: 2486469 - DNA, 23 bp, Homo sapiens
agctggctctgagcgcctccatc

SEQ ID NO: 2486470 - DNA, 15 bp, Homo sapiens
agctgggcctggtct

SEQ ID NO: 2486471 - DNA, 15 bp, Homo sapiens
agctgggctctgcaa

SEQ ID NO: 2486472 - DNA, 14 bp, Homo sapiens
agctggggtgcagg

SEQ ID NO: 2486473 - DNA, 18 bp, Homo sapiens
agctggggtgcagggatg

SEQ ID NO: 2486474 - DNA, 22 bp, Homo sapiens
agctggggtgcagggatgtggg

SEQ ID NO: 2486475 - DNA, 14 bp, Homo sapiens
agctgggtcaggca

SEQ ID NO: 2486476 - DNA, 17 bp, Homo sapiens
agctgggtcaggcaggg

SEQ ID NO: 2486477 - DNA, 17 bp, Homo sapiens
agctggtgtagctacag

SEQ ID NO: 2486478 - DNA, 16 bp, Homo sapiens
agctgtattgtctgaa

SEQ ID NO: 2486479 - DNA, 14 bp, Homo sapiens
agctgtcttttgga

SEQ ID NO: 2486480 - DNA, 20 bp, Homo sapiens
agctgtgacctgctgagctc

SEQ ID NO: 2486481 - DNA, 12 bp, Homo sapiens
agctgtgcaggt

SEQ ID NO: 2486482 - DNA, 21 bp, Homo sapiens
agctgtgtgaatacctgctca

SEQ ID NO: 2486483 - DNA, 14 bp, Homo sapiens
agcttaaaactttg

SEQ ID NO: 2486484 - DNA, 14 bp, Homo sapiens
agcttaaaatacaa

SEQ ID NO: 2486485 - DNA, 19 bp, Homo sapiens
agcttaatggctgataatt

SEQ ID NO: 2486486 - DNA, 22 bp, Homo sapiens
agcttaatggctgataatttta

SEQ ID NO: 2486487 - DNA, 15 bp, Homo sapiens
agcttagactaaggc

SEQ ID NO: 2486488 - DNA, 13 bp, Homo sapiens
agcttagatttca

SEQ ID NO: 2486489 - DNA, 21 bp, Homo sapiens
agcttatacgaaataattgtt

SEQ ID NO: 2486490 - DNA, 22 bp, Homo sapiens
agcttccatgattctatttata

SEQ ID NO: 2486491 - DNA, 13 bp, Homo sapiens
agcttccttcaga

SEQ ID NO: 2486492 - DNA, 14 bp, Homo sapiens
agcttccttcagag

SEQ ID NO: 2486493 - DNA, 15 bp, Homo sapiens
agcttccttcagaga

SEQ ID NO: 2486494 - DNA, 17 bp, Homo sapiens
agcttccttcagagagc

SEQ ID NO: 2486495 - DNA, 14 bp, Homo sapiens
agcttgacctgagg

SEQ ID NO: 2486496 - DNA, 20 bp, Homo sapiens
agcttgacctgaggctgtgg

SEQ ID NO: 2486497 - DNA, 14 bp, Homo sapiens
agcttgtctcttgc

SEQ ID NO: 2486498 - DNA, 18 bp, Homo sapiens
agcttgtctcttgcctgc

SEQ ID NO: 2486499 - DNA, 19 bp, Homo sapiens
agcttgtctcttgcctgcc

SEQ ID NO: 2486500 - DNA, 23 bp, Homo sapiens
agcttgtctcttgcctgccactg

SEQ ID NO: 2486501 - DNA, 23 bp, Homo sapiens
agcttgtttacatgcttattcca

SEQ ID NO: 2486502 - DNA, 17 bp, Homo sapiens
agctttcagaatatgtc

SEQ ID NO: 2486503 - DNA, 14 bp, Homo sapiens
agctttcctgcccc

SEQ ID NO: 2486504 - DNA, 22 bp, Homo sapiens
agctttcctgccccaggcctga

SEQ ID NO: 2486505 - DNA, 17 bp, Homo sapiens
agctttctgaacagctg

SEQ ID NO: 2486506 - DNA, 22 bp, Homo sapiens
agctttctgaacagctggtgta

SEQ ID NO: 2486507 - DNA, 20 bp, Homo sapiens
agctttgactcaggagcctg

SEQ ID NO: 2486508 - DNA, 18 bp, Homo sapiens
agctttggaagtttagct

SEQ ID NO: 2486509 - DNA, 16 bp, Homo sapiens
agcttttaaaagattt

SEQ ID NO: 2486510 - DNA, 14 bp, Homo sapiens
aggaaaagacacat

SEQ ID NO: 2486511 - DNA, 14 bp, Homo sapiens
aggaaaaggcctgg

SEQ ID NO: 2486512 - DNA, 16 bp, Homo sapiens
aggaaaaggcctgggg

SEQ ID NO: 2486513 - DNA, 21 bp, Homo sapiens
aggaaacagttgcatgtagta

SEQ ID NO: 2486514 - DNA, 22 bp, Homo sapiens
aggaaacagttgcatgtagtaa

SEQ ID NO: 2486515 - DNA, 13 bp, Homo sapiens
aggaaatcaaatg

SEQ ID NO: 2486516 - DNA, 21 bp, Homo sapiens
aggaaatcaacttgcttatca

SEQ ID NO: 2486517 - DNA, 13 bp, Homo sapiens
aggaaatcccttc

SEQ ID NO: 2486518 - DNA, 22 bp, Homo sapiens
agggcagcagccagccctgcct

SEQ ID NO: 2486519 - DNA, 23 bp, Homo sapiens
agggcagcagccagccctgcctg

SEQ ID NO: 2486520 - DNA, 19 bp, Homo sapiens
agggcagccagggagagcc

SEQ ID NO: 2486521 - DNA, 23 bp, Homo sapiens
agggcagccagggagagcccagg

SEQ ID NO: 2486522 - DNA, 17 bp, Homo sapiens
agggcagcgccaggctg

SEQ ID NO: 2486523 - DNA, 17 bp, Homo sapiens
agggcagggccccaggc

SEQ ID NO: 2486524 - DNA, 15 bp, Homo sapiens
agggcagtacctgag

SEQ ID NO: 2486525 - DNA, 20 bp, Homo sapiens
agggcagtcattggctgtct

SEQ ID NO: 2486526 - DNA, 14 bp, Homo sapiens
agggcagttcgcag

SEQ ID NO: 2486527 - DNA, 20 bp, Homo sapiens
agggcagttcgcagccaccc

SEQ ID NO: 2486528 - DNA, 14 bp, Homo sapiens
agggcatctctggg

SEQ ID NO: 2486529 - DNA, 16 bp, Homo sapiens
agggccacgctccagc

SEQ ID NO: 2486530 - DNA, 16 bp, Homo sapiens
agggccagagccaggg

SEQ ID NO: 2486531 - DNA, 20 bp, Homo sapiens
agggccatgctgaggcctgg

SEQ ID NO: 2486532 - DNA, 12 bp, Homo sapiens
agggcccagagc

SEQ ID NO: 2486533 - DNA, 16 bp, Homo sapiens
agggcccagagcccag

SEQ ID NO: 2486534 - DNA, 17 bp, Homo sapiens
agggcccagagcccagc

SEQ ID NO: 2486535 - DNA, 20 bp, Homo sapiens
agggcccagagcccagctcc

SEQ ID NO: 2486536 - DNA, 21 bp, Homo sapiens
agggcccagagcccagctcca

SEQ ID NO: 2486537 - DNA, 19 bp, Homo sapiens
agggcccctcaccctgcct

SEQ ID NO: 2486538 - DNA, 18 bp, Homo sapiens
agggccctgggcctgcct

SEQ ID NO: 2486539 - DNA, 20 bp, Homo sapiens
agggccgactaagagaagtt

SEQ ID NO: 2486540 - DNA, 18 bp, Homo sapiens
agggccggggaactggcc

SEQ ID NO: 2486541 - DNA, 19 bp, Homo sapiens
agggccggggaactggcca

SEQ ID NO: 2486542 - DNA, 23 bp, Homo sapiens
agggccggggaactggccaagct

SEQ ID NO: 2486543 - DNA, 13 bp, Homo sapiens
agggcgcaggccg

SEQ ID NO: 2486544 - DNA, 17 bp, Homo sapiens
agggcgggcagagggct

SEQ ID NO: 2486545 - DNA, 19 bp, Homo sapiens
agggcgggcagagggctgg

SEQ ID NO: 2486546 - DNA, 22 bp, Homo sapiens
agggctagtgacttgtgtccca

SEQ ID NO: 2486547 - DNA, 24 bp, Homo sapiens
agggctagtgacttgtgtcccatg

SEQ ID NO: 2486548 - DNA, 14 bp, Homo sapiens
agggctccagcccc

SEQ ID NO: 2486549 - DNA, 18 bp, Homo sapiens
agggctccttgtgggcct

SEQ ID NO: 2486550 - DNA, 22 bp, Homo sapiens
agggctccttgtgggcctgggc

SEQ ID NO: 2486551 - DNA, 18 bp, Homo sapiens
agggctcgaggggtgggc

SEQ ID NO: 2486552 - DNA, 16 bp, Homo sapiens
agggctctgaggcgcc

SEQ ID NO: 2486553 - DNA, 20 bp, Homo sapiens
agggctgcttccctgaagct

SEQ ID NO: 2486554 - DNA, 13 bp, Homo sapiens
agggctggctggc

SEQ ID NO: 2486555 - DNA, 20 bp, Homo sapiens
agggctgtcatctgtgcact

SEQ ID NO: 2486556 - DNA, 13 bp, Homo sapiens
aggggaccaggag

SEQ ID NO: 2486557 - DNA, 20 bp, Homo sapiens
aggccttgcggctcctcagg

SEQ ID NO: 2486558 - DNA, 13 bp, Homo sapiens
aggcgaggccctt

SEQ ID NO: 2486559 - DNA, 20 bp, Homo sapiens
aggcgaggcccttggcgggc

SEQ ID NO: 2486560 - DNA, 14 bp, Homo sapiens
aggcggggcttgcc

SEQ ID NO: 2486561 - DNA, 15 bp, Homo sapiens
aggcggggcttgcct

SEQ ID NO: 2486562 - DNA, 16 bp, Homo sapiens
aggcggtgggcctggt

SEQ ID NO: 2486563 - DNA, 22 bp, Homo sapiens
aggctaatttttttgtatttta

SEQ ID NO: 2486564 - DNA, 12 bp, Homo sapiens
aggctacagaga

SEQ ID NO: 2486565 - DNA, 13 bp, Homo sapiens
aggctacagagaa

SEQ ID NO: 2486566 - DNA, 19 bp, Homo sapiens
aggctacagagaagccttc

SEQ ID NO: 2486567 - DNA, 17 bp, Homo sapiens
aggctacttcggggctg

SEQ ID NO: 2486568 - DNA, 15 bp, Homo sapiens
aggctaggccagcag

SEQ ID NO: 2486569 - DNA, 20 bp, Homo sapiens
aggctaggccagcaggggct

SEQ ID NO: 2486570 - DNA, 11 bp, Homo sapiens
aggctatttgt

SEQ ID NO: 2486571 - DNA, 21 bp, Homo sapiens
aggctatttgtaaatctgcca

SEQ ID NO: 2486572 - DNA, 21 bp, Homo sapiens
aggctcacccccttctccatc

SEQ ID NO: 2486573 - DNA, 20 bp, Homo sapiens
aggctcaggcaggggcctcc

SEQ ID NO: 2486574 - DNA, 13 bp, Homo sapiens
aggctccagaggg

SEQ ID NO: 2486575 - DNA, 15 bp, Homo sapiens
aggctccagagggca

SEQ ID NO: 2486576 - DNA, 16 bp, Homo sapiens
aggctccagagggcac

SEQ ID NO: 2486577 - DNA, 16 bp, Homo sapiens
aggctcctgttttgca

SEQ ID NO: 2486578 - DNA, 17 bp, Homo sapiens
aggctctagatcataag

SEQ ID NO: 2486579 - DNA, 20 bp, Homo sapiens
aggctctgagagtctagatt

SEQ ID NO: 2486580 - DNA, 22 bp, Homo sapiens
aggctcttagcagcttccagat

SEQ ID NO: 2486581 - DNA, 14 bp, Homo sapiens
aggctgaggctggc

SEQ ID NO: 2486582 - DNA, 17 bp, Homo sapiens
aggctgaggctggcaca

SEQ ID NO: 2486583 - DNA, 21 bp, Homo sapiens
aggctgatgtcaatttctgtg

SEQ ID NO: 2486584 - DNA, 14 bp, Homo sapiens
aggctgccctcctg

SEQ ID NO: 2486585 - DNA, 22 bp, Homo sapiens
aggctgccgtcccctagagtcc

SEQ ID NO: 2486586 - DNA, 24 bp, Homo sapiens
aggctgcctgagtcgtgacctgct

SEQ ID NO: 2486587 - DNA, 21 bp, Homo sapiens
aggctgctcggggtgcacagg

SEQ ID NO: 2486588 - DNA, 22 bp, Homo sapiens
aggctgctcggggtgcacagga

SEQ ID NO: 2486589 - DNA, 23 bp, Homo sapiens
aggctgctcggggtgcacaggag

SEQ ID NO: 2486590 - DNA, 22 bp, Homo sapiens
aggctggaagatagctgtgact

SEQ ID NO: 2486591 - DNA, 17 bp, Homo sapiens
aggctggcacaggacat

SEQ ID NO: 2486592 - DNA, 15 bp, Homo sapiens
aggctggccagtcca

SEQ ID NO: 2486593 - DNA, 17 bp, Homo sapiens
aggctggccagtccagg

SEQ ID NO: 2486594 - DNA, 21 bp, Homo sapiens
aggctggccagtccaggctgc

SEQ ID NO: 2486595 - DNA, 22 bp, Homo sapiens
aggctgggccatgtccaaagag

SEQ ID NO: 2486596 - DNA, 21 bp, Homo sapiens
aggctggtgggctggccgctg

SEQ ID NO: 2486597 - DNA, 12 bp, Homo sapiens
aggctgtaacta

SEQ ID NO: 2486598 - DNA, 19 bp, Homo sapiens
aggaaatgaaaatgtcttg

SEQ ID NO: 2486599 - DNA, 23 bp, Homo sapiens
aggaaatgtttttaataaaagaa

SEQ ID NO: 2486600 - DNA, 15 bp, Homo sapiens
aggaagagccttcca

SEQ ID NO: 2486601 - DNA, 21 bp, Homo sapiens
aggaagagccttccacccagg

SEQ ID NO: 2486602 - DNA, 17 bp, Homo sapiens
aggaagcaagcttaatg

SEQ ID NO: 2486603 - DNA, 22 bp, Homo sapiens
aggaagcattgtaaaataattc

SEQ ID NO: 2486604 - DNA, 15 bp, Homo sapiens
aggaagccaaagagt

SEQ ID NO: 2486605 - DNA, 22 bp, Homo sapiens
aggaagcccccaccgtgggcag

SEQ ID NO: 2486606 - DNA, 20 bp, Homo sapiens
aggaagcctgcagtcctgga

SEQ ID NO: 2486607 - DNA, 12 bp, Homo sapiens
aggaagccttcc

SEQ ID NO: 2486608 - DNA, 16 bp, Homo sapiens
aggaaggactatgaaa

SEQ ID NO: 2486609 - DNA, 12 bp, Homo sapiens
aggaaggagctg

SEQ ID NO: 2486610 - DNA, 18 bp, Homo sapiens
aggaaggagctgcctgga

SEQ ID NO: 2486611 - DNA, 19 bp, Homo sapiens
aggaaggcttgttgtgctt

SEQ ID NO: 2486612 - DNA, 18 bp, Homo sapiens
aggaaggggccagaggct

SEQ ID NO: 2486613 - DNA, 20 bp, Homo sapiens
aggaaggggccagaggctcg

SEQ ID NO: 2486614 - DNA, 16 bp, Homo sapiens
aggaaggtggatggcc

SEQ ID NO: 2486615 - DNA, 15 bp, Homo sapiens
aggaagtagaaacaa

SEQ ID NO: 2486616 - DNA, 19 bp, Homo sapiens
aggaatctgtgggtctggg

SEQ ID NO: 2486617 - DNA, 22 bp, Homo sapiens
aggaatctttaaaagatgcttt

SEQ ID NO: 2486618 - DNA, 23 bp, Homo sapiens
aggaatggctgcacctttttgca

SEQ ID NO: 2486619 - DNA, 15 bp, Homo sapiens
aggaatttcttaact

SEQ ID NO: 2486620 - DNA, 11 bp, Homo sapiens
aggacacaggc

SEQ ID NO: 2486621 - DNA, 12 bp, Homo sapiens
aggacacaggcc

SEQ ID NO: 2486622 - DNA, 14 bp, Homo sapiens
aggacagagagaaa

SEQ ID NO: 2486623 - DNA, 15 bp, Homo sapiens
aggacagagagaaat

SEQ ID NO: 2486624 - DNA, 16 bp, Homo sapiens
aggacagatgcctcct

SEQ ID NO: 2486625 - DNA, 20 bp, Homo sapiens
aggacagatgcctccttcct

SEQ ID NO: 2486626 - DNA, 16 bp, Homo sapiens
aggaccagtcccagag

SEQ ID NO: 2486627 - DNA, 15 bp, Homo sapiens
aggacccagaggaag

SEQ ID NO: 2486628 - DNA, 17 bp, Homo sapiens
aggaccctggacccagc

SEQ ID NO: 2486629 - DNA, 17 bp, Homo sapiens
aggacctgagcctgccg

SEQ ID NO: 2486630 - DNA, 18 bp, Homo sapiens
aggacctgagcctgccga

SEQ ID NO: 2486631 - DNA, 19 bp, Homo sapiens
aggacctgagcctgccgag

SEQ ID NO: 2486632 - DNA, 19 bp, Homo sapiens
aggaccttcgggctgtgcc

SEQ ID NO: 2486633 - DNA, 20 bp, Homo sapiens
aggaccttcgggctgtgccc

SEQ ID NO: 2486634 - DNA, 21 bp, Homo sapiens
aggacctttccaccacagcca

SEQ ID NO: 2486635 - DNA, 22 bp, Homo sapiens
aggacctttccaccacagccag

SEQ ID NO: 2486636 - DNA, 18 bp, Homo sapiens
aggactaacactcagaag

SEQ ID NO: 2486637 - DNA, 20 bp, Homo sapiens
aggactaacactcagaagcc

SEQ ID NO: 2486638 - DNA, 23 bp, Homo sapiens
aggactaacactcagaagcctgg

SEQ ID NO: 2486639 - DNA, 17 bp, Homo sapiens
aggactaatagaaaagt

SEQ ID NO: 2486640 - DNA, 20 bp, Homo sapiens
aggactatatttgggcctgc

SEQ ID NO: 2486641 - DNA, 15 bp, Homo sapiens
aggactccaggccca

SEQ ID NO: 2486642 - DNA, 20 bp, Homo sapiens
aggactccaggcccaaggct

SEQ ID NO: 2486643 - DNA, 19 bp, Homo sapiens
aggactcctcctttttcca

SEQ ID NO: 2486644 - DNA, 12 bp, Homo sapiens
aggactctcagg

SEQ ID NO: 2486645 - DNA, 15 bp, Homo sapiens
aggactgatgtctcc

SEQ ID NO: 2486646 - DNA, 20 bp, Homo sapiens
aggactgatgtctcctaagc

SEQ ID NO: 2486647 - DNA, 15 bp, Homo sapiens
aggacttccctgtgt

SEQ ID NO: 2486648 - DNA, 20 bp, Homo sapiens
aggacttcctgtccagctcc

SEQ ID NO: 2486649 - DNA, 23 bp, Homo sapiens
ataactggaaaacagaacactta

SEQ ID NO: 2486650 - DNA, 15 bp, Homo sapiens
ataactggaaagaag

SEQ ID NO: 2486651 - DNA, 15 bp, Homo sapiens
ataactgtatttgaa

SEQ ID NO: 2486652 - DNA, 14 bp, Homo sapiens
ataacttccacagg

SEQ ID NO: 2486653 - DNA, 14 bp, Homo sapiens
ataagaaagcctga

SEQ ID NO: 2486654 - DNA, 20 bp, Homo sapiens
ataagaagaatgcttaatca

SEQ ID NO: 2486655 - DNA, 22 bp, Homo sapiens
ataagaagccttaatttgcaca

SEQ ID NO: 2486656 - DNA, 19 bp, Homo sapiens
ataagatcctagatcctaa

SEQ ID NO: 2486657 - DNA, 15 bp, Homo sapiens
ataagatcttttatt

SEQ ID NO: 2486658 - DNA, 17 bp, Homo sapiens
ataagatcttttatttt

SEQ ID NO: 2486659 - DNA, 17 bp, Homo sapiens
ataagattctaacggtc

SEQ ID NO: 2486660 - DNA, 21 bp, Homo sapiens
ataagcaagaaggcaaaaata

SEQ ID NO: 2486661 - DNA, 17 bp, Homo sapiens
ataagcaggtggatcta

SEQ ID NO: 2486662 - DNA, 17 bp, Homo sapiens
ataagcatcattattta

SEQ ID NO: 2486663 - DNA, 19 bp, Homo sapiens
ataagcatcattatttatg

SEQ ID NO: 2486664 - DNA, 16 bp, Homo sapiens
ataagctatttgatgt

SEQ ID NO: 2486665 - DNA, 18 bp, Homo sapiens
ataagctatttgatgtaa

SEQ ID NO: 2486666 - DNA, 18 bp, Homo sapiens
ataagctatttttctaac

SEQ ID NO: 2486667 - DNA, 22 bp, Homo sapiens
ataaggaaatcaacttgcttat

SEQ ID NO: 2486668 - DNA, 24 bp, Homo sapiens
ataaggaaatcaacttgcttatca

SEQ ID NO: 2486669 - DNA, 17 bp, Homo sapiens
ataaggtgctctctttc

SEQ ID NO: 2486670 - DNA, 20 bp, Homo sapiens
ataaggtgctctctttctgt

SEQ ID NO: 2486671 - DNA, 19 bp, Homo sapiens
ataaggttttaatttagta

SEQ ID NO: 2486672 - DNA, 22 bp, Homo sapiens
ataagtggacaaattttgagtt

SEQ ID NO: 2486673 - DNA, 14 bp, Homo sapiens
ataagtgtacatat

SEQ ID NO: 2486674 - DNA, 20 bp, Homo sapiens
ataagtgtacatatgtgctg

SEQ ID NO: 2486675 - DNA, 14 bp, Homo sapiens
ataagttattgcag

SEQ ID NO: 2486676 - DNA, 16 bp, Homo sapiens
ataagttattgcagtt

SEQ ID NO: 2486677 - DNA, 13 bp, Homo sapiens
ataagttttatgt

SEQ ID NO: 2486678 - DNA, 14 bp, Homo sapiens
ataataaagaatag

SEQ ID NO: 2486679 - DNA, 15 bp, Homo sapiens
ataatatattttctg

SEQ ID NO: 2486680 - DNA, 16 bp, Homo sapiens
ataatgtgaaaatggt

SEQ ID NO: 2486681 - DNA, 18 bp, Homo sapiens
ataatgtgtagttcatgt

SEQ ID NO: 2486682 - DNA, 19 bp, Homo sapiens
ataatgttgttatttaaag

SEQ ID NO: 2486683 - DNA, 19 bp, Homo sapiens
ataattatataactgtatt

SEQ ID NO: 2486684 - DNA, 15 bp, Homo sapiens
ataattctcattaaa

SEQ ID NO: 2486685 - DNA, 23 bp, Homo sapiens
ataattctcattaaaagaatatc

SEQ ID NO: 2486686 - DNA, 23 bp, Homo sapiens
ataattctgagttttgtgtttgt

SEQ ID NO: 2486687 - DNA, 15 bp, Homo sapiens
ataattctttcaata

SEQ ID NO: 2486688 - DNA, 16 bp, Homo sapiens
ataattggatttccta

SEQ ID NO: 2486689 - DNA, 18 bp, Homo sapiens
ataattggatttcctaat

SEQ ID NO: 2486690 - DNA, 23 bp, Homo sapiens
ataattgttgttctgttaactga

SEQ ID NO: 2486691 - DNA, 13 bp, Homo sapiens
ataatttacctaa

SEQ ID NO: 2486692 - DNA, 23 bp, Homo sapiens
ataatttacctaagattacaaat

SEQ ID NO: 2486693 - DNA, 17 bp, Homo sapiens
ataatttagtttcatat

SEQ ID NO: 2486694 - DNA, 14 bp, Homo sapiens
ataattttaaattc

SEQ ID NO: 2486695 - DNA, 14 bp, Homo sapiens
ataatttttatatg

SEQ ID NO: 2486696 - DNA, 13 bp, Homo sapiens
atacaaatggatt

SEQ ID NO: 2486697 - DNA, 20 bp, Homo sapiens
atacaaatggattttgggag

SEQ ID NO: 2486698 - DNA, 17 bp, Homo sapiens
atacaattttttttatt

SEQ ID NO: 2486699 - DNA, 11 bp, Homo sapiens
atacactgtgt

SEQ ID NO: 2486700 - DNA, 23 bp, Homo sapiens
atacactttttctctttccatga

SEQ ID NO: 2486701 - DNA, 23 bp, Homo sapiens
atacagagaagtcacagggcagt

SEQ ID NO: 2486702 - DNA, 13 bp, Homo sapiens
atacagatatatt

SEQ ID NO: 2486703 - DNA, 14 bp, Homo sapiens
atacagatatattt

SEQ ID NO: 2486704 - DNA, 18 bp, Homo sapiens
atacagatatattttctt

SEQ ID NO: 2486705 - DNA, 17 bp, Homo sapiens
atacagatcatcttgga

SEQ ID NO: 2486706 - DNA, 17 bp, Homo sapiens
atacaggagattctctt

SEQ ID NO: 2486707 - DNA, 20 bp, Homo sapiens
atacagtcttccatttgcaa

SEQ ID NO: 2486708 - DNA, 18 bp, Homo sapiens
atacatagggatatgcgt

SEQ ID NO: 2486709 - DNA, 16 bp, Homo sapiens
ataccacctttactgt

SEQ ID NO: 2486710 - DNA, 15 bp, Homo sapiens
ataccctgacctggc

SEQ ID NO: 2486711 - DNA, 19 bp, Homo sapiens
ataccctggccgccccctg

SEQ ID NO: 2486712 - DNA, 12 bp, Homo sapiens
atacctcacttt

SEQ ID NO: 2486713 - DNA, 19 bp, Homo sapiens
atacctgtgtttcttgcct

SEQ ID NO: 2486714 - DNA, 22 bp, Homo sapiens
atacctgtgtttcttgcctcat

SEQ ID NO: 2486715 - DNA, 15 bp, Homo sapiens
atacgaaataattgt

SEQ ID NO: 2486716 - DNA, 17 bp, Homo sapiens
atacgagagcagaggtc

SEQ ID NO: 2486717 - DNA, 20 bp, Homo sapiens
atacgagagcagaggtctcc

SEQ ID NO: 2486718 - DNA, 15 bp, Homo sapiens
atacgtgcacagggt

SEQ ID NO: 2486719 - DNA, 13 bp, Homo sapiens
atactaaaaagaa

SEQ ID NO: 2486720 - DNA, 17 bp, Homo sapiens
atactaccttgaaaata

SEQ ID NO: 2486721 - DNA, 20 bp, Homo sapiens
atactagggagccatttgag

SEQ ID NO: 2486722 - DNA, 22 bp, Homo sapiens
atactattaaaaaggtttacag

SEQ ID NO: 2486723 - DNA, 21 bp, Homo sapiens
atactatttaaagcctcctca

SEQ ID NO: 2486724 - DNA, 22 bp, Homo sapiens
atactatttaaagcctcctcat

SEQ ID NO: 2486725 - DNA, 23 bp, Homo sapiens
atactctagatgaagttttacat

SEQ ID NO: 2486726 - DNA, 20 bp, Homo sapiens
atactctcaccatttggatc

SEQ ID NO: 2486727 - DNA, 14 bp, Homo sapiens
atactctttctgta

SEQ ID NO: 2486728 - DNA, 14 bp, Homo sapiens
aggtatatactttg

SEQ ID NO: 2486729 - DNA, 17 bp, Homo sapiens
aggtccagctctggagg

SEQ ID NO: 2486730 - DNA, 18 bp, Homo sapiens
aggtccagctctggaggg

SEQ ID NO: 2486731 - DNA, 18 bp, Homo sapiens
aggtccctgctgccagct

SEQ ID NO: 2486732 - DNA, 14 bp, Homo sapiens
aggtcctctgtcag

SEQ ID NO: 2486733 - DNA, 15 bp, Homo sapiens
aggtcctgagcactg

SEQ ID NO: 2486734 - DNA, 21 bp, Homo sapiens
aggtcctgagcactgccagga

SEQ ID NO: 2486735 - DNA, 23 bp, Homo sapiens
aggtcctgagcactgccaggagg

SEQ ID NO: 2486736 - DNA, 19 bp, Homo sapiens
aggtcctggtggggcagct

SEQ ID NO: 2486737 - DNA, 20 bp, Homo sapiens
aggtcctggtggggcagctc

SEQ ID NO: 2486738 - DNA, 20 bp, Homo sapiens
aggtcgcttgggaattttat

SEQ ID NO: 2486739 - DNA, 13 bp, Homo sapiens
aggtctccctgga

SEQ ID NO: 2486740 - DNA, 23 bp, Homo sapiens
aggtctgaaatttttcttcttga

SEQ ID NO: 2486741 - DNA, 19 bp, Homo sapiens
aggtgaaactccagatgcc

SEQ ID NO: 2486742 - DNA, 21 bp, Homo sapiens
aggtgaatagccatatttgta

SEQ ID NO: 2486743 - DNA, 22 bp, Homo sapiens
aggtgaatagccatatttgtaa

SEQ ID NO: 2486744 - DNA, 19 bp, Homo sapiens
aggtgacatcggaaaaata

SEQ ID NO: 2486745 - DNA, 16 bp, Homo sapiens
aggtgaccccagggca

SEQ ID NO: 2486746 - DNA, 14 bp, Homo sapiens
aggtgactgtctgg

SEQ ID NO: 2486747 - DNA, 17 bp, Homo sapiens
aggtgactgtctgggga

SEQ ID NO: 2486748 - DNA, 18 bp, Homo sapiens
aggtgactgtctggggag

SEQ ID NO: 2486749 - DNA, 19 bp, Homo sapiens
aggtgatccatgtaactgc

SEQ ID NO: 2486750 - DNA, 21 bp, Homo sapiens
aggtgcaacagacttgaatgc

SEQ ID NO: 2486751 - DNA, 15 bp, Homo sapiens
aggtgcaatttcaag

SEQ ID NO: 2486752 - DNA, 19 bp, Homo sapiens
aggtgcaatttcaaggttc

SEQ ID NO: 2486753 - DNA, 17 bp, Homo sapiens
aggtgctaatttgtttt

SEQ ID NO: 2486754 - DNA, 20 bp, Homo sapiens
aggtgctaatttgttttgga

SEQ ID NO: 2486755 - DNA, 17 bp, Homo sapiens
aggtgctgacggccagg

SEQ ID NO: 2486756 - DNA, 17 bp, Homo sapiens
aggtgctggggcctggt

SEQ ID NO: 2486757 - DNA, 16 bp, Homo sapiens
aggtggatctatttca

SEQ ID NO: 2486758 - DNA, 16 bp, Homo sapiens
aggtggatggccccag

SEQ ID NO: 2486759 - DNA, 19 bp, Homo sapiens
aggtggggagactgggctg

SEQ ID NO: 2486760 - DNA, 21 bp, Homo sapiens
aggtggggagactgggctgag

SEQ ID NO: 2486761 - DNA, 19 bp, Homo sapiens
aggtgtcctacagaaaaac

SEQ ID NO: 2486762 - DNA, 13 bp, Homo sapiens
aggtgtctcaggc

SEQ ID NO: 2486763 - DNA, 17 bp, Homo sapiens
aggtgtctcaggctgcc

SEQ ID NO: 2486764 - DNA, 22 bp, Homo sapiens
agtcaacagtaaaccactgaaa

SEQ ID NO: 2486765 - DNA, 21 bp, Homo sapiens
agtcaatacatagtgctgctg

SEQ ID NO: 2486766 - DNA, 24 bp, Homo sapiens
agtcaatcaagtctgtttactgca

SEQ ID NO: 2486767 - DNA, 17 bp, Homo sapiens
agtcacacagtgttgga

SEQ ID NO: 2486768 - DNA, 18 bp, Homo sapiens
agtcacgcatgcagtgtt

SEQ ID NO: 2486769 - DNA, 20 bp, Homo sapiens
agtcacggctgcgcactgtg

SEQ ID NO: 2486770 - DNA, 21 bp, Homo sapiens
agtcacggctgcgcactgtgt

SEQ ID NO: 2486771 - DNA, 17 bp, Homo sapiens
agtcactctagtcaatg

SEQ ID NO: 2486772 - DNA, 12 bp, Homo sapiens
agtcactgctct

SEQ ID NO: 2486773 - DNA, 23 bp, Homo sapiens
agtcagagccatgtcttctccct

SEQ ID NO: 2486774 - DNA, 20 bp, Homo sapiens
agtcagatggaaaattcatt

SEQ ID NO: 2486775 - DNA, 22 bp, Homo sapiens
agtcagatggaaaattcatttt

SEQ ID NO: 2486776 - DNA, 14 bp, Homo sapiens
agtcataccaatga

SEQ ID NO: 2486777 - DNA, 17 bp, Homo sapiens
agtcataccaatgaaaa

SEQ ID NO: 2486778 - DNA, 20 bp, Homo sapiens
agtcatatatatcacccaga

SEQ ID NO: 2486779 - DNA, 13 bp, Homo sapiens
agtcatcttgcta

SEQ ID NO: 2486780 - DNA, 14 bp, Homo sapiens
agtcatgtttatct

SEQ ID NO: 2486781 - DNA, 19 bp, Homo sapiens
agtcatttgctgagcatgt

SEQ ID NO: 2486782 - DNA, 14 bp, Homo sapiens
agtcatttttacaa

SEQ ID NO: 2486783 - DNA, 14 bp, Homo sapiens
agtccaagctggga

SEQ ID NO: 2486784 - DNA, 16 bp, Homo sapiens
agtccaagctgggaga

SEQ ID NO: 2486785 - DNA, 16 bp, Homo sapiens
agtccaaggtttaaag

SEQ ID NO: 2486786 - DNA, 14 bp, Homo sapiens
agtccaatgtggca

SEQ ID NO: 2486787 - DNA, 15 bp, Homo sapiens
agtccacctgaggaa

SEQ ID NO: 2486788 - DNA, 20 bp, Homo sapiens
agtccacttctgacagcctc

SEQ ID NO: 2486789 - DNA, 22 bp, Homo sapiens
agtccaggatgctaacatctaa

SEQ ID NO: 2486790 - DNA, 18 bp, Homo sapiens
agtccaggctgccgtggg

SEQ ID NO: 2486791 - DNA, 16 bp, Homo sapiens
agtccaggtcctggtg

SEQ ID NO: 2486792 - DNA, 20 bp, Homo sapiens
agtcccaggttggctctgcc

SEQ ID NO: 2486793 - DNA, 21 bp, Homo sapiens
agtcccaggttggctctgcca

SEQ ID NO: 2486794 - DNA, 22 bp, Homo sapiens
agtcccaggttggctctgccag

SEQ ID NO: 2486795 - DNA, 16 bp, Homo sapiens
agtcccctcacctcct

SEQ ID NO: 2486796 - DNA, 19 bp, Homo sapiens
agtccctgcacagtgactt

SEQ ID NO: 2486797 - DNA, 16 bp, Homo sapiens
agtcctatctgggctt

SEQ ID NO: 2486798 - DNA, 19 bp, Homo sapiens
agtcctatctgggcttcct

SEQ ID NO: 2486799 - DNA, 14 bp, Homo sapiens
agtcctgaaggaca

SEQ ID NO: 2486800 - DNA, 22 bp, Homo sapiens
agtcctgcgaaaacccccaaac

SEQ ID NO: 2486801 - DNA, 22 bp, Homo sapiens
agtcctgtgaatgccactgcct

SEQ ID NO: 2486802 - DNA, 21 bp, Homo sapiens
agtcctttttttccatcttta

SEQ ID NO: 2486803 - DNA, 17 bp, Homo sapiens
agtcgtccttactcctg

SEQ ID NO: 2486804 - DNA, 19 bp, Homo sapiens
agtcgtccttactcctgtg

SEQ ID NO: 2486805 - DNA, 22 bp, Homo sapiens
agtcgtccttactcctgtggga

SEQ ID NO: 2486806 - DNA, 13 bp, Homo sapiens
agtcgtgcctgtg

SEQ ID NO: 2486807 - DNA, 14 bp, Homo sapiens
agtcgtgcctgtgt

SEQ ID NO: 2486808 - DNA, 19 bp, Homo sapiens
agtcgtggggtgtgctggg

SEQ ID NO: 2486809 - DNA, 21 bp, Homo sapiens
agtcgtggggtgtgctgggag

SEQ ID NO: 2486810 - DNA, 20 bp, Homo sapiens
agtctaaagatggagtttct

SEQ ID NO: 2486811 - DNA, 21 bp, Homo sapiens
agtctaaagatggagtttcta

SEQ ID NO: 2486812 - DNA, 23 bp, Homo sapiens
agtctaaagatggagtttctaag

SEQ ID NO: 2486813 - DNA, 22 bp, Homo sapiens
agtctagattcaaaggttctag

SEQ ID NO: 2486814 - DNA, 10 bp, Homo sapiens
agtctcagtt

SEQ ID NO: 2486815 - DNA, 18 bp, Homo sapiens
agtctcagtttgtgtgtc

SEQ ID NO: 2486816 - DNA, 15 bp, Homo sapiens
agtctctcttctctc

SEQ ID NO: 2486817 - DNA, 18 bp, Homo sapiens
agtctctcttctctccag

SEQ ID NO: 2486818 - DNA, 21 bp, Homo sapiens
agtctctcttctctccagctg

SEQ ID NO: 2486819 - DNA, 11 bp, Homo sapiens
agtctctgagc

SEQ ID NO: 2486820 - DNA, 16 bp, Homo sapiens
agtctctgctggccca

SEQ ID NO: 2486821 - DNA, 20 bp, Homo sapiens
agtctgaacctatttcttaa

SEQ ID NO: 2486822 - DNA, 14 bp, Homo sapiens
agtctgccacccag

SEQ ID NO: 2486823 - DNA, 11 bp, Homo sapiens
agtctgccagg

SEQ ID NO: 2486824 - DNA, 13 bp, Homo sapiens
agtctgccagggc

SEQ ID NO: 2486825 - DNA, 22 bp, Homo sapiens
agtctgccagggcccctctccc

SEQ ID NO: 2486826 - DNA, 12 bp, Homo sapiens
agtctgtccttg

SEQ ID NO: 2486827 - DNA, 14 bp, Homo sapiens
agtcttaactggtc

SEQ ID NO: 2486828 - DNA, 15 bp, Homo sapiens
agtctttggttctaa

SEQ ID NO: 2486829 - DNA, 16 bp, Homo sapiens
agtctttggttctaag

SEQ ID NO: 2486830 - DNA, 20 bp, Homo sapiens
agtcttttgcttttggcaaa

SEQ ID NO: 2486831 - DNA, 16 bp, Homo sapiens
agtgaaaactttgtag

SEQ ID NO: 2486832 - DNA, 14 bp, Homo sapiens
agtgaaaatatagc

SEQ ID NO: 2486833 - DNA, 19 bp, Homo sapiens
agtgaaataatgtgtagtt

SEQ ID NO: 2486834 - DNA, 18 bp, Homo sapiens
agtgaacttagtcctgtt

SEQ ID NO: 2486835 - DNA, 13 bp, Homo sapiens
agtgaagacagaa

SEQ ID NO: 2486836 - DNA, 15 bp, Homo sapiens
agtgaaggcttctct

SEQ ID NO: 2486837 - DNA, 16 bp, Homo sapiens
agtgaagttgctgctt

SEQ ID NO: 2486838 - DNA, 23 bp, Homo sapiens
agtgaagttgctgcttctcccag

SEQ ID NO: 2486839 - DNA, 14 bp, Homo sapiens
agtgaataaatgtc

SEQ ID NO: 2486840 - DNA, 16 bp, Homo sapiens
agtgaatactgctaca

SEQ ID NO: 2486841 - DNA, 13 bp, Homo sapiens
agtgaatgattca

SEQ ID NO: 2486842 - DNA, 17 bp, Homo sapiens
agtgaatgattcagtgt

SEQ ID NO: 2486843 - DNA, 15 bp, Homo sapiens
agtgaatgctgggac

SEQ ID NO: 2486844 - DNA, 14 bp, Homo sapiens
agtgaattccctca

SEQ ID NO: 2486845 - DNA, 23 bp, Homo sapiens
agtgaattccctcactcgtctcc

SEQ ID NO: 2486846 - DNA, 12 bp, Homo sapiens
agtgacttctga

SEQ ID NO: 2486847 - DNA, 13 bp, Homo sapiens
agtgacttctgag

SEQ ID NO: 2486848 - DNA, 15 bp, Homo sapiens
agtgacttctgagat

SEQ ID NO: 2486849 - DNA, 16 bp, Homo sapiens
agtgacttgtgtccca

SEQ ID NO: 2486850 - DNA, 21 bp, Homo sapiens
agtgagcatggaacacttcga

SEQ ID NO: 2486851 - DNA, 22 bp, Homo sapiens
agtgagcatggaacacttcgag

SEQ ID NO: 2486852 - DNA, 15 bp, Homo sapiens
agtgagtctctctgg

SEQ ID NO: 2486853 - DNA, 20 bp, Homo sapiens
agtgatagtcttttgctttt

SEQ ID NO: 2486854 - DNA, 17 bp, Homo sapiens
agtgattgtcttaatat

SEQ ID NO: 2486855 - DNA, 20 bp, Homo sapiens
agtgcaataaatctgaccca

SEQ ID NO: 2486856 - DNA, 22 bp, Homo sapiens
agtgcaataaatctgacccagt

SEQ ID NO: 2486857 - DNA, 18 bp, Homo sapiens
agtgcccccactgaccag

SEQ ID NO: 2486858 - DNA, 13 bp, Homo sapiens
agtgccctctccc

SEQ ID NO: 2486859 - DNA, 15 bp, Homo sapiens
agtgccctctcccac

SEQ ID NO: 2486860 - DNA, 18 bp, Homo sapiens
agtgccctctcccaccct

SEQ ID NO: 2486861 - DNA, 15 bp, Homo sapiens
agtgccctctcccct

SEQ ID NO: 2486862 - DNA, 13 bp, Homo sapiens
agtgcctttcagg

SEQ ID NO: 2486863 - DNA, 16 bp, Homo sapiens
agtgcgggtccggcag

SEQ ID NO: 2486864 - DNA, 14 bp, Homo sapiens
agtgctaaggttct

SEQ ID NO: 2486865 - DNA, 16 bp, Homo sapiens
agtgctaaggttctaa

SEQ ID NO: 2486866 - DNA, 16 bp, Homo sapiens
agtgctacagggtcca

SEQ ID NO: 2486867 - DNA, 11 bp, Homo sapiens
agtgctccctc

SEQ ID NO: 2486868 - DNA, 21 bp, Homo sapiens
attcaggaaaaggcctggggt

SEQ ID NO: 2486869 - DNA, 19 bp, Homo sapiens
attcaggactgctggtttg

SEQ ID NO: 2486870 - DNA, 19 bp, Homo sapiens
attcaggacttgaaagaaa

SEQ ID NO: 2486871 - DNA, 23 bp, Homo sapiens
attcagggaaggaggagcctgtc

SEQ ID NO: 2486872 - DNA, 19 bp, Homo sapiens
attcagtgttaaatgtgat

SEQ ID NO: 2486873 - DNA, 14 bp, Homo sapiens
attcagtttcataa

SEQ ID NO: 2486874 - DNA, 17 bp, Homo sapiens
attcagtttcataaaag

SEQ ID NO: 2486875 - DNA, 13 bp, Homo sapiens
attcagttttcat

SEQ ID NO: 2486876 - DNA, 16 bp, Homo sapiens
attccaaagtctctaa

SEQ ID NO: 2486877 - DNA, 19 bp, Homo sapiens
attccaaagtctctaattc

SEQ ID NO: 2486878 - DNA, 18 bp, Homo sapiens
attccaacagtttaatga

SEQ ID NO: 2486879 - DNA, 20 bp, Homo sapiens
attccaacagtttaatgaag

SEQ ID NO: 2486880 - DNA, 16 bp, Homo sapiens
attccacctgcaatca

SEQ ID NO: 2486881 - DNA, 15 bp, Homo sapiens
attccagaatgctgt

SEQ ID NO: 2486882 - DNA, 17 bp, Homo sapiens
attccagcccctctggt

SEQ ID NO: 2486883 - DNA, 13 bp, Homo sapiens
attccagctgtcc

SEQ ID NO: 2486884 - DNA, 17 bp, Homo sapiens
attccatgactgcttgc

SEQ ID NO: 2486885 - DNA, 14 bp, Homo sapiens
attccatgtgccca

SEQ ID NO: 2486886 - DNA, 22 bp, Homo sapiens
attcccctctgctgctgtccct

SEQ ID NO: 2486887 - DNA, 17 bp, Homo sapiens
attccctagaaacttcc

SEQ ID NO: 2486888 - DNA, 15 bp, Homo sapiens
attccctctcccagg

SEQ ID NO: 2486889 - DNA, 16 bp, Homo sapiens
attccctctcccaggc

SEQ ID NO: 2486890 - DNA, 19 bp, Homo sapiens
attcccttcctgccagccc

SEQ ID NO: 2486891 - DNA, 23 bp, Homo sapiens
attcccttcctgccagcccctgc

SEQ ID NO: 2486892 - DNA, 17 bp, Homo sapiens
attcctcatgaatgtaa

SEQ ID NO: 2486893 - DNA, 18 bp, Homo sapiens
attcctcatgaatgtaaa

SEQ ID NO: 2486894 - DNA, 20 bp, Homo sapiens
attcctctactaacaatcag

SEQ ID NO: 2486895 - DNA, 18 bp, Homo sapiens
attcctgacctccgccat

SEQ ID NO: 2486896 - DNA, 22 bp, Homo sapiens
attcctgacctccgccatccac

SEQ ID NO: 2486897 - DNA, 16 bp, Homo sapiens
attccttcccagaggg

SEQ ID NO: 2486898 - DNA, 16 bp, Homo sapiens
attcgtgtgttttttt

SEQ ID NO: 2486899 - DNA, 20 bp, Homo sapiens
attctaaaatgattgtagta

SEQ ID NO: 2486900 - DNA, 23 bp, Homo sapiens
attctaaaatgtgatgttctaag

SEQ ID NO: 2486901 - DNA, 14 bp, Homo sapiens
attctaaagattct

SEQ ID NO: 2486902 - DNA, 20 bp, Homo sapiens
attctaaagattctatagtt

SEQ ID NO: 2486903 - DNA, 17 bp, Homo sapiens
attctaaatgaatgttt

SEQ ID NO: 2486904 - DNA, 18 bp, Homo sapiens
attctaacggtctgttct

SEQ ID NO: 2486905 - DNA, 20 bp, Homo sapiens
attctaagacttactctaag

SEQ ID NO: 2486906 - DNA, 23 bp, Homo sapiens
attctaatgatgatcaattatag

SEQ ID NO: 2486907 - DNA, 15 bp, Homo sapiens
attctatagttctag

SEQ ID NO: 2486908 - DNA, 17 bp, Homo sapiens
attctatagttctagac

SEQ ID NO: 2486909 - DNA, 15 bp, Homo sapiens
attctattaaagtgc

SEQ ID NO: 2486910 - DNA, 20 bp, Homo sapiens
attctattacattttcagtg

SEQ ID NO: 2486911 - DNA, 11 bp, Homo sapiens
attctcattgg

SEQ ID NO: 2486912 - DNA, 22 bp, Homo sapiens
attctcattggaaatttagcat

SEQ ID NO: 2486913 - DNA, 12 bp, Homo sapiens
attctcctcctc

SEQ ID NO: 2486914 - DNA, 11 bp, Homo sapiens
attctcctgga

SEQ ID NO: 2486915 - DNA, 14 bp, Homo sapiens
attctctgtctcat

SEQ ID NO: 2486916 - DNA, 18 bp, Homo sapiens
attctctgtctcatccat

SEQ ID NO: 2486917 - DNA, 20 bp, Homo sapiens
attctctgtgtctaagattc

SEQ ID NO: 2486918 - DNA, 19 bp, Homo sapiens
attctgaactaaagtgctg

SEQ ID NO: 2486919 - DNA, 20 bp, Homo sapiens
attctgactcggtttctcca

SEQ ID NO: 2486920 - DNA, 17 bp, Homo sapiens
attctgagttttgtgtt

SEQ ID NO: 2486921 - DNA, 22 bp, Homo sapiens
attctgcaagcacatctgcatt

SEQ ID NO: 2486922 - DNA, 13 bp, Homo sapiens
attctgctccttc

SEQ ID NO: 2486923 - DNA, 16 bp, Homo sapiens
attctgctggcctctg

SEQ ID NO: 2486924 - DNA, 15 bp, Homo sapiens
attctggacaggatg

SEQ ID NO: 2486925 - DNA, 16 bp, Homo sapiens
attctgggggctgcag

SEQ ID NO: 2486926 - DNA, 16 bp, Homo sapiens
attctggttccagggt

SEQ ID NO: 2486927 - DNA, 19 bp, Homo sapiens
attctggttccagggtccc

SEQ ID NO: 2486928 - DNA, 23 bp, Homo sapiens
attctggttccagggtccctctg

SEQ ID NO: 2486929 - DNA, 18 bp, Homo sapiens
attctgtccctaggtgtt

SEQ ID NO: 2486930 - DNA, 13 bp, Homo sapiens
attcttctagagt

SEQ ID NO: 2486931 - DNA, 17 bp, Homo sapiens
attcttgatgtaaaatc

SEQ ID NO: 2486932 - DNA, 16 bp, Homo sapiens
attctttcaatacaga

SEQ ID NO: 2486933 - DNA, 22 bp, Homo sapiens
attctttcaatacagatatatt

SEQ ID NO: 2486934 - DNA, 16 bp, Homo sapiens
attctttccatttgca

SEQ ID NO: 2486935 - DNA, 19 bp, Homo sapiens
attctttccatttgcattt

SEQ ID NO: 2486936 - DNA, 20 bp, Homo sapiens
attctttccatttgcatttg

SEQ ID NO: 2486937 - DNA, 21 bp, Homo sapiens
attctttcccaattcacatct

SEQ ID NO: 2486938 - DNA, 19 bp, Homo sapiens
attctttcccagtctgtcg

SEQ ID NO: 2486939 - DNA, 19 bp, Homo sapiens
attgaaggcttaaacccat

SEQ ID NO: 2486940 - DNA, 15 bp, Homo sapiens
attgaagtaaacttt

SEQ ID NO: 2486941 - DNA, 15 bp, Homo sapiens
attgaatactttgaa

SEQ ID NO: 2486942 - DNA, 20 bp, Homo sapiens
attgaatactttgaatgtgt

SEQ ID NO: 2486943 - DNA, 21 bp, Homo sapiens
attgaatggctatgtttttaa

SEQ ID NO: 2486944 - DNA, 23 bp, Homo sapiens
attgaatggctatgtttttaatg

SEQ ID NO: 2486945 - DNA, 20 bp, Homo sapiens
attgaattcttggttgagga

SEQ ID NO: 2486946 - DNA, 17 bp, Homo sapiens
attgacaacagttacat

SEQ ID NO: 2486947 - DNA, 14 bp, Homo sapiens
attgacacagaaaa

SEQ ID NO: 2486948 - DNA, 22 bp, Homo sapiens
attgacgacaagtgctgaacag

SEQ ID NO: 2486949 - DNA, 15 bp, Homo sapiens
attgagtcaaatggt

SEQ ID NO: 2486950 - DNA, 12 bp, Homo sapiens
attgatttgcat

SEQ ID NO: 2486951 - DNA, 15 bp, Homo sapiens
attgatttgcattga

SEQ ID NO: 2486952 - DNA, 16 bp, Homo sapiens
attgatttttctcttc

SEQ ID NO: 2486953 - DNA, 17 bp, Homo sapiens
attgcaaatcttgaaat

SEQ ID NO: 2486954 - DNA, 17 bp, Homo sapiens
attgcaatatctgaagc

SEQ ID NO: 2486955 - DNA, 15 bp, Homo sapiens
attgcacattgtaaa

SEQ ID NO: 2486956 - DNA, 21 bp, Homo sapiens
attgcacttggcctcatgctg

SEQ ID NO: 2486957 - DNA, 17 bp, Homo sapiens
attgcaggatggtgtct

SEQ ID NO: 2486958 - DNA, 17 bp, Homo sapiens
attgcagtttatcattc

SEQ ID NO: 2486959 - DNA, 23 bp, Homo sapiens
attgcagtttatcattcaagtgt

SEQ ID NO: 2486960 - DNA, 15 bp, Homo sapiens
attgcattgactttc

SEQ ID NO: 2486961 - DNA, 14 bp, Homo sapiens
attgccaagggctt

SEQ ID NO: 2486962 - DNA, 12 bp, Homo sapiens
attgccacctct

SEQ ID NO: 2486963 - DNA, 17 bp, Homo sapiens
attgctgagaagcaaac

SEQ ID NO: 2486964 - DNA, 20 bp, Homo sapiens
attgctgccccatcagtgct

SEQ ID NO: 2486965 - DNA, 21 bp, Homo sapiens
attgcttacaagcctaagaat

SEQ ID NO: 2486966 - DNA, 17 bp, Homo sapiens
attgcttatttattgta

SEQ ID NO: 2486967 - DNA, 23 bp, Homo sapiens
attgcttatttattgtattctgg

SEQ ID NO: 2486968 - DNA, 16 bp, Homo sapiens
attgcttcctcctccc

SEQ ID NO: 2486969 - DNA, 16 bp, Homo sapiens
attggaaatttagcat

SEQ ID NO: 2486970 - DNA, 22 bp, Homo sapiens
attggaagagcagcacctcctc

SEQ ID NO: 2486971 - DNA, 24 bp, Homo sapiens
attggaagagcagcacctcctcag

SEQ ID NO: 2486972 - DNA, 17 bp, Homo sapiens
attggacaaagaacctt

SEQ ID NO: 2486973 - DNA, 19 bp, Homo sapiens
attggcaccgaagcccaga

SEQ ID NO: 2486974 - DNA, 22 bp, Homo sapiens
attggcatggaaatttaaagca

SEQ ID NO: 2486975 - DNA, 17 bp, Homo sapiens
attggctatttaaaact

SEQ ID NO: 2486976 - DNA, 18 bp, Homo sapiens
attggtgtttttttctat

SEQ ID NO: 2486977 - DNA, 15 bp, Homo sapiens
attggtttaaagaaa

SEQ ID NO: 2486978 - DNA, 17 bp, Homo sapiens
attggtttaaagaaagt

SEQ ID NO: 2486979 - DNA, 15 bp, Homo sapiens
attgtaaaaatggca

SEQ ID NO: 2486980 - DNA, 14 bp, Homo sapiens
attgtaaaacaggt

SEQ ID NO: 2486981 - DNA, 13 bp, Homo sapiens
attgtaaaagcat

SEQ ID NO: 2486982 - DNA, 10 bp, Homo sapiens
attgtaactc

SEQ ID NO: 2486983 - DNA, 13 bp, Homo sapiens
attgtaactgttc

SEQ ID NO: 2486984 - DNA, 13 bp, Homo sapiens
attgtaatcactg

SEQ ID NO: 2486985 - DNA, 19 bp, Homo sapiens
attgtacgcgccaccgagt

SEQ ID NO: 2486986 - DNA, 15 bp, Homo sapiens
attgtagaattgtat

SEQ ID NO: 2486987 - DNA, 19 bp, Homo sapiens
attgtagaattgtatatag

SEQ ID NO: 2486988 - DNA, 17 bp, Homo sapiens
attgtatattgtaattt

SEQ ID NO: 2486989 - DNA, 18 bp, Homo sapiens
attgtctgaacttgcatt

SEQ ID NO: 2486990 - DNA, 22 bp, Homo sapiens
attgtgattagacagaacacct

SEQ ID NO: 2486991 - DNA, 15 bp, Homo sapiens
attgtgcaatgtaaa

SEQ ID NO: 2486992 - DNA, 20 bp, Homo sapiens
attgtgcaatgtaaatattt

SEQ ID NO: 2486993 - DNA, 18 bp, Homo sapiens
attgtgcaatgtgtataa

SEQ ID NO: 2486994 - DNA, 21 bp, Homo sapiens
attgtgcaatgtgtataaaca

SEQ ID NO: 2486995 - DNA, 22 bp, Homo sapiens
attgtgcaatgtgtataaacaa

SEQ ID NO: 2486996 - DNA, 16 bp, Homo sapiens
attgtgggtgttaatt

SEQ ID NO: 2486997 - DNA, 19 bp, Homo sapiens
attgtgtggattctttaaa

SEQ ID NO: 2486998 - DNA, 13 bp, Homo sapiens
attgtgtttgtgt

SEQ ID NO: 2486999 - DNA, 17 bp, Homo sapiens
attgttaatttttccta

SEQ ID NO: 2487000 - DNA, 17 bp, Homo sapiens
attgttgaaaaagtttg

SEQ ID NO: 2487001 - DNA, 17 bp, Homo sapiens
attgttgtccttttcat

SEQ ID NO: 2487002 - DNA, 21 bp, Homo sapiens
attgttgttctgttaactgaa

SEQ ID NO: 2487003 - DNA, 13 bp, Homo sapiens
attgtttcaattg

SEQ ID NO: 2487004 - DNA, 22 bp, Homo sapiens
attgtttcaattgcatctccca

SEQ ID NO: 2487005 - DNA, 19 bp, Homo sapiens
attgttttatctgaatttt

SEQ ID NO: 2487006 - DNA, 12 bp, Homo sapiens
atttaaaaataa

SEQ ID NO: 2487007 - DNA, 19 bp, Homo sapiens
atttaaaacattaaaatat

SEQ ID NO: 2487008 - DNA, 15 bp, Homo sapiens
atttaaaagcctgct

SEQ ID NO: 2487009 - DNA, 17 bp, Homo sapiens
atttaaaagcctgctca

SEQ ID NO: 2487010 - DNA, 18 bp, Homo sapiens
atttaaaatagcaaaaga

SEQ ID NO: 2487011 - DNA, 23 bp, Homo sapiens
atttaaaatagcaaaagaagaag

SEQ ID NO: 2487012 - DNA, 20 bp, Homo sapiens
atttaaaccgctaaaagaaa

SEQ ID NO: 2487013 - DNA, 21 bp, Homo sapiens
atttaaaccgctaaaagaaac

SEQ ID NO: 2487014 - DNA, 23 bp, Homo sapiens
atttaaaccgctaaaagaaactt

SEQ ID NO: 2487015 - DNA, 19 bp, Homo sapiens
atttaaactataagcaaga

SEQ ID NO: 2487016 - DNA, 19 bp, Homo sapiens
atttaaagaacaccctata

SEQ ID NO: 2487017 - DNA, 20 bp, Homo sapiens
atttaaagcaggttcttgtt

SEQ ID NO: 2487018 - DNA, 19 bp, Homo sapiens
atttaaatgtaaagacaaa

SEQ ID NO: 2487019 - DNA, 13 bp, Homo sapiens
atttaacagaaat

SEQ ID NO: 2487020 - DNA, 20 bp, Homo sapiens
atttaacagaaattgtatat

SEQ ID NO: 2487021 - DNA, 19 bp, Homo sapiens
atttaacccccctgtacac

SEQ ID NO: 2487022 - DNA, 14 bp, Homo sapiens
atttaatgctgtgg

SEQ ID NO: 2487023 - DNA, 18 bp, Homo sapiens
atttaatttgaaatatgg

SEQ ID NO: 2487024 - DNA, 19 bp, Homo sapiens
atttacaaaaatataaaat

SEQ ID NO: 2487025 - DNA, 14 bp, Homo sapiens
atttacaaactgaa

SEQ ID NO: 2487026 - DNA, 16 bp, Homo sapiens
atttacaggaacttca

SEQ ID NO: 2487027 - DNA, 11 bp, Homo sapiens
atttacctcag

SEQ ID NO: 2487028 - DNA, 13 bp, Homo sapiens
atttacctcagcc

SEQ ID NO: 2487029 - DNA, 16 bp, Homo sapiens
atttacctcagcctgg

SEQ ID NO: 2487030 - DNA, 17 bp, Homo sapiens
atttagaaaactttaaa

SEQ ID NO: 2487031 - DNA, 20 bp, Homo sapiens
atttagcattgtagtgcttt

SEQ ID NO: 2487032 - DNA, 15 bp, Homo sapiens
atttagcctgtcctg

SEQ ID NO: 2487033 - DNA, 22 bp, Homo sapiens
atttagctaaacggattccaaa

SEQ ID NO: 2487034 - DNA, 14 bp, Homo sapiens
atttagtaaaccaa

SEQ ID NO: 2487035 - DNA, 19 bp, Homo sapiens
atttagtaatagcctgggt

SEQ ID NO: 2487036 - DNA, 14 bp, Homo sapiens
atttagtttcagta

SEQ ID NO: 2487037 - DNA, 20 bp, Homo sapiens
atttagtttcagtagattgc

SEQ ID NO: 2487038 - DNA, 15 bp, Homo sapiens
atttatatatgtatt

SEQ ID NO: 2487039 - DNA, 21 bp, Homo sapiens
atttatcaaaccctagccttg

SEQ ID NO: 2487040 - DNA, 19 bp, Homo sapiens
atttatcacacaaagcaga

SEQ ID NO: 2487041 - DNA, 11 bp, Homo sapiens
atttatctata

SEQ ID NO: 2487042 - DNA, 14 bp, Homo sapiens
atttatgtatggtg

SEQ ID NO: 2487043 - DNA, 22 bp, Homo sapiens
atttatgtattgtgcaatgtgt

SEQ ID NO: 2487044 - DNA, 18 bp, Homo sapiens
atttattgactttgacaa

SEQ ID NO: 2487045 - DNA, 21 bp, Homo sapiens
atttattgcaggatggtgtct

SEQ ID NO: 2487046 - DNA, 15 bp, Homo sapiens
atttatttcctccct

SEQ ID NO: 2487047 - DNA, 16 bp, Homo sapiens
atttatttgaatgatt

SEQ ID NO: 2487048 - DNA, 21 bp, Homo sapiens
atttattttgacataaagttg

SEQ ID NO: 2487049 - DNA, 19 bp, Homo sapiens
atttcaacatgagtgtatt

SEQ ID NO: 2487050 - DNA, 12 bp, Homo sapiens
atttcaaggttc

SEQ ID NO: 2487051 - DNA, 19 bp, Homo sapiens
atttcagaagttagtttgt

SEQ ID NO: 2487052 - DNA, 23 bp, Homo sapiens
atttcagactcccattcctgaag

SEQ ID NO: 2487053 - DNA, 20 bp, Homo sapiens
atttcaggaggaatactgaa

SEQ ID NO: 2487054 - DNA, 22 bp, Homo sapiens
atttcaggaggaatactgaaca

SEQ ID NO: 2487055 - DNA, 13 bp, Homo sapiens
atttcatagttca

SEQ ID NO: 2487056 - DNA, 16 bp, Homo sapiens
atttcatagttcagaa

SEQ ID NO: 2487057 - DNA, 15 bp, Homo sapiens
atttcatgatttcat

SEQ ID NO: 2487058 - DNA, 23 bp, Homo sapiens
atttcatttttcaatagcacata

SEQ ID NO: 2487059 - DNA, 18 bp, Homo sapiens
atttcccaacacaaagat

SEQ ID NO: 2487060 - DNA, 16 bp, Homo sapiens
atttcccctccttccc

SEQ ID NO: 2487061 - DNA, 21 bp, Homo sapiens
atttcctaatactgtcatcct

SEQ ID NO: 2487062 - DNA, 23 bp, Homo sapiens
atttccttgaatgtggcttgaga

SEQ ID NO: 2487063 - DNA, 17 bp, Homo sapiens
atttcggattttttcca

SEQ ID NO: 2487064 - DNA, 14 bp, Homo sapiens
atttctaattatgt

SEQ ID NO: 2487065 - DNA, 19 bp, Homo sapiens
atttctaattatgtagctc

SEQ ID NO: 2487066 - DNA, 23 bp, Homo sapiens
atttctatagccaaaaatagcta

SEQ ID NO: 2487067 - DNA, 18 bp, Homo sapiens
atttctatttctcctcca

SEQ ID NO: 2487068 - DNA, 15 bp, Homo sapiens
atttctcaggctagg

SEQ ID NO: 2487069 - DNA, 16 bp, Homo sapiens
atttctcaggctaggc

SEQ ID NO: 2487070 - DNA, 22 bp, Homo sapiens
atttctcaggctaggccagcag

SEQ ID NO: 2487071 - DNA, 20 bp, Homo sapiens
atttctcctccatgggagaa

SEQ ID NO: 2487072 - DNA, 16 bp, Homo sapiens
atttctgcctcccctt

SEQ ID NO: 2487073 - DNA, 12 bp, Homo sapiens
atttctttgaaa

SEQ ID NO: 2487074 - DNA, 20 bp, Homo sapiens
atttctttttgggagagact

SEQ ID NO: 2487075 - DNA, 21 bp, Homo sapiens
atttctttttgggagagactt

SEQ ID NO: 2487076 - DNA, 21 bp, Homo sapiens
atgttttctgaaaatataacc

SEQ ID NO: 2487077 - DNA, 23 bp, Homo sapiens
atgttttggccaatgcacctaaa

SEQ ID NO: 2487078 - DNA, 16 bp, Homo sapiens
atgtttttaataaaag

SEQ ID NO: 2487079 - DNA, 19 bp, Homo sapiens
atgtttttgttcaaagcca

SEQ ID NO: 2487080 - DNA, 12 bp, Homo sapiens
atgttttttgcc

SEQ ID NO: 2487081 - DNA, 22 bp, Homo sapiens
atgttttttgccacagcttttg

SEQ ID NO: 2487082 - DNA, 17 bp, Homo sapiens
attaaaaaagataaaca

SEQ ID NO: 2487083 - DNA, 18 bp, Homo sapiens
attaaaaaggtttacaga

SEQ ID NO: 2487084 - DNA, 19 bp, Homo sapiens
attaaaaaggtttacagaa

SEQ ID NO: 2487085 - DNA, 16 bp, Homo sapiens
attaaaagaatatctg

SEQ ID NO: 2487086 - DNA, 16 bp, Homo sapiens
attaaaagcaaatcat

SEQ ID NO: 2487087 - DNA, 22 bp, Homo sapiens
attaaaagcaaatcatttgttt

SEQ ID NO: 2487088 - DNA, 11 bp, Homo sapiens
attaaaatgta

SEQ ID NO: 2487089 - DNA, 15 bp, Homo sapiens
attaaaatgtatgca

SEQ ID NO: 2487090 - DNA, 23 bp, Homo sapiens
attaaaatgtatgcatgttgtct

SEQ ID NO: 2487091 - DNA, 17 bp, Homo sapiens
attaaaccatctccctg

SEQ ID NO: 2487092 - DNA, 15 bp, Homo sapiens
attaaacgattttta

SEQ ID NO: 2487093 - DNA, 18 bp, Homo sapiens
attaaagaaaaaaatgta

SEQ ID NO: 2487094 - DNA, 21 bp, Homo sapiens
attaaagaaaaaaatgtattt

SEQ ID NO: 2487095 - DNA, 21 bp, Homo sapiens
attaaagaagggttgagctgg

SEQ ID NO: 2487096 - DNA, 22 bp, Homo sapiens
attaaagtgctaaggttctaag

SEQ ID NO: 2487097 - DNA, 13 bp, Homo sapiens
attaaataaattt

SEQ ID NO: 2487098 - DNA, 17 bp, Homo sapiens
attaaataagattctaa

SEQ ID NO: 2487099 - DNA, 18 bp, Homo sapiens
attaaattcacaaacttt

SEQ ID NO: 2487100 - DNA, 20 bp, Homo sapiens
attaaattttttaaaaagca

SEQ ID NO: 2487101 - DNA, 17 bp, Homo sapiens
attaaattttttgttga

SEQ ID NO: 2487102 - DNA, 18 bp, Homo sapiens
attaaattttttgttgac

SEQ ID NO: 2487103 - DNA, 19 bp, Homo sapiens
attaacaaaatgtatgtct

SEQ ID NO: 2487104 - DNA, 19 bp, Homo sapiens
attaactgggtaatgaaac

SEQ ID NO: 2487105 - DNA, 12 bp, Homo sapiens
attaagaaagga

SEQ ID NO: 2487106 - DNA, 13 bp, Homo sapiens
attaagaaaggaa

SEQ ID NO: 2487107 - DNA, 11 bp, Homo sapiens
attaagaaata

SEQ ID NO: 2487108 - DNA, 15 bp, Homo sapiens
attaagaaggcaaaa

SEQ ID NO: 2487109 - DNA, 14 bp, Homo sapiens
attaagcatcagaa

SEQ ID NO: 2487110 - DNA, 17 bp, Homo sapiens
attaagcatcagaaact

SEQ ID NO: 2487111 - DNA, 19 bp, Homo sapiens
attaatatccctacatgta

SEQ ID NO: 2487112 - DNA, 17 bp, Homo sapiens
attaatcttagtgtatg

SEQ ID NO: 2487113 - DNA, 13 bp, Homo sapiens
attaatgcacttt

SEQ ID NO: 2487114 - DNA, 12 bp, Homo sapiens
attaattatctt

SEQ ID NO: 2487115 - DNA, 20 bp, Homo sapiens
attaattcctgtttgtctac

SEQ ID NO: 2487116 - DNA, 19 bp, Homo sapiens
attaattgggccagctttt

SEQ ID NO: 2487117 - DNA, 22 bp, Homo sapiens
attaattgggccagcttttcaa

SEQ ID NO: 2487118 - DNA, 17 bp, Homo sapiens
attaatttatgcagaat

SEQ ID NO: 2487119 - DNA, 14 bp, Homo sapiens
attacacttggtaa

SEQ ID NO: 2487120 - DNA, 19 bp, Homo sapiens
attacagatgggcaaatta

SEQ ID NO: 2487121 - DNA, 16 bp, Homo sapiens
attacctgtggatatt

SEQ ID NO: 2487122 - DNA, 19 bp, Homo sapiens
attacctgtggatatttgt

SEQ ID NO: 2487123 - DNA, 15 bp, Homo sapiens
attacgtatgtctgg

SEQ ID NO: 2487124 - DNA, 17 bp, Homo sapiens
attactggcctttttca

SEQ ID NO: 2487125 - DNA, 18 bp, Homo sapiens
attacttgtaaatataaa

SEQ ID NO: 2487126 - DNA, 15 bp, Homo sapiens
attagaaataaagca

SEQ ID NO: 2487127 - DNA, 14 bp, Homo sapiens
attagaaatatttt

SEQ ID NO: 2487128 - DNA, 21 bp, Homo sapiens
attagaaatattttaaaatca

SEQ ID NO: 2487129 - DNA, 21 bp, Homo sapiens
attagaatcaaacattttgaa

SEQ ID NO: 2487130 - DNA, 18 bp, Homo sapiens
attagactgtgattcaga

SEQ ID NO: 2487131 - DNA, 16 bp, Homo sapiens
attagagcctgtaaac

SEQ ID NO: 2487132 - DNA, 17 bp, Homo sapiens
attagagtgtctttcca

SEQ ID NO: 2487133 - DNA, 17 bp, Homo sapiens
attaggctgtaactact

SEQ ID NO: 2487134 - DNA, 15 bp, Homo sapiens
attagggatgcctcc

SEQ ID NO: 2487135 - DNA, 16 bp, Homo sapiens
attagtaacatgtgtt

SEQ ID NO: 2487136 - DNA, 14 bp, Homo sapiens
attagtattgttgt

SEQ ID NO: 2487137 - DNA, 17 bp, Homo sapiens
attagtattgttgtcct

SEQ ID NO: 2487138 - DNA, 15 bp, Homo sapiens
attagtcatgtttat

SEQ ID NO: 2487139 - DNA, 20 bp, Homo sapiens
attagtgccacttaatgtat

SEQ ID NO: 2487140 - DNA, 12 bp, Homo sapiens
attagtttcctt

SEQ ID NO: 2487141 - DNA, 20 bp, Homo sapiens
attagtttcctttttaatat

SEQ ID NO: 2487142 - DNA, 14 bp, Homo sapiens
attataatgaattt

SEQ ID NO: 2487143 - DNA, 15 bp, Homo sapiens
attataccaaaatgt

SEQ ID NO: 2487144 - DNA, 19 bp, Homo sapiens
attataccaaaatgttgct

SEQ ID NO: 2487145 - DNA, 16 bp, Homo sapiens
attatacttgtaatta

SEQ ID NO: 2487146 - DNA, 13 bp, Homo sapiens
attatagattcta

SEQ ID NO: 2487147 - DNA, 15 bp, Homo sapiens
attatagattctaaa

SEQ ID NO: 2487148 - DNA, 17 bp, Homo sapiens
attatagattctaaaga

SEQ ID NO: 2487149 - DNA, 16 bp, Homo sapiens
attatagtttctgagg

SEQ ID NO: 2487150 - DNA, 17 bp, Homo sapiens
attatatgttgtaagca

SEQ ID NO: 2487151 - DNA, 22 bp, Homo sapiens
attatatttctattttattatg

SEQ ID NO: 2487152 - DNA, 12 bp, Homo sapiens
attatcagatgc

SEQ ID NO: 2487153 - DNA, 14 bp, Homo sapiens
attatccatattga

SEQ ID NO: 2487154 - DNA, 17 bp, Homo sapiens
attatccatattgagtc

SEQ ID NO: 2487155 - DNA, 14 bp, Homo sapiens
attatcccagctgc

SEQ ID NO: 2487156 - DNA, 16 bp, Homo sapiens
attatgcattatatca

SEQ ID NO: 2487157 - DNA, 16 bp, Homo sapiens
attatgggtcacagga

SEQ ID NO: 2487158 - DNA, 12 bp, Homo sapiens
attatgtaaatt

SEQ ID NO: 2487159 - DNA, 13 bp, Homo sapiens
attattacagtgt

SEQ ID NO: 2487160 - DNA, 16 bp, Homo sapiens
attattacttgtaaat

SEQ ID NO: 2487161 - DNA, 23 bp, Homo sapiens
attattacttgtaaatataaaga

SEQ ID NO: 2487162 - DNA, 15 bp, Homo sapiens
attattattcttcat

SEQ ID NO: 2487163 - DNA, 15 bp, Homo sapiens
attattatttgtgtt

SEQ ID NO: 2487164 - DNA, 16 bp, Homo sapiens
attatttatatatgta

SEQ ID NO: 2487165 - DNA, 16 bp, Homo sapiens
attatttatgtatggt

SEQ ID NO: 2487166 - DNA, 12 bp, Homo sapiens
attatttgtgtt

SEQ ID NO: 2487167 - DNA, 13 bp, Homo sapiens
attcaaaggttct

SEQ ID NO: 2487168 - DNA, 17 bp, Homo sapiens
attcaacaatttcaata

SEQ ID NO: 2487169 - DNA, 20 bp, Homo sapiens
attcaaggaatttcttaact

SEQ ID NO: 2487170 - DNA, 22 bp, Homo sapiens
attcaaggaatttcttaacttc

SEQ ID NO: 2487171 - DNA, 17 bp, Homo sapiens
attcacaaacttttata

SEQ ID NO: 2487172 - DNA, 20 bp, Homo sapiens
attcacagtgctcttttctc

SEQ ID NO: 2487173 - DNA, 22 bp, Homo sapiens
attcacagttctttgggccaga

SEQ ID NO: 2487174 - DNA, 18 bp, Homo sapiens
attcacatcgcagattct

SEQ ID NO: 2487175 - DNA, 16 bp, Homo sapiens
attcaccccctttcct

SEQ ID NO: 2487176 - DNA, 14 bp, Homo sapiens
attcagaagaaaaa

SEQ ID NO: 2487177 - DNA, 20 bp, Homo sapiens
attcagacagatgaggcttt

SEQ ID NO: 2487178 - DNA, 13 bp, Homo sapiens
attcagacaggca

SEQ ID NO: 2487179 - DNA, 14 bp, Homo sapiens
attcagacaggcaa

SEQ ID NO: 2487180 - DNA, 19 bp, Homo sapiens
attcaggaaaaggcctggg

SEQ ID NO: 2487181 - DNA, 23 bp, Homo sapiens
caaaaccaggtccaatgagcttt

SEQ ID NO: 2487182 - DNA, 17 bp, Homo sapiens
cacagcttagatttcat

SEQ ID NO: 2487183 - DNA, 18 bp, Homo sapiens
cacagcttgacctgaggc

SEQ ID NO: 2487184 - DNA, 19 bp, Homo sapiens
cacagcttgacctgaggct

SEQ ID NO: 2487185 - DNA, 22 bp, Homo sapiens
cacaggaagcctgcagtcctgg

SEQ ID NO: 2487186 - DNA, 22 bp, Homo sapiens
cacaggacatgcggtagccagc

SEQ ID NO: 2487187 - DNA, 23 bp, Homo sapiens
cacaggacatgcggtagccagca

SEQ ID NO: 2487188 - DNA, 15 bp, Homo sapiens
cacaggacatttctc

SEQ ID NO: 2487189 - DNA, 22 bp, Homo sapiens
cacaggagggcggcctccttct

SEQ ID NO: 2487190 - DNA, 12 bp, Homo sapiens
cacaggaggggg

SEQ ID NO: 2487191 - DNA, 20 bp, Homo sapiens
cacaggagtgtcctcttccc

SEQ ID NO: 2487192 - DNA, 19 bp, Homo sapiens
cacaggcagccagtgccct

SEQ ID NO: 2487193 - DNA, 23 bp, Homo sapiens
cacaggcagccagtgccctgagc

SEQ ID NO: 2487194 - DNA, 20 bp, Homo sapiens
caagcagtcgtgcctgtgtc

SEQ ID NO: 2487195 - DNA, 22 bp, Homo sapiens
caagcatggtcccacatccctg

SEQ ID NO: 2487196 - DNA, 17 bp, Homo sapiens
caagcattcagaagaaa

SEQ ID NO: 2487197 - DNA, 23 bp, Homo sapiens
caagccaagggaacctgtgtccg

SEQ ID NO: 2487198 - DNA, 15 bp, Homo sapiens
caagccagaggctgg

SEQ ID NO: 2487199 - DNA, 19 bp, Homo sapiens
caagcccagcccatggaga

SEQ ID NO: 2487200 - DNA, 22 bp, Homo sapiens
cagctgccggtcgccctttgct

SEQ ID NO: 2487201 - DNA, 22 bp, Homo sapiens
cagctggaggcaggggcttcct

SEQ ID NO: 2487202 - DNA, 14 bp, Homo sapiens
cagctggggtgcag

SEQ ID NO: 2487203 - DNA, 15 bp, Homo sapiens
cagctggggtgcagg

SEQ ID NO: 2487204 - DNA, 19 bp, Homo sapiens
cagctggtgtagctacaga

SEQ ID NO: 2487205 - DNA, 20 bp, Homo sapiens
cagctggtgtagctacagag

SEQ ID NO: 2487206 - DNA, 16 bp, Homo sapiens
cagctgtaatctatga

SEQ ID NO: 2487207 - DNA, 17 bp, Homo sapiens
cagctgtgcctcgctcc

SEQ ID NO: 2487208 - DNA, 15 bp, Homo sapiens
cagctgttttgttga

SEQ ID NO: 2487209 - DNA, 16 bp, Homo sapiens
cagcttagatttcata

SEQ ID NO: 2487210 - DNA, 17 bp, Homo sapiens
cagcttagatttcatag

SEQ ID NO: 2487211 - DNA, 19 bp, Homo sapiens
cagcttccttcagagagca

SEQ ID NO: 2487212 - DNA, 16 bp, Homo sapiens
cagcttgacctgaggc

SEQ ID NO: 2487213 - DNA, 21 bp, Homo sapiens
cagcttgacctgaggctgtgg

SEQ ID NO: 2487214 - DNA, 12 bp, Homo sapiens
cagcttgtagcc

SEQ ID NO: 2487215 - DNA, 21 bp, Homo sapiens
cagcttgtctcttgcctgcca

SEQ ID NO: 2487216 - DNA, 18 bp, Homo sapiens
cagcttttaaaagatttt

SEQ ID NO: 2487217 - DNA, 11 bp, Homo sapiens
cagcttttcaa

SEQ ID NO: 2487218 - DNA, 14 bp, Homo sapiens
caggaaaaggcctg

SEQ ID NO: 2487219 - DNA, 19 bp, Homo sapiens
caggaaaaggcctggggtg

SEQ ID NO: 2487220 - DNA, 21 bp, Homo sapiens
caggaaaaggcctggggtgac

SEQ ID NO: 2487221 - DNA, 23 bp, Homo sapiens
caggaaacagttgcatgtagtaa

SEQ ID NO: 2487222 - DNA, 18 bp, Homo sapiens
caggaaactcctgtgacc

SEQ ID NO: 2487223 - DNA, 15 bp, Homo sapiens
caggaaaggaatcat

SEQ ID NO: 2487224 - DNA, 19 bp, Homo sapiens
caggaaaggaatcatttct

SEQ ID NO: 2487225 - DNA, 13 bp, Homo sapiens
caggaaatgaaaa

SEQ ID NO: 2487226 - DNA, 21 bp, Homo sapiens
caggaaatgaaaatgtcttgt

SEQ ID NO: 2487227 - DNA, 18 bp, Homo sapiens
caggaagcccaattgctg

SEQ ID NO: 2487228 - DNA, 19 bp, Homo sapiens
caggaagcctgcagtcctg

SEQ ID NO: 2487229 - DNA, 21 bp, Homo sapiens
caggaagcctgcagtcctgga

SEQ ID NO: 2487230 - DNA, 14 bp, Homo sapiens
caggaagccttccc

SEQ ID NO: 2487231 - DNA, 16 bp, Homo sapiens
caggaaggactatgaa

SEQ ID NO: 2487232 - DNA, 19 bp, Homo sapiens
caggaaggactatgaaaag

SEQ ID NO: 2487233 - DNA, 12 bp, Homo sapiens
caggaaggagct

SEQ ID NO: 2487234 - DNA, 14 bp, Homo sapiens
caggaaggagctgc

SEQ ID NO: 2487235 - DNA, 13 bp, Homo sapiens
caggaaggcttgt

SEQ ID NO: 2487236 - DNA, 15 bp, Homo sapiens
caggaatcttaaggt

SEQ ID NO: 2487237 - DNA, 19 bp, Homo sapiens
caggaatggctgcaccttt

SEQ ID NO: 2487238 - DNA, 21 bp, Homo sapiens
caggaattcttggagaaaatg

SEQ ID NO: 2487239 - DNA, 20 bp, Homo sapiens
caggaatttcccaggaccct

SEQ ID NO: 2487240 - DNA, 14 bp, Homo sapiens
caggacaagcatgg

SEQ ID NO: 2487241 - DNA, 17 bp, Homo sapiens
caggacacaggcctgtg

SEQ ID NO: 2487242 - DNA, 19 bp, Homo sapiens
caggacacaggcctgtgta

SEQ ID NO: 2487243 - DNA, 13 bp, Homo sapiens
caggacagatgcc

SEQ ID NO: 2487244 - DNA, 17 bp, Homo sapiens
caggacagatgccacac

SEQ ID NO: 2487245 - DNA, 23 bp, Homo sapiens
caggacatgcggtagccagcaca

SEQ ID NO: 2487246 - DNA, 14 bp, Homo sapiens
caggacatttctct

SEQ ID NO: 2487247 - DNA, 18 bp, Homo sapiens
caggacatttctctaaga

SEQ ID NO: 2487248 - DNA, 20 bp, Homo sapiens
caggaccagctcaggacaga

SEQ ID NO: 2487249 - DNA, 14 bp, Homo sapiens
caggacccagagga

SEQ ID NO: 2487250 - DNA, 16 bp, Homo sapiens
caggaccctgaagggg

SEQ ID NO: 2487251 - DNA, 18 bp, Homo sapiens
caggaccctgaaggggcc

SEQ ID NO: 2487252 - DNA, 17 bp, Homo sapiens
caggactaacactcaga

SEQ ID NO: 2487253 - DNA, 23 bp, Homo sapiens
caggactaacactcagaagcctg

SEQ ID NO: 2487254 - DNA, 20 bp, Homo sapiens
caggactatatttgggcctg

SEQ ID NO: 2487255 - DNA, 19 bp, Homo sapiens
caggactccaggcccaagg

SEQ ID NO: 2487256 - DNA, 21 bp, Homo sapiens
caggactccaggcccaaggct

SEQ ID NO: 2487257 - DNA, 18 bp, Homo sapiens
caggactctgcagcctca

SEQ ID NO: 2487258 - DNA, 20 bp, Homo sapiens
caggactctgcagcctcaga

SEQ ID NO: 2487259 - DNA, 12 bp, Homo sapiens
caggactgatgt

SEQ ID NO: 2487260 - DNA, 23 bp, Homo sapiens
caggactgatgtctcctaagcac

SEQ ID NO: 2487261 - DNA, 14 bp, Homo sapiens
caggactgggagcc

SEQ ID NO: 2487262 - DNA, 17 bp, Homo sapiens
caggagaagctcagctg

SEQ ID NO: 2487263 - DNA, 16 bp, Homo sapiens
caggagcacggctctg

SEQ ID NO: 2487264 - DNA, 14 bp, Homo sapiens
caggagcctgtgac

SEQ ID NO: 2487265 - DNA, 22 bp, Homo sapiens
caggagctacctgtgtggacag

SEQ ID NO: 2487266 - DNA, 23 bp, Homo sapiens
caggagctccagtgtcctgagct

SEQ ID NO: 2487267 - DNA, 14 bp, Homo sapiens
caggagctcccctc

SEQ ID NO: 2487268 - DNA, 15 bp, Homo sapiens
caggaggaatactga

SEQ ID NO: 2487269 - DNA, 15 bp, Homo sapiens
caggaggacccaggg

SEQ ID NO: 2487270 - DNA, 16 bp, Homo sapiens
caggaggacccagggc

SEQ ID NO: 2487271 - DNA, 17 bp, Homo sapiens
caggaggacccagggct

SEQ ID NO: 2487272 - DNA, 21 bp, Homo sapiens
caggagggacaaaggagcctg

SEQ ID NO: 2487273 - DNA, 15 bp, Homo sapiens
caggaggggggaggg

SEQ ID NO: 2487274 - DNA, 20 bp, Homo sapiens
caggagggggtcgtggagag

SEQ ID NO: 2487275 - DNA, 20 bp, Homo sapiens
caggaggtgccactggagtg

SEQ ID NO: 2487276 - DNA, 14 bp, Homo sapiens
caggagtgggtggg

SEQ ID NO: 2487277 - DNA, 22 bp, Homo sapiens
caggatccccaaggcacttgag

SEQ ID NO: 2487278 - DNA, 22 bp, Homo sapiens
caggatctcaccaggcagcctc

SEQ ID NO: 2487279 - DNA, 20 bp, Homo sapiens
caggatgtgtttgctttctg

SEQ ID NO: 2487280 - DNA, 13 bp, Homo sapiens
caggattgcgaga

SEQ ID NO: 2487281 - DNA, 20 bp, Homo sapiens
caggattggggaagagagcc

SEQ ID NO: 2487282 - DNA, 14 bp, Homo sapiens
caggcaaggctgtg

SEQ ID NO: 2487283 - DNA, 17 bp, Homo sapiens
caggcaaggctgtggac

SEQ ID NO: 2487284 - DNA, 23 bp, Homo sapiens
caggcacacagctactctcccca

SEQ ID NO: 2487285 - DNA, 14 bp, Homo sapiens
caggcaccaggcag

SEQ ID NO: 2487286 - DNA, 16 bp, Homo sapiens
caggcactgccctggt

SEQ ID NO: 2487287 - DNA, 12 bp, Homo sapiens
caggcacttggc

SEQ ID NO: 2487288 - DNA, 20 bp, Homo sapiens
caggcagaggcccaggctgc

SEQ ID NO: 2487289 - DNA, 21 bp, Homo sapiens
caggcagaggcccaggctgcc

SEQ ID NO: 2487290 - DNA, 22 bp, Homo sapiens
caggcagaggcccaggctgccg

SEQ ID NO: 2487291 - DNA, 23 bp, Homo sapiens
caggcagccagtgccctgagcca

SEQ ID NO: 2487292 - DNA, 19 bp, Homo sapiens
caggcagcctctggggggt

SEQ ID NO: 2487293 - DNA, 18 bp, Homo sapiens
caggcaggctcccaggga

SEQ ID NO: 2487294 - DNA, 12 bp, Homo sapiens
caggcagggctc

SEQ ID NO: 2487295 - DNA, 13 bp, Homo sapiens
caggcagggctct

SEQ ID NO: 2487296 - DNA, 18 bp, Homo sapiens
caggcagggctctcctgg

SEQ ID NO: 2487297 - DNA, 23 bp, Homo sapiens
caggcagggctctcctggcttcc

SEQ ID NO: 2487298 - DNA, 18 bp, Homo sapiens
caggcaggggcctccatg

SEQ ID NO: 2487299 - DNA, 19 bp, Homo sapiens
caggcatttcctgggtggc

SEQ ID NO: 2487300 - DNA, 19 bp, Homo sapiens
caggccaaaggggacctgg

SEQ ID NO: 2487301 - DNA, 22 bp, Homo sapiens
caggccaaaggggacctggaag

SEQ ID NO: 2487302 - DNA, 17 bp, Homo sapiens
caggccaagaaacgtct

SEQ ID NO: 2487303 - DNA, 18 bp, Homo sapiens
caggccacacttcaaact

SEQ ID NO: 2487304 - DNA, 19 bp, Homo sapiens
cagggctgtaactgccagg

SEQ ID NO: 2487305 - DNA, 14 bp, Homo sapiens
caggggcagcccca

SEQ ID NO: 2487306 - DNA, 12 bp, Homo sapiens
caggggcctgga

SEQ ID NO: 2487307 - DNA, 23 bp, Homo sapiens
caggggcctggagatcctcctgc

SEQ ID NO: 2487308 - DNA, 18 bp, Homo sapiens
caggggctgcttcctcct

SEQ ID NO: 2487309 - DNA, 20 bp, Homo sapiens
caggggctgcttcctcctgg

SEQ ID NO: 2487310 - DNA, 16 bp, Homo sapiens
caggggcttgactttt

SEQ ID NO: 2487311 - DNA, 18 bp, Homo sapiens
cagggggagctgggcctg

SEQ ID NO: 2487312 - DNA, 20 bp, Homo sapiens
cagggggctgctgctgggct

SEQ ID NO: 2487313 - DNA, 15 bp, Homo sapiens
caggggggtgaggag

SEQ ID NO: 2487314 - DNA, 19 bp, Homo sapiens
caggggggtgaggagctgg

SEQ ID NO: 2487315 - DNA, 19 bp, Homo sapiens
cagggggtctggctggtgt

SEQ ID NO: 2487316 - DNA, 17 bp, Homo sapiens
cagggtatgaagagtgt

SEQ ID NO: 2487317 - DNA, 21 bp, Homo sapiens
cagggtccaacatagagccgg

SEQ ID NO: 2487318 - DNA, 18 bp, Homo sapiens
cagggtcccacagccacg

SEQ ID NO: 2487319 - DNA, 15 bp, Homo sapiens
cagggtccctctgtg

SEQ ID NO: 2487320 - DNA, 13 bp, Homo sapiens
cagggtcctggga

SEQ ID NO: 2487321 - DNA, 14 bp, Homo sapiens
cagggtccttttga

SEQ ID NO: 2487322 - DNA, 21 bp, Homo sapiens
cagggtccttttgacactgct

SEQ ID NO: 2487323 - DNA, 22 bp, Homo sapiens
cagggtccttttgacactgctc

SEQ ID NO: 2487324 - DNA, 21 bp, Homo sapiens
cagggtctgctctttctctgc

SEQ ID NO: 2487325 - DNA, 22 bp, Homo sapiens
caggtaggccaaggtgtcctac

SEQ ID NO: 2487326 - DNA, 14 bp, Homo sapiens
caggtatacctcac

SEQ ID NO: 2487327 - DNA, 15 bp, Homo sapiens
caggtatacctcact

SEQ ID NO: 2487328 - DNA, 18 bp, Homo sapiens
caggtatatactttgaaa

SEQ ID NO: 2487329 - DNA, 22 bp, Homo sapiens
caggtatatactttgaaaggag

SEQ ID NO: 2487330 - DNA, 14 bp, Homo sapiens
caggtccaatgagc

SEQ ID NO: 2487331 - DNA, 22 bp, Homo sapiens
caggtccaatgagctttctgaa

SEQ ID NO: 2487332 - DNA, 17 bp, Homo sapiens
caggtccagctctggag

SEQ ID NO: 2487333 - DNA, 21 bp, Homo sapiens
caggtcccaaatggccctggg

SEQ ID NO: 2487334 - DNA, 16 bp, Homo sapiens
caggtccctctcattt

SEQ ID NO: 2487335 - DNA, 21 bp, Homo sapiens
caggtcctggtggggcagctc

SEQ ID NO: 2487336 - DNA, 23 bp, Homo sapiens
caggtcctggtggggcagctcct

SEQ ID NO: 2487337 - DNA, 20 bp, Homo sapiens
caggtctgggtggggcccag

SEQ ID NO: 2487338 - DNA, 20 bp, Homo sapiens
caggtcttcatcgaatctac

SEQ ID NO: 2487339 - DNA, 21 bp, Homo sapiens
caggtgacccccccccatccc

SEQ ID NO: 2487340 - DNA, 18 bp, Homo sapiens
caggtgaggtcagcacat

SEQ ID NO: 2487341 - DNA, 16 bp, Homo sapiens
caggtgaggtctgttc

SEQ ID NO: 2487342 - DNA, 19 bp, Homo sapiens
caggtgctcaataaatgat

SEQ ID NO: 2487343 - DNA, 20 bp, Homo sapiens
caggtgctgacttcatctcc

SEQ ID NO: 2487344 - DNA, 20 bp, Homo sapiens
caggtggccaagttcctcta

SEQ ID NO: 2487345 - DNA, 19 bp, Homo sapiens
caggtggggagactgggct

SEQ ID NO: 2487346 - DNA, 22 bp, Homo sapiens
caggtggggagactgggctgag

SEQ ID NO: 2487347 - DNA, 17 bp, Homo sapiens
caggtgttaacattcca

SEQ ID NO: 2487348 - DNA, 20 bp, Homo sapiens
caggttctccgttagctcct

SEQ ID NO: 2487349 - DNA, 23 bp, Homo sapiens
caggttctccgttagctcctgtg

SEQ ID NO: 2487350 - DNA, 22 bp, Homo sapiens
caggttggctctgccagtcctg

SEQ ID NO: 2487351 - DNA, 23 bp, Homo sapiens
caggttggctctgccagtcctgt

SEQ ID NO: 2487352 - DNA, 19 bp, Homo sapiens
caggtttgagaaaaaggaa

SEQ ID NO: 2487353 - DNA, 16 bp, Homo sapiens
cagtaaaccactgaaa

SEQ ID NO: 2487354 - DNA, 20 bp, Homo sapiens
cagtaaatcttttacaactg

SEQ ID NO: 2487355 - DNA, 18 bp, Homo sapiens
cagtaacgcgtcttcctg

SEQ ID NO: 2487356 - DNA, 14 bp, Homo sapiens
cagtaatttagaaa

SEQ ID NO: 2487357 - DNA, 24 bp, Homo sapiens
cagtaccctctcagctccaggtgg

SEQ ID NO: 2487358 - DNA, 14 bp, Homo sapiens
cagtacctgagggt

SEQ ID NO: 2487359 - DNA, 22 bp, Homo sapiens
cagtacctgagggtctgtaggt

SEQ ID NO: 2487360 - DNA, 16 bp, Homo sapiens
cagtactttgtgcatt

SEQ ID NO: 2487361 - DNA, 18 bp, Homo sapiens
cagtactttgtgcattct

SEQ ID NO: 2487362 - DNA, 16 bp, Homo sapiens
cagtagattgcagaaa

SEQ ID NO: 2487363 - DNA, 18 bp, Homo sapiens
cagtagattgcagaaaat

SEQ ID NO: 2487364 - DNA, 16 bp, Homo sapiens
cagtagattttccaaa

SEQ ID NO: 2487365 - DNA, 18 bp, Homo sapiens
cagtagattttccaaatg

SEQ ID NO: 2487366 - DNA, 12 bp, Homo sapiens
cagtaggagccc

SEQ ID NO: 2487367 - DNA, 14 bp, Homo sapiens
cagtaggagcccag

SEQ ID NO: 2487368 - DNA, 22 bp, Homo sapiens
cagtagttcacatacaaatcat

SEQ ID NO: 2487369 - DNA, 19 bp, Homo sapiens
cagtatcatgccctgtgca

SEQ ID NO: 2487370 - DNA, 19 bp, Homo sapiens
cagtatgggggttgtaaat

SEQ ID NO: 2487371 - DNA, 23 bp, Homo sapiens
cagtatgggggttgtaaattggc

SEQ ID NO: 2487372 - DNA, 13 bp, Homo sapiens
cagtatttaacta

SEQ ID NO: 2487373 - DNA, 17 bp, Homo sapiens
cagtatttaactaatta

SEQ ID NO: 2487374 - DNA, 14 bp, Homo sapiens
cagtatttgtaatt

SEQ ID NO: 2487375 - DNA, 18 bp, Homo sapiens
cagtatttgtaattaaaa

SEQ ID NO: 2487376 - DNA, 17 bp, Homo sapiens
cagtattttttttttta

SEQ ID NO: 2487377 - DNA, 24 bp, Homo sapiens
cagtcaaaaccaagtcacttaggt

SEQ ID NO: 2487378 - DNA, 14 bp, Homo sapiens
cagtcaacctgggc

SEQ ID NO: 2487379 - DNA, 16 bp, Homo sapiens
cagtcaacctgggcaa

SEQ ID NO: 2487380 - DNA, 14 bp, Homo sapiens
cagtcacagccacc

SEQ ID NO: 2487381 - DNA, 24 bp, Homo sapiens
cagtcactctagtcaatgacatga

SEQ ID NO: 2487382 - DNA, 14 bp, Homo sapiens
cagtcaggcccagg

SEQ ID NO: 2487383 - DNA, 15 bp, Homo sapiens
cagtcataactaaat

SEQ ID NO: 2487384 - DNA, 13 bp, Homo sapiens
cagtcattggctg

SEQ ID NO: 2487385 - DNA, 17 bp, Homo sapiens
cagtcattggctgtctc

SEQ ID NO: 2487386 - DNA, 21 bp, Homo sapiens
cagtccacttctgacagcctc

SEQ ID NO: 2487387 - DNA, 18 bp, Homo sapiens
cagtccaggctgccgtgg

SEQ ID NO: 2487388 - DNA, 23 bp, Homo sapiens
cagtccagtcctatctgggcttc

SEQ ID NO: 2487389 - DNA, 19 bp, Homo sapiens
cagtcccaagcggtgtctc

SEQ ID NO: 2487390 - DNA, 21 bp, Homo sapiens
cagtcccaagcggtgtctctc

SEQ ID NO: 2487391 - DNA, 16 bp, Homo sapiens
cagtcctatctgggct

SEQ ID NO: 2487392 - DNA, 15 bp, Homo sapiens
cagtccttggcctgc

SEQ ID NO: 2487393 - DNA, 16 bp, Homo sapiens
cagtccttggcctgct

SEQ ID NO: 2487394 - DNA, 15 bp, Homo sapiens
cagtcgtgcctgtgt

SEQ ID NO: 2487395 - DNA, 14 bp, Homo sapiens
cagtcgttcccagt

SEQ ID NO: 2487396 - DNA, 21 bp, Homo sapiens
cagtctcagaatgtcattttg

SEQ ID NO: 2487397 - DNA, 14 bp, Homo sapiens
cagtctctcttctc

SEQ ID NO: 2487398 - DNA, 17 bp, Homo sapiens
cagtctctcttctctcc

SEQ ID NO: 2487399 - DNA, 15 bp, Homo sapiens
cagtcttccatttgc

SEQ ID NO: 2487400 - DNA, 17 bp, Homo sapiens
cagtcttccatttgcaa

SEQ ID NO: 2487401 - DNA, 18 bp, Homo sapiens
cagtcttccatttgcaag

SEQ ID NO: 2487402 - DNA, 13 bp, Homo sapiens
cagtgaagacaga

SEQ ID NO: 2487403 - DNA, 16 bp, Homo sapiens
cagtgaagacagaagt

SEQ ID NO: 2487404 - DNA, 21 bp, Homo sapiens
cagtgaagagccactgccatt

SEQ ID NO: 2487405 - DNA, 14 bp, Homo sapiens
cagtgaagttgctg

SEQ ID NO: 2487406 - DNA, 18 bp, Homo sapiens
cagtgaatgattcagtgt

SEQ ID NO: 2487407 - DNA, 23 bp, Homo sapiens
cccttcctggacagctgtgcctc

SEQ ID NO: 2487408 - DNA, 23 bp, Homo sapiens
cccttctatttggggcttgatga

SEQ ID NO: 2487409 - DNA, 18 bp, Homo sapiens
cccttctcccctgcactg

SEQ ID NO: 2487410 - DNA, 17 bp, Homo sapiens
cccttgacaactggcag

SEQ ID NO: 2487411 - DNA, 16 bp, Homo sapiens
cccttggacacgctca

SEQ ID NO: 2487412 - DNA, 15 bp, Homo sapiens
cccttgggccagaag

SEQ ID NO: 2487413 - DNA, 21 bp, Homo sapiens
cccttgggccagaagtaccag

SEQ ID NO: 2487414 - DNA, 12 bp, Homo sapiens
cccttgggggtc

SEQ ID NO: 2487415 - DNA, 22 bp, Homo sapiens
cccttgggggtcctcctccagg

SEQ ID NO: 2487416 - DNA, 21 bp, Homo sapiens
cccttgtgaatcaagggtcag

SEQ ID NO: 2487417 - DNA, 14 bp, Homo sapiens
ccctttcccacccc

SEQ ID NO: 2487418 - DNA, 14 bp, Homo sapiens
ccctttcctcctca

SEQ ID NO: 2487419 - DNA, 17 bp, Homo sapiens
ccctttcctcctcaggc

SEQ ID NO: 2487420 - DNA, 22 bp, Homo sapiens
ccctttctatcgttctctcttt

SEQ ID NO: 2487421 - DNA, 14 bp, Homo sapiens
ccctttgagtgcag

SEQ ID NO: 2487422 - DNA, 23 bp, Homo sapiens
ccctttgctgtgaggctgtcctg

SEQ ID NO: 2487423 - DNA, 23 bp, Homo sapiens
ccctttgtgtgctctccattctg

SEQ ID NO: 2487424 - DNA, 20 bp, Homo sapiens
cccttttgggtttctgccct

SEQ ID NO: 2487425 - DNA, 14 bp, Homo sapiens
ccctttttcaatga

SEQ ID NO: 2487426 - DNA, 23 bp, Homo sapiens
ccgaagctaacagggaaggcagg

SEQ ID NO: 2487427 - DNA, 13 bp, Homo sapiens
ccgaagtcttttg

SEQ ID NO: 2487428 - DNA, 14 bp, Homo sapiens
ccgaatgtgtcttt

SEQ ID NO: 2487429 - DNA, 15 bp, Homo sapiens
ccgaatgtgtcttta

SEQ ID NO: 2487430 - DNA, 16 bp, Homo sapiens
ccgaccccaagagttt

SEQ ID NO: 2487431 - DNA, 16 bp, Homo sapiens
ccgactgctttggacc

SEQ ID NO: 2487432 - DNA, 21 bp, Homo sapiens
ccgagaggtgggccagtctgt

SEQ ID NO: 2487433 - DNA, 19 bp, Homo sapiens
ccgagatcagtatttaact

SEQ ID NO: 2487434 - DNA, 23 bp, Homo sapiens
ccgagcaaccgtggcccttcctg

SEQ ID NO: 2487435 - DNA, 17 bp, Homo sapiens
ccgagcagctgagcagg

SEQ ID NO: 2487436 - DNA, 18 bp, Homo sapiens
ccgagcagctgagcaggg

SEQ ID NO: 2487437 - DNA, 16 bp, Homo sapiens
ccgagcaggaggccta

SEQ ID NO: 2487438 - DNA, 16 bp, Homo sapiens
ccgagctcctcttcca

SEQ ID NO: 2487439 - DNA, 14 bp, Homo sapiens
cctccctctgctgt

SEQ ID NO: 2487440 - DNA, 21 bp, Homo sapiens
cctccctctgctgtcaccttg

SEQ ID NO: 2487441 - DNA, 11 bp, Homo sapiens
cctccctgtaa

SEQ ID NO: 2487442 - DNA, 14 bp, Homo sapiens
cctccctgtaactt

SEQ ID NO: 2487443 - DNA, 19 bp, Homo sapiens
cctccctgttccccagaga

SEQ ID NO: 2487444 - DNA, 20 bp, Homo sapiens
cctccctgttccccagagaa

SEQ ID NO: 2487445 - DNA, 12 bp, Homo sapiens
cctccgccctgc

SEQ ID NO: 2487446 - DNA, 18 bp, Homo sapiens
cctccgggacctggtgct

SEQ ID NO: 2487447 - DNA, 15 bp, Homo sapiens
cctcctcagcctgaa

SEQ ID NO: 2487448 - DNA, 22 bp, Homo sapiens
cctcctcagcctgaaccccagg

SEQ ID NO: 2487449 - DNA, 19 bp, Homo sapiens
cctcctcaggcacacagct

SEQ ID NO: 2487450 - DNA, 13 bp, Homo sapiens
cctcctccaggga

SEQ ID NO: 2487451 - DNA, 18 bp, Homo sapiens
cctcctccagggacagca

SEQ ID NO: 2487452 - DNA, 23 bp, Homo sapiens
cctcctcccacccggctgcagag

SEQ ID NO: 2487453 - DNA, 21 bp, Homo sapiens
cctcctccccaactgtggggg

SEQ ID NO: 2487454 - DNA, 13 bp, Homo sapiens
cctcctccctccc

SEQ ID NO: 2487455 - DNA, 15 bp, Homo sapiens
cctcctgacaccctt

SEQ ID NO: 2487456 - DNA, 19 bp, Homo sapiens
cctcctgccggctccttgg

SEQ ID NO: 2487457 - DNA, 17 bp, Homo sapiens
cctcctgtgctcagccc

SEQ ID NO: 2487458 - DNA, 21 bp, Homo sapiens
cctcctgtgctcagccctgag

SEQ ID NO: 2487459 - DNA, 13 bp, Homo sapiens
cctccttccctct

SEQ ID NO: 2487460 - DNA, 13 bp, Homo sapiens
cctccttcctaaa

SEQ ID NO: 2487461 - DNA, 23 bp, Homo sapiens
cctccttcctcttttccttccca

SEQ ID NO: 2487462 - DNA, 14 bp, Homo sapiens
cctccttctgctgc

SEQ ID NO: 2487463 - DNA, 15 bp, Homo sapiens
cctcctttctgaggg

SEQ ID NO: 2487464 - DNA, 21 bp, Homo sapiens
cctcctttttccatgccctaa

SEQ ID NO: 2487465 - DNA, 16 bp, Homo sapiens
cctcgaaacacagaaa

SEQ ID NO: 2487466 - DNA, 17 bp, Homo sapiens
cctcgctggactctcag

SEQ ID NO: 2487467 - DNA, 15 bp, Homo sapiens
cctcgtactcaggag

SEQ ID NO: 2487468 - DNA, 13 bp, Homo sapiens
cctcgtttgtgtt

SEQ ID NO: 2487469 - DNA, 16 bp, Homo sapiens
cctctaacagcaccaa

SEQ ID NO: 2487470 - DNA, 17 bp, Homo sapiens
cctctaacttggctcac

SEQ ID NO: 2487471 - DNA, 21 bp, Homo sapiens
cctctaacttggctcacactc

SEQ ID NO: 2487472 - DNA, 16 bp, Homo sapiens
cctctactgggaaggc

SEQ ID NO: 2487473 - DNA, 15 bp, Homo sapiens
cctctcaggatccaa

SEQ ID NO: 2487474 - DNA, 13 bp, Homo sapiens
cctctccacacag

SEQ ID NO: 2487475 - DNA, 23 bp, Homo sapiens
cctctccacacagtgctcaaggc

SEQ ID NO: 2487476 - DNA, 13 bp, Homo sapiens
cctctcccaccct

SEQ ID NO: 2487477 - DNA, 19 bp, Homo sapiens
cctctcccaccctcttcct

SEQ ID NO: 2487478 - DNA, 14 bp, Homo sapiens
cctctcccaggcag

SEQ ID NO: 2487479 - DNA, 17 bp, Homo sapiens
cctctcccaggccccat

SEQ ID NO: 2487480 - DNA, 13 bp, Homo sapiens
cctctcccagttg

SEQ ID NO: 2487481 - DNA, 12 bp, Homo sapiens
cctctccccagc

SEQ ID NO: 2487482 - DNA, 16 bp, Homo sapiens
cctctccccagcccag

SEQ ID NO: 2487483 - DNA, 17 bp, Homo sapiens
cctctccccagcccaga

SEQ ID NO: 2487484 - DNA, 22 bp, Homo sapiens
cctctccccagggaagcagcag

SEQ ID NO: 2487485 - DNA, 12 bp, Homo sapiens
cctctcccctgc

SEQ ID NO: 2487486 - DNA, 22 bp, Homo sapiens
cctctcccctgccccctgcagg

SEQ ID NO: 2487487 - DNA, 18 bp, Homo sapiens
cctctccctcctccagga

SEQ ID NO: 2487488 - DNA, 23 bp, Homo sapiens
cctctccctcctccaggaagcct

SEQ ID NO: 2487489 - DNA, 16 bp, Homo sapiens
cctctcgagggcaggg

SEQ ID NO: 2487490 - DNA, 19 bp, Homo sapiens
cctctcgtaagatttcctt

SEQ ID NO: 2487491 - DNA, 20 bp, Homo sapiens
cctctctacagtctcgtctc

SEQ ID NO: 2487492 - DNA, 21 bp, Homo sapiens
cctctctgcagacttcccagc

SEQ ID NO: 2487493 - DNA, 12 bp, Homo sapiens
cctctctgctct

SEQ ID NO: 2487494 - DNA, 15 bp, Homo sapiens
cctctctgctctgcg

SEQ ID NO: 2487495 - DNA, 16 bp, Homo sapiens
cctctctgctctgcgt

SEQ ID NO: 2487496 - DNA, 22 bp, Homo sapiens
cctctctggagaaagggccctg

SEQ ID NO: 2487497 - DNA, 12 bp, Homo sapiens
cctctgaaatac

SEQ ID NO: 2487498 - DNA, 15 bp, Homo sapiens
cctctgacagcagca

SEQ ID NO: 2487499 - DNA, 19 bp, Homo sapiens
cctctgacagcagcatctc

SEQ ID NO: 2487500 - DNA, 14 bp, Homo sapiens
cctctgacctgcac

SEQ ID NO: 2487501 - DNA, 16 bp, Homo sapiens
cctctgactcagggct

SEQ ID NO: 2487502 - DNA, 21 bp, Homo sapiens
cctctgactcagggctcctgg

SEQ ID NO: 2487503 - DNA, 22 bp, Homo sapiens
cctctgactcagggctcctggg

SEQ ID NO: 2487504 - DNA, 14 bp, Homo sapiens
cctctgaggccagc

SEQ ID NO: 2487505 - DNA, 15 bp, Homo sapiens
cctctgaggccagcc

SEQ ID NO: 2487506 - DNA, 22 bp, Homo sapiens
cctctgaggccagcctggcctc

SEQ ID NO: 2487507 - DNA, 20 bp, Homo sapiens
cctctgcactactgacatgt

SEQ ID NO: 2487508 - DNA, 16 bp, Homo sapiens
cctctgcatcctctgg

SEQ ID NO: 2487509 - DNA, 18 bp, Homo sapiens
cctctgcatcctctggag

SEQ ID NO: 2487510 - DNA, 22 bp, Homo sapiens
cctctgcccaggcactgctagg

SEQ ID NO: 2487511 - DNA, 15 bp, Homo sapiens
cctctgcttctcacg

SEQ ID NO: 2487512 - DNA, 14 bp, Homo sapiens
cctctggagccagc

SEQ ID NO: 2487513 - DNA, 18 bp, Homo sapiens
cctctggcttggccacag

SEQ ID NO: 2487514 - DNA, 12 bp, Homo sapiens
cctctgggctct

SEQ ID NO: 2487515 - DNA, 16 bp, Homo sapiens
cctctgggctctgagt

SEQ ID NO: 2487516 - DNA, 15 bp, Homo sapiens
cctctggggggtggc

SEQ ID NO: 2487517 - DNA, 19 bp, Homo sapiens
cctctgtcagtcacagcca

SEQ ID NO: 2487518 - DNA, 21 bp, Homo sapiens
cctctgtcagtcacagccacc

SEQ ID NO: 2487519 - DNA, 20 bp, Homo sapiens
ccccctttagatctctgaag

SEQ ID NO: 2487520 - DNA, 13 bp, Homo sapiens
ccccgactggggc

SEQ ID NO: 2487521 - DNA, 22 bp, Homo sapiens
cccctaaccctttgtgtgctct

SEQ ID NO: 2487522 - DNA, 18 bp, Homo sapiens
cccctaagagagcacctg

SEQ ID NO: 2487523 - DNA, 20 bp, Homo sapiens
cccctagcgctatctccctg

SEQ ID NO: 2487524 - DNA, 14 bp, Homo sapiens
cccctatttattga

SEQ ID NO: 2487525 - DNA, 20 bp, Homo sapiens
cccctcacagtattgctcac

SEQ ID NO: 2487526 - DNA, 12 bp, Homo sapiens
cccctcacctcc

SEQ ID NO: 2487527 - DNA, 23 bp, Homo sapiens
cccctcagcctctcccctgcctg

SEQ ID NO: 2487528 - DNA, 20 bp, Homo sapiens
cccctccccctgagattcag

SEQ ID NO: 2487529 - DNA, 14 bp, Homo sapiens
cccctccctggatg

SEQ ID NO: 2487530 - DNA, 19 bp, Homo sapiens
cccctcctctagctgtggg

SEQ ID NO: 2487531 - DNA, 15 bp, Homo sapiens
cccctctcagccctc

SEQ ID NO: 2487532 - DNA, 18 bp, Homo sapiens
cccctctgacctgcactg

SEQ ID NO: 2487533 - DNA, 12 bp, Homo sapiens
cccctctgtcca

SEQ ID NO: 2487534 - DNA, 22 bp, Homo sapiens
cccctctgtccaggcactgaga

SEQ ID NO: 2487535 - DNA, 14 bp, Homo sapiens
cccctcttggagaa

SEQ ID NO: 2487536 - DNA, 23 bp, Homo sapiens
cccctcttggagaagtctcagct

SEQ ID NO: 2487537 - DNA, 16 bp, Homo sapiens
cccctgaccactcaga

SEQ ID NO: 2487538 - DNA, 11 bp, Homo sapiens
cccctgcactg

SEQ ID NO: 2487539 - DNA, 23 bp, Homo sapiens
cccctgcagcttgtagccagccg

SEQ ID NO: 2487540 - DNA, 21 bp, Homo sapiens
cccctgcaggaaggagctgcc

SEQ ID NO: 2487541 - DNA, 22 bp, Homo sapiens
cccctgcaggaaggagctgcct

SEQ ID NO: 2487542 - DNA, 12 bp, Homo sapiens
cccctgccacca

SEQ ID NO: 2487543 - DNA, 15 bp, Homo sapiens
cccctgccagggcag

SEQ ID NO: 2487544 - DNA, 19 bp, Homo sapiens
cccctgccagggcagggcc

SEQ ID NO: 2487545 - DNA, 17 bp, Homo sapiens
cccctgccccccagcct

SEQ ID NO: 2487546 - DNA, 20 bp, Homo sapiens
cccctggaggcactgaagtg

SEQ ID NO: 2487547 - DNA, 12 bp, Homo sapiens
cccctggcagag

SEQ ID NO: 2487548 - DNA, 21 bp, Homo sapiens
cccctggcagagatgcctccc

SEQ ID NO: 2487549 - DNA, 23 bp, Homo sapiens
cccctgtctctcagggccaggcc

SEQ ID NO: 2487550 - DNA, 13 bp, Homo sapiens
ccccttagacaga

SEQ ID NO: 2487551 - DNA, 15 bp, Homo sapiens
ccccttatcctccct

SEQ ID NO: 2487552 - DNA, 17 bp, Homo sapiens
ccccttatcctccctgt

SEQ ID NO: 2487553 - DNA, 18 bp, Homo sapiens
ccccttatcctccctgta

SEQ ID NO: 2487554 - DNA, 14 bp, Homo sapiens
ccccttccgccact

SEQ ID NO: 2487555 - DNA, 12 bp, Homo sapiens
ccccttctcccc

SEQ ID NO: 2487556 - DNA, 11 bp, Homo sapiens
cagttgcagtc

SEQ ID NO: 2487557 - DNA, 16 bp, Homo sapiens
cagttgcatgtagtaa

SEQ ID NO: 2487558 - DNA, 18 bp, Homo sapiens
cagttgcatgtagtaaca

SEQ ID NO: 2487559 - DNA, 19 bp, Homo sapiens
cagttgcatgtagtaacac

SEQ ID NO: 2487560 - DNA, 20 bp, Homo sapiens
cagttgcatgtagtaacact

SEQ ID NO: 2487561 - DNA, 23 bp, Homo sapiens
cagttgcatgtagtaacactaat

SEQ ID NO: 2487562 - DNA, 22 bp, Homo sapiens
cagttggagttttttgtaccaa

SEQ ID NO: 2487563 - DNA, 16 bp, Homo sapiens
cagttggtaacttttg

SEQ ID NO: 2487564 - DNA, 17 bp, Homo sapiens
cagttggtaacttttgt

SEQ ID NO: 2487565 - DNA, 18 bp, Homo sapiens
cagttgtcccgattgtaa

SEQ ID NO: 2487566 - DNA, 21 bp, Homo sapiens
cagttgtcccgattgtaactc

SEQ ID NO: 2487567 - DNA, 21 bp, Homo sapiens
cagttgtctctgatgcagctt

SEQ ID NO: 2487568 - DNA, 19 bp, Homo sapiens
cagtttaatgaagatctaa

SEQ ID NO: 2487569 - DNA, 23 bp, Homo sapiens
cagtttaccagttgccttttatc

SEQ ID NO: 2487570 - DNA, 13 bp, Homo sapiens
cagtttatcattc

SEQ ID NO: 2487571 - DNA, 15 bp, Homo sapiens
cagtttcacagaaaa

SEQ ID NO: 2487572 - DNA, 20 bp, Homo sapiens
cagtttctaaactggagact

SEQ ID NO: 2487573 - DNA, 16 bp, Homo sapiens
cagtttgctttgccct

SEQ ID NO: 2487574 - DNA, 15 bp, Homo sapiens
cagtttgtgtgtctt

SEQ ID NO: 2487575 - DNA, 14 bp, Homo sapiens
cagttttaactgtg

SEQ ID NO: 2487576 - DNA, 19 bp, Homo sapiens
cagttttcctatgctttga

SEQ ID NO: 2487577 - DNA, 19 bp, Homo sapiens
cagttttttttttcttgtc

SEQ ID NO: 2487578 - DNA, 21 bp, Homo sapiens
cataaaggaaaagacacattt

SEQ ID NO: 2487579 - DNA, 12 bp, Homo sapiens
cataaattattg

SEQ ID NO: 2487580 - DNA, 22 bp, Homo sapiens
cataacccaaggtaccatccta

SEQ ID NO: 2487581 - DNA, 18 bp, Homo sapiens
cataagctatttttctaa

SEQ ID NO: 2487582 - DNA, 15 bp, Homo sapiens
cataagtatttcaaa

SEQ ID NO: 2487583 - DNA, 21 bp, Homo sapiens
cataatgcattcttctctgtt

SEQ ID NO: 2487584 - DNA, 22 bp, Homo sapiens
cataatgcattcttctctgttg

SEQ ID NO: 2487585 - DNA, 18 bp, Homo sapiens
cataatgttacattatta

SEQ ID NO: 2487586 - DNA, 18 bp, Homo sapiens
cataatgtttctggattt

SEQ ID NO: 2487587 - DNA, 21 bp, Homo sapiens
cataatgtttctggatttcat

SEQ ID NO: 2487588 - DNA, 22 bp, Homo sapiens
cataatgtttctggatttcata

SEQ ID NO: 2487589 - DNA, 14 bp, Homo sapiens
cataattcactctg

SEQ ID NO: 2487590 - DNA, 17 bp, Homo sapiens
cataattcactctgagt

SEQ ID NO: 2487591 - DNA, 22 bp, Homo sapiens
cataatttagtttcatataaag

SEQ ID NO: 2487592 - DNA, 14 bp, Homo sapiens
catacactttttct

SEQ ID NO: 2487593 - DNA, 11 bp, Homo sapiens
catacagagaa

SEQ ID NO: 2487594 - DNA, 17 bp, Homo sapiens
catacagagaagtcaca

SEQ ID NO: 2487595 - DNA, 22 bp, Homo sapiens
catacagagaagtcacagggca

SEQ ID NO: 2487596 - DNA, 14 bp, Homo sapiens
catacattttctaa

SEQ ID NO: 2487597 - DNA, 18 bp, Homo sapiens
catacattttctaagaaa

SEQ ID NO: 2487598 - DNA, 15 bp, Homo sapiens
cataccccctccccc

SEQ ID NO: 2487599 - DNA, 17 bp, Homo sapiens
catactgtaacattcag

SEQ ID NO: 2487600 - DNA, 13 bp, Homo sapiens
catacttgaaggg

SEQ ID NO: 2487601 - DNA, 20 bp, Homo sapiens
catacttgaagggccagagc

SEQ ID NO: 2487602 - DNA, 23 bp, Homo sapiens
catacttgaagggccagagccag

SEQ ID NO: 2487603 - DNA, 15 bp, Homo sapiens
catagacagaagaaa

SEQ ID NO: 2487604 - DNA, 18 bp, Homo sapiens
catagataaaacatcttt

SEQ ID NO: 2487605 - DNA, 22 bp, Homo sapiens
catagcacctaacaacattgta

SEQ ID NO: 2487606 - DNA, 16 bp, Homo sapiens
cataggacctttccac

SEQ ID NO: 2487607 - DNA, 18 bp, Homo sapiens
cataggtgatccatgtaa

SEQ ID NO: 2487608 - DNA, 23 bp, Homo sapiens
cataggtgatccatgtaactgcc

SEQ ID NO: 2487609 - DNA, 18 bp, Homo sapiens
catagtaccaatcatttt

SEQ ID NO: 2487610 - DNA, 18 bp, Homo sapiens
catagtattcatgactat

SEQ ID NO: 2487611 - DNA, 12 bp, Homo sapiens
catagttcagaa

SEQ ID NO: 2487612 - DNA, 17 bp, Homo sapiens
catataatgttgttatt

SEQ ID NO: 2487613 - DNA, 22 bp, Homo sapiens
catataattatatgttgtaagc

SEQ ID NO: 2487614 - DNA, 17 bp, Homo sapiens
catatatatactattaa

SEQ ID NO: 2487615 - DNA, 17 bp, Homo sapiens
catatcatccacacatg

SEQ ID NO: 2487616 - DNA, 20 bp, Homo sapiens
catatcatccacacatgaat

SEQ ID NO: 2487617 - DNA, 22 bp, Homo sapiens
catatgagtaagggcactgacg

SEQ ID NO: 2487618 - DNA, 15 bp, Homo sapiens
catatgatctgtctg

SEQ ID NO: 2487619 - DNA, 17 bp, Homo sapiens
catatgctaccaccagc

SEQ ID NO: 2487620 - DNA, 16 bp, Homo sapiens
catatgttgaatactt

SEQ ID NO: 2487621 - DNA, 16 bp, Homo sapiens
catattgtaaaacagg

SEQ ID NO: 2487622 - DNA, 19 bp, Homo sapiens
cccagccagggctcaatct

SEQ ID NO: 2487623 - DNA, 22 bp, Homo sapiens
cccagccagggctcaatctctg

SEQ ID NO: 2487624 - DNA, 15 bp, Homo sapiens
cccagcccacccccg

SEQ ID NO: 2487625 - DNA, 12 bp, Homo sapiens
cccagcccagag

SEQ ID NO: 2487626 - DNA, 15 bp, Homo sapiens
cccagcccagagaca

SEQ ID NO: 2487627 - DNA, 16 bp, Homo sapiens
cccagcccagagacat

SEQ ID NO: 2487628 - DNA, 11 bp, Homo sapiens
cccagcccagg

SEQ ID NO: 2487629 - DNA, 16 bp, Homo sapiens
cccagccccactcctc

SEQ ID NO: 2487630 - DNA, 17 bp, Homo sapiens
cccagccccagccaggg

SEQ ID NO: 2487631 - DNA, 21 bp, Homo sapiens
cccagccccctaagagagcac

SEQ ID NO: 2487632 - DNA, 14 bp, Homo sapiens
cccagccctcatcc

SEQ ID NO: 2487633 - DNA, 15 bp, Homo sapiens
cccagccctcatccc

SEQ ID NO: 2487634 - DNA, 16 bp, Homo sapiens
cccagccctcatcccg

SEQ ID NO: 2487635 - DNA, 15 bp, Homo sapiens
cccagcctctggcat

SEQ ID NO: 2487636 - DNA, 14 bp, Homo sapiens
cccagcctgtcaga

SEQ ID NO: 2487637 - DNA, 22 bp, Homo sapiens
cccagcctttgttccccactgg

SEQ ID NO: 2487638 - DNA, 14 bp, Homo sapiens
cccagcgattccct

SEQ ID NO: 2487639 - DNA, 14 bp, Homo sapiens
cccagcggacacac

SEQ ID NO: 2487640 - DNA, 13 bp, Homo sapiens
cccagctaggaag

SEQ ID NO: 2487641 - DNA, 23 bp, Homo sapiens
cccagctaggaagagcaggactc

SEQ ID NO: 2487642 - DNA, 11 bp, Homo sapiens
cccagctcaat

SEQ ID NO: 2487643 - DNA, 23 bp, Homo sapiens
cccaggaatcagtttaaaagcac

SEQ ID NO: 2487644 - DNA, 17 bp, Homo sapiens
cccaggaccacaggctc

SEQ ID NO: 2487645 - DNA, 22 bp, Homo sapiens
cccaggaccacaggctcaggca

SEQ ID NO: 2487646 - DNA, 22 bp, Homo sapiens
cccaggaccagaagctccccca

SEQ ID NO: 2487647 - DNA, 17 bp, Homo sapiens
cccaggaccagctcagg

SEQ ID NO: 2487648 - DNA, 20 bp, Homo sapiens
cccaggaccagctcaggaca

SEQ ID NO: 2487649 - DNA, 22 bp, Homo sapiens
cccaggaccagctcaggacaga

SEQ ID NO: 2487650 - DNA, 16 bp, Homo sapiens
cccaggacctggctgc

SEQ ID NO: 2487651 - DNA, 18 bp, Homo sapiens
cccaggacctggctgcca

SEQ ID NO: 2487652 - DNA, 12 bp, Homo sapiens
cccaggagctcc

SEQ ID NO: 2487653 - DNA, 14 bp, Homo sapiens
cccaggccaggact

SEQ ID NO: 2487654 - DNA, 22 bp, Homo sapiens
cccaggcccactgtgcctcaga

SEQ ID NO: 2487655 - DNA, 12 bp, Homo sapiens
cccaggctgccg

SEQ ID NO: 2487656 - DNA, 12 bp, Homo sapiens
cccaggctggga

SEQ ID NO: 2487657 - DNA, 14 bp, Homo sapiens
cccaggctgggaac

SEQ ID NO: 2487658 - DNA, 15 bp, Homo sapiens
cccagggaagcagca

SEQ ID NO: 2487659 - DNA, 19 bp, Homo sapiens
cccagggaagcagcagcct

SEQ ID NO: 2487660 - DNA, 19 bp, Homo sapiens
cccagggacacctgggaga

SEQ ID NO: 2487661 - DNA, 18 bp, Homo sapiens
cccagggcagccagggag

SEQ ID NO: 2487662 - DNA, 15 bp, Homo sapiens
cccagggcccagagc

SEQ ID NO: 2487663 - DNA, 14 bp, Homo sapiens
cccagggctcctgc

SEQ ID NO: 2487664 - DNA, 13 bp, Homo sapiens
cccagggctctgt

SEQ ID NO: 2487665 - DNA, 14 bp, Homo sapiens
cccagggctgggag

SEQ ID NO: 2487666 - DNA, 16 bp, Homo sapiens
cccagggctgggagga

SEQ ID NO: 2487667 - DNA, 16 bp, Homo sapiens
cccaggggcagcccca

SEQ ID NO: 2487668 - DNA, 14 bp, Homo sapiens
cccaggggctccct

SEQ ID NO: 2487669 - DNA, 17 bp, Homo sapiens
cccaggggctccctccg

SEQ ID NO: 2487670 - DNA, 17 bp, Homo sapiens
cccagggtcctgggagg

SEQ ID NO: 2487671 - DNA, 18 bp, Homo sapiens
cccagggtcctgggagga

SEQ ID NO: 2487672 - DNA, 20 bp, Homo sapiens
cccaggtaggccaaggtgtc

SEQ ID NO: 2487673 - DNA, 14 bp, Homo sapiens
cccaggtccagctc

SEQ ID NO: 2487674 - DNA, 17 bp, Homo sapiens
cccaggtccagctctgg

SEQ ID NO: 2487675 - DNA, 18 bp, Homo sapiens
cccaggttggctctgcca

SEQ ID NO: 2487676 - DNA, 17 bp, Homo sapiens
cccagtcattctgggaa

SEQ ID NO: 2487677 - DNA, 19 bp, Homo sapiens
cccagtgcccccactgacc

SEQ ID NO: 2487678 - DNA, 16 bp, Homo sapiens
cccagttcctgtggct

SEQ ID NO: 2487679 - DNA, 15 bp, Homo sapiens
cccagttgccatctg

SEQ ID NO: 2487680 - DNA, 20 bp, Homo sapiens
cccagtttctaaactggaga

SEQ ID NO: 2487681 - DNA, 20 bp, Homo sapiens
cccatatgctaccaccagct

SEQ ID NO: 2487682 - DNA, 15 bp, Homo sapiens
cccatattgtaaaac

SEQ ID NO: 2487683 - DNA, 19 bp, Homo sapiens
cccatattgtaaaacaggt

SEQ ID NO: 2487684 - DNA, 13 bp, Homo sapiens
cccatcccacacc

SEQ ID NO: 2487685 - DNA, 14 bp, Homo sapiens
cccatcccatgctg

SEQ ID NO: 2487686 - DNA, 14 bp, Homo sapiens
cccatccccagcga

SEQ ID NO: 2487687 - DNA, 16 bp, Homo sapiens
cccatccctccccagt

SEQ ID NO: 2487688 - DNA, 18 bp, Homo sapiens
cccatcctgtggtcactg

SEQ ID NO: 2487689 - DNA, 19 bp, Homo sapiens
cccatcgtctcggccttca

SEQ ID NO: 2487690 - DNA, 14 bp, Homo sapiens
cccatctcatgccc

SEQ ID NO: 2487691 - DNA, 22 bp, Homo sapiens
cccatctcatgcccctggctgg

SEQ ID NO: 2487692 - DNA, 21 bp, Homo sapiens
cccatctctccctcccctgcc

SEQ ID NO: 2487693 - DNA, 12 bp, Homo sapiens
cccatcttgctt

SEQ ID NO: 2487694 - DNA, 15 bp, Homo sapiens
cccatgatccctgtg

SEQ ID NO: 2487695 - DNA, 12 bp, Homo sapiens
cccatgcactgt

SEQ ID NO: 2487696 - DNA, 22 bp, Homo sapiens
cccatgcactgtgaaggaccct

SEQ ID NO: 2487697 - DNA, 20 bp, Homo sapiens
cccatggacaggctggctcc

SEQ ID NO: 2487698 - DNA, 20 bp, Homo sapiens
cccatggagattgacctgga

SEQ ID NO: 2487699 - DNA, 17 bp, Homo sapiens
cccatggtgctaggaag

SEQ ID NO: 2487700 - DNA, 21 bp, Homo sapiens
cccatgtgtcctggttcccgt

SEQ ID NO: 2487701 - DNA, 15 bp, Homo sapiens
cccatgttctgtccc

SEQ ID NO: 2487702 - DNA, 16 bp, Homo sapiens
cccattcccgcagtgg

SEQ ID NO: 2487703 - DNA, 18 bp, Homo sapiens
cccattcccgcagtggga

SEQ ID NO: 2487704 - DNA, 20 bp, Homo sapiens
cccatttttatatcgatctc

SEQ ID NO: 2487705 - DNA, 19 bp, Homo sapiens
ccccaaaagcgtgagctta

SEQ ID NO: 2487706 - DNA, 14 bp, Homo sapiens
ccccaacagcgccc

SEQ ID NO: 2487707 - DNA, 23 bp, Homo sapiens
ccccaacagctggaccctgacca

SEQ ID NO: 2487708 - DNA, 20 bp, Homo sapiens
ccccaacccgtggaggctgc

SEQ ID NO: 2487709 - DNA, 19 bp, Homo sapiens
ccccaacctgctctcctct

SEQ ID NO: 2487710 - DNA, 14 bp, Homo sapiens
ccccaaggaggcag

SEQ ID NO: 2487711 - DNA, 17 bp, Homo sapiens
ccccaaggaggcagcct

SEQ ID NO: 2487712 - DNA, 13 bp, Homo sapiens
ccccaagtcctca

SEQ ID NO: 2487713 - DNA, 22 bp, Homo sapiens
ccccacccaccaaccctcaggg

SEQ ID NO: 2487714 - DNA, 18 bp, Homo sapiens
ccccacccaggccaggca

SEQ ID NO: 2487715 - DNA, 14 bp, Homo sapiens
ccccaccccagggc

SEQ ID NO: 2487716 - DNA, 15 bp, Homo sapiens
ccccaccccagggca

SEQ ID NO: 2487717 - DNA, 23 bp, Homo sapiens
ccccaccctcggggatgtgtcct

SEQ ID NO: 2487718 - DNA, 18 bp, Homo sapiens
ccccaccctgttcctgct

SEQ ID NO: 2487719 - DNA, 14 bp, Homo sapiens
ccccacgagggctg

SEQ ID NO: 2487720 - DNA, 16 bp, Homo sapiens
ccccacgagggctggc

SEQ ID NO: 2487721 - DNA, 17 bp, Homo sapiens
ccccacgagggctggct

SEQ ID NO: 2487722 - DNA, 14 bp, Homo sapiens
ccccactccctcac

SEQ ID NO: 2487723 - DNA, 16 bp, Homo sapiens
ccccactcctctgctg

SEQ ID NO: 2487724 - DNA, 21 bp, Homo sapiens
ccccactcctctgctgacctg

SEQ ID NO: 2487725 - DNA, 19 bp, Homo sapiens
ccccactctgctctgatgc

SEQ ID NO: 2487726 - DNA, 15 bp, Homo sapiens
ccccactgacagcct

SEQ ID NO: 2487727 - DNA, 14 bp, Homo sapiens
cactgcaacctcca

SEQ ID NO: 2487728 - DNA, 20 bp, Homo sapiens
cactgcaatctccacctccc

SEQ ID NO: 2487729 - DNA, 17 bp, Homo sapiens
cactgcacctgcctcca

SEQ ID NO: 2487730 - DNA, 22 bp, Homo sapiens
cactgcacctgcctccagccgc

SEQ ID NO: 2487731 - DNA, 18 bp, Homo sapiens
cactgcagccccacccag

SEQ ID NO: 2487732 - DNA, 12 bp, Homo sapiens
cactgccactgg

SEQ ID NO: 2487733 - DNA, 18 bp, Homo sapiens
cactgcccatggacaggc

SEQ ID NO: 2487734 - DNA, 14 bp, Homo sapiens
cactgcctgctccc

SEQ ID NO: 2487735 - DNA, 20 bp, Homo sapiens
cactgcctgctcccatcctg

SEQ ID NO: 2487736 - DNA, 21 bp, Homo sapiens
cactgcctgctcccatcctgt

SEQ ID NO: 2487737 - DNA, 21 bp, Homo sapiens
cactgccttcgcttcttgcct

SEQ ID NO: 2487738 - DNA, 23 bp, Homo sapiens
cactgccttcgcttcttgcctct

SEQ ID NO: 2487739 - DNA, 18 bp, Homo sapiens
cactgctctaacagccct

SEQ ID NO: 2487740 - DNA, 19 bp, Homo sapiens
cactgctctaacagccctc

SEQ ID NO: 2487741 - DNA, 10 bp, Homo sapiens
cactggagca

SEQ ID NO: 2487742 - DNA, 19 bp, Homo sapiens
cactggagcagaaggggag

SEQ ID NO: 2487743 - DNA, 17 bp, Homo sapiens
cactggctctcctggcc

SEQ ID NO: 2487744 - DNA, 18 bp, Homo sapiens
cactggggacttggcctc

SEQ ID NO: 2487745 - DNA, 18 bp, Homo sapiens
cactggggctcagagccg

SEQ ID NO: 2487746 - DNA, 17 bp, Homo sapiens
cactgggtggtggcctg

SEQ ID NO: 2487747 - DNA, 16 bp, Homo sapiens
cactggtctgctgttc

SEQ ID NO: 2487748 - DNA, 22 bp, Homo sapiens
cactggtggggataggccagcc

SEQ ID NO: 2487749 - DNA, 15 bp, Homo sapiens
cactgtagttctaag

SEQ ID NO: 2487750 - DNA, 14 bp, Homo sapiens
cactgtgaccccca

SEQ ID NO: 2487751 - DNA, 15 bp, Homo sapiens
cactgtgacccccag

SEQ ID NO: 2487752 - DNA, 19 bp, Homo sapiens
cactgtgacccccagctcc

SEQ ID NO: 2487753 - DNA, 21 bp, Homo sapiens
cactgttcttagctcaatgag

SEQ ID NO: 2487754 - DNA, 12 bp, Homo sapiens
cacttaatgtat

SEQ ID NO: 2487755 - DNA, 14 bp, Homo sapiens
cacttaatgtatgt

SEQ ID NO: 2487756 - DNA, 16 bp, Homo sapiens
cacttatctgatcaga

SEQ ID NO: 2487757 - DNA, 19 bp, Homo sapiens
cacttatgttatacaatac

SEQ ID NO: 2487758 - DNA, 14 bp, Homo sapiens
cacttcaaactact

SEQ ID NO: 2487759 - DNA, 19 bp, Homo sapiens
cacttcagggctttactcc

SEQ ID NO: 2487760 - DNA, 21 bp, Homo sapiens
cacttcctctcgcggccctca

SEQ ID NO: 2487761 - DNA, 21 bp, Homo sapiens
cacttctcaggacacaggcct

SEQ ID NO: 2487762 - DNA, 22 bp, Homo sapiens
cacttctcaggacacaggcctg

SEQ ID NO: 2487763 - DNA, 13 bp, Homo sapiens
cacttgcctcttc

SEQ ID NO: 2487764 - DNA, 14 bp, Homo sapiens
cacttggcagcctt

SEQ ID NO: 2487765 - DNA, 17 bp, Homo sapiens
cacttggcctcatgctg

SEQ ID NO: 2487766 - DNA, 20 bp, Homo sapiens
cacttgtcaggagtgtgtgt

SEQ ID NO: 2487767 - DNA, 18 bp, Homo sapiens
cacttgtcattgttatat

SEQ ID NO: 2487768 - DNA, 14 bp, Homo sapiens
cacttgtccagctg

SEQ ID NO: 2487769 - DNA, 20 bp, Homo sapiens
cacttgtccttagcctggac

SEQ ID NO: 2487770 - DNA, 21 bp, Homo sapiens
cacttgtccttagcctggacc

SEQ ID NO: 2487771 - DNA, 22 bp, Homo sapiens
cacttgtccttagcctggacct

SEQ ID NO: 2487772 - DNA, 22 bp, Homo sapiens
cacttgtgggtttttgttttgt

SEQ ID NO: 2487773 - DNA, 12 bp, Homo sapiens
cactttcagctg

SEQ ID NO: 2487774 - DNA, 14 bp, Homo sapiens
cactttcagctgtc

SEQ ID NO: 2487775 - DNA, 18 bp, Homo sapiens
cactttcagctgtctttt

SEQ ID NO: 2487776 - DNA, 13 bp, Homo sapiens
cactttcccaccc

SEQ ID NO: 2487777 - DNA, 23 bp, Homo sapiens
cactttcttttttttctatttca

SEQ ID NO: 2487778 - DNA, 22 bp, Homo sapiens
cactttgcactgatatatcatg

SEQ ID NO: 2487779 - DNA, 20 bp, Homo sapiens
cactttgctttaatataaat

SEQ ID NO: 2487780 - DNA, 13 bp, Homo sapiens
cacttttcccact

SEQ ID NO: 2487781 - DNA, 16 bp, Homo sapiens
cactttttgaggcaaa

SEQ ID NO: 2487782 - DNA, 20 bp, Homo sapiens
cactttttgaggcaaaagaa

SEQ ID NO: 2487783 - DNA, 19 bp, Homo sapiens
cagaaaacccttgggccag

SEQ ID NO: 2487784 - DNA, 20 bp, Homo sapiens
cagaaaacccttgggccaga

SEQ ID NO: 2487785 - DNA, 18 bp, Homo sapiens
cagaaaatgttgagaatc

SEQ ID NO: 2487786 - DNA, 17 bp, Homo sapiens
cagaaaattctgtgcct

SEQ ID NO: 2487787 - DNA, 19 bp, Homo sapiens
cagaaaggaaaaacaaact

SEQ ID NO: 2487788 - DNA, 18 bp, Homo sapiens
cagaaagggagggctctg

SEQ ID NO: 2487789 - DNA, 22 bp, Homo sapiens
cagaaagggagggctctgaggc

SEQ ID NO: 2487790 - DNA, 12 bp, Homo sapiens
cagaaattgtat

SEQ ID NO: 2487791 - DNA, 13 bp, Homo sapiens
cagaaattgtata

SEQ ID NO: 2487792 - DNA, 18 bp, Homo sapiens
cagaaattgtatattgta

SEQ ID NO: 2487793 - DNA, 19 bp, Homo sapiens
cagaaattgtatattgtaa

SEQ ID NO: 2487794 - DNA, 21 bp, Homo sapiens
cagaacatagacagaagaaac

SEQ ID NO: 2487795 - DNA, 17 bp, Homo sapiens
cagaaccaattattttc

SEQ ID NO: 2487796 - DNA, 20 bp, Homo sapiens
cagaaccaattattttcatc

SEQ ID NO: 2487797 - DNA, 12 bp, Homo sapiens
cagaaccacagg

SEQ ID NO: 2487798 - DNA, 19 bp, Homo sapiens
cagaaccggagagccagct

SEQ ID NO: 2487799 - DNA, 19 bp, Homo sapiens
cagaactagaatttgatta

SEQ ID NO: 2487800 - DNA, 14 bp, Homo sapiens
cagaactctttcaa

SEQ ID NO: 2487801 - DNA, 15 bp, Homo sapiens
cagaactctttcaaa

SEQ ID NO: 2487802 - DNA, 13 bp, Homo sapiens
cagaacttcagaa

SEQ ID NO: 2487803 - DNA, 19 bp, Homo sapiens
cagaacttcagaaagactt

SEQ ID NO: 2487804 - DNA, 13 bp, Homo sapiens
cagaagcctgggg

SEQ ID NO: 2487805 - DNA, 14 bp, Homo sapiens
cagaagcctggggg

SEQ ID NO: 2487806 - DNA, 14 bp, Homo sapiens
cagagttacagttc

SEQ ID NO: 2487807 - DNA, 18 bp, Homo sapiens
cagagttacagttctgtg

SEQ ID NO: 2487808 - DNA, 19 bp, Homo sapiens
cagataactgaaaattatt

SEQ ID NO: 2487809 - DNA, 12 bp, Homo sapiens
cagataactttt

SEQ ID NO: 2487810 - DNA, 22 bp, Homo sapiens
cagataaggtaaaatgccatga

SEQ ID NO: 2487811 - DNA, 18 bp, Homo sapiens
cagatagtgtagctgagg

SEQ ID NO: 2487812 - DNA, 15 bp, Homo sapiens
cagatatttgtcatg

SEQ ID NO: 2487813 - DNA, 16 bp, Homo sapiens
cagatcagtgtaccat

SEQ ID NO: 2487814 - DNA, 17 bp, Homo sapiens
cagatccagcctggggt

SEQ ID NO: 2487815 - DNA, 13 bp, Homo sapiens
cagatccagggac

SEQ ID NO: 2487816 - DNA, 16 bp, Homo sapiens
cagatcctcctcattc

SEQ ID NO: 2487817 - DNA, 17 bp, Homo sapiens
cagatcggccacagggc

SEQ ID NO: 2487818 - DNA, 23 bp, Homo sapiens
cagatctgatttgtaacccactg

SEQ ID NO: 2487819 - DNA, 19 bp, Homo sapiens
cagatctggaacctcagcc

SEQ ID NO: 2487820 - DNA, 23 bp, Homo sapiens
cagatctggaacctcagcctggc

SEQ ID NO: 2487821 - DNA, 16 bp, Homo sapiens
cagatgaggctttcca

SEQ ID NO: 2487822 - DNA, 14 bp, Homo sapiens
cagatgagtcacac

SEQ ID NO: 2487823 - DNA, 17 bp, Homo sapiens
cagatgcagggcagtca

SEQ ID NO: 2487824 - DNA, 16 bp, Homo sapiens
cagatgctccaagatt

SEQ ID NO: 2487825 - DNA, 18 bp, Homo sapiens
cagatgctccaagattct

SEQ ID NO: 2487826 - DNA, 21 bp, Homo sapiens
cagatgctttcctgcacatta

SEQ ID NO: 2487827 - DNA, 12 bp, Homo sapiens
cagatggcactt

SEQ ID NO: 2487828 - DNA, 13 bp, Homo sapiens
cagatggcagctt

SEQ ID NO: 2487829 - DNA, 19 bp, Homo sapiens
cagatggcagcttttaaaa

SEQ ID NO: 2487830 - DNA, 14 bp, Homo sapiens
cagatgtgaaccat

SEQ ID NO: 2487831 - DNA, 12 bp, Homo sapiens
cagattccttcc

SEQ ID NO: 2487832 - DNA, 14 bp, Homo sapiens
cagattccttccca

SEQ ID NO: 2487833 - DNA, 13 bp, Homo sapiens
cagcaaagccccc

SEQ ID NO: 2487834 - DNA, 12 bp, Homo sapiens
ctcctctgcact

SEQ ID NO: 2487835 - DNA, 16 bp, Homo sapiens
ctcctcttccatgctg

SEQ ID NO: 2487836 - DNA, 18 bp, Homo sapiens
ctcctcttccatgctgtg

SEQ ID NO: 2487837 - DNA, 13 bp, Homo sapiens
ctcctcttcccca

SEQ ID NO: 2487838 - DNA, 17 bp, Homo sapiens
ctcctcttccccagacg

SEQ ID NO: 2487839 - DNA, 23 bp, Homo sapiens
ctcctcttctactcacttttccc

SEQ ID NO: 2487840 - DNA, 15 bp, Homo sapiens
ctcctgacctcaggc

SEQ ID NO: 2487841 - DNA, 19 bp, Homo sapiens
ctcctgaggatgtgtccca

SEQ ID NO: 2487842 - DNA, 19 bp, Homo sapiens
ctcctgagtgcttgctttt

SEQ ID NO: 2487843 - DNA, 15 bp, Homo sapiens
ctcctgcacttactt

SEQ ID NO: 2487844 - DNA, 15 bp, Homo sapiens
ctcctgcagccccag

SEQ ID NO: 2487845 - DNA, 15 bp, Homo sapiens
ctcctgccggctcct

SEQ ID NO: 2487846 - DNA, 18 bp, Homo sapiens
ctcctgccttcctcctgg

SEQ ID NO: 2487847 - DNA, 16 bp, Homo sapiens
ctcctgctgctccctc

SEQ ID NO: 2487848 - DNA, 20 bp, Homo sapiens
ctcctgctgctccctcagac

SEQ ID NO: 2487849 - DNA, 22 bp, Homo sapiens
ctcctgctgctccctcagactg

SEQ ID NO: 2487850 - DNA, 22 bp, Homo sapiens
ctcctggacccccctttcacag

SEQ ID NO: 2487851 - DNA, 16 bp, Homo sapiens
ctcctggatctccctg

SEQ ID NO: 2487852 - DNA, 19 bp, Homo sapiens
ctcctggatctccctgaga

SEQ ID NO: 2487853 - DNA, 12 bp, Homo sapiens
ctcctgggccct

SEQ ID NO: 2487854 - DNA, 20 bp, Homo sapiens
ctcctgggccctctctgctc

SEQ ID NO: 2487855 - DNA, 23 bp, Homo sapiens
ctcctgggttttgtattctctga

SEQ ID NO: 2487856 - DNA, 23 bp, Homo sapiens
ctcctgtaacatactggcctgga

SEQ ID NO: 2487857 - DNA, 11 bp, Homo sapiens
ctcctgtgacc

SEQ ID NO: 2487858 - DNA, 17 bp, Homo sapiens
ctcctgtgctcagccct

SEQ ID NO: 2487859 - DNA, 22 bp, Homo sapiens
ctcctgtgctcagccctgagga

SEQ ID NO: 2487860 - DNA, 15 bp, Homo sapiens
ctcctgtgggagcct

SEQ ID NO: 2487861 - DNA, 17 bp, Homo sapiens
ctcctgtgggagcctcg

SEQ ID NO: 2487862 - DNA, 14 bp, Homo sapiens
ctcctgttgggaga

SEQ ID NO: 2487863 - DNA, 16 bp, Homo sapiens
ctcctgttgggagagg

SEQ ID NO: 2487864 - DNA, 13 bp, Homo sapiens
ctccttccctctc

SEQ ID NO: 2487865 - DNA, 12 bp, Homo sapiens
ctccttcctaaa

SEQ ID NO: 2487866 - DNA, 22 bp, Homo sapiens
ctccttcctgattgtttacagt

SEQ ID NO: 2487867 - DNA, 13 bp, Homo sapiens
ctccttcctgccc

SEQ ID NO: 2487868 - DNA, 13 bp, Homo sapiens
ctccttctgagct

SEQ ID NO: 2487869 - DNA, 14 bp, Homo sapiens
ctccttctgagctc

SEQ ID NO: 2487870 - DNA, 16 bp, Homo sapiens
ctccttgtgggcctgg

SEQ ID NO: 2487871 - DNA, 18 bp, Homo sapiens
ctccttgtgggcctgggc

SEQ ID NO: 2487872 - DNA, 13 bp, Homo sapiens
ctccttttaaaga

SEQ ID NO: 2487873 - DNA, 21 bp, Homo sapiens
ctcgaactattttcaaagact

SEQ ID NO: 2487874 - DNA, 17 bp, Homo sapiens
ctcgagcagtcctgcct

SEQ ID NO: 2487875 - DNA, 18 bp, Homo sapiens
ctcgagcgccctgcagac

SEQ ID NO: 2487876 - DNA, 14 bp, Homo sapiens
ctcgaggggtgggc

SEQ ID NO: 2487877 - DNA, 17 bp, Homo sapiens
ctcgaggggtgggctgg

SEQ ID NO: 2487878 - DNA, 19 bp, Homo sapiens
ctcgaggggtgggctggta

SEQ ID NO: 2487879 - DNA, 24 bp, Homo sapiens
ctcgatgtggtcacagctgtatag

SEQ ID NO: 2487880 - DNA, 14 bp, Homo sapiens
ctcgatttctccag

SEQ ID NO: 2487881 - DNA, 12 bp, Homo sapiens
ctcgcaacccgt

SEQ ID NO: 2487882 - DNA, 23 bp, Homo sapiens
ctcgcaacccgtgccaagtccag

SEQ ID NO: 2487883 - DNA, 18 bp, Homo sapiens
ctcgcataggacctttcc

SEQ ID NO: 2487884 - DNA, 14 bp, Homo sapiens
ctcgccccagcagg

SEQ ID NO: 2487885 - DNA, 20 bp, Homo sapiens
ctcgccctgcggtagatggg

SEQ ID NO: 2487886 - DNA, 16 bp, Homo sapiens
ctcgctccccactctg

SEQ ID NO: 2487887 - DNA, 15 bp, Homo sapiens
ctcgctggactctca

SEQ ID NO: 2487888 - DNA, 14 bp, Homo sapiens
ctcggatctctcct

SEQ ID NO: 2487889 - DNA, 23 bp, Homo sapiens
ctcggcagcccttccaaactctt

SEQ ID NO: 2487890 - DNA, 20 bp, Homo sapiens
ctcggcctcccaaagtgctg

SEQ ID NO: 2487891 - DNA, 15 bp, Homo sapiens
ctcggggtgcacagg

SEQ ID NO: 2487892 - DNA, 19 bp, Homo sapiens
ctcggggtgcacaggaggg

SEQ ID NO: 2487893 - DNA, 12 bp, Homo sapiens
ctcgtactcagg

SEQ ID NO: 2487894 - DNA, 13 bp, Homo sapiens
ctcgtatagcatg

SEQ ID NO: 2487895 - DNA, 14 bp, Homo sapiens
ctcgtcctcgtttg

SEQ ID NO: 2487896 - DNA, 12 bp, Homo sapiens
ctctaaagcaaa

SEQ ID NO: 2487897 - DNA, 16 bp, Homo sapiens
ctctaaagcaaattta

SEQ ID NO: 2487898 - DNA, 13 bp, Homo sapiens
ctctaacagcacc

SEQ ID NO: 2487899 - DNA, 14 bp, Homo sapiens
ctctaacagccctc

SEQ ID NO: 2487900 - DNA, 19 bp, Homo sapiens
ctctaacagtggacaaagt

SEQ ID NO: 2487901 - DNA, 12 bp, Homo sapiens
ctctaacgcctg

SEQ ID NO: 2487902 - DNA, 17 bp, Homo sapiens
ctctaacgcctgagccc

SEQ ID NO: 2487903 - DNA, 21 bp, Homo sapiens
ctctaacgcctgagcccaggg

SEQ ID NO: 2487904 - DNA, 20 bp, Homo sapiens
ctctaacttggctcacactc

SEQ ID NO: 2487905 - DNA, 20 bp, Homo sapiens
ctctaattcacagtgctctt

SEQ ID NO: 2487906 - DNA, 17 bp, Homo sapiens
ctctacagagcttccct

SEQ ID NO: 2487907 - DNA, 18 bp, Homo sapiens
ctctacatcttctgcctt

SEQ ID NO: 2487908 - DNA, 19 bp, Homo sapiens
ctctacccatattacagat

SEQ ID NO: 2487909 - DNA, 14 bp, Homo sapiens
ctctaccttctccc

SEQ ID NO: 2487910 - DNA, 21 bp, Homo sapiens
ctctagagaaataagatcttt

SEQ ID NO: 2487911 - DNA, 19 bp, Homo sapiens
ctctagagcagactacagc

SEQ ID NO: 2487912 - DNA, 16 bp, Homo sapiens
ctctagagtccaaggt

SEQ ID NO: 2487913 - DNA, 14 bp, Homo sapiens
ctctagatcataag

SEQ ID NO: 2487914 - DNA, 12 bp, Homo sapiens
ctctagattcca

SEQ ID NO: 2487915 - DNA, 15 bp, Homo sapiens
ctctagtcaatgaca

SEQ ID NO: 2487916 - DNA, 15 bp, Homo sapiens
ctctagttctttgtt

SEQ ID NO: 2487917 - DNA, 18 bp, Homo sapiens
ctctagttctttgttcat

SEQ ID NO: 2487918 - DNA, 17 bp, Homo sapiens
ctctatgagtctagatg

SEQ ID NO: 2487919 - DNA, 19 bp, Homo sapiens
ctctatgagtctagatgtt

SEQ ID NO: 2487920 - DNA, 15 bp, Homo sapiens
ctctattatgaatgt

SEQ ID NO: 2487921 - DNA, 23 bp, Homo sapiens
ctctattatgaatgtgaagcctt

SEQ ID NO: 2487922 - DNA, 22 bp, Homo sapiens
ctctcaacaccatgattccttt

SEQ ID NO: 2487923 - DNA, 16 bp, Homo sapiens
ctctcaccatttggat

SEQ ID NO: 2487924 - DNA, 23 bp, Homo sapiens
ctctcaccatttggatcctgtgt

SEQ ID NO: 2487925 - DNA, 15 bp, Homo sapiens
ctctcactccctccc

SEQ ID NO: 2487926 - DNA, 13 bp, Homo sapiens
ctctcagctccag

SEQ ID NO: 2487927 - DNA, 20 bp, Homo sapiens
ctgaccatgctcatctgctg

SEQ ID NO: 2487928 - DNA, 22 bp, Homo sapiens
ctgaccatgctcatctgctggt

SEQ ID NO: 2487929 - DNA, 20 bp, Homo sapiens
ctgaccccaaacaccttcca

SEQ ID NO: 2487930 - DNA, 22 bp, Homo sapiens
ctgaccccaaacaccttccagc

SEQ ID NO: 2487931 - DNA, 16 bp, Homo sapiens
ctgacctccgccatcc

SEQ ID NO: 2487932 - DNA, 19 bp, Homo sapiens
ctgacctccgccatccacc

SEQ ID NO: 2487933 - DNA, 14 bp, Homo sapiens
ctgacctgcactgg

SEQ ID NO: 2487934 - DNA, 13 bp, Homo sapiens
ctgacctgctgac

SEQ ID NO: 2487935 - DNA, 15 bp, Homo sapiens
ctgacctgctgacct

SEQ ID NO: 2487936 - DNA, 12 bp, Homo sapiens
ctgacctggccc

SEQ ID NO: 2487937 - DNA, 13 bp, Homo sapiens
ctgacctggcccc

SEQ ID NO: 2487938 - DNA, 17 bp, Homo sapiens
ctgacctggccccctca

SEQ ID NO: 2487939 - DNA, 21 bp, Homo sapiens
ctgacctgtgagcccagctgg

SEQ ID NO: 2487940 - DNA, 19 bp, Homo sapiens
ctgaccttaaatgcaacca

SEQ ID NO: 2487941 - DNA, 19 bp, Homo sapiens
ctgacggccagggagaagc

SEQ ID NO: 2487942 - DNA, 20 bp, Homo sapiens
ctgacggccagggagaagct

SEQ ID NO: 2487943 - DNA, 14 bp, Homo sapiens
ctgactaaactttt

SEQ ID NO: 2487944 - DNA, 12 bp, Homo sapiens
ctcaggacagat

SEQ ID NO: 2487945 - DNA, 14 bp, Homo sapiens
ctcaggacagatgc

SEQ ID NO: 2487946 - DNA, 18 bp, Homo sapiens
ctcaggacagatgccaca

SEQ ID NO: 2487947 - DNA, 14 bp, Homo sapiens
ctcaggactgggag

SEQ ID NO: 2487948 - DNA, 15 bp, Homo sapiens
ctcaggactgggagc

SEQ ID NO: 2487949 - DNA, 16 bp, Homo sapiens
ctcaggagcctgtgac

SEQ ID NO: 2487950 - DNA, 20 bp, Homo sapiens
ctcaggatccaagctaagca

SEQ ID NO: 2487951 - DNA, 16 bp, Homo sapiens
ctcaggatgagggaaa

SEQ ID NO: 2487952 - DNA, 13 bp, Homo sapiens
ctcaggcacacag

SEQ ID NO: 2487953 - DNA, 15 bp, Homo sapiens
ctcaggcaggggcct

SEQ ID NO: 2487954 - DNA, 20 bp, Homo sapiens
ctcaggcgatccacctgtct

SEQ ID NO: 2487955 - DNA, 15 bp, Homo sapiens
ctcaggctaggccag

SEQ ID NO: 2487956 - DNA, 16 bp, Homo sapiens
ctcaggctaggccagc

SEQ ID NO: 2487957 - DNA, 18 bp, Homo sapiens
ctcaggctaggccagcag

SEQ ID NO: 2487958 - DNA, 21 bp, Homo sapiens
ctcaggctaggccagcagggg

SEQ ID NO: 2487959 - DNA, 13 bp, Homo sapiens
ctcaggctgcctg

SEQ ID NO: 2487960 - DNA, 15 bp, Homo sapiens
ctcaggctgcctgag

SEQ ID NO: 2487961 - DNA, 16 bp, Homo sapiens
ctcaggctgcctgagt

SEQ ID NO: 2487962 - DNA, 16 bp, Homo sapiens
ctcagggaccatggct

SEQ ID NO: 2487963 - DNA, 16 bp, Homo sapiens
ctcagggcaaagccag

SEQ ID NO: 2487964 - DNA, 10 bp, Homo sapiens
ctcagggcag

SEQ ID NO: 2487965 - DNA, 14 bp, Homo sapiens
ctcagggccaggcc

SEQ ID NO: 2487966 - DNA, 21 bp, Homo sapiens
ctcagggccaggcctctccct

SEQ ID NO: 2487967 - DNA, 15 bp, Homo sapiens
ctcagggctcctggg

SEQ ID NO: 2487968 - DNA, 15 bp, Homo sapiens
ctcagggctccttgt

SEQ ID NO: 2487969 - DNA, 14 bp, Homo sapiens
ctcagggggcgcct

SEQ ID NO: 2487970 - DNA, 23 bp, Homo sapiens
ctcagggggcgcctgtggttctg

SEQ ID NO: 2487971 - DNA, 22 bp, Homo sapiens
ctcagtaatttagaaatcattt

SEQ ID NO: 2487972 - DNA, 19 bp, Homo sapiens
ctcagtctctcttctctcc

SEQ ID NO: 2487973 - DNA, 14 bp, Homo sapiens
ctcagtgaagacta

SEQ ID NO: 2487974 - DNA, 15 bp, Homo sapiens
ctcagtgaagttgct

SEQ ID NO: 2487975 - DNA, 18 bp, Homo sapiens
ctcagtgaagttgctgct

SEQ ID NO: 2487976 - DNA, 22 bp, Homo sapiens
ctcagtggcccatggcatttta

SEQ ID NO: 2487977 - DNA, 16 bp, Homo sapiens
ctcagtggggcagagg

SEQ ID NO: 2487978 - DNA, 15 bp, Homo sapiens
ctcagtttcttgctt

SEQ ID NO: 2487979 - DNA, 17 bp, Homo sapiens
ctcatacactcgtatga

SEQ ID NO: 2487980 - DNA, 12 bp, Homo sapiens
ctcatcagtagt

SEQ ID NO: 2487981 - DNA, 13 bp, Homo sapiens
ctcatcattctct

SEQ ID NO: 2487982 - DNA, 14 bp, Homo sapiens
ctcatcattctctg

SEQ ID NO: 2487983 - DNA, 17 bp, Homo sapiens
ctcatcattctctgtct

SEQ ID NO: 2487984 - DNA, 23 bp, Homo sapiens
ctcatcattctctgtctcatcca

SEQ ID NO: 2487985 - DNA, 15 bp, Homo sapiens
ctcatccaccccatc

SEQ ID NO: 2487986 - DNA, 24 bp, Homo sapiens
ctcatccaccccatccctccccag

SEQ ID NO: 2487987 - DNA, 16 bp, Homo sapiens
ctcatcccgtgttctc

SEQ ID NO: 2487988 - DNA, 13 bp, Homo sapiens
ctcatcctccttc

SEQ ID NO: 2487989 - DNA, 16 bp, Homo sapiens
ctcatctctctgccca

SEQ ID NO: 2487990 - DNA, 13 bp, Homo sapiens
ctcatctgctggt

SEQ ID NO: 2487991 - DNA, 14 bp, Homo sapiens
ctcatctgctggtc

SEQ ID NO: 2487992 - DNA, 16 bp, Homo sapiens
ctcatctgctggtccg

SEQ ID NO: 2487993 - DNA, 20 bp, Homo sapiens
ctcatctggggagcaggcag

SEQ ID NO: 2487994 - DNA, 13 bp, Homo sapiens
ctcatctgtccct

SEQ ID NO: 2487995 - DNA, 15 bp, Homo sapiens
ctcatgaatgtaaat

SEQ ID NO: 2487996 - DNA, 21 bp, Homo sapiens
ctcatgaatgtaaatttgtac

SEQ ID NO: 2487997 - DNA, 22 bp, Homo sapiens
ctcatgataccacctttactgt

SEQ ID NO: 2487998 - DNA, 22 bp, Homo sapiens
ctcatgccagtaacaggctcaa

SEQ ID NO: 2487999 - DNA, 16 bp, Homo sapiens
ctcatgcccctggctg

SEQ ID NO: 2488000 - DNA, 14 bp, Homo sapiens
ctcatggcccctct

SEQ ID NO: 2488001 - DNA, 15 bp, Homo sapiens
ctcatggcccctctg

SEQ ID NO: 2488002 - DNA, 17 bp, Homo sapiens
ctcatggcccctctgac

SEQ ID NO: 2488003 - DNA, 19 bp, Homo sapiens
ctcatggcccctctgacct

SEQ ID NO: 2488004 - DNA, 14 bp, Homo sapiens
ctcatgggtggcac

SEQ ID NO: 2488005 - DNA, 19 bp, Homo sapiens
ctcatgggtggcactcagt

SEQ ID NO: 2488006 - DNA, 16 bp, Homo sapiens
ctcatgtacataccct

SEQ ID NO: 2488007 - DNA, 14 bp, Homo sapiens
ctcatgtggctgga

SEQ ID NO: 2488008 - DNA, 17 bp, Homo sapiens
ctcattaaaagaatatc

SEQ ID NO: 2488009 - DNA, 19 bp, Homo sapiens
ctcattctgaaggagcccc

SEQ ID NO: 2488010 - DNA, 19 bp, Homo sapiens
ctcattgcttacaagccta

SEQ ID NO: 2488011 - DNA, 16 bp, Homo sapiens
ctcattggaaatttag

SEQ ID NO: 2488012 - DNA, 22 bp, Homo sapiens
ctcattggaaatttagcattgt

SEQ ID NO: 2488013 - DNA, 14 bp, Homo sapiens
ctcatttagcctgt

SEQ ID NO: 2488014 - DNA, 22 bp, Homo sapiens
ctccaaactgaagcagcctctc

SEQ ID NO: 2488015 - DNA, 23 bp, Homo sapiens
ctccaaactgaagcagcctctcc

SEQ ID NO: 2488016 - DNA, 19 bp, Homo sapiens
ctccaaagtcataattgca

SEQ ID NO: 2488017 - DNA, 23 bp, Homo sapiens
ctccaaagtcataattgcattga

SEQ ID NO: 2488018 - DNA, 16 bp, Homo sapiens
ctccaacaccaagcac

SEQ ID NO: 2488019 - DNA, 19 bp, Homo sapiens
ctccaacatcacagcccag

SEQ ID NO: 2488020 - DNA, 18 bp, Homo sapiens
ctccaaccaaataagact

SEQ ID NO: 2488021 - DNA, 22 bp, Homo sapiens
ctccaaccaaataagacttcca

SEQ ID NO: 2488022 - DNA, 20 bp, Homo sapiens
ctccaacccaacctcatcct

SEQ ID NO: 2488023 - DNA, 13 bp, Homo sapiens
ctccaagattcta

SEQ ID NO: 2488024 - DNA, 16 bp, Homo sapiens
ctccaagattctagat

SEQ ID NO: 2488025 - DNA, 16 bp, Homo sapiens
ctccaagcagcttaga

SEQ ID NO: 2488026 - DNA, 17 bp, Homo sapiens
ctccaagcccagcccat

SEQ ID NO: 2488027 - DNA, 22 bp, Homo sapiens
ctccaagcccagcccatggaga

SEQ ID NO: 2488028 - DNA, 18 bp, Homo sapiens
ctccaagccccatcttct

SEQ ID NO: 2488029 - DNA, 12 bp, Homo sapiens
ctccacacctgc

SEQ ID NO: 2488030 - DNA, 13 bp, Homo sapiens
ctccacatcctcc

SEQ ID NO: 2488031 - DNA, 15 bp, Homo sapiens
ctccacatcctccac

SEQ ID NO: 2488032 - DNA, 15 bp, Homo sapiens
ctccacgttctgctc

SEQ ID NO: 2488033 - DNA, 12 bp, Homo sapiens
ctccactctgct

SEQ ID NO: 2488034 - DNA, 17 bp, Homo sapiens
ctccactctgcttctct

SEQ ID NO: 2488035 - DNA, 13 bp, Homo sapiens
ctccagagggcac

SEQ ID NO: 2488036 - DNA, 18 bp, Homo sapiens
ctccagatgcagggcagt

SEQ ID NO: 2488037 - DNA, 18 bp, Homo sapiens
ctccagcccctcttggag

SEQ ID NO: 2488038 - DNA, 21 bp, Homo sapiens
ctccagcccctcttggagaag

SEQ ID NO: 2488039 - DNA, 22 bp, Homo sapiens
ctccagcccctcttggagaagt

SEQ ID NO: 2488040 - DNA, 13 bp, Homo sapiens
ctccagcctgaca

SEQ ID NO: 2488041 - DNA, 18 bp, Homo sapiens
ctatttgtaaatctgcca

SEQ ID NO: 2488042 - DNA, 16 bp, Homo sapiens
ctattttattatgaag

SEQ ID NO: 2488043 - DNA, 22 bp, Homo sapiens
cggaggttgggtgggccggctt

SEQ ID NO: 2488044 - DNA, 23 bp, Homo sapiens
cggagtcgtggggtgtgctggga

SEQ ID NO: 2488045 - DNA, 23 bp, Homo sapiens
cggagtgcggaccaccctcactg

SEQ ID NO: 2488046 - DNA, 13 bp, Homo sapiens
cggatccagggag

SEQ ID NO: 2488047 - DNA, 19 bp, Homo sapiens
cggatcctaagcatctaag

SEQ ID NO: 2488048 - DNA, 23 bp, Homo sapiens
ccttcattctgcaagtatactag

SEQ ID NO: 2488049 - DNA, 19 bp, Homo sapiens
ccttccaatgtctggagac

SEQ ID NO: 2488050 - DNA, 13 bp, Homo sapiens
ccttccacccagg

SEQ ID NO: 2488051 - DNA, 15 bp, Homo sapiens
ccttccactgagggc

SEQ ID NO: 2488052 - DNA, 17 bp, Homo sapiens
ccttccactgagggcag

SEQ ID NO: 2488053 - DNA, 14 bp, Homo sapiens
ccttccagaaaaca

SEQ ID NO: 2488054 - DNA, 13 bp, Homo sapiens
ccttccagctcct

SEQ ID NO: 2488055 - DNA, 20 bp, Homo sapiens
ccttcccagaggggcctgcc

SEQ ID NO: 2488056 - DNA, 16 bp, Homo sapiens
ccttcccctccttctc

SEQ ID NO: 2488057 - DNA, 13 bp, Homo sapiens
ccttccctccaag

SEQ ID NO: 2488058 - DNA, 18 bp, Homo sapiens
ccttcccttttctgttct

SEQ ID NO: 2488059 - DNA, 22 bp, Homo sapiens
ccttcccttttctgttctagtt

SEQ ID NO: 2488060 - DNA, 13 bp, Homo sapiens
ccttccgccactg

SEQ ID NO: 2488061 - DNA, 14 bp, Homo sapiens
ccttccgccactgg

SEQ ID NO: 2488062 - DNA, 16 bp, Homo sapiens
ccttcctcatccaccc

SEQ ID NO: 2488063 - DNA, 18 bp, Homo sapiens
ccttcctcatccacccca

SEQ ID NO: 2488064 - DNA, 19 bp, Homo sapiens
ccttcctcatccaccccat

SEQ ID NO: 2488065 - DNA, 23 bp, Homo sapiens
ccttcctgccccaactccttcca

SEQ ID NO: 2488066 - DNA, 19 bp, Homo sapiens
ccttcctggacagctgtgc

SEQ ID NO: 2488067 - DNA, 16 bp, Homo sapiens
ccttcgcttcttgcct

SEQ ID NO: 2488068 - DNA, 20 bp, Homo sapiens
ccttcgcttcttgcctctgt

SEQ ID NO: 2488069 - DNA, 16 bp, Homo sapiens
ccttcgtctttcccat

SEQ ID NO: 2488070 - DNA, 11 bp, Homo sapiens
ccttctccatc

SEQ ID NO: 2488071 - DNA, 15 bp, Homo sapiens
ccttctcccactctc

SEQ ID NO: 2488072 - DNA, 17 bp, Homo sapiens
ccttctccccagctccc

SEQ ID NO: 2488073 - DNA, 22 bp, Homo sapiens
ccttctcccctgcactgtaaaa

SEQ ID NO: 2488074 - DNA, 17 bp, Homo sapiens
ccttctgctcagctctg

SEQ ID NO: 2488075 - DNA, 19 bp, Homo sapiens
ccttctttctaccctgctg

SEQ ID NO: 2488076 - DNA, 18 bp, Homo sapiens
ccttgaagaactgcaggc

SEQ ID NO: 2488077 - DNA, 14 bp, Homo sapiens
ccttgacacctgct

SEQ ID NO: 2488078 - DNA, 18 bp, Homo sapiens
ccttgatcagccccaccc

SEQ ID NO: 2488079 - DNA, 21 bp, Homo sapiens
ccttgcccccctggcctcccc

SEQ ID NO: 2488080 - DNA, 15 bp, Homo sapiens
ccttgcctcaatgcc

SEQ ID NO: 2488081 - DNA, 11 bp, Homo sapiens
ccttgcctggt

SEQ ID NO: 2488082 - DNA, 17 bp, Homo sapiens
ccttgcctggtacagta

SEQ ID NO: 2488083 - DNA, 15 bp, Homo sapiens
ccttgcggctcctca

SEQ ID NO: 2488084 - DNA, 18 bp, Homo sapiens
ccttgcggctcctcaggg

SEQ ID NO: 2488085 - DNA, 20 bp, Homo sapiens
ccttgcggctcctcagggac

SEQ ID NO: 2488086 - DNA, 16 bp, Homo sapiens
ccttgcttacctctca

SEQ ID NO: 2488087 - DNA, 13 bp, Homo sapiens
ccttggcctggag

SEQ ID NO: 2488088 - DNA, 20 bp, Homo sapiens
ccttggctgacatgaagctg

SEQ ID NO: 2488089 - DNA, 12 bp, Homo sapiens
ccttgggccctt

SEQ ID NO: 2488090 - DNA, 14 bp, Homo sapiens
ccttgggccctttg

SEQ ID NO: 2488091 - DNA, 12 bp, Homo sapiens
ccttgggctccc

SEQ ID NO: 2488092 - DNA, 13 bp, Homo sapiens
ccttgggctccct

SEQ ID NO: 2488093 - DNA, 15 bp, Homo sapiens
ccttgggctctgatg

SEQ ID NO: 2488094 - DNA, 20 bp, Homo sapiens
ccttgggggtcctcctccag

SEQ ID NO: 2488095 - DNA, 14 bp, Homo sapiens
ccttgtagctcctc

SEQ ID NO: 2488096 - DNA, 17 bp, Homo sapiens
ccttgtagctcctcccc

SEQ ID NO: 2488097 - DNA, 14 bp, Homo sapiens
ccttgtcctttccc

SEQ ID NO: 2488098 - DNA, 23 bp, Homo sapiens
ccttgtgatgtcatacagagaag

SEQ ID NO: 2488099 - DNA, 15 bp, Homo sapiens
ccttgtgggcctggg

SEQ ID NO: 2488100 - DNA, 15 bp, Homo sapiens
ccttgttacttctga

SEQ ID NO: 2488101 - DNA, 16 bp, Homo sapiens
ccttgttacttctgag

SEQ ID NO: 2488102 - DNA, 17 bp, Homo sapiens
ccttgttgtttcttgcc

SEQ ID NO: 2488103 - DNA, 19 bp, Homo sapiens
ccttgtttggggcaggagt

SEQ ID NO: 2488104 - DNA, 16 bp, Homo sapiens
ccttgttttggacagt

SEQ ID NO: 2488105 - DNA, 16 bp, Homo sapiens
cctttaacaacatgtt

SEQ ID NO: 2488106 - DNA, 19 bp, Homo sapiens
cctttaactgacaagccat

SEQ ID NO: 2488107 - DNA, 20 bp, Homo sapiens
cctttaactgacaagccatc

SEQ ID NO: 2488108 - DNA, 16 bp, Homo sapiens
cctttagatctctgaa

SEQ ID NO: 2488109 - DNA, 19 bp, Homo sapiens
cctttatttccactgtgca

SEQ ID NO: 2488110 - DNA, 21 bp, Homo sapiens
cctttatttttggcgtggctg

SEQ ID NO: 2488111 - DNA, 17 bp, Homo sapiens
cctttcaggatctattt

SEQ ID NO: 2488112 - DNA, 20 bp, Homo sapiens
cctttccataaatccttgat

SEQ ID NO: 2488113 - DNA, 11 bp, Homo sapiens
cctttcccacc

SEQ ID NO: 2488114 - DNA, 20 bp, Homo sapiens
cctttcccttgtagctcctc

SEQ ID NO: 2488115 - DNA, 19 bp, Homo sapiens
cctttctagagcactgcca

SEQ ID NO: 2488116 - DNA, 23 bp, Homo sapiens
cctttctggattattctgggggc

SEQ ID NO: 2488117 - DNA, 11 bp, Homo sapiens
cctttcttccg

SEQ ID NO: 2488118 - DNA, 19 bp, Homo sapiens
cctttcttttccccctttg

SEQ ID NO: 2488119 - DNA, 22 bp, Homo sapiens
cctttgctgtgaggctgtcctg

SEQ ID NO: 2488120 - DNA, 23 bp, Homo sapiens
cctttgctgtgaggctgtcctgt

SEQ ID NO: 2488121 - DNA, 22 bp, Homo sapiens
cctttgggcttcagctgccagt

SEQ ID NO: 2488122 - DNA, 13 bp, Homo sapiens
cctttgtgagtca

SEQ ID NO: 2488123 - DNA, 20 bp, Homo sapiens
cctttgttccccactggagc

SEQ ID NO: 2488124 - DNA, 23 bp, Homo sapiens
cctttgttggagtcaaaaagaac

SEQ ID NO: 2488125 - DNA, 19 bp, Homo sapiens
ccttttatcccaaagttgt

SEQ ID NO: 2488126 - DNA, 22 bp, Homo sapiens
ccttttatgtagtaattgacat

SEQ ID NO: 2488127 - DNA, 13 bp, Homo sapiens
ccttttctgacca

SEQ ID NO: 2488128 - DNA, 18 bp, Homo sapiens
ccttttctgaccaaagag

SEQ ID NO: 2488129 - DNA, 13 bp, Homo sapiens
ccttttgacactg

SEQ ID NO: 2488130 - DNA, 16 bp, Homo sapiens
ccttttgaggagcccc

SEQ ID NO: 2488131 - DNA, 21 bp, Homo sapiens
ccttttgaggagccccagcta

SEQ ID NO: 2488132 - DNA, 23 bp, Homo sapiens
ccttttgaggagccccagctacc

SEQ ID NO: 2488133 - DNA, 21 bp, Homo sapiens
ccttttgggtttctgccctgc

SEQ ID NO: 2488134 - DNA, 14 bp, Homo sapiens
cctttttctccagc

SEQ ID NO: 2488135 - DNA, 14 bp, Homo sapiens
ccttttttccccag

SEQ ID NO: 2488136 - DNA, 12 bp, Homo sapiens
ccttttttgatc

SEQ ID NO: 2488137 - DNA, 13 bp, Homo sapiens
ccttttttgatca

SEQ ID NO: 2488138 - DNA, 18 bp, Homo sapiens
cctttttttccatcttta

SEQ ID NO: 2488139 - DNA, 13 bp, Homo sapiens
cgaaaatcaaatg

SEQ ID NO: 2488140 - DNA, 13 bp, Homo sapiens
cgaaatgttattt

SEQ ID NO: 2488141 - DNA, 22 bp, Homo sapiens
cgaaatgttattttttaattat

SEQ ID NO: 2488142 - DNA, 18 bp, Homo sapiens
cgaagcccagagggtctg

SEQ ID NO: 2488143 - DNA, 19 bp, Homo sapiens
cctggggcctgtactgcct

SEQ ID NO: 2488144 - DNA, 21 bp, Homo sapiens
cctggggctctaacgcctgag

SEQ ID NO: 2488145 - DNA, 15 bp, Homo sapiens
cctggggctggcctc

SEQ ID NO: 2488146 - DNA, 16 bp, Homo sapiens
cctggggctggcctcc

SEQ ID NO: 2488147 - DNA, 17 bp, Homo sapiens
cctggggctggcctccc

SEQ ID NO: 2488148 - DNA, 19 bp, Homo sapiens
cctggggctggcctcccaa

SEQ ID NO: 2488149 - DNA, 13 bp, Homo sapiens
cctgggggcctgg

SEQ ID NO: 2488150 - DNA, 15 bp, Homo sapiens
cctgggggtgccagg

SEQ ID NO: 2488151 - DNA, 15 bp, Homo sapiens
cctgggtcccaggac

SEQ ID NO: 2488152 - DNA, 15 bp, Homo sapiens
cctgggtgacatttg

SEQ ID NO: 2488153 - DNA, 20 bp, Homo sapiens
cctggtactccctctcagga

SEQ ID NO: 2488154 - DNA, 18 bp, Homo sapiens
cctggtagaccactgcca

SEQ ID NO: 2488155 - DNA, 17 bp, Homo sapiens
cctggtcacctaggaag

SEQ ID NO: 2488156 - DNA, 13 bp, Homo sapiens
cctggtcccctcc

SEQ ID NO: 2488157 - DNA, 13 bp, Homo sapiens
cctggtctcaccc

SEQ ID NO: 2488158 - DNA, 23 bp, Homo sapiens
cctggtgacatcaggtttttccc

SEQ ID NO: 2488159 - DNA, 13 bp, Homo sapiens
cctggtgccacct

SEQ ID NO: 2488160 - DNA, 15 bp, Homo sapiens
cctggtgctgcctct

SEQ ID NO: 2488161 - DNA, 14 bp, Homo sapiens
cctggtgctggagg

SEQ ID NO: 2488162 - DNA, 14 bp, Homo sapiens
cctggtgcttctcc

SEQ ID NO: 2488163 - DNA, 16 bp, Homo sapiens
cctggtggccctctcc

SEQ ID NO: 2488164 - DNA, 22 bp, Homo sapiens
cctggtggccctctcccctgcc

SEQ ID NO: 2488165 - DNA, 23 bp, Homo sapiens
cctggtggccctctcccctgccc

SEQ ID NO: 2488166 - DNA, 14 bp, Homo sapiens
cctggtgggccaac

SEQ ID NO: 2488167 - DNA, 18 bp, Homo sapiens
cctggtggggcagctcct

SEQ ID NO: 2488168 - DNA, 19 bp, Homo sapiens
cctggtggggcagctcctc

SEQ ID NO: 2488169 - DNA, 23 bp, Homo sapiens
cctggtggggcagctcctctgtc

SEQ ID NO: 2488170 - DNA, 18 bp, Homo sapiens
cctggtggtattttcaat

SEQ ID NO: 2488171 - DNA, 13 bp, Homo sapiens
cctggttcccgtt

SEQ ID NO: 2488172 - DNA, 22 bp, Homo sapiens
cctggttcccgtttctccacct

SEQ ID NO: 2488173 - DNA, 19 bp, Homo sapiens
cctgtaaactttatcactt

SEQ ID NO: 2488174 - DNA, 20 bp, Homo sapiens
cctgtaatcatataataaat

SEQ ID NO: 2488175 - DNA, 23 bp, Homo sapiens
cctgtaccttttgaggagcccca

SEQ ID NO: 2488176 - DNA, 14 bp, Homo sapiens
cctgtactgcctgc

SEQ ID NO: 2488177 - DNA, 23 bp, Homo sapiens
cctgtagaactcaacctctacag

SEQ ID NO: 2488178 - DNA, 17 bp, Homo sapiens
cctgtagcacttactgg

SEQ ID NO: 2488179 - DNA, 14 bp, Homo sapiens
cctgtatacctcct

SEQ ID NO: 2488180 - DNA, 19 bp, Homo sapiens
cctgtattcctgacctccg

SEQ ID NO: 2488181 - DNA, 19 bp, Homo sapiens
cctgtatttgttcccaaga

SEQ ID NO: 2488182 - DNA, 21 bp, Homo sapiens
cctgtatttgttcccaagagc

SEQ ID NO: 2488183 - DNA, 22 bp, Homo sapiens
cctgtatttgttcccaagagca

SEQ ID NO: 2488184 - DNA, 14 bp, Homo sapiens
cctgtccacaggct

SEQ ID NO: 2488185 - DNA, 13 bp, Homo sapiens
cctgtccagctcc

SEQ ID NO: 2488186 - DNA, 9 bp, Homo sapiens
cctgtcctc

SEQ ID NO: 2488187 - DNA, 13 bp, Homo sapiens
cctgtcctccaac

SEQ ID NO: 2488188 - DNA, 22 bp, Homo sapiens
cctgtcctccaacaccaagcac

SEQ ID NO: 2488189 - DNA, 15 bp, Homo sapiens
cctgtcctggtggta

SEQ ID NO: 2488190 - DNA, 19 bp, Homo sapiens
cctgtccttagcctaggcc

SEQ ID NO: 2488191 - DNA, 21 bp, Homo sapiens
cctgtcctttaccaaagatga

SEQ ID NO: 2488192 - DNA, 14 bp, Homo sapiens
cctgtctcagcctc

SEQ ID NO: 2488193 - DNA, 15 bp, Homo sapiens
cctgtctcagcctcc

SEQ ID NO: 2488194 - DNA, 17 bp, Homo sapiens
cctgtcttatcctccac

SEQ ID NO: 2488195 - DNA, 18 bp, Homo sapiens
cctgtgaacccaggacaa

SEQ ID NO: 2488196 - DNA, 22 bp, Homo sapiens
cctgtgaatgccactgccttcg

SEQ ID NO: 2488197 - DNA, 21 bp, Homo sapiens
cctgtgcagccgctgagcgag

SEQ ID NO: 2488198 - DNA, 12 bp, Homo sapiens
cctgtgcctcct

SEQ ID NO: 2488199 - DNA, 15 bp, Homo sapiens
cctgtgcctcctccc

SEQ ID NO: 2488200 - DNA, 17 bp, Homo sapiens
cctgtgctcagccctga

SEQ ID NO: 2488201 - DNA, 22 bp, Homo sapiens
cctgtgcttcgggcccttccca

SEQ ID NO: 2488202 - DNA, 23 bp, Homo sapiens
cctgtggccatgaccctgcctct

SEQ ID NO: 2488203 - DNA, 15 bp, Homo sapiens
cctgtggccccaccc

SEQ ID NO: 2488204 - DNA, 16 bp, Homo sapiens
cctgtggccccaccct

SEQ ID NO: 2488205 - DNA, 20 bp, Homo sapiens
cctgtggccccaccctgggc

SEQ ID NO: 2488206 - DNA, 15 bp, Homo sapiens
cctgtgggagcctcg

SEQ ID NO: 2488207 - DNA, 16 bp, Homo sapiens
cctgtgggagcctcgc

SEQ ID NO: 2488208 - DNA, 17 bp, Homo sapiens
cctgtgggagcctcgca

SEQ ID NO: 2488209 - DNA, 19 bp, Homo sapiens
cctgtggttctgagatggc

SEQ ID NO: 2488210 - DNA, 14 bp, Homo sapiens
cctgtgtagctgtg

SEQ ID NO: 2488211 - DNA, 17 bp, Homo sapiens
cctgtgtagctgtgacc

SEQ ID NO: 2488212 - DNA, 19 bp, Homo sapiens
cctgtgtccatgcgctcag

SEQ ID NO: 2488213 - DNA, 13 bp, Homo sapiens
cctgtgtggagag

SEQ ID NO: 2488214 - DNA, 14 bp, Homo sapiens
cctgtgtggagagg

SEQ ID NO: 2488215 - DNA, 19 bp, Homo sapiens
cctgtgtggagagggaatg

SEQ ID NO: 2488216 - DNA, 23 bp, Homo sapiens
cctgtgtggagagggaatgtgaa

SEQ ID NO: 2488217 - DNA, 17 bp, Homo sapiens
cctgtgtgttaagctct

SEQ ID NO: 2488218 - DNA, 20 bp, Homo sapiens
cctgtgtgttaagctctgct

SEQ ID NO: 2488219 - DNA, 19 bp, Homo sapiens
cctgtgttcttcctggccg

SEQ ID NO: 2488220 - DNA, 20 bp, Homo sapiens
cctgtgttcttcctggccgc

SEQ ID NO: 2488221 - DNA, 19 bp, Homo sapiens
cctgtgtttcttgcctcat

SEQ ID NO: 2488222 - DNA, 15 bp, Homo sapiens
cctgttagcagacag

SEQ ID NO: 2488223 - DNA, 16 bp, Homo sapiens
cctgtttaaaaaacca

SEQ ID NO: 2488224 - DNA, 17 bp, Homo sapiens
cctgtttcccaggccca

SEQ ID NO: 2488225 - DNA, 13 bp, Homo sapiens
cctgttttccccc

SEQ ID NO: 2488226 - DNA, 16 bp, Homo sapiens
ccttaacagttgtatt

SEQ ID NO: 2488227 - DNA, 14 bp, Homo sapiens
ccttactcctgtgg

SEQ ID NO: 2488228 - DNA, 20 bp, Homo sapiens
ccttactcctgtgggagcct

SEQ ID NO: 2488229 - DNA, 15 bp, Homo sapiens
ccttactttttatat

SEQ ID NO: 2488230 - DNA, 17 bp, Homo sapiens
ccttactttttatatat

SEQ ID NO: 2488231 - DNA, 18 bp, Homo sapiens
ccttactttttatatata

SEQ ID NO: 2488232 - DNA, 22 bp, Homo sapiens
ccttagacagaggccctcaagt

SEQ ID NO: 2488233 - DNA, 21 bp, Homo sapiens
ccttagcctggacctctgaca

SEQ ID NO: 2488234 - DNA, 14 bp, Homo sapiens
ccttatagttactg

SEQ ID NO: 2488235 - DNA, 21 bp, Homo sapiens
ctgtcagatccaggagctcca

SEQ ID NO: 2488236 - DNA, 16 bp, Homo sapiens
ctgtcagcatgaattt

SEQ ID NO: 2488237 - DNA, 12 bp, Homo sapiens
ctgtcagctgca

SEQ ID NO: 2488238 - DNA, 15 bp, Homo sapiens
ctgtcaggattgcga

SEQ ID NO: 2488239 - DNA, 17 bp, Homo sapiens
ctgtcaggattgcgaga

SEQ ID NO: 2488240 - DNA, 14 bp, Homo sapiens
ctgtcatctgtgca

SEQ ID NO: 2488241 - DNA, 13 bp, Homo sapiens
ctgtccagctcca

SEQ ID NO: 2488242 - DNA, 14 bp, Homo sapiens
ctgtccagctccaa

SEQ ID NO: 2488243 - DNA, 16 bp, Homo sapiens
ctgtccaggcactgag

SEQ ID NO: 2488244 - DNA, 14 bp, Homo sapiens
ctgtcccaccccca

SEQ ID NO: 2488245 - DNA, 12 bp, Homo sapiens
ctgtccccagcc

SEQ ID NO: 2488246 - DNA, 16 bp, Homo sapiens
ctgtccccagcctggg

SEQ ID NO: 2488247 - DNA, 21 bp, Homo sapiens
ctgtccccccactccctcaca

SEQ ID NO: 2488248 - DNA, 22 bp, Homo sapiens
ctgtcccttgcccccctggcct

SEQ ID NO: 2488249 - DNA, 18 bp, Homo sapiens
ctgtcctcagccttgcca

SEQ ID NO: 2488250 - DNA, 21 bp, Homo sapiens
ctgtcctcccgagctcctctt

SEQ ID NO: 2488251 - DNA, 17 bp, Homo sapiens
ctgtcctctttcagctc

SEQ ID NO: 2488252 - DNA, 20 bp, Homo sapiens
ctgtcctctttcagctcctg

SEQ ID NO: 2488253 - DNA, 15 bp, Homo sapiens
ctgtcctgaaggcct

SEQ ID NO: 2488254 - DNA, 20 bp, Homo sapiens
ctgtcctgaaggcctgaggt

SEQ ID NO: 2488255 - DNA, 13 bp, Homo sapiens
ctgtcctgcctgt

SEQ ID NO: 2488256 - DNA, 17 bp, Homo sapiens
ctgtcctggtggtattt

SEQ ID NO: 2488257 - DNA, 21 bp, Homo sapiens
ctgtcctggtggtattttcaa

SEQ ID NO: 2488258 - DNA, 14 bp, Homo sapiens
ctgtcctgtacatt

SEQ ID NO: 2488259 - DNA, 22 bp, Homo sapiens
ctgtcctgtacattgtgggatg

SEQ ID NO: 2488260 - DNA, 23 bp, Homo sapiens
ctgtcctgtcatcatcatggcca

SEQ ID NO: 2488261 - DNA, 20 bp, Homo sapiens
ctgtccttgaaggactaata

SEQ ID NO: 2488262 - DNA, 20 bp, Homo sapiens
ctgtcctttctagagcactg

SEQ ID NO: 2488263 - DNA, 21 bp, Homo sapiens
ctgtcctttctagagcactgc

SEQ ID NO: 2488264 - DNA, 18 bp, Homo sapiens
ctgtcctttttcctctcc

SEQ ID NO: 2488265 - DNA, 15 bp, Homo sapiens
ctgtcgctctcagtt

SEQ ID NO: 2488266 - DNA, 14 bp, Homo sapiens
ctgtcgctgcttcg

SEQ ID NO: 2488267 - DNA, 20 bp, Homo sapiens
ctgtctacttgctcaggtac

SEQ ID NO: 2488268 - DNA, 20 bp, Homo sapiens
ctgtctccatggccctgcaa

SEQ ID NO: 2488269 - DNA, 13 bp, Homo sapiens
ctgtctcctagga

SEQ ID NO: 2488270 - DNA, 16 bp, Homo sapiens
ctgtctcgagcgccct

SEQ ID NO: 2488271 - DNA, 18 bp, Homo sapiens
ctgtctcgagcgccctgc

SEQ ID NO: 2488272 - DNA, 19 bp, Homo sapiens
ctgtctctcagggccaggc

SEQ ID NO: 2488273 - DNA, 15 bp, Homo sapiens
ctgtctcttttctct

SEQ ID NO: 2488274 - DNA, 20 bp, Homo sapiens
ctgtctgacaacctcttggt

SEQ ID NO: 2488275 - DNA, 20 bp, Homo sapiens
ctgtctgccaacctaaaact

SEQ ID NO: 2488276 - DNA, 14 bp, Homo sapiens
ctgtctgccccgcc

SEQ ID NO: 2488277 - DNA, 17 bp, Homo sapiens
ctgtctgggtgctactg

SEQ ID NO: 2488278 - DNA, 23 bp, Homo sapiens
ctgtctgggtgctactggggaaa

SEQ ID NO: 2488279 - DNA, 15 bp, Homo sapiens
ctgtctggtggcccc

SEQ ID NO: 2488280 - DNA, 19 bp, Homo sapiens
ctgtctgttgtattcattg

SEQ ID NO: 2488281 - DNA, 21 bp, Homo sapiens
ctgtcttaaactaaatgtgca

SEQ ID NO: 2488282 - DNA, 16 bp, Homo sapiens
ctgtctttaattctgt

SEQ ID NO: 2488283 - DNA, 16 bp, Homo sapiens
ctgtgaatgccactgc

SEQ ID NO: 2488284 - DNA, 16 bp, Homo sapiens
ctgtgaccaatgtctt

SEQ ID NO: 2488285 - DNA, 14 bp, Homo sapiens
ctgtgaccacaaca

SEQ ID NO: 2488286 - DNA, 17 bp, Homo sapiens
ctgtgaccacaacatga

SEQ ID NO: 2488287 - DNA, 13 bp, Homo sapiens
ctgtgacccccag

SEQ ID NO: 2488288 - DNA, 17 bp, Homo sapiens
ctgtgacctgctgagct

SEQ ID NO: 2488289 - DNA, 18 bp, Homo sapiens
ctgtgacctgctgagctc

SEQ ID NO: 2488290 - DNA, 23 bp, Homo sapiens
ctgtgacctgctgagctctgaga

SEQ ID NO: 2488291 - DNA, 20 bp, Homo sapiens
ctgtgagtctttggttctaa

SEQ ID NO: 2488292 - DNA, 21 bp, Homo sapiens
ctgtgagtctttggttctaag

SEQ ID NO: 2488293 - DNA, 23 bp, Homo sapiens
ctgtgagtctttggttctaagga

SEQ ID NO: 2488294 - DNA, 16 bp, Homo sapiens
ctgtgagttctccctg

SEQ ID NO: 2488295 - DNA, 16 bp, Homo sapiens
ctgtgattcagaaaat

SEQ ID NO: 2488296 - DNA, 22 bp, Homo sapiens
ctgtgcacaaaacccagacctg

SEQ ID NO: 2488297 - DNA, 20 bp, Homo sapiens
ctgtgcacatctgtgtcttg

SEQ ID NO: 2488298 - DNA, 21 bp, Homo sapiens
ctgtgcacatctgtgtcttgt

SEQ ID NO: 2488299 - DNA, 21 bp, Homo sapiens
ctgtgcagccgctgagcgagg

SEQ ID NO: 2488300 - DNA, 17 bp, Homo sapiens
ctgtgcaggttcccact

SEQ ID NO: 2488301 - DNA, 15 bp, Homo sapiens
ctgtgcagtcctggg

SEQ ID NO: 2488302 - DNA, 18 bp, Homo sapiens
ctgtgcagtcctgggtcc

SEQ ID NO: 2488303 - DNA, 14 bp, Homo sapiens
ctgtgccagagcct

SEQ ID NO: 2488304 - DNA, 17 bp, Homo sapiens
ctgtgccagagcctggg

SEQ ID NO: 2488305 - DNA, 18 bp, Homo sapiens
ctgtgccagagcctgggg

SEQ ID NO: 2488306 - DNA, 19 bp, Homo sapiens
ctgtgccagagcctggggc

SEQ ID NO: 2488307 - DNA, 20 bp, Homo sapiens
ctgtgccagagcctggggct

SEQ ID NO: 2488308 - DNA, 23 bp, Homo sapiens
ctgtgccaggcgaggcccttggc

SEQ ID NO: 2488309 - DNA, 23 bp, Homo sapiens
ctgtgcccccagggtcctgggag

SEQ ID NO: 2488310 - DNA, 20 bp, Homo sapiens
ctgtgccccttgacaactgg

SEQ ID NO: 2488311 - DNA, 18 bp, Homo sapiens
ctgtgcctcagagaccag

SEQ ID NO: 2488312 - DNA, 15 bp, Homo sapiens
ctgtgcctcctccct

SEQ ID NO: 2488313 - DNA, 16 bp, Homo sapiens
ctgtgcctcctccctc

SEQ ID NO: 2488314 - DNA, 17 bp, Homo sapiens
ctgtgcctcctccctcc

SEQ ID NO: 2488315 - DNA, 15 bp, Homo sapiens
ctgtgctcagccctg

SEQ ID NO: 2488316 - DNA, 13 bp, Homo sapiens
ctgtgctggccag

SEQ ID NO: 2488317 - DNA, 14 bp, Homo sapiens
ctgtgctggccagc

SEQ ID NO: 2488318 - DNA, 17 bp, Homo sapiens
ctgtgcttcgggccctt

SEQ ID NO: 2488319 - DNA, 17 bp, Homo sapiens
ctgtggcagagttacag

SEQ ID NO: 2488320 - DNA, 18 bp, Homo sapiens
ctgtggcaggccagctgt

SEQ ID NO: 2488321 - DNA, 14 bp, Homo sapiens
ctgtggccaggagg

SEQ ID NO: 2488322 - DNA, 17 bp, Homo sapiens
ctgtggcgccgtctcca

SEQ ID NO: 2488323 - DNA, 19 bp, Homo sapiens
ctgtggcgccgtctccagg

SEQ ID NO: 2488324 - DNA, 21 bp, Homo sapiens
ctgtgggagcctcgcaacccg

SEQ ID NO: 2488325 - DNA, 24 bp, Homo sapiens
ctgtgggggtgagggtcccatgtg

SEQ ID NO: 2488326 - DNA, 22 bp, Homo sapiens
ctgtgggtctgggagtcacaca

SEQ ID NO: 2488327 - DNA, 22 bp, Homo sapiens
ctgtggttctgagatggctccc

SEQ ID NO: 2488328 - DNA, 15 bp, Homo sapiens
ctgtggtttcatgtt

SEQ ID NO: 2488329 - DNA, 18 bp, Homo sapiens
ctgtggtttcatgttagt

SEQ ID NO: 2488330 - DNA, 22 bp, Homo sapiens
ctgtgtagctgtgacctgctga

SEQ ID NO: 2488331 - DNA, 23 bp, Homo sapiens
ctgtgtagctgtgacctgctgag

SEQ ID NO: 2488332 - DNA, 19 bp, Homo sapiens
ctgtgtccatgcgctcagg

SEQ ID NO: 2488333 - DNA, 13 bp, Homo sapiens
ctgtgtctaagat

SEQ ID NO: 2488334 - DNA, 16 bp, Homo sapiens
ctgtgtctaagattct

SEQ ID NO: 2488335 - DNA, 18 bp, Homo sapiens
ctgtgtctaagattctag

SEQ ID NO: 2488336 - DNA, 20 bp, Homo sapiens
ctgtgtctaagattctagat

SEQ ID NO: 2488337 - DNA, 21 bp, Homo sapiens
ctgtgtctaagattctagatc

SEQ ID NO: 2488338 - DNA, 20 bp, Homo sapiens
ctgtgtgaaactttcattcc

SEQ ID NO: 2488339 - DNA, 15 bp, Homo sapiens
ctgggtacttcttga

SEQ ID NO: 2488340 - DNA, 17 bp, Homo sapiens
ctgggtcctcctttctg

SEQ ID NO: 2488341 - DNA, 24 bp, Homo sapiens
ctgggtcctcctttctgagggccc

SEQ ID NO: 2488342 - DNA, 23 bp, Homo sapiens
ctgggtctcaccggctctcacct

SEQ ID NO: 2488343 - DNA, 18 bp, Homo sapiens
ctgggtgctactggggaa

SEQ ID NO: 2488344 - DNA, 15 bp, Homo sapiens
ctgggtggctactct

SEQ ID NO: 2488345 - DNA, 19 bp, Homo sapiens
ctgggtggctactctgtgc

SEQ ID NO: 2488346 - DNA, 21 bp, Homo sapiens
ctgggtggctactctgtgcca

SEQ ID NO: 2488347 - DNA, 15 bp, Homo sapiens
ctgggtggctcactc

SEQ ID NO: 2488348 - DNA, 17 bp, Homo sapiens
ctgggtggctcactcag

SEQ ID NO: 2488349 - DNA, 15 bp, Homo sapiens
ctgggtggggcccag

SEQ ID NO: 2488350 - DNA, 20 bp, Homo sapiens
ctgggtggggcccaggcccg

SEQ ID NO: 2488351 - DNA, 19 bp, Homo sapiens
ctgggtggtaccctctgga

SEQ ID NO: 2488352 - DNA, 15 bp, Homo sapiens
ctgggttgcagacag

SEQ ID NO: 2488353 - DNA, 18 bp, Homo sapiens
ctgggttgcagacaggaa

SEQ ID NO: 2488354 - DNA, 15 bp, Homo sapiens
ctggtaatattgact

SEQ ID NO: 2488355 - DNA, 19 bp, Homo sapiens
ctggtaatattgacttgta

SEQ ID NO: 2488356 - DNA, 18 bp, Homo sapiens
ctggtactccctctcagg

SEQ ID NO: 2488357 - DNA, 21 bp, Homo sapiens
ctggtactccctctcaggatc

SEQ ID NO: 2488358 - DNA, 18 bp, Homo sapiens
ctggtaggaccaagcatc

SEQ ID NO: 2488359 - DNA, 19 bp, Homo sapiens
ctggtcaacttgagcatgt

SEQ ID NO: 2488360 - DNA, 14 bp, Homo sapiens
ctggtcacctagga

SEQ ID NO: 2488361 - DNA, 18 bp, Homo sapiens
ctggtcacggatttgtgt

SEQ ID NO: 2488362 - DNA, 14 bp, Homo sapiens
ctggtcccctcctt

SEQ ID NO: 2488363 - DNA, 9 bp, Homo sapiens
ctggtccct

SEQ ID NO: 2488364 - DNA, 21 bp, Homo sapiens
ctggtccgtgggacggtgccc

SEQ ID NO: 2488365 - DNA, 15 bp, Homo sapiens
ctggtcgctcctgcc

SEQ ID NO: 2488366 - DNA, 18 bp, Homo sapiens
ctggtcgctcctgcccac

SEQ ID NO: 2488367 - DNA, 16 bp, Homo sapiens
ctggtctcaccctgga

SEQ ID NO: 2488368 - DNA, 23 bp, Homo sapiens
ctggtctctctatgcctctctac

SEQ ID NO: 2488369 - DNA, 14 bp, Homo sapiens
ctggtctgtaggga

SEQ ID NO: 2488370 - DNA, 24 bp, Homo sapiens
ctggtgagtcaccacttcagggct

SEQ ID NO: 2488371 - DNA, 21 bp, Homo sapiens
ctggtgatcacgtggtcacgg

SEQ ID NO: 2488372 - DNA, 23 bp, Homo sapiens
ctggtgcaagttgaggacttctt

SEQ ID NO: 2488373 - DNA, 12 bp, Homo sapiens
ctggtgccacct

SEQ ID NO: 2488374 - DNA, 15 bp, Homo sapiens
ctggtgcctccagag

SEQ ID NO: 2488375 - DNA, 19 bp, Homo sapiens
ctggtgcggctggccatgg

SEQ ID NO: 2488376 - DNA, 21 bp, Homo sapiens
ctggtgcggctggccatggag

SEQ ID NO: 2488377 - DNA, 14 bp, Homo sapiens
ctggtggcacagga

SEQ ID NO: 2488378 - DNA, 20 bp, Homo sapiens
ctggtggccccgtttctggt

SEQ ID NO: 2488379 - DNA, 21 bp, Homo sapiens
ctggtggccccgtttctggtg

SEQ ID NO: 2488380 - DNA, 13 bp, Homo sapiens
ctggtgggccaac

SEQ ID NO: 2488381 - DNA, 19 bp, Homo sapiens
ctggtgggctggccgctgt

SEQ ID NO: 2488382 - DNA, 21 bp, Homo sapiens
ctggtggggataggccagccg

SEQ ID NO: 2488383 - DNA, 15 bp, Homo sapiens
ctggtggggcagctc

SEQ ID NO: 2488384 - DNA, 17 bp, Homo sapiens
ctggtggggcagctcct

SEQ ID NO: 2488385 - DNA, 18 bp, Homo sapiens
ctggtgggtgcctaggcc

SEQ ID NO: 2488386 - DNA, 18 bp, Homo sapiens
ctggtggtctgttggcag

SEQ ID NO: 2488387 - DNA, 17 bp, Homo sapiens
ctggtgtagctacagag

SEQ ID NO: 2488388 - DNA, 20 bp, Homo sapiens
ctggtgtagctacagagaaa

SEQ ID NO: 2488389 - DNA, 23 bp, Homo sapiens
ctggtgtagctacagagaaacca

SEQ ID NO: 2488390 - DNA, 18 bp, Homo sapiens
ctggtgtggtacagagaa

SEQ ID NO: 2488391 - DNA, 19 bp, Homo sapiens
ctggtgtggtacagagaag

SEQ ID NO: 2488392 - DNA, 21 bp, Homo sapiens
ctggtgtggtacagagaagcc

SEQ ID NO: 2488393 - DNA, 22 bp, Homo sapiens
ctggtgttaacagaagggaggg

SEQ ID NO: 2488394 - DNA, 19 bp, Homo sapiens
ctggttaaataaggcaggg

SEQ ID NO: 2488395 - DNA, 18 bp, Homo sapiens
ctggttcccgtttctcca

SEQ ID NO: 2488396 - DNA, 17 bp, Homo sapiens
ctggttctcaattccaa

SEQ ID NO: 2488397 - DNA, 19 bp, Homo sapiens
ctgtaaactttatcactta

SEQ ID NO: 2488398 - DNA, 16 bp, Homo sapiens
ctgtaaagatgtttat

SEQ ID NO: 2488399 - DNA, 14 bp, Homo sapiens
ctgtaaatctacac

SEQ ID NO: 2488400 - DNA, 15 bp, Homo sapiens
ctgtaacattcagga

SEQ ID NO: 2488401 - DNA, 15 bp, Homo sapiens
ctgtaacctcttcag

SEQ ID NO: 2488402 - DNA, 22 bp, Homo sapiens
ctgtaacctcttcagaggccct

SEQ ID NO: 2488403 - DNA, 16 bp, Homo sapiens
ctgtaactactttata

SEQ ID NO: 2488404 - DNA, 15 bp, Homo sapiens
ctgtaactgccaggc

SEQ ID NO: 2488405 - DNA, 22 bp, Homo sapiens
ctgtaacttgatccatttctaa

SEQ ID NO: 2488406 - DNA, 14 bp, Homo sapiens
ctgtaaggctctag

SEQ ID NO: 2488407 - DNA, 16 bp, Homo sapiens
ctgtaaggctctagat

SEQ ID NO: 2488408 - DNA, 22 bp, Homo sapiens
ctgtaagttgggcttgctattc

SEQ ID NO: 2488409 - DNA, 22 bp, Homo sapiens
ctgtaatgtgcgagggacccag

SEQ ID NO: 2488410 - DNA, 14 bp, Homo sapiens
ctgtaatgttaata

SEQ ID NO: 2488411 - DNA, 12 bp, Homo sapiens
ctgtaattgtgt

SEQ ID NO: 2488412 - DNA, 16 bp, Homo sapiens
ctgtacacaactcact

SEQ ID NO: 2488413 - DNA, 20 bp, Homo sapiens
ctgtacacaactcactcctt

SEQ ID NO: 2488414 - DNA, 17 bp, Homo sapiens
ctgtacagctggctcta

SEQ ID NO: 2488415 - DNA, 13 bp, Homo sapiens
ctgtacccagttt

SEQ ID NO: 2488416 - DNA, 14 bp, Homo sapiens
ctgtacctgagagg

SEQ ID NO: 2488417 - DNA, 18 bp, Homo sapiens
ctgtagaactcaacctct

SEQ ID NO: 2488418 - DNA, 16 bp, Homo sapiens
ctgtagagttgctgag

SEQ ID NO: 2488419 - DNA, 23 bp, Homo sapiens
ctgtagagttgctgagagggctc

SEQ ID NO: 2488420 - DNA, 22 bp, Homo sapiens
ctgtaggcctcaggtgaaactc

SEQ ID NO: 2488421 - DNA, 20 bp, Homo sapiens
ctgtagggagggcggcaggg

SEQ ID NO: 2488422 - DNA, 24 bp, Homo sapiens
ctgtagggtaattagtaacatgtg

SEQ ID NO: 2488423 - DNA, 15 bp, Homo sapiens
ctgtaggttgcacac

SEQ ID NO: 2488424 - DNA, 19 bp, Homo sapiens
ctgtaggttgcacactttg

SEQ ID NO: 2488425 - DNA, 20 bp, Homo sapiens
ctgtaggttgcacactttgg

SEQ ID NO: 2488426 - DNA, 17 bp, Homo sapiens
ctgtagtaaataatgct

SEQ ID NO: 2488427 - DNA, 18 bp, Homo sapiens
ctgtagtaggcattttta

SEQ ID NO: 2488428 - DNA, 20 bp, Homo sapiens
ctgtagtgtcactcaaggcg

SEQ ID NO: 2488429 - DNA, 14 bp, Homo sapiens
ctgtagttctaaga

SEQ ID NO: 2488430 - DNA, 16 bp, Homo sapiens
ctgtagttctaagact

SEQ ID NO: 2488431 - DNA, 14 bp, Homo sapiens
ctgtataaatgtct

SEQ ID NO: 2488432 - DNA, 20 bp, Homo sapiens
ctgtatagctgcttccagtg

SEQ ID NO: 2488433 - DNA, 16 bp, Homo sapiens
ctgtatcaggacccag

SEQ ID NO: 2488434 - DNA, 22 bp, Homo sapiens
ctgtatcaggacccagaggaag

SEQ ID NO: 2488435 - DNA, 16 bp, Homo sapiens
ctgtatgttcaactag

SEQ ID NO: 2488436 - DNA, 15 bp, Homo sapiens
ctgtattcagacaga

SEQ ID NO: 2488437 - DNA, 21 bp, Homo sapiens
ctgtcaattgtacgcgccacc

SEQ ID NO: 2488438 - DNA, 16 bp, Homo sapiens
ctgtcacaaccaagaa

SEQ ID NO: 2488439 - DNA, 16 bp, Homo sapiens
ctgtcaccaccctgct

SEQ ID NO: 2488440 - DNA, 23 bp, Homo sapiens
ctgtcaccaccctgctcatccac

SEQ ID NO: 2488441 - DNA, 18 bp, Homo sapiens
ctgtcagatccaggagct

SEQ ID NO: 2488442 - DNA, 19 bp, Homo sapiens
ctgtcagatccaggagctc

SEQ ID NO: 2488443 - DNA, 13 bp, Homo sapiens
ctggccctgcttc

SEQ ID NO: 2488444 - DNA, 23 bp, Homo sapiens
ctggccctgcttcctgcttgcca

SEQ ID NO: 2488445 - DNA, 21 bp, Homo sapiens
ctggcccttgcttacctctca

SEQ ID NO: 2488446 - DNA, 16 bp, Homo sapiens
ctggccgagtccaagc

SEQ ID NO: 2488447 - DNA, 17 bp, Homo sapiens
ctggccgagtccaagct

SEQ ID NO: 2488448 - DNA, 16 bp, Homo sapiens
ctggcctcccaaatga

SEQ ID NO: 2488449 - DNA, 17 bp, Homo sapiens
ctggcctcccctgccac

SEQ ID NO: 2488450 - DNA, 21 bp, Homo sapiens
ctggcctcccctgccaccagg

SEQ ID NO: 2488451 - DNA, 15 bp, Homo sapiens
ctggcctcctgcctc

SEQ ID NO: 2488452 - DNA, 12 bp, Homo sapiens
ctggcctctgcg

SEQ ID NO: 2488453 - DNA, 13 bp, Homo sapiens
ctggcctggccag

SEQ ID NO: 2488454 - DNA, 22 bp, Homo sapiens
ctggcgacacgtagcagcttag

SEQ ID NO: 2488455 - DNA, 19 bp, Homo sapiens
ctggcggctggggtcccag

SEQ ID NO: 2488456 - DNA, 22 bp, Homo sapiens
ctggcggctggggtcccagcag

SEQ ID NO: 2488457 - DNA, 15 bp, Homo sapiens
ctggcggggggccca

SEQ ID NO: 2488458 - DNA, 21 bp, Homo sapiens
ctggctccagatgcagggcag

SEQ ID NO: 2488459 - DNA, 18 bp, Homo sapiens
ctggctccttgtgccaga

SEQ ID NO: 2488460 - DNA, 21 bp, Homo sapiens
ctggctccttgtgccagagaa

SEQ ID NO: 2488461 - DNA, 19 bp, Homo sapiens
ctggctctcacctctaggt

SEQ ID NO: 2488462 - DNA, 17 bp, Homo sapiens
ctggctctcctggccct

SEQ ID NO: 2488463 - DNA, 20 bp, Homo sapiens
ctggctcttgatacccccct

SEQ ID NO: 2488464 - DNA, 22 bp, Homo sapiens
ctggctcttgatacccccctct

SEQ ID NO: 2488465 - DNA, 13 bp, Homo sapiens
ctggctgagggca

SEQ ID NO: 2488466 - DNA, 15 bp, Homo sapiens
ctggctgagggcagt

SEQ ID NO: 2488467 - DNA, 20 bp, Homo sapiens
ctggctgctgatcgccttcc

SEQ ID NO: 2488468 - DNA, 17 bp, Homo sapiens
ctggctggctgagggca

SEQ ID NO: 2488469 - DNA, 19 bp, Homo sapiens
ctggctgggacgtggctca

SEQ ID NO: 2488470 - DNA, 18 bp, Homo sapiens
ctggctggtagagcaggt

SEQ ID NO: 2488471 - DNA, 18 bp, Homo sapiens
ctggctggtgttaacaga

SEQ ID NO: 2488472 - DNA, 18 bp, Homo sapiens
ctggcttcccatccccag

SEQ ID NO: 2488473 - DNA, 13 bp, Homo sapiens
ctggcttctggcc

SEQ ID NO: 2488474 - DNA, 19 bp, Homo sapiens
ctggcttctggccaggaag

SEQ ID NO: 2488475 - DNA, 16 bp, Homo sapiens
ctggcttgggcagcat

SEQ ID NO: 2488476 - DNA, 16 bp, Homo sapiens
ctggcttgtttgattt

SEQ ID NO: 2488477 - DNA, 14 bp, Homo sapiens
ctggcttttattaa

SEQ ID NO: 2488478 - DNA, 22 bp, Homo sapiens
ctggcttttattaatgcacttt

SEQ ID NO: 2488479 - DNA, 16 bp, Homo sapiens
ctgggaaagcccctgc

SEQ ID NO: 2488480 - DNA, 21 bp, Homo sapiens
ctgggaacagtgtgcaaggca

SEQ ID NO: 2488481 - DNA, 17 bp, Homo sapiens
ctgggaacccctttccc

SEQ ID NO: 2488482 - DNA, 16 bp, Homo sapiens
ctgggaaggctacttc

SEQ ID NO: 2488483 - DNA, 20 bp, Homo sapiens
ctgggaccgctacaccactc

SEQ ID NO: 2488484 - DNA, 22 bp, Homo sapiens
ctgggaccgctacaccactctg

SEQ ID NO: 2488485 - DNA, 23 bp, Homo sapiens
ctgggaccgctacaccactctgg

SEQ ID NO: 2488486 - DNA, 16 bp, Homo sapiens
ctgggacgtggctcag

SEQ ID NO: 2488487 - DNA, 17 bp, Homo sapiens
ctgggacgtggctcagc

SEQ ID NO: 2488488 - DNA, 18 bp, Homo sapiens
ctgggacgtggctcagcc

SEQ ID NO: 2488489 - DNA, 23 bp, Homo sapiens
ctgggacgtggctcagccagcac

SEQ ID NO: 2488490 - DNA, 14 bp, Homo sapiens
ctgggactcagcct

SEQ ID NO: 2488491 - DNA, 15 bp, Homo sapiens
ctgggagattcaagg

SEQ ID NO: 2488492 - DNA, 16 bp, Homo sapiens
ctgggagcccccagcc

SEQ ID NO: 2488493 - DNA, 19 bp, Homo sapiens
ctgggagcccccagcctgt

SEQ ID NO: 2488494 - DNA, 21 bp, Homo sapiens
ctgggagcccccagcctgtca

SEQ ID NO: 2488495 - DNA, 17 bp, Homo sapiens
ctgggagctccactctg

SEQ ID NO: 2488496 - DNA, 16 bp, Homo sapiens
ctgggagtcacacagt

SEQ ID NO: 2488497 - DNA, 21 bp, Homo sapiens
ctgggatctactttccctctg

SEQ ID NO: 2488498 - DNA, 11 bp, Homo sapiens
ctgggattagg

SEQ ID NO: 2488499 - DNA, 22 bp, Homo sapiens
ctgggattcaggaaaaggcctg

SEQ ID NO: 2488500 - DNA, 17 bp, Homo sapiens
ctgggccatgtccaaag

SEQ ID NO: 2488501 - DNA, 12 bp, Homo sapiens
ctgggccctggg

SEQ ID NO: 2488502 - DNA, 15 bp, Homo sapiens
ctgggccctgggctg

SEQ ID NO: 2488503 - DNA, 16 bp, Homo sapiens
ctgggccctgggctgg

SEQ ID NO: 2488504 - DNA, 13 bp, Homo sapiens
ctgggccctgggg

SEQ ID NO: 2488505 - DNA, 14 bp, Homo sapiens
ctgggccctggggc

SEQ ID NO: 2488506 - DNA, 16 bp, Homo sapiens
ctgggcctatggagag

SEQ ID NO: 2488507 - DNA, 18 bp, Homo sapiens
ctgggcctatggagagcc

SEQ ID NO: 2488508 - DNA, 22 bp, Homo sapiens
ctgggcctatggagagccctgg

SEQ ID NO: 2488509 - DNA, 14 bp, Homo sapiens
ctgggcctgcctca

SEQ ID NO: 2488510 - DNA, 13 bp, Homo sapiens
ctgggcctgctgc

SEQ ID NO: 2488511 - DNA, 15 bp, Homo sapiens
ctgggcctgctgctg

SEQ ID NO: 2488512 - DNA, 15 bp, Homo sapiens
ctgggcctggtctca

SEQ ID NO: 2488513 - DNA, 17 bp, Homo sapiens
ctgggccttggcctgga

SEQ ID NO: 2488514 - DNA, 18 bp, Homo sapiens
ctgggccttggcctggag

SEQ ID NO: 2488515 - DNA, 15 bp, Homo sapiens
ctgggccttgggctc

SEQ ID NO: 2488516 - DNA, 13 bp, Homo sapiens
ctgggctcctgga

SEQ ID NO: 2488517 - DNA, 14 bp, Homo sapiens
ctgggctcctggac

SEQ ID NO: 2488518 - DNA, 22 bp, Homo sapiens
ctgggctctgcaattcccctct

SEQ ID NO: 2488519 - DNA, 23 bp, Homo sapiens
ctgggctctgcaattcccctctg

SEQ ID NO: 2488520 - DNA, 18 bp, Homo sapiens
ctgggctgagggagcctg

SEQ ID NO: 2488521 - DNA, 17 bp, Homo sapiens
ctgggctggatgagctc

SEQ ID NO: 2488522 - DNA, 22 bp, Homo sapiens
ctgggcttatatctggcctctg

SEQ ID NO: 2488523 - DNA, 14 bp, Homo sapiens
ctgggcttcctgga

SEQ ID NO: 2488524 - DNA, 19 bp, Homo sapiens
ctgggcttcctggagcaga

SEQ ID NO: 2488525 - DNA, 22 bp, Homo sapiens
ctgggcttcctggagcagaagc

SEQ ID NO: 2488526 - DNA, 14 bp, Homo sapiens
ctggggaagacagt

SEQ ID NO: 2488527 - DNA, 15 bp, Homo sapiens
ctggggagcccgtct

SEQ ID NO: 2488528 - DNA, 18 bp, Homo sapiens
ctggggcaggctgggcca

SEQ ID NO: 2488529 - DNA, 16 bp, Homo sapiens
ctggggcctgggacaa

SEQ ID NO: 2488530 - DNA, 17 bp, Homo sapiens
ctggggcctgtactgcc

SEQ ID NO: 2488531 - DNA, 18 bp, Homo sapiens
ctggggctagggggagcc

SEQ ID NO: 2488532 - DNA, 12 bp, Homo sapiens
ctggggctcaga

SEQ ID NO: 2488533 - DNA, 19 bp, Homo sapiens
ctggggctctaacgcctga

SEQ ID NO: 2488534 - DNA, 12 bp, Homo sapiens
ctgggggcctgg

SEQ ID NO: 2488535 - DNA, 18 bp, Homo sapiens
ctgggggcctggctggct

SEQ ID NO: 2488536 - DNA, 18 bp, Homo sapiens
ctgggggctgaggagcag

SEQ ID NO: 2488537 - DNA, 18 bp, Homo sapiens
ctgggggctgcagttcga

SEQ ID NO: 2488538 - DNA, 13 bp, Homo sapiens
ctggggggtggcc

SEQ ID NO: 2488539 - DNA, 19 bp, Homo sapiens
ctggggggtggccaggccg

SEQ ID NO: 2488540 - DNA, 18 bp, Homo sapiens
ctggggtcccagcagctg

SEQ ID NO: 2488541 - DNA, 22 bp, Homo sapiens
ctggggtctggagttgatctgg

SEQ ID NO: 2488542 - DNA, 12 bp, Homo sapiens
ctggggtgcagg

SEQ ID NO: 2488543 - DNA, 15 bp, Homo sapiens
ctggggtgcagggat

SEQ ID NO: 2488544 - DNA, 20 bp, Homo sapiens
ctggggtgcagggatgtggg

SEQ ID NO: 2488545 - DNA, 21 bp, Homo sapiens
ctggggtgcagggatgtgggt

SEQ ID NO: 2488546 - DNA, 16 bp, Homo sapiens
ctggggtgggcagttt

SEQ ID NO: 2488547 - DNA, 18 bp, Homo sapiens
ctggggtgggcagttttt

SEQ ID NO: 2488548 - DNA, 21 bp, Homo sapiens
ctggcagctctggacagcccc

SEQ ID NO: 2488549 - DNA, 16 bp, Homo sapiens
ctggcagtccgtggga

SEQ ID NO: 2488550 - DNA, 13 bp, Homo sapiens
ctggccaagctga

SEQ ID NO: 2488551 - DNA, 14 bp, Homo sapiens
ctggccaagctgag

SEQ ID NO: 2488552 - DNA, 19 bp, Homo sapiens
ctggccaagctgaggtgcc

SEQ ID NO: 2488553 - DNA, 15 bp, Homo sapiens
ctggccagacacagg

SEQ ID NO: 2488554 - DNA, 19 bp, Homo sapiens
ctggccagacacaggccct

SEQ ID NO: 2488555 - DNA, 13 bp, Homo sapiens
ctggccagggcca

SEQ ID NO: 2488556 - DNA, 14 bp, Homo sapiens
ctggccagggccac

SEQ ID NO: 2488557 - DNA, 17 bp, Homo sapiens
ctggccagggccacgct

SEQ ID NO: 2488558 - DNA, 18 bp, Homo sapiens
ctggccagggccacgctc

SEQ ID NO: 2488559 - DNA, 16 bp, Homo sapiens
ctggccagtccaggct

SEQ ID NO: 2488560 - DNA, 17 bp, Homo sapiens
ctggccagtccaggctg

SEQ ID NO: 2488561 - DNA, 18 bp, Homo sapiens
ctggccagtccaggctgc

SEQ ID NO: 2488562 - DNA, 21 bp, Homo sapiens
ctggccagtgccctgatccca

SEQ ID NO: 2488563 - DNA, 16 bp, Homo sapiens
ctggccatggagaaag

SEQ ID NO: 2488564 - DNA, 18 bp, Homo sapiens
ctggccatggagaaagct

SEQ ID NO: 2488565 - DNA, 20 bp, Homo sapiens
ctggccatggagaaagctga

SEQ ID NO: 2488566 - DNA, 16 bp, Homo sapiens
ctggccatggcctgca

SEQ ID NO: 2488567 - DNA, 22 bp, Homo sapiens
ctggccatggcctgcaaactgg

SEQ ID NO: 2488568 - DNA, 13 bp, Homo sapiens
ctggcccaccagg

SEQ ID NO: 2488569 - DNA, 14 bp, Homo sapiens
ctggcccaccaggg

SEQ ID NO: 2488570 - DNA, 14 bp, Homo sapiens
ctggcccaccccac

SEQ ID NO: 2488571 - DNA, 16 bp, Homo sapiens
ctggcccaccccaccc

SEQ ID NO: 2488572 - DNA, 17 bp, Homo sapiens
ctggcccagccaaaccc

SEQ ID NO: 2488573 - DNA, 20 bp, Homo sapiens
ctggcccagccaaaccctgt

SEQ ID NO: 2488574 - DNA, 21 bp, Homo sapiens
ctggcccagcctttgttcccc

SEQ ID NO: 2488575 - DNA, 14 bp, Homo sapiens
ctggcccagggccc

SEQ ID NO: 2488576 - DNA, 23 bp, Homo sapiens
ctggcccagggcccagagcccag

SEQ ID NO: 2488577 - DNA, 21 bp, Homo sapiens
ctggccccaggacctggctgc

SEQ ID NO: 2488578 - DNA, 17 bp, Homo sapiens
ctggccccatggtcagc

SEQ ID NO: 2488579 - DNA, 15 bp, Homo sapiens
ctggccccctccctg

SEQ ID NO: 2488580 - DNA, 18 bp, Homo sapiens
ctggccccctccctggat

SEQ ID NO: 2488581 - DNA, 19 bp, Homo sapiens
ctggccccctccctggatg

SEQ ID NO: 2488582 - DNA, 20 bp, Homo sapiens
ctgtgtgctttttttgtgtg

SEQ ID NO: 2488583 - DNA, 12 bp, Homo sapiens
ctgtgtggagag

SEQ ID NO: 2488584 - DNA, 15 bp, Homo sapiens
ctgtgtggagaggga

SEQ ID NO: 2488585 - DNA, 19 bp, Homo sapiens
ctgtgtgtccaaaactgcc

SEQ ID NO: 2488586 - DNA, 11 bp, Homo sapiens
ctgtgtgtgcc

SEQ ID NO: 2488587 - DNA, 19 bp, Homo sapiens
ctgtgtgtgccctctgggc

SEQ ID NO: 2488588 - DNA, 23 bp, Homo sapiens
ctgtgtgtgccctctgggctctg

SEQ ID NO: 2488589 - DNA, 16 bp, Homo sapiens
ctgtgtgtgtgaatga

SEQ ID NO: 2488590 - DNA, 17 bp, Homo sapiens
ctgtgttatgcaaaagc

SEQ ID NO: 2488591 - DNA, 19 bp, Homo sapiens
ctgtgttatgcaaaagcaa

SEQ ID NO: 2488592 - DNA, 13 bp, Homo sapiens
ctgtgttccttcc

SEQ ID NO: 2488593 - DNA, 21 bp, Homo sapiens
ctgtgttgccaagctccaagc

SEQ ID NO: 2488594 - DNA, 19 bp, Homo sapiens
ctgtgttgtctctagagca

SEQ ID NO: 2488595 - DNA, 15 bp, Homo sapiens
ctgtgtttcttgcct

SEQ ID NO: 2488596 - DNA, 23 bp, Homo sapiens
ctgtgtttggctttcagggaggc

SEQ ID NO: 2488597 - DNA, 15 bp, Homo sapiens
ctgttaaatacagga

SEQ ID NO: 2488598 - DNA, 17 bp, Homo sapiens
ctgttaactgaatacca

SEQ ID NO: 2488599 - DNA, 18 bp, Homo sapiens
ctgttaactgaataccac

SEQ ID NO: 2488600 - DNA, 18 bp, Homo sapiens
ctgttacactttttggaa

SEQ ID NO: 2488601 - DNA, 13 bp, Homo sapiens
ctgttagtcattt

SEQ ID NO: 2488602 - DNA, 14 bp, Homo sapiens
ctgttccaaattca

SEQ ID NO: 2488603 - DNA, 20 bp, Homo sapiens
ctgttccaaattcagtttca

SEQ ID NO: 2488604 - DNA, 14 bp, Homo sapiens
ctgttccccagaga

SEQ ID NO: 2488605 - DNA, 16 bp, Homo sapiens
ctgttccccagagaaa

SEQ ID NO: 2488606 - DNA, 12 bp, Homo sapiens
ctgttccccctg

SEQ ID NO: 2488607 - DNA, 13 bp, Homo sapiens
ctgttcctgctgc

SEQ ID NO: 2488608 - DNA, 21 bp, Homo sapiens
ctgttcctgctgctgtctggg

SEQ ID NO: 2488609 - DNA, 12 bp, Homo sapiens
ctgttcctttta

SEQ ID NO: 2488610 - DNA, 12 bp, Homo sapiens
ctgttctagttt

SEQ ID NO: 2488611 - DNA, 13 bp, Homo sapiens
ctgttctgtgtct

SEQ ID NO: 2488612 - DNA, 23 bp, Homo sapiens
ctgttcttagctcaatgagcatg

SEQ ID NO: 2488613 - DNA, 17 bp, Homo sapiens
ctgttcttcctcagcca

SEQ ID NO: 2488614 - DNA, 18 bp, Homo sapiens
ctgttcttcctcagccag

SEQ ID NO: 2488615 - DNA, 23 bp, Homo sapiens
ctgttcttcctcagccagcctcg

SEQ ID NO: 2488616 - DNA, 20 bp, Homo sapiens
ctgttgcacgtgtgtttttc

SEQ ID NO: 2488617 - DNA, 20 bp, Homo sapiens
ctgttgggagagggcgcagg

SEQ ID NO: 2488618 - DNA, 22 bp, Homo sapiens
ctgttgggagagggcgcaggcc

SEQ ID NO: 2488619 - DNA, 20 bp, Homo sapiens
ctgtttaaaaaaccacatgg

SEQ ID NO: 2488620 - DNA, 17 bp, Homo sapiens
ctgtttcctagctgtgt

SEQ ID NO: 2488621 - DNA, 15 bp, Homo sapiens
ctgtttgacacctct

SEQ ID NO: 2488622 - DNA, 14 bp, Homo sapiens
ctgtttggcctctc

SEQ ID NO: 2488623 - DNA, 20 bp, Homo sapiens
ctgtttgtttacaaaatcag

SEQ ID NO: 2488624 - DNA, 17 bp, Homo sapiens
ctgttttacaagttgga

SEQ ID NO: 2488625 - DNA, 17 bp, Homo sapiens
ctgttttgaaggcaaaa

SEQ ID NO: 2488626 - DNA, 20 bp, Homo sapiens
ctgttttgttatataattta

SEQ ID NO: 2488627 - DNA, 17 bp, Homo sapiens
ctgttttgttgacattc

SEQ ID NO: 2488628 - DNA, 19 bp, Homo sapiens
ctgttttgttgacattctg

SEQ ID NO: 2488629 - DNA, 16 bp, Homo sapiens
ctgttttgtttcgctc

SEQ ID NO: 2488630 - DNA, 12 bp, Homo sapiens
cttaaaaagtta

SEQ ID NO: 2488631 - DNA, 13 bp, Homo sapiens
cttaaaataagca

SEQ ID NO: 2488632 - DNA, 14 bp, Homo sapiens
cttaaaataagcag

SEQ ID NO: 2488633 - DNA, 18 bp, Homo sapiens
cttaaaatacaagactgc

SEQ ID NO: 2488634 - DNA, 14 bp, Homo sapiens
cttaaactaaatgt

SEQ ID NO: 2488635 - DNA, 16 bp, Homo sapiens
cttaacagttgtattt

SEQ ID NO: 2488636 - DNA, 22 bp, Homo sapiens
cttaagacctactgttctaaag

SEQ ID NO: 2488637 - DNA, 15 bp, Homo sapiens
cttaagcatctggct

SEQ ID NO: 2488638 - DNA, 18 bp, Homo sapiens
cttaagcatctggctcta

SEQ ID NO: 2488639 - DNA, 23 bp, Homo sapiens
cttaagcatctggctctaattca

SEQ ID NO: 2488640 - DNA, 17 bp, Homo sapiens
cttaaggtgtagccaca

SEQ ID NO: 2488641 - DNA, 21 bp, Homo sapiens
cttaaggtgtagccacaccag

SEQ ID NO: 2488642 - DNA, 16 bp, Homo sapiens
cttaagtgctgcaatt

SEQ ID NO: 2488643 - DNA, 18 bp, Homo sapiens
cttaatactaccttgaaa

SEQ ID NO: 2488644 - DNA, 15 bp, Homo sapiens
cttaattattatttg

SEQ ID NO: 2488645 - DNA, 19 bp, Homo sapiens
cttaattattatttgtgtt

SEQ ID NO: 2488646 - DNA, 20 bp, Homo sapiens
cttaattgccacctctaaca

SEQ ID NO: 2488647 - DNA, 13 bp, Homo sapiens
cttaatttgcaca

SEQ ID NO: 2488648 - DNA, 16 bp, Homo sapiens
cttacagtaggagccc

SEQ ID NO: 2488649 - DNA, 22 bp, Homo sapiens
cttacatttacaaactgaagag

SEQ ID NO: 2488650 - DNA, 18 bp, Homo sapiens
cttacctggcccatcagg

SEQ ID NO: 2488651 - DNA, 23 bp, Homo sapiens
cttacgaatacttttgccctttg

SEQ ID NO: 2488652 - DNA, 15 bp, Homo sapiens
cttactcccaggcac

SEQ ID NO: 2488653 - DNA, 13 bp, Homo sapiens
cttactcctgtgg

SEQ ID NO: 2488654 - DNA, 20 bp, Homo sapiens
cttactcctgtgggagcctc

SEQ ID NO: 2488655 - DNA, 19 bp, Homo sapiens
cttacttggaactgaaggg

SEQ ID NO: 2488656 - DNA, 14 bp, Homo sapiens
cttactttttatat

SEQ ID NO: 2488657 - DNA, 11 bp, Homo sapiens
cttagaaaacc

SEQ ID NO: 2488658 - DNA, 19 bp, Homo sapiens
cttagacagaggccctcaa

SEQ ID NO: 2488659 - DNA, 16 bp, Homo sapiens
cttagatctggcatgt

SEQ ID NO: 2488660 - DNA, 11 bp, Homo sapiens
cttagattctc

SEQ ID NO: 2488661 - DNA, 12 bp, Homo sapiens
cttagattttac

SEQ ID NO: 2488662 - DNA, 16 bp, Homo sapiens
cttagattttacatga

SEQ ID NO: 2488663 - DNA, 19 bp, Homo sapiens
cttagattttacatgaagt

SEQ ID NO: 2488664 - DNA, 18 bp, Homo sapiens
cttagcctggacctctga

SEQ ID NO: 2488665 - DNA, 20 bp, Homo sapiens
cttagcctggacctctgaca

SEQ ID NO: 2488666 - DNA, 19 bp, Homo sapiens
cttagctagttttattctt

SEQ ID NO: 2488667 - DNA, 20 bp, Homo sapiens
cttagctttagaaacagtgc

SEQ ID NO: 2488668 - DNA, 21 bp, Homo sapiens
cttagggacagtcaaaaccaa

SEQ ID NO: 2488669 - DNA, 15 bp, Homo sapiens
cttagggcaccaggg

SEQ ID NO: 2488670 - DNA, 21 bp, Homo sapiens
cttagtctaggtccttgttgt

SEQ ID NO: 2488671 - DNA, 13 bp, Homo sapiens
cttagtctcagtt

SEQ ID NO: 2488672 - DNA, 20 bp, Homo sapiens
cttagtctcagtttgtgtgt

SEQ ID NO: 2488673 - DNA, 23 bp, Homo sapiens
cttagtctcagtttgtgtgtctt

SEQ ID NO: 2488674 - DNA, 11 bp, Homo sapiens
cttagtgtatg

SEQ ID NO: 2488675 - DNA, 15 bp, Homo sapiens
cttagtgtatgatta

SEQ ID NO: 2488676 - DNA, 14 bp, Homo sapiens
cttataattgttct

SEQ ID NO: 2488677 - DNA, 20 bp, Homo sapiens
cttatacgaaataattgttg

SEQ ID NO: 2488678 - DNA, 14 bp, Homo sapiens
cttatagttactgt

SEQ ID NO: 2488679 - DNA, 18 bp, Homo sapiens
cttatagttactgtgtaa

SEQ ID NO: 2488680 - DNA, 15 bp, Homo sapiens
cttatagttctaggc

SEQ ID NO: 2488681 - DNA, 22 bp, Homo sapiens
cttatatctggcctctgctttc

SEQ ID NO: 2488682 - DNA, 16 bp, Homo sapiens
cttatcctccctgtaa

SEQ ID NO: 2488683 - DNA, 17 bp, Homo sapiens
cttatcctccctgtaac

SEQ ID NO: 2488684 - DNA, 22 bp, Homo sapiens
cttatctgatcagaacaaatgt

SEQ ID NO: 2488685 - DNA, 14 bp, Homo sapiens
cttatgaaaagaat

SEQ ID NO: 2488686 - DNA, 21 bp, Homo sapiens
cttatgaaaagaattgttggg

SEQ ID NO: 2488687 - DNA, 16 bp, Homo sapiens
cttatgcggttaattt

SEQ ID NO: 2488688 - DNA, 18 bp, Homo sapiens
cttatgcggttaattttg

SEQ ID NO: 2488689 - DNA, 16 bp, Homo sapiens
cttatggaattgattt

SEQ ID NO: 2488690 - DNA, 21 bp, Homo sapiens
cttatggaattgatttgcatt

SEQ ID NO: 2488691 - DNA, 23 bp, Homo sapiens
cttatggaattgatttgcattga

SEQ ID NO: 2488692 - DNA, 21 bp, Homo sapiens
cttatggatgtccccagcaga

SEQ ID NO: 2488693 - DNA, 20 bp, Homo sapiens
cttattagagtgtctttcca

SEQ ID NO: 2488694 - DNA, 14 bp, Homo sapiens
cttatttattgtat

SEQ ID NO: 2488695 - DNA, 21 bp, Homo sapiens
cttatttttttaagaaaaaag

SEQ ID NO: 2488696 - DNA, 21 bp, Homo sapiens
cttcaaaagtttgtttgctta

SEQ ID NO: 2488697 - DNA, 16 bp, Homo sapiens
cttcaaatgcctgact

SEQ ID NO: 2488698 - DNA, 21 bp, Homo sapiens
cttcaacacagcttgtctctt

SEQ ID NO: 2488699 - DNA, 14 bp, Homo sapiens
cttcaagctctgag

SEQ ID NO: 2488700 - DNA, 18 bp, Homo sapiens
cttcaagctctgagggaa

SEQ ID NO: 2488701 - DNA, 12 bp, Homo sapiens
cttcactgtcac

SEQ ID NO: 2488702 - DNA, 19 bp, Homo sapiens
cttcagacagagaggactg

SEQ ID NO: 2488703 - DNA, 17 bp, Homo sapiens
cttcagagagcagtgct

SEQ ID NO: 2488704 - DNA, 23 bp, Homo sapiens
cttcagaggccctcgctgccagc

SEQ ID NO: 2488705 - DNA, 10 bp, Homo sapiens
cttcaggtcc

SEQ ID NO: 2488706 - DNA, 18 bp, Homo sapiens
cttcaggttggtttaatc

SEQ ID NO: 2488707 - DNA, 22 bp, Homo sapiens
cttcagtaaatgtgattcacct

SEQ ID NO: 2488708 - DNA, 13 bp, Homo sapiens
cttcagttgtctc

SEQ ID NO: 2488709 - DNA, 14 bp, Homo sapiens
cttcagttgtctct

SEQ ID NO: 2488710 - DNA, 16 bp, Homo sapiens
cttcatatcatccaca

SEQ ID NO: 2488711 - DNA, 18 bp, Homo sapiens
cttcatatcatccacaca

SEQ ID NO: 2488712 - DNA, 20 bp, Homo sapiens
cttcatatcatccacacatg

SEQ ID NO: 2488713 - DNA, 13 bp, Homo sapiens
cttcatctcccac

SEQ ID NO: 2488714 - DNA, 16 bp, Homo sapiens
cttcatgacagcctcc

SEQ ID NO: 2488715 - DNA, 14 bp, Homo sapiens
cttcatgccagcta

SEQ ID NO: 2488716 - DNA, 15 bp, Homo sapiens
cttcatgccagctac

SEQ ID NO: 2488717 - DNA, 16 bp, Homo sapiens
cttcatgccagctact

SEQ ID NO: 2488718 - DNA, 13 bp, Homo sapiens
cttcatggatggg

SEQ ID NO: 2488719 - DNA, 12 bp, Homo sapiens
cttcatttcaga

SEQ ID NO: 2488720 - DNA, 19 bp, Homo sapiens
cttccaaatcccctaagca

SEQ ID NO: 2488721 - DNA, 17 bp, Homo sapiens
cttccaatgtctggaga

SEQ ID NO: 2488722 - DNA, 18 bp, Homo sapiens
cttccacagggtcccaca

SEQ ID NO: 2488723 - DNA, 19 bp, Homo sapiens
cttccacagggtcccacag

SEQ ID NO: 2488724 - DNA, 13 bp, Homo sapiens
cttccaccacaga

SEQ ID NO: 2488725 - DNA, 19 bp, Homo sapiens
cttccactcgatgatgctt

SEQ ID NO: 2488726 - DNA, 18 bp, Homo sapiens
cttccactgagggcagtc

SEQ ID NO: 2488727 - DNA, 16 bp, Homo sapiens
cttccagaaaacaaaa

SEQ ID NO: 2488728 - DNA, 13 bp, Homo sapiens
cttccagaaatac

SEQ ID NO: 2488729 - DNA, 12 bp, Homo sapiens
cttccagctcct

SEQ ID NO: 2488730 - DNA, 15 bp, Homo sapiens
cttccatgctgtgcg

SEQ ID NO: 2488731 - DNA, 13 bp, Homo sapiens
cttccatttgcaa

SEQ ID NO: 2488732 - DNA, 17 bp, Homo sapiens
cttcccaagggctgccg

SEQ ID NO: 2488733 - DNA, 23 bp, Homo sapiens
cttcccaagtgagtctctctggg

SEQ ID NO: 2488734 - DNA, 18 bp, Homo sapiens
cttcccagaggggcctgc

SEQ ID NO: 2488735 - DNA, 14 bp, Homo sapiens
cttcccatccccag

SEQ ID NO: 2488736 - DNA, 13 bp, Homo sapiens
cttcccccaccac

SEQ ID NO: 2488737 - DNA, 15 bp, Homo sapiens
cttcccccaccacca

SEQ ID NO: 2488738 - DNA, 16 bp, Homo sapiens
cttcccccaccaccaa

SEQ ID NO: 2488739 - DNA, 17 bp, Homo sapiens
cttccccctctcccagt

SEQ ID NO: 2488740 - DNA, 14 bp, Homo sapiens
cttccctctctgga

SEQ ID NO: 2488741 - DNA, 15 bp, Homo sapiens
cttccctgaagctcc

SEQ ID NO: 2488742 - DNA, 13 bp, Homo sapiens
cttccctgactca

SEQ ID NO: 2488743 - DNA, 16 bp, Homo sapiens
cttcccttttctgttc

SEQ ID NO: 2488744 - DNA, 23 bp, Homo sapiens
cttccgcttggagctattttcca

SEQ ID NO: 2488745 - DNA, 13 bp, Homo sapiens
cttccggcccctc

SEQ ID NO: 2488746 - DNA, 21 bp, Homo sapiens
cttcctaaattttcctgtcct

SEQ ID NO: 2488747 - DNA, 11 bp, Homo sapiens
cttcctcagcc

SEQ ID NO: 2488748 - DNA, 12 bp, Homo sapiens
cttcctcctgga

SEQ ID NO: 2488749 - DNA, 14 bp, Homo sapiens
cttcctcctggaaa

SEQ ID NO: 2488750 - DNA, 15 bp, Homo sapiens
cttcctcctgggccc

SEQ ID NO: 2488751 - DNA, 22 bp, Homo sapiens
cttcctcctgggccctctctgc

SEQ ID NO: 2488752 - DNA, 19 bp, Homo sapiens
cttcctcttttccttccca

SEQ ID NO: 2488753 - DNA, 12 bp, Homo sapiens
cttcctgccagc

SEQ ID NO: 2488754 - DNA, 22 bp, Homo sapiens
cttcctgccagcccctgccatt

SEQ ID NO: 2488755 - DNA, 21 bp, Homo sapiens
cttcctgccccaactccttcc

SEQ ID NO: 2488756 - DNA, 14 bp, Homo sapiens
cttcctgcttgcca

SEQ ID NO: 2488757 - DNA, 22 bp, Homo sapiens
cttcctggacagctgtgcctcg

SEQ ID NO: 2488758 - DNA, 24 bp, Homo sapiens
cttcctggacagctgtgcctcgct

SEQ ID NO: 2488759 - DNA, 22 bp, Homo sapiens
cttcctggagactgcccagcta

SEQ ID NO: 2488760 - DNA, 22 bp, Homo sapiens
cttcctggagcagaagcagcaa

SEQ ID NO: 2488761 - DNA, 19 bp, Homo sapiens
cttcctggccgcctgggtc

SEQ ID NO: 2488762 - DNA, 15 bp, Homo sapiens
cttcctggtgctgga

SEQ ID NO: 2488763 - DNA, 15 bp, Homo sapiens
cttcctgtgtgtcca

SEQ ID NO: 2488764 - DNA, 23 bp, Homo sapiens
cttccttcagagagcagtgcttt

SEQ ID NO: 2488765 - DNA, 14 bp, Homo sapiens
cttcgtctttccca

SEQ ID NO: 2488766 - DNA, 18 bp, Homo sapiens
cttctaaacttccccatc

SEQ ID NO: 2488767 - DNA, 17 bp, Homo sapiens
cttctaagtaaatacaa

SEQ ID NO: 2488768 - DNA, 19 bp, Homo sapiens
cttctactcacttttccca

SEQ ID NO: 2488769 - DNA, 23 bp, Homo sapiens
cttctactcacttttcccactcc

SEQ ID NO: 2488770 - DNA, 14 bp, Homo sapiens
cttctcaagttcta

SEQ ID NO: 2488771 - DNA, 15 bp, Homo sapiens
cttctcaagttctaa

SEQ ID NO: 2488772 - DNA, 20 bp, Homo sapiens
cttctcccactctcctaggc

SEQ ID NO: 2488773 - DNA, 17 bp, Homo sapiens
cttctcccaggcaaggc

SEQ ID NO: 2488774 - DNA, 19 bp, Homo sapiens
cttctcccaggcaaggctg

SEQ ID NO: 2488775 - DNA, 19 bp, Homo sapiens
cttctccccagctcccagg

SEQ ID NO: 2488776 - DNA, 14 bp, Homo sapiens
cttctcccctgcac

SEQ ID NO: 2488777 - DNA, 20 bp, Homo sapiens
cttctcccctgcactgtaaa

SEQ ID NO: 2488778 - DNA, 22 bp, Homo sapiens
cttctcccctgcactgtaaaat

SEQ ID NO: 2488779 - DNA, 14 bp, Homo sapiens
cttctctccagctg

SEQ ID NO: 2488780 - DNA, 15 bp, Homo sapiens
cttctctccagctga

SEQ ID NO: 2488781 - DNA, 15 bp, Homo sapiens
cttctctgacttctg

SEQ ID NO: 2488782 - DNA, 16 bp, Homo sapiens
cttctctgacttctgc

SEQ ID NO: 2488783 - DNA, 22 bp, Homo sapiens
cttctctgacttctgcctggag

SEQ ID NO: 2488784 - DNA, 15 bp, Homo sapiens
cttctgagcactgtt

SEQ ID NO: 2488785 - DNA, 14 bp, Homo sapiens
cttctgagctcctg

SEQ ID NO: 2488786 - DNA, 19 bp, Homo sapiens
cttctgagctcctgtcccc

SEQ ID NO: 2488787 - DNA, 22 bp, Homo sapiens
cttctgagctcctgtcccctgc

SEQ ID NO: 2488788 - DNA, 17 bp, Homo sapiens
cttctgccccctgcaga

SEQ ID NO: 2488789 - DNA, 14 bp, Homo sapiens
cttctgcctggaga

SEQ ID NO: 2488790 - DNA, 15 bp, Homo sapiens
cttctgcctggagac

SEQ ID NO: 2488791 - DNA, 20 bp, Homo sapiens
cttctgccttagtctcagtt

SEQ ID NO: 2488792 - DNA, 23 bp, Homo sapiens
cttttatgtagtaattgacatgt

SEQ ID NO: 2488793 - DNA, 18 bp, Homo sapiens
cttttcataggtctgaaa

SEQ ID NO: 2488794 - DNA, 13 bp, Homo sapiens
cttttcatgcaaa

SEQ ID NO: 2488795 - DNA, 17 bp, Homo sapiens
cttttcatgcaaactct

SEQ ID NO: 2488796 - DNA, 19 bp, Homo sapiens
cttttcatgcaaactcttt

SEQ ID NO: 2488797 - DNA, 20 bp, Homo sapiens
cttttcatgcaaactctttg

SEQ ID NO: 2488798 - DNA, 18 bp, Homo sapiens
cttttcccaaaatgttga

SEQ ID NO: 2488799 - DNA, 22 bp, Homo sapiens
cttttcccactccaagcccagc

SEQ ID NO: 2488800 - DNA, 16 bp, Homo sapiens
cttttccttccctttt

SEQ ID NO: 2488801 - DNA, 20 bp, Homo sapiens
cttttctaacagaaagcatg

SEQ ID NO: 2488802 - DNA, 17 bp, Homo sapiens
cttttctcctcactgta

SEQ ID NO: 2488803 - DNA, 19 bp, Homo sapiens
cttttctcttttgctttct

SEQ ID NO: 2488804 - DNA, 19 bp, Homo sapiens
cttttctggaatgtaatca

SEQ ID NO: 2488805 - DNA, 16 bp, Homo sapiens
cttttctgttctagtt

SEQ ID NO: 2488806 - DNA, 17 bp, Homo sapiens
cttttgacactgctcta

SEQ ID NO: 2488807 - DNA, 20 bp, Homo sapiens
cttttgcaaagaaagaaaaa

SEQ ID NO: 2488808 - DNA, 15 bp, Homo sapiens
cttttgcaaccagga

SEQ ID NO: 2488809 - DNA, 24 bp, Homo sapiens
cttttgcaaccaggaacagcaaat

SEQ ID NO: 2488810 - DNA, 20 bp, Homo sapiens
cttttgccttttgcaaccag

SEQ ID NO: 2488811 - DNA, 23 bp, Homo sapiens
cttttgcggttcaggaaaattga

SEQ ID NO: 2488812 - DNA, 20 bp, Homo sapiens
cttttgctttctgtttctta

SEQ ID NO: 2488813 - DNA, 18 bp, Homo sapiens
cttttgcttttgcccatt

SEQ ID NO: 2488814 - DNA, 17 bp, Homo sapiens
cttttgcttttggcaaa

SEQ ID NO: 2488815 - DNA, 12 bp, Homo sapiens
cttttggaggac

SEQ ID NO: 2488816 - DNA, 17 bp, Homo sapiens
cttttggcggggaggag

SEQ ID NO: 2488817 - DNA, 20 bp, Homo sapiens
cttttgggtttctgccctgc

SEQ ID NO: 2488818 - DNA, 20 bp, Homo sapiens
cttttggtaaagactggctt

SEQ ID NO: 2488819 - DNA, 13 bp, Homo sapiens
cttttgtattaag

SEQ ID NO: 2488820 - DNA, 17 bp, Homo sapiens
cttttgtattaagaaag

SEQ ID NO: 2488821 - DNA, 11 bp, Homo sapiens
cttttgtctac

SEQ ID NO: 2488822 - DNA, 19 bp, Homo sapiens
cttttgtctacacaccctg

SEQ ID NO: 2488823 - DNA, 13 bp, Homo sapiens
cttttgtgaatta

SEQ ID NO: 2488824 - DNA, 15 bp, Homo sapiens
ctttttacctttcat

SEQ ID NO: 2488825 - DNA, 17 bp, Homo sapiens
ctttttacctttcatac

SEQ ID NO: 2488826 - DNA, 20 bp, Homo sapiens
ctttttcaatgaattttata

SEQ ID NO: 2488827 - DNA, 12 bp, Homo sapiens
ctttttcattta

SEQ ID NO: 2488828 - DNA, 15 bp, Homo sapiens
ctttttcatttatct

SEQ ID NO: 2488829 - DNA, 23 bp, Homo sapiens
ctttttcatttatctataattta

SEQ ID NO: 2488830 - DNA, 22 bp, Homo sapiens
ctttttccaactcagaaattca

SEQ ID NO: 2488831 - DNA, 14 bp, Homo sapiens
ctttttgaggcaaa

SEQ ID NO: 2488832 - DNA, 20 bp, Homo sapiens
ctttttgcatgatatcttca

SEQ ID NO: 2488833 - DNA, 17 bp, Homo sapiens
ctttttgggagagactt

SEQ ID NO: 2488834 - DNA, 20 bp, Homo sapiens
ctttttgggagagacttgtt

SEQ ID NO: 2488835 - DNA, 18 bp, Homo sapiens
ctttttgtataaaataga

SEQ ID NO: 2488836 - DNA, 16 bp, Homo sapiens
cttttttggccatctg

SEQ ID NO: 2488837 - DNA, 13 bp, Homo sapiens
cttttttgttttg

SEQ ID NO: 2488838 - DNA, 19 bp, Homo sapiens
ctttttttccatctttaca

SEQ ID NO: 2488839 - DNA, 21 bp, Homo sapiens
ctttttttgtgtgtatttgct

SEQ ID NO: 2488840 - DNA, 15 bp, Homo sapiens
cttttttttccttct

SEQ ID NO: 2488841 - DNA, 18 bp, Homo sapiens
cttttttttctatttcac

SEQ ID NO: 2488842 - DNA, 14 bp, Homo sapiens
cttttttttcttta

SEQ ID NO: 2488843 - DNA, 15 bp, Homo sapiens
cttttttttctttaa

SEQ ID NO: 2488844 - DNA, 17 bp, Homo sapiens
gaaaaaaaaacagccac

SEQ ID NO: 2488845 - DNA, 16 bp, Homo sapiens
gaaaaaaaacagtgga

SEQ ID NO: 2488846 - DNA, 18 bp, Homo sapiens
ctttagaatcccagcccc

SEQ ID NO: 2488847 - DNA, 19 bp, Homo sapiens
ctttagagaagtatacata

SEQ ID NO: 2488848 - DNA, 15 bp, Homo sapiens
ctttagatagccctg

SEQ ID NO: 2488849 - DNA, 16 bp, Homo sapiens
ctttataagaaagcct

SEQ ID NO: 2488850 - DNA, 20 bp, Homo sapiens
ctttatgataatagattctc

SEQ ID NO: 2488851 - DNA, 19 bp, Homo sapiens
ctttatgtagtttttatat

SEQ ID NO: 2488852 - DNA, 19 bp, Homo sapiens
ctttcaaaaccttttgaaa

SEQ ID NO: 2488853 - DNA, 15 bp, Homo sapiens
ctttcaaaagggaag

SEQ ID NO: 2488854 - DNA, 23 bp, Homo sapiens
ctttcaagcagtcgtgcctgtgt

SEQ ID NO: 2488855 - DNA, 17 bp, Homo sapiens
ctttcaatacagatata

SEQ ID NO: 2488856 - DNA, 20 bp, Homo sapiens
ctttcaatacagatatattt

SEQ ID NO: 2488857 - DNA, 14 bp, Homo sapiens
ctttcacagctcct

SEQ ID NO: 2488858 - DNA, 15 bp, Homo sapiens
ctttcacagctcctc

SEQ ID NO: 2488859 - DNA, 18 bp, Homo sapiens
ctttcacagctcctccca

SEQ ID NO: 2488860 - DNA, 13 bp, Homo sapiens
ctttcacaggcag

SEQ ID NO: 2488861 - DNA, 19 bp, Homo sapiens
ctttcacaggcagccagtg

SEQ ID NO: 2488862 - DNA, 19 bp, Homo sapiens
ctttcagctcctgaccagt

SEQ ID NO: 2488863 - DNA, 17 bp, Homo sapiens
ctttcaggatctatttt

SEQ ID NO: 2488864 - DNA, 20 bp, Homo sapiens
ctttcatgtaaactgtgcac

SEQ ID NO: 2488865 - DNA, 21 bp, Homo sapiens
ctttcatgtaaactgtgcacc

SEQ ID NO: 2488866 - DNA, 15 bp, Homo sapiens
ctttcatttcttcta

SEQ ID NO: 2488867 - DNA, 18 bp, Homo sapiens
ctttccatccatggccag

SEQ ID NO: 2488868 - DNA, 20 bp, Homo sapiens
ctttccatccatggccagca

SEQ ID NO: 2488869 - DNA, 21 bp, Homo sapiens
ctttccatccatggccagcag

SEQ ID NO: 2488870 - DNA, 22 bp, Homo sapiens
ctttcccaccccaacctgctct

SEQ ID NO: 2488871 - DNA, 18 bp, Homo sapiens
ctttccctaccctctaga

SEQ ID NO: 2488872 - DNA, 15 bp, Homo sapiens
ctttccctctgggat

SEQ ID NO: 2488873 - DNA, 22 bp, Homo sapiens
ctttcctcctcaggcacacagc

SEQ ID NO: 2488874 - DNA, 10 bp, Homo sapiens
ctttcctgcc

SEQ ID NO: 2488875 - DNA, 23 bp, Homo sapiens
ctttcctggacactcagacctga

SEQ ID NO: 2488876 - DNA, 22 bp, Homo sapiens
ctttctagaaagagaaacagtt

SEQ ID NO: 2488877 - DNA, 17 bp, Homo sapiens
ctttctatcctctgtaa

SEQ ID NO: 2488878 - DNA, 17 bp, Homo sapiens
ctttctcactaaatctt

SEQ ID NO: 2488879 - DNA, 16 bp, Homo sapiens
ctttctctttccctgg

SEQ ID NO: 2488880 - DNA, 13 bp, Homo sapiens
ctttctgaacagc

SEQ ID NO: 2488881 - DNA, 14 bp, Homo sapiens
ctttctgaattgca

SEQ ID NO: 2488882 - DNA, 22 bp, Homo sapiens
ctttctgagggcccgtgtaaat

SEQ ID NO: 2488883 - DNA, 17 bp, Homo sapiens
ctttctgatcaaggcct

SEQ ID NO: 2488884 - DNA, 20 bp, Homo sapiens
ctttctgatcaaggccttat

SEQ ID NO: 2488885 - DNA, 12 bp, Homo sapiens
ctttctgcctgg

SEQ ID NO: 2488886 - DNA, 18 bp, Homo sapiens
ctttctgtatatactttt

SEQ ID NO: 2488887 - DNA, 20 bp, Homo sapiens
ctttctgtatatactttttt

SEQ ID NO: 2488888 - DNA, 18 bp, Homo sapiens
ctttctgtcttctacaga

SEQ ID NO: 2488889 - DNA, 22 bp, Homo sapiens
ctttctgttccaaattcagttt

SEQ ID NO: 2488890 - DNA, 17 bp, Homo sapiens
ctttctttaaagttctt

SEQ ID NO: 2488891 - DNA, 21 bp, Homo sapiens
ctttctttttgtagctggggc

SEQ ID NO: 2488892 - DNA, 15 bp, Homo sapiens
ctttcttttttgata

SEQ ID NO: 2488893 - DNA, 15 bp, Homo sapiens
ctttgaaaaaaaata

SEQ ID NO: 2488894 - DNA, 17 bp, Homo sapiens
ctttgaaaaaaaataaa

SEQ ID NO: 2488895 - DNA, 18 bp, Homo sapiens
ctttgaaattgaaccttt

SEQ ID NO: 2488896 - DNA, 18 bp, Homo sapiens
ctttgaaggggcctcacc

SEQ ID NO: 2488897 - DNA, 15 bp, Homo sapiens
cttctgctcagctct

SEQ ID NO: 2488898 - DNA, 13 bp, Homo sapiens
cttctgctggggc

SEQ ID NO: 2488899 - DNA, 15 bp, Homo sapiens
cttctgctggggcct

SEQ ID NO: 2488900 - DNA, 19 bp, Homo sapiens
cttctgctggggcctggga

SEQ ID NO: 2488901 - DNA, 23 bp, Homo sapiens
cttctgggagggcagcagggcta

SEQ ID NO: 2488902 - DNA, 14 bp, Homo sapiens
cttctggggcaggc

SEQ ID NO: 2488903 - DNA, 15 bp, Homo sapiens
cttctggggcaggct

SEQ ID NO: 2488904 - DNA, 20 bp, Homo sapiens
cttctggggcaggctgggcc

SEQ ID NO: 2488905 - DNA, 21 bp, Homo sapiens
cttctggggcaggctgggcca

SEQ ID NO: 2488906 - DNA, 19 bp, Homo sapiens
cttcttatggaattgattt

SEQ ID NO: 2488907 - DNA, 13 bp, Homo sapiens
cttcttgcctctg

SEQ ID NO: 2488908 - DNA, 18 bp, Homo sapiens
cttcttgcctctgtgctg

SEQ ID NO: 2488909 - DNA, 20 bp, Homo sapiens
cttcttgcttctttctagaa

SEQ ID NO: 2488910 - DNA, 20 bp, Homo sapiens
cttgaaaaaaaacagtggat

SEQ ID NO: 2488911 - DNA, 19 bp, Homo sapiens
cttgaaagaagaaaaggtt

SEQ ID NO: 2488912 - DNA, 20 bp, Homo sapiens
cttgaaattaagaaggcaaa

SEQ ID NO: 2488913 - DNA, 21 bp, Homo sapiens
cttgaaattaagaaggcaaaa

SEQ ID NO: 2488914 - DNA, 19 bp, Homo sapiens
cttgaacgttttctaattg

SEQ ID NO: 2488915 - DNA, 17 bp, Homo sapiens
cttgaagggccagagcc

SEQ ID NO: 2488916 - DNA, 14 bp, Homo sapiens
cttgacaactggca

SEQ ID NO: 2488917 - DNA, 22 bp, Homo sapiens
cttgacacctgctgagaaaaca

SEQ ID NO: 2488918 - DNA, 13 bp, Homo sapiens
cttgaccctgagc

SEQ ID NO: 2488919 - DNA, 20 bp, Homo sapiens
cttgacctgaggctgtggtc

SEQ ID NO: 2488920 - DNA, 21 bp, Homo sapiens
cttgagcagtggctggtccag

SEQ ID NO: 2488921 - DNA, 16 bp, Homo sapiens
cttgagcatgttactg

SEQ ID NO: 2488922 - DNA, 15 bp, Homo sapiens
cttgaggggaccagg

SEQ ID NO: 2488923 - DNA, 19 bp, Homo sapiens
cttgaggggaccaggagtg

SEQ ID NO: 2488924 - DNA, 13 bp, Homo sapiens
cttgagggggaag

SEQ ID NO: 2488925 - DNA, 20 bp, Homo sapiens
cttgagggggaaggattctg

SEQ ID NO: 2488926 - DNA, 18 bp, Homo sapiens
cttgaggtctcagcccct

SEQ ID NO: 2488927 - DNA, 12 bp, Homo sapiens
cttgatagaaat

SEQ ID NO: 2488928 - DNA, 21 bp, Homo sapiens
cttgatgcatgcactgttccc

SEQ ID NO: 2488929 - DNA, 18 bp, Homo sapiens
cttgatgggattctggac

SEQ ID NO: 2488930 - DNA, 21 bp, Homo sapiens
cttgatgtaaaatcttgtcat

SEQ ID NO: 2488931 - DNA, 19 bp, Homo sapiens
cttgatgtaaggatgggca

SEQ ID NO: 2488932 - DNA, 20 bp, Homo sapiens
cttgattctgcagtaaatct

SEQ ID NO: 2488933 - DNA, 22 bp, Homo sapiens
cttgattctgcagtaaatcttt

SEQ ID NO: 2488934 - DNA, 23 bp, Homo sapiens
cttgcaccccaaagctttcctgc

SEQ ID NO: 2488935 - DNA, 13 bp, Homo sapiens
cttgccaaattta

SEQ ID NO: 2488936 - DNA, 16 bp, Homo sapiens
cttgccagagatccaa

SEQ ID NO: 2488937 - DNA, 23 bp, Homo sapiens
cttgccagagatccaaaagaagc

SEQ ID NO: 2488938 - DNA, 16 bp, Homo sapiens
cttgcccccctggcct

SEQ ID NO: 2488939 - DNA, 15 bp, Homo sapiens
cttgcctcaatgcca

SEQ ID NO: 2488940 - DNA, 18 bp, Homo sapiens
cttgcctcaatgccagta

SEQ ID NO: 2488941 - DNA, 23 bp, Homo sapiens
cttgcctcatttttttccttgca

SEQ ID NO: 2488942 - DNA, 13 bp, Homo sapiens
cttgcctctgtgc

SEQ ID NO: 2488943 - DNA, 14 bp, Homo sapiens
cttgcctctgtgct

SEQ ID NO: 2488944 - DNA, 13 bp, Homo sapiens
cttgcctcttcct

SEQ ID NO: 2488945 - DNA, 18 bp, Homo sapiens
cttgcctcttccttgaag

SEQ ID NO: 2488946 - DNA, 13 bp, Homo sapiens
cttgcctgccact

SEQ ID NO: 2488947 - DNA, 15 bp, Homo sapiens
cttgcctggtacagt

SEQ ID NO: 2488948 - DNA, 22 bp, Homo sapiens
cttgcctgtttcccaggcccac

SEQ ID NO: 2488949 - DNA, 20 bp, Homo sapiens
cttgctaccagtatttagaa

SEQ ID NO: 2488950 - DNA, 14 bp, Homo sapiens
cttgctattctgtc

SEQ ID NO: 2488951 - DNA, 17 bp, Homo sapiens
cttgctattctgtccct

SEQ ID NO: 2488952 - DNA, 23 bp, Homo sapiens
cttgctattctgtccctaggtgt

SEQ ID NO: 2488953 - DNA, 20 bp, Homo sapiens
cttgctgcaagcacagccct

SEQ ID NO: 2488954 - DNA, 12 bp, Homo sapiens
cttgctgcttta

SEQ ID NO: 2488955 - DNA, 16 bp, Homo sapiens
cttgctggtctagtca

SEQ ID NO: 2488956 - DNA, 17 bp, Homo sapiens
cttgcttccctaatcta

SEQ ID NO: 2488957 - DNA, 15 bp, Homo sapiens
cttgcttctttctag

SEQ ID NO: 2488958 - DNA, 15 bp, Homo sapiens
cttggaactgaaggg

SEQ ID NO: 2488959 - DNA, 13 bp, Homo sapiens
cttggaactgcat

SEQ ID NO: 2488960 - DNA, 20 bp, Homo sapiens
cttggacatcctcctcccac

SEQ ID NO: 2488961 - DNA, 18 bp, Homo sapiens
cttggagaagtctcagct

SEQ ID NO: 2488962 - DNA, 20 bp, Homo sapiens
cttggagctattttccaggc

SEQ ID NO: 2488963 - DNA, 23 bp, Homo sapiens
cttggagctgtgagttctccctg

SEQ ID NO: 2488964 - DNA, 16 bp, Homo sapiens
cttggattctttccat

SEQ ID NO: 2488965 - DNA, 21 bp, Homo sapiens
cttggattctttccatttgca

SEQ ID NO: 2488966 - DNA, 13 bp, Homo sapiens
cttggcagccttg

SEQ ID NO: 2488967 - DNA, 14 bp, Homo sapiens
cttggcagccttgt

SEQ ID NO: 2488968 - DNA, 15 bp, Homo sapiens
cttggcgatgccagc

SEQ ID NO: 2488969 - DNA, 20 bp, Homo sapiens
cttggcgatgccagccaagc

SEQ ID NO: 2488970 - DNA, 18 bp, Homo sapiens
cttggctcgaatctctgt

SEQ ID NO: 2488971 - DNA, 21 bp, Homo sapiens
cttggctcgaatctctgtgcc

SEQ ID NO: 2488972 - DNA, 20 bp, Homo sapiens
cttggctggacccagccagg

SEQ ID NO: 2488973 - DNA, 22 bp, Homo sapiens
cttgggaaaggtggtgtttctg

SEQ ID NO: 2488974 - DNA, 21 bp, Homo sapiens
cttgggaagactcctagctgt

SEQ ID NO: 2488975 - DNA, 20 bp, Homo sapiens
cttgggcacccccagcctgg

SEQ ID NO: 2488976 - DNA, 22 bp, Homo sapiens
cttgggcagagctggctctgag

SEQ ID NO: 2488977 - DNA, 14 bp, Homo sapiens
cttgggcagcatcc

SEQ ID NO: 2488978 - DNA, 15 bp, Homo sapiens
cttgggcccacacct

SEQ ID NO: 2488979 - DNA, 16 bp, Homo sapiens
cttgggcccacacctc

SEQ ID NO: 2488980 - DNA, 18 bp, Homo sapiens
cttgggcccacacctcct

SEQ ID NO: 2488981 - DNA, 13 bp, Homo sapiens
cttgggctccctg

SEQ ID NO: 2488982 - DNA, 13 bp, Homo sapiens
cttgggctctgat

SEQ ID NO: 2488983 - DNA, 16 bp, Homo sapiens
cttgggctctgatgaa

SEQ ID NO: 2488984 - DNA, 17 bp, Homo sapiens
cttgggctctgatgaaa

SEQ ID NO: 2488985 - DNA, 22 bp, Homo sapiens
cttggggagacctctactgcct

SEQ ID NO: 2488986 - DNA, 19 bp, Homo sapiens
cttggggagttaagacctg

SEQ ID NO: 2488987 - DNA, 20 bp, Homo sapiens
cttggggagttaagacctgg

SEQ ID NO: 2488988 - DNA, 18 bp, Homo sapiens
cttggggctcacacacct

SEQ ID NO: 2488989 - DNA, 18 bp, Homo sapiens
cttgggggggtggccgct

SEQ ID NO: 2488990 - DNA, 22 bp, Homo sapiens
cttgggggggtggccgctgagt

SEQ ID NO: 2488991 - DNA, 22 bp, Homo sapiens
cttgggggtcctcctccaggga

SEQ ID NO: 2488992 - DNA, 23 bp, Homo sapiens
cttgggggttcaggcccggcagg

SEQ ID NO: 2488993 - DNA, 18 bp, Homo sapiens
cttgggttagacctacag

SEQ ID NO: 2488994 - DNA, 22 bp, Homo sapiens
cttgggttagacctacaggggg

SEQ ID NO: 2488995 - DNA, 19 bp, Homo sapiens
cttggttcttgaggggacc

SEQ ID NO: 2488996 - DNA, 15 bp, Homo sapiens
cttggttgaggaaac

SEQ ID NO: 2488997 - DNA, 15 bp, Homo sapiens
cttggtttgccttcc

SEQ ID NO: 2488998 - DNA, 21 bp, Homo sapiens
cttggttttgctacataatta

SEQ ID NO: 2488999 - DNA, 12 bp, Homo sapiens
cttgtaaatata

SEQ ID NO: 2489000 - DNA, 17 bp, Homo sapiens
cttgtaactaaaataat

SEQ ID NO: 2489001 - DNA, 14 bp, Homo sapiens
tccctccgggacct

SEQ ID NO: 2489002 - DNA, 16 bp, Homo sapiens
tccctctcaggatcca

SEQ ID NO: 2489003 - DNA, 16 bp, Homo sapiens
tccctgactcattctg

SEQ ID NO: 2489004 - DNA, 22 bp, Homo sapiens
tccctgactcattctgaaggag

SEQ ID NO: 2489005 - DNA, 13 bp, Homo sapiens
tccctgagatggg

SEQ ID NO: 2489006 - DNA, 23 bp, Homo sapiens
tccctgagatgggcttcccaagg

SEQ ID NO: 2489007 - DNA, 22 bp, Homo sapiens
tccctgcacagtgacttctgag

SEQ ID NO: 2489008 - DNA, 13 bp, Homo sapiens
tccctgcctcctg

SEQ ID NO: 2489009 - DNA, 14 bp, Homo sapiens
tccctgctgccagc

SEQ ID NO: 2489010 - DNA, 15 bp, Homo sapiens
tccctgctgccagct

SEQ ID NO: 2489011 - DNA, 20 bp, Homo sapiens
tccctggaatgagttgaggc

SEQ ID NO: 2489012 - DNA, 18 bp, Homo sapiens
tccctggatgacattaaa

SEQ ID NO: 2489013 - DNA, 18 bp, Homo sapiens
tccctggccccctccctg

SEQ ID NO: 2489014 - DNA, 23 bp, Homo sapiens
tccctgggagggacatgcttagc

SEQ ID NO: 2489015 - DNA, 15 bp, Homo sapiens
tccctgggcctgctg

SEQ ID NO: 2489016 - DNA, 18 bp, Homo sapiens
tccctgggcctgctgctg

SEQ ID NO: 2489017 - DNA, 14 bp, Homo sapiens
tccctgtaacctct

SEQ ID NO: 2489018 - DNA, 18 bp, Homo sapiens
tccctgtaacctcttcag

SEQ ID NO: 2489019 - DNA, 18 bp, Homo sapiens
tccctgttggtcggtggg

SEQ ID NO: 2489020 - DNA, 19 bp, Homo sapiens
tccctgttttcccacgagg

SEQ ID NO: 2489021 - DNA, 15 bp, Homo sapiens
tcccttaaacaaaaa

SEQ ID NO: 2489022 - DNA, 14 bp, Homo sapiens
tcccttaatatcct

SEQ ID NO: 2489023 - DNA, 21 bp, Homo sapiens
tcccttaatatcctaaacatc

SEQ ID NO: 2489024 - DNA, 16 bp, Homo sapiens
tcccttcagtaccctc

SEQ ID NO: 2489025 - DNA, 13 bp, Homo sapiens
tcccttgggctct

SEQ ID NO: 2489026 - DNA, 14 bp, Homo sapiens
tcccttgggctctg

SEQ ID NO: 2489027 - DNA, 15 bp, Homo sapiens
tccgactgctttgga

SEQ ID NO: 2489028 - DNA, 16 bp, Homo sapiens
tccgagaggtgggcca

SEQ ID NO: 2489029 - DNA, 21 bp, Homo sapiens
tccgaggacccaggaaaggca

SEQ ID NO: 2489030 - DNA, 16 bp, Homo sapiens
tccgcaggtgctggtc

SEQ ID NO: 2489031 - DNA, 15 bp, Homo sapiens
tccgccactggggct

SEQ ID NO: 2489032 - DNA, 21 bp, Homo sapiens
tccgccactggggctcagagc

SEQ ID NO: 2489033 - DNA, 21 bp, Homo sapiens
tccgcccacaggaagcctgca

SEQ ID NO: 2489034 - DNA, 20 bp, Homo sapiens
tccgcttggagctattttcc

SEQ ID NO: 2489035 - DNA, 19 bp, Homo sapiens
tccggcagcttctgccccc

SEQ ID NO: 2489036 - DNA, 14 bp, Homo sapiens
tccggtgttctaag

SEQ ID NO: 2489037 - DNA, 16 bp, Homo sapiens
tccgtgggacggtgcc

SEQ ID NO: 2489038 - DNA, 15 bp, Homo sapiens
tccgtgtccaccccc

SEQ ID NO: 2489039 - DNA, 15 bp, Homo sapiens
tccgttagctcctgt

SEQ ID NO: 2489040 - DNA, 19 bp, Homo sapiens
tccgttagctcctgtggcc

SEQ ID NO: 2489041 - DNA, 16 bp, Homo sapiens
tccgttcacatgtgtg

SEQ ID NO: 2489042 - DNA, 21 bp, Homo sapiens
tcctaagggtcgaaagctcta

SEQ ID NO: 2489043 - DNA, 17 bp, Homo sapiens
tcctacagaaaaacctt

SEQ ID NO: 2489044 - DNA, 20 bp, Homo sapiens
tcctacagaaaaaccttggg

SEQ ID NO: 2489045 - DNA, 16 bp, Homo sapiens
tcctactggtctctct

SEQ ID NO: 2489046 - DNA, 17 bp, Homo sapiens
tcctactggtctctcta

SEQ ID NO: 2489047 - DNA, 18 bp, Homo sapiens
tcctagagaagacaggct

SEQ ID NO: 2489048 - DNA, 15 bp, Homo sapiens
tcctagcacagatgg

SEQ ID NO: 2489049 - DNA, 20 bp, Homo sapiens
tcctagcacagatggccagc

SEQ ID NO: 2489050 - DNA, 21 bp, Homo sapiens
tcctagcacagatggccagcc

SEQ ID NO: 2489051 - DNA, 13 bp, Homo sapiens
tcctagttctaga

SEQ ID NO: 2489052 - DNA, 17 bp, Homo sapiens
tcctagttctagaaaaa

SEQ ID NO: 2489053 - DNA, 19 bp, Homo sapiens
tcctagttctagaaaaaca

SEQ ID NO: 2489054 - DNA, 16 bp, Homo sapiens
tcctagttcttcatcc

SEQ ID NO: 2489055 - DNA, 19 bp, Homo sapiens
tcctatacgcagcgtgctt

SEQ ID NO: 2489056 - DNA, 17 bp, Homo sapiens
tcctatctccagcggcc

SEQ ID NO: 2489057 - DNA, 18 bp, Homo sapiens
tcctatctgggcttcctg

SEQ ID NO: 2489058 - DNA, 22 bp, Homo sapiens
tcctatgcatggtttcagcact

SEQ ID NO: 2489059 - DNA, 15 bp, Homo sapiens
tcctcaaagaaagtg

SEQ ID NO: 2489060 - DNA, 19 bp, Homo sapiens
tcctcaaagaaagtgtatt

SEQ ID NO: 2489061 - DNA, 17 bp, Homo sapiens
tcctcaacacccaactg

SEQ ID NO: 2489062 - DNA, 12 bp, Homo sapiens
tcctcaatccag

SEQ ID NO: 2489063 - DNA, 13 bp, Homo sapiens
tcctcaatccagc

SEQ ID NO: 2489064 - DNA, 14 bp, Homo sapiens
tcctcactgtatcc

SEQ ID NO: 2489065 - DNA, 17 bp, Homo sapiens
tcctcagactctaagaa

SEQ ID NO: 2489066 - DNA, 13 bp, Homo sapiens
tcctcagccagcc

SEQ ID NO: 2489067 - DNA, 16 bp, Homo sapiens
tcctcagccagcctcg

SEQ ID NO: 2489068 - DNA, 11 bp, Homo sapiens
tcctcagcctt

SEQ ID NO: 2489069 - DNA, 16 bp, Homo sapiens
tcctcaggcacacagc

SEQ ID NO: 2489070 - DNA, 14 bp, Homo sapiens
tcctcatcccgtgt

SEQ ID NO: 2489071 - DNA, 15 bp, Homo sapiens
tcctcatgaatgtaa

SEQ ID NO: 2489072 - DNA, 22 bp, Homo sapiens
tcctccaacaccaagcacagca

SEQ ID NO: 2489073 - DNA, 21 bp, Homo sapiens
tcctccacgttctgctcatca

SEQ ID NO: 2489074 - DNA, 16 bp, Homo sapiens
tcctccagggacagca

SEQ ID NO: 2489075 - DNA, 20 bp, Homo sapiens
tcctcccaatttcagactcc

SEQ ID NO: 2489076 - DNA, 13 bp, Homo sapiens
tcctcccctggag

SEQ ID NO: 2489077 - DNA, 14 bp, Homo sapiens
tcctccctgtaact

SEQ ID NO: 2489078 - DNA, 14 bp, Homo sapiens
tcctcctccaggga

SEQ ID NO: 2489079 - DNA, 14 bp, Homo sapiens
tcctcctcccaccc

SEQ ID NO: 2489080 - DNA, 13 bp, Homo sapiens
tcctcctctgtga

SEQ ID NO: 2489081 - DNA, 12 bp, Homo sapiens
tcctcctgcaga

SEQ ID NO: 2489082 - DNA, 15 bp, Homo sapiens
tcctcctgggccctc

SEQ ID NO: 2489083 - DNA, 20 bp, Homo sapiens
tcctcctgggccctctctgc

SEQ ID NO: 2489084 - DNA, 16 bp, Homo sapiens
tcctcctgtattcctg

SEQ ID NO: 2489085 - DNA, 15 bp, Homo sapiens
tcctcctttctgagg

SEQ ID NO: 2489086 - DNA, 17 bp, Homo sapiens
tcctcctttctgagggc

SEQ ID NO: 2489087 - DNA, 14 bp, Homo sapiens
tcctcgtttgtgtt

SEQ ID NO: 2489088 - DNA, 19 bp, Homo sapiens
tcatcaagagaatttgggg

SEQ ID NO: 2489089 - DNA, 16 bp, Homo sapiens
tcatcagaaaggaaaa

SEQ ID NO: 2489090 - DNA, 17 bp, Homo sapiens
tcatcatggccagctgg

SEQ ID NO: 2489091 - DNA, 22 bp, Homo sapiens
tcatcatggccagctggaggca

SEQ ID NO: 2489092 - DNA, 19 bp, Homo sapiens
tcatccaagttaaatgtag

SEQ ID NO: 2489093 - DNA, 19 bp, Homo sapiens
tcatccacataccctgacc

SEQ ID NO: 2489094 - DNA, 11 bp, Homo sapiens
tcatccatcat

SEQ ID NO: 2489095 - DNA, 16 bp, Homo sapiens
tcatccatcatcatgt

SEQ ID NO: 2489096 - DNA, 17 bp, Homo sapiens
tcatccatcatcatgtg

SEQ ID NO: 2489097 - DNA, 17 bp, Homo sapiens
tcagagtccttaaaatg

SEQ ID NO: 2489098 - DNA, 19 bp, Homo sapiens
tcagagtgacatccaggag

SEQ ID NO: 2489099 - DNA, 20 bp, Homo sapiens
tcagataaggtaaaatgcca

SEQ ID NO: 2489100 - DNA, 14 bp, Homo sapiens
tcagatccaggagc

SEQ ID NO: 2489101 - DNA, 16 bp, Homo sapiens
tcagatccaggagctc

SEQ ID NO: 2489102 - DNA, 15 bp, Homo sapiens
tcagatgctccaaga

SEQ ID NO: 2489103 - DNA, 20 bp, Homo sapiens
tcagatgctccaagattcta

SEQ ID NO: 2489104 - DNA, 22 bp, Homo sapiens
tcagatgctccaagattctaga

SEQ ID NO: 2489105 - DNA, 20 bp, Homo sapiens
tatgttatatataaatatat

SEQ ID NO: 2489106 - DNA, 16 bp, Homo sapiens
tatgttcaaagtcaaa

SEQ ID NO: 2489107 - DNA, 18 bp, Homo sapiens
tatgttctaacctttaca

SEQ ID NO: 2489108 - DNA, 18 bp, Homo sapiens
tatgttgaatacttttta

SEQ ID NO: 2489109 - DNA, 13 bp, Homo sapiens
tattaaaagactc

SEQ ID NO: 2489110 - DNA, 12 bp, Homo sapiens
tattaaaatgta

SEQ ID NO: 2489111 - DNA, 20 bp, Homo sapiens
tattaaattttttgttgaca

SEQ ID NO: 2489112 - DNA, 15 bp, Homo sapiens
tattaacgatgtcca

SEQ ID NO: 2489113 - DNA, 17 bp, Homo sapiens
tattaactttaatgttt

SEQ ID NO: 2489114 - DNA, 12 bp, Homo sapiens
tattaagaaagg

SEQ ID NO: 2489115 - DNA, 13 bp, Homo sapiens
tattaagaaagga

SEQ ID NO: 2489116 - DNA, 14 bp, Homo sapiens
tattaagaaaggaa

SEQ ID NO: 2489117 - DNA, 24 bp, Homo sapiens
tattaagaaaggaagcattgtaaa

SEQ ID NO: 2489118 - DNA, 15 bp, Homo sapiens
tattaagcatcagaa

SEQ ID NO: 2489119 - DNA, 14 bp, Homo sapiens
tattaatcttagtg

SEQ ID NO: 2489120 - DNA, 18 bp, Homo sapiens
tattaatcttagtgtatg

SEQ ID NO: 2489121 - DNA, 15 bp, Homo sapiens
tattaatgcccagac

SEQ ID NO: 2489122 - DNA, 15 bp, Homo sapiens
tattacagtgtttat

SEQ ID NO: 2489123 - DNA, 19 bp, Homo sapiens
tattacagtgtttatcctt

SEQ ID NO: 2489124 - DNA, 16 bp, Homo sapiens
tattacgtatgtctgg

SEQ ID NO: 2489125 - DNA, 19 bp, Homo sapiens
tattacttgtaaatataaa

SEQ ID NO: 2489126 - DNA, 21 bp, Homo sapiens
tattacttgtaaatataaaga

SEQ ID NO: 2489127 - DNA, 23 bp, Homo sapiens
tattacttgtaaatataaagacg

SEQ ID NO: 2489128 - DNA, 17 bp, Homo sapiens
tattagaatcaaacatt

SEQ ID NO: 2489129 - DNA, 21 bp, Homo sapiens
tattagaatcaaacattttga

SEQ ID NO: 2489130 - DNA, 21 bp, Homo sapiens
tattaggtgcaatttcaaggt

SEQ ID NO: 2489131 - DNA, 16 bp, Homo sapiens
tattagtattgttgtc

SEQ ID NO: 2489132 - DNA, 19 bp, Homo sapiens
tattagtattgttgtcctt

SEQ ID NO: 2489133 - DNA, 20 bp, Homo sapiens
tattagtattgttgtccttt

SEQ ID NO: 2489134 - DNA, 21 bp, Homo sapiens
tattagtattgttgtcctttt

SEQ ID NO: 2489135 - DNA, 15 bp, Homo sapiens
tattatcaacaatag

SEQ ID NO: 2489136 - DNA, 21 bp, Homo sapiens
tattatgaatgtgaagccttc

SEQ ID NO: 2489137 - DNA, 14 bp, Homo sapiens
tattatgagatgct

SEQ ID NO: 2489138 - DNA, 15 bp, Homo sapiens
tattatgagatgctg

SEQ ID NO: 2489139 - DNA, 14 bp, Homo sapiens
tattattacttgta

SEQ ID NO: 2489140 - DNA, 12 bp, Homo sapiens
tattattagggc

SEQ ID NO: 2489141 - DNA, 22 bp, Homo sapiens
tattattataatcttataattg

SEQ ID NO: 2489142 - DNA, 19 bp, Homo sapiens
tattcaacaatttcaataa

SEQ ID NO: 2489143 - DNA, 23 bp, Homo sapiens
tattcagggaaggaggagcctgt

SEQ ID NO: 2489144 - DNA, 16 bp, Homo sapiens
tattcatagtttaatt

SEQ ID NO: 2489145 - DNA, 18 bp, Homo sapiens
tattcattgtggtcatag

SEQ ID NO: 2489146 - DNA, 16 bp, Homo sapiens
tattccagaatgctgt

SEQ ID NO: 2489147 - DNA, 14 bp, Homo sapiens
tattccatgactgc

SEQ ID NO: 2489148 - DNA, 23 bp, Homo sapiens
tattccatgactgcttgccctaa

SEQ ID NO: 2489149 - DNA, 23 bp, Homo sapiens
tattctaagacttactctaagat

SEQ ID NO: 2489150 - DNA, 16 bp, Homo sapiens
tattctcctcctccct

SEQ ID NO: 2489151 - DNA, 18 bp, Homo sapiens
tattctggggtatggcgt

SEQ ID NO: 2489152 - DNA, 11 bp, Homo sapiens
tattctgtccc

SEQ ID NO: 2489153 - DNA, 14 bp, Homo sapiens
tattcttcataaca

SEQ ID NO: 2489154 - DNA, 18 bp, Homo sapiens
tattcttctagagttcag

SEQ ID NO: 2489155 - DNA, 13 bp, Homo sapiens
tattcttggtttt

SEQ ID NO: 2489156 - DNA, 15 bp, Homo sapiens
tattgacttgtatat

SEQ ID NO: 2489157 - DNA, 19 bp, Homo sapiens
tattgactttgacaattac

SEQ ID NO: 2489158 - DNA, 14 bp, Homo sapiens
tattgagtcaaatg

SEQ ID NO: 2489159 - DNA, 18 bp, Homo sapiens
tattgataagatctttta

SEQ ID NO: 2489160 - DNA, 17 bp, Homo sapiens
tattgcacattgtaaaa

SEQ ID NO: 2489161 - DNA, 15 bp, Homo sapiens
tattgctagagctcc

SEQ ID NO: 2489162 - DNA, 16 bp, Homo sapiens
tattgctagagctcct

SEQ ID NO: 2489163 - DNA, 19 bp, Homo sapiens
tattggccaaggaaaggca

SEQ ID NO: 2489164 - DNA, 17 bp, Homo sapiens
tattggtgtaaggtact

SEQ ID NO: 2489165 - DNA, 20 bp, Homo sapiens
tattggtttaaagaaagtgt

SEQ ID NO: 2489166 - DNA, 13 bp, Homo sapiens
tattgtattctgg

SEQ ID NO: 2489167 - DNA, 15 bp, Homo sapiens
tattgtccattgtcc

SEQ ID NO: 2489168 - DNA, 17 bp, Homo sapiens
tattgtccattgtccaa

SEQ ID NO: 2489169 - DNA, 23 bp, Homo sapiens
tattgtctgaacttgcattgtga

SEQ ID NO: 2489170 - DNA, 13 bp, Homo sapiens
tattgttgtcctt

SEQ ID NO: 2489171 - DNA, 14 bp, Homo sapiens
tattgttgtccttt

SEQ ID NO: 2489172 - DNA, 16 bp, Homo sapiens
tattgttgtccttttc

SEQ ID NO: 2489173 - DNA, 22 bp, Homo sapiens
tattgttgtccttttcataggt

SEQ ID NO: 2489174 - DNA, 20 bp, Homo sapiens
tatttaaaaaactaaaaact

SEQ ID NO: 2489175 - DNA, 17 bp, Homo sapiens
tatttaaaaataagtca

SEQ ID NO: 2489176 - DNA, 23 bp, Homo sapiens
tatttaaaaataagtcaacagta

SEQ ID NO: 2489177 - DNA, 13 bp, Homo sapiens
tatttaaaacttg

SEQ ID NO: 2489178 - DNA, 24 bp, Homo sapiens
tatttaaactctgttgcaagtgca

SEQ ID NO: 2489179 - DNA, 18 bp, Homo sapiens
tatttaaatgtaaagaca

SEQ ID NO: 2489180 - DNA, 14 bp, Homo sapiens
tatttaacagaaat

SEQ ID NO: 2489181 - DNA, 23 bp, Homo sapiens
tatttaactctctttatgtctgt

SEQ ID NO: 2489182 - DNA, 11 bp, Homo sapiens
tatttaactga

SEQ ID NO: 2489183 - DNA, 20 bp, Homo sapiens
tatttaagataattataata

SEQ ID NO: 2489184 - DNA, 13 bp, Homo sapiens
tatttaatagcaa

SEQ ID NO: 2489185 - DNA, 19 bp, Homo sapiens
tatttaatagcaaagaatt

SEQ ID NO: 2489186 - DNA, 22 bp, Homo sapiens
tatttaatagcaaagaattgac

SEQ ID NO: 2489187 - DNA, 14 bp, Homo sapiens
tatttacatttaat

SEQ ID NO: 2489188 - DNA, 13 bp, Homo sapiens
tatttacctcagc

SEQ ID NO: 2489189 - DNA, 16 bp, Homo sapiens
tatttacctcagcctg

SEQ ID NO: 2489190 - DNA, 14 bp, Homo sapiens
tatttacgctttga

SEQ ID NO: 2489191 - DNA, 15 bp, Homo sapiens
tatttacgctttgat

SEQ ID NO: 2489192 - DNA, 22 bp, Homo sapiens
tatttacgctttgattcatagt

SEQ ID NO: 2489193 - DNA, 16 bp, Homo sapiens
tatttataaatatatt

SEQ ID NO: 2489194 - DNA, 15 bp, Homo sapiens
tatttatatgtacat

SEQ ID NO: 2489195 - DNA, 17 bp, Homo sapiens
tatttatatgtacatga

SEQ ID NO: 2489196 - DNA, 13 bp, Homo sapiens
tatttatgtatgg

SEQ ID NO: 2489197 - DNA, 13 bp, Homo sapiens
tatttatgtattg

SEQ ID NO: 2489198 - DNA, 17 bp, Homo sapiens
tatttattgtattctgg

SEQ ID NO: 2489199 - DNA, 14 bp, Homo sapiens
tatttcaaattgga

SEQ ID NO: 2489200 - DNA, 13 bp, Homo sapiens
tatttcctccctc

SEQ ID NO: 2489201 - DNA, 16 bp, Homo sapiens
tatttggaaataaagt

SEQ ID NO: 2489202 - DNA, 15 bp, Homo sapiens
tatttgtaaaatgac

SEQ ID NO: 2489203 - DNA, 13 bp, Homo sapiens
tatttgtaaatct

SEQ ID NO: 2489204 - DNA, 17 bp, Homo sapiens
tatttgtaaatctgcca

SEQ ID NO: 2489205 - DNA, 15 bp, Homo sapiens
tatttgtaatagatg

SEQ ID NO: 2489206 - DNA, 13 bp, Homo sapiens
tatttgtaattaa

SEQ ID NO: 2489207 - DNA, 12 bp, Homo sapiens
tattttaaagaa

SEQ ID NO: 2489208 - DNA, 13 bp, Homo sapiens
tattttaaagaat

SEQ ID NO: 2489209 - DNA, 13 bp, Homo sapiens
tattttcaccatt

SEQ ID NO: 2489210 - DNA, 18 bp, Homo sapiens
tattttgacataaagttg

SEQ ID NO: 2489211 - DNA, 22 bp, Homo sapiens
tatagctgcttccagtgtagac

SEQ ID NO: 2489212 - DNA, 19 bp, Homo sapiens
tataggcatacctcctatg

SEQ ID NO: 2489213 - DNA, 13 bp, Homo sapiens
tatagttaacaca

SEQ ID NO: 2489214 - DNA, 18 bp, Homo sapiens
tatagttaacacactacc

SEQ ID NO: 2489215 - DNA, 22 bp, Homo sapiens
tatagttactgtgtaattagtg

SEQ ID NO: 2489216 - DNA, 21 bp, Homo sapiens
tatagttcatgtctgctatca

SEQ ID NO: 2489217 - DNA, 13 bp, Homo sapiens
tatagttctagac

SEQ ID NO: 2489218 - DNA, 13 bp, Homo sapiens
tatagttctaggc

SEQ ID NO: 2489219 - DNA, 14 bp, Homo sapiens
tatagtttctgagg

SEQ ID NO: 2489220 - DNA, 22 bp, Homo sapiens
tatagtttctgaggctttatga

SEQ ID NO: 2489221 - DNA, 11 bp, Homo sapiens
tatatataaat

SEQ ID NO: 2489222 - DNA, 12 bp, Homo sapiens
tatatataaata

SEQ ID NO: 2489223 - DNA, 13 bp, Homo sapiens
tatatattatact

SEQ ID NO: 2489224 - DNA, 18 bp, Homo sapiens
tatatattatacttgtaa

SEQ ID NO: 2489225 - DNA, 15 bp, Homo sapiens
tatatattatatgga

SEQ ID NO: 2489226 - DNA, 13 bp, Homo sapiens
tatatgatggggg

SEQ ID NO: 2489227 - DNA, 20 bp, Homo sapiens
tatatggggatggtagtttt

SEQ ID NO: 2489228 - DNA, 19 bp, Homo sapiens
tatatgtaccctctgaaat

SEQ ID NO: 2489229 - DNA, 22 bp, Homo sapiens
tatatgtaccctctgaaataca

SEQ ID NO: 2489230 - DNA, 17 bp, Homo sapiens
tatattacagatatttg

SEQ ID NO: 2489231 - DNA, 13 bp, Homo sapiens
tatattatctttt

SEQ ID NO: 2489232 - DNA, 12 bp, Homo sapiens
tatattattata

SEQ ID NO: 2489233 - DNA, 12 bp, Homo sapiens
tatattgtaatt

SEQ ID NO: 2489234 - DNA, 14 bp, Homo sapiens
tatattgtaattta

SEQ ID NO: 2489235 - DNA, 19 bp, Homo sapiens
tatattgtgtttgtgtatt

SEQ ID NO: 2489236 - DNA, 19 bp, Homo sapiens
tatattgttcagcatgcaa

SEQ ID NO: 2489237 - DNA, 14 bp, Homo sapiens
tatatttaaaaata

SEQ ID NO: 2489238 - DNA, 15 bp, Homo sapiens
tatatttaaaaataa

SEQ ID NO: 2489239 - DNA, 19 bp, Homo sapiens
tatatttaactctctttat

SEQ ID NO: 2489240 - DNA, 13 bp, Homo sapiens
tatattttaagaa

SEQ ID NO: 2489241 - DNA, 18 bp, Homo sapiens
tatcaaaccctagccttg

SEQ ID NO: 2489242 - DNA, 19 bp, Homo sapiens
tatcaaaccctagccttgc

SEQ ID NO: 2489243 - DNA, 19 bp, Homo sapiens
tatcaacttcctaaatatt

SEQ ID NO: 2489244 - DNA, 13 bp, Homo sapiens
tatcacacacatt

SEQ ID NO: 2489245 - DNA, 19 bp, Homo sapiens
tatcacacacattgctgtg

SEQ ID NO: 2489246 - DNA, 16 bp, Homo sapiens
tatcacccaacgctcc

SEQ ID NO: 2489247 - DNA, 22 bp, Homo sapiens
tatcacccagacataaaggaaa

SEQ ID NO: 2489248 - DNA, 19 bp, Homo sapiens
tatcaccgtgggctccctg

SEQ ID NO: 2489249 - DNA, 18 bp, Homo sapiens
tatcacctagctgaatgt

SEQ ID NO: 2489250 - DNA, 17 bp, Homo sapiens
tatcagactaagccagc

SEQ ID NO: 2489251 - DNA, 15 bp, Homo sapiens
tatcagtaaataact

SEQ ID NO: 2489252 - DNA, 14 bp, Homo sapiens
tatcatccacacat

SEQ ID NO: 2489253 - DNA, 15 bp, Homo sapiens
tatccaatcaatctt

SEQ ID NO: 2489254 - DNA, 19 bp, Homo sapiens
tatccaggttccctcccag

SEQ ID NO: 2489255 - DNA, 22 bp, Homo sapiens
tatcccaaagttgttgtaacct

SEQ ID NO: 2489256 - DNA, 15 bp, Homo sapiens
tatccctcacctgta

SEQ ID NO: 2489257 - DNA, 20 bp, Homo sapiens
tatccctcctgttgggagag

SEQ ID NO: 2489258 - DNA, 14 bp, Homo sapiens
tatcctccctgtaa

SEQ ID NO: 2489259 - DNA, 16 bp, Homo sapiens
tatcctccctgtaact

SEQ ID NO: 2489260 - DNA, 17 bp, Homo sapiens
tatcctccctgtaactt

SEQ ID NO: 2489261 - DNA, 14 bp, Homo sapiens
tatcctctcttcct

SEQ ID NO: 2489262 - DNA, 18 bp, Homo sapiens
tatcctttcatatagtta

SEQ ID NO: 2489263 - DNA, 22 bp, Homo sapiens
tatctaccccagactagatgta

SEQ ID NO: 2489264 - DNA, 16 bp, Homo sapiens
tatctataatttacct

SEQ ID NO: 2489265 - DNA, 12 bp, Homo sapiens
tatctcagaaag

SEQ ID NO: 2489266 - DNA, 16 bp, Homo sapiens
tatctccagcggccct

SEQ ID NO: 2489267 - DNA, 19 bp, Homo sapiens
tatctgaatttttaaacaa

SEQ ID NO: 2489268 - DNA, 15 bp, Homo sapiens
tatctgggcttcctg

SEQ ID NO: 2489269 - DNA, 18 bp, Homo sapiens
tatctgggcttcctggag

SEQ ID NO: 2489270 - DNA, 22 bp, Homo sapiens
tatctgtaatggtactgacttt

SEQ ID NO: 2489271 - DNA, 18 bp, Homo sapiens
tatcttactatttcacaa

SEQ ID NO: 2489272 - DNA, 15 bp, Homo sapiens
tatcttctcaagttc

SEQ ID NO: 2489273 - DNA, 17 bp, Homo sapiens
tatgaatgtgaagcctt

SEQ ID NO: 2489274 - DNA, 19 bp, Homo sapiens
tatgaatgtgaagccttcc

SEQ ID NO: 2489275 - DNA, 14 bp, Homo sapiens
tatgaattattcaa

SEQ ID NO: 2489276 - DNA, 21 bp, Homo sapiens
tatgacttgggcacccccagc

SEQ ID NO: 2489277 - DNA, 22 bp, Homo sapiens
tatgacttgggcacccccagcc

SEQ ID NO: 2489278 - DNA, 16 bp, Homo sapiens
tatgataatagattct

SEQ ID NO: 2489279 - DNA, 17 bp, Homo sapiens
tatgataatagattctc

SEQ ID NO: 2489280 - DNA, 24 bp, Homo sapiens
tatgataggttattttgatgtaaa

SEQ ID NO: 2489281 - DNA, 16 bp, Homo sapiens
tatgatctgtctgtgg

SEQ ID NO: 2489282 - DNA, 22 bp, Homo sapiens
tatgattactggcctttttcat

SEQ ID NO: 2489283 - DNA, 17 bp, Homo sapiens
tatgatttaatttgaaa

SEQ ID NO: 2489284 - DNA, 13 bp, Homo sapiens
tatgatttacatt

SEQ ID NO: 2489285 - DNA, 16 bp, Homo sapiens
tatgcacatgaactta

SEQ ID NO: 2489286 - DNA, 22 bp, Homo sapiens
tatgcacttataattttcctaa

SEQ ID NO: 2489287 - DNA, 14 bp, Homo sapiens
tatgcatatttgtt

SEQ ID NO: 2489288 - DNA, 22 bp, Homo sapiens
tatgcatggtgccccaggacca

SEQ ID NO: 2489289 - DNA, 23 bp, Homo sapiens
tatgcatggtgccccaggaccag

SEQ ID NO: 2489290 - DNA, 16 bp, Homo sapiens
tatgcattatatcaaa

SEQ ID NO: 2489291 - DNA, 18 bp, Homo sapiens
tatgctaccaccagctgt

SEQ ID NO: 2489292 - DNA, 13 bp, Homo sapiens
tatgcttaaaata

SEQ ID NO: 2489293 - DNA, 16 bp, Homo sapiens
tatgcttgcaaaaact

SEQ ID NO: 2489294 - DNA, 13 bp, Homo sapiens
tatggaaatatat

SEQ ID NO: 2489295 - DNA, 14 bp, Homo sapiens
tatggaaatatata

SEQ ID NO: 2489296 - DNA, 19 bp, Homo sapiens
tatggaattgatttgcatt

SEQ ID NO: 2489297 - DNA, 18 bp, Homo sapiens
tatggactatctgtctgg

SEQ ID NO: 2489298 - DNA, 14 bp, Homo sapiens
tatggagagccctg

SEQ ID NO: 2489299 - DNA, 16 bp, Homo sapiens
tatggagtcattttta

SEQ ID NO: 2489300 - DNA, 16 bp, Homo sapiens
tatggattctaaaatg

SEQ ID NO: 2489301 - DNA, 21 bp, Homo sapiens
tatggcgtaagtacagagaag

SEQ ID NO: 2489302 - DNA, 17 bp, Homo sapiens
tatggggatggtagttt

SEQ ID NO: 2489303 - DNA, 19 bp, Homo sapiens
tatgggggttgtaaattgg

SEQ ID NO: 2489304 - DNA, 23 bp, Homo sapiens
tatgggggttgtaaattggcatg

SEQ ID NO: 2489305 - DNA, 18 bp, Homo sapiens
tatgggtagggtaaatca

SEQ ID NO: 2489306 - DNA, 19 bp, Homo sapiens
tatggtaactgctttctgt

SEQ ID NO: 2489307 - DNA, 12 bp, Homo sapiens
tatgtaacatgt

SEQ ID NO: 2489308 - DNA, 15 bp, Homo sapiens
tatgtacatgagaag

SEQ ID NO: 2489309 - DNA, 10 bp, Homo sapiens
tatgtaccaa

SEQ ID NO: 2489310 - DNA, 16 bp, Homo sapiens
tatgtaccctctgaaa

SEQ ID NO: 2489311 - DNA, 15 bp, Homo sapiens
tatgtagcaaaatac

SEQ ID NO: 2489312 - DNA, 17 bp, Homo sapiens
tatgtatggtgcaatgt

SEQ ID NO: 2489313 - DNA, 21 bp, Homo sapiens
tatgtattatttacatttaat

SEQ ID NO: 2489314 - DNA, 12 bp, Homo sapiens
tatgtatttata

SEQ ID NO: 2489315 - DNA, 17 bp, Homo sapiens
tagggactgaccagcag

SEQ ID NO: 2489316 - DNA, 18 bp, Homo sapiens
tagggagggcggcagggg

SEQ ID NO: 2489317 - DNA, 16 bp, Homo sapiens
tagggatgcctccttt

SEQ ID NO: 2489318 - DNA, 15 bp, Homo sapiens
tagggcaccaggggt

SEQ ID NO: 2489319 - DNA, 20 bp, Homo sapiens
tagggcaccaggggtttctc

SEQ ID NO: 2489320 - DNA, 16 bp, Homo sapiens
tagggccaagcccagc

SEQ ID NO: 2489321 - DNA, 14 bp, Homo sapiens
taggggctgggaac

SEQ ID NO: 2489322 - DNA, 14 bp, Homo sapiens
tagggggtccctcc

SEQ ID NO: 2489323 - DNA, 20 bp, Homo sapiens
tagggggtccctccaagtgg

SEQ ID NO: 2489324 - DNA, 16 bp, Homo sapiens
tagggtaaatcagtaa

SEQ ID NO: 2489325 - DNA, 22 bp, Homo sapiens
tagggtaaatcagtaagaggtg

SEQ ID NO: 2489326 - DNA, 15 bp, Homo sapiens
tagggtatattttcc

SEQ ID NO: 2489327 - DNA, 16 bp, Homo sapiens
tagggtggagagccac

SEQ ID NO: 2489328 - DNA, 13 bp, Homo sapiens
taggtctcatctc

SEQ ID NO: 2489329 - DNA, 18 bp, Homo sapiens
taggtctcatctcttcag

SEQ ID NO: 2489330 - DNA, 14 bp, Homo sapiens
taggtctgaaattt

SEQ ID NO: 2489331 - DNA, 18 bp, Homo sapiens
taggtctgaaatttttct

SEQ ID NO: 2489332 - DNA, 15 bp, Homo sapiens
taggttcagccaagg

SEQ ID NO: 2489333 - DNA, 12 bp, Homo sapiens
taggttctaaaa

SEQ ID NO: 2489334 - DNA, 16 bp, Homo sapiens
taggttctaaagttct

SEQ ID NO: 2489335 - DNA, 16 bp, Homo sapiens
taggttgcacactttg

SEQ ID NO: 2489336 - DNA, 14 bp, Homo sapiens
tagtaaataatgct

SEQ ID NO: 2489337 - DNA, 21 bp, Homo sapiens
tagtaaatcacgctttttgaa

SEQ ID NO: 2489338 - DNA, 22 bp, Homo sapiens
tagtaacactaatatatttaaa

SEQ ID NO: 2489339 - DNA, 14 bp, Homo sapiens
tagtaatagcctgg

SEQ ID NO: 2489340 - DNA, 14 bp, Homo sapiens
tagtaatctgcatt

SEQ ID NO: 2489341 - DNA, 21 bp, Homo sapiens
tagtattgttgtccttttcat

SEQ ID NO: 2489342 - DNA, 13 bp, Homo sapiens
tagtcatgtgacc

SEQ ID NO: 2489343 - DNA, 12 bp, Homo sapiens
tagtcctgtgaa

SEQ ID NO: 2489344 - DNA, 15 bp, Homo sapiens
tagtctcagtgaaga

SEQ ID NO: 2489345 - DNA, 11 bp, Homo sapiens
tagtctcagtt

SEQ ID NO: 2489346 - DNA, 13 bp, Homo sapiens
tagtcttttgctt

SEQ ID NO: 2489347 - DNA, 17 bp, Homo sapiens
tagtcttttgcttttgc

SEQ ID NO: 2489348 - DNA, 21 bp, Homo sapiens
tagtcttttgcttttggcaaa

SEQ ID NO: 2489349 - DNA, 12 bp, Homo sapiens
tagtgaatgact

SEQ ID NO: 2489350 - DNA, 15 bp, Homo sapiens
tagtgacccacatgc

SEQ ID NO: 2489351 - DNA, 16 bp, Homo sapiens
tagtgacttgtgtccc

SEQ ID NO: 2489352 - DNA, 19 bp, Homo sapiens
tagtgatcaaattgtgcag

SEQ ID NO: 2489353 - DNA, 12 bp, Homo sapiens
tagtgctttgag

SEQ ID NO: 2489354 - DNA, 19 bp, Homo sapiens
tagttaagacatgatttcc

SEQ ID NO: 2489355 - DNA, 12 bp, Homo sapiens
tagttaccttat

SEQ ID NO: 2489356 - DNA, 19 bp, Homo sapiens
tagttaccttatagttact

SEQ ID NO: 2489357 - DNA, 22 bp, Homo sapiens
tagttaccttatagttactgtg

SEQ ID NO: 2489358 - DNA, 15 bp, Homo sapiens
tagttcatgtaaata

SEQ ID NO: 2489359 - DNA, 16 bp, Homo sapiens
tagttcatgtaaataa

SEQ ID NO: 2489360 - DNA, 21 bp, Homo sapiens
tagttcatgtaaataatacat

SEQ ID NO: 2489361 - DNA, 17 bp, Homo sapiens
tagttcatgtctgctat

SEQ ID NO: 2489362 - DNA, 18 bp, Homo sapiens
tagttccacttatagcct

SEQ ID NO: 2489363 - DNA, 20 bp, Homo sapiens
tagttccacttatagcctct

SEQ ID NO: 2489364 - DNA, 14 bp, Homo sapiens
tagttctaagactc

SEQ ID NO: 2489365 - DNA, 15 bp, Homo sapiens
tagttctaagactca

SEQ ID NO: 2489366 - DNA, 14 bp, Homo sapiens
tagttctagaaaaa

SEQ ID NO: 2489367 - DNA, 15 bp, Homo sapiens
tagttctagaaaaac

SEQ ID NO: 2489368 - DNA, 11 bp, Homo sapiens
tagttctagac

SEQ ID NO: 2489369 - DNA, 16 bp, Homo sapiens
tagttctaggcactgt

SEQ ID NO: 2489370 - DNA, 12 bp, Homo sapiens
tagttgaatttt

SEQ ID NO: 2489371 - DNA, 22 bp, Homo sapiens
tagttgaattttttttaacatt

SEQ ID NO: 2489372 - DNA, 17 bp, Homo sapiens
tagttgtctttcctggc

SEQ ID NO: 2489373 - DNA, 19 bp, Homo sapiens
tagtttcatataaagtatc

SEQ ID NO: 2489374 - DNA, 20 bp, Homo sapiens
tagtttcatataaagtatca

SEQ ID NO: 2489375 - DNA, 13 bp, Homo sapiens
tagtttccttttt

SEQ ID NO: 2489376 - DNA, 14 bp, Homo sapiens
tagtttttcattaa

SEQ ID NO: 2489377 - DNA, 13 bp, Homo sapiens
tagttttttcatc

SEQ ID NO: 2489378 - DNA, 17 bp, Homo sapiens
tagttttttcatcttca

SEQ ID NO: 2489379 - DNA, 21 bp, Homo sapiens
tagttttttcatcttcagttg

SEQ ID NO: 2489380 - DNA, 15 bp, Homo sapiens
tataaaactttcctc

SEQ ID NO: 2489381 - DNA, 19 bp, Homo sapiens
tataaaatagacaaataga

SEQ ID NO: 2489382 - DNA, 15 bp, Homo sapiens
tataaacaagaaaaa

SEQ ID NO: 2489383 - DNA, 22 bp, Homo sapiens
tataaacaagaaaaataaagaa

SEQ ID NO: 2489384 - DNA, 16 bp, Homo sapiens
tataaagtagtcctgt

SEQ ID NO: 2489385 - DNA, 18 bp, Homo sapiens
tataaagtagtcctgtga

SEQ ID NO: 2489386 - DNA, 15 bp, Homo sapiens
tataaatgcaaataa

SEQ ID NO: 2489387 - DNA, 11 bp, Homo sapiens
tataaatgtct

SEQ ID NO: 2489388 - DNA, 19 bp, Homo sapiens
tataaatgtctttaatgca

SEQ ID NO: 2489389 - DNA, 23 bp, Homo sapiens
tataaatgtctttaatgcaatat

SEQ ID NO: 2489390 - DNA, 16 bp, Homo sapiens
tataactggaaagaag

SEQ ID NO: 2489391 - DNA, 23 bp, Homo sapiens
tataactgtatttgaaataagaa

SEQ ID NO: 2489392 - DNA, 15 bp, Homo sapiens
tataagaaagcctga

SEQ ID NO: 2489393 - DNA, 17 bp, Homo sapiens
tataagaagccttaatt

SEQ ID NO: 2489394 - DNA, 12 bp, Homo sapiens
tataagactctc

SEQ ID NO: 2489395 - DNA, 16 bp, Homo sapiens
tataagcatcattatt

SEQ ID NO: 2489396 - DNA, 21 bp, Homo sapiens
tataaggtgctctctttctgt

SEQ ID NO: 2489397 - DNA, 18 bp, Homo sapiens
tataagtgtacatatgtg

SEQ ID NO: 2489398 - DNA, 16 bp, Homo sapiens
tataataaatgtacat

SEQ ID NO: 2489399 - DNA, 22 bp, Homo sapiens
tataatcatcaagtaatacaaa

SEQ ID NO: 2489400 - DNA, 17 bp, Homo sapiens
tataatcattattactt

SEQ ID NO: 2489401 - DNA, 16 bp, Homo sapiens
tataatgaatttagtg

SEQ ID NO: 2489402 - DNA, 13 bp, Homo sapiens
tataattatatgt

SEQ ID NO: 2489403 - DNA, 16 bp, Homo sapiens
tataattctcattaaa

SEQ ID NO: 2489404 - DNA, 14 bp, Homo sapiens
tataatttacctaa

SEQ ID NO: 2489405 - DNA, 18 bp, Homo sapiens
tataatttacctaagatt

SEQ ID NO: 2489406 - DNA, 19 bp, Homo sapiens
tataccagtataattgagt

SEQ ID NO: 2489407 - DNA, 20 bp, Homo sapiens
tatacgcagcgtgctttaaa

SEQ ID NO: 2489408 - DNA, 21 bp, Homo sapiens
tatactattaaaaaggtttac

SEQ ID NO: 2489409 - DNA, 19 bp, Homo sapiens
tatactctttctgtatata

SEQ ID NO: 2489410 - DNA, 16 bp, Homo sapiens
tatacttgaatgaaaa

SEQ ID NO: 2489411 - DNA, 14 bp, Homo sapiens
tatacttgtaatta

SEQ ID NO: 2489412 - DNA, 16 bp, Homo sapiens
tatactttccctaccc

SEQ ID NO: 2489413 - DNA, 11 bp, Homo sapiens
tatactttttt

SEQ ID NO: 2489414 - DNA, 18 bp, Homo sapiens
tatagaactgaatgagaa

SEQ ID NO: 2489415 - DNA, 23 bp, Homo sapiens
tatagatgggggaaagcaaagca

SEQ ID NO: 2489416 - DNA, 18 bp, Homo sapiens
tatagatgtcttttccca

SEQ ID NO: 2489417 - DNA, 12 bp, Homo sapiens
tatagattctaa

SEQ ID NO: 2489418 - DNA, 19 bp, Homo sapiens
tatagccaaaaatagctaa

SEQ ID NO: 2489419 - DNA, 14 bp, Homo sapiens
tatagccaatataa

SEQ ID NO: 2489420 - DNA, 17 bp, Homo sapiens
tatagctgcttccagtg

SEQ ID NO: 2489421 - DNA, 23 bp, Homo sapiens
tagatcagatgctccaagattct

SEQ ID NO: 2489422 - DNA, 14 bp, Homo sapiens
tagatcataaggct

SEQ ID NO: 2489423 - DNA, 21 bp, Homo sapiens
tagatcataaggcttcaaaat

SEQ ID NO: 2489424 - DNA, 16 bp, Homo sapiens
tagatgaagttttaca

SEQ ID NO: 2489425 - DNA, 21 bp, Homo sapiens
tagatgattaaataagattct

SEQ ID NO: 2489426 - DNA, 23 bp, Homo sapiens
tagatgattaaataagattctaa

SEQ ID NO: 2489427 - DNA, 18 bp, Homo sapiens
tagatgatttcagttcta

SEQ ID NO: 2489428 - DNA, 21 bp, Homo sapiens
tagatgcatttgggtccagga

SEQ ID NO: 2489429 - DNA, 22 bp, Homo sapiens
tagatgcatttgggtccaggag

SEQ ID NO: 2489430 - DNA, 14 bp, Homo sapiens
tagatgctggccca

SEQ ID NO: 2489431 - DNA, 18 bp, Homo sapiens
tagatgctggcccagggc

SEQ ID NO: 2489432 - DNA, 17 bp, Homo sapiens
tagatgtagtatttttt

SEQ ID NO: 2489433 - DNA, 17 bp, Homo sapiens
tagattcaaaggttcta

SEQ ID NO: 2489434 - DNA, 12 bp, Homo sapiens
tagattctaaag

SEQ ID NO: 2489435 - DNA, 15 bp, Homo sapiens
tagattctaaagatt

SEQ ID NO: 2489436 - DNA, 20 bp, Homo sapiens
tagattctctgtgtctaaga

SEQ ID NO: 2489437 - DNA, 22 bp, Homo sapiens
tagattctctgtgtctaagatt

SEQ ID NO: 2489438 - DNA, 12 bp, Homo sapiens
tagattgcagaa

SEQ ID NO: 2489439 - DNA, 23 bp, Homo sapiens
tagattgtccttttgcaaagaaa

SEQ ID NO: 2489440 - DNA, 16 bp, Homo sapiens
tagatttaatataaag

SEQ ID NO: 2489441 - DNA, 11 bp, Homo sapiens
tagatttatgg

SEQ ID NO: 2489442 - DNA, 23 bp, Homo sapiens
tagatttcatagttcagaattta

SEQ ID NO: 2489443 - DNA, 20 bp, Homo sapiens
tagatttggctcctctgctt

SEQ ID NO: 2489444 - DNA, 22 bp, Homo sapiens
tagatttgtgtgcatcaggctt

SEQ ID NO: 2489445 - DNA, 15 bp, Homo sapiens
tagattttacatgaa

SEQ ID NO: 2489446 - DNA, 17 bp, Homo sapiens
tagattttacatgaagt

SEQ ID NO: 2489447 - DNA, 18 bp, Homo sapiens
tagattttacatgaagta

SEQ ID NO: 2489448 - DNA, 20 bp, Homo sapiens
tagattttacatgaagtatt

SEQ ID NO: 2489449 - DNA, 13 bp, Homo sapiens
tagattttctgct

SEQ ID NO: 2489450 - DNA, 21 bp, Homo sapiens
tagattttctggttctaacat

SEQ ID NO: 2489451 - DNA, 22 bp, Homo sapiens
tagattttctggttctaacatt

SEQ ID NO: 2489452 - DNA, 14 bp, Homo sapiens
tagcaaaagaagaa

SEQ ID NO: 2489453 - DNA, 16 bp, Homo sapiens
tagcaaaagaagaagt

SEQ ID NO: 2489454 - DNA, 19 bp, Homo sapiens
tagcagacaggccccgtga

SEQ ID NO: 2489455 - DNA, 16 bp, Homo sapiens
tagcagtccccttccc

SEQ ID NO: 2489456 - DNA, 16 bp, Homo sapiens
tagcagtggcaggcag

SEQ ID NO: 2489457 - DNA, 23 bp, Homo sapiens
tagcatgcttgttgcaattgcct

SEQ ID NO: 2489458 - DNA, 16 bp, Homo sapiens
tagccaaaaatagcta

SEQ ID NO: 2489459 - DNA, 17 bp, Homo sapiens
tagccacaccaggatag

SEQ ID NO: 2489460 - DNA, 20 bp, Homo sapiens
tagccacatttggaatactt

SEQ ID NO: 2489461 - DNA, 21 bp, Homo sapiens
tagccactaaccttgcctggt

SEQ ID NO: 2489462 - DNA, 19 bp, Homo sapiens
tagccagcacacagggcag

SEQ ID NO: 2489463 - DNA, 20 bp, Homo sapiens
tagccagcacacagggcagt

SEQ ID NO: 2489464 - DNA, 15 bp, Homo sapiens
tagccatatttgtaa

SEQ ID NO: 2489465 - DNA, 22 bp, Homo sapiens
tagccatatttgtaaaatgaca

SEQ ID NO: 2489466 - DNA, 23 bp, Homo sapiens
tagccatatttgtaaaatgacaa

SEQ ID NO: 2489467 - DNA, 14 bp, Homo sapiens
tagccctgtcctgg

SEQ ID NO: 2489468 - DNA, 22 bp, Homo sapiens
tagccctgtcctggtggtattt

SEQ ID NO: 2489469 - DNA, 21 bp, Homo sapiens
tagcctaaggctcctgttttg

SEQ ID NO: 2489470 - DNA, 12 bp, Homo sapiens
tagcctcagggg

SEQ ID NO: 2489471 - DNA, 16 bp, Homo sapiens
tagcctctgtctggca

SEQ ID NO: 2489472 - DNA, 17 bp, Homo sapiens
tagcctggacctctgac

SEQ ID NO: 2489473 - DNA, 11 bp, Homo sapiens
tagcctgtcct

SEQ ID NO: 2489474 - DNA, 14 bp, Homo sapiens
tagcctgtcctgtc

SEQ ID NO: 2489475 - DNA, 15 bp, Homo sapiens
tagcgttcttgtaat

SEQ ID NO: 2489476 - DNA, 18 bp, Homo sapiens
tagcgttcttgtaatttt

SEQ ID NO: 2489477 - DNA, 18 bp, Homo sapiens
tagctaaacggattccaa

SEQ ID NO: 2489478 - DNA, 22 bp, Homo sapiens
tagctaataaaaagcttttgtc

SEQ ID NO: 2489479 - DNA, 11 bp, Homo sapiens
tagctacagag

SEQ ID NO: 2489480 - DNA, 12 bp, Homo sapiens
tagctacagaga

SEQ ID NO: 2489481 - DNA, 14 bp, Homo sapiens
tagctacagagaaa

SEQ ID NO: 2489482 - DNA, 21 bp, Homo sapiens
tagctacagagaaaccagctt

SEQ ID NO: 2489483 - DNA, 15 bp, Homo sapiens
tagctcaatgagcat

SEQ ID NO: 2489484 - DNA, 15 bp, Homo sapiens
tagctcaattagtgt

SEQ ID NO: 2489485 - DNA, 13 bp, Homo sapiens
tagctctgagaac

SEQ ID NO: 2489486 - DNA, 23 bp, Homo sapiens
tagctctggggtgggcagttttt

SEQ ID NO: 2489487 - DNA, 19 bp, Homo sapiens
tagctgaatgtttttctaa

SEQ ID NO: 2489488 - DNA, 15 bp, Homo sapiens
tagctgggattacag

SEQ ID NO: 2489489 - DNA, 17 bp, Homo sapiens
tagctgtgacctgctga

SEQ ID NO: 2489490 - DNA, 19 bp, Homo sapiens
tagctgtgacctgctgagc

SEQ ID NO: 2489491 - DNA, 24 bp, Homo sapiens
tagctgtgacctgctgagctctga

SEQ ID NO: 2489492 - DNA, 22 bp, Homo sapiens
tagctgtgtgaatacctgctca

SEQ ID NO: 2489493 - DNA, 16 bp, Homo sapiens
tagcttatgaaaagaa

SEQ ID NO: 2489494 - DNA, 17 bp, Homo sapiens
taggaagaaagaagaca

SEQ ID NO: 2489495 - DNA, 19 bp, Homo sapiens
taggaagaaagaagacaaa

SEQ ID NO: 2489496 - DNA, 21 bp, Homo sapiens
taggaagagccttccacccag

SEQ ID NO: 2489497 - DNA, 23 bp, Homo sapiens
taggaatagcatgtcactaaagc

SEQ ID NO: 2489498 - DNA, 23 bp, Homo sapiens
taggaccatggttaagagtccaa

SEQ ID NO: 2489499 - DNA, 21 bp, Homo sapiens
taggacctttccaccacagcc

SEQ ID NO: 2489500 - DNA, 17 bp, Homo sapiens
taggagaaccaaatctg

SEQ ID NO: 2489501 - DNA, 12 bp, Homo sapiens
taggagaagcca

SEQ ID NO: 2489502 - DNA, 13 bp, Homo sapiens
taggagctaaggc

SEQ ID NO: 2489503 - DNA, 20 bp, Homo sapiens
taggaggaccagagctactg

SEQ ID NO: 2489504 - DNA, 23 bp, Homo sapiens
taggagggactgtcgctgcttcg

SEQ ID NO: 2489505 - DNA, 14 bp, Homo sapiens
taggagggagacac

SEQ ID NO: 2489506 - DNA, 22 bp, Homo sapiens
taggatttatttaaaatagcaa

SEQ ID NO: 2489507 - DNA, 22 bp, Homo sapiens
taggattttttttaatgtttaa

SEQ ID NO: 2489508 - DNA, 22 bp, Homo sapiens
taggcagactctttatgcttgc

SEQ ID NO: 2489509 - DNA, 20 bp, Homo sapiens
taggcattctggacctctgg

SEQ ID NO: 2489510 - DNA, 19 bp, Homo sapiens
taggcatttttaccatcac

SEQ ID NO: 2489511 - DNA, 18 bp, Homo sapiens
taggccaaggtgtcctac

SEQ ID NO: 2489512 - DNA, 22 bp, Homo sapiens
taggccaaggtgtcctacagaa

SEQ ID NO: 2489513 - DNA, 14 bp, Homo sapiens
taggccagagccca

SEQ ID NO: 2489514 - DNA, 16 bp, Homo sapiens
taggccagcaggggct

SEQ ID NO: 2489515 - DNA, 14 bp, Homo sapiens
taggcccccacttg

SEQ ID NO: 2489516 - DNA, 20 bp, Homo sapiens
taggccttgcggctcctcag

SEQ ID NO: 2489517 - DNA, 21 bp, Homo sapiens
taggccttgcggctcctcagg

SEQ ID NO: 2489518 - DNA, 19 bp, Homo sapiens
taggcggggcttgccttct

SEQ ID NO: 2489519 - DNA, 14 bp, Homo sapiens
taggctacagagaa

SEQ ID NO: 2489520 - DNA, 19 bp, Homo sapiens
taggctgacacctaactct

SEQ ID NO: 2489521 - DNA, 13 bp, Homo sapiens
tagggaacaattt

SEQ ID NO: 2489522 - DNA, 14 bp, Homo sapiens
tagggaagggcctg

SEQ ID NO: 2489523 - DNA, 14 bp, Homo sapiens
tagggactgaccag

SEQ ID NO: 2489524 - DNA, 15 bp, Homo sapiens
tagggactgaccagc

SEQ ID NO: 2489525 - DNA, 21 bp, Homo sapiens
tactgctgagatacatacaga

SEQ ID NO: 2489526 - DNA, 18 bp, Homo sapiens
tactggcctttttcattt

SEQ ID NO: 2489527 - DNA, 13 bp, Homo sapiens
tactgggaaggct

SEQ ID NO: 2489528 - DNA, 19 bp, Homo sapiens
tactggggaaactggccat

SEQ ID NO: 2489529 - DNA, 22 bp, Homo sapiens
tactggggaaactggccatggc

SEQ ID NO: 2489530 - DNA, 16 bp, Homo sapiens
tactgtaacattcagg

SEQ ID NO: 2489531 - DNA, 19 bp, Homo sapiens
tactgtacagctggctcta

SEQ ID NO: 2489532 - DNA, 17 bp, Homo sapiens
tactgtgtgtgtgaatg

SEQ ID NO: 2489533 - DNA, 22 bp, Homo sapiens
tactgtgtgtgtgaatgaacac

SEQ ID NO: 2489534 - DNA, 12 bp, Homo sapiens
tactgttctaaa

SEQ ID NO: 2489535 - DNA, 14 bp, Homo sapiens
tactgttgcacgtg

SEQ ID NO: 2489536 - DNA, 23 bp, Homo sapiens
tactgttgcacgtgtgtttttct

SEQ ID NO: 2489537 - DNA, 17 bp, Homo sapiens
tacttccccatggccct

SEQ ID NO: 2489538 - DNA, 14 bp, Homo sapiens
tacttcctcctccc

SEQ ID NO: 2489539 - DNA, 18 bp, Homo sapiens
tacttcgacactgttctt

SEQ ID NO: 2489540 - DNA, 13 bp, Homo sapiens
tacttctgaggta

SEQ ID NO: 2489541 - DNA, 24 bp, Homo sapiens
tacttgaacgttttctaattgctt

SEQ ID NO: 2489542 - DNA, 20 bp, Homo sapiens
tacttgaagggccagagcca

SEQ ID NO: 2489543 - DNA, 21 bp, Homo sapiens
tacttgaagggccagagccag

SEQ ID NO: 2489544 - DNA, 21 bp, Homo sapiens
tacttgggagacctgtaatca

SEQ ID NO: 2489545 - DNA, 23 bp, Homo sapiens
tacttgggagacctgtaatcata

SEQ ID NO: 2489546 - DNA, 14 bp, Homo sapiens
tacttgtaaatata

SEQ ID NO: 2489547 - DNA, 19 bp, Homo sapiens
tacttgtaaatataaagac

SEQ ID NO: 2489548 - DNA, 20 bp, Homo sapiens
tacttgtaaatataaagacg

SEQ ID NO: 2489549 - DNA, 14 bp, Homo sapiens
tactttccctctgg

SEQ ID NO: 2489550 - DNA, 16 bp, Homo sapiens
tactttccctctggga

SEQ ID NO: 2489551 - DNA, 20 bp, Homo sapiens
tactttccctctgggatttg

SEQ ID NO: 2489552 - DNA, 13 bp, Homo sapiens
tactttgaatgtg

SEQ ID NO: 2489553 - DNA, 15 bp, Homo sapiens
tactttgacagtgtt

SEQ ID NO: 2489554 - DNA, 22 bp, Homo sapiens
tactttggtggccacataagcc

SEQ ID NO: 2489555 - DNA, 16 bp, Homo sapiens
tactttttatatatat

SEQ ID NO: 2489556 - DNA, 15 bp, Homo sapiens
tagaaaaacaggcac

SEQ ID NO: 2489557 - DNA, 16 bp, Homo sapiens
tagaaacagtgcaaca

SEQ ID NO: 2489558 - DNA, 15 bp, Homo sapiens
tagaaagaccaggcc

SEQ ID NO: 2489559 - DNA, 16 bp, Homo sapiens
tagaaataaagcatct

SEQ ID NO: 2489560 - DNA, 20 bp, Homo sapiens
tagaaataaaggatgtgatt

SEQ ID NO: 2489561 - DNA, 14 bp, Homo sapiens
tagaaatattttaa

SEQ ID NO: 2489562 - DNA, 20 bp, Homo sapiens
tagaaatattttaaaatcag

SEQ ID NO: 2489563 - DNA, 13 bp, Homo sapiens
tagaaatcatttt

SEQ ID NO: 2489564 - DNA, 16 bp, Homo sapiens
tagaaatcattttgca

SEQ ID NO: 2489565 - DNA, 17 bp, Homo sapiens
tagaaatcattttgcaa

SEQ ID NO: 2489566 - DNA, 15 bp, Homo sapiens
tagaacactaattca

SEQ ID NO: 2489567 - DNA, 19 bp, Homo sapiens
tagaacactaattcataat

SEQ ID NO: 2489568 - DNA, 21 bp, Homo sapiens
tagaactcaacctctacaggg

SEQ ID NO: 2489569 - DNA, 19 bp, Homo sapiens
tagaactctgaaatgaaga

SEQ ID NO: 2489570 - DNA, 17 bp, Homo sapiens
tagaagtataaagaatt

SEQ ID NO: 2489571 - DNA, 19 bp, Homo sapiens
tagaagtataaagaattgt

SEQ ID NO: 2489572 - DNA, 21 bp, Homo sapiens
tagaataaaggcagttttcta

SEQ ID NO: 2489573 - DNA, 18 bp, Homo sapiens
tagaatcccagccccctg

SEQ ID NO: 2489574 - DNA, 22 bp, Homo sapiens
tagaatcccagccccctgacca

SEQ ID NO: 2489575 - DNA, 18 bp, Homo sapiens
tagaatctgcaattcaaa

SEQ ID NO: 2489576 - DNA, 22 bp, Homo sapiens
tagaattataactgtaaagatg

SEQ ID NO: 2489577 - DNA, 16 bp, Homo sapiens
tagaattatctaattt

SEQ ID NO: 2489578 - DNA, 21 bp, Homo sapiens
tagaattatctaatttataaa

SEQ ID NO: 2489579 - DNA, 15 bp, Homo sapiens
tagaattatttaaac

SEQ ID NO: 2489580 - DNA, 17 bp, Homo sapiens
tagaattgagtgtttaa

SEQ ID NO: 2489581 - DNA, 20 bp, Homo sapiens
tagaattgagtgtttaaagt

SEQ ID NO: 2489582 - DNA, 14 bp, Homo sapiens
tagaattgcattga

SEQ ID NO: 2489583 - DNA, 13 bp, Homo sapiens
tagaattgtatat

SEQ ID NO: 2489584 - DNA, 19 bp, Homo sapiens
tagacaaatagaaaatggt

SEQ ID NO: 2489585 - DNA, 14 bp, Homo sapiens
tagacaagccagaa

SEQ ID NO: 2489586 - DNA, 15 bp, Homo sapiens
tagacaagccagaac

SEQ ID NO: 2489587 - DNA, 20 bp, Homo sapiens
tagacacatgaaggtaaata

SEQ ID NO: 2489588 - DNA, 18 bp, Homo sapiens
tagacaccaaagttctaa

SEQ ID NO: 2489589 - DNA, 15 bp, Homo sapiens
tagacactttggaag

SEQ ID NO: 2489590 - DNA, 14 bp, Homo sapiens
tagacagaacacct

SEQ ID NO: 2489591 - DNA, 15 bp, Homo sapiens
tagacagaacaccta

SEQ ID NO: 2489592 - DNA, 14 bp, Homo sapiens
tagacagaagaaac

SEQ ID NO: 2489593 - DNA, 15 bp, Homo sapiens
tagacagaagaaaca

SEQ ID NO: 2489594 - DNA, 19 bp, Homo sapiens
tagacagaggccctcaagt

SEQ ID NO: 2489595 - DNA, 17 bp, Homo sapiens
tagacatggaggttcta

SEQ ID NO: 2489596 - DNA, 18 bp, Homo sapiens
tagacatggaggttctaa

SEQ ID NO: 2489597 - DNA, 22 bp, Homo sapiens
tagacatggaggttctaaggcc

SEQ ID NO: 2489598 - DNA, 22 bp, Homo sapiens
tagaccagcagacagagccagg

SEQ ID NO: 2489599 - DNA, 12 bp, Homo sapiens
tagacctacagg

SEQ ID NO: 2489600 - DNA, 16 bp, Homo sapiens
tagacctccagctgtt

SEQ ID NO: 2489601 - DNA, 19 bp, Homo sapiens
tagaccttgttacttctga

SEQ ID NO: 2489602 - DNA, 17 bp, Homo sapiens
tagactgtgattcagaa

SEQ ID NO: 2489603 - DNA, 21 bp, Homo sapiens
tagactttaacataagctatt

SEQ ID NO: 2489604 - DNA, 15 bp, Homo sapiens
tagagaagacaggct

SEQ ID NO: 2489605 - DNA, 19 bp, Homo sapiens
tagagaagtatacataagt

SEQ ID NO: 2489606 - DNA, 18 bp, Homo sapiens
tagagactggaacactag

SEQ ID NO: 2489607 - DNA, 16 bp, Homo sapiens
tagagcactgccacca

SEQ ID NO: 2489608 - DNA, 17 bp, Homo sapiens
tagagcactgccaccag

SEQ ID NO: 2489609 - DNA, 17 bp, Homo sapiens
tagagcaggactgatgt

SEQ ID NO: 2489610 - DNA, 23 bp, Homo sapiens
tagagcaggactgatgtctccta

SEQ ID NO: 2489611 - DNA, 18 bp, Homo sapiens
tagagccgggtgtcccca

SEQ ID NO: 2489612 - DNA, 21 bp, Homo sapiens
tagagccgggtgtccccaaca

SEQ ID NO: 2489613 - DNA, 14 bp, Homo sapiens
tagagcctgaggga

SEQ ID NO: 2489614 - DNA, 22 bp, Homo sapiens
tagaggatggtcttacagcagg

SEQ ID NO: 2489615 - DNA, 17 bp, Homo sapiens
tagagtagaagtctctt

SEQ ID NO: 2489616 - DNA, 16 bp, Homo sapiens
tagagtccaaggttta

SEQ ID NO: 2489617 - DNA, 20 bp, Homo sapiens
tagagtcccaggttggctct

SEQ ID NO: 2489618 - DNA, 14 bp, Homo sapiens
tagagttgctgaga

SEQ ID NO: 2489619 - DNA, 19 bp, Homo sapiens
tagataaaacatctttgaa

SEQ ID NO: 2489620 - DNA, 15 bp, Homo sapiens
tagatagccctgtcc

SEQ ID NO: 2489621 - DNA, 17 bp, Homo sapiens
tagatagccctgtcctg

SEQ ID NO: 2489622 - DNA, 23 bp, Homo sapiens
tagatagccctgtcctggtggta

SEQ ID NO: 2489623 - DNA, 20 bp, Homo sapiens
tagataggaagaaagaagac

SEQ ID NO: 2489624 - DNA, 17 bp, Homo sapiens
tagatagttagaacctg

SEQ ID NO: 2489625 - DNA, 23 bp, Homo sapiens
tagatatcgacttgtttttgcac

SEQ ID NO: 2489626 - DNA, 16 bp, Homo sapiens
tagatattggacaaag

SEQ ID NO: 2489627 - DNA, 14 bp, Homo sapiens
tagatcagatgctc

SEQ ID NO: 2489628 - DNA, 19 bp, Homo sapiens
tagatcagatgctccaaga

SEQ ID NO: 2489629 - DNA, 18 bp, Homo sapiens
taaaagcaaaaaagaaaa

SEQ ID NO: 2489630 - DNA, 20 bp, Homo sapiens
taaaagcaaaaaagaaaacc

SEQ ID NO: 2489631 - DNA, 23 bp, Homo sapiens
taaaagcaaaaaagaaaaccttt

SEQ ID NO: 2489632 - DNA, 14 bp, Homo sapiens
taaaagcaaatcat

SEQ ID NO: 2489633 - DNA, 14 bp, Homo sapiens
taaaagcattttgt

SEQ ID NO: 2489634 - DNA, 16 bp, Homo sapiens
taaaagcattttgtaa

SEQ ID NO: 2489635 - DNA, 17 bp, Homo sapiens
taaaagcattttgtaat

SEQ ID NO: 2489636 - DNA, 12 bp, Homo sapiens
taaaagcctgct

SEQ ID NO: 2489637 - DNA, 14 bp, Homo sapiens
taaaagcctgctca

SEQ ID NO: 2489638 - DNA, 19 bp, Homo sapiens
taaaagtgggcttgattct

SEQ ID NO: 2489639 - DNA, 18 bp, Homo sapiens
taaaataattatataact

SEQ ID NO: 2489640 - DNA, 16 bp, Homo sapiens
taaaataattctgagt

SEQ ID NO: 2489641 - DNA, 15 bp, Homo sapiens
taaaataattttgta

SEQ ID NO: 2489642 - DNA, 16 bp, Homo sapiens
taaaataattttgtaa

SEQ ID NO: 2489643 - DNA, 18 bp, Homo sapiens
taaaatacaagactgcca

SEQ ID NO: 2489644 - DNA, 19 bp, Homo sapiens
taaaatacttttactctgc

SEQ ID NO: 2489645 - DNA, 17 bp, Homo sapiens
taaaatagcaaaagaag

SEQ ID NO: 2489646 - DNA, 17 bp, Homo sapiens
taaaatagcgttcttgt

SEQ ID NO: 2489647 - DNA, 19 bp, Homo sapiens
taaaatatgaagacataaa

SEQ ID NO: 2489648 - DNA, 14 bp, Homo sapiens
taaaatctgtcacg

SEQ ID NO: 2489649 - DNA, 14 bp, Homo sapiens
taaaatcttgtcat

SEQ ID NO: 2489650 - DNA, 16 bp, Homo sapiens
taaaatcttgtcatgt

SEQ ID NO: 2489651 - DNA, 20 bp, Homo sapiens
taaaatcttgtcatgtgtat

SEQ ID NO: 2489652 - DNA, 23 bp, Homo sapiens
taaaatcttgtcatgtgtataaa

SEQ ID NO: 2489653 - DNA, 14 bp, Homo sapiens
taaaatgacaatca

SEQ ID NO: 2489654 - DNA, 18 bp, Homo sapiens
taaaatgacaatcatgtg

SEQ ID NO: 2489655 - DNA, 19 bp, Homo sapiens
taaaatgacaatcatgtgt

SEQ ID NO: 2489656 - DNA, 16 bp, Homo sapiens
taaaatgattgtagta

SEQ ID NO: 2489657 - DNA, 17 bp, Homo sapiens
taaaatgctaggttcta

SEQ ID NO: 2489658 - DNA, 14 bp, Homo sapiens
taaaatgtaagatt

SEQ ID NO: 2489659 - DNA, 17 bp, Homo sapiens
taaaatgtatgcatgtt

SEQ ID NO: 2489660 - DNA, 19 bp, Homo sapiens
taaaatgtatgcatgttgt

SEQ ID NO: 2489661 - DNA, 18 bp, Homo sapiens
taaaatgtgggattatgg

SEQ ID NO: 2489662 - DNA, 23 bp, Homo sapiens
taaaatgtgggattatgggtcac

SEQ ID NO: 2489663 - DNA, 22 bp, Homo sapiens
taaaattgatttttctcttcat

SEQ ID NO: 2489664 - DNA, 14 bp, Homo sapiens
taaaatttgttgca

SEQ ID NO: 2489665 - DNA, 15 bp, Homo sapiens
taaaatttgttgcat

SEQ ID NO: 2489666 - DNA, 19 bp, Homo sapiens
taaacaaactgtgtaactg

SEQ ID NO: 2489667 - DNA, 22 bp, Homo sapiens
taaacaaactgtgtaactgccc

SEQ ID NO: 2489668 - DNA, 20 bp, Homo sapiens
taaacaagaaaaataaagaa

SEQ ID NO: 2489669 - DNA, 13 bp, Homo sapiens
taaacaagtattt

SEQ ID NO: 2489670 - DNA, 15 bp, Homo sapiens
taaacatcattcatt

SEQ ID NO: 2489671 - DNA, 17 bp, Homo sapiens
taaacatcattcatttt

SEQ ID NO: 2489672 - DNA, 21 bp, Homo sapiens
taaacattaatagcagccttt

SEQ ID NO: 2489673 - DNA, 22 bp, Homo sapiens
taaaccatctccctggtgctta

SEQ ID NO: 2489674 - DNA, 20 bp, Homo sapiens
taaaccccacctttattcct

SEQ ID NO: 2489675 - DNA, 20 bp, Homo sapiens
taaacgatttttaaaatgta

SEQ ID NO: 2489676 - DNA, 21 bp, Homo sapiens
taaacgatttttaaaatgtac

SEQ ID NO: 2489677 - DNA, 16 bp, Homo sapiens
taaactaataattgca

SEQ ID NO: 2489678 - DNA, 17 bp, Homo sapiens
taaactataagcaagaa

SEQ ID NO: 2489679 - DNA, 14 bp, Homo sapiens
taaactggagactg

SEQ ID NO: 2489680 - DNA, 23 bp, Homo sapiens
taaactggagactgtgtgtgccc

SEQ ID NO: 2489681 - DNA, 12 bp, Homo sapiens
taaactgtacag

SEQ ID NO: 2489682 - DNA, 18 bp, Homo sapiens
taaactgtacagtgtctt

SEQ ID NO: 2489683 - DNA, 19 bp, Homo sapiens
taaactgtacagtgtcttt

SEQ ID NO: 2489684 - DNA, 17 bp, Homo sapiens
taaacttttaattcatt

SEQ ID NO: 2489685 - DNA, 16 bp, Homo sapiens
taaactttttttctgt

SEQ ID NO: 2489686 - DNA, 15 bp, Homo sapiens
taaagaaaaaaattg

SEQ ID NO: 2489687 - DNA, 17 bp, Homo sapiens
taaagaaaaaaattgaa

SEQ ID NO: 2489688 - DNA, 14 bp, Homo sapiens
taaagaaaaacaaa

SEQ ID NO: 2489689 - DNA, 11 bp, Homo sapiens
taaagaaagtg

SEQ ID NO: 2489690 - DNA, 13 bp, Homo sapiens
taaagaaagtgta

SEQ ID NO: 2489691 - DNA, 14 bp, Homo sapiens
taaagaaagtgtat

SEQ ID NO: 2489692 - DNA, 15 bp, Homo sapiens
taaagaaagtgtatt

SEQ ID NO: 2489693 - DNA, 17 bp, Homo sapiens
taaagaaagtgtatttg

SEQ ID NO: 2489694 - DNA, 24 bp, Homo sapiens
taaagaaagtgtatttggaaataa

SEQ ID NO: 2489695 - DNA, 11 bp, Homo sapiens
taaagaagacc

SEQ ID NO: 2489696 - DNA, 16 bp, Homo sapiens
taaagaattattttgt

SEQ ID NO: 2489697 - DNA, 18 bp, Homo sapiens
taaagaattgtggtttat

SEQ ID NO: 2489698 - DNA, 15 bp, Homo sapiens
taaagactggctttt

SEQ ID NO: 2489699 - DNA, 22 bp, Homo sapiens
taaagagacagtgatattggaa

SEQ ID NO: 2489700 - DNA, 21 bp, Homo sapiens
taaagagtctagattcaaagg

SEQ ID NO: 2489701 - DNA, 19 bp, Homo sapiens
taaagatgagctttgtcta

SEQ ID NO: 2489702 - DNA, 19 bp, Homo sapiens
taaagatggagtttctaag

SEQ ID NO: 2489703 - DNA, 24 bp, Homo sapiens
taaagattctatagttctagacat

SEQ ID NO: 2489704 - DNA, 17 bp, Homo sapiens
taaagcaatatgcattt

SEQ ID NO: 2489705 - DNA, 17 bp, Homo sapiens
taaagcagtatttttct

SEQ ID NO: 2489706 - DNA, 11 bp, Homo sapiens
taaagcattta

SEQ ID NO: 2489707 - DNA, 12 bp, Homo sapiens
taaagcctcctc

SEQ ID NO: 2489708 - DNA, 15 bp, Homo sapiens
taaagcgtttgcaca

SEQ ID NO: 2489709 - DNA, 15 bp, Homo sapiens
taaagctggtttaat

SEQ ID NO: 2489710 - DNA, 19 bp, Homo sapiens
taaagctttcagaatatgt

SEQ ID NO: 2489711 - DNA, 16 bp, Homo sapiens
taaaggaaaagacaca

SEQ ID NO: 2489712 - DNA, 15 bp, Homo sapiens
taaaggagtttatgt

SEQ ID NO: 2489713 - DNA, 17 bp, Homo sapiens
taaaggagtttatgttc

SEQ ID NO: 2489714 - DNA, 16 bp, Homo sapiens
taaaggatgtgattgt

SEQ ID NO: 2489715 - DNA, 22 bp, Homo sapiens
taaaggatgtgattgtggaatg

SEQ ID NO: 2489716 - DNA, 15 bp, Homo sapiens
taaagtacttgtagt

SEQ ID NO: 2489717 - DNA, 19 bp, Homo sapiens
taaagtatgtattatttac

SEQ ID NO: 2489718 - DNA, 21 bp, Homo sapiens
taaagtatgtattatttacat

SEQ ID NO: 2489719 - DNA, 22 bp, Homo sapiens
taaagtattcaacaatttcaat

SEQ ID NO: 2489720 - DNA, 13 bp, Homo sapiens
taaagtattcttc

SEQ ID NO: 2489721 - DNA, 17 bp, Homo sapiens
taaagtcagatggaaaa

SEQ ID NO: 2489722 - DNA, 19 bp, Homo sapiens
taaagtgactaatggcatg

SEQ ID NO: 2489723 - DNA, 21 bp, Homo sapiens
taaagtgctaaggttctaagg

SEQ ID NO: 2489724 - DNA, 22 bp, Homo sapiens
taaagtgctaaggttctaaggc

SEQ ID NO: 2489725 - DNA, 14 bp, Homo sapiens
taaagttaagttga

SEQ ID NO: 2489726 - DNA, 18 bp, Homo sapiens
taaagttcaacatgttat

SEQ ID NO: 2489727 - DNA, 14 bp, Homo sapiens
taaagttctaagat

SEQ ID NO: 2489728 - DNA, 18 bp, Homo sapiens
taaagttttatatattat

SEQ ID NO: 2489729 - DNA, 23 bp, Homo sapiens
taaagttttatatattatatgga

SEQ ID NO: 2489730 - DNA, 16 bp, Homo sapiens
taaataaaaagaaagg

SEQ ID NO: 2489731 - DNA, 21 bp, Homo sapiens
taaataaaatgctaggttcta

SEQ ID NO: 2489732 - DNA, 13 bp, Homo sapiens
taaataaaatttg

SEQ ID NO: 2489733 - DNA, 13 bp, Homo sapiens
taaataaatttga

SEQ ID NO: 2489734 - DNA, 19 bp, Homo sapiens
gtggattgcacgtggcctc

SEQ ID NO: 2489735 - DNA, 12 bp, Homo sapiens
gtggcacaggcc

SEQ ID NO: 2489736 - DNA, 16 bp, Homo sapiens
gtggcagcccagccag

SEQ ID NO: 2489737 - DNA, 18 bp, Homo sapiens
gtggcagcccagccagcg

SEQ ID NO: 2489738 - DNA, 12 bp, Homo sapiens
gtggcaggcaga

SEQ ID NO: 2489739 - DNA, 23 bp, Homo sapiens
gtggcaggcagaggcccaggctg

SEQ ID NO: 2489740 - DNA, 10 bp, Homo sapiens
gtggccaggc

SEQ ID NO: 2489741 - DNA, 23 bp, Homo sapiens
gtggccccgtttctggtggtctg

SEQ ID NO: 2489742 - DNA, 14 bp, Homo sapiens
gtggccctctcccc

SEQ ID NO: 2489743 - DNA, 23 bp, Homo sapiens
gtggcccttatgactgccaagac

SEQ ID NO: 2489744 - DNA, 21 bp, Homo sapiens
gtggcccttcctggacagctg

SEQ ID NO: 2489745 - DNA, 23 bp, Homo sapiens
gtggcctcagctcccacaagcct

SEQ ID NO: 2489746 - DNA, 17 bp, Homo sapiens
gtggcctcttgagcagt

SEQ ID NO: 2489747 - DNA, 21 bp, Homo sapiens
gtggcctcttgagcagtggct

SEQ ID NO: 2489748 - DNA, 20 bp, Homo sapiens
gtggccttgttctgtcacca

SEQ ID NO: 2489749 - DNA, 16 bp, Homo sapiens
gtggctactctgtgcc

SEQ ID NO: 2489750 - DNA, 21 bp, Homo sapiens
gtggctactctgtgccagagc

SEQ ID NO: 2489751 - DNA, 17 bp, Homo sapiens
gtggctggaagatcctg

SEQ ID NO: 2489752 - DNA, 15 bp, Homo sapiens
gtggctggtccaggg

SEQ ID NO: 2489753 - DNA, 22 bp, Homo sapiens
gtgggacagcttgtaggggagg

SEQ ID NO: 2489754 - DNA, 17 bp, Homo sapiens
gtgggacctagggaggc

SEQ ID NO: 2489755 - DNA, 20 bp, Homo sapiens
gtgggacgggatggttctgg

SEQ ID NO: 2489756 - DNA, 19 bp, Homo sapiens
gtgggagcaaactgcatgc

SEQ ID NO: 2489757 - DNA, 20 bp, Homo sapiens
gtgggagcaaactgcatgcc

SEQ ID NO: 2489758 - DNA, 12 bp, Homo sapiens
gtgggagcctcg

SEQ ID NO: 2489759 - DNA, 17 bp, Homo sapiens
gtgggagtgtgtgcctg

SEQ ID NO: 2489760 - DNA, 23 bp, Homo sapiens
gtgggatgttcagcactgtccct

SEQ ID NO: 2489761 - DNA, 13 bp, Homo sapiens
gaaaaaaatgtat

SEQ ID NO: 2489762 - DNA, 14 bp, Homo sapiens
gaaaaaaatgtatt

SEQ ID NO: 2489763 - DNA, 19 bp, Homo sapiens
gaaaaaaatgtattttatg

SEQ ID NO: 2489764 - DNA, 12 bp, Homo sapiens
gaaaaaaattga

SEQ ID NO: 2489765 - DNA, 19 bp, Homo sapiens
gaaaaaaattgaaatgtaa

SEQ ID NO: 2489766 - DNA, 16 bp, Homo sapiens
gaaaaattccactcaa

SEQ ID NO: 2489767 - DNA, 21 bp, Homo sapiens
gaaaaattgctgactgtagct

SEQ ID NO: 2489768 - DNA, 22 bp, Homo sapiens
gaaaaattgctgactgtagctt

SEQ ID NO: 2489769 - DNA, 12 bp, Homo sapiens
gaaaacaaggaa

SEQ ID NO: 2489770 - DNA, 21 bp, Homo sapiens
gaaaacactgtgcacatctgt

SEQ ID NO: 2489771 - DNA, 15 bp, Homo sapiens
gaaaacagaacactt

SEQ ID NO: 2489772 - DNA, 20 bp, Homo sapiens
gaaaaccagctcagcactgc

SEQ ID NO: 2489773 - DNA, 15 bp, Homo sapiens
gaaaacctttcttca

SEQ ID NO: 2489774 - DNA, 18 bp, Homo sapiens
gaaaactccaccttccca

SEQ ID NO: 2489775 - DNA, 16 bp, Homo sapiens
gaaaactttaaagcgt

SEQ ID NO: 2489776 - DNA, 20 bp, Homo sapiens
gaaaagcctgggtttggtgt

SEQ ID NO: 2489777 - DNA, 23 bp, Homo sapiens
gaaaagctagaattgagtgttta

SEQ ID NO: 2489778 - DNA, 22 bp, Homo sapiens
gaaaaggcacccccgtcaagag

SEQ ID NO: 2489779 - DNA, 23 bp, Homo sapiens
gaaaaggtagaggagtcacgtta

SEQ ID NO: 2489780 - DNA, 22 bp, Homo sapiens
gaaaaggtttatgaaaaagaag

SEQ ID NO: 2489781 - DNA, 23 bp, Homo sapiens
gaaaaggtttatgaaaaagaaga

SEQ ID NO: 2489782 - DNA, 13 bp, Homo sapiens
gaaaagtatgttc

SEQ ID NO: 2489783 - DNA, 15 bp, Homo sapiens
gaaaagtatgttcta

SEQ ID NO: 2489784 - DNA, 19 bp, Homo sapiens
gaaaagtatgttctaacct

SEQ ID NO: 2489785 - DNA, 13 bp, Homo sapiens
gaaaataaggcac

SEQ ID NO: 2489786 - DNA, 19 bp, Homo sapiens
gaaaataggcaggaagccc

SEQ ID NO: 2489787 - DNA, 19 bp, Homo sapiens
gaaaatctttataaatgta

SEQ ID NO: 2489788 - DNA, 17 bp, Homo sapiens
gaaaatgatacagcaga

SEQ ID NO: 2489789 - DNA, 14 bp, Homo sapiens
gaaaatgtccagga

SEQ ID NO: 2489790 - DNA, 15 bp, Homo sapiens
gaaaatgttctgttt

SEQ ID NO: 2489791 - DNA, 20 bp, Homo sapiens
gaaaatgttgagaatcccaa

SEQ ID NO: 2489792 - DNA, 13 bp, Homo sapiens
gaaaattatttaa

SEQ ID NO: 2489793 - DNA, 23 bp, Homo sapiens
gaaaattatttaaaccgctaaaa

SEQ ID NO: 2489794 - DNA, 13 bp, Homo sapiens
gaaaattcatttt

SEQ ID NO: 2489795 - DNA, 13 bp, Homo sapiens
gaaaattctgtgc

SEQ ID NO: 2489796 - DNA, 20 bp, Homo sapiens
gaaaattctgtgccttgttt

SEQ ID NO: 2489797 - DNA, 17 bp, Homo sapiens
gaaacaacactgtagta

SEQ ID NO: 2489798 - DNA, 17 bp, Homo sapiens
gaaacaactctttgaga

SEQ ID NO: 2489799 - DNA, 13 bp, Homo sapiens
gaaacagcatctc

SEQ ID NO: 2489800 - DNA, 18 bp, Homo sapiens
gaaacagcatctccaagc

SEQ ID NO: 2489801 - DNA, 17 bp, Homo sapiens
gaaacagttgcatgtag

SEQ ID NO: 2489802 - DNA, 23 bp, Homo sapiens
gaaacagttgcatgtagtaacac

SEQ ID NO: 2489803 - DNA, 18 bp, Homo sapiens
gaaacagttggtaacttt

SEQ ID NO: 2489804 - DNA, 20 bp, Homo sapiens
gaaacagttggtaacttttg

SEQ ID NO: 2489805 - DNA, 22 bp, Homo sapiens
gaaaccagcttccttcagagag

SEQ ID NO: 2489806 - DNA, 19 bp, Homo sapiens
gaaacccctgtaggcctca

SEQ ID NO: 2489807 - DNA, 14 bp, Homo sapiens
gaaactggccatgg

SEQ ID NO: 2489808 - DNA, 21 bp, Homo sapiens
gaaactggccatggcctgcaa

SEQ ID NO: 2489809 - DNA, 19 bp, Homo sapiens
ggaccagcagccccacacc

SEQ ID NO: 2489810 - DNA, 13 bp, Homo sapiens
ggaccagcctggc

SEQ ID NO: 2489811 - DNA, 22 bp, Homo sapiens
ggaccagcctggcccaccccac

SEQ ID NO: 2489812 - DNA, 13 bp, Homo sapiens
ggaccagctcagg

SEQ ID NO: 2489813 - DNA, 18 bp, Homo sapiens
ggaccagctcaggacaga

SEQ ID NO: 2489814 - DNA, 19 bp, Homo sapiens
ggaccagctcaggacagat

SEQ ID NO: 2489815 - DNA, 21 bp, Homo sapiens
ggaccaggagtgggtggggag

SEQ ID NO: 2489816 - DNA, 23 bp, Homo sapiens
ggaccaggagtgggtggggagtg

SEQ ID NO: 2489817 - DNA, 21 bp, Homo sapiens
ggacccagaggaaggggccag

SEQ ID NO: 2489818 - DNA, 12 bp, Homo sapiens
ggacccagccag

SEQ ID NO: 2489819 - DNA, 15 bp, Homo sapiens
ggacccagccaggcc

SEQ ID NO: 2489820 - DNA, 22 bp, Homo sapiens
ggacccatgagttggggtctgg

SEQ ID NO: 2489821 - DNA, 18 bp, Homo sapiens
ggacccccctttcacagg

SEQ ID NO: 2489822 - DNA, 21 bp, Homo sapiens
ggacccccctttcacaggcag

SEQ ID NO: 2489823 - DNA, 22 bp, Homo sapiens
ggacccccctttcacaggcagc

SEQ ID NO: 2489824 - DNA, 19 bp, Homo sapiens
ggaccgctacaccactctg

SEQ ID NO: 2489825 - DNA, 22 bp, Homo sapiens
ggacctagggaggcatggtctg

SEQ ID NO: 2489826 - DNA, 13 bp, Homo sapiens
ggacctctgacag

SEQ ID NO: 2489827 - DNA, 19 bp, Homo sapiens
ggacctgaaattccaaagt

SEQ ID NO: 2489828 - DNA, 16 bp, Homo sapiens
ggacctgagcctgccg

SEQ ID NO: 2489829 - DNA, 19 bp, Homo sapiens
ggacctgagcctgccgagc

SEQ ID NO: 2489830 - DNA, 19 bp, Homo sapiens
ggaccttcgggctgtgccc

SEQ ID NO: 2489831 - DNA, 17 bp, Homo sapiens
ggacggtgcccaagcca

SEQ ID NO: 2489832 - DNA, 21 bp, Homo sapiens
ggacgtacgtaataaggtttt

SEQ ID NO: 2489833 - DNA, 18 bp, Homo sapiens
ggacgtggctcagccagc

SEQ ID NO: 2489834 - DNA, 22 bp, Homo sapiens
ggactaacactcagaagcctgg

SEQ ID NO: 2489835 - DNA, 23 bp, Homo sapiens
ggactaacactcagaagcctggg

SEQ ID NO: 2489836 - DNA, 23 bp, Homo sapiens
ggactatatttgggcctgctcca

SEQ ID NO: 2489837 - DNA, 19 bp, Homo sapiens
ggactatgaaaagctagaa

SEQ ID NO: 2489838 - DNA, 13 bp, Homo sapiens
ggactcagggcag

SEQ ID NO: 2489839 - DNA, 15 bp, Homo sapiens
ggactcagggcagcg

SEQ ID NO: 2489840 - DNA, 11 bp, Homo sapiens
ggactcctgaa

SEQ ID NO: 2489841 - DNA, 13 bp, Homo sapiens
ggactctaaagtc

SEQ ID NO: 2489842 - DNA, 17 bp, Homo sapiens
ggactctcagtctctga

SEQ ID NO: 2489843 - DNA, 18 bp, Homo sapiens
ggactctcagtctctgag

SEQ ID NO: 2489844 - DNA, 17 bp, Homo sapiens
ggactctggtgcctcca

SEQ ID NO: 2489845 - DNA, 18 bp, Homo sapiens
ggactctggtgcctccag

SEQ ID NO: 2489846 - DNA, 16 bp, Homo sapiens
ggactctgtcctgaag

SEQ ID NO: 2489847 - DNA, 22 bp, Homo sapiens
ggactctgtcctgaaggcctga

SEQ ID NO: 2489848 - DNA, 23 bp, Homo sapiens
ggactctgtcctgaaggcctgag

SEQ ID NO: 2489849 - DNA, 14 bp, Homo sapiens
ggactgaccagcag

SEQ ID NO: 2489850 - DNA, 15 bp, Homo sapiens
ggactgaccagcagc

SEQ ID NO: 2489851 - DNA, 15 bp, Homo sapiens
ggactgatgtctcct

SEQ ID NO: 2489852 - DNA, 16 bp, Homo sapiens
ggactgctcaggaaac

SEQ ID NO: 2489853 - DNA, 20 bp, Homo sapiens
ggactgggagcccccagcct

SEQ ID NO: 2489854 - DNA, 21 bp, Homo sapiens
ggactgggagcccccagcctg

SEQ ID NO: 2489855 - DNA, 21 bp, Homo sapiens
ggactgtaagttgggcttgct

SEQ ID NO: 2489856 - DNA, 22 bp, Homo sapiens
ggacttagaaaaccagctcagc

SEQ ID NO: 2489857 - DNA, 21 bp, Homo sapiens
ggacttcctgtccagctccaa

SEQ ID NO: 2489858 - DNA, 22 bp, Homo sapiens
ggacttctggggtaagtggtct

SEQ ID NO: 2489859 - DNA, 12 bp, Homo sapiens
ggactttgtaca

SEQ ID NO: 2489860 - DNA, 14 bp, Homo sapiens
ggagaaagctgact

SEQ ID NO: 2489861 - DNA, 15 bp, Homo sapiens
ggagaaagctgactt

SEQ ID NO: 2489862 - DNA, 22 bp, Homo sapiens
ggagaaagctgacttggctggt

SEQ ID NO: 2489863 - DNA, 23 bp, Homo sapiens
ggagaaagctgacttggctggtg

SEQ ID NO: 2489864 - DNA, 22 bp, Homo sapiens
ggagaaatctggcttctggcca

SEQ ID NO: 2489865 - DNA, 19 bp, Homo sapiens
ggagaagctcctctcccca

SEQ ID NO: 2489866 - DNA, 13 bp, Homo sapiens
ggagaagtctcag

SEQ ID NO: 2489867 - DNA, 22 bp, Homo sapiens
ggagaagtctcagctaagctca

SEQ ID NO: 2489868 - DNA, 19 bp, Homo sapiens
ggagaatcgctcctgcagc

SEQ ID NO: 2489869 - DNA, 20 bp, Homo sapiens
ggagacactggcccctcaaa

SEQ ID NO: 2489870 - DNA, 22 bp, Homo sapiens
ggagaccggcctgccaggagga

SEQ ID NO: 2489871 - DNA, 17 bp, Homo sapiens
ggagactgggctgaggg

SEQ ID NO: 2489872 - DNA, 20 bp, Homo sapiens
ggagactgggctgagggagc

SEQ ID NO: 2489873 - DNA, 23 bp, Homo sapiens
ggagactgggctgagggagcctg

SEQ ID NO: 2489874 - DNA, 20 bp, Homo sapiens
ggagactgtctggcccccct

SEQ ID NO: 2489875 - DNA, 18 bp, Homo sapiens
ggagactgtgtgtgccct

SEQ ID NO: 2489876 - DNA, 19 bp, Homo sapiens
ggagactgtgtgtgccctc

SEQ ID NO: 2489877 - DNA, 20 bp, Homo sapiens
ggagactgtgtgtgccctct

SEQ ID NO: 2489878 - DNA, 21 bp, Homo sapiens
ggagactgtgtgtgccctctg

SEQ ID NO: 2489879 - DNA, 21 bp, Homo sapiens
ggagagcccaggagctcccct

SEQ ID NO: 2489880 - DNA, 13 bp, Homo sapiens
ggagagctaggag

SEQ ID NO: 2489881 - DNA, 13 bp, Homo sapiens
ggagagtttgcct

SEQ ID NO: 2489882 - DNA, 15 bp, Homo sapiens
ggagatcctcctgca

SEQ ID NO: 2489883 - DNA, 21 bp, Homo sapiens
ggagcaaactgcatgcccaga

SEQ ID NO: 2489884 - DNA, 13 bp, Homo sapiens
ggagcaaagcctg

SEQ ID NO: 2489885 - DNA, 15 bp, Homo sapiens
ggagcaaagcctgtt

SEQ ID NO: 2489886 - DNA, 24 bp, Homo sapiens
ggagcaaagcctgttcatggcaga

SEQ ID NO: 2489887 - DNA, 20 bp, Homo sapiens
ggagcacaaagaccctggct

SEQ ID NO: 2489888 - DNA, 22 bp, Homo sapiens
ggagcacaaagaccctggcttt

SEQ ID NO: 2489889 - DNA, 22 bp, Homo sapiens
ggagcacggctctgtccccagc

SEQ ID NO: 2489890 - DNA, 22 bp, Homo sapiens
ggagcactgcacctgcctccag

SEQ ID NO: 2489891 - DNA, 23 bp, Homo sapiens
ggagcagaaaacccttgggccag

SEQ ID NO: 2489892 - DNA, 15 bp, Homo sapiens
ggagcagaccacccc

SEQ ID NO: 2489893 - DNA, 21 bp, Homo sapiens
ggagcagaggggcagaggccc

SEQ ID NO: 2489894 - DNA, 21 bp, Homo sapiens
ggagcagcaggaggggggagg

SEQ ID NO: 2489895 - DNA, 13 bp, Homo sapiens
ggagcaggcagcc

SEQ ID NO: 2489896 - DNA, 18 bp, Homo sapiens
ggagccaagggatggaca

SEQ ID NO: 2489897 - DNA, 14 bp, Homo sapiens
ggagccaccagttc

SEQ ID NO: 2489898 - DNA, 15 bp, Homo sapiens
ggagccaccagttct

SEQ ID NO: 2489899 - DNA, 19 bp, Homo sapiens
ggagccactcctctgactc

SEQ ID NO: 2489900 - DNA, 14 bp, Homo sapiens
ggagccagccgagc

SEQ ID NO: 2489901 - DNA, 17 bp, Homo sapiens
ggagcccactgtcctgg

SEQ ID NO: 2489902 - DNA, 18 bp, Homo sapiens
ggagcccactgtcctggg

SEQ ID NO: 2489903 - DNA, 20 bp, Homo sapiens
ggagcccactgtcctgggcc

SEQ ID NO: 2489904 - DNA, 23 bp, Homo sapiens
ggagcccactgtcctgggcctgc

SEQ ID NO: 2489905 - DNA, 22 bp, Homo sapiens
ggagcccaggccaggactctgc

SEQ ID NO: 2489906 - DNA, 15 bp, Homo sapiens
ggagcccccaccctg

SEQ ID NO: 2489907 - DNA, 17 bp, Homo sapiens
ggagcccccagcctgtc

SEQ ID NO: 2489908 - DNA, 22 bp, Homo sapiens
ggagcctcgcaacccgtgccaa

SEQ ID NO: 2489909 - DNA, 11 bp, Homo sapiens
ggagcctgtcc

SEQ ID NO: 2489910 - DNA, 20 bp, Homo sapiens
ggagcctgtgaacccaggac

SEQ ID NO: 2489911 - DNA, 22 bp, Homo sapiens
ggagcgagcatgtcgtggacac

SEQ ID NO: 2489912 - DNA, 20 bp, Homo sapiens
gggacgtggctcagccagca

SEQ ID NO: 2489913 - DNA, 18 bp, Homo sapiens
gggactagcctggcttgg

SEQ ID NO: 2489914 - DNA, 22 bp, Homo sapiens
gggactcagccttcagacagag

SEQ ID NO: 2489915 - DNA, 17 bp, Homo sapiens
gggagaccggcctgcca

SEQ ID NO: 2489916 - DNA, 22 bp, Homo sapiens
gggagaccggcctgccaggagg

SEQ ID NO: 2489917 - DNA, 13 bp, Homo sapiens
gggagagcccagg

SEQ ID NO: 2489918 - DNA, 18 bp, Homo sapiens
gggagagcccaggagctc

SEQ ID NO: 2489919 - DNA, 14 bp, Homo sapiens
gggagagggcgcag

SEQ ID NO: 2489920 - DNA, 20 bp, Homo sapiens
gggagagggcgcaggccgtg

SEQ ID NO: 2489921 - DNA, 17 bp, Homo sapiens
gggagattcaagggacc

SEQ ID NO: 2489922 - DNA, 9 bp, Homo sapiens
gggagccaa

SEQ ID NO: 2489923 - DNA, 12 bp, Homo sapiens
gggagccaaggg

SEQ ID NO: 2489924 - DNA, 15 bp, Homo sapiens
gggagccaagggatg

SEQ ID NO: 2489925 - DNA, 19 bp, Homo sapiens
gggagcccactgtcctggg

SEQ ID NO: 2489926 - DNA, 13 bp, Homo sapiens
gggagcccccagc

SEQ ID NO: 2489927 - DNA, 21 bp, Homo sapiens
gggagcctcgcaacccgtgcc

SEQ ID NO: 2489928 - DNA, 22 bp, Homo sapiens
gggagcgggtctgctcccaagg

SEQ ID NO: 2489929 - DNA, 15 bp, Homo sapiens
gggaggctcaggtcc

SEQ ID NO: 2489930 - DNA, 20 bp, Homo sapiens
gggaggctggaagctgggag

SEQ ID NO: 2489931 - DNA, 15 bp, Homo sapiens
gggagggaagggagc

SEQ ID NO: 2489932 - DNA, 18 bp, Homo sapiens
gggagggcagagctggtg

SEQ ID NO: 2489933 - DNA, 21 bp, Homo sapiens
gggagggcggcaggggcctgg

SEQ ID NO: 2489934 - DNA, 22 bp, Homo sapiens
gggagggcggcaggggcctgga

SEQ ID NO: 2489935 - DNA, 19 bp, Homo sapiens
gggatggacgatctcccac

SEQ ID NO: 2489936 - DNA, 12 bp, Homo sapiens
gggatgtgtcct

SEQ ID NO: 2489937 - DNA, 17 bp, Homo sapiens
gggattatgggtcacag

SEQ ID NO: 2489938 - DNA, 18 bp, Homo sapiens
gggattatgggtcacagg

SEQ ID NO: 2489939 - DNA, 20 bp, Homo sapiens
gggattatgggtcacaggaa

SEQ ID NO: 2489940 - DNA, 23 bp, Homo sapiens
gggattattagaatcaaacattt

SEQ ID NO: 2489941 - DNA, 13 bp, Homo sapiens
gggcaaagccagg

SEQ ID NO: 2489942 - DNA, 16 bp, Homo sapiens
gggcaaagccaggtcc

SEQ ID NO: 2489943 - DNA, 14 bp, Homo sapiens
gggcacaggagcta

SEQ ID NO: 2489944 - DNA, 18 bp, Homo sapiens
gggcacaggagctacctg

SEQ ID NO: 2489945 - DNA, 17 bp, Homo sapiens
gggcacccccagcctgg

SEQ ID NO: 2489946 - DNA, 12 bp, Homo sapiens
gggcagagccca

SEQ ID NO: 2489947 - DNA, 16 bp, Homo sapiens
gggcagagctggctct

SEQ ID NO: 2489948 - DNA, 17 bp, Homo sapiens
gggcagagctggctctg

SEQ ID NO: 2489949 - DNA, 21 bp, Homo sapiens
gggcagaggcagtacctgggc

SEQ ID NO: 2489950 - DNA, 14 bp, Homo sapiens
gggcagagggctgg

SEQ ID NO: 2489951 - DNA, 12 bp, Homo sapiens
gggcagcagcca

SEQ ID NO: 2489952 - DNA, 13 bp, Homo sapiens
gggcagcagccag

SEQ ID NO: 2489953 - DNA, 20 bp, Homo sapiens
gggcagcagccagccctgcc

SEQ ID NO: 2489954 - DNA, 18 bp, Homo sapiens
gggcagccagggagagcc

SEQ ID NO: 2489955 - DNA, 19 bp, Homo sapiens
gggcagccagggagagccc

SEQ ID NO: 2489956 - DNA, 20 bp, Homo sapiens
gggcagccagggagagccca

SEQ ID NO: 2489957 - DNA, 16 bp, Homo sapiens
gggcagcgccaggctg

SEQ ID NO: 2489958 - DNA, 12 bp, Homo sapiens
gggcagctcctc

SEQ ID NO: 2489959 - DNA, 19 bp, Homo sapiens
gggcaggagtagctgagct

SEQ ID NO: 2489960 - DNA, 21 bp, Homo sapiens
gggcaggccacctggctctca

SEQ ID NO: 2489961 - DNA, 23 bp, Homo sapiens
gggcaggccacctggctctcacc

SEQ ID NO: 2489962 - DNA, 16 bp, Homo sapiens
gggcaggctgggccat

SEQ ID NO: 2489963 - DNA, 16 bp, Homo sapiens
gggcagttcgcagcca

SEQ ID NO: 2489964 - DNA, 20 bp, Homo sapiens
gggcagttcgcagccaccct

SEQ ID NO: 2489965 - DNA, 14 bp, Homo sapiens
gggcatctctgggc

SEQ ID NO: 2489966 - DNA, 16 bp, Homo sapiens
gggcatctctgggctg

SEQ ID NO: 2489967 - DNA, 19 bp, Homo sapiens
gggcatggtgttctcctgc

SEQ ID NO: 2489968 - DNA, 21 bp, Homo sapiens
gggcatggtgttctcctgctg

SEQ ID NO: 2489969 - DNA, 13 bp, Homo sapiens
gggccaaggacct

SEQ ID NO: 2489970 - DNA, 14 bp, Homo sapiens
gggccaaggacctg

SEQ ID NO: 2489971 - DNA, 16 bp, Homo sapiens
gggccacgctccagct

SEQ ID NO: 2489972 - DNA, 17 bp, Homo sapiens
gggccacgctccagctg

SEQ ID NO: 2489973 - DNA, 12 bp, Homo sapiens
gggccagaggct

SEQ ID NO: 2489974 - DNA, 16 bp, Homo sapiens
gggccagatccagcct

SEQ ID NO: 2489975 - DNA, 21 bp, Homo sapiens
gggccatgtccaaagaggctg

SEQ ID NO: 2489976 - DNA, 19 bp, Homo sapiens
gggcccagagcccagctcc

SEQ ID NO: 2489977 - DNA, 16 bp, Homo sapiens
gggcccctctcagccc

SEQ ID NO: 2489978 - DNA, 13 bp, Homo sapiens
gggcccctctccc

SEQ ID NO: 2489979 - DNA, 22 bp, Homo sapiens
gggcccgcgatgtggaactgct

SEQ ID NO: 2489980 - DNA, 14 bp, Homo sapiens
ggcctagaccagca

SEQ ID NO: 2489981 - DNA, 21 bp, Homo sapiens
ggcctaggagggtcctctgag

SEQ ID NO: 2489982 - DNA, 23 bp, Homo sapiens
ggcctaggagggtcctctgagac

SEQ ID NO: 2489983 - DNA, 16 bp, Homo sapiens
ggcctatggagagccc

SEQ ID NO: 2489984 - DNA, 21 bp, Homo sapiens
ggcctatggagagccctggga

SEQ ID NO: 2489985 - DNA, 23 bp, Homo sapiens
ggcctcaaagcaagcattcagaa

SEQ ID NO: 2489986 - DNA, 19 bp, Homo sapiens
ggcctcaaatgcaccatgt

SEQ ID NO: 2489987 - DNA, 13 bp, Homo sapiens
ggcctcacccacc

SEQ ID NO: 2489988 - DNA, 17 bp, Homo sapiens
ggcctcacccacccctg

SEQ ID NO: 2489989 - DNA, 18 bp, Homo sapiens
ggcctcaccgagtggggg

SEQ ID NO: 2489990 - DNA, 14 bp, Homo sapiens
ggcctcagggctcc

SEQ ID NO: 2489991 - DNA, 15 bp, Homo sapiens
ggcctcagggctcct

SEQ ID NO: 2489992 - DNA, 16 bp, Homo sapiens
ggcctcagggctcctt

SEQ ID NO: 2489993 - DNA, 18 bp, Homo sapiens
ggcctcatgctggaggga

SEQ ID NO: 2489994 - DNA, 20 bp, Homo sapiens
ggcctcatgtggctggaaga

SEQ ID NO: 2489995 - DNA, 18 bp, Homo sapiens
ggcctccatgggccccag

SEQ ID NO: 2489996 - DNA, 12 bp, Homo sapiens
ggcctcccccac

SEQ ID NO: 2489997 - DNA, 15 bp, Homo sapiens
ggcctcccccacttt

SEQ ID NO: 2489998 - DNA, 22 bp, Homo sapiens
ggcctccttctgagctcctgtc

SEQ ID NO: 2489999 - DNA, 23 bp, Homo sapiens
ggcctctccctcctccaggaagc

SEQ ID NO: 2490000 - DNA, 14 bp, Homo sapiens
ggcctctctctagg

SEQ ID NO: 2490001 - DNA, 20 bp, Homo sapiens
ggcctctgcgagtggtttct

SEQ ID NO: 2490002 - DNA, 13 bp, Homo sapiens
ggcctctgtcaat

SEQ ID NO: 2490003 - DNA, 13 bp, Homo sapiens
ggcctcttgagca

SEQ ID NO: 2490004 - DNA, 18 bp, Homo sapiens
ggcctcttgagcagtggc

SEQ ID NO: 2490005 - DNA, 19 bp, Homo sapiens
ggcctgagcagtccttggc

SEQ ID NO: 2490006 - DNA, 20 bp, Homo sapiens
ggcctgatcagaccacggct

SEQ ID NO: 2490007 - DNA, 14 bp, Homo sapiens
ggcctgcaaactgg

SEQ ID NO: 2490008 - DNA, 14 bp, Homo sapiens
ggcctgcagggcct

SEQ ID NO: 2490009 - DNA, 14 bp, Homo sapiens
ggcctgccacctgg

SEQ ID NO: 2490010 - DNA, 23 bp, Homo sapiens
ggcctgccacctggacccctgca

SEQ ID NO: 2490011 - DNA, 12 bp, Homo sapiens
ggcctgccagga

SEQ ID NO: 2490012 - DNA, 14 bp, Homo sapiens
ggcctgccaggagg

SEQ ID NO: 2490013 - DNA, 15 bp, Homo sapiens
ggcctgcccagttgc

SEQ ID NO: 2490014 - DNA, 13 bp, Homo sapiens
ggcctgcccccac

SEQ ID NO: 2490015 - DNA, 13 bp, Homo sapiens
ggcctgctccaga

SEQ ID NO: 2490016 - DNA, 15 bp, Homo sapiens
ggcctgctccagacc

SEQ ID NO: 2490017 - DNA, 17 bp, Homo sapiens
ggcctgctccagacctg

SEQ ID NO: 2490018 - DNA, 18 bp, Homo sapiens
ggcctgctccagacctga

SEQ ID NO: 2490019 - DNA, 15 bp, Homo sapiens
ggcctgctgctgaga

SEQ ID NO: 2490020 - DNA, 16 bp, Homo sapiens
ggcctgctgctgagaa

SEQ ID NO: 2490021 - DNA, 15 bp, Homo sapiens
ggcctggagatcctc

SEQ ID NO: 2490022 - DNA, 17 bp, Homo sapiens
ggcctggagatcctcct

SEQ ID NO: 2490023 - DNA, 18 bp, Homo sapiens
ggcctggagatcctcctg

SEQ ID NO: 2490024 - DNA, 22 bp, Homo sapiens
ggcctggagcacaaagaccctg

SEQ ID NO: 2490025 - DNA, 16 bp, Homo sapiens
ggcctggccagtgccc

SEQ ID NO: 2490026 - DNA, 11 bp, Homo sapiens
ggcctggctgg

SEQ ID NO: 2490027 - DNA, 18 bp, Homo sapiens
ggcctgggctcctggacc

SEQ ID NO: 2490028 - DNA, 15 bp, Homo sapiens
ggcctggggtgaccc

SEQ ID NO: 2490029 - DNA, 18 bp, Homo sapiens
ggcctggggtgacccggc

SEQ ID NO: 2490030 - DNA, 11 bp, Homo sapiens
ggcctggtccc

SEQ ID NO: 2490031 - DNA, 19 bp, Homo sapiens
ggcctggtctcaccctgga

SEQ ID NO: 2490032 - DNA, 16 bp, Homo sapiens
ggcctgtactgcctgc

SEQ ID NO: 2490033 - DNA, 14 bp, Homo sapiens
ggcctgtcctccaa

SEQ ID NO: 2490034 - DNA, 20 bp, Homo sapiens
ggcctgtgtagctgtgacct

SEQ ID NO: 2490035 - DNA, 21 bp, Homo sapiens
ggcctgtgtagctgtgacctg

SEQ ID NO: 2490036 - DNA, 16 bp, Homo sapiens
ggcctgtgttcttcct

SEQ ID NO: 2490037 - DNA, 21 bp, Homo sapiens
ggcctgtgttcttcctggccg

SEQ ID NO: 2490038 - DNA, 17 bp, Homo sapiens
ggcctgtttggcctctc

SEQ ID NO: 2490039 - DNA, 15 bp, Homo sapiens
ggccttaggaagagc

SEQ ID NO: 2490040 - DNA, 18 bp, Homo sapiens
ggccttgcggctcctcag

SEQ ID NO: 2490041 - DNA, 16 bp, Homo sapiens
ggccttggcctggagc

SEQ ID NO: 2490042 - DNA, 18 bp, Homo sapiens
ggccttgttctgtcacca

SEQ ID NO: 2490043 - DNA, 16 bp, Homo sapiens
ggcctttgagctcaga

SEQ ID NO: 2490044 - DNA, 16 bp, Homo sapiens
ggcgccccaacccgtg

SEQ ID NO: 2490045 - DNA, 18 bp, Homo sapiens
ggcgccccaacccgtgga

SEQ ID NO: 2490046 - DNA, 20 bp, Homo sapiens
ggcgccgtctccaggggctg

SEQ ID NO: 2490047 - DNA, 18 bp, Homo sapiens
ggcggcaggggcctggag

SEQ ID NO: 2490048 - DNA, 18 bp, Homo sapiens
ggcggctggggtcccagc

SEQ ID NO: 2490049 - DNA, 14 bp, Homo sapiens
ggcgggggtggcgg

SEQ ID NO: 2490050 - DNA, 20 bp, Homo sapiens
ggcgggtacagcgcggagga

SEQ ID NO: 2490051 - DNA, 15 bp, Homo sapiens
ggcgtaagtacagag

SEQ ID NO: 2490052 - DNA, 12 bp, Homo sapiens
ggctaatttaac

SEQ ID NO: 2490053 - DNA, 13 bp, Homo sapiens
ggcacccccagcc

SEQ ID NO: 2490054 - DNA, 15 bp, Homo sapiens
ggcacccccagcctg

SEQ ID NO: 2490055 - DNA, 16 bp, Homo sapiens
ggcacccccagcctgg

SEQ ID NO: 2490056 - DNA, 20 bp, Homo sapiens
ggcacccccagcctgggcct

SEQ ID NO: 2490057 - DNA, 14 bp, Homo sapiens
ggcaccccctgcag

SEQ ID NO: 2490058 - DNA, 18 bp, Homo sapiens
ggcaccccctgcagcttg

SEQ ID NO: 2490059 - DNA, 19 bp, Homo sapiens
ggcaccccctgcagcttgt

SEQ ID NO: 2490060 - DNA, 15 bp, Homo sapiens
ggcaccgaagcccag

SEQ ID NO: 2490061 - DNA, 22 bp, Homo sapiens
ggcacctaatccaggcagatcc

SEQ ID NO: 2490062 - DNA, 23 bp, Homo sapiens
ggcacctgggccctggggcctgt

SEQ ID NO: 2490063 - DNA, 22 bp, Homo sapiens
ggcacctggtggccatgctcct

SEQ ID NO: 2490064 - DNA, 21 bp, Homo sapiens
ggcacgggtgtcacggccagg

SEQ ID NO: 2490065 - DNA, 18 bp, Homo sapiens
ggcactgtagttctaaga

SEQ ID NO: 2490066 - DNA, 22 bp, Homo sapiens
ggcactttgaaggggcctcacc

SEQ ID NO: 2490067 - DNA, 18 bp, Homo sapiens
ggcagactctttatgctt

SEQ ID NO: 2490068 - DNA, 16 bp, Homo sapiens
ggcagagatgcctccc

SEQ ID NO: 2490069 - DNA, 22 bp, Homo sapiens
ggcagagatgcctccctgagct

SEQ ID NO: 2490070 - DNA, 11 bp, Homo sapiens
ggcagagctgg

SEQ ID NO: 2490071 - DNA, 16 bp, Homo sapiens
ggcagagctggctctg

SEQ ID NO: 2490072 - DNA, 17 bp, Homo sapiens
ggcagagctggctctga

SEQ ID NO: 2490073 - DNA, 12 bp, Homo sapiens
ggcagagctggt

SEQ ID NO: 2490074 - DNA, 18 bp, Homo sapiens
ggcagagctggtgcggct

SEQ ID NO: 2490075 - DNA, 15 bp, Homo sapiens
ggcagaggcagtacc

SEQ ID NO: 2490076 - DNA, 16 bp, Homo sapiens
ggcagaggcccaggct

SEQ ID NO: 2490077 - DNA, 17 bp, Homo sapiens
ggcagaggcccaggctg

SEQ ID NO: 2490078 - DNA, 14 bp, Homo sapiens
ggcagaggcctggg

SEQ ID NO: 2490079 - DNA, 18 bp, Homo sapiens
ggcagaggcctgggctgg

SEQ ID NO: 2490080 - DNA, 14 bp, Homo sapiens
ggcagagggctgga

SEQ ID NO: 2490081 - DNA, 20 bp, Homo sapiens
ggcagagggctggaggccca

SEQ ID NO: 2490082 - DNA, 16 bp, Homo sapiens
ggcagatccaggacta

SEQ ID NO: 2490083 - DNA, 14 bp, Homo sapiens
ggcagatgtaggag

SEQ ID NO: 2490084 - DNA, 13 bp, Homo sapiens
ggcagcaaggccc

SEQ ID NO: 2490085 - DNA, 20 bp, Homo sapiens
ggcagcaaggcccgagcagc

SEQ ID NO: 2490086 - DNA, 21 bp, Homo sapiens
ggcagcaaggcccgagcagct

SEQ ID NO: 2490087 - DNA, 23 bp, Homo sapiens
ggcagcaaggcccgagcagctga

SEQ ID NO: 2490088 - DNA, 18 bp, Homo sapiens
ggcagcagccagccctgc

SEQ ID NO: 2490089 - DNA, 19 bp, Homo sapiens
ggcagcagccagccctgcc

SEQ ID NO: 2490090 - DNA, 22 bp, Homo sapiens
ggcagcagtgtgaggccagggc

SEQ ID NO: 2490091 - DNA, 17 bp, Homo sapiens
ggcagcatccccttgaa

SEQ ID NO: 2490092 - DNA, 20 bp, Homo sapiens
ggcagccacacttctcagga

SEQ ID NO: 2490093 - DNA, 16 bp, Homo sapiens
ggcagccagcatctgg

SEQ ID NO: 2490094 - DNA, 17 bp, Homo sapiens
ggcagccagggagagcc

SEQ ID NO: 2490095 - DNA, 19 bp, Homo sapiens
ggcagccagggagagccca

SEQ ID NO: 2490096 - DNA, 15 bp, Homo sapiens
ggcagccagtgccct

SEQ ID NO: 2490097 - DNA, 12 bp, Homo sapiens
ggcagcccagcc

SEQ ID NO: 2490098 - DNA, 20 bp, Homo sapiens
ggcagccgaggtccctgctg

SEQ ID NO: 2490099 - DNA, 22 bp, Homo sapiens
ggcagccgtgggccccaccctc

SEQ ID NO: 2490100 - DNA, 16 bp, Homo sapiens
ggcagcctctgggggg

SEQ ID NO: 2490101 - DNA, 20 bp, Homo sapiens
ggcagcctctggggggtggc

SEQ ID NO: 2490102 - DNA, 16 bp, Homo sapiens
ggcagctcctctgtct

SEQ ID NO: 2490103 - DNA, 18 bp, Homo sapiens
ggcagctcctctgtctcg

SEQ ID NO: 2490104 - DNA, 21 bp, Homo sapiens
ggcagctcctctgtctcgagc

SEQ ID NO: 2490105 - DNA, 17 bp, Homo sapiens
ggcagcttctgccccct

SEQ ID NO: 2490106 - DNA, 21 bp, Homo sapiens
ggcagcttctgccccctgcag

SEQ ID NO: 2490107 - DNA, 22 bp, Homo sapiens
ggcagcttctgccccctgcaga

SEQ ID NO: 2490108 - DNA, 14 bp, Homo sapiens
ggcagcttttaaaa

SEQ ID NO: 2490109 - DNA, 23 bp, Homo sapiens
ggcaggaccttcgggctgtgccc

SEQ ID NO: 2490110 - DNA, 14 bp, Homo sapiens
ggcaggagtagctg

SEQ ID NO: 2490111 - DNA, 18 bp, Homo sapiens
ggcaggagtagctgagct

SEQ ID NO: 2490112 - DNA, 17 bp, Homo sapiens
ggcaggcagaggcccag

SEQ ID NO: 2490113 - DNA, 19 bp, Homo sapiens
ggcaggcagggctctcctg

SEQ ID NO: 2490114 - DNA, 18 bp, Homo sapiens
ggcaggccacctggctct

SEQ ID NO: 2490115 - DNA, 12 bp, Homo sapiens
ggcaggctgggc

SEQ ID NO: 2490116 - DNA, 14 bp, Homo sapiens
ggcaggctgggcca

SEQ ID NO: 2490117 - DNA, 16 bp, Homo sapiens
ggcaggctgggccatg

SEQ ID NO: 2490118 - DNA, 18 bp, Homo sapiens
ggcagggaacatggggag

SEQ ID NO: 2490119 - DNA, 14 bp, Homo sapiens
ggcagggaccacac

SEQ ID NO: 2490120 - DNA, 16 bp, Homo sapiens
ggcagggctctcctgg

SEQ ID NO: 2490121 - DNA, 21 bp, Homo sapiens
ggcaggggcctccatgggccc

SEQ ID NO: 2490122 - DNA, 14 bp, Homo sapiens
ggcaggggcctgga

SEQ ID NO: 2490123 - DNA, 16 bp, Homo sapiens
ggcagggggctgctgc

SEQ ID NO: 2490124 - DNA, 18 bp, Homo sapiens
ggcagggggctgctgctg

SEQ ID NO: 2490125 - DNA, 17 bp, Homo sapiens
ggcaggggttagagcag

SEQ ID NO: 2490126 - DNA, 18 bp, Homo sapiens
ggcaggtagggggtccct

SEQ ID NO: 2490127 - DNA, 17 bp, Homo sapiens
ggcagtacctgggcaag

SEQ ID NO: 2490128 - DNA, 16 bp, Homo sapiens
ggcagtccgtgggacg

SEQ ID NO: 2490129 - DNA, 23 bp, Homo sapiens
ggcagttaccattaaaccatctc

SEQ ID NO: 2490130 - DNA, 17 bp, Homo sapiens
ggcagttcgcagccacc

SEQ ID NO: 2490131 - DNA, 16 bp, Homo sapiens
gtgatgtcatacagag

SEQ ID NO: 2490132 - DNA, 15 bp, Homo sapiens
gtgatgttcatgggt

SEQ ID NO: 2490133 - DNA, 19 bp, Homo sapiens
gtgatgttctaaggctctg

SEQ ID NO: 2490134 - DNA, 24 bp, Homo sapiens
gtgattggcctgtagagttgctga

SEQ ID NO: 2490135 - DNA, 17 bp, Homo sapiens
gtgatttaagggcccag

SEQ ID NO: 2490136 - DNA, 22 bp, Homo sapiens
gtgcaacaaggtcctctgtcag

SEQ ID NO: 2490137 - DNA, 14 bp, Homo sapiens
gtgcaacagggtat

SEQ ID NO: 2490138 - DNA, 19 bp, Homo sapiens
gtgcaatgtgtataaacaa

SEQ ID NO: 2490139 - DNA, 19 bp, Homo sapiens
gtgcaatttcaaggttcta

SEQ ID NO: 2490140 - DNA, 20 bp, Homo sapiens
gtgcacaccccactcccaca

SEQ ID NO: 2490141 - DNA, 15 bp, Homo sapiens
gtgcactgggaggct

SEQ ID NO: 2490142 - DNA, 21 bp, Homo sapiens
gtgcactgggaggctcccctt

SEQ ID NO: 2490143 - DNA, 17 bp, Homo sapiens
gtgcagccgctgagcga

SEQ ID NO: 2490144 - DNA, 15 bp, Homo sapiens
gtgcagggatgtggg

SEQ ID NO: 2490145 - DNA, 15 bp, Homo sapiens
gtgcagtactttgtg

SEQ ID NO: 2490146 - DNA, 16 bp, Homo sapiens
gtgcagtcctgggtcc

SEQ ID NO: 2490147 - DNA, 22 bp, Homo sapiens
gtgccaaacaaaaaggttctca

SEQ ID NO: 2490148 - DNA, 18 bp, Homo sapiens
gtgccaagtccaggtcct

SEQ ID NO: 2490149 - DNA, 19 bp, Homo sapiens
gtgccaagtccaggtcctg

SEQ ID NO: 2490150 - DNA, 18 bp, Homo sapiens
gtgccagagaacccagcc

SEQ ID NO: 2490151 - DNA, 18 bp, Homo sapiens
gtgccaggcgaggccctt

SEQ ID NO: 2490152 - DNA, 16 bp, Homo sapiens
gtgccagtattttaaa

SEQ ID NO: 2490153 - DNA, 18 bp, Homo sapiens
gtgccagtattttaaaat

SEQ ID NO: 2490154 - DNA, 12 bp, Homo sapiens
gtgcccaagcca

SEQ ID NO: 2490155 - DNA, 12 bp, Homo sapiens
gtgcccaggaga

SEQ ID NO: 2490156 - DNA, 12 bp, Homo sapiens
gtgccccaggac

SEQ ID NO: 2490157 - DNA, 15 bp, Homo sapiens
gtgcccccactgacc

SEQ ID NO: 2490158 - DNA, 14 bp, Homo sapiens
gtgcccccagggtc

SEQ ID NO: 2490159 - DNA, 21 bp, Homo sapiens
gtgcccctctccttcttagct

SEQ ID NO: 2490160 - DNA, 20 bp, Homo sapiens
gtgccccttccgccactggg

SEQ ID NO: 2490161 - DNA, 15 bp, Homo sapiens
gtgccctctgggctc

SEQ ID NO: 2490162 - DNA, 13 bp, Homo sapiens
gtgcctcagagac

SEQ ID NO: 2490163 - DNA, 19 bp, Homo sapiens
gtgcctcagagaccagggc

SEQ ID NO: 2490164 - DNA, 14 bp, Homo sapiens
gtgcctcctccctc

SEQ ID NO: 2490165 - DNA, 21 bp, Homo sapiens
gtgcctgacacactaaccaag

SEQ ID NO: 2490166 - DNA, 13 bp, Homo sapiens
gtgcctgtgtcca

SEQ ID NO: 2490167 - DNA, 17 bp, Homo sapiens
gtgccttcaacacagct

SEQ ID NO: 2490168 - DNA, 22 bp, Homo sapiens
gtgccttcaagaaaacaggcac

SEQ ID NO: 2490169 - DNA, 15 bp, Homo sapiens
gtgccttctctctcc

SEQ ID NO: 2490170 - DNA, 12 bp, Homo sapiens
gtgcgagcacac

SEQ ID NO: 2490171 - DNA, 13 bp, Homo sapiens
gtgcgcccagggc

SEQ ID NO: 2490172 - DNA, 16 bp, Homo sapiens
gtgcgcccagggctgg

SEQ ID NO: 2490173 - DNA, 15 bp, Homo sapiens
gtgcggaccaccctc

SEQ ID NO: 2490174 - DNA, 21 bp, Homo sapiens
gtgcgtggaatgcccttcact

SEQ ID NO: 2490175 - DNA, 21 bp, Homo sapiens
gtgctacacccttttccagct

SEQ ID NO: 2490176 - DNA, 11 bp, Homo sapiens
gtgctactggg

SEQ ID NO: 2490177 - DNA, 13 bp, Homo sapiens
gtgctactgggga

SEQ ID NO: 2490178 - DNA, 16 bp, Homo sapiens
gtgctatggtgctctg

SEQ ID NO: 2490179 - DNA, 12 bp, Homo sapiens
gtgctcagccct

SEQ ID NO: 2490180 - DNA, 18 bp, Homo sapiens
gtgctcagccctgaggac

SEQ ID NO: 2490181 - DNA, 22 bp, Homo sapiens
gtgctctccattctgctccttc

SEQ ID NO: 2490182 - DNA, 16 bp, Homo sapiens
gtgctcttttctcctc

SEQ ID NO: 2490183 - DNA, 20 bp, Homo sapiens
gtgctcttttctcctcactg

SEQ ID NO: 2490184 - DNA, 16 bp, Homo sapiens
gtgctgacggccaggg

SEQ ID NO: 2490185 - DNA, 18 bp, Homo sapiens
gtgctgacggccagggag

SEQ ID NO: 2490186 - DNA, 21 bp, Homo sapiens
gtgctgacggccagggagaag

SEQ ID NO: 2490187 - DNA, 22 bp, Homo sapiens
gtgctgacgggacccacatgct

SEQ ID NO: 2490188 - DNA, 19 bp, Homo sapiens
gtgctgcctctacctgaca

SEQ ID NO: 2490189 - DNA, 15 bp, Homo sapiens
gtgctggggcctggt

SEQ ID NO: 2490190 - DNA, 19 bp, Homo sapiens
gtgctgtttattaatctta

SEQ ID NO: 2490191 - DNA, 16 bp, Homo sapiens
gtgctgttttgttata

SEQ ID NO: 2490192 - DNA, 21 bp, Homo sapiens
gtgctgttttgttatataatt

SEQ ID NO: 2490193 - DNA, 14 bp, Homo sapiens
gtgcttcgggccct

SEQ ID NO: 2490194 - DNA, 17 bp, Homo sapiens
gtgcttcgggcccttcc

SEQ ID NO: 2490195 - DNA, 20 bp, Homo sapiens
gtgcttgttccctctccctg

SEQ ID NO: 2490196 - DNA, 15 bp, Homo sapiens
gtgctttgagagaga

SEQ ID NO: 2490197 - DNA, 16 bp, Homo sapiens
gtggaactgctgccac

SEQ ID NO: 2490198 - DNA, 14 bp, Homo sapiens
gtggaagcttgggg

SEQ ID NO: 2490199 - DNA, 12 bp, Homo sapiens
gtggacaggact

SEQ ID NO: 2490200 - DNA, 21 bp, Homo sapiens
gtggactagacctccagctgt

SEQ ID NO: 2490201 - DNA, 17 bp, Homo sapiens
gtggactgagtgggaag

SEQ ID NO: 2490202 - DNA, 14 bp, Homo sapiens
gtggagagggaatg

SEQ ID NO: 2490203 - DNA, 15 bp, Homo sapiens
gtggagagggaatgt

SEQ ID NO: 2490204 - DNA, 18 bp, Homo sapiens
gtggaggaggagggaggc

SEQ ID NO: 2490205 - DNA, 19 bp, Homo sapiens
gtggaggggtaggggctgg

SEQ ID NO: 2490206 - DNA, 19 bp, Homo sapiens
gtggatggccccagcacag

SEQ ID NO: 2490207 - DNA, 14 bp, Homo sapiens
gggccttgggctcc

SEQ ID NO: 2490208 - DNA, 21 bp, Homo sapiens
gggcggcaggggcctggagat

SEQ ID NO: 2490209 - DNA, 17 bp, Homo sapiens
gggcgggcagagggctg

SEQ ID NO: 2490210 - DNA, 21 bp, Homo sapiens
gggctaccctgagctgaggca

SEQ ID NO: 2490211 - DNA, 21 bp, Homo sapiens
gggctattttgtttgcttcat

SEQ ID NO: 2490212 - DNA, 18 bp, Homo sapiens
gggctcaatctctggggg

SEQ ID NO: 2490213 - DNA, 22 bp, Homo sapiens
gggctcaggtcacataaaactt

SEQ ID NO: 2490214 - DNA, 14 bp, Homo sapiens
gggctccctccgcc

SEQ ID NO: 2490215 - DNA, 12 bp, Homo sapiens
gggctccctgac

SEQ ID NO: 2490216 - DNA, 18 bp, Homo sapiens
gggctccctgactgggag

SEQ ID NO: 2490217 - DNA, 11 bp, Homo sapiens
gggctcctgca

SEQ ID NO: 2490218 - DNA, 18 bp, Homo sapiens
gggctcctgcacttactt

SEQ ID NO: 2490219 - DNA, 18 bp, Homo sapiens
gggctccttgtgggcctg

SEQ ID NO: 2490220 - DNA, 19 bp, Homo sapiens
gggctccttgtgggcctgg

SEQ ID NO: 2490221 - DNA, 20 bp, Homo sapiens
gggctcgaggggtgggctgg

SEQ ID NO: 2490222 - DNA, 17 bp, Homo sapiens
gggctctaacgcctgag

SEQ ID NO: 2490223 - DNA, 21 bp, Homo sapiens
gggctctaacgcctgagccca

SEQ ID NO: 2490224 - DNA, 13 bp, Homo sapiens
gggctctcctggc

SEQ ID NO: 2490225 - DNA, 11 bp, Homo sapiens
gggctctgagg

SEQ ID NO: 2490226 - DNA, 12 bp, Homo sapiens
gggctctgaggc

SEQ ID NO: 2490227 - DNA, 14 bp, Homo sapiens
gggctgagggagcc

SEQ ID NO: 2490228 - DNA, 20 bp, Homo sapiens
gggctgccggggcagccccc

SEQ ID NO: 2490229 - DNA, 17 bp, Homo sapiens
gggctgcttcctcctgg

SEQ ID NO: 2490230 - DNA, 19 bp, Homo sapiens
gggctgcttcctcctggaa

SEQ ID NO: 2490231 - DNA, 20 bp, Homo sapiens
gggctgcttcctcctggaaa

SEQ ID NO: 2490232 - DNA, 15 bp, Homo sapiens
gggctggaggagccc

SEQ ID NO: 2490233 - DNA, 23 bp, Homo sapiens
gggctggaggagcccaggccagg

SEQ ID NO: 2490234 - DNA, 14 bp, Homo sapiens
gggctggaggccca

SEQ ID NO: 2490235 - DNA, 16 bp, Homo sapiens
gggctggaggcccagg

SEQ ID NO: 2490236 - DNA, 19 bp, Homo sapiens
gggctggaggcccaggctg

SEQ ID NO: 2490237 - DNA, 15 bp, Homo sapiens
gggctggatgagctc

SEQ ID NO: 2490238 - DNA, 13 bp, Homo sapiens
gggctggccgctg

SEQ ID NO: 2490239 - DNA, 22 bp, Homo sapiens
gggctgtaactgccaggctctc

SEQ ID NO: 2490240 - DNA, 22 bp, Homo sapiens
gggctgtcctgccacccagccc

SEQ ID NO: 2490241 - DNA, 14 bp, Homo sapiens
gggcttatatctgg

SEQ ID NO: 2490242 - DNA, 17 bp, Homo sapiens
gggcttcagctgccagt

SEQ ID NO: 2490243 - DNA, 12 bp, Homo sapiens
gggcttcctgga

SEQ ID NO: 2490244 - DNA, 13 bp, Homo sapiens
gggcttcctggag

SEQ ID NO: 2490245 - DNA, 21 bp, Homo sapiens
gggcttcctggagcagaagca

SEQ ID NO: 2490246 - DNA, 14 bp, Homo sapiens
gggcttgccttctg

SEQ ID NO: 2490247 - DNA, 21 bp, Homo sapiens
gggcttgctattctgtcccta

SEQ ID NO: 2490248 - DNA, 16 bp, Homo sapiens
gggcttgtggggcctg

SEQ ID NO: 2490249 - DNA, 18 bp, Homo sapiens
gggcttgtggggcctggg

SEQ ID NO: 2490250 - DNA, 14 bp, Homo sapiens
gggcttttttcttt

SEQ ID NO: 2490251 - DNA, 18 bp, Homo sapiens
ggggaaagcaaagcacag

SEQ ID NO: 2490252 - DNA, 21 bp, Homo sapiens
ggggaaagcaaagcacagaga

SEQ ID NO: 2490253 - DNA, 13 bp, Homo sapiens
ggggaactggcca

SEQ ID NO: 2490254 - DNA, 20 bp, Homo sapiens
ggggaagagagcctgcagga

SEQ ID NO: 2490255 - DNA, 14 bp, Homo sapiens
ggggaccagcagcc

SEQ ID NO: 2490256 - DNA, 13 bp, Homo sapiens
ggggaccaggagt

SEQ ID NO: 2490257 - DNA, 15 bp, Homo sapiens
ggggacttggcctct

SEQ ID NO: 2490258 - DNA, 19 bp, Homo sapiens
ggggagcccactgtcctgg

SEQ ID NO: 2490259 - DNA, 14 bp, Homo sapiens
ggggagggaaggga

SEQ ID NO: 2490260 - DNA, 20 bp, Homo sapiens
ggggagggaagggagccaag

SEQ ID NO: 2490261 - DNA, 13 bp, Homo sapiens
ggggagggtaggc

SEQ ID NO: 2490262 - DNA, 17 bp, Homo sapiens
ggggagggtaggcagga

SEQ ID NO: 2490263 - DNA, 17 bp, Homo sapiens
ggggagttaagacctgg

SEQ ID NO: 2490264 - DNA, 14 bp, Homo sapiens
ggggcacaagactg

SEQ ID NO: 2490265 - DNA, 22 bp, Homo sapiens
ggggcacaagactgacgccagg

SEQ ID NO: 2490266 - DNA, 20 bp, Homo sapiens
ggggcaggagtagctgagct

SEQ ID NO: 2490267 - DNA, 16 bp, Homo sapiens
ggggcaggctgggcca

SEQ ID NO: 2490268 - DNA, 15 bp, Homo sapiens
ggggcatctggcctg

SEQ ID NO: 2490269 - DNA, 13 bp, Homo sapiens
ggggccagatcca

SEQ ID NO: 2490270 - DNA, 14 bp, Homo sapiens
ggggccagatccag

SEQ ID NO: 2490271 - DNA, 17 bp, Homo sapiens
ggggccagatccagcct

SEQ ID NO: 2490272 - DNA, 20 bp, Homo sapiens
gtaggggcccctctcagccc

SEQ ID NO: 2490273 - DNA, 16 bp, Homo sapiens
gtagggggctggagga

SEQ ID NO: 2490274 - DNA, 20 bp, Homo sapiens
gtagggggtccctccaagtg

SEQ ID NO: 2490275 - DNA, 12 bp, Homo sapiens
gtagggtgggag

SEQ ID NO: 2490276 - DNA, 12 bp, Homo sapiens
gtagggtttcta

SEQ ID NO: 2490277 - DNA, 23 bp, Homo sapiens
gtaggtggaagctagacacatga

SEQ ID NO: 2490278 - DNA, 24 bp, Homo sapiens
gtaggtggaagctagacacatgaa

SEQ ID NO: 2490279 - DNA, 17 bp, Homo sapiens
gtaggttcagccaaggt

SEQ ID NO: 2490280 - DNA, 13 bp, Homo sapiens
gtaggttgcacac

SEQ ID NO: 2490281 - DNA, 19 bp, Homo sapiens
gtaggttgcacactttggt

SEQ ID NO: 2490282 - DNA, 13 bp, Homo sapiens
gtagtaacactaa

SEQ ID NO: 2490283 - DNA, 14 bp, Homo sapiens
gtagtaacactaat

SEQ ID NO: 2490284 - DNA, 15 bp, Homo sapiens
gtagtaacactaata

SEQ ID NO: 2490285 - DNA, 15 bp, Homo sapiens
gtagtaccaaaataa

SEQ ID NO: 2490286 - DNA, 16 bp, Homo sapiens
gtagtaggcattttta

SEQ ID NO: 2490287 - DNA, 19 bp, Homo sapiens
gtagtattttttgtataat

SEQ ID NO: 2490288 - DNA, 13 bp, Homo sapiens
gtagttctaagac

SEQ ID NO: 2490289 - DNA, 14 bp, Homo sapiens
gtagttgaatattg

SEQ ID NO: 2490290 - DNA, 12 bp, Homo sapiens
gtagttgtcttt

SEQ ID NO: 2490291 - DNA, 15 bp, Homo sapiens
gtataaaactttcct

SEQ ID NO: 2490292 - DNA, 19 bp, Homo sapiens
gtataaaactttcctcgcc

SEQ ID NO: 2490293 - DNA, 15 bp, Homo sapiens
gtataaacaagaaaa

SEQ ID NO: 2490294 - DNA, 16 bp, Homo sapiens
gtataaactgatggat

SEQ ID NO: 2490295 - DNA, 16 bp, Homo sapiens
gtataaatgtctttaa

SEQ ID NO: 2490296 - DNA, 18 bp, Homo sapiens
gtataattggatttccta

SEQ ID NO: 2490297 - DNA, 23 bp, Homo sapiens
gtatactagggagccatttgaga

SEQ ID NO: 2490298 - DNA, 12 bp, Homo sapiens
gtatatactttg

SEQ ID NO: 2490299 - DNA, 16 bp, Homo sapiens
gtatatggtatttatt

SEQ ID NO: 2490300 - DNA, 12 bp, Homo sapiens
gtatattcagga

SEQ ID NO: 2490301 - DNA, 13 bp, Homo sapiens
gtatattgtgttt

SEQ ID NO: 2490302 - DNA, 20 bp, Homo sapiens
gtatattgtgtttgtgtatt

SEQ ID NO: 2490303 - DNA, 13 bp, Homo sapiens
gtatcaaatacat

SEQ ID NO: 2490304 - DNA, 14 bp, Homo sapiens
gtatcaggacccag

SEQ ID NO: 2490305 - DNA, 22 bp, Homo sapiens
gtatcaggacccagaggaaggg

SEQ ID NO: 2490306 - DNA, 14 bp, Homo sapiens
gtatccccccatct

SEQ ID NO: 2490307 - DNA, 13 bp, Homo sapiens
gtatcccctgcag

SEQ ID NO: 2490308 - DNA, 11 bp, Homo sapiens
gtatctcagaa

SEQ ID NO: 2490309 - DNA, 18 bp, Homo sapiens
gtatctcagaaagtgcct

SEQ ID NO: 2490310 - DNA, 21 bp, Homo sapiens
gtctcgagcgccctgcagacc

SEQ ID NO: 2490311 - DNA, 17 bp, Homo sapiens
gtctcgctttgttgccc

SEQ ID NO: 2490312 - DNA, 19 bp, Homo sapiens
gtctcgctttgttgcccag

SEQ ID NO: 2490313 - DNA, 23 bp, Homo sapiens
gtctcgctttgttgcccaggctg

SEQ ID NO: 2490314 - DNA, 21 bp, Homo sapiens
gtctctaattctattaaagtg

SEQ ID NO: 2490315 - DNA, 17 bp, Homo sapiens
gtctctcagggccaggc

SEQ ID NO: 2490316 - DNA, 17 bp, Homo sapiens
gtctctctatgcctctc

SEQ ID NO: 2490317 - DNA, 18 bp, Homo sapiens
gtctctctatgcctctct

SEQ ID NO: 2490318 - DNA, 22 bp, Homo sapiens
gtctctctatgcctctctacag

SEQ ID NO: 2490319 - DNA, 15 bp, Homo sapiens
gtctctgctggccca

SEQ ID NO: 2490320 - DNA, 13 bp, Homo sapiens
gtctcttgtaatc

SEQ ID NO: 2490321 - DNA, 13 bp, Homo sapiens
gtctcttttctct

SEQ ID NO: 2490322 - DNA, 14 bp, Homo sapiens
gtctgaggtcctga

SEQ ID NO: 2490323 - DNA, 19 bp, Homo sapiens
gtctgccaacctaaaactc

SEQ ID NO: 2490324 - DNA, 21 bp, Homo sapiens
gtctgccaacctaaaactctt

SEQ ID NO: 2490325 - DNA, 21 bp, Homo sapiens
gtctgctcccaaggggcctga

SEQ ID NO: 2490326 - DNA, 15 bp, Homo sapiens
gtctgctctttctct

SEQ ID NO: 2490327 - DNA, 19 bp, Homo sapiens
gtctgctctttctctgcca

SEQ ID NO: 2490328 - DNA, 14 bp, Homo sapiens
gtctggaagatggg

SEQ ID NO: 2490329 - DNA, 10 bp, Homo sapiens
gtctggagac

SEQ ID NO: 2490330 - DNA, 21 bp, Homo sapiens
gtctggataacttccacaggg

SEQ ID NO: 2490331 - DNA, 22 bp, Homo sapiens
gtctggcaatgccacagccctg

SEQ ID NO: 2490332 - DNA, 22 bp, Homo sapiens
gtctggcagcctcccatccagg

SEQ ID NO: 2490333 - DNA, 23 bp, Homo sapiens
gtctggggagcgggtctgctccc

SEQ ID NO: 2490334 - DNA, 20 bp, Homo sapiens
gtctgggggcacaagactga

SEQ ID NO: 2490335 - DNA, 15 bp, Homo sapiens
gtctgggtgctactg

SEQ ID NO: 2490336 - DNA, 20 bp, Homo sapiens
gtctgggtgctactggggaa

SEQ ID NO: 2490337 - DNA, 15 bp, Homo sapiens
gtctgggtggctcac

SEQ ID NO: 2490338 - DNA, 18 bp, Homo sapiens
gtctgggtggggcccagg

SEQ ID NO: 2490339 - DNA, 19 bp, Homo sapiens
gtctgggtggggcccaggc

SEQ ID NO: 2490340 - DNA, 17 bp, Homo sapiens
gtctgtaggttgcacac

SEQ ID NO: 2490341 - DNA, 18 bp, Homo sapiens
gtctgtaggttgcacact

SEQ ID NO: 2490342 - DNA, 22 bp, Homo sapiens
gtctgtagtgtcactcaaggcg

SEQ ID NO: 2490343 - DNA, 22 bp, Homo sapiens
gtctgtgccccttccgccactg

SEQ ID NO: 2490344 - DNA, 13 bp, Homo sapiens
gtctgtggatcag

SEQ ID NO: 2490345 - DNA, 16 bp, Homo sapiens
gtctgtggattttttc

SEQ ID NO: 2490346 - DNA, 16 bp, Homo sapiens
gtctgttggcaggctg

SEQ ID NO: 2490347 - DNA, 21 bp, Homo sapiens
gtctgttggcaggctggccag

SEQ ID NO: 2490348 - DNA, 22 bp, Homo sapiens
gtcttaaactaaatgtgcaata

SEQ ID NO: 2490349 - DNA, 14 bp, Homo sapiens
gtcttctaaacttc

SEQ ID NO: 2490350 - DNA, 16 bp, Homo sapiens
gtcttgagctctatta

SEQ ID NO: 2490351 - DNA, 16 bp, Homo sapiens
gtcttgggcagagctg

SEQ ID NO: 2490352 - DNA, 19 bp, Homo sapiens
gtcttgggcagagctggct

SEQ ID NO: 2490353 - DNA, 24 bp, Homo sapiens
gtctttagatagccctgtcctggt

SEQ ID NO: 2490354 - DNA, 18 bp, Homo sapiens
gtctttccacggagccac

SEQ ID NO: 2490355 - DNA, 22 bp, Homo sapiens
gtctttggagaaatgcttagaa

SEQ ID NO: 2490356 - DNA, 12 bp, Homo sapiens
gtcttttgcttt

SEQ ID NO: 2490357 - DNA, 16 bp, Homo sapiens
gtcttttgcttttggc

SEQ ID NO: 2490358 - DNA, 16 bp, Homo sapiens
gtcttttggttatgaa

SEQ ID NO: 2490359 - DNA, 15 bp, Homo sapiens
gtcttttgttcgcat

SEQ ID NO: 2490360 - DNA, 15 bp, Homo sapiens
gtctttttttgtata

SEQ ID NO: 2490361 - DNA, 14 bp, Homo sapiens
gtgaagacagaagt

SEQ ID NO: 2490362 - DNA, 20 bp, Homo sapiens
gtgaagccaattcagacagg

SEQ ID NO: 2490363 - DNA, 22 bp, Homo sapiens
gtgaagccaattcagacaggca

SEQ ID NO: 2490364 - DNA, 10 bp, Homo sapiens
gtgaagcctt

SEQ ID NO: 2490365 - DNA, 11 bp, Homo sapiens
gtgaagccttc

SEQ ID NO: 2490366 - DNA, 17 bp, Homo sapiens
gtgaaggcttctctctg

SEQ ID NO: 2490367 - DNA, 13 bp, Homo sapiens
gtgaagttgctgc

SEQ ID NO: 2490368 - DNA, 14 bp, Homo sapiens
gtgaagttgctgct

SEQ ID NO: 2490369 - DNA, 13 bp, Homo sapiens
gtgaatgaacact

SEQ ID NO: 2490370 - DNA, 15 bp, Homo sapiens
gtgaatgctgggact

SEQ ID NO: 2490371 - DNA, 12 bp, Homo sapiens
gtgaatgggtgc

SEQ ID NO: 2490372 - DNA, 22 bp, Homo sapiens
gtgaattaggctgtaactactt

SEQ ID NO: 2490373 - DNA, 12 bp, Homo sapiens
gtgacaataaaa

SEQ ID NO: 2490374 - DNA, 13 bp, Homo sapiens
gtgacacaaacac

SEQ ID NO: 2490375 - DNA, 18 bp, Homo sapiens
gtgacacaaacacacaca

SEQ ID NO: 2490376 - DNA, 16 bp, Homo sapiens
gtgacagacaggctct

SEQ ID NO: 2490377 - DNA, 22 bp, Homo sapiens
gtgacatttgggagacatgtga

SEQ ID NO: 2490378 - DNA, 17 bp, Homo sapiens
gtgaccactctgtcttg

SEQ ID NO: 2490379 - DNA, 19 bp, Homo sapiens
gtgaccccagggcacagga

SEQ ID NO: 2490380 - DNA, 21 bp, Homo sapiens
gtgaccccagggcacaggagc

SEQ ID NO: 2490381 - DNA, 18 bp, Homo sapiens
gtgacctatacctgtgtt

SEQ ID NO: 2490382 - DNA, 18 bp, Homo sapiens
gtgacctgctaggccaga

SEQ ID NO: 2490383 - DNA, 12 bp, Homo sapiens
tccatgattcta

SEQ ID NO: 2490384 - DNA, 16 bp, Homo sapiens
tccatgcgctcagggc

SEQ ID NO: 2490385 - DNA, 22 bp, Homo sapiens
tccatgctgtgcgcccagggct

SEQ ID NO: 2490386 - DNA, 15 bp, Homo sapiens
tccatggccagcagc

SEQ ID NO: 2490387 - DNA, 16 bp, Homo sapiens
tccatggccagcagca

SEQ ID NO: 2490388 - DNA, 18 bp, Homo sapiens
tccatgggcagagcccaa

SEQ ID NO: 2490389 - DNA, 15 bp, Homo sapiens
tccatgtaactgcct

SEQ ID NO: 2490390 - DNA, 22 bp, Homo sapiens
tccatgtaactgcctagaaaca

SEQ ID NO: 2490391 - DNA, 14 bp, Homo sapiens
tccatgtgcccagt

SEQ ID NO: 2490392 - DNA, 16 bp, Homo sapiens
tccatgtgcccagtta

SEQ ID NO: 2490393 - DNA, 15 bp, Homo sapiens
tccattggtccaaga

SEQ ID NO: 2490394 - DNA, 19 bp, Homo sapiens
tccattggtccaagattcc

SEQ ID NO: 2490395 - DNA, 22 bp, Homo sapiens
tccattggtccaagattccgga

SEQ ID NO: 2490396 - DNA, 17 bp, Homo sapiens
tcctgagcactgccagg

SEQ ID NO: 2490397 - DNA, 17 bp, Homo sapiens
tcctgagccccagggag

SEQ ID NO: 2490398 - DNA, 14 bp, Homo sapiens
tcctgagctcagcg

SEQ ID NO: 2490399 - DNA, 17 bp, Homo sapiens
tcctgattgtttacagt

SEQ ID NO: 2490400 - DNA, 17 bp, Homo sapiens
tcctgcaactcaaggac

SEQ ID NO: 2490401 - DNA, 21 bp, Homo sapiens
tcctgcacttacttgcttatt

SEQ ID NO: 2490402 - DNA, 20 bp, Homo sapiens
tcctgccacccagccccagc

SEQ ID NO: 2490403 - DNA, 22 bp, Homo sapiens
tcctgccacccagccccagcca

SEQ ID NO: 2490404 - DNA, 14 bp, Homo sapiens
tcctgccagcccct

SEQ ID NO: 2490405 - DNA, 14 bp, Homo sapiens
tcctgccccaggcc

SEQ ID NO: 2490406 - DNA, 17 bp, Homo sapiens
tcctgcccccaaggagg

SEQ ID NO: 2490407 - DNA, 17 bp, Homo sapiens
tcctgccggctccttgg

SEQ ID NO: 2490408 - DNA, 16 bp, Homo sapiens
tcctgcctcagcctcc

SEQ ID NO: 2490409 - DNA, 21 bp, Homo sapiens
tcctgcctctactgggaaggc

SEQ ID NO: 2490410 - DNA, 12 bp, Homo sapiens
tcctgcctgtgg

SEQ ID NO: 2490411 - DNA, 15 bp, Homo sapiens
tcctgcctgtggcca

SEQ ID NO: 2490412 - DNA, 14 bp, Homo sapiens
tcctgccttcctcc

SEQ ID NO: 2490413 - DNA, 16 bp, Homo sapiens
tcctgccttgaaaaag

SEQ ID NO: 2490414 - DNA, 19 bp, Homo sapiens
tcctgccttggcctcccaa

SEQ ID NO: 2490415 - DNA, 21 bp, Homo sapiens
tcctgccttggcctcccaagt

SEQ ID NO: 2490416 - DNA, 13 bp, Homo sapiens
tcctgcgggtggg

SEQ ID NO: 2490417 - DNA, 20 bp, Homo sapiens
tcctgctaacggtgctcagg

SEQ ID NO: 2490418 - DNA, 16 bp, Homo sapiens
tcctgctgctccctca

SEQ ID NO: 2490419 - DNA, 18 bp, Homo sapiens
tcctgctgctgtctgggt

SEQ ID NO: 2490420 - DNA, 22 bp, Homo sapiens
tcctggaaattgacgaggggtg

SEQ ID NO: 2490421 - DNA, 19 bp, Homo sapiens
tcctggacagctgtgcctc

SEQ ID NO: 2490422 - DNA, 22 bp, Homo sapiens
tcctggacagctgtgcctcgct

SEQ ID NO: 2490423 - DNA, 13 bp, Homo sapiens
tcctggagcagaa

SEQ ID NO: 2490424 - DNA, 20 bp, Homo sapiens
tcctggagcagaagcagcaa

SEQ ID NO: 2490425 - DNA, 19 bp, Homo sapiens
tcctggagcagaccacccc

SEQ ID NO: 2490426 - DNA, 13 bp, Homo sapiens
tcctggaggccca

SEQ ID NO: 2490427 - DNA, 15 bp, Homo sapiens
tcctggaggcccagt

SEQ ID NO: 2490428 - DNA, 14 bp, Homo sapiens
tcctggcccagcct

SEQ ID NO: 2490429 - DNA, 17 bp, Homo sapiens
tcctggcccagcctttg

SEQ ID NO: 2490430 - DNA, 20 bp, Homo sapiens
tcctggcgcctggcagtccg

SEQ ID NO: 2490431 - DNA, 20 bp, Homo sapiens
tcctggcttcccatccccag

SEQ ID NO: 2490432 - DNA, 21 bp, Homo sapiens
tcctggcttcccatccccagc

SEQ ID NO: 2490433 - DNA, 22 bp, Homo sapiens
tcctggcttcccatccccagcg

SEQ ID NO: 2490434 - DNA, 14 bp, Homo sapiens
tcctgggaaatatt

SEQ ID NO: 2490435 - DNA, 20 bp, Homo sapiens
tcctgggaaatattccctag

SEQ ID NO: 2490436 - DNA, 23 bp, Homo sapiens
tcctgggccctctctgctctgcg

SEQ ID NO: 2490437 - DNA, 13 bp, Homo sapiens
tcctgggcctgca

SEQ ID NO: 2490438 - DNA, 17 bp, Homo sapiens
tcctgggtggctactct

SEQ ID NO: 2490439 - DNA, 20 bp, Homo sapiens
tcctgggttttgtattctct

SEQ ID NO: 2490440 - DNA, 21 bp, Homo sapiens
tcctgggttttgtattctctg

SEQ ID NO: 2490441 - DNA, 23 bp, Homo sapiens
tcctgggttttgtattctctgag

SEQ ID NO: 2490442 - DNA, 16 bp, Homo sapiens
tcctggtcacctagga

SEQ ID NO: 2490443 - DNA, 17 bp, Homo sapiens
tcctggtcacctaggaa

SEQ ID NO: 2490444 - DNA, 20 bp, Homo sapiens
tcctggtcacctaggaagcc

SEQ ID NO: 2490445 - DNA, 13 bp, Homo sapiens
tcctggtggggca

SEQ ID NO: 2490446 - DNA, 21 bp, Homo sapiens
tcctggtggggcagctcctct

SEQ ID NO: 2490447 - DNA, 16 bp, Homo sapiens
tcctggtggtattttc

SEQ ID NO: 2490448 - DNA, 14 bp, Homo sapiens
tcctgtacattgtg

SEQ ID NO: 2490449 - DNA, 19 bp, Homo sapiens
tcctgtatacctcctccag

SEQ ID NO: 2490450 - DNA, 17 bp, Homo sapiens
tcctgtattcagacaga

SEQ ID NO: 2490451 - DNA, 22 bp, Homo sapiens
tcctgtatttgttcccaagagc

SEQ ID NO: 2490452 - DNA, 16 bp, Homo sapiens
tcctgtccagctccaa

SEQ ID NO: 2490453 - DNA, 16 bp, Homo sapiens
tcctgtcccctgctac

SEQ ID NO: 2490454 - DNA, 17 bp, Homo sapiens
tcctgtcccctgctaca

SEQ ID NO: 2490455 - DNA, 22 bp, Homo sapiens
tcctgtcctttaccaaagatga

SEQ ID NO: 2490456 - DNA, 15 bp, Homo sapiens
tcctgtgctcagccc

SEQ ID NO: 2490457 - DNA, 18 bp, Homo sapiens
tcctgtgctcagccctga

SEQ ID NO: 2490458 - DNA, 14 bp, Homo sapiens
tcctgtggctccct

SEQ ID NO: 2490459 - DNA, 18 bp, Homo sapiens
tcctgtgggagcctcgca

SEQ ID NO: 2490460 - DNA, 21 bp, Homo sapiens
tcctgtgtggagagggaatgt

SEQ ID NO: 2490461 - DNA, 12 bp, Homo sapiens
tcctgtgtgtta

SEQ ID NO: 2490462 - DNA, 18 bp, Homo sapiens
tcctgtgtgttaagctct

SEQ ID NO: 2490463 - DNA, 21 bp, Homo sapiens
tcctgttttgcacagccaaat

SEQ ID NO: 2490464 - DNA, 14 bp, Homo sapiens
tccttactcctgtg

SEQ ID NO: 2490465 - DNA, 22 bp, Homo sapiens
tccttactcctgtgggagcctc

SEQ ID NO: 2490466 - DNA, 23 bp, Homo sapiens
tccttactcctgtgggagcctcg

SEQ ID NO: 2490467 - DNA, 21 bp, Homo sapiens
tccttagcctggacctctgac

SEQ ID NO: 2490468 - DNA, 23 bp, Homo sapiens
tccttagcctggacctctgacag

SEQ ID NO: 2490469 - DNA, 19 bp, Homo sapiens
tccttcagagagcagtgct

SEQ ID NO: 2490470 - DNA, 21 bp, Homo sapiens
tccttcagagagcagtgcttt

SEQ ID NO: 2490471 - DNA, 16 bp, Homo sapiens
tccttccagctagtga

SEQ ID NO: 2490472 - DNA, 12 bp, Homo sapiens
tccttccctctc

SEQ ID NO: 2490473 - DNA, 14 bp, Homo sapiens
tccttccctctctg

SEQ ID NO: 2490474 - DNA, 16 bp, Homo sapiens
tccttccgcttggagc

SEQ ID NO: 2490475 - DNA, 20 bp, Homo sapiens
tccttcctgattgtttacag

SEQ ID NO: 2490476 - DNA, 18 bp, Homo sapiens
tccttctgagctcctgtc

SEQ ID NO: 2490477 - DNA, 19 bp, Homo sapiens
tccttgaagaactgcaggc

SEQ ID NO: 2490478 - DNA, 21 bp, Homo sapiens
tccttgaagaactgcaggccc

SEQ ID NO: 2490479 - DNA, 24 bp, Homo sapiens
tgacgtgaccggacttttctgcaa

SEQ ID NO: 2490480 - DNA, 15 bp, Homo sapiens
tgactaatggcatga

SEQ ID NO: 2490481 - DNA, 16 bp, Homo sapiens
tgactacagtcaggaa

SEQ ID NO: 2490482 - DNA, 17 bp, Homo sapiens
tgactacagtcaggaaa

SEQ ID NO: 2490483 - DNA, 21 bp, Homo sapiens
tgactagggagccatgtttca

SEQ ID NO: 2490484 - DNA, 20 bp, Homo sapiens
tgactattcttgatgtaaaa

SEQ ID NO: 2490485 - DNA, 21 bp, Homo sapiens
tgactattcttgatgtaaaat

SEQ ID NO: 2490486 - DNA, 15 bp, Homo sapiens
tgactcaagaagtga

SEQ ID NO: 2490487 - DNA, 22 bp, Homo sapiens
tgactcaagaagtgaagaatgc

SEQ ID NO: 2490488 - DNA, 19 bp, Homo sapiens
tgactcacacctgaactga

SEQ ID NO: 2490489 - DNA, 14 bp, Homo sapiens
tgactcaggagcct

SEQ ID NO: 2490490 - DNA, 21 bp, Homo sapiens
tgactcaggagcctgtgacat

SEQ ID NO: 2490491 - DNA, 17 bp, Homo sapiens
tgactcgggggtgggga

SEQ ID NO: 2490492 - DNA, 16 bp, Homo sapiens
tgactcggtttctcca

SEQ ID NO: 2490493 - DNA, 14 bp, Homo sapiens
tgactgccaagact

SEQ ID NO: 2490494 - DNA, 17 bp, Homo sapiens
tgactgtagctttggaa

SEQ ID NO: 2490495 - DNA, 15 bp, Homo sapiens
tgacttctgcctgga

SEQ ID NO: 2490496 - DNA, 18 bp, Homo sapiens
tgacttctgcctggagac

SEQ ID NO: 2490497 - DNA, 13 bp, Homo sapiens
tgacttggctggt

SEQ ID NO: 2490498 - DNA, 21 bp, Homo sapiens
tgacttggctggtgtggtaca

SEQ ID NO: 2490499 - DNA, 19 bp, Homo sapiens
tgacttgggcacccccagc

SEQ ID NO: 2490500 - DNA, 21 bp, Homo sapiens
tgacttgggcacccccagcct

SEQ ID NO: 2490501 - DNA, 22 bp, Homo sapiens
tgactttccccaccagatgctg

SEQ ID NO: 2490502 - DNA, 23 bp, Homo sapiens
tgactttccccaccagatgctga

SEQ ID NO: 2490503 - DNA, 16 bp, Homo sapiens
tgagaaagccttcttt

SEQ ID NO: 2490504 - DNA, 19 bp, Homo sapiens
tgagaaagggtagaattct

SEQ ID NO: 2490505 - DNA, 22 bp, Homo sapiens
tgagaaatagcttatgaaaaga

SEQ ID NO: 2490506 - DNA, 17 bp, Homo sapiens
tgagaaatttaaactat

SEQ ID NO: 2490507 - DNA, 12 bp, Homo sapiens
tgagaacctggc

SEQ ID NO: 2490508 - DNA, 15 bp, Homo sapiens
tgagaacctggcctt

SEQ ID NO: 2490509 - DNA, 21 bp, Homo sapiens
tgagaatcccaaatttgattg

SEQ ID NO: 2490510 - DNA, 18 bp, Homo sapiens
tgagactgggtctcgctt

SEQ ID NO: 2490511 - DNA, 16 bp, Homo sapiens
tgagagtctagattct

SEQ ID NO: 2490512 - DNA, 14 bp, Homo sapiens
tgagatacatacag

SEQ ID NO: 2490513 - DNA, 21 bp, Homo sapiens
tgagatacatacagaattact

SEQ ID NO: 2490514 - DNA, 19 bp, Homo sapiens
tgagatattaatgcccaga

SEQ ID NO: 2490515 - DNA, 17 bp, Homo sapiens
tgagatgctggcttggg

SEQ ID NO: 2490516 - DNA, 17 bp, Homo sapiens
tgagatggagtcttgct

SEQ ID NO: 2490517 - DNA, 15 bp, Homo sapiens
tgagattctcaaagg

SEQ ID NO: 2490518 - DNA, 18 bp, Homo sapiens
tgagattgcaccactgca

SEQ ID NO: 2490519 - DNA, 17 bp, Homo sapiens
tgagatttattaaagaa

SEQ ID NO: 2490520 - DNA, 16 bp, Homo sapiens
tgagcaaatcaccaca

SEQ ID NO: 2490521 - DNA, 16 bp, Homo sapiens
tgagcaactcttgatt

SEQ ID NO: 2490522 - DNA, 14 bp, Homo sapiens
tgagcactgccagg

SEQ ID NO: 2490523 - DNA, 14 bp, Homo sapiens
tgagcagtccttgg

SEQ ID NO: 2490524 - DNA, 16 bp, Homo sapiens
tgagcagtccttggcc

SEQ ID NO: 2490525 - DNA, 12 bp, Homo sapiens
tgagcagtggct

SEQ ID NO: 2490526 - DNA, 14 bp, Homo sapiens
tgagcagtggctgg

SEQ ID NO: 2490527 - DNA, 22 bp, Homo sapiens
tgagcagtggctggtccagggc

SEQ ID NO: 2490528 - DNA, 14 bp, Homo sapiens
tgagcatcacagaa

SEQ ID NO: 2490529 - DNA, 18 bp, Homo sapiens
tgagcatcacagaatgtg

SEQ ID NO: 2490530 - DNA, 19 bp, Homo sapiens
tgagcatggaacacttcga

SEQ ID NO: 2490531 - DNA, 16 bp, Homo sapiens
tgagcatgttactgac

SEQ ID NO: 2490532 - DNA, 22 bp, Homo sapiens
tgagccagggtctccagaaagc

SEQ ID NO: 2490533 - DNA, 21 bp, Homo sapiens
tgagcccagctgggtcaggca

SEQ ID NO: 2490534 - DNA, 14 bp, Homo sapiens
tgagcccagggagg

SEQ ID NO: 2490535 - DNA, 23 bp, Homo sapiens
tgagcgagtggagtctgccaccc

SEQ ID NO: 2490536 - DNA, 18 bp, Homo sapiens
tgagctagaaccctctgt

SEQ ID NO: 2490537 - DNA, 17 bp, Homo sapiens
tgagctcacaaggcagc

SEQ ID NO: 2490538 - DNA, 13 bp, Homo sapiens
tgagctctctgcc

SEQ ID NO: 2490539 - DNA, 20 bp, Homo sapiens
tgagctctgagaggccctgg

SEQ ID NO: 2490540 - DNA, 14 bp, Homo sapiens
tgagctgagcaggc

SEQ ID NO: 2490541 - DNA, 14 bp, Homo sapiens
tgagctgaggcagc

SEQ ID NO: 2490542 - DNA, 21 bp, Homo sapiens
tgagcttaaaatacaagactg

SEQ ID NO: 2490543 - DNA, 11 bp, Homo sapiens
tgaggagcccc

SEQ ID NO: 2490544 - DNA, 15 bp, Homo sapiens
tgatgctgcccctca

SEQ ID NO: 2490545 - DNA, 19 bp, Homo sapiens
tgatgtcaatttctgtgtt

SEQ ID NO: 2490546 - DNA, 16 bp, Homo sapiens
tgatgtcatacagaga

SEQ ID NO: 2490547 - DNA, 21 bp, Homo sapiens
tgatgtcatacagagaagtca

SEQ ID NO: 2490548 - DNA, 22 bp, Homo sapiens
tgatgtcatacagagaagtcac

SEQ ID NO: 2490549 - DNA, 23 bp, Homo sapiens
tgatgttaaaaaaataagaagaa

SEQ ID NO: 2490550 - DNA, 18 bp, Homo sapiens
tgatgttctaaggctctg

SEQ ID NO: 2490551 - DNA, 20 bp, Homo sapiens
tgatgttctaaggctctgag

SEQ ID NO: 2490552 - DNA, 15 bp, Homo sapiens
tgattaaagatgagc

SEQ ID NO: 2490553 - DNA, 18 bp, Homo sapiens
tgattaaataagattcta

SEQ ID NO: 2490554 - DNA, 22 bp, Homo sapiens
tgattaaataagattctaacgg

SEQ ID NO: 2490555 - DNA, 20 bp, Homo sapiens
tgattactggcctttttcat

SEQ ID NO: 2490556 - DNA, 23 bp, Homo sapiens
tgattactggcctttttcattta

SEQ ID NO: 2490557 - DNA, 17 bp, Homo sapiens
tgattagacagaacacc

SEQ ID NO: 2490558 - DNA, 20 bp, Homo sapiens
tgattattaacgatgtccaa

SEQ ID NO: 2490559 - DNA, 14 bp, Homo sapiens
tgattattcagtgt

SEQ ID NO: 2490560 - DNA, 16 bp, Homo sapiens
tgattcacctcttctt

SEQ ID NO: 2490561 - DNA, 18 bp, Homo sapiens
tgattcagaaaatgttct

SEQ ID NO: 2490562 - DNA, 20 bp, Homo sapiens
tgattcagaaaatgttctgt

SEQ ID NO: 2490563 - DNA, 22 bp, Homo sapiens
tgattcagaaaatgttctgttt

SEQ ID NO: 2490564 - DNA, 19 bp, Homo sapiens
tgattcatagtaacttctt

SEQ ID NO: 2490565 - DNA, 18 bp, Homo sapiens
tgattccatccacctttc

SEQ ID NO: 2490566 - DNA, 15 bp, Homo sapiens
tgattcctttaacaa

SEQ ID NO: 2490567 - DNA, 22 bp, Homo sapiens
tgattctatttatatgtacatg

SEQ ID NO: 2490568 - DNA, 14 bp, Homo sapiens
tgattgatttgaag

SEQ ID NO: 2490569 - DNA, 13 bp, Homo sapiens
tgattgtcttaat

SEQ ID NO: 2490570 - DNA, 14 bp, Homo sapiens
tgattgtcttaata

SEQ ID NO: 2490571 - DNA, 18 bp, Homo sapiens
tgattgtggaatggagat

SEQ ID NO: 2490572 - DNA, 13 bp, Homo sapiens
tgatttaatgttt

SEQ ID NO: 2490573 - DNA, 16 bp, Homo sapiens
tgatttaggagaagcc

SEQ ID NO: 2490574 - DNA, 22 bp, Homo sapiens
tgatttaggagaagccaggaat

SEQ ID NO: 2490575 - DNA, 18 bp, Homo sapiens
tgatttatcacacaaagc

SEQ ID NO: 2490576 - DNA, 23 bp, Homo sapiens
tgatttattaatatatattatct

SEQ ID NO: 2490577 - DNA, 18 bp, Homo sapiens
tgatttcagttctaggaa

SEQ ID NO: 2490578 - DNA, 19 bp, Homo sapiens
tgatttcagttctaggaaa

SEQ ID NO: 2490579 - DNA, 15 bp, Homo sapiens
tgatttccttgaatg

SEQ ID NO: 2490580 - DNA, 23 bp, Homo sapiens
tgatttccttgaatgtggcttga

SEQ ID NO: 2490581 - DNA, 17 bp, Homo sapiens
tgatttgaagaacatgt

SEQ ID NO: 2490582 - DNA, 19 bp, Homo sapiens
tgatttgaagaacatgtga

SEQ ID NO: 2490583 - DNA, 15 bp, Homo sapiens
tgatttgcattgaac

SEQ ID NO: 2490584 - DNA, 18 bp, Homo sapiens
tgccctaagcagaaagtg

SEQ ID NO: 2490585 - DNA, 22 bp, Homo sapiens
tgccctaagcagaaagtgcctt

SEQ ID NO: 2490586 - DNA, 21 bp, Homo sapiens
tgccctcatggcccctctgac

SEQ ID NO: 2490587 - DNA, 14 bp, Homo sapiens
tgccctcctgtgct

SEQ ID NO: 2490588 - DNA, 21 bp, Homo sapiens
tgccctcctgtgctcagccct

SEQ ID NO: 2490589 - DNA, 12 bp, Homo sapiens
tgccctctgggc

SEQ ID NO: 2490590 - DNA, 13 bp, Homo sapiens
tgccctctgggct

SEQ ID NO: 2490591 - DNA, 17 bp, Homo sapiens
tgccctctgggctctga

SEQ ID NO: 2490592 - DNA, 18 bp, Homo sapiens
tgccctctgggctctgag

SEQ ID NO: 2490593 - DNA, 16 bp, Homo sapiens
tgccctggtggccctc

SEQ ID NO: 2490594 - DNA, 21 bp, Homo sapiens
tgccctggtggccctctcccc

SEQ ID NO: 2490595 - DNA, 12 bp, Homo sapiens
tgccctgtgcaa

SEQ ID NO: 2490596 - DNA, 13 bp, Homo sapiens
tgcccttctttct

SEQ ID NO: 2490597 - DNA, 23 bp, Homo sapiens
tgcccttgtttggggcaggagta

SEQ ID NO: 2490598 - DNA, 15 bp, Homo sapiens
tgccgagcaaccgtg

SEQ ID NO: 2490599 - DNA, 19 bp, Homo sapiens
tgccgagcaaccgtggccc

SEQ ID NO: 2490600 - DNA, 21 bp, Homo sapiens
tgccgagcaaccgtggccctt

SEQ ID NO: 2490601 - DNA, 16 bp, Homo sapiens
tgccggggcagccccc

SEQ ID NO: 2490602 - DNA, 19 bp, Homo sapiens
tgccgtcagtgctgtgctg

SEQ ID NO: 2490603 - DNA, 20 bp, Homo sapiens
tgccgtggattgcacgtggc

SEQ ID NO: 2490604 - DNA, 23 bp, Homo sapiens
tgccgtggggccgccgcctcttt

SEQ ID NO: 2490605 - DNA, 22 bp, Homo sapiens
tgcctagaaacaacactgtagt

SEQ ID NO: 2490606 - DNA, 20 bp, Homo sapiens
tgcctaggcctgggcagtgg

SEQ ID NO: 2490607 - DNA, 21 bp, Homo sapiens
tgcctattatctgtcagctgc

SEQ ID NO: 2490608 - DNA, 21 bp, Homo sapiens
tgcctcaaataaaaagtgctt

SEQ ID NO: 2490609 - DNA, 15 bp, Homo sapiens
tgcctcaatgccagt

SEQ ID NO: 2490610 - DNA, 14 bp, Homo sapiens
tgcctcagcctccg

SEQ ID NO: 2490611 - DNA, 18 bp, Homo sapiens
tgcctcaggaggcaggac

SEQ ID NO: 2490612 - DNA, 19 bp, Homo sapiens
tgcctccagccgccggctg

SEQ ID NO: 2490613 - DNA, 17 bp, Homo sapiens
tgcctcccctctccttc

SEQ ID NO: 2490614 - DNA, 22 bp, Homo sapiens
tgcctccctctcgtaagatttc

SEQ ID NO: 2490615 - DNA, 19 bp, Homo sapiens
tgcctcctccctccctctc

SEQ ID NO: 2490616 - DNA, 14 bp, Homo sapiens
tgcctcctgccggc

SEQ ID NO: 2490617 - DNA, 20 bp, Homo sapiens
tgcctcctgccggctccttg

SEQ ID NO: 2490618 - DNA, 13 bp, Homo sapiens
tgcctcgaaacac

SEQ ID NO: 2490619 - DNA, 17 bp, Homo sapiens
tgcctcgaaacacagaa

SEQ ID NO: 2490620 - DNA, 21 bp, Homo sapiens
tgcctcgctccccactctgct

SEQ ID NO: 2490621 - DNA, 19 bp, Homo sapiens
tgcctctactgggaaggct

SEQ ID NO: 2490622 - DNA, 20 bp, Homo sapiens
tgcctctcgctcctcaaccc

SEQ ID NO: 2490623 - DNA, 15 bp, Homo sapiens
tgcctctctaggacc

SEQ ID NO: 2490624 - DNA, 17 bp, Homo sapiens
tgcctctgaggccagcc

SEQ ID NO: 2490625 - DNA, 18 bp, Homo sapiens
tgcctctgaggccagcct

SEQ ID NO: 2490626 - DNA, 20 bp, Homo sapiens
tgcctctgaggccagcctgg

SEQ ID NO: 2490627 - DNA, 22 bp, Homo sapiens
tgcctctgaggccagcctggcc

SEQ ID NO: 2490628 - DNA, 22 bp, Homo sapiens
tgcctctgccaaaggatgtgat

SEQ ID NO: 2490629 - DNA, 18 bp, Homo sapiens
tgcctctgtcttctggac

SEQ ID NO: 2490630 - DNA, 11 bp, Homo sapiens
tgcctctgtgc

SEQ ID NO: 2490631 - DNA, 13 bp, Homo sapiens
tgcctctgtgctg

SEQ ID NO: 2490632 - DNA, 14 bp, Homo sapiens
tgcctctgtgctgt

SEQ ID NO: 2490633 - DNA, 17 bp, Homo sapiens
tgcctcttccttgaaga

SEQ ID NO: 2490634 - DNA, 13 bp, Homo sapiens
tgcctcttctggg

SEQ ID NO: 2490635 - DNA, 19 bp, Homo sapiens
tgcctgagtcgtgacctgc

SEQ ID NO: 2490636 - DNA, 20 bp, Homo sapiens
tgcctgagtcgtgacctgct

SEQ ID NO: 2490637 - DNA, 23 bp, Homo sapiens
tgcctgcataggagtttggagga

SEQ ID NO: 2490638 - DNA, 14 bp, Homo sapiens
tgcctgccactgtg

SEQ ID NO: 2490639 - DNA, 19 bp, Homo sapiens
tgcctgccagctgcactga

SEQ ID NO: 2490640 - DNA, 14 bp, Homo sapiens
tgcctgcctttcca

SEQ ID NO: 2490641 - DNA, 21 bp, Homo sapiens
tgcctgctcgctccctgcaga

SEQ ID NO: 2490642 - DNA, 12 bp, Homo sapiens
tgcctggacccg

SEQ ID NO: 2490643 - DNA, 11 bp, Homo sapiens
tgcctggagga

SEQ ID NO: 2490644 - DNA, 15 bp, Homo sapiens
tgcctggaggacctg

SEQ ID NO: 2490645 - DNA, 23 bp, Homo sapiens
tgcctgtggcgccgtctccaggg

SEQ ID NO: 2490646 - DNA, 15 bp, Homo sapiens
tgcctgtgtccatgc

SEQ ID NO: 2490647 - DNA, 21 bp, Homo sapiens
tgcctgtgtccatgcgctcag

SEQ ID NO: 2490648 - DNA, 15 bp, Homo sapiens
tgccttagtctcagt

SEQ ID NO: 2490649 - DNA, 15 bp, Homo sapiens
tgccttcctcctggg

SEQ ID NO: 2490650 - DNA, 16 bp, Homo sapiens
tgccttcctcctgggc

SEQ ID NO: 2490651 - DNA, 16 bp, Homo sapiens
tgccttgaaaaagaca

SEQ ID NO: 2490652 - DNA, 20 bp, Homo sapiens
tgccttgttttttgtttgtt

SEQ ID NO: 2490653 - DNA, 14 bp, Homo sapiens
tgccttttatccca

SEQ ID NO: 2490654 - DNA, 19 bp, Homo sapiens
tgccttttgcaaccaggaa

SEQ ID NO: 2490655 - DNA, 22 bp, Homo sapiens
tgccttttttctgtataaatgt

SEQ ID NO: 2490656 - DNA, 16 bp, Homo sapiens
tgcgactttctgcctg

SEQ ID NO: 2490657 - DNA, 13 bp, Homo sapiens
tgcgagagatgtg

SEQ ID NO: 2490658 - DNA, 21 bp, Homo sapiens
tgcgccccctccgccctgcca

SEQ ID NO: 2490659 - DNA, 13 bp, Homo sapiens
tgcgctcagggcc

SEQ ID NO: 2490660 - DNA, 21 bp, Homo sapiens
tgcgctcagggccatgctgag

SEQ ID NO: 2490661 - DNA, 22 bp, Homo sapiens
tgcgctcagggccatgctgagg

SEQ ID NO: 2490662 - DNA, 23 bp, Homo sapiens
tgcgctcagggccatgctgaggc

SEQ ID NO: 2490663 - DNA, 13 bp, Homo sapiens
tgcgctcctggcc

SEQ ID NO: 2490664 - DNA, 14 bp, Homo sapiens
tgcgctcctggccc

SEQ ID NO: 2490665 - DNA, 22 bp, Homo sapiens
tgcggaccaccctcactggctc

SEQ ID NO: 2490666 - DNA, 22 bp, Homo sapiens
tgcggctggccatggagaaagc

SEQ ID NO: 2490667 - DNA, 23 bp, Homo sapiens
tgcggctggccatggagaaagct

SEQ ID NO: 2490668 - DNA, 21 bp, Homo sapiens
tgcgggtgaacaaagcagcca

SEQ ID NO: 2490669 - DNA, 17 bp, Homo sapiens
tgcggtagccagcacac

SEQ ID NO: 2490670 - DNA, 18 bp, Homo sapiens
tgcggttccggcatggac

SEQ ID NO: 2490671 - DNA, 15 bp, Homo sapiens
tgcgtgacaataaaa

SEQ ID NO: 2490672 - DNA, 22 bp, Homo sapiens
tgcgtgacaataaaacattaat

SEQ ID NO: 2490673 - DNA, 18 bp, Homo sapiens
tgcgtggtggtccctggg

SEQ ID NO: 2490674 - DNA, 22 bp, Homo sapiens
tgcgtgtttgggtttttttcct

SEQ ID NO: 2490675 - DNA, 22 bp, Homo sapiens
tgctaaataaaatttgttgcat

SEQ ID NO: 2490676 - DNA, 23 bp, Homo sapiens
tgctaaataaaatttgttgcata

SEQ ID NO: 2490677 - DNA, 13 bp, Homo sapiens
tgctaacatctaa

SEQ ID NO: 2490678 - DNA, 23 bp, Homo sapiens
tgctaaggtcttggaacttgcct

SEQ ID NO: 2490679 - DNA, 13 bp, Homo sapiens
tgctaaggttcta

SEQ ID NO: 2490680 - DNA, 15 bp, Homo sapiens
tgctaaggttctaag

SEQ ID NO: 2490681 - DNA, 16 bp, Homo sapiens
tgctaaggttctaagg

SEQ ID NO: 2490682 - DNA, 18 bp, Homo sapiens
tgctaaggttctaaggcc

SEQ ID NO: 2490683 - DNA, 23 bp, Homo sapiens
tgctaatcagggaggtcattttg

SEQ ID NO: 2490684 - DNA, 14 bp, Homo sapiens
tgctaccaccagct

SEQ ID NO: 2490685 - DNA, 22 bp, Homo sapiens
tgctaccaccagctgtgtccaa

SEQ ID NO: 2490686 - DNA, 15 bp, Homo sapiens
tgctaccagtattta

SEQ ID NO: 2490687 - DNA, 22 bp, Homo sapiens
tgctactggggaaactggccat

SEQ ID NO: 2490688 - DNA, 13 bp, Homo sapiens
tgctgctgagaac

SEQ ID NO: 2490689 - DNA, 17 bp, Homo sapiens
tgctgctgagaacctgg

SEQ ID NO: 2490690 - DNA, 20 bp, Homo sapiens
tgctgctgagaacctggcct

SEQ ID NO: 2490691 - DNA, 17 bp, Homo sapiens
tgctgctgggctcagtg

SEQ ID NO: 2490692 - DNA, 15 bp, Homo sapiens
tgctgctggggaaga

SEQ ID NO: 2490693 - DNA, 19 bp, Homo sapiens
tgctgctggggaagacagt

SEQ ID NO: 2490694 - DNA, 20 bp, Homo sapiens
tgctgctggggaagacagtg

SEQ ID NO: 2490695 - DNA, 24 bp, Homo sapiens
tgctgctggggaagacagtggccc

SEQ ID NO: 2490696 - DNA, 17 bp, Homo sapiens
tgctgctgtctgggtgc

SEQ ID NO: 2490697 - DNA, 18 bp, Homo sapiens
tgctgcttctcccaggca

SEQ ID NO: 2490698 - DNA, 20 bp, Homo sapiens
tgctgcttctcccaggcaag

SEQ ID NO: 2490699 - DNA, 23 bp, Homo sapiens
tgctgcttctcccaggcaaggct

SEQ ID NO: 2490700 - DNA, 21 bp, Homo sapiens
tgctggagggaggctgggcgg

SEQ ID NO: 2490701 - DNA, 12 bp, Homo sapiens
tgctggcccagg

SEQ ID NO: 2490702 - DNA, 19 bp, Homo sapiens
tgctggcccagggcccaga

SEQ ID NO: 2490703 - DNA, 21 bp, Homo sapiens
tgctggcccagggcccagagc

SEQ ID NO: 2490704 - DNA, 23 bp, Homo sapiens
tgctggcccagggcccagagccc

SEQ ID NO: 2490705 - DNA, 15 bp, Homo sapiens
tgctgggagctccac

SEQ ID NO: 2490706 - DNA, 20 bp, Homo sapiens
tgctgggagctccactctgc

SEQ ID NO: 2490707 - DNA, 21 bp, Homo sapiens
tgctgggagctccactctgct

SEQ ID NO: 2490708 - DNA, 14 bp, Homo sapiens
tgctgggatttcca

SEQ ID NO: 2490709 - DNA, 22 bp, Homo sapiens
tgctggggaagacagtggcccc

SEQ ID NO: 2490710 - DNA, 14 bp, Homo sapiens
tgctggggcctggg

SEQ ID NO: 2490711 - DNA, 22 bp, Homo sapiens
tgctgggtccatatcacacaca

SEQ ID NO: 2490712 - DNA, 19 bp, Homo sapiens
tgctggtcccggggccagc

SEQ ID NO: 2490713 - DNA, 20 bp, Homo sapiens
tgctgtaaagagttgctttt

SEQ ID NO: 2490714 - DNA, 17 bp, Homo sapiens
tgctgtacatctatttt

SEQ ID NO: 2490715 - DNA, 12 bp, Homo sapiens
tgctgtccctcc

SEQ ID NO: 2490716 - DNA, 18 bp, Homo sapiens
tgctgtctgggtggctca

SEQ ID NO: 2490717 - DNA, 14 bp, Homo sapiens
tgctgtcttaaact

SEQ ID NO: 2490718 - DNA, 18 bp, Homo sapiens
tgctgtgcgcccagggct

SEQ ID NO: 2490719 - DNA, 14 bp, Homo sapiens
tgctgtggccagga

SEQ ID NO: 2490720 - DNA, 14 bp, Homo sapiens
tgctgttccagtgg

SEQ ID NO: 2490721 - DNA, 16 bp, Homo sapiens
tgctgttttgttatat

SEQ ID NO: 2490722 - DNA, 19 bp, Homo sapiens
tgctgttttgttatataat

SEQ ID NO: 2490723 - DNA, 19 bp, Homo sapiens
tgcttcatgtgtcccagaa

SEQ ID NO: 2490724 - DNA, 14 bp, Homo sapiens
tgcttcctcctgga

SEQ ID NO: 2490725 - DNA, 15 bp, Homo sapiens
tgcttcctcctggaa

SEQ ID NO: 2490726 - DNA, 16 bp, Homo sapiens
tgcttctaagtaaata

SEQ ID NO: 2490727 - DNA, 17 bp, Homo sapiens
tgcttctaagtaaatac

SEQ ID NO: 2490728 - DNA, 19 bp, Homo sapiens
tgcttctaagtaaatacaa

SEQ ID NO: 2490729 - DNA, 16 bp, Homo sapiens
tgcttctcccaggcaa

SEQ ID NO: 2490730 - DNA, 12 bp, Homo sapiens
tgcttctctgac

SEQ ID NO: 2490731 - DNA, 17 bp, Homo sapiens
tgcttctctgacttctg

SEQ ID NO: 2490732 - DNA, 21 bp, Homo sapiens
tgcttctctgacttctgcctg

SEQ ID NO: 2490733 - DNA, 22 bp, Homo sapiens
tgcttctctgacttctgcctgg

SEQ ID NO: 2490734 - DNA, 14 bp, Homo sapiens
tgcttctttctaga

SEQ ID NO: 2490735 - DNA, 13 bp, Homo sapiens
tgcttgaggaaaa

SEQ ID NO: 2490736 - DNA, 13 bp, Homo sapiens
tgcttgatagaaa

SEQ ID NO: 2490737 - DNA, 20 bp, Homo sapiens
tgcttgatgggattctggac

SEQ ID NO: 2490738 - DNA, 22 bp, Homo sapiens
tgcttgatgggattctggacag

SEQ ID NO: 2490739 - DNA, 13 bp, Homo sapiens
tgcactgtaaaat

SEQ ID NO: 2490740 - DNA, 15 bp, Homo sapiens
tgcactgtgaaggac

SEQ ID NO: 2490741 - DNA, 19 bp, Homo sapiens
tgcactgttccccctgtgc

SEQ ID NO: 2490742 - DNA, 21 bp, Homo sapiens
tgcactgttccccctgtgcag

SEQ ID NO: 2490743 - DNA, 18 bp, Homo sapiens
tgcacttacttgcttatt

SEQ ID NO: 2490744 - DNA, 16 bp, Homo sapiens
tgcactttgctttaat

SEQ ID NO: 2490745 - DNA, 20 bp, Homo sapiens
tgcactttgctttaatataa

SEQ ID NO: 2490746 - DNA, 18 bp, Homo sapiens
tgcagaaaattctgtgcc

SEQ ID NO: 2490747 - DNA, 15 bp, Homo sapiens
tgcagaaactactga

SEQ ID NO: 2490748 - DNA, 15 bp, Homo sapiens
tgcagaccctgccct

SEQ ID NO: 2490749 - DNA, 22 bp, Homo sapiens
tgcagacttcccagctaggaag

SEQ ID NO: 2490750 - DNA, 17 bp, Homo sapiens
tgcagccggcacagggt

SEQ ID NO: 2490751 - DNA, 16 bp, Homo sapiens
tgcagcctcaggactg

SEQ ID NO: 2490752 - DNA, 18 bp, Homo sapiens
tgcagcctcaggactggg

SEQ ID NO: 2490753 - DNA, 20 bp, Homo sapiens
tgcagctgtggcagagttac

SEQ ID NO: 2490754 - DNA, 19 bp, Homo sapiens
tgcagcttgtagccagccg

SEQ ID NO: 2490755 - DNA, 20 bp, Homo sapiens
tgcagcttgtagccagccgg

SEQ ID NO: 2490756 - DNA, 22 bp, Homo sapiens
tgcagcttgtagccagccgggg

SEQ ID NO: 2490757 - DNA, 18 bp, Homo sapiens
tgcaggaaggagctgcct

SEQ ID NO: 2490758 - DNA, 14 bp, Homo sapiens
tgcaggatggtgtc

SEQ ID NO: 2490759 - DNA, 15 bp, Homo sapiens
tgcaggccctggcct

SEQ ID NO: 2490760 - DNA, 19 bp, Homo sapiens
tgcaggccctggcctcccc

SEQ ID NO: 2490761 - DNA, 22 bp, Homo sapiens
tgcagggaaaattatttgcata

SEQ ID NO: 2490762 - DNA, 15 bp, Homo sapiens
tgcagggatgtgggt

SEQ ID NO: 2490763 - DNA, 22 bp, Homo sapiens
tgcagggatgtgggttccacag

SEQ ID NO: 2490764 - DNA, 23 bp, Homo sapiens
tgcagggatgtgggttccacaga

SEQ ID NO: 2490765 - DNA, 14 bp, Homo sapiens
tgcagggcagtcat

SEQ ID NO: 2490766 - DNA, 22 bp, Homo sapiens
tgcagggtcctcttctgggcct

SEQ ID NO: 2490767 - DNA, 19 bp, Homo sapiens
tgcaggtggccaagttcct

SEQ ID NO: 2490768 - DNA, 18 bp, Homo sapiens
tgcagtaaatcttttaca

SEQ ID NO: 2490769 - DNA, 16 bp, Homo sapiens
tgcagtatcatgccct

SEQ ID NO: 2490770 - DNA, 21 bp, Homo sapiens
tgcagtatcatgccctgtgca

SEQ ID NO: 2490771 - DNA, 11 bp, Homo sapiens
tgcagtcccaa

SEQ ID NO: 2490772 - DNA, 22 bp, Homo sapiens
tgcagtcctgatcagagccgtg

SEQ ID NO: 2490773 - DNA, 17 bp, Homo sapiens
tgcagtcctgggtcctc

SEQ ID NO: 2490774 - DNA, 21 bp, Homo sapiens
tgcagttcccacattaaagaa

SEQ ID NO: 2490775 - DNA, 14 bp, Homo sapiens
tgcagttgtctctg

SEQ ID NO: 2490776 - DNA, 15 bp, Homo sapiens
tgcagttgtctctgt

SEQ ID NO: 2490777 - DNA, 12 bp, Homo sapiens
tgcagtttatca

SEQ ID NO: 2490778 - DNA, 16 bp, Homo sapiens
tgcagtttatcattca

SEQ ID NO: 2490779 - DNA, 17 bp, Homo sapiens
tgcataacaattcctct

SEQ ID NO: 2490780 - DNA, 22 bp, Homo sapiens
tgcatagtaccaatcattttaa

SEQ ID NO: 2490781 - DNA, 19 bp, Homo sapiens
tgcatatgttgaatacttt

SEQ ID NO: 2490782 - DNA, 21 bp, Homo sapiens
tgcatcagaaagggagggctc

SEQ ID NO: 2490783 - DNA, 22 bp, Homo sapiens
ttatttaaaatagcaaaagaag

SEQ ID NO: 2490784 - DNA, 13 bp, Homo sapiens
ttatttacattta

SEQ ID NO: 2490785 - DNA, 15 bp, Homo sapiens
ttatttacatttaat

SEQ ID NO: 2490786 - DNA, 16 bp, Homo sapiens
ttatttacatttaata

SEQ ID NO: 2490787 - DNA, 15 bp, Homo sapiens
ttatttatgtatggt

SEQ ID NO: 2490788 - DNA, 21 bp, Homo sapiens
ttatttatgtatggtgcaatg

SEQ ID NO: 2490789 - DNA, 22 bp, Homo sapiens
ttatttctgcatatgttgaata

SEQ ID NO: 2490790 - DNA, 18 bp, Homo sapiens
ttatttggaaccttgttt

SEQ ID NO: 2490791 - DNA, 23 bp, Homo sapiens
ttatttggaaccttgttttggac

SEQ ID NO: 2490792 - DNA, 12 bp, Homo sapiens
ttatttgtaata

SEQ ID NO: 2490793 - DNA, 18 bp, Homo sapiens
ttatttgtaatagatgtt

SEQ ID NO: 2490794 - DNA, 20 bp, Homo sapiens
ttcaaaaccaggtccaatga

SEQ ID NO: 2490795 - DNA, 16 bp, Homo sapiens
ttcaaaagttccaaga

SEQ ID NO: 2490796 - DNA, 20 bp, Homo sapiens
ttcaaaagtttgtttgctta

SEQ ID NO: 2490797 - DNA, 20 bp, Homo sapiens
ttcaaaatgctttttattat

SEQ ID NO: 2490798 - DNA, 21 bp, Homo sapiens
ttccttccaatgtctggagac

SEQ ID NO: 2490799 - DNA, 12 bp, Homo sapiens
ttccttccgctt

SEQ ID NO: 2490800 - DNA, 18 bp, Homo sapiens
ttcctttcttttccccct

SEQ ID NO: 2490801 - DNA, 12 bp, Homo sapiens
ttccttttatca

SEQ ID NO: 2490802 - DNA, 14 bp, Homo sapiens
ttcctttttcagat

SEQ ID NO: 2490803 - DNA, 14 bp, Homo sapiens
ttcctttttttgta

SEQ ID NO: 2490804 - DNA, 16 bp, Homo sapiens
ttcctttttttgtacc

SEQ ID NO: 2490805 - DNA, 24 bp, Homo sapiens
ttcgcagccaccctgaggagtctg

SEQ ID NO: 2490806 - DNA, 19 bp, Homo sapiens
ttcgcatggtcacacactg

SEQ ID NO: 2490807 - DNA, 13 bp, Homo sapiens
ttcggggctggga

SEQ ID NO: 2490808 - DNA, 13 bp, Homo sapiens
ttcgtaacacagc

SEQ ID NO: 2490809 - DNA, 12 bp, Homo sapiens
ttcgtctgttgt

SEQ ID NO: 2490810 - DNA, 21 bp, Homo sapiens
ttctaaaatcttatagttcta

SEQ ID NO: 2490811 - DNA, 15 bp, Homo sapiens
ttctaaaatgattgt

SEQ ID NO: 2490812 - DNA, 14 bp, Homo sapiens
ttctaaaatgcctt

SEQ ID NO: 2490813 - DNA, 23 bp, Homo sapiens
ttctaaaatgtgatgttctaagg

SEQ ID NO: 2490814 - DNA, 12 bp, Homo sapiens
ttctaaagattc

SEQ ID NO: 2490815 - DNA, 19 bp, Homo sapiens
ttctaaaggagtttatgtt

SEQ ID NO: 2490816 - DNA, 13 bp, Homo sapiens
ttctaaaggtcca

SEQ ID NO: 2490817 - DNA, 17 bp, Homo sapiens
ttctaaagttctaagat

SEQ ID NO: 2490818 - DNA, 18 bp, Homo sapiens
ttctaaagttctaagatt

SEQ ID NO: 2490819 - DNA, 20 bp, Homo sapiens
ttctaaagttctaagattct

SEQ ID NO: 2490820 - DNA, 18 bp, Homo sapiens
ttctaaatgaatgtttac

SEQ ID NO: 2490821 - DNA, 15 bp, Homo sapiens
ttctaacctttacat

SEQ ID NO: 2490822 - DNA, 16 bp, Homo sapiens
ttctaagaaacattta

SEQ ID NO: 2490823 - DNA, 13 bp, Homo sapiens
ttctaagactcaa

SEQ ID NO: 2490824 - DNA, 16 bp, Homo sapiens
ttctaagactcaaatg

SEQ ID NO: 2490825 - DNA, 20 bp, Homo sapiens
ttctaagactcaaatgttct

SEQ ID NO: 2490826 - DNA, 22 bp, Homo sapiens
ttctaagactcaaatgttctaa

SEQ ID NO: 2490827 - DNA, 20 bp, Homo sapiens
ttctaagacttactctaaga

SEQ ID NO: 2490828 - DNA, 21 bp, Homo sapiens
ttctaagatgtgatattctaa

SEQ ID NO: 2490829 - DNA, 15 bp, Homo sapiens
ttctaagattctaat

SEQ ID NO: 2490830 - DNA, 16 bp, Homo sapiens
ttctaagattctaatg

SEQ ID NO: 2490831 - DNA, 13 bp, Homo sapiens
ttctaagattctg

SEQ ID NO: 2490832 - DNA, 14 bp, Homo sapiens
ttctaagattctga

SEQ ID NO: 2490833 - DNA, 17 bp, Homo sapiens
ttctaagcataaaagat

SEQ ID NO: 2490834 - DNA, 20 bp, Homo sapiens
ttctaaggcctaggattcta

SEQ ID NO: 2490835 - DNA, 21 bp, Homo sapiens
ttctaaggcctaggattctaa

SEQ ID NO: 2490836 - DNA, 16 bp, Homo sapiens
ttctaaggctctgaga

SEQ ID NO: 2490837 - DNA, 18 bp, Homo sapiens
ttctaaggctctgagagt

SEQ ID NO: 2490838 - DNA, 23 bp, Homo sapiens
ttctaaggtccggtgttctaaga

SEQ ID NO: 2490839 - DNA, 20 bp, Homo sapiens
ttctaagtaaatacaatttt

SEQ ID NO: 2490840 - DNA, 15 bp, Homo sapiens
ttctaagtctttcca

SEQ ID NO: 2490841 - DNA, 17 bp, Homo sapiens
ttctaagtctttccatt

SEQ ID NO: 2490842 - DNA, 21 bp, Homo sapiens
ttctaagtttctaagattcta

SEQ ID NO: 2490843 - DNA, 13 bp, Homo sapiens
ttctaatgatgat

SEQ ID NO: 2490844 - DNA, 14 bp, Homo sapiens
ttctaattgccatg

SEQ ID NO: 2490845 - DNA, 15 bp, Homo sapiens
ttctaattgccatgt

SEQ ID NO: 2490846 - DNA, 16 bp, Homo sapiens
ttctaattgcttattt

SEQ ID NO: 2490847 - DNA, 15 bp, Homo sapiens
ttctaatttttaaga

SEQ ID NO: 2490848 - DNA, 20 bp, Homo sapiens
ttctactcacttttcccact

SEQ ID NO: 2490849 - DNA, 20 bp, Homo sapiens
ttctagacatggaggttcta

SEQ ID NO: 2490850 - DNA, 12 bp, Homo sapiens
ttctagaccaat

SEQ ID NO: 2490851 - DNA, 19 bp, Homo sapiens
ttctagagttcagagtcct

SEQ ID NO: 2490852 - DNA, 24 bp, Homo sapiens
ttctagatcagatgctccaagatt

SEQ ID NO: 2490853 - DNA, 22 bp, Homo sapiens
ttctagatgattaaataagatt

SEQ ID NO: 2490854 - DNA, 16 bp, Homo sapiens
ttctagcgcagttttt

SEQ ID NO: 2490855 - DNA, 16 bp, Homo sapiens
ttctaggaaaataaaa

SEQ ID NO: 2490856 - DNA, 23 bp, Homo sapiens
ttctaggcactgtagttctaaga

SEQ ID NO: 2490857 - DNA, 15 bp, Homo sapiens
ttctaggttctaaaa

SEQ ID NO: 2490858 - DNA, 21 bp, Homo sapiens
ttctaggtttcaaagatgctg

SEQ ID NO: 2490859 - DNA, 13 bp, Homo sapiens
ttctataaggcca

SEQ ID NO: 2490860 - DNA, 14 bp, Homo sapiens
ttctataaggccat

SEQ ID NO: 2490861 - DNA, 21 bp, Homo sapiens
ttctataagttttatgttaaa

SEQ ID NO: 2490862 - DNA, 22 bp, Homo sapiens
ttctataagttttatgttaaat

SEQ ID NO: 2490863 - DNA, 21 bp, Homo sapiens
ttctatagccaaaaatagcta

SEQ ID NO: 2490864 - DNA, 15 bp, Homo sapiens
ttctatcctctgtaa

SEQ ID NO: 2490865 - DNA, 18 bp, Homo sapiens
ttctatgggtgttatcac

SEQ ID NO: 2490866 - DNA, 18 bp, Homo sapiens
ttctattaaaagactcat

SEQ ID NO: 2490867 - DNA, 23 bp, Homo sapiens
ttctattaaaagtgggaattagg

SEQ ID NO: 2490868 - DNA, 12 bp, Homo sapiens
ttctattaaagt

SEQ ID NO: 2490869 - DNA, 15 bp, Homo sapiens
ttctattaaagtgct

SEQ ID NO: 2490870 - DNA, 21 bp, Homo sapiens
ttctattaaagtgctaaggtt

SEQ ID NO: 2490871 - DNA, 19 bp, Homo sapiens
ttctatttatatgtacatg

SEQ ID NO: 2490872 - DNA, 19 bp, Homo sapiens
ttctatttctcctccatgg

SEQ ID NO: 2490873 - DNA, 18 bp, Homo sapiens
ttctatttggggcttgat

SEQ ID NO: 2490874 - DNA, 20 bp, Homo sapiens
ttctattttattatgaagaa

SEQ ID NO: 2490875 - DNA, 23 bp, Homo sapiens
ttctcaagttctaagattctaat

SEQ ID NO: 2490876 - DNA, 21 bp, Homo sapiens
ttctcacactggtctgctgtc

SEQ ID NO: 2490877 - DNA, 18 bp, Homo sapiens
ttctcacaggtcccaaat

SEQ ID NO: 2490878 - DNA, 15 bp, Homo sapiens
ttctcactaatttgt

SEQ ID NO: 2490879 - DNA, 19 bp, Homo sapiens
ttctcaggacacaggcctg

SEQ ID NO: 2490880 - DNA, 17 bp, Homo sapiens
ttctcaggtgttgccaa

SEQ ID NO: 2490881 - DNA, 20 bp, Homo sapiens
ttctcatgttgaagccactg

SEQ ID NO: 2490882 - DNA, 15 bp, Homo sapiens
ttctcattaaaagaa

SEQ ID NO: 2490883 - DNA, 17 bp, Homo sapiens
ttctcattttttaaaaa

SEQ ID NO: 2490884 - DNA, 23 bp, Homo sapiens
ttctcattttttaaaaaagctta

SEQ ID NO: 2490885 - DNA, 22 bp, Homo sapiens
ttctccaacatcacagcccagc

SEQ ID NO: 2490886 - DNA, 12 bp, Homo sapiens
ttctccagctgg

SEQ ID NO: 2490887 - DNA, 11 bp, Homo sapiens
ttctcccactc

SEQ ID NO: 2490888 - DNA, 16 bp, Homo sapiens
ttctcccactctccta

SEQ ID NO: 2490889 - DNA, 15 bp, Homo sapiens
ttctccccagctccc

SEQ ID NO: 2490890 - DNA, 21 bp, Homo sapiens
ttctcccccatgttctgtccc

SEQ ID NO: 2490891 - DNA, 18 bp, Homo sapiens
ttctccgttagctcctgt

SEQ ID NO: 2490892 - DNA, 18 bp, Homo sapiens
tgttggcgtaggctacag

SEQ ID NO: 2490893 - DNA, 20 bp, Homo sapiens
tgttggcgtaggctacagag

SEQ ID NO: 2490894 - DNA, 21 bp, Homo sapiens
tgttggcgtaggctacagaga

SEQ ID NO: 2490895 - DNA, 23 bp, Homo sapiens
tgttggcgtggggcctttgtcag

SEQ ID NO: 2490896 - DNA, 19 bp, Homo sapiens
tgttgggactgctaaataa

SEQ ID NO: 2490897 - DNA, 11 bp, Homo sapiens
tgttggtgcac

SEQ ID NO: 2490898 - DNA, 15 bp, Homo sapiens
tgttggttggttttc

SEQ ID NO: 2490899 - DNA, 20 bp, Homo sapiens
tgttggttggttttcttctt

SEQ ID NO: 2490900 - DNA, 14 bp, Homo sapiens
tgttgtaagcaaca

SEQ ID NO: 2490901 - DNA, 11 bp, Homo sapiens
tgttgttctgt

SEQ ID NO: 2490902 - DNA, 19 bp, Homo sapiens
tgttgttgaaaggtttttt

SEQ ID NO: 2490903 - DNA, 17 bp, Homo sapiens
tgttgtttcttaaataa

SEQ ID NO: 2490904 - DNA, 21 bp, Homo sapiens
tgttgtttcttaaataagaaa

SEQ ID NO: 2490905 - DNA, 16 bp, Homo sapiens
tgtttaaaacatcatt

SEQ ID NO: 2490906 - DNA, 14 bp, Homo sapiens
tgtttaaacctttt

SEQ ID NO: 2490907 - DNA, 23 bp, Homo sapiens
tgtttaaagttcaacatgttatt

SEQ ID NO: 2490908 - DNA, 19 bp, Homo sapiens
tgtttaatttttatttctt

SEQ ID NO: 2490909 - DNA, 19 bp, Homo sapiens
tgtttacaaaatcaggtaa

SEQ ID NO: 2490910 - DNA, 15 bp, Homo sapiens
tgtttacagataatt

SEQ ID NO: 2490911 - DNA, 13 bp, Homo sapiens
tgtttactaggga

SEQ ID NO: 2490912 - DNA, 19 bp, Homo sapiens
tgtttactagggatccctc

SEQ ID NO: 2490913 - DNA, 18 bp, Homo sapiens
tgtttagactttaacata

SEQ ID NO: 2490914 - DNA, 18 bp, Homo sapiens
tgtgatcatgtgtggaag

SEQ ID NO: 2490915 - DNA, 18 bp, Homo sapiens
tgtgatgaatactgtatt

SEQ ID NO: 2490916 - DNA, 17 bp, Homo sapiens
tgtgatggagtgctgtt

SEQ ID NO: 2490917 - DNA, 19 bp, Homo sapiens
tgtgatgtcatacagagaa

SEQ ID NO: 2490918 - DNA, 23 bp, Homo sapiens
tgtgatgtcatacagagaagtca

SEQ ID NO: 2490919 - DNA, 17 bp, Homo sapiens
tgtgatgttctaaggct

SEQ ID NO: 2490920 - DNA, 16 bp, Homo sapiens
tgtgattagacagaac

SEQ ID NO: 2490921 - DNA, 22 bp, Homo sapiens
tgtgattagacagaacacctat

SEQ ID NO: 2490922 - DNA, 19 bp, Homo sapiens
tgtgcaaggcagccgtggg

SEQ ID NO: 2490923 - DNA, 16 bp, Homo sapiens
tgtgcaatagaaggtg

SEQ ID NO: 2490924 - DNA, 18 bp, Homo sapiens
tgtgcaatgtaaatattt

SEQ ID NO: 2490925 - DNA, 20 bp, Homo sapiens
tgtgcacatctgtgtcttgt

SEQ ID NO: 2490926 - DNA, 13 bp, Homo sapiens
tgtgcaccagggt

SEQ ID NO: 2490927 - DNA, 22 bp, Homo sapiens
tgtgcacgtaaagtacttgtag

SEQ ID NO: 2490928 - DNA, 17 bp, Homo sapiens
tgtgcaggagcggcaga

SEQ ID NO: 2490929 - DNA, 19 bp, Homo sapiens
tgtgcagtactttgtgcat

SEQ ID NO: 2490930 - DNA, 15 bp, Homo sapiens
tgtgcagtcctgggt

SEQ ID NO: 2490931 - DNA, 23 bp, Homo sapiens
tgtgccagagaacccagcccacc

SEQ ID NO: 2490932 - DNA, 20 bp, Homo sapiens
tgtgccagagcctggggctc

SEQ ID NO: 2490933 - DNA, 22 bp, Homo sapiens
tgtgccagagcctggggctcta

SEQ ID NO: 2490934 - DNA, 21 bp, Homo sapiens
tgtgcccagttaatcttgctt

SEQ ID NO: 2490935 - DNA, 18 bp, Homo sapiens
tgtgcccccaaccatttc

SEQ ID NO: 2490936 - DNA, 23 bp, Homo sapiens
tgtgcccccaaccatttcctcag

SEQ ID NO: 2490937 - DNA, 20 bp, Homo sapiens
tgtgccccttccgccactgg

SEQ ID NO: 2490938 - DNA, 21 bp, Homo sapiens
tgtgccccttccgccactggg

SEQ ID NO: 2490939 - DNA, 23 bp, Homo sapiens
tgtgccccttgacaactggcagg

SEQ ID NO: 2490940 - DNA, 12 bp, Homo sapiens
tgtgccctctgg

SEQ ID NO: 2490941 - DNA, 22 bp, Homo sapiens
tgtgcctattgctagagctcct

SEQ ID NO: 2490942 - DNA, 16 bp, Homo sapiens
tgtgcgtggtggtccc

SEQ ID NO: 2490943 - DNA, 19 bp, Homo sapiens
tgtgcgtggtggtccctgg

SEQ ID NO: 2490944 - DNA, 22 bp, Homo sapiens
tgtgctacaattcattgtgtta

SEQ ID NO: 2490945 - DNA, 15 bp, Homo sapiens
tgtgctcagccctga

SEQ ID NO: 2490946 - DNA, 21 bp, Homo sapiens
tgtgctctccattctgctcct

SEQ ID NO: 2490947 - DNA, 13 bp, Homo sapiens
tgtgctggccagc

SEQ ID NO: 2490948 - DNA, 14 bp, Homo sapiens
tgtgctttgagaag

SEQ ID NO: 2490949 - DNA, 16 bp, Homo sapiens
tgtggaaaagatggca

SEQ ID NO: 2490950 - DNA, 21 bp, Homo sapiens
tgtggaccatggagtggcagc

SEQ ID NO: 2490951 - DNA, 17 bp, Homo sapiens
tgtggagagggaatgtg

SEQ ID NO: 2490952 - DNA, 19 bp, Homo sapiens
tgtggagccgaggcctacc

SEQ ID NO: 2490953 - DNA, 20 bp, Homo sapiens
tgtggagccgaggcctaccc

SEQ ID NO: 2490954 - DNA, 14 bp, Homo sapiens
tgtggatcagagat

SEQ ID NO: 2490955 - DNA, 22 bp, Homo sapiens
tgtggattttttccttcaaagt

SEQ ID NO: 2490956 - DNA, 17 bp, Homo sapiens
tgtggcaaggaaaaaca

SEQ ID NO: 2490957 - DNA, 15 bp, Homo sapiens
tgtggcagagttaca

SEQ ID NO: 2490958 - DNA, 17 bp, Homo sapiens
tgtggccccaccctggg

SEQ ID NO: 2490959 - DNA, 23 bp, Homo sapiens
tgtggcctaagaggctgccctcc

SEQ ID NO: 2490960 - DNA, 17 bp, Homo sapiens
tgtggcctttgcgctcc

SEQ ID NO: 2490961 - DNA, 23 bp, Homo sapiens
tgtggcgccgtctccaggggctg

SEQ ID NO: 2490962 - DNA, 15 bp, Homo sapiens
tgtggctccttccca

SEQ ID NO: 2490963 - DNA, 17 bp, Homo sapiens
tgtgggactagcctggc

SEQ ID NO: 2490964 - DNA, 17 bp, Homo sapiens
tgtgggagaccggcctg

SEQ ID NO: 2490965 - DNA, 23 bp, Homo sapiens
tgtgggagaccggcctgccagga

SEQ ID NO: 2490966 - DNA, 14 bp, Homo sapiens
tgtgggagcctcgc

SEQ ID NO: 2490967 - DNA, 19 bp, Homo sapiens
tgtgggatgttcagcactg

SEQ ID NO: 2490968 - DNA, 11 bp, Homo sapiens
tgtgggcctgg

SEQ ID NO: 2490969 - DNA, 13 bp, Homo sapiens
tgtgggcctgggc

SEQ ID NO: 2490970 - DNA, 19 bp, Homo sapiens
tgtggggggtaatccctgc

SEQ ID NO: 2490971 - DNA, 14 bp, Homo sapiens
tgtgggtgttaatt

SEQ ID NO: 2490972 - DNA, 13 bp, Homo sapiens
tgtggtacagaga

SEQ ID NO: 2490973 - DNA, 17 bp, Homo sapiens
tgtggtacagagaagcc

SEQ ID NO: 2490974 - DNA, 21 bp, Homo sapiens
tgtggtacagagaagccagct

SEQ ID NO: 2490975 - DNA, 19 bp, Homo sapiens
tgtggtacatggtgtttgt

SEQ ID NO: 2490976 - DNA, 23 bp, Homo sapiens
tgtggtcacagcggaggtgtgga

SEQ ID NO: 2490977 - DNA, 14 bp, Homo sapiens
tgtggtttatatat

SEQ ID NO: 2490978 - DNA, 21 bp, Homo sapiens
tgtgtaactgcccaaagcagc

SEQ ID NO: 2490979 - DNA, 17 bp, Homo sapiens
tgtgtaagaaatacaga

SEQ ID NO: 2490980 - DNA, 12 bp, Homo sapiens
tgtgtaagattt

SEQ ID NO: 2490981 - DNA, 20 bp, Homo sapiens
tgtgtagcctttttgtataa

SEQ ID NO: 2490982 - DNA, 19 bp, Homo sapiens
tgtgtagctgtgacctgct

SEQ ID NO: 2490983 - DNA, 14 bp, Homo sapiens
tgtgtatatggaca

SEQ ID NO: 2490984 - DNA, 23 bp, Homo sapiens
tgtgtatgcacatgaacttagat

SEQ ID NO: 2490985 - DNA, 17 bp, Homo sapiens
tgtgtccacgactgtct

SEQ ID NO: 2490986 - DNA, 21 bp, Homo sapiens
tgtgtcccagaagatgactga

SEQ ID NO: 2490987 - DNA, 19 bp, Homo sapiens
tgtgtcccatgatccctgt

SEQ ID NO: 2490988 - DNA, 16 bp, Homo sapiens
tgtgtccccctctgtc

SEQ ID NO: 2490989 - DNA, 14 bp, Homo sapiens
tgtgtcctggttcc

SEQ ID NO: 2490990 - DNA, 20 bp, Homo sapiens
tgtgtctaagattctagatc

SEQ ID NO: 2490991 - DNA, 14 bp, Homo sapiens
tgtgtcttaattat

SEQ ID NO: 2490992 - DNA, 13 bp, Homo sapiens
tgggctcctccag

SEQ ID NO: 2490993 - DNA, 12 bp, Homo sapiens
tgggctcctgga

SEQ ID NO: 2490994 - DNA, 13 bp, Homo sapiens
tgggctcctggac

SEQ ID NO: 2490995 - DNA, 15 bp, Homo sapiens
tgggctctgatgaaa

SEQ ID NO: 2490996 - DNA, 12 bp, Homo sapiens
tgggctgaggga

SEQ ID NO: 2490997 - DNA, 20 bp, Homo sapiens
tgggctggtatctcagaaag

SEQ ID NO: 2490998 - DNA, 20 bp, Homo sapiens
tgggcttatatctggcctct

SEQ ID NO: 2490999 - DNA, 21 bp, Homo sapiens
tgggcttatatctggcctctg

SEQ ID NO: 2491000 - DNA, 22 bp, Homo sapiens
tgggcttatatctggcctctgc

SEQ ID NO: 2491001 - DNA, 17 bp, Homo sapiens
tgggcttcagctgccag

SEQ ID NO: 2491002 - DNA, 18 bp, Homo sapiens
tgggcttcagctgccagt

SEQ ID NO: 2491003 - DNA, 17 bp, Homo sapiens
tgggcttcctggagcag

SEQ ID NO: 2491004 - DNA, 14 bp, Homo sapiens
tgggcttgctattc

SEQ ID NO: 2491005 - DNA, 19 bp, Homo sapiens
tgggcttgggcctaggctg

SEQ ID NO: 2491006 - DNA, 22 bp, Homo sapiens
tgggcttgtggggcctgggagg

SEQ ID NO: 2491007 - DNA, 16 bp, Homo sapiens
tggggaaacagcatct

SEQ ID NO: 2491008 - DNA, 18 bp, Homo sapiens
tggggaaacagcatctcc

SEQ ID NO: 2491009 - DNA, 17 bp, Homo sapiens
tggggaagagagcctgc

SEQ ID NO: 2491010 - DNA, 22 bp, Homo sapiens
tggggaagagagcctgcaggat

SEQ ID NO: 2491011 - DNA, 15 bp, Homo sapiens
tggggaccagcagcc

SEQ ID NO: 2491012 - DNA, 18 bp, Homo sapiens
tggggacctggtaccctc

SEQ ID NO: 2491013 - DNA, 17 bp, Homo sapiens
tggggagactgggctga

SEQ ID NO: 2491014 - DNA, 21 bp, Homo sapiens
tggggagactgggctgaggga

SEQ ID NO: 2491015 - DNA, 16 bp, Homo sapiens
tggggagcaggcagcc

SEQ ID NO: 2491016 - DNA, 18 bp, Homo sapiens
tggggagcccgtctcagt

SEQ ID NO: 2491017 - DNA, 19 bp, Homo sapiens
tggggagcgggtctgctcc

SEQ ID NO: 2491018 - DNA, 20 bp, Homo sapiens
tggggagcgggtctgctccc

SEQ ID NO: 2491019 - DNA, 12 bp, Homo sapiens
tggggaggagga

SEQ ID NO: 2491020 - DNA, 13 bp, Homo sapiens
tggggaggaggag

SEQ ID NO: 2491021 - DNA, 19 bp, Homo sapiens
tggggagtaggacatacca

SEQ ID NO: 2491022 - DNA, 20 bp, Homo sapiens
tggggagttaagacctggca

SEQ ID NO: 2491023 - DNA, 17 bp, Homo sapiens
tggggataggccagccg

SEQ ID NO: 2491024 - DNA, 18 bp, Homo sapiens
tggggataggccagccgc

SEQ ID NO: 2491025 - DNA, 20 bp, Homo sapiens
tggggatccctcccccccat

SEQ ID NO: 2491026 - DNA, 20 bp, Homo sapiens
tggggcagctcctctgtctc

SEQ ID NO: 2491027 - DNA, 14 bp, Homo sapiens
tggggcaggagtag

SEQ ID NO: 2491028 - DNA, 15 bp, Homo sapiens
tggggcaggagtagc

SEQ ID NO: 2491029 - DNA, 14 bp, Homo sapiens
tggggcaggctggg

SEQ ID NO: 2491030 - DNA, 15 bp, Homo sapiens
tggggcaggctgggc

SEQ ID NO: 2491031 - DNA, 20 bp, Homo sapiens
tggggcaggctgggccatgt

SEQ ID NO: 2491032 - DNA, 15 bp, Homo sapiens
tggggccagatccag

SEQ ID NO: 2491033 - DNA, 15 bp, Homo sapiens
tggggccaggtcacc

SEQ ID NO: 2491034 - DNA, 19 bp, Homo sapiens
tggggccgccgcctctttc

SEQ ID NO: 2491035 - DNA, 12 bp, Homo sapiens
tggggcctggga

SEQ ID NO: 2491036 - DNA, 20 bp, Homo sapiens
tggggctagggggagcccct

SEQ ID NO: 2491037 - DNA, 13 bp, Homo sapiens
tggggctcagagc

SEQ ID NO: 2491038 - DNA, 17 bp, Homo sapiens
tggggctggagaggaca

SEQ ID NO: 2491039 - DNA, 16 bp, Homo sapiens
tggggcttgggggctc

SEQ ID NO: 2491040 - DNA, 20 bp, Homo sapiens
tgggggaactcagatccagg

SEQ ID NO: 2491041 - DNA, 14 bp, Homo sapiens
tgggggagagggtg

SEQ ID NO: 2491042 - DNA, 21 bp, Homo sapiens
tgggggagtagatctttctag

SEQ ID NO: 2491043 - DNA, 13 bp, Homo sapiens
tgggggctgcagt

SEQ ID NO: 2491044 - DNA, 18 bp, Homo sapiens
tggggggtgatgagggca

SEQ ID NO: 2491045 - DNA, 19 bp, Homo sapiens
tggggggtgatgagggcag

SEQ ID NO: 2491046 - DNA, 19 bp, Homo sapiens
tgggggtagggggctggag

SEQ ID NO: 2491047 - DNA, 15 bp, Homo sapiens
tgggggtgagggtcc

SEQ ID NO: 2491048 - DNA, 16 bp, Homo sapiens
tgggggtgggggtagg

SEQ ID NO: 2491049 - DNA, 16 bp, Homo sapiens
tgggggttcaggcccg

SEQ ID NO: 2491050 - DNA, 21 bp, Homo sapiens
tggggtcccagcagctgccag

SEQ ID NO: 2491051 - DNA, 20 bp, Homo sapiens
tggggtcctggagcagacca

SEQ ID NO: 2491052 - DNA, 21 bp, Homo sapiens
tggggtctcacagtgttgccc

SEQ ID NO: 2491053 - DNA, 14 bp, Homo sapiens
tggggtctgacccc

SEQ ID NO: 2491054 - DNA, 15 bp, Homo sapiens
tggggtgtgctggga

SEQ ID NO: 2491055 - DNA, 19 bp, Homo sapiens
tggggttatctctgtgtta

SEQ ID NO: 2491056 - DNA, 23 bp, Homo sapiens
tgggtaaaatacttttactctgc

SEQ ID NO: 2491057 - DNA, 20 bp, Homo sapiens
tgggtatagttcatgtctgc

SEQ ID NO: 2491058 - DNA, 14 bp, Homo sapiens
tgggtccaggagga

SEQ ID NO: 2491059 - DNA, 14 bp, Homo sapiens
tgggtccatgggca

SEQ ID NO: 2491060 - DNA, 18 bp, Homo sapiens
tgggtccatgggcagagc

SEQ ID NO: 2491061 - DNA, 23 bp, Homo sapiens
tgggtctcaccggctctcacctg

SEQ ID NO: 2491062 - DNA, 22 bp, Homo sapiens
tgggtctcgctttgttgcccag

SEQ ID NO: 2491063 - DNA, 21 bp, Homo sapiens
tgggtctgggagtcacacagt

SEQ ID NO: 2491064 - DNA, 17 bp, Homo sapiens
tgggtgcctaggcctgg

SEQ ID NO: 2491065 - DNA, 17 bp, Homo sapiens
tgggtgctactggggaa

SEQ ID NO: 2491066 - DNA, 22 bp, Homo sapiens
tgggtggtaccctctggagggg

SEQ ID NO: 2491067 - DNA, 14 bp, Homo sapiens
tgggttaagtatta

SEQ ID NO: 2491068 - DNA, 15 bp, Homo sapiens
tgggttagacctaca

SEQ ID NO: 2491069 - DNA, 15 bp, Homo sapiens
tgggttccacagacg

SEQ ID NO: 2491070 - DNA, 14 bp, Homo sapiens
tgggttctgcctgc

SEQ ID NO: 2491071 - DNA, 21 bp, Homo sapiens
tgggttgcagacaggaatctt

SEQ ID NO: 2491072 - DNA, 15 bp, Homo sapiens
tgggttgtcaccaag

SEQ ID NO: 2491073 - DNA, 21 bp, Homo sapiens
tgggttttgtattctctgagc

SEQ ID NO: 2491074 - DNA, 17 bp, Homo sapiens
tgggtttttggacttct

SEQ ID NO: 2491075 - DNA, 16 bp, Homo sapiens
tggtaaagactggctt

SEQ ID NO: 2491076 - DNA, 14 bp, Homo sapiens
tggtaactgctttc

SEQ ID NO: 2491077 - DNA, 18 bp, Homo sapiens
tggtaagcaacatggctt

SEQ ID NO: 2491078 - DNA, 17 bp, Homo sapiens
tggtaagctatgtccca

SEQ ID NO: 2491079 - DNA, 15 bp, Homo sapiens
tggtacagagaagcc

SEQ ID NO: 2491080 - DNA, 16 bp, Homo sapiens
tggtacagagaagcca

SEQ ID NO: 2491081 - DNA, 18 bp, Homo sapiens
tggtacagagaagccagc

SEQ ID NO: 2491082 - DNA, 22 bp, Homo sapiens
tggtacagtatgggggttgtaa

SEQ ID NO: 2491083 - DNA, 15 bp, Homo sapiens
tggtacatggtgttt

SEQ ID NO: 2491084 - DNA, 13 bp, Homo sapiens
tggtaccagataa

SEQ ID NO: 2491085 - DNA, 13 bp, Homo sapiens
tggtaccagatgc

SEQ ID NO: 2491086 - DNA, 21 bp, Homo sapiens
tggtaccctcctggctcttga

SEQ ID NO: 2491087 - DNA, 17 bp, Homo sapiens
tggtactccctctcagg

SEQ ID NO: 2491088 - DNA, 22 bp, Homo sapiens
tggtactccctctcaggatcca

SEQ ID NO: 2491089 - DNA, 21 bp, Homo sapiens
tggtactgactttgcttgctt

SEQ ID NO: 2491090 - DNA, 19 bp, Homo sapiens
tggtactgtacagctggct

SEQ ID NO: 2491091 - DNA, 21 bp, Homo sapiens
tggtactgtacagctggctct

SEQ ID NO: 2491092 - DNA, 19 bp, Homo sapiens
tggtagggtgggagtggtt

SEQ ID NO: 2491093 - DNA, 15 bp, Homo sapiens
tggtagttttttcat

SEQ ID NO: 2491094 - DNA, 16 bp, Homo sapiens
tggtagttttttcatc

SEQ ID NO: 2491095 - DNA, 13 bp, Homo sapiens
tggtatctcagaa

SEQ ID NO: 2491096 - DNA, 21 bp, Homo sapiens
tgtacatctattttggattgt

SEQ ID NO: 2491097 - DNA, 23 bp, Homo sapiens
tgtacatctattttggattgtat

SEQ ID NO: 2491098 - DNA, 14 bp, Homo sapiens
tgtacatctggcct

SEQ ID NO: 2491099 - DNA, 14 bp, Homo sapiens
tgtacattaattac

SEQ ID NO: 2491100 - DNA, 15 bp, Homo sapiens
tgtacatttctcagg

SEQ ID NO: 2491101 - DNA, 19 bp, Homo sapiens
tgtacatttctcaggctag

SEQ ID NO: 2491102 - DNA, 15 bp, Homo sapiens
tgtaccagttaattt

SEQ ID NO: 2491103 - DNA, 12 bp, Homo sapiens
tgtacccaccgg

SEQ ID NO: 2491104 - DNA, 14 bp, Homo sapiens
tgtacccagtttct

SEQ ID NO: 2491105 - DNA, 17 bp, Homo sapiens
tgtaccctctgaaatac

SEQ ID NO: 2491106 - DNA, 22 bp, Homo sapiens
tgtaccttttgaggagccccag

SEQ ID NO: 2491107 - DNA, 15 bp, Homo sapiens
tgtactaaagccaaa

SEQ ID NO: 2491108 - DNA, 14 bp, Homo sapiens
tgtactatttaact

SEQ ID NO: 2491109 - DNA, 15 bp, Homo sapiens
tgtactgcctgcttg

SEQ ID NO: 2491110 - DNA, 15 bp, Homo sapiens
tgtagaacactaatt

SEQ ID NO: 2491111 - DNA, 15 bp, Homo sapiens
tgtagaattgtatat

SEQ ID NO: 2491112 - DNA, 16 bp, Homo sapiens
tgtagattcaggtaat

SEQ ID NO: 2491113 - DNA, 15 bp, Homo sapiens
tgtagcacttactgg

SEQ ID NO: 2491114 - DNA, 12 bp, Homo sapiens
tgtagccagccg

SEQ ID NO: 2491115 - DNA, 15 bp, Homo sapiens
tgtagccagccgggg

SEQ ID NO: 2491116 - DNA, 19 bp, Homo sapiens
tgtagccctttccaagctt

SEQ ID NO: 2491117 - DNA, 12 bp, Homo sapiens
tgtagccttttt

SEQ ID NO: 2491118 - DNA, 13 bp, Homo sapiens
tgtagcctttttg

SEQ ID NO: 2491119 - DNA, 16 bp, Homo sapiens
tgtagcgtctttcttt

SEQ ID NO: 2491120 - DNA, 13 bp, Homo sapiens
tgtagctacagag

SEQ ID NO: 2491121 - DNA, 15 bp, Homo sapiens
tgtagctgaggaggc

SEQ ID NO: 2491122 - DNA, 19 bp, Homo sapiens
tgtaggagggactgtcgct

SEQ ID NO: 2491123 - DNA, 13 bp, Homo sapiens
tgtagggagggcg

SEQ ID NO: 2491124 - DNA, 18 bp, Homo sapiens
tgtagtaaataatgcttt

SEQ ID NO: 2491125 - DNA, 15 bp, Homo sapiens
tgtagtaacactaat

SEQ ID NO: 2491126 - DNA, 15 bp, Homo sapiens
tgtagtaattgacat

SEQ ID NO: 2491127 - DNA, 19 bp, Homo sapiens
tgtagtaattgacatgtgc

SEQ ID NO: 2491128 - DNA, 20 bp, Homo sapiens
tgtagtaggcatttttacca

SEQ ID NO: 2491129 - DNA, 18 bp, Homo sapiens
tgtagtatggcctgtgtc

SEQ ID NO: 2491130 - DNA, 20 bp, Homo sapiens
tgtagtttttatatgttgta

SEQ ID NO: 2491131 - DNA, 21 bp, Homo sapiens
tgtataaaagtgtgaaataaa

SEQ ID NO: 2491132 - DNA, 17 bp, Homo sapiens
tgtataaacaagaaaaa

SEQ ID NO: 2491133 - DNA, 19 bp, Homo sapiens
tgtataaatgtctttaatg

SEQ ID NO: 2491134 - DNA, 15 bp, Homo sapiens
tgtataactaggagc

SEQ ID NO: 2491135 - DNA, 14 bp, Homo sapiens
tgtataattggatt

SEQ ID NO: 2491136 - DNA, 21 bp, Homo sapiens
tgtataattggatttcctaat

SEQ ID NO: 2491137 - DNA, 15 bp, Homo sapiens
tgtatagttaacaca

SEQ ID NO: 2491138 - DNA, 17 bp, Homo sapiens
tgtatagttaacacact

SEQ ID NO: 2491139 - DNA, 13 bp, Homo sapiens
tgtatattgtaat

SEQ ID NO: 2491140 - DNA, 14 bp, Homo sapiens
tgtatcccctgcag

SEQ ID NO: 2491141 - DNA, 12 bp, Homo sapiens
tgtatgattact

SEQ ID NO: 2491142 - DNA, 21 bp, Homo sapiens
tgtatgcacatgaacttagat

SEQ ID NO: 2491143 - DNA, 15 bp, Homo sapiens
tgtatggggcagctt

SEQ ID NO: 2491144 - DNA, 22 bp, Homo sapiens
tgtatgggtagggtaaatcagt

SEQ ID NO: 2491145 - DNA, 21 bp, Homo sapiens
tgtattctctgagctgtgcag

SEQ ID NO: 2491146 - DNA, 19 bp, Homo sapiens
tgtattgcacattgtaaaa

SEQ ID NO: 2491147 - DNA, 18 bp, Homo sapiens
tgtattgtgcaatgtgta

SEQ ID NO: 2491148 - DNA, 18 bp, Homo sapiens
tgtattgttgaaaaagtt

SEQ ID NO: 2491149 - DNA, 13 bp, Homo sapiens
tgtatttggaaat

SEQ ID NO: 2491150 - DNA, 21 bp, Homo sapiens
tgtatttggaaataaagtcag

SEQ ID NO: 2491151 - DNA, 16 bp, Homo sapiens
tgtattttagcagaga

SEQ ID NO: 2491152 - DNA, 13 bp, Homo sapiens
tgtattttatgtt

SEQ ID NO: 2491153 - DNA, 14 bp, Homo sapiens
tgtattttgtattg

SEQ ID NO: 2491154 - DNA, 22 bp, Homo sapiens
tgtattttttaaaattgatttt

SEQ ID NO: 2491155 - DNA, 18 bp, Homo sapiens
tgtcaagtctctgctggc

SEQ ID NO: 2491156 - DNA, 19 bp, Homo sapiens
tgtcaagtctctgctggcc

SEQ ID NO: 2491157 - DNA, 15 bp, Homo sapiens
tgtcaatctgtccgt

SEQ ID NO: 2491158 - DNA, 20 bp, Homo sapiens
tgtcaattgtacgcgccacc

SEQ ID NO: 2491159 - DNA, 15 bp, Homo sapiens
tgtcaatttctgtgt

SEQ ID NO: 2491160 - DNA, 16 bp, Homo sapiens
tgtcacaatgagattg

SEQ ID NO: 2491161 - DNA, 16 bp, Homo sapiens
tgtcacggccaggcag

SEQ ID NO: 2491162 - DNA, 14 bp, Homo sapiens
tgtcactaaagcag

SEQ ID NO: 2491163 - DNA, 15 bp, Homo sapiens
tgtcactaaagcagg

SEQ ID NO: 2491164 - DNA, 14 bp, Homo sapiens
tgtcactcaaggcg

SEQ ID NO: 2491165 - DNA, 20 bp, Homo sapiens
tgtcactcaaggcggtgctt

SEQ ID NO: 2491166 - DNA, 12 bp, Homo sapiens
tgtcactttttg

SEQ ID NO: 2491167 - DNA, 15 bp, Homo sapiens
tgtcagaccctggag

SEQ ID NO: 2491168 - DNA, 16 bp, Homo sapiens
tgtcagaccctggagg

SEQ ID NO: 2491169 - DNA, 20 bp, Homo sapiens
tgtcagatccaggagctcca

SEQ ID NO: 2491170 - DNA, 18 bp, Homo sapiens
tttttaaactgtacagtg

SEQ ID NO: 2491171 - DNA, 16 bp, Homo sapiens
tttttaagaatatctg

SEQ ID NO: 2491172 - DNA, 17 bp, Homo sapiens
tttttaagaatatctgt

SEQ ID NO: 2491173 - DNA, 16 bp, Homo sapiens
tttttaataaatttca

SEQ ID NO: 2491174 - DNA, 17 bp, Homo sapiens
tttttacaatgtaatta

SEQ ID NO: 2491175 - DNA, 23 bp, Homo sapiens
tttttattaattttagtttttca

SEQ ID NO: 2491176 - DNA, 18 bp, Homo sapiens
tttttattagtattgttg

SEQ ID NO: 2491177 - DNA, 13 bp, Homo sapiens
tttttatttaaaa

SEQ ID NO: 2491178 - DNA, 20 bp, Homo sapiens
tttttcaatcaactttactg

SEQ ID NO: 2491179 - DNA, 21 bp, Homo sapiens
tttttcaatcaactttactgt

SEQ ID NO: 2491180 - DNA, 20 bp, Homo sapiens
tttttcagttgttcttttta

SEQ ID NO: 2491181 - DNA, 15 bp, Homo sapiens
tttttcatcttcagt

SEQ ID NO: 2491182 - DNA, 23 bp, Homo sapiens
tttttcatcttcagttgtctctg

SEQ ID NO: 2491183 - DNA, 20 bp, Homo sapiens
tttttcattaaataaatttg

SEQ ID NO: 2491184 - DNA, 17 bp, Homo sapiens
tttttccccagacttgt

SEQ ID NO: 2491185 - DNA, 13 bp, Homo sapiens
tttttcctctcca

SEQ ID NO: 2491186 - DNA, 10 bp, Homo sapiens
tttttccttt

SEQ ID NO: 2491187 - DNA, 18 bp, Homo sapiens
tttttcctttaactgaca

SEQ ID NO: 2491188 - DNA, 16 bp, Homo sapiens
tttttcgtttgtttgt

SEQ ID NO: 2491189 - DNA, 15 bp, Homo sapiens
tttttctaactacaa

SEQ ID NO: 2491190 - DNA, 13 bp, Homo sapiens
tttttctattaaa

SEQ ID NO: 2491191 - DNA, 18 bp, Homo sapiens
tttttctctcaacaccat

SEQ ID NO: 2491192 - DNA, 16 bp, Homo sapiens
tttttctgtaccagtt

SEQ ID NO: 2491193 - DNA, 23 bp, Homo sapiens
tttttgaaaaagcgaaaaaatca

SEQ ID NO: 2491194 - DNA, 12 bp, Homo sapiens
tttttgatatag

SEQ ID NO: 2491195 - DNA, 16 bp, Homo sapiens
tttttgccacagcttt

SEQ ID NO: 2491196 - DNA, 18 bp, Homo sapiens
tttttgtatagttaacac

SEQ ID NO: 2491197 - DNA, 13 bp, Homo sapiens
tttttgttgacat

SEQ ID NO: 2491198 - DNA, 11 bp, Homo sapiens
ttttttcatct

SEQ ID NO: 2491199 - DNA, 13 bp, Homo sapiens
ttttttcatcttc

SEQ ID NO: 2491200 - DNA, 13 bp, Homo sapiens
ttttttccatctt

SEQ ID NO: 2491201 - DNA, 22 bp, Homo sapiens
ttttttccatctttacaaaact

SEQ ID NO: 2491202 - DNA, 13 bp, Homo sapiens
ttttttcgtttgt

SEQ ID NO: 2491203 - DNA, 10 bp, Homo sapiens
ttttttgcag

SEQ ID NO: 2491204 - DNA, 12 bp, Homo sapiens
tttttttcttta

SEQ ID NO: 2491205 - DNA, 14 bp, Homo sapiens
ttttttttaaacta

SEQ ID NO: 2491206 - DNA, 12 bp, Homo sapiens
ttttttttgcag

SEQ ID NO: 2491207 - DNA, 14 bp, Homo sapiens
ttttttttgtttgt

SEQ ID NO: 2491208 - DNA, 21 bp, Homo sapiens
tttgtttaatttttatttctt

SEQ ID NO: 2491209 - DNA, 22 bp, Homo sapiens
tttgtttaatttttatttcttc

SEQ ID NO: 2491210 - DNA, 17 bp, Homo sapiens
tttgttttgtttttaca

SEQ ID NO: 2491211 - DNA, 16 bp, Homo sapiens
tttgtttttaaactgt

SEQ ID NO: 2491212 - DNA, 17 bp, Homo sapiens
ttttaaaaatagacact

SEQ ID NO: 2491213 - DNA, 13 bp, Homo sapiens
ttttaaaacccag

SEQ ID NO: 2491214 - DNA, 14 bp, Homo sapiens
ttttaaaatcagct

SEQ ID NO: 2491215 - DNA, 11 bp, Homo sapiens
ttttaaaattt

SEQ ID NO: 2491216 - DNA, 20 bp, Homo sapiens
ttttaaaatttgttcttgta

SEQ ID NO: 2491217 - DNA, 18 bp, Homo sapiens
ttttaaacacattaggaa

SEQ ID NO: 2491218 - DNA, 16 bp, Homo sapiens
ttttaaactgtacagt

SEQ ID NO: 2491219 - DNA, 18 bp, Homo sapiens
ttttaaagacccctaacc

SEQ ID NO: 2491220 - DNA, 14 bp, Homo sapiens
ttttaactgtggat

SEQ ID NO: 2491221 - DNA, 11 bp, Homo sapiens
ttttaactttg

SEQ ID NO: 2491222 - DNA, 14 bp, Homo sapiens
ttttaagttgctga

SEQ ID NO: 2491223 - DNA, 19 bp, Homo sapiens
ttttaagtttctctgcaga

SEQ ID NO: 2491224 - DNA, 12 bp, Homo sapiens
ttttaataaatt

SEQ ID NO: 2491225 - DNA, 14 bp, Homo sapiens
ttttaataaatttc

SEQ ID NO: 2491226 - DNA, 23 bp, Homo sapiens
ttttaattattatttatatatgt

SEQ ID NO: 2491227 - DNA, 17 bp, Homo sapiens
ttttaatttacaaaaat

SEQ ID NO: 2491228 - DNA, 12 bp, Homo sapiens
ttttacaaatgt

SEQ ID NO: 2491229 - DNA, 15 bp, Homo sapiens
ttttacatgaagtat

SEQ ID NO: 2491230 - DNA, 13 bp, Homo sapiens
ttttactctgcct

SEQ ID NO: 2491231 - DNA, 16 bp, Homo sapiens
ttttactgctctgaga

SEQ ID NO: 2491232 - DNA, 20 bp, Homo sapiens
ttttaggagctaaggctcta

SEQ ID NO: 2491233 - DNA, 23 bp, Homo sapiens
ttttaggagctaaggctctatga

SEQ ID NO: 2491234 - DNA, 16 bp, Homo sapiens
ttttaggttctaaagt

SEQ ID NO: 2491235 - DNA, 22 bp, Homo sapiens
ttttagtttttcattaaataaa

SEQ ID NO: 2491236 - DNA, 13 bp, Homo sapiens
ttttatactcttt

SEQ ID NO: 2491237 - DNA, 18 bp, Homo sapiens
ttttatactctttctgta

SEQ ID NO: 2491238 - DNA, 19 bp, Homo sapiens
ttttatactctttctgtat

SEQ ID NO: 2491239 - DNA, 11 bp, Homo sapiens
ttttatatata

SEQ ID NO: 2491240 - DNA, 12 bp, Homo sapiens
ttttatcagtag

SEQ ID NO: 2491241 - DNA, 17 bp, Homo sapiens
ttttatccctcacctgt

SEQ ID NO: 2491242 - DNA, 11 bp, Homo sapiens
ttttattaatg

SEQ ID NO: 2491243 - DNA, 15 bp, Homo sapiens
ttttattagtattgt

SEQ ID NO: 2491244 - DNA, 12 bp, Homo sapiens
ttttattatgaa

SEQ ID NO: 2491245 - DNA, 16 bp, Homo sapiens
ttttattgacacagaa

SEQ ID NO: 2491246 - DNA, 14 bp, Homo sapiens
ttttattttgccaa

SEQ ID NO: 2491247 - DNA, 22 bp, Homo sapiens
ttttcaaaaccaggtccaatga

SEQ ID NO: 2491248 - DNA, 16 bp, Homo sapiens
ttttcaatagccacta

SEQ ID NO: 2491249 - DNA, 20 bp, Homo sapiens
ttttcaatcaactttactgt

SEQ ID NO: 2491250 - DNA, 18 bp, Homo sapiens
ttttcaatgaattttata

SEQ ID NO: 2491251 - DNA, 18 bp, Homo sapiens
ttttcacattagaagaca

SEQ ID NO: 2491252 - DNA, 19 bp, Homo sapiens
ttttcagtattatatgtac

SEQ ID NO: 2491253 - DNA, 15 bp, Homo sapiens
ttttcagttgttctt

SEQ ID NO: 2491254 - DNA, 16 bp, Homo sapiens
ttttcataggtctgaa

SEQ ID NO: 2491255 - DNA, 14 bp, Homo sapiens
ttttcatcttcagt

SEQ ID NO: 2491256 - DNA, 16 bp, Homo sapiens
ttttcatgcgatgaca

SEQ ID NO: 2491257 - DNA, 22 bp, Homo sapiens
ttttcattaaataaatttgact

SEQ ID NO: 2491258 - DNA, 21 bp, Homo sapiens
ttttcattccatgtgcccagt

SEQ ID NO: 2491259 - DNA, 13 bp, Homo sapiens
ttttcatttatct

SEQ ID NO: 2491260 - DNA, 18 bp, Homo sapiens
ttttccaactactaatag

SEQ ID NO: 2491261 - DNA, 21 bp, Homo sapiens
ttttccatggcaggaaggctt

SEQ ID NO: 2491262 - DNA, 12 bp, Homo sapiens
ttttcccacgag

SEQ ID NO: 2491263 - DNA, 16 bp, Homo sapiens
ttttccccctttgtgc

SEQ ID NO: 2491264 - DNA, 11 bp, Homo sapiens
ttttcctatat

SEQ ID NO: 2491265 - DNA, 12 bp, Homo sapiens
ttttcctgtcct

SEQ ID NO: 2491266 - DNA, 21 bp, Homo sapiens
ttttcctgtcctctttcagct

SEQ ID NO: 2491267 - DNA, 21 bp, Homo sapiens
ttttccttccaatgtctggag

SEQ ID NO: 2491268 - DNA, 23 bp, Homo sapiens
ttttctaacagaaagcatgattt

SEQ ID NO: 2491269 - DNA, 16 bp, Homo sapiens
ttttctaagaaacatt

SEQ ID NO: 2491270 - DNA, 18 bp, Homo sapiens
ttttctaagaaacattta

SEQ ID NO: 2491271 - DNA, 16 bp, Homo sapiens
ttttctattaaaagac

SEQ ID NO: 2491272 - DNA, 17 bp, Homo sapiens
ttttctattaaaagact

SEQ ID NO: 2491273 - DNA, 10 bp, Homo sapiens
ttttctctca

SEQ ID NO: 2491274 - DNA, 21 bp, Homo sapiens
ttttctctcaacaccatgatt

SEQ ID NO: 2491275 - DNA, 14 bp, Homo sapiens
ttttctctggtaat

SEQ ID NO: 2491276 - DNA, 16 bp, Homo sapiens
ttttctctggtaatat

SEQ ID NO: 2491277 - DNA, 21 bp, Homo sapiens
ttttctctggtaatattgact

SEQ ID NO: 2491278 - DNA, 17 bp, Homo sapiens
ttttctggttctaacat

SEQ ID NO: 2491279 - DNA, 14 bp, Homo sapiens
ttttctgtaccagt

SEQ ID NO: 2491280 - DNA, 21 bp, Homo sapiens
ttttctgtaccagttaatttt

SEQ ID NO: 2491281 - DNA, 18 bp, Homo sapiens
ttttcttaaagtgccagt

SEQ ID NO: 2491282 - DNA, 13 bp, Homo sapiens
ttttcttgtctat

SEQ ID NO: 2491283 - DNA, 20 bp, Homo sapiens
ttttcttgtctataaagcat

SEQ ID NO: 2491284 - DNA, 20 bp, Homo sapiens
ttttctttgaataaatgtca

SEQ ID NO: 2491285 - DNA, 12 bp, Homo sapiens
ttttgaaagaat

SEQ ID NO: 2491286 - DNA, 15 bp, Homo sapiens
ttttgacataaagtt

SEQ ID NO: 2491287 - DNA, 13 bp, Homo sapiens
ttttgactgcttg

SEQ ID NO: 2491288 - DNA, 23 bp, Homo sapiens
ttttgagatattaatgcccagac

SEQ ID NO: 2491289 - DNA, 13 bp, Homo sapiens
ttttgaggcaaaa

SEQ ID NO: 2491290 - DNA, 18 bp, Homo sapiens
ttttgaggcaaaagaagg

SEQ ID NO: 2491291 - DNA, 16 bp, Homo sapiens
ttttgatgagttgtga

SEQ ID NO: 2491292 - DNA, 16 bp, Homo sapiens
ttttgatgtaaagatg

SEQ ID NO: 2491293 - DNA, 17 bp, Homo sapiens
ttttgcaacctcgctgg

SEQ ID NO: 2491294 - DNA, 20 bp, Homo sapiens
ttttgccacagcttttgcaa

SEQ ID NO: 2491295 - DNA, 15 bp, Homo sapiens
ttttgccattaaact

SEQ ID NO: 2491296 - DNA, 21 bp, Homo sapiens
ttttgctttcgaactgctagt

SEQ ID NO: 2491297 - DNA, 13 bp, Homo sapiens
ttttggaatttgc

SEQ ID NO: 2491298 - DNA, 11 bp, Homo sapiens
ttttggatgcc

SEQ ID NO: 2491299 - DNA, 19 bp, Homo sapiens
ttttggcaaaactctactt

SEQ ID NO: 2491300 - DNA, 11 bp, Homo sapiens
ttttggcacct

SEQ ID NO: 2491301 - DNA, 19 bp, Homo sapiens
ttttgtaagttgaagcaaa

SEQ ID NO: 2491302 - DNA, 14 bp, Homo sapiens
ttttgtataattgg

SEQ ID NO: 2491303 - DNA, 16 bp, Homo sapiens
ttttgtataattggat

SEQ ID NO: 2491304 - DNA, 20 bp, Homo sapiens
ttttgtatagttaacacact

SEQ ID NO: 2491305 - DNA, 15 bp, Homo sapiens
ttttgtctacacacc

SEQ ID NO: 2491306 - DNA, 19 bp, Homo sapiens
ttttgtgatggagtgctgt

SEQ ID NO: 2491307 - DNA, 21 bp, Homo sapiens
ttttgtgggggactgtaagtt

SEQ ID NO: 2491308 - DNA, 17 bp, Homo sapiens
ttttgtgtgtatttgct

SEQ ID NO: 2491309 - DNA, 16 bp, Homo sapiens
ttttgttcaaagccag

SEQ ID NO: 2491310 - DNA, 18 bp, Homo sapiens
ttttgttgacattctgaa

SEQ ID NO: 2491311 - DNA, 19 bp, Homo sapiens
ttttgttgtttcttaaata

SEQ ID NO: 2491312 - DNA, 22 bp, Homo sapiens
ttttgtttgcttcatgtgtccc

SEQ ID NO: 2491313 - DNA, 13 bp, Homo sapiens
tttttaaaattga

SEQ ID NO: 2491314 - DNA, 13 bp, Homo sapiens
tttctgcatatgt

SEQ ID NO: 2491315 - DNA, 17 bp, Homo sapiens
tttctgcatatgttgaa

SEQ ID NO: 2491316 - DNA, 12 bp, Homo sapiens
tttctgccctgc

SEQ ID NO: 2491317 - DNA, 23 bp, Homo sapiens
tttctggattccccatctcaggc

SEQ ID NO: 2491318 - DNA, 19 bp, Homo sapiens
tttctggccagtgtttaaa

SEQ ID NO: 2491319 - DNA, 16 bp, Homo sapiens
tttctgggataagtaa

SEQ ID NO: 2491320 - DNA, 17 bp, Homo sapiens
tttctggtggtctgttg

SEQ ID NO: 2491321 - DNA, 22 bp, Homo sapiens
tttctgtaagaaacctactgcc

SEQ ID NO: 2491322 - DNA, 17 bp, Homo sapiens
tttctgtatatactttt

SEQ ID NO: 2491323 - DNA, 15 bp, Homo sapiens
tttctgttccaaatt

SEQ ID NO: 2491324 - DNA, 12 bp, Homo sapiens
tttctgttttct

SEQ ID NO: 2491325 - DNA, 17 bp, Homo sapiens
tttcttaaagtgccagt

SEQ ID NO: 2491326 - DNA, 12 bp, Homo sapiens
tttcttaaataa

SEQ ID NO: 2491327 - DNA, 13 bp, Homo sapiens
tttcttaaataag

SEQ ID NO: 2491328 - DNA, 18 bp, Homo sapiens
tttcttaaataagaaact

SEQ ID NO: 2491329 - DNA, 14 bp, Homo sapiens
tttcttaacttctt

SEQ ID NO: 2491330 - DNA, 17 bp, Homo sapiens
tttcttaacttcttgct

SEQ ID NO: 2491331 - DNA, 18 bp, Homo sapiens
tttcttaacttcttgctt

SEQ ID NO: 2491332 - DNA, 17 bp, Homo sapiens
tttcttcctaccaagtc

SEQ ID NO: 2491333 - DNA, 13 bp, Homo sapiens
tttcttgcctcat

SEQ ID NO: 2491334 - DNA, 13 bp, Homo sapiens
tttcttgtctata

SEQ ID NO: 2491335 - DNA, 20 bp, Homo sapiens
tttcttgtgcactggcacca

SEQ ID NO: 2491336 - DNA, 15 bp, Homo sapiens
tttctttaaaaaaca

SEQ ID NO: 2491337 - DNA, 13 bp, Homo sapiens
tttctttaactgc

SEQ ID NO: 2491338 - DNA, 14 bp, Homo sapiens
tttctttgaataaa

SEQ ID NO: 2491339 - DNA, 15 bp, Homo sapiens
tttctttgaataaat

SEQ ID NO: 2491340 - DNA, 18 bp, Homo sapiens
tttctttgtttctttctt

SEQ ID NO: 2491341 - DNA, 19 bp, Homo sapiens
tttctttgtttctttcttt

SEQ ID NO: 2491342 - DNA, 21 bp, Homo sapiens
tttcttttcccccattaatca

SEQ ID NO: 2491343 - DNA, 22 bp, Homo sapiens
tttcttttctggaatgtaatca

SEQ ID NO: 2491344 - DNA, 23 bp, Homo sapiens
tttgaaaaagcgaaaaaatcagg

SEQ ID NO: 2491345 - DNA, 14 bp, Homo sapiens
tttgaaataagcta

SEQ ID NO: 2491346 - DNA, 16 bp, Homo sapiens
tttgaaatatggtctt

SEQ ID NO: 2491347 - DNA, 17 bp, Homo sapiens
tttgaagaacatgtgag

SEQ ID NO: 2491348 - DNA, 18 bp, Homo sapiens
tttgaagctactgtgtgt

SEQ ID NO: 2491349 - DNA, 20 bp, Homo sapiens
tttgaagtgctgtttattaa

SEQ ID NO: 2491350 - DNA, 19 bp, Homo sapiens
tttgaatcaataatatatt

SEQ ID NO: 2491351 - DNA, 15 bp, Homo sapiens
tttgaatgtgtttca

SEQ ID NO: 2491352 - DNA, 20 bp, Homo sapiens
tttgacaacgtttcagcgac

SEQ ID NO: 2491353 - DNA, 13 bp, Homo sapiens
tttgacaattact

SEQ ID NO: 2491354 - DNA, 20 bp, Homo sapiens
tttgacacctcttttttcgt

SEQ ID NO: 2491355 - DNA, 21 bp, Homo sapiens
tttgaccccgatatattttag

SEQ ID NO: 2491356 - DNA, 12 bp, Homo sapiens
tttgacttttct

SEQ ID NO: 2491357 - DNA, 15 bp, Homo sapiens
tttgacttttctgta

SEQ ID NO: 2491358 - DNA, 17 bp, Homo sapiens
tttgacttttctgtaat

SEQ ID NO: 2491359 - DNA, 20 bp, Homo sapiens
tttgagaaaaaggaaaaaaa

SEQ ID NO: 2491360 - DNA, 22 bp, Homo sapiens
tttgagatattaatgcccagac

SEQ ID NO: 2491361 - DNA, 15 bp, Homo sapiens
tttgagcttaatctt

SEQ ID NO: 2491362 - DNA, 15 bp, Homo sapiens
tttgattcatagtaa

SEQ ID NO: 2491363 - DNA, 15 bp, Homo sapiens
tttgattgatttgaa

SEQ ID NO: 2491364 - DNA, 14 bp, Homo sapiens
tttgatttcattaa

SEQ ID NO: 2491365 - DNA, 19 bp, Homo sapiens
tttgcaaagaaagaaaaaa

SEQ ID NO: 2491366 - DNA, 21 bp, Homo sapiens
tttgcaaggtgcatttttact

SEQ ID NO: 2491367 - DNA, 16 bp, Homo sapiens
tttgcagcgactggca

SEQ ID NO: 2491368 - DNA, 9 bp, Homo sapiens
tttgcagta

SEQ ID NO: 2491369 - DNA, 17 bp, Homo sapiens
tttgcagtaactgtttt

SEQ ID NO: 2491370 - DNA, 16 bp, Homo sapiens
tttgcataacaattcc

SEQ ID NO: 2491371 - DNA, 13 bp, Homo sapiens
tttgcatctcagt

SEQ ID NO: 2491372 - DNA, 14 bp, Homo sapiens
tttgcatctcagta

SEQ ID NO: 2491373 - DNA, 16 bp, Homo sapiens
tttgcattaaattaca

SEQ ID NO: 2491374 - DNA, 17 bp, Homo sapiens
tttgcattaaattcaca

SEQ ID NO: 2491375 - DNA, 21 bp, Homo sapiens
tttgcatttgtttatgtaatt

SEQ ID NO: 2491376 - DNA, 15 bp, Homo sapiens
tttgccacagctttt

SEQ ID NO: 2491377 - DNA, 15 bp, Homo sapiens
tttgctaaagacatg

SEQ ID NO: 2491378 - DNA, 20 bp, Homo sapiens
tttgctcttcaagaaatctg

SEQ ID NO: 2491379 - DNA, 20 bp, Homo sapiens
tttgctgctaatattttcct

SEQ ID NO: 2491380 - DNA, 22 bp, Homo sapiens
tttgctgctgcccatgtttcaa

SEQ ID NO: 2491381 - DNA, 17 bp, Homo sapiens
tttgctgtgaggctgtc

SEQ ID NO: 2491382 - DNA, 21 bp, Homo sapiens
tttgctgttttaaacattaat

SEQ ID NO: 2491383 - DNA, 19 bp, Homo sapiens
tttgcttcatgtgtcccag

SEQ ID NO: 2491384 - DNA, 12 bp, Homo sapiens
tttgctttctgt

SEQ ID NO: 2491385 - DNA, 13 bp, Homo sapiens
tttggaaagtaca

SEQ ID NO: 2491386 - DNA, 15 bp, Homo sapiens
tttggaaagtacact

SEQ ID NO: 2491387 - DNA, 22 bp, Homo sapiens
tttggaaagtacactctgctgt

SEQ ID NO: 2491388 - DNA, 15 bp, Homo sapiens
tttggaatacttttt

SEQ ID NO: 2491389 - DNA, 16 bp, Homo sapiens
tttggacttctggggt

SEQ ID NO: 2491390 - DNA, 18 bp, Homo sapiens
tttggagagtttcctgaa

SEQ ID NO: 2491391 - DNA, 16 bp, Homo sapiens
tttggagagtttgcct

SEQ ID NO: 2491392 - DNA, 18 bp, Homo sapiens
tttggagggaagctcttg

SEQ ID NO: 2491393 - DNA, 10 bp, Homo sapiens
tttggatgcc

SEQ ID NO: 2491394 - DNA, 16 bp, Homo sapiens
tttggcatccctgggc

SEQ ID NO: 2491395 - DNA, 20 bp, Homo sapiens
tttggctgaaattctcctgg

SEQ ID NO: 2491396 - DNA, 16 bp, Homo sapiens
tttgggcttcagctgc

SEQ ID NO: 2491397 - DNA, 14 bp, Homo sapiens
tttgggttctgcct

SEQ ID NO: 2491398 - DNA, 16 bp, Homo sapiens
tttgggtttctgccct

SEQ ID NO: 2491399 - DNA, 20 bp, Homo sapiens
tttggtaaaatacttcttga

SEQ ID NO: 2491400 - DNA, 18 bp, Homo sapiens
tttggtcgaggagtaaca

SEQ ID NO: 2491401 - DNA, 23 bp, Homo sapiens
tttgtaaaatgacaatcatgtgt

SEQ ID NO: 2491402 - DNA, 20 bp, Homo sapiens
tttgtaagttgaagcaaatc

SEQ ID NO: 2491403 - DNA, 19 bp, Homo sapiens
tttgtaataataaagaata

SEQ ID NO: 2491404 - DNA, 23 bp, Homo sapiens
tttgtaatgtcttgagctctatt

SEQ ID NO: 2491405 - DNA, 23 bp, Homo sapiens
tttgtaattaaaagcaaatcatt

SEQ ID NO: 2491406 - DNA, 16 bp, Homo sapiens
tttgtagggtttctag

SEQ ID NO: 2491407 - DNA, 15 bp, Homo sapiens
tttgtagttgaatat

SEQ ID NO: 2491408 - DNA, 14 bp, Homo sapiens
tttgtcactttttc

SEQ ID NO: 2491409 - DNA, 22 bp, Homo sapiens
tttgtcagaactagaatttgat

SEQ ID NO: 2491410 - DNA, 21 bp, Homo sapiens
tttgtcagggagtgttcccta

SEQ ID NO: 2491411 - DNA, 19 bp, Homo sapiens
tttgtcagtatttttgccg

SEQ ID NO: 2491412 - DNA, 18 bp, Homo sapiens
tttgtgagtcaatacata

SEQ ID NO: 2491413 - DNA, 20 bp, Homo sapiens
tttgtgatatgcacaatgta

SEQ ID NO: 2491414 - DNA, 18 bp, Homo sapiens
tttgtgatggagtgctgt

SEQ ID NO: 2491415 - DNA, 17 bp, Homo sapiens
tttgtgggggactgtaa

SEQ ID NO: 2491416 - DNA, 15 bp, Homo sapiens
tttgttattttgcaa

SEQ ID NO: 2491417 - DNA, 17 bp, Homo sapiens
tttgttgacattctgaa

SEQ ID NO: 2491418 - DNA, 18 bp, Homo sapiens
tttgttgacattctgaat

SEQ ID NO: 2491419 - DNA, 19 bp, Homo sapiens
tttatctataatttaccta

SEQ ID NO: 2491420 - DNA, 20 bp, Homo sapiens
tttatctataatttacctaa

SEQ ID NO: 2491421 - DNA, 14 bp, Homo sapiens
tttatgagaaactt

SEQ ID NO: 2491422 - DNA, 23 bp, Homo sapiens
tttatggtaactgctttctgttc

SEQ ID NO: 2491423 - DNA, 14 bp, Homo sapiens
tttatgtaatttca

SEQ ID NO: 2491424 - DNA, 11 bp, Homo sapiens
tttatgtctgg

SEQ ID NO: 2491425 - DNA, 19 bp, Homo sapiens
tttatgtctgtggattttt

SEQ ID NO: 2491426 - DNA, 20 bp, Homo sapiens
tttatgttatatataaatat

SEQ ID NO: 2491427 - DNA, 19 bp, Homo sapiens
tttatgttccattaaacga

SEQ ID NO: 2491428 - DNA, 19 bp, Homo sapiens
tttattaatatatattatc

SEQ ID NO: 2491429 - DNA, 13 bp, Homo sapiens
tttattaatctta

SEQ ID NO: 2491430 - DNA, 16 bp, Homo sapiens
tttattatgcattata

SEQ ID NO: 2491431 - DNA, 23 bp, Homo sapiens
tttattccagaatgctgtacatc

SEQ ID NO: 2491432 - DNA, 16 bp, Homo sapiens
tttattcttctagagt

SEQ ID NO: 2491433 - DNA, 14 bp, Homo sapiens
tttattgacacaga

SEQ ID NO: 2491434 - DNA, 17 bp, Homo sapiens
tttatttttcttgtctt

SEQ ID NO: 2491435 - DNA, 12 bp, Homo sapiens
tttcaaaatgct

SEQ ID NO: 2491436 - DNA, 15 bp, Homo sapiens
tttcaaaatgctttt

SEQ ID NO: 2491437 - DNA, 14 bp, Homo sapiens
tttcaaagatgctg

SEQ ID NO: 2491438 - DNA, 19 bp, Homo sapiens
tttcaaagatgctgtgagt

SEQ ID NO: 2491439 - DNA, 17 bp, Homo sapiens
tttcaaaggtacttgga

SEQ ID NO: 2491440 - DNA, 19 bp, Homo sapiens
tttcaacagtgaagacaga

SEQ ID NO: 2491441 - DNA, 18 bp, Homo sapiens
tttcaacatgagtgtatt

SEQ ID NO: 2491442 - DNA, 15 bp, Homo sapiens
tttcaacggaaagtg

SEQ ID NO: 2491443 - DNA, 20 bp, Homo sapiens
tttcaaggcactctagattc

SEQ ID NO: 2491444 - DNA, 14 bp, Homo sapiens
tttcaatagccact

SEQ ID NO: 2491445 - DNA, 18 bp, Homo sapiens
tttcaattgcatctccca

SEQ ID NO: 2491446 - DNA, 20 bp, Homo sapiens
tttcaattgcatctcccaga

SEQ ID NO: 2491447 - DNA, 18 bp, Homo sapiens
tttcacagtttgaaataa

SEQ ID NO: 2491448 - DNA, 17 bp, Homo sapiens
tttcacattagaagaca

SEQ ID NO: 2491449 - DNA, 18 bp, Homo sapiens
tttcacattagaagacaa

SEQ ID NO: 2491450 - DNA, 19 bp, Homo sapiens
tttcacattagaagacaat

SEQ ID NO: 2491451 - DNA, 20 bp, Homo sapiens
tttcacgcctgaggcaatta

SEQ ID NO: 2491452 - DNA, 15 bp, Homo sapiens
tttcactggagcaca

SEQ ID NO: 2491453 - DNA, 11 bp, Homo sapiens
tttcagactcc

SEQ ID NO: 2491454 - DNA, 22 bp, Homo sapiens
tttcagagtgactacacacagt

SEQ ID NO: 2491455 - DNA, 18 bp, Homo sapiens
tttcagagttctttttga

SEQ ID NO: 2491456 - DNA, 23 bp, Homo sapiens
tttcagcactagccaaacctcac

SEQ ID NO: 2491457 - DNA, 23 bp, Homo sapiens
tttcagcgactccgttggccact

SEQ ID NO: 2491458 - DNA, 12 bp, Homo sapiens
tttcagctcctg

SEQ ID NO: 2491459 - DNA, 16 bp, Homo sapiens
tttcagctgtcttttg

SEQ ID NO: 2491460 - DNA, 18 bp, Homo sapiens
tttcaggaggaatactga

SEQ ID NO: 2491461 - DNA, 21 bp, Homo sapiens
tttcaggaggaatactgaaca

SEQ ID NO: 2491462 - DNA, 19 bp, Homo sapiens
tttcaggcattggatattt

SEQ ID NO: 2491463 - DNA, 18 bp, Homo sapiens
tttcagttctaggaaaat

SEQ ID NO: 2491464 - DNA, 17 bp, Homo sapiens
tttcataagtatttcaa

SEQ ID NO: 2491465 - DNA, 16 bp, Homo sapiens
tttcatacattttcta

SEQ ID NO: 2491466 - DNA, 15 bp, Homo sapiens
tttcatatagttagc

SEQ ID NO: 2491467 - DNA, 13 bp, Homo sapiens
tttcatcattttt

SEQ ID NO: 2491468 - DNA, 20 bp, Homo sapiens
tttcatccataactgaacat

SEQ ID NO: 2491469 - DNA, 15 bp, Homo sapiens
tttcatccttgtctt

SEQ ID NO: 2491470 - DNA, 19 bp, Homo sapiens
tttcatgataatgaacaga

SEQ ID NO: 2491471 - DNA, 22 bp, Homo sapiens
tttcatgataatgaacagaaca

SEQ ID NO: 2491472 - DNA, 17 bp, Homo sapiens
tttcatgcaaactcttt

SEQ ID NO: 2491473 - DNA, 21 bp, Homo sapiens
tttcatgcgatgacacttgta

SEQ ID NO: 2491474 - DNA, 19 bp, Homo sapiens
tttcattaaataaatttga

SEQ ID NO: 2491475 - DNA, 21 bp, Homo sapiens
tttcattaatacagggcattt

SEQ ID NO: 2491476 - DNA, 14 bp, Homo sapiens
tttcatttcaactg

SEQ ID NO: 2491477 - DNA, 16 bp, Homo sapiens
tttcatttcttctaca

SEQ ID NO: 2491478 - DNA, 16 bp, Homo sapiens
tttcattttctctcag

SEQ ID NO: 2491479 - DNA, 12 bp, Homo sapiens
tttccaactact

SEQ ID NO: 2491480 - DNA, 19 bp, Homo sapiens
tttccaactactaatagaa

SEQ ID NO: 2491481 - DNA, 17 bp, Homo sapiens
tttccagatttggggta

SEQ ID NO: 2491482 - DNA, 17 bp, Homo sapiens
tttccagcattcccagg

SEQ ID NO: 2491483 - DNA, 16 bp, Homo sapiens
tttccaggcttctgct

SEQ ID NO: 2491484 - DNA, 14 bp, Homo sapiens
tttccatttgcatt

SEQ ID NO: 2491485 - DNA, 21 bp, Homo sapiens
tttcccaccccaacctgctct

SEQ ID NO: 2491486 - DNA, 18 bp, Homo sapiens
tttccccaccagatgctg

SEQ ID NO: 2491487 - DNA, 15 bp, Homo sapiens
tttccccagacttgt

SEQ ID NO: 2491488 - DNA, 19 bp, Homo sapiens
tttcccttcagtaccctct

SEQ ID NO: 2491489 - DNA, 17 bp, Homo sapiens
tttcccttgtagctcct

SEQ ID NO: 2491490 - DNA, 24 bp, Homo sapiens
tttcctaataaagttctgtactca

SEQ ID NO: 2491491 - DNA, 12 bp, Homo sapiens
tttcctaatact

SEQ ID NO: 2491492 - DNA, 15 bp, Homo sapiens
tttcctatgggaaca

SEQ ID NO: 2491493 - DNA, 21 bp, Homo sapiens
tttcctcctgaggctttggat

SEQ ID NO: 2491494 - DNA, 23 bp, Homo sapiens
tttcctctgttcaaagctgcctg

SEQ ID NO: 2491495 - DNA, 23 bp, Homo sapiens
tttcctgtatttgttcccaagag

SEQ ID NO: 2491496 - DNA, 12 bp, Homo sapiens
tttcctgtcctc

SEQ ID NO: 2491497 - DNA, 14 bp, Homo sapiens
tttccttccctttt

SEQ ID NO: 2491498 - DNA, 21 bp, Homo sapiens
tttcctttaactgacaagcca

SEQ ID NO: 2491499 - DNA, 19 bp, Homo sapiens
tttcctttttaatatgctt

SEQ ID NO: 2491500 - DNA, 22 bp, Homo sapiens
tttcctttttaatatgcttaaa

SEQ ID NO: 2491501 - DNA, 13 bp, Homo sapiens
tttcgtggggagg

SEQ ID NO: 2491502 - DNA, 12 bp, Homo sapiens
tttcgtttgttt

SEQ ID NO: 2491503 - DNA, 12 bp, Homo sapiens
tttctaaaatct

SEQ ID NO: 2491504 - DNA, 21 bp, Homo sapiens
tttctaaaatcttatagttct

SEQ ID NO: 2491505 - DNA, 15 bp, Homo sapiens
tttctaaactggaga

SEQ ID NO: 2491506 - DNA, 17 bp, Homo sapiens
tttctaaactggagact

SEQ ID NO: 2491507 - DNA, 19 bp, Homo sapiens
tttctaaactggagactgt

SEQ ID NO: 2491508 - DNA, 14 bp, Homo sapiens
tttctaagattcta

SEQ ID NO: 2491509 - DNA, 19 bp, Homo sapiens
tttctaattatgtagctct

SEQ ID NO: 2491510 - DNA, 13 bp, Homo sapiens
tttctaattgctt

SEQ ID NO: 2491511 - DNA, 16 bp, Homo sapiens
tttctagagcactgcc

SEQ ID NO: 2491512 - DNA, 18 bp, Homo sapiens
tttctatagccaaaaata

SEQ ID NO: 2491513 - DNA, 20 bp, Homo sapiens
tttctatcgttctctctttg

SEQ ID NO: 2491514 - DNA, 14 bp, Homo sapiens
tttctattaaaaga

SEQ ID NO: 2491515 - DNA, 20 bp, Homo sapiens
tttctcaggctaggccagca

SEQ ID NO: 2491516 - DNA, 21 bp, Homo sapiens
tttctcaggctaggccagcag

SEQ ID NO: 2491517 - DNA, 22 bp, Homo sapiens
tttctcaggctaggccagcagg

SEQ ID NO: 2491518 - DNA, 17 bp, Homo sapiens
tttaaaaatagacactc

SEQ ID NO: 2491519 - DNA, 22 bp, Homo sapiens
tttaaaactgttggaatggatt

SEQ ID NO: 2491520 - DNA, 13 bp, Homo sapiens
tttaaaagatgct

SEQ ID NO: 2491521 - DNA, 12 bp, Homo sapiens
tttaaaagattt

SEQ ID NO: 2491522 - DNA, 12 bp, Homo sapiens
tttaaaatagca

SEQ ID NO: 2491523 - DNA, 20 bp, Homo sapiens
tttaaaatagcgttcttgta

SEQ ID NO: 2491524 - DNA, 16 bp, Homo sapiens
tttaaaatatctacat

SEQ ID NO: 2491525 - DNA, 17 bp, Homo sapiens
tttaaaatgtaaagcca

SEQ ID NO: 2491526 - DNA, 18 bp, Homo sapiens
tttaaaattgatttttct

SEQ ID NO: 2491527 - DNA, 12 bp, Homo sapiens
tttaaaatttgt

SEQ ID NO: 2491528 - DNA, 15 bp, Homo sapiens
tttaaacaagtattt

SEQ ID NO: 2491529 - DNA, 19 bp, Homo sapiens
tttaaaccaattgctgcta

SEQ ID NO: 2491530 - DNA, 20 bp, Homo sapiens
tttaaaccgctaaaagaaac

SEQ ID NO: 2491531 - DNA, 21 bp, Homo sapiens
tttaaaccgctaaaagaaact

SEQ ID NO: 2491532 - DNA, 11 bp, Homo sapiens
tttaaaccttt

SEQ ID NO: 2491533 - DNA, 22 bp, Homo sapiens
tttaaagaaaaaaattgaaatg

SEQ ID NO: 2491534 - DNA, 18 bp, Homo sapiens
tttaaagacaatgttaaa

SEQ ID NO: 2491535 - DNA, 21 bp, Homo sapiens
tttaaagagtctagattcaaa

SEQ ID NO: 2491536 - DNA, 23 bp, Homo sapiens
tttaaagagtctagattcaaagg

SEQ ID NO: 2491537 - DNA, 17 bp, Homo sapiens
tttaaagcgtttgcaca

SEQ ID NO: 2491538 - DNA, 18 bp, Homo sapiens
tttaaagtctcagtttct

SEQ ID NO: 2491539 - DNA, 22 bp, Homo sapiens
tttaaagtgactaatggcatga

SEQ ID NO: 2491540 - DNA, 23 bp, Homo sapiens
tttaaatgaacaagagaagcatt

SEQ ID NO: 2491541 - DNA, 11 bp, Homo sapiens
tttaaattgtg

SEQ ID NO: 2491542 - DNA, 18 bp, Homo sapiens
tttaacagaaactttcaa

SEQ ID NO: 2491543 - DNA, 21 bp, Homo sapiens
tttaacagaaactttcaaaag

SEQ ID NO: 2491544 - DNA, 19 bp, Homo sapiens
tttaacagaaattgtatat

SEQ ID NO: 2491545 - DNA, 21 bp, Homo sapiens
tttaacagaaattgtatattg

SEQ ID NO: 2491546 - DNA, 19 bp, Homo sapiens
tttaacataagctattttt

SEQ ID NO: 2491547 - DNA, 19 bp, Homo sapiens
tttaacccccctgtacaca

SEQ ID NO: 2491548 - DNA, 19 bp, Homo sapiens
tttaactgacaagccatct

SEQ ID NO: 2491549 - DNA, 12 bp, Homo sapiens
tttaactgccgt

SEQ ID NO: 2491550 - DNA, 13 bp, Homo sapiens
tttaacttaaata

SEQ ID NO: 2491551 - DNA, 21 bp, Homo sapiens
tttaactttgttttattttca

SEQ ID NO: 2491552 - DNA, 14 bp, Homo sapiens
tttaagaaatagaa

SEQ ID NO: 2491553 - DNA, 15 bp, Homo sapiens
tttaagaatatctgt

SEQ ID NO: 2491554 - DNA, 18 bp, Homo sapiens
tttaagccaaaacaatgt

SEQ ID NO: 2491555 - DNA, 20 bp, Homo sapiens
tttaagccaaaacaatgttt

SEQ ID NO: 2491556 - DNA, 13 bp, Homo sapiens
tttaagctctgag

SEQ ID NO: 2491557 - DNA, 17 bp, Homo sapiens
tttaagctctgagctgt

SEQ ID NO: 2491558 - DNA, 16 bp, Homo sapiens
tttaaggtttttactg

SEQ ID NO: 2491559 - DNA, 15 bp, Homo sapiens
tttaagtgaaaatgg

SEQ ID NO: 2491560 - DNA, 18 bp, Homo sapiens
tttaatataaatgcaaat

SEQ ID NO: 2491561 - DNA, 13 bp, Homo sapiens
tttaatcaaattt

SEQ ID NO: 2491562 - DNA, 19 bp, Homo sapiens
tttaatgaagatctaaata

SEQ ID NO: 2491563 - DNA, 23 bp, Homo sapiens
tttaatgccgatatactctagat

SEQ ID NO: 2491564 - DNA, 19 bp, Homo sapiens
tttaatggggtgcacctgt

SEQ ID NO: 2491565 - DNA, 16 bp, Homo sapiens
tttaatgtttaaaaca

SEQ ID NO: 2491566 - DNA, 14 bp, Homo sapiens
tttaattattattc

SEQ ID NO: 2491567 - DNA, 23 bp, Homo sapiens
tttaattattatttatatatgta

SEQ ID NO: 2491568 - DNA, 16 bp, Homo sapiens
tttacaaaaatataaa

SEQ ID NO: 2491569 - DNA, 14 bp, Homo sapiens
tttacaaactgaag

SEQ ID NO: 2491570 - DNA, 16 bp, Homo sapiens
tttacacgcttttgtg

SEQ ID NO: 2491571 - DNA, 19 bp, Homo sapiens
tttacaggaacttcatcat

SEQ ID NO: 2491572 - DNA, 14 bp, Homo sapiens
tttacatgaagtat

SEQ ID NO: 2491573 - DNA, 16 bp, Homo sapiens
tttacatgaagtattt

SEQ ID NO: 2491574 - DNA, 21 bp, Homo sapiens
tttacatgaagtattttttca

SEQ ID NO: 2491575 - DNA, 16 bp, Homo sapiens
tttacatgaggactct

SEQ ID NO: 2491576 - DNA, 13 bp, Homo sapiens
tttacatgcttat

SEQ ID NO: 2491577 - DNA, 17 bp, Homo sapiens
tttacatgcttattcca

SEQ ID NO: 2491578 - DNA, 20 bp, Homo sapiens
tttacatgcttattccatga

SEQ ID NO: 2491579 - DNA, 14 bp, Homo sapiens
tttaccctggcccc

SEQ ID NO: 2491580 - DNA, 19 bp, Homo sapiens
tttaccctggcccctctcc

SEQ ID NO: 2491581 - DNA, 13 bp, Homo sapiens
tttacctcagcct

SEQ ID NO: 2491582 - DNA, 15 bp, Homo sapiens
tttacctcagcctgg

SEQ ID NO: 2491583 - DNA, 13 bp, Homo sapiens
tttactgtaatat

SEQ ID NO: 2491584 - DNA, 14 bp, Homo sapiens
tttagaaaacttta

SEQ ID NO: 2491585 - DNA, 15 bp, Homo sapiens
tttagaaagaatatt

SEQ ID NO: 2491586 - DNA, 18 bp, Homo sapiens
tttagaaatcattttgca

SEQ ID NO: 2491587 - DNA, 14 bp, Homo sapiens
tttagaagccaact

SEQ ID NO: 2491588 - DNA, 14 bp, Homo sapiens
tttagaagcctgca

SEQ ID NO: 2491589 - DNA, 16 bp, Homo sapiens
tttagacagtctcact

SEQ ID NO: 2491590 - DNA, 21 bp, Homo sapiens
tttagacttggattctttcca

SEQ ID NO: 2491591 - DNA, 21 bp, Homo sapiens
tttagagataagagttggctg

SEQ ID NO: 2491592 - DNA, 14 bp, Homo sapiens
tttagatagccctg

SEQ ID NO: 2491593 - DNA, 18 bp, Homo sapiens
tttagatagccctgtcct

SEQ ID NO: 2491594 - DNA, 20 bp, Homo sapiens
tttagatagccctgtcctgg

SEQ ID NO: 2491595 - DNA, 15 bp, Homo sapiens
tttagatctctgaag

SEQ ID NO: 2491596 - DNA, 21 bp, Homo sapiens
tttagatgataaagagacagt

SEQ ID NO: 2491597 - DNA, 20 bp, Homo sapiens
tttagcattgtagtgctttg

SEQ ID NO: 2491598 - DNA, 13 bp, Homo sapiens
tttagctctgaga

SEQ ID NO: 2491599 - DNA, 14 bp, Homo sapiens
tttagctctgagaa

SEQ ID NO: 2491600 - DNA, 18 bp, Homo sapiens
tttaggctatttgtaaat

SEQ ID NO: 2491601 - DNA, 16 bp, Homo sapiens
tttagggaacaatttg

SEQ ID NO: 2491602 - DNA, 18 bp, Homo sapiens
tttaggttctaaagttct

SEQ ID NO: 2491603 - DNA, 22 bp, Homo sapiens
tttagtaaaccaatcctatgca

SEQ ID NO: 2491604 - DNA, 15 bp, Homo sapiens
tttagtcatgtgacc

SEQ ID NO: 2491605 - DNA, 16 bp, Homo sapiens
tttagtgaacttgaaa

SEQ ID NO: 2491606 - DNA, 13 bp, Homo sapiens
tttagtttttcat

SEQ ID NO: 2491607 - DNA, 15 bp, Homo sapiens
tttagtttttcatta

SEQ ID NO: 2491608 - DNA, 17 bp, Homo sapiens
tttataaatactgcaaa

SEQ ID NO: 2491609 - DNA, 13 bp, Homo sapiens
tttataaatccaa

SEQ ID NO: 2491610 - DNA, 22 bp, Homo sapiens
tttataagcatcattatttatg

SEQ ID NO: 2491611 - DNA, 23 bp, Homo sapiens
tttataagcatcattatttatgt

SEQ ID NO: 2491612 - DNA, 18 bp, Homo sapiens
tttatactctttctgtat

SEQ ID NO: 2491613 - DNA, 20 bp, Homo sapiens
tttatactctttctgtatat

SEQ ID NO: 2491614 - DNA, 21 bp, Homo sapiens
tttatatatttaaaagtgtca

SEQ ID NO: 2491615 - DNA, 13 bp, Homo sapiens
tttatatgtacat

SEQ ID NO: 2491616 - DNA, 13 bp, Homo sapiens
tttatatgttgta

SEQ ID NO: 2491617 - DNA, 22 bp, Homo sapiens
tttatattgataagatctttta

SEQ ID NO: 2491618 - DNA, 21 bp, Homo sapiens
tttatcaaaccctagccttgc

SEQ ID NO: 2491619 - DNA, 13 bp, Homo sapiens
tttatcacttaaa

SEQ ID NO: 2491620 - DNA, 20 bp, Homo sapiens
ttctctctttatacagctgt

SEQ ID NO: 2491621 - DNA, 18 bp, Homo sapiens
ttctctgagctgtgcagg

SEQ ID NO: 2491622 - DNA, 10 bp, Homo sapiens
ttctctgcca

SEQ ID NO: 2491623 - DNA, 12 bp, Homo sapiens
ttctctgccagt

SEQ ID NO: 2491624 - DNA, 13 bp, Homo sapiens
ttctctgccagtg

SEQ ID NO: 2491625 - DNA, 16 bp, Homo sapiens
ttctctgtgtctaaga

SEQ ID NO: 2491626 - DNA, 17 bp, Homo sapiens
ttctctgtgtctaagat

SEQ ID NO: 2491627 - DNA, 20 bp, Homo sapiens
ttctctgtgtctaagattct

SEQ ID NO: 2491628 - DNA, 12 bp, Homo sapiens
ttctcttcattt

SEQ ID NO: 2491629 - DNA, 13 bp, Homo sapiens
ttctcttgcctca

SEQ ID NO: 2491630 - DNA, 23 bp, Homo sapiens
ttctcttgtataagatcctagat

SEQ ID NO: 2491631 - DNA, 14 bp, Homo sapiens
ttctgaacagctgg

SEQ ID NO: 2491632 - DNA, 16 bp, Homo sapiens
ttctgaacagctggtg

SEQ ID NO: 2491633 - DNA, 13 bp, Homo sapiens
ttctgaactaaag

SEQ ID NO: 2491634 - DNA, 22 bp, Homo sapiens
ttctgaactaaagtgctgcact

SEQ ID NO: 2491635 - DNA, 13 bp, Homo sapiens
ttctgacagcctc

SEQ ID NO: 2491636 - DNA, 18 bp, Homo sapiens
ttctgactcggtttctcc

SEQ ID NO: 2491637 - DNA, 19 bp, Homo sapiens
ttctgactcggtttctcca

SEQ ID NO: 2491638 - DNA, 17 bp, Homo sapiens
ttctgagacgtcatgag

SEQ ID NO: 2491639 - DNA, 19 bp, Homo sapiens
ttctgagacgtcatgagga

SEQ ID NO: 2491640 - DNA, 16 bp, Homo sapiens
ttctgagatctgttga

SEQ ID NO: 2491641 - DNA, 20 bp, Homo sapiens
ttctgagggcccgtgtaaat

SEQ ID NO: 2491642 - DNA, 14 bp, Homo sapiens
ttctgagttttgtg

SEQ ID NO: 2491643 - DNA, 15 bp, Homo sapiens
ttctgagttttgtgt

SEQ ID NO: 2491644 - DNA, 16 bp, Homo sapiens
ttctgagttttgtgtt

SEQ ID NO: 2491645 - DNA, 22 bp, Homo sapiens
ttctgagttttgtgtttgttgt

SEQ ID NO: 2491646 - DNA, 19 bp, Homo sapiens
ttctgataaaagatggcca

SEQ ID NO: 2491647 - DNA, 22 bp, Homo sapiens
ttctgatcaaggccttattgga

SEQ ID NO: 2491648 - DNA, 22 bp, Homo sapiens
ttctgcaagcacatctgcattt

SEQ ID NO: 2491649 - DNA, 22 bp, Homo sapiens
ttctgcacttgcggttccggca

SEQ ID NO: 2491650 - DNA, 15 bp, Homo sapiens
ttctgcagtaaatct

SEQ ID NO: 2491651 - DNA, 14 bp, Homo sapiens
ttctgcctcccctt

SEQ ID NO: 2491652 - DNA, 18 bp, Homo sapiens
ttctgcctctctaggacc

SEQ ID NO: 2491653 - DNA, 22 bp, Homo sapiens
ttctgcctgccagctgcactga

SEQ ID NO: 2491654 - DNA, 15 bp, Homo sapiens
ttctgcctttgccag

SEQ ID NO: 2491655 - DNA, 20 bp, Homo sapiens
ttctgctcagctctgggcca

SEQ ID NO: 2491656 - DNA, 20 bp, Homo sapiens
ttctgctcatcattctctgt

SEQ ID NO: 2491657 - DNA, 21 bp, Homo sapiens
ttctgctctggttgtttctgt

SEQ ID NO: 2491658 - DNA, 18 bp, Homo sapiens
ttctgctggcctctgcga

SEQ ID NO: 2491659 - DNA, 20 bp, Homo sapiens
ttctgctggcctctgcgagt

SEQ ID NO: 2491660 - DNA, 20 bp, Homo sapiens
ttctgctggggcctgggaca

SEQ ID NO: 2491661 - DNA, 21 bp, Homo sapiens
ttctgctggggcctgggacaa

SEQ ID NO: 2491662 - DNA, 14 bp, Homo sapiens
ttctgctttgctct

SEQ ID NO: 2491663 - DNA, 15 bp, Homo sapiens
ttctggaatgtaatc

SEQ ID NO: 2491664 - DNA, 16 bp, Homo sapiens
ttctggaatgtaatca

SEQ ID NO: 2491665 - DNA, 22 bp, Homo sapiens
ttctggaatgtaatcaatgttt

SEQ ID NO: 2491666 - DNA, 16 bp, Homo sapiens
ttctggacctctgggt

SEQ ID NO: 2491667 - DNA, 17 bp, Homo sapiens
ttctggacctctgggtt

SEQ ID NO: 2491668 - DNA, 14 bp, Homo sapiens
ttctggccaggaag

SEQ ID NO: 2491669 - DNA, 15 bp, Homo sapiens
ttctggccaggaagc

SEQ ID NO: 2491670 - DNA, 17 bp, Homo sapiens
ttctggccagtgtttaa

SEQ ID NO: 2491671 - DNA, 14 bp, Homo sapiens
ttctgggagggcag

SEQ ID NO: 2491672 - DNA, 17 bp, Homo sapiens
ttctggggcaggctggg

SEQ ID NO: 2491673 - DNA, 20 bp, Homo sapiens
ttctggggcaggctgggcca

SEQ ID NO: 2491674 - DNA, 23 bp, Homo sapiens
ttctggtgttggacaagcttctg

SEQ ID NO: 2491675 - DNA, 12 bp, Homo sapiens
ttctggttctaa

SEQ ID NO: 2491676 - DNA, 21 bp, Homo sapiens
ttctggttcttgtgttggctg

SEQ ID NO: 2491677 - DNA, 22 bp, Homo sapiens
ttctgtaattcaggtttttcct

SEQ ID NO: 2491678 - DNA, 13 bp, Homo sapiens
ttctgtaattgtg

SEQ ID NO: 2491679 - DNA, 22 bp, Homo sapiens
ttctgtacatgcattgagctct

SEQ ID NO: 2491680 - DNA, 12 bp, Homo sapiens
ttctgtaccagt

SEQ ID NO: 2491681 - DNA, 13 bp, Homo sapiens
ttctgtaccagtt

SEQ ID NO: 2491682 - DNA, 13 bp, Homo sapiens
ttctgtataaatg

SEQ ID NO: 2491683 - DNA, 13 bp, Homo sapiens
ttctgtccctagg

SEQ ID NO: 2491684 - DNA, 18 bp, Homo sapiens
ttctgtctcttttctctt

SEQ ID NO: 2491685 - DNA, 18 bp, Homo sapiens
ttctgtggtttcatgtta

SEQ ID NO: 2491686 - DNA, 14 bp, Homo sapiens
ttctgttctagttt

SEQ ID NO: 2491687 - DNA, 23 bp, Homo sapiens
ttctgtttcaaggcactctagat

SEQ ID NO: 2491688 - DNA, 17 bp, Homo sapiens
ttctgttttgtttcgct

SEQ ID NO: 2491689 - DNA, 14 bp, Homo sapiens
ttcttaaaaagtta

SEQ ID NO: 2491690 - DNA, 20 bp, Homo sapiens
ttcttaaagtgccagtattt

SEQ ID NO: 2491691 - DNA, 13 bp, Homo sapiens
ttcttaacttctt

SEQ ID NO: 2491692 - DNA, 15 bp, Homo sapiens
ttcttagctcaatga

SEQ ID NO: 2491693 - DNA, 18 bp, Homo sapiens
ttcttcataacaatttta

SEQ ID NO: 2491694 - DNA, 15 bp, Homo sapiens
ttcttccggcccctc

SEQ ID NO: 2491695 - DNA, 12 bp, Homo sapiens
ttcttcctcagc

SEQ ID NO: 2491696 - DNA, 16 bp, Homo sapiens
ttcttcctcagccagc

SEQ ID NO: 2491697 - DNA, 17 bp, Homo sapiens
ttcttcctcagccagcc

SEQ ID NO: 2491698 - DNA, 13 bp, Homo sapiens
ttcttcctgccag

SEQ ID NO: 2491699 - DNA, 14 bp, Homo sapiens
ttcttcctggccgc

SEQ ID NO: 2491700 - DNA, 18 bp, Homo sapiens
ttcttctaggttctaaaa

SEQ ID NO: 2491701 - DNA, 21 bp, Homo sapiens
ttcttctaggttctaaaaatt

SEQ ID NO: 2491702 - DNA, 14 bp, Homo sapiens
ttcttcttctcgtc

SEQ ID NO: 2491703 - DNA, 14 bp, Homo sapiens
ttcttgatgtaaaa

SEQ ID NO: 2491704 - DNA, 19 bp, Homo sapiens
ttcttgatgtaaaatcttg

SEQ ID NO: 2491705 - DNA, 12 bp, Homo sapiens
ttcttgcctcat

SEQ ID NO: 2491706 - DNA, 15 bp, Homo sapiens
ttcttgcctctgtgc

SEQ ID NO: 2491707 - DNA, 16 bp, Homo sapiens
ttcttgcctctgtgct

SEQ ID NO: 2491708 - DNA, 18 bp, Homo sapiens
ttcttgcctgaactcctg

SEQ ID NO: 2491709 - DNA, 17 bp, Homo sapiens
ttcttgcttctttctag

SEQ ID NO: 2491710 - DNA, 13 bp, Homo sapiens
ttcttgtctataa

SEQ ID NO: 2491711 - DNA, 22 bp, Homo sapiens
ttcttgtgtgtatgcacatgaa

SEQ ID NO: 2491712 - DNA, 17 bp, Homo sapiens
ttcttgttggtgcacag

SEQ ID NO: 2491713 - DNA, 12 bp, Homo sapiens
ttctttaactgc

SEQ ID NO: 2491714 - DNA, 20 bp, Homo sapiens
ttctttacaaaacaaactca

SEQ ID NO: 2491715 - DNA, 16 bp, Homo sapiens
ttctttcccagtctgt

SEQ ID NO: 2491716 - DNA, 13 bp, Homo sapiens
ttctttctagaaa

SEQ ID NO: 2491717 - DNA, 14 bp, Homo sapiens
ccacccttcccctc

SEQ ID NO: 2491718 - DNA, 14 bp, Homo sapiens
ccaccgggccactc

SEQ ID NO: 2491719 - DNA, 18 bp, Homo sapiens
ccaccgggccactccttc

SEQ ID NO: 2491720 - DNA, 22 bp, Homo sapiens
ccaccgggccactccttcctgc

SEQ ID NO: 2491721 - DNA, 13 bp, Homo sapiens
ccacctagcagca

SEQ ID NO: 2491722 - DNA, 23 bp, Homo sapiens
ccacctagcagcaccgttctgtg

SEQ ID NO: 2491723 - DNA, 18 bp, Homo sapiens
ccacctcagaccccgggg

SEQ ID NO: 2491724 - DNA, 21 bp, Homo sapiens
ccacctcctgacacccttctc

SEQ ID NO: 2491725 - DNA, 21 bp, Homo sapiens
ccacctctaacagcaccaaat

SEQ ID NO: 2491726 - DNA, 19 bp, Homo sapiens
ccacctgctagtgtgaatt

SEQ ID NO: 2491727 - DNA, 18 bp, Homo sapiens
ccacctggacccctgcat

SEQ ID NO: 2491728 - DNA, 23 bp, Homo sapiens
ccacctgtctcagcctcccagag

SEQ ID NO: 2491729 - DNA, 13 bp, Homo sapiens
ccacctttactgt

SEQ ID NO: 2491730 - DNA, 14 bp, Homo sapiens
ccacctttactgtg

SEQ ID NO: 2491731 - DNA, 12 bp, Homo sapiens
ccacgagggctg

SEQ ID NO: 2491732 - DNA, 15 bp, Homo sapiens
ccacgagggctggct

SEQ ID NO: 2491733 - DNA, 19 bp, Homo sapiens
ccacgagggctggctggcc

SEQ ID NO: 2491734 - DNA, 22 bp, Homo sapiens
ccacgagggctggctggcctca

SEQ ID NO: 2491735 - DNA, 22 bp, Homo sapiens
ccacgcccgtcctgcctgtggc

SEQ ID NO: 2491736 - DNA, 23 bp, Homo sapiens
ccacgcccgtcctgcctgtggcg

SEQ ID NO: 2491737 - DNA, 18 bp, Homo sapiens
ccacgcctcttgaccagg

SEQ ID NO: 2491738 - DNA, 12 bp, Homo sapiens
ccacggagccac

SEQ ID NO: 2491739 - DNA, 21 bp, Homo sapiens
ccactaaccttgcctggtaca

SEQ ID NO: 2491740 - DNA, 14 bp, Homo sapiens
ccactagcctcagg

SEQ ID NO: 2491741 - DNA, 17 bp, Homo sapiens
ccactcagagacatgca

SEQ ID NO: 2491742 - DNA, 18 bp, Homo sapiens
ccactccatctggtagaa

SEQ ID NO: 2491743 - DNA, 17 bp, Homo sapiens
ccactccgagaggtggg

SEQ ID NO: 2491744 - DNA, 20 bp, Homo sapiens
ccactccgagaggtgggcca

SEQ ID NO: 2491745 - DNA, 13 bp, Homo sapiens
ccactcctctgac

SEQ ID NO: 2491746 - DNA, 20 bp, Homo sapiens
ccactcctctgactcagggc

SEQ ID NO: 2491747 - DNA, 14 bp, Homo sapiens
ccactccttcctgc

SEQ ID NO: 2491748 - DNA, 16 bp, Homo sapiens
ccactccttcctgccc

SEQ ID NO: 2491749 - DNA, 16 bp, Homo sapiens
ccactcgatgatgctt

SEQ ID NO: 2491750 - DNA, 14 bp, Homo sapiens
ccactctcctaggc

SEQ ID NO: 2491751 - DNA, 13 bp, Homo sapiens
ccactctgctctg

SEQ ID NO: 2491752 - DNA, 19 bp, Homo sapiens
ccactctgcttctctgact

SEQ ID NO: 2491753 - DNA, 13 bp, Homo sapiens
ccactctggcagc

SEQ ID NO: 2491754 - DNA, 18 bp, Homo sapiens
ccactctggcagccacac

SEQ ID NO: 2491755 - DNA, 22 bp, Homo sapiens
ccactctggcagccacacttct

SEQ ID NO: 2491756 - DNA, 12 bp, Homo sapiens
ccactctgtaat

SEQ ID NO: 2491757 - DNA, 14 bp, Homo sapiens
ccactctgtaattg

SEQ ID NO: 2491758 - DNA, 19 bp, Homo sapiens
ccactctgtaattgcaaaa

SEQ ID NO: 2491759 - DNA, 13 bp, Homo sapiens
ccactgaccagaa

SEQ ID NO: 2491760 - DNA, 17 bp, Homo sapiens
ccactgagaggacagag

SEQ ID NO: 2491761 - DNA, 16 bp, Homo sapiens
ccactgccttcgcttc

SEQ ID NO: 2491762 - DNA, 14 bp, Homo sapiens
ccactgcttttccc

SEQ ID NO: 2491763 - DNA, 16 bp, Homo sapiens
ccactgtgcctcagag

SEQ ID NO: 2491764 - DNA, 13 bp, Homo sapiens
ccactgtgttcct

SEQ ID NO: 2491765 - DNA, 15 bp, Homo sapiens
ccacttaatgtatgt

SEQ ID NO: 2491766 - DNA, 14 bp, Homo sapiens
ccacttctgacagc

SEQ ID NO: 2491767 - DNA, 16 bp, Homo sapiens
ccacttctgacagcct

SEQ ID NO: 2491768 - DNA, 18 bp, Homo sapiens
ccacttctgacagcctca

SEQ ID NO: 2491769 - DNA, 19 bp, Homo sapiens
ccacttctgacagcctcag

SEQ ID NO: 2491770 - DNA, 12 bp, Homo sapiens
ccacttgcctct

SEQ ID NO: 2491771 - DNA, 17 bp, Homo sapiens
ccacttgcctcttcctt

SEQ ID NO: 2491772 - DNA, 15 bp, Homo sapiens
ccacttgtccgctgg

SEQ ID NO: 2491773 - DNA, 13 bp, Homo sapiens
ccactttcagctg

SEQ ID NO: 2491774 - DNA, 14 bp, Homo sapiens
ccactttcagctgt

SEQ ID NO: 2491775 - DNA, 16 bp, Homo sapiens
ccactttcagctgtct

SEQ ID NO: 2491776 - DNA, 13 bp, Homo sapiens
ccactttctttct

SEQ ID NO: 2491777 - DNA, 16 bp, Homo sapiens
ccactttctttctttc

SEQ ID NO: 2491778 - DNA, 21 bp, Homo sapiens
ccagaaagcagttgagacaag

SEQ ID NO: 2491779 - DNA, 20 bp, Homo sapiens
ccagaacttgaccctgagct

SEQ ID NO: 2491780 - DNA, 13 bp, Homo sapiens
ccagaagatgact

SEQ ID NO: 2491781 - DNA, 19 bp, Homo sapiens
ccagaagctcccccagcaa

SEQ ID NO: 2491782 - DNA, 16 bp, Homo sapiens
ccagaagtgtgactgg

SEQ ID NO: 2491783 - DNA, 21 bp, Homo sapiens
ccagaataagttattgcagtt

SEQ ID NO: 2491784 - DNA, 23 bp, Homo sapiens
ccagaataagttattgcagttta

SEQ ID NO: 2491785 - DNA, 17 bp, Homo sapiens
ccagaatgctgtacatc

SEQ ID NO: 2491786 - DNA, 15 bp, Homo sapiens
ccagacacaggccct

SEQ ID NO: 2491787 - DNA, 19 bp, Homo sapiens
ccagacacaggccctccct

SEQ ID NO: 2491788 - DNA, 17 bp, Homo sapiens
ccagacataaaggaaaa

SEQ ID NO: 2491789 - DNA, 23 bp, Homo sapiens
ccagacctgatcctggaggccca

SEQ ID NO: 2491790 - DNA, 20 bp, Homo sapiens
ccagacctgttagcagacag

SEQ ID NO: 2491791 - DNA, 15 bp, Homo sapiens
ccagactcttgcctg

SEQ ID NO: 2491792 - DNA, 19 bp, Homo sapiens
ccagagaaaggggagccca

SEQ ID NO: 2491793 - DNA, 17 bp, Homo sapiens
ccagagacatacttgaa

SEQ ID NO: 2491794 - DNA, 18 bp, Homo sapiens
ccagagacatacttgaag

SEQ ID NO: 2491795 - DNA, 23 bp, Homo sapiens
ccagagacatacttgaagggcca

SEQ ID NO: 2491796 - DNA, 21 bp, Homo sapiens
ccagagacccagcggacacac

SEQ ID NO: 2491797 - DNA, 19 bp, Homo sapiens
ccagagagcccgaggaggt

SEQ ID NO: 2491798 - DNA, 13 bp, Homo sapiens
ccagagatccaaa

SEQ ID NO: 2491799 - DNA, 20 bp, Homo sapiens
ccagagcacctgctgtctgg

SEQ ID NO: 2491800 - DNA, 15 bp, Homo sapiens
ccagagcccactcca

SEQ ID NO: 2491801 - DNA, 11 bp, Homo sapiens
ccagagcccag

SEQ ID NO: 2491802 - DNA, 12 bp, Homo sapiens
ccagagcccagc

SEQ ID NO: 2491803 - DNA, 14 bp, Homo sapiens
ccagagcccagctc

SEQ ID NO: 2491804 - DNA, 15 bp, Homo sapiens
ccagagcccagctcc

SEQ ID NO: 2491805 - DNA, 16 bp, Homo sapiens
ccagagcccagctcca

SEQ ID NO: 2491806 - DNA, 17 bp, Homo sapiens
ccagagcccagctccaa

SEQ ID NO: 2491807 - DNA, 14 bp, Homo sapiens
ccagagcctggggc

SEQ ID NO: 2491808 - DNA, 22 bp, Homo sapiens
ccagaggaaggggccagaggct

SEQ ID NO: 2491809 - DNA, 16 bp, Homo sapiens
ccagaggagccaccag

SEQ ID NO: 2491810 - DNA, 19 bp, Homo sapiens
ccagaggagccaccagttc

SEQ ID NO: 2491811 - DNA, 21 bp, Homo sapiens
ccagaggagccaccagttctc

SEQ ID NO: 2491812 - DNA, 15 bp, Homo sapiens
ccagaggcccccagc

SEQ ID NO: 2491813 - DNA, 19 bp, Homo sapiens
ccagaggcccccagcccag

SEQ ID NO: 2491814 - DNA, 11 bp, Homo sapiens
ccagaggctcg

SEQ ID NO: 2491815 - DNA, 13 bp, Homo sapiens
ccagaggggcctg

SEQ ID NO: 2491816 - DNA, 23 bp, Homo sapiens
ccagaggggcctgccacctggac

SEQ ID NO: 2491817 - DNA, 17 bp, Homo sapiens
ccagagggtctgggggc

SEQ ID NO: 2491818 - DNA, 16 bp, Homo sapiens
ccagatccagcctggg

SEQ ID NO: 2491819 - DNA, 23 bp, Homo sapiens
ccagatctgatttgtaacccact

SEQ ID NO: 2491820 - DNA, 13 bp, Homo sapiens
ccagattgacgac

SEQ ID NO: 2491821 - DNA, 18 bp, Homo sapiens
ccagattgacgacaagtg

SEQ ID NO: 2491822 - DNA, 13 bp, Homo sapiens
agattgacctgga

SEQ ID NO: 2491823 - DNA, 15 bp, Homo sapiens
agattgagagaattt

SEQ ID NO: 2491824 - DNA, 16 bp, Homo sapiens
agattgcagaaaattc

SEQ ID NO: 2491825 - DNA, 23 bp, Homo sapiens
agattgcagaaaattctgtgcct

SEQ ID NO: 2491826 - DNA, 14 bp, Homo sapiens
agattggtgttttt

SEQ ID NO: 2491827 - DNA, 20 bp, Homo sapiens
agattggtgtttttttctat

SEQ ID NO: 2491828 - DNA, 20 bp, Homo sapiens
agattgtccttttgcaaaga

SEQ ID NO: 2491829 - DNA, 15 bp, Homo sapiens
agatttattaaagaa

SEQ ID NO: 2491830 - DNA, 17 bp, Homo sapiens
agatttattaaagaaaa

SEQ ID NO: 2491831 - DNA, 12 bp, Homo sapiens
agatttcatagt

SEQ ID NO: 2491832 - DNA, 20 bp, Homo sapiens
agatttcatagttcagaatt

SEQ ID NO: 2491833 - DNA, 21 bp, Homo sapiens
agatttccttctttttttctt

SEQ ID NO: 2491834 - DNA, 17 bp, Homo sapiens
agatttggcttgacaaa

SEQ ID NO: 2491835 - DNA, 15 bp, Homo sapiens
agatttgtttttaaa

SEQ ID NO: 2491836 - DNA, 17 bp, Homo sapiens
agatttgtttttaaact

SEQ ID NO: 2491837 - DNA, 19 bp, Homo sapiens
agatttgtttttaaactgt

SEQ ID NO: 2491838 - DNA, 15 bp, Homo sapiens
agattttaatcaaat

SEQ ID NO: 2491839 - DNA, 16 bp, Homo sapiens
agattttaatcaaatt

SEQ ID NO: 2491840 - DNA, 13 bp, Homo sapiens
agattttacatga

SEQ ID NO: 2491841 - DNA, 20 bp, Homo sapiens
agattttacatgaagtattt

SEQ ID NO: 2491842 - DNA, 16 bp, Homo sapiens
agattttctggttcta

SEQ ID NO: 2491843 - DNA, 13 bp, Homo sapiens
agcaaacctgtaa

SEQ ID NO: 2491844 - DNA, 12 bp, Homo sapiens
agcaaagcacag

SEQ ID NO: 2491845 - DNA, 22 bp, Homo sapiens
agcaaagcccccagagcccagg

SEQ ID NO: 2491846 - DNA, 18 bp, Homo sapiens
agcaaatcaccacaaact

SEQ ID NO: 2491847 - DNA, 22 bp, Homo sapiens
agcaaatcaccacaaactgtaa

SEQ ID NO: 2491848 - DNA, 15 bp, Homo sapiens
agcaaatggcctcat

SEQ ID NO: 2491849 - DNA, 13 bp, Homo sapiens
agcaacatggctt

SEQ ID NO: 2491850 - DNA, 14 bp, Homo sapiens
agcaaccccaggct

SEQ ID NO: 2491851 - DNA, 15 bp, Homo sapiens
agcaaccccaggctg

SEQ ID NO: 2491852 - DNA, 15 bp, Homo sapiens
agcaacctcagtaat

SEQ ID NO: 2491853 - DNA, 19 bp, Homo sapiens
agcaacgctattccagctg

SEQ ID NO: 2491854 - DNA, 20 bp, Homo sapiens
agcaacgctattccagctgt

SEQ ID NO: 2491855 - DNA, 14 bp, Homo sapiens
agcaacttgtccta

SEQ ID NO: 2491856 - DNA, 15 bp, Homo sapiens
agcaagcattcagaa

SEQ ID NO: 2491857 - DNA, 21 bp, Homo sapiens
agcaagcattcagaagaaaaa

SEQ ID NO: 2491858 - DNA, 22 bp, Homo sapiens
agcaagcattcagaagaaaaag

SEQ ID NO: 2491859 - DNA, 18 bp, Homo sapiens
agcaaggcccgagcagct

SEQ ID NO: 2491860 - DNA, 22 bp, Homo sapiens
agcaaggcccgagcagctgagc

SEQ ID NO: 2491861 - DNA, 13 bp, Homo sapiens
agcaatttctaat

SEQ ID NO: 2491862 - DNA, 16 bp, Homo sapiens
agcacagatggccagc

SEQ ID NO: 2491863 - DNA, 20 bp, Homo sapiens
agcacagatggccagcccct

SEQ ID NO: 2491864 - DNA, 15 bp, Homo sapiens
agcacagcagcctgg

SEQ ID NO: 2491865 - DNA, 13 bp, Homo sapiens
agcacagccaaca

SEQ ID NO: 2491866 - DNA, 16 bp, Homo sapiens
agcacagcttagattt

SEQ ID NO: 2491867 - DNA, 16 bp, Homo sapiens
agcacaggctaatttt

SEQ ID NO: 2491868 - DNA, 15 bp, Homo sapiens
agcacatctcaacag

SEQ ID NO: 2491869 - DNA, 23 bp, Homo sapiens
agcacatctgcattttcacccca

SEQ ID NO: 2491870 - DNA, 16 bp, Homo sapiens
agcacctccaaccaaa

SEQ ID NO: 2491871 - DNA, 14 bp, Homo sapiens
agcacctcctcagc

SEQ ID NO: 2491872 - DNA, 18 bp, Homo sapiens
agcacgaaatgttatttt

SEQ ID NO: 2491873 - DNA, 17 bp, Homo sapiens
agcacgacagtggatgc

SEQ ID NO: 2491874 - DNA, 15 bp, Homo sapiens
agcacggctctgtcc

SEQ ID NO: 2491875 - DNA, 20 bp, Homo sapiens
agcacggctctgtccccagc

SEQ ID NO: 2491876 - DNA, 20 bp, Homo sapiens
agcactagccaaacctcacc

SEQ ID NO: 2491877 - DNA, 19 bp, Homo sapiens
agcactcgctagcagtggc

SEQ ID NO: 2491878 - DNA, 23 bp, Homo sapiens
agcactcgctagcagtggcaggc

SEQ ID NO: 2491879 - DNA, 12 bp, Homo sapiens
agcactgcacct

SEQ ID NO: 2491880 - DNA, 21 bp, Homo sapiens
agcactgcacctgcctccagc

SEQ ID NO: 2491881 - DNA, 22 bp, Homo sapiens
agcactgcacctgcctccagcc

SEQ ID NO: 2491882 - DNA, 14 bp, Homo sapiens
agcactgccaccag

SEQ ID NO: 2491883 - DNA, 12 bp, Homo sapiens
agcactgccagg

SEQ ID NO: 2491884 - DNA, 13 bp, Homo sapiens
agcactgccagga

SEQ ID NO: 2491885 - DNA, 20 bp, Homo sapiens
agaggtttgcagtcccaagc

SEQ ID NO: 2491886 - DNA, 18 bp, Homo sapiens
agagtagaattgcattga

SEQ ID NO: 2491887 - DNA, 21 bp, Homo sapiens
agagtccaaggtttaaagagt

SEQ ID NO: 2491888 - DNA, 12 bp, Homo sapiens
agagtctaaaga

SEQ ID NO: 2491889 - DNA, 22 bp, Homo sapiens
agagtctaaagatggagtttct

SEQ ID NO: 2491890 - DNA, 15 bp, Homo sapiens
agagtctagattcaa

SEQ ID NO: 2491891 - DNA, 17 bp, Homo sapiens
agagtctagattcaaag

SEQ ID NO: 2491892 - DNA, 22 bp, Homo sapiens
agagtctagattcaaaggttct

SEQ ID NO: 2491893 - DNA, 14 bp, Homo sapiens
agagtctagattct

SEQ ID NO: 2491894 - DNA, 12 bp, Homo sapiens
agagtctgaaca

SEQ ID NO: 2491895 - DNA, 23 bp, Homo sapiens
agagtctggataacttccacagg

SEQ ID NO: 2491896 - DNA, 16 bp, Homo sapiens
agagtgaattccctca

SEQ ID NO: 2491897 - DNA, 17 bp, Homo sapiens
agagtgaattccctcac

SEQ ID NO: 2491898 - DNA, 20 bp, Homo sapiens
agagtgatagtcttttgctt

SEQ ID NO: 2491899 - DNA, 18 bp, Homo sapiens
agagtgcattgtgagggt

SEQ ID NO: 2491900 - DNA, 15 bp, Homo sapiens
agagtgtctttccac

SEQ ID NO: 2491901 - DNA, 11 bp, Homo sapiens
agagttacagt

SEQ ID NO: 2491902 - DNA, 22 bp, Homo sapiens
agagttacagttctgtggtttc

SEQ ID NO: 2491903 - DNA, 21 bp, Homo sapiens
agagttcaagaaataagtttt

SEQ ID NO: 2491904 - DNA, 20 bp, Homo sapiens
agagttctttttgaagtatt

SEQ ID NO: 2491905 - DNA, 21 bp, Homo sapiens
agagttctttttgaagtattt

SEQ ID NO: 2491906 - DNA, 21 bp, Homo sapiens
agagttgctgagagggctcga

SEQ ID NO: 2491907 - DNA, 15 bp, Homo sapiens
agagttggccatatt

SEQ ID NO: 2491908 - DNA, 14 bp, Homo sapiens
agataaacacaaga

SEQ ID NO: 2491909 - DNA, 13 bp, Homo sapiens
agataatgtgaaa

SEQ ID NO: 2491910 - DNA, 14 bp, Homo sapiens
agataccagcgagg

SEQ ID NO: 2491911 - DNA, 23 bp, Homo sapiens
agataccctacgctgtccagaaa

SEQ ID NO: 2491912 - DNA, 15 bp, Homo sapiens
agatagccctgtcct

SEQ ID NO: 2491913 - DNA, 18 bp, Homo sapiens
agatagccctgtcctggt

SEQ ID NO: 2491914 - DNA, 13 bp, Homo sapiens
agatagttttcat

SEQ ID NO: 2491915 - DNA, 14 bp, Homo sapiens
agatagttttcatc

SEQ ID NO: 2491916 - DNA, 19 bp, Homo sapiens
agatatcttggacaaatca

SEQ ID NO: 2491917 - DNA, 15 bp, Homo sapiens
agatatgaaagctga

SEQ ID NO: 2491918 - DNA, 17 bp, Homo sapiens
agatattggacaaagaa

SEQ ID NO: 2491919 - DNA, 12 bp, Homo sapiens
agatcaaagatg

SEQ ID NO: 2491920 - DNA, 13 bp, Homo sapiens
agatcaaagatga

SEQ ID NO: 2491921 - DNA, 16 bp, Homo sapiens
agatcataaggcttca

SEQ ID NO: 2491922 - DNA, 23 bp, Homo sapiens
agatccaaaagaagcccccagct

SEQ ID NO: 2491923 - DNA, 12 bp, Homo sapiens
agatccaggact

SEQ ID NO: 2491924 - DNA, 16 bp, Homo sapiens
agatccaggagctcca

SEQ ID NO: 2491925 - DNA, 21 bp, Homo sapiens
agatcctaagggtcgaaagct

SEQ ID NO: 2491926 - DNA, 19 bp, Homo sapiens
agatctaaataaaatgcta

SEQ ID NO: 2491927 - DNA, 17 bp, Homo sapiens
agatctggaacctcagc

SEQ ID NO: 2491928 - DNA, 13 bp, Homo sapiens
agatctggcatgt

SEQ ID NO: 2491929 - DNA, 17 bp, Homo sapiens
agatctgtcctcagcct

SEQ ID NO: 2491930 - DNA, 18 bp, Homo sapiens
agatctgtcctcagcctt

SEQ ID NO: 2491931 - DNA, 14 bp, Homo sapiens
agatctgttttgaa

SEQ ID NO: 2491932 - DNA, 18 bp, Homo sapiens
agatctgttttgaaggca

SEQ ID NO: 2491933 - DNA, 15 bp, Homo sapiens
agatcttagattctc

SEQ ID NO: 2491934 - DNA, 16 bp, Homo sapiens
agatgaaggagaggca

SEQ ID NO: 2491935 - DNA, 16 bp, Homo sapiens
agatgaatgccgtgga

SEQ ID NO: 2491936 - DNA, 23 bp, Homo sapiens
agatgacctcgtactcaggagcc

SEQ ID NO: 2491937 - DNA, 19 bp, Homo sapiens
agatgattaaataagattc

SEQ ID NO: 2491938 - DNA, 22 bp, Homo sapiens
agatgattaaataagattctaa

SEQ ID NO: 2491939 - DNA, 20 bp, Homo sapiens
agatgatttcagttctagga

SEQ ID NO: 2491940 - DNA, 23 bp, Homo sapiens
agatgatttcagttctaggaaaa

SEQ ID NO: 2491941 - DNA, 21 bp, Homo sapiens
agatgcaccaccaagccaagg

SEQ ID NO: 2491942 - DNA, 23 bp, Homo sapiens
agatgcaccaccaagccaaggga

SEQ ID NO: 2491943 - DNA, 19 bp, Homo sapiens
agatgcactttgctttaat

SEQ ID NO: 2491944 - DNA, 22 bp, Homo sapiens
agatgcactttgctttaatata

SEQ ID NO: 2491945 - DNA, 13 bp, Homo sapiens
agatgcagggcag

SEQ ID NO: 2491946 - DNA, 20 bp, Homo sapiens
agatgcatttgggtccagga

SEQ ID NO: 2491947 - DNA, 21 bp, Homo sapiens
agatgcatttgggtccaggag

SEQ ID NO: 2491948 - DNA, 16 bp, Homo sapiens
agatgcctccttcctc

SEQ ID NO: 2491949 - DNA, 21 bp, Homo sapiens
agatgctccaagattctagat

SEQ ID NO: 2491950 - DNA, 15 bp, Homo sapiens
agatgctggcccagg

SEQ ID NO: 2491951 - DNA, 17 bp, Homo sapiens
agatgctggcccagggc

SEQ ID NO: 2491952 - DNA, 18 bp, Homo sapiens
agatgctggcttgggcag

SEQ ID NO: 2491953 - DNA, 19 bp, Homo sapiens
agatgctggcttgggcagc

SEQ ID NO: 2491954 - DNA, 20 bp, Homo sapiens
agatgcttttaacagagtct

SEQ ID NO: 2491955 - DNA, 15 bp, Homo sapiens
agatggagtttctaa

SEQ ID NO: 2491956 - DNA, 18 bp, Homo sapiens
agatggagtttctaaggt

SEQ ID NO: 2491957 - DNA, 13 bp, Homo sapiens
agatggcagcttt

SEQ ID NO: 2491958 - DNA, 13 bp, Homo sapiens
agatggctcccag

SEQ ID NO: 2491959 - DNA, 23 bp, Homo sapiens
agatggctcccaggggctccctc

SEQ ID NO: 2491960 - DNA, 18 bp, Homo sapiens
agatgggcatcttttgta

SEQ ID NO: 2491961 - DNA, 21 bp, Homo sapiens
agatgggcatcttttgtatta

SEQ ID NO: 2491962 - DNA, 16 bp, Homo sapiens
agatgtaggagggact

SEQ ID NO: 2491963 - DNA, 18 bp, Homo sapiens
agatgtcttggaacattg

SEQ ID NO: 2491964 - DNA, 15 bp, Homo sapiens
agatgtgatattcta

SEQ ID NO: 2491965 - DNA, 17 bp, Homo sapiens
agatgtgatattctaag

SEQ ID NO: 2491966 - DNA, 24 bp, Homo sapiens
agatgtgtgttgatactgttgcac

SEQ ID NO: 2491967 - DNA, 21 bp, Homo sapiens
agatgttctaagtctttccat

SEQ ID NO: 2491968 - DNA, 22 bp, Homo sapiens
agatgttctaagtctttccatt

SEQ ID NO: 2491969 - DNA, 19 bp, Homo sapiens
agatgtttgatagattttc

SEQ ID NO: 2491970 - DNA, 15 bp, Homo sapiens
agattaagaaataga

SEQ ID NO: 2491971 - DNA, 15 bp, Homo sapiens
agattatagattcta

SEQ ID NO: 2491972 - DNA, 17 bp, Homo sapiens
agattatagattctaaa

SEQ ID NO: 2491973 - DNA, 14 bp, Homo sapiens
agattcaaaggttc

SEQ ID NO: 2491974 - DNA, 18 bp, Homo sapiens
agattcaaaggttctagg

SEQ ID NO: 2491975 - DNA, 20 bp, Homo sapiens
agattcaggtaatacaaact

SEQ ID NO: 2491976 - DNA, 23 bp, Homo sapiens
agattccattggtccaagattcc

SEQ ID NO: 2491977 - DNA, 17 bp, Homo sapiens
agattccttcccatgga

SEQ ID NO: 2491978 - DNA, 14 bp, Homo sapiens
agattctaaagatt

SEQ ID NO: 2491979 - DNA, 21 bp, Homo sapiens
agattctaaagattctatagt

SEQ ID NO: 2491980 - DNA, 12 bp, Homo sapiens
agattctaacgg

SEQ ID NO: 2491981 - DNA, 12 bp, Homo sapiens
agattctagatc

SEQ ID NO: 2491982 - DNA, 14 bp, Homo sapiens
agattctagatcag

SEQ ID NO: 2491983 - DNA, 14 bp, Homo sapiens
agattctagatgat

SEQ ID NO: 2491984 - DNA, 18 bp, Homo sapiens
agattctatagttctaga

SEQ ID NO: 2491985 - DNA, 17 bp, Homo sapiens
agattctctgtgtctaa

SEQ ID NO: 2491986 - DNA, 19 bp, Homo sapiens
agattctctgtgtctaaga

SEQ ID NO: 2491987 - DNA, 22 bp, Homo sapiens
agattctctgtgtctaagattc

SEQ ID NO: 2491988 - DNA, 19 bp, Homo sapiens
agattctgcctttgccagg

SEQ ID NO: 2491989 - DNA, 18 bp, Homo sapiens
taaatgtagagtttttaa

SEQ ID NO: 2491990 - DNA, 22 bp, Homo sapiens
taaatgtcactttttgaggcaa

SEQ ID NO: 2491991 - DNA, 19 bp, Homo sapiens
taaatgtgattcacctctt

SEQ ID NO: 2491992 - DNA, 22 bp, Homo sapiens
taaatgtgcaatagaaggtgat

SEQ ID NO: 2491993 - DNA, 18 bp, Homo sapiens
taaattcacaaactttta

SEQ ID NO: 2491994 - DNA, 22 bp, Homo sapiens
taaattctctctcttgcaggaa

SEQ ID NO: 2491995 - DNA, 21 bp, Homo sapiens
taaattggcatggaaatttaa

SEQ ID NO: 2491996 - DNA, 17 bp, Homo sapiens
taaatttgacttttctg

SEQ ID NO: 2491997 - DNA, 13 bp, Homo sapiens
taaatttgtacta

SEQ ID NO: 2491998 - DNA, 14 bp, Homo sapiens
taaatttgtactat

SEQ ID NO: 2491999 - DNA, 21 bp, Homo sapiens
taaatttgtactatttaactg

SEQ ID NO: 2492000 - DNA, 16 bp, Homo sapiens
taaattttcctgtcct

SEQ ID NO: 2492001 - DNA, 15 bp, Homo sapiens
taacaaaatgtatgt

SEQ ID NO: 2492002 - DNA, 19 bp, Homo sapiens
taacaaaatgtatgtctgg

SEQ ID NO: 2492003 - DNA, 20 bp, Homo sapiens
taacaaaatgtatgtctggt

SEQ ID NO: 2492004 - DNA, 19 bp, Homo sapiens
taacaagaactttaaattg

SEQ ID NO: 2492005 - DNA, 16 bp, Homo sapiens
taacaatacaaatgga

SEQ ID NO: 2492006 - DNA, 18 bp, Homo sapiens
taacaatacaaatggatt

SEQ ID NO: 2492007 - DNA, 19 bp, Homo sapiens
taacaatacaaatggattt

SEQ ID NO: 2492008 - DNA, 13 bp, Homo sapiens
taacaattcctct

SEQ ID NO: 2492009 - DNA, 19 bp, Homo sapiens
taacactcagaagcctggg

SEQ ID NO: 2492010 - DNA, 16 bp, Homo sapiens
taacagaaactttcaa

SEQ ID NO: 2492011 - DNA, 13 bp, Homo sapiens
taacagaaattgt

SEQ ID NO: 2492012 - DNA, 17 bp, Homo sapiens
taacagaaattgtatat

SEQ ID NO: 2492013 - DNA, 16 bp, Homo sapiens
taacagggaaggcagg

SEQ ID NO: 2492014 - DNA, 23 bp, Homo sapiens
taacagttgtatttaacagaaat

SEQ ID NO: 2492015 - DNA, 15 bp, Homo sapiens
taacataagctattt

SEQ ID NO: 2492016 - DNA, 14 bp, Homo sapiens
taacatataatgtt

SEQ ID NO: 2492017 - DNA, 22 bp, Homo sapiens
taacattcctcatgaatgtaaa

SEQ ID NO: 2492018 - DNA, 16 bp, Homo sapiens
taacatttgctgtttt

SEQ ID NO: 2492019 - DNA, 21 bp, Homo sapiens
taaccaagagataactgtaaa

SEQ ID NO: 2492020 - DNA, 13 bp, Homo sapiens
taaccactgcttc

SEQ ID NO: 2492021 - DNA, 17 bp, Homo sapiens
taacccccctgtacaca

SEQ ID NO: 2492022 - DNA, 17 bp, Homo sapiens
taacctcttcagaggcc

SEQ ID NO: 2492023 - DNA, 12 bp, Homo sapiens
taacgcctgagc

SEQ ID NO: 2492024 - DNA, 13 bp, Homo sapiens
taacgcctgagcc

SEQ ID NO: 2492025 - DNA, 18 bp, Homo sapiens
taacgcctgagcccaggg

SEQ ID NO: 2492026 - DNA, 17 bp, Homo sapiens
taacgcgtcttcctgag

SEQ ID NO: 2492027 - DNA, 22 bp, Homo sapiens
taacggtctgttctgtttcaag

SEQ ID NO: 2492028 - DNA, 17 bp, Homo sapiens
taacgtttaagccaaaa

SEQ ID NO: 2492029 - DNA, 12 bp, Homo sapiens
taactaaaataa

SEQ ID NO: 2492030 - DNA, 18 bp, Homo sapiens
taactaaaataattttgt

SEQ ID NO: 2492031 - DNA, 21 bp, Homo sapiens
taactaaaataattttgtaat

SEQ ID NO: 2492032 - DNA, 16 bp, Homo sapiens
taactaacatgtcctg

SEQ ID NO: 2492033 - DNA, 22 bp, Homo sapiens
taactacaaaggtttaaatgaa

SEQ ID NO: 2492034 - DNA, 14 bp, Homo sapiens
taactactttataa

SEQ ID NO: 2492035 - DNA, 16 bp, Homo sapiens
taactactttataact

SEQ ID NO: 2492036 - DNA, 17 bp, Homo sapiens
taactactttataacta

SEQ ID NO: 2492037 - DNA, 23 bp, Homo sapiens
taactactttataactaacatgt

SEQ ID NO: 2492038 - DNA, 18 bp, Homo sapiens
taactagacaccaaagtt

SEQ ID NO: 2492039 - DNA, 20 bp, Homo sapiens
taactagacaccaaagttct

SEQ ID NO: 2492040 - DNA, 22 bp, Homo sapiens
taactagacaccaaagttctaa

SEQ ID NO: 2492041 - DNA, 12 bp, Homo sapiens
taactaggagct

SEQ ID NO: 2492042 - DNA, 22 bp, Homo sapiens
taactcttctttcatttcttct

SEQ ID NO: 2492043 - DNA, 21 bp, Homo sapiens
taactgaataccactctgtaa

SEQ ID NO: 2492044 - DNA, 17 bp, Homo sapiens
taactgacaagccatct

SEQ ID NO: 2492045 - DNA, 20 bp, Homo sapiens
taactgacaagccatcttga

SEQ ID NO: 2492046 - DNA, 22 bp, Homo sapiens
taactgactattcttgatgtaa

SEQ ID NO: 2492047 - DNA, 17 bp, Homo sapiens
taactgcccaaagcagc

SEQ ID NO: 2492048 - DNA, 17 bp, Homo sapiens
taactgccgtaatttaa

SEQ ID NO: 2492049 - DNA, 14 bp, Homo sapiens
taactgcctagaaa

SEQ ID NO: 2492050 - DNA, 17 bp, Homo sapiens
taactgctttctgttcc

SEQ ID NO: 2492051 - DNA, 15 bp, Homo sapiens
taactggaaaacaga

SEQ ID NO: 2492052 - DNA, 13 bp, Homo sapiens
taacttcttgctt

SEQ ID NO: 2492053 - DNA, 12 bp, Homo sapiens
taacttggctca

SEQ ID NO: 2492054 - DNA, 16 bp, Homo sapiens
taactttaatgttttt

SEQ ID NO: 2492055 - DNA, 22 bp, Homo sapiens
taacttttgtgaattaggctgt

SEQ ID NO: 2492056 - DNA, 19 bp, Homo sapiens
taacttttttttttcttta

SEQ ID NO: 2492057 - DNA, 21 bp, Homo sapiens
taagaaacaactctttgagaa

SEQ ID NO: 2492058 - DNA, 19 bp, Homo sapiens
taagaaacttttttattta

SEQ ID NO: 2492059 - DNA, 15 bp, Homo sapiens
taagaaagcctgagt

SEQ ID NO: 2492060 - DNA, 15 bp, Homo sapiens
taagaaaggaagcat

SEQ ID NO: 2492061 - DNA, 22 bp, Homo sapiens
taagaaaggaagcattgtaaaa

SEQ ID NO: 2492062 - DNA, 15 bp, Homo sapiens
taagaaatacagact

SEQ ID NO: 2492063 - DNA, 21 bp, Homo sapiens
taagaaattgaatactttgaa

SEQ ID NO: 2492064 - DNA, 22 bp, Homo sapiens
taagaaattgaatactttgaat

SEQ ID NO: 2492065 - DNA, 23 bp, Homo sapiens
taagaaattgaatactttgaatg

SEQ ID NO: 2492066 - DNA, 14 bp, Homo sapiens
taagaaatttcaca

SEQ ID NO: 2492067 - DNA, 14 bp, Homo sapiens
taagaacctggaac

SEQ ID NO: 2492068 - DNA, 18 bp, Homo sapiens
taagaaggcaaaaatgta

SEQ ID NO: 2492069 - DNA, 17 bp, Homo sapiens
taagaatctagcaagaa

SEQ ID NO: 2492070 - DNA, 16 bp, Homo sapiens
taagaattgagtaatg

SEQ ID NO: 2492071 - DNA, 19 bp, Homo sapiens
taagaattgagtaatggtg

SEQ ID NO: 2492072 - DNA, 16 bp, Homo sapiens
taagacctactgttct

SEQ ID NO: 2492073 - DNA, 17 bp, Homo sapiens
taagacctactgttcta

SEQ ID NO: 2492074 - DNA, 18 bp, Homo sapiens
taagacctactgttctaa

SEQ ID NO: 2492075 - DNA, 21 bp, Homo sapiens
taagacctactgttctaaagc

SEQ ID NO: 2492076 - DNA, 18 bp, Homo sapiens
taagacctggcagctctg

SEQ ID NO: 2492077 - DNA, 16 bp, Homo sapiens
agcaggaggcctagga

SEQ ID NO: 2492078 - DNA, 12 bp, Homo sapiens
agcaggcagcca

SEQ ID NO: 2492079 - DNA, 19 bp, Homo sapiens
agcaggcagccagcatctg

SEQ ID NO: 2492080 - DNA, 13 bp, Homo sapiens
agcaggccacact

SEQ ID NO: 2492081 - DNA, 21 bp, Homo sapiens
agcaggccttttgatattaaa

SEQ ID NO: 2492082 - DNA, 13 bp, Homo sapiens
agcaggtgctgac

SEQ ID NO: 2492083 - DNA, 18 bp, Homo sapiens
agcaggttcccaagctca

SEQ ID NO: 2492084 - DNA, 14 bp, Homo sapiens
agcaggtttcaagg

SEQ ID NO: 2492085 - DNA, 22 bp, Homo sapiens
agcagtccccttccctccaaga

SEQ ID NO: 2492086 - DNA, 16 bp, Homo sapiens
agcagtccttggcctg

SEQ ID NO: 2492087 - DNA, 18 bp, Homo sapiens
agcagtccttggcctgct

SEQ ID NO: 2492088 - DNA, 19 bp, Homo sapiens
agcagtcgtgcctgtgtcc

SEQ ID NO: 2492089 - DNA, 20 bp, Homo sapiens
agcagtgaatgattcagtgt

SEQ ID NO: 2492090 - DNA, 19 bp, Homo sapiens
agcagtgattgtcttaata

SEQ ID NO: 2492091 - DNA, 12 bp, Homo sapiens
agcagtgctttt

SEQ ID NO: 2492092 - DNA, 19 bp, Homo sapiens
agcagtggccttattgcat

SEQ ID NO: 2492093 - DNA, 16 bp, Homo sapiens
agcagtggctggtcca

SEQ ID NO: 2492094 - DNA, 19 bp, Homo sapiens
agcagtggctggtccaggg

SEQ ID NO: 2492095 - DNA, 21 bp, Homo sapiens
agcagtggctggtccagggct

SEQ ID NO: 2492096 - DNA, 15 bp, Homo sapiens
agcagtgtgaggcca

SEQ ID NO: 2492097 - DNA, 19 bp, Homo sapiens
agcagttgagacaagaaaa

SEQ ID NO: 2492098 - DNA, 20 bp, Homo sapiens
agcagttgagacaagaaaat

SEQ ID NO: 2492099 - DNA, 23 bp, Homo sapiens
agcataaaagatgaaagagcagt

SEQ ID NO: 2492100 - DNA, 24 bp, Homo sapiens
agcataaggccggacgcatctcaa

SEQ ID NO: 2492101 - DNA, 17 bp, Homo sapiens
agcataagtttctggga

SEQ ID NO: 2492102 - DNA, 14 bp, Homo sapiens
agcatcacagaatg

SEQ ID NO: 2492103 - DNA, 18 bp, Homo sapiens
agcatcatgcctctgagg

SEQ ID NO: 2492104 - DNA, 19 bp, Homo sapiens
agcatcatgcctctgaggc

SEQ ID NO: 2492105 - DNA, 18 bp, Homo sapiens
agcatcattatttatgta

SEQ ID NO: 2492106 - DNA, 22 bp, Homo sapiens
agcatcattatttatgtattgt

SEQ ID NO: 2492107 - DNA, 18 bp, Homo sapiens
agcatccccttgaactct

SEQ ID NO: 2492108 - DNA, 20 bp, Homo sapiens
agcatccccttgaactcttc

SEQ ID NO: 2492109 - DNA, 23 bp, Homo sapiens
agcatcggacaagacccccagca

SEQ ID NO: 2492110 - DNA, 17 bp, Homo sapiens
agcatctccaagcagct

SEQ ID NO: 2492111 - DNA, 18 bp, Homo sapiens
agcatctctaccttctcc

SEQ ID NO: 2492112 - DNA, 16 bp, Homo sapiens
agcatctggctctaat

SEQ ID NO: 2492113 - DNA, 15 bp, Homo sapiens
agcatctgtccccct

SEQ ID NO: 2492114 - DNA, 15 bp, Homo sapiens
agcatcttgcattat

SEQ ID NO: 2492115 - DNA, 23 bp, Homo sapiens
agcatcttgggggggtggccgct

SEQ ID NO: 2492116 - DNA, 16 bp, Homo sapiens
agcatgaatttgtaat

SEQ ID NO: 2492117 - DNA, 21 bp, Homo sapiens
agcatgtactgagccttgtaa

SEQ ID NO: 2492118 - DNA, 16 bp, Homo sapiens
agcatgtcactaaagc

SEQ ID NO: 2492119 - DNA, 12 bp, Homo sapiens
agcatgttactg

SEQ ID NO: 2492120 - DNA, 17 bp, Homo sapiens
agcattcagaagaaaaa

SEQ ID NO: 2492121 - DNA, 19 bp, Homo sapiens
agcattcagaagaaaaaga

SEQ ID NO: 2492122 - DNA, 19 bp, Homo sapiens
agcattccagcccctctgg

SEQ ID NO: 2492123 - DNA, 20 bp, Homo sapiens
agcattccagcccctctggt

SEQ ID NO: 2492124 - DNA, 13 bp, Homo sapiens
agcattcccaggt

SEQ ID NO: 2492125 - DNA, 22 bp, Homo sapiens
agcattctcattggaaatttag

SEQ ID NO: 2492126 - DNA, 16 bp, Homo sapiens
agcattgtaaaataat

SEQ ID NO: 2492127 - DNA, 22 bp, Homo sapiens
agcattgtaaaattatttcatg

SEQ ID NO: 2492128 - DNA, 20 bp, Homo sapiens
agcattgtagtgctttgaga

SEQ ID NO: 2492129 - DNA, 23 bp, Homo sapiens
agcatttaacccccctgtacaca

SEQ ID NO: 2492130 - DNA, 18 bp, Homo sapiens
agcatttctcatcagtag

SEQ ID NO: 2492131 - DNA, 13 bp, Homo sapiens
agccaaatttaaa

SEQ ID NO: 2492132 - DNA, 19 bp, Homo sapiens
agccaaatttaaaactgtt

SEQ ID NO: 2492133 - DNA, 17 bp, Homo sapiens
agccaactagcccctgg

SEQ ID NO: 2492134 - DNA, 17 bp, Homo sapiens
agccaactatgattatt

SEQ ID NO: 2492135 - DNA, 15 bp, Homo sapiens
agccaacttttgcat

SEQ ID NO: 2492136 - DNA, 17 bp, Homo sapiens
agccaagggaacctgtg

SEQ ID NO: 2492137 - DNA, 16 bp, Homo sapiens
agccctgtcctggtgg

SEQ ID NO: 2492138 - DNA, 21 bp, Homo sapiens
agccctgtcctggtggtattt

SEQ ID NO: 2492139 - DNA, 22 bp, Homo sapiens
agcccttgggggtcctcctcca

SEQ ID NO: 2492140 - DNA, 14 bp, Homo sapiens
agccgagcaggagg

SEQ ID NO: 2492141 - DNA, 18 bp, Homo sapiens
agccgaggtccctgctgc

SEQ ID NO: 2492142 - DNA, 23 bp, Homo sapiens
agccgaggtccctgctgccagct

SEQ ID NO: 2492143 - DNA, 14 bp, Homo sapiens
agccggcacagggt

SEQ ID NO: 2492144 - DNA, 19 bp, Homo sapiens
agccggggtggggtggctg

SEQ ID NO: 2492145 - DNA, 20 bp, Homo sapiens
agccggggtggggtggctgc

SEQ ID NO: 2492146 - DNA, 16 bp, Homo sapiens
agccgggtctgcctct

SEQ ID NO: 2492147 - DNA, 21 bp, Homo sapiens
agccgggtctgcctcttctgg

SEQ ID NO: 2492148 - DNA, 13 bp, Homo sapiens
agccgtcctggcg

SEQ ID NO: 2492149 - DNA, 23 bp, Homo sapiens
agccgtcctggcgcctggcagtc

SEQ ID NO: 2492150 - DNA, 16 bp, Homo sapiens
agccgtggtcctttgg

SEQ ID NO: 2492151 - DNA, 23 bp, Homo sapiens
agcctagtgaaggcttctctctg

SEQ ID NO: 2492152 - DNA, 20 bp, Homo sapiens
agcctcaaaacaaaggccta

SEQ ID NO: 2492153 - DNA, 18 bp, Homo sapiens
agcctcagattccttccc

SEQ ID NO: 2492154 - DNA, 23 bp, Homo sapiens
agcctcagattccttcccatgga

SEQ ID NO: 2492155 - DNA, 18 bp, Homo sapiens
agcctcaggactgggagc

SEQ ID NO: 2492156 - DNA, 23 bp, Homo sapiens
agcctcaggggtctgagctccag

SEQ ID NO: 2492157 - DNA, 22 bp, Homo sapiens
agcctccaccccacaacccaaa

SEQ ID NO: 2492158 - DNA, 13 bp, Homo sapiens
agcctcccaaagt

SEQ ID NO: 2492159 - DNA, 15 bp, Homo sapiens
agcctcccctgccag

SEQ ID NO: 2492160 - DNA, 16 bp, Homo sapiens
agcctcccctgccagg

SEQ ID NO: 2492161 - DNA, 17 bp, Homo sapiens
agcctcccctgccaggg

SEQ ID NO: 2492162 - DNA, 20 bp, Homo sapiens
agcctcccctgccagggcag

SEQ ID NO: 2492163 - DNA, 13 bp, Homo sapiens
agcctccctgaag

SEQ ID NO: 2492164 - DNA, 23 bp, Homo sapiens
agcctccggagtagctgggacca

SEQ ID NO: 2492165 - DNA, 19 bp, Homo sapiens
agcctcgcaacccgtgcca

SEQ ID NO: 2492166 - DNA, 23 bp, Homo sapiens
agcctcgcaacccgtgccaagtc

SEQ ID NO: 2492167 - DNA, 15 bp, Homo sapiens
agcctcgcccctggc

SEQ ID NO: 2492168 - DNA, 19 bp, Homo sapiens
agcctctagagcagactac

SEQ ID NO: 2492169 - DNA, 18 bp, Homo sapiens
agcctctccccaggtcca

SEQ ID NO: 2492170 - DNA, 22 bp, Homo sapiens
agcctctccccaggtccagctc

SEQ ID NO: 2492171 - DNA, 18 bp, Homo sapiens
agcctctgcccaggcact

SEQ ID NO: 2492172 - DNA, 23 bp, Homo sapiens
agcctctggcattagaattattt

SEQ ID NO: 2492173 - DNA, 21 bp, Homo sapiens
agcctctggggggtggccagg

SEQ ID NO: 2492174 - DNA, 18 bp, Homo sapiens
agcctgaaccccagggct

SEQ ID NO: 2492175 - DNA, 16 bp, Homo sapiens
agcctgagcaactctt

SEQ ID NO: 2492176 - DNA, 22 bp, Homo sapiens
agcctgagggaaaggccagcac

SEQ ID NO: 2492177 - DNA, 16 bp, Homo sapiens
agcctggaccactcct

SEQ ID NO: 2492178 - DNA, 19 bp, Homo sapiens
agcctggaccactcctcat

SEQ ID NO: 2492179 - DNA, 15 bp, Homo sapiens
agcctggacctctga

SEQ ID NO: 2492180 - DNA, 17 bp, Homo sapiens
agcctggacctctgaca

SEQ ID NO: 2492181 - DNA, 22 bp, Homo sapiens
agcctggacctctgacagcagc

SEQ ID NO: 2492182 - DNA, 18 bp, Homo sapiens
agcctggccagacacagg

SEQ ID NO: 2492183 - DNA, 18 bp, Homo sapiens
taagactcaaatgttcta

SEQ ID NO: 2492184 - DNA, 16 bp, Homo sapiens
taagactctcacactc

SEQ ID NO: 2492185 - DNA, 20 bp, Homo sapiens
taagagaagtagaaatcata

SEQ ID NO: 2492186 - DNA, 14 bp, Homo sapiens
taagagtgctgggc

SEQ ID NO: 2492187 - DNA, 14 bp, Homo sapiens
taagatcttagatt

SEQ ID NO: 2492188 - DNA, 20 bp, Homo sapiens
taagatcttagattctctgt

SEQ ID NO: 2492189 - DNA, 18 bp, Homo sapiens
taagatgtgatattctaa

SEQ ID NO: 2492190 - DNA, 16 bp, Homo sapiens
taagattatagattct

SEQ ID NO: 2492191 - DNA, 19 bp, Homo sapiens
taagattatagattctaaa

SEQ ID NO: 2492192 - DNA, 23 bp, Homo sapiens
taagattatagattctaaagatt

SEQ ID NO: 2492193 - DNA, 12 bp, Homo sapiens
taagattctaaa

SEQ ID NO: 2492194 - DNA, 13 bp, Homo sapiens
taagattctaacg

SEQ ID NO: 2492195 - DNA, 13 bp, Homo sapiens
taagattctgatt

SEQ ID NO: 2492196 - DNA, 18 bp, Homo sapiens
taagatttgtttttaaac

SEQ ID NO: 2492197 - DNA, 20 bp, Homo sapiens
taccaatcattttaattatt

SEQ ID NO: 2492198 - DNA, 17 bp, Homo sapiens
taccaatgaaaaaatgt

SEQ ID NO: 2492199 - DNA, 13 bp, Homo sapiens
taccaccagctgt

SEQ ID NO: 2492200 - DNA, 14 bp, Homo sapiens
taccaccagctgtg

SEQ ID NO: 2492201 - DNA, 16 bp, Homo sapiens
taccacctttactgtg

SEQ ID NO: 2492202 - DNA, 19 bp, Homo sapiens
taccactctgtaattgcaa

SEQ ID NO: 2492203 - DNA, 12 bp, Homo sapiens
taccagtattta

SEQ ID NO: 2492204 - DNA, 15 bp, Homo sapiens
taccagtatttagaa

SEQ ID NO: 2492205 - DNA, 19 bp, Homo sapiens
taccagtatttagaagcca

SEQ ID NO: 2492206 - DNA, 12 bp, Homo sapiens
taccagttgcct

SEQ ID NO: 2492207 - DNA, 19 bp, Homo sapiens
taccagttgccttttatcc

SEQ ID NO: 2492208 - DNA, 20 bp, Homo sapiens
taccattaaaccatctccct

SEQ ID NO: 2492209 - DNA, 13 bp, Homo sapiens
taccatttacatg

SEQ ID NO: 2492210 - DNA, 15 bp, Homo sapiens
taccatttgcctccc

SEQ ID NO: 2492211 - DNA, 15 bp, Homo sapiens
taccattttctggtt

SEQ ID NO: 2492212 - DNA, 20 bp, Homo sapiens
tacccaccgggccactcctt

SEQ ID NO: 2492213 - DNA, 18 bp, Homo sapiens
taccccaatttcggattt

SEQ ID NO: 2492214 - DNA, 22 bp, Homo sapiens
taccccagactagatgtagtat

SEQ ID NO: 2492215 - DNA, 17 bp, Homo sapiens
taccccgcagacacctt

SEQ ID NO: 2492216 - DNA, 19 bp, Homo sapiens
taccccttacaaatgaaaa

SEQ ID NO: 2492217 - DNA, 17 bp, Homo sapiens
taccctctcagctccag

SEQ ID NO: 2492218 - DNA, 20 bp, Homo sapiens
taccctctcagctccaggtg

SEQ ID NO: 2492219 - DNA, 15 bp, Homo sapiens
taccctctgaaatac

SEQ ID NO: 2492220 - DNA, 16 bp, Homo sapiens
taccctctgaaataca

SEQ ID NO: 2492221 - DNA, 17 bp, Homo sapiens
taccctctgaaatacat

SEQ ID NO: 2492222 - DNA, 20 bp, Homo sapiens
taccctgacctggccccctc

SEQ ID NO: 2492223 - DNA, 22 bp, Homo sapiens
taccctgacctggccccctcag

SEQ ID NO: 2492224 - DNA, 18 bp, Homo sapiens
taccctgagctgaggcag

SEQ ID NO: 2492225 - DNA, 12 bp, Homo sapiens
taccctggcccc

SEQ ID NO: 2492226 - DNA, 15 bp, Homo sapiens
taccgaatgtgtctt

SEQ ID NO: 2492227 - DNA, 16 bp, Homo sapiens
taccgaatgtgtcttt

SEQ ID NO: 2492228 - DNA, 20 bp, Homo sapiens
taccgagttcaagtgatttt

SEQ ID NO: 2492229 - DNA, 23 bp, Homo sapiens
tacctaaaaggaaatctcacccc

SEQ ID NO: 2492230 - DNA, 17 bp, Homo sapiens
tacctaagattacaaat

SEQ ID NO: 2492231 - DNA, 11 bp, Homo sapiens
tacctcagcct

SEQ ID NO: 2492232 - DNA, 14 bp, Homo sapiens
tacctcaggcagct

SEQ ID NO: 2492233 - DNA, 20 bp, Homo sapiens
tacctgaaaacactgtgcac

SEQ ID NO: 2492234 - DNA, 17 bp, Homo sapiens
tacctgacactcccttg

SEQ ID NO: 2492235 - DNA, 20 bp, Homo sapiens
tacctgccccacttgtcctt

SEQ ID NO: 2492236 - DNA, 17 bp, Homo sapiens
tacctgctcagccctgc

SEQ ID NO: 2492237 - DNA, 17 bp, Homo sapiens
tacctgtgtttcttgcc

SEQ ID NO: 2492238 - DNA, 21 bp, Homo sapiens
tacctgttgagcatcacagaa

SEQ ID NO: 2492239 - DNA, 19 bp, Homo sapiens
taccttctccccagctccc

SEQ ID NO: 2492240 - DNA, 13 bp, Homo sapiens
taccttggttccc

SEQ ID NO: 2492241 - DNA, 16 bp, Homo sapiens
taccttgtatactgta

SEQ ID NO: 2492242 - DNA, 21 bp, Homo sapiens
taccttttgaggagccccagc

SEQ ID NO: 2492243 - DNA, 20 bp, Homo sapiens
tacgaaataattgttgttct

SEQ ID NO: 2492244 - DNA, 13 bp, Homo sapiens
tacgatgcttcaa

SEQ ID NO: 2492245 - DNA, 15 bp, Homo sapiens
tacgctttgattcat

SEQ ID NO: 2492246 - DNA, 17 bp, Homo sapiens
tacggacagagaccaag

SEQ ID NO: 2492247 - DNA, 17 bp, Homo sapiens
tacggattttcagttac

SEQ ID NO: 2492248 - DNA, 16 bp, Homo sapiens
tacgtaataaggtttt

SEQ ID NO: 2492249 - DNA, 12 bp, Homo sapiens
tacgtatgtctg

SEQ ID NO: 2492250 - DNA, 18 bp, Homo sapiens
tacgtatgtctggttctc

SEQ ID NO: 2492251 - DNA, 16 bp, Homo sapiens
tacgtatttaatagca

SEQ ID NO: 2492252 - DNA, 12 bp, Homo sapiens
tacgtgcacagg

SEQ ID NO: 2492253 - DNA, 14 bp, Homo sapiens
tactaaagccaaac

SEQ ID NO: 2492254 - DNA, 18 bp, Homo sapiens
tactaaagccaaacatat

SEQ ID NO: 2492255 - DNA, 16 bp, Homo sapiens
tactaataaactaata

SEQ ID NO: 2492256 - DNA, 20 bp, Homo sapiens
tactaataaactaataattg

SEQ ID NO: 2492257 - DNA, 13 bp, Homo sapiens
tactaatgaaaac

SEQ ID NO: 2492258 - DNA, 16 bp, Homo sapiens
tactaatgaaaacaga

SEQ ID NO: 2492259 - DNA, 13 bp, Homo sapiens
tactaattccaca

SEQ ID NO: 2492260 - DNA, 13 bp, Homo sapiens
tactaccttgaaa

SEQ ID NO: 2492261 - DNA, 14 bp, Homo sapiens
tactactgtgtaag

SEQ ID NO: 2492262 - DNA, 20 bp, Homo sapiens
tactagggagccatttgaga

SEQ ID NO: 2492263 - DNA, 14 bp, Homo sapiens
tactatatttatgg

SEQ ID NO: 2492264 - DNA, 21 bp, Homo sapiens
tactatttaaagcctcctcat

SEQ ID NO: 2492265 - DNA, 22 bp, Homo sapiens
tactatttaaagcctcctcatc

SEQ ID NO: 2492266 - DNA, 18 bp, Homo sapiens
tactcaaatgagtaacat

SEQ ID NO: 2492267 - DNA, 14 bp, Homo sapiens
tactcaggagcccg

SEQ ID NO: 2492268 - DNA, 12 bp, Homo sapiens
tactcaggtttg

SEQ ID NO: 2492269 - DNA, 14 bp, Homo sapiens
tactccacactgca

SEQ ID NO: 2492270 - DNA, 13 bp, Homo sapiens
tactcccaggcac

SEQ ID NO: 2492271 - DNA, 20 bp, Homo sapiens
tactcccaggcactgtctta

SEQ ID NO: 2492272 - DNA, 17 bp, Homo sapiens
tactcctatgatctgag

SEQ ID NO: 2492273 - DNA, 11 bp, Homo sapiens
tactcctgtgg

SEQ ID NO: 2492274 - DNA, 12 bp, Homo sapiens
tactcctgtggg

SEQ ID NO: 2492275 - DNA, 17 bp, Homo sapiens
tactcctgtgggagcct

SEQ ID NO: 2492276 - DNA, 20 bp, Homo sapiens
tactctaagatcttagattc

SEQ ID NO: 2492277 - DNA, 21 bp, Homo sapiens
tactctaagatcttagattct

SEQ ID NO: 2492278 - DNA, 15 bp, Homo sapiens
tactctccccacgag

SEQ ID NO: 2492279 - DNA, 20 bp, Homo sapiens
tactctccccacgagggctg

SEQ ID NO: 2492280 - DNA, 18 bp, Homo sapiens
tactctgtgccagagcct

SEQ ID NO: 2492281 - DNA, 21 bp, Homo sapiens
tactgaacatctgagtcctgg

SEQ ID NO: 2492282 - DNA, 19 bp, Homo sapiens
tactgaatgtcattgaaaa

SEQ ID NO: 2492283 - DNA, 22 bp, Homo sapiens
tactgacatgtggggccaggtc

SEQ ID NO: 2492284 - DNA, 17 bp, Homo sapiens
tactgactttgcttgct

SEQ ID NO: 2492285 - DNA, 18 bp, Homo sapiens
tactgactttgcttgctt

SEQ ID NO: 2492286 - DNA, 22 bp, Homo sapiens
tactgcaaatcaggcttttgtt

SEQ ID NO: 2492287 - DNA, 22 bp, Homo sapiens
tactgcagcctttgcctccccg

SEQ ID NO: 2492288 - DNA, 16 bp, Homo sapiens
tactgcgactttctgc

SEQ ID NO: 2492289 - DNA, 20 bp, Homo sapiens
tactgcgactttctgcctgg

SEQ ID NO: 2492290 - DNA, 20 bp, Homo sapiens
tactgctacagcaatttcta

SEQ ID NO: 2492291 - DNA, 12 bp, Homo sapiens
tactgctctgag

SEQ ID NO: 2492292 - DNA, 12 bp, Homo sapiens
tcctcccagggt

SEQ ID NO: 2492293 - DNA, 23 bp, Homo sapiens
tcctcccagggttttaactttgt

SEQ ID NO: 2492294 - DNA, 19 bp, Homo sapiens
tcctcccctccagctccct

SEQ ID NO: 2492295 - DNA, 17 bp, Homo sapiens
tcctccctccctctccg

SEQ ID NO: 2492296 - DNA, 11 bp, Homo sapiens
tcctccctgta

SEQ ID NO: 2492297 - DNA, 12 bp, Homo sapiens
tcctccctgtaa

SEQ ID NO: 2492298 - DNA, 13 bp, Homo sapiens
tcctcctccaggg

SEQ ID NO: 2492299 - DNA, 15 bp, Homo sapiens
tcctcctccagggac

SEQ ID NO: 2492300 - DNA, 16 bp, Homo sapiens
tcctcctccagggaca

SEQ ID NO: 2492301 - DNA, 15 bp, Homo sapiens
tcctcctgcagacca

SEQ ID NO: 2492302 - DNA, 14 bp, Homo sapiens
tcctcctgggccct

SEQ ID NO: 2492303 - DNA, 16 bp, Homo sapiens
tcctcctgggccctct

SEQ ID NO: 2492304 - DNA, 22 bp, Homo sapiens
tcctcctgggccctctctgctc

SEQ ID NO: 2492305 - DNA, 14 bp, Homo sapiens
tcctcctttttcca

SEQ ID NO: 2492306 - DNA, 13 bp, Homo sapiens
tcctcgcctgaca

SEQ ID NO: 2492307 - DNA, 15 bp, Homo sapiens
tcctcgtttgtgttc

SEQ ID NO: 2492308 - DNA, 16 bp, Homo sapiens
tcctctaacttggctc

SEQ ID NO: 2492309 - DNA, 18 bp, Homo sapiens
tcctctactaacaatcag

SEQ ID NO: 2492310 - DNA, 19 bp, Homo sapiens
tcctctccccagcccagag

SEQ ID NO: 2492311 - DNA, 22 bp, Homo sapiens
cccaggcccggatgcagaggcc

SEQ ID NO: 2492312 - DNA, 19 bp, Homo sapiens
cccaggctcggcctgcccc

SEQ ID NO: 2492313 - DNA, 14 bp, Homo sapiens
cccaggctgccgtc

SEQ ID NO: 2492314 - DNA, 15 bp, Homo sapiens
cccaggctgccgtcc

SEQ ID NO: 2492315 - DNA, 13 bp, Homo sapiens
cccaggctgggaa

SEQ ID NO: 2492316 - DNA, 11 bp, Homo sapiens
cccagggcaca

SEQ ID NO: 2492317 - DNA, 13 bp, Homo sapiens
cccagggcacagg

SEQ ID NO: 2492318 - DNA, 16 bp, Homo sapiens
cccagggcacaggagc

SEQ ID NO: 2492319 - DNA, 13 bp, Homo sapiens
cccagggcccaga

SEQ ID NO: 2492320 - DNA, 16 bp, Homo sapiens
cccagggcccagagcc

SEQ ID NO: 2492321 - DNA, 17 bp, Homo sapiens
cccagggcccagagccc

SEQ ID NO: 2492322 - DNA, 19 bp, Homo sapiens
cccagggcccagagcccag

SEQ ID NO: 2492323 - DNA, 21 bp, Homo sapiens
cccagggctgtaactgccagg

SEQ ID NO: 2492324 - DNA, 23 bp, Homo sapiens
cccaggggctccctccgccccca

SEQ ID NO: 2492325 - DNA, 16 bp, Homo sapiens
cccagggtcctgggag

SEQ ID NO: 2492326 - DNA, 17 bp, Homo sapiens
cccaggtaggccaaggt

SEQ ID NO: 2492327 - DNA, 21 bp, Homo sapiens
cccaggtaggggcccctctca

SEQ ID NO: 2492328 - DNA, 22 bp, Homo sapiens
cccaggtaggggcccctctcag

SEQ ID NO: 2492329 - DNA, 21 bp, Homo sapiens
cccaggtctccctggatcaga

SEQ ID NO: 2492330 - DNA, 16 bp, Homo sapiens
cccaggttggctctgc

SEQ ID NO: 2492331 - DNA, 16 bp, Homo sapiens
cccagtagaccttgtt

SEQ ID NO: 2492332 - DNA, 11 bp, Homo sapiens
cccagtctgtc

SEQ ID NO: 2492333 - DNA, 14 bp, Homo sapiens
cccagtgcccccac

SEQ ID NO: 2492334 - DNA, 21 bp, Homo sapiens
cccagttcctgtggctccctc

SEQ ID NO: 2492335 - DNA, 15 bp, Homo sapiens
cccagttggagctcc

SEQ ID NO: 2492336 - DNA, 16 bp, Homo sapiens
cccagttggagctcca

SEQ ID NO: 2492337 - DNA, 17 bp, Homo sapiens
cccagttggagctccag

SEQ ID NO: 2492338 - DNA, 22 bp, Homo sapiens
cccagttggagctccagcctga

SEQ ID NO: 2492339 - DNA, 19 bp, Homo sapiens
cccagtttctaaactggag

SEQ ID NO: 2492340 - DNA, 23 bp, Homo sapiens
cccagtttctaaactggagactg

SEQ ID NO: 2492341 - DNA, 21 bp, Homo sapiens
cccatatgctaccaccagctg

SEQ ID NO: 2492342 - DNA, 18 bp, Homo sapiens
cccatattgtaaaacagg

SEQ ID NO: 2492343 - DNA, 20 bp, Homo sapiens
cccatcacctactcacacag

SEQ ID NO: 2492344 - DNA, 23 bp, Homo sapiens
cccatcacctactcacacaggca

SEQ ID NO: 2492345 - DNA, 14 bp, Homo sapiens
cccatcagggtagg

SEQ ID NO: 2492346 - DNA, 19 bp, Homo sapiens
cccatcatcctctggcttg

SEQ ID NO: 2492347 - DNA, 13 bp, Homo sapiens
cccatccccagcg

SEQ ID NO: 2492348 - DNA, 22 bp, Homo sapiens
cccatcctgtgtgttaagctct

SEQ ID NO: 2492349 - DNA, 20 bp, Homo sapiens
cccatcgttgcccccatttc

SEQ ID NO: 2492350 - DNA, 22 bp, Homo sapiens
cccatcgttgcccccatttctg

SEQ ID NO: 2492351 - DNA, 11 bp, Homo sapiens
cccatctcagg

SEQ ID NO: 2492352 - DNA, 23 bp, Homo sapiens
cccatgagttggggtctggcagc

SEQ ID NO: 2492353 - DNA, 20 bp, Homo sapiens
cccatgcactgtgaaggacc

SEQ ID NO: 2492354 - DNA, 18 bp, Homo sapiens
cccatgctgtccatccat

SEQ ID NO: 2492355 - DNA, 22 bp, Homo sapiens
cccatggacaggctggctccag

SEQ ID NO: 2492356 - DNA, 19 bp, Homo sapiens
cccatggggagggattctg

SEQ ID NO: 2492357 - DNA, 21 bp, Homo sapiens
cccatgttctgtcccttgccc

SEQ ID NO: 2492358 - DNA, 13 bp, Homo sapiens
cccatgtttcaaa

SEQ ID NO: 2492359 - DNA, 13 bp, Homo sapiens
cccatttctgagg

SEQ ID NO: 2492360 - DNA, 13 bp, Homo sapiens
cccatttttcctt

SEQ ID NO: 2492361 - DNA, 16 bp, Homo sapiens
ccccaaagctttcctg

SEQ ID NO: 2492362 - DNA, 21 bp, Homo sapiens
ccccaaagctttcctgcccca

SEQ ID NO: 2492363 - DNA, 15 bp, Homo sapiens
ccccaacagcgccca

SEQ ID NO: 2492364 - DNA, 23 bp, Homo sapiens
ccccaaccatttcctcagactct

SEQ ID NO: 2492365 - DNA, 13 bp, Homo sapiens
ccccaacctgctc

SEQ ID NO: 2492366 - DNA, 14 bp, Homo sapiens
ccccaacctgctct

SEQ ID NO: 2492367 - DNA, 20 bp, Homo sapiens
ccccaacctgctctcctctt

SEQ ID NO: 2492368 - DNA, 20 bp, Homo sapiens
ccccaactacccccagctgt

SEQ ID NO: 2492369 - DNA, 17 bp, Homo sapiens
ccccaactccttccagc

SEQ ID NO: 2492370 - DNA, 22 bp, Homo sapiens
ccccaagattgagctctctgcc

SEQ ID NO: 2492371 - DNA, 23 bp, Homo sapiens
ccccaaggaggcagcctggacca

SEQ ID NO: 2492372 - DNA, 14 bp, Homo sapiens
ccccaatcctccca

SEQ ID NO: 2492373 - DNA, 13 bp, Homo sapiens
ccccacccacttc

SEQ ID NO: 2492374 - DNA, 14 bp, Homo sapiens
ccccacccccaagg

SEQ ID NO: 2492375 - DNA, 16 bp, Homo sapiens
ccccacccccagctca

SEQ ID NO: 2492376 - DNA, 20 bp, Homo sapiens
ccccacccccagctcaatgg

SEQ ID NO: 2492377 - DNA, 12 bp, Homo sapiens
ccccaccctcat

SEQ ID NO: 2492378 - DNA, 15 bp, Homo sapiens
ccccaccctcgggga

SEQ ID NO: 2492379 - DNA, 21 bp, Homo sapiens
ccccaccctcggggatgtgtc

SEQ ID NO: 2492380 - DNA, 15 bp, Homo sapiens
ccccaccctgggccc

SEQ ID NO: 2492381 - DNA, 20 bp, Homo sapiens
ccccaccctgggccctgggc

SEQ ID NO: 2492382 - DNA, 14 bp, Homo sapiens
ccccaccctgttcc

SEQ ID NO: 2492383 - DNA, 13 bp, Homo sapiens
ccccacgagggct

SEQ ID NO: 2492384 - DNA, 18 bp, Homo sapiens
ccccacgagggctggctg

SEQ ID NO: 2492385 - DNA, 21 bp, Homo sapiens
ccccacgagggctggctggcc

SEQ ID NO: 2492386 - DNA, 14 bp, Homo sapiens
ccccactcccacat

SEQ ID NO: 2492387 - DNA, 13 bp, Homo sapiens
ccccactccctca

SEQ ID NO: 2492388 - DNA, 12 bp, Homo sapiens
ccccactctgct

SEQ ID NO: 2492389 - DNA, 17 bp, Homo sapiens
ccccactctgctctgat

SEQ ID NO: 2492390 - DNA, 14 bp, Homo sapiens
ccccactggagcag

SEQ ID NO: 2492391 - DNA, 24 bp, Homo sapiens
ccccactggagcagaaggggagat

SEQ ID NO: 2492392 - DNA, 13 bp, Homo sapiens
ccccacttgcctc

SEQ ID NO: 2492393 - DNA, 18 bp, Homo sapiens
ccccagactagatgtagt

SEQ ID NO: 2492394 - DNA, 24 bp, Homo sapiens
ccccagcaaagcccccagagccca

SEQ ID NO: 2492395 - DNA, 11 bp, Homo sapiens
ccccagcactt

SEQ ID NO: 2492396 - DNA, 16 bp, Homo sapiens
ccccagccagggctca

SEQ ID NO: 2492397 - DNA, 12 bp, Homo sapiens
ccccagcccagg

SEQ ID NO: 2492398 - DNA, 20 bp, Homo sapiens
ccccagcccagggctcctgc

SEQ ID NO: 2492399 - DNA, 13 bp, Homo sapiens
ccccagcctgggc

SEQ ID NO: 2492400 - DNA, 16 bp, Homo sapiens
ccccagcctgggccta

SEQ ID NO: 2492401 - DNA, 13 bp, Homo sapiens
ccccagctcccac

SEQ ID NO: 2492402 - DNA, 11 bp, Homo sapiens
ccccagctccg

SEQ ID NO: 2492403 - DNA, 13 bp, Homo sapiens
ccccaggaccaga

SEQ ID NO: 2492404 - DNA, 14 bp, Homo sapiens
ccccaggaccagaa

SEQ ID NO: 2492405 - DNA, 19 bp, Homo sapiens
ccccaggaccagctcagga

SEQ ID NO: 2492406 - DNA, 15 bp, Homo sapiens
ccccaggacctggct

SEQ ID NO: 2492407 - DNA, 11 bp, Homo sapiens
ccccagggcac

SEQ ID NO: 2492408 - DNA, 12 bp, Homo sapiens
ccccagggcagc

SEQ ID NO: 2492409 - DNA, 15 bp, Homo sapiens
ccccagggcagccag

SEQ ID NO: 2492410 - DNA, 20 bp, Homo sapiens
ccccaggtaggggcccctct

SEQ ID NO: 2492411 - DNA, 17 bp, Homo sapiens
ccccatcatcctctggc

SEQ ID NO: 2492412 - DNA, 14 bp, Homo sapiens
ccccatcccatgct

SEQ ID NO: 2492413 - DNA, 22 bp, Homo sapiens
ccccatcgttgcccccatttct

SEQ ID NO: 2492414 - DNA, 17 bp, Homo sapiens
ccccatctcaggccaga

SEQ ID NO: 2492415 - DNA, 12 bp, Homo sapiens
ccccatctctcc

SEQ ID NO: 2492416 - DNA, 13 bp, Homo sapiens
ccctggtgacatc

SEQ ID NO: 2492417 - DNA, 20 bp, Homo sapiens
ccctggtggccctctcccct

SEQ ID NO: 2492418 - DNA, 15 bp, Homo sapiens
ccctgtacagtgtta

SEQ ID NO: 2492419 - DNA, 18 bp, Homo sapiens
ccctgtactgttctgtgt

SEQ ID NO: 2492420 - DNA, 14 bp, Homo sapiens
ccctgtaggcctca

SEQ ID NO: 2492421 - DNA, 20 bp, Homo sapiens
ccctgtcatccagctcactc

SEQ ID NO: 2492422 - DNA, 13 bp, Homo sapiens
ccctgtcctggtg

SEQ ID NO: 2492423 - DNA, 23 bp, Homo sapiens
ccctgtcctggtggtattttcaa

SEQ ID NO: 2492424 - DNA, 22 bp, Homo sapiens
ccctgtgcagccgctgagcgag

SEQ ID NO: 2492425 - DNA, 15 bp, Homo sapiens
ccctgtgttgtctct

SEQ ID NO: 2492426 - DNA, 16 bp, Homo sapiens
ccctgttccccagaga

SEQ ID NO: 2492427 - DNA, 13 bp, Homo sapiens
ccctgttcctgct

SEQ ID NO: 2492428 - DNA, 22 bp, Homo sapiens
ccctgttttcccacgaggaatc

SEQ ID NO: 2492429 - DNA, 14 bp, Homo sapiens
cccttacagtagga

SEQ ID NO: 2492430 - DNA, 16 bp, Homo sapiens
cccttagacagaggcc

SEQ ID NO: 2492431 - DNA, 16 bp, Homo sapiens
cccttatcctccctgt

SEQ ID NO: 2492432 - DNA, 13 bp, Homo sapiens
cccttccactgag

SEQ ID NO: 2492433 - DNA, 14 bp, Homo sapiens
cccttcccacagga

SEQ ID NO: 2492434 - DNA, 15 bp, Homo sapiens
cccttccgccactgg

SEQ ID NO: 2492435 - DNA, 21 bp, Homo sapiens
cccttcctccctattaaccta

SEQ ID NO: 2492436 - DNA, 23 bp, Homo sapiens
cccttctccatccacatgggagc

SEQ ID NO: 2492437 - DNA, 20 bp, Homo sapiens
cccttctcccactctcctag

SEQ ID NO: 2492438 - DNA, 14 bp, Homo sapiens
cccttctcccctgc

SEQ ID NO: 2492439 - DNA, 15 bp, Homo sapiens
cccttctcccctgca

SEQ ID NO: 2492440 - DNA, 16 bp, Homo sapiens
cccttctcccctgcac

SEQ ID NO: 2492441 - DNA, 21 bp, Homo sapiens
cccttctcccctgcactgtaa

SEQ ID NO: 2492442 - DNA, 23 bp, Homo sapiens
cccttctgctcagctctgggcca

SEQ ID NO: 2492443 - DNA, 12 bp, Homo sapiens
cccttcttccct

SEQ ID NO: 2492444 - DNA, 18 bp, Homo sapiens
cccttgacaactggcagg

SEQ ID NO: 2492445 - DNA, 15 bp, Homo sapiens
cccttgacacctgct

SEQ ID NO: 2492446 - DNA, 15 bp, Homo sapiens
cccttgcccccctgg

SEQ ID NO: 2492447 - DNA, 22 bp, Homo sapiens
cccttgcccccctggcctcccc

SEQ ID NO: 2492448 - DNA, 15 bp, Homo sapiens
cccttgctgtgaatt

SEQ ID NO: 2492449 - DNA, 16 bp, Homo sapiens
cccttgggccagaagt

SEQ ID NO: 2492450 - DNA, 15 bp, Homo sapiens
cccttgggctctgat

SEQ ID NO: 2492451 - DNA, 17 bp, Homo sapiens
cccttgtagctcctccc

SEQ ID NO: 2492452 - DNA, 18 bp, Homo sapiens
cccttgtagctcctcccc

SEQ ID NO: 2492453 - DNA, 20 bp, Homo sapiens
cccttgtttggggcaggagt

SEQ ID NO: 2492454 - DNA, 20 bp, Homo sapiens
ccctttcccaccccaacctg

SEQ ID NO: 2492455 - DNA, 23 bp, Homo sapiens
ccctttcccaccccaacctgctc

SEQ ID NO: 2492456 - DNA, 13 bp, Homo sapiens
cccttttctgttc

SEQ ID NO: 2492457 - DNA, 16 bp, Homo sapiens
cccttttgggtttctg

SEQ ID NO: 2492458 - DNA, 16 bp, Homo sapiens
ccctttttctccagct

SEQ ID NO: 2492459 - DNA, 13 bp, Homo sapiens
ccgaatgtgtctt

SEQ ID NO: 2492460 - DNA, 20 bp, Homo sapiens
ccgactcacaccactagcct

SEQ ID NO: 2492461 - DNA, 19 bp, Homo sapiens
ccgagaggtgggccagtct

SEQ ID NO: 2492462 - DNA, 14 bp, Homo sapiens
ccgagcaaccgtgg

SEQ ID NO: 2492463 - DNA, 18 bp, Homo sapiens
ccgaggaggtgtctcagg

SEQ ID NO: 2492464 - DNA, 23 bp, Homo sapiens
ccgaggaggtgtctcaggctgcc

SEQ ID NO: 2492465 - DNA, 12 bp, Homo sapiens
ccgaggctgaga

SEQ ID NO: 2492466 - DNA, 21 bp, Homo sapiens
ccgaggtccctgctgccagct

SEQ ID NO: 2492467 - DNA, 12 bp, Homo sapiens
ccgagtccaagc

SEQ ID NO: 2492468 - DNA, 22 bp, Homo sapiens
ccgagtctgtttttcatgcgat

SEQ ID NO: 2492469 - DNA, 18 bp, Homo sapiens
ccgatagggtatttgacc

SEQ ID NO: 2492470 - DNA, 14 bp, Homo sapiens
ccgcagacaccttg

SEQ ID NO: 2492471 - DNA, 15 bp, Homo sapiens
ccgcagacaccttgg

SEQ ID NO: 2492472 - DNA, 23 bp, Homo sapiens
ccgcccagcggcttgcctgcctg

SEQ ID NO: 2492473 - DNA, 14 bp, Homo sapiens
ccgcccccaggtag

SEQ ID NO: 2492474 - DNA, 14 bp, Homo sapiens
ccgcctgccctcat

SEQ ID NO: 2492475 - DNA, 21 bp, Homo sapiens
ccgctacaccactctggcagc

SEQ ID NO: 2492476 - DNA, 13 bp, Homo sapiens
ccgctgtgccagg

SEQ ID NO: 2492477 - DNA, 14 bp, Homo sapiens
ccggagagccagct

SEQ ID NO: 2492478 - DNA, 20 bp, Homo sapiens
ccggaggcggtgggcctggt

SEQ ID NO: 2492479 - DNA, 22 bp, Homo sapiens
ccggatgcagaggcctgcaggg

SEQ ID NO: 2492480 - DNA, 19 bp, Homo sapiens
ccggcacagggtctgctct

SEQ ID NO: 2492481 - DNA, 20 bp, Homo sapiens
ccggcacagggtctgctctt

SEQ ID NO: 2492482 - DNA, 16 bp, Homo sapiens
ccggcaccccctgcag

SEQ ID NO: 2492483 - DNA, 16 bp, Homo sapiens
ccggcagcagccccca

SEQ ID NO: 2492484 - DNA, 22 bp, Homo sapiens
ccggcagcttctgccccctgca

SEQ ID NO: 2492485 - DNA, 22 bp, Homo sapiens
ccggcatggacaatggaccgga

SEQ ID NO: 2492486 - DNA, 17 bp, Homo sapiens
ccggcccctccccctga

SEQ ID NO: 2492487 - DNA, 15 bp, Homo sapiens
ccggcctgccaggag

SEQ ID NO: 2492488 - DNA, 16 bp, Homo sapiens
ccggcctgccaggagg

SEQ ID NO: 2492489 - DNA, 19 bp, Homo sapiens
ccggctaatttttgtattt

SEQ ID NO: 2492490 - DNA, 14 bp, Homo sapiens
ccggctcctggtca

SEQ ID NO: 2492491 - DNA, 23 bp, Homo sapiens
ccggctcgagcagtcctgcctca

SEQ ID NO: 2492492 - DNA, 20 bp, Homo sapiens
ccgggaccaccctgagccgg

SEQ ID NO: 2492493 - DNA, 16 bp, Homo sapiens
ccggggaactggccaa

SEQ ID NO: 2492494 - DNA, 17 bp, Homo sapiens
ccggggaactggccaag

SEQ ID NO: 2492495 - DNA, 19 bp, Homo sapiens
ccggggaactggccaagct

SEQ ID NO: 2492496 - DNA, 20 bp, Homo sapiens
ccggggtgcccacaggccgc

SEQ ID NO: 2492497 - DNA, 12 bp, Homo sapiens
ccggtgttctaa

SEQ ID NO: 2492498 - DNA, 14 bp, Homo sapiens
ccggtgttctaaga

SEQ ID NO: 2492499 - DNA, 12 bp, Homo sapiens
ccgtaatttaac

SEQ ID NO: 2492500 - DNA, 22 bp, Homo sapiens
ccgtcaagagtgaattccctca

SEQ ID NO: 2492501 - DNA, 19 bp, Homo sapiens
ccgtcaccacgactggcca

SEQ ID NO: 2492502 - DNA, 17 bp, Homo sapiens
ccgtcacccctgtttct

SEQ ID NO: 2492503 - DNA, 17 bp, Homo sapiens
ccgtctggcccaccagg

SEQ ID NO: 2492504 - DNA, 15 bp, Homo sapiens
ccgtgagcatgtttg

SEQ ID NO: 2492505 - DNA, 21 bp, Homo sapiens
ccgtgccaagtccaggtcctg

SEQ ID NO: 2492506 - DNA, 11 bp, Homo sapiens
ccgtggaggct

SEQ ID NO: 2492507 - DNA, 22 bp, Homo sapiens
ccgtggaggctgctcggggtgc

SEQ ID NO: 2492508 - DNA, 19 bp, Homo sapiens
ccgtggcccttcctggaca

SEQ ID NO: 2492509 - DNA, 21 bp, Homo sapiens
ccgtggcccttcctggacagc

SEQ ID NO: 2492510 - DNA, 22 bp, Homo sapiens
ccgtggcccttcctggacagct

SEQ ID NO: 2492511 - DNA, 20 bp, Homo sapiens
ccgtggctgctgtgggaaat

SEQ ID NO: 2492512 - DNA, 20 bp, Homo sapiens
ccgtggggccgccgcctctt

SEQ ID NO: 2492513 - DNA, 21 bp, Homo sapiens
ccgtgtaaatatgtacatttc

SEQ ID NO: 2492514 - DNA, 22 bp, Homo sapiens
ccgtgtgagaagtgaatgctgg

SEQ ID NO: 2492515 - DNA, 14 bp, Homo sapiens
ccgttagctcctgt

SEQ ID NO: 2492516 - DNA, 18 bp, Homo sapiens
ccgttagctcctgtggcc

SEQ ID NO: 2492517 - DNA, 16 bp, Homo sapiens
ccgttcatgggggagg

SEQ ID NO: 2492518 - DNA, 23 bp, Homo sapiens
ccgttcatgggggagggggcaga

SEQ ID NO: 2492519 - DNA, 16 bp, Homo sapiens
cctaaagaaaaacaaa

SEQ ID NO: 2492520 - DNA, 12 bp, Homo sapiens
aaaggcctgggg

SEQ ID NO: 2492521 - DNA, 13 bp, Homo sapiens
aaaggcctggggt

SEQ ID NO: 2492522 - DNA, 20 bp, Homo sapiens
aaaggtccacaggtctagac

SEQ ID NO: 2492523 - DNA, 13 bp, Homo sapiens
aaaggttctaggt

SEQ ID NO: 2492524 - DNA, 20 bp, Homo sapiens
aaaggttctaggtttcaaag

SEQ ID NO: 2492525 - DNA, 13 bp, Homo sapiens
aaaggtttaaatg

SEQ ID NO: 2492526 - DNA, 16 bp, Homo sapiens
aaaggtttaaatgaac

SEQ ID NO: 2492527 - DNA, 20 bp, Homo sapiens
aaaggtttaaatgaacaaga

SEQ ID NO: 2492528 - DNA, 16 bp, Homo sapiens
aaaggtttacagaatt

SEQ ID NO: 2492529 - DNA, 19 bp, Homo sapiens
aaaggtttatgaaaaagaa

SEQ ID NO: 2492530 - DNA, 22 bp, Homo sapiens
aaaggtttatgaaaaagaagaa

SEQ ID NO: 2492531 - DNA, 19 bp, Homo sapiens
aaagtacaaccatagagga

SEQ ID NO: 2492532 - DNA, 12 bp, Homo sapiens
aaagtatgttct

SEQ ID NO: 2492533 - DNA, 19 bp, Homo sapiens
aaagtatgttctaaccttt

SEQ ID NO: 2492534 - DNA, 12 bp, Homo sapiens
aaagtattcttc

SEQ ID NO: 2492535 - DNA, 15 bp, Homo sapiens
aaagtcataattgca

SEQ ID NO: 2492536 - DNA, 16 bp, Homo sapiens
aaagtcctttttttcc

SEQ ID NO: 2492537 - DNA, 22 bp, Homo sapiens
aaagtcctttttttccatcttt

SEQ ID NO: 2492538 - DNA, 15 bp, Homo sapiens
aaagtctctaattct

SEQ ID NO: 2492539 - DNA, 15 bp, Homo sapiens
aaagtgcctttcagg

SEQ ID NO: 2492540 - DNA, 19 bp, Homo sapiens
aaagtgcctttcaggatct

SEQ ID NO: 2492541 - DNA, 13 bp, Homo sapiens
aaagtgctgagat

SEQ ID NO: 2492542 - DNA, 19 bp, Homo sapiens
aaagtggccaagaagcagt

SEQ ID NO: 2492543 - DNA, 10 bp, Homo sapiens
aaagtgtatt

SEQ ID NO: 2492544 - DNA, 22 bp, Homo sapiens
aaagtgtatttggaaataaagt

SEQ ID NO: 2492545 - DNA, 22 bp, Homo sapiens
aaagttccaagagtctaaagat

SEQ ID NO: 2492546 - DNA, 16 bp, Homo sapiens
aaagttctaagattct

SEQ ID NO: 2492547 - DNA, 20 bp, Homo sapiens
aaagttctaataatttctaa

SEQ ID NO: 2492548 - DNA, 18 bp, Homo sapiens
aaagttgataaagatttt

SEQ ID NO: 2492549 - DNA, 17 bp, Homo sapiens
aaagttgcagctgtttt

SEQ ID NO: 2492550 - DNA, 20 bp, Homo sapiens
aaagttgcagctgttttgtt

SEQ ID NO: 2492551 - DNA, 23 bp, Homo sapiens
aaagttgcagctgttttgttgac

SEQ ID NO: 2492552 - DNA, 15 bp, Homo sapiens
aaagtttaatcagag

SEQ ID NO: 2492553 - DNA, 15 bp, Homo sapiens
aaagttttatatatt

SEQ ID NO: 2492554 - DNA, 20 bp, Homo sapiens
aaagttttatatattatatg

SEQ ID NO: 2492555 - DNA, 15 bp, Homo sapiens
aaataaaaaagatcc

SEQ ID NO: 2492556 - DNA, 21 bp, Homo sapiens
aaataaaacccgttgattact

SEQ ID NO: 2492557 - DNA, 14 bp, Homo sapiens
aaataaaatgctag

SEQ ID NO: 2492558 - DNA, 16 bp, Homo sapiens
aaataaaatttgttgc

SEQ ID NO: 2492559 - DNA, 17 bp, Homo sapiens
aaataaaatttgttgca

SEQ ID NO: 2492560 - DNA, 19 bp, Homo sapiens
aaataaaatttgttgcata

SEQ ID NO: 2492561 - DNA, 19 bp, Homo sapiens
aaataactggaaaacagaa

SEQ ID NO: 2492562 - DNA, 21 bp, Homo sapiens
aaataactggaaaacagaaca

SEQ ID NO: 2492563 - DNA, 12 bp, Homo sapiens
aaataagaaact

SEQ ID NO: 2492564 - DNA, 14 bp, Homo sapiens
aaataagaaacttt

SEQ ID NO: 2492565 - DNA, 17 bp, Homo sapiens
aaataagagctcaggat

SEQ ID NO: 2492566 - DNA, 13 bp, Homo sapiens
aaataagattcta

SEQ ID NO: 2492567 - DNA, 22 bp, Homo sapiens
aaataagcaggtggatctattt

SEQ ID NO: 2492568 - DNA, 18 bp, Homo sapiens
aaataagctatttgatgt

SEQ ID NO: 2492569 - DNA, 22 bp, Homo sapiens
aaataaggcacccatctgtctg

SEQ ID NO: 2492570 - DNA, 13 bp, Homo sapiens
aaataagtcaaca

SEQ ID NO: 2492571 - DNA, 15 bp, Homo sapiens
aaataagtcaacagt

SEQ ID NO: 2492572 - DNA, 18 bp, Homo sapiens
aaataagtcaacagtaaa

SEQ ID NO: 2492573 - DNA, 21 bp, Homo sapiens
aaataagtcaacagtaaacca

SEQ ID NO: 2492574 - DNA, 13 bp, Homo sapiens
aaataatacatta

SEQ ID NO: 2492575 - DNA, 14 bp, Homo sapiens
aaataatcaaaagc

SEQ ID NO: 2492576 - DNA, 15 bp, Homo sapiens
aaataatcaaaagct

SEQ ID NO: 2492577 - DNA, 15 bp, Homo sapiens
aaataattgttgttc

SEQ ID NO: 2492578 - DNA, 14 bp, Homo sapiens
aaataattttgtaa

SEQ ID NO: 2492579 - DNA, 15 bp, Homo sapiens
aaatacaaaaatact

SEQ ID NO: 2492580 - DNA, 14 bp, Homo sapiens
aaatacaggaaaca

SEQ ID NO: 2492581 - DNA, 23 bp, Homo sapiens
aaatacagtcttccatttgcaag

SEQ ID NO: 2492582 - DNA, 23 bp, Homo sapiens
aaatactaatgaaaacagaatgt

SEQ ID NO: 2492583 - DNA, 19 bp, Homo sapiens
aaatacttttactctgcct

SEQ ID NO: 2492584 - DNA, 14 bp, Homo sapiens
aaatagaaaatggt

SEQ ID NO: 2492585 - DNA, 17 bp, Homo sapiens
aaatagacagcatgaga

SEQ ID NO: 2492586 - DNA, 17 bp, Homo sapiens
aaatagcgttcttgtaa

SEQ ID NO: 2492587 - DNA, 20 bp, Homo sapiens
aaatagggtatattttccta

SEQ ID NO: 2492588 - DNA, 14 bp, Homo sapiens
aaatatatattata

SEQ ID NO: 2492589 - DNA, 22 bp, Homo sapiens
aaatatatattatacttgtaat

SEQ ID NO: 2492590 - DNA, 19 bp, Homo sapiens
aaatatattattacttgta

SEQ ID NO: 2492591 - DNA, 23 bp, Homo sapiens
aaatatattattacttgtaaata

SEQ ID NO: 2492592 - DNA, 20 bp, Homo sapiens
aaatatgaagacataaaccc

SEQ ID NO: 2492593 - DNA, 15 bp, Homo sapiens
aaatatgatgttaaa

SEQ ID NO: 2492594 - DNA, 15 bp, Homo sapiens
aaatatggacactta

SEQ ID NO: 2492595 - DNA, 16 bp, Homo sapiens
aaatatggacacttaa

SEQ ID NO: 2492596 - DNA, 19 bp, Homo sapiens
aaatatggtcttttggtta

SEQ ID NO: 2492597 - DNA, 13 bp, Homo sapiens
aaatatgtaccaa

SEQ ID NO: 2492598 - DNA, 16 bp, Homo sapiens
aaatattatgagatgc

SEQ ID NO: 2492599 - DNA, 17 bp, Homo sapiens
aaatattatgagatgct

SEQ ID NO: 2492600 - DNA, 17 bp, Homo sapiens
aaatcaaaatctctcca

SEQ ID NO: 2492601 - DNA, 20 bp, Homo sapiens
aaatcaaaatctctccactt

SEQ ID NO: 2492602 - DNA, 13 bp, Homo sapiens
aaatcaaatgaat

SEQ ID NO: 2492603 - DNA, 18 bp, Homo sapiens
aaatcaagtatttgggaa

SEQ ID NO: 2492604 - DNA, 19 bp, Homo sapiens
aaatcacatattttaaaat

SEQ ID NO: 2492605 - DNA, 18 bp, Homo sapiens
aaatcagctattttgtga

SEQ ID NO: 2492606 - DNA, 20 bp, Homo sapiens
aaatcatcagaaaggaaaaa

SEQ ID NO: 2492607 - DNA, 17 bp, Homo sapiens
aaatctaccactgtatg

SEQ ID NO: 2492608 - DNA, 20 bp, Homo sapiens
aaatctcccattttggaatt

SEQ ID NO: 2492609 - DNA, 20 bp, Homo sapiens
aaatctgacccagtgccccc

SEQ ID NO: 2492610 - DNA, 11 bp, Homo sapiens
aaatctgccac

SEQ ID NO: 2492611 - DNA, 19 bp, Homo sapiens
aaatctgccacaaaaacag

SEQ ID NO: 2492612 - DNA, 20 bp, Homo sapiens
aaatctgctggagtttcatg

SEQ ID NO: 2492613 - DNA, 22 bp, Homo sapiens
aaatctgctggagtttcatgta

SEQ ID NO: 2492614 - DNA, 18 bp, Homo sapiens
aaatctggcttctggcca

SEQ ID NO: 2492615 - DNA, 16 bp, Homo sapiens
aaatcttatagttcta

SEQ ID NO: 2492616 - DNA, 17 bp, Homo sapiens
aaatcttatagttctag

SEQ ID NO: 2492617 - DNA, 14 bp, Homo sapiens
aaatcttgtcatgt

SEQ ID NO: 2492618 - DNA, 11 bp, Homo sapiens
aaatcttttac

SEQ ID NO: 2492619 - DNA, 13 bp, Homo sapiens
aaatgaaagctac

SEQ ID NO: 2492620 - DNA, 14 bp, Homo sapiens
aaatgaaagctact

SEQ ID NO: 2492621 - DNA, 21 bp, Homo sapiens
aaatgaacaagagaagcattc

SEQ ID NO: 2492622 - DNA, 23 bp, Homo sapiens
aaatgaatggaggaactttccaa

SEQ ID NO: 2492623 - DNA, 17 bp, Homo sapiens
aaatgacaatcatgtgt

SEQ ID NO: 2492624 - DNA, 19 bp, Homo sapiens
aagaagcccccagctaaga

SEQ ID NO: 2492625 - DNA, 17 bp, Homo sapiens
aagaagcccggctcctg

SEQ ID NO: 2492626 - DNA, 16 bp, Homo sapiens
aagaagccttaatttg

SEQ ID NO: 2492627 - DNA, 14 bp, Homo sapiens
aagaaggcaaaaat

SEQ ID NO: 2492628 - DNA, 22 bp, Homo sapiens
aagaatacttctcattttttaa

SEQ ID NO: 2492629 - DNA, 23 bp, Homo sapiens
aagaatagcattgtaaaagcatt

SEQ ID NO: 2492630 - DNA, 16 bp, Homo sapiens
aagaatatctggcaaa

SEQ ID NO: 2492631 - DNA, 17 bp, Homo sapiens
aagaatatctgtaatgg

SEQ ID NO: 2492632 - DNA, 20 bp, Homo sapiens
aagaatatctgtaatggtac

SEQ ID NO: 2492633 - DNA, 21 bp, Homo sapiens
aagaatcttggtttgccttcc

SEQ ID NO: 2492634 - DNA, 20 bp, Homo sapiens
aagaatgcacaagaatggat

SEQ ID NO: 2492635 - DNA, 17 bp, Homo sapiens
aagaatgcttaatcaga

SEQ ID NO: 2492636 - DNA, 11 bp, Homo sapiens
aagaattattt

SEQ ID NO: 2492637 - DNA, 17 bp, Homo sapiens
aagaattgagtaatggt

SEQ ID NO: 2492638 - DNA, 23 bp, Homo sapiens
aagaattgtggtttatatattta

SEQ ID NO: 2492639 - DNA, 21 bp, Homo sapiens
aagaattgttgggggtttttt

SEQ ID NO: 2492640 - DNA, 15 bp, Homo sapiens
aagacaaactttgca

SEQ ID NO: 2492641 - DNA, 15 bp, Homo sapiens
aagacatgatttcct

SEQ ID NO: 2492642 - DNA, 18 bp, Homo sapiens
aagaccctaaacatccat

SEQ ID NO: 2492643 - DNA, 20 bp, Homo sapiens
aagacccttttgggtttctg

SEQ ID NO: 2492644 - DNA, 20 bp, Homo sapiens
aagacctactgttctaaagc

SEQ ID NO: 2492645 - DNA, 15 bp, Homo sapiens
aagacgttttataag

SEQ ID NO: 2492646 - DNA, 17 bp, Homo sapiens
aagactatgaaaatgct

SEQ ID NO: 2492647 - DNA, 10 bp, Homo sapiens
aagactcatc

SEQ ID NO: 2492648 - DNA, 12 bp, Homo sapiens
aagactcatccg

SEQ ID NO: 2492649 - DNA, 15 bp, Homo sapiens
aagactctagagtcc

SEQ ID NO: 2492650 - DNA, 20 bp, Homo sapiens
aagactgctgtggccaggag

SEQ ID NO: 2492651 - DNA, 21 bp, Homo sapiens
aagactgctgtggccaggagg

SEQ ID NO: 2492652 - DNA, 20 bp, Homo sapiens
aagactggaagctaatttgc

SEQ ID NO: 2492653 - DNA, 22 bp, Homo sapiens
aagactggaagctaatttgcat

SEQ ID NO: 2492654 - DNA, 23 bp, Homo sapiens
aagactggaagctaatttgcatt

SEQ ID NO: 2492655 - DNA, 12 bp, Homo sapiens
aagacttgtttt

SEQ ID NO: 2492656 - DNA, 17 bp, Homo sapiens
aagagcagcacctcctc

SEQ ID NO: 2492657 - DNA, 20 bp, Homo sapiens
aagagcatcatgcctctgag

SEQ ID NO: 2492658 - DNA, 18 bp, Homo sapiens
aagagccttccacccagg

SEQ ID NO: 2492659 - DNA, 18 bp, Homo sapiens
aagagcgagagatcaaag

SEQ ID NO: 2492660 - DNA, 17 bp, Homo sapiens
aagaggaggggaagagg

SEQ ID NO: 2492661 - DNA, 21 bp, Homo sapiens
aagaggaggggaagaggcctg

SEQ ID NO: 2492662 - DNA, 18 bp, Homo sapiens
aagaggccgtggctgctg

SEQ ID NO: 2492663 - DNA, 15 bp, Homo sapiens
aagaggctgaggcct

SEQ ID NO: 2492664 - DNA, 18 bp, Homo sapiens
aagaggctgaggcctgga

SEQ ID NO: 2492665 - DNA, 22 bp, Homo sapiens
aagaggctgaggctggcacagg

SEQ ID NO: 2492666 - DNA, 19 bp, Homo sapiens
aagaggtgaccccagggca

SEQ ID NO: 2492667 - DNA, 13 bp, Homo sapiens
aagaggtgttatt

SEQ ID NO: 2492668 - DNA, 20 bp, Homo sapiens
aagagtagaaactgcaggga

SEQ ID NO: 2492669 - DNA, 14 bp, Homo sapiens
aagagtctaaagat

SEQ ID NO: 2492670 - DNA, 18 bp, Homo sapiens
aagagtgaattccctcac

SEQ ID NO: 2492671 - DNA, 14 bp, Homo sapiens
aagagttttgggag

SEQ ID NO: 2492672 - DNA, 17 bp, Homo sapiens
aagatctgtcctcagcc

SEQ ID NO: 2492673 - DNA, 18 bp, Homo sapiens
aagatctgtcctcagcct

SEQ ID NO: 2492674 - DNA, 20 bp, Homo sapiens
aagatctgtcctcagccttg

SEQ ID NO: 2492675 - DNA, 20 bp, Homo sapiens
aagatctgttttgaaggcaa

SEQ ID NO: 2492676 - DNA, 15 bp, Homo sapiens
aagatgactgagggt

SEQ ID NO: 2492677 - DNA, 15 bp, Homo sapiens
aagatgccacattca

SEQ ID NO: 2492678 - DNA, 22 bp, Homo sapiens
aagatgccacattcaaaatagg

SEQ ID NO: 2492679 - DNA, 12 bp, Homo sapiens
aagatgctttta

SEQ ID NO: 2492680 - DNA, 16 bp, Homo sapiens
aagatggagtttctaa

SEQ ID NO: 2492681 - DNA, 15 bp, Homo sapiens
aagatggcccatcct

SEQ ID NO: 2492682 - DNA, 19 bp, Homo sapiens
aagatgggcatcttttgta

SEQ ID NO: 2492683 - DNA, 22 bp, Homo sapiens
aagatgggcatcttttgtatta

SEQ ID NO: 2492684 - DNA, 18 bp, Homo sapiens
aagatgtgatattctaag

SEQ ID NO: 2492685 - DNA, 20 bp, Homo sapiens
aagatgtgatattctaagac

SEQ ID NO: 2492686 - DNA, 20 bp, Homo sapiens
aagatgttatggtgtttaga

SEQ ID NO: 2492687 - DNA, 15 bp, Homo sapiens
aagatgttctggata

SEQ ID NO: 2492688 - DNA, 24 bp, Homo sapiens
aagattccggatcctaagcatcta

SEQ ID NO: 2492689 - DNA, 13 bp, Homo sapiens
aagattctaaagg

SEQ ID NO: 2492690 - DNA, 14 bp, Homo sapiens
aagattctaatgat

SEQ ID NO: 2492691 - DNA, 11 bp, Homo sapiens
aagattctaga

SEQ ID NO: 2492692 - DNA, 12 bp, Homo sapiens
aagattctagat

SEQ ID NO: 2492693 - DNA, 20 bp, Homo sapiens
aagattctatagttctagac

SEQ ID NO: 2492694 - DNA, 22 bp, Homo sapiens
aagatttccttctttttttctt

SEQ ID NO: 2492695 - DNA, 20 bp, Homo sapiens
aagatttgtttttaaactgt

SEQ ID NO: 2492696 - DNA, 15 bp, Homo sapiens
aagcaaaaaagaaaa

SEQ ID NO: 2492697 - DNA, 21 bp, Homo sapiens
aagcaaaccgccctgcagcat

SEQ ID NO: 2492698 - DNA, 16 bp, Homo sapiens
aagcaaagcacagaga

SEQ ID NO: 2492699 - DNA, 13 bp, Homo sapiens
aagcaacatggct

SEQ ID NO: 2492700 - DNA, 15 bp, Homo sapiens
aagcaagcaagaggc

SEQ ID NO: 2492701 - DNA, 19 bp, Homo sapiens
aagcaagctgattaaatga

SEQ ID NO: 2492702 - DNA, 13 bp, Homo sapiens
aagcacctgtaat

SEQ ID NO: 2492703 - DNA, 12 bp, Homo sapiens
aagcagaaagtg

SEQ ID NO: 2492704 - DNA, 13 bp, Homo sapiens
aagcagaaagtgc

SEQ ID NO: 2492705 - DNA, 22 bp, Homo sapiens
aagcaggaaatgaaaatgtctt

SEQ ID NO: 2492706 - DNA, 19 bp, Homo sapiens
aagcaggtggatctatttc

SEQ ID NO: 2492707 - DNA, 15 bp, Homo sapiens
aagcaggttcttgtt

SEQ ID NO: 2492708 - DNA, 17 bp, Homo sapiens
aagcagtcgtgcctgtg

SEQ ID NO: 2492709 - DNA, 19 bp, Homo sapiens
aagcagtcgtgcctgtgtc

SEQ ID NO: 2492710 - DNA, 22 bp, Homo sapiens
aagcataaaagatgaaagagca

SEQ ID NO: 2492711 - DNA, 17 bp, Homo sapiens
aagcatcattatttatg

SEQ ID NO: 2492712 - DNA, 18 bp, Homo sapiens
aagcatcattatttatgt

SEQ ID NO: 2492713 - DNA, 21 bp, Homo sapiens
aagcatcattatttatgtatt

SEQ ID NO: 2492714 - DNA, 15 bp, Homo sapiens
aagcatggctatttt

SEQ ID NO: 2492715 - DNA, 15 bp, Homo sapiens
aagcattctcattgg

SEQ ID NO: 2492716 - DNA, 14 bp, Homo sapiens
aagcattgtaaaat

SEQ ID NO: 2492717 - DNA, 15 bp, Homo sapiens
aagcattgtaaaata

SEQ ID NO: 2492718 - DNA, 17 bp, Homo sapiens
aagcattgtaaaataat

SEQ ID NO: 2492719 - DNA, 23 bp, Homo sapiens
aagcatttaacccccctgtacac

SEQ ID NO: 2492720 - DNA, 17 bp, Homo sapiens
aagcattttgtaataat

SEQ ID NO: 2492721 - DNA, 12 bp, Homo sapiens
aagccaaagagt

SEQ ID NO: 2492722 - DNA, 19 bp, Homo sapiens
aagccaagggaacctgtgt

SEQ ID NO: 2492723 - DNA, 20 bp, Homo sapiens
aagccaagggaacctgtgtc

SEQ ID NO: 2492724 - DNA, 18 bp, Homo sapiens
aagccacttaaaatgttc

SEQ ID NO: 2492725 - DNA, 14 bp, Homo sapiens
aagccagaggctgg

SEQ ID NO: 2492726 - DNA, 17 bp, Homo sapiens
aagccagcgtcctcctc

SEQ ID NO: 2492727 - DNA, 20 bp, Homo sapiens
aagccagcgtcctcctctgt

SEQ ID NO: 2492728 - DNA, 19 bp, Homo sapiens
aagtttctaagattctaaa

SEQ ID NO: 2492729 - DNA, 13 bp, Homo sapiens
aagttttatatat

SEQ ID NO: 2492730 - DNA, 17 bp, Homo sapiens
aagttttatatattata

SEQ ID NO: 2492731 - DNA, 23 bp, Homo sapiens
aagttttatatattatatggaaa

SEQ ID NO: 2492732 - DNA, 13 bp, Homo sapiens
aataaaagaaaat

SEQ ID NO: 2492733 - DNA, 11 bp, Homo sapiens
aataaaatttg

SEQ ID NO: 2492734 - DNA, 13 bp, Homo sapiens
aataaaatttgtt

SEQ ID NO: 2492735 - DNA, 14 bp, Homo sapiens
aataaaatttgttg

SEQ ID NO: 2492736 - DNA, 17 bp, Homo sapiens
aataaaatttgttgcat

SEQ ID NO: 2492737 - DNA, 14 bp, Homo sapiens
aataaagaaaagat

SEQ ID NO: 2492738 - DNA, 16 bp, Homo sapiens
aataaaggatgtgatt

SEQ ID NO: 2492739 - DNA, 17 bp, Homo sapiens
aataaagtcagatggaa

SEQ ID NO: 2492740 - DNA, 18 bp, Homo sapiens
aataaagtgtaacaattg

SEQ ID NO: 2492741 - DNA, 19 bp, Homo sapiens
aataaataaggaaaagctt

SEQ ID NO: 2492742 - DNA, 14 bp, Homo sapiens
aataaatcttccta

SEQ ID NO: 2492743 - DNA, 11 bp, Homo sapiens
aataaatgtca

SEQ ID NO: 2492744 - DNA, 14 bp, Homo sapiens
aataaatgtcactt

SEQ ID NO: 2492745 - DNA, 14 bp, Homo sapiens
aataaatgtcttgc

SEQ ID NO: 2492746 - DNA, 22 bp, Homo sapiens
aataaattgatttttataaata

SEQ ID NO: 2492747 - DNA, 18 bp, Homo sapiens
aataacaaatgccaaatt

SEQ ID NO: 2492748 - DNA, 22 bp, Homo sapiens
aataacgtttaagccaaaacaa

SEQ ID NO: 2492749 - DNA, 18 bp, Homo sapiens
aataagaatagaaataaa

SEQ ID NO: 2492750 - DNA, 14 bp, Homo sapiens
aataagattctaac

SEQ ID NO: 2492751 - DNA, 14 bp, Homo sapiens
aataagcaggtgga

SEQ ID NO: 2492752 - DNA, 21 bp, Homo sapiens
aataagctatttgatgtaata

SEQ ID NO: 2492753 - DNA, 15 bp, Homo sapiens
aataaggaaaagctt

SEQ ID NO: 2492754 - DNA, 16 bp, Homo sapiens
aataaggcacccatct

SEQ ID NO: 2492755 - DNA, 18 bp, Homo sapiens
aataaggcacccatctgt

SEQ ID NO: 2492756 - DNA, 16 bp, Homo sapiens
aataagtcaacagtaa

SEQ ID NO: 2492757 - DNA, 22 bp, Homo sapiens
aataagtcaacagtaaaccact

SEQ ID NO: 2492758 - DNA, 17 bp, Homo sapiens
aataagtgccctctccc

SEQ ID NO: 2492759 - DNA, 19 bp, Homo sapiens
aataatgtacatctggcct

SEQ ID NO: 2492760 - DNA, 17 bp, Homo sapiens
aataatgtgcactgaat

SEQ ID NO: 2492761 - DNA, 20 bp, Homo sapiens
aataatgtgtagttcatgta

SEQ ID NO: 2492762 - DNA, 18 bp, Homo sapiens
aataattgttgttctgtt

SEQ ID NO: 2492763 - DNA, 13 bp, Homo sapiens
aatacaaatggat

SEQ ID NO: 2492764 - DNA, 15 bp, Homo sapiens
aatacagatatattt

SEQ ID NO: 2492765 - DNA, 22 bp, Homo sapiens
aatacatgctaagagaagtaga

SEQ ID NO: 2492766 - DNA, 16 bp, Homo sapiens
aatactaccttgaaaa

SEQ ID NO: 2492767 - DNA, 18 bp, Homo sapiens
aatactgctgagatacat

SEQ ID NO: 2492768 - DNA, 19 bp, Homo sapiens
aatacttcttgtgtgtatg

SEQ ID NO: 2492769 - DNA, 21 bp, Homo sapiens
aatacttcttgtgtgtatgca

SEQ ID NO: 2492770 - DNA, 14 bp, Homo sapiens
aatactttgaatgt

SEQ ID NO: 2492771 - DNA, 18 bp, Homo sapiens
aatacttttactctgcct

SEQ ID NO: 2492772 - DNA, 11 bp, Homo sapiens
aatacttttgc

SEQ ID NO: 2492773 - DNA, 14 bp, Homo sapiens
aatagaaaatggtc

SEQ ID NO: 2492774 - DNA, 15 bp, Homo sapiens
aatagaaaatggtcc

SEQ ID NO: 2492775 - DNA, 13 bp, Homo sapiens
aatagaacacagt

SEQ ID NO: 2492776 - DNA, 22 bp, Homo sapiens
aatagacactccccgaagtctt

SEQ ID NO: 2492777 - DNA, 16 bp, Homo sapiens
aatagacagcatgaga

SEQ ID NO: 2492778 - DNA, 14 bp, Homo sapiens
aatagagcctgagg

SEQ ID NO: 2492779 - DNA, 19 bp, Homo sapiens
aatagatatgaaagctgat

SEQ ID NO: 2492780 - DNA, 11 bp, Homo sapiens
aatagatgttt

SEQ ID NO: 2492781 - DNA, 19 bp, Homo sapiens
aatagcaaaagaagaagtt

SEQ ID NO: 2492782 - DNA, 18 bp, Homo sapiens
aatagcaaagaattgact

SEQ ID NO: 2492783 - DNA, 12 bp, Homo sapiens
aatagcatgtca

SEQ ID NO: 2492784 - DNA, 15 bp, Homo sapiens
aatagcatgtcacta

SEQ ID NO: 2492785 - DNA, 20 bp, Homo sapiens
aatagccactaaccttgcct

SEQ ID NO: 2492786 - DNA, 18 bp, Homo sapiens
aatagccatatttgtaaa

SEQ ID NO: 2492787 - DNA, 14 bp, Homo sapiens
aatagcgttcttgt

SEQ ID NO: 2492788 - DNA, 19 bp, Homo sapiens
aatagcgttcttgtaattt

SEQ ID NO: 2492789 - DNA, 17 bp, Homo sapiens
aatagcttatgaaaaga

SEQ ID NO: 2492790 - DNA, 15 bp, Homo sapiens
aatagctttaatgat

SEQ ID NO: 2492791 - DNA, 18 bp, Homo sapiens
aataggcggggcttgcct

SEQ ID NO: 2492792 - DNA, 18 bp, Homo sapiens
aatagggactatctatct

SEQ ID NO: 2492793 - DNA, 17 bp, Homo sapiens
aatagtcggtgaagaaa

SEQ ID NO: 2492794 - DNA, 22 bp, Homo sapiens
aatagttaagacatgatttcct

SEQ ID NO: 2492795 - DNA, 11 bp, Homo sapiens
aatagttcctg

SEQ ID NO: 2492796 - DNA, 12 bp, Homo sapiens
aatataaagacg

SEQ ID NO: 2492797 - DNA, 14 bp, Homo sapiens
aatataaatgcaaa

SEQ ID NO: 2492798 - DNA, 18 bp, Homo sapiens
aatataaatgcaaataac

SEQ ID NO: 2492799 - DNA, 20 bp, Homo sapiens
aatataaatgcaaataacaa

SEQ ID NO: 2492800 - DNA, 22 bp, Homo sapiens
aatataaatgcaaataacaaat

SEQ ID NO: 2492801 - DNA, 21 bp, Homo sapiens
aatatatattatacttgtaat

SEQ ID NO: 2492802 - DNA, 15 bp, Homo sapiens
aatatatattatctt

SEQ ID NO: 2492803 - DNA, 16 bp, Homo sapiens
aatatatgtatataca

SEQ ID NO: 2492804 - DNA, 13 bp, Homo sapiens
aatatattattac

SEQ ID NO: 2492805 - DNA, 20 bp, Homo sapiens
aatatattattacttgtaaa

SEQ ID NO: 2492806 - DNA, 14 bp, Homo sapiens
aatatatttaaaaa

SEQ ID NO: 2492807 - DNA, 19 bp, Homo sapiens
aatatattttgtttacaaa

SEQ ID NO: 2492808 - DNA, 16 bp, Homo sapiens
aatatccctacatgta

SEQ ID NO: 2492809 - DNA, 19 bp, Homo sapiens
aatatccctacatgtattg

SEQ ID NO: 2492810 - DNA, 18 bp, Homo sapiens
aatatcctaaacatcatt

SEQ ID NO: 2492811 - DNA, 12 bp, Homo sapiens
aatatctgaagc

SEQ ID NO: 2492812 - DNA, 17 bp, Homo sapiens
aatatcttcacttgtca

SEQ ID NO: 2492813 - DNA, 22 bp, Homo sapiens
aatatgcttaaaataagcaggt

SEQ ID NO: 2492814 - DNA, 23 bp, Homo sapiens
aatatgcttaaaataagcaggtg

SEQ ID NO: 2492815 - DNA, 18 bp, Homo sapiens
aatatggtcttttggtta

SEQ ID NO: 2492816 - DNA, 22 bp, Homo sapiens
aatattatgagatgctggcttg

SEQ ID NO: 2492817 - DNA, 17 bp, Homo sapiens
aatattgacttgtatat

SEQ ID NO: 2492818 - DNA, 16 bp, Homo sapiens
aatattttaaaatcag

SEQ ID NO: 2492819 - DNA, 20 bp, Homo sapiens
aatattttcctcctgagtgc

SEQ ID NO: 2492820 - DNA, 14 bp, Homo sapiens
aatattttcttttc

SEQ ID NO: 2492821 - DNA, 14 bp, Homo sapiens
aatattttgaatca

SEQ ID NO: 2492822 - DNA, 15 bp, Homo sapiens
aatattttgaatcaa

SEQ ID NO: 2492823 - DNA, 20 bp, Homo sapiens
aatattttgaatcaataata

SEQ ID NO: 2492824 - DNA, 14 bp, Homo sapiens
aatatttttagata

SEQ ID NO: 2492825 - DNA, 17 bp, Homo sapiens
aatcaaacattttctgg

SEQ ID NO: 2492826 - DNA, 22 bp, Homo sapiens
aatcaaatttgtagggtttcta

SEQ ID NO: 2492827 - DNA, 21 bp, Homo sapiens
aatcaacttgcttatcaactt

SEQ ID NO: 2492828 - DNA, 11 bp, Homo sapiens
aatcaacttta

SEQ ID NO: 2492829 - DNA, 15 bp, Homo sapiens
aatcaactttactgt

SEQ ID NO: 2492830 - DNA, 14 bp, Homo sapiens
aatcaagggtcagg

SEQ ID NO: 2492831 - DNA, 15 bp, Homo sapiens
aatcaagtctgttta

SEQ ID NO: 2492832 - DNA, 21 bp, Homo sapiens
aatcaagtctgtttactgcaa

SEQ ID NO: 2492833 - DNA, 15 bp, Homo sapiens
acaaatagaaaatgg

SEQ ID NO: 2492834 - DNA, 18 bp, Homo sapiens
acaaatgttaaaatgtgt

SEQ ID NO: 2492835 - DNA, 19 bp, Homo sapiens
acaaatgttaaaatgtgtt

SEQ ID NO: 2492836 - DNA, 23 bp, Homo sapiens
acaacactgtagtaaataatgct

SEQ ID NO: 2492837 - DNA, 14 bp, Homo sapiens
acaacatttctata

SEQ ID NO: 2492838 - DNA, 15 bp, Homo sapiens
acaaccactggtctg

SEQ ID NO: 2492839 - DNA, 14 bp, Homo sapiens
acaaccatgtcatt

SEQ ID NO: 2492840 - DNA, 22 bp, Homo sapiens
acaacgtgctctttgttttgtg

SEQ ID NO: 2492841 - DNA, 17 bp, Homo sapiens
acaactatggatcagaa

SEQ ID NO: 2492842 - DNA, 19 bp, Homo sapiens
acaactcactccttttaaa

SEQ ID NO: 2492843 - DNA, 14 bp, Homo sapiens
acaactcatacact

SEQ ID NO: 2492844 - DNA, 21 bp, Homo sapiens
acaactgcctcgaaacacaga

SEQ ID NO: 2492845 - DNA, 16 bp, Homo sapiens
acaactggcaggcagg

SEQ ID NO: 2492846 - DNA, 16 bp, Homo sapiens
acaagaaaaataaaga

SEQ ID NO: 2492847 - DNA, 23 bp, Homo sapiens
acaagaaaataagagctcaggat

SEQ ID NO: 2492848 - DNA, 17 bp, Homo sapiens
acaagaagcattttgta

SEQ ID NO: 2492849 - DNA, 18 bp, Homo sapiens
acaagaagcattttgtaa

SEQ ID NO: 2492850 - DNA, 20 bp, Homo sapiens
acaagaagccacagacctag

SEQ ID NO: 2492851 - DNA, 14 bp, Homo sapiens
acaagagaaaaagc

SEQ ID NO: 2492852 - DNA, 15 bp, Homo sapiens
acaagagaagcattc

SEQ ID NO: 2492853 - DNA, 17 bp, Homo sapiens
acaagagaagcattctc

SEQ ID NO: 2492854 - DNA, 20 bp, Homo sapiens
acaagcctctgcccaggcac

SEQ ID NO: 2492855 - DNA, 23 bp, Homo sapiens
acaagcctctgcccaggcactgc

SEQ ID NO: 2492856 - DNA, 22 bp, Homo sapiens
acaagcctgagggaaaggccag

SEQ ID NO: 2492857 - DNA, 14 bp, Homo sapiens
acaagctaaaatta

SEQ ID NO: 2492858 - DNA, 15 bp, Homo sapiens
acaaggacttcctgt

SEQ ID NO: 2492859 - DNA, 16 bp, Homo sapiens
acaaggatagatgctg

SEQ ID NO: 2492860 - DNA, 18 bp, Homo sapiens
acaaggcagcaaggcccg

SEQ ID NO: 2492861 - DNA, 22 bp, Homo sapiens
acaaggcagcaaggcccgagca

SEQ ID NO: 2492862 - DNA, 23 bp, Homo sapiens
acaagtcataggttaatatttaa

SEQ ID NO: 2492863 - DNA, 15 bp, Homo sapiens
acaagtggactcagg

SEQ ID NO: 2492864 - DNA, 15 bp, Homo sapiens
acaataactcctccc

SEQ ID NO: 2492865 - DNA, 16 bp, Homo sapiens
acaataactcctccca

SEQ ID NO: 2492866 - DNA, 19 bp, Homo sapiens
acaataactcctcccaggg

SEQ ID NO: 2492867 - DNA, 17 bp, Homo sapiens
acaatacagatcatctt

SEQ ID NO: 2492868 - DNA, 14 bp, Homo sapiens
acaatcatgtgtgt

SEQ ID NO: 2492869 - DNA, 18 bp, Homo sapiens
acaatgaaaactctttgc

SEQ ID NO: 2492870 - DNA, 15 bp, Homo sapiens
acaatgacaaagcag

SEQ ID NO: 2492871 - DNA, 16 bp, Homo sapiens
acaatgacatttatat

SEQ ID NO: 2492872 - DNA, 16 bp, Homo sapiens
acaatggaccggagag

SEQ ID NO: 2492873 - DNA, 23 bp, Homo sapiens
acaatggaccggagagtgggggt

SEQ ID NO: 2492874 - DNA, 13 bp, Homo sapiens
acaatgtaattat

SEQ ID NO: 2492875 - DNA, 15 bp, Homo sapiens
acaatgtaattattt

SEQ ID NO: 2492876 - DNA, 22 bp, Homo sapiens
acaattcctctactaacaatca

SEQ ID NO: 2492877 - DNA, 14 bp, Homo sapiens
acaattctaaaatg

SEQ ID NO: 2492878 - DNA, 17 bp, Homo sapiens
acaattctaaaatgatt

SEQ ID NO: 2492879 - DNA, 24 bp, Homo sapiens
acaattctaaaatgattgtagtaa

SEQ ID NO: 2492880 - DNA, 19 bp, Homo sapiens
acaattgaagtaaactttt

SEQ ID NO: 2492881 - DNA, 14 bp, Homo sapiens
acaattgtgtagcc

SEQ ID NO: 2492882 - DNA, 21 bp, Homo sapiens
acaattgtgtagcctttttgt

SEQ ID NO: 2492883 - DNA, 14 bp, Homo sapiens
acaatttggcaatt

SEQ ID NO: 2492884 - DNA, 22 bp, Homo sapiens
acaatttggcaattttgtggtt

SEQ ID NO: 2492885 - DNA, 24 bp, Homo sapiens
acaattttttttattagtattgtt

SEQ ID NO: 2492886 - DNA, 16 bp, Homo sapiens
acacaaactgtaaata

SEQ ID NO: 2492887 - DNA, 17 bp, Homo sapiens
acacaagattggtgttt

SEQ ID NO: 2492888 - DNA, 22 bp, Homo sapiens
acacacgtgcgtgcgagcacac

SEQ ID NO: 2492889 - DNA, 18 bp, Homo sapiens
acacagcattgtatatgt

SEQ ID NO: 2492890 - DNA, 16 bp, Homo sapiens
acacagcttgtctctt

SEQ ID NO: 2492891 - DNA, 17 bp, Homo sapiens
acacagcttgtctcttg

SEQ ID NO: 2492892 - DNA, 18 bp, Homo sapiens
acacaggcatttcctggg

SEQ ID NO: 2492893 - DNA, 23 bp, Homo sapiens
acacaggcatttcctgggtggct

SEQ ID NO: 2492894 - DNA, 11 bp, Homo sapiens
acacagggcag

SEQ ID NO: 2492895 - DNA, 16 bp, Homo sapiens
acacaggggcttgact

SEQ ID NO: 2492896 - DNA, 19 bp, Homo sapiens
acacagtaccatttaatgg

SEQ ID NO: 2492897 - DNA, 22 bp, Homo sapiens
acacatactcatttttcatgat

SEQ ID NO: 2492898 - DNA, 15 bp, Homo sapiens
acacattttttagga

SEQ ID NO: 2492899 - DNA, 14 bp, Homo sapiens
acaccaaagttcta

SEQ ID NO: 2492900 - DNA, 15 bp, Homo sapiens
acaccaaagttctaa

SEQ ID NO: 2492901 - DNA, 17 bp, Homo sapiens
acaccaacataaaaatg

SEQ ID NO: 2492902 - DNA, 18 bp, Homo sapiens
acaccaacataaaaatga

SEQ ID NO: 2492903 - DNA, 13 bp, Homo sapiens
acaccactctggc

SEQ ID NO: 2492904 - DNA, 15 bp, Homo sapiens
acaccatgattcctt

SEQ ID NO: 2492905 - DNA, 18 bp, Homo sapiens
acaccatgattcctttaa

SEQ ID NO: 2492906 - DNA, 17 bp, Homo sapiens
acaccattgaaggctta

SEQ ID NO: 2492907 - DNA, 17 bp, Homo sapiens
acacctaccctcctttt

SEQ ID NO: 2492908 - DNA, 20 bp, Homo sapiens
acaccttggacatcctcctc

SEQ ID NO: 2492909 - DNA, 22 bp, Homo sapiens
acaccttggacatcctcctccc

SEQ ID NO: 2492910 - DNA, 23 bp, Homo sapiens
acaccttggacatcctcctccca

SEQ ID NO: 2492911 - DNA, 15 bp, Homo sapiens
acacctttaggttct

SEQ ID NO: 2492912 - DNA, 16 bp, Homo sapiens
acacctttaggttctt

SEQ ID NO: 2492913 - DNA, 13 bp, Homo sapiens
acacgcacctgcc

SEQ ID NO: 2492914 - DNA, 17 bp, Homo sapiens
acacgcacctgcctcag

SEQ ID NO: 2492915 - DNA, 14 bp, Homo sapiens
acacgcttttgtga

SEQ ID NO: 2492916 - DNA, 12 bp, Homo sapiens
acacggccacat

SEQ ID NO: 2492917 - DNA, 23 bp, Homo sapiens
acacggtcggggcatctggcctg

SEQ ID NO: 2492918 - DNA, 22 bp, Homo sapiens
acactaaccaagctgagtttcc

SEQ ID NO: 2492919 - DNA, 14 bp, Homo sapiens
acactaatatattt

SEQ ID NO: 2492920 - DNA, 16 bp, Homo sapiens
acactagacaagccag

SEQ ID NO: 2492921 - DNA, 20 bp, Homo sapiens
acactcagaagcctgggggc

SEQ ID NO: 2492922 - DNA, 14 bp, Homo sapiens
acactcagacctga

SEQ ID NO: 2492923 - DNA, 16 bp, Homo sapiens
acactcagcacaaggc

SEQ ID NO: 2492924 - DNA, 22 bp, Homo sapiens
acactcagtggcccatggcatt

SEQ ID NO: 2492925 - DNA, 16 bp, Homo sapiens
acactctttgtaagag

SEQ ID NO: 2492926 - DNA, 16 bp, Homo sapiens
acactgcacaataact

SEQ ID NO: 2492927 - DNA, 17 bp, Homo sapiens
acactggggacttggcc

SEQ ID NO: 2492928 - DNA, 22 bp, Homo sapiens
acactggggacttggcctctct

SEQ ID NO: 2492929 - DNA, 16 bp, Homo sapiens
acactggtctgctgtc

SEQ ID NO: 2492930 - DNA, 20 bp, Homo sapiens
acactggtctgctgttccag

SEQ ID NO: 2492931 - DNA, 22 bp, Homo sapiens
acactgtagtaaataatgcttt

SEQ ID NO: 2492932 - DNA, 18 bp, Homo sapiens
acactgtgcacatctgtg

SEQ ID NO: 2492933 - DNA, 18 bp, Homo sapiens
acactgtgtactgcagtt

SEQ ID NO: 2492934 - DNA, 23 bp, Homo sapiens
acactgttcttagctcaatgagc

SEQ ID NO: 2492935 - DNA, 14 bp, Homo sapiens
acacttctcaggac

SEQ ID NO: 2492936 - DNA, 22 bp, Homo sapiens
acacttctcaggacacaggcct

SEQ ID NO: 2492937 - DNA, 23 bp, Homo sapiens
acccacatgccatttgtactgac

SEQ ID NO: 2492938 - DNA, 15 bp, Homo sapiens
acccacccctgcaca

SEQ ID NO: 2492939 - DNA, 17 bp, Homo sapiens
acccacttctgcacttg

SEQ ID NO: 2492940 - DNA, 15 bp, Homo sapiens
acccagacataaagg

SEQ ID NO: 2492941 - DNA, 15 bp, Homo sapiens
acccagactcagaca

SEQ ID NO: 2492942 - DNA, 13 bp, Homo sapiens
acccagccaggcc

SEQ ID NO: 2492943 - DNA, 18 bp, Homo sapiens
acccagccaggcccagcc

SEQ ID NO: 2492944 - DNA, 15 bp, Homo sapiens
acccagcggacacac

SEQ ID NO: 2492945 - DNA, 17 bp, Homo sapiens
acccaggacaagcatgg

SEQ ID NO: 2492946 - DNA, 23 bp, Homo sapiens
acccaggacttatttaaactctg

SEQ ID NO: 2492947 - DNA, 18 bp, Homo sapiens
acccaggctggagtgcag

SEQ ID NO: 2492948 - DNA, 19 bp, Homo sapiens
acccaggctggagtgcagt

SEQ ID NO: 2492949 - DNA, 13 bp, Homo sapiens
acccagggctctg

SEQ ID NO: 2492950 - DNA, 17 bp, Homo sapiens
acccaggttaagaaaat

SEQ ID NO: 2492951 - DNA, 18 bp, Homo sapiens
acccagtgcccccactga

SEQ ID NO: 2492952 - DNA, 15 bp, Homo sapiens
acccagtgccctctc

SEQ ID NO: 2492953 - DNA, 18 bp, Homo sapiens
acccagttgccatctgcg

SEQ ID NO: 2492954 - DNA, 22 bp, Homo sapiens
acccagtttctaaactggagac

SEQ ID NO: 2492955 - DNA, 23 bp, Homo sapiens
acccatatccttaccctccttgg

SEQ ID NO: 2492956 - DNA, 21 bp, Homo sapiens
acccatgagttggggtctggc

SEQ ID NO: 2492957 - DNA, 13 bp, Homo sapiens
acccattccttcc

SEQ ID NO: 2492958 - DNA, 16 bp, Homo sapiens
acccattccttcccag

SEQ ID NO: 2492959 - DNA, 17 bp, Homo sapiens
acccatttttccttttg

SEQ ID NO: 2492960 - DNA, 20 bp, Homo sapiens
accccaaacaccttccagct

SEQ ID NO: 2492961 - DNA, 17 bp, Homo sapiens
accccaaagctttcctg

SEQ ID NO: 2492962 - DNA, 20 bp, Homo sapiens
accccaacctgctctcctct

SEQ ID NO: 2492963 - DNA, 13 bp, Homo sapiens
accccactcccac

SEQ ID NO: 2492964 - DNA, 19 bp, Homo sapiens
accccagactagatgtagt

SEQ ID NO: 2492965 - DNA, 22 bp, Homo sapiens
accccagggctgtaactgccag

SEQ ID NO: 2492966 - DNA, 12 bp, Homo sapiens
acccccagcctg

SEQ ID NO: 2492967 - DNA, 15 bp, Homo sapiens
acccccagcctgggc

SEQ ID NO: 2492968 - DNA, 17 bp, Homo sapiens
acccccagcctgggcct

SEQ ID NO: 2492969 - DNA, 15 bp, Homo sapiens
acccccaggaccaga

SEQ ID NO: 2492970 - DNA, 15 bp, Homo sapiens
acccccggcagcagc

SEQ ID NO: 2492971 - DNA, 13 bp, Homo sapiens
accccctcacccc

SEQ ID NO: 2492972 - DNA, 12 bp, Homo sapiens
accccctgcagc

SEQ ID NO: 2492973 - DNA, 19 bp, Homo sapiens
acccccttctccatccaca

SEQ ID NO: 2492974 - DNA, 17 bp, Homo sapiens
accccgcagacaccttg

SEQ ID NO: 2492975 - DNA, 14 bp, Homo sapiens
accccgcctgccct

SEQ ID NO: 2492976 - DNA, 21 bp, Homo sapiens
accccggggtgcccacaggcc

SEQ ID NO: 2492977 - DNA, 13 bp, Homo sapiens
acccctttcccac

SEQ ID NO: 2492978 - DNA, 20 bp, Homo sapiens
acccggcaccccctgcagct

SEQ ID NO: 2492979 - DNA, 13 bp, Homo sapiens
acccggctaattt

SEQ ID NO: 2492980 - DNA, 14 bp, Homo sapiens
acccggctgcagag

SEQ ID NO: 2492981 - DNA, 16 bp, Homo sapiens
accctaaatcttgact

SEQ ID NO: 2492982 - DNA, 23 bp, Homo sapiens
accctatattttgcatagtacca

SEQ ID NO: 2492983 - DNA, 19 bp, Homo sapiens
accctcactggctctcctg

SEQ ID NO: 2492984 - DNA, 11 bp, Homo sapiens
accctcctggc

SEQ ID NO: 2492985 - DNA, 19 bp, Homo sapiens
accctcggggatgtgtcct

SEQ ID NO: 2492986 - DNA, 21 bp, Homo sapiens
accctctgttccttccctgtg

SEQ ID NO: 2492987 - DNA, 13 bp, Homo sapiens
accctcttcatgg

SEQ ID NO: 2492988 - DNA, 16 bp, Homo sapiens
accctcttcctactgg

SEQ ID NO: 2492989 - DNA, 12 bp, Homo sapiens
accctgagccgg

SEQ ID NO: 2492990 - DNA, 14 bp, Homo sapiens
accctgaggagtct

SEQ ID NO: 2492991 - DNA, 19 bp, Homo sapiens
accctgaggagtctgaggt

SEQ ID NO: 2492992 - DNA, 22 bp, Homo sapiens
accctgaggagtctgaggtcct

SEQ ID NO: 2492993 - DNA, 16 bp, Homo sapiens
accctgagttgctttt

SEQ ID NO: 2492994 - DNA, 19 bp, Homo sapiens
accctgataggaagagggg

SEQ ID NO: 2492995 - DNA, 14 bp, Homo sapiens
accctggacccagc

SEQ ID NO: 2492996 - DNA, 17 bp, Homo sapiens
accctggaggcacctgg

SEQ ID NO: 2492997 - DNA, 20 bp, Homo sapiens
accctggaggcacctggtgg

SEQ ID NO: 2492998 - DNA, 22 bp, Homo sapiens
accctggccgagtccaagctgg

SEQ ID NO: 2492999 - DNA, 16 bp, Homo sapiens
accctggccgccccct

SEQ ID NO: 2493000 - DNA, 17 bp, Homo sapiens
accctggccgccccctg

SEQ ID NO: 2493001 - DNA, 23 bp, Homo sapiens
accctggcctagaccagcagaca

SEQ ID NO: 2493002 - DNA, 22 bp, Homo sapiens
accctgtactgttctgtgtctt

SEQ ID NO: 2493003 - DNA, 11 bp, Homo sapiens
accctgtcctc

SEQ ID NO: 2493004 - DNA, 21 bp, Homo sapiens
accctgtctgccccgccctca

SEQ ID NO: 2493005 - DNA, 17 bp, Homo sapiens
accctgtggtcttcctc

SEQ ID NO: 2493006 - DNA, 21 bp, Homo sapiens
accctgttcctgctgctgtct

SEQ ID NO: 2493007 - DNA, 19 bp, Homo sapiens
acccttacagtaggagccc

SEQ ID NO: 2493008 - DNA, 22 bp, Homo sapiens
acccttcccctccttctccctt

SEQ ID NO: 2493009 - DNA, 17 bp, Homo sapiens
acccttctcccactctc

SEQ ID NO: 2493010 - DNA, 18 bp, Homo sapiens
acccttctcccactctcc

SEQ ID NO: 2493011 - DNA, 16 bp, Homo sapiens
acccttgggccagaag

SEQ ID NO: 2493012 - DNA, 18 bp, Homo sapiens
acccttgggccagaagta

SEQ ID NO: 2493013 - DNA, 20 bp, Homo sapiens
acccttgggccagaagtacc

SEQ ID NO: 2493014 - DNA, 13 bp, Homo sapiens
accgaagcccaga

SEQ ID NO: 2493015 - DNA, 19 bp, Homo sapiens
accgaatgtgtctttagat

SEQ ID NO: 2493016 - DNA, 22 bp, Homo sapiens
accgaatgtgtctttagatagc

SEQ ID NO: 2493017 - DNA, 12 bp, Homo sapiens
accgccagctct

SEQ ID NO: 2493018 - DNA, 16 bp, Homo sapiens
accgccagctctgttc

SEQ ID NO: 2493019 - DNA, 23 bp, Homo sapiens
accgcccagcggcttgcctgcct

SEQ ID NO: 2493020 - DNA, 19 bp, Homo sapiens
accgccccctcctctagct

SEQ ID NO: 2493021 - DNA, 16 bp, Homo sapiens
accgcgactaatttca

SEQ ID NO: 2493022 - DNA, 21 bp, Homo sapiens
accgctacaccactctggcag

SEQ ID NO: 2493023 - DNA, 18 bp, Homo sapiens
accggaccagcctggccc

SEQ ID NO: 2493024 - DNA, 21 bp, Homo sapiens
accggctctcacctggccctg

SEQ ID NO: 2493025 - DNA, 19 bp, Homo sapiens
accgggccactccttcctg

SEQ ID NO: 2493026 - DNA, 13 bp, Homo sapiens
accgttgtctcat

SEQ ID NO: 2493027 - DNA, 22 bp, Homo sapiens
acctaaaaggaaatctcacccc

SEQ ID NO: 2493028 - DNA, 12 bp, Homo sapiens
acctaaagaaaa

SEQ ID NO: 2493029 - DNA, 13 bp, Homo sapiens
acctaaagaaaaa

SEQ ID NO: 2493030 - DNA, 15 bp, Homo sapiens
acctaaatggcctca

SEQ ID NO: 2493031 - DNA, 20 bp, Homo sapiens
acctaatccaggcagatcca

SEQ ID NO: 2493032 - DNA, 23 bp, Homo sapiens
acctacagggggtctggctggtg

SEQ ID NO: 2493033 - DNA, 17 bp, Homo sapiens
acctacagttttaactg

SEQ ID NO: 2493034 - DNA, 18 bp, Homo sapiens
acctacagttttaactgt

SEQ ID NO: 2493035 - DNA, 18 bp, Homo sapiens
acctactgttctaaagct

SEQ ID NO: 2493036 - DNA, 20 bp, Homo sapiens
acctactgttctaaagctct

SEQ ID NO: 2493037 - DNA, 21 bp, Homo sapiens
acctactgttctaaagctctg

SEQ ID NO: 2493038 - DNA, 13 bp, Homo sapiens
acctagatttaat

SEQ ID NO: 2493039 - DNA, 21 bp, Homo sapiens
acctagcagcaccgttctgtg

SEQ ID NO: 2493040 - DNA, 22 bp, Homo sapiens
acctagcagcaccgttctgtgc

SEQ ID NO: 2493041 - DNA, 20 bp, Homo sapiens
actgaacaccattgaaggct

SEQ ID NO: 2493042 - DNA, 21 bp, Homo sapiens
actgaacaccattgaaggctt

SEQ ID NO: 2493043 - DNA, 22 bp, Homo sapiens
actgaacaccattgaaggctta

SEQ ID NO: 2493044 - DNA, 20 bp, Homo sapiens
actgaacatctgagtcctgg

SEQ ID NO: 2493045 - DNA, 21 bp, Homo sapiens
actgaagcagcctctccccag

SEQ ID NO: 2493046 - DNA, 17 bp, Homo sapiens
actgaagtgcttagtgt

SEQ ID NO: 2493047 - DNA, 23 bp, Homo sapiens
actgaataaattgtacagccggc

SEQ ID NO: 2493048 - DNA, 14 bp, Homo sapiens
actgaataccactc

SEQ ID NO: 2493049 - DNA, 18 bp, Homo sapiens
actgacaagccatcttga

SEQ ID NO: 2493050 - DNA, 18 bp, Homo sapiens
actgacatgtggggccag

SEQ ID NO: 2493051 - DNA, 22 bp, Homo sapiens
actgacatgtggggccaggtca

SEQ ID NO: 2493052 - DNA, 12 bp, Homo sapiens
actgaccagaac

SEQ ID NO: 2493053 - DNA, 23 bp, Homo sapiens
actgactattcttgatgtaaaat

SEQ ID NO: 2493054 - DNA, 13 bp, Homo sapiens
actgactttgctt

SEQ ID NO: 2493055 - DNA, 23 bp, Homo sapiens
actgactttgcttgctttgaagt

SEQ ID NO: 2493056 - DNA, 18 bp, Homo sapiens
actgagataccagcgagg

SEQ ID NO: 2493057 - DNA, 19 bp, Homo sapiens
actgagataccagcgagga

SEQ ID NO: 2493058 - DNA, 21 bp, Homo sapiens
actgagcaacgctattccagc

SEQ ID NO: 2493059 - DNA, 15 bp, Homo sapiens
actgagtgggaagcc

SEQ ID NO: 2493060 - DNA, 18 bp, Homo sapiens
actgagttttccatggca

SEQ ID NO: 2493061 - DNA, 14 bp, Homo sapiens
actgatctcgtttt

SEQ ID NO: 2493062 - DNA, 20 bp, Homo sapiens
actgatgctgcccctcatct

SEQ ID NO: 2493063 - DNA, 12 bp, Homo sapiens
actgatttcaga

SEQ ID NO: 2493064 - DNA, 18 bp, Homo sapiens
actgcaaatcaggctttt

SEQ ID NO: 2493065 - DNA, 20 bp, Homo sapiens
actgcaaatcaggcttttgt

SEQ ID NO: 2493066 - DNA, 12 bp, Homo sapiens
actgcaggccct

SEQ ID NO: 2493067 - DNA, 13 bp, Homo sapiens
actgcaggccctg

SEQ ID NO: 2493068 - DNA, 18 bp, Homo sapiens
actgcaggccctggcctc

SEQ ID NO: 2493069 - DNA, 19 bp, Homo sapiens
actgcaggccctggcctcc

SEQ ID NO: 2493070 - DNA, 14 bp, Homo sapiens
actgcatgcccaga

SEQ ID NO: 2493071 - DNA, 17 bp, Homo sapiens
actgcatgcccagagac

SEQ ID NO: 2493072 - DNA, 16 bp, Homo sapiens
actgccaagactgctg

SEQ ID NO: 2493073 - DNA, 14 bp, Homo sapiens
actgccaggctctc

SEQ ID NO: 2493074 - DNA, 18 bp, Homo sapiens
actgccaggctctctttg

SEQ ID NO: 2493075 - DNA, 16 bp, Homo sapiens
actgccatattaaatt

SEQ ID NO: 2493076 - DNA, 17 bp, Homo sapiens
actgcccaggcactgca

SEQ ID NO: 2493077 - DNA, 21 bp, Homo sapiens
actgcccatggacaggctggc

SEQ ID NO: 2493078 - DNA, 18 bp, Homo sapiens
actgccccctgctgccat

SEQ ID NO: 2493079 - DNA, 14 bp, Homo sapiens
actgcctagaaaca

SEQ ID NO: 2493080 - DNA, 16 bp, Homo sapiens
actgcctagaaacaac

SEQ ID NO: 2493081 - DNA, 21 bp, Homo sapiens
actgcctagaaacaacactgt

SEQ ID NO: 2493082 - DNA, 17 bp, Homo sapiens
actgcctcgaaacacag

SEQ ID NO: 2493083 - DNA, 9 bp, Homo sapiens
actgcctgc

SEQ ID NO: 2493084 - DNA, 15 bp, Homo sapiens
actgccttcgcttct

SEQ ID NO: 2493085 - DNA, 16 bp, Homo sapiens
actgccttcgcttctt

SEQ ID NO: 2493086 - DNA, 17 bp, Homo sapiens
actgcgactttctgcct

SEQ ID NO: 2493087 - DNA, 22 bp, Homo sapiens
actgcgactttctgcctggagt

SEQ ID NO: 2493088 - DNA, 23 bp, Homo sapiens
actgcgactttctgcctggagtg

SEQ ID NO: 2493089 - DNA, 15 bp, Homo sapiens
actgctaaataaaat

SEQ ID NO: 2493090 - DNA, 17 bp, Homo sapiens
actgctaaataaaattt

SEQ ID NO: 2493091 - DNA, 19 bp, Homo sapiens
actgctaaataaaatttgt

SEQ ID NO: 2493092 - DNA, 16 bp, Homo sapiens
actgctcccacctcct

SEQ ID NO: 2493093 - DNA, 18 bp, Homo sapiens
actgctcccacctcctga

SEQ ID NO: 2493094 - DNA, 18 bp, Homo sapiens
actgctctaacagccctc

SEQ ID NO: 2493095 - DNA, 13 bp, Homo sapiens
actgctctgagaa

SEQ ID NO: 2493096 - DNA, 22 bp, Homo sapiens
actgctgagatacatacagaat

SEQ ID NO: 2493097 - DNA, 22 bp, Homo sapiens
actgctggagaggccccagccg

SEQ ID NO: 2493098 - DNA, 14 bp, Homo sapiens
actgctgtggccag

SEQ ID NO: 2493099 - DNA, 15 bp, Homo sapiens
actgctgtggccagg

SEQ ID NO: 2493100 - DNA, 16 bp, Homo sapiens
actgctgtggccagga

SEQ ID NO: 2493101 - DNA, 16 bp, Homo sapiens
actgcttggagctgag

SEQ ID NO: 2493102 - DNA, 18 bp, Homo sapiens
actgctttctgttccaaa

SEQ ID NO: 2493103 - DNA, 18 bp, Homo sapiens
actggaaaacagaacact

SEQ ID NO: 2493104 - DNA, 19 bp, Homo sapiens
actggaaaacagaacactt

SEQ ID NO: 2493105 - DNA, 22 bp, Homo sapiens
actggaacactagacaagccag

SEQ ID NO: 2493106 - DNA, 12 bp, Homo sapiens
actggagcacaa

SEQ ID NO: 2493107 - DNA, 15 bp, Homo sapiens
actggagcagaaggg

SEQ ID NO: 2493108 - DNA, 22 bp, Homo sapiens
actggagtgtgcgtggtggtcc

SEQ ID NO: 2493109 - DNA, 14 bp, Homo sapiens
actggccaagctga

SEQ ID NO: 2493110 - DNA, 16 bp, Homo sapiens
actggccaagctgagg

SEQ ID NO: 2493111 - DNA, 19 bp, Homo sapiens
actggccaagctgaggtgc

SEQ ID NO: 2493112 - DNA, 21 bp, Homo sapiens
actggccaagctgaggtgccc

SEQ ID NO: 2493113 - DNA, 16 bp, Homo sapiens
actggccatggcctgc

SEQ ID NO: 2493114 - DNA, 21 bp, Homo sapiens
actggccatggcctgcaaact

SEQ ID NO: 2493115 - DNA, 17 bp, Homo sapiens
actggcctcaaagcaag

SEQ ID NO: 2493116 - DNA, 15 bp, Homo sapiens
actggctctcctggc

SEQ ID NO: 2493117 - DNA, 14 bp, Homo sapiens
actggcttttatta

SEQ ID NO: 2493118 - DNA, 15 bp, Homo sapiens
actgggagcccccag

SEQ ID NO: 2493119 - DNA, 12 bp, Homo sapiens
actgggaggctc

SEQ ID NO: 2493120 - DNA, 15 bp, Homo sapiens
actggggacttggcc

SEQ ID NO: 2493121 - DNA, 22 bp, Homo sapiens
actgggtggtggcctggtccct

SEQ ID NO: 2493122 - DNA, 13 bp, Homo sapiens
actggtctgctgt

SEQ ID NO: 2493123 - DNA, 21 bp, Homo sapiens
actggtgttatcaccgtgggc

SEQ ID NO: 2493124 - DNA, 14 bp, Homo sapiens
actggttttcacat

SEQ ID NO: 2493125 - DNA, 16 bp, Homo sapiens
actgtaaaatgtggga

SEQ ID NO: 2493126 - DNA, 13 bp, Homo sapiens
actgtaaagatgt

SEQ ID NO: 2493127 - DNA, 15 bp, Homo sapiens
actgtaacattcagg

SEQ ID NO: 2493128 - DNA, 18 bp, Homo sapiens
actgtaatataaagtatt

SEQ ID NO: 2493129 - DNA, 13 bp, Homo sapiens
actgtacagctgg

SEQ ID NO: 2493130 - DNA, 15 bp, Homo sapiens
actgtaggcacactt

SEQ ID NO: 2493131 - DNA, 18 bp, Homo sapiens
actgtagtaaataatgct

SEQ ID NO: 2493132 - DNA, 19 bp, Homo sapiens
actgtagtaaataatgctt

SEQ ID NO: 2493133 - DNA, 14 bp, Homo sapiens
actgtcctgggcct

SEQ ID NO: 2493134 - DNA, 17 bp, Homo sapiens
actgtcgctgcttcgtg

SEQ ID NO: 2493135 - DNA, 22 bp, Homo sapiens
actgtctccatggccctgcaaa

SEQ ID NO: 2493136 - DNA, 19 bp, Homo sapiens
actgtctggcccccctggt

SEQ ID NO: 2493137 - DNA, 22 bp, Homo sapiens
actgtctggggagcgggtctgc

SEQ ID NO: 2493138 - DNA, 19 bp, Homo sapiens
actgtgacccccagctccg

SEQ ID NO: 2493139 - DNA, 15 bp, Homo sapiens
actgtgcacatctgt

SEQ ID NO: 2493140 - DNA, 20 bp, Homo sapiens
actgtgcacatctgtgtctt

SEQ ID NO: 2493141 - DNA, 22 bp, Homo sapiens
actgtgcctcagagaccagggc

SEQ ID NO: 2493142 - DNA, 23 bp, Homo sapiens
actgtgcctcagagaccagggct

SEQ ID NO: 2493143 - DNA, 14 bp, Homo sapiens
actgtgtaactgcc

SEQ ID NO: 2493144 - DNA, 18 bp, Homo sapiens
actgtgtgtgtgaatgaa

SEQ ID NO: 2493145 - DNA, 14 bp, Homo sapiens
agactgacgccagg

SEQ ID NO: 2493146 - DNA, 16 bp, Homo sapiens
agactgctgtggccag

SEQ ID NO: 2493147 - DNA, 21 bp, Homo sapiens
agactgctgtggccaggaggt

SEQ ID NO: 2493148 - DNA, 21 bp, Homo sapiens
agactggaagctaatttgcat

SEQ ID NO: 2493149 - DNA, 18 bp, Homo sapiens
agactgtctggcccccct

SEQ ID NO: 2493150 - DNA, 17 bp, Homo sapiens
agactgtgattcagaaa

SEQ ID NO: 2493151 - DNA, 16 bp, Homo sapiens
agactgtgtgtgccct

SEQ ID NO: 2493152 - DNA, 17 bp, Homo sapiens
agactgtgtgtgccctc

SEQ ID NO: 2493153 - DNA, 19 bp, Homo sapiens
agactgtgtgtgccctctg

SEQ ID NO: 2493154 - DNA, 20 bp, Homo sapiens
agactgtgtgtgccctctgg

SEQ ID NO: 2493155 - DNA, 23 bp, Homo sapiens
agacttacagggataaggcctgt

SEQ ID NO: 2493156 - DNA, 14 bp, Homo sapiens
agacttactctaag

SEQ ID NO: 2493157 - DNA, 16 bp, Homo sapiens
agacttagggcaccag

SEQ ID NO: 2493158 - DNA, 19 bp, Homo sapiens
agacttcaagcatggctat

SEQ ID NO: 2493159 - DNA, 14 bp, Homo sapiens
agacttcccagcta

SEQ ID NO: 2493160 - DNA, 19 bp, Homo sapiens
agacttctctttgcctcaa

SEQ ID NO: 2493161 - DNA, 20 bp, Homo sapiens
agacttctctttgcctcaaa

SEQ ID NO: 2493162 - DNA, 15 bp, Homo sapiens
agacttggattcttt

SEQ ID NO: 2493163 - DNA, 21 bp, Homo sapiens
agacttggattctttccattt

SEQ ID NO: 2493164 - DNA, 15 bp, Homo sapiens
agactttccattaca

SEQ ID NO: 2493165 - DNA, 17 bp, Homo sapiens
agagaaaccagcttcct

SEQ ID NO: 2493166 - DNA, 19 bp, Homo sapiens
agagaaaccagcttccttc

SEQ ID NO: 2493167 - DNA, 20 bp, Homo sapiens
agagaaaccagcttccttca

SEQ ID NO: 2493168 - DNA, 23 bp, Homo sapiens
agagaaaggggagcccactgtcc

SEQ ID NO: 2493169 - DNA, 14 bp, Homo sapiens
agagaacccagccc

SEQ ID NO: 2493170 - DNA, 14 bp, Homo sapiens
agagaagacaggct

SEQ ID NO: 2493171 - DNA, 16 bp, Homo sapiens
agagaagacaggctgg

SEQ ID NO: 2493172 - DNA, 11 bp, Homo sapiens
agagaagccag

SEQ ID NO: 2493173 - DNA, 14 bp, Homo sapiens
agagaagccagctt

SEQ ID NO: 2493174 - DNA, 22 bp, Homo sapiens
agagaagccatcacctcagatg

SEQ ID NO: 2493175 - DNA, 14 bp, Homo sapiens
agagaagccttcaa

SEQ ID NO: 2493176 - DNA, 17 bp, Homo sapiens
agagaagccttcaagct

SEQ ID NO: 2493177 - DNA, 22 bp, Homo sapiens
agagaagccttcaagctctgag

SEQ ID NO: 2493178 - DNA, 18 bp, Homo sapiens
agagaagtatacataagt

SEQ ID NO: 2493179 - DNA, 18 bp, Homo sapiens
agagaagtcacagggcag

SEQ ID NO: 2493180 - DNA, 20 bp, Homo sapiens
agagaagtcacagggcagta

SEQ ID NO: 2493181 - DNA, 13 bp, Homo sapiens
agagaataaattg

SEQ ID NO: 2493182 - DNA, 15 bp, Homo sapiens
agagacatcagccct

SEQ ID NO: 2493183 - DNA, 18 bp, Homo sapiens
agagacttgttttggatg

SEQ ID NO: 2493184 - DNA, 17 bp, Homo sapiens
agagagcagtgcttttg

SEQ ID NO: 2493185 - DNA, 22 bp, Homo sapiens
agagaggtttgcagtcccaagc

SEQ ID NO: 2493186 - DNA, 13 bp, Homo sapiens
agagatgcctccc

SEQ ID NO: 2493187 - DNA, 13 bp, Homo sapiens
agagatgtgtgtt

SEQ ID NO: 2493188 - DNA, 20 bp, Homo sapiens
agagcacgcctgtactagag

SEQ ID NO: 2493189 - DNA, 21 bp, Homo sapiens
agagcacgcctgtactagagc

SEQ ID NO: 2493190 - DNA, 13 bp, Homo sapiens
agagcactgccac

SEQ ID NO: 2493191 - DNA, 22 bp, Homo sapiens
agagcagcacctcctcagcctg

SEQ ID NO: 2493192 - DNA, 22 bp, Homo sapiens
agagcagggattaacctctgca

SEQ ID NO: 2493193 - DNA, 13 bp, Homo sapiens
agagcagtgcttt

SEQ ID NO: 2493194 - DNA, 17 bp, Homo sapiens
agagcatcatgcctctg

SEQ ID NO: 2493195 - DNA, 19 bp, Homo sapiens
agagccaggagaagctcag

SEQ ID NO: 2493196 - DNA, 22 bp, Homo sapiens
agagccaggagaagctcagctg

SEQ ID NO: 2493197 - DNA, 19 bp, Homo sapiens
agagccatgtcttctccct

SEQ ID NO: 2493198 - DNA, 14 bp, Homo sapiens
agagcccagctcca

SEQ ID NO: 2493199 - DNA, 13 bp, Homo sapiens
agagcccaggagc

SEQ ID NO: 2493200 - DNA, 15 bp, Homo sapiens
agagcccaggagctc

SEQ ID NO: 2493201 - DNA, 16 bp, Homo sapiens
agagcccaggagctcc

SEQ ID NO: 2493202 - DNA, 15 bp, Homo sapiens
agagccctgggaccg

SEQ ID NO: 2493203 - DNA, 19 bp, Homo sapiens
agagccctgtcagtagagt

SEQ ID NO: 2493204 - DNA, 14 bp, Homo sapiens
agagcctgagggat

SEQ ID NO: 2493205 - DNA, 12 bp, Homo sapiens
agagcctggggc

SEQ ID NO: 2493206 - DNA, 13 bp, Homo sapiens
agagccttccacc

SEQ ID NO: 2493207 - DNA, 20 bp, Homo sapiens
agagccttccacccaggggc

SEQ ID NO: 2493208 - DNA, 22 bp, Homo sapiens
agagccttccacccaggggcag

SEQ ID NO: 2493209 - DNA, 19 bp, Homo sapiens
agagcgagagatcaaagat

SEQ ID NO: 2493210 - DNA, 18 bp, Homo sapiens
agagcgtgagctgagcag

SEQ ID NO: 2493211 - DNA, 13 bp, Homo sapiens
agagctaggagca

SEQ ID NO: 2493212 - DNA, 12 bp, Homo sapiens
agagctcctccc

SEQ ID NO: 2493213 - DNA, 13 bp, Homo sapiens
agagctcctccct

SEQ ID NO: 2493214 - DNA, 17 bp, Homo sapiens
agagctcctccctctca

SEQ ID NO: 2493215 - DNA, 12 bp, Homo sapiens
agagctggctct

SEQ ID NO: 2493216 - DNA, 13 bp, Homo sapiens
agagctggctctg

SEQ ID NO: 2493217 - DNA, 11 bp, Homo sapiens
agagctggtgc

SEQ ID NO: 2493218 - DNA, 17 bp, Homo sapiens
agagctggtgcggctgg

SEQ ID NO: 2493219 - DNA, 19 bp, Homo sapiens
agagctggtgcggctggcc

SEQ ID NO: 2493220 - DNA, 19 bp, Homo sapiens
agagctgtattaagccact

SEQ ID NO: 2493221 - DNA, 20 bp, Homo sapiens
agaggaaggggccagaggct

SEQ ID NO: 2493222 - DNA, 23 bp, Homo sapiens
agaggagcccccaccctgttcct

SEQ ID NO: 2493223 - DNA, 11 bp, Homo sapiens
agaggcagccc

SEQ ID NO: 2493224 - DNA, 17 bp, Homo sapiens
agaggcccaggctgccg

SEQ ID NO: 2493225 - DNA, 18 bp, Homo sapiens
agaggcccaggctgccgt

SEQ ID NO: 2493226 - DNA, 12 bp, Homo sapiens
agaggccccagc

SEQ ID NO: 2493227 - DNA, 16 bp, Homo sapiens
agaggcccccagccca

SEQ ID NO: 2493228 - DNA, 13 bp, Homo sapiens
agaggccctggat

SEQ ID NO: 2493229 - DNA, 17 bp, Homo sapiens
agaggccctggatcagc

SEQ ID NO: 2493230 - DNA, 21 bp, Homo sapiens
agaggccctggatcagcgtgg

SEQ ID NO: 2493231 - DNA, 22 bp, Homo sapiens
agaggccctggatcagcgtggc

SEQ ID NO: 2493232 - DNA, 14 bp, Homo sapiens
agaggccgtggctg

SEQ ID NO: 2493233 - DNA, 15 bp, Homo sapiens
agaggccgtggctgc

SEQ ID NO: 2493234 - DNA, 13 bp, Homo sapiens
agaggcctgcagg

SEQ ID NO: 2493235 - DNA, 18 bp, Homo sapiens
agaggcctgggctgggaa

SEQ ID NO: 2493236 - DNA, 19 bp, Homo sapiens
agaggcctgggctgggaaa

SEQ ID NO: 2493237 - DNA, 19 bp, Homo sapiens
agaggctgaggcctggact

SEQ ID NO: 2493238 - DNA, 19 bp, Homo sapiens
agaggctgaggctggcaca

SEQ ID NO: 2493239 - DNA, 16 bp, Homo sapiens
agaggctgcccctctc

SEQ ID NO: 2493240 - DNA, 20 bp, Homo sapiens
agaggctgcccctctcacca

SEQ ID NO: 2493241 - DNA, 15 bp, Homo sapiens
agaggctgccctcct

SEQ ID NO: 2493242 - DNA, 16 bp, Homo sapiens
agagggaatgtgaaat

SEQ ID NO: 2493243 - DNA, 15 bp, Homo sapiens
agagggacgcctggg

SEQ ID NO: 2493244 - DNA, 14 bp, Homo sapiens
agagggcgcaggcc

SEQ ID NO: 2493245 - DNA, 23 bp, Homo sapiens
agaggggcctgccacctggaccc

SEQ ID NO: 2493246 - DNA, 14 bp, Homo sapiens
agagggggctggtg

SEQ ID NO: 2493247 - DNA, 15 bp, Homo sapiens
agaggtgaccccagg

SEQ ID NO: 2493248 - DNA, 16 bp, Homo sapiens
agaggtgagaaattta

SEQ ID NO: 2493249 - DNA, 17 bp, Homo sapiens
agaggtgagaaatttaa

SEQ ID NO: 2493250 - DNA, 16 bp, Homo sapiens
agcccagccccactcc

SEQ ID NO: 2493251 - DNA, 14 bp, Homo sapiens
agcccagctctgaa

SEQ ID NO: 2493252 - DNA, 16 bp, Homo sapiens
agcccagctgggtcag

SEQ ID NO: 2493253 - DNA, 17 bp, Homo sapiens
agcccagctgggtcagg

SEQ ID NO: 2493254 - DNA, 19 bp, Homo sapiens
agcccagctgggtcaggca

SEQ ID NO: 2493255 - DNA, 16 bp, Homo sapiens
agcccattgtggccta

SEQ ID NO: 2493256 - DNA, 22 bp, Homo sapiens
agccccacaccagggccagcct

SEQ ID NO: 2493257 - DNA, 23 bp, Homo sapiens
agccccacaccagggccagcctc

SEQ ID NO: 2493258 - DNA, 14 bp, Homo sapiens
agccccagccaggg

SEQ ID NO: 2493259 - DNA, 16 bp, Homo sapiens
agccccattcctggga

SEQ ID NO: 2493260 - DNA, 18 bp, Homo sapiens
agcccccaccctgttcct

SEQ ID NO: 2493261 - DNA, 23 bp, Homo sapiens
agcccccaccctgttcctgctgc

SEQ ID NO: 2493262 - DNA, 14 bp, Homo sapiens
agcccccagcctgt

SEQ ID NO: 2493263 - DNA, 16 bp, Homo sapiens
agcccccagcctgtca

SEQ ID NO: 2493264 - DNA, 19 bp, Homo sapiens
agccccctaagagagcacc

SEQ ID NO: 2493265 - DNA, 13 bp, Homo sapiens
agccccctcctgg

SEQ ID NO: 2493266 - DNA, 16 bp, Homo sapiens
agcccctctggtcgct

SEQ ID NO: 2493267 - DNA, 17 bp, Homo sapiens
agcccctcttggagaag

SEQ ID NO: 2493268 - DNA, 15 bp, Homo sapiens
agccccttctgctca

SEQ ID NO: 2493269 - DNA, 19 bp, Homo sapiens
agccccttctgctcagctc

SEQ ID NO: 2493270 - DNA, 14 bp, Homo sapiens
agcccggctcctgg

SEQ ID NO: 2493271 - DNA, 16 bp, Homo sapiens
agcccggctcctggtc

SEQ ID NO: 2493272 - DNA, 21 bp, Homo sapiens
agccctaaacatcattcttga

SEQ ID NO: 2493273 - DNA, 16 bp, Homo sapiens
agccctagggtggaga

SEQ ID NO: 2493274 - DNA, 16 bp, Homo sapiens
agccctcacacaccct

SEQ ID NO: 2493275 - DNA, 19 bp, Homo sapiens
agccctgaggacagatgcc

SEQ ID NO: 2493276 - DNA, 23 bp, Homo sapiens
agccctgaggacagatgcctcct

SEQ ID NO: 2493277 - DNA, 16 bp, Homo sapiens
agccctgcctggagga

SEQ ID NO: 2493278 - DNA, 23 bp, Homo sapiens
agccctgcctggaggacctgagc

SEQ ID NO: 2493279 - DNA, 14 bp, Homo sapiens
agcccttgggggtc

SEQ ID NO: 2493280 - DNA, 21 bp, Homo sapiens
agcccttgggggtcctcctcc

SEQ ID NO: 2493281 - DNA, 21 bp, Homo sapiens
agcccttgtgaatcaagggtc

SEQ ID NO: 2493282 - DNA, 20 bp, Homo sapiens
agccgaccccctctccctgc

SEQ ID NO: 2493283 - DNA, 21 bp, Homo sapiens
agccgaggtccctgctgccag

SEQ ID NO: 2493284 - DNA, 19 bp, Homo sapiens
agccgctgagcgaggagat

SEQ ID NO: 2493285 - DNA, 20 bp, Homo sapiens
agccgcttggcgatgccagc

SEQ ID NO: 2493286 - DNA, 15 bp, Homo sapiens
agccggcacagggtc

SEQ ID NO: 2493287 - DNA, 23 bp, Homo sapiens
agccggggtggggtggctgcagc

SEQ ID NO: 2493288 - DNA, 20 bp, Homo sapiens
agccgggtctgcctcttctg

SEQ ID NO: 2493289 - DNA, 18 bp, Homo sapiens
agcctaaggctcctgttt

SEQ ID NO: 2493290 - DNA, 19 bp, Homo sapiens
agcctaaggctcctgtttt

SEQ ID NO: 2493291 - DNA, 17 bp, Homo sapiens
agcctaggcctagtcct

SEQ ID NO: 2493292 - DNA, 20 bp, Homo sapiens
agcctagtgaaggcttctct

SEQ ID NO: 2493293 - DNA, 16 bp, Homo sapiens
agcctcagattccttc

SEQ ID NO: 2493294 - DNA, 13 bp, Homo sapiens
agcctcaggactg

SEQ ID NO: 2493295 - DNA, 17 bp, Homo sapiens
agcctcaggactgggag

SEQ ID NO: 2493296 - DNA, 19 bp, Homo sapiens
agcctcaggactgggagcc

SEQ ID NO: 2493297 - DNA, 23 bp, Homo sapiens
agcctcaggactgggagccccca

SEQ ID NO: 2493298 - DNA, 14 bp, Homo sapiens
agcctccaattttt

SEQ ID NO: 2493299 - DNA, 17 bp, Homo sapiens
agcctcccatccagggc

SEQ ID NO: 2493300 - DNA, 18 bp, Homo sapiens
agcctcccatccagggcc

SEQ ID NO: 2493301 - DNA, 18 bp, Homo sapiens
agcctcccctgccagggc

SEQ ID NO: 2493302 - DNA, 15 bp, Homo sapiens
agcctccctgaagcc

SEQ ID NO: 2493303 - DNA, 22 bp, Homo sapiens
agcctctagagcagactacagc

SEQ ID NO: 2493304 - DNA, 16 bp, Homo sapiens
agcctctccccaggtc

SEQ ID NO: 2493305 - DNA, 23 bp, Homo sapiens
agcctctccccaggtccagctct

SEQ ID NO: 2493306 - DNA, 19 bp, Homo sapiens
agcctgaaccccagggctg

SEQ ID NO: 2493307 - DNA, 17 bp, Homo sapiens
agcctgacaacatttct

SEQ ID NO: 2493308 - DNA, 19 bp, Homo sapiens
agcctgagggaaaggccag

SEQ ID NO: 2493309 - DNA, 23 bp, Homo sapiens
agcctgagggaaaggccagcact

SEQ ID NO: 2493310 - DNA, 10 bp, Homo sapiens
agcctggacc

SEQ ID NO: 2493311 - DNA, 19 bp, Homo sapiens
agcctggacctctgacagc

SEQ ID NO: 2493312 - DNA, 21 bp, Homo sapiens
agcctggacctctgacagcag

SEQ ID NO: 2493313 - DNA, 14 bp, Homo sapiens
agcctggccagaca

SEQ ID NO: 2493314 - DNA, 21 bp, Homo sapiens
agcctggccagacacaggccc

SEQ ID NO: 2493315 - DNA, 17 bp, Homo sapiens
agcctggccccatggtc

SEQ ID NO: 2493316 - DNA, 14 bp, Homo sapiens
agcctggcctcctg

SEQ ID NO: 2493317 - DNA, 17 bp, Homo sapiens
agcctggcctcctgcct

SEQ ID NO: 2493318 - DNA, 18 bp, Homo sapiens
agcctggcctcctgcctc

SEQ ID NO: 2493319 - DNA, 19 bp, Homo sapiens
agcctgggcctatggagag

SEQ ID NO: 2493320 - DNA, 20 bp, Homo sapiens
agcctgggcctatggagagc

SEQ ID NO: 2493321 - DNA, 23 bp, Homo sapiens
agcctgggcctatggagagccct

SEQ ID NO: 2493322 - DNA, 13 bp, Homo sapiens
agcctggggctct

SEQ ID NO: 2493323 - DNA, 14 bp, Homo sapiens
agcctggggctcta

SEQ ID NO: 2493324 - DNA, 22 bp, Homo sapiens
agcctggggctctaacgcctga

SEQ ID NO: 2493325 - DNA, 23 bp, Homo sapiens
agcctggggctctaacgcctgag

SEQ ID NO: 2493326 - DNA, 14 bp, Homo sapiens
agcctggggctggc

SEQ ID NO: 2493327 - DNA, 17 bp, Homo sapiens
agcctgggggcctggct

SEQ ID NO: 2493328 - DNA, 22 bp, Homo sapiens
agcctgggggcctggctggctg

SEQ ID NO: 2493329 - DNA, 21 bp, Homo sapiens
agcctgtcagatccaggagct

SEQ ID NO: 2493330 - DNA, 20 bp, Homo sapiens
agcctgtcctgcctgtggcc

SEQ ID NO: 2493331 - DNA, 18 bp, Homo sapiens
agcctgttcatggcagat

SEQ ID NO: 2493332 - DNA, 15 bp, Homo sapiens
agccttaatttgcac

SEQ ID NO: 2493333 - DNA, 13 bp, Homo sapiens
agccttccaccca

SEQ ID NO: 2493334 - DNA, 20 bp, Homo sapiens
agccttcccctaccccttgt

SEQ ID NO: 2493335 - DNA, 23 bp, Homo sapiens
agccttccccttatcctccctgt

SEQ ID NO: 2493336 - DNA, 17 bp, Homo sapiens
agccttgccagagatcc

SEQ ID NO: 2493337 - DNA, 23 bp, Homo sapiens
agccttgtgatgtcatacagaga

SEQ ID NO: 2493338 - DNA, 23 bp, Homo sapiens
agcctttgttccccactggagca

SEQ ID NO: 2493339 - DNA, 23 bp, Homo sapiens
agccttttccctctttggctccc

SEQ ID NO: 2493340 - DNA, 17 bp, Homo sapiens
agccttttttccccaga

SEQ ID NO: 2493341 - DNA, 21 bp, Homo sapiens
agccttttttccccagacttg

SEQ ID NO: 2493342 - DNA, 14 bp, Homo sapiens
agcgaccgccccct

SEQ ID NO: 2493343 - DNA, 17 bp, Homo sapiens
agcgaccgccccctcct

SEQ ID NO: 2493344 - DNA, 19 bp, Homo sapiens
agcgaggaggctccagagg

SEQ ID NO: 2493345 - DNA, 20 bp, Homo sapiens
agcgattccctctcccaggc

SEQ ID NO: 2493346 - DNA, 23 bp, Homo sapiens
agcgattccctctcccaggcccc

SEQ ID NO: 2493347 - DNA, 21 bp, Homo sapiens
agcgccaggctgaccacagca

SEQ ID NO: 2493348 - DNA, 13 bp, Homo sapiens
agcgccctgcaga

SEQ ID NO: 2493349 - DNA, 18 bp, Homo sapiens
agcgccctgcagaccctg

SEQ ID NO: 2493350 - DNA, 21 bp, Homo sapiens
agcgccctgcagaccctgccc

SEQ ID NO: 2493351 - DNA, 18 bp, Homo sapiens
agcgcctccatccaaggc

SEQ ID NO: 2493352 - DNA, 22 bp, Homo sapiens
agcgcctccatccaaggccagg

SEQ ID NO: 2493353 - DNA, 14 bp, Homo sapiens
aggagggaggccag

SEQ ID NO: 2493354 - DNA, 12 bp, Homo sapiens
aggaggggaaga

SEQ ID NO: 2493355 - DNA, 16 bp, Homo sapiens
aggaggggggagggaa

SEQ ID NO: 2493356 - DNA, 17 bp, Homo sapiens
aggagggtcggtgcctt

SEQ ID NO: 2493357 - DNA, 14 bp, Homo sapiens
aggagggtgggaag

SEQ ID NO: 2493358 - DNA, 20 bp, Homo sapiens
aggaggtgtctcaggctgcc

SEQ ID NO: 2493359 - DNA, 21 bp, Homo sapiens
aggaggtgtctcaggctgcct

SEQ ID NO: 2493360 - DNA, 22 bp, Homo sapiens
aggaggtgtctcaggctgcctg

SEQ ID NO: 2493361 - DNA, 19 bp, Homo sapiens
aggagtaacaatacaaatg

SEQ ID NO: 2493362 - DNA, 20 bp, Homo sapiens
aggagtccactttgtttcgt

SEQ ID NO: 2493363 - DNA, 17 bp, Homo sapiens
aggagtctgaggtcctg

SEQ ID NO: 2493364 - DNA, 22 bp, Homo sapiens
aggagtctgaggtcctgagcac

SEQ ID NO: 2493365 - DNA, 13 bp, Homo sapiens
aggagtgtgtgtg

SEQ ID NO: 2493366 - DNA, 21 bp, Homo sapiens
aggatagatgctggcccaggg

SEQ ID NO: 2493367 - DNA, 17 bp, Homo sapiens
aggatatcggcatttgt

SEQ ID NO: 2493368 - DNA, 16 bp, Homo sapiens
aggatgctaacatcta

SEQ ID NO: 2493369 - DNA, 17 bp, Homo sapiens
aggatgctaacatctaa

SEQ ID NO: 2493370 - DNA, 14 bp, Homo sapiens
aggatggaacacgg

SEQ ID NO: 2493371 - DNA, 19 bp, Homo sapiens
aggatggaacacggccaca

SEQ ID NO: 2493372 - DNA, 20 bp, Homo sapiens
aggatgggcatggtgttctc

SEQ ID NO: 2493373 - DNA, 19 bp, Homo sapiens
aggatggtcttacagcagg

SEQ ID NO: 2493374 - DNA, 13 bp, Homo sapiens
aggatgtgtttgc

SEQ ID NO: 2493375 - DNA, 19 bp, Homo sapiens
aggatgtgtttgctttctg

SEQ ID NO: 2493376 - DNA, 12 bp, Homo sapiens
aggattctaaaa

SEQ ID NO: 2493377 - DNA, 22 bp, Homo sapiens
aggattctgctggcctctgcga

SEQ ID NO: 2493378 - DNA, 24 bp, Homo sapiens
aggattgaaaatgtccaggaaagt

SEQ ID NO: 2493379 - DNA, 15 bp, Homo sapiens
aggattgcgagagat

SEQ ID NO: 2493380 - DNA, 17 bp, Homo sapiens
aggattgcgagagatgt

SEQ ID NO: 2493381 - DNA, 21 bp, Homo sapiens
aggattgcgagagatgtgtgt

SEQ ID NO: 2493382 - DNA, 20 bp, Homo sapiens
aggatttcatgatttcattt

SEQ ID NO: 2493383 - DNA, 20 bp, Homo sapiens
aggatttggtccgtcataac

SEQ ID NO: 2493384 - DNA, 15 bp, Homo sapiens
aggcaaaaatgtaaa

SEQ ID NO: 2493385 - DNA, 22 bp, Homo sapiens
attccttagactcttttccttc

SEQ ID NO: 2493386 - DNA, 20 bp, Homo sapiens
attcctttaacaacatgttt

SEQ ID NO: 2493387 - DNA, 17 bp, Homo sapiens
attcgccacacagtatt

SEQ ID NO: 2493388 - DNA, 18 bp, Homo sapiens
attcgccacacagtattt

SEQ ID NO: 2493389 - DNA, 21 bp, Homo sapiens
attcgctactatgatttaatt

SEQ ID NO: 2493390 - DNA, 12 bp, Homo sapiens
attcgtgaaaac

SEQ ID NO: 2493391 - DNA, 19 bp, Homo sapiens
attcgtgaaaacacatttg

SEQ ID NO: 2493392 - DNA, 18 bp, Homo sapiens
attctaaatgaatgttta

SEQ ID NO: 2493393 - DNA, 23 bp, Homo sapiens
attctaagacttactctaagatc

SEQ ID NO: 2493394 - DNA, 22 bp, Homo sapiens
attctagatcagatgctccaag

SEQ ID NO: 2493395 - DNA, 15 bp, Homo sapiens
attctataaggccat

SEQ ID NO: 2493396 - DNA, 16 bp, Homo sapiens
attctatagttctaga

SEQ ID NO: 2493397 - DNA, 22 bp, Homo sapiens
attctatttatatgtacatgag

SEQ ID NO: 2493398 - DNA, 19 bp, Homo sapiens
attctcattaaaagaatat

SEQ ID NO: 2493399 - DNA, 16 bp, Homo sapiens
attctccacagcaacc

SEQ ID NO: 2493400 - DNA, 11 bp, Homo sapiens
attctcctcct

SEQ ID NO: 2493401 - DNA, 13 bp, Homo sapiens
attctctgtctca

SEQ ID NO: 2493402 - DNA, 19 bp, Homo sapiens
attctctgtctcatccatc

SEQ ID NO: 2493403 - DNA, 17 bp, Homo sapiens
attctctgtgtctaaga

SEQ ID NO: 2493404 - DNA, 21 bp, Homo sapiens
attctctgtgtctaagattct

SEQ ID NO: 2493405 - DNA, 23 bp, Homo sapiens
attctctgtgtctaagattctag

SEQ ID NO: 2493406 - DNA, 16 bp, Homo sapiens
attctgaatgcttcta

SEQ ID NO: 2493407 - DNA, 17 bp, Homo sapiens
attctgaatgcttctaa

SEQ ID NO: 2493408 - DNA, 14 bp, Homo sapiens
attctgaccttaaa

SEQ ID NO: 2493409 - DNA, 23 bp, Homo sapiens
attctgagttttgtgtttgttgt

SEQ ID NO: 2493410 - DNA, 19 bp, Homo sapiens
attctgcaagcacatctgc

SEQ ID NO: 2493411 - DNA, 18 bp, Homo sapiens
attctgcagtaaatcttt

SEQ ID NO: 2493412 - DNA, 20 bp, Homo sapiens
attctgcagtaaatctttta

SEQ ID NO: 2493413 - DNA, 23 bp, Homo sapiens
attctgcagtaaatcttttacaa

SEQ ID NO: 2493414 - DNA, 19 bp, Homo sapiens
attctgcctttgccaggtg

SEQ ID NO: 2493415 - DNA, 19 bp, Homo sapiens
attctgctggcctctgcga

SEQ ID NO: 2493416 - DNA, 12 bp, Homo sapiens
attctggacctc

SEQ ID NO: 2493417 - DNA, 12 bp, Homo sapiens
attcttctagag

SEQ ID NO: 2493418 - DNA, 15 bp, Homo sapiens
attcttctcttcctt

SEQ ID NO: 2493419 - DNA, 14 bp, Homo sapiens
attcttgatgtaaa

SEQ ID NO: 2493420 - DNA, 20 bp, Homo sapiens
attcttgatgtaaaatcttg

SEQ ID NO: 2493421 - DNA, 17 bp, Homo sapiens
attcttggttgaggaaa

SEQ ID NO: 2493422 - DNA, 18 bp, Homo sapiens
attctttcaatacagata

SEQ ID NO: 2493423 - DNA, 21 bp, Homo sapiens
attctttcaatacagatatat

SEQ ID NO: 2493424 - DNA, 22 bp, Homo sapiens
attctttccatttgcatttgtt

SEQ ID NO: 2493425 - DNA, 22 bp, Homo sapiens
attcttttatactcagctttct

SEQ ID NO: 2493426 - DNA, 14 bp, Homo sapiens
attgaaaaaataga

SEQ ID NO: 2493427 - DNA, 18 bp, Homo sapiens
attgaaaaaatagagcct

SEQ ID NO: 2493428 - DNA, 16 bp, Homo sapiens
attgaacacaaactgt

SEQ ID NO: 2493429 - DNA, 19 bp, Homo sapiens
attgaacacaaactgtaaa

SEQ ID NO: 2493430 - DNA, 23 bp, Homo sapiens
attgaacctttgtgccctatcac

SEQ ID NO: 2493431 - DNA, 13 bp, Homo sapiens
attgaatactttg

SEQ ID NO: 2493432 - DNA, 16 bp, Homo sapiens
attgaatactttgaat

SEQ ID NO: 2493433 - DNA, 12 bp, Homo sapiens
attgacacagaa

SEQ ID NO: 2493434 - DNA, 18 bp, Homo sapiens
attgacacagtaccattt

SEQ ID NO: 2493435 - DNA, 20 bp, Homo sapiens
attgaccgcgactaatttca

SEQ ID NO: 2493436 - DNA, 21 bp, Homo sapiens
attgacgacaagtgctgaaca

SEQ ID NO: 2493437 - DNA, 15 bp, Homo sapiens
attgagctctctcat

SEQ ID NO: 2493438 - DNA, 20 bp, Homo sapiens
attgagctctctgcccttga

SEQ ID NO: 2493439 - DNA, 15 bp, Homo sapiens
attgagttttcagtg

SEQ ID NO: 2493440 - DNA, 16 bp, Homo sapiens
attgagttttcagtgg

SEQ ID NO: 2493441 - DNA, 19 bp, Homo sapiens
attgataaccttgaaaaaa

SEQ ID NO: 2493442 - DNA, 18 bp, Homo sapiens
attgatagagtgttatca

SEQ ID NO: 2493443 - DNA, 14 bp, Homo sapiens
attgatttgaagaa

SEQ ID NO: 2493444 - DNA, 16 bp, Homo sapiens
attgatttgaagaaca

SEQ ID NO: 2493445 - DNA, 16 bp, Homo sapiens
attgatttgcattgaa

SEQ ID NO: 2493446 - DNA, 19 bp, Homo sapiens
attgatttttataaatact

SEQ ID NO: 2493447 - DNA, 17 bp, Homo sapiens
attgatttttctcttca

SEQ ID NO: 2493448 - DNA, 18 bp, Homo sapiens
attgatttttctcttcat

SEQ ID NO: 2493449 - DNA, 14 bp, Homo sapiens
attgcagtttatca

SEQ ID NO: 2493450 - DNA, 19 bp, Homo sapiens
attgcagtttatcattcaa

SEQ ID NO: 2493451 - DNA, 16 bp, Homo sapiens
attgcatcaaagcatc

SEQ ID NO: 2493452 - DNA, 23 bp, Homo sapiens
attgcatctcccagataatgtga

SEQ ID NO: 2493453 - DNA, 14 bp, Homo sapiens
attgcattgacttt

SEQ ID NO: 2493454 - DNA, 22 bp, Homo sapiens
attgccacctctaacagcacca

SEQ ID NO: 2493455 - DNA, 15 bp, Homo sapiens
attgcctcacttcag

SEQ ID NO: 2493456 - DNA, 23 bp, Homo sapiens
attgccttttttctgtataaatg

SEQ ID NO: 2493457 - DNA, 18 bp, Homo sapiens
attgcgagagatgtgtgt

SEQ ID NO: 2493458 - DNA, 19 bp, Homo sapiens
attgcgagagatgtgtgtt

SEQ ID NO: 2493459 - DNA, 14 bp, Homo sapiens
attgctagagctcc

SEQ ID NO: 2493460 - DNA, 15 bp, Homo sapiens
attgctagagctcct

SEQ ID NO: 2493461 - DNA, 16 bp, Homo sapiens
attgctagagctcctc

SEQ ID NO: 2493462 - DNA, 18 bp, Homo sapiens
attgctagagctcctccc

SEQ ID NO: 2493463 - DNA, 23 bp, Homo sapiens
attgctcacccagtgccctctcc

SEQ ID NO: 2493464 - DNA, 16 bp, Homo sapiens
attgctgactgtagct

SEQ ID NO: 2493465 - DNA, 20 bp, Homo sapiens
attgcttatttattgtattc

SEQ ID NO: 2493466 - DNA, 19 bp, Homo sapiens
attgcttcctcctccccaa

SEQ ID NO: 2493467 - DNA, 18 bp, Homo sapiens
attggaactggaggcagg

SEQ ID NO: 2493468 - DNA, 21 bp, Homo sapiens
attggaagagcagcacctcct

SEQ ID NO: 2493469 - DNA, 11 bp, Homo sapiens
attggatattt

SEQ ID NO: 2493470 - DNA, 22 bp, Homo sapiens
attggatttcctaatactgtca

SEQ ID NO: 2493471 - DNA, 20 bp, Homo sapiens
attggcacctaatccaggca

SEQ ID NO: 2493472 - DNA, 23 bp, Homo sapiens
attggcatggaaatttaaagcag

SEQ ID NO: 2493473 - DNA, 20 bp, Homo sapiens
attggcctgtagagttgctg

SEQ ID NO: 2493474 - DNA, 18 bp, Homo sapiens
attggctatttaaaactt

SEQ ID NO: 2493475 - DNA, 16 bp, Homo sapiens
attggggaagagagcc

SEQ ID NO: 2493476 - DNA, 14 bp, Homo sapiens
attggggttatttt

SEQ ID NO: 2493477 - DNA, 19 bp, Homo sapiens
attggtgtaaggtactttc

SEQ ID NO: 2493478 - DNA, 19 bp, Homo sapiens
attggtgtttttttctatg

SEQ ID NO: 2493479 - DNA, 15 bp, Homo sapiens
attgtaactgttctt

SEQ ID NO: 2493480 - DNA, 19 bp, Homo sapiens
attgtaactgttcttgaat

SEQ ID NO: 2493481 - DNA, 12 bp, Homo sapiens
attgtaatcact

SEQ ID NO: 2493482 - DNA, 16 bp, Homo sapiens
attgtaatctgaataa

SEQ ID NO: 2493483 - DNA, 21 bp, Homo sapiens
attgtactaaagccaaacata

SEQ ID NO: 2493484 - DNA, 22 bp, Homo sapiens
attgtactaaagccaaacatat

SEQ ID NO: 2493485 - DNA, 13 bp, Homo sapiens
attgtagtaatct

SEQ ID NO: 2493486 - DNA, 14 bp, Homo sapiens
attgtagtgctttg

SEQ ID NO: 2493487 - DNA, 23 bp, Homo sapiens
attgtagtgctttgagagagaaa

SEQ ID NO: 2493488 - DNA, 23 bp, Homo sapiens
caaaagcgtgagcttaaaataca

SEQ ID NO: 2493489 - DNA, 18 bp, Homo sapiens
caaaagttccaagagtct

SEQ ID NO: 2493490 - DNA, 23 bp, Homo sapiens
caaaagttccaagagtctaaaga

SEQ ID NO: 2493491 - DNA, 13 bp, Homo sapiens
caaaatagggact

SEQ ID NO: 2493492 - DNA, 21 bp, Homo sapiens
caaaatctctccactttcagc

SEQ ID NO: 2493493 - DNA, 22 bp, Homo sapiens
caaaatctctccactttcagct

SEQ ID NO: 2493494 - DNA, 18 bp, Homo sapiens
caaaatcttgatcagtta

SEQ ID NO: 2493495 - DNA, 20 bp, Homo sapiens
caaaatgctttttatttctg

SEQ ID NO: 2493496 - DNA, 20 bp, Homo sapiens
caaaatgttatcttctcaag

SEQ ID NO: 2493497 - DNA, 21 bp, Homo sapiens
caaaatgttatcttctcaagt

SEQ ID NO: 2493498 - DNA, 22 bp, Homo sapiens
caaaatgttgaaatatgatgtt

SEQ ID NO: 2493499 - DNA, 14 bp, Homo sapiens
caaacaacctgccc

SEQ ID NO: 2493500 - DNA, 19 bp, Homo sapiens
caaacaatgacaaagcaga

SEQ ID NO: 2493501 - DNA, 12 bp, Homo sapiens
caaacaccttcc

SEQ ID NO: 2493502 - DNA, 14 bp, Homo sapiens
caaacaccttccag

SEQ ID NO: 2493503 - DNA, 21 bp, Homo sapiens
caaacatgaccctaaatcttg

SEQ ID NO: 2493504 - DNA, 18 bp, Homo sapiens
caaacattttctggccag

SEQ ID NO: 2493505 - DNA, 21 bp, Homo sapiens
caaacccacctgctagtgtga

SEQ ID NO: 2493506 - DNA, 20 bp, Homo sapiens
caaacgccctttcctcctca

SEQ ID NO: 2493507 - DNA, 20 bp, Homo sapiens
caaactactttgctgctaat

SEQ ID NO: 2493508 - DNA, 19 bp, Homo sapiens
caaactcctgacctcaggc

SEQ ID NO: 2493509 - DNA, 18 bp, Homo sapiens
caaactgcatgcccagag

SEQ ID NO: 2493510 - DNA, 20 bp, Homo sapiens
caaactgcatgcccagagac

SEQ ID NO: 2493511 - DNA, 16 bp, Homo sapiens
caaactgggaacccct

SEQ ID NO: 2493512 - DNA, 15 bp, Homo sapiens
caaactgtgtaactg

SEQ ID NO: 2493513 - DNA, 13 bp, Homo sapiens
caaactttgcatc

SEQ ID NO: 2493514 - DNA, 17 bp, Homo sapiens
caaagaaacaaagatgt

SEQ ID NO: 2493515 - DNA, 13 bp, Homo sapiens
caaagaaagtgta

SEQ ID NO: 2493516 - DNA, 16 bp, Homo sapiens
caaagaccctggcttt

SEQ ID NO: 2493517 - DNA, 18 bp, Homo sapiens
caaagaccctggctttca

SEQ ID NO: 2493518 - DNA, 21 bp, Homo sapiens
caaagagttcaagaaataagt

SEQ ID NO: 2493519 - DNA, 20 bp, Homo sapiens
caaagatgaatgaagcaaat

SEQ ID NO: 2493520 - DNA, 14 bp, Homo sapiens
caaagattgatttg

SEQ ID NO: 2493521 - DNA, 16 bp, Homo sapiens
caaagatttaatctgc

SEQ ID NO: 2493522 - DNA, 22 bp, Homo sapiens
caaagcaagcattcagaagaaa

SEQ ID NO: 2493523 - DNA, 15 bp, Homo sapiens
caaagcaaggaaact

SEQ ID NO: 2493524 - DNA, 13 bp, Homo sapiens
caaagcacagaga

SEQ ID NO: 2493525 - DNA, 14 bp, Homo sapiens
caaagcacagagag

SEQ ID NO: 2493526 - DNA, 20 bp, Homo sapiens
caaagcacgaaatgttattt

SEQ ID NO: 2493527 - DNA, 19 bp, Homo sapiens
caaagcagattcagaaatg

SEQ ID NO: 2493528 - DNA, 23 bp, Homo sapiens
caaagcatcttgcattatgcaat

SEQ ID NO: 2493529 - DNA, 19 bp, Homo sapiens
caaagcatgggattattag

SEQ ID NO: 2493530 - DNA, 19 bp, Homo sapiens
caaagccaggtccctctca

SEQ ID NO: 2493531 - DNA, 14 bp, Homo sapiens
caaagcccccagag

SEQ ID NO: 2493532 - DNA, 21 bp, Homo sapiens
caaagcctgttcatggcagat

SEQ ID NO: 2493533 - DNA, 11 bp, Homo sapiens
caaagctgcct

SEQ ID NO: 2493534 - DNA, 18 bp, Homo sapiens
caaagctttcctgcccca

SEQ ID NO: 2493535 - DNA, 22 bp, Homo sapiens
caaagctttcctgccccaggcc

SEQ ID NO: 2493536 - DNA, 16 bp, Homo sapiens
caaaggacgcactgag

SEQ ID NO: 2493537 - DNA, 14 bp, Homo sapiens
caaaggatgtgata

SEQ ID NO: 2493538 - DNA, 17 bp, Homo sapiens
caaaggatgtgatatat

SEQ ID NO: 2493539 - DNA, 21 bp, Homo sapiens
caaaggatgtgatatataagt

SEQ ID NO: 2493540 - DNA, 23 bp, Homo sapiens
caaaggcctaattctatgcctgt

SEQ ID NO: 2493541 - DNA, 18 bp, Homo sapiens
caaaggggacctggaagg

SEQ ID NO: 2493542 - DNA, 21 bp, Homo sapiens
caaaggttctaggtttcaaag

SEQ ID NO: 2493543 - DNA, 18 bp, Homo sapiens
caaaggtttggaaggagc

SEQ ID NO: 2493544 - DNA, 19 bp, Homo sapiens
caaaggtttggaaggagca

SEQ ID NO: 2493545 - DNA, 13 bp, Homo sapiens
caaagtctctaat

SEQ ID NO: 2493546 - DNA, 14 bp, Homo sapiens
caaagtggaacgaa

SEQ ID NO: 2493547 - DNA, 20 bp, Homo sapiens
caaagttctaataatttcta

SEQ ID NO: 2493548 - DNA, 22 bp, Homo sapiens
caaagttctaataatttctaat

SEQ ID NO: 2493549 - DNA, 23 bp, Homo sapiens
caaagttctaataatttctaatg

SEQ ID NO: 2493550 - DNA, 15 bp, Homo sapiens
caaagttgttgtaac

SEQ ID NO: 2493551 - DNA, 20 bp, Homo sapiens
caaagtttaataaatttatt

SEQ ID NO: 2493552 - DNA, 15 bp, Homo sapiens
caaatactaaaaaga

SEQ ID NO: 2493553 - DNA, 16 bp, Homo sapiens
caaatactaaaaagaa

SEQ ID NO: 2493554 - DNA, 14 bp, Homo sapiens
caaatatgtcctgg

SEQ ID NO: 2493555 - DNA, 17 bp, Homo sapiens
caaatatgtcctggggt

SEQ ID NO: 2493556 - DNA, 23 bp, Homo sapiens
caaatatttagatgtaattttgt

SEQ ID NO: 2493557 - DNA, 15 bp, Homo sapiens
caaatcacatatttt

SEQ ID NO: 2493558 - DNA, 19 bp, Homo sapiens
caaatcacatattttaaaa

SEQ ID NO: 2493559 - DNA, 20 bp, Homo sapiens
caaatcaccacaaactgtaa

SEQ ID NO: 2493560 - DNA, 14 bp, Homo sapiens
caaatcatttgttt

SEQ ID NO: 2493561 - DNA, 17 bp, Homo sapiens
caaatcatttgtttaaa

SEQ ID NO: 2493562 - DNA, 17 bp, Homo sapiens
caaatccttagatctgg

SEQ ID NO: 2493563 - DNA, 21 bp, Homo sapiens
caaatccttagatctggcatg

SEQ ID NO: 2493564 - DNA, 14 bp, Homo sapiens
caaatctaccactg

SEQ ID NO: 2493565 - DNA, 13 bp, Homo sapiens
caaatcttgaaat

SEQ ID NO: 2493566 - DNA, 22 bp, Homo sapiens
caaatcttggttgatgccaaaa

SEQ ID NO: 2493567 - DNA, 12 bp, Homo sapiens
caaatgagccat

SEQ ID NO: 2493568 - DNA, 14 bp, Homo sapiens
caaatgagtaacat

SEQ ID NO: 2493569 - DNA, 21 bp, Homo sapiens
caaatggcgtctggaagtcca

SEQ ID NO: 2493570 - DNA, 17 bp, Homo sapiens
caaatggggccagatcc

SEQ ID NO: 2493571 - DNA, 22 bp, Homo sapiens
caaatgtagtatggcctgtgtc

SEQ ID NO: 2493572 - DNA, 23 bp, Homo sapiens
caaatgtagtatggcctgtgtca

SEQ ID NO: 2493573 - DNA, 19 bp, Homo sapiens
caaatgttctaagtttcta

SEQ ID NO: 2493574 - DNA, 23 bp, Homo sapiens
caaatgttctaagtttctaagat

SEQ ID NO: 2493575 - DNA, 23 bp, Homo sapiens
caaatgtttattaagcatcagaa

SEQ ID NO: 2493576 - DNA, 16 bp, Homo sapiens
caaattaaaaaagata

SEQ ID NO: 2493577 - DNA, 19 bp, Homo sapiens
caaattaaaaaagataaac

SEQ ID NO: 2493578 - DNA, 20 bp, Homo sapiens
caaattaaaaaagataaaca

SEQ ID NO: 2493579 - DNA, 15 bp, Homo sapiens
caaattattaatgaa

SEQ ID NO: 2493580 - DNA, 17 bp, Homo sapiens
caaattattaatgaaaa

SEQ ID NO: 2493581 - DNA, 14 bp, Homo sapiens
caaattcaaataaa

SEQ ID NO: 2493582 - DNA, 19 bp, Homo sapiens
caacacagcttgtctcttg

SEQ ID NO: 2493583 - DNA, 14 bp, Homo sapiens
caacagatctggaa

SEQ ID NO: 2493584 - DNA, 17 bp, Homo sapiens
caacagatctggaacct

SEQ ID NO: 2493585 - DNA, 23 bp, Homo sapiens
caacagatctggaacctcagcct

SEQ ID NO: 2493586 - DNA, 17 bp, Homo sapiens
caacagcaaacaggtgc

SEQ ID NO: 2493587 - DNA, 15 bp, Homo sapiens
caacagtaaaccact

SEQ ID NO: 2493588 - DNA, 16 bp, Homo sapiens
caacagttacataatt

SEQ ID NO: 2493589 - DNA, 12 bp, Homo sapiens
caacagtttaat

SEQ ID NO: 2493590 - DNA, 22 bp, Homo sapiens
caacagttttcctatgctttga

SEQ ID NO: 2493591 - DNA, 21 bp, Homo sapiens
cacagtgtgtgacttacagaa

SEQ ID NO: 2493592 - DNA, 19 bp, Homo sapiens
cacagtgttgcccaggctg

SEQ ID NO: 2493593 - DNA, 23 bp, Homo sapiens
cacagttgaagggaggggctgtg

SEQ ID NO: 2493594 - DNA, 13 bp, Homo sapiens
cacagtttgaaat

SEQ ID NO: 2493595 - DNA, 16 bp, Homo sapiens
cacataccctgacctg

SEQ ID NO: 2493596 - DNA, 18 bp, Homo sapiens
cacatactcatttttcat

SEQ ID NO: 2493597 - DNA, 19 bp, Homo sapiens
cacatactcatttttcatg

SEQ ID NO: 2493598 - DNA, 17 bp, Homo sapiens
cacatctaacctcatct

SEQ ID NO: 2493599 - DNA, 23 bp, Homo sapiens
cacatctcaacaggcctcagggc

SEQ ID NO: 2493600 - DNA, 21 bp, Homo sapiens
cacatctgcattttcacccca

SEQ ID NO: 2493601 - DNA, 16 bp, Homo sapiens
cacatctgtgtcttgt

SEQ ID NO: 2493602 - DNA, 23 bp, Homo sapiens
cacatctgtgtcttgtttggaat

SEQ ID NO: 2493603 - DNA, 21 bp, Homo sapiens
cacatgaacttagattttaca

SEQ ID NO: 2493604 - DNA, 23 bp, Homo sapiens
cacatgaacttagattttacatg

SEQ ID NO: 2493605 - DNA, 20 bp, Homo sapiens
cacatgaatctgcacatctg

SEQ ID NO: 2493606 - DNA, 14 bp, Homo sapiens
cacatgccccatcc

SEQ ID NO: 2493607 - DNA, 12 bp, Homo sapiens
cacatgtttcct

SEQ ID NO: 2493608 - DNA, 14 bp, Homo sapiens
cacatgtttcctct

SEQ ID NO: 2493609 - DNA, 15 bp, Homo sapiens
cacatgtttcctcta

SEQ ID NO: 2493610 - DNA, 16 bp, Homo sapiens
cacattaaagaagacc

SEQ ID NO: 2493611 - DNA, 21 bp, Homo sapiens
cacattggaagagcagcacct

SEQ ID NO: 2493612 - DNA, 17 bp, Homo sapiens
cacatttctaaaatctt

SEQ ID NO: 2493613 - DNA, 21 bp, Homo sapiens
cacatttgctttttgtgatat

SEQ ID NO: 2493614 - DNA, 17 bp, Homo sapiens
cacatttggaatacttt

SEQ ID NO: 2493615 - DNA, 19 bp, Homo sapiens
cacatttgtcagtattttt

SEQ ID NO: 2493616 - DNA, 22 bp, Homo sapiens
cacatttgtcagtatttttgcc

SEQ ID NO: 2493617 - DNA, 17 bp, Homo sapiens
cacattttttaggaaat

SEQ ID NO: 2493618 - DNA, 12 bp, Homo sapiens
caccaaagttct

SEQ ID NO: 2493619 - DNA, 14 bp, Homo sapiens
caccaaagttctaa

SEQ ID NO: 2493620 - DNA, 17 bp, Homo sapiens
caccaaagttctaataa

SEQ ID NO: 2493621 - DNA, 18 bp, Homo sapiens
caccaactactacctgta

SEQ ID NO: 2493622 - DNA, 19 bp, Homo sapiens
caccaactcctagttctag

SEQ ID NO: 2493623 - DNA, 22 bp, Homo sapiens
caccaagacttgttttatgctc

SEQ ID NO: 2493624 - DNA, 14 bp, Homo sapiens
caccaagcacagca

SEQ ID NO: 2493625 - DNA, 15 bp, Homo sapiens
caccaagcacagcag

SEQ ID NO: 2493626 - DNA, 18 bp, Homo sapiens
caccaagcacagcagcct

SEQ ID NO: 2493627 - DNA, 13 bp, Homo sapiens
caccaagccaagg

SEQ ID NO: 2493628 - DNA, 23 bp, Homo sapiens
caccaatgtttcaagaggagccc

SEQ ID NO: 2493629 - DNA, 21 bp, Homo sapiens
caccactctggcagccacact

SEQ ID NO: 2493630 - DNA, 23 bp, Homo sapiens
caccactgccccctgctgccatg

SEQ ID NO: 2493631 - DNA, 17 bp, Homo sapiens
caccagacacccaggac

SEQ ID NO: 2493632 - DNA, 14 bp, Homo sapiens
caccagctgtgtcc

SEQ ID NO: 2493633 - DNA, 15 bp, Homo sapiens
caccagctgtgtcca

SEQ ID NO: 2493634 - DNA, 13 bp, Homo sapiens
caccaggaagccg

SEQ ID NO: 2493635 - DNA, 22 bp, Homo sapiens
caccaggatagagactggaaca

SEQ ID NO: 2493636 - DNA, 13 bp, Homo sapiens
caccaggcagcct

SEQ ID NO: 2493637 - DNA, 14 bp, Homo sapiens
caccaggcagcctc

SEQ ID NO: 2493638 - DNA, 17 bp, Homo sapiens
caccagggcatctctgg

SEQ ID NO: 2493639 - DNA, 19 bp, Homo sapiens
caccagggcatctctgggc

SEQ ID NO: 2493640 - DNA, 20 bp, Homo sapiens
caccagggcatctctgggct

SEQ ID NO: 2493641 - DNA, 21 bp, Homo sapiens
caccagggcatctctgggctg

SEQ ID NO: 2493642 - DNA, 22 bp, Homo sapiens
caccagggcatctctgggctgg

SEQ ID NO: 2493643 - DNA, 14 bp, Homo sapiens
caccagggccagcc

SEQ ID NO: 2493644 - DNA, 16 bp, Homo sapiens
caccagggccagcctc

SEQ ID NO: 2493645 - DNA, 15 bp, Homo sapiens
caccaggggtttctc

SEQ ID NO: 2493646 - DNA, 22 bp, Homo sapiens
caccagggtccttttgacactg

SEQ ID NO: 2493647 - DNA, 20 bp, Homo sapiens
caccagttctcatgggtggc

SEQ ID NO: 2493648 - DNA, 14 bp, Homo sapiens
caccattataatga

SEQ ID NO: 2493649 - DNA, 13 bp, Homo sapiens
caccattgaaggc

SEQ ID NO: 2493650 - DNA, 14 bp, Homo sapiens
caccattgaaggct

SEQ ID NO: 2493651 - DNA, 18 bp, Homo sapiens
caccatttggcatccctg

SEQ ID NO: 2493652 - DNA, 19 bp, Homo sapiens
caccatttggcatccctgg

SEQ ID NO: 2493653 - DNA, 16 bp, Homo sapiens
cacccaccaaccctca

SEQ ID NO: 2493654 - DNA, 16 bp, Homo sapiens
cacccacttctgcact

SEQ ID NO: 2493655 - DNA, 15 bp, Homo sapiens
cacccagacataaag

SEQ ID NO: 2493656 - DNA, 15 bp, Homo sapiens
caccccaacctgctc

SEQ ID NO: 2493657 - DNA, 21 bp, Homo sapiens
caccccaacctgctctcctct

SEQ ID NO: 2493658 - DNA, 22 bp, Homo sapiens
caccccaacctgctctcctctt

SEQ ID NO: 2493659 - DNA, 15 bp, Homo sapiens
caccccactcccaca

SEQ ID NO: 2493660 - DNA, 18 bp, Homo sapiens
caccccagggcagccagg

SEQ ID NO: 2493661 - DNA, 19 bp, Homo sapiens
caccccagggcagccaggg

SEQ ID NO: 2493662 - DNA, 17 bp, Homo sapiens
cacccccagcctgggcc

SEQ ID NO: 2493663 - DNA, 13 bp, Homo sapiens
cacccccagctca

SEQ ID NO: 2493664 - DNA, 18 bp, Homo sapiens
caccccctcacccctcca

SEQ ID NO: 2493665 - DNA, 14 bp, Homo sapiens
caccccctgcagct

SEQ ID NO: 2493666 - DNA, 16 bp, Homo sapiens
caccccgcctgccctc

SEQ ID NO: 2493667 - DNA, 21 bp, Homo sapiens
caccctcactggctctcctgg

SEQ ID NO: 2493668 - DNA, 12 bp, Homo sapiens
caccctcttcct

SEQ ID NO: 2493669 - DNA, 14 bp, Homo sapiens
caccctcttcctac

SEQ ID NO: 2493670 - DNA, 17 bp, Homo sapiens
caccctgataggaagag

SEQ ID NO: 2493671 - DNA, 21 bp, Homo sapiens
caccctggaggatttcatctc

SEQ ID NO: 2493672 - DNA, 22 bp, Homo sapiens
caccctggccgagtccaagctg

SEQ ID NO: 2493673 - DNA, 11 bp, Homo sapiens
caccctggcct

SEQ ID NO: 2493674 - DNA, 19 bp, Homo sapiens
caccctgtctgccccgccc

SEQ ID NO: 2493675 - DNA, 18 bp, Homo sapiens
caccctgtggtcttcctc

SEQ ID NO: 2493676 - DNA, 13 bp, Homo sapiens
cacccttcccctc

SEQ ID NO: 2493677 - DNA, 22 bp, Homo sapiens
cacccttcccctccttctccct

SEQ ID NO: 2493678 - DNA, 15 bp, Homo sapiens
cacccttctcccact

SEQ ID NO: 2493679 - DNA, 18 bp, Homo sapiens
cacccttctcccactctc

SEQ ID NO: 2493680 - DNA, 23 bp, Homo sapiens
cacccttctcccactctcctagg

SEQ ID NO: 2493681 - DNA, 20 bp, Homo sapiens
caccctttgctgtgaggctg

SEQ ID NO: 2493682 - DNA, 17 bp, Homo sapiens
caccggaccagcctggc

SEQ ID NO: 2493683 - DNA, 19 bp, Homo sapiens
caccgggccactccttcct

SEQ ID NO: 2493684 - DNA, 23 bp, Homo sapiens
caccgggccactccttcctgccc

SEQ ID NO: 2493685 - DNA, 15 bp, Homo sapiens
caccgtgggcaggga

SEQ ID NO: 2493686 - DNA, 15 bp, Homo sapiens
cacctaactcttctt

SEQ ID NO: 2493687 - DNA, 17 bp, Homo sapiens
cacctaatccaggcaga

SEQ ID NO: 2493688 - DNA, 21 bp, Homo sapiens
cacctaatccaggcagatcca

SEQ ID NO: 2493689 - DNA, 14 bp, Homo sapiens
cacctagctgaatg

SEQ ID NO: 2493690 - DNA, 23 bp, Homo sapiens
cacctagctgaatgtttttctaa

SEQ ID NO: 2493691 - DNA, 17 bp, Homo sapiens
cacctaggaagcctcag

SEQ ID NO: 2493692 - DNA, 18 bp, Homo sapiens
cacctaggaagcctcaga

SEQ ID NO: 2493693 - DNA, 21 bp, Homo sapiens
cacctattatcccagctgcct

SEQ ID NO: 2493694 - DNA, 13 bp, Homo sapiens
cacctatttccat

SEQ ID NO: 2493695 - DNA, 19 bp, Homo sapiens
cagaggcccccagcccagg

SEQ ID NO: 2493696 - DNA, 23 bp, Homo sapiens
cagaggcccccagcccagggctc

SEQ ID NO: 2493697 - DNA, 14 bp, Homo sapiens
cagaggctgggttc

SEQ ID NO: 2493698 - DNA, 14 bp, Homo sapiens
cagagggcactctg

SEQ ID NO: 2493699 - DNA, 11 bp, Homo sapiens
cagagggctgg

SEQ ID NO: 2493700 - DNA, 18 bp, Homo sapiens
cagagggctggaggccca

SEQ ID NO: 2493701 - DNA, 23 bp, Homo sapiens
cagaggggcctgccacctggacc

SEQ ID NO: 2493702 - DNA, 16 bp, Homo sapiens
cagagtccttaaaatg

SEQ ID NO: 2493703 - DNA, 14 bp, Homo sapiens
cagagtgagaccca

SEQ ID NO: 2493704 - DNA, 12 bp, Homo sapiens
cagagttacagt

SEQ ID NO: 2493705 - DNA, 15 bp, Homo sapiens
cagagttacagttct

SEQ ID NO: 2493706 - DNA, 16 bp, Homo sapiens
cagagttacagttctg

SEQ ID NO: 2493707 - DNA, 19 bp, Homo sapiens
cagagttacagttctgtgg

SEQ ID NO: 2493708 - DNA, 13 bp, Homo sapiens
cagataatgtgaa

SEQ ID NO: 2493709 - DNA, 15 bp, Homo sapiens
cagatatatattcat

SEQ ID NO: 2493710 - DNA, 20 bp, Homo sapiens
cagatatcttggacaaatca

SEQ ID NO: 2493711 - DNA, 18 bp, Homo sapiens
cagatccagcctggggtc

SEQ ID NO: 2493712 - DNA, 12 bp, Homo sapiens
cagatccaggac

SEQ ID NO: 2493713 - DNA, 20 bp, Homo sapiens
cagatccaggagctccagtg

SEQ ID NO: 2493714 - DNA, 14 bp, Homo sapiens
cagatccagggaca

SEQ ID NO: 2493715 - DNA, 15 bp, Homo sapiens
cagatccagggacag

SEQ ID NO: 2493716 - DNA, 13 bp, Homo sapiens
cagatcctcctca

SEQ ID NO: 2493717 - DNA, 16 bp, Homo sapiens
cagatcggccacaggg

SEQ ID NO: 2493718 - DNA, 14 bp, Homo sapiens
cagatctggaacct

SEQ ID NO: 2493719 - DNA, 17 bp, Homo sapiens
cagatgaatgccgtgga

SEQ ID NO: 2493720 - DNA, 23 bp, Homo sapiens
cagatgacctcgtactcaggagc

SEQ ID NO: 2493721 - DNA, 16 bp, Homo sapiens
cagatgcagctcaaga

SEQ ID NO: 2493722 - DNA, 14 bp, Homo sapiens
cagatgcagggcag

SEQ ID NO: 2493723 - DNA, 17 bp, Homo sapiens
cagatgcctccttcctc

SEQ ID NO: 2493724 - DNA, 14 bp, Homo sapiens
cagatgctccaaga

SEQ ID NO: 2493725 - DNA, 16 bp, Homo sapiens
cagatggccagcccct

SEQ ID NO: 2493726 - DNA, 15 bp, Homo sapiens
cagatgtaggaggga

SEQ ID NO: 2493727 - DNA, 17 bp, Homo sapiens
cagatgtaggagggact

SEQ ID NO: 2493728 - DNA, 15 bp, Homo sapiens
cagattcagaaatga

SEQ ID NO: 2493729 - DNA, 21 bp, Homo sapiens
cagattcagaaatgaggccat

SEQ ID NO: 2493730 - DNA, 13 bp, Homo sapiens
cagattccttccc

SEQ ID NO: 2493731 - DNA, 13 bp, Homo sapiens
cagatttggaaag

SEQ ID NO: 2493732 - DNA, 22 bp, Homo sapiens
cagatttggggtataggtctca

SEQ ID NO: 2493733 - DNA, 14 bp, Homo sapiens
cagcaaacaggtgc

SEQ ID NO: 2493734 - DNA, 15 bp, Homo sapiens
cagcaaagcccccag

SEQ ID NO: 2493735 - DNA, 17 bp, Homo sapiens
cagcaaagcccccagag

SEQ ID NO: 2493736 - DNA, 22 bp, Homo sapiens
cagcaaagcccccagagcccag

SEQ ID NO: 2493737 - DNA, 23 bp, Homo sapiens
cagcaaagcccccagagcccagg

SEQ ID NO: 2493738 - DNA, 22 bp, Homo sapiens
cagcaaatgcaaaaactctttg

SEQ ID NO: 2493739 - DNA, 13 bp, Homo sapiens
cagcaaccccagg

SEQ ID NO: 2493740 - DNA, 16 bp, Homo sapiens
cagcaaccccaggctg

SEQ ID NO: 2493741 - DNA, 22 bp, Homo sapiens
cagcaacttgtcctagcacaga

SEQ ID NO: 2493742 - DNA, 19 bp, Homo sapiens
cagcaaggcccgagcagct

SEQ ID NO: 2493743 - DNA, 21 bp, Homo sapiens
cagcaaggcccgagcagctga

SEQ ID NO: 2493744 - DNA, 23 bp, Homo sapiens
cagcaaggcccgagcagctgagc

SEQ ID NO: 2493745 - DNA, 13 bp, Homo sapiens
cagcacacagggc

SEQ ID NO: 2493746 - DNA, 14 bp, Homo sapiens
cagcacacagggca

SEQ ID NO: 2493747 - DNA, 13 bp, Homo sapiens
cagcacagccaac

SEQ ID NO: 2493748 - DNA, 17 bp, Homo sapiens
cagcacagcttagattt

SEQ ID NO: 2493749 - DNA, 19 bp, Homo sapiens
cagcacatctcaacaggcc

SEQ ID NO: 2493750 - DNA, 11 bp, Homo sapiens
cagcaccaaat

SEQ ID NO: 2493751 - DNA, 19 bp, Homo sapiens
cagcaccaaatcaaaatct

SEQ ID NO: 2493752 - DNA, 23 bp, Homo sapiens
cagcaccaaatcaaaatctctcc

SEQ ID NO: 2493753 - DNA, 19 bp, Homo sapiens
cagcaccggaccagcctgg

SEQ ID NO: 2493754 - DNA, 19 bp, Homo sapiens
cagcacctcctcagcctga

SEQ ID NO: 2493755 - DNA, 12 bp, Homo sapiens
cagcacctggca

SEQ ID NO: 2493756 - DNA, 22 bp, Homo sapiens
cagcactcgctagcagtggcag

SEQ ID NO: 2493757 - DNA, 14 bp, Homo sapiens
cagcactgcctgct

SEQ ID NO: 2493758 - DNA, 16 bp, Homo sapiens
cagcactgcttgagga

SEQ ID NO: 2493759 - DNA, 12 bp, Homo sapiens
cagcactgtccc

SEQ ID NO: 2493760 - DNA, 14 bp, Homo sapiens
cagcactgtccctt

SEQ ID NO: 2493761 - DNA, 15 bp, Homo sapiens
cagcacttggccctt

SEQ ID NO: 2493762 - DNA, 19 bp, Homo sapiens
cagcacttggcccttctac

SEQ ID NO: 2493763 - DNA, 18 bp, Homo sapiens
cagcacttgtccagctga

SEQ ID NO: 2493764 - DNA, 16 bp, Homo sapiens
cagcagacagagccag

SEQ ID NO: 2493765 - DNA, 10 bp, Homo sapiens
cagcagccag

SEQ ID NO: 2493766 - DNA, 20 bp, Homo sapiens
cagcagccagccctgcctgg

SEQ ID NO: 2493767 - DNA, 21 bp, Homo sapiens
cagcagccagccctgcctgga

SEQ ID NO: 2493768 - DNA, 22 bp, Homo sapiens
cagcagccagccctgcctggag

SEQ ID NO: 2493769 - DNA, 16 bp, Homo sapiens
cagcagccccacacca

SEQ ID NO: 2493770 - DNA, 23 bp, Homo sapiens
cagcagcccccagctcccacctc

SEQ ID NO: 2493771 - DNA, 18 bp, Homo sapiens
cagcaggaggggggaggg

SEQ ID NO: 2493772 - DNA, 19 bp, Homo sapiens
cagcagggctaccctgagc

SEQ ID NO: 2493773 - DNA, 21 bp, Homo sapiens
cagcagggctaccctgagctg

SEQ ID NO: 2493774 - DNA, 17 bp, Homo sapiens
cagcagtgtgaggccag

SEQ ID NO: 2493775 - DNA, 13 bp, Homo sapiens
cagcatcagggtt

SEQ ID NO: 2493776 - DNA, 17 bp, Homo sapiens
cagcatccgcaggtgct

SEQ ID NO: 2493777 - DNA, 21 bp, Homo sapiens
cagcatctccaagcagcttag

SEQ ID NO: 2493778 - DNA, 23 bp, Homo sapiens
cagcatctctaccttctccccag

SEQ ID NO: 2493779 - DNA, 16 bp, Homo sapiens
cagcatctgggccttg

SEQ ID NO: 2493780 - DNA, 19 bp, Homo sapiens
cagcatctgggccttggcc

SEQ ID NO: 2493781 - DNA, 22 bp, Homo sapiens
cagcatctgggccttggcctgg

SEQ ID NO: 2493782 - DNA, 12 bp, Homo sapiens
cagcatgaattt

SEQ ID NO: 2493783 - DNA, 14 bp, Homo sapiens
cagcatgaatttgt

SEQ ID NO: 2493784 - DNA, 17 bp, Homo sapiens
cagcatgaatttgtaat

SEQ ID NO: 2493785 - DNA, 21 bp, Homo sapiens
cagcatgtacggattttcagt

SEQ ID NO: 2493786 - DNA, 22 bp, Homo sapiens
cagcatgtacggattttcagtt

SEQ ID NO: 2493787 - DNA, 16 bp, Homo sapiens
cagcattccagcccct

SEQ ID NO: 2493788 - DNA, 20 bp, Homo sapiens
cagcattccagcccctctgg

SEQ ID NO: 2493789 - DNA, 21 bp, Homo sapiens
cagcattccagcccctctggt

SEQ ID NO: 2493790 - DNA, 12 bp, Homo sapiens
cagcattcccag

SEQ ID NO: 2493791 - DNA, 13 bp, Homo sapiens
cagcattcccagg

SEQ ID NO: 2493792 - DNA, 18 bp, Homo sapiens
cagcattcccaggtaggc

SEQ ID NO: 2493793 - DNA, 20 bp, Homo sapiens
cagccaacacgcacctgcct

SEQ ID NO: 2493794 - DNA, 14 bp, Homo sapiens
cagccaactagccc

SEQ ID NO: 2493795 - DNA, 16 bp, Homo sapiens
cagccaactagcccct

SEQ ID NO: 2493796 - DNA, 19 bp, Homo sapiens
cagccaactagcccctggg

SEQ ID NO: 2493797 - DNA, 23 bp, Homo sapiens
cagccaaggttttataaggctga

SEQ ID NO: 2493798 - DNA, 18 bp, Homo sapiens
cagccacacttctcagga

SEQ ID NO: 2493799 - DNA, 22 bp, Homo sapiens
ctcctgacacccttctcccact

SEQ ID NO: 2493800 - DNA, 14 bp, Homo sapiens
ctcctgacactgct

SEQ ID NO: 2493801 - DNA, 12 bp, Homo sapiens
ctcctgaccagt

SEQ ID NO: 2493802 - DNA, 23 bp, Homo sapiens
ctcctgaccagttgcagtcactc

SEQ ID NO: 2493803 - DNA, 20 bp, Homo sapiens
ctcctgagaaaaaaggttcc

SEQ ID NO: 2493804 - DNA, 16 bp, Homo sapiens
ctcctgaggctttgga

SEQ ID NO: 2493805 - DNA, 17 bp, Homo sapiens
ctcctgaggctttggat

SEQ ID NO: 2493806 - DNA, 17 bp, Homo sapiens
ctcctgcacttacttgc

SEQ ID NO: 2493807 - DNA, 14 bp, Homo sapiens
ctcctgcagaccac

SEQ ID NO: 2493808 - DNA, 17 bp, Homo sapiens
ctcctgcccacggagtc

SEQ ID NO: 2493809 - DNA, 16 bp, Homo sapiens
ctcctgccttcctcct

SEQ ID NO: 2493810 - DNA, 20 bp, Homo sapiens
ctcctgccttcctcctgggc

SEQ ID NO: 2493811 - DNA, 23 bp, Homo sapiens
ctcctgctaacggtgctcagggg

SEQ ID NO: 2493812 - DNA, 15 bp, Homo sapiens
ctcctgctgctccct

SEQ ID NO: 2493813 - DNA, 17 bp, Homo sapiens
ctcctgctgctccctca

SEQ ID NO: 2493814 - DNA, 18 bp, Homo sapiens
ctcctgctgctccctcag

SEQ ID NO: 2493815 - DNA, 14 bp, Homo sapiens
ctcctggcttccca

SEQ ID NO: 2493816 - DNA, 23 bp, Homo sapiens
ctcctggcttcccatccccagcg

SEQ ID NO: 2493817 - DNA, 15 bp, Homo sapiens
ctcctgggccctctc

SEQ ID NO: 2493818 - DNA, 22 bp, Homo sapiens
ctcctgggttttgtattctctg

SEQ ID NO: 2493819 - DNA, 15 bp, Homo sapiens
ctcctgtcccctgct

SEQ ID NO: 2493820 - DNA, 16 bp, Homo sapiens
ctcctgtgctcagccc

SEQ ID NO: 2493821 - DNA, 19 bp, Homo sapiens
ctcctgtggccccaccctg

SEQ ID NO: 2493822 - DNA, 13 bp, Homo sapiens
ctcctgtgggagc

SEQ ID NO: 2493823 - DNA, 13 bp, Homo sapiens
ctcctgttgggag

SEQ ID NO: 2493824 - DNA, 24 bp, Homo sapiens
ctcctgttgggagagggcgcaggc

SEQ ID NO: 2493825 - DNA, 19 bp, Homo sapiens
ctccttcatgacagcctcc

SEQ ID NO: 2493826 - DNA, 13 bp, Homo sapiens
ctccttcccaagt

SEQ ID NO: 2493827 - DNA, 17 bp, Homo sapiens
ctccttcccatcgctgt

SEQ ID NO: 2493828 - DNA, 12 bp, Homo sapiens
ctccttccccat

SEQ ID NO: 2493829 - DNA, 19 bp, Homo sapiens
ctccttccctctctggaga

SEQ ID NO: 2493830 - DNA, 21 bp, Homo sapiens
ctccttcctgccccaactcct

SEQ ID NO: 2493831 - DNA, 13 bp, Homo sapiens
ctccttcctggag

SEQ ID NO: 2493832 - DNA, 13 bp, Homo sapiens
ctccttcctgtgt

SEQ ID NO: 2493833 - DNA, 16 bp, Homo sapiens
ctccttgggccctttg

SEQ ID NO: 2493834 - DNA, 13 bp, Homo sapiens
ctcctttaattgt

SEQ ID NO: 2493835 - DNA, 18 bp, Homo sapiens
ctcctttcatcacactgg

SEQ ID NO: 2493836 - DNA, 14 bp, Homo sapiens
ctccttttaaagaa

SEQ ID NO: 2493837 - DNA, 13 bp, Homo sapiens
ctcctttttccat

SEQ ID NO: 2493838 - DNA, 14 bp, Homo sapiens
ctcgaaacacagaa

SEQ ID NO: 2493839 - DNA, 15 bp, Homo sapiens
ctcgaaacacagaaa

SEQ ID NO: 2493840 - DNA, 20 bp, Homo sapiens
ctcgaactattttcaaagac

SEQ ID NO: 2493841 - DNA, 15 bp, Homo sapiens
ctcgaatctctgtgc

SEQ ID NO: 2493842 - DNA, 18 bp, Homo sapiens
ctcgaatctctgtgcctt

SEQ ID NO: 2493843 - DNA, 12 bp, Homo sapiens
ctcgagcgccct

SEQ ID NO: 2493844 - DNA, 19 bp, Homo sapiens
ctcgagcgccctgcagacc

SEQ ID NO: 2493845 - DNA, 20 bp, Homo sapiens
ctcgatgtggtcacagctgt

SEQ ID NO: 2493846 - DNA, 21 bp, Homo sapiens
ctcgcaacccgtgccaagtcc

SEQ ID NO: 2493847 - DNA, 19 bp, Homo sapiens
ctcgcataggacctttcca

SEQ ID NO: 2493848 - DNA, 22 bp, Homo sapiens
ctcgcataggacctttccacca

SEQ ID NO: 2493849 - DNA, 19 bp, Homo sapiens
ctcgcccatccccttgagg

SEQ ID NO: 2493850 - DNA, 14 bp, Homo sapiens
ctcgcccctggcag

SEQ ID NO: 2493851 - DNA, 19 bp, Homo sapiens
ctcgctgccagctctgtat

SEQ ID NO: 2493852 - DNA, 13 bp, Homo sapiens
ctcggaggaagcc

SEQ ID NO: 2493853 - DNA, 15 bp, Homo sapiens
ctcggcctcccaaag

SEQ ID NO: 2493854 - DNA, 22 bp, Homo sapiens
ctcggctccccatgtgtcctgg

SEQ ID NO: 2493855 - DNA, 18 bp, Homo sapiens
ctcggggtgcacaggagg

SEQ ID NO: 2493856 - DNA, 13 bp, Homo sapiens
ctcggtttctcca

SEQ ID NO: 2493857 - DNA, 20 bp, Homo sapiens
ctcgttgactggctgtgtgt

SEQ ID NO: 2493858 - DNA, 13 bp, Homo sapiens
ctcgtttgtgttc

SEQ ID NO: 2493859 - DNA, 17 bp, Homo sapiens
ctctaaaattataaatg

SEQ ID NO: 2493860 - DNA, 22 bp, Homo sapiens
ctctaaagtctgttgattaaag

SEQ ID NO: 2493861 - DNA, 22 bp, Homo sapiens
ctctaacgcctgagcccaggga

SEQ ID NO: 2493862 - DNA, 12 bp, Homo sapiens
ctctaagaaaga

SEQ ID NO: 2493863 - DNA, 16 bp, Homo sapiens
ctctaagatcttagat

SEQ ID NO: 2493864 - DNA, 17 bp, Homo sapiens
ctctaattcacagtgct

SEQ ID NO: 2493865 - DNA, 22 bp, Homo sapiens
ctctacagagcttccctgactc

SEQ ID NO: 2493866 - DNA, 15 bp, Homo sapiens
ctctacatcttctgc

SEQ ID NO: 2493867 - DNA, 15 bp, Homo sapiens
ctctaccttctcccc

SEQ ID NO: 2493868 - DNA, 21 bp, Homo sapiens
ctctaccttctccccagctcc

SEQ ID NO: 2493869 - DNA, 22 bp, Homo sapiens
ctctaccttctccccagctccc

SEQ ID NO: 2493870 - DNA, 20 bp, Homo sapiens
ctctactgaatgtcattgaa

SEQ ID NO: 2493871 - DNA, 19 bp, Homo sapiens
ctctactgggaaggctact

SEQ ID NO: 2493872 - DNA, 13 bp, Homo sapiens
ctctagagcaggg

SEQ ID NO: 2493873 - DNA, 16 bp, Homo sapiens
ctctagagcagggatt

SEQ ID NO: 2493874 - DNA, 13 bp, Homo sapiens
ctctagagtccaa

SEQ ID NO: 2493875 - DNA, 22 bp, Homo sapiens
ctctagtcaatgacatgaattt

SEQ ID NO: 2493876 - DNA, 18 bp, Homo sapiens
ctctatcctctcttcctc

SEQ ID NO: 2493877 - DNA, 16 bp, Homo sapiens
ctctatgagtctagat

SEQ ID NO: 2493878 - DNA, 23 bp, Homo sapiens
ctctattcgccacacagtatttt

SEQ ID NO: 2493879 - DNA, 15 bp, Homo sapiens
ctctcaacaccatga

SEQ ID NO: 2493880 - DNA, 23 bp, Homo sapiens
ctctcacggccacacagctgccg

SEQ ID NO: 2493881 - DNA, 15 bp, Homo sapiens
ctctcagggccaggc

SEQ ID NO: 2493882 - DNA, 18 bp, Homo sapiens
ctctcatttagcctgtcc

SEQ ID NO: 2493883 - DNA, 15 bp, Homo sapiens
ctctccactttcagc

SEQ ID NO: 2493884 - DNA, 18 bp, Homo sapiens
ctctccagctgactaaac

SEQ ID NO: 2493885 - DNA, 12 bp, Homo sapiens
ctctccattctg

SEQ ID NO: 2493886 - DNA, 16 bp, Homo sapiens
ctctccattctgctcc

SEQ ID NO: 2493887 - DNA, 19 bp, Homo sapiens
ctctccattctgctccttc

SEQ ID NO: 2493888 - DNA, 21 bp, Homo sapiens
ctctccattctgctccttccc

SEQ ID NO: 2493889 - DNA, 17 bp, Homo sapiens
ctctcccaccctcttcc

SEQ ID NO: 2493890 - DNA, 14 bp, Homo sapiens
ctctcccaggcagg

SEQ ID NO: 2493891 - DNA, 12 bp, Homo sapiens
ctctcccaggcc

SEQ ID NO: 2493892 - DNA, 13 bp, Homo sapiens
ctctcccaggccc

SEQ ID NO: 2493893 - DNA, 24 bp, Homo sapiens
ctctcccaggccccatgacctcca

SEQ ID NO: 2493894 - DNA, 15 bp, Homo sapiens
ctctccccagcccag

SEQ ID NO: 2493895 - DNA, 23 bp, Homo sapiens
ctctccccaggtccagctctgga

SEQ ID NO: 2493896 - DNA, 19 bp, Homo sapiens
ctctccccccgcctgccac

SEQ ID NO: 2493897 - DNA, 14 bp, Homo sapiens
ctctcccctgcctg

SEQ ID NO: 2493898 - DNA, 16 bp, Homo sapiens
ctctcccctgcctgcc

SEQ ID NO: 2493899 - DNA, 13 bp, Homo sapiens
ctctccctcccct

SEQ ID NO: 2493900 - DNA, 12 bp, Homo sapiens
ctctccctgttg

SEQ ID NO: 2493901 - DNA, 18 bp, Homo sapiens
ctctcccttgggctctga

SEQ ID NO: 2493902 - DNA, 19 bp, Homo sapiens
ctctcccttgggctctgat

SEQ ID NO: 2493903 - DNA, 21 bp, Homo sapiens
ctctcccttgggctctgatga

SEQ ID NO: 2493904 - DNA, 12 bp, Homo sapiens
ctctcctcttct

SEQ ID NO: 2493905 - DNA, 22 bp, Homo sapiens
ctctcctggcttcccatcccca

SEQ ID NO: 2493906 - DNA, 22 bp, Homo sapiens
ctctccttcatgacagcctcca

SEQ ID NO: 2493907 - DNA, 14 bp, Homo sapiens
ctctccttcctgtg

SEQ ID NO: 2493908 - DNA, 13 bp, Homo sapiens
ctctcgcacacct

SEQ ID NO: 2493909 - DNA, 18 bp, Homo sapiens
ctctcggctccccatgtg

SEQ ID NO: 2493910 - DNA, 23 bp, Homo sapiens
ctctctagggtacatggtgctgg

SEQ ID NO: 2493911 - DNA, 16 bp, Homo sapiens
ctctcttctctccagc

SEQ ID NO: 2493912 - DNA, 18 bp, Homo sapiens
ctctctttgcatggattt

SEQ ID NO: 2493913 - DNA, 11 bp, Homo sapiens
ctctgaaatac

SEQ ID NO: 2493914 - DNA, 19 bp, Homo sapiens
ctctgaagccacaaatagg

SEQ ID NO: 2493915 - DNA, 14 bp, Homo sapiens
ctctgacagcagca

SEQ ID NO: 2493916 - DNA, 14 bp, Homo sapiens
ctctgactcagggc

SEQ ID NO: 2493917 - DNA, 15 bp, Homo sapiens
ctctgactcagggct

SEQ ID NO: 2493918 - DNA, 18 bp, Homo sapiens
ctctgacttctgcctgga

SEQ ID NO: 2493919 - DNA, 20 bp, Homo sapiens
ctctgagaattgttgagata

SEQ ID NO: 2493920 - DNA, 23 bp, Homo sapiens
ctctgagaattgttgagatactt

SEQ ID NO: 2493921 - DNA, 14 bp, Homo sapiens
ctctgagaggccct

SEQ ID NO: 2493922 - DNA, 17 bp, Homo sapiens
ctctgagaggccctgga

SEQ ID NO: 2493923 - DNA, 13 bp, Homo sapiens
ctctgagagtcta

SEQ ID NO: 2493924 - DNA, 11 bp, Homo sapiens
ctctgagctgt

SEQ ID NO: 2493925 - DNA, 15 bp, Homo sapiens
ctctgagctgtgcag

SEQ ID NO: 2493926 - DNA, 16 bp, Homo sapiens
ctctgaggccagcctg

SEQ ID NO: 2493927 - DNA, 10 bp, Homo sapiens
ctctgaggcg

SEQ ID NO: 2493928 - DNA, 22 bp, Homo sapiens
ctctgaggtgcctgtcccaccc

SEQ ID NO: 2493929 - DNA, 19 bp, Homo sapiens
ctctgagtgttttatgaga

SEQ ID NO: 2493930 - DNA, 22 bp, Homo sapiens
ctctgagtgttttatgagaaag

SEQ ID NO: 2493931 - DNA, 12 bp, Homo sapiens
ctctgatccctc

SEQ ID NO: 2493932 - DNA, 21 bp, Homo sapiens
ctctgatccctctacagagct

SEQ ID NO: 2493933 - DNA, 14 bp, Homo sapiens
ctctgatgaaaaat

SEQ ID NO: 2493934 - DNA, 22 bp, Homo sapiens
ctctgatgaaaaattgctgact

SEQ ID NO: 2493935 - DNA, 18 bp, Homo sapiens
ctctgatgcagcttatac

SEQ ID NO: 2493936 - DNA, 18 bp, Homo sapiens
ctctgcaattcccctctg

SEQ ID NO: 2493937 - DNA, 21 bp, Homo sapiens
ctctgcaattcccctctgctg

SEQ ID NO: 2493938 - DNA, 20 bp, Homo sapiens
ctctgcactactgacatgtg

SEQ ID NO: 2493939 - DNA, 13 bp, Homo sapiens
ctctgcagcctca

SEQ ID NO: 2493940 - DNA, 15 bp, Homo sapiens
ctctgcattctagta

SEQ ID NO: 2493941 - DNA, 19 bp, Homo sapiens
ctctgccaaaggatgtgat

SEQ ID NO: 2493942 - DNA, 21 bp, Homo sapiens
ctctgccaaaggatgtgatat

SEQ ID NO: 2493943 - DNA, 15 bp, Homo sapiens
ctctgccagtgacag

SEQ ID NO: 2493944 - DNA, 15 bp, Homo sapiens
ctctgcctacagaac

SEQ ID NO: 2493945 - DNA, 15 bp, Homo sapiens
ctctgctctgatgca

SEQ ID NO: 2493946 - DNA, 13 bp, Homo sapiens
ctctgctgacctg

SEQ ID NO: 2493947 - DNA, 18 bp, Homo sapiens
ctctgctggcccagccaa

SEQ ID NO: 2493948 - DNA, 14 bp, Homo sapiens
ctctgcttctctga

SEQ ID NO: 2493949 - DNA, 14 bp, Homo sapiens
ctctggagcatttc

SEQ ID NO: 2493950 - DNA, 16 bp, Homo sapiens
ctctggcagccacact

SEQ ID NO: 2493951 - DNA, 22 bp, Homo sapiens
ctctggcagccacacttctcag

SEQ ID NO: 2493952 - DNA, 19 bp, Homo sapiens
ctctggcattagaattatt

SEQ ID NO: 2493953 - DNA, 19 bp, Homo sapiens
ctctggctgtaaggctcta

SEQ ID NO: 2493954 - DNA, 20 bp, Homo sapiens
ctctggctgtaaggctctag

SEQ ID NO: 2493955 - DNA, 21 bp, Homo sapiens
ctctggctgtaaggctctaga

SEQ ID NO: 2493956 - DNA, 20 bp, Homo sapiens
ctctggcttggccacagcca

SEQ ID NO: 2493957 - DNA, 21 bp, Homo sapiens
ctctggcttggccacagccag

SEQ ID NO: 2493958 - DNA, 20 bp, Homo sapiens
ctctgggatttgcccacgta

SEQ ID NO: 2493959 - DNA, 20 bp, Homo sapiens
ctctgggccattctccacag

SEQ ID NO: 2493960 - DNA, 11 bp, Homo sapiens
ctctgggctct

SEQ ID NO: 2493961 - DNA, 16 bp, Homo sapiens
ctctgggctggatgag

SEQ ID NO: 2493962 - DNA, 20 bp, Homo sapiens
ctctgggctggatgagctcc

SEQ ID NO: 2493963 - DNA, 22 bp, Homo sapiens
ctctgggctggatgagctccca

SEQ ID NO: 2493964 - DNA, 21 bp, Homo sapiens
ctctgggggctgaggagcagc

SEQ ID NO: 2493965 - DNA, 16 bp, Homo sapiens
ctctggtcgctcctgc

SEQ ID NO: 2493966 - DNA, 23 bp, Homo sapiens
ctctggtgagtcaccacttcagg

SEQ ID NO: 2493967 - DNA, 16 bp, Homo sapiens
ctctggtgcctccaga

SEQ ID NO: 2493968 - DNA, 22 bp, Homo sapiens
ctctggttgtttctgttccaaa

SEQ ID NO: 2493969 - DNA, 23 bp, Homo sapiens
ctctgtaagtagatgcatttggg

SEQ ID NO: 2493970 - DNA, 16 bp, Homo sapiens
ctctgtaattgcaaaa

SEQ ID NO: 2493971 - DNA, 22 bp, Homo sapiens
ctctgtatcaggacccagagga

SEQ ID NO: 2493972 - DNA, 20 bp, Homo sapiens
ctctgtcagtcacagccacc

SEQ ID NO: 2493973 - DNA, 19 bp, Homo sapiens
ctctgtccaggcactgaga

SEQ ID NO: 2493974 - DNA, 13 bp, Homo sapiens
ctctgtccccagc

SEQ ID NO: 2493975 - DNA, 14 bp, Homo sapiens
ctctgtccccagcc

SEQ ID NO: 2493976 - DNA, 16 bp, Homo sapiens
ctctgtccccagcctg

SEQ ID NO: 2493977 - DNA, 14 bp, Homo sapiens
ctctgtctcatcca

SEQ ID NO: 2493978 - DNA, 15 bp, Homo sapiens
ctctgtcttgtgttt

SEQ ID NO: 2493979 - DNA, 16 bp, Homo sapiens
ctctgtcttgtgtttc

SEQ ID NO: 2493980 - DNA, 17 bp, Homo sapiens
ctctgtgaccaatgtct

SEQ ID NO: 2493981 - DNA, 18 bp, Homo sapiens
ctctgtgaccaatgtctt

SEQ ID NO: 2493982 - DNA, 18 bp, Homo sapiens
ctctgtgccagagcctgg

SEQ ID NO: 2493983 - DNA, 19 bp, Homo sapiens
ctctgtgccagagcctggg

SEQ ID NO: 2493984 - DNA, 21 bp, Homo sapiens
ctctgtgccagagcctggggc

SEQ ID NO: 2493985 - DNA, 19 bp, Homo sapiens
ctctgtgctggccagcgag

SEQ ID NO: 2493986 - DNA, 18 bp, Homo sapiens
ctctgtgtatttgctttt

SEQ ID NO: 2493987 - DNA, 15 bp, Homo sapiens
ctctgtgtctaagat

SEQ ID NO: 2493988 - DNA, 15 bp, Homo sapiens
ctctgttccttccct

SEQ ID NO: 2493989 - DNA, 22 bp, Homo sapiens
ctctgttcttcctcagccagcc

SEQ ID NO: 2493990 - DNA, 20 bp, Homo sapiens
ctctgttgcaagtgcaataa

SEQ ID NO: 2493991 - DNA, 22 bp, Homo sapiens
ctctgttttacaagttggagtc

SEQ ID NO: 2493992 - DNA, 18 bp, Homo sapiens
ctcttagcagcttccaga

SEQ ID NO: 2493993 - DNA, 19 bp, Homo sapiens
ctcttagcagcttccagat

SEQ ID NO: 2493994 - DNA, 21 bp, Homo sapiens
ctcttatggatgtccccagca

SEQ ID NO: 2493995 - DNA, 22 bp, Homo sapiens
ctcttatggatgtccccagcag

SEQ ID NO: 2493996 - DNA, 18 bp, Homo sapiens
ctcttcactcttcaaatg

SEQ ID NO: 2493997 - DNA, 15 bp, Homo sapiens
ctcttcaggttctca

SEQ ID NO: 2493998 - DNA, 21 bp, Homo sapiens
ctcttccccagacgcctggct

SEQ ID NO: 2493999 - DNA, 16 bp, Homo sapiens
ctcttccccctctccc

SEQ ID NO: 2494000 - DNA, 20 bp, Homo sapiens
ctcttcctactggtctctct

SEQ ID NO: 2494001 - DNA, 21 bp, Homo sapiens
ctcttccttactttttatata

SEQ ID NO: 2494002 - DNA, 23 bp, Homo sapiens
ctcttccttgaagaactgcaggc

SEQ ID NO: 2494003 - DNA, 18 bp, Homo sapiens
ctcttctactcacttttc

SEQ ID NO: 2494004 - DNA, 14 bp, Homo sapiens
ctcttctctccagc

SEQ ID NO: 2494005 - DNA, 19 bp, Homo sapiens
ctcttctctccagctgact

SEQ ID NO: 2494006 - DNA, 22 bp, Homo sapiens
ctcttctgggagggcagcaggg

SEQ ID NO: 2494007 - DNA, 19 bp, Homo sapiens
ctcttctggggcaggctgg

SEQ ID NO: 2494008 - DNA, 19 bp, Homo sapiens
ctcttctttcatttcttct

SEQ ID NO: 2494009 - DNA, 14 bp, Homo sapiens
ctcttgaccaggct

SEQ ID NO: 2494010 - DNA, 15 bp, Homo sapiens
ctcttgaccaggctg

SEQ ID NO: 2494011 - DNA, 19 bp, Homo sapiens
ctcttgaccaggctgcctc

SEQ ID NO: 2494012 - DNA, 18 bp, Homo sapiens
ctcttgatacccccctct

SEQ ID NO: 2494013 - DNA, 23 bp, Homo sapiens
ctcttgatacccccctctgtctt

SEQ ID NO: 2494014 - DNA, 21 bp, Homo sapiens
ctcttgcacagtcactgctct

SEQ ID NO: 2494015 - DNA, 12 bp, Homo sapiens
ctcttgcctgcc

SEQ ID NO: 2494016 - DNA, 18 bp, Homo sapiens
ctcttgcctgccactgtg

SEQ ID NO: 2494017 - DNA, 21 bp, Homo sapiens
ctcttggagaagtctcagcta

SEQ ID NO: 2494018 - DNA, 16 bp, Homo sapiens
ctcttggcctgatcag

SEQ ID NO: 2494019 - DNA, 21 bp, Homo sapiens
ctcttgggaactgaactcact

SEQ ID NO: 2494020 - DNA, 13 bp, Homo sapiens
ctctttcagctcc

SEQ ID NO: 2494021 - DNA, 18 bp, Homo sapiens
ctctttccatgacatcaa

SEQ ID NO: 2494022 - DNA, 17 bp, Homo sapiens
ctctttccctggtccct

SEQ ID NO: 2494023 - DNA, 13 bp, Homo sapiens
ctctttctctgcc

SEQ ID NO: 2494024 - DNA, 11 bp, Homo sapiens
ctctttctgta

SEQ ID NO: 2494025 - DNA, 15 bp, Homo sapiens
ctctttctgtcttct

SEQ ID NO: 2494026 - DNA, 15 bp, Homo sapiens
ctctttcttcccatg

SEQ ID NO: 2494027 - DNA, 12 bp, Homo sapiens
ctctttgagaaa

SEQ ID NO: 2494028 - DNA, 12 bp, Homo sapiens
ctctttgcctca

SEQ ID NO: 2494029 - DNA, 13 bp, Homo sapiens
ctctttgcctcaa

SEQ ID NO: 2494030 - DNA, 18 bp, Homo sapiens
ctctttgttatttgaaaa

SEQ ID NO: 2494031 - DNA, 14 bp, Homo sapiens
ctcttttaccctgg

SEQ ID NO: 2494032 - DNA, 20 bp, Homo sapiens
ctcttttaccctggcccctc

SEQ ID NO: 2494033 - DNA, 21 bp, Homo sapiens
ctcttttaccctggcccctct

SEQ ID NO: 2494034 - DNA, 16 bp, Homo sapiens
ctcttttgctttctgt

SEQ ID NO: 2494035 - DNA, 12 bp, Homo sapiens
ctctttttccaa

SEQ ID NO: 2494036 - DNA, 21 bp, Homo sapiens
ctctttttccaacttggctgc

SEQ ID NO: 2494037 - DNA, 17 bp, Homo sapiens
ctgaaaacactgtgcac

SEQ ID NO: 2494038 - DNA, 17 bp, Homo sapiens
ctgaaaaggtttatgaa

SEQ ID NO: 2494039 - DNA, 14 bp, Homo sapiens
ctgaaaatgtcctt

SEQ ID NO: 2494040 - DNA, 19 bp, Homo sapiens
ctgaaaatgtccttgtgat

SEQ ID NO: 2494041 - DNA, 22 bp, Homo sapiens
ctgaaactcacacaactaggaa

SEQ ID NO: 2494042 - DNA, 15 bp, Homo sapiens
ctgaaattccaaagt

SEQ ID NO: 2494043 - DNA, 20 bp, Homo sapiens
ctgaaattccaaagtctcta

SEQ ID NO: 2494044 - DNA, 20 bp, Homo sapiens
ctgaaattctcctggaggtc

SEQ ID NO: 2494045 - DNA, 20 bp, Homo sapiens
ctgaacaccattgaaggctt

SEQ ID NO: 2494046 - DNA, 15 bp, Homo sapiens
ctgaacagctggtgt

SEQ ID NO: 2494047 - DNA, 19 bp, Homo sapiens
ctgaacagctggtgtagct

SEQ ID NO: 2494048 - DNA, 13 bp, Homo sapiens
ctgaacagctgta

SEQ ID NO: 2494049 - DNA, 13 bp, Homo sapiens
ctgaactgaacac

SEQ ID NO: 2494050 - DNA, 17 bp, Homo sapiens
ctgaacttgcattgtga

SEQ ID NO: 2494051 - DNA, 18 bp, Homo sapiens
ctgaacttgcattgtgat

SEQ ID NO: 2494052 - DNA, 14 bp, Homo sapiens
ctgaagcagcctct

SEQ ID NO: 2494053 - DNA, 13 bp, Homo sapiens
ctgaagcccttgt

SEQ ID NO: 2494054 - DNA, 21 bp, Homo sapiens
ctgaaggagccccattcctgg

SEQ ID NO: 2494055 - DNA, 20 bp, Homo sapiens
ctgaagggggcggcctatga

SEQ ID NO: 2494056 - DNA, 21 bp, Homo sapiens
ctgaagtgagcacagcctagg

SEQ ID NO: 2494057 - DNA, 22 bp, Homo sapiens
ctgaataaattgtacagccggc

SEQ ID NO: 2494058 - DNA, 20 bp, Homo sapiens
ctgaataccactctgtaatt

SEQ ID NO: 2494059 - DNA, 22 bp, Homo sapiens
ctgaataccactctgtaattgc

SEQ ID NO: 2494060 - DNA, 15 bp, Homo sapiens
ctgaatagcagaagg

SEQ ID NO: 2494061 - DNA, 21 bp, Homo sapiens
ctgaatattgccattatgctt

SEQ ID NO: 2494062 - DNA, 16 bp, Homo sapiens
ctgaatgttgggactg

SEQ ID NO: 2494063 - DNA, 18 bp, Homo sapiens
ctgaatgtttttctaaag

SEQ ID NO: 2494064 - DNA, 12 bp, Homo sapiens
ctgaatttttaa

SEQ ID NO: 2494065 - DNA, 18 bp, Homo sapiens
ctgaatttttaaacaagt

SEQ ID NO: 2494066 - DNA, 20 bp, Homo sapiens
ctgacaaccactggtctgta

SEQ ID NO: 2494067 - DNA, 14 bp, Homo sapiens
ctgacacaccaggc

SEQ ID NO: 2494068 - DNA, 13 bp, Homo sapiens
ctgacacactaac

SEQ ID NO: 2494069 - DNA, 16 bp, Homo sapiens
ctgacacactaaccaa

SEQ ID NO: 2494070 - DNA, 23 bp, Homo sapiens
ctgacacactaaccaagctgagt

SEQ ID NO: 2494071 - DNA, 16 bp, Homo sapiens
ctgacacctaactctt

SEQ ID NO: 2494072 - DNA, 17 bp, Homo sapiens
ctgacactcccttgggc

SEQ ID NO: 2494073 - DNA, 20 bp, Homo sapiens
ctgacactgctggagaggcc

SEQ ID NO: 2494074 - DNA, 21 bp, Homo sapiens
ctgacactgctggagaggccc

SEQ ID NO: 2494075 - DNA, 11 bp, Homo sapiens
ctgacagcagc

SEQ ID NO: 2494076 - DNA, 13 bp, Homo sapiens
ctgacatcaaaaa

SEQ ID NO: 2494077 - DNA, 15 bp, Homo sapiens
ctgacatcaaaaaag

SEQ ID NO: 2494078 - DNA, 23 bp, Homo sapiens
ctgacattcacctgccccaactc

SEQ ID NO: 2494079 - DNA, 15 bp, Homo sapiens
ctgaccacagcacag

SEQ ID NO: 2494080 - DNA, 22 bp, Homo sapiens
ctgaccacctttgtttctcccc

SEQ ID NO: 2494081 - DNA, 14 bp, Homo sapiens
ctgaccactcagag

SEQ ID NO: 2494082 - DNA, 15 bp, Homo sapiens
ctgaccactcagaga

SEQ ID NO: 2494083 - DNA, 22 bp, Homo sapiens
ctgaccactcagagacatgcag

SEQ ID NO: 2494084 - DNA, 13 bp, Homo sapiens
ctgaccagctccc

SEQ ID NO: 2494085 - DNA, 13 bp, Homo sapiens
ctgaccagctgct

SEQ ID NO: 2494086 - DNA, 21 bp, Homo sapiens
ctgaccatgctcatctgctgg

SEQ ID NO: 2494087 - DNA, 10 bp, Homo sapiens
ctgacccagt

SEQ ID NO: 2494088 - DNA, 12 bp, Homo sapiens
ctgacccagtgc

SEQ ID NO: 2494089 - DNA, 13 bp, Homo sapiens
ctgacccagtgcc

SEQ ID NO: 2494090 - DNA, 21 bp, Homo sapiens
ctgacccagtgcccccactga

SEQ ID NO: 2494091 - DNA, 15 bp, Homo sapiens
ctgaccccatcacct

SEQ ID NO: 2494092 - DNA, 18 bp, Homo sapiens
ctgaccccatcacctact

SEQ ID NO: 2494093 - DNA, 18 bp, Homo sapiens
ctgacctgtgagcccagc

SEQ ID NO: 2494094 - DNA, 14 bp, Homo sapiens
ctgacggactcatg

SEQ ID NO: 2494095 - DNA, 15 bp, Homo sapiens
ctgacggccagggag

SEQ ID NO: 2494096 - DNA, 21 bp, Homo sapiens
ctgacggccagggagaagctc

SEQ ID NO: 2494097 - DNA, 19 bp, Homo sapiens
ctgactaaactttttttct

SEQ ID NO: 2494098 - DNA, 21 bp, Homo sapiens
ctgactagggagccatgtttc

SEQ ID NO: 2494099 - DNA, 16 bp, Homo sapiens
ctgactcattctgaag

SEQ ID NO: 2494100 - DNA, 23 bp, Homo sapiens
ctgacttcatctcccacctagca

SEQ ID NO: 2494101 - DNA, 11 bp, Homo sapiens
ctgacttctgc

SEQ ID NO: 2494102 - DNA, 18 bp, Homo sapiens
ctgacttctgcctggaga

SEQ ID NO: 2494103 - DNA, 15 bp, Homo sapiens
ctgactttgcttgct

SEQ ID NO: 2494104 - DNA, 22 bp, Homo sapiens
ctgagaaccgtagatgatttca

SEQ ID NO: 2494105 - DNA, 12 bp, Homo sapiens
ctgagaacctgg

SEQ ID NO: 2494106 - DNA, 13 bp, Homo sapiens
ctgagaagcaaac

SEQ ID NO: 2494107 - DNA, 16 bp, Homo sapiens
ctgagaatcagactga

SEQ ID NO: 2494108 - DNA, 21 bp, Homo sapiens
ctgagaattgttgagatactt

SEQ ID NO: 2494109 - DNA, 16 bp, Homo sapiens
ctgagactccagacct

SEQ ID NO: 2494110 - DNA, 14 bp, Homo sapiens
ctgagaggccctgg

SEQ ID NO: 2494111 - DNA, 15 bp, Homo sapiens
ctgagaggccctgga

SEQ ID NO: 2494112 - DNA, 16 bp, Homo sapiens
ctgagaggccctggat

SEQ ID NO: 2494113 - DNA, 17 bp, Homo sapiens
ctgagagtctagattct

SEQ ID NO: 2494114 - DNA, 22 bp, Homo sapiens
ctgagagtctagattctctggc

SEQ ID NO: 2494115 - DNA, 13 bp, Homo sapiens
ctgagatggctcc

SEQ ID NO: 2494116 - DNA, 20 bp, Homo sapiens
ctgagatggctcccaggggc

SEQ ID NO: 2494117 - DNA, 19 bp, Homo sapiens
ctgagatttattaaagaaa

SEQ ID NO: 2494118 - DNA, 19 bp, Homo sapiens
ctgagcaacgctattccag

SEQ ID NO: 2494119 - DNA, 20 bp, Homo sapiens
ctgagcaacgctattccagc

SEQ ID NO: 2494120 - DNA, 14 bp, Homo sapiens
ctgagcactgccag

SEQ ID NO: 2494121 - DNA, 19 bp, Homo sapiens
ctgagcactgccaggaggg

SEQ ID NO: 2494122 - DNA, 16 bp, Homo sapiens
ctgagcagcgagcctg

SEQ ID NO: 2494123 - DNA, 23 bp, Homo sapiens
ctgagcaggccacacttcaaact

SEQ ID NO: 2494124 - DNA, 21 bp, Homo sapiens
ctgagcagggccggggaactg

SEQ ID NO: 2494125 - DNA, 15 bp, Homo sapiens
ctgagcagtccttgg

SEQ ID NO: 2494126 - DNA, 17 bp, Homo sapiens
ctgagcagtccttggcc

SEQ ID NO: 2494127 - DNA, 18 bp, Homo sapiens
ctgagcagtccttggcct

SEQ ID NO: 2494128 - DNA, 21 bp, Homo sapiens
ctgagcagtccttggcctgct

SEQ ID NO: 2494129 - DNA, 22 bp, Homo sapiens
ctgagcagtccttggcctgcta

SEQ ID NO: 2494130 - DNA, 20 bp, Homo sapiens
ctgagcagtgaatgattcag

SEQ ID NO: 2494131 - DNA, 17 bp, Homo sapiens
ctgagccagggtctcca

SEQ ID NO: 2494132 - DNA, 18 bp, Homo sapiens
ctgagccagggtctccag

SEQ ID NO: 2494133 - DNA, 14 bp, Homo sapiens
ctgagcccagggag

SEQ ID NO: 2494134 - DNA, 15 bp, Homo sapiens
ctgagcccagggagg

SEQ ID NO: 2494135 - DNA, 19 bp, Homo sapiens
ctgagcccagggaggccga

SEQ ID NO: 2494136 - DNA, 22 bp, Homo sapiens
ctgagcccagggaggccgaagc

SEQ ID NO: 2494137 - DNA, 13 bp, Homo sapiens
ctgagcctgccga

SEQ ID NO: 2494138 - DNA, 14 bp, Homo sapiens
ctgagcctgccgag

SEQ ID NO: 2494139 - DNA, 19 bp, Homo sapiens
ctgagcctgccgagcaacc

SEQ ID NO: 2494140 - DNA, 21 bp, Homo sapiens
ctgagccttgtaattctaaat

SEQ ID NO: 2494141 - DNA, 18 bp, Homo sapiens
ctgagcgagtggagtctg

SEQ ID NO: 2494142 - DNA, 22 bp, Homo sapiens
ctgagcgcctccatccaaggcc

SEQ ID NO: 2494143 - DNA, 14 bp, Homo sapiens
ctgagctcacaagg

SEQ ID NO: 2494144 - DNA, 17 bp, Homo sapiens
ctgagctcacaaggcag

SEQ ID NO: 2494145 - DNA, 19 bp, Homo sapiens
ctgagctcacaaggcagca

SEQ ID NO: 2494146 - DNA, 12 bp, Homo sapiens
ctgagctcctgt

SEQ ID NO: 2494147 - DNA, 22 bp, Homo sapiens
ctgagctcctgtcccctgctac

SEQ ID NO: 2494148 - DNA, 21 bp, Homo sapiens
ctgagctctgagaggccctgg

SEQ ID NO: 2494149 - DNA, 23 bp, Homo sapiens
ctgagctctgagaggccctggat

SEQ ID NO: 2494150 - DNA, 12 bp, Homo sapiens
ctgagctgaggc

SEQ ID NO: 2494151 - DNA, 15 bp, Homo sapiens
ctgagctgaggcagc

SEQ ID NO: 2494152 - DNA, 14 bp, Homo sapiens
ctgaggacagatgc

SEQ ID NO: 2494153 - DNA, 15 bp, Homo sapiens
ctgaggacagatgcc

SEQ ID NO: 2494154 - DNA, 18 bp, Homo sapiens
ctgaggacagatgcctcc

SEQ ID NO: 2494155 - DNA, 15 bp, Homo sapiens
ctgaggagtctgagg

SEQ ID NO: 2494156 - DNA, 20 bp, Homo sapiens
ctgaggagtctgaggtcctg

SEQ ID NO: 2494157 - DNA, 23 bp, Homo sapiens
ctgaggcagcagtgtgaggccag

SEQ ID NO: 2494158 - DNA, 20 bp, Homo sapiens
ctgaggccacactcagcaca

SEQ ID NO: 2494159 - DNA, 21 bp, Homo sapiens
ctgaggccacactcagcacaa

SEQ ID NO: 2494160 - DNA, 12 bp, Homo sapiens
ctgaggccagcc

SEQ ID NO: 2494161 - DNA, 14 bp, Homo sapiens
ctgaggccagcctg

SEQ ID NO: 2494162 - DNA, 18 bp, Homo sapiens
ctgaggccagcctggcct

SEQ ID NO: 2494163 - DNA, 19 bp, Homo sapiens
ctgaggccagcctggcctc

SEQ ID NO: 2494164 - DNA, 20 bp, Homo sapiens
ctgaggccagcctggcctcc

SEQ ID NO: 2494165 - DNA, 11 bp, Homo sapiens
ctgaggctggc

SEQ ID NO: 2494166 - DNA, 18 bp, Homo sapiens
ctgaggctggcacaggac

SEQ ID NO: 2494167 - DNA, 19 bp, Homo sapiens
ctgaggctggcacaggaca

SEQ ID NO: 2494168 - DNA, 20 bp, Homo sapiens
ctgaggctggcacaggacat

SEQ ID NO: 2494169 - DNA, 19 bp, Homo sapiens
ctgaggctgtggtcacagc

SEQ ID NO: 2494170 - DNA, 20 bp, Homo sapiens
ctgaggctgtggtcacagcg

SEQ ID NO: 2494171 - DNA, 15 bp, Homo sapiens
ctgaggctttggatt

SEQ ID NO: 2494172 - DNA, 18 bp, Homo sapiens
ctgaggctttggatttga

SEQ ID NO: 2494173 - DNA, 12 bp, Homo sapiens
ctgagggagcct

SEQ ID NO: 2494174 - DNA, 13 bp, Homo sapiens
ctgagggagcctg

SEQ ID NO: 2494175 - DNA, 21 bp, Homo sapiens
ctgagggcagttcgcagccac

SEQ ID NO: 2494176 - DNA, 13 bp, Homo sapiens
ctgaggtgcccag

SEQ ID NO: 2494177 - DNA, 15 bp, Homo sapiens
ctgaggtgcccagga

SEQ ID NO: 2494178 - DNA, 18 bp, Homo sapiens
ctgaggtgcccaggagaa

SEQ ID NO: 2494179 - DNA, 17 bp, Homo sapiens
ctgagtacccctgcttt

SEQ ID NO: 2494180 - DNA, 13 bp, Homo sapiens
ctgagtactccac

SEQ ID NO: 2494181 - DNA, 18 bp, Homo sapiens
ctgagtactccacactgc

SEQ ID NO: 2494182 - DNA, 23 bp, Homo sapiens
ctgagtactccacactgcacaat

SEQ ID NO: 2494183 - DNA, 23 bp, Homo sapiens
ctgagtattaaaatgtatgcatg

SEQ ID NO: 2494184 - DNA, 14 bp, Homo sapiens
ctgagtcagagcca

SEQ ID NO: 2494185 - DNA, 21 bp, Homo sapiens
ctgagtcgtgacctgctaggc

SEQ ID NO: 2494186 - DNA, 13 bp, Homo sapiens
ctgagtggcaggg

SEQ ID NO: 2494187 - DNA, 15 bp, Homo sapiens
ctgagttgcttttca

SEQ ID NO: 2494188 - DNA, 15 bp, Homo sapiens
ctgagttggagctca

SEQ ID NO: 2494189 - DNA, 19 bp, Homo sapiens
ctgagttttccatggcagg

SEQ ID NO: 2494190 - DNA, 22 bp, Homo sapiens
ctgagttttccatggcaggaag

SEQ ID NO: 2494191 - DNA, 13 bp, Homo sapiens
ctgagttttgtgt

SEQ ID NO: 2494192 - DNA, 19 bp, Homo sapiens
ctgagttttgtgtttgttg

SEQ ID NO: 2494193 - DNA, 19 bp, Homo sapiens
ctgataagagaatcaacat

SEQ ID NO: 2494194 - DNA, 18 bp, Homo sapiens
ctgataattttaaattct

SEQ ID NO: 2494195 - DNA, 19 bp, Homo sapiens
ctgatagggtttgtgacag

SEQ ID NO: 2494196 - DNA, 14 bp, Homo sapiens
ctgatcagagccgt

SEQ ID NO: 2494197 - DNA, 15 bp, Homo sapiens
ctgatcccagagagc

SEQ ID NO: 2494198 - DNA, 19 bp, Homo sapiens
ctgatcctggaggcccagt

SEQ ID NO: 2494199 - DNA, 13 bp, Homo sapiens
ctgatcgccttcc

SEQ ID NO: 2494200 - DNA, 16 bp, Homo sapiens
ctgatcgccttcccca

SEQ ID NO: 2494201 - DNA, 12 bp, Homo sapiens
ctgatgcagctt

SEQ ID NO: 2494202 - DNA, 18 bp, Homo sapiens
ctgatgtcaatttctgtg

SEQ ID NO: 2494203 - DNA, 13 bp, Homo sapiens
ctgatgtctccta

SEQ ID NO: 2494204 - DNA, 15 bp, Homo sapiens
ctgatgtctcctaag

SEQ ID NO: 2494205 - DNA, 18 bp, Homo sapiens
ctgatgtctcctaagcac

SEQ ID NO: 2494206 - DNA, 12 bp, Homo sapiens
ctgatgttgtgt

SEQ ID NO: 2494207 - DNA, 15 bp, Homo sapiens
ctgattaaatgacac

SEQ ID NO: 2494208 - DNA, 14 bp, Homo sapiens
ctgattgtttacag

SEQ ID NO: 2494209 - DNA, 21 bp, Homo sapiens
ctgatttaggagaagccagga

SEQ ID NO: 2494210 - DNA, 22 bp, Homo sapiens
ctgattttaggagctaaggctc

SEQ ID NO: 2494211 - DNA, 12 bp, Homo sapiens
ctgcaaactggg

SEQ ID NO: 2494212 - DNA, 18 bp, Homo sapiens
ctgcaaatcaggcttttg

SEQ ID NO: 2494213 - DNA, 13 bp, Homo sapiens
ctgcaacctccac

SEQ ID NO: 2494214 - DNA, 14 bp, Homo sapiens
ctgcaagcacagcc

SEQ ID NO: 2494215 - DNA, 17 bp, Homo sapiens
ctgcaaggtactctggt

SEQ ID NO: 2494216 - DNA, 19 bp, Homo sapiens
ctgcaaggtactctggtga

SEQ ID NO: 2494217 - DNA, 19 bp, Homo sapiens
ctgcaagtcagtccaggat

SEQ ID NO: 2494218 - DNA, 19 bp, Homo sapiens
ctgcaagtgaggtgtgtca

SEQ ID NO: 2494219 - DNA, 14 bp, Homo sapiens
ctgcaattcaaaag

SEQ ID NO: 2494220 - DNA, 18 bp, Homo sapiens
ctgcaattcaaaagttcc

SEQ ID NO: 2494221 - DNA, 20 bp, Homo sapiens
ctgcaattcccctctgctgc

SEQ ID NO: 2494222 - DNA, 20 bp, Homo sapiens
ctgcacaataactcctccca

SEQ ID NO: 2494223 - DNA, 21 bp, Homo sapiens
ctgcacagtgacttctgagat

SEQ ID NO: 2494224 - DNA, 22 bp, Homo sapiens
ctgcacagtgacttctgagatc

SEQ ID NO: 2494225 - DNA, 22 bp, Homo sapiens
ctgcacatctgtaaatctacac

SEQ ID NO: 2494226 - DNA, 23 bp, Homo sapiens
ctgcacatgactcgggggtgggg

SEQ ID NO: 2494227 - DNA, 15 bp, Homo sapiens
ctgcacctgcctcca

SEQ ID NO: 2494228 - DNA, 16 bp, Homo sapiens
ctgcacctgcctccag

SEQ ID NO: 2494229 - DNA, 19 bp, Homo sapiens
ctgcactcccacctgacac

SEQ ID NO: 2494230 - DNA, 22 bp, Homo sapiens
ctgcactcccacctgacacacc

SEQ ID NO: 2494231 - DNA, 15 bp, Homo sapiens
ctgcactgatgctgc

SEQ ID NO: 2494232 - DNA, 17 bp, Homo sapiens
ctgcactgatgctgccc

SEQ ID NO: 2494233 - DNA, 13 bp, Homo sapiens
ctgcactgtaaaa

SEQ ID NO: 2494234 - DNA, 15 bp, Homo sapiens
ctgcactgtaaaatg

SEQ ID NO: 2494235 - DNA, 16 bp, Homo sapiens
ctgcacttacttgctt

SEQ ID NO: 2494236 - DNA, 22 bp, Homo sapiens
ctgcagaatttgggttctgcct

SEQ ID NO: 2494237 - DNA, 15 bp, Homo sapiens
ctgcagaccacgccc

SEQ ID NO: 2494238 - DNA, 13 bp, Homo sapiens
ctgcagaccctgc

SEQ ID NO: 2494239 - DNA, 16 bp, Homo sapiens
ctgcagaccctgccct

SEQ ID NO: 2494240 - DNA, 21 bp, Homo sapiens
ctgcagaccctgcccttgttt

SEQ ID NO: 2494241 - DNA, 12 bp, Homo sapiens
ctgcagaggacg

SEQ ID NO: 2494242 - DNA, 17 bp, Homo sapiens
ctgcagaggccagaggc

SEQ ID NO: 2494243 - DNA, 20 bp, Homo sapiens
ctgcagaggccagaggcccc

SEQ ID NO: 2494244 - DNA, 12 bp, Homo sapiens
ctgcagcctcag

SEQ ID NO: 2494245 - DNA, 13 bp, Homo sapiens
ctgcagcctcaga

SEQ ID NO: 2494246 - DNA, 17 bp, Homo sapiens
ctgcagcctcaggactg

SEQ ID NO: 2494247 - DNA, 18 bp, Homo sapiens
ctgcagcctcaggactgg

SEQ ID NO: 2494248 - DNA, 21 bp, Homo sapiens
ctgcagcctcaggactgggag

SEQ ID NO: 2494249 - DNA, 20 bp, Homo sapiens
ctgcagcttgtagccagccg

SEQ ID NO: 2494250 - DNA, 22 bp, Homo sapiens
ctgcagcttgtagccagccggg

SEQ ID NO: 2494251 - DNA, 15 bp, Homo sapiens
ctgcaggaaggagct

SEQ ID NO: 2494252 - DNA, 16 bp, Homo sapiens
ctgcaggaaggagctg

SEQ ID NO: 2494253 - DNA, 18 bp, Homo sapiens
ctgcaggaaggagctgcc

SEQ ID NO: 2494254 - DNA, 15 bp, Homo sapiens
ctgcaggccctggcc

SEQ ID NO: 2494255 - DNA, 15 bp, Homo sapiens
ctgcaggctgagtgc

SEQ ID NO: 2494256 - DNA, 12 bp, Homo sapiens
ctgcagggaaaa

SEQ ID NO: 2494257 - DNA, 23 bp, Homo sapiens
ctgcagggaaaattatttgcata

SEQ ID NO: 2494258 - DNA, 12 bp, Homo sapiens
ctgcaggggagc

SEQ ID NO: 2494259 - DNA, 14 bp, Homo sapiens
ctgcagtaaatctt

SEQ ID NO: 2494260 - DNA, 13 bp, Homo sapiens
ctgcagtcctgga

SEQ ID NO: 2494261 - DNA, 21 bp, Homo sapiens
ctgcagttcgactctgtgctg

SEQ ID NO: 2494262 - DNA, 22 bp, Homo sapiens
ctgcataatgtttctggatttc

SEQ ID NO: 2494263 - DNA, 22 bp, Homo sapiens
ctgcatcctctggagccagccg

SEQ ID NO: 2494264 - DNA, 14 bp, Homo sapiens
ctgcatgcccagag

SEQ ID NO: 2494265 - DNA, 19 bp, Homo sapiens
ctgcatgcccagagaccca

SEQ ID NO: 2494266 - DNA, 20 bp, Homo sapiens
ctgcatggcagggggctgct

SEQ ID NO: 2494267 - DNA, 16 bp, Homo sapiens
ctgcatggcatcctcc

SEQ ID NO: 2494268 - DNA, 18 bp, Homo sapiens
ctgcatggcatcctccag

SEQ ID NO: 2494269 - DNA, 23 bp, Homo sapiens
ctgcattattggaatataattgt

SEQ ID NO: 2494270 - DNA, 22 bp, Homo sapiens
ctgcattcttctgagcactgtt

SEQ ID NO: 2494271 - DNA, 19 bp, Homo sapiens
ctgcattgaaaagagctga

SEQ ID NO: 2494272 - DNA, 16 bp, Homo sapiens
ctgcattggaactgga

SEQ ID NO: 2494273 - DNA, 17 bp, Homo sapiens
ctgcattttcaccccac

SEQ ID NO: 2494274 - DNA, 18 bp, Homo sapiens
ctgcattttcaccccacc

SEQ ID NO: 2494275 - DNA, 22 bp, Homo sapiens
ctgccaaaggatgtgatatata

SEQ ID NO: 2494276 - DNA, 12 bp, Homo sapiens
ctgccacccagg

SEQ ID NO: 2494277 - DNA, 17 bp, Homo sapiens
ctgccacctccccccac

SEQ ID NO: 2494278 - DNA, 12 bp, Homo sapiens
ctgccacctgga

SEQ ID NO: 2494279 - DNA, 22 bp, Homo sapiens
ctgccacctggacccctgcatt

SEQ ID NO: 2494280 - DNA, 19 bp, Homo sapiens
ctgccactcactaggcccc

SEQ ID NO: 2494281 - DNA, 14 bp, Homo sapiens
ctgccactgagggg

SEQ ID NO: 2494282 - DNA, 14 bp, Homo sapiens
ctgccagcccctgc

SEQ ID NO: 2494283 - DNA, 11 bp, Homo sapiens
ctgccagctgc

SEQ ID NO: 2494284 - DNA, 15 bp, Homo sapiens
ctgccagcttcaggt

SEQ ID NO: 2494285 - DNA, 11 bp, Homo sapiens
ctgccaggagg

SEQ ID NO: 2494286 - DNA, 11 bp, Homo sapiens
ctgccagggca

SEQ ID NO: 2494287 - DNA, 13 bp, Homo sapiens
ctgccagggcagg

SEQ ID NO: 2494288 - DNA, 21 bp, Homo sapiens
ctgccagggcccctctcccca

SEQ ID NO: 2494289 - DNA, 16 bp, Homo sapiens
ctgccagtcctgtcct

SEQ ID NO: 2494290 - DNA, 21 bp, Homo sapiens
ctgccagtgacagacaggctc

SEQ ID NO: 2494291 - DNA, 17 bp, Homo sapiens
ctgccagtgtcctgagc

SEQ ID NO: 2494292 - DNA, 23 bp, Homo sapiens
ctgccatgtttagtgaatgactt

SEQ ID NO: 2494293 - DNA, 23 bp, Homo sapiens
ctgcccaaagcagcacttataaa

SEQ ID NO: 2494294 - DNA, 17 bp, Homo sapiens
ctgcccaacccttccct

SEQ ID NO: 2494295 - DNA, 16 bp, Homo sapiens
ctgcccatggacaggc

SEQ ID NO: 2494296 - DNA, 18 bp, Homo sapiens
ctgcccatggacaggctg

SEQ ID NO: 2494297 - DNA, 24 bp, Homo sapiens
ctgccccaactccttccagctagt

SEQ ID NO: 2494298 - DNA, 18 bp, Homo sapiens
ctgccccacttgtcctta

SEQ ID NO: 2494299 - DNA, 12 bp, Homo sapiens
ctgccccaggcc

SEQ ID NO: 2494300 - DNA, 19 bp, Homo sapiens
ctgcccccaaggaggcagc

SEQ ID NO: 2494301 - DNA, 20 bp, Homo sapiens
ctgcccccaaggaggcagcc

SEQ ID NO: 2494302 - DNA, 23 bp, Homo sapiens
ctgcccccaaggaggcagcctgg

SEQ ID NO: 2494303 - DNA, 22 bp, Homo sapiens
ctgcccccaccccattcccgca

SEQ ID NO: 2494304 - DNA, 23 bp, Homo sapiens
ctgcccccaccccattcccgcag

SEQ ID NO: 2494305 - DNA, 19 bp, Homo sapiens
ctgccccccagcctctggc

SEQ ID NO: 2494306 - DNA, 14 bp, Homo sapiens
ctgccccctgcaga

SEQ ID NO: 2494307 - DNA, 15 bp, Homo sapiens
ctgccccctgcagaa

SEQ ID NO: 2494308 - DNA, 13 bp, Homo sapiens
ctgcccctctcac

SEQ ID NO: 2494309 - DNA, 17 bp, Homo sapiens
ctgccctacctgcccca

SEQ ID NO: 2494310 - DNA, 23 bp, Homo sapiens
ctgccctcctgtgctcagccctg

SEQ ID NO: 2494311 - DNA, 13 bp, Homo sapiens
ctgccctgcccac

SEQ ID NO: 2494312 - DNA, 16 bp, Homo sapiens
ctgccgagcaaccgtg

SEQ ID NO: 2494313 - DNA, 17 bp, Homo sapiens
ctgccggggcagccccc

SEQ ID NO: 2494314 - DNA, 19 bp, Homo sapiens
ctgccggggcagccccctc

SEQ ID NO: 2494315 - DNA, 20 bp, Homo sapiens
ctgccggggcagccccctca

SEQ ID NO: 2494316 - DNA, 15 bp, Homo sapiens
ctgccgtaatttaac

SEQ ID NO: 2494317 - DNA, 13 bp, Homo sapiens
ctgccgtcagtgc

SEQ ID NO: 2494318 - DNA, 19 bp, Homo sapiens
ctgccgtcagtgctgtgct

SEQ ID NO: 2494319 - DNA, 21 bp, Homo sapiens
ctgccgtcccctagagtccca

SEQ ID NO: 2494320 - DNA, 21 bp, Homo sapiens
ctgccgtggggccgccgcctc

SEQ ID NO: 2494321 - DNA, 20 bp, Homo sapiens
ctgcctacagaacttcagaa

SEQ ID NO: 2494322 - DNA, 21 bp, Homo sapiens
ctgcctagaaacaacactgta

SEQ ID NO: 2494323 - DNA, 12 bp, Homo sapiens
ctgcctcagcct

SEQ ID NO: 2494324 - DNA, 11 bp, Homo sapiens
ctgcctcagga

SEQ ID NO: 2494325 - DNA, 12 bp, Homo sapiens
ctgcctcaggac

SEQ ID NO: 2494326 - DNA, 14 bp, Homo sapiens
ctgcctcaggactg

SEQ ID NO: 2494327 - DNA, 15 bp, Homo sapiens
ctgcctccagccgcc

SEQ ID NO: 2494328 - DNA, 15 bp, Homo sapiens
ctgcctcctgccggc

SEQ ID NO: 2494329 - DNA, 22 bp, Homo sapiens
ctgcctctactgggaaggctac

SEQ ID NO: 2494330 - DNA, 15 bp, Homo sapiens
ctgcctctcccaggc

SEQ ID NO: 2494331 - DNA, 18 bp, Homo sapiens
ctgcctctcccaggcagg

SEQ ID NO: 2494332 - DNA, 22 bp, Homo sapiens
ctgcctcttctgggagggcagc

SEQ ID NO: 2494333 - DNA, 20 bp, Homo sapiens
ctgcctgagtcgtgacctgc

SEQ ID NO: 2494334 - DNA, 21 bp, Homo sapiens
ctgcctgagtcgtgacctgct

SEQ ID NO: 2494335 - DNA, 20 bp, Homo sapiens
ctgcctgccagctgcactga

SEQ ID NO: 2494336 - DNA, 15 bp, Homo sapiens
ctgcctgccctggtg

SEQ ID NO: 2494337 - DNA, 14 bp, Homo sapiens
ctgcctgctcccat

SEQ ID NO: 2494338 - DNA, 18 bp, Homo sapiens
ctgcctgctcccatcctg

SEQ ID NO: 2494339 - DNA, 18 bp, Homo sapiens
ctgcctgctcgctccctg

SEQ ID NO: 2494340 - DNA, 12 bp, Homo sapiens
ctgcctggagga

SEQ ID NO: 2494341 - DNA, 16 bp, Homo sapiens
ctgcctggaggacctg

SEQ ID NO: 2494342 - DNA, 20 bp, Homo sapiens
ctgcctggtgcccagcacat

SEQ ID NO: 2494343 - DNA, 21 bp, Homo sapiens
ctgcctgtggccatgaccctg

SEQ ID NO: 2494344 - DNA, 16 bp, Homo sapiens
ctgccttagtctcagt

SEQ ID NO: 2494345 - DNA, 19 bp, Homo sapiens
ctgccttattcagggaagg

SEQ ID NO: 2494346 - DNA, 20 bp, Homo sapiens
ctgccttattcagggaagga

SEQ ID NO: 2494347 - DNA, 13 bp, Homo sapiens
ctgccttcctcct

SEQ ID NO: 2494348 - DNA, 14 bp, Homo sapiens
ctgccttcctcctg

SEQ ID NO: 2494349 - DNA, 16 bp, Homo sapiens
ctgccttcctcctggg

SEQ ID NO: 2494350 - DNA, 13 bp, Homo sapiens
ctgccttcgcttc

SEQ ID NO: 2494351 - DNA, 20 bp, Homo sapiens
ctgccttcgcttcttgcctc

SEQ ID NO: 2494352 - DNA, 23 bp, Homo sapiens
ctgccttcgcttcttgcctctgt

SEQ ID NO: 2494353 - DNA, 21 bp, Homo sapiens
ctgcctttccatccatggcca

SEQ ID NO: 2494354 - DNA, 15 bp, Homo sapiens
ctgcctttgccaggt

SEQ ID NO: 2494355 - DNA, 16 bp, Homo sapiens
ctgcctttgccaggtg

SEQ ID NO: 2494356 - DNA, 18 bp, Homo sapiens
ctgcctttgccaggtgac

SEQ ID NO: 2494357 - DNA, 20 bp, Homo sapiens
ctgcgactttctgcctggag

SEQ ID NO: 2494358 - DNA, 21 bp, Homo sapiens
ctgcgggtggggcttggggct

SEQ ID NO: 2494359 - DNA, 22 bp, Homo sapiens
ctgcgtgggtgtgtgcgtgttt

SEQ ID NO: 2494360 - DNA, 23 bp, Homo sapiens
ctgctaaataaaatttgttgcat

SEQ ID NO: 2494361 - DNA, 18 bp, Homo sapiens
ctgctaacggtgctcagg

SEQ ID NO: 2494362 - DNA, 15 bp, Homo sapiens
ctgctagaacatggt

SEQ ID NO: 2494363 - DNA, 16 bp, Homo sapiens
ctgctaggccagagcc

SEQ ID NO: 2494364 - DNA, 18 bp, Homo sapiens
ctgctaggccagagccca

SEQ ID NO: 2494365 - DNA, 21 bp, Homo sapiens
ctgctatggttttctccaaga

SEQ ID NO: 2494366 - DNA, 21 bp, Homo sapiens
ctgctattaggccagcaagcg

SEQ ID NO: 2494367 - DNA, 14 bp, Homo sapiens
ctgctcagccctgc

SEQ ID NO: 2494368 - DNA, 17 bp, Homo sapiens
ctgctcaggaaacgaga

SEQ ID NO: 2494369 - DNA, 17 bp, Homo sapiens
ctgctcatcattctctg

SEQ ID NO: 2494370 - DNA, 14 bp, Homo sapiens
ctgctccagacagg

SEQ ID NO: 2494371 - DNA, 22 bp, Homo sapiens
ctgctccagacctgatcctgga

SEQ ID NO: 2494372 - DNA, 21 bp, Homo sapiens
ctgctcccaaggggcctgagc

SEQ ID NO: 2494373 - DNA, 22 bp, Homo sapiens
ctgctcccaaggggcctgagca

SEQ ID NO: 2494374 - DNA, 17 bp, Homo sapiens
ctgctcccacctcctga

SEQ ID NO: 2494375 - DNA, 19 bp, Homo sapiens
ctgctcccatcctgtgtgt

SEQ ID NO: 2494376 - DNA, 14 bp, Homo sapiens
ctgctccctcagac

SEQ ID NO: 2494377 - DNA, 23 bp, Homo sapiens
ctgctccttccccatcgttgccc

SEQ ID NO: 2494378 - DNA, 23 bp, Homo sapiens
ctgctcggggtgcacaggagggg

SEQ ID NO: 2494379 - DNA, 21 bp, Homo sapiens
ctgctcgtccccaagtgacct

SEQ ID NO: 2494380 - DNA, 13 bp, Homo sapiens
ctgctctcctctt

SEQ ID NO: 2494381 - DNA, 22 bp, Homo sapiens
ctgctctgagaattgttgagat

SEQ ID NO: 2494382 - DNA, 17 bp, Homo sapiens
ctgctctggttgtttct

SEQ ID NO: 2494383 - DNA, 17 bp, Homo sapiens
ctgctcttggctggacc

SEQ ID NO: 2494384 - DNA, 19 bp, Homo sapiens
ctgctcttggctggaccca

SEQ ID NO: 2494385 - DNA, 21 bp, Homo sapiens
ctgctcttggctggacccagc

SEQ ID NO: 2494386 - DNA, 14 bp, Homo sapiens
ctgctgacctgctg

SEQ ID NO: 2494387 - DNA, 13 bp, Homo sapiens
ctgctgagctctg

SEQ ID NO: 2494388 - DNA, 15 bp, Homo sapiens
ctgctgagctctgag

SEQ ID NO: 2494389 - DNA, 18 bp, Homo sapiens
ctgctgagctctgagagg

SEQ ID NO: 2494390 - DNA, 21 bp, Homo sapiens
ctgctgagctctgagaggccc

SEQ ID NO: 2494391 - DNA, 23 bp, Homo sapiens
ctgctgagctctgagaggccctg

SEQ ID NO: 2494392 - DNA, 17 bp, Homo sapiens
ctgctgatcgccttccc

SEQ ID NO: 2494393 - DNA, 18 bp, Homo sapiens
ctgctgatcgccttcccc

SEQ ID NO: 2494394 - DNA, 15 bp, Homo sapiens
ctgctgccactgagg

SEQ ID NO: 2494395 - DNA, 16 bp, Homo sapiens
ctgctgccactgaggg

SEQ ID NO: 2494396 - DNA, 18 bp, Homo sapiens
ctgctgccagcttcaggt

SEQ ID NO: 2494397 - DNA, 15 bp, Homo sapiens
ctgctgctccctcag

SEQ ID NO: 2494398 - DNA, 22 bp, Homo sapiens
ctgctgctgagaacctggcctt

SEQ ID NO: 2494399 - DNA, 13 bp, Homo sapiens
ctgctgctgggct

SEQ ID NO: 2494400 - DNA, 17 bp, Homo sapiens
ctgctgctgggctcagt

SEQ ID NO: 2494401 - DNA, 14 bp, Homo sapiens
ctgctgctgtccct

SEQ ID NO: 2494402 - DNA, 15 bp, Homo sapiens
ctgctggagaggccc

SEQ ID NO: 2494403 - DNA, 19 bp, Homo sapiens
ctgctggagaggccccagc

SEQ ID NO: 2494404 - DNA, 21 bp, Homo sapiens
ctgctggagtttcatgtacaa

SEQ ID NO: 2494405 - DNA, 15 bp, Homo sapiens
ctgctggcccagcca

SEQ ID NO: 2494406 - DNA, 15 bp, Homo sapiens
ctgctggcctctgcg

SEQ ID NO: 2494407 - DNA, 15 bp, Homo sapiens
ctgctggggaagaca

SEQ ID NO: 2494408 - DNA, 18 bp, Homo sapiens
ctgctggggaagacagtg

SEQ ID NO: 2494409 - DNA, 21 bp, Homo sapiens
ctgctggggaagacagtggcc

SEQ ID NO: 2494410 - DNA, 17 bp, Homo sapiens
ctgctggtccgtgggac

SEQ ID NO: 2494411 - DNA, 12 bp, Homo sapiens
ctgctgtctggg

SEQ ID NO: 2494412 - DNA, 21 bp, Homo sapiens
ctgctgtgatacgatgcttca

SEQ ID NO: 2494413 - DNA, 12 bp, Homo sapiens
ctgctgtggcca

SEQ ID NO: 2494414 - DNA, 17 bp, Homo sapiens
ctgctgtggccaggagg

SEQ ID NO: 2494415 - DNA, 21 bp, Homo sapiens
ctgctgtggccaggaggtgcc

SEQ ID NO: 2494416 - DNA, 15 bp, Homo sapiens
ctgctgttccagtgg

SEQ ID NO: 2494417 - DNA, 21 bp, Homo sapiens
ctgctgttccagtggtaagct

SEQ ID NO: 2494418 - DNA, 14 bp, Homo sapiens
ctgcttcctcctgg

SEQ ID NO: 2494419 - DNA, 18 bp, Homo sapiens
ctgcttcctcctggaaat

SEQ ID NO: 2494420 - DNA, 13 bp, Homo sapiens
ctgcttctctgac

SEQ ID NO: 2494421 - DNA, 16 bp, Homo sapiens
ctgcttctctgacttc

SEQ ID NO: 2494422 - DNA, 12 bp, Homo sapiens
ctgcttgaggaa

SEQ ID NO: 2494423 - DNA, 13 bp, Homo sapiens
ctgcttgaggaaa

SEQ ID NO: 2494424 - DNA, 14 bp, Homo sapiens
ctgcttgaggaaaa

SEQ ID NO: 2494425 - DNA, 23 bp, Homo sapiens
ctgcttgatgggattctggacag

SEQ ID NO: 2494426 - DNA, 21 bp, Homo sapiens
ctgcttgccaaggcagaggcc

SEQ ID NO: 2494427 - DNA, 13 bp, Homo sapiens
ctgcttgccctaa

SEQ ID NO: 2494428 - DNA, 15 bp, Homo sapiens
ctgcttgccctaagc

SEQ ID NO: 2494429 - DNA, 19 bp, Homo sapiens
ctgcttgccctaagcagaa

SEQ ID NO: 2494430 - DNA, 19 bp, Homo sapiens
ctgcttggggggtgatgag

SEQ ID NO: 2494431 - DNA, 18 bp, Homo sapiens
ctgcttggtccttgattt

SEQ ID NO: 2494432 - DNA, 14 bp, Homo sapiens
ctggaaaacagaac

SEQ ID NO: 2494433 - DNA, 19 bp, Homo sapiens
ctggaaaacagaacactta

SEQ ID NO: 2494434 - DNA, 23 bp, Homo sapiens
ctggaaaataatactgctgagat

SEQ ID NO: 2494435 - DNA, 11 bp, Homo sapiens
ctggaaagaag

SEQ ID NO: 2494436 - DNA, 22 bp, Homo sapiens
ctggaacactagacaagccaga

SEQ ID NO: 2494437 - DNA, 23 bp, Homo sapiens
ctggaacactagacaagccagaa

SEQ ID NO: 2494438 - DNA, 13 bp, Homo sapiens
ctggaacccagac

SEQ ID NO: 2494439 - DNA, 12 bp, Homo sapiens
ctggaacctcag

SEQ ID NO: 2494440 - DNA, 22 bp, Homo sapiens
ctggaacctcagcctggccaga

SEQ ID NO: 2494441 - DNA, 16 bp, Homo sapiens
ctggaagatagctgtg

SEQ ID NO: 2494442 - DNA, 14 bp, Homo sapiens
ctggaagatgggga

SEQ ID NO: 2494443 - DNA, 22 bp, Homo sapiens
ctggaagccaaaatgtaggctt

SEQ ID NO: 2494444 - DNA, 15 bp, Homo sapiens
ctggaagctgggagg

SEQ ID NO: 2494445 - DNA, 19 bp, Homo sapiens
ctggaaggggaagggacac

SEQ ID NO: 2494446 - DNA, 16 bp, Homo sapiens
ctggaagtccaatgtg

SEQ ID NO: 2494447 - DNA, 24 bp, Homo sapiens
ctggaatgagttgaggccactgtg

SEQ ID NO: 2494448 - DNA, 15 bp, Homo sapiens
ctggacactcagacc

SEQ ID NO: 2494449 - DNA, 13 bp, Homo sapiens
ctggacagcccca

SEQ ID NO: 2494450 - DNA, 19 bp, Homo sapiens
ctggacagccccaccctgg

SEQ ID NO: 2494451 - DNA, 18 bp, Homo sapiens
ctggacagctgtgcctcg

SEQ ID NO: 2494452 - DNA, 13 bp, Homo sapiens
ctggacccagcca

SEQ ID NO: 2494453 - DNA, 14 bp, Homo sapiens
ctggacccagccag

SEQ ID NO: 2494454 - DNA, 19 bp, Homo sapiens
ctggacccagccaggccca

SEQ ID NO: 2494455 - DNA, 19 bp, Homo sapiens
ctggacccccctttcacag

SEQ ID NO: 2494456 - DNA, 13 bp, Homo sapiens
ctggacccctgca

SEQ ID NO: 2494457 - DNA, 14 bp, Homo sapiens
ctggacccctgcat

SEQ ID NO: 2494458 - DNA, 18 bp, Homo sapiens
ctggacccctgcattgga

SEQ ID NO: 2494459 - DNA, 12 bp, Homo sapiens
ctggaccctgac

SEQ ID NO: 2494460 - DNA, 20 bp, Homo sapiens
ctggaccctgaccagctccc

SEQ ID NO: 2494461 - DNA, 17 bp, Homo sapiens
ctggacctctgacagca

SEQ ID NO: 2494462 - DNA, 14 bp, Homo sapiens
ctggacctctgggt

SEQ ID NO: 2494463 - DNA, 23 bp, Homo sapiens
ctggactctaaagtctgttgatt

SEQ ID NO: 2494464 - DNA, 18 bp, Homo sapiens
ctggactctcagtctctg

SEQ ID NO: 2494465 - DNA, 19 bp, Homo sapiens
ctggactctcagtctctga

SEQ ID NO: 2494466 - DNA, 13 bp, Homo sapiens
ctggactttcctg

SEQ ID NO: 2494467 - DNA, 16 bp, Homo sapiens
ctggactttcctgcaa

SEQ ID NO: 2494468 - DNA, 20 bp, Homo sapiens
ctggagactgtgtgtgccct

SEQ ID NO: 2494469 - DNA, 22 bp, Homo sapiens
ctggagactgtgtgtgccctct

SEQ ID NO: 2494470 - DNA, 23 bp, Homo sapiens
ctggagactgtgtgtgccctctg

SEQ ID NO: 2494471 - DNA, 14 bp, Homo sapiens
ctggagagaacagg

SEQ ID NO: 2494472 - DNA, 16 bp, Homo sapiens
ctggagagaacaggtt

SEQ ID NO: 2494473 - DNA, 12 bp, Homo sapiens
ctggagaggccc

SEQ ID NO: 2494474 - DNA, 23 bp, Homo sapiens
ctggagatcctcctgcagaccac

SEQ ID NO: 2494475 - DNA, 16 bp, Homo sapiens
ctggagcacaaagacc

SEQ ID NO: 2494476 - DNA, 13 bp, Homo sapiens
ctggagcagaagg

SEQ ID NO: 2494477 - DNA, 15 bp, Homo sapiens
ctggagcagaccacc

SEQ ID NO: 2494478 - DNA, 12 bp, Homo sapiens
ctggagccagcc

SEQ ID NO: 2494479 - DNA, 22 bp, Homo sapiens
ctggagccagccgagcaggagg

SEQ ID NO: 2494480 - DNA, 18 bp, Homo sapiens
ctggaggacctgagcctg

SEQ ID NO: 2494481 - DNA, 20 bp, Homo sapiens
ctggaggacctgagcctgcc

SEQ ID NO: 2494482 - DNA, 12 bp, Homo sapiens
ctggaggagccc

SEQ ID NO: 2494483 - DNA, 15 bp, Homo sapiens
ctggaggagcccagg

SEQ ID NO: 2494484 - DNA, 16 bp, Homo sapiens
ctggaggcacctggtg

SEQ ID NO: 2494485 - DNA, 22 bp, Homo sapiens
ctggaggcaggggcttcctggt

SEQ ID NO: 2494486 - DNA, 12 bp, Homo sapiens
ctggaggcccag

SEQ ID NO: 2494487 - DNA, 18 bp, Homo sapiens
ctggaggcccaggctggg

SEQ ID NO: 2494488 - DNA, 19 bp, Homo sapiens
ctggaggcccaggctggga

SEQ ID NO: 2494489 - DNA, 21 bp, Homo sapiens
ctggaggcccagttcaccctg

SEQ ID NO: 2494490 - DNA, 13 bp, Homo sapiens
ctggaggggaggg

SEQ ID NO: 2494491 - DNA, 22 bp, Homo sapiens
ctggagggggaatggcagcagg

SEQ ID NO: 2494492 - DNA, 17 bp, Homo sapiens
ctggagttagggactga

SEQ ID NO: 2494493 - DNA, 18 bp, Homo sapiens
ctggagtttcatgtacaa

SEQ ID NO: 2494494 - DNA, 22 bp, Homo sapiens
ctggagtttcatgtacaagatg

SEQ ID NO: 2494495 - DNA, 16 bp, Homo sapiens
ctggatcagcgtggcc

SEQ ID NO: 2494496 - DNA, 19 bp, Homo sapiens
ctggatcagcgtggccttg

SEQ ID NO: 2494497 - DNA, 18 bp, Homo sapiens
ctggatgatactaataaa

SEQ ID NO: 2494498 - DNA, 24 bp, Homo sapiens
ctggatggggcaggccacctggct

SEQ ID NO: 2494499 - DNA, 20 bp, Homo sapiens
ctggcaaggactttgtacat

SEQ ID NO: 2494500 - DNA, 21 bp, Homo sapiens
ctggcaatgccacagccctgt

SEQ ID NO: 2494501 - DNA, 20 bp, Homo sapiens
ctggcagagatgcctccctg

SEQ ID NO: 2494502 - DNA, 12 bp, Homo sapiens
ctggcagccaca

SEQ ID NO: 2494503 - DNA, 20 bp, Homo sapiens
ctggcagcctcccatccagg

SEQ ID NO: 2494504 - DNA, 17 bp, Homo sapiens
ctggcagctctggacag

SEQ ID NO: 2494505 - DNA, 18 bp, Homo sapiens
ctggcaggcaggctccca

SEQ ID NO: 2494506 - DNA, 24 bp, Homo sapiens
ctggcaggcaggctcccagggaca

SEQ ID NO: 2494507 - DNA, 23 bp, Homo sapiens
ctggcatcgcaccattctgactc

SEQ ID NO: 2494508 - DNA, 18 bp, Homo sapiens
ctggcattagaattattt

SEQ ID NO: 2494509 - DNA, 19 bp, Homo sapiens
ctggcattagaattattta

SEQ ID NO: 2494510 - DNA, 20 bp, Homo sapiens
ctggcattagaattatttaa

SEQ ID NO: 2494511 - DNA, 22 bp, Homo sapiens
ctggcattagaattatttaaac

SEQ ID NO: 2494512 - DNA, 17 bp, Homo sapiens
ctggccaagctgaggtg

SEQ ID NO: 2494513 - DNA, 23 bp, Homo sapiens
ctggccaagctgaggtgcccagg

SEQ ID NO: 2494514 - DNA, 13 bp, Homo sapiens
ctggccagacaca

SEQ ID NO: 2494515 - DNA, 12 bp, Homo sapiens
ctggccagcgag

SEQ ID NO: 2494516 - DNA, 22 bp, Homo sapiens
ctggccagggccacgctccagc

SEQ ID NO: 2494517 - DNA, 23 bp, Homo sapiens
ctggccagggccacgctccagct

SEQ ID NO: 2494518 - DNA, 23 bp, Homo sapiens
ctggccagtccaggctgccgtgg

SEQ ID NO: 2494519 - DNA, 17 bp, Homo sapiens
ctggccagtgccctgat

SEQ ID NO: 2494520 - DNA, 15 bp, Homo sapiens
ctggccagtgtttaa

SEQ ID NO: 2494521 - DNA, 20 bp, Homo sapiens
ctggccagtgtttaaaactt

SEQ ID NO: 2494522 - DNA, 16 bp, Homo sapiens
ctggccatactgtgtc

SEQ ID NO: 2494523 - DNA, 13 bp, Homo sapiens
ctggccatggcct

SEQ ID NO: 2494524 - DNA, 20 bp, Homo sapiens
ctggccatggcctgcaaact

SEQ ID NO: 2494525 - DNA, 13 bp, Homo sapiens
ctggcccagcctt

SEQ ID NO: 2494526 - DNA, 16 bp, Homo sapiens
ctggcccagggcccag

SEQ ID NO: 2494527 - DNA, 16 bp, Homo sapiens
ctggccccaggacctg

SEQ ID NO: 2494528 - DNA, 13 bp, Homo sapiens
ctggcccccctgg

SEQ ID NO: 2494529 - DNA, 19 bp, Homo sapiens
ctggcccccctggtcccct

SEQ ID NO: 2494530 - DNA, 22 bp, Homo sapiens
ctggcccccctggtcccctcct

SEQ ID NO: 2494531 - DNA, 20 bp, Homo sapiens
ctggccccctccctggatga

SEQ ID NO: 2494532 - DNA, 17 bp, Homo sapiens
ctggccctgcttcctgc

SEQ ID NO: 2494533 - DNA, 21 bp, Homo sapiens
ctggccctgcttcctgcttgc

SEQ ID NO: 2494534 - DNA, 20 bp, Homo sapiens
ctggccgagtccaagctggg

SEQ ID NO: 2494535 - DNA, 21 bp, Homo sapiens
ctggccgcccccagccccctc

SEQ ID NO: 2494536 - DNA, 13 bp, Homo sapiens
ctggccgccccct

SEQ ID NO: 2494537 - DNA, 22 bp, Homo sapiens
ctggccgccccctgccccccag

SEQ ID NO: 2494538 - DNA, 15 bp, Homo sapiens
ctggccgctgtgcca

SEQ ID NO: 2494539 - DNA, 17 bp, Homo sapiens
ctggccgctgtgccagg

SEQ ID NO: 2494540 - DNA, 22 bp, Homo sapiens
ctggcctagaccagcagacaga

SEQ ID NO: 2494541 - DNA, 17 bp, Homo sapiens
ctggcctcccccacttt

SEQ ID NO: 2494542 - DNA, 16 bp, Homo sapiens
ctggcctcccctgcca

SEQ ID NO: 2494543 - DNA, 14 bp, Homo sapiens
ctggcctcctgcct

SEQ ID NO: 2494544 - DNA, 22 bp, Homo sapiens
ctggcctggactgttttctctc

SEQ ID NO: 2494545 - DNA, 19 bp, Homo sapiens
ctggcctggccatactgtg

SEQ ID NO: 2494546 - DNA, 19 bp, Homo sapiens
ctggccttgaaaccacctt

SEQ ID NO: 2494547 - DNA, 19 bp, Homo sapiens
ctggcctttttcatttatc

SEQ ID NO: 2494548 - DNA, 18 bp, Homo sapiens
ctggcggctggggtccca

SEQ ID NO: 2494549 - DNA, 20 bp, Homo sapiens
ctggcggctggggtcccagc

SEQ ID NO: 2494550 - DNA, 14 bp, Homo sapiens
ctggctccagatgc

SEQ ID NO: 2494551 - DNA, 15 bp, Homo sapiens
ctggctctaattcac

SEQ ID NO: 2494552 - DNA, 22 bp, Homo sapiens
ctggctctaattcacagtgctc

SEQ ID NO: 2494553 - DNA, 23 bp, Homo sapiens
ctggctctaattcacagtgctct

SEQ ID NO: 2494554 - DNA, 13 bp, Homo sapiens
ctggctctcctgg

SEQ ID NO: 2494555 - DNA, 15 bp, Homo sapiens
ctggctctcctggcc

SEQ ID NO: 2494556 - DNA, 20 bp, Homo sapiens
ctggctctgagcgcctccat

SEQ ID NO: 2494557 - DNA, 21 bp, Homo sapiens
ctggctctgagcgcctccatc

SEQ ID NO: 2494558 - DNA, 21 bp, Homo sapiens
ctggctcttgatacccccctc

SEQ ID NO: 2494559 - DNA, 23 bp, Homo sapiens
ctggctcttgatacccccctctg

SEQ ID NO: 2494560 - DNA, 23 bp, Homo sapiens
ctggctgagggcagttcgcagcc

SEQ ID NO: 2494561 - DNA, 21 bp, Homo sapiens
ctggctgctgatcgccttccc

SEQ ID NO: 2494562 - DNA, 17 bp, Homo sapiens
ctggctggcctcaccca

SEQ ID NO: 2494563 - DNA, 11 bp, Homo sapiens
ctggctggctg

SEQ ID NO: 2494564 - DNA, 16 bp, Homo sapiens
ctggctgggacgtggc

SEQ ID NO: 2494565 - DNA, 21 bp, Homo sapiens
ctggctgggacgtggctcagc

SEQ ID NO: 2494566 - DNA, 16 bp, Homo sapiens
ctggctggtgttaaca

SEQ ID NO: 2494567 - DNA, 12 bp, Homo sapiens
ctggctgtttga

SEQ ID NO: 2494568 - DNA, 16 bp, Homo sapiens
ctggcttcccatcccc

SEQ ID NO: 2494569 - DNA, 21 bp, Homo sapiens
ctggcttcccatccccagcga

SEQ ID NO: 2494570 - DNA, 22 bp, Homo sapiens
ctggcttcccatccccagcgat

SEQ ID NO: 2494571 - DNA, 17 bp, Homo sapiens
ctggcttctggccagga

SEQ ID NO: 2494572 - DNA, 21 bp, Homo sapiens
ctggctttcattttctctcag

SEQ ID NO: 2494573 - DNA, 22 bp, Homo sapiens
ctggctttcattttctctcagg

SEQ ID NO: 2494574 - DNA, 23 bp, Homo sapiens
ctggctttcattttctctcaggt

SEQ ID NO: 2494575 - DNA, 23 bp, Homo sapiens
ctggcttttattaatgcactttc

SEQ ID NO: 2494576 - DNA, 22 bp, Homo sapiens
ctgggaaaaactttggaaccag

SEQ ID NO: 2494577 - DNA, 18 bp, Homo sapiens
ctgggaaatattccctag

SEQ ID NO: 2494578 - DNA, 18 bp, Homo sapiens
ctgggaacccctttccca

SEQ ID NO: 2494579 - DNA, 20 bp, Homo sapiens
ctgggacgtggctcagccag

SEQ ID NO: 2494580 - DNA, 21 bp, Homo sapiens
ctgggacgtggctcagccagc

SEQ ID NO: 2494581 - DNA, 16 bp, Homo sapiens
ctgggactcagccttc

SEQ ID NO: 2494582 - DNA, 17 bp, Homo sapiens
ctgggactcagccttca

SEQ ID NO: 2494583 - DNA, 18 bp, Homo sapiens
ctgggactcagccttcag

SEQ ID NO: 2494584 - DNA, 21 bp, Homo sapiens
ctgggactcagccttcagaca

SEQ ID NO: 2494585 - DNA, 19 bp, Homo sapiens
ctgggagaaatctggcttc

SEQ ID NO: 2494586 - DNA, 14 bp, Homo sapiens
ctgggagaggcagc

SEQ ID NO: 2494587 - DNA, 19 bp, Homo sapiens
ctgggagaggcagcccagg

SEQ ID NO: 2494588 - DNA, 23 bp, Homo sapiens
ctgggagaggcagcccaggaagt

SEQ ID NO: 2494589 - DNA, 14 bp, Homo sapiens
ctgggaggaaggac

SEQ ID NO: 2494590 - DNA, 16 bp, Homo sapiens
ctgggaggctcccctt

SEQ ID NO: 2494591 - DNA, 11 bp, Homo sapiens
ctgggagggca

SEQ ID NO: 2494592 - DNA, 15 bp, Homo sapiens
ctgggagggcagcag

SEQ ID NO: 2494593 - DNA, 21 bp, Homo sapiens
ctgggagtagttgtctttcct

SEQ ID NO: 2494594 - DNA, 21 bp, Homo sapiens
ctgggattacaggcgtgagcc

SEQ ID NO: 2494595 - DNA, 15 bp, Homo sapiens
ctgggcaaagcctag

SEQ ID NO: 2494596 - DNA, 22 bp, Homo sapiens
ctgggccatgtccaaagaggct

SEQ ID NO: 2494597 - DNA, 13 bp, Homo sapiens
ctgggccctctct

SEQ ID NO: 2494598 - DNA, 14 bp, Homo sapiens
ctgggccctctctg

SEQ ID NO: 2494599 - DNA, 15 bp, Homo sapiens
ctgggccctctctgc

SEQ ID NO: 2494600 - DNA, 11 bp, Homo sapiens
ctgggccctgg

SEQ ID NO: 2494601 - DNA, 18 bp, Homo sapiens
ctgggccctggggcctgt

SEQ ID NO: 2494602 - DNA, 20 bp, Homo sapiens
ctgggccctggggcctgtac

SEQ ID NO: 2494603 - DNA, 22 bp, Homo sapiens
ctgggccctggggcctgtactg

SEQ ID NO: 2494604 - DNA, 17 bp, Homo sapiens
ctgggcctatggagagc

SEQ ID NO: 2494605 - DNA, 20 bp, Homo sapiens
ctgggcctatggagagccct

SEQ ID NO: 2494606 - DNA, 23 bp, Homo sapiens
ctgggcctatggagagccctggg

SEQ ID NO: 2494607 - DNA, 13 bp, Homo sapiens
ctgggcctgcaga

SEQ ID NO: 2494608 - DNA, 16 bp, Homo sapiens
ctgggcctgctgctga

SEQ ID NO: 2494609 - DNA, 17 bp, Homo sapiens
ctgggcctgctgctgag

SEQ ID NO: 2494610 - DNA, 19 bp, Homo sapiens
ctgggcctgctgctgagaa

SEQ ID NO: 2494611 - DNA, 20 bp, Homo sapiens
ctgggcctgctgctgagaac

SEQ ID NO: 2494612 - DNA, 13 bp, Homo sapiens
ctgggcctggtct

SEQ ID NO: 2494613 - DNA, 14 bp, Homo sapiens
ctgggcctggtctc

SEQ ID NO: 2494614 - DNA, 16 bp, Homo sapiens
ctgggcctggtctcac

SEQ ID NO: 2494615 - DNA, 16 bp, Homo sapiens
ctgggccttggcctgg

SEQ ID NO: 2494616 - DNA, 20 bp, Homo sapiens
ctgggccttggcctggagca

SEQ ID NO: 2494617 - DNA, 14 bp, Homo sapiens
ctgggcgctggtcc

SEQ ID NO: 2494618 - DNA, 12 bp, Homo sapiens
ctgggctcagtg

SEQ ID NO: 2494619 - DNA, 22 bp, Homo sapiens
ctgggctccggaggactcacca

SEQ ID NO: 2494620 - DNA, 16 bp, Homo sapiens
ctgggctggatgagct

SEQ ID NO: 2494621 - DNA, 20 bp, Homo sapiens
ctgggctggatgagctccca

SEQ ID NO: 2494622 - DNA, 12 bp, Homo sapiens
ctgggctgggaa

SEQ ID NO: 2494623 - DNA, 12 bp, Homo sapiens
ctgggcttcctg

SEQ ID NO: 2494624 - DNA, 15 bp, Homo sapiens
ctgggcttcctggag

SEQ ID NO: 2494625 - DNA, 16 bp, Homo sapiens
ctgggcttcctggagc

SEQ ID NO: 2494626 - DNA, 17 bp, Homo sapiens
ctgggcttcctggagca

SEQ ID NO: 2494627 - DNA, 15 bp, Homo sapiens
ctggggaagacagtg

SEQ ID NO: 2494628 - DNA, 16 bp, Homo sapiens
ctggggaagacagtgg

SEQ ID NO: 2494629 - DNA, 18 bp, Homo sapiens
ctggggaagacagtggcc

SEQ ID NO: 2494630 - DNA, 22 bp, Homo sapiens
ctggggacctggtaccctcctg

SEQ ID NO: 2494631 - DNA, 19 bp, Homo sapiens
ctggggacttggcctctct

SEQ ID NO: 2494632 - DNA, 12 bp, Homo sapiens
ctggggagcccg

SEQ ID NO: 2494633 - DNA, 14 bp, Homo sapiens
ctggggcaggctgg

SEQ ID NO: 2494634 - DNA, 21 bp, Homo sapiens
ctggggcctgtactgcctgct

SEQ ID NO: 2494635 - DNA, 13 bp, Homo sapiens
ctggggctcagag

SEQ ID NO: 2494636 - DNA, 16 bp, Homo sapiens
ctggggctcagagccg

SEQ ID NO: 2494637 - DNA, 21 bp, Homo sapiens
ctggggctctaacgcctgagc

SEQ ID NO: 2494638 - DNA, 23 bp, Homo sapiens
ctggggctctaacgcctgagccc

SEQ ID NO: 2494639 - DNA, 14 bp, Homo sapiens
ctggggctggcctc

SEQ ID NO: 2494640 - DNA, 15 bp, Homo sapiens
ctggggctggcctcc

SEQ ID NO: 2494641 - DNA, 22 bp, Homo sapiens
ctgggggcacaagactgacgcc

SEQ ID NO: 2494642 - DNA, 14 bp, Homo sapiens
ctgggggcctggct

SEQ ID NO: 2494643 - DNA, 17 bp, Homo sapiens
ctgggggcctggctggc

SEQ ID NO: 2494644 - DNA, 12 bp, Homo sapiens
ctggggggtggc

SEQ ID NO: 2494645 - DNA, 17 bp, Homo sapiens
ctggggggtggccaggc

SEQ ID NO: 2494646 - DNA, 14 bp, Homo sapiens
ctgggggtgccagg

SEQ ID NO: 2494647 - DNA, 19 bp, Homo sapiens
ctggggtaagtggtctaag

SEQ ID NO: 2494648 - DNA, 15 bp, Homo sapiens
ctggggtcccagcag

SEQ ID NO: 2494649 - DNA, 20 bp, Homo sapiens
ctggggtcccagcagctgcc

SEQ ID NO: 2494650 - DNA, 13 bp, Homo sapiens
ctggggtctggag

SEQ ID NO: 2494651 - DNA, 16 bp, Homo sapiens
ctggggtggccaccag

SEQ ID NO: 2494652 - DNA, 16 bp, Homo sapiens
ctgggtaataaaagtg

SEQ ID NO: 2494653 - DNA, 17 bp, Homo sapiens
ctgggtagcgggggagg

SEQ ID NO: 2494654 - DNA, 13 bp, Homo sapiens
ctgggtccatatc

SEQ ID NO: 2494655 - DNA, 15 bp, Homo sapiens
ctgggtccatatcac

SEQ ID NO: 2494656 - DNA, 17 bp, Homo sapiens
ctgggtccatatcacac

SEQ ID NO: 2494657 - DNA, 20 bp, Homo sapiens
ctgggtccatatcacacaca

SEQ ID NO: 2494658 - DNA, 22 bp, Homo sapiens
ctgggtctcgctttgttgccca

SEQ ID NO: 2494659 - DNA, 14 bp, Homo sapiens
ctgggtgacatttg

SEQ ID NO: 2494660 - DNA, 17 bp, Homo sapiens
ctgggtgctactgggga

SEQ ID NO: 2494661 - DNA, 12 bp, Homo sapiens
ctgggtggggcc

SEQ ID NO: 2494662 - DNA, 16 bp, Homo sapiens
ctgggtggtaccctct

SEQ ID NO: 2494663 - DNA, 14 bp, Homo sapiens
ctgggtggtggcct

SEQ ID NO: 2494664 - DNA, 17 bp, Homo sapiens
ctgggtggtggcctggt

SEQ ID NO: 2494665 - DNA, 23 bp, Homo sapiens
ctggtacagtatgggggttgtaa

SEQ ID NO: 2494666 - DNA, 20 bp, Homo sapiens
ctggtactccctctcaggat

SEQ ID NO: 2494667 - DNA, 17 bp, Homo sapiens
ctggtagaagggaaagc

SEQ ID NO: 2494668 - DNA, 13 bp, Homo sapiens
ctggtagagcagg

SEQ ID NO: 2494669 - DNA, 23 bp, Homo sapiens
ctggtaggaatagcatgtcacta

SEQ ID NO: 2494670 - DNA, 15 bp, Homo sapiens
ctggtaggaccaagc

SEQ ID NO: 2494671 - DNA, 17 bp, Homo sapiens
ctggtaggaccaagcat

SEQ ID NO: 2494672 - DNA, 17 bp, Homo sapiens
ctggtatctcagaaagt

SEQ ID NO: 2494673 - DNA, 22 bp, Homo sapiens
ctggtatctcagaaagtgcctg

SEQ ID NO: 2494674 - DNA, 23 bp, Homo sapiens
ctggtatctcagaaagtgcctga

SEQ ID NO: 2494675 - DNA, 15 bp, Homo sapiens
ctggtattgttctca

SEQ ID NO: 2494676 - DNA, 19 bp, Homo sapiens
ctggtcacctaggaagcct

SEQ ID NO: 2494677 - DNA, 21 bp, Homo sapiens
ctggtcattaatgtgtcccct

SEQ ID NO: 2494678 - DNA, 20 bp, Homo sapiens
ctggtcccggggccagcact

SEQ ID NO: 2494679 - DNA, 23 bp, Homo sapiens
ctggtccctgttttcccacgagg

SEQ ID NO: 2494680 - DNA, 22 bp, Homo sapiens
ctggtcccttgtatcccctgca

SEQ ID NO: 2494681 - DNA, 21 bp, Homo sapiens
ctggtcctatggcctcatgtt

SEQ ID NO: 2494682 - DNA, 16 bp, Homo sapiens
ctggtcctttcttccg

SEQ ID NO: 2494683 - DNA, 14 bp, Homo sapiens
ctggtcgctcctgc

SEQ ID NO: 2494684 - DNA, 16 bp, Homo sapiens
ctggtcgctcctgccc

SEQ ID NO: 2494685 - DNA, 23 bp, Homo sapiens
ctggtcgctcctgcccacggagt

SEQ ID NO: 2494686 - DNA, 21 bp, Homo sapiens
ctggtctcaaactcctgggct

SEQ ID NO: 2494687 - DNA, 23 bp, Homo sapiens
ctggtctcaccctggaggcacct

SEQ ID NO: 2494688 - DNA, 15 bp, Homo sapiens
ctggtgcggctggcc

SEQ ID NO: 2494689 - DNA, 18 bp, Homo sapiens
ctggtgcggctggccatg

SEQ ID NO: 2494690 - DNA, 14 bp, Homo sapiens
ctggtgctgcctct

SEQ ID NO: 2494691 - DNA, 19 bp, Homo sapiens
ctggtgctgcctctacctg

SEQ ID NO: 2494692 - DNA, 21 bp, Homo sapiens
ctggtgcttctcctctcctag

SEQ ID NO: 2494693 - DNA, 15 bp, Homo sapiens
ctggtggcacaggag

SEQ ID NO: 2494694 - DNA, 22 bp, Homo sapiens
ctggtggccccgtttctggtgg

SEQ ID NO: 2494695 - DNA, 17 bp, Homo sapiens
ctggtggccctctcccc

SEQ ID NO: 2494696 - DNA, 20 bp, Homo sapiens
ctggtggccctctcccctgc

SEQ ID NO: 2494697 - DNA, 22 bp, Homo sapiens
ctggtgggctggccgctgtgcc

SEQ ID NO: 2494698 - DNA, 21 bp, Homo sapiens
ctggtgggtgcctaggcctgg

SEQ ID NO: 2494699 - DNA, 15 bp, Homo sapiens
ctggtgtagctacag

SEQ ID NO: 2494700 - DNA, 18 bp, Homo sapiens
ctggtgtagctacagaga

SEQ ID NO: 2494701 - DNA, 19 bp, Homo sapiens
ctggtgtagctacagagaa

SEQ ID NO: 2494702 - DNA, 14 bp, Homo sapiens
ctggtgtggtacag

SEQ ID NO: 2494703 - DNA, 20 bp, Homo sapiens
ctggtgtggtacagagaagc

SEQ ID NO: 2494704 - DNA, 22 bp, Homo sapiens
ctggttaggttaggacttgccc

SEQ ID NO: 2494705 - DNA, 16 bp, Homo sapiens
ctggttgttatgtgat

SEQ ID NO: 2494706 - DNA, 21 bp, Homo sapiens
ctggttgtttctgttccaaat

SEQ ID NO: 2494707 - DNA, 21 bp, Homo sapiens
ctgtaaaatgtgggattatgg

SEQ ID NO: 2494708 - DNA, 21 bp, Homo sapiens
ctgtaaataatgtgcactgaa

SEQ ID NO: 2494709 - DNA, 20 bp, Homo sapiens
ctgtaacctcttcagaggcc

SEQ ID NO: 2494710 - DNA, 19 bp, Homo sapiens
ctgtaactactttataact

SEQ ID NO: 2494711 - DNA, 14 bp, Homo sapiens
ctgtaactgccagg

SEQ ID NO: 2494712 - DNA, 22 bp, Homo sapiens
ctgtaagaaacctactgcccag

SEQ ID NO: 2494713 - DNA, 13 bp, Homo sapiens
ctgtaaggctcta

SEQ ID NO: 2494714 - DNA, 17 bp, Homo sapiens
ctgtaaggctctagatc

SEQ ID NO: 2494715 - DNA, 14 bp, Homo sapiens
ctgtaatctatgaa

SEQ ID NO: 2494716 - DNA, 18 bp, Homo sapiens
ctgtaatggtactgactt

SEQ ID NO: 2494717 - DNA, 15 bp, Homo sapiens
ctgtaattcaggttt

SEQ ID NO: 2494718 - DNA, 15 bp, Homo sapiens
ctgtacagctggctc

SEQ ID NO: 2494719 - DNA, 16 bp, Homo sapiens
ctgtacagctggctct

SEQ ID NO: 2494720 - DNA, 13 bp, Homo sapiens
ctgtacagtgtta

SEQ ID NO: 2494721 - DNA, 15 bp, Homo sapiens
ctgtacagtgttacc

SEQ ID NO: 2494722 - DNA, 16 bp, Homo sapiens
ctgtaccagttaattt

SEQ ID NO: 2494723 - DNA, 20 bp, Homo sapiens
ctgtaccttttgaggagccc

SEQ ID NO: 2494724 - DNA, 16 bp, Homo sapiens
ctgtactgcctgcttg

SEQ ID NO: 2494725 - DNA, 17 bp, Homo sapiens
ctgtactgttctgtgtc

SEQ ID NO: 2494726 - DNA, 20 bp, Homo sapiens
ctgtactgttctgtgtcttt

SEQ ID NO: 2494727 - DNA, 16 bp, Homo sapiens
ctgtagcacttactgg

SEQ ID NO: 2494728 - DNA, 19 bp, Homo sapiens
ctgtagtaaataatgcttt

SEQ ID NO: 2494729 - DNA, 20 bp, Homo sapiens
ctgtagtaaataatgctttg

SEQ ID NO: 2494730 - DNA, 22 bp, Homo sapiens
ctgtagtaaataatgctttgaa

SEQ ID NO: 2494731 - DNA, 14 bp, Homo sapiens
ctgtatatactttt

SEQ ID NO: 2494732 - DNA, 15 bp, Homo sapiens
ctgtattaagccact

SEQ ID NO: 2494733 - DNA, 14 bp, Homo sapiens
ctgtattgtctgaa

SEQ ID NO: 2494734 - DNA, 22 bp, Homo sapiens
ctgtatttgaaataagaattca

SEQ ID NO: 2494735 - DNA, 15 bp, Homo sapiens
ctgtatttgttccca

SEQ ID NO: 2494736 - DNA, 16 bp, Homo sapiens
ctgtatttgttcccaa

SEQ ID NO: 2494737 - DNA, 13 bp, Homo sapiens
ctgtcaaggctca

SEQ ID NO: 2494738 - DNA, 13 bp, Homo sapiens
ctgtcaattgtac

SEQ ID NO: 2494739 - DNA, 24 bp, Homo sapiens
ctgtcagatccaggagctccagtg

SEQ ID NO: 2494740 - DNA, 12 bp, Homo sapiens
ctgtcagcatga

SEQ ID NO: 2494741 - DNA, 22 bp, Homo sapiens
ctgtcaggattgcgagagatgt

SEQ ID NO: 2494742 - DNA, 24 bp, Homo sapiens
ctgtcaggattgcgagagatgtgt

SEQ ID NO: 2494743 - DNA, 17 bp, Homo sapiens
ctgtcagtcacagccac

SEQ ID NO: 2494744 - DNA, 17 bp, Homo sapiens
ctgtcatccagctcact

SEQ ID NO: 2494745 - DNA, 20 bp, Homo sapiens
ctgtcatcctcaaagaaagt

SEQ ID NO: 2494746 - DNA, 21 bp, Homo sapiens
ctgtcatctgtgcactgccca

SEQ ID NO: 2494747 - DNA, 17 bp, Homo sapiens
ctgtccacaggcttctg

SEQ ID NO: 2494748 - DNA, 17 bp, Homo sapiens
ctgtccagctccaacct

SEQ ID NO: 2494749 - DNA, 14 bp, Homo sapiens
ctgtccccagcctg

SEQ ID NO: 2494750 - DNA, 13 bp, Homo sapiens
ctgtccccccact

SEQ ID NO: 2494751 - DNA, 20 bp, Homo sapiens
ctgtcccttgcccccctggc

SEQ ID NO: 2494752 - DNA, 21 bp, Homo sapiens
ctgtcccttgcccccctggcc

SEQ ID NO: 2494753 - DNA, 23 bp, Homo sapiens
ctgtcccttgcccccctggcctc

SEQ ID NO: 2494754 - DNA, 16 bp, Homo sapiens
ctgtcccttgcctcaa

SEQ ID NO: 2494755 - DNA, 21 bp, Homo sapiens
ctgtcccttgcctcaatgcca

SEQ ID NO: 2494756 - DNA, 20 bp, Homo sapiens
ctgtcctcagccttgccaga

SEQ ID NO: 2494757 - DNA, 21 bp, Homo sapiens
ctgtcctcagccttgccagag

SEQ ID NO: 2494758 - DNA, 22 bp, Homo sapiens
ctgtcctcagccttgccagaga

SEQ ID NO: 2494759 - DNA, 22 bp, Homo sapiens
ctgtcctctttcagctcctgac

SEQ ID NO: 2494760 - DNA, 17 bp, Homo sapiens
ctgtcctgccacccagc

SEQ ID NO: 2494761 - DNA, 23 bp, Homo sapiens
ctgtcctgccacccagccccagc

SEQ ID NO: 2494762 - DNA, 18 bp, Homo sapiens
ctgtcctgcctgtggcca

SEQ ID NO: 2494763 - DNA, 14 bp, Homo sapiens
ctgtcctgggcctg

SEQ ID NO: 2494764 - DNA, 14 bp, Homo sapiens
ctgtcctggtggta

SEQ ID NO: 2494765 - DNA, 20 bp, Homo sapiens
ctgtcctggtggtattttca

SEQ ID NO: 2494766 - DNA, 23 bp, Homo sapiens
ctgtcctggtggtattttcaata

SEQ ID NO: 2494767 - DNA, 14 bp, Homo sapiens
ctgtcctgtcatca

SEQ ID NO: 2494768 - DNA, 22 bp, Homo sapiens
ctgtcctttctagagcactgcc

SEQ ID NO: 2494769 - DNA, 19 bp, Homo sapiens
ctgtcctttttcctctcca

SEQ ID NO: 2494770 - DNA, 20 bp, Homo sapiens
ctgtcctttttcctctccac

SEQ ID NO: 2494771 - DNA, 13 bp, Homo sapiens
ctgtcgctgcttc

SEQ ID NO: 2494772 - DNA, 14 bp, Homo sapiens
ctgtctcacctgga

SEQ ID NO: 2494773 - DNA, 17 bp, Homo sapiens
ctgtctcacctggactt

SEQ ID NO: 2494774 - DNA, 12 bp, Homo sapiens
ctgtctcagcct

SEQ ID NO: 2494775 - DNA, 16 bp, Homo sapiens
ctgtctcatccatcat

SEQ ID NO: 2494776 - DNA, 20 bp, Homo sapiens
ctgtctcgagcgccctgcag

SEQ ID NO: 2494777 - DNA, 21 bp, Homo sapiens
ctgtctcgagcgccctgcaga

SEQ ID NO: 2494778 - DNA, 22 bp, Homo sapiens
ctgtctcgagcgccctgcagac

SEQ ID NO: 2494779 - DNA, 23 bp, Homo sapiens
ctgtctcgagcgccctgcagacc

SEQ ID NO: 2494780 - DNA, 23 bp, Homo sapiens
ctgtctggcaatgccacagccct

SEQ ID NO: 2494781 - DNA, 16 bp, Homo sapiens
ctgtctgggtgctact

SEQ ID NO: 2494782 - DNA, 16 bp, Homo sapiens
ctgtctgggtggctca

SEQ ID NO: 2494783 - DNA, 17 bp, Homo sapiens
ctgtctgggtggctcac

SEQ ID NO: 2494784 - DNA, 23 bp, Homo sapiens
ctgtctggtggccccgtttctgg

SEQ ID NO: 2494785 - DNA, 19 bp, Homo sapiens
ctgtcttaaactaaatgtg

SEQ ID NO: 2494786 - DNA, 14 bp, Homo sapiens
ctgtcttctggact

SEQ ID NO: 2494787 - DNA, 16 bp, Homo sapiens
ctgtgaacccaggaca

SEQ ID NO: 2494788 - DNA, 14 bp, Homo sapiens
ctgtgaaggaccct

SEQ ID NO: 2494789 - DNA, 21 bp, Homo sapiens
ctgtgacccccagctccggcc

SEQ ID NO: 2494790 - DNA, 15 bp, Homo sapiens
ctgtgacctgctgag

SEQ ID NO: 2494791 - DNA, 19 bp, Homo sapiens
ctgtgacctgctgagctct

SEQ ID NO: 2494792 - DNA, 21 bp, Homo sapiens
ctgtgacctgctgagctctga

SEQ ID NO: 2494793 - DNA, 16 bp, Homo sapiens
ctgtgaggctgtcctg

SEQ ID NO: 2494794 - DNA, 22 bp, Homo sapiens
ctgtgagtctttggttctaagg

SEQ ID NO: 2494795 - DNA, 22 bp, Homo sapiens
ctgtgagttctccctgtacagt

SEQ ID NO: 2494796 - DNA, 21 bp, Homo sapiens
ctgtgcaacctcttggcctga

SEQ ID NO: 2494797 - DNA, 19 bp, Homo sapiens
ctgtgcacaaaacccagac

SEQ ID NO: 2494798 - DNA, 21 bp, Homo sapiens
ctgtgcacaccccactcccac

SEQ ID NO: 2494799 - DNA, 22 bp, Homo sapiens
ctgtgcacaccccactcccaca

SEQ ID NO: 2494800 - DNA, 14 bp, Homo sapiens
ctgtgcactgccca

SEQ ID NO: 2494801 - DNA, 16 bp, Homo sapiens
ctgtgcagtcctgggt

SEQ ID NO: 2494802 - DNA, 13 bp, Homo sapiens
ctgtgccagagcc

SEQ ID NO: 2494803 - DNA, 20 bp, Homo sapiens
ctgtgccaggcgaggccctt

SEQ ID NO: 2494804 - DNA, 21 bp, Homo sapiens
ctgtgccaggcgaggcccttg

SEQ ID NO: 2494805 - DNA, 22 bp, Homo sapiens
ctgtgccaggcgaggcccttgg

SEQ ID NO: 2494806 - DNA, 20 bp, Homo sapiens
ctgtgcccccagggtcctgg

SEQ ID NO: 2494807 - DNA, 22 bp, Homo sapiens
ctgtgcccccagggtcctggga

SEQ ID NO: 2494808 - DNA, 20 bp, Homo sapiens
ctgtgccccttccgccactg

SEQ ID NO: 2494809 - DNA, 16 bp, Homo sapiens
ctgtgcctcagagacc

SEQ ID NO: 2494810 - DNA, 19 bp, Homo sapiens
ctgtgcctcagagaccagg

SEQ ID NO: 2494811 - DNA, 21 bp, Homo sapiens
ctgtgctatggtgctctgtct

SEQ ID NO: 2494812 - DNA, 13 bp, Homo sapiens
ctgtgctcagccc

SEQ ID NO: 2494813 - DNA, 16 bp, Homo sapiens
ctgtgctcagccctga

SEQ ID NO: 2494814 - DNA, 13 bp, Homo sapiens
ctgtgctgtgtgt

SEQ ID NO: 2494815 - DNA, 18 bp, Homo sapiens
ctgtgctgtgtgtgacgt

SEQ ID NO: 2494816 - DNA, 16 bp, Homo sapiens
ctgtgcttatggtacc

SEQ ID NO: 2494817 - DNA, 19 bp, Homo sapiens
ctgtgcttcgggcccttcc

SEQ ID NO: 2494818 - DNA, 20 bp, Homo sapiens
ctgtgcttcgggcccttccc

SEQ ID NO: 2494819 - DNA, 23 bp, Homo sapiens
ctgtggaccatggagtggcagcc

SEQ ID NO: 2494820 - DNA, 15 bp, Homo sapiens
ctgtggatcagagat

SEQ ID NO: 2494821 - DNA, 23 bp, Homo sapiens
ctgtggcagagttacagttctgt

SEQ ID NO: 2494822 - DNA, 20 bp, Homo sapiens
ctgtggccatgaccctgcct

SEQ ID NO: 2494823 - DNA, 22 bp, Homo sapiens
ctgtggccatgaccctgcctct

SEQ ID NO: 2494824 - DNA, 17 bp, Homo sapiens
ctgtggccccaccctgg

SEQ ID NO: 2494825 - DNA, 15 bp, Homo sapiens
ctgtgggagcctcgc

SEQ ID NO: 2494826 - DNA, 23 bp, Homo sapiens
ctgtgggggtgagggtcccatgt

SEQ ID NO: 2494827 - DNA, 16 bp, Homo sapiens
ctgtggtcacagcgga

SEQ ID NO: 2494828 - DNA, 15 bp, Homo sapiens
ctgtggtgtgtcccc

SEQ ID NO: 2494829 - DNA, 18 bp, Homo sapiens
ctgtggttctgagatggc

SEQ ID NO: 2494830 - DNA, 23 bp, Homo sapiens
ctgtggttctgagatggctccca

SEQ ID NO: 2494831 - DNA, 16 bp, Homo sapiens
ctgtggtttcatgtta

SEQ ID NO: 2494832 - DNA, 15 bp, Homo sapiens
ctgtgtaactgccca

SEQ ID NO: 2494833 - DNA, 18 bp, Homo sapiens
ctgtgtaattagtgccac

SEQ ID NO: 2494834 - DNA, 15 bp, Homo sapiens
ctgtgtactgcagtt

SEQ ID NO: 2494835 - DNA, 20 bp, Homo sapiens
ctgtgtagctgtgacctgct

SEQ ID NO: 2494836 - DNA, 22 bp, Homo sapiens
ctgtgtccaaaaccgccagctc

SEQ ID NO: 2494837 - DNA, 18 bp, Homo sapiens
ctgtgtccatgcgctcag

SEQ ID NO: 2494838 - DNA, 22 bp, Homo sapiens
ctgtgtccatgcgctcagggcc

SEQ ID NO: 2494839 - DNA, 23 bp, Homo sapiens
ctgtgtccatgcgctcagggcca

SEQ ID NO: 2494840 - DNA, 12 bp, Homo sapiens
ctgtgtctaaga

SEQ ID NO: 2494841 - DNA, 17 bp, Homo sapiens
ctgtgtctaagattcta

SEQ ID NO: 2494842 - DNA, 16 bp, Homo sapiens
cagggaaggaggagcc

SEQ ID NO: 2494843 - DNA, 13 bp, Homo sapiens
cagggaaggcagg

SEQ ID NO: 2494844 - DNA, 14 bp, Homo sapiens
cagggaaggcaggc

SEQ ID NO: 2494845 - DNA, 16 bp, Homo sapiens
cagggaaggcaggcag

SEQ ID NO: 2494846 - DNA, 20 bp, Homo sapiens
cccctggggtggccaccagt

SEQ ID NO: 2494847 - DNA, 17 bp, Homo sapiens
cccctggtcccctcctt

SEQ ID NO: 2494848 - DNA, 21 bp, Homo sapiens
cccctggtcccctccttccca

SEQ ID NO: 2494849 - DNA, 11 bp, Homo sapiens
cccctgtacac

SEQ ID NO: 2494850 - DNA, 11 bp, Homo sapiens
cccctgtgcag

SEQ ID NO: 2494851 - DNA, 19 bp, Homo sapiens
cccctgtgcagccgctgag

SEQ ID NO: 2494852 - DNA, 17 bp, Homo sapiens
ccccttagacagaggcc

SEQ ID NO: 2494853 - DNA, 14 bp, Homo sapiens
ccccttccactgag

SEQ ID NO: 2494854 - DNA, 22 bp, Homo sapiens
ccccttgaggtctcagcccctt

SEQ ID NO: 2494855 - DNA, 19 bp, Homo sapiens
cccctttcacaggcagcca

SEQ ID NO: 2494856 - DNA, 13 bp, Homo sapiens
cccctttcccacc

SEQ ID NO: 2494857 - DNA, 14 bp, Homo sapiens
cccctttcccaccc

SEQ ID NO: 2494858 - DNA, 17 bp, Homo sapiens
cccgactggggcagggt

SEQ ID NO: 2494859 - DNA, 20 bp, Homo sapiens
cccgagaaaacaaacccagg

SEQ ID NO: 2494860 - DNA, 21 bp, Homo sapiens
cccgagcagctgagcagggcc

SEQ ID NO: 2494861 - DNA, 22 bp, Homo sapiens
cccgagcagctgagcagggccg

SEQ ID NO: 2494862 - DNA, 21 bp, Homo sapiens
cccgaggaggtgtctcaggct

SEQ ID NO: 2494863 - DNA, 21 bp, Homo sapiens
cccgagtcattcgttctgtgg

SEQ ID NO: 2494864 - DNA, 22 bp, Homo sapiens
cccgcgatgtggaactgctgcc

SEQ ID NO: 2494865 - DNA, 19 bp, Homo sapiens
cccggaggcggtgggcctg

SEQ ID NO: 2494866 - DNA, 22 bp, Homo sapiens
cccggatgcagaggcctgcagg

SEQ ID NO: 2494867 - DNA, 23 bp, Homo sapiens
cccggatgcagaggcctgcaggg

SEQ ID NO: 2494868 - DNA, 13 bp, Homo sapiens
cccggcaccccct

SEQ ID NO: 2494869 - DNA, 18 bp, Homo sapiens
cccggcaccccctgcagc

SEQ ID NO: 2494870 - DNA, 12 bp, Homo sapiens
cccggcagggcg

SEQ ID NO: 2494871 - DNA, 21 bp, Homo sapiens
cccggcagggcgggcagaggg

SEQ ID NO: 2494872 - DNA, 13 bp, Homo sapiens
cccggctcctggt

SEQ ID NO: 2494873 - DNA, 18 bp, Homo sapiens
cccggctcctggtcacct

SEQ ID NO: 2494874 - DNA, 22 bp, Homo sapiens
cccggctcgagcagtcctgcct

SEQ ID NO: 2494875 - DNA, 16 bp, Homo sapiens
cccggctgcagaggcc

SEQ ID NO: 2494876 - DNA, 15 bp, Homo sapiens
cccgtcctgcctgtg

SEQ ID NO: 2494877 - DNA, 13 bp, Homo sapiens
cccgtctcagtgt

SEQ ID NO: 2494878 - DNA, 22 bp, Homo sapiens
cccgtgccaagtccaggtcctg

SEQ ID NO: 2494879 - DNA, 20 bp, Homo sapiens
cccgtgtaaatatgtacatt

SEQ ID NO: 2494880 - DNA, 12 bp, Homo sapiens
cccgtttctcca

SEQ ID NO: 2494881 - DNA, 14 bp, Homo sapiens
cccgtttctggtgg

SEQ ID NO: 2494882 - DNA, 18 bp, Homo sapiens
ccctaagagagcacctgg

SEQ ID NO: 2494883 - DNA, 11 bp, Homo sapiens
ccctaccctct

SEQ ID NO: 2494884 - DNA, 11 bp, Homo sapiens
ccctagccttg

SEQ ID NO: 2494885 - DNA, 14 bp, Homo sapiens
ccctatctgtattc

SEQ ID NO: 2494886 - DNA, 15 bp, Homo sapiens
ccctatttattgact

SEQ ID NO: 2494887 - DNA, 19 bp, Homo sapiens
ccctcactggctctcctgg

SEQ ID NO: 2494888 - DNA, 20 bp, Homo sapiens
ccctcactggctctcctggc

SEQ ID NO: 2494889 - DNA, 20 bp, Homo sapiens
ccctcagggcaaagccaggt

SEQ ID NO: 2494890 - DNA, 19 bp, Homo sapiens
ccctcagtagtccctgcac

SEQ ID NO: 2494891 - DNA, 19 bp, Homo sapiens
ccctcatcaaggacacggg

SEQ ID NO: 2494892 - DNA, 15 bp, Homo sapiens
ccctcccccccatgc

SEQ ID NO: 2494893 - DNA, 18 bp, Homo sapiens
ccctcccctccatccctg

SEQ ID NO: 2494894 - DNA, 14 bp, Homo sapiens
ccctccccttctct

SEQ ID NO: 2494895 - DNA, 21 bp, Homo sapiens
ccctccccttgcctgtgccag

SEQ ID NO: 2494896 - DNA, 20 bp, Homo sapiens
ccctccctgttccccagaga

SEQ ID NO: 2494897 - DNA, 17 bp, Homo sapiens
ccctccgctctgtagtg

SEQ ID NO: 2494898 - DNA, 21 bp, Homo sapiens
ccctctacagagcttccctga

SEQ ID NO: 2494899 - DNA, 17 bp, Homo sapiens
ccctctcaacacccagt

SEQ ID NO: 2494900 - DNA, 14 bp, Homo sapiens
ccctctcagccctc

SEQ ID NO: 2494901 - DNA, 18 bp, Homo sapiens
ccctctcagccctcacac

SEQ ID NO: 2494902 - DNA, 16 bp, Homo sapiens
ccctctcatttagcct

SEQ ID NO: 2494903 - DNA, 14 bp, Homo sapiens
ccctctcccaggcc

SEQ ID NO: 2494904 - DNA, 20 bp, Homo sapiens
ccctctcccaggccccatga

SEQ ID NO: 2494905 - DNA, 16 bp, Homo sapiens
ccctctctgctctgcg

SEQ ID NO: 2494906 - DNA, 13 bp, Homo sapiens
ccctctctggaga

SEQ ID NO: 2494907 - DNA, 21 bp, Homo sapiens
ccctctggaggggtgtggctc

SEQ ID NO: 2494908 - DNA, 12 bp, Homo sapiens
ccctctgggctc

SEQ ID NO: 2494909 - DNA, 17 bp, Homo sapiens
ccctctgggctctgagt

SEQ ID NO: 2494910 - DNA, 18 bp, Homo sapiens
ccctctgtgtatttgctt

SEQ ID NO: 2494911 - DNA, 14 bp, Homo sapiens
ccctcttcctactg

SEQ ID NO: 2494912 - DNA, 19 bp, Homo sapiens
ccctcttcctactggtctc

SEQ ID NO: 2494913 - DNA, 17 bp, Homo sapiens
ccctctttggctcccct

SEQ ID NO: 2494914 - DNA, 14 bp, Homo sapiens
ccctgaccactcag

SEQ ID NO: 2494915 - DNA, 15 bp, Homo sapiens
ccctgaccactcaga

SEQ ID NO: 2494916 - DNA, 16 bp, Homo sapiens
ccctgaccactcagag

SEQ ID NO: 2494917 - DNA, 17 bp, Homo sapiens
ccctgaccactcagaga

SEQ ID NO: 2494918 - DNA, 23 bp, Homo sapiens
ccctgaccactcagagacatgca

SEQ ID NO: 2494919 - DNA, 19 bp, Homo sapiens
ccctgactcattctgaagg

SEQ ID NO: 2494920 - DNA, 21 bp, Homo sapiens
ccctgactcattctgaaggag

SEQ ID NO: 2494921 - DNA, 13 bp, Homo sapiens
ccctgactgggag

SEQ ID NO: 2494922 - DNA, 20 bp, Homo sapiens
ccctgagccagggtctccag

SEQ ID NO: 2494923 - DNA, 11 bp, Homo sapiens
ccctgagctga

SEQ ID NO: 2494924 - DNA, 13 bp, Homo sapiens
ccctgagctgagg

SEQ ID NO: 2494925 - DNA, 13 bp, Homo sapiens
ccctgaggagtct

SEQ ID NO: 2494926 - DNA, 15 bp, Homo sapiens
ccctgaggagtctga

SEQ ID NO: 2494927 - DNA, 19 bp, Homo sapiens
ccctgaggagtctgaggtc

SEQ ID NO: 2494928 - DNA, 16 bp, Homo sapiens
ccctgagttggagctc

SEQ ID NO: 2494929 - DNA, 17 bp, Homo sapiens
ccctgatcccagagagc

SEQ ID NO: 2494930 - DNA, 21 bp, Homo sapiens
ccctgatttaggagaagccag

SEQ ID NO: 2494931 - DNA, 23 bp, Homo sapiens
ccctgcagaaccggagagccagc

SEQ ID NO: 2494932 - DNA, 15 bp, Homo sapiens
ccctgcagaccctgc

SEQ ID NO: 2494933 - DNA, 20 bp, Homo sapiens
ccctgcagcttgtagccagc

SEQ ID NO: 2494934 - DNA, 15 bp, Homo sapiens
ccctgcaggaaggag

SEQ ID NO: 2494935 - DNA, 17 bp, Homo sapiens
ccctgcaggaaggagct

SEQ ID NO: 2494936 - DNA, 23 bp, Homo sapiens
ccctgcattggaactggaggcag

SEQ ID NO: 2494937 - DNA, 20 bp, Homo sapiens
ccctgccactcactaggccc

SEQ ID NO: 2494938 - DNA, 14 bp, Homo sapiens
ccctgccagggcag

SEQ ID NO: 2494939 - DNA, 18 bp, Homo sapiens
ccctgcctggaggacctg

SEQ ID NO: 2494940 - DNA, 21 bp, Homo sapiens
ccctgcctggaggacctgagc

SEQ ID NO: 2494941 - DNA, 15 bp, Homo sapiens
ccctgcttcctgctt

SEQ ID NO: 2494942 - DNA, 22 bp, Homo sapiens
ccctgctttgggcttgggccta

SEQ ID NO: 2494943 - DNA, 23 bp, Homo sapiens
ccctggaatgagttgaggccact

SEQ ID NO: 2494944 - DNA, 19 bp, Homo sapiens
ccctggaggcactgaagtg

SEQ ID NO: 2494945 - DNA, 15 bp, Homo sapiens
ccctggatcagaaca

SEQ ID NO: 2494946 - DNA, 17 bp, Homo sapiens
ccctggatcagaacagg

SEQ ID NO: 2494947 - DNA, 22 bp, Homo sapiens
ccctggcagagatgcctccctg

SEQ ID NO: 2494948 - DNA, 13 bp, Homo sapiens
ccctggccccctc

SEQ ID NO: 2494949 - DNA, 21 bp, Homo sapiens
ccctggccccctccctggatg

SEQ ID NO: 2494950 - DNA, 17 bp, Homo sapiens
ccctggcccctctccct

SEQ ID NO: 2494951 - DNA, 14 bp, Homo sapiens
ccctggcctcccct

SEQ ID NO: 2494952 - DNA, 19 bp, Homo sapiens
ccctggcctcccctgccac

SEQ ID NO: 2494953 - DNA, 22 bp, Homo sapiens
ccctggctccttgtgccagaga

SEQ ID NO: 2494954 - DNA, 16 bp, Homo sapiens
ccctgggccctgggct

SEQ ID NO: 2494955 - DNA, 18 bp, Homo sapiens
ccctgggccctgggctgg

SEQ ID NO: 2494956 - DNA, 11 bp, Homo sapiens
ccctgggcctg

SEQ ID NO: 2494957 - DNA, 20 bp, Homo sapiens
ccctggggcctgtactgcct

SEQ ID NO: 2494958 - DNA, 22 bp, Homo sapiens
ccctggggcctgtactgcctgc

SEQ ID NO: 2494959 - DNA, 11 bp, Homo sapiens
ccctggtccct

SEQ ID NO: 2494960 - DNA, 22 bp, Homo sapiens
ccctggtggccctctcccctgc

SEQ ID NO: 2494961 - DNA, 20 bp, Homo sapiens
ccctgtacagtgttaccatc

SEQ ID NO: 2494962 - DNA, 19 bp, Homo sapiens
ccctgtaccttttgaggag

SEQ ID NO: 2494963 - DNA, 15 bp, Homo sapiens
ccctgtaggcctcag

SEQ ID NO: 2494964 - DNA, 21 bp, Homo sapiens
ccctgtctctcagggccaggc

SEQ ID NO: 2494965 - DNA, 22 bp, Homo sapiens
ccctgtctctcagggccaggcc

SEQ ID NO: 2494966 - DNA, 22 bp, Homo sapiens
ccctgtgcaacctcttggcctg

SEQ ID NO: 2494967 - DNA, 19 bp, Homo sapiens
ccctgtgcctcctccctcc

SEQ ID NO: 2494968 - DNA, 16 bp, Homo sapiens
ccctgtgttgtctcta

SEQ ID NO: 2494969 - DNA, 23 bp, Homo sapiens
ccctgtgttgtctctagagcagg

SEQ ID NO: 2494970 - DNA, 14 bp, Homo sapiens
ccctgttccccaga

SEQ ID NO: 2494971 - DNA, 17 bp, Homo sapiens
ccctgttcctgctgctg

SEQ ID NO: 2494972 - DNA, 20 bp, Homo sapiens
ccctgttcctgctgctgtct

SEQ ID NO: 2494973 - DNA, 12 bp, Homo sapiens
cccttagacaga

SEQ ID NO: 2494974 - DNA, 15 bp, Homo sapiens
cccttagacagaggc

SEQ ID NO: 2494975 - DNA, 14 bp, Homo sapiens
cccttatcctccct

SEQ ID NO: 2494976 - DNA, 17 bp, Homo sapiens
cccttcagtaccctctc

SEQ ID NO: 2494977 - DNA, 20 bp, Homo sapiens
cccttcagtaccctctcagc

SEQ ID NO: 2494978 - DNA, 23 bp, Homo sapiens
cccttcccacaggacatttctct

SEQ ID NO: 2494979 - DNA, 18 bp, Homo sapiens
cccttccgccactggggc

SEQ ID NO: 2494980 - DNA, 11 bp, Homo sapiens
cccttcctgga

SEQ ID NO: 2494981 - DNA, 16 bp, Homo sapiens
cccttcctggacagct

SEQ ID NO: 2494982 - DNA, 18 bp, Homo sapiens
cccttcctggacagctgt

SEQ ID NO: 2494983 - DNA, 20 bp, Homo sapiens
cccttcctggacagctgtgc

SEQ ID NO: 2494984 - DNA, 14 bp, Homo sapiens
cccttctcccactc

SEQ ID NO: 2494985 - DNA, 14 bp, Homo sapiens
cccttctgctcagc

SEQ ID NO: 2494986 - DNA, 12 bp, Homo sapiens
cccttgaactct

SEQ ID NO: 2494987 - DNA, 19 bp, Homo sapiens
cccttgacaactggcaggc

SEQ ID NO: 2494988 - DNA, 21 bp, Homo sapiens
cccttgacaactggcaggcag

SEQ ID NO: 2494989 - DNA, 18 bp, Homo sapiens
cccttgaggtctcagccc

SEQ ID NO: 2494990 - DNA, 21 bp, Homo sapiens
cccttgatcagccccaccctg

SEQ ID NO: 2494991 - DNA, 12 bp, Homo sapiens
cccttgctgctt

SEQ ID NO: 2494992 - DNA, 16 bp, Homo sapiens
cccttgggctctgatg

SEQ ID NO: 2494993 - DNA, 21 bp, Homo sapiens
cccttgtagctcctcccctgg

SEQ ID NO: 2494994 - DNA, 23 bp, Homo sapiens
cccttgtagctcctcccctggag

SEQ ID NO: 2494995 - DNA, 18 bp, Homo sapiens
cccttgtatcccctgcag

SEQ ID NO: 2494996 - DNA, 18 bp, Homo sapiens
ccctttagatctctgaag

SEQ ID NO: 2494997 - DNA, 20 bp, Homo sapiens
ccctttcacaggcagccagt

SEQ ID NO: 2494998 - DNA, 12 bp, Homo sapiens
ccctttcccacc

SEQ ID NO: 2494999 - DNA, 18 bp, Homo sapiens
ccctttcggatccaggga

SEQ ID NO: 2495000 - DNA, 12 bp, Homo sapiens
ccctttgagtgc

SEQ ID NO: 2495001 - DNA, 17 bp, Homo sapiens
ccctttgctgcatggca

SEQ ID NO: 2495002 - DNA, 15 bp, Homo sapiens
ccctttttctccagc

SEQ ID NO: 2495003 - DNA, 18 bp, Homo sapiens
ccgaagccgcctgtggac

SEQ ID NO: 2495004 - DNA, 23 bp, Homo sapiens
ccgactcacaccactagcctcag

SEQ ID NO: 2495005 - DNA, 14 bp, Homo sapiens
ccgactgctttgga

SEQ ID NO: 2495006 - DNA, 16 bp, Homo sapiens
ccgagcaaccgtggcc

SEQ ID NO: 2495007 - DNA, 20 bp, Homo sapiens
ccgagcagctgagcagggcc

SEQ ID NO: 2495008 - DNA, 21 bp, Homo sapiens
ccgagcagctgagcagggccg

SEQ ID NO: 2495009 - DNA, 18 bp, Homo sapiens
ccgagctcctcttccatg

SEQ ID NO: 2495010 - DNA, 20 bp, Homo sapiens
ccgaggaggtgtctcaggct

SEQ ID NO: 2495011 - DNA, 22 bp, Homo sapiens
ccgaggcctaccccgcagacac

SEQ ID NO: 2495012 - DNA, 16 bp, Homo sapiens
ccgaggtccctgctgc

SEQ ID NO: 2495013 - DNA, 20 bp, Homo sapiens
ccgagtcattcgttctgtgg

SEQ ID NO: 2495014 - DNA, 13 bp, Homo sapiens
ccgagtccaagct

SEQ ID NO: 2495015 - DNA, 13 bp, Homo sapiens
ccgattgtaactc

SEQ ID NO: 2495016 - DNA, 15 bp, Homo sapiens
ccgcagcccccaccc

SEQ ID NO: 2495017 - DNA, 21 bp, Homo sapiens
ccgcagcccccacccccaagg

SEQ ID NO: 2495018 - DNA, 13 bp, Homo sapiens
ccgccactggggc

SEQ ID NO: 2495019 - DNA, 14 bp, Homo sapiens
ccgccctgccactc

SEQ ID NO: 2495020 - DNA, 16 bp, Homo sapiens
ccgcctgccctcatgg

SEQ ID NO: 2495021 - DNA, 22 bp, Homo sapiens
ccgcctggatgcggatggccgg

SEQ ID NO: 2495022 - DNA, 14 bp, Homo sapiens
ccgcctggcctggc

SEQ ID NO: 2495023 - DNA, 23 bp, Homo sapiens
ccgcgatgtggaactgctgccac

SEQ ID NO: 2495024 - DNA, 16 bp, Homo sapiens
ccgcgtctaccctggg

SEQ ID NO: 2495025 - DNA, 17 bp, Homo sapiens
ccgcgtctaccctggga

SEQ ID NO: 2495026 - DNA, 22 bp, Homo sapiens
ccgcgtgcggaggggacagagc

SEQ ID NO: 2495027 - DNA, 17 bp, Homo sapiens
ccgctacaccactctgg

SEQ ID NO: 2495028 - DNA, 19 bp, Homo sapiens
ccgctacaccactctggca

SEQ ID NO: 2495029 - DNA, 23 bp, Homo sapiens
ccgctgagcgaggagatgctcct

SEQ ID NO: 2495030 - DNA, 20 bp, Homo sapiens
ccgctgccacgttggagaag

SEQ ID NO: 2495031 - DNA, 17 bp, Homo sapiens
ccgcttggagcagaggg

SEQ ID NO: 2495032 - DNA, 20 bp, Homo sapiens
ccgcttggcgatgccagcca

SEQ ID NO: 2495033 - DNA, 15 bp, Homo sapiens
ccggaccagcctggc

SEQ ID NO: 2495034 - DNA, 16 bp, Homo sapiens
ccggaccagcctggcc

SEQ ID NO: 2495035 - DNA, 16 bp, Homo sapiens
ccggacttttctgcaa

SEQ ID NO: 2495036 - DNA, 16 bp, Homo sapiens
ccggagagtgggggtg

SEQ ID NO: 2495037 - DNA, 18 bp, Homo sapiens
ccggcaccccctgcagct

SEQ ID NO: 2495038 - DNA, 21 bp, Homo sapiens
ccggcaccccctgcagcttgt

SEQ ID NO: 2495039 - DNA, 16 bp, Homo sapiens
ccggcacctcccttgg

SEQ ID NO: 2495040 - DNA, 19 bp, Homo sapiens
ccggcagcttctgccccct

SEQ ID NO: 2495041 - DNA, 21 bp, Homo sapiens
ccggcagggcgggcagagggc

SEQ ID NO: 2495042 - DNA, 23 bp, Homo sapiens
ccggcagggcgggcagagggctg

SEQ ID NO: 2495043 - DNA, 13 bp, Homo sapiens
ccggcatggacaa

SEQ ID NO: 2495044 - DNA, 17 bp, Homo sapiens
ccggcatggacaatgga

SEQ ID NO: 2495045 - DNA, 18 bp, Homo sapiens
ccggcatggacaatggac

SEQ ID NO: 2495046 - DNA, 11 bp, Homo sapiens
ccggccagccc

SEQ ID NO: 2495047 - DNA, 18 bp, Homo sapiens
ccggccccagtacacagg

SEQ ID NO: 2495048 - DNA, 18 bp, Homo sapiens
ccggcctgccaggaggac

SEQ ID NO: 2495049 - DNA, 19 bp, Homo sapiens
ccggcgggatgttgaactg

SEQ ID NO: 2495050 - DNA, 15 bp, Homo sapiens
ccggctaatttttgt

SEQ ID NO: 2495051 - DNA, 18 bp, Homo sapiens
ccggctcccttctacagc

SEQ ID NO: 2495052 - DNA, 15 bp, Homo sapiens
ccggctcctggtcac

SEQ ID NO: 2495053 - DNA, 17 bp, Homo sapiens
ccggctcctggtcacct

SEQ ID NO: 2495054 - DNA, 13 bp, Homo sapiens
ccgggccactcct

SEQ ID NO: 2495055 - DNA, 20 bp, Homo sapiens
ccgggccactccttcctgcc

SEQ ID NO: 2495056 - DNA, 15 bp, Homo sapiens
ccggggccagcactt

SEQ ID NO: 2495057 - DNA, 22 bp, Homo sapiens
ccggggtgagggggggctccct

SEQ ID NO: 2495058 - DNA, 18 bp, Homo sapiens
ccggggtggggtggctgc

SEQ ID NO: 2495059 - DNA, 20 bp, Homo sapiens
ccggggtggggtggctgcag

SEQ ID NO: 2495060 - DNA, 21 bp, Homo sapiens
ccggggtggggtggctgcagc

SEQ ID NO: 2495061 - DNA, 14 bp, Homo sapiens
ccgggtctgcctct

SEQ ID NO: 2495062 - DNA, 18 bp, Homo sapiens
ccggtcgccctttgctgc

SEQ ID NO: 2495063 - DNA, 20 bp, Homo sapiens
ccgtcaccacgactggccag

SEQ ID NO: 2495064 - DNA, 15 bp, Homo sapiens
ccgtcctgcctgtgg

SEQ ID NO: 2495065 - DNA, 16 bp, Homo sapiens
ccgtcctgcctgtggc

SEQ ID NO: 2495066 - DNA, 20 bp, Homo sapiens
ccgtctccaggggctgcttc

SEQ ID NO: 2495067 - DNA, 16 bp, Homo sapiens
ccgtctggcccaccag

SEQ ID NO: 2495068 - DNA, 18 bp, Homo sapiens
ccgtctggcccaccaggg

SEQ ID NO: 2495069 - DNA, 14 bp, Homo sapiens
ccgtgacgtctggg

SEQ ID NO: 2495070 - DNA, 16 bp, Homo sapiens
ccgtgacgtctgggtg

SEQ ID NO: 2495071 - DNA, 12 bp, Homo sapiens
ccgtggaggctg

SEQ ID NO: 2495072 - DNA, 14 bp, Homo sapiens
ccgtggaggctgct

SEQ ID NO: 2495073 - DNA, 22 bp, Homo sapiens
ccgtggattgcacgtggcctct

SEQ ID NO: 2495074 - DNA, 23 bp, Homo sapiens
ccgtggattgcacgtggcctctt

SEQ ID NO: 2495075 - DNA, 14 bp, Homo sapiens
ccgtggcccttcct

SEQ ID NO: 2495076 - DNA, 16 bp, Homo sapiens
ccgtggcccttcctgg

SEQ ID NO: 2495077 - DNA, 16 bp, Homo sapiens
ccgtggctgctgtggg

SEQ ID NO: 2495078 - DNA, 15 bp, Homo sapiens
ccgtggctttggttt

SEQ ID NO: 2495079 - DNA, 22 bp, Homo sapiens
ccgtgggcaattgtctgaaaag

SEQ ID NO: 2495080 - DNA, 14 bp, Homo sapiens
ccgtgggctccctg

SEQ ID NO: 2495081 - DNA, 15 bp, Homo sapiens
ccgtgtccaccccca

SEQ ID NO: 2495082 - DNA, 18 bp, Homo sapiens
ccgtgtccacccccatac

SEQ ID NO: 2495083 - DNA, 17 bp, Homo sapiens
ccgttagctcctgtggc

SEQ ID NO: 2495084 - DNA, 15 bp, Homo sapiens
ccgttcatgggggag

SEQ ID NO: 2495085 - DNA, 19 bp, Homo sapiens
ccgttttgtcactttttct

SEQ ID NO: 2495086 - DNA, 22 bp, Homo sapiens
cctaaaaggaaatctcacccca

SEQ ID NO: 2495087 - DNA, 23 bp, Homo sapiens
cctaaaaggaaatctcaccccat

SEQ ID NO: 2495088 - DNA, 18 bp, Homo sapiens
cctaaatggcctcatgtg

SEQ ID NO: 2495089 - DNA, 22 bp, Homo sapiens
cctaaattttcctgtcctcttt

SEQ ID NO: 2495090 - DNA, 17 bp, Homo sapiens
cctaactcttctttcat

SEQ ID NO: 2495091 - DNA, 15 bp, Homo sapiens
cctaagagagcacct

SEQ ID NO: 2495092 - DNA, 15 bp, Homo sapiens
cctaagcagaaagtg

SEQ ID NO: 2495093 - DNA, 22 bp, Homo sapiens
cctaagggtcgaaagctctaga

SEQ ID NO: 2495094 - DNA, 16 bp, Homo sapiens
cctaataaagttctgt

SEQ ID NO: 2495095 - DNA, 20 bp, Homo sapiens
cctaatccaggcagatccag

SEQ ID NO: 2495096 - DNA, 18 bp, Homo sapiens
cctaatccccttctcccc

SEQ ID NO: 2495097 - DNA, 13 bp, Homo sapiens
cctaatgtgttta

SEQ ID NO: 2495098 - DNA, 21 bp, Homo sapiens
cctacagaaaaaccttgggtt

SEQ ID NO: 2495099 - DNA, 17 bp, Homo sapiens
cctacagttttaactgt

SEQ ID NO: 2495100 - DNA, 21 bp, Homo sapiens
cctacagttttaactgtggat

SEQ ID NO: 2495101 - DNA, 14 bp, Homo sapiens
cctactcacacagg

SEQ ID NO: 2495102 - DNA, 22 bp, Homo sapiens
cctactcacacaggcatttcct

SEQ ID NO: 2495103 - DNA, 16 bp, Homo sapiens
cctactggtctctcta

SEQ ID NO: 2495104 - DNA, 13 bp, Homo sapiens
cctactgttctaa

SEQ ID NO: 2495105 - DNA, 16 bp, Homo sapiens
cctactgttctaaagc

SEQ ID NO: 2495106 - DNA, 23 bp, Homo sapiens
cctactgttctaaagctctgaca

SEQ ID NO: 2495107 - DNA, 15 bp, Homo sapiens
cctagaaacaacact

SEQ ID NO: 2495108 - DNA, 17 bp, Homo sapiens
cctagaaacaacactgt

SEQ ID NO: 2495109 - DNA, 13 bp, Homo sapiens
cctagaccagcag

SEQ ID NO: 2495110 - DNA, 19 bp, Homo sapiens
cctagagaagacaggctgg

SEQ ID NO: 2495111 - DNA, 22 bp, Homo sapiens
cctagagaagacaggctggaag

SEQ ID NO: 2495112 - DNA, 20 bp, Homo sapiens
cctagatgtataactaggag

SEQ ID NO: 2495113 - DNA, 22 bp, Homo sapiens
cctagatgtataactaggagct

SEQ ID NO: 2495114 - DNA, 21 bp, Homo sapiens
cctagcagcaccgttctgtgc

SEQ ID NO: 2495115 - DNA, 15 bp, Homo sapiens
cctagccttgcttgt

SEQ ID NO: 2495116 - DNA, 14 bp, Homo sapiens
cctagctgaatgtt

SEQ ID NO: 2495117 - DNA, 20 bp, Homo sapiens
cctagctgaatgtttttcta

SEQ ID NO: 2495118 - DNA, 22 bp, Homo sapiens
cctagctgaatgtttttctaaa

SEQ ID NO: 2495119 - DNA, 13 bp, Homo sapiens
cctagctgtcctt

SEQ ID NO: 2495120 - DNA, 16 bp, Homo sapiens
cctagctgtgtgaata

SEQ ID NO: 2495121 - DNA, 13 bp, Homo sapiens
cctaggaagcctc

SEQ ID NO: 2495122 - DNA, 23 bp, Homo sapiens
cctatactgcttggagctgagca

SEQ ID NO: 2495123 - DNA, 19 bp, Homo sapiens
cctatactgtagtattctt

SEQ ID NO: 2495124 - DNA, 19 bp, Homo sapiens
cctatgcatggtttcagca

SEQ ID NO: 2495125 - DNA, 23 bp, Homo sapiens
cctatgcatggtttcagcactag

SEQ ID NO: 2495126 - DNA, 13 bp, Homo sapiens
cctatggagagcc

SEQ ID NO: 2495127 - DNA, 17 bp, Homo sapiens
cctatggagagccctgg

SEQ ID NO: 2495128 - DNA, 21 bp, Homo sapiens
cctatggagagccctgggacc

SEQ ID NO: 2495129 - DNA, 22 bp, Homo sapiens
cctatggagagccctgggaccg

SEQ ID NO: 2495130 - DNA, 12 bp, Homo sapiens
cctatggcctca

SEQ ID NO: 2495131 - DNA, 15 bp, Homo sapiens
cctatggcctcatgt

SEQ ID NO: 2495132 - DNA, 22 bp, Homo sapiens
cctatgtttttgttcaaagcca

SEQ ID NO: 2495133 - DNA, 17 bp, Homo sapiens
cctattatctgtcagct

SEQ ID NO: 2495134 - DNA, 18 bp, Homo sapiens
cctattgctagagctcct

SEQ ID NO: 2495135 - DNA, 19 bp, Homo sapiens
cctatttattgactttgac

SEQ ID NO: 2495136 - DNA, 14 bp, Homo sapiens
cctcaaaacaaagg

SEQ ID NO: 2495137 - DNA, 18 bp, Homo sapiens
cctcaacgtattgtttcg

SEQ ID NO: 2495138 - DNA, 13 bp, Homo sapiens
cctcaagtctttc

SEQ ID NO: 2495139 - DNA, 21 bp, Homo sapiens
cctcaagtctttctctttccc

SEQ ID NO: 2495140 - DNA, 21 bp, Homo sapiens
cctcacaagtgggtaccccca

SEQ ID NO: 2495141 - DNA, 15 bp, Homo sapiens
cctcacaggccccag

SEQ ID NO: 2495142 - DNA, 14 bp, Homo sapiens
cctcaccctgcctt

SEQ ID NO: 2495143 - DNA, 18 bp, Homo sapiens
cctcaccgagtgggggca

SEQ ID NO: 2495144 - DNA, 15 bp, Homo sapiens
cctcaccttggcacc

SEQ ID NO: 2495145 - DNA, 21 bp, Homo sapiens
cctcaccttggcaccagacac

SEQ ID NO: 2495146 - DNA, 20 bp, Homo sapiens
cctcactgtatccaggttcc

SEQ ID NO: 2495147 - DNA, 20 bp, Homo sapiens
cctcagagacatcagccctt

SEQ ID NO: 2495148 - DNA, 21 bp, Homo sapiens
cctcagagaccagggctccag

SEQ ID NO: 2495149 - DNA, 16 bp, Homo sapiens
cctcagatggcagctt

SEQ ID NO: 2495150 - DNA, 23 bp, Homo sapiens
cctcagatggcagcttttaaaag

SEQ ID NO: 2495151 - DNA, 16 bp, Homo sapiens
cctcagattccttccc

SEQ ID NO: 2495152 - DNA, 17 bp, Homo sapiens
cctcagattccttccca

SEQ ID NO: 2495153 - DNA, 22 bp, Homo sapiens
cctcagattccttcccatggag

SEQ ID NO: 2495154 - DNA, 21 bp, Homo sapiens
cctcagcctcccaaagtgctg

SEQ ID NO: 2495155 - DNA, 12 bp, Homo sapiens
cctcagcctggg

SEQ ID NO: 2495156 - DNA, 16 bp, Homo sapiens
cctcagcctgggcgct

SEQ ID NO: 2495157 - DNA, 12 bp, Homo sapiens
cctcagccttaa

SEQ ID NO: 2495158 - DNA, 17 bp, Homo sapiens
cctcagccttgccagag

SEQ ID NO: 2495159 - DNA, 18 bp, Homo sapiens
cctcagccttgccagaga

SEQ ID NO: 2495160 - DNA, 19 bp, Homo sapiens
cctcagccttgccagagat

SEQ ID NO: 2495161 - DNA, 20 bp, Homo sapiens
cctcagccttgccagagatc

SEQ ID NO: 2495162 - DNA, 22 bp, Homo sapiens
cctcagccttgccagagatcca

SEQ ID NO: 2495163 - DNA, 14 bp, Homo sapiens
cctcagctcccaca

SEQ ID NO: 2495164 - DNA, 20 bp, Homo sapiens
cctcagctcccacaagcctc

SEQ ID NO: 2495165 - DNA, 14 bp, Homo sapiens
cctcaggactggga

SEQ ID NO: 2495166 - DNA, 15 bp, Homo sapiens
cctcaggactgggag

SEQ ID NO: 2495167 - DNA, 15 bp, Homo sapiens
cctcaggcacacagc

SEQ ID NO: 2495168 - DNA, 17 bp, Homo sapiens
cctcaggcacacagcta

SEQ ID NO: 2495169 - DNA, 16 bp, Homo sapiens
cctcaggggtctgagc

SEQ ID NO: 2495170 - DNA, 21 bp, Homo sapiens
cctcagtagtccctgcacagt

SEQ ID NO: 2495171 - DNA, 17 bp, Homo sapiens
cctcagtgaccctggct

SEQ ID NO: 2495172 - DNA, 19 bp, Homo sapiens
cctcagtgaccctggctcc

SEQ ID NO: 2495173 - DNA, 19 bp, Homo sapiens
cctcagttttatcattttc

SEQ ID NO: 2495174 - DNA, 19 bp, Homo sapiens
cctcatagcaatacttgga

SEQ ID NO: 2495175 - DNA, 17 bp, Homo sapiens
cctcatctctctgccca

SEQ ID NO: 2495176 - DNA, 15 bp, Homo sapiens
cctcatctgtccctc

SEQ ID NO: 2495177 - DNA, 13 bp, Homo sapiens
cctcatgaatgta

SEQ ID NO: 2495178 - DNA, 23 bp, Homo sapiens
cctcatgaatgtaaatttgtact

SEQ ID NO: 2495179 - DNA, 16 bp, Homo sapiens
cctcatggcccctctg

SEQ ID NO: 2495180 - DNA, 13 bp, Homo sapiens
cctcatgtggctg

SEQ ID NO: 2495181 - DNA, 15 bp, Homo sapiens
cctcatgtggctgga

SEQ ID NO: 2495182 - DNA, 23 bp, Homo sapiens
cctcatgtggctggaagatcctg

SEQ ID NO: 2495183 - DNA, 18 bp, Homo sapiens
cctcatttttttccttgc

SEQ ID NO: 2495184 - DNA, 19 bp, Homo sapiens
cctccaacaccaagcacag

SEQ ID NO: 2495185 - DNA, 15 bp, Homo sapiens
cctccacatcctcca

SEQ ID NO: 2495186 - DNA, 16 bp, Homo sapiens
cctccacatcctccac

SEQ ID NO: 2495187 - DNA, 15 bp, Homo sapiens
cctccaggaagcctt

SEQ ID NO: 2495188 - DNA, 23 bp, Homo sapiens
cctcccagaggagccaccagttc

SEQ ID NO: 2495189 - DNA, 13 bp, Homo sapiens
cctcccccacttt

SEQ ID NO: 2495190 - DNA, 16 bp, Homo sapiens
cctcccccccatgcac

SEQ ID NO: 2495191 - DNA, 17 bp, Homo sapiens
cctcccctgccaccagg

SEQ ID NO: 2495192 - DNA, 13 bp, Homo sapiens
cctcccctgccag

SEQ ID NO: 2495193 - DNA, 19 bp, Homo sapiens
cctccctgaagcctttgca

SEQ ID NO: 2495194 - DNA, 12 bp, Homo sapiens
cctccctggatg

SEQ ID NO: 2495195 - DNA, 14 bp, Homo sapiens
cctccgccatccac

SEQ ID NO: 2495196 - DNA, 15 bp, Homo sapiens
cctccgccatccacc

SEQ ID NO: 2495197 - DNA, 13 bp, Homo sapiens
cctcctcagcctg

SEQ ID NO: 2495198 - DNA, 14 bp, Homo sapiens
cctcctcagcctga

SEQ ID NO: 2495199 - DNA, 13 bp, Homo sapiens
cctcctcatcccg

SEQ ID NO: 2495200 - DNA, 20 bp, Homo sapiens
cctcctcatcccgtgttctc

SEQ ID NO: 2495201 - DNA, 12 bp, Homo sapiens
cctcctcatgta

SEQ ID NO: 2495202 - DNA, 20 bp, Homo sapiens
cctcctcatgtacataccct

SEQ ID NO: 2495203 - DNA, 16 bp, Homo sapiens
cctcctccagggacag

SEQ ID NO: 2495204 - DNA, 16 bp, Homo sapiens
cctcctcccacccggc

SEQ ID NO: 2495205 - DNA, 19 bp, Homo sapiens
cctcctcccacccggctgc

SEQ ID NO: 2495206 - DNA, 14 bp, Homo sapiens
cctcctccctccct

SEQ ID NO: 2495207 - DNA, 19 bp, Homo sapiens
cctcctctaaggttgggca

SEQ ID NO: 2495208 - DNA, 18 bp, Homo sapiens
cctcctgacacccttctc

SEQ ID NO: 2495209 - DNA, 12 bp, Homo sapiens
cctcctgagaaa

SEQ ID NO: 2495210 - DNA, 19 bp, Homo sapiens
cctcctgcagaccacgccc

SEQ ID NO: 2495211 - DNA, 23 bp, Homo sapiens
cctcctgttgggagagggcgcag

SEQ ID NO: 2495212 - DNA, 15 bp, Homo sapiens
cctccttccctctct

SEQ ID NO: 2495213 - DNA, 15 bp, Homo sapiens
cctccttctcccttt

SEQ ID NO: 2495214 - DNA, 20 bp, Homo sapiens
cctccttctgagctcctgtc

SEQ ID NO: 2495215 - DNA, 19 bp, Homo sapiens
cctcctttcatcacactgg

SEQ ID NO: 2495216 - DNA, 13 bp, Homo sapiens
cctcctttttcca

SEQ ID NO: 2495217 - DNA, 23 bp, Homo sapiens
cctcgcaacccgtgccaagtcca

SEQ ID NO: 2495218 - DNA, 15 bp, Homo sapiens
cctcgcccctggcag

SEQ ID NO: 2495219 - DNA, 13 bp, Homo sapiens
cctcgcctgacaa

SEQ ID NO: 2495220 - DNA, 17 bp, Homo sapiens
cctcgctccccactctg

SEQ ID NO: 2495221 - DNA, 21 bp, Homo sapiens
cctcgctccccactctgctct

SEQ ID NO: 2495222 - DNA, 22 bp, Homo sapiens
cctcgctccccactctgctctg

SEQ ID NO: 2495223 - DNA, 23 bp, Homo sapiens
cctcgctccccactctgctctga

SEQ ID NO: 2495224 - DNA, 19 bp, Homo sapiens
cctcgctgccagctctgta

SEQ ID NO: 2495225 - DNA, 18 bp, Homo sapiens
cctcgctggactctcagt

SEQ ID NO: 2495226 - DNA, 13 bp, Homo sapiens
cctcgggcctgct

SEQ ID NO: 2495227 - DNA, 16 bp, Homo sapiens
cctcggggatgtgtcc

SEQ ID NO: 2495228 - DNA, 16 bp, Homo sapiens
cctcgtactcaggagc

SEQ ID NO: 2495229 - DNA, 15 bp, Homo sapiens
cctcgtttgtgttct

SEQ ID NO: 2495230 - DNA, 24 bp, Homo sapiens
cctctacagagcttccctgactca

SEQ ID NO: 2495231 - DNA, 15 bp, Homo sapiens
cctctaccccaattt

SEQ ID NO: 2495232 - DNA, 22 bp, Homo sapiens
cctctactgggaaggctacttc

SEQ ID NO: 2495233 - DNA, 14 bp, Homo sapiens
cctctagagcagac

SEQ ID NO: 2495234 - DNA, 15 bp, Homo sapiens
cctctagagcagact

SEQ ID NO: 2495235 - DNA, 15 bp, Homo sapiens
cctctaggtccccat

SEQ ID NO: 2495236 - DNA, 15 bp, Homo sapiens
cctctcaacacccag

SEQ ID NO: 2495237 - DNA, 11 bp, Homo sapiens
cctctcagccc

SEQ ID NO: 2495238 - DNA, 18 bp, Homo sapiens
cctctcatttagcctgtc

SEQ ID NO: 2495239 - DNA, 16 bp, Homo sapiens
cctctcccaccctctt

SEQ ID NO: 2495240 - DNA, 18 bp, Homo sapiens
cctctcccaccctcttcc

SEQ ID NO: 2495241 - DNA, 19 bp, Homo sapiens
cctctcccaggcaggggcc

SEQ ID NO: 2495242 - DNA, 15 bp, Homo sapiens
cctctcccaggcccc

SEQ ID NO: 2495243 - DNA, 15 bp, Homo sapiens
cctctcccagttgtc

SEQ ID NO: 2495244 - DNA, 18 bp, Homo sapiens
cctctccccagcccagag

SEQ ID NO: 2495245 - DNA, 15 bp, Homo sapiens
cctctcccctcagcc

SEQ ID NO: 2495246 - DNA, 16 bp, Homo sapiens
cctctccctgcatggc

SEQ ID NO: 2495247 - DNA, 22 bp, Homo sapiens
cctctcgtaagatttccttctt

SEQ ID NO: 2495248 - DNA, 23 bp, Homo sapiens
cctctcgtaagatttccttcttt

SEQ ID NO: 2495249 - DNA, 15 bp, Homo sapiens
cctctctacagtctc

SEQ ID NO: 2495250 - DNA, 20 bp, Homo sapiens
cctctgacagcagcatctct

SEQ ID NO: 2495251 - DNA, 16 bp, Homo sapiens
cctctgacctgcactg

SEQ ID NO: 2495252 - DNA, 12 bp, Homo sapiens
cctctgactcag

SEQ ID NO: 2495253 - DNA, 15 bp, Homo sapiens
cctctgagactccag

SEQ ID NO: 2495254 - DNA, 19 bp, Homo sapiens
cctctgcacctttgcacgt

SEQ ID NO: 2495255 - DNA, 21 bp, Homo sapiens
cctctgcactactgacatgtg

SEQ ID NO: 2495256 - DNA, 19 bp, Homo sapiens
cctctgccaaaggatgtga

SEQ ID NO: 2495257 - DNA, 22 bp, Homo sapiens
cctctgctttctcctttaattg

SEQ ID NO: 2495258 - DNA, 17 bp, Homo sapiens
cctctggaggggtgtgg

SEQ ID NO: 2495259 - DNA, 20 bp, Homo sapiens
cctctggaggggtgtggctc

SEQ ID NO: 2495260 - DNA, 20 bp, Homo sapiens
cctctggcttggccacagcc

SEQ ID NO: 2495261 - DNA, 21 bp, Homo sapiens
cctctggcttggccacagcca

SEQ ID NO: 2495262 - DNA, 19 bp, Homo sapiens
cctctggggggtggccagg

SEQ ID NO: 2495263 - DNA, 16 bp, Homo sapiens
cctctggtcgctcctg

SEQ ID NO: 2495264 - DNA, 19 bp, Homo sapiens
cctctggtcgctcctgccc

SEQ ID NO: 2495265 - DNA, 18 bp, Homo sapiens
cctctgtcagtcacagcc

SEQ ID NO: 2495266 - DNA, 23 bp, Homo sapiens
cctctgtctcgagcgccctgcag

SEQ ID NO: 2495267 - DNA, 14 bp, Homo sapiens
cctctgtctggcaa

SEQ ID NO: 2495268 - DNA, 22 bp, Homo sapiens
cctctgtctggcaatgccacag

SEQ ID NO: 2495269 - DNA, 15 bp, Homo sapiens
cctctgtgctgtgtg

SEQ ID NO: 2495270 - DNA, 13 bp, Homo sapiens
cctcttcagaggc

SEQ ID NO: 2495271 - DNA, 21 bp, Homo sapiens
cctcttccccagacgcctggc

SEQ ID NO: 2495272 - DNA, 15 bp, Homo sapiens
cctcttcctactggt

SEQ ID NO: 2495273 - DNA, 21 bp, Homo sapiens
cctcttcctactggtctctct

SEQ ID NO: 2495274 - DNA, 18 bp, Homo sapiens
cctcttctgggagggcag

SEQ ID NO: 2495275 - DNA, 21 bp, Homo sapiens
cctcttctgggagggcagcag

SEQ ID NO: 2495276 - DNA, 15 bp, Homo sapiens
cctcttgagcagtgg

SEQ ID NO: 2495277 - DNA, 16 bp, Homo sapiens
cctcttgagcagtggc

SEQ ID NO: 2495278 - DNA, 18 bp, Homo sapiens
cctcttggagaagtctca

SEQ ID NO: 2495279 - DNA, 19 bp, Homo sapiens
cctcttggagaagtctcag

SEQ ID NO: 2495280 - DNA, 20 bp, Homo sapiens
cctcttggagaagtctcagc

SEQ ID NO: 2495281 - DNA, 23 bp, Homo sapiens
cctctttcaagcagtcgtgcctg

SEQ ID NO: 2495282 - DNA, 23 bp, Homo sapiens
cctctttttccaacttggctgca

SEQ ID NO: 2495283 - DNA, 15 bp, Homo sapiens
cctgaaagaggctga

SEQ ID NO: 2495284 - DNA, 19 bp, Homo sapiens
cctgaaagaggctgaggcc

SEQ ID NO: 2495285 - DNA, 22 bp, Homo sapiens
cctgaaagaggctgaggcctgg

SEQ ID NO: 2495286 - DNA, 17 bp, Homo sapiens
cctgaaccccagggctg

SEQ ID NO: 2495287 - DNA, 17 bp, Homo sapiens
cctgaactgaacaccat

SEQ ID NO: 2495288 - DNA, 23 bp, Homo sapiens
cctgaaggcctgaggttactgga

SEQ ID NO: 2495289 - DNA, 15 bp, Homo sapiens
cctgaattctttttc

SEQ ID NO: 2495290 - DNA, 19 bp, Homo sapiens
cctgacaaccactggtctg

SEQ ID NO: 2495291 - DNA, 20 bp, Homo sapiens
cctgacacactaaccaagct

SEQ ID NO: 2495292 - DNA, 13 bp, Homo sapiens
cctgacacccttc

SEQ ID NO: 2495293 - DNA, 18 bp, Homo sapiens
cctgacacccttctccca

SEQ ID NO: 2495294 - DNA, 12 bp, Homo sapiens
cctgacactgca

SEQ ID NO: 2495295 - DNA, 15 bp, Homo sapiens
cctgacactgctgga

SEQ ID NO: 2495296 - DNA, 22 bp, Homo sapiens
cctgacaggtgaggtctgttcc

SEQ ID NO: 2495297 - DNA, 23 bp, Homo sapiens
cctgacaggtgaggtctgttcct

SEQ ID NO: 2495298 - DNA, 19 bp, Homo sapiens
cctgacatcaaaaaaggca

SEQ ID NO: 2495299 - DNA, 15 bp, Homo sapiens
cctgaccagctgctc

SEQ ID NO: 2495300 - DNA, 13 bp, Homo sapiens
cctgacctcaggc

SEQ ID NO: 2495301 - DNA, 14 bp, Homo sapiens
cctgacctgtgagc

SEQ ID NO: 2495302 - DNA, 13 bp, Homo sapiens
cctgactcattct

SEQ ID NO: 2495303 - DNA, 18 bp, Homo sapiens
cctgagatgggcttccca

SEQ ID NO: 2495304 - DNA, 21 bp, Homo sapiens
cctgagatgggcttcccaagg

SEQ ID NO: 2495305 - DNA, 13 bp, Homo sapiens
cctgagcaactct

SEQ ID NO: 2495306 - DNA, 14 bp, Homo sapiens
cctgagcaactctt

SEQ ID NO: 2495307 - DNA, 15 bp, Homo sapiens
cctgagcaactcttg

SEQ ID NO: 2495308 - DNA, 12 bp, Homo sapiens
cctgagcactgc

SEQ ID NO: 2495309 - DNA, 17 bp, Homo sapiens
cctgagcactgccagga

SEQ ID NO: 2495310 - DNA, 21 bp, Homo sapiens
cctgagccagggtctccagaa

SEQ ID NO: 2495311 - DNA, 17 bp, Homo sapiens
cctgagcccagggaggc

SEQ ID NO: 2495312 - DNA, 18 bp, Homo sapiens
cctgagcccagggaggcc

SEQ ID NO: 2495313 - DNA, 19 bp, Homo sapiens
cctgagcccagggaggccg

SEQ ID NO: 2495314 - DNA, 17 bp, Homo sapiens
cctgagccccagggaga

SEQ ID NO: 2495315 - DNA, 21 bp, Homo sapiens
cctgagccccagggagagggg

SEQ ID NO: 2495316 - DNA, 12 bp, Homo sapiens
cctgagcctgcc

SEQ ID NO: 2495317 - DNA, 13 bp, Homo sapiens
cctgagcctgccg

SEQ ID NO: 2495318 - DNA, 17 bp, Homo sapiens
cctgagcctgccgagca

SEQ ID NO: 2495319 - DNA, 21 bp, Homo sapiens
cctgagcctgccgagcaaccg

SEQ ID NO: 2495320 - DNA, 23 bp, Homo sapiens
cctgagcctgccgagcaaccgtg

SEQ ID NO: 2495321 - DNA, 23 bp, Homo sapiens
cctgagcgagtggagtctgccac

SEQ ID NO: 2495322 - DNA, 15 bp, Homo sapiens
cctgagctgaggcag

SEQ ID NO: 2495323 - DNA, 13 bp, Homo sapiens
cctgaggaactgt

SEQ ID NO: 2495324 - DNA, 19 bp, Homo sapiens
cctgaggacagatgcctcc

SEQ ID NO: 2495325 - DNA, 23 bp, Homo sapiens
cctgaggactgatttcagagtga

SEQ ID NO: 2495326 - DNA, 19 bp, Homo sapiens
cctgaggagtctgaggtcc

SEQ ID NO: 2495327 - DNA, 21 bp, Homo sapiens
cctgaggagtctgaggtcctg

SEQ ID NO: 2495328 - DNA, 16 bp, Homo sapiens
cctgaggctgtggtca

SEQ ID NO: 2495329 - DNA, 17 bp, Homo sapiens
cctgaggctgtggtcac

SEQ ID NO: 2495330 - DNA, 19 bp, Homo sapiens
cctgagggaaaggccagca

SEQ ID NO: 2495331 - DNA, 13 bp, Homo sapiens
cctgagggtctgt

SEQ ID NO: 2495332 - DNA, 22 bp, Homo sapiens
cctgaggtcaggagttcaagac

SEQ ID NO: 2495333 - DNA, 18 bp, Homo sapiens
cctgagtactccacactg

SEQ ID NO: 2495334 - DNA, 14 bp, Homo sapiens
cctgagtggtgcca

SEQ ID NO: 2495335 - DNA, 16 bp, Homo sapiens
cctgagtggtgccaaa

SEQ ID NO: 2495336 - DNA, 19 bp, Homo sapiens
cctgatcagaccacggctc

SEQ ID NO: 2495337 - DNA, 13 bp, Homo sapiens
cctgatcagagcc

SEQ ID NO: 2495338 - DNA, 19 bp, Homo sapiens
cctgatcctggaggcccag

SEQ ID NO: 2495339 - DNA, 13 bp, Homo sapiens
cctgatgctgaca

SEQ ID NO: 2495340 - DNA, 18 bp, Homo sapiens
cctgatttaggagaagcc

SEQ ID NO: 2495341 - DNA, 22 bp, Homo sapiens
cctgatttaggagaagccagga

SEQ ID NO: 2495342 - DNA, 17 bp, Homo sapiens
cctgcaaaaggactctc

SEQ ID NO: 2495343 - DNA, 16 bp, Homo sapiens
cctgcaaactgggaac

SEQ ID NO: 2495344 - DNA, 20 bp, Homo sapiens
cctgcaaactgggaacccct

SEQ ID NO: 2495345 - DNA, 17 bp, Homo sapiens
cctgcaactcaaggact

SEQ ID NO: 2495346 - DNA, 15 bp, Homo sapiens
cctgcacagtgactt

SEQ ID NO: 2495347 - DNA, 19 bp, Homo sapiens
cctgcaccatgctgctggg

SEQ ID NO: 2495348 - DNA, 12 bp, Homo sapiens
cctgcactgtaa

SEQ ID NO: 2495349 - DNA, 21 bp, Homo sapiens
cctgcagaaccggagagccag

SEQ ID NO: 2495350 - DNA, 22 bp, Homo sapiens
cctgcagaaccggagagccagc

SEQ ID NO: 2495351 - DNA, 23 bp, Homo sapiens
cctgcagaaccggagagccagct

SEQ ID NO: 2495352 - DNA, 13 bp, Homo sapiens
cctgcagaccctg

SEQ ID NO: 2495353 - DNA, 12 bp, Homo sapiens
cctgcagcttgt

SEQ ID NO: 2495354 - DNA, 17 bp, Homo sapiens
cctgcagcttgtagcca

SEQ ID NO: 2495355 - DNA, 21 bp, Homo sapiens
cctgcagcttgtagccagccg

SEQ ID NO: 2495356 - DNA, 14 bp, Homo sapiens
cctgcaggaaggag

SEQ ID NO: 2495357 - DNA, 23 bp, Homo sapiens
cctgcaggaaggagctgcctgga

SEQ ID NO: 2495358 - DNA, 16 bp, Homo sapiens
cctgcagggcctctgt

SEQ ID NO: 2495359 - DNA, 17 bp, Homo sapiens
cctgcagggcctctgtc

SEQ ID NO: 2495360 - DNA, 23 bp, Homo sapiens
cctgcaggggagcacggagccgc

SEQ ID NO: 2495361 - DNA, 22 bp, Homo sapiens
cctgcatccattctcctgagga

SEQ ID NO: 2495362 - DNA, 18 bp, Homo sapiens
cctgcatggcatcctcca

SEQ ID NO: 2495363 - DNA, 18 bp, Homo sapiens
cctgcattggaactggag

SEQ ID NO: 2495364 - DNA, 19 bp, Homo sapiens
cctgcattggaactggagg

SEQ ID NO: 2495365 - DNA, 21 bp, Homo sapiens
cctgcattggaactggaggca

SEQ ID NO: 2495366 - DNA, 12 bp, Homo sapiens
cctgccacagcc

SEQ ID NO: 2495367 - DNA, 15 bp, Homo sapiens
cctgccaccaggcca

SEQ ID NO: 2495368 - DNA, 17 bp, Homo sapiens
cctgccacccagcccca

SEQ ID NO: 2495369 - DNA, 18 bp, Homo sapiens
cctgccacccagccccag

SEQ ID NO: 2495370 - DNA, 13 bp, Homo sapiens
cctgccacctgga

SEQ ID NO: 2495371 - DNA, 16 bp, Homo sapiens
cctgccacctggaccc

SEQ ID NO: 2495372 - DNA, 13 bp, Homo sapiens
cctgccactcact

SEQ ID NO: 2495373 - DNA, 15 bp, Homo sapiens
cctgccactcactag

SEQ ID NO: 2495374 - DNA, 16 bp, Homo sapiens
cctgccactcactagg

SEQ ID NO: 2495375 - DNA, 18 bp, Homo sapiens
cctgccactcactaggcc

SEQ ID NO: 2495376 - DNA, 12 bp, Homo sapiens
cctgccactgtg

SEQ ID NO: 2495377 - DNA, 11 bp, Homo sapiens
cctgccagcag

SEQ ID NO: 2495378 - DNA, 17 bp, Homo sapiens
cctgccagctgcactga

SEQ ID NO: 2495379 - DNA, 23 bp, Homo sapiens
cctgccagctgcactgatgctgc

SEQ ID NO: 2495380 - DNA, 15 bp, Homo sapiens
cctgccaggaggacc

SEQ ID NO: 2495381 - DNA, 19 bp, Homo sapiens
cctgccaggaggacccagg

SEQ ID NO: 2495382 - DNA, 17 bp, Homo sapiens
cctgccagggcagggcc

SEQ ID NO: 2495383 - DNA, 14 bp, Homo sapiens
cctgccccaactcc

SEQ ID NO: 2495384 - DNA, 15 bp, Homo sapiens
cctgccccaactcct

SEQ ID NO: 2495385 - DNA, 22 bp, Homo sapiens
cctgccccaactccttccagct

SEQ ID NO: 2495386 - DNA, 21 bp, Homo sapiens
cctgcccccaaggaggcagcc

SEQ ID NO: 2495387 - DNA, 17 bp, Homo sapiens
cctgccccccagcctct

SEQ ID NO: 2495388 - DNA, 16 bp, Homo sapiens
cctgccccctgcagga

SEQ ID NO: 2495389 - DNA, 22 bp, Homo sapiens
cctgcccctcctctccctcatc

SEQ ID NO: 2495390 - DNA, 14 bp, Homo sapiens
cctgcctctcccag

SEQ ID NO: 2495391 - DNA, 12 bp, Homo sapiens
cctgcctggagg

SEQ ID NO: 2495392 - DNA, 13 bp, Homo sapiens
cctgcctggagga

SEQ ID NO: 2495393 - DNA, 20 bp, Homo sapiens
cctgcctggaggacctgagc

SEQ ID NO: 2495394 - DNA, 23 bp, Homo sapiens
cctgcctggaggacctgagcctg

SEQ ID NO: 2495395 - DNA, 24 bp, Homo sapiens
cctgcctggaggacctgagcctgc

SEQ ID NO: 2495396 - DNA, 12 bp, Homo sapiens
cctgcctgtggc

SEQ ID NO: 2495397 - DNA, 14 bp, Homo sapiens
cctgcctgtggcca

SEQ ID NO: 2495398 - DNA, 16 bp, Homo sapiens
cctgccttatcttgca

SEQ ID NO: 2495399 - DNA, 20 bp, Homo sapiens
cctgcgccaccgcccagaga

SEQ ID NO: 2495400 - DNA, 23 bp, Homo sapiens
cctgcgggtgaacaaagcagcca

SEQ ID NO: 2495401 - DNA, 24 bp, Homo sapiens
cctgcgggtggggcttggggctca

SEQ ID NO: 2495402 - DNA, 23 bp, Homo sapiens
cctgcggtagatgggagggaggc

SEQ ID NO: 2495403 - DNA, 20 bp, Homo sapiens
cctgctacacctattatccc

SEQ ID NO: 2495404 - DNA, 15 bp, Homo sapiens
cctgctaggccagag

SEQ ID NO: 2495405 - DNA, 16 bp, Homo sapiens
cctgctaggccagagc

SEQ ID NO: 2495406 - DNA, 19 bp, Homo sapiens
cctgctcacgtcaaatgca

SEQ ID NO: 2495407 - DNA, 20 bp, Homo sapiens
cctgctcagccctgcaccat

SEQ ID NO: 2495408 - DNA, 15 bp, Homo sapiens
cctgctccagacctg

SEQ ID NO: 2495409 - DNA, 18 bp, Homo sapiens
cctgctcgtccccaagtg

SEQ ID NO: 2495410 - DNA, 12 bp, Homo sapiens
cctgctctcctc

SEQ ID NO: 2495411 - DNA, 15 bp, Homo sapiens
cctgctctcctcttc

SEQ ID NO: 2495412 - DNA, 16 bp, Homo sapiens
cctgctctcctcttct

SEQ ID NO: 2495413 - DNA, 14 bp, Homo sapiens
cctgctgacctgtg

SEQ ID NO: 2495414 - DNA, 18 bp, Homo sapiens
cctgctgacctgtgcaca

SEQ ID NO: 2495415 - DNA, 11 bp, Homo sapiens
cctgctgagct

SEQ ID NO: 2495416 - DNA, 21 bp, Homo sapiens
cctgctgagctctgagaggcc

SEQ ID NO: 2495417 - DNA, 22 bp, Homo sapiens
cctgctgagctctgagaggccc

SEQ ID NO: 2495418 - DNA, 12 bp, Homo sapiens
cctgctgctccc

SEQ ID NO: 2495419 - DNA, 17 bp, Homo sapiens
cctgctgctccctcaga

SEQ ID NO: 2495420 - DNA, 15 bp, Homo sapiens
cctgctgctgagaac

SEQ ID NO: 2495421 - DNA, 19 bp, Homo sapiens
cctgctgctgtctgggtgc

SEQ ID NO: 2495422 - DNA, 23 bp, Homo sapiens
cctgctgctgtctgggtgctact

SEQ ID NO: 2495423 - DNA, 15 bp, Homo sapiens
cctgcttcctgcttg

SEQ ID NO: 2495424 - DNA, 16 bp, Homo sapiens
cctggaacttggggag

SEQ ID NO: 2495425 - DNA, 14 bp, Homo sapiens
cctggacagctgtg

SEQ ID NO: 2495426 - DNA, 15 bp, Homo sapiens
cctggacagctgtgc

SEQ ID NO: 2495427 - DNA, 23 bp, Homo sapiens
cctggacatgaagattctttccc

SEQ ID NO: 2495428 - DNA, 24 bp, Homo sapiens
cctggacatgaagattctttccca

SEQ ID NO: 2495429 - DNA, 14 bp, Homo sapiens
cctggacccctgca

SEQ ID NO: 2495430 - DNA, 15 bp, Homo sapiens
cctggacccctgcat

SEQ ID NO: 2495431 - DNA, 15 bp, Homo sapiens
cctggacctctgaca

SEQ ID NO: 2495432 - DNA, 18 bp, Homo sapiens
cctggacctctgacagca

SEQ ID NO: 2495433 - DNA, 19 bp, Homo sapiens
cctggacctctgacagcag

SEQ ID NO: 2495434 - DNA, 20 bp, Homo sapiens
cctggacctctgacagcagc

SEQ ID NO: 2495435 - DNA, 18 bp, Homo sapiens
cctggagactgcccagct

SEQ ID NO: 2495436 - DNA, 18 bp, Homo sapiens
cctggagatcctcctgca

SEQ ID NO: 2495437 - DNA, 14 bp, Homo sapiens
cctggaggacctga

SEQ ID NO: 2495438 - DNA, 15 bp, Homo sapiens
cctggaggacctgag

SEQ ID NO: 2495439 - DNA, 17 bp, Homo sapiens
cctggaggacctgagcc

SEQ ID NO: 2495440 - DNA, 20 bp, Homo sapiens
cctggaggacctgagcctgc

SEQ ID NO: 2495441 - DNA, 22 bp, Homo sapiens
cctggaggcactgaagtgctta

SEQ ID NO: 2495442 - DNA, 13 bp, Homo sapiens
cctggaggcccag

SEQ ID NO: 2495443 - DNA, 22 bp, Homo sapiens
cctggagggggaatggcagcag

SEQ ID NO: 2495444 - DNA, 14 bp, Homo sapiens
cctggatgatacta

SEQ ID NO: 2495445 - DNA, 12 bp, Homo sapiens
cctggcagctct

SEQ ID NO: 2495446 - DNA, 14 bp, Homo sapiens
cctggcagctctgg

SEQ ID NO: 2495447 - DNA, 19 bp, Homo sapiens
cctggcagctctggacagc

SEQ ID NO: 2495448 - DNA, 23 bp, Homo sapiens
cctggcagctctggacagcccca

SEQ ID NO: 2495449 - DNA, 21 bp, Homo sapiens
cctggcagtccgtgggacggg

SEQ ID NO: 2495450 - DNA, 19 bp, Homo sapiens
cctggcatgtcaacagcgt

SEQ ID NO: 2495451 - DNA, 12 bp, Homo sapiens
cctggccagtgc

SEQ ID NO: 2495452 - DNA, 15 bp, Homo sapiens
cctggcccatcaggg

SEQ ID NO: 2495453 - DNA, 12 bp, Homo sapiens
cctggccccctc

SEQ ID NO: 2495454 - DNA, 13 bp, Homo sapiens
cctggcccctctc

SEQ ID NO: 2495455 - DNA, 13 bp, Homo sapiens
cctggccctgctt

SEQ ID NO: 2495456 - DNA, 17 bp, Homo sapiens
cctggccctgcttcctg

SEQ ID NO: 2495457 - DNA, 12 bp, Homo sapiens
cctggccgcccc

SEQ ID NO: 2495458 - DNA, 14 bp, Homo sapiens
cctggccgccccct

SEQ ID NO: 2495459 - DNA, 15 bp, Homo sapiens
cctggccgccccctg

SEQ ID NO: 2495460 - DNA, 20 bp, Homo sapiens
cctggccgccccctgccccc

SEQ ID NO: 2495461 - DNA, 21 bp, Homo sapiens
cctggccgccccctgcccccc

SEQ ID NO: 2495462 - DNA, 22 bp, Homo sapiens
cctggccgccccctgcccccca

SEQ ID NO: 2495463 - DNA, 17 bp, Homo sapiens
cctggcctcccccactt

SEQ ID NO: 2495464 - DNA, 20 bp, Homo sapiens
cctggcctcccctgccacca

SEQ ID NO: 2495465 - DNA, 16 bp, Homo sapiens
cctggcctcctgcctc

SEQ ID NO: 2495466 - DNA, 17 bp, Homo sapiens
cctggctctcacctcta

SEQ ID NO: 2495467 - DNA, 22 bp, Homo sapiens
cctggctgctgatcgccttccc

SEQ ID NO: 2495468 - DNA, 23 bp, Homo sapiens
cctggctgctgatcgccttcccc

SEQ ID NO: 2495469 - DNA, 19 bp, Homo sapiens
cctggctggctgagggcag

SEQ ID NO: 2495470 - DNA, 15 bp, Homo sapiens
cctggcttcccatcc

SEQ ID NO: 2495471 - DNA, 19 bp, Homo sapiens
cctggcttcccatccccag

SEQ ID NO: 2495472 - DNA, 17 bp, Homo sapiens
cctgggaaatattccct

SEQ ID NO: 2495473 - DNA, 23 bp, Homo sapiens
cctgggacaactgctcccacctc

SEQ ID NO: 2495474 - DNA, 16 bp, Homo sapiens
cctgggattcaggaaa

SEQ ID NO: 2495475 - DNA, 18 bp, Homo sapiens
cctgggattcaggaaaag

SEQ ID NO: 2495476 - DNA, 13 bp, Homo sapiens
cctgggcaaagcc

SEQ ID NO: 2495477 - DNA, 16 bp, Homo sapiens
cctgggccctgggctg

SEQ ID NO: 2495478 - DNA, 18 bp, Homo sapiens
cctgggccctgggctgga

SEQ ID NO: 2495479 - DNA, 19 bp, Homo sapiens
cctgggccctgggctggaa

SEQ ID NO: 2495480 - DNA, 18 bp, Homo sapiens
cctgggccctggggcctg

SEQ ID NO: 2495481 - DNA, 17 bp, Homo sapiens
cctgggcctatggagag

SEQ ID NO: 2495482 - DNA, 18 bp, Homo sapiens
cctgggcctatggagagc

SEQ ID NO: 2495483 - DNA, 22 bp, Homo sapiens
cctgggcctatggagagccctg

SEQ ID NO: 2495484 - DNA, 15 bp, Homo sapiens
cctgggcctgcctca

SEQ ID NO: 2495485 - DNA, 15 bp, Homo sapiens
cctgggcctgctgct

SEQ ID NO: 2495486 - DNA, 18 bp, Homo sapiens
cctgggcctgctgctgag

SEQ ID NO: 2495487 - DNA, 19 bp, Homo sapiens
cctgggcctgctgctgaga

SEQ ID NO: 2495488 - DNA, 18 bp, Homo sapiens
cctgggccttgggctccg

SEQ ID NO: 2495489 - DNA, 16 bp, Homo sapiens
cctgggcgctggtcct

SEQ ID NO: 2495490 - DNA, 15 bp, Homo sapiens
cctgggctcctggac

SEQ ID NO: 2495491 - DNA, 16 bp, Homo sapiens
cctgggctcctggacc

SEQ ID NO: 2495492 - DNA, 14 bp, Homo sapiens
cctgggctgggaaa

SEQ ID NO: 2495493 - DNA, 20 bp, Homo sapiens
cctggggcctgtactgcctg

SEQ ID NO: 2495494 - DNA, 22 bp, Homo sapiens
cctggggcctgtactgcctgct

SEQ ID NO: 2495495 - DNA, 20 bp, Homo sapiens
cctggggctctaacgcctga

SEQ ID NO: 2495496 - DNA, 12 bp, Homo sapiens
cctgggggcctg

SEQ ID NO: 2495497 - DNA, 14 bp, Homo sapiens
cctgggggcctggc

SEQ ID NO: 2495498 - DNA, 23 bp, Homo sapiens
cctgggggcctggctggctgagg

SEQ ID NO: 2495499 - DNA, 14 bp, Homo sapiens
cctgggggtgccag

SEQ ID NO: 2495500 - DNA, 22 bp, Homo sapiens
cctggggtataaaactttcctc

SEQ ID NO: 2495501 - DNA, 15 bp, Homo sapiens
cctggggtgacccgg

SEQ ID NO: 2495502 - DNA, 18 bp, Homo sapiens
cctggggtgacccggcac

SEQ ID NO: 2495503 - DNA, 18 bp, Homo sapiens
cctgggtagcgggggagg

SEQ ID NO: 2495504 - DNA, 14 bp, Homo sapiens
cctgggtggctact

SEQ ID NO: 2495505 - DNA, 17 bp, Homo sapiens
cctgggtggctactctg

SEQ ID NO: 2495506 - DNA, 20 bp, Homo sapiens
cctgggtggctactctgtgc

SEQ ID NO: 2495507 - DNA, 21 bp, Homo sapiens
cctgggtggctactctgtgcc

SEQ ID NO: 2495508 - DNA, 16 bp, Homo sapiens
cctgggttgcagacag

SEQ ID NO: 2495509 - DNA, 21 bp, Homo sapiens
cctgggttttgtattctctga

SEQ ID NO: 2495510 - DNA, 22 bp, Homo sapiens
cctgggttttgtattctctgag

SEQ ID NO: 2495511 - DNA, 18 bp, Homo sapiens
cctggtaatagctgtaaa

SEQ ID NO: 2495512 - DNA, 20 bp, Homo sapiens
cctggtagaccactgccata

SEQ ID NO: 2495513 - DNA, 15 bp, Homo sapiens
cctggtcacctagga

SEQ ID NO: 2495514 - DNA, 21 bp, Homo sapiens
cctggtcacctaggaagcctc

SEQ ID NO: 2495515 - DNA, 17 bp, Homo sapiens
cctggtctcaccctgga

SEQ ID NO: 2495516 - DNA, 19 bp, Homo sapiens
cctggtctcaccctggagg

SEQ ID NO: 2495517 - DNA, 13 bp, Homo sapiens
cctggtgctggag

SEQ ID NO: 2495518 - DNA, 16 bp, Homo sapiens
cctggtggccatgctc

SEQ ID NO: 2495519 - DNA, 18 bp, Homo sapiens
cctggtggccatgctcct

SEQ ID NO: 2495520 - DNA, 18 bp, Homo sapiens
cctggtggccctctcccc

SEQ ID NO: 2495521 - DNA, 21 bp, Homo sapiens
cctggtggccctctcccctgc

SEQ ID NO: 2495522 - DNA, 23 bp, Homo sapiens
cctggtgggccaacaaagaacac

SEQ ID NO: 2495523 - DNA, 15 bp, Homo sapiens
cctggtggggcagct

SEQ ID NO: 2495524 - DNA, 16 bp, Homo sapiens
cctggtggggcagctc

SEQ ID NO: 2495525 - DNA, 16 bp, Homo sapiens
cctggtggtattttca

SEQ ID NO: 2495526 - DNA, 20 bp, Homo sapiens
cctggttaaataaggcaggg

SEQ ID NO: 2495527 - DNA, 12 bp, Homo sapiens
cctgtaaacttt

SEQ ID NO: 2495528 - DNA, 19 bp, Homo sapiens
cctgtaacatactggcctg

SEQ ID NO: 2495529 - DNA, 16 bp, Homo sapiens
cctgtaacctcttcag

SEQ ID NO: 2495530 - DNA, 17 bp, Homo sapiens
cctgtacacaactcact

SEQ ID NO: 2495531 - DNA, 14 bp, Homo sapiens
cctgtacagtagat

SEQ ID NO: 2495532 - DNA, 20 bp, Homo sapiens
cctgtacagtagattttcca

SEQ ID NO: 2495533 - DNA, 13 bp, Homo sapiens
cctgtactgcctg

SEQ ID NO: 2495534 - DNA, 18 bp, Homo sapiens
cctgtactgttctgtgtc

SEQ ID NO: 2495535 - DNA, 20 bp, Homo sapiens
cctgtactgttctgtgtctt

SEQ ID NO: 2495536 - DNA, 13 bp, Homo sapiens
cctgtagagttgc

SEQ ID NO: 2495537 - DNA, 14 bp, Homo sapiens
cctgtagagttgct

SEQ ID NO: 2495538 - DNA, 17 bp, Homo sapiens
cctgtagagttgctgag

SEQ ID NO: 2495539 - DNA, 16 bp, Homo sapiens
cctgtattcagacaga

SEQ ID NO: 2495540 - DNA, 12 bp, Homo sapiens
cctgtcagcatg

SEQ ID NO: 2495541 - DNA, 13 bp, Homo sapiens
cctgtcagcatga

SEQ ID NO: 2495542 - DNA, 15 bp, Homo sapiens
cctgtccagctccaa

SEQ ID NO: 2495543 - DNA, 15 bp, Homo sapiens
cctgtcccaccccca

SEQ ID NO: 2495544 - DNA, 17 bp, Homo sapiens
cctgtcccacccccacc

SEQ ID NO: 2495545 - DNA, 17 bp, Homo sapiens
cctgtcctctttcagct

SEQ ID NO: 2495546 - DNA, 19 bp, Homo sapiens
cctgtcctctttcagctcc

SEQ ID NO: 2495547 - DNA, 22 bp, Homo sapiens
cctgtcctctttcagctcctga

SEQ ID NO: 2495548 - DNA, 11 bp, Homo sapiens
cctgtcctgcc

SEQ ID NO: 2495549 - DNA, 12 bp, Homo sapiens
cctgtcctgcct

SEQ ID NO: 2495550 - DNA, 19 bp, Homo sapiens
cctgtctctcagggccagg

SEQ ID NO: 2495551 - DNA, 22 bp, Homo sapiens
cctgtcttatcctccaccgtct

SEQ ID NO: 2495552 - DNA, 15 bp, Homo sapiens
cctgtgagcccagct

SEQ ID NO: 2495553 - DNA, 17 bp, Homo sapiens
cctgtgagcccagctgg

SEQ ID NO: 2495554 - DNA, 18 bp, Homo sapiens
cctgtgcacaccccactc

SEQ ID NO: 2495555 - DNA, 18 bp, Homo sapiens
cctgtgcagccgctgagc

SEQ ID NO: 2495556 - DNA, 16 bp, Homo sapiens
cctgtgcctcctccct

SEQ ID NO: 2495557 - DNA, 16 bp, Homo sapiens
cctgtgctcagccctg

SEQ ID NO: 2495558 - DNA, 12 bp, Homo sapiens
cctgtggatatt

SEQ ID NO: 2495559 - DNA, 17 bp, Homo sapiens
cctgtggccatgaccct

SEQ ID NO: 2495560 - DNA, 22 bp, Homo sapiens
cctgtggccatgaccctgcctc

SEQ ID NO: 2495561 - DNA, 17 bp, Homo sapiens
cctgtggccccaccctg

SEQ ID NO: 2495562 - DNA, 15 bp, Homo sapiens
cctgtgtagctgtga

SEQ ID NO: 2495563 - DNA, 23 bp, Homo sapiens
cctgtgtagctgtgacctgctga

SEQ ID NO: 2495564 - DNA, 14 bp, Homo sapiens
cctgtgtggacagg

SEQ ID NO: 2495565 - DNA, 15 bp, Homo sapiens
cctgtgtggagaggg

SEQ ID NO: 2495566 - DNA, 16 bp, Homo sapiens
cctgtgtggagaggga

SEQ ID NO: 2495567 - DNA, 21 bp, Homo sapiens
cctgtgtggagagggaatgtg

SEQ ID NO: 2495568 - DNA, 21 bp, Homo sapiens
cctgtgtgtccaaaactgcct

SEQ ID NO: 2495569 - DNA, 16 bp, Homo sapiens
cctgtgttgtctctag

SEQ ID NO: 2495570 - DNA, 20 bp, Homo sapiens
cctgtgttgtctctagagca

SEQ ID NO: 2495571 - DNA, 14 bp, Homo sapiens
cctgtgtttcttgc

SEQ ID NO: 2495572 - DNA, 18 bp, Homo sapiens
cctgtgtttcttgcctca

SEQ ID NO: 2495573 - DNA, 14 bp, Homo sapiens
cctgttcacaccag

SEQ ID NO: 2495574 - DNA, 13 bp, Homo sapiens
cctgttccccaga

SEQ ID NO: 2495575 - DNA, 23 bp, Homo sapiens
cctgttccccagagaaaggggag

SEQ ID NO: 2495576 - DNA, 12 bp, Homo sapiens
cctgttgggaga

SEQ ID NO: 2495577 - DNA, 14 bp, Homo sapiens
cctgtttaaaaaac

SEQ ID NO: 2495578 - DNA, 19 bp, Homo sapiens
cctgtttgaggaaagcaag

SEQ ID NO: 2495579 - DNA, 21 bp, Homo sapiens
cctgtttggcctctctatcct

SEQ ID NO: 2495580 - DNA, 17 bp, Homo sapiens
ccttaacagttgtattt

SEQ ID NO: 2495581 - DNA, 21 bp, Homo sapiens
ccttacagtaggagcccagct

SEQ ID NO: 2495582 - DNA, 17 bp, Homo sapiens
ccttaccctccttggga

SEQ ID NO: 2495583 - DNA, 16 bp, Homo sapiens
ccttactcccaggcac

SEQ ID NO: 2495584 - DNA, 15 bp, Homo sapiens
ccttagacagaggcc

SEQ ID NO: 2495585 - DNA, 17 bp, Homo sapiens
ccttagacagaggccct

SEQ ID NO: 2495586 - DNA, 17 bp, Homo sapiens
ccttagactcttttcct

SEQ ID NO: 2495587 - DNA, 13 bp, Homo sapiens
ccttagcctggac

SEQ ID NO: 2495588 - DNA, 23 bp, Homo sapiens
ccttaggaagagccttccaccca

SEQ ID NO: 2495589 - DNA, 20 bp, Homo sapiens
ccttagtctcagtttgtgtg

SEQ ID NO: 2495590 - DNA, 13 bp, Homo sapiens
ccttatcctccct

SEQ ID NO: 2495591 - DNA, 17 bp, Homo sapiens
ccttatcctccctgtaa

SEQ ID NO: 2495592 - DNA, 13 bp, Homo sapiens
ccttcaagctctg

SEQ ID NO: 2495593 - DNA, 19 bp, Homo sapiens
ccttcagagagcagtgctt

SEQ ID NO: 2495594 - DNA, 17 bp, Homo sapiens
ccttccaatgtctggag

SEQ ID NO: 2495595 - DNA, 23 bp, Homo sapiens
ccttccagctagtgacccacatg

SEQ ID NO: 2495596 - DNA, 12 bp, Homo sapiens
ccttccagctcc

SEQ ID NO: 2495597 - DNA, 23 bp, Homo sapiens
ccttccatggtgtgatcgtctga

SEQ ID NO: 2495598 - DNA, 10 bp, Homo sapiens
ccttcccaaa

SEQ ID NO: 2495599 - DNA, 12 bp, Homo sapiens
ccttcccagagg

SEQ ID NO: 2495600 - DNA, 22 bp, Homo sapiens
ccttcccagaggggcctgccac

SEQ ID NO: 2495601 - DNA, 16 bp, Homo sapiens
ccttcccatggaggga

SEQ ID NO: 2495602 - DNA, 21 bp, Homo sapiens
ccttccccttatcctccctgt

SEQ ID NO: 2495603 - DNA, 14 bp, Homo sapiens
ccttccctctctgg

SEQ ID NO: 2495604 - DNA, 15 bp, Homo sapiens
ccttccctctctgga

SEQ ID NO: 2495605 - DNA, 17 bp, Homo sapiens
ccttcctcatccacccc

SEQ ID NO: 2495606 - DNA, 18 bp, Homo sapiens
ccttcctggacagctgtg

SEQ ID NO: 2495607 - DNA, 20 bp, Homo sapiens
ccttcctggagactgcccag

SEQ ID NO: 2495608 - DNA, 23 bp, Homo sapiens
ccttcgcttcttgcctctgtgct

SEQ ID NO: 2495609 - DNA, 16 bp, Homo sapiens
ccttcgggctgtgccc

SEQ ID NO: 2495610 - DNA, 16 bp, Homo sapiens
ccttctatttggggct

SEQ ID NO: 2495611 - DNA, 22 bp, Homo sapiens
ccttctccatccacatgggagc

SEQ ID NO: 2495612 - DNA, 13 bp, Homo sapiens
ccttctcccactc

SEQ ID NO: 2495613 - DNA, 17 bp, Homo sapiens
ccttctcccactctcct

SEQ ID NO: 2495614 - DNA, 18 bp, Homo sapiens
ccttctcccactctccta

SEQ ID NO: 2495615 - DNA, 13 bp, Homo sapiens
ccttctccccagc

SEQ ID NO: 2495616 - DNA, 20 bp, Homo sapiens
ccttctccccagctcccagg

SEQ ID NO: 2495617 - DNA, 21 bp, Homo sapiens
ccttctccccagctcccagga

SEQ ID NO: 2495618 - DNA, 13 bp, Homo sapiens
ccttctcccctgc

SEQ ID NO: 2495619 - DNA, 16 bp, Homo sapiens
ccttctcccctgcact

SEQ ID NO: 2495620 - DNA, 13 bp, Homo sapiens
ccttgaaggacta

SEQ ID NO: 2495621 - DNA, 17 bp, Homo sapiens
ccttgaggtctcagccc

SEQ ID NO: 2495622 - DNA, 14 bp, Homo sapiens
ccttgagtggggtt

SEQ ID NO: 2495623 - DNA, 22 bp, Homo sapiens
ccttgagtggggttatctctgt

SEQ ID NO: 2495624 - DNA, 20 bp, Homo sapiens
ccttgatcagccccaccctg

SEQ ID NO: 2495625 - DNA, 23 bp, Homo sapiens
ccttgatgattgacaacacccat

SEQ ID NO: 2495626 - DNA, 16 bp, Homo sapiens
ccttgccagagatcca

SEQ ID NO: 2495627 - DNA, 16 bp, Homo sapiens
ccttgcctcaatgcca

SEQ ID NO: 2495628 - DNA, 15 bp, Homo sapiens
ccttgcctggtacag

SEQ ID NO: 2495629 - DNA, 22 bp, Homo sapiens
ccttgctgcaagcacagccctt

SEQ ID NO: 2495630 - DNA, 18 bp, Homo sapiens
ccttggacaacttttctc

SEQ ID NO: 2495631 - DNA, 21 bp, Homo sapiens
ccttggcaccagacacccagg

SEQ ID NO: 2495632 - DNA, 22 bp, Homo sapiens
ccttggcaccagacacccagga

SEQ ID NO: 2495633 - DNA, 23 bp, Homo sapiens
ccttggcaccagacacccaggac

SEQ ID NO: 2495634 - DNA, 16 bp, Homo sapiens
ccttggcctctttcct

SEQ ID NO: 2495635 - DNA, 12 bp, Homo sapiens
ccttggcctgga

SEQ ID NO: 2495636 - DNA, 14 bp, Homo sapiens
ccttggcctggagc

SEQ ID NO: 2495637 - DNA, 22 bp, Homo sapiens
ccttgggcacgtgtgctgggat

SEQ ID NO: 2495638 - DNA, 23 bp, Homo sapiens
ccttgggccagaagtaccagact

SEQ ID NO: 2495639 - DNA, 17 bp, Homo sapiens
ccttgggccctttgagt

SEQ ID NO: 2495640 - DNA, 14 bp, Homo sapiens
ccttgggctctgat

SEQ ID NO: 2495641 - DNA, 16 bp, Homo sapiens
ccttgggctctgatga

SEQ ID NO: 2495642 - DNA, 20 bp, Homo sapiens
ccttgggctctgatgaaaaa

SEQ ID NO: 2495643 - DNA, 11 bp, Homo sapiens
ccttgggggtc

SEQ ID NO: 2495644 - DNA, 22 bp, Homo sapiens
ccttgggttagacctacagggg

SEQ ID NO: 2495645 - DNA, 21 bp, Homo sapiens
ccttggttgtctggcaaggac

SEQ ID NO: 2495646 - DNA, 21 bp, Homo sapiens
ccttggtttttactgctctga

SEQ ID NO: 2495647 - DNA, 16 bp, Homo sapiens
ccttgtaattctaaat

SEQ ID NO: 2495648 - DNA, 20 bp, Homo sapiens
ccttgtatcccctgcaggct

SEQ ID NO: 2495649 - DNA, 20 bp, Homo sapiens
ccttgtgaatcaagggtcag

SEQ ID NO: 2495650 - DNA, 22 bp, Homo sapiens
ccttgtgatgtcatacagagaa

SEQ ID NO: 2495651 - DNA, 20 bp, Homo sapiens
ccttgtgggcctgggctcct

SEQ ID NO: 2495652 - DNA, 18 bp, Homo sapiens
ccttgttacttctgaggt

SEQ ID NO: 2495653 - DNA, 19 bp, Homo sapiens
ccttgttacttctgaggta

SEQ ID NO: 2495654 - DNA, 11 bp, Homo sapiens
ccttgttctgt

SEQ ID NO: 2495655 - DNA, 22 bp, Homo sapiens
cctttaacaacatgtttccagc

SEQ ID NO: 2495656 - DNA, 14 bp, Homo sapiens
cctttactgtgctt

SEQ ID NO: 2495657 - DNA, 13 bp, Homo sapiens
cctttaggttctt

SEQ ID NO: 2495658 - DNA, 22 bp, Homo sapiens
cctttcacaggcagccagtgcc

SEQ ID NO: 2495659 - DNA, 14 bp, Homo sapiens
cctttcaggatcta

SEQ ID NO: 2495660 - DNA, 19 bp, Homo sapiens
cctttccaccacagccagc

SEQ ID NO: 2495661 - DNA, 12 bp, Homo sapiens
cctttcccaccc

SEQ ID NO: 2495662 - DNA, 19 bp, Homo sapiens
cctttcccttgtagctcct

SEQ ID NO: 2495663 - DNA, 14 bp, Homo sapiens
cctttctagagcac

SEQ ID NO: 2495664 - DNA, 18 bp, Homo sapiens
cctttctatcgttctctc

SEQ ID NO: 2495665 - DNA, 12 bp, Homo sapiens
cctttcttttcc

SEQ ID NO: 2495666 - DNA, 19 bp, Homo sapiens
cctttgagtgcagtcctga

SEQ ID NO: 2495667 - DNA, 22 bp, Homo sapiens
cctttgagtgcagtcctgatca

SEQ ID NO: 2495668 - DNA, 17 bp, Homo sapiens
cctttgctgtgaggctg

SEQ ID NO: 2495669 - DNA, 16 bp, Homo sapiens
cctttgtgagtcaata

SEQ ID NO: 2495670 - DNA, 20 bp, Homo sapiens
cctttgtgtgctctccattc

SEQ ID NO: 2495671 - DNA, 12 bp, Homo sapiens
ccttttaaagaa

SEQ ID NO: 2495672 - DNA, 15 bp, Homo sapiens
ccttttattgacaca

SEQ ID NO: 2495673 - DNA, 10 bp, Homo sapiens
ccttttcata

SEQ ID NO: 2495674 - DNA, 18 bp, Homo sapiens
ccttttcataggtctgaa

SEQ ID NO: 2495675 - DNA, 19 bp, Homo sapiens
ccttttcataggtctgaaa

SEQ ID NO: 2495676 - DNA, 12 bp, Homo sapiens
ccttttctgacc

SEQ ID NO: 2495677 - DNA, 15 bp, Homo sapiens
ccttttgacactgct

SEQ ID NO: 2495678 - DNA, 11 bp, Homo sapiens
ccttttgcaaa

SEQ ID NO: 2495679 - DNA, 21 bp, Homo sapiens
cctttttcaatgaattttata

SEQ ID NO: 2495680 - DNA, 17 bp, Homo sapiens
cctttttcctctccaca

SEQ ID NO: 2495681 - DNA, 14 bp, Homo sapiens
cctttttgtataaa

SEQ ID NO: 2495682 - DNA, 19 bp, Homo sapiens
cctttttgtataaaataga

SEQ ID NO: 2495683 - DNA, 15 bp, Homo sapiens
ccttttttctgtata

SEQ ID NO: 2495684 - DNA, 18 bp, Homo sapiens
cgaaagctctagaatctg

SEQ ID NO: 2495685 - DNA, 21 bp, Homo sapiens
cgaaataattgttgttctgtt

SEQ ID NO: 2495686 - DNA, 22 bp, Homo sapiens
cgaaataattgttgttctgtta

SEQ ID NO: 2495687 - DNA, 16 bp, Homo sapiens
cgaatctctgtgcctt

SEQ ID NO: 2495688 - DNA, 14 bp, Homo sapiens
cgaatgtgtcttta

SEQ ID NO: 2495689 - DNA, 21 bp, Homo sapiens
cgacagtggatgctgggtcca

SEQ ID NO: 2495690 - DNA, 14 bp, Homo sapiens
cgactaatttcaaa

SEQ ID NO: 2495691 - DNA, 19 bp, Homo sapiens
cgactcacaccactagcct

SEQ ID NO: 2495692 - DNA, 21 bp, Homo sapiens
cgactcacaccactagcctca

SEQ ID NO: 2495693 - DNA, 17 bp, Homo sapiens
cgactggccagggccac

SEQ ID NO: 2495694 - DNA, 20 bp, Homo sapiens
cgactggccagggccacgct

SEQ ID NO: 2495695 - DNA, 16 bp, Homo sapiens
cgacttgccaaattta

SEQ ID NO: 2495696 - DNA, 13 bp, Homo sapiens
cgactttctgcct

SEQ ID NO: 2495697 - DNA, 14 bp, Homo sapiens
cgactttctgcctg

SEQ ID NO: 2495698 - DNA, 17 bp, Homo sapiens
cgagaaagaggcaccag

SEQ ID NO: 2495699 - DNA, 21 bp, Homo sapiens
cgagaaattcgtgtgtttttt

SEQ ID NO: 2495700 - DNA, 14 bp, Homo sapiens
cgagactttccatt

SEQ ID NO: 2495701 - DNA, 22 bp, Homo sapiens
cgagaggggccgatgcccagag

SEQ ID NO: 2495702 - DNA, 16 bp, Homo sapiens
cgagcaaccgtggccc

SEQ ID NO: 2495703 - DNA, 22 bp, Homo sapiens
cgagcaaccgtggcccttcctg

SEQ ID NO: 2495704 - DNA, 14 bp, Homo sapiens
cgagcagctgagca

SEQ ID NO: 2495705 - DNA, 16 bp, Homo sapiens
cgagcagctgagcagg

SEQ ID NO: 2495706 - DNA, 23 bp, Homo sapiens
cgagcagtcctgcctcagcctcc

SEQ ID NO: 2495707 - DNA, 15 bp, Homo sapiens
cgagcatgtcgtgga

SEQ ID NO: 2495708 - DNA, 15 bp, Homo sapiens
cgaggacccaggaaa

SEQ ID NO: 2495709 - DNA, 22 bp, Homo sapiens
cgaggaggtgtctcaggctgcc

SEQ ID NO: 2495710 - DNA, 12 bp, Homo sapiens
cgaggagtaaca

SEQ ID NO: 2495711 - DNA, 14 bp, Homo sapiens
cgaggagtaacaat

SEQ ID NO: 2495712 - DNA, 13 bp, Homo sapiens
cgaggctgagaat

SEQ ID NO: 2495713 - DNA, 13 bp, Homo sapiens
cgaggtccctgct

SEQ ID NO: 2495714 - DNA, 13 bp, Homo sapiens
cgagtccaagctg

SEQ ID NO: 2495715 - DNA, 15 bp, Homo sapiens
cgagtccaagctggg

SEQ ID NO: 2495716 - DNA, 18 bp, Homo sapiens
cgagtggagtctgccacc

SEQ ID NO: 2495717 - DNA, 19 bp, Homo sapiens
cgatactgcgactttctgc

SEQ ID NO: 2495718 - DNA, 22 bp, Homo sapiens
cgatactgcgactttctgcctg

SEQ ID NO: 2495719 - DNA, 22 bp, Homo sapiens
cgatccacctgtctcagcctcc

SEQ ID NO: 2495720 - DNA, 14 bp, Homo sapiens
cgatctcccacctt

SEQ ID NO: 2495721 - DNA, 17 bp, Homo sapiens
cgatgacacttgtacaa

SEQ ID NO: 2495722 - DNA, 19 bp, Homo sapiens
cgatgtggaactgctgcca

SEQ ID NO: 2495723 - DNA, 17 bp, Homo sapiens
cgatgtggtcacagctg

SEQ ID NO: 2495724 - DNA, 18 bp, Homo sapiens
cgatgtggtcacagctgt

SEQ ID NO: 2495725 - DNA, 17 bp, Homo sapiens
cgattccctctcccagg

SEQ ID NO: 2495726 - DNA, 12 bp, Homo sapiens
cgattgtaactc

SEQ ID NO: 2495727 - DNA, 15 bp, Homo sapiens
cgcacctgcctcagg

SEQ ID NO: 2495728 - DNA, 16 bp, Homo sapiens
cgcacctgcctcagga

SEQ ID NO: 2495729 - DNA, 17 bp, Homo sapiens
cgcagacaccttggaca

SEQ ID NO: 2495730 - DNA, 13 bp, Homo sapiens
cgcagccaccctg

SEQ ID NO: 2495731 - DNA, 17 bp, Homo sapiens
cgcagccaccctgagga

SEQ ID NO: 2495732 - DNA, 22 bp, Homo sapiens
cgcagccaccctgaggagtctg

SEQ ID NO: 2495733 - DNA, 19 bp, Homo sapiens
cgcagtccacttctgacag

SEQ ID NO: 2495734 - DNA, 20 bp, Homo sapiens
cgcagtccacttctgacagc

SEQ ID NO: 2495735 - DNA, 15 bp, Homo sapiens
cgccactggggctca

SEQ ID NO: 2495736 - DNA, 18 bp, Homo sapiens
cgccactggggctcagag

SEQ ID NO: 2495737 - DNA, 19 bp, Homo sapiens
cgccactggggctcagagc

SEQ ID NO: 2495738 - DNA, 21 bp, Homo sapiens
cgccaggctgaccacagcaca

SEQ ID NO: 2495739 - DNA, 23 bp, Homo sapiens
cgccaggctgaccacagcacagc

SEQ ID NO: 2495740 - DNA, 18 bp, Homo sapiens
cgcccaaaggacgcactg

SEQ ID NO: 2495741 - DNA, 22 bp, Homo sapiens
cgcccacaggaagcctgcagtc

SEQ ID NO: 2495742 - DNA, 22 bp, Homo sapiens
cgcccagagacccaagctgcct

SEQ ID NO: 2495743 - DNA, 17 bp, Homo sapiens
cgccccctccgccctgc

SEQ ID NO: 2495744 - DNA, 13 bp, Homo sapiens
cgccccctgtctc

SEQ ID NO: 2495745 - DNA, 18 bp, Homo sapiens
cgccccctgtctctcagg

SEQ ID NO: 2495746 - DNA, 14 bp, Homo sapiens
cgcccgtcctgcct

SEQ ID NO: 2495747 - DNA, 15 bp, Homo sapiens
cgccctgcagaccct

SEQ ID NO: 2495748 - DNA, 16 bp, Homo sapiens
cgccctgcagaccctg

SEQ ID NO: 2495749 - DNA, 21 bp, Homo sapiens
cgccctgcagaccctgccctt

SEQ ID NO: 2495750 - DNA, 14 bp, Homo sapiens
cgccctttcctcct

SEQ ID NO: 2495751 - DNA, 16 bp, Homo sapiens
cgccctttcctcctca

SEQ ID NO: 2495752 - DNA, 17 bp, Homo sapiens
cgccctttcctcctcag

SEQ ID NO: 2495753 - DNA, 12 bp, Homo sapiens
cgccgcctcttt

SEQ ID NO: 2495754 - DNA, 21 bp, Homo sapiens
cgcctcactgcaaccttcacc

SEQ ID NO: 2495755 - DNA, 16 bp, Homo sapiens
cgcctccatccaaggc

SEQ ID NO: 2495756 - DNA, 15 bp, Homo sapiens
cgcctcttgaccagg

SEQ ID NO: 2495757 - DNA, 15 bp, Homo sapiens
cgcctctttcaagca

SEQ ID NO: 2495758 - DNA, 14 bp, Homo sapiens
cgcctgagcccagg

SEQ ID NO: 2495759 - DNA, 16 bp, Homo sapiens
cgcctgagcccaggga

SEQ ID NO: 2495760 - DNA, 19 bp, Homo sapiens
cgcctgagcccagggaggc

SEQ ID NO: 2495761 - DNA, 17 bp, Homo sapiens
cgcctgaggcaattaga

SEQ ID NO: 2495762 - DNA, 16 bp, Homo sapiens
cgccttggcctgtgtt

SEQ ID NO: 2495763 - DNA, 15 bp, Homo sapiens
cgcgactaatttcaa

SEQ ID NO: 2495764 - DNA, 14 bp, Homo sapiens
cgcgatgtggaact

SEQ ID NO: 2495765 - DNA, 18 bp, Homo sapiens
cgcgatgtggaactgctg

SEQ ID NO: 2495766 - DNA, 20 bp, Homo sapiens
cgcgatgtggaactgctgcc

SEQ ID NO: 2495767 - DNA, 21 bp, Homo sapiens
cgcgatgtggaactgctgcca

SEQ ID NO: 2495768 - DNA, 23 bp, Homo sapiens
cgcgatgtggaactgctgccact

SEQ ID NO: 2495769 - DNA, 21 bp, Homo sapiens
cgcggaggaggagggaggcca

SEQ ID NO: 2495770 - DNA, 23 bp, Homo sapiens
cgcggaggaggagggaggccagg

SEQ ID NO: 2495771 - DNA, 14 bp, Homo sapiens
cgcgtcttcctgag

SEQ ID NO: 2495772 - DNA, 16 bp, Homo sapiens
cgcgtcttcctgagtg

SEQ ID NO: 2495773 - DNA, 13 bp, Homo sapiens
cgctaaaagaaac

SEQ ID NO: 2495774 - DNA, 15 bp, Homo sapiens
cgctaaaagaaactt

SEQ ID NO: 2495775 - DNA, 21 bp, Homo sapiens
cgctatctccctgcctcctgc

SEQ ID NO: 2495776 - DNA, 16 bp, Homo sapiens
cgctattccagctgtc

SEQ ID NO: 2495777 - DNA, 23 bp, Homo sapiens
cgctcagctcatccatgcctcag

SEQ ID NO: 2495778 - DNA, 19 bp, Homo sapiens
cgctcagggccatgctgag

SEQ ID NO: 2495779 - DNA, 20 bp, Homo sapiens
cgctcagggccatgctgagg

SEQ ID NO: 2495780 - DNA, 13 bp, Homo sapiens
cgctccagctgcc

SEQ ID NO: 2495781 - DNA, 15 bp, Homo sapiens
cgctccagctgcccc

SEQ ID NO: 2495782 - DNA, 18 bp, Homo sapiens
cgctccagctgccccggc

SEQ ID NO: 2495783 - DNA, 17 bp, Homo sapiens
cgctccccactctgctc

SEQ ID NO: 2495784 - DNA, 19 bp, Homo sapiens
cgctccccactctgctctg

SEQ ID NO: 2495785 - DNA, 18 bp, Homo sapiens
cgctcctgcagccccagc

SEQ ID NO: 2495786 - DNA, 23 bp, Homo sapiens
cgctcctgctaacggtgctcagg

SEQ ID NO: 2495787 - DNA, 15 bp, Homo sapiens
cgctcctggcccagc

SEQ ID NO: 2495788 - DNA, 18 bp, Homo sapiens
cgctcctggcccagcctt

SEQ ID NO: 2495789 - DNA, 15 bp, Homo sapiens
cgctgccagctctgt

SEQ ID NO: 2495790 - DNA, 14 bp, Homo sapiens
cgctgggtggtacc

SEQ ID NO: 2495791 - DNA, 18 bp, Homo sapiens
cgctggtcctttcttccg

SEQ ID NO: 2495792 - DNA, 16 bp, Homo sapiens
cgctgtgccaggcgag

SEQ ID NO: 2495793 - DNA, 20 bp, Homo sapiens
cgcttatcaactaatgattt

SEQ ID NO: 2495794 - DNA, 16 bp, Homo sapiens
cgcttcttgcctctgt

SEQ ID NO: 2495795 - DNA, 17 bp, Homo sapiens
cgcttcttgcctctgtg

SEQ ID NO: 2495796 - DNA, 22 bp, Homo sapiens
cgcttggagctattttccaggc

SEQ ID NO: 2495797 - DNA, 16 bp, Homo sapiens
cgctttttgaaaaagc

SEQ ID NO: 2495798 - DNA, 19 bp, Homo sapiens
cggaagggtaaacaatata

SEQ ID NO: 2495799 - DNA, 21 bp, Homo sapiens
cggaccaccctcactggctct

SEQ ID NO: 2495800 - DNA, 13 bp, Homo sapiens
cggaccagcctgg

SEQ ID NO: 2495801 - DNA, 18 bp, Homo sapiens
cggagccactcctctgac

SEQ ID NO: 2495802 - DNA, 21 bp, Homo sapiens
cggagccactcctctgactca

SEQ ID NO: 2495803 - DNA, 23 bp, Homo sapiens
cggaggaggagggaggccaggcg

SEQ ID NO: 2495804 - DNA, 17 bp, Homo sapiens
cggaggcggtgggcctg

SEQ ID NO: 2495805 - DNA, 15 bp, Homo sapiens
cggagtcgtggggtg

SEQ ID NO: 2495806 - DNA, 22 bp, Homo sapiens
cggagtcgtggggtgtgctggg

SEQ ID NO: 2495807 - DNA, 21 bp, Homo sapiens
cggatccagggaggctggtcc

SEQ ID NO: 2495808 - DNA, 22 bp, Homo sapiens
cggatccagggaggctggtcct

SEQ ID NO: 2495809 - DNA, 13 bp, Homo sapiens
cggatgcagaggc

SEQ ID NO: 2495810 - DNA, 19 bp, Homo sapiens
cggcaccccctgcagcttg

SEQ ID NO: 2495811 - DNA, 20 bp, Homo sapiens
cggcaccccctgcagcttgt

SEQ ID NO: 2495812 - DNA, 13 bp, Homo sapiens
cggcacctgggcc

SEQ ID NO: 2495813 - DNA, 19 bp, Homo sapiens
cggcacctgggccctgggg

SEQ ID NO: 2495814 - DNA, 21 bp, Homo sapiens
cggcagcttctgccccctgca

SEQ ID NO: 2495815 - DNA, 17 bp, Homo sapiens
cggcaggggcctggaga

SEQ ID NO: 2495816 - DNA, 16 bp, Homo sapiens
cggccacacagctgcc

SEQ ID NO: 2495817 - DNA, 22 bp, Homo sapiens
cggccagcccctggccccagga

SEQ ID NO: 2495818 - DNA, 16 bp, Homo sapiens
cggccagggagaagct

SEQ ID NO: 2495819 - DNA, 14 bp, Homo sapiens
cggcccctccccct

SEQ ID NO: 2495820 - DNA, 14 bp, Homo sapiens
cggccctagcattg

SEQ ID NO: 2495821 - DNA, 18 bp, Homo sapiens
cggcctatgacttgggca

SEQ ID NO: 2495822 - DNA, 12 bp, Homo sapiens
cggcctccttct

SEQ ID NO: 2495823 - DNA, 14 bp, Homo sapiens
cggcctgccaggag

SEQ ID NO: 2495824 - DNA, 17 bp, Homo sapiens
cggcggcccctagcgct

SEQ ID NO: 2495825 - DNA, 19 bp, Homo sapiens
cggctaatttttatatttt

SEQ ID NO: 2495826 - DNA, 15 bp, Homo sapiens
cggctccccatgtgt

SEQ ID NO: 2495827 - DNA, 14 bp, Homo sapiens
cggctcctcaggga

SEQ ID NO: 2495828 - DNA, 20 bp, Homo sapiens
cggctcgagcagtcctgcct

SEQ ID NO: 2495829 - DNA, 13 bp, Homo sapiens
cggctctcacctg

SEQ ID NO: 2495830 - DNA, 14 bp, Homo sapiens
cggctctgtcccca

SEQ ID NO: 2495831 - DNA, 12 bp, Homo sapiens
cggctgcagagg

SEQ ID NO: 2495832 - DNA, 15 bp, Homo sapiens
cggctgcagaggcca

SEQ ID NO: 2495833 - DNA, 15 bp, Homo sapiens
cggctgtgcagtcct

SEQ ID NO: 2495834 - DNA, 13 bp, Homo sapiens
cggctgtgtgtgc

SEQ ID NO: 2495835 - DNA, 22 bp, Homo sapiens
cggctgtgtgtgcacgcgtgtg

SEQ ID NO: 2495836 - DNA, 18 bp, Homo sapiens
cgggaattttcatctagg

SEQ ID NO: 2495837 - DNA, 17 bp, Homo sapiens
cgggaccaccctgagcc

SEQ ID NO: 2495838 - DNA, 18 bp, Homo sapiens
cgggaccaccctgagccg

SEQ ID NO: 2495839 - DNA, 14 bp, Homo sapiens
cgggcagagggctg

SEQ ID NO: 2495840 - DNA, 18 bp, Homo sapiens
cgggcagagggctggagg

SEQ ID NO: 2495841 - DNA, 22 bp, Homo sapiens
cgggcagagggctggaggccca

SEQ ID NO: 2495842 - DNA, 23 bp, Homo sapiens
cgggcagagggctggaggcccag

SEQ ID NO: 2495843 - DNA, 15 bp, Homo sapiens
cgggccaaggacctg

SEQ ID NO: 2495844 - DNA, 18 bp, Homo sapiens
cgggccaaggacctgaga

SEQ ID NO: 2495845 - DNA, 18 bp, Homo sapiens
cgggccactccttcctgc

SEQ ID NO: 2495846 - DNA, 16 bp, Homo sapiens
cgggcctgtccacagg

SEQ ID NO: 2495847 - DNA, 22 bp, Homo sapiens
cgggcctgtccacaggcttctg

SEQ ID NO: 2495848 - DNA, 22 bp, Homo sapiens
cggggaactggccaagctgagg

SEQ ID NO: 2495849 - DNA, 13 bp, Homo sapiens
cggggcagccccc

SEQ ID NO: 2495850 - DNA, 16 bp, Homo sapiens
cggggcttgccttctg

SEQ ID NO: 2495851 - DNA, 18 bp, Homo sapiens
cggggcttgccttctggt

SEQ ID NO: 2495852 - DNA, 21 bp, Homo sapiens
cgggggtggcggcggccccta

SEQ ID NO: 2495853 - DNA, 15 bp, Homo sapiens
cggggtgcacaggag

SEQ ID NO: 2495854 - DNA, 18 bp, Homo sapiens
cggggtgcacaggagggg

SEQ ID NO: 2495855 - DNA, 16 bp, Homo sapiens
cggggtgggggcagca

SEQ ID NO: 2495856 - DNA, 17 bp, Homo sapiens
cgggtctgctcccaagg

SEQ ID NO: 2495857 - DNA, 16 bp, Homo sapiens
cgggtggggcttgggg

SEQ ID NO: 2495858 - DNA, 20 bp, Homo sapiens
cgggtgtcacggccaggcag

SEQ ID NO: 2495859 - DNA, 18 bp, Homo sapiens
cggtaggttcagccaagg

SEQ ID NO: 2495860 - DNA, 24 bp, Homo sapiens
cggtcgccctttgctgcatggcag

SEQ ID NO: 2495861 - DNA, 13 bp, Homo sapiens
cggtctgtgcccc

SEQ ID NO: 2495862 - DNA, 18 bp, Homo sapiens
cggtgcccaagccagagg

SEQ ID NO: 2495863 - DNA, 20 bp, Homo sapiens
cggtgcccaagccagaggct

SEQ ID NO: 2495864 - DNA, 23 bp, Homo sapiens
cggtgcccaagccagaggctggg

SEQ ID NO: 2495865 - DNA, 11 bp, Homo sapiens
cggtgggggta

SEQ ID NO: 2495866 - DNA, 19 bp, Homo sapiens
cggtgggggtagggggctg

SEQ ID NO: 2495867 - DNA, 22 bp, Homo sapiens
cggtgggggtagggggctggag

SEQ ID NO: 2495868 - DNA, 11 bp, Homo sapiens
cggtgtctctc

SEQ ID NO: 2495869 - DNA, 12 bp, Homo sapiens
cgtaaagatttg

SEQ ID NO: 2495870 - DNA, 14 bp, Homo sapiens
cgtaagatttcctt

SEQ ID NO: 2495871 - DNA, 15 bp, Homo sapiens
cgtaataaggtttta

SEQ ID NO: 2495872 - DNA, 17 bp, Homo sapiens
cgtacgtaataaggttt

SEQ ID NO: 2495873 - DNA, 20 bp, Homo sapiens
cgtacgtaataaggttttaa

SEQ ID NO: 2495874 - DNA, 14 bp, Homo sapiens
cgtagatgatttca

SEQ ID NO: 2495875 - DNA, 19 bp, Homo sapiens
cgtagctatccggacagag

SEQ ID NO: 2495876 - DNA, 14 bp, Homo sapiens
cgtaggctacagag

SEQ ID NO: 2495877 - DNA, 16 bp, Homo sapiens
cgtaggctacagagaa

SEQ ID NO: 2495878 - DNA, 20 bp, Homo sapiens
cgtaggctacagagaagcct

SEQ ID NO: 2495879 - DNA, 15 bp, Homo sapiens
cgtatgtctggttct

SEQ ID NO: 2495880 - DNA, 19 bp, Homo sapiens
cgtatgtctggttctcaat

SEQ ID NO: 2495881 - DNA, 21 bp, Homo sapiens
cgtcacccctgtttctggcac

SEQ ID NO: 2495882 - DNA, 22 bp, Homo sapiens
cgtcatgaggagattctgcctt

SEQ ID NO: 2495883 - DNA, 12 bp, Homo sapiens
cgtcctcctctg

SEQ ID NO: 2495884 - DNA, 16 bp, Homo sapiens
cgtcctgcctgtggcg

SEQ ID NO: 2495885 - DNA, 20 bp, Homo sapiens
cgtccttactcctgtgggag

SEQ ID NO: 2495886 - DNA, 19 bp, Homo sapiens
cgtctcccccaacagctgg

SEQ ID NO: 2495887 - DNA, 21 bp, Homo sapiens
cgtctcttttaccctggcccc

SEQ ID NO: 2495888 - DNA, 15 bp, Homo sapiens
cgtctggaagtccaa

SEQ ID NO: 2495889 - DNA, 13 bp, Homo sapiens
cgtcttctccaac

SEQ ID NO: 2495890 - DNA, 13 bp, Homo sapiens
cgtgacacaaaca

SEQ ID NO: 2495891 - DNA, 10 bp, Homo sapiens
cgtgcacagg

SEQ ID NO: 2495892 - DNA, 12 bp, Homo sapiens
cgtgcacagggt

SEQ ID NO: 2495893 - DNA, 20 bp, Homo sapiens
cgtgccaagtccaggtcctg

SEQ ID NO: 2495894 - DNA, 21 bp, Homo sapiens
cgtgccaagtccaggtcctgg

SEQ ID NO: 2495895 - DNA, 23 bp, Homo sapiens
cgtgccaagtccaggtcctggtg

SEQ ID NO: 2495896 - DNA, 21 bp, Homo sapiens
cgtggactgagtgggaagccc

SEQ ID NO: 2495897 - DNA, 20 bp, Homo sapiens
cgtggaggaggagggaggcc

SEQ ID NO: 2495898 - DNA, 14 bp, Homo sapiens
cgtggcccttcctg

SEQ ID NO: 2495899 - DNA, 18 bp, Homo sapiens
cgtggcccttcctggaca

SEQ ID NO: 2495900 - DNA, 14 bp, Homo sapiens
cgtggctcagccag

SEQ ID NO: 2495901 - DNA, 14 bp, Homo sapiens
cgtgggcattgtct

SEQ ID NO: 2495902 - DNA, 21 bp, Homo sapiens
cgtgggccccaccctcgggga

SEQ ID NO: 2495903 - DNA, 18 bp, Homo sapiens
cgtggggtgtgctgggag

SEQ ID NO: 2495904 - DNA, 17 bp, Homo sapiens
cgtggtggtccctgggt

SEQ ID NO: 2495905 - DNA, 18 bp, Homo sapiens
cgtgtgtttttctattaa

SEQ ID NO: 2495906 - DNA, 14 bp, Homo sapiens
cgttaaaaacagat

SEQ ID NO: 2495907 - DNA, 21 bp, Homo sapiens
cgttaaaaacagatttggaaa

SEQ ID NO: 2495908 - DNA, 21 bp, Homo sapiens
cgttactagcagtcacttgat

SEQ ID NO: 2495909 - DNA, 14 bp, Homo sapiens
cgttagctcctgtg

SEQ ID NO: 2495910 - DNA, 19 bp, Homo sapiens
cgttctctctttgcatgga

SEQ ID NO: 2495911 - DNA, 12 bp, Homo sapiens
cgttcttgtaat

SEQ ID NO: 2495912 - DNA, 22 bp, Homo sapiens
cgtttaagccaaaacaatgttt

SEQ ID NO: 2495913 - DNA, 12 bp, Homo sapiens
cgtttcctaccg

SEQ ID NO: 2495914 - DNA, 22 bp, Homo sapiens
cgtttctccacctagactgtaa

SEQ ID NO: 2495915 - DNA, 17 bp, Homo sapiens
cgtttgaccttttatgt

SEQ ID NO: 2495916 - DNA, 15 bp, Homo sapiens
cgttttctaattgct

SEQ ID NO: 2495917 - DNA, 20 bp, Homo sapiens
cgttttctaattgcttattt

SEQ ID NO: 2495918 - DNA, 20 bp, Homo sapiens
cgttttgaagctactgtgtg

SEQ ID NO: 2495919 - DNA, 11 bp, Homo sapiens
cgttttgtcac

SEQ ID NO: 2495920 - DNA, 21 bp, Homo sapiens
ctaaaaatagacttaaatctc

SEQ ID NO: 2495921 - DNA, 20 bp, Homo sapiens
ctaaaagtgggcttgattct

SEQ ID NO: 2495922 - DNA, 18 bp, Homo sapiens
ctaaaataattttgtaat

SEQ ID NO: 2495923 - DNA, 19 bp, Homo sapiens
ctaaaatcttatagttcta

SEQ ID NO: 2495924 - DNA, 22 bp, Homo sapiens
ctaaaatcttatagttctaggc

SEQ ID NO: 2495925 - DNA, 21 bp, Homo sapiens
ctaaaatgtgatgttctaagg

SEQ ID NO: 2495926 - DNA, 22 bp, Homo sapiens
ctaaaatgtgatgttctaaggc

SEQ ID NO: 2495927 - DNA, 23 bp, Homo sapiens
ctaaaatgtgatgttctaaggct

SEQ ID NO: 2495928 - DNA, 17 bp, Homo sapiens
ctaaacacgtgacacaa

SEQ ID NO: 2495929 - DNA, 23 bp, Homo sapiens
ctaaacatcattcatttttgttg

SEQ ID NO: 2495930 - DNA, 17 bp, Homo sapiens
ctaaactggagactgtg

SEQ ID NO: 2495931 - DNA, 19 bp, Homo sapiens
ctaaactggagactgtgtg

SEQ ID NO: 2495932 - DNA, 16 bp, Homo sapiens
ctaaacttccccatct

SEQ ID NO: 2495933 - DNA, 15 bp, Homo sapiens
ctaaactttttttct

SEQ ID NO: 2495934 - DNA, 18 bp, Homo sapiens
ctaaactttttttctgta

SEQ ID NO: 2495935 - DNA, 19 bp, Homo sapiens
ctaaagatggagtttctaa

SEQ ID NO: 2495936 - DNA, 20 bp, Homo sapiens
ctaaagatggagtttctaag

SEQ ID NO: 2495937 - DNA, 18 bp, Homo sapiens
ctaaagattctatagttc

SEQ ID NO: 2495938 - DNA, 22 bp, Homo sapiens
ctaaagattctatagttctaga

SEQ ID NO: 2495939 - DNA, 16 bp, Homo sapiens
ctaaaggagtttatgt

SEQ ID NO: 2495940 - DNA, 12 bp, Homo sapiens
ctaaagttctaa

SEQ ID NO: 2495941 - DNA, 15 bp, Homo sapiens
ctaaagttctaagat

SEQ ID NO: 2495942 - DNA, 18 bp, Homo sapiens
ctaaagttctaagattct

SEQ ID NO: 2495943 - DNA, 19 bp, Homo sapiens
ctaaagttctaagattctg

SEQ ID NO: 2495944 - DNA, 20 bp, Homo sapiens
ctaaataaaatttgttgcat

SEQ ID NO: 2495945 - DNA, 14 bp, Homo sapiens
ctaaatgccctgct

SEQ ID NO: 2495946 - DNA, 16 bp, Homo sapiens
ctaaatggcctcatgt

SEQ ID NO: 2495947 - DNA, 15 bp, Homo sapiens
ctaaattatttactg

SEQ ID NO: 2495948 - DNA, 22 bp, Homo sapiens
ctaacaagtcataggttaatat

SEQ ID NO: 2495949 - DNA, 15 bp, Homo sapiens
ctaacaatgacattt

SEQ ID NO: 2495950 - DNA, 22 bp, Homo sapiens
ctaacatataatgttgttattt

SEQ ID NO: 2495951 - DNA, 21 bp, Homo sapiens
ctaacatttttgataaagcct

SEQ ID NO: 2495952 - DNA, 15 bp, Homo sapiens
ctaaccaagctgagt

SEQ ID NO: 2495953 - DNA, 21 bp, Homo sapiens
ctaaccagggaagctgtccct

SEQ ID NO: 2495954 - DNA, 23 bp, Homo sapiens
ctaaccctatactgtagtattct

SEQ ID NO: 2495955 - DNA, 22 bp, Homo sapiens
ctaaccctttgtgtgctctcca

SEQ ID NO: 2495956 - DNA, 23 bp, Homo sapiens
ctaaccctttgtgtgctctccat

SEQ ID NO: 2495957 - DNA, 17 bp, Homo sapiens
ctaaccttgcctggtac

SEQ ID NO: 2495958 - DNA, 13 bp, Homo sapiens
ctaacctttacat

SEQ ID NO: 2495959 - DNA, 13 bp, Homo sapiens
ctaacgcctgagc

SEQ ID NO: 2495960 - DNA, 22 bp, Homo sapiens
ctaacgcctgagcccagggagg

SEQ ID NO: 2495961 - DNA, 17 bp, Homo sapiens
ctaacggtgctcagggg

SEQ ID NO: 2495962 - DNA, 20 bp, Homo sapiens
ctaactacaaaggtttaaat

SEQ ID NO: 2495963 - DNA, 23 bp, Homo sapiens
ctaactacaaaggtttaaatgaa

SEQ ID NO: 2495964 - DNA, 15 bp, Homo sapiens
ctaactagacaccaa

SEQ ID NO: 2495965 - DNA, 22 bp, Homo sapiens
ctaactagacaccaaagttcta

SEQ ID NO: 2495966 - DNA, 12 bp, Homo sapiens
ctaagaaagaac

SEQ ID NO: 2495967 - DNA, 16 bp, Homo sapiens
ctaagaacctggaact

SEQ ID NO: 2495968 - DNA, 13 bp, Homo sapiens
ctaagactcaaat

SEQ ID NO: 2495969 - DNA, 17 bp, Homo sapiens
ctaagactcaaatgttc

SEQ ID NO: 2495970 - DNA, 20 bp, Homo sapiens
ctaagactcaaatgttctaa

SEQ ID NO: 2495971 - DNA, 21 bp, Homo sapiens
ctaagactcaaatgttctaag

SEQ ID NO: 2495972 - DNA, 22 bp, Homo sapiens
ctaagacttactctaagatctt

SEQ ID NO: 2495973 - DNA, 15 bp, Homo sapiens
ctaagagaagtagaa

SEQ ID NO: 2495974 - DNA, 21 bp, Homo sapiens
ctaagagaagttgtaaagtat

SEQ ID NO: 2495975 - DNA, 14 bp, Homo sapiens
ctaagaggctgccc

SEQ ID NO: 2495976 - DNA, 22 bp, Homo sapiens
ctaagatgtgatattctaagac

SEQ ID NO: 2495977 - DNA, 12 bp, Homo sapiens
ctaagattctaa

SEQ ID NO: 2495978 - DNA, 11 bp, Homo sapiens
ctaagattctg

SEQ ID NO: 2495979 - DNA, 18 bp, Homo sapiens
ctaagcagaaagtgcctt

SEQ ID NO: 2495980 - DNA, 21 bp, Homo sapiens
ctaagcataaaagatgaaaga

SEQ ID NO: 2495981 - DNA, 14 bp, Homo sapiens
ctaagcatctaagt

SEQ ID NO: 2495982 - DNA, 19 bp, Homo sapiens
ctaagccagcaccggacca

SEQ ID NO: 2495983 - DNA, 14 bp, Homo sapiens
ctaaggaaccaaca

SEQ ID NO: 2495984 - DNA, 13 bp, Homo sapiens
ctaaggcctactt

SEQ ID NO: 2495985 - DNA, 16 bp, Homo sapiens
ctaaggctcctgtttt

SEQ ID NO: 2495986 - DNA, 18 bp, Homo sapiens
ctaaggctctatgagtct

SEQ ID NO: 2495987 - DNA, 21 bp, Homo sapiens
ctaaggctctatgagtctaga

SEQ ID NO: 2495988 - DNA, 11 bp, Homo sapiens
ctaaggctctg

SEQ ID NO: 2495989 - DNA, 20 bp, Homo sapiens
ctaaggctctgagagtctag

SEQ ID NO: 2495990 - DNA, 21 bp, Homo sapiens
ctaaggctctgagagtctaga

SEQ ID NO: 2495991 - DNA, 23 bp, Homo sapiens
ctaagggtcgaaagctctagaat

SEQ ID NO: 2495992 - DNA, 20 bp, Homo sapiens
ctaaggtccggtgttctaag

SEQ ID NO: 2495993 - DNA, 22 bp, Homo sapiens
ctaaggtccggtgttctaagat

SEQ ID NO: 2495994 - DNA, 14 bp, Homo sapiens
ctaaggttctaagg

SEQ ID NO: 2495995 - DNA, 16 bp, Homo sapiens
ctaagtaaatacaatt

SEQ ID NO: 2495996 - DNA, 19 bp, Homo sapiens
ctaagtaaatacaattttt

SEQ ID NO: 2495997 - DNA, 21 bp, Homo sapiens
ctaagtccagtccagtcctat

SEQ ID NO: 2495998 - DNA, 23 bp, Homo sapiens
ctaagtccagtccagtcctatct

SEQ ID NO: 2495999 - DNA, 14 bp, Homo sapiens
ctaagtgatataaa

SEQ ID NO: 2496000 - DNA, 21 bp, Homo sapiens
ctaagttataagactctcaca

SEQ ID NO: 2496001 - DNA, 12 bp, Homo sapiens
ctaagtttctaa

SEQ ID NO: 2496002 - DNA, 17 bp, Homo sapiens
ctaataaaaagcttttg

SEQ ID NO: 2496003 - DNA, 22 bp, Homo sapiens
ctaataaaaagcttttgtctac

SEQ ID NO: 2496004 - DNA, 20 bp, Homo sapiens
ctaatagaataaaggcagtt

SEQ ID NO: 2496005 - DNA, 13 bp, Homo sapiens
ctaatattttcct

SEQ ID NO: 2496006 - DNA, 17 bp, Homo sapiens
ctaatattttcctcctg

SEQ ID NO: 2496007 - DNA, 15 bp, Homo sapiens
ctaatccccttctcc

SEQ ID NO: 2496008 - DNA, 18 bp, Homo sapiens
ctaatccccttctcccct

SEQ ID NO: 2496009 - DNA, 19 bp, Homo sapiens
ctaatctagatatcgactt

SEQ ID NO: 2496010 - DNA, 18 bp, Homo sapiens
ctaatctatggtcgggag

SEQ ID NO: 2496011 - DNA, 19 bp, Homo sapiens
ctaattaattgtaatctga

SEQ ID NO: 2496012 - DNA, 18 bp, Homo sapiens
ctaattatgtagctcttt

SEQ ID NO: 2496013 - DNA, 22 bp, Homo sapiens
ctaattcacagtgctcttttct

SEQ ID NO: 2496014 - DNA, 10 bp, Homo sapiens
ctaattcata

SEQ ID NO: 2496015 - DNA, 15 bp, Homo sapiens
ctaattccacacctt

SEQ ID NO: 2496016 - DNA, 15 bp, Homo sapiens
ctaattctatgcctg

SEQ ID NO: 2496017 - DNA, 16 bp, Homo sapiens
ctaattctattaaagt

SEQ ID NO: 2496018 - DNA, 20 bp, Homo sapiens
ctaattctattaaagtgcta

SEQ ID NO: 2496019 - DNA, 13 bp, Homo sapiens
ctaattgcttatt

SEQ ID NO: 2496020 - DNA, 13 bp, Homo sapiens
ctaatttataaaa

SEQ ID NO: 2496021 - DNA, 14 bp, Homo sapiens
ctaatttataaaaa

SEQ ID NO: 2496022 - DNA, 12 bp, Homo sapiens
ctaatttttaag

SEQ ID NO: 2496023 - DNA, 20 bp, Homo sapiens
ctaatttttgtaattttagt

SEQ ID NO: 2496024 - DNA, 14 bp, Homo sapiens
ctaattttttgttg

SEQ ID NO: 2496025 - DNA, 20 bp, Homo sapiens
ctaatttttttgtattttag

SEQ ID NO: 2496026 - DNA, 21 bp, Homo sapiens
ctaatttttttgtattttagc

SEQ ID NO: 2496027 - DNA, 19 bp, Homo sapiens
ctacaaaggtttaaatgaa

SEQ ID NO: 2496028 - DNA, 18 bp, Homo sapiens
ctacaccactctggcagc

SEQ ID NO: 2496029 - DNA, 21 bp, Homo sapiens
ctacaccactctggcagccac

SEQ ID NO: 2496030 - DNA, 17 bp, Homo sapiens
ctacagaaaaaccttgg

SEQ ID NO: 2496031 - DNA, 20 bp, Homo sapiens
ctacagaacttcagaaagac

SEQ ID NO: 2496032 - DNA, 12 bp, Homo sapiens
ctacagagaaac

SEQ ID NO: 2496033 - DNA, 15 bp, Homo sapiens
ctacagagaaaccag

SEQ ID NO: 2496034 - DNA, 18 bp, Homo sapiens
ctacagagaaaccagctt

SEQ ID NO: 2496035 - DNA, 19 bp, Homo sapiens
ctacagagaaaccagcttc

SEQ ID NO: 2496036 - DNA, 20 bp, Homo sapiens
ctacagagaaaccagcttcc

SEQ ID NO: 2496037 - DNA, 12 bp, Homo sapiens
ctacagagaagc

SEQ ID NO: 2496038 - DNA, 13 bp, Homo sapiens
ctacagagaagcc

SEQ ID NO: 2496039 - DNA, 14 bp, Homo sapiens
ctacagagaagcct

SEQ ID NO: 2496040 - DNA, 16 bp, Homo sapiens
ctacagagaagccttc

SEQ ID NO: 2496041 - DNA, 18 bp, Homo sapiens
ctacagagcttccctgac

SEQ ID NO: 2496042 - DNA, 14 bp, Homo sapiens
ctacagatgagtca

SEQ ID NO: 2496043 - DNA, 17 bp, Homo sapiens
ctacagctggggtgcag

SEQ ID NO: 2496044 - DNA, 21 bp, Homo sapiens
ctacaggcgtgagccaccatg

SEQ ID NO: 2496045 - DNA, 17 bp, Homo sapiens
ctacagggggtctggct

SEQ ID NO: 2496046 - DNA, 22 bp, Homo sapiens
ctacagggggtctggctggtgt

SEQ ID NO: 2496047 - DNA, 14 bp, Homo sapiens
ctacagtcaggaaa

SEQ ID NO: 2496048 - DNA, 17 bp, Homo sapiens
ctacagttttaactgtg

SEQ ID NO: 2496049 - DNA, 16 bp, Homo sapiens
ctacatatgatctgtc

SEQ ID NO: 2496050 - DNA, 14 bp, Homo sapiens
ctacatcttctgcc

SEQ ID NO: 2496051 - DNA, 13 bp, Homo sapiens
ctaccaccagctg

SEQ ID NO: 2496052 - DNA, 20 bp, Homo sapiens
ctaccagtatttagaagcca

SEQ ID NO: 2496053 - DNA, 17 bp, Homo sapiens
ctaccgaatgtgtcttt

SEQ ID NO: 2496054 - DNA, 14 bp, Homo sapiens
ctaccgagttcaag

SEQ ID NO: 2496055 - DNA, 16 bp, Homo sapiens
ctaccgtcttttcctg

SEQ ID NO: 2496056 - DNA, 13 bp, Homo sapiens
ctaccttctcccc

SEQ ID NO: 2496057 - DNA, 21 bp, Homo sapiens
ctaccttctccccagctccca

SEQ ID NO: 2496058 - DNA, 19 bp, Homo sapiens
ctaccttgaaaataagaat

SEQ ID NO: 2496059 - DNA, 21 bp, Homo sapiens
ctaccttggttcccccactga

SEQ ID NO: 2496060 - DNA, 14 bp, Homo sapiens
ctacgtatttaata

SEQ ID NO: 2496061 - DNA, 23 bp, Homo sapiens
ctactaacaatcagctccttcct

SEQ ID NO: 2496062 - DNA, 12 bp, Homo sapiens
ctactaattcca

SEQ ID NO: 2496063 - DNA, 15 bp, Homo sapiens
ctactaattccacac

SEQ ID NO: 2496064 - DNA, 13 bp, Homo sapiens
ctactcaaagcat

SEQ ID NO: 2496065 - DNA, 14 bp, Homo sapiens
ctactcacacaggc

SEQ ID NO: 2496066 - DNA, 19 bp, Homo sapiens
ctactcacttttcccactc

SEQ ID NO: 2496067 - DNA, 19 bp, Homo sapiens
ctactctccccacgagggc

SEQ ID NO: 2496068 - DNA, 23 bp, Homo sapiens
ctactctccccacgagggctggc

SEQ ID NO: 2496069 - DNA, 18 bp, Homo sapiens
ctactctgtgccagagcc

SEQ ID NO: 2496070 - DNA, 14 bp, Homo sapiens
ctactgggaaggct

SEQ ID NO: 2496071 - DNA, 16 bp, Homo sapiens
ctactgtgttatgcaa

SEQ ID NO: 2496072 - DNA, 12 bp, Homo sapiens
ctactgttctaa

SEQ ID NO: 2496073 - DNA, 18 bp, Homo sapiens
ctactgttctaaagctct

SEQ ID NO: 2496074 - DNA, 22 bp, Homo sapiens
ctacttccccatggccctgagc

SEQ ID NO: 2496075 - DNA, 14 bp, Homo sapiens
ctacttgctcaggt

SEQ ID NO: 2496076 - DNA, 14 bp, Homo sapiens
ctactttataacta

SEQ ID NO: 2496077 - DNA, 14 bp, Homo sapiens
ctagaaacttccaa

SEQ ID NO: 2496078 - DNA, 17 bp, Homo sapiens
ctagacaccaaagttct

SEQ ID NO: 2496079 - DNA, 19 bp, Homo sapiens
ctagacaccaaagttctaa

SEQ ID NO: 2496080 - DNA, 12 bp, Homo sapiens
ctagaccaataa

SEQ ID NO: 2496081 - DNA, 17 bp, Homo sapiens
ctagaccagcagacaga

SEQ ID NO: 2496082 - DNA, 21 bp, Homo sapiens
ctagaccagcagacagagcca

SEQ ID NO: 2496083 - DNA, 19 bp, Homo sapiens
ctagagaaataagatcttt

SEQ ID NO: 2496084 - DNA, 15 bp, Homo sapiens
ctagagaagacaggc

SEQ ID NO: 2496085 - DNA, 11 bp, Homo sapiens
ctagagctcct

SEQ ID NO: 2496086 - DNA, 17 bp, Homo sapiens
ctagaggtgagaaattt

SEQ ID NO: 2496087 - DNA, 16 bp, Homo sapiens
ctagagtctgaacagc

SEQ ID NO: 2496088 - DNA, 19 bp, Homo sapiens
ctagagtctgaacagctgt

SEQ ID NO: 2496089 - DNA, 21 bp, Homo sapiens
ctagatatcgacttgtttttg

SEQ ID NO: 2496090 - DNA, 15 bp, Homo sapiens
ctagatcagatgctc

SEQ ID NO: 2496091 - DNA, 17 bp, Homo sapiens
ctagatcataaggcttc

SEQ ID NO: 2496092 - DNA, 22 bp, Homo sapiens
ctagatcataaggcttcaaaat

SEQ ID NO: 2496093 - DNA, 13 bp, Homo sapiens
ctagatggacctg

SEQ ID NO: 2496094 - DNA, 21 bp, Homo sapiens
ctagatgtataactaggagct

SEQ ID NO: 2496095 - DNA, 14 bp, Homo sapiens
ctagattcagggaa

SEQ ID NO: 2496096 - DNA, 21 bp, Homo sapiens
ctagattgctaaggagctgat

SEQ ID NO: 2496097 - DNA, 14 bp, Homo sapiens
ctagcacagatggc

SEQ ID NO: 2496098 - DNA, 21 bp, Homo sapiens
ctagcagcaccgttctgtgca

SEQ ID NO: 2496099 - DNA, 15 bp, Homo sapiens
ctagcagtggcaggc

SEQ ID NO: 2496100 - DNA, 22 bp, Homo sapiens
ctagcattgtaaaattatttca

SEQ ID NO: 2496101 - DNA, 18 bp, Homo sapiens
ctagccaaacctcaccaa

SEQ ID NO: 2496102 - DNA, 21 bp, Homo sapiens
ctagccatacgctcagctcat

SEQ ID NO: 2496103 - DNA, 11 bp, Homo sapiens
ctagccttgct

SEQ ID NO: 2496104 - DNA, 14 bp, Homo sapiens
ctagccttgcttgt

SEQ ID NO: 2496105 - DNA, 22 bp, Homo sapiens
ctagccttggcctctttcctca

SEQ ID NO: 2496106 - DNA, 21 bp, Homo sapiens
ctagcgcagttttttttttct

SEQ ID NO: 2496107 - DNA, 17 bp, Homo sapiens
ctagcgctatctccctg

SEQ ID NO: 2496108 - DNA, 19 bp, Homo sapiens
ctagcgggatggggctccc

SEQ ID NO: 2496109 - DNA, 18 bp, Homo sapiens
ctagctgaatgtttttct

SEQ ID NO: 2496110 - DNA, 20 bp, Homo sapiens
ctagctgaatgtttttctaa

SEQ ID NO: 2496111 - DNA, 23 bp, Homo sapiens
ctagctgtgtgaatacctgctca

SEQ ID NO: 2496112 - DNA, 23 bp, Homo sapiens
ctaggaagagcaggactccaggc

SEQ ID NO: 2496113 - DNA, 14 bp, Homo sapiens
ctaggaagcctcag

SEQ ID NO: 2496114 - DNA, 15 bp, Homo sapiens
ctaggaagcctcaga

SEQ ID NO: 2496115 - DNA, 13 bp, Homo sapiens
ctaggagcaaagc

SEQ ID NO: 2496116 - DNA, 20 bp, Homo sapiens
ctaggagcaaagcctgttca

SEQ ID NO: 2496117 - DNA, 23 bp, Homo sapiens
ctaggagctttgactcaggagcc

SEQ ID NO: 2496118 - DNA, 16 bp, Homo sapiens
ctaggagggtcctctg

SEQ ID NO: 2496119 - DNA, 15 bp, Homo sapiens
ctaggccagagccca

SEQ ID NO: 2496120 - DNA, 14 bp, Homo sapiens
ctaggccagcaggg

SEQ ID NO: 2496121 - DNA, 23 bp, Homo sapiens
ctaggcccccacttgcctcttcc

SEQ ID NO: 2496122 - DNA, 17 bp, Homo sapiens
ctagggagccatttgag

SEQ ID NO: 2496123 - DNA, 18 bp, Homo sapiens
ctagggagccatttgaga

SEQ ID NO: 2496124 - DNA, 23 bp, Homo sapiens
ctagggaggcatggtctgccctc

SEQ ID NO: 2496125 - DNA, 13 bp, Homo sapiens
ctagggatccctc

SEQ ID NO: 2496126 - DNA, 17 bp, Homo sapiens
ctagggatccctcatct

SEQ ID NO: 2496127 - DNA, 23 bp, Homo sapiens
ctagggatccctcatctgtccct

SEQ ID NO: 2496128 - DNA, 23 bp, Homo sapiens
ctagggggagccccttctgctca

SEQ ID NO: 2496129 - DNA, 20 bp, Homo sapiens
ctaggtaatttttacagaat

SEQ ID NO: 2496130 - DNA, 20 bp, Homo sapiens
ctaggtacgatgacagtgtt

SEQ ID NO: 2496131 - DNA, 21 bp, Homo sapiens
ctaggtccccatactcctatg

SEQ ID NO: 2496132 - DNA, 17 bp, Homo sapiens
ctaggtgttttgttcac

SEQ ID NO: 2496133 - DNA, 21 bp, Homo sapiens
ctagtcaatcaagtctgttta

SEQ ID NO: 2496134 - DNA, 15 bp, Homo sapiens
ctagtcttttgcttt

SEQ ID NO: 2496135 - DNA, 21 bp, Homo sapiens
ctagtgaaggcttctctctgt

SEQ ID NO: 2496136 - DNA, 16 bp, Homo sapiens
ctagtgacccacatgc

SEQ ID NO: 2496137 - DNA, 18 bp, Homo sapiens
ctagtgacccacatgcca

SEQ ID NO: 2496138 - DNA, 14 bp, Homo sapiens
ctagttctagaaaa

SEQ ID NO: 2496139 - DNA, 16 bp, Homo sapiens
ctagttctagaaaaac

SEQ ID NO: 2496140 - DNA, 11 bp, Homo sapiens
ctagtttttta

SEQ ID NO: 2496141 - DNA, 18 bp, Homo sapiens
ctataaagcagtattttt

SEQ ID NO: 2496142 - DNA, 13 bp, Homo sapiens
ctataaagcattt

SEQ ID NO: 2496143 - DNA, 21 bp, Homo sapiens
ctataagaagccttaatttgc

SEQ ID NO: 2496144 - DNA, 15 bp, Homo sapiens
ctataattttgcctt

SEQ ID NO: 2496145 - DNA, 13 bp, Homo sapiens
ctatacctgtgtt

SEQ ID NO: 2496146 - DNA, 15 bp, Homo sapiens
ctatagttctagaca

SEQ ID NO: 2496147 - DNA, 12 bp, Homo sapiens
ctatatttgggc

SEQ ID NO: 2496148 - DNA, 22 bp, Homo sapiens
ctatatttgggcctgctccaga

SEQ ID NO: 2496149 - DNA, 16 bp, Homo sapiens
ctatcacctatttcca

SEQ ID NO: 2496150 - DNA, 18 bp, Homo sapiens
ctatcattgcttcctcct

SEQ ID NO: 2496151 - DNA, 20 bp, Homo sapiens
ctatcattgcttcctcctcc

SEQ ID NO: 2496152 - DNA, 18 bp, Homo sapiens
ctatccctaggcacttaa

SEQ ID NO: 2496153 - DNA, 20 bp, Homo sapiens
ctatccggacagagcacgtt

SEQ ID NO: 2496154 - DNA, 15 bp, Homo sapiens
ctatcctctcttcct

SEQ ID NO: 2496155 - DNA, 20 bp, Homo sapiens
ctatcctctcttcctcttcc

SEQ ID NO: 2496156 - DNA, 12 bp, Homo sapiens
ctatcctctgta

SEQ ID NO: 2496157 - DNA, 16 bp, Homo sapiens
ctatctgggcttcctg

SEQ ID NO: 2496158 - DNA, 23 bp, Homo sapiens
ctatctgggcttcctggagcaga

SEQ ID NO: 2496159 - DNA, 18 bp, Homo sapiens
ctatcttactatttcaca

SEQ ID NO: 2496160 - DNA, 16 bp, Homo sapiens
ctatgaaaagctagaa

SEQ ID NO: 2496161 - DNA, 20 bp, Homo sapiens
ctatgacttgggcaccccca

SEQ ID NO: 2496162 - DNA, 15 bp, Homo sapiens
ctatgagtctagatg

SEQ ID NO: 2496163 - DNA, 19 bp, Homo sapiens
ctatgagtctagatgttta

SEQ ID NO: 2496164 - DNA, 21 bp, Homo sapiens
ctatgcatggtgccccaggac

SEQ ID NO: 2496165 - DNA, 22 bp, Homo sapiens
ctatgcatggtgccccaggacc

SEQ ID NO: 2496166 - DNA, 19 bp, Homo sapiens
ctatgcatggtttcagcac

SEQ ID NO: 2496167 - DNA, 21 bp, Homo sapiens
ctatgcatggtttcagcacta

SEQ ID NO: 2496168 - DNA, 15 bp, Homo sapiens
ctatggaaagatggc

SEQ ID NO: 2496169 - DNA, 11 bp, Homo sapiens
ctatggagagc

SEQ ID NO: 2496170 - DNA, 21 bp, Homo sapiens
ctatggtcgggagacagcatc

SEQ ID NO: 2496171 - DNA, 15 bp, Homo sapiens
ctatgtcccaggaat

SEQ ID NO: 2496172 - DNA, 14 bp, Homo sapiens
ctatgtttttaatg

SEQ ID NO: 2496173 - DNA, 22 bp, Homo sapiens
ctatgtttttgttcaaagccag

SEQ ID NO: 2496174 - DNA, 12 bp, Homo sapiens
ctattaaaagac

SEQ ID NO: 2496175 - DNA, 13 bp, Homo sapiens
ctattaaaagact

SEQ ID NO: 2496176 - DNA, 16 bp, Homo sapiens
ctattaaaagactcat

SEQ ID NO: 2496177 - DNA, 17 bp, Homo sapiens
ctattaaaagactcatc

SEQ ID NO: 2496178 - DNA, 20 bp, Homo sapiens
ctattaaaagactcatccgt

SEQ ID NO: 2496179 - DNA, 20 bp, Homo sapiens
ctattaaagtgctaaggttc

SEQ ID NO: 2496180 - DNA, 18 bp, Homo sapiens
ctattatcccagctgcct

SEQ ID NO: 2496181 - DNA, 19 bp, Homo sapiens
ctattatcccagctgccta

SEQ ID NO: 2496182 - DNA, 19 bp, Homo sapiens
ctattatctgtcagctgca

SEQ ID NO: 2496183 - DNA, 21 bp, Homo sapiens
ctattatgaatgtgaagcctt

SEQ ID NO: 2496184 - DNA, 21 bp, Homo sapiens
ctattcgccacacagtatttt

SEQ ID NO: 2496185 - DNA, 12 bp, Homo sapiens
ctattctgtccc

SEQ ID NO: 2496186 - DNA, 14 bp, Homo sapiens
ctattctgtcccta

SEQ ID NO: 2496187 - DNA, 17 bp, Homo sapiens
ctattcttgatgtaaaa

SEQ ID NO: 2496188 - DNA, 18 bp, Homo sapiens
ctattgctagagctcctc

SEQ ID NO: 2496189 - DNA, 15 bp, Homo sapiens
ctatttaactgacta

SEQ ID NO: 2496190 - DNA, 17 bp, Homo sapiens
ctatttattgactttga

SEQ ID NO: 2496191 - DNA, 13 bp, Homo sapiens
ctatttcactgga

SEQ ID NO: 2496192 - DNA, 15 bp, Homo sapiens
ctatttcatgttttt

SEQ ID NO: 2496193 - DNA, 17 bp, Homo sapiens
ctatttcatgtttttga

SEQ ID NO: 2496194 - DNA, 19 bp, Homo sapiens
ctatttgatgtaatacttc

SEQ ID NO: 2496195 - DNA, 19 bp, Homo sapiens
ctatttgtaaatctgccac

SEQ ID NO: 2496196 - DNA, 21 bp, Homo sapiens
ctatttgtaaatctgccacaa

SEQ ID NO: 2496197 - DNA, 22 bp, Homo sapiens
ctattttcagatgtgaaccatt

SEQ ID NO: 2496198 - DNA, 19 bp, Homo sapiens
ctattttccaggcttctgc

SEQ ID NO: 2496199 - DNA, 18 bp, Homo sapiens
ctatttttttttttttgt

SEQ ID NO: 2496200 - DNA, 20 bp, Homo sapiens
ctcaaacaatgacaaagcag

SEQ ID NO: 2496201 - DNA, 14 bp, Homo sapiens
ctcaaactcctgac

SEQ ID NO: 2496202 - DNA, 19 bp, Homo sapiens
ctcaaactcctgacctcag

SEQ ID NO: 2496203 - DNA, 17 bp, Homo sapiens
ctcaaaggtttggaagg

SEQ ID NO: 2496204 - DNA, 19 bp, Homo sapiens
ctcaaaggtttggaaggag

SEQ ID NO: 2496205 - DNA, 23 bp, Homo sapiens
ctcaaaggtttggaaggagcaga

SEQ ID NO: 2496206 - DNA, 22 bp, Homo sapiens
ctcaaatgcggggtgggggcag

SEQ ID NO: 2496207 - DNA, 15 bp, Homo sapiens
ctcaaatggggccag

SEQ ID NO: 2496208 - DNA, 16 bp, Homo sapiens
ctcaaatggggccaga

SEQ ID NO: 2496209 - DNA, 19 bp, Homo sapiens
ctcaaatggggccagatcc

SEQ ID NO: 2496210 - DNA, 20 bp, Homo sapiens
ctcaaatggggccagatcca

SEQ ID NO: 2496211 - DNA, 16 bp, Homo sapiens
ctcaaatgttctaagt

SEQ ID NO: 2496212 - DNA, 23 bp, Homo sapiens
ctcaaatgttctaagtttctaag

SEQ ID NO: 2496213 - DNA, 15 bp, Homo sapiens
ctcaacaggcctcag

SEQ ID NO: 2496214 - DNA, 16 bp, Homo sapiens
ctcaaggactttgcag

SEQ ID NO: 2496215 - DNA, 19 bp, Homo sapiens
ctcaaggttttaggttcta

SEQ ID NO: 2496216 - DNA, 23 bp, Homo sapiens
ctcaaggttttaggttctaaagt

SEQ ID NO: 2496217 - DNA, 21 bp, Homo sapiens
ctcaagtctttctctttccct

SEQ ID NO: 2496218 - DNA, 13 bp, Homo sapiens
ctcaagttctaag

SEQ ID NO: 2496219 - DNA, 12 bp, Homo sapiens
ctcaatgagcat

SEQ ID NO: 2496220 - DNA, 13 bp, Homo sapiens
ctcaatgagcatg

SEQ ID NO: 2496221 - DNA, 14 bp, Homo sapiens
ctcaatggactgga

SEQ ID NO: 2496222 - DNA, 20 bp, Homo sapiens
ctcaatggactggaagggga

SEQ ID NO: 2496223 - DNA, 12 bp, Homo sapiens
ctcaattccaac

SEQ ID NO: 2496224 - DNA, 14 bp, Homo sapiens
ctcacaaggcagca

SEQ ID NO: 2496225 - DNA, 16 bp, Homo sapiens
ctcacaaggcagcaag

SEQ ID NO: 2496226 - DNA, 21 bp, Homo sapiens
ctcacaagtgggtacccccag

SEQ ID NO: 2496227 - DNA, 22 bp, Homo sapiens
ctcacacaggcatttcctgggt

SEQ ID NO: 2496228 - DNA, 21 bp, Homo sapiens
ctcacaccactagcctcaggg

SEQ ID NO: 2496229 - DNA, 22 bp, Homo sapiens
ctcacagtattgctcacccagt

SEQ ID NO: 2496230 - DNA, 22 bp, Homo sapiens
ctcacagtgaacactcagtggc

SEQ ID NO: 2496231 - DNA, 17 bp, Homo sapiens
ctcacagtgttgcccag

SEQ ID NO: 2496232 - DNA, 22 bp, Homo sapiens
ctcacatgtcagtaccttcaaa

SEQ ID NO: 2496233 - DNA, 17 bp, Homo sapiens
ctcaccatttggatcct

SEQ ID NO: 2496234 - DNA, 12 bp, Homo sapiens
ctcaccccatcc

SEQ ID NO: 2496235 - DNA, 15 bp, Homo sapiens
ctcaccctggaggca

SEQ ID NO: 2496236 - DNA, 22 bp, Homo sapiens
ctcacctctaggtccccatact

SEQ ID NO: 2496237 - DNA, 23 bp, Homo sapiens
ctcacctctaggtccccatactc

SEQ ID NO: 2496238 - DNA, 20 bp, Homo sapiens
ctcacctgcactaacagagt

SEQ ID NO: 2496239 - DNA, 17 bp, Homo sapiens
ctcacctggccctgctt

SEQ ID NO: 2496240 - DNA, 14 bp, Homo sapiens
ctcacgtcctgaga

SEQ ID NO: 2496241 - DNA, 18 bp, Homo sapiens
ctcactaggcccccactt

SEQ ID NO: 2496242 - DNA, 19 bp, Homo sapiens
ctcactcagcacttggccc

SEQ ID NO: 2496243 - DNA, 13 bp, Homo sapiens
ctcactcctttta

SEQ ID NO: 2496244 - DNA, 14 bp, Homo sapiens
ctcactccttttaa

SEQ ID NO: 2496245 - DNA, 15 bp, Homo sapiens
ctcactggctctcct

SEQ ID NO: 2496246 - DNA, 17 bp, Homo sapiens
ctcactggctctcctgg

SEQ ID NO: 2496247 - DNA, 21 bp, Homo sapiens
ctcactggctctcctggccct

SEQ ID NO: 2496248 - DNA, 15 bp, Homo sapiens
ctcactgttgaattt

SEQ ID NO: 2496249 - DNA, 20 bp, Homo sapiens
ctcactttcctcctgaggct

SEQ ID NO: 2496250 - DNA, 12 bp, Homo sapiens
ctcacttttccc

SEQ ID NO: 2496251 - DNA, 14 bp, Homo sapiens
ctcacttttcccac

SEQ ID NO: 2496252 - DNA, 18 bp, Homo sapiens
ctcacttttcccactcca

SEQ ID NO: 2496253 - DNA, 21 bp, Homo sapiens
ctcacttttcccactccaagc

SEQ ID NO: 2496254 - DNA, 20 bp, Homo sapiens
ctcagaaaatatccctcctg

SEQ ID NO: 2496255 - DNA, 15 bp, Homo sapiens
ctcagaaagtgcctg

SEQ ID NO: 2496256 - DNA, 22 bp, Homo sapiens
ctcagaagcctgggggcctggc

SEQ ID NO: 2496257 - DNA, 12 bp, Homo sapiens
ctcagaagtaaa

SEQ ID NO: 2496258 - DNA, 13 bp, Homo sapiens
ctcagaagtaaag

SEQ ID NO: 2496259 - DNA, 17 bp, Homo sapiens
ctcagacattggcacct

SEQ ID NO: 2496260 - DNA, 18 bp, Homo sapiens
ctcagaccacatgcccca

SEQ ID NO: 2496261 - DNA, 19 bp, Homo sapiens
ctcagactctaagaaagaa

SEQ ID NO: 2496262 - DNA, 14 bp, Homo sapiens
ctcagactggggca

SEQ ID NO: 2496263 - DNA, 16 bp, Homo sapiens
ctcagagaccagggct

SEQ ID NO: 2496264 - DNA, 21 bp, Homo sapiens
ctcagagaccagggctccagc

SEQ ID NO: 2496265 - DNA, 22 bp, Homo sapiens
ctcagagaccagggctccagcc

SEQ ID NO: 2496266 - DNA, 22 bp, Homo sapiens
ctcagataaggtaaaatgccat

SEQ ID NO: 2496267 - DNA, 17 bp, Homo sapiens
ctcagatcagtgtacca

SEQ ID NO: 2496268 - DNA, 17 bp, Homo sapiens
ctcagatccagggacag

SEQ ID NO: 2496269 - DNA, 16 bp, Homo sapiens
ctcagatcctcctcat

SEQ ID NO: 2496270 - DNA, 19 bp, Homo sapiens
ctcagatcggccacagggc

SEQ ID NO: 2496271 - DNA, 20 bp, Homo sapiens
ctcagatggcagcttttaaa

SEQ ID NO: 2496272 - DNA, 17 bp, Homo sapiens
ctcagattccttcccat

SEQ ID NO: 2496273 - DNA, 20 bp, Homo sapiens
ctcagattccttcccatgga

SEQ ID NO: 2496274 - DNA, 18 bp, Homo sapiens
ctcagcactgcctgctcc

SEQ ID NO: 2496275 - DNA, 18 bp, Homo sapiens
ctcagcacttggcccttc

SEQ ID NO: 2496276 - DNA, 13 bp, Homo sapiens
ctcagccagcact

SEQ ID NO: 2496277 - DNA, 12 bp, Homo sapiens
ctcagccagcct

SEQ ID NO: 2496278 - DNA, 13 bp, Homo sapiens
ctcagccagcctc

SEQ ID NO: 2496279 - DNA, 19 bp, Homo sapiens
ctcagccccaccccagggc

SEQ ID NO: 2496280 - DNA, 16 bp, Homo sapiens
ctcagcccctttccct

SEQ ID NO: 2496281 - DNA, 12 bp, Homo sapiens
ctcagccctgag

SEQ ID NO: 2496282 - DNA, 17 bp, Homo sapiens
ctcagccctgaggacag

SEQ ID NO: 2496283 - DNA, 20 bp, Homo sapiens
ctcagcctcccagagtgctg

SEQ ID NO: 2496284 - DNA, 15 bp, Homo sapiens
ctcagcctctcccct

SEQ ID NO: 2496285 - DNA, 15 bp, Homo sapiens
ctcagcctggccaga

SEQ ID NO: 2496286 - DNA, 16 bp, Homo sapiens
ctcagcctggccagac

SEQ ID NO: 2496287 - DNA, 12 bp, Homo sapiens
ctcagcctgggc

SEQ ID NO: 2496288 - DNA, 14 bp, Homo sapiens
ctcagcctgggcgc

SEQ ID NO: 2496289 - DNA, 16 bp, Homo sapiens
ctcagcctgggcgctg

SEQ ID NO: 2496290 - DNA, 15 bp, Homo sapiens
ctcagccttcagaca

SEQ ID NO: 2496291 - DNA, 19 bp, Homo sapiens
ctcagccttcagacagaga

SEQ ID NO: 2496292 - DNA, 15 bp, Homo sapiens
ctcagccttgccaga

SEQ ID NO: 2496293 - DNA, 17 bp, Homo sapiens
ctcagccttgccagaga

SEQ ID NO: 2496294 - DNA, 20 bp, Homo sapiens
ctcagccttgccagagatcc

SEQ ID NO: 2496295 - DNA, 21 bp, Homo sapiens
ctcagccttgccagagatcca

SEQ ID NO: 2496296 - DNA, 15 bp, Homo sapiens
ctcagctaagctcac

SEQ ID NO: 2496297 - DNA, 22 bp, Homo sapiens
ctcagctcccacaagcctctgc

SEQ ID NO: 2496298 - DNA, 14 bp, Homo sapiens
ctcagctctgggcc

SEQ ID NO: 2496299 - DNA, 18 bp, Homo sapiens
ctcagctgtcaaggctca

SEQ ID NO: 2496300 - DNA, 23 bp, Homo sapiens
ctcaggaaacgagactttccatt

SEQ ID NO: 2496301 - DNA, 15 bp, Homo sapiens
ctcaggacacaggcc

SEQ ID NO: 2496302 - DNA, 16 bp, Homo sapiens
ctcaggacacaggcct

SEQ ID NO: 2496303 - DNA, 21 bp, Homo sapiens
ctcaggacacaggcctgtgta

SEQ ID NO: 2496304 - DNA, 21 bp, Homo sapiens
ctcaggaccaaagctttcatg

SEQ ID NO: 2496305 - DNA, 22 bp, Homo sapiens
ctcaggaccaaagctttcatgt

SEQ ID NO: 2496306 - DNA, 16 bp, Homo sapiens
ctcaggaggcaggacc

SEQ ID NO: 2496307 - DNA, 20 bp, Homo sapiens
ctcaggatgagggaaaagaa

SEQ ID NO: 2496308 - DNA, 21 bp, Homo sapiens
ctcaggatgagggaaaagaaa

SEQ ID NO: 2496309 - DNA, 15 bp, Homo sapiens
ctcaggcacacagct

SEQ ID NO: 2496310 - DNA, 18 bp, Homo sapiens
ctcaggcacacagctact

SEQ ID NO: 2496311 - DNA, 14 bp, Homo sapiens
ctcaggcagctcaa

SEQ ID NO: 2496312 - DNA, 15 bp, Homo sapiens
ctcaggcagctcaag

SEQ ID NO: 2496313 - DNA, 18 bp, Homo sapiens
ctcaggcaggggcctcca

SEQ ID NO: 2496314 - DNA, 16 bp, Homo sapiens
ctcaggccagagccaa

SEQ ID NO: 2496315 - DNA, 17 bp, Homo sapiens
ctcaggccagagccaag

SEQ ID NO: 2496316 - DNA, 18 bp, Homo sapiens
ctcaggccagagccaagg

SEQ ID NO: 2496317 - DNA, 17 bp, Homo sapiens
ctcaggctaggccagca

SEQ ID NO: 2496318 - DNA, 22 bp, Homo sapiens
ctcaggctaggccagcaggggc

SEQ ID NO: 2496319 - DNA, 23 bp, Homo sapiens
ctcaggctaggccagcaggggct

SEQ ID NO: 2496320 - DNA, 21 bp, Homo sapiens
ctcaggctgcctgagtcgtga

SEQ ID NO: 2496321 - DNA, 15 bp, Homo sapiens
ctcagggcaaagcca

SEQ ID NO: 2496322 - DNA, 20 bp, Homo sapiens
ctcagggcagcgccaggctg

SEQ ID NO: 2496323 - DNA, 13 bp, Homo sapiens
ctcagggctcctg

SEQ ID NO: 2496324 - DNA, 21 bp, Homo sapiens
ctcaggggtctgagctccagc

SEQ ID NO: 2496325 - DNA, 19 bp, Homo sapiens
ctcaggtcacataaaactt

SEQ ID NO: 2496326 - DNA, 15 bp, Homo sapiens
ctcaggtgctggggc

SEQ ID NO: 2496327 - DNA, 14 bp, Homo sapiens
ctcaggtgttgcca

SEQ ID NO: 2496328 - DNA, 15 bp, Homo sapiens
ctcaggtgttgccaa

SEQ ID NO: 2496329 - DNA, 13 bp, Homo sapiens
ctcagtaatttag

SEQ ID NO: 2496330 - DNA, 16 bp, Homo sapiens
ctcagtagtccctgca

SEQ ID NO: 2496331 - DNA, 17 bp, Homo sapiens
ctcagtatgaattattc

SEQ ID NO: 2496332 - DNA, 20 bp, Homo sapiens
ctcagtctctgagcagtgaa

SEQ ID NO: 2496333 - DNA, 15 bp, Homo sapiens
ctcagtgaagaatac

SEQ ID NO: 2496334 - DNA, 18 bp, Homo sapiens
ctcagtgaagaatacttc

SEQ ID NO: 2496335 - DNA, 16 bp, Homo sapiens
ctcagtgaagttgctg

SEQ ID NO: 2496336 - DNA, 19 bp, Homo sapiens
ctcagtgaagttgctgctt

SEQ ID NO: 2496337 - DNA, 15 bp, Homo sapiens
ctcagttgattttct

SEQ ID NO: 2496338 - DNA, 22 bp, Homo sapiens
ctcagtttgtgtgtcttaatta

SEQ ID NO: 2496339 - DNA, 18 bp, Homo sapiens
ctcagttttatcattttc

SEQ ID NO: 2496340 - DNA, 20 bp, Homo sapiens
ctcatataattatatgttgt

SEQ ID NO: 2496341 - DNA, 16 bp, Homo sapiens
ctcatccaccccatcc

SEQ ID NO: 2496342 - DNA, 22 bp, Homo sapiens
ctcatcccgagcacctccacat

SEQ ID NO: 2496343 - DNA, 19 bp, Homo sapiens
ctcatcccgtgttctcctt

SEQ ID NO: 2496344 - DNA, 17 bp, Homo sapiens
ctcatctcttcaggttc

SEQ ID NO: 2496345 - DNA, 12 bp, Homo sapiens
ctcatctgctgg

SEQ ID NO: 2496346 - DNA, 15 bp, Homo sapiens
ctcatctgctggtcc

SEQ ID NO: 2496347 - DNA, 21 bp, Homo sapiens
ctcatctggggagcaggcagc

SEQ ID NO: 2496348 - DNA, 15 bp, Homo sapiens
ctcatctgtccctcc

SEQ ID NO: 2496349 - DNA, 17 bp, Homo sapiens
ctcatctgtccctccgg

SEQ ID NO: 2496350 - DNA, 14 bp, Homo sapiens
ctcatctttttact

SEQ ID NO: 2496351 - DNA, 12 bp, Homo sapiens
ctcatgaatgta

SEQ ID NO: 2496352 - DNA, 13 bp, Homo sapiens
ctcatgaatgtaa

SEQ ID NO: 2496353 - DNA, 22 bp, Homo sapiens
ctcatgaatgtaaatttgtact

SEQ ID NO: 2496354 - DNA, 17 bp, Homo sapiens
ctcatgcccctggctgg

SEQ ID NO: 2496355 - DNA, 23 bp, Homo sapiens
ctcatgggtggcactcagtctct

SEQ ID NO: 2496356 - DNA, 23 bp, Homo sapiens
ctcatgttaaataggcggggctt

SEQ ID NO: 2496357 - DNA, 22 bp, Homo sapiens
ctcattatttatgtccaggtgt

SEQ ID NO: 2496358 - DNA, 17 bp, Homo sapiens
ctcattctgaaggagcc

SEQ ID NO: 2496359 - DNA, 18 bp, Homo sapiens
ctcattggaaatttagca

SEQ ID NO: 2496360 - DNA, 20 bp, Homo sapiens
ctcattggaaatttagcatt

SEQ ID NO: 2496361 - DNA, 13 bp, Homo sapiens
ctcattggaccct

SEQ ID NO: 2496362 - DNA, 17 bp, Homo sapiens
ctcattggacccttcca

SEQ ID NO: 2496363 - DNA, 18 bp, Homo sapiens
ctcattggacccttccat

SEQ ID NO: 2496364 - DNA, 15 bp, Homo sapiens
ctcattgtaaacaaa

SEQ ID NO: 2496365 - DNA, 22 bp, Homo sapiens
ctcatttaatcctcccttcctc

SEQ ID NO: 2496366 - DNA, 13 bp, Homo sapiens
ctcattttttaaa

SEQ ID NO: 2496367 - DNA, 19 bp, Homo sapiens
ctcatttttttccttgcaa

SEQ ID NO: 2496368 - DNA, 18 bp, Homo sapiens
ctccaaactgaagcagcc

SEQ ID NO: 2496369 - DNA, 12 bp, Homo sapiens
ctccaaagtcat

SEQ ID NO: 2496370 - DNA, 20 bp, Homo sapiens
ctccaaagtcataattgcat

SEQ ID NO: 2496371 - DNA, 15 bp, Homo sapiens
ctccaacaccaagca

SEQ ID NO: 2496372 - DNA, 21 bp, Homo sapiens
ctccaacaccacctctccaga

SEQ ID NO: 2496373 - DNA, 14 bp, Homo sapiens
ctccaagattctag

SEQ ID NO: 2496374 - DNA, 13 bp, Homo sapiens
ctccaagcagctt

SEQ ID NO: 2496375 - DNA, 15 bp, Homo sapiens
ctccacacctgcggc

SEQ ID NO: 2496376 - DNA, 16 bp, Homo sapiens
ctccacacctgcggcc

SEQ ID NO: 2496377 - DNA, 17 bp, Homo sapiens
ctccacatcctccacgt

SEQ ID NO: 2496378 - DNA, 12 bp, Homo sapiens
ctccaccttccc

SEQ ID NO: 2496379 - DNA, 14 bp, Homo sapiens
ctccaccttcccac

SEQ ID NO: 2496380 - DNA, 17 bp, Homo sapiens
ctccacgttctgctcat

SEQ ID NO: 2496381 - DNA, 18 bp, Homo sapiens
ctccacgttctgctcatc

SEQ ID NO: 2496382 - DNA, 13 bp, Homo sapiens
ctccactctgctt

SEQ ID NO: 2496383 - DNA, 15 bp, Homo sapiens
ctccactctgcttct

SEQ ID NO: 2496384 - DNA, 21 bp, Homo sapiens
ctccactctgcttctctgact

SEQ ID NO: 2496385 - DNA, 16 bp, Homo sapiens
ctccactttcagctgt

SEQ ID NO: 2496386 - DNA, 11 bp, Homo sapiens
ctccagacctg

SEQ ID NO: 2496387 - DNA, 21 bp, Homo sapiens
ctccagagggcactctgcttg

SEQ ID NO: 2496388 - DNA, 16 bp, Homo sapiens
ctccagatgcagggca

SEQ ID NO: 2496389 - DNA, 16 bp, Homo sapiens
ctccagcccctcttgg

SEQ ID NO: 2496390 - DNA, 18 bp, Homo sapiens
ctccagccgccggctgtg

SEQ ID NO: 2496391 - DNA, 12 bp, Homo sapiens
ctccagcctgac

SEQ ID NO: 2496392 - DNA, 21 bp, Homo sapiens
ctccagctccctgtgccccca

SEQ ID NO: 2496393 - DNA, 16 bp, Homo sapiens
ctccagctcctttggg

SEQ ID NO: 2496394 - DNA, 17 bp, Homo sapiens
ctccagctcctttgggc

SEQ ID NO: 2496395 - DNA, 11 bp, Homo sapiens
ctccagctgcc

SEQ ID NO: 2496396 - DNA, 13 bp, Homo sapiens
ctccagctttcct

SEQ ID NO: 2496397 - DNA, 15 bp, Homo sapiens
ctccagctttcctgt

SEQ ID NO: 2496398 - DNA, 16 bp, Homo sapiens
ctccagctttcctgta

SEQ ID NO: 2496399 - DNA, 19 bp, Homo sapiens
ctccaggaagccttcccct

SEQ ID NO: 2496400 - DNA, 16 bp, Homo sapiens
ctccaggcccaaggct

SEQ ID NO: 2496401 - DNA, 14 bp, Homo sapiens
ctccaggggctgct

SEQ ID NO: 2496402 - DNA, 16 bp, Homo sapiens
ctccagggtgtgtgct

SEQ ID NO: 2496403 - DNA, 14 bp, Homo sapiens
ctccaggtggctct

SEQ ID NO: 2496404 - DNA, 17 bp, Homo sapiens
ctccaggtggctctgag

SEQ ID NO: 2496405 - DNA, 19 bp, Homo sapiens
ctccagtgtcctgagctca

SEQ ID NO: 2496406 - DNA, 22 bp, Homo sapiens
ctccagtgtcctgagctcagcg

SEQ ID NO: 2496407 - DNA, 13 bp, Homo sapiens
ctccatccaaggc

SEQ ID NO: 2496408 - DNA, 11 bp, Homo sapiens
ctccatccctg

SEQ ID NO: 2496409 - DNA, 24 bp, Homo sapiens
ctccatccctggccccctccctgg

SEQ ID NO: 2496410 - DNA, 14 bp, Homo sapiens
ctccatctggtaga

SEQ ID NO: 2496411 - DNA, 14 bp, Homo sapiens
ctccattctgctcc

SEQ ID NO: 2496412 - DNA, 15 bp, Homo sapiens
ctccattctgctcct

SEQ ID NO: 2496413 - DNA, 22 bp, Homo sapiens
ctcccaaagtgctgagattaca

SEQ ID NO: 2496414 - DNA, 22 bp, Homo sapiens
ctcccaaagtgctgggattaca

SEQ ID NO: 2496415 - DNA, 19 bp, Homo sapiens
ctcccaatttcagactccc

SEQ ID NO: 2496416 - DNA, 21 bp, Homo sapiens
ctcccacaagcctctgcccag

SEQ ID NO: 2496417 - DNA, 23 bp, Homo sapiens
ctcccacaagcctctgcccaggc

SEQ ID NO: 2496418 - DNA, 15 bp, Homo sapiens
ctcccacaagcctga

SEQ ID NO: 2496419 - DNA, 21 bp, Homo sapiens
ctcccacagtcccatctgctt

SEQ ID NO: 2496420 - DNA, 22 bp, Homo sapiens
ctcccacccccatctctccctc

SEQ ID NO: 2496421 - DNA, 19 bp, Homo sapiens
ctcccacccggctgcagag

SEQ ID NO: 2496422 - DNA, 20 bp, Homo sapiens
ctcccaccctcttcctactg

SEQ ID NO: 2496423 - DNA, 18 bp, Homo sapiens
ctcccacctccccttggg

SEQ ID NO: 2496424 - DNA, 14 bp, Homo sapiens
ctcccacctgacac

SEQ ID NO: 2496425 - DNA, 16 bp, Homo sapiens
ctcccactctcctagg

SEQ ID NO: 2496426 - DNA, 21 bp, Homo sapiens
ctcccactctcctaggcattc

SEQ ID NO: 2496427 - DNA, 15 bp, Homo sapiens
ctcccagagcacctg

SEQ ID NO: 2496428 - DNA, 19 bp, Homo sapiens
ctcccagagcacctgctgt

SEQ ID NO: 2496429 - DNA, 19 bp, Homo sapiens
ctcccagaggagccaccag

SEQ ID NO: 2496430 - DNA, 22 bp, Homo sapiens
ctcccagaggagccaccagttc

SEQ ID NO: 2496431 - DNA, 23 bp, Homo sapiens
ctcccagaggagccaccagttct

SEQ ID NO: 2496432 - DNA, 21 bp, Homo sapiens
ctcccaggaccacaggctcag

SEQ ID NO: 2496433 - DNA, 18 bp, Homo sapiens
ctcccaggcaaggctgtg

SEQ ID NO: 2496434 - DNA, 22 bp, Homo sapiens
ctcccaggcaaggctgtggacc

SEQ ID NO: 2496435 - DNA, 19 bp, Homo sapiens
ctcccaggccccatgacct

SEQ ID NO: 2496436 - DNA, 21 bp, Homo sapiens
ctcccaggccccatgacctcc

SEQ ID NO: 2496437 - DNA, 16 bp, Homo sapiens
ctcccaggggctccct

SEQ ID NO: 2496438 - DNA, 19 bp, Homo sapiens
ctcccaggggctccctccg

SEQ ID NO: 2496439 - DNA, 20 bp, Homo sapiens
ctcccagggttttaactttg

SEQ ID NO: 2496440 - DNA, 15 bp, Homo sapiens
ctcccatccagggcc

SEQ ID NO: 2496441 - DNA, 13 bp, Homo sapiens
ctcccatcctgtg

SEQ ID NO: 2496442 - DNA, 15 bp, Homo sapiens
ctcccatcctgtgtg

SEQ ID NO: 2496443 - DNA, 19 bp, Homo sapiens
ctcccattcctgaagaacc

SEQ ID NO: 2496444 - DNA, 20 bp, Homo sapiens
ctccccaactgaccaccttt

SEQ ID NO: 2496445 - DNA, 15 bp, Homo sapiens
ctccccacgagggct

SEQ ID NO: 2496446 - DNA, 16 bp, Homo sapiens
ctccccacgagggctg

SEQ ID NO: 2496447 - DNA, 12 bp, Homo sapiens
ctccccactctg

SEQ ID NO: 2496448 - DNA, 13 bp, Homo sapiens
ctccccactctgc

SEQ ID NO: 2496449 - DNA, 17 bp, Homo sapiens
ctccccactctgctctg

SEQ ID NO: 2496450 - DNA, 19 bp, Homo sapiens
ctccccagcattccagccc

SEQ ID NO: 2496451 - DNA, 18 bp, Homo sapiens
ctccccagcccagagaca

SEQ ID NO: 2496452 - DNA, 16 bp, Homo sapiens
ctccccagctcccagg

SEQ ID NO: 2496453 - DNA, 17 bp, Homo sapiens
ctccccaggtccagctc

SEQ ID NO: 2496454 - DNA, 18 bp, Homo sapiens
ctccccaggtccagctct

SEQ ID NO: 2496455 - DNA, 20 bp, Homo sapiens
ctccccaggtccagctctgg

SEQ ID NO: 2496456 - DNA, 21 bp, Homo sapiens
ctccccatgtgtcctggttcc

SEQ ID NO: 2496457 - DNA, 16 bp, Homo sapiens
ctcccccaacagctgg

SEQ ID NO: 2496458 - DNA, 20 bp, Homo sapiens
ctcccccagcaaagccccca

SEQ ID NO: 2496459 - DNA, 22 bp, Homo sapiens
ctcccccagcaaagcccccaga

SEQ ID NO: 2496460 - DNA, 20 bp, Homo sapiens
ctcccccccatgcactgtga

SEQ ID NO: 2496461 - DNA, 14 bp, Homo sapiens
ctccccggctcgag

SEQ ID NO: 2496462 - DNA, 16 bp, Homo sapiens
ctcccctaaagcctca

SEQ ID NO: 2496463 - DNA, 12 bp, Homo sapiens
ctcccctcagcc

SEQ ID NO: 2496464 - DNA, 21 bp, Homo sapiens
ctcccctcagcctctcccctg

SEQ ID NO: 2496465 - DNA, 13 bp, Homo sapiens
ctcccctccagct

SEQ ID NO: 2496466 - DNA, 19 bp, Homo sapiens
ctcccctccatccctggcc

SEQ ID NO: 2496467 - DNA, 16 bp, Homo sapiens
ctcccctgacctgtga

SEQ ID NO: 2496468 - DNA, 15 bp, Homo sapiens
ctcccctgcactgta

SEQ ID NO: 2496469 - DNA, 18 bp, Homo sapiens
ctcccctgcactgtaaaa

SEQ ID NO: 2496470 - DNA, 21 bp, Homo sapiens
ctcccctgcactgtaaaatgt

SEQ ID NO: 2496471 - DNA, 13 bp, Homo sapiens
ctcccctgccacc

SEQ ID NO: 2496472 - DNA, 14 bp, Homo sapiens
ctcccctgccattt

SEQ ID NO: 2496473 - DNA, 13 bp, Homo sapiens
ctcccctgccccc

SEQ ID NO: 2496474 - DNA, 17 bp, Homo sapiens
ctcccctgccccctgca

SEQ ID NO: 2496475 - DNA, 18 bp, Homo sapiens
ctcccctgccccctgcag

SEQ ID NO: 2496476 - DNA, 19 bp, Homo sapiens
ctcccctgccccctgcagg

SEQ ID NO: 2496477 - DNA, 14 bp, Homo sapiens
ctcccgagctcctc

SEQ ID NO: 2496478 - DNA, 18 bp, Homo sapiens
ctcccgagctcctcttcc

SEQ ID NO: 2496479 - DNA, 18 bp, Homo sapiens
ctccctatactgcttgga

SEQ ID NO: 2496480 - DNA, 22 bp, Homo sapiens
ctccctcatcaaggacacgggc

SEQ ID NO: 2496481 - DNA, 18 bp, Homo sapiens
ctccctcccctgccattt

SEQ ID NO: 2496482 - DNA, 18 bp, Homo sapiens
ctccctccccttgcctgt

SEQ ID NO: 2496483 - DNA, 14 bp, Homo sapiens
ctccctccctctcc

SEQ ID NO: 2496484 - DNA, 15 bp, Homo sapiens
ctccctccctctccg

SEQ ID NO: 2496485 - DNA, 18 bp, Homo sapiens
ctccctccgcccccaggt

SEQ ID NO: 2496486 - DNA, 20 bp, Homo sapiens
ctccctccgcccccaggtag

SEQ ID NO: 2496487 - DNA, 12 bp, Homo sapiens
ctccctgagatg

SEQ ID NO: 2496488 - DNA, 20 bp, Homo sapiens
ctccctgcagaggggctgag

SEQ ID NO: 2496489 - DNA, 10 bp, Homo sapiens
ctccctgggg

SEQ ID NO: 2496490 - DNA, 13 bp, Homo sapiens
ctccctggtgctt

SEQ ID NO: 2496491 - DNA, 18 bp, Homo sapiens
ctccctggtgcttatgct

SEQ ID NO: 2496492 - DNA, 19 bp, Homo sapiens
ctccctgtaacctcttcag

SEQ ID NO: 2496493 - DNA, 15 bp, Homo sapiens
ctccctgtacagtgt

SEQ ID NO: 2496494 - DNA, 21 bp, Homo sapiens
ctcccttgggcacgtgtgctg

SEQ ID NO: 2496495 - DNA, 21 bp, Homo sapiens
ctccctttttatatcccattt

SEQ ID NO: 2496496 - DNA, 14 bp, Homo sapiens
ctccgagaggtggg

SEQ ID NO: 2496497 - DNA, 17 bp, Homo sapiens
ctccgagaggtgggcca

SEQ ID NO: 2496498 - DNA, 18 bp, Homo sapiens
ctccgagaggtgggccag

SEQ ID NO: 2496499 - DNA, 13 bp, Homo sapiens
ctccgccctgcca

SEQ ID NO: 2496500 - DNA, 14 bp, Homo sapiens
ctccgccctgccac

SEQ ID NO: 2496501 - DNA, 17 bp, Homo sapiens
ctccgccctgccactca

SEQ ID NO: 2496502 - DNA, 17 bp, Homo sapiens
ctccggaggactcacca

SEQ ID NO: 2496503 - DNA, 15 bp, Homo sapiens
ctccgggacctggtg

SEQ ID NO: 2496504 - DNA, 17 bp, Homo sapiens
ctcctaaagtactggga

SEQ ID NO: 2496505 - DNA, 17 bp, Homo sapiens
ctcctagttctagaaaa

SEQ ID NO: 2496506 - DNA, 23 bp, Homo sapiens
ctcctagttctagaaaaacaggc

SEQ ID NO: 2496507 - DNA, 14 bp, Homo sapiens
ctcctcactgtatc

SEQ ID NO: 2496508 - DNA, 19 bp, Homo sapiens
ctcctcactgtatccaggt

SEQ ID NO: 2496509 - DNA, 17 bp, Homo sapiens
ctcctcaggcacacagc

SEQ ID NO: 2496510 - DNA, 19 bp, Homo sapiens
ctcctcaggcacacagcta

SEQ ID NO: 2496511 - DNA, 21 bp, Homo sapiens
ctcctcaggcacacagctact

SEQ ID NO: 2496512 - DNA, 12 bp, Homo sapiens
ctcctcatcccg

SEQ ID NO: 2496513 - DNA, 15 bp, Homo sapiens
ctcctcatcccgtgt

SEQ ID NO: 2496514 - DNA, 20 bp, Homo sapiens
ctcctcatgtacataccctg

SEQ ID NO: 2496515 - DNA, 15 bp, Homo sapiens
ctcctccatgggaga

SEQ ID NO: 2496516 - DNA, 22 bp, Homo sapiens
ctcctcccacccggctgcagag

SEQ ID NO: 2496517 - DNA, 21 bp, Homo sapiens
ctcctcccagggttttaactt

SEQ ID NO: 2496518 - DNA, 16 bp, Homo sapiens
ctcctccctccctctc

SEQ ID NO: 2496519 - DNA, 15 bp, Homo sapiens
ctcctcctttttcca

SEQ ID NO: 2496520 - DNA, 13 bp, Homo sapiens
ctcctctgcactc

SEQ ID NO: 2496521 - DNA, 16 bp, Homo sapiens
ctcctctgctgacctg

SEQ ID NO: 2496522 - DNA, 20 bp, Homo sapiens
ctcctctgctgacctgctga

SEQ ID NO: 2496523 - DNA, 22 bp, Homo sapiens
ctcctctgtgaccaatgtcttg

SEQ ID NO: 2496524 - DNA, 11 bp, Homo sapiens
ctcctcttcca

SEQ ID NO: 2496525 - DNA, 15 bp, Homo sapiens
ctcctcttccccaga

SEQ ID NO: 2496526 - DNA, 17 bp, Homo sapiens
ctcctcttctactcact

SEQ ID NO: 2496527 - DNA, 17 bp, Homo sapiens
ctcctgacacccttctc

SEQ ID NO: 2496528 - DNA, 11 bp, Homo sapiens
tgagggcagtc

SEQ ID NO: 2496529 - DNA, 20 bp, Homo sapiens
tgagggcagttcgcagccac

SEQ ID NO: 2496530 - DNA, 23 bp, Homo sapiens
tgagggcagttcgcagccaccct

SEQ ID NO: 2496531 - DNA, 18 bp, Homo sapiens
tgagggcccgtgtaaata

SEQ ID NO: 2496532 - DNA, 18 bp, Homo sapiens
tgaggggaagctagtctt

SEQ ID NO: 2496533 - DNA, 14 bp, Homo sapiens
tgaggggaccagga

SEQ ID NO: 2496534 - DNA, 18 bp, Homo sapiens
tgaggggaccaggagtgg

SEQ ID NO: 2496535 - DNA, 13 bp, Homo sapiens
tgaggggttcctc

SEQ ID NO: 2496536 - DNA, 18 bp, Homo sapiens
tgaggggttcctcccctc

SEQ ID NO: 2496537 - DNA, 14 bp, Homo sapiens
tgagggtaagtatt

SEQ ID NO: 2496538 - DNA, 21 bp, Homo sapiens
tgagggtgcttgttccctctc

SEQ ID NO: 2496539 - DNA, 18 bp, Homo sapiens
tgaggtcctgagcactgc

SEQ ID NO: 2496540 - DNA, 20 bp, Homo sapiens
tgaggtcctgagcactgcca

SEQ ID NO: 2496541 - DNA, 23 bp, Homo sapiens
tgaggtcctgagcactgccagga

SEQ ID NO: 2496542 - DNA, 15 bp, Homo sapiens
tgaggtgcactggga

SEQ ID NO: 2496543 - DNA, 16 bp, Homo sapiens
tgaggtgcactgggag

SEQ ID NO: 2496544 - DNA, 12 bp, Homo sapiens
tgaggtgcccag

SEQ ID NO: 2496545 - DNA, 14 bp, Homo sapiens
tgaggtgcccagga

SEQ ID NO: 2496546 - DNA, 15 bp, Homo sapiens
tgaggtgcccaggag

SEQ ID NO: 2496547 - DNA, 18 bp, Homo sapiens
tgaggtgcccaggagaag

SEQ ID NO: 2496548 - DNA, 15 bp, Homo sapiens
tgagtaacatttgct

SEQ ID NO: 2496549 - DNA, 17 bp, Homo sapiens
tgagtaacatttgctgt

SEQ ID NO: 2496550 - DNA, 15 bp, Homo sapiens
tgagtaatggtgtag

SEQ ID NO: 2496551 - DNA, 11 bp, Homo sapiens
tgcaatgaaca

SEQ ID NO: 2496552 - DNA, 18 bp, Homo sapiens
tgcaatgtgtataaacaa

SEQ ID NO: 2496553 - DNA, 20 bp, Homo sapiens
tgcaatgtgtgtatatggac

SEQ ID NO: 2496554 - DNA, 17 bp, Homo sapiens
tgcaattcaaaagttcc

SEQ ID NO: 2496555 - DNA, 21 bp, Homo sapiens
tgcaattgccttttttctgta

SEQ ID NO: 2496556 - DNA, 17 bp, Homo sapiens
tgcaatttcaaggttct

SEQ ID NO: 2496557 - DNA, 19 bp, Homo sapiens
tgcacaaaacccagacctg

SEQ ID NO: 2496558 - DNA, 22 bp, Homo sapiens
tgcacaataactcctcccaggg

SEQ ID NO: 2496559 - DNA, 17 bp, Homo sapiens
tgcacactttggtacca

SEQ ID NO: 2496560 - DNA, 13 bp, Homo sapiens
tgcacaggagggg

SEQ ID NO: 2496561 - DNA, 16 bp, Homo sapiens
tgcacagtatttgtaa

SEQ ID NO: 2496562 - DNA, 15 bp, Homo sapiens
tgcacagtgacttct

SEQ ID NO: 2496563 - DNA, 20 bp, Homo sapiens
tgcacagtgacttctgagat

SEQ ID NO: 2496564 - DNA, 21 bp, Homo sapiens
tgcacagtgacttctgagatc

SEQ ID NO: 2496565 - DNA, 14 bp, Homo sapiens
tgcacatgaactta

SEQ ID NO: 2496566 - DNA, 21 bp, Homo sapiens
tgcacatgactcgggggtggg

SEQ ID NO: 2496567 - DNA, 22 bp, Homo sapiens
tgcacatttatttcctccctct

SEQ ID NO: 2496568 - DNA, 22 bp, Homo sapiens
tgcaccaagcaggaaatgaaaa

SEQ ID NO: 2496569 - DNA, 22 bp, Homo sapiens
tgcaccatgctgctggggaaga

SEQ ID NO: 2496570 - DNA, 23 bp, Homo sapiens
tgcaccccaaagctttcctgccc

SEQ ID NO: 2496571 - DNA, 18 bp, Homo sapiens
tgcacgaccgccccagtt

SEQ ID NO: 2496572 - DNA, 21 bp, Homo sapiens
tgcacgtaaagtacttgtagt

SEQ ID NO: 2496573 - DNA, 14 bp, Homo sapiens
tgcacgtggcctct

SEQ ID NO: 2496574 - DNA, 15 bp, Homo sapiens
tgcacgtggcctctt

SEQ ID NO: 2496575 - DNA, 17 bp, Homo sapiens
tgcacgtggcctcttga

SEQ ID NO: 2496576 - DNA, 19 bp, Homo sapiens
tgcacgtggcctcttgagc

SEQ ID NO: 2496577 - DNA, 11 bp, Homo sapiens
tgcacgtgtgt

SEQ ID NO: 2496578 - DNA, 22 bp, Homo sapiens
tgcacgtgtgtttttctattaa

SEQ ID NO: 2496579 - DNA, 17 bp, Homo sapiens
tgcactaacagagtggc

SEQ ID NO: 2496580 - DNA, 18 bp, Homo sapiens
tgcactactgacatgtgg

SEQ ID NO: 2496581 - DNA, 15 bp, Homo sapiens
tgcactcccacctga

SEQ ID NO: 2496582 - DNA, 14 bp, Homo sapiens
tgcactgatgttgt

SEQ ID NO: 2496583 - DNA, 17 bp, Homo sapiens
tgcactgggaggctccc

SEQ ID NO: 2496584 - DNA, 20 bp, Homo sapiens
tgcactgggaggctcccctt

SEQ ID NO: 2496585 - DNA, 17 bp, Homo sapiens
tgcactgtaaaatgtgg

SEQ ID NO: 2496586 - DNA, 22 bp, Homo sapiens
tgcactttgctttaatataaat

SEQ ID NO: 2496587 - DNA, 20 bp, Homo sapiens
tgcagaaccggagagccagc

SEQ ID NO: 2496588 - DNA, 21 bp, Homo sapiens
tgcagaaccggagagccagct

SEQ ID NO: 2496589 - DNA, 15 bp, Homo sapiens
tgcagacttcccagc

SEQ ID NO: 2496590 - DNA, 16 bp, Homo sapiens
tgcagacttcccagct

SEQ ID NO: 2496591 - DNA, 19 bp, Homo sapiens
tgcagaggcctgcagggcc

SEQ ID NO: 2496592 - DNA, 14 bp, Homo sapiens
tgcagccgctgagc

SEQ ID NO: 2496593 - DNA, 14 bp, Homo sapiens
tgcagcctcagaga

SEQ ID NO: 2496594 - DNA, 20 bp, Homo sapiens
tgcagcctcagagacatcag

SEQ ID NO: 2496595 - DNA, 20 bp, Homo sapiens
tgcagcctcaggactgggag

SEQ ID NO: 2496596 - DNA, 22 bp, Homo sapiens
tgcagctgtggcagagttacag

SEQ ID NO: 2496597 - DNA, 23 bp, Homo sapiens
tgcagctgttttgttgacattct

SEQ ID NO: 2496598 - DNA, 14 bp, Homo sapiens
tgcaggaaggagct

SEQ ID NO: 2496599 - DNA, 19 bp, Homo sapiens
tgcaggatctcaccaggca

SEQ ID NO: 2496600 - DNA, 20 bp, Homo sapiens
tgcaggatctcaccaggcag

SEQ ID NO: 2496601 - DNA, 21 bp, Homo sapiens
tgcaggatctcaccaggcagc

SEQ ID NO: 2496602 - DNA, 18 bp, Homo sapiens
tgcaggatggtgtctctt

SEQ ID NO: 2496603 - DNA, 17 bp, Homo sapiens
tgcaggccctggcctcc

SEQ ID NO: 2496604 - DNA, 21 bp, Homo sapiens
tgcagggaaaattatttgcat

SEQ ID NO: 2496605 - DNA, 15 bp, Homo sapiens
tgcagggtcctcttc

SEQ ID NO: 2496606 - DNA, 19 bp, Homo sapiens
tgcagggtcctcttctggg

SEQ ID NO: 2496607 - DNA, 20 bp, Homo sapiens
tgcaggtggccaagttcctc

SEQ ID NO: 2496608 - DNA, 13 bp, Homo sapiens
tgcagtaaatctt

SEQ ID NO: 2496609 - DNA, 14 bp, Homo sapiens
tgcagtaaatcttt

SEQ ID NO: 2496610 - DNA, 15 bp, Homo sapiens
tgcagtaaatctttt

SEQ ID NO: 2496611 - DNA, 18 bp, Homo sapiens
tgcagtaactgtttttta

SEQ ID NO: 2496612 - DNA, 13 bp, Homo sapiens
tgcagtcccaagc

SEQ ID NO: 2496613 - DNA, 19 bp, Homo sapiens
tgcagtcctgatcagagcc

SEQ ID NO: 2496614 - DNA, 17 bp, Homo sapiens
tgcagtttatcattcaa

SEQ ID NO: 2496615 - DNA, 13 bp, Homo sapiens
tgcatatgttgaa

SEQ ID NO: 2496616 - DNA, 15 bp, Homo sapiens
tgcatatgttgaata

SEQ ID NO: 2496617 - DNA, 15 bp, Homo sapiens
tgcatatttgtttat

SEQ ID NO: 2496618 - DNA, 17 bp, Homo sapiens
tgcatcagaaagggagg

SEQ ID NO: 2496619 - DNA, 22 bp, Homo sapiens
tgcatcagaaagggagggctct

SEQ ID NO: 2496620 - DNA, 19 bp, Homo sapiens
tgcatccattctcctgagg

SEQ ID NO: 2496621 - DNA, 23 bp, Homo sapiens
tgcatcccaaaccacgcctcttg

SEQ ID NO: 2496622 - DNA, 19 bp, Homo sapiens
tgcatcctctggagccagc

SEQ ID NO: 2496623 - DNA, 22 bp, Homo sapiens
tgcatcctctggagccagccga

SEQ ID NO: 2496624 - DNA, 13 bp, Homo sapiens
tgcatctcccaga

SEQ ID NO: 2496625 - DNA, 18 bp, Homo sapiens
tgcatctcccagataatg

SEQ ID NO: 2496626 - DNA, 19 bp, Homo sapiens
tgcatgcactgttccccct

SEQ ID NO: 2496627 - DNA, 22 bp, Homo sapiens
tgcatgcactgttccccctgtg

SEQ ID NO: 2496628 - DNA, 23 bp, Homo sapiens
tgcatgcccagagacccagcgga

SEQ ID NO: 2496629 - DNA, 14 bp, Homo sapiens
tgcatggatttctt

SEQ ID NO: 2496630 - DNA, 23 bp, Homo sapiens
tgcatggcagggggctgctgctg

SEQ ID NO: 2496631 - DNA, 20 bp, Homo sapiens
tgcatggcatcctccagccc

SEQ ID NO: 2496632 - DNA, 21 bp, Homo sapiens
tgcatggcatcctccagcccc

SEQ ID NO: 2496633 - DNA, 20 bp, Homo sapiens
tgcatggtgccccaggacca

SEQ ID NO: 2496634 - DNA, 17 bp, Homo sapiens
tgcatgtactgtatatt

SEQ ID NO: 2496635 - DNA, 20 bp, Homo sapiens
tgcatgttgtctaagaaatt

SEQ ID NO: 2496636 - DNA, 21 bp, Homo sapiens
tgcatgttgtctaagaaattg

SEQ ID NO: 2496637 - DNA, 17 bp, Homo sapiens
tgcattaaattacagaa

SEQ ID NO: 2496638 - DNA, 13 bp, Homo sapiens
tgcattaaattca

SEQ ID NO: 2496639 - DNA, 16 bp, Homo sapiens
tgcattaaattcacaa

SEQ ID NO: 2496640 - DNA, 19 bp, Homo sapiens
tgcattagggatgcctcct

SEQ ID NO: 2496641 - DNA, 13 bp, Homo sapiens
tgcattatgcaat

SEQ ID NO: 2496642 - DNA, 23 bp, Homo sapiens
tgcattcgaagaaacccttgctg

SEQ ID NO: 2496643 - DNA, 12 bp, Homo sapiens
tgcattctagta

SEQ ID NO: 2496644 - DNA, 14 bp, Homo sapiens
tgcattctgcctct

SEQ ID NO: 2496645 - DNA, 15 bp, Homo sapiens
tgcattcttctctgt

SEQ ID NO: 2496646 - DNA, 13 bp, Homo sapiens
tgcattgaacaca

SEQ ID NO: 2496647 - DNA, 17 bp, Homo sapiens
tgcattgaacacaaact

SEQ ID NO: 2496648 - DNA, 23 bp, Homo sapiens
tgcattgaacacaaactgtaaat

SEQ ID NO: 2496649 - DNA, 20 bp, Homo sapiens
tgcattgaccgcgactaatt

SEQ ID NO: 2496650 - DNA, 21 bp, Homo sapiens
tgcattggaactggaggcagg

SEQ ID NO: 2496651 - DNA, 22 bp, Homo sapiens
tgcattggaactggaggcaggg

SEQ ID NO: 2496652 - DNA, 16 bp, Homo sapiens
tgcatttaaatacagt

SEQ ID NO: 2496653 - DNA, 16 bp, Homo sapiens
tgcatttgatacattt

SEQ ID NO: 2496654 - DNA, 16 bp, Homo sapiens
tgcctcaatgccagta

SEQ ID NO: 2496655 - DNA, 14 bp, Homo sapiens
tgcctcacttcagg

SEQ ID NO: 2496656 - DNA, 15 bp, Homo sapiens
tgcctcagagaccag

SEQ ID NO: 2496657 - DNA, 19 bp, Homo sapiens
tgcctcagagaccagggct

SEQ ID NO: 2496658 - DNA, 21 bp, Homo sapiens
tgcctcaggaggcaggacctt

SEQ ID NO: 2496659 - DNA, 23 bp, Homo sapiens
tgcctccctctcgtaagatttcc

SEQ ID NO: 2496660 - DNA, 19 bp, Homo sapiens
tgcctccgtcccctgccca

SEQ ID NO: 2496661 - DNA, 15 bp, Homo sapiens
tgcctcctccctccc

SEQ ID NO: 2496662 - DNA, 21 bp, Homo sapiens
tgcctcctgccggctccttgg

SEQ ID NO: 2496663 - DNA, 13 bp, Homo sapiens
tgcctccttcctc

SEQ ID NO: 2496664 - DNA, 21 bp, Homo sapiens
tgcctcgaaacacagaaacct

SEQ ID NO: 2496665 - DNA, 20 bp, Homo sapiens
tgcctcggcctcccaaagtg

SEQ ID NO: 2496666 - DNA, 15 bp, Homo sapiens
tgcctctacctgaca

SEQ ID NO: 2496667 - DNA, 17 bp, Homo sapiens
tgcctctacctgacact

SEQ ID NO: 2496668 - DNA, 16 bp, Homo sapiens
tgcctctactgggaag

SEQ ID NO: 2496669 - DNA, 23 bp, Homo sapiens
tgcctctactgggaaggctactt

SEQ ID NO: 2496670 - DNA, 13 bp, Homo sapiens
tgcctctcccagg

SEQ ID NO: 2496671 - DNA, 17 bp, Homo sapiens
tgcctctcccaggcagg

SEQ ID NO: 2496672 - DNA, 11 bp, Homo sapiens
tgcctctgagg

SEQ ID NO: 2496673 - DNA, 13 bp, Homo sapiens
tgcctctgaggcc

SEQ ID NO: 2496674 - DNA, 19 bp, Homo sapiens
tgcctctgaggccagcctg

SEQ ID NO: 2496675 - DNA, 21 bp, Homo sapiens
tgcctctgaggccagcctggc

SEQ ID NO: 2496676 - DNA, 16 bp, Homo sapiens
tgcctctgtcttctgg

SEQ ID NO: 2496677 - DNA, 20 bp, Homo sapiens
tgcctcttctgggagggcag

SEQ ID NO: 2496678 - DNA, 21 bp, Homo sapiens
tgcctcttctgggagggcagc

SEQ ID NO: 2496679 - DNA, 13 bp, Homo sapiens
tgcctgacacact

SEQ ID NO: 2496680 - DNA, 18 bp, Homo sapiens
tgcctgacatttggagtg

SEQ ID NO: 2496681 - DNA, 22 bp, Homo sapiens
tgcctgcctttccatccatggc

SEQ ID NO: 2496682 - DNA, 15 bp, Homo sapiens
tgcctgctcccatcc

SEQ ID NO: 2496683 - DNA, 20 bp, Homo sapiens
tgcctgctcccatcctgtgt

SEQ ID NO: 2496684 - DNA, 19 bp, Homo sapiens
tgcctggaggacctgagcc

SEQ ID NO: 2496685 - DNA, 15 bp, Homo sapiens
tgcctggtacagtat

SEQ ID NO: 2496686 - DNA, 23 bp, Homo sapiens
tgcctgtgccaggtgaggtcagc

SEQ ID NO: 2496687 - DNA, 19 bp, Homo sapiens
tgcctgtgctacaattcat

SEQ ID NO: 2496688 - DNA, 14 bp, Homo sapiens
tgcctgtggccatg

SEQ ID NO: 2496689 - DNA, 11 bp, Homo sapiens
tgcctgtggcg

SEQ ID NO: 2496690 - DNA, 19 bp, Homo sapiens
tgcctgtgtccatgcgctc

SEQ ID NO: 2496691 - DNA, 22 bp, Homo sapiens
tgcctgtgtccatgcgctcagg

SEQ ID NO: 2496692 - DNA, 19 bp, Homo sapiens
tgcctgtttcccaggccca

SEQ ID NO: 2496693 - DNA, 21 bp, Homo sapiens
tgccttattagagtgtctttc

SEQ ID NO: 2496694 - DNA, 14 bp, Homo sapiens
tgccttcctcctgg

SEQ ID NO: 2496695 - DNA, 14 bp, Homo sapiens
tgccttcgcttctt

SEQ ID NO: 2496696 - DNA, 16 bp, Homo sapiens
tgccttcgcttcttgc

SEQ ID NO: 2496697 - DNA, 13 bp, Homo sapiens
tgccttctctctc

SEQ ID NO: 2496698 - DNA, 16 bp, Homo sapiens
tgccttgttttttgtt

SEQ ID NO: 2496699 - DNA, 22 bp, Homo sapiens
tgcctttaacagaaactttcaa

SEQ ID NO: 2496700 - DNA, 23 bp, Homo sapiens
tgcctttaacagaaactttcaaa

SEQ ID NO: 2496701 - DNA, 17 bp, Homo sapiens
tgcctttatttccactg

SEQ ID NO: 2496702 - DNA, 19 bp, Homo sapiens
tgcctttcaggatctattt

SEQ ID NO: 2496703 - DNA, 20 bp, Homo sapiens
tgcctttccatccatggcca

SEQ ID NO: 2496704 - DNA, 22 bp, Homo sapiens
tgcctttccatccatggccagc

SEQ ID NO: 2496705 - DNA, 14 bp, Homo sapiens
tgccttttttgatc

SEQ ID NO: 2496706 - DNA, 17 bp, Homo sapiens
tgcgactttctgcctgg

SEQ ID NO: 2496707 - DNA, 18 bp, Homo sapiens
tgcgactttctgcctgga

SEQ ID NO: 2496708 - DNA, 15 bp, Homo sapiens
tgcgagagatgtgtg

SEQ ID NO: 2496709 - DNA, 17 bp, Homo sapiens
tgcgagagatgtgtgtt

SEQ ID NO: 2496710 - DNA, 23 bp, Homo sapiens
tgcgagagatgtgtgttgatact

SEQ ID NO: 2496711 - DNA, 13 bp, Homo sapiens
tgcgatagagtct

SEQ ID NO: 2496712 - DNA, 14 bp, Homo sapiens
tgcgatagagtctc

SEQ ID NO: 2496713 - DNA, 16 bp, Homo sapiens
tgcgatagagtctcac

SEQ ID NO: 2496714 - DNA, 18 bp, Homo sapiens
tgcgcccagggctgggag

SEQ ID NO: 2496715 - DNA, 17 bp, Homo sapiens
tgcgctcctggcccagc

SEQ ID NO: 2496716 - DNA, 18 bp, Homo sapiens
tgcgctcctggcccagcc

SEQ ID NO: 2496717 - DNA, 15 bp, Homo sapiens
tgcggctcctcaggg

SEQ ID NO: 2496718 - DNA, 14 bp, Homo sapiens
tgcggctggccatg

SEQ ID NO: 2496719 - DNA, 13 bp, Homo sapiens
tgcggctgtgtgt

SEQ ID NO: 2496720 - DNA, 16 bp, Homo sapiens
tgcgggtgagagtaat

SEQ ID NO: 2496721 - DNA, 19 bp, Homo sapiens
tgcggttataaaaaatggt

SEQ ID NO: 2496722 - DNA, 19 bp, Homo sapiens
tgcgtccacgagctgttta

SEQ ID NO: 2496723 - DNA, 18 bp, Homo sapiens
tgcgtgggagtgtgtgcc

SEQ ID NO: 2496724 - DNA, 21 bp, Homo sapiens
tgcgtggtggtccctgggtag

SEQ ID NO: 2496725 - DNA, 12 bp, Homo sapiens
tgctaaagacat

SEQ ID NO: 2496726 - DNA, 13 bp, Homo sapiens
tgctaagagaagt

SEQ ID NO: 2496727 - DNA, 15 bp, Homo sapiens
tgctaaggtcttgga

SEQ ID NO: 2496728 - DNA, 12 bp, Homo sapiens
tgctaaggttct

SEQ ID NO: 2496729 - DNA, 17 bp, Homo sapiens
tgctaaggttctaaggc

SEQ ID NO: 2496730 - DNA, 20 bp, Homo sapiens
tgctaatattttcctcctga

SEQ ID NO: 2496731 - DNA, 22 bp, Homo sapiens
tgctaatcagggaggtcatttt

SEQ ID NO: 2496732 - DNA, 13 bp, Homo sapiens
tgctaatttgttt

SEQ ID NO: 2496733 - DNA, 15 bp, Homo sapiens
tgctaccaccagctg

SEQ ID NO: 2496734 - DNA, 17 bp, Homo sapiens
tgctaccaccagctgtg

SEQ ID NO: 2496735 - DNA, 18 bp, Homo sapiens
tgctaccaccagctgtgt

SEQ ID NO: 2496736 - DNA, 21 bp, Homo sapiens
tgctaccaccagctgtgtcca

SEQ ID NO: 2496737 - DNA, 19 bp, Homo sapiens
tgctactggggaaactggc

SEQ ID NO: 2496738 - DNA, 14 bp, Homo sapiens
tgctagagctcctc

SEQ ID NO: 2496739 - DNA, 17 bp, Homo sapiens
tgctaggccagagccca

SEQ ID NO: 2496740 - DNA, 12 bp, Homo sapiens
tgctaggttcta

SEQ ID NO: 2496741 - DNA, 13 bp, Homo sapiens
tgctaggttctac

SEQ ID NO: 2496742 - DNA, 15 bp, Homo sapiens
tgctattctgtccct

SEQ ID NO: 2496743 - DNA, 17 bp, Homo sapiens
tgctattctgtccctag

SEQ ID NO: 2496744 - DNA, 13 bp, Homo sapiens
tgctcaaggccag

SEQ ID NO: 2496745 - DNA, 16 bp, Homo sapiens
tgctcaaggccagctt

SEQ ID NO: 2496746 - DNA, 14 bp, Homo sapiens
tgctcacccagtgc

SEQ ID NO: 2496747 - DNA, 17 bp, Homo sapiens
tgctcacgtcaaatgca

SEQ ID NO: 2496748 - DNA, 19 bp, Homo sapiens
tgctcagccctgaggacag

SEQ ID NO: 2496749 - DNA, 13 bp, Homo sapiens
tgctcagccctgc

SEQ ID NO: 2496750 - DNA, 20 bp, Homo sapiens
tgctcagctctgggccattc

SEQ ID NO: 2496751 - DNA, 21 bp, Homo sapiens
tgctcagggggcgcctgtggt

SEQ ID NO: 2496752 - DNA, 16 bp, Homo sapiens
tgctcagggtcaattt

SEQ ID NO: 2496753 - DNA, 20 bp, Homo sapiens
tgctcagggtcaatttcttt

SEQ ID NO: 2496754 - DNA, 17 bp, Homo sapiens
tgctcaggtacttgtaa

SEQ ID NO: 2496755 - DNA, 19 bp, Homo sapiens
tgctcatcattctctgtct

SEQ ID NO: 2496756 - DNA, 16 bp, Homo sapiens
tgctccaagattctag

SEQ ID NO: 2496757 - DNA, 18 bp, Homo sapiens
tgctccaagattctagat

SEQ ID NO: 2496758 - DNA, 15 bp, Homo sapiens
tgctttctcctttaa

SEQ ID NO: 2496759 - DNA, 20 bp, Homo sapiens
tgctttctcctttaattgta

SEQ ID NO: 2496760 - DNA, 14 bp, Homo sapiens
tgctttctgttcca

SEQ ID NO: 2496761 - DNA, 14 bp, Homo sapiens
tgctttctgtttct

SEQ ID NO: 2496762 - DNA, 20 bp, Homo sapiens
tgctttgaagtagctctttt

SEQ ID NO: 2496763 - DNA, 15 bp, Homo sapiens
tgctttgagagagaa

SEQ ID NO: 2496764 - DNA, 22 bp, Homo sapiens
tgctttgcccttctttctaccc

SEQ ID NO: 2496765 - DNA, 15 bp, Homo sapiens
tgctttgggaagccg

SEQ ID NO: 2496766 - DNA, 14 bp, Homo sapiens
tgcttttcagctga

SEQ ID NO: 2496767 - DNA, 17 bp, Homo sapiens
tgcttttccctttgtga

SEQ ID NO: 2496768 - DNA, 18 bp, Homo sapiens
tgcttttgcccattttga

SEQ ID NO: 2496769 - DNA, 19 bp, Homo sapiens
tgctttttatttctgcata

SEQ ID NO: 2496770 - DNA, 14 bp, Homo sapiens
tgctttttccaact

SEQ ID NO: 2496771 - DNA, 21 bp, Homo sapiens
tgctttttccaactcagaaat

SEQ ID NO: 2496772 - DNA, 17 bp, Homo sapiens
tgctttttttgtgtgta

SEQ ID NO: 2496773 - DNA, 14 bp, Homo sapiens
tgcttttttttcct

SEQ ID NO: 2496774 - DNA, 17 bp, Homo sapiens
tgcttttttttccttct

SEQ ID NO: 2496775 - DNA, 19 bp, Homo sapiens
tggaaagtacactctgctg

SEQ ID NO: 2496776 - DNA, 20 bp, Homo sapiens
tggaaagtacactctgctgt

SEQ ID NO: 2496777 - DNA, 12 bp, Homo sapiens
tggaaataaagt

SEQ ID NO: 2496778 - DNA, 14 bp, Homo sapiens
tggaaatatatatt

SEQ ID NO: 2496779 - DNA, 17 bp, Homo sapiens
tggaacacggccacatc

SEQ ID NO: 2496780 - DNA, 12 bp, Homo sapiens
tggaacccagac

SEQ ID NO: 2496781 - DNA, 15 bp, Homo sapiens
tggaacccagactca

SEQ ID NO: 2496782 - DNA, 16 bp, Homo sapiens
tggaacccagactcag

SEQ ID NO: 2496783 - DNA, 22 bp, Homo sapiens
tggaacccagactcagacattg

SEQ ID NO: 2496784 - DNA, 16 bp, Homo sapiens
tggaacctcagcctgg

SEQ ID NO: 2496785 - DNA, 23 bp, Homo sapiens
tggaacctcagcctggccagaca

SEQ ID NO: 2496786 - DNA, 13 bp, Homo sapiens
tggaaccttgttt

SEQ ID NO: 2496787 - DNA, 17 bp, Homo sapiens
tggaactacattactgt

SEQ ID NO: 2496788 - DNA, 15 bp, Homo sapiens
tggaactgaaggggg

SEQ ID NO: 2496789 - DNA, 17 bp, Homo sapiens
tggaactggaggcaggg

SEQ ID NO: 2496790 - DNA, 16 bp, Homo sapiens
tggaagatagctgtga

SEQ ID NO: 2496791 - DNA, 21 bp, Homo sapiens
tggaagatcctgcgggtgggg

SEQ ID NO: 2496792 - DNA, 18 bp, Homo sapiens
tggaagctaatttgcatt

SEQ ID NO: 2496793 - DNA, 20 bp, Homo sapiens
tggaagctagacacatgaag

SEQ ID NO: 2496794 - DNA, 16 bp, Homo sapiens
tggaagggaggtgggc

SEQ ID NO: 2496795 - DNA, 17 bp, Homo sapiens
tggaagtccaatgtggc

SEQ ID NO: 2496796 - DNA, 18 bp, Homo sapiens
tggaagtgaaaactttgt

SEQ ID NO: 2496797 - DNA, 13 bp, Homo sapiens
tggaatacttttt

SEQ ID NO: 2496798 - DNA, 18 bp, Homo sapiens
tggaatactttttgttat

SEQ ID NO: 2496799 - DNA, 14 bp, Homo sapiens
tggaatataattgt

SEQ ID NO: 2496800 - DNA, 19 bp, Homo sapiens
tggaattgatttgcattga

SEQ ID NO: 2496801 - DNA, 23 bp, Homo sapiens
tggaattgatttgcattgaacac

SEQ ID NO: 2496802 - DNA, 23 bp, Homo sapiens
tggaattttgcaaagatttaatc

SEQ ID NO: 2496803 - DNA, 19 bp, Homo sapiens
tggacaaaacaagaaagac

SEQ ID NO: 2496804 - DNA, 15 bp, Homo sapiens
tggacaaagaacctt

SEQ ID NO: 2496805 - DNA, 21 bp, Homo sapiens
tggacaaatcacatattttaa

SEQ ID NO: 2496806 - DNA, 22 bp, Homo sapiens
tggacaaatcacatattttaaa

SEQ ID NO: 2496807 - DNA, 16 bp, Homo sapiens
tggacaagcttctgag

SEQ ID NO: 2496808 - DNA, 17 bp, Homo sapiens
tggacaagcttctgaga

SEQ ID NO: 2496809 - DNA, 19 bp, Homo sapiens
tggacaagcttctgagacg

SEQ ID NO: 2496810 - DNA, 18 bp, Homo sapiens
tggacacctttaggttct

SEQ ID NO: 2496811 - DNA, 15 bp, Homo sapiens
tggacacgctcagtg

SEQ ID NO: 2496812 - DNA, 22 bp, Homo sapiens
tggacacgctcagtggggcaga

SEQ ID NO: 2496813 - DNA, 15 bp, Homo sapiens
tggacactcagacct

SEQ ID NO: 2496814 - DNA, 12 bp, Homo sapiens
tggacagcccca

SEQ ID NO: 2496815 - DNA, 14 bp, Homo sapiens
tggacagctgtgcc

SEQ ID NO: 2496816 - DNA, 18 bp, Homo sapiens
tggacagctgtgcctcgc

SEQ ID NO: 2496817 - DNA, 19 bp, Homo sapiens
tggacagctgtgcctcgct

SEQ ID NO: 2496818 - DNA, 13 bp, Homo sapiens
tggacaggatgtg

SEQ ID NO: 2496819 - DNA, 14 bp, Homo sapiens
tggacaggctggct

SEQ ID NO: 2496820 - DNA, 14 bp, Homo sapiens
tggacatcctcctc

SEQ ID NO: 2496821 - DNA, 18 bp, Homo sapiens
tggacatcctcctcccac

SEQ ID NO: 2496822 - DNA, 18 bp, Homo sapiens
tggacatgaagattcttt

SEQ ID NO: 2496823 - DNA, 17 bp, Homo sapiens
tggacccccctttcaca

SEQ ID NO: 2496824 - DNA, 20 bp, Homo sapiens
tggacccccctttcacaggc

SEQ ID NO: 2496825 - DNA, 12 bp, Homo sapiens
tggacccctgca

SEQ ID NO: 2496826 - DNA, 22 bp, Homo sapiens
tggacccgttcatgggggaggg

SEQ ID NO: 2496827 - DNA, 18 bp, Homo sapiens
tggaccggagagtggggg

SEQ ID NO: 2496828 - DNA, 21 bp, Homo sapiens
tggacctaaatggcctcatgt

SEQ ID NO: 2496829 - DNA, 19 bp, Homo sapiens
tggacctctgacagcagca

SEQ ID NO: 2496830 - DNA, 22 bp, Homo sapiens
tggacctctgacagcagcatct

SEQ ID NO: 2496831 - DNA, 22 bp, Homo sapiens
tggactatctgtctggtggccc

SEQ ID NO: 2496832 - DNA, 23 bp, Homo sapiens
tggactatctgtctggtggcccc

SEQ ID NO: 2496833 - DNA, 18 bp, Homo sapiens
tggactcagggcagcgcc

SEQ ID NO: 2496834 - DNA, 15 bp, Homo sapiens
tggactctcagtctc

SEQ ID NO: 2496835 - DNA, 22 bp, Homo sapiens
tggactctcagtctctgagcag

SEQ ID NO: 2496836 - DNA, 13 bp, Homo sapiens
tggactctgtcct

SEQ ID NO: 2496837 - DNA, 17 bp, Homo sapiens
tggactgagtgggaagc

SEQ ID NO: 2496838 - DNA, 19 bp, Homo sapiens
tggactgagtgggaagccc

SEQ ID NO: 2496839 - DNA, 17 bp, Homo sapiens
tggactgttttctctcg

SEQ ID NO: 2496840 - DNA, 15 bp, Homo sapiens
tggagaaagctgact

SEQ ID NO: 2496841 - DNA, 22 bp, Homo sapiens
tggagaaagggccctgggcctg

SEQ ID NO: 2496842 - DNA, 15 bp, Homo sapiens
tggagaagtctcagc

SEQ ID NO: 2496843 - DNA, 18 bp, Homo sapiens
tggagactgtgtgtgccc

SEQ ID NO: 2496844 - DNA, 16 bp, Homo sapiens
tggagacttagggcac

SEQ ID NO: 2496845 - DNA, 13 bp, Homo sapiens
tggagagccctgg

SEQ ID NO: 2496846 - DNA, 20 bp, Homo sapiens
tggagagccctgggaccgct

SEQ ID NO: 2496847 - DNA, 14 bp, Homo sapiens
tggagatcctcctg

SEQ ID NO: 2496848 - DNA, 20 bp, Homo sapiens
tggagatcctcctgcagacc

SEQ ID NO: 2496849 - DNA, 16 bp, Homo sapiens
tggagattgacctgga

SEQ ID NO: 2496850 - DNA, 21 bp, Homo sapiens
tggagccagccgagcaggagg

SEQ ID NO: 2496851 - DNA, 22 bp, Homo sapiens
tggagccagccgagcaggaggc

SEQ ID NO: 2496852 - DNA, 16 bp, Homo sapiens
tggagctccagcctga

SEQ ID NO: 2496853 - DNA, 18 bp, Homo sapiens
tggaggaagagggacaga

SEQ ID NO: 2496854 - DNA, 13 bp, Homo sapiens
tggaggacctgag

SEQ ID NO: 2496855 - DNA, 18 bp, Homo sapiens
tggaggccccaaccctgt

SEQ ID NO: 2496856 - DNA, 12 bp, Homo sapiens
tggaggctgctc

SEQ ID NO: 2496857 - DNA, 13 bp, Homo sapiens
tggagggaggctg

SEQ ID NO: 2496858 - DNA, 13 bp, Homo sapiens
tggaggggtgtgg

SEQ ID NO: 2496859 - DNA, 23 bp, Homo sapiens
tggaggggtgtggctccttccca

SEQ ID NO: 2496860 - DNA, 15 bp, Homo sapiens
tggaggttctaaggc

SEQ ID NO: 2496861 - DNA, 16 bp, Homo sapiens
tggagtcaaaaagaac

SEQ ID NO: 2496862 - DNA, 21 bp, Homo sapiens
tgggcaaagcctagtgaaggc

SEQ ID NO: 2496863 - DNA, 15 bp, Homo sapiens
tgggcacccccagcc

SEQ ID NO: 2496864 - DNA, 17 bp, Homo sapiens
tgggcacccccagcctg

SEQ ID NO: 2496865 - DNA, 14 bp, Homo sapiens
tgggcagagctggc

SEQ ID NO: 2496866 - DNA, 20 bp, Homo sapiens
tgggcagagctggctctgag

SEQ ID NO: 2496867 - DNA, 13 bp, Homo sapiens
tgggccagacatg

SEQ ID NO: 2496868 - DNA, 19 bp, Homo sapiens
tgggccagacatgccacaa

SEQ ID NO: 2496869 - DNA, 14 bp, Homo sapiens
tgggccatgtccaa

SEQ ID NO: 2496870 - DNA, 17 bp, Homo sapiens
tgggccatgtccaaaga

SEQ ID NO: 2496871 - DNA, 18 bp, Homo sapiens
tgggccatgtccaaagag

SEQ ID NO: 2496872 - DNA, 24 bp, Homo sapiens
tgggccatgtccaaagaggctgcc

SEQ ID NO: 2496873 - DNA, 14 bp, Homo sapiens
tgggccccaccctc

SEQ ID NO: 2496874 - DNA, 14 bp, Homo sapiens
tgggccctggggcc

SEQ ID NO: 2496875 - DNA, 22 bp, Homo sapiens
tgggccctggggcctgtactgc

SEQ ID NO: 2496876 - DNA, 14 bp, Homo sapiens
tgggccgctgccac

SEQ ID NO: 2496877 - DNA, 15 bp, Homo sapiens
tgggcctatggagag

SEQ ID NO: 2496878 - DNA, 15 bp, Homo sapiens
tgggcctgctccaga

SEQ ID NO: 2496879 - DNA, 14 bp, Homo sapiens
tgggcctgctgctg

SEQ ID NO: 2496880 - DNA, 17 bp, Homo sapiens
tgggcctgctgctgaga

SEQ ID NO: 2496881 - DNA, 15 bp, Homo sapiens
tgggcctgggctcct

SEQ ID NO: 2496882 - DNA, 21 bp, Homo sapiens
tgggcctggtctcaccctgga

SEQ ID NO: 2496883 - DNA, 15 bp, Homo sapiens
tgggccttaggaaga

SEQ ID NO: 2496884 - DNA, 13 bp, Homo sapiens
tgggccttggcct

SEQ ID NO: 2496885 - DNA, 16 bp, Homo sapiens
tgggccttggcctgga

SEQ ID NO: 2496886 - DNA, 18 bp, Homo sapiens
tgggctcaaccagaaaag

SEQ ID NO: 2496887 - DNA, 23 bp, Homo sapiens
tgggctcctccagggtgtgtgct

SEQ ID NO: 2496888 - DNA, 21 bp, Homo sapiens
tgggctctgagtacccctgct

SEQ ID NO: 2496889 - DNA, 11 bp, Homo sapiens
tgggctctgat

SEQ ID NO: 2496890 - DNA, 13 bp, Homo sapiens
tgggctctgatga

SEQ ID NO: 2496891 - DNA, 18 bp, Homo sapiens
tgggctggatgagctccc

SEQ ID NO: 2496892 - DNA, 14 bp, Homo sapiens
tgggctggccgctg

SEQ ID NO: 2496893 - DNA, 15 bp, Homo sapiens
tgggctggccgctgt

SEQ ID NO: 2496894 - DNA, 18 bp, Homo sapiens
tgggctggccgctgtgcc

SEQ ID NO: 2496895 - DNA, 14 bp, Homo sapiens
tgggctggtatctc

SEQ ID NO: 2496896 - DNA, 13 bp, Homo sapiens
tgggcttcccaag

SEQ ID NO: 2496897 - DNA, 13 bp, Homo sapiens
tgggcttgattct

SEQ ID NO: 2496898 - DNA, 17 bp, Homo sapiens
tgggcttgctattctgt

SEQ ID NO: 2496899 - DNA, 15 bp, Homo sapiens
tgggcttgggcctag

SEQ ID NO: 2496900 - DNA, 16 bp, Homo sapiens
tggggaaactggccat

SEQ ID NO: 2496901 - DNA, 18 bp, Homo sapiens
tggggaaactggccatgg

SEQ ID NO: 2496902 - DNA, 24 bp, Homo sapiens
tggggaagacccattccttcccag

SEQ ID NO: 2496903 - DNA, 20 bp, Homo sapiens
tggggaaggttatcagtgct

SEQ ID NO: 2496904 - DNA, 22 bp, Homo sapiens
tggggaccagcagccccacacc

SEQ ID NO: 2496905 - DNA, 19 bp, Homo sapiens
tggggagcccgtctcagtg

SEQ ID NO: 2496906 - DNA, 17 bp, Homo sapiens
tggggagcgggtctgct

SEQ ID NO: 2496907 - DNA, 18 bp, Homo sapiens
tggggagggattctggtt

SEQ ID NO: 2496908 - DNA, 17 bp, Homo sapiens
tggggagtgggggtggg

SEQ ID NO: 2496909 - DNA, 19 bp, Homo sapiens
tggggagttaagacctggc

SEQ ID NO: 2496910 - DNA, 22 bp, Homo sapiens
tggggatggtagttttttcatc

SEQ ID NO: 2496911 - DNA, 15 bp, Homo sapiens
tggggcagctcctct

SEQ ID NO: 2496912 - DNA, 19 bp, Homo sapiens
tggggcaggagtagctgag

SEQ ID NO: 2496913 - DNA, 20 bp, Homo sapiens
tggggcaggagtagctgagc

SEQ ID NO: 2496914 - DNA, 21 bp, Homo sapiens
tggggcaggagtagctgagct

SEQ ID NO: 2496915 - DNA, 21 bp, Homo sapiens
tggggcaggccacctggctct

SEQ ID NO: 2496916 - DNA, 16 bp, Homo sapiens
tggggcaggctgggcc

SEQ ID NO: 2496917 - DNA, 13 bp, Homo sapiens
tggggccagatcc

SEQ ID NO: 2496918 - DNA, 14 bp, Homo sapiens
tggggccagatcca

SEQ ID NO: 2496919 - DNA, 15 bp, Homo sapiens
tggggcccaggcccg

SEQ ID NO: 2496920 - DNA, 13 bp, Homo sapiens
tggggcctgggac

SEQ ID NO: 2496921 - DNA, 20 bp, Homo sapiens
tggggctctaacgcctgagc

SEQ ID NO: 2496922 - DNA, 20 bp, Homo sapiens
tgggggaaagcaaagcacag

SEQ ID NO: 2496923 - DNA, 22 bp, Homo sapiens
tgggggaaagcaaagcacagag

SEQ ID NO: 2496924 - DNA, 19 bp, Homo sapiens
tgggggcctggctggctga

SEQ ID NO: 2496925 - DNA, 13 bp, Homo sapiens
tgggggggtggcc

SEQ ID NO: 2496926 - DNA, 20 bp, Homo sapiens
tggggggtgatgagggcagc

SEQ ID NO: 2496927 - DNA, 21 bp, Homo sapiens
tgggggtagggggctggagga

SEQ ID NO: 2496928 - DNA, 16 bp, Homo sapiens
tggggtataggtctca

SEQ ID NO: 2496929 - DNA, 19 bp, Homo sapiens
tggggtataggtctcatct

SEQ ID NO: 2496930 - DNA, 17 bp, Homo sapiens
tggggtctggcagcctc

SEQ ID NO: 2496931 - DNA, 11 bp, Homo sapiens
tggggtgcagg

SEQ ID NO: 2496932 - DNA, 15 bp, Homo sapiens
tggggtgcagggatg

SEQ ID NO: 2496933 - DNA, 18 bp, Homo sapiens
tggggtgcagggatgtgg

SEQ ID NO: 2496934 - DNA, 19 bp, Homo sapiens
tggggtgcagggatgtggg

SEQ ID NO: 2496935 - DNA, 18 bp, Homo sapiens
tggggtggctgcagcctc

SEQ ID NO: 2496936 - DNA, 18 bp, Homo sapiens
tgggtaatgaaacaaaga

SEQ ID NO: 2496937 - DNA, 13 bp, Homo sapiens
tgggtcacaggaa

SEQ ID NO: 2496938 - DNA, 12 bp, Homo sapiens
tgggtccaggag

SEQ ID NO: 2496939 - DNA, 13 bp, Homo sapiens
tgggtccaggagg

SEQ ID NO: 2496940 - DNA, 18 bp, Homo sapiens
tgggtctcaccggctctc

SEQ ID NO: 2496941 - DNA, 22 bp, Homo sapiens
tgggtgaggatccctgaaggcc

SEQ ID NO: 2496942 - DNA, 13 bp, Homo sapiens
tgggtggtaccct

SEQ ID NO: 2496943 - DNA, 19 bp, Homo sapiens
tgggtgtaccacccatccc

SEQ ID NO: 2496944 - DNA, 14 bp, Homo sapiens
tgggtgttaatttt

SEQ ID NO: 2496945 - DNA, 21 bp, Homo sapiens
tgggttctgcctgccagctgc

SEQ ID NO: 2496946 - DNA, 22 bp, Homo sapiens
tgggttctgcctgccagctgca

SEQ ID NO: 2496947 - DNA, 17 bp, Homo sapiens
tgggtttggtgtatggt

SEQ ID NO: 2496948 - DNA, 17 bp, Homo sapiens
tgggtttttttccttta

SEQ ID NO: 2496949 - DNA, 22 bp, Homo sapiens
tggtaactgctttctgttccaa

SEQ ID NO: 2496950 - DNA, 20 bp, Homo sapiens
tggtacagagaagccagctt

SEQ ID NO: 2496951 - DNA, 22 bp, Homo sapiens
tggtacagagaagccagcttgt

SEQ ID NO: 2496952 - DNA, 14 bp, Homo sapiens
tggtaccctctgga

SEQ ID NO: 2496953 - DNA, 17 bp, Homo sapiens
tggtactgtacagctgg

SEQ ID NO: 2496954 - DNA, 23 bp, Homo sapiens
tggtagaccactgccatatgatt

SEQ ID NO: 2496955 - DNA, 17 bp, Homo sapiens
tggtagttttttcatct

SEQ ID NO: 2496956 - DNA, 22 bp, Homo sapiens
tggtatctcagaaagtgcctga

SEQ ID NO: 2496957 - DNA, 17 bp, Homo sapiens
tggtattttcaatagcc

SEQ ID NO: 2496958 - DNA, 18 bp, Homo sapiens
tggtcaacttgagcatgt

SEQ ID NO: 2496959 - DNA, 16 bp, Homo sapiens
tggtcacctaggaagc

SEQ ID NO: 2496960 - DNA, 22 bp, Homo sapiens
tggtcacctaggaagcctcaga

SEQ ID NO: 2496961 - DNA, 19 bp, Homo sapiens
tggtcacggatttgtgtct

SEQ ID NO: 2496962 - DNA, 15 bp, Homo sapiens
tggtccaattagttt

SEQ ID NO: 2496963 - DNA, 19 bp, Homo sapiens
tggtccaattagtttcctt

SEQ ID NO: 2496964 - DNA, 23 bp, Homo sapiens
tggtccacaagcttctgtcctgc

SEQ ID NO: 2496965 - DNA, 16 bp, Homo sapiens
tggtcccacatccctg

SEQ ID NO: 2496966 - DNA, 18 bp, Homo sapiens
tgtactaaagccaaacat

SEQ ID NO: 2496967 - DNA, 16 bp, Homo sapiens
tgtactaactagcatt

SEQ ID NO: 2496968 - DNA, 14 bp, Homo sapiens
tgtactgcctgctt

SEQ ID NO: 2496969 - DNA, 15 bp, Homo sapiens
tgtactgttctgtgt

SEQ ID NO: 2496970 - DNA, 14 bp, Homo sapiens
tgtagaacactaat

SEQ ID NO: 2496971 - DNA, 17 bp, Homo sapiens
tgtagaacactaattca

SEQ ID NO: 2496972 - DNA, 20 bp, Homo sapiens
tgtagaacactaattcataa

SEQ ID NO: 2496973 - DNA, 14 bp, Homo sapiens
tgtagagttgctga

SEQ ID NO: 2496974 - DNA, 15 bp, Homo sapiens
tgtagagttgctgag

SEQ ID NO: 2496975 - DNA, 20 bp, Homo sapiens
tgtagagttgctgagagggc

SEQ ID NO: 2496976 - DNA, 14 bp, Homo sapiens
tgtagataagtgtt

SEQ ID NO: 2496977 - DNA, 18 bp, Homo sapiens
tgtagattgattgtattg

SEQ ID NO: 2496978 - DNA, 16 bp, Homo sapiens
tgtagccacaccagga

SEQ ID NO: 2496979 - DNA, 17 bp, Homo sapiens
tgtagccacaccaggat

SEQ ID NO: 2496980 - DNA, 14 bp, Homo sapiens
tgtagccagccggg

SEQ ID NO: 2496981 - DNA, 14 bp, Homo sapiens
tgtagctacagaga

SEQ ID NO: 2496982 - DNA, 15 bp, Homo sapiens
tgtagctacagagaa

SEQ ID NO: 2496983 - DNA, 19 bp, Homo sapiens
tgtagctacagagaaacca

SEQ ID NO: 2496984 - DNA, 21 bp, Homo sapiens
tgtagctacagagaaaccagc

SEQ ID NO: 2496985 - DNA, 18 bp, Homo sapiens
tgtagctcctcccctgga

SEQ ID NO: 2496986 - DNA, 20 bp, Homo sapiens
tgtagctctttgtcagggag

SEQ ID NO: 2496987 - DNA, 14 bp, Homo sapiens
tgtagctgtgacct

SEQ ID NO: 2496988 - DNA, 15 bp, Homo sapiens
tgtagctgtgacctg

SEQ ID NO: 2496989 - DNA, 18 bp, Homo sapiens
tgtagctgtgacctgctg

SEQ ID NO: 2496990 - DNA, 22 bp, Homo sapiens
tgtagctgtgacctgctgagct

SEQ ID NO: 2496991 - DNA, 14 bp, Homo sapiens
tgtaggagggactg

SEQ ID NO: 2496992 - DNA, 22 bp, Homo sapiens
tgtagggagggcggcaggggcc

SEQ ID NO: 2496993 - DNA, 23 bp, Homo sapiens
tgtaggggaggggctcctttcca

SEQ ID NO: 2496994 - DNA, 13 bp, Homo sapiens
tgtagggtttcta

SEQ ID NO: 2496995 - DNA, 20 bp, Homo sapiens
tgtaggttgcacactttggt

SEQ ID NO: 2496996 - DNA, 17 bp, Homo sapiens
tgtagtaaataatgctt

SEQ ID NO: 2496997 - DNA, 14 bp, Homo sapiens
tgtagtaacactaa

SEQ ID NO: 2496998 - DNA, 14 bp, Homo sapiens
tgtagtaattgaca

SEQ ID NO: 2496999 - DNA, 20 bp, Homo sapiens
tgtagttcatgtaaataata

SEQ ID NO: 2497000 - DNA, 22 bp, Homo sapiens
tgtagttccacttatagcctct

SEQ ID NO: 2497001 - DNA, 13 bp, Homo sapiens
tgtagttctaaga

SEQ ID NO: 2497002 - DNA, 15 bp, Homo sapiens
tgtagttctaagact

SEQ ID NO: 2497003 - DNA, 20 bp, Homo sapiens
tgtagttctgctccagacag

SEQ ID NO: 2497004 - DNA, 14 bp, Homo sapiens
tgtataaaaataaa

SEQ ID NO: 2497005 - DNA, 18 bp, Homo sapiens
tgtataaaagtgtgaaat

SEQ ID NO: 2497006 - DNA, 15 bp, Homo sapiens
tgtataaaatagaca

SEQ ID NO: 2497007 - DNA, 16 bp, Homo sapiens
tgtataaacaagaaaa

SEQ ID NO: 2497008 - DNA, 23 bp, Homo sapiens
tgtataaacaagaaaaataaaga

SEQ ID NO: 2497009 - DNA, 18 bp, Homo sapiens
tgtataattggatttcct

SEQ ID NO: 2497010 - DNA, 19 bp, Homo sapiens
tgtataattggatttccta

SEQ ID NO: 2497011 - DNA, 14 bp, Homo sapiens
tgtatagttcacgt

SEQ ID NO: 2497012 - DNA, 17 bp, Homo sapiens
tgtatattgtaatttaa

SEQ ID NO: 2497013 - DNA, 14 bp, Homo sapiens
tgtatcaaatacat

SEQ ID NO: 2497014 - DNA, 21 bp, Homo sapiens
tgtatcaaatacatttaaaac

SEQ ID NO: 2497015 - DNA, 17 bp, Homo sapiens
tgtatgactgcacatga

SEQ ID NO: 2497016 - DNA, 13 bp, Homo sapiens
tgtatgattactg

SEQ ID NO: 2497017 - DNA, 22 bp, Homo sapiens
tgtatgattactggcctttttc

SEQ ID NO: 2497018 - DNA, 17 bp, Homo sapiens
tgtatgcacatgaactt

SEQ ID NO: 2497019 - DNA, 18 bp, Homo sapiens
tgtatgcacatgaactta

SEQ ID NO: 2497020 - DNA, 13 bp, Homo sapiens
tgtatgcatgttg

SEQ ID NO: 2497021 - DNA, 15 bp, Homo sapiens
tgtatgcatgttgtc

SEQ ID NO: 2497022 - DNA, 22 bp, Homo sapiens
tgtatggtttttgagatattaa

SEQ ID NO: 2497023 - DNA, 21 bp, Homo sapiens
tgtattatttacatttaatag

SEQ ID NO: 2497024 - DNA, 14 bp, Homo sapiens
tgtattcagacaga

SEQ ID NO: 2497025 - DNA, 13 bp, Homo sapiens
tgtattctctgag

SEQ ID NO: 2497026 - DNA, 14 bp, Homo sapiens
tgtattctctgagc

SEQ ID NO: 2497027 - DNA, 20 bp, Homo sapiens
tgtattctctgagctgtgca

SEQ ID NO: 2497028 - DNA, 19 bp, Homo sapiens
tgtattgtgcaatgtgtat

SEQ ID NO: 2497029 - DNA, 20 bp, Homo sapiens
tgtattgttgaaaaagtttg

SEQ ID NO: 2497030 - DNA, 22 bp, Homo sapiens
tgtattgttgaaaaagtttgtt

SEQ ID NO: 2497031 - DNA, 21 bp, Homo sapiens
tgtatttataaatatatttaa

SEQ ID NO: 2497032 - DNA, 12 bp, Homo sapiens
tgtatttgctaa

SEQ ID NO: 2497033 - DNA, 14 bp, Homo sapiens
tgtatttgcttttt

SEQ ID NO: 2497034 - DNA, 12 bp, Homo sapiens
tgtatttggaaa

SEQ ID NO: 2497035 - DNA, 15 bp, Homo sapiens
tgtattttttaaaat

SEQ ID NO: 2497036 - DNA, 21 bp, Homo sapiens
tgtattttttaaaattgattt

SEQ ID NO: 2497037 - DNA, 19 bp, Homo sapiens
tgtcaaatatttagatgta

SEQ ID NO: 2497038 - DNA, 21 bp, Homo sapiens
tgtcaagaatagcattgtaaa

SEQ ID NO: 2497039 - DNA, 21 bp, Homo sapiens
tgtcaagggttcaagattgtt

SEQ ID NO: 2497040 - DNA, 17 bp, Homo sapiens
tgtcaagtctctgctgg

SEQ ID NO: 2497041 - DNA, 20 bp, Homo sapiens
tgtcaatgcagttgtctctg

SEQ ID NO: 2497042 - DNA, 23 bp, Homo sapiens
tgtcaatgcagttgtctctgttt

SEQ ID NO: 2497043 - DNA, 21 bp, Homo sapiens
tgtcacaatgagattgaattt

SEQ ID NO: 2497044 - DNA, 23 bp, Homo sapiens
tgtcaccaatgtacccaccgggc

SEQ ID NO: 2497045 - DNA, 15 bp, Homo sapiens
tgtcacggccaggca

SEQ ID NO: 2497046 - DNA, 15 bp, Homo sapiens
tgtcactttttgagg

SEQ ID NO: 2497047 - DNA, 21 bp, Homo sapiens
tgtcactttttgaggcaaaag

SEQ ID NO: 2497048 - DNA, 17 bp, Homo sapiens
tgtcagaccctggaggc

SEQ ID NO: 2497049 - DNA, 21 bp, Homo sapiens
tgtcagatccaggagctccag

SEQ ID NO: 2497050 - DNA, 16 bp, Homo sapiens
tgtcagcatgaatttg

SEQ ID NO: 2497051 - DNA, 22 bp, Homo sapiens
tgtcagctgcaaggtactctgg

SEQ ID NO: 2497052 - DNA, 22 bp, Homo sapiens
tgtcaggattgcgagagatgtg

SEQ ID NO: 2497053 - DNA, 19 bp, Homo sapiens
tgtcagggagtgttcccta

SEQ ID NO: 2497054 - DNA, 20 bp, Homo sapiens
tgtcagtaccttcaaactag

SEQ ID NO: 2497055 - DNA, 17 bp, Homo sapiens
tgtcagtcacagccacc

SEQ ID NO: 2497056 - DNA, 18 bp, Homo sapiens
tgtcagtcacagccaccc

SEQ ID NO: 2497057 - DNA, 13 bp, Homo sapiens
tgtcatacagaga

SEQ ID NO: 2497058 - DNA, 18 bp, Homo sapiens
tgtcatacagagaagtca

SEQ ID NO: 2497059 - DNA, 20 bp, Homo sapiens
tgtcatcctcaaagaaagtg

SEQ ID NO: 2497060 - DNA, 14 bp, Homo sapiens
tgtcatgctgcctt

SEQ ID NO: 2497061 - DNA, 15 bp, Homo sapiens
tgtcatgtgtataaa

SEQ ID NO: 2497062 - DNA, 20 bp, Homo sapiens
tgtcattgttatataatcat

SEQ ID NO: 2497063 - DNA, 19 bp, Homo sapiens
tgtccaaaaccgccagctc

SEQ ID NO: 2497064 - DNA, 23 bp, Homo sapiens
tgtccaaaaccgccagctctgtt

SEQ ID NO: 2497065 - DNA, 15 bp, Homo sapiens
tgtccaaaactgcct

SEQ ID NO: 2497066 - DNA, 17 bp, Homo sapiens
tgtccaaagaggctgcc

SEQ ID NO: 2497067 - DNA, 16 bp, Homo sapiens
tgtccacgactgtctc

SEQ ID NO: 2497068 - DNA, 18 bp, Homo sapiens
tgtccacgactgtctcca

SEQ ID NO: 2497069 - DNA, 17 bp, Homo sapiens
tgtcccacccccacccc

SEQ ID NO: 2497070 - DNA, 20 bp, Homo sapiens
tgtgccagagaacccagccc

SEQ ID NO: 2497071 - DNA, 15 bp, Homo sapiens
tgtgccagagcctgg

SEQ ID NO: 2497072 - DNA, 21 bp, Homo sapiens
tgtgccagagcctggggctct

SEQ ID NO: 2497073 - DNA, 22 bp, Homo sapiens
tgtgccaggcgaggcccttggc

SEQ ID NO: 2497074 - DNA, 12 bp, Homo sapiens
tgtgcccagtta

SEQ ID NO: 2497075 - DNA, 22 bp, Homo sapiens
tgtgcccagttaatcttgcttt

SEQ ID NO: 2497076 - DNA, 16 bp, Homo sapiens
tgtgcctcagagacca

SEQ ID NO: 2497077 - DNA, 14 bp, Homo sapiens
tgtgcctcctccct

SEQ ID NO: 2497078 - DNA, 15 bp, Homo sapiens
tgtgcctcctccctc

SEQ ID NO: 2497079 - DNA, 21 bp, Homo sapiens
tgtgcctcctccctccctctc

SEQ ID NO: 2497080 - DNA, 20 bp, Homo sapiens
tgtgcctcgctccccactct

SEQ ID NO: 2497081 - DNA, 21 bp, Homo sapiens
tgtgccttctctctccctttt

SEQ ID NO: 2497082 - DNA, 13 bp, Homo sapiens
tgtgccttgtttt

SEQ ID NO: 2497083 - DNA, 15 bp, Homo sapiens
tgtgcggctgtgtgt

SEQ ID NO: 2497084 - DNA, 22 bp, Homo sapiens
tgtgcgtggtggtccctgggta

SEQ ID NO: 2497085 - DNA, 12 bp, Homo sapiens
tgtgctgggagc

SEQ ID NO: 2497086 - DNA, 17 bp, Homo sapiens
tgtgctgggagctccac

SEQ ID NO: 2497087 - DNA, 19 bp, Homo sapiens
tgtgcttatggtaccagat

SEQ ID NO: 2497088 - DNA, 17 bp, Homo sapiens
tgtggaactgctgccac

SEQ ID NO: 2497089 - DNA, 22 bp, Homo sapiens
tgtggaactgctgccactgagg

SEQ ID NO: 2497090 - DNA, 14 bp, Homo sapiens
tgtggacaggacta

SEQ ID NO: 2497091 - DNA, 12 bp, Homo sapiens
tgtggactctgg

SEQ ID NO: 2497092 - DNA, 22 bp, Homo sapiens
tgtggactctggtgcctccaga

SEQ ID NO: 2497093 - DNA, 23 bp, Homo sapiens
tgtggactctggtgcctccagag

SEQ ID NO: 2497094 - DNA, 14 bp, Homo sapiens
tgtggcagagttac

SEQ ID NO: 2497095 - DNA, 19 bp, Homo sapiens
tgtggcagagttacagttc

SEQ ID NO: 2497096 - DNA, 20 bp, Homo sapiens
tgtggcaggggttagagcag

SEQ ID NO: 2497097 - DNA, 17 bp, Homo sapiens
tgtggcatgggtgaaga

SEQ ID NO: 2497098 - DNA, 12 bp, Homo sapiens
tgtggccaggag

SEQ ID NO: 2497099 - DNA, 21 bp, Homo sapiens
tgtggccatgaccctgcctct

SEQ ID NO: 2497100 - DNA, 19 bp, Homo sapiens
tgtggccccaccctgggcc

SEQ ID NO: 2497101 - DNA, 23 bp, Homo sapiens
tgtggcctcagctcccacaagcc

SEQ ID NO: 2497102 - DNA, 14 bp, Homo sapiens
tgtggctccttccc

SEQ ID NO: 2497103 - DNA, 14 bp, Homo sapiens
tgtgggcctgggct

SEQ ID NO: 2497104 - DNA, 17 bp, Homo sapiens
tgtgggcctgggctcct

SEQ ID NO: 2497105 - DNA, 20 bp, Homo sapiens
tgtgggcctgggctcctgga

SEQ ID NO: 2497106 - DNA, 16 bp, Homo sapiens
tgtggggattttcact

SEQ ID NO: 2497107 - DNA, 16 bp, Homo sapiens
tgtgggggactgtaag

SEQ ID NO: 2497108 - DNA, 22 bp, Homo sapiens
tgtgggtgttaatttttgatac

SEQ ID NO: 2497109 - DNA, 16 bp, Homo sapiens
tgtgggttccacagac

SEQ ID NO: 2497110 - DNA, 12 bp, Homo sapiens
tgtggtacagag

SEQ ID NO: 2497111 - DNA, 19 bp, Homo sapiens
tgtggtacagagaagccag

SEQ ID NO: 2497112 - DNA, 20 bp, Homo sapiens
tgtggtacagagaagccagc

SEQ ID NO: 2497113 - DNA, 23 bp, Homo sapiens
tgtggtacagagaagccagcttg

SEQ ID NO: 2497114 - DNA, 22 bp, Homo sapiens
tgtggtttcatgttagttacct

SEQ ID NO: 2497115 - DNA, 18 bp, Homo sapiens
tgtggttttcgagattat

SEQ ID NO: 2497116 - DNA, 21 bp, Homo sapiens
tgtggttttcttttgccatga

SEQ ID NO: 2497117 - DNA, 18 bp, Homo sapiens
tgtgtaactgcccaaagc

SEQ ID NO: 2497118 - DNA, 16 bp, Homo sapiens
tgtgtagctgtgacct

SEQ ID NO: 2497119 - DNA, 17 bp, Homo sapiens
tgtgtagttcatgtaaa

SEQ ID NO: 2497120 - DNA, 13 bp, Homo sapiens
tgtgtataaacaa

SEQ ID NO: 2497121 - DNA, 21 bp, Homo sapiens
tgtgtataaacaagaaaaata

SEQ ID NO: 2497122 - DNA, 23 bp, Homo sapiens
tgtgtcacaatgagattgaattt

SEQ ID NO: 2497123 - DNA, 17 bp, Homo sapiens
tgtgtccaaaaccgcca

SEQ ID NO: 2497124 - DNA, 18 bp, Homo sapiens
tgtgtccacgactgtctc

SEQ ID NO: 2497125 - DNA, 19 bp, Homo sapiens
tgtgtccacgactgtctcc

SEQ ID NO: 2497126 - DNA, 18 bp, Homo sapiens
tgtgtccccctctgtcca

SEQ ID NO: 2497127 - DNA, 15 bp, Homo sapiens
tgtgtctaagattct

SEQ ID NO: 2497128 - DNA, 14 bp, Homo sapiens
tgtgtctttagata

SEQ ID NO: 2497129 - DNA, 12 bp, Homo sapiens
tgtgtgaatgaa

SEQ ID NO: 2497130 - DNA, 17 bp, Homo sapiens
tgtgtgcatcaggcttt

SEQ ID NO: 2497131 - DNA, 13 bp, Homo sapiens
tgtgtgtatttgc

SEQ ID NO: 2497132 - DNA, 20 bp, Homo sapiens
tgtgtgtatttgctaatttt

SEQ ID NO: 2497133 - DNA, 16 bp, Homo sapiens
tgtgtgtcttaattat

SEQ ID NO: 2497134 - DNA, 16 bp, Homo sapiens
tgtgtgtgaatgaaca

SEQ ID NO: 2497135 - DNA, 14 bp, Homo sapiens
tgtgtgtgccctct

SEQ ID NO: 2497136 - DNA, 17 bp, Homo sapiens
tgtgtgttgatactgtt

SEQ ID NO: 2497137 - DNA, 18 bp, Homo sapiens
tgtgtgttgtctcttgag

SEQ ID NO: 2497138 - DNA, 23 bp, Homo sapiens
tgtgttactaaaaaaaagatgaa

SEQ ID NO: 2497139 - DNA, 17 bp, Homo sapiens
tgtgttgatactgttgc

SEQ ID NO: 2497140 - DNA, 18 bp, Homo sapiens
tgtgttgatactgttgca

SEQ ID NO: 2497141 - DNA, 22 bp, Homo sapiens
tgtgttgggattgagtctgtgc

SEQ ID NO: 2497142 - DNA, 17 bp, Homo sapiens
tgtgtttcttgcctcat

SEQ ID NO: 2497143 - DNA, 17 bp, Homo sapiens
tgtgtttggctttcagg

SEQ ID NO: 2497144 - DNA, 21 bp, Homo sapiens
tgtgtttttctattaaaagac

SEQ ID NO: 2497145 - DNA, 20 bp, Homo sapiens
tgttaaaaaaataagaagaa

SEQ ID NO: 2497146 - DNA, 13 bp, Homo sapiens
tgttaagctctgc

SEQ ID NO: 2497147 - DNA, 13 bp, Homo sapiens
tgttaatattgat

SEQ ID NO: 2497148 - DNA, 18 bp, Homo sapiens
tgttaatttagaaaactt

SEQ ID NO: 2497149 - DNA, 20 bp, Homo sapiens
tgttaatttagaaaacttta

SEQ ID NO: 2497150 - DNA, 13 bp, Homo sapiens
tgttaatttttga

SEQ ID NO: 2497151 - DNA, 15 bp, Homo sapiens
tgttaatttttgata

SEQ ID NO: 2497152 - DNA, 18 bp, Homo sapiens
tgttacactttttggaag

SEQ ID NO: 2497153 - DNA, 22 bp, Homo sapiens
tgttacctgaaaacactgtgca

SEQ ID NO: 2497154 - DNA, 17 bp, Homo sapiens
tgttagattaagaaata

SEQ ID NO: 2497155 - DNA, 20 bp, Homo sapiens
tgttagattaagaaatagac

SEQ ID NO: 2497156 - DNA, 14 bp, Homo sapiens
tgttagcagacagg

SEQ ID NO: 2497157 - DNA, 19 bp, Homo sapiens
tgttagccttttttcccca

SEQ ID NO: 2497158 - DNA, 21 bp, Homo sapiens
tgttagccttttttccccaga

SEQ ID NO: 2497159 - DNA, 23 bp, Homo sapiens
tgttagttaccttatagttactg

SEQ ID NO: 2497160 - DNA, 21 bp, Homo sapiens
tgttatcagtcaatattttta

SEQ ID NO: 2497161 - DNA, 16 bp, Homo sapiens
tgttatcttctcaagt

SEQ ID NO: 2497162 - DNA, 17 bp, Homo sapiens
tgttatgcaaaagcaag

SEQ ID NO: 2497163 - DNA, 21 bp, Homo sapiens
tgttcaaagccagcgtcctcc

SEQ ID NO: 2497164 - DNA, 16 bp, Homo sapiens
tgttcacaccagagaa

SEQ ID NO: 2497165 - DNA, 22 bp, Homo sapiens
tgttcaccattataatgaattt

SEQ ID NO: 2497166 - DNA, 15 bp, Homo sapiens
tgttcagcactgtcc

SEQ ID NO: 2497167 - DNA, 18 bp, Homo sapiens
tgttcagcactgtccctt

SEQ ID NO: 2497168 - DNA, 15 bp, Homo sapiens
tgttcatagcccagt

SEQ ID NO: 2497169 - DNA, 14 bp, Homo sapiens
tgttcatggcagat

SEQ ID NO: 2497170 - DNA, 18 bp, Homo sapiens
tgttccaaattcagtttc

SEQ ID NO: 2497171 - DNA, 23 bp, Homo sapiens
tgttcccaagagcatcatgcctc

SEQ ID NO: 2497172 - DNA, 14 bp, Homo sapiens
tgttccccactgga

SEQ ID NO: 2497173 - DNA, 18 bp, Homo sapiens
ttaaaagactcatccgtc

SEQ ID NO: 2497174 - DNA, 22 bp, Homo sapiens
ttaaaagatgcttttaacagag

SEQ ID NO: 2497175 - DNA, 14 bp, Homo sapiens
ttaaaagcaaatca

SEQ ID NO: 2497176 - DNA, 13 bp, Homo sapiens
ttaaaatacaaga

SEQ ID NO: 2497177 - DNA, 16 bp, Homo sapiens
ttaaaatcagctattt

SEQ ID NO: 2497178 - DNA, 14 bp, Homo sapiens
ttaaaatgtatgca

SEQ ID NO: 2497179 - DNA, 17 bp, Homo sapiens
ttaaaatgtatgcatgt

SEQ ID NO: 2497180 - DNA, 19 bp, Homo sapiens
ttaaaatgtatgcatgttg

SEQ ID NO: 2497181 - DNA, 19 bp, Homo sapiens
ttaaacatcaatctttaaa

SEQ ID NO: 2497182 - DNA, 18 bp, Homo sapiens
ttaaaccatctccctggt

SEQ ID NO: 2497183 - DNA, 22 bp, Homo sapiens
ttaaaccatctccctggtgctt

SEQ ID NO: 2497184 - DNA, 16 bp, Homo sapiens
ttaaaccgctaaaaga

SEQ ID NO: 2497185 - DNA, 14 bp, Homo sapiens
ttaaaccttttttg

SEQ ID NO: 2497186 - DNA, 15 bp, Homo sapiens
ttaaacgatttttaa

SEQ ID NO: 2497187 - DNA, 18 bp, Homo sapiens
ttaaacgatttttaaaat

SEQ ID NO: 2497188 - DNA, 22 bp, Homo sapiens
ttaaacgatttttaaaatgtac

SEQ ID NO: 2497189 - DNA, 17 bp, Homo sapiens
ttaaacttgcatcactt

SEQ ID NO: 2497190 - DNA, 20 bp, Homo sapiens
ttaaagaaaaaaatgtattt

SEQ ID NO: 2497191 - DNA, 12 bp, Homo sapiens
ttaaagaagacc

SEQ ID NO: 2497192 - DNA, 12 bp, Homo sapiens
ttaaagagtcta

SEQ ID NO: 2497193 - DNA, 17 bp, Homo sapiens
ttaaagagtctagattc

SEQ ID NO: 2497194 - DNA, 23 bp, Homo sapiens
ttaaagagtctagattcaaaggt

SEQ ID NO: 2497195 - DNA, 13 bp, Homo sapiens
ttaaagcctcctc

SEQ ID NO: 2497196 - DNA, 13 bp, Homo sapiens
ttaaagtgccagt

SEQ ID NO: 2497197 - DNA, 21 bp, Homo sapiens
ttaaagtgctaaggttctaag

SEQ ID NO: 2497198 - DNA, 23 bp, Homo sapiens
ttaaagttagtatcttttgatat

SEQ ID NO: 2497199 - DNA, 15 bp, Homo sapiens
ttaaataagattcta

SEQ ID NO: 2497200 - DNA, 19 bp, Homo sapiens
ttaaatacaggaaacagtt

SEQ ID NO: 2497201 - DNA, 18 bp, Homo sapiens
ttaaatgaacaagagaag

SEQ ID NO: 2497202 - DNA, 18 bp, Homo sapiens
ttaaatgtaaagacaaaa

SEQ ID NO: 2497203 - DNA, 17 bp, Homo sapiens
ttaaattggaaagcagg

SEQ ID NO: 2497204 - DNA, 15 bp, Homo sapiens
ttaaattgtgtttta

SEQ ID NO: 2497205 - DNA, 16 bp, Homo sapiens
ttaaattttttgttga

SEQ ID NO: 2497206 - DNA, 14 bp, Homo sapiens
ttaacaacatgttt

SEQ ID NO: 2497207 - DNA, 14 bp, Homo sapiens
ttaacaagaacttt

SEQ ID NO: 2497208 - DNA, 13 bp, Homo sapiens
ttaacagaaattg

SEQ ID NO: 2497209 - DNA, 17 bp, Homo sapiens
ttaacagaaattgtata

SEQ ID NO: 2497210 - DNA, 14 bp, Homo sapiens
ttaacagaagggag

SEQ ID NO: 2497211 - DNA, 18 bp, Homo sapiens
ttaacataagctattttt

SEQ ID NO: 2497212 - DNA, 14 bp, Homo sapiens
ttaacattccaaga

SEQ ID NO: 2497213 - DNA, 11 bp, Homo sapiens
ttaacattcct

SEQ ID NO: 2497214 - DNA, 14 bp, Homo sapiens
ttaacccccctgta

SEQ ID NO: 2497215 - DNA, 17 bp, Homo sapiens
ttaacccccctgtacac

SEQ ID NO: 2497216 - DNA, 20 bp, Homo sapiens
ttaacccccctgtacacaac

SEQ ID NO: 2497217 - DNA, 15 bp, Homo sapiens
ttaacctctgcacta

SEQ ID NO: 2497218 - DNA, 18 bp, Homo sapiens
ttaacgatgtccaacccg

SEQ ID NO: 2497219 - DNA, 23 bp, Homo sapiens
ttaactcccattaccatgtaatg

SEQ ID NO: 2497220 - DNA, 19 bp, Homo sapiens
ttaactctctttatgtctg

SEQ ID NO: 2497221 - DNA, 20 bp, Homo sapiens
ttaactgaataccactctgt

SEQ ID NO: 2497222 - DNA, 21 bp, Homo sapiens
ttaactgacaagccatcttga

SEQ ID NO: 2497223 - DNA, 21 bp, Homo sapiens
ttaactgggtaatgaaacaaa

SEQ ID NO: 2497224 - DNA, 14 bp, Homo sapiens
ttaactttaatgtt

SEQ ID NO: 2497225 - DNA, 14 bp, Homo sapiens
ttaactttgtttta

SEQ ID NO: 2497226 - DNA, 18 bp, Homo sapiens
ttaagaaaaaagtgttga

SEQ ID NO: 2497227 - DNA, 12 bp, Homo sapiens
ttaagaaggcaa

SEQ ID NO: 2497228 - DNA, 18 bp, Homo sapiens
ttaagacctggcagctct

SEQ ID NO: 2497229 - DNA, 12 bp, Homo sapiens
ttaagagtaaaa

SEQ ID NO: 2497230 - DNA, 14 bp, Homo sapiens
ttaagagtccaaga

SEQ ID NO: 2497231 - DNA, 19 bp, Homo sapiens
ttaagagtccaagaatcca

SEQ ID NO: 2497232 - DNA, 15 bp, Homo sapiens
ttaagctctgagctg

SEQ ID NO: 2497233 - DNA, 16 bp, Homo sapiens
ttaagctctgagctgt

SEQ ID NO: 2497234 - DNA, 17 bp, Homo sapiens
ttaagctctgagctgtc

SEQ ID NO: 2497235 - DNA, 18 bp, Homo sapiens
ttaagctctgagctgtca

SEQ ID NO: 2497236 - DNA, 17 bp, Homo sapiens
ttaaggtgtagccacac

SEQ ID NO: 2497237 - DNA, 17 bp, Homo sapiens
ttaagtgaaaatatagc

SEQ ID NO: 2497238 - DNA, 20 bp, Homo sapiens
ttaagttagttccactgaga

SEQ ID NO: 2497239 - DNA, 14 bp, Homo sapiens
ttaataaaagaaaa

SEQ ID NO: 2497240 - DNA, 17 bp, Homo sapiens
ttaataaaagaaaatta

SEQ ID NO: 2497241 - DNA, 19 bp, Homo sapiens
ttaataatttagacttcaa

SEQ ID NO: 2497242 - DNA, 22 bp, Homo sapiens
ttaatactcaaatgagtaacat

SEQ ID NO: 2497243 - DNA, 20 bp, Homo sapiens
ttaatagcaaagaattgact

SEQ ID NO: 2497244 - DNA, 22 bp, Homo sapiens
ttaatataaagtagtcctgtga

SEQ ID NO: 2497245 - DNA, 21 bp, Homo sapiens
ttaatataaagttttatatat

SEQ ID NO: 2497246 - DNA, 14 bp, Homo sapiens
ttaatatcctaaac

SEQ ID NO: 2497247 - DNA, 13 bp, Homo sapiens
ttaatattgattt

SEQ ID NO: 2497248 - DNA, 16 bp, Homo sapiens
ttaatattgatttatt

SEQ ID NO: 2497249 - DNA, 17 bp, Homo sapiens
ttaatcatcaagagaat

SEQ ID NO: 2497250 - DNA, 17 bp, Homo sapiens
ttaatctttgaaaggtt

SEQ ID NO: 2497251 - DNA, 15 bp, Homo sapiens
ttaatgaaaataaga

SEQ ID NO: 2497252 - DNA, 21 bp, Homo sapiens
ttaatgatatgcttgtaacta

SEQ ID NO: 2497253 - DNA, 12 bp, Homo sapiens
ttaatgcacttt

SEQ ID NO: 2497254 - DNA, 15 bp, Homo sapiens
ttaatgcactttcta

SEQ ID NO: 2497255 - DNA, 15 bp, Homo sapiens
ttaatgtttaaaaca

SEQ ID NO: 2497256 - DNA, 18 bp, Homo sapiens
ttaatgttttttgccaca

SEQ ID NO: 2497257 - DNA, 21 bp, Homo sapiens
ttaattattatttgtgtttta

SEQ ID NO: 2497258 - DNA, 14 bp, Homo sapiens
ttaatttacaaaaa

SEQ ID NO: 2497259 - DNA, 16 bp, Homo sapiens
ttaatttagaaaactt

SEQ ID NO: 2497260 - DNA, 14 bp, Homo sapiens
ttaatttgcacagt

SEQ ID NO: 2497261 - DNA, 20 bp, Homo sapiens
ttaattttgaagtgctgttt

SEQ ID NO: 2497262 - DNA, 23 bp, Homo sapiens
ttaattttgaagtgctgtttatt

SEQ ID NO: 2497263 - DNA, 18 bp, Homo sapiens
ttaatttttatttcttcc

SEQ ID NO: 2497264 - DNA, 12 bp, Homo sapiens
ttaatttttgat

SEQ ID NO: 2497265 - DNA, 21 bp, Homo sapiens
ttacaaatgaaaaattccact

SEQ ID NO: 2497266 - DNA, 23 bp, Homo sapiens
ttacagaattgcttgtttgcttc

SEQ ID NO: 2497267 - DNA, 18 bp, Homo sapiens
ttacagatatttgtcatg

SEQ ID NO: 2497268 - DNA, 20 bp, Homo sapiens
ttacaggcatgagccactgc

SEQ ID NO: 2497269 - DNA, 13 bp, Homo sapiens
ttacatcatttct

SEQ ID NO: 2497270 - DNA, 19 bp, Homo sapiens
ttacatttacaaactgaag

SEQ ID NO: 2497271 - DNA, 23 bp, Homo sapiens
ttacccatttgggtgggagtgtt

SEQ ID NO: 2497272 - DNA, 18 bp, Homo sapiens
ttaccctggcccctctcc

SEQ ID NO: 2497273 - DNA, 14 bp, Homo sapiens
ttacctaagattac

SEQ ID NO: 2497274 - DNA, 14 bp, Homo sapiens
ttacctcagcctgg

SEQ ID NO: 2497275 - DNA, 15 bp, Homo sapiens
ttacctcagcctggg

SEQ ID NO: 2497276 - DNA, 18 bp, Homo sapiens
ttacctcagcctgggcgc

SEQ ID NO: 2497277 - DNA, 12 bp, Homo sapiens
ttcagcatgcaa

SEQ ID NO: 2497278 - DNA, 10 bp, Homo sapiens
ttcagccaag

SEQ ID NO: 2497279 - DNA, 12 bp, Homo sapiens
ttcagctcctga

SEQ ID NO: 2497280 - DNA, 14 bp, Homo sapiens
ttcagctcctgacc

SEQ ID NO: 2497281 - DNA, 13 bp, Homo sapiens
ttcagctgccagt

SEQ ID NO: 2497282 - DNA, 17 bp, Homo sapiens
ttcaggaaaaggcctgg

SEQ ID NO: 2497283 - DNA, 18 bp, Homo sapiens
ttcaggaaaaggcctggg

SEQ ID NO: 2497284 - DNA, 15 bp, Homo sapiens
ttcaggaggaatact

SEQ ID NO: 2497285 - DNA, 12 bp, Homo sapiens
ttcaggatctat

SEQ ID NO: 2497286 - DNA, 14 bp, Homo sapiens
ttcaggatctattt

SEQ ID NO: 2497287 - DNA, 21 bp, Homo sapiens
ttcagggaaggaggagcctgt

SEQ ID NO: 2497288 - DNA, 15 bp, Homo sapiens
ttcaggttctcatga

SEQ ID NO: 2497289 - DNA, 17 bp, Homo sapiens
ttcagtattatatgtac

SEQ ID NO: 2497290 - DNA, 14 bp, Homo sapiens
ttcagtggggcagt

SEQ ID NO: 2497291 - DNA, 17 bp, Homo sapiens
ttcataagtatttcaaa

SEQ ID NO: 2497292 - DNA, 22 bp, Homo sapiens
ttcatactgtaacattcaggaa

SEQ ID NO: 2497293 - DNA, 16 bp, Homo sapiens
ttcatataaagtatca

SEQ ID NO: 2497294 - DNA, 21 bp, Homo sapiens
ttcatatagttagctaataaa

SEQ ID NO: 2497295 - DNA, 15 bp, Homo sapiens
ttcatatcatccaca

SEQ ID NO: 2497296 - DNA, 20 bp, Homo sapiens
ttcatatgtaccatgtacat

SEQ ID NO: 2497297 - DNA, 23 bp, Homo sapiens
ttcatattgttgcattgcttttt

SEQ ID NO: 2497298 - DNA, 19 bp, Homo sapiens
ttcatcttcagttgtctct

SEQ ID NO: 2497299 - DNA, 12 bp, Homo sapiens
ttcatgataatg

SEQ ID NO: 2497300 - DNA, 18 bp, Homo sapiens
ttcatgataatgaacaga

SEQ ID NO: 2497301 - DNA, 23 bp, Homo sapiens
ttcatgatttcatttcaactgtt

SEQ ID NO: 2497302 - DNA, 16 bp, Homo sapiens
ttcatgcaaactcttt

SEQ ID NO: 2497303 - DNA, 13 bp, Homo sapiens
ttcatgcagctgt

SEQ ID NO: 2497304 - DNA, 21 bp, Homo sapiens
ttcatgcgatgacacttgtac

SEQ ID NO: 2497305 - DNA, 18 bp, Homo sapiens
ttcatgtaaactgtgcac

SEQ ID NO: 2497306 - DNA, 17 bp, Homo sapiens
ttcatgtacaagatgaa

SEQ ID NO: 2497307 - DNA, 16 bp, Homo sapiens
ttcatgtgtcccagaa

SEQ ID NO: 2497308 - DNA, 18 bp, Homo sapiens
ttcatgttagttacctta

SEQ ID NO: 2497309 - DNA, 20 bp, Homo sapiens
ttcattagaaatattttaaa

SEQ ID NO: 2497310 - DNA, 16 bp, Homo sapiens
ttcattagtcatgttt

SEQ ID NO: 2497311 - DNA, 21 bp, Homo sapiens
ttcattccttcagatttggct

SEQ ID NO: 2497312 - DNA, 18 bp, Homo sapiens
ttcattgagttggttact

SEQ ID NO: 2497313 - DNA, 19 bp, Homo sapiens
ttcattgcactttgattag

SEQ ID NO: 2497314 - DNA, 22 bp, Homo sapiens
ttcatttggttcattaattcta

SEQ ID NO: 2497315 - DNA, 15 bp, Homo sapiens
ttccaaatactaatg

SEQ ID NO: 2497316 - DNA, 19 bp, Homo sapiens
ttccaaattcagtttcata

SEQ ID NO: 2497317 - DNA, 19 bp, Homo sapiens
ttccaactcgtatagcatg

SEQ ID NO: 2497318 - DNA, 22 bp, Homo sapiens
ttccaacttggctgcaggaatc

SEQ ID NO: 2497319 - DNA, 16 bp, Homo sapiens
ttccaagactctagag

SEQ ID NO: 2497320 - DNA, 17 bp, Homo sapiens
ttccaagactctagagt

SEQ ID NO: 2497321 - DNA, 14 bp, Homo sapiens
ttccaagagtctaa

SEQ ID NO: 2497322 - DNA, 17 bp, Homo sapiens
ttccaatgtctggagac

SEQ ID NO: 2497323 - DNA, 13 bp, Homo sapiens
ttccacagaggac

SEQ ID NO: 2497324 - DNA, 21 bp, Homo sapiens
ttccaccacagccagcacctg

SEQ ID NO: 2497325 - DNA, 21 bp, Homo sapiens
ttccacccaggggcagcccca

SEQ ID NO: 2497326 - DNA, 22 bp, Homo sapiens
ttccacggagccactcctctga

SEQ ID NO: 2497327 - DNA, 17 bp, Homo sapiens
ttccacttatagcctct

SEQ ID NO: 2497328 - DNA, 20 bp, Homo sapiens
ttccacttatagcctctgtc

SEQ ID NO: 2497329 - DNA, 15 bp, Homo sapiens
ttccagaatgctgta

SEQ ID NO: 2497330 - DNA, 16 bp, Homo sapiens
ttccagaatgctgtac

SEQ ID NO: 2497331 - DNA, 19 bp, Homo sapiens
ttccagaatgctgtacatc

SEQ ID NO: 2497332 - DNA, 20 bp, Homo sapiens
ttccagcattcccaggtagg

SEQ ID NO: 2497333 - DNA, 14 bp, Homo sapiens
ttccagcccctctg

SEQ ID NO: 2497334 - DNA, 23 bp, Homo sapiens
ttccagctagtgacccacatgcc

SEQ ID NO: 2497335 - DNA, 11 bp, Homo sapiens
ttccagctcct

SEQ ID NO: 2497336 - DNA, 14 bp, Homo sapiens
ttccaggcttctgc

SEQ ID NO: 2497337 - DNA, 17 bp, Homo sapiens
ttccaggcttctgctgg

SEQ ID NO: 2497338 - DNA, 18 bp, Homo sapiens
ttccaggcttctgctggg

SEQ ID NO: 2497339 - DNA, 19 bp, Homo sapiens
ttccagggtccctctgtgt

SEQ ID NO: 2497340 - DNA, 20 bp, Homo sapiens
ttccagggtccctctgtgta

SEQ ID NO: 2497341 - DNA, 18 bp, Homo sapiens
ttccatgattctatttat

SEQ ID NO: 2497342 - DNA, 23 bp, Homo sapiens
ttccatgctgtgcgcccagggct

SEQ ID NO: 2497343 - DNA, 15 bp, Homo sapiens
ttccatgtgcccagt

SEQ ID NO: 2497344 - DNA, 17 bp, Homo sapiens
ttccatgtgcccagtta

SEQ ID NO: 2497345 - DNA, 13 bp, Homo sapiens
ttccattaaacga

SEQ ID NO: 2497346 - DNA, 16 bp, Homo sapiens
ttccattggtccaaga

SEQ ID NO: 2497347 - DNA, 19 bp, Homo sapiens
ttccattggtccaagattc

SEQ ID NO: 2497348 - DNA, 20 bp, Homo sapiens
ttccattggtccaagattcc

SEQ ID NO: 2497349 - DNA, 13 bp, Homo sapiens
ttccatttgcaag

SEQ ID NO: 2497350 - DNA, 13 bp, Homo sapiens
ttcccaacacaaa

SEQ ID NO: 2497351 - DNA, 20 bp, Homo sapiens
ttcccaagagcatcatgcct

SEQ ID NO: 2497352 - DNA, 21 bp, Homo sapiens
ttcccaagagcatcatgcctc

SEQ ID NO: 2497353 - DNA, 21 bp, Homo sapiens
ttcccaccccaacctgctctc

SEQ ID NO: 2497354 - DNA, 18 bp, Homo sapiens
ttcccactttcccacccc

SEQ ID NO: 2497355 - DNA, 20 bp, Homo sapiens
ttcccactttcccaccccac

SEQ ID NO: 2497356 - DNA, 11 bp, Homo sapiens
ttcccagaggg

SEQ ID NO: 2497357 - DNA, 21 bp, Homo sapiens
ttcccaggtaggccaaggtgt

SEQ ID NO: 2497358 - DNA, 12 bp, Homo sapiens
ttcccaggtgct

SEQ ID NO: 2497359 - DNA, 15 bp, Homo sapiens
ttcccagtctgtcga

SEQ ID NO: 2497360 - DNA, 16 bp, Homo sapiens
ttcccagttggagctc

SEQ ID NO: 2497361 - DNA, 15 bp, Homo sapiens
ttcccatttatctaa

SEQ ID NO: 2497362 - DNA, 21 bp, Homo sapiens
ttccccactgacagcctccca

SEQ ID NO: 2497363 - DNA, 23 bp, Homo sapiens
ttccccactgacagcctcccacc

SEQ ID NO: 2497364 - DNA, 17 bp, Homo sapiens
ttccccatcttctaaac

SEQ ID NO: 2497365 - DNA, 19 bp, Homo sapiens
ttccccatggccctgagcg

SEQ ID NO: 2497366 - DNA, 13 bp, Homo sapiens
ttccccccaaggg

SEQ ID NO: 2497367 - DNA, 14 bp, Homo sapiens
ttccccctctccca

SEQ ID NO: 2497368 - DNA, 17 bp, Homo sapiens
ttcccctccttctccct

SEQ ID NO: 2497369 - DNA, 14 bp, Homo sapiens
ttccccttccactg

SEQ ID NO: 2497370 - DNA, 21 bp, Homo sapiens
ttccccttccactgagggcag

SEQ ID NO: 2497371 - DNA, 14 bp, Homo sapiens
ttcccgtttctcca

SEQ ID NO: 2497372 - DNA, 16 bp, Homo sapiens
ttccctaccctctaga

SEQ ID NO: 2497373 - DNA, 15 bp, Homo sapiens
ttccctctctggaga

SEQ ID NO: 2497374 - DNA, 14 bp, Homo sapiens
ttccctctttggct

SEQ ID NO: 2497375 - DNA, 16 bp, Homo sapiens
ttccctctttggctcc

SEQ ID NO: 2497376 - DNA, 16 bp, Homo sapiens
ttcccttgtagctcct

SEQ ID NO: 2497377 - DNA, 22 bp, Homo sapiens
ttccctttgtgagtcaatacat

SEQ ID NO: 2497378 - DNA, 18 bp, Homo sapiens
ttccgccactggggctca

SEQ ID NO: 2497379 - DNA, 17 bp, Homo sapiens
ttccggcccctcccctc

SEQ ID NO: 2497380 - DNA, 21 bp, Homo sapiens
ttccggcccctcccctccaaa

SEQ ID NO: 2497381 - DNA, 18 bp, Homo sapiens
ttgaaattgaacctttgt

SEQ ID NO: 2497382 - DNA, 15 bp, Homo sapiens
ttgaacacaaactgt

SEQ ID NO: 2497383 - DNA, 18 bp, Homo sapiens
ttgaacacaaactgtaaa

SEQ ID NO: 2497384 - DNA, 20 bp, Homo sapiens
ttgaacacaaactgtaaata

SEQ ID NO: 2497385 - DNA, 18 bp, Homo sapiens
ttgaacgttttctaattg

SEQ ID NO: 2497386 - DNA, 19 bp, Homo sapiens
ttgaacgttttctaattgc

SEQ ID NO: 2497387 - DNA, 20 bp, Homo sapiens
ttgaagaactgcaggccctg

SEQ ID NO: 2497388 - DNA, 18 bp, Homo sapiens
ttgaagcacgtacatttt

SEQ ID NO: 2497389 - DNA, 12 bp, Homo sapiens
ttgaaggcaaaa

SEQ ID NO: 2497390 - DNA, 15 bp, Homo sapiens
ttgaaggcaaaattg

SEQ ID NO: 2497391 - DNA, 15 bp, Homo sapiens
ttgaagggaggggct

SEQ ID NO: 2497392 - DNA, 20 bp, Homo sapiens
ttgaagggccagagccaggg

SEQ ID NO: 2497393 - DNA, 18 bp, Homo sapiens
ttgaatactttgaatgtg

SEQ ID NO: 2497394 - DNA, 12 bp, Homo sapiens
ttgaatactttt

SEQ ID NO: 2497395 - DNA, 21 bp, Homo sapiens
ttgaatgtggcttgagaaata

SEQ ID NO: 2497396 - DNA, 19 bp, Homo sapiens
ttgaattttttttaacatt

SEQ ID NO: 2497397 - DNA, 15 bp, Homo sapiens
ttgacactgctctaa

SEQ ID NO: 2497398 - DNA, 22 bp, Homo sapiens
ttgacactgctctaacagccct

SEQ ID NO: 2497399 - DNA, 19 bp, Homo sapiens
ttgacctgaggctgtggtc

SEQ ID NO: 2497400 - DNA, 21 bp, Homo sapiens
ttgaccttttatgtagtaatt

SEQ ID NO: 2497401 - DNA, 13 bp, Homo sapiens
ttgactcaggagc

SEQ ID NO: 2497402 - DNA, 13 bp, Homo sapiens
ttgactttcccca

SEQ ID NO: 2497403 - DNA, 23 bp, Homo sapiens
ttgactttccccaccagatgctg

SEQ ID NO: 2497404 - DNA, 13 bp, Homo sapiens
ttgacttttctgt

SEQ ID NO: 2497405 - DNA, 16 bp, Homo sapiens
ttgagagaatttgtgc

SEQ ID NO: 2497406 - DNA, 20 bp, Homo sapiens
ttgagatattaatgcccaga

SEQ ID NO: 2497407 - DNA, 16 bp, Homo sapiens
ttgagcatcacagaat

SEQ ID NO: 2497408 - DNA, 15 bp, Homo sapiens
ttgagctattgctgt

SEQ ID NO: 2497409 - DNA, 15 bp, Homo sapiens
ttgagcttaatcttt

SEQ ID NO: 2497410 - DNA, 16 bp, Homo sapiens
ttgagcttaatctttg

SEQ ID NO: 2497411 - DNA, 23 bp, Homo sapiens
ttgaggaaagcaagaatcagaga

SEQ ID NO: 2497412 - DNA, 15 bp, Homo sapiens
ttgaggacttcttgc

SEQ ID NO: 2497413 - DNA, 12 bp, Homo sapiens
ttgaggagcccc

SEQ ID NO: 2497414 - DNA, 13 bp, Homo sapiens
ttgaggtctcagc

SEQ ID NO: 2497415 - DNA, 16 bp, Homo sapiens
ttgagtaatggtgtag

SEQ ID NO: 2497416 - DNA, 14 bp, Homo sapiens
ttgagtctgtgcca

SEQ ID NO: 2497417 - DNA, 13 bp, Homo sapiens
ttgagtgtttaaa

SEQ ID NO: 2497418 - DNA, 19 bp, Homo sapiens
ttgagttttcagtggggca

SEQ ID NO: 2497419 - DNA, 17 bp, Homo sapiens
ttgagttttgactgctt

SEQ ID NO: 2497420 - DNA, 20 bp, Homo sapiens
ttgataaagattttttaata

SEQ ID NO: 2497421 - DNA, 15 bp, Homo sapiens
ttgatactgttgcac

SEQ ID NO: 2497422 - DNA, 20 bp, Homo sapiens
ttgatatagaagtataaaga

SEQ ID NO: 2497423 - DNA, 21 bp, Homo sapiens
ttgatcagccccaccctggcc

SEQ ID NO: 2497424 - DNA, 16 bp, Homo sapiens
ttgatccatttctaat

SEQ ID NO: 2497425 - DNA, 17 bp, Homo sapiens
ttgatccatttctaatt

SEQ ID NO: 2497426 - DNA, 18 bp, Homo sapiens
ttgatccatttctaatta

SEQ ID NO: 2497427 - DNA, 19 bp, Homo sapiens
ttgatcgcctttcccaggt

SEQ ID NO: 2497428 - DNA, 16 bp, Homo sapiens
ttgatctccgtggctt

SEQ ID NO: 2497429 - DNA, 17 bp, Homo sapiens
ttgatctggaacccaga

SEQ ID NO: 2497430 - DNA, 14 bp, Homo sapiens
ttgatgccaaaaaa

SEQ ID NO: 2497431 - DNA, 13 bp, Homo sapiens
ttgatgtaaaatc

SEQ ID NO: 2497432 - DNA, 21 bp, Homo sapiens
ttgatgtaaaatcttgtcatg

SEQ ID NO: 2497433 - DNA, 23 bp, Homo sapiens
ttgatgtaaagatgttctggata

SEQ ID NO: 2497434 - DNA, 20 bp, Homo sapiens
ttgatgtaaggatgggcatg

SEQ ID NO: 2497435 - DNA, 19 bp, Homo sapiens
ttgatgttccttccagtgt

SEQ ID NO: 2497436 - DNA, 13 bp, Homo sapiens
ttgattaaagatg

SEQ ID NO: 2497437 - DNA, 14 bp, Homo sapiens
ttgatttgaagaac

SEQ ID NO: 2497438 - DNA, 17 bp, Homo sapiens
ttgatttgcattgaaca

SEQ ID NO: 2497439 - DNA, 13 bp, Homo sapiens
ttgcaaccaggaa

SEQ ID NO: 2497440 - DNA, 18 bp, Homo sapiens
ttgcaaccaggaacagca

SEQ ID NO: 2497441 - DNA, 14 bp, Homo sapiens
ttgcaacctcgctg

SEQ ID NO: 2497442 - DNA, 19 bp, Homo sapiens
ttgcaagggaaaagtctct

SEQ ID NO: 2497443 - DNA, 22 bp, Homo sapiens
ttgcaagggaaaagtctcttgt

SEQ ID NO: 2497444 - DNA, 18 bp, Homo sapiens
ttgcacagccaaatttaa

SEQ ID NO: 2497445 - DNA, 13 bp, Homo sapiens
ttgcacagtgtgt

SEQ ID NO: 2497446 - DNA, 14 bp, Homo sapiens
ttgcacgtgtgttt

SEQ ID NO: 2497447 - DNA, 22 bp, Homo sapiens
ttgcacgtgtgtttttctatta

SEQ ID NO: 2497448 - DNA, 16 bp, Homo sapiens
ttgcagaaaattctgt

SEQ ID NO: 2497449 - DNA, 9 bp, Homo sapiens
ttgcagctg

SEQ ID NO: 2497450 - DNA, 17 bp, Homo sapiens
ttgcagctgttttgttg

SEQ ID NO: 2497451 - DNA, 23 bp, Homo sapiens
ttgcagggtcctcttctgggcct

SEQ ID NO: 2497452 - DNA, 15 bp, Homo sapiens
ttgcagtaactgttt

SEQ ID NO: 2497453 - DNA, 16 bp, Homo sapiens
ttgcagtcactctagt

SEQ ID NO: 2497454 - DNA, 13 bp, Homo sapiens
ttgcagtcccaag

SEQ ID NO: 2497455 - DNA, 18 bp, Homo sapiens
ttgcagtttatcattcaa

SEQ ID NO: 2497456 - DNA, 22 bp, Homo sapiens
ttgcatagtaccaatcatttta

SEQ ID NO: 2497457 - DNA, 23 bp, Homo sapiens
ttgcatcccaaaccacgcctctt

SEQ ID NO: 2497458 - DNA, 20 bp, Homo sapiens
ttgcatctcccagataatgt

SEQ ID NO: 2497459 - DNA, 13 bp, Homo sapiens
ttgcatgtagtaa

SEQ ID NO: 2497460 - DNA, 15 bp, Homo sapiens
ttgcattaaattaca

SEQ ID NO: 2497461 - DNA, 21 bp, Homo sapiens
ttgcattaaattcacaaactt

SEQ ID NO: 2497462 - DNA, 13 bp, Homo sapiens
ttgcattatgcaa

SEQ ID NO: 2497463 - DNA, 14 bp, Homo sapiens
ttgcattatgcaat

SEQ ID NO: 2497464 - DNA, 20 bp, Homo sapiens
ttgcatttgtttatgtaatt

SEQ ID NO: 2497465 - DNA, 21 bp, Homo sapiens
ttgccaagggcataaattatt

SEQ ID NO: 2497466 - DNA, 14 bp, Homo sapiens
ttgccacagctttt

SEQ ID NO: 2497467 - DNA, 19 bp, Homo sapiens
ttgccagagatccaaaaga

SEQ ID NO: 2497468 - DNA, 20 bp, Homo sapiens
ttgccaggtgactgtctggg

SEQ ID NO: 2497469 - DNA, 15 bp, Homo sapiens
ttgcccccctggcct

SEQ ID NO: 2497470 - DNA, 16 bp, Homo sapiens
ttgcccccctggcctc

SEQ ID NO: 2497471 - DNA, 17 bp, Homo sapiens
ttgcctgccactgtgtg

SEQ ID NO: 2497472 - DNA, 14 bp, Homo sapiens
ttgcctgcctttcc

SEQ ID NO: 2497473 - DNA, 16 bp, Homo sapiens
ttgcctgcctttccat

SEQ ID NO: 2497474 - DNA, 20 bp, Homo sapiens
ttgcgctcctggcccagcct

SEQ ID NO: 2497475 - DNA, 21 bp, Homo sapiens
ttgcgctcctggcccagcctt

SEQ ID NO: 2497476 - DNA, 17 bp, Homo sapiens
ttgctaatttttattaa

SEQ ID NO: 2497477 - DNA, 16 bp, Homo sapiens
ttgctacataattatc

SEQ ID NO: 2497478 - DNA, 15 bp, Homo sapiens
ttgctaccagtattt

SEQ ID NO: 2497479 - DNA, 23 bp, Homo sapiens
ttgctaccagtatttagaagcca

SEQ ID NO: 2497480 - DNA, 21 bp, Homo sapiens
ttgctagagctcctccctctc

SEQ ID NO: 2497481 - DNA, 12 bp, Homo sapiens
ttgctattctgt

SEQ ID NO: 2497482 - DNA, 17 bp, Homo sapiens
ttgctattctgtcccta

SEQ ID NO: 2497483 - DNA, 12 bp, Homo sapiens
ttgctcacccag

SEQ ID NO: 2497484 - DNA, 17 bp, Homo sapiens
ttgctccgcctggcctg

SEQ ID NO: 2497485 - DNA, 13 bp, Homo sapiens
tttaacagaaatt

SEQ ID NO: 2497486 - DNA, 14 bp, Homo sapiens
tttaacataagcta

SEQ ID NO: 2497487 - DNA, 16 bp, Homo sapiens
tttaacataagctatt

SEQ ID NO: 2497488 - DNA, 17 bp, Homo sapiens
tttaacataagctattt

SEQ ID NO: 2497489 - DNA, 18 bp, Homo sapiens
tttaacataagctatttt

SEQ ID NO: 2497490 - DNA, 18 bp, Homo sapiens
tttaacccccctgtacac

SEQ ID NO: 2497491 - DNA, 20 bp, Homo sapiens
tttaactcccattaccatgt

SEQ ID NO: 2497492 - DNA, 14 bp, Homo sapiens
tttaactgacaagc

SEQ ID NO: 2497493 - DNA, 12 bp, Homo sapiens
tttaactgtgga

SEQ ID NO: 2497494 - DNA, 15 bp, Homo sapiens
tttaactgtggatat

SEQ ID NO: 2497495 - DNA, 17 bp, Homo sapiens
tttaactttgttttatt

SEQ ID NO: 2497496 - DNA, 14 bp, Homo sapiens
tttaagctctgagc

SEQ ID NO: 2497497 - DNA, 17 bp, Homo sapiens
tttaagtgaaaatggtc

SEQ ID NO: 2497498 - DNA, 13 bp, Homo sapiens
tttaatataaagt

SEQ ID NO: 2497499 - DNA, 16 bp, Homo sapiens
tttaatataaagtttt

SEQ ID NO: 2497500 - DNA, 18 bp, Homo sapiens
tttaatataaagttttat

SEQ ID NO: 2497501 - DNA, 23 bp, Homo sapiens
tttaatataaagttttatatatt

SEQ ID NO: 2497502 - DNA, 16 bp, Homo sapiens
tttaatgaagatctaa

SEQ ID NO: 2497503 - DNA, 20 bp, Homo sapiens
tttaatgtatagtaaatcac

SEQ ID NO: 2497504 - DNA, 14 bp, Homo sapiens
tttaattaattggg

SEQ ID NO: 2497505 - DNA, 20 bp, Homo sapiens
tttaattaattgggccagct

SEQ ID NO: 2497506 - DNA, 22 bp, Homo sapiens
tttaattaattgggccagcttt

SEQ ID NO: 2497507 - DNA, 12 bp, Homo sapiens
tttaattctctc

SEQ ID NO: 2497508 - DNA, 12 bp, Homo sapiens
tttaattgtaaa

SEQ ID NO: 2497509 - DNA, 15 bp, Homo sapiens
tttaattgtaaagta

SEQ ID NO: 2497510 - DNA, 16 bp, Homo sapiens
tttaatttgaaatatg

SEQ ID NO: 2497511 - DNA, 16 bp, Homo sapiens
tttacaaactgaagag

SEQ ID NO: 2497512 - DNA, 17 bp, Homo sapiens
tttacaatgtaattatt

SEQ ID NO: 2497513 - DNA, 19 bp, Homo sapiens
tttacaatgtaattattta

SEQ ID NO: 2497514 - DNA, 19 bp, Homo sapiens
tttacacaatagaattata

SEQ ID NO: 2497515 - DNA, 19 bp, Homo sapiens
tttacagaattgcttgttt

SEQ ID NO: 2497516 - DNA, 18 bp, Homo sapiens
tttacaggaacttcatca

SEQ ID NO: 2497517 - DNA, 13 bp, Homo sapiens
tttacatgaagta

SEQ ID NO: 2497518 - DNA, 12 bp, Homo sapiens
tttacatgctta

SEQ ID NO: 2497519 - DNA, 14 bp, Homo sapiens
tttacatgcttatt

SEQ ID NO: 2497520 - DNA, 12 bp, Homo sapiens
tttacatgtttt

SEQ ID NO: 2497521 - DNA, 16 bp, Homo sapiens
tttacattgttgagct

SEQ ID NO: 2497522 - DNA, 13 bp, Homo sapiens
tttaccagaaagc

SEQ ID NO: 2497523 - DNA, 17 bp, Homo sapiens
tttaccagttgcctttt

SEQ ID NO: 2497524 - DNA, 17 bp, Homo sapiens
tttaccctggcccctct

SEQ ID NO: 2497525 - DNA, 13 bp, Homo sapiens
tttacccttcagg

SEQ ID NO: 2497526 - DNA, 18 bp, Homo sapiens
tttacgctttgattcata

SEQ ID NO: 2497527 - DNA, 18 bp, Homo sapiens
tttactagggatccctca

SEQ ID NO: 2497528 - DNA, 12 bp, Homo sapiens
tttactctgcct

SEQ ID NO: 2497529 - DNA, 15 bp, Homo sapiens
tttactgctctgaga

SEQ ID NO: 2497530 - DNA, 18 bp, Homo sapiens
tttactttagaagcctgc

SEQ ID NO: 2497531 - DNA, 12 bp, Homo sapiens
tttagaaaactt

SEQ ID NO: 2497532 - DNA, 13 bp, Homo sapiens
tttagaaaacttt

SEQ ID NO: 2497533 - DNA, 15 bp, Homo sapiens
tttagaaaactttaa

SEQ ID NO: 2497534 - DNA, 22 bp, Homo sapiens
tttagaaacagtgcaacactgg

SEQ ID NO: 2497535 - DNA, 21 bp, Homo sapiens
tttagaaagataattcactgt

SEQ ID NO: 2497536 - DNA, 19 bp, Homo sapiens
tttagaatcccagccccct

SEQ ID NO: 2497537 - DNA, 13 bp, Homo sapiens
tttagatagccct

SEQ ID NO: 2497538 - DNA, 23 bp, Homo sapiens
tttagatagccctgtcctggtgg

SEQ ID NO: 2497539 - DNA, 12 bp, Homo sapiens
tttagctctgag

SEQ ID NO: 2497540 - DNA, 18 bp, Homo sapiens
tttaggaagcaagcttaa

SEQ ID NO: 2497541 - DNA, 17 bp, Homo sapiens
tttagggaacaatttgg

SEQ ID NO: 2497542 - DNA, 11 bp, Homo sapiens
tttaggttcta

SEQ ID NO: 2497543 - DNA, 15 bp, Homo sapiens
tttaggttctaaagt

SEQ ID NO: 2497544 - DNA, 14 bp, Homo sapiens
tttagttgaatttt

SEQ ID NO: 2497545 - DNA, 23 bp, Homo sapiens
tttagttgaattttttttaacat

SEQ ID NO: 2497546 - DNA, 16 bp, Homo sapiens
tttagtttttcattaa

SEQ ID NO: 2497547 - DNA, 14 bp, Homo sapiens
tttataactaacat

SEQ ID NO: 2497548 - DNA, 16 bp, Homo sapiens
tttataagaaagcctg

SEQ ID NO: 2497549 - DNA, 23 bp, Homo sapiens
tttataagaaagcctgagtactc

SEQ ID NO: 2497550 - DNA, 20 bp, Homo sapiens
tttatactttccctaccctc

SEQ ID NO: 2497551 - DNA, 13 bp, Homo sapiens
tttatatatatat

SEQ ID NO: 2497552 - DNA, 13 bp, Homo sapiens
tttatatatgtat

SEQ ID NO: 2497553 - DNA, 18 bp, Homo sapiens
tttatatattatatggaa

SEQ ID NO: 2497554 - DNA, 17 bp, Homo sapiens
tttatatcccattttta

SEQ ID NO: 2497555 - DNA, 17 bp, Homo sapiens
tttatatgtacatgaga

SEQ ID NO: 2497556 - DNA, 16 bp, Homo sapiens
tttatattacactaca

SEQ ID NO: 2497557 - DNA, 14 bp, Homo sapiens
tttatatttaaatg

SEQ ID NO: 2497558 - DNA, 17 bp, Homo sapiens
tttatcattcaagtgta

SEQ ID NO: 2497559 - DNA, 16 bp, Homo sapiens
tttatccctcacctgt

SEQ ID NO: 2497560 - DNA, 15 bp, Homo sapiens
tttatcgctgggaaa

SEQ ID NO: 2497561 - DNA, 14 bp, Homo sapiens
tttatctataattt

SEQ ID NO: 2497562 - DNA, 16 bp, Homo sapiens
tttatctgaattttta

SEQ ID NO: 2497563 - DNA, 19 bp, Homo sapiens
tttatgaaaaagaagaatc

SEQ ID NO: 2497564 - DNA, 17 bp, Homo sapiens
tttatgagaaagccttc

SEQ ID NO: 2497565 - DNA, 18 bp, Homo sapiens
tttatgataatagattct

SEQ ID NO: 2497566 - DNA, 19 bp, Homo sapiens
tttatggtaaaaaatttat

SEQ ID NO: 2497567 - DNA, 11 bp, Homo sapiens
tttattaaaga

SEQ ID NO: 2497568 - DNA, 13 bp, Homo sapiens
tttattaaagaaa

SEQ ID NO: 2497569 - DNA, 16 bp, Homo sapiens
tttattaaagaaaaaa

SEQ ID NO: 2497570 - DNA, 19 bp, Homo sapiens
tttattaatcttagtgtat

SEQ ID NO: 2497571 - DNA, 18 bp, Homo sapiens
tttattacgtatgtctgg

SEQ ID NO: 2497572 - DNA, 19 bp, Homo sapiens
tttattacgtatgtctggt

SEQ ID NO: 2497573 - DNA, 18 bp, Homo sapiens
tttattccagaatgctgt

SEQ ID NO: 2497574 - DNA, 12 bp, Homo sapiens
tttattgacaca

SEQ ID NO: 2497575 - DNA, 13 bp, Homo sapiens
tttattgacacag

SEQ ID NO: 2497576 - DNA, 14 bp, Homo sapiens
tttattgtattctg

SEQ ID NO: 2497577 - DNA, 20 bp, Homo sapiens
tttatttcatttttcaatag

SEQ ID NO: 2497578 - DNA, 16 bp, Homo sapiens
tttatttctgcatatg

SEQ ID NO: 2497579 - DNA, 12 bp, Homo sapiens
tttcaaaaccag

SEQ ID NO: 2497580 - DNA, 13 bp, Homo sapiens
tttcaaaatgctt

SEQ ID NO: 2497581 - DNA, 16 bp, Homo sapiens
tttcaacatgagtgta

SEQ ID NO: 2497582 - DNA, 23 bp, Homo sapiens
tttcaagaggagcccccaccctg

SEQ ID NO: 2497583 - DNA, 11 bp, Homo sapiens
tttcaaggaag

SEQ ID NO: 2497584 - DNA, 19 bp, Homo sapiens
tttcaaggaagtagaaaca

SEQ ID NO: 2497585 - DNA, 15 bp, Homo sapiens
tttcaaggcactcta

SEQ ID NO: 2497586 - DNA, 18 bp, Homo sapiens
tttcaaggcactctagat

SEQ ID NO: 2497587 - DNA, 13 bp, Homo sapiens
tttcaaggttcta

SEQ ID NO: 2497588 - DNA, 16 bp, Homo sapiens
tttcaatacagatata

SEQ ID NO: 2497589 - DNA, 18 bp, Homo sapiens
tttcaatcaactttactg

SEQ ID NO: 2497590 - DNA, 22 bp, Homo sapiens
tttcaatcaactttactgtaat

SEQ ID NO: 2497591 - DNA, 22 bp, Homo sapiens
ttttacaaatgttaaaatgtgt

SEQ ID NO: 2497592 - DNA, 21 bp, Homo sapiens
ttttagacagtctcactttgt

SEQ ID NO: 2497593 - DNA, 11 bp, Homo sapiens
ttttaggaaat

SEQ ID NO: 2497594 - DNA, 12 bp, Homo sapiens
ttttaggaaatg

SEQ ID NO: 2497595 - DNA, 15 bp, Homo sapiens
ttttaggttctaaag

SEQ ID NO: 2497596 - DNA, 19 bp, Homo sapiens
ttttagtgaacttgaaata

SEQ ID NO: 2497597 - DNA, 12 bp, Homo sapiens
ttttagttgaat

SEQ ID NO: 2497598 - DNA, 22 bp, Homo sapiens
ttttataaatactgcaaatcag

SEQ ID NO: 2497599 - DNA, 19 bp, Homo sapiens
ttttataattctcattaaa

SEQ ID NO: 2497600 - DNA, 12 bp, Homo sapiens
ttttatatatta

SEQ ID NO: 2497601 - DNA, 19 bp, Homo sapiens
ttttatcattttcaaaatg

SEQ ID NO: 2497602 - DNA, 19 bp, Homo sapiens
ttttatgagaaagccttct

SEQ ID NO: 2497603 - DNA, 19 bp, Homo sapiens
ttttatgtagtaattgaca

SEQ ID NO: 2497604 - DNA, 14 bp, Homo sapiens
ttttattaatgcac

SEQ ID NO: 2497605 - DNA, 19 bp, Homo sapiens
ttttattaattttagtttt

SEQ ID NO: 2497606 - DNA, 20 bp, Homo sapiens
ttttattagtattgttgtcc

SEQ ID NO: 2497607 - DNA, 14 bp, Homo sapiens
ttttattatgcatt

SEQ ID NO: 2497608 - DNA, 17 bp, Homo sapiens
ttttattttcaaaacca

SEQ ID NO: 2497609 - DNA, 16 bp, Homo sapiens
ttttcaaacaaagatg

SEQ ID NO: 2497610 - DNA, 22 bp, Homo sapiens
ttttcaacagtgaagacagaag

SEQ ID NO: 2497611 - DNA, 13 bp, Homo sapiens
ttttcaccccacc

SEQ ID NO: 2497612 - DNA, 18 bp, Homo sapiens
ttttcagatgtgaaccat

SEQ ID NO: 2497613 - DNA, 20 bp, Homo sapiens
ttttcatccataactgaaca

SEQ ID NO: 2497614 - DNA, 19 bp, Homo sapiens
ttttcatcttcagttgtct

SEQ ID NO: 2497615 - DNA, 14 bp, Homo sapiens
ttttcattaaataa

SEQ ID NO: 2497616 - DNA, 20 bp, Homo sapiens
ttttcattccatgtgcccag

SEQ ID NO: 2497617 - DNA, 22 bp, Homo sapiens
ttttccaaatgtaataaacttt

SEQ ID NO: 2497618 - DNA, 22 bp, Homo sapiens
ttttccatggcaggaaggcttg

SEQ ID NO: 2497619 - DNA, 20 bp, Homo sapiens
ttttcccaaagcatccctct

SEQ ID NO: 2497620 - DNA, 20 bp, Homo sapiens
ttttcccatttatctaaata

SEQ ID NO: 2497621 - DNA, 14 bp, Homo sapiens
ttttccccagactt

SEQ ID NO: 2497622 - DNA, 22 bp, Homo sapiens
ttttccctctttggctcccctg

SEQ ID NO: 2497623 - DNA, 15 bp, Homo sapiens
ttttccctgtacagt

SEQ ID NO: 2497624 - DNA, 13 bp, Homo sapiens
ttttcctgtcctc

SEQ ID NO: 2497625 - DNA, 20 bp, Homo sapiens
ttttcctgtcctctttcagc

SEQ ID NO: 2497626 - DNA, 14 bp, Homo sapiens
ttttcgaaaatcaa

SEQ ID NO: 2497627 - DNA, 16 bp, Homo sapiens
ttttcgaaaatcaaat

SEQ ID NO: 2497628 - DNA, 20 bp, Homo sapiens
ttttctaaaggagtttatgt

SEQ ID NO: 2497629 - DNA, 12 bp, Homo sapiens
ttttctattaaa

SEQ ID NO: 2497630 - DNA, 15 bp, Homo sapiens
ttttctattaaaaga

SEQ ID NO: 2497631 - DNA, 18 bp, Homo sapiens
ttttctattaaaagactc

SEQ ID NO: 2497632 - DNA, 19 bp, Homo sapiens
ttttctattaaaagactca

SEQ ID NO: 2497633 - DNA, 20 bp, Homo sapiens
ttttctattaaaagactcat

SEQ ID NO: 2497634 - DNA, 16 bp, Homo sapiens
ttttctattttaataa

SEQ ID NO: 2497635 - DNA, 20 bp, Homo sapiens
ttttctggccagtgtttaaa

SEQ ID NO: 2497636 - DNA, 15 bp, Homo sapiens
ttttctggttctaac

SEQ ID NO: 2497637 - DNA, 17 bp, Homo sapiens
ttttctgtataaatgtc

SEQ ID NO: 2497638 - DNA, 16 bp, Homo sapiens
ttttcttaaagtgcca

SEQ ID NO: 2497639 - DNA, 14 bp, Homo sapiens
ttttctttaactgc

SEQ ID NO: 2497640 - DNA, 20 bp, Homo sapiens
ttttctttacaaaacaaact

SEQ ID NO: 2497641 - DNA, 13 bp, Homo sapiens
ttttctttataag

SEQ ID NO: 2497642 - DNA, 19 bp, Homo sapiens
ttttctttataagaaagcc

SEQ ID NO: 2497643 - DNA, 13 bp, Homo sapiens
ttttgaatcaata

SEQ ID NO: 2497644 - DNA, 18 bp, Homo sapiens
ttttgatactaagcattg

SEQ ID NO: 2497645 - DNA, 19 bp, Homo sapiens
ttttgatatgcatatttgt

SEQ ID NO: 2497646 - DNA, 18 bp, Homo sapiens
ttttgatgtaaagatgtt

SEQ ID NO: 2497647 - DNA, 13 bp, Homo sapiens
ttttgcaaagaaa

SEQ ID NO: 2497648 - DNA, 17 bp, Homo sapiens
ttttgcaaagatttaat

SEQ ID NO: 2497649 - DNA, 21 bp, Homo sapiens
ttttgcaaccaggaacagcaa

SEQ ID NO: 2497650 - DNA, 13 bp, Homo sapiens
ttttgcagtaact

SEQ ID NO: 2497651 - DNA, 16 bp, Homo sapiens
ttttgcagtaactgtt

SEQ ID NO: 2497652 - DNA, 14 bp, Homo sapiens
ttttgccacagctt

SEQ ID NO: 2497653 - DNA, 16 bp, Homo sapiens
ttttgccacagctttt

SEQ ID NO: 2497654 - DNA, 13 bp, Homo sapiens
ttttgccctttga

SEQ ID NO: 2497655 - DNA, 15 bp, Homo sapiens
ttttgccttttgcaa

SEQ ID NO: 2497656 - DNA, 15 bp, Homo sapiens
ttttggacttctggg

SEQ ID NO: 2497657 - DNA, 22 bp, Homo sapiens
ttttggctgaaattctcctgga

SEQ ID NO: 2497658 - DNA, 19 bp, Homo sapiens
ttttgtaataataaagaat

SEQ ID NO: 2497659 - DNA, 11 bp, Homo sapiens
ttttgtaccaa

SEQ ID NO: 2497660 - DNA, 21 bp, Homo sapiens
ttttgtagctggggctttgat

SEQ ID NO: 2497661 - DNA, 16 bp, Homo sapiens
ttttgtataaaataga

SEQ ID NO: 2497662 - DNA, 23 bp, Homo sapiens
ttttgtataattggatttcctaa

SEQ ID NO: 2497663 - DNA, 20 bp, Homo sapiens
ttttgtgatgcaaataaata

SEQ ID NO: 2497664 - DNA, 21 bp, Homo sapiens
ttttgtgtctcttatggatgt

SEQ ID NO: 2497665 - DNA, 16 bp, Homo sapiens
ttttgtgtttgttgta

SEQ ID NO: 2497666 - DNA, 13 bp, Homo sapiens
ttttgttggcata

SEQ ID NO: 2497667 - DNA, 15 bp, Homo sapiens
ttttgttttggctga

SEQ ID NO: 2497668 - DNA, 22 bp, Homo sapiens
tttttaaaaaagcttaaaactt

SEQ ID NO: 2497669 - DNA, 14 bp, Homo sapiens
tttttaaaaagcaa

SEQ ID NO: 2497670 - DNA, 16 bp, Homo sapiens
tttttaaacaagtatt

SEQ ID NO: 2497671 - DNA, 13 bp, Homo sapiens
tttttaaacatca

SEQ ID NO: 2497672 - DNA, 13 bp, Homo sapiens
tttttaaactgta

SEQ ID NO: 2497673 - DNA, 21 bp, Homo sapiens
tttttaaactgtacagtgtct

SEQ ID NO: 2497674 - DNA, 18 bp, Homo sapiens
tttttaagaatatctgta

SEQ ID NO: 2497675 - DNA, 14 bp, Homo sapiens
tttttaagctctga

SEQ ID NO: 2497676 - DNA, 13 bp, Homo sapiens
tttttaagtgaaa

SEQ ID NO: 2497677 - DNA, 14 bp, Homo sapiens
tttttaatatgctt

SEQ ID NO: 2497678 - DNA, 14 bp, Homo sapiens
tttttaattaattg

SEQ ID NO: 2497679 - DNA, 12 bp, Homo sapiens
tttttaattatt

SEQ ID NO: 2497680 - DNA, 15 bp, Homo sapiens
tttttactgctctga

SEQ ID NO: 2497681 - DNA, 13 bp, Homo sapiens
tttttaggaaatg

SEQ ID NO: 2497682 - DNA, 14 bp, Homo sapiens
tttttatcttttta

SEQ ID NO: 2497683 - DNA, 14 bp, Homo sapiens
tttttattatgcat

SEQ ID NO: 2497684 - DNA, 15 bp, Homo sapiens
tttttattatgcatt

SEQ ID NO: 2497685 - DNA, 12 bp, Homo sapiens
tttttatttctt

SEQ ID NO: 2497686 - DNA, 17 bp, Homo sapiens
tttttcagtattatatg

SEQ ID NO: 2497687 - DNA, 11 bp, Homo sapiens
tttttcagttg

SEQ ID NO: 2497688 - DNA, 20 bp, Homo sapiens
tttttcatcttcagttgtct

SEQ ID NO: 2497689 - DNA, 23 bp, Homo sapiens
tttttcatgcgatgacacttgta

SEQ ID NO: 2497690 - DNA, 18 bp, Homo sapiens
tttttccctatcactgaa

SEQ ID NO: 2497691 - DNA, 18 bp, Homo sapiens
tttttccttcaaagttta

SEQ ID NO: 2497692 - DNA, 19 bp, Homo sapiens
tttttccttcaaagtttaa

SEQ ID NO: 2497693 - DNA, 22 bp, Homo sapiens
tttttccttcaaagtttaataa

SEQ ID NO: 2497694 - DNA, 11 bp, Homo sapiens
tttttctatta

SEQ ID NO: 2497695 - DNA, 21 bp, Homo sapiens
tttttctattaaaagactcat

SEQ ID NO: 2497696 - DNA, 12 bp, Homo sapiens
aaacttttttat

SEQ ID NO: 2497697 - DNA, 17 bp, Homo sapiens
aaacttttttatttaaa

SEQ ID NO: 2497698 - DNA, 19 bp, Homo sapiens
aaacttttttatttaaaaa

SEQ ID NO: 2497699 - DNA, 15 bp, Homo sapiens
aaactttttttctgt

SEQ ID NO: 2497700 - DNA, 23 bp, Homo sapiens
aaactttttttctgtaccagtta

SEQ ID NO: 2497701 - DNA, 18 bp, Homo sapiens
aaagaaaaaaatgtattt

SEQ ID NO: 2497702 - DNA, 22 bp, Homo sapiens
aaagaaaaaaatgtattttatg

SEQ ID NO: 2497703 - DNA, 18 bp, Homo sapiens
aaagaaaaaaattgaaat

SEQ ID NO: 2497704 - DNA, 21 bp, Homo sapiens
aaagaaaaaaattgaaatgta

SEQ ID NO: 2497705 - DNA, 13 bp, Homo sapiens
aaagaaaaacaaa

SEQ ID NO: 2497706 - DNA, 13 bp, Homo sapiens
aaagaaaaccttt

SEQ ID NO: 2497707 - DNA, 20 bp, Homo sapiens
aaagaaaagatgcactttgc

SEQ ID NO: 2497708 - DNA, 16 bp, Homo sapiens
aaagaaagtgtatttg

SEQ ID NO: 2497709 - DNA, 20 bp, Homo sapiens
aaagaacgctgatttaaaga

SEQ ID NO: 2497710 - DNA, 15 bp, Homo sapiens
aaagaagacaaactt

SEQ ID NO: 2497711 - DNA, 18 bp, Homo sapiens
aaagaagacctgagaatg

SEQ ID NO: 2497712 - DNA, 15 bp, Homo sapiens
aaagaagtaaaagca

SEQ ID NO: 2497713 - DNA, 24 bp, Homo sapiens
aaagaagtgtggggattttcactg

SEQ ID NO: 2497714 - DNA, 16 bp, Homo sapiens
aaagaatagaagctaa

SEQ ID NO: 2497715 - DNA, 15 bp, Homo sapiens
aaagaattattttgt

SEQ ID NO: 2497716 - DNA, 19 bp, Homo sapiens
aaagacattcaggactgct

SEQ ID NO: 2497717 - DNA, 18 bp, Homo sapiens
aaagaccctggctttcat

SEQ ID NO: 2497718 - DNA, 14 bp, Homo sapiens
aaagactcatccgt

SEQ ID NO: 2497719 - DNA, 13 bp, Homo sapiens
aaagactggcttt

SEQ ID NO: 2497720 - DNA, 21 bp, Homo sapiens
aaagactggcttttattaatg

SEQ ID NO: 2497721 - DNA, 18 bp, Homo sapiens
aaagacttggttggtagg

SEQ ID NO: 2497722 - DNA, 20 bp, Homo sapiens
aaagacttggttggtagggt

SEQ ID NO: 2497723 - DNA, 19 bp, Homo sapiens
aaagaggcaccaggaagcc

SEQ ID NO: 2497724 - DNA, 13 bp, Homo sapiens
aaagagtagaatt

SEQ ID NO: 2497725 - DNA, 14 bp, Homo sapiens
aaagagttcaagaa

SEQ ID NO: 2497726 - DNA, 16 bp, Homo sapiens
aaagataaacacaaga

SEQ ID NO: 2497727 - DNA, 18 bp, Homo sapiens
aaagataaacacaagatt

SEQ ID NO: 2497728 - DNA, 21 bp, Homo sapiens
aaagatctgttttgaaggcaa

SEQ ID NO: 2497729 - DNA, 12 bp, Homo sapiens
aaagatgctttt

SEQ ID NO: 2497730 - DNA, 13 bp, Homo sapiens
aaagatgctttta

SEQ ID NO: 2497731 - DNA, 19 bp, Homo sapiens
aaagatgcttttaacagag

SEQ ID NO: 2497732 - DNA, 15 bp, Homo sapiens
aaagatggagtttct

SEQ ID NO: 2497733 - DNA, 17 bp, Homo sapiens
aaagatggagtttctaa

SEQ ID NO: 2497734 - DNA, 16 bp, Homo sapiens
aaagatgttctggata

SEQ ID NO: 2497735 - DNA, 19 bp, Homo sapiens
aaagattctatagttctag

SEQ ID NO: 2497736 - DNA, 15 bp, Homo sapiens
aaagcaaaaaagaaa

SEQ ID NO: 2497737 - DNA, 16 bp, Homo sapiens
aaagcaaaaaagaaaa

SEQ ID NO: 2497738 - DNA, 15 bp, Homo sapiens
aaagcaaacctgtaa

SEQ ID NO: 2497739 - DNA, 18 bp, Homo sapiens
aaagcaagaatcagagaa

SEQ ID NO: 2497740 - DNA, 19 bp, Homo sapiens
aaagcaagctgattaaatg

SEQ ID NO: 2497741 - DNA, 14 bp, Homo sapiens
aaagcaaggaaact

SEQ ID NO: 2497742 - DNA, 20 bp, Homo sapiens
aaagcaaggaaactatgtaa

SEQ ID NO: 2497743 - DNA, 14 bp, Homo sapiens
aaagcagaggccaa

SEQ ID NO: 2497744 - DNA, 12 bp, Homo sapiens
aaagcagccacg

SEQ ID NO: 2497745 - DNA, 16 bp, Homo sapiens
aaagcaggttcttgtt

SEQ ID NO: 2497746 - DNA, 17 bp, Homo sapiens
aaagcaggtttcaagga

SEQ ID NO: 2497747 - DNA, 21 bp, Homo sapiens
aaagcattttgtaataataaa

SEQ ID NO: 2497748 - DNA, 15 bp, Homo sapiens
aaagccaaacatata

SEQ ID NO: 2497749 - DNA, 15 bp, Homo sapiens
aaagccaggtccctc

SEQ ID NO: 2497750 - DNA, 22 bp, Homo sapiens
aaagcccatatgctaccaccag

SEQ ID NO: 2497751 - DNA, 20 bp, Homo sapiens
aaagcctcaaggttttaggt

SEQ ID NO: 2497752 - DNA, 16 bp, Homo sapiens
aaagcgaaaaaatcag

SEQ ID NO: 2497753 - DNA, 23 bp, Homo sapiens
aaagctcaaaggtttggaaggag

SEQ ID NO: 2497754 - DNA, 13 bp, Homo sapiens
aaagctttcagaa

SEQ ID NO: 2497755 - DNA, 23 bp, Homo sapiens
aaagctttcctgccccaggcctg

SEQ ID NO: 2497756 - DNA, 12 bp, Homo sapiens
aaaggaaaaaaa

SEQ ID NO: 2497757 - DNA, 15 bp, Homo sapiens
aaaggaaaaacaaac

SEQ ID NO: 2497758 - DNA, 17 bp, Homo sapiens
aaaggaaatctcacccc

SEQ ID NO: 2497759 - DNA, 12 bp, Homo sapiens
aaaggaagccaa

SEQ ID NO: 2497760 - DNA, 21 bp, Homo sapiens
aaaggagtttatgttccatta

SEQ ID NO: 2497761 - DNA, 23 bp, Homo sapiens
aaaggcagtttgcaaaaaatgtt

SEQ ID NO: 2497762 - DNA, 15 bp, Homo sapiens
aaaggctgttaaata

SEQ ID NO: 2497763 - DNA, 19 bp, Homo sapiens
aaaggctgttaaatacagg

SEQ ID NO: 2497764 - DNA, 22 bp, Homo sapiens
aaaggctgttaaatacaggaaa

SEQ ID NO: 2497765 - DNA, 18 bp, Homo sapiens
aaagggagggctctgagg

SEQ ID NO: 2497766 - DNA, 17 bp, Homo sapiens
aaagggagtctgccagg

SEQ ID NO: 2497767 - DNA, 23 bp, Homo sapiens
aaaggggtcggctgaccatgctc

SEQ ID NO: 2497768 - DNA, 24 bp, Homo sapiens
aaaggggtcggctgaccatgctca

SEQ ID NO: 2497769 - DNA, 19 bp, Homo sapiens
aaaggttagagaataaatt

SEQ ID NO: 2497770 - DNA, 21 bp, Homo sapiens
aaaggttctaggtttcaaaga

SEQ ID NO: 2497771 - DNA, 14 bp, Homo sapiens
aaaggtttaaatga

SEQ ID NO: 2497772 - DNA, 21 bp, Homo sapiens
aaaggtttaaatgaacaagag

SEQ ID NO: 2497773 - DNA, 20 bp, Homo sapiens
aaaggtttaagaaatagaat

SEQ ID NO: 2497774 - DNA, 15 bp, Homo sapiens
aaaggtttacagaat

SEQ ID NO: 2497775 - DNA, 18 bp, Homo sapiens
aaaggtttatgaaaaaga

SEQ ID NO: 2497776 - DNA, 12 bp, Homo sapiens
aaaggttttttt

SEQ ID NO: 2497777 - DNA, 16 bp, Homo sapiens
aaagtatgtattattt

SEQ ID NO: 2497778 - DNA, 18 bp, Homo sapiens
aaagtctctaattctatt

SEQ ID NO: 2497779 - DNA, 19 bp, Homo sapiens
aaagtctgttgattaaaga

SEQ ID NO: 2497780 - DNA, 20 bp, Homo sapiens
aaagtctgttgattaaagat

SEQ ID NO: 2497781 - DNA, 15 bp, Homo sapiens
aaagtgccagtattt

SEQ ID NO: 2497782 - DNA, 20 bp, Homo sapiens
aaagtgcctgacacactaac

SEQ ID NO: 2497783 - DNA, 14 bp, Homo sapiens
aaagtgcctttcag

SEQ ID NO: 2497784 - DNA, 20 bp, Homo sapiens
aaagtgcctttcaggatcta

SEQ ID NO: 2497785 - DNA, 17 bp, Homo sapiens
aaagtgctaaggttcta

SEQ ID NO: 2497786 - DNA, 20 bp, Homo sapiens
aaagtgctaaggttctaagg

SEQ ID NO: 2497787 - DNA, 21 bp, Homo sapiens
aaagtgctaaggttctaaggc

SEQ ID NO: 2497788 - DNA, 13 bp, Homo sapiens
aaagtggaacgaa

SEQ ID NO: 2497789 - DNA, 21 bp, Homo sapiens
aaagtgggttttttagttgaa

SEQ ID NO: 2497790 - DNA, 18 bp, Homo sapiens
aaagttagtatcttttga

SEQ ID NO: 2497791 - DNA, 21 bp, Homo sapiens
aaagttagtatcttttgatat

SEQ ID NO: 2497792 - DNA, 18 bp, Homo sapiens
aaagttcaacatgttatt

SEQ ID NO: 2497793 - DNA, 16 bp, Homo sapiens
aaagttccaagagtct

SEQ ID NO: 2497794 - DNA, 18 bp, Homo sapiens
aaagttccaagagtctaa

SEQ ID NO: 2497795 - DNA, 20 bp, Homo sapiens
aaagttccaagagtctaaag

SEQ ID NO: 2497796 - DNA, 21 bp, Homo sapiens
aaagttccaagagtctaaaga

SEQ ID NO: 2497797 - DNA, 11 bp, Homo sapiens
aaagttctaag

SEQ ID NO: 2497798 - DNA, 12 bp, Homo sapiens
aaagttctaaga

SEQ ID NO: 2497799 - DNA, 14 bp, Homo sapiens
aaagttctgtactc

SEQ ID NO: 2497800 - DNA, 13 bp, Homo sapiens
aactctggtggca

SEQ ID NO: 2497801 - DNA, 16 bp, Homo sapiens
aactctgttacacttt

SEQ ID NO: 2497802 - DNA, 22 bp, Homo sapiens
aactctgttacactttttggaa

SEQ ID NO: 2497803 - DNA, 23 bp, Homo sapiens
aactctgttacactttttggaag

SEQ ID NO: 2497804 - DNA, 15 bp, Homo sapiens
aactcttcactcttc

SEQ ID NO: 2497805 - DNA, 17 bp, Homo sapiens
aactcttcactcttcaa

SEQ ID NO: 2497806 - DNA, 17 bp, Homo sapiens
aactgaaaattatttaa

SEQ ID NO: 2497807 - DNA, 17 bp, Homo sapiens
aactgaataccactctg

SEQ ID NO: 2497808 - DNA, 22 bp, Homo sapiens
aactgactattcttgatgtaaa

SEQ ID NO: 2497809 - DNA, 21 bp, Homo sapiens
aactgatccagtataagacta

SEQ ID NO: 2497810 - DNA, 21 bp, Homo sapiens
aactgcaggccctggcctccc

SEQ ID NO: 2497811 - DNA, 14 bp, Homo sapiens
aactgcagggaaaa

SEQ ID NO: 2497812 - DNA, 16 bp, Homo sapiens
aactgccgtaatttaa

SEQ ID NO: 2497813 - DNA, 14 bp, Homo sapiens
aactgcctagaaac

SEQ ID NO: 2497814 - DNA, 22 bp, Homo sapiens
aactgcctagaaacaacactgt

SEQ ID NO: 2497815 - DNA, 15 bp, Homo sapiens
aactgctttctgttc

SEQ ID NO: 2497816 - DNA, 15 bp, Homo sapiens
aactggaaaacagaa

SEQ ID NO: 2497817 - DNA, 17 bp, Homo sapiens
aactggaaaacagaaca

SEQ ID NO: 2497818 - DNA, 12 bp, Homo sapiens
aactggaaagaa

SEQ ID NO: 2497819 - DNA, 14 bp, Homo sapiens
aactggcaggcagg

SEQ ID NO: 2497820 - DNA, 22 bp, Homo sapiens
aactggcaggcaggctcccagg

SEQ ID NO: 2497821 - DNA, 22 bp, Homo sapiens
aactgggaacccctttcccacc

SEQ ID NO: 2497822 - DNA, 14 bp, Homo sapiens
aactgtaaagatgt

SEQ ID NO: 2497823 - DNA, 13 bp, Homo sapiens
aactgtaaataaa

SEQ ID NO: 2497824 - DNA, 18 bp, Homo sapiens
aactgtacagtgtctttt

SEQ ID NO: 2497825 - DNA, 20 bp, Homo sapiens
aactgtatttgaaataagaa

SEQ ID NO: 2497826 - DNA, 19 bp, Homo sapiens
aacttaaatgttattatct

SEQ ID NO: 2497827 - DNA, 21 bp, Homo sapiens
aacttaccaggcaccaaaaga

SEQ ID NO: 2497828 - DNA, 19 bp, Homo sapiens
aacttagattttacatgaa

SEQ ID NO: 2497829 - DNA, 16 bp, Homo sapiens
aacttcatttcagagt

SEQ ID NO: 2497830 - DNA, 22 bp, Homo sapiens
aacttccaggtgttactgtaat

SEQ ID NO: 2497831 - DNA, 17 bp, Homo sapiens
aacttccccatcttcta

SEQ ID NO: 2497832 - DNA, 15 bp, Homo sapiens
aacttctaattgcca

SEQ ID NO: 2497833 - DNA, 19 bp, Homo sapiens
aacttcttatggaattgat

SEQ ID NO: 2497834 - DNA, 17 bp, Homo sapiens
aacttgatccatttcta

SEQ ID NO: 2497835 - DNA, 11 bp, Homo sapiens
aacttggctca

SEQ ID NO: 2497836 - DNA, 22 bp, Homo sapiens
aacttggttttgctacataatt

SEQ ID NO: 2497837 - DNA, 19 bp, Homo sapiens
aacttgtcctagcacagat

SEQ ID NO: 2497838 - DNA, 11 bp, Homo sapiens
aactttactgt

SEQ ID NO: 2497839 - DNA, 16 bp, Homo sapiens
aactttccaaacacca

SEQ ID NO: 2497840 - DNA, 15 bp, Homo sapiens
aactttgaagttagc

SEQ ID NO: 2497841 - DNA, 17 bp, Homo sapiens
aacttttagtaaagtca

SEQ ID NO: 2497842 - DNA, 18 bp, Homo sapiens
aacttttctattaaaagt

SEQ ID NO: 2497843 - DNA, 13 bp, Homo sapiens
aacttttgtgaat

SEQ ID NO: 2497844 - DNA, 15 bp, Homo sapiens
aactttttgttctgg

SEQ ID NO: 2497845 - DNA, 23 bp, Homo sapiens
aactttttgttctggtccttttt

SEQ ID NO: 2497846 - DNA, 22 bp, Homo sapiens
aactttttttctgtaccagtta

SEQ ID NO: 2497847 - DNA, 19 bp, Homo sapiens
aagaaaaaaattgaaatgt

SEQ ID NO: 2497848 - DNA, 15 bp, Homo sapiens
aagaaaaagaagcaa

SEQ ID NO: 2497849 - DNA, 15 bp, Homo sapiens
aagaaaaataaagaa

SEQ ID NO: 2497850 - DNA, 11 bp, Homo sapiens
aagaaaagatg

SEQ ID NO: 2497851 - DNA, 14 bp, Homo sapiens
aagaaacaaagatg

SEQ ID NO: 2497852 - DNA, 23 bp, Homo sapiens
aagaaactttctttctcactaaa

SEQ ID NO: 2497853 - DNA, 21 bp, Homo sapiens
aagaaataaaaggaagccaaa

SEQ ID NO: 2497854 - DNA, 15 bp, Homo sapiens
aagaaataagttttt

SEQ ID NO: 2497855 - DNA, 13 bp, Homo sapiens
aagaaatggtgaa

SEQ ID NO: 2497856 - DNA, 17 bp, Homo sapiens
aagaaattgaatacttt

SEQ ID NO: 2497857 - DNA, 18 bp, Homo sapiens
aagaaattgaatactttg

SEQ ID NO: 2497858 - DNA, 19 bp, Homo sapiens
aagaaattgaatactttga

SEQ ID NO: 2497859 - DNA, 21 bp, Homo sapiens
aagaacaccctatattttgca

SEQ ID NO: 2497860 - DNA, 14 bp, Homo sapiens
aagaacctggaact

SEQ ID NO: 2497861 - DNA, 18 bp, Homo sapiens
aagaactttgagctactg

SEQ ID NO: 2497862 - DNA, 13 bp, Homo sapiens
aagaagaagggca

SEQ ID NO: 2497863 - DNA, 15 bp, Homo sapiens
aagaagacaaacttt

SEQ ID NO: 2497864 - DNA, 20 bp, Homo sapiens
aagaagacctgagaatgtat

SEQ ID NO: 2497865 - DNA, 21 bp, Homo sapiens
aagaagacctgagaatgtatc

SEQ ID NO: 2497866 - DNA, 19 bp, Homo sapiens
aagaagagcgagagatcaa

SEQ ID NO: 2497867 - DNA, 22 bp, Homo sapiens
aagaagcagtggccttattgca

SEQ ID NO: 2497868 - DNA, 15 bp, Homo sapiens
aagaagcccccagct

SEQ ID NO: 2497869 - DNA, 16 bp, Homo sapiens
aagaagcccccagcta

SEQ ID NO: 2497870 - DNA, 14 bp, Homo sapiens
aagaaggtgaatag

SEQ ID NO: 2497871 - DNA, 15 bp, Homo sapiens
aagaagtttcatcat

SEQ ID NO: 2497872 - DNA, 18 bp, Homo sapiens
aagaagtttcatcatttt

SEQ ID NO: 2497873 - DNA, 17 bp, Homo sapiens
aagaatacttctcattt

SEQ ID NO: 2497874 - DNA, 11 bp, Homo sapiens
aagaatagaac

SEQ ID NO: 2497875 - DNA, 17 bp, Homo sapiens
aagaatagcattgtaaa

SEQ ID NO: 2497876 - DNA, 19 bp, Homo sapiens
aagaatatctgtaatggta

SEQ ID NO: 2497877 - DNA, 23 bp, Homo sapiens
aagaatcagagaaggaacatacc

SEQ ID NO: 2497878 - DNA, 17 bp, Homo sapiens
aagaatccacatttcta

SEQ ID NO: 2497879 - DNA, 19 bp, Homo sapiens
aagaatccacatttctaaa

SEQ ID NO: 2497880 - DNA, 20 bp, Homo sapiens
aagaatctcatctcagtgaa

SEQ ID NO: 2497881 - DNA, 20 bp, Homo sapiens
aagaatcttggtttgccttc

SEQ ID NO: 2497882 - DNA, 17 bp, Homo sapiens
aagaatgcacaagaatg

SEQ ID NO: 2497883 - DNA, 18 bp, Homo sapiens
aagaatgcacaagaatgg

SEQ ID NO: 2497884 - DNA, 13 bp, Homo sapiens
aagaatgcttaat

SEQ ID NO: 2497885 - DNA, 16 bp, Homo sapiens
aagaattattttgatg

SEQ ID NO: 2497886 - DNA, 16 bp, Homo sapiens
aagaattgagtaatgg

SEQ ID NO: 2497887 - DNA, 20 bp, Homo sapiens
aagaattgtggtttatatat

SEQ ID NO: 2497888 - DNA, 21 bp, Homo sapiens
aagacacattttttaggaaat

SEQ ID NO: 2497889 - DNA, 16 bp, Homo sapiens
aagacagaagtttgca

SEQ ID NO: 2497890 - DNA, 18 bp, Homo sapiens
aagacagaagtttgcact

SEQ ID NO: 2497891 - DNA, 12 bp, Homo sapiens
aagacatgaagc

SEQ ID NO: 2497892 - DNA, 16 bp, Homo sapiens
aagacattcaggactg

SEQ ID NO: 2497893 - DNA, 14 bp, Homo sapiens
aagaccctggcttt

SEQ ID NO: 2497894 - DNA, 17 bp, Homo sapiens
aagacccttttgggttt

SEQ ID NO: 2497895 - DNA, 17 bp, Homo sapiens
aagacctactgttctaa

SEQ ID NO: 2497896 - DNA, 17 bp, Homo sapiens
aagacctggcagctctg

SEQ ID NO: 2497897 - DNA, 16 bp, Homo sapiens
aagactcaaatgttct

SEQ ID NO: 2497898 - DNA, 19 bp, Homo sapiens
aagactcaaatgttctaag

SEQ ID NO: 2497899 - DNA, 11 bp, Homo sapiens
aagactcatcc

SEQ ID NO: 2497900 - DNA, 14 bp, Homo sapiens
aagactcctagctg

SEQ ID NO: 2497901 - DNA, 21 bp, Homo sapiens
aagactctagagtccaaggtt

SEQ ID NO: 2497902 - DNA, 18 bp, Homo sapiens
aagactgctgtggccagg

SEQ ID NO: 2497903 - DNA, 22 bp, Homo sapiens
aagactggcttttattaatgca

SEQ ID NO: 2497904 - DNA, 21 bp, Homo sapiens
aataaaaggaagccaaagagt

SEQ ID NO: 2497905 - DNA, 16 bp, Homo sapiens
aataaaatttgttgca

SEQ ID NO: 2497906 - DNA, 17 bp, Homo sapiens
aataaagaaaagatgca

SEQ ID NO: 2497907 - DNA, 18 bp, Homo sapiens
aataaaggatgtgattgt

SEQ ID NO: 2497908 - DNA, 15 bp, Homo sapiens
aataaaggcagtttt

SEQ ID NO: 2497909 - DNA, 17 bp, Homo sapiens
aataaatctgacccagt

SEQ ID NO: 2497910 - DNA, 20 bp, Homo sapiens
aataaatctgacccagtgcc

SEQ ID NO: 2497911 - DNA, 13 bp, Homo sapiens
aataaatgtcact

SEQ ID NO: 2497912 - DNA, 19 bp, Homo sapiens
aataaatgtcactttttga

SEQ ID NO: 2497913 - DNA, 18 bp, Homo sapiens
aataaattgtacagccgg

SEQ ID NO: 2497914 - DNA, 22 bp, Homo sapiens
aataaattttttataaaagtgt

SEQ ID NO: 2497915 - DNA, 19 bp, Homo sapiens
aataactcctcattgtaaa

SEQ ID NO: 2497916 - DNA, 16 bp, Homo sapiens
aataactcctcccagg

SEQ ID NO: 2497917 - DNA, 17 bp, Homo sapiens
aataactcctcccaggg

SEQ ID NO: 2497918 - DNA, 22 bp, Homo sapiens
aataactcctcccagggtttta

SEQ ID NO: 2497919 - DNA, 20 bp, Homo sapiens
aataactggaaaacagaaca

SEQ ID NO: 2497920 - DNA, 21 bp, Homo sapiens
aataactggaaaacagaacac

SEQ ID NO: 2497921 - DNA, 22 bp, Homo sapiens
aataagaaacaactctttgaga

SEQ ID NO: 2497922 - DNA, 14 bp, Homo sapiens
aataagctatttga

SEQ ID NO: 2497923 - DNA, 20 bp, Homo sapiens
aataagctatttgatgtaat

SEQ ID NO: 2497924 - DNA, 14 bp, Homo sapiens
aataaggaaaagct

SEQ ID NO: 2497925 - DNA, 13 bp, Homo sapiens
aataaggttttaa

SEQ ID NO: 2497926 - DNA, 14 bp, Homo sapiens
aataagtcaacagt

SEQ ID NO: 2497927 - DNA, 11 bp, Homo sapiens
aataagttatt

SEQ ID NO: 2497928 - DNA, 13 bp, Homo sapiens
aataagttattgc

SEQ ID NO: 2497929 - DNA, 12 bp, Homo sapiens
aataataaagaa

SEQ ID NO: 2497930 - DNA, 17 bp, Homo sapiens
aataatacattatattt

SEQ ID NO: 2497931 - DNA, 18 bp, Homo sapiens
aataatacctaagccttc

SEQ ID NO: 2497932 - DNA, 16 bp, Homo sapiens
aataatactgctgaga

SEQ ID NO: 2497933 - DNA, 15 bp, Homo sapiens
aataatatattttct

SEQ ID NO: 2497934 - DNA, 14 bp, Homo sapiens
aataatgtgtagtt

SEQ ID NO: 2497935 - DNA, 17 bp, Homo sapiens
aataattctgagttttg

SEQ ID NO: 2497936 - DNA, 19 bp, Homo sapiens
aataattctgagttttgtg

SEQ ID NO: 2497937 - DNA, 22 bp, Homo sapiens
aataattctgagttttgtgttt

SEQ ID NO: 2497938 - DNA, 12 bp, Homo sapiens
aataatttagac

SEQ ID NO: 2497939 - DNA, 12 bp, Homo sapiens
aatacaaatgga

SEQ ID NO: 2497940 - DNA, 20 bp, Homo sapiens
aatacaattttttttattag

SEQ ID NO: 2497941 - DNA, 15 bp, Homo sapiens
aatacagactggatg

SEQ ID NO: 2497942 - DNA, 19 bp, Homo sapiens
aatacagatatattttctt

SEQ ID NO: 2497943 - DNA, 13 bp, Homo sapiens
aatacaggaaaca

SEQ ID NO: 2497944 - DNA, 18 bp, Homo sapiens
aatacaggaaacagttgc

SEQ ID NO: 2497945 - DNA, 23 bp, Homo sapiens
aatacaggaaacagttgcatgta

SEQ ID NO: 2497946 - DNA, 21 bp, Homo sapiens
aatacagtcttccatttgcaa

SEQ ID NO: 2497947 - DNA, 17 bp, Homo sapiens
aatacatgacatttatt

SEQ ID NO: 2497948 - DNA, 19 bp, Homo sapiens
aatacattatatttctatt

SEQ ID NO: 2497949 - DNA, 14 bp, Homo sapiens
aatacatttaaaac

SEQ ID NO: 2497950 - DNA, 22 bp, Homo sapiens
aatacatttaaaacattaaaat

SEQ ID NO: 2497951 - DNA, 23 bp, Homo sapiens
aatacatttaaaacattaaaata

SEQ ID NO: 2497952 - DNA, 17 bp, Homo sapiens
aataccactctgtaatt

SEQ ID NO: 2497953 - DNA, 14 bp, Homo sapiens
aatactaccttgaa

SEQ ID NO: 2497954 - DNA, 15 bp, Homo sapiens
aatactaccttgaaa

SEQ ID NO: 2497955 - DNA, 21 bp, Homo sapiens
aatactaccttgaaaataaga

SEQ ID NO: 2497956 - DNA, 15 bp, Homo sapiens
aatactgaacatctg

SEQ ID NO: 2497957 - DNA, 23 bp, Homo sapiens
aatactgctacagcaatttctaa

SEQ ID NO: 2497958 - DNA, 13 bp, Homo sapiens
aatactgctgaga

SEQ ID NO: 2497959 - DNA, 21 bp, Homo sapiens
aatactgctgagatacataca

SEQ ID NO: 2497960 - DNA, 14 bp, Homo sapiens
aatacttctcattt

SEQ ID NO: 2497961 - DNA, 22 bp, Homo sapiens
aatacttctcattttttaaaaa

SEQ ID NO: 2497962 - DNA, 13 bp, Homo sapiens
aatacttcttgtg

SEQ ID NO: 2497963 - DNA, 17 bp, Homo sapiens
aatacttggagggccca

SEQ ID NO: 2497964 - DNA, 15 bp, Homo sapiens
aatactttgaatgtg

SEQ ID NO: 2497965 - DNA, 20 bp, Homo sapiens
aatacttttactctgcctac

SEQ ID NO: 2497966 - DNA, 13 bp, Homo sapiens
aatagaaaatggt

SEQ ID NO: 2497967 - DNA, 22 bp, Homo sapiens
aatagaagctaaggtttagata

SEQ ID NO: 2497968 - DNA, 13 bp, Homo sapiens
aatagaaggtgat

SEQ ID NO: 2497969 - DNA, 14 bp, Homo sapiens
aatagaaggtgatg

SEQ ID NO: 2497970 - DNA, 16 bp, Homo sapiens
aatagaattataactg

SEQ ID NO: 2497971 - DNA, 14 bp, Homo sapiens
aatagacaaataga

SEQ ID NO: 2497972 - DNA, 23 bp, Homo sapiens
aatagacactccccgaagtcttt

SEQ ID NO: 2497973 - DNA, 16 bp, Homo sapiens
aatagagcctgaggga

SEQ ID NO: 2497974 - DNA, 12 bp, Homo sapiens
aatagattctct

SEQ ID NO: 2497975 - DNA, 20 bp, Homo sapiens
aatagcaaaagaagaagttt

SEQ ID NO: 2497976 - DNA, 14 bp, Homo sapiens
aatagcaaagaatt

SEQ ID NO: 2497977 - DNA, 15 bp, Homo sapiens
aatagcaaagaattg

SEQ ID NO: 2497978 - DNA, 14 bp, Homo sapiens
aatagcagcctttc

SEQ ID NO: 2497979 - DNA, 20 bp, Homo sapiens
aatagcatgtcactaaagca

SEQ ID NO: 2497980 - DNA, 21 bp, Homo sapiens
aatagccactaaccttgcctg

SEQ ID NO: 2497981 - DNA, 23 bp, Homo sapiens
aatagccactaaccttgcctggt

SEQ ID NO: 2497982 - DNA, 15 bp, Homo sapiens
aatagccatatttgt

SEQ ID NO: 2497983 - DNA, 15 bp, Homo sapiens
aatagcgttcttgta

SEQ ID NO: 2497984 - DNA, 16 bp, Homo sapiens
aatagcgttcttgtaa

SEQ ID NO: 2497985 - DNA, 18 bp, Homo sapiens
aatagctgtaaacttcca

SEQ ID NO: 2497986 - DNA, 20 bp, Homo sapiens
aatagggtatattttcctat

SEQ ID NO: 2497987 - DNA, 16 bp, Homo sapiens
aatagtatttcccatt

SEQ ID NO: 2497988 - DNA, 14 bp, Homo sapiens
aatataaaatatga

SEQ ID NO: 2497989 - DNA, 18 bp, Homo sapiens
aatataaagacgttttat

SEQ ID NO: 2497990 - DNA, 21 bp, Homo sapiens
aatataaagttttatatatta

SEQ ID NO: 2497991 - DNA, 11 bp, Homo sapiens
aatataaatgc

SEQ ID NO: 2497992 - DNA, 12 bp, Homo sapiens
aatataaatgca

SEQ ID NO: 2497993 - DNA, 13 bp, Homo sapiens
aatataaatgcaa

SEQ ID NO: 2497994 - DNA, 17 bp, Homo sapiens
aatataaatgcaaataa

SEQ ID NO: 2497995 - DNA, 15 bp, Homo sapiens
aatataattgtttta

SEQ ID NO: 2497996 - DNA, 19 bp, Homo sapiens
aatatatattatcttttca

SEQ ID NO: 2497997 - DNA, 15 bp, Homo sapiens
aatatattattactt

SEQ ID NO: 2497998 - DNA, 21 bp, Homo sapiens
aatatattattacttgtaaat

SEQ ID NO: 2497999 - DNA, 20 bp, Homo sapiens
aatatatttaagataattat

SEQ ID NO: 2498000 - DNA, 21 bp, Homo sapiens
aatatattttctgttttcttt

SEQ ID NO: 2498001 - DNA, 15 bp, Homo sapiens
aatatcctaaacatc

SEQ ID NO: 2498002 - DNA, 19 bp, Homo sapiens
aatatgcttaaaataagca

SEQ ID NO: 2498003 - DNA, 21 bp, Homo sapiens
aatatgggggccttttgggaa

SEQ ID NO: 2498004 - DNA, 18 bp, Homo sapiens
aatatgtacatttctcag

SEQ ID NO: 2498005 - DNA, 19 bp, Homo sapiens
aatatgtacatttctcagg

SEQ ID NO: 2498006 - DNA, 20 bp, Homo sapiens
aatatgtacatttctcaggc

SEQ ID NO: 2498007 - DNA, 18 bp, Homo sapiens
aatattatgagatgctgg

SEQ ID NO: 2498008 - DNA, 22 bp, Homo sapiens
acactgatgcttagatgttcca

SEQ ID NO: 2498009 - DNA, 18 bp, Homo sapiens
acactgcagccccaccca

SEQ ID NO: 2498010 - DNA, 13 bp, Homo sapiens
acactgctctaac

SEQ ID NO: 2498011 - DNA, 14 bp, Homo sapiens
acactgctctaaca

SEQ ID NO: 2498012 - DNA, 19 bp, Homo sapiens
acactgggtggtggcctgg

SEQ ID NO: 2498013 - DNA, 19 bp, Homo sapiens
acactgtagtaaataatgc

SEQ ID NO: 2498014 - DNA, 21 bp, Homo sapiens
acactgtgcacatctgtgtct

SEQ ID NO: 2498015 - DNA, 24 bp, Homo sapiens
acacttctcaggacacaggcctgt

SEQ ID NO: 2498016 - DNA, 21 bp, Homo sapiens
acacttgtaattttgtatctt

SEQ ID NO: 2498017 - DNA, 14 bp, Homo sapiens
acacttgtacaatt

SEQ ID NO: 2498018 - DNA, 19 bp, Homo sapiens
acactttgccatattttca

SEQ ID NO: 2498019 - DNA, 21 bp, Homo sapiens
acactttttctctttccatga

SEQ ID NO: 2498020 - DNA, 11 bp, Homo sapiens
acagaaaaacc

SEQ ID NO: 2498021 - DNA, 14 bp, Homo sapiens
acagaaaaaccttg

SEQ ID NO: 2498022 - DNA, 19 bp, Homo sapiens
acagaaaaatatgtaccaa

SEQ ID NO: 2498023 - DNA, 20 bp, Homo sapiens
acagaaacctttttaaaaat

SEQ ID NO: 2498024 - DNA, 23 bp, Homo sapiens
acagaaactaaactcttaccata

SEQ ID NO: 2498025 - DNA, 14 bp, Homo sapiens
acagaaattgtata

SEQ ID NO: 2498026 - DNA, 13 bp, Homo sapiens
acagaacacttat

SEQ ID NO: 2498027 - DNA, 18 bp, Homo sapiens
acagaacttcagaaagac

SEQ ID NO: 2498028 - DNA, 19 bp, Homo sapiens
acagaacttcagaaagact

SEQ ID NO: 2498029 - DNA, 20 bp, Homo sapiens
acagaacttcagaaagactt

SEQ ID NO: 2498030 - DNA, 12 bp, Homo sapiens
acagaagaaaca

SEQ ID NO: 2498031 - DNA, 14 bp, Homo sapiens
acagaagaaacaag

SEQ ID NO: 2498032 - DNA, 17 bp, Homo sapiens
acagaagtttgcactat

SEQ ID NO: 2498033 - DNA, 17 bp, Homo sapiens
acagacggaagggtaaa

SEQ ID NO: 2498034 - DNA, 17 bp, Homo sapiens
acagactatttttagat

SEQ ID NO: 2498035 - DNA, 22 bp, Homo sapiens
acagagaaaccagcttccttca

SEQ ID NO: 2498036 - DNA, 23 bp, Homo sapiens
acagagaaaccagcttccttcag

SEQ ID NO: 2498037 - DNA, 9 bp, Homo sapiens
acagagaag

SEQ ID NO: 2498038 - DNA, 15 bp, Homo sapiens
acagagaagccatca

SEQ ID NO: 2498039 - DNA, 22 bp, Homo sapiens
acagagaagccttcaagctctg

SEQ ID NO: 2498040 - DNA, 12 bp, Homo sapiens
acagagaagtca

SEQ ID NO: 2498041 - DNA, 13 bp, Homo sapiens
acagagaccaaga

SEQ ID NO: 2498042 - DNA, 16 bp, Homo sapiens
acagagaggactgtag

SEQ ID NO: 2498043 - DNA, 16 bp, Homo sapiens
acagagattctgaact

SEQ ID NO: 2498044 - DNA, 11 bp, Homo sapiens
acagagccagg

SEQ ID NO: 2498045 - DNA, 14 bp, Homo sapiens
acagagccaggaga

SEQ ID NO: 2498046 - DNA, 20 bp, Homo sapiens
acagagccaggagaagctca

SEQ ID NO: 2498047 - DNA, 14 bp, Homo sapiens
acagagcttccctg

SEQ ID NO: 2498048 - DNA, 15 bp, Homo sapiens
acagagcttccctga

SEQ ID NO: 2498049 - DNA, 13 bp, Homo sapiens
acagaggcagccc

SEQ ID NO: 2498050 - DNA, 16 bp, Homo sapiens
acagaggccccagcct

SEQ ID NO: 2498051 - DNA, 18 bp, Homo sapiens
acagaggccccagcctcc

SEQ ID NO: 2498052 - DNA, 18 bp, Homo sapiens
acagagtgtggactctgg

SEQ ID NO: 2498053 - DNA, 16 bp, Homo sapiens
acagagttgatttttt

SEQ ID NO: 2498054 - DNA, 23 bp, Homo sapiens
acagatcgaaccgttttgaagct

SEQ ID NO: 2498055 - DNA, 22 bp, Homo sapiens
acagatctggaacctcagcctg

SEQ ID NO: 2498056 - DNA, 13 bp, Homo sapiens
acagatgagtcac

SEQ ID NO: 2498057 - DNA, 22 bp, Homo sapiens
acagatggcactttgaaggggc

SEQ ID NO: 2498058 - DNA, 16 bp, Homo sapiens
acagatgggcaaatta

SEQ ID NO: 2498059 - DNA, 21 bp, Homo sapiens
acagatttggaaagactggac

SEQ ID NO: 2498060 - DNA, 15 bp, Homo sapiens
acagcaaacaggtgc

SEQ ID NO: 2498061 - DNA, 22 bp, Homo sapiens
acagcaaacaggtgctaatttg

SEQ ID NO: 2498062 - DNA, 16 bp, Homo sapiens
acagcaaatgcaaaaa

SEQ ID NO: 2498063 - DNA, 15 bp, Homo sapiens
acagcatctccaagc

SEQ ID NO: 2498064 - DNA, 16 bp, Homo sapiens
acagccaactagcccc

SEQ ID NO: 2498065 - DNA, 20 bp, Homo sapiens
acagccaactagcccctggg

SEQ ID NO: 2498066 - DNA, 16 bp, Homo sapiens
acagccagcacctggc

SEQ ID NO: 2498067 - DNA, 22 bp, Homo sapiens
acagccctgtcagcatgaattt

SEQ ID NO: 2498068 - DNA, 12 bp, Homo sapiens
acagcctcagaa

SEQ ID NO: 2498069 - DNA, 15 bp, Homo sapiens
acagcctcccctgcc

SEQ ID NO: 2498070 - DNA, 17 bp, Homo sapiens
acagcctcccctgccag

SEQ ID NO: 2498071 - DNA, 19 bp, Homo sapiens
acagcctcccctgccaggg

SEQ ID NO: 2498072 - DNA, 21 bp, Homo sapiens
acagcctcccctgccagggca

SEQ ID NO: 2498073 - DNA, 20 bp, Homo sapiens
acagcctgacaacatttcta

SEQ ID NO: 2498074 - DNA, 21 bp, Homo sapiens
acagcctgacaacatttctat

SEQ ID NO: 2498075 - DNA, 15 bp, Homo sapiens
acagcctgcaagtca

SEQ ID NO: 2498076 - DNA, 16 bp, Homo sapiens
acagcggaggtgtgga

SEQ ID NO: 2498077 - DNA, 22 bp, Homo sapiens
acagcgttcctagagaagacag

SEQ ID NO: 2498078 - DNA, 14 bp, Homo sapiens
acagctactctccc

SEQ ID NO: 2498079 - DNA, 17 bp, Homo sapiens
acagctggaccctgacc

SEQ ID NO: 2498080 - DNA, 12 bp, Homo sapiens
acagctggtgta

SEQ ID NO: 2498081 - DNA, 15 bp, Homo sapiens
acagctggtgtagct

SEQ ID NO: 2498082 - DNA, 19 bp, Homo sapiens
acagctggtgtagctacag

SEQ ID NO: 2498083 - DNA, 17 bp, Homo sapiens
acagctgtattgtctga

SEQ ID NO: 2498084 - DNA, 19 bp, Homo sapiens
acagctgtattgtctgaac

SEQ ID NO: 2498085 - DNA, 17 bp, Homo sapiens
acagctgtgcctcgctc

SEQ ID NO: 2498086 - DNA, 20 bp, Homo sapiens
acagcttgtctcttgcctgc

SEQ ID NO: 2498087 - DNA, 22 bp, Homo sapiens
acagcttgtctcttgcctgcca

SEQ ID NO: 2498088 - DNA, 12 bp, Homo sapiens
acagcttttgca

SEQ ID NO: 2498089 - DNA, 14 bp, Homo sapiens
acagcttttgcaac

SEQ ID NO: 2498090 - DNA, 22 bp, Homo sapiens
acaggaaactcctgtgaccaca

SEQ ID NO: 2498091 - DNA, 19 bp, Homo sapiens
acaggactaacactcagaa

SEQ ID NO: 2498092 - DNA, 13 bp, Homo sapiens
acaggagctacct

SEQ ID NO: 2498093 - DNA, 14 bp, Homo sapiens
acaggagctacctg

SEQ ID NO: 2498094 - DNA, 19 bp, Homo sapiens
acaggagggcggcctcctt

SEQ ID NO: 2498095 - DNA, 17 bp, Homo sapiens
acaggagtgtcctcttc

SEQ ID NO: 2498096 - DNA, 21 bp, Homo sapiens
acaggagtgtcctcttccctc

SEQ ID NO: 2498097 - DNA, 16 bp, Homo sapiens
acaggatgtgtttgct

SEQ ID NO: 2498098 - DNA, 20 bp, Homo sapiens
acaggatgtgtttgctttct

SEQ ID NO: 2498099 - DNA, 20 bp, Homo sapiens
acaggcacttggcagccttg

SEQ ID NO: 2498100 - DNA, 20 bp, Homo sapiens
acaggcatttcctgggtggc

SEQ ID NO: 2498101 - DNA, 22 bp, Homo sapiens
acaggccctccctgttccccag

SEQ ID NO: 2498102 - DNA, 19 bp, Homo sapiens
acaggcctgtgtagctgtg

SEQ ID NO: 2498103 - DNA, 20 bp, Homo sapiens
acaggcctgtgtagctgtga

SEQ ID NO: 2498104 - DNA, 20 bp, Homo sapiens
acaggcgtgagccacctcgc

SEQ ID NO: 2498105 - DNA, 13 bp, Homo sapiens
acaggctcttagc

SEQ ID NO: 2498106 - DNA, 19 bp, Homo sapiens
acaggctcttagcagcttc

SEQ ID NO: 2498107 - DNA, 18 bp, Homo sapiens
acaggctggaagatagct

SEQ ID NO: 2498108 - DNA, 20 bp, Homo sapiens
acaggctggaagatagctgt

SEQ ID NO: 2498109 - DNA, 21 bp, Homo sapiens
acaggctggaagatagctgtg

SEQ ID NO: 2498110 - DNA, 20 bp, Homo sapiens
acagggaaggcaggcagggc

SEQ ID NO: 2498111 - DNA, 18 bp, Homo sapiens
acagggataaggcctgtg

SEQ ID NO: 2498112 - DNA, 22 bp, Homo sapiens
accttgaaaaaaaacagtggat

SEQ ID NO: 2498113 - DNA, 15 bp, Homo sapiens
accttgcctggtaca

SEQ ID NO: 2498114 - DNA, 18 bp, Homo sapiens
accttgcctggtacagta

SEQ ID NO: 2498115 - DNA, 22 bp, Homo sapiens
accttggcaccagacacccagg

SEQ ID NO: 2498116 - DNA, 23 bp, Homo sapiens
accttgggttagacctacagggg

SEQ ID NO: 2498117 - DNA, 16 bp, Homo sapiens
accttgttacttctga

SEQ ID NO: 2498118 - DNA, 12 bp, Homo sapiens
acctttactgtg

SEQ ID NO: 2498119 - DNA, 14 bp, Homo sapiens
acctttaggttctt

SEQ ID NO: 2498120 - DNA, 13 bp, Homo sapiens
acctttgtgccct

SEQ ID NO: 2498121 - DNA, 15 bp, Homo sapiens
accttttatgtagta

SEQ ID NO: 2498122 - DNA, 21 bp, Homo sapiens
accttttgaggagccccagct

SEQ ID NO: 2498123 - DNA, 23 bp, Homo sapiens
acgaaataattgttgttctgtta

SEQ ID NO: 2498124 - DNA, 12 bp, Homo sapiens
acgaaatgttat

SEQ ID NO: 2498125 - DNA, 14 bp, Homo sapiens
acgaaggagcccat

SEQ ID NO: 2498126 - DNA, 21 bp, Homo sapiens
acgacacggtcggggcatctg

SEQ ID NO: 2498127 - DNA, 16 bp, Homo sapiens
acgagacgtttcctac

SEQ ID NO: 2498128 - DNA, 14 bp, Homo sapiens
acgagactttccat

SEQ ID NO: 2498129 - DNA, 18 bp, Homo sapiens
acgatttttaaaatgtac

SEQ ID NO: 2498130 - DNA, 15 bp, Homo sapiens
acgcaagttcccagt

SEQ ID NO: 2498131 - DNA, 16 bp, Homo sapiens
acgcacctgcctcagg

SEQ ID NO: 2498132 - DNA, 21 bp, Homo sapiens
acgcatctcaaaacagagggc

SEQ ID NO: 2498133 - DNA, 18 bp, Homo sapiens
acgccctttcctcctcag

SEQ ID NO: 2498134 - DNA, 21 bp, Homo sapiens
acgccctttcctcctcaggca

SEQ ID NO: 2498135 - DNA, 16 bp, Homo sapiens
acgcctcttgaccagg

SEQ ID NO: 2498136 - DNA, 11 bp, Homo sapiens
acgcctgagcc

SEQ ID NO: 2498137 - DNA, 20 bp, Homo sapiens
acgcctgagcccagggaggc

SEQ ID NO: 2498138 - DNA, 15 bp, Homo sapiens
acgcctgaggcaatt

SEQ ID NO: 2498139 - DNA, 18 bp, Homo sapiens
acgcctgggggtgccagg

SEQ ID NO: 2498140 - DNA, 15 bp, Homo sapiens
acgcgtcttcctgag

SEQ ID NO: 2498141 - DNA, 19 bp, Homo sapiens
acgctgctgtcacaaccaa

SEQ ID NO: 2498142 - DNA, 18 bp, Homo sapiens
acgctggcaacacagagg

SEQ ID NO: 2498143 - DNA, 12 bp, Homo sapiens
acgctttgattc

SEQ ID NO: 2498144 - DNA, 14 bp, Homo sapiens
acgcttttgtgatg

SEQ ID NO: 2498145 - DNA, 15 bp, Homo sapiens
acggaaagtgctgtc

SEQ ID NO: 2498146 - DNA, 12 bp, Homo sapiens
acggattccaaa

SEQ ID NO: 2498147 - DNA, 23 bp, Homo sapiens
acggccagggagaagctcctctc

SEQ ID NO: 2498148 - DNA, 21 bp, Homo sapiens
acgggacccacatgctccaga

SEQ ID NO: 2498149 - DNA, 22 bp, Homo sapiens
acgggatggttctggctgtttg

SEQ ID NO: 2498150 - DNA, 17 bp, Homo sapiens
acgggcctgtccacagg

SEQ ID NO: 2498151 - DNA, 19 bp, Homo sapiens
acgggtgtcacggccaggc

SEQ ID NO: 2498152 - DNA, 22 bp, Homo sapiens
acggtcggggcatctggcctgg

SEQ ID NO: 2498153 - DNA, 16 bp, Homo sapiens
acgtaaagtacttgta

SEQ ID NO: 2498154 - DNA, 16 bp, Homo sapiens
acgtatttaatagcaa

SEQ ID NO: 2498155 - DNA, 16 bp, Homo sapiens
acgtggcctcttgagc

SEQ ID NO: 2498156 - DNA, 17 bp, Homo sapiens
acgtggctcagccagca

SEQ ID NO: 2498157 - DNA, 17 bp, Homo sapiens
acgtgtgtttttctatt

SEQ ID NO: 2498158 - DNA, 19 bp, Homo sapiens
acgtttaagccaaaacaat

SEQ ID NO: 2498159 - DNA, 16 bp, Homo sapiens
acgttttctaattgct

SEQ ID NO: 2498160 - DNA, 17 bp, Homo sapiens
actaaaaaaaagatgaa

SEQ ID NO: 2498161 - DNA, 15 bp, Homo sapiens
actaaaataattttg

SEQ ID NO: 2498162 - DNA, 18 bp, Homo sapiens
actaaacacgtgacacaa

SEQ ID NO: 2498163 - DNA, 17 bp, Homo sapiens
actaaactcttaccata

SEQ ID NO: 2498164 - DNA, 18 bp, Homo sapiens
actaaactttttttctgt

SEQ ID NO: 2498165 - DNA, 20 bp, Homo sapiens
actaaagcaggccttttgat

SEQ ID NO: 2498166 - DNA, 17 bp, Homo sapiens
actaaagccaaacatat

SEQ ID NO: 2498167 - DNA, 13 bp, Homo sapiens
actaaatctttta

SEQ ID NO: 2498168 - DNA, 15 bp, Homo sapiens
actaacactcagaag

SEQ ID NO: 2498169 - DNA, 15 bp, Homo sapiens
actaacatataatgt

SEQ ID NO: 2498170 - DNA, 15 bp, Homo sapiens
actaaccttgcctgg

SEQ ID NO: 2498171 - DNA, 21 bp, Homo sapiens
actaaccttgcctggtacagt

SEQ ID NO: 2498172 - DNA, 22 bp, Homo sapiens
actaaccttgcctggtacagta

SEQ ID NO: 2498173 - DNA, 18 bp, Homo sapiens
actaagccagcaccggac

SEQ ID NO: 2498174 - DNA, 17 bp, Homo sapiens
actaatatatttaaaaa

SEQ ID NO: 2498175 - DNA, 18 bp, Homo sapiens
actaatatatttaaaaat

SEQ ID NO: 2498176 - DNA, 23 bp, Homo sapiens
actaattccacaccttttattga

SEQ ID NO: 2498177 - DNA, 14 bp, Homo sapiens
actaatttcaaaat

SEQ ID NO: 2498178 - DNA, 17 bp, Homo sapiens
actacaaaggtttaaat

SEQ ID NO: 2498179 - DNA, 18 bp, Homo sapiens
actacaaaggtttaaatg

SEQ ID NO: 2498180 - DNA, 20 bp, Homo sapiens
actacaaaggtttaaatgaa

SEQ ID NO: 2498181 - DNA, 22 bp, Homo sapiens
actacaaaggtttaaatgaaca

SEQ ID NO: 2498182 - DNA, 11 bp, Homo sapiens
actacaaatca

SEQ ID NO: 2498183 - DNA, 13 bp, Homo sapiens
actacaaatcaag

SEQ ID NO: 2498184 - DNA, 22 bp, Homo sapiens
actacccaggttaagaaaataa

SEQ ID NO: 2498185 - DNA, 16 bp, Homo sapiens
actaccgaatgtgtct

SEQ ID NO: 2498186 - DNA, 17 bp, Homo sapiens
actaccgaatgtgtctt

SEQ ID NO: 2498187 - DNA, 19 bp, Homo sapiens
actaccgaatgtgtcttta

SEQ ID NO: 2498188 - DNA, 17 bp, Homo sapiens
actaccttgaaaataag

SEQ ID NO: 2498189 - DNA, 23 bp, Homo sapiens
actactgacatgtggggccaggt

SEQ ID NO: 2498190 - DNA, 12 bp, Homo sapiens
actactttataa

SEQ ID NO: 2498191 - DNA, 16 bp, Homo sapiens
actactttgctgctaa

SEQ ID NO: 2498192 - DNA, 17 bp, Homo sapiens
actagacaagccagaac

SEQ ID NO: 2498193 - DNA, 18 bp, Homo sapiens
actagacaccaaagttct

SEQ ID NO: 2498194 - DNA, 20 bp, Homo sapiens
actagatggacctgcctgca

SEQ ID NO: 2498195 - DNA, 12 bp, Homo sapiens
actagatgtagt

SEQ ID NO: 2498196 - DNA, 17 bp, Homo sapiens
actagatgtagtatttt

SEQ ID NO: 2498197 - DNA, 23 bp, Homo sapiens
actaggagctttgactcaggagc

SEQ ID NO: 2498198 - DNA, 23 bp, Homo sapiens
actaggcccccacttgcctcttc

SEQ ID NO: 2498199 - DNA, 23 bp, Homo sapiens
actaggccttgcggctcctcagg

SEQ ID NO: 2498200 - DNA, 14 bp, Homo sapiens
actagggagccatg

SEQ ID NO: 2498201 - DNA, 19 bp, Homo sapiens
actagggagccatgtttca

SEQ ID NO: 2498202 - DNA, 22 bp, Homo sapiens
actagggagccatgtttcacaa

SEQ ID NO: 2498203 - DNA, 16 bp, Homo sapiens
actagggatccctcat

SEQ ID NO: 2498204 - DNA, 20 bp, Homo sapiens
actagggatccctcatctgt

SEQ ID NO: 2498205 - DNA, 16 bp, Homo sapiens
actagggccaagccca

SEQ ID NO: 2498206 - DNA, 14 bp, Homo sapiens
actataagaacttt

SEQ ID NO: 2498207 - DNA, 16 bp, Homo sapiens
actatgaaaagctaga

SEQ ID NO: 2498208 - DNA, 19 bp, Homo sapiens
actatgaaaagctagaatt

SEQ ID NO: 2498209 - DNA, 20 bp, Homo sapiens
actatgaaaagctagaattg

SEQ ID NO: 2498210 - DNA, 21 bp, Homo sapiens
actatgaaaagctagaattga

SEQ ID NO: 2498211 - DNA, 16 bp, Homo sapiens
actatgaaaatgctgg

SEQ ID NO: 2498212 - DNA, 24 bp, Homo sapiens
actatgcatggtgccccaggacca

SEQ ID NO: 2498213 - DNA, 20 bp, Homo sapiens
actatttaaagcctcctcat

SEQ ID NO: 2498214 - DNA, 16 bp, Homo sapiens
actatttaactgacta

SEQ ID NO: 2498215 - DNA, 21 bp, Homo sapiens
actcaaatggggccagatcca

SEQ ID NO: 2498216 - DNA, 16 bp, Homo sapiens
agaagtcacagggcag

SEQ ID NO: 2498217 - DNA, 21 bp, Homo sapiens
agaagtcacagggcagtacct

SEQ ID NO: 2498218 - DNA, 15 bp, Homo sapiens
agaagtcatcttgct

SEQ ID NO: 2498219 - DNA, 22 bp, Homo sapiens
agaagtcatcttgctaccagta

SEQ ID NO: 2498220 - DNA, 17 bp, Homo sapiens
agaagtgacattgcatc

SEQ ID NO: 2498221 - DNA, 23 bp, Homo sapiens
agaagtgcatctggagagaacag

SEQ ID NO: 2498222 - DNA, 16 bp, Homo sapiens
agaagttagtttgtat

SEQ ID NO: 2498223 - DNA, 15 bp, Homo sapiens
agaagtttagatttt

SEQ ID NO: 2498224 - DNA, 19 bp, Homo sapiens
agaagtttcatcatttttt

SEQ ID NO: 2498225 - DNA, 23 bp, Homo sapiens
agaagtttcatcattttttactt

SEQ ID NO: 2498226 - DNA, 13 bp, Homo sapiens
agaagtttctgtc

SEQ ID NO: 2498227 - DNA, 13 bp, Homo sapiens
agaagtttgcact

SEQ ID NO: 2498228 - DNA, 21 bp, Homo sapiens
agaagtttgcactatctttca

SEQ ID NO: 2498229 - DNA, 15 bp, Homo sapiens
agaataaattgattt

SEQ ID NO: 2498230 - DNA, 16 bp, Homo sapiens
agaataagttattgca

SEQ ID NO: 2498231 - DNA, 19 bp, Homo sapiens
agaataagttattgcagtt

SEQ ID NO: 2498232 - DNA, 22 bp, Homo sapiens
agaatagaaataaaggatgtga

SEQ ID NO: 2498233 - DNA, 17 bp, Homo sapiens
agaatagaacacagttt

SEQ ID NO: 2498234 - DNA, 17 bp, Homo sapiens
agaatagccacatttgg

SEQ ID NO: 2498235 - DNA, 14 bp, Homo sapiens
agaatatgtcagtg

SEQ ID NO: 2498236 - DNA, 23 bp, Homo sapiens
agaatcaacatttctcaataatt

SEQ ID NO: 2498237 - DNA, 16 bp, Homo sapiens
agaatccacatttcta

SEQ ID NO: 2498238 - DNA, 17 bp, Homo sapiens
agaatccacatttctaa

SEQ ID NO: 2498239 - DNA, 18 bp, Homo sapiens
agaatccacatttctaaa

SEQ ID NO: 2498240 - DNA, 15 bp, Homo sapiens
agaatcccaaatttg

SEQ ID NO: 2498241 - DNA, 17 bp, Homo sapiens
agaatcccaaatttgat

SEQ ID NO: 2498242 - DNA, 19 bp, Homo sapiens
agaatcttggtttgccttc

SEQ ID NO: 2498243 - DNA, 19 bp, Homo sapiens
agaatgcacaagaatggat

SEQ ID NO: 2498244 - DNA, 20 bp, Homo sapiens
agaatgcacaagaatggatc

SEQ ID NO: 2498245 - DNA, 20 bp, Homo sapiens
agaatgctgtacatctattt

SEQ ID NO: 2498246 - DNA, 16 bp, Homo sapiens
agaatgtcattttggt

SEQ ID NO: 2498247 - DNA, 18 bp, Homo sapiens
agaattaaacttttaatt

SEQ ID NO: 2498248 - DNA, 15 bp, Homo sapiens
agaattatctaattt

SEQ ID NO: 2498249 - DNA, 17 bp, Homo sapiens
agaattatctaatttat

SEQ ID NO: 2498250 - DNA, 18 bp, Homo sapiens
agaattgagtaatggtgt

SEQ ID NO: 2498251 - DNA, 14 bp, Homo sapiens
agaattgagtgttt

SEQ ID NO: 2498252 - DNA, 22 bp, Homo sapiens
agaattgtggtttatatattta

SEQ ID NO: 2498253 - DNA, 20 bp, Homo sapiens
agaattgtgtcagactgttt

SEQ ID NO: 2498254 - DNA, 21 bp, Homo sapiens
agaattgttgggggttttttt

SEQ ID NO: 2498255 - DNA, 21 bp, Homo sapiens
agacaaactttgcatctcagt

SEQ ID NO: 2498256 - DNA, 19 bp, Homo sapiens
agacaaatagaaaatggtc

SEQ ID NO: 2498257 - DNA, 19 bp, Homo sapiens
agacaattgacaacagtta

SEQ ID NO: 2498258 - DNA, 16 bp, Homo sapiens
agacacatactcattt

SEQ ID NO: 2498259 - DNA, 17 bp, Homo sapiens
agacacattttttagga

SEQ ID NO: 2498260 - DNA, 20 bp, Homo sapiens
agacacattttttaggaaat

SEQ ID NO: 2498261 - DNA, 16 bp, Homo sapiens
agacaccaaagttcta

SEQ ID NO: 2498262 - DNA, 13 bp, Homo sapiens
agacacccaggac

SEQ ID NO: 2498263 - DNA, 22 bp, Homo sapiens
agacactccccgaagtcttttg

SEQ ID NO: 2498264 - DNA, 23 bp, Homo sapiens
agacactccccgaagtcttttgt

SEQ ID NO: 2498265 - DNA, 18 bp, Homo sapiens
agacactgaaaaatctaa

SEQ ID NO: 2498266 - DNA, 13 bp, Homo sapiens
agacactttggaa

SEQ ID NO: 2498267 - DNA, 12 bp, Homo sapiens
agacagaacacc

SEQ ID NO: 2498268 - DNA, 16 bp, Homo sapiens
agacagaagaaacaag

SEQ ID NO: 2498269 - DNA, 13 bp, Homo sapiens
agacagagccagg

SEQ ID NO: 2498270 - DNA, 21 bp, Homo sapiens
agacagagccaggagaagctc

SEQ ID NO: 2498271 - DNA, 18 bp, Homo sapiens
agacagaggccctcaagt

SEQ ID NO: 2498272 - DNA, 20 bp, Homo sapiens
agacaggctcttagcagctt

SEQ ID NO: 2498273 - DNA, 22 bp, Homo sapiens
agacagggaattaggcccccat

SEQ ID NO: 2498274 - DNA, 19 bp, Homo sapiens
agacagtgatattggaact

SEQ ID NO: 2498275 - DNA, 14 bp, Homo sapiens
agacataaaggaaa

SEQ ID NO: 2498276 - DNA, 15 bp, Homo sapiens
agacataaaggaaaa

SEQ ID NO: 2498277 - DNA, 23 bp, Homo sapiens
agacataaaggaaaagacacatt

SEQ ID NO: 2498278 - DNA, 14 bp, Homo sapiens
agacatacttgaag

SEQ ID NO: 2498279 - DNA, 16 bp, Homo sapiens
agacatacttgaaggg

SEQ ID NO: 2498280 - DNA, 21 bp, Homo sapiens
agacatacttgaagggccaga

SEQ ID NO: 2498281 - DNA, 20 bp, Homo sapiens
agacatccaaactaaaagga

SEQ ID NO: 2498282 - DNA, 23 bp, Homo sapiens
agacatgccacaaggacttcctg

SEQ ID NO: 2498283 - DNA, 17 bp, Homo sapiens
agacatggaggttctaa

SEQ ID NO: 2498284 - DNA, 20 bp, Homo sapiens
agacatggaggttctaaggc

SEQ ID NO: 2498285 - DNA, 14 bp, Homo sapiens
agacatgtgacatt

SEQ ID NO: 2498286 - DNA, 15 bp, Homo sapiens
agacatgtgacattt

SEQ ID NO: 2498287 - DNA, 15 bp, Homo sapiens
agacattggcaccta

SEQ ID NO: 2498288 - DNA, 11 bp, Homo sapiens
agaccaataaa

SEQ ID NO: 2498289 - DNA, 11 bp, Homo sapiens
agaccaccagg

SEQ ID NO: 2498290 - DNA, 14 bp, Homo sapiens
agaccaccagggca

SEQ ID NO: 2498291 - DNA, 20 bp, Homo sapiens
agaccagcagacagagccag

SEQ ID NO: 2498292 - DNA, 15 bp, Homo sapiens
agacccattccttcc

SEQ ID NO: 2498293 - DNA, 24 bp, Homo sapiens
agacccctaaccctttgtgtgctc

SEQ ID NO: 2498294 - DNA, 12 bp, Homo sapiens
agaccctgccct

SEQ ID NO: 2498295 - DNA, 18 bp, Homo sapiens
agacctactgttctaaag

SEQ ID NO: 2498296 - DNA, 19 bp, Homo sapiens
agacctactgttctaaagc

SEQ ID NO: 2498297 - DNA, 22 bp, Homo sapiens
agacctactgttctaaagctct

SEQ ID NO: 2498298 - DNA, 19 bp, Homo sapiens
agacctctactgccttgga

SEQ ID NO: 2498299 - DNA, 18 bp, Homo sapiens
agacctgatcctggaggc

SEQ ID NO: 2498300 - DNA, 19 bp, Homo sapiens
agacctgatcctggaggcc

SEQ ID NO: 2498301 - DNA, 22 bp, Homo sapiens
agacctgatcctggaggcccag

SEQ ID NO: 2498302 - DNA, 15 bp, Homo sapiens
agacctggcagctct

SEQ ID NO: 2498303 - DNA, 16 bp, Homo sapiens
agacctggcagctctg

SEQ ID NO: 2498304 - DNA, 17 bp, Homo sapiens
agacctggcagctctgg

SEQ ID NO: 2498305 - DNA, 23 bp, Homo sapiens
agacctggcagctctggacagcc

SEQ ID NO: 2498306 - DNA, 19 bp, Homo sapiens
agacctgttagcagacagg

SEQ ID NO: 2498307 - DNA, 18 bp, Homo sapiens
agaccttgttacttctga

SEQ ID NO: 2498308 - DNA, 14 bp, Homo sapiens
agaccttttttagg

SEQ ID NO: 2498309 - DNA, 16 bp, Homo sapiens
agaccttttttaggaa

SEQ ID NO: 2498310 - DNA, 13 bp, Homo sapiens
agacgcctgagga

SEQ ID NO: 2498311 - DNA, 15 bp, Homo sapiens
agactaagccagcac

SEQ ID NO: 2498312 - DNA, 16 bp, Homo sapiens
agactagatggacctg

SEQ ID NO: 2498313 - DNA, 12 bp, Homo sapiens
agactagatgta

SEQ ID NO: 2498314 - DNA, 14 bp, Homo sapiens
agactagatgtagt

SEQ ID NO: 2498315 - DNA, 20 bp, Homo sapiens
agactcaaatgttctaagtt

SEQ ID NO: 2498316 - DNA, 23 bp, Homo sapiens
agactcaaatgttctaagtttct

SEQ ID NO: 2498317 - DNA, 19 bp, Homo sapiens
agactcaggccaagaaacg

SEQ ID NO: 2498318 - DNA, 20 bp, Homo sapiens
agactcaggccaagaaacgt

SEQ ID NO: 2498319 - DNA, 16 bp, Homo sapiens
agactctagagtccaa

SEQ ID NO: 2498320 - DNA, 22 bp, Homo sapiens
agcagaccaccccgcctgccct

SEQ ID NO: 2498321 - DNA, 17 bp, Homo sapiens
agcagactacagctggg

SEQ ID NO: 2498322 - DNA, 23 bp, Homo sapiens
agcagactacagctggggtgcag

SEQ ID NO: 2498323 - DNA, 14 bp, Homo sapiens
agcagcacctcctc

SEQ ID NO: 2498324 - DNA, 17 bp, Homo sapiens
agcagcacctcctcagc

SEQ ID NO: 2498325 - DNA, 21 bp, Homo sapiens
agcagcacctcctcagcctga

SEQ ID NO: 2498326 - DNA, 13 bp, Homo sapiens
agcagcagcctcg

SEQ ID NO: 2498327 - DNA, 15 bp, Homo sapiens
agcagcaggaggggg

SEQ ID NO: 2498328 - DNA, 21 bp, Homo sapiens
agcagcaggaggggggaggga

SEQ ID NO: 2498329 - DNA, 22 bp, Homo sapiens
agcagcaggaggggggagggaa

SEQ ID NO: 2498330 - DNA, 11 bp, Homo sapiens
agcagcatctc

SEQ ID NO: 2498331 - DNA, 20 bp, Homo sapiens
agcagcatctctaccttctc

SEQ ID NO: 2498332 - DNA, 10 bp, Homo sapiens
agcagccacg

SEQ ID NO: 2498333 - DNA, 13 bp, Homo sapiens
agcagccacgagg

SEQ ID NO: 2498334 - DNA, 14 bp, Homo sapiens
agcagccagccctg

SEQ ID NO: 2498335 - DNA, 20 bp, Homo sapiens
agcagccagccctgcctgga

SEQ ID NO: 2498336 - DNA, 21 bp, Homo sapiens
agcagccagccctgcctggag

SEQ ID NO: 2498337 - DNA, 17 bp, Homo sapiens
agcagcccccagctccc

SEQ ID NO: 2498338 - DNA, 20 bp, Homo sapiens
agcagcctcgcccctggcag

SEQ ID NO: 2498339 - DNA, 21 bp, Homo sapiens
agcagcctcgcccctggcaga

SEQ ID NO: 2498340 - DNA, 18 bp, Homo sapiens
agcagcctctccccaggt

SEQ ID NO: 2498341 - DNA, 13 bp, Homo sapiens
agcagcctgagca

SEQ ID NO: 2498342 - DNA, 23 bp, Homo sapiens
agcagcgaccgccccctcctcta

SEQ ID NO: 2498343 - DNA, 13 bp, Homo sapiens
agcagcgagcctg

SEQ ID NO: 2498344 - DNA, 11 bp, Homo sapiens
agcagctgagc

SEQ ID NO: 2498345 - DNA, 18 bp, Homo sapiens
agcagctgccaggagcac

SEQ ID NO: 2498346 - DNA, 12 bp, Homo sapiens
agcagcttccag

SEQ ID NO: 2498347 - DNA, 21 bp, Homo sapiens
agcaggaaatgaaaatgtctt

SEQ ID NO: 2498348 - DNA, 14 bp, Homo sapiens
agcaggactccagg

SEQ ID NO: 2498349 - DNA, 15 bp, Homo sapiens
agcaggactccaggc

SEQ ID NO: 2498350 - DNA, 19 bp, Homo sapiens
agcaggactccaggcccaa

SEQ ID NO: 2498351 - DNA, 22 bp, Homo sapiens
agcaggactccaggcccaaggc

SEQ ID NO: 2498352 - DNA, 16 bp, Homo sapiens
agcaggactgatgtct

SEQ ID NO: 2498353 - DNA, 14 bp, Homo sapiens
agcaggagggggga

SEQ ID NO: 2498354 - DNA, 16 bp, Homo sapiens
agcaggaggggggagg

SEQ ID NO: 2498355 - DNA, 11 bp, Homo sapiens
agcaggcagcc

SEQ ID NO: 2498356 - DNA, 15 bp, Homo sapiens
agcaggcagccagca

SEQ ID NO: 2498357 - DNA, 17 bp, Homo sapiens
agcaggcagccagcatc

SEQ ID NO: 2498358 - DNA, 23 bp, Homo sapiens
agcaggccacacttcaaactact

SEQ ID NO: 2498359 - DNA, 24 bp, Homo sapiens
agcaggccacacttcaaactactt

SEQ ID NO: 2498360 - DNA, 21 bp, Homo sapiens
agcagggattaacctctgcac

SEQ ID NO: 2498361 - DNA, 22 bp, Homo sapiens
agcagggattaacctctgcact

SEQ ID NO: 2498362 - DNA, 14 bp, Homo sapiens
agcaggggctgccc

SEQ ID NO: 2498363 - DNA, 18 bp, Homo sapiens
agcaggggctgcccgagt

SEQ ID NO: 2498364 - DNA, 21 bp, Homo sapiens
agcaggggtgtgatgtaccag

SEQ ID NO: 2498365 - DNA, 14 bp, Homo sapiens
agcaggttcttgtt

SEQ ID NO: 2498366 - DNA, 12 bp, Homo sapiens
agcagtattttt

SEQ ID NO: 2498367 - DNA, 22 bp, Homo sapiens
agcagtccttggcctgctaagg

SEQ ID NO: 2498368 - DNA, 16 bp, Homo sapiens
agcagtcgtgcctgtg

SEQ ID NO: 2498369 - DNA, 16 bp, Homo sapiens
agcagttctgcagagg

SEQ ID NO: 2498370 - DNA, 22 bp, Homo sapiens
agcagttgagacaagaaaataa

SEQ ID NO: 2498371 - DNA, 15 bp, Homo sapiens
agcataaaagatgaa

SEQ ID NO: 2498372 - DNA, 17 bp, Homo sapiens
agcataaaagatgaaag

SEQ ID NO: 2498373 - DNA, 23 bp, Homo sapiens
agcataagtttctgggacctcag

SEQ ID NO: 2498374 - DNA, 22 bp, Homo sapiens
agcatcagggttaagaagactt

SEQ ID NO: 2498375 - DNA, 21 bp, Homo sapiens
agcatcattatttatgtattg

SEQ ID NO: 2498376 - DNA, 17 bp, Homo sapiens
agcatccccttgaactc

SEQ ID NO: 2498377 - DNA, 17 bp, Homo sapiens
agcatccctcagcctgt

SEQ ID NO: 2498378 - DNA, 16 bp, Homo sapiens
agcatccgcaggtgct

SEQ ID NO: 2498379 - DNA, 20 bp, Homo sapiens
agcatctaagttataagact

SEQ ID NO: 2498380 - DNA, 23 bp, Homo sapiens
agcatctaagttataagactctc

SEQ ID NO: 2498381 - DNA, 16 bp, Homo sapiens
agcatctccaagcagc

SEQ ID NO: 2498382 - DNA, 14 bp, Homo sapiens
agcatctctacctt

SEQ ID NO: 2498383 - DNA, 15 bp, Homo sapiens
agcatctctaccttc

SEQ ID NO: 2498384 - DNA, 22 bp, Homo sapiens
agcatctctaccttctccccag

SEQ ID NO: 2498385 - DNA, 13 bp, Homo sapiens
agcatctggctct

SEQ ID NO: 2498386 - DNA, 18 bp, Homo sapiens
agcatctggctctaattc

SEQ ID NO: 2498387 - DNA, 13 bp, Homo sapiens
agcatctgggcct

SEQ ID NO: 2498388 - DNA, 23 bp, Homo sapiens
agcatctgggccttggcctggag

SEQ ID NO: 2498389 - DNA, 18 bp, Homo sapiens
agcatgcaatacatacca

SEQ ID NO: 2498390 - DNA, 19 bp, Homo sapiens
agcatggaacacttcgagt

SEQ ID NO: 2498391 - DNA, 19 bp, Homo sapiens
agcatggaggaggagggag

SEQ ID NO: 2498392 - DNA, 12 bp, Homo sapiens
agcatgtttaga

SEQ ID NO: 2498393 - DNA, 13 bp, Homo sapiens
agcatgtttagac

SEQ ID NO: 2498394 - DNA, 23 bp, Homo sapiens
agcatgtttagactttaacataa

SEQ ID NO: 2498395 - DNA, 16 bp, Homo sapiens
agcattccagcccctc

SEQ ID NO: 2498396 - DNA, 18 bp, Homo sapiens
agcattgtagtgctttga

SEQ ID NO: 2498397 - DNA, 22 bp, Homo sapiens
agcattgtagtgctttgagaga

SEQ ID NO: 2498398 - DNA, 17 bp, Homo sapiens
agcattttaattctctc

SEQ ID NO: 2498399 - DNA, 22 bp, Homo sapiens
agccaaaatgtaggcttagttt

SEQ ID NO: 2498400 - DNA, 15 bp, Homo sapiens
agccaaaccctgtct

SEQ ID NO: 2498401 - DNA, 16 bp, Homo sapiens
agccaaaccctgtctg

SEQ ID NO: 2498402 - DNA, 17 bp, Homo sapiens
agccaaacctcaccaac

SEQ ID NO: 2498403 - DNA, 21 bp, Homo sapiens
agccaaacctcaccaactcct

SEQ ID NO: 2498404 - DNA, 11 bp, Homo sapiens
agccaaagagt

SEQ ID NO: 2498405 - DNA, 22 bp, Homo sapiens
agccaacacgcacctgcctcag

SEQ ID NO: 2498406 - DNA, 20 bp, Homo sapiens
agccaactatgattattaac

SEQ ID NO: 2498407 - DNA, 15 bp, Homo sapiens
agccaagctctgcag

SEQ ID NO: 2498408 - DNA, 16 bp, Homo sapiens
agccaagggaacctgt

SEQ ID NO: 2498409 - DNA, 18 bp, Homo sapiens
agccaagggatggacatc

SEQ ID NO: 2498410 - DNA, 12 bp, Homo sapiens
agccaccctgag

SEQ ID NO: 2498411 - DNA, 14 bp, Homo sapiens
agccaccctgagga

SEQ ID NO: 2498412 - DNA, 18 bp, Homo sapiens
agccaccctgaggagtct

SEQ ID NO: 2498413 - DNA, 21 bp, Homo sapiens
agccaccctgaggagtctgag

SEQ ID NO: 2498414 - DNA, 15 bp, Homo sapiens
agccaccgaagccgc

SEQ ID NO: 2498415 - DNA, 20 bp, Homo sapiens
agccaccgaagccgcctgtg

SEQ ID NO: 2498416 - DNA, 20 bp, Homo sapiens
agccactaaccttgcctggt

SEQ ID NO: 2498417 - DNA, 22 bp, Homo sapiens
agccactaaccttgcctggtac

SEQ ID NO: 2498418 - DNA, 15 bp, Homo sapiens
agccactcctctgac

SEQ ID NO: 2498419 - DNA, 22 bp, Homo sapiens
agccagaacttgaccctgagct

SEQ ID NO: 2498420 - DNA, 14 bp, Homo sapiens
agccagaggctggg

SEQ ID NO: 2498421 - DNA, 15 bp, Homo sapiens
agccagaggctgggt

SEQ ID NO: 2498422 - DNA, 18 bp, Homo sapiens
agccagaggctgggttca

SEQ ID NO: 2498423 - DNA, 17 bp, Homo sapiens
agccagcacacagggca

SEQ ID NO: 2498424 - DNA, 22 bp, Homo sapiens
agcttacaaatactaaaaagaa

SEQ ID NO: 2498425 - DNA, 21 bp, Homo sapiens
agcttagctttagaaacagtg

SEQ ID NO: 2498426 - DNA, 18 bp, Homo sapiens
agcttatacgaaataatt

SEQ ID NO: 2498427 - DNA, 20 bp, Homo sapiens
agcttatacgaaataattgt

SEQ ID NO: 2498428 - DNA, 18 bp, Homo sapiens
agcttcacagtacccaaa

SEQ ID NO: 2498429 - DNA, 19 bp, Homo sapiens
agcttcatggcagaaggca

SEQ ID NO: 2498430 - DNA, 16 bp, Homo sapiens
agcttccttcagagag

SEQ ID NO: 2498431 - DNA, 18 bp, Homo sapiens
agcttccttcagagagca

SEQ ID NO: 2498432 - DNA, 19 bp, Homo sapiens
agcttccttcagagagcag

SEQ ID NO: 2498433 - DNA, 23 bp, Homo sapiens
agcttccttcagagagcagtgct

SEQ ID NO: 2498434 - DNA, 15 bp, Homo sapiens
agcttctgccccctg

SEQ ID NO: 2498435 - DNA, 16 bp, Homo sapiens
agcttgacctgaggct

SEQ ID NO: 2498436 - DNA, 15 bp, Homo sapiens
agcttgtagccagcc

SEQ ID NO: 2498437 - DNA, 13 bp, Homo sapiens
agcttgtctcttg

SEQ ID NO: 2498438 - DNA, 13 bp, Homo sapiens
agcttgtttacat

SEQ ID NO: 2498439 - DNA, 16 bp, Homo sapiens
agcttgtttacatgct

SEQ ID NO: 2498440 - DNA, 16 bp, Homo sapiens
agctttcagaatatgt

SEQ ID NO: 2498441 - DNA, 12 bp, Homo sapiens
agctttcctgcc

SEQ ID NO: 2498442 - DNA, 15 bp, Homo sapiens
agctttcctgcccca

SEQ ID NO: 2498443 - DNA, 20 bp, Homo sapiens
agctttcctgccccaggcct

SEQ ID NO: 2498444 - DNA, 23 bp, Homo sapiens
agctttcctgccccaggcctgaa

SEQ ID NO: 2498445 - DNA, 12 bp, Homo sapiens
agctttctgaac

SEQ ID NO: 2498446 - DNA, 15 bp, Homo sapiens
agctttctgaacagc

SEQ ID NO: 2498447 - DNA, 16 bp, Homo sapiens
agctttctgaacagct

SEQ ID NO: 2498448 - DNA, 18 bp, Homo sapiens
agctttctgaacagctgg

SEQ ID NO: 2498449 - DNA, 20 bp, Homo sapiens
agctttctgaacagctggtg

SEQ ID NO: 2498450 - DNA, 21 bp, Homo sapiens
agctttgactcaggagcctgt

SEQ ID NO: 2498451 - DNA, 23 bp, Homo sapiens
agctttggaagtttagctctgag

SEQ ID NO: 2498452 - DNA, 22 bp, Homo sapiens
agcttttgtgggggactgtaag

SEQ ID NO: 2498453 - DNA, 19 bp, Homo sapiens
aggaaaaaaaaacagccac

SEQ ID NO: 2498454 - DNA, 13 bp, Homo sapiens
aggaaaaacaggt

SEQ ID NO: 2498455 - DNA, 17 bp, Homo sapiens
aggaaacagttgcatgt

SEQ ID NO: 2498456 - DNA, 19 bp, Homo sapiens
aggaaacagttgcatgtag

SEQ ID NO: 2498457 - DNA, 20 bp, Homo sapiens
aggaaacagttgcatgtagt

SEQ ID NO: 2498458 - DNA, 15 bp, Homo sapiens
aggaaacgagacttt

SEQ ID NO: 2498459 - DNA, 21 bp, Homo sapiens
aggaaactctgcattctagta

SEQ ID NO: 2498460 - DNA, 16 bp, Homo sapiens
aggaaatcccttcata

SEQ ID NO: 2498461 - DNA, 16 bp, Homo sapiens
aggaaatctcacccca

SEQ ID NO: 2498462 - DNA, 13 bp, Homo sapiens
aggaaccaacaat

SEQ ID NO: 2498463 - DNA, 21 bp, Homo sapiens
aggaaccaacaatcttcctgt

SEQ ID NO: 2498464 - DNA, 19 bp, Homo sapiens
aggaacccttacagtagga

SEQ ID NO: 2498465 - DNA, 14 bp, Homo sapiens
aggaacttccaggt

SEQ ID NO: 2498466 - DNA, 20 bp, Homo sapiens
aggaagaatggtgtgggaga

SEQ ID NO: 2498467 - DNA, 21 bp, Homo sapiens
aggaagcattgtaaaataatt

SEQ ID NO: 2498468 - DNA, 19 bp, Homo sapiens
aggaagcccaattgctgga

SEQ ID NO: 2498469 - DNA, 14 bp, Homo sapiens
aggaagccgtcctg

SEQ ID NO: 2498470 - DNA, 22 bp, Homo sapiens
aggaagcctcagattccttccc

SEQ ID NO: 2498471 - DNA, 22 bp, Homo sapiens
aggaagctttggtgagaacctg

SEQ ID NO: 2498472 - DNA, 13 bp, Homo sapiens
aggaaggagctgc

SEQ ID NO: 2498473 - DNA, 21 bp, Homo sapiens
aggaaggagctgcctggaccc

SEQ ID NO: 2498474 - DNA, 15 bp, Homo sapiens
aggaaggtggatggc

SEQ ID NO: 2498475 - DNA, 18 bp, Homo sapiens
aggaagtcaaagcaagga

SEQ ID NO: 2498476 - DNA, 22 bp, Homo sapiens
aggaatctgtgggtctgggagt

SEQ ID NO: 2498477 - DNA, 18 bp, Homo sapiens
aggaatttcccaggaccc

SEQ ID NO: 2498478 - DNA, 13 bp, Homo sapiens
aggacaagcatgg

SEQ ID NO: 2498479 - DNA, 16 bp, Homo sapiens
aggacacaggcctgtg

SEQ ID NO: 2498480 - DNA, 16 bp, Homo sapiens
aggacagccgcctgga

SEQ ID NO: 2498481 - DNA, 14 bp, Homo sapiens
aggacatttctcta

SEQ ID NO: 2498482 - DNA, 19 bp, Homo sapiens
aggaccaagcatcttgggg

SEQ ID NO: 2498483 - DNA, 17 bp, Homo sapiens
aggaccacaggctcagg

SEQ ID NO: 2498484 - DNA, 20 bp, Homo sapiens
aggaccacaggctcaggcag

SEQ ID NO: 2498485 - DNA, 12 bp, Homo sapiens
aggaccagaagc

SEQ ID NO: 2498486 - DNA, 12 bp, Homo sapiens
aggaccagctca

SEQ ID NO: 2498487 - DNA, 13 bp, Homo sapiens
aggaccagctcag

SEQ ID NO: 2498488 - DNA, 15 bp, Homo sapiens
aggaccagctcagga

SEQ ID NO: 2498489 - DNA, 18 bp, Homo sapiens
aggaccagctcaggacag

SEQ ID NO: 2498490 - DNA, 24 bp, Homo sapiens
aggaccagctcaggacagatgcca

SEQ ID NO: 2498491 - DNA, 17 bp, Homo sapiens
aggaccagtcccagagc

SEQ ID NO: 2498492 - DNA, 13 bp, Homo sapiens
aggacccagagga

SEQ ID NO: 2498493 - DNA, 14 bp, Homo sapiens
aggacccaggaaag

SEQ ID NO: 2498494 - DNA, 13 bp, Homo sapiens
aggacccagggct

SEQ ID NO: 2498495 - DNA, 14 bp, Homo sapiens
aggacccagggctc

SEQ ID NO: 2498496 - DNA, 15 bp, Homo sapiens
aggacccagggctct

SEQ ID NO: 2498497 - DNA, 17 bp, Homo sapiens
aggacccagggctctgt

SEQ ID NO: 2498498 - DNA, 16 bp, Homo sapiens
aggaccggcggctcgg

SEQ ID NO: 2498499 - DNA, 18 bp, Homo sapiens
aggacctgaaattccaaa

SEQ ID NO: 2498500 - DNA, 13 bp, Homo sapiens
aggacctgagcct

SEQ ID NO: 2498501 - DNA, 13 bp, Homo sapiens
aggacctggctgc

SEQ ID NO: 2498502 - DNA, 14 bp, Homo sapiens
aggacgtacgtaat

SEQ ID NO: 2498503 - DNA, 13 bp, Homo sapiens
aggactaatagaa

SEQ ID NO: 2498504 - DNA, 16 bp, Homo sapiens
aggactccaggcccaa

SEQ ID NO: 2498505 - DNA, 21 bp, Homo sapiens
aggactcctcctttttccatg

SEQ ID NO: 2498506 - DNA, 14 bp, Homo sapiens
aggactcctgaaaa

SEQ ID NO: 2498507 - DNA, 13 bp, Homo sapiens
aggactctgcagc

SEQ ID NO: 2498508 - DNA, 17 bp, Homo sapiens
aggactctgcagcctca

SEQ ID NO: 2498509 - DNA, 18 bp, Homo sapiens
aggactgggagcccccag

SEQ ID NO: 2498510 - DNA, 16 bp, Homo sapiens
aggacttgaaagaaat

SEQ ID NO: 2498511 - DNA, 15 bp, Homo sapiens
aggactttgtacatt

SEQ ID NO: 2498512 - DNA, 21 bp, Homo sapiens
aggagaggcaacatccaaaat

SEQ ID NO: 2498513 - DNA, 16 bp, Homo sapiens
aggagatgctccttgg

SEQ ID NO: 2498514 - DNA, 20 bp, Homo sapiens
aggagattctgcctttgcca

SEQ ID NO: 2498515 - DNA, 21 bp, Homo sapiens
aggagattctgcctttgccag

SEQ ID NO: 2498516 - DNA, 22 bp, Homo sapiens
aggagattctgcctttgccagg

SEQ ID NO: 2498517 - DNA, 16 bp, Homo sapiens
aggagcaaagcctgtt

SEQ ID NO: 2498518 - DNA, 20 bp, Homo sapiens
aggagcccacgacactgcag

SEQ ID NO: 2498519 - DNA, 10 bp, Homo sapiens
aggagcccag

SEQ ID NO: 2498520 - DNA, 15 bp, Homo sapiens
aggagcccaggccag

SEQ ID NO: 2498521 - DNA, 14 bp, Homo sapiens
aggagccccagcta

SEQ ID NO: 2498522 - DNA, 16 bp, Homo sapiens
aggagcctgtcctgcc

SEQ ID NO: 2498523 - DNA, 12 bp, Homo sapiens
aggagcctgtga

SEQ ID NO: 2498524 - DNA, 13 bp, Homo sapiens
aggagcctgtgaa

SEQ ID NO: 2498525 - DNA, 19 bp, Homo sapiens
aggagcctgtgaacccagg

SEQ ID NO: 2498526 - DNA, 20 bp, Homo sapiens
aggagcctgtgaacccagga

SEQ ID NO: 2498527 - DNA, 13 bp, Homo sapiens
aggagcctgtgac

SEQ ID NO: 2498528 - DNA, 15 bp, Homo sapiens
aggagctaaggctct

SEQ ID NO: 2498529 - DNA, 22 bp, Homo sapiens
aggtaaaatgccatgatgcctc

SEQ ID NO: 2498530 - DNA, 18 bp, Homo sapiens
aggtaactaactgcatac

SEQ ID NO: 2498531 - DNA, 15 bp, Homo sapiens
aggtaagaagtttta

SEQ ID NO: 2498532 - DNA, 12 bp, Homo sapiens
aggtaccatcct

SEQ ID NO: 2498533 - DNA, 19 bp, Homo sapiens
aggtacgatgacagtgttc

SEQ ID NO: 2498534 - DNA, 13 bp, Homo sapiens
aggtatacctcac

SEQ ID NO: 2498535 - DNA, 15 bp, Homo sapiens
aggtcacataaaact

SEQ ID NO: 2498536 - DNA, 15 bp, Homo sapiens
aggtcaccctttgct

SEQ ID NO: 2498537 - DNA, 15 bp, Homo sapiens
aggtccaatgagctt

SEQ ID NO: 2498538 - DNA, 16 bp, Homo sapiens
aggtccaatgagcttt

SEQ ID NO: 2498539 - DNA, 15 bp, Homo sapiens
aggtccacaggtcta

SEQ ID NO: 2498540 - DNA, 13 bp, Homo sapiens
aggtccagctctg

SEQ ID NO: 2498541 - DNA, 15 bp, Homo sapiens
aggtccagctctgga

SEQ ID NO: 2498542 - DNA, 16 bp, Homo sapiens
aggtccagctctggag

SEQ ID NO: 2498543 - DNA, 14 bp, Homo sapiens
aggtccctgctgcc

SEQ ID NO: 2498544 - DNA, 16 bp, Homo sapiens
aggtccctgctgccag

SEQ ID NO: 2498545 - DNA, 13 bp, Homo sapiens
aggtcctctgtca

SEQ ID NO: 2498546 - DNA, 19 bp, Homo sapiens
aggtcctctgtcagtcaca

SEQ ID NO: 2498547 - DNA, 23 bp, Homo sapiens
aggtcctctgtcagtcacagcca

SEQ ID NO: 2498548 - DNA, 12 bp, Homo sapiens
aggtcctgagca

SEQ ID NO: 2498549 - DNA, 16 bp, Homo sapiens
aggtcctgagcactgc

SEQ ID NO: 2498550 - DNA, 20 bp, Homo sapiens
aggtcctgagcactgccagg

SEQ ID NO: 2498551 - DNA, 14 bp, Homo sapiens
aggtcctggtgggg

SEQ ID NO: 2498552 - DNA, 12 bp, Homo sapiens
aggtctcagccc

SEQ ID NO: 2498553 - DNA, 16 bp, Homo sapiens
aggtctcatctcttca

SEQ ID NO: 2498554 - DNA, 21 bp, Homo sapiens
aggtctcatctcttcaggttc

SEQ ID NO: 2498555 - DNA, 20 bp, Homo sapiens
aggtctgggtggggcccagg

SEQ ID NO: 2498556 - DNA, 21 bp, Homo sapiens
aggtgaacattggttctttca

SEQ ID NO: 2498557 - DNA, 19 bp, Homo sapiens
aggtgaatagccatatttg

SEQ ID NO: 2498558 - DNA, 17 bp, Homo sapiens
aggtgaccccagggcac

SEQ ID NO: 2498559 - DNA, 18 bp, Homo sapiens
aggtgaccccagggcaca

SEQ ID NO: 2498560 - DNA, 15 bp, Homo sapiens
aggtgactgtctggg

SEQ ID NO: 2498561 - DNA, 13 bp, Homo sapiens
aggtgagaaattt

SEQ ID NO: 2498562 - DNA, 15 bp, Homo sapiens
aggtgatccatgtaa

SEQ ID NO: 2498563 - DNA, 22 bp, Homo sapiens
aggtgcaacaaggtcctctgtc

SEQ ID NO: 2498564 - DNA, 22 bp, Homo sapiens
aggtgcaatttcaaggttctaa

SEQ ID NO: 2498565 - DNA, 15 bp, Homo sapiens
aggtgcactgggagg

SEQ ID NO: 2498566 - DNA, 15 bp, Homo sapiens
aggtgcatttttact

SEQ ID NO: 2498567 - DNA, 18 bp, Homo sapiens
aggtgccactggagtgtg

SEQ ID NO: 2498568 - DNA, 21 bp, Homo sapiens
aggtgctacacccttttccag

SEQ ID NO: 2498569 - DNA, 15 bp, Homo sapiens
aggtggatctatttc

SEQ ID NO: 2498570 - DNA, 18 bp, Homo sapiens
aggtggggagactgggct

SEQ ID NO: 2498571 - DNA, 19 bp, Homo sapiens
aggtgtagccacaccagga

SEQ ID NO: 2498572 - DNA, 20 bp, Homo sapiens
aggtgtagccacaccaggat

SEQ ID NO: 2498573 - DNA, 18 bp, Homo sapiens
aggtgtcctacagaaaaa

SEQ ID NO: 2498574 - DNA, 20 bp, Homo sapiens
aggtgtcctacagaaaaacc

SEQ ID NO: 2498575 - DNA, 16 bp, Homo sapiens
aggtgtctcaggctgc

SEQ ID NO: 2498576 - DNA, 19 bp, Homo sapiens
aggtgtctcaggctgcctg

SEQ ID NO: 2498577 - DNA, 20 bp, Homo sapiens
aggtgtctcaggctgcctga

SEQ ID NO: 2498578 - DNA, 12 bp, Homo sapiens
aggtgttatttg

SEQ ID NO: 2498579 - DNA, 19 bp, Homo sapiens
aggttcagccaaggtttta

SEQ ID NO: 2498580 - DNA, 18 bp, Homo sapiens
aggttccacagaggacac

SEQ ID NO: 2498581 - DNA, 14 bp, Homo sapiens
aggttccctcccag

SEQ ID NO: 2498582 - DNA, 18 bp, Homo sapiens
aggttccgcttggagcag

SEQ ID NO: 2498583 - DNA, 21 bp, Homo sapiens
aggttccgcttggagcagagg

SEQ ID NO: 2498584 - DNA, 11 bp, Homo sapiens
aggttctaaaa

SEQ ID NO: 2498585 - DNA, 20 bp, Homo sapiens
aggttctaaagttctaagat

SEQ ID NO: 2498586 - DNA, 14 bp, Homo sapiens
aggttctaacccta

SEQ ID NO: 2498587 - DNA, 19 bp, Homo sapiens
aggttctaaggcctaggat

SEQ ID NO: 2498588 - DNA, 21 bp, Homo sapiens
aggttctccaacatcacagcc

SEQ ID NO: 2498589 - DNA, 22 bp, Homo sapiens
aggttctccaacatcacagccc

SEQ ID NO: 2498590 - DNA, 19 bp, Homo sapiens
aggttctccgttagctcct

SEQ ID NO: 2498591 - DNA, 21 bp, Homo sapiens
aggttctccgttagctcctgt

SEQ ID NO: 2498592 - DNA, 17 bp, Homo sapiens
aggttcttgttggtgca

SEQ ID NO: 2498593 - DNA, 17 bp, Homo sapiens
aggttgagctcttctta

SEQ ID NO: 2498594 - DNA, 16 bp, Homo sapiens
aggttgcacactttgg

SEQ ID NO: 2498595 - DNA, 19 bp, Homo sapiens
aggttgcacactttggtac

SEQ ID NO: 2498596 - DNA, 21 bp, Homo sapiens
aggttggctctgccagtcctg

SEQ ID NO: 2498597 - DNA, 14 bp, Homo sapiens
aggtttaaagagtc

SEQ ID NO: 2498598 - DNA, 14 bp, Homo sapiens
aggtttaaatgaac

SEQ ID NO: 2498599 - DNA, 14 bp, Homo sapiens
aggtttacagaatt

SEQ ID NO: 2498600 - DNA, 14 bp, Homo sapiens
aggtttatgaaaaa

SEQ ID NO: 2498601 - DNA, 14 bp, Homo sapiens
aggtttcaaagatg

SEQ ID NO: 2498602 - DNA, 22 bp, Homo sapiens
agtaaagaacgtggtcagagta

SEQ ID NO: 2498603 - DNA, 15 bp, Homo sapiens
agtaaagaattattt

SEQ ID NO: 2498604 - DNA, 18 bp, Homo sapiens
agtaaagtcaaggagaaa

SEQ ID NO: 2498605 - DNA, 19 bp, Homo sapiens
agtaaatcacgctttttga

SEQ ID NO: 2498606 - DNA, 20 bp, Homo sapiens
agtaaatcacgctttttgaa

SEQ ID NO: 2498607 - DNA, 15 bp, Homo sapiens
agtaaatcttttaca

SEQ ID NO: 2498608 - DNA, 15 bp, Homo sapiens
agtaacatttgctgt

SEQ ID NO: 2498609 - DNA, 16 bp, Homo sapiens
agtaacgcgtcttcct

SEQ ID NO: 2498610 - DNA, 19 bp, Homo sapiens
agtaacgcgtcttcctgag

SEQ ID NO: 2498611 - DNA, 22 bp, Homo sapiens
agtaacgcgtcttcctgagtgg

SEQ ID NO: 2498612 - DNA, 22 bp, Homo sapiens
agtaagggcactgacggactca

SEQ ID NO: 2498613 - DNA, 15 bp, Homo sapiens
agtaatggtgtagaa

SEQ ID NO: 2498614 - DNA, 20 bp, Homo sapiens
agtaattgacatgtgccagg

SEQ ID NO: 2498615 - DNA, 14 bp, Homo sapiens
agtaatttagaaat

SEQ ID NO: 2498616 - DNA, 14 bp, Homo sapiens
agtacactctgctg

SEQ ID NO: 2498617 - DNA, 15 bp, Homo sapiens
agtacagagaagcca

SEQ ID NO: 2498618 - DNA, 19 bp, Homo sapiens
agtaccctctcagctccag

SEQ ID NO: 2498619 - DNA, 16 bp, Homo sapiens
agtacctgagggtctg

SEQ ID NO: 2498620 - DNA, 18 bp, Homo sapiens
agtacctgggcaagctgg

SEQ ID NO: 2498621 - DNA, 19 bp, Homo sapiens
agtacctgggcaagctggc

SEQ ID NO: 2498622 - DNA, 19 bp, Homo sapiens
agtaccttttatatcccat

SEQ ID NO: 2498623 - DNA, 20 bp, Homo sapiens
agtactgggattacaggcgt

SEQ ID NO: 2498624 - DNA, 12 bp, Homo sapiens
agtagaaatcat

SEQ ID NO: 2498625 - DNA, 15 bp, Homo sapiens
agtagaattgcattg

SEQ ID NO: 2498626 - DNA, 14 bp, Homo sapiens
agtagcagtgattg

SEQ ID NO: 2498627 - DNA, 22 bp, Homo sapiens
agtagctgagctcacaaggcag

SEQ ID NO: 2498628 - DNA, 12 bp, Homo sapiens
agtagttcacat

SEQ ID NO: 2498629 - DNA, 23 bp, Homo sapiens
agtatactagggagccatttgag

SEQ ID NO: 2498630 - DNA, 15 bp, Homo sapiens
agtatcatgccctgt

SEQ ID NO: 2498631 - DNA, 22 bp, Homo sapiens
agtatgaattattcaatttatt

SEQ ID NO: 2498632 - DNA, 18 bp, Homo sapiens
agtatgggggttgtaaat

SEQ ID NO: 2498633 - DNA, 13 bp, Homo sapiens
agttgtaaagtat

SEQ ID NO: 2498634 - DNA, 18 bp, Homo sapiens
agttgtaaagtatgtatt

SEQ ID NO: 2498635 - DNA, 11 bp, Homo sapiens
agttgtctctg

SEQ ID NO: 2498636 - DNA, 16 bp, Homo sapiens
agttgtctctgatgca

SEQ ID NO: 2498637 - DNA, 22 bp, Homo sapiens
agttgtgagtttaccttgtata

SEQ ID NO: 2498638 - DNA, 18 bp, Homo sapiens
agttgttctttttagaaa

SEQ ID NO: 2498639 - DNA, 16 bp, Homo sapiens
agttgttgtaacctgc

SEQ ID NO: 2498640 - DNA, 18 bp, Homo sapiens
agtttaaaacagaagcct

SEQ ID NO: 2498641 - DNA, 15 bp, Homo sapiens
agtttaaaatcatca

SEQ ID NO: 2498642 - DNA, 21 bp, Homo sapiens
agtttaaaatcatcagaaagg

SEQ ID NO: 2498643 - DNA, 14 bp, Homo sapiens
agtttagctctgag

SEQ ID NO: 2498644 - DNA, 23 bp, Homo sapiens
agtttagggaacaatttggcaat

SEQ ID NO: 2498645 - DNA, 15 bp, Homo sapiens
agtttatatttaact

SEQ ID NO: 2498646 - DNA, 18 bp, Homo sapiens
agtttatatttaactctc

SEQ ID NO: 2498647 - DNA, 18 bp, Homo sapiens
agtttatcagtaaataac

SEQ ID NO: 2498648 - DNA, 15 bp, Homo sapiens
agtttatcattcaag

SEQ ID NO: 2498649 - DNA, 17 bp, Homo sapiens
agtttatcattcaagtg

SEQ ID NO: 2498650 - DNA, 17 bp, Homo sapiens
agtttcacagaaaataa

SEQ ID NO: 2498651 - DNA, 20 bp, Homo sapiens
agtttcagtagattgcagaa

SEQ ID NO: 2498652 - DNA, 20 bp, Homo sapiens
agtttctaaactggagactg

SEQ ID NO: 2498653 - DNA, 14 bp, Homo sapiens
agtttctaagattc

SEQ ID NO: 2498654 - DNA, 15 bp, Homo sapiens
agtttctaagattct

SEQ ID NO: 2498655 - DNA, 17 bp, Homo sapiens
agtttctaagattctaa

SEQ ID NO: 2498656 - DNA, 17 bp, Homo sapiens
agtttctgggacctcag

SEQ ID NO: 2498657 - DNA, 13 bp, Homo sapiens
agtttcttgcttg

SEQ ID NO: 2498658 - DNA, 16 bp, Homo sapiens
agtttgatgaggccct

SEQ ID NO: 2498659 - DNA, 18 bp, Homo sapiens
agtttgatgaggccctcc

SEQ ID NO: 2498660 - DNA, 17 bp, Homo sapiens
agtttgattattcagtg

SEQ ID NO: 2498661 - DNA, 18 bp, Homo sapiens
agtttgggtaaaatactt

SEQ ID NO: 2498662 - DNA, 15 bp, Homo sapiens
agtttgtgtgtctta

SEQ ID NO: 2498663 - DNA, 20 bp, Homo sapiens
agttttatatattatatgga

SEQ ID NO: 2498664 - DNA, 21 bp, Homo sapiens
agttttatatattatatggaa

SEQ ID NO: 2498665 - DNA, 12 bp, Homo sapiens
agttttatcatt

SEQ ID NO: 2498666 - DNA, 20 bp, Homo sapiens
agttttatcattttcaaaat

SEQ ID NO: 2498667 - DNA, 12 bp, Homo sapiens
agttttcagtgg

SEQ ID NO: 2498668 - DNA, 22 bp, Homo sapiens
agttttccatggcaggaaggct

SEQ ID NO: 2498669 - DNA, 18 bp, Homo sapiens
agttttcctatgctttga

SEQ ID NO: 2498670 - DNA, 12 bp, Homo sapiens
agttttgtgttt

SEQ ID NO: 2498671 - DNA, 22 bp, Homo sapiens
agttttgtgtttgttgtagatt

SEQ ID NO: 2498672 - DNA, 17 bp, Homo sapiens
ataaaaagcttccatga

SEQ ID NO: 2498673 - DNA, 16 bp, Homo sapiens
ataaaaagtgcttttg

SEQ ID NO: 2498674 - DNA, 19 bp, Homo sapiens
ataaaaataaaaaagatcc

SEQ ID NO: 2498675 - DNA, 17 bp, Homo sapiens
ataaaaatgatctaaac

SEQ ID NO: 2498676 - DNA, 13 bp, Homo sapiens
ataaaagaaaatt

SEQ ID NO: 2498677 - DNA, 17 bp, Homo sapiens
ataaaatgctaggttct

SEQ ID NO: 2498678 - DNA, 18 bp, Homo sapiens
ataaaatgctaggttcta

SEQ ID NO: 2498679 - DNA, 19 bp, Homo sapiens
ataaaatgctaggttctac

SEQ ID NO: 2498680 - DNA, 11 bp, Homo sapiens
ataaaatgtac

SEQ ID NO: 2498681 - DNA, 19 bp, Homo sapiens
ataaacaagaaaaataaag

SEQ ID NO: 2498682 - DNA, 20 bp, Homo sapiens
ataaacaagaaaaataaaga

SEQ ID NO: 2498683 - DNA, 15 bp, Homo sapiens
ataaactaataattg

SEQ ID NO: 2498684 - DNA, 17 bp, Homo sapiens
ataaactaataattgca

SEQ ID NO: 2498685 - DNA, 17 bp, Homo sapiens
ataaagaaaagatgcac

SEQ ID NO: 2498686 - DNA, 14 bp, Homo sapiens
ataaagaccacttt

SEQ ID NO: 2498687 - DNA, 22 bp, Homo sapiens
ataaagacgttttataagcatc

SEQ ID NO: 2498688 - DNA, 16 bp, Homo sapiens
ataaagattttttaat

SEQ ID NO: 2498689 - DNA, 14 bp, Homo sapiens
ataaagcagtattt

SEQ ID NO: 2498690 - DNA, 16 bp, Homo sapiens
ataaagcagtattttt

SEQ ID NO: 2498691 - DNA, 21 bp, Homo sapiens
ataaagcctcaaggttttagg

SEQ ID NO: 2498692 - DNA, 12 bp, Homo sapiens
ataaaggaaaag

SEQ ID NO: 2498693 - DNA, 14 bp, Homo sapiens
ataaaggatgtgat

SEQ ID NO: 2498694 - DNA, 17 bp, Homo sapiens
ataaaggatgtgattgt

SEQ ID NO: 2498695 - DNA, 17 bp, Homo sapiens
ataaaggcagttttcta

SEQ ID NO: 2498696 - DNA, 17 bp, Homo sapiens
ataaagtagtcctgtga

SEQ ID NO: 2498697 - DNA, 15 bp, Homo sapiens
ataaagtatcatcag

SEQ ID NO: 2498698 - DNA, 20 bp, Homo sapiens
ataaagttgataaagatttt

SEQ ID NO: 2498699 - DNA, 17 bp, Homo sapiens
ataaagttttatatatt

SEQ ID NO: 2498700 - DNA, 14 bp, Homo sapiens
ataaatatattatt

SEQ ID NO: 2498701 - DNA, 22 bp, Homo sapiens
ataaatatattattacttgtaa

SEQ ID NO: 2498702 - DNA, 16 bp, Homo sapiens
ataaatctgacccagt

SEQ ID NO: 2498703 - DNA, 18 bp, Homo sapiens
ataaatctgacccagtgc

SEQ ID NO: 2498704 - DNA, 16 bp, Homo sapiens
ataaatgattcttagt

SEQ ID NO: 2498705 - DNA, 12 bp, Homo sapiens
ataaatgcaaat

SEQ ID NO: 2498706 - DNA, 13 bp, Homo sapiens
ataaatgcaaata

SEQ ID NO: 2498707 - DNA, 14 bp, Homo sapiens
ataaatgcaaataa

SEQ ID NO: 2498708 - DNA, 15 bp, Homo sapiens
ataaatgtacattaa

SEQ ID NO: 2498709 - DNA, 21 bp, Homo sapiens
ataaattgcacaccttggaat

SEQ ID NO: 2498710 - DNA, 18 bp, Homo sapiens
ataaatttgacttttctg

SEQ ID NO: 2498711 - DNA, 15 bp, Homo sapiens
ataaattttttataa

SEQ ID NO: 2498712 - DNA, 17 bp, Homo sapiens
ataacaaatgccaaatt

SEQ ID NO: 2498713 - DNA, 20 bp, Homo sapiens
ataacaaatgccaaattaaa

SEQ ID NO: 2498714 - DNA, 14 bp, Homo sapiens
ataacaattcctct

SEQ ID NO: 2498715 - DNA, 15 bp, Homo sapiens
ataacaattcctcta

SEQ ID NO: 2498716 - DNA, 23 bp, Homo sapiens
ataacagaaagcctgggtgacat

SEQ ID NO: 2498717 - DNA, 19 bp, Homo sapiens
ataacatgtgaaaagaata

SEQ ID NO: 2498718 - DNA, 18 bp, Homo sapiens
ataacgtttaagccaaaa

SEQ ID NO: 2498719 - DNA, 22 bp, Homo sapiens
ataacgtttaagccaaaacaat

SEQ ID NO: 2498720 - DNA, 14 bp, Homo sapiens
ataactaaataaag

SEQ ID NO: 2498721 - DNA, 17 bp, Homo sapiens
ataactgaaaattattt

SEQ ID NO: 2498722 - DNA, 20 bp, Homo sapiens
ataactgaaaattatttaaa

SEQ ID NO: 2498723 - DNA, 21 bp, Homo sapiens
ataactgaaaattatttaaac

SEQ ID NO: 2498724 - DNA, 18 bp, Homo sapiens
ataactgtatttgaaata

SEQ ID NO: 2498725 - DNA, 21 bp, Homo sapiens
ataagaaacttttttatttaa

SEQ ID NO: 2498726 - DNA, 13 bp, Homo sapiens
ataagaaagcctg

SEQ ID NO: 2498727 - DNA, 13 bp, Homo sapiens
ataagaagaatgc

SEQ ID NO: 2498728 - DNA, 13 bp, Homo sapiens
ataagatctttta

SEQ ID NO: 2498729 - DNA, 11 bp, Homo sapiens
ataagattcta

SEQ ID NO: 2498730 - DNA, 12 bp, Homo sapiens
ataagattctaa

SEQ ID NO: 2498731 - DNA, 13 bp, Homo sapiens
ataagattctaac

SEQ ID NO: 2498732 - DNA, 16 bp, Homo sapiens
ataagcaagaaggcaa

SEQ ID NO: 2498733 - DNA, 22 bp, Homo sapiens
ataagcaggtggatctatttca

SEQ ID NO: 2498734 - DNA, 15 bp, Homo sapiens
ataagcatcattatt

SEQ ID NO: 2498735 - DNA, 22 bp, Homo sapiens
ataagctatttgatgtaatact

SEQ ID NO: 2498736 - DNA, 23 bp, Homo sapiens
ataagctatttgatgtaatactt

SEQ ID NO: 2498737 - DNA, 16 bp, Homo sapiens
ataagctatttttcta

SEQ ID NO: 2498738 - DNA, 20 bp, Homo sapiens
atcccttcatacttgaacgt

SEQ ID NO: 2498739 - DNA, 14 bp, Homo sapiens
atccgaatctcttt

SEQ ID NO: 2498740 - DNA, 21 bp, Homo sapiens
atccgtctttggcctcctcca

SEQ ID NO: 2498741 - DNA, 18 bp, Homo sapiens
atcctaagggtcgaaagc

SEQ ID NO: 2498742 - DNA, 19 bp, Homo sapiens
atcctaagggtcgaaagct

SEQ ID NO: 2498743 - DNA, 16 bp, Homo sapiens
atcctaggctgacacc

SEQ ID NO: 2498744 - DNA, 17 bp, Homo sapiens
atcctatgcatggtttc

SEQ ID NO: 2498745 - DNA, 20 bp, Homo sapiens
atcctatgtttttgttcaaa

SEQ ID NO: 2498746 - DNA, 19 bp, Homo sapiens
atcctccacgttctgctca

SEQ ID NO: 2498747 - DNA, 11 bp, Homo sapiens
atcctcctgca

SEQ ID NO: 2498748 - DNA, 13 bp, Homo sapiens
atcctctcttcct

SEQ ID NO: 2498749 - DNA, 20 bp, Homo sapiens
atcctctcttcctcttcccc

SEQ ID NO: 2498750 - DNA, 13 bp, Homo sapiens
atcctctggcttg

SEQ ID NO: 2498751 - DNA, 20 bp, Homo sapiens
atcctctgtaaactttttgt

SEQ ID NO: 2498752 - DNA, 24 bp, Homo sapiens
atcctgaccagctgctccgaggac

SEQ ID NO: 2498753 - DNA, 17 bp, Homo sapiens
atcctggaggcccagtt

SEQ ID NO: 2498754 - DNA, 18 bp, Homo sapiens
atcctgtgtggagaggga

SEQ ID NO: 2498755 - DNA, 19 bp, Homo sapiens
atcctgtgtggagagggaa

SEQ ID NO: 2498756 - DNA, 23 bp, Homo sapiens
atcctgtgtggagagggaatgtg

SEQ ID NO: 2498757 - DNA, 22 bp, Homo sapiens
atccttgccaatagtgtcatcc

SEQ ID NO: 2498758 - DNA, 21 bp, Homo sapiens
atcgacttgtttttgcacatg

SEQ ID NO: 2498759 - DNA, 17 bp, Homo sapiens
atcgcaccattctgact

SEQ ID NO: 2498760 - DNA, 13 bp, Homo sapiens
atcgccttcccca

SEQ ID NO: 2498761 - DNA, 22 bp, Homo sapiens
atcgctcctgcagccccagccc

SEQ ID NO: 2498762 - DNA, 21 bp, Homo sapiens
atcgctgggaaatgagatgac

SEQ ID NO: 2498763 - DNA, 15 bp, Homo sapiens
atcggaaaaataatc

SEQ ID NO: 2498764 - DNA, 16 bp, Homo sapiens
atcggccacagggcgg

SEQ ID NO: 2498765 - DNA, 19 bp, Homo sapiens
atcgtccagcgaccttcct

SEQ ID NO: 2498766 - DNA, 14 bp, Homo sapiens
atcgttttcttaaa

SEQ ID NO: 2498767 - DNA, 18 bp, Homo sapiens
atctaacctcatcttctt

SEQ ID NO: 2498768 - DNA, 14 bp, Homo sapiens
atctaagtgatata

SEQ ID NO: 2498769 - DNA, 13 bp, Homo sapiens
atctaagttataa

SEQ ID NO: 2498770 - DNA, 19 bp, Homo sapiens
atctaagttataagactct

SEQ ID NO: 2498771 - DNA, 16 bp, Homo sapiens
atctaatatggccaca

SEQ ID NO: 2498772 - DNA, 23 bp, Homo sapiens
atctaatatggccacagtagtct

SEQ ID NO: 2498773 - DNA, 14 bp, Homo sapiens
atctacacacggtg

SEQ ID NO: 2498774 - DNA, 14 bp, Homo sapiens
atctaccccagact

SEQ ID NO: 2498775 - DNA, 15 bp, Homo sapiens
atctactcaaagcat

SEQ ID NO: 2498776 - DNA, 19 bp, Homo sapiens
atctactttccctctggga

SEQ ID NO: 2498777 - DNA, 16 bp, Homo sapiens
atctagatatcgactt

SEQ ID NO: 2498778 - DNA, 19 bp, Homo sapiens
atctaggattttaagggaa

SEQ ID NO: 2498779 - DNA, 13 bp, Homo sapiens
atctataatttac

SEQ ID NO: 2498780 - DNA, 20 bp, Homo sapiens
atctcaacaggcctcagggc

SEQ ID NO: 2498781 - DNA, 22 bp, Homo sapiens
atctcaacaggcctcagggctc

SEQ ID NO: 2498782 - DNA, 15 bp, Homo sapiens
atctcaccaggcagc

SEQ ID NO: 2498783 - DNA, 22 bp, Homo sapiens
atctcaccccatcccacaccct

SEQ ID NO: 2498784 - DNA, 15 bp, Homo sapiens
atctcagaaagtgcc

SEQ ID NO: 2498785 - DNA, 17 bp, Homo sapiens
atctcagaaagtgcctg

SEQ ID NO: 2498786 - DNA, 18 bp, Homo sapiens
atctcagaaagtgcctga

SEQ ID NO: 2498787 - DNA, 14 bp, Homo sapiens
atctcaggccagag

SEQ ID NO: 2498788 - DNA, 14 bp, Homo sapiens
atctcagtgaagaa

SEQ ID NO: 2498789 - DNA, 17 bp, Homo sapiens
atctcagtgaagaatac

SEQ ID NO: 2498790 - DNA, 21 bp, Homo sapiens
atctcagttgattttctggat

SEQ ID NO: 2498791 - DNA, 16 bp, Homo sapiens
atctcattgcttacaa

SEQ ID NO: 2498792 - DNA, 20 bp, Homo sapiens
atctcccacctagcagcacc

SEQ ID NO: 2498793 - DNA, 19 bp, Homo sapiens
atctcccattttggaattt

SEQ ID NO: 2498794 - DNA, 14 bp, Homo sapiens
atctccctgcctcc

SEQ ID NO: 2498795 - DNA, 16 bp, Homo sapiens
atctccctgcctcctg

SEQ ID NO: 2498796 - DNA, 10 bp, Homo sapiens
atctccctgg

SEQ ID NO: 2498797 - DNA, 15 bp, Homo sapiens
atctccctggtgctt

SEQ ID NO: 2498798 - DNA, 21 bp, Homo sapiens
atctcccttttccatgactgt

SEQ ID NO: 2498799 - DNA, 15 bp, Homo sapiens
atctccgtggctttg

SEQ ID NO: 2498800 - DNA, 17 bp, Homo sapiens
atctctccactttcagc

SEQ ID NO: 2498801 - DNA, 20 bp, Homo sapiens
atctctccactttcagctgt

SEQ ID NO: 2498802 - DNA, 21 bp, Homo sapiens
atctctccactttcagctgtc

SEQ ID NO: 2498803 - DNA, 11 bp, Homo sapiens
atctctccctc

SEQ ID NO: 2498804 - DNA, 15 bp, Homo sapiens
atctctccctcccct

SEQ ID NO: 2498805 - DNA, 19 bp, Homo sapiens
atctctgaagccacaaata

SEQ ID NO: 2498806 - DNA, 21 bp, Homo sapiens
atctctgggggctgaggagca

SEQ ID NO: 2498807 - DNA, 14 bp, Homo sapiens
atctctgtgccttc

SEQ ID NO: 2498808 - DNA, 18 bp, Homo sapiens
atctctgtgccttcgtct

SEQ ID NO: 2498809 - DNA, 14 bp, Homo sapiens
atctcttcaggttc

SEQ ID NO: 2498810 - DNA, 15 bp, Homo sapiens
atctgaagccctccc

SEQ ID NO: 2498811 - DNA, 18 bp, Homo sapiens
atctgaagccctcccagg

SEQ ID NO: 2498812 - DNA, 12 bp, Homo sapiens
atctgaattttt

SEQ ID NO: 2498813 - DNA, 14 bp, Homo sapiens
atctgaatttttaa

SEQ ID NO: 2498814 - DNA, 19 bp, Homo sapiens
atctgaatttttaaacaag

SEQ ID NO: 2498815 - DNA, 13 bp, Homo sapiens
atctgagtcctgg

SEQ ID NO: 2498816 - DNA, 14 bp, Homo sapiens
atctgagtcctgga

SEQ ID NO: 2498817 - DNA, 15 bp, Homo sapiens
atctgcccacctcag

SEQ ID NO: 2498818 - DNA, 23 bp, Homo sapiens
atctgcccacctcagcctcccaa

SEQ ID NO: 2498819 - DNA, 12 bp, Homo sapiens
atctgcctccct

SEQ ID NO: 2498820 - DNA, 16 bp, Homo sapiens
atctgcgtgacaataa

SEQ ID NO: 2498821 - DNA, 23 bp, Homo sapiens
atctgcgtgacaataaaacatta

SEQ ID NO: 2498822 - DNA, 15 bp, Homo sapiens
atctggaacccagac

SEQ ID NO: 2498823 - DNA, 17 bp, Homo sapiens
atctggaacccagactc

SEQ ID NO: 2498824 - DNA, 23 bp, Homo sapiens
atctggaacccagactcagacat

SEQ ID NO: 2498825 - DNA, 17 bp, Homo sapiens
atctggaacctcagcct

SEQ ID NO: 2498826 - DNA, 19 bp, Homo sapiens
atctggaacctcagcctgg

SEQ ID NO: 2498827 - DNA, 16 bp, Homo sapiens
atctggcctggccagt

SEQ ID NO: 2498828 - DNA, 19 bp, Homo sapiens
atctggcctggccagtgcc

SEQ ID NO: 2498829 - DNA, 21 bp, Homo sapiens
atctgggccttggcctggagc

SEQ ID NO: 2498830 - DNA, 20 bp, Homo sapiens
atctgggcttcctggagcag

SEQ ID NO: 2498831 - DNA, 18 bp, Homo sapiens
atctggggagcaggcagc

SEQ ID NO: 2498832 - DNA, 12 bp, Homo sapiens
atctgtcagttc

SEQ ID NO: 2498833 - DNA, 14 bp, Homo sapiens
atctgtcctcagcc

SEQ ID NO: 2498834 - DNA, 16 bp, Homo sapiens
atctgtcctcagcctt

SEQ ID NO: 2498835 - DNA, 21 bp, Homo sapiens
atctgtcctcagccttgccag

SEQ ID NO: 2498836 - DNA, 16 bp, Homo sapiens
atctgtctggtggccc

SEQ ID NO: 2498837 - DNA, 15 bp, Homo sapiens
atctgtctgtggcaa

SEQ ID NO: 2498838 - DNA, 19 bp, Homo sapiens
atctgtctgtggcaaaagt

SEQ ID NO: 2498839 - DNA, 22 bp, Homo sapiens
atctgtctgtggcaaaagttta

SEQ ID NO: 2498840 - DNA, 21 bp, Homo sapiens
atctgtgaaatgctggcattt

SEQ ID NO: 2498841 - DNA, 23 bp, Homo sapiens
atctgtgggtctgggagtcacac

SEQ ID NO: 2498842 - DNA, 22 bp, Homo sapiens
attacaaatcagaagtcatctt

SEQ ID NO: 2498843 - DNA, 14 bp, Homo sapiens
attacaagtatttt

SEQ ID NO: 2498844 - DNA, 19 bp, Homo sapiens
attacaagtatttttaatt

SEQ ID NO: 2498845 - DNA, 21 bp, Homo sapiens
attacagatgggcaaattaag

SEQ ID NO: 2498846 - DNA, 20 bp, Homo sapiens
attacaggcacctgccacca

SEQ ID NO: 2498847 - DNA, 14 bp, Homo sapiens
attacagtgtttat

SEQ ID NO: 2498848 - DNA, 15 bp, Homo sapiens
attacattttcagtg

SEQ ID NO: 2498849 - DNA, 15 bp, Homo sapiens
attaccatgtaatgg

SEQ ID NO: 2498850 - DNA, 13 bp, Homo sapiens
attacctcctgag

SEQ ID NO: 2498851 - DNA, 17 bp, Homo sapiens
attacctcctgagaaaa

SEQ ID NO: 2498852 - DNA, 14 bp, Homo sapiens
attactcaggtttg

SEQ ID NO: 2498853 - DNA, 13 bp, Homo sapiens
attacttgtaaat

SEQ ID NO: 2498854 - DNA, 16 bp, Homo sapiens
attacttgtaaatata

SEQ ID NO: 2498855 - DNA, 21 bp, Homo sapiens
attactttggggctaatttaa

SEQ ID NO: 2498856 - DNA, 23 bp, Homo sapiens
attactttggggctaatttaaca

SEQ ID NO: 2498857 - DNA, 14 bp, Homo sapiens
attacttttgctgt

SEQ ID NO: 2498858 - DNA, 24 bp, Homo sapiens
attagaaatattttaaaatcagct

SEQ ID NO: 2498859 - DNA, 22 bp, Homo sapiens
attagaaattacctgtggatat

SEQ ID NO: 2498860 - DNA, 21 bp, Homo sapiens
attagaagacaattgacaaca

SEQ ID NO: 2498861 - DNA, 14 bp, Homo sapiens
attagacagaacac

SEQ ID NO: 2498862 - DNA, 20 bp, Homo sapiens
attagagattacctcctgag

SEQ ID NO: 2498863 - DNA, 23 bp, Homo sapiens
attagagtgtctttccacggagc

SEQ ID NO: 2498864 - DNA, 14 bp, Homo sapiens
attaggctgtaact

SEQ ID NO: 2498865 - DNA, 15 bp, Homo sapiens
attaggctgtaacta

SEQ ID NO: 2498866 - DNA, 21 bp, Homo sapiens
attaggctgtaactactttat

SEQ ID NO: 2498867 - DNA, 23 bp, Homo sapiens
attaggctgtaactactttataa

SEQ ID NO: 2498868 - DNA, 18 bp, Homo sapiens
attagggccctgtgtctg

SEQ ID NO: 2498869 - DNA, 15 bp, Homo sapiens
attagtattgttgtc

SEQ ID NO: 2498870 - DNA, 16 bp, Homo sapiens
attagtgccacttaat

SEQ ID NO: 2498871 - DNA, 19 bp, Homo sapiens
attagtgccacttaatgta

SEQ ID NO: 2498872 - DNA, 21 bp, Homo sapiens
attagtgccacttaatgtatg

SEQ ID NO: 2498873 - DNA, 22 bp, Homo sapiens
attagtgccacttaatgtatgt

SEQ ID NO: 2498874 - DNA, 12 bp, Homo sapiens
attagttatata

SEQ ID NO: 2498875 - DNA, 17 bp, Homo sapiens
attagtttcctttttaa

SEQ ID NO: 2498876 - DNA, 22 bp, Homo sapiens
attataatatactatatttatg

SEQ ID NO: 2498877 - DNA, 18 bp, Homo sapiens
attataatcttataattg

SEQ ID NO: 2498878 - DNA, 20 bp, Homo sapiens
attataccaaaatgttgctg

SEQ ID NO: 2498879 - DNA, 21 bp, Homo sapiens
attatacttgtaattatggag

SEQ ID NO: 2498880 - DNA, 14 bp, Homo sapiens
attatagattctaa

SEQ ID NO: 2498881 - DNA, 16 bp, Homo sapiens
attatagattctaaag

SEQ ID NO: 2498882 - DNA, 21 bp, Homo sapiens
attatatggaaatatatatta

SEQ ID NO: 2498883 - DNA, 20 bp, Homo sapiens
attatattattagttttgat

SEQ ID NO: 2498884 - DNA, 17 bp, Homo sapiens
attatccaggtaatcca

SEQ ID NO: 2498885 - DNA, 19 bp, Homo sapiens
attatcgttttcttaaagt

SEQ ID NO: 2498886 - DNA, 14 bp, Homo sapiens
attatctaatttat

SEQ ID NO: 2498887 - DNA, 22 bp, Homo sapiens
attatcttttcaaaggtacttg

SEQ ID NO: 2498888 - DNA, 22 bp, Homo sapiens
attatcttttcatacattttct

SEQ ID NO: 2498889 - DNA, 15 bp, Homo sapiens
attatgtagctcttt

SEQ ID NO: 2498890 - DNA, 16 bp, Homo sapiens
attatgtagctctttg

SEQ ID NO: 2498891 - DNA, 14 bp, Homo sapiens
attattaatgaaaa

SEQ ID NO: 2498892 - DNA, 22 bp, Homo sapiens
attattaatgaaaataagaatt

SEQ ID NO: 2498893 - DNA, 14 bp, Homo sapiens
attattacttgtaa

SEQ ID NO: 2498894 - DNA, 19 bp, Homo sapiens
attattacttgtaaatata

SEQ ID NO: 2498895 - DNA, 20 bp, Homo sapiens
attattacttgtaaatataa

SEQ ID NO: 2498896 - DNA, 22 bp, Homo sapiens
attattacttgtaaatataaag

SEQ ID NO: 2498897 - DNA, 16 bp, Homo sapiens
attattattcttcata

SEQ ID NO: 2498898 - DNA, 14 bp, Homo sapiens
attattcactagta

SEQ ID NO: 2498899 - DNA, 13 bp, Homo sapiens
attattcagtgtc

SEQ ID NO: 2498900 - DNA, 15 bp, Homo sapiens
attattcagtgtcac

SEQ ID NO: 2498901 - DNA, 22 bp, Homo sapiens
attatttaaaccgctaaaagaa

SEQ ID NO: 2498902 - DNA, 13 bp, Homo sapiens
attatttatgtat

SEQ ID NO: 2498903 - DNA, 14 bp, Homo sapiens
attatttatgtatt

SEQ ID NO: 2498904 - DNA, 15 bp, Homo sapiens
attatttatgtattg

SEQ ID NO: 2498905 - DNA, 15 bp, Homo sapiens
attatttgtgtttta

SEQ ID NO: 2498906 - DNA, 12 bp, Homo sapiens
attattttcatc

SEQ ID NO: 2498907 - DNA, 23 bp, Homo sapiens
attattttcatccttgtcttatt

SEQ ID NO: 2498908 - DNA, 12 bp, Homo sapiens
attattttgtga

SEQ ID NO: 2498909 - DNA, 14 bp, Homo sapiens
attcaaaagttcca

SEQ ID NO: 2498910 - DNA, 14 bp, Homo sapiens
attcaaaggttcta

SEQ ID NO: 2498911 - DNA, 16 bp, Homo sapiens
attcaaaggttctagg

SEQ ID NO: 2498912 - DNA, 21 bp, Homo sapiens
attcaaaggttctaggtttca

SEQ ID NO: 2498913 - DNA, 15 bp, Homo sapiens
attcaacaatttcaa

SEQ ID NO: 2498914 - DNA, 17 bp, Homo sapiens
attcaaggaatttctta

SEQ ID NO: 2498915 - DNA, 18 bp, Homo sapiens
attcaaggaatttcttaa

SEQ ID NO: 2498916 - DNA, 14 bp, Homo sapiens
attcacaaactttt

SEQ ID NO: 2498917 - DNA, 22 bp, Homo sapiens
attcacaaacttttatactctt

SEQ ID NO: 2498918 - DNA, 19 bp, Homo sapiens
attcacagtgctcttttct

SEQ ID NO: 2498919 - DNA, 21 bp, Homo sapiens
attcacagtgctcttttctcc

SEQ ID NO: 2498920 - DNA, 22 bp, Homo sapiens
attcaccccctttcctggacac

SEQ ID NO: 2498921 - DNA, 18 bp, Homo sapiens
attcagaaaatgttctgt

SEQ ID NO: 2498922 - DNA, 19 bp, Homo sapiens
attcagaaaatgttctgtt

SEQ ID NO: 2498923 - DNA, 13 bp, Homo sapiens
attcagaaatgag

SEQ ID NO: 2498924 - DNA, 16 bp, Homo sapiens
attcagaagaaaaaga

SEQ ID NO: 2498925 - DNA, 17 bp, Homo sapiens
attcagaagaaaaagaa

SEQ ID NO: 2498926 - DNA, 14 bp, Homo sapiens
attcagacagatga

SEQ ID NO: 2498927 - DNA, 11 bp, Homo sapiens
attcagacatc

SEQ ID NO: 2498928 - DNA, 17 bp, Homo sapiens
attcaggaaaaggcctg

SEQ ID NO: 2498929 - DNA, 20 bp, Homo sapiens
attcaggaaaaggcctgggg

SEQ ID NO: 2498930 - DNA, 14 bp, Homo sapiens
attcagggaaggag

SEQ ID NO: 2498931 - DNA, 15 bp, Homo sapiens
attcaggtaatacaa

SEQ ID NO: 2498932 - DNA, 14 bp, Homo sapiens
attcaggtttttcc

SEQ ID NO: 2498933 - DNA, 14 bp, Homo sapiens
attcagttttcatt

SEQ ID NO: 2498934 - DNA, 17 bp, Homo sapiens
attcatagtaacttctt

SEQ ID NO: 2498935 - DNA, 20 bp, Homo sapiens
attcatagtctttggagaaa

SEQ ID NO: 2498936 - DNA, 18 bp, Homo sapiens
attcatccaagttaaatg

SEQ ID NO: 2498937 - DNA, 15 bp, Homo sapiens
attcattagtcatgt

SEQ ID NO: 2498938 - DNA, 14 bp, Homo sapiens
attcattgtgttac

SEQ ID NO: 2498939 - DNA, 17 bp, Homo sapiens
attcattttttaaattc

SEQ ID NO: 2498940 - DNA, 20 bp, Homo sapiens
attccaaagagtagaattgc

SEQ ID NO: 2498941 - DNA, 18 bp, Homo sapiens
attccaaagtctctaatt

SEQ ID NO: 2498942 - DNA, 16 bp, Homo sapiens
attccaagactctaga

SEQ ID NO: 2498943 - DNA, 17 bp, Homo sapiens
attccaagactctagag

SEQ ID NO: 2498944 - DNA, 14 bp, Homo sapiens
attccaagtctcca

SEQ ID NO: 2498945 - DNA, 13 bp, Homo sapiens
attccagcccctc

SEQ ID NO: 2498946 - DNA, 17 bp, Homo sapiens
caaagtcctttttttcc

SEQ ID NO: 2498947 - DNA, 21 bp, Homo sapiens
caaagttctaataatttctaa

SEQ ID NO: 2498948 - DNA, 22 bp, Homo sapiens
caaagttgttgtaacctgctgt

SEQ ID NO: 2498949 - DNA, 17 bp, Homo sapiens
caaataaaaagtgcttt

SEQ ID NO: 2498950 - DNA, 18 bp, Homo sapiens
caaataaaaagtgctttt

SEQ ID NO: 2498951 - DNA, 19 bp, Homo sapiens
caaatacatttaaaacatt

SEQ ID NO: 2498952 - DNA, 21 bp, Homo sapiens
caaatactaaaaagaagtgct

SEQ ID NO: 2498953 - DNA, 16 bp, Homo sapiens
caaatactaatgaaaa

SEQ ID NO: 2498954 - DNA, 18 bp, Homo sapiens
caaatactgtatattcag

SEQ ID NO: 2498955 - DNA, 18 bp, Homo sapiens
caaataggatgcttggga

SEQ ID NO: 2498956 - DNA, 13 bp, Homo sapiens
caaatatgtcctg

SEQ ID NO: 2498957 - DNA, 22 bp, Homo sapiens
caaatatttagatgtaattttg

SEQ ID NO: 2498958 - DNA, 14 bp, Homo sapiens
caaatcacatattt

SEQ ID NO: 2498959 - DNA, 14 bp, Homo sapiens
caaatcaccacaaa

SEQ ID NO: 2498960 - DNA, 15 bp, Homo sapiens
caaatcagaagtcat

SEQ ID NO: 2498961 - DNA, 16 bp, Homo sapiens
caaatcaggcttttgt

SEQ ID NO: 2498962 - DNA, 18 bp, Homo sapiens
caaatcatttgtttaaaa

SEQ ID NO: 2498963 - DNA, 14 bp, Homo sapiens
caaatcgaatgaaa

SEQ ID NO: 2498964 - DNA, 13 bp, Homo sapiens
caaatctggaagc

SEQ ID NO: 2498965 - DNA, 18 bp, Homo sapiens
caaatgagtaacatttgc

SEQ ID NO: 2498966 - DNA, 21 bp, Homo sapiens
caaatgagtaacatttgctgt

SEQ ID NO: 2498967 - DNA, 21 bp, Homo sapiens
caaatgcaaaaactctttgag

SEQ ID NO: 2498968 - DNA, 21 bp, Homo sapiens
caaatgccaaattaaaaaaga

SEQ ID NO: 2498969 - DNA, 19 bp, Homo sapiens
caaatggggccagatccag

SEQ ID NO: 2498970 - DNA, 23 bp, Homo sapiens
caaatggggccagatccagcctg

SEQ ID NO: 2498971 - DNA, 13 bp, Homo sapiens
caaatggtaggca

SEQ ID NO: 2498972 - DNA, 15 bp, Homo sapiens
caaatggtaggcatt

SEQ ID NO: 2498973 - DNA, 15 bp, Homo sapiens
caaatggtatctttt

SEQ ID NO: 2498974 - DNA, 15 bp, Homo sapiens
caaatgttaaaatgt

SEQ ID NO: 2498975 - DNA, 20 bp, Homo sapiens
caaatgttaaaatgtgttgt

SEQ ID NO: 2498976 - DNA, 14 bp, Homo sapiens
caaatgttctaagt

SEQ ID NO: 2498977 - DNA, 21 bp, Homo sapiens
caaatgttctaagtttctaag

SEQ ID NO: 2498978 - DNA, 21 bp, Homo sapiens
caaattaaaaaagataaacac

SEQ ID NO: 2498979 - DNA, 15 bp, Homo sapiens
caaattagttatata

SEQ ID NO: 2498980 - DNA, 14 bp, Homo sapiens
caaattcagtttca

SEQ ID NO: 2498981 - DNA, 15 bp, Homo sapiens
caaattcagtttcat

SEQ ID NO: 2498982 - DNA, 16 bp, Homo sapiens
caaattcagtttcata

SEQ ID NO: 2498983 - DNA, 18 bp, Homo sapiens
caaattcagtttcataaa

SEQ ID NO: 2498984 - DNA, 17 bp, Homo sapiens
caaatttgattgatttg

SEQ ID NO: 2498985 - DNA, 19 bp, Homo sapiens
caaatttgtagggtttcta

SEQ ID NO: 2498986 - DNA, 19 bp, Homo sapiens
caaattttgagttgccaca

SEQ ID NO: 2498987 - DNA, 20 bp, Homo sapiens
caacaaagaaacaaagatgt

SEQ ID NO: 2498988 - DNA, 13 bp, Homo sapiens
caacaattctaaa

SEQ ID NO: 2498989 - DNA, 13 bp, Homo sapiens
caacaatttctac

SEQ ID NO: 2498990 - DNA, 19 bp, Homo sapiens
caacaatttctactttgaa

SEQ ID NO: 2498991 - DNA, 14 bp, Homo sapiens
caacacagaggcag

SEQ ID NO: 2498992 - DNA, 13 bp, Homo sapiens
caacaccaagcac

SEQ ID NO: 2498993 - DNA, 22 bp, Homo sapiens
caacaccaagcacagcagcctg

SEQ ID NO: 2498994 - DNA, 19 bp, Homo sapiens
caacaccatgattccttta

SEQ ID NO: 2498995 - DNA, 22 bp, Homo sapiens
caacaccatgattcctttaaca

SEQ ID NO: 2498996 - DNA, 13 bp, Homo sapiens
caacacgttacta

SEQ ID NO: 2498997 - DNA, 18 bp, Homo sapiens
caacactggtctgctgtt

SEQ ID NO: 2498998 - DNA, 22 bp, Homo sapiens
caacactggtctgctgttccag

SEQ ID NO: 2498999 - DNA, 20 bp, Homo sapiens
caacagagactgaatagata

SEQ ID NO: 2499000 - DNA, 15 bp, Homo sapiens
caacagcaaacaggt

SEQ ID NO: 2499001 - DNA, 16 bp, Homo sapiens
caacagctggaccctg

SEQ ID NO: 2499002 - DNA, 20 bp, Homo sapiens
caacagctggaccctgacca

SEQ ID NO: 2499003 - DNA, 17 bp, Homo sapiens
caacagtaaaccactga

SEQ ID NO: 2499004 - DNA, 22 bp, Homo sapiens
caacagtaaaccactgaaaaaa

SEQ ID NO: 2499005 - DNA, 16 bp, Homo sapiens
caacagtgaagacaga

SEQ ID NO: 2499006 - DNA, 20 bp, Homo sapiens
caacagtttaatgaagatct

SEQ ID NO: 2499007 - DNA, 12 bp, Homo sapiens
caacagttttcc

SEQ ID NO: 2499008 - DNA, 17 bp, Homo sapiens
caacatcacagcccagc

SEQ ID NO: 2499009 - DNA, 22 bp, Homo sapiens
caacatgatgaggtagtacctt

SEQ ID NO: 2499010 - DNA, 12 bp, Homo sapiens
caacatggcttt

SEQ ID NO: 2499011 - DNA, 22 bp, Homo sapiens
caacatgttatttgtaatagat

SEQ ID NO: 2499012 - DNA, 23 bp, Homo sapiens
caacatgttatttgtaatagatg

SEQ ID NO: 2499013 - DNA, 14 bp, Homo sapiens
caacatttctcaat

SEQ ID NO: 2499014 - DNA, 22 bp, Homo sapiens
caaccaagaatgttatgtgcaa

SEQ ID NO: 2499015 - DNA, 16 bp, Homo sapiens
caaccatttcctcaga

SEQ ID NO: 2499016 - DNA, 14 bp, Homo sapiens
caaccatttgaaac

SEQ ID NO: 2499017 - DNA, 21 bp, Homo sapiens
caacccctcccctccatccct

SEQ ID NO: 2499018 - DNA, 22 bp, Homo sapiens
caacccgtctggcccaccaggg

SEQ ID NO: 2499019 - DNA, 16 bp, Homo sapiens
caacccgtgccaagtc

SEQ ID NO: 2499020 - DNA, 17 bp, Homo sapiens
caacccgtgccaagtcc

SEQ ID NO: 2499021 - DNA, 23 bp, Homo sapiens
caacccgtgccaagtccaggtcc

SEQ ID NO: 2499022 - DNA, 21 bp, Homo sapiens
caacccgtggaggctgctcgg

SEQ ID NO: 2499023 - DNA, 11 bp, Homo sapiens
caaccctcagg

SEQ ID NO: 2499024 - DNA, 15 bp, Homo sapiens
caacctaaaactctt

SEQ ID NO: 2499025 - DNA, 14 bp, Homo sapiens
caacctccacctcc

SEQ ID NO: 2499026 - DNA, 13 bp, Homo sapiens
caacctcttggcc

SEQ ID NO: 2499027 - DNA, 21 bp, Homo sapiens
caacctgaatacccttttctg

SEQ ID NO: 2499028 - DNA, 21 bp, Homo sapiens
caacctgcctgacatttggag

SEQ ID NO: 2499029 - DNA, 20 bp, Homo sapiens
caacggaaagtgctgtctta

SEQ ID NO: 2499030 - DNA, 20 bp, Homo sapiens
caactacccccagctgtgct

SEQ ID NO: 2499031 - DNA, 21 bp, Homo sapiens
caactactaatagaataaagg

SEQ ID NO: 2499032 - DNA, 21 bp, Homo sapiens
caactatcagactaagccagc

SEQ ID NO: 2499033 - DNA, 17 bp, Homo sapiens
caactatggatcagaat

SEQ ID NO: 2499034 - DNA, 18 bp, Homo sapiens
caactcactccttttaaa

SEQ ID NO: 2499035 - DNA, 19 bp, Homo sapiens
caactcctagttctagaaa

SEQ ID NO: 2499036 - DNA, 20 bp, Homo sapiens
caactcctagttctagaaaa

SEQ ID NO: 2499037 - DNA, 18 bp, Homo sapiens
caactctcccctgacctg

SEQ ID NO: 2499038 - DNA, 24 bp, Homo sapiens
caactctcccctgacctgtgagcc

SEQ ID NO: 2499039 - DNA, 16 bp, Homo sapiens
caactctcttattgcc

SEQ ID NO: 2499040 - DNA, 21 bp, Homo sapiens
caactctcttattgcctcact

SEQ ID NO: 2499041 - DNA, 18 bp, Homo sapiens
caactcttgattatccat

SEQ ID NO: 2499042 - DNA, 13 bp, Homo sapiens
caactctttgaga

SEQ ID NO: 2499043 - DNA, 14 bp, Homo sapiens
caactctttgagaa

SEQ ID NO: 2499044 - DNA, 13 bp, Homo sapiens
caactctttgtta

SEQ ID NO: 2499045 - DNA, 14 bp, Homo sapiens
caactctttgttat

SEQ ID NO: 2499046 - DNA, 15 bp, Homo sapiens
caactgctcccacct

SEQ ID NO: 2499047 - DNA, 12 bp, Homo sapiens
caactggcaggc

SEQ ID NO: 2499048 - DNA, 16 bp, Homo sapiens
caacttctaattgcca

SEQ ID NO: 2499049 - DNA, 13 bp, Homo sapiens
caactttactgta

SEQ ID NO: 2499050 - DNA, 16 bp, Homo sapiens
caatataagcttttct

SEQ ID NO: 2499051 - DNA, 18 bp, Homo sapiens
caatatgggggccttttg

SEQ ID NO: 2499052 - DNA, 14 bp, Homo sapiens
caatatttttagat

SEQ ID NO: 2499053 - DNA, 15 bp, Homo sapiens
caatcaactttactg

SEQ ID NO: 2499054 - DNA, 15 bp, Homo sapiens
caatcaagtctgttt

SEQ ID NO: 2499055 - DNA, 16 bp, Homo sapiens
caatcctatgcatggt

SEQ ID NO: 2499056 - DNA, 11 bp, Homo sapiens
caatcctggac

SEQ ID NO: 2499057 - DNA, 17 bp, Homo sapiens
caatctactcaaagcat

SEQ ID NO: 2499058 - DNA, 22 bp, Homo sapiens
caatctttaaaccaattgctgc

SEQ ID NO: 2499059 - DNA, 20 bp, Homo sapiens
caatgaaaactctttgctgc

SEQ ID NO: 2499060 - DNA, 22 bp, Homo sapiens
caatgaataaaaactcaaggag

SEQ ID NO: 2499061 - DNA, 12 bp, Homo sapiens
caatgacatgaa

SEQ ID NO: 2499062 - DNA, 20 bp, Homo sapiens
caatgagcatgtttagactt

SEQ ID NO: 2499063 - DNA, 12 bp, Homo sapiens
caatgagctttc

SEQ ID NO: 2499064 - DNA, 15 bp, Homo sapiens
caatgagctttctga

SEQ ID NO: 2499065 - DNA, 17 bp, Homo sapiens
caatgagctttctgaac

SEQ ID NO: 2499066 - DNA, 20 bp, Homo sapiens
caatgagctttctgaacagc

SEQ ID NO: 2499067 - DNA, 20 bp, Homo sapiens
caatgaggtgtccaactggc

SEQ ID NO: 2499068 - DNA, 19 bp, Homo sapiens
caatgatcctgtattcaga

SEQ ID NO: 2499069 - DNA, 23 bp, Homo sapiens
caatgcacctaaagaaaaacaaa

SEQ ID NO: 2499070 - DNA, 16 bp, Homo sapiens
caatgcagttgtctct

SEQ ID NO: 2499071 - DNA, 14 bp, Homo sapiens
caatgccatcatct

SEQ ID NO: 2499072 - DNA, 17 bp, Homo sapiens
caatgtaaatattttaa

SEQ ID NO: 2499073 - DNA, 14 bp, Homo sapiens
caatgtaattattt

SEQ ID NO: 2499074 - DNA, 19 bp, Homo sapiens
caatgtacccaccgggcca

SEQ ID NO: 2499075 - DNA, 22 bp, Homo sapiens
caatgtacccaccgggccactc

SEQ ID NO: 2499076 - DNA, 16 bp, Homo sapiens
caatgtctggagacca

SEQ ID NO: 2499077 - DNA, 21 bp, Homo sapiens
caatgtctggagaccaccagg

SEQ ID NO: 2499078 - DNA, 23 bp, Homo sapiens
caatgtcttgatgcatgcactgt

SEQ ID NO: 2499079 - DNA, 23 bp, Homo sapiens
caatgtggcaaggaaaaacaggt

SEQ ID NO: 2499080 - DNA, 23 bp, Homo sapiens
caattaggcagactctttatgct

SEQ ID NO: 2499081 - DNA, 13 bp, Homo sapiens
caattagtttcct

SEQ ID NO: 2499082 - DNA, 14 bp, Homo sapiens
caattagtttcctt

SEQ ID NO: 2499083 - DNA, 21 bp, Homo sapiens
caattagtttcctttttaata

SEQ ID NO: 2499084 - DNA, 21 bp, Homo sapiens
caattataagaggatatgaac

SEQ ID NO: 2499085 - DNA, 14 bp, Homo sapiens
caattatagtttct

SEQ ID NO: 2499086 - DNA, 22 bp, Homo sapiens
caattatagtttctgaggcttt

SEQ ID NO: 2499087 - DNA, 14 bp, Homo sapiens
caattcagacaggc

SEQ ID NO: 2499088 - DNA, 23 bp, Homo sapiens
caattcagacaggcaaataaaag

SEQ ID NO: 2499089 - DNA, 15 bp, Homo sapiens
caattccaacagttt

SEQ ID NO: 2499090 - DNA, 21 bp, Homo sapiens
caattccaacagtttaatgaa

SEQ ID NO: 2499091 - DNA, 22 bp, Homo sapiens
caattgaaagtgggcaaaagct

SEQ ID NO: 2499092 - DNA, 15 bp, Homo sapiens
caattgaagtaaact

SEQ ID NO: 2499093 - DNA, 20 bp, Homo sapiens
caattggcaccgaagcccag

SEQ ID NO: 2499094 - DNA, 21 bp, Homo sapiens
caattggcaccgaagcccaga

SEQ ID NO: 2499095 - DNA, 18 bp, Homo sapiens
caattgtgagccaccacg

SEQ ID NO: 2499096 - DNA, 17 bp, Homo sapiens
caattgtgtagcctttt

SEQ ID NO: 2499097 - DNA, 13 bp, Homo sapiens
caatttatttgaa

SEQ ID NO: 2499098 - DNA, 17 bp, Homo sapiens
caatttcggattttttc

SEQ ID NO: 2499099 - DNA, 21 bp, Homo sapiens
caatttcggattttttccaaa

SEQ ID NO: 2499100 - DNA, 19 bp, Homo sapiens
caatttctaatttttaaga

SEQ ID NO: 2499101 - DNA, 21 bp, Homo sapiens
caatttggatttaaaagcctg

SEQ ID NO: 2499102 - DNA, 21 bp, Homo sapiens
caattttatccctcacctgta

SEQ ID NO: 2499103 - DNA, 20 bp, Homo sapiens
caattttttaagtgaaaata

SEQ ID NO: 2499104 - DNA, 20 bp, Homo sapiens
caattttttttattagtatt

SEQ ID NO: 2499105 - DNA, 15 bp, Homo sapiens
cacaaactgtaaata

SEQ ID NO: 2499106 - DNA, 17 bp, Homo sapiens
cacaaattattaatgaa

SEQ ID NO: 2499107 - DNA, 20 bp, Homo sapiens
cacaaattattaatgaaaat

SEQ ID NO: 2499108 - DNA, 11 bp, Homo sapiens
cacaactagga

SEQ ID NO: 2499109 - DNA, 19 bp, Homo sapiens
cacaactcactccttttaa

SEQ ID NO: 2499110 - DNA, 22 bp, Homo sapiens
cacaactcactccttttaaaga

SEQ ID NO: 2499111 - DNA, 23 bp, Homo sapiens
cacaactcactccttttaaagaa

SEQ ID NO: 2499112 - DNA, 12 bp, Homo sapiens
cacaacttgttt

SEQ ID NO: 2499113 - DNA, 14 bp, Homo sapiens
cacaagaatggatc

SEQ ID NO: 2499114 - DNA, 11 bp, Homo sapiens
cacaagactga

SEQ ID NO: 2499115 - DNA, 20 bp, Homo sapiens
cacaagactgacgccagggt

SEQ ID NO: 2499116 - DNA, 22 bp, Homo sapiens
cacaagatggaatttatcaaac

SEQ ID NO: 2499117 - DNA, 15 bp, Homo sapiens
cacaagattggtgtt

SEQ ID NO: 2499118 - DNA, 15 bp, Homo sapiens
cacaagcctgaggga

SEQ ID NO: 2499119 - DNA, 19 bp, Homo sapiens
cacaagcttctgtcctgcc

SEQ ID NO: 2499120 - DNA, 21 bp, Homo sapiens
cacaaggatagatgctggccc

SEQ ID NO: 2499121 - DNA, 17 bp, Homo sapiens
cacaataactcctccca

SEQ ID NO: 2499122 - DNA, 15 bp, Homo sapiens
cacaatagaattata

SEQ ID NO: 2499123 - DNA, 18 bp, Homo sapiens
cacacaagaagaagggca

SEQ ID NO: 2499124 - DNA, 19 bp, Homo sapiens
cacacacaaaagggaaccc

SEQ ID NO: 2499125 - DNA, 11 bp, Homo sapiens
cacacacctgt

SEQ ID NO: 2499126 - DNA, 13 bp, Homo sapiens
cacacacctgtag

SEQ ID NO: 2499127 - DNA, 14 bp, Homo sapiens
cacacactgatgct

SEQ ID NO: 2499128 - DNA, 17 bp, Homo sapiens
cacacaggcatttcctg

SEQ ID NO: 2499129 - DNA, 18 bp, Homo sapiens
cacacaggcatttcctgg

SEQ ID NO: 2499130 - DNA, 12 bp, Homo sapiens
cacacagggcag

SEQ ID NO: 2499131 - DNA, 14 bp, Homo sapiens
cacacagtattttt

SEQ ID NO: 2499132 - DNA, 20 bp, Homo sapiens
cacacatacgtgcacagggt

SEQ ID NO: 2499133 - DNA, 18 bp, Homo sapiens
cacaccagggccagcctc

SEQ ID NO: 2499134 - DNA, 20 bp, Homo sapiens
cacaccagggccagcctcta

SEQ ID NO: 2499135 - DNA, 12 bp, Homo sapiens
cacaccccactc

SEQ ID NO: 2499136 - DNA, 18 bp, Homo sapiens
cacactaccgaatgtgtc

SEQ ID NO: 2499137 - DNA, 22 bp, Homo sapiens
cacactaccgaatgtgtcttta

SEQ ID NO: 2499138 - DNA, 13 bp, Homo sapiens
cacacttcaaact

SEQ ID NO: 2499139 - DNA, 10 bp, Homo sapiens
cacacttgtc

SEQ ID NO: 2499140 - DNA, 17 bp, Homo sapiens
cacagaaaataaggcac

SEQ ID NO: 2499141 - DNA, 10 bp, Homo sapiens
cacagagagt

SEQ ID NO: 2499142 - DNA, 19 bp, Homo sapiens
cacagataactgaaaatta

SEQ ID NO: 2499143 - DNA, 14 bp, Homo sapiens
cacagcaaccccag

SEQ ID NO: 2499144 - DNA, 18 bp, Homo sapiens
cacagcaaccccaggctg

SEQ ID NO: 2499145 - DNA, 16 bp, Homo sapiens
cacagcacaaattagt

SEQ ID NO: 2499146 - DNA, 15 bp, Homo sapiens
cacagcacagccaac

SEQ ID NO: 2499147 - DNA, 16 bp, Homo sapiens
cacagcatggaggagg

SEQ ID NO: 2499148 - DNA, 17 bp, Homo sapiens
cacagcatggaggagga

SEQ ID NO: 2499149 - DNA, 17 bp, Homo sapiens
cacagcctcccctgcca

SEQ ID NO: 2499150 - DNA, 23 bp, Homo sapiens
cacagcctcccctgccagggcag

SEQ ID NO: 2499151 - DNA, 15 bp, Homo sapiens
cacagctcctcccac

SEQ ID NO: 2499152 - DNA, 21 bp, Homo sapiens
cacagctgccggtcgcccttt

SEQ ID NO: 2499153 - DNA, 19 bp, Homo sapiens
cacagcttagatttcatag

SEQ ID NO: 2499154 - DNA, 22 bp, Homo sapiens
cacttggggcaccttgctcctc

SEQ ID NO: 2499155 - DNA, 20 bp, Homo sapiens
cacttgggggttcaggcccg

SEQ ID NO: 2499156 - DNA, 19 bp, Homo sapiens
cactttaaaatatctacat

SEQ ID NO: 2499157 - DNA, 13 bp, Homo sapiens
cactttcagctgt

SEQ ID NO: 2499158 - DNA, 16 bp, Homo sapiens
cactttcagctgtctt

SEQ ID NO: 2499159 - DNA, 17 bp, Homo sapiens
cactttcagctgtcttt

SEQ ID NO: 2499160 - DNA, 12 bp, Homo sapiens
cactttgcttta

SEQ ID NO: 2499161 - DNA, 14 bp, Homo sapiens
cacttttcccactc

SEQ ID NO: 2499162 - DNA, 18 bp, Homo sapiens
cacttttgacaaaggcaa

SEQ ID NO: 2499163 - DNA, 14 bp, Homo sapiens
cactttttgaggca

SEQ ID NO: 2499164 - DNA, 18 bp, Homo sapiens
cagaaaaatatgtaccaa

SEQ ID NO: 2499165 - DNA, 15 bp, Homo sapiens
cagaaaacaaaactg

SEQ ID NO: 2499166 - DNA, 16 bp, Homo sapiens
cagaaaacatgtttcc

SEQ ID NO: 2499167 - DNA, 22 bp, Homo sapiens
cagaaaacccttgggccagaag

SEQ ID NO: 2499168 - DNA, 12 bp, Homo sapiens
cagaaaataagg

SEQ ID NO: 2499169 - DNA, 21 bp, Homo sapiens
cagaaaataaggcacccatct

SEQ ID NO: 2499170 - DNA, 19 bp, Homo sapiens
cagaaaatgaacacagcag

SEQ ID NO: 2499171 - DNA, 23 bp, Homo sapiens
cagaaagcagttgagacaagaaa

SEQ ID NO: 2499172 - DNA, 22 bp, Homo sapiens
cagaaagccccacccaggccag

SEQ ID NO: 2499173 - DNA, 17 bp, Homo sapiens
cagaaaggaaaaacaaa

SEQ ID NO: 2499174 - DNA, 20 bp, Homo sapiens
cagaaaggactcctcctttt

SEQ ID NO: 2499175 - DNA, 16 bp, Homo sapiens
cagaaagggagggctc

SEQ ID NO: 2499176 - DNA, 12 bp, Homo sapiens
cagaaagtgcct

SEQ ID NO: 2499177 - DNA, 16 bp, Homo sapiens
cagaaagtgcctgaca

SEQ ID NO: 2499178 - DNA, 23 bp, Homo sapiens
cagaaagtgcctgacacactaac

SEQ ID NO: 2499179 - DNA, 16 bp, Homo sapiens
cagaaagtgcctttca

SEQ ID NO: 2499180 - DNA, 19 bp, Homo sapiens
cagaaagtgcctttcagga

SEQ ID NO: 2499181 - DNA, 20 bp, Homo sapiens
cagaaattcaatttggattt

SEQ ID NO: 2499182 - DNA, 15 bp, Homo sapiens
cagaaattgtatatt

SEQ ID NO: 2499183 - DNA, 21 bp, Homo sapiens
cagaaattgtatattgtaatt

SEQ ID NO: 2499184 - DNA, 22 bp, Homo sapiens
cagaaattgtatattgtaattt

SEQ ID NO: 2499185 - DNA, 16 bp, Homo sapiens
cagaacatagacagaa

SEQ ID NO: 2499186 - DNA, 13 bp, Homo sapiens
cagaactagaatt

SEQ ID NO: 2499187 - DNA, 20 bp, Homo sapiens
cagaactcaaatggggccag

SEQ ID NO: 2499188 - DNA, 20 bp, Homo sapiens
cagaacttcagaaagacttg

SEQ ID NO: 2499189 - DNA, 21 bp, Homo sapiens
cagaacttgaccctgagctga

SEQ ID NO: 2499190 - DNA, 19 bp, Homo sapiens
cagaacttgtgccctccct

SEQ ID NO: 2499191 - DNA, 14 bp, Homo sapiens
cagaagaaacaagg

SEQ ID NO: 2499192 - DNA, 14 bp, Homo sapiens
cagaagatgactga

SEQ ID NO: 2499193 - DNA, 12 bp, Homo sapiens
cagaagcctggg

SEQ ID NO: 2499194 - DNA, 20 bp, Homo sapiens
cagaagcctgggggcctggc

SEQ ID NO: 2499195 - DNA, 15 bp, Homo sapiens
cagaagctcccccag

SEQ ID NO: 2499196 - DNA, 13 bp, Homo sapiens
cagaagggagggc

SEQ ID NO: 2499197 - DNA, 15 bp, Homo sapiens
cagaagggagggcag

SEQ ID NO: 2499198 - DNA, 19 bp, Homo sapiens
cagaagggagggcagagct

SEQ ID NO: 2499199 - DNA, 21 bp, Homo sapiens
cagaagggagggcagagctgg

SEQ ID NO: 2499200 - DNA, 15 bp, Homo sapiens
cagaagggggtctct

SEQ ID NO: 2499201 - DNA, 14 bp, Homo sapiens
cagaagtcatcttg

SEQ ID NO: 2499202 - DNA, 16 bp, Homo sapiens
cagaagtcatcttgct

SEQ ID NO: 2499203 - DNA, 12 bp, Homo sapiens
cagaagtgcatc

SEQ ID NO: 2499204 - DNA, 13 bp, Homo sapiens
cagaagtgtgact

SEQ ID NO: 2499205 - DNA, 18 bp, Homo sapiens
cagaataagttattgcag

SEQ ID NO: 2499206 - DNA, 14 bp, Homo sapiens
cagaatagtatttt

SEQ ID NO: 2499207 - DNA, 17 bp, Homo sapiens
cagaatatcacagaaaa

SEQ ID NO: 2499208 - DNA, 18 bp, Homo sapiens
cagaatcccttaacagtt

SEQ ID NO: 2499209 - DNA, 18 bp, Homo sapiens
cagaatgctgtacatcta

SEQ ID NO: 2499210 - DNA, 21 bp, Homo sapiens
cagaatgctgtacatctattt

SEQ ID NO: 2499211 - DNA, 22 bp, Homo sapiens
cagaatgttgattacagtgcag

SEQ ID NO: 2499212 - DNA, 17 bp, Homo sapiens
cagaattaaacttttaa

SEQ ID NO: 2499213 - DNA, 23 bp, Homo sapiens
cagaattactgtaactgattaca

SEQ ID NO: 2499214 - DNA, 20 bp, Homo sapiens
cagaattttatactttccct

SEQ ID NO: 2499215 - DNA, 21 bp, Homo sapiens
cagaattttatactttcccta

SEQ ID NO: 2499216 - DNA, 22 bp, Homo sapiens
cagaattttatactttccctac

SEQ ID NO: 2499217 - DNA, 14 bp, Homo sapiens
cagacacccaggac

SEQ ID NO: 2499218 - DNA, 13 bp, Homo sapiens
cagacagagccag

SEQ ID NO: 2499219 - DNA, 15 bp, Homo sapiens
cagacagagccagga

SEQ ID NO: 2499220 - DNA, 17 bp, Homo sapiens
cagacagagccaggaga

SEQ ID NO: 2499221 - DNA, 20 bp, Homo sapiens
cagacagagccaggagaagc

SEQ ID NO: 2499222 - DNA, 18 bp, Homo sapiens
cagacagatgaggctttc

SEQ ID NO: 2499223 - DNA, 15 bp, Homo sapiens
cagacataaaggaaa

SEQ ID NO: 2499224 - DNA, 22 bp, Homo sapiens
cagacataaaggaaaagacaca

SEQ ID NO: 2499225 - DNA, 17 bp, Homo sapiens
cagacatccaaactaaa

SEQ ID NO: 2499226 - DNA, 14 bp, Homo sapiens
cagacattggcacc

SEQ ID NO: 2499227 - DNA, 19 bp, Homo sapiens
cagaccaccccgcctgccc

SEQ ID NO: 2499228 - DNA, 23 bp, Homo sapiens
cagaccacgcccgtcctgcctgt

SEQ ID NO: 2499229 - DNA, 13 bp, Homo sapiens
cagaccacggctc

SEQ ID NO: 2499230 - DNA, 15 bp, Homo sapiens
cagaccctgcccttg

SEQ ID NO: 2499231 - DNA, 13 bp, Homo sapiens
cagaccctggagg

SEQ ID NO: 2499232 - DNA, 14 bp, Homo sapiens
cagaccctggaggc

SEQ ID NO: 2499233 - DNA, 19 bp, Homo sapiens
cagaccctggaggccccaa

SEQ ID NO: 2499234 - DNA, 17 bp, Homo sapiens
cagacctgatcctggag

SEQ ID NO: 2499235 - DNA, 14 bp, Homo sapiens
cagacgcctggctg

SEQ ID NO: 2499236 - DNA, 15 bp, Homo sapiens
cagacgcctggctgc

SEQ ID NO: 2499237 - DNA, 23 bp, Homo sapiens
cagacgcctggctgctgatcgcc

SEQ ID NO: 2499238 - DNA, 17 bp, Homo sapiens
cagacgctgctgtcaca

SEQ ID NO: 2499239 - DNA, 19 bp, Homo sapiens
cagacggaagggtaaacaa

SEQ ID NO: 2499240 - DNA, 20 bp, Homo sapiens
cagacggaagggtaaacaat

SEQ ID NO: 2499241 - DNA, 22 bp, Homo sapiens
cagactaagccagcaccggacc

SEQ ID NO: 2499242 - DNA, 21 bp, Homo sapiens
cagactacagctggggtgcag

SEQ ID NO: 2499243 - DNA, 23 bp, Homo sapiens
cagactagatggacctgcctgca

SEQ ID NO: 2499244 - DNA, 21 bp, Homo sapiens
cagactagatgtagtattttt

SEQ ID NO: 2499245 - DNA, 18 bp, Homo sapiens
cagactcccattcctgaa

SEQ ID NO: 2499246 - DNA, 14 bp, Homo sapiens
cagactctaagaaa

SEQ ID NO: 2499247 - DNA, 15 bp, Homo sapiens
cagacttcccagcta

SEQ ID NO: 2499248 - DNA, 11 bp, Homo sapiens
cagacttgttg

SEQ ID NO: 2499249 - DNA, 17 bp, Homo sapiens
cagagaaaccagcttcc

SEQ ID NO: 2499250 - DNA, 18 bp, Homo sapiens
cagagaaaccagcttcct

SEQ ID NO: 2499251 - DNA, 19 bp, Homo sapiens
cagagaaaccagcttcctt

SEQ ID NO: 2499252 - DNA, 11 bp, Homo sapiens
cagagaagcca

SEQ ID NO: 2499253 - DNA, 12 bp, Homo sapiens
cagagaagccag

SEQ ID NO: 2499254 - DNA, 14 bp, Homo sapiens
cagagaagccagct

SEQ ID NO: 2499255 - DNA, 15 bp, Homo sapiens
cagagaagccagctt

SEQ ID NO: 2499256 - DNA, 16 bp, Homo sapiens
cagagaagccagcttg

SEQ ID NO: 2499257 - DNA, 17 bp, Homo sapiens
cagagaagccagcttgt

SEQ ID NO: 2499258 - DNA, 20 bp, Homo sapiens
cagcttctgccccctgcaga

SEQ ID NO: 2499259 - DNA, 20 bp, Homo sapiens
cagcttgacctgaggctgtg

SEQ ID NO: 2499260 - DNA, 16 bp, Homo sapiens
cagcttgtagccagcc

SEQ ID NO: 2499261 - DNA, 17 bp, Homo sapiens
cagcttgtagccagccg

SEQ ID NO: 2499262 - DNA, 18 bp, Homo sapiens
cagcttgtagccagccgg

SEQ ID NO: 2499263 - DNA, 19 bp, Homo sapiens
cagcttgtctcttgcctgc

SEQ ID NO: 2499264 - DNA, 20 bp, Homo sapiens
cagcttgtctcttgcctgcc

SEQ ID NO: 2499265 - DNA, 13 bp, Homo sapiens
cagcttgtttaca

SEQ ID NO: 2499266 - DNA, 18 bp, Homo sapiens
cagctttagaatcccagc

SEQ ID NO: 2499267 - DNA, 17 bp, Homo sapiens
caggaaaaggcctgggg

SEQ ID NO: 2499268 - DNA, 17 bp, Homo sapiens
caggaaaattgaatgca

SEQ ID NO: 2499269 - DNA, 19 bp, Homo sapiens
caggaaactcctgtgacca

SEQ ID NO: 2499270 - DNA, 21 bp, Homo sapiens
caggaaactcctgtgaccaca

SEQ ID NO: 2499271 - DNA, 16 bp, Homo sapiens
caggaagcccaattgc

SEQ ID NO: 2499272 - DNA, 18 bp, Homo sapiens
caggaagccgtcctggcg

SEQ ID NO: 2499273 - DNA, 21 bp, Homo sapiens
caggaagctttggtgagaacc

SEQ ID NO: 2499274 - DNA, 22 bp, Homo sapiens
caggaagctttggtgagaacct

SEQ ID NO: 2499275 - DNA, 23 bp, Homo sapiens
caggaagctttggtgagaacctg

SEQ ID NO: 2499276 - DNA, 13 bp, Homo sapiens
caggaaggagctg

SEQ ID NO: 2499277 - DNA, 15 bp, Homo sapiens
caggaaggagctgcc

SEQ ID NO: 2499278 - DNA, 17 bp, Homo sapiens
caggaaggagctgcctg

SEQ ID NO: 2499279 - DNA, 19 bp, Homo sapiens
caggaaggagctgcctgga

SEQ ID NO: 2499280 - DNA, 22 bp, Homo sapiens
caggaaggagctgcctggaccc

SEQ ID NO: 2499281 - DNA, 22 bp, Homo sapiens
caggaaggcttgttgtgctttt

SEQ ID NO: 2499282 - DNA, 17 bp, Homo sapiens
caggaatattttccaaa

SEQ ID NO: 2499283 - DNA, 21 bp, Homo sapiens
caggaatcagtttaaaagcac

SEQ ID NO: 2499284 - DNA, 14 bp, Homo sapiens
caggaatcttaagg

SEQ ID NO: 2499285 - DNA, 18 bp, Homo sapiens
caggaatttcccaggacc

SEQ ID NO: 2499286 - DNA, 21 bp, Homo sapiens
caggaatttcccaggaccctg

SEQ ID NO: 2499287 - DNA, 14 bp, Homo sapiens
caggacacaggcct

SEQ ID NO: 2499288 - DNA, 15 bp, Homo sapiens
caggacacaggcctg

SEQ ID NO: 2499289 - DNA, 14 bp, Homo sapiens
caggacagatgcca

SEQ ID NO: 2499290 - DNA, 12 bp, Homo sapiens
caggacatttct

SEQ ID NO: 2499291 - DNA, 15 bp, Homo sapiens
caggaccacaggctc

SEQ ID NO: 2499292 - DNA, 18 bp, Homo sapiens
caggaccacaggctcagg

SEQ ID NO: 2499293 - DNA, 19 bp, Homo sapiens
caggaccacaggctcaggc

SEQ ID NO: 2499294 - DNA, 21 bp, Homo sapiens
caggaccacaggctcaggcag

SEQ ID NO: 2499295 - DNA, 15 bp, Homo sapiens
caggaccagctcagg

SEQ ID NO: 2499296 - DNA, 16 bp, Homo sapiens
caggaccagctcagga

SEQ ID NO: 2499297 - DNA, 17 bp, Homo sapiens
caggaccctgaaggggc

SEQ ID NO: 2499298 - DNA, 18 bp, Homo sapiens
caggaccctggacccagc

SEQ ID NO: 2499299 - DNA, 16 bp, Homo sapiens
caggacctggctgcca

SEQ ID NO: 2499300 - DNA, 17 bp, Homo sapiens
caggacctggctgccat

SEQ ID NO: 2499301 - DNA, 18 bp, Homo sapiens
caggacctggctgccata

SEQ ID NO: 2499302 - DNA, 19 bp, Homo sapiens
caggactaacactcagaag

SEQ ID NO: 2499303 - DNA, 13 bp, Homo sapiens
caggactctgcag

SEQ ID NO: 2499304 - DNA, 15 bp, Homo sapiens
caggactctgcagcc

SEQ ID NO: 2499305 - DNA, 17 bp, Homo sapiens
caggactctgcagcctc

SEQ ID NO: 2499306 - DNA, 21 bp, Homo sapiens
caggactctgcagcctcagag

SEQ ID NO: 2499307 - DNA, 23 bp, Homo sapiens
caggactgggagcccccagcctg

SEQ ID NO: 2499308 - DNA, 21 bp, Homo sapiens
caggagaagaaagaggtgacc

SEQ ID NO: 2499309 - DNA, 13 bp, Homo sapiens
caggagaagctca

SEQ ID NO: 2499310 - DNA, 14 bp, Homo sapiens
caggagaagctcag

SEQ ID NO: 2499311 - DNA, 18 bp, Homo sapiens
caggagctacctgtgtgg

SEQ ID NO: 2499312 - DNA, 22 bp, Homo sapiens
caggagctcccctccccaactg

SEQ ID NO: 2499313 - DNA, 16 bp, Homo sapiens
caggaggaatactgaa

SEQ ID NO: 2499314 - DNA, 16 bp, Homo sapiens
caggagggacaaagga

SEQ ID NO: 2499315 - DNA, 19 bp, Homo sapiens
caggagggacaaaggagcc

SEQ ID NO: 2499316 - DNA, 23 bp, Homo sapiens
caggagggacaaaggagcctgtg

SEQ ID NO: 2499317 - DNA, 21 bp, Homo sapiens
caggagggcggcctccttctg

SEQ ID NO: 2499318 - DNA, 19 bp, Homo sapiens
caggagggggtcgtggaga

SEQ ID NO: 2499319 - DNA, 17 bp, Homo sapiens
caggaggtgccactgga

SEQ ID NO: 2499320 - DNA, 18 bp, Homo sapiens
caggagtccactttgttt

SEQ ID NO: 2499321 - DNA, 17 bp, Homo sapiens
caggagtgggtggggag

SEQ ID NO: 2499322 - DNA, 18 bp, Homo sapiens
caggagtgggtggggagt

SEQ ID NO: 2499323 - DNA, 13 bp, Homo sapiens
caggagtgtgtgt

SEQ ID NO: 2499324 - DNA, 19 bp, Homo sapiens
caggatagagactggaaca

SEQ ID NO: 2499325 - DNA, 12 bp, Homo sapiens
caggatctattt

SEQ ID NO: 2499326 - DNA, 18 bp, Homo sapiens
caggatctatttttggag

SEQ ID NO: 2499327 - DNA, 20 bp, Homo sapiens
caggatctatttttggaggt

SEQ ID NO: 2499328 - DNA, 17 bp, Homo sapiens
caggatctcaccaggca

SEQ ID NO: 2499329 - DNA, 18 bp, Homo sapiens
caggatgagggaaaagaa

SEQ ID NO: 2499330 - DNA, 23 bp, Homo sapiens
caggatggggtatggattctaaa

SEQ ID NO: 2499331 - DNA, 16 bp, Homo sapiens
caggattgcgagagat

SEQ ID NO: 2499332 - DNA, 22 bp, Homo sapiens
caggattgcgagagatgtgtgt

SEQ ID NO: 2499333 - DNA, 23 bp, Homo sapiens
caggattgcgagagatgtgtgtt

SEQ ID NO: 2499334 - DNA, 24 bp, Homo sapiens
caggattggggaagagagcctgca

SEQ ID NO: 2499335 - DNA, 14 bp, Homo sapiens
caggcacacagcta

SEQ ID NO: 2499336 - DNA, 22 bp, Homo sapiens
caggcactgagataccagcgag

SEQ ID NO: 2499337 - DNA, 13 bp, Homo sapiens
caggcactgccct

SEQ ID NO: 2499338 - DNA, 22 bp, Homo sapiens
caggcactgccctggtggccct

SEQ ID NO: 2499339 - DNA, 15 bp, Homo sapiens
caggcactgctaggc

SEQ ID NO: 2499340 - DNA, 20 bp, Homo sapiens
caggcacttggcagccttgt

SEQ ID NO: 2499341 - DNA, 14 bp, Homo sapiens
caggcagaggccca

SEQ ID NO: 2499342 - DNA, 17 bp, Homo sapiens
caggcagaggcccaggc

SEQ ID NO: 2499343 - DNA, 14 bp, Homo sapiens
caggcagatccagg

SEQ ID NO: 2499344 - DNA, 21 bp, Homo sapiens
caggcagccagcatctgggcc

SEQ ID NO: 2499345 - DNA, 14 bp, Homo sapiens
caggcagcctctgg

SEQ ID NO: 2499346 - DNA, 15 bp, Homo sapiens
caggcagcctctggg

SEQ ID NO: 2499347 - DNA, 16 bp, Homo sapiens
caggcaggctcccagg

SEQ ID NO: 2499348 - DNA, 17 bp, Homo sapiens
caggcagggctctcctg

SEQ ID NO: 2499349 - DNA, 15 bp, Homo sapiens
caggcagggtgcagt

SEQ ID NO: 2499350 - DNA, 15 bp, Homo sapiens
caggcattggatatt

SEQ ID NO: 2499351 - DNA, 15 bp, Homo sapiens
caggcatttcctggg

SEQ ID NO: 2499352 - DNA, 22 bp, Homo sapiens
caggccaaagagtctccagttt

SEQ ID NO: 2499353 - DNA, 21 bp, Homo sapiens
caggccacacttcaaactact

SEQ ID NO: 2499354 - DNA, 21 bp, Homo sapiens
caggccacctggctctcacct

SEQ ID NO: 2499355 - DNA, 22 bp, Homo sapiens
caggccacctggctctcacctc

SEQ ID NO: 2499356 - DNA, 19 bp, Homo sapiens
caggccaggactctgcagc

SEQ ID NO: 2499357 - DNA, 16 bp, Homo sapiens
caggcccaaggctccc

SEQ ID NO: 2499358 - DNA, 19 bp, Homo sapiens
caggcccactgtgcctcag

SEQ ID NO: 2499359 - DNA, 16 bp, Homo sapiens
caggcccagccgaccc

SEQ ID NO: 2499360 - DNA, 19 bp, Homo sapiens
caggcccagccgaccccct

SEQ ID NO: 2499361 - DNA, 14 bp, Homo sapiens
catcccacaccctg

SEQ ID NO: 2499362 - DNA, 23 bp, Homo sapiens
catcccagacaggtccctcccct

SEQ ID NO: 2499363 - DNA, 12 bp, Homo sapiens
catcccatgctg

SEQ ID NO: 2499364 - DNA, 19 bp, Homo sapiens
catccccttgaactcttca

SEQ ID NO: 2499365 - DNA, 22 bp, Homo sapiens
catccccttgaggtctcagccc

SEQ ID NO: 2499366 - DNA, 17 bp, Homo sapiens
catcccgtgttctcctt

SEQ ID NO: 2499367 - DNA, 22 bp, Homo sapiens
catccctggccccctccctgga

SEQ ID NO: 2499368 - DNA, 13 bp, Homo sapiens
catccctgggcct

SEQ ID NO: 2499369 - DNA, 17 bp, Homo sapiens
catccctgggcctgctg

SEQ ID NO: 2499370 - DNA, 21 bp, Homo sapiens
catccctgggcctgctgctga

SEQ ID NO: 2499371 - DNA, 13 bp, Homo sapiens
catcctcctccca

SEQ ID NO: 2499372 - DNA, 17 bp, Homo sapiens
catcctctggagccagc

SEQ ID NO: 2499373 - DNA, 19 bp, Homo sapiens
catcgcaccattctgactc

SEQ ID NO: 2499374 - DNA, 19 bp, Homo sapiens
catcggacaagacccccag

SEQ ID NO: 2499375 - DNA, 21 bp, Homo sapiens
catcggacaagacccccagca

SEQ ID NO: 2499376 - DNA, 19 bp, Homo sapiens
catctacctagatttaata

SEQ ID NO: 2499377 - DNA, 20 bp, Homo sapiens
catctacctagatttaatat

SEQ ID NO: 2499378 - DNA, 12 bp, Homo sapiens
catctaggattt

SEQ ID NO: 2499379 - DNA, 14 bp, Homo sapiens
catctattttggat

SEQ ID NO: 2499380 - DNA, 16 bp, Homo sapiens
catctattttggattg

SEQ ID NO: 2499381 - DNA, 21 bp, Homo sapiens
catctcaaaacagagggctgc

SEQ ID NO: 2499382 - DNA, 19 bp, Homo sapiens
catctcaacaggcctcagg

SEQ ID NO: 2499383 - DNA, 21 bp, Homo sapiens
catctcaacaggcctcagggc

SEQ ID NO: 2499384 - DNA, 14 bp, Homo sapiens
catctcaggccaga

SEQ ID NO: 2499385 - DNA, 17 bp, Homo sapiens
catctcagtatgaatta

SEQ ID NO: 2499386 - DNA, 21 bp, Homo sapiens
catctcagtgaagaatacttc

SEQ ID NO: 2499387 - DNA, 21 bp, Homo sapiens
catctcccacctagcagcacc

SEQ ID NO: 2499388 - DNA, 15 bp, Homo sapiens
catctccctggtgct

SEQ ID NO: 2499389 - DNA, 16 bp, Homo sapiens
catctccctggtgctt

SEQ ID NO: 2499390 - DNA, 22 bp, Homo sapiens
catctcctgccttcctcctggg

SEQ ID NO: 2499391 - DNA, 19 bp, Homo sapiens
catctctaccttctcccca

SEQ ID NO: 2499392 - DNA, 20 bp, Homo sapiens
catctctaccttctccccag

SEQ ID NO: 2499393 - DNA, 16 bp, Homo sapiens
catctctccctcccct

SEQ ID NO: 2499394 - DNA, 15 bp, Homo sapiens
catctctctgcccaa

SEQ ID NO: 2499395 - DNA, 15 bp, Homo sapiens
catctgaggttttat

SEQ ID NO: 2499396 - DNA, 21 bp, Homo sapiens
catctgaggttttatttcatt

SEQ ID NO: 2499397 - DNA, 21 bp, Homo sapiens
catctgagtcctggatgatac

SEQ ID NO: 2499398 - DNA, 16 bp, Homo sapiens
catctgcgtgacaata

SEQ ID NO: 2499399 - DNA, 10 bp, Homo sapiens
catctgctcc

SEQ ID NO: 2499400 - DNA, 11 bp, Homo sapiens
catctgctcct

SEQ ID NO: 2499401 - DNA, 14 bp, Homo sapiens
catctgctcctgga

SEQ ID NO: 2499402 - DNA, 19 bp, Homo sapiens
catctgctggtccgtggga

SEQ ID NO: 2499403 - DNA, 17 bp, Homo sapiens
catctggagagaacagg

SEQ ID NO: 2499404 - DNA, 18 bp, Homo sapiens
catctggctctaattcac

SEQ ID NO: 2499405 - DNA, 20 bp, Homo sapiens
catctgggctcctccagggt

SEQ ID NO: 2499406 - DNA, 20 bp, Homo sapiens
catctggtagaagggaaagc

SEQ ID NO: 2499407 - DNA, 19 bp, Homo sapiens
catctgtataccctctgtt

SEQ ID NO: 2499408 - DNA, 20 bp, Homo sapiens
catctgtataccctctgttt

SEQ ID NO: 2499409 - DNA, 16 bp, Homo sapiens
catctgtccctccggg

SEQ ID NO: 2499410 - DNA, 20 bp, Homo sapiens
catctgtccctccgggacct

SEQ ID NO: 2499411 - DNA, 18 bp, Homo sapiens
catctgtgcactgcccat

SEQ ID NO: 2499412 - DNA, 14 bp, Homo sapiens
catctgtgtcttgt

SEQ ID NO: 2499413 - DNA, 13 bp, Homo sapiens
catcttctgcctt

SEQ ID NO: 2499414 - DNA, 14 bp, Homo sapiens
catcttgctaccag

SEQ ID NO: 2499415 - DNA, 17 bp, Homo sapiens
catcttgctaccagtat

SEQ ID NO: 2499416 - DNA, 20 bp, Homo sapiens
catcttgctaccagtattta

SEQ ID NO: 2499417 - DNA, 13 bp, Homo sapiens
catcttgcttccc

SEQ ID NO: 2499418 - DNA, 11 bp, Homo sapiens
catctttgaaa

SEQ ID NO: 2499419 - DNA, 21 bp, Homo sapiens
catctttgaaattatgtaaat

SEQ ID NO: 2499420 - DNA, 13 bp, Homo sapiens
catcttttacatt

SEQ ID NO: 2499421 - DNA, 22 bp, Homo sapiens
catgaaaaatcatgggccagag

SEQ ID NO: 2499422 - DNA, 20 bp, Homo sapiens
catgaacttagattttacat

SEQ ID NO: 2499423 - DNA, 16 bp, Homo sapiens
catgaaggtaaataaa

SEQ ID NO: 2499424 - DNA, 14 bp, Homo sapiens
catgaagtattttt

SEQ ID NO: 2499425 - DNA, 19 bp, Homo sapiens
catgaatgtaaatttgtac

SEQ ID NO: 2499426 - DNA, 22 bp, Homo sapiens
catgaatgtaaatttgtactat

SEQ ID NO: 2499427 - DNA, 20 bp, Homo sapiens
catgaattattacagtgttt

SEQ ID NO: 2499428 - DNA, 12 bp, Homo sapiens
catgaatttgta

SEQ ID NO: 2499429 - DNA, 19 bp, Homo sapiens
catgaatttgtaatgtctt

SEQ ID NO: 2499430 - DNA, 22 bp, Homo sapiens
catgaatttgtaatgtcttgag

SEQ ID NO: 2499431 - DNA, 13 bp, Homo sapiens
catgacagcctcc

SEQ ID NO: 2499432 - DNA, 14 bp, Homo sapiens
catgacctccagct

SEQ ID NO: 2499433 - DNA, 20 bp, Homo sapiens
catgacctccagctttcctg

SEQ ID NO: 2499434 - DNA, 21 bp, Homo sapiens
catgacctccagctttcctgt

SEQ ID NO: 2499435 - DNA, 22 bp, Homo sapiens
catgacctccagctttcctgta

SEQ ID NO: 2499436 - DNA, 14 bp, Homo sapiens
catgactatggata

SEQ ID NO: 2499437 - DNA, 21 bp, Homo sapiens
catgaggactctattctttaa

SEQ ID NO: 2499438 - DNA, 18 bp, Homo sapiens
catgaggggttcctcccc

SEQ ID NO: 2499439 - DNA, 22 bp, Homo sapiens
catgaggggttcctcccctcca

SEQ ID NO: 2499440 - DNA, 18 bp, Homo sapiens
catgagttccagaaagta

SEQ ID NO: 2499441 - DNA, 21 bp, Homo sapiens
catgagttggggtctggcagc

SEQ ID NO: 2499442 - DNA, 18 bp, Homo sapiens
catgataatgaacagaac

SEQ ID NO: 2499443 - DNA, 20 bp, Homo sapiens
catgataccacctttactgt

SEQ ID NO: 2499444 - DNA, 22 bp, Homo sapiens
catgatccctgtgttgtctcta

SEQ ID NO: 2499445 - DNA, 23 bp, Homo sapiens
catgatgcctctgtcttctggac

SEQ ID NO: 2499446 - DNA, 15 bp, Homo sapiens
catgatggcaacaga

SEQ ID NO: 2499447 - DNA, 12 bp, Homo sapiens
catgcaaactct

SEQ ID NO: 2499448 - DNA, 16 bp, Homo sapiens
catgcaatacatacca

SEQ ID NO: 2499449 - DNA, 19 bp, Homo sapiens
catgcacagtatttgtaat

SEQ ID NO: 2499450 - DNA, 20 bp, Homo sapiens
catgcacagtatttgtaatt

SEQ ID NO: 2499451 - DNA, 15 bp, Homo sapiens
catgcactgatgttg

SEQ ID NO: 2499452 - DNA, 20 bp, Homo sapiens
catgcactgatgttgtgttt

SEQ ID NO: 2499453 - DNA, 22 bp, Homo sapiens
catgcatctgtttattctatag

SEQ ID NO: 2499454 - DNA, 21 bp, Homo sapiens
catgccacaaggacttcctgt

SEQ ID NO: 2499455 - DNA, 21 bp, Homo sapiens
catgccaccatggccagccaa

SEQ ID NO: 2499456 - DNA, 18 bp, Homo sapiens
catgccaggctaattttt

SEQ ID NO: 2499457 - DNA, 16 bp, Homo sapiens
catgcccagagaccca

SEQ ID NO: 2499458 - DNA, 18 bp, Homo sapiens
catgccccatcccatgct

SEQ ID NO: 2499459 - DNA, 19 bp, Homo sapiens
catgccctgtgcaacctct

SEQ ID NO: 2499460 - DNA, 16 bp, Homo sapiens
catgcctctgaggcca

SEQ ID NO: 2499461 - DNA, 20 bp, Homo sapiens
catgcctctgaggccagcct

SEQ ID NO: 2499462 - DNA, 18 bp, Homo sapiens
catgcgatgacacttgta

SEQ ID NO: 2499463 - DNA, 21 bp, Homo sapiens
catgcgccccctccgccctgc

SEQ ID NO: 2499464 - DNA, 21 bp, Homo sapiens
ccaggaatttcccaggaccct

SEQ ID NO: 2499465 - DNA, 15 bp, Homo sapiens
ccaggacaagcatgg

SEQ ID NO: 2499466 - DNA, 23 bp, Homo sapiens
ccaggacaagcatggtcccacat

SEQ ID NO: 2499467 - DNA, 16 bp, Homo sapiens
ccaggaccacaggctc

SEQ ID NO: 2499468 - DNA, 14 bp, Homo sapiens
ccaggaccagctca

SEQ ID NO: 2499469 - DNA, 16 bp, Homo sapiens
ccaggaccagctcagg

SEQ ID NO: 2499470 - DNA, 18 bp, Homo sapiens
ccaggaccctgaaggggc

SEQ ID NO: 2499471 - DNA, 19 bp, Homo sapiens
ccaggaccctgaaggggcc

SEQ ID NO: 2499472 - DNA, 23 bp, Homo sapiens
ccaggaccctgaaggggccatga

SEQ ID NO: 2499473 - DNA, 18 bp, Homo sapiens
ccaggacctggctgccat

SEQ ID NO: 2499474 - DNA, 16 bp, Homo sapiens
ccaggactctgcagcc

SEQ ID NO: 2499475 - DNA, 17 bp, Homo sapiens
ccaggactctgcagcct

SEQ ID NO: 2499476 - DNA, 22 bp, Homo sapiens
ccaggactctgcagcctcagag

SEQ ID NO: 2499477 - DNA, 20 bp, Homo sapiens
ccaggagaagaaagaggtga

SEQ ID NO: 2499478 - DNA, 13 bp, Homo sapiens
ccaggagaagctc

SEQ ID NO: 2499479 - DNA, 17 bp, Homo sapiens
ccaggagaagctcagct

SEQ ID NO: 2499480 - DNA, 18 bp, Homo sapiens
ccaggagaagctcagctg

SEQ ID NO: 2499481 - DNA, 21 bp, Homo sapiens
ccaggagaagctcagctgcat

SEQ ID NO: 2499482 - DNA, 20 bp, Homo sapiens
ccaggagaaggccaattcct

SEQ ID NO: 2499483 - DNA, 17 bp, Homo sapiens
ccaggagcacggctctg

SEQ ID NO: 2499484 - DNA, 18 bp, Homo sapiens
ccaggagctccagtgtcc

SEQ ID NO: 2499485 - DNA, 21 bp, Homo sapiens
ccaggagctccagtgtcctga

SEQ ID NO: 2499486 - DNA, 18 bp, Homo sapiens
ccaggaggacccagggct

SEQ ID NO: 2499487 - DNA, 21 bp, Homo sapiens
ccaggaggtgccactggagtg

SEQ ID NO: 2499488 - DNA, 18 bp, Homo sapiens
ccaggatcgttttttccc

SEQ ID NO: 2499489 - DNA, 17 bp, Homo sapiens
ccaggcagatccaggac

SEQ ID NO: 2499490 - DNA, 16 bp, Homo sapiens
ccaggcagcctctggg

SEQ ID NO: 2499491 - DNA, 17 bp, Homo sapiens
ccaggcagcctctgggg

SEQ ID NO: 2499492 - DNA, 18 bp, Homo sapiens
ccaggcatgtggcagggg

SEQ ID NO: 2499493 - DNA, 23 bp, Homo sapiens
ccaggccaaaggggacctggaag

SEQ ID NO: 2499494 - DNA, 21 bp, Homo sapiens
ccaggccaggactctgcagcc

SEQ ID NO: 2499495 - DNA, 19 bp, Homo sapiens
ccaggcccaaggctcccgg

SEQ ID NO: 2499496 - DNA, 22 bp, Homo sapiens
ccaggcccactgtgcctcagag

SEQ ID NO: 2499497 - DNA, 17 bp, Homo sapiens
ccaggccccatgacctc

SEQ ID NO: 2499498 - DNA, 23 bp, Homo sapiens
ccaggccccatgacctccagctt

SEQ ID NO: 2499499 - DNA, 19 bp, Homo sapiens
ccaggcctgaaagaggctg

SEQ ID NO: 2499500 - DNA, 24 bp, Homo sapiens
ccaggctaatttttttgtatttta

SEQ ID NO: 2499501 - DNA, 16 bp, Homo sapiens
ccaggctcggcctgcc

SEQ ID NO: 2499502 - DNA, 16 bp, Homo sapiens
ccaggctgaccacagc

SEQ ID NO: 2499503 - DNA, 13 bp, Homo sapiens
ccaggctgcctcc

SEQ ID NO: 2499504 - DNA, 23 bp, Homo sapiens
ccaggctgcctcccttgtggcag

SEQ ID NO: 2499505 - DNA, 16 bp, Homo sapiens
ccaggctggtctaaaa

SEQ ID NO: 2499506 - DNA, 20 bp, Homo sapiens
ccaggctggtctaaaactcc

SEQ ID NO: 2499507 - DNA, 21 bp, Homo sapiens
ccaggctggtttcgaactcct

SEQ ID NO: 2499508 - DNA, 16 bp, Homo sapiens
ccaggcttctgctggg

SEQ ID NO: 2499509 - DNA, 18 bp, Homo sapiens
ccagggaagcagcagcct

SEQ ID NO: 2499510 - DNA, 23 bp, Homo sapiens
ccagggaagcagcagcctcgccc

SEQ ID NO: 2499511 - DNA, 23 bp, Homo sapiens
ccagggacagaggccccagcctc

SEQ ID NO: 2499512 - DNA, 21 bp, Homo sapiens
ccagggagagcccaggagctc

SEQ ID NO: 2499513 - DNA, 17 bp, Homo sapiens
ccagggaggctggtcct

SEQ ID NO: 2499514 - DNA, 14 bp, Homo sapiens
ccagggcacaggag

SEQ ID NO: 2499515 - DNA, 15 bp, Homo sapiens
ccagggcacaggagc

SEQ ID NO: 2499516 - DNA, 22 bp, Homo sapiens
ccagggcacaggagctacctgt

SEQ ID NO: 2499517 - DNA, 14 bp, Homo sapiens
ccagggcagccagg

SEQ ID NO: 2499518 - DNA, 19 bp, Homo sapiens
ccagggcagccagggagag

SEQ ID NO: 2499519 - DNA, 14 bp, Homo sapiens
ccagggcatctctg

SEQ ID NO: 2499520 - DNA, 15 bp, Homo sapiens
ccagggcatctctgg

SEQ ID NO: 2499521 - DNA, 16 bp, Homo sapiens
ccagggcatctctggg

SEQ ID NO: 2499522 - DNA, 17 bp, Homo sapiens
ccagggcatctctgggc

SEQ ID NO: 2499523 - DNA, 19 bp, Homo sapiens
ccagggcatctctgggctg

SEQ ID NO: 2499524 - DNA, 15 bp, Homo sapiens
ccagggccagcctct

SEQ ID NO: 2499525 - DNA, 15 bp, Homo sapiens
ccagggcccagagcc

SEQ ID NO: 2499526 - DNA, 18 bp, Homo sapiens
ccagggcccagagcccag

SEQ ID NO: 2499527 - DNA, 19 bp, Homo sapiens
ccagggcccagagcccagc

SEQ ID NO: 2499528 - DNA, 11 bp, Homo sapiens
ccagggcccct

SEQ ID NO: 2499529 - DNA, 22 bp, Homo sapiens
ccagggcccctctccccaggga

SEQ ID NO: 2499530 - DNA, 15 bp, Homo sapiens
ccagggcctgtctca

SEQ ID NO: 2499531 - DNA, 21 bp, Homo sapiens
ccagggctccagcccctcttg

SEQ ID NO: 2499532 - DNA, 13 bp, Homo sapiens
ccagggctcctgc

SEQ ID NO: 2499533 - DNA, 22 bp, Homo sapiens
ccagggctgtaactgccaggct

SEQ ID NO: 2499534 - DNA, 15 bp, Homo sapiens
ccaggggagcagagg

SEQ ID NO: 2499535 - DNA, 20 bp, Homo sapiens
ccaggggagcagaggggcag

SEQ ID NO: 2499536 - DNA, 16 bp, Homo sapiens
ccaggggctccctccg

SEQ ID NO: 2499537 - DNA, 20 bp, Homo sapiens
ccaggggctgcttcctcctg

SEQ ID NO: 2499538 - DNA, 23 bp, Homo sapiens
ccagggtcctgggaggagagaca

SEQ ID NO: 2499539 - DNA, 18 bp, Homo sapiens
ccagggttgaccccagag

SEQ ID NO: 2499540 - DNA, 20 bp, Homo sapiens
ccaggtaggggcccctctca

SEQ ID NO: 2499541 - DNA, 18 bp, Homo sapiens
ccaggtccaatgagcttt

SEQ ID NO: 2499542 - DNA, 14 bp, Homo sapiens
ccaggtccagctct

SEQ ID NO: 2499543 - DNA, 16 bp, Homo sapiens
ccaggtccagctctgg

SEQ ID NO: 2499544 - DNA, 19 bp, Homo sapiens
ccaggtccagctctggagg

SEQ ID NO: 2499545 - DNA, 15 bp, Homo sapiens
ccaggtccctctcat

SEQ ID NO: 2499546 - DNA, 21 bp, Homo sapiens
ccaggtcctggtggggcagct

SEQ ID NO: 2499547 - DNA, 21 bp, Homo sapiens
ccaggtctgggtggggcccag

SEQ ID NO: 2499548 - DNA, 23 bp, Homo sapiens
ccaggtgaacaaagtttaccaga

SEQ ID NO: 2499549 - DNA, 20 bp, Homo sapiens
ccaggtgaggtcagcacatc

SEQ ID NO: 2499550 - DNA, 23 bp, Homo sapiens
ccaggtgttaacattccaagact

SEQ ID NO: 2499551 - DNA, 15 bp, Homo sapiens
ccaggttccacagag

SEQ ID NO: 2499552 - DNA, 22 bp, Homo sapiens
ccaggttctccgttagctcctg

SEQ ID NO: 2499553 - DNA, 14 bp, Homo sapiens
ccagtaacaggctc

SEQ ID NO: 2499554 - DNA, 15 bp, Homo sapiens
ccagtaacaggctca

SEQ ID NO: 2499555 - DNA, 16 bp, Homo sapiens
ccagtaacaggctcaa

SEQ ID NO: 2499556 - DNA, 20 bp, Homo sapiens
ccagtaacgcgtcttcctga

SEQ ID NO: 2499557 - DNA, 22 bp, Homo sapiens
ccagtagaccttgttacttctg

SEQ ID NO: 2499558 - DNA, 13 bp, Homo sapiens
ccagtatcgctca

SEQ ID NO: 2499559 - DNA, 15 bp, Homo sapiens
ccagtcaggcccagg

SEQ ID NO: 2499560 - DNA, 13 bp, Homo sapiens
ccagtcccagagc

SEQ ID NO: 2499561 - DNA, 16 bp, Homo sapiens
ccagtcctatctgggc

SEQ ID NO: 2499562 - DNA, 17 bp, Homo sapiens
ccagtcctatctgggct

SEQ ID NO: 2499563 - DNA, 18 bp, Homo sapiens
ccagtcctatctgggctt

SEQ ID NO: 2499564 - DNA, 13 bp, Homo sapiens
ccagtcctgtcct

SEQ ID NO: 2499565 - DNA, 15 bp, Homo sapiens
ccagtgacagacagg

SEQ ID NO: 2499566 - DNA, 16 bp, Homo sapiens
ccagtgcccccactga

SEQ ID NO: 2499567 - DNA, 16 bp, Homo sapiens
ccttatcctccctgta

SEQ ID NO: 2499568 - DNA, 19 bp, Homo sapiens
ccttatcctccctgtaact

SEQ ID NO: 2499569 - DNA, 16 bp, Homo sapiens
ccttattagagtgtct

SEQ ID NO: 2499570 - DNA, 21 bp, Homo sapiens
ccttattagagtgtctttcca

SEQ ID NO: 2499571 - DNA, 14 bp, Homo sapiens
ccttcaacacagct

SEQ ID NO: 2499572 - DNA, 18 bp, Homo sapiens
ccttcaagaaaacaggca

SEQ ID NO: 2499573 - DNA, 15 bp, Homo sapiens
ccttcaagctctgag

SEQ ID NO: 2499574 - DNA, 18 bp, Homo sapiens
ccttcaagctctgaggga

SEQ ID NO: 2499575 - DNA, 13 bp, Homo sapiens
ccttcagagagca

SEQ ID NO: 2499576 - DNA, 15 bp, Homo sapiens
ccttcagagagcagt

SEQ ID NO: 2499577 - DNA, 20 bp, Homo sapiens
ccttcatacttgaacgtttt

SEQ ID NO: 2499578 - DNA, 18 bp, Homo sapiens
ccttcatatcatccacac

SEQ ID NO: 2499579 - DNA, 17 bp, Homo sapiens
ccttcatgacagcctcc

SEQ ID NO: 2499580 - DNA, 18 bp, Homo sapiens
ccttccaatgtctggaga

SEQ ID NO: 2499581 - DNA, 20 bp, Homo sapiens
ccttccaatgtctggagacc

SEQ ID NO: 2499582 - DNA, 14 bp, Homo sapiens
ccttccacccaggg

SEQ ID NO: 2499583 - DNA, 15 bp, Homo sapiens
ccttccagctcctgt

SEQ ID NO: 2499584 - DNA, 16 bp, Homo sapiens
ccttccagctcctgta

SEQ ID NO: 2499585 - DNA, 17 bp, Homo sapiens
ccttccagctcctgtaa

SEQ ID NO: 2499586 - DNA, 23 bp, Homo sapiens
ccttcccaagtgagtctctctgg

SEQ ID NO: 2499587 - DNA, 17 bp, Homo sapiens
ccttcccaatccagtgg

SEQ ID NO: 2499588 - DNA, 19 bp, Homo sapiens
ccttcccagaggggcctgc

SEQ ID NO: 2499589 - DNA, 15 bp, Homo sapiens
ccttcccatcgctgt

SEQ ID NO: 2499590 - DNA, 13 bp, Homo sapiens
ccttcccatggag

SEQ ID NO: 2499591 - DNA, 23 bp, Homo sapiens
ccttccctcaccttggcaccaga

SEQ ID NO: 2499592 - DNA, 24 bp, Homo sapiens
ccttccctcaccttggcaccagac

SEQ ID NO: 2499593 - DNA, 18 bp, Homo sapiens
ccttccctctctggagaa

SEQ ID NO: 2499594 - DNA, 16 bp, Homo sapiens
ccttccgcttggagct

SEQ ID NO: 2499595 - DNA, 23 bp, Homo sapiens
ccttcctaaattttcctgtcctc

SEQ ID NO: 2499596 - DNA, 20 bp, Homo sapiens
ccttcctcatccaccccatc

SEQ ID NO: 2499597 - DNA, 13 bp, Homo sapiens
ccttcctcctggg

SEQ ID NO: 2499598 - DNA, 13 bp, Homo sapiens
ccttcctggacag

SEQ ID NO: 2499599 - DNA, 16 bp, Homo sapiens
ccttcctggacagctg

SEQ ID NO: 2499600 - DNA, 17 bp, Homo sapiens
ccttcgcttcttgcctc

SEQ ID NO: 2499601 - DNA, 18 bp, Homo sapiens
ccttcgcttcttgcctct

SEQ ID NO: 2499602 - DNA, 21 bp, Homo sapiens
ccttcgcttcttgcctctgtg

SEQ ID NO: 2499603 - DNA, 17 bp, Homo sapiens
ccttcgtctttcccatg

SEQ ID NO: 2499604 - DNA, 14 bp, Homo sapiens
ccttctatttgggg

SEQ ID NO: 2499605 - DNA, 15 bp, Homo sapiens
ccttctatttggggc

SEQ ID NO: 2499606 - DNA, 16 bp, Homo sapiens
ccttctccatccacat

SEQ ID NO: 2499607 - DNA, 14 bp, Homo sapiens
ccttctcccactct

SEQ ID NO: 2499608 - DNA, 14 bp, Homo sapiens
ccttctccccagct

SEQ ID NO: 2499609 - DNA, 19 bp, Homo sapiens
ccttctccccagctcccag

SEQ ID NO: 2499610 - DNA, 15 bp, Homo sapiens
ccttctcccctgcac

SEQ ID NO: 2499611 - DNA, 24 bp, Homo sapiens
ccttctcccctgcactgtaaaatg

SEQ ID NO: 2499612 - DNA, 11 bp, Homo sapiens
ccttctgctgc

SEQ ID NO: 2499613 - DNA, 17 bp, Homo sapiens
ccttgaaaaaaaacagt

SEQ ID NO: 2499614 - DNA, 21 bp, Homo sapiens
ccttgaaaataagaatagaaa

SEQ ID NO: 2499615 - DNA, 21 bp, Homo sapiens
ccttgaagaactgcaggccct

SEQ ID NO: 2499616 - DNA, 22 bp, Homo sapiens
ccttgaagaactgcaggccctg

SEQ ID NO: 2499617 - DNA, 18 bp, Homo sapiens
ccttgaaggactaataga

SEQ ID NO: 2499618 - DNA, 12 bp, Homo sapiens
ccttgaatgtgg

SEQ ID NO: 2499619 - DNA, 15 bp, Homo sapiens
ccttgacaactggca

SEQ ID NO: 2499620 - DNA, 21 bp, Homo sapiens
ccttgatttatcacacaaagc

SEQ ID NO: 2499621 - DNA, 13 bp, Homo sapiens
ccttgccagagat

SEQ ID NO: 2499622 - DNA, 16 bp, Homo sapiens
ccttgcccccctggcc

SEQ ID NO: 2499623 - DNA, 12 bp, Homo sapiens
ccttgcctggta

SEQ ID NO: 2499624 - DNA, 14 bp, Homo sapiens
ccttgcctgtgcca

SEQ ID NO: 2499625 - DNA, 17 bp, Homo sapiens
ccttgcggctcctcagg

SEQ ID NO: 2499626 - DNA, 19 bp, Homo sapiens
ccttgcggctcctcaggga

SEQ ID NO: 2499627 - DNA, 21 bp, Homo sapiens
ccttgctcctccttctgctgc

SEQ ID NO: 2499628 - DNA, 12 bp, Homo sapiens
ccttgcttgtta

SEQ ID NO: 2499629 - DNA, 17 bp, Homo sapiens
ccttggacatcctcctc

SEQ ID NO: 2499630 - DNA, 20 bp, Homo sapiens
ccttggcaccagacacccag

SEQ ID NO: 2499631 - DNA, 15 bp, Homo sapiens
ccttggcctggagca

SEQ ID NO: 2499632 - DNA, 21 bp, Homo sapiens
ccttggcctggagcacaaaga

SEQ ID NO: 2499633 - DNA, 14 bp, Homo sapiens
ccttggcctgtgtt

SEQ ID NO: 2499634 - DNA, 22 bp, Homo sapiens
ccttgggccagaagtaccagac

SEQ ID NO: 2499635 - DNA, 23 bp, Homo sapiens
ccttgggcccacacctccttccc

SEQ ID NO: 2499636 - DNA, 22 bp, Homo sapiens
ccttgggggtcctcctccaggg

SEQ ID NO: 2499637 - DNA, 16 bp, Homo sapiens
ccttggttcccccact

SEQ ID NO: 2499638 - DNA, 22 bp, Homo sapiens
ccttggttcttgaggggaccag

SEQ ID NO: 2499639 - DNA, 19 bp, Homo sapiens
ccttgtaattctaaatgaa

SEQ ID NO: 2499640 - DNA, 21 bp, Homo sapiens
ccttgtcttattcccttcctg

SEQ ID NO: 2499641 - DNA, 20 bp, Homo sapiens
ccttgtgatgtgcacgtaaa

SEQ ID NO: 2499642 - DNA, 22 bp, Homo sapiens
ccttgtgcccagggttttgccc

SEQ ID NO: 2499643 - DNA, 21 bp, Homo sapiens
ccttgtgggcctgggctcctg

SEQ ID NO: 2499644 - DNA, 17 bp, Homo sapiens
ccttgtttggggcagga

SEQ ID NO: 2499645 - DNA, 21 bp, Homo sapiens
cctttaacaacatgtttccag

SEQ ID NO: 2499646 - DNA, 16 bp, Homo sapiens
cctttaacagaaactt

SEQ ID NO: 2499647 - DNA, 18 bp, Homo sapiens
cctttaattgtaaagtaa

SEQ ID NO: 2499648 - DNA, 17 bp, Homo sapiens
cctttagatctctgaag

SEQ ID NO: 2499649 - DNA, 14 bp, Homo sapiens
cctttcacaggcag

SEQ ID NO: 2499650 - DNA, 19 bp, Homo sapiens
cctttcaggatctattttt

SEQ ID NO: 2499651 - DNA, 23 bp, Homo sapiens
cctttccaccacagccagcacct

SEQ ID NO: 2499652 - DNA, 18 bp, Homo sapiens
cctttcccaccccaacct

SEQ ID NO: 2499653 - DNA, 22 bp, Homo sapiens
cctttcctggacactcagacct

SEQ ID NO: 2499654 - DNA, 17 bp, Homo sapiens
cctttcggatccaggga

SEQ ID NO: 2499655 - DNA, 22 bp, Homo sapiens
cctttctctctttatacagctg

SEQ ID NO: 2499656 - DNA, 21 bp, Homo sapiens
cctttgattaaagactccagt

SEQ ID NO: 2499657 - DNA, 14 bp, Homo sapiens
cctttgtgtgctct

SEQ ID NO: 2499658 - DNA, 18 bp, Homo sapiens
cctttgtgtgctctccat

SEQ ID NO: 2499659 - DNA, 18 bp, Homo sapiens
cctttgttccccactgga

SEQ ID NO: 2499660 - DNA, 21 bp, Homo sapiens
cctttgttccccactggagca

SEQ ID NO: 2499661 - DNA, 16 bp, Homo sapiens
ccttttatatcccatt

SEQ ID NO: 2499662 - DNA, 22 bp, Homo sapiens
ccttttcataggtctgaaattt

SEQ ID NO: 2499663 - DNA, 16 bp, Homo sapiens
ccttttcatgatttta

SEQ ID NO: 2499664 - DNA, 23 bp, Homo sapiens
ccttttcccaaaatgttgaaata

SEQ ID NO: 2499665 - DNA, 14 bp, Homo sapiens
ccttttctgttcta

SEQ ID NO: 2499666 - DNA, 21 bp, Homo sapiens
ccttttgaaattaacctctca

SEQ ID NO: 2499667 - DNA, 15 bp, Homo sapiens
ccttttgggtttctg

SEQ ID NO: 2499668 - DNA, 13 bp, Homo sapiens
cctttttcctctc

SEQ ID NO: 2499669 - DNA, 15 bp, Homo sapiens
cctttttcctctcca

SEQ ID NO: 2499670 - DNA, 16 bp, Homo sapiens
cgtggcctcttgagca

SEQ ID NO: 2499671 - DNA, 18 bp, Homo sapiens
cgtggctgctgtgggaaa

SEQ ID NO: 2499672 - DNA, 11 bp, Homo sapiens
cgtggggaggt

SEQ ID NO: 2499673 - DNA, 15 bp, Homo sapiens
cgtggggtgtgctgg

SEQ ID NO: 2499674 - DNA, 17 bp, Homo sapiens
cgtggggtgtgctggga

SEQ ID NO: 2499675 - DNA, 15 bp, Homo sapiens
cgtggtggtccctgg

SEQ ID NO: 2499676 - DNA, 18 bp, Homo sapiens
cgtgtaaatatgtacatt

SEQ ID NO: 2499677 - DNA, 13 bp, Homo sapiens
cgtgtccaccccc

SEQ ID NO: 2499678 - DNA, 22 bp, Homo sapiens
cgtgtgagaagtgaatgctggg

SEQ ID NO: 2499679 - DNA, 21 bp, Homo sapiens
cgttcatgggggagggggcag

SEQ ID NO: 2499680 - DNA, 14 bp, Homo sapiens
cgttctgctcatca

SEQ ID NO: 2499681 - DNA, 12 bp, Homo sapiens
cgttctgtgcac

SEQ ID NO: 2499682 - DNA, 18 bp, Homo sapiens
cgttcttgtaattttaca

SEQ ID NO: 2499683 - DNA, 16 bp, Homo sapiens
cgttggagaagcccgt

SEQ ID NO: 2499684 - DNA, 22 bp, Homo sapiens
cgtttcagcgactccgttggcc

SEQ ID NO: 2499685 - DNA, 18 bp, Homo sapiens
cgtttctccacctagact

SEQ ID NO: 2499686 - DNA, 11 bp, Homo sapiens
cgtttgtgttc

SEQ ID NO: 2499687 - DNA, 19 bp, Homo sapiens
cgtttgtgttctgttttgt

SEQ ID NO: 2499688 - DNA, 20 bp, Homo sapiens
cgtttgtgttctgttttgtt

SEQ ID NO: 2499689 - DNA, 12 bp, Homo sapiens
cgttttctaatt

SEQ ID NO: 2499690 - DNA, 17 bp, Homo sapiens
cgttttctaattgctta

SEQ ID NO: 2499691 - DNA, 15 bp, Homo sapiens
cgtttttttcattcc

SEQ ID NO: 2499692 - DNA, 20 bp, Homo sapiens
cgttttttttttgtttgttg

SEQ ID NO: 2499693 - DNA, 15 bp, Homo sapiens
ctaaaaaaaagatga

SEQ ID NO: 2499694 - DNA, 14 bp, Homo sapiens
ctaaaagaaacttt

SEQ ID NO: 2499695 - DNA, 19 bp, Homo sapiens
ctaaaagtgggcttgattc

SEQ ID NO: 2499696 - DNA, 23 bp, Homo sapiens
ctaaaagtgggcttgattctgca

SEQ ID NO: 2499697 - DNA, 17 bp, Homo sapiens
ctaaaataattttgtaa

SEQ ID NO: 2499698 - DNA, 12 bp, Homo sapiens
ctaaacatccat

SEQ ID NO: 2499699 - DNA, 15 bp, Homo sapiens
ctaaacggattccaa

SEQ ID NO: 2499700 - DNA, 16 bp, Homo sapiens
ctaaacggattccaaa

SEQ ID NO: 2499701 - DNA, 12 bp, Homo sapiens
ctaaactggaga

SEQ ID NO: 2499702 - DNA, 13 bp, Homo sapiens
ctaaactggagac

SEQ ID NO: 2499703 - DNA, 17 bp, Homo sapiens
ctaaactttttttctgt

SEQ ID NO: 2499704 - DNA, 20 bp, Homo sapiens
ctaaagaaaaacaaactcgt

SEQ ID NO: 2499705 - DNA, 21 bp, Homo sapiens
ctaaagatggagtttctaagg

SEQ ID NO: 2499706 - DNA, 23 bp, Homo sapiens
ctaaagatggagtttctaaggtc

SEQ ID NO: 2499707 - DNA, 12 bp, Homo sapiens
ctaaagattcta

SEQ ID NO: 2499708 - DNA, 14 bp, Homo sapiens
ctaaagattctata

SEQ ID NO: 2499709 - DNA, 20 bp, Homo sapiens
ctaaagattctatagttcta

SEQ ID NO: 2499710 - DNA, 18 bp, Homo sapiens
ctaaagccaaacatatat

SEQ ID NO: 2499711 - DNA, 16 bp, Homo sapiens
ctaaagcctcaaaaca

SEQ ID NO: 2499712 - DNA, 18 bp, Homo sapiens
ctaaagctggtttaatgt

SEQ ID NO: 2499713 - DNA, 14 bp, Homo sapiens
ctaaaggaaaaaac

SEQ ID NO: 2499714 - DNA, 20 bp, Homo sapiens
ctaaaggtccacaggtctag

SEQ ID NO: 2499715 - DNA, 21 bp, Homo sapiens
ctaaaggtccacaggtctaga

SEQ ID NO: 2499716 - DNA, 11 bp, Homo sapiens
ctaaagttcta

SEQ ID NO: 2499717 - DNA, 17 bp, Homo sapiens
ctaaagttctaagattc

SEQ ID NO: 2499718 - DNA, 21 bp, Homo sapiens
ctaaataaaatgctaggttct

SEQ ID NO: 2499719 - DNA, 15 bp, Homo sapiens
ctaaataaaatttgt

SEQ ID NO: 2499720 - DNA, 19 bp, Homo sapiens
ctaaatacctcaatcagtc

SEQ ID NO: 2499721 - DNA, 16 bp, Homo sapiens
ctaaatatggactgct

SEQ ID NO: 2499722 - DNA, 20 bp, Homo sapiens
ctaaatattatgagatgctg

SEQ ID NO: 2499723 - DNA, 12 bp, Homo sapiens
ctaaatgaatgt

SEQ ID NO: 2499724 - DNA, 14 bp, Homo sapiens
ctaaatgaatgttt

SEQ ID NO: 2499725 - DNA, 15 bp, Homo sapiens
ctaaatgaatgttta

SEQ ID NO: 2499726 - DNA, 13 bp, Homo sapiens
ctaaatgccctgc

SEQ ID NO: 2499727 - DNA, 13 bp, Homo sapiens
ctaaatggcctca

SEQ ID NO: 2499728 - DNA, 18 bp, Homo sapiens
ctaaatgtgcaatagaag

SEQ ID NO: 2499729 - DNA, 21 bp, Homo sapiens
ctaaatgtgcaatagaaggtg

SEQ ID NO: 2499730 - DNA, 14 bp, Homo sapiens
ctaaattatttact

SEQ ID NO: 2499731 - DNA, 20 bp, Homo sapiens
ctaacaacattgtagcctca

SEQ ID NO: 2499732 - DNA, 17 bp, Homo sapiens
ctaacactcagaagcct

SEQ ID NO: 2499733 - DNA, 20 bp, Homo sapiens
ctaacactcagaagcctggg

SEQ ID NO: 2499734 - DNA, 16 bp, Homo sapiens
ctaacagggaaggcag

SEQ ID NO: 2499735 - DNA, 17 bp, Homo sapiens
ctaacagggaaggcagg

SEQ ID NO: 2499736 - DNA, 21 bp, Homo sapiens
ctaacagggaaggcaggcagg

SEQ ID NO: 2499737 - DNA, 23 bp, Homo sapiens
ctaacatataatgttgttattta

SEQ ID NO: 2499738 - DNA, 20 bp, Homo sapiens
ctaaccaagctgagtttcct

SEQ ID NO: 2499739 - DNA, 18 bp, Homo sapiens
ctaaccatgtgttatgtt

SEQ ID NO: 2499740 - DNA, 21 bp, Homo sapiens
ctaacctttacatgaggactc

SEQ ID NO: 2499741 - DNA, 12 bp, Homo sapiens
ctaacgcctgag

SEQ ID NO: 2499742 - DNA, 18 bp, Homo sapiens
ctaacgcctgagcccagg

SEQ ID NO: 2499743 - DNA, 21 bp, Homo sapiens
ctaacgcctgagcccagggag

SEQ ID NO: 2499744 - DNA, 16 bp, Homo sapiens
ctaacggtgctcaggg

SEQ ID NO: 2499745 - DNA, 21 bp, Homo sapiens
ctaagaaacatttatattgat

SEQ ID NO: 2499746 - DNA, 22 bp, Homo sapiens
ctaagaaacatttatattgata

SEQ ID NO: 2499747 - DNA, 15 bp, Homo sapiens
ctaagaaagaacacg

SEQ ID NO: 2499748 - DNA, 16 bp, Homo sapiens
ctaagaaattgaatac

SEQ ID NO: 2499749 - DNA, 21 bp, Homo sapiens
ctaagaaattgaatactttga

SEQ ID NO: 2499750 - DNA, 15 bp, Homo sapiens
ctaagaacctggaac

SEQ ID NO: 2499751 - DNA, 23 bp, Homo sapiens
ctaagacttactctaagatctta

SEQ ID NO: 2499752 - DNA, 18 bp, Homo sapiens
ctaagaggctgccctcct

SEQ ID NO: 2499753 - DNA, 13 bp, Homo sapiens
ctaagattctaaa

SEQ ID NO: 2499754 - DNA, 15 bp, Homo sapiens
ctaagattctaaagg

SEQ ID NO: 2499755 - DNA, 12 bp, Homo sapiens
ctaagattctag

SEQ ID NO: 2499756 - DNA, 18 bp, Homo sapiens
ctaagattctagatcaga

SEQ ID NO: 2499757 - DNA, 22 bp, Homo sapiens
ctaagattctagatcagatgct

SEQ ID NO: 2499758 - DNA, 18 bp, Homo sapiens
ctaagattctgattttag

SEQ ID NO: 2499759 - DNA, 19 bp, Homo sapiens
ctaagattctgattttagg

SEQ ID NO: 2499760 - DNA, 13 bp, Homo sapiens
ctaagcagaaagt

SEQ ID NO: 2499761 - DNA, 17 bp, Homo sapiens
ctaagcagaaagtgcct

SEQ ID NO: 2499762 - DNA, 21 bp, Homo sapiens
ctaagcagaaagtgcctttca

SEQ ID NO: 2499763 - DNA, 22 bp, Homo sapiens
ctaagcagaaagtgcctttcag

SEQ ID NO: 2499764 - DNA, 23 bp, Homo sapiens
ctaagcagaaagtgcctttcagg

SEQ ID NO: 2499765 - DNA, 13 bp, Homo sapiens
ctaagcatctaag

SEQ ID NO: 2499766 - DNA, 22 bp, Homo sapiens
ctaaggacctgaaattccaaag

SEQ ID NO: 2499767 - DNA, 22 bp, Homo sapiens
ctaaggcctaggattctaaaat

SEQ ID NO: 2499768 - DNA, 20 bp, Homo sapiens
ctaaggctctatgagtctag

SEQ ID NO: 2499769 - DNA, 23 bp, Homo sapiens
ctaaggctctatgagtctagatg

SEQ ID NO: 2499770 - DNA, 19 bp, Homo sapiens
ctaaggctctgagagtcta

SEQ ID NO: 2499771 - DNA, 23 bp, Homo sapiens
ctaaggctctgagagtctagatt

SEQ ID NO: 2499772 - DNA, 17 bp, Homo sapiens
ctaagggtcgaaagctc

SEQ ID NO: 2499773 - DNA, 18 bp, Homo sapiens
ctaagggtcgaaagctct

SEQ ID NO: 2499774 - DNA, 17 bp, Homo sapiens
ctcagcactgcctgctc

SEQ ID NO: 2499775 - DNA, 19 bp, Homo sapiens
ctcagcactgcctgctccc

SEQ ID NO: 2499776 - DNA, 14 bp, Homo sapiens
ctcagcacttggcc

SEQ ID NO: 2499777 - DNA, 18 bp, Homo sapiens
ctcagccaccctgagttg

SEQ ID NO: 2499778 - DNA, 21 bp, Homo sapiens
ctcagccaccctgagttgctt

SEQ ID NO: 2499779 - DNA, 11 bp, Homo sapiens
ctcagccagca

SEQ ID NO: 2499780 - DNA, 21 bp, Homo sapiens
ctcagccccaccccagggcag

SEQ ID NO: 2499781 - DNA, 13 bp, Homo sapiens
ctcagccctgagg

SEQ ID NO: 2499782 - DNA, 15 bp, Homo sapiens
ctcagccctgcacca

SEQ ID NO: 2499783 - DNA, 16 bp, Homo sapiens
ctcagccctgcaccat

SEQ ID NO: 2499784 - DNA, 20 bp, Homo sapiens
ctcagccctgcaccatgctg

SEQ ID NO: 2499785 - DNA, 15 bp, Homo sapiens
ctcagcctcccaaag

SEQ ID NO: 2499786 - DNA, 17 bp, Homo sapiens
ctcagcctcccaaagtg

SEQ ID NO: 2499787 - DNA, 21 bp, Homo sapiens
ctcagcctctcccctgcctgc

SEQ ID NO: 2499788 - DNA, 13 bp, Homo sapiens
ctcagcctggcca

SEQ ID NO: 2499789 - DNA, 21 bp, Homo sapiens
ctcagcctgggcgctggtcct

SEQ ID NO: 2499790 - DNA, 18 bp, Homo sapiens
ctcagccttgccagagat

SEQ ID NO: 2499791 - DNA, 14 bp, Homo sapiens
ctcagctcatccat

SEQ ID NO: 2499792 - DNA, 20 bp, Homo sapiens
ctcagctcccacaagcctct

SEQ ID NO: 2499793 - DNA, 13 bp, Homo sapiens
ctcaggacacagg

SEQ ID NO: 2499794 - DNA, 19 bp, Homo sapiens
ctcaggacacaggcctgtg

SEQ ID NO: 2499795 - DNA, 20 bp, Homo sapiens
ctcaggacacaggcctgtgt

SEQ ID NO: 2499796 - DNA, 16 bp, Homo sapiens
ctcaggacagatgcca

SEQ ID NO: 2499797 - DNA, 19 bp, Homo sapiens
ctcaggacagatgccacac

SEQ ID NO: 2499798 - DNA, 20 bp, Homo sapiens
ctcaggaccaaagctttcat

SEQ ID NO: 2499799 - DNA, 18 bp, Homo sapiens
ctcaggatccaagctaag

SEQ ID NO: 2499800 - DNA, 22 bp, Homo sapiens
ctcaggatgagggaaaagaaaa

SEQ ID NO: 2499801 - DNA, 16 bp, Homo sapiens
ctcaggcacacagcta

SEQ ID NO: 2499802 - DNA, 13 bp, Homo sapiens
ctcaggccagagc

SEQ ID NO: 2499803 - DNA, 20 bp, Homo sapiens
ctcaggctaggccagcaggg

SEQ ID NO: 2499804 - DNA, 12 bp, Homo sapiens
ctcaggctgcct

SEQ ID NO: 2499805 - DNA, 14 bp, Homo sapiens
ctcagggcaaagcc

SEQ ID NO: 2499806 - DNA, 17 bp, Homo sapiens
ctcagggcaaagccagg

SEQ ID NO: 2499807 - DNA, 18 bp, Homo sapiens
ctcagggcaaagccaggt

SEQ ID NO: 2499808 - DNA, 22 bp, Homo sapiens
ctcagggcaaagccaggtccct

SEQ ID NO: 2499809 - DNA, 16 bp, Homo sapiens
ctcagggccaggcctc

SEQ ID NO: 2499810 - DNA, 18 bp, Homo sapiens
ctcagggccaggcctctc

SEQ ID NO: 2499811 - DNA, 13 bp, Homo sapiens
ctcagggccatgc

SEQ ID NO: 2499812 - DNA, 15 bp, Homo sapiens
ctcagggccatgctg

SEQ ID NO: 2499813 - DNA, 19 bp, Homo sapiens
ctcagggccatgctgaggc

SEQ ID NO: 2499814 - DNA, 14 bp, Homo sapiens
ctcagggctcctgg

SEQ ID NO: 2499815 - DNA, 17 bp, Homo sapiens
ctcagggctcctgggtt

SEQ ID NO: 2499816 - DNA, 22 bp, Homo sapiens
ctcagggctccttgtgggcctg

SEQ ID NO: 2499817 - DNA, 13 bp, Homo sapiens
ctcaggtgctggg

SEQ ID NO: 2499818 - DNA, 16 bp, Homo sapiens
ctcaggtgctggggcc

SEQ ID NO: 2499819 - DNA, 22 bp, Homo sapiens
ctcaggtgctggggcctggttc

SEQ ID NO: 2499820 - DNA, 18 bp, Homo sapiens
ctcagtaatttagaaatc

SEQ ID NO: 2499821 - DNA, 19 bp, Homo sapiens
ctcagtaatttagaaatca

SEQ ID NO: 2499822 - DNA, 13 bp, Homo sapiens
ctcagtagtccct

SEQ ID NO: 2499823 - DNA, 14 bp, Homo sapiens
ctcagtctctgagc

SEQ ID NO: 2499824 - DNA, 19 bp, Homo sapiens
ctcagtgaccctggctcct

SEQ ID NO: 2499825 - DNA, 20 bp, Homo sapiens
ctcagttgattttctggatt

SEQ ID NO: 2499826 - DNA, 17 bp, Homo sapiens
ctcatataattatatgt

SEQ ID NO: 2499827 - DNA, 18 bp, Homo sapiens
ctcatcaatggggccagt

SEQ ID NO: 2499828 - DNA, 19 bp, Homo sapiens
ctcatcattctctgtctca

SEQ ID NO: 2499829 - DNA, 13 bp, Homo sapiens
ctcatccacccca

SEQ ID NO: 2499830 - DNA, 19 bp, Homo sapiens
ctcatccaccccatccctc

SEQ ID NO: 2499831 - DNA, 16 bp, Homo sapiens
ctcatccatcatcatg

SEQ ID NO: 2499832 - DNA, 16 bp, Homo sapiens
ctcatcctccttcttc

SEQ ID NO: 2499833 - DNA, 11 bp, Homo sapiens
ctcatctcagt

SEQ ID NO: 2499834 - DNA, 18 bp, Homo sapiens
ctcatctcagtgaagaat

SEQ ID NO: 2499835 - DNA, 18 bp, Homo sapiens
ctcatctgtccctccggg

SEQ ID NO: 2499836 - DNA, 14 bp, Homo sapiens
ctcatgcccctggc

SEQ ID NO: 2499837 - DNA, 12 bp, Homo sapiens
ctcatgtggctg

SEQ ID NO: 2499838 - DNA, 13 bp, Homo sapiens
ctcatgtggctgg

SEQ ID NO: 2499839 - DNA, 16 bp, Homo sapiens
ctcatgtgtgcaacag

SEQ ID NO: 2499840 - DNA, 23 bp, Homo sapiens
ctcatgttgaagccactgccttc

SEQ ID NO: 2499841 - DNA, 21 bp, Homo sapiens
ctcattatttatgtccaggtg

SEQ ID NO: 2499842 - DNA, 16 bp, Homo sapiens
ctcatttagcctgtcc

SEQ ID NO: 2499843 - DNA, 18 bp, Homo sapiens
ctcatttagcctgtcctg

SEQ ID NO: 2499844 - DNA, 14 bp, Homo sapiens
ctccaaaatgtgcc

SEQ ID NO: 2499845 - DNA, 17 bp, Homo sapiens
ctccaaagtcataattg

SEQ ID NO: 2499846 - DNA, 18 bp, Homo sapiens
ctccaacaccaagcacag

SEQ ID NO: 2499847 - DNA, 23 bp, Homo sapiens
ctccaacaccaagcacagcagcc

SEQ ID NO: 2499848 - DNA, 20 bp, Homo sapiens
ctccaagagctacataattt

SEQ ID NO: 2499849 - DNA, 12 bp, Homo sapiens
ctccaagattct

SEQ ID NO: 2499850 - DNA, 15 bp, Homo sapiens
ctccaagattctaga

SEQ ID NO: 2499851 - DNA, 15 bp, Homo sapiens
ctccaagccccatct

SEQ ID NO: 2499852 - DNA, 17 bp, Homo sapiens
ctccaagccccatcttc

SEQ ID NO: 2499853 - DNA, 15 bp, Homo sapiens
ctccaattttttaag

SEQ ID NO: 2499854 - DNA, 20 bp, Homo sapiens
ctccacacagtgctcaaggc

SEQ ID NO: 2499855 - DNA, 13 bp, Homo sapiens
ctccacacctgcg

SEQ ID NO: 2499856 - DNA, 20 bp, Homo sapiens
ctccacatatttcagtgagg

SEQ ID NO: 2499857 - DNA, 14 bp, Homo sapiens
ctccacatcctcca

SEQ ID NO: 2499858 - DNA, 15 bp, Homo sapiens
ctccacctagactgt

SEQ ID NO: 2499859 - DNA, 20 bp, Homo sapiens
ctccacgttctgctcatcat

SEQ ID NO: 2499860 - DNA, 14 bp, Homo sapiens
ctccactctgcttc

SEQ ID NO: 2499861 - DNA, 16 bp, Homo sapiens
ctccactctgcttctc

SEQ ID NO: 2499862 - DNA, 13 bp, Homo sapiens
ctccactggctcc

SEQ ID NO: 2499863 - DNA, 21 bp, Homo sapiens
ctccacttcttgttccccact

SEQ ID NO: 2499864 - DNA, 13 bp, Homo sapiens
ctccactttcagc

SEQ ID NO: 2499865 - DNA, 14 bp, Homo sapiens
ctccactttcagct

SEQ ID NO: 2499866 - DNA, 17 bp, Homo sapiens
ctccactttcagctgtc

SEQ ID NO: 2499867 - DNA, 19 bp, Homo sapiens
ctccactttcagctgtctt

SEQ ID NO: 2499868 - DNA, 20 bp, Homo sapiens
ctccactttcagctgtcttt

SEQ ID NO: 2499869 - DNA, 14 bp, Homo sapiens
ctccagacctgatc

SEQ ID NO: 2499870 - DNA, 20 bp, Homo sapiens
ctccagaggggctcaggtca

SEQ ID NO: 2499871 - DNA, 22 bp, Homo sapiens
ctccagattagagcctgtaaac

SEQ ID NO: 2499872 - DNA, 20 bp, Homo sapiens
ctccagcccctcttggagaa

SEQ ID NO: 2499873 - DNA, 21 bp, Homo sapiens
ctccagccgccggctgtgcag

SEQ ID NO: 2499874 - DNA, 13 bp, Homo sapiens
ctccagcggccct

SEQ ID NO: 2499875 - DNA, 19 bp, Homo sapiens
ctccagcggccctgtcatc

SEQ ID NO: 2499876 - DNA, 13 bp, Homo sapiens
ctccagctccctg

SEQ ID NO: 2499877 - DNA, 13 bp, Homo sapiens
ctccagctgcccc

SEQ ID NO: 2499878 - DNA, 12 bp, Homo sapiens
ctccaggcccaa

SEQ ID NO: 2499879 - DNA, 19 bp, Homo sapiens
ctctaagatcttagattct

SEQ ID NO: 2499880 - DNA, 22 bp, Homo sapiens
ctctaagatcttagattctctg

SEQ ID NO: 2499881 - DNA, 17 bp, Homo sapiens
ctctacatcttctgcct

SEQ ID NO: 2499882 - DNA, 22 bp, Homo sapiens
ctctacctgacactcccttggg

SEQ ID NO: 2499883 - DNA, 20 bp, Homo sapiens
ctctactaatgcctcttcat

SEQ ID NO: 2499884 - DNA, 13 bp, Homo sapiens
ctctactgggaag

SEQ ID NO: 2499885 - DNA, 21 bp, Homo sapiens
ctctagggtacatggtgctgg

SEQ ID NO: 2499886 - DNA, 18 bp, Homo sapiens
ctctagtcaatgacatga

SEQ ID NO: 2499887 - DNA, 17 bp, Homo sapiens
ctctagtgcggtttact

SEQ ID NO: 2499888 - DNA, 22 bp, Homo sapiens
ctctatattgttcagcatgcaa

SEQ ID NO: 2499889 - DNA, 13 bp, Homo sapiens
ctctatgagtcta

SEQ ID NO: 2499890 - DNA, 14 bp, Homo sapiens
ctctatgagtctag

SEQ ID NO: 2499891 - DNA, 15 bp, Homo sapiens
ctctatgagtctaga

SEQ ID NO: 2499892 - DNA, 19 bp, Homo sapiens
ctctatggggcatcctctt

SEQ ID NO: 2499893 - DNA, 13 bp, Homo sapiens
ctctattctttaa

SEQ ID NO: 2499894 - DNA, 14 bp, Homo sapiens
ctctcaacaccatg

SEQ ID NO: 2499895 - DNA, 18 bp, Homo sapiens
ctctcaacaccatgattc

SEQ ID NO: 2499896 - DNA, 17 bp, Homo sapiens
ctctcaacacccagttt

SEQ ID NO: 2499897 - DNA, 14 bp, Homo sapiens
ctctcacctctagg

SEQ ID NO: 2499898 - DNA, 21 bp, Homo sapiens
ctctcagccctcacacaccct

SEQ ID NO: 2499899 - DNA, 15 bp, Homo sapiens
ctctcagctccaggt

SEQ ID NO: 2499900 - DNA, 17 bp, Homo sapiens
ctctcaggaccaaagct

SEQ ID NO: 2499901 - DNA, 18 bp, Homo sapiens
ctctcagggccaggcctc

SEQ ID NO: 2499902 - DNA, 14 bp, Homo sapiens
ctctcagtctctga

SEQ ID NO: 2499903 - DNA, 18 bp, Homo sapiens
ctctcagtctctgagcag

SEQ ID NO: 2499904 - DNA, 21 bp, Homo sapiens
ctctccactttcagctgtctt

SEQ ID NO: 2499905 - DNA, 15 bp, Homo sapiens
ctctccagctgacta

SEQ ID NO: 2499906 - DNA, 15 bp, Homo sapiens
ctctccattctgctc

SEQ ID NO: 2499907 - DNA, 20 bp, Homo sapiens
ctctccattctgctccttcc

SEQ ID NO: 2499908 - DNA, 13 bp, Homo sapiens
ctctcccaccctc

SEQ ID NO: 2499909 - DNA, 19 bp, Homo sapiens
ctctcccaccctcttccta

SEQ ID NO: 2499910 - DNA, 13 bp, Homo sapiens
ctctcccaggcag

SEQ ID NO: 2499911 - DNA, 21 bp, Homo sapiens
ctctccccacgagggctggct

SEQ ID NO: 2499912 - DNA, 13 bp, Homo sapiens
ctctccccagccc

SEQ ID NO: 2499913 - DNA, 16 bp, Homo sapiens
ctctccccagcccaga

SEQ ID NO: 2499914 - DNA, 18 bp, Homo sapiens
ctctccccagcccagaga

SEQ ID NO: 2499915 - DNA, 18 bp, Homo sapiens
ctctccccaggtccagct

SEQ ID NO: 2499916 - DNA, 12 bp, Homo sapiens
ctctcccctgcc

SEQ ID NO: 2499917 - DNA, 21 bp, Homo sapiens
ctctcccctgccccctgcagg

SEQ ID NO: 2499918 - DNA, 17 bp, Homo sapiens
ctctccctcccctgcca

SEQ ID NO: 2499919 - DNA, 17 bp, Homo sapiens
ctctcccttgggctctg

SEQ ID NO: 2499920 - DNA, 24 bp, Homo sapiens
ctctccgactcacaccactagcct

SEQ ID NO: 2499921 - DNA, 15 bp, Homo sapiens
ctctcctagcccctg

SEQ ID NO: 2499922 - DNA, 22 bp, Homo sapiens
ctctcctaggcattctggacct

SEQ ID NO: 2499923 - DNA, 15 bp, Homo sapiens
ctctcctgccccttg

SEQ ID NO: 2499924 - DNA, 22 bp, Homo sapiens
ctctctagggtacatggtgctg

SEQ ID NO: 2499925 - DNA, 24 bp, Homo sapiens
ctctctatcctctcttcctcttcc

SEQ ID NO: 2499926 - DNA, 14 bp, Homo sapiens
ctctctatgcctct

SEQ ID NO: 2499927 - DNA, 13 bp, Homo sapiens
ctctctccctttt

SEQ ID NO: 2499928 - DNA, 17 bp, Homo sapiens
ctctctgcccttgatca

SEQ ID NO: 2499929 - DNA, 14 bp, Homo sapiens
ctctctgctctgcg

SEQ ID NO: 2499930 - DNA, 19 bp, Homo sapiens
ctctcttagggacagtcaa

SEQ ID NO: 2499931 - DNA, 23 bp, Homo sapiens
ctctcttattgcctcacttcagg

SEQ ID NO: 2499932 - DNA, 17 bp, Homo sapiens
ctctctttatacagctg

SEQ ID NO: 2499933 - DNA, 16 bp, Homo sapiens
ctctctttgcatggat

SEQ ID NO: 2499934 - DNA, 15 bp, Homo sapiens
ctctctttgcccagt

SEQ ID NO: 2499935 - DNA, 17 bp, Homo sapiens
ctctgaagccacaaata

SEQ ID NO: 2499936 - DNA, 17 bp, Homo sapiens
ctctgacagcagcatct

SEQ ID NO: 2499937 - DNA, 18 bp, Homo sapiens
ctctgacagcagcatctc

SEQ ID NO: 2499938 - DNA, 12 bp, Homo sapiens
ctctgacctgca

SEQ ID NO: 2499939 - DNA, 21 bp, Homo sapiens
ctctgactcagggctcctggg

SEQ ID NO: 2499940 - DNA, 15 bp, Homo sapiens
ctctgacttctgcct

SEQ ID NO: 2499941 - DNA, 15 bp, Homo sapiens
ctctgagactccaga

SEQ ID NO: 2499942 - DNA, 18 bp, Homo sapiens
ctctgagaggccctggat

SEQ ID NO: 2499943 - DNA, 15 bp, Homo sapiens
ctctgagagtctaga

SEQ ID NO: 2499944 - DNA, 16 bp, Homo sapiens
ctctgagagtctagat

SEQ ID NO: 2499945 - DNA, 17 bp, Homo sapiens
ctctgagagtctagatt

SEQ ID NO: 2499946 - DNA, 22 bp, Homo sapiens
ctctgagagtctagattctctg

SEQ ID NO: 2499947 - DNA, 16 bp, Homo sapiens
ctctgagctgtgcagg

SEQ ID NO: 2499948 - DNA, 13 bp, Homo sapiens
ctctgaggccagc

SEQ ID NO: 2499949 - DNA, 15 bp, Homo sapiens
ctctgaggccagcct

SEQ ID NO: 2499950 - DNA, 18 bp, Homo sapiens
ctctgaggccagcctggc

SEQ ID NO: 2499951 - DNA, 19 bp, Homo sapiens
ctctgaggccagcctggcc

SEQ ID NO: 2499952 - DNA, 12 bp, Homo sapiens
ctctgaggcgcc

SEQ ID NO: 2499953 - DNA, 19 bp, Homo sapiens
ctctgaggcgccccaaccc

SEQ ID NO: 2499954 - DNA, 19 bp, Homo sapiens
ctctgaggtgcctgtccca

SEQ ID NO: 2499955 - DNA, 12 bp, Homo sapiens
ctctgagtgtga

SEQ ID NO: 2499956 - DNA, 23 bp, Homo sapiens
ctctgatgaaaaattgctgactg

SEQ ID NO: 2499957 - DNA, 13 bp, Homo sapiens
ctctgatgcagct

SEQ ID NO: 2499958 - DNA, 19 bp, Homo sapiens
ctctgcaattcccctctgc

SEQ ID NO: 2499959 - DNA, 23 bp, Homo sapiens
ctctgcaattcccctctgctgct

SEQ ID NO: 2499960 - DNA, 16 bp, Homo sapiens
ctctgcactactgaca

SEQ ID NO: 2499961 - DNA, 19 bp, Homo sapiens
ctctgcactcccacctgac

SEQ ID NO: 2499962 - DNA, 12 bp, Homo sapiens
ctctgcagcctc

SEQ ID NO: 2499963 - DNA, 19 bp, Homo sapiens
ctctgcagcctcagagaca

SEQ ID NO: 2499964 - DNA, 18 bp, Homo sapiens
ctctgcatcctctggagc

SEQ ID NO: 2499965 - DNA, 20 bp, Homo sapiens
ctctgcatcctctggagcca

SEQ ID NO: 2499966 - DNA, 14 bp, Homo sapiens
ctctgccagtgaca

SEQ ID NO: 2499967 - DNA, 19 bp, Homo sapiens
ctctgcccaggcactgcta

SEQ ID NO: 2499968 - DNA, 22 bp, Homo sapiens
ctctgcgtgtcacctgtgcttc

SEQ ID NO: 2499969 - DNA, 12 bp, Homo sapiens
ctctgctctgat

SEQ ID NO: 2499970 - DNA, 14 bp, Homo sapiens
ctctgctctgatgc

SEQ ID NO: 2499971 - DNA, 13 bp, Homo sapiens
ctctgctctgcgt

SEQ ID NO: 2499972 - DNA, 17 bp, Homo sapiens
ctctgctgacctgctga

SEQ ID NO: 2499973 - DNA, 21 bp, Homo sapiens
ctctgctgctgtccctccccc

SEQ ID NO: 2499974 - DNA, 14 bp, Homo sapiens
ctctgcttctcacg

SEQ ID NO: 2499975 - DNA, 15 bp, Homo sapiens
ctctgcttctctgac

SEQ ID NO: 2499976 - DNA, 15 bp, Homo sapiens
ctctggacagcccca

SEQ ID NO: 2499977 - DNA, 18 bp, Homo sapiens
ctctggacagccccaccc

SEQ ID NO: 2499978 - DNA, 15 bp, Homo sapiens
ctctggagccagccg

SEQ ID NO: 2499979 - DNA, 23 bp, Homo sapiens
ctctggagccagccgagcaggag

SEQ ID NO: 2499980 - DNA, 14 bp, Homo sapiens
ctctggaggggagg

SEQ ID NO: 2499981 - DNA, 15 bp, Homo sapiens
ctctggaggggaggg

SEQ ID NO: 2499982 - DNA, 11 bp, Homo sapiens
ctctggcagcc

SEQ ID NO: 2499983 - DNA, 17 bp, Homo sapiens
ctgccagctctgtatca

SEQ ID NO: 2499984 - DNA, 13 bp, Homo sapiens
ctgccagctgcac

SEQ ID NO: 2499985 - DNA, 17 bp, Homo sapiens
ctgccagctgcactgat

SEQ ID NO: 2499986 - DNA, 17 bp, Homo sapiens
ctgccagcttcaggtga

SEQ ID NO: 2499987 - DNA, 20 bp, Homo sapiens
ctgccaggagcacggctctg

SEQ ID NO: 2499988 - DNA, 16 bp, Homo sapiens
ctgccaggaggaccca

SEQ ID NO: 2499989 - DNA, 18 bp, Homo sapiens
ctgccaggaggacccagg

SEQ ID NO: 2499990 - DNA, 21 bp, Homo sapiens
ctgccaggaggacccagggct

SEQ ID NO: 2499991 - DNA, 22 bp, Homo sapiens
ctgccaggaggacccagggctc

SEQ ID NO: 2499992 - DNA, 23 bp, Homo sapiens
ctgccaggaggacccagggctct

SEQ ID NO: 2499993 - DNA, 18 bp, Homo sapiens
ctgccaggagggacaaag

SEQ ID NO: 2499994 - DNA, 20 bp, Homo sapiens
ctgccaggagggacaaagga

SEQ ID NO: 2499995 - DNA, 22 bp, Homo sapiens
ctgccaggagggacaaaggagc

SEQ ID NO: 2499996 - DNA, 12 bp, Homo sapiens
ctgccagggcag

SEQ ID NO: 2499997 - DNA, 15 bp, Homo sapiens
ctgccagggcagggc

SEQ ID NO: 2499998 - DNA, 16 bp, Homo sapiens
ctgccagggcagggcc

SEQ ID NO: 2499999 - DNA, 16 bp, Homo sapiens
ctgccagggcccctct

SEQ ID NO: 2500000 - DNA, 12 bp, Homo sapiens
ctgccagtgaca

SEQ ID NO: 2500001 - DNA, 23 bp, Homo sapiens
ctgccagtgacagacaggctctt

SEQ ID NO: 2500002 - DNA, 23 bp, Homo sapiens
ctgccagtgtcctgagccccagg

SEQ ID NO: 2500003 - DNA, 18 bp, Homo sapiens
ctgccatatgatttacat

SEQ ID NO: 2500004 - DNA, 14 bp, Homo sapiens
ctgccatattaaat

SEQ ID NO: 2500005 - DNA, 17 bp, Homo sapiens
ctgccattaaagaatat

SEQ ID NO: 2500006 - DNA, 20 bp, Homo sapiens
ctgcccatggacaggctggc

SEQ ID NO: 2500007 - DNA, 12 bp, Homo sapiens
ctgccccaactc

SEQ ID NO: 2500008 - DNA, 20 bp, Homo sapiens
ctgccccaactccttccagc

SEQ ID NO: 2500009 - DNA, 13 bp, Homo sapiens
ctgccccaactct

SEQ ID NO: 2500010 - DNA, 21 bp, Homo sapiens
ctgcccccaaggaggcagcct

SEQ ID NO: 2500011 - DNA, 12 bp, Homo sapiens
ctgccccccagc

SEQ ID NO: 2500012 - DNA, 15 bp, Homo sapiens
ctgccccctgcagga

SEQ ID NO: 2500013 - DNA, 22 bp, Homo sapiens
ctgccccctgcaggaaggagct

SEQ ID NO: 2500014 - DNA, 14 bp, Homo sapiens
ctgccccgccctca

SEQ ID NO: 2500015 - DNA, 15 bp, Homo sapiens
ctgccccgccctcat

SEQ ID NO: 2500016 - DNA, 22 bp, Homo sapiens
ctgccccttggacacgctcagt

SEQ ID NO: 2500017 - DNA, 12 bp, Homo sapiens
ctgccctcatgg

SEQ ID NO: 2500018 - DNA, 12 bp, Homo sapiens
ctgccctcctgt

SEQ ID NO: 2500019 - DNA, 19 bp, Homo sapiens
ctgccctcctgtgctcagc

SEQ ID NO: 2500020 - DNA, 22 bp, Homo sapiens
ctgccctcctgtgctcagccct

SEQ ID NO: 2500021 - DNA, 17 bp, Homo sapiens
ctgccctggtggccctc

SEQ ID NO: 2500022 - DNA, 16 bp, Homo sapiens
ctgcccttgatcagcc

SEQ ID NO: 2500023 - DNA, 17 bp, Homo sapiens
ctgcccttgatcagccc

SEQ ID NO: 2500024 - DNA, 12 bp, Homo sapiens
ctgcccttgttt

SEQ ID NO: 2500025 - DNA, 21 bp, Homo sapiens
ctgcccttgtttggggcagga

SEQ ID NO: 2500026 - DNA, 23 bp, Homo sapiens
ctgcccttgtttggggcaggagt

SEQ ID NO: 2500027 - DNA, 17 bp, Homo sapiens
ctgccgcaacagttttt

SEQ ID NO: 2500028 - DNA, 20 bp, Homo sapiens
ctgccgtggggccgccgcct

SEQ ID NO: 2500029 - DNA, 23 bp, Homo sapiens
ctgcctacagaacttcagaaaga

SEQ ID NO: 2500030 - DNA, 15 bp, Homo sapiens
ctgcctagaaacaac

SEQ ID NO: 2500031 - DNA, 23 bp, Homo sapiens
ctgcctagattcagggaaagtgg

SEQ ID NO: 2500032 - DNA, 23 bp, Homo sapiens
ctgcctattatctgtcagctgca

SEQ ID NO: 2500033 - DNA, 22 bp, Homo sapiens
ctgcctcaggaggcaggacctt

SEQ ID NO: 2500034 - DNA, 22 bp, Homo sapiens
ctgcctcctgccggctccttgg

SEQ ID NO: 2500035 - DNA, 15 bp, Homo sapiens
ctgcctcgaaacaca

SEQ ID NO: 2500036 - DNA, 19 bp, Homo sapiens
ctgcctcgaaacacagaaa

SEQ ID NO: 2500037 - DNA, 13 bp, Homo sapiens
ctgcctctcccag

SEQ ID NO: 2500038 - DNA, 17 bp, Homo sapiens
ctgcctctcccaggcag

SEQ ID NO: 2500039 - DNA, 21 bp, Homo sapiens
ctgcctctcccaggcaggggc

SEQ ID NO: 2500040 - DNA, 16 bp, Homo sapiens
ctgcctcttctgggag

SEQ ID NO: 2500041 - DNA, 23 bp, Homo sapiens
ctgcctgacatttggagtgttcc

SEQ ID NO: 2500042 - DNA, 19 bp, Homo sapiens
ctgcctgagtcgtgacctg

SEQ ID NO: 2500043 - DNA, 17 bp, Homo sapiens
ctgcctgcataggagtt

SEQ ID NO: 2500044 - DNA, 13 bp, Homo sapiens
ctgcctgctccca

SEQ ID NO: 2500045 - DNA, 12 bp, Homo sapiens
ctgcctgcttgg

SEQ ID NO: 2500046 - DNA, 13 bp, Homo sapiens
ctgcctgcttggg

SEQ ID NO: 2500047 - DNA, 12 bp, Homo sapiens
ctgcctggaccc

SEQ ID NO: 2500048 - DNA, 13 bp, Homo sapiens
ctgcctggacccg

SEQ ID NO: 2500049 - DNA, 17 bp, Homo sapiens
ctgcctggaggacctga

SEQ ID NO: 2500050 - DNA, 21 bp, Homo sapiens
ctgcctggaggacctgagcct

SEQ ID NO: 2500051 - DNA, 14 bp, Homo sapiens
ctgcctgtggccat

SEQ ID NO: 2500052 - DNA, 22 bp, Homo sapiens
ctgcctgtggcgccgtctccag

SEQ ID NO: 2500053 - DNA, 15 bp, Homo sapiens
ctgccttatcttgca

SEQ ID NO: 2500054 - DNA, 17 bp, Homo sapiens
ctgccttatcttgcacc

SEQ ID NO: 2500055 - DNA, 21 bp, Homo sapiens
ctgccttattcagggaaggag

SEQ ID NO: 2500056 - DNA, 15 bp, Homo sapiens
ctgccttcctcctgg

SEQ ID NO: 2500057 - DNA, 18 bp, Homo sapiens
ctgccttcctcctgggcc

SEQ ID NO: 2500058 - DNA, 21 bp, Homo sapiens
ctgccttcctcctgggccctc

SEQ ID NO: 2500059 - DNA, 17 bp, Homo sapiens
ctgccttcgcttcttgc

SEQ ID NO: 2500060 - DNA, 21 bp, Homo sapiens
ctgccttcgcttcttgcctct

SEQ ID NO: 2500061 - DNA, 17 bp, Homo sapiens
ctgccttgaaaaagaca

SEQ ID NO: 2500062 - DNA, 14 bp, Homo sapiens
ctgccttggcctcc

SEQ ID NO: 2500063 - DNA, 17 bp, Homo sapiens
ctgccttggcctcccaa

SEQ ID NO: 2500064 - DNA, 20 bp, Homo sapiens
ctgcctttccatccatggcc

SEQ ID NO: 2500065 - DNA, 12 bp, Homo sapiens
ctgcgcactgtg

SEQ ID NO: 2500066 - DNA, 22 bp, Homo sapiens
ctgcgggtgaacaaagcagcca

SEQ ID NO: 2500067 - DNA, 22 bp, Homo sapiens
ctgcggtagatgggagggaggc

SEQ ID NO: 2500068 - DNA, 19 bp, Homo sapiens
ctgcgtgtcacctgtgctt

SEQ ID NO: 2500069 - DNA, 12 bp, Homo sapiens
ctgctaaataaa

SEQ ID NO: 2500070 - DNA, 24 bp, Homo sapiens
ctgctaatattttcctcctgagtg

SEQ ID NO: 2500071 - DNA, 20 bp, Homo sapiens
ctgctacacctattatccca

SEQ ID NO: 2500072 - DNA, 12 bp, Homo sapiens
ctgctacagcaa

SEQ ID NO: 2500073 - DNA, 20 bp, Homo sapiens
ctgctacagcaatttctaat

SEQ ID NO: 2500074 - DNA, 12 bp, Homo sapiens
ctgctaggccag

SEQ ID NO: 2500075 - DNA, 20 bp, Homo sapiens
ctgctaggccagagcccact

SEQ ID NO: 2500076 - DNA, 21 bp, Homo sapiens
ctgctaggccagagcccactc

SEQ ID NO: 2500077 - DNA, 18 bp, Homo sapiens
ctgctattaggccagcaa

SEQ ID NO: 2500078 - DNA, 18 bp, Homo sapiens
ctgctcacgtcaaatgca

SEQ ID NO: 2500079 - DNA, 15 bp, Homo sapiens
ctgctcagccctgca

SEQ ID NO: 2500080 - DNA, 22 bp, Homo sapiens
ctgctcatcattctctgtctca

SEQ ID NO: 2500081 - DNA, 13 bp, Homo sapiens
ctgctccagacct

SEQ ID NO: 2500082 - DNA, 17 bp, Homo sapiens
ctgctcccaaggggcct

SEQ ID NO: 2500083 - DNA, 18 bp, Homo sapiens
ctgctcccatcctgtgtg

SEQ ID NO: 2500084 - DNA, 12 bp, Homo sapiens
ctgctccctcag

SEQ ID NO: 2500085 - DNA, 13 bp, Homo sapiens
ctgctccctcaga

SEQ ID NO: 2500086 - DNA, 18 bp, Homo sapiens
ctgctcggggtgcacagg

SEQ ID NO: 2500087 - DNA, 15 bp, Homo sapiens
ctgtcctccaacacc

SEQ ID NO: 2500088 - DNA, 23 bp, Homo sapiens
ctgtcctccaacaccaagcacag

SEQ ID NO: 2500089 - DNA, 13 bp, Homo sapiens
ctgtcctctttca

SEQ ID NO: 2500090 - DNA, 15 bp, Homo sapiens
ctgtcctctttcagc

SEQ ID NO: 2500091 - DNA, 16 bp, Homo sapiens
ctgtcctctttcagct

SEQ ID NO: 2500092 - DNA, 18 bp, Homo sapiens
ctgtcctctttcagctcc

SEQ ID NO: 2500093 - DNA, 21 bp, Homo sapiens
ctgtcctctttcagctcctga

SEQ ID NO: 2500094 - DNA, 22 bp, Homo sapiens
ctgtcctgccacccagccccag

SEQ ID NO: 2500095 - DNA, 11 bp, Homo sapiens
ctgtcctgcct

SEQ ID NO: 2500096 - DNA, 17 bp, Homo sapiens
ctgtcctgcctgtggcc

SEQ ID NO: 2500097 - DNA, 13 bp, Homo sapiens
ctgtcctgggcct

SEQ ID NO: 2500098 - DNA, 18 bp, Homo sapiens
ctgtcctgggcctgcaga

SEQ ID NO: 2500099 - DNA, 19 bp, Homo sapiens
ctgtcctggtggtattttc

SEQ ID NO: 2500100 - DNA, 21 bp, Homo sapiens
ctgtcctgtcatcatcatggc

SEQ ID NO: 2500101 - DNA, 17 bp, Homo sapiens
ctgtcctttttcctctc

SEQ ID NO: 2500102 - DNA, 17 bp, Homo sapiens
ctgtcgctgcttcgtgg

SEQ ID NO: 2500103 - DNA, 12 bp, Homo sapiens
ctgtctcacctg

SEQ ID NO: 2500104 - DNA, 16 bp, Homo sapiens
ctgtctcagcctccca

SEQ ID NO: 2500105 - DNA, 12 bp, Homo sapiens
ctgtctcatcca

SEQ ID NO: 2500106 - DNA, 15 bp, Homo sapiens
ctgtctcatccatca

SEQ ID NO: 2500107 - DNA, 17 bp, Homo sapiens
ctgtctcatccatcatc

SEQ ID NO: 2500108 - DNA, 19 bp, Homo sapiens
ctgtctcctacctctgctc

SEQ ID NO: 2500109 - DNA, 15 bp, Homo sapiens
ctgtctcgagcgccc

SEQ ID NO: 2500110 - DNA, 17 bp, Homo sapiens
ctgtctcgagcgccctg

SEQ ID NO: 2500111 - DNA, 20 bp, Homo sapiens
ctgtctctcagggccaggcc

SEQ ID NO: 2500112 - DNA, 17 bp, Homo sapiens
ctgtctggaagatgggg

SEQ ID NO: 2500113 - DNA, 18 bp, Homo sapiens
ctgtctggaagatgggga

SEQ ID NO: 2500114 - DNA, 19 bp, Homo sapiens
ctgtctggcaatgccacag

SEQ ID NO: 2500115 - DNA, 15 bp, Homo sapiens
ctgtctggcccccct

SEQ ID NO: 2500116 - DNA, 19 bp, Homo sapiens
ctgtctgggtgctactggg

SEQ ID NO: 2500117 - DNA, 22 bp, Homo sapiens
ctgtctgggtgctactggggaa

SEQ ID NO: 2500118 - DNA, 18 bp, Homo sapiens
ctgtctgttgtattcatt

SEQ ID NO: 2500119 - DNA, 14 bp, Homo sapiens
ctgtgaacccagga

SEQ ID NO: 2500120 - DNA, 17 bp, Homo sapiens
ctgtgaacccaggacaa

SEQ ID NO: 2500121 - DNA, 19 bp, Homo sapiens
ctgtgaacccaggacaagc

SEQ ID NO: 2500122 - DNA, 22 bp, Homo sapiens
ctgtgaacccaggacaagcatg

SEQ ID NO: 2500123 - DNA, 15 bp, Homo sapiens
ctgtgaatgccactg

SEQ ID NO: 2500124 - DNA, 21 bp, Homo sapiens
ctgtgaatgccactgccttcg

SEQ ID NO: 2500125 - DNA, 15 bp, Homo sapiens
ctgtgaccaatgtct

SEQ ID NO: 2500126 - DNA, 17 bp, Homo sapiens
ctgtgaccaatgtcttg

SEQ ID NO: 2500127 - DNA, 16 bp, Homo sapiens
ctgtgaccacaacatg

SEQ ID NO: 2500128 - DNA, 18 bp, Homo sapiens
ctgtgacccccagctccg

SEQ ID NO: 2500129 - DNA, 16 bp, Homo sapiens
ctgtgacctgctgagc

SEQ ID NO: 2500130 - DNA, 15 bp, Homo sapiens
ctgtgagcccagctg

SEQ ID NO: 2500131 - DNA, 12 bp, Homo sapiens
ctgtgaggctgt

SEQ ID NO: 2500132 - DNA, 15 bp, Homo sapiens
ctgtgaggctgtcct

SEQ ID NO: 2500133 - DNA, 17 bp, Homo sapiens
ctgtgaggctgtcctgt

SEQ ID NO: 2500134 - DNA, 20 bp, Homo sapiens
ctgtgcacaaaacccagacc

SEQ ID NO: 2500135 - DNA, 18 bp, Homo sapiens
ctgtgcacatctgtgtct

SEQ ID NO: 2500136 - DNA, 14 bp, Homo sapiens
ctgtgcaccaagca

SEQ ID NO: 2500137 - DNA, 17 bp, Homo sapiens
ctgtgcagccgctgagc

SEQ ID NO: 2500138 - DNA, 19 bp, Homo sapiens
ctgtgcagccgctgagcga

SEQ ID NO: 2500139 - DNA, 17 bp, Homo sapiens
ctgtgcagtcctgggtc

SEQ ID NO: 2500140 - DNA, 15 bp, Homo sapiens
ctgtgccagagcctg

SEQ ID NO: 2500141 - DNA, 16 bp, Homo sapiens
ctgtgccagagcctgg

SEQ ID NO: 2500142 - DNA, 14 bp, Homo sapiens
ctgtgccaggtgag

SEQ ID NO: 2500143 - DNA, 13 bp, Homo sapiens
ctgtgcccccagg

SEQ ID NO: 2500144 - DNA, 23 bp, Homo sapiens
ctgtgccccttccgccactgggg

SEQ ID NO: 2500145 - DNA, 22 bp, Homo sapiens
ctgtgcctcagagaccagggct

SEQ ID NO: 2500146 - DNA, 14 bp, Homo sapiens
ctgtgcctcctccc

SEQ ID NO: 2500147 - DNA, 18 bp, Homo sapiens
ctgtgcctcctccctccc

SEQ ID NO: 2500148 - DNA, 21 bp, Homo sapiens
ctgtgcctcctccctccctct

SEQ ID NO: 2500149 - DNA, 17 bp, Homo sapiens
ctgtgcctcgctcccca

SEQ ID NO: 2500150 - DNA, 22 bp, Homo sapiens
ctgtgcctcgctccccactctg

SEQ ID NO: 2500151 - DNA, 19 bp, Homo sapiens
ctgtgctatggtgctctgt

SEQ ID NO: 2500152 - DNA, 19 bp, Homo sapiens
ctgtgctcagccctgagga

SEQ ID NO: 2500153 - DNA, 11 bp, Homo sapiens
ctgtgctgtgt

SEQ ID NO: 2500154 - DNA, 21 bp, Homo sapiens
ctgtgcttcgggcccttccca

SEQ ID NO: 2500155 - DNA, 18 bp, Homo sapiens
ctgtggcagagttacagt

SEQ ID NO: 2500156 - DNA, 19 bp, Homo sapiens
ctgtggcagagttacagtt

SEQ ID NO: 2500157 - DNA, 19 bp, Homo sapiens
ctgtggcaggccagctgtg

SEQ ID NO: 2500158 - DNA, 23 bp, Homo sapiens
ctgtggcaggccagctgtggttt

SEQ ID NO: 2500159 - DNA, 18 bp, Homo sapiens
ctgtggcatgggtgaaga

SEQ ID NO: 2500160 - DNA, 12 bp, Homo sapiens
ctgtggccagga

SEQ ID NO: 2500161 - DNA, 13 bp, Homo sapiens
ctgtggccaggag

SEQ ID NO: 2500162 - DNA, 16 bp, Homo sapiens
ctgtggccccaccctg

SEQ ID NO: 2500163 - DNA, 21 bp, Homo sapiens
ctgtggccccaccctgggccc

SEQ ID NO: 2500164 - DNA, 20 bp, Homo sapiens
ctgtggcgccgtctccaggg

SEQ ID NO: 2500165 - DNA, 21 bp, Homo sapiens
ctgtggcgccgtctccagggg

SEQ ID NO: 2500166 - DNA, 14 bp, Homo sapiens
ctgtgggaaatggt

SEQ ID NO: 2500167 - DNA, 13 bp, Homo sapiens
ctgtgggagcctc

SEQ ID NO: 2500168 - DNA, 14 bp, Homo sapiens
ctgtgggagcctcg

SEQ ID NO: 2500169 - DNA, 20 bp, Homo sapiens
ctgtgggggtgtgccccctt

SEQ ID NO: 2500170 - DNA, 16 bp, Homo sapiens
ctgtgggtctgggagt

SEQ ID NO: 2500171 - DNA, 14 bp, Homo sapiens
ctgtggtgtgtccc

SEQ ID NO: 2500172 - DNA, 17 bp, Homo sapiens
ctgtggtttcatgttag

SEQ ID NO: 2500173 - DNA, 21 bp, Homo sapiens
ctgtggttttcttttgccatg

SEQ ID NO: 2500174 - DNA, 22 bp, Homo sapiens
ctgtggttttcttttgccatga

SEQ ID NO: 2500175 - DNA, 16 bp, Homo sapiens
ctgtgtaactgcccaa

SEQ ID NO: 2500176 - DNA, 13 bp, Homo sapiens
ctgtgtaagattt

SEQ ID NO: 2500177 - DNA, 23 bp, Homo sapiens
ctgtgtaagggccagaaatatct

SEQ ID NO: 2500178 - DNA, 16 bp, Homo sapiens
ctgtgtagctgtgacc

SEQ ID NO: 2500179 - DNA, 17 bp, Homo sapiens
ctgtgtagctgtgacct

SEQ ID NO: 2500180 - DNA, 19 bp, Homo sapiens
ctgtgtagctgtgacctgc

SEQ ID NO: 2500181 - DNA, 14 bp, Homo sapiens
ctgtgtatttgctt

SEQ ID NO: 2500182 - DNA, 15 bp, Homo sapiens
ctgtgtatttgcttt

SEQ ID NO: 2500183 - DNA, 16 bp, Homo sapiens
ctgtgtatttgctttt

SEQ ID NO: 2500184 - DNA, 18 bp, Homo sapiens
ctgtgtgaatacctgctc

SEQ ID NO: 2500185 - DNA, 19 bp, Homo sapiens
ctgtgtgaatacctgctca

SEQ ID NO: 2500186 - DNA, 16 bp, Homo sapiens
ctgtgtggagagggaa

SEQ ID NO: 2500187 - DNA, 22 bp, Homo sapiens
ctgtgtggagagggaatgtgaa

SEQ ID NO: 2500188 - DNA, 15 bp, Homo sapiens
ctgtgtgtccaaaac

SEQ ID NO: 2500189 - DNA, 13 bp, Homo sapiens
ctgtgtgtgccct

SEQ ID NO: 2500190 - DNA, 20 bp, Homo sapiens
ctgtgtgtgccctctgggct

SEQ ID NO: 2500191 - DNA, 19 bp, Homo sapiens
cttggagctattttccagg

SEQ ID NO: 2500192 - DNA, 14 bp, Homo sapiens
cttggagctgagca

SEQ ID NO: 2500193 - DNA, 14 bp, Homo sapiens
cttggagctgtgag

SEQ ID NO: 2500194 - DNA, 20 bp, Homo sapiens
cttggcaccagacacccagg

SEQ ID NO: 2500195 - DNA, 16 bp, Homo sapiens
cttggccacagccagg

SEQ ID NO: 2500196 - DNA, 14 bp, Homo sapiens
cttggcctcccaag

SEQ ID NO: 2500197 - DNA, 15 bp, Homo sapiens
cttggcctggagcac

SEQ ID NO: 2500198 - DNA, 17 bp, Homo sapiens
cttggcgatgccagcca

SEQ ID NO: 2500199 - DNA, 22 bp, Homo sapiens
cttggctcgaatctctgtgcct

SEQ ID NO: 2500200 - DNA, 13 bp, Homo sapiens
cttggctgcagga

SEQ ID NO: 2500201 - DNA, 16 bp, Homo sapiens
cttggctggacccagc

SEQ ID NO: 2500202 - DNA, 19 bp, Homo sapiens
cttgggactaaatgccctg

SEQ ID NO: 2500203 - DNA, 17 bp, Homo sapiens
cttgggatttgctgtgt

SEQ ID NO: 2500204 - DNA, 17 bp, Homo sapiens
cttgggcacccccagcc

SEQ ID NO: 2500205 - DNA, 18 bp, Homo sapiens
cttgggcacccccagcct

SEQ ID NO: 2500206 - DNA, 21 bp, Homo sapiens
cttgggcacccccagcctggg

SEQ ID NO: 2500207 - DNA, 22 bp, Homo sapiens
cttgggcacccccagcctgggc

SEQ ID NO: 2500208 - DNA, 21 bp, Homo sapiens
cttgggcacgtgtgctgggat

SEQ ID NO: 2500209 - DNA, 14 bp, Homo sapiens
cttgggcagagctg

SEQ ID NO: 2500210 - DNA, 15 bp, Homo sapiens
cttgggcagagctgg

SEQ ID NO: 2500211 - DNA, 18 bp, Homo sapiens
cttgggcagagctggctc

SEQ ID NO: 2500212 - DNA, 23 bp, Homo sapiens
cttgggccagaagtaccagacta

SEQ ID NO: 2500213 - DNA, 17 bp, Homo sapiens
cttgggccctttgagtg

SEQ ID NO: 2500214 - DNA, 19 bp, Homo sapiens
cttgggccctttgagtgca

SEQ ID NO: 2500215 - DNA, 18 bp, Homo sapiens
cttgggctctgatgaaaa

SEQ ID NO: 2500216 - DNA, 22 bp, Homo sapiens
cttggggagttaagacctggca

SEQ ID NO: 2500217 - DNA, 23 bp, Homo sapiens
cttggggagttaagacctggcag

SEQ ID NO: 2500218 - DNA, 14 bp, Homo sapiens
cttgggggggtggc

SEQ ID NO: 2500219 - DNA, 16 bp, Homo sapiens
cttgggggggtggccg

SEQ ID NO: 2500220 - DNA, 13 bp, Homo sapiens
cttggggggtgat

SEQ ID NO: 2500221 - DNA, 16 bp, Homo sapiens
cttgggttagacctac

SEQ ID NO: 2500222 - DNA, 19 bp, Homo sapiens
cttgggttagacctacagg

SEQ ID NO: 2500223 - DNA, 16 bp, Homo sapiens
cttggttcccccactg

SEQ ID NO: 2500224 - DNA, 19 bp, Homo sapiens
cttggttcccccactgatc

SEQ ID NO: 2500225 - DNA, 16 bp, Homo sapiens
cttggttccttcccaa

SEQ ID NO: 2500226 - DNA, 22 bp, Homo sapiens
cttggttcttgaggggaccagg

SEQ ID NO: 2500227 - DNA, 14 bp, Homo sapiens
cttggttgaggaaa

SEQ ID NO: 2500228 - DNA, 19 bp, Homo sapiens
cttggttggtagggtggga

SEQ ID NO: 2500229 - DNA, 15 bp, Homo sapiens
cttggttgtctggca

SEQ ID NO: 2500230 - DNA, 20 bp, Homo sapiens
cttggtttttactgctctga

SEQ ID NO: 2500231 - DNA, 22 bp, Homo sapiens
cttggtttttactgctctgaga

SEQ ID NO: 2500232 - DNA, 14 bp, Homo sapiens
cttgtaaatataaa

SEQ ID NO: 2500233 - DNA, 17 bp, Homo sapiens
cttgtaaatataaagac

SEQ ID NO: 2500234 - DNA, 14 bp, Homo sapiens
cttgtaactaaaat

SEQ ID NO: 2500235 - DNA, 22 bp, Homo sapiens
cttgtaattttacacgcttttg

SEQ ID NO: 2500236 - DNA, 22 bp, Homo sapiens
cttgtaatttttttaatttaca

SEQ ID NO: 2500237 - DNA, 20 bp, Homo sapiens
cttgtacaattaattatctt

SEQ ID NO: 2500238 - DNA, 14 bp, Homo sapiens
cttgtagccagccg

SEQ ID NO: 2500239 - DNA, 15 bp, Homo sapiens
cttgtagccagccgg

SEQ ID NO: 2500240 - DNA, 23 bp, Homo sapiens
cttgtagctcctcccctggaggg

SEQ ID NO: 2500241 - DNA, 22 bp, Homo sapiens
cttgtaggggaggggctccttt

SEQ ID NO: 2500242 - DNA, 23 bp, Homo sapiens
cttgtaggggaggggctcctttc

SEQ ID NO: 2500243 - DNA, 20 bp, Homo sapiens
cttgtcaggagtgtgtgtga

SEQ ID NO: 2500244 - DNA, 17 bp, Homo sapiens
cttgtcatgtgtataaa

SEQ ID NO: 2500245 - DNA, 12 bp, Homo sapiens
cttgtccagctg

SEQ ID NO: 2500246 - DNA, 20 bp, Homo sapiens
cttgtcctagcacagatggc

SEQ ID NO: 2500247 - DNA, 17 bp, Homo sapiens
cttgtccttagcctgga

SEQ ID NO: 2500248 - DNA, 14 bp, Homo sapiens
cttgtcctttccct

SEQ ID NO: 2500249 - DNA, 20 bp, Homo sapiens
cttgtcttattcccttcctg

SEQ ID NO: 2500250 - DNA, 24 bp, Homo sapiens
cttgtgatgtcatacagagaagtc

SEQ ID NO: 2500251 - DNA, 17 bp, Homo sapiens
cttgtgccctccctgtc

SEQ ID NO: 2500252 - DNA, 20 bp, Homo sapiens
cttgtgccctccctgtcctt

SEQ ID NO: 2500253 - DNA, 16 bp, Homo sapiens
cttgtgggcctgggct

SEQ ID NO: 2500254 - DNA, 14 bp, Homo sapiens
cttgtggggcctgg

SEQ ID NO: 2500255 - DNA, 22 bp, Homo sapiens
cttgttggcgtaggctacagag

SEQ ID NO: 2500256 - DNA, 14 bp, Homo sapiens
cttgtttacatgct

SEQ ID NO: 2500257 - DNA, 22 bp, Homo sapiens
cttgtttacatgcttattccat

SEQ ID NO: 2500258 - DNA, 12 bp, Homo sapiens
cttgtttcaatt

SEQ ID NO: 2500259 - DNA, 16 bp, Homo sapiens
cttgtttgatttcaac

SEQ ID NO: 2500260 - DNA, 18 bp, Homo sapiens
cttgtttgatttcaacat

SEQ ID NO: 2500261 - DNA, 14 bp, Homo sapiens
cttgtttggggcag

SEQ ID NO: 2500262 - DNA, 14 bp, Homo sapiens
cttgttttggacag

SEQ ID NO: 2500263 - DNA, 13 bp, Homo sapiens
cttgttttggatg

SEQ ID NO: 2500264 - DNA, 16 bp, Homo sapiens
cttgtttttgcacatg

SEQ ID NO: 2500265 - DNA, 16 bp, Homo sapiens
ctttaaaatgtaaagc

SEQ ID NO: 2500266 - DNA, 21 bp, Homo sapiens
ctttaactcccattaccatgt

SEQ ID NO: 2500267 - DNA, 21 bp, Homo sapiens
ctttaactgccgtaatttaac

SEQ ID NO: 2500268 - DNA, 15 bp, Homo sapiens
ctttaatataaatgc

SEQ ID NO: 2500269 - DNA, 16 bp, Homo sapiens
ctttaatataaatgca

SEQ ID NO: 2500270 - DNA, 18 bp, Homo sapiens
ctttaatataaatgcaaa

SEQ ID NO: 2500271 - DNA, 22 bp, Homo sapiens
ctttaatgatatgcttgtaact

SEQ ID NO: 2500272 - DNA, 23 bp, Homo sapiens
ctttaatgttttttgccacagct

SEQ ID NO: 2500273 - DNA, 18 bp, Homo sapiens
ctttaattctgtatctgt

SEQ ID NO: 2500274 - DNA, 14 bp, Homo sapiens
ctttactgtgctta

SEQ ID NO: 2500275 - DNA, 21 bp, Homo sapiens
ctttagaatcccagccccctg

SEQ ID NO: 2500276 - DNA, 23 bp, Homo sapiens
ctttagaatcccagccccctgac

SEQ ID NO: 2500277 - DNA, 19 bp, Homo sapiens
ctttagatagccctgtcct

SEQ ID NO: 2500278 - DNA, 21 bp, Homo sapiens
ctttagatagccctgtcctgg

SEQ ID NO: 2500279 - DNA, 12 bp, Homo sapiens
ctttataagaaa

SEQ ID NO: 2500280 - DNA, 13 bp, Homo sapiens
ctttataagaaag

SEQ ID NO: 2500281 - DNA, 19 bp, Homo sapiens
ctttataagaaagcctgag

SEQ ID NO: 2500282 - DNA, 13 bp, Homo sapiens
ctttatgcttgca

SEQ ID NO: 2500283 - DNA, 20 bp, Homo sapiens
ctttatgtagtttttatatg

SEQ ID NO: 2500284 - DNA, 20 bp, Homo sapiens
ctttattccagaatgctgta

SEQ ID NO: 2500285 - DNA, 18 bp, Homo sapiens
ctttattccttcatttca

SEQ ID NO: 2500286 - DNA, 22 bp, Homo sapiens
ctttatttgttaatagttcctg

SEQ ID NO: 2500287 - DNA, 22 bp, Homo sapiens
ctttattttaacctttgataga

SEQ ID NO: 2500288 - DNA, 22 bp, Homo sapiens
ctttcaagcagtcgtgcctgtg

SEQ ID NO: 2500289 - DNA, 13 bp, Homo sapiens
ctttcacagctcc

SEQ ID NO: 2500290 - DNA, 16 bp, Homo sapiens
ctttcagaatatgtca

SEQ ID NO: 2500291 - DNA, 20 bp, Homo sapiens
ctttcagcaagacttctctt

SEQ ID NO: 2500292 - DNA, 13 bp, Homo sapiens
ctttcagctcctg

SEQ ID NO: 2500293 - DNA, 14 bp, Homo sapiens
ctttcagctcctga

SEQ ID NO: 2500294 - DNA, 18 bp, Homo sapiens
gaaattacctgtggatat

SEQ ID NO: 2500295 - DNA, 15 bp, Homo sapiens
gaaattcgtgtgttt

SEQ ID NO: 2500296 - DNA, 17 bp, Homo sapiens
gaaattgaacctttgtg

SEQ ID NO: 2500297 - DNA, 13 bp, Homo sapiens
gaaatttaaacta

SEQ ID NO: 2500298 - DNA, 23 bp, Homo sapiens
gaaatttaaactataagcaagaa

SEQ ID NO: 2500299 - DNA, 12 bp, Homo sapiens
gaaatttagcat

SEQ ID NO: 2500300 - DNA, 16 bp, Homo sapiens
gaaatttagcattgta

SEQ ID NO: 2500301 - DNA, 15 bp, Homo sapiens
gaacaagagaagcat

SEQ ID NO: 2500302 - DNA, 20 bp, Homo sapiens
gaacaattgaagtaaacttt

SEQ ID NO: 2500303 - DNA, 21 bp, Homo sapiens
gaacaccagagacctcaaatt

SEQ ID NO: 2500304 - DNA, 16 bp, Homo sapiens
gaacaccattgaaggc

SEQ ID NO: 2500305 - DNA, 16 bp, Homo sapiens
gaacaccctatatttt

SEQ ID NO: 2500306 - DNA, 18 bp, Homo sapiens
gaacacctatgcaaagat

SEQ ID NO: 2500307 - DNA, 14 bp, Homo sapiens
gaacacggccacat

SEQ ID NO: 2500308 - DNA, 15 bp, Homo sapiens
gaacactaattcata

SEQ ID NO: 2500309 - DNA, 20 bp, Homo sapiens
gaacactagacaagccagaa

SEQ ID NO: 2500310 - DNA, 18 bp, Homo sapiens
gaacactcttttgcttta

SEQ ID NO: 2500311 - DNA, 15 bp, Homo sapiens
gaacagctggtgtag

SEQ ID NO: 2500312 - DNA, 20 bp, Homo sapiens
gaacagggaaaataggcagg

SEQ ID NO: 2500313 - DNA, 21 bp, Homo sapiens
gaacagggaaaataggcagga

SEQ ID NO: 2500314 - DNA, 21 bp, Homo sapiens
gaacagtgtgcaaggcagccg

SEQ ID NO: 2500315 - DNA, 22 bp, Homo sapiens
gaacagtgtgcaaggcagccgt

SEQ ID NO: 2500316 - DNA, 22 bp, Homo sapiens
gaacataccccttacaaatgaa

SEQ ID NO: 2500317 - DNA, 16 bp, Homo sapiens
gaacatagacagaaga

SEQ ID NO: 2500318 - DNA, 19 bp, Homo sapiens
gaacatggcctaagggcca

SEQ ID NO: 2500319 - DNA, 21 bp, Homo sapiens
gaacattggaatgttctcaga

SEQ ID NO: 2500320 - DNA, 17 bp, Homo sapiens
gaaccaaatctggaagc

SEQ ID NO: 2500321 - DNA, 11 bp, Homo sapiens
gaaccagactc

SEQ ID NO: 2500322 - DNA, 16 bp, Homo sapiens
gaaccagactcttgcc

SEQ ID NO: 2500323 - DNA, 16 bp, Homo sapiens
gaacccagactcagac

SEQ ID NO: 2500324 - DNA, 16 bp, Homo sapiens
gaacccagcccacccc

SEQ ID NO: 2500325 - DNA, 17 bp, Homo sapiens
gaacccagcccaccccc

SEQ ID NO: 2500326 - DNA, 17 bp, Homo sapiens
gaaccccttcatcctct

SEQ ID NO: 2500327 - DNA, 16 bp, Homo sapiens
gaaccggagagccagc

SEQ ID NO: 2500328 - DNA, 18 bp, Homo sapiens
gaaccgttttgaagctac

SEQ ID NO: 2500329 - DNA, 18 bp, Homo sapiens
gaacctacagttttaact

SEQ ID NO: 2500330 - DNA, 21 bp, Homo sapiens
gaacctacagttttaactgtg

SEQ ID NO: 2500331 - DNA, 19 bp, Homo sapiens
gaacctcagcctggccaga

SEQ ID NO: 2500332 - DNA, 21 bp, Homo sapiens
gaacctcagcctggccagaca

SEQ ID NO: 2500333 - DNA, 12 bp, Homo sapiens
gaacctggcctt

SEQ ID NO: 2500334 - DNA, 13 bp, Homo sapiens
gaacctggccttc

SEQ ID NO: 2500335 - DNA, 21 bp, Homo sapiens
gaacctgggttgcagacagga

SEQ ID NO: 2500336 - DNA, 14 bp, Homo sapiens
gaacgttttctaat

SEQ ID NO: 2500337 - DNA, 16 bp, Homo sapiens
gaacgttttctaattg

SEQ ID NO: 2500338 - DNA, 20 bp, Homo sapiens
gaacgttttctaattgctta

SEQ ID NO: 2500339 - DNA, 19 bp, Homo sapiens
gaactaccttggttccccc

SEQ ID NO: 2500340 - DNA, 20 bp, Homo sapiens
gaactattttcaaagactta

SEQ ID NO: 2500341 - DNA, 19 bp, Homo sapiens
gaactcaaatggggccaga

SEQ ID NO: 2500342 - DNA, 14 bp, Homo sapiens
gaactcagatccag

SEQ ID NO: 2500343 - DNA, 15 bp, Homo sapiens
gaactcctgacctca

SEQ ID NO: 2500344 - DNA, 12 bp, Homo sapiens
gaactctgaaat

SEQ ID NO: 2500345 - DNA, 12 bp, Homo sapiens
gaactgaacacc

SEQ ID NO: 2500346 - DNA, 21 bp, Homo sapiens
gaactgaacaccattgaaggc

SEQ ID NO: 2500347 - DNA, 22 bp, Homo sapiens
gaactgaacaccattgaaggct

SEQ ID NO: 2500348 - DNA, 23 bp, Homo sapiens
gaactgaacaccattgaaggctt

SEQ ID NO: 2500349 - DNA, 19 bp, Homo sapiens
gaactgaagggggcggcct

SEQ ID NO: 2500350 - DNA, 16 bp, Homo sapiens
gaactgcaggccctgg

SEQ ID NO: 2500351 - DNA, 17 bp, Homo sapiens
gaactgcaggccctggc

SEQ ID NO: 2500352 - DNA, 14 bp, Homo sapiens
gaactgctgccact

SEQ ID NO: 2500353 - DNA, 15 bp, Homo sapiens
gaactgctgccactg

SEQ ID NO: 2500354 - DNA, 17 bp, Homo sapiens
gaactgctgccactgag

SEQ ID NO: 2500355 - DNA, 11 bp, Homo sapiens
gaactggaggc

SEQ ID NO: 2500356 - DNA, 18 bp, Homo sapiens
gaactggccaagctgagg

SEQ ID NO: 2500357 - DNA, 22 bp, Homo sapiens
gaacttgaaatatcctgcttga

SEQ ID NO: 2500358 - DNA, 22 bp, Homo sapiens
gaacttgcctgcctttccatcc

SEQ ID NO: 2500359 - DNA, 24 bp, Homo sapiens
gaacttgcgagaaattcgtgtgtt

SEQ ID NO: 2500360 - DNA, 20 bp, Homo sapiens
gaacttgtgtccctaatgtg

SEQ ID NO: 2500361 - DNA, 16 bp, Homo sapiens
gaactttttattgatt

SEQ ID NO: 2500362 - DNA, 13 bp, Homo sapiens
gaagaaaaagaag

SEQ ID NO: 2500363 - DNA, 14 bp, Homo sapiens
gaagaaagaagaca

SEQ ID NO: 2500364 - DNA, 15 bp, Homo sapiens
gaagaaagtggaaaa

SEQ ID NO: 2500365 - DNA, 19 bp, Homo sapiens
gaagaagtttcatcatttt

SEQ ID NO: 2500366 - DNA, 12 bp, Homo sapiens
gaagacaaactt

SEQ ID NO: 2500367 - DNA, 18 bp, Homo sapiens
gaagacaattgacaacag

SEQ ID NO: 2500368 - DNA, 13 bp, Homo sapiens
gaagacagtggcc

SEQ ID NO: 2500369 - DNA, 23 bp, Homo sapiens
gaagactatcttactatttcaca

SEQ ID NO: 2500370 - DNA, 15 bp, Homo sapiens
gaagactcctagctg

SEQ ID NO: 2500371 - DNA, 22 bp, Homo sapiens
gaagagccttccacccaggggc

SEQ ID NO: 2500372 - DNA, 14 bp, Homo sapiens
gaagatgactgagg

SEQ ID NO: 2500373 - DNA, 17 bp, Homo sapiens
gaagcaaatcgaatgaa

SEQ ID NO: 2500374 - DNA, 22 bp, Homo sapiens
gaagcaaatgtcatgctgcctt

SEQ ID NO: 2500375 - DNA, 22 bp, Homo sapiens
gaagcaacctcagtaatttaga

SEQ ID NO: 2500376 - DNA, 16 bp, Homo sapiens
gaagcattctcattgg

SEQ ID NO: 2500377 - DNA, 20 bp, Homo sapiens
gaagcattgtaaaataattc

SEQ ID NO: 2500378 - DNA, 13 bp, Homo sapiens
gaagccaaagagt

SEQ ID NO: 2500379 - DNA, 18 bp, Homo sapiens
gaagccaattcagacagg

SEQ ID NO: 2500380 - DNA, 20 bp, Homo sapiens
gaagccaattcagacaggca

SEQ ID NO: 2500381 - DNA, 19 bp, Homo sapiens
gaagccaggaatttcccag

SEQ ID NO: 2500382 - DNA, 18 bp, Homo sapiens
gaagccatcacctcagat

SEQ ID NO: 2500383 - DNA, 20 bp, Homo sapiens
gaagccatcacctcagatgg

SEQ ID NO: 2500384 - DNA, 13 bp, Homo sapiens
gaagcccagaggg

SEQ ID NO: 2500385 - DNA, 17 bp, Homo sapiens
gaagcccatcctgacca

SEQ ID NO: 2500386 - DNA, 20 bp, Homo sapiens
gaagcccccaccgtgggcag

SEQ ID NO: 2500387 - DNA, 17 bp, Homo sapiens
gaagcccggctcctggt

SEQ ID NO: 2500388 - DNA, 19 bp, Homo sapiens
gaagcccggctcctggtca

SEQ ID NO: 2500389 - DNA, 21 bp, Homo sapiens
gaagcccggctcctggtcacc

SEQ ID NO: 2500390 - DNA, 16 bp, Homo sapiens
gaagcctgggggcctg

SEQ ID NO: 2500391 - DNA, 19 bp, Homo sapiens
gaagcctgggggcctggct

SEQ ID NO: 2500392 - DNA, 22 bp, Homo sapiens
gaagcctgggggcctggctggc

SEQ ID NO: 2500393 - DNA, 10 bp, Homo sapiens
gaagccttcc

SEQ ID NO: 2500394 - DNA, 15 bp, Homo sapiens
gaagctaacagggaa

SEQ ID NO: 2500395 - DNA, 19 bp, Homo sapiens
gaagctaacagggaaggca

SEQ ID NO: 2500396 - DNA, 16 bp, Homo sapiens
gaagctaatttgcatt

SEQ ID NO: 2500397 - DNA, 15 bp, Homo sapiens
gaagctcccccagca

SEQ ID NO: 2500398 - DNA, 20 bp, Homo sapiens
gactgtaagttgggcttgct

SEQ ID NO: 2500399 - DNA, 23 bp, Homo sapiens
gactgtagggagggcggcagggg

SEQ ID NO: 2500400 - DNA, 21 bp, Homo sapiens
gactgttttctctcggctccc

SEQ ID NO: 2500401 - DNA, 13 bp, Homo sapiens
gacttccctgtgt

SEQ ID NO: 2500402 - DNA, 17 bp, Homo sapiens
gacttctattttaaaga

SEQ ID NO: 2500403 - DNA, 18 bp, Homo sapiens
gacttctctttgcctcaa

SEQ ID NO: 2500404 - DNA, 16 bp, Homo sapiens
gacttctgcctggaga

SEQ ID NO: 2500405 - DNA, 14 bp, Homo sapiens
gacttggctggtgt

SEQ ID NO: 2500406 - DNA, 18 bp, Homo sapiens
gacttgtgtcccatgatc

SEQ ID NO: 2500407 - DNA, 18 bp, Homo sapiens
gacttgttttatgctcag

SEQ ID NO: 2500408 - DNA, 15 bp, Homo sapiens
gacttgtttttgcac

SEQ ID NO: 2500409 - DNA, 18 bp, Homo sapiens
gacttgtttttgcacatg

SEQ ID NO: 2500410 - DNA, 21 bp, Homo sapiens
gactttacccatttgggtggg

SEQ ID NO: 2500411 - DNA, 17 bp, Homo sapiens
gactttatgtagttttt

SEQ ID NO: 2500412 - DNA, 12 bp, Homo sapiens
gactttccccac

SEQ ID NO: 2500413 - DNA, 12 bp, Homo sapiens
gactttctgcct

SEQ ID NO: 2500414 - DNA, 14 bp, Homo sapiens
gactttctgcctgg

SEQ ID NO: 2500415 - DNA, 19 bp, Homo sapiens
gactttctttttgtagctg

SEQ ID NO: 2500416 - DNA, 22 bp, Homo sapiens
gactttcttttttgatatagaa

SEQ ID NO: 2500417 - DNA, 17 bp, Homo sapiens
gactttgacaattactc

SEQ ID NO: 2500418 - DNA, 23 bp, Homo sapiens
gactttgacaattactcaggttt

SEQ ID NO: 2500419 - DNA, 12 bp, Homo sapiens
gacttttctgta

SEQ ID NO: 2500420 - DNA, 15 bp, Homo sapiens
gagaaaccagcttcc

SEQ ID NO: 2500421 - DNA, 14 bp, Homo sapiens
gagaaagctcaaag

SEQ ID NO: 2500422 - DNA, 17 bp, Homo sapiens
gagaaaggggagcccac

SEQ ID NO: 2500423 - DNA, 14 bp, Homo sapiens
gagaaatacaaaaa

SEQ ID NO: 2500424 - DNA, 15 bp, Homo sapiens
gagaaatacaaaaat

SEQ ID NO: 2500425 - DNA, 17 bp, Homo sapiens
gagaaattcgtgtgttt

SEQ ID NO: 2500426 - DNA, 20 bp, Homo sapiens
gagaacccagcccacccccg

SEQ ID NO: 2500427 - DNA, 13 bp, Homo sapiens
gagaacctggcct

SEQ ID NO: 2500428 - DNA, 21 bp, Homo sapiens
gagaacctgggttgcagacag

SEQ ID NO: 2500429 - DNA, 11 bp, Homo sapiens
gagaagccagc

SEQ ID NO: 2500430 - DNA, 13 bp, Homo sapiens
gagaagccagctt

SEQ ID NO: 2500431 - DNA, 20 bp, Homo sapiens
gagaagccagcttgtttaca

SEQ ID NO: 2500432 - DNA, 23 bp, Homo sapiens
gagaagccatcacctcagatggc

SEQ ID NO: 2500433 - DNA, 13 bp, Homo sapiens
gagaagccttcaa

SEQ ID NO: 2500434 - DNA, 16 bp, Homo sapiens
gagaagccttcaagct

SEQ ID NO: 2500435 - DNA, 16 bp, Homo sapiens
gagaagtcacagggca

SEQ ID NO: 2500436 - DNA, 17 bp, Homo sapiens
gagaagtcacagggcag

SEQ ID NO: 2500437 - DNA, 18 bp, Homo sapiens
gagaagtcacagggcagt

SEQ ID NO: 2500438 - DNA, 14 bp, Homo sapiens
gagaagtctcagct

SEQ ID NO: 2500439 - DNA, 18 bp, Homo sapiens
gagacatacttgaagggc

SEQ ID NO: 2500440 - DNA, 21 bp, Homo sapiens
gagacatacttgaagggccag

SEQ ID NO: 2500441 - DNA, 13 bp, Homo sapiens
gagaccagggctc

SEQ ID NO: 2500442 - DNA, 11 bp, Homo sapiens
gagacccagcg

SEQ ID NO: 2500443 - DNA, 15 bp, Homo sapiens
gagaccggcctgcca

SEQ ID NO: 2500444 - DNA, 18 bp, Homo sapiens
gagaccggcctgccagga

SEQ ID NO: 2500445 - DNA, 21 bp, Homo sapiens
gagaccggcctgccaggagga

SEQ ID NO: 2500446 - DNA, 13 bp, Homo sapiens
gagacctcagaag

SEQ ID NO: 2500447 - DNA, 19 bp, Homo sapiens
gagactccagacctgaggc

SEQ ID NO: 2500448 - DNA, 17 bp, Homo sapiens
gagactgggaaggcttg

SEQ ID NO: 2500449 - DNA, 17 bp, Homo sapiens
gagactgggctgaggga

SEQ ID NO: 2500450 - DNA, 20 bp, Homo sapiens
gagactgggctgagggagcc

SEQ ID NO: 2500451 - DNA, 21 bp, Homo sapiens
gagactgggctgagggagcct

SEQ ID NO: 2500452 - DNA, 17 bp, Homo sapiens
gagactgtgtgtgccct

SEQ ID NO: 2500453 - DNA, 21 bp, Homo sapiens
gagacttagggcaccaggggt

SEQ ID NO: 2500454 - DNA, 11 bp, Homo sapiens
gagacttgttt

SEQ ID NO: 2500455 - DNA, 21 bp, Homo sapiens
gagagaaataagtgccctctc

SEQ ID NO: 2500456 - DNA, 14 bp, Homo sapiens
gagagatcaaagat

SEQ ID NO: 2500457 - DNA, 16 bp, Homo sapiens
gagagccaccaagagg

SEQ ID NO: 2500458 - DNA, 22 bp, Homo sapiens
gagagccagctaaggggtgggg

SEQ ID NO: 2500459 - DNA, 13 bp, Homo sapiens
gagagccctggga

SEQ ID NO: 2500460 - DNA, 13 bp, Homo sapiens
gagagctaggagc

SEQ ID NO: 2500461 - DNA, 19 bp, Homo sapiens
gagagctaggagcaaagcc

SEQ ID NO: 2500462 - DNA, 21 bp, Homo sapiens
gagaggccctggatcagcgtg

SEQ ID NO: 2500463 - DNA, 24 bp, Homo sapiens
gagaggccctggatcagcgtggcc

SEQ ID NO: 2500464 - DNA, 14 bp, Homo sapiens
gagagggaatgtga

SEQ ID NO: 2500465 - DNA, 16 bp, Homo sapiens
gagagggcgcaggccg

SEQ ID NO: 2500466 - DNA, 20 bp, Homo sapiens
gagagggctcgaggggtggg

SEQ ID NO: 2500467 - DNA, 21 bp, Homo sapiens
gagagggctcgaggggtgggc

SEQ ID NO: 2500468 - DNA, 19 bp, Homo sapiens
gagagggggctggtgggtg

SEQ ID NO: 2500469 - DNA, 23 bp, Homo sapiens
gagaggtgggccagtctgtggat

SEQ ID NO: 2500470 - DNA, 13 bp, Homo sapiens
gagagtctagatt

SEQ ID NO: 2500471 - DNA, 13 bp, Homo sapiens
gagatacatacag

SEQ ID NO: 2500472 - DNA, 16 bp, Homo sapiens
gagatacatacagaat

SEQ ID NO: 2500473 - DNA, 16 bp, Homo sapiens
gagatagttttcatcc

SEQ ID NO: 2500474 - DNA, 22 bp, Homo sapiens
gagatccaaaagaagcccccag

SEQ ID NO: 2500475 - DNA, 13 bp, Homo sapiens
gagatcctcctgc

SEQ ID NO: 2500476 - DNA, 23 bp, Homo sapiens
gagatcctcctgcagaccacgcc

SEQ ID NO: 2500477 - DNA, 21 bp, Homo sapiens
gagatgcaccaccaagccaag

SEQ ID NO: 2500478 - DNA, 13 bp, Homo sapiens
gagatggtgaggc

SEQ ID NO: 2500479 - DNA, 17 bp, Homo sapiens
gagatgtgtgttgatac

SEQ ID NO: 2500480 - DNA, 23 bp, Homo sapiens
gagatgtgtgttgatactgttgc

SEQ ID NO: 2500481 - DNA, 21 bp, Homo sapiens
gagattctgcctttgccaggt

SEQ ID NO: 2500482 - DNA, 14 bp, Homo sapiens
gagattgaatttca

SEQ ID NO: 2500483 - DNA, 14 bp, Homo sapiens
gagattgacctgga

SEQ ID NO: 2500484 - DNA, 17 bp, Homo sapiens
gagatttattaaagaaa

SEQ ID NO: 2500485 - DNA, 22 bp, Homo sapiens
gagcaaagcctgttcatggcag

SEQ ID NO: 2500486 - DNA, 23 bp, Homo sapiens
gagcaaagcctgttcatggcaga

SEQ ID NO: 2500487 - DNA, 21 bp, Homo sapiens
gagcaaccgtggcccttcctg

SEQ ID NO: 2500488 - DNA, 18 bp, Homo sapiens
gagcaagcaggaatcaga

SEQ ID NO: 2500489 - DNA, 16 bp, Homo sapiens
gagcacaaagaccctg

SEQ ID NO: 2500490 - DNA, 15 bp, Homo sapiens
gagcacctgctgtct

SEQ ID NO: 2500491 - DNA, 13 bp, Homo sapiens
gagcacggctctg

SEQ ID NO: 2500492 - DNA, 13 bp, Homo sapiens
gagcactgcacct

SEQ ID NO: 2500493 - DNA, 16 bp, Homo sapiens
gagcactgccaggagg

SEQ ID NO: 2500494 - DNA, 20 bp, Homo sapiens
gagcactgccaggagggaca

SEQ ID NO: 2500495 - DNA, 12 bp, Homo sapiens
gagcagaagcag

SEQ ID NO: 2500496 - DNA, 17 bp, Homo sapiens
gagcagaaggggagatg

SEQ ID NO: 2500497 - DNA, 23 bp, Homo sapiens
gagcagactggcggggggcccat

SEQ ID NO: 2500498 - DNA, 14 bp, Homo sapiens
gagcagcacctcct

SEQ ID NO: 2500499 - DNA, 22 bp, Homo sapiens
gagcagcaggaggggggaggga

SEQ ID NO: 2500500 - DNA, 14 bp, Homo sapiens
gagcagctgagcag

SEQ ID NO: 2500501 - DNA, 16 bp, Homo sapiens
gagcaggactccaggc

SEQ ID NO: 2500502 - DNA, 17 bp, Homo sapiens
gatctggaacctcagcc

SEQ ID NO: 2500503 - DNA, 18 bp, Homo sapiens
gatctggaacctcagcct

SEQ ID NO: 2500504 - DNA, 20 bp, Homo sapiens
gatctggaacctcagcctgg

SEQ ID NO: 2500505 - DNA, 21 bp, Homo sapiens
gatctggaacctcagcctggc

SEQ ID NO: 2500506 - DNA, 23 bp, Homo sapiens
gatctggaacctcagcctggcca

SEQ ID NO: 2500507 - DNA, 15 bp, Homo sapiens
gatctgtcctcagcc

SEQ ID NO: 2500508 - DNA, 13 bp, Homo sapiens
gatctgtctgtgg

SEQ ID NO: 2500509 - DNA, 13 bp, Homo sapiens
gatctgttttgaa

SEQ ID NO: 2500510 - DNA, 17 bp, Homo sapiens
gatctgttttgaaggca

SEQ ID NO: 2500511 - DNA, 18 bp, Homo sapiens
gatctgttttgaaggcaa

SEQ ID NO: 2500512 - DNA, 21 bp, Homo sapiens
gatgaagagagagagggcctg

SEQ ID NO: 2500513 - DNA, 23 bp, Homo sapiens
gatgaagttttacattgttgagc

SEQ ID NO: 2500514 - DNA, 15 bp, Homo sapiens
gatgaatgccgtgga

SEQ ID NO: 2500515 - DNA, 16 bp, Homo sapiens
gatgaatgccgtggat

SEQ ID NO: 2500516 - DNA, 20 bp, Homo sapiens
gatgacctcgtactcaggag

SEQ ID NO: 2500517 - DNA, 12 bp, Homo sapiens
gatgagctccca

SEQ ID NO: 2500518 - DNA, 18 bp, Homo sapiens
gatgagctcccacaagcc

SEQ ID NO: 2500519 - DNA, 23 bp, Homo sapiens
gatgagctcccacaagcctgagg

SEQ ID NO: 2500520 - DNA, 12 bp, Homo sapiens
gatgagggcagc

SEQ ID NO: 2500521 - DNA, 16 bp, Homo sapiens
gatgagggcagcagcc

SEQ ID NO: 2500522 - DNA, 18 bp, Homo sapiens
gatgagggcagcagccag

SEQ ID NO: 2500523 - DNA, 16 bp, Homo sapiens
gatgataaacgacttt

SEQ ID NO: 2500524 - DNA, 19 bp, Homo sapiens
gatgatactaataaactaa

SEQ ID NO: 2500525 - DNA, 19 bp, Homo sapiens
gatgattgacaacacccat

SEQ ID NO: 2500526 - DNA, 15 bp, Homo sapiens
gatgcagggcagtca

SEQ ID NO: 2500527 - DNA, 19 bp, Homo sapiens
gatgcatttgggtccagga

SEQ ID NO: 2500528 - DNA, 20 bp, Homo sapiens
gatgcatttgggtccaggag

SEQ ID NO: 2500529 - DNA, 19 bp, Homo sapiens
gatgccaaaaaaaaataca

SEQ ID NO: 2500530 - DNA, 16 bp, Homo sapiens
gatgctccaagattct

SEQ ID NO: 2500531 - DNA, 17 bp, Homo sapiens
gatgctggcccagggcc

SEQ ID NO: 2500532 - DNA, 23 bp, Homo sapiens
gatgctggcccagggcccagagc

SEQ ID NO: 2500533 - DNA, 15 bp, Homo sapiens
gatggagtgctgttt

SEQ ID NO: 2500534 - DNA, 17 bp, Homo sapiens
gatggagtttctaaggt

SEQ ID NO: 2500535 - DNA, 15 bp, Homo sapiens
gatggcaacagatct

SEQ ID NO: 2500536 - DNA, 17 bp, Homo sapiens
gatggcaacagatctgg

SEQ ID NO: 2500537 - DNA, 22 bp, Homo sapiens
gatggcaacagatctggaacct

SEQ ID NO: 2500538 - DNA, 13 bp, Homo sapiens
gatggccagcccc

SEQ ID NO: 2500539 - DNA, 14 bp, Homo sapiens
gatggcccatcctg

SEQ ID NO: 2500540 - DNA, 12 bp, Homo sapiens
gatggccccagc

SEQ ID NO: 2500541 - DNA, 15 bp, Homo sapiens
gatggccccagcaca

SEQ ID NO: 2500542 - DNA, 22 bp, Homo sapiens
gatgggacattccaaagaacag

SEQ ID NO: 2500543 - DNA, 19 bp, Homo sapiens
gatgggatggtggagggcc

SEQ ID NO: 2500544 - DNA, 22 bp, Homo sapiens
gatgggcatggtgttctcctgc

SEQ ID NO: 2500545 - DNA, 13 bp, Homo sapiens
gatgggcttccca

SEQ ID NO: 2500546 - DNA, 15 bp, Homo sapiens
gatgggcttcccaag

SEQ ID NO: 2500547 - DNA, 22 bp, Homo sapiens
gatgggggaactcagatccagg

SEQ ID NO: 2500548 - DNA, 23 bp, Homo sapiens
gatggggtctcacagtgttgccc

SEQ ID NO: 2500549 - DNA, 17 bp, Homo sapiens
gatggtagttttttcat

SEQ ID NO: 2500550 - DNA, 15 bp, Homo sapiens
gatggtggagggcca

SEQ ID NO: 2500551 - DNA, 16 bp, Homo sapiens
gatgtaaaatcttgtc

SEQ ID NO: 2500552 - DNA, 12 bp, Homo sapiens
gatgtaaagatg

SEQ ID NO: 2500553 - DNA, 13 bp, Homo sapiens
gatgtaatacttc

SEQ ID NO: 2500554 - DNA, 22 bp, Homo sapiens
gatgtaatacttcttgtgtgta

SEQ ID NO: 2500555 - DNA, 19 bp, Homo sapiens
gatgtaattttgtgtaaga

SEQ ID NO: 2500556 - DNA, 19 bp, Homo sapiens
gatgtaccagtttgtccat

SEQ ID NO: 2500557 - DNA, 13 bp, Homo sapiens
gatgtaggaggga

SEQ ID NO: 2500558 - DNA, 14 bp, Homo sapiens
gatgtaggagggac

SEQ ID NO: 2500559 - DNA, 18 bp, Homo sapiens
gatgtcatacagagaagt

SEQ ID NO: 2500560 - DNA, 20 bp, Homo sapiens
gatgtcatacagagaagtca

SEQ ID NO: 2500561 - DNA, 19 bp, Homo sapiens
gatgtctcctaagcacctg

SEQ ID NO: 2500562 - DNA, 22 bp, Homo sapiens
gatgtcttggaacattggaatg

SEQ ID NO: 2500563 - DNA, 12 bp, Homo sapiens
gatgtctttgtt

SEQ ID NO: 2500564 - DNA, 15 bp, Homo sapiens
gatgtgatattctaa

SEQ ID NO: 2500565 - DNA, 18 bp, Homo sapiens
gatgtgattgtggaatgg

SEQ ID NO: 2500566 - DNA, 19 bp, Homo sapiens
gatgtgcacgtaaagtact

SEQ ID NO: 2500567 - DNA, 19 bp, Homo sapiens
gatgtggaactgctgccac

SEQ ID NO: 2500568 - DNA, 21 bp, Homo sapiens
gatgtggaactgctgccactg

SEQ ID NO: 2500569 - DNA, 17 bp, Homo sapiens
gatgtggtcacagctgt

SEQ ID NO: 2500570 - DNA, 13 bp, Homo sapiens
gatgtgtcctgac

SEQ ID NO: 2500571 - DNA, 12 bp, Homo sapiens
gatgtgtgttga

SEQ ID NO: 2500572 - DNA, 14 bp, Homo sapiens
gatgtgtgttgata

SEQ ID NO: 2500573 - DNA, 23 bp, Homo sapiens
gatgtgtgttgatactgttgcac

SEQ ID NO: 2500574 - DNA, 19 bp, Homo sapiens
gatgttcagcactgtccct

SEQ ID NO: 2500575 - DNA, 13 bp, Homo sapiens
gatgttctaaggc

SEQ ID NO: 2500576 - DNA, 14 bp, Homo sapiens
gatgttctaaggct

SEQ ID NO: 2500577 - DNA, 18 bp, Homo sapiens
gatgtttattcttctaga

SEQ ID NO: 2500578 - DNA, 23 bp, Homo sapiens
gatgtttattcttctagagttca

SEQ ID NO: 2500579 - DNA, 20 bp, Homo sapiens
gattaaagatgagctttgtc

SEQ ID NO: 2500580 - DNA, 16 bp, Homo sapiens
gattaaataagattct

SEQ ID NO: 2500581 - DNA, 20 bp, Homo sapiens
gattagaaattacctgtgga

SEQ ID NO: 2500582 - DNA, 22 bp, Homo sapiens
gattagaaattacctgtggata

SEQ ID NO: 2500583 - DNA, 19 bp, Homo sapiens
gattagacagaacacctat

SEQ ID NO: 2500584 - DNA, 14 bp, Homo sapiens
gattatagattcta

SEQ ID NO: 2500585 - DNA, 13 bp, Homo sapiens
gattatcgttttc

SEQ ID NO: 2500586 - DNA, 18 bp, Homo sapiens
gattatgggtcacaggaa

SEQ ID NO: 2500587 - DNA, 19 bp, Homo sapiens
gattatgtagcaaaataca

SEQ ID NO: 2500588 - DNA, 13 bp, Homo sapiens
gattcaaaggttc

SEQ ID NO: 2500589 - DNA, 18 bp, Homo sapiens
gattcagaaatgaggcca

SEQ ID NO: 2500590 - DNA, 22 bp, Homo sapiens
gattcagttttcatttggttca

SEQ ID NO: 2500591 - DNA, 18 bp, Homo sapiens
gattccaaagagtagaat

SEQ ID NO: 2500592 - DNA, 19 bp, Homo sapiens
gattccaaagagtagaatt

SEQ ID NO: 2500593 - DNA, 17 bp, Homo sapiens
gattccccatctcaggc

SEQ ID NO: 2500594 - DNA, 19 bp, Homo sapiens
gattccctctcccaggccc

SEQ ID NO: 2500595 - DNA, 12 bp, Homo sapiens
gattccttccca

SEQ ID NO: 2500596 - DNA, 14 bp, Homo sapiens
gattcctttaacaa

SEQ ID NO: 2500597 - DNA, 17 bp, Homo sapiens
gattcggtatcccccca

SEQ ID NO: 2500598 - DNA, 22 bp, Homo sapiens
gattctaaaatgtgatgttcta

SEQ ID NO: 2500599 - DNA, 17 bp, Homo sapiens
gattctaaagattctat

SEQ ID NO: 2500600 - DNA, 15 bp, Homo sapiens
gattctaaaggtcca

SEQ ID NO: 2500601 - DNA, 15 bp, Homo sapiens
gattctaatgatgat

SEQ ID NO: 2500602 - DNA, 18 bp, Homo sapiens
gattctatagttctagac

SEQ ID NO: 2500603 - DNA, 21 bp, Homo sapiens
gattctatttatatgtacatg

SEQ ID NO: 2500604 - DNA, 23 bp, Homo sapiens
gattctctgtgtctaagattcta

SEQ ID NO: 2500605 - DNA, 12 bp, Homo sapiens
gattctgccttt

SEQ ID NO: 2500606 - DNA, 17 bp, Homo sapiens
gcagggcgggcagaggg

SEQ ID NO: 2500607 - DNA, 14 bp, Homo sapiens
gcagggctctcctg

SEQ ID NO: 2500608 - DNA, 16 bp, Homo sapiens
gcaggggcctggagat

SEQ ID NO: 2500609 - DNA, 17 bp, Homo sapiens
gcaggtgctggtcccgg

SEQ ID NO: 2500610 - DNA, 18 bp, Homo sapiens
gcaggtggccaagttcct

SEQ ID NO: 2500611 - DNA, 21 bp, Homo sapiens
gcaggtggccaagttcctcta

SEQ ID NO: 2500612 - DNA, 17 bp, Homo sapiens
gcaggtggggagactgg

SEQ ID NO: 2500613 - DNA, 13 bp, Homo sapiens
gcaggttcccaag

SEQ ID NO: 2500614 - DNA, 18 bp, Homo sapiens
gcaggttcccaagctcag

SEQ ID NO: 2500615 - DNA, 21 bp, Homo sapiens
gcagtagaggctatggacagg

SEQ ID NO: 2500616 - DNA, 22 bp, Homo sapiens
gcagtcactctagtcaatgaca

SEQ ID NO: 2500617 - DNA, 19 bp, Homo sapiens
gcagtcattatccaggtaa

SEQ ID NO: 2500618 - DNA, 20 bp, Homo sapiens
gcagtccacttctgacagcc

SEQ ID NO: 2500619 - DNA, 14 bp, Homo sapiens
gcagtccccttccc

SEQ ID NO: 2500620 - DNA, 18 bp, Homo sapiens
gcagtccttggcctgcta

SEQ ID NO: 2500621 - DNA, 13 bp, Homo sapiens
gcagtcgtgcctg

SEQ ID NO: 2500622 - DNA, 17 bp, Homo sapiens
gcagtcgtgcctgtgtc

SEQ ID NO: 2500623 - DNA, 19 bp, Homo sapiens
gcagtcgtgcctgtgtcca

SEQ ID NO: 2500624 - DNA, 13 bp, Homo sapiens
gcagtgcttttgg

SEQ ID NO: 2500625 - DNA, 23 bp, Homo sapiens
gcagtggatggccgtgaatgggt

SEQ ID NO: 2500626 - DNA, 12 bp, Homo sapiens
gcagtggcctta

SEQ ID NO: 2500627 - DNA, 18 bp, Homo sapiens
gcagtggctggtccaggg

SEQ ID NO: 2500628 - DNA, 15 bp, Homo sapiens
gcagtgtgaggccag

SEQ ID NO: 2500629 - DNA, 19 bp, Homo sapiens
gcagtgtgaggccagggca

SEQ ID NO: 2500630 - DNA, 14 bp, Homo sapiens
gcagttaccattaa

SEQ ID NO: 2500631 - DNA, 15 bp, Homo sapiens
gcagttaccattaaa

SEQ ID NO: 2500632 - DNA, 18 bp, Homo sapiens
gcagttaccattaaacca

SEQ ID NO: 2500633 - DNA, 22 bp, Homo sapiens
gcagttcccacattaaagaaga

SEQ ID NO: 2500634 - DNA, 17 bp, Homo sapiens
gcagttcgactctgtgc

SEQ ID NO: 2500635 - DNA, 17 bp, Homo sapiens
gcagttgagacaagaaa

SEQ ID NO: 2500636 - DNA, 18 bp, Homo sapiens
gcagtttatatttaactc

SEQ ID NO: 2500637 - DNA, 14 bp, Homo sapiens
gcagtttatcattc

SEQ ID NO: 2500638 - DNA, 16 bp, Homo sapiens
gcagtttatcattcaa

SEQ ID NO: 2500639 - DNA, 16 bp, Homo sapiens
gcagtttgcaaaaaat

SEQ ID NO: 2500640 - DNA, 17 bp, Homo sapiens
gcataacaattcctcta

SEQ ID NO: 2500641 - DNA, 19 bp, Homo sapiens
gcataacctgtctcacctg

SEQ ID NO: 2500642 - DNA, 20 bp, Homo sapiens
gcatacaagtttcattctcc

SEQ ID NO: 2500643 - DNA, 22 bp, Homo sapiens
gcatagctactaaaatcagtga

SEQ ID NO: 2500644 - DNA, 16 bp, Homo sapiens
gcatatagattgtcct

SEQ ID NO: 2500645 - DNA, 13 bp, Homo sapiens
gcatatcataatg

SEQ ID NO: 2500646 - DNA, 18 bp, Homo sapiens
gcatatgttgaatacttt

SEQ ID NO: 2500647 - DNA, 20 bp, Homo sapiens
gcatatgttgaatacttttt

SEQ ID NO: 2500648 - DNA, 19 bp, Homo sapiens
gcatcagaaagggagggct

SEQ ID NO: 2500649 - DNA, 22 bp, Homo sapiens
gcatcagaaagggagggctctg

SEQ ID NO: 2500650 - DNA, 22 bp, Homo sapiens
gcatcagactgtgaaccccacg

SEQ ID NO: 2500651 - DNA, 12 bp, Homo sapiens
gcatcatgcctc

SEQ ID NO: 2500652 - DNA, 16 bp, Homo sapiens
gcatcatgcctctgag

SEQ ID NO: 2500653 - DNA, 17 bp, Homo sapiens
gcatcattatttatgta

SEQ ID NO: 2500654 - DNA, 20 bp, Homo sapiens
gcatcattatttatgtattg

SEQ ID NO: 2500655 - DNA, 12 bp, Homo sapiens
gcatccctgggc

SEQ ID NO: 2500656 - DNA, 18 bp, Homo sapiens
gcatccctgggccttggg

SEQ ID NO: 2500657 - DNA, 19 bp, Homo sapiens
gcatccctgggccttgggc

SEQ ID NO: 2500658 - DNA, 18 bp, Homo sapiens
gcatccgcaggtgctggt

SEQ ID NO: 2500659 - DNA, 14 bp, Homo sapiens
gcatcctccagccc

SEQ ID NO: 2500660 - DNA, 18 bp, Homo sapiens
gcatcctctggagccagc

SEQ ID NO: 2500661 - DNA, 18 bp, Homo sapiens
gcatcgcaccattctgac

SEQ ID NO: 2500662 - DNA, 20 bp, Homo sapiens
gcatcgcaccattctgactc

SEQ ID NO: 2500663 - DNA, 19 bp, Homo sapiens
gcatctcaaaacagagggc

SEQ ID NO: 2500664 - DNA, 17 bp, Homo sapiens
gcatctccaagcagctt

SEQ ID NO: 2500665 - DNA, 13 bp, Homo sapiens
gcatctctgggct

SEQ ID NO: 2500666 - DNA, 14 bp, Homo sapiens
gcatctctgggctg

SEQ ID NO: 2500667 - DNA, 20 bp, Homo sapiens
gcatctctgggctggatgag

SEQ ID NO: 2500668 - DNA, 23 bp, Homo sapiens
gcatctctgggctggatgagctc

SEQ ID NO: 2500669 - DNA, 16 bp, Homo sapiens
gcatctggagagaaca

SEQ ID NO: 2500670 - DNA, 21 bp, Homo sapiens
gcatctgggccttggcctgga

SEQ ID NO: 2500671 - DNA, 16 bp, Homo sapiens
gcatctgtcccccttt

SEQ ID NO: 2500672 - DNA, 22 bp, Homo sapiens
gcatcttgggggggtggccgct

SEQ ID NO: 2500673 - DNA, 23 bp, Homo sapiens
gcatgaaaaatcatgggccagag

SEQ ID NO: 2500674 - DNA, 14 bp, Homo sapiens
gcatgagaaataca

SEQ ID NO: 2500675 - DNA, 17 bp, Homo sapiens
gcatgaggggttcctcc

SEQ ID NO: 2500676 - DNA, 20 bp, Homo sapiens
gcatgaggggttcctcccct

SEQ ID NO: 2500677 - DNA, 22 bp, Homo sapiens
gcatgaggggttcctcccctcc

SEQ ID NO: 2500678 - DNA, 16 bp, Homo sapiens
gcatgcactgttcccc

SEQ ID NO: 2500679 - DNA, 21 bp, Homo sapiens
gcatgcactgttccccctgtg

SEQ ID NO: 2500680 - DNA, 17 bp, Homo sapiens
gcatggaaatttaaagc

SEQ ID NO: 2500681 - DNA, 18 bp, Homo sapiens
gcatggacaatggaccgg

SEQ ID NO: 2500682 - DNA, 15 bp, Homo sapiens
gcatggaggaggagg

SEQ ID NO: 2500683 - DNA, 19 bp, Homo sapiens
gcatggcatcctccagccc

SEQ ID NO: 2500684 - DNA, 21 bp, Homo sapiens
gcatggcatcctccagcccct

SEQ ID NO: 2500685 - DNA, 18 bp, Homo sapiens
gcatggtgccccaggacc

SEQ ID NO: 2500686 - DNA, 19 bp, Homo sapiens
gcatggtgccccaggacca

SEQ ID NO: 2500687 - DNA, 20 bp, Homo sapiens
gcatggtgccccaggaccag

SEQ ID NO: 2500688 - DNA, 15 bp, Homo sapiens
gcatggtgttctcct

SEQ ID NO: 2500689 - DNA, 18 bp, Homo sapiens
gcatggtgttctcctgct

SEQ ID NO: 2500690 - DNA, 13 bp, Homo sapiens
gcatgtagtaaca

SEQ ID NO: 2500691 - DNA, 17 bp, Homo sapiens
gcatgttgtctaagaaa

SEQ ID NO: 2500692 - DNA, 22 bp, Homo sapiens
gcatgtttagactttaacataa

SEQ ID NO: 2500693 - DNA, 18 bp, Homo sapiens
gcattagaattatttaaa

SEQ ID NO: 2500694 - DNA, 16 bp, Homo sapiens
gcattcagaagaaaaa

SEQ ID NO: 2500695 - DNA, 18 bp, Homo sapiens
gcattcagaagaaaaaga

SEQ ID NO: 2500696 - DNA, 19 bp, Homo sapiens
gcattccagcccctctggt

SEQ ID NO: 2500697 - DNA, 13 bp, Homo sapiens
gcattcccaggta

SEQ ID NO: 2500698 - DNA, 20 bp, Homo sapiens
gcattcccaggtaggccaag

SEQ ID NO: 2500699 - DNA, 13 bp, Homo sapiens
gcattcttctctg

SEQ ID NO: 2500700 - DNA, 19 bp, Homo sapiens
gcattgaatggctatgttt

SEQ ID NO: 2500701 - DNA, 12 bp, Homo sapiens
gcattgactttc

SEQ ID NO: 2500702 - DNA, 18 bp, Homo sapiens
gcattggatattttttac

SEQ ID NO: 2500703 - DNA, 20 bp, Homo sapiens
gcattgtaaaagcattttgt

SEQ ID NO: 2500704 - DNA, 22 bp, Homo sapiens
gcattgtgattggcctgtagag

SEQ ID NO: 2500705 - DNA, 21 bp, Homo sapiens
gcatttaacccccctgtacac

SEQ ID NO: 2500706 - DNA, 21 bp, Homo sapiens
gcatttcctatcacctatttc

SEQ ID NO: 2500707 - DNA, 17 bp, Homo sapiens
gcatttgggtccaggag

SEQ ID NO: 2500708 - DNA, 18 bp, Homo sapiens
gcatttgtttatgtaatt

SEQ ID NO: 2500709 - DNA, 19 bp, Homo sapiens
gccccaccccagggcagcc

SEQ ID NO: 2500710 - DNA, 12 bp, Homo sapiens
gccccaccctcg

SEQ ID NO: 2500711 - DNA, 16 bp, Homo sapiens
gccccaccctcgggga

SEQ ID NO: 2500712 - DNA, 16 bp, Homo sapiens
gccccaccctgggccc

SEQ ID NO: 2500713 - DNA, 22 bp, Homo sapiens
gccccaccctgggccctgggct

SEQ ID NO: 2500714 - DNA, 23 bp, Homo sapiens
gccccaccctgggccctgggctg

SEQ ID NO: 2500715 - DNA, 24 bp, Homo sapiens
gccccaccctgggccctgggctgg

SEQ ID NO: 2500716 - DNA, 12 bp, Homo sapiens
gccccactcctc

SEQ ID NO: 2500717 - DNA, 16 bp, Homo sapiens
gccccacttgtcctta

SEQ ID NO: 2500718 - DNA, 20 bp, Homo sapiens
gccccagcacagcttgacct

SEQ ID NO: 2500719 - DNA, 18 bp, Homo sapiens
gccccagcctccctgaag

SEQ ID NO: 2500720 - DNA, 21 bp, Homo sapiens
gccccagcctccctgaagcct

SEQ ID NO: 2500721 - DNA, 12 bp, Homo sapiens
gccccaggacca

SEQ ID NO: 2500722 - DNA, 22 bp, Homo sapiens
gccccaggaccagctcaggaca

SEQ ID NO: 2500723 - DNA, 23 bp, Homo sapiens
gccccaggaccagctcaggacag

SEQ ID NO: 2500724 - DNA, 19 bp, Homo sapiens
gccccaggctcgtggactg

SEQ ID NO: 2500725 - DNA, 18 bp, Homo sapiens
gccccatgacctccagct

SEQ ID NO: 2500726 - DNA, 20 bp, Homo sapiens
gcccccaaggaggcagcctg

SEQ ID NO: 2500727 - DNA, 11 bp, Homo sapiens
gcccccaccct

SEQ ID NO: 2500728 - DNA, 23 bp, Homo sapiens
gcccccaccctgttcctgctgct

SEQ ID NO: 2500729 - DNA, 17 bp, Homo sapiens
gcccccactgaccagaa

SEQ ID NO: 2500730 - DNA, 21 bp, Homo sapiens
gcccccacttgcctcttcctt

SEQ ID NO: 2500731 - DNA, 19 bp, Homo sapiens
gcccccagagcccaggctc

SEQ ID NO: 2500732 - DNA, 22 bp, Homo sapiens
gcccccagcccagggctcctgc

SEQ ID NO: 2500733 - DNA, 21 bp, Homo sapiens
gcccccagcctgtcagatcca

SEQ ID NO: 2500734 - DNA, 18 bp, Homo sapiens
gcccccctggtcccctcc

SEQ ID NO: 2500735 - DNA, 23 bp, Homo sapiens
gccccctcacagtattgctcacc

SEQ ID NO: 2500736 - DNA, 15 bp, Homo sapiens
gccccctccctggat

SEQ ID NO: 2500737 - DNA, 16 bp, Homo sapiens
gccccctccctggatg

SEQ ID NO: 2500738 - DNA, 16 bp, Homo sapiens
gccccctccgccctgc

SEQ ID NO: 2500739 - DNA, 22 bp, Homo sapiens
gccccctccgccctgccactca

SEQ ID NO: 2500740 - DNA, 16 bp, Homo sapiens
gccccctcctctagct

SEQ ID NO: 2500741 - DNA, 19 bp, Homo sapiens
gccccctgaccactcagag

SEQ ID NO: 2500742 - DNA, 14 bp, Homo sapiens
gccccctgcccccc

SEQ ID NO: 2500743 - DNA, 15 bp, Homo sapiens
gccccctgctgccat

SEQ ID NO: 2500744 - DNA, 16 bp, Homo sapiens
gccccctgtctctcag

SEQ ID NO: 2500745 - DNA, 21 bp, Homo sapiens
gcccctcatctctctgcccaa

SEQ ID NO: 2500746 - DNA, 17 bp, Homo sapiens
gcccctcccctccaaaa

SEQ ID NO: 2500747 - DNA, 20 bp, Homo sapiens
gcccctccctcccagagcac

SEQ ID NO: 2500748 - DNA, 14 bp, Homo sapiens
gcccctctcaccaa

SEQ ID NO: 2500749 - DNA, 14 bp, Homo sapiens
gcccctctcagccc

SEQ ID NO: 2500750 - DNA, 20 bp, Homo sapiens
gcccctctggtcgctcctgc

SEQ ID NO: 2500751 - DNA, 22 bp, Homo sapiens
gcccctcttggagaagtctcag

SEQ ID NO: 2500752 - DNA, 21 bp, Homo sapiens
gcccctgccattgtagcgtct

SEQ ID NO: 2500753 - DNA, 23 bp, Homo sapiens
gcccctggcagagatgcctccct

SEQ ID NO: 2500754 - DNA, 14 bp, Homo sapiens
gcccctggctggga

SEQ ID NO: 2500755 - DNA, 23 bp, Homo sapiens
gcccctggctgggacgtggctca

SEQ ID NO: 2500756 - DNA, 14 bp, Homo sapiens
gccccttctgctca

SEQ ID NO: 2500757 - DNA, 21 bp, Homo sapiens
gcccctttcccttgtagctcc

SEQ ID NO: 2500758 - DNA, 23 bp, Homo sapiens
gcccctttcccttgtagctcctc

SEQ ID NO: 2500759 - DNA, 14 bp, Homo sapiens
gcccgagcagctga

SEQ ID NO: 2500760 - DNA, 16 bp, Homo sapiens
gcccgagcagctgagc

SEQ ID NO: 2500761 - DNA, 18 bp, Homo sapiens
gcccgagcagctgagcag

SEQ ID NO: 2500762 - DNA, 19 bp, Homo sapiens
gcccgagcagctgagcagg

SEQ ID NO: 2500763 - DNA, 21 bp, Homo sapiens
gcccgaggaggtgtctcaggc

SEQ ID NO: 2500764 - DNA, 22 bp, Homo sapiens
gcccgaggaggtgtctcaggct

SEQ ID NO: 2500765 - DNA, 13 bp, Homo sapiens
gcccgcacacctg

SEQ ID NO: 2500766 - DNA, 22 bp, Homo sapiens
gcccggatgcagaggcctgcag

SEQ ID NO: 2500767 - DNA, 15 bp, Homo sapiens
gcccggcagggcggg

SEQ ID NO: 2500768 - DNA, 18 bp, Homo sapiens
gcccggctaatttttgta

SEQ ID NO: 2500769 - DNA, 14 bp, Homo sapiens
gcccggctcctggt

SEQ ID NO: 2500770 - DNA, 15 bp, Homo sapiens
gcccggctcctggtc

SEQ ID NO: 2500771 - DNA, 16 bp, Homo sapiens
gcccgtcctgcctgtg

SEQ ID NO: 2500772 - DNA, 20 bp, Homo sapiens
gcccgtgtaaatatgtacat

SEQ ID NO: 2500773 - DNA, 12 bp, Homo sapiens
gccctaagcaga

SEQ ID NO: 2500774 - DNA, 15 bp, Homo sapiens
gccctacagcaccct

SEQ ID NO: 2500775 - DNA, 21 bp, Homo sapiens
gccctacctgccccacttgtc

SEQ ID NO: 2500776 - DNA, 22 bp, Homo sapiens
gccctcatggcccctctgacct

SEQ ID NO: 2500777 - DNA, 16 bp, Homo sapiens
gccctccacacctgcg

SEQ ID NO: 2500778 - DNA, 20 bp, Homo sapiens
gccctccctgttccccagag

SEQ ID NO: 2500779 - DNA, 14 bp, Homo sapiens
gccctcgctgccag

SEQ ID NO: 2500780 - DNA, 15 bp, Homo sapiens
gccctcgctgccagc

SEQ ID NO: 2500781 - DNA, 23 bp, Homo sapiens
gccctcgtggtggaaacttttct

SEQ ID NO: 2500782 - DNA, 13 bp, Homo sapiens
gccctctcccacc

SEQ ID NO: 2500783 - DNA, 16 bp, Homo sapiens
gccctctcccaccctc

SEQ ID NO: 2500784 - DNA, 15 bp, Homo sapiens
gccctctcccctgcc

SEQ ID NO: 2500785 - DNA, 17 bp, Homo sapiens
gccctctcccctgcccc

SEQ ID NO: 2500786 - DNA, 18 bp, Homo sapiens
gccctctcccctgccccc

SEQ ID NO: 2500787 - DNA, 20 bp, Homo sapiens
gccctctgcatcctctggag

SEQ ID NO: 2500788 - DNA, 21 bp, Homo sapiens
gccctctgcatcctctggagc

SEQ ID NO: 2500789 - DNA, 15 bp, Homo sapiens
gccctctgggctctg

SEQ ID NO: 2500790 - DNA, 21 bp, Homo sapiens
gccctgagccagggtctccag

SEQ ID NO: 2500791 - DNA, 22 bp, Homo sapiens
gccctgagccagggtctccaga

SEQ ID NO: 2500792 - DNA, 17 bp, Homo sapiens
gccctgaggacagatgc

SEQ ID NO: 2500793 - DNA, 13 bp, Homo sapiens
gccctgatcccag

SEQ ID NO: 2500794 - DNA, 21 bp, Homo sapiens
gccctgcaccatgctgctggg

SEQ ID NO: 2500795 - DNA, 16 bp, Homo sapiens
gccctgcagaccctgc

SEQ ID NO: 2500796 - DNA, 17 bp, Homo sapiens
gccctgcagaccctgcc

SEQ ID NO: 2500797 - DNA, 11 bp, Homo sapiens
gccctgcagca

SEQ ID NO: 2500798 - DNA, 19 bp, Homo sapiens
gccctgccactcactaggc

SEQ ID NO: 2500799 - DNA, 21 bp, Homo sapiens
gccctgccactcactaggccc

SEQ ID NO: 2500800 - DNA, 11 bp, Homo sapiens
gccctgcctgg

SEQ ID NO: 2500801 - DNA, 21 bp, Homo sapiens
gccctgcctggaggacctgag

SEQ ID NO: 2500802 - DNA, 22 bp, Homo sapiens
gccctgcctggaggacctgagc

SEQ ID NO: 2500803 - DNA, 16 bp, Homo sapiens
gccctgcttcctgctt

SEQ ID NO: 2500804 - DNA, 14 bp, Homo sapiens
gccctggcctcccc

SEQ ID NO: 2500805 - DNA, 19 bp, Homo sapiens
gccctggcctcccctgcca

SEQ ID NO: 2500806 - DNA, 14 bp, Homo sapiens
gccctgggaccgct

SEQ ID NO: 2500807 - DNA, 15 bp, Homo sapiens
gccctgggcctgcct

SEQ ID NO: 2500808 - DNA, 16 bp, Homo sapiens
gccctgggcctgcctc

SEQ ID NO: 2500809 - DNA, 20 bp, Homo sapiens
gccctgggcctgcctcacca

SEQ ID NO: 2500810 - DNA, 11 bp, Homo sapiens
gccctgggctg

SEQ ID NO: 2500811 - DNA, 14 bp, Homo sapiens
gccctgggctggaa

SEQ ID NO: 2500812 - DNA, 18 bp, Homo sapiens
gctccttcccatcgctgt

SEQ ID NO: 2500813 - DNA, 11 bp, Homo sapiens
gctccttgggc

SEQ ID NO: 2500814 - DNA, 20 bp, Homo sapiens
gctccttgtgggcctgggct

SEQ ID NO: 2500815 - DNA, 16 bp, Homo sapiens
gctcgaatctctgtgc

SEQ ID NO: 2500816 - DNA, 14 bp, Homo sapiens
gctcggcctgcccc

SEQ ID NO: 2500817 - DNA, 19 bp, Homo sapiens
gctcgtccccaagtgacct

SEQ ID NO: 2500818 - DNA, 14 bp, Homo sapiens
gctctaacgcctga

SEQ ID NO: 2500819 - DNA, 18 bp, Homo sapiens
gctctaacgcctgagccc

SEQ ID NO: 2500820 - DNA, 20 bp, Homo sapiens
gctctaacgcctgagcccag

SEQ ID NO: 2500821 - DNA, 21 bp, Homo sapiens
gctctaacgcctgagcccagg

SEQ ID NO: 2500822 - DNA, 16 bp, Homo sapiens
gctctacatcttctgc

SEQ ID NO: 2500823 - DNA, 20 bp, Homo sapiens
gctctacatcttctgcctta

SEQ ID NO: 2500824 - DNA, 15 bp, Homo sapiens
gctctacttccccat

SEQ ID NO: 2500825 - DNA, 22 bp, Homo sapiens
gctctacttccccatggccctg

SEQ ID NO: 2500826 - DNA, 13 bp, Homo sapiens
gctctagaatctg

SEQ ID NO: 2500827 - DNA, 13 bp, Homo sapiens
gctctatgagtct

SEQ ID NO: 2500828 - DNA, 16 bp, Homo sapiens
gctctattatgaatgt

SEQ ID NO: 2500829 - DNA, 21 bp, Homo sapiens
gctctcacggccacacagctg

SEQ ID NO: 2500830 - DNA, 14 bp, Homo sapiens
gctctccattctgc

SEQ ID NO: 2500831 - DNA, 15 bp, Homo sapiens
gctctcctcttctac

SEQ ID NO: 2500832 - DNA, 14 bp, Homo sapiens
gctctcctggcttc

SEQ ID NO: 2500833 - DNA, 17 bp, Homo sapiens
gctctcctggcttccca

SEQ ID NO: 2500834 - DNA, 13 bp, Homo sapiens
gctctgagagtct

SEQ ID NO: 2500835 - DNA, 14 bp, Homo sapiens
gctctgagagtcta

SEQ ID NO: 2500836 - DNA, 14 bp, Homo sapiens
gctctgagcgcctc

SEQ ID NO: 2500837 - DNA, 17 bp, Homo sapiens
gctctgagcgcctccat

SEQ ID NO: 2500838 - DNA, 14 bp, Homo sapiens
gctctgagctgtca

SEQ ID NO: 2500839 - DNA, 9 bp, Homo sapiens
gctctgagg

SEQ ID NO: 2500840 - DNA, 10 bp, Homo sapiens
gctctgaggc

SEQ ID NO: 2500841 - DNA, 22 bp, Homo sapiens
gctctgagtacccctgctttgg

SEQ ID NO: 2500842 - DNA, 13 bp, Homo sapiens
gctctgatccctc

SEQ ID NO: 2500843 - DNA, 19 bp, Homo sapiens
gctctgatgcatcagaaag

SEQ ID NO: 2500844 - DNA, 17 bp, Homo sapiens
gctctgcaattcccctc

SEQ ID NO: 2500845 - DNA, 18 bp, Homo sapiens
gctctgcaattcccctct

SEQ ID NO: 2500846 - DNA, 23 bp, Homo sapiens
gctctgcaattcccctctgctgc

SEQ ID NO: 2500847 - DNA, 22 bp, Homo sapiens
gctctgcgtgtcacctgtgctt

SEQ ID NO: 2500848 - DNA, 16 bp, Homo sapiens
gctctggacagcccca

SEQ ID NO: 2500849 - DNA, 19 bp, Homo sapiens
gctctggacagccccaccc

SEQ ID NO: 2500850 - DNA, 22 bp, Homo sapiens
gctctggacagccccaccctgg

SEQ ID NO: 2500851 - DNA, 21 bp, Homo sapiens
gctctggggtgggcagttttt

SEQ ID NO: 2500852 - DNA, 21 bp, Homo sapiens
gctctggttgtttctgttcca

SEQ ID NO: 2500853 - DNA, 22 bp, Homo sapiens
gctctggttgtttctgttccaa

SEQ ID NO: 2500854 - DNA, 13 bp, Homo sapiens
gctctgtctactt

SEQ ID NO: 2500855 - DNA, 19 bp, Homo sapiens
gctctgttcttcctcagcc

SEQ ID NO: 2500856 - DNA, 20 bp, Homo sapiens
gctctgttcttcctcagcca

SEQ ID NO: 2500857 - DNA, 16 bp, Homo sapiens
gctcttagcagcttcc

SEQ ID NO: 2500858 - DNA, 17 bp, Homo sapiens
gctcttagcagcttcca

SEQ ID NO: 2500859 - DNA, 21 bp, Homo sapiens
gctcttggctggacccagcca

SEQ ID NO: 2500860 - DNA, 18 bp, Homo sapiens
gctgaaaatgtccttgtg

SEQ ID NO: 2500861 - DNA, 13 bp, Homo sapiens
gctgaacagtgga

SEQ ID NO: 2500862 - DNA, 17 bp, Homo sapiens
gctgacacctaactctt

SEQ ID NO: 2500863 - DNA, 17 bp, Homo sapiens
gctgacatgaagctgtt

SEQ ID NO: 2500864 - DNA, 16 bp, Homo sapiens
gctgacattcacctgc

SEQ ID NO: 2500865 - DNA, 17 bp, Homo sapiens
gctgaccacagcacagc

SEQ ID NO: 2500866 - DNA, 19 bp, Homo sapiens
gctgaccacagcacagcca

SEQ ID NO: 2500867 - DNA, 21 bp, Homo sapiens
gctgaccatgctcatctgctg

SEQ ID NO: 2500868 - DNA, 12 bp, Homo sapiens
gctgacctgctg

SEQ ID NO: 2500869 - DNA, 17 bp, Homo sapiens
gctgacctgctgacctg

SEQ ID NO: 2500870 - DNA, 19 bp, Homo sapiens
gctgacgggacccacatgc

SEQ ID NO: 2500871 - DNA, 20 bp, Homo sapiens
gctgactaaactttttttct

SEQ ID NO: 2500872 - DNA, 16 bp, Homo sapiens
gctgacttggctggtg

SEQ ID NO: 2500873 - DNA, 23 bp, Homo sapiens
gctgacttggctggtgtggtaca

SEQ ID NO: 2500874 - DNA, 13 bp, Homo sapiens
gctgagaacctgg

SEQ ID NO: 2500875 - DNA, 14 bp, Homo sapiens
gctgagaacctggc

SEQ ID NO: 2500876 - DNA, 13 bp, Homo sapiens
gctgagcagggcc

SEQ ID NO: 2500877 - DNA, 14 bp, Homo sapiens
gctgagcgccagga

SEQ ID NO: 2500878 - DNA, 23 bp, Homo sapiens
gctgagctcacaaggcagcaagg

SEQ ID NO: 2500879 - DNA, 13 bp, Homo sapiens
gctgagctctgag

SEQ ID NO: 2500880 - DNA, 14 bp, Homo sapiens
gctgagctctgaga

SEQ ID NO: 2500881 - DNA, 23 bp, Homo sapiens
gctgagctctgagaggccctgga

SEQ ID NO: 2500882 - DNA, 12 bp, Homo sapiens
gctgaggagcag

SEQ ID NO: 2500883 - DNA, 19 bp, Homo sapiens
gctgaggccacactcagca

SEQ ID NO: 2500884 - DNA, 13 bp, Homo sapiens
gctgaggcctgga

SEQ ID NO: 2500885 - DNA, 20 bp, Homo sapiens
gctgaggcctgggccgctgc

SEQ ID NO: 2500886 - DNA, 16 bp, Homo sapiens
gctgaggctggcacag

SEQ ID NO: 2500887 - DNA, 15 bp, Homo sapiens
gctgaggtgcccagg

SEQ ID NO: 2500888 - DNA, 17 bp, Homo sapiens
gctgagtattaaaatgt

SEQ ID NO: 2500889 - DNA, 17 bp, Homo sapiens
gctgagtggcaggggac

SEQ ID NO: 2500890 - DNA, 21 bp, Homo sapiens
gctgagtggcaggggacagga

SEQ ID NO: 2500891 - DNA, 12 bp, Homo sapiens
gctgagtttcct

SEQ ID NO: 2500892 - DNA, 12 bp, Homo sapiens
gctgataatttt

SEQ ID NO: 2500893 - DNA, 19 bp, Homo sapiens
gctgatcgccttccccacc

SEQ ID NO: 2500894 - DNA, 11 bp, Homo sapiens
gctgatttttt

SEQ ID NO: 2500895 - DNA, 17 bp, Homo sapiens
gctgcacctttttgcat

SEQ ID NO: 2500896 - DNA, 15 bp, Homo sapiens
gctgcagaggccaga

SEQ ID NO: 2500897 - DNA, 15 bp, Homo sapiens
gctgcagcctcagga

SEQ ID NO: 2500898 - DNA, 16 bp, Homo sapiens
gctgcagcctcaggac

SEQ ID NO: 2500899 - DNA, 19 bp, Homo sapiens
gctgcagcctcaggactgg

SEQ ID NO: 2500900 - DNA, 22 bp, Homo sapiens
gctgcagcctcaggactgggag

SEQ ID NO: 2500901 - DNA, 22 bp, Homo sapiens
gctgcaggaatctttaaaagat

SEQ ID NO: 2500902 - DNA, 17 bp, Homo sapiens
gctgccagctctgtatc

SEQ ID NO: 2500903 - DNA, 19 bp, Homo sapiens
gctgccagcttcaggtgac

SEQ ID NO: 2500904 - DNA, 13 bp, Homo sapiens
gctgccaggagca

SEQ ID NO: 2500905 - DNA, 19 bp, Homo sapiens
gctgccagtgtcctgagcc

SEQ ID NO: 2500906 - DNA, 13 bp, Homo sapiens
gctgcccctctca

SEQ ID NO: 2500907 - DNA, 17 bp, Homo sapiens
gctgccggggcagcccc

SEQ ID NO: 2500908 - DNA, 19 bp, Homo sapiens
gctgccggggcagccccct

SEQ ID NO: 2500909 - DNA, 21 bp, Homo sapiens
gctgcctcccctctccttcct

SEQ ID NO: 2500910 - DNA, 18 bp, Homo sapiens
gctgcctccctctgctgt

SEQ ID NO: 2500911 - DNA, 21 bp, Homo sapiens
gctgcctcccttgtggcagca

SEQ ID NO: 2500912 - DNA, 22 bp, Homo sapiens
gctgcctgagtcgtgacctgct

SEQ ID NO: 2500913 - DNA, 19 bp, Homo sapiens
gctgctagagtgactcact

SEQ ID NO: 2500914 - DNA, 16 bp, Homo sapiens
gctgctccctcagact

SEQ ID NO: 2500915 - DNA, 19 bp, Homo sapiens
gctgctcggggtgcacagg

SEQ ID NO: 2500916 - DNA, 15 bp, Homo sapiens
gcttagatttcatag

SEQ ID NO: 2500917 - DNA, 19 bp, Homo sapiens
gcttatacgaaataattgt

SEQ ID NO: 2500918 - DNA, 23 bp, Homo sapiens
gcttatacgaaataattgttgtt

SEQ ID NO: 2500919 - DNA, 18 bp, Homo sapiens
gcttatcaactaatgatt

SEQ ID NO: 2500920 - DNA, 16 bp, Homo sapiens
gcttatggtaccagat

SEQ ID NO: 2500921 - DNA, 17 bp, Homo sapiens
gcttattccatgactgc

SEQ ID NO: 2500922 - DNA, 17 bp, Homo sapiens
gcttatttattgtattc

SEQ ID NO: 2500923 - DNA, 20 bp, Homo sapiens
gcttatttattgtattctgg

SEQ ID NO: 2500924 - DNA, 15 bp, Homo sapiens
gcttcagctgccagt

SEQ ID NO: 2500925 - DNA, 14 bp, Homo sapiens
gcttcatgtgtccc

SEQ ID NO: 2500926 - DNA, 16 bp, Homo sapiens
gcttcatgtgtcccag

SEQ ID NO: 2500927 - DNA, 17 bp, Homo sapiens
gcttcatgtgtcccaga

SEQ ID NO: 2500928 - DNA, 19 bp, Homo sapiens
gcttccatgattctattta

SEQ ID NO: 2500929 - DNA, 18 bp, Homo sapiens
gcttcccaagggctgccg

SEQ ID NO: 2500930 - DNA, 13 bp, Homo sapiens
gcttcccatcccc

SEQ ID NO: 2500931 - DNA, 16 bp, Homo sapiens
gcttcccatccccagc

SEQ ID NO: 2500932 - DNA, 13 bp, Homo sapiens
gcttccctaatct

SEQ ID NO: 2500933 - DNA, 16 bp, Homo sapiens
gcttccctgaagctcc

SEQ ID NO: 2500934 - DNA, 14 bp, Homo sapiens
gcttccctgactca

SEQ ID NO: 2500935 - DNA, 12 bp, Homo sapiens
gcttcctcctgg

SEQ ID NO: 2500936 - DNA, 21 bp, Homo sapiens
gcttcctgcttgccaaggcag

SEQ ID NO: 2500937 - DNA, 15 bp, Homo sapiens
gcttcctggagcaga

SEQ ID NO: 2500938 - DNA, 18 bp, Homo sapiens
gcttcctggagcagaagc

SEQ ID NO: 2500939 - DNA, 11 bp, Homo sapiens
gcttcctggtg

SEQ ID NO: 2500940 - DNA, 13 bp, Homo sapiens
gcttccttcagag

SEQ ID NO: 2500941 - DNA, 14 bp, Homo sapiens
gcttccttcagaga

SEQ ID NO: 2500942 - DNA, 19 bp, Homo sapiens
gcttccttcagagagcagt

SEQ ID NO: 2500943 - DNA, 20 bp, Homo sapiens
gcttctaagtaaatacaatt

SEQ ID NO: 2500944 - DNA, 22 bp, Homo sapiens
gcttctaagtaaatacaatttt

SEQ ID NO: 2500945 - DNA, 19 bp, Homo sapiens
gcttctataattttgcctt

SEQ ID NO: 2500946 - DNA, 15 bp, Homo sapiens
gcttctcccaggcaa

SEQ ID NO: 2500947 - DNA, 16 bp, Homo sapiens
gcttctcccaggcaag

SEQ ID NO: 2500948 - DNA, 22 bp, Homo sapiens
gcttctcccaggcaaggctgtg

SEQ ID NO: 2500949 - DNA, 23 bp, Homo sapiens
gcttctcccaggcaaggctgtgg

SEQ ID NO: 2500950 - DNA, 16 bp, Homo sapiens
gcttctctctgtggga

SEQ ID NO: 2500951 - DNA, 20 bp, Homo sapiens
gcttctctgacttctgcctg

SEQ ID NO: 2500952 - DNA, 18 bp, Homo sapiens
gcttctgagcagcgagcc

SEQ ID NO: 2500953 - DNA, 23 bp, Homo sapiens
gcttctgagcagcgagcctgcta

SEQ ID NO: 2500954 - DNA, 18 bp, Homo sapiens
gcttctgccccctgcaga

SEQ ID NO: 2500955 - DNA, 16 bp, Homo sapiens
gcttctgctggggcct

SEQ ID NO: 2500956 - DNA, 21 bp, Homo sapiens
gcttctgctggggcctgggac

SEQ ID NO: 2500957 - DNA, 15 bp, Homo sapiens
gcttctggccaggaa

SEQ ID NO: 2500958 - DNA, 16 bp, Homo sapiens
gcttctggccaggaag

SEQ ID NO: 2500959 - DNA, 17 bp, Homo sapiens
gcttctggccaggaagc

SEQ ID NO: 2500960 - DNA, 13 bp, Homo sapiens
gcttctgtcctgc

SEQ ID NO: 2500961 - DNA, 13 bp, Homo sapiens
gcttcttgcctct

SEQ ID NO: 2500962 - DNA, 15 bp, Homo sapiens
gcttctttctagaaa

SEQ ID NO: 2500963 - DNA, 14 bp, Homo sapiens
gcttgacctgaggc

SEQ ID NO: 2500964 - DNA, 14 bp, Homo sapiens
gcttgattctgcag

SEQ ID NO: 2500965 - DNA, 18 bp, Homo sapiens
gcttgccaaggcagaggc

SEQ ID NO: 2500966 - DNA, 16 bp, Homo sapiens
gcttgcctgcctgctc

SEQ ID NO: 2500967 - DNA, 14 bp, Homo sapiens
gcttgcttttcatg

SEQ ID NO: 2500968 - DNA, 14 bp, Homo sapiens
gcttggagcagagg

SEQ ID NO: 2500969 - DNA, 14 bp, Homo sapiens
gcttggagctgagc

SEQ ID NO: 2500970 - DNA, 15 bp, Homo sapiens
gcttggagctgagca

SEQ ID NO: 2500971 - DNA, 18 bp, Homo sapiens
gcttggccacagccaggg

SEQ ID NO: 2500972 - DNA, 18 bp, Homo sapiens
gcttggcgatgccagcca

SEQ ID NO: 2500973 - DNA, 21 bp, Homo sapiens
gcttgggaagactcctagctg

SEQ ID NO: 2500974 - DNA, 15 bp, Homo sapiens
gcttgggaattttat

SEQ ID NO: 2500975 - DNA, 17 bp, Homo sapiens
gcttgggatttgctgtg

SEQ ID NO: 2500976 - DNA, 19 bp, Homo sapiens
gcttgggcctaggctgcat

SEQ ID NO: 2500977 - DNA, 21 bp, Homo sapiens
gcttgggcctaggctgcattg

SEQ ID NO: 2500978 - DNA, 17 bp, Homo sapiens
gcttggggctggagagg

SEQ ID NO: 2500979 - DNA, 15 bp, Homo sapiens
gcttgtagccagccg

SEQ ID NO: 2500980 - DNA, 22 bp, Homo sapiens
gcttgtagccagccggggcgag

SEQ ID NO: 2500981 - DNA, 22 bp, Homo sapiens
gcttgtaggggaggggctcctt

SEQ ID NO: 2500982 - DNA, 16 bp, Homo sapiens
gcttgtctcttgcctg

SEQ ID NO: 2500983 - DNA, 18 bp, Homo sapiens
gcttgtctcttgcctgcc

SEQ ID NO: 2500984 - DNA, 21 bp, Homo sapiens
gcttgtctcttgcctgccact

SEQ ID NO: 2500985 - DNA, 19 bp, Homo sapiens
gcttgtttgatttcaacat

SEQ ID NO: 2500986 - DNA, 18 bp, Homo sapiens
gctttaacttaaatagta

SEQ ID NO: 2500987 - DNA, 14 bp, Homo sapiens
gctttaatataaat

SEQ ID NO: 2500988 - DNA, 17 bp, Homo sapiens
gctttattccagaatgc

SEQ ID NO: 2500989 - DNA, 18 bp, Homo sapiens
gctttcagggaggccctg

SEQ ID NO: 2500990 - DNA, 17 bp, Homo sapiens
gctttcattttctctca

SEQ ID NO: 2500991 - DNA, 18 bp, Homo sapiens
gctttcattttctctcag

SEQ ID NO: 2500992 - DNA, 19 bp, Homo sapiens
gctttcattttctctcagg

SEQ ID NO: 2500993 - DNA, 12 bp, Homo sapiens
gctttcctgccc

SEQ ID NO: 2500994 - DNA, 17 bp, Homo sapiens
gctttcctgccccaggc

SEQ ID NO: 2500995 - DNA, 16 bp, Homo sapiens
gctttcgaactgctag

SEQ ID NO: 2500996 - DNA, 21 bp, Homo sapiens
gctttctgaacagctggtgta

SEQ ID NO: 2500997 - DNA, 17 bp, Homo sapiens
gctttctgatcaaggcc

SEQ ID NO: 2500998 - DNA, 14 bp, Homo sapiens
gctttctgttccaa

SEQ ID NO: 2500999 - DNA, 15 bp, Homo sapiens
gctttgaaacagaaa

SEQ ID NO: 2501000 - DNA, 19 bp, Homo sapiens
gctttgaaattgaaccttt

SEQ ID NO: 2501001 - DNA, 15 bp, Homo sapiens
gctttgatgttcctt

SEQ ID NO: 2501002 - DNA, 20 bp, Homo sapiens
gctttgatgttccttccagt

SEQ ID NO: 2501003 - DNA, 15 bp, Homo sapiens
gctttgattcatagt

SEQ ID NO: 2501004 - DNA, 17 bp, Homo sapiens
gctttgcccttctttct

SEQ ID NO: 2501005 - DNA, 17 bp, Homo sapiens
gctttggatttgacatt

SEQ ID NO: 2501006 - DNA, 17 bp, Homo sapiens
gctttggtgagaacctg

SEQ ID NO: 2501007 - DNA, 18 bp, Homo sapiens
gctttgtctacttcaaaa

SEQ ID NO: 2501008 - DNA, 18 bp, Homo sapiens
gcttttattaatgcactt

SEQ ID NO: 2501009 - DNA, 19 bp, Homo sapiens
gcttttattaatgcacttt

SEQ ID NO: 2501010 - DNA, 16 bp, Homo sapiens
gcttttccctttgtga

SEQ ID NO: 2501011 - DNA, 21 bp, Homo sapiens
gcttttgcccattttgaatca

SEQ ID NO: 2501012 - DNA, 23 bp, Homo sapiens
gcttttgcggttcaggaaaattg

SEQ ID NO: 2501013 - DNA, 11 bp, Homo sapiens
gcttttggcaa

SEQ ID NO: 2501014 - DNA, 22 bp, Homo sapiens
gcttttggcggggaggaggaaa

SEQ ID NO: 2501015 - DNA, 20 bp, Homo sapiens
gcttttgtctacacaccctg

SEQ ID NO: 2501016 - DNA, 23 bp, Homo sapiens
gctttttgtgatatgcacaatgt

SEQ ID NO: 2501017 - DNA, 15 bp, Homo sapiens
ggaaaaaaaaacagc

SEQ ID NO: 2501018 - DNA, 14 bp, Homo sapiens
ggaaaaggcctggg

SEQ ID NO: 2501019 - DNA, 22 bp, Homo sapiens
ggaaaaggcctggggtgacccg

SEQ ID NO: 2501020 - DNA, 15 bp, Homo sapiens
ggccctctctgctct

SEQ ID NO: 2501021 - DNA, 23 bp, Homo sapiens
ggccctgagcgagtggagtctgc

SEQ ID NO: 2501022 - DNA, 19 bp, Homo sapiens
ggccctgcaaaaggactct

SEQ ID NO: 2501023 - DNA, 22 bp, Homo sapiens
ggccctgcaaaaggactctcag

SEQ ID NO: 2501024 - DNA, 14 bp, Homo sapiens
ggccctgcttcctg

SEQ ID NO: 2501025 - DNA, 15 bp, Homo sapiens
ggccctgcttcctgc

SEQ ID NO: 2501026 - DNA, 13 bp, Homo sapiens
ggccctggcctcc

SEQ ID NO: 2501027 - DNA, 18 bp, Homo sapiens
ggccctgggcctgcctca

SEQ ID NO: 2501028 - DNA, 12 bp, Homo sapiens
ggccctgggctg

SEQ ID NO: 2501029 - DNA, 13 bp, Homo sapiens
ggccctgggctgg

SEQ ID NO: 2501030 - DNA, 14 bp, Homo sapiens
ggccctgggctgga

SEQ ID NO: 2501031 - DNA, 14 bp, Homo sapiens
ggccctggggcctg

SEQ ID NO: 2501032 - DNA, 17 bp, Homo sapiens
ggccctggggcctgtac

SEQ ID NO: 2501033 - DNA, 18 bp, Homo sapiens
ggccctggggcctgtact

SEQ ID NO: 2501034 - DNA, 19 bp, Homo sapiens
ggccctgtcatccagctca

SEQ ID NO: 2501035 - DNA, 19 bp, Homo sapiens
ggcccttcccacaggacat

SEQ ID NO: 2501036 - DNA, 21 bp, Homo sapiens
ggcccttcctggacagctgtg

SEQ ID NO: 2501037 - DNA, 22 bp, Homo sapiens
ggcccttcctggacagctgtgc

SEQ ID NO: 2501038 - DNA, 12 bp, Homo sapiens
ggccgccccctg

SEQ ID NO: 2501039 - DNA, 18 bp, Homo sapiens
ggccgccccctgcccccc

SEQ ID NO: 2501040 - DNA, 19 bp, Homo sapiens
ggccgccccctgcccccca

SEQ ID NO: 2501041 - DNA, 13 bp, Homo sapiens
ggccgcctgggtc

SEQ ID NO: 2501042 - DNA, 12 bp, Homo sapiens
ggccgctgccac

SEQ ID NO: 2501043 - DNA, 15 bp, Homo sapiens
ggccggccagcccct

SEQ ID NO: 2501044 - DNA, 19 bp, Homo sapiens
ggccggggaactggccaag

SEQ ID NO: 2501045 - DNA, 21 bp, Homo sapiens
ggccgtgaatgggtgcccaca

SEQ ID NO: 2501046 - DNA, 20 bp, Homo sapiens
ggccgtgacgtctgggtggc

SEQ ID NO: 2501047 - DNA, 18 bp, Homo sapiens
ggcctaagaggctgccct

SEQ ID NO: 2501048 - DNA, 13 bp, Homo sapiens
ggcctagaccagc

SEQ ID NO: 2501049 - DNA, 19 bp, Homo sapiens
ggcctaggagggtcctctg

SEQ ID NO: 2501050 - DNA, 15 bp, Homo sapiens
ggcctaggattctaa

SEQ ID NO: 2501051 - DNA, 14 bp, Homo sapiens
ggcctaggctgcat

SEQ ID NO: 2501052 - DNA, 19 bp, Homo sapiens
ggcctatggagagccctgg

SEQ ID NO: 2501053 - DNA, 12 bp, Homo sapiens
ggcctcacccac

SEQ ID NO: 2501054 - DNA, 18 bp, Homo sapiens
ggcctcacccacccctgc

SEQ ID NO: 2501055 - DNA, 19 bp, Homo sapiens
ggcctcaccgagtgggggc

SEQ ID NO: 2501056 - DNA, 13 bp, Homo sapiens
ggcctcagggctc

SEQ ID NO: 2501057 - DNA, 17 bp, Homo sapiens
ggcctcagggctccttg

SEQ ID NO: 2501058 - DNA, 18 bp, Homo sapiens
ggcctcagggctccttgt

SEQ ID NO: 2501059 - DNA, 16 bp, Homo sapiens
ggcctcatgtggctgg

SEQ ID NO: 2501060 - DNA, 22 bp, Homo sapiens
ggcctcccctgccaccaggcca

SEQ ID NO: 2501061 - DNA, 14 bp, Homo sapiens
ggcctccttctgag

SEQ ID NO: 2501062 - DNA, 22 bp, Homo sapiens
ggcctcttgagcagtggctggt

SEQ ID NO: 2501063 - DNA, 17 bp, Homo sapiens
ggcctgaaagaggctga

SEQ ID NO: 2501064 - DNA, 23 bp, Homo sapiens
ggcctgaaagaggctgaggcctg

SEQ ID NO: 2501065 - DNA, 17 bp, Homo sapiens
ggcctgcagggcctctg

SEQ ID NO: 2501066 - DNA, 17 bp, Homo sapiens
ggcctgccacctggacc

SEQ ID NO: 2501067 - DNA, 12 bp, Homo sapiens
ggcctgccccca

SEQ ID NO: 2501068 - DNA, 15 bp, Homo sapiens
ggcctgctaaggtct

SEQ ID NO: 2501069 - DNA, 14 bp, Homo sapiens
ggcctgctccagac

SEQ ID NO: 2501070 - DNA, 11 bp, Homo sapiens
ggcctgctgct

SEQ ID NO: 2501071 - DNA, 14 bp, Homo sapiens
ggcctgctgctgag

SEQ ID NO: 2501072 - DNA, 18 bp, Homo sapiens
ggcctgctgctgagaacc

SEQ ID NO: 2501073 - DNA, 19 bp, Homo sapiens
ggcctgctgctgagaacct

SEQ ID NO: 2501074 - DNA, 22 bp, Homo sapiens
ggcctgctgctgagaacctggc

SEQ ID NO: 2501075 - DNA, 21 bp, Homo sapiens
ggcctggactttcctgcaact

SEQ ID NO: 2501076 - DNA, 11 bp, Homo sapiens
ggcctggagat

SEQ ID NO: 2501077 - DNA, 14 bp, Homo sapiens
ggcctggagatcct

SEQ ID NO: 2501078 - DNA, 19 bp, Homo sapiens
ggcctggagatcctcctgc

SEQ ID NO: 2501079 - DNA, 14 bp, Homo sapiens
ggcctggccagtgc

SEQ ID NO: 2501080 - DNA, 12 bp, Homo sapiens
ggcctggctggc

SEQ ID NO: 2501081 - DNA, 11 bp, Homo sapiens
ggcctgggagg

SEQ ID NO: 2501082 - DNA, 18 bp, Homo sapiens
ggcctgggcagtggatgg

SEQ ID NO: 2501083 - DNA, 16 bp, Homo sapiens
ggcctgggctcctgga

SEQ ID NO: 2501084 - DNA, 11 bp, Homo sapiens
ggcctggggtg

SEQ ID NO: 2501085 - DNA, 14 bp, Homo sapiens
ggcctggtccctgt

SEQ ID NO: 2501086 - DNA, 21 bp, Homo sapiens
ggcctggttaaataaggcagg

SEQ ID NO: 2501087 - DNA, 23 bp, Homo sapiens
ggcctggttaaataaggcagggt

SEQ ID NO: 2501088 - DNA, 14 bp, Homo sapiens
ggcctgtactgcct

SEQ ID NO: 2501089 - DNA, 19 bp, Homo sapiens
ggcctgtgtagctgtgacc

SEQ ID NO: 2501090 - DNA, 22 bp, Homo sapiens
ggcctgtgtagctgtgacctgc

SEQ ID NO: 2501091 - DNA, 18 bp, Homo sapiens
ggcctgtttggcctctct

SEQ ID NO: 2501092 - DNA, 19 bp, Homo sapiens
ggccttacttaaacccagc

SEQ ID NO: 2501093 - DNA, 17 bp, Homo sapiens
ggccttggcctggagca

SEQ ID NO: 2501094 - DNA, 18 bp, Homo sapiens
ggccttggcctggagcac

SEQ ID NO: 2501095 - DNA, 12 bp, Homo sapiens
ggccttgggctc

SEQ ID NO: 2501096 - DNA, 13 bp, Homo sapiens
ggccttgggctcc

SEQ ID NO: 2501097 - DNA, 11 bp, Homo sapiens
ggcgacctcct

SEQ ID NO: 2501098 - DNA, 22 bp, Homo sapiens
ggcgatccacctgtctcagcct

SEQ ID NO: 2501099 - DNA, 12 bp, Homo sapiens
ggcgcactgtga

SEQ ID NO: 2501100 - DNA, 20 bp, Homo sapiens
ggcggatgttgaagtgagct

SEQ ID NO: 2501101 - DNA, 17 bp, Homo sapiens
ggcggcaggggcctgga

SEQ ID NO: 2501102 - DNA, 19 bp, Homo sapiens
ggcggctggggtcccagca

SEQ ID NO: 2501103 - DNA, 20 bp, Homo sapiens
ggcggctggggtcccagcag

SEQ ID NO: 2501104 - DNA, 12 bp, Homo sapiens
ggcgggggtggc

SEQ ID NO: 2501105 - DNA, 16 bp, Homo sapiens
ggcgtaagtacagaga

SEQ ID NO: 2501106 - DNA, 21 bp, Homo sapiens
ggcgtaagtacagagaagcca

SEQ ID NO: 2501107 - DNA, 20 bp, Homo sapiens
ggcgtaggctacagagaagc

SEQ ID NO: 2501108 - DNA, 13 bp, Homo sapiens
ggcgtttgtaatg

SEQ ID NO: 2501109 - DNA, 13 bp, Homo sapiens
ggctaatttaaca

SEQ ID NO: 2501110 - DNA, 12 bp, Homo sapiens
ggctacagagaa

SEQ ID NO: 2501111 - DNA, 15 bp, Homo sapiens
ggctacagagaagcc

SEQ ID NO: 2501112 - DNA, 19 bp, Homo sapiens
ggctacagagaagccttca

SEQ ID NO: 2501113 - DNA, 20 bp, Homo sapiens
ggctactctgtgccagagcc

SEQ ID NO: 2501114 - DNA, 21 bp, Homo sapiens
ggctactctgtgccagagcct

SEQ ID NO: 2501115 - DNA, 17 bp, Homo sapiens
ggctaggccagcagggg

SEQ ID NO: 2501116 - DNA, 19 bp, Homo sapiens
ggctaggccagcaggggct

SEQ ID NO: 2501117 - DNA, 20 bp, Homo sapiens
ggctagtgacttgtgtccca

SEQ ID NO: 2501118 - DNA, 16 bp, Homo sapiens
ggctatttgtaaatct

SEQ ID NO: 2501119 - DNA, 22 bp, Homo sapiens
ggctcacccccttctccatcca

SEQ ID NO: 2501120 - DNA, 23 bp, Homo sapiens
ggctcactgcaacctccacctcc

SEQ ID NO: 2501121 - DNA, 16 bp, Homo sapiens
ggctcagattgtaata

SEQ ID NO: 2501122 - DNA, 15 bp, Homo sapiens
ggctcagccagcact

SEQ ID NO: 2501123 - DNA, 23 bp, Homo sapiens
ggctcagccccaccccagggcag

SEQ ID NO: 2501124 - DNA, 16 bp, Homo sapiens
ggctcaggtcacataa

SEQ ID NO: 2501125 - DNA, 18 bp, Homo sapiens
ggggtggctgcagcctca

SEQ ID NO: 2501126 - DNA, 15 bp, Homo sapiens
ggggttatctctgtg

SEQ ID NO: 2501127 - DNA, 14 bp, Homo sapiens
ggggttcaggcccg

SEQ ID NO: 2501128 - DNA, 21 bp, Homo sapiens
gggtaaaatacttttactctg

SEQ ID NO: 2501129 - DNA, 20 bp, Homo sapiens
gggtacagcgcggaggagga

SEQ ID NO: 2501130 - DNA, 17 bp, Homo sapiens
gggtacatggtgctggg

SEQ ID NO: 2501131 - DNA, 16 bp, Homo sapiens
gggtagcgggggaggg

SEQ ID NO: 2501132 - DNA, 12 bp, Homo sapiens
gggtaggcagga

SEQ ID NO: 2501133 - DNA, 19 bp, Homo sapiens
gggtcaggcctttgagctc

SEQ ID NO: 2501134 - DNA, 21 bp, Homo sapiens
gggtcaggcctttgagctcag

SEQ ID NO: 2501135 - DNA, 11 bp, Homo sapiens
gggtccaggag

SEQ ID NO: 2501136 - DNA, 15 bp, Homo sapiens
gggtccggcagcttc

SEQ ID NO: 2501137 - DNA, 18 bp, Homo sapiens
gggtcctcctccagggac

SEQ ID NO: 2501138 - DNA, 23 bp, Homo sapiens
gggtcctcctttctgagggcccg

SEQ ID NO: 2501139 - DNA, 15 bp, Homo sapiens
gggtcctctgagact

SEQ ID NO: 2501140 - DNA, 15 bp, Homo sapiens
gggtcggctgaccat

SEQ ID NO: 2501141 - DNA, 22 bp, Homo sapiens
gggtctgctctttctctgccag

SEQ ID NO: 2501142 - DNA, 20 bp, Homo sapiens
gggtctggagttgatctgga

SEQ ID NO: 2501143 - DNA, 14 bp, Homo sapiens
gggtctggctggtg

SEQ ID NO: 2501144 - DNA, 15 bp, Homo sapiens
gggtgaggagctggg

SEQ ID NO: 2501145 - DNA, 14 bp, Homo sapiens
gggtgatgagggca

SEQ ID NO: 2501146 - DNA, 18 bp, Homo sapiens
gggtgatgagggcagcag

SEQ ID NO: 2501147 - DNA, 23 bp, Homo sapiens
gggtgatgagggcagcagccagc

SEQ ID NO: 2501148 - DNA, 13 bp, Homo sapiens
gggtgcacaggag

SEQ ID NO: 2501149 - DNA, 16 bp, Homo sapiens
gggtgcacaggagggg

SEQ ID NO: 2501150 - DNA, 19 bp, Homo sapiens
gggtgcacaggagggggtc

SEQ ID NO: 2501151 - DNA, 24 bp, Homo sapiens
gggtgcctaggcctgggcagtgga

SEQ ID NO: 2501152 - DNA, 16 bp, Homo sapiens
gggtgctactggggaa

SEQ ID NO: 2501153 - DNA, 20 bp, Homo sapiens
gggtggccaggccgggaaaa

SEQ ID NO: 2501154 - DNA, 18 bp, Homo sapiens
gggtggctactctgtgcc

SEQ ID NO: 2501155 - DNA, 19 bp, Homo sapiens
gggtggctactctgtgcca

SEQ ID NO: 2501156 - DNA, 17 bp, Homo sapiens
gggtggctgcagcctca

SEQ ID NO: 2501157 - DNA, 15 bp, Homo sapiens
gggtgggcagttttt

SEQ ID NO: 2501158 - DNA, 17 bp, Homo sapiens
gggtggggcccaggccc

SEQ ID NO: 2501159 - DNA, 21 bp, Homo sapiens
gggttctgcctgccagctgca

SEQ ID NO: 2501160 - DNA, 23 bp, Homo sapiens
gggttgtaaattggcatggaaat

SEQ ID NO: 2501161 - DNA, 15 bp, Homo sapiens
gggtttctgccctgc

SEQ ID NO: 2501162 - DNA, 17 bp, Homo sapiens
gggtttgtgacagggcg

SEQ ID NO: 2501163 - DNA, 18 bp, Homo sapiens
gggttttgtattctctga

SEQ ID NO: 2501164 - DNA, 22 bp, Homo sapiens
gggttttttagttgaatttttt

SEQ ID NO: 2501165 - DNA, 13 bp, Homo sapiens
ggtaaaatacttc

SEQ ID NO: 2501166 - DNA, 23 bp, Homo sapiens
ggtaaaatacttttactctgcct

SEQ ID NO: 2501167 - DNA, 15 bp, Homo sapiens
ggtaaataaaaagaa

SEQ ID NO: 2501168 - DNA, 19 bp, Homo sapiens
ggtaaataaaaagaaaggc

SEQ ID NO: 2501169 - DNA, 15 bp, Homo sapiens
ggtaaatcagtaaga

SEQ ID NO: 2501170 - DNA, 16 bp, Homo sapiens
ggtaagcaacatggct

SEQ ID NO: 2501171 - DNA, 17 bp, Homo sapiens
ggtaagcaacatggctt

SEQ ID NO: 2501172 - DNA, 19 bp, Homo sapiens
ggtaagcaacatggctttg

SEQ ID NO: 2501173 - DNA, 10 bp, Homo sapiens
ggtacagaga

SEQ ID NO: 2501174 - DNA, 16 bp, Homo sapiens
ggtaccttgtgcccag

SEQ ID NO: 2501175 - DNA, 21 bp, Homo sapiens
ggtactgtacagctggctcta

SEQ ID NO: 2501176 - DNA, 16 bp, Homo sapiens
ggtacttgtcatttcg

SEQ ID NO: 2501177 - DNA, 21 bp, Homo sapiens
ggtagccagcacacagggcag

SEQ ID NO: 2501178 - DNA, 23 bp, Homo sapiens
ggtagggggctggaggagcccag

SEQ ID NO: 2501179 - DNA, 15 bp, Homo sapiens
ggtaggttcagccaa

SEQ ID NO: 2501180 - DNA, 17 bp, Homo sapiens
ggtaggttcagccaagg

SEQ ID NO: 2501181 - DNA, 18 bp, Homo sapiens
ggtaggttcagccaaggt

SEQ ID NO: 2501182 - DNA, 14 bp, Homo sapiens
ggtatacctcactt

SEQ ID NO: 2501183 - DNA, 18 bp, Homo sapiens
ggtatccccccatcttgc

SEQ ID NO: 2501184 - DNA, 23 bp, Homo sapiens
ggtatggcgtaagtacagagaag

SEQ ID NO: 2501185 - DNA, 12 bp, Homo sapiens
ggtattttcaat

SEQ ID NO: 2501186 - DNA, 23 bp, Homo sapiens
ggtcaacttgagcatgttactga

SEQ ID NO: 2501187 - DNA, 18 bp, Homo sapiens
ggtcaagttattaatttc

SEQ ID NO: 2501188 - DNA, 14 bp, Homo sapiens
ggtcacacactgat

SEQ ID NO: 2501189 - DNA, 13 bp, Homo sapiens
ggtcaggcctttg

SEQ ID NO: 2501190 - DNA, 16 bp, Homo sapiens
ggtcatgggccactgc

SEQ ID NO: 2501191 - DNA, 21 bp, Homo sapiens
ggtccaatgctcaggtgctgg

SEQ ID NO: 2501192 - DNA, 17 bp, Homo sapiens
ggtccaattagtttcct

SEQ ID NO: 2501193 - DNA, 13 bp, Homo sapiens
ggtccaggctgtg

SEQ ID NO: 2501194 - DNA, 14 bp, Homo sapiens
ggtccatgggcaga

SEQ ID NO: 2501195 - DNA, 17 bp, Homo sapiens
ggtccatgggcagagcc

SEQ ID NO: 2501196 - DNA, 20 bp, Homo sapiens
ggtcccacatccctgggcct

SEQ ID NO: 2501197 - DNA, 22 bp, Homo sapiens
ggtcccacatccctgggcctgc

SEQ ID NO: 2501198 - DNA, 23 bp, Homo sapiens
ggtcccacatccctgggcctgct

SEQ ID NO: 2501199 - DNA, 12 bp, Homo sapiens
ggtcccagcagc

SEQ ID NO: 2501200 - DNA, 21 bp, Homo sapiens
ggtcccccactctaaagcaaa

SEQ ID NO: 2501201 - DNA, 22 bp, Homo sapiens
ggtcccccactctaaagcaaat

SEQ ID NO: 2501202 - DNA, 17 bp, Homo sapiens
ggtccctccccttctct

SEQ ID NO: 2501203 - DNA, 14 bp, Homo sapiens
ggtccctctgtgta

SEQ ID NO: 2501204 - DNA, 13 bp, Homo sapiens
ggtccctgctgcc

SEQ ID NO: 2501205 - DNA, 17 bp, Homo sapiens
ggtcctcctccagggac

SEQ ID NO: 2501206 - DNA, 18 bp, Homo sapiens
ggtcctcctccagggaca

SEQ ID NO: 2501207 - DNA, 21 bp, Homo sapiens
ggtcctctgtcagtcacagcc

SEQ ID NO: 2501208 - DNA, 23 bp, Homo sapiens
ggtcctctgtcagtcacagccac

SEQ ID NO: 2501209 - DNA, 15 bp, Homo sapiens
ggtcctgggaggaga

SEQ ID NO: 2501210 - DNA, 17 bp, Homo sapiens
ggtcctggtggggcagc

SEQ ID NO: 2501211 - DNA, 18 bp, Homo sapiens
ggtcctggtggggcagct

SEQ ID NO: 2501212 - DNA, 18 bp, Homo sapiens
ggtccttttgacactgct

SEQ ID NO: 2501213 - DNA, 19 bp, Homo sapiens
ggtcgccctttgctgcatg

SEQ ID NO: 2501214 - DNA, 14 bp, Homo sapiens
ggtcgctcctgccc

SEQ ID NO: 2501215 - DNA, 14 bp, Homo sapiens
ggtcggggcatctg

SEQ ID NO: 2501216 - DNA, 20 bp, Homo sapiens
ggtcgtggagagctaggagc

SEQ ID NO: 2501217 - DNA, 17 bp, Homo sapiens
ggtctcaaactcctgac

SEQ ID NO: 2501218 - DNA, 23 bp, Homo sapiens
ggtctcaaactcctgggctcagg

SEQ ID NO: 2501219 - DNA, 18 bp, Homo sapiens
ggtctcacagtgttgccc

SEQ ID NO: 2501220 - DNA, 20 bp, Homo sapiens
ggtctcaccctggaggcacc

SEQ ID NO: 2501221 - DNA, 21 bp, Homo sapiens
ggtctcaccctggaggcacct

SEQ ID NO: 2501222 - DNA, 19 bp, Homo sapiens
ggtctcaccggctctcacc

SEQ ID NO: 2501223 - DNA, 16 bp, Homo sapiens
ggtctcatctcttcag

SEQ ID NO: 2501224 - DNA, 15 bp, Homo sapiens
ggtctgagctccagc

SEQ ID NO: 2501225 - DNA, 20 bp, Homo sapiens
ggtctgctcccaaggggcct

SEQ ID NO: 2501226 - DNA, 22 bp, Homo sapiens
ggtctgctcccaaggggcctga

SEQ ID NO: 2501227 - DNA, 16 bp, Homo sapiens
ggtctgctctttctct

SEQ ID NO: 2501228 - DNA, 20 bp, Homo sapiens
ggtctgctctttctctgcca

SEQ ID NO: 2501229 - DNA, 12 bp, Homo sapiens
gtcataattgca

SEQ ID NO: 2501230 - DNA, 18 bp, Homo sapiens
gtcataattgcattgact

SEQ ID NO: 2501231 - DNA, 22 bp, Homo sapiens
gtcatcctcaaagaaagtgtat

SEQ ID NO: 2501232 - DNA, 18 bp, Homo sapiens
gtcatcttgctaccagta

SEQ ID NO: 2501233 - DNA, 22 bp, Homo sapiens
gtcatcttgctaccagtattta

SEQ ID NO: 2501234 - DNA, 14 bp, Homo sapiens
gtcatgtttatctg

SEQ ID NO: 2501235 - DNA, 21 bp, Homo sapiens
gtcattgttatataatcatta

SEQ ID NO: 2501236 - DNA, 21 bp, Homo sapiens
gtcatttgctgagcatgtact

SEQ ID NO: 2501237 - DNA, 17 bp, Homo sapiens
gtcatttttacaatgta

SEQ ID NO: 2501238 - DNA, 18 bp, Homo sapiens
gtccaaaaccgccagctc

SEQ ID NO: 2501239 - DNA, 20 bp, Homo sapiens
gtccaaaaccgccagctctg

SEQ ID NO: 2501240 - DNA, 16 bp, Homo sapiens
gtccaaagaggctgcc

SEQ ID NO: 2501241 - DNA, 19 bp, Homo sapiens
gtccaaagaggctgcccct

SEQ ID NO: 2501242 - DNA, 15 bp, Homo sapiens
gtccaagctgggaga

SEQ ID NO: 2501243 - DNA, 12 bp, Homo sapiens
gtccaatcctat

SEQ ID NO: 2501244 - DNA, 17 bp, Homo sapiens
gtccaatgagctttctg

SEQ ID NO: 2501245 - DNA, 20 bp, Homo sapiens
gtccacaagcttctgtcctg

SEQ ID NO: 2501246 - DNA, 22 bp, Homo sapiens
gtccacaggcttctgagcagcg

SEQ ID NO: 2501247 - DNA, 12 bp, Homo sapiens
gtccagctctgg

SEQ ID NO: 2501248 - DNA, 16 bp, Homo sapiens
gtccagctctggaggg

SEQ ID NO: 2501249 - DNA, 17 bp, Homo sapiens
gtccagctgagcgccag

SEQ ID NO: 2501250 - DNA, 21 bp, Homo sapiens
gtccaggatgctaacatctaa

SEQ ID NO: 2501251 - DNA, 15 bp, Homo sapiens
gtccaggcactgaga

SEQ ID NO: 2501252 - DNA, 14 bp, Homo sapiens
gtccaggctgccgt

SEQ ID NO: 2501253 - DNA, 17 bp, Homo sapiens
gtccaggtcctggtggg

SEQ ID NO: 2501254 - DNA, 17 bp, Homo sapiens
gtccagtcctatctggg

SEQ ID NO: 2501255 - DNA, 16 bp, Homo sapiens
gtccatgggcagagcc

SEQ ID NO: 2501256 - DNA, 18 bp, Homo sapiens
gtcccacatccctgggcc

SEQ ID NO: 2501257 - DNA, 14 bp, Homo sapiens
gtcccacccccacc

SEQ ID NO: 2501258 - DNA, 22 bp, Homo sapiens
gtcccacccccacccccagctc

SEQ ID NO: 2501259 - DNA, 21 bp, Homo sapiens
gtcccaggttggctctgccag

SEQ ID NO: 2501260 - DNA, 22 bp, Homo sapiens
gtcccaggttggctctgccagt

SEQ ID NO: 2501261 - DNA, 17 bp, Homo sapiens
gtcccatgatccctgtg

SEQ ID NO: 2501262 - DNA, 13 bp, Homo sapiens
gtcccatgtggtg

SEQ ID NO: 2501263 - DNA, 16 bp, Homo sapiens
gtccccaacagcgccc

SEQ ID NO: 2501264 - DNA, 12 bp, Homo sapiens
gtccccagcaga

SEQ ID NO: 2501265 - DNA, 16 bp, Homo sapiens
gtccccatactcctat

SEQ ID NO: 2501266 - DNA, 13 bp, Homo sapiens
gtccccccaccct

SEQ ID NO: 2501267 - DNA, 14 bp, Homo sapiens
gtccccccactccc

SEQ ID NO: 2501268 - DNA, 21 bp, Homo sapiens
gtccccctctgtccaggcact

SEQ ID NO: 2501269 - DNA, 17 bp, Homo sapiens
gtcccctgagttggagc

SEQ ID NO: 2501270 - DNA, 18 bp, Homo sapiens
gtcccctgctacacctat

SEQ ID NO: 2501271 - DNA, 19 bp, Homo sapiens
gtcccgatagggtatttga

SEQ ID NO: 2501272 - DNA, 15 bp, Homo sapiens
gtcccggggccagca

SEQ ID NO: 2501273 - DNA, 16 bp, Homo sapiens
gtccctcccccttgtc

SEQ ID NO: 2501274 - DNA, 13 bp, Homo sapiens
gtccctctgtgta

SEQ ID NO: 2501275 - DNA, 22 bp, Homo sapiens
gtccctctgtgtatttgctttt

SEQ ID NO: 2501276 - DNA, 15 bp, Homo sapiens
gtccctgctgccagc

SEQ ID NO: 2501277 - DNA, 19 bp, Homo sapiens
gtccctgggagggacatgc

SEQ ID NO: 2501278 - DNA, 15 bp, Homo sapiens
gtccctggggctagg

SEQ ID NO: 2501279 - DNA, 20 bp, Homo sapiens
gtccctgggtagcgggggag

SEQ ID NO: 2501280 - DNA, 18 bp, Homo sapiens
gtcccttgcccccctggc

SEQ ID NO: 2501281 - DNA, 19 bp, Homo sapiens
gtcccttgcccccctggcc

SEQ ID NO: 2501282 - DNA, 20 bp, Homo sapiens
gtcccttgcccccctggcct

SEQ ID NO: 2501283 - DNA, 19 bp, Homo sapiens
gtcccttgcctcaatgcca

SEQ ID NO: 2501284 - DNA, 16 bp, Homo sapiens
gtccggtgttctaaga

SEQ ID NO: 2501285 - DNA, 19 bp, Homo sapiens
gtccgttcacatgtgtggt

SEQ ID NO: 2501286 - DNA, 22 bp, Homo sapiens
gtcctaacctcgggcctgctgc

SEQ ID NO: 2501287 - DNA, 17 bp, Homo sapiens
gtcctagcacagatggc

SEQ ID NO: 2501288 - DNA, 20 bp, Homo sapiens
gtcctatctccagcggccct

SEQ ID NO: 2501289 - DNA, 14 bp, Homo sapiens
gtcctatctgggct

SEQ ID NO: 2501290 - DNA, 17 bp, Homo sapiens
gtcctatctgggcttcc

SEQ ID NO: 2501291 - DNA, 22 bp, Homo sapiens
gtcctatctgggcttcctggag

SEQ ID NO: 2501292 - DNA, 12 bp, Homo sapiens
gtcctcagcctt

SEQ ID NO: 2501293 - DNA, 16 bp, Homo sapiens
gtcctcagccttgcca

SEQ ID NO: 2501294 - DNA, 21 bp, Homo sapiens
gtcctcagccttgccagagat

SEQ ID NO: 2501295 - DNA, 21 bp, Homo sapiens
gtcctccaacaccaagcacag

SEQ ID NO: 2501296 - DNA, 12 bp, Homo sapiens
gtcctcctctgt

SEQ ID NO: 2501297 - DNA, 14 bp, Homo sapiens
gtcctcctctgtga

SEQ ID NO: 2501298 - DNA, 18 bp, Homo sapiens
gtcctctgtcagtcacag

SEQ ID NO: 2501299 - DNA, 19 bp, Homo sapiens
gtcctctgtcagtcacagc

SEQ ID NO: 2501300 - DNA, 18 bp, Homo sapiens
gtcctcttccctctctgc

SEQ ID NO: 2501301 - DNA, 20 bp, Homo sapiens
gtcctcttccctctctgcag

SEQ ID NO: 2501302 - DNA, 14 bp, Homo sapiens
gtcctgaaggcctg

SEQ ID NO: 2501303 - DNA, 19 bp, Homo sapiens
gtcctgaaggcctgaggtt

SEQ ID NO: 2501304 - DNA, 16 bp, Homo sapiens
gtcctgagaaagctca

SEQ ID NO: 2501305 - DNA, 18 bp, Homo sapiens
gtcctgagcactgccagg

SEQ ID NO: 2501306 - DNA, 21 bp, Homo sapiens
gtcctgagcactgccaggagg

SEQ ID NO: 2501307 - DNA, 15 bp, Homo sapiens
gtcctgatcagagcc

SEQ ID NO: 2501308 - DNA, 22 bp, Homo sapiens
gtcctgcccccaaggaggcagc

SEQ ID NO: 2501309 - DNA, 15 bp, Homo sapiens
gtcctgcctcagcct

SEQ ID NO: 2501310 - DNA, 13 bp, Homo sapiens
gtcctgggcctgc

SEQ ID NO: 2501311 - DNA, 15 bp, Homo sapiens
gtcctgtacattgtg

SEQ ID NO: 2501312 - DNA, 16 bp, Homo sapiens
gtcctgtcatcatcat

SEQ ID NO: 2501313 - DNA, 23 bp, Homo sapiens
gtcctgtcatcatcatggccagc

SEQ ID NO: 2501314 - DNA, 18 bp, Homo sapiens
gtcctgtgaatgccactg

SEQ ID NO: 2501315 - DNA, 15 bp, Homo sapiens
gtccttactcctgtg

SEQ ID NO: 2501316 - DNA, 20 bp, Homo sapiens
gtccttagcctggacctctg

SEQ ID NO: 2501317 - DNA, 13 bp, Homo sapiens
gtcctttcttccg

SEQ ID NO: 2501318 - DNA, 17 bp, Homo sapiens
gtccttttgacactgct

SEQ ID NO: 2501319 - DNA, 21 bp, Homo sapiens
gtccttttgacactgctctaa

SEQ ID NO: 2501320 - DNA, 16 bp, Homo sapiens
gtcctttttttccatc

SEQ ID NO: 2501321 - DNA, 20 bp, Homo sapiens
gtcgcccatgctggagtgca

SEQ ID NO: 2501322 - DNA, 22 bp, Homo sapiens
gtcgccctttgctgcatggcag

SEQ ID NO: 2501323 - DNA, 21 bp, Homo sapiens
gtcgctcatgtgtgcaacagg

SEQ ID NO: 2501324 - DNA, 14 bp, Homo sapiens
gtcggctgaccatg

SEQ ID NO: 2501325 - DNA, 17 bp, Homo sapiens
gtcggctgaccatgctc

SEQ ID NO: 2501326 - DNA, 18 bp, Homo sapiens
gtcggctgaccatgctca

SEQ ID NO: 2501327 - DNA, 18 bp, Homo sapiens
gtcgtgcctgtgtccatg

SEQ ID NO: 2501328 - DNA, 18 bp, Homo sapiens
gtcgtggagagctaggag

SEQ ID NO: 2501329 - DNA, 21 bp, Homo sapiens
gtcgtggagagctaggagcaa

SEQ ID NO: 2501330 - DNA, 23 bp, Homo sapiens
gtcgttaaaaacagatttggaaa

SEQ ID NO: 2501331 - DNA, 16 bp, Homo sapiens
gtcgttttttttttgt

SEQ ID NO: 2501332 - DNA, 11 bp, Homo sapiens
gtctaaaactc

SEQ ID NO: 2501333 - DNA, 24 bp, Homo sapiens
gtgtccaaaaccgccagctctgtt

SEQ ID NO: 2501334 - DNA, 20 bp, Homo sapiens
gtgtccatgcgctcagggcc

SEQ ID NO: 2501335 - DNA, 15 bp, Homo sapiens
gtgtcctgagctcag

SEQ ID NO: 2501336 - DNA, 20 bp, Homo sapiens
gtgtctaagattctagatca

SEQ ID NO: 2501337 - DNA, 19 bp, Homo sapiens
gtgtctagaggcaggtagg

SEQ ID NO: 2501338 - DNA, 11 bp, Homo sapiens
gtgtctcaggc

SEQ ID NO: 2501339 - DNA, 15 bp, Homo sapiens
gtgtcttaattatta

SEQ ID NO: 2501340 - DNA, 19 bp, Homo sapiens
gtgtcttaattattatttg

SEQ ID NO: 2501341 - DNA, 16 bp, Homo sapiens
gtgtcttgggcagagc

SEQ ID NO: 2501342 - DNA, 20 bp, Homo sapiens
gtgtcttgggcagagctggc

SEQ ID NO: 2501343 - DNA, 18 bp, Homo sapiens
gtgtctttcacagctcct

SEQ ID NO: 2501344 - DNA, 12 bp, Homo sapiens
gtgtgagactgg

SEQ ID NO: 2501345 - DNA, 13 bp, Homo sapiens
gtgtgccctctgg

SEQ ID NO: 2501346 - DNA, 17 bp, Homo sapiens
gtgtgccctctgggctc

SEQ ID NO: 2501347 - DNA, 21 bp, Homo sapiens
gtgtgccctctgggctctgag

SEQ ID NO: 2501348 - DNA, 16 bp, Homo sapiens
gtgtgcggctgtgtgt

SEQ ID NO: 2501349 - DNA, 15 bp, Homo sapiens
gtgtgctctccattc

SEQ ID NO: 2501350 - DNA, 12 bp, Homo sapiens
gtgtgctgggag

SEQ ID NO: 2501351 - DNA, 17 bp, Homo sapiens
gtgtgctttttttgtgt

SEQ ID NO: 2501352 - DNA, 21 bp, Homo sapiens
gtgtggaagttattaacttta

SEQ ID NO: 2501353 - DNA, 14 bp, Homo sapiens
gtgtggacaggact

SEQ ID NO: 2501354 - DNA, 18 bp, Homo sapiens
gtgtggagagggaatgtg

SEQ ID NO: 2501355 - DNA, 14 bp, Homo sapiens
gtgtggtacagaga

SEQ ID NO: 2501356 - DNA, 17 bp, Homo sapiens
gtgtggtacagagaagc

SEQ ID NO: 2501357 - DNA, 14 bp, Homo sapiens
gtgtgtatatggac

SEQ ID NO: 2501358 - DNA, 15 bp, Homo sapiens
gtgtgtatttgctaa

SEQ ID NO: 2501359 - DNA, 20 bp, Homo sapiens
gtgtgtccacgactgtctcc

SEQ ID NO: 2501360 - DNA, 23 bp, Homo sapiens
gtgtgtgccctctgggctctgag

SEQ ID NO: 2501361 - DNA, 13 bp, Homo sapiens
gtgtgtgtgaatg

SEQ ID NO: 2501362 - DNA, 19 bp, Homo sapiens
gtgtgttgatactgttgca

SEQ ID NO: 2501363 - DNA, 14 bp, Homo sapiens
gtgtgttgtctctt

SEQ ID NO: 2501364 - DNA, 22 bp, Homo sapiens
gtgttaacagaagggagggcag

SEQ ID NO: 2501365 - DNA, 23 bp, Homo sapiens
gtgttaacagaagggagggcaga

SEQ ID NO: 2501366 - DNA, 14 bp, Homo sapiens
gtgttaacattcca

SEQ ID NO: 2501367 - DNA, 12 bp, Homo sapiens
gtgttacctgta

SEQ ID NO: 2501368 - DNA, 16 bp, Homo sapiens
gtgttagggaagggcc

SEQ ID NO: 2501369 - DNA, 21 bp, Homo sapiens
gtgttatttggaaccttgttt

SEQ ID NO: 2501370 - DNA, 14 bp, Homo sapiens
gtgttcaatatttt

SEQ ID NO: 2501371 - DNA, 16 bp, Homo sapiens
gtgttcaatattttct

SEQ ID NO: 2501372 - DNA, 13 bp, Homo sapiens
gtgttctaagatg

SEQ ID NO: 2501373 - DNA, 11 bp, Homo sapiens
gtgttctcctt

SEQ ID NO: 2501374 - DNA, 13 bp, Homo sapiens
gtgttctgttttg

SEQ ID NO: 2501375 - DNA, 22 bp, Homo sapiens
gtgttgagcatctgtccccctt

SEQ ID NO: 2501376 - DNA, 13 bp, Homo sapiens
gtgttgatactgt

SEQ ID NO: 2501377 - DNA, 14 bp, Homo sapiens
gtgttgatactgtt

SEQ ID NO: 2501378 - DNA, 17 bp, Homo sapiens
gtgttgatactgttgca

SEQ ID NO: 2501379 - DNA, 18 bp, Homo sapiens
gtgtttccacagcctgca

SEQ ID NO: 2501380 - DNA, 14 bp, Homo sapiens
gtgtttcttgcctc

SEQ ID NO: 2501381 - DNA, 16 bp, Homo sapiens
gtgtttcttgcctcat

SEQ ID NO: 2501382 - DNA, 13 bp, Homo sapiens
gtgttttaattta

SEQ ID NO: 2501383 - DNA, 14 bp, Homo sapiens
gtgttttaatttaa

SEQ ID NO: 2501384 - DNA, 20 bp, Homo sapiens
gtgttttgaaagaatagaac

SEQ ID NO: 2501385 - DNA, 15 bp, Homo sapiens
gtgtttttctattaa

SEQ ID NO: 2501386 - DNA, 21 bp, Homo sapiens
gtgtttttctattaaaagact

SEQ ID NO: 2501387 - DNA, 22 bp, Homo sapiens
gtgtttttctattaaaagactc

SEQ ID NO: 2501388 - DNA, 19 bp, Homo sapiens
gtgtttttttatgaatggg

SEQ ID NO: 2501389 - DNA, 20 bp, Homo sapiens
gttaaaaacagatttggaaa

SEQ ID NO: 2501390 - DNA, 18 bp, Homo sapiens
gttaaaggtgaacattgg

SEQ ID NO: 2501391 - DNA, 20 bp, Homo sapiens
gttaacagaagggagggcag

SEQ ID NO: 2501392 - DNA, 23 bp, Homo sapiens
gttaacagaagggagggcagagc

SEQ ID NO: 2501393 - DNA, 22 bp, Homo sapiens
gttaactgaataccactctgta

SEQ ID NO: 2501394 - DNA, 17 bp, Homo sapiens
gttaagacatgatttcc

SEQ ID NO: 2501395 - DNA, 22 bp, Homo sapiens
gttaagacatgatttccttgaa

SEQ ID NO: 2501396 - DNA, 16 bp, Homo sapiens
gttaagacctggcagc

SEQ ID NO: 2501397 - DNA, 12 bp, Homo sapiens
gttaagctctgc

SEQ ID NO: 2501398 - DNA, 21 bp, Homo sapiens
gttaatattgatttattaata

SEQ ID NO: 2501399 - DNA, 19 bp, Homo sapiens
gttaatttagaaaacttta

SEQ ID NO: 2501400 - DNA, 17 bp, Homo sapiens
gttaattttgaagtgct

SEQ ID NO: 2501401 - DNA, 22 bp, Homo sapiens
gttaattttgaagtgctgttta

SEQ ID NO: 2501402 - DNA, 14 bp, Homo sapiens
gttaatttttccta

SEQ ID NO: 2501403 - DNA, 14 bp, Homo sapiens
gttaatttttgata

SEQ ID NO: 2501404 - DNA, 17 bp, Homo sapiens
gttacactttttggaag

SEQ ID NO: 2501405 - DNA, 13 bp, Homo sapiens
gttacagttctgt

SEQ ID NO: 2501406 - DNA, 15 bp, Homo sapiens
gttacagttctgtgg

SEQ ID NO: 2501407 - DNA, 16 bp, Homo sapiens
gttaccattaaaccat

SEQ ID NO: 2501408 - DNA, 23 bp, Homo sapiens
gttaccattaaaccatctccctg

SEQ ID NO: 2501409 - DNA, 16 bp, Homo sapiens
gttaccatttacatgt

SEQ ID NO: 2501410 - DNA, 22 bp, Homo sapiens
gttacctgaaaacactgtgcac

SEQ ID NO: 2501411 - DNA, 18 bp, Homo sapiens
gttaccttatagttactg

SEQ ID NO: 2501412 - DNA, 22 bp, Homo sapiens
gttaccttatagttactgtgta

SEQ ID NO: 2501413 - DNA, 13 bp, Homo sapiens
gttagcagacagg

SEQ ID NO: 2501414 - DNA, 18 bp, Homo sapiens
gttagcagacaggccccg

SEQ ID NO: 2501415 - DNA, 23 bp, Homo sapiens
gttagccttttttccccagactt

SEQ ID NO: 2501416 - DNA, 19 bp, Homo sapiens
gttagggactgaccagcag

SEQ ID NO: 2501417 - DNA, 21 bp, Homo sapiens
gttagtttgtatatattatta

SEQ ID NO: 2501418 - DNA, 13 bp, Homo sapiens
gttataagactct

SEQ ID NO: 2501419 - DNA, 14 bp, Homo sapiens
gttatataatttag

SEQ ID NO: 2501420 - DNA, 15 bp, Homo sapiens
gttatataatttaga

SEQ ID NO: 2501421 - DNA, 13 bp, Homo sapiens
gttatatataaat

SEQ ID NO: 2501422 - DNA, 16 bp, Homo sapiens
gttatatataaatata

SEQ ID NO: 2501423 - DNA, 20 bp, Homo sapiens
gttatcaccgtgggctccct

SEQ ID NO: 2501424 - DNA, 20 bp, Homo sapiens
gttatcacctagctgaatgt

SEQ ID NO: 2501425 - DNA, 21 bp, Homo sapiens
gttatcttctcaagttctaag

SEQ ID NO: 2501426 - DNA, 16 bp, Homo sapiens
gttatgcaaaagcaag

SEQ ID NO: 2501427 - DNA, 22 bp, Homo sapiens
gttattatctgggcttatatct

SEQ ID NO: 2501428 - DNA, 16 bp, Homo sapiens
gttattgcagtttatc

SEQ ID NO: 2501429 - DNA, 17 bp, Homo sapiens
gttattttgtttttcct

SEQ ID NO: 2501430 - DNA, 23 bp, Homo sapiens
gttcaacaaagaaacaaagatgt

SEQ ID NO: 2501431 - DNA, 14 bp, Homo sapiens
gttcaacttattaa

SEQ ID NO: 2501432 - DNA, 16 bp, Homo sapiens
gttcacttttgacaaa

SEQ ID NO: 2501433 - DNA, 20 bp, Homo sapiens
gttcacttttgacaaaggca

SEQ ID NO: 2501434 - DNA, 22 bp, Homo sapiens
gttcagaatttagtgtatccat

SEQ ID NO: 2501435 - DNA, 15 bp, Homo sapiens
gttcagcactgtccc

SEQ ID NO: 2501436 - DNA, 19 bp, Homo sapiens
gttcagcatggcatccaag

SEQ ID NO: 2501437 - DNA, 20 bp, Homo sapiens
taaataaaatgctaggttct

SEQ ID NO: 2501438 - DNA, 14 bp, Homo sapiens
taaataactggaaa

SEQ ID NO: 2501439 - DNA, 13 bp, Homo sapiens
taaataatgcttt

SEQ ID NO: 2501440 - DNA, 16 bp, Homo sapiens
taaataatgctttgaa

SEQ ID NO: 2501441 - DNA, 19 bp, Homo sapiens
taaatacaattttttttat

SEQ ID NO: 2501442 - DNA, 13 bp, Homo sapiens
taaatacaggaaa

SEQ ID NO: 2501443 - DNA, 17 bp, Homo sapiens
taaatacaggaaacagt

SEQ ID NO: 2501444 - DNA, 13 bp, Homo sapiens
taaatacagtctt

SEQ ID NO: 2501445 - DNA, 22 bp, Homo sapiens
taaatacagtcttccatttgca

SEQ ID NO: 2501446 - DNA, 23 bp, Homo sapiens
taaatacagtcttccatttgcaa

SEQ ID NO: 2501447 - DNA, 21 bp, Homo sapiens
taaataggcggggcttgcctt

SEQ ID NO: 2501448 - DNA, 13 bp, Homo sapiens
taaatagtatttc

SEQ ID NO: 2501449 - DNA, 13 bp, Homo sapiens
taaatatattatt

SEQ ID NO: 2501450 - DNA, 18 bp, Homo sapiens
taaatatattattacttg

SEQ ID NO: 2501451 - DNA, 21 bp, Homo sapiens
taaatatattattacttgtaa

SEQ ID NO: 2501452 - DNA, 23 bp, Homo sapiens
taaatatattattacttgtaaat

SEQ ID NO: 2501453 - DNA, 22 bp, Homo sapiens
taaatatatttaagataattat

SEQ ID NO: 2501454 - DNA, 14 bp, Homo sapiens
taaatatgtacatt

SEQ ID NO: 2501455 - DNA, 17 bp, Homo sapiens
taaatattttaaagaat

SEQ ID NO: 2501456 - DNA, 13 bp, Homo sapiens
taaatcaataaag

SEQ ID NO: 2501457 - DNA, 16 bp, Homo sapiens
taaatcacgctttttg

SEQ ID NO: 2501458 - DNA, 17 bp, Homo sapiens
taaatcagtaagaggtg

SEQ ID NO: 2501459 - DNA, 18 bp, Homo sapiens
taaatcagtaagaggtgt

SEQ ID NO: 2501460 - DNA, 17 bp, Homo sapiens
taaatcctttactgtta

SEQ ID NO: 2501461 - DNA, 15 bp, Homo sapiens
taaatctacacacgg

SEQ ID NO: 2501462 - DNA, 14 bp, Homo sapiens
taaatctgacccag

SEQ ID NO: 2501463 - DNA, 12 bp, Homo sapiens
taaatctgccac

SEQ ID NO: 2501464 - DNA, 13 bp, Homo sapiens
taaatcttttata

SEQ ID NO: 2501465 - DNA, 19 bp, Homo sapiens
taaatcttttataggattt

SEQ ID NO: 2501466 - DNA, 13 bp, Homo sapiens
taaatgaatgttt

SEQ ID NO: 2501467 - DNA, 16 bp, Homo sapiens
taaatgcaaataacaa

SEQ ID NO: 2501468 - DNA, 12 bp, Homo sapiens
taaatgccctgc

SEQ ID NO: 2501469 - DNA, 12 bp, Homo sapiens
taaatggcctca

SEQ ID NO: 2501470 - DNA, 21 bp, Homo sapiens
taaatgtagttctgctccaga

SEQ ID NO: 2501471 - DNA, 17 bp, Homo sapiens
taaatgtcactttttga

SEQ ID NO: 2501472 - DNA, 23 bp, Homo sapiens
taaatgtcactttttgaggcaaa

SEQ ID NO: 2501473 - DNA, 19 bp, Homo sapiens
taaatgtgatgaatactgt

SEQ ID NO: 2501474 - DNA, 13 bp, Homo sapiens
taaatgttattat

SEQ ID NO: 2501475 - DNA, 16 bp, Homo sapiens
taaattacagaaattt

SEQ ID NO: 2501476 - DNA, 16 bp, Homo sapiens
taaattatgtaaatta

SEQ ID NO: 2501477 - DNA, 16 bp, Homo sapiens
taaattcacaaacttt

SEQ ID NO: 2501478 - DNA, 13 bp, Homo sapiens
taaattgattttt

SEQ ID NO: 2501479 - DNA, 21 bp, Homo sapiens
taaattgatttttataaatac

SEQ ID NO: 2501480 - DNA, 22 bp, Homo sapiens
taaattgatttttataaatact

SEQ ID NO: 2501481 - DNA, 17 bp, Homo sapiens
taaattggcatggaaat

SEQ ID NO: 2501482 - DNA, 18 bp, Homo sapiens
taaatttgacttttctgt

SEQ ID NO: 2501483 - DNA, 18 bp, Homo sapiens
taaattttttgttgacat

SEQ ID NO: 2501484 - DNA, 14 bp, Homo sapiens
taacaacatgtttc

SEQ ID NO: 2501485 - DNA, 13 bp, Homo sapiens
taacaatacaaat

SEQ ID NO: 2501486 - DNA, 20 bp, Homo sapiens
taacaatacaaatggatttt

SEQ ID NO: 2501487 - DNA, 18 bp, Homo sapiens
taacaattgtgtagcctt

SEQ ID NO: 2501488 - DNA, 19 bp, Homo sapiens
taacaattgtgtagccttt

SEQ ID NO: 2501489 - DNA, 23 bp, Homo sapiens
taacactaatatatttaaaaata

SEQ ID NO: 2501490 - DNA, 18 bp, Homo sapiens
taacactcagaagcctgg

SEQ ID NO: 2501491 - DNA, 20 bp, Homo sapiens
taacactcagaagcctgggg

SEQ ID NO: 2501492 - DNA, 14 bp, Homo sapiens
taacagaaattgta

SEQ ID NO: 2501493 - DNA, 15 bp, Homo sapiens
taacagcaccaaatc

SEQ ID NO: 2501494 - DNA, 11 bp, Homo sapiens
taacagccctc

SEQ ID NO: 2501495 - DNA, 17 bp, Homo sapiens
taacagccctcctctgc

SEQ ID NO: 2501496 - DNA, 18 bp, Homo sapiens
taacagccctcctctgca

SEQ ID NO: 2501497 - DNA, 20 bp, Homo sapiens
taacagccctcctctgcact

SEQ ID NO: 2501498 - DNA, 20 bp, Homo sapiens
taacagggaaggcaggcagg

SEQ ID NO: 2501499 - DNA, 23 bp, Homo sapiens
taacagggaaggcaggcagggct

SEQ ID NO: 2501500 - DNA, 18 bp, Homo sapiens
taacagttgtatttaaca

SEQ ID NO: 2501501 - DNA, 14 bp, Homo sapiens
taacataagctatt

SEQ ID NO: 2501502 - DNA, 19 bp, Homo sapiens
taacataagctatttttct

SEQ ID NO: 2501503 - DNA, 23 bp, Homo sapiens
taacatataatgttgttatttaa

SEQ ID NO: 2501504 - DNA, 22 bp, Homo sapiens
taacatgtcctgcctattatct

SEQ ID NO: 2501505 - DNA, 19 bp, Homo sapiens
taacatgtgaaaagaatag

SEQ ID NO: 2501506 - DNA, 22 bp, Homo sapiens
taacatgtgttaagtattttca

SEQ ID NO: 2501507 - DNA, 12 bp, Homo sapiens
taacattccaag

SEQ ID NO: 2501508 - DNA, 10 bp, Homo sapiens
taacattcct

SEQ ID NO: 2501509 - DNA, 11 bp, Homo sapiens
taacattcctc

SEQ ID NO: 2501510 - DNA, 21 bp, Homo sapiens
taacattcctcatgaatgtaa

SEQ ID NO: 2501511 - DNA, 23 bp, Homo sapiens
taacattcctcatgaatgtaaat

SEQ ID NO: 2501512 - DNA, 13 bp, Homo sapiens
taacatttgctgt

SEQ ID NO: 2501513 - DNA, 17 bp, Homo sapiens
taacatttgctgtttta

SEQ ID NO: 2501514 - DNA, 16 bp, Homo sapiens
taacccccctgtacac

SEQ ID NO: 2501515 - DNA, 19 bp, Homo sapiens
taaccctttgtgtgctctc

SEQ ID NO: 2501516 - DNA, 21 bp, Homo sapiens
taaccctttgtgtgctctcca

SEQ ID NO: 2501517 - DNA, 14 bp, Homo sapiens
taacctcatcttct

SEQ ID NO: 2501518 - DNA, 16 bp, Homo sapiens
taaccttgcctggtac

SEQ ID NO: 2501519 - DNA, 19 bp, Homo sapiens
taaccttgcctggtacagt

SEQ ID NO: 2501520 - DNA, 14 bp, Homo sapiens
taacgcctgagccc

SEQ ID NO: 2501521 - DNA, 14 bp, Homo sapiens
taacggaccaaagc

SEQ ID NO: 2501522 - DNA, 23 bp, Homo sapiens
taacggtctgttctgtttcaagg

SEQ ID NO: 2501523 - DNA, 16 bp, Homo sapiens
taacgttgagcccctg

SEQ ID NO: 2501524 - DNA, 20 bp, Homo sapiens
taactaaaataattttgtaa

SEQ ID NO: 2501525 - DNA, 21 bp, Homo sapiens
taactacaaaggtttaaatga

SEQ ID NO: 2501526 - DNA, 17 bp, Homo sapiens
taactagacaccaaagt

SEQ ID NO: 2501527 - DNA, 21 bp, Homo sapiens
taactagacaccaaagttcta

SEQ ID NO: 2501528 - DNA, 14 bp, Homo sapiens
taactcccattacc

SEQ ID NO: 2501529 - DNA, 12 bp, Homo sapiens
taactcctccca

SEQ ID NO: 2501530 - DNA, 21 bp, Homo sapiens
taactcctcccagggttttaa

SEQ ID NO: 2501531 - DNA, 14 bp, Homo sapiens
taactctctttatg

SEQ ID NO: 2501532 - DNA, 14 bp, Homo sapiens
taactgaataccac

SEQ ID NO: 2501533 - DNA, 18 bp, Homo sapiens
taactgaataccactctg

SEQ ID NO: 2501534 - DNA, 16 bp, Homo sapiens
taactgacaagccatc

SEQ ID NO: 2501535 - DNA, 14 bp, Homo sapiens
taactgactattct

SEQ ID NO: 2501536 - DNA, 14 bp, Homo sapiens
taactgctttctgt

SEQ ID NO: 2501537 - DNA, 20 bp, Homo sapiens
taactgctttctgttccaaa

SEQ ID NO: 2501538 - DNA, 18 bp, Homo sapiens
taactggaaaacagaaca

SEQ ID NO: 2501539 - DNA, 20 bp, Homo sapiens
taactggaaaacagaacact

SEQ ID NO: 2501540 - DNA, 20 bp, Homo sapiens
taactgggtaatgaaacaaa

SEQ ID NO: 2501541 - DNA, 20 bp, Homo sapiens
tacctaagattacaaatcag

SEQ ID NO: 2501542 - DNA, 17 bp, Homo sapiens
tacctcagcctgggcgc

SEQ ID NO: 2501543 - DNA, 21 bp, Homo sapiens
tacctcagcctgggcgctggt

SEQ ID NO: 2501544 - DNA, 16 bp, Homo sapiens
tacctcaggcagctca

SEQ ID NO: 2501545 - DNA, 17 bp, Homo sapiens
tacctcaggcagctcaa

SEQ ID NO: 2501546 - DNA, 18 bp, Homo sapiens
tacctcaggcagctcaag

SEQ ID NO: 2501547 - DNA, 14 bp, Homo sapiens
tacctcctgagaaa

SEQ ID NO: 2501548 - DNA, 20 bp, Homo sapiens
tacctgacactcccttgggc

SEQ ID NO: 2501549 - DNA, 12 bp, Homo sapiens
tacctgtggata

SEQ ID NO: 2501550 - DNA, 22 bp, Homo sapiens
taccttctccccagctcccagg

SEQ ID NO: 2501551 - DNA, 14 bp, Homo sapiens
taccttgtatactg

SEQ ID NO: 2501552 - DNA, 16 bp, Homo sapiens
tacgaaataattgttg

SEQ ID NO: 2501553 - DNA, 22 bp, Homo sapiens
tacgaacctacagttttaactg

SEQ ID NO: 2501554 - DNA, 14 bp, Homo sapiens
tacgaatacttttg

SEQ ID NO: 2501555 - DNA, 14 bp, Homo sapiens
tacgctttgattca

SEQ ID NO: 2501556 - DNA, 15 bp, Homo sapiens
tacggattttcagtt

SEQ ID NO: 2501557 - DNA, 20 bp, Homo sapiens
tacggtttgcccctttataa

SEQ ID NO: 2501558 - DNA, 21 bp, Homo sapiens
tacgtagcctaaggctcctgt

SEQ ID NO: 2501559 - DNA, 21 bp, Homo sapiens
tacgtatgtctggttctcaat

SEQ ID NO: 2501560 - DNA, 22 bp, Homo sapiens
tacgtatgtctggttctcaatt

SEQ ID NO: 2501561 - DNA, 14 bp, Homo sapiens
tacgtgcacagggt

SEQ ID NO: 2501562 - DNA, 18 bp, Homo sapiens
tactaaaaaaaagatgaa

SEQ ID NO: 2501563 - DNA, 23 bp, Homo sapiens
tactaacaatcagctccttcctg

SEQ ID NO: 2501564 - DNA, 20 bp, Homo sapiens
tactaagcattgaatggcta

SEQ ID NO: 2501565 - DNA, 16 bp, Homo sapiens
tactaaggacgttgtt

SEQ ID NO: 2501566 - DNA, 22 bp, Homo sapiens
tactaataaactaataattgca

SEQ ID NO: 2501567 - DNA, 20 bp, Homo sapiens
tactaatagaataaaggcag

SEQ ID NO: 2501568 - DNA, 23 bp, Homo sapiens
tactaatagaataaaggcagttt

SEQ ID NO: 2501569 - DNA, 16 bp, Homo sapiens
tactaattccacacct

SEQ ID NO: 2501570 - DNA, 14 bp, Homo sapiens
tactacctgtaatg

SEQ ID NO: 2501571 - DNA, 19 bp, Homo sapiens
tactagagtctgaacagct

SEQ ID NO: 2501572 - DNA, 19 bp, Homo sapiens
tactagggagccatttgag

SEQ ID NO: 2501573 - DNA, 12 bp, Homo sapiens
tactatttaact

SEQ ID NO: 2501574 - DNA, 16 bp, Homo sapiens
tactatttaactgact

SEQ ID NO: 2501575 - DNA, 19 bp, Homo sapiens
tactatttaactgactatt

SEQ ID NO: 2501576 - DNA, 13 bp, Homo sapiens
tactatttcacaa

SEQ ID NO: 2501577 - DNA, 23 bp, Homo sapiens
tactcaaatgagtaacatttgct

SEQ ID NO: 2501578 - DNA, 13 bp, Homo sapiens
tactcacacaggc

SEQ ID NO: 2501579 - DNA, 14 bp, Homo sapiens
tactcacacaggca

SEQ ID NO: 2501580 - DNA, 16 bp, Homo sapiens
tactcacttttcccac

SEQ ID NO: 2501581 - DNA, 23 bp, Homo sapiens
tactcagataaggtaaaatgcca

SEQ ID NO: 2501582 - DNA, 11 bp, Homo sapiens
tactcattttt

SEQ ID NO: 2501583 - DNA, 16 bp, Homo sapiens
tactcatttttcatga

SEQ ID NO: 2501584 - DNA, 17 bp, Homo sapiens
tactccacactgcacaa

SEQ ID NO: 2501585 - DNA, 14 bp, Homo sapiens
tactccctctcagg

SEQ ID NO: 2501586 - DNA, 19 bp, Homo sapiens
tactcctatgatctgagtc

SEQ ID NO: 2501587 - DNA, 20 bp, Homo sapiens
tactcctgtgggagcctcgc

SEQ ID NO: 2501588 - DNA, 21 bp, Homo sapiens
tactcctgtgggagcctcgca

SEQ ID NO: 2501589 - DNA, 13 bp, Homo sapiens
tactctaagatct

SEQ ID NO: 2501590 - DNA, 18 bp, Homo sapiens
tactctaagatcttagat

SEQ ID NO: 2501591 - DNA, 14 bp, Homo sapiens
tactctagatgaag

SEQ ID NO: 2501592 - DNA, 17 bp, Homo sapiens
tactctgtgccagagcc

SEQ ID NO: 2501593 - DNA, 19 bp, Homo sapiens
tactctgtgccagagcctg

SEQ ID NO: 2501594 - DNA, 22 bp, Homo sapiens
tactctgtgccagagcctgggg

SEQ ID NO: 2501595 - DNA, 13 bp, Homo sapiens
tactctttctgta

SEQ ID NO: 2501596 - DNA, 16 bp, Homo sapiens
tactctttctgtatat

SEQ ID NO: 2501597 - DNA, 18 bp, Homo sapiens
tactgaacatctgagtcc

SEQ ID NO: 2501598 - DNA, 16 bp, Homo sapiens
tactgactttgcttgc

SEQ ID NO: 2501599 - DNA, 14 bp, Homo sapiens
tactgcaaatcagg

SEQ ID NO: 2501600 - DNA, 21 bp, Homo sapiens
tactgcaaggttcaacttatt

SEQ ID NO: 2501601 - DNA, 12 bp, Homo sapiens
tactgcctgctt

SEQ ID NO: 2501602 - DNA, 14 bp, Homo sapiens
tactgcctgcttgg

SEQ ID NO: 2501603 - DNA, 17 bp, Homo sapiens
tactgcgactttctgcc

SEQ ID NO: 2501604 - DNA, 14 bp, Homo sapiens
tactggaaagcttt

SEQ ID NO: 2501605 - DNA, 17 bp, Homo sapiens
tactgggaaggctactt

SEQ ID NO: 2501606 - DNA, 21 bp, Homo sapiens
tactggggaaactggccatgg

SEQ ID NO: 2501607 - DNA, 12 bp, Homo sapiens
tactggtctctc

SEQ ID NO: 2501608 - DNA, 15 bp, Homo sapiens
tactgtaattcctca

SEQ ID NO: 2501609 - DNA, 14 bp, Homo sapiens
tactgtacagctgg

SEQ ID NO: 2501610 - DNA, 14 bp, Homo sapiens
tactgtagtattct

SEQ ID NO: 2501611 - DNA, 17 bp, Homo sapiens
tactgtattttgtattg

SEQ ID NO: 2501612 - DNA, 23 bp, Homo sapiens
tactgtattttgtattgtttcaa

SEQ ID NO: 2501613 - DNA, 14 bp, Homo sapiens
tactgtgtgtgtga

SEQ ID NO: 2501614 - DNA, 18 bp, Homo sapiens
tactgtgtgtgtgaatga

SEQ ID NO: 2501615 - DNA, 19 bp, Homo sapiens
tactgtgtgtgtgaatgaa

SEQ ID NO: 2501616 - DNA, 15 bp, Homo sapiens
tactgtgttatgcaa

SEQ ID NO: 2501617 - DNA, 19 bp, Homo sapiens
tactgttctaaagctctga

SEQ ID NO: 2501618 - DNA, 21 bp, Homo sapiens
tactgttctaaagctctgaca

SEQ ID NO: 2501619 - DNA, 14 bp, Homo sapiens
tactgttctgtgtc

SEQ ID NO: 2501620 - DNA, 13 bp, Homo sapiens
tactgttgcacgt

SEQ ID NO: 2501621 - DNA, 16 bp, Homo sapiens
tactgttgcacgtgtg

SEQ ID NO: 2501622 - DNA, 19 bp, Homo sapiens
tactgtttattaaagtaca

SEQ ID NO: 2501623 - DNA, 15 bp, Homo sapiens
tacttaatccaatgg

SEQ ID NO: 2501624 - DNA, 16 bp, Homo sapiens
tacttctgtaattgtg

SEQ ID NO: 2501625 - DNA, 19 bp, Homo sapiens
tacttcttgtgtgtatgca

SEQ ID NO: 2501626 - DNA, 16 bp, Homo sapiens
tacttgaacgttttct

SEQ ID NO: 2501627 - DNA, 18 bp, Homo sapiens
tacttgaacgttttctaa

SEQ ID NO: 2501628 - DNA, 20 bp, Homo sapiens
tacttgaacgttttctaatt

SEQ ID NO: 2501629 - DNA, 23 bp, Homo sapiens
tacttgaacgttttctaattgct

SEQ ID NO: 2501630 - DNA, 14 bp, Homo sapiens
tacttgaagggcca

SEQ ID NO: 2501631 - DNA, 17 bp, Homo sapiens
tacttgaagggccagag

SEQ ID NO: 2501632 - DNA, 18 bp, Homo sapiens
tacttgaagggccagagc

SEQ ID NO: 2501633 - DNA, 19 bp, Homo sapiens
tacttgaagggccagagcc

SEQ ID NO: 2501634 - DNA, 22 bp, Homo sapiens
tacttgaagggccagagccagg

SEQ ID NO: 2501635 - DNA, 12 bp, Homo sapiens
tacttgaatgaa

SEQ ID NO: 2501636 - DNA, 14 bp, Homo sapiens
tacttgaatgaaaa

SEQ ID NO: 2501637 - DNA, 16 bp, Homo sapiens
tacttggagggcccag

SEQ ID NO: 2501638 - DNA, 12 bp, Homo sapiens
tacttgtaatta

SEQ ID NO: 2501639 - DNA, 13 bp, Homo sapiens
tacttgtaattat

SEQ ID NO: 2501640 - DNA, 14 bp, Homo sapiens
tacttgtaattatg

SEQ ID NO: 2501641 - DNA, 23 bp, Homo sapiens
tactttataactaacatgtcctg

SEQ ID NO: 2501642 - DNA, 21 bp, Homo sapiens
tactttccctaccctctagag

SEQ ID NO: 2501643 - DNA, 15 bp, Homo sapiens
tactttccctctggg

SEQ ID NO: 2501644 - DNA, 14 bp, Homo sapiens
tactttgaatgtgt

SEQ ID NO: 2501645 - DNA, 15 bp, Homo sapiens
tatgaaaaagaagaa

SEQ ID NO: 2501646 - DNA, 14 bp, Homo sapiens
tatgaaaagctaga

SEQ ID NO: 2501647 - DNA, 19 bp, Homo sapiens
tatgaaaagctagaattga

SEQ ID NO: 2501648 - DNA, 14 bp, Homo sapiens
tatgaagacataaa

SEQ ID NO: 2501649 - DNA, 13 bp, Homo sapiens
tatgaatactttg

SEQ ID NO: 2501650 - DNA, 15 bp, Homo sapiens
tatgaatgtgaagcc

SEQ ID NO: 2501651 - DNA, 16 bp, Homo sapiens
tatgaatgtgaagcct

SEQ ID NO: 2501652 - DNA, 19 bp, Homo sapiens
tatgaattattcaatttat

SEQ ID NO: 2501653 - DNA, 14 bp, Homo sapiens
tatgagtctagatg

SEQ ID NO: 2501654 - DNA, 20 bp, Homo sapiens
tatgatacttcgacactgtt

SEQ ID NO: 2501655 - DNA, 15 bp, Homo sapiens
tatgattactggcct

SEQ ID NO: 2501656 - DNA, 21 bp, Homo sapiens
tatgattattaacgatgtcca

SEQ ID NO: 2501657 - DNA, 18 bp, Homo sapiens
tatgatttaatttgaaat

SEQ ID NO: 2501658 - DNA, 17 bp, Homo sapiens
tatgcatggtttcagca

SEQ ID NO: 2501659 - DNA, 18 bp, Homo sapiens
tatgcatggtttcagcac

SEQ ID NO: 2501660 - DNA, 20 bp, Homo sapiens
tatgcatggtttcagcacta

SEQ ID NO: 2501661 - DNA, 21 bp, Homo sapiens
tatgcatttaaatacagtctt

SEQ ID NO: 2501662 - DNA, 13 bp, Homo sapiens
tatgcggttaatt

SEQ ID NO: 2501663 - DNA, 13 bp, Homo sapiens
tatgctaatcagg

SEQ ID NO: 2501664 - DNA, 19 bp, Homo sapiens
tatgctaccaccagctgtg

SEQ ID NO: 2501665 - DNA, 15 bp, Homo sapiens
tatgctgtacccagt

SEQ ID NO: 2501666 - DNA, 15 bp, Homo sapiens
tatgctttgaaacag

SEQ ID NO: 2501667 - DNA, 16 bp, Homo sapiens
tatggacaaaacaaga

SEQ ID NO: 2501668 - DNA, 17 bp, Homo sapiens
tatggactatctgtctg

SEQ ID NO: 2501669 - DNA, 15 bp, Homo sapiens
tatggagagccctgg

SEQ ID NO: 2501670 - DNA, 13 bp, Homo sapiens
tatggattctaaa

SEQ ID NO: 2501671 - DNA, 14 bp, Homo sapiens
tatggattctaaaa

SEQ ID NO: 2501672 - DNA, 15 bp, Homo sapiens
tatggattctaaaat

SEQ ID NO: 2501673 - DNA, 14 bp, Homo sapiens
tatggcctgtgtca

SEQ ID NO: 2501674 - DNA, 18 bp, Homo sapiens
tatggcgtaagtacagag

SEQ ID NO: 2501675 - DNA, 21 bp, Homo sapiens
tatggggaaggttatcagtgc

SEQ ID NO: 2501676 - DNA, 23 bp, Homo sapiens
tatggggaaggttatcagtgctt

SEQ ID NO: 2501677 - DNA, 11 bp, Homo sapiens
tatgggtcaca

SEQ ID NO: 2501678 - DNA, 15 bp, Homo sapiens
tatggtaaaaaattt

SEQ ID NO: 2501679 - DNA, 16 bp, Homo sapiens
tatggtaccagatgca

SEQ ID NO: 2501680 - DNA, 17 bp, Homo sapiens
tatggtaccagatgcag

SEQ ID NO: 2501681 - DNA, 21 bp, Homo sapiens
tatggtatttattttttcttt

SEQ ID NO: 2501682 - DNA, 20 bp, Homo sapiens
tatggtgcaatgtgtgtata

SEQ ID NO: 2501683 - DNA, 22 bp, Homo sapiens
tatggtgcaatgtgtgtatatg

SEQ ID NO: 2501684 - DNA, 15 bp, Homo sapiens
tatggtgctctgtct

SEQ ID NO: 2501685 - DNA, 22 bp, Homo sapiens
tatggtttttgagatattaatg

SEQ ID NO: 2501686 - DNA, 13 bp, Homo sapiens
tatgtaaaacatt

SEQ ID NO: 2501687 - DNA, 21 bp, Homo sapiens
tatgtaaatggtatgtcattc

SEQ ID NO: 2501688 - DNA, 15 bp, Homo sapiens
tatgtaaattatgta

SEQ ID NO: 2501689 - DNA, 14 bp, Homo sapiens
tatgtacatttctc

SEQ ID NO: 2501690 - DNA, 14 bp, Homo sapiens
tatgtaccaagaat

SEQ ID NO: 2501691 - DNA, 16 bp, Homo sapiens
tatgtaccatgtacat

SEQ ID NO: 2501692 - DNA, 19 bp, Homo sapiens
tatgtaccctctgaaatac

SEQ ID NO: 2501693 - DNA, 20 bp, Homo sapiens
tatgtaccctctgaaataca

SEQ ID NO: 2501694 - DNA, 15 bp, Homo sapiens
tatgtagctctttgt

SEQ ID NO: 2501695 - DNA, 14 bp, Homo sapiens
tatgtagtaattga

SEQ ID NO: 2501696 - DNA, 17 bp, Homo sapiens
tatgtagtaattgacat

SEQ ID NO: 2501697 - DNA, 15 bp, Homo sapiens
tatgtattgtgcaat

SEQ ID NO: 2501698 - DNA, 18 bp, Homo sapiens
tatgtctggttctcaatt

SEQ ID NO: 2501699 - DNA, 18 bp, Homo sapiens
tatgtggttttagatttt

SEQ ID NO: 2501700 - DNA, 21 bp, Homo sapiens
tatgttatatataaatatatt

SEQ ID NO: 2501701 - DNA, 14 bp, Homo sapiens
tatgttccattaaa

SEQ ID NO: 2501702 - DNA, 15 bp, Homo sapiens
tatgttccattaaac

SEQ ID NO: 2501703 - DNA, 12 bp, Homo sapiens
tatgttgaatac

SEQ ID NO: 2501704 - DNA, 15 bp, Homo sapiens
tatgttgaatacttt

SEQ ID NO: 2501705 - DNA, 18 bp, Homo sapiens
tatgttttcgaaaatcaa

SEQ ID NO: 2501706 - DNA, 20 bp, Homo sapiens
tattaaaaaggtttacagaa

SEQ ID NO: 2501707 - DNA, 15 bp, Homo sapiens
tattaaaagactcat

SEQ ID NO: 2501708 - DNA, 16 bp, Homo sapiens
tattaaaagactcatc

SEQ ID NO: 2501709 - DNA, 13 bp, Homo sapiens
tattaaaatgtat

SEQ ID NO: 2501710 - DNA, 13 bp, Homo sapiens
tattaaagaaaaa

SEQ ID NO: 2501711 - DNA, 21 bp, Homo sapiens
tattaaagaaaaaaatgtatt

SEQ ID NO: 2501712 - DNA, 18 bp, Homo sapiens
tattaaagtgctaaggtt

SEQ ID NO: 2501713 - DNA, 23 bp, Homo sapiens
tattaaattttttgttgacatta

SEQ ID NO: 2501714 - DNA, 20 bp, Homo sapiens
tattaagaaaggaagcattg

SEQ ID NO: 2501715 - DNA, 23 bp, Homo sapiens
tattaatatatattatcttttca

SEQ ID NO: 2501716 - DNA, 12 bp, Homo sapiens
tattaatgcact

SEQ ID NO: 2501717 - DNA, 13 bp, Homo sapiens
tattaatgcactt

SEQ ID NO: 2501718 - DNA, 15 bp, Homo sapiens
tattacattttcagt

SEQ ID NO: 2501719 - DNA, 16 bp, Homo sapiens
tattacggtttgcccc

SEQ ID NO: 2501720 - DNA, 22 bp, Homo sapiens
tattacttgtaaatataaagac

SEQ ID NO: 2501721 - DNA, 18 bp, Homo sapiens
tattagagtgtctttcca

SEQ ID NO: 2501722 - DNA, 17 bp, Homo sapiens
tattagtattgttgtcc

SEQ ID NO: 2501723 - DNA, 14 bp, Homo sapiens
tattataatcttat

SEQ ID NO: 2501724 - DNA, 15 bp, Homo sapiens
tattatcccagctgc

SEQ ID NO: 2501725 - DNA, 13 bp, Homo sapiens
tattatctgtcag

SEQ ID NO: 2501726 - DNA, 19 bp, Homo sapiens
tattatcttttcatacatt

SEQ ID NO: 2501727 - DNA, 22 bp, Homo sapiens
tattatgaatgtgaagccttcc

SEQ ID NO: 2501728 - DNA, 19 bp, Homo sapiens
tattatgcattatatcaaa

SEQ ID NO: 2501729 - DNA, 14 bp, Homo sapiens
tattatttgtgttt

SEQ ID NO: 2501730 - DNA, 20 bp, Homo sapiens
tattcaggacttgaaagaaa

SEQ ID NO: 2501731 - DNA, 20 bp, Homo sapiens
tattcagggaaggaggagcc

SEQ ID NO: 2501732 - DNA, 21 bp, Homo sapiens
tattcatccaagttaaatgta

SEQ ID NO: 2501733 - DNA, 22 bp, Homo sapiens
tattcatccaagttaaatgtag

SEQ ID NO: 2501734 - DNA, 23 bp, Homo sapiens
tattcatccaagttaaatgtaga

SEQ ID NO: 2501735 - DNA, 21 bp, Homo sapiens
tattccagaatgctgtacatc

SEQ ID NO: 2501736 - DNA, 23 bp, Homo sapiens
tattccagaatgctgtacatcta

SEQ ID NO: 2501737 - DNA, 16 bp, Homo sapiens
tattccatgactgctt

SEQ ID NO: 2501738 - DNA, 19 bp, Homo sapiens
tattcgccacacagtattt

SEQ ID NO: 2501739 - DNA, 13 bp, Homo sapiens
tattctaagactt

SEQ ID NO: 2501740 - DNA, 20 bp, Homo sapiens
tattctattacattttcagt

SEQ ID NO: 2501741 - DNA, 16 bp, Homo sapiens
tattctcctatgtttg

SEQ ID NO: 2501742 - DNA, 18 bp, Homo sapiens
tattctctgagctgtgca

SEQ ID NO: 2501743 - DNA, 13 bp, Homo sapiens
tattctgtcccta

SEQ ID NO: 2501744 - DNA, 15 bp, Homo sapiens
tattctgtccctagg

SEQ ID NO: 2501745 - DNA, 16 bp, Homo sapiens
tattgacacagaaaat

SEQ ID NO: 2501746 - DNA, 20 bp, Homo sapiens
tattgacacagaaaatgttg

SEQ ID NO: 2501747 - DNA, 23 bp, Homo sapiens
tattgacacagaaaatgttgaga

SEQ ID NO: 2501748 - DNA, 17 bp, Homo sapiens
tattgacttgtatattt

SEQ ID NO: 2501749 - DNA, 14 bp, Homo sapiens
tcaggacagatgcc

SEQ ID NO: 2501750 - DNA, 15 bp, Homo sapiens
tcaggacagatgcca

SEQ ID NO: 2501751 - DNA, 14 bp, Homo sapiens
tcaggactgggagc

SEQ ID NO: 2501752 - DNA, 22 bp, Homo sapiens
tcaggactgggagcccccagcc

SEQ ID NO: 2501753 - DNA, 16 bp, Homo sapiens
tcaggagtgtgtgtga

SEQ ID NO: 2501754 - DNA, 14 bp, Homo sapiens
tcaggatctatttt

SEQ ID NO: 2501755 - DNA, 18 bp, Homo sapiens
tcaggatgagggaaaaga

SEQ ID NO: 2501756 - DNA, 15 bp, Homo sapiens
tcaggattgcgagag

SEQ ID NO: 2501757 - DNA, 22 bp, Homo sapiens
tcaggattgcgagagatgtgtg

SEQ ID NO: 2501758 - DNA, 23 bp, Homo sapiens
tcaggattgcgagagatgtgtgt

SEQ ID NO: 2501759 - DNA, 18 bp, Homo sapiens
tcaggcactgggcatgag

SEQ ID NO: 2501760 - DNA, 17 bp, Homo sapiens
tcaggcaggggcctcca

SEQ ID NO: 2501761 - DNA, 17 bp, Homo sapiens
tcaggccagagccaagg

SEQ ID NO: 2501762 - DNA, 19 bp, Homo sapiens
tcaggcccccgccttggcc

SEQ ID NO: 2501763 - DNA, 20 bp, Homo sapiens
tcaggcccccgccttggcct

SEQ ID NO: 2501764 - DNA, 21 bp, Homo sapiens
tcaggcgatccacctgtctca

SEQ ID NO: 2501765 - DNA, 14 bp, Homo sapiens
tcaggctaggccag

SEQ ID NO: 2501766 - DNA, 17 bp, Homo sapiens
tcaggctaggccagcag

SEQ ID NO: 2501767 - DNA, 12 bp, Homo sapiens
tcaggctgcctg

SEQ ID NO: 2501768 - DNA, 13 bp, Homo sapiens
tcaggctgcctga

SEQ ID NO: 2501769 - DNA, 19 bp, Homo sapiens
tcagggaggccctgtgccc

SEQ ID NO: 2501770 - DNA, 15 bp, Homo sapiens
tcagggaggtcattt

SEQ ID NO: 2501771 - DNA, 17 bp, Homo sapiens
tcagggccaggcctctc

SEQ ID NO: 2501772 - DNA, 13 bp, Homo sapiens
tcagggccatgct

SEQ ID NO: 2501773 - DNA, 19 bp, Homo sapiens
tcagggccatgctgaggcc

SEQ ID NO: 2501774 - DNA, 23 bp, Homo sapiens
tcagggccatgctgaggcctggg

SEQ ID NO: 2501775 - DNA, 23 bp, Homo sapiens
tcagggctccttgtgggcctggg

SEQ ID NO: 2501776 - DNA, 15 bp, Homo sapiens
tcagggtaggctgga

SEQ ID NO: 2501777 - DNA, 14 bp, Homo sapiens
tcaggtacttgtaa

SEQ ID NO: 2501778 - DNA, 15 bp, Homo sapiens
tcaggtgctggggcc

SEQ ID NO: 2501779 - DNA, 14 bp, Homo sapiens
tcaggtgttgccaa

SEQ ID NO: 2501780 - DNA, 16 bp, Homo sapiens
tcaggtttgagaaaaa

SEQ ID NO: 2501781 - DNA, 22 bp, Homo sapiens
tcaggtttttcctttttttgta

SEQ ID NO: 2501782 - DNA, 18 bp, Homo sapiens
tcagtaatttagaaatca

SEQ ID NO: 2501783 - DNA, 15 bp, Homo sapiens
tcagtagtccctgca

SEQ ID NO: 2501784 - DNA, 14 bp, Homo sapiens
tcagtatttaacta

SEQ ID NO: 2501785 - DNA, 20 bp, Homo sapiens
tcagtatttaactaattata

SEQ ID NO: 2501786 - DNA, 17 bp, Homo sapiens
tcagtctctgagcagtg

SEQ ID NO: 2501787 - DNA, 20 bp, Homo sapiens
tcagtctctgagcagtgaat

SEQ ID NO: 2501788 - DNA, 14 bp, Homo sapiens
tcagtgaagttgct

SEQ ID NO: 2501789 - DNA, 16 bp, Homo sapiens
tcagtgaagttgctgc

SEQ ID NO: 2501790 - DNA, 18 bp, Homo sapiens
tcagtgaagttgctgctt

SEQ ID NO: 2501791 - DNA, 12 bp, Homo sapiens
tcagtgctccct

SEQ ID NO: 2501792 - DNA, 13 bp, Homo sapiens
tcagtgctccctc

SEQ ID NO: 2501793 - DNA, 19 bp, Homo sapiens
tcagtgctccctcacatgt

SEQ ID NO: 2501794 - DNA, 13 bp, Homo sapiens
tcagtgctgtgct

SEQ ID NO: 2501795 - DNA, 15 bp, Homo sapiens
tcagtgttaaatgtg

SEQ ID NO: 2501796 - DNA, 17 bp, Homo sapiens
tcagtgttaaatgtgat

SEQ ID NO: 2501797 - DNA, 18 bp, Homo sapiens
tcagttgattttctggat

SEQ ID NO: 2501798 - DNA, 19 bp, Homo sapiens
tcagtttaaaagcacgaca

SEQ ID NO: 2501799 - DNA, 18 bp, Homo sapiens
tcagtttcacagaaaata

SEQ ID NO: 2501800 - DNA, 16 bp, Homo sapiens
tcagtttgtgtgtctt

SEQ ID NO: 2501801 - DNA, 17 bp, Homo sapiens
tcagtttgtgtgtctta

SEQ ID NO: 2501802 - DNA, 14 bp, Homo sapiens
tcataaggcttcaa

SEQ ID NO: 2501803 - DNA, 15 bp, Homo sapiens
tcataagtatttcaa

SEQ ID NO: 2501804 - DNA, 11 bp, Homo sapiens
tcatacagaga

SEQ ID NO: 2501805 - DNA, 12 bp, Homo sapiens
tcatacagagaa

SEQ ID NO: 2501806 - DNA, 14 bp, Homo sapiens
tcatacagagaagt

SEQ ID NO: 2501807 - DNA, 23 bp, Homo sapiens
tcatacagagaagtcacagggca

SEQ ID NO: 2501808 - DNA, 14 bp, Homo sapiens
tcatacattttcta

SEQ ID NO: 2501809 - DNA, 21 bp, Homo sapiens
tcatacattttctaagaaaca

SEQ ID NO: 2501810 - DNA, 15 bp, Homo sapiens
tcataccaatgaaaa

SEQ ID NO: 2501811 - DNA, 12 bp, Homo sapiens
tcatacttgaac

SEQ ID NO: 2501812 - DNA, 22 bp, Homo sapiens
tcatacttgaacgttttctaat

SEQ ID NO: 2501813 - DNA, 22 bp, Homo sapiens
tcataggtctgaaatttttctt

SEQ ID NO: 2501814 - DNA, 18 bp, Homo sapiens
tcatagtaacttcttatg

SEQ ID NO: 2501815 - DNA, 13 bp, Homo sapiens
tcatagttcagaa

SEQ ID NO: 2501816 - DNA, 14 bp, Homo sapiens
tcatagttcagaat

SEQ ID NO: 2501817 - DNA, 16 bp, Homo sapiens
tcatagttcagaattt

SEQ ID NO: 2501818 - DNA, 16 bp, Homo sapiens
tcatataaagtatcat

SEQ ID NO: 2501819 - DNA, 15 bp, Homo sapiens
tcatataataaatgt

SEQ ID NO: 2501820 - DNA, 20 bp, Homo sapiens
tcatattttaaacagaggat

SEQ ID NO: 2501821 - DNA, 19 bp, Homo sapiens
tcatcaatggggccagtca

SEQ ID NO: 2501822 - DNA, 14 bp, Homo sapiens
tcatcacactgggt

SEQ ID NO: 2501823 - DNA, 21 bp, Homo sapiens
tcatcactttgacctaaatta

SEQ ID NO: 2501824 - DNA, 18 bp, Homo sapiens
tcatcatggccagctgga

SEQ ID NO: 2501825 - DNA, 13 bp, Homo sapiens
tcatcattctctg

SEQ ID NO: 2501826 - DNA, 19 bp, Homo sapiens
tcatcattctctgtctcat

SEQ ID NO: 2501827 - DNA, 14 bp, Homo sapiens
tcatccaccccatc

SEQ ID NO: 2501828 - DNA, 16 bp, Homo sapiens
tcatccaccccatccc

SEQ ID NO: 2501829 - DNA, 14 bp, Homo sapiens
tcatccatcatcat

SEQ ID NO: 2501830 - DNA, 15 bp, Homo sapiens
tcatccatcatcatg

SEQ ID NO: 2501831 - DNA, 21 bp, Homo sapiens
tcatcccgagcacctccacat

SEQ ID NO: 2501832 - DNA, 23 bp, Homo sapiens
tcatcccgagcacctccacatcc

SEQ ID NO: 2501833 - DNA, 17 bp, Homo sapiens
tcatcctcaaagaaagt

SEQ ID NO: 2501834 - DNA, 12 bp, Homo sapiens
tcatcctctggc

SEQ ID NO: 2501835 - DNA, 14 bp, Homo sapiens
tcatctacctagat

SEQ ID NO: 2501836 - DNA, 13 bp, Homo sapiens
tcatctaggattt

SEQ ID NO: 2501837 - DNA, 20 bp, Homo sapiens
tcatctcatttaatcctccc

SEQ ID NO: 2501838 - DNA, 22 bp, Homo sapiens
tcatctcccacctagcagcacc

SEQ ID NO: 2501839 - DNA, 18 bp, Homo sapiens
tcatctcctgccttcctc

SEQ ID NO: 2501840 - DNA, 19 bp, Homo sapiens
tcatctcttcaggttctca

SEQ ID NO: 2501841 - DNA, 19 bp, Homo sapiens
tcatctgctggtccgtggg

SEQ ID NO: 2501842 - DNA, 23 bp, Homo sapiens
tcatctggggagcaggcagccag

SEQ ID NO: 2501843 - DNA, 20 bp, Homo sapiens
tcatctggttgaactctggt

SEQ ID NO: 2501844 - DNA, 23 bp, Homo sapiens
tcatctggttgaactctggtggc

SEQ ID NO: 2501845 - DNA, 12 bp, Homo sapiens
tcatctgtccct

SEQ ID NO: 2501846 - DNA, 21 bp, Homo sapiens
tcatgaatgtaaatttgtact

SEQ ID NO: 2501847 - DNA, 14 bp, Homo sapiens
tcatgacagcctcc

SEQ ID NO: 2501848 - DNA, 21 bp, Homo sapiens
tcatgaggagattctgccttt

SEQ ID NO: 2501849 - DNA, 17 bp, Homo sapiens
tcatgataatgaacaga

SEQ ID NO: 2501850 - DNA, 22 bp, Homo sapiens
tcatgccaccatggccagccaa

SEQ ID NO: 2501851 - DNA, 12 bp, Homo sapiens
tcatgccagcta

SEQ ID NO: 2501852 - DNA, 23 bp, Homo sapiens
tcatgccagctacttcctcctcc

SEQ ID NO: 2501853 - DNA, 17 bp, Homo sapiens
tcccatagccaggaaac

SEQ ID NO: 2501854 - DNA, 13 bp, Homo sapiens
tcccatcgctgtc

SEQ ID NO: 2501855 - DNA, 20 bp, Homo sapiens
tcccatcgtctcggccttca

SEQ ID NO: 2501856 - DNA, 15 bp, Homo sapiens
tcccatgatccctgt

SEQ ID NO: 2501857 - DNA, 23 bp, Homo sapiens
tcccatgggcagaggaccaggct

SEQ ID NO: 2501858 - DNA, 19 bp, Homo sapiens
tccccaaaagcgtgagctt

SEQ ID NO: 2501859 - DNA, 14 bp, Homo sapiens
tccccaactgacca

SEQ ID NO: 2501860 - DNA, 18 bp, Homo sapiens
tccccaactgaccacctt

SEQ ID NO: 2501861 - DNA, 19 bp, Homo sapiens
tccccaactgaccaccttt

SEQ ID NO: 2501862 - DNA, 23 bp, Homo sapiens
tccccacccaccaaccctcaggg

SEQ ID NO: 2501863 - DNA, 20 bp, Homo sapiens
tccccactctgctctgatgc

SEQ ID NO: 2501864 - DNA, 19 bp, Homo sapiens
tccccactgacagcctccc

SEQ ID NO: 2501865 - DNA, 15 bp, Homo sapiens
tccccactggagcag

SEQ ID NO: 2501866 - DNA, 15 bp, Homo sapiens
tccccactgtatcta

SEQ ID NO: 2501867 - DNA, 19 bp, Homo sapiens
tccccacttgtccgctggg

SEQ ID NO: 2501868 - DNA, 18 bp, Homo sapiens
tccccagacgcctggctg

SEQ ID NO: 2501869 - DNA, 21 bp, Homo sapiens
tccccagacgcctggctgctg

SEQ ID NO: 2501870 - DNA, 11 bp, Homo sapiens
tccccagagaa

SEQ ID NO: 2501871 - DNA, 22 bp, Homo sapiens
tccccagagaaaggggagccca

SEQ ID NO: 2501872 - DNA, 17 bp, Homo sapiens
tccccagcccagagaca

SEQ ID NO: 2501873 - DNA, 13 bp, Homo sapiens
tccccagctccca

SEQ ID NO: 2501874 - DNA, 20 bp, Homo sapiens
tccccagggaagcagcagcc

SEQ ID NO: 2501875 - DNA, 23 bp, Homo sapiens
tccccaggtccagctctggaggg

SEQ ID NO: 2501876 - DNA, 18 bp, Homo sapiens
tccccatcgttgccccca

SEQ ID NO: 2501877 - DNA, 14 bp, Homo sapiens
tccccatctcaggc

SEQ ID NO: 2501878 - DNA, 19 bp, Homo sapiens
tccccatcttctaaaccca

SEQ ID NO: 2501879 - DNA, 17 bp, Homo sapiens
tccccatggccctgagc

SEQ ID NO: 2501880 - DNA, 21 bp, Homo sapiens
tcccccagcaaagcccccaga

SEQ ID NO: 2501881 - DNA, 22 bp, Homo sapiens
tcccccagcaaagcccccagag

SEQ ID NO: 2501882 - DNA, 23 bp, Homo sapiens
tcccccagcaaagcccccagagc

SEQ ID NO: 2501883 - DNA, 23 bp, Homo sapiens
tcccccagtcattctgggaacat

SEQ ID NO: 2501884 - DNA, 16 bp, Homo sapiens
tcccccatgttctgtc

SEQ ID NO: 2501885 - DNA, 12 bp, Homo sapiens
tccccccatctt

SEQ ID NO: 2501886 - DNA, 21 bp, Homo sapiens
tccccctatttattgactttg

SEQ ID NO: 2501887 - DNA, 16 bp, Homo sapiens
tccccctccctcccct

SEQ ID NO: 2501888 - DNA, 21 bp, Homo sapiens
tccccctgtttcagaggctca

SEQ ID NO: 2501889 - DNA, 13 bp, Homo sapiens
tccccggctcgag

SEQ ID NO: 2501890 - DNA, 15 bp, Homo sapiens
tcccctaaagcctca

SEQ ID NO: 2501891 - DNA, 15 bp, Homo sapiens
tcccctagagtccca

SEQ ID NO: 2501892 - DNA, 17 bp, Homo sapiens
tcccctcacctcctcta

SEQ ID NO: 2501893 - DNA, 15 bp, Homo sapiens
tcccctccatccctg

SEQ ID NO: 2501894 - DNA, 18 bp, Homo sapiens
tcccctccatccctggcc

SEQ ID NO: 2501895 - DNA, 18 bp, Homo sapiens
tcccctccttctcccttt

SEQ ID NO: 2501896 - DNA, 13 bp, Homo sapiens
tcccctctgctgc

SEQ ID NO: 2501897 - DNA, 15 bp, Homo sapiens
tcccctctgctgctg

SEQ ID NO: 2501898 - DNA, 14 bp, Homo sapiens
tcccctgcaggctg

SEQ ID NO: 2501899 - DNA, 21 bp, Homo sapiens
tcccctgccccctgcaggaag

SEQ ID NO: 2501900 - DNA, 19 bp, Homo sapiens
tcccctggagggggaatgg

SEQ ID NO: 2501901 - DNA, 13 bp, Homo sapiens
tccccttatcctc

SEQ ID NO: 2501902 - DNA, 17 bp, Homo sapiens
tccccttatcctccctg

SEQ ID NO: 2501903 - DNA, 18 bp, Homo sapiens
tccccttatcctccctgt

SEQ ID NO: 2501904 - DNA, 19 bp, Homo sapiens
tccccttatcctccctgta

SEQ ID NO: 2501905 - DNA, 20 bp, Homo sapiens
tccccttatcctccctgtaa

SEQ ID NO: 2501906 - DNA, 18 bp, Homo sapiens
tccccttctcccctgcac

SEQ ID NO: 2501907 - DNA, 18 bp, Homo sapiens
tccccttgggcccacacc

SEQ ID NO: 2501908 - DNA, 19 bp, Homo sapiens
tccccttgggcccacacct

SEQ ID NO: 2501909 - DNA, 22 bp, Homo sapiens
tcccgagcacctccacatcctc

SEQ ID NO: 2501910 - DNA, 20 bp, Homo sapiens
tcccgtttctccacctagac

SEQ ID NO: 2501911 - DNA, 13 bp, Homo sapiens
tccctacatgtat

SEQ ID NO: 2501912 - DNA, 24 bp, Homo sapiens
tccctacatgtattgcacattgta

SEQ ID NO: 2501913 - DNA, 23 bp, Homo sapiens
tccctaggtgttttgttcaccat

SEQ ID NO: 2501914 - DNA, 14 bp, Homo sapiens
tccctcacctgtag

SEQ ID NO: 2501915 - DNA, 15 bp, Homo sapiens
tccctcaccttggca

SEQ ID NO: 2501916 - DNA, 22 bp, Homo sapiens
tccctcaccttggcaccagaca

SEQ ID NO: 2501917 - DNA, 23 bp, Homo sapiens
tccctcccagaggagccaccagt

SEQ ID NO: 2501918 - DNA, 14 bp, Homo sapiens
tccctccccttctc

SEQ ID NO: 2501919 - DNA, 14 bp, Homo sapiens
tccctccccttgcc

SEQ ID NO: 2501920 - DNA, 14 bp, Homo sapiens
tccctccctctccg

SEQ ID NO: 2501921 - DNA, 15 bp, Homo sapiens
tccctccgggacctg

SEQ ID NO: 2501922 - DNA, 14 bp, Homo sapiens
tccctcctgttggg

SEQ ID NO: 2501923 - DNA, 21 bp, Homo sapiens
tccctctcatttagcctgtcc

SEQ ID NO: 2501924 - DNA, 13 bp, Homo sapiens
tccctctcccagg

SEQ ID NO: 2501925 - DNA, 16 bp, Homo sapiens
tccctctcccaggccc

SEQ ID NO: 2501926 - DNA, 20 bp, Homo sapiens
tccctctcccaggccccatg

SEQ ID NO: 2501927 - DNA, 13 bp, Homo sapiens
tccctctctggag

SEQ ID NO: 2501928 - DNA, 15 bp, Homo sapiens
tccctctctggagaa

SEQ ID NO: 2501929 - DNA, 21 bp, Homo sapiens
tccctcttagtctaggtcctt

SEQ ID NO: 2501930 - DNA, 18 bp, Homo sapiens
tccctctttggctcccct

SEQ ID NO: 2501931 - DNA, 23 bp, Homo sapiens
tccctctttggctcccctgtacc

SEQ ID NO: 2501932 - DNA, 14 bp, Homo sapiens
tccctgactgggag

SEQ ID NO: 2501933 - DNA, 23 bp, Homo sapiens
tccctgcacagtgacttctgaga

SEQ ID NO: 2501934 - DNA, 21 bp, Homo sapiens
tccctgcatggcatcctccag

SEQ ID NO: 2501935 - DNA, 22 bp, Homo sapiens
tccctggaatgagttgaggcca

SEQ ID NO: 2501936 - DNA, 20 bp, Homo sapiens
tccctggccccctccctgga

SEQ ID NO: 2501937 - DNA, 12 bp, Homo sapiens
tccctgggcctg

SEQ ID NO: 2501938 - DNA, 21 bp, Homo sapiens
tccctgggcctgctgctgaga

SEQ ID NO: 2501939 - DNA, 15 bp, Homo sapiens
tccctgggccttggg

SEQ ID NO: 2501940 - DNA, 19 bp, Homo sapiens
tccctgggccttgggctcc

SEQ ID NO: 2501941 - DNA, 23 bp, Homo sapiens
tccctgtaacctcttcagaggcc

SEQ ID NO: 2501942 - DNA, 12 bp, Homo sapiens
tccctgtaactt

SEQ ID NO: 2501943 - DNA, 14 bp, Homo sapiens
tccctgtgccccca

SEQ ID NO: 2501944 - DNA, 16 bp, Homo sapiens
tccctgtgcctcctcc

SEQ ID NO: 2501945 - DNA, 17 bp, Homo sapiens
tccctgtgttgtctcta

SEQ ID NO: 2501946 - DNA, 16 bp, Homo sapiens
tccctgttccccagag

SEQ ID NO: 2501947 - DNA, 19 bp, Homo sapiens
tccctgttttccccccaag

SEQ ID NO: 2501948 - DNA, 22 bp, Homo sapiens
tcccttaaacaaaaattaaaat

SEQ ID NO: 2501949 - DNA, 16 bp, Homo sapiens
tcccttaacagttgta

SEQ ID NO: 2501950 - DNA, 22 bp, Homo sapiens
tcccttaacagttgtatttaac

SEQ ID NO: 2501951 - DNA, 18 bp, Homo sapiens
tcccttcagtaccctctc

SEQ ID NO: 2501952 - DNA, 23 bp, Homo sapiens
tcccttcagtaccctctcagctc

SEQ ID NO: 2501953 - DNA, 16 bp, Homo sapiens
tcccttcatacttgaa

SEQ ID NO: 2501954 - DNA, 12 bp, Homo sapiens
tcccttgcctca

SEQ ID NO: 2501955 - DNA, 22 bp, Homo sapiens
tcccttgggcacgtgtgctggg

SEQ ID NO: 2501956 - DNA, 13 bp, Homo sapiens
tctatttggggct

SEQ ID NO: 2501957 - DNA, 16 bp, Homo sapiens
tctattttattatgaa

SEQ ID NO: 2501958 - DNA, 19 bp, Homo sapiens
tctatttttggaggtttat

SEQ ID NO: 2501959 - DNA, 23 bp, Homo sapiens
tctcaaaacagagggctgcattc

SEQ ID NO: 2501960 - DNA, 21 bp, Homo sapiens
tctcaaactcctgacctcagg

SEQ ID NO: 2501961 - DNA, 19 bp, Homo sapiens
tctcaacacccagtttcct

SEQ ID NO: 2501962 - DNA, 18 bp, Homo sapiens
tctcaacaggcctcaggg

SEQ ID NO: 2501963 - DNA, 15 bp, Homo sapiens
tctcaagagccctgt

SEQ ID NO: 2501964 - DNA, 22 bp, Homo sapiens
tctcaagttctaagattctaat

SEQ ID NO: 2501965 - DNA, 16 bp, Homo sapiens
tctcaccatttggatc

SEQ ID NO: 2501966 - DNA, 18 bp, Homo sapiens
tctcaccatttggatcct

SEQ ID NO: 2501967 - DNA, 21 bp, Homo sapiens
tctcaccccatcccacaccct

SEQ ID NO: 2501968 - DNA, 12 bp, Homo sapiens
tctcaccctgga

SEQ ID NO: 2501969 - DNA, 13 bp, Homo sapiens
tctcaccctggag

SEQ ID NO: 2501970 - DNA, 14 bp, Homo sapiens
tctcacctctaggt

SEQ ID NO: 2501971 - DNA, 14 bp, Homo sapiens
tctcacctggccct

SEQ ID NO: 2501972 - DNA, 21 bp, Homo sapiens
tctcacggccacacagctgcc

SEQ ID NO: 2501973 - DNA, 14 bp, Homo sapiens
tctcactaaatctt

SEQ ID NO: 2501974 - DNA, 16 bp, Homo sapiens
tctcactataccagta

SEQ ID NO: 2501975 - DNA, 17 bp, Homo sapiens
tctcagaaagtgcctga

SEQ ID NO: 2501976 - DNA, 19 bp, Homo sapiens
tctcagaaagtgcctgaca

SEQ ID NO: 2501977 - DNA, 11 bp, Homo sapiens
tctcagcctcc

SEQ ID NO: 2501978 - DNA, 13 bp, Homo sapiens
tctcaggatccaa

SEQ ID NO: 2501979 - DNA, 17 bp, Homo sapiens
tctcaggccagagccaa

SEQ ID NO: 2501980 - DNA, 18 bp, Homo sapiens
tctcaggctaggccagca

SEQ ID NO: 2501981 - DNA, 14 bp, Homo sapiens
tctcaggctgcctg

SEQ ID NO: 2501982 - DNA, 20 bp, Homo sapiens
tctcagtaccccatggagct

SEQ ID NO: 2501983 - DNA, 11 bp, Homo sapiens
tctcagtctct

SEQ ID NO: 2501984 - DNA, 20 bp, Homo sapiens
tctcagtgaagactatgaaa

SEQ ID NO: 2501985 - DNA, 18 bp, Homo sapiens
tctcagtgttgagccttt

SEQ ID NO: 2501986 - DNA, 19 bp, Homo sapiens
tctcagtttgtgtgtctta

SEQ ID NO: 2501987 - DNA, 19 bp, Homo sapiens
tctcatctcagtgaagaat

SEQ ID NO: 2501988 - DNA, 20 bp, Homo sapiens
tctcatctcagtgaagaata

SEQ ID NO: 2501989 - DNA, 11 bp, Homo sapiens
tctcatctggg

SEQ ID NO: 2501990 - DNA, 20 bp, Homo sapiens
tctcattaaaagaatatctg

SEQ ID NO: 2501991 - DNA, 14 bp, Homo sapiens
tctcattggaaatt

SEQ ID NO: 2501992 - DNA, 22 bp, Homo sapiens
tctccaaactgaagcagcctct

SEQ ID NO: 2501993 - DNA, 21 bp, Homo sapiens
tctccaacatcacagcccagc

SEQ ID NO: 2501994 - DNA, 13 bp, Homo sapiens
tctccaagcagct

SEQ ID NO: 2501995 - DNA, 19 bp, Homo sapiens
tctccacagcaaccccagg

SEQ ID NO: 2501996 - DNA, 18 bp, Homo sapiens
tctccactttcagctgtc

SEQ ID NO: 2501997 - DNA, 17 bp, Homo sapiens
tctccagaggccaagga

SEQ ID NO: 2501998 - DNA, 18 bp, Homo sapiens
tctccagcggccctgtca

SEQ ID NO: 2501999 - DNA, 20 bp, Homo sapiens
tctccagcggccctgtcatc

SEQ ID NO: 2502000 - DNA, 12 bp, Homo sapiens
tctccagctgac

SEQ ID NO: 2502001 - DNA, 11 bp, Homo sapiens
tctccagctgg

SEQ ID NO: 2502002 - DNA, 20 bp, Homo sapiens
tctccaggggctgcttcctc

SEQ ID NO: 2502003 - DNA, 14 bp, Homo sapiens
tctcccacctagca

SEQ ID NO: 2502004 - DNA, 15 bp, Homo sapiens
tctcccactctccta

SEQ ID NO: 2502005 - DNA, 16 bp, Homo sapiens
tctcccactctcctag

SEQ ID NO: 2502006 - DNA, 21 bp, Homo sapiens
tctcccagataatgtgaaaat

SEQ ID NO: 2502007 - DNA, 23 bp, Homo sapiens
tctcccagataatgtgaaaatgg

SEQ ID NO: 2502008 - DNA, 19 bp, Homo sapiens
tctcccaggcaaggctgtg

SEQ ID NO: 2502009 - DNA, 13 bp, Homo sapiens
tctcccaggcagg

SEQ ID NO: 2502010 - DNA, 12 bp, Homo sapiens
tctcccaggccc

SEQ ID NO: 2502011 - DNA, 21 bp, Homo sapiens
tctcccaggccccatgacctc

SEQ ID NO: 2502012 - DNA, 11 bp, Homo sapiens
tctcccagttg

SEQ ID NO: 2502013 - DNA, 20 bp, Homo sapiens
tctccccacgagggctggct

SEQ ID NO: 2502014 - DNA, 15 bp, Homo sapiens
tctccccagcccaga

SEQ ID NO: 2502015 - DNA, 16 bp, Homo sapiens
tctccccagcccagag

SEQ ID NO: 2502016 - DNA, 18 bp, Homo sapiens
tctccccagctcccagga

SEQ ID NO: 2502017 - DNA, 12 bp, Homo sapiens
tctcccccaaca

SEQ ID NO: 2502018 - DNA, 17 bp, Homo sapiens
tctcccctgcactgtaa

SEQ ID NO: 2502019 - DNA, 14 bp, Homo sapiens
tctcccctgccccc

SEQ ID NO: 2502020 - DNA, 20 bp, Homo sapiens
tctcccggaggttgggtggg

SEQ ID NO: 2502021 - DNA, 12 bp, Homo sapiens
tctccctcccct

SEQ ID NO: 2502022 - DNA, 22 bp, Homo sapiens
tctccctgagatgggcttccca

SEQ ID NO: 2502023 - DNA, 13 bp, Homo sapiens
tctccctgcatgg

SEQ ID NO: 2502024 - DNA, 15 bp, Homo sapiens
tctccctgcatggca

SEQ ID NO: 2502025 - DNA, 13 bp, Homo sapiens
tctccctggtgct

SEQ ID NO: 2502026 - DNA, 14 bp, Homo sapiens
tctcccttgggctc

SEQ ID NO: 2502027 - DNA, 20 bp, Homo sapiens
tctcccttgggctctgatga

SEQ ID NO: 2502028 - DNA, 22 bp, Homo sapiens
tctccgttagctcctgtggccc

SEQ ID NO: 2502029 - DNA, 23 bp, Homo sapiens
tctcctaggcattctggacctct

SEQ ID NO: 2502030 - DNA, 16 bp, Homo sapiens
tctcctccatgggaga

SEQ ID NO: 2502031 - DNA, 17 bp, Homo sapiens
tctcctgctgctccctc

SEQ ID NO: 2502032 - DNA, 13 bp, Homo sapiens
tctccttcctgtg

SEQ ID NO: 2502033 - DNA, 16 bp, Homo sapiens
tctccttcctgtgtgt

SEQ ID NO: 2502034 - DNA, 13 bp, Homo sapiens
tctccttcttagc

SEQ ID NO: 2502035 - DNA, 15 bp, Homo sapiens
tctcctttaattgta

SEQ ID NO: 2502036 - DNA, 19 bp, Homo sapiens
tctccttttcctctctccc

SEQ ID NO: 2502037 - DNA, 14 bp, Homo sapiens
tctcgagcgccctg

SEQ ID NO: 2502038 - DNA, 17 bp, Homo sapiens
tctcgagcgccctgcag

SEQ ID NO: 2502039 - DNA, 19 bp, Homo sapiens
tctcgagcgccctgcagac

SEQ ID NO: 2502040 - DNA, 20 bp, Homo sapiens
tctctaacagtggacaaagt

SEQ ID NO: 2502041 - DNA, 22 bp, Homo sapiens
tctctaacttcaaggcccatat

SEQ ID NO: 2502042 - DNA, 15 bp, Homo sapiens
tctctaattctatta

SEQ ID NO: 2502043 - DNA, 19 bp, Homo sapiens
tctctaccttctccccagc

SEQ ID NO: 2502044 - DNA, 19 bp, Homo sapiens
tctctcaacaccatgattc

SEQ ID NO: 2502045 - DNA, 12 bp, Homo sapiens
tctctcaggtga

SEQ ID NO: 2502046 - DNA, 18 bp, Homo sapiens
tctctccactttcagctg

SEQ ID NO: 2502047 - DNA, 22 bp, Homo sapiens
tctctccactttcagctgtctt

SEQ ID NO: 2502048 - DNA, 15 bp, Homo sapiens
tctctccagctgact

SEQ ID NO: 2502049 - DNA, 19 bp, Homo sapiens
tctctccccctatttattg

SEQ ID NO: 2502050 - DNA, 20 bp, Homo sapiens
tctctcggctccccatgtgt

SEQ ID NO: 2502051 - DNA, 13 bp, Homo sapiens
tctctgaagccac

SEQ ID NO: 2502052 - DNA, 14 bp, Homo sapiens
tctctgacttctgc

SEQ ID NO: 2502053 - DNA, 20 bp, Homo sapiens
tctctgcagacttcccagct

SEQ ID NO: 2502054 - DNA, 15 bp, Homo sapiens
tctctgccagtgaca

SEQ ID NO: 2502055 - DNA, 13 bp, Homo sapiens
tctctgcccaacc

SEQ ID NO: 2502056 - DNA, 20 bp, Homo sapiens
tctctgcccttgatcagccc

SEQ ID NO: 2502057 - DNA, 16 bp, Homo sapiens
tctctgctggcccagc

SEQ ID NO: 2502058 - DNA, 19 bp, Homo sapiens
tctctggctgtaaggctct

SEQ ID NO: 2502059 - DNA, 20 bp, Homo sapiens
tctctggctgtaaggctcta

SEQ ID NO: 2502060 - DNA, 22 bp, Homo sapiens
tctctggctgtaaggctctaga

SEQ ID NO: 2502061 - DNA, 15 bp, Homo sapiens
tcttctccctggaat

SEQ ID NO: 2502062 - DNA, 13 bp, Homo sapiens
tcttctctgttgt

SEQ ID NO: 2502063 - DNA, 18 bp, Homo sapiens
tcttctggactggttttc

SEQ ID NO: 2502064 - DNA, 22 bp, Homo sapiens
tcttctgggagggcagcagggc

SEQ ID NO: 2502065 - DNA, 22 bp, Homo sapiens
tcttctggggcaggctgggcca

SEQ ID NO: 2502066 - DNA, 15 bp, Homo sapiens
tcttcttcaccattt

SEQ ID NO: 2502067 - DNA, 14 bp, Homo sapiens
tcttgaaattaaga

SEQ ID NO: 2502068 - DNA, 23 bp, Homo sapiens
tcttgaatttaataatctgtagg

SEQ ID NO: 2502069 - DNA, 13 bp, Homo sapiens
tcttgagctctat

SEQ ID NO: 2502070 - DNA, 18 bp, Homo sapiens
tcttgaggggaccaggag

SEQ ID NO: 2502071 - DNA, 19 bp, Homo sapiens
tcttgaggggaccaggagt

SEQ ID NO: 2502072 - DNA, 14 bp, Homo sapiens
tcttgagtttgtcg

SEQ ID NO: 2502073 - DNA, 21 bp, Homo sapiens
tcttgagtttgtcgctcatgt

SEQ ID NO: 2502074 - DNA, 17 bp, Homo sapiens
tcttgatacccccctct

SEQ ID NO: 2502075 - DNA, 22 bp, Homo sapiens
tcttgatacccccctctgtctt

SEQ ID NO: 2502076 - DNA, 16 bp, Homo sapiens
tcttgatcagttaaga

SEQ ID NO: 2502077 - DNA, 17 bp, Homo sapiens
tcttgatcagttaagaa

SEQ ID NO: 2502078 - DNA, 18 bp, Homo sapiens
tcttgatcagttaagaaa

SEQ ID NO: 2502079 - DNA, 21 bp, Homo sapiens
tcttgatgcatgcactgttcc

SEQ ID NO: 2502080 - DNA, 14 bp, Homo sapiens
tcttgatgtaaaat

SEQ ID NO: 2502081 - DNA, 15 bp, Homo sapiens
tcttgatgtaaaatc

SEQ ID NO: 2502082 - DNA, 13 bp, Homo sapiens
tcttgcctctgtg

SEQ ID NO: 2502083 - DNA, 16 bp, Homo sapiens
tcttgcctctgtgctg

SEQ ID NO: 2502084 - DNA, 22 bp, Homo sapiens
tcttgctggtctagtcacgcat

SEQ ID NO: 2502085 - DNA, 23 bp, Homo sapiens
tcttgcttccctaatctatggtc

SEQ ID NO: 2502086 - DNA, 17 bp, Homo sapiens
tcttgcttctttctaga

SEQ ID NO: 2502087 - DNA, 21 bp, Homo sapiens
tcttggaacattggaatgttc

SEQ ID NO: 2502088 - DNA, 15 bp, Homo sapiens
tcttggacaaatcac

SEQ ID NO: 2502089 - DNA, 19 bp, Homo sapiens
tcttggcttactgcagcct

SEQ ID NO: 2502090 - DNA, 19 bp, Homo sapiens
tcttgggcagagctggctc

SEQ ID NO: 2502091 - DNA, 19 bp, Homo sapiens
tcttgggggggtggccgct

SEQ ID NO: 2502092 - DNA, 20 bp, Homo sapiens
tcttgggggggtggccgctg

SEQ ID NO: 2502093 - DNA, 13 bp, Homo sapiens
tcttggttgagga

SEQ ID NO: 2502094 - DNA, 19 bp, Homo sapiens
tcttgtaatccgaatctct

SEQ ID NO: 2502095 - DNA, 13 bp, Homo sapiens
tcttgtcatgtgt

SEQ ID NO: 2502096 - DNA, 21 bp, Homo sapiens
tcttgtgtgtatgcacatgaa

SEQ ID NO: 2502097 - DNA, 22 bp, Homo sapiens
tcttgtgtgtatgcacatgaac

SEQ ID NO: 2502098 - DNA, 13 bp, Homo sapiens
tcttgtgttggct

SEQ ID NO: 2502099 - DNA, 19 bp, Homo sapiens
tctttaaaagatgctttta

SEQ ID NO: 2502100 - DNA, 11 bp, Homo sapiens
tctttaactgc

SEQ ID NO: 2502101 - DNA, 21 bp, Homo sapiens
tctttaactgccgtaatttaa

SEQ ID NO: 2502102 - DNA, 17 bp, Homo sapiens
tctttaatgcaatatac

SEQ ID NO: 2502103 - DNA, 22 bp, Homo sapiens
tctttacaaaacaaactcattc

SEQ ID NO: 2502104 - DNA, 11 bp, Homo sapiens
tctttagaaca

SEQ ID NO: 2502105 - DNA, 21 bp, Homo sapiens
tctttagatagccctgtcctg

SEQ ID NO: 2502106 - DNA, 23 bp, Homo sapiens
tctttagatagccctgtcctggt

SEQ ID NO: 2502107 - DNA, 13 bp, Homo sapiens
tctttataagaaa

SEQ ID NO: 2502108 - DNA, 14 bp, Homo sapiens
tctttataagaaag

SEQ ID NO: 2502109 - DNA, 16 bp, Homo sapiens
tctttataagaaagcc

SEQ ID NO: 2502110 - DNA, 23 bp, Homo sapiens
tctttcaaaaccttttgaaatta

SEQ ID NO: 2502111 - DNA, 16 bp, Homo sapiens
tctttcaatacagata

SEQ ID NO: 2502112 - DNA, 18 bp, Homo sapiens
tctttcaatacagatata

SEQ ID NO: 2502113 - DNA, 14 bp, Homo sapiens
tctttcagctcctg

SEQ ID NO: 2502114 - DNA, 18 bp, Homo sapiens
tctttcccatggggaggg

SEQ ID NO: 2502115 - DNA, 16 bp, Homo sapiens
tctttctctgccagtg

SEQ ID NO: 2502116 - DNA, 17 bp, Homo sapiens
tctttctctgccagtga

SEQ ID NO: 2502117 - DNA, 16 bp, Homo sapiens
tctttctctttccctg

SEQ ID NO: 2502118 - DNA, 17 bp, Homo sapiens
tctttgaataaatgtca

SEQ ID NO: 2502119 - DNA, 22 bp, Homo sapiens
tctttggctcccctgtaccttt

SEQ ID NO: 2502120 - DNA, 16 bp, Homo sapiens
tctttgggccagacat

SEQ ID NO: 2502121 - DNA, 12 bp, Homo sapiens
tctttggttcta

SEQ ID NO: 2502122 - DNA, 15 bp, Homo sapiens
tctttggttctaagg

SEQ ID NO: 2502123 - DNA, 18 bp, Homo sapiens
tctttgttttgtgtctct

SEQ ID NO: 2502124 - DNA, 13 bp, Homo sapiens
tcttttaccctgg

SEQ ID NO: 2502125 - DNA, 18 bp, Homo sapiens
tcttttaccctggcccct

SEQ ID NO: 2502126 - DNA, 22 bp, Homo sapiens
tcttttaccctggcccctctcc

SEQ ID NO: 2502127 - DNA, 18 bp, Homo sapiens
tcttttatactcagcttt

SEQ ID NO: 2502128 - DNA, 21 bp, Homo sapiens
tcttttcaaaggtacttggat

SEQ ID NO: 2502129 - DNA, 23 bp, Homo sapiens
tcttttcatacattttctaagaa

SEQ ID NO: 2502130 - DNA, 18 bp, Homo sapiens
tcttttgcttttggcaaa

SEQ ID NO: 2502131 - DNA, 14 bp, Homo sapiens
tctttttgaagtat

SEQ ID NO: 2502132 - DNA, 15 bp, Homo sapiens
tctttttgaagtatt

SEQ ID NO: 2502133 - DNA, 21 bp, Homo sapiens
tcttttttggccatctgctcc

SEQ ID NO: 2502134 - DNA, 22 bp, Homo sapiens
tctttttttttttttaataaat

SEQ ID NO: 2502135 - DNA, 16 bp, Homo sapiens
tgaaaaaaaacagtgg

SEQ ID NO: 2502136 - DNA, 21 bp, Homo sapiens
tgaaaaattccactcaaaata

SEQ ID NO: 2502137 - DNA, 16 bp, Homo sapiens
tgaaaaattgctgact

SEQ ID NO: 2502138 - DNA, 16 bp, Homo sapiens
tgaaaacactgtgcac

SEQ ID NO: 2502139 - DNA, 14 bp, Homo sapiens
tgaaaacagaatgt

SEQ ID NO: 2502140 - DNA, 17 bp, Homo sapiens
tgaaaactctttgctgc

SEQ ID NO: 2502141 - DNA, 13 bp, Homo sapiens
tgaaaactttgta

SEQ ID NO: 2502142 - DNA, 22 bp, Homo sapiens
tgaaaaggtttatgaaaaagaa

SEQ ID NO: 2502143 - DNA, 12 bp, Homo sapiens
tgaaaatgctgg

SEQ ID NO: 2502144 - DNA, 17 bp, Homo sapiens
tgaaaatgtccttgtga

SEQ ID NO: 2502145 - DNA, 23 bp, Homo sapiens
tgaaaatgtccttgtgatgtgca

SEQ ID NO: 2502146 - DNA, 15 bp, Homo sapiens
tgaaaatgtcttgtg

SEQ ID NO: 2502147 - DNA, 15 bp, Homo sapiens
tgaaacaacttggaa

SEQ ID NO: 2502148 - DNA, 20 bp, Homo sapiens
tgaaacccctgtaggcctca

SEQ ID NO: 2502149 - DNA, 17 bp, Homo sapiens
tgaaactccagatgcca

SEQ ID NO: 2502150 - DNA, 18 bp, Homo sapiens
tgaaactccagatgccac

SEQ ID NO: 2502151 - DNA, 23 bp, Homo sapiens
tgaaactttcattccttcagatt

SEQ ID NO: 2502152 - DNA, 13 bp, Homo sapiens
tgaaagaagaaaa

SEQ ID NO: 2502153 - DNA, 21 bp, Homo sapiens
tgaaagaggctgaggcctgga

SEQ ID NO: 2502154 - DNA, 22 bp, Homo sapiens
tgaaataaaactgtttttgaac

SEQ ID NO: 2502155 - DNA, 15 bp, Homo sapiens
tgaaataagaattca

SEQ ID NO: 2502156 - DNA, 13 bp, Homo sapiens
tgaaataatgtgt

SEQ ID NO: 2502157 - DNA, 22 bp, Homo sapiens
tgaaataatgtgtagttcatgt

SEQ ID NO: 2502158 - DNA, 16 bp, Homo sapiens
tgaaatatgatgttaa

SEQ ID NO: 2502159 - DNA, 16 bp, Homo sapiens
tgaaatgctggcattt

SEQ ID NO: 2502160 - DNA, 12 bp, Homo sapiens
tgaaatgtaagg

SEQ ID NO: 2502161 - DNA, 15 bp, Homo sapiens
tgaaatgtaaggctg

SEQ ID NO: 2502162 - DNA, 19 bp, Homo sapiens
tgaaattaagaaggcaaaa

SEQ ID NO: 2502163 - DNA, 21 bp, Homo sapiens
tgaaattaagaaggcaaaaat

SEQ ID NO: 2502164 - DNA, 14 bp, Homo sapiens
tgaaattccaaagt

SEQ ID NO: 2502165 - DNA, 17 bp, Homo sapiens
tgatacttcgacactgt

SEQ ID NO: 2502166 - DNA, 18 bp, Homo sapiens
tgatacttcgacactgtt

SEQ ID NO: 2502167 - DNA, 14 bp, Homo sapiens
tgatagattttctg

SEQ ID NO: 2502168 - DNA, 16 bp, Homo sapiens
tgatagtcttttgctt

SEQ ID NO: 2502169 - DNA, 19 bp, Homo sapiens
tgatataaatcagattctt

SEQ ID NO: 2502170 - DNA, 18 bp, Homo sapiens
tgatatataagtgtacat

SEQ ID NO: 2502171 - DNA, 15 bp, Homo sapiens
tgatatgcacaatgt

SEQ ID NO: 2502172 - DNA, 18 bp, Homo sapiens
tgatatgcatatttgttt

SEQ ID NO: 2502173 - DNA, 12 bp, Homo sapiens
tgatattctaag

SEQ ID NO: 2502174 - DNA, 17 bp, Homo sapiens
tgatattctaagactta

SEQ ID NO: 2502175 - DNA, 13 bp, Homo sapiens
tgatcaaggcctt

SEQ ID NO: 2502176 - DNA, 22 bp, Homo sapiens
tgatcatgtgtggaagttatta

SEQ ID NO: 2502177 - DNA, 12 bp, Homo sapiens
tgatccatgtaa

SEQ ID NO: 2502178 - DNA, 14 bp, Homo sapiens
tgatccatgtaact

SEQ ID NO: 2502179 - DNA, 15 bp, Homo sapiens
tgatccatgtaactg

SEQ ID NO: 2502180 - DNA, 18 bp, Homo sapiens
tgatccatgtaactgcct

SEQ ID NO: 2502181 - DNA, 21 bp, Homo sapiens
tgatccatttctaattatgta

SEQ ID NO: 2502182 - DNA, 19 bp, Homo sapiens
tgatcccagagagcccgag

SEQ ID NO: 2502183 - DNA, 14 bp, Homo sapiens
tgatcctggaggcc

SEQ ID NO: 2502184 - DNA, 17 bp, Homo sapiens
tgatcctggaggcccag

SEQ ID NO: 2502185 - DNA, 20 bp, Homo sapiens
tgatcctggaggcccagttc

SEQ ID NO: 2502186 - DNA, 14 bp, Homo sapiens
tgatcgccttcccc

SEQ ID NO: 2502187 - DNA, 15 bp, Homo sapiens
tgatcgcctttccca

SEQ ID NO: 2502188 - DNA, 17 bp, Homo sapiens
tgatcgcctttcccagg

SEQ ID NO: 2502189 - DNA, 14 bp, Homo sapiens
tgatctgtctgtgg

SEQ ID NO: 2502190 - DNA, 17 bp, Homo sapiens
tgatctgtctgtggcaa

SEQ ID NO: 2502191 - DNA, 14 bp, Homo sapiens
tgatgaatactgta

SEQ ID NO: 2502192 - DNA, 14 bp, Homo sapiens
tgatgaccaaagtc

SEQ ID NO: 2502193 - DNA, 16 bp, Homo sapiens
tgatgacccttttcat

SEQ ID NO: 2502194 - DNA, 23 bp, Homo sapiens
tgatgactttctttttgtagctg

SEQ ID NO: 2502195 - DNA, 13 bp, Homo sapiens
tgatgagggcagc

SEQ ID NO: 2502196 - DNA, 21 bp, Homo sapiens
tgatgagggcagcagccagcc

SEQ ID NO: 2502197 - DNA, 23 bp, Homo sapiens
tgatgagggcagcagccagccct

SEQ ID NO: 2502198 - DNA, 18 bp, Homo sapiens
tgatgcatgcactgttcc

SEQ ID NO: 2502199 - DNA, 14 bp, Homo sapiens
tgatgcctctgtct

SEQ ID NO: 2502200 - DNA, 16 bp, Homo sapiens
tgatggagtgctgttt

SEQ ID NO: 2502201 - DNA, 18 bp, Homo sapiens
tgatggcaacagatctgg

SEQ ID NO: 2502202 - DNA, 19 bp, Homo sapiens
tgatggcaacagatctgga

SEQ ID NO: 2502203 - DNA, 17 bp, Homo sapiens
tgatggcttatgatagc

SEQ ID NO: 2502204 - DNA, 21 bp, Homo sapiens
tgatgggaagtccggccccag

SEQ ID NO: 2502205 - DNA, 16 bp, Homo sapiens
tgatgggattctggac

SEQ ID NO: 2502206 - DNA, 17 bp, Homo sapiens
tgatgggattctggaca

SEQ ID NO: 2502207 - DNA, 24 bp, Homo sapiens
tgatgggattctggacaggatgtg

SEQ ID NO: 2502208 - DNA, 15 bp, Homo sapiens
tgatgggggagaggg

SEQ ID NO: 2502209 - DNA, 16 bp, Homo sapiens
tgatgtaaaatcttgt

SEQ ID NO: 2502210 - DNA, 22 bp, Homo sapiens
tgatgtaatcttgaattgtaac

SEQ ID NO: 2502211 - DNA, 18 bp, Homo sapiens
tgatgtcaatttctgtgt

SEQ ID NO: 2502212 - DNA, 17 bp, Homo sapiens
tgatgtcatacagagaa

SEQ ID NO: 2502213 - DNA, 12 bp, Homo sapiens
tgatgtctccta

SEQ ID NO: 2502214 - DNA, 16 bp, Homo sapiens
tgatgtctcctaagca

SEQ ID NO: 2502215 - DNA, 20 bp, Homo sapiens
tgatgtctcctaagcacctg

SEQ ID NO: 2502216 - DNA, 23 bp, Homo sapiens
tgatgtctttgttaagactgctg

SEQ ID NO: 2502217 - DNA, 22 bp, Homo sapiens
tgatgtgaagccaattcagaca

SEQ ID NO: 2502218 - DNA, 14 bp, Homo sapiens
tgatgttctaaggc

SEQ ID NO: 2502219 - DNA, 17 bp, Homo sapiens
tgatgttctaaggctct

SEQ ID NO: 2502220 - DNA, 19 bp, Homo sapiens
tgatgttctaaggctctga

SEQ ID NO: 2502221 - DNA, 21 bp, Homo sapiens
tgatgttctaaggctctgaga

SEQ ID NO: 2502222 - DNA, 23 bp, Homo sapiens
tgattaaaatgcttcctcccagc

SEQ ID NO: 2502223 - DNA, 20 bp, Homo sapiens
tgattaaataagattctaac

SEQ ID NO: 2502224 - DNA, 16 bp, Homo sapiens
tgattacagtgcagtg

SEQ ID NO: 2502225 - DNA, 13 bp, Homo sapiens
tgattagacagaa

SEQ ID NO: 2502226 - DNA, 16 bp, Homo sapiens
tgattagacagaacac

SEQ ID NO: 2502227 - DNA, 12 bp, Homo sapiens
tgattcagtgtt

SEQ ID NO: 2502228 - DNA, 16 bp, Homo sapiens
tgattcatagtaactt

SEQ ID NO: 2502229 - DNA, 18 bp, Homo sapiens
tgattcatagtaacttct

SEQ ID NO: 2502230 - DNA, 16 bp, Homo sapiens
tgattccatccacctt

SEQ ID NO: 2502231 - DNA, 20 bp, Homo sapiens
tgattgtagtaatctgcatt

SEQ ID NO: 2502232 - DNA, 16 bp, Homo sapiens
tgattgtattgttgaa

SEQ ID NO: 2502233 - DNA, 14 bp, Homo sapiens
tgattgtggaatgg

SEQ ID NO: 2502234 - DNA, 21 bp, Homo sapiens
tgattgtggaatggagattca

SEQ ID NO: 2502235 - DNA, 20 bp, Homo sapiens
tgatttcagttctaggaaaa

SEQ ID NO: 2502236 - DNA, 13 bp, Homo sapiens
tgatttcatttca

SEQ ID NO: 2502237 - DNA, 17 bp, Homo sapiens
tgatttccttgaatgtg

SEQ ID NO: 2502238 - DNA, 19 bp, Homo sapiens
tgatttccttgaatgtggc

SEQ ID NO: 2502239 - DNA, 14 bp, Homo sapiens
tgatttgcattgaa

SEQ ID NO: 2502240 - DNA, 17 bp, Homo sapiens
tgatttgtaacccactg

SEQ ID NO: 2502241 - DNA, 13 bp, Homo sapiens
tgattttctggat

SEQ ID NO: 2502242 - DNA, 21 bp, Homo sapiens
tgatttttttttttttttcct

SEQ ID NO: 2502243 - DNA, 21 bp, Homo sapiens
tgcaaaaactctttgagaggg

SEQ ID NO: 2502244 - DNA, 19 bp, Homo sapiens
tgcaaaaggactctcagga

SEQ ID NO: 2502245 - DNA, 23 bp, Homo sapiens
tgcaaactgggaacccctttccc

SEQ ID NO: 2502246 - DNA, 22 bp, Homo sapiens
tgcaaagaaagaaaaaaaacca

SEQ ID NO: 2502247 - DNA, 23 bp, Homo sapiens
tgcaaagaaagaaaaaaaaccat

SEQ ID NO: 2502248 - DNA, 23 bp, Homo sapiens
tgcaaataaatatcctttaattg

SEQ ID NO: 2502249 - DNA, 14 bp, Homo sapiens
tgcaaatcttgaaa

SEQ ID NO: 2502250 - DNA, 15 bp, Homo sapiens
tgcaacatgatgagg

SEQ ID NO: 2502251 - DNA, 17 bp, Homo sapiens
tgcaaccaggaacagca

SEQ ID NO: 2502252 - DNA, 20 bp, Homo sapiens
tgcaaccaggaacagcaaat

SEQ ID NO: 2502253 - DNA, 21 bp, Homo sapiens
tgcaacctccacctcctgggt

SEQ ID NO: 2502254 - DNA, 18 bp, Homo sapiens
tgcaacctcttggcctga

SEQ ID NO: 2502255 - DNA, 16 bp, Homo sapiens
tgcaactcaaggactt

SEQ ID NO: 2502256 - DNA, 18 bp, Homo sapiens
tgcaaggtactctggtga

SEQ ID NO: 2502257 - DNA, 17 bp, Homo sapiens
tgcaagtatactaggga

SEQ ID NO: 2502258 - DNA, 13 bp, Homo sapiens
tgcaagttgagga

SEQ ID NO: 2502259 - DNA, 19 bp, Homo sapiens
tgcaagttgaggacttctt

SEQ ID NO: 2502260 - DNA, 19 bp, Homo sapiens
tgcaataaatctgacccag

SEQ ID NO: 2502261 - DNA, 23 bp, Homo sapiens
tgcaataaatctgacccagtgcc

SEQ ID NO: 2502262 - DNA, 16 bp, Homo sapiens
tgcaatagaaggtgat

SEQ ID NO: 2502263 - DNA, 20 bp, Homo sapiens
tgcaatatactggaaagctt

SEQ ID NO: 2502264 - DNA, 18 bp, Homo sapiens
tgcaattcaaaagttcca

SEQ ID NO: 2502265 - DNA, 19 bp, Homo sapiens
tgcaattcaaaagttccaa

SEQ ID NO: 2502266 - DNA, 13 bp, Homo sapiens
tgcaattcccctc

SEQ ID NO: 2502267 - DNA, 18 bp, Homo sapiens
tgcaattcccctctgctg

SEQ ID NO: 2502268 - DNA, 23 bp, Homo sapiens
tgcaattggcaccgaagcccaga

SEQ ID NO: 2502269 - DNA, 19 bp, Homo sapiens
tgcccccaaggaggcagcc

SEQ ID NO: 2502270 - DNA, 20 bp, Homo sapiens
tgcccccaaggaggcagcct

SEQ ID NO: 2502271 - DNA, 12 bp, Homo sapiens
tgcccccacccc

SEQ ID NO: 2502272 - DNA, 17 bp, Homo sapiens
tgcccccaccccattcc

SEQ ID NO: 2502273 - DNA, 22 bp, Homo sapiens
tgcccccaccccattcccgcag

SEQ ID NO: 2502274 - DNA, 17 bp, Homo sapiens
tgcccccactgaccaga

SEQ ID NO: 2502275 - DNA, 13 bp, Homo sapiens
tgccccctgcagg

SEQ ID NO: 2502276 - DNA, 21 bp, Homo sapiens
tgccccctgcaggaaggagct

SEQ ID NO: 2502277 - DNA, 14 bp, Homo sapiens
tgcccctctcacca

SEQ ID NO: 2502278 - DNA, 14 bp, Homo sapiens
tgccccttccgcca

SEQ ID NO: 2502279 - DNA, 18 bp, Homo sapiens
tgccccttccgccactgg

SEQ ID NO: 2502280 - DNA, 19 bp, Homo sapiens
tgccccttccgccactggg

SEQ ID NO: 2502281 - DNA, 20 bp, Homo sapiens
tgccccttccgccactgggg

SEQ ID NO: 2502282 - DNA, 21 bp, Homo sapiens
tgccccttgacaactggcagg

SEQ ID NO: 2502283 - DNA, 11 bp, Homo sapiens
tgcccctttct

SEQ ID NO: 2502284 - DNA, 20 bp, Homo sapiens
tgcccggctaatttttgtaa

SEQ ID NO: 2502285 - DNA, 13 bp, Homo sapiens
tgccctaagcaga

SEQ ID NO: 2502286 - DNA, 17 bp, Homo sapiens
tgccctaagcagaaagt

SEQ ID NO: 2502287 - DNA, 22 bp, Homo sapiens
tgccctacagcaccctgtggtc

SEQ ID NO: 2502288 - DNA, 19 bp, Homo sapiens
tgccctcatggcccctctg

SEQ ID NO: 2502289 - DNA, 20 bp, Homo sapiens
tgccctcctgtgctcagccc

SEQ ID NO: 2502290 - DNA, 23 bp, Homo sapiens
tgccctcctgtgctcagccctga

SEQ ID NO: 2502291 - DNA, 15 bp, Homo sapiens
tgccctctcccaccc

SEQ ID NO: 2502292 - DNA, 22 bp, Homo sapiens
tgccctgagccagggtctccag

SEQ ID NO: 2502293 - DNA, 15 bp, Homo sapiens
tgccctgatcccaga

SEQ ID NO: 2502294 - DNA, 16 bp, Homo sapiens
tgcccttctttctacc

SEQ ID NO: 2502295 - DNA, 21 bp, Homo sapiens
tgcccttctttctaccctgct

SEQ ID NO: 2502296 - DNA, 21 bp, Homo sapiens
tgccgatatactctagatgaa

SEQ ID NO: 2502297 - DNA, 22 bp, Homo sapiens
tgccgtggattgcacgtggcct

SEQ ID NO: 2502298 - DNA, 22 bp, Homo sapiens
tgcctacagaacttcagaaaga

SEQ ID NO: 2502299 - DNA, 19 bp, Homo sapiens
tgcctagaaacaacactgt

SEQ ID NO: 2502300 - DNA, 16 bp, Homo sapiens
tgcctaggcctgggca

SEQ ID NO: 2502301 - DNA, 21 bp, Homo sapiens
tgcctcatttttttccttgca

SEQ ID NO: 2502302 - DNA, 23 bp, Homo sapiens
tgcctccagccgccggctgtgca

SEQ ID NO: 2502303 - DNA, 18 bp, Homo sapiens
tgcctcccctctccttcc

SEQ ID NO: 2502304 - DNA, 19 bp, Homo sapiens
tgcctcccttgtggcagca

SEQ ID NO: 2502305 - DNA, 11 bp, Homo sapiens
tgcctcctccc

SEQ ID NO: 2502306 - DNA, 12 bp, Homo sapiens
tgcctcctccct

SEQ ID NO: 2502307 - DNA, 13 bp, Homo sapiens
tgcctcctccctc

SEQ ID NO: 2502308 - DNA, 12 bp, Homo sapiens
tgcctctctaca

SEQ ID NO: 2502309 - DNA, 21 bp, Homo sapiens
tgcctctgccaaaggatgtga

SEQ ID NO: 2502310 - DNA, 12 bp, Homo sapiens
tgcctctgtgct

SEQ ID NO: 2502311 - DNA, 16 bp, Homo sapiens
tgcctctgtgctgtgt

SEQ ID NO: 2502312 - DNA, 21 bp, Homo sapiens
tgcctctgtgctgtgtgtgac

SEQ ID NO: 2502313 - DNA, 15 bp, Homo sapiens
tgcctcttctgggag

SEQ ID NO: 2502314 - DNA, 16 bp, Homo sapiens
tgcctcttctgggagg

SEQ ID NO: 2502315 - DNA, 19 bp, Homo sapiens
tgcctcttctgggagggca

SEQ ID NO: 2502316 - DNA, 24 bp, Homo sapiens
tgcctgagtcgtgacctgctaggc

SEQ ID NO: 2502317 - DNA, 15 bp, Homo sapiens
tgcctgcaggggagc

SEQ ID NO: 2502318 - DNA, 15 bp, Homo sapiens
tgcctgcctttccat

SEQ ID NO: 2502319 - DNA, 19 bp, Homo sapiens
tgcctgcgtgggtgtgtgc

SEQ ID NO: 2502320 - DNA, 14 bp, Homo sapiens
tgcctgctcccatc

SEQ ID NO: 2502321 - DNA, 18 bp, Homo sapiens
tgcctgctcccatcctgt

SEQ ID NO: 2502322 - DNA, 16 bp, Homo sapiens
tgcctgctcgctccct

SEQ ID NO: 2502323 - DNA, 20 bp, Homo sapiens
tgcctggagacttagggcac

SEQ ID NO: 2502324 - DNA, 20 bp, Homo sapiens
tgcctggaggacctgagcct

SEQ ID NO: 2502325 - DNA, 22 bp, Homo sapiens
tgcctggaggacctgagcctgc

SEQ ID NO: 2502326 - DNA, 14 bp, Homo sapiens
tgcctggtacagta

SEQ ID NO: 2502327 - DNA, 21 bp, Homo sapiens
tgcctgtggcgccgtctccag

SEQ ID NO: 2502328 - DNA, 16 bp, Homo sapiens
tgccttagtctcagtt

SEQ ID NO: 2502329 - DNA, 14 bp, Homo sapiens
tgccttatcttgca

SEQ ID NO: 2502330 - DNA, 18 bp, Homo sapiens
tgccttattcagggaagg

SEQ ID NO: 2502331 - DNA, 16 bp, Homo sapiens
tgccttcaacacagct

SEQ ID NO: 2502332 - DNA, 20 bp, Homo sapiens
tgccttcaacacagcttgtc

SEQ ID NO: 2502333 - DNA, 12 bp, Homo sapiens
tgccttcaagaa

SEQ ID NO: 2502334 - DNA, 18 bp, Homo sapiens
tgccttccagaaaacaaa

SEQ ID NO: 2502335 - DNA, 17 bp, Homo sapiens
tgccttcctcctgggcc

SEQ ID NO: 2502336 - DNA, 19 bp, Homo sapiens
tgccttcctcctgggccct

SEQ ID NO: 2502337 - DNA, 20 bp, Homo sapiens
tgccttcctcctgggccctc

SEQ ID NO: 2502338 - DNA, 17 bp, Homo sapiens
tgccttcgcttcttgcc

SEQ ID NO: 2502339 - DNA, 20 bp, Homo sapiens
tgccttcgcttcttgcctct

SEQ ID NO: 2502340 - DNA, 21 bp, Homo sapiens
tgccttcgcttcttgcctctg

SEQ ID NO: 2502341 - DNA, 23 bp, Homo sapiens
tgccttcgcttcttgcctctgtg

SEQ ID NO: 2502342 - DNA, 20 bp, Homo sapiens
tgccttcgtctttcccatgg

SEQ ID NO: 2502343 - DNA, 13 bp, Homo sapiens
tgccttggttttt

SEQ ID NO: 2502344 - DNA, 12 bp, Homo sapiens
tgcctttaacag

SEQ ID NO: 2502345 - DNA, 16 bp, Homo sapiens
tgcctttcaggatcta

SEQ ID NO: 2502346 - DNA, 16 bp, Homo sapiens
tgcctttgccaggtga

SEQ ID NO: 2502347 - DNA, 17 bp, Homo sapiens
tgcctttgccaggtgac

SEQ ID NO: 2502348 - DNA, 20 bp, Homo sapiens
tgccttttttctgtataaat

SEQ ID NO: 2502349 - DNA, 23 bp, Homo sapiens
tgccttttttctgtataaatgtc

SEQ ID NO: 2502350 - DNA, 21 bp, Homo sapiens
tgcgactttctgcctggagtg

SEQ ID NO: 2502351 - DNA, 14 bp, Homo sapiens
tgcgagagatgtgt

SEQ ID NO: 2502352 - DNA, 16 bp, Homo sapiens
tgcgagagatgtgtgt

SEQ ID NO: 2502353 - DNA, 19 bp, Homo sapiens
tgcgcccagggctgggagg

SEQ ID NO: 2502354 - DNA, 23 bp, Homo sapiens
tgcgcccagggctgggaggaagg

SEQ ID NO: 2502355 - DNA, 15 bp, Homo sapiens
tgcgctcagggccat

SEQ ID NO: 2502356 - DNA, 19 bp, Homo sapiens
tgcgctcagggccatgctg

SEQ ID NO: 2502357 - DNA, 18 bp, Homo sapiens
tgcggaccaccctcactg

SEQ ID NO: 2502358 - DNA, 13 bp, Homo sapiens
tgcggctcctcag

SEQ ID NO: 2502359 - DNA, 15 bp, Homo sapiens
tgcggctggccatgg

SEQ ID NO: 2502360 - DNA, 14 bp, Homo sapiens
tgcggctgtgtgtg

SEQ ID NO: 2502361 - DNA, 22 bp, Homo sapiens
tgcgggggttccgtgtccaccc

SEQ ID NO: 2502362 - DNA, 22 bp, Homo sapiens
tgcgggtgaacaaagcagccac

SEQ ID NO: 2502363 - DNA, 15 bp, Homo sapiens
tgcggtagccagcac

SEQ ID NO: 2502364 - DNA, 21 bp, Homo sapiens
tgcggttaattttgaagtgct

SEQ ID NO: 2502365 - DNA, 20 bp, Homo sapiens
tgcggttataaaaaatggtt

SEQ ID NO: 2502366 - DNA, 22 bp, Homo sapiens
tgcggttataaaaaatggttca

SEQ ID NO: 2502367 - DNA, 17 bp, Homo sapiens
tgcgtgcgagcacacac

SEQ ID NO: 2502368 - DNA, 14 bp, Homo sapiens
tgcgtgggtgtgtg

SEQ ID NO: 2502369 - DNA, 23 bp, Homo sapiens
tgcgtgggtgtgtgcgtgtttgg

SEQ ID NO: 2502370 - DNA, 17 bp, Homo sapiens
tgctaaataaaatttgt

SEQ ID NO: 2502371 - DNA, 16 bp, Homo sapiens
tgctaacatctaaaaa

SEQ ID NO: 2502372 - DNA, 22 bp, Homo sapiens
tggccagggccacgctccagct

SEQ ID NO: 2502373 - DNA, 15 bp, Homo sapiens
tggccatatttacct

SEQ ID NO: 2502374 - DNA, 21 bp, Homo sapiens
tggccatatttacctcagcct

SEQ ID NO: 2502375 - DNA, 15 bp, Homo sapiens
tggccatctgctcct

SEQ ID NO: 2502376 - DNA, 18 bp, Homo sapiens
tggccatctgctcctgga

SEQ ID NO: 2502377 - DNA, 14 bp, Homo sapiens
tggccatgaccctg

SEQ ID NO: 2502378 - DNA, 17 bp, Homo sapiens
tggccatgaccctgcct

SEQ ID NO: 2502379 - DNA, 16 bp, Homo sapiens
tggccatgctcctctt

SEQ ID NO: 2502380 - DNA, 21 bp, Homo sapiens
tggccatgctcctcttcccca

SEQ ID NO: 2502381 - DNA, 17 bp, Homo sapiens
tggccatggagaaagct

SEQ ID NO: 2502382 - DNA, 18 bp, Homo sapiens
tggccatggagaaagctg

SEQ ID NO: 2502383 - DNA, 15 bp, Homo sapiens
tggcccagggcccag

SEQ ID NO: 2502384 - DNA, 21 bp, Homo sapiens
tggcccagggcccagagccca

SEQ ID NO: 2502385 - DNA, 23 bp, Homo sapiens
tggcccagggcccagagcccagc

SEQ ID NO: 2502386 - DNA, 16 bp, Homo sapiens
tggccccaccctgggc

SEQ ID NO: 2502387 - DNA, 12 bp, Homo sapiens
tggccccagcac

SEQ ID NO: 2502388 - DNA, 15 bp, Homo sapiens
tggccccgtttctgg

SEQ ID NO: 2502389 - DNA, 16 bp, Homo sapiens
tggcccctctgacctg

SEQ ID NO: 2502390 - DNA, 21 bp, Homo sapiens
tggccctctcccctgccccct

SEQ ID NO: 2502391 - DNA, 14 bp, Homo sapiens
tggccctgcttcct

SEQ ID NO: 2502392 - DNA, 21 bp, Homo sapiens
tggcccttatgactgccaaga

SEQ ID NO: 2502393 - DNA, 15 bp, Homo sapiens
tggcccttcctggac

SEQ ID NO: 2502394 - DNA, 13 bp, Homo sapiens
tggccgccccctg

SEQ ID NO: 2502395 - DNA, 15 bp, Homo sapiens
tggccgcctgggtcc

SEQ ID NO: 2502396 - DNA, 22 bp, Homo sapiens
tggcctaagaggctgccctcct

SEQ ID NO: 2502397 - DNA, 15 bp, Homo sapiens
tggcctcaaagcaag

SEQ ID NO: 2502398 - DNA, 21 bp, Homo sapiens
tggcctcatgtggctggaaga

SEQ ID NO: 2502399 - DNA, 20 bp, Homo sapiens
tggcctcccaaatgagccat

SEQ ID NO: 2502400 - DNA, 14 bp, Homo sapiens
tggcctcccctgcc

SEQ ID NO: 2502401 - DNA, 13 bp, Homo sapiens
tggcctcctgcct

SEQ ID NO: 2502402 - DNA, 14 bp, Homo sapiens
tggcctcctgcctc

SEQ ID NO: 2502403 - DNA, 21 bp, Homo sapiens
tggcctcctgcctctactggg

SEQ ID NO: 2502404 - DNA, 19 bp, Homo sapiens
tggcctcttgagcagtggc

SEQ ID NO: 2502405 - DNA, 16 bp, Homo sapiens
tggcctgcaaactggg

SEQ ID NO: 2502406 - DNA, 20 bp, Homo sapiens
tggcctgcaaactgggaacc

SEQ ID NO: 2502407 - DNA, 23 bp, Homo sapiens
tggcctgcaaactgggaacccct

SEQ ID NO: 2502408 - DNA, 23 bp, Homo sapiens
tggcctggagcacaaagaccctg

SEQ ID NO: 2502409 - DNA, 13 bp, Homo sapiens
tggcctggccagt

SEQ ID NO: 2502410 - DNA, 19 bp, Homo sapiens
tggcctgtgttcttcctgg

SEQ ID NO: 2502411 - DNA, 22 bp, Homo sapiens
tggcctttttcatttatctata

SEQ ID NO: 2502412 - DNA, 19 bp, Homo sapiens
tggcgatgccagccaagct

SEQ ID NO: 2502413 - DNA, 18 bp, Homo sapiens
tggcgccgtctccagggg

SEQ ID NO: 2502414 - DNA, 21 bp, Homo sapiens
tggcgcgatctcggctcactg

SEQ ID NO: 2502415 - DNA, 18 bp, Homo sapiens
tggcgtaagtacagagaa

SEQ ID NO: 2502416 - DNA, 21 bp, Homo sapiens
tggcgtaagtacagagaagcc

SEQ ID NO: 2502417 - DNA, 22 bp, Homo sapiens
tggcgtaagtacagagaagcca

SEQ ID NO: 2502418 - DNA, 16 bp, Homo sapiens
tggcgtaggctacaga

SEQ ID NO: 2502419 - DNA, 23 bp, Homo sapiens
tggcgtaggctacagagaagcct

SEQ ID NO: 2502420 - DNA, 13 bp, Homo sapiens
tggcgtggaggag

SEQ ID NO: 2502421 - DNA, 18 bp, Homo sapiens
tggctactctgtgccaga

SEQ ID NO: 2502422 - DNA, 22 bp, Homo sapiens
tggctactctgtgccagagcct

SEQ ID NO: 2502423 - DNA, 18 bp, Homo sapiens
tggctatagatgtctttt

SEQ ID NO: 2502424 - DNA, 13 bp, Homo sapiens
tggctatgttttt

SEQ ID NO: 2502425 - DNA, 12 bp, Homo sapiens
tggctattttat

SEQ ID NO: 2502426 - DNA, 17 bp, Homo sapiens
tggctcacgcctgtaat

SEQ ID NO: 2502427 - DNA, 18 bp, Homo sapiens
tggctcactcagcacttg

SEQ ID NO: 2502428 - DNA, 22 bp, Homo sapiens
tggctcactcagcacttggccc

SEQ ID NO: 2502429 - DNA, 13 bp, Homo sapiens
tggctcagccagc

SEQ ID NO: 2502430 - DNA, 21 bp, Homo sapiens
tggctccagatgcagggcagt

SEQ ID NO: 2502431 - DNA, 18 bp, Homo sapiens
tggctcgaatctctgtgc

SEQ ID NO: 2502432 - DNA, 14 bp, Homo sapiens
tggctctacttccc

SEQ ID NO: 2502433 - DNA, 13 bp, Homo sapiens
tggctctcctggc

SEQ ID NO: 2502434 - DNA, 19 bp, Homo sapiens
tggctctgagcgcctccat

SEQ ID NO: 2502435 - DNA, 22 bp, Homo sapiens
tggctctgaggtgcctgtccca

SEQ ID NO: 2502436 - DNA, 12 bp, Homo sapiens
tggctctgccag

SEQ ID NO: 2502437 - DNA, 17 bp, Homo sapiens
tggctctgccagtcctg

SEQ ID NO: 2502438 - DNA, 13 bp, Homo sapiens
tggctgagggcag

SEQ ID NO: 2502439 - DNA, 22 bp, Homo sapiens
tggctgagggcagttcgcagcc

SEQ ID NO: 2502440 - DNA, 16 bp, Homo sapiens
tggctgcagcctcagg

SEQ ID NO: 2502441 - DNA, 17 bp, Homo sapiens
tggctgcagcctcagga

SEQ ID NO: 2502442 - DNA, 16 bp, Homo sapiens
tggctgcaggaatctt

SEQ ID NO: 2502443 - DNA, 21 bp, Homo sapiens
tggctggaagatcctgcgggt

SEQ ID NO: 2502444 - DNA, 23 bp, Homo sapiens
tggctggacccagccaggcccag

SEQ ID NO: 2502445 - DNA, 15 bp, Homo sapiens
tggctggcctcaccc

SEQ ID NO: 2502446 - DNA, 19 bp, Homo sapiens
tggctgggacgtggctcag

SEQ ID NO: 2502447 - DNA, 22 bp, Homo sapiens
tggctggtcaacttgagcatgt

SEQ ID NO: 2502448 - DNA, 16 bp, Homo sapiens
tggctggtccagggct

SEQ ID NO: 2502449 - DNA, 20 bp, Homo sapiens
tggctggtgtggtacagaga

SEQ ID NO: 2502450 - DNA, 19 bp, Homo sapiens
tggctgtaaggctctagat

SEQ ID NO: 2502451 - DNA, 14 bp, Homo sapiens
tggcttacctggcc

SEQ ID NO: 2502452 - DNA, 14 bp, Homo sapiens
tggcttcccatccc

SEQ ID NO: 2502453 - DNA, 18 bp, Homo sapiens
tggcttcccatccccagc

SEQ ID NO: 2502454 - DNA, 19 bp, Homo sapiens
tggcttcccatccccagcg

SEQ ID NO: 2502455 - DNA, 20 bp, Homo sapiens
tggcttcccatccccagcga

SEQ ID NO: 2502456 - DNA, 21 bp, Homo sapiens
tggcttcccatccccagcgat

SEQ ID NO: 2502457 - DNA, 18 bp, Homo sapiens
tggcttctggccaggaag

SEQ ID NO: 2502458 - DNA, 19 bp, Homo sapiens
tggcttctggccaggaagc

SEQ ID NO: 2502459 - DNA, 21 bp, Homo sapiens
tggcttctggccaggaagctt

SEQ ID NO: 2502460 - DNA, 17 bp, Homo sapiens
tggcttggccacagcca

SEQ ID NO: 2502461 - DNA, 20 bp, Homo sapiens
tggcttggccacagccaggg

SEQ ID NO: 2502462 - DNA, 23 bp, Homo sapiens
tggcttgggactaaatgccctgc

SEQ ID NO: 2502463 - DNA, 21 bp, Homo sapiens
tggctttggtctcttgcttgt

SEQ ID NO: 2502464 - DNA, 17 bp, Homo sapiens
tggcttttattaatgca

SEQ ID NO: 2502465 - DNA, 20 bp, Homo sapiens
tggcttttgcggttcaggaa

SEQ ID NO: 2502466 - DNA, 18 bp, Homo sapiens
tgggaaggcttgggattt

SEQ ID NO: 2502467 - DNA, 16 bp, Homo sapiens
tgggacagcaacctgt

SEQ ID NO: 2502468 - DNA, 13 bp, Homo sapiens
tgggaccaggcac

SEQ ID NO: 2502469 - DNA, 15 bp, Homo sapiens
tgggaccgctacacc

SEQ ID NO: 2502470 - DNA, 21 bp, Homo sapiens
tgggaccgctacaccactctg

SEQ ID NO: 2502471 - DNA, 21 bp, Homo sapiens
tgggacgtggctcagccagca

SEQ ID NO: 2502472 - DNA, 15 bp, Homo sapiens
tgggactaaatgccc

SEQ ID NO: 2502473 - DNA, 18 bp, Homo sapiens
tgggactaaatgccctgc

SEQ ID NO: 2502474 - DNA, 17 bp, Homo sapiens
tgggactcagccttcag

SEQ ID NO: 2502475 - DNA, 20 bp, Homo sapiens
tggttttctccaagagctac

SEQ ID NO: 2502476 - DNA, 19 bp, Homo sapiens
tgtaaaacatttattttga

SEQ ID NO: 2502477 - DNA, 21 bp, Homo sapiens
tgtaaaatgacaatcatgtgt

SEQ ID NO: 2502478 - DNA, 17 bp, Homo sapiens
tgtaaactttatcactt

SEQ ID NO: 2502479 - DNA, 19 bp, Homo sapiens
tgtaaaggagtcaaaacta

SEQ ID NO: 2502480 - DNA, 14 bp, Homo sapiens
tgtaaataaaaaga

SEQ ID NO: 2502481 - DNA, 12 bp, Homo sapiens
tgtaaatataaa

SEQ ID NO: 2502482 - DNA, 14 bp, Homo sapiens
tgtaaatataaaga

SEQ ID NO: 2502483 - DNA, 15 bp, Homo sapiens
tgtaaatatgtacat

SEQ ID NO: 2502484 - DNA, 23 bp, Homo sapiens
tgtaaatatgtacatttctcagg

SEQ ID NO: 2502485 - DNA, 14 bp, Homo sapiens
tgtaaatattttaa

SEQ ID NO: 2502486 - DNA, 18 bp, Homo sapiens
tgtaaatattttaaagaa

SEQ ID NO: 2502487 - DNA, 16 bp, Homo sapiens
tgtaaatctgccacaa

SEQ ID NO: 2502488 - DNA, 12 bp, Homo sapiens
tgtaaattatgt

SEQ ID NO: 2502489 - DNA, 13 bp, Homo sapiens
tgtaaattatgta

SEQ ID NO: 2502490 - DNA, 11 bp, Homo sapiens
tgtaaattggc

SEQ ID NO: 2502491 - DNA, 15 bp, Homo sapiens
tgtaactaaaataat

SEQ ID NO: 2502492 - DNA, 15 bp, Homo sapiens
tgtaactgccaggct

SEQ ID NO: 2502493 - DNA, 13 bp, Homo sapiens
tgtaactgcccaa

SEQ ID NO: 2502494 - DNA, 23 bp, Homo sapiens
tgtaacttgatccatttctaatt

SEQ ID NO: 2502495 - DNA, 12 bp, Homo sapiens
tgtaagaaacct

SEQ ID NO: 2502496 - DNA, 15 bp, Homo sapiens
tgtaagaaatacaga

SEQ ID NO: 2502497 - DNA, 17 bp, Homo sapiens
tgtaagaaatacagact

SEQ ID NO: 2502498 - DNA, 18 bp, Homo sapiens
tgtaaggctctagatcat

SEQ ID NO: 2502499 - DNA, 21 bp, Homo sapiens
tgtaaggctgtgtaagatttg

SEQ ID NO: 2502500 - DNA, 18 bp, Homo sapiens
tgtaagttgggcttgcta

SEQ ID NO: 2502501 - DNA, 15 bp, Homo sapiens
tgtaataaactttaa

SEQ ID NO: 2502502 - DNA, 18 bp, Homo sapiens
tgtaatagatgtttgata

SEQ ID NO: 2502503 - DNA, 16 bp, Homo sapiens
tgtaatataaagtatt

SEQ ID NO: 2502504 - DNA, 17 bp, Homo sapiens
tgtaatatttcttcaaa

SEQ ID NO: 2502505 - DNA, 20 bp, Homo sapiens
tgtaatcaatgtttcttcta

SEQ ID NO: 2502506 - DNA, 17 bp, Homo sapiens
tgtaatcatataataaa

SEQ ID NO: 2502507 - DNA, 12 bp, Homo sapiens
tgtaatgacagg

SEQ ID NO: 2502508 - DNA, 15 bp, Homo sapiens
tgtaatgtcttgagc

SEQ ID NO: 2502509 - DNA, 15 bp, Homo sapiens
tgtaatgttaatatt

SEQ ID NO: 2502510 - DNA, 17 bp, Homo sapiens
tgtaatgttaatattga

SEQ ID NO: 2502511 - DNA, 13 bp, Homo sapiens
tgtaattctaaat

SEQ ID NO: 2502512 - DNA, 14 bp, Homo sapiens
tgtaattctaaatg

SEQ ID NO: 2502513 - DNA, 20 bp, Homo sapiens
tgtaattgtgtggattcttt

SEQ ID NO: 2502514 - DNA, 21 bp, Homo sapiens
tgtaattgtgtggattcttta

SEQ ID NO: 2502515 - DNA, 15 bp, Homo sapiens
tgtaattttgtgtaa

SEQ ID NO: 2502516 - DNA, 16 bp, Homo sapiens
tgtaattttgtgtaag

SEQ ID NO: 2502517 - DNA, 21 bp, Homo sapiens
tgtacaattaattatcttttc

SEQ ID NO: 2502518 - DNA, 12 bp, Homo sapiens
tgtacacagtca

SEQ ID NO: 2502519 - DNA, 17 bp, Homo sapiens
tgtacagctggctctac

SEQ ID NO: 2502520 - DNA, 17 bp, Homo sapiens
tgtacagtagattttcc

SEQ ID NO: 2502521 - DNA, 18 bp, Homo sapiens
tgtacagtagattttcca

SEQ ID NO: 2502522 - DNA, 22 bp, Homo sapiens
tgtacagtgtctttttttgtat

SEQ ID NO: 2502523 - DNA, 17 bp, Homo sapiens
tgtacatatgtgctgga

SEQ ID NO: 2502524 - DNA, 14 bp, Homo sapiens
tgtacatctatttt

SEQ ID NO: 2502525 - DNA, 16 bp, Homo sapiens
tgtacatttctcaggc

SEQ ID NO: 2502526 - DNA, 11 bp, Homo sapiens
tgtaccagtta

SEQ ID NO: 2502527 - DNA, 17 bp, Homo sapiens
tgtaccatgtacatgaa

SEQ ID NO: 2502528 - DNA, 14 bp, Homo sapiens
tgtaccatttgcct

SEQ ID NO: 2502529 - DNA, 20 bp, Homo sapiens
tgtacccaccgggccactcc

SEQ ID NO: 2502530 - DNA, 21 bp, Homo sapiens
tgtacggattttcagttactt

SEQ ID NO: 2502531 - DNA, 17 bp, Homo sapiens
tgtactgagccttgtaa

SEQ ID NO: 2502532 - DNA, 20 bp, Homo sapiens
tgtactgagccttgtaattc

SEQ ID NO: 2502533 - DNA, 12 bp, Homo sapiens
tgtactgcctgc

SEQ ID NO: 2502534 - DNA, 13 bp, Homo sapiens
tgtactgcctgct

SEQ ID NO: 2502535 - DNA, 22 bp, Homo sapiens
tgtacttggagtattggggtct

SEQ ID NO: 2502536 - DNA, 23 bp, Homo sapiens
tgtagaaaatttgttattttgca

SEQ ID NO: 2502537 - DNA, 18 bp, Homo sapiens
tgtagaacactaattcat

SEQ ID NO: 2502538 - DNA, 19 bp, Homo sapiens
tgtagaacactaattcata

SEQ ID NO: 2502539 - DNA, 17 bp, Homo sapiens
tgtagaacctaattcaa

SEQ ID NO: 2502540 - DNA, 14 bp, Homo sapiens
tgtagattgattgt

SEQ ID NO: 2502541 - DNA, 13 bp, Homo sapiens
tgtagccacacca

SEQ ID NO: 2502542 - DNA, 18 bp, Homo sapiens
tgtagccacaccaggata

SEQ ID NO: 2502543 - DNA, 23 bp, Homo sapiens
tgtagcctcaatcgagtgagaca

SEQ ID NO: 2502544 - DNA, 15 bp, Homo sapiens
tgtagcgtctttctt

SEQ ID NO: 2502545 - DNA, 16 bp, Homo sapiens
tgtagctacagagaaa

SEQ ID NO: 2502546 - DNA, 17 bp, Homo sapiens
tgtagctacagagaaac

SEQ ID NO: 2502547 - DNA, 18 bp, Homo sapiens
tgtagctacagagaaacc

SEQ ID NO: 2502548 - DNA, 22 bp, Homo sapiens
tgtagctacagagaaaccagct

SEQ ID NO: 2502549 - DNA, 11 bp, Homo sapiens
tgtagctgtga

SEQ ID NO: 2502550 - DNA, 13 bp, Homo sapiens
tgtagctgtgacc

SEQ ID NO: 2502551 - DNA, 16 bp, Homo sapiens
tgtagctgtgacctgc

SEQ ID NO: 2502552 - DNA, 17 bp, Homo sapiens
tgtagctgtgacctgct

SEQ ID NO: 2502553 - DNA, 19 bp, Homo sapiens
tgtagctgtgacctgctga

SEQ ID NO: 2502554 - DNA, 20 bp, Homo sapiens
tgtagctgtgacctgctgag

SEQ ID NO: 2502555 - DNA, 21 bp, Homo sapiens
tgtagctgtgacctgctgagc

SEQ ID NO: 2502556 - DNA, 23 bp, Homo sapiens
tgtagctgtgacctgctgagctc

SEQ ID NO: 2502557 - DNA, 23 bp, Homo sapiens
tgtagctttggaagtttagctct

SEQ ID NO: 2502558 - DNA, 22 bp, Homo sapiens
tgtaggggaggggctcctttcc

SEQ ID NO: 2502559 - DNA, 14 bp, Homo sapiens
tgtaggttgcacac

SEQ ID NO: 2502560 - DNA, 18 bp, Homo sapiens
tgtaggttgcacactttg

SEQ ID NO: 2502561 - DNA, 21 bp, Homo sapiens
tgtagtaaataatgctttgaa

SEQ ID NO: 2502562 - DNA, 17 bp, Homo sapiens
tgtagtaacactaatat

SEQ ID NO: 2502563 - DNA, 20 bp, Homo sapiens
tgtagtaacactaatatatt

SEQ ID NO: 2502564 - DNA, 19 bp, Homo sapiens
tgtagtaatctgcattatt

SEQ ID NO: 2502565 - DNA, 18 bp, Homo sapiens
tgtagtaattgacatgtg

SEQ ID NO: 2502566 - DNA, 18 bp, Homo sapiens
tgtagtattttttgtata

SEQ ID NO: 2502567 - DNA, 15 bp, Homo sapiens
tgtagtgctttgaga

SEQ ID NO: 2502568 - DNA, 22 bp, Homo sapiens
tgtagtgctttgagagagaaag

SEQ ID NO: 2502569 - DNA, 13 bp, Homo sapiens
tgtagttcatgta

SEQ ID NO: 2502570 - DNA, 22 bp, Homo sapiens
tgtataaaaataaaaaagatcc

SEQ ID NO: 2502571 - DNA, 13 bp, Homo sapiens
tgtataaaagtgt

SEQ ID NO: 2502572 - DNA, 13 bp, Homo sapiens
tgtataaaataga

SEQ ID NO: 2502573 - DNA, 16 bp, Homo sapiens
tgtataactaggagct

SEQ ID NO: 2502574 - DNA, 17 bp, Homo sapiens
tgtataagatcctagat

SEQ ID NO: 2502575 - DNA, 15 bp, Homo sapiens
tgtatagctgcttcc

SEQ ID NO: 2502576 - DNA, 15 bp, Homo sapiens
tgtatagtaaatcac

SEQ ID NO: 2502577 - DNA, 16 bp, Homo sapiens
tgtatagttaacacac

SEQ ID NO: 2502578 - DNA, 12 bp, Homo sapiens
tgtatatacttt

SEQ ID NO: 2502579 - DNA, 14 bp, Homo sapiens
tgtatatattatta

SEQ ID NO: 2502580 - DNA, 19 bp, Homo sapiens
ttaacaacatgtttccagc

SEQ ID NO: 2502581 - DNA, 12 bp, Homo sapiens
ttaacacactac

SEQ ID NO: 2502582 - DNA, 16 bp, Homo sapiens
ttaacagaaattgtat

SEQ ID NO: 2502583 - DNA, 13 bp, Homo sapiens
ttaacagagtctg

SEQ ID NO: 2502584 - DNA, 14 bp, Homo sapiens
ttaacagagtctga

SEQ ID NO: 2502585 - DNA, 13 bp, Homo sapiens
ttaacagttgtat

SEQ ID NO: 2502586 - DNA, 13 bp, Homo sapiens
ttaacataagcta

SEQ ID NO: 2502587 - DNA, 15 bp, Homo sapiens
ttaacataagctatt

SEQ ID NO: 2502588 - DNA, 21 bp, Homo sapiens
ttaacataagctatttttcta

SEQ ID NO: 2502589 - DNA, 17 bp, Homo sapiens
ttaacattccaagactc

SEQ ID NO: 2502590 - DNA, 13 bp, Homo sapiens
ttaaccagatcta

SEQ ID NO: 2502591 - DNA, 22 bp, Homo sapiens
ttaaccagatctagtcaatcaa

SEQ ID NO: 2502592 - DNA, 12 bp, Homo sapiens
ttaacctctgca

SEQ ID NO: 2502593 - DNA, 12 bp, Homo sapiens
ttaacctttgat

SEQ ID NO: 2502594 - DNA, 14 bp, Homo sapiens
ttaacgatgtccaa

SEQ ID NO: 2502595 - DNA, 16 bp, Homo sapiens
ttaactgaataccact

SEQ ID NO: 2502596 - DNA, 19 bp, Homo sapiens
ttaactgccgtaatttaac

SEQ ID NO: 2502597 - DNA, 17 bp, Homo sapiens
ttaactgggtaatgaaa

SEQ ID NO: 2502598 - DNA, 12 bp, Homo sapiens
ttaactgtggat

SEQ ID NO: 2502599 - DNA, 13 bp, Homo sapiens
ttaactgtggata

SEQ ID NO: 2502600 - DNA, 13 bp, Homo sapiens
ttaacttaaatag

SEQ ID NO: 2502601 - DNA, 17 bp, Homo sapiens
ttaacttcttgcttctt

SEQ ID NO: 2502602 - DNA, 15 bp, Homo sapiens
ttaagaaatagaatt

SEQ ID NO: 2502603 - DNA, 18 bp, Homo sapiens
ttaagaaggcaaaaatgt

SEQ ID NO: 2502604 - DNA, 10 bp, Homo sapiens
ttaagaatat

SEQ ID NO: 2502605 - DNA, 16 bp, Homo sapiens
ttaagacatgatttcc

SEQ ID NO: 2502606 - DNA, 21 bp, Homo sapiens
ttaagacctactgttctaaag

SEQ ID NO: 2502607 - DNA, 14 bp, Homo sapiens
ttaagataattata

SEQ ID NO: 2502608 - DNA, 21 bp, Homo sapiens
ttaagccacttaaaatgttca

SEQ ID NO: 2502609 - DNA, 11 bp, Homo sapiens
ttaagttgaga

SEQ ID NO: 2502610 - DNA, 23 bp, Homo sapiens
ttaagttgagatagttttcatcc

SEQ ID NO: 2502611 - DNA, 11 bp, Homo sapiens
ttaataaaaga

SEQ ID NO: 2502612 - DNA, 17 bp, Homo sapiens
ttaatactaccttgaaa

SEQ ID NO: 2502613 - DNA, 21 bp, Homo sapiens
ttaatactcaaatgagtaaca

SEQ ID NO: 2502614 - DNA, 14 bp, Homo sapiens
ttaatagcagcctt

SEQ ID NO: 2502615 - DNA, 23 bp, Homo sapiens
ttaatataaagtagtcctgtgaa

SEQ ID NO: 2502616 - DNA, 23 bp, Homo sapiens
ttaatataaagttttatatatta

SEQ ID NO: 2502617 - DNA, 14 bp, Homo sapiens
ttaatataaatgca

SEQ ID NO: 2502618 - DNA, 20 bp, Homo sapiens
ttaatatccctacatgtatt

SEQ ID NO: 2502619 - DNA, 20 bp, Homo sapiens
ttaatatgcttaaaataagc

SEQ ID NO: 2502620 - DNA, 22 bp, Homo sapiens
ttaatcagttcattagaaatat

SEQ ID NO: 2502621 - DNA, 20 bp, Homo sapiens
ttaatccgccaatattagta

SEQ ID NO: 2502622 - DNA, 17 bp, Homo sapiens
ttaatctctaacagtgg

SEQ ID NO: 2502623 - DNA, 18 bp, Homo sapiens
ttaatctctaacagtgga

SEQ ID NO: 2502624 - DNA, 14 bp, Homo sapiens
ttaatgaagaaagt

SEQ ID NO: 2502625 - DNA, 17 bp, Homo sapiens
ttaatgaagatctaaat

SEQ ID NO: 2502626 - DNA, 18 bp, Homo sapiens
ttaatgaagatctaaata

SEQ ID NO: 2502627 - DNA, 13 bp, Homo sapiens
ttaatgcactttc

SEQ ID NO: 2502628 - DNA, 22 bp, Homo sapiens
ttaattatgccttttttgatca

SEQ ID NO: 2502629 - DNA, 18 bp, Homo sapiens
ttaattgggccagctttt

SEQ ID NO: 2502630 - DNA, 14 bp, Homo sapiens
ttaattgtaaagta

SEQ ID NO: 2502631 - DNA, 15 bp, Homo sapiens
ttaattgtaaagtaa

SEQ ID NO: 2502632 - DNA, 14 bp, Homo sapiens
ttaattgtaatctg

SEQ ID NO: 2502633 - DNA, 15 bp, Homo sapiens
ttaatttagaaaact

SEQ ID NO: 2502634 - DNA, 14 bp, Homo sapiens
ttaatttatgcaga

SEQ ID NO: 2502635 - DNA, 15 bp, Homo sapiens
ttaatttgaaatatg

SEQ ID NO: 2502636 - DNA, 15 bp, Homo sapiens
ttaattttagttttt

SEQ ID NO: 2502637 - DNA, 15 bp, Homo sapiens
ttaatttttccaact

SEQ ID NO: 2502638 - DNA, 18 bp, Homo sapiens
ttaatttttccaactact

SEQ ID NO: 2502639 - DNA, 17 bp, Homo sapiens
ttacaaaactacatgag

SEQ ID NO: 2502640 - DNA, 20 bp, Homo sapiens
ttacaaaactacatgagaac

SEQ ID NO: 2502641 - DNA, 18 bp, Homo sapiens
ttacaaagcccttttata

SEQ ID NO: 2502642 - DNA, 18 bp, Homo sapiens
ttacaaatgttaaaatgt

SEQ ID NO: 2502643 - DNA, 13 bp, Homo sapiens
ttacaatgtaatt

SEQ ID NO: 2502644 - DNA, 17 bp, Homo sapiens
ttacaatgtaattattt

SEQ ID NO: 2502645 - DNA, 21 bp, Homo sapiens
ttacaatgtaattatttatgt

SEQ ID NO: 2502646 - DNA, 14 bp, Homo sapiens
ttacacgcttttgt

SEQ ID NO: 2502647 - DNA, 12 bp, Homo sapiens
ttacagtgttta

SEQ ID NO: 2502648 - DNA, 11 bp, Homo sapiens
ttacagttctg

SEQ ID NO: 2502649 - DNA, 13 bp, Homo sapiens
ttacagttctgtg

SEQ ID NO: 2502650 - DNA, 14 bp, Homo sapiens
ttacagttctgtgg

SEQ ID NO: 2502651 - DNA, 20 bp, Homo sapiens
ttacataattcactctgagt

SEQ ID NO: 2502652 - DNA, 13 bp, Homo sapiens
ttacatgaagtat

SEQ ID NO: 2502653 - DNA, 12 bp, Homo sapiens
ttacatgcttat

SEQ ID NO: 2502654 - DNA, 14 bp, Homo sapiens
ttacatgcttattc

SEQ ID NO: 2502655 - DNA, 17 bp, Homo sapiens
ttacatttacaaactga

SEQ ID NO: 2502656 - DNA, 21 bp, Homo sapiens
ttaccaaaaataaatatatct

SEQ ID NO: 2502657 - DNA, 21 bp, Homo sapiens
ttaccaggcaccaaaagaagt

SEQ ID NO: 2502658 - DNA, 18 bp, Homo sapiens
ttaccagtgccttaaact

SEQ ID NO: 2502659 - DNA, 22 bp, Homo sapiens
ttaccattaaaccatctccctg

SEQ ID NO: 2502660 - DNA, 20 bp, Homo sapiens
ttaccctggcccctctccct

SEQ ID NO: 2502661 - DNA, 12 bp, Homo sapiens
ttacctcagcct

SEQ ID NO: 2502662 - DNA, 20 bp, Homo sapiens
ttacctcagcctgggcgctg

SEQ ID NO: 2502663 - DNA, 11 bp, Homo sapiens
ttacctcctga

SEQ ID NO: 2502664 - DNA, 20 bp, Homo sapiens
ttacctgtggatatttgtat

SEQ ID NO: 2502665 - DNA, 19 bp, Homo sapiens
ttacgtatgtctggttctc

SEQ ID NO: 2502666 - DNA, 18 bp, Homo sapiens
ttactaaaaaaaagatga

SEQ ID NO: 2502667 - DNA, 16 bp, Homo sapiens
ttactagggatccctc

SEQ ID NO: 2502668 - DNA, 20 bp, Homo sapiens
ttactagggatccctcatct

SEQ ID NO: 2502669 - DNA, 14 bp, Homo sapiens
ttactgctctgaga

SEQ ID NO: 2502670 - DNA, 20 bp, Homo sapiens
ttactggcctttttcattta

SEQ ID NO: 2502671 - DNA, 15 bp, Homo sapiens
ttactgtaattcctc

SEQ ID NO: 2502672 - DNA, 18 bp, Homo sapiens
ttactgttagtcatttgc

SEQ ID NO: 2502673 - DNA, 16 bp, Homo sapiens
ttacttaatcaaaact

SEQ ID NO: 2502674 - DNA, 11 bp, Homo sapiens
ttacttcatat

SEQ ID NO: 2502675 - DNA, 16 bp, Homo sapiens
ttacttgtaaatataa

SEQ ID NO: 2502676 - DNA, 23 bp, Homo sapiens
ttacttgtaaatataaagacgtt

SEQ ID NO: 2502677 - DNA, 13 bp, Homo sapiens
ttactttgtgaat

SEQ ID NO: 2502678 - DNA, 22 bp, Homo sapiens
ttagaaataaagcatctcattt

SEQ ID NO: 2502679 - DNA, 19 bp, Homo sapiens
ttagaaattacctgtggat

SEQ ID NO: 2502680 - DNA, 17 bp, Homo sapiens
ttagaatcaaacatttt

SEQ ID NO: 2502681 - DNA, 13 bp, Homo sapiens
ttagacctacagg

SEQ ID NO: 2502682 - DNA, 16 bp, Homo sapiens
ttagacctgtgttact

SEQ ID NO: 2502683 - DNA, 21 bp, Homo sapiens
ttagactttaacataagctat

SEQ ID NO: 2502684 - DNA, 22 bp, Homo sapiens
ttagactttaacataagctatt

SEQ ID NO: 2502685 - DNA, 19 bp, Homo sapiens
ttcctggacagctgtgcct

SEQ ID NO: 2502686 - DNA, 20 bp, Homo sapiens
ttcctggacagctgtgcctc

SEQ ID NO: 2502687 - DNA, 24 bp, Homo sapiens
ttcctggacagctgtgcctcgctc

SEQ ID NO: 2502688 - DNA, 17 bp, Homo sapiens
ttcctgggaaatattcc

SEQ ID NO: 2502689 - DNA, 16 bp, Homo sapiens
ttcctgggtggctact

SEQ ID NO: 2502690 - DNA, 23 bp, Homo sapiens
ttcctgggtggctactctgtgcc

SEQ ID NO: 2502691 - DNA, 22 bp, Homo sapiens
ttcctggtagaccactgccata

SEQ ID NO: 2502692 - DNA, 14 bp, Homo sapiens
ttcctggtgctgga

SEQ ID NO: 2502693 - DNA, 15 bp, Homo sapiens
ttcctggtgctggag

SEQ ID NO: 2502694 - DNA, 15 bp, Homo sapiens
ttcctgtccagctcc

SEQ ID NO: 2502695 - DNA, 19 bp, Homo sapiens
ttcctgtcttatcctccac

SEQ ID NO: 2502696 - DNA, 21 bp, Homo sapiens
ttcctgtgtgtccaaaactgc

SEQ ID NO: 2502697 - DNA, 22 bp, Homo sapiens
ttccttagactcttttccttcc

SEQ ID NO: 2502698 - DNA, 19 bp, Homo sapiens
ttcctttaacaacatgttt

SEQ ID NO: 2502699 - DNA, 17 bp, Homo sapiens
ttcctttcttttccccc

SEQ ID NO: 2502700 - DNA, 13 bp, Homo sapiens
ttcctttgtgctt

SEQ ID NO: 2502701 - DNA, 13 bp, Homo sapiens
ttcgaaaatcaaa

SEQ ID NO: 2502702 - DNA, 14 bp, Homo sapiens
ttcgacactgttct

SEQ ID NO: 2502703 - DNA, 15 bp, Homo sapiens
ttcgacactgttctt

SEQ ID NO: 2502704 - DNA, 23 bp, Homo sapiens
ttcgagattatcgttttcttaaa

SEQ ID NO: 2502705 - DNA, 11 bp, Homo sapiens
ttcgcagccac

SEQ ID NO: 2502706 - DNA, 15 bp, Homo sapiens
ttcgcagccaccctg

SEQ ID NO: 2502707 - DNA, 20 bp, Homo sapiens
ttcgcatggtcacacactga

SEQ ID NO: 2502708 - DNA, 22 bp, Homo sapiens
ttcgcttcttgcctctgtgctg

SEQ ID NO: 2502709 - DNA, 17 bp, Homo sapiens
ttcggccccatgtatct

SEQ ID NO: 2502710 - DNA, 20 bp, Homo sapiens
ttcgggccaaggacctgaga

SEQ ID NO: 2502711 - DNA, 15 bp, Homo sapiens
ttctaaaaggtgtga

SEQ ID NO: 2502712 - DNA, 19 bp, Homo sapiens
ttctaaaatgtgatgttct

SEQ ID NO: 2502713 - DNA, 18 bp, Homo sapiens
ttctaaacccaatccaaa

SEQ ID NO: 2502714 - DNA, 15 bp, Homo sapiens
ttctaaactggagac

SEQ ID NO: 2502715 - DNA, 13 bp, Homo sapiens
ttctaaagattct

SEQ ID NO: 2502716 - DNA, 15 bp, Homo sapiens
ttctaaagctctgac

SEQ ID NO: 2502717 - DNA, 16 bp, Homo sapiens
ttctaaagctctgaca

SEQ ID NO: 2502718 - DNA, 17 bp, Homo sapiens
ttctaaagctctgacat

SEQ ID NO: 2502719 - DNA, 19 bp, Homo sapiens
ttctaagatgtgatattct

SEQ ID NO: 2502720 - DNA, 15 bp, Homo sapiens
ttctaagattctaaa

SEQ ID NO: 2502721 - DNA, 17 bp, Homo sapiens
ttctaagattctaaagg

SEQ ID NO: 2502722 - DNA, 19 bp, Homo sapiens
ttctaagattctaatgatg

SEQ ID NO: 2502723 - DNA, 19 bp, Homo sapiens
ttctaaggcctaggattct

SEQ ID NO: 2502724 - DNA, 15 bp, Homo sapiens
ttctaagtaaataca

SEQ ID NO: 2502725 - DNA, 18 bp, Homo sapiens
ttctaagtaaatacaatt

SEQ ID NO: 2502726 - DNA, 21 bp, Homo sapiens
ttctaagtaaatacaattttt

SEQ ID NO: 2502727 - DNA, 12 bp, Homo sapiens
ttctaagtcttt

SEQ ID NO: 2502728 - DNA, 23 bp, Homo sapiens
ttctaattatgtagctctttgtc

SEQ ID NO: 2502729 - DNA, 13 bp, Homo sapiens
ttctaattgctta

SEQ ID NO: 2502730 - DNA, 14 bp, Homo sapiens
ttctaattgcttat

SEQ ID NO: 2502731 - DNA, 19 bp, Homo sapiens
ttctactcacttttcccac

SEQ ID NO: 2502732 - DNA, 21 bp, Homo sapiens
ttctactcacttttcccactc

SEQ ID NO: 2502733 - DNA, 19 bp, Homo sapiens
ttctagaaagagaaacagt

SEQ ID NO: 2502734 - DNA, 22 bp, Homo sapiens
ttctagaaagagaaacagttgg

SEQ ID NO: 2502735 - DNA, 22 bp, Homo sapiens
ttctagacatggaggttctaag

SEQ ID NO: 2502736 - DNA, 23 bp, Homo sapiens
ttctagacatggaggttctaagg

SEQ ID NO: 2502737 - DNA, 14 bp, Homo sapiens
ttctagagttcaga

SEQ ID NO: 2502738 - DNA, 22 bp, Homo sapiens
ttctagatcagatgctccaaga

SEQ ID NO: 2502739 - DNA, 11 bp, Homo sapiens
ttctaggaaaa

SEQ ID NO: 2502740 - DNA, 12 bp, Homo sapiens
ttctaggaaaat

SEQ ID NO: 2502741 - DNA, 21 bp, Homo sapiens
ttctaggcactgtagttctaa

SEQ ID NO: 2502742 - DNA, 17 bp, Homo sapiens
ttctaggtttcaaagat

SEQ ID NO: 2502743 - DNA, 21 bp, Homo sapiens
ttctataaggccataaaacag

SEQ ID NO: 2502744 - DNA, 23 bp, Homo sapiens
ttctataaggccataaaacaggt

SEQ ID NO: 2502745 - DNA, 23 bp, Homo sapiens
ttctatagccaaaaatagctaaa

SEQ ID NO: 2502746 - DNA, 14 bp, Homo sapiens
ttctatagttctag

SEQ ID NO: 2502747 - DNA, 15 bp, Homo sapiens
ttctatagttctaga

SEQ ID NO: 2502748 - DNA, 20 bp, Homo sapiens
ttctattacattttcagtga

SEQ ID NO: 2502749 - DNA, 15 bp, Homo sapiens
ttctatttcactgga

SEQ ID NO: 2502750 - DNA, 14 bp, Homo sapiens
ttctatttggggct

SEQ ID NO: 2502751 - DNA, 16 bp, Homo sapiens
ttctatttggggcttg

SEQ ID NO: 2502752 - DNA, 15 bp, Homo sapiens
ttctattttattatg

SEQ ID NO: 2502753 - DNA, 13 bp, Homo sapiens
ttctcaagttcta

SEQ ID NO: 2502754 - DNA, 14 bp, Homo sapiens
ttctcaagttctaa

SEQ ID NO: 2502755 - DNA, 16 bp, Homo sapiens
ttctcaagttctaaga

SEQ ID NO: 2502756 - DNA, 22 bp, Homo sapiens
ttctcaagttctaagattctaa

SEQ ID NO: 2502757 - DNA, 18 bp, Homo sapiens
ttctcaattccaacagtt

SEQ ID NO: 2502758 - DNA, 18 bp, Homo sapiens
ttctcaggacacaggcct

SEQ ID NO: 2502759 - DNA, 20 bp, Homo sapiens
ttctcaggacacaggcctgt

SEQ ID NO: 2502760 - DNA, 21 bp, Homo sapiens
ttctcaggctaggccagcagg

SEQ ID NO: 2502761 - DNA, 16 bp, Homo sapiens
ttctcaggtgttgcca

SEQ ID NO: 2502762 - DNA, 22 bp, Homo sapiens
ttctcattttttaaaaaagctt

SEQ ID NO: 2502763 - DNA, 22 bp, Homo sapiens
ttctccacagcaaccccaggct

SEQ ID NO: 2502764 - DNA, 15 bp, Homo sapiens
ttctccagctgggct

SEQ ID NO: 2502765 - DNA, 20 bp, Homo sapiens
ttctccagctgggctctgca

SEQ ID NO: 2502766 - DNA, 20 bp, Homo sapiens
ttctccatccacatgggagc

SEQ ID NO: 2502767 - DNA, 19 bp, Homo sapiens
ttctcccaggcaaggctgt

SEQ ID NO: 2502768 - DNA, 12 bp, Homo sapiens
ttctccccagct

SEQ ID NO: 2502769 - DNA, 15 bp, Homo sapiens
ttctcccctgcactg

SEQ ID NO: 2502770 - DNA, 18 bp, Homo sapiens
ttctcccctgcactgtaa

SEQ ID NO: 2502771 - DNA, 20 bp, Homo sapiens
ttctcccctgcactgtaaaa

SEQ ID NO: 2502772 - DNA, 16 bp, Homo sapiens
ttctccgttagctcct

SEQ ID NO: 2502773 - DNA, 22 bp, Homo sapiens
ttctccgttagctcctgtggcc

SEQ ID NO: 2502774 - DNA, 14 bp, Homo sapiens
ttctcctatgtttg

SEQ ID NO: 2502775 - DNA, 19 bp, Homo sapiens
ttctcctgctgctccctca

SEQ ID NO: 2502776 - DNA, 21 bp, Homo sapiens
ttctcctgctgctccctcaga

SEQ ID NO: 2502777 - DNA, 18 bp, Homo sapiens
ttctccttttcctctctc

SEQ ID NO: 2502778 - DNA, 12 bp, Homo sapiens
ttctctccagct

SEQ ID NO: 2502779 - DNA, 17 bp, Homo sapiens
ttctctcggctccccat

SEQ ID NO: 2502780 - DNA, 17 bp, Homo sapiens
ttctctgagctgtgcag

SEQ ID NO: 2502781 - DNA, 13 bp, Homo sapiens
ttctctgaggaca

SEQ ID NO: 2502782 - DNA, 20 bp, Homo sapiens
ttctctggctgtaaggctct

SEQ ID NO: 2502783 - DNA, 17 bp, Homo sapiens
ttctctgtctcatccat

SEQ ID NO: 2502784 - DNA, 20 bp, Homo sapiens
ttctctgttgtcgtaaagat

SEQ ID NO: 2502785 - DNA, 20 bp, Homo sapiens
ttctcttccttttatcagta

SEQ ID NO: 2502786 - DNA, 22 bp, Homo sapiens
ttctcttgggaactgaactcac

SEQ ID NO: 2502787 - DNA, 14 bp, Homo sapiens
ttctctttccctgg

SEQ ID NO: 2502788 - DNA, 18 bp, Homo sapiens
ttctcttttgctttctgt

SEQ ID NO: 2502789 - DNA, 15 bp, Homo sapiens
ttgtatattgtgttt

SEQ ID NO: 2502790 - DNA, 14 bp, Homo sapiens
ttgtatcccctgca

SEQ ID NO: 2502791 - DNA, 15 bp, Homo sapiens
ttgtattctctgagc

SEQ ID NO: 2502792 - DNA, 20 bp, Homo sapiens
ttgtattctctgagctgtgc

SEQ ID NO: 2502793 - DNA, 20 bp, Homo sapiens
ttgtcaagtctctgctggcc

SEQ ID NO: 2502794 - DNA, 14 bp, Homo sapiens
ttgtcactttttct

SEQ ID NO: 2502795 - DNA, 16 bp, Homo sapiens
ttgtcactttttctga

SEQ ID NO: 2502796 - DNA, 14 bp, Homo sapiens
ttgtcagtattttt

SEQ ID NO: 2502797 - DNA, 22 bp, Homo sapiens
ttgtcatgtgtataaaaataaa

SEQ ID NO: 2502798 - DNA, 16 bp, Homo sapiens
ttgtccgctgggtggt

SEQ ID NO: 2502799 - DNA, 17 bp, Homo sapiens
ttgtcctttcccttcag

SEQ ID NO: 2502800 - DNA, 14 bp, Homo sapiens
ttgtccttttcata

SEQ ID NO: 2502801 - DNA, 16 bp, Homo sapiens
ttgtctataaagcatt

SEQ ID NO: 2502802 - DNA, 15 bp, Homo sapiens
ttgtctctgatgcag

SEQ ID NO: 2502803 - DNA, 21 bp, Homo sapiens
ttgtctctgatgcagcttata

SEQ ID NO: 2502804 - DNA, 12 bp, Homo sapiens
ttgtctctgttt

SEQ ID NO: 2502805 - DNA, 20 bp, Homo sapiens
ttgtctggcaaggactttgt

SEQ ID NO: 2502806 - DNA, 12 bp, Homo sapiens
ttgtcttaatat

SEQ ID NO: 2502807 - DNA, 17 bp, Homo sapiens
ttgtcttaatattgtgg

SEQ ID NO: 2502808 - DNA, 21 bp, Homo sapiens
ttgtgaatcaagggtcaggcc

SEQ ID NO: 2502809 - DNA, 23 bp, Homo sapiens
ttgtgaatcaagggtcaggcctt

SEQ ID NO: 2502810 - DNA, 19 bp, Homo sapiens
ttgtgaattaggctgtaac

SEQ ID NO: 2502811 - DNA, 23 bp, Homo sapiens
ttgtgaattaggctgtaactact

SEQ ID NO: 2502812 - DNA, 21 bp, Homo sapiens
ttgtgatatgcacaatgtaga

SEQ ID NO: 2502813 - DNA, 23 bp, Homo sapiens
ttgtgatcagaccataatgttac

SEQ ID NO: 2502814 - DNA, 16 bp, Homo sapiens
ttgtgatggagtgctg

SEQ ID NO: 2502815 - DNA, 17 bp, Homo sapiens
ttgtgatggagtgctgt

SEQ ID NO: 2502816 - DNA, 18 bp, Homo sapiens
ttgtgattagacagaaca

SEQ ID NO: 2502817 - DNA, 15 bp, Homo sapiens
ttgtgattggcctgt

SEQ ID NO: 2502818 - DNA, 23 bp, Homo sapiens
ttgtgcaatgtaaatattttaaa

SEQ ID NO: 2502819 - DNA, 21 bp, Homo sapiens
ttgtgcaatgtgtataaacaa

SEQ ID NO: 2502820 - DNA, 16 bp, Homo sapiens
ttgtgcacatttattt

SEQ ID NO: 2502821 - DNA, 14 bp, Homo sapiens
ttgtgcattctgga

SEQ ID NO: 2502822 - DNA, 23 bp, Homo sapiens
ttgtgggcctgggctcctggacc

SEQ ID NO: 2502823 - DNA, 17 bp, Homo sapiens
ttgtggggcctgggagg

SEQ ID NO: 2502824 - DNA, 14 bp, Homo sapiens
ttgtgtagcctttt

SEQ ID NO: 2502825 - DNA, 15 bp, Homo sapiens
ttgtgtagccttttt

SEQ ID NO: 2502826 - DNA, 19 bp, Homo sapiens
ttgtgtatttacgctttga

SEQ ID NO: 2502827 - DNA, 23 bp, Homo sapiens
ttgtgtatttacgctttgattca

SEQ ID NO: 2502828 - DNA, 19 bp, Homo sapiens
ttgtgtctggcagtttata

SEQ ID NO: 2502829 - DNA, 13 bp, Homo sapiens
ttgtgtgtatgca

SEQ ID NO: 2502830 - DNA, 15 bp, Homo sapiens
ttgtgtgttgtctct

SEQ ID NO: 2502831 - DNA, 20 bp, Homo sapiens
ttgttaatttagaaaacttt

SEQ ID NO: 2502832 - DNA, 16 bp, Homo sapiens
ttgttacgtagcctaa

SEQ ID NO: 2502833 - DNA, 23 bp, Homo sapiens
ttgttatttgaaaacatgtttat

SEQ ID NO: 2502834 - DNA, 17 bp, Homo sapiens
ttgttccccactggagc

SEQ ID NO: 2502835 - DNA, 18 bp, Homo sapiens
ttgttccccactggagca

SEQ ID NO: 2502836 - DNA, 18 bp, Homo sapiens
ttgttgagctattgctgt

SEQ ID NO: 2502837 - DNA, 15 bp, Homo sapiens
ttgttgtaacctgct

SEQ ID NO: 2502838 - DNA, 18 bp, Homo sapiens
ttgttgtaacctgctgtg

SEQ ID NO: 2502839 - DNA, 14 bp, Homo sapiens
ttgttgttctgtta

SEQ ID NO: 2502840 - DNA, 15 bp, Homo sapiens
ttgttgttctgttaa

SEQ ID NO: 2502841 - DNA, 23 bp, Homo sapiens
ttgtttcaatgaggtgtccaact

SEQ ID NO: 2502842 - DNA, 15 bp, Homo sapiens
ttgtttcgctctttg

SEQ ID NO: 2502843 - DNA, 19 bp, Homo sapiens
ttgtttcgctctttgagaa

SEQ ID NO: 2502844 - DNA, 22 bp, Homo sapiens
ttgtttcgctctttgagaaata

SEQ ID NO: 2502845 - DNA, 14 bp, Homo sapiens
ttgtttcttaaata

SEQ ID NO: 2502846 - DNA, 19 bp, Homo sapiens
ttgtttctttctctgagga

SEQ ID NO: 2502847 - DNA, 22 bp, Homo sapiens
ttgttttggctgaaattctcct

SEQ ID NO: 2502848 - DNA, 18 bp, Homo sapiens
ttgtttttaaactgtaca

SEQ ID NO: 2502849 - DNA, 14 bp, Homo sapiens
tttaaaaaactaaa

SEQ ID NO: 2502850 - DNA, 14 bp, Homo sapiens
tttaaaaaagctta

SEQ ID NO: 2502851 - DNA, 14 bp, Homo sapiens
tttaaaaagccagt

SEQ ID NO: 2502852 - DNA, 11 bp, Homo sapiens
tttaaaaataa

SEQ ID NO: 2502853 - DNA, 18 bp, Homo sapiens
tttaaaaataagtcaaca

SEQ ID NO: 2502854 - DNA, 12 bp, Homo sapiens
tttaaaagacac

SEQ ID NO: 2502855 - DNA, 19 bp, Homo sapiens
tttaaaagacacacttgtc

SEQ ID NO: 2502856 - DNA, 19 bp, Homo sapiens
tttaaaagcacgacagtgg

SEQ ID NO: 2502857 - DNA, 13 bp, Homo sapiens
tttaaaagcctgc

SEQ ID NO: 2502858 - DNA, 22 bp, Homo sapiens
tttaaaatcagctattttgtga

SEQ ID NO: 2502859 - DNA, 19 bp, Homo sapiens
tttaaaatcatcagaaagg

SEQ ID NO: 2502860 - DNA, 18 bp, Homo sapiens
tttaaaatgtaaagccat

SEQ ID NO: 2502861 - DNA, 16 bp, Homo sapiens
tttaaaatttgttctt

SEQ ID NO: 2502862 - DNA, 23 bp, Homo sapiens
tttaaaccgctaaaagaaacttt

SEQ ID NO: 2502863 - DNA, 15 bp, Homo sapiens
tttaaactataagca

SEQ ID NO: 2502864 - DNA, 13 bp, Homo sapiens
tttaaactgtaca

SEQ ID NO: 2502865 - DNA, 15 bp, Homo sapiens
tttaaactgtacagt

SEQ ID NO: 2502866 - DNA, 19 bp, Homo sapiens
tttaaagaaaaaaattgaa

SEQ ID NO: 2502867 - DNA, 12 bp, Homo sapiens
tttaaagaaagt

SEQ ID NO: 2502868 - DNA, 13 bp, Homo sapiens
tttaaagaaagtg

SEQ ID NO: 2502869 - DNA, 16 bp, Homo sapiens
tttaaagagtctagat

SEQ ID NO: 2502870 - DNA, 17 bp, Homo sapiens
tttaaagagtctagatt

SEQ ID NO: 2502871 - DNA, 15 bp, Homo sapiens
tttaaagcaggttct

SEQ ID NO: 2502872 - DNA, 16 bp, Homo sapiens
tttaaagcaggttctt

SEQ ID NO: 2502873 - DNA, 19 bp, Homo sapiens
tttaaagcaggttcttgtt

SEQ ID NO: 2502874 - DNA, 21 bp, Homo sapiens
tttaaatgaacaagagaagca

SEQ ID NO: 2502875 - DNA, 16 bp, Homo sapiens
tttaacagaaattgta

SEQ ID NO: 2502876 - DNA, 12 bp, Homo sapiens
tttaacattcct

SEQ ID NO: 2502877 - DNA, 13 bp, Homo sapiens
tttaacattcctc

SEQ ID NO: 2502878 - DNA, 17 bp, Homo sapiens
tttaacccccctgtaca

SEQ ID NO: 2502879 - DNA, 11 bp, Homo sapiens
tttaactgact

SEQ ID NO: 2502880 - DNA, 21 bp, Homo sapiens
tttaactgccgtaatttaact

SEQ ID NO: 2502881 - DNA, 17 bp, Homo sapiens
tttaactgtggatattg

SEQ ID NO: 2502882 - DNA, 15 bp, Homo sapiens
tttaagataattata

SEQ ID NO: 2502883 - DNA, 12 bp, Homo sapiens
tttaagccaaaa

SEQ ID NO: 2502884 - DNA, 18 bp, Homo sapiens
tttaagctctgagctgtc

SEQ ID NO: 2502885 - DNA, 19 bp, Homo sapiens
tttaagctctgagctgtca

SEQ ID NO: 2502886 - DNA, 14 bp, Homo sapiens
tttaataaatttat

SEQ ID NO: 2502887 - DNA, 22 bp, Homo sapiens
tttaatataaagttttatatat

SEQ ID NO: 2502888 - DNA, 13 bp, Homo sapiens
tttaatataaatg

SEQ ID NO: 2502889 - DNA, 15 bp, Homo sapiens
tttaatataaatgca

SEQ ID NO: 2502890 - DNA, 20 bp, Homo sapiens
tttaatataaatgcaaataa

SEQ ID NO: 2502891 - DNA, 18 bp, Homo sapiens
tttaatgtatagtaaatc

SEQ ID NO: 2502892 - DNA, 17 bp, Homo sapiens
tttaatgtttaaaacat

SEQ ID NO: 2502893 - DNA, 18 bp, Homo sapiens
tttgatgaggccctccac

SEQ ID NO: 2502894 - DNA, 15 bp, Homo sapiens
tttgatgagttgtga

SEQ ID NO: 2502895 - DNA, 14 bp, Homo sapiens
tttgatttcaacat

SEQ ID NO: 2502896 - DNA, 16 bp, Homo sapiens
tttgatttcaacatga

SEQ ID NO: 2502897 - DNA, 14 bp, Homo sapiens
tttgcaacctcgct

SEQ ID NO: 2502898 - DNA, 20 bp, Homo sapiens
tttgcaagggaaaagtctct

SEQ ID NO: 2502899 - DNA, 21 bp, Homo sapiens
tttgcaagggaaaagtctctt

SEQ ID NO: 2502900 - DNA, 24 bp, Homo sapiens
tttgcaaggtgcatttttactatt

SEQ ID NO: 2502901 - DNA, 19 bp, Homo sapiens
tttgcacagtgtgtgactt

SEQ ID NO: 2502902 - DNA, 19 bp, Homo sapiens
tttgcacatgtttcctcta

SEQ ID NO: 2502903 - DNA, 12 bp, Homo sapiens
tttgcagtaact

SEQ ID NO: 2502904 - DNA, 17 bp, Homo sapiens
tttgcatgatatcttca

SEQ ID NO: 2502905 - DNA, 18 bp, Homo sapiens
tttgcatgatatcttcaa

SEQ ID NO: 2502906 - DNA, 19 bp, Homo sapiens
tttgcatgatatcttcaag

SEQ ID NO: 2502907 - DNA, 22 bp, Homo sapiens
tttgcattaaattcacaaactt

SEQ ID NO: 2502908 - DNA, 12 bp, Homo sapiens
tttgcatttgtt

SEQ ID NO: 2502909 - DNA, 23 bp, Homo sapiens
tttgcatttgtttatgtaatttc

SEQ ID NO: 2502910 - DNA, 22 bp, Homo sapiens
tttgccaagggcataaattatt

SEQ ID NO: 2502911 - DNA, 16 bp, Homo sapiens
tttgccacagcttttg

SEQ ID NO: 2502912 - DNA, 17 bp, Homo sapiens
tttgccccaagtcctca

SEQ ID NO: 2502913 - DNA, 14 bp, Homo sapiens
tttgcccctttata

SEQ ID NO: 2502914 - DNA, 14 bp, Homo sapiens
tttgcctcaaataa

SEQ ID NO: 2502915 - DNA, 14 bp, Homo sapiens
tttgcctttaacag

SEQ ID NO: 2502916 - DNA, 14 bp, Homo sapiens
tttgctaattttta

SEQ ID NO: 2502917 - DNA, 21 bp, Homo sapiens
tttgctgtgaggctgtcctgt

SEQ ID NO: 2502918 - DNA, 18 bp, Homo sapiens
tttgctttaatataaatg

SEQ ID NO: 2502919 - DNA, 21 bp, Homo sapiens
tttggaaagtacactctgctg

SEQ ID NO: 2502920 - DNA, 13 bp, Homo sapiens
tttggaatacttt

SEQ ID NO: 2502921 - DNA, 17 bp, Homo sapiens
tttggaatactttttgt

SEQ ID NO: 2502922 - DNA, 16 bp, Homo sapiens
tttggacagtttacca

SEQ ID NO: 2502923 - DNA, 20 bp, Homo sapiens
tttggagtcccctcacctcc

SEQ ID NO: 2502924 - DNA, 20 bp, Homo sapiens
tttggatttaaaagcctgct

SEQ ID NO: 2502925 - DNA, 16 bp, Homo sapiens
tttggatttgacattg

SEQ ID NO: 2502926 - DNA, 23 bp, Homo sapiens
tttggccaatgcacctaaagaaa

SEQ ID NO: 2502927 - DNA, 21 bp, Homo sapiens
tttggctgaaattctcctgga

SEQ ID NO: 2502928 - DNA, 13 bp, Homo sapiens
tttggctttcagg

SEQ ID NO: 2502929 - DNA, 21 bp, Homo sapiens
tttgggagacatgtgacattt

SEQ ID NO: 2502930 - DNA, 23 bp, Homo sapiens
tttgggagagacttgttttggat

SEQ ID NO: 2502931 - DNA, 23 bp, Homo sapiens
tttgggagtttttatgagaaact

SEQ ID NO: 2502932 - DNA, 20 bp, Homo sapiens
tttgggcttcagctgccagt

SEQ ID NO: 2502933 - DNA, 18 bp, Homo sapiens
tttggggcagaaaggact

SEQ ID NO: 2502934 - DNA, 20 bp, Homo sapiens
tttggggcaggagtagctga

SEQ ID NO: 2502935 - DNA, 15 bp, Homo sapiens
tttggggcttgatga

SEQ ID NO: 2502936 - DNA, 18 bp, Homo sapiens
tttggggtgcccctctcc

SEQ ID NO: 2502937 - DNA, 18 bp, Homo sapiens
tttgggtttttttccttt

SEQ ID NO: 2502938 - DNA, 16 bp, Homo sapiens
tttggtcgaggagtaa

SEQ ID NO: 2502939 - DNA, 20 bp, Homo sapiens
tttggttcattaattctata

SEQ ID NO: 2502940 - DNA, 11 bp, Homo sapiens
tttggttctaa

SEQ ID NO: 2502941 - DNA, 17 bp, Homo sapiens
tttgtaaatctgccaca

SEQ ID NO: 2502942 - DNA, 21 bp, Homo sapiens
tttgtaataataaagaatagc

SEQ ID NO: 2502943 - DNA, 14 bp, Homo sapiens
tttgtaattaaaag

SEQ ID NO: 2502944 - DNA, 19 bp, Homo sapiens
tttgtaccattttaaagtt

SEQ ID NO: 2502945 - DNA, 14 bp, Homo sapiens
tttgtagttgaata

SEQ ID NO: 2502946 - DNA, 14 bp, Homo sapiens
tttgtataaaagtg

SEQ ID NO: 2502947 - DNA, 20 bp, Homo sapiens
tttgtataaaagtgtgaaat

SEQ ID NO: 2502948 - DNA, 16 bp, Homo sapiens
tttgtattaagaaagg

SEQ ID NO: 2502949 - DNA, 16 bp, Homo sapiens
tttgtattctctgagc

SEQ ID NO: 2502950 - DNA, 22 bp, Homo sapiens
tttgtcatgctgggatttccaa

SEQ ID NO: 2502951 - DNA, 19 bp, Homo sapiens
tttgtgatggagtgctgtt

SEQ ID NO: 2502952 - DNA, 14 bp, Homo sapiens
tttgtgtgctctcc

SEQ ID NO: 2502953 - DNA, 18 bp, Homo sapiens
tttgttatataatttaga

SEQ ID NO: 2502954 - DNA, 17 bp, Homo sapiens
tttgttccccactggag

SEQ ID NO: 2502955 - DNA, 19 bp, Homo sapiens
tttgttccccactggagca

SEQ ID NO: 2502956 - DNA, 15 bp, Homo sapiens
tttgttgacattctg

SEQ ID NO: 2502957 - DNA, 22 bp, Homo sapiens
tttgttgcgttcctttcttttc

SEQ ID NO: 2502958 - DNA, 15 bp, Homo sapiens
tttgtttgtttaatt

SEQ ID NO: 2502959 - DNA, 12 bp, Homo sapiens
tttgttttgcac

SEQ ID NO: 2502960 - DNA, 15 bp, Homo sapiens
tttgttttgtttaca

SEQ ID NO: 2502961 - DNA, 20 bp, Homo sapiens
tttgtttttaaactgtacag

SEQ ID NO: 2502962 - DNA, 21 bp, Homo sapiens
tttgtttttaaactgtacagt

SEQ ID NO: 2502963 - DNA, 23 bp, Homo sapiens
tttgtttttaaactgtacagtgt

SEQ ID NO: 2502964 - DNA, 12 bp, Homo sapiens
tttgtttttcat

SEQ ID NO: 2502965 - DNA, 21 bp, Homo sapiens
ttttaaaaaagcttaaaactt

SEQ ID NO: 2502966 - DNA, 14 bp, Homo sapiens
ttttaaaaagcaaa

SEQ ID NO: 2502967 - DNA, 22 bp, Homo sapiens
ttttaaaatcagctattttgtg

SEQ ID NO: 2502968 - DNA, 13 bp, Homo sapiens
ttttaaaatgtac

SEQ ID NO: 2502969 - DNA, 13 bp, Homo sapiens
ttttaaacacatt

SEQ ID NO: 2502970 - DNA, 13 bp, Homo sapiens
ttttaaactgtac

SEQ ID NO: 2502971 - DNA, 14 bp, Homo sapiens
ttttaaactgtaca

SEQ ID NO: 2502972 - DNA, 12 bp, Homo sapiens
ttttaaagaatt

SEQ ID NO: 2502973 - DNA, 14 bp, Homo sapiens
ttttaactttgttt

SEQ ID NO: 2502974 - DNA, 15 bp, Homo sapiens
ttttaactttgtttt

SEQ ID NO: 2502975 - DNA, 13 bp, Homo sapiens
ttttaagaatatc

SEQ ID NO: 2502976 - DNA, 15 bp, Homo sapiens
ttttaataaaagaaa

SEQ ID NO: 2502977 - DNA, 22 bp, Homo sapiens
ttttaatatgcttaaaataagc

SEQ ID NO: 2502978 - DNA, 17 bp, Homo sapiens
ttttaattattattctt

SEQ ID NO: 2502979 - DNA, 12 bp, Homo sapiens
ttttaattcatt

SEQ ID NO: 2502980 - DNA, 12 bp, Homo sapiens
ttttacaaagcc

SEQ ID NO: 2502981 - DNA, 14 bp, Homo sapiens
ttttacaaatgtta

SEQ ID NO: 2502982 - DNA, 16 bp, Homo sapiens
ttttacaatgtaatta

SEQ ID NO: 2502983 - DNA, 23 bp, Homo sapiens
ttttacaatgtaattatttatgt

SEQ ID NO: 2502984 - DNA, 22 bp, Homo sapiens
ttttaccctggcccctctccct

SEQ ID NO: 2502985 - DNA, 12 bp, Homo sapiens
ttttactctgcc

SEQ ID NO: 2502986 - DNA, 16 bp, Homo sapiens
ttttactctgcctaca

SEQ ID NO: 2502987 - DNA, 22 bp, Homo sapiens
ttttactctgcctacagaactt

SEQ ID NO: 2502988 - DNA, 12 bp, Homo sapiens
ttttacttttgt

SEQ ID NO: 2502989 - DNA, 22 bp, Homo sapiens
ttttagattttctggttctaac

SEQ ID NO: 2502990 - DNA, 11 bp, Homo sapiens
ttttagcattt

SEQ ID NO: 2502991 - DNA, 12 bp, Homo sapiens
ttttaggttcta

SEQ ID NO: 2502992 - DNA, 13 bp, Homo sapiens
ttttaggttctaa

SEQ ID NO: 2502993 - DNA, 23 bp, Homo sapiens
ttttaggttctaaagttctaaga

SEQ ID NO: 2502994 - DNA, 16 bp, Homo sapiens
ttttagtttttcatta

SEQ ID NO: 2502995 - DNA, 13 bp, Homo sapiens
ttttataaatact

SEQ ID NO: 2502996 - DNA, 18 bp, Homo sapiens
ttttatactttccctacc

SEQ ID NO: 2502997 - DNA, 13 bp, Homo sapiens
aaagctagaaatg

SEQ ID NO: 2502998 - DNA, 14 bp, Homo sapiens
aaagctagaaatga

SEQ ID NO: 2502999 - DNA, 16 bp, Homo sapiens
aaagtacatgttaaac

SEQ ID NO: 2503000 - DNA, 21 bp, Homo sapiens
aaagtatcctgcttctgatat

SEQ ID NO: 2503001 - DNA, 16 bp, Homo sapiens
aaagtggtatagaaat

SEQ ID NO: 2503002 - DNA, 20 bp, Homo sapiens
aaagtggtatagaaatgctg

SEQ ID NO: 2503003 - DNA, 14 bp, Homo sapiens
aaatgaaagtgaga

SEQ ID NO: 2503004 - DNA, 18 bp, Homo sapiens
aaattttttttgtttcat

SEQ ID NO: 2503005 - DNA, 16 bp, Homo sapiens
aacattgcaatagaaa

SEQ ID NO: 2503006 - DNA, 16 bp, Homo sapiens
aaccaaatattccaga

SEQ ID NO: 2503007 - DNA, 21 bp, Homo sapiens
aaccaggccagagcaaacaga

SEQ ID NO: 2503008 - DNA, 22 bp, Homo sapiens
aaccaggccagagcaaacagaa

SEQ ID NO: 2503009 - DNA, 21 bp, Homo sapiens
aacctcgaggtttctcaaaga

SEQ ID NO: 2503010 - DNA, 23 bp, Homo sapiens
aacctgatgctggggacacagca

SEQ ID NO: 2503011 - DNA, 14 bp, Homo sapiens
aactgaattttgtc

SEQ ID NO: 2503012 - DNA, 23 bp, Homo sapiens
aagacgtgattttgctgtagaag

SEQ ID NO: 2503013 - DNA, 14 bp, Homo sapiens
aagatgaaacatca

SEQ ID NO: 2503014 - DNA, 21 bp, Homo sapiens
aagtaatccacctgcctcggc

SEQ ID NO: 2503015 - DNA, 14 bp, Homo sapiens
aagttacacatttt

SEQ ID NO: 2503016 - DNA, 14 bp, Homo sapiens
aagtttaattgact

SEQ ID NO: 2503017 - DNA, 15 bp, Homo sapiens
aagttttgtaaattt

SEQ ID NO: 2503018 - DNA, 11 bp, Homo sapiens
aataaagacag

SEQ ID NO: 2503019 - DNA, 12 bp, Homo sapiens
aataactttttt

SEQ ID NO: 2503020 - DNA, 18 bp, Homo sapiens
aatagcgtcataactaga

SEQ ID NO: 2503021 - DNA, 15 bp, Homo sapiens
aatattgtacagttt

SEQ ID NO: 2503022 - DNA, 15 bp, Homo sapiens
aatcacgtaaagcta

SEQ ID NO: 2503023 - DNA, 14 bp, Homo sapiens
aatcctggggaaca

SEQ ID NO: 2503024 - DNA, 19 bp, Homo sapiens
aatgatccccagctgttta

SEQ ID NO: 2503025 - DNA, 22 bp, Homo sapiens
aatgatccccagctgtttatgc

SEQ ID NO: 2503026 - DNA, 12 bp, Homo sapiens
aatgtactgcat

SEQ ID NO: 2503027 - DNA, 18 bp, Homo sapiens
aatgtactgcatatgaaa

SEQ ID NO: 2503028 - DNA, 18 bp, Homo sapiens
aatgtctaaaaacatttg

SEQ ID NO: 2503029 - DNA, 15 bp, Homo sapiens
acaagccagctggag

SEQ ID NO: 2503030 - DNA, 16 bp, Homo sapiens
acacagcatcagctca

SEQ ID NO: 2503031 - DNA, 21 bp, Homo sapiens
acagaaaaagaaggttgaggg

SEQ ID NO: 2503032 - DNA, 21 bp, Homo sapiens
acagaaaacctgatgctgggg

SEQ ID NO: 2503033 - DNA, 19 bp, Homo sapiens
acagctcctggaccaggcc

SEQ ID NO: 2503034 - DNA, 15 bp, Homo sapiens
acagtcttgtattaa

SEQ ID NO: 2503035 - DNA, 12 bp, Homo sapiens
acagtgtacagt

SEQ ID NO: 2503036 - DNA, 13 bp, Homo sapiens
acagtgtacagtc

SEQ ID NO: 2503037 - DNA, 15 bp, Homo sapiens
acagtgtacagtctt

SEQ ID NO: 2503038 - DNA, 14 bp, Homo sapiens
acattgcaatagaa

SEQ ID NO: 2503039 - DNA, 11 bp, Homo sapiens
acattttgtat

SEQ ID NO: 2503040 - DNA, 16 bp, Homo sapiens
accaatattgtacagt

SEQ ID NO: 2503041 - DNA, 18 bp, Homo sapiens
accaatattgtacagttt

SEQ ID NO: 2503042 - DNA, 12 bp, Homo sapiens
acccttcttttc

SEQ ID NO: 2503043 - DNA, 16 bp, Homo sapiens
acctacagtgtacagt

SEQ ID NO: 2503044 - DNA, 17 bp, Homo sapiens
acctacagtgtacagtc

SEQ ID NO: 2503045 - DNA, 16 bp, Homo sapiens
actagaactgaatttt

SEQ ID NO: 2503046 - DNA, 20 bp, Homo sapiens
actcaagacttccagagcct

SEQ ID NO: 2503047 - DNA, 20 bp, Homo sapiens
actgaccaatattgtacagt

SEQ ID NO: 2503048 - DNA, 20 bp, Homo sapiens
actgatgtatgaggaatttc

SEQ ID NO: 2503049 - DNA, 14 bp, Homo sapiens
actgcaacttctgc

SEQ ID NO: 2503050 - DNA, 16 bp, Homo sapiens
actgcaacttctgcct

SEQ ID NO: 2503051 - DNA, 15 bp, Homo sapiens
acttatttatataaa

SEQ ID NO: 2503052 - DNA, 13 bp, Homo sapiens
acttctgcctctt

SEQ ID NO: 2503053 - DNA, 19 bp, Homo sapiens
actttgagggtgtatattt

SEQ ID NO: 2503054 - DNA, 23 bp, Homo sapiens
actttgagggtgtatattttctg

SEQ ID NO: 2503055 - DNA, 15 bp, Homo sapiens
acttttttttaagtt

SEQ ID NO: 2503056 - DNA, 23 bp, Homo sapiens
agaaaacctgatgctggggacac

SEQ ID NO: 2503057 - DNA, 20 bp, Homo sapiens
agaaagcccttaggaagaat

SEQ ID NO: 2503058 - DNA, 16 bp, Homo sapiens
agaaatttccactcag

SEQ ID NO: 2503059 - DNA, 22 bp, Homo sapiens
agaaatttccactcaggtctgt

SEQ ID NO: 2503060 - DNA, 21 bp, Homo sapiens
agaactcatgacggaagagtt

SEQ ID NO: 2503061 - DNA, 16 bp, Homo sapiens
agaagagggaaaacag

SEQ ID NO: 2503062 - DNA, 20 bp, Homo sapiens
agaagagggaaaacagaaaa

SEQ ID NO: 2503063 - DNA, 14 bp, Homo sapiens
agagcctcaaatga

SEQ ID NO: 2503064 - DNA, 17 bp, Homo sapiens
agagcctcaaatgagaa

SEQ ID NO: 2503065 - DNA, 13 bp, Homo sapiens
agatgaaacatca

SEQ ID NO: 2503066 - DNA, 18 bp, Homo sapiens
agatgaaacatcatttca

SEQ ID NO: 2503067 - DNA, 13 bp, Homo sapiens
agcaaacagaaaa

SEQ ID NO: 2503068 - DNA, 21 bp, Homo sapiens
agccatggcaggacagctcct

SEQ ID NO: 2503069 - DNA, 18 bp, Homo sapiens
agctcctggaccaggccc

SEQ ID NO: 2503070 - DNA, 19 bp, Homo sapiens
aggccagagcaaacagaaa

SEQ ID NO: 2503071 - DNA, 20 bp, Homo sapiens
aggccagagcaaacagaaaa

SEQ ID NO: 2503072 - DNA, 22 bp, Homo sapiens
aggctggtctcaaactcctgac

SEQ ID NO: 2503073 - DNA, 15 bp, Homo sapiens
agggaaaacagaaaa

SEQ ID NO: 2503074 - DNA, 14 bp, Homo sapiens
agtacatgttaaac

SEQ ID NO: 2503075 - DNA, 16 bp, Homo sapiens
agtccacagtggaacc

SEQ ID NO: 2503076 - DNA, 16 bp, Homo sapiens
agtgcaatgacacagt

SEQ ID NO: 2503077 - DNA, 17 bp, Homo sapiens
agtggaagtagtggagc

SEQ ID NO: 2503078 - DNA, 18 bp, Homo sapiens
agtggtatagaaatgctg

SEQ ID NO: 2503079 - DNA, 13 bp, Homo sapiens
agtgtacagtctt

SEQ ID NO: 2503080 - DNA, 13 bp, Homo sapiens
agttacacatttt

SEQ ID NO: 2503081 - DNA, 16 bp, Homo sapiens
agttacacatttttca

SEQ ID NO: 2503082 - DNA, 21 bp, Homo sapiens
agttatttttatttatttaaa

SEQ ID NO: 2503083 - DNA, 21 bp, Homo sapiens
agttcttagttgctgtatgtc

SEQ ID NO: 2503084 - DNA, 12 bp, Homo sapiens
agttttgtaaat

SEQ ID NO: 2503085 - DNA, 20 bp, Homo sapiens
agtttttattgcttgttgga

SEQ ID NO: 2503086 - DNA, 11 bp, Homo sapiens
ataaagacagg

SEQ ID NO: 2503087 - DNA, 12 bp, Homo sapiens
ataaataacttt

SEQ ID NO: 2503088 - DNA, 11 bp, Homo sapiens
ataaattattt

SEQ ID NO: 2503089 - DNA, 22 bp, Homo sapiens
ataaattttttttgtttcatat

SEQ ID NO: 2503090 - DNA, 16 bp, Homo sapiens
ataagatgaaacatca

SEQ ID NO: 2503091 - DNA, 13 bp, Homo sapiens
atacgataaataa

SEQ ID NO: 2503092 - DNA, 12 bp, Homo sapiens
atactgaaccag

SEQ ID NO: 2503093 - DNA, 13 bp, Homo sapiens
atagaaatgctgg

SEQ ID NO: 2503094 - DNA, 22 bp, Homo sapiens
atagcttacaagccagctggag

SEQ ID NO: 2503095 - DNA, 16 bp, Homo sapiens
atataaaagactgacc

SEQ ID NO: 2503096 - DNA, 17 bp, Homo sapiens
atataaattttttttgt

SEQ ID NO: 2503097 - DNA, 22 bp, Homo sapiens
atataaattttttttgtttcat

SEQ ID NO: 2503098 - DNA, 13 bp, Homo sapiens
atattgatgtgtg

SEQ ID NO: 2503099 - DNA, 16 bp, Homo sapiens
atcaattcatatctat

SEQ ID NO: 2503100 - DNA, 19 bp, Homo sapiens
atcctgcttctgatatgca

SEQ ID NO: 2503101 - DNA, 13 bp, Homo sapiens
atctttctgcaga

SEQ ID NO: 2503102 - DNA, 15 bp, Homo sapiens
atgaaacatcatttc

SEQ ID NO: 2503103 - DNA, 17 bp, Homo sapiens
atgaaacatcatttcaa

SEQ ID NO: 2503104 - DNA, 14 bp, Homo sapiens
atgatttttaaaga

SEQ ID NO: 2503105 - DNA, 16 bp, Homo sapiens
atgatttttaaagaaa

SEQ ID NO: 2503106 - DNA, 16 bp, Homo sapiens
atgtctcgtggtagga

SEQ ID NO: 2503107 - DNA, 19 bp, Homo sapiens
atgtctcgtggtaggactg

SEQ ID NO: 2503108 - DNA, 13 bp, Homo sapiens
attaagttgttaa

SEQ ID NO: 2503109 - DNA, 14 bp, Homo sapiens
attaagttgttaat

SEQ ID NO: 2503110 - DNA, 19 bp, Homo sapiens
attccagagcgtgtagtga

SEQ ID NO: 2503111 - DNA, 16 bp, Homo sapiens
attgcttgttggattt

SEQ ID NO: 2503112 - DNA, 14 bp, Homo sapiens
attgtacagttttt

SEQ ID NO: 2503113 - DNA, 15 bp, Homo sapiens
attgtacagttttta

SEQ ID NO: 2503114 - DNA, 16 bp, Homo sapiens
attttactttttcctg

SEQ ID NO: 2503115 - DNA, 16 bp, Homo sapiens
atttttattaaattat

SEQ ID NO: 2503116 - DNA, 15 bp, Homo sapiens
attttttttgtttca

SEQ ID NO: 2503117 - DNA, 20 bp, Homo sapiens
caaagtgctgggattacagg

SEQ ID NO: 2503118 - DNA, 22 bp, Homo sapiens
caagtaatccacctgcctcggc

SEQ ID NO: 2503119 - DNA, 14 bp, Homo sapiens
caagtgattctcct

SEQ ID NO: 2503120 - DNA, 16 bp, Homo sapiens
caagtgattctcctgc

SEQ ID NO: 2503121 - DNA, 14 bp, Homo sapiens
caatattgtacagt

SEQ ID NO: 2503122 - DNA, 15 bp, Homo sapiens
caatattgtacagtt

SEQ ID NO: 2503123 - DNA, 17 bp, Homo sapiens
caatgtctaaaaacatt

SEQ ID NO: 2503124 - DNA, 20 bp, Homo sapiens
caattggatacgacaacttg

SEQ ID NO: 2503125 - DNA, 13 bp, Homo sapiens
cacctacagtgta

SEQ ID NO: 2503126 - DNA, 23 bp, Homo sapiens
cacctacagtgtacagtcttgta

SEQ ID NO: 2503127 - DNA, 16 bp, Homo sapiens
cactcaggtctgtttt

SEQ ID NO: 2503128 - DNA, 17 bp, Homo sapiens
cagaaaacctgatgctg

SEQ ID NO: 2503129 - DNA, 16 bp, Homo sapiens
cagagcaaacagaaaa

SEQ ID NO: 2503130 - DNA, 23 bp, Homo sapiens
cagagtctcgctctgttgcccag

SEQ ID NO: 2503131 - DNA, 13 bp, Homo sapiens
cagcatcagctca

SEQ ID NO: 2503132 - DNA, 20 bp, Homo sapiens
cagcctcctgagtagctgga

SEQ ID NO: 2503133 - DNA, 18 bp, Homo sapiens
cagctggagaaatatggt

SEQ ID NO: 2503134 - DNA, 21 bp, Homo sapiens
cagctgtttatgcatagataa

SEQ ID NO: 2503135 - DNA, 21 bp, Homo sapiens
caggccagagcaaacagaaaa

SEQ ID NO: 2503136 - DNA, 17 bp, Homo sapiens
cagtcttgtattaagtt

SEQ ID NO: 2503137 - DNA, 16 bp, Homo sapiens
cagtggaaccagccca

SEQ ID NO: 2503138 - DNA, 15 bp, Homo sapiens
cagtgtacagtcttg

SEQ ID NO: 2503139 - DNA, 17 bp, Homo sapiens
cagtgtacagtcttgta

SEQ ID NO: 2503140 - DNA, 22 bp, Homo sapiens
catggatatgttatactgaacc

SEQ ID NO: 2503141 - DNA, 23 bp, Homo sapiens
cattctgcactcagaaaatggca

SEQ ID NO: 2503142 - DNA, 17 bp, Homo sapiens
catttcaatcgtaaaat

SEQ ID NO: 2503143 - DNA, 20 bp, Homo sapiens
cattttactttttcctggct

SEQ ID NO: 2503144 - DNA, 22 bp, Homo sapiens
ccaaagtggtatagaaatgctg

SEQ ID NO: 2503145 - DNA, 18 bp, Homo sapiens
ccaatattgtacagtttt

SEQ ID NO: 2503146 - DNA, 13 bp, Homo sapiens
ccagagcaaacag

SEQ ID NO: 2503147 - DNA, 13 bp, Homo sapiens
ccaggccagagca

SEQ ID NO: 2503148 - DNA, 19 bp, Homo sapiens
ccatggcaggacagctcct

SEQ ID NO: 2503149 - DNA, 11 bp, Homo sapiens
cccagctgttt

SEQ ID NO: 2503150 - DNA, 17 bp, Homo sapiens
ccctccattctgcactc

SEQ ID NO: 2503151 - DNA, 16 bp, Homo sapiens
cctacagtgtacagtc

SEQ ID NO: 2503152 - DNA, 14 bp, Homo sapiens
cctcagcctcctga

SEQ ID NO: 2503153 - DNA, 23 bp, Homo sapiens
cctcccaaagtgctgggattaca

SEQ ID NO: 2503154 - DNA, 16 bp, Homo sapiens
cctcgaggtttctcaa

SEQ ID NO: 2503155 - DNA, 15 bp, Homo sapiens
cctgagtagctggat

SEQ ID NO: 2503156 - DNA, 19 bp, Homo sapiens
cctgagtagctggattaca

SEQ ID NO: 2503157 - DNA, 17 bp, Homo sapiens
cctgtgcctctgggact

SEQ ID NO: 2503158 - DNA, 14 bp, Homo sapiens
ccttagaagtggaa

SEQ ID NO: 2503159 - DNA, 16 bp, Homo sapiens
cggggtggattggatt

SEQ ID NO: 2503160 - DNA, 16 bp, Homo sapiens
cgtcgacgtagaacct

SEQ ID NO: 2503161 - DNA, 18 bp, Homo sapiens
cgtgattttgctgtagaa

SEQ ID NO: 2503162 - DNA, 13 bp, Homo sapiens
ctaaaaacatttg

SEQ ID NO: 2503163 - DNA, 20 bp, Homo sapiens
ctaagcacgggccatatgaa

SEQ ID NO: 2503164 - DNA, 14 bp, Homo sapiens
ctacagtgtacagt

SEQ ID NO: 2503165 - DNA, 23 bp, Homo sapiens
ctagaaatgatccccagctgttt

SEQ ID NO: 2503166 - DNA, 22 bp, Homo sapiens
ctagcctgtgcctctgggactg

SEQ ID NO: 2503167 - DNA, 22 bp, Homo sapiens
ctataagatgaaacatcatttc

SEQ ID NO: 2503168 - DNA, 14 bp, Homo sapiens
ctcaaactcctgac

SEQ ID NO: 2503169 - DNA, 14 bp, Homo sapiens
ctcagcctcctgag

SEQ ID NO: 2503170 - DNA, 23 bp, Homo sapiens
ctccaagtccacagtggaaccag

SEQ ID NO: 2503171 - DNA, 21 bp, Homo sapiens
ctcctgagtagctggattaca

SEQ ID NO: 2503172 - DNA, 23 bp, Homo sapiens
ctgaaccaggccagagcaaacag

SEQ ID NO: 2503173 - DNA, 15 bp, Homo sapiens
ctgaccaatattgta

SEQ ID NO: 2503174 - DNA, 20 bp, Homo sapiens
ctgaccaatattgtacagtt

SEQ ID NO: 2503175 - DNA, 21 bp, Homo sapiens
ctgaccaatattgtacagttt

SEQ ID NO: 2503176 - DNA, 14 bp, Homo sapiens
ctgcactcagaaaa

SEQ ID NO: 2503177 - DNA, 16 bp, Homo sapiens
ctgcactcagaaaatg

SEQ ID NO: 2503178 - DNA, 13 bp, Homo sapiens
ctggctcatctct

SEQ ID NO: 2503179 - DNA, 18 bp, Homo sapiens
ctggtctcaaactcctga

SEQ ID NO: 2503180 - DNA, 14 bp, Homo sapiens
ctggtttttcagtt

SEQ ID NO: 2503181 - DNA, 16 bp, Homo sapiens
ctgtggccaagttctt

SEQ ID NO: 2503182 - DNA, 20 bp, Homo sapiens
cttacattttactttttcct

SEQ ID NO: 2503183 - DNA, 14 bp, Homo sapiens
cttacttagtgtta

SEQ ID NO: 2503184 - DNA, 20 bp, Homo sapiens
cttctccttagaagtggaag

SEQ ID NO: 2503185 - DNA, 19 bp, Homo sapiens
cttgcacgtattttaatag

SEQ ID NO: 2503186 - DNA, 16 bp, Homo sapiens
ttttcaatgtctaaaa

SEQ ID NO: 2503187 - DNA, 15 bp, Homo sapiens
ttttcagatataaaa

SEQ ID NO: 2503188 - DNA, 14 bp, Homo sapiens
ttttgctgtagaag

SEQ ID NO: 2503189 - DNA, 20 bp, Homo sapiens
tttttaataaagacagggtt

SEQ ID NO: 2503190 - DNA, 12 bp, Homo sapiens
ttttttgtttca

SEQ ID NO: 2503191 - DNA, 19 bp, Homo sapiens
gtctcgtggtaggactgta

SEQ ID NO: 2503192 - DNA, 20 bp, Homo sapiens
gtcttgtgtttctttagttt

SEQ ID NO: 2503193 - DNA, 16 bp, Homo sapiens
gtgagctcctaagcca

SEQ ID NO: 2503194 - DNA, 12 bp, Homo sapiens
gtgcctctggga

SEQ ID NO: 2503195 - DNA, 14 bp, Homo sapiens
gtgcctctgggact

SEQ ID NO: 2503196 - DNA, 12 bp, Homo sapiens
gtgggctaagca

SEQ ID NO: 2503197 - DNA, 16 bp, Homo sapiens
gtgtacagtcttgtat

SEQ ID NO: 2503198 - DNA, 14 bp, Homo sapiens
gttctaaagatgga

SEQ ID NO: 2503199 - DNA, 20 bp, Homo sapiens
gttctaaagatggaaaaacc

SEQ ID NO: 2503200 - DNA, 16 bp, Homo sapiens
gttcttaagacgtgat

SEQ ID NO: 2503201 - DNA, 19 bp, Homo sapiens
gttcttagttgctgtatgt

SEQ ID NO: 2503202 - DNA, 21 bp, Homo sapiens
gtttaagtgactgatggctaa

SEQ ID NO: 2503203 - DNA, 14 bp, Homo sapiens
gtttctcaaagaaa

SEQ ID NO: 2503204 - DNA, 17 bp, Homo sapiens
gtttctcaaagaaattt

SEQ ID NO: 2503205 - DNA, 24 bp, Homo sapiens
gttttcaggagtgggttgatttca

SEQ ID NO: 2503206 - DNA, 19 bp, Homo sapiens
gtttttcctgttcttaaga

SEQ ID NO: 2503207 - DNA, 13 bp, Homo sapiens
taaaagacttttt

SEQ ID NO: 2503208 - DNA, 20 bp, Homo sapiens
taaaagtacatgttaaactt

SEQ ID NO: 2503209 - DNA, 19 bp, Homo sapiens
taaacccagtagtggtgac

SEQ ID NO: 2503210 - DNA, 13 bp, Homo sapiens
taaagatggaaaa

SEQ ID NO: 2503211 - DNA, 14 bp, Homo sapiens
taaagctagaaatg

SEQ ID NO: 2503212 - DNA, 11 bp, Homo sapiens
taaattatttt

SEQ ID NO: 2503213 - DNA, 18 bp, Homo sapiens
taacatggtgtgcttctt

SEQ ID NO: 2503214 - DNA, 12 bp, Homo sapiens
taactagaactg

SEQ ID NO: 2503215 - DNA, 17 bp, Homo sapiens
taactagaactgaattt

SEQ ID NO: 2503216 - DNA, 21 bp, Homo sapiens
taagatgaaacatcatttcaa

SEQ ID NO: 2503217 - DNA, 15 bp, Homo sapiens
taagccatgggagac

SEQ ID NO: 2503218 - DNA, 13 bp, Homo sapiens
taataaagacagg

SEQ ID NO: 2503219 - DNA, 15 bp, Homo sapiens
tacacatttttcaga

SEQ ID NO: 2503220 - DNA, 19 bp, Homo sapiens
tacacatttttcagatata

SEQ ID NO: 2503221 - DNA, 15 bp, Homo sapiens
tacagtgtacagtct

SEQ ID NO: 2503222 - DNA, 22 bp, Homo sapiens
tacagtgtacagtcttgtatta

SEQ ID NO: 2503223 - DNA, 16 bp, Homo sapiens
tactgaaccaggccag

SEQ ID NO: 2503224 - DNA, 13 bp, Homo sapiens
tactttttcctgg

SEQ ID NO: 2503225 - DNA, 13 bp, Homo sapiens
tagaactgaattt

SEQ ID NO: 2503226 - DNA, 18 bp, Homo sapiens
tagaagatggcacttata

SEQ ID NO: 2503227 - DNA, 18 bp, Homo sapiens
tagcctgtgcctctggga

SEQ ID NO: 2503228 - DNA, 15 bp, Homo sapiens
taggcaggacctgtg

SEQ ID NO: 2503229 - DNA, 17 bp, Homo sapiens
tataaattttttttgtt

SEQ ID NO: 2503230 - DNA, 12 bp, Homo sapiens
tatgaataacat

SEQ ID NO: 2503231 - DNA, 11 bp, Homo sapiens
tattgtacagt

SEQ ID NO: 2503232 - DNA, 17 bp, Homo sapiens
tcaatgtctaaaaacat

SEQ ID NO: 2503233 - DNA, 19 bp, Homo sapiens
tcaatgtctaaaaacattt

SEQ ID NO: 2503234 - DNA, 16 bp, Homo sapiens
tcacagccacttggga

SEQ ID NO: 2503235 - DNA, 17 bp, Homo sapiens
tcagaatctctcttctt

SEQ ID NO: 2503236 - DNA, 18 bp, Homo sapiens
tcagatataaaagactga

SEQ ID NO: 2503237 - DNA, 20 bp, Homo sapiens
tcagatataaaagactgacc

SEQ ID NO: 2503238 - DNA, 13 bp, Homo sapiens
tcagcctcctgag

SEQ ID NO: 2503239 - DNA, 21 bp, Homo sapiens
tcagggagtgggctaagcacg

SEQ ID NO: 2503240 - DNA, 19 bp, Homo sapiens
tccaagtccacagtggaac

SEQ ID NO: 2503241 - DNA, 21 bp, Homo sapiens
tccattctgcactcagaaaat

SEQ ID NO: 2503242 - DNA, 14 bp, Homo sapiens
tccccagctgttta

SEQ ID NO: 2503243 - DNA, 15 bp, Homo sapiens
tccccagctgtttat

SEQ ID NO: 2503244 - DNA, 13 bp, Homo sapiens
tccccttcactcc

SEQ ID NO: 2503245 - DNA, 16 bp, Homo sapiens
tcccgtggaacgtttt

SEQ ID NO: 2503246 - DNA, 23 bp, Homo sapiens
tcccgtggaacgtttttcctgtt

SEQ ID NO: 2503247 - DNA, 14 bp, Homo sapiens
tcctggaccaggcc

SEQ ID NO: 2503248 - DNA, 16 bp, Homo sapiens
tcgaggtttctcaaag

SEQ ID NO: 2503249 - DNA, 15 bp, Homo sapiens
tcgtggtaggactgt

SEQ ID NO: 2503250 - DNA, 19 bp, Homo sapiens
tctcaaagaaatttccact

SEQ ID NO: 2503251 - DNA, 15 bp, Homo sapiens
tctccttagaagtgg

SEQ ID NO: 2503252 - DNA, 15 bp, Homo sapiens
tctgcagaaacagaa

SEQ ID NO: 2503253 - DNA, 18 bp, Homo sapiens
tcttgtattaagttgtta

SEQ ID NO: 2503254 - DNA, 22 bp, Homo sapiens
tcttgtattaagttgttaataa

SEQ ID NO: 2503255 - DNA, 22 bp, Homo sapiens
tctttctgcagaaacagaaagg

SEQ ID NO: 2503256 - DNA, 23 bp, Homo sapiens
tctttttttttttttaaagacag

SEQ ID NO: 2503257 - DNA, 22 bp, Homo sapiens
tgaaaaagtatcctgcttctga

SEQ ID NO: 2503258 - DNA, 20 bp, Homo sapiens
tgaaatttttattaaattat

SEQ ID NO: 2503259 - DNA, 14 bp, Homo sapiens
tgaacattccagag

SEQ ID NO: 2503260 - DNA, 23 bp, Homo sapiens
tgacacagtcttggctcactgca

SEQ ID NO: 2503261 - DNA, 17 bp, Homo sapiens
tgaccaatattgtacag

SEQ ID NO: 2503262 - DNA, 21 bp, Homo sapiens
tgacttatttatataaatttt

SEQ ID NO: 2503263 - DNA, 19 bp, Homo sapiens
tgatatgttggtagattct

SEQ ID NO: 2503264 - DNA, 21 bp, Homo sapiens
tgatttcagcacctacagtgt

SEQ ID NO: 2503265 - DNA, 16 bp, Homo sapiens
tgattttgctgtagaa

SEQ ID NO: 2503266 - DNA, 13 bp, Homo sapiens
tgcccaggctgga

SEQ ID NO: 2503267 - DNA, 20 bp, Homo sapiens
tgcccaggctggagtgcaat

SEQ ID NO: 2503268 - DNA, 17 bp, Homo sapiens
tgcctcagcctcctgag

SEQ ID NO: 2503269 - DNA, 15 bp, Homo sapiens
tgctggtttttcagt

SEQ ID NO: 2503270 - DNA, 18 bp, Homo sapiens
tgctggtttttcagtttt

SEQ ID NO: 2503271 - DNA, 15 bp, Homo sapiens
tggaaaataaattat

SEQ ID NO: 2503272 - DNA, 14 bp, Homo sapiens
tggaccaggcccat

SEQ ID NO: 2503273 - DNA, 13 bp, Homo sapiens
tggcctccaagtc

SEQ ID NO: 2503274 - DNA, 23 bp, Homo sapiens
tggcctccaagtccacagtggaa

SEQ ID NO: 2503275 - DNA, 19 bp, Homo sapiens
tggctaatgtactgcatat

SEQ ID NO: 2503276 - DNA, 20 bp, Homo sapiens
tggggacacagcatcagctc

SEQ ID NO: 2503277 - DNA, 17 bp, Homo sapiens
tggtactcattaaaaaa

SEQ ID NO: 2503278 - DNA, 13 bp, Homo sapiens
tggtatagaaatg

SEQ ID NO: 2503279 - DNA, 16 bp, Homo sapiens
tggtatagaaatgctg

SEQ ID NO: 2503280 - DNA, 18 bp, Homo sapiens
tggtctcaaactcctgac

SEQ ID NO: 2503281 - DNA, 15 bp, Homo sapiens
tggtgaacattgcaa

SEQ ID NO: 2503282 - DNA, 20 bp, Homo sapiens
tggtgaacattgcaatagaa

SEQ ID NO: 2503283 - DNA, 20 bp, Homo sapiens
tgtaagatcgttctctgcct

SEQ ID NO: 2503284 - DNA, 12 bp, Homo sapiens
tgtacagtcttg

SEQ ID NO: 2503285 - DNA, 21 bp, Homo sapiens
tgtagaaaagggaactgaaca

SEQ ID NO: 2503286 - DNA, 23 bp, Homo sapiens
tgtagaaaagggaactgaacatt

SEQ ID NO: 2503287 - DNA, 18 bp, Homo sapiens
tgtctcgtggtaggactg

SEQ ID NO: 2503288 - DNA, 19 bp, Homo sapiens
tgtctcgtggtaggactgt

SEQ ID NO: 2503289 - DNA, 20 bp, Homo sapiens
tgtctcgtggtaggactgta

SEQ ID NO: 2503290 - DNA, 15 bp, Homo sapiens
tgtcttgtgtttctt

SEQ ID NO: 2503291 - DNA, 16 bp, Homo sapiens
tgtgcctctgggactg

SEQ ID NO: 2503292 - DNA, 19 bp, Homo sapiens
tgtgtctaggcaggacctg

SEQ ID NO: 2503293 - DNA, 22 bp, Homo sapiens
tgtgtgtctaggcaggacctgt

SEQ ID NO: 2503294 - DNA, 18 bp, Homo sapiens
tgttaataaaagtacatg

SEQ ID NO: 2503295 - DNA, 21 bp, Homo sapiens
tgttatactgaaccaggccag

SEQ ID NO: 2503296 - DNA, 17 bp, Homo sapiens
tgttggatttttgtctt

SEQ ID NO: 2503297 - DNA, 14 bp, Homo sapiens
tgttggccaggctg

SEQ ID NO: 2503298 - DNA, 16 bp, Homo sapiens
ttaataaaagtacatg

SEQ ID NO: 2503299 - DNA, 20 bp, Homo sapiens
ttaatagcgtcataactaga

SEQ ID NO: 2503300 - DNA, 15 bp, Homo sapiens
ttacacatttttcag

SEQ ID NO: 2503301 - DNA, 15 bp, Homo sapiens
ttagttgctgtatgt

SEQ ID NO: 2503302 - DNA, 16 bp, Homo sapiens
ttatgatttttaaaga

SEQ ID NO: 2503303 - DNA, 14 bp, Homo sapiens
ttatgcatagataa

SEQ ID NO: 2503304 - DNA, 12 bp, Homo sapiens
ttcagatataaa

SEQ ID NO: 2503305 - DNA, 13 bp, Homo sapiens
ttccagagcctca

SEQ ID NO: 2503306 - DNA, 15 bp, Homo sapiens
ttctcaaagaaattt

SEQ ID NO: 2503307 - DNA, 19 bp, Homo sapiens
ttctcaaagaaatttccac

SEQ ID NO: 2503308 - DNA, 23 bp, Homo sapiens
ttcttaagacgtgattttgctgt

SEQ ID NO: 2503309 - DNA, 21 bp, Homo sapiens
ttgaaatttttattaaattat

SEQ ID NO: 2503310 - DNA, 19 bp, Homo sapiens
ttgcagcgattaataacag

SEQ ID NO: 2503311 - DNA, 17 bp, Homo sapiens
ttggaaaataaattatt

SEQ ID NO: 2503312 - DNA, 18 bp, Homo sapiens
ttggatttttgtcttgtg

SEQ ID NO: 2503313 - DNA, 21 bp, Homo sapiens
ttggtgaacattgcaatagaa

SEQ ID NO: 2503314 - DNA, 12 bp, Homo sapiens
ttgtacagtttt

SEQ ID NO: 2503315 - DNA, 14 bp, Homo sapiens
ttgttaataaaagt

SEQ ID NO: 2503316 - DNA, 13 bp, Homo sapiens
tttaaagaaaagt

SEQ ID NO: 2503317 - DNA, 21 bp, Homo sapiens
tttaaagaaaagttttgtaaa

SEQ ID NO: 2503318 - DNA, 13 bp, Homo sapiens
tttaaatgaaagt

SEQ ID NO: 2503319 - DNA, 22 bp, Homo sapiens
tttaatagcgtcataactagaa

SEQ ID NO: 2503320 - DNA, 22 bp, Homo sapiens
tttatgggtcagagttccgact

SEQ ID NO: 2503321 - DNA, 18 bp, Homo sapiens
tttcagatataaaagact

SEQ ID NO: 2503322 - DNA, 23 bp, Homo sapiens
tttcagcacctacagtgtacagt

SEQ ID NO: 2503323 - DNA, 15 bp, Homo sapiens
tttcagttttcagga

SEQ ID NO: 2503324 - DNA, 17 bp, Homo sapiens
tttccactcaggtctgt

SEQ ID NO: 2503325 - DNA, 15 bp, Homo sapiens
tttctcaaagaaatt

SEQ ID NO: 2503326 - DNA, 14 bp, Homo sapiens
tttctgcagaaaca

SEQ ID NO: 2503327 - DNA, 12 bp, Homo sapiens
tttggaaaataa

SEQ ID NO: 2503328 - DNA, 22 bp, Homo sapiens
tttggtgaacattgcaatagaa

SEQ ID NO: 2503329 - DNA, 19 bp, Homo sapiens
tttgtctttggtgaacatt

SEQ ID NO: 2503330 - DNA, 21 bp, Homo sapiens
ttttaagttacacatttttca

SEQ ID NO: 2503331 - DNA, 20 bp, Homo sapiens
ttttaggccaaaaaaatgta

SEQ ID NO: 2503332 - DNA, 12 bp, Homo sapiens
ttttattaaatt

SEQ ID NO: 2503333 - DNA, 15 bp, Homo sapiens
agtcttggctcactg

SEQ ID NO: 2503334 - DNA, 15 bp, Homo sapiens
agtcttttccatgaa

SEQ ID NO: 2503335 - DNA, 22 bp, Homo sapiens
agtgattctcctgcctcagcct

SEQ ID NO: 2503336 - DNA, 19 bp, Homo sapiens
agttacacatttttcagat

SEQ ID NO: 2503337 - DNA, 16 bp, Homo sapiens
agttcttagttgctgt

SEQ ID NO: 2503338 - DNA, 16 bp, Homo sapiens
agttgttaataaaagt

SEQ ID NO: 2503339 - DNA, 23 bp, Homo sapiens
agttgttaataaaagtacatgtt

SEQ ID NO: 2503340 - DNA, 14 bp, Homo sapiens
agtttaattgactt

SEQ ID NO: 2503341 - DNA, 18 bp, Homo sapiens
agtttaattgacttattt

SEQ ID NO: 2503342 - DNA, 15 bp, Homo sapiens
agtttttattgcttg

SEQ ID NO: 2503343 - DNA, 21 bp, Homo sapiens
ataaaagtacatgttaaactt

SEQ ID NO: 2503344 - DNA, 19 bp, Homo sapiens
ataaattttttttgtttca

SEQ ID NO: 2503345 - DNA, 20 bp, Homo sapiens
ataaccaaagcccaaagtgg

SEQ ID NO: 2503346 - DNA, 18 bp, Homo sapiens
ataacttttttttaagtt

SEQ ID NO: 2503347 - DNA, 19 bp, Homo sapiens
atagaaatgctggtttttc

SEQ ID NO: 2503348 - DNA, 18 bp, Homo sapiens
atagcgtcataactagaa

SEQ ID NO: 2503349 - DNA, 17 bp, Homo sapiens
atatgcagttttcctta

SEQ ID NO: 2503350 - DNA, 13 bp, Homo sapiens
atattgtacagtt

SEQ ID NO: 2503351 - DNA, 14 bp, Homo sapiens
atattgtacagttt

SEQ ID NO: 2503352 - DNA, 21 bp, Homo sapiens
atcctgcttctgatatgcagt

SEQ ID NO: 2503353 - DNA, 15 bp, Homo sapiens
atctctcttcttttc

SEQ ID NO: 2503354 - DNA, 16 bp, Homo sapiens
atgaaagtgagacttt

SEQ ID NO: 2503355 - DNA, 18 bp, Homo sapiens
atgagccaccgcgcccag

SEQ ID NO: 2503356 - DNA, 21 bp, Homo sapiens
atgagccaccgcgcccagcct

SEQ ID NO: 2503357 - DNA, 18 bp, Homo sapiens
atggcacttgggggactg

SEQ ID NO: 2503358 - DNA, 11 bp, Homo sapiens
attaaattatg

SEQ ID NO: 2503359 - DNA, 19 bp, Homo sapiens
attaagttgttaataaaag

SEQ ID NO: 2503360 - DNA, 18 bp, Homo sapiens
attctgcactcagaaaat

SEQ ID NO: 2503361 - DNA, 19 bp, Homo sapiens
atttacccttcttttctga

SEQ ID NO: 2503362 - DNA, 12 bp, Homo sapiens
atttatttaaat

SEQ ID NO: 2503363 - DNA, 13 bp, Homo sapiens
atttgtcaacaaa

SEQ ID NO: 2503364 - DNA, 14 bp, Homo sapiens
attttggaaaataa

SEQ ID NO: 2503365 - DNA, 20 bp, Homo sapiens
attttggaaaataaattatt

SEQ ID NO: 2503366 - DNA, 18 bp, Homo sapiens
attttgtatatttgtatt

SEQ ID NO: 2503367 - DNA, 19 bp, Homo sapiens
caaagaaatttccactcag

SEQ ID NO: 2503368 - DNA, 18 bp, Homo sapiens
caaagtggtatagaaatg

SEQ ID NO: 2503369 - DNA, 19 bp, Homo sapiens
caaagtggtatagaaatgc

SEQ ID NO: 2503370 - DNA, 17 bp, Homo sapiens
caagtccacagtggaac

SEQ ID NO: 2503371 - DNA, 19 bp, Homo sapiens
caatagatatttacctttt

SEQ ID NO: 2503372 - DNA, 14 bp, Homo sapiens
caatgacacagtct

SEQ ID NO: 2503373 - DNA, 19 bp, Homo sapiens
caatgacacagtcttggct

SEQ ID NO: 2503374 - DNA, 21 bp, Homo sapiens
caatgacacagtcttggctca

SEQ ID NO: 2503375 - DNA, 15 bp, Homo sapiens
caatgtctaaaaaca

SEQ ID NO: 2503376 - DNA, 15 bp, Homo sapiens
cacagcatcagctca

SEQ ID NO: 2503377 - DNA, 14 bp, Homo sapiens
cacatttttcagat

SEQ ID NO: 2503378 - DNA, 17 bp, Homo sapiens
cacctacagtgtacagt

SEQ ID NO: 2503379 - DNA, 23 bp, Homo sapiens
cacctgcctcggcctcccaaagt

SEQ ID NO: 2503380 - DNA, 12 bp, Homo sapiens
cactcagaaaat

SEQ ID NO: 2503381 - DNA, 17 bp, Homo sapiens
cactgcaacttctgcct

SEQ ID NO: 2503382 - DNA, 16 bp, Homo sapiens
cacttgggggactggg

SEQ ID NO: 2503383 - DNA, 20 bp, Homo sapiens
cagaaaggttttcttctttt

SEQ ID NO: 2503384 - DNA, 17 bp, Homo sapiens
cagagcaaacagaaaaa

SEQ ID NO: 2503385 - DNA, 20 bp, Homo sapiens
cagcacctacagtgtacagt

SEQ ID NO: 2503386 - DNA, 15 bp, Homo sapiens
cagctcctggaccag

SEQ ID NO: 2503387 - DNA, 21 bp, Homo sapiens
cagctcctggaccaggcccat

SEQ ID NO: 2503388 - DNA, 18 bp, Homo sapiens
caggacagctcctggacc

SEQ ID NO: 2503389 - DNA, 17 bp, Homo sapiens
caggacctgtggccaag

SEQ ID NO: 2503390 - DNA, 17 bp, Homo sapiens
caggagtgggttgattt

SEQ ID NO: 2503391 - DNA, 23 bp, Homo sapiens
caggctggtctcaaactcctgac

SEQ ID NO: 2503392 - DNA, 16 bp, Homo sapiens
cagtcttggctcactg

SEQ ID NO: 2503393 - DNA, 11 bp, Homo sapiens
cagttttcctt

SEQ ID NO: 2503394 - DNA, 23 bp, Homo sapiens
catggatatgttatactgaacca

SEQ ID NO: 2503395 - DNA, 17 bp, Homo sapiens
catggcaggacagctcc

SEQ ID NO: 2503396 - DNA, 16 bp, Homo sapiens
catgttggccaggctg

SEQ ID NO: 2503397 - DNA, 18 bp, Homo sapiens
catttttcagatataaaa

SEQ ID NO: 2503398 - DNA, 20 bp, Homo sapiens
catttttcagatataaaaga

SEQ ID NO: 2503399 - DNA, 20 bp, Homo sapiens
ccacagtggaaccagcccag

SEQ ID NO: 2503400 - DNA, 11 bp, Homo sapiens
ccactcaggtc

SEQ ID NO: 2503401 - DNA, 20 bp, Homo sapiens
ccagagcctcaaatgagaaa

SEQ ID NO: 2503402 - DNA, 19 bp, Homo sapiens
ccagcctcatctctttgtt

SEQ ID NO: 2503403 - DNA, 24 bp, Homo sapiens
ccagctggagaaatatggtactca

SEQ ID NO: 2503404 - DNA, 14 bp, Homo sapiens
ccaggctggtctca

SEQ ID NO: 2503405 - DNA, 23 bp, Homo sapiens
ccatgttggccaggctggtctca

SEQ ID NO: 2503406 - DNA, 20 bp, Homo sapiens
ccattctgcactcagaaaat

SEQ ID NO: 2503407 - DNA, 20 bp, Homo sapiens
cccaaagtggtatagaaatg

SEQ ID NO: 2503408 - DNA, 20 bp, Homo sapiens
cccaggctggagtgcaatga

SEQ ID NO: 2503409 - DNA, 23 bp, Homo sapiens
ccgcaggatttgggctcttggaa

SEQ ID NO: 2503410 - DNA, 20 bp, Homo sapiens
cctagcctgtgcctctggga

SEQ ID NO: 2503411 - DNA, 23 bp, Homo sapiens
cctagcctgtgcctctgggactg

SEQ ID NO: 2503412 - DNA, 20 bp, Homo sapiens
tttacccttcttttctgact

SEQ ID NO: 2503413 - DNA, 13 bp, Homo sapiens
tttattgcttgtt

SEQ ID NO: 2503414 - DNA, 16 bp, Homo sapiens
tttcagatataaaaga

SEQ ID NO: 2503415 - DNA, 21 bp, Homo sapiens
tttgagggtgtatattttctg

SEQ ID NO: 2503416 - DNA, 15 bp, Homo sapiens
ttttaaagaaaagtt

SEQ ID NO: 2503417 - DNA, 20 bp, Homo sapiens
ttttcaatgtctaaaaacat

SEQ ID NO: 2503418 - DNA, 17 bp, Homo sapiens
ttttcagatataaaaga

SEQ ID NO: 2503419 - DNA, 21 bp, Homo sapiens
ttttcagatataaaagactga

SEQ ID NO: 2503420 - DNA, 22 bp, Homo sapiens
ttttcagatataaaagactgac

SEQ ID NO: 2503421 - DNA, 13 bp, Homo sapiens
ttttgctgtagaa

SEQ ID NO: 2503422 - DNA, 12 bp, Homo sapiens
ttttgtttcata

SEQ ID NO: 2503423 - DNA, 20 bp, Homo sapiens
tttttaaagaaaagttttgt

SEQ ID NO: 2503424 - DNA, 18 bp, Homo sapiens
tttttaagttacacattt

SEQ ID NO: 2503425 - DNA, 17 bp, Homo sapiens
tttttaataaagacagg

SEQ ID NO: 2503426 - DNA, 12 bp, Homo sapiens
tttttcagtttt

SEQ ID NO: 2503427 - DNA, 16 bp, Homo sapiens
caatgtctaaaaacat

SEQ ID NO: 2503428 - DNA, 13 bp, Homo sapiens
cacagtggaacca

SEQ ID NO: 2503429 - DNA, 19 bp, Homo sapiens
cacagtggaaccagcccag

SEQ ID NO: 2503430 - DNA, 18 bp, Homo sapiens
cacatttttcagatataa

SEQ ID NO: 2503431 - DNA, 19 bp, Homo sapiens
caccatgttggccaggctg

SEQ ID NO: 2503432 - DNA, 19 bp, Homo sapiens
caccctccattctgcactc

SEQ ID NO: 2503433 - DNA, 16 bp, Homo sapiens
cacctacagtgtacag

SEQ ID NO: 2503434 - DNA, 20 bp, Homo sapiens
cacctacagtgtacagtctt

SEQ ID NO: 2503435 - DNA, 16 bp, Homo sapiens
cactgcaacttctgcc

SEQ ID NO: 2503436 - DNA, 9 bp, Homo sapiens
cagaaaacc

SEQ ID NO: 2503437 - DNA, 14 bp, Homo sapiens
cagagcaaacagaa

SEQ ID NO: 2503438 - DNA, 22 bp, Homo sapiens
cagatataaaagactgaccaat

SEQ ID NO: 2503439 - DNA, 15 bp, Homo sapiens
cagcacctacagtgt

SEQ ID NO: 2503440 - DNA, 14 bp, Homo sapiens
cagcatcagctcaa

SEQ ID NO: 2503441 - DNA, 14 bp, Homo sapiens
cagctcctggacca

SEQ ID NO: 2503442 - DNA, 19 bp, Homo sapiens
cagctcctggaccaggccc

SEQ ID NO: 2503443 - DNA, 13 bp, Homo sapiens
caggacagctcct

SEQ ID NO: 2503444 - DNA, 18 bp, Homo sapiens
cagtgtacagtcttgtat

SEQ ID NO: 2503445 - DNA, 20 bp, Homo sapiens
cagttggtctttaaccactt

SEQ ID NO: 2503446 - DNA, 13 bp, Homo sapiens
cataactagaact

SEQ ID NO: 2503447 - DNA, 22 bp, Homo sapiens
catagcttacaagccagctgga

SEQ ID NO: 2503448 - DNA, 18 bp, Homo sapiens
catggcaggacagctcct

SEQ ID NO: 2503449 - DNA, 14 bp, Homo sapiens
catgtgttccaagg

SEQ ID NO: 2503450 - DNA, 22 bp, Homo sapiens
cattaaaaaaaaaaaaaaaagt

SEQ ID NO: 2503451 - DNA, 19 bp, Homo sapiens
cattctgcactcagaaaat

SEQ ID NO: 2503452 - DNA, 13 bp, Homo sapiens
cattgcaatagaa

SEQ ID NO: 2503453 - DNA, 15 bp, Homo sapiens
cattgcaatagaaat

SEQ ID NO: 2503454 - DNA, 17 bp, Homo sapiens
cattttactttttcctg

SEQ ID NO: 2503455 - DNA, 22 bp, Homo sapiens
ccaaagtgctgggattacaggg

SEQ ID NO: 2503456 - DNA, 16 bp, Homo sapiens
ccactcaggtctgttt

SEQ ID NO: 2503457 - DNA, 17 bp, Homo sapiens
ccagagcaaacagaaaa

SEQ ID NO: 2503458 - DNA, 23 bp, Homo sapiens
ccagagcctcaaatgagaaaatg

SEQ ID NO: 2503459 - DNA, 20 bp, Homo sapiens
ccaggccagagcaaacagaa

SEQ ID NO: 2503460 - DNA, 17 bp, Homo sapiens
cccgtcgacgtagaacc

SEQ ID NO: 2503461 - DNA, 15 bp, Homo sapiens
cctacagtgtacagt

SEQ ID NO: 2503462 - DNA, 20 bp, Homo sapiens
cctacagtgtacagtcttgt

SEQ ID NO: 2503463 - DNA, 14 bp, Homo sapiens
cctcaaatgagaaa

SEQ ID NO: 2503464 - DNA, 12 bp, Homo sapiens
cctctgggactg

SEQ ID NO: 2503465 - DNA, 20 bp, Homo sapiens
cctgagtagctggattacag

SEQ ID NO: 2503466 - DNA, 13 bp, Homo sapiens
cctgcctcagcct

SEQ ID NO: 2503467 - DNA, 20 bp, Homo sapiens
cctgtgcctctgggactgga

SEQ ID NO: 2503468 - DNA, 20 bp, Homo sapiens
cctgtggccaagttcttagt

SEQ ID NO: 2503469 - DNA, 22 bp, Homo sapiens
cgctctgttgcccaggctggag

SEQ ID NO: 2503470 - DNA, 14 bp, Homo sapiens
cggcctcccaaagt

SEQ ID NO: 2503471 - DNA, 16 bp, Homo sapiens
cgtaaagctagaaatg

SEQ ID NO: 2503472 - DNA, 16 bp, Homo sapiens
cgtcataactagaact

SEQ ID NO: 2503473 - DNA, 17 bp, Homo sapiens
cgtcataactagaactg

SEQ ID NO: 2503474 - DNA, 14 bp, Homo sapiens
ctaatgtactgcat

SEQ ID NO: 2503475 - DNA, 13 bp, Homo sapiens
ctacagtgtacag

SEQ ID NO: 2503476 - DNA, 20 bp, Homo sapiens
ctacagtgtacagtcttgta

SEQ ID NO: 2503477 - DNA, 15 bp, Homo sapiens
ctagaactgaatttt

SEQ ID NO: 2503478 - DNA, 15 bp, Homo sapiens
ctataagatgaaaca

SEQ ID NO: 2503479 - DNA, 14 bp, Homo sapiens
ctcaagacttccag

SEQ ID NO: 2503480 - DNA, 16 bp, Homo sapiens
ctcaagacttccagag

SEQ ID NO: 2503481 - DNA, 22 bp, Homo sapiens
ctcagcctcctgagtagctgga

SEQ ID NO: 2503482 - DNA, 15 bp, Homo sapiens
ctcaggtctgttttc

SEQ ID NO: 2503483 - DNA, 21 bp, Homo sapiens
ctccattctgcactcagaaaa

SEQ ID NO: 2503484 - DNA, 22 bp, Homo sapiens
ctcccaaagtgctgggattaca

SEQ ID NO: 2503485 - DNA, 21 bp, Homo sapiens
ctcctgcctcagcctcctgag

SEQ ID NO: 2503486 - DNA, 16 bp, Homo sapiens
ctcctggaccaggccc

SEQ ID NO: 2503487 - DNA, 20 bp, Homo sapiens
ctccttagaagtggaagtag

SEQ ID NO: 2503488 - DNA, 21 bp, Homo sapiens
ctcgtggtaggactgtagaaa

SEQ ID NO: 2503489 - DNA, 21 bp, Homo sapiens
ctctccattcccgtggaacgt

SEQ ID NO: 2503490 - DNA, 20 bp, Homo sapiens
ctctgttgcccaggctggag

SEQ ID NO: 2503491 - DNA, 22 bp, Homo sapiens
ctctgttgcccaggctggagtg

SEQ ID NO: 2503492 - DNA, 19 bp, Homo sapiens
ctcttgggttcaagtgatt

SEQ ID NO: 2503493 - DNA, 15 bp, Homo sapiens
ctgaacattccagag

SEQ ID NO: 2503494 - DNA, 13 bp, Homo sapiens
ctgaaccaggcca

SEQ ID NO: 2503495 - DNA, 18 bp, Homo sapiens
ctgaccaatattgtacag

SEQ ID NO: 2503496 - DNA, 15 bp, Homo sapiens
ctgatgctggggaca

SEQ ID NO: 2503497 - DNA, 15 bp, Homo sapiens
ctgcatatgaaagga

SEQ ID NO: 2503498 - DNA, 22 bp, Homo sapiens
ctggggacacagcatcagctca

SEQ ID NO: 2503499 - DNA, 16 bp, Homo sapiens
ctggtttttcagtttt

SEQ ID NO: 2503500 - DNA, 19 bp, Homo sapiens
ctgtagaaaagggaactga

SEQ ID NO: 2503501 - DNA, 14 bp, Homo sapiens
ctgtgcctctggga

SEQ ID NO: 2503502 - DNA, 16 bp, Homo sapiens
ctgtgcctctgggact

SEQ ID NO: 2503503 - DNA, 18 bp, Homo sapiens
ctgttcttaagacgtgat

SEQ ID NO: 2503504 - DNA, 23 bp, Homo sapiens
cttgggttcaagtgattctcctg

SEQ ID NO: 2503505 - DNA, 13 bp, Homo sapiens
cttgtattaagtt

SEQ ID NO: 2503506 - DNA, 17 bp, Homo sapiens
cttgtattaagttgtta

SEQ ID NO: 2503507 - DNA, 22 bp, Homo sapiens
cttgtattaagttgttaataaa

SEQ ID NO: 2503508 - DNA, 21 bp, Homo sapiens
cttgtgtttctttagtttttg

SEQ ID NO: 2503509 - DNA, 15 bp, Homo sapiens
ctttagtttttgtga

SEQ ID NO: 2503510 - DNA, 16 bp, Homo sapiens
cttttaggccaaaaaa

SEQ ID NO: 2503511 - DNA, 18 bp, Homo sapiens
cttttcaatgtctaaaaa

SEQ ID NO: 2503512 - DNA, 13 bp, Homo sapiens
gaaaacagaaaac

SEQ ID NO: 2503513 - DNA, 14 bp, Homo sapiens
gaaaacagaaaacc

SEQ ID NO: 2503514 - DNA, 20 bp, Homo sapiens
gaaatttccactcaggtctg

SEQ ID NO: 2503515 - DNA, 18 bp, Homo sapiens
gaagagggaaaacagaaa

SEQ ID NO: 2503516 - DNA, 21 bp, Homo sapiens
gaagggcttggactcaagcaa

SEQ ID NO: 2503517 - DNA, 18 bp, Homo sapiens
gaagtttaattgacttat

SEQ ID NO: 2503518 - DNA, 16 bp, Homo sapiens
gacagctcctggacca

SEQ ID NO: 2503519 - DNA, 21 bp, Homo sapiens
gacagctcctggaccaggccc

SEQ ID NO: 2503520 - DNA, 16 bp, Homo sapiens
gacttatttatataaa

SEQ ID NO: 2503521 - DNA, 21 bp, Homo sapiens
gagccagcagcctggctctcc

SEQ ID NO: 2503522 - DNA, 13 bp, Homo sapiens
gagggaaaacaga

SEQ ID NO: 2503523 - DNA, 20 bp, Homo sapiens
gaggtttctcaaagaaattt

SEQ ID NO: 2503524 - DNA, 19 bp, Homo sapiens
gagtgcaatgacacagtct

SEQ ID NO: 2503525 - DNA, 21 bp, Homo sapiens
gataaataacttttttttaag

SEQ ID NO: 2503526 - DNA, 18 bp, Homo sapiens
gatataaaagactgacca

SEQ ID NO: 2503527 - DNA, 20 bp, Homo sapiens
gatttgtctttggtgaacat

SEQ ID NO: 2503528 - DNA, 13 bp, Homo sapiens
gcaaacagaaaaa

SEQ ID NO: 2503529 - DNA, 19 bp, Homo sapiens
gcacctacagtgtacagtc

SEQ ID NO: 2503530 - DNA, 14 bp, Homo sapiens
gcacgtattttaat

SEQ ID NO: 2503531 - DNA, 15 bp, Homo sapiens
gcacgtattttaata

SEQ ID NO: 2503532 - DNA, 15 bp, Homo sapiens
gcaggacagctcctg

SEQ ID NO: 2503533 - DNA, 12 bp, Homo sapiens
gccaagttctta

SEQ ID NO: 2503534 - DNA, 16 bp, Homo sapiens
gccagagcaaacagaa

SEQ ID NO: 2503535 - DNA, 20 bp, Homo sapiens
gccatggcaggacagctcct

SEQ ID NO: 2503536 - DNA, 15 bp, Homo sapiens
gccatgtgttccaag

SEQ ID NO: 2503537 - DNA, 16 bp, Homo sapiens
gccatgtgttccaagg

SEQ ID NO: 2503538 - DNA, 19 bp, Homo sapiens
gcccaaagtggtatagaaa

SEQ ID NO: 2503539 - DNA, 12 bp, Homo sapiens
gcctctgggact

SEQ ID NO: 2503540 - DNA, 18 bp, Homo sapiens
gcctgtgcctctgggact

SEQ ID NO: 2503541 - DNA, 17 bp, Homo sapiens
gctcctggaccaggccc

SEQ ID NO: 2503542 - DNA, 15 bp, Homo sapiens
gctctggcctccaag

SEQ ID NO: 2503543 - DNA, 20 bp, Homo sapiens
ggagtgcaatgacacagtct

SEQ ID NO: 2503544 - DNA, 12 bp, Homo sapiens
ggccaagttctt

SEQ ID NO: 2503545 - DNA, 21 bp, Homo sapiens
ggccagagcaaacagaaaaag

SEQ ID NO: 2503546 - DNA, 16 bp, Homo sapiens
ggctaatgtactgcat

SEQ ID NO: 2503547 - DNA, 14 bp, Homo sapiens
ggggctgccagggg

SEQ ID NO: 2503548 - DNA, 15 bp, Homo sapiens
gtaaagctagaaatg

SEQ ID NO: 2503549 - DNA, 16 bp, Homo sapiens
gtaaagctagaaatga

SEQ ID NO: 2503550 - DNA, 16 bp, Homo sapiens
gtacagtcttgtatta

SEQ ID NO: 2503551 - DNA, 17 bp, Homo sapiens
gtagctggattacaggc

SEQ ID NO: 2503552 - DNA, 13 bp, Homo sapiens
gtctaaaaacatt

SEQ ID NO: 2503553 - DNA, 15 bp, Homo sapiens
gtctaaaaacatttg

SEQ ID NO: 2503554 - DNA, 16 bp, Homo sapiens
gtgaatcacgtaaagc

SEQ ID NO: 2503555 - DNA, 18 bp, Homo sapiens
gtgaatcacgtaaagcta

SEQ ID NO: 2503556 - DNA, 22 bp, Homo sapiens
gtggaacgtttttcctgttctt

SEQ ID NO: 2503557 - DNA, 19 bp, Homo sapiens
gtggaagtagtggagcccc

SEQ ID NO: 2503558 - DNA, 14 bp, Homo sapiens
gtggccaagttctt

SEQ ID NO: 2503559 - DNA, 16 bp, Homo sapiens
gtgtttctttagtttt

SEQ ID NO: 2503560 - DNA, 17 bp, Homo sapiens
gttacacatttttcaga

SEQ ID NO: 2503561 - DNA, 14 bp, Homo sapiens
gttcttcatctaag

SEQ ID NO: 2503562 - DNA, 15 bp, Homo sapiens
gttgttaataaaagt

SEQ ID NO: 2503563 - DNA, 12 bp, Homo sapiens
gttttgtaaatt

SEQ ID NO: 2503564 - DNA, 17 bp, Homo sapiens
gtttttaataaagacag

SEQ ID NO: 2503565 - DNA, 14 bp, Homo sapiens
gtggtatagaaatg

SEQ ID NO: 2503566 - DNA, 21 bp, Homo sapiens
gtggtctataagatgaaacat

SEQ ID NO: 2503567 - DNA, 22 bp, Homo sapiens
gtgtacagtcttgtattaagtt

SEQ ID NO: 2503568 - DNA, 19 bp, Homo sapiens
gtgtctaggcaggacctgt

SEQ ID NO: 2503569 - DNA, 13 bp, Homo sapiens
gtgtttctttagt

SEQ ID NO: 2503570 - DNA, 19 bp, Homo sapiens
gttaaacttacttagtgtt

SEQ ID NO: 2503571 - DNA, 14 bp, Homo sapiens
gttatactgaacca

SEQ ID NO: 2503572 - DNA, 23 bp, Homo sapiens
gttctaaagatggaaaaaccacc

SEQ ID NO: 2503573 - DNA, 14 bp, Homo sapiens
gttttgtaaatttc

SEQ ID NO: 2503574 - DNA, 16 bp, Homo sapiens
taaagaaaagttttgt

SEQ ID NO: 2503575 - DNA, 22 bp, Homo sapiens
taaagaaaagttttgtaaattt

SEQ ID NO: 2503576 - DNA, 15 bp, Homo sapiens
taaagctagaaatga

SEQ ID NO: 2503577 - DNA, 23 bp, Homo sapiens
taaagggagaagagggaaaacag

SEQ ID NO: 2503578 - DNA, 20 bp, Homo sapiens
taactagaactgaattttgt

SEQ ID NO: 2503579 - DNA, 21 bp, Homo sapiens
taagttacacatttttcagat

SEQ ID NO: 2503580 - DNA, 19 bp, Homo sapiens
taatagcgtcataactaga

SEQ ID NO: 2503581 - DNA, 13 bp, Homo sapiens
taatgtactgcat

SEQ ID NO: 2503582 - DNA, 13 bp, Homo sapiens
tacagtcttgtat

SEQ ID NO: 2503583 - DNA, 21 bp, Homo sapiens
tacattttgtatatttgtatt

SEQ ID NO: 2503584 - DNA, 15 bp, Homo sapiens
tacgacaacttgcac

SEQ ID NO: 2503585 - DNA, 22 bp, Homo sapiens
tagaactgaattttgtctttat

SEQ ID NO: 2503586 - DNA, 14 bp, Homo sapiens
tataaaagactgac

SEQ ID NO: 2503587 - DNA, 11 bp, Homo sapiens
tatagaaatgc

SEQ ID NO: 2503588 - DNA, 23 bp, Homo sapiens
tatataaattttttttgtttcat

SEQ ID NO: 2503589 - DNA, 12 bp, Homo sapiens
tattaaattatg

SEQ ID NO: 2503590 - DNA, 19 bp, Homo sapiens
tattgcttgttggattttt

SEQ ID NO: 2503591 - DNA, 15 bp, Homo sapiens
tattgtacagttttt

SEQ ID NO: 2503592 - DNA, 13 bp, Homo sapiens
tatttatttaaat

SEQ ID NO: 2503593 - DNA, 12 bp, Homo sapiens
tcaaagaaattt

SEQ ID NO: 2503594 - DNA, 19 bp, Homo sapiens
tcaaagaaatttccactca

SEQ ID NO: 2503595 - DNA, 20 bp, Homo sapiens
tcaaagaaatttccactcag

SEQ ID NO: 2503596 - DNA, 17 bp, Homo sapiens
tcaagcaagatttcaga

SEQ ID NO: 2503597 - DNA, 19 bp, Homo sapiens
tcaagtgattctcctgcct

SEQ ID NO: 2503598 - DNA, 20 bp, Homo sapiens
tcaatgtctaaaaacatttg

SEQ ID NO: 2503599 - DNA, 20 bp, Homo sapiens
tcacgtaaagctagaaatga

SEQ ID NO: 2503600 - DNA, 17 bp, Homo sapiens
tcactgcaacttctgcc

SEQ ID NO: 2503601 - DNA, 18 bp, Homo sapiens
tcactgcaacttctgcct

SEQ ID NO: 2503602 - DNA, 22 bp, Homo sapiens
tcagcacctacagtgtacagtc

SEQ ID NO: 2503603 - DNA, 21 bp, Homo sapiens
tcagcctcctgagtagctgga

SEQ ID NO: 2503604 - DNA, 13 bp, Homo sapiens
tcataactagaac

SEQ ID NO: 2503605 - DNA, 14 bp, Homo sapiens
tccacagtgactcc

SEQ ID NO: 2503606 - DNA, 20 bp, Homo sapiens
tccacagtggaaccagccca

SEQ ID NO: 2503607 - DNA, 21 bp, Homo sapiens
tcccaaagtgctgggattaca

SEQ ID NO: 2503608 - DNA, 14 bp, Homo sapiens
tcctgcctcagcct

SEQ ID NO: 2503609 - DNA, 21 bp, Homo sapiens
tcctttaattttttactattt

SEQ ID NO: 2503610 - DNA, 22 bp, Homo sapiens
tcgaggtttctcaaagaaattt

SEQ ID NO: 2503611 - DNA, 14 bp, Homo sapiens
tcgtggtaggactg

SEQ ID NO: 2503612 - DNA, 13 bp, Homo sapiens
tcgttctctgcct

SEQ ID NO: 2503613 - DNA, 15 bp, Homo sapiens
tctaaaaacatttgt

SEQ ID NO: 2503614 - DNA, 21 bp, Homo sapiens
tctcaaagaaatttccactca

SEQ ID NO: 2503615 - DNA, 22 bp, Homo sapiens
tctcaaagaaatttccactcag

SEQ ID NO: 2503616 - DNA, 21 bp, Homo sapiens
tctccttagaagtggaagtag

SEQ ID NO: 2503617 - DNA, 21 bp, Homo sapiens
tctcgtggtaggactgtagaa

SEQ ID NO: 2503618 - DNA, 14 bp, Homo sapiens
tctctccattcccg

SEQ ID NO: 2503619 - DNA, 15 bp, Homo sapiens
tctgcactcagaaaa

SEQ ID NO: 2503620 - DNA, 16 bp, Homo sapiens
tctgttgcccaggctg

SEQ ID NO: 2503621 - DNA, 16 bp, Homo sapiens
tctttatgatttttaa

SEQ ID NO: 2503622 - DNA, 17 bp, Homo sapiens
tctttattaaatgtaga

SEQ ID NO: 2503623 - DNA, 21 bp, Homo sapiens
tctttattaaatgtagaaagt

SEQ ID NO: 2503624 - DNA, 15 bp, Homo sapiens
tgaaatttttattaa

SEQ ID NO: 2503625 - DNA, 17 bp, Homo sapiens
tgaacattgcaatagaa

SEQ ID NO: 2503626 - DNA, 23 bp, Homo sapiens
tgaatcacgtaaagctagaaatg

SEQ ID NO: 2503627 - DNA, 19 bp, Homo sapiens
tgaccaatattgtacagtt

SEQ ID NO: 2503628 - DNA, 16 bp, Homo sapiens
tgacctgccaggcaca

SEQ ID NO: 2503629 - DNA, 19 bp, Homo sapiens
tgacctgccaggcacactg

SEQ ID NO: 2503630 - DNA, 19 bp, Homo sapiens
tgactcttggcacagcatg

SEQ ID NO: 2503631 - DNA, 13 bp, Homo sapiens
tgagtagctggat

SEQ ID NO: 2503632 - DNA, 19 bp, Homo sapiens
tgatttttaaagaaaagtt

SEQ ID NO: 2503633 - DNA, 17 bp, Homo sapiens
tgcacgtattttaatag

SEQ ID NO: 2503634 - DNA, 14 bp, Homo sapiens
tgcactcagaaaat

SEQ ID NO: 2503635 - DNA, 18 bp, Homo sapiens
tgcccaggctggagtgca

SEQ ID NO: 2503636 - DNA, 14 bp, Homo sapiens
tgctggggacacag

SEQ ID NO: 2503637 - DNA, 12 bp, Homo sapiens
tgctggtttttc

SEQ ID NO: 2503638 - DNA, 20 bp, Homo sapiens
tggaaaaaccacccccaaat

SEQ ID NO: 2503639 - DNA, 21 bp, Homo sapiens
tggaacgtttttcctgttctt

SEQ ID NO: 2503640 - DNA, 14 bp, Homo sapiens
tggaagtagtggag

SEQ ID NO: 2503641 - DNA, 15 bp, Homo sapiens
tggaccaggcccata

SEQ ID NO: 2503642 - DNA, 19 bp, Homo sapiens
tggatacgacaacttgcac

SEQ ID NO: 2503643 - DNA, 13 bp, Homo sapiens
tggattggatttg

SEQ ID NO: 2503644 - DNA, 16 bp, Homo sapiens
tggccaagttcttagt

SEQ ID NO: 2503645 - DNA, 21 bp, Homo sapiens
tgggattacagggatgagcca

SEQ ID NO: 2503646 - DNA, 17 bp, Homo sapiens
tggtaggactgtagaaa

SEQ ID NO: 2503647 - DNA, 14 bp, Homo sapiens
tggtatagaaatgc

SEQ ID NO: 2503648 - DNA, 22 bp, Homo sapiens
tggtatagaaatgctggttttt

SEQ ID NO: 2503649 - DNA, 23 bp, Homo sapiens
tggtctataagatgaaacatcat

SEQ ID NO: 2503650 - DNA, 16 bp, Homo sapiens
tggtttttcagttttc

SEQ ID NO: 2503651 - DNA, 15 bp, Homo sapiens
tgtacagtcttgtat

SEQ ID NO: 2503652 - DNA, 17 bp, Homo sapiens
tgtacagtcttgtatta

SEQ ID NO: 2503653 - DNA, 12 bp, Homo sapiens
tgtacagttttt

SEQ ID NO: 2503654 - DNA, 19 bp, Homo sapiens
tgtctaggcaggacctgtg

SEQ ID NO: 2503655 - DNA, 21 bp, Homo sapiens
tgtctcgtggtaggactgtag

SEQ ID NO: 2503656 - DNA, 18 bp, Homo sapiens
tgtcttgtgtttctttag

SEQ ID NO: 2503657 - DNA, 20 bp, Homo sapiens
tgtgtctaggcaggacctgt

SEQ ID NO: 2503658 - DNA, 15 bp, Homo sapiens
tgtgtttttaataaa

SEQ ID NO: 2503659 - DNA, 19 bp, Homo sapiens
tgttaataaaagtacatgt

SEQ ID NO: 2503660 - DNA, 15 bp, Homo sapiens
tgttgcccaggctgg

SEQ ID NO: 2503661 - DNA, 21 bp, Homo sapiens
tgttgcccaggctggagtgca

SEQ ID NO: 2503662 - DNA, 20 bp, Homo sapiens
tgtttcatattgatgtgtgt

SEQ ID NO: 2503663 - DNA, 18 bp, Homo sapiens
ttaaagaaaagttttgta

SEQ ID NO: 2503664 - DNA, 11 bp, Homo sapiens
ttaaagacaga

SEQ ID NO: 2503665 - DNA, 15 bp, Homo sapiens
ttaaatgtagaaagt

SEQ ID NO: 2503666 - DNA, 15 bp, Homo sapiens
ttaaatttctaccgc

SEQ ID NO: 2503667 - DNA, 17 bp, Homo sapiens
ttacacatttttcagat

SEQ ID NO: 2503668 - DNA, 22 bp, Homo sapiens
ttattttggaaaataaattatt

SEQ ID NO: 2503669 - DNA, 14 bp, Homo sapiens
ttcagatataaaag

SEQ ID NO: 2503670 - DNA, 15 bp, Homo sapiens
ttcagatataaaaga

SEQ ID NO: 2503671 - DNA, 22 bp, Homo sapiens
ttcagatataaaagactgacca

SEQ ID NO: 2503672 - DNA, 20 bp, Homo sapiens
ttcatatctatttattaaat

SEQ ID NO: 2503673 - DNA, 13 bp, Homo sapiens
ttctaaagatgga

SEQ ID NO: 2503674 - DNA, 13 bp, Homo sapiens
ttctgtgcagcca

SEQ ID NO: 2503675 - DNA, 21 bp, Homo sapiens
ttcttaagacgtgattttgct

SEQ ID NO: 2503676 - DNA, 15 bp, Homo sapiens
ttcttagttgctgta

SEQ ID NO: 2503677 - DNA, 19 bp, Homo sapiens
ttgcacgtattttaatagc

SEQ ID NO: 2503678 - DNA, 20 bp, Homo sapiens
ttgctgtagaagatggcact

SEQ ID NO: 2503679 - DNA, 23 bp, Homo sapiens
ttgtatttaaatgaaagtgagac

SEQ ID NO: 2503680 - DNA, 19 bp, Homo sapiens
ttgtctttggtgaacattg

SEQ ID NO: 2503681 - DNA, 19 bp, Homo sapiens
ttgtgtttctttagttttt

SEQ ID NO: 2503682 - DNA, 21 bp, Homo sapiens
tttaaatgaaagtgagacttt

SEQ ID NO: 2503683 - DNA, 19 bp, Homo sapiens
tttattaaatgtagaaagt

SEQ ID NO: 2503684 - DNA, 18 bp, Homo sapiens
tttcaatcgtaaaatttc

SEQ ID NO: 2503685 - DNA, 19 bp, Homo sapiens
tttcaatgtctaaaaacat

SEQ ID NO: 2503686 - DNA, 22 bp, Homo sapiens
tttcaatgtctaaaaacatttg

SEQ ID NO: 2503687 - DNA, 14 bp, Homo sapiens
tttctcaaagaaat

SEQ ID NO: 2503688 - DNA, 16 bp, Homo sapiens
tttctcaaagaaattt

SEQ ID NO: 2503689 - DNA, 21 bp, Homo sapiens
tttctttagtttttgtgaagt

SEQ ID NO: 2503690 - DNA, 13 bp, Homo sapiens
tttgctgtagaag

SEQ ID NO: 2503691 - DNA, 21 bp, Homo sapiens
tttgtcttgtgtttctttagt

SEQ ID NO: 2503692 - DNA, 22 bp, Homo sapiens
ttttaagttacacatttttcag

SEQ ID NO: 2503693 - DNA, 19 bp, Homo sapiens
ttttcagatataaaagact

SEQ ID NO: 2503694 - DNA, 12 bp, Homo sapiens
ttttcagttttc

SEQ ID NO: 2503695 - DNA, 21 bp, Homo sapiens
ttttgtgaagtttaattgact

SEQ ID NO: 2503696 - DNA, 19 bp, Homo sapiens
ttttgtttcatattgatgt

SEQ ID NO: 2503697 - DNA, 12 bp, Homo sapiens
tttttaaagaaa

SEQ ID NO: 2503698 - DNA, 15 bp, Homo sapiens
tttttcagttttcag

SEQ ID NO: 2503699 - DNA, 20 bp, Homo sapiens
aatcacgtaaagctagaaat

SEQ ID NO: 2503700 - DNA, 21 bp, Homo sapiens
aatcctggggaacatagaact

SEQ ID NO: 2503701 - DNA, 13 bp, Homo sapiens
aatgacacagtct

SEQ ID NO: 2503702 - DNA, 16 bp, Homo sapiens
aatgatccccagctgt

SEQ ID NO: 2503703 - DNA, 20 bp, Homo sapiens
aatgatccccagctgtttat

SEQ ID NO: 2503704 - DNA, 18 bp, Homo sapiens
aatgctggtttttcagtt

SEQ ID NO: 2503705 - DNA, 12 bp, Homo sapiens
aatgtttccttt

SEQ ID NO: 2503706 - DNA, 19 bp, Homo sapiens
aattatgagttatttttat

SEQ ID NO: 2503707 - DNA, 21 bp, Homo sapiens
aattgacttatttatataaat

SEQ ID NO: 2503708 - DNA, 21 bp, Homo sapiens
aatttccactcaggtctgttt

SEQ ID NO: 2503709 - DNA, 16 bp, Homo sapiens
aatttctctactgtct

SEQ ID NO: 2503710 - DNA, 18 bp, Homo sapiens
aatttttattaaattatg

SEQ ID NO: 2503711 - DNA, 24 bp, Homo sapiens
acaacttgcacgtattttaatagc

SEQ ID NO: 2503712 - DNA, 14 bp, Homo sapiens
acacatttttcaga

SEQ ID NO: 2503713 - DNA, 16 bp, Homo sapiens
acagaaaggttttctt

SEQ ID NO: 2503714 - DNA, 18 bp, Homo sapiens
acagtcttgtattaagtt

SEQ ID NO: 2503715 - DNA, 18 bp, Homo sapiens
acagtggaaccagcccag

SEQ ID NO: 2503716 - DNA, 17 bp, Homo sapiens
acagtgtacagtcttgt

SEQ ID NO: 2503717 - DNA, 18 bp, Homo sapiens
acagtgtacagtcttgta

SEQ ID NO: 2503718 - DNA, 15 bp, Homo sapiens
acagtttttattgct

SEQ ID NO: 2503719 - DNA, 14 bp, Homo sapiens
acatcatttcaatc

SEQ ID NO: 2503720 - DNA, 22 bp, Homo sapiens
acatcatttcaatcgtaaaatt

SEQ ID NO: 2503721 - DNA, 16 bp, Homo sapiens
acattgcaatagaaat

SEQ ID NO: 2503722 - DNA, 14 bp, Homo sapiens
accaatattgtaca

SEQ ID NO: 2503723 - DNA, 19 bp, Homo sapiens
accaatattgtacagtttt

SEQ ID NO: 2503724 - DNA, 15 bp, Homo sapiens
accagcccagaccct

SEQ ID NO: 2503725 - DNA, 17 bp, Homo sapiens
acgtaaagctagaaatg

SEQ ID NO: 2503726 - DNA, 19 bp, Homo sapiens
actagaactgaattttgtc

SEQ ID NO: 2503727 - DNA, 17 bp, Homo sapiens
actattgcttgcacaaa

SEQ ID NO: 2503728 - DNA, 18 bp, Homo sapiens
actatttttcagaatctc

SEQ ID NO: 2503729 - DNA, 17 bp, Homo sapiens
actcaagacttccagag

SEQ ID NO: 2503730 - DNA, 16 bp, Homo sapiens
actgaacattccagag

SEQ ID NO: 2503731 - DNA, 15 bp, Homo sapiens
actgaaccaggccag

SEQ ID NO: 2503732 - DNA, 16 bp, Homo sapiens
actgcatatgaaagga

SEQ ID NO: 2503733 - DNA, 23 bp, Homo sapiens
actgtagaaaagggaactgaaca

SEQ ID NO: 2503734 - DNA, 20 bp, Homo sapiens
agaaaagggaactgaacatt

SEQ ID NO: 2503735 - DNA, 21 bp, Homo sapiens
agaaatgctggtttttcagtt

SEQ ID NO: 2503736 - DNA, 18 bp, Homo sapiens
agaagagggaaaacagaa

SEQ ID NO: 2503737 - DNA, 15 bp, Homo sapiens
agaaggttgagggca

SEQ ID NO: 2503738 - DNA, 19 bp, Homo sapiens
agacctaacgagaaataga

SEQ ID NO: 2503739 - DNA, 17 bp, Homo sapiens
agacgtgattttgctgt

SEQ ID NO: 2503740 - DNA, 12 bp, Homo sapiens
agactgaccaat

SEQ ID NO: 2503741 - DNA, 15 bp, Homo sapiens
agagcaaacagaaaa

SEQ ID NO: 2503742 - DNA, 18 bp, Homo sapiens
agagggaaaacagaaaac

SEQ ID NO: 2503743 - DNA, 16 bp, Homo sapiens
agatcgttctctgcct

SEQ ID NO: 2503744 - DNA, 23 bp, Homo sapiens
agcccaaagtggtatagaaatgc

SEQ ID NO: 2503745 - DNA, 12 bp, Homo sapiens
agcctcatctct

SEQ ID NO: 2503746 - DNA, 17 bp, Homo sapiens
agctggagaaatatggt

SEQ ID NO: 2503747 - DNA, 13 bp, Homo sapiens
agctgtttatgca

SEQ ID NO: 2503748 - DNA, 21 bp, Homo sapiens
aggacctgtggccaagttctt

SEQ ID NO: 2503749 - DNA, 13 bp, Homo sapiens
aggccaaaaaaat

SEQ ID NO: 2503750 - DNA, 21 bp, Homo sapiens
aggccagagcaaacagaaaaa

SEQ ID NO: 2503751 - DNA, 14 bp, Homo sapiens
agggcaatggacaa

SEQ ID NO: 2503752 - DNA, 17 bp, Homo sapiens
agtagctggattacagg

SEQ ID NO: 2503753 - DNA, 18 bp, Homo sapiens
cctccaagtccacagtgg

SEQ ID NO: 2503754 - DNA, 14 bp, Homo sapiens
cctggaccaggccc

SEQ ID NO: 2503755 - DNA, 15 bp, Homo sapiens
cctgtgcctctggga

SEQ ID NO: 2503756 - DNA, 19 bp, Homo sapiens
cctgtgcctctgggactgg

SEQ ID NO: 2503757 - DNA, 20 bp, Homo sapiens
ccttctgaaaaagtatcctg

SEQ ID NO: 2503758 - DNA, 19 bp, Homo sapiens
cgctctgttgcccaggctg

SEQ ID NO: 2503759 - DNA, 17 bp, Homo sapiens
cgtaaagctagaaatga

SEQ ID NO: 2503760 - DNA, 15 bp, Homo sapiens
cgtggaacgtttttc

SEQ ID NO: 2503761 - DNA, 16 bp, Homo sapiens
ctaatgtactgcatat

SEQ ID NO: 2503762 - DNA, 15 bp, Homo sapiens
ctacagtgtacagtc

SEQ ID NO: 2503763 - DNA, 17 bp, Homo sapiens
ctacagtgtacagtctt

SEQ ID NO: 2503764 - DNA, 22 bp, Homo sapiens
ctagaagattttgaaattttta

SEQ ID NO: 2503765 - DNA, 22 bp, Homo sapiens
ctagccatggcaggacagctcc

SEQ ID NO: 2503766 - DNA, 21 bp, Homo sapiens
ctagcctgtgcctctgggact

SEQ ID NO: 2503767 - DNA, 15 bp, Homo sapiens
ctaggcaggacctgt

SEQ ID NO: 2503768 - DNA, 13 bp, Homo sapiens
ctcattaaaaaaa

SEQ ID NO: 2503769 - DNA, 22 bp, Homo sapiens
ctccaagtccacagtggaacca

SEQ ID NO: 2503770 - DNA, 17 bp, Homo sapiens
ctcctggaccaggccca

SEQ ID NO: 2503771 - DNA, 13 bp, Homo sapiens
ctccttagaagtg

SEQ ID NO: 2503772 - DNA, 17 bp, Homo sapiens
ctccttagaagtggaag

SEQ ID NO: 2503773 - DNA, 15 bp, Homo sapiens
ctcgtggtaggactg

SEQ ID NO: 2503774 - DNA, 20 bp, Homo sapiens
ctctttgttctaaagatgga

SEQ ID NO: 2503775 - DNA, 19 bp, Homo sapiens
ctgaccaatattgtacagt

SEQ ID NO: 2503776 - DNA, 19 bp, Homo sapiens
ctgagtagctggattacag

SEQ ID NO: 2503777 - DNA, 20 bp, Homo sapiens
ctgagtagctggattacagg

SEQ ID NO: 2503778 - DNA, 22 bp, Homo sapiens
ctgatgctggggacacagcatc

SEQ ID NO: 2503779 - DNA, 15 bp, Homo sapiens
ctgcactcagaaaat

SEQ ID NO: 2503780 - DNA, 15 bp, Homo sapiens
ctggtttttcagttt

SEQ ID NO: 2503781 - DNA, 18 bp, Homo sapiens
ctgtggccaagttcttag

SEQ ID NO: 2503782 - DNA, 17 bp, Homo sapiens
cttacaagccagctgga

SEQ ID NO: 2503783 - DNA, 23 bp, Homo sapiens
cttgtattaagttgttaataaaa

SEQ ID NO: 2503784 - DNA, 21 bp, Homo sapiens
cttgttggatttttgtcttgt

SEQ ID NO: 2503785 - DNA, 23 bp, Homo sapiens
cttgttggatttttgtcttgtgt

SEQ ID NO: 2503786 - DNA, 13 bp, Homo sapiens
ctttagtttttgt

SEQ ID NO: 2503787 - DNA, 17 bp, Homo sapiens
ctttattaaatgtagaa

SEQ ID NO: 2503788 - DNA, 15 bp, Homo sapiens
ctttggtgaacattg

SEQ ID NO: 2503789 - DNA, 17 bp, Homo sapiens
cttttcaatgtctaaaa

SEQ ID NO: 2503790 - DNA, 22 bp, Homo sapiens
ctttttttttttttaaagacag

SEQ ID NO: 2503791 - DNA, 9 bp, Homo sapiens
gaaaacaga

SEQ ID NO: 2503792 - DNA, 19 bp, Homo sapiens
gaaaagttttgtaaatttc

SEQ ID NO: 2503793 - DNA, 19 bp, Homo sapiens
gaaatttttattaaattat

SEQ ID NO: 2503794 - DNA, 23 bp, Homo sapiens
gaaccaggccagagcaaacagaa

SEQ ID NO: 2503795 - DNA, 15 bp, Homo sapiens
gaacgtttttcctgt

SEQ ID NO: 2503796 - DNA, 19 bp, Homo sapiens
gaagagggaaaacagaaaa

SEQ ID NO: 2503797 - DNA, 16 bp, Homo sapiens
gacacagcatcagctc

SEQ ID NO: 2503798 - DNA, 18 bp, Homo sapiens
gaccaatattgtacagtt

SEQ ID NO: 2503799 - DNA, 21 bp, Homo sapiens
gaccaatattgtacagttttt

SEQ ID NO: 2503800 - DNA, 19 bp, Homo sapiens
gacctgtggccaagttctt

SEQ ID NO: 2503801 - DNA, 17 bp, Homo sapiens
gacgtgattttgctgta

SEQ ID NO: 2503802 - DNA, 21 bp, Homo sapiens
gactgaccaatattgtacagt

SEQ ID NO: 2503803 - DNA, 15 bp, Homo sapiens
gagcaaacagaaaaa

SEQ ID NO: 2503804 - DNA, 14 bp, Homo sapiens
gagggaaaacagaa

SEQ ID NO: 2503805 - DNA, 17 bp, Homo sapiens
gagggaaaacagaaaac

SEQ ID NO: 2503806 - DNA, 12 bp, Homo sapiens
gagtagctggat

SEQ ID NO: 2503807 - DNA, 15 bp, Homo sapiens
gagtgggttgatttc

SEQ ID NO: 2503808 - DNA, 16 bp, Homo sapiens
gataaataactttttt

SEQ ID NO: 2503809 - DNA, 18 bp, Homo sapiens
gattacagggatgagcca

SEQ ID NO: 2503810 - DNA, 21 bp, Homo sapiens
gattttgaaatttttattaaa

SEQ ID NO: 2503811 - DNA, 18 bp, Homo sapiens
gcacctacagtgtacagt

SEQ ID NO: 2503812 - DNA, 21 bp, Homo sapiens
gcacctacagtgtacagtctt

SEQ ID NO: 2503813 - DNA, 14 bp, Homo sapiens
gcaggacagctcct

SEQ ID NO: 2503814 - DNA, 20 bp, Homo sapiens
gcaggacagctcctggacca

SEQ ID NO: 2503815 - DNA, 20 bp, Homo sapiens
attaagttgttaataaaagt

SEQ ID NO: 2503816 - DNA, 18 bp, Homo sapiens
attctcctgcctcagcct

SEQ ID NO: 2503817 - DNA, 17 bp, Homo sapiens
attctgcactcagaaaa

SEQ ID NO: 2503818 - DNA, 13 bp, Homo sapiens
attgtacagtttt

SEQ ID NO: 2503819 - DNA, 21 bp, Homo sapiens
attgtacagtttttattgctt

SEQ ID NO: 2503820 - DNA, 15 bp, Homo sapiens
atttatataaatttt

SEQ ID NO: 2503821 - DNA, 14 bp, Homo sapiens
atttatttaaattt

SEQ ID NO: 2503822 - DNA, 15 bp, Homo sapiens
atttcagatttgtga

SEQ ID NO: 2503823 - DNA, 16 bp, Homo sapiens
atttccactcaggtct

SEQ ID NO: 2503824 - DNA, 22 bp, Homo sapiens
atttccactcaggtctgttttc

SEQ ID NO: 2503825 - DNA, 15 bp, Homo sapiens
atttgtcaacaaagt

SEQ ID NO: 2503826 - DNA, 17 bp, Homo sapiens
attttactttttcctgg

SEQ ID NO: 2503827 - DNA, 12 bp, Homo sapiens
attttgtcttta

SEQ ID NO: 2503828 - DNA, 14 bp, Homo sapiens
atttttgtcttgtg

SEQ ID NO: 2503829 - DNA, 12 bp, Homo sapiens
caaacagaaaaa

SEQ ID NO: 2503830 - DNA, 12 bp, Homo sapiens
caaagaaatttc

SEQ ID NO: 2503831 - DNA, 18 bp, Homo sapiens
caaagaaatttccactca

SEQ ID NO: 2503832 - DNA, 19 bp, Homo sapiens
caaagtgctgggattacag

SEQ ID NO: 2503833 - DNA, 22 bp, Homo sapiens
caaatgagaaaatgtctttatt

SEQ ID NO: 2503834 - DNA, 14 bp, Homo sapiens
caagccagctggag

SEQ ID NO: 2503835 - DNA, 16 bp, Homo sapiens
caatattgtacagttt

SEQ ID NO: 2503836 - DNA, 12 bp, Homo sapiens
caggacagctcc

SEQ ID NO: 2503837 - DNA, 22 bp, Homo sapiens
caggccagagcaaacagaaaaa

SEQ ID NO: 2503838 - DNA, 12 bp, Homo sapiens
cagtgtacagtc

SEQ ID NO: 2503839 - DNA, 15 bp, Homo sapiens
cagtttttattgctt

SEQ ID NO: 2503840 - DNA, 14 bp, Homo sapiens
cattgcaatagaaa

SEQ ID NO: 2503841 - DNA, 22 bp, Homo sapiens
catttacccttcttttctgact

SEQ ID NO: 2503842 - DNA, 22 bp, Homo sapiens
cattttactttttcctggctca

SEQ ID NO: 2503843 - DNA, 19 bp, Homo sapiens
ccaaagtggtatagaaatg

SEQ ID NO: 2503844 - DNA, 17 bp, Homo sapiens
ccaaattttctttttat

SEQ ID NO: 2503845 - DNA, 14 bp, Homo sapiens
ccaatattgtacag

SEQ ID NO: 2503846 - DNA, 15 bp, Homo sapiens
ccaatattgtacagt

SEQ ID NO: 2503847 - DNA, 16 bp, Homo sapiens
ccaatattgtacagtt

SEQ ID NO: 2503848 - DNA, 18 bp, Homo sapiens
ccagagcaaacagaaaaa

SEQ ID NO: 2503849 - DNA, 21 bp, Homo sapiens
cccaaagtggtatagaaatgc

SEQ ID NO: 2503850 - DNA, 23 bp, Homo sapiens
ccctccattctgcactcagaaaa

SEQ ID NO: 2503851 - DNA, 11 bp, Homo sapiens
cccttcttttt

SEQ ID NO: 2503852 - DNA, 15 bp, Homo sapiens
cctcagcctcctgag

SEQ ID NO: 2503853 - DNA, 21 bp, Homo sapiens
cctccaagtccacagtggaac

SEQ ID NO: 2503854 - DNA, 21 bp, Homo sapiens
cctcgaggtttctcaaagaaa

SEQ ID NO: 2503855 - DNA, 24 bp, Homo sapiens
cctgatgctggggacacagcatca

SEQ ID NO: 2503856 - DNA, 17 bp, Homo sapiens
cgactgccatcttggac

SEQ ID NO: 2503857 - DNA, 21 bp, Homo sapiens
cgaggtttctcaaagaaattt

SEQ ID NO: 2503858 - DNA, 17 bp, Homo sapiens
cggctctggcctccaag

SEQ ID NO: 2503859 - DNA, 14 bp, Homo sapiens
cgtcataactagaa

SEQ ID NO: 2503860 - DNA, 20 bp, Homo sapiens
cgtggaacgtttttcctgtt

SEQ ID NO: 2503861 - DNA, 12 bp, Homo sapiens
cgttctctgcct

SEQ ID NO: 2503862 - DNA, 22 bp, Homo sapiens
ctaagaaagcccttaggaagaa

SEQ ID NO: 2503863 - DNA, 23 bp, Homo sapiens
ctaagcacgggccatatgaataa

SEQ ID NO: 2503864 - DNA, 16 bp, Homo sapiens
ctacagtgtacagtct

SEQ ID NO: 2503865 - DNA, 19 bp, Homo sapiens
ctagcctgtgcctctggga

SEQ ID NO: 2503866 - DNA, 16 bp, Homo sapiens
ctaggcaggacctgtg

SEQ ID NO: 2503867 - DNA, 14 bp, Homo sapiens
ctatttttcagaat

SEQ ID NO: 2503868 - DNA, 13 bp, Homo sapiens
ctcaaactcctga

SEQ ID NO: 2503869 - DNA, 22 bp, Homo sapiens
ctcaaagaaatttccactcagg

SEQ ID NO: 2503870 - DNA, 20 bp, Homo sapiens
ctcacatagcttacaagcca

SEQ ID NO: 2503871 - DNA, 24 bp, Homo sapiens
ctccattcccgtggaacgtttttc

SEQ ID NO: 2503872 - DNA, 22 bp, Homo sapiens
ctcctagcctgtgcctctggga

SEQ ID NO: 2503873 - DNA, 17 bp, Homo sapiens
ctcgaggtttctcaaag

SEQ ID NO: 2503874 - DNA, 16 bp, Homo sapiens
ctcgtggtaggactgt

SEQ ID NO: 2503875 - DNA, 17 bp, Homo sapiens
ctcgtggtaggactgta

SEQ ID NO: 2503876 - DNA, 14 bp, Homo sapiens
ctgaaccaggccag

SEQ ID NO: 2503877 - DNA, 14 bp, Homo sapiens
ctgcaacttctgcc

SEQ ID NO: 2503878 - DNA, 15 bp, Homo sapiens
ctgcaacttctgcct

SEQ ID NO: 2503879 - DNA, 15 bp, Homo sapiens
ctggaccaggcccat

SEQ ID NO: 2503880 - DNA, 19 bp, Homo sapiens
ctggcagtggaactaagaa

SEQ ID NO: 2503881 - DNA, 20 bp, Homo sapiens
ctgtatgtctcgtggtagga

SEQ ID NO: 2503882 - DNA, 17 bp, Homo sapiens
ctgtgcctctgggactg

SEQ ID NO: 2503883 - DNA, 18 bp, Homo sapiens
ctgtgcctctgggactgg

SEQ ID NO: 2503884 - DNA, 16 bp, Homo sapiens
cttacaagccagctgg

SEQ ID NO: 2503885 - DNA, 16 bp, Homo sapiens
cttagaagtggaagta

SEQ ID NO: 2503886 - DNA, 15 bp, Homo sapiens
cttaggaagaatttt

SEQ ID NO: 2503887 - DNA, 24 bp, Homo sapiens
cttggctcactgcaacttctgcct

SEQ ID NO: 2503888 - DNA, 15 bp, Homo sapiens
ctttctgcagaaaca

SEQ ID NO: 2503889 - DNA, 18 bp, Homo sapiens
ctttgttctaaagatgga

SEQ ID NO: 2503890 - DNA, 18 bp, Homo sapiens
cttttaggccaaaaaaat

SEQ ID NO: 2503891 - DNA, 20 bp, Homo sapiens
cttttcaatgtctaaaaaca

SEQ ID NO: 2503892 - DNA, 23 bp, Homo sapiens
ctttttttttttttaaagacaga

SEQ ID NO: 2503893 - DNA, 12 bp, Homo sapiens
gaaaacagaaaa

SEQ ID NO: 2503894 - DNA, 18 bp, Homo sapiens
gaaaagggaactgaacat

SEQ ID NO: 2503895 - DNA, 18 bp, Homo sapiens
gaaatttttattaaatta

SEQ ID NO: 2503896 - DNA, 15 bp, Homo sapiens
gaacattgcaataga

SEQ ID NO: 2503897 - DNA, 17 bp, Homo sapiens
gaacattgcaatagaaa

SEQ ID NO: 2503898 - DNA, 12 bp, Homo sapiens
gaaccaggccag

SEQ ID NO: 2503899 - DNA, 20 bp, Homo sapiens
gaagagggaaaacagaaaac

SEQ ID NO: 2503900 - DNA, 23 bp, Homo sapiens
gaagattttgaaatttttattaa

SEQ ID NO: 2503901 - DNA, 17 bp, Homo sapiens
gacacagcatcagctca

SEQ ID NO: 2503902 - DNA, 18 bp, Homo sapiens
gacacagcatcagctcaa

SEQ ID NO: 2503903 - DNA, 16 bp, Homo sapiens
gacactagaagatttt

SEQ ID NO: 2503904 - DNA, 19 bp, Homo sapiens
gacgtcaccctccattctg

SEQ ID NO: 2503905 - DNA, 16 bp, Homo sapiens
gacgtgattttgctgt

SEQ ID NO: 2503906 - DNA, 11 bp, Homo sapiens
gactgtagaaa

SEQ ID NO: 2503907 - DNA, 20 bp, Homo sapiens
gagaagagggaaaacagaaa

SEQ ID NO: 2503908 - DNA, 14 bp, Homo sapiens
gagcaaacagaaaa

SEQ ID NO: 2503909 - DNA, 18 bp, Homo sapiens
gagccaccgcgcccagcc

SEQ ID NO: 2503910 - DNA, 17 bp, Homo sapiens
gatacgacaacttgcac

SEQ ID NO: 2503911 - DNA, 18 bp, Homo sapiens
gatatgcagttttcctta

SEQ ID NO: 2503912 - DNA, 16 bp, Homo sapiens
gatgaaacatcatttc

SEQ ID NO: 2503913 - DNA, 22 bp, Homo sapiens
gatggaaaaaccacccccaaat

SEQ ID NO: 2503914 - DNA, 21 bp, Homo sapiens
gatggcacttataaccaaagc

SEQ ID NO: 2503915 - DNA, 18 bp, Homo sapiens
gatgtaaaagactttttt

SEQ ID NO: 2503916 - DNA, 18 bp, Homo sapiens
gattacaggcatgtgcca

SEQ ID NO: 2503917 - DNA, 18 bp, Homo sapiens
gattctcctgcctcagcc

SEQ ID NO: 2503918 - DNA, 16 bp, Homo sapiens
gattttgctgtagaag

SEQ ID NO: 2503919 - DNA, 14 bp, Homo sapiens
gcaaacagaaaaag

SEQ ID NO: 2503920 - DNA, 13 bp, Homo sapiens
gcactcagaaaat

SEQ ID NO: 2503921 - DNA, 14 bp, Homo sapiens
gcactcagaaaatg

SEQ ID NO: 2503922 - DNA, 15 bp, Homo sapiens
gcccaggctggagtg

SEQ ID NO: 2503923 - DNA, 15 bp, Homo sapiens
gcccctgctctggtg

SEQ ID NO: 2503924 - DNA, 18 bp, Homo sapiens
gcctcagcctcctgagta

SEQ ID NO: 2503925 - DNA, 19 bp, Homo sapiens
gcctgtgcctctgggactg

SEQ ID NO: 2503926 - DNA, 17 bp, Homo sapiens
gctgggattacagggat

SEQ ID NO: 2503927 - DNA, 19 bp, Homo sapiens
gctggtctcaaactcctga

SEQ ID NO: 2503928 - DNA, 19 bp, Homo sapiens
ggaaaaaccacccccaaat

SEQ ID NO: 2503929 - DNA, 13 bp, Homo sapiens
ggaaaacagaaaa

SEQ ID NO: 2503930 - DNA, 14 bp, Homo sapiens
ggaaaataaattat

SEQ ID NO: 2503931 - DNA, 17 bp, Homo sapiens
ggaactgaacattccag

SEQ ID NO: 2503932 - DNA, 23 bp, Homo sapiens
ggaaggaataaagggagaagagg

SEQ ID NO: 2503933 - DNA, 18 bp, Homo sapiens
ggacacagcatcagctca

SEQ ID NO: 2503934 - DNA, 14 bp, Homo sapiens
ggatttttgtcttg

SEQ ID NO: 2503935 - DNA, 16 bp, Homo sapiens
ggatttttgtcttgtg

SEQ ID NO: 2503936 - DNA, 15 bp, Homo sapiens
ggcaggacagctcct

SEQ ID NO: 2503937 - DNA, 23 bp, Homo sapiens
ggcctccaagtccacagtggaac

SEQ ID NO: 2503938 - DNA, 13 bp, Homo sapiens
ggcctcccaaagt

SEQ ID NO: 2503939 - DNA, 18 bp, Homo sapiens
ggtctataagatgaaaca

SEQ ID NO: 2503940 - DNA, 22 bp, Homo sapiens
ggtctttaaccacttttcaatg

SEQ ID NO: 2503941 - DNA, 14 bp, Homo sapiens
ggtgaacattgcaa

SEQ ID NO: 2503942 - DNA, 15 bp, Homo sapiens
gtaatccacctgcct

SEQ ID NO: 2503943 - DNA, 12 bp, Homo sapiens
gtacagttttta

SEQ ID NO: 2503944 - DNA, 20 bp, Homo sapiens
gtagaaaagggaactgaaca

SEQ ID NO: 2503945 - DNA, 15 bp, Homo sapiens
gtaggactgtagaaa

SEQ ID NO: 2503946 - DNA, 22 bp, Homo sapiens
gtatatttgtatttaaatgaaa

SEQ ID NO: 2503947 - DNA, 17 bp, Homo sapiens
gtcataactagaactga

SEQ ID NO: 2503948 - DNA, 19 bp, Homo sapiens
gtgaagtttaattgactta

SEQ ID NO: 2503949 - DNA, 16 bp, Homo sapiens
gtgattttgctgtaga

SEQ ID NO: 2503950 - DNA, 13 bp, Homo sapiens
gtgcctctgggac

SEQ ID NO: 2503951 - DNA, 15 bp, Homo sapiens
gtgcctctgggactg

SEQ ID NO: 2503952 - DNA, 11 bp, Homo sapiens
aaaacagaaaa

SEQ ID NO: 2503953 - DNA, 15 bp, Homo sapiens
aaaatctgctaggga

SEQ ID NO: 2503954 - DNA, 11 bp, Homo sapiens
aaacagaaaaa

SEQ ID NO: 2503955 - DNA, 11 bp, Homo sapiens
aaacagaaaac

SEQ ID NO: 2503956 - DNA, 19 bp, Homo sapiens
aaagactgaccaatattgt

SEQ ID NO: 2503957 - DNA, 15 bp, Homo sapiens
aaagcccaaagtggt

SEQ ID NO: 2503958 - DNA, 16 bp, Homo sapiens
aaagggaactgaacat

SEQ ID NO: 2503959 - DNA, 11 bp, Homo sapiens
aaataaattat

SEQ ID NO: 2503960 - DNA, 23 bp, Homo sapiens
aaatgatccccagctgtttatgc

SEQ ID NO: 2503961 - DNA, 14 bp, Homo sapiens
aaatttccactcag

SEQ ID NO: 2503962 - DNA, 15 bp, Homo sapiens
aacatcatttcaatc

SEQ ID NO: 2503963 - DNA, 17 bp, Homo sapiens
aacattgcaatagaaat

SEQ ID NO: 2503964 - DNA, 21 bp, Homo sapiens
aacctgatgctggggacacag

SEQ ID NO: 2503965 - DNA, 17 bp, Homo sapiens
aacgtttttcctgttct

SEQ ID NO: 2503966 - DNA, 22 bp, Homo sapiens
aacttctcccctggtagaaaga

SEQ ID NO: 2503967 - DNA, 14 bp, Homo sapiens
aacttttttttaag

SEQ ID NO: 2503968 - DNA, 20 bp, Homo sapiens
aacttttttttaagttacac

SEQ ID NO: 2503969 - DNA, 16 bp, Homo sapiens
aagaaaagttttgtaa

SEQ ID NO: 2503970 - DNA, 17 bp, Homo sapiens
aagatcgttctctgcct

SEQ ID NO: 2503971 - DNA, 23 bp, Homo sapiens
aagatggcacttataaccaaagc

SEQ ID NO: 2503972 - DNA, 15 bp, Homo sapiens
aagcaagatttcaga

SEQ ID NO: 2503973 - DNA, 16 bp, Homo sapiens
aagcaagatttcagat

SEQ ID NO: 2503974 - DNA, 13 bp, Homo sapiens
aaggacactagaa

SEQ ID NO: 2503975 - DNA, 15 bp, Homo sapiens
aagtagtggagcccc

SEQ ID NO: 2503976 - DNA, 14 bp, Homo sapiens
aagtccacagtgga

SEQ ID NO: 2503977 - DNA, 17 bp, Homo sapiens
aagtggtatagaaatgc

SEQ ID NO: 2503978 - DNA, 15 bp, Homo sapiens
aagttgttaataaaa

SEQ ID NO: 2503979 - DNA, 12 bp, Homo sapiens
aataaagacagg

SEQ ID NO: 2503980 - DNA, 17 bp, Homo sapiens
aatagaaatggggaact

SEQ ID NO: 2503981 - DNA, 12 bp, Homo sapiens
aatattccagag

SEQ ID NO: 2503982 - DNA, 17 bp, Homo sapiens
gccagagcaaacagaaa

SEQ ID NO: 2503983 - DNA, 18 bp, Homo sapiens
gccagagcaaacagaaaa

SEQ ID NO: 2503984 - DNA, 19 bp, Homo sapiens
gccagagcaaacagaaaaa

SEQ ID NO: 2503985 - DNA, 13 bp, Homo sapiens
gccagctggagaa

SEQ ID NO: 2503986 - DNA, 19 bp, Homo sapiens
gccatggcaggacagctcc

SEQ ID NO: 2503987 - DNA, 12 bp, Homo sapiens
gccggggtggat

SEQ ID NO: 2503988 - DNA, 16 bp, Homo sapiens
gcctcagcctcctgag

SEQ ID NO: 2503989 - DNA, 16 bp, Homo sapiens
gcctgtgcctctggga

SEQ ID NO: 2503990 - DNA, 11 bp, Homo sapiens
gctagaaatga

SEQ ID NO: 2503991 - DNA, 17 bp, Homo sapiens
gctctggcctccaagtc

SEQ ID NO: 2503992 - DNA, 14 bp, Homo sapiens
gctggtttttcagt

SEQ ID NO: 2503993 - DNA, 22 bp, Homo sapiens
gcttacaagccagctggagaaa

SEQ ID NO: 2503994 - DNA, 14 bp, Homo sapiens
ggaaaacagaaaac

SEQ ID NO: 2503995 - DNA, 18 bp, Homo sapiens
ggagaagagggaaaacag

SEQ ID NO: 2503996 - DNA, 20 bp, Homo sapiens
ggatatgttatactgaacca

SEQ ID NO: 2503997 - DNA, 10 bp, Homo sapiens
gggaaaacag

SEQ ID NO: 2503998 - DNA, 13 bp, Homo sapiens
ggtatagaaatgc

SEQ ID NO: 2503999 - DNA, 17 bp, Homo sapiens
ggtctcaaactcctgac

SEQ ID NO: 2504000 - DNA, 19 bp, Homo sapiens
gtaagatcgttctctgcct

SEQ ID NO: 2504001 - DNA, 15 bp, Homo sapiens
gtatagaaatgctgg

SEQ ID NO: 2504002 - DNA, 23 bp, Homo sapiens
gtatagaaatgctggtttttcag

SEQ ID NO: 2504003 - DNA, 13 bp, Homo sapiens
gtcataactagaa

SEQ ID NO: 2504004 - DNA, 19 bp, Homo sapiens
gtccacagtggaaccagcc

SEQ ID NO: 2504005 - DNA, 13 bp, Homo sapiens
gtctcgtggtagg

SEQ ID NO: 2504006 - DNA, 16 bp, Homo sapiens
gtctttggtgaacatt

SEQ ID NO: 2504007 - DNA, 13 bp, Homo sapiens
gtgattctcctgc

SEQ ID NO: 2504008 - DNA, 13 bp, Homo sapiens
gtgtacagtcttg

SEQ ID NO: 2504009 - DNA, 12 bp, Homo sapiens
gttaataaaagt

SEQ ID NO: 2504010 - DNA, 16 bp, Homo sapiens
gttacacatttttcag

SEQ ID NO: 2504011 - DNA, 19 bp, Homo sapiens
gttatactgaaccaggcca

SEQ ID NO: 2504012 - DNA, 20 bp, Homo sapiens
gttatactgaaccaggccag

SEQ ID NO: 2504013 - DNA, 23 bp, Homo sapiens
gttatttttatttatttaaattt

SEQ ID NO: 2504014 - DNA, 17 bp, Homo sapiens
gttctaaagatggaaaa

SEQ ID NO: 2504015 - DNA, 23 bp, Homo sapiens
gttgatttcagcacctacagtgt

SEQ ID NO: 2504016 - DNA, 14 bp, Homo sapiens
gttggatttttgtc

SEQ ID NO: 2504017 - DNA, 20 bp, Homo sapiens
gttggatttttgtcttgtgt

SEQ ID NO: 2504018 - DNA, 18 bp, Homo sapiens
gtttctcaaagaaatttc

SEQ ID NO: 2504019 - DNA, 16 bp, Homo sapiens
gtttctttagtttttg

SEQ ID NO: 2504020 - DNA, 14 bp, Homo sapiens
gtttttcagttttc

SEQ ID NO: 2504021 - DNA, 13 bp, Homo sapiens
taaataacttttt

SEQ ID NO: 2504022 - DNA, 14 bp, Homo sapiens
taactagaactgaa

SEQ ID NO: 2504023 - DNA, 18 bp, Homo sapiens
taagatcgttctctgcct

SEQ ID NO: 2504024 - DNA, 14 bp, Homo sapiens
taagatgaaacatc

SEQ ID NO: 2504025 - DNA, 19 bp, Homo sapiens
taagatgaaacatcatttc

SEQ ID NO: 2504026 - DNA, 21 bp, Homo sapiens
taatagcgtcataactagaac

SEQ ID NO: 2504027 - DNA, 22 bp, Homo sapiens
taatttttgtgtttttaataaa

SEQ ID NO: 2504028 - DNA, 21 bp, Homo sapiens
tacacatttttcagatataaa

SEQ ID NO: 2504029 - DNA, 13 bp, Homo sapiens
tacagtgtacagt

SEQ ID NO: 2504030 - DNA, 14 bp, Homo sapiens
tacgacaacttgca

SEQ ID NO: 2504031 - DNA, 17 bp, Homo sapiens
tactgcatatgaaagga

SEQ ID NO: 2504032 - DNA, 21 bp, Homo sapiens
tagcttacaagccagctggag

SEQ ID NO: 2504033 - DNA, 14 bp, Homo sapiens
taggactgtagaaa

SEQ ID NO: 2504034 - DNA, 14 bp, Homo sapiens
taggcaggacctgt

SEQ ID NO: 2504035 - DNA, 21 bp, Homo sapiens
tataaattttttttgtttcat

SEQ ID NO: 2504036 - DNA, 16 bp, Homo sapiens
tatactgaaccaggcc

SEQ ID NO: 2504037 - DNA, 17 bp, Homo sapiens
tatactgaaccaggcca

SEQ ID NO: 2504038 - DNA, 21 bp, Homo sapiens
tatgtctcgtggtaggactgt

SEQ ID NO: 2504039 - DNA, 15 bp, Homo sapiens
tattaagttgttaat

SEQ ID NO: 2504040 - DNA, 22 bp, Homo sapiens
tattgcagcgattaataacagg

SEQ ID NO: 2504041 - DNA, 15 bp, Homo sapiens
tattgcttgcacaaa

SEQ ID NO: 2504042 - DNA, 21 bp, Homo sapiens
tattgcttgcacaaaccaatt

SEQ ID NO: 2504043 - DNA, 12 bp, Homo sapiens
tattgtacagtt

SEQ ID NO: 2504044 - DNA, 14 bp, Homo sapiens
tattgtacagtttt

SEQ ID NO: 2504045 - DNA, 13 bp, Homo sapiens
tatttatataaat

SEQ ID NO: 2504046 - DNA, 14 bp, Homo sapiens
tatttatttaaatt

SEQ ID NO: 2504047 - DNA, 19 bp, Homo sapiens
tcaagtaatccacctgcct

SEQ ID NO: 2504048 - DNA, 18 bp, Homo sapiens
tcaatgtctaaaaacatt

SEQ ID NO: 2504049 - DNA, 15 bp, Homo sapiens
tcaccatgttggcca

SEQ ID NO: 2504050 - DNA, 18 bp, Homo sapiens
tcacgtaaagctagaaat

SEQ ID NO: 2504051 - DNA, 19 bp, Homo sapiens
tcacgtaaagctagaaatg

SEQ ID NO: 2504052 - DNA, 17 bp, Homo sapiens
tcagatataaaagactg

SEQ ID NO: 2504053 - DNA, 21 bp, Homo sapiens
tcagcacctacagtgtacagt

SEQ ID NO: 2504054 - DNA, 20 bp, Homo sapiens
tcagcctcctgagtagctgg

SEQ ID NO: 2504055 - DNA, 16 bp, Homo sapiens
tcagttttcaggagtg

SEQ ID NO: 2504056 - DNA, 14 bp, Homo sapiens
tccagagactggga

SEQ ID NO: 2504057 - DNA, 20 bp, Homo sapiens
tcccaaagtgctgggattac

SEQ ID NO: 2504058 - DNA, 19 bp, Homo sapiens
tcctgagtagctggattac

SEQ ID NO: 2504059 - DNA, 17 bp, Homo sapiens
tcctggaccaggcccat

SEQ ID NO: 2504060 - DNA, 14 bp, Homo sapiens
tctcaaactcctga

SEQ ID NO: 2504061 - DNA, 17 bp, Homo sapiens
tctcaaagaaatttcca

SEQ ID NO: 2504062 - DNA, 17 bp, Homo sapiens
tctcgctctgttgccca

SEQ ID NO: 2504063 - DNA, 17 bp, Homo sapiens
tctctttgttctaaaga

SEQ ID NO: 2504064 - DNA, 16 bp, Homo sapiens
tctgcactcagaaaat

SEQ ID NO: 2504065 - DNA, 16 bp, Homo sapiens
tcttgtattaagttgt

SEQ ID NO: 2504066 - DNA, 16 bp, Homo sapiens
tctttggtgaacattg

SEQ ID NO: 2504067 - DNA, 16 bp, Homo sapiens
tctttttatactatta

SEQ ID NO: 2504068 - DNA, 18 bp, Homo sapiens
tgaacattgcaatagaaa

SEQ ID NO: 2504069 - DNA, 14 bp, Homo sapiens
tgaaccaggccaga

SEQ ID NO: 2504070 - DNA, 21 bp, Homo sapiens
tgaaccaggccagagcaaaca

SEQ ID NO: 2504071 - DNA, 22 bp, Homo sapiens
tgacacagtcttggctcactgc

SEQ ID NO: 2504072 - DNA, 19 bp, Homo sapiens
tgactatttttcagaatct

SEQ ID NO: 2504073 - DNA, 13 bp, Homo sapiens
tgattctcctgcc

SEQ ID NO: 2504074 - DNA, 20 bp, Homo sapiens
tgatttcagcacctacagtg

SEQ ID NO: 2504075 - DNA, 17 bp, Homo sapiens
tgattttgctgtagaag

SEQ ID NO: 2504076 - DNA, 19 bp, Homo sapiens
tgattttgctgtagaagat

SEQ ID NO: 2504077 - DNA, 13 bp, Homo sapiens
tgcaacttctgcc

SEQ ID NO: 2504078 - DNA, 14 bp, Homo sapiens
tgcaacttctgcct

SEQ ID NO: 2504079 - DNA, 21 bp, Homo sapiens
tgcaatgacacagtcttggct

SEQ ID NO: 2504080 - DNA, 12 bp, Homo sapiens
tgcagttttcct

SEQ ID NO: 2504081 - DNA, 14 bp, Homo sapiens
tgcctctgggactg

SEQ ID NO: 2504082 - DNA, 11 bp, Homo sapiens
tgctggggaca

SEQ ID NO: 2504083 - DNA, 16 bp, Homo sapiens
tgctggtttttcagtt

SEQ ID NO: 2504084 - DNA, 21 bp, Homo sapiens
tgcttcaaaaacattcttaca

SEQ ID NO: 2504085 - DNA, 14 bp, Homo sapiens
tgcttgttggattt

SEQ ID NO: 2504086 - DNA, 16 bp, Homo sapiens
tggaaaataaattatt

SEQ ID NO: 2504087 - DNA, 17 bp, Homo sapiens
tggaagtagtggagccc

SEQ ID NO: 2504088 - DNA, 16 bp, Homo sapiens
tggcacttgggggact

SEQ ID NO: 2504089 - DNA, 20 bp, Homo sapiens
tggtggggctgccaggggag

SEQ ID NO: 2504090 - DNA, 19 bp, Homo sapiens
tgtaagatcgttctctgcc

SEQ ID NO: 2504091 - DNA, 14 bp, Homo sapiens
tgtacagtcttgta

SEQ ID NO: 2504092 - DNA, 21 bp, Homo sapiens
tgtacagtcttgtattaagtt

SEQ ID NO: 2504093 - DNA, 19 bp, Homo sapiens
tgtactgcatatgaaagga

SEQ ID NO: 2504094 - DNA, 18 bp, Homo sapiens
tgtagaaaagggaactga

SEQ ID NO: 2504095 - DNA, 22 bp, Homo sapiens
tgtagtgaatcacgtaaagcta

SEQ ID NO: 2504096 - DNA, 21 bp, Homo sapiens
tgtattaagttgttaataaaa

SEQ ID NO: 2504097 - DNA, 15 bp, Homo sapiens
tgtatttaaatgaaa

SEQ ID NO: 2504098 - DNA, 13 bp, Homo sapiens
tgttaataaaagt

SEQ ID NO: 2504099 - DNA, 16 bp, Homo sapiens
tgttcttaagacgtga

SEQ ID NO: 2504100 - DNA, 20 bp, Homo sapiens
tgttggatttttgtcttgtg

SEQ ID NO: 2504101 - DNA, 12 bp, Homo sapiens
ttaaagacagag

SEQ ID NO: 2504102 - DNA, 22 bp, Homo sapiens
ttaagttacacatttttcagat

SEQ ID NO: 2504103 - DNA, 14 bp, Homo sapiens
ttaataaagacagg

SEQ ID NO: 2504104 - DNA, 23 bp, Homo sapiens
ttacacatttttcagatataaaa

SEQ ID NO: 2504105 - DNA, 13 bp, Homo sapiens
ttagttgctgtat

SEQ ID NO: 2504106 - DNA, 18 bp, Homo sapiens
ttagtttttgtgaagttt

SEQ ID NO: 2504107 - DNA, 21 bp, Homo sapiens
ttagtttttgtgaagtttaat

SEQ ID NO: 2504108 - DNA, 20 bp, Homo sapiens
ttcaagtgattctcctgcct

SEQ ID NO: 2504109 - DNA, 19 bp, Homo sapiens
ttcagatataaaagactga

SEQ ID NO: 2504110 - DNA, 22 bp, Homo sapiens
ttcagcacctacagtgtacagt

SEQ ID NO: 2504111 - DNA, 23 bp, Homo sapiens
ttcagcacctacagtgtacagtc

SEQ ID NO: 2504112 - DNA, 15 bp, Homo sapiens
ttctaaagatggaaa

SEQ ID NO: 2504113 - DNA, 13 bp, Homo sapiens
ttctcaaagaaat

SEQ ID NO: 2504114 - DNA, 20 bp, Homo sapiens
ttctcaaagaaatttccact

SEQ ID NO: 2504115 - DNA, 23 bp, Homo sapiens
ttcttagttgctgtatgtctcgt

SEQ ID NO: 2504116 - DNA, 17 bp, Homo sapiens
ttcttctttttgcttca

SEQ ID NO: 2504117 - DNA, 21 bp, Homo sapiens
ttcttctttttgcttcaaaaa

SEQ ID NO: 2504118 - DNA, 16 bp, Homo sapiens
ttgatgtgtgtctagg

SEQ ID NO: 2504119 - DNA, 22 bp, Homo sapiens
ttgcaatagaaatccaattgga

SEQ ID NO: 2504120 - DNA, 18 bp, Homo sapiens
ttgcagcgattaataaca

SEQ ID NO: 2504121 - DNA, 14 bp, Homo sapiens
ttgtaaatttctct

SEQ ID NO: 2504122 - DNA, 21 bp, Homo sapiens
ttgttaataaaagtacatgtt

SEQ ID NO: 2504123 - DNA, 15 bp, Homo sapiens
tttaaagaaaagttt

SEQ ID NO: 2504124 - DNA, 21 bp, Homo sapiens
tttaatagcgtcataactaga

SEQ ID NO: 2504125 - DNA, 12 bp, Homo sapiens
aaaataaattat

SEQ ID NO: 2504126 - DNA, 18 bp, Homo sapiens
aaaatttcccattaaaga

SEQ ID NO: 2504127 - DNA, 22 bp, Homo sapiens
aaacctgatgctggggacacag

SEQ ID NO: 2504128 - DNA, 9 bp, Homo sapiens
aaagacaga

SEQ ID NO: 2504129 - DNA, 23 bp, Homo sapiens
aaagtgagactttgagggtgtat

SEQ ID NO: 2504130 - DNA, 22 bp, Homo sapiens
aaatgctggtttttcagttttc

SEQ ID NO: 2504131 - DNA, 22 bp, Homo sapiens
aaatgtaagatcgttctctgcc

SEQ ID NO: 2504132 - DNA, 17 bp, Homo sapiens
aaattttttttgtttca

SEQ ID NO: 2504133 - DNA, 13 bp, Homo sapiens
aacatcatttcaa

SEQ ID NO: 2504134 - DNA, 15 bp, Homo sapiens
aacattgcaatagaa

SEQ ID NO: 2504135 - DNA, 15 bp, Homo sapiens
aaccacttttcaatg

SEQ ID NO: 2504136 - DNA, 17 bp, Homo sapiens
aactagaactgaatttt

SEQ ID NO: 2504137 - DNA, 15 bp, Homo sapiens
aactgaacattccag

SEQ ID NO: 2504138 - DNA, 15 bp, Homo sapiens
aactgaattttgtct

SEQ ID NO: 2504139 - DNA, 14 bp, Homo sapiens
aacttacttagtgt

SEQ ID NO: 2504140 - DNA, 14 bp, Homo sapiens
aacttggaaatagt

SEQ ID NO: 2504141 - DNA, 22 bp, Homo sapiens
aagaaaagttttgtaaatttct

SEQ ID NO: 2504142 - DNA, 19 bp, Homo sapiens
aagaaagcccttaggaaga

SEQ ID NO: 2504143 - DNA, 12 bp, Homo sapiens
aagacagagtct

SEQ ID NO: 2504144 - DNA, 16 bp, Homo sapiens
aagacgtgattttgct

SEQ ID NO: 2504145 - DNA, 19 bp, Homo sapiens
aagagggaaaacagaaaac

SEQ ID NO: 2504146 - DNA, 19 bp, Homo sapiens
aagattttgaaatttttat

SEQ ID NO: 2504147 - DNA, 13 bp, Homo sapiens
aagctagaaatga

SEQ ID NO: 2504148 - DNA, 13 bp, Homo sapiens
aagtggtatagaa

SEQ ID NO: 2504149 - DNA, 17 bp, Homo sapiens
aagttacacatttttca

SEQ ID NO: 2504150 - DNA, 22 bp, Homo sapiens
aagttcttagttgctgtatgtc

SEQ ID NO: 2504151 - DNA, 13 bp, Homo sapiens
aatattgtacagt

SEQ ID NO: 2504152 - DNA, 23 bp, Homo sapiens
aatattgtacagtttttattgct

SEQ ID NO: 2504153 - DNA, 18 bp, Homo sapiens
aatccacctgcctcggcc

SEQ ID NO: 2504154 - DNA, 16 bp, Homo sapiens
aatctctccattcccg

SEQ ID NO: 2504155 - DNA, 17 bp, Homo sapiens
aatttttattaaattat

SEQ ID NO: 2504156 - DNA, 19 bp, Homo sapiens
acacagtcttggctcactg

SEQ ID NO: 2504157 - DNA, 13 bp, Homo sapiens
acagaaaaagaag

SEQ ID NO: 2504158 - DNA, 20 bp, Homo sapiens
acagatgtaaaagacttttt

SEQ ID NO: 2504159 - DNA, 14 bp, Homo sapiens
acagcatcagctca

SEQ ID NO: 2504160 - DNA, 16 bp, Homo sapiens
acagctcctggaccag

SEQ ID NO: 2504161 - DNA, 21 bp, Homo sapiens
acagctcctggaccaggccca

SEQ ID NO: 2504162 - DNA, 14 bp, Homo sapiens
acagtcttgtatta

SEQ ID NO: 2504163 - DNA, 22 bp, Homo sapiens
acagtcttgtattaagttgtta

SEQ ID NO: 2504164 - DNA, 15 bp, Homo sapiens
acattgcaatagaaa

SEQ ID NO: 2504165 - DNA, 18 bp, Homo sapiens
acattttactttttcctg

SEQ ID NO: 2504166 - DNA, 15 bp, Homo sapiens
accaatattgtacag

SEQ ID NO: 2504167 - DNA, 17 bp, Homo sapiens
accaatattgtacagtt

SEQ ID NO: 2504168 - DNA, 19 bp, Homo sapiens
accaggccagagcaaacag

SEQ ID NO: 2504169 - DNA, 18 bp, Homo sapiens
acctacagtgtacagtct

SEQ ID NO: 2504170 - DNA, 20 bp, Homo sapiens
acctacagtgtacagtcttg

SEQ ID NO: 2504171 - DNA, 13 bp, Homo sapiens
acctgatgctggg

SEQ ID NO: 2504172 - DNA, 18 bp, Homo sapiens
actagaactgaattttgt

SEQ ID NO: 2504173 - DNA, 14 bp, Homo sapiens
actatttttcagaa

SEQ ID NO: 2504174 - DNA, 14 bp, Homo sapiens
actgaaccaggcca

SEQ ID NO: 2504175 - DNA, 22 bp, Homo sapiens
actgatggctaatgtactgcat

SEQ ID NO: 2504176 - DNA, 12 bp, Homo sapiens
agaaaatggcac

SEQ ID NO: 2504177 - DNA, 23 bp, Homo sapiens
agaaaatggcacttgggggactg

SEQ ID NO: 2504178 - DNA, 15 bp, Homo sapiens
agaaagaagatgaat

SEQ ID NO: 2504179 - DNA, 20 bp, Homo sapiens
agaaatgctggtttttcagt

SEQ ID NO: 2504180 - DNA, 21 bp, Homo sapiens
agaactgaattttgtctttat

SEQ ID NO: 2504181 - DNA, 17 bp, Homo sapiens
agaagagggaaaacaga

SEQ ID NO: 2504182 - DNA, 18 bp, Homo sapiens
agaagatgaatgagcaaa

SEQ ID NO: 2504183 - DNA, 22 bp, Homo sapiens
agactgaccaatattgtacagt

SEQ ID NO: 2504184 - DNA, 15 bp, Homo sapiens
agacttccagagcct

SEQ ID NO: 2504185 - DNA, 16 bp, Homo sapiens
agagcaaacagaaaaa

SEQ ID NO: 2504186 - DNA, 21 bp, Homo sapiens
agcaaaaccaaatattccaga

SEQ ID NO: 2504187 - DNA, 16 bp, Homo sapiens
agcaaacagaaaaaga

SEQ ID NO: 2504188 - DNA, 14 bp, Homo sapiens
agcaagatttcaga

SEQ ID NO: 2504189 - DNA, 19 bp, Homo sapiens
agcacctacagtgtacagt

SEQ ID NO: 2504190 - DNA, 22 bp, Homo sapiens
agcacctacagtgtacagtctt

SEQ ID NO: 2504191 - DNA, 17 bp, Homo sapiens
agcctgtgcctctggga

SEQ ID NO: 2504192 - DNA, 18 bp, Homo sapiens
agcctgtgcctctgggac

SEQ ID NO: 2504193 - DNA, 21 bp, Homo sapiens
agcctgtgcctctgggactgg

SEQ ID NO: 2504194 - DNA, 11 bp, Homo sapiens
agctagaaatg

SEQ ID NO: 2504195 - DNA, 12 bp, Homo sapiens
agctagaaatga

SEQ ID NO: 2504196 - DNA, 20 bp, Homo sapiens
agctcctggaccaggcccat

SEQ ID NO: 2504197 - DNA, 15 bp, Homo sapiens
agcttacaagccagc

SEQ ID NO: 2504198 - DNA, 17 bp, Homo sapiens
agcttacaagccagctg

SEQ ID NO: 2504199 - DNA, 12 bp, Homo sapiens
aggacagctcct

SEQ ID NO: 2504200 - DNA, 19 bp, Homo sapiens
aggacagctcctggaccag

SEQ ID NO: 2504201 - DNA, 18 bp, Homo sapiens
aggagtgggttgatttca

SEQ ID NO: 2504202 - DNA, 14 bp, Homo sapiens
agggaaaacagaaa

SEQ ID NO: 2504203 - DNA, 16 bp, Homo sapiens
aggtttctcaaagaaa

SEQ ID NO: 2504204 - DNA, 19 bp, Homo sapiens
aggtttctcaaagaaattt

SEQ ID NO: 2504205 - DNA, 19 bp, Homo sapiens
agtctcgctctgttgccca

SEQ ID NO: 2504206 - DNA, 18 bp, Homo sapiens
agtcttgtattaagttgt

SEQ ID NO: 2504207 - DNA, 22 bp, Homo sapiens
agtcttgtattaagttgttaat

SEQ ID NO: 2504208 - DNA, 13 bp, Homo sapiens
agtcttttccatg

SEQ ID NO: 2504209 - DNA, 21 bp, Homo sapiens
agtgactgatggctaatgtac

SEQ ID NO: 2504210 - DNA, 19 bp, Homo sapiens
agtgattctcctgcctcag

SEQ ID NO: 2504211 - DNA, 14 bp, Homo sapiens
agtggtatagaaat

SEQ ID NO: 2504212 - DNA, 15 bp, Homo sapiens
agtggtatagaaatg

SEQ ID NO: 2504213 - DNA, 16 bp, Homo sapiens
agtggtatagaaatgc

SEQ ID NO: 2504214 - DNA, 15 bp, Homo sapiens
agtgtacagtcttgt

SEQ ID NO: 2504215 - DNA, 15 bp, Homo sapiens
agtttaattgactta

SEQ ID NO: 2504216 - DNA, 15 bp, Homo sapiens
agttttgtaaatttc

SEQ ID NO: 2504217 - DNA, 19 bp, Homo sapiens
ataactagaactgaatttt

SEQ ID NO: 2504218 - DNA, 18 bp, Homo sapiens
ataatctctccattcccg

SEQ ID NO: 2504219 - DNA, 20 bp, Homo sapiens
atagcgtcataactagaact

SEQ ID NO: 2504220 - DNA, 16 bp, Homo sapiens
atatgcagttttcctt

SEQ ID NO: 2504221 - DNA, 20 bp, Homo sapiens
atatttgtatttaaatgaaa

SEQ ID NO: 2504222 - DNA, 14 bp, Homo sapiens
atcacgtaaagcta

SEQ ID NO: 2504223 - DNA, 21 bp, Homo sapiens
atcacgtaaagctagaaatga

SEQ ID NO: 2504224 - DNA, 18 bp, Homo sapiens
atcagtagccagcatctg

SEQ ID NO: 2504225 - DNA, 22 bp, Homo sapiens
atctctttgttctaaagatgga

SEQ ID NO: 2504226 - DNA, 20 bp, Homo sapiens
atctgctagggaatatcaat

SEQ ID NO: 2504227 - DNA, 17 bp, Homo sapiens
atgagaaaatgtcttta

SEQ ID NO: 2504228 - DNA, 15 bp, Homo sapiens
atgcagttttcctta

SEQ ID NO: 2504229 - DNA, 16 bp, Homo sapiens
atggcaggacagctcc

SEQ ID NO: 2504230 - DNA, 17 bp, Homo sapiens
atggcaggacagctcct

SEQ ID NO: 2504231 - DNA, 18 bp, Homo sapiens
atggctaatgtactgcat

SEQ ID NO: 2504232 - DNA, 17 bp, Homo sapiens
atgtaaaagactttttt

SEQ ID NO: 2504233 - DNA, 21 bp, Homo sapiens
atgttaaacttacttagtgtt

SEQ ID NO: 2504234 - DNA, 21 bp, Homo sapiens
atgttatactgaaccaggcca

SEQ ID NO: 2504235 - DNA, 16 bp, Homo sapiens
atgttggccaggctgg

SEQ ID NO: 2504236 - DNA, 19 bp, Homo sapiens
attagcatttgtcaacaaa

SEQ ID NO: 2504237 - DNA, 19 bp, Homo sapiens
attatctaaaatctgctag

SEQ ID NO: 2504238 - DNA, 12 bp, Homo sapiens
attgcaatagaa

SEQ ID NO: 2504239 - DNA, 14 bp, Homo sapiens
attgcttgcacaaa

SEQ ID NO: 2504240 - DNA, 16 bp, Homo sapiens
attggatttgtctttg

SEQ ID NO: 2504241 - DNA, 20 bp, Homo sapiens
attttgctgtagaagatggc

SEQ ID NO: 2504242 - DNA, 19 bp, Homo sapiens
attttggaaaataaattat

SEQ ID NO: 2504243 - DNA, 13 bp, Homo sapiens
atttttaaagaaa

SEQ ID NO: 2504244 - DNA, 20 bp, Homo sapiens
atttttaaagaaaagttttg

SEQ ID NO: 2504245 - DNA, 16 bp, Homo sapiens
atttttcagatataaa

SEQ ID NO: 2504246 - DNA, 17 bp, Homo sapiens
caaagcccaaagtggta

SEQ ID NO: 2504247 - DNA, 19 bp, Homo sapiens
caaagcccaaagtggtata

SEQ ID NO: 2504248 - DNA, 13 bp, Homo sapiens
caaatattccaga

SEQ ID NO: 2504249 - DNA, 17 bp, Homo sapiens
caaatattccagagact

SEQ ID NO: 2504250 - DNA, 12 bp, Homo sapiens
caagatttcaga

SEQ ID NO: 2504251 - DNA, 20 bp, Homo sapiens
caagtgattctcctgcctca

SEQ ID NO: 2504252 - DNA, 21 bp, Homo sapiens
caagtgattctcctgcctcag

SEQ ID NO: 2504253 - DNA, 22 bp, Homo sapiens
caagtgattctcctgcctcagc

SEQ ID NO: 2504254 - DNA, 17 bp, Homo sapiens
caatattgtacagtttt

SEQ ID NO: 2504255 - DNA, 18 bp, Homo sapiens
caatattgtacagttttt

SEQ ID NO: 2504256 - DNA, 14 bp, Homo sapiens
cttttttttaagtt

SEQ ID NO: 2504257 - DNA, 23 bp, Homo sapiens
gaaatgctggtttttcagttttc

SEQ ID NO: 2504258 - DNA, 19 bp, Homo sapiens
gaaatttccactcaggtct

SEQ ID NO: 2504259 - DNA, 13 bp, Homo sapiens
gaacattgcaata

SEQ ID NO: 2504260 - DNA, 12 bp, Homo sapiens
gaacgtttttcc

SEQ ID NO: 2504261 - DNA, 23 bp, Homo sapiens
gaagtagtggagcccctgctctg

SEQ ID NO: 2504262 - DNA, 17 bp, Homo sapiens
gacagggtttcaccatg

SEQ ID NO: 2504263 - DNA, 17 bp, Homo sapiens
gaccaatattgtacagt

SEQ ID NO: 2504264 - DNA, 19 bp, Homo sapiens
gaccaatattgtacagttt

SEQ ID NO: 2504265 - DNA, 22 bp, Homo sapiens
gactgaccaatattgtacagtt

SEQ ID NO: 2504266 - DNA, 21 bp, Homo sapiens
gagaagagggaaaacagaaaa

SEQ ID NO: 2504267 - DNA, 20 bp, Homo sapiens
gaggcggccccggccggggt

SEQ ID NO: 2504268 - DNA, 16 bp, Homo sapiens
gatatgttatactgaa

SEQ ID NO: 2504269 - DNA, 14 bp, Homo sapiens
gatccccagctgtt

SEQ ID NO: 2504270 - DNA, 20 bp, Homo sapiens
gattacagggatgagccacc

SEQ ID NO: 2504271 - DNA, 22 bp, Homo sapiens
gatttgtctttggtgaacattg

SEQ ID NO: 2504272 - DNA, 15 bp, Homo sapiens
gatttttgtcttgtg

SEQ ID NO: 2504273 - DNA, 17 bp, Homo sapiens
gccaccgcgcccagcct

SEQ ID NO: 2504274 - DNA, 14 bp, Homo sapiens
gcctctgggactgg

SEQ ID NO: 2504275 - DNA, 17 bp, Homo sapiens
gcctgtgcctctgggac

SEQ ID NO: 2504276 - DNA, 16 bp, Homo sapiens
gctggattacaggcat

SEQ ID NO: 2504277 - DNA, 20 bp, Homo sapiens
gctggtctcaaactcctgac

SEQ ID NO: 2504278 - DNA, 15 bp, Homo sapiens
gctggtttttcagtt

SEQ ID NO: 2504279 - DNA, 13 bp, Homo sapiens
gcttacaagccag

SEQ ID NO: 2504280 - DNA, 19 bp, Homo sapiens
gcttacaagccagctggag

SEQ ID NO: 2504281 - DNA, 14 bp, Homo sapiens
gcttgttggatttt

SEQ ID NO: 2504282 - DNA, 15 bp, Homo sapiens
gggaaaacagaaaac

SEQ ID NO: 2504283 - DNA, 20 bp, Homo sapiens
gggtttcaccatgttggcca

SEQ ID NO: 2504284 - DNA, 20 bp, Homo sapiens
ggttgagggcaatggacaag

SEQ ID NO: 2504285 - DNA, 19 bp, Homo sapiens
ggtttcaccatgttggcca

SEQ ID NO: 2504286 - DNA, 15 bp, Homo sapiens
gtaaaagactttttt

SEQ ID NO: 2504287 - DNA, 19 bp, Homo sapiens
gtaaaatttcccattaaag

SEQ ID NO: 2504288 - DNA, 13 bp, Homo sapiens
gtacagtcttgta

SEQ ID NO: 2504289 - DNA, 14 bp, Homo sapiens
gtacagtcttgtat

SEQ ID NO: 2504290 - DNA, 13 bp, Homo sapiens
gtacagtttttat

SEQ ID NO: 2504291 - DNA, 14 bp, Homo sapiens
gtactcattaaaaa

SEQ ID NO: 2504292 - DNA, 12 bp, Homo sapiens
gtagaagatggc

SEQ ID NO: 2504293 - DNA, 14 bp, Homo sapiens
gtatagaaatgctg

SEQ ID NO: 2504294 - DNA, 22 bp, Homo sapiens
gtatagaaatgctggtttttca

SEQ ID NO: 2504295 - DNA, 22 bp, Homo sapiens
gtattaagttgttaataaaagt

SEQ ID NO: 2504296 - DNA, 22 bp, Homo sapiens
gtcataactagaactgaatttt

SEQ ID NO: 2504297 - DNA, 16 bp, Homo sapiens
gtccacagtggaacca

SEQ ID NO: 2504298 - DNA, 21 bp, Homo sapiens
gtccacagtggaaccagccca

SEQ ID NO: 2504299 - DNA, 23 bp, Homo sapiens
gtctaggcaggacctgtggccaa

SEQ ID NO: 2504300 - DNA, 16 bp, Homo sapiens
gtctcaaactcctgac

SEQ ID NO: 2504301 - DNA, 12 bp, Homo sapiens
aaaacagaaaac

SEQ ID NO: 2504302 - DNA, 18 bp, Homo sapiens
aaaagggaactgaacatt

SEQ ID NO: 2504303 - DNA, 13 bp, Homo sapiens
aaaatgtctttat

SEQ ID NO: 2504304 - DNA, 11 bp, Homo sapiens
aaactcctgac

SEQ ID NO: 2504305 - DNA, 18 bp, Homo sapiens
aaagcccaaagtggtata

SEQ ID NO: 2504306 - DNA, 19 bp, Homo sapiens
aaagcccttaggaagaatt

SEQ ID NO: 2504307 - DNA, 21 bp, Homo sapiens
aaagggaactgaacattccag

SEQ ID NO: 2504308 - DNA, 12 bp, Homo sapiens
aaagtgctggga

SEQ ID NO: 2504309 - DNA, 17 bp, Homo sapiens
aaagtggtatagaaatg

SEQ ID NO: 2504310 - DNA, 14 bp, Homo sapiens
aaatgtaagatcgt

SEQ ID NO: 2504311 - DNA, 22 bp, Homo sapiens
aaatttccactcaggtctgttt

SEQ ID NO: 2504312 - DNA, 17 bp, Homo sapiens
aaatttctctactgtct

SEQ ID NO: 2504313 - DNA, 14 bp, Homo sapiens
aacattgcaataga

SEQ ID NO: 2504314 - DNA, 22 bp, Homo sapiens
aacctcgaggtttctcaaagaa

SEQ ID NO: 2504315 - DNA, 15 bp, Homo sapiens
aagaaaagttttgta

SEQ ID NO: 2504316 - DNA, 21 bp, Homo sapiens
aagaaaagttttgtaaatttc

SEQ ID NO: 2504317 - DNA, 21 bp, Homo sapiens
aagaaatttccactcaggtct

SEQ ID NO: 2504318 - DNA, 22 bp, Homo sapiens
aagacgtgattttgctgtagaa

SEQ ID NO: 2504319 - DNA, 16 bp, Homo sapiens
aagacttccagagcct

SEQ ID NO: 2504320 - DNA, 18 bp, Homo sapiens
aagacttccagagcctca

SEQ ID NO: 2504321 - DNA, 14 bp, Homo sapiens
aagagggaaaacag

SEQ ID NO: 2504322 - DNA, 18 bp, Homo sapiens
aagagggaaaacagaaaa

SEQ ID NO: 2504323 - DNA, 16 bp, Homo sapiens
aagatcgttctctgcc

SEQ ID NO: 2504324 - DNA, 18 bp, Homo sapiens
aagtatcctgcttctgat

SEQ ID NO: 2504325 - DNA, 19 bp, Homo sapiens
aagtccacagtggaaccag

SEQ ID NO: 2504326 - DNA, 18 bp, Homo sapiens
aagtgagactttgagggt

SEQ ID NO: 2504327 - DNA, 21 bp, Homo sapiens
aagtgattctcctgcctcagc

SEQ ID NO: 2504328 - DNA, 15 bp, Homo sapiens
aagttcttagttgct

SEQ ID NO: 2504329 - DNA, 12 bp, Homo sapiens
aataaattattt

SEQ ID NO: 2504330 - DNA, 16 bp, Homo sapiens
aatagaaatccaattg

SEQ ID NO: 2504331 - DNA, 14 bp, Homo sapiens
aatattgtacagtt

SEQ ID NO: 2504332 - DNA, 17 bp, Homo sapiens
aatattgtacagttttt

SEQ ID NO: 2504333 - DNA, 21 bp, Homo sapiens
aatcacgtaaagctagaaatg

SEQ ID NO: 2504334 - DNA, 19 bp, Homo sapiens
aatccacctgcctcggcct

SEQ ID NO: 2504335 - DNA, 13 bp, Homo sapiens
aatctttctgcag

SEQ ID NO: 2504336 - DNA, 20 bp, Homo sapiens
aatgagaaaatgtctttatt

SEQ ID NO: 2504337 - DNA, 14 bp, Homo sapiens
aatgtactgcatat

SEQ ID NO: 2504338 - DNA, 14 bp, Homo sapiens
aatgtgactcaaga

SEQ ID NO: 2504339 - DNA, 13 bp, Homo sapiens
aatgtttccttta

SEQ ID NO: 2504340 - DNA, 14 bp, Homo sapiens
aattgacttattta

SEQ ID NO: 2504341 - DNA, 22 bp, Homo sapiens
aattggatacgacaacttgcac

SEQ ID NO: 2504342 - DNA, 13 bp, Homo sapiens
acaagccagctgg

SEQ ID NO: 2504343 - DNA, 9 bp, Homo sapiens
acagaaaac

SEQ ID NO: 2504344 - DNA, 21 bp, Homo sapiens
acatagcttacaagccagctg

SEQ ID NO: 2504345 - DNA, 17 bp, Homo sapiens
acatgttaaacttactt

SEQ ID NO: 2504346 - DNA, 21 bp, Homo sapiens
acatttttcagatataaaaga

SEQ ID NO: 2504347 - DNA, 16 bp, Homo sapiens
acccccaaattttctt

SEQ ID NO: 2504348 - DNA, 15 bp, Homo sapiens
acctacagtgtacag

SEQ ID NO: 2504349 - DNA, 17 bp, Homo sapiens
acctgtggccaagttct

SEQ ID NO: 2504350 - DNA, 18 bp, Homo sapiens
acctgtggccaagttctt

SEQ ID NO: 2504351 - DNA, 19 bp, Homo sapiens
acctgtggccaagttctta

SEQ ID NO: 2504352 - DNA, 18 bp, Homo sapiens
acgtaaagctagaaatga

SEQ ID NO: 2504353 - DNA, 19 bp, Homo sapiens
acgtgattttgctgtagaa

SEQ ID NO: 2504354 - DNA, 14 bp, Homo sapiens
actaatctttctgc

SEQ ID NO: 2504355 - DNA, 17 bp, Homo sapiens
actagaactgaattttg

SEQ ID NO: 2504356 - DNA, 23 bp, Homo sapiens
actagaactgaattttgtcttta

SEQ ID NO: 2504357 - DNA, 15 bp, Homo sapiens
actcctgacctcaag

SEQ ID NO: 2504358 - DNA, 13 bp, Homo sapiens
actgaacattcca

SEQ ID NO: 2504359 - DNA, 21 bp, Homo sapiens
actgaccaatattgtacagtt

SEQ ID NO: 2504360 - DNA, 22 bp, Homo sapiens
actgaccaatattgtacagttt

SEQ ID NO: 2504361 - DNA, 19 bp, Homo sapiens
acttgggggactgggcgca

SEQ ID NO: 2504362 - DNA, 19 bp, Homo sapiens
acttttcaatgtctaaaaa

SEQ ID NO: 2504363 - DNA, 22 bp, Homo sapiens
agaaagcccttaggaagaattt

SEQ ID NO: 2504364 - DNA, 21 bp, Homo sapiens
agaagagggaaaacagaaaac

SEQ ID NO: 2504365 - DNA, 19 bp, Homo sapiens
agaagatggcacttataac

SEQ ID NO: 2504366 - DNA, 18 bp, Homo sapiens
agaagattttgaaatttt

SEQ ID NO: 2504367 - DNA, 11 bp, Homo sapiens
agacagagtct

SEQ ID NO: 2504368 - DNA, 19 bp, Homo sapiens
agacagggtttcaccatgt

SEQ ID NO: 2504369 - DNA, 21 bp, Homo sapiens
agactgaccaatattgtacag

SEQ ID NO: 2504370 - DNA, 13 bp, Homo sapiens
agagcaaacagaa

SEQ ID NO: 2504371 - DNA, 17 bp, Homo sapiens
agagggaaaacagaaaa

SEQ ID NO: 2504372 - DNA, 15 bp, Homo sapiens
agatataaaagactg

SEQ ID NO: 2504373 - DNA, 21 bp, Homo sapiens
agattttgaaatttttattaa

SEQ ID NO: 2504374 - DNA, 14 bp, Homo sapiens
agcaaacagaaaaa

SEQ ID NO: 2504375 - DNA, 14 bp, Homo sapiens
agcacctacagtgt

SEQ ID NO: 2504376 - DNA, 15 bp, Homo sapiens
agcacctacagtgta

SEQ ID NO: 2504377 - DNA, 21 bp, Homo sapiens
agcacctacagtgtacagtct

SEQ ID NO: 2504378 - DNA, 16 bp, Homo sapiens
agcatttgtcaacaaa

SEQ ID NO: 2504379 - DNA, 20 bp, Homo sapiens
agccatggcaggacagctcc

SEQ ID NO: 2504380 - DNA, 20 bp, Homo sapiens
agcccaaagtggtatagaaa

SEQ ID NO: 2504381 - DNA, 11 bp, Homo sapiens
agcctcctgag

SEQ ID NO: 2504382 - DNA, 19 bp, Homo sapiens
agcctcctgagtagctgga

SEQ ID NO: 2504383 - DNA, 19 bp, Homo sapiens
agcctgtgcctctgggact

SEQ ID NO: 2504384 - DNA, 19 bp, Homo sapiens
agcttacaagccagctgga

SEQ ID NO: 2504385 - DNA, 16 bp, Homo sapiens
aggacctgtggccaag

SEQ ID NO: 2504386 - DNA, 22 bp, Homo sapiens
aggcatgtgccacccacccaac

SEQ ID NO: 2504387 - DNA, 22 bp, Homo sapiens
aggccaacccaaaataagcagg

SEQ ID NO: 2504388 - DNA, 13 bp, Homo sapiens
agggaaaacagaa

SEQ ID NO: 2504389 - DNA, 16 bp, Homo sapiens
agggaaaacagaaaac

SEQ ID NO: 2504390 - DNA, 20 bp, Homo sapiens
agggactcatcatttccatt

SEQ ID NO: 2504391 - DNA, 14 bp, Homo sapiens
agtaatccacctgc

SEQ ID NO: 2504392 - DNA, 16 bp, Homo sapiens
agtcttgtattaagtt

SEQ ID NO: 2504393 - DNA, 18 bp, Homo sapiens
agtgcaatgacacagtct

SEQ ID NO: 2504394 - DNA, 17 bp, Homo sapiens
agtgctgggattacagg

SEQ ID NO: 2504395 - DNA, 16 bp, Homo sapiens
agtggaaccagcccag

SEQ ID NO: 2504396 - DNA, 16 bp, Homo sapiens
agtgtacagtcttgta

SEQ ID NO: 2504397 - DNA, 17 bp, Homo sapiens
agtgtacagtcttgtat

SEQ ID NO: 2504398 - DNA, 20 bp, Homo sapiens
agttcttagttgctgtatgt

SEQ ID NO: 2504399 - DNA, 15 bp, Homo sapiens
ataaaagtacatgtt

SEQ ID NO: 2504400 - DNA, 14 bp, Homo sapiens
ataaataacttttt

SEQ ID NO: 2504401 - DNA, 17 bp, Homo sapiens
atactgaaccaggccag

SEQ ID NO: 2504402 - DNA, 22 bp, Homo sapiens
atagaaatgctggtttttcagt

SEQ ID NO: 2504403 - DNA, 12 bp, Homo sapiens
atattgtacagt

SEQ ID NO: 2504404 - DNA, 13 bp, Homo sapiens
atccaattggata

SEQ ID NO: 2504405 - DNA, 14 bp, Homo sapiens
atcgttctctgcct

SEQ ID NO: 2504406 - DNA, 13 bp, Homo sapiens
atgctggtttttc

SEQ ID NO: 2504407 - DNA, 19 bp, Homo sapiens
atgtatgaggaatttctgt

SEQ ID NO: 2504408 - DNA, 15 bp, Homo sapiens
atgtctcgtggtagg

SEQ ID NO: 2504409 - DNA, 22 bp, Homo sapiens
atgttatactgaaccaggccag

SEQ ID NO: 2504410 - DNA, 12 bp, Homo sapiens
gtttttcagttt

SEQ ID NO: 2504411 - DNA, 9 bp, Homo sapiens
taaagacag

SEQ ID NO: 2504412 - DNA, 10 bp, Homo sapiens
taaagacaga

SEQ ID NO: 2504413 - DNA, 15 bp, Homo sapiens
taaatgtagaaagtg

SEQ ID NO: 2504414 - DNA, 19 bp, Homo sapiens
taaattttttttgtttcat

SEQ ID NO: 2504415 - DNA, 17 bp, Homo sapiens
taataaaagtacatgtt

SEQ ID NO: 2504416 - DNA, 11 bp, Homo sapiens
taatgtttcct

SEQ ID NO: 2504417 - DNA, 13 bp, Homo sapiens
taattttttacta

SEQ ID NO: 2504418 - DNA, 18 bp, Homo sapiens
tacaagccagctggagaa

SEQ ID NO: 2504419 - DNA, 17 bp, Homo sapiens
tacacatttttcagata

SEQ ID NO: 2504420 - DNA, 12 bp, Homo sapiens
tacagtcttgta

SEQ ID NO: 2504421 - DNA, 16 bp, Homo sapiens
tacagtgtacagtctt

SEQ ID NO: 2504422 - DNA, 15 bp, Homo sapiens
tagaaagaagatgaa

SEQ ID NO: 2504423 - DNA, 21 bp, Homo sapiens
tagaacctcgaggtttctcaa

SEQ ID NO: 2504424 - DNA, 17 bp, Homo sapiens
tagaactgaattttgtc

SEQ ID NO: 2504425 - DNA, 20 bp, Homo sapiens
tagcctgtgcctctgggact

SEQ ID NO: 2504426 - DNA, 13 bp, Homo sapiens
taggactgtagaa

SEQ ID NO: 2504427 - DNA, 21 bp, Homo sapiens
tagtgaatcacgtaaagctag

SEQ ID NO: 2504428 - DNA, 10 bp, Homo sapiens
tagtttttgt

SEQ ID NO: 2504429 - DNA, 18 bp, Homo sapiens
tatacgataaataacttt

SEQ ID NO: 2504430 - DNA, 22 bp, Homo sapiens
tatcctgcttctgatatgcagt

SEQ ID NO: 2504431 - DNA, 12 bp, Homo sapiens
tatgatttttaa

SEQ ID NO: 2504432 - DNA, 23 bp, Homo sapiens
tatgatttttaaagaaaagtttt

SEQ ID NO: 2504433 - DNA, 18 bp, Homo sapiens
tatgttggtagattctaa

SEQ ID NO: 2504434 - DNA, 13 bp, Homo sapiens
tattgtacagttt

SEQ ID NO: 2504435 - DNA, 17 bp, Homo sapiens
tattgtacagtttttat

SEQ ID NO: 2504436 - DNA, 15 bp, Homo sapiens
tcaaaaacattctta

SEQ ID NO: 2504437 - DNA, 13 bp, Homo sapiens
tcaaagaaatttc

SEQ ID NO: 2504438 - DNA, 15 bp, Homo sapiens
tcaaatgagaaaatg

SEQ ID NO: 2504439 - DNA, 14 bp, Homo sapiens
tcaaccagcagatg

SEQ ID NO: 2504440 - DNA, 15 bp, Homo sapiens
tcaagacttccagag

SEQ ID NO: 2504441 - DNA, 18 bp, Homo sapiens
tcaagtgattctcctgcc

SEQ ID NO: 2504442 - DNA, 21 bp, Homo sapiens
tcaccatgttggccaggctgg

SEQ ID NO: 2504443 - DNA, 14 bp, Homo sapiens
tcagatataaaaga

SEQ ID NO: 2504444 - DNA, 20 bp, Homo sapiens
tcagcacctacagtgtacag

SEQ ID NO: 2504445 - DNA, 15 bp, Homo sapiens
tcataactagaactg

SEQ ID NO: 2504446 - DNA, 21 bp, Homo sapiens
tcatggatatgttatactgaa

SEQ ID NO: 2504447 - DNA, 18 bp, Homo sapiens
tcatttcaatcgtaaaat

SEQ ID NO: 2504448 - DNA, 16 bp, Homo sapiens
tccacagtggaaccag

SEQ ID NO: 2504449 - DNA, 17 bp, Homo sapiens
tccactcaggtctgttt

SEQ ID NO: 2504450 - DNA, 22 bp, Homo sapiens
tcccgtggaacgtttttcctgt

SEQ ID NO: 2504451 - DNA, 21 bp, Homo sapiens
tcctagcctgtgcctctggga

SEQ ID NO: 2504452 - DNA, 19 bp, Homo sapiens
tcctgttcttaagacgtga

SEQ ID NO: 2504453 - DNA, 14 bp, Homo sapiens
tccttagaagtgga

SEQ ID NO: 2504454 - DNA, 21 bp, Homo sapiens
tcgctctgttgcccaggctgg

SEQ ID NO: 2504455 - DNA, 20 bp, Homo sapiens
tcgtggtaggactgtagaaa

SEQ ID NO: 2504456 - DNA, 19 bp, Homo sapiens
tctcgtggtaggactgtag

SEQ ID NO: 2504457 - DNA, 21 bp, Homo sapiens
tctctactgtctcagtttaca

SEQ ID NO: 2504458 - DNA, 20 bp, Homo sapiens
tctgcctcacatagcttaca

SEQ ID NO: 2504459 - DNA, 19 bp, Homo sapiens
tcttctttttgcttcaaaa

SEQ ID NO: 2504460 - DNA, 12 bp, Homo sapiens
tcttgtgtttct

SEQ ID NO: 2504461 - DNA, 19 bp, Homo sapiens
tctttaaccacttttcaat

SEQ ID NO: 2504462 - DNA, 15 bp, Homo sapiens
tctttagtttttgtg

SEQ ID NO: 2504463 - DNA, 21 bp, Homo sapiens
tctttctgcagaaacagaaag

SEQ ID NO: 2504464 - DNA, 22 bp, Homo sapiens
tctttggtgaacattgcaatag

SEQ ID NO: 2504465 - DNA, 19 bp, Homo sapiens
tgaaatttttattaaatta

SEQ ID NO: 2504466 - DNA, 13 bp, Homo sapiens
tgaacattccaga

SEQ ID NO: 2504467 - DNA, 15 bp, Homo sapiens
tgaacattgcaatag

SEQ ID NO: 2504468 - DNA, 17 bp, Homo sapiens
tgaatcacgtaaagcta

SEQ ID NO: 2504469 - DNA, 18 bp, Homo sapiens
tgaccaatattgtacagt

SEQ ID NO: 2504470 - DNA, 21 bp, Homo sapiens
tgaccaatattgtacagtttt

SEQ ID NO: 2504471 - DNA, 14 bp, Homo sapiens
tgactcttggcaca

SEQ ID NO: 2504472 - DNA, 17 bp, Homo sapiens
tgacttatttatataaa

SEQ ID NO: 2504473 - DNA, 20 bp, Homo sapiens
tgacttatttatataaattt

SEQ ID NO: 2504474 - DNA, 19 bp, Homo sapiens
tgatatgcagttttcctta

SEQ ID NO: 2504475 - DNA, 14 bp, Homo sapiens
tgattttgctgtag

SEQ ID NO: 2504476 - DNA, 13 bp, Homo sapiens
tgcctctgggact

SEQ ID NO: 2504477 - DNA, 13 bp, Homo sapiens
tgcttcaaaaaca

SEQ ID NO: 2504478 - DNA, 17 bp, Homo sapiens
tggagtgcaatgacaca

SEQ ID NO: 2504479 - DNA, 17 bp, Homo sapiens
tggatttttgtcttgtg

SEQ ID NO: 2504480 - DNA, 13 bp, Homo sapiens
tggccaggctggt

SEQ ID NO: 2504481 - DNA, 17 bp, Homo sapiens
tggctaatgtactgcat

SEQ ID NO: 2504482 - DNA, 18 bp, Homo sapiens
tggtaggactgtagaaaa

SEQ ID NO: 2504483 - DNA, 19 bp, Homo sapiens
tgtagaaaagggaactgaa

SEQ ID NO: 2504484 - DNA, 20 bp, Homo sapiens
tgtagaaaagggaactgaac

SEQ ID NO: 2504485 - DNA, 18 bp, Homo sapiens
tgtatgtctcgtggtagg

SEQ ID NO: 2504486 - DNA, 12 bp, Homo sapiens
tgtctaaaaaca

SEQ ID NO: 2504487 - DNA, 14 bp, Homo sapiens
tgtctaaaaacatt

SEQ ID NO: 2504488 - DNA, 17 bp, Homo sapiens
tgtctaggcaggacctg

SEQ ID NO: 2504489 - DNA, 13 bp, Homo sapiens
tgtgcctctggga

SEQ ID NO: 2504490 - DNA, 15 bp, Homo sapiens
tgtgcctctgggact

SEQ ID NO: 2504491 - DNA, 17 bp, Homo sapiens
tgtgcctctgggactgg

SEQ ID NO: 2504492 - DNA, 18 bp, Homo sapiens
tgtggccaagttcttagt

SEQ ID NO: 2504493 - DNA, 20 bp, Homo sapiens
tgtgtttttaataaagacag

SEQ ID NO: 2504494 - DNA, 14 bp, Homo sapiens
tgttgcccaggctg

SEQ ID NO: 2504495 - DNA, 13 bp, Homo sapiens
ttaataaagacag

SEQ ID NO: 2504496 - DNA, 21 bp, Homo sapiens
ttaattgacttatttatataa

SEQ ID NO: 2504497 - DNA, 20 bp, Homo sapiens
ttacagggatgagccaccgc

SEQ ID NO: 2504498 - DNA, 22 bp, Homo sapiens
ttaggccaaaaaaatgtaagat

SEQ ID NO: 2504499 - DNA, 19 bp, Homo sapiens
ttatgatttttaaagaaaa

SEQ ID NO: 2504500 - DNA, 19 bp, Homo sapiens
ttattgcagcgattaataa

SEQ ID NO: 2504501 - DNA, 14 bp, Homo sapiens
ttatttaaatttta

SEQ ID NO: 2504502 - DNA, 12 bp, Homo sapiens
ttcagttttcag

SEQ ID NO: 2504503 - DNA, 18 bp, Homo sapiens
ttccactcaggtctgttt

SEQ ID NO: 2504504 - DNA, 23 bp, Homo sapiens
ttcccgtggaacgtttttcctgt

SEQ ID NO: 2504505 - DNA, 20 bp, Homo sapiens
ttcctgttcttaagacgtga

SEQ ID NO: 2504506 - DNA, 22 bp, Homo sapiens
ttctgatatgcagttttcctta

SEQ ID NO: 2504507 - DNA, 14 bp, Homo sapiens
ttcttagttgctgt

SEQ ID NO: 2504508 - DNA, 15 bp, Homo sapiens
ttgcaatagaaatcc

SEQ ID NO: 2504509 - DNA, 19 bp, Homo sapiens
ttgcacaaaccaattaaac

SEQ ID NO: 2504510 - DNA, 13 bp, Homo sapiens
ttgtacagttttt

SEQ ID NO: 2504511 - DNA, 16 bp, Homo sapiens
ttgtacagtttttatt

SEQ ID NO: 2504512 - DNA, 19 bp, Homo sapiens
ttgttaataaaagtacatg

SEQ ID NO: 2504513 - DNA, 17 bp, Homo sapiens
tttaaagaaaagttttg

SEQ ID NO: 2504514 - DNA, 18 bp, Homo sapiens
tttaagttacacattttt

SEQ ID NO: 2504515 - DNA, 22 bp, Homo sapiens
tttcaatcgtaaaatttcccat

SEQ ID NO: 2504516 - DNA, 14 bp, Homo sapiens
tttcagatataaaa

SEQ ID NO: 2504517 - DNA, 19 bp, Homo sapiens
tttccttaaattatctaaa

SEQ ID NO: 2504518 - DNA, 21 bp, Homo sapiens
tttgctgtagaagatggcact

SEQ ID NO: 2504519 - DNA, 15 bp, Homo sapiens
tttgcttcaaaaaca

SEQ ID NO: 2504520 - DNA, 23 bp, Homo sapiens
tttggtgaacattgcaatagaaa

SEQ ID NO: 2504521 - DNA, 13 bp, Homo sapiens
tttgtttcatatt

SEQ ID NO: 2504522 - DNA, 14 bp, Homo sapiens
ttttaaagaaaagt

SEQ ID NO: 2504523 - DNA, 14 bp, Homo sapiens
ttttcagttttcag

SEQ ID NO: 2504524 - DNA, 13 bp, Homo sapiens
ttttgtcttgtgt

SEQ ID NO: 2504525 - DNA, 17 bp, Homo sapiens
tttttaaagacagagtc

SEQ ID NO: 2504526 - DNA, 13 bp, Homo sapiens
ttttttgtttcat

SEQ ID NO: 2504527 - DNA, 14 bp, Homo sapiens
aaactgccagcaac

SEQ ID NO: 2504528 - DNA, 20 bp, Homo sapiens
aaactgccagttttgtttcc

SEQ ID NO: 2504529 - DNA, 14 bp, Homo sapiens
aaactgcttgtttc

SEQ ID NO: 2504530 - DNA, 17 bp, Homo sapiens
aaactgcttgtttccta

SEQ ID NO: 2504531 - DNA, 22 bp, Homo sapiens
aaactgcttgtttcctagcaca

SEQ ID NO: 2504532 - DNA, 16 bp, Homo sapiens
aaactggattaaactt

SEQ ID NO: 2504533 - DNA, 15 bp, Homo sapiens
aaactgggttcctgc

SEQ ID NO: 2504534 - DNA, 18 bp, Homo sapiens
aaactgtagaaatgatga

SEQ ID NO: 2504535 - DNA, 12 bp, Homo sapiens
aaactgtgcacc

SEQ ID NO: 2504536 - DNA, 10 bp, Homo sapiens
aaactgtgta

SEQ ID NO: 2504537 - DNA, 21 bp, Homo sapiens
aaactgtgtacataactgaaa

SEQ ID NO: 2504538 - DNA, 19 bp, Homo sapiens
aaactgttaatagttcagg

SEQ ID NO: 2504539 - DNA, 20 bp, Homo sapiens
aaactgttcccacctgctgg

SEQ ID NO: 2504540 - DNA, 14 bp, Homo sapiens
aaacttaatctaaa

SEQ ID NO: 2504541 - DNA, 18 bp, Homo sapiens
aaacttaatctaaatgga

SEQ ID NO: 2504542 - DNA, 19 bp, Homo sapiens
aaacttaatctaaatggaa

SEQ ID NO: 2504543 - DNA, 22 bp, Homo sapiens
aaacttatttttttctgattgt

SEQ ID NO: 2504544 - DNA, 21 bp, Homo sapiens
aaacttccagtgcaacactga

SEQ ID NO: 2504545 - DNA, 23 bp, Homo sapiens
aaacttccatgaggccaaacgtt

SEQ ID NO: 2504546 - DNA, 12 bp, Homo sapiens
aaacttgtaaat

SEQ ID NO: 2504547 - DNA, 18 bp, Homo sapiens
aaacttgttactaaagaa

SEQ ID NO: 2504548 - DNA, 21 bp, Homo sapiens
aaactttactaagatgacatt

SEQ ID NO: 2504549 - DNA, 9 bp, Homo sapiens
aaagaaaaa

SEQ ID NO: 2504550 - DNA, 16 bp, Homo sapiens
aaagaaaacccacccc

SEQ ID NO: 2504551 - DNA, 12 bp, Homo sapiens
aaagaaaataaa

SEQ ID NO: 2504552 - DNA, 12 bp, Homo sapiens
aaagaaagagag

SEQ ID NO: 2504553 - DNA, 18 bp, Homo sapiens
aaagaaagagagaaaata

SEQ ID NO: 2504554 - DNA, 17 bp, Homo sapiens
aaagaaagcctcagaga

SEQ ID NO: 2504555 - DNA, 20 bp, Homo sapiens
aaagaacatggacttgtata

SEQ ID NO: 2504556 - DNA, 12 bp, Homo sapiens
aaagaagacatg

SEQ ID NO: 2504557 - DNA, 12 bp, Homo sapiens
aaagaaggaagt

SEQ ID NO: 2504558 - DNA, 15 bp, Homo sapiens
aaagaatacagaaag

SEQ ID NO: 2504559 - DNA, 13 bp, Homo sapiens
aaagaatgaaaga

SEQ ID NO: 2504560 - DNA, 14 bp, Homo sapiens
aaagaatgaaagag

SEQ ID NO: 2504561 - DNA, 16 bp, Homo sapiens
aaagacaaatcaaagc

SEQ ID NO: 2504562 - DNA, 22 bp, Homo sapiens
aaagacaaattctgtttcttga

SEQ ID NO: 2504563 - DNA, 15 bp, Homo sapiens
aaagacaattcttta

SEQ ID NO: 2504564 - DNA, 16 bp, Homo sapiens
aaagacaattctttat

SEQ ID NO: 2504565 - DNA, 20 bp, Homo sapiens
aaagacaattctttatacaa

SEQ ID NO: 2504566 - DNA, 13 bp, Homo sapiens
aaagaccagacta

SEQ ID NO: 2504567 - DNA, 14 bp, Homo sapiens
aaagactaatttaa

SEQ ID NO: 2504568 - DNA, 19 bp, Homo sapiens
aaagactattcaaacagtc

SEQ ID NO: 2504569 - DNA, 21 bp, Homo sapiens
aaagactccaaagaaatgtaa

SEQ ID NO: 2504570 - DNA, 23 bp, Homo sapiens
aaagactgagtacgttgtgcatt

SEQ ID NO: 2504571 - DNA, 21 bp, Homo sapiens
aaagactggcttttattaatg

SEQ ID NO: 2504572 - DNA, 13 bp, Homo sapiens
aaagactgtacaa

SEQ ID NO: 2504573 - DNA, 18 bp, Homo sapiens
aaagacttagtatatttt

SEQ ID NO: 2504574 - DNA, 14 bp, Homo sapiens
aaagagaaaagaaa

SEQ ID NO: 2504575 - DNA, 17 bp, Homo sapiens
aaagagacctacctcag

SEQ ID NO: 2504576 - DNA, 20 bp, Homo sapiens
aaagagacctacctcaggtt

SEQ ID NO: 2504577 - DNA, 15 bp, Homo sapiens
aaagagactggagca

SEQ ID NO: 2504578 - DNA, 12 bp, Homo sapiens
aaagagagaaaa

SEQ ID NO: 2504579 - DNA, 13 bp, Homo sapiens
aaagagagaatgt

SEQ ID NO: 2504580 - DNA, 13 bp, Homo sapiens
aaagagatatttt

SEQ ID NO: 2504581 - DNA, 14 bp, Homo sapiens
aaagagatttcaag

SEQ ID NO: 2504582 - DNA, 20 bp, Homo sapiens
aaagaggcgtctgtatattt

SEQ ID NO: 2504583 - DNA, 24 bp, Homo sapiens
aaagaggtgactgggccctgcctc

SEQ ID NO: 2504584 - DNA, 19 bp, Homo sapiens
aaagagtaaaggaaatgat

SEQ ID NO: 2504585 - DNA, 14 bp, Homo sapiens
aaagagtaggaaga

SEQ ID NO: 2504586 - DNA, 12 bp, Homo sapiens
aaagagttagaa

SEQ ID NO: 2504587 - DNA, 21 bp, Homo sapiens
aaagatacagaactctttcaa

SEQ ID NO: 2504588 - DNA, 12 bp, Homo sapiens
aaagatattttg

SEQ ID NO: 2504589 - DNA, 16 bp, Homo sapiens
aaagatattttgcttt

SEQ ID NO: 2504590 - DNA, 20 bp, Homo sapiens
aaagatattttgctttgtga

SEQ ID NO: 2504591 - DNA, 16 bp, Homo sapiens
aaagatatttttatct

SEQ ID NO: 2504592 - DNA, 17 bp, Homo sapiens
aaagatgaaaatatttg

SEQ ID NO: 2504593 - DNA, 15 bp, Homo sapiens
aaagatgagtgagca

SEQ ID NO: 2504594 - DNA, 21 bp, Homo sapiens
aaagatgatttaaaagggaag

SEQ ID NO: 2504595 - DNA, 20 bp, Homo sapiens
aaagatgcaaggaccaggac

SEQ ID NO: 2504596 - DNA, 17 bp, Homo sapiens
aaagatgctcttctgtg

SEQ ID NO: 2504597 - DNA, 15 bp, Homo sapiens
aaagattcattttta

SEQ ID NO: 2504598 - DNA, 19 bp, Homo sapiens
aaagattgctgaaatttta

SEQ ID NO: 2504599 - DNA, 21 bp, Homo sapiens
aaagattgctgaaattttata

SEQ ID NO: 2504600 - DNA, 12 bp, Homo sapiens
aaagatttatca

SEQ ID NO: 2504601 - DNA, 13 bp, Homo sapiens
aaagatttatcaa

SEQ ID NO: 2504602 - DNA, 14 bp, Homo sapiens
aaagatttcttgag

SEQ ID NO: 2504603 - DNA, 21 bp, Homo sapiens
aaagcaactgttatgaaataa

SEQ ID NO: 2504604 - DNA, 14 bp, Homo sapiens
aaagcaaggaaact

SEQ ID NO: 2504605 - DNA, 17 bp, Homo sapiens
aaagcaataaatgaatg

SEQ ID NO: 2504606 - DNA, 12 bp, Homo sapiens
aaagcaatgcat

SEQ ID NO: 2504607 - DNA, 13 bp, Homo sapiens
aaagcaatgcatt

SEQ ID NO: 2504608 - DNA, 14 bp, Homo sapiens
aaagcaatgcattt

SEQ ID NO: 2504609 - DNA, 15 bp, Homo sapiens
aaagcaattccaacc

SEQ ID NO: 2504610 - DNA, 20 bp, Homo sapiens
aaagcacactcatcccctca

SEQ ID NO: 2504611 - DNA, 16 bp, Homo sapiens
aaagcacagtttgaac

SEQ ID NO: 2504612 - DNA, 16 bp, Homo sapiens
aaagcaccaaaataag

SEQ ID NO: 2504613 - DNA, 18 bp, Homo sapiens
aaagcaccaaaataagaa

SEQ ID NO: 2504614 - DNA, 19 bp, Homo sapiens
aaagcaccaaaataagaaa

SEQ ID NO: 2504615 - DNA, 20 bp, Homo sapiens
aaagcaccaaaataagaaaa

SEQ ID NO: 2504616 - DNA, 14 bp, Homo sapiens
aaagcactatacag

SEQ ID NO: 2504617 - DNA, 18 bp, Homo sapiens
aaagcagcgtttctatga

SEQ ID NO: 2504618 - DNA, 22 bp, Homo sapiens
aaagcagcgtttctatgacaca

SEQ ID NO: 2504619 - DNA, 19 bp, Homo sapiens
aaagcagctcaaaggcaca

SEQ ID NO: 2504620 - DNA, 17 bp, Homo sapiens
aaagcagggacttgaac

SEQ ID NO: 2504621 - DNA, 17 bp, Homo sapiens
aaagcaggtggcatctc

SEQ ID NO: 2504622 - DNA, 18 bp, Homo sapiens
aaagcatcacctcaggcc

SEQ ID NO: 2504623 - DNA, 13 bp, Homo sapiens
aaagcatccatgt

SEQ ID NO: 2504624 - DNA, 15 bp, Homo sapiens
aaagcattgtaaatg

SEQ ID NO: 2504625 - DNA, 19 bp, Homo sapiens
aaagcattgtaaatgtgct

SEQ ID NO: 2504626 - DNA, 23 bp, Homo sapiens
aaagccaacagtcaaaacagaga

SEQ ID NO: 2504627 - DNA, 12 bp, Homo sapiens
aaagccacctct

SEQ ID NO: 2504628 - DNA, 17 bp, Homo sapiens
aaagccagtgactccag

SEQ ID NO: 2504629 - DNA, 20 bp, Homo sapiens
aaagcctgttcccctcactg

SEQ ID NO: 2504630 - DNA, 23 bp, Homo sapiens
aaagccttgtgtctacagagaac

SEQ ID NO: 2504631 - DNA, 18 bp, Homo sapiens
aaagctaaagtatctgta

SEQ ID NO: 2504632 - DNA, 13 bp, Homo sapiens
aaagctagaaatg

SEQ ID NO: 2504633 - DNA, 14 bp, Homo sapiens
aaagctaggcctgg

SEQ ID NO: 2504634 - DNA, 18 bp, Homo sapiens
aaagctaggcctggccag

SEQ ID NO: 2504635 - DNA, 22 bp, Homo sapiens
aaagctattagccaggatcatg

SEQ ID NO: 2504636 - DNA, 21 bp, Homo sapiens
aaagctcatattttgtatata

SEQ ID NO: 2504637 - DNA, 13 bp, Homo sapiens
aaagctcctgtcc

SEQ ID NO: 2504638 - DNA, 15 bp, Homo sapiens
aaagctgcctgtagt

SEQ ID NO: 2504639 - DNA, 16 bp, Homo sapiens
aaagctgcctgtagtt

SEQ ID NO: 2504640 - DNA, 17 bp, Homo sapiens
aaagctgcctgtagtta

SEQ ID NO: 2504641 - DNA, 23 bp, Homo sapiens
aaagctgcctgtagttaggaaat

SEQ ID NO: 2504642 - DNA, 21 bp, Homo sapiens
aaagctgctcagggaaaagca

SEQ ID NO: 2504643 - DNA, 13 bp, Homo sapiens
aaagcttattaaa

SEQ ID NO: 2504644 - DNA, 11 bp, Homo sapiens
aaagcttcccc

SEQ ID NO: 2504645 - DNA, 11 bp, Homo sapiens
aaaggaaagag

SEQ ID NO: 2504646 - DNA, 17 bp, Homo sapiens
aaaggaaatctcacccc

SEQ ID NO: 2504647 - DNA, 20 bp, Homo sapiens
aaaggaaggttctggtgtga

SEQ ID NO: 2504648 - DNA, 22 bp, Homo sapiens
aaaggacaccttttaactcacc

SEQ ID NO: 2504649 - DNA, 20 bp, Homo sapiens
aaaggactgttttttcctga

SEQ ID NO: 2504650 - DNA, 16 bp, Homo sapiens
aaaggatgttggtgtt

SEQ ID NO: 2504651 - DNA, 17 bp, Homo sapiens
aaaggcacctataaaac

SEQ ID NO: 2504652 - DNA, 20 bp, Homo sapiens
aaaggcacctataaaacagg

SEQ ID NO: 2504653 - DNA, 21 bp, Homo sapiens
aaaggcacctataaaacaggt

SEQ ID NO: 2504654 - DNA, 20 bp, Homo sapiens
aaaggccaaacctctgttca

SEQ ID NO: 2504655 - DNA, 14 bp, Homo sapiens
aaaggccatggaga

SEQ ID NO: 2504656 - DNA, 19 bp, Homo sapiens
aaaggccatggagagctgg

SEQ ID NO: 2504657 - DNA, 21 bp, Homo sapiens
aaaggcgcagtgcttctctac

SEQ ID NO: 2504658 - DNA, 14 bp, Homo sapiens
aaaggctccaggag

SEQ ID NO: 2504659 - DNA, 15 bp, Homo sapiens
aaaggctccaggagc

SEQ ID NO: 2504660 - DNA, 20 bp, Homo sapiens
aaaggctctgaaagccagct

SEQ ID NO: 2504661 - DNA, 23 bp, Homo sapiens
aaagggagcactgggttgacttt

SEQ ID NO: 2504662 - DNA, 20 bp, Homo sapiens
aaagggatggcaagatgtgg

SEQ ID NO: 2504663 - DNA, 22 bp, Homo sapiens
aaaggtgaccttgcaacttcat

SEQ ID NO: 2504664 - DNA, 22 bp, Homo sapiens
aaaggtggtatgtgtgtgtatg

SEQ ID NO: 2504665 - DNA, 16 bp, Homo sapiens
aaaggtgtcttcctcc

SEQ ID NO: 2504666 - DNA, 14 bp, Homo sapiens
aaaggttttcctct

SEQ ID NO: 2504667 - DNA, 12 bp, Homo sapiens
aaagtaaagcta

SEQ ID NO: 2504668 - DNA, 23 bp, Homo sapiens
aaagtaaagctaaaatgatttta

SEQ ID NO: 2504669 - DNA, 19 bp, Homo sapiens
aaagtaagtaccactcagg

SEQ ID NO: 2504670 - DNA, 12 bp, Homo sapiens
aaagtacattta

SEQ ID NO: 2504671 - DNA, 14 bp, Homo sapiens
aaagtacatttaat

SEQ ID NO: 2504672 - DNA, 19 bp, Homo sapiens
aaagtacttctccaccctg

SEQ ID NO: 2504673 - DNA, 20 bp, Homo sapiens
aaagtagaagtcttagatgt

SEQ ID NO: 2504674 - DNA, 18 bp, Homo sapiens
aaagtatatatagaatct

SEQ ID NO: 2504675 - DNA, 15 bp, Homo sapiens
aaagtatatatttat

SEQ ID NO: 2504676 - DNA, 23 bp, Homo sapiens
aaagtatatatttatttaagctt

SEQ ID NO: 2504677 - DNA, 14 bp, Homo sapiens
aaagtatatgttag

SEQ ID NO: 2504678 - DNA, 14 bp, Homo sapiens
aaagtatcatgcat

SEQ ID NO: 2504679 - DNA, 22 bp, Homo sapiens
aaacagccgtcagccaaatgta

SEQ ID NO: 2504680 - DNA, 11 bp, Homo sapiens
aaacaggacca

SEQ ID NO: 2504681 - DNA, 15 bp, Homo sapiens
aaacaggcccagcat

SEQ ID NO: 2504682 - DNA, 11 bp, Homo sapiens
aaacatctgga

SEQ ID NO: 2504683 - DNA, 15 bp, Homo sapiens
aaacatggttacaat

SEQ ID NO: 2504684 - DNA, 17 bp, Homo sapiens
aaacatggttacaatca

SEQ ID NO: 2504685 - DNA, 14 bp, Homo sapiens
aaacatgtgtttta

SEQ ID NO: 2504686 - DNA, 20 bp, Homo sapiens
aaacattaagattgaggcct

SEQ ID NO: 2504687 - DNA, 12 bp, Homo sapiens
aaacattctatc

SEQ ID NO: 2504688 - DNA, 23 bp, Homo sapiens
aaacattctgatttggaaaaaga

SEQ ID NO: 2504689 - DNA, 20 bp, Homo sapiens
aaacattgaagtaatgaatt

SEQ ID NO: 2504690 - DNA, 21 bp, Homo sapiens
aaacattggttcttgtattaa

SEQ ID NO: 2504691 - DNA, 16 bp, Homo sapiens
aaacattttcacacaa

SEQ ID NO: 2504692 - DNA, 22 bp, Homo sapiens
aaacattttcacacaatacaat

SEQ ID NO: 2504693 - DNA, 19 bp, Homo sapiens
aaacattttgtcatataag

SEQ ID NO: 2504694 - DNA, 22 bp, Homo sapiens
aaaccaagggggatgacatgtg

SEQ ID NO: 2504695 - DNA, 15 bp, Homo sapiens
aaaccacagccctgt

SEQ ID NO: 2504696 - DNA, 14 bp, Homo sapiens
aaaccacagctgct

SEQ ID NO: 2504697 - DNA, 16 bp, Homo sapiens
aaaccactagaactct

SEQ ID NO: 2504698 - DNA, 12 bp, Homo sapiens
aaaccagggagc

SEQ ID NO: 2504699 - DNA, 19 bp, Homo sapiens
aaaccagtgtagccttgcc

SEQ ID NO: 2504700 - DNA, 13 bp, Homo sapiens
aaaccataaactt

SEQ ID NO: 2504701 - DNA, 18 bp, Homo sapiens
aaacccagctctggtcca

SEQ ID NO: 2504702 - DNA, 17 bp, Homo sapiens
aaacccagttgccatct

SEQ ID NO: 2504703 - DNA, 17 bp, Homo sapiens
aaaccccatctctacaa

SEQ ID NO: 2504704 - DNA, 19 bp, Homo sapiens
aaacccgacagagggaaga

SEQ ID NO: 2504705 - DNA, 16 bp, Homo sapiens
aaacccttgaaaagac

SEQ ID NO: 2504706 - DNA, 23 bp, Homo sapiens
aaaccgccagcgaacttgacaat

SEQ ID NO: 2504707 - DNA, 19 bp, Homo sapiens
aaacctaagtcctttatgt

SEQ ID NO: 2504708 - DNA, 21 bp, Homo sapiens
aaacctccaaaactcctgccc

SEQ ID NO: 2504709 - DNA, 22 bp, Homo sapiens
aaacctctcctcatgttctgct

SEQ ID NO: 2504710 - DNA, 22 bp, Homo sapiens
aaacctgaaaaaaagtttacaa

SEQ ID NO: 2504711 - DNA, 14 bp, Homo sapiens
aaacctgatgttaa

SEQ ID NO: 2504712 - DNA, 19 bp, Homo sapiens
aaacctgatgttaaaattc

SEQ ID NO: 2504713 - DNA, 12 bp, Homo sapiens
aaacctgccctg

SEQ ID NO: 2504714 - DNA, 16 bp, Homo sapiens
aaaccttattgtacct

SEQ ID NO: 2504715 - DNA, 14 bp, Homo sapiens
aaaccttggtgtag

SEQ ID NO: 2504716 - DNA, 16 bp, Homo sapiens
aaaccttttttaagat

SEQ ID NO: 2504717 - DNA, 22 bp, Homo sapiens
aaaccttttttaagatttttct

SEQ ID NO: 2504718 - DNA, 15 bp, Homo sapiens
aaacgatttaattct

SEQ ID NO: 2504719 - DNA, 16 bp, Homo sapiens
aaacggattatttttt

SEQ ID NO: 2504720 - DNA, 18 bp, Homo sapiens
aaacggattattttttca

SEQ ID NO: 2504721 - DNA, 22 bp, Homo sapiens
aaacggattattttttcagacc

SEQ ID NO: 2504722 - DNA, 23 bp, Homo sapiens
aaacggattattttttcagaccg

SEQ ID NO: 2504723 - DNA, 18 bp, Homo sapiens
aaacgtcttattgtggta

SEQ ID NO: 2504724 - DNA, 16 bp, Homo sapiens
aaacgttttattgtgt

SEQ ID NO: 2504725 - DNA, 15 bp, Homo sapiens
aaactaaattgtaaa

SEQ ID NO: 2504726 - DNA, 11 bp, Homo sapiens
aaactatttat

SEQ ID NO: 2504727 - DNA, 18 bp, Homo sapiens
aaactcaaaacttaacat

SEQ ID NO: 2504728 - DNA, 11 bp, Homo sapiens
aaactcaaatg

SEQ ID NO: 2504729 - DNA, 16 bp, Homo sapiens
aaactcaccatgtaaa

SEQ ID NO: 2504730 - DNA, 18 bp, Homo sapiens
aaactcaccatgtaaaag

SEQ ID NO: 2504731 - DNA, 18 bp, Homo sapiens
aaactcacctgctggccc

SEQ ID NO: 2504732 - DNA, 23 bp, Homo sapiens
aaactcaggatggtcatcttgga

SEQ ID NO: 2504733 - DNA, 15 bp, Homo sapiens
aaactcatttcctat

SEQ ID NO: 2504734 - DNA, 23 bp, Homo sapiens
aaactcccacttgtcatgtgaca

SEQ ID NO: 2504735 - DNA, 11 bp, Homo sapiens
aaactcctgac

SEQ ID NO: 2504736 - DNA, 16 bp, Homo sapiens
aaactcgaggactgta

SEQ ID NO: 2504737 - DNA, 20 bp, Homo sapiens
aaactctaaacattaatcaa

SEQ ID NO: 2504738 - DNA, 21 bp, Homo sapiens
aaactctaaacattaatcaat

SEQ ID NO: 2504739 - DNA, 12 bp, Homo sapiens
aaactcttaaaa

SEQ ID NO: 2504740 - DNA, 15 bp, Homo sapiens
aaactcttatctcag

SEQ ID NO: 2504741 - DNA, 22 bp, Homo sapiens
aaactcttatctcagtcatgca

SEQ ID NO: 2504742 - DNA, 16 bp, Homo sapiens
aaactctttaacttct

SEQ ID NO: 2504743 - DNA, 13 bp, Homo sapiens
aaactcttttccc

SEQ ID NO: 2504744 - DNA, 12 bp, Homo sapiens
aaactgaaaatc

SEQ ID NO: 2504745 - DNA, 19 bp, Homo sapiens
aaactgaaaatctaatatt

SEQ ID NO: 2504746 - DNA, 16 bp, Homo sapiens
aaactgaagtctgaaa

SEQ ID NO: 2504747 - DNA, 18 bp, Homo sapiens
aaactgaggaattttctt

SEQ ID NO: 2504748 - DNA, 19 bp, Homo sapiens
aaactgaggaattttcttt

SEQ ID NO: 2504749 - DNA, 15 bp, Homo sapiens
aaactgcactgtcaa

SEQ ID NO: 2504750 - DNA, 17 bp, Homo sapiens
aaactgcattagaaatt

SEQ ID NO: 2504751 - DNA, 12 bp, Homo sapiens
aaaagaatattt

SEQ ID NO: 2504752 - DNA, 16 bp, Homo sapiens
aaaagaatgggcagtt

SEQ ID NO: 2504753 - DNA, 13 bp, Homo sapiens
aaaagaccagact

SEQ ID NO: 2504754 - DNA, 16 bp, Homo sapiens
aaaagactcagtgttc

SEQ ID NO: 2504755 - DNA, 13 bp, Homo sapiens
aaaagagaaaaga

SEQ ID NO: 2504756 - DNA, 14 bp, Homo sapiens
aaaagagatttcaa

SEQ ID NO: 2504757 - DNA, 17 bp, Homo sapiens
aaaagaggtttttctta

SEQ ID NO: 2504758 - DNA, 17 bp, Homo sapiens
aaaagataaagatgatc

SEQ ID NO: 2504759 - DNA, 18 bp, Homo sapiens
aaaagataaagatgatct

SEQ ID NO: 2504760 - DNA, 17 bp, Homo sapiens
aaaagatgaaaatattt

SEQ ID NO: 2504761 - DNA, 13 bp, Homo sapiens
aaaagattcattt

SEQ ID NO: 2504762 - DNA, 21 bp, Homo sapiens
aaaagattgaagtattttgct

SEQ ID NO: 2504763 - DNA, 21 bp, Homo sapiens
aaaagcacactcatcccctca

SEQ ID NO: 2504764 - DNA, 14 bp, Homo sapiens
aaaagcagctacca

SEQ ID NO: 2504765 - DNA, 16 bp, Homo sapiens
aaaagcagctctcccc

SEQ ID NO: 2504766 - DNA, 15 bp, Homo sapiens
aaaagcataaatgca

SEQ ID NO: 2504767 - DNA, 21 bp, Homo sapiens
aaaagcctcaactagtcattt

SEQ ID NO: 2504768 - DNA, 17 bp, Homo sapiens
aaaagctattagccagg

SEQ ID NO: 2504769 - DNA, 20 bp, Homo sapiens
aaaagctcttacactacatt

SEQ ID NO: 2504770 - DNA, 10 bp, Homo sapiens
aaaagctgat

SEQ ID NO: 2504771 - DNA, 14 bp, Homo sapiens
aaaagctttttatt

SEQ ID NO: 2504772 - DNA, 13 bp, Homo sapiens
aaaaggaagacta

SEQ ID NO: 2504773 - DNA, 16 bp, Homo sapiens
aaaaggacaatttcaa

SEQ ID NO: 2504774 - DNA, 14 bp, Homo sapiens
aaaaggcattgttt

SEQ ID NO: 2504775 - DNA, 14 bp, Homo sapiens
aaaaggccaaacct

SEQ ID NO: 2504776 - DNA, 22 bp, Homo sapiens
aaaaggccaaacctctgttcag

SEQ ID NO: 2504777 - DNA, 19 bp, Homo sapiens
aaaagggctctttagccag

SEQ ID NO: 2504778 - DNA, 21 bp, Homo sapiens
aaaagggtcttgggaaatatg

SEQ ID NO: 2504779 - DNA, 19 bp, Homo sapiens
aaaaggtatgcaatcaaat

SEQ ID NO: 2504780 - DNA, 17 bp, Homo sapiens
aaaaggttaataaagta

SEQ ID NO: 2504781 - DNA, 19 bp, Homo sapiens
aaaaggttcactaaagcag

SEQ ID NO: 2504782 - DNA, 23 bp, Homo sapiens
aaaagtaagtaccactcaggcca

SEQ ID NO: 2504783 - DNA, 13 bp, Homo sapiens
aaaagtacattta

SEQ ID NO: 2504784 - DNA, 17 bp, Homo sapiens
aaaagtacatttaatac

SEQ ID NO: 2504785 - DNA, 13 bp, Homo sapiens
aaaagtatatgtt

SEQ ID NO: 2504786 - DNA, 22 bp, Homo sapiens
aaaagtattattttccaaaagt

SEQ ID NO: 2504787 - DNA, 13 bp, Homo sapiens
aaaagtgacacag

SEQ ID NO: 2504788 - DNA, 14 bp, Homo sapiens
aaaagtgacacagc

SEQ ID NO: 2504789 - DNA, 15 bp, Homo sapiens
aaaagtgacacagca

SEQ ID NO: 2504790 - DNA, 23 bp, Homo sapiens
aaaagtgatcaataaaatgtgat

SEQ ID NO: 2504791 - DNA, 17 bp, Homo sapiens
aaaagtggcctctttgt

SEQ ID NO: 2504792 - DNA, 21 bp, Homo sapiens
aaaagtgggccagtgtgggaa

SEQ ID NO: 2504793 - DNA, 14 bp, Homo sapiens
aaaagttaaaaagt

SEQ ID NO: 2504794 - DNA, 22 bp, Homo sapiens
aaaagtttacaagtgtatatca

SEQ ID NO: 2504795 - DNA, 12 bp, Homo sapiens
aaaagtttccat

SEQ ID NO: 2504796 - DNA, 16 bp, Homo sapiens
aaaataaaaaaaagaa

SEQ ID NO: 2504797 - DNA, 18 bp, Homo sapiens
aaaataaaaaaaagaaaa

SEQ ID NO: 2504798 - DNA, 15 bp, Homo sapiens
aaaataaaaagttaa

SEQ ID NO: 2504799 - DNA, 13 bp, Homo sapiens
aaaataaaaatgg

SEQ ID NO: 2504800 - DNA, 12 bp, Homo sapiens
aaaataaataaa

SEQ ID NO: 2504801 - DNA, 14 bp, Homo sapiens
aaaataacacacat

SEQ ID NO: 2504802 - DNA, 16 bp, Homo sapiens
aaaataacttcaagca

SEQ ID NO: 2504803 - DNA, 22 bp, Homo sapiens
aaaataagaaaagatgtagatt

SEQ ID NO: 2504804 - DNA, 13 bp, Homo sapiens
aaaataattctaa

SEQ ID NO: 2504805 - DNA, 17 bp, Homo sapiens
aaaatacataagaccat

SEQ ID NO: 2504806 - DNA, 14 bp, Homo sapiens
aaaatacattttat

SEQ ID NO: 2504807 - DNA, 14 bp, Homo sapiens
aaaataccagccag

SEQ ID NO: 2504808 - DNA, 14 bp, Homo sapiens
aaaatactgccaga

SEQ ID NO: 2504809 - DNA, 21 bp, Homo sapiens
aaaatagcaacactctatatt

SEQ ID NO: 2504810 - DNA, 23 bp, Homo sapiens
aaaatagcaacctttttatctcc

SEQ ID NO: 2504811 - DNA, 17 bp, Homo sapiens
aaaatagcaatcctaaa

SEQ ID NO: 2504812 - DNA, 13 bp, Homo sapiens
aaaatagcttgta

SEQ ID NO: 2504813 - DNA, 11 bp, Homo sapiens
aaaatatgcat

SEQ ID NO: 2504814 - DNA, 15 bp, Homo sapiens
aaaatattcctgcat

SEQ ID NO: 2504815 - DNA, 16 bp, Homo sapiens
aaaatattttcctgcc

SEQ ID NO: 2504816 - DNA, 18 bp, Homo sapiens
aaggcgtggagctgcctg

SEQ ID NO: 2504817 - DNA, 19 bp, Homo sapiens
aaggctacctttgtattct

SEQ ID NO: 2504818 - DNA, 16 bp, Homo sapiens
aaggctcagtctcagg

SEQ ID NO: 2504819 - DNA, 14 bp, Homo sapiens
aaggctccaggagc

SEQ ID NO: 2504820 - DNA, 18 bp, Homo sapiens
aaggctcgagcatgcctg

SEQ ID NO: 2504821 - DNA, 20 bp, Homo sapiens
aaggctcgagcatgcctgga

SEQ ID NO: 2504822 - DNA, 17 bp, Homo sapiens
aaggctcttctccccag

SEQ ID NO: 2504823 - DNA, 15 bp, Homo sapiens
aaggctgaccaagag

SEQ ID NO: 2504824 - DNA, 19 bp, Homo sapiens
aaggctgaccaagagagaa

SEQ ID NO: 2504825 - DNA, 17 bp, Homo sapiens
aaggctgaggaaaggcc

SEQ ID NO: 2504826 - DNA, 19 bp, Homo sapiens
aaggctgtgtacactgaca

SEQ ID NO: 2504827 - DNA, 13 bp, Homo sapiens
aaggctgttgcat

SEQ ID NO: 2504828 - DNA, 23 bp, Homo sapiens
aaggctgttgcatgggctaatga

SEQ ID NO: 2504829 - DNA, 17 bp, Homo sapiens
aaggcttctctctgtgg

SEQ ID NO: 2504830 - DNA, 18 bp, Homo sapiens
aaggcttctctctgtggg

SEQ ID NO: 2504831 - DNA, 15 bp, Homo sapiens
aagggaaatatcatt

SEQ ID NO: 2504832 - DNA, 23 bp, Homo sapiens
aagggaacagtgaggtgcccagc

SEQ ID NO: 2504833 - DNA, 16 bp, Homo sapiens
aagggacatgttttga

SEQ ID NO: 2504834 - DNA, 18 bp, Homo sapiens
aagggagctatcaggaac

SEQ ID NO: 2504835 - DNA, 18 bp, Homo sapiens
aagggattacccaagcaa

SEQ ID NO: 2504836 - DNA, 22 bp, Homo sapiens
aagggattttagtcacacgtgg

SEQ ID NO: 2504837 - DNA, 18 bp, Homo sapiens
aagggcagaacactaacc

SEQ ID NO: 2504838 - DNA, 23 bp, Homo sapiens
aagggcattggccattctattgt

SEQ ID NO: 2504839 - DNA, 14 bp, Homo sapiens
aagggccagtcctg

SEQ ID NO: 2504840 - DNA, 16 bp, Homo sapiens
aagggccagtcctgcc

SEQ ID NO: 2504841 - DNA, 19 bp, Homo sapiens
aagggccatgctgaaggga

SEQ ID NO: 2504842 - DNA, 13 bp, Homo sapiens
aagggcccagaga

SEQ ID NO: 2504843 - DNA, 15 bp, Homo sapiens
aagggcccagagagg

SEQ ID NO: 2504844 - DNA, 16 bp, Homo sapiens
aagggcccagattcta

SEQ ID NO: 2504845 - DNA, 20 bp, Homo sapiens
aagggcccttcactgccttt

SEQ ID NO: 2504846 - DNA, 17 bp, Homo sapiens
aagggcctggcctgagc

SEQ ID NO: 2504847 - DNA, 19 bp, Homo sapiens
aagggcctggcctgagctg

SEQ ID NO: 2504848 - DNA, 21 bp, Homo sapiens
aagggcttacacgtggaggaa

SEQ ID NO: 2504849 - DNA, 16 bp, Homo sapiens
aaggggacccccgccc

SEQ ID NO: 2504850 - DNA, 15 bp, Homo sapiens
aaggggcccgtggga

SEQ ID NO: 2504851 - DNA, 14 bp, Homo sapiens
aaggggccctggtc

SEQ ID NO: 2504852 - DNA, 23 bp, Homo sapiens
aagggggctgggacatgggaaag

SEQ ID NO: 2504853 - DNA, 19 bp, Homo sapiens
aagggggtcccagtgggag

SEQ ID NO: 2504854 - DNA, 17 bp, Homo sapiens
aagggtatcaggtgctg

SEQ ID NO: 2504855 - DNA, 19 bp, Homo sapiens
aagggtatcaggtgctgcc

SEQ ID NO: 2504856 - DNA, 16 bp, Homo sapiens
aagggtatctggtgac

SEQ ID NO: 2504857 - DNA, 20 bp, Homo sapiens
aagggtgctgcttccctctg

SEQ ID NO: 2504858 - DNA, 16 bp, Homo sapiens
aagggttttaatgtag

SEQ ID NO: 2504859 - DNA, 16 bp, Homo sapiens
aaggtaaaattgaaag

SEQ ID NO: 2504860 - DNA, 11 bp, Homo sapiens
aaggtataatt

SEQ ID NO: 2504861 - DNA, 22 bp, Homo sapiens
aaggtattaaattgatgttgct

SEQ ID NO: 2504862 - DNA, 18 bp, Homo sapiens
aaggtattccttttgtgt

SEQ ID NO: 2504863 - DNA, 14 bp, Homo sapiens
aaggtcggaccagc

SEQ ID NO: 2504864 - DNA, 18 bp, Homo sapiens
aaggtcggaggcttggga

SEQ ID NO: 2504865 - DNA, 22 bp, Homo sapiens
aaggtcggaggcttgggaccgc

SEQ ID NO: 2504866 - DNA, 17 bp, Homo sapiens
aaggtgacccaatgatt

SEQ ID NO: 2504867 - DNA, 17 bp, Homo sapiens
aaggtgggccttgctac

SEQ ID NO: 2504868 - DNA, 18 bp, Homo sapiens
aaggtgggctgagccctg

SEQ ID NO: 2504869 - DNA, 21 bp, Homo sapiens
aaggtgggctgagccctggca

SEQ ID NO: 2504870 - DNA, 16 bp, Homo sapiens
aaggtggggacaggga

SEQ ID NO: 2504871 - DNA, 17 bp, Homo sapiens
aaggtggtatgtgtgtg

SEQ ID NO: 2504872 - DNA, 18 bp, Homo sapiens
aaggtgtcagaataataa

SEQ ID NO: 2504873 - DNA, 16 bp, Homo sapiens
aaggttccctctgaga

SEQ ID NO: 2504874 - DNA, 23 bp, Homo sapiens
aaggttccgcttggagcagaggg

SEQ ID NO: 2504875 - DNA, 18 bp, Homo sapiens
aaggttctggtgtgaact

SEQ ID NO: 2504876 - DNA, 23 bp, Homo sapiens
aaggtttcagaaagaagtgggga

SEQ ID NO: 2504877 - DNA, 21 bp, Homo sapiens
aaggtttcgtttctgtataca

SEQ ID NO: 2504878 - DNA, 16 bp, Homo sapiens
aaggtttctgaaaatt

SEQ ID NO: 2504879 - DNA, 14 bp, Homo sapiens
aagtaaaaccacag

SEQ ID NO: 2504880 - DNA, 15 bp, Homo sapiens
aagtaaaaccacagc

SEQ ID NO: 2504881 - DNA, 18 bp, Homo sapiens
aagtaaaaccacagcagt

SEQ ID NO: 2504882 - DNA, 14 bp, Homo sapiens
aagtaagaagacat

SEQ ID NO: 2504883 - DNA, 18 bp, Homo sapiens
aagtaaggtgcagttccc

SEQ ID NO: 2504884 - DNA, 21 bp, Homo sapiens
aagtaatccacctgcctcggc

SEQ ID NO: 2504885 - DNA, 15 bp, Homo sapiens
aagtaattatcggga

SEQ ID NO: 2504886 - DNA, 22 bp, Homo sapiens
aagtaattatcgggaacagtgt

SEQ ID NO: 2504887 - DNA, 23 bp, Homo sapiens
aagtaattatcgggaacagtgtt

SEQ ID NO: 2504888 - DNA, 16 bp, Homo sapiens
aagtaattgtgaaaaa

SEQ ID NO: 2504889 - DNA, 19 bp, Homo sapiens
aagtacactgtttcaaact

SEQ ID NO: 2504890 - DNA, 12 bp, Homo sapiens
aagtacatttaa

SEQ ID NO: 2504891 - DNA, 18 bp, Homo sapiens
aagtacccgttcacattt

SEQ ID NO: 2504892 - DNA, 16 bp, Homo sapiens
aagtactatgtatcaa

SEQ ID NO: 2504893 - DNA, 20 bp, Homo sapiens
aagtagaagtcttagatgta

SEQ ID NO: 2504894 - DNA, 18 bp, Homo sapiens
aagtagtaaaaattaaaa

SEQ ID NO: 2504895 - DNA, 19 bp, Homo sapiens
aagtagtaaaaattaaaaa

SEQ ID NO: 2504896 - DNA, 20 bp, Homo sapiens
aagtagtttgtataacttct

SEQ ID NO: 2504897 - DNA, 12 bp, Homo sapiens
aagtatataatg

SEQ ID NO: 2504898 - DNA, 18 bp, Homo sapiens
aagtatataatggtttca

SEQ ID NO: 2504899 - DNA, 14 bp, Homo sapiens
aagtatcatgcatt

SEQ ID NO: 2504900 - DNA, 15 bp, Homo sapiens
aagtatcatgcattc

SEQ ID NO: 2504901 - DNA, 18 bp, Homo sapiens
aagtatccctactgtaat

SEQ ID NO: 2504902 - DNA, 18 bp, Homo sapiens
aagtatcctgcttctgat

SEQ ID NO: 2504903 - DNA, 17 bp, Homo sapiens
aagtatctacatgcggt

SEQ ID NO: 2504904 - DNA, 13 bp, Homo sapiens
aagtatgtaaaca

SEQ ID NO: 2504905 - DNA, 16 bp, Homo sapiens
aagtatgttttagcat

SEQ ID NO: 2504906 - DNA, 19 bp, Homo sapiens
aagtattatacctttttta

SEQ ID NO: 2504907 - DNA, 13 bp, Homo sapiens
aagtattatcaga

SEQ ID NO: 2504908 - DNA, 14 bp, Homo sapiens
aagtatttatatat

SEQ ID NO: 2504909 - DNA, 15 bp, Homo sapiens
aagtatttatatatt

SEQ ID NO: 2504910 - DNA, 23 bp, Homo sapiens
aagtatttatatatttataactc

SEQ ID NO: 2504911 - DNA, 22 bp, Homo sapiens
aagtatttcaaattggagcttc

SEQ ID NO: 2504912 - DNA, 17 bp, Homo sapiens
aagtattttcataagta

SEQ ID NO: 2504913 - DNA, 18 bp, Homo sapiens
aagtattttcctgtaaaa

SEQ ID NO: 2504914 - DNA, 16 bp, Homo sapiens
aagtcaacctgcctga

SEQ ID NO: 2504915 - DNA, 18 bp, Homo sapiens
aagtcaatgttttcagtt

SEQ ID NO: 2504916 - DNA, 14 bp, Homo sapiens
aagtcaccggagct

SEQ ID NO: 2504917 - DNA, 16 bp, Homo sapiens
aagtcagactgctggg

SEQ ID NO: 2504918 - DNA, 17 bp, Homo sapiens
aagtcagactgctggga

SEQ ID NO: 2504919 - DNA, 15 bp, Homo sapiens
aagtcagaggatggc

SEQ ID NO: 2504920 - DNA, 21 bp, Homo sapiens
aagtcagaggatggccagtgt

SEQ ID NO: 2504921 - DNA, 22 bp, Homo sapiens
aagtcagaggatggccagtgtc

SEQ ID NO: 2504922 - DNA, 13 bp, Homo sapiens
aagtcagatgtgg

SEQ ID NO: 2504923 - DNA, 15 bp, Homo sapiens
aagtcaggtccaatt

SEQ ID NO: 2504924 - DNA, 16 bp, Homo sapiens
aagtcaggtccaattt

SEQ ID NO: 2504925 - DNA, 23 bp, Homo sapiens
aagtcatgaagcccaagtgaaat

SEQ ID NO: 2504926 - DNA, 16 bp, Homo sapiens
aagtcattttaacttt

SEQ ID NO: 2504927 - DNA, 17 bp, Homo sapiens
aagtccaagcataccaa

SEQ ID NO: 2504928 - DNA, 22 bp, Homo sapiens
aagtccctgtaattgttgtttg

SEQ ID NO: 2504929 - DNA, 22 bp, Homo sapiens
aagtcctcttttctgagaggac

SEQ ID NO: 2504930 - DNA, 13 bp, Homo sapiens
aagtcctgaagag

SEQ ID NO: 2504931 - DNA, 17 bp, Homo sapiens
aagtcctgaagaggcgg

SEQ ID NO: 2504932 - DNA, 16 bp, Homo sapiens
aagtctaaatatttcc

SEQ ID NO: 2504933 - DNA, 14 bp, Homo sapiens
aagtctccttcccc

SEQ ID NO: 2504934 - DNA, 15 bp, Homo sapiens
aagtctctgctggcc

SEQ ID NO: 2504935 - DNA, 21 bp, Homo sapiens
aagtctgcaactttaagcagc

SEQ ID NO: 2504936 - DNA, 22 bp, Homo sapiens
aagtctgtgagattcattcatg

SEQ ID NO: 2504937 - DNA, 16 bp, Homo sapiens
aagtctgttttatgac

SEQ ID NO: 2504938 - DNA, 18 bp, Homo sapiens
aagtcttaaaataactta

SEQ ID NO: 2504939 - DNA, 18 bp, Homo sapiens
aagtcttagatgtatata

SEQ ID NO: 2504940 - DNA, 17 bp, Homo sapiens
aagtcttatcaagcagc

SEQ ID NO: 2504941 - DNA, 18 bp, Homo sapiens
aagtcttccctgatcaag

SEQ ID NO: 2504942 - DNA, 22 bp, Homo sapiens
aagtcttccctgatcaagtcac

SEQ ID NO: 2504943 - DNA, 21 bp, Homo sapiens
aagtgaaaaaggaggaagaga

SEQ ID NO: 2504944 - DNA, 17 bp, Homo sapiens
aagtgaagacaatgact

SEQ ID NO: 2504945 - DNA, 16 bp, Homo sapiens
aagtgaatttgaatga

SEQ ID NO: 2504946 - DNA, 16 bp, Homo sapiens
aagtgacaaggcccca

SEQ ID NO: 2504947 - DNA, 19 bp, Homo sapiens
aagtgacaaggccccagag

SEQ ID NO: 2504948 - DNA, 20 bp, Homo sapiens
aagtgacaaggccccagaga

SEQ ID NO: 2504949 - DNA, 24 bp, Homo sapiens
aagtgacacagcagcttcaccaga

SEQ ID NO: 2504950 - DNA, 22 bp, Homo sapiens
aagtgacagggaagctacaggt

SEQ ID NO: 2504951 - DNA, 23 bp, Homo sapiens
aagtgacagggaagctacaggtt

SEQ ID NO: 2504952 - DNA, 11 bp, Homo sapiens
aagtgaggaag

SEQ ID NO: 2504953 - DNA, 22 bp, Homo sapiens
aagtgagggccgagtgagagcg

SEQ ID NO: 2504954 - DNA, 20 bp, Homo sapiens
aagtgatcctcccacctcag

SEQ ID NO: 2504955 - DNA, 17 bp, Homo sapiens
aagtgattctcctgcct

SEQ ID NO: 2504956 - DNA, 19 bp, Homo sapiens
aagtgattctcctgcctca

SEQ ID NO: 2504957 - DNA, 18 bp, Homo sapiens
aagtgattgggacagagg

SEQ ID NO: 2504958 - DNA, 15 bp, Homo sapiens
aagtgattgttggca

SEQ ID NO: 2504959 - DNA, 17 bp, Homo sapiens
aagtgcaggctggcacc

SEQ ID NO: 2504960 - DNA, 16 bp, Homo sapiens
aagtgcatccaaaggt

SEQ ID NO: 2504961 - DNA, 21 bp, Homo sapiens
aagtgccactcattcctgtag

SEQ ID NO: 2504962 - DNA, 23 bp, Homo sapiens
aagtgccactgcccgagctggtg

SEQ ID NO: 2504963 - DNA, 14 bp, Homo sapiens
aagtgccagaggtg

SEQ ID NO: 2504964 - DNA, 15 bp, Homo sapiens
aagtgccagaggtgg

SEQ ID NO: 2504965 - DNA, 19 bp, Homo sapiens
aagtgccagaggtgggcag

SEQ ID NO: 2504966 - DNA, 12 bp, Homo sapiens
aagccctgaggg

SEQ ID NO: 2504967 - DNA, 19 bp, Homo sapiens
aagccctggagccaactgc

SEQ ID NO: 2504968 - DNA, 18 bp, Homo sapiens
aagccctgtcgagacact

SEQ ID NO: 2504969 - DNA, 14 bp, Homo sapiens
aagccgggaacaga

SEQ ID NO: 2504970 - DNA, 14 bp, Homo sapiens
aagcctacctgctc

SEQ ID NO: 2504971 - DNA, 16 bp, Homo sapiens
aagcctacctgctctc

SEQ ID NO: 2504972 - DNA, 13 bp, Homo sapiens
aagcctcagagaa

SEQ ID NO: 2504973 - DNA, 15 bp, Homo sapiens
aagcctcctccagcc

SEQ ID NO: 2504974 - DNA, 15 bp, Homo sapiens
aagcctgaggctggg

SEQ ID NO: 2504975 - DNA, 22 bp, Homo sapiens
aagcctgcacaataaaaatgtt

SEQ ID NO: 2504976 - DNA, 14 bp, Homo sapiens
aagcctgcaggagt

SEQ ID NO: 2504977 - DNA, 23 bp, Homo sapiens
aagcctgcctaggaattcccagc

SEQ ID NO: 2504978 - DNA, 16 bp, Homo sapiens
aagcctgttcccctca

SEQ ID NO: 2504979 - DNA, 20 bp, Homo sapiens
aagcctgttcccctcactgg

SEQ ID NO: 2504980 - DNA, 16 bp, Homo sapiens
aagccttatcaagtgt

SEQ ID NO: 2504981 - DNA, 16 bp, Homo sapiens
aagccttcattgcctt

SEQ ID NO: 2504982 - DNA, 14 bp, Homo sapiens
aagcctttccataa

SEQ ID NO: 2504983 - DNA, 16 bp, Homo sapiens
aagcctttttccccaa

SEQ ID NO: 2504984 - DNA, 15 bp, Homo sapiens
aagcgattcttctgc

SEQ ID NO: 2504985 - DNA, 23 bp, Homo sapiens
aagcgtgaaggccgagaagcaag

SEQ ID NO: 2504986 - DNA, 21 bp, Homo sapiens
aagctaaatcctttactgtta

SEQ ID NO: 2504987 - DNA, 18 bp, Homo sapiens
aagctacaggttacaaca

SEQ ID NO: 2504988 - DNA, 19 bp, Homo sapiens
aagctacaggttacaacag

SEQ ID NO: 2504989 - DNA, 20 bp, Homo sapiens
aagctacaggttacaacaga

SEQ ID NO: 2504990 - DNA, 19 bp, Homo sapiens
aagctagaaggccacatgt

SEQ ID NO: 2504991 - DNA, 18 bp, Homo sapiens
aagctaggcctggccaga

SEQ ID NO: 2504992 - DNA, 22 bp, Homo sapiens
aagctaggcctggccagatgca

SEQ ID NO: 2504993 - DNA, 20 bp, Homo sapiens
aagctatagacccgaggaaa

SEQ ID NO: 2504994 - DNA, 22 bp, Homo sapiens
aagctatatcaatctctcttag

SEQ ID NO: 2504995 - DNA, 22 bp, Homo sapiens
aagctatggtgagatgcagctg

SEQ ID NO: 2504996 - DNA, 22 bp, Homo sapiens
aagctcacctgttgcttacaat

SEQ ID NO: 2504997 - DNA, 14 bp, Homo sapiens
aagctcacttctgg

SEQ ID NO: 2504998 - DNA, 23 bp, Homo sapiens
aagctcacttctgggcttcatct

SEQ ID NO: 2504999 - DNA, 16 bp, Homo sapiens
aagctcagaaggctct

SEQ ID NO: 2505000 - DNA, 16 bp, Homo sapiens
aagctcagcccacccc

SEQ ID NO: 2505001 - DNA, 21 bp, Homo sapiens
aagctcagcccacccccctca

SEQ ID NO: 2505002 - DNA, 17 bp, Homo sapiens
aagctcagctactgatt

SEQ ID NO: 2505003 - DNA, 12 bp, Homo sapiens
aagctcagggcc

SEQ ID NO: 2505004 - DNA, 19 bp, Homo sapiens
aagctcagggcctggctca

SEQ ID NO: 2505005 - DNA, 20 bp, Homo sapiens
aagctcagggcctggctcag

SEQ ID NO: 2505006 - DNA, 16 bp, Homo sapiens
aagctccactgtcacc

SEQ ID NO: 2505007 - DNA, 19 bp, Homo sapiens
aagctccactgtcaccctc

SEQ ID NO: 2505008 - DNA, 13 bp, Homo sapiens
aagctcccaggaa

SEQ ID NO: 2505009 - DNA, 16 bp, Homo sapiens
aagctcccaggaacaa

SEQ ID NO: 2505010 - DNA, 12 bp, Homo sapiens
aagctcccaggc

SEQ ID NO: 2505011 - DNA, 23 bp, Homo sapiens
aagctcccaggcattccccagga

SEQ ID NO: 2505012 - DNA, 14 bp, Homo sapiens
aagctcccaggccg

SEQ ID NO: 2505013 - DNA, 14 bp, Homo sapiens
aagctcctgtcctc

SEQ ID NO: 2505014 - DNA, 21 bp, Homo sapiens
aagctctactgaggtgctatg

SEQ ID NO: 2505015 - DNA, 13 bp, Homo sapiens
aagctctgctcct

SEQ ID NO: 2505016 - DNA, 11 bp, Homo sapiens
aagctctggct

SEQ ID NO: 2505017 - DNA, 23 bp, Homo sapiens
aagctctggctgaaccctgtgct

SEQ ID NO: 2505018 - DNA, 12 bp, Homo sapiens
aagctgaaaata

SEQ ID NO: 2505019 - DNA, 17 bp, Homo sapiens
aagctgaagtgcatcca

SEQ ID NO: 2505020 - DNA, 19 bp, Homo sapiens
aagctgaagtgcatccaaa

SEQ ID NO: 2505021 - DNA, 22 bp, Homo sapiens
aagctgaagtttcactccggag

SEQ ID NO: 2505022 - DNA, 13 bp, Homo sapiens
aagctgaatacat

SEQ ID NO: 2505023 - DNA, 23 bp, Homo sapiens
aagctgaatacattctgctttca

SEQ ID NO: 2505024 - DNA, 17 bp, Homo sapiens
aagctgacgaacttcca

SEQ ID NO: 2505025 - DNA, 17 bp, Homo sapiens
aagctgaggcgggagaa

SEQ ID NO: 2505026 - DNA, 13 bp, Homo sapiens
aagctgcaccctc

SEQ ID NO: 2505027 - DNA, 22 bp, Homo sapiens
aagctgcaccctcaggcaggtg

SEQ ID NO: 2505028 - DNA, 12 bp, Homo sapiens
aagctgcctgct

SEQ ID NO: 2505029 - DNA, 19 bp, Homo sapiens
aagctgcctgtagttagga

SEQ ID NO: 2505030 - DNA, 11 bp, Homo sapiens
aagctgggcag

SEQ ID NO: 2505031 - DNA, 18 bp, Homo sapiens
aagctgggccccagccca

SEQ ID NO: 2505032 - DNA, 19 bp, Homo sapiens
aagctgggccccagcccac

SEQ ID NO: 2505033 - DNA, 17 bp, Homo sapiens
aagctggtaaactattt

SEQ ID NO: 2505034 - DNA, 21 bp, Homo sapiens
aagctggtcccactcagtcca

SEQ ID NO: 2505035 - DNA, 22 bp, Homo sapiens
aagctgtgagacagtgggaaat

SEQ ID NO: 2505036 - DNA, 13 bp, Homo sapiens
aagctgtggccag

SEQ ID NO: 2505037 - DNA, 18 bp, Homo sapiens
aagctgttactgtcttca

SEQ ID NO: 2505038 - DNA, 22 bp, Homo sapiens
aagctgttgatggtaggtggca

SEQ ID NO: 2505039 - DNA, 17 bp, Homo sapiens
aagctgttgtacattta

SEQ ID NO: 2505040 - DNA, 21 bp, Homo sapiens
aagctgttgtacatttatgat

SEQ ID NO: 2505041 - DNA, 15 bp, Homo sapiens
aagctgtttccatag

SEQ ID NO: 2505042 - DNA, 13 bp, Homo sapiens
aagcttagcagga

SEQ ID NO: 2505043 - DNA, 18 bp, Homo sapiens
aagcttattaaaactcat

SEQ ID NO: 2505044 - DNA, 15 bp, Homo sapiens
aagcttcagtttcct

SEQ ID NO: 2505045 - DNA, 14 bp, Homo sapiens
aagcttgctcacat

SEQ ID NO: 2505046 - DNA, 21 bp, Homo sapiens
aagcttgtgtatccattatca

SEQ ID NO: 2505047 - DNA, 23 bp, Homo sapiens
aagcttgtgtatccattatcatg

SEQ ID NO: 2505048 - DNA, 22 bp, Homo sapiens
aagctttatacgtgtagctata

SEQ ID NO: 2505049 - DNA, 23 bp, Homo sapiens
aagctttttattcctcctgctca

SEQ ID NO: 2505050 - DNA, 15 bp, Homo sapiens
aaggaaaaaatgttg

SEQ ID NO: 2505051 - DNA, 18 bp, Homo sapiens
aaggaaaccacagctgct

SEQ ID NO: 2505052 - DNA, 17 bp, Homo sapiens
aaggaaacccagctctg

SEQ ID NO: 2505053 - DNA, 22 bp, Homo sapiens
aaggaaacccagctctggtcca

SEQ ID NO: 2505054 - DNA, 19 bp, Homo sapiens
aaggaaactcttatctcag

SEQ ID NO: 2505055 - DNA, 21 bp, Homo sapiens
aaggaaacttgaatcaaagca

SEQ ID NO: 2505056 - DNA, 13 bp, Homo sapiens
aaggaaaggcaaa

SEQ ID NO: 2505057 - DNA, 18 bp, Homo sapiens
aaggaactctggcttcca

SEQ ID NO: 2505058 - DNA, 22 bp, Homo sapiens
aaggaactctggcttccaggta

SEQ ID NO: 2505059 - DNA, 13 bp, Homo sapiens
aaggaaggaaaga

SEQ ID NO: 2505060 - DNA, 21 bp, Homo sapiens
aaggaaggctcttctccccag

SEQ ID NO: 2505061 - DNA, 16 bp, Homo sapiens
aaggaaggttctggtg

SEQ ID NO: 2505062 - DNA, 17 bp, Homo sapiens
aaggaatacctgtcccc

SEQ ID NO: 2505063 - DNA, 18 bp, Homo sapiens
aaggaatacctgtccccc

SEQ ID NO: 2505064 - DNA, 22 bp, Homo sapiens
aaggaatccactcccaggcagc

SEQ ID NO: 2505065 - DNA, 21 bp, Homo sapiens
aaggaatgtagctggtttcct

SEQ ID NO: 2505066 - DNA, 17 bp, Homo sapiens
aaggacaaaaatgaact

SEQ ID NO: 2505067 - DNA, 13 bp, Homo sapiens
aaggacactagaa

SEQ ID NO: 2505068 - DNA, 13 bp, Homo sapiens
aaggaccaggact

SEQ ID NO: 2505069 - DNA, 13 bp, Homo sapiens
aaggacccctcac

SEQ ID NO: 2505070 - DNA, 21 bp, Homo sapiens
aaggacggccttcaactgaaa

SEQ ID NO: 2505071 - DNA, 21 bp, Homo sapiens
aaggactacgttaagggaagg

SEQ ID NO: 2505072 - DNA, 22 bp, Homo sapiens
aaggactgccgaccgaggctgg

SEQ ID NO: 2505073 - DNA, 23 bp, Homo sapiens
aaggactgttttttcctgagctt

SEQ ID NO: 2505074 - DNA, 17 bp, Homo sapiens
aaggacttgaaagcatc

SEQ ID NO: 2505075 - DNA, 19 bp, Homo sapiens
aaggacttgaaagcatcca

SEQ ID NO: 2505076 - DNA, 17 bp, Homo sapiens
aaggacttgacttgcaa

SEQ ID NO: 2505077 - DNA, 15 bp, Homo sapiens
aaggagatgaagcaa

SEQ ID NO: 2505078 - DNA, 18 bp, Homo sapiens
aaggaggaagagaaaaaa

SEQ ID NO: 2505079 - DNA, 20 bp, Homo sapiens
aaggaggaagagaaaaaata

SEQ ID NO: 2505080 - DNA, 12 bp, Homo sapiens
aaggagggtgag

SEQ ID NO: 2505081 - DNA, 19 bp, Homo sapiens
aaggagggttagggagggg

SEQ ID NO: 2505082 - DNA, 22 bp, Homo sapiens
aaggatcagaacagcagaggtt

SEQ ID NO: 2505083 - DNA, 16 bp, Homo sapiens
aaggatctctcaggag

SEQ ID NO: 2505084 - DNA, 20 bp, Homo sapiens
aaggatctctcaggagcaca

SEQ ID NO: 2505085 - DNA, 21 bp, Homo sapiens
aaggatctgtttttaaaaatc

SEQ ID NO: 2505086 - DNA, 18 bp, Homo sapiens
aaggatgcacagagttgt

SEQ ID NO: 2505087 - DNA, 17 bp, Homo sapiens
aaggatgcttgtacata

SEQ ID NO: 2505088 - DNA, 17 bp, Homo sapiens
aaggatgtcacagggcc

SEQ ID NO: 2505089 - DNA, 15 bp, Homo sapiens
aaggattgctactgt

SEQ ID NO: 2505090 - DNA, 13 bp, Homo sapiens
aaggattgtaaaa

SEQ ID NO: 2505091 - DNA, 12 bp, Homo sapiens
aaggattttatg

SEQ ID NO: 2505092 - DNA, 13 bp, Homo sapiens
aaggattttatgc

SEQ ID NO: 2505093 - DNA, 16 bp, Homo sapiens
aaggattttatgcttt

SEQ ID NO: 2505094 - DNA, 23 bp, Homo sapiens
aaggattttatgctttaaacatt

SEQ ID NO: 2505095 - DNA, 15 bp, Homo sapiens
aaggcaaacccatca

SEQ ID NO: 2505096 - DNA, 14 bp, Homo sapiens
aaggcaaatgactt

SEQ ID NO: 2505097 - DNA, 16 bp, Homo sapiens
aaggcaaatgcccaag

SEQ ID NO: 2505098 - DNA, 20 bp, Homo sapiens
aaggcaagtttctagctaga

SEQ ID NO: 2505099 - DNA, 22 bp, Homo sapiens
aaggcacctataaaacaggtca

SEQ ID NO: 2505100 - DNA, 21 bp, Homo sapiens
aaggcactctgttatttagac

SEQ ID NO: 2505101 - DNA, 12 bp, Homo sapiens
aaggcaggaaga

SEQ ID NO: 2505102 - DNA, 20 bp, Homo sapiens
aaggcatatcagtctctgag

SEQ ID NO: 2505103 - DNA, 12 bp, Homo sapiens
aaggcatgaagg

SEQ ID NO: 2505104 - DNA, 12 bp, Homo sapiens
aaggcattctct

SEQ ID NO: 2505105 - DNA, 17 bp, Homo sapiens
aaggccaaacctctgtt

SEQ ID NO: 2505106 - DNA, 21 bp, Homo sapiens
aaggccaataaagagttagaa

SEQ ID NO: 2505107 - DNA, 19 bp, Homo sapiens
aaggccagagtggcctggc

SEQ ID NO: 2505108 - DNA, 23 bp, Homo sapiens
aaggccagagtggcctggccagg

SEQ ID NO: 2505109 - DNA, 14 bp, Homo sapiens
aaggccagctggca

SEQ ID NO: 2505110 - DNA, 17 bp, Homo sapiens
aaggccagctggcagca

SEQ ID NO: 2505111 - DNA, 21 bp, Homo sapiens
aaggccatggagagctggagc

SEQ ID NO: 2505112 - DNA, 19 bp, Homo sapiens
aaggccgaagctctggctg

SEQ ID NO: 2505113 - DNA, 20 bp, Homo sapiens
aaggccgaagctctggctga

SEQ ID NO: 2505114 - DNA, 23 bp, Homo sapiens
aaggcgatcccatcttgataaga

SEQ ID NO: 2505115 - DNA, 16 bp, Homo sapiens
aaggcgtggagctgcc

SEQ ID NO: 2505116 - DNA, 15 bp, Homo sapiens
aagagaggagttcaa

SEQ ID NO: 2505117 - DNA, 19 bp, Homo sapiens
aagagaggagttcaatgat

SEQ ID NO: 2505118 - DNA, 11 bp, Homo sapiens
aagagaggtta

SEQ ID NO: 2505119 - DNA, 14 bp, Homo sapiens
aagagagtcataaa

SEQ ID NO: 2505120 - DNA, 20 bp, Homo sapiens
aagagagtcataaaccttaa

SEQ ID NO: 2505121 - DNA, 12 bp, Homo sapiens
aagagatatttt

SEQ ID NO: 2505122 - DNA, 13 bp, Homo sapiens
aagagatgaagag

SEQ ID NO: 2505123 - DNA, 13 bp, Homo sapiens
aagagatttcaag

SEQ ID NO: 2505124 - DNA, 13 bp, Homo sapiens
aagagatttttca

SEQ ID NO: 2505125 - DNA, 16 bp, Homo sapiens
aagagcagcctgtggc

SEQ ID NO: 2505126 - DNA, 17 bp, Homo sapiens
aagagcagcctgtggca

SEQ ID NO: 2505127 - DNA, 19 bp, Homo sapiens
aagagcagcctgtggcatc

SEQ ID NO: 2505128 - DNA, 20 bp, Homo sapiens
aagagcctgcaggtgctgct

SEQ ID NO: 2505129 - DNA, 22 bp, Homo sapiens
aagagcctgcaggtgctgctgc

SEQ ID NO: 2505130 - DNA, 22 bp, Homo sapiens
aagaggagagaggaagctctct

SEQ ID NO: 2505131 - DNA, 20 bp, Homo sapiens
aagaggagtttcgaggtaga

SEQ ID NO: 2505132 - DNA, 16 bp, Homo sapiens
aagaggatcggaggct

SEQ ID NO: 2505133 - DNA, 19 bp, Homo sapiens
aagaggcagaaaattgcac

SEQ ID NO: 2505134 - DNA, 18 bp, Homo sapiens
aagaggcgggccagccag

SEQ ID NO: 2505135 - DNA, 18 bp, Homo sapiens
aagaggctgaaagaggcc

SEQ ID NO: 2505136 - DNA, 13 bp, Homo sapiens
aagaggctggttc

SEQ ID NO: 2505137 - DNA, 17 bp, Homo sapiens
aagagggagaagcatga

SEQ ID NO: 2505138 - DNA, 19 bp, Homo sapiens
aagagggagaggtggagca

SEQ ID NO: 2505139 - DNA, 18 bp, Homo sapiens
aagagggagatggagact

SEQ ID NO: 2505140 - DNA, 15 bp, Homo sapiens
aagaggggtggagac

SEQ ID NO: 2505141 - DNA, 22 bp, Homo sapiens
aagagggtctgaggaatccaga

SEQ ID NO: 2505142 - DNA, 12 bp, Homo sapiens
aagagtaggaag

SEQ ID NO: 2505143 - DNA, 23 bp, Homo sapiens
aagagtagttgatgttgcatttt

SEQ ID NO: 2505144 - DNA, 14 bp, Homo sapiens
aagagtgtactggg

SEQ ID NO: 2505145 - DNA, 14 bp, Homo sapiens
aagagtgtagaagc

SEQ ID NO: 2505146 - DNA, 18 bp, Homo sapiens
aagagtgtagaagcattc

SEQ ID NO: 2505147 - DNA, 22 bp, Homo sapiens
aagagtgtagaagcattccttc

SEQ ID NO: 2505148 - DNA, 14 bp, Homo sapiens
aagatacgacttta

SEQ ID NO: 2505149 - DNA, 18 bp, Homo sapiens
aagatacgactttatttt

SEQ ID NO: 2505150 - DNA, 15 bp, Homo sapiens
aagataggctctgca

SEQ ID NO: 2505151 - DNA, 15 bp, Homo sapiens
aagatatttatatat

SEQ ID NO: 2505152 - DNA, 17 bp, Homo sapiens
aagatatttttcatgat

SEQ ID NO: 2505153 - DNA, 21 bp, Homo sapiens
aagatcaaaataaaaagtgac

SEQ ID NO: 2505154 - DNA, 21 bp, Homo sapiens
aagatcctgtctttaaggaaa

SEQ ID NO: 2505155 - DNA, 16 bp, Homo sapiens
aagatcgttctctgcc

SEQ ID NO: 2505156 - DNA, 23 bp, Homo sapiens
aagatctgcagggggtgtgtctg

SEQ ID NO: 2505157 - DNA, 17 bp, Homo sapiens
aagatcttaaattttgt

SEQ ID NO: 2505158 - DNA, 13 bp, Homo sapiens
aagatgacattgc

SEQ ID NO: 2505159 - DNA, 17 bp, Homo sapiens
aagatgacattgctaag

SEQ ID NO: 2505160 - DNA, 15 bp, Homo sapiens
aagatgcaaggacca

SEQ ID NO: 2505161 - DNA, 15 bp, Homo sapiens
aagatgctcttttaa

SEQ ID NO: 2505162 - DNA, 16 bp, Homo sapiens
aagatgcttctcactg

SEQ ID NO: 2505163 - DNA, 21 bp, Homo sapiens
aagatggattctcagatattt

SEQ ID NO: 2505164 - DNA, 16 bp, Homo sapiens
aagatggctgtgcctc

SEQ ID NO: 2505165 - DNA, 13 bp, Homo sapiens
aagatgtagagga

SEQ ID NO: 2505166 - DNA, 22 bp, Homo sapiens
aagatgtagatttatttcatca

SEQ ID NO: 2505167 - DNA, 16 bp, Homo sapiens
aagatgtttgtcagat

SEQ ID NO: 2505168 - DNA, 19 bp, Homo sapiens
aagattcacacctgactct

SEQ ID NO: 2505169 - DNA, 17 bp, Homo sapiens
aagattcatccatttat

SEQ ID NO: 2505170 - DNA, 17 bp, Homo sapiens
aagattctcctgtgcta

SEQ ID NO: 2505171 - DNA, 12 bp, Homo sapiens
aagattgctgaa

SEQ ID NO: 2505172 - DNA, 13 bp, Homo sapiens
aagatttcttgag

SEQ ID NO: 2505173 - DNA, 23 bp, Homo sapiens
aagatttgatgctggagaggtta

SEQ ID NO: 2505174 - DNA, 21 bp, Homo sapiens
aagatttgttttgtcaagtgt

SEQ ID NO: 2505175 - DNA, 15 bp, Homo sapiens
aagattttgaatgct

SEQ ID NO: 2505176 - DNA, 20 bp, Homo sapiens
aagatttttctcaaagtttt

SEQ ID NO: 2505177 - DNA, 14 bp, Homo sapiens
aagcaaaatattat

SEQ ID NO: 2505178 - DNA, 13 bp, Homo sapiens
aagcaaaatgtga

SEQ ID NO: 2505179 - DNA, 13 bp, Homo sapiens
aagcaaacacatt

SEQ ID NO: 2505180 - DNA, 14 bp, Homo sapiens
aagcaaacacatta

SEQ ID NO: 2505181 - DNA, 17 bp, Homo sapiens
aagcaaaggtgaagaga

SEQ ID NO: 2505182 - DNA, 21 bp, Homo sapiens
aagcaacctgggtccaaataa

SEQ ID NO: 2505183 - DNA, 14 bp, Homo sapiens
aagcaactgttatg

SEQ ID NO: 2505184 - DNA, 15 bp, Homo sapiens
aagcaagatttcaga

SEQ ID NO: 2505185 - DNA, 11 bp, Homo sapiens
aagcaatgcat

SEQ ID NO: 2505186 - DNA, 15 bp, Homo sapiens
aagcaattccaacct

SEQ ID NO: 2505187 - DNA, 19 bp, Homo sapiens
aagcacactcatcccctca

SEQ ID NO: 2505188 - DNA, 12 bp, Homo sapiens
aagcacagtggt

SEQ ID NO: 2505189 - DNA, 24 bp, Homo sapiens
aagcacagtggtggcagggcctag

SEQ ID NO: 2505190 - DNA, 13 bp, Homo sapiens
aagcacagtgtta

SEQ ID NO: 2505191 - DNA, 20 bp, Homo sapiens
aagcacagtgttaaatgaaa

SEQ ID NO: 2505192 - DNA, 17 bp, Homo sapiens
aagcacagtttgaacaa

SEQ ID NO: 2505193 - DNA, 16 bp, Homo sapiens
aagcacatattgagca

SEQ ID NO: 2505194 - DNA, 16 bp, Homo sapiens
aagcacatgtttattt

SEQ ID NO: 2505195 - DNA, 17 bp, Homo sapiens
aagcaccaaaataagaa

SEQ ID NO: 2505196 - DNA, 13 bp, Homo sapiens
aagcacctcctgc

SEQ ID NO: 2505197 - DNA, 15 bp, Homo sapiens
aagcacctcctgcct

SEQ ID NO: 2505198 - DNA, 21 bp, Homo sapiens
aagcactgacctgtcatgccc

SEQ ID NO: 2505199 - DNA, 19 bp, Homo sapiens
aagcactgacttctaagta

SEQ ID NO: 2505200 - DNA, 20 bp, Homo sapiens
aagcactgacttctaagtaa

SEQ ID NO: 2505201 - DNA, 20 bp, Homo sapiens
aagcacttggactcttgctc

SEQ ID NO: 2505202 - DNA, 13 bp, Homo sapiens
aagcagagcttcc

SEQ ID NO: 2505203 - DNA, 14 bp, Homo sapiens
aagcagaggaagga

SEQ ID NO: 2505204 - DNA, 21 bp, Homo sapiens
aagcagaggaaggagaggaga

SEQ ID NO: 2505205 - DNA, 21 bp, Homo sapiens
aagcagatgcaaagaggcaag

SEQ ID NO: 2505206 - DNA, 23 bp, Homo sapiens
aagcagatgcaaagaggcaagag

SEQ ID NO: 2505207 - DNA, 14 bp, Homo sapiens
aagcagcgtttcta

SEQ ID NO: 2505208 - DNA, 11 bp, Homo sapiens
aagcagctctt

SEQ ID NO: 2505209 - DNA, 16 bp, Homo sapiens
aagcagctttaaacaa

SEQ ID NO: 2505210 - DNA, 21 bp, Homo sapiens
aagcagctttaaacaaattca

SEQ ID NO: 2505211 - DNA, 13 bp, Homo sapiens
aagcaggaagctc

SEQ ID NO: 2505212 - DNA, 16 bp, Homo sapiens
aagcaggaagctcaga

SEQ ID NO: 2505213 - DNA, 16 bp, Homo sapiens
aagcaggctacactga

SEQ ID NO: 2505214 - DNA, 22 bp, Homo sapiens
aagcaggttgaggggctcctgg

SEQ ID NO: 2505215 - DNA, 22 bp, Homo sapiens
aagcagtagaaataatatgcat

SEQ ID NO: 2505216 - DNA, 14 bp, Homo sapiens
aagcagtagacaag

SEQ ID NO: 2505217 - DNA, 15 bp, Homo sapiens
aagcagtgccttcca

SEQ ID NO: 2505218 - DNA, 17 bp, Homo sapiens
aagcagtgccttccata

SEQ ID NO: 2505219 - DNA, 20 bp, Homo sapiens
aagcagtgccttccataatt

SEQ ID NO: 2505220 - DNA, 17 bp, Homo sapiens
aagcagtggacaccagg

SEQ ID NO: 2505221 - DNA, 15 bp, Homo sapiens
aagcagttgtgtcag

SEQ ID NO: 2505222 - DNA, 22 bp, Homo sapiens
aagcatcattatttgcagagac

SEQ ID NO: 2505223 - DNA, 17 bp, Homo sapiens
aagcatccatgtgtgga

SEQ ID NO: 2505224 - DNA, 20 bp, Homo sapiens
aagcatccatgtgtggactc

SEQ ID NO: 2505225 - DNA, 18 bp, Homo sapiens
aagcatcggagggaattg

SEQ ID NO: 2505226 - DNA, 21 bp, Homo sapiens
aagcatcttccagaagtgtga

SEQ ID NO: 2505227 - DNA, 13 bp, Homo sapiens
aagcatgaaaaag

SEQ ID NO: 2505228 - DNA, 18 bp, Homo sapiens
aagcatgtattcagcttt

SEQ ID NO: 2505229 - DNA, 12 bp, Homo sapiens
aagcatgtttca

SEQ ID NO: 2505230 - DNA, 15 bp, Homo sapiens
aagcattcagagagc

SEQ ID NO: 2505231 - DNA, 14 bp, Homo sapiens
aagcattccaacaa

SEQ ID NO: 2505232 - DNA, 13 bp, Homo sapiens
aagcattccttct

SEQ ID NO: 2505233 - DNA, 14 bp, Homo sapiens
aagcattccttctt

SEQ ID NO: 2505234 - DNA, 16 bp, Homo sapiens
aagcattccttctttg

SEQ ID NO: 2505235 - DNA, 22 bp, Homo sapiens
aagcattccttctttgataatg

SEQ ID NO: 2505236 - DNA, 18 bp, Homo sapiens
aagcattgtaaatgtgct

SEQ ID NO: 2505237 - DNA, 21 bp, Homo sapiens
aagcattgtttgcttattgtt

SEQ ID NO: 2505238 - DNA, 23 bp, Homo sapiens
aagcattgtttgcttattgttcc

SEQ ID NO: 2505239 - DNA, 23 bp, Homo sapiens
aagcatttaatgtagccatggga

SEQ ID NO: 2505240 - DNA, 17 bp, Homo sapiens
aagcattttataaatcg

SEQ ID NO: 2505241 - DNA, 19 bp, Homo sapiens
aagcattttataaatcgct

SEQ ID NO: 2505242 - DNA, 17 bp, Homo sapiens
aagccaaagctaggcct

SEQ ID NO: 2505243 - DNA, 16 bp, Homo sapiens
aagccaacaccctgtc

SEQ ID NO: 2505244 - DNA, 17 bp, Homo sapiens
aagccaacagtcaaaac

SEQ ID NO: 2505245 - DNA, 22 bp, Homo sapiens
aagccaacttggctttcccgga

SEQ ID NO: 2505246 - DNA, 19 bp, Homo sapiens
aagccaacttgtaaataca

SEQ ID NO: 2505247 - DNA, 14 bp, Homo sapiens
aagccaagcagcca

SEQ ID NO: 2505248 - DNA, 22 bp, Homo sapiens
aagccaagtcagctttgccttc

SEQ ID NO: 2505249 - DNA, 20 bp, Homo sapiens
aagccaataacacacagcta

SEQ ID NO: 2505250 - DNA, 16 bp, Homo sapiens
aagccacaagaaattt

SEQ ID NO: 2505251 - DNA, 18 bp, Homo sapiens
aagccacaagaaatttga

SEQ ID NO: 2505252 - DNA, 14 bp, Homo sapiens
aagccacagctggt

SEQ ID NO: 2505253 - DNA, 21 bp, Homo sapiens
aagccaccaacatactcccat

SEQ ID NO: 2505254 - DNA, 17 bp, Homo sapiens
aagccactgaagctggg

SEQ ID NO: 2505255 - DNA, 18 bp, Homo sapiens
aagccacttaaaatgttc

SEQ ID NO: 2505256 - DNA, 17 bp, Homo sapiens
aagccagaagctgagca

SEQ ID NO: 2505257 - DNA, 20 bp, Homo sapiens
aagccagcgtcctcctctgt

SEQ ID NO: 2505258 - DNA, 14 bp, Homo sapiens
aagccagctttccc

SEQ ID NO: 2505259 - DNA, 15 bp, Homo sapiens
aagccagctttccct

SEQ ID NO: 2505260 - DNA, 23 bp, Homo sapiens
aagccagctttccctgcctctca

SEQ ID NO: 2505261 - DNA, 18 bp, Homo sapiens
aagccaggagcaaatgtt

SEQ ID NO: 2505262 - DNA, 14 bp, Homo sapiens
aagccatcttggta

SEQ ID NO: 2505263 - DNA, 22 bp, Homo sapiens
aagcccaacctcctgacctgtc

SEQ ID NO: 2505264 - DNA, 18 bp, Homo sapiens
aagcccaatattataatt

SEQ ID NO: 2505265 - DNA, 14 bp, Homo sapiens
aagcccaggcccct

SEQ ID NO: 2505266 - DNA, 17 bp, Homo sapiens
aagccccaggcaggctg

SEQ ID NO: 2505267 - DNA, 16 bp, Homo sapiens
aagccctcttccatca

SEQ ID NO: 2505268 - DNA, 21 bp, Homo sapiens
aacttaaaaatgtaaatattc

SEQ ID NO: 2505269 - DNA, 17 bp, Homo sapiens
aacttaacattctgtaa

SEQ ID NO: 2505270 - DNA, 18 bp, Homo sapiens
aacttaatagtatttatg

SEQ ID NO: 2505271 - DNA, 15 bp, Homo sapiens
aacttaatctaaatg

SEQ ID NO: 2505272 - DNA, 13 bp, Homo sapiens
aacttacacacaa

SEQ ID NO: 2505273 - DNA, 19 bp, Homo sapiens
aacttacctgggcattctt

SEQ ID NO: 2505274 - DNA, 19 bp, Homo sapiens
aacttatattgtaagaaat

SEQ ID NO: 2505275 - DNA, 19 bp, Homo sapiens
aacttatcctaaaacaaat

SEQ ID NO: 2505276 - DNA, 13 bp, Homo sapiens
aacttattctgta

SEQ ID NO: 2505277 - DNA, 14 bp, Homo sapiens
aacttattctgtag

SEQ ID NO: 2505278 - DNA, 23 bp, Homo sapiens
aacttattctgtagattctgtgg

SEQ ID NO: 2505279 - DNA, 18 bp, Homo sapiens
aacttatttttttctgat

SEQ ID NO: 2505280 - DNA, 20 bp, Homo sapiens
aacttatttttttctgattg

SEQ ID NO: 2505281 - DNA, 22 bp, Homo sapiens
aacttcaccatattaccacaga

SEQ ID NO: 2505282 - DNA, 22 bp, Homo sapiens
aacttcagagggaaagtaaata

SEQ ID NO: 2505283 - DNA, 11 bp, Homo sapiens
aacttcagcag

SEQ ID NO: 2505284 - DNA, 19 bp, Homo sapiens
aacttgagggcccagagca

SEQ ID NO: 2505285 - DNA, 22 bp, Homo sapiens
aacttgctgcagtatgaaaata

SEQ ID NO: 2505286 - DNA, 22 bp, Homo sapiens
aacttgtctttggaccctgagg

SEQ ID NO: 2505287 - DNA, 18 bp, Homo sapiens
aacttgttactaaagaaa

SEQ ID NO: 2505288 - DNA, 20 bp, Homo sapiens
aactttaattctctttcaaa

SEQ ID NO: 2505289 - DNA, 21 bp, Homo sapiens
aactttaccttttttatacat

SEQ ID NO: 2505290 - DNA, 22 bp, Homo sapiens
aactttaccttttttatacata

SEQ ID NO: 2505291 - DNA, 21 bp, Homo sapiens
aactttatcacattatttgca

SEQ ID NO: 2505292 - DNA, 20 bp, Homo sapiens
aactttatgctaagtgaaat

SEQ ID NO: 2505293 - DNA, 14 bp, Homo sapiens
aactttatgtgtaa

SEQ ID NO: 2505294 - DNA, 17 bp, Homo sapiens
aactttatgtgtaaata

SEQ ID NO: 2505295 - DNA, 21 bp, Homo sapiens
aactttgcttgcagtagattt

SEQ ID NO: 2505296 - DNA, 20 bp, Homo sapiens
aactttgtggatgtcttcct

SEQ ID NO: 2505297 - DNA, 12 bp, Homo sapiens
aacttttataaa

SEQ ID NO: 2505298 - DNA, 18 bp, Homo sapiens
aacttttcccctgtcctg

SEQ ID NO: 2505299 - DNA, 11 bp, Homo sapiens
aacttttgtaa

SEQ ID NO: 2505300 - DNA, 14 bp, Homo sapiens
aacttttgtaaata

SEQ ID NO: 2505301 - DNA, 19 bp, Homo sapiens
aacttttttgaaataataa

SEQ ID NO: 2505302 - DNA, 16 bp, Homo sapiens
aagaaaaaaaaaatat

SEQ ID NO: 2505303 - DNA, 15 bp, Homo sapiens
aagaaaaaaaaagaa

SEQ ID NO: 2505304 - DNA, 17 bp, Homo sapiens
aagaaaaaaaagaaagc

SEQ ID NO: 2505305 - DNA, 18 bp, Homo sapiens
aagaaaaagaaaaagaaa

SEQ ID NO: 2505306 - DNA, 19 bp, Homo sapiens
aagaaaaaggatgcacaga

SEQ ID NO: 2505307 - DNA, 22 bp, Homo sapiens
aagaaaaaggatgcacagagtt

SEQ ID NO: 2505308 - DNA, 20 bp, Homo sapiens
aagaaaaagtcatccaatct

SEQ ID NO: 2505309 - DNA, 16 bp, Homo sapiens
aagaaaagagctttct

SEQ ID NO: 2505310 - DNA, 15 bp, Homo sapiens
aagaaaagataaaga

SEQ ID NO: 2505311 - DNA, 13 bp, Homo sapiens
aagaaaataaaaa

SEQ ID NO: 2505312 - DNA, 18 bp, Homo sapiens
aagaaaataaaaaaaaga

SEQ ID NO: 2505313 - DNA, 22 bp, Homo sapiens
aagaaaataaaaaaaagaaaaa

SEQ ID NO: 2505314 - DNA, 23 bp, Homo sapiens
aagaaaataaaaaaaagaaaaaa

SEQ ID NO: 2505315 - DNA, 21 bp, Homo sapiens
aagaaaatagtggtgtgattt

SEQ ID NO: 2505316 - DNA, 22 bp, Homo sapiens
aagaaaatagtggtgtgatttg

SEQ ID NO: 2505317 - DNA, 17 bp, Homo sapiens
aagaaactatacatcat

SEQ ID NO: 2505318 - DNA, 13 bp, Homo sapiens
aagaaagaaggaa

SEQ ID NO: 2505319 - DNA, 14 bp, Homo sapiens
aagaaagaaggaag

SEQ ID NO: 2505320 - DNA, 13 bp, Homo sapiens
aagaaagagagaa

SEQ ID NO: 2505321 - DNA, 16 bp, Homo sapiens
aagaaagcatagacat

SEQ ID NO: 2505322 - DNA, 17 bp, Homo sapiens
aagaaagctggtaaact

SEQ ID NO: 2505323 - DNA, 23 bp, Homo sapiens
aagaaatccctgtttaatattta

SEQ ID NO: 2505324 - DNA, 14 bp, Homo sapiens
aagaaatgacactt

SEQ ID NO: 2505325 - DNA, 13 bp, Homo sapiens
aagaaatgtaagg

SEQ ID NO: 2505326 - DNA, 14 bp, Homo sapiens
aagaaatgtaaggg

SEQ ID NO: 2505327 - DNA, 13 bp, Homo sapiens
aagaaattgcaat

SEQ ID NO: 2505328 - DNA, 12 bp, Homo sapiens
aagaactgcttt

SEQ ID NO: 2505329 - DNA, 15 bp, Homo sapiens
aagaacttgcatgga

SEQ ID NO: 2505330 - DNA, 16 bp, Homo sapiens
aagaagaaacgtctat

SEQ ID NO: 2505331 - DNA, 14 bp, Homo sapiens
aagaagagacagga

SEQ ID NO: 2505332 - DNA, 22 bp, Homo sapiens
aagaagaggagaaaaaaacttc

SEQ ID NO: 2505333 - DNA, 14 bp, Homo sapiens
aagaagcaggctac

SEQ ID NO: 2505334 - DNA, 19 bp, Homo sapiens
aagaagccacagacctagg

SEQ ID NO: 2505335 - DNA, 17 bp, Homo sapiens
aagaagccgggaacaga

SEQ ID NO: 2505336 - DNA, 15 bp, Homo sapiens
aagaagtaggcatga

SEQ ID NO: 2505337 - DNA, 22 bp, Homo sapiens
aagaagtgaaaatctacactcc

SEQ ID NO: 2505338 - DNA, 19 bp, Homo sapiens
aagaagtgtgtcaccctta

SEQ ID NO: 2505339 - DNA, 17 bp, Homo sapiens
aagaagtttaaggaata

SEQ ID NO: 2505340 - DNA, 18 bp, Homo sapiens
aagaatacaaacatattt

SEQ ID NO: 2505341 - DNA, 13 bp, Homo sapiens
aagaatacagaaa

SEQ ID NO: 2505342 - DNA, 13 bp, Homo sapiens
aagaatattcagg

SEQ ID NO: 2505343 - DNA, 19 bp, Homo sapiens
aagaatgaacaaattgaac

SEQ ID NO: 2505344 - DNA, 18 bp, Homo sapiens
aagaatgggcagttacat

SEQ ID NO: 2505345 - DNA, 20 bp, Homo sapiens
aagaatgggcagttacatgc

SEQ ID NO: 2505346 - DNA, 16 bp, Homo sapiens
aagaattgaagcagga

SEQ ID NO: 2505347 - DNA, 15 bp, Homo sapiens
aagaatttagggaga

SEQ ID NO: 2505348 - DNA, 20 bp, Homo sapiens
aagaatttcttggtaagaag

SEQ ID NO: 2505349 - DNA, 22 bp, Homo sapiens
aagaatttcttggtaagaagcc

SEQ ID NO: 2505350 - DNA, 13 bp, Homo sapiens
aagaattttaaaa

SEQ ID NO: 2505351 - DNA, 17 bp, Homo sapiens
aagaattttaaaaatga

SEQ ID NO: 2505352 - DNA, 17 bp, Homo sapiens
aagacaaaggttttcct

SEQ ID NO: 2505353 - DNA, 17 bp, Homo sapiens
aagacaaatcaaagcag

SEQ ID NO: 2505354 - DNA, 16 bp, Homo sapiens
aagacaaattctgttt

SEQ ID NO: 2505355 - DNA, 16 bp, Homo sapiens
aagacaatccatgtaa

SEQ ID NO: 2505356 - DNA, 23 bp, Homo sapiens
aagacaatggcttactccaggag

SEQ ID NO: 2505357 - DNA, 19 bp, Homo sapiens
aagacaatgtgaaaagaaa

SEQ ID NO: 2505358 - DNA, 21 bp, Homo sapiens
aagacaccagagcagatgcag

SEQ ID NO: 2505359 - DNA, 23 bp, Homo sapiens
aagacaccagagcagatgcagag

SEQ ID NO: 2505360 - DNA, 14 bp, Homo sapiens
aagacactgaaata

SEQ ID NO: 2505361 - DNA, 16 bp, Homo sapiens
aagacagagctgggat

SEQ ID NO: 2505362 - DNA, 12 bp, Homo sapiens
aagacagagtct

SEQ ID NO: 2505363 - DNA, 20 bp, Homo sapiens
aagacagatgccccagagct

SEQ ID NO: 2505364 - DNA, 23 bp, Homo sapiens
aagacaggacagtgcttcagcct

SEQ ID NO: 2505365 - DNA, 22 bp, Homo sapiens
aagacaggatgggggctggcct

SEQ ID NO: 2505366 - DNA, 21 bp, Homo sapiens
aagacataacgtttttccttt

SEQ ID NO: 2505367 - DNA, 23 bp, Homo sapiens
aagacatactccttccatcaaat

SEQ ID NO: 2505368 - DNA, 13 bp, Homo sapiens
aagacatgaacca

SEQ ID NO: 2505369 - DNA, 19 bp, Homo sapiens
aagacatggagactcctgc

SEQ ID NO: 2505370 - DNA, 17 bp, Homo sapiens
aagacatgtctgttcta

SEQ ID NO: 2505371 - DNA, 19 bp, Homo sapiens
aagacatgtctgttctaca

SEQ ID NO: 2505372 - DNA, 18 bp, Homo sapiens
aagacattaaatctatga

SEQ ID NO: 2505373 - DNA, 19 bp, Homo sapiens
aagaccaccacctcagagt

SEQ ID NO: 2505374 - DNA, 15 bp, Homo sapiens
aagaccacgtttcta

SEQ ID NO: 2505375 - DNA, 23 bp, Homo sapiens
aagaccagagatagtggggagac

SEQ ID NO: 2505376 - DNA, 13 bp, Homo sapiens
aagaccccaccca

SEQ ID NO: 2505377 - DNA, 21 bp, Homo sapiens
aagacccttgtggtcccaccc

SEQ ID NO: 2505378 - DNA, 22 bp, Homo sapiens
aagacccttgtggtcccacccc

SEQ ID NO: 2505379 - DNA, 21 bp, Homo sapiens
aagacctggcaaggacacaga

SEQ ID NO: 2505380 - DNA, 21 bp, Homo sapiens
aagacgaggccctcgggccca

SEQ ID NO: 2505381 - DNA, 15 bp, Homo sapiens
aagacgcctgagctc

SEQ ID NO: 2505382 - DNA, 20 bp, Homo sapiens
aagacgctgtgctgccctgc

SEQ ID NO: 2505383 - DNA, 21 bp, Homo sapiens
aagacgctgtgctgccctgcc

SEQ ID NO: 2505384 - DNA, 22 bp, Homo sapiens
aagacgtgattttgctgtagaa

SEQ ID NO: 2505385 - DNA, 16 bp, Homo sapiens
aagactaatttaaaaa

SEQ ID NO: 2505386 - DNA, 17 bp, Homo sapiens
aagactatctaaatgtt

SEQ ID NO: 2505387 - DNA, 14 bp, Homo sapiens
aagactattcaaac

SEQ ID NO: 2505388 - DNA, 14 bp, Homo sapiens
aagactcagtgttc

SEQ ID NO: 2505389 - DNA, 23 bp, Homo sapiens
aagactgagtacgttgtgcattt

SEQ ID NO: 2505390 - DNA, 21 bp, Homo sapiens
aagactggaaggtggggacag

SEQ ID NO: 2505391 - DNA, 16 bp, Homo sapiens
aagactgtaatgaatc

SEQ ID NO: 2505392 - DNA, 16 bp, Homo sapiens
aagactgtacaaagta

SEQ ID NO: 2505393 - DNA, 17 bp, Homo sapiens
aagactgtacaaagtag

SEQ ID NO: 2505394 - DNA, 18 bp, Homo sapiens
aagactgtggctgctagc

SEQ ID NO: 2505395 - DNA, 17 bp, Homo sapiens
aagactgttgctcaaat

SEQ ID NO: 2505396 - DNA, 16 bp, Homo sapiens
aagacttggcaacaga

SEQ ID NO: 2505397 - DNA, 20 bp, Homo sapiens
aagacttggcaacagaagca

SEQ ID NO: 2505398 - DNA, 12 bp, Homo sapiens
aagacttgtttt

SEQ ID NO: 2505399 - DNA, 16 bp, Homo sapiens
aagactttggaaagac

SEQ ID NO: 2505400 - DNA, 19 bp, Homo sapiens
aagactttgggataggaaa

SEQ ID NO: 2505401 - DNA, 11 bp, Homo sapiens
aagagaaaaga

SEQ ID NO: 2505402 - DNA, 12 bp, Homo sapiens
aagagaaaagaa

SEQ ID NO: 2505403 - DNA, 18 bp, Homo sapiens
aagagaaagtgatttcta

SEQ ID NO: 2505404 - DNA, 16 bp, Homo sapiens
aagagaaccgagcaaa

SEQ ID NO: 2505405 - DNA, 18 bp, Homo sapiens
aagagaagggcagggctg

SEQ ID NO: 2505406 - DNA, 20 bp, Homo sapiens
aagagaatattagctttact

SEQ ID NO: 2505407 - DNA, 21 bp, Homo sapiens
aagagacaaacacctcccagg

SEQ ID NO: 2505408 - DNA, 22 bp, Homo sapiens
aagagacaggagggcaagggcc

SEQ ID NO: 2505409 - DNA, 22 bp, Homo sapiens
aagagacagtcaccccaggact

SEQ ID NO: 2505410 - DNA, 16 bp, Homo sapiens
aagagacctacctcag

SEQ ID NO: 2505411 - DNA, 16 bp, Homo sapiens
aagagactctggcctc

SEQ ID NO: 2505412 - DNA, 16 bp, Homo sapiens
aagagagaaaaacaaa

SEQ ID NO: 2505413 - DNA, 12 bp, Homo sapiens
aagagagaaaat

SEQ ID NO: 2505414 - DNA, 18 bp, Homo sapiens
aagagagaaaataaaaag

SEQ ID NO: 2505415 - DNA, 21 bp, Homo sapiens
aagagagaaaataaaaagtta

SEQ ID NO: 2505416 - DNA, 23 bp, Homo sapiens
aagagagaaaataaaaagttaaa

SEQ ID NO: 2505417 - DNA, 13 bp, Homo sapiens
aagagagaatgta

SEQ ID NO: 2505418 - DNA, 14 bp, Homo sapiens
aacccccacacaca

SEQ ID NO: 2505419 - DNA, 15 bp, Homo sapiens
aacccccacacacac

SEQ ID NO: 2505420 - DNA, 10 bp, Homo sapiens
aacccccacc

SEQ ID NO: 2505421 - DNA, 16 bp, Homo sapiens
aaccccctttgtgctg

SEQ ID NO: 2505422 - DNA, 18 bp, Homo sapiens
aaccccctttgtgctgtg

SEQ ID NO: 2505423 - DNA, 19 bp, Homo sapiens
aaccccctttgtgctgtgg

SEQ ID NO: 2505424 - DNA, 16 bp, Homo sapiens
aacccgacagagggaa

SEQ ID NO: 2505425 - DNA, 17 bp, Homo sapiens
aacccgacagagggaag

SEQ ID NO: 2505426 - DNA, 15 bp, Homo sapiens
aacccgaggcccgca

SEQ ID NO: 2505427 - DNA, 15 bp, Homo sapiens
aaccctattggtaaa

SEQ ID NO: 2505428 - DNA, 18 bp, Homo sapiens
aaccctccctcagcccct

SEQ ID NO: 2505429 - DNA, 21 bp, Homo sapiens
aaccctctcaggtgaccaaaa

SEQ ID NO: 2505430 - DNA, 12 bp, Homo sapiens
aaccctgcccct

SEQ ID NO: 2505431 - DNA, 15 bp, Homo sapiens
aaccctgttttatac

SEQ ID NO: 2505432 - DNA, 20 bp, Homo sapiens
aaccctgttttatactgtac

SEQ ID NO: 2505433 - DNA, 23 bp, Homo sapiens
aacccttaggacagggtccctgc

SEQ ID NO: 2505434 - DNA, 22 bp, Homo sapiens
aacccttttggcccccgagctg

SEQ ID NO: 2505435 - DNA, 13 bp, Homo sapiens
aaccgatgctcca

SEQ ID NO: 2505436 - DNA, 18 bp, Homo sapiens
aaccgcactcacccatgt

SEQ ID NO: 2505437 - DNA, 13 bp, Homo sapiens
aaccgcaggaagc

SEQ ID NO: 2505438 - DNA, 15 bp, Homo sapiens
aaccgtcaataggca

SEQ ID NO: 2505439 - DNA, 22 bp, Homo sapiens
aaccgttattataattgtatca

SEQ ID NO: 2505440 - DNA, 20 bp, Homo sapiens
aacctaaaataattggttct

SEQ ID NO: 2505441 - DNA, 22 bp, Homo sapiens
aacctaaatttggttctaggcc

SEQ ID NO: 2505442 - DNA, 20 bp, Homo sapiens
aacctaccaccccttcctgt

SEQ ID NO: 2505443 - DNA, 16 bp, Homo sapiens
aacctatatgatttat

SEQ ID NO: 2505444 - DNA, 16 bp, Homo sapiens
aacctattttgaaaaa

SEQ ID NO: 2505445 - DNA, 23 bp, Homo sapiens
aacctattttgaaaaattcctat

SEQ ID NO: 2505446 - DNA, 19 bp, Homo sapiens
aacctcagacttaccagga

SEQ ID NO: 2505447 - DNA, 16 bp, Homo sapiens
aacctcatcttcttca

SEQ ID NO: 2505448 - DNA, 14 bp, Homo sapiens
aacctcattcccca

SEQ ID NO: 2505449 - DNA, 12 bp, Homo sapiens
aacctcctctgt

SEQ ID NO: 2505450 - DNA, 13 bp, Homo sapiens
aacctcctggaca

SEQ ID NO: 2505451 - DNA, 13 bp, Homo sapiens
aacctcctttctc

SEQ ID NO: 2505452 - DNA, 17 bp, Homo sapiens
aacctcctttctcttct

SEQ ID NO: 2505453 - DNA, 18 bp, Homo sapiens
aacctcctttctcttctc

SEQ ID NO: 2505454 - DNA, 19 bp, Homo sapiens
aacctcctttctcttctct

SEQ ID NO: 2505455 - DNA, 12 bp, Homo sapiens
aacctctgttca

SEQ ID NO: 2505456 - DNA, 18 bp, Homo sapiens
aacctgatgttaaaattc

SEQ ID NO: 2505457 - DNA, 22 bp, Homo sapiens
aacctgcaagggctccccactg

SEQ ID NO: 2505458 - DNA, 13 bp, Homo sapiens
aacctgccctgcc

SEQ ID NO: 2505459 - DNA, 15 bp, Homo sapiens
aacctgccctgcctg

SEQ ID NO: 2505460 - DNA, 16 bp, Homo sapiens
aacctgccctgcctga

SEQ ID NO: 2505461 - DNA, 20 bp, Homo sapiens
aacctgctctcctcttgcca

SEQ ID NO: 2505462 - DNA, 22 bp, Homo sapiens
aacctggagggctggaatctgg

SEQ ID NO: 2505463 - DNA, 17 bp, Homo sapiens
aacctgggtccaaataa

SEQ ID NO: 2505464 - DNA, 18 bp, Homo sapiens
aacctgggtccaaataaa

SEQ ID NO: 2505465 - DNA, 23 bp, Homo sapiens
aacctggtcacaggactctgcct

SEQ ID NO: 2505466 - DNA, 15 bp, Homo sapiens
aacctgtacttcaag

SEQ ID NO: 2505467 - DNA, 11 bp, Homo sapiens
aacctgtcctt

SEQ ID NO: 2505468 - DNA, 15 bp, Homo sapiens
aacctgtccttgcac

SEQ ID NO: 2505469 - DNA, 23 bp, Homo sapiens
aaccttagatgttctaagtcttt

SEQ ID NO: 2505470 - DNA, 13 bp, Homo sapiens
aaccttgcctttc

SEQ ID NO: 2505471 - DNA, 18 bp, Homo sapiens
aaccttggtgtagttgaa

SEQ ID NO: 2505472 - DNA, 20 bp, Homo sapiens
aaccttggtgtagttgaact

SEQ ID NO: 2505473 - DNA, 15 bp, Homo sapiens
aaccttgtgcctggc

SEQ ID NO: 2505474 - DNA, 16 bp, Homo sapiens
aacctttagggcagct

SEQ ID NO: 2505475 - DNA, 18 bp, Homo sapiens
aaccttttttaagatttt

SEQ ID NO: 2505476 - DNA, 21 bp, Homo sapiens
aaccttttttaagatttttct

SEQ ID NO: 2505477 - DNA, 17 bp, Homo sapiens
aacgatttaattctctt

SEQ ID NO: 2505478 - DNA, 13 bp, Homo sapiens
aacgcatggagtg

SEQ ID NO: 2505479 - DNA, 18 bp, Homo sapiens
aacgcatggagtgtgtat

SEQ ID NO: 2505480 - DNA, 20 bp, Homo sapiens
aacggagccccaggcctctg

SEQ ID NO: 2505481 - DNA, 18 bp, Homo sapiens
aacggattattttttcag

SEQ ID NO: 2505482 - DNA, 21 bp, Homo sapiens
aacggattattttttcagacc

SEQ ID NO: 2505483 - DNA, 17 bp, Homo sapiens
aacgggctgccctgcca

SEQ ID NO: 2505484 - DNA, 15 bp, Homo sapiens
aacggggtccttcaa

SEQ ID NO: 2505485 - DNA, 17 bp, Homo sapiens
aacgtaaccacggaaaa

SEQ ID NO: 2505486 - DNA, 15 bp, Homo sapiens
aacgtgatgatcagc

SEQ ID NO: 2505487 - DNA, 17 bp, Homo sapiens
aacgtttttcctgttct

SEQ ID NO: 2505488 - DNA, 16 bp, Homo sapiens
aactaaattgtaaact

SEQ ID NO: 2505489 - DNA, 12 bp, Homo sapiens
aactaatgcctt

SEQ ID NO: 2505490 - DNA, 14 bp, Homo sapiens
aactactgtgttcc

SEQ ID NO: 2505491 - DNA, 17 bp, Homo sapiens
aactactgtgttcctgg

SEQ ID NO: 2505492 - DNA, 22 bp, Homo sapiens
aactagaatttattcaattcct

SEQ ID NO: 2505493 - DNA, 20 bp, Homo sapiens
aactagagatgactgagtcc

SEQ ID NO: 2505494 - DNA, 16 bp, Homo sapiens
aactagagcagccctg

SEQ ID NO: 2505495 - DNA, 22 bp, Homo sapiens
aactagagcagccctggagtca

SEQ ID NO: 2505496 - DNA, 23 bp, Homo sapiens
aactagagcagccctggagtcat

SEQ ID NO: 2505497 - DNA, 18 bp, Homo sapiens
aactagccaccaactctt

SEQ ID NO: 2505498 - DNA, 18 bp, Homo sapiens
aactatcttggtgaattt

SEQ ID NO: 2505499 - DNA, 15 bp, Homo sapiens
aactatgttgataaa

SEQ ID NO: 2505500 - DNA, 13 bp, Homo sapiens
aactatttatctg

SEQ ID NO: 2505501 - DNA, 20 bp, Homo sapiens
aactatttatctgtgttttt

SEQ ID NO: 2505502 - DNA, 17 bp, Homo sapiens
aactatttcttatatat

SEQ ID NO: 2505503 - DNA, 19 bp, Homo sapiens
aactatttgtctttcagga

SEQ ID NO: 2505504 - DNA, 15 bp, Homo sapiens
aactcaaaatatttg

SEQ ID NO: 2505505 - DNA, 22 bp, Homo sapiens
aactcaaactgaggaatttcac

SEQ ID NO: 2505506 - DNA, 21 bp, Homo sapiens
aactcaatattttccatgaaa

SEQ ID NO: 2505507 - DNA, 14 bp, Homo sapiens
aactcacctaactc

SEQ ID NO: 2505508 - DNA, 14 bp, Homo sapiens
aactcactgctcaa

SEQ ID NO: 2505509 - DNA, 21 bp, Homo sapiens
aactcactgctcaagaagaca

SEQ ID NO: 2505510 - DNA, 22 bp, Homo sapiens
aactcactgctcaagaagacat

SEQ ID NO: 2505511 - DNA, 14 bp, Homo sapiens
aactcagatcacta

SEQ ID NO: 2505512 - DNA, 21 bp, Homo sapiens
aactcagatcactactgcagt

SEQ ID NO: 2505513 - DNA, 20 bp, Homo sapiens
aactcagccaagcacagtgg

SEQ ID NO: 2505514 - DNA, 21 bp, Homo sapiens
aactcagccaagcacagtggt

SEQ ID NO: 2505515 - DNA, 16 bp, Homo sapiens
aactcagggacagagc

SEQ ID NO: 2505516 - DNA, 18 bp, Homo sapiens
aactcagttttaactaga

SEQ ID NO: 2505517 - DNA, 21 bp, Homo sapiens
aactcatccctaatgctgcag

SEQ ID NO: 2505518 - DNA, 15 bp, Homo sapiens
aactcattcctgcct

SEQ ID NO: 2505519 - DNA, 21 bp, Homo sapiens
aactcattcctgcctgtctcc

SEQ ID NO: 2505520 - DNA, 22 bp, Homo sapiens
aactcattcctgcctgtctcct

SEQ ID NO: 2505521 - DNA, 22 bp, Homo sapiens
aactcatttcctatgtaactgc

SEQ ID NO: 2505522 - DNA, 21 bp, Homo sapiens
aactcatttttgttttcatta

SEQ ID NO: 2505523 - DNA, 19 bp, Homo sapiens
aactccccttcctcactgc

SEQ ID NO: 2505524 - DNA, 21 bp, Homo sapiens
aactcctagggccactgaaga

SEQ ID NO: 2505525 - DNA, 14 bp, Homo sapiens
aactcctgtccttt

SEQ ID NO: 2505526 - DNA, 19 bp, Homo sapiens
aactcgaggactgtatttg

SEQ ID NO: 2505527 - DNA, 20 bp, Homo sapiens
aactcgaggactgtatttgt

SEQ ID NO: 2505528 - DNA, 22 bp, Homo sapiens
aactcgaggactgtatttgtga

SEQ ID NO: 2505529 - DNA, 22 bp, Homo sapiens
aactctaattcccattttgcaa

SEQ ID NO: 2505530 - DNA, 23 bp, Homo sapiens
aactctcctctgctgctggctgg

SEQ ID NO: 2505531 - DNA, 12 bp, Homo sapiens
aactctctccac

SEQ ID NO: 2505532 - DNA, 12 bp, Homo sapiens
aactctctgaac

SEQ ID NO: 2505533 - DNA, 15 bp, Homo sapiens
aactctgcactactc

SEQ ID NO: 2505534 - DNA, 17 bp, Homo sapiens
aactctggcttccaggt

SEQ ID NO: 2505535 - DNA, 21 bp, Homo sapiens
aactctgggctgctacccaga

SEQ ID NO: 2505536 - DNA, 17 bp, Homo sapiens
aactctgtcttcacctg

SEQ ID NO: 2505537 - DNA, 23 bp, Homo sapiens
aactctgtcttcacctgattcaa

SEQ ID NO: 2505538 - DNA, 20 bp, Homo sapiens
aactctgtgttgtgaatgtc

SEQ ID NO: 2505539 - DNA, 15 bp, Homo sapiens
aactcttatctcagt

SEQ ID NO: 2505540 - DNA, 12 bp, Homo sapiens
aactctttcaaa

SEQ ID NO: 2505541 - DNA, 20 bp, Homo sapiens
aactgaaaagactcagtgtt

SEQ ID NO: 2505542 - DNA, 12 bp, Homo sapiens
aactgaaaatgt

SEQ ID NO: 2505543 - DNA, 15 bp, Homo sapiens
aactgaacattccag

SEQ ID NO: 2505544 - DNA, 13 bp, Homo sapiens
aactgaagccaga

SEQ ID NO: 2505545 - DNA, 12 bp, Homo sapiens
aactgaatgaga

SEQ ID NO: 2505546 - DNA, 22 bp, Homo sapiens
aactgaatggaaggtttgtata

SEQ ID NO: 2505547 - DNA, 18 bp, Homo sapiens
aactgagatccttccttt

SEQ ID NO: 2505548 - DNA, 14 bp, Homo sapiens
aactgagctcctct

SEQ ID NO: 2505549 - DNA, 17 bp, Homo sapiens
aactgagtccttaaaca

SEQ ID NO: 2505550 - DNA, 15 bp, Homo sapiens
aactgatagttactg

SEQ ID NO: 2505551 - DNA, 16 bp, Homo sapiens
aactgatagttactgt

SEQ ID NO: 2505552 - DNA, 22 bp, Homo sapiens
aactgatagttactgttgtgac

SEQ ID NO: 2505553 - DNA, 17 bp, Homo sapiens
aactgcagacctgtcct

SEQ ID NO: 2505554 - DNA, 14 bp, Homo sapiens
aactgcagggaaaa

SEQ ID NO: 2505555 - DNA, 23 bp, Homo sapiens
aactgcagggaaaattatttgca

SEQ ID NO: 2505556 - DNA, 20 bp, Homo sapiens
aactgcctactccaaaatgt

SEQ ID NO: 2505557 - DNA, 15 bp, Homo sapiens
aactgcctctttcct

SEQ ID NO: 2505558 - DNA, 20 bp, Homo sapiens
aactgctgctttttgaggtg

SEQ ID NO: 2505559 - DNA, 17 bp, Homo sapiens
aactggccggtctgcaa

SEQ ID NO: 2505560 - DNA, 12 bp, Homo sapiens
aactggctgtgt

SEQ ID NO: 2505561 - DNA, 21 bp, Homo sapiens
aactgggggagggtgaagtga

SEQ ID NO: 2505562 - DNA, 21 bp, Homo sapiens
aactgggtacttgtggacaca

SEQ ID NO: 2505563 - DNA, 18 bp, Homo sapiens
aactgtgtggactgtgat

SEQ ID NO: 2505564 - DNA, 20 bp, Homo sapiens
aactgttatttataatcact

SEQ ID NO: 2505565 - DNA, 22 bp, Homo sapiens
aactgttatttataatcacttt

SEQ ID NO: 2505566 - DNA, 15 bp, Homo sapiens
aactgttcccacctg

SEQ ID NO: 2505567 - DNA, 19 bp, Homo sapiens
aactgttgtataaatttat

SEQ ID NO: 2505568 - DNA, 14 bp, Homo sapiens
aacaccacagacac

SEQ ID NO: 2505569 - DNA, 15 bp, Homo sapiens
aacaccacagacaca

SEQ ID NO: 2505570 - DNA, 17 bp, Homo sapiens
aacaccacagacacaca

SEQ ID NO: 2505571 - DNA, 19 bp, Homo sapiens
aacaccacagacacacaca

SEQ ID NO: 2505572 - DNA, 17 bp, Homo sapiens
aacaccctcacactggg

SEQ ID NO: 2505573 - DNA, 15 bp, Homo sapiens
aacacctgatgtgta

SEQ ID NO: 2505574 - DNA, 17 bp, Homo sapiens
aacaccttccagctcct

SEQ ID NO: 2505575 - DNA, 21 bp, Homo sapiens
aacacgtccagaatttttcat

SEQ ID NO: 2505576 - DNA, 18 bp, Homo sapiens
aacactaacatataatgt

SEQ ID NO: 2505577 - DNA, 20 bp, Homo sapiens
aacactatatggcagtgtct

SEQ ID NO: 2505578 - DNA, 16 bp, Homo sapiens
aacactatgtttattt

SEQ ID NO: 2505579 - DNA, 15 bp, Homo sapiens
aacactcatgctgaa

SEQ ID NO: 2505580 - DNA, 21 bp, Homo sapiens
aacactcattgacctgaggcc

SEQ ID NO: 2505581 - DNA, 17 bp, Homo sapiens
aacactccaattaagga

SEQ ID NO: 2505582 - DNA, 12 bp, Homo sapiens
aacactccttca

SEQ ID NO: 2505583 - DNA, 14 bp, Homo sapiens
aacactgcaggcat

SEQ ID NO: 2505584 - DNA, 22 bp, Homo sapiens
aacactgccatcttagtttgga

SEQ ID NO: 2505585 - DNA, 19 bp, Homo sapiens
aacactggcaacaacaaag

SEQ ID NO: 2505586 - DNA, 12 bp, Homo sapiens
aacactggcccc

SEQ ID NO: 2505587 - DNA, 13 bp, Homo sapiens
aacactggcccct

SEQ ID NO: 2505588 - DNA, 15 bp, Homo sapiens
aacactggggctggc

SEQ ID NO: 2505589 - DNA, 17 bp, Homo sapiens
aacactgggggagggga

SEQ ID NO: 2505590 - DNA, 16 bp, Homo sapiens
aacactgtcttgaaga

SEQ ID NO: 2505591 - DNA, 22 bp, Homo sapiens
aacactgtgcacatctgtgtct

SEQ ID NO: 2505592 - DNA, 13 bp, Homo sapiens
aacactgtgccct

SEQ ID NO: 2505593 - DNA, 21 bp, Homo sapiens
aacactgtgccctggtggaga

SEQ ID NO: 2505594 - DNA, 18 bp, Homo sapiens
aacactgttctctgccct

SEQ ID NO: 2505595 - DNA, 19 bp, Homo sapiens
aacactgttctctgccctc

SEQ ID NO: 2505596 - DNA, 22 bp, Homo sapiens
aacacttaagggttttagaaaa

SEQ ID NO: 2505597 - DNA, 13 bp, Homo sapiens
aacagaaacaaaa

SEQ ID NO: 2505598 - DNA, 18 bp, Homo sapiens
aacagaaagggcaacaat

SEQ ID NO: 2505599 - DNA, 11 bp, Homo sapiens
aacagaaatgt

SEQ ID NO: 2505600 - DNA, 21 bp, Homo sapiens
aacagaaatgtacagcaagga

SEQ ID NO: 2505601 - DNA, 13 bp, Homo sapiens
aacagaacagctt

SEQ ID NO: 2505602 - DNA, 15 bp, Homo sapiens
aacagaacagcttca

SEQ ID NO: 2505603 - DNA, 13 bp, Homo sapiens
aacagaaggatga

SEQ ID NO: 2505604 - DNA, 19 bp, Homo sapiens
aacagaccccctctagaaa

SEQ ID NO: 2505605 - DNA, 19 bp, Homo sapiens
aacagactcgattcatatt

SEQ ID NO: 2505606 - DNA, 19 bp, Homo sapiens
aacagactggaagcacagc

SEQ ID NO: 2505607 - DNA, 13 bp, Homo sapiens
aacagagatgtga

SEQ ID NO: 2505608 - DNA, 20 bp, Homo sapiens
aacagaggaagaatttgtta

SEQ ID NO: 2505609 - DNA, 19 bp, Homo sapiens
aacagagtgagaccctgtc

SEQ ID NO: 2505610 - DNA, 19 bp, Homo sapiens
aacagattattaccttaca

SEQ ID NO: 2505611 - DNA, 15 bp, Homo sapiens
aacagattcacactg

SEQ ID NO: 2505612 - DNA, 13 bp, Homo sapiens
aacagatttgtga

SEQ ID NO: 2505613 - DNA, 15 bp, Homo sapiens
aacagatttgtgaac

SEQ ID NO: 2505614 - DNA, 13 bp, Homo sapiens
aacagatttttac

SEQ ID NO: 2505615 - DNA, 14 bp, Homo sapiens
aacagatttttaca

SEQ ID NO: 2505616 - DNA, 20 bp, Homo sapiens
aacagcactggctctctcca

SEQ ID NO: 2505617 - DNA, 21 bp, Homo sapiens
aacagcagggtagtctggttt

SEQ ID NO: 2505618 - DNA, 18 bp, Homo sapiens
aacagccactacattact

SEQ ID NO: 2505619 - DNA, 21 bp, Homo sapiens
aacagccgctcctgtctgcca

SEQ ID NO: 2505620 - DNA, 22 bp, Homo sapiens
aacagctatgggagccccaggg

SEQ ID NO: 2505621 - DNA, 19 bp, Homo sapiens
aacaggagctgggatccta

SEQ ID NO: 2505622 - DNA, 14 bp, Homo sapiens
aacaggcaagtgaa

SEQ ID NO: 2505623 - DNA, 11 bp, Homo sapiens
aacaggcagat

SEQ ID NO: 2505624 - DNA, 13 bp, Homo sapiens
aacaggtctcctc

SEQ ID NO: 2505625 - DNA, 15 bp, Homo sapiens
aacaggtctcctctt

SEQ ID NO: 2505626 - DNA, 20 bp, Homo sapiens
aacaggtctcctcttaaaaa

SEQ ID NO: 2505627 - DNA, 22 bp, Homo sapiens
aacaggttattttagtttctgt

SEQ ID NO: 2505628 - DNA, 19 bp, Homo sapiens
aacagtctcaggaaatcaa

SEQ ID NO: 2505629 - DNA, 23 bp, Homo sapiens
aacagtctgatcgtgacgctgaa

SEQ ID NO: 2505630 - DNA, 13 bp, Homo sapiens
aacagtgagcctg

SEQ ID NO: 2505631 - DNA, 22 bp, Homo sapiens
aacagtgattaccagggactga

SEQ ID NO: 2505632 - DNA, 23 bp, Homo sapiens
aacagtgctaaaaatgggacttc

SEQ ID NO: 2505633 - DNA, 20 bp, Homo sapiens
aacagtgtgaagttagaatt

SEQ ID NO: 2505634 - DNA, 22 bp, Homo sapiens
aacagtgtgaagttagaattcc

SEQ ID NO: 2505635 - DNA, 19 bp, Homo sapiens
aacagtgtttcccataatt

SEQ ID NO: 2505636 - DNA, 17 bp, Homo sapiens
aacagttaactttcaga

SEQ ID NO: 2505637 - DNA, 19 bp, Homo sapiens
aacagttaataccattttt

SEQ ID NO: 2505638 - DNA, 16 bp, Homo sapiens
aacagttagctggagc

SEQ ID NO: 2505639 - DNA, 14 bp, Homo sapiens
aacagttttccatg

SEQ ID NO: 2505640 - DNA, 21 bp, Homo sapiens
aacagttttttatgctaatca

SEQ ID NO: 2505641 - DNA, 17 bp, Homo sapiens
aacataattcttgtata

SEQ ID NO: 2505642 - DNA, 14 bp, Homo sapiens
aacatactcccatc

SEQ ID NO: 2505643 - DNA, 15 bp, Homo sapiens
aacatactcccatct

SEQ ID NO: 2505644 - DNA, 16 bp, Homo sapiens
aacatactcccatctg

SEQ ID NO: 2505645 - DNA, 18 bp, Homo sapiens
aacatactcccatctgtg

SEQ ID NO: 2505646 - DNA, 13 bp, Homo sapiens
aacatataatgtt

SEQ ID NO: 2505647 - DNA, 17 bp, Homo sapiens
aacatatgaaaatacaa

SEQ ID NO: 2505648 - DNA, 14 bp, Homo sapiens
aacatattgttgaa

SEQ ID NO: 2505649 - DNA, 20 bp, Homo sapiens
aacatatttgttaaatattt

SEQ ID NO: 2505650 - DNA, 14 bp, Homo sapiens
aacatcaacatctt

SEQ ID NO: 2505651 - DNA, 19 bp, Homo sapiens
aacatcagttactctgaag

SEQ ID NO: 2505652 - DNA, 21 bp, Homo sapiens
aacatcagttactctgaaggg

SEQ ID NO: 2505653 - DNA, 14 bp, Homo sapiens
aacatcatcaaggc

SEQ ID NO: 2505654 - DNA, 19 bp, Homo sapiens
aacatccaaggagaaacag

SEQ ID NO: 2505655 - DNA, 21 bp, Homo sapiens
aacatgaagtcgttgtgaggg

SEQ ID NO: 2505656 - DNA, 20 bp, Homo sapiens
aacatgaccctaaatcttga

SEQ ID NO: 2505657 - DNA, 22 bp, Homo sapiens
aacatggaactcattcctgcct

SEQ ID NO: 2505658 - DNA, 19 bp, Homo sapiens
aacatggacttgtatattt

SEQ ID NO: 2505659 - DNA, 20 bp, Homo sapiens
aacatggacttgtatatttg

SEQ ID NO: 2505660 - DNA, 22 bp, Homo sapiens
aacatggcctttgcttgaaaga

SEQ ID NO: 2505661 - DNA, 18 bp, Homo sapiens
aacatggtgtctggattc

SEQ ID NO: 2505662 - DNA, 18 bp, Homo sapiens
aacatgtaatataaagat

SEQ ID NO: 2505663 - DNA, 22 bp, Homo sapiens
aacatgtaatataaagatgtta

SEQ ID NO: 2505664 - DNA, 14 bp, Homo sapiens
aacatgtaattaag

SEQ ID NO: 2505665 - DNA, 13 bp, Homo sapiens
aacatgtgtactt

SEQ ID NO: 2505666 - DNA, 13 bp, Homo sapiens
aacatgtgtttta

SEQ ID NO: 2505667 - DNA, 16 bp, Homo sapiens
aacatgttactgacca

SEQ ID NO: 2505668 - DNA, 11 bp, Homo sapiens
aacatgtttcc

SEQ ID NO: 2505669 - DNA, 21 bp, Homo sapiens
aacattaaaacaatattgttt

SEQ ID NO: 2505670 - DNA, 23 bp, Homo sapiens
aacattaaaacaatattgtttct

SEQ ID NO: 2505671 - DNA, 21 bp, Homo sapiens
aacattaagattgaggcctgc

SEQ ID NO: 2505672 - DNA, 13 bp, Homo sapiens
aacattccatcct

SEQ ID NO: 2505673 - DNA, 23 bp, Homo sapiens
aacattccatccttgagtcaaaa

SEQ ID NO: 2505674 - DNA, 17 bp, Homo sapiens
aacattctgatttggaa

SEQ ID NO: 2505675 - DNA, 18 bp, Homo sapiens
aacattgaagtaatgaat

SEQ ID NO: 2505676 - DNA, 20 bp, Homo sapiens
aacattgcatataacttata

SEQ ID NO: 2505677 - DNA, 18 bp, Homo sapiens
aacattggttcttgtatt

SEQ ID NO: 2505678 - DNA, 19 bp, Homo sapiens
aacattggttcttgtatta

SEQ ID NO: 2505679 - DNA, 22 bp, Homo sapiens
aacattggttcttgtattaaga

SEQ ID NO: 2505680 - DNA, 23 bp, Homo sapiens
aacattggttcttgtattaagaa

SEQ ID NO: 2505681 - DNA, 16 bp, Homo sapiens
aacatttctcaataat

SEQ ID NO: 2505682 - DNA, 13 bp, Homo sapiens
aacattttcacac

SEQ ID NO: 2505683 - DNA, 16 bp, Homo sapiens
aacattttgtcatata

SEQ ID NO: 2505684 - DNA, 22 bp, Homo sapiens
aacattttgtggtcattaagca

SEQ ID NO: 2505685 - DNA, 18 bp, Homo sapiens
aaccaaaaagaccagact

SEQ ID NO: 2505686 - DNA, 19 bp, Homo sapiens
aaccaaaaagaccagacta

SEQ ID NO: 2505687 - DNA, 16 bp, Homo sapiens
aaccaaagagactgga

SEQ ID NO: 2505688 - DNA, 20 bp, Homo sapiens
aaccaagtcatgtgcatttc

SEQ ID NO: 2505689 - DNA, 13 bp, Homo sapiens
aaccacagccctg

SEQ ID NO: 2505690 - DNA, 14 bp, Homo sapiens
aaccacagctgctg

SEQ ID NO: 2505691 - DNA, 15 bp, Homo sapiens
aaccacagctgctgg

SEQ ID NO: 2505692 - DNA, 16 bp, Homo sapiens
aaccacagctgctgga

SEQ ID NO: 2505693 - DNA, 15 bp, Homo sapiens
aaccaccgctcccca

SEQ ID NO: 2505694 - DNA, 18 bp, Homo sapiens
aaccaccgctccccagcc

SEQ ID NO: 2505695 - DNA, 13 bp, Homo sapiens
aaccacgctggac

SEQ ID NO: 2505696 - DNA, 11 bp, Homo sapiens
aaccactgaat

SEQ ID NO: 2505697 - DNA, 15 bp, Homo sapiens
aaccactgtaaaatg

SEQ ID NO: 2505698 - DNA, 20 bp, Homo sapiens
aaccactgtaaaatgaaatt

SEQ ID NO: 2505699 - DNA, 19 bp, Homo sapiens
aaccacttaaaaaatgtcc

SEQ ID NO: 2505700 - DNA, 22 bp, Homo sapiens
aaccagaagcaacagaaaaaat

SEQ ID NO: 2505701 - DNA, 18 bp, Homo sapiens
aaccagagccatggactc

SEQ ID NO: 2505702 - DNA, 21 bp, Homo sapiens
aaccagcatcccttgaccagg

SEQ ID NO: 2505703 - DNA, 15 bp, Homo sapiens
aaccaggaaatggaa

SEQ ID NO: 2505704 - DNA, 18 bp, Homo sapiens
aaccagtttcaggtgttt

SEQ ID NO: 2505705 - DNA, 17 bp, Homo sapiens
aaccatgaagacaggat

SEQ ID NO: 2505706 - DNA, 19 bp, Homo sapiens
aaccatgcaaatgctatga

SEQ ID NO: 2505707 - DNA, 16 bp, Homo sapiens
aaccatggctgaagga

SEQ ID NO: 2505708 - DNA, 23 bp, Homo sapiens
aaccattaaaactgaagtctgaa

SEQ ID NO: 2505709 - DNA, 18 bp, Homo sapiens
aacccaaatgttcatcaa

SEQ ID NO: 2505710 - DNA, 16 bp, Homo sapiens
aacccaactctcctgg

SEQ ID NO: 2505711 - DNA, 11 bp, Homo sapiens
aacccagctct

SEQ ID NO: 2505712 - DNA, 20 bp, Homo sapiens
aacccatatttgtacaccaa

SEQ ID NO: 2505713 - DNA, 12 bp, Homo sapiens
aaccccagctcc

SEQ ID NO: 2505714 - DNA, 13 bp, Homo sapiens
aaccccaggcccc

SEQ ID NO: 2505715 - DNA, 13 bp, Homo sapiens
aaccccagttctg

SEQ ID NO: 2505716 - DNA, 18 bp, Homo sapiens
aaccccagttctgctcct

SEQ ID NO: 2505717 - DNA, 22 bp, Homo sapiens
aaccccagttctgctcctctcc

SEQ ID NO: 2505718 - DNA, 12 bp, Homo sapiens
aacccccacaca

SEQ ID NO: 2505719 - DNA, 23 bp, Homo sapiens
aaatgatccccagctgtttatgc

SEQ ID NO: 2505720 - DNA, 15 bp, Homo sapiens
aaatgattgtaaaat

SEQ ID NO: 2505721 - DNA, 23 bp, Homo sapiens
aaatgatttttacaagttttaaa

SEQ ID NO: 2505722 - DNA, 21 bp, Homo sapiens
aaatgcaaacacacaaaggta

SEQ ID NO: 2505723 - DNA, 19 bp, Homo sapiens
aaatgcacatagctatcaa

SEQ ID NO: 2505724 - DNA, 18 bp, Homo sapiens
aaatgcacctggaatata

SEQ ID NO: 2505725 - DNA, 21 bp, Homo sapiens
aaatgcagcgaaccaatattt

SEQ ID NO: 2505726 - DNA, 18 bp, Homo sapiens
aaatgcccagccccttct

SEQ ID NO: 2505727 - DNA, 13 bp, Homo sapiens
aaatgcctttgag

SEQ ID NO: 2505728 - DNA, 14 bp, Homo sapiens
aaatgcctttgaga

SEQ ID NO: 2505729 - DNA, 18 bp, Homo sapiens
aaatgcctttgagacagt

SEQ ID NO: 2505730 - DNA, 14 bp, Homo sapiens
aaatgctatttttt

SEQ ID NO: 2505731 - DNA, 15 bp, Homo sapiens
aaatgctgaacattg

SEQ ID NO: 2505732 - DNA, 18 bp, Homo sapiens
aaatggaagacacattga

SEQ ID NO: 2505733 - DNA, 22 bp, Homo sapiens
aaatggaggtccttctgctgga

SEQ ID NO: 2505734 - DNA, 13 bp, Homo sapiens
aaatggatactgg

SEQ ID NO: 2505735 - DNA, 19 bp, Homo sapiens
aaatggccatttgcttttt

SEQ ID NO: 2505736 - DNA, 17 bp, Homo sapiens
aaatggctggtttttag

SEQ ID NO: 2505737 - DNA, 20 bp, Homo sapiens
aaatgggacttcttttcaca

SEQ ID NO: 2505738 - DNA, 14 bp, Homo sapiens
aaatggtccaggag

SEQ ID NO: 2505739 - DNA, 18 bp, Homo sapiens
aaatggtcgcccaggaga

SEQ ID NO: 2505740 - DNA, 14 bp, Homo sapiens
aaatggtgccttca

SEQ ID NO: 2505741 - DNA, 14 bp, Homo sapiens
aaatggtgtacata

SEQ ID NO: 2505742 - DNA, 18 bp, Homo sapiens
aaatgtaacttttgtaag

SEQ ID NO: 2505743 - DNA, 22 bp, Homo sapiens
aaatgtaagatcgttctctgcc

SEQ ID NO: 2505744 - DNA, 15 bp, Homo sapiens
aaatgtatatgcact

SEQ ID NO: 2505745 - DNA, 17 bp, Homo sapiens
aaatgtatcatagaaat

SEQ ID NO: 2505746 - DNA, 20 bp, Homo sapiens
aaatgtatcatagaaatgta

SEQ ID NO: 2505747 - DNA, 22 bp, Homo sapiens
aaatgtcctccagaagcctctg

SEQ ID NO: 2505748 - DNA, 12 bp, Homo sapiens
aaatgtcttgtg

SEQ ID NO: 2505749 - DNA, 22 bp, Homo sapiens
aaatgtctttccttttgctctt

SEQ ID NO: 2505750 - DNA, 22 bp, Homo sapiens
aaatgtcttttttttaatgtgc

SEQ ID NO: 2505751 - DNA, 21 bp, Homo sapiens
aaatgtgaataaaattatttt

SEQ ID NO: 2505752 - DNA, 18 bp, Homo sapiens
aaatgtgccttcattttt

SEQ ID NO: 2505753 - DNA, 15 bp, Homo sapiens
aaatgtgcttttaaa

SEQ ID NO: 2505754 - DNA, 15 bp, Homo sapiens
aaatgtggctcctgg

SEQ ID NO: 2505755 - DNA, 13 bp, Homo sapiens
aaatgtgtatttt

SEQ ID NO: 2505756 - DNA, 16 bp, Homo sapiens
aaatgtgtttaaaaca

SEQ ID NO: 2505757 - DNA, 16 bp, Homo sapiens
aaatgttaaaatgtat

SEQ ID NO: 2505758 - DNA, 20 bp, Homo sapiens
aaatgttaagttgatggtga

SEQ ID NO: 2505759 - DNA, 16 bp, Homo sapiens
aaatgttcacttttga

SEQ ID NO: 2505760 - DNA, 20 bp, Homo sapiens
aaatgttcatcaatgaatga

SEQ ID NO: 2505761 - DNA, 23 bp, Homo sapiens
aaatgttgaataaaaatatgtac

SEQ ID NO: 2505762 - DNA, 18 bp, Homo sapiens
aaatgttggatttataaa

SEQ ID NO: 2505763 - DNA, 20 bp, Homo sapiens
aaatgttggatttataaatg

SEQ ID NO: 2505764 - DNA, 23 bp, Homo sapiens
aaatgttggatttataaatgcta

SEQ ID NO: 2505765 - DNA, 19 bp, Homo sapiens
aaatgttggtcattttatg

SEQ ID NO: 2505766 - DNA, 22 bp, Homo sapiens
aaatgttgttctcttctttaaa

SEQ ID NO: 2505767 - DNA, 17 bp, Homo sapiens
aaatgtttttctatgta

SEQ ID NO: 2505768 - DNA, 17 bp, Homo sapiens
aaattaaagctgaaaac

SEQ ID NO: 2505769 - DNA, 13 bp, Homo sapiens
aaattaacactgc

SEQ ID NO: 2505770 - DNA, 21 bp, Homo sapiens
aaattaacactgcttgtgttt

SEQ ID NO: 2505771 - DNA, 18 bp, Homo sapiens
aaattaacagtcctaact

SEQ ID NO: 2505772 - DNA, 17 bp, Homo sapiens
aaattaacttgagtttt

SEQ ID NO: 2505773 - DNA, 12 bp, Homo sapiens
aaattaactttt

SEQ ID NO: 2505774 - DNA, 12 bp, Homo sapiens
aaattaagacat

SEQ ID NO: 2505775 - DNA, 21 bp, Homo sapiens
aaattacttatcatccacatt

SEQ ID NO: 2505776 - DNA, 23 bp, Homo sapiens
aaattagaaaccttaatatgtgg

SEQ ID NO: 2505777 - DNA, 16 bp, Homo sapiens
aaattaggaataaata

SEQ ID NO: 2505778 - DNA, 18 bp, Homo sapiens
aaattaggatttcatgat

SEQ ID NO: 2505779 - DNA, 23 bp, Homo sapiens
aaattaggttttgtacaattgaa

SEQ ID NO: 2505780 - DNA, 17 bp, Homo sapiens
aaattataacttaaaat

SEQ ID NO: 2505781 - DNA, 17 bp, Homo sapiens
aaattatagatgggaat

SEQ ID NO: 2505782 - DNA, 20 bp, Homo sapiens
aaattatagatgggaatgaa

SEQ ID NO: 2505783 - DNA, 20 bp, Homo sapiens
aaattatgttacatctgttt

SEQ ID NO: 2505784 - DNA, 17 bp, Homo sapiens
aaattatgtttatataa

SEQ ID NO: 2505785 - DNA, 19 bp, Homo sapiens
aaattattagtttacatca

SEQ ID NO: 2505786 - DNA, 13 bp, Homo sapiens
aaattatttgcat

SEQ ID NO: 2505787 - DNA, 15 bp, Homo sapiens
aaattcctattgtga

SEQ ID NO: 2505788 - DNA, 16 bp, Homo sapiens
aaattcctattgtgat

SEQ ID NO: 2505789 - DNA, 22 bp, Homo sapiens
aaattcctattgtgatttgact

SEQ ID NO: 2505790 - DNA, 15 bp, Homo sapiens
aaattctacaacaca

SEQ ID NO: 2505791 - DNA, 19 bp, Homo sapiens
aaattctattacagtatgt

SEQ ID NO: 2505792 - DNA, 21 bp, Homo sapiens
aaattctattctgatcttatt

SEQ ID NO: 2505793 - DNA, 15 bp, Homo sapiens
aaattctgtttcttg

SEQ ID NO: 2505794 - DNA, 23 bp, Homo sapiens
aaattcttctgaactcaaactga

SEQ ID NO: 2505795 - DNA, 18 bp, Homo sapiens
aaattcttgcaaagtatc

SEQ ID NO: 2505796 - DNA, 23 bp, Homo sapiens
aaattgaaaggcattctctgaag

SEQ ID NO: 2505797 - DNA, 23 bp, Homo sapiens
aaattgaataatggtaccagata

SEQ ID NO: 2505798 - DNA, 19 bp, Homo sapiens
aaattgacacttaaaaatg

SEQ ID NO: 2505799 - DNA, 22 bp, Homo sapiens
aaattgacacttaaaaatggtt

SEQ ID NO: 2505800 - DNA, 13 bp, Homo sapiens
aaattgagagaat

SEQ ID NO: 2505801 - DNA, 17 bp, Homo sapiens
aaattgagagaatggaa

SEQ ID NO: 2505802 - DNA, 13 bp, Homo sapiens
aaattgctccttg

SEQ ID NO: 2505803 - DNA, 16 bp, Homo sapiens
aaattgcttgaaagaa

SEQ ID NO: 2505804 - DNA, 19 bp, Homo sapiens
aaattggaacagaatgttt

SEQ ID NO: 2505805 - DNA, 16 bp, Homo sapiens
aaattggttctttatt

SEQ ID NO: 2505806 - DNA, 12 bp, Homo sapiens
aaattgtacata

SEQ ID NO: 2505807 - DNA, 15 bp, Homo sapiens
aaattgtacatattt

SEQ ID NO: 2505808 - DNA, 22 bp, Homo sapiens
aaattgtacatatttgtggaat

SEQ ID NO: 2505809 - DNA, 15 bp, Homo sapiens
aaattgtgatgtgtc

SEQ ID NO: 2505810 - DNA, 22 bp, Homo sapiens
aaattgtttccaagatagagag

SEQ ID NO: 2505811 - DNA, 23 bp, Homo sapiens
aaatttaaaagacactgtttaca

SEQ ID NO: 2505812 - DNA, 12 bp, Homo sapiens
aaatttaagcat

SEQ ID NO: 2505813 - DNA, 13 bp, Homo sapiens
aaatttaagcatt

SEQ ID NO: 2505814 - DNA, 12 bp, Homo sapiens
aaatttatgtga

SEQ ID NO: 2505815 - DNA, 14 bp, Homo sapiens
aaatttatttactg

SEQ ID NO: 2505816 - DNA, 23 bp, Homo sapiens
aaatttccagtacctttgtcaca

SEQ ID NO: 2505817 - DNA, 17 bp, Homo sapiens
aaatttccccaacagtg

SEQ ID NO: 2505818 - DNA, 13 bp, Homo sapiens
aaatttctaaatc

SEQ ID NO: 2505819 - DNA, 15 bp, Homo sapiens
aaatttctaaatctc

SEQ ID NO: 2505820 - DNA, 10 bp, Homo sapiens
aaatttgaat

SEQ ID NO: 2505821 - DNA, 20 bp, Homo sapiens
aaatttgaatgggtccattt

SEQ ID NO: 2505822 - DNA, 12 bp, Homo sapiens
aaatttgtaagt

SEQ ID NO: 2505823 - DNA, 22 bp, Homo sapiens
aaatttgtaagtttcaggtgac

SEQ ID NO: 2505824 - DNA, 18 bp, Homo sapiens
aaatttgttataatgaat

SEQ ID NO: 2505825 - DNA, 18 bp, Homo sapiens
aaatttgttgaaattatg

SEQ ID NO: 2505826 - DNA, 13 bp, Homo sapiens
aaatttgttgcat

SEQ ID NO: 2505827 - DNA, 14 bp, Homo sapiens
aaatttgtttgaaa

SEQ ID NO: 2505828 - DNA, 18 bp, Homo sapiens
aaatttgtttgaaatctt

SEQ ID NO: 2505829 - DNA, 17 bp, Homo sapiens
aaattttatctcttatt

SEQ ID NO: 2505830 - DNA, 18 bp, Homo sapiens
aaattttatttcctggac

SEQ ID NO: 2505831 - DNA, 19 bp, Homo sapiens
aaattttctagactttctg

SEQ ID NO: 2505832 - DNA, 18 bp, Homo sapiens
aaattttggccaaagtgt

SEQ ID NO: 2505833 - DNA, 17 bp, Homo sapiens
aaattttttttgtttca

SEQ ID NO: 2505834 - DNA, 18 bp, Homo sapiens
aaattttttttgtttcat

SEQ ID NO: 2505835 - DNA, 11 bp, Homo sapiens
aacaaaaataa

SEQ ID NO: 2505836 - DNA, 15 bp, Homo sapiens
aacaaaagcaagact

SEQ ID NO: 2505837 - DNA, 20 bp, Homo sapiens
aacaaaatctcctcttttag

SEQ ID NO: 2505838 - DNA, 14 bp, Homo sapiens
aacaaactatttct

SEQ ID NO: 2505839 - DNA, 19 bp, Homo sapiens
aacaaagagaaaaaataca

SEQ ID NO: 2505840 - DNA, 12 bp, Homo sapiens
aacaaagccaga

SEQ ID NO: 2505841 - DNA, 19 bp, Homo sapiens
aacaaagcttagcaggaga

SEQ ID NO: 2505842 - DNA, 21 bp, Homo sapiens
aacaaattaggttttgtacaa

SEQ ID NO: 2505843 - DNA, 20 bp, Homo sapiens
aacaaattatgttacatctg

SEQ ID NO: 2505844 - DNA, 16 bp, Homo sapiens
aacaaattgaactctt

SEQ ID NO: 2505845 - DNA, 18 bp, Homo sapiens
aacaaatttacagagaca

SEQ ID NO: 2505846 - DNA, 13 bp, Homo sapiens
aacaacctggaga

SEQ ID NO: 2505847 - DNA, 21 bp, Homo sapiens
aacaactcctagggccactga

SEQ ID NO: 2505848 - DNA, 22 bp, Homo sapiens
aacaagacctcagtgccttcct

SEQ ID NO: 2505849 - DNA, 20 bp, Homo sapiens
aacaagggagagacctcatc

SEQ ID NO: 2505850 - DNA, 16 bp, Homo sapiens
aacaaggtagttttta

SEQ ID NO: 2505851 - DNA, 16 bp, Homo sapiens
aacaagtccctgtaat

SEQ ID NO: 2505852 - DNA, 18 bp, Homo sapiens
aacaataactactgtgtt

SEQ ID NO: 2505853 - DNA, 20 bp, Homo sapiens
aacaataactactgtgttcc

SEQ ID NO: 2505854 - DNA, 21 bp, Homo sapiens
aacaatactcataatgtgaag

SEQ ID NO: 2505855 - DNA, 18 bp, Homo sapiens
aacaatggaaactgaatg

SEQ ID NO: 2505856 - DNA, 21 bp, Homo sapiens
aacaatgttaaggaaactctt

SEQ ID NO: 2505857 - DNA, 16 bp, Homo sapiens
aacaatttatgaattg

SEQ ID NO: 2505858 - DNA, 22 bp, Homo sapiens
aacaatttcctttatatttagt

SEQ ID NO: 2505859 - DNA, 20 bp, Homo sapiens
aacaatttgagatgtatttc

SEQ ID NO: 2505860 - DNA, 15 bp, Homo sapiens
aacacaagctggaag

SEQ ID NO: 2505861 - DNA, 18 bp, Homo sapiens
aacacactgaggcaggga

SEQ ID NO: 2505862 - DNA, 21 bp, Homo sapiens
aacacactgaggcagggaagt

SEQ ID NO: 2505863 - DNA, 20 bp, Homo sapiens
aacacagacattctgccagg

SEQ ID NO: 2505864 - DNA, 15 bp, Homo sapiens
aacacagcaagggtg

SEQ ID NO: 2505865 - DNA, 20 bp, Homo sapiens
aacacagcaagggtgatggg

SEQ ID NO: 2505866 - DNA, 19 bp, Homo sapiens
aacacagctgagagacttt

SEQ ID NO: 2505867 - DNA, 19 bp, Homo sapiens
aacacagtgtttttgtaaa

SEQ ID NO: 2505868 - DNA, 21 bp, Homo sapiens
aacacagtgtttttgtaaagt

SEQ ID NO: 2505869 - DNA, 21 bp, Homo sapiens
aaagtatcctgcttctgatat

SEQ ID NO: 2505870 - DNA, 19 bp, Homo sapiens
aaagtatgtaaagtatgta

SEQ ID NO: 2505871 - DNA, 12 bp, Homo sapiens
aaagtattttcc

SEQ ID NO: 2505872 - DNA, 21 bp, Homo sapiens
aaagtattttcctgtaaaaaa

SEQ ID NO: 2505873 - DNA, 16 bp, Homo sapiens
aaagtcaggtccaatt

SEQ ID NO: 2505874 - DNA, 19 bp, Homo sapiens
aaagtcatgcaaaggctgg

SEQ ID NO: 2505875 - DNA, 21 bp, Homo sapiens
aaagtcatgcaaaggctggga

SEQ ID NO: 2505876 - DNA, 12 bp, Homo sapiens
aaagtctcttgt

SEQ ID NO: 2505877 - DNA, 11 bp, Homo sapiens
aaagtctgcaa

SEQ ID NO: 2505878 - DNA, 20 bp, Homo sapiens
aaagtgaaagtccagaaact

SEQ ID NO: 2505879 - DNA, 22 bp, Homo sapiens
aaagtgaatttgaatgaaaaat

SEQ ID NO: 2505880 - DNA, 20 bp, Homo sapiens
aaagtgagggccgagtgaga

SEQ ID NO: 2505881 - DNA, 10 bp, Homo sapiens
aaagtgatta

SEQ ID NO: 2505882 - DNA, 11 bp, Homo sapiens
aaagtgctggg

SEQ ID NO: 2505883 - DNA, 12 bp, Homo sapiens
aaagtgctggga

SEQ ID NO: 2505884 - DNA, 19 bp, Homo sapiens
aaagtggaaaacaaggaag

SEQ ID NO: 2505885 - DNA, 16 bp, Homo sapiens
aaagtggcctctttgt

SEQ ID NO: 2505886 - DNA, 18 bp, Homo sapiens
aaagtggcctctttgtct

SEQ ID NO: 2505887 - DNA, 17 bp, Homo sapiens
aaagtggtatagaaatg

SEQ ID NO: 2505888 - DNA, 20 bp, Homo sapiens
aaagtggtatagaaatgctg

SEQ ID NO: 2505889 - DNA, 16 bp, Homo sapiens
aaagtggtgctcagtt

SEQ ID NO: 2505890 - DNA, 11 bp, Homo sapiens
aaagtgtaaag

SEQ ID NO: 2505891 - DNA, 22 bp, Homo sapiens
aaagtgtaaagcattccaacaa

SEQ ID NO: 2505892 - DNA, 21 bp, Homo sapiens
aaagtgtatttttttactaat

SEQ ID NO: 2505893 - DNA, 18 bp, Homo sapiens
aaagtgtgagcaaactaa

SEQ ID NO: 2505894 - DNA, 16 bp, Homo sapiens
aaagttaacagatttt

SEQ ID NO: 2505895 - DNA, 19 bp, Homo sapiens
aaagttactacctgtcaag

SEQ ID NO: 2505896 - DNA, 16 bp, Homo sapiens
aaagttatataggttt

SEQ ID NO: 2505897 - DNA, 23 bp, Homo sapiens
aaagttctgcagataaacagtag

SEQ ID NO: 2505898 - DNA, 17 bp, Homo sapiens
aaagttctgtaaaatat

SEQ ID NO: 2505899 - DNA, 18 bp, Homo sapiens
aaagttgcacggctgctg

SEQ ID NO: 2505900 - DNA, 12 bp, Homo sapiens
aaagtttcaatg

SEQ ID NO: 2505901 - DNA, 15 bp, Homo sapiens
aaagttttcctgaga

SEQ ID NO: 2505902 - DNA, 14 bp, Homo sapiens
aaagttttgaaaag

SEQ ID NO: 2505903 - DNA, 13 bp, Homo sapiens
aaataaaaaaaag

SEQ ID NO: 2505904 - DNA, 15 bp, Homo sapiens
aaataaaaagtgaca

SEQ ID NO: 2505905 - DNA, 21 bp, Homo sapiens
aaataaaaagtgacacagcag

SEQ ID NO: 2505906 - DNA, 12 bp, Homo sapiens
aaataaaacatt

SEQ ID NO: 2505907 - DNA, 11 bp, Homo sapiens
aaataaaacct

SEQ ID NO: 2505908 - DNA, 18 bp, Homo sapiens
aaataaacaaataacaat

SEQ ID NO: 2505909 - DNA, 20 bp, Homo sapiens
aaataaagcttgcaacaaaa

SEQ ID NO: 2505910 - DNA, 13 bp, Homo sapiens
aaataaagtatat

SEQ ID NO: 2505911 - DNA, 16 bp, Homo sapiens
aaataaagtatatata

SEQ ID NO: 2505912 - DNA, 18 bp, Homo sapiens
aaataaagttggtgacag

SEQ ID NO: 2505913 - DNA, 20 bp, Homo sapiens
aaataaatgagctatgtatt

SEQ ID NO: 2505914 - DNA, 11 bp, Homo sapiens
aaataaattat

SEQ ID NO: 2505915 - DNA, 19 bp, Homo sapiens
aaataaatttggttctaat

SEQ ID NO: 2505916 - DNA, 17 bp, Homo sapiens
aaataactagtgttgct

SEQ ID NO: 2505917 - DNA, 16 bp, Homo sapiens
aaataacttcaagcaa

SEQ ID NO: 2505918 - DNA, 18 bp, Homo sapiens
aaataacttcaagcaaac

SEQ ID NO: 2505919 - DNA, 12 bp, Homo sapiens
aaataagaaaag

SEQ ID NO: 2505920 - DNA, 24 bp, Homo sapiens
aaataagaaacaactctttgagaa

SEQ ID NO: 2505921 - DNA, 12 bp, Homo sapiens
aaataagagaga

SEQ ID NO: 2505922 - DNA, 20 bp, Homo sapiens
aaataagtggttatttctca

SEQ ID NO: 2505923 - DNA, 17 bp, Homo sapiens
aaataataaagatgctc

SEQ ID NO: 2505924 - DNA, 12 bp, Homo sapiens
aaataatatgca

SEQ ID NO: 2505925 - DNA, 14 bp, Homo sapiens
aaataatgtgaaac

SEQ ID NO: 2505926 - DNA, 22 bp, Homo sapiens
aaataatgtgaaactggattaa

SEQ ID NO: 2505927 - DNA, 14 bp, Homo sapiens
aaataattctaaag

SEQ ID NO: 2505928 - DNA, 17 bp, Homo sapiens
aaataattgatttcaag

SEQ ID NO: 2505929 - DNA, 15 bp, Homo sapiens
aaatacacactcaaa

SEQ ID NO: 2505930 - DNA, 22 bp, Homo sapiens
aaatacagtttgtcacatgaaa

SEQ ID NO: 2505931 - DNA, 18 bp, Homo sapiens
aaataccagccagtaaat

SEQ ID NO: 2505932 - DNA, 21 bp, Homo sapiens
aaataccagccagtaaatggg

SEQ ID NO: 2505933 - DNA, 21 bp, Homo sapiens
aaatactatttttactgccac

SEQ ID NO: 2505934 - DNA, 22 bp, Homo sapiens
aaatactatttttactgccact

SEQ ID NO: 2505935 - DNA, 23 bp, Homo sapiens
aaatactgccagatgctgatgtt

SEQ ID NO: 2505936 - DNA, 14 bp, Homo sapiens
aaatactgtacaat

SEQ ID NO: 2505937 - DNA, 20 bp, Homo sapiens
aaatacttgtcaatatttaa

SEQ ID NO: 2505938 - DNA, 22 bp, Homo sapiens
aaatacttgtcaatatttaaac

SEQ ID NO: 2505939 - DNA, 16 bp, Homo sapiens
aaatactttaaaggaa

SEQ ID NO: 2505940 - DNA, 17 bp, Homo sapiens
aaatactttaaaggaaa

SEQ ID NO: 2505941 - DNA, 17 bp, Homo sapiens
aaatagagtatatgcac

SEQ ID NO: 2505942 - DNA, 19 bp, Homo sapiens
aaatagagtatatgcactt

SEQ ID NO: 2505943 - DNA, 13 bp, Homo sapiens
aaatagctctttc

SEQ ID NO: 2505944 - DNA, 16 bp, Homo sapiens
aaataggagaggatga

SEQ ID NO: 2505945 - DNA, 24 bp, Homo sapiens
aaataggagaggatgagagcccag

SEQ ID NO: 2505946 - DNA, 21 bp, Homo sapiens
aaatagtgcagaatctcatag

SEQ ID NO: 2505947 - DNA, 20 bp, Homo sapiens
aaatagtgtggaaattaaga

SEQ ID NO: 2505948 - DNA, 12 bp, Homo sapiens
aaatataattct

SEQ ID NO: 2505949 - DNA, 19 bp, Homo sapiens
aaatataattctgtaaatg

SEQ ID NO: 2505950 - DNA, 15 bp, Homo sapiens
aaatatacacacagc

SEQ ID NO: 2505951 - DNA, 15 bp, Homo sapiens
aaatatactgtaaag

SEQ ID NO: 2505952 - DNA, 17 bp, Homo sapiens
aaatatactgtaaagaa

SEQ ID NO: 2505953 - DNA, 21 bp, Homo sapiens
aaatatactgtaaagaaagag

SEQ ID NO: 2505954 - DNA, 14 bp, Homo sapiens
aaatatacttaaat

SEQ ID NO: 2505955 - DNA, 23 bp, Homo sapiens
aaatatatatgtgtgtgtatgtt

SEQ ID NO: 2505956 - DNA, 18 bp, Homo sapiens
aaatatctgaaaatgtat

SEQ ID NO: 2505957 - DNA, 21 bp, Homo sapiens
aaatatctgaaaatgtatgtg

SEQ ID NO: 2505958 - DNA, 22 bp, Homo sapiens
aaatatctgaaaatgtatgtgt

SEQ ID NO: 2505959 - DNA, 22 bp, Homo sapiens
aaatatctgtatttaattttga

SEQ ID NO: 2505960 - DNA, 19 bp, Homo sapiens
aaatatgattttatttgac

SEQ ID NO: 2505961 - DNA, 10 bp, Homo sapiens
aaatatgcaa

SEQ ID NO: 2505962 - DNA, 13 bp, Homo sapiens
aaatatgcaaagc

SEQ ID NO: 2505963 - DNA, 15 bp, Homo sapiens
aaatatgcaaagcac

SEQ ID NO: 2505964 - DNA, 14 bp, Homo sapiens
aaatatgcagtgat

SEQ ID NO: 2505965 - DNA, 23 bp, Homo sapiens
aaatatgcagtgatatggcagaa

SEQ ID NO: 2505966 - DNA, 20 bp, Homo sapiens
aaatatgcctctcctttgta

SEQ ID NO: 2505967 - DNA, 22 bp, Homo sapiens
aaatatgcctctcctttgtata

SEQ ID NO: 2505968 - DNA, 16 bp, Homo sapiens
aaatatgcctttttga

SEQ ID NO: 2505969 - DNA, 12 bp, Homo sapiens
aaatatgtacaa

SEQ ID NO: 2505970 - DNA, 16 bp, Homo sapiens
aaatatgttgatgaaa

SEQ ID NO: 2505971 - DNA, 21 bp, Homo sapiens
aaatatgttttttagatcaaa

SEQ ID NO: 2505972 - DNA, 15 bp, Homo sapiens
aaatattagatgtga

SEQ ID NO: 2505973 - DNA, 18 bp, Homo sapiens
aaatattccctagaaact

SEQ ID NO: 2505974 - DNA, 13 bp, Homo sapiens
aaatattctatat

SEQ ID NO: 2505975 - DNA, 15 bp, Homo sapiens
aaatatttacatatg

SEQ ID NO: 2505976 - DNA, 17 bp, Homo sapiens
aaatatttacatatgaa

SEQ ID NO: 2505977 - DNA, 15 bp, Homo sapiens
aaatatttatgtaaa

SEQ ID NO: 2505978 - DNA, 15 bp, Homo sapiens
aaatatttgtacata

SEQ ID NO: 2505979 - DNA, 15 bp, Homo sapiens
aaatattttgaatca

SEQ ID NO: 2505980 - DNA, 22 bp, Homo sapiens
aaatattttgaatcaataatat

SEQ ID NO: 2505981 - DNA, 14 bp, Homo sapiens
aaatatttttagta

SEQ ID NO: 2505982 - DNA, 22 bp, Homo sapiens
aaatatttttggtcattgtaat

SEQ ID NO: 2505983 - DNA, 15 bp, Homo sapiens
aaatcaaatatgcaa

SEQ ID NO: 2505984 - DNA, 16 bp, Homo sapiens
aaatcataaactgtgt

SEQ ID NO: 2505985 - DNA, 23 bp, Homo sapiens
aaatcataaactgtgtgcagact

SEQ ID NO: 2505986 - DNA, 19 bp, Homo sapiens
aaatcattaatactcttct

SEQ ID NO: 2505987 - DNA, 12 bp, Homo sapiens
aaatcatttctg

SEQ ID NO: 2505988 - DNA, 15 bp, Homo sapiens
aaatccagaaagaaa

SEQ ID NO: 2505989 - DNA, 15 bp, Homo sapiens
aaatccgaacctcct

SEQ ID NO: 2505990 - DNA, 19 bp, Homo sapiens
aaatccgaacctcctctgt

SEQ ID NO: 2505991 - DNA, 15 bp, Homo sapiens
aaatcctactgaatg

SEQ ID NO: 2505992 - DNA, 14 bp, Homo sapiens
aaatcctcttcctc

SEQ ID NO: 2505993 - DNA, 18 bp, Homo sapiens
aaatcctcttcctctgag

SEQ ID NO: 2505994 - DNA, 16 bp, Homo sapiens
aaatccttccatgaaa

SEQ ID NO: 2505995 - DNA, 16 bp, Homo sapiens
aaatcctttactgtta

SEQ ID NO: 2505996 - DNA, 18 bp, Homo sapiens
aaatcctttttctttata

SEQ ID NO: 2505997 - DNA, 19 bp, Homo sapiens
aaatctaatattaaaaata

SEQ ID NO: 2505998 - DNA, 16 bp, Homo sapiens
aaatctcaaatttcta

SEQ ID NO: 2505999 - DNA, 17 bp, Homo sapiens
aaatctcaaatttctaa

SEQ ID NO: 2506000 - DNA, 15 bp, Homo sapiens
aaatctcagcaatga

SEQ ID NO: 2506001 - DNA, 19 bp, Homo sapiens
aaatctccaaaataaaact

SEQ ID NO: 2506002 - DNA, 19 bp, Homo sapiens
aaatctgtttgatccctgt

SEQ ID NO: 2506003 - DNA, 22 bp, Homo sapiens
aaatcttttaaaaattcaaatg

SEQ ID NO: 2506004 - DNA, 15 bp, Homo sapiens
aaatgaaaatgtctt

SEQ ID NO: 2506005 - DNA, 17 bp, Homo sapiens
aaatgaaaatgtcttgt

SEQ ID NO: 2506006 - DNA, 12 bp, Homo sapiens
aaatgaaagaaa

SEQ ID NO: 2506007 - DNA, 22 bp, Homo sapiens
aaatgaaagcagggacttgaac

SEQ ID NO: 2506008 - DNA, 19 bp, Homo sapiens
aaatgaaggttaggattta

SEQ ID NO: 2506009 - DNA, 17 bp, Homo sapiens
aaatgactaaaaatatt

SEQ ID NO: 2506010 - DNA, 20 bp, Homo sapiens
aaatgactaaaaatattata

SEQ ID NO: 2506011 - DNA, 13 bp, Homo sapiens
aaatgagaaggaa

SEQ ID NO: 2506012 - DNA, 21 bp, Homo sapiens
aaatgagaaggcagccaccag

SEQ ID NO: 2506013 - DNA, 20 bp, Homo sapiens
aaatgagaccctcgtggcct

SEQ ID NO: 2506014 - DNA, 15 bp, Homo sapiens
aaatgagatcaggct

SEQ ID NO: 2506015 - DNA, 22 bp, Homo sapiens
aaatgagatcaggctctgcctc

SEQ ID NO: 2506016 - DNA, 13 bp, Homo sapiens
aaatgagcctggc

SEQ ID NO: 2506017 - DNA, 19 bp, Homo sapiens
aaatgagcctggcaagaat

SEQ ID NO: 2506018 - DNA, 13 bp, Homo sapiens
aaatgaggaaact

SEQ ID NO: 2506019 - DNA, 16 bp, Homo sapiens
aaatgaggacatgttt

SEQ ID NO: 2506020 - DNA, 21 bp, Homo sapiens
aaatgagttacctacatttta

SEQ ID NO: 2506021 - DNA, 21 bp, Homo sapiens
accaccctcccctctcttgca

SEQ ID NO: 2506022 - DNA, 18 bp, Homo sapiens
accacctaatcaggctga

SEQ ID NO: 2506023 - DNA, 17 bp, Homo sapiens
accaccttttattacat

SEQ ID NO: 2506024 - DNA, 16 bp, Homo sapiens
accacgctggaccttg

SEQ ID NO: 2506025 - DNA, 14 bp, Homo sapiens
accacggaaaagag

SEQ ID NO: 2506026 - DNA, 18 bp, Homo sapiens
accacggaaaagagcgca

SEQ ID NO: 2506027 - DNA, 18 bp, Homo sapiens
accacggccactggccat

SEQ ID NO: 2506028 - DNA, 14 bp, Homo sapiens
accacgtttctaaa

SEQ ID NO: 2506029 - DNA, 15 bp, Homo sapiens
accacgtttctaaag

SEQ ID NO: 2506030 - DNA, 19 bp, Homo sapiens
accacgtttctaaaggcta

SEQ ID NO: 2506031 - DNA, 23 bp, Homo sapiens
accactaaaagatcgcagtttgc

SEQ ID NO: 2506032 - DNA, 17 bp, Homo sapiens
accactacatgcagccc

SEQ ID NO: 2506033 - DNA, 15 bp, Homo sapiens
accactacattctgt

SEQ ID NO: 2506034 - DNA, 17 bp, Homo sapiens
accactaggactctgag

SEQ ID NO: 2506035 - DNA, 19 bp, Homo sapiens
accactgcagaagacagta

SEQ ID NO: 2506036 - DNA, 19 bp, Homo sapiens
accactggccaccaggctg

SEQ ID NO: 2506037 - DNA, 20 bp, Homo sapiens
accactggccaccaggctgg

SEQ ID NO: 2506038 - DNA, 13 bp, Homo sapiens
accactgtcttct

SEQ ID NO: 2506039 - DNA, 15 bp, Homo sapiens
accactgtcttcttc

SEQ ID NO: 2506040 - DNA, 16 bp, Homo sapiens
accactgtgtatttaa

SEQ ID NO: 2506041 - DNA, 16 bp, Homo sapiens
accacttcttttataa

SEQ ID NO: 2506042 - DNA, 17 bp, Homo sapiens
accacttcttttataac

SEQ ID NO: 2506043 - DNA, 21 bp, Homo sapiens
accacttttgttcttggtttg

SEQ ID NO: 2506044 - DNA, 22 bp, Homo sapiens
accacttttgttcttggtttgt

SEQ ID NO: 2506045 - DNA, 14 bp, Homo sapiens
accagaagccaaag

SEQ ID NO: 2506046 - DNA, 14 bp, Homo sapiens
accagacaccttga

SEQ ID NO: 2506047 - DNA, 23 bp, Homo sapiens
accagacaccttgacagggcaca

SEQ ID NO: 2506048 - DNA, 11 bp, Homo sapiens
accagacaggt

SEQ ID NO: 2506049 - DNA, 18 bp, Homo sapiens
accagactgtggagaaat

SEQ ID NO: 2506050 - DNA, 15 bp, Homo sapiens
accagagcagatgca

SEQ ID NO: 2506051 - DNA, 16 bp, Homo sapiens
accagagcagatgcag

SEQ ID NO: 2506052 - DNA, 13 bp, Homo sapiens
accagagccatgg

SEQ ID NO: 2506053 - DNA, 12 bp, Homo sapiens
accagagcccac

SEQ ID NO: 2506054 - DNA, 15 bp, Homo sapiens
accagaggaatcact

SEQ ID NO: 2506055 - DNA, 14 bp, Homo sapiens
accagaggctgcag

SEQ ID NO: 2506056 - DNA, 20 bp, Homo sapiens
accagataagaatgctggtt

SEQ ID NO: 2506057 - DNA, 15 bp, Homo sapiens
accagcagatcccag

SEQ ID NO: 2506058 - DNA, 19 bp, Homo sapiens
accagcagatcccagctca

SEQ ID NO: 2506059 - DNA, 17 bp, Homo sapiens
accagccaggctctgtg

SEQ ID NO: 2506060 - DNA, 16 bp, Homo sapiens
accagccccagtgccc

SEQ ID NO: 2506061 - DNA, 14 bp, Homo sapiens
accagcccggcctg

SEQ ID NO: 2506062 - DNA, 14 bp, Homo sapiens
accagcctccatgc

SEQ ID NO: 2506063 - DNA, 20 bp, Homo sapiens
accagcctccatgctgcctc

SEQ ID NO: 2506064 - DNA, 20 bp, Homo sapiens
accagcctggccaacatggt

SEQ ID NO: 2506065 - DNA, 13 bp, Homo sapiens
accagcctgggca

SEQ ID NO: 2506066 - DNA, 22 bp, Homo sapiens
accagcctttctcccaggccag

SEQ ID NO: 2506067 - DNA, 20 bp, Homo sapiens
accagcgcccgctgggctga

SEQ ID NO: 2506068 - DNA, 17 bp, Homo sapiens
accagctgtaacacagc

SEQ ID NO: 2506069 - DNA, 23 bp, Homo sapiens
accagctgttctgtcccttggag

SEQ ID NO: 2506070 - DNA, 19 bp, Homo sapiens
accaggactatagcccagg

SEQ ID NO: 2506071 - DNA, 21 bp, Homo sapiens
accaggactatagcccaggtc

SEQ ID NO: 2506072 - DNA, 14 bp, Homo sapiens
accaggactccctc

SEQ ID NO: 2506073 - DNA, 16 bp, Homo sapiens
accaggactccctcct

SEQ ID NO: 2506074 - DNA, 17 bp, Homo sapiens
accaggactccctcctc

SEQ ID NO: 2506075 - DNA, 18 bp, Homo sapiens
accaggactccctcctca

SEQ ID NO: 2506076 - DNA, 14 bp, Homo sapiens
accaggatggccct

SEQ ID NO: 2506077 - DNA, 17 bp, Homo sapiens
acatgcatacacacaca

SEQ ID NO: 2506078 - DNA, 19 bp, Homo sapiens
acatgcatacttcaaaagt

SEQ ID NO: 2506079 - DNA, 12 bp, Homo sapiens
acatgcatttga

SEQ ID NO: 2506080 - DNA, 15 bp, Homo sapiens
acatgcctgccccaa

SEQ ID NO: 2506081 - DNA, 21 bp, Homo sapiens
acatgcctgccccaaacaaat

SEQ ID NO: 2506082 - DNA, 22 bp, Homo sapiens
acatgcctgccccaaacaaata

SEQ ID NO: 2506083 - DNA, 23 bp, Homo sapiens
acatgcggagaacaaatgtgaag

SEQ ID NO: 2506084 - DNA, 12 bp, Homo sapiens
acatggacccgg

SEQ ID NO: 2506085 - DNA, 16 bp, Homo sapiens
acatggacccggagct

SEQ ID NO: 2506086 - DNA, 19 bp, Homo sapiens
acatggacccggagctaac

SEQ ID NO: 2506087 - DNA, 14 bp, Homo sapiens
acatggacttgtat

SEQ ID NO: 2506088 - DNA, 15 bp, Homo sapiens
acatggagactcctg

SEQ ID NO: 2506089 - DNA, 21 bp, Homo sapiens
acatggcccctccccctgcca

SEQ ID NO: 2506090 - DNA, 19 bp, Homo sapiens
acatggcttagttttcata

SEQ ID NO: 2506091 - DNA, 23 bp, Homo sapiens
acatgggagccgggtctgcctct

SEQ ID NO: 2506092 - DNA, 18 bp, Homo sapiens
acatggggctgggcagct

SEQ ID NO: 2506093 - DNA, 16 bp, Homo sapiens
acatggggttttcaat

SEQ ID NO: 2506094 - DNA, 18 bp, Homo sapiens
acatggggttttcaattt

SEQ ID NO: 2506095 - DNA, 22 bp, Homo sapiens
acatggggttttcaattttgca

SEQ ID NO: 2506096 - DNA, 19 bp, Homo sapiens
acatggtgggtccatgggc

SEQ ID NO: 2506097 - DNA, 18 bp, Homo sapiens
acatggttacaatcattg

SEQ ID NO: 2506098 - DNA, 23 bp, Homo sapiens
acatgtaataaaaagtatatgtt

SEQ ID NO: 2506099 - DNA, 18 bp, Homo sapiens
acatgtaatataaagatg

SEQ ID NO: 2506100 - DNA, 17 bp, Homo sapiens
acatgtaattaagtact

SEQ ID NO: 2506101 - DNA, 23 bp, Homo sapiens
acatgtaattaagtactatgtat

SEQ ID NO: 2506102 - DNA, 20 bp, Homo sapiens
acatgtactgttctcttctt

SEQ ID NO: 2506103 - DNA, 14 bp, Homo sapiens
acatgtataatatt

SEQ ID NO: 2506104 - DNA, 15 bp, Homo sapiens
acatgtatgttttgg

SEQ ID NO: 2506105 - DNA, 19 bp, Homo sapiens
acatgtcagtaccttcaaa

SEQ ID NO: 2506106 - DNA, 21 bp, Homo sapiens
acatgtcagtaccttcaaact

SEQ ID NO: 2506107 - DNA, 15 bp, Homo sapiens
acatgtccaagaagc

SEQ ID NO: 2506108 - DNA, 19 bp, Homo sapiens
acatgtccaagaagcccag

SEQ ID NO: 2506109 - DNA, 13 bp, Homo sapiens
acatgtcttgtac

SEQ ID NO: 2506110 - DNA, 19 bp, Homo sapiens
acatgtcttgtacatgtgt

SEQ ID NO: 2506111 - DNA, 12 bp, Homo sapiens
acatgtgaaacc

SEQ ID NO: 2506112 - DNA, 20 bp, Homo sapiens
acatgtgaaaccttttttaa

SEQ ID NO: 2506113 - DNA, 12 bp, Homo sapiens
acatgtgacaca

SEQ ID NO: 2506114 - DNA, 15 bp, Homo sapiens
acatgtgacacatat

SEQ ID NO: 2506115 - DNA, 17 bp, Homo sapiens
acatgtgccgaatgtgc

SEQ ID NO: 2506116 - DNA, 16 bp, Homo sapiens
acatgtgtgcgtgtgc

SEQ ID NO: 2506117 - DNA, 17 bp, Homo sapiens
acatgttactgaccagc

SEQ ID NO: 2506118 - DNA, 14 bp, Homo sapiens
acatgttatatatt

SEQ ID NO: 2506119 - DNA, 15 bp, Homo sapiens
acatgttatatattt

SEQ ID NO: 2506120 - DNA, 21 bp, Homo sapiens
acatgtttatttattctgcat

SEQ ID NO: 2506121 - DNA, 20 bp, Homo sapiens
acatgttttagacaaatact

SEQ ID NO: 2506122 - DNA, 22 bp, Homo sapiens
acatgttttagacaaatactca

SEQ ID NO: 2506123 - DNA, 13 bp, Homo sapiens
acatgttttgata

SEQ ID NO: 2506124 - DNA, 21 bp, Homo sapiens
acatgttttgataaagtagta

SEQ ID NO: 2506125 - DNA, 15 bp, Homo sapiens
acattaaaacaatat

SEQ ID NO: 2506126 - DNA, 17 bp, Homo sapiens
acattaacagttttcca

SEQ ID NO: 2506127 - DNA, 20 bp, Homo sapiens
acattaacagttttccatga

SEQ ID NO: 2506128 - DNA, 20 bp, Homo sapiens
acattaagattgaggcctgc

SEQ ID NO: 2506129 - DNA, 15 bp, Homo sapiens
acattaccttactgt

SEQ ID NO: 2506130 - DNA, 19 bp, Homo sapiens
acattaccttactgtggag

SEQ ID NO: 2506131 - DNA, 21 bp, Homo sapiens
acattatcgggagcagtgtct

SEQ ID NO: 2506132 - DNA, 19 bp, Homo sapiens
acattatctcacttgtgcc

SEQ ID NO: 2506133 - DNA, 18 bp, Homo sapiens
acattattatcaacaata

SEQ ID NO: 2506134 - DNA, 14 bp, Homo sapiens
acattatttgcatg

SEQ ID NO: 2506135 - DNA, 18 bp, Homo sapiens
acattcaaccctggagag

SEQ ID NO: 2506136 - DNA, 15 bp, Homo sapiens
acattccaagacagt

SEQ ID NO: 2506137 - DNA, 14 bp, Homo sapiens
acattcctgatgct

SEQ ID NO: 2506138 - DNA, 17 bp, Homo sapiens
acattccttgcctgcac

SEQ ID NO: 2506139 - DNA, 12 bp, Homo sapiens
acattctgcttt

SEQ ID NO: 2506140 - DNA, 19 bp, Homo sapiens
acagggaagctacaggtta

SEQ ID NO: 2506141 - DNA, 21 bp, Homo sapiens
acagggatgagcatggagctg

SEQ ID NO: 2506142 - DNA, 17 bp, Homo sapiens
acagggctggcccagcc

SEQ ID NO: 2506143 - DNA, 23 bp, Homo sapiens
acagggctggcccagccctgctg

SEQ ID NO: 2506144 - DNA, 24 bp, Homo sapiens
acagggctggcccagccctgctgg

SEQ ID NO: 2506145 - DNA, 19 bp, Homo sapiens
acagggtctctagtgctgt

SEQ ID NO: 2506146 - DNA, 14 bp, Homo sapiens
acaggtctcctctt

SEQ ID NO: 2506147 - DNA, 16 bp, Homo sapiens
acaggtggacacacaa

SEQ ID NO: 2506148 - DNA, 20 bp, Homo sapiens
acaggtggcaggaccaggac

SEQ ID NO: 2506149 - DNA, 21 bp, Homo sapiens
acaggtggcaggaccaggact

SEQ ID NO: 2506150 - DNA, 20 bp, Homo sapiens
acaggtgggcttcccagtgg

SEQ ID NO: 2506151 - DNA, 20 bp, Homo sapiens
acaggtgtgaaccaccacac

SEQ ID NO: 2506152 - DNA, 23 bp, Homo sapiens
acaggtgtgaaccaccacaccca

SEQ ID NO: 2506153 - DNA, 12 bp, Homo sapiens
acaggttacaac

SEQ ID NO: 2506154 - DNA, 15 bp, Homo sapiens
acaggttacaacaga

SEQ ID NO: 2506155 - DNA, 12 bp, Homo sapiens
acagtaaacatt

SEQ ID NO: 2506156 - DNA, 21 bp, Homo sapiens
acagtaactttatgtgtaaat

SEQ ID NO: 2506157 - DNA, 13 bp, Homo sapiens
acagtaggagccc

SEQ ID NO: 2506158 - DNA, 22 bp, Homo sapiens
acagtaggagcccagctctgaa

SEQ ID NO: 2506159 - DNA, 21 bp, Homo sapiens
acagtatggcagctttcctca

SEQ ID NO: 2506160 - DNA, 19 bp, Homo sapiens
acagtattacttctgctac

SEQ ID NO: 2506161 - DNA, 17 bp, Homo sapiens
acagtattttggttctt

SEQ ID NO: 2506162 - DNA, 16 bp, Homo sapiens
acagtcaaaacagaga

SEQ ID NO: 2506163 - DNA, 14 bp, Homo sapiens
acagtcctcccatc

SEQ ID NO: 2506164 - DNA, 22 bp, Homo sapiens
acagtcctgggagaacctcagg

SEQ ID NO: 2506165 - DNA, 20 bp, Homo sapiens
acagtccttaccagcagagc

SEQ ID NO: 2506166 - DNA, 22 bp, Homo sapiens
acagtccttaccagcagagcac

SEQ ID NO: 2506167 - DNA, 13 bp, Homo sapiens
acagtctcaggaa

SEQ ID NO: 2506168 - DNA, 17 bp, Homo sapiens
acagtctcaggaaatca

SEQ ID NO: 2506169 - DNA, 20 bp, Homo sapiens
acagtctctttaatcttcag

SEQ ID NO: 2506170 - DNA, 18 bp, Homo sapiens
acagtgaaaatgtaagct

SEQ ID NO: 2506171 - DNA, 14 bp, Homo sapiens
acagtgagactctg

SEQ ID NO: 2506172 - DNA, 18 bp, Homo sapiens
acagtgagactctgtctc

SEQ ID NO: 2506173 - DNA, 12 bp, Homo sapiens
acagtgagccaa

SEQ ID NO: 2506174 - DNA, 14 bp, Homo sapiens
acagtgagcctgaa

SEQ ID NO: 2506175 - DNA, 21 bp, Homo sapiens
acagtgagcctgaattttgtt

SEQ ID NO: 2506176 - DNA, 17 bp, Homo sapiens
acagtgaggtgcccagc

SEQ ID NO: 2506177 - DNA, 22 bp, Homo sapiens
acagtgagtcgaggacagggag

SEQ ID NO: 2506178 - DNA, 20 bp, Homo sapiens
acagtgattaccagggactg

SEQ ID NO: 2506179 - DNA, 13 bp, Homo sapiens
acagtgatttttt

SEQ ID NO: 2506180 - DNA, 20 bp, Homo sapiens
acagtgcatattcctttcta

SEQ ID NO: 2506181 - DNA, 18 bp, Homo sapiens
acagtgcctgggaatgta

SEQ ID NO: 2506182 - DNA, 22 bp, Homo sapiens
acagtgctgtctgatctgtgct

SEQ ID NO: 2506183 - DNA, 14 bp, Homo sapiens
acagtgcttcagcc

SEQ ID NO: 2506184 - DNA, 15 bp, Homo sapiens
acagtgcttcagcct

SEQ ID NO: 2506185 - DNA, 18 bp, Homo sapiens
acagtgcttcagcctgag

SEQ ID NO: 2506186 - DNA, 22 bp, Homo sapiens
acagtgcttcagcctgaggctg

SEQ ID NO: 2506187 - DNA, 21 bp, Homo sapiens
acagtgcttgccacagagcgg

SEQ ID NO: 2506188 - DNA, 18 bp, Homo sapiens
acagtggaatataaggaa

SEQ ID NO: 2506189 - DNA, 17 bp, Homo sapiens
acagtggattgcatttc

SEQ ID NO: 2506190 - DNA, 16 bp, Homo sapiens
acagtgggagccaggg

SEQ ID NO: 2506191 - DNA, 21 bp, Homo sapiens
acagtgggtgccccccttgcc

SEQ ID NO: 2506192 - DNA, 13 bp, Homo sapiens
acagtgtgaagtt

SEQ ID NO: 2506193 - DNA, 15 bp, Homo sapiens
acagtgtgaagttag

SEQ ID NO: 2506194 - DNA, 16 bp, Homo sapiens
acagtgtgaagttaga

SEQ ID NO: 2506195 - DNA, 16 bp, Homo sapiens
acagtgttattttctt

SEQ ID NO: 2506196 - DNA, 19 bp, Homo sapiens
acagtgttgaaaatgttca

SEQ ID NO: 2506197 - DNA, 23 bp, Homo sapiens
acagtgtttcccataattttctt

SEQ ID NO: 2506198 - DNA, 22 bp, Homo sapiens
acagtgtttttgtaaagtgtgg

SEQ ID NO: 2506199 - DNA, 20 bp, Homo sapiens
acagttactcagaattctct

SEQ ID NO: 2506200 - DNA, 23 bp, Homo sapiens
acagttagcaaactttgtatgtc

SEQ ID NO: 2506201 - DNA, 16 bp, Homo sapiens
acagttcaagaaagct

SEQ ID NO: 2506202 - DNA, 13 bp, Homo sapiens
acagttcagtggc

SEQ ID NO: 2506203 - DNA, 20 bp, Homo sapiens
acagttcagtggcagggctc

SEQ ID NO: 2506204 - DNA, 20 bp, Homo sapiens
acagttcatgtttgcttcat

SEQ ID NO: 2506205 - DNA, 13 bp, Homo sapiens
acagttctgaaga

SEQ ID NO: 2506206 - DNA, 21 bp, Homo sapiens
acagttcttcgggaagagagg

SEQ ID NO: 2506207 - DNA, 13 bp, Homo sapiens
acagttgtttgat

SEQ ID NO: 2506208 - DNA, 22 bp, Homo sapiens
acagttgtttgatgcattaaaa

SEQ ID NO: 2506209 - DNA, 16 bp, Homo sapiens
acagtttcttagcttt

SEQ ID NO: 2506210 - DNA, 17 bp, Homo sapiens
acagtttcttagctttt

SEQ ID NO: 2506211 - DNA, 22 bp, Homo sapiens
acagtttcttagctttttaatt

SEQ ID NO: 2506212 - DNA, 12 bp, Homo sapiens
acagtttgctgt

SEQ ID NO: 2506213 - DNA, 17 bp, Homo sapiens
acagttttccatgaaaa

SEQ ID NO: 2506214 - DNA, 22 bp, Homo sapiens
acagttttccttctcatctgtg

SEQ ID NO: 2506215 - DNA, 15 bp, Homo sapiens
acagttttctgagaa

SEQ ID NO: 2506216 - DNA, 21 bp, Homo sapiens
acagttttctggctggagcct

SEQ ID NO: 2506217 - DNA, 23 bp, Homo sapiens
acataaacaagaccacgtttcta

SEQ ID NO: 2506218 - DNA, 14 bp, Homo sapiens
acataacgtttttc

SEQ ID NO: 2506219 - DNA, 12 bp, Homo sapiens
acataactgaaa

SEQ ID NO: 2506220 - DNA, 14 bp, Homo sapiens
acataagaccataa

SEQ ID NO: 2506221 - DNA, 23 bp, Homo sapiens
acataatcttctgccttctcatg

SEQ ID NO: 2506222 - DNA, 19 bp, Homo sapiens
acatactggcctggactgt

SEQ ID NO: 2506223 - DNA, 12 bp, Homo sapiens
acatagaaagtt

SEQ ID NO: 2506224 - DNA, 23 bp, Homo sapiens
acatagagagggagaagaagtca

SEQ ID NO: 2506225 - DNA, 22 bp, Homo sapiens
acatagagatcatcctttccag

SEQ ID NO: 2506226 - DNA, 19 bp, Homo sapiens
acatagctatcaagtgtgc

SEQ ID NO: 2506227 - DNA, 18 bp, Homo sapiens
acatatgaaatttaatat

SEQ ID NO: 2506228 - DNA, 19 bp, Homo sapiens
acatatgagtgtggaagcc

SEQ ID NO: 2506229 - DNA, 15 bp, Homo sapiens
acatatgcaccttgt

SEQ ID NO: 2506230 - DNA, 14 bp, Homo sapiens
acatattatgtctt

SEQ ID NO: 2506231 - DNA, 12 bp, Homo sapiens
acatattcattt

SEQ ID NO: 2506232 - DNA, 22 bp, Homo sapiens
acatattgatttccgttaaaat

SEQ ID NO: 2506233 - DNA, 17 bp, Homo sapiens
acatatttgtggaataa

SEQ ID NO: 2506234 - DNA, 19 bp, Homo sapiens
acatatttgtggaataatg

SEQ ID NO: 2506235 - DNA, 19 bp, Homo sapiens
acatatttgttaaatattt

SEQ ID NO: 2506236 - DNA, 20 bp, Homo sapiens
acatatttgttaaatattta

SEQ ID NO: 2506237 - DNA, 20 bp, Homo sapiens
acatcaatattgtcattcct

SEQ ID NO: 2506238 - DNA, 15 bp, Homo sapiens
acatcaatgttcatt

SEQ ID NO: 2506239 - DNA, 16 bp, Homo sapiens
acatcaatgttcattg

SEQ ID NO: 2506240 - DNA, 13 bp, Homo sapiens
acatcacacacac

SEQ ID NO: 2506241 - DNA, 16 bp, Homo sapiens
acatcaccacagttta

SEQ ID NO: 2506242 - DNA, 22 bp, Homo sapiens
acatcaccgacgcgtctcctgt

SEQ ID NO: 2506243 - DNA, 15 bp, Homo sapiens
acatcacttgtacaa

SEQ ID NO: 2506244 - DNA, 19 bp, Homo sapiens
acatcacttgtacaaaata

SEQ ID NO: 2506245 - DNA, 20 bp, Homo sapiens
acatcagcacgatttctgtt

SEQ ID NO: 2506246 - DNA, 20 bp, Homo sapiens
acatcagtggcatggctcca

SEQ ID NO: 2506247 - DNA, 15 bp, Homo sapiens
acatcagttactctg

SEQ ID NO: 2506248 - DNA, 13 bp, Homo sapiens
acatccaaggaga

SEQ ID NO: 2506249 - DNA, 14 bp, Homo sapiens
acatccaaggagaa

SEQ ID NO: 2506250 - DNA, 22 bp, Homo sapiens
acatccaaggagaaacagagac

SEQ ID NO: 2506251 - DNA, 23 bp, Homo sapiens
acatccaaggagaaacagagaca

SEQ ID NO: 2506252 - DNA, 20 bp, Homo sapiens
acatccatttcatctatttc

SEQ ID NO: 2506253 - DNA, 23 bp, Homo sapiens
acatccctacaaaaaattagaaa

SEQ ID NO: 2506254 - DNA, 15 bp, Homo sapiens
acatcctcttctgct

SEQ ID NO: 2506255 - DNA, 14 bp, Homo sapiens
acatcctgtgtttc

SEQ ID NO: 2506256 - DNA, 16 bp, Homo sapiens
acatctaacctcatct

SEQ ID NO: 2506257 - DNA, 22 bp, Homo sapiens
acatctcagaccctttagccaa

SEQ ID NO: 2506258 - DNA, 13 bp, Homo sapiens
acatctcttcctc

SEQ ID NO: 2506259 - DNA, 23 bp, Homo sapiens
acatctcttcctccgaggccagt

SEQ ID NO: 2506260 - DNA, 14 bp, Homo sapiens
acatctctttgaat

SEQ ID NO: 2506261 - DNA, 16 bp, Homo sapiens
acatctgttttaaatt

SEQ ID NO: 2506262 - DNA, 17 bp, Homo sapiens
acatctgttttaaattt

SEQ ID NO: 2506263 - DNA, 14 bp, Homo sapiens
acatcttagtattt

SEQ ID NO: 2506264 - DNA, 18 bp, Homo sapiens
acatcttagtatttgcat

SEQ ID NO: 2506265 - DNA, 23 bp, Homo sapiens
acatcttccctagagggttcctg

SEQ ID NO: 2506266 - DNA, 18 bp, Homo sapiens
acatcttgctctgctgac

SEQ ID NO: 2506267 - DNA, 22 bp, Homo sapiens
acatcttgctctgctgacagac

SEQ ID NO: 2506268 - DNA, 19 bp, Homo sapiens
acatcttggtcagatttga

SEQ ID NO: 2506269 - DNA, 13 bp, Homo sapiens
acatctttcacat

SEQ ID NO: 2506270 - DNA, 15 bp, Homo sapiens
acatctttcacattg

SEQ ID NO: 2506271 - DNA, 15 bp, Homo sapiens
acatcttttttcaca

SEQ ID NO: 2506272 - DNA, 23 bp, Homo sapiens
acatgaaaaaaggacaatttcaa

SEQ ID NO: 2506273 - DNA, 15 bp, Homo sapiens
acatgaaacagaaac

SEQ ID NO: 2506274 - DNA, 15 bp, Homo sapiens
acatgaagattcttt

SEQ ID NO: 2506275 - DNA, 22 bp, Homo sapiens
acatgaagattctttcccaatt

SEQ ID NO: 2506276 - DNA, 18 bp, Homo sapiens
acatgaattgcattttac

SEQ ID NO: 2506277 - DNA, 19 bp, Homo sapiens
acatgaccctaaatcttga

SEQ ID NO: 2506278 - DNA, 13 bp, Homo sapiens
acatgagcatcag

SEQ ID NO: 2506279 - DNA, 23 bp, Homo sapiens
acatgagctatttccattccaga

SEQ ID NO: 2506280 - DNA, 20 bp, Homo sapiens
acatgaggtactgagagtga

SEQ ID NO: 2506281 - DNA, 23 bp, Homo sapiens
acatgaggtactgagagtgaaca

SEQ ID NO: 2506282 - DNA, 19 bp, Homo sapiens
acatgatcctgcaattcca

SEQ ID NO: 2506283 - DNA, 16 bp, Homo sapiens
acatgcaaggtcattt

SEQ ID NO: 2506284 - DNA, 13 bp, Homo sapiens
acatgcacgtgtg

SEQ ID NO: 2506285 - DNA, 17 bp, Homo sapiens
acatgcactcagctctt

SEQ ID NO: 2506286 - DNA, 18 bp, Homo sapiens
acatgcactcagctcttg

SEQ ID NO: 2506287 - DNA, 13 bp, Homo sapiens
acatgcatacaca

SEQ ID NO: 2506288 - DNA, 16 bp, Homo sapiens
acatgcatacacacac

SEQ ID NO: 2506289 - DNA, 19 bp, Homo sapiens
actagtttagttaaatgag

SEQ ID NO: 2506290 - DNA, 18 bp, Homo sapiens
actataaaggttgacaat

SEQ ID NO: 2506291 - DNA, 14 bp, Homo sapiens
actataatgtaagc

SEQ ID NO: 2506292 - DNA, 20 bp, Homo sapiens
actatagcccaggtcctctg

SEQ ID NO: 2506293 - DNA, 18 bp, Homo sapiens
actatagcctaggtgaca

SEQ ID NO: 2506294 - DNA, 21 bp, Homo sapiens
actatagtccagctttgttct

SEQ ID NO: 2506295 - DNA, 18 bp, Homo sapiens
actatatagagatgtttt

SEQ ID NO: 2506296 - DNA, 17 bp, Homo sapiens
actatatctgtatataa

SEQ ID NO: 2506297 - DNA, 15 bp, Homo sapiens
actatattgtacaca

SEQ ID NO: 2506298 - DNA, 20 bp, Homo sapiens
actatcagcccaagatgctt

SEQ ID NO: 2506299 - DNA, 22 bp, Homo sapiens
actatcatgtcaaacgtgaaaa

SEQ ID NO: 2506300 - DNA, 12 bp, Homo sapiens
actatctgggtg

SEQ ID NO: 2506301 - DNA, 15 bp, Homo sapiens
actatgatttggaaa

SEQ ID NO: 2506302 - DNA, 13 bp, Homo sapiens
actctaccctctt

SEQ ID NO: 2506303 - DNA, 13 bp, Homo sapiens
actctacctcata

SEQ ID NO: 2506304 - DNA, 17 bp, Homo sapiens
actctagggaaaaacca

SEQ ID NO: 2506305 - DNA, 21 bp, Homo sapiens
actctaggggtcaggctccat

SEQ ID NO: 2506306 - DNA, 17 bp, Homo sapiens
actctaggtgcccttgg

SEQ ID NO: 2506307 - DNA, 15 bp, Homo sapiens
actctatagactcta

SEQ ID NO: 2506308 - DNA, 14 bp, Homo sapiens
actctatcaagtat

SEQ ID NO: 2506309 - DNA, 21 bp, Homo sapiens
actctatcaagtattatacct

SEQ ID NO: 2506310 - DNA, 23 bp, Homo sapiens
actctatcaagtattataccttt

SEQ ID NO: 2506311 - DNA, 22 bp, Homo sapiens
actctcaggaccaaagctttca

SEQ ID NO: 2506312 - DNA, 22 bp, Homo sapiens
actctcaggatcaagaaagtgt

SEQ ID NO: 2506313 - DNA, 13 bp, Homo sapiens
actctcagtctct

SEQ ID NO: 2506314 - DNA, 16 bp, Homo sapiens
actctcagtctctgag

SEQ ID NO: 2506315 - DNA, 18 bp, Homo sapiens
actctcagtctctgagca

SEQ ID NO: 2506316 - DNA, 14 bp, Homo sapiens
actctcccatggct

SEQ ID NO: 2506317 - DNA, 15 bp, Homo sapiens
actctcccatggctt

SEQ ID NO: 2506318 - DNA, 14 bp, Homo sapiens
actctccccacact

SEQ ID NO: 2506319 - DNA, 14 bp, Homo sapiens
actctcctctgctg

SEQ ID NO: 2506320 - DNA, 13 bp, Homo sapiens
actctctccaccc

SEQ ID NO: 2506321 - DNA, 21 bp, Homo sapiens
actctctccaccctatatgta

SEQ ID NO: 2506322 - DNA, 12 bp, Homo sapiens
actctgaagctg

SEQ ID NO: 2506323 - DNA, 23 bp, Homo sapiens
actctgaagctgacgaacttcca

SEQ ID NO: 2506324 - DNA, 19 bp, Homo sapiens
actctgcacatgtcttgta

SEQ ID NO: 2506325 - DNA, 15 bp, Homo sapiens
actctgcactactcc

SEQ ID NO: 2506326 - DNA, 21 bp, Homo sapiens
actctgccccctgctggctct

SEQ ID NO: 2506327 - DNA, 12 bp, Homo sapiens
actctgcctctg

SEQ ID NO: 2506328 - DNA, 15 bp, Homo sapiens
actctgctgcttaga

SEQ ID NO: 2506329 - DNA, 15 bp, Homo sapiens
actctgcttgatttt

SEQ ID NO: 2506330 - DNA, 13 bp, Homo sapiens
actctggcagctc

SEQ ID NO: 2506331 - DNA, 15 bp, Homo sapiens
actctggcagctcag

SEQ ID NO: 2506332 - DNA, 17 bp, Homo sapiens
actctggcagctcagag

SEQ ID NO: 2506333 - DNA, 12 bp, Homo sapiens
actctggctggt

SEQ ID NO: 2506334 - DNA, 15 bp, Homo sapiens
actctggcttccagg

SEQ ID NO: 2506335 - DNA, 19 bp, Homo sapiens
actctgggaaataagagag

SEQ ID NO: 2506336 - DNA, 23 bp, Homo sapiens
actctgtcaatttccctgactcc

SEQ ID NO: 2506337 - DNA, 19 bp, Homo sapiens
actctgtcgcccagtctgg

SEQ ID NO: 2506338 - DNA, 17 bp, Homo sapiens
actctgtcttcacctga

SEQ ID NO: 2506339 - DNA, 18 bp, Homo sapiens
actctgtcttcacctgat

SEQ ID NO: 2506340 - DNA, 22 bp, Homo sapiens
actctgtcttcacctgattcaa

SEQ ID NO: 2506341 - DNA, 14 bp, Homo sapiens
actctgttccttca

SEQ ID NO: 2506342 - DNA, 18 bp, Homo sapiens
actcttaaaacccaagtg

SEQ ID NO: 2506343 - DNA, 19 bp, Homo sapiens
actcttaagtttctcagct

SEQ ID NO: 2506344 - DNA, 21 bp, Homo sapiens
actcttaagtttctcagctcc

SEQ ID NO: 2506345 - DNA, 20 bp, Homo sapiens
actcttaggaagagaaacca

SEQ ID NO: 2506346 - DNA, 19 bp, Homo sapiens
actcttattgcccacgctg

SEQ ID NO: 2506347 - DNA, 20 bp, Homo sapiens
actcttccgaaaaatcctct

SEQ ID NO: 2506348 - DNA, 15 bp, Homo sapiens
actcttcctgcaagg

SEQ ID NO: 2506349 - DNA, 19 bp, Homo sapiens
actcttcttgaaattttaa

SEQ ID NO: 2506350 - DNA, 13 bp, Homo sapiens
actcttgctcttt

SEQ ID NO: 2506351 - DNA, 18 bp, Homo sapiens
actctttgaatgacaaag

SEQ ID NO: 2506352 - DNA, 19 bp, Homo sapiens
actctttgagatagaagaa

SEQ ID NO: 2506353 - DNA, 18 bp, Homo sapiens
actctttttgggctcctt

SEQ ID NO: 2506354 - DNA, 16 bp, Homo sapiens
actgaaaacctctcct

SEQ ID NO: 2506355 - DNA, 15 bp, Homo sapiens
actgaaaatgtgcta

SEQ ID NO: 2506356 - DNA, 13 bp, Homo sapiens
actgaaaggttac

SEQ ID NO: 2506357 - DNA, 16 bp, Homo sapiens
actgaaatatacacac

SEQ ID NO: 2506358 - DNA, 17 bp, Homo sapiens
actgaaatatacacaca

SEQ ID NO: 2506359 - DNA, 18 bp, Homo sapiens
actgaaccggctttacca

SEQ ID NO: 2506360 - DNA, 21 bp, Homo sapiens
actgaacttcaggataataaa

SEQ ID NO: 2506361 - DNA, 16 bp, Homo sapiens
actgaagcctgcagga

SEQ ID NO: 2506362 - DNA, 14 bp, Homo sapiens
actgaagtctgaaa

SEQ ID NO: 2506363 - DNA, 15 bp, Homo sapiens
actgaagtctgaaat

SEQ ID NO: 2506364 - DNA, 17 bp, Homo sapiens
actgaagttaacagaga

SEQ ID NO: 2506365 - DNA, 15 bp, Homo sapiens
actgaatatttatat

SEQ ID NO: 2506366 - DNA, 22 bp, Homo sapiens
actgaatatttatatttcacta

SEQ ID NO: 2506367 - DNA, 22 bp, Homo sapiens
actgaatgaaacccccacacac

SEQ ID NO: 2506368 - DNA, 23 bp, Homo sapiens
actgaatgaaacccccacacaca

SEQ ID NO: 2506369 - DNA, 21 bp, Homo sapiens
actgaatgcctcaatgtgacc

SEQ ID NO: 2506370 - DNA, 16 bp, Homo sapiens
actgaatgctctgtgc

SEQ ID NO: 2506371 - DNA, 13 bp, Homo sapiens
actgaattaatca

SEQ ID NO: 2506372 - DNA, 22 bp, Homo sapiens
actgaattaatgacagagccag

SEQ ID NO: 2506373 - DNA, 19 bp, Homo sapiens
actgaattataagaggctg

SEQ ID NO: 2506374 - DNA, 23 bp, Homo sapiens
actgaatttcttttgccgttatt

SEQ ID NO: 2506375 - DNA, 16 bp, Homo sapiens
actgacacccatgttt

SEQ ID NO: 2506376 - DNA, 22 bp, Homo sapiens
actgacacccatgtttctctgg

SEQ ID NO: 2506377 - DNA, 20 bp, Homo sapiens
actgacacctttgcaggcat

SEQ ID NO: 2506378 - DNA, 18 bp, Homo sapiens
actgacattgttggccaa

SEQ ID NO: 2506379 - DNA, 13 bp, Homo sapiens
actgaccagcctc

SEQ ID NO: 2506380 - DNA, 23 bp, Homo sapiens
actgaccagcctccatgctgcct

SEQ ID NO: 2506381 - DNA, 16 bp, Homo sapiens
actgaccatccactct

SEQ ID NO: 2506382 - DNA, 22 bp, Homo sapiens
actgaccatccactctaccctc

SEQ ID NO: 2506383 - DNA, 14 bp, Homo sapiens
actgactccttaga

SEQ ID NO: 2506384 - DNA, 16 bp, Homo sapiens
actgacttctaagtaa

SEQ ID NO: 2506385 - DNA, 15 bp, Homo sapiens
actgactttatcctc

SEQ ID NO: 2506386 - DNA, 19 bp, Homo sapiens
actgagataccagcgagga

SEQ ID NO: 2506387 - DNA, 17 bp, Homo sapiens
actgagattttggtatt

SEQ ID NO: 2506388 - DNA, 20 bp, Homo sapiens
actgagccagtcccaggggc

SEQ ID NO: 2506389 - DNA, 14 bp, Homo sapiens
actgagccttgtaa

SEQ ID NO: 2506390 - DNA, 17 bp, Homo sapiens
actgagcttctctgtga

SEQ ID NO: 2506391 - DNA, 18 bp, Homo sapiens
actgaggaatgatgaagc

SEQ ID NO: 2506392 - DNA, 17 bp, Homo sapiens
actgaggaatttcacct

SEQ ID NO: 2506393 - DNA, 20 bp, Homo sapiens
actgaggaattttctttgtg

SEQ ID NO: 2506394 - DNA, 13 bp, Homo sapiens
actgaggcagaca

SEQ ID NO: 2506395 - DNA, 15 bp, Homo sapiens
actgaggcagacagc

SEQ ID NO: 2506396 - DNA, 23 bp, Homo sapiens
actgaggcagacagcagctcagg

SEQ ID NO: 2506397 - DNA, 12 bp, Homo sapiens
actgaggcaggg

SEQ ID NO: 2506398 - DNA, 21 bp, Homo sapiens
actgaggcctaaaagtaaaca

SEQ ID NO: 2506399 - DNA, 14 bp, Homo sapiens
actgagggactctg

SEQ ID NO: 2506400 - DNA, 18 bp, Homo sapiens
actgaggggtctccagga

SEQ ID NO: 2506401 - DNA, 18 bp, Homo sapiens
actgagtacgttgtgcat

SEQ ID NO: 2506402 - DNA, 23 bp, Homo sapiens
actgagtacgttgtgcatttggt

SEQ ID NO: 2506403 - DNA, 21 bp, Homo sapiens
actgagttaaattatactgga

SEQ ID NO: 2506404 - DNA, 15 bp, Homo sapiens
actgagttacattgt

SEQ ID NO: 2506405 - DNA, 18 bp, Homo sapiens
actgagttacattgtcat

SEQ ID NO: 2506406 - DNA, 20 bp, Homo sapiens
actgatagttactgttgtga

SEQ ID NO: 2506407 - DNA, 23 bp, Homo sapiens
actgatagttactgttgtgacct

SEQ ID NO: 2506408 - DNA, 15 bp, Homo sapiens
actgatcacaaaaac

SEQ ID NO: 2506409 - DNA, 16 bp, Homo sapiens
actgatcatgcattgt

SEQ ID NO: 2506410 - DNA, 17 bp, Homo sapiens
actgatcatgcattgtt

SEQ ID NO: 2506411 - DNA, 18 bp, Homo sapiens
actgatcatgcattgttg

SEQ ID NO: 2506412 - DNA, 22 bp, Homo sapiens
actgatggctaatgtactgcat

SEQ ID NO: 2506413 - DNA, 22 bp, Homo sapiens
actgatgttacatcacagtgtt

SEQ ID NO: 2506414 - DNA, 20 bp, Homo sapiens
actgattcataataaatatc

SEQ ID NO: 2506415 - DNA, 17 bp, Homo sapiens
actgatttcacaacaga

SEQ ID NO: 2506416 - DNA, 20 bp, Homo sapiens
actgatttcacaacagatca

SEQ ID NO: 2506417 - DNA, 13 bp, Homo sapiens
actgatttccttt

SEQ ID NO: 2506418 - DNA, 14 bp, Homo sapiens
actgatttcctttg

SEQ ID NO: 2506419 - DNA, 22 bp, Homo sapiens
actgattttgttatttttatat

SEQ ID NO: 2506420 - DNA, 15 bp, Homo sapiens
actgatttttgtaag

SEQ ID NO: 2506421 - DNA, 19 bp, Homo sapiens
actgatttttgtaagacaa

SEQ ID NO: 2506422 - DNA, 16 bp, Homo sapiens
actgcaacctccgcct

SEQ ID NO: 2506423 - DNA, 14 bp, Homo sapiens
actgcactccagcc

SEQ ID NO: 2506424 - DNA, 17 bp, Homo sapiens
actgcactccagcctgg

SEQ ID NO: 2506425 - DNA, 20 bp, Homo sapiens
actgcactccagcctgggcg

SEQ ID NO: 2506426 - DNA, 19 bp, Homo sapiens
actgcactccagcctgggt

SEQ ID NO: 2506427 - DNA, 20 bp, Homo sapiens
actgcactccagcctgggtg

SEQ ID NO: 2506428 - DNA, 18 bp, Homo sapiens
actgcagacctgtcctcc

SEQ ID NO: 2506429 - DNA, 20 bp, Homo sapiens
actgcagacctgtcctcctg

SEQ ID NO: 2506430 - DNA, 23 bp, Homo sapiens
actgcagcctcaacctcctgggc

SEQ ID NO: 2506431 - DNA, 17 bp, Homo sapiens
actgcatactttttaaa

SEQ ID NO: 2506432 - DNA, 16 bp, Homo sapiens
actgcatatgaaagga

SEQ ID NO: 2506433 - DNA, 14 bp, Homo sapiens
actgccagatgctg

SEQ ID NO: 2506434 - DNA, 15 bp, Homo sapiens
actgccagatgctga

SEQ ID NO: 2506435 - DNA, 13 bp, Homo sapiens
actgccagcaacg

SEQ ID NO: 2506436 - DNA, 16 bp, Homo sapiens
actgccagtctcactg

SEQ ID NO: 2506437 - DNA, 16 bp, Homo sapiens
actgccatgcagggcc

SEQ ID NO: 2506438 - DNA, 14 bp, Homo sapiens
actgccatgccagc

SEQ ID NO: 2506439 - DNA, 15 bp, Homo sapiens
actgcccaccccctc

SEQ ID NO: 2506440 - DNA, 17 bp, Homo sapiens
actgcccaccccctcaa

SEQ ID NO: 2506441 - DNA, 20 bp, Homo sapiens
actgcccgagctggtgcatt

SEQ ID NO: 2506442 - DNA, 17 bp, Homo sapiens
actgcccggggcagctg

SEQ ID NO: 2506443 - DNA, 13 bp, Homo sapiens
actgcctcaggtt

SEQ ID NO: 2506444 - DNA, 15 bp, Homo sapiens
actgcctcaggttcc

SEQ ID NO: 2506445 - DNA, 20 bp, Homo sapiens
actgcctgatggacctgtca

SEQ ID NO: 2506446 - DNA, 14 bp, Homo sapiens
actgcctgcccacc

SEQ ID NO: 2506447 - DNA, 22 bp, Homo sapiens
actgcctgcccacccgtggaga

SEQ ID NO: 2506448 - DNA, 14 bp, Homo sapiens
actgcctgggctcc

SEQ ID NO: 2506449 - DNA, 21 bp, Homo sapiens
actgccttgaatatcccctcc

SEQ ID NO: 2506450 - DNA, 15 bp, Homo sapiens
accccaattccttgt

SEQ ID NO: 2506451 - DNA, 22 bp, Homo sapiens
accccacaccaggccgtcctcc

SEQ ID NO: 2506452 - DNA, 11 bp, Homo sapiens
accccacccaa

SEQ ID NO: 2506453 - DNA, 14 bp, Homo sapiens
accccaccctcagc

SEQ ID NO: 2506454 - DNA, 15 bp, Homo sapiens
accccaccctcagca

SEQ ID NO: 2506455 - DNA, 15 bp, Homo sapiens
accccaccctccctg

SEQ ID NO: 2506456 - DNA, 22 bp, Homo sapiens
accccagccccaaaactctcct

SEQ ID NO: 2506457 - DNA, 12 bp, Homo sapiens
accccagcctaa

SEQ ID NO: 2506458 - DNA, 11 bp, Homo sapiens
accccagctgg

SEQ ID NO: 2506459 - DNA, 17 bp, Homo sapiens
accccagctgggaggca

SEQ ID NO: 2506460 - DNA, 20 bp, Homo sapiens
accccagctgggaggcaaga

SEQ ID NO: 2506461 - DNA, 12 bp, Homo sapiens
accccaggcccc

SEQ ID NO: 2506462 - DNA, 13 bp, Homo sapiens
accccaggtttct

SEQ ID NO: 2506463 - DNA, 17 bp, Homo sapiens
accccagtggccactca

SEQ ID NO: 2506464 - DNA, 19 bp, Homo sapiens
accccagtggccactcagc

SEQ ID NO: 2506465 - DNA, 15 bp, Homo sapiens
accccagttctgctc

SEQ ID NO: 2506466 - DNA, 16 bp, Homo sapiens
accccagttctgctcc

SEQ ID NO: 2506467 - DNA, 22 bp, Homo sapiens
accccagttctgctcctctcca

SEQ ID NO: 2506468 - DNA, 15 bp, Homo sapiens
accccatcccacacc

SEQ ID NO: 2506469 - DNA, 16 bp, Homo sapiens
accccatctgtgaata

SEQ ID NO: 2506470 - DNA, 16 bp, Homo sapiens
accccatgctgttgat

SEQ ID NO: 2506471 - DNA, 16 bp, Homo sapiens
accccattttctgtgg

SEQ ID NO: 2506472 - DNA, 16 bp, Homo sapiens
acccccaaattttctt

SEQ ID NO: 2506473 - DNA, 15 bp, Homo sapiens
acccccacacacaca

SEQ ID NO: 2506474 - DNA, 20 bp, Homo sapiens
acccccacacacacacacat

SEQ ID NO: 2506475 - DNA, 15 bp, Homo sapiens
acccccacacctcag

SEQ ID NO: 2506476 - DNA, 12 bp, Homo sapiens
acccccacccaa

SEQ ID NO: 2506477 - DNA, 14 bp, Homo sapiens
acccccaccccaca

SEQ ID NO: 2506478 - DNA, 17 bp, Homo sapiens
acccccaccccacactt

SEQ ID NO: 2506479 - DNA, 15 bp, Homo sapiens
acccccaccccttcc

SEQ ID NO: 2506480 - DNA, 20 bp, Homo sapiens
acccccaccccttccccact

SEQ ID NO: 2506481 - DNA, 11 bp, Homo sapiens
acccccagcaa

SEQ ID NO: 2506482 - DNA, 16 bp, Homo sapiens
acccccagcaaccctc

SEQ ID NO: 2506483 - DNA, 13 bp, Homo sapiens
acccccagcctgc

SEQ ID NO: 2506484 - DNA, 15 bp, Homo sapiens
acccccagcctgcta

SEQ ID NO: 2506485 - DNA, 21 bp, Homo sapiens
acccccagctcaatggactgg

SEQ ID NO: 2506486 - DNA, 19 bp, Homo sapiens
acccccagctgcttgtgtc

SEQ ID NO: 2506487 - DNA, 17 bp, Homo sapiens
acccccatctctccctc

SEQ ID NO: 2506488 - DNA, 18 bp, Homo sapiens
acccccatttctatttat

SEQ ID NO: 2506489 - DNA, 19 bp, Homo sapiens
accccccactctgtgcctg

SEQ ID NO: 2506490 - DNA, 18 bp, Homo sapiens
accccccagaacctgtcc

SEQ ID NO: 2506491 - DNA, 20 bp, Homo sapiens
accccccagaacctgtcctt

SEQ ID NO: 2506492 - DNA, 18 bp, Homo sapiens
acccccgccccctgccct

SEQ ID NO: 2506493 - DNA, 20 bp, Homo sapiens
acccccgccccctgccctcc

SEQ ID NO: 2506494 - DNA, 19 bp, Homo sapiens
accccctcaagccaatccc

SEQ ID NO: 2506495 - DNA, 14 bp, Homo sapiens
accccctcctctct

SEQ ID NO: 2506496 - DNA, 15 bp, Homo sapiens
accccctcctctctg

SEQ ID NO: 2506497 - DNA, 16 bp, Homo sapiens
accccctcgcttggac

SEQ ID NO: 2506498 - DNA, 18 bp, Homo sapiens
accccctcgggtctcctc

SEQ ID NO: 2506499 - DNA, 21 bp, Homo sapiens
acctgcttcatgctcagccct

SEQ ID NO: 2506500 - DNA, 23 bp, Homo sapiens
acctggagaactagaacctggag

SEQ ID NO: 2506501 - DNA, 13 bp, Homo sapiens
acctggagaccag

SEQ ID NO: 2506502 - DNA, 22 bp, Homo sapiens
acctggagagctagaacctgga

SEQ ID NO: 2506503 - DNA, 19 bp, Homo sapiens
acctggagttcctgaacct

SEQ ID NO: 2506504 - DNA, 22 bp, Homo sapiens
acctggcaagctagaacctgga

SEQ ID NO: 2506505 - DNA, 18 bp, Homo sapiens
acctggcactgctgtgct

SEQ ID NO: 2506506 - DNA, 18 bp, Homo sapiens
acctggccacctgaggtg

SEQ ID NO: 2506507 - DNA, 21 bp, Homo sapiens
acctggccacctgaggtgggc

SEQ ID NO: 2506508 - DNA, 12 bp, Homo sapiens
acctggcctctg

SEQ ID NO: 2506509 - DNA, 13 bp, Homo sapiens
acctggcctctgc

SEQ ID NO: 2506510 - DNA, 18 bp, Homo sapiens
acctggcctctgcactcc

SEQ ID NO: 2506511 - DNA, 23 bp, Homo sapiens
acctggcctctgcactcccctgc

SEQ ID NO: 2506512 - DNA, 13 bp, Homo sapiens
acctgggaagggg

SEQ ID NO: 2506513 - DNA, 22 bp, Homo sapiens
acctgggaggcggatgttgaag

SEQ ID NO: 2506514 - DNA, 13 bp, Homo sapiens
acctgggcacctg

SEQ ID NO: 2506515 - DNA, 19 bp, Homo sapiens
acctgggcacctggggagt

SEQ ID NO: 2506516 - DNA, 14 bp, Homo sapiens
acctggggctgctg

SEQ ID NO: 2506517 - DNA, 20 bp, Homo sapiens
acctggggctgctggcctga

SEQ ID NO: 2506518 - DNA, 15 bp, Homo sapiens
acctgggtccaaata

SEQ ID NO: 2506519 - DNA, 20 bp, Homo sapiens
acctgggtccaaataaaaac

SEQ ID NO: 2506520 - DNA, 18 bp, Homo sapiens
acctggtaccctcctggc

SEQ ID NO: 2506521 - DNA, 23 bp, Homo sapiens
acctggtcacaggactctgcctc

SEQ ID NO: 2506522 - DNA, 11 bp, Homo sapiens
acctggtgctg

SEQ ID NO: 2506523 - DNA, 19 bp, Homo sapiens
acctgtaatcccagctact

SEQ ID NO: 2506524 - DNA, 20 bp, Homo sapiens
acctgtaatcccagctactt

SEQ ID NO: 2506525 - DNA, 14 bp, Homo sapiens
acctgtagtcccag

SEQ ID NO: 2506526 - DNA, 17 bp, Homo sapiens
acctgtagtcccagcta

SEQ ID NO: 2506527 - DNA, 20 bp, Homo sapiens
acctgtcaaacaaagccaga

SEQ ID NO: 2506528 - DNA, 18 bp, Homo sapiens
acctgtcaccgtgagcag

SEQ ID NO: 2506529 - DNA, 19 bp, Homo sapiens
acctgtcaccgtgagcagc

SEQ ID NO: 2506530 - DNA, 18 bp, Homo sapiens
acctgtcatgcccccctc

SEQ ID NO: 2506531 - DNA, 20 bp, Homo sapiens
acctgtcatgcccccctcaa

SEQ ID NO: 2506532 - DNA, 14 bp, Homo sapiens
acctgtcctcctgg

SEQ ID NO: 2506533 - DNA, 15 bp, Homo sapiens
acctgtcctcctggt

SEQ ID NO: 2506534 - DNA, 17 bp, Homo sapiens
acctgtctcctttctca

SEQ ID NO: 2506535 - DNA, 13 bp, Homo sapiens
acctgtgaccagc

SEQ ID NO: 2506536 - DNA, 19 bp, Homo sapiens
acctgtgaccagcactgtc

SEQ ID NO: 2506537 - DNA, 19 bp, Homo sapiens
acctgtgagtttaaagcaa

SEQ ID NO: 2506538 - DNA, 17 bp, Homo sapiens
acctgtggccaagttct

SEQ ID NO: 2506539 - DNA, 18 bp, Homo sapiens
acctgtggccaagttctt

SEQ ID NO: 2506540 - DNA, 15 bp, Homo sapiens
acctgtggctctaca

SEQ ID NO: 2506541 - DNA, 19 bp, Homo sapiens
acctgttgcttacaatttt

SEQ ID NO: 2506542 - DNA, 14 bp, Homo sapiens
acctgttggttcca

SEQ ID NO: 2506543 - DNA, 14 bp, Homo sapiens
acctgtttaaatat

SEQ ID NO: 2506544 - DNA, 20 bp, Homo sapiens
acctgtttttaagctgtttc

SEQ ID NO: 2506545 - DNA, 21 bp, Homo sapiens
accttaagtaagcaacagcat

SEQ ID NO: 2506546 - DNA, 18 bp, Homo sapiens
accttaccaactttctgt

SEQ ID NO: 2506547 - DNA, 20 bp, Homo sapiens
accttaccaactttctgtaa

SEQ ID NO: 2506548 - DNA, 15 bp, Homo sapiens
accttactgtggagg

SEQ ID NO: 2506549 - DNA, 17 bp, Homo sapiens
accttagattagctctg

SEQ ID NO: 2506550 - DNA, 22 bp, Homo sapiens
accttagctggcattacagctg

SEQ ID NO: 2506551 - DNA, 15 bp, Homo sapiens
accttaggcagggaa

SEQ ID NO: 2506552 - DNA, 20 bp, Homo sapiens
accttattgtacctctctta

SEQ ID NO: 2506553 - DNA, 22 bp, Homo sapiens
accttattgtacctctcttata

SEQ ID NO: 2506554 - DNA, 19 bp, Homo sapiens
accttcaaactagggccaa

SEQ ID NO: 2506555 - DNA, 14 bp, Homo sapiens
accttcaataaagt

SEQ ID NO: 2506556 - DNA, 20 bp, Homo sapiens
accttcaataaagtatctac

SEQ ID NO: 2506557 - DNA, 18 bp, Homo sapiens
accttcatttcaggaggg

SEQ ID NO: 2506558 - DNA, 21 bp, Homo sapiens
accttcatttcaggagggatt

SEQ ID NO: 2506559 - DNA, 13 bp, Homo sapiens
accttccagctcc

SEQ ID NO: 2506560 - DNA, 14 bp, Homo sapiens
accttccagctcct

SEQ ID NO: 2506561 - DNA, 17 bp, Homo sapiens
accttccagctcctgta

SEQ ID NO: 2506562 - DNA, 17 bp, Homo sapiens
accttcccatgccctgg

SEQ ID NO: 2506563 - DNA, 19 bp, Homo sapiens
accttccctctcaccatcc

SEQ ID NO: 2506564 - DNA, 16 bp, Homo sapiens
accttcctcacttcca

SEQ ID NO: 2506565 - DNA, 17 bp, Homo sapiens
accttcctcacttccat

SEQ ID NO: 2506566 - DNA, 17 bp, Homo sapiens
accttcctcgcagagag

SEQ ID NO: 2506567 - DNA, 22 bp, Homo sapiens
accttctaggacgccacccagc

SEQ ID NO: 2506568 - DNA, 23 bp, Homo sapiens
accttctctggagccaagtccag

SEQ ID NO: 2506569 - DNA, 19 bp, Homo sapiens
accttctggcttccttctc

SEQ ID NO: 2506570 - DNA, 13 bp, Homo sapiens
accttctgtagtt

SEQ ID NO: 2506571 - DNA, 19 bp, Homo sapiens
accttcttcagccacctct

SEQ ID NO: 2506572 - DNA, 21 bp, Homo sapiens
accttgaacactgggggaggg

SEQ ID NO: 2506573 - DNA, 15 bp, Homo sapiens
accttgagacagctt

SEQ ID NO: 2506574 - DNA, 22 bp, Homo sapiens
accttgaggaggggcaggtaaa

SEQ ID NO: 2506575 - DNA, 22 bp, Homo sapiens
accttgaggtcttttgacatgt

SEQ ID NO: 2506576 - DNA, 12 bp, Homo sapiens
accttggctcaa

SEQ ID NO: 2506577 - DNA, 14 bp, Homo sapiens
accttggctgcagg

SEQ ID NO: 2506578 - DNA, 17 bp, Homo sapiens
accttggggcttgactt

SEQ ID NO: 2506579 - DNA, 17 bp, Homo sapiens
accttgtgcctggctca

SEQ ID NO: 2506580 - DNA, 21 bp, Homo sapiens
accttgtgtctgtacacgtgt

SEQ ID NO: 2506581 - DNA, 17 bp, Homo sapiens
accttgttatttctcag

SEQ ID NO: 2506582 - DNA, 18 bp, Homo sapiens
accttgttggagcctgca

SEQ ID NO: 2506583 - DNA, 16 bp, Homo sapiens
acctttattaaaatct

SEQ ID NO: 2506584 - DNA, 20 bp, Homo sapiens
acctttattaaaatcttaaa

SEQ ID NO: 2506585 - DNA, 14 bp, Homo sapiens
acctttattgtgat

SEQ ID NO: 2506586 - DNA, 17 bp, Homo sapiens
acctttattttagaatt

SEQ ID NO: 2506587 - DNA, 17 bp, Homo sapiens
acctttcaaatttcaca

SEQ ID NO: 2506588 - DNA, 13 bp, Homo sapiens
acctttcccatct

SEQ ID NO: 2506589 - DNA, 17 bp, Homo sapiens
acctttgtccccaccgc

SEQ ID NO: 2506590 - DNA, 23 bp, Homo sapiens
acctttgtggggtttttggagaa

SEQ ID NO: 2506591 - DNA, 21 bp, Homo sapiens
accttttaacacctgatgtgt

SEQ ID NO: 2506592 - DNA, 21 bp, Homo sapiens
accttttgcacctgctctctt

SEQ ID NO: 2506593 - DNA, 19 bp, Homo sapiens
acctttttatttgcatgtg

SEQ ID NO: 2506594 - DNA, 15 bp, Homo sapiens
accttttttaagatt

SEQ ID NO: 2506595 - DNA, 17 bp, Homo sapiens
accttttttatacataa

SEQ ID NO: 2506596 - DNA, 18 bp, Homo sapiens
accttttttatacataaa

SEQ ID NO: 2506597 - DNA, 20 bp, Homo sapiens
accttttttatacataaaca

SEQ ID NO: 2506598 - DNA, 12 bp, Homo sapiens
acgaaatgttat

SEQ ID NO: 2506599 - DNA, 23 bp, Homo sapiens
acgaaatgttattttttaattat

SEQ ID NO: 2506600 - DNA, 14 bp, Homo sapiens
acgaatacttttgc

SEQ ID NO: 2506601 - DNA, 20 bp, Homo sapiens
acgacaatagctttaccctc

SEQ ID NO: 2506602 - DNA, 21 bp, Homo sapiens
acgagaggggaagagtgtact

SEQ ID NO: 2506603 - DNA, 19 bp, Homo sapiens
acgagatcaagagatcaag

SEQ ID NO: 2506604 - DNA, 19 bp, Homo sapiens
acgagctgtttactaggga

SEQ ID NO: 2506605 - DNA, 16 bp, Homo sapiens
acgagtaatttattgt

SEQ ID NO: 2506606 - DNA, 14 bp, Homo sapiens
acgatgaaaaactt

SEQ ID NO: 2506607 - DNA, 13 bp, Homo sapiens
acgatgtcttcat

SEQ ID NO: 2506608 - DNA, 17 bp, Homo sapiens
acgatttaattctcttg

SEQ ID NO: 2506609 - DNA, 12 bp, Homo sapiens
acgatttctgtt

SEQ ID NO: 2506610 - DNA, 17 bp, Homo sapiens
acgatttctgtttagat

SEQ ID NO: 2506611 - DNA, 14 bp, Homo sapiens
acgcacacacacaa

SEQ ID NO: 2506612 - DNA, 18 bp, Homo sapiens
acgcacacacacacacag

SEQ ID NO: 2506613 - DNA, 14 bp, Homo sapiens
acgcaccacatctc

SEQ ID NO: 2506614 - DNA, 11 bp, Homo sapiens
acgcacgcaca

SEQ ID NO: 2506615 - DNA, 13 bp, Homo sapiens
acgcacgcacaca

SEQ ID NO: 2506616 - DNA, 14 bp, Homo sapiens
acgcacgcacacac

SEQ ID NO: 2506617 - DNA, 17 bp, Homo sapiens
acgcactccatgagcac

SEQ ID NO: 2506618 - DNA, 22 bp, Homo sapiens
acgcagccctagagcctgcctg

SEQ ID NO: 2506619 - DNA, 20 bp, Homo sapiens
acgctggaccttgaactggg

SEQ ID NO: 2506620 - DNA, 15 bp, Homo sapiens
acgctggagtgcagt

SEQ ID NO: 2506621 - DNA, 17 bp, Homo sapiens
acgctggagtgcagtga

SEQ ID NO: 2506622 - DNA, 12 bp, Homo sapiens
acgctgtctcca

SEQ ID NO: 2506623 - DNA, 21 bp, Homo sapiens
acgctgtctccagacccccac

SEQ ID NO: 2506624 - DNA, 11 bp, Homo sapiens
acgctgtgctg

SEQ ID NO: 2506625 - DNA, 14 bp, Homo sapiens
acgctgtgctgccc

SEQ ID NO: 2506626 - DNA, 19 bp, Homo sapiens
acgctgtgctgccctgccc

SEQ ID NO: 2506627 - DNA, 22 bp, Homo sapiens
acgctgtgctgccctgcccacc

SEQ ID NO: 2506628 - DNA, 12 bp, Homo sapiens
acgcttctgaat

SEQ ID NO: 2506629 - DNA, 13 bp, Homo sapiens
acgcttctgaatg

SEQ ID NO: 2506630 - DNA, 18 bp, Homo sapiens
acgcttctgaatgctgct

SEQ ID NO: 2506631 - DNA, 22 bp, Homo sapiens
acgcttctgaatgctgctactt

SEQ ID NO: 2506632 - DNA, 18 bp, Homo sapiens
acgcttgcgtatgtctgt

SEQ ID NO: 2506633 - DNA, 17 bp, Homo sapiens
acggacactcaaaagct

SEQ ID NO: 2506634 - DNA, 19 bp, Homo sapiens
acggagccactcctctgac

SEQ ID NO: 2506635 - DNA, 19 bp, Homo sapiens
acggagtcccaccttggct

SEQ ID NO: 2506636 - DNA, 22 bp, Homo sapiens
acggatgccttcccctgggccc

SEQ ID NO: 2506637 - DNA, 22 bp, Homo sapiens
acggattagggcatttgagaaa

SEQ ID NO: 2506638 - DNA, 13 bp, Homo sapiens
acggattattttt

SEQ ID NO: 2506639 - DNA, 19 bp, Homo sapiens
acggattattttttcagac

SEQ ID NO: 2506640 - DNA, 20 bp, Homo sapiens
acggattattttttcagacc

SEQ ID NO: 2506641 - DNA, 16 bp, Homo sapiens
acggccaacaaagctg

SEQ ID NO: 2506642 - DNA, 18 bp, Homo sapiens
acggccgctccaggggtg

SEQ ID NO: 2506643 - DNA, 21 bp, Homo sapiens
acggccttcaactgaaaagac

SEQ ID NO: 2506644 - DNA, 16 bp, Homo sapiens
acggctcactgcagcc

SEQ ID NO: 2506645 - DNA, 18 bp, Homo sapiens
acggctctaggtggggcg

SEQ ID NO: 2506646 - DNA, 11 bp, Homo sapiens
acggctgggca

SEQ ID NO: 2506647 - DNA, 18 bp, Homo sapiens
acggcttttacttaaacc

SEQ ID NO: 2506648 - DNA, 13 bp, Homo sapiens
acgggaccgggcc

SEQ ID NO: 2506649 - DNA, 16 bp, Homo sapiens
acgggactgacgcaac

SEQ ID NO: 2506650 - DNA, 14 bp, Homo sapiens
acgggctgccctgc

SEQ ID NO: 2506651 - DNA, 14 bp, Homo sapiens
acggggactgggga

SEQ ID NO: 2506652 - DNA, 15 bp, Homo sapiens
acggggggccccagt

SEQ ID NO: 2506653 - DNA, 22 bp, Homo sapiens
acggggggccccagtcagcctc

SEQ ID NO: 2506654 - DNA, 15 bp, Homo sapiens
acggtgctccaggca

SEQ ID NO: 2506655 - DNA, 20 bp, Homo sapiens
acggtgggccttgctgggga

SEQ ID NO: 2506656 - DNA, 21 bp, Homo sapiens
acggtggtcactggaactcag

SEQ ID NO: 2506657 - DNA, 17 bp, Homo sapiens
acggtttgaagcctgga

SEQ ID NO: 2506658 - DNA, 17 bp, Homo sapiens
acggttttactgcagct

SEQ ID NO: 2506659 - DNA, 13 bp, Homo sapiens
acgtacacacaca

SEQ ID NO: 2506660 - DNA, 17 bp, Homo sapiens
acgtagctgaggccgga

SEQ ID NO: 2506661 - DNA, 24 bp, Homo sapiens
acgtagcttctaccatgaacagaa

SEQ ID NO: 2506662 - DNA, 14 bp, Homo sapiens
acgtcaaacatgaa

SEQ ID NO: 2506663 - DNA, 17 bp, Homo sapiens
acgtcaagtctccttcc

SEQ ID NO: 2506664 - DNA, 13 bp, Homo sapiens
acgtctgtgccat

SEQ ID NO: 2506665 - DNA, 17 bp, Homo sapiens
acgtgacagtgcctggg

SEQ ID NO: 2506666 - DNA, 19 bp, Homo sapiens
acgtgacagtgcctgggaa

SEQ ID NO: 2506667 - DNA, 23 bp, Homo sapiens
acgtgagagtgtcttcacggcag

SEQ ID NO: 2506668 - DNA, 23 bp, Homo sapiens
acgtgcacctgtactcaggaggc

SEQ ID NO: 2506669 - DNA, 15 bp, Homo sapiens
acgtgccttttgcac

SEQ ID NO: 2506670 - DNA, 19 bp, Homo sapiens
acgtgccttttgcacccct

SEQ ID NO: 2506671 - DNA, 18 bp, Homo sapiens
acgtggaggagcagtgca

SEQ ID NO: 2506672 - DNA, 18 bp, Homo sapiens
acgtgtactacaatttaa

SEQ ID NO: 2506673 - DNA, 12 bp, Homo sapiens
acgtgtgatttt

SEQ ID NO: 2506674 - DNA, 11 bp, Homo sapiens
acgtgtgtgac

SEQ ID NO: 2506675 - DNA, 16 bp, Homo sapiens
acgtgtgtgactcaga

SEQ ID NO: 2506676 - DNA, 11 bp, Homo sapiens
acgtgttgcct

SEQ ID NO: 2506677 - DNA, 22 bp, Homo sapiens
acgtgttttattcctgtatgtt

SEQ ID NO: 2506678 - DNA, 15 bp, Homo sapiens
acgttaccaggcagg

SEQ ID NO: 2506679 - DNA, 14 bp, Homo sapiens
acgttccagccggc

SEQ ID NO: 2506680 - DNA, 16 bp, Homo sapiens
acgttcctattgtcat

SEQ ID NO: 2506681 - DNA, 18 bp, Homo sapiens
acgttcctattgtcatta

SEQ ID NO: 2506682 - DNA, 20 bp, Homo sapiens
acgttcctattgtcattaaa

SEQ ID NO: 2506683 - DNA, 12 bp, Homo sapiens
acgttgctgtgg

SEQ ID NO: 2506684 - DNA, 15 bp, Homo sapiens
acgttgctgtgggaa

SEQ ID NO: 2506685 - DNA, 14 bp, Homo sapiens
acgttgtgcatttg

SEQ ID NO: 2506686 - DNA, 18 bp, Homo sapiens
acgttttattgtgttttt

SEQ ID NO: 2506687 - DNA, 12 bp, Homo sapiens
actaaaagatcg

SEQ ID NO: 2506688 - DNA, 20 bp, Homo sapiens
actaaaagttcttctccaat

SEQ ID NO: 2506689 - DNA, 14 bp, Homo sapiens
actaaaatatttat

SEQ ID NO: 2506690 - DNA, 21 bp, Homo sapiens
actaaagaaaatatctgaaat

SEQ ID NO: 2506691 - DNA, 17 bp, Homo sapiens
actaaagcagtagaaat

SEQ ID NO: 2506692 - DNA, 14 bp, Homo sapiens
actaaagtatgtaa

SEQ ID NO: 2506693 - DNA, 16 bp, Homo sapiens
actaacagataagcaa

SEQ ID NO: 2506694 - DNA, 12 bp, Homo sapiens
actaaccacgct

SEQ ID NO: 2506695 - DNA, 13 bp, Homo sapiens
actaaccacgctg

SEQ ID NO: 2506696 - DNA, 16 bp, Homo sapiens
actaaccagcagaaat

SEQ ID NO: 2506697 - DNA, 18 bp, Homo sapiens
actaacgttgagcccctg

SEQ ID NO: 2506698 - DNA, 17 bp, Homo sapiens
actaacttgacttttaa

SEQ ID NO: 2506699 - DNA, 18 bp, Homo sapiens
actaagatgacattgcta

SEQ ID NO: 2506700 - DNA, 20 bp, Homo sapiens
actaagatgacattgctaag

SEQ ID NO: 2506701 - DNA, 15 bp, Homo sapiens
actaagccacaagaa

SEQ ID NO: 2506702 - DNA, 18 bp, Homo sapiens
actaagccacaagaaatt

SEQ ID NO: 2506703 - DNA, 13 bp, Homo sapiens
actaagccctgtc

SEQ ID NO: 2506704 - DNA, 18 bp, Homo sapiens
actaagccctgtcgagac

SEQ ID NO: 2506705 - DNA, 19 bp, Homo sapiens
actaagcctacctgctctc

SEQ ID NO: 2506706 - DNA, 18 bp, Homo sapiens
actaagttatagtatatc

SEQ ID NO: 2506707 - DNA, 22 bp, Homo sapiens
actaagtttttatggcttttgt

SEQ ID NO: 2506708 - DNA, 15 bp, Homo sapiens
actaatagacaattt

SEQ ID NO: 2506709 - DNA, 22 bp, Homo sapiens
actaatatgggcattgtagtta

SEQ ID NO: 2506710 - DNA, 20 bp, Homo sapiens
actaatctattgggttcatt

SEQ ID NO: 2506711 - DNA, 22 bp, Homo sapiens
actaatctattgggttcattat

SEQ ID NO: 2506712 - DNA, 23 bp, Homo sapiens
actaatgccttactcttcttgaa

SEQ ID NO: 2506713 - DNA, 14 bp, Homo sapiens
actaattgtataac

SEQ ID NO: 2506714 - DNA, 16 bp, Homo sapiens
actaattgtataacag

SEQ ID NO: 2506715 - DNA, 19 bp, Homo sapiens
actaattgtataacaggtt

SEQ ID NO: 2506716 - DNA, 20 bp, Homo sapiens
actaattgtataacaggtta

SEQ ID NO: 2506717 - DNA, 23 bp, Homo sapiens
actacaaagcttctatcccagga

SEQ ID NO: 2506718 - DNA, 22 bp, Homo sapiens
actacaatttaaagcaaaggag

SEQ ID NO: 2506719 - DNA, 13 bp, Homo sapiens
actacagtttgtt

SEQ ID NO: 2506720 - DNA, 14 bp, Homo sapiens
actacagtttgtta

SEQ ID NO: 2506721 - DNA, 16 bp, Homo sapiens
actacataaactgact

SEQ ID NO: 2506722 - DNA, 18 bp, Homo sapiens
actacatgtggtttatag

SEQ ID NO: 2506723 - DNA, 12 bp, Homo sapiens
actacattctgt

SEQ ID NO: 2506724 - DNA, 21 bp, Homo sapiens
actaccaagaggccctgtctg

SEQ ID NO: 2506725 - DNA, 21 bp, Homo sapiens
actacccacgttctcacaccc

SEQ ID NO: 2506726 - DNA, 15 bp, Homo sapiens
actacgtgactgtgg

SEQ ID NO: 2506727 - DNA, 15 bp, Homo sapiens
actacgttaagggaa

SEQ ID NO: 2506728 - DNA, 21 bp, Homo sapiens
actactcctctgcagtgcctt

SEQ ID NO: 2506729 - DNA, 13 bp, Homo sapiens
actactctgtgcc

SEQ ID NO: 2506730 - DNA, 20 bp, Homo sapiens
actactgctaccacaactat

SEQ ID NO: 2506731 - DNA, 18 bp, Homo sapiens
actactgggcaaagagtg

SEQ ID NO: 2506732 - DNA, 22 bp, Homo sapiens
actactgtggaaaaatatttaa

SEQ ID NO: 2506733 - DNA, 16 bp, Homo sapiens
actagaactctccatc

SEQ ID NO: 2506734 - DNA, 13 bp, Homo sapiens
actagaagatgaa

SEQ ID NO: 2506735 - DNA, 15 bp, Homo sapiens
actagaatttattca

SEQ ID NO: 2506736 - DNA, 19 bp, Homo sapiens
actagactcccaagctgga

SEQ ID NO: 2506737 - DNA, 19 bp, Homo sapiens
actagagcagccctggagt

SEQ ID NO: 2506738 - DNA, 21 bp, Homo sapiens
actagagcagccctggagtca

SEQ ID NO: 2506739 - DNA, 23 bp, Homo sapiens
actagccaccaactcttgcaggt

SEQ ID NO: 2506740 - DNA, 17 bp, Homo sapiens
actaggactctgaggct

SEQ ID NO: 2506741 - DNA, 18 bp, Homo sapiens
actagggatccctcatct

SEQ ID NO: 2506742 - DNA, 19 bp, Homo sapiens
actagggatccctcatctg

SEQ ID NO: 2506743 - DNA, 19 bp, Homo sapiens
actagtagttcctgctaca

SEQ ID NO: 2506744 - DNA, 23 bp, Homo sapiens
actagtgacaagctcctggtctt

SEQ ID NO: 2506745 - DNA, 15 bp, Homo sapiens
actagtgttgcttgg

SEQ ID NO: 2506746 - DNA, 13 bp, Homo sapiens
actagttacacat

SEQ ID NO: 2506747 - DNA, 15 bp, Homo sapiens
actagttacacatct

SEQ ID NO: 2506748 - DNA, 18 bp, Homo sapiens
actagttacacatcttca

SEQ ID NO: 2506749 - DNA, 17 bp, Homo sapiens
agacacagaagaggctg

SEQ ID NO: 2506750 - DNA, 19 bp, Homo sapiens
agacacaggcccggctcca

SEQ ID NO: 2506751 - DNA, 21 bp, Homo sapiens
agacacatgtccaagaagccc

SEQ ID NO: 2506752 - DNA, 22 bp, Homo sapiens
agacactaacgacttcagggca

SEQ ID NO: 2506753 - DNA, 22 bp, Homo sapiens
agacactgaaatatacacacag

SEQ ID NO: 2506754 - DNA, 19 bp, Homo sapiens
agacactgaccatccactc

SEQ ID NO: 2506755 - DNA, 20 bp, Homo sapiens
agacactgtttacaagaaaa

SEQ ID NO: 2506756 - DNA, 16 bp, Homo sapiens
agacagaagcaggctg

SEQ ID NO: 2506757 - DNA, 17 bp, Homo sapiens
agacagaagcaggctgg

SEQ ID NO: 2506758 - DNA, 18 bp, Homo sapiens
agacagaagctgaagtgc

SEQ ID NO: 2506759 - DNA, 12 bp, Homo sapiens
agacagaatctc

SEQ ID NO: 2506760 - DNA, 21 bp, Homo sapiens
agacagagacctcctgcctcc

SEQ ID NO: 2506761 - DNA, 21 bp, Homo sapiens
agacagagctggttgggaaga

SEQ ID NO: 2506762 - DNA, 21 bp, Homo sapiens
agacagagtctcactgttgcc

SEQ ID NO: 2506763 - DNA, 23 bp, Homo sapiens
agacagagtctcactgttgccca

SEQ ID NO: 2506764 - DNA, 16 bp, Homo sapiens
agacagcagctcaggc

SEQ ID NO: 2506765 - DNA, 14 bp, Homo sapiens
agacagcccgggct

SEQ ID NO: 2506766 - DNA, 20 bp, Homo sapiens
agacagcccgggctctgcct

SEQ ID NO: 2506767 - DNA, 20 bp, Homo sapiens
agacagctccctctgcctga

SEQ ID NO: 2506768 - DNA, 14 bp, Homo sapiens
agacagctgcctgg

SEQ ID NO: 2506769 - DNA, 16 bp, Homo sapiens
agacagctgcctggga

SEQ ID NO: 2506770 - DNA, 18 bp, Homo sapiens
agacaggacctgactatt

SEQ ID NO: 2506771 - DNA, 19 bp, Homo sapiens
agacaggagggcaagggcc

SEQ ID NO: 2506772 - DNA, 23 bp, Homo sapiens
agacaggagggcaagggccatgc

SEQ ID NO: 2506773 - DNA, 22 bp, Homo sapiens
agacaggcaagcacctcctgcc

SEQ ID NO: 2506774 - DNA, 23 bp, Homo sapiens
agacaggcaagcacctcctgcct

SEQ ID NO: 2506775 - DNA, 14 bp, Homo sapiens
agacagtatacagt

SEQ ID NO: 2506776 - DNA, 12 bp, Homo sapiens
agacagtccctg

SEQ ID NO: 2506777 - DNA, 19 bp, Homo sapiens
agacagtccctgccaatgg

SEQ ID NO: 2506778 - DNA, 15 bp, Homo sapiens
agacagtgatctcca

SEQ ID NO: 2506779 - DNA, 13 bp, Homo sapiens
agacagtttctta

SEQ ID NO: 2506780 - DNA, 18 bp, Homo sapiens
agacagtttcttagcttt

SEQ ID NO: 2506781 - DNA, 21 bp, Homo sapiens
agacagtttcttagcttttta

SEQ ID NO: 2506782 - DNA, 14 bp, Homo sapiens
agacataacgtttt

SEQ ID NO: 2506783 - DNA, 19 bp, Homo sapiens
agacatccataaagaagca

SEQ ID NO: 2506784 - DNA, 17 bp, Homo sapiens
agacatccatgtttgta

SEQ ID NO: 2506785 - DNA, 14 bp, Homo sapiens
agacatgaatatga

SEQ ID NO: 2506786 - DNA, 22 bp, Homo sapiens
agacatggagactcctgccctg

SEQ ID NO: 2506787 - DNA, 16 bp, Homo sapiens
agacatggcttgccac

SEQ ID NO: 2506788 - DNA, 12 bp, Homo sapiens
agacatggggag

SEQ ID NO: 2506789 - DNA, 18 bp, Homo sapiens
agacatggggaggaagga

SEQ ID NO: 2506790 - DNA, 15 bp, Homo sapiens
agacatgttttagac

SEQ ID NO: 2506791 - DNA, 19 bp, Homo sapiens
agacatgttttagacaaat

SEQ ID NO: 2506792 - DNA, 14 bp, Homo sapiens
agacattaaatcta

SEQ ID NO: 2506793 - DNA, 17 bp, Homo sapiens
agacattcctgggcaca

SEQ ID NO: 2506794 - DNA, 12 bp, Homo sapiens
agacattctgtc

SEQ ID NO: 2506795 - DNA, 23 bp, Homo sapiens
agacatttctcttactgcaaatg

SEQ ID NO: 2506796 - DNA, 13 bp, Homo sapiens
agaccaagcttgt

SEQ ID NO: 2506797 - DNA, 14 bp, Homo sapiens
agaccacaaatagt

SEQ ID NO: 2506798 - DNA, 21 bp, Homo sapiens
agaccacaaatagtgctcgct

SEQ ID NO: 2506799 - DNA, 13 bp, Homo sapiens
agaccacatcttt

SEQ ID NO: 2506800 - DNA, 16 bp, Homo sapiens
agaccaccccgcctgc

SEQ ID NO: 2506801 - DNA, 15 bp, Homo sapiens
agaccacgtttctaa

SEQ ID NO: 2506802 - DNA, 13 bp, Homo sapiens
agaccagcctggc

SEQ ID NO: 2506803 - DNA, 13 bp, Homo sapiens
agaccagctcttc

SEQ ID NO: 2506804 - DNA, 17 bp, Homo sapiens
agaccaggcaaagcaag

SEQ ID NO: 2506805 - DNA, 19 bp, Homo sapiens
agaccagttgggagcactg

SEQ ID NO: 2506806 - DNA, 23 bp, Homo sapiens
agaccagttgggagcactggagt

SEQ ID NO: 2506807 - DNA, 13 bp, Homo sapiens
agaccataatgtt

SEQ ID NO: 2506808 - DNA, 14 bp, Homo sapiens
agaccatccctgaa

SEQ ID NO: 2506809 - DNA, 17 bp, Homo sapiens
agaccatccctgaaggc

SEQ ID NO: 2506810 - DNA, 17 bp, Homo sapiens
agaccatgcagagcgcc

SEQ ID NO: 2506811 - DNA, 19 bp, Homo sapiens
agacccaaaaggcagaagc

SEQ ID NO: 2506812 - DNA, 18 bp, Homo sapiens
agacccagccctcatccc

SEQ ID NO: 2506813 - DNA, 16 bp, Homo sapiens
agaccccacccaagct

SEQ ID NO: 2506814 - DNA, 20 bp, Homo sapiens
agaccccacccaagcttggc

SEQ ID NO: 2506815 - DNA, 13 bp, Homo sapiens
agacccccacacc

SEQ ID NO: 2506816 - DNA, 19 bp, Homo sapiens
agacccccaccccttcccc

SEQ ID NO: 2506817 - DNA, 20 bp, Homo sapiens
agacccccaccccttcccca

SEQ ID NO: 2506818 - DNA, 21 bp, Homo sapiens
agacccccaccccttccccac

SEQ ID NO: 2506819 - DNA, 19 bp, Homo sapiens
agacccctctggccaggat

SEQ ID NO: 2506820 - DNA, 19 bp, Homo sapiens
agaccctaagcctcctttt

SEQ ID NO: 2506821 - DNA, 19 bp, Homo sapiens
agaccctgccctgtgggcc

SEQ ID NO: 2506822 - DNA, 13 bp, Homo sapiens
agacccttgtggt

SEQ ID NO: 2506823 - DNA, 14 bp, Homo sapiens
agacctacctcagg

SEQ ID NO: 2506824 - DNA, 15 bp, Homo sapiens
agacctacctcaggt

SEQ ID NO: 2506825 - DNA, 16 bp, Homo sapiens
agacctacctcaggtt

SEQ ID NO: 2506826 - DNA, 16 bp, Homo sapiens
agacctatttgacata

SEQ ID NO: 2506827 - DNA, 14 bp, Homo sapiens
agacctcagcctgt

SEQ ID NO: 2506828 - DNA, 16 bp, Homo sapiens
agacctcagcctgtgc

SEQ ID NO: 2506829 - DNA, 20 bp, Homo sapiens
agacctcagcctgtgctgcc

SEQ ID NO: 2506830 - DNA, 18 bp, Homo sapiens
agacctcagtgccttcct

SEQ ID NO: 2506831 - DNA, 20 bp, Homo sapiens
agacctcagtgccttcctgt

SEQ ID NO: 2506832 - DNA, 17 bp, Homo sapiens
agacctcatcaggatga

SEQ ID NO: 2506833 - DNA, 16 bp, Homo sapiens
agacctcgagcagatg

SEQ ID NO: 2506834 - DNA, 15 bp, Homo sapiens
agaccttctccttca

SEQ ID NO: 2506835 - DNA, 16 bp, Homo sapiens
agaccttgttcacact

SEQ ID NO: 2506836 - DNA, 20 bp, Homo sapiens
agaccttgttcacactctca

SEQ ID NO: 2506837 - DNA, 22 bp, Homo sapiens
agaccttgttcacactctcaca

SEQ ID NO: 2506838 - DNA, 16 bp, Homo sapiens
agacgatgtcttcata

SEQ ID NO: 2506839 - DNA, 16 bp, Homo sapiens
agacgctgtgctgccc

SEQ ID NO: 2506840 - DNA, 21 bp, Homo sapiens
agacggaggcctactcttcca

SEQ ID NO: 2506841 - DNA, 20 bp, Homo sapiens
agacggagtctcgctctgtc

SEQ ID NO: 2506842 - DNA, 14 bp, Homo sapiens
agacggattgcatt

SEQ ID NO: 2506843 - DNA, 19 bp, Homo sapiens
agacggttcaccagcctct

SEQ ID NO: 2506844 - DNA, 14 bp, Homo sapiens
agactaatttaaaa

SEQ ID NO: 2506845 - DNA, 22 bp, Homo sapiens
agactagtttttattccttgtg

SEQ ID NO: 2506846 - DNA, 17 bp, Homo sapiens
agactatctaaatgttg

SEQ ID NO: 2506847 - DNA, 14 bp, Homo sapiens
agactattcaaaca

SEQ ID NO: 2506848 - DNA, 15 bp, Homo sapiens
agactattcaaacag

SEQ ID NO: 2506849 - DNA, 20 bp, Homo sapiens
agactattcaaacagtctca

SEQ ID NO: 2506850 - DNA, 17 bp, Homo sapiens
agactcagggccccagc

SEQ ID NO: 2506851 - DNA, 23 bp, Homo sapiens
agactcaggttgtagtaaagaaa

SEQ ID NO: 2506852 - DNA, 17 bp, Homo sapiens
agactcatcttactgta

SEQ ID NO: 2506853 - DNA, 17 bp, Homo sapiens
agactcattcttctgta

SEQ ID NO: 2506854 - DNA, 19 bp, Homo sapiens
agactccaaagaaatgtaa

SEQ ID NO: 2506855 - DNA, 21 bp, Homo sapiens
agactccagctgggttggaaa

SEQ ID NO: 2506856 - DNA, 15 bp, Homo sapiens
agactcctgaggaca

SEQ ID NO: 2506857 - DNA, 23 bp, Homo sapiens
agactcctgcaggcagccaggcc

SEQ ID NO: 2506858 - DNA, 20 bp, Homo sapiens
agactccttgagagaccagg

SEQ ID NO: 2506859 - DNA, 20 bp, Homo sapiens
agactcgattcatattgaat

SEQ ID NO: 2506860 - DNA, 21 bp, Homo sapiens
agactctaccagactgtgtat

SEQ ID NO: 2506861 - DNA, 14 bp, Homo sapiens
agactctcttagga

SEQ ID NO: 2506862 - DNA, 16 bp, Homo sapiens
agactctgtggggcct

SEQ ID NO: 2506863 - DNA, 15 bp, Homo sapiens
agactctttgcatat

SEQ ID NO: 2506864 - DNA, 20 bp, Homo sapiens
agactgagtacgttgtgcat

SEQ ID NO: 2506865 - DNA, 23 bp, Homo sapiens
agactgagtacgttgtgcatttg

SEQ ID NO: 2506866 - DNA, 20 bp, Homo sapiens
agactgcgggatggtcctgg

SEQ ID NO: 2506867 - DNA, 23 bp, Homo sapiens
agactgcgggatggtcctggggc

SEQ ID NO: 2506868 - DNA, 20 bp, Homo sapiens
agactgctgtgtttgagctc

SEQ ID NO: 2506869 - DNA, 14 bp, Homo sapiens
agactgcttcccat

SEQ ID NO: 2506870 - DNA, 16 bp, Homo sapiens
agactgcttcccatcc

SEQ ID NO: 2506871 - DNA, 16 bp, Homo sapiens
agactggagcatctga

SEQ ID NO: 2506872 - DNA, 15 bp, Homo sapiens
agactggcacagttt

SEQ ID NO: 2506873 - DNA, 20 bp, Homo sapiens
agactggcacagttttctga

SEQ ID NO: 2506874 - DNA, 23 bp, Homo sapiens
agactggcttttattaatgcact

SEQ ID NO: 2506875 - DNA, 22 bp, Homo sapiens
agactgggaagataggctctgc

SEQ ID NO: 2506876 - DNA, 23 bp, Homo sapiens
agactgggaagataggctctgca

SEQ ID NO: 2506877 - DNA, 14 bp, Homo sapiens
agactgggctgagg

SEQ ID NO: 2506878 - DNA, 15 bp, Homo sapiens
agactgggctgaggg

SEQ ID NO: 2506879 - DNA, 16 bp, Homo sapiens
agactgggctgaggga

SEQ ID NO: 2506880 - DNA, 15 bp, Homo sapiens
agactggtcctgtgt

SEQ ID NO: 2506881 - DNA, 20 bp, Homo sapiens
agactggttccatggcctct

SEQ ID NO: 2506882 - DNA, 14 bp, Homo sapiens
agactgtacaaagt

SEQ ID NO: 2506883 - DNA, 14 bp, Homo sapiens
agactgtggctgct

SEQ ID NO: 2506884 - DNA, 20 bp, Homo sapiens
agactgtggctgctagcact

SEQ ID NO: 2506885 - DNA, 23 bp, Homo sapiens
agactgtttttcagggaggtggc

SEQ ID NO: 2506886 - DNA, 21 bp, Homo sapiens
agacttactttactcattttt

SEQ ID NO: 2506887 - DNA, 14 bp, Homo sapiens
agacttatcaacat

SEQ ID NO: 2506888 - DNA, 19 bp, Homo sapiens
agacttccaaacctgacag

SEQ ID NO: 2506889 - DNA, 19 bp, Homo sapiens
agacttccctgaatgtatt

SEQ ID NO: 2506890 - DNA, 14 bp, Homo sapiens
agacttgaaatact

SEQ ID NO: 2506891 - DNA, 20 bp, Homo sapiens
agactttacatgacacagct

SEQ ID NO: 2506892 - DNA, 21 bp, Homo sapiens
agactttggaaaatgcattgt

SEQ ID NO: 2506893 - DNA, 15 bp, Homo sapiens
agactttggaaagag

SEQ ID NO: 2506894 - DNA, 19 bp, Homo sapiens
agactttggaaagagtagg

SEQ ID NO: 2506895 - DNA, 18 bp, Homo sapiens
agacttttaatcagacaa

SEQ ID NO: 2506896 - DNA, 15 bp, Homo sapiens
agacttttccaaccc

SEQ ID NO: 2506897 - DNA, 12 bp, Homo sapiens
agagaaaagaaa

SEQ ID NO: 2506898 - DNA, 13 bp, Homo sapiens
agagaaaagaaaa

SEQ ID NO: 2506899 - DNA, 12 bp, Homo sapiens
agaacctggaga

SEQ ID NO: 2506900 - DNA, 14 bp, Homo sapiens
agaacctgtccttg

SEQ ID NO: 2506901 - DNA, 22 bp, Homo sapiens
agaaccttgtgcctggctcaga

SEQ ID NO: 2506902 - DNA, 23 bp, Homo sapiens
agaaccttgtgcctggctcagag

SEQ ID NO: 2506903 - DNA, 17 bp, Homo sapiens
agaactagaacctggag

SEQ ID NO: 2506904 - DNA, 21 bp, Homo sapiens
agaactgaaccggctttacca

SEQ ID NO: 2506905 - DNA, 15 bp, Homo sapiens
agaactgagctcctc

SEQ ID NO: 2506906 - DNA, 19 bp, Homo sapiens
agaactgcatatgtttcgc

SEQ ID NO: 2506907 - DNA, 16 bp, Homo sapiens
agaactggactcagga

SEQ ID NO: 2506908 - DNA, 17 bp, Homo sapiens
agaactggactcaggat

SEQ ID NO: 2506909 - DNA, 18 bp, Homo sapiens
agaacttggatgtacctg

SEQ ID NO: 2506910 - DNA, 21 bp, Homo sapiens
agaagaacttgcatggagcag

SEQ ID NO: 2506911 - DNA, 14 bp, Homo sapiens
agaagaaggcagca

SEQ ID NO: 2506912 - DNA, 20 bp, Homo sapiens
agaagaatacaaacatattt

SEQ ID NO: 2506913 - DNA, 14 bp, Homo sapiens
agaagaatattcag

SEQ ID NO: 2506914 - DNA, 18 bp, Homo sapiens
agaagaatattcaggact

SEQ ID NO: 2506915 - DNA, 13 bp, Homo sapiens
agaagacaaaatt

SEQ ID NO: 2506916 - DNA, 15 bp, Homo sapiens
agaagacaccagagc

SEQ ID NO: 2506917 - DNA, 23 bp, Homo sapiens
agaagacaccagagcagatgcag

SEQ ID NO: 2506918 - DNA, 12 bp, Homo sapiens
agaagacatgaa

SEQ ID NO: 2506919 - DNA, 15 bp, Homo sapiens
agaagacatgaacca

SEQ ID NO: 2506920 - DNA, 16 bp, Homo sapiens
agaagacatgaaccaa

SEQ ID NO: 2506921 - DNA, 14 bp, Homo sapiens
agaagacccttctc

SEQ ID NO: 2506922 - DNA, 20 bp, Homo sapiens
agaagactctaccagactgt

SEQ ID NO: 2506923 - DNA, 22 bp, Homo sapiens
agaagagaatattagctttact

SEQ ID NO: 2506924 - DNA, 22 bp, Homo sapiens
agaagagagtccatatttcaat

SEQ ID NO: 2506925 - DNA, 22 bp, Homo sapiens
agaagagctgttcacagccaga

SEQ ID NO: 2506926 - DNA, 22 bp, Homo sapiens
agaagaggctggtgctgtggcc

SEQ ID NO: 2506927 - DNA, 13 bp, Homo sapiens
agaagatcccctc

SEQ ID NO: 2506928 - DNA, 16 bp, Homo sapiens
agaagatcctacccca

SEQ ID NO: 2506929 - DNA, 13 bp, Homo sapiens
agaagatgaatac

SEQ ID NO: 2506930 - DNA, 19 bp, Homo sapiens
agaagatggcacttataac

SEQ ID NO: 2506931 - DNA, 20 bp, Homo sapiens
agaagcaataaagaagagtg

SEQ ID NO: 2506932 - DNA, 14 bp, Homo sapiens
agaagcagaaatac

SEQ ID NO: 2506933 - DNA, 12 bp, Homo sapiens
agaagcagctct

SEQ ID NO: 2506934 - DNA, 14 bp, Homo sapiens
agaagcattccttc

SEQ ID NO: 2506935 - DNA, 23 bp, Homo sapiens
agaagcattccttctttgataat

SEQ ID NO: 2506936 - DNA, 24 bp, Homo sapiens
agaagcattccttctttgataatg

SEQ ID NO: 2506937 - DNA, 17 bp, Homo sapiens
agaagccaaaagattgg

SEQ ID NO: 2506938 - DNA, 14 bp, Homo sapiens
agaagccaggagca

SEQ ID NO: 2506939 - DNA, 11 bp, Homo sapiens
agaagccattg

SEQ ID NO: 2506940 - DNA, 12 bp, Homo sapiens
agaagccattgt

SEQ ID NO: 2506941 - DNA, 15 bp, Homo sapiens
agaagccattgtctt

SEQ ID NO: 2506942 - DNA, 21 bp, Homo sapiens
agaagcccaatattataattt

SEQ ID NO: 2506943 - DNA, 20 bp, Homo sapiens
agaagcccaggaaaggctcc

SEQ ID NO: 2506944 - DNA, 21 bp, Homo sapiens
agaagcccaggaaaggctcca

SEQ ID NO: 2506945 - DNA, 22 bp, Homo sapiens
agaagcccaggaaaggctccag

SEQ ID NO: 2506946 - DNA, 21 bp, Homo sapiens
agaagccccttccccatggga

SEQ ID NO: 2506947 - DNA, 18 bp, Homo sapiens
agaagccgggaacagaca

SEQ ID NO: 2506948 - DNA, 16 bp, Homo sapiens
agaagcctgttttgtt

SEQ ID NO: 2506949 - DNA, 18 bp, Homo sapiens
agaagctaaaacctgagc

SEQ ID NO: 2506950 - DNA, 20 bp, Homo sapiens
agaagctgagcaccagggga

SEQ ID NO: 2506951 - DNA, 16 bp, Homo sapiens
agaagctggaggacta

SEQ ID NO: 2506952 - DNA, 13 bp, Homo sapiens
agaagctgtagta

SEQ ID NO: 2506953 - DNA, 23 bp, Homo sapiens
agaagctgttgtacatttatgat

SEQ ID NO: 2506954 - DNA, 9 bp, Homo sapiens
agaaggaag

SEQ ID NO: 2506955 - DNA, 20 bp, Homo sapiens
agaaggagtcagaaactgtt

SEQ ID NO: 2506956 - DNA, 21 bp, Homo sapiens
agaaggatgaatgaggtccca

SEQ ID NO: 2506957 - DNA, 13 bp, Homo sapiens
agaaggcagccac

SEQ ID NO: 2506958 - DNA, 13 bp, Homo sapiens
agaaggccaagaa

SEQ ID NO: 2506959 - DNA, 14 bp, Homo sapiens
agaaggccacatgt

SEQ ID NO: 2506960 - DNA, 21 bp, Homo sapiens
agaagggctagaacctggaga

SEQ ID NO: 2506961 - DNA, 20 bp, Homo sapiens
agaagggttttccaccctgg

SEQ ID NO: 2506962 - DNA, 21 bp, Homo sapiens
agaagggttttccaccctgga

SEQ ID NO: 2506963 - DNA, 21 bp, Homo sapiens
agaaggtattccttttgtgta

SEQ ID NO: 2506964 - DNA, 21 bp, Homo sapiens
agaaggtccttaatgatccgt

SEQ ID NO: 2506965 - DNA, 20 bp, Homo sapiens
agaaggtcggaggcttggga

SEQ ID NO: 2506966 - DNA, 21 bp, Homo sapiens
agaaggtgcctcaagaatttc

SEQ ID NO: 2506967 - DNA, 20 bp, Homo sapiens
agaaggttaccaagaagcct

SEQ ID NO: 2506968 - DNA, 16 bp, Homo sapiens
agaaggttgctctaga

SEQ ID NO: 2506969 - DNA, 17 bp, Homo sapiens
agaaggtttgtgttttt

SEQ ID NO: 2506970 - DNA, 19 bp, Homo sapiens
agaaggtttgtgtttttct

SEQ ID NO: 2506971 - DNA, 13 bp, Homo sapiens
agaagtagattaa

SEQ ID NO: 2506972 - DNA, 17 bp, Homo sapiens
agaagtaggcatgaggg

SEQ ID NO: 2506973 - DNA, 14 bp, Homo sapiens
agaagtattataaa

SEQ ID NO: 2506974 - DNA, 19 bp, Homo sapiens
agaagtattataaattatg

SEQ ID NO: 2506975 - DNA, 14 bp, Homo sapiens
agaagtcaaagtaa

SEQ ID NO: 2506976 - DNA, 14 bp, Homo sapiens
agaagtcacacagt

SEQ ID NO: 2506977 - DNA, 13 bp, Homo sapiens
agaagtcatgaag

SEQ ID NO: 2506978 - DNA, 17 bp, Homo sapiens
agaagtcatgaagccca

SEQ ID NO: 2506979 - DNA, 20 bp, Homo sapiens
agaagtcatgaagcccaagt

SEQ ID NO: 2506980 - DNA, 17 bp, Homo sapiens
agaagtcttagatgtat

SEQ ID NO: 2506981 - DNA, 21 bp, Homo sapiens
agaagtgaaaatctacactcc

SEQ ID NO: 2506982 - DNA, 22 bp, Homo sapiens
agaagtgacagggaagctacag

SEQ ID NO: 2506983 - DNA, 23 bp, Homo sapiens
agaagtgacagggaagctacagg

SEQ ID NO: 2506984 - DNA, 14 bp, Homo sapiens
agaagtgcccctgc

SEQ ID NO: 2506985 - DNA, 14 bp, Homo sapiens
agaagttgtttgtc

SEQ ID NO: 2506986 - DNA, 15 bp, Homo sapiens
agaagtttaaggaat

SEQ ID NO: 2506987 - DNA, 23 bp, Homo sapiens
agaagtttctggccctggctgac

SEQ ID NO: 2506988 - DNA, 14 bp, Homo sapiens
agaagtttttgtac

SEQ ID NO: 2506989 - DNA, 15 bp, Homo sapiens
agaagtttttgtact

SEQ ID NO: 2506990 - DNA, 14 bp, Homo sapiens
agaataagagaaag

SEQ ID NO: 2506991 - DNA, 22 bp, Homo sapiens
agaataagagagtcataaacct

SEQ ID NO: 2506992 - DNA, 15 bp, Homo sapiens
agaataagtcatgtt

SEQ ID NO: 2506993 - DNA, 20 bp, Homo sapiens
agaataagttattgcagttt

SEQ ID NO: 2506994 - DNA, 21 bp, Homo sapiens
agaataatcacgctttcctga

SEQ ID NO: 2506995 - DNA, 15 bp, Homo sapiens
agaataatgaatgga

SEQ ID NO: 2506996 - DNA, 15 bp, Homo sapiens
agaatacaaacatat

SEQ ID NO: 2506997 - DNA, 18 bp, Homo sapiens
agaatacagaaagatgga

SEQ ID NO: 2506998 - DNA, 16 bp, Homo sapiens
agaatataaaaaactt

SEQ ID NO: 2506999 - DNA, 13 bp, Homo sapiens
agaatataatact

SEQ ID NO: 2507000 - DNA, 23 bp, Homo sapiens
agaatataattatcggaagcagt

SEQ ID NO: 2507001 - DNA, 13 bp, Homo sapiens
agaatatatacat

SEQ ID NO: 2507002 - DNA, 17 bp, Homo sapiens
agaatatccatgaccta

SEQ ID NO: 2507003 - DNA, 11 bp, Homo sapiens
agaatatctgg

SEQ ID NO: 2507004 - DNA, 20 bp, Homo sapiens
agaatattagctttactgtt

SEQ ID NO: 2507005 - DNA, 16 bp, Homo sapiens
agaatatttattacct

SEQ ID NO: 2507006 - DNA, 14 bp, Homo sapiens
agaatcaaaactct

SEQ ID NO: 2507007 - DNA, 21 bp, Homo sapiens
agaatcaacatttctcaataa

SEQ ID NO: 2507008 - DNA, 22 bp, Homo sapiens
agaatcacttctgagaactcat

SEQ ID NO: 2507009 - DNA, 16 bp, Homo sapiens
agaatcagtgcaaaga

SEQ ID NO: 2507010 - DNA, 18 bp, Homo sapiens
agaatcatgtgaacccgg

SEQ ID NO: 2507011 - DNA, 18 bp, Homo sapiens
agaatcccactttctata

SEQ ID NO: 2507012 - DNA, 17 bp, Homo sapiens
actttcacatagatgtc

SEQ ID NO: 2507013 - DNA, 20 bp, Homo sapiens
actttcacatagatgtccct

SEQ ID NO: 2507014 - DNA, 21 bp, Homo sapiens
actttcacatagatgtccctt

SEQ ID NO: 2507015 - DNA, 21 bp, Homo sapiens
actttcatcctgactctgccc

SEQ ID NO: 2507016 - DNA, 23 bp, Homo sapiens
actttcatcctgactctgccccc

SEQ ID NO: 2507017 - DNA, 20 bp, Homo sapiens
actttccaccccctccctgg

SEQ ID NO: 2507018 - DNA, 17 bp, Homo sapiens
actttcctcctggcaga

SEQ ID NO: 2507019 - DNA, 17 bp, Homo sapiens
actttctcagttttcat

SEQ ID NO: 2507020 - DNA, 18 bp, Homo sapiens
actttctcagttttcata

SEQ ID NO: 2507021 - DNA, 23 bp, Homo sapiens
actttgacctctgcagcaataaa

SEQ ID NO: 2507022 - DNA, 14 bp, Homo sapiens
actttgcttcccat

SEQ ID NO: 2507023 - DNA, 18 bp, Homo sapiens
actttggaaaatgcattg

SEQ ID NO: 2507024 - DNA, 13 bp, Homo sapiens
actttggaaagac

SEQ ID NO: 2507025 - DNA, 13 bp, Homo sapiens
actttggctgcat

SEQ ID NO: 2507026 - DNA, 17 bp, Homo sapiens
actttggctgcatgcga

SEQ ID NO: 2507027 - DNA, 15 bp, Homo sapiens
actttgggaggccaa

SEQ ID NO: 2507028 - DNA, 20 bp, Homo sapiens
actttgggaggccaaggtgg

SEQ ID NO: 2507029 - DNA, 19 bp, Homo sapiens
actttggtacatggccagt

SEQ ID NO: 2507030 - DNA, 19 bp, Homo sapiens
actttgtatgtcatttcct

SEQ ID NO: 2507031 - DNA, 14 bp, Homo sapiens
actttgtgaataga

SEQ ID NO: 2507032 - DNA, 21 bp, Homo sapiens
actttgttagtttctccaagc

SEQ ID NO: 2507033 - DNA, 14 bp, Homo sapiens
actttgttctggct

SEQ ID NO: 2507034 - DNA, 16 bp, Homo sapiens
actttgttctggctct

SEQ ID NO: 2507035 - DNA, 20 bp, Homo sapiens
actttgttctttaggagatt

SEQ ID NO: 2507036 - DNA, 14 bp, Homo sapiens
acttttaaactgtg

SEQ ID NO: 2507037 - DNA, 15 bp, Homo sapiens
acttttaaactgtgt

SEQ ID NO: 2507038 - DNA, 17 bp, Homo sapiens
acttttaaactgtgtac

SEQ ID NO: 2507039 - DNA, 20 bp, Homo sapiens
acttttaaactgtgtacata

SEQ ID NO: 2507040 - DNA, 20 bp, Homo sapiens
acttttatgatgtatattta

SEQ ID NO: 2507041 - DNA, 21 bp, Homo sapiens
actttttaaaatcttttctat

SEQ ID NO: 2507042 - DNA, 19 bp, Homo sapiens
actttttaactattaagag

SEQ ID NO: 2507043 - DNA, 13 bp, Homo sapiens
actttttcatttg

SEQ ID NO: 2507044 - DNA, 18 bp, Homo sapiens
actttttcatttgcctat

SEQ ID NO: 2507045 - DNA, 23 bp, Homo sapiens
acttttttggggatatgcttagt

SEQ ID NO: 2507046 - DNA, 22 bp, Homo sapiens
actttttttttccaaaaaaata

SEQ ID NO: 2507047 - DNA, 17 bp, Homo sapiens
agaaaaaaaaagaaaaa

SEQ ID NO: 2507048 - DNA, 18 bp, Homo sapiens
agaaaaaaaaagaaaaaa

SEQ ID NO: 2507049 - DNA, 19 bp, Homo sapiens
agaaaaaaaaagaaaaaag

SEQ ID NO: 2507050 - DNA, 10 bp, Homo sapiens
agaaaaaaga

SEQ ID NO: 2507051 - DNA, 12 bp, Homo sapiens
agaaaaaagaag

SEQ ID NO: 2507052 - DNA, 18 bp, Homo sapiens
agaaaaaataacacacat

SEQ ID NO: 2507053 - DNA, 11 bp, Homo sapiens
agaaaaaatac

SEQ ID NO: 2507054 - DNA, 14 bp, Homo sapiens
agaaaaaatacatt

SEQ ID NO: 2507055 - DNA, 17 bp, Homo sapiens
agaaaaaatattttcct

SEQ ID NO: 2507056 - DNA, 13 bp, Homo sapiens
agaaaacatgttt

SEQ ID NO: 2507057 - DNA, 13 bp, Homo sapiens
agaaaagaaaaaa

SEQ ID NO: 2507058 - DNA, 15 bp, Homo sapiens
agaaaagataaagat

SEQ ID NO: 2507059 - DNA, 16 bp, Homo sapiens
agaaaagataaagatg

SEQ ID NO: 2507060 - DNA, 14 bp, Homo sapiens
agaaaaggacagaa

SEQ ID NO: 2507061 - DNA, 20 bp, Homo sapiens
agaaaagggaactgaacatt

SEQ ID NO: 2507062 - DNA, 18 bp, Homo sapiens
agaaaataaaaaaaagaa

SEQ ID NO: 2507063 - DNA, 19 bp, Homo sapiens
agaaaataaaaaaaagaaa

SEQ ID NO: 2507064 - DNA, 20 bp, Homo sapiens
agaaaataaaaaaaagaaaa

SEQ ID NO: 2507065 - DNA, 13 bp, Homo sapiens
agaaaataaaaag

SEQ ID NO: 2507066 - DNA, 16 bp, Homo sapiens
agaaaataaaaagtta

SEQ ID NO: 2507067 - DNA, 19 bp, Homo sapiens
agaaaatagtggtgtgatt

SEQ ID NO: 2507068 - DNA, 10 bp, Homo sapiens
agaaaatata

SEQ ID NO: 2507069 - DNA, 12 bp, Homo sapiens
agaaaatatact

SEQ ID NO: 2507070 - DNA, 16 bp, Homo sapiens
agaaaatatactgtaa

SEQ ID NO: 2507071 - DNA, 18 bp, Homo sapiens
agaaaatatactgtaaag

SEQ ID NO: 2507072 - DNA, 21 bp, Homo sapiens
agaaaatatactgtaaagaaa

SEQ ID NO: 2507073 - DNA, 22 bp, Homo sapiens
agaaaatatactgtaaagaaag

SEQ ID NO: 2507074 - DNA, 15 bp, Homo sapiens
agaaaatggacactg

SEQ ID NO: 2507075 - DNA, 20 bp, Homo sapiens
agaaacaactctttgagaaa

SEQ ID NO: 2507076 - DNA, 15 bp, Homo sapiens
agaaacacactgagg

SEQ ID NO: 2507077 - DNA, 17 bp, Homo sapiens
agaaacacactgaggca

SEQ ID NO: 2507078 - DNA, 16 bp, Homo sapiens
agaaacatcagttact

SEQ ID NO: 2507079 - DNA, 20 bp, Homo sapiens
agaaacgtttggaacaatct

SEQ ID NO: 2507080 - DNA, 16 bp, Homo sapiens
agaaactctacataat

SEQ ID NO: 2507081 - DNA, 16 bp, Homo sapiens
agaaactgagaccaaa

SEQ ID NO: 2507082 - DNA, 15 bp, Homo sapiens
agaaactgcagggaa

SEQ ID NO: 2507083 - DNA, 15 bp, Homo sapiens
agaaactgttcccac

SEQ ID NO: 2507084 - DNA, 21 bp, Homo sapiens
agaaactgttcccacctgctg

SEQ ID NO: 2507085 - DNA, 22 bp, Homo sapiens
agaaactgttcccacctgctgg

SEQ ID NO: 2507086 - DNA, 13 bp, Homo sapiens
agaaacttgtgaa

SEQ ID NO: 2507087 - DNA, 23 bp, Homo sapiens
agaaacttgtgaagtggaaatgt

SEQ ID NO: 2507088 - DNA, 16 bp, Homo sapiens
agaaagaaaatgaaga

SEQ ID NO: 2507089 - DNA, 18 bp, Homo sapiens
agaaagacagagctggga

SEQ ID NO: 2507090 - DNA, 18 bp, Homo sapiens
agaaagactattcaaaca

SEQ ID NO: 2507091 - DNA, 23 bp, Homo sapiens
agaaagactattcaaacagtctc

SEQ ID NO: 2507092 - DNA, 12 bp, Homo sapiens
agaaagactgag

SEQ ID NO: 2507093 - DNA, 13 bp, Homo sapiens
agaaagagagaaa

SEQ ID NO: 2507094 - DNA, 14 bp, Homo sapiens
agaaagagagaaaa

SEQ ID NO: 2507095 - DNA, 19 bp, Homo sapiens
agaaagatggatgtgcttt

SEQ ID NO: 2507096 - DNA, 21 bp, Homo sapiens
agaaagcaaaattatgtttgc

SEQ ID NO: 2507097 - DNA, 16 bp, Homo sapiens
agaaagcattacattt

SEQ ID NO: 2507098 - DNA, 22 bp, Homo sapiens
agaaagcccttaggaagaattt

SEQ ID NO: 2507099 - DNA, 15 bp, Homo sapiens
agaaagcctcagaga

SEQ ID NO: 2507100 - DNA, 22 bp, Homo sapiens
agaaagcctgttcccctcactg

SEQ ID NO: 2507101 - DNA, 16 bp, Homo sapiens
agaaagctggtaaact

SEQ ID NO: 2507102 - DNA, 19 bp, Homo sapiens
agaaagctggtaaactatt

SEQ ID NO: 2507103 - DNA, 14 bp, Homo sapiens
agaaaggactctgg

SEQ ID NO: 2507104 - DNA, 20 bp, Homo sapiens
agaaaggaggggatagagag

SEQ ID NO: 2507105 - DNA, 23 bp, Homo sapiens
agaaaggaggggatagagagaga

SEQ ID NO: 2507106 - DNA, 17 bp, Homo sapiens
agaaagggtgtttttct

SEQ ID NO: 2507107 - DNA, 20 bp, Homo sapiens
agaaaggtggactggaaggg

SEQ ID NO: 2507108 - DNA, 16 bp, Homo sapiens
agaaaggttctgcccg

SEQ ID NO: 2507109 - DNA, 23 bp, Homo sapiens
agaaagtacttctccaccctgct

SEQ ID NO: 2507110 - DNA, 19 bp, Homo sapiens
agaaagtcttatttattca

SEQ ID NO: 2507111 - DNA, 22 bp, Homo sapiens
agaaagtcttatttattcatat

SEQ ID NO: 2507112 - DNA, 15 bp, Homo sapiens
agaaagtgatttcta

SEQ ID NO: 2507113 - DNA, 14 bp, Homo sapiens
agaaataaaactgt

SEQ ID NO: 2507114 - DNA, 15 bp, Homo sapiens
agaaataaaactgtt

SEQ ID NO: 2507115 - DNA, 17 bp, Homo sapiens
agaaataagtggttatt

SEQ ID NO: 2507116 - DNA, 14 bp, Homo sapiens
agaaatactgtaca

SEQ ID NO: 2507117 - DNA, 16 bp, Homo sapiens
agaaatactgtacaat

SEQ ID NO: 2507118 - DNA, 14 bp, Homo sapiens
agaaatataattga

SEQ ID NO: 2507119 - DNA, 19 bp, Homo sapiens
agaaatatctgaaaatgta

SEQ ID NO: 2507120 - DNA, 15 bp, Homo sapiens
agaaatatgatttta

SEQ ID NO: 2507121 - DNA, 16 bp, Homo sapiens
agaaatatgattttat

SEQ ID NO: 2507122 - DNA, 14 bp, Homo sapiens
agaaatatgtggtt

SEQ ID NO: 2507123 - DNA, 19 bp, Homo sapiens
agaaatgaataatttccca

SEQ ID NO: 2507124 - DNA, 15 bp, Homo sapiens
agaaatgccttaccc

SEQ ID NO: 2507125 - DNA, 14 bp, Homo sapiens
agaaatgctgcctg

SEQ ID NO: 2507126 - DNA, 15 bp, Homo sapiens
agaaatgctgcctgc

SEQ ID NO: 2507127 - DNA, 16 bp, Homo sapiens
agaaatgtacagcaag

SEQ ID NO: 2507128 - DNA, 16 bp, Homo sapiens
agaaatgttgttcatt

SEQ ID NO: 2507129 - DNA, 17 bp, Homo sapiens
agaaattaagtatctga

SEQ ID NO: 2507130 - DNA, 16 bp, Homo sapiens
agaaattatttaataa

SEQ ID NO: 2507131 - DNA, 17 bp, Homo sapiens
agaaattatttaataaa

SEQ ID NO: 2507132 - DNA, 20 bp, Homo sapiens
agaaattcctgtagcatctt

SEQ ID NO: 2507133 - DNA, 23 bp, Homo sapiens
agaaattcctgtagcatcttctg

SEQ ID NO: 2507134 - DNA, 14 bp, Homo sapiens
agagaaaataaaaa

SEQ ID NO: 2507135 - DNA, 17 bp, Homo sapiens
agagaaaataaaaagtt

SEQ ID NO: 2507136 - DNA, 14 bp, Homo sapiens
agagaaagaagaga

SEQ ID NO: 2507137 - DNA, 17 bp, Homo sapiens
agagaaagaagagacag

SEQ ID NO: 2507138 - DNA, 17 bp, Homo sapiens
agagaaccgagcaaaga

SEQ ID NO: 2507139 - DNA, 20 bp, Homo sapiens
agagaacctggagttcctga

SEQ ID NO: 2507140 - DNA, 11 bp, Homo sapiens
agagaagacaa

SEQ ID NO: 2507141 - DNA, 10 bp, Homo sapiens
agagaagaga

SEQ ID NO: 2507142 - DNA, 18 bp, Homo sapiens
agagaaggcctccctagc

SEQ ID NO: 2507143 - DNA, 16 bp, Homo sapiens
agagaagtattataaa

SEQ ID NO: 2507144 - DNA, 22 bp, Homo sapiens
agagaatattagctttactgtt

SEQ ID NO: 2507145 - DNA, 12 bp, Homo sapiens
agagaatcaaca

SEQ ID NO: 2507146 - DNA, 15 bp, Homo sapiens
agagaatggaaaaca

SEQ ID NO: 2507147 - DNA, 17 bp, Homo sapiens
agagaatgtagatattg

SEQ ID NO: 2507148 - DNA, 19 bp, Homo sapiens
agagacaaacacctcccag

SEQ ID NO: 2507149 - DNA, 14 bp, Homo sapiens
agagacagaaagca

SEQ ID NO: 2507150 - DNA, 24 bp, Homo sapiens
agagacagaaagcagaacagtgat

SEQ ID NO: 2507151 - DNA, 13 bp, Homo sapiens
agagacagaagca

SEQ ID NO: 2507152 - DNA, 18 bp, Homo sapiens
agagacaggcccaagaga

SEQ ID NO: 2507153 - DNA, 20 bp, Homo sapiens
agagacaggcccaagagatg

SEQ ID NO: 2507154 - DNA, 12 bp, Homo sapiens
agagacattcct

SEQ ID NO: 2507155 - DNA, 22 bp, Homo sapiens
agagaccatccctgaaggcccc

SEQ ID NO: 2507156 - DNA, 16 bp, Homo sapiens
agagacctacctcagg

SEQ ID NO: 2507157 - DNA, 15 bp, Homo sapiens
agagacctcctgcct

SEQ ID NO: 2507158 - DNA, 19 bp, Homo sapiens
agagactcagggccccagc

SEQ ID NO: 2507159 - DNA, 16 bp, Homo sapiens
agagactccagctggg

SEQ ID NO: 2507160 - DNA, 11 bp, Homo sapiens
agagactcctg

SEQ ID NO: 2507161 - DNA, 13 bp, Homo sapiens
agagactcctgca

SEQ ID NO: 2507162 - DNA, 20 bp, Homo sapiens
agagactcctgcaggcagcc

SEQ ID NO: 2507163 - DNA, 21 bp, Homo sapiens
agagactcctgcaggcagcca

SEQ ID NO: 2507164 - DNA, 22 bp, Homo sapiens
agagactcctgcaggcagccag

SEQ ID NO: 2507165 - DNA, 21 bp, Homo sapiens
agagactggagcatctgactc

SEQ ID NO: 2507166 - DNA, 14 bp, Homo sapiens
agagagaaaaacaa

SEQ ID NO: 2507167 - DNA, 13 bp, Homo sapiens
agagagaaaataa

SEQ ID NO: 2507168 - DNA, 15 bp, Homo sapiens
agagagaaaataaaa

SEQ ID NO: 2507169 - DNA, 18 bp, Homo sapiens
agagagaaaataaaaagt

SEQ ID NO: 2507170 - DNA, 21 bp, Homo sapiens
agagagaaagaagtaggcatg

SEQ ID NO: 2507171 - DNA, 11 bp, Homo sapiens
agagagaagcc

SEQ ID NO: 2507172 - DNA, 17 bp, Homo sapiens
agagagagagacagaga

SEQ ID NO: 2507173 - DNA, 17 bp, Homo sapiens
agagagccattttgtga

SEQ ID NO: 2507174 - DNA, 18 bp, Homo sapiens
agagagccattttgtgaa

SEQ ID NO: 2507175 - DNA, 11 bp, Homo sapiens
agagagctggt

SEQ ID NO: 2507176 - DNA, 13 bp, Homo sapiens
agagaggagttca

SEQ ID NO: 2507177 - DNA, 18 bp, Homo sapiens
agagaggagttcaatgat

SEQ ID NO: 2507178 - DNA, 21 bp, Homo sapiens
agagaggagttcaatgatcta

SEQ ID NO: 2507179 - DNA, 17 bp, Homo sapiens
agagagggaggtatgga

SEQ ID NO: 2507180 - DNA, 22 bp, Homo sapiens
agagaggggaataatagaagaa

SEQ ID NO: 2507181 - DNA, 23 bp, Homo sapiens
agagagggtggtgacctctgcct

SEQ ID NO: 2507182 - DNA, 15 bp, Homo sapiens
agagagtcccactgc

SEQ ID NO: 2507183 - DNA, 15 bp, Homo sapiens
agagagtcctctgga

SEQ ID NO: 2507184 - DNA, 16 bp, Homo sapiens
agagagtcctctggat

SEQ ID NO: 2507185 - DNA, 22 bp, Homo sapiens
agagagtcctctggatggcacc

SEQ ID NO: 2507186 - DNA, 19 bp, Homo sapiens
agagatgaagagtgagagg

SEQ ID NO: 2507187 - DNA, 17 bp, Homo sapiens
agagatgggagctcctc

SEQ ID NO: 2507188 - DNA, 20 bp, Homo sapiens
agagatgggagctcctctcc

SEQ ID NO: 2507189 - DNA, 22 bp, Homo sapiens
agagatgtttttaaaagtttca

SEQ ID NO: 2507190 - DNA, 20 bp, Homo sapiens
agagattacctcctgagaaa

SEQ ID NO: 2507191 - DNA, 20 bp, Homo sapiens
agagattggaatgggcagct

SEQ ID NO: 2507192 - DNA, 13 bp, Homo sapiens
agagatttaatta

SEQ ID NO: 2507193 - DNA, 18 bp, Homo sapiens
agagcaaaataattttaa

SEQ ID NO: 2507194 - DNA, 21 bp, Homo sapiens
agagcaccttagacagtccct

SEQ ID NO: 2507195 - DNA, 23 bp, Homo sapiens
agagcaccttagacagtccctgc

SEQ ID NO: 2507196 - DNA, 14 bp, Homo sapiens
agagcaccttcctc

SEQ ID NO: 2507197 - DNA, 20 bp, Homo sapiens
agagcactgggttgcagggg

SEQ ID NO: 2507198 - DNA, 21 bp, Homo sapiens
agagcactgggttgcagggga

SEQ ID NO: 2507199 - DNA, 20 bp, Homo sapiens
agagcagaacggagccccag

SEQ ID NO: 2507200 - DNA, 15 bp, Homo sapiens
agagcagatgcagag

SEQ ID NO: 2507201 - DNA, 23 bp, Homo sapiens
agagcagcagtgaaaacaagtgc

SEQ ID NO: 2507202 - DNA, 18 bp, Homo sapiens
agagcagctttaaactca

SEQ ID NO: 2507203 - DNA, 22 bp, Homo sapiens
agagcaggaggcccctggccca

SEQ ID NO: 2507204 - DNA, 12 bp, Homo sapiens
agagcaggcaca

SEQ ID NO: 2507205 - DNA, 18 bp, Homo sapiens
agagcaggcacatggagg

SEQ ID NO: 2507206 - DNA, 17 bp, Homo sapiens
agagcattacgtgagcc

SEQ ID NO: 2507207 - DNA, 21 bp, Homo sapiens
agagcattacgtgagccaggt

SEQ ID NO: 2507208 - DNA, 19 bp, Homo sapiens
agagccaccaagagggacg

SEQ ID NO: 2507209 - DNA, 15 bp, Homo sapiens
agagccagagaagtg

SEQ ID NO: 2507210 - DNA, 17 bp, Homo sapiens
agagccagagaagtgac

SEQ ID NO: 2507211 - DNA, 16 bp, Homo sapiens
agagccatgctgggaa

SEQ ID NO: 2507212 - DNA, 17 bp, Homo sapiens
agagccattttgtgaat

SEQ ID NO: 2507213 - DNA, 13 bp, Homo sapiens
agagcccaccttg

SEQ ID NO: 2507214 - DNA, 17 bp, Homo sapiens
agagcccacgcccccac

SEQ ID NO: 2507215 - DNA, 16 bp, Homo sapiens
agagcccagaggtaac

SEQ ID NO: 2507216 - DNA, 24 bp, Homo sapiens
agagcccagaggtaacagaacagc

SEQ ID NO: 2507217 - DNA, 16 bp, Homo sapiens
agagccccagctgaca

SEQ ID NO: 2507218 - DNA, 11 bp, Homo sapiens
agagcctgagg

SEQ ID NO: 2507219 - DNA, 14 bp, Homo sapiens
agagcctgagggat

SEQ ID NO: 2507220 - DNA, 18 bp, Homo sapiens
agagcctgcaggtgctgc

SEQ ID NO: 2507221 - DNA, 17 bp, Homo sapiens
agagcctgcctggagcg

SEQ ID NO: 2507222 - DNA, 15 bp, Homo sapiens
agagcctgctgcatg

SEQ ID NO: 2507223 - DNA, 14 bp, Homo sapiens
agagcctggagaag

SEQ ID NO: 2507224 - DNA, 16 bp, Homo sapiens
agagcctggagaagct

SEQ ID NO: 2507225 - DNA, 13 bp, Homo sapiens
agagccttccagg

SEQ ID NO: 2507226 - DNA, 22 bp, Homo sapiens
agagccttccaggggtgggaca

SEQ ID NO: 2507227 - DNA, 21 bp, Homo sapiens
agagcctttggatgaccagaa

SEQ ID NO: 2507228 - DNA, 18 bp, Homo sapiens
agagcctttttctaggcc

SEQ ID NO: 2507229 - DNA, 18 bp, Homo sapiens
agagcgccgtgagttctc

SEQ ID NO: 2507230 - DNA, 14 bp, Homo sapiens
agagcgcctgcccc

SEQ ID NO: 2507231 - DNA, 15 bp, Homo sapiens
agataatctctcagc

SEQ ID NO: 2507232 - DNA, 13 bp, Homo sapiens
agataatgtgaaa

SEQ ID NO: 2507233 - DNA, 19 bp, Homo sapiens
agataatgtgatattatac

SEQ ID NO: 2507234 - DNA, 22 bp, Homo sapiens
agatacagttactcagaattct

SEQ ID NO: 2507235 - DNA, 18 bp, Homo sapiens
agatacatatgagtgtgg

SEQ ID NO: 2507236 - DNA, 22 bp, Homo sapiens
agatacatatgagtgtggaagc

SEQ ID NO: 2507237 - DNA, 21 bp, Homo sapiens
agataccagcgaggaggctcc

SEQ ID NO: 2507238 - DNA, 18 bp, Homo sapiens
agataccaggttgaaaga

SEQ ID NO: 2507239 - DNA, 14 bp, Homo sapiens
agatacgactttat

SEQ ID NO: 2507240 - DNA, 20 bp, Homo sapiens
agatacgactttattttctg

SEQ ID NO: 2507241 - DNA, 20 bp, Homo sapiens
agatactggaagttttgcat

SEQ ID NO: 2507242 - DNA, 11 bp, Homo sapiens
agatactgtat

SEQ ID NO: 2507243 - DNA, 22 bp, Homo sapiens
agatacttggggggctgaggtg

SEQ ID NO: 2507244 - DNA, 11 bp, Homo sapiens
agatagaaata

SEQ ID NO: 2507245 - DNA, 14 bp, Homo sapiens
agatagaagaactg

SEQ ID NO: 2507246 - DNA, 14 bp, Homo sapiens
agatagagagctat

SEQ ID NO: 2507247 - DNA, 16 bp, Homo sapiens
agatagcattgtgaac

SEQ ID NO: 2507248 - DNA, 16 bp, Homo sapiens
agataggctctgcaca

SEQ ID NO: 2507249 - DNA, 14 bp, Homo sapiens
agatagtacataaa

SEQ ID NO: 2507250 - DNA, 17 bp, Homo sapiens
agatagtagcatacatt

SEQ ID NO: 2507251 - DNA, 22 bp, Homo sapiens
agatagtatctagcaatcacaa

SEQ ID NO: 2507252 - DNA, 15 bp, Homo sapiens
agatagttactatat

SEQ ID NO: 2507253 - DNA, 15 bp, Homo sapiens
agatataaaagactg

SEQ ID NO: 2507254 - DNA, 20 bp, Homo sapiens
agatataactattgcccagg

SEQ ID NO: 2507255 - DNA, 20 bp, Homo sapiens
agatatattaagtgactgtt

SEQ ID NO: 2507256 - DNA, 15 bp, Homo sapiens
agatatatttttcac

SEQ ID NO: 2507257 - DNA, 21 bp, Homo sapiens
agatatctgagggaggaggcc

SEQ ID NO: 2507258 - DNA, 16 bp, Homo sapiens
agatatgatatgtaaa

SEQ ID NO: 2507259 - DNA, 17 bp, Homo sapiens
agatatgatatgtaaac

SEQ ID NO: 2507260 - DNA, 12 bp, Homo sapiens
agatattcaagt

SEQ ID NO: 2507261 - DNA, 18 bp, Homo sapiens
agatattgtgaagtacat

SEQ ID NO: 2507262 - DNA, 23 bp, Homo sapiens
agatatttacatgaattgcattt

SEQ ID NO: 2507263 - DNA, 18 bp, Homo sapiens
agatattttaaaatgaga

SEQ ID NO: 2507264 - DNA, 22 bp, Homo sapiens
agatattttgctttgtgatttt

SEQ ID NO: 2507265 - DNA, 17 bp, Homo sapiens
agatatttttatcttta

SEQ ID NO: 2507266 - DNA, 20 bp, Homo sapiens
agatatttttatctttatat

SEQ ID NO: 2507267 - DNA, 21 bp, Homo sapiens
agatatttttatctttatatg

SEQ ID NO: 2507268 - DNA, 19 bp, Homo sapiens
agatattttttcagaaata

SEQ ID NO: 2507269 - DNA, 18 bp, Homo sapiens
agatcaaaaggttaataa

SEQ ID NO: 2507270 - DNA, 12 bp, Homo sapiens
agatcaaaataa

SEQ ID NO: 2507271 - DNA, 16 bp, Homo sapiens
agatcaaaataaaaag

SEQ ID NO: 2507272 - DNA, 15 bp, Homo sapiens
agatcaaatacttta

SEQ ID NO: 2507273 - DNA, 16 bp, Homo sapiens
agatcaaatactttaa

SEQ ID NO: 2507274 - DNA, 14 bp, Homo sapiens
agatcaaccccttc

SEQ ID NO: 2507275 - DNA, 21 bp, Homo sapiens
agatcaaccccttcgctcctg

SEQ ID NO: 2507276 - DNA, 15 bp, Homo sapiens
agatcaagagatcaa

SEQ ID NO: 2507277 - DNA, 14 bp, Homo sapiens
agatcaagctgtga

SEQ ID NO: 2507278 - DNA, 21 bp, Homo sapiens
agatcaatttgtaattgctta

SEQ ID NO: 2507279 - DNA, 16 bp, Homo sapiens
agatcaccagcccggc

SEQ ID NO: 2507280 - DNA, 21 bp, Homo sapiens
agatcaccagcccggcctgct

SEQ ID NO: 2507281 - DNA, 17 bp, Homo sapiens
agatcacgccactgcac

SEQ ID NO: 2507282 - DNA, 18 bp, Homo sapiens
agatcacgccactgcact

SEQ ID NO: 2507283 - DNA, 14 bp, Homo sapiens
agatcactactgca

SEQ ID NO: 2507284 - DNA, 23 bp, Homo sapiens
agatcactttctcagttttcata

SEQ ID NO: 2507285 - DNA, 13 bp, Homo sapiens
agatcagcctggg

SEQ ID NO: 2507286 - DNA, 18 bp, Homo sapiens
agatcatatacgtgaaaa

SEQ ID NO: 2507287 - DNA, 17 bp, Homo sapiens
agatccacacacagagg

SEQ ID NO: 2507288 - DNA, 14 bp, Homo sapiens
agatcccccagact

SEQ ID NO: 2507289 - DNA, 11 bp, Homo sapiens
agatcccctca

SEQ ID NO: 2507290 - DNA, 13 bp, Homo sapiens
agatcctaaaaca

SEQ ID NO: 2507291 - DNA, 16 bp, Homo sapiens
agatcctaaaacaaaa

SEQ ID NO: 2507292 - DNA, 14 bp, Homo sapiens
agatccttgtttca

SEQ ID NO: 2507293 - DNA, 20 bp, Homo sapiens
agatccttgtttcaaacaca

SEQ ID NO: 2507294 - DNA, 20 bp, Homo sapiens
agatcctttaaatccttcca

SEQ ID NO: 2507295 - DNA, 15 bp, Homo sapiens
agatcgcccccacct

SEQ ID NO: 2507296 - DNA, 16 bp, Homo sapiens
agatcgttctctgcct

SEQ ID NO: 2507297 - DNA, 19 bp, Homo sapiens
agatctaggtgaggattga

SEQ ID NO: 2507298 - DNA, 12 bp, Homo sapiens
agatctggtttt

SEQ ID NO: 2507299 - DNA, 13 bp, Homo sapiens
agatctgtgcccc

SEQ ID NO: 2507300 - DNA, 14 bp, Homo sapiens
agatcttaaatttt

SEQ ID NO: 2507301 - DNA, 17 bp, Homo sapiens
agatgaaagaggaggtt

SEQ ID NO: 2507302 - DNA, 20 bp, Homo sapiens
agatgaaatcttacagctgg

SEQ ID NO: 2507303 - DNA, 18 bp, Homo sapiens
agatgaagcaaacacatt

SEQ ID NO: 2507304 - DNA, 16 bp, Homo sapiens
agatgaatacaaacaa

SEQ ID NO: 2507305 - DNA, 15 bp, Homo sapiens
agatgactgagtcct

SEQ ID NO: 2507306 - DNA, 13 bp, Homo sapiens
agatgagcttttc

SEQ ID NO: 2507307 - DNA, 16 bp, Homo sapiens
agatgagcttttctag

SEQ ID NO: 2507308 - DNA, 14 bp, Homo sapiens
agatgagtgagcat

SEQ ID NO: 2507309 - DNA, 16 bp, Homo sapiens
agatgatctactcaga

SEQ ID NO: 2507310 - DNA, 17 bp, Homo sapiens
agatgatgggggagggg

SEQ ID NO: 2507311 - DNA, 14 bp, Homo sapiens
agatgcaaagaggc

SEQ ID NO: 2507312 - DNA, 13 bp, Homo sapiens
agatgcaagatat

SEQ ID NO: 2507313 - DNA, 14 bp, Homo sapiens
agatgcagagagcc

SEQ ID NO: 2507314 - DNA, 19 bp, Homo sapiens
agatgcagagagccatttt

SEQ ID NO: 2507315 - DNA, 15 bp, Homo sapiens
agatgcagctggaaa

SEQ ID NO: 2507316 - DNA, 22 bp, Homo sapiens
agatgcccagagggcccaggca

SEQ ID NO: 2507317 - DNA, 17 bp, Homo sapiens
agatgccccagagctgt

SEQ ID NO: 2507318 - DNA, 11 bp, Homo sapiens
agatgccctga

SEQ ID NO: 2507319 - DNA, 17 bp, Homo sapiens
agatgctctatcttgct

SEQ ID NO: 2507320 - DNA, 15 bp, Homo sapiens
agatgctcttctgtg

SEQ ID NO: 2507321 - DNA, 13 bp, Homo sapiens
agatgctctttta

SEQ ID NO: 2507322 - DNA, 15 bp, Homo sapiens
agatgctgatgttca

SEQ ID NO: 2507323 - DNA, 20 bp, Homo sapiens
agatgctgatgttcagtgta

SEQ ID NO: 2507324 - DNA, 21 bp, Homo sapiens
agatgctgatgttcagtgtaa

SEQ ID NO: 2507325 - DNA, 13 bp, Homo sapiens
agatgctgggttg

SEQ ID NO: 2507326 - DNA, 18 bp, Homo sapiens
agatgctgggttggtgca

SEQ ID NO: 2507327 - DNA, 18 bp, Homo sapiens
agatgcttctcactgcca

SEQ ID NO: 2507328 - DNA, 15 bp, Homo sapiens
agatgcttctgggag

SEQ ID NO: 2507329 - DNA, 22 bp, Homo sapiens
agatgcttttctgtctctgcct

SEQ ID NO: 2507330 - DNA, 20 bp, Homo sapiens
agatggaaccgcaggaagct

SEQ ID NO: 2507331 - DNA, 20 bp, Homo sapiens
agatggattctcagatattt

SEQ ID NO: 2507332 - DNA, 16 bp, Homo sapiens
agatggcaaatgacca

SEQ ID NO: 2507333 - DNA, 17 bp, Homo sapiens
agatggcatcctgtgaa

SEQ ID NO: 2507334 - DNA, 22 bp, Homo sapiens
agatggctgactttgctctttc

SEQ ID NO: 2507335 - DNA, 19 bp, Homo sapiens
agatggctgtgcctctgcc

SEQ ID NO: 2507336 - DNA, 14 bp, Homo sapiens
agatgggaatgaag

SEQ ID NO: 2507337 - DNA, 21 bp, Homo sapiens
agatgggagaatcacttgaac

SEQ ID NO: 2507338 - DNA, 23 bp, Homo sapiens
agatgggagctcctctcctggag

SEQ ID NO: 2507339 - DNA, 16 bp, Homo sapiens
agatgggatgcttgcc

SEQ ID NO: 2507340 - DNA, 22 bp, Homo sapiens
agatgggcatggggtgggcctc

SEQ ID NO: 2507341 - DNA, 17 bp, Homo sapiens
agatgggtctggctgag

SEQ ID NO: 2507342 - DNA, 20 bp, Homo sapiens
agatgggtgcttggaggaag

SEQ ID NO: 2507343 - DNA, 19 bp, Homo sapiens
agatggtatatttggtact

SEQ ID NO: 2507344 - DNA, 15 bp, Homo sapiens
agatggtgaaattta

SEQ ID NO: 2507345 - DNA, 17 bp, Homo sapiens
agatgtaaaaggtatta

SEQ ID NO: 2507346 - DNA, 14 bp, Homo sapiens
agatgtagaggaga

SEQ ID NO: 2507347 - DNA, 22 bp, Homo sapiens
agatgtctctggcgtgtgggta

SEQ ID NO: 2507348 - DNA, 19 bp, Homo sapiens
agatgtcttcgtacagttc

SEQ ID NO: 2507349 - DNA, 17 bp, Homo sapiens
agatgtcttctgcctgt

SEQ ID NO: 2507350 - DNA, 19 bp, Homo sapiens
agatgtcttctgcctgtta

SEQ ID NO: 2507351 - DNA, 16 bp, Homo sapiens
agatgtgcaaatgcaa

SEQ ID NO: 2507352 - DNA, 21 bp, Homo sapiens
agatgtggccttccatttata

SEQ ID NO: 2507353 - DNA, 18 bp, Homo sapiens
agatgttcagtcattttt

SEQ ID NO: 2507354 - DNA, 17 bp, Homo sapiens
agatgttctaagtcttt

SEQ ID NO: 2507355 - DNA, 22 bp, Homo sapiens
agatgttctaagtctttccatt

SEQ ID NO: 2507356 - DNA, 17 bp, Homo sapiens
agatgtttgtcagatat

SEQ ID NO: 2507357 - DNA, 24 bp, Homo sapiens
agatgtttgtcagatatgatatgt

SEQ ID NO: 2507358 - DNA, 11 bp, Homo sapiens
agatgttttag

SEQ ID NO: 2507359 - DNA, 23 bp, Homo sapiens
agatgttttagagttaacaatga

SEQ ID NO: 2507360 - DNA, 18 bp, Homo sapiens
agatgtttttaaaagttt

SEQ ID NO: 2507361 - DNA, 15 bp, Homo sapiens
agattagaagctgaa

SEQ ID NO: 2507362 - DNA, 18 bp, Homo sapiens
agattagagggaggtgtt

SEQ ID NO: 2507363 - DNA, 15 bp, Homo sapiens
agattagatctttta

SEQ ID NO: 2507364 - DNA, 14 bp, Homo sapiens
agattataacttgt

SEQ ID NO: 2507365 - DNA, 13 bp, Homo sapiens
agattcacactgt

SEQ ID NO: 2507366 - DNA, 21 bp, Homo sapiens
agattcattatttttccactt

SEQ ID NO: 2507367 - DNA, 12 bp, Homo sapiens
agattcattttt

SEQ ID NO: 2507368 - DNA, 17 bp, Homo sapiens
agattcatttttaatca

SEQ ID NO: 2507369 - DNA, 22 bp, Homo sapiens
agattccccattgcctcctcct

SEQ ID NO: 2507370 - DNA, 23 bp, Homo sapiens
agattccccattgcctcctcctt

SEQ ID NO: 2507371 - DNA, 15 bp, Homo sapiens
agattctcctgtgct

SEQ ID NO: 2507372 - DNA, 12 bp, Homo sapiens
agattctttccc

SEQ ID NO: 2507373 - DNA, 16 bp, Homo sapiens
agattctttcctgagg

SEQ ID NO: 2507374 - DNA, 21 bp, Homo sapiens
agattgcaacaggctgggctt

SEQ ID NO: 2507375 - DNA, 19 bp, Homo sapiens
agattgcatgtgactctga

SEQ ID NO: 2507376 - DNA, 22 bp, Homo sapiens
agcatctccctcactgaaacca

SEQ ID NO: 2507377 - DNA, 19 bp, Homo sapiens
agcatctcttgaggccagg

SEQ ID NO: 2507378 - DNA, 13 bp, Homo sapiens
agcatctgctaat

SEQ ID NO: 2507379 - DNA, 22 bp, Homo sapiens
agcatcttccagaagtgtgatt

SEQ ID NO: 2507380 - DNA, 12 bp, Homo sapiens
agcatcttctgg

SEQ ID NO: 2507381 - DNA, 15 bp, Homo sapiens
agcatcttctggagt

SEQ ID NO: 2507382 - DNA, 22 bp, Homo sapiens
agcatgaatggtatggaactct

SEQ ID NO: 2507383 - DNA, 22 bp, Homo sapiens
agcatgacaagccccaggcagg

SEQ ID NO: 2507384 - DNA, 12 bp, Homo sapiens
agcatgcctgga

SEQ ID NO: 2507385 - DNA, 17 bp, Homo sapiens
agcatgtggcatgttca

SEQ ID NO: 2507386 - DNA, 16 bp, Homo sapiens
agcatgtgttgaaaaa

SEQ ID NO: 2507387 - DNA, 16 bp, Homo sapiens
agcatgttgagccagg

SEQ ID NO: 2507388 - DNA, 20 bp, Homo sapiens
agcatgttgagccaggcctg

SEQ ID NO: 2507389 - DNA, 15 bp, Homo sapiens
agcatgtttgctgaa

SEQ ID NO: 2507390 - DNA, 17 bp, Homo sapiens
agcatgtttgctgaaca

SEQ ID NO: 2507391 - DNA, 20 bp, Homo sapiens
agcatgtttgctgaacacct

SEQ ID NO: 2507392 - DNA, 18 bp, Homo sapiens
agcattaacttctctgga

SEQ ID NO: 2507393 - DNA, 17 bp, Homo sapiens
agcattaagaacacttt

SEQ ID NO: 2507394 - DNA, 17 bp, Homo sapiens
agcattacaaattgctt

SEQ ID NO: 2507395 - DNA, 19 bp, Homo sapiens
agcattacgtgagccaggt

SEQ ID NO: 2507396 - DNA, 16 bp, Homo sapiens
agcattcagagagcag

SEQ ID NO: 2507397 - DNA, 17 bp, Homo sapiens
agcattccttctttgat

SEQ ID NO: 2507398 - DNA, 23 bp, Homo sapiens
agcattccttctttgataatgtt

SEQ ID NO: 2507399 - DNA, 24 bp, Homo sapiens
agcattccttctttgataatgtta

SEQ ID NO: 2507400 - DNA, 15 bp, Homo sapiens
agcattgctggttct

SEQ ID NO: 2507401 - DNA, 11 bp, Homo sapiens
agcattgcttt

SEQ ID NO: 2507402 - DNA, 21 bp, Homo sapiens
agcattgtgaactgacaggca

SEQ ID NO: 2507403 - DNA, 17 bp, Homo sapiens
agcattgtttgcttatt

SEQ ID NO: 2507404 - DNA, 22 bp, Homo sapiens
agcattgtttgcttattgttcc

SEQ ID NO: 2507405 - DNA, 17 bp, Homo sapiens
agcatttaatgtagcca

SEQ ID NO: 2507406 - DNA, 15 bp, Homo sapiens
agcatttactttgaa

SEQ ID NO: 2507407 - DNA, 13 bp, Homo sapiens
agcatttatgttt

SEQ ID NO: 2507408 - DNA, 13 bp, Homo sapiens
agcatttcattct

SEQ ID NO: 2507409 - DNA, 18 bp, Homo sapiens
agcatttccaacaccaca

SEQ ID NO: 2507410 - DNA, 21 bp, Homo sapiens
agcatttccaacaccacagac

SEQ ID NO: 2507411 - DNA, 13 bp, Homo sapiens
agcattttataaa

SEQ ID NO: 2507412 - DNA, 16 bp, Homo sapiens
agcatttttgatttat

SEQ ID NO: 2507413 - DNA, 19 bp, Homo sapiens
agccaaacccatgaggcaa

SEQ ID NO: 2507414 - DNA, 15 bp, Homo sapiens
agccaaactctgcca

SEQ ID NO: 2507415 - DNA, 15 bp, Homo sapiens
agccaaagataatct

SEQ ID NO: 2507416 - DNA, 16 bp, Homo sapiens
agccaaagctaggcct

SEQ ID NO: 2507417 - DNA, 21 bp, Homo sapiens
agccaacaggtggcaggacca

SEQ ID NO: 2507418 - DNA, 14 bp, Homo sapiens
agccaacccctgtg

SEQ ID NO: 2507419 - DNA, 21 bp, Homo sapiens
agccaacgacaaagccaaact

SEQ ID NO: 2507420 - DNA, 14 bp, Homo sapiens
agccaactgctgct

SEQ ID NO: 2507421 - DNA, 14 bp, Homo sapiens
agccaacttggctt

SEQ ID NO: 2507422 - DNA, 19 bp, Homo sapiens
agccaagatcgcgccactg

SEQ ID NO: 2507423 - DNA, 13 bp, Homo sapiens
agccaagcacagt

SEQ ID NO: 2507424 - DNA, 14 bp, Homo sapiens
agccaagcacagtg

SEQ ID NO: 2507425 - DNA, 16 bp, Homo sapiens
agccaagcacagtggt

SEQ ID NO: 2507426 - DNA, 22 bp, Homo sapiens
agccaagggttcagagactcag

SEQ ID NO: 2507427 - DNA, 21 bp, Homo sapiens
agccaagtcagctttgccttc

SEQ ID NO: 2507428 - DNA, 14 bp, Homo sapiens
agccaatatttttc

SEQ ID NO: 2507429 - DNA, 13 bp, Homo sapiens
agccaatcccctc

SEQ ID NO: 2507430 - DNA, 15 bp, Homo sapiens
agccaatcccctcct

SEQ ID NO: 2507431 - DNA, 18 bp, Homo sapiens
agccaatcccctccttgg

SEQ ID NO: 2507432 - DNA, 17 bp, Homo sapiens
agccacacaaacgttta

SEQ ID NO: 2507433 - DNA, 15 bp, Homo sapiens
agccacacacacaga

SEQ ID NO: 2507434 - DNA, 17 bp, Homo sapiens
agccacacacacagaaa

SEQ ID NO: 2507435 - DNA, 22 bp, Homo sapiens
agccacacacacagaaaatata

SEQ ID NO: 2507436 - DNA, 10 bp, Homo sapiens
agccacagaa

SEQ ID NO: 2507437 - DNA, 22 bp, Homo sapiens
agccacagaagccaggagcaaa

SEQ ID NO: 2507438 - DNA, 23 bp, Homo sapiens
agccacagaagccaggagcaaat

SEQ ID NO: 2507439 - DNA, 23 bp, Homo sapiens
agcaatttaatattttgcacagt

SEQ ID NO: 2507440 - DNA, 20 bp, Homo sapiens
agcaatttatacaatatcat

SEQ ID NO: 2507441 - DNA, 21 bp, Homo sapiens
agcaatttcgccgttgaagag

SEQ ID NO: 2507442 - DNA, 13 bp, Homo sapiens
agcacagaaggag

SEQ ID NO: 2507443 - DNA, 12 bp, Homo sapiens
agcacagaccct

SEQ ID NO: 2507444 - DNA, 18 bp, Homo sapiens
agcacagaccctgccctg

SEQ ID NO: 2507445 - DNA, 16 bp, Homo sapiens
agcacagcttcatttc

SEQ ID NO: 2507446 - DNA, 21 bp, Homo sapiens
agcacagcttcatttcctgtg

SEQ ID NO: 2507447 - DNA, 15 bp, Homo sapiens
agcacaggtgggctt

SEQ ID NO: 2507448 - DNA, 14 bp, Homo sapiens
agcacagtgcctgc

SEQ ID NO: 2507449 - DNA, 15 bp, Homo sapiens
agcacagtgcctgca

SEQ ID NO: 2507450 - DNA, 16 bp, Homo sapiens
agcacagtggtggcag

SEQ ID NO: 2507451 - DNA, 20 bp, Homo sapiens
agcacagtggtggcagggcc

SEQ ID NO: 2507452 - DNA, 16 bp, Homo sapiens
agcacagtgttaaatg

SEQ ID NO: 2507453 - DNA, 22 bp, Homo sapiens
agcaccaaaagcttaccaaggg

SEQ ID NO: 2507454 - DNA, 16 bp, Homo sapiens
agcaccaaaataagaa

SEQ ID NO: 2507455 - DNA, 20 bp, Homo sapiens
agcaccaaaataagaaaaga

SEQ ID NO: 2507456 - DNA, 23 bp, Homo sapiens
agcaccaccctagtcccttcccc

SEQ ID NO: 2507457 - DNA, 18 bp, Homo sapiens
agcaccagcttctccagg

SEQ ID NO: 2507458 - DNA, 14 bp, Homo sapiens
agcacccctctctg

SEQ ID NO: 2507459 - DNA, 15 bp, Homo sapiens
agcacccctctctgc

SEQ ID NO: 2507460 - DNA, 12 bp, Homo sapiens
agcaccccttcc

SEQ ID NO: 2507461 - DNA, 14 bp, Homo sapiens
agcacctacagtgt

SEQ ID NO: 2507462 - DNA, 15 bp, Homo sapiens
agcacctacagtgta

SEQ ID NO: 2507463 - DNA, 17 bp, Homo sapiens
agcacctagcctcgctc

SEQ ID NO: 2507464 - DNA, 13 bp, Homo sapiens
agcacctcctgcc

SEQ ID NO: 2507465 - DNA, 14 bp, Homo sapiens
agcacctcctgcct

SEQ ID NO: 2507466 - DNA, 22 bp, Homo sapiens
agcaccttagacagtccctgcc

SEQ ID NO: 2507467 - DNA, 20 bp, Homo sapiens
agcaccttcctcacttccat

SEQ ID NO: 2507468 - DNA, 18 bp, Homo sapiens
agcacgaaatgttatttt

SEQ ID NO: 2507469 - DNA, 13 bp, Homo sapiens
agcacgatttctg

SEQ ID NO: 2507470 - DNA, 19 bp, Homo sapiens
agcacgatttctgtttaga

SEQ ID NO: 2507471 - DNA, 17 bp, Homo sapiens
agcacggactcttactg

SEQ ID NO: 2507472 - DNA, 13 bp, Homo sapiens
agcactaaagcag

SEQ ID NO: 2507473 - DNA, 14 bp, Homo sapiens
agcactaaagcagt

SEQ ID NO: 2507474 - DNA, 23 bp, Homo sapiens
agcactaaagcagtggacaccag

SEQ ID NO: 2507475 - DNA, 14 bp, Homo sapiens
agcactcacacagg

SEQ ID NO: 2507476 - DNA, 13 bp, Homo sapiens
agcactgacctgt

SEQ ID NO: 2507477 - DNA, 22 bp, Homo sapiens
agcactgacctgtcatgccccc

SEQ ID NO: 2507478 - DNA, 16 bp, Homo sapiens
agcactgacttctaag

SEQ ID NO: 2507479 - DNA, 17 bp, Homo sapiens
agcactgacttctaagt

SEQ ID NO: 2507480 - DNA, 19 bp, Homo sapiens
agcactgacttctaagtaa

SEQ ID NO: 2507481 - DNA, 16 bp, Homo sapiens
agcactgagcaaagca

SEQ ID NO: 2507482 - DNA, 22 bp, Homo sapiens
agcactgctaggcgagtgccag

SEQ ID NO: 2507483 - DNA, 17 bp, Homo sapiens
agcactgcttgaggaaa

SEQ ID NO: 2507484 - DNA, 19 bp, Homo sapiens
agcactggagtgcagggag

SEQ ID NO: 2507485 - DNA, 13 bp, Homo sapiens
agcactggctctc

SEQ ID NO: 2507486 - DNA, 19 bp, Homo sapiens
agcactggctctctccagg

SEQ ID NO: 2507487 - DNA, 19 bp, Homo sapiens
agcactgggttgcagggga

SEQ ID NO: 2507488 - DNA, 14 bp, Homo sapiens
agcactgtctcagt

SEQ ID NO: 2507489 - DNA, 23 bp, Homo sapiens
agcactgtgctaataacagtgca

SEQ ID NO: 2507490 - DNA, 14 bp, Homo sapiens
agcactgtgctcag

SEQ ID NO: 2507491 - DNA, 15 bp, Homo sapiens
agcactgtgctcagg

SEQ ID NO: 2507492 - DNA, 20 bp, Homo sapiens
agcactgttccagcctgccc

SEQ ID NO: 2507493 - DNA, 22 bp, Homo sapiens
agcacttgcaaccgtctgttat

SEQ ID NO: 2507494 - DNA, 20 bp, Homo sapiens
agcacttggactcttgctct

SEQ ID NO: 2507495 - DNA, 12 bp, Homo sapiens
agcacttgtata

SEQ ID NO: 2507496 - DNA, 15 bp, Homo sapiens
agcactttgggaggc

SEQ ID NO: 2507497 - DNA, 20 bp, Homo sapiens
agcactttgggaggccaagg

SEQ ID NO: 2507498 - DNA, 22 bp, Homo sapiens
agcactttgggaggccaaggtg

SEQ ID NO: 2507499 - DNA, 23 bp, Homo sapiens
agcactttgggaggccaaggtgg

SEQ ID NO: 2507500 - DNA, 13 bp, Homo sapiens
agcagaaatacat

SEQ ID NO: 2507501 - DNA, 12 bp, Homo sapiens
agcagaaatgcc

SEQ ID NO: 2507502 - DNA, 13 bp, Homo sapiens
agcagaaatgcct

SEQ ID NO: 2507503 - DNA, 14 bp, Homo sapiens
agcagaacagtgat

SEQ ID NO: 2507504 - DNA, 18 bp, Homo sapiens
agcagagaccatccctga

SEQ ID NO: 2507505 - DNA, 19 bp, Homo sapiens
agcagagaccatccctgaa

SEQ ID NO: 2507506 - DNA, 14 bp, Homo sapiens
agcagagcaggggc

SEQ ID NO: 2507507 - DNA, 23 bp, Homo sapiens
agcagaggtggccagagctggga

SEQ ID NO: 2507508 - DNA, 22 bp, Homo sapiens
agcagatacatatgagtgtgga

SEQ ID NO: 2507509 - DNA, 18 bp, Homo sapiens
agcagatttaacaattcc

SEQ ID NO: 2507510 - DNA, 22 bp, Homo sapiens
agcagattttaattttgaataa

SEQ ID NO: 2507511 - DNA, 15 bp, Homo sapiens
acagaagccaggagc

SEQ ID NO: 2507512 - DNA, 16 bp, Homo sapiens
acagaagccaggagca

SEQ ID NO: 2507513 - DNA, 21 bp, Homo sapiens
acagaagctgaagtgcatcca

SEQ ID NO: 2507514 - DNA, 13 bp, Homo sapiens
acagaagcttcag

SEQ ID NO: 2507515 - DNA, 14 bp, Homo sapiens
acagaagcttcaga

SEQ ID NO: 2507516 - DNA, 18 bp, Homo sapiens
acagaagcttcagaagtt

SEQ ID NO: 2507517 - DNA, 16 bp, Homo sapiens
acagaagtcatgaagc

SEQ ID NO: 2507518 - DNA, 18 bp, Homo sapiens
acagaagtcatgaagccc

SEQ ID NO: 2507519 - DNA, 15 bp, Homo sapiens
acagaataatgaatg

SEQ ID NO: 2507520 - DNA, 15 bp, Homo sapiens
acagaattctgctac

SEQ ID NO: 2507521 - DNA, 12 bp, Homo sapiens
acagacacacac

SEQ ID NO: 2507522 - DNA, 17 bp, Homo sapiens
acagacacacacacgca

SEQ ID NO: 2507523 - DNA, 18 bp, Homo sapiens
acagacacacacacgcac

SEQ ID NO: 2507524 - DNA, 22 bp, Homo sapiens
acagacacacacacgcacgcac

SEQ ID NO: 2507525 - DNA, 23 bp, Homo sapiens
acagacacacacacgcacgcaca

SEQ ID NO: 2507526 - DNA, 14 bp, Homo sapiens
acagacacacgcac

SEQ ID NO: 2507527 - DNA, 17 bp, Homo sapiens
acagacacaggcccggc

SEQ ID NO: 2507528 - DNA, 15 bp, Homo sapiens
acagacatctctgca

SEQ ID NO: 2507529 - DNA, 14 bp, Homo sapiens
acagaccctgccct

SEQ ID NO: 2507530 - DNA, 15 bp, Homo sapiens
acagaccctgccctg

SEQ ID NO: 2507531 - DNA, 20 bp, Homo sapiens
acagactcaaatgctcagac

SEQ ID NO: 2507532 - DNA, 17 bp, Homo sapiens
acagactcctgaggaca

SEQ ID NO: 2507533 - DNA, 21 bp, Homo sapiens
acagactggaagcacagcttc

SEQ ID NO: 2507534 - DNA, 11 bp, Homo sapiens
acagagaaagt

SEQ ID NO: 2507535 - DNA, 19 bp, Homo sapiens
acagagacattcctccgag

SEQ ID NO: 2507536 - DNA, 16 bp, Homo sapiens
acagagaggagaaaca

SEQ ID NO: 2507537 - DNA, 14 bp, Homo sapiens
acagagcccacgcc

SEQ ID NO: 2507538 - DNA, 19 bp, Homo sapiens
acagagcccacgcccccac

SEQ ID NO: 2507539 - DNA, 10 bp, Homo sapiens
acagagctgg

SEQ ID NO: 2507540 - DNA, 16 bp, Homo sapiens
acagaggaagagcagg

SEQ ID NO: 2507541 - DNA, 17 bp, Homo sapiens
acagaggagagtcccag

SEQ ID NO: 2507542 - DNA, 13 bp, Homo sapiens
acagaggcagccc

SEQ ID NO: 2507543 - DNA, 17 bp, Homo sapiens
acagaggccatgggcct

SEQ ID NO: 2507544 - DNA, 21 bp, Homo sapiens
acagaggccatgggcctcctg

SEQ ID NO: 2507545 - DNA, 13 bp, Homo sapiens
acagaggcctgcc

SEQ ID NO: 2507546 - DNA, 15 bp, Homo sapiens
acagagggaagaaaa

SEQ ID NO: 2507547 - DNA, 14 bp, Homo sapiens
acagagggggtggc

SEQ ID NO: 2507548 - DNA, 19 bp, Homo sapiens
acagagggggtggcctccc

SEQ ID NO: 2507549 - DNA, 22 bp, Homo sapiens
acagagggggtggcctcccaac

SEQ ID NO: 2507550 - DNA, 18 bp, Homo sapiens
acagagtggtctttctgg

SEQ ID NO: 2507551 - DNA, 21 bp, Homo sapiens
acagagtggtctttctggaga

SEQ ID NO: 2507552 - DNA, 15 bp, Homo sapiens
acagagttgttacat

SEQ ID NO: 2507553 - DNA, 18 bp, Homo sapiens
acagagttgttacatttt

SEQ ID NO: 2507554 - DNA, 19 bp, Homo sapiens
acagagttgttacattttt

SEQ ID NO: 2507555 - DNA, 21 bp, Homo sapiens
acagagttgttacatttttaa

SEQ ID NO: 2507556 - DNA, 22 bp, Homo sapiens
acagagttgttacatttttaag

SEQ ID NO: 2507557 - DNA, 18 bp, Homo sapiens
acagagttttcactctta

SEQ ID NO: 2507558 - DNA, 13 bp, Homo sapiens
acagataagcaag

SEQ ID NO: 2507559 - DNA, 15 bp, Homo sapiens
acagataagcaagag

SEQ ID NO: 2507560 - DNA, 21 bp, Homo sapiens
acagatactggaagttttgca

SEQ ID NO: 2507561 - DNA, 13 bp, Homo sapiens
acagatagttgtg

SEQ ID NO: 2507562 - DNA, 17 bp, Homo sapiens
acagatataaatggctg

SEQ ID NO: 2507563 - DNA, 16 bp, Homo sapiens
acagatcaagctgtga

SEQ ID NO: 2507564 - DNA, 17 bp, Homo sapiens
acagatgcaatgtgcta

SEQ ID NO: 2507565 - DNA, 20 bp, Homo sapiens
acagatgcaatgtgctactg

SEQ ID NO: 2507566 - DNA, 14 bp, Homo sapiens
acagatgccccaga

SEQ ID NO: 2507567 - DNA, 21 bp, Homo sapiens
acagatgccccagagctgttt

SEQ ID NO: 2507568 - DNA, 12 bp, Homo sapiens
acagatgcctcc

SEQ ID NO: 2507569 - DNA, 22 bp, Homo sapiens
acagatggcactttgaaggggc

SEQ ID NO: 2507570 - DNA, 23 bp, Homo sapiens
acagatgggtgcttggaggaagg

SEQ ID NO: 2507571 - DNA, 20 bp, Homo sapiens
acagatgtcagccgagccgg

SEQ ID NO: 2507572 - DNA, 13 bp, Homo sapiens
acagatttgtgaa

SEQ ID NO: 2507573 - DNA, 14 bp, Homo sapiens
acagatttgtgaac

SEQ ID NO: 2507574 - DNA, 15 bp, Homo sapiens
acagatttgtgaact

SEQ ID NO: 2507575 - DNA, 17 bp, Homo sapiens
acagatttttacaaatg

SEQ ID NO: 2507576 - DNA, 18 bp, Homo sapiens
acagcaaaactccatctc

SEQ ID NO: 2507577 - DNA, 16 bp, Homo sapiens
acagcaaggagattta

SEQ ID NO: 2507578 - DNA, 12 bp, Homo sapiens
acagcaagtcag

SEQ ID NO: 2507579 - DNA, 15 bp, Homo sapiens
acagcacagagaaga

SEQ ID NO: 2507580 - DNA, 22 bp, Homo sapiens
acagcacagagaagacaaaatt

SEQ ID NO: 2507581 - DNA, 13 bp, Homo sapiens
acagcactactct

SEQ ID NO: 2507582 - DNA, 18 bp, Homo sapiens
acagcagcttcaccagag

SEQ ID NO: 2507583 - DNA, 11 bp, Homo sapiens
acagcaggtgt

SEQ ID NO: 2507584 - DNA, 22 bp, Homo sapiens
acagcataacaaggtccaagat

SEQ ID NO: 2507585 - DNA, 16 bp, Homo sapiens
acagcatcattttgca

SEQ ID NO: 2507586 - DNA, 20 bp, Homo sapiens
acagcatcattttgcattca

SEQ ID NO: 2507587 - DNA, 21 bp, Homo sapiens
acagcatcattttgcattcaa

SEQ ID NO: 2507588 - DNA, 20 bp, Homo sapiens
acagcatgagaggctctgtg

SEQ ID NO: 2507589 - DNA, 11 bp, Homo sapiens
acagcattgct

SEQ ID NO: 2507590 - DNA, 12 bp, Homo sapiens
acagcattgctt

SEQ ID NO: 2507591 - DNA, 23 bp, Homo sapiens
acagccaaatgcatggtgcagtt

SEQ ID NO: 2507592 - DNA, 13 bp, Homo sapiens
acagccacacaca

SEQ ID NO: 2507593 - DNA, 14 bp, Homo sapiens
acagccacacacac

SEQ ID NO: 2507594 - DNA, 15 bp, Homo sapiens
acagccacacacaca

SEQ ID NO: 2507595 - DNA, 16 bp, Homo sapiens
acagccaggtgccttg

SEQ ID NO: 2507596 - DNA, 15 bp, Homo sapiens
acagccatcccagcc

SEQ ID NO: 2507597 - DNA, 19 bp, Homo sapiens
acagcccaaagaaggaaaa

SEQ ID NO: 2507598 - DNA, 15 bp, Homo sapiens
acagcccgggctctg

SEQ ID NO: 2507599 - DNA, 20 bp, Homo sapiens
acagcccgggctctgcctcc

SEQ ID NO: 2507600 - DNA, 12 bp, Homo sapiens
acagccctgtca

SEQ ID NO: 2507601 - DNA, 13 bp, Homo sapiens
acagccctgtcag

SEQ ID NO: 2507602 - DNA, 13 bp, Homo sapiens
acagccgcagcct

SEQ ID NO: 2507603 - DNA, 20 bp, Homo sapiens
acagccgcagcctccctctg

SEQ ID NO: 2507604 - DNA, 14 bp, Homo sapiens
acagccgctcctgt

SEQ ID NO: 2507605 - DNA, 18 bp, Homo sapiens
acagccgctcctgtctgc

SEQ ID NO: 2507606 - DNA, 15 bp, Homo sapiens
acagcctcccacccc

SEQ ID NO: 2507607 - DNA, 16 bp, Homo sapiens
acagcctcccaccccc

SEQ ID NO: 2507608 - DNA, 22 bp, Homo sapiens
acagcctcctctgtctgccctt

SEQ ID NO: 2507609 - DNA, 18 bp, Homo sapiens
acagcgagactccgtctc

SEQ ID NO: 2507610 - DNA, 22 bp, Homo sapiens
acagcgagaggcagagaaagaa

SEQ ID NO: 2507611 - DNA, 18 bp, Homo sapiens
acagctaacacacagctc

SEQ ID NO: 2507612 - DNA, 17 bp, Homo sapiens
acagctatgggagcccc

SEQ ID NO: 2507613 - DNA, 21 bp, Homo sapiens
acagctcagttctagtctctc

SEQ ID NO: 2507614 - DNA, 12 bp, Homo sapiens
acagctcctccc

SEQ ID NO: 2507615 - DNA, 14 bp, Homo sapiens
acagctccttctgt

SEQ ID NO: 2507616 - DNA, 15 bp, Homo sapiens
acagctccttctgtc

SEQ ID NO: 2507617 - DNA, 16 bp, Homo sapiens
acagctccttctgtcc

SEQ ID NO: 2507618 - DNA, 18 bp, Homo sapiens
acagctccttctgtccta

SEQ ID NO: 2507619 - DNA, 23 bp, Homo sapiens
acagctccttctgtcctactctg

SEQ ID NO: 2507620 - DNA, 16 bp, Homo sapiens
acagctcttctccagg

SEQ ID NO: 2507621 - DNA, 15 bp, Homo sapiens
acagctgagagactt

SEQ ID NO: 2507622 - DNA, 19 bp, Homo sapiens
acagctgagagacttttaa

SEQ ID NO: 2507623 - DNA, 13 bp, Homo sapiens
acagctgctttct

SEQ ID NO: 2507624 - DNA, 21 bp, Homo sapiens
acagctgctttctgttgtcat

SEQ ID NO: 2507625 - DNA, 20 bp, Homo sapiens
acagctgggtggcactgcca

SEQ ID NO: 2507626 - DNA, 15 bp, Homo sapiens
acagcttcagccagg

SEQ ID NO: 2507627 - DNA, 18 bp, Homo sapiens
acagcttcagccaggagc

SEQ ID NO: 2507628 - DNA, 13 bp, Homo sapiens
acagcttcaggtt

SEQ ID NO: 2507629 - DNA, 21 bp, Homo sapiens
acagcttcatttcctgtgtct

SEQ ID NO: 2507630 - DNA, 19 bp, Homo sapiens
acagctttgtgactgtata

SEQ ID NO: 2507631 - DNA, 19 bp, Homo sapiens
acaggaaaagctgctgaca

SEQ ID NO: 2507632 - DNA, 21 bp, Homo sapiens
acaggaaaagctgctgacagt

SEQ ID NO: 2507633 - DNA, 20 bp, Homo sapiens
acaggaaaattttaaaaata

SEQ ID NO: 2507634 - DNA, 22 bp, Homo sapiens
acaggaagatcttaaattttgt

SEQ ID NO: 2507635 - DNA, 20 bp, Homo sapiens
acaggaagcaccccatgcca

SEQ ID NO: 2507636 - DNA, 22 bp, Homo sapiens
acaggacagtgcttcagcctga

SEQ ID NO: 2507637 - DNA, 14 bp, Homo sapiens
acaggagacctggc

SEQ ID NO: 2507638 - DNA, 13 bp, Homo sapiens
acaggagctggga

SEQ ID NO: 2507639 - DNA, 15 bp, Homo sapiens
acaggaggacaattc

SEQ ID NO: 2507640 - DNA, 16 bp, Homo sapiens
acaggaggacaattca

SEQ ID NO: 2507641 - DNA, 22 bp, Homo sapiens
acaggatcctattctcaccagg

SEQ ID NO: 2507642 - DNA, 14 bp, Homo sapiens
acaggcaaatgcat

SEQ ID NO: 2507643 - DNA, 18 bp, Homo sapiens
acaggcaactgaggcaga

SEQ ID NO: 2507644 - DNA, 22 bp, Homo sapiens
acaggcaactgaggcagacagc

SEQ ID NO: 2507645 - DNA, 12 bp, Homo sapiens
acaggcaagcac

SEQ ID NO: 2507646 - DNA, 17 bp, Homo sapiens
acaggcaatgctggctg

SEQ ID NO: 2507647 - DNA, 15 bp, Homo sapiens
acaggcagatacagg

SEQ ID NO: 2507648 - DNA, 13 bp, Homo sapiens
acaggcagcacag

SEQ ID NO: 2507649 - DNA, 12 bp, Homo sapiens
acaggcagcaga

SEQ ID NO: 2507650 - DNA, 14 bp, Homo sapiens
acaggcagcagaga

SEQ ID NO: 2507651 - DNA, 16 bp, Homo sapiens
acaggcagcctggaca

SEQ ID NO: 2507652 - DNA, 22 bp, Homo sapiens
acaggcagcgatggtctcagaa

SEQ ID NO: 2507653 - DNA, 14 bp, Homo sapiens
acaggcatgttctc

SEQ ID NO: 2507654 - DNA, 22 bp, Homo sapiens
acaggcccaagagatgaagagt

SEQ ID NO: 2507655 - DNA, 12 bp, Homo sapiens
acaggcccagca

SEQ ID NO: 2507656 - DNA, 15 bp, Homo sapiens
acaggcccagcattg

SEQ ID NO: 2507657 - DNA, 18 bp, Homo sapiens
acaggcccagcattgctg

SEQ ID NO: 2507658 - DNA, 20 bp, Homo sapiens
acaggcccagcattgctggt

SEQ ID NO: 2507659 - DNA, 16 bp, Homo sapiens
acaggcccggctccag

SEQ ID NO: 2507660 - DNA, 14 bp, Homo sapiens
acaggcgaggcctg

SEQ ID NO: 2507661 - DNA, 14 bp, Homo sapiens
acaggctgggcttc

SEQ ID NO: 2507662 - DNA, 16 bp, Homo sapiens
acagggaagctacagg

SEQ ID NO: 2507663 - DNA, 18 bp, Homo sapiens
acagggaagctacaggtt

SEQ ID NO: 2507664 - DNA, 16 bp, Homo sapiens
acacaggcccggctcc

SEQ ID NO: 2507665 - DNA, 20 bp, Homo sapiens
acacaggcccggctccaggc

SEQ ID NO: 2507666 - DNA, 22 bp, Homo sapiens
acacaggcccggctccaggctc

SEQ ID NO: 2507667 - DNA, 13 bp, Homo sapiens
acacagtgagtcg

SEQ ID NO: 2507668 - DNA, 21 bp, Homo sapiens
acacagtgtttttgtaaagtg

SEQ ID NO: 2507669 - DNA, 22 bp, Homo sapiens
acacagttgctgtcataagaat

SEQ ID NO: 2507670 - DNA, 18 bp, Homo sapiens
acacatcacccttaccat

SEQ ID NO: 2507671 - DNA, 19 bp, Homo sapiens
acacatccctaatgtgtgc

SEQ ID NO: 2507672 - DNA, 21 bp, Homo sapiens
acacatgagcatcaggccagg

SEQ ID NO: 2507673 - DNA, 13 bp, Homo sapiens
acacatgcataca

SEQ ID NO: 2507674 - DNA, 14 bp, Homo sapiens
acacatgcatacac

SEQ ID NO: 2507675 - DNA, 19 bp, Homo sapiens
acacatgcatacacacaca

SEQ ID NO: 2507676 - DNA, 13 bp, Homo sapiens
acacatgtccaag

SEQ ID NO: 2507677 - DNA, 18 bp, Homo sapiens
acacatgtccaagaagcc

SEQ ID NO: 2507678 - DNA, 22 bp, Homo sapiens
acacatgtccaagaagcccagg

SEQ ID NO: 2507679 - DNA, 17 bp, Homo sapiens
acacattcaataagcat

SEQ ID NO: 2507680 - DNA, 14 bp, Homo sapiens
acacattttatttt

SEQ ID NO: 2507681 - DNA, 16 bp, Homo sapiens
acacattttgtataat

SEQ ID NO: 2507682 - DNA, 20 bp, Homo sapiens
acacattttttaaatgcacc

SEQ ID NO: 2507683 - DNA, 14 bp, Homo sapiens
acaccaaataaata

SEQ ID NO: 2507684 - DNA, 15 bp, Homo sapiens
acaccaatattcata

SEQ ID NO: 2507685 - DNA, 16 bp, Homo sapiens
acaccacagacacaca

SEQ ID NO: 2507686 - DNA, 17 bp, Homo sapiens
acaccactacattctgt

SEQ ID NO: 2507687 - DNA, 21 bp, Homo sapiens
acaccactacattctgttaat

SEQ ID NO: 2507688 - DNA, 14 bp, Homo sapiens
acaccagacagaca

SEQ ID NO: 2507689 - DNA, 17 bp, Homo sapiens
acaccagagcagatgca

SEQ ID NO: 2507690 - DNA, 20 bp, Homo sapiens
acaccagagcagatgcagag

SEQ ID NO: 2507691 - DNA, 12 bp, Homo sapiens
acaccagagccc

SEQ ID NO: 2507692 - DNA, 12 bp, Homo sapiens
acaccagccagg

SEQ ID NO: 2507693 - DNA, 19 bp, Homo sapiens
acaccagcctcgtcttcat

SEQ ID NO: 2507694 - DNA, 12 bp, Homo sapiens
acaccaggctgt

SEQ ID NO: 2507695 - DNA, 21 bp, Homo sapiens
acacccaccgtccgccctgct

SEQ ID NO: 2507696 - DNA, 20 bp, Homo sapiens
acacccagcccacttctgcc

SEQ ID NO: 2507697 - DNA, 13 bp, Homo sapiens
acacccatgtttc

SEQ ID NO: 2507698 - DNA, 20 bp, Homo sapiens
acaccccattggtggactac

SEQ ID NO: 2507699 - DNA, 14 bp, Homo sapiens
acacccccacccct

SEQ ID NO: 2507700 - DNA, 13 bp, Homo sapiens
acaccctcacact

SEQ ID NO: 2507701 - DNA, 22 bp, Homo sapiens
acaccctgtactgttctgtgtc

SEQ ID NO: 2507702 - DNA, 11 bp, Homo sapiens
acaccctgtga

SEQ ID NO: 2507703 - DNA, 19 bp, Homo sapiens
acaccggggtggtgggaac

SEQ ID NO: 2507704 - DNA, 18 bp, Homo sapiens
acacctaagggacatgtt

SEQ ID NO: 2507705 - DNA, 18 bp, Homo sapiens
acacctaccaaaaaataa

SEQ ID NO: 2507706 - DNA, 20 bp, Homo sapiens
acacctcagaggctgttctt

SEQ ID NO: 2507707 - DNA, 12 bp, Homo sapiens
acacctcgcccc

SEQ ID NO: 2507708 - DNA, 14 bp, Homo sapiens
acacctctgccaga

SEQ ID NO: 2507709 - DNA, 13 bp, Homo sapiens
acacctgccctgc

SEQ ID NO: 2507710 - DNA, 16 bp, Homo sapiens
acacctgtagtcccag

SEQ ID NO: 2507711 - DNA, 17 bp, Homo sapiens
acacctgtagtcccagc

SEQ ID NO: 2507712 - DNA, 21 bp, Homo sapiens
acacctgtagtcccagctact

SEQ ID NO: 2507713 - DNA, 14 bp, Homo sapiens
acaccttctctgga

SEQ ID NO: 2507714 - DNA, 16 bp, Homo sapiens
acaccttgacagggca

SEQ ID NO: 2507715 - DNA, 18 bp, Homo sapiens
acacctttgcaggcatgc

SEQ ID NO: 2507716 - DNA, 19 bp, Homo sapiens
acacgagcaggctactgtc

SEQ ID NO: 2507717 - DNA, 14 bp, Homo sapiens
acacgcacacacac

SEQ ID NO: 2507718 - DNA, 23 bp, Homo sapiens
acacgcacacacacacacaggag

SEQ ID NO: 2507719 - DNA, 17 bp, Homo sapiens
acacgcacgcacacaca

SEQ ID NO: 2507720 - DNA, 19 bp, Homo sapiens
acacgccttgttcttggcc

SEQ ID NO: 2507721 - DNA, 14 bp, Homo sapiens
acacgctcctccct

SEQ ID NO: 2507722 - DNA, 14 bp, Homo sapiens
acacggaggcatct

SEQ ID NO: 2507723 - DNA, 18 bp, Homo sapiens
acacggaggcatctgcac

SEQ ID NO: 2507724 - DNA, 19 bp, Homo sapiens
acacgtacctctcatcagt

SEQ ID NO: 2507725 - DNA, 16 bp, Homo sapiens
acacgtacttaaatga

SEQ ID NO: 2507726 - DNA, 13 bp, Homo sapiens
acacgtgagaatc

SEQ ID NO: 2507727 - DNA, 17 bp, Homo sapiens
acacgtggaggaatgct

SEQ ID NO: 2507728 - DNA, 14 bp, Homo sapiens
acactaaaaataaa

SEQ ID NO: 2507729 - DNA, 16 bp, Homo sapiens
acactaaccacgctgg

SEQ ID NO: 2507730 - DNA, 17 bp, Homo sapiens
acactaaccacgctgga

SEQ ID NO: 2507731 - DNA, 12 bp, Homo sapiens
acactaattcct

SEQ ID NO: 2507732 - DNA, 17 bp, Homo sapiens
acactagcccaatgaaa

SEQ ID NO: 2507733 - DNA, 14 bp, Homo sapiens
acactatatctgta

SEQ ID NO: 2507734 - DNA, 17 bp, Homo sapiens
acactatatctgtatat

SEQ ID NO: 2507735 - DNA, 17 bp, Homo sapiens
acactatggtatttgag

SEQ ID NO: 2507736 - DNA, 18 bp, Homo sapiens
acactatggtatttgagt

SEQ ID NO: 2507737 - DNA, 21 bp, Homo sapiens
acactcaaaagctgggcaggt

SEQ ID NO: 2507738 - DNA, 19 bp, Homo sapiens
acactcaaatcaagaaact

SEQ ID NO: 2507739 - DNA, 17 bp, Homo sapiens
acactcaagaagcaggc

SEQ ID NO: 2507740 - DNA, 20 bp, Homo sapiens
acactcacatttattctgct

SEQ ID NO: 2507741 - DNA, 22 bp, Homo sapiens
acactcacatttattctgctca

SEQ ID NO: 2507742 - DNA, 18 bp, Homo sapiens
acactcacctctaaaaca

SEQ ID NO: 2507743 - DNA, 14 bp, Homo sapiens
acactcagacctga

SEQ ID NO: 2507744 - DNA, 15 bp, Homo sapiens
acactccaattaagg

SEQ ID NO: 2507745 - DNA, 16 bp, Homo sapiens
acactccaattaagga

SEQ ID NO: 2507746 - DNA, 12 bp, Homo sapiens
acactccagcct

SEQ ID NO: 2507747 - DNA, 16 bp, Homo sapiens
acactccagcctgagc

SEQ ID NO: 2507748 - DNA, 17 bp, Homo sapiens
acactccagcctgagca

SEQ ID NO: 2507749 - DNA, 13 bp, Homo sapiens
acactccagtgcc

SEQ ID NO: 2507750 - DNA, 14 bp, Homo sapiens
acactccagtgcca

SEQ ID NO: 2507751 - DNA, 14 bp, Homo sapiens
acactcctagagaa

SEQ ID NO: 2507752 - DNA, 23 bp, Homo sapiens
acactgaatatttatatttcact

SEQ ID NO: 2507753 - DNA, 14 bp, Homo sapiens
acactgagctgtca

SEQ ID NO: 2507754 - DNA, 15 bp, Homo sapiens
acactgcatgtttgt

SEQ ID NO: 2507755 - DNA, 23 bp, Homo sapiens
acactgctaggtgggccagcccc

SEQ ID NO: 2507756 - DNA, 21 bp, Homo sapiens
acactgctgctccagtgcagg

SEQ ID NO: 2507757 - DNA, 18 bp, Homo sapiens
acactggaggagagaaga

SEQ ID NO: 2507758 - DNA, 22 bp, Homo sapiens
acactggaggagagaagaatga

SEQ ID NO: 2507759 - DNA, 13 bp, Homo sapiens
acactggcccctc

SEQ ID NO: 2507760 - DNA, 14 bp, Homo sapiens
acactgggaaacag

SEQ ID NO: 2507761 - DNA, 18 bp, Homo sapiens
acactgggacttgcaaaa

SEQ ID NO: 2507762 - DNA, 19 bp, Homo sapiens
acactgggacttgcaaaaa

SEQ ID NO: 2507763 - DNA, 19 bp, Homo sapiens
acactggtattcctgcctc

SEQ ID NO: 2507764 - DNA, 16 bp, Homo sapiens
acactggtgtgacctg

SEQ ID NO: 2507765 - DNA, 13 bp, Homo sapiens
acactgtcttgaa

SEQ ID NO: 2507766 - DNA, 12 bp, Homo sapiens
acactgtgccct

SEQ ID NO: 2507767 - DNA, 13 bp, Homo sapiens
acactgtgccctg

SEQ ID NO: 2507768 - DNA, 17 bp, Homo sapiens
acactgtgccctggtgg

SEQ ID NO: 2507769 - DNA, 18 bp, Homo sapiens
acactgtgccctggtgga

SEQ ID NO: 2507770 - DNA, 17 bp, Homo sapiens
acactgtgctgagtctg

SEQ ID NO: 2507771 - DNA, 14 bp, Homo sapiens
acactgttctctgc

SEQ ID NO: 2507772 - DNA, 22 bp, Homo sapiens
acactgttctctgccctccaag

SEQ ID NO: 2507773 - DNA, 23 bp, Homo sapiens
acactgttctctgccctccaaga

SEQ ID NO: 2507774 - DNA, 14 bp, Homo sapiens
acactgttctgaaa

SEQ ID NO: 2507775 - DNA, 15 bp, Homo sapiens
acactgtttcaaact

SEQ ID NO: 2507776 - DNA, 13 bp, Homo sapiens
acacttaaaaatg

SEQ ID NO: 2507777 - DNA, 16 bp, Homo sapiens
acacttaacagatgca

SEQ ID NO: 2507778 - DNA, 21 bp, Homo sapiens
acacttacactttatgcacaa

SEQ ID NO: 2507779 - DNA, 14 bp, Homo sapiens
acacttactgttgt

SEQ ID NO: 2507780 - DNA, 23 bp, Homo sapiens
acacttactgttgtcctatggga

SEQ ID NO: 2507781 - DNA, 18 bp, Homo sapiens
acacttcagagagctggt

SEQ ID NO: 2507782 - DNA, 20 bp, Homo sapiens
acacttcagagagctggtag

SEQ ID NO: 2507783 - DNA, 19 bp, Homo sapiens
acacttccaccagcctgca

SEQ ID NO: 2507784 - DNA, 21 bp, Homo sapiens
acacttccaccagcctgcact

SEQ ID NO: 2507785 - DNA, 22 bp, Homo sapiens
acacttcttcttggtcttattt

SEQ ID NO: 2507786 - DNA, 16 bp, Homo sapiens
acacttgagaggatga

SEQ ID NO: 2507787 - DNA, 18 bp, Homo sapiens
acacttgagaggatgaat

SEQ ID NO: 2507788 - DNA, 21 bp, Homo sapiens
acacttgagaggatgaatgta

SEQ ID NO: 2507789 - DNA, 18 bp, Homo sapiens
acacttgccttcttcacc

SEQ ID NO: 2507790 - DNA, 22 bp, Homo sapiens
acacttggcccaagtggcagag

SEQ ID NO: 2507791 - DNA, 20 bp, Homo sapiens
acacttggttgggtcctcac

SEQ ID NO: 2507792 - DNA, 16 bp, Homo sapiens
acacttgtgtgtgggc

SEQ ID NO: 2507793 - DNA, 22 bp, Homo sapiens
acacttgtgtgtgggctgtgag

SEQ ID NO: 2507794 - DNA, 19 bp, Homo sapiens
acacttgttccagctcttt

SEQ ID NO: 2507795 - DNA, 20 bp, Homo sapiens
acacttgttccagctctttg

SEQ ID NO: 2507796 - DNA, 13 bp, Homo sapiens
acacttttggtta

SEQ ID NO: 2507797 - DNA, 22 bp, Homo sapiens
acacttttttggggatatgctt

SEQ ID NO: 2507798 - DNA, 23 bp, Homo sapiens
acacttttttggggatatgctta

SEQ ID NO: 2507799 - DNA, 22 bp, Homo sapiens
acagaaaacattctgatttgga

SEQ ID NO: 2507800 - DNA, 21 bp, Homo sapiens
acagaaaatatactgtaaaga

SEQ ID NO: 2507801 - DNA, 14 bp, Homo sapiens
acagaaagtggtgc

SEQ ID NO: 2507802 - DNA, 17 bp, Homo sapiens
acagaaagtggtgctca

SEQ ID NO: 2507803 - DNA, 22 bp, Homo sapiens
acagaaagtggtgctcagttgt

SEQ ID NO: 2507804 - DNA, 17 bp, Homo sapiens
acagaaattagccgggc

SEQ ID NO: 2507805 - DNA, 13 bp, Homo sapiens
acagaacagcttc

SEQ ID NO: 2507806 - DNA, 15 bp, Homo sapiens
acagaacagcttcag

SEQ ID NO: 2507807 - DNA, 17 bp, Homo sapiens
acagaacatcattagaa

SEQ ID NO: 2507808 - DNA, 17 bp, Homo sapiens
acagaacccctacatga

SEQ ID NO: 2507809 - DNA, 23 bp, Homo sapiens
acagaaccttgttatttctcaga

SEQ ID NO: 2507810 - DNA, 16 bp, Homo sapiens
acagaagaaggcagca

SEQ ID NO: 2507811 - DNA, 20 bp, Homo sapiens
acagaagaaggcagcaggtg

SEQ ID NO: 2507812 - DNA, 13 bp, Homo sapiens
acagaagcagctc

SEQ ID NO: 2507813 - DNA, 18 bp, Homo sapiens
acagaagcaggctggagg

SEQ ID NO: 2507814 - DNA, 13 bp, Homo sapiens
acagaagccagga

SEQ ID NO: 2507815 - DNA, 20 bp, Homo sapiens
acaaattaggttttgtacaa

SEQ ID NO: 2507816 - DNA, 22 bp, Homo sapiens
acaaattatgttacatctgttt

SEQ ID NO: 2507817 - DNA, 22 bp, Homo sapiens
acaaattgaactctttgaatga

SEQ ID NO: 2507818 - DNA, 20 bp, Homo sapiens
acaaattgcttactttggaa

SEQ ID NO: 2507819 - DNA, 18 bp, Homo sapiens
acaaatttacagagacag

SEQ ID NO: 2507820 - DNA, 14 bp, Homo sapiens
acaacacacacact

SEQ ID NO: 2507821 - DNA, 12 bp, Homo sapiens
acaacactcaca

SEQ ID NO: 2507822 - DNA, 13 bp, Homo sapiens
acaacagaagctt

SEQ ID NO: 2507823 - DNA, 11 bp, Homo sapiens
acaacagaagt

SEQ ID NO: 2507824 - DNA, 23 bp, Homo sapiens
acaacagtgctaaaaatgggact

SEQ ID NO: 2507825 - DNA, 14 bp, Homo sapiens
acaacatgtataat

SEQ ID NO: 2507826 - DNA, 19 bp, Homo sapiens
acaaccaccgctccccagc

SEQ ID NO: 2507827 - DNA, 21 bp, Homo sapiens
acaaccacctaatcaggctga

SEQ ID NO: 2507828 - DNA, 14 bp, Homo sapiens
acaaccattccaga

SEQ ID NO: 2507829 - DNA, 16 bp, Homo sapiens
acaactaggcttcagc

SEQ ID NO: 2507830 - DNA, 12 bp, Homo sapiens
acaactgagtcc

SEQ ID NO: 2507831 - DNA, 13 bp, Homo sapiens
acaactgagtcct

SEQ ID NO: 2507832 - DNA, 15 bp, Homo sapiens
acaacttaaataata

SEQ ID NO: 2507833 - DNA, 14 bp, Homo sapiens
acaacttcagcagt

SEQ ID NO: 2507834 - DNA, 14 bp, Homo sapiens
acaacttctttgta

SEQ ID NO: 2507835 - DNA, 16 bp, Homo sapiens
acaagaaaaaatgaat

SEQ ID NO: 2507836 - DNA, 15 bp, Homo sapiens
acaagaaatccctgt

SEQ ID NO: 2507837 - DNA, 23 bp, Homo sapiens
acaagaaatccctgtttaatatt

SEQ ID NO: 2507838 - DNA, 16 bp, Homo sapiens
acaagaaatgaaagca

SEQ ID NO: 2507839 - DNA, 22 bp, Homo sapiens
acaagaaatgaaagcagggact

SEQ ID NO: 2507840 - DNA, 13 bp, Homo sapiens
acaagaagaccag

SEQ ID NO: 2507841 - DNA, 15 bp, Homo sapiens
acaagacagaagctg

SEQ ID NO: 2507842 - DNA, 19 bp, Homo sapiens
acaagaccacgtttctaaa

SEQ ID NO: 2507843 - DNA, 14 bp, Homo sapiens
acaagagcagcctg

SEQ ID NO: 2507844 - DNA, 20 bp, Homo sapiens
acaagagcagcctgtggcat

SEQ ID NO: 2507845 - DNA, 18 bp, Homo sapiens
acaagagtttatttccaa

SEQ ID NO: 2507846 - DNA, 18 bp, Homo sapiens
acaagatagagagctatt

SEQ ID NO: 2507847 - DNA, 13 bp, Homo sapiens
acaagatctttca

SEQ ID NO: 2507848 - DNA, 20 bp, Homo sapiens
acaagatctttcaggaaaga

SEQ ID NO: 2507849 - DNA, 15 bp, Homo sapiens
acaagcaagctccca

SEQ ID NO: 2507850 - DNA, 22 bp, Homo sapiens
acaagcaattagacaagaactt

SEQ ID NO: 2507851 - DNA, 11 bp, Homo sapiens
acaagcagagg

SEQ ID NO: 2507852 - DNA, 12 bp, Homo sapiens
acaagccacaga

SEQ ID NO: 2507853 - DNA, 12 bp, Homo sapiens
acaagccacccc

SEQ ID NO: 2507854 - DNA, 15 bp, Homo sapiens
acaagccagctggag

SEQ ID NO: 2507855 - DNA, 14 bp, Homo sapiens
acaagccccccctt

SEQ ID NO: 2507856 - DNA, 17 bp, Homo sapiens
acaagcccccccttcca

SEQ ID NO: 2507857 - DNA, 17 bp, Homo sapiens
acaagcgtgagccactg

SEQ ID NO: 2507858 - DNA, 21 bp, Homo sapiens
acaagcgtgagccactgcacc

SEQ ID NO: 2507859 - DNA, 14 bp, Homo sapiens
acaagctaaaatta

SEQ ID NO: 2507860 - DNA, 16 bp, Homo sapiens
acaagctcctggtctt

SEQ ID NO: 2507861 - DNA, 21 bp, Homo sapiens
acaagctgcaccctcaggcag

SEQ ID NO: 2507862 - DNA, 16 bp, Homo sapiens
acaaggccccagagac

SEQ ID NO: 2507863 - DNA, 13 bp, Homo sapiens
acaaggctgacca

SEQ ID NO: 2507864 - DNA, 22 bp, Homo sapiens
acaaggctgaccaagagagaaa

SEQ ID NO: 2507865 - DNA, 15 bp, Homo sapiens
acaaggctgttgcat

SEQ ID NO: 2507866 - DNA, 19 bp, Homo sapiens
acaagggagagacctcatc

SEQ ID NO: 2507867 - DNA, 18 bp, Homo sapiens
acaagggtggcatcccag

SEQ ID NO: 2507868 - DNA, 21 bp, Homo sapiens
acaaggtacccctttctggct

SEQ ID NO: 2507869 - DNA, 14 bp, Homo sapiens
acaaggtagttttt

SEQ ID NO: 2507870 - DNA, 16 bp, Homo sapiens
acaaggtagtttttac

SEQ ID NO: 2507871 - DNA, 19 bp, Homo sapiens
acaaggttccctctgagaa

SEQ ID NO: 2507872 - DNA, 17 bp, Homo sapiens
acaagtccctgtaattg

SEQ ID NO: 2507873 - DNA, 19 bp, Homo sapiens
acaagtcctgtgaatttct

SEQ ID NO: 2507874 - DNA, 20 bp, Homo sapiens
acaagtgtatatcagaaaag

SEQ ID NO: 2507875 - DNA, 15 bp, Homo sapiens
acaagtttttctgtc

SEQ ID NO: 2507876 - DNA, 16 bp, Homo sapiens
acaagtttttctgtca

SEQ ID NO: 2507877 - DNA, 14 bp, Homo sapiens
acaataaaaatgtt

SEQ ID NO: 2507878 - DNA, 16 bp, Homo sapiens
acaataaaacattaat

SEQ ID NO: 2507879 - DNA, 21 bp, Homo sapiens
acaataaaattttttttcatg

SEQ ID NO: 2507880 - DNA, 19 bp, Homo sapiens
acaataactactgtgttcc

SEQ ID NO: 2507881 - DNA, 21 bp, Homo sapiens
acaataagttaactattttat

SEQ ID NO: 2507882 - DNA, 18 bp, Homo sapiens
acaatactcataatgtga

SEQ ID NO: 2507883 - DNA, 19 bp, Homo sapiens
acaatactcataatgtgaa

SEQ ID NO: 2507884 - DNA, 21 bp, Homo sapiens
acaatactcataatgtgaagt

SEQ ID NO: 2507885 - DNA, 18 bp, Homo sapiens
acaatagtaacctgggta

SEQ ID NO: 2507886 - DNA, 14 bp, Homo sapiens
acaatattgaactt

SEQ ID NO: 2507887 - DNA, 10 bp, Homo sapiens
acaatattta

SEQ ID NO: 2507888 - DNA, 16 bp, Homo sapiens
acaatatttaaaattt

SEQ ID NO: 2507889 - DNA, 14 bp, Homo sapiens
acaatcaaaggaaa

SEQ ID NO: 2507890 - DNA, 17 bp, Homo sapiens
acaatcagtcccctccc

SEQ ID NO: 2507891 - DNA, 18 bp, Homo sapiens
acaatcagtcccctccca

SEQ ID NO: 2507892 - DNA, 20 bp, Homo sapiens
acaatcagtcccctcccatc

SEQ ID NO: 2507893 - DNA, 21 bp, Homo sapiens
acaatcattgctgaaaatggt

SEQ ID NO: 2507894 - DNA, 22 bp, Homo sapiens
acaatcattgctgaaaatggta

SEQ ID NO: 2507895 - DNA, 18 bp, Homo sapiens
acaatctgacattctcag

SEQ ID NO: 2507896 - DNA, 16 bp, Homo sapiens
acaatgacatttatat

SEQ ID NO: 2507897 - DNA, 20 bp, Homo sapiens
acaatgacttactgtacatg

SEQ ID NO: 2507898 - DNA, 15 bp, Homo sapiens
acaatgatatatgga

SEQ ID NO: 2507899 - DNA, 23 bp, Homo sapiens
acaatgctgtgccctaaagtgta

SEQ ID NO: 2507900 - DNA, 14 bp, Homo sapiens
acaatggaaactga

SEQ ID NO: 2507901 - DNA, 17 bp, Homo sapiens
acaatgtgaaaagaaaa

SEQ ID NO: 2507902 - DNA, 14 bp, Homo sapiens
acaattccaaagga

SEQ ID NO: 2507903 - DNA, 18 bp, Homo sapiens
acaattccaaaggaatct

SEQ ID NO: 2507904 - DNA, 16 bp, Homo sapiens
acaattccctgctgtc

SEQ ID NO: 2507905 - DNA, 22 bp, Homo sapiens
acaattcctctactaacaatca

SEQ ID NO: 2507906 - DNA, 15 bp, Homo sapiens
acaattctacattgt

SEQ ID NO: 2507907 - DNA, 13 bp, Homo sapiens
acaattctttata

SEQ ID NO: 2507908 - DNA, 14 bp, Homo sapiens
acaattctttatac

SEQ ID NO: 2507909 - DNA, 13 bp, Homo sapiens
acaatttaaagca

SEQ ID NO: 2507910 - DNA, 14 bp, Homo sapiens
acaatttaaagcaa

SEQ ID NO: 2507911 - DNA, 15 bp, Homo sapiens
acaatttattatggc

SEQ ID NO: 2507912 - DNA, 11 bp, Homo sapiens
acaatttctgt

SEQ ID NO: 2507913 - DNA, 14 bp, Homo sapiens
acaatttttttaat

SEQ ID NO: 2507914 - DNA, 17 bp, Homo sapiens
acacaaacctgcctggg

SEQ ID NO: 2507915 - DNA, 13 bp, Homo sapiens
acacaagccacag

SEQ ID NO: 2507916 - DNA, 16 bp, Homo sapiens
acacaagccacagaag

SEQ ID NO: 2507917 - DNA, 13 bp, Homo sapiens
acacaagtaaaca

SEQ ID NO: 2507918 - DNA, 12 bp, Homo sapiens
acacacacacag

SEQ ID NO: 2507919 - DNA, 13 bp, Homo sapiens
acacacacacagc

SEQ ID NO: 2507920 - DNA, 14 bp, Homo sapiens
acacacacacagcc

SEQ ID NO: 2507921 - DNA, 15 bp, Homo sapiens
acacacacacagcca

SEQ ID NO: 2507922 - DNA, 15 bp, Homo sapiens
acacacacacatgca

SEQ ID NO: 2507923 - DNA, 17 bp, Homo sapiens
acacacacacatgcata

SEQ ID NO: 2507924 - DNA, 15 bp, Homo sapiens
acacacacagaaaat

SEQ ID NO: 2507925 - DNA, 15 bp, Homo sapiens
acacacacagccaca

SEQ ID NO: 2507926 - DNA, 16 bp, Homo sapiens
acacacacagccacac

SEQ ID NO: 2507927 - DNA, 16 bp, Homo sapiens
acacacagaaaatata

SEQ ID NO: 2507928 - DNA, 18 bp, Homo sapiens
acacacagaaaatatact

SEQ ID NO: 2507929 - DNA, 19 bp, Homo sapiens
acacacagaaaatatactg

SEQ ID NO: 2507930 - DNA, 20 bp, Homo sapiens
acacacagaaaatatactgt

SEQ ID NO: 2507931 - DNA, 13 bp, Homo sapiens
acacacagaggaa

SEQ ID NO: 2507932 - DNA, 14 bp, Homo sapiens
acacacagccacac

SEQ ID NO: 2507933 - DNA, 15 bp, Homo sapiens
acacacagccacaca

SEQ ID NO: 2507934 - DNA, 22 bp, Homo sapiens
acacacagccacacacacagaa

SEQ ID NO: 2507935 - DNA, 13 bp, Homo sapiens
acacacagctctg

SEQ ID NO: 2507936 - DNA, 14 bp, Homo sapiens
acacacatgcatac

SEQ ID NO: 2507937 - DNA, 16 bp, Homo sapiens
acacacatgcatacac

SEQ ID NO: 2507938 - DNA, 17 bp, Homo sapiens
acacacatgcatacaca

SEQ ID NO: 2507939 - DNA, 18 bp, Homo sapiens
acacacatgcatacacac

SEQ ID NO: 2507940 - DNA, 20 bp, Homo sapiens
acacacatgcatacacacac

SEQ ID NO: 2507941 - DNA, 20 bp, Homo sapiens
acacaccagagcccaccttg

SEQ ID NO: 2507942 - DNA, 12 bp, Homo sapiens
acacaccaggct

SEQ ID NO: 2507943 - DNA, 22 bp, Homo sapiens
acacaccaggctgtgggcctca

SEQ ID NO: 2507944 - DNA, 13 bp, Homo sapiens
acacacgcacgca

SEQ ID NO: 2507945 - DNA, 14 bp, Homo sapiens
acacacgcacgcac

SEQ ID NO: 2507946 - DNA, 16 bp, Homo sapiens
acacacgcaggaactc

SEQ ID NO: 2507947 - DNA, 20 bp, Homo sapiens
acacacgcaggaactcccag

SEQ ID NO: 2507948 - DNA, 21 bp, Homo sapiens
acacacgcgtgcacacaccag

SEQ ID NO: 2507949 - DNA, 15 bp, Homo sapiens
acacactgaggcagg

SEQ ID NO: 2507950 - DNA, 21 bp, Homo sapiens
acacactgcatgtttgtgatt

SEQ ID NO: 2507951 - DNA, 17 bp, Homo sapiens
acacagaaaatatactg

SEQ ID NO: 2507952 - DNA, 19 bp, Homo sapiens
acacagaaaatatactgta

SEQ ID NO: 2507953 - DNA, 20 bp, Homo sapiens
acacagaaaatatactgtaa

SEQ ID NO: 2507954 - DNA, 22 bp, Homo sapiens
acacagaaaatatactgtaaag

SEQ ID NO: 2507955 - DNA, 19 bp, Homo sapiens
acacagagtggtctttctg

SEQ ID NO: 2507956 - DNA, 21 bp, Homo sapiens
acacagagtggtctttctgga

SEQ ID NO: 2507957 - DNA, 21 bp, Homo sapiens
acacagccacacacacagaaa

SEQ ID NO: 2507958 - DNA, 21 bp, Homo sapiens
acacagctaacacacagctcc

SEQ ID NO: 2507959 - DNA, 11 bp, Homo sapiens
acacagctctg

SEQ ID NO: 2507960 - DNA, 11 bp, Homo sapiens
acacagctctt

SEQ ID NO: 2507961 - DNA, 13 bp, Homo sapiens
acacagctcttct

SEQ ID NO: 2507962 - DNA, 22 bp, Homo sapiens
acacagctcttctccaggctgt

SEQ ID NO: 2507963 - DNA, 16 bp, Homo sapiens
acacagctgggctgtg

SEQ ID NO: 2507964 - DNA, 22 bp, Homo sapiens
acacagctttatcaccagagag

SEQ ID NO: 2507965 - DNA, 14 bp, Homo sapiens
acacaggaggagaa

SEQ ID NO: 2507966 - DNA, 24 bp, Homo sapiens
acacaggatcctattctcaccagg

SEQ ID NO: 2507967 - DNA, 15 bp, Homo sapiens
acacaggcaactgag

SEQ ID NO: 2507968 - DNA, 15 bp, Homo sapiens
aattcttacatgttt

SEQ ID NO: 2507969 - DNA, 19 bp, Homo sapiens
aattcttggttgaggaaac

SEQ ID NO: 2507970 - DNA, 14 bp, Homo sapiens
aattctttatacaa

SEQ ID NO: 2507971 - DNA, 20 bp, Homo sapiens
aattctttatacaacagtgc

SEQ ID NO: 2507972 - DNA, 22 bp, Homo sapiens
aattgaacttaaataaatgtca

SEQ ID NO: 2507973 - DNA, 14 bp, Homo sapiens
aattgaataatggt

SEQ ID NO: 2507974 - DNA, 19 bp, Homo sapiens
aattgaatggtcagcgttg

SEQ ID NO: 2507975 - DNA, 16 bp, Homo sapiens
aattgacccacaagaa

SEQ ID NO: 2507976 - DNA, 19 bp, Homo sapiens
aattgacccacaagaaatg

SEQ ID NO: 2507977 - DNA, 22 bp, Homo sapiens
aattgacccacaagaaatgaaa

SEQ ID NO: 2507978 - DNA, 15 bp, Homo sapiens
aattgactcaaatct

SEQ ID NO: 2507979 - DNA, 14 bp, Homo sapiens
aattgacttattta

SEQ ID NO: 2507980 - DNA, 19 bp, Homo sapiens
aattgaggactatggaaat

SEQ ID NO: 2507981 - DNA, 19 bp, Homo sapiens
aattgaggtctgctcggcc

SEQ ID NO: 2507982 - DNA, 17 bp, Homo sapiens
aattgagttttcagtgg

SEQ ID NO: 2507983 - DNA, 21 bp, Homo sapiens
aattgatcataggtatttcaa

SEQ ID NO: 2507984 - DNA, 22 bp, Homo sapiens
aattgatcattttccccccact

SEQ ID NO: 2507985 - DNA, 23 bp, Homo sapiens
aattgattattctgattccactt

SEQ ID NO: 2507986 - DNA, 15 bp, Homo sapiens
aattgcactctaaaa

SEQ ID NO: 2507987 - DNA, 14 bp, Homo sapiens
aattgccaaagctg

SEQ ID NO: 2507988 - DNA, 18 bp, Homo sapiens
aattgctgtgtatctgat

SEQ ID NO: 2507989 - DNA, 17 bp, Homo sapiens
aattgcttgaaagaaaa

SEQ ID NO: 2507990 - DNA, 22 bp, Homo sapiens
aattgcttgaaagaaaatatgc

SEQ ID NO: 2507991 - DNA, 20 bp, Homo sapiens
aattggaagctgccctgccc

SEQ ID NO: 2507992 - DNA, 16 bp, Homo sapiens
aattgtaactgttctt

SEQ ID NO: 2507993 - DNA, 18 bp, Homo sapiens
aattgtaggggtgtgtgt

SEQ ID NO: 2507994 - DNA, 24 bp, Homo sapiens
aattgtatcatttgaacaactagg

SEQ ID NO: 2507995 - DNA, 22 bp, Homo sapiens
aattgtatcgtatagctgtatt

SEQ ID NO: 2507996 - DNA, 23 bp, Homo sapiens
aattgtatctagtgcagctgatt

SEQ ID NO: 2507997 - DNA, 22 bp, Homo sapiens
aattgtatgttaagttacttca

SEQ ID NO: 2507998 - DNA, 16 bp, Homo sapiens
aattgtcccttaaaca

SEQ ID NO: 2507999 - DNA, 18 bp, Homo sapiens
aattgtcccttaaacaaa

SEQ ID NO: 2508000 - DNA, 21 bp, Homo sapiens
aattgtggggatgatgaaata

SEQ ID NO: 2508001 - DNA, 13 bp, Homo sapiens
aattgttgacagt

SEQ ID NO: 2508002 - DNA, 20 bp, Homo sapiens
aattgttgacagttctgaag

SEQ ID NO: 2508003 - DNA, 15 bp, Homo sapiens
aattgttgtttcttt

SEQ ID NO: 2508004 - DNA, 20 bp, Homo sapiens
aattgttgtttctttctagt

SEQ ID NO: 2508005 - DNA, 21 bp, Homo sapiens
aattgttgtttgtatgtataa

SEQ ID NO: 2508006 - DNA, 15 bp, Homo sapiens
aattgtttaagtgtt

SEQ ID NO: 2508007 - DNA, 20 bp, Homo sapiens
aattgtttcaaaataaaaac

SEQ ID NO: 2508008 - DNA, 22 bp, Homo sapiens
aattgtttggggatgagaaagg

SEQ ID NO: 2508009 - DNA, 17 bp, Homo sapiens
aattgttttgcactttt

SEQ ID NO: 2508010 - DNA, 19 bp, Homo sapiens
aatttaaacacctcctcat

SEQ ID NO: 2508011 - DNA, 11 bp, Homo sapiens
aatttaaacag

SEQ ID NO: 2508012 - DNA, 19 bp, Homo sapiens
aatttaaagggtgtactta

SEQ ID NO: 2508013 - DNA, 13 bp, Homo sapiens
aatttaagcattg

SEQ ID NO: 2508014 - DNA, 15 bp, Homo sapiens
aatttaagcattgtt

SEQ ID NO: 2508015 - DNA, 21 bp, Homo sapiens
aatttaagcattgtttgctta

SEQ ID NO: 2508016 - DNA, 16 bp, Homo sapiens
aatttaagtgcgtgtg

SEQ ID NO: 2508017 - DNA, 23 bp, Homo sapiens
aatttaagtgcgtgtgtagagtt

SEQ ID NO: 2508018 - DNA, 14 bp, Homo sapiens
aatttaatatagct

SEQ ID NO: 2508019 - DNA, 18 bp, Homo sapiens
aatttacagagacagaaa

SEQ ID NO: 2508020 - DNA, 14 bp, Homo sapiens
aatttacatggcaa

SEQ ID NO: 2508021 - DNA, 16 bp, Homo sapiens
aatttagtttttgttc

SEQ ID NO: 2508022 - DNA, 18 bp, Homo sapiens
aatttagtttttgttctt

SEQ ID NO: 2508023 - DNA, 18 bp, Homo sapiens
aatttatcctgaaatttc

SEQ ID NO: 2508024 - DNA, 18 bp, Homo sapiens
aatttatcttgtctctgg

SEQ ID NO: 2508025 - DNA, 20 bp, Homo sapiens
aatttatcttgtctctgggc

SEQ ID NO: 2508026 - DNA, 19 bp, Homo sapiens
aatttatgagtttttgata

SEQ ID NO: 2508027 - DNA, 20 bp, Homo sapiens
aatttatgagtttttgatag

SEQ ID NO: 2508028 - DNA, 15 bp, Homo sapiens
aatttattaaaatga

SEQ ID NO: 2508029 - DNA, 18 bp, Homo sapiens
aatttattagttaatata

SEQ ID NO: 2508030 - DNA, 17 bp, Homo sapiens
aatttattatggcacat

SEQ ID NO: 2508031 - DNA, 14 bp, Homo sapiens
aatttattcaagaa

SEQ ID NO: 2508032 - DNA, 20 bp, Homo sapiens
aatttatttttgcatggcac

SEQ ID NO: 2508033 - DNA, 16 bp, Homo sapiens
aatttcaaaaatataa

SEQ ID NO: 2508034 - DNA, 19 bp, Homo sapiens
aatttcaaaaatataactt

SEQ ID NO: 2508035 - DNA, 19 bp, Homo sapiens
aatttcacctgtaaacctg

SEQ ID NO: 2508036 - DNA, 20 bp, Homo sapiens
aatttcacctgtaaacctga

SEQ ID NO: 2508037 - DNA, 21 bp, Homo sapiens
aatttccacaaaatctgtcca

SEQ ID NO: 2508038 - DNA, 24 bp, Homo sapiens
aatttccagtgagcttatcatgct

SEQ ID NO: 2508039 - DNA, 15 bp, Homo sapiens
aatttccccaacagt

SEQ ID NO: 2508040 - DNA, 18 bp, Homo sapiens
aatttccccaacagtgtg

SEQ ID NO: 2508041 - DNA, 19 bp, Homo sapiens
aatttccccaacagtgtga

SEQ ID NO: 2508042 - DNA, 21 bp, Homo sapiens
aatttccccaacagtgtgaag

SEQ ID NO: 2508043 - DNA, 11 bp, Homo sapiens
aatttctcccc

SEQ ID NO: 2508044 - DNA, 21 bp, Homo sapiens
aatttcttcactgttgaaaat

SEQ ID NO: 2508045 - DNA, 14 bp, Homo sapiens
aatttgaaatttag

SEQ ID NO: 2508046 - DNA, 18 bp, Homo sapiens
aatttgcaagtcatggct

SEQ ID NO: 2508047 - DNA, 18 bp, Homo sapiens
aatttggcctgcactaat

SEQ ID NO: 2508048 - DNA, 17 bp, Homo sapiens
aatttggttctaggccg

SEQ ID NO: 2508049 - DNA, 24 bp, Homo sapiens
aatttgtaaaaacagcattgcttt

SEQ ID NO: 2508050 - DNA, 16 bp, Homo sapiens
aatttgtaacctcagc

SEQ ID NO: 2508051 - DNA, 19 bp, Homo sapiens
aatttgtaagtttcaggtg

SEQ ID NO: 2508052 - DNA, 19 bp, Homo sapiens
aatttgtaattgcttacat

SEQ ID NO: 2508053 - DNA, 18 bp, Homo sapiens
aatttgttattttgcaac

SEQ ID NO: 2508054 - DNA, 14 bp, Homo sapiens
aattttaaaaatga

SEQ ID NO: 2508055 - DNA, 17 bp, Homo sapiens
aattttaaaaatgaatc

SEQ ID NO: 2508056 - DNA, 17 bp, Homo sapiens
aattttaaataaaagtg

SEQ ID NO: 2508057 - DNA, 16 bp, Homo sapiens
aattttaatattttat

SEQ ID NO: 2508058 - DNA, 13 bp, Homo sapiens
aattttaatgcta

SEQ ID NO: 2508059 - DNA, 21 bp, Homo sapiens
aattttaccctttagactgta

SEQ ID NO: 2508060 - DNA, 23 bp, Homo sapiens
aattttagtgacagctctgcctg

SEQ ID NO: 2508061 - DNA, 15 bp, Homo sapiens
aattttcaagtaatt

SEQ ID NO: 2508062 - DNA, 18 bp, Homo sapiens
aattttctagactttctg

SEQ ID NO: 2508063 - DNA, 22 bp, Homo sapiens
aattttctggaatacatgaaat

SEQ ID NO: 2508064 - DNA, 19 bp, Homo sapiens
aattttcttcatgcaatga

SEQ ID NO: 2508065 - DNA, 21 bp, Homo sapiens
aattttctttttaataaaaag

SEQ ID NO: 2508066 - DNA, 21 bp, Homo sapiens
aattttgaataaataaatgta

SEQ ID NO: 2508067 - DNA, 22 bp, Homo sapiens
aattttggttgtattctttgat

SEQ ID NO: 2508068 - DNA, 15 bp, Homo sapiens
aattttgtaacgaag

SEQ ID NO: 2508069 - DNA, 13 bp, Homo sapiens
aattttgtatttt

SEQ ID NO: 2508070 - DNA, 13 bp, Homo sapiens
aatttttaaagta

SEQ ID NO: 2508071 - DNA, 13 bp, Homo sapiens
aatttttaagcaa

SEQ ID NO: 2508072 - DNA, 19 bp, Homo sapiens
aatttttcagatgcttctg

SEQ ID NO: 2508073 - DNA, 20 bp, Homo sapiens
aatttttcattgatatgaaa

SEQ ID NO: 2508074 - DNA, 20 bp, Homo sapiens
aatttttctctaactcagaa

SEQ ID NO: 2508075 - DNA, 16 bp, Homo sapiens
aatttttgccttcatt

SEQ ID NO: 2508076 - DNA, 18 bp, Homo sapiens
aattttttatcatgcatg

SEQ ID NO: 2508077 - DNA, 16 bp, Homo sapiens
aatttttttaattttg

SEQ ID NO: 2508078 - DNA, 15 bp, Homo sapiens
aatttttttattact

SEQ ID NO: 2508079 - DNA, 13 bp, Homo sapiens
acaaaaacacagc

SEQ ID NO: 2508080 - DNA, 14 bp, Homo sapiens
acaaaaagcttccc

SEQ ID NO: 2508081 - DNA, 12 bp, Homo sapiens
acaaaaataaca

SEQ ID NO: 2508082 - DNA, 13 bp, Homo sapiens
acaaaaatataaa

SEQ ID NO: 2508083 - DNA, 22 bp, Homo sapiens
acaaaaatgaaagcatgtctca

SEQ ID NO: 2508084 - DNA, 19 bp, Homo sapiens
acaaaaatgaactgaagtt

SEQ ID NO: 2508085 - DNA, 23 bp, Homo sapiens
acaaaaatgaactgaagtttcac

SEQ ID NO: 2508086 - DNA, 21 bp, Homo sapiens
acaaaaatgtaatgatcataa

SEQ ID NO: 2508087 - DNA, 14 bp, Homo sapiens
acaaaacttttcta

SEQ ID NO: 2508088 - DNA, 23 bp, Homo sapiens
acaaaagcaagactgttgctcaa

SEQ ID NO: 2508089 - DNA, 12 bp, Homo sapiens
acaaaataaaca

SEQ ID NO: 2508090 - DNA, 14 bp, Homo sapiens
acaaaatctcctct

SEQ ID NO: 2508091 - DNA, 20 bp, Homo sapiens
acaaaatgtagggttataat

SEQ ID NO: 2508092 - DNA, 22 bp, Homo sapiens
acaaaatgtagggttataataa

SEQ ID NO: 2508093 - DNA, 15 bp, Homo sapiens
acaaaatttagtttt

SEQ ID NO: 2508094 - DNA, 15 bp, Homo sapiens
acaaacacctcccag

SEQ ID NO: 2508095 - DNA, 19 bp, Homo sapiens
acaaacatatttgttaaat

SEQ ID NO: 2508096 - DNA, 14 bp, Homo sapiens
acaaaccagaagca

SEQ ID NO: 2508097 - DNA, 16 bp, Homo sapiens
acaaactacatgtaat

SEQ ID NO: 2508098 - DNA, 20 bp, Homo sapiens
acaaactcaccatctgtgca

SEQ ID NO: 2508099 - DNA, 15 bp, Homo sapiens
acaaactctctgaac

SEQ ID NO: 2508100 - DNA, 22 bp, Homo sapiens
acaaactctctgaacccctccc

SEQ ID NO: 2508101 - DNA, 21 bp, Homo sapiens
acaaagaagacatgttttaga

SEQ ID NO: 2508102 - DNA, 21 bp, Homo sapiens
acaaagatgtttgtcagatat

SEQ ID NO: 2508103 - DNA, 23 bp, Homo sapiens
acaaagatgtttgtcagatatga

SEQ ID NO: 2508104 - DNA, 18 bp, Homo sapiens
acaaagccttatcaagtg

SEQ ID NO: 2508105 - DNA, 22 bp, Homo sapiens
acaaagcttctatcccaggagg

SEQ ID NO: 2508106 - DNA, 23 bp, Homo sapiens
acaaagcttctatcccaggaggt

SEQ ID NO: 2508107 - DNA, 19 bp, Homo sapiens
acaaaggtataattttatg

SEQ ID NO: 2508108 - DNA, 24 bp, Homo sapiens
acaaaggttgagatgtaaaaggta

SEQ ID NO: 2508109 - DNA, 21 bp, Homo sapiens
acaaaggttttcctcttctat

SEQ ID NO: 2508110 - DNA, 15 bp, Homo sapiens
acaaatactcatgtg

SEQ ID NO: 2508111 - DNA, 16 bp, Homo sapiens
acaaatactcatgtgt

SEQ ID NO: 2508112 - DNA, 17 bp, Homo sapiens
acaaatactcttaggaa

SEQ ID NO: 2508113 - DNA, 23 bp, Homo sapiens
acaaatactcttaggaagagaaa

SEQ ID NO: 2508114 - DNA, 19 bp, Homo sapiens
acaaatatgcaaaaggttc

SEQ ID NO: 2508115 - DNA, 12 bp, Homo sapiens
acaaatatttat

SEQ ID NO: 2508116 - DNA, 16 bp, Homo sapiens
acaaatggaggcctgt

SEQ ID NO: 2508117 - DNA, 15 bp, Homo sapiens
aatggttataaaagt

SEQ ID NO: 2508118 - DNA, 16 bp, Homo sapiens
aatggttataaaagtg

SEQ ID NO: 2508119 - DNA, 21 bp, Homo sapiens
aatggttccatgcctgagggt

SEQ ID NO: 2508120 - DNA, 18 bp, Homo sapiens
aatggttgccttaaagaa

SEQ ID NO: 2508121 - DNA, 17 bp, Homo sapiens
aatggtttgaatataaa

SEQ ID NO: 2508122 - DNA, 12 bp, Homo sapiens
aatgtaaatatt

SEQ ID NO: 2508123 - DNA, 17 bp, Homo sapiens
aatgtaacagtctgatc

SEQ ID NO: 2508124 - DNA, 13 bp, Homo sapiens
aatgtaagctcta

SEQ ID NO: 2508125 - DNA, 19 bp, Homo sapiens
aatgtaatcaatgtttctt

SEQ ID NO: 2508126 - DNA, 21 bp, Homo sapiens
aatgtaatgatcataagtcta

SEQ ID NO: 2508127 - DNA, 14 bp, Homo sapiens
aatgtaattgaata

SEQ ID NO: 2508128 - DNA, 23 bp, Homo sapiens
aatgtacagcaaggagatttaca

SEQ ID NO: 2508129 - DNA, 18 bp, Homo sapiens
aatgtactgcatatgaaa

SEQ ID NO: 2508130 - DNA, 12 bp, Homo sapiens
aatgtagatttt

SEQ ID NO: 2508131 - DNA, 13 bp, Homo sapiens
aatgtagccatgg

SEQ ID NO: 2508132 - DNA, 20 bp, Homo sapiens
aatgtaggtatgaataagtt

SEQ ID NO: 2508133 - DNA, 14 bp, Homo sapiens
aatgtatcaggaaa

SEQ ID NO: 2508134 - DNA, 19 bp, Homo sapiens
aatgtatcatagaaatgta

SEQ ID NO: 2508135 - DNA, 18 bp, Homo sapiens
aatgtatcttattcacat

SEQ ID NO: 2508136 - DNA, 12 bp, Homo sapiens
aatgtatgtgta

SEQ ID NO: 2508137 - DNA, 20 bp, Homo sapiens
aatgtatgtgtaagtattct

SEQ ID NO: 2508138 - DNA, 16 bp, Homo sapiens
aatgtattattctgca

SEQ ID NO: 2508139 - DNA, 13 bp, Homo sapiens
aatgtattgtacc

SEQ ID NO: 2508140 - DNA, 16 bp, Homo sapiens
aatgtcacaggcaggt

SEQ ID NO: 2508141 - DNA, 21 bp, Homo sapiens
aatgtcagatacaatgtattt

SEQ ID NO: 2508142 - DNA, 20 bp, Homo sapiens
aatgtcaggaacagaaggat

SEQ ID NO: 2508143 - DNA, 13 bp, Homo sapiens
aatgtcagtatgt

SEQ ID NO: 2508144 - DNA, 16 bp, Homo sapiens
aatgtcagtatgtgga

SEQ ID NO: 2508145 - DNA, 22 bp, Homo sapiens
aatgtcagtatgtggaagtgtg

SEQ ID NO: 2508146 - DNA, 17 bp, Homo sapiens
aatgtcatcagaacttt

SEQ ID NO: 2508147 - DNA, 23 bp, Homo sapiens
aatgtcctccagaagcctctggc

SEQ ID NO: 2508148 - DNA, 22 bp, Homo sapiens
aatgtctagttgtaacaccatg

SEQ ID NO: 2508149 - DNA, 17 bp, Homo sapiens
aatgtctgttaacttaa

SEQ ID NO: 2508150 - DNA, 17 bp, Homo sapiens
aatgtcttcatttcatt

SEQ ID NO: 2508151 - DNA, 20 bp, Homo sapiens
aatgtcttgatgcatgcact

SEQ ID NO: 2508152 - DNA, 13 bp, Homo sapiens
aatgtcttttgaa

SEQ ID NO: 2508153 - DNA, 21 bp, Homo sapiens
aatgtcttttttttaatgtgc

SEQ ID NO: 2508154 - DNA, 22 bp, Homo sapiens
aatgtcttttttttaatgtgct

SEQ ID NO: 2508155 - DNA, 19 bp, Homo sapiens
aatgtgaaaagaaaaatga

SEQ ID NO: 2508156 - DNA, 14 bp, Homo sapiens
aatgtgaaactgga

SEQ ID NO: 2508157 - DNA, 15 bp, Homo sapiens
aatgtgaaactggat

SEQ ID NO: 2508158 - DNA, 22 bp, Homo sapiens
aatgtgaaactggattaaactt

SEQ ID NO: 2508159 - DNA, 15 bp, Homo sapiens
aatgtgaccaggggt

SEQ ID NO: 2508160 - DNA, 11 bp, Homo sapiens
aatgtgatatg

SEQ ID NO: 2508161 - DNA, 12 bp, Homo sapiens
aatgtgatgaat

SEQ ID NO: 2508162 - DNA, 19 bp, Homo sapiens
aatgtgattctaatgtctt

SEQ ID NO: 2508163 - DNA, 22 bp, Homo sapiens
aatgtgattctaatgtcttcat

SEQ ID NO: 2508164 - DNA, 16 bp, Homo sapiens
aatgtgatttttctga

SEQ ID NO: 2508165 - DNA, 19 bp, Homo sapiens
aatgtgctactgattgttt

SEQ ID NO: 2508166 - DNA, 13 bp, Homo sapiens
aatgtgctgtgta

SEQ ID NO: 2508167 - DNA, 19 bp, Homo sapiens
aatgtgctgtgtaaagtta

SEQ ID NO: 2508168 - DNA, 20 bp, Homo sapiens
aatgtgctgtgtaaagttag

SEQ ID NO: 2508169 - DNA, 20 bp, Homo sapiens
aatgtggcctaaaaatgcaa

SEQ ID NO: 2508170 - DNA, 16 bp, Homo sapiens
aatgttaaaatgtatt

SEQ ID NO: 2508171 - DNA, 18 bp, Homo sapiens
aatgttaaggaaactctt

SEQ ID NO: 2508172 - DNA, 23 bp, Homo sapiens
aatgttaattcagcactgatttc

SEQ ID NO: 2508173 - DNA, 19 bp, Homo sapiens
aatgttactgatcatgcat

SEQ ID NO: 2508174 - DNA, 21 bp, Homo sapiens
aatgttatttgttattttcag

SEQ ID NO: 2508175 - DNA, 23 bp, Homo sapiens
aatgttatttgttattttcagta

SEQ ID NO: 2508176 - DNA, 20 bp, Homo sapiens
aatgttattttttaattatt

SEQ ID NO: 2508177 - DNA, 21 bp, Homo sapiens
aatgttattttttaattatta

SEQ ID NO: 2508178 - DNA, 16 bp, Homo sapiens
aatgttcatcaatgaa

SEQ ID NO: 2508179 - DNA, 17 bp, Homo sapiens
aatgttcattgtaatgt

SEQ ID NO: 2508180 - DNA, 24 bp, Homo sapiens
aatgttcattgtaatgttactgat

SEQ ID NO: 2508181 - DNA, 14 bp, Homo sapiens
aatgttgaattttg

SEQ ID NO: 2508182 - DNA, 22 bp, Homo sapiens
aatgttgggactgctaaataaa

SEQ ID NO: 2508183 - DNA, 23 bp, Homo sapiens
aatgttggtcattttatgttaag

SEQ ID NO: 2508184 - DNA, 17 bp, Homo sapiens
aatgttgtattcagtga

SEQ ID NO: 2508185 - DNA, 21 bp, Homo sapiens
aatgttgttcattattggagg

SEQ ID NO: 2508186 - DNA, 14 bp, Homo sapiens
aatgtttaatgctg

SEQ ID NO: 2508187 - DNA, 20 bp, Homo sapiens
aatgtttacactctttgtaa

SEQ ID NO: 2508188 - DNA, 20 bp, Homo sapiens
aatgtttagcaaatacatat

SEQ ID NO: 2508189 - DNA, 22 bp, Homo sapiens
aatgtttatgagccagacaaat

SEQ ID NO: 2508190 - DNA, 23 bp, Homo sapiens
aatgtttatgcaaggaaggaaag

SEQ ID NO: 2508191 - DNA, 16 bp, Homo sapiens
aatgtttattccttga

SEQ ID NO: 2508192 - DNA, 18 bp, Homo sapiens
aatgtttgcctctgcctc

SEQ ID NO: 2508193 - DNA, 18 bp, Homo sapiens
aatgtttgggcagaaggg

SEQ ID NO: 2508194 - DNA, 23 bp, Homo sapiens
aatgtttgggcagaagggagaag

SEQ ID NO: 2508195 - DNA, 13 bp, Homo sapiens
aatgtttttctat

SEQ ID NO: 2508196 - DNA, 13 bp, Homo sapiens
aattaaaactgaa

SEQ ID NO: 2508197 - DNA, 12 bp, Homo sapiens
aattaaacggat

SEQ ID NO: 2508198 - DNA, 13 bp, Homo sapiens
aattaaacggatt

SEQ ID NO: 2508199 - DNA, 23 bp, Homo sapiens
aattaaacggattattttttcag

SEQ ID NO: 2508200 - DNA, 20 bp, Homo sapiens
aattaacattgggaaatctt

SEQ ID NO: 2508201 - DNA, 20 bp, Homo sapiens
aattaacttttataaacttt

SEQ ID NO: 2508202 - DNA, 22 bp, Homo sapiens
aattaacttttataaactttac

SEQ ID NO: 2508203 - DNA, 16 bp, Homo sapiens
aattaaggattttatg

SEQ ID NO: 2508204 - DNA, 13 bp, Homo sapiens
aattaagtatctg

SEQ ID NO: 2508205 - DNA, 19 bp, Homo sapiens
aattaatgaaatatctgta

SEQ ID NO: 2508206 - DNA, 15 bp, Homo sapiens
aattaccaacctgtt

SEQ ID NO: 2508207 - DNA, 15 bp, Homo sapiens
aattactacaaaatt

SEQ ID NO: 2508208 - DNA, 17 bp, Homo sapiens
aattaggaagtgattat

SEQ ID NO: 2508209 - DNA, 22 bp, Homo sapiens
aattaggaagtgtaacagctga

SEQ ID NO: 2508210 - DNA, 16 bp, Homo sapiens
aattaggttttgtaca

SEQ ID NO: 2508211 - DNA, 18 bp, Homo sapiens
aattagtggcacttgctt

SEQ ID NO: 2508212 - DNA, 17 bp, Homo sapiens
aattataagaggctgat

SEQ ID NO: 2508213 - DNA, 22 bp, Homo sapiens
aattatatcagtcctctttcaa

SEQ ID NO: 2508214 - DNA, 13 bp, Homo sapiens
aattatgacagtt

SEQ ID NO: 2508215 - DNA, 19 bp, Homo sapiens
aattatgagttatttttat

SEQ ID NO: 2508216 - DNA, 19 bp, Homo sapiens
aattatgccttttttgatc

SEQ ID NO: 2508217 - DNA, 18 bp, Homo sapiens
aattatgtttatataaat

SEQ ID NO: 2508218 - DNA, 16 bp, Homo sapiens
aattattaatgaaaat

SEQ ID NO: 2508219 - DNA, 16 bp, Homo sapiens
aattattatttatata

SEQ ID NO: 2508220 - DNA, 12 bp, Homo sapiens
aattattatttg

SEQ ID NO: 2508221 - DNA, 18 bp, Homo sapiens
aattattatttgtgtttt

SEQ ID NO: 2508222 - DNA, 12 bp, Homo sapiens
aattattgtaca

SEQ ID NO: 2508223 - DNA, 12 bp, Homo sapiens
aattattgtata

SEQ ID NO: 2508224 - DNA, 22 bp, Homo sapiens
aattatttattaaatgcccagc

SEQ ID NO: 2508225 - DNA, 18 bp, Homo sapiens
aattatttattattaaga

SEQ ID NO: 2508226 - DNA, 19 bp, Homo sapiens
aattatttatttaataaca

SEQ ID NO: 2508227 - DNA, 12 bp, Homo sapiens
aattatttgcat

SEQ ID NO: 2508228 - DNA, 14 bp, Homo sapiens
aattattttaaaca

SEQ ID NO: 2508229 - DNA, 18 bp, Homo sapiens
aattattttggattttgt

SEQ ID NO: 2508230 - DNA, 19 bp, Homo sapiens
aattattttggtactttta

SEQ ID NO: 2508231 - DNA, 14 bp, Homo sapiens
aattcaaaaagtgt

SEQ ID NO: 2508232 - DNA, 16 bp, Homo sapiens
aattcaaaaagtgttt

SEQ ID NO: 2508233 - DNA, 21 bp, Homo sapiens
aattcaaccactgtaaaatga

SEQ ID NO: 2508234 - DNA, 21 bp, Homo sapiens
aattcaccccctttcctggac

SEQ ID NO: 2508235 - DNA, 20 bp, Homo sapiens
aattcagcactgatttcaca

SEQ ID NO: 2508236 - DNA, 16 bp, Homo sapiens
aattcagtgctgtact

SEQ ID NO: 2508237 - DNA, 23 bp, Homo sapiens
aattcatcaaatggaagacacat

SEQ ID NO: 2508238 - DNA, 14 bp, Homo sapiens
aattcatgtttctt

SEQ ID NO: 2508239 - DNA, 14 bp, Homo sapiens
aattccaaaggaat

SEQ ID NO: 2508240 - DNA, 23 bp, Homo sapiens
aattccaaggagttccatgaaga

SEQ ID NO: 2508241 - DNA, 16 bp, Homo sapiens
aattccaatatgatga

SEQ ID NO: 2508242 - DNA, 16 bp, Homo sapiens
aattccacaccctcac

SEQ ID NO: 2508243 - DNA, 14 bp, Homo sapiens
aattccactggact

SEQ ID NO: 2508244 - DNA, 14 bp, Homo sapiens
aattccactgtcaa

SEQ ID NO: 2508245 - DNA, 10 bp, Homo sapiens
aattccatga

SEQ ID NO: 2508246 - DNA, 14 bp, Homo sapiens
aattccccaccctg

SEQ ID NO: 2508247 - DNA, 13 bp, Homo sapiens
aattccctgctgt

SEQ ID NO: 2508248 - DNA, 18 bp, Homo sapiens
aattcctattgtgatttg

SEQ ID NO: 2508249 - DNA, 22 bp, Homo sapiens
aattcctattgtgatttgactg

SEQ ID NO: 2508250 - DNA, 21 bp, Homo sapiens
aattcctgtagcatcttctgg

SEQ ID NO: 2508251 - DNA, 13 bp, Homo sapiens
aattccttagctt

SEQ ID NO: 2508252 - DNA, 16 bp, Homo sapiens
aattccttcagggtga

SEQ ID NO: 2508253 - DNA, 23 bp, Homo sapiens
aattccttcagggtgatgccagg

SEQ ID NO: 2508254 - DNA, 19 bp, Homo sapiens
aattccttttctaactctc

SEQ ID NO: 2508255 - DNA, 23 bp, Homo sapiens
aattcgaaccaggaaatggaacc

SEQ ID NO: 2508256 - DNA, 23 bp, Homo sapiens
aattctaggcatcccaggggacc

SEQ ID NO: 2508257 - DNA, 13 bp, Homo sapiens
aattctcatgtga

SEQ ID NO: 2508258 - DNA, 16 bp, Homo sapiens
aattctcatgtgatcc

SEQ ID NO: 2508259 - DNA, 20 bp, Homo sapiens
aattctcatgtgatcctttt

SEQ ID NO: 2508260 - DNA, 15 bp, Homo sapiens
aattctctagtttga

SEQ ID NO: 2508261 - DNA, 17 bp, Homo sapiens
aattctctagtttgatt

SEQ ID NO: 2508262 - DNA, 19 bp, Homo sapiens
aattctgctacctcactgg

SEQ ID NO: 2508263 - DNA, 12 bp, Homo sapiens
aattctgtacat

SEQ ID NO: 2508264 - DNA, 12 bp, Homo sapiens
aattctgtttct

SEQ ID NO: 2508265 - DNA, 16 bp, Homo sapiens
aattctgtttcttgag

SEQ ID NO: 2508266 - DNA, 21 bp, Homo sapiens
aattctgttttaggttaaaaa

SEQ ID NO: 2508267 - DNA, 13 bp, Homo sapiens
aatcctcttcctc

SEQ ID NO: 2508268 - DNA, 15 bp, Homo sapiens
aatcctcttcctctg

SEQ ID NO: 2508269 - DNA, 12 bp, Homo sapiens
aatcctgtcttt

SEQ ID NO: 2508270 - DNA, 21 bp, Homo sapiens
aatcgcttaaagatgttccta

SEQ ID NO: 2508271 - DNA, 15 bp, Homo sapiens
aatcgttatgtgtgt

SEQ ID NO: 2508272 - DNA, 18 bp, Homo sapiens
aatcgttatgtgtgtata

SEQ ID NO: 2508273 - DNA, 15 bp, Homo sapiens
aatctaaatggaacc

SEQ ID NO: 2508274 - DNA, 19 bp, Homo sapiens
aatctaatattaaaaatat

SEQ ID NO: 2508275 - DNA, 20 bp, Homo sapiens
aatctatctgcttatgcagt

SEQ ID NO: 2508276 - DNA, 20 bp, Homo sapiens
aatctatgaagtatataatg

SEQ ID NO: 2508277 - DNA, 13 bp, Homo sapiens
aatctattcagac

SEQ ID NO: 2508278 - DNA, 11 bp, Homo sapiens
aatctatttaa

SEQ ID NO: 2508279 - DNA, 15 bp, Homo sapiens
aatctcaaataacta

SEQ ID NO: 2508280 - DNA, 12 bp, Homo sapiens
aatctcaaattt

SEQ ID NO: 2508281 - DNA, 18 bp, Homo sapiens
aatctcctcttttatctt

SEQ ID NO: 2508282 - DNA, 16 bp, Homo sapiens
aatctcgtttcaaaaa

SEQ ID NO: 2508283 - DNA, 19 bp, Homo sapiens
aatctcgtttcaaaaacac

SEQ ID NO: 2508284 - DNA, 22 bp, Homo sapiens
aatctgatttgttttcctctta

SEQ ID NO: 2508285 - DNA, 24 bp, Homo sapiens
aatctggaccccatctgtgaataa

SEQ ID NO: 2508286 - DNA, 17 bp, Homo sapiens
aatctggactcctctgt

SEQ ID NO: 2508287 - DNA, 15 bp, Homo sapiens
aatctgtaaactgtg

SEQ ID NO: 2508288 - DNA, 22 bp, Homo sapiens
aatctgtagggctggacctatg

SEQ ID NO: 2508289 - DNA, 21 bp, Homo sapiens
aatctgtccaaaggaggctgg

SEQ ID NO: 2508290 - DNA, 20 bp, Homo sapiens
aatctgtgtacaaagaaata

SEQ ID NO: 2508291 - DNA, 14 bp, Homo sapiens
aatcttacagctgg

SEQ ID NO: 2508292 - DNA, 20 bp, Homo sapiens
aatcttcagttttatcttta

SEQ ID NO: 2508293 - DNA, 15 bp, Homo sapiens
aatctttctttacct

SEQ ID NO: 2508294 - DNA, 15 bp, Homo sapiens
aatcttttcacaaat

SEQ ID NO: 2508295 - DNA, 17 bp, Homo sapiens
aatcttttcacaaataa

SEQ ID NO: 2508296 - DNA, 21 bp, Homo sapiens
aatcttttttagcataaaatt

SEQ ID NO: 2508297 - DNA, 17 bp, Homo sapiens
aatgaaaaatttaagca

SEQ ID NO: 2508298 - DNA, 18 bp, Homo sapiens
aatgaaaaatttaagcat

SEQ ID NO: 2508299 - DNA, 17 bp, Homo sapiens
aatgaaaagctgaatcc

SEQ ID NO: 2508300 - DNA, 14 bp, Homo sapiens
aatgaaaataagaa

SEQ ID NO: 2508301 - DNA, 12 bp, Homo sapiens
aatgaaaatgtc

SEQ ID NO: 2508302 - DNA, 20 bp, Homo sapiens
aatgaaaatgtcagaaacca

SEQ ID NO: 2508303 - DNA, 15 bp, Homo sapiens
aatgaaaatgtcttg

SEQ ID NO: 2508304 - DNA, 16 bp, Homo sapiens
aatgaaagactgtaca

SEQ ID NO: 2508305 - DNA, 17 bp, Homo sapiens
aatgaaagactgtacaa

SEQ ID NO: 2508306 - DNA, 18 bp, Homo sapiens
aatgaaagactgtacaaa

SEQ ID NO: 2508307 - DNA, 20 bp, Homo sapiens
aatgaaagactgtacaaagt

SEQ ID NO: 2508308 - DNA, 15 bp, Homo sapiens
aatgaaagtttgcac

SEQ ID NO: 2508309 - DNA, 14 bp, Homo sapiens
aatgaaatatctgt

SEQ ID NO: 2508310 - DNA, 21 bp, Homo sapiens
aatgaaatcctgcttcagtgt

SEQ ID NO: 2508311 - DNA, 17 bp, Homo sapiens
aatgaaatgctctcctt

SEQ ID NO: 2508312 - DNA, 17 bp, Homo sapiens
aatgaaattactacaaa

SEQ ID NO: 2508313 - DNA, 16 bp, Homo sapiens
aatgaaccacatcttg

SEQ ID NO: 2508314 - DNA, 17 bp, Homo sapiens
aatgaaccacatcttgc

SEQ ID NO: 2508315 - DNA, 23 bp, Homo sapiens
aatgaaccacatcttgctctgct

SEQ ID NO: 2508316 - DNA, 17 bp, Homo sapiens
aatgaaccccactgggt

SEQ ID NO: 2508317 - DNA, 15 bp, Homo sapiens
aatgaactgaagttt

SEQ ID NO: 2508318 - DNA, 15 bp, Homo sapiens
aatgaagcagcttta

SEQ ID NO: 2508319 - DNA, 17 bp, Homo sapiens
aatgaagcagctttaaa

SEQ ID NO: 2508320 - DNA, 15 bp, Homo sapiens
aatgaagcttgtgta

SEQ ID NO: 2508321 - DNA, 16 bp, Homo sapiens
aatgaagcttgtgtat

SEQ ID NO: 2508322 - DNA, 17 bp, Homo sapiens
aatgaagcttgtgtatc

SEQ ID NO: 2508323 - DNA, 22 bp, Homo sapiens
aatgaagcttgtgtatccatta

SEQ ID NO: 2508324 - DNA, 15 bp, Homo sapiens
aatgaatgaatgaat

SEQ ID NO: 2508325 - DNA, 12 bp, Homo sapiens
aatgaatgacct

SEQ ID NO: 2508326 - DNA, 19 bp, Homo sapiens
aatgaatggactcaaactg

SEQ ID NO: 2508327 - DNA, 22 bp, Homo sapiens
aatgaatggctaagcaaaatgt

SEQ ID NO: 2508328 - DNA, 23 bp, Homo sapiens
aatgaatgtttacactctttgta

SEQ ID NO: 2508329 - DNA, 17 bp, Homo sapiens
aatgaattaaataaacc

SEQ ID NO: 2508330 - DNA, 14 bp, Homo sapiens
aatgacaacagaag

SEQ ID NO: 2508331 - DNA, 16 bp, Homo sapiens
aatgacaacagaagct

SEQ ID NO: 2508332 - DNA, 13 bp, Homo sapiens
aatgacacagtct

SEQ ID NO: 2508333 - DNA, 13 bp, Homo sapiens
aatgacatcttca

SEQ ID NO: 2508334 - DNA, 15 bp, Homo sapiens
aatgacattttgcca

SEQ ID NO: 2508335 - DNA, 14 bp, Homo sapiens
aatgaccaatatta

SEQ ID NO: 2508336 - DNA, 20 bp, Homo sapiens
aatgactaaaaaacaaagaa

SEQ ID NO: 2508337 - DNA, 20 bp, Homo sapiens
aatgactcaggacatccccc

SEQ ID NO: 2508338 - DNA, 14 bp, Homo sapiens
aatgagaaccaaca

SEQ ID NO: 2508339 - DNA, 17 bp, Homo sapiens
aatgagaaggaatttga

SEQ ID NO: 2508340 - DNA, 18 bp, Homo sapiens
aatgagagaataagtcat

SEQ ID NO: 2508341 - DNA, 17 bp, Homo sapiens
aatgagatcccgcctct

SEQ ID NO: 2508342 - DNA, 21 bp, Homo sapiens
aatgagcctacgctgaagatg

SEQ ID NO: 2508343 - DNA, 13 bp, Homo sapiens
aatgagcctggca

SEQ ID NO: 2508344 - DNA, 15 bp, Homo sapiens
aatgagcctggcaag

SEQ ID NO: 2508345 - DNA, 16 bp, Homo sapiens
aatgaggacatgtttt

SEQ ID NO: 2508346 - DNA, 15 bp, Homo sapiens
aatgaggcttgctga

SEQ ID NO: 2508347 - DNA, 16 bp, Homo sapiens
aatgaggtctgaaatg

SEQ ID NO: 2508348 - DNA, 19 bp, Homo sapiens
aatgaggtctgaaatggag

SEQ ID NO: 2508349 - DNA, 17 bp, Homo sapiens
aatgatatatggataat

SEQ ID NO: 2508350 - DNA, 16 bp, Homo sapiens
aatgatcataagtcta

SEQ ID NO: 2508351 - DNA, 20 bp, Homo sapiens
aatgatccccagctgtttat

SEQ ID NO: 2508352 - DNA, 13 bp, Homo sapiens
aatgatctaggtt

SEQ ID NO: 2508353 - DNA, 22 bp, Homo sapiens
aatgatctaggtttaactcaga

SEQ ID NO: 2508354 - DNA, 21 bp, Homo sapiens
aatgatgatcctaggcatttg

SEQ ID NO: 2508355 - DNA, 19 bp, Homo sapiens
aatgatggcaattttgtaa

SEQ ID NO: 2508356 - DNA, 14 bp, Homo sapiens
aatgatgtccagaa

SEQ ID NO: 2508357 - DNA, 14 bp, Homo sapiens
aatgattcagtgtt

SEQ ID NO: 2508358 - DNA, 20 bp, Homo sapiens
aatgattgtaaaatagcttg

SEQ ID NO: 2508359 - DNA, 13 bp, Homo sapiens
aatgatttcatgc

SEQ ID NO: 2508360 - DNA, 16 bp, Homo sapiens
aatgatttcattcaat

SEQ ID NO: 2508361 - DNA, 14 bp, Homo sapiens
aatgatttttagat

SEQ ID NO: 2508362 - DNA, 17 bp, Homo sapiens
aatgcacacaaaacaac

SEQ ID NO: 2508363 - DNA, 17 bp, Homo sapiens
aatgcacactagcctct

SEQ ID NO: 2508364 - DNA, 13 bp, Homo sapiens
aatgcactttcta

SEQ ID NO: 2508365 - DNA, 13 bp, Homo sapiens
aatgcactttgtt

SEQ ID NO: 2508366 - DNA, 16 bp, Homo sapiens
aatgcactttgttctg

SEQ ID NO: 2508367 - DNA, 12 bp, Homo sapiens
aatgcagccaga

SEQ ID NO: 2508368 - DNA, 22 bp, Homo sapiens
aatgcagggattgctgccactt

SEQ ID NO: 2508369 - DNA, 14 bp, Homo sapiens
aatgcataaatgca

SEQ ID NO: 2508370 - DNA, 17 bp, Homo sapiens
aatgccatcctcaaaca

SEQ ID NO: 2508371 - DNA, 16 bp, Homo sapiens
aatgccattatccctg

SEQ ID NO: 2508372 - DNA, 11 bp, Homo sapiens
aatgcccagcc

SEQ ID NO: 2508373 - DNA, 20 bp, Homo sapiens
aatgcccagccccttctgac

SEQ ID NO: 2508374 - DNA, 24 bp, Homo sapiens
aatgcccagccccttctgacccat

SEQ ID NO: 2508375 - DNA, 18 bp, Homo sapiens
aatgcccgtaatgcttag

SEQ ID NO: 2508376 - DNA, 16 bp, Homo sapiens
aatgcccttaaatcat

SEQ ID NO: 2508377 - DNA, 20 bp, Homo sapiens
aatgcctcaatgtgaccagg

SEQ ID NO: 2508378 - DNA, 13 bp, Homo sapiens
aatgcctttgaga

SEQ ID NO: 2508379 - DNA, 14 bp, Homo sapiens
aatgcctttgagac

SEQ ID NO: 2508380 - DNA, 18 bp, Homo sapiens
aatgcctttgagacagtt

SEQ ID NO: 2508381 - DNA, 20 bp, Homo sapiens
aatgcctttgagacagtttc

SEQ ID NO: 2508382 - DNA, 23 bp, Homo sapiens
aatgcctttgagacagtttctta

SEQ ID NO: 2508383 - DNA, 19 bp, Homo sapiens
aatgcgtgcataccacttt

SEQ ID NO: 2508384 - DNA, 18 bp, Homo sapiens
aatgctaaagaaaaagtc

SEQ ID NO: 2508385 - DNA, 20 bp, Homo sapiens
aatgctattttttattttac

SEQ ID NO: 2508386 - DNA, 23 bp, Homo sapiens
aatgctctttacttcatggactt

SEQ ID NO: 2508387 - DNA, 22 bp, Homo sapiens
aatgctggctgttggctggggg

SEQ ID NO: 2508388 - DNA, 18 bp, Homo sapiens
aatgctggttttcctaaa

SEQ ID NO: 2508389 - DNA, 21 bp, Homo sapiens
aatgcttctgacttcatagat

SEQ ID NO: 2508390 - DNA, 13 bp, Homo sapiens
aatgcttttaaaa

SEQ ID NO: 2508391 - DNA, 14 bp, Homo sapiens
aatgctttttgaat

SEQ ID NO: 2508392 - DNA, 20 bp, Homo sapiens
aatggaaatgggcagagcag

SEQ ID NO: 2508393 - DNA, 13 bp, Homo sapiens
aatggaagacaca

SEQ ID NO: 2508394 - DNA, 14 bp, Homo sapiens
aatggaagacacat

SEQ ID NO: 2508395 - DNA, 20 bp, Homo sapiens
aatggaaggtttgtatattg

SEQ ID NO: 2508396 - DNA, 20 bp, Homo sapiens
aatggagatttgaaggtctg

SEQ ID NO: 2508397 - DNA, 15 bp, Homo sapiens
aatggaggaatatga

SEQ ID NO: 2508398 - DNA, 17 bp, Homo sapiens
aatggaggccattgtgt

SEQ ID NO: 2508399 - DNA, 18 bp, Homo sapiens
aatggattggattattta

SEQ ID NO: 2508400 - DNA, 20 bp, Homo sapiens
aatggattggattatttaat

SEQ ID NO: 2508401 - DNA, 21 bp, Homo sapiens
aatggatttgatgctgtttga

SEQ ID NO: 2508402 - DNA, 17 bp, Homo sapiens
aatggccatttgctttt

SEQ ID NO: 2508403 - DNA, 16 bp, Homo sapiens
aatggccggctggaaa

SEQ ID NO: 2508404 - DNA, 15 bp, Homo sapiens
aatggctcagatgcc

SEQ ID NO: 2508405 - DNA, 22 bp, Homo sapiens
aatggcttatccagctggtgag

SEQ ID NO: 2508406 - DNA, 21 bp, Homo sapiens
aatgggacttcttttcacatt

SEQ ID NO: 2508407 - DNA, 12 bp, Homo sapiens
aatgggcacagc

SEQ ID NO: 2508408 - DNA, 23 bp, Homo sapiens
aatgggcactgggatgagccgct

SEQ ID NO: 2508409 - DNA, 15 bp, Homo sapiens
aatgggcagagcaga

SEQ ID NO: 2508410 - DNA, 18 bp, Homo sapiens
aatgggcagttacatgca

SEQ ID NO: 2508411 - DNA, 22 bp, Homo sapiens
aatgggcagttacatgcatact

SEQ ID NO: 2508412 - DNA, 15 bp, Homo sapiens
aatgggggtgcattt

SEQ ID NO: 2508413 - DNA, 17 bp, Homo sapiens
aatgggggtgcatttga

SEQ ID NO: 2508414 - DNA, 15 bp, Homo sapiens
aatggtaccagataa

SEQ ID NO: 2508415 - DNA, 15 bp, Homo sapiens
aatggtatgagctga

SEQ ID NO: 2508416 - DNA, 18 bp, Homo sapiens
aatggtatgagctgaggg

SEQ ID NO: 2508417 - DNA, 14 bp, Homo sapiens
aatggtccagggtt

SEQ ID NO: 2508418 - DNA, 19 bp, Homo sapiens
aatggtgttgtatgccttt

SEQ ID NO: 2508419 - DNA, 19 bp, Homo sapiens
aatactgccagatgctgat

SEQ ID NO: 2508420 - DNA, 23 bp, Homo sapiens
aatactgccagatgctgatgttc

SEQ ID NO: 2508421 - DNA, 24 bp, Homo sapiens
aatactgccagatgctgatgttca

SEQ ID NO: 2508422 - DNA, 17 bp, Homo sapiens
aatacttctcaaacctg

SEQ ID NO: 2508423 - DNA, 18 bp, Homo sapiens
aatacttgtcaatattta

SEQ ID NO: 2508424 - DNA, 18 bp, Homo sapiens
aatagaaaactgaaaatc

SEQ ID NO: 2508425 - DNA, 20 bp, Homo sapiens
aatagacagtatatttatag

SEQ ID NO: 2508426 - DNA, 15 bp, Homo sapiens
aatagagtatatgca

SEQ ID NO: 2508427 - DNA, 22 bp, Homo sapiens
aatagagtttgctattagagca

SEQ ID NO: 2508428 - DNA, 15 bp, Homo sapiens
aatagattatagttg

SEQ ID NO: 2508429 - DNA, 19 bp, Homo sapiens
aatagctctttcagggggg

SEQ ID NO: 2508430 - DNA, 13 bp, Homo sapiens
aatagctgggact

SEQ ID NO: 2508431 - DNA, 21 bp, Homo sapiens
aatagctttaccctcaggcat

SEQ ID NO: 2508432 - DNA, 17 bp, Homo sapiens
aatagcttttattgtat

SEQ ID NO: 2508433 - DNA, 20 bp, Homo sapiens
aataggagaggatgagagcc

SEQ ID NO: 2508434 - DNA, 23 bp, Homo sapiens
aataggagaggatgagagcccag

SEQ ID NO: 2508435 - DNA, 14 bp, Homo sapiens
aatagtatcctcca

SEQ ID NO: 2508436 - DNA, 15 bp, Homo sapiens
aatagtatcctccag

SEQ ID NO: 2508437 - DNA, 13 bp, Homo sapiens
aatagtatttatg

SEQ ID NO: 2508438 - DNA, 13 bp, Homo sapiens
aatagtcaagaaa

SEQ ID NO: 2508439 - DNA, 13 bp, Homo sapiens
aatagtctgtgtg

SEQ ID NO: 2508440 - DNA, 13 bp, Homo sapiens
aatagtgaaatga

SEQ ID NO: 2508441 - DNA, 15 bp, Homo sapiens
aatagtgaaatgaat

SEQ ID NO: 2508442 - DNA, 19 bp, Homo sapiens
aatagtgcagaatctcata

SEQ ID NO: 2508443 - DNA, 22 bp, Homo sapiens
aatagtgctcgctttctatgta

SEQ ID NO: 2508444 - DNA, 19 bp, Homo sapiens
aatagtgtggaaattaaga

SEQ ID NO: 2508445 - DNA, 13 bp, Homo sapiens
aatagtgtgttct

SEQ ID NO: 2508446 - DNA, 17 bp, Homo sapiens
aatagtgtgttctgatt

SEQ ID NO: 2508447 - DNA, 21 bp, Homo sapiens
aatagtgtgttctgattagaa

SEQ ID NO: 2508448 - DNA, 15 bp, Homo sapiens
aatagtgttaatcaa

SEQ ID NO: 2508449 - DNA, 16 bp, Homo sapiens
aatagtgttaatcaat

SEQ ID NO: 2508450 - DNA, 19 bp, Homo sapiens
aatagtgttaatcaattta

SEQ ID NO: 2508451 - DNA, 20 bp, Homo sapiens
aatagttactccagtgccaa

SEQ ID NO: 2508452 - DNA, 22 bp, Homo sapiens
aatagttcaaagccaagtttat

SEQ ID NO: 2508453 - DNA, 21 bp, Homo sapiens
aatagttcaggtaacaggcag

SEQ ID NO: 2508454 - DNA, 19 bp, Homo sapiens
aatagtttacatgtagtag

SEQ ID NO: 2508455 - DNA, 14 bp, Homo sapiens
aatataaaatatga

SEQ ID NO: 2508456 - DNA, 13 bp, Homo sapiens
aatataaacacta

SEQ ID NO: 2508457 - DNA, 14 bp, Homo sapiens
aatataaacactat

SEQ ID NO: 2508458 - DNA, 21 bp, Homo sapiens
aatataacttaaaaatgtaaa

SEQ ID NO: 2508459 - DNA, 18 bp, Homo sapiens
aatataaggaaagcaata

SEQ ID NO: 2508460 - DNA, 14 bp, Homo sapiens
aatataatactgta

SEQ ID NO: 2508461 - DNA, 14 bp, Homo sapiens
aatataattatcgg

SEQ ID NO: 2508462 - DNA, 13 bp, Homo sapiens
aatataattctgt

SEQ ID NO: 2508463 - DNA, 19 bp, Homo sapiens
aatataccccttagtgttt

SEQ ID NO: 2508464 - DNA, 11 bp, Homo sapiens
aatatactgta

SEQ ID NO: 2508465 - DNA, 14 bp, Homo sapiens
aatatactgtaaag

SEQ ID NO: 2508466 - DNA, 16 bp, Homo sapiens
aatatactgtaaagaa

SEQ ID NO: 2508467 - DNA, 18 bp, Homo sapiens
aatatactgtaaagaaag

SEQ ID NO: 2508468 - DNA, 14 bp, Homo sapiens
aatatagaaacacg

SEQ ID NO: 2508469 - DNA, 18 bp, Homo sapiens
aatataggaacttaaata

SEQ ID NO: 2508470 - DNA, 18 bp, Homo sapiens
aatatataaaaagaaaag

SEQ ID NO: 2508471 - DNA, 21 bp, Homo sapiens
aatatataaaaagaaaagata

SEQ ID NO: 2508472 - DNA, 16 bp, Homo sapiens
aatatatcccagaaat

SEQ ID NO: 2508473 - DNA, 22 bp, Homo sapiens
aatatatcccagaaattagaaa

SEQ ID NO: 2508474 - DNA, 21 bp, Homo sapiens
aatatatctaaattgaataat

SEQ ID NO: 2508475 - DNA, 13 bp, Homo sapiens
aatatattataat

SEQ ID NO: 2508476 - DNA, 19 bp, Homo sapiens
aatatatttaagataatta

SEQ ID NO: 2508477 - DNA, 19 bp, Homo sapiens
aatatatttttatatttag

SEQ ID NO: 2508478 - DNA, 13 bp, Homo sapiens
aatatcagacttt

SEQ ID NO: 2508479 - DNA, 17 bp, Homo sapiens
aatatctgaaaatgtat

SEQ ID NO: 2508480 - DNA, 19 bp, Homo sapiens
aatatctgaaaatgtatgt

SEQ ID NO: 2508481 - DNA, 22 bp, Homo sapiens
aatatctgtatttaattttgac

SEQ ID NO: 2508482 - DNA, 16 bp, Homo sapiens
aatatgagaatcagat

SEQ ID NO: 2508483 - DNA, 18 bp, Homo sapiens
aatatgattagtaaagaa

SEQ ID NO: 2508484 - DNA, 19 bp, Homo sapiens
aatatgcctctcctttgta

SEQ ID NO: 2508485 - DNA, 10 bp, Homo sapiens
aatatgctta

SEQ ID NO: 2508486 - DNA, 20 bp, Homo sapiens
aatatggaacttctaatata

SEQ ID NO: 2508487 - DNA, 17 bp, Homo sapiens
aatatggactcagtttt

SEQ ID NO: 2508488 - DNA, 13 bp, Homo sapiens
aatatgggagaaa

SEQ ID NO: 2508489 - DNA, 14 bp, Homo sapiens
aatatgtattgtaa

SEQ ID NO: 2508490 - DNA, 15 bp, Homo sapiens
aatatgtattgtaaa

SEQ ID NO: 2508491 - DNA, 16 bp, Homo sapiens
aatatgttagcaaaga

SEQ ID NO: 2508492 - DNA, 22 bp, Homo sapiens
aatattaaatacagacactaag

SEQ ID NO: 2508493 - DNA, 13 bp, Homo sapiens
aatattaagaaag

SEQ ID NO: 2508494 - DNA, 13 bp, Homo sapiens
aatattagaaaca

SEQ ID NO: 2508495 - DNA, 12 bp, Homo sapiens
aatattagatgt

SEQ ID NO: 2508496 - DNA, 22 bp, Homo sapiens
aatattatactaagaaaagata

SEQ ID NO: 2508497 - DNA, 16 bp, Homo sapiens
aatattctatatgaat

SEQ ID NO: 2508498 - DNA, 20 bp, Homo sapiens
aatattctatatgaatttaa

SEQ ID NO: 2508499 - DNA, 15 bp, Homo sapiens
aatattgaacttttt

SEQ ID NO: 2508500 - DNA, 20 bp, Homo sapiens
aatattgagaaagaaactaa

SEQ ID NO: 2508501 - DNA, 14 bp, Homo sapiens
aatattgtacagtt

SEQ ID NO: 2508502 - DNA, 17 bp, Homo sapiens
aatattgtacagttttt

SEQ ID NO: 2508503 - DNA, 23 bp, Homo sapiens
aatattgtacagtttttattgct

SEQ ID NO: 2508504 - DNA, 15 bp, Homo sapiens
aatatttaaacatgg

SEQ ID NO: 2508505 - DNA, 22 bp, Homo sapiens
aatatttaaacatggttacaat

SEQ ID NO: 2508506 - DNA, 20 bp, Homo sapiens
aatatttagcaaataatttc

SEQ ID NO: 2508507 - DNA, 17 bp, Homo sapiens
aatatttatatttcact

SEQ ID NO: 2508508 - DNA, 18 bp, Homo sapiens
aatatttatatttcacta

SEQ ID NO: 2508509 - DNA, 12 bp, Homo sapiens
aatatttattac

SEQ ID NO: 2508510 - DNA, 16 bp, Homo sapiens
aatatttattacctct

SEQ ID NO: 2508511 - DNA, 12 bp, Homo sapiens
aatatttattat

SEQ ID NO: 2508512 - DNA, 19 bp, Homo sapiens
aatatttattattttcacc

SEQ ID NO: 2508513 - DNA, 20 bp, Homo sapiens
aatatttattattttcacct

SEQ ID NO: 2508514 - DNA, 11 bp, Homo sapiens
aatatttattt

SEQ ID NO: 2508515 - DNA, 12 bp, Homo sapiens
aatatttgtaca

SEQ ID NO: 2508516 - DNA, 14 bp, Homo sapiens
aatatttgtacata

SEQ ID NO: 2508517 - DNA, 11 bp, Homo sapiens
aatattttcat

SEQ ID NO: 2508518 - DNA, 15 bp, Homo sapiens
aatattttgaatcaa

SEQ ID NO: 2508519 - DNA, 22 bp, Homo sapiens
aatattttgaatcaataatata

SEQ ID NO: 2508520 - DNA, 17 bp, Homo sapiens
aatatttttaatatata

SEQ ID NO: 2508521 - DNA, 23 bp, Homo sapiens
aatatttttgaaaggcatgttcc

SEQ ID NO: 2508522 - DNA, 18 bp, Homo sapiens
aatcaaaactctcctaca

SEQ ID NO: 2508523 - DNA, 22 bp, Homo sapiens
aatcaaagcaatgcattttgga

SEQ ID NO: 2508524 - DNA, 14 bp, Homo sapiens
aatcaactctaata

SEQ ID NO: 2508525 - DNA, 13 bp, Homo sapiens
aatcaagagctgc

SEQ ID NO: 2508526 - DNA, 14 bp, Homo sapiens
aatcaagagctgcc

SEQ ID NO: 2508527 - DNA, 15 bp, Homo sapiens
aatcaagcttcagtt

SEQ ID NO: 2508528 - DNA, 17 bp, Homo sapiens
aatcaatgtcacttaaa

SEQ ID NO: 2508529 - DNA, 18 bp, Homo sapiens
aatcaatttaaacccatt

SEQ ID NO: 2508530 - DNA, 20 bp, Homo sapiens
aatcaccacaccaaacctct

SEQ ID NO: 2508531 - DNA, 15 bp, Homo sapiens
aatcacgtaaagcta

SEQ ID NO: 2508532 - DNA, 21 bp, Homo sapiens
aatcacgtaaagctagaaatg

SEQ ID NO: 2508533 - DNA, 11 bp, Homo sapiens
aatcagcctgc

SEQ ID NO: 2508534 - DNA, 13 bp, Homo sapiens
aatcagcctgctc

SEQ ID NO: 2508535 - DNA, 21 bp, Homo sapiens
aatcagtaatatttatatatt

SEQ ID NO: 2508536 - DNA, 17 bp, Homo sapiens
aatcagtataattctgt

SEQ ID NO: 2508537 - DNA, 13 bp, Homo sapiens
aatcagtcccctc

SEQ ID NO: 2508538 - DNA, 17 bp, Homo sapiens
aatcagtcccctcccat

SEQ ID NO: 2508539 - DNA, 17 bp, Homo sapiens
aatcagtctatccacag

SEQ ID NO: 2508540 - DNA, 17 bp, Homo sapiens
aatcataaactgtgtgc

SEQ ID NO: 2508541 - DNA, 15 bp, Homo sapiens
aatcatccaatgctc

SEQ ID NO: 2508542 - DNA, 18 bp, Homo sapiens
aatcatctataaagaaga

SEQ ID NO: 2508543 - DNA, 15 bp, Homo sapiens
aatcatctgtgtgaa

SEQ ID NO: 2508544 - DNA, 18 bp, Homo sapiens
aatcatctgtgtgaaaat

SEQ ID NO: 2508545 - DNA, 16 bp, Homo sapiens
aatcatgaaatatgca

SEQ ID NO: 2508546 - DNA, 14 bp, Homo sapiens
aatcatgtacattt

SEQ ID NO: 2508547 - DNA, 13 bp, Homo sapiens
aatcatgtagtat

SEQ ID NO: 2508548 - DNA, 18 bp, Homo sapiens
aatcatgtagtatcaaat

SEQ ID NO: 2508549 - DNA, 23 bp, Homo sapiens
aatcatgtagtatcaaatattag

SEQ ID NO: 2508550 - DNA, 15 bp, Homo sapiens
aatcattaggtgtga

SEQ ID NO: 2508551 - DNA, 17 bp, Homo sapiens
aatcattctcgatttaa

SEQ ID NO: 2508552 - DNA, 14 bp, Homo sapiens
aatcatttgctttt

SEQ ID NO: 2508553 - DNA, 11 bp, Homo sapiens
aatcatttgtt

SEQ ID NO: 2508554 - DNA, 17 bp, Homo sapiens
aatcattttaattatta

SEQ ID NO: 2508555 - DNA, 19 bp, Homo sapiens
aatcattttgcctcttttc

SEQ ID NO: 2508556 - DNA, 17 bp, Homo sapiens
aatccaacccatgatga

SEQ ID NO: 2508557 - DNA, 18 bp, Homo sapiens
aatccacaatctgacatt

SEQ ID NO: 2508558 - DNA, 13 bp, Homo sapiens
aatccagaaagaa

SEQ ID NO: 2508559 - DNA, 19 bp, Homo sapiens
aatccagacccggctgcgt

SEQ ID NO: 2508560 - DNA, 20 bp, Homo sapiens
aatcccaagatctgtgcagc

SEQ ID NO: 2508561 - DNA, 17 bp, Homo sapiens
aatcccacccacatgtg

SEQ ID NO: 2508562 - DNA, 20 bp, Homo sapiens
aatcccagcactttgggagg

SEQ ID NO: 2508563 - DNA, 18 bp, Homo sapiens
aatcccattcataacttt

SEQ ID NO: 2508564 - DNA, 21 bp, Homo sapiens
aatcccctccctgtcaaagct

SEQ ID NO: 2508565 - DNA, 18 bp, Homo sapiens
aatcccctccttgggcac

SEQ ID NO: 2508566 - DNA, 23 bp, Homo sapiens
aatccctggttttaagtatcaat

SEQ ID NO: 2508567 - DNA, 13 bp, Homo sapiens
aatccctgtttaa

SEQ ID NO: 2508568 - DNA, 14 bp, Homo sapiens
aatccctgtttaat

SEQ ID NO: 2508569 - DNA, 13 bp, Homo sapiens
aatccgaacctcc

SEQ ID NO: 2508570 - DNA, 15 bp, Homo sapiens
aatcctaaaagaagc

SEQ ID NO: 2508571 - DNA, 19 bp, Homo sapiens
aagtgcccctgctgcctcc

SEQ ID NO: 2508572 - DNA, 15 bp, Homo sapiens
aagtgcgtgtgtaga

SEQ ID NO: 2508573 - DNA, 14 bp, Homo sapiens
aagtgctgcattta

SEQ ID NO: 2508574 - DNA, 22 bp, Homo sapiens
aagtgctgcatttaaaagatac

SEQ ID NO: 2508575 - DNA, 21 bp, Homo sapiens
aagtgctggcaccaccaggca

SEQ ID NO: 2508576 - DNA, 20 bp, Homo sapiens
aagtggaccttgagaccaca

SEQ ID NO: 2508577 - DNA, 23 bp, Homo sapiens
aagtggactctttggtggctttg

SEQ ID NO: 2508578 - DNA, 20 bp, Homo sapiens
aagtggactggcccctgggt

SEQ ID NO: 2508579 - DNA, 14 bp, Homo sapiens
aagtggcctctttg

SEQ ID NO: 2508580 - DNA, 17 bp, Homo sapiens
aagtggcctctttgtct

SEQ ID NO: 2508581 - DNA, 20 bp, Homo sapiens
aagtggggttgcaaccactg

SEQ ID NO: 2508582 - DNA, 16 bp, Homo sapiens
aagtgtaatagattat

SEQ ID NO: 2508583 - DNA, 18 bp, Homo sapiens
aagtgtatttttttacta

SEQ ID NO: 2508584 - DNA, 24 bp, Homo sapiens
aagtgtcatatgtaggtgtctgca

SEQ ID NO: 2508585 - DNA, 21 bp, Homo sapiens
aagtgtgagtaagagctggtg

SEQ ID NO: 2508586 - DNA, 21 bp, Homo sapiens
aagtgtgattgggaataaata

SEQ ID NO: 2508587 - DNA, 10 bp, Homo sapiens
aagtgtgggt

SEQ ID NO: 2508588 - DNA, 19 bp, Homo sapiens
aagtgtggtcccaacagga

SEQ ID NO: 2508589 - DNA, 12 bp, Homo sapiens
aagtgtgtatgt

SEQ ID NO: 2508590 - DNA, 13 bp, Homo sapiens
aagtgtgtgtgcg

SEQ ID NO: 2508591 - DNA, 23 bp, Homo sapiens
aagtgttggctaatgaagggaaa

SEQ ID NO: 2508592 - DNA, 20 bp, Homo sapiens
aagtgttgtaaatatttatg

SEQ ID NO: 2508593 - DNA, 16 bp, Homo sapiens
aagtgtttatttttca

SEQ ID NO: 2508594 - DNA, 19 bp, Homo sapiens
aagtgtttatttttcatat

SEQ ID NO: 2508595 - DNA, 21 bp, Homo sapiens
aagtgtttatttttcatattg

SEQ ID NO: 2508596 - DNA, 18 bp, Homo sapiens
aagttaaacattgaagta

SEQ ID NO: 2508597 - DNA, 13 bp, Homo sapiens
aagttaacagaga

SEQ ID NO: 2508598 - DNA, 23 bp, Homo sapiens
aagttaagaatgttcttatgttg

SEQ ID NO: 2508599 - DNA, 19 bp, Homo sapiens
aagttaatccactgtgact

SEQ ID NO: 2508600 - DNA, 14 bp, Homo sapiens
aagttagctgagcg

SEQ ID NO: 2508601 - DNA, 23 bp, Homo sapiens
aagttagtctactcttaagccat

SEQ ID NO: 2508602 - DNA, 20 bp, Homo sapiens
aagttataaatcaatgtcac

SEQ ID NO: 2508603 - DNA, 19 bp, Homo sapiens
aagttattaatattttaat

SEQ ID NO: 2508604 - DNA, 15 bp, Homo sapiens
aagttattgcagttt

SEQ ID NO: 2508605 - DNA, 12 bp, Homo sapiens
aagttattgtac

SEQ ID NO: 2508606 - DNA, 14 bp, Homo sapiens
aagttccctacttc

SEQ ID NO: 2508607 - DNA, 17 bp, Homo sapiens
aagttccctacttcctg

SEQ ID NO: 2508608 - DNA, 20 bp, Homo sapiens
aagttccctacttcctgtga

SEQ ID NO: 2508609 - DNA, 14 bp, Homo sapiens
aagttcctttgggt

SEQ ID NO: 2508610 - DNA, 15 bp, Homo sapiens
aagttctgagtgttt

SEQ ID NO: 2508611 - DNA, 20 bp, Homo sapiens
aagttctggatgcatttctc

SEQ ID NO: 2508612 - DNA, 22 bp, Homo sapiens
aagttcttagttgctgtatgtc

SEQ ID NO: 2508613 - DNA, 20 bp, Homo sapiens
aagttgatatagaacagtgc

SEQ ID NO: 2508614 - DNA, 14 bp, Homo sapiens
aagttgatgcaatc

SEQ ID NO: 2508615 - DNA, 18 bp, Homo sapiens
aagttgcacggctgctga

SEQ ID NO: 2508616 - DNA, 18 bp, Homo sapiens
aagttgtgccttttatag

SEQ ID NO: 2508617 - DNA, 20 bp, Homo sapiens
aagttgtggtgctgacaaag

SEQ ID NO: 2508618 - DNA, 17 bp, Homo sapiens
aagttgttaactaaatt

SEQ ID NO: 2508619 - DNA, 15 bp, Homo sapiens
aagttgtttcattga

SEQ ID NO: 2508620 - DNA, 17 bp, Homo sapiens
aagttgtttgtcatctt

SEQ ID NO: 2508621 - DNA, 17 bp, Homo sapiens
aagtttaaagctcgaaa

SEQ ID NO: 2508622 - DNA, 14 bp, Homo sapiens
aagtttaaggaata

SEQ ID NO: 2508623 - DNA, 18 bp, Homo sapiens
aagtttacaagtgtatat

SEQ ID NO: 2508624 - DNA, 21 bp, Homo sapiens
aagtttacaagtgtatatcag

SEQ ID NO: 2508625 - DNA, 22 bp, Homo sapiens
aagtttcaatgtgattctaatg

SEQ ID NO: 2508626 - DNA, 20 bp, Homo sapiens
aagtttcactgacttagaac

SEQ ID NO: 2508627 - DNA, 15 bp, Homo sapiens
aagtttcaggtgaca

SEQ ID NO: 2508628 - DNA, 16 bp, Homo sapiens
aagtttcagttgattt

SEQ ID NO: 2508629 - DNA, 18 bp, Homo sapiens
aagtttccatatgttata

SEQ ID NO: 2508630 - DNA, 20 bp, Homo sapiens
aagtttccttggctggtgca

SEQ ID NO: 2508631 - DNA, 21 bp, Homo sapiens
aagtttctagctagaaatatg

SEQ ID NO: 2508632 - DNA, 23 bp, Homo sapiens
aagtttctagctagaaatatgat

SEQ ID NO: 2508633 - DNA, 22 bp, Homo sapiens
aagtttctcagatccttgtttc

SEQ ID NO: 2508634 - DNA, 23 bp, Homo sapiens
aagtttctcagatccttgtttca

SEQ ID NO: 2508635 - DNA, 14 bp, Homo sapiens
aagtttctcagctc

SEQ ID NO: 2508636 - DNA, 16 bp, Homo sapiens
aagtttgatttcatta

SEQ ID NO: 2508637 - DNA, 21 bp, Homo sapiens
aagttttaggacaaacagctc

SEQ ID NO: 2508638 - DNA, 11 bp, Homo sapiens
aagttttcagg

SEQ ID NO: 2508639 - DNA, 12 bp, Homo sapiens
aagttttgaaaa

SEQ ID NO: 2508640 - DNA, 20 bp, Homo sapiens
aagtttttatggcttttgtg

SEQ ID NO: 2508641 - DNA, 12 bp, Homo sapiens
aataaaaacaaa

SEQ ID NO: 2508642 - DNA, 19 bp, Homo sapiens
aataaaaactgactcctta

SEQ ID NO: 2508643 - DNA, 11 bp, Homo sapiens
aataaaaaggc

SEQ ID NO: 2508644 - DNA, 13 bp, Homo sapiens
aataaaaaggcac

SEQ ID NO: 2508645 - DNA, 13 bp, Homo sapiens
aataaaaagtgac

SEQ ID NO: 2508646 - DNA, 20 bp, Homo sapiens
aataaaaagtgacacagcag

SEQ ID NO: 2508647 - DNA, 14 bp, Homo sapiens
aataaaaagttaaa

SEQ ID NO: 2508648 - DNA, 17 bp, Homo sapiens
aataaaacattttcaca

SEQ ID NO: 2508649 - DNA, 19 bp, Homo sapiens
aataaaacattttcacaca

SEQ ID NO: 2508650 - DNA, 12 bp, Homo sapiens
aataaaaccttt

SEQ ID NO: 2508651 - DNA, 13 bp, Homo sapiens
aataaaacctttc

SEQ ID NO: 2508652 - DNA, 23 bp, Homo sapiens
aataaaacctttcaaatttcaca

SEQ ID NO: 2508653 - DNA, 15 bp, Homo sapiens
aataaaactttttaa

SEQ ID NO: 2508654 - DNA, 16 bp, Homo sapiens
aataaaatcttgaaaa

SEQ ID NO: 2508655 - DNA, 21 bp, Homo sapiens
aataaaatgtgatttttctga

SEQ ID NO: 2508656 - DNA, 11 bp, Homo sapiens
aataaaatttg

SEQ ID NO: 2508657 - DNA, 22 bp, Homo sapiens
aataaaattttttttcatgttt

SEQ ID NO: 2508658 - DNA, 17 bp, Homo sapiens
aataaactgtgtttact

SEQ ID NO: 2508659 - DNA, 14 bp, Homo sapiens
aataaagatcatgt

SEQ ID NO: 2508660 - DNA, 16 bp, Homo sapiens
aataaagtatcatgca

SEQ ID NO: 2508661 - DNA, 19 bp, Homo sapiens
aataaagtatcatgcattc

SEQ ID NO: 2508662 - DNA, 14 bp, Homo sapiens
aataaagtatctac

SEQ ID NO: 2508663 - DNA, 15 bp, Homo sapiens
aataaagtatctaca

SEQ ID NO: 2508664 - DNA, 16 bp, Homo sapiens
aataaagtatctacat

SEQ ID NO: 2508665 - DNA, 19 bp, Homo sapiens
aataaagttctgagtgttt

SEQ ID NO: 2508666 - DNA, 20 bp, Homo sapiens
aataaatctggtagaaaaat

SEQ ID NO: 2508667 - DNA, 22 bp, Homo sapiens
aataaatggtatagcaaatgtt

SEQ ID NO: 2508668 - DNA, 23 bp, Homo sapiens
aataaatggtatagcaaatgttt

SEQ ID NO: 2508669 - DNA, 20 bp, Homo sapiens
aataaatgtatcttattcac

SEQ ID NO: 2508670 - DNA, 13 bp, Homo sapiens
aataaatgtcatt

SEQ ID NO: 2508671 - DNA, 23 bp, Homo sapiens
aataaatgtcttttttttaatgt

SEQ ID NO: 2508672 - DNA, 20 bp, Homo sapiens
aataaatgtgaaattctgtc

SEQ ID NO: 2508673 - DNA, 18 bp, Homo sapiens
aataaattaaaacatgca

SEQ ID NO: 2508674 - DNA, 14 bp, Homo sapiens
aataaattcagata

SEQ ID NO: 2508675 - DNA, 19 bp, Homo sapiens
aataacaatgtgctctcgg

SEQ ID NO: 2508676 - DNA, 14 bp, Homo sapiens
aataacaatgttaa

SEQ ID NO: 2508677 - DNA, 15 bp, Homo sapiens
aataacacacagcta

SEQ ID NO: 2508678 - DNA, 12 bp, Homo sapiens
aataacacacat

SEQ ID NO: 2508679 - DNA, 22 bp, Homo sapiens
aataacatgtaattaagtacta

SEQ ID NO: 2508680 - DNA, 14 bp, Homo sapiens
aataacattacctt

SEQ ID NO: 2508681 - DNA, 20 bp, Homo sapiens
aataacattaccttactgtg

SEQ ID NO: 2508682 - DNA, 13 bp, Homo sapiens
aataacatttgtg

SEQ ID NO: 2508683 - DNA, 16 bp, Homo sapiens
aataactactgtgttc

SEQ ID NO: 2508684 - DNA, 14 bp, Homo sapiens
aataagaatgattt

SEQ ID NO: 2508685 - DNA, 17 bp, Homo sapiens
aataagtgccaggatgg

SEQ ID NO: 2508686 - DNA, 22 bp, Homo sapiens
aataagttaactattttatttt

SEQ ID NO: 2508687 - DNA, 11 bp, Homo sapiens
aataagttatt

SEQ ID NO: 2508688 - DNA, 13 bp, Homo sapiens
aataagttattgc

SEQ ID NO: 2508689 - DNA, 19 bp, Homo sapiens
aataataaagatgctcttt

SEQ ID NO: 2508690 - DNA, 14 bp, Homo sapiens
aataatacactaat

SEQ ID NO: 2508691 - DNA, 17 bp, Homo sapiens
aataatatattttaaat

SEQ ID NO: 2508692 - DNA, 17 bp, Homo sapiens
aataatatattttctgt

SEQ ID NO: 2508693 - DNA, 19 bp, Homo sapiens
aataatatattttctgttt

SEQ ID NO: 2508694 - DNA, 12 bp, Homo sapiens
aataatatgcat

SEQ ID NO: 2508695 - DNA, 22 bp, Homo sapiens
aataatgtgaaactggattaaa

SEQ ID NO: 2508696 - DNA, 14 bp, Homo sapiens
aataattggttctt

SEQ ID NO: 2508697 - DNA, 21 bp, Homo sapiens
aataatttcctggtgtgaagg

SEQ ID NO: 2508698 - DNA, 17 bp, Homo sapiens
aatacaaacacctggac

SEQ ID NO: 2508699 - DNA, 14 bp, Homo sapiens
aatacaataagtta

SEQ ID NO: 2508700 - DNA, 23 bp, Homo sapiens
aatacacatagcatgtaatggta

SEQ ID NO: 2508701 - DNA, 22 bp, Homo sapiens
aatacaccacctcactcctgtt

SEQ ID NO: 2508702 - DNA, 15 bp, Homo sapiens
aatacaccactacat

SEQ ID NO: 2508703 - DNA, 18 bp, Homo sapiens
aatacaccactacattct

SEQ ID NO: 2508704 - DNA, 19 bp, Homo sapiens
aatacagaaattagccggg

SEQ ID NO: 2508705 - DNA, 20 bp, Homo sapiens
aatacagtatctcagggcct

SEQ ID NO: 2508706 - DNA, 20 bp, Homo sapiens
aataccagtgaaccaaagag

SEQ ID NO: 2508707 - DNA, 13 bp, Homo sapiens
aatacctctgtgt

SEQ ID NO: 2508708 - DNA, 15 bp, Homo sapiens
aatacctctgtgtgc

SEQ ID NO: 2508709 - DNA, 16 bp, Homo sapiens
aatacctcttagctga

SEQ ID NO: 2508710 - DNA, 17 bp, Homo sapiens
aatacctcttagctgag

SEQ ID NO: 2508711 - DNA, 21 bp, Homo sapiens
aatacctcttagctgagtgga

SEQ ID NO: 2508712 - DNA, 16 bp, Homo sapiens
aatacgcactacatgt

SEQ ID NO: 2508713 - DNA, 14 bp, Homo sapiens
aatactagttgtga

SEQ ID NO: 2508714 - DNA, 15 bp, Homo sapiens
aatactatttttact

SEQ ID NO: 2508715 - DNA, 16 bp, Homo sapiens
aatactatttttactg

SEQ ID NO: 2508716 - DNA, 16 bp, Homo sapiens
aatactcataatgtga

SEQ ID NO: 2508717 - DNA, 23 bp, Homo sapiens
aatactcataatgtgaagtgtta

SEQ ID NO: 2508718 - DNA, 14 bp, Homo sapiens
aatactcatgtgta

SEQ ID NO: 2508719 - DNA, 15 bp, Homo sapiens
aatactcatgtgtat

SEQ ID NO: 2508720 - DNA, 16 bp, Homo sapiens
aatactcatgtgtatg

SEQ ID NO: 2508721 - DNA, 17 bp, Homo sapiens
aatactgccagatgctg

SEQ ID NO: 2508722 - DNA, 23 bp, Homo sapiens
ttttggtattacactgtatttgt

SEQ ID NO: 2508723 - DNA, 21 bp, Homo sapiens
ttttggtccaagttgtgctta

SEQ ID NO: 2508724 - DNA, 20 bp, Homo sapiens
ttttggtggttttagtgatt

SEQ ID NO: 2508725 - DNA, 16 bp, Homo sapiens
ttttggttcttagttc

SEQ ID NO: 2508726 - DNA, 12 bp, Homo sapiens
ttttggttgtat

SEQ ID NO: 2508727 - DNA, 22 bp, Homo sapiens
ttttggtttgcagatgacaaaa

SEQ ID NO: 2508728 - DNA, 14 bp, Homo sapiens
ttttgtaagacaaa

SEQ ID NO: 2508729 - DNA, 15 bp, Homo sapiens
ttttgtaagatgctg

SEQ ID NO: 2508730 - DNA, 16 bp, Homo sapiens
ttttgtactgtaaaga

SEQ ID NO: 2508731 - DNA, 16 bp, Homo sapiens
ttttgtataattgtat

SEQ ID NO: 2508732 - DNA, 18 bp, Homo sapiens
ttttgtatagtaaagtga

SEQ ID NO: 2508733 - DNA, 10 bp, Homo sapiens
ttttgtattt

SEQ ID NO: 2508734 - DNA, 13 bp, Homo sapiens
ttttgtcttatat

SEQ ID NO: 2508735 - DNA, 12 bp, Homo sapiens
ttttgtcttgaa

SEQ ID NO: 2508736 - DNA, 13 bp, Homo sapiens
ttttgtcttgaat

SEQ ID NO: 2508737 - DNA, 13 bp, Homo sapiens
ttttgtcttgtgt

SEQ ID NO: 2508738 - DNA, 22 bp, Homo sapiens
ttttgtgaaatgaaaacatgta

SEQ ID NO: 2508739 - DNA, 23 bp, Homo sapiens
ttttgtgaatggattggattatt

SEQ ID NO: 2508740 - DNA, 23 bp, Homo sapiens
ttttgtgcattatctagatactg

SEQ ID NO: 2508741 - DNA, 13 bp, Homo sapiens
ttttgtgtacagt

SEQ ID NO: 2508742 - DNA, 21 bp, Homo sapiens
ttttgttccacaagttaaata

SEQ ID NO: 2508743 - DNA, 22 bp, Homo sapiens
ttttgtttgctatcttaatttt

SEQ ID NO: 2508744 - DNA, 16 bp, Homo sapiens
ttttgttttaaaatta

SEQ ID NO: 2508745 - DNA, 19 bp, Homo sapiens
tttttaaaagtttcaatgt

SEQ ID NO: 2508746 - DNA, 16 bp, Homo sapiens
tttttaaaattttaat

SEQ ID NO: 2508747 - DNA, 17 bp, Homo sapiens
tttttaaagacagagtc

SEQ ID NO: 2508748 - DNA, 18 bp, Homo sapiens
tttttaagctgtttccat

SEQ ID NO: 2508749 - DNA, 16 bp, Homo sapiens
tttttaagtatttata

SEQ ID NO: 2508750 - DNA, 16 bp, Homo sapiens
tttttaagtgctgcat

SEQ ID NO: 2508751 - DNA, 15 bp, Homo sapiens
tttttaatcatgaaa

SEQ ID NO: 2508752 - DNA, 12 bp, Homo sapiens
tttttaattatt

SEQ ID NO: 2508753 - DNA, 23 bp, Homo sapiens
tttttaatttacaaaaatataaa

SEQ ID NO: 2508754 - DNA, 18 bp, Homo sapiens
tttttaattttgtatttt

SEQ ID NO: 2508755 - DNA, 13 bp, Homo sapiens
tttttacaataaa

SEQ ID NO: 2508756 - DNA, 18 bp, Homo sapiens
tttttacccatatcccct

SEQ ID NO: 2508757 - DNA, 11 bp, Homo sapiens
tttttactaat

SEQ ID NO: 2508758 - DNA, 21 bp, Homo sapiens
tttttatggcttttgtgcatt

SEQ ID NO: 2508759 - DNA, 14 bp, Homo sapiens
tttttcaattaaac

SEQ ID NO: 2508760 - DNA, 20 bp, Homo sapiens
tttttcaattaaacggatta

SEQ ID NO: 2508761 - DNA, 14 bp, Homo sapiens
tttttcagaaatat

SEQ ID NO: 2508762 - DNA, 12 bp, Homo sapiens
tttttcagtttt

SEQ ID NO: 2508763 - DNA, 15 bp, Homo sapiens
tttttccccaaagtc

SEQ ID NO: 2508764 - DNA, 17 bp, Homo sapiens
tttttccttgtatttaa

SEQ ID NO: 2508765 - DNA, 11 bp, Homo sapiens
tttttcctttt

SEQ ID NO: 2508766 - DNA, 11 bp, Homo sapiens
tttttctgatt

SEQ ID NO: 2508767 - DNA, 13 bp, Homo sapiens
tttttctgattgt

SEQ ID NO: 2508768 - DNA, 21 bp, Homo sapiens
tttttctggaggttgataact

SEQ ID NO: 2508769 - DNA, 14 bp, Homo sapiens
tttttctgttatat

SEQ ID NO: 2508770 - DNA, 23 bp, Homo sapiens
tttttcttaaataataaagatca

SEQ ID NO: 2508771 - DNA, 14 bp, Homo sapiens
tttttctttaagat

SEQ ID NO: 2508772 - DNA, 16 bp, Homo sapiens
tttttctttataaact

SEQ ID NO: 2508773 - DNA, 23 bp, Homo sapiens
tttttgaaaggcatgttcctctg

SEQ ID NO: 2508774 - DNA, 23 bp, Homo sapiens
tttttgaaggcagaaagcaaaat

SEQ ID NO: 2508775 - DNA, 14 bp, Homo sapiens
tttttgatagcttt

SEQ ID NO: 2508776 - DNA, 12 bp, Homo sapiens
tttttggggata

SEQ ID NO: 2508777 - DNA, 10 bp, Homo sapiens
tttttgtaaa

SEQ ID NO: 2508778 - DNA, 14 bp, Homo sapiens
tttttgtactgtaa

SEQ ID NO: 2508779 - DNA, 20 bp, Homo sapiens
tttttgtagagccagggtct

SEQ ID NO: 2508780 - DNA, 12 bp, Homo sapiens
tttttgtatgtt

SEQ ID NO: 2508781 - DNA, 20 bp, Homo sapiens
tttttgtgaaaatgtcaaag

SEQ ID NO: 2508782 - DNA, 22 bp, Homo sapiens
tttttgtgttttgttctttaaa

SEQ ID NO: 2508783 - DNA, 22 bp, Homo sapiens
tttttgttcttaattgcactct

SEQ ID NO: 2508784 - DNA, 11 bp, Homo sapiens
ttttttaagat

SEQ ID NO: 2508785 - DNA, 15 bp, Homo sapiens
ttttttaatgtgctg

SEQ ID NO: 2508786 - DNA, 16 bp, Homo sapiens
ttttttaatgtgctgt

SEQ ID NO: 2508787 - DNA, 15 bp, Homo sapiens
ttttttagatcaaat

SEQ ID NO: 2508788 - DNA, 16 bp, Homo sapiens
ttttttatgctaatca

SEQ ID NO: 2508789 - DNA, 11 bp, Homo sapiens
ttttttctacc

SEQ ID NO: 2508790 - DNA, 11 bp, Homo sapiens
ttttttctgat

SEQ ID NO: 2508791 - DNA, 12 bp, Homo sapiens
ttttttgataaa

SEQ ID NO: 2508792 - DNA, 12 bp, Homo sapiens
ttttttgtttca

SEQ ID NO: 2508793 - DNA, 13 bp, Homo sapiens
ttttttgtttcat

SEQ ID NO: 2508794 - DNA, 13 bp, Homo sapiens
tttttttaatgtg

SEQ ID NO: 2508795 - DNA, 12 bp, Homo sapiens
tttttttgagat

SEQ ID NO: 2508796 - DNA, 13 bp, Homo sapiens
ttttttttaatgt

SEQ ID NO: 2508797 - DNA, 11 bp, Homo sapiens
ttttttttcat

SEQ ID NO: 2508798 - DNA, 19 bp, Homo sapiens
tttgaatataaacactata

SEQ ID NO: 2508799 - DNA, 13 bp, Homo sapiens
tttgaatgaaaaa

SEQ ID NO: 2508800 - DNA, 22 bp, Homo sapiens
tttgaatgaaaaatttaagcat

SEQ ID NO: 2508801 - DNA, 24 bp, Homo sapiens
tttgaatgaaaaatttaagcattg

SEQ ID NO: 2508802 - DNA, 15 bp, Homo sapiens
tttgacactatatct

SEQ ID NO: 2508803 - DNA, 17 bp, Homo sapiens
tttgacactatatctgt

SEQ ID NO: 2508804 - DNA, 18 bp, Homo sapiens
tttgacctctgcagcaat

SEQ ID NO: 2508805 - DNA, 23 bp, Homo sapiens
tttgacctgttgggagtgaggat

SEQ ID NO: 2508806 - DNA, 13 bp, Homo sapiens
tttgacgccatcc

SEQ ID NO: 2508807 - DNA, 20 bp, Homo sapiens
tttgacgccatcccagcccc

SEQ ID NO: 2508808 - DNA, 16 bp, Homo sapiens
tttgactgtttttacc

SEQ ID NO: 2508809 - DNA, 13 bp, Homo sapiens
tttgagaaatgca

SEQ ID NO: 2508810 - DNA, 16 bp, Homo sapiens
tttgagacagtttctt

SEQ ID NO: 2508811 - DNA, 19 bp, Homo sapiens
tttgagacagtttcttagc

SEQ ID NO: 2508812 - DNA, 10 bp, Homo sapiens
tttgagacgg

SEQ ID NO: 2508813 - DNA, 15 bp, Homo sapiens
tttgagcaattttcg

SEQ ID NO: 2508814 - DNA, 16 bp, Homo sapiens
tgtatttatgtgtgag

SEQ ID NO: 2508815 - DNA, 23 bp, Homo sapiens
tgtatttattccatattcatgta

SEQ ID NO: 2508816 - DNA, 16 bp, Homo sapiens
tgtatttatttaaaag

SEQ ID NO: 2508817 - DNA, 20 bp, Homo sapiens
tgtatttatttaaaagattc

SEQ ID NO: 2508818 - DNA, 19 bp, Homo sapiens
tgtatttattttcctcccc

SEQ ID NO: 2508819 - DNA, 20 bp, Homo sapiens
tgtatttattttcctcccca

SEQ ID NO: 2508820 - DNA, 23 bp, Homo sapiens
tgtatttccccaacatgtaataa

SEQ ID NO: 2508821 - DNA, 13 bp, Homo sapiens
tgtatttgtgact

SEQ ID NO: 2508822 - DNA, 20 bp, Homo sapiens
tgtatttgtgactaattgta

SEQ ID NO: 2508823 - DNA, 20 bp, Homo sapiens
tgtatttgttaatggtttga

SEQ ID NO: 2508824 - DNA, 14 bp, Homo sapiens
tgtatttgtttgca

SEQ ID NO: 2508825 - DNA, 19 bp, Homo sapiens
ttaatagtgttaatcaatt

SEQ ID NO: 2508826 - DNA, 21 bp, Homo sapiens
ttaatagtgttaatcaattta

SEQ ID NO: 2508827 - DNA, 20 bp, Homo sapiens
ttaatatatcccagaaatta

SEQ ID NO: 2508828 - DNA, 18 bp, Homo sapiens
ttaatatcatcagtattg

SEQ ID NO: 2508829 - DNA, 16 bp, Homo sapiens
ttaatatggggatgca

SEQ ID NO: 2508830 - DNA, 15 bp, Homo sapiens
ttaatattctattaa

SEQ ID NO: 2508831 - DNA, 22 bp, Homo sapiens
ttaatattgatatgcttataca

SEQ ID NO: 2508832 - DNA, 22 bp, Homo sapiens
ttaatatttaaacagcagtgtt

SEQ ID NO: 2508833 - DNA, 16 bp, Homo sapiens
ttaatcagacaaagta

SEQ ID NO: 2508834 - DNA, 13 bp, Homo sapiens
ttaatcatgaaat

SEQ ID NO: 2508835 - DNA, 22 bp, Homo sapiens
ttaatcattaggtgtgactgaa

SEQ ID NO: 2508836 - DNA, 22 bp, Homo sapiens
ttaatcattttgcctcttttct

SEQ ID NO: 2508837 - DNA, 15 bp, Homo sapiens
ttaatcttcagtttt

SEQ ID NO: 2508838 - DNA, 23 bp, Homo sapiens
ttaatctttctttacctgagacc

SEQ ID NO: 2508839 - DNA, 24 bp, Homo sapiens
ttaatctttctttacctgagacca

SEQ ID NO: 2508840 - DNA, 16 bp, Homo sapiens
ttaatcttttcacaaa

SEQ ID NO: 2508841 - DNA, 17 bp, Homo sapiens
ttaatcttttcacaaat

SEQ ID NO: 2508842 - DNA, 19 bp, Homo sapiens
ttaatgaaagactgtacaa

SEQ ID NO: 2508843 - DNA, 21 bp, Homo sapiens
ttaatgaaatatctgtattta

SEQ ID NO: 2508844 - DNA, 14 bp, Homo sapiens
ttaatgacacttgt

SEQ ID NO: 2508845 - DNA, 12 bp, Homo sapiens
ttaatgcacttt

SEQ ID NO: 2508846 - DNA, 13 bp, Homo sapiens
ttaatgcactttc

SEQ ID NO: 2508847 - DNA, 14 bp, Homo sapiens
ttaatgcactttct

SEQ ID NO: 2508848 - DNA, 15 bp, Homo sapiens
ttaatgcactttcta

SEQ ID NO: 2508849 - DNA, 18 bp, Homo sapiens
ttaatgtaatctgatggc

SEQ ID NO: 2508850 - DNA, 15 bp, Homo sapiens
ttaatgtagattttt

SEQ ID NO: 2508851 - DNA, 21 bp, Homo sapiens
ttaatgtgctgtgtaaagtta

SEQ ID NO: 2508852 - DNA, 13 bp, Homo sapiens
ttaatgtgtatta

SEQ ID NO: 2508853 - DNA, 20 bp, Homo sapiens
ttaattaatgaaatatctgt

SEQ ID NO: 2508854 - DNA, 13 bp, Homo sapiens
ttaattcatgttt

SEQ ID NO: 2508855 - DNA, 22 bp, Homo sapiens
ttaattccatgaatcgcttctc

SEQ ID NO: 2508856 - DNA, 17 bp, Homo sapiens
ttaattctctttcaaag

SEQ ID NO: 2508857 - DNA, 15 bp, Homo sapiens
ttaattcttagctca

SEQ ID NO: 2508858 - DNA, 13 bp, Homo sapiens
ttaattgttgttt

SEQ ID NO: 2508859 - DNA, 20 bp, Homo sapiens
ttaattgttgtttctttcta

SEQ ID NO: 2508860 - DNA, 22 bp, Homo sapiens
ttaattgttgtttctttctagt

SEQ ID NO: 2508861 - DNA, 18 bp, Homo sapiens
ttaattgttttgcacttt

SEQ ID NO: 2508862 - DNA, 19 bp, Homo sapiens
ttaattgttttgcactttt

SEQ ID NO: 2508863 - DNA, 14 bp, Homo sapiens
ttaatttacaaaaa

SEQ ID NO: 2508864 - DNA, 22 bp, Homo sapiens
ttaatttacaaaaatataaaat

SEQ ID NO: 2508865 - DNA, 23 bp, Homo sapiens
ttaatttacaaaaatataaaata

SEQ ID NO: 2508866 - DNA, 19 bp, Homo sapiens
ttaatttattattgaaatt

SEQ ID NO: 2508867 - DNA, 13 bp, Homo sapiens
ttaattttgtatt

SEQ ID NO: 2508868 - DNA, 18 bp, Homo sapiens
ttaattttgtattttcca

SEQ ID NO: 2508869 - DNA, 15 bp, Homo sapiens
ttacaaacatgtggt

SEQ ID NO: 2508870 - DNA, 15 bp, Homo sapiens
ttacaacagatttgt

SEQ ID NO: 2508871 - DNA, 19 bp, Homo sapiens
ttacaagcccccccttcca

SEQ ID NO: 2508872 - DNA, 22 bp, Homo sapiens
ttacaatcattgctgaaaatgg

SEQ ID NO: 2508873 - DNA, 23 bp, Homo sapiens
ttacaatcattgctgaaaatggt

SEQ ID NO: 2508874 - DNA, 14 bp, Homo sapiens
ttacaattgaaatg

SEQ ID NO: 2508875 - DNA, 20 bp, Homo sapiens
ttacaattttttatcatgca

SEQ ID NO: 2508876 - DNA, 22 bp, Homo sapiens
ttacaatttttttaattttgta

SEQ ID NO: 2508877 - DNA, 23 bp, Homo sapiens
ttacaatttttttaattttgtat

SEQ ID NO: 2508878 - DNA, 17 bp, Homo sapiens
ttacacatcttcaacag

SEQ ID NO: 2508879 - DNA, 21 bp, Homo sapiens
ttacaccagcctcgtcttcat

SEQ ID NO: 2508880 - DNA, 13 bp, Homo sapiens
ttacactgggaga

SEQ ID NO: 2508881 - DNA, 17 bp, Homo sapiens
ttacactgtatttgtat

SEQ ID NO: 2508882 - DNA, 14 bp, Homo sapiens
ttacagaaagtggt

SEQ ID NO: 2508883 - DNA, 22 bp, Homo sapiens
ttacagaaagtggtgctcagtt

SEQ ID NO: 2508884 - DNA, 20 bp, Homo sapiens
ttacagagacagaaagcaga

SEQ ID NO: 2508885 - DNA, 22 bp, Homo sapiens
ttacagagaggagaaacacatc

SEQ ID NO: 2508886 - DNA, 15 bp, Homo sapiens
ttacagaggacagta

SEQ ID NO: 2508887 - DNA, 15 bp, Homo sapiens
ttacagcgagaggca

SEQ ID NO: 2508888 - DNA, 21 bp, Homo sapiens
ttacagcgagaggcagagaaa

SEQ ID NO: 2508889 - DNA, 15 bp, Homo sapiens
ttacaggcaccgaga

SEQ ID NO: 2508890 - DNA, 18 bp, Homo sapiens
ttacagggagctgggaca

SEQ ID NO: 2508891 - DNA, 18 bp, Homo sapiens
ttacaggtggacacacaa

SEQ ID NO: 2508892 - DNA, 14 bp, Homo sapiens
ttacaggtgtgaac

SEQ ID NO: 2508893 - DNA, 22 bp, Homo sapiens
ttacatatcacctcatggccta

SEQ ID NO: 2508894 - DNA, 18 bp, Homo sapiens
ttacatcatttttgtatc

SEQ ID NO: 2508895 - DNA, 22 bp, Homo sapiens
ttacatgcaatttattaaaatg

SEQ ID NO: 2508896 - DNA, 14 bp, Homo sapiens
ttacatgcatactt

SEQ ID NO: 2508897 - DNA, 18 bp, Homo sapiens
ttacatgcatacttcaaa

SEQ ID NO: 2508898 - DNA, 13 bp, Homo sapiens
ttacatgcatttg

SEQ ID NO: 2508899 - DNA, 18 bp, Homo sapiens
ttacatgttttctttgct

SEQ ID NO: 2508900 - DNA, 13 bp, Homo sapiens
ttacattcagttg

SEQ ID NO: 2508901 - DNA, 13 bp, Homo sapiens
ttacattctgaat

SEQ ID NO: 2508902 - DNA, 15 bp, Homo sapiens
ttacattgtcattta

SEQ ID NO: 2508903 - DNA, 17 bp, Homo sapiens
ttacattgtttgtctgt

SEQ ID NO: 2508904 - DNA, 12 bp, Homo sapiens
ttacatttttaa

SEQ ID NO: 2508905 - DNA, 21 bp, Homo sapiens
ttacatttttaagtgctgcat

SEQ ID NO: 2508906 - DNA, 22 bp, Homo sapiens
ttacatttttaagtgctgcatt

SEQ ID NO: 2508907 - DNA, 23 bp, Homo sapiens
ttacatttttaagtgctgcattt

SEQ ID NO: 2508908 - DNA, 13 bp, Homo sapiens
ttacatttttaca

SEQ ID NO: 2508909 - DNA, 18 bp, Homo sapiens
ttacatttttacaataaa

SEQ ID NO: 2508910 - DNA, 13 bp, Homo sapiens
ttaccaacctgtt

SEQ ID NO: 2508911 - DNA, 15 bp, Homo sapiens
ttaccaactttctgt

SEQ ID NO: 2508912 - DNA, 12 bp, Homo sapiens
ttaccaccccca

SEQ ID NO: 2508913 - DNA, 13 bp, Homo sapiens
ttaccacccccac

SEQ ID NO: 2508914 - DNA, 12 bp, Homo sapiens
ttaccactcagg

SEQ ID NO: 2508915 - DNA, 21 bp, Homo sapiens
ttaccagacggttcaccagcc

SEQ ID NO: 2508916 - DNA, 22 bp, Homo sapiens
ttatagccacatccctttgaaa

SEQ ID NO: 2508917 - DNA, 16 bp, Homo sapiens
ttataggatcatttgt

SEQ ID NO: 2508918 - DNA, 18 bp, Homo sapiens
ttataggtcactcctggg

SEQ ID NO: 2508919 - DNA, 20 bp, Homo sapiens
ttatagttgtgggtgggaga

SEQ ID NO: 2508920 - DNA, 16 bp, Homo sapiens
ttatagtttgtacatg

SEQ ID NO: 2508921 - DNA, 18 bp, Homo sapiens
ttatataggttgtgcaaa

SEQ ID NO: 2508922 - DNA, 23 bp, Homo sapiens
ttatataggttttgtttgctatc

SEQ ID NO: 2508923 - DNA, 17 bp, Homo sapiens
ttatatatgtatttata

SEQ ID NO: 2508924 - DNA, 13 bp, Homo sapiens
ttatatatgtgaa

SEQ ID NO: 2508925 - DNA, 23 bp, Homo sapiens
ttatatatgtgaacatttatcaa

SEQ ID NO: 2508926 - DNA, 20 bp, Homo sapiens
ttatatatttataactcatc

SEQ ID NO: 2508927 - DNA, 19 bp, Homo sapiens
ttatatcagtcctctttca

SEQ ID NO: 2508928 - DNA, 16 bp, Homo sapiens
ttatattccatatatt

SEQ ID NO: 2508929 - DNA, 17 bp, Homo sapiens
ttatatttagttatagt

SEQ ID NO: 2508930 - DNA, 13 bp, Homo sapiens
ttatatttttaaa

SEQ ID NO: 2508931 - DNA, 20 bp, Homo sapiens
ttatcaaatcagtcagtgca

SEQ ID NO: 2508932 - DNA, 15 bp, Homo sapiens
ttatcaacaatagtg

SEQ ID NO: 2508933 - DNA, 19 bp, Homo sapiens
ttatcacatgtatgttttg

SEQ ID NO: 2508934 - DNA, 20 bp, Homo sapiens
ttatcaccagagagggactg

SEQ ID NO: 2508935 - DNA, 17 bp, Homo sapiens
ttatcacccagaagaaa

SEQ ID NO: 2508936 - DNA, 21 bp, Homo sapiens
ttatcagtaagaaaaagaaga

SEQ ID NO: 2508937 - DNA, 23 bp, Homo sapiens
ttatcagtcataactaaataaag

SEQ ID NO: 2508938 - DNA, 19 bp, Homo sapiens
ttatcatgacatgttatat

SEQ ID NO: 2508939 - DNA, 11 bp, Homo sapiens
ttatcatgcaa

SEQ ID NO: 2508940 - DNA, 16 bp, Homo sapiens
ttatcatgcaaatgct

SEQ ID NO: 2508941 - DNA, 12 bp, Homo sapiens
ttatcatgtgta

SEQ ID NO: 2508942 - DNA, 18 bp, Homo sapiens
ttatcatgtgtaatcaat

SEQ ID NO: 2508943 - DNA, 19 bp, Homo sapiens
ttatccacagaaacatttt

SEQ ID NO: 2508944 - DNA, 23 bp, Homo sapiens
ttatcccttccttttagcctagt

SEQ ID NO: 2508945 - DNA, 16 bp, Homo sapiens
ttatcctctgatctcc

SEQ ID NO: 2508946 - DNA, 17 bp, Homo sapiens
ttatcctgaaatttcag

SEQ ID NO: 2508947 - DNA, 14 bp, Homo sapiens
ttatcgaaataaca

SEQ ID NO: 2508948 - DNA, 15 bp, Homo sapiens
ttatcgaaataacaa

SEQ ID NO: 2508949 - DNA, 16 bp, Homo sapiens
ttatcgggagcagtgt

SEQ ID NO: 2508950 - DNA, 17 bp, Homo sapiens
ttatctagatactgtat

SEQ ID NO: 2508951 - DNA, 11 bp, Homo sapiens
ttatctcaaaa

SEQ ID NO: 2508952 - DNA, 17 bp, Homo sapiens
ttatctcagtcatgcat

SEQ ID NO: 2508953 - DNA, 21 bp, Homo sapiens
ttatctcagtcatgcataaat

SEQ ID NO: 2508954 - DNA, 22 bp, Homo sapiens
ttatctcagtcatgcataaata

SEQ ID NO: 2508955 - DNA, 21 bp, Homo sapiens
ttatctccccttcacatgcat

SEQ ID NO: 2508956 - DNA, 18 bp, Homo sapiens
ttatctgtgcgtgaaaca

SEQ ID NO: 2508957 - DNA, 17 bp, Homo sapiens
ttatcttgtctctgggc

SEQ ID NO: 2508958 - DNA, 17 bp, Homo sapiens
ttatctttcgtgataaa

SEQ ID NO: 2508959 - DNA, 24 bp, Homo sapiens
ttatctttcgtgataaactttgct

SEQ ID NO: 2508960 - DNA, 20 bp, Homo sapiens
ttatgaaataaagaaattgc

SEQ ID NO: 2508961 - DNA, 15 bp, Homo sapiens
ttatgagtttgctta

SEQ ID NO: 2508962 - DNA, 13 bp, Homo sapiens
ttatgagtttttg

SEQ ID NO: 2508963 - DNA, 21 bp, Homo sapiens
ttatgagtttttgatagcttt

SEQ ID NO: 2508964 - DNA, 23 bp, Homo sapiens
ttatgagtttttgatagctttat

SEQ ID NO: 2508965 - DNA, 15 bp, Homo sapiens
ttatgatttaataaa

SEQ ID NO: 2508966 - DNA, 17 bp, Homo sapiens
ttatgatttaataaaat

SEQ ID NO: 2508967 - DNA, 20 bp, Homo sapiens
ttatgatttaataaaataat

SEQ ID NO: 2508968 - DNA, 22 bp, Homo sapiens
ttatgcatgaagtaatatgcac

SEQ ID NO: 2508969 - DNA, 21 bp, Homo sapiens
ttatgcccagtttctgcctct

SEQ ID NO: 2508970 - DNA, 17 bp, Homo sapiens
ttatgctgtgacacatg

SEQ ID NO: 2508971 - DNA, 13 bp, Homo sapiens
ttatgctttaaac

SEQ ID NO: 2508972 - DNA, 12 bp, Homo sapiens
ttatggcctcag

SEQ ID NO: 2508973 - DNA, 17 bp, Homo sapiens
ttatggctataggtgct

SEQ ID NO: 2508974 - DNA, 21 bp, Homo sapiens
ttatggctcactatgaatcta

SEQ ID NO: 2508975 - DNA, 17 bp, Homo sapiens
ttatggcttttgtgcat

SEQ ID NO: 2508976 - DNA, 23 bp, Homo sapiens
ttatgggaaccccttcatcctct

SEQ ID NO: 2508977 - DNA, 22 bp, Homo sapiens
ttatgggctgggttctacccag

SEQ ID NO: 2508978 - DNA, 20 bp, Homo sapiens
ttatgtaaaatgttttagca

SEQ ID NO: 2508979 - DNA, 16 bp, Homo sapiens
ttatgtaataatgtga

SEQ ID NO: 2508980 - DNA, 15 bp, Homo sapiens
ttatgtaatctatgt

SEQ ID NO: 2508981 - DNA, 15 bp, Homo sapiens
ttatgtagatgtgca

SEQ ID NO: 2508982 - DNA, 17 bp, Homo sapiens
ttatgtcatcatacatg

SEQ ID NO: 2508983 - DNA, 15 bp, Homo sapiens
ttatgtccactgtgt

SEQ ID NO: 2508984 - DNA, 17 bp, Homo sapiens
ttatgtctatttaagcc

SEQ ID NO: 2508985 - DNA, 15 bp, Homo sapiens
tttgaggatatattt

SEQ ID NO: 2508986 - DNA, 16 bp, Homo sapiens
tttgaggggaaaacac

SEQ ID NO: 2508987 - DNA, 11 bp, Homo sapiens
tttgaggggct

SEQ ID NO: 2508988 - DNA, 23 bp, Homo sapiens
tttgaggtcaagtaagaagacat

SEQ ID NO: 2508989 - DNA, 17 bp, Homo sapiens
tttgaggtctgttcttt

SEQ ID NO: 2508990 - DNA, 22 bp, Homo sapiens
tttgaggtctgttctttccaaa

SEQ ID NO: 2508991 - DNA, 16 bp, Homo sapiens
tttgagtgagggtttc

SEQ ID NO: 2508992 - DNA, 13 bp, Homo sapiens
tttgagtgctctg

SEQ ID NO: 2508993 - DNA, 16 bp, Homo sapiens
tttgagtggatgatgt

SEQ ID NO: 2508994 - DNA, 20 bp, Homo sapiens
tttgagtggatgatgtttcg

SEQ ID NO: 2508995 - DNA, 14 bp, Homo sapiens
tttgagtgttttaa

SEQ ID NO: 2508996 - DNA, 20 bp, Homo sapiens
tttgataaagtagtaaaaat

SEQ ID NO: 2508997 - DNA, 21 bp, Homo sapiens
tttgataaagtagtaaaaatt

SEQ ID NO: 2508998 - DNA, 15 bp, Homo sapiens
tttgataaagtttct

SEQ ID NO: 2508999 - DNA, 19 bp, Homo sapiens
tttgataaagtttctcaga

SEQ ID NO: 2509000 - DNA, 15 bp, Homo sapiens
tttgataatgttaaa

SEQ ID NO: 2509001 - DNA, 16 bp, Homo sapiens
tttgatacatatgtga

SEQ ID NO: 2509002 - DNA, 15 bp, Homo sapiens
tttgatacttgttca

SEQ ID NO: 2509003 - DNA, 17 bp, Homo sapiens
tttgatatccaaagctg

SEQ ID NO: 2509004 - DNA, 18 bp, Homo sapiens
tttgatcaggtggggagt

SEQ ID NO: 2509005 - DNA, 15 bp, Homo sapiens
tttgatccaagctgg

SEQ ID NO: 2509006 - DNA, 16 bp, Homo sapiens
tttgatgctggagagg

SEQ ID NO: 2509007 - DNA, 18 bp, Homo sapiens
tttgatgctggagaggtt

SEQ ID NO: 2509008 - DNA, 14 bp, Homo sapiens
tttgatgttaacac

SEQ ID NO: 2509009 - DNA, 16 bp, Homo sapiens
tttgatgttaacacat

SEQ ID NO: 2509010 - DNA, 21 bp, Homo sapiens
tttgattcagacagctgcctg

SEQ ID NO: 2509011 - DNA, 15 bp, Homo sapiens
tttgattctgtgtgt

SEQ ID NO: 2509012 - DNA, 14 bp, Homo sapiens
tttgatttaatgtt

SEQ ID NO: 2509013 - DNA, 14 bp, Homo sapiens
tttgcaacctcgct

SEQ ID NO: 2509014 - DNA, 12 bp, Homo sapiens
tttgcaaggaag

SEQ ID NO: 2509015 - DNA, 14 bp, Homo sapiens
tttgcaaggaagcc

SEQ ID NO: 2509016 - DNA, 16 bp, Homo sapiens
tttgcacctgctctct

SEQ ID NO: 2509017 - DNA, 14 bp, Homo sapiens
tttgcactgagggc

SEQ ID NO: 2509018 - DNA, 16 bp, Homo sapiens
tttgcactgagggcca

SEQ ID NO: 2509019 - DNA, 17 bp, Homo sapiens
tttgcactgagggccac

SEQ ID NO: 2509020 - DNA, 12 bp, Homo sapiens
tttgcaggctca

SEQ ID NO: 2509021 - DNA, 14 bp, Homo sapiens
tttgcaggttgctt

SEQ ID NO: 2509022 - DNA, 20 bp, Homo sapiens
tttgcataacaattcctcta

SEQ ID NO: 2509023 - DNA, 22 bp, Homo sapiens
tttgcatggcacttgcatctgt

SEQ ID NO: 2509024 - DNA, 21 bp, Homo sapiens
tttgcatgtgaaaatcaaata

SEQ ID NO: 2509025 - DNA, 15 bp, Homo sapiens
tttgcattcaaatta

SEQ ID NO: 2509026 - DNA, 21 bp, Homo sapiens
tttgcatttaaaacagacact

SEQ ID NO: 2509027 - DNA, 13 bp, Homo sapiens
tttgccagctgct

SEQ ID NO: 2509028 - DNA, 14 bp, Homo sapiens
tttgccagctgctg

SEQ ID NO: 2509029 - DNA, 16 bp, Homo sapiens
tttgccagctgctgct

SEQ ID NO: 2509030 - DNA, 22 bp, Homo sapiens
tttgccatgttggccaggctgg

SEQ ID NO: 2509031 - DNA, 12 bp, Homo sapiens
tttgccctttga

SEQ ID NO: 2509032 - DNA, 15 bp, Homo sapiens
tttgccgttattaaa

SEQ ID NO: 2509033 - DNA, 19 bp, Homo sapiens
tttgcctgttcagttacag

SEQ ID NO: 2509034 - DNA, 22 bp, Homo sapiens
tttgcctgttcagttacagaaa

SEQ ID NO: 2509035 - DNA, 22 bp, Homo sapiens
tttgctaactagcttggaaact

SEQ ID NO: 2509036 - DNA, 19 bp, Homo sapiens
tttgctatcttaattttgg

SEQ ID NO: 2509037 - DNA, 13 bp, Homo sapiens
tttgctattgaca

SEQ ID NO: 2509038 - DNA, 12 bp, Homo sapiens
tttgctctgcca

SEQ ID NO: 2509039 - DNA, 13 bp, Homo sapiens
tttgctctttctt

SEQ ID NO: 2509040 - DNA, 13 bp, Homo sapiens
tttgctgtagaag

SEQ ID NO: 2509041 - DNA, 15 bp, Homo sapiens
tttgcttcaaaaaca

SEQ ID NO: 2509042 - DNA, 13 bp, Homo sapiens
tttgcttcataaa

SEQ ID NO: 2509043 - DNA, 16 bp, Homo sapiens
tttgctttgtgatttt

SEQ ID NO: 2509044 - DNA, 15 bp, Homo sapiens
tttggaaaatgcatt

SEQ ID NO: 2509045 - DNA, 14 bp, Homo sapiens
tttggaagttttca

SEQ ID NO: 2509046 - DNA, 13 bp, Homo sapiens
tttggaataaagt

SEQ ID NO: 2509047 - DNA, 16 bp, Homo sapiens
tttggaccccagctgg

SEQ ID NO: 2509048 - DNA, 13 bp, Homo sapiens
tttggaccctgag

SEQ ID NO: 2509049 - DNA, 16 bp, Homo sapiens
tttggacctaatccaa

SEQ ID NO: 2509050 - DNA, 19 bp, Homo sapiens
tttggagactctgtggggc

SEQ ID NO: 2509051 - DNA, 19 bp, Homo sapiens
tttggatgggagtgagaca

SEQ ID NO: 2509052 - DNA, 18 bp, Homo sapiens
tttggattcttatgtagc

SEQ ID NO: 2509053 - DNA, 18 bp, Homo sapiens
tttggattgactctgcat

SEQ ID NO: 2509054 - DNA, 23 bp, Homo sapiens
tttggctctcctcagaagaaaga

SEQ ID NO: 2509055 - DNA, 13 bp, Homo sapiens
tttggctgctgaa

SEQ ID NO: 2509056 - DNA, 14 bp, Homo sapiens
tttggcttccatga

SEQ ID NO: 2509057 - DNA, 12 bp, Homo sapiens
tttgggcccagg

SEQ ID NO: 2509058 - DNA, 22 bp, Homo sapiens
tttgggggaaaatttagaaata

SEQ ID NO: 2509059 - DNA, 21 bp, Homo sapiens
tttggggtacccactgctctg

SEQ ID NO: 2509060 - DNA, 17 bp, Homo sapiens
tttgggtacctattttc

SEQ ID NO: 2509061 - DNA, 23 bp, Homo sapiens
tttggtcccgtgcagcttctgtc

SEQ ID NO: 2509062 - DNA, 17 bp, Homo sapiens
tttggtctacactgtgc

SEQ ID NO: 2509063 - DNA, 21 bp, Homo sapiens
tttggtctttttttgtattat

SEQ ID NO: 2509064 - DNA, 20 bp, Homo sapiens
tttggtgggggtagagctga

SEQ ID NO: 2509065 - DNA, 13 bp, Homo sapiens
tttggtgtgttcc

SEQ ID NO: 2509066 - DNA, 14 bp, Homo sapiens
tttggtgtgttccc

SEQ ID NO: 2509067 - DNA, 14 bp, Homo sapiens
tttggttctggggc

SEQ ID NO: 2509068 - DNA, 21 bp, Homo sapiens
tttggttcttagttctcactg

SEQ ID NO: 2509069 - DNA, 14 bp, Homo sapiens
tttggttgaataaa

SEQ ID NO: 2509070 - DNA, 17 bp, Homo sapiens
tttgtaaactcaaaata

SEQ ID NO: 2509071 - DNA, 12 bp, Homo sapiens
tttgtaaagtgt

SEQ ID NO: 2509072 - DNA, 15 bp, Homo sapiens
tttgtaaattaactt

SEQ ID NO: 2509073 - DNA, 16 bp, Homo sapiens
tttgtaaattaacttt

SEQ ID NO: 2509074 - DNA, 15 bp, Homo sapiens
tttgtaacctcagct

SEQ ID NO: 2509075 - DNA, 19 bp, Homo sapiens
tttgtaacctcagctctgg

SEQ ID NO: 2509076 - DNA, 22 bp, Homo sapiens
tttgtaagagtgtagaagcatt

SEQ ID NO: 2509077 - DNA, 14 bp, Homo sapiens
tttgtaagatgctg

SEQ ID NO: 2509078 - DNA, 21 bp, Homo sapiens
tttgtaatcgttatgtgtgta

SEQ ID NO: 2509079 - DNA, 18 bp, Homo sapiens
tttgtaattgcttacatt

SEQ ID NO: 2509080 - DNA, 16 bp, Homo sapiens
tttgtaatttttttat

SEQ ID NO: 2509081 - DNA, 23 bp, Homo sapiens
tttgtacaaaaaaaaagttttat

SEQ ID NO: 2509082 - DNA, 10 bp, Homo sapiens
tttgtacaga

SEQ ID NO: 2509083 - DNA, 22 bp, Homo sapiens
tttgtacagacgtatgcttatt

SEQ ID NO: 2509084 - DNA, 19 bp, Homo sapiens
tttgtacatagttatttat

SEQ ID NO: 2509085 - DNA, 14 bp, Homo sapiens
tttgtactgaaaaa

SEQ ID NO: 2509086 - DNA, 15 bp, Homo sapiens
tttgtactgaaaaat

SEQ ID NO: 2509087 - DNA, 16 bp, Homo sapiens
tttgtactgtaaagag

SEQ ID NO: 2509088 - DNA, 23 bp, Homo sapiens
tttgtaggggtcaaagaaatgct

SEQ ID NO: 2509089 - DNA, 16 bp, Homo sapiens
tttgtataattgtatc

SEQ ID NO: 2509090 - DNA, 12 bp, Homo sapiens
tttgtatattgt

SEQ ID NO: 2509091 - DNA, 21 bp, Homo sapiens
tttgtatctctgaagcatgtt

SEQ ID NO: 2509092 - DNA, 14 bp, Homo sapiens
tttgtatgtataat

SEQ ID NO: 2509093 - DNA, 14 bp, Homo sapiens
tttgtattctctga

SEQ ID NO: 2509094 - DNA, 15 bp, Homo sapiens
tttgtattttccaag

SEQ ID NO: 2509095 - DNA, 14 bp, Homo sapiens
tttgtcaaactgta

SEQ ID NO: 2509096 - DNA, 17 bp, Homo sapiens
tttgtcaatgacagttt

SEQ ID NO: 2509097 - DNA, 14 bp, Homo sapiens
tttgtcagacttta

SEQ ID NO: 2509098 - DNA, 21 bp, Homo sapiens
tttgtcatgaattcttatgct

SEQ ID NO: 2509099 - DNA, 21 bp, Homo sapiens
tttgtccccaccgcagacagg

SEQ ID NO: 2509100 - DNA, 17 bp, Homo sapiens
tttgtctgtcttcatag

SEQ ID NO: 2509101 - DNA, 13 bp, Homo sapiens
tttgtcttaaaaa

SEQ ID NO: 2509102 - DNA, 23 bp, Homo sapiens
tttgtcttaaaaagtggaaaaat

SEQ ID NO: 2509103 - DNA, 14 bp, Homo sapiens
tttgtcttatatat

SEQ ID NO: 2509104 - DNA, 15 bp, Homo sapiens
tttgtcttctcccca

SEQ ID NO: 2509105 - DNA, 16 bp, Homo sapiens
tttgtcttctccccag

SEQ ID NO: 2509106 - DNA, 23 bp, Homo sapiens
tttgtgaatggattggattattt

SEQ ID NO: 2509107 - DNA, 20 bp, Homo sapiens
tttgtgactatatagagatg

SEQ ID NO: 2509108 - DNA, 22 bp, Homo sapiens
tttgtgactatatagagatgtt

SEQ ID NO: 2509109 - DNA, 23 bp, Homo sapiens
tttgtgactatatagagatgttt

SEQ ID NO: 2509110 - DNA, 18 bp, Homo sapiens
tttgtgaggaagccgctg

SEQ ID NO: 2509111 - DNA, 20 bp, Homo sapiens
tttgtgatatggagccctgt

SEQ ID NO: 2509112 - DNA, 17 bp, Homo sapiens
tttgtgatttagaactg

SEQ ID NO: 2509113 - DNA, 19 bp, Homo sapiens
tttgtgcattatctagata

SEQ ID NO: 2509114 - DNA, 18 bp, Homo sapiens
ttttaaaagtttcaatgt

SEQ ID NO: 2509115 - DNA, 21 bp, Homo sapiens
ttttaaaagtttcaatgtgat

SEQ ID NO: 2509116 - DNA, 22 bp, Homo sapiens
ttttaaaagtttcaatgtgatt

SEQ ID NO: 2509117 - DNA, 20 bp, Homo sapiens
ttttaaacaaaatagaagct

SEQ ID NO: 2509118 - DNA, 13 bp, Homo sapiens
ttttaaacagtga

SEQ ID NO: 2509119 - DNA, 20 bp, Homo sapiens
ttttaaactgtgtacataac

SEQ ID NO: 2509120 - DNA, 17 bp, Homo sapiens
ttttaaagaatgctctt

SEQ ID NO: 2509121 - DNA, 22 bp, Homo sapiens
ttttaaagtatgttattgcata

SEQ ID NO: 2509122 - DNA, 19 bp, Homo sapiens
ttttaaagtgattaaacgt

SEQ ID NO: 2509123 - DNA, 16 bp, Homo sapiens
ttttaacaaaagcaag

SEQ ID NO: 2509124 - DNA, 21 bp, Homo sapiens
ttttaacaataactactgtgt

SEQ ID NO: 2509125 - DNA, 17 bp, Homo sapiens
ttttaacacctgatgtg

SEQ ID NO: 2509126 - DNA, 12 bp, Homo sapiens
ttttaactcacc

SEQ ID NO: 2509127 - DNA, 16 bp, Homo sapiens
ttttaagaggcagggt

SEQ ID NO: 2509128 - DNA, 22 bp, Homo sapiens
ttttaagataaattataagtta

SEQ ID NO: 2509129 - DNA, 17 bp, Homo sapiens
ttttaagatttttctca

SEQ ID NO: 2509130 - DNA, 15 bp, Homo sapiens
ttttaagcaaaatat

SEQ ID NO: 2509131 - DNA, 21 bp, Homo sapiens
ttttaagcgtaattttgccaa

SEQ ID NO: 2509132 - DNA, 23 bp, Homo sapiens
ttttaagggtttgtggaaaatga

SEQ ID NO: 2509133 - DNA, 19 bp, Homo sapiens
ttttaagtatttatatatt

SEQ ID NO: 2509134 - DNA, 21 bp, Homo sapiens
ttttaagttacacatttttca

SEQ ID NO: 2509135 - DNA, 21 bp, Homo sapiens
ttttaatagaatataattatc

SEQ ID NO: 2509136 - DNA, 12 bp, Homo sapiens
ttttaatcatga

SEQ ID NO: 2509137 - DNA, 22 bp, Homo sapiens
ttttaatgggggtagcagctgg

SEQ ID NO: 2509138 - DNA, 23 bp, Homo sapiens
ttttaatgggggtagcagctgga

SEQ ID NO: 2509139 - DNA, 12 bp, Homo sapiens
ttttaatgtgct

SEQ ID NO: 2509140 - DNA, 11 bp, Homo sapiens
ttttaattcca

SEQ ID NO: 2509141 - DNA, 18 bp, Homo sapiens
ttttaattccatgaatcg

SEQ ID NO: 2509142 - DNA, 21 bp, Homo sapiens
ttttaatttatttatactatt

SEQ ID NO: 2509143 - DNA, 12 bp, Homo sapiens
ttttaattttgt

SEQ ID NO: 2509144 - DNA, 15 bp, Homo sapiens
ttttaattttgtatt

SEQ ID NO: 2509145 - DNA, 17 bp, Homo sapiens
ttttacaataaaatctt

SEQ ID NO: 2509146 - DNA, 16 bp, Homo sapiens
ttttacaattgaaatg

SEQ ID NO: 2509147 - DNA, 16 bp, Homo sapiens
ttttacatactgctgt

SEQ ID NO: 2509148 - DNA, 14 bp, Homo sapiens
ttttacccatatcc

SEQ ID NO: 2509149 - DNA, 18 bp, Homo sapiens
ttttacccatatcccctc

SEQ ID NO: 2509150 - DNA, 18 bp, Homo sapiens
ttttacctaccacagtgt

SEQ ID NO: 2509151 - DNA, 15 bp, Homo sapiens
ttttactccagtggt

SEQ ID NO: 2509152 - DNA, 11 bp, Homo sapiens
ttttactgaac

SEQ ID NO: 2509153 - DNA, 13 bp, Homo sapiens
ttttactgaacaa

SEQ ID NO: 2509154 - DNA, 18 bp, Homo sapiens
ttttacttttaaactgtg

SEQ ID NO: 2509155 - DNA, 14 bp, Homo sapiens
ttttagaaaacagc

SEQ ID NO: 2509156 - DNA, 17 bp, Homo sapiens
ttttagagttgatacta

SEQ ID NO: 2509157 - DNA, 16 bp, Homo sapiens
ttttagatcaaatact

SEQ ID NO: 2509158 - DNA, 19 bp, Homo sapiens
ttttagctccttgactcct

SEQ ID NO: 2509159 - DNA, 16 bp, Homo sapiens
ttttaggtgttgattt

SEQ ID NO: 2509160 - DNA, 19 bp, Homo sapiens
ttttaggtgttgattttct

SEQ ID NO: 2509161 - DNA, 22 bp, Homo sapiens
ttttaggtgttgattttctgtt

SEQ ID NO: 2509162 - DNA, 18 bp, Homo sapiens
ttttagtttctgttctgt

SEQ ID NO: 2509163 - DNA, 19 bp, Homo sapiens
ttttagtttctgttctgtg

SEQ ID NO: 2509164 - DNA, 20 bp, Homo sapiens
ttttagtttctgttctgtgg

SEQ ID NO: 2509165 - DNA, 21 bp, Homo sapiens
ttttagtttctgttctgtgga

SEQ ID NO: 2509166 - DNA, 14 bp, Homo sapiens
ttttataaacttta

SEQ ID NO: 2509167 - DNA, 19 bp, Homo sapiens
ttttataaactttaccttt

SEQ ID NO: 2509168 - DNA, 12 bp, Homo sapiens
ttttataaatcg

SEQ ID NO: 2509169 - DNA, 23 bp, Homo sapiens
ttttataataaaaggaaaagcaa

SEQ ID NO: 2509170 - DNA, 13 bp, Homo sapiens
ttttatacataaa

SEQ ID NO: 2509171 - DNA, 21 bp, Homo sapiens
ttttatacataaacaagacca

SEQ ID NO: 2509172 - DNA, 17 bp, Homo sapiens
ttttatcatgacatgtt

SEQ ID NO: 2509173 - DNA, 19 bp, Homo sapiens
ttttatcgtcactgcttaa

SEQ ID NO: 2509174 - DNA, 19 bp, Homo sapiens
ttttatctttcgtgataaa

SEQ ID NO: 2509175 - DNA, 20 bp, Homo sapiens
ttttatgacttcattaataa

SEQ ID NO: 2509176 - DNA, 21 bp, Homo sapiens
ttttatgacttcattaataat

SEQ ID NO: 2509177 - DNA, 23 bp, Homo sapiens
ttttatggaggctttgcatagat

SEQ ID NO: 2509178 - DNA, 18 bp, Homo sapiens
ttttatgtgagagaaagt

SEQ ID NO: 2509179 - DNA, 12 bp, Homo sapiens
ttttattaaatt

SEQ ID NO: 2509180 - DNA, 11 bp, Homo sapiens
ttttattaatg

SEQ ID NO: 2509181 - DNA, 13 bp, Homo sapiens
ttttattaatgca

SEQ ID NO: 2509182 - DNA, 16 bp, Homo sapiens
ttttattattactgtt

SEQ ID NO: 2509183 - DNA, 15 bp, Homo sapiens
ttttattcctgtatg

SEQ ID NO: 2509184 - DNA, 19 bp, Homo sapiens
ttttattgagaattttaaa

SEQ ID NO: 2509185 - DNA, 12 bp, Homo sapiens
ttttattgtttt

SEQ ID NO: 2509186 - DNA, 14 bp, Homo sapiens
ttttattgttttca

SEQ ID NO: 2509187 - DNA, 15 bp, Homo sapiens
ttttatttgacaaaa

SEQ ID NO: 2509188 - DNA, 21 bp, Homo sapiens
ttttatttttctcatgatgag

SEQ ID NO: 2509189 - DNA, 16 bp, Homo sapiens
ttttcaatatttatta

SEQ ID NO: 2509190 - DNA, 15 bp, Homo sapiens
ttttcaattaaacgg

SEQ ID NO: 2509191 - DNA, 17 bp, Homo sapiens
ttttcaattaaacggat

SEQ ID NO: 2509192 - DNA, 18 bp, Homo sapiens
ttttcaattaaacggatt

SEQ ID NO: 2509193 - DNA, 21 bp, Homo sapiens
ttttcaattaaacggattatt

SEQ ID NO: 2509194 - DNA, 18 bp, Homo sapiens
ttttcaattttgcatgct

SEQ ID NO: 2509195 - DNA, 13 bp, Homo sapiens
ttttcacaaataa

SEQ ID NO: 2509196 - DNA, 21 bp, Homo sapiens
ttttcactggagttacattaa

SEQ ID NO: 2509197 - DNA, 16 bp, Homo sapiens
ttttcactgtagaatg

SEQ ID NO: 2509198 - DNA, 21 bp, Homo sapiens
ttttcagatataaaagactga

SEQ ID NO: 2509199 - DNA, 19 bp, Homo sapiens
ttttcagcccatatttcat

SEQ ID NO: 2509200 - DNA, 23 bp, Homo sapiens
ttttcagtattttggagaaatta

SEQ ID NO: 2509201 - DNA, 14 bp, Homo sapiens
ttttcagtgtacat

SEQ ID NO: 2509202 - DNA, 16 bp, Homo sapiens
ttttcatctgggaaag

SEQ ID NO: 2509203 - DNA, 21 bp, Homo sapiens
ttttcatcttctctggcgaca

SEQ ID NO: 2509204 - DNA, 21 bp, Homo sapiens
ttttcatgattttgaaatcat

SEQ ID NO: 2509205 - DNA, 16 bp, Homo sapiens
ttttcatgttttaaca

SEQ ID NO: 2509206 - DNA, 19 bp, Homo sapiens
ttttcatgttttaacaaaa

SEQ ID NO: 2509207 - DNA, 17 bp, Homo sapiens
ttttcattgatatgaaa

SEQ ID NO: 2509208 - DNA, 14 bp, Homo sapiens
ttttccaatgtctg

SEQ ID NO: 2509209 - DNA, 15 bp, Homo sapiens
ttttccaatgtctgc

SEQ ID NO: 2509210 - DNA, 20 bp, Homo sapiens
ttttccagctggatgagaat

SEQ ID NO: 2509211 - DNA, 19 bp, Homo sapiens
ttttccaggtttaagctgt

SEQ ID NO: 2509212 - DNA, 18 bp, Homo sapiens
ttttccatgaaaatgcaa

SEQ ID NO: 2509213 - DNA, 19 bp, Homo sapiens
ttttccatgagtcccctgt

SEQ ID NO: 2509214 - DNA, 20 bp, Homo sapiens
ttttcccagatacttcccat

SEQ ID NO: 2509215 - DNA, 18 bp, Homo sapiens
ttttccccccactctccc

SEQ ID NO: 2509216 - DNA, 19 bp, Homo sapiens
ttttccccccactctcccc

SEQ ID NO: 2509217 - DNA, 14 bp, Homo sapiens
ttttcctaaatgca

SEQ ID NO: 2509218 - DNA, 13 bp, Homo sapiens
ttttcctccctca

SEQ ID NO: 2509219 - DNA, 16 bp, Homo sapiens
ttttccttgtccccac

SEQ ID NO: 2509220 - DNA, 13 bp, Homo sapiens
ttttctacagtta

SEQ ID NO: 2509221 - DNA, 18 bp, Homo sapiens
ttttctagactttctgtt

SEQ ID NO: 2509222 - DNA, 20 bp, Homo sapiens
ttttctcaaagttttgaaaa

SEQ ID NO: 2509223 - DNA, 23 bp, Homo sapiens
ttttctcaaagttttgaaaagct

SEQ ID NO: 2509224 - DNA, 14 bp, Homo sapiens
ttttctcctcccag

SEQ ID NO: 2509225 - DNA, 17 bp, Homo sapiens
ttttctctaactcagaa

SEQ ID NO: 2509226 - DNA, 12 bp, Homo sapiens
ttttctctttct

SEQ ID NO: 2509227 - DNA, 14 bp, Homo sapiens
ttttctctttctcc

SEQ ID NO: 2509228 - DNA, 22 bp, Homo sapiens
ttttctctttctccttagtctt

SEQ ID NO: 2509229 - DNA, 15 bp, Homo sapiens
ttttctgagaaagac

SEQ ID NO: 2509230 - DNA, 12 bp, Homo sapiens
ttttctgagccc

SEQ ID NO: 2509231 - DNA, 22 bp, Homo sapiens
ttttctgggtgtccaaaggaag

SEQ ID NO: 2509232 - DNA, 18 bp, Homo sapiens
ttttctgtgcctgaatat

SEQ ID NO: 2509233 - DNA, 13 bp, Homo sapiens
ttttcttacataa

SEQ ID NO: 2509234 - DNA, 13 bp, Homo sapiens
ttttcttatttca

SEQ ID NO: 2509235 - DNA, 16 bp, Homo sapiens
ttttcttcatgcaatg

SEQ ID NO: 2509236 - DNA, 12 bp, Homo sapiens
ttttctttaaaa

SEQ ID NO: 2509237 - DNA, 16 bp, Homo sapiens
ttttctttgtgtagct

SEQ ID NO: 2509238 - DNA, 13 bp, Homo sapiens
ttttcttttctat

SEQ ID NO: 2509239 - DNA, 21 bp, Homo sapiens
ttttgaaaccatgaagagatt

SEQ ID NO: 2509240 - DNA, 22 bp, Homo sapiens
ttttgaaatattaaaccctgga

SEQ ID NO: 2509241 - DNA, 18 bp, Homo sapiens
ttttgaatgcttcctgac

SEQ ID NO: 2509242 - DNA, 18 bp, Homo sapiens
ttttgaatggtgttgtat

SEQ ID NO: 2509243 - DNA, 20 bp, Homo sapiens
ttttgacaaggggcagtggt

SEQ ID NO: 2509244 - DNA, 18 bp, Homo sapiens
ttttgacactatatctgt

SEQ ID NO: 2509245 - DNA, 19 bp, Homo sapiens
ttttgacactatatctgta

SEQ ID NO: 2509246 - DNA, 16 bp, Homo sapiens
ttttgagcaactttct

SEQ ID NO: 2509247 - DNA, 23 bp, Homo sapiens
ttttgataaagtagtaaaaatta

SEQ ID NO: 2509248 - DNA, 15 bp, Homo sapiens
ttttgatgtttgtgg

SEQ ID NO: 2509249 - DNA, 22 bp, Homo sapiens
ttttgatgtttgtggcctcaga

SEQ ID NO: 2509250 - DNA, 21 bp, Homo sapiens
ttttgatttgtactgaaaaat

SEQ ID NO: 2509251 - DNA, 19 bp, Homo sapiens
ttttgcaccccatgctgtt

SEQ ID NO: 2509252 - DNA, 22 bp, Homo sapiens
ttttgcagtagagtcatctcca

SEQ ID NO: 2509253 - DNA, 22 bp, Homo sapiens
ttttgcatggcacttgcatctg

SEQ ID NO: 2509254 - DNA, 13 bp, Homo sapiens
ttttgcattcaaa

SEQ ID NO: 2509255 - DNA, 23 bp, Homo sapiens
ttttgccatgttggccaggctgg

SEQ ID NO: 2509256 - DNA, 15 bp, Homo sapiens
ttttgccattaaact

SEQ ID NO: 2509257 - DNA, 17 bp, Homo sapiens
ttttgccttcattacct

SEQ ID NO: 2509258 - DNA, 13 bp, Homo sapiens
ttttgctggaata

SEQ ID NO: 2509259 - DNA, 14 bp, Homo sapiens
ttttgctgtagaag

SEQ ID NO: 2509260 - DNA, 13 bp, Homo sapiens
ttttggaggtgct

SEQ ID NO: 2509261 - DNA, 19 bp, Homo sapiens
ttttggcactgagatattt

SEQ ID NO: 2509262 - DNA, 17 bp, Homo sapiens
ttttggccaaagtgtta

SEQ ID NO: 2509263 - DNA, 14 bp, Homo sapiens
ttttggctgctgaa

SEQ ID NO: 2509264 - DNA, 17 bp, Homo sapiens
ttttggtattacactgt

SEQ ID NO: 2509265 - DNA, 18 bp, Homo sapiens
tgccctggtccagggaag

SEQ ID NO: 2509266 - DNA, 15 bp, Homo sapiens
tgccctggtggagaa

SEQ ID NO: 2509267 - DNA, 19 bp, Homo sapiens
tgccctgttgtgtatagat

SEQ ID NO: 2509268 - DNA, 15 bp, Homo sapiens
tgcccttcaccccag

SEQ ID NO: 2509269 - DNA, 15 bp, Homo sapiens
tgcccttccctgtcc

SEQ ID NO: 2509270 - DNA, 17 bp, Homo sapiens
tgcccttggaggccagc

SEQ ID NO: 2509271 - DNA, 19 bp, Homo sapiens
tgcccttggaggccagcca

SEQ ID NO: 2509272 - DNA, 16 bp, Homo sapiens
tgcccttgtcccactc

SEQ ID NO: 2509273 - DNA, 19 bp, Homo sapiens
tgccgaatgtgcaggtttg

SEQ ID NO: 2509274 - DNA, 15 bp, Homo sapiens
tgccgactcctgggt

SEQ ID NO: 2509275 - DNA, 18 bp, Homo sapiens
tgccgcctcccagcctgg

SEQ ID NO: 2509276 - DNA, 24 bp, Homo sapiens
tgccgcctccccacggccgctcca

SEQ ID NO: 2509277 - DNA, 12 bp, Homo sapiens
tgccgcctgccc

SEQ ID NO: 2509278 - DNA, 20 bp, Homo sapiens
tgccgcgtcgccctcccagg

SEQ ID NO: 2509279 - DNA, 19 bp, Homo sapiens
tgccgggttctagtctcct

SEQ ID NO: 2509280 - DNA, 14 bp, Homo sapiens
tgccgggttttata

SEQ ID NO: 2509281 - DNA, 18 bp, Homo sapiens
tgccgggttttatatttt

SEQ ID NO: 2509282 - DNA, 14 bp, Homo sapiens
tgcctaacaccagc

SEQ ID NO: 2509283 - DNA, 15 bp, Homo sapiens
tgcctaacaccagcg

SEQ ID NO: 2509284 - DNA, 21 bp, Homo sapiens
tgcctaataaacatccttcaa

SEQ ID NO: 2509285 - DNA, 12 bp, Homo sapiens
tgcctactgcat

SEQ ID NO: 2509286 - DNA, 18 bp, Homo sapiens
tgcctaggattgtgcctg

SEQ ID NO: 2509287 - DNA, 13 bp, Homo sapiens
tgcctattcccac

SEQ ID NO: 2509288 - DNA, 22 bp, Homo sapiens
tgcctattcccacacctccaca

SEQ ID NO: 2509289 - DNA, 15 bp, Homo sapiens
tgcctcaccccttgc

SEQ ID NO: 2509290 - DNA, 17 bp, Homo sapiens
tgcctcagcctcctgag

SEQ ID NO: 2509291 - DNA, 12 bp, Homo sapiens
tgcctcaggttc

SEQ ID NO: 2509292 - DNA, 18 bp, Homo sapiens
tgcctcagtaaaatgaac

SEQ ID NO: 2509293 - DNA, 21 bp, Homo sapiens
tgcctcattttagaaccacca

SEQ ID NO: 2509294 - DNA, 19 bp, Homo sapiens
tgcctccaccaccactggc

SEQ ID NO: 2509295 - DNA, 13 bp, Homo sapiens
tgcctccaccctc

SEQ ID NO: 2509296 - DNA, 16 bp, Homo sapiens
tgcctccaccctctga

SEQ ID NO: 2509297 - DNA, 11 bp, Homo sapiens
tgcctccaggt

SEQ ID NO: 2509298 - DNA, 15 bp, Homo sapiens
tgcctccaggtgtgc

SEQ ID NO: 2509299 - DNA, 22 bp, Homo sapiens
tgcctcccatcacccgctaaga

SEQ ID NO: 2509300 - DNA, 18 bp, Homo sapiens
tgcctccccaaccctgcc

SEQ ID NO: 2509301 - DNA, 19 bp, Homo sapiens
tgcctccccaaccctgccc

SEQ ID NO: 2509302 - DNA, 22 bp, Homo sapiens
tgcctccccaaccctgcccctg

SEQ ID NO: 2509303 - DNA, 18 bp, Homo sapiens
tgcctccccggctcgagc

SEQ ID NO: 2509304 - DNA, 13 bp, Homo sapiens
tgcctcccctgtg

SEQ ID NO: 2509305 - DNA, 16 bp, Homo sapiens
tgcctccctcaccctg

SEQ ID NO: 2509306 - DNA, 17 bp, Homo sapiens
tgcctccctcaccctga

SEQ ID NO: 2509307 - DNA, 16 bp, Homo sapiens
tgcctcccttcatgca

SEQ ID NO: 2509308 - DNA, 12 bp, Homo sapiens
tgcctcctcacc

SEQ ID NO: 2509309 - DNA, 20 bp, Homo sapiens
tgcctcctccttcccaaagg

SEQ ID NO: 2509310 - DNA, 13 bp, Homo sapiens
tgcctcctgtgta

SEQ ID NO: 2509311 - DNA, 17 bp, Homo sapiens
tgcctcctttgtgagga

SEQ ID NO: 2509312 - DNA, 18 bp, Homo sapiens
tgcctcctttgtgaggaa

SEQ ID NO: 2509313 - DNA, 22 bp, Homo sapiens
tgcctcctttgtgaggaagccg

SEQ ID NO: 2509314 - DNA, 15 bp, Homo sapiens
tgcctctacctgaca

SEQ ID NO: 2509315 - DNA, 17 bp, Homo sapiens
tgcctctacctgacact

SEQ ID NO: 2509316 - DNA, 12 bp, Homo sapiens
tgcctctctgtt

SEQ ID NO: 2509317 - DNA, 20 bp, Homo sapiens
tgcctctgacacacagctct

SEQ ID NO: 2509318 - DNA, 16 bp, Homo sapiens
tgcctctgcctgcatt

SEQ ID NO: 2509319 - DNA, 15 bp, Homo sapiens
tgcctcttagacttc

SEQ ID NO: 2509320 - DNA, 21 bp, Homo sapiens
tgcctcttccagtcttcctga

SEQ ID NO: 2509321 - DNA, 15 bp, Homo sapiens
tgcctcttctgggag

SEQ ID NO: 2509322 - DNA, 19 bp, Homo sapiens
tgcctcttctgggagggca

SEQ ID NO: 2509323 - DNA, 20 bp, Homo sapiens
tgcctcttctgggagggcag

SEQ ID NO: 2509324 - DNA, 14 bp, Homo sapiens
tgcctctttcctgt

SEQ ID NO: 2509325 - DNA, 17 bp, Homo sapiens
tgcctgaagtcacacag

SEQ ID NO: 2509326 - DNA, 23 bp, Homo sapiens
tgcctgaccctacttcttttgct

SEQ ID NO: 2509327 - DNA, 15 bp, Homo sapiens
tgcctgagggcccct

SEQ ID NO: 2509328 - DNA, 21 bp, Homo sapiens
tgcctgagggcccctctgccc

SEQ ID NO: 2509329 - DNA, 11 bp, Homo sapiens
tgcctgagggt

SEQ ID NO: 2509330 - DNA, 15 bp, Homo sapiens
tgcctgatggacctg

SEQ ID NO: 2509331 - DNA, 15 bp, Homo sapiens
tgcctgcagagagaa

SEQ ID NO: 2509332 - DNA, 11 bp, Homo sapiens
tgcctgcagcc

SEQ ID NO: 2509333 - DNA, 15 bp, Homo sapiens
tgcctgcccacccgt

SEQ ID NO: 2509334 - DNA, 14 bp, Homo sapiens
tgcctgcccaggcc

SEQ ID NO: 2509335 - DNA, 15 bp, Homo sapiens
tgcctgcccaggccc

SEQ ID NO: 2509336 - DNA, 21 bp, Homo sapiens
tgcagacaggcaagcacctcc

SEQ ID NO: 2509337 - DNA, 22 bp, Homo sapiens
tgcagacaggcaagcacctcct

SEQ ID NO: 2509338 - DNA, 19 bp, Homo sapiens
tgcagacctgtcctcctgg

SEQ ID NO: 2509339 - DNA, 19 bp, Homo sapiens
tgcagactcaataaaatca

SEQ ID NO: 2509340 - DNA, 15 bp, Homo sapiens
tgcagactcagtttg

SEQ ID NO: 2509341 - DNA, 19 bp, Homo sapiens
tgcagactcagtttgtcag

SEQ ID NO: 2509342 - DNA, 18 bp, Homo sapiens
tgcagactctacagaggc

SEQ ID NO: 2509343 - DNA, 19 bp, Homo sapiens
tgcagactctacagaggcc

SEQ ID NO: 2509344 - DNA, 20 bp, Homo sapiens
tgcagagacaggacctgact

SEQ ID NO: 2509345 - DNA, 15 bp, Homo sapiens
tgcagagagaagcct

SEQ ID NO: 2509346 - DNA, 16 bp, Homo sapiens
tgcagagagccatttt

SEQ ID NO: 2509347 - DNA, 17 bp, Homo sapiens
tgcagagagccattttg

SEQ ID NO: 2509348 - DNA, 22 bp, Homo sapiens
tgcagagagccattttgtgaat

SEQ ID NO: 2509349 - DNA, 16 bp, Homo sapiens
tgcagataaacagtag

SEQ ID NO: 2509350 - DNA, 17 bp, Homo sapiens
tgcagataaacagtagt

SEQ ID NO: 2509351 - DNA, 18 bp, Homo sapiens
tgcagatggggctcccgc

SEQ ID NO: 2509352 - DNA, 16 bp, Homo sapiens
tgcagatttgggctgg

SEQ ID NO: 2509353 - DNA, 14 bp, Homo sapiens
tgcagcaataaagc

SEQ ID NO: 2509354 - DNA, 20 bp, Homo sapiens
tgcagcaataaagcagcgtt

SEQ ID NO: 2509355 - DNA, 23 bp, Homo sapiens
tgcagcaataaagcagcgtttct

SEQ ID NO: 2509356 - DNA, 14 bp, Homo sapiens
tgcagcagaggcac

SEQ ID NO: 2509357 - DNA, 21 bp, Homo sapiens
tgcagcaggatctagaggggg

SEQ ID NO: 2509358 - DNA, 17 bp, Homo sapiens
tgcagcatgacctgtga

SEQ ID NO: 2509359 - DNA, 23 bp, Homo sapiens
tgcagcatgttgctgaggagtga

SEQ ID NO: 2509360 - DNA, 23 bp, Homo sapiens
tgcagccagacctattcctcctg

SEQ ID NO: 2509361 - DNA, 18 bp, Homo sapiens
tgcagcccatgcccacct

SEQ ID NO: 2509362 - DNA, 23 bp, Homo sapiens
tgcagccccgcctccaggccaca

SEQ ID NO: 2509363 - DNA, 21 bp, Homo sapiens
tgcagccccgcgcctccttcc

SEQ ID NO: 2509364 - DNA, 19 bp, Homo sapiens
tgcagcccgtgtggcccct

SEQ ID NO: 2509365 - DNA, 21 bp, Homo sapiens
tgcagcccgtgtggccccttc

SEQ ID NO: 2509366 - DNA, 19 bp, Homo sapiens
tgcagcctcaacctcctgg

SEQ ID NO: 2509367 - DNA, 15 bp, Homo sapiens
tgcagctgacctctg

SEQ ID NO: 2509368 - DNA, 21 bp, Homo sapiens
tgcagctgacctctgttgtcc

SEQ ID NO: 2509369 - DNA, 19 bp, Homo sapiens
tgcagctgagagaaaataa

SEQ ID NO: 2509370 - DNA, 20 bp, Homo sapiens
tgcagctgattttaacaata

SEQ ID NO: 2509371 - DNA, 22 bp, Homo sapiens
tgcagctgattttaacaataac

SEQ ID NO: 2509372 - DNA, 19 bp, Homo sapiens
tgcagctggaaaagggtct

SEQ ID NO: 2509373 - DNA, 18 bp, Homo sapiens
tgcaggacctcaggtgag

SEQ ID NO: 2509374 - DNA, 22 bp, Homo sapiens
tgcaggagcagtatcatgaagc

SEQ ID NO: 2509375 - DNA, 16 bp, Homo sapiens
tgcaggcaccttagtg

SEQ ID NO: 2509376 - DNA, 23 bp, Homo sapiens
tgcaggcactcaatgcagccaga

SEQ ID NO: 2509377 - DNA, 21 bp, Homo sapiens
tgcaggcctgctcagggactg

SEQ ID NO: 2509378 - DNA, 20 bp, Homo sapiens
tgcagggaaaattatttgca

SEQ ID NO: 2509379 - DNA, 14 bp, Homo sapiens
tgcagggagccgag

SEQ ID NO: 2509380 - DNA, 13 bp, Homo sapiens
tgcagggagtccg

SEQ ID NO: 2509381 - DNA, 19 bp, Homo sapiens
tgcagggattgctgccact

SEQ ID NO: 2509382 - DNA, 20 bp, Homo sapiens
tgcaggggattgaagccctc

SEQ ID NO: 2509383 - DNA, 19 bp, Homo sapiens
tgcagggtggtgctgggac

SEQ ID NO: 2509384 - DNA, 13 bp, Homo sapiens
tgcaggtggggag

SEQ ID NO: 2509385 - DNA, 15 bp, Homo sapiens
tgcaggtttgttaca

SEQ ID NO: 2509386 - DNA, 19 bp, Homo sapiens
tgcagtagattttctttaa

SEQ ID NO: 2509387 - DNA, 20 bp, Homo sapiens
tgcagtagattttctttaaa

SEQ ID NO: 2509388 - DNA, 14 bp, Homo sapiens
tgcagtcctgggat

SEQ ID NO: 2509389 - DNA, 14 bp, Homo sapiens
tgcagtctggctga

SEQ ID NO: 2509390 - DNA, 20 bp, Homo sapiens
tgcagtctggctgagccctg

SEQ ID NO: 2509391 - DNA, 21 bp, Homo sapiens
tgcagtctggctgagccctgc

SEQ ID NO: 2509392 - DNA, 13 bp, Homo sapiens
tgcagtctgggtg

SEQ ID NO: 2509393 - DNA, 13 bp, Homo sapiens
tgcagtgaattgt

SEQ ID NO: 2509394 - DNA, 17 bp, Homo sapiens
tgcagtgatatggcaga

SEQ ID NO: 2509395 - DNA, 21 bp, Homo sapiens
tgcagtgatatggcagaagac

SEQ ID NO: 2509396 - DNA, 22 bp, Homo sapiens
tgcagtgatatggcagaagaca

SEQ ID NO: 2509397 - DNA, 23 bp, Homo sapiens
tgcagtgatatggcagaagacac

SEQ ID NO: 2509398 - DNA, 17 bp, Homo sapiens
tgcagtgcccctagctt

SEQ ID NO: 2509399 - DNA, 23 bp, Homo sapiens
tgcagtgccttggggaatttcct

SEQ ID NO: 2509400 - DNA, 21 bp, Homo sapiens
tgcagttcccccaacctcaga

SEQ ID NO: 2509401 - DNA, 14 bp, Homo sapiens
tgcagttctgcagc

SEQ ID NO: 2509402 - DNA, 12 bp, Homo sapiens
tgcagtttccaa

SEQ ID NO: 2509403 - DNA, 14 bp, Homo sapiens
tgcagtttttcaga

SEQ ID NO: 2509404 - DNA, 11 bp, Homo sapiens
tgcataaaatg

SEQ ID NO: 2509405 - DNA, 17 bp, Homo sapiens
tgcataaagtcagtgcc

SEQ ID NO: 2509406 - DNA, 22 bp, Homo sapiens
tgcataataagctaaagaggct

SEQ ID NO: 2509407 - DNA, 24 bp, Homo sapiens
tgcataataagctaaagaggctga

SEQ ID NO: 2509408 - DNA, 9 bp, Homo sapiens
tgcatacac

SEQ ID NO: 2509409 - DNA, 13 bp, Homo sapiens
tgcatacacacac

SEQ ID NO: 2509410 - DNA, 15 bp, Homo sapiens
tgcatacacacacac

SEQ ID NO: 2509411 - DNA, 22 bp, Homo sapiens
tgcatacacacacacacacagc

SEQ ID NO: 2509412 - DNA, 13 bp, Homo sapiens
tgcatactcatta

SEQ ID NO: 2509413 - DNA, 19 bp, Homo sapiens
tgcatactcattaggatgg

SEQ ID NO: 2509414 - DNA, 19 bp, Homo sapiens
tgcatacttcaaaagtatt

SEQ ID NO: 2509415 - DNA, 21 bp, Homo sapiens
tgcatacttcaaaagtatttt

SEQ ID NO: 2509416 - DNA, 22 bp, Homo sapiens
tgcatactttttaaatgtaaag

SEQ ID NO: 2509417 - DNA, 19 bp, Homo sapiens
tgcatagagccacgtatgt

SEQ ID NO: 2509418 - DNA, 16 bp, Homo sapiens
tgcatataacttatat

SEQ ID NO: 2509419 - DNA, 17 bp, Homo sapiens
tgcatatcctgagccat

SEQ ID NO: 2509420 - DNA, 22 bp, Homo sapiens
tgcatcaatttttcttatttca

SEQ ID NO: 2509421 - DNA, 14 bp, Homo sapiens
tgcatcctccaaga

SEQ ID NO: 2509422 - DNA, 21 bp, Homo sapiens
tgcatctcactggatgcaaag

SEQ ID NO: 2509423 - DNA, 20 bp, Homo sapiens
tgcatctgggattcccacca

SEQ ID NO: 2509424 - DNA, 14 bp, Homo sapiens
tgcatctgtcctca

SEQ ID NO: 2509425 - DNA, 19 bp, Homo sapiens
tgcatctgtcctcatgtgt

SEQ ID NO: 2509426 - DNA, 14 bp, Homo sapiens
tgcatcttactgaa

SEQ ID NO: 2509427 - DNA, 20 bp, Homo sapiens
tgcatcttggggacatctct

SEQ ID NO: 2509428 - DNA, 21 bp, Homo sapiens
tgcatgaaggtttctgaaaat

SEQ ID NO: 2509429 - DNA, 20 bp, Homo sapiens
tgcatgaagtaatatgcaca

SEQ ID NO: 2509430 - DNA, 21 bp, Homo sapiens
tgcatgagctacgcctgcctc

SEQ ID NO: 2509431 - DNA, 15 bp, Homo sapiens
tgcatgagcttttat

SEQ ID NO: 2509432 - DNA, 21 bp, Homo sapiens
tgcatgaggctagtgtggtgt

SEQ ID NO: 2509433 - DNA, 14 bp, Homo sapiens
tgcatgatgtattt

SEQ ID NO: 2509434 - DNA, 22 bp, Homo sapiens
tgcatgcagccactgtgctgaa

SEQ ID NO: 2509435 - DNA, 14 bp, Homo sapiens
tgcatgcctggtct

SEQ ID NO: 2509436 - DNA, 16 bp, Homo sapiens
tgcatgcggcccagcc

SEQ ID NO: 2509437 - DNA, 21 bp, Homo sapiens
tgcatgcggcccagcccggct

SEQ ID NO: 2509438 - DNA, 22 bp, Homo sapiens
tgcatggctccagaaatgtcta

SEQ ID NO: 2509439 - DNA, 12 bp, Homo sapiens
tgcatgggagca

SEQ ID NO: 2509440 - DNA, 19 bp, Homo sapiens
tgcatgggctaatgaagat

SEQ ID NO: 2509441 - DNA, 16 bp, Homo sapiens
tgcatggtggcaccag

SEQ ID NO: 2509442 - DNA, 17 bp, Homo sapiens
tgcatggtttagaaagc

SEQ ID NO: 2509443 - DNA, 16 bp, Homo sapiens
tgcatgtcctgtaaag

SEQ ID NO: 2509444 - DNA, 21 bp, Homo sapiens
tgcatgtcgtgaccaactaga

SEQ ID NO: 2509445 - DNA, 16 bp, Homo sapiens
tgcatgttccactaac

SEQ ID NO: 2509446 - DNA, 17 bp, Homo sapiens
tgcatgttccactaacc

SEQ ID NO: 2509447 - DNA, 12 bp, Homo sapiens
tgcattacagag

SEQ ID NO: 2509448 - DNA, 20 bp, Homo sapiens
tgcattagaaatagacagta

SEQ ID NO: 2509449 - DNA, 21 bp, Homo sapiens
tgcattagagcccatttcaat

SEQ ID NO: 2509450 - DNA, 17 bp, Homo sapiens
tgcattatctagatact

SEQ ID NO: 2509451 - DNA, 12 bp, Homo sapiens
tgcattcaaatt

SEQ ID NO: 2509452 - DNA, 14 bp, Homo sapiens
tgcattcaaattaa

SEQ ID NO: 2509453 - DNA, 16 bp, Homo sapiens
tgcattcacccagaca

SEQ ID NO: 2509454 - DNA, 20 bp, Homo sapiens
tgcattcacccagacagctc

SEQ ID NO: 2509455 - DNA, 20 bp, Homo sapiens
tgcattcttggttggctggc

SEQ ID NO: 2509456 - DNA, 15 bp, Homo sapiens
tgcattgaatatatt

SEQ ID NO: 2509457 - DNA, 15 bp, Homo sapiens
tgcattgagaactgc

SEQ ID NO: 2509458 - DNA, 19 bp, Homo sapiens
tgcattgctgtgaattagc

SEQ ID NO: 2509459 - DNA, 18 bp, Homo sapiens
tgcattggaagaccccac

SEQ ID NO: 2509460 - DNA, 22 bp, Homo sapiens
tgcatttaaatacagtcttcca

SEQ ID NO: 2509461 - DNA, 19 bp, Homo sapiens
tgcatttgaaaattttgat

SEQ ID NO: 2509462 - DNA, 23 bp, Homo sapiens
tgcatttgaaaattttgatgttt

SEQ ID NO: 2509463 - DNA, 23 bp, Homo sapiens
tgcatttggtggtttcagaaatg

SEQ ID NO: 2509464 - DNA, 16 bp, Homo sapiens
tgcattttaaaaatga

SEQ ID NO: 2509465 - DNA, 18 bp, Homo sapiens
tgcattttgcagcagtga

SEQ ID NO: 2509466 - DNA, 17 bp, Homo sapiens
tgcattttgctattgta

SEQ ID NO: 2509467 - DNA, 20 bp, Homo sapiens
tgccaaagctagggtggccc

SEQ ID NO: 2509468 - DNA, 20 bp, Homo sapiens
tgccaacactcaagaagcag

SEQ ID NO: 2509469 - DNA, 22 bp, Homo sapiens
tgccaacactcaagaagcaggc

SEQ ID NO: 2509470 - DNA, 14 bp, Homo sapiens
tgccaagacatgat

SEQ ID NO: 2509471 - DNA, 15 bp, Homo sapiens
tgccaagcactgtgc

SEQ ID NO: 2509472 - DNA, 21 bp, Homo sapiens
tgccaatgaggtctgaaatgg

SEQ ID NO: 2509473 - DNA, 17 bp, Homo sapiens
tgccaatttttgccttc

SEQ ID NO: 2509474 - DNA, 14 bp, Homo sapiens
tgccacagagcggg

SEQ ID NO: 2509475 - DNA, 15 bp, Homo sapiens
tgccacagagcgggg

SEQ ID NO: 2509476 - DNA, 13 bp, Homo sapiens
tgccacagcctcc

SEQ ID NO: 2509477 - DNA, 21 bp, Homo sapiens
tgccacagcctcccctgccag

SEQ ID NO: 2509478 - DNA, 22 bp, Homo sapiens
tgccacagcctcccctgccagg

SEQ ID NO: 2509479 - DNA, 18 bp, Homo sapiens
tgccaccaaaggccaggg

SEQ ID NO: 2509480 - DNA, 13 bp, Homo sapiens
tgccaccaggaga

SEQ ID NO: 2509481 - DNA, 17 bp, Homo sapiens
tgccaccaggagaacca

SEQ ID NO: 2509482 - DNA, 22 bp, Homo sapiens
tgccaccaggagaaccactaca

SEQ ID NO: 2509483 - DNA, 15 bp, Homo sapiens
tgccaccccaccctc

SEQ ID NO: 2509484 - DNA, 19 bp, Homo sapiens
tgccaccccaccctccctg

SEQ ID NO: 2509485 - DNA, 16 bp, Homo sapiens
ggggacagggctggcc

SEQ ID NO: 2509486 - DNA, 24 bp, Homo sapiens
ggggacagggctggcccagccctg

SEQ ID NO: 2509487 - DNA, 15 bp, Homo sapiens
ggggactcagccctg

SEQ ID NO: 2509488 - DNA, 18 bp, Homo sapiens
ggggagagcaggctggca

SEQ ID NO: 2509489 - DNA, 18 bp, Homo sapiens
ggggaggaaactcacctg

SEQ ID NO: 2509490 - DNA, 13 bp, Homo sapiens
ggggaggccaagt

SEQ ID NO: 2509491 - DNA, 21 bp, Homo sapiens
ggggaggccaagtgcaggctg

SEQ ID NO: 2509492 - DNA, 22 bp, Homo sapiens
ggggaggcggacgttccagccg

SEQ ID NO: 2509493 - DNA, 21 bp, Homo sapiens
ggggagggccgtaccccaccc

SEQ ID NO: 2509494 - DNA, 19 bp, Homo sapiens
ggggagtgggacagagtct

SEQ ID NO: 2509495 - DNA, 13 bp, Homo sapiens
ggggatcacagag

SEQ ID NO: 2509496 - DNA, 17 bp, Homo sapiens
ggggatcacagcctctg

SEQ ID NO: 2509497 - DNA, 15 bp, Homo sapiens
ggggatttctcccag

SEQ ID NO: 2509498 - DNA, 14 bp, Homo sapiens
ggggcagctgccag

SEQ ID NO: 2509499 - DNA, 19 bp, Homo sapiens
ggggcagctgccagagaag

SEQ ID NO: 2509500 - DNA, 19 bp, Homo sapiens
ggggccacttttgactagg

SEQ ID NO: 2509501 - DNA, 12 bp, Homo sapiens
ggggccagaggc

SEQ ID NO: 2509502 - DNA, 13 bp, Homo sapiens
ggggccagaggct

SEQ ID NO: 2509503 - DNA, 19 bp, Homo sapiens
ggggccagttggtccccct

SEQ ID NO: 2509504 - DNA, 20 bp, Homo sapiens
ggggccatgagctccagacc

SEQ ID NO: 2509505 - DNA, 22 bp, Homo sapiens
ggggccatgagctccagacccc

SEQ ID NO: 2509506 - DNA, 21 bp, Homo sapiens
ggggcccctttttactcccct

SEQ ID NO: 2509507 - DNA, 15 bp, Homo sapiens
ggggccctgcctcct

SEQ ID NO: 2509508 - DNA, 15 bp, Homo sapiens
ggggcctggacctgc

SEQ ID NO: 2509509 - DNA, 13 bp, Homo sapiens
ggggcgaggcaga

SEQ ID NO: 2509510 - DNA, 17 bp, Homo sapiens
ggggcgaggcagaggac

SEQ ID NO: 2509511 - DNA, 22 bp, Homo sapiens
ggggcgccgcaaaccacactgg

SEQ ID NO: 2509512 - DNA, 17 bp, Homo sapiens
ggggcgctggcccagcc

SEQ ID NO: 2509513 - DNA, 11 bp, Homo sapiens
ggggctcctgg

SEQ ID NO: 2509514 - DNA, 16 bp, Homo sapiens
ggggctctcagctcag

SEQ ID NO: 2509515 - DNA, 20 bp, Homo sapiens
ggggctgaccttcctcgcag

SEQ ID NO: 2509516 - DNA, 23 bp, Homo sapiens
ggggctgaccttcctcgcagaga

SEQ ID NO: 2509517 - DNA, 21 bp, Homo sapiens
ggggctgctgacctccacagc

SEQ ID NO: 2509518 - DNA, 15 bp, Homo sapiens
ggggctgctggcctg

SEQ ID NO: 2509519 - DNA, 12 bp, Homo sapiens
gggggaaagcac

SEQ ID NO: 2509520 - DNA, 22 bp, Homo sapiens
gggggaggtgggatcctccagg

SEQ ID NO: 2509521 - DNA, 12 bp, Homo sapiens
gggggatatgaa

SEQ ID NO: 2509522 - DNA, 17 bp, Homo sapiens
gggggccccagtcagcc

SEQ ID NO: 2509523 - DNA, 15 bp, Homo sapiens
gggggcctcagtgcc

SEQ ID NO: 2509524 - DNA, 12 bp, Homo sapiens
gggggctggcct

SEQ ID NO: 2509525 - DNA, 22 bp, Homo sapiens
gggggtcccagtgggaggggca

SEQ ID NO: 2509526 - DNA, 13 bp, Homo sapiens
gggggtggcctcc

SEQ ID NO: 2509527 - DNA, 18 bp, Homo sapiens
gggggttgcggggggagg

SEQ ID NO: 2509528 - DNA, 24 bp, Homo sapiens
gggggtttttactccagtggtgaa

SEQ ID NO: 2509529 - DNA, 22 bp, Homo sapiens
ggggtcagggaccaaggacccc

SEQ ID NO: 2509530 - DNA, 17 bp, Homo sapiens
ggggtccagggagcagg

SEQ ID NO: 2509531 - DNA, 13 bp, Homo sapiens
ggggtcccagtgg

SEQ ID NO: 2509532 - DNA, 19 bp, Homo sapiens
ggggtcctggagcagacca

SEQ ID NO: 2509533 - DNA, 15 bp, Homo sapiens
ggggtcctgtggcag

SEQ ID NO: 2509534 - DNA, 18 bp, Homo sapiens
ggggtgacgcctgccctc

SEQ ID NO: 2509535 - DNA, 20 bp, Homo sapiens
ggggtgccccctcctctccc

SEQ ID NO: 2509536 - DNA, 22 bp, Homo sapiens
ggggttctttcttcctctgctg

SEQ ID NO: 2509537 - DNA, 13 bp, Homo sapiens
gggtaaactgtgg

SEQ ID NO: 2509538 - DNA, 23 bp, Homo sapiens
gggtaccttgaacactgggggag

SEQ ID NO: 2509539 - DNA, 22 bp, Homo sapiens
gggtacttgtggacacagctct

SEQ ID NO: 2509540 - DNA, 23 bp, Homo sapiens
gggtacttgtggacacagctctt

SEQ ID NO: 2509541 - DNA, 13 bp, Homo sapiens
gggtagcagctgg

SEQ ID NO: 2509542 - DNA, 14 bp, Homo sapiens
gggtagcagctgga

SEQ ID NO: 2509543 - DNA, 12 bp, Homo sapiens
gggtagcccgcc

SEQ ID NO: 2509544 - DNA, 18 bp, Homo sapiens
gggtaggaggatgggctc

SEQ ID NO: 2509545 - DNA, 16 bp, Homo sapiens
gggtaggcgggaagga

SEQ ID NO: 2509546 - DNA, 12 bp, Homo sapiens
gggtcaaggaat

SEQ ID NO: 2509547 - DNA, 20 bp, Homo sapiens
gggtcactctggcagctcag

SEQ ID NO: 2509548 - DNA, 13 bp, Homo sapiens
gggtcagccaggg

SEQ ID NO: 2509549 - DNA, 18 bp, Homo sapiens
gggtcagggaccaaggac

SEQ ID NO: 2509550 - DNA, 18 bp, Homo sapiens
gggtcattcatggcctgg

SEQ ID NO: 2509551 - DNA, 12 bp, Homo sapiens
gggtccaaataa

SEQ ID NO: 2509552 - DNA, 17 bp, Homo sapiens
gggtccagggagcaggc

SEQ ID NO: 2509553 - DNA, 17 bp, Homo sapiens
gggtcccaagctgggcc

SEQ ID NO: 2509554 - DNA, 22 bp, Homo sapiens
gggtcccaagctgggccccagc

SEQ ID NO: 2509555 - DNA, 22 bp, Homo sapiens
gggtcccagtgggaggggcagg

SEQ ID NO: 2509556 - DNA, 23 bp, Homo sapiens
gggtcccagtgggaggggcaggc

SEQ ID NO: 2509557 - DNA, 22 bp, Homo sapiens
gggtccccatcatcccagctgc

SEQ ID NO: 2509558 - DNA, 18 bp, Homo sapiens
gggtcctgtggcaggcag

SEQ ID NO: 2509559 - DNA, 15 bp, Homo sapiens
gggtctctagtgctg

SEQ ID NO: 2509560 - DNA, 20 bp, Homo sapiens
gggtctctagtgctgtgaaa

SEQ ID NO: 2509561 - DNA, 12 bp, Homo sapiens
gggtctctgctg

SEQ ID NO: 2509562 - DNA, 21 bp, Homo sapiens
gggtctgagtcatggccgggt

SEQ ID NO: 2509563 - DNA, 17 bp, Homo sapiens
gggtgaagtgaagacaa

SEQ ID NO: 2509564 - DNA, 12 bp, Homo sapiens
gggtgccgcctg

SEQ ID NO: 2509565 - DNA, 21 bp, Homo sapiens
gggtgctgcttccctctgcct

SEQ ID NO: 2509566 - DNA, 12 bp, Homo sapiens
gggtggagaagc

SEQ ID NO: 2509567 - DNA, 13 bp, Homo sapiens
gggtggagaagcc

SEQ ID NO: 2509568 - DNA, 17 bp, Homo sapiens
gggtggatgcctggtgg

SEQ ID NO: 2509569 - DNA, 22 bp, Homo sapiens
gggtggggaatgtttgggcaga

SEQ ID NO: 2509570 - DNA, 17 bp, Homo sapiens
gggtggggtagggctga

SEQ ID NO: 2509571 - DNA, 14 bp, Homo sapiens
gggtggtgctggga

SEQ ID NO: 2509572 - DNA, 13 bp, Homo sapiens
gggtggtggggag

SEQ ID NO: 2509573 - DNA, 19 bp, Homo sapiens
gggtggtggggaggggcgc

SEQ ID NO: 2509574 - DNA, 19 bp, Homo sapiens
gggtgtaacaggtctcctc

SEQ ID NO: 2509575 - DNA, 17 bp, Homo sapiens
gggtgtggcgcagcata

SEQ ID NO: 2509576 - DNA, 16 bp, Homo sapiens
gggttcaaaatgtctg

SEQ ID NO: 2509577 - DNA, 19 bp, Homo sapiens
gggttcagagactcagggc

SEQ ID NO: 2509578 - DNA, 13 bp, Homo sapiens
gggttcaggggac

SEQ ID NO: 2509579 - DNA, 20 bp, Homo sapiens
gggttcataggtcactggct

SEQ ID NO: 2509580 - DNA, 14 bp, Homo sapiens
gggttcccccagcc

SEQ ID NO: 2509581 - DNA, 15 bp, Homo sapiens
gggttcccccagccc

SEQ ID NO: 2509582 - DNA, 23 bp, Homo sapiens
gggttcccttttttggctgctga

SEQ ID NO: 2509583 - DNA, 18 bp, Homo sapiens
gggttcgtggaaagggtg

SEQ ID NO: 2509584 - DNA, 22 bp, Homo sapiens
gggttctacccaggtgctagga

SEQ ID NO: 2509585 - DNA, 16 bp, Homo sapiens
gggttctttcttcctc

SEQ ID NO: 2509586 - DNA, 19 bp, Homo sapiens
gggttctttggaaggagtg

SEQ ID NO: 2509587 - DNA, 12 bp, Homo sapiens
gggttgagggga

SEQ ID NO: 2509588 - DNA, 19 bp, Homo sapiens
gggttggcccctgcccggc

SEQ ID NO: 2509589 - DNA, 18 bp, Homo sapiens
gggttggtcctcttgcct

SEQ ID NO: 2509590 - DNA, 23 bp, Homo sapiens
gggttgtgaggcctggccaggca

SEQ ID NO: 2509591 - DNA, 22 bp, Homo sapiens
gggtttggcgggccaaggactg

SEQ ID NO: 2509592 - DNA, 14 bp, Homo sapiens
gggttttatatttt

SEQ ID NO: 2509593 - DNA, 20 bp, Homo sapiens
gggttttattgtttaaaatc

SEQ ID NO: 2509594 - DNA, 17 bp, Homo sapiens
gggttttccaccctgga

SEQ ID NO: 2509595 - DNA, 23 bp, Homo sapiens
gggttttgccatgttggccaggc

SEQ ID NO: 2509596 - DNA, 16 bp, Homo sapiens
ggtaaagactggcttt

SEQ ID NO: 2509597 - DNA, 15 bp, Homo sapiens
ggtaaattaagacat

SEQ ID NO: 2509598 - DNA, 16 bp, Homo sapiens
ggtaacttgcacctct

SEQ ID NO: 2509599 - DNA, 19 bp, Homo sapiens
ggtaagttgttaagagtgg

SEQ ID NO: 2509600 - DNA, 22 bp, Homo sapiens
ggtaattgttgctaatcttctt

SEQ ID NO: 2509601 - DNA, 13 bp, Homo sapiens
ggtaccctctgga

SEQ ID NO: 2509602 - DNA, 12 bp, Homo sapiens
ggtactctccta

SEQ ID NO: 2509603 - DNA, 16 bp, Homo sapiens
gggattgggggctggt

SEQ ID NO: 2509604 - DNA, 16 bp, Homo sapiens
gggattgtaaaatggt

SEQ ID NO: 2509605 - DNA, 20 bp, Homo sapiens
gggatttccagccagggctg

SEQ ID NO: 2509606 - DNA, 17 bp, Homo sapiens
gggatttctcccagctc

SEQ ID NO: 2509607 - DNA, 16 bp, Homo sapiens
gggcaaaactgaatta

SEQ ID NO: 2509608 - DNA, 15 bp, Homo sapiens
gggcaaacaggcagt

SEQ ID NO: 2509609 - DNA, 18 bp, Homo sapiens
gggcaacccccagcctgc

SEQ ID NO: 2509610 - DNA, 16 bp, Homo sapiens
gggcacagggtctcta

SEQ ID NO: 2509611 - DNA, 20 bp, Homo sapiens
gggcactcagaagacactga

SEQ ID NO: 2509612 - DNA, 17 bp, Homo sapiens
gggcacttcacagagtg

SEQ ID NO: 2509613 - DNA, 18 bp, Homo sapiens
gggcacttcacagagtgt

SEQ ID NO: 2509614 - DNA, 23 bp, Homo sapiens
gggcactttttaattcaccaaag

SEQ ID NO: 2509615 - DNA, 22 bp, Homo sapiens
gggcagaacactaacctgaccg

SEQ ID NO: 2509616 - DNA, 22 bp, Homo sapiens
gggcagaacagccgctcctgtc

SEQ ID NO: 2509617 - DNA, 16 bp, Homo sapiens
gggcagaagggagaag

SEQ ID NO: 2509618 - DNA, 18 bp, Homo sapiens
gggcagaagggagaagga

SEQ ID NO: 2509619 - DNA, 19 bp, Homo sapiens
gggcagaagggagaaggat

SEQ ID NO: 2509620 - DNA, 17 bp, Homo sapiens
gggcagagcagagacca

SEQ ID NO: 2509621 - DNA, 22 bp, Homo sapiens
gggcagagcagagaccatccct

SEQ ID NO: 2509622 - DNA, 19 bp, Homo sapiens
gggcagcccttgcttgttg

SEQ ID NO: 2509623 - DNA, 13 bp, Homo sapiens
gggcagctgggcc

SEQ ID NO: 2509624 - DNA, 14 bp, Homo sapiens
gggcagctgggccc

SEQ ID NO: 2509625 - DNA, 18 bp, Homo sapiens
gggcagctgggcccaacc

SEQ ID NO: 2509626 - DNA, 19 bp, Homo sapiens
gggcagcttgccccggccc

SEQ ID NO: 2509627 - DNA, 20 bp, Homo sapiens
gggcagggcatctcctgtgc

SEQ ID NO: 2509628 - DNA, 17 bp, Homo sapiens
gggcagtcattatccag

SEQ ID NO: 2509629 - DNA, 17 bp, Homo sapiens
gggcatgctggggcaag

SEQ ID NO: 2509630 - DNA, 22 bp, Homo sapiens
gggcatgtattggcctggaggt

SEQ ID NO: 2509631 - DNA, 16 bp, Homo sapiens
gggccaacaccaggga

SEQ ID NO: 2509632 - DNA, 22 bp, Homo sapiens
gggccaacttgagggcccagag

SEQ ID NO: 2509633 - DNA, 13 bp, Homo sapiens
gggccaagaaaga

SEQ ID NO: 2509634 - DNA, 13 bp, Homo sapiens
gggccaagcccag

SEQ ID NO: 2509635 - DNA, 13 bp, Homo sapiens
gggccaaggactg

SEQ ID NO: 2509636 - DNA, 15 bp, Homo sapiens
gggccacacagaaac

SEQ ID NO: 2509637 - DNA, 19 bp, Homo sapiens
gggccacatgggaggctca

SEQ ID NO: 2509638 - DNA, 13 bp, Homo sapiens
gggccagccaggc

SEQ ID NO: 2509639 - DNA, 11 bp, Homo sapiens
gggccaggcag

SEQ ID NO: 2509640 - DNA, 23 bp, Homo sapiens
gggccaggcaggtgcctggacat

SEQ ID NO: 2509641 - DNA, 16 bp, Homo sapiens
gggccagggccctgca

SEQ ID NO: 2509642 - DNA, 15 bp, Homo sapiens
gggccagtcctgcct

SEQ ID NO: 2509643 - DNA, 19 bp, Homo sapiens
gggccagtcctgcctggcc

SEQ ID NO: 2509644 - DNA, 21 bp, Homo sapiens
gggccagtcctgcctggccag

SEQ ID NO: 2509645 - DNA, 22 bp, Homo sapiens
gggccagtcctgcctggccagg

SEQ ID NO: 2509646 - DNA, 16 bp, Homo sapiens
gggccagtctgggctg

SEQ ID NO: 2509647 - DNA, 23 bp, Homo sapiens
gggccagttggtcccccttccat

SEQ ID NO: 2509648 - DNA, 18 bp, Homo sapiens
gggccatgagctccagac

SEQ ID NO: 2509649 - DNA, 19 bp, Homo sapiens
gggccatgagctccagacc

SEQ ID NO: 2509650 - DNA, 13 bp, Homo sapiens
gggcccaaaggcc

SEQ ID NO: 2509651 - DNA, 10 bp, Homo sapiens
gggcccacct

SEQ ID NO: 2509652 - DNA, 14 bp, Homo sapiens
gggcccacctggcc

SEQ ID NO: 2509653 - DNA, 15 bp, Homo sapiens
gggcccacctggcca

SEQ ID NO: 2509654 - DNA, 16 bp, Homo sapiens
gggcccacctggccac

SEQ ID NO: 2509655 - DNA, 18 bp, Homo sapiens
gggcccacctggccacct

SEQ ID NO: 2509656 - DNA, 19 bp, Homo sapiens
gggcccacctggccacctg

SEQ ID NO: 2509657 - DNA, 17 bp, Homo sapiens
gggcccagagagggtgg

SEQ ID NO: 2509658 - DNA, 11 bp, Homo sapiens
gggcccagccc

SEQ ID NO: 2509659 - DNA, 9 bp, Homo sapiens
gggcccagg

SEQ ID NO: 2509660 - DNA, 14 bp, Homo sapiens
gggcccaggaccag

SEQ ID NO: 2509661 - DNA, 19 bp, Homo sapiens
gggcccaggaccagctggg

SEQ ID NO: 2509662 - DNA, 22 bp, Homo sapiens
gggccccaaacgggctgccctg

SEQ ID NO: 2509663 - DNA, 12 bp, Homo sapiens
gggccccagccc

SEQ ID NO: 2509664 - DNA, 13 bp, Homo sapiens
gggccccagccca

SEQ ID NO: 2509665 - DNA, 14 bp, Homo sapiens
gggccccagcccac

SEQ ID NO: 2509666 - DNA, 16 bp, Homo sapiens
gggccccagcccaccc

SEQ ID NO: 2509667 - DNA, 18 bp, Homo sapiens
gggccccagcccaccctc

SEQ ID NO: 2509668 - DNA, 14 bp, Homo sapiens
gggccccagtcagc

SEQ ID NO: 2509669 - DNA, 17 bp, Homo sapiens
gggccccagtcagcctc

SEQ ID NO: 2509670 - DNA, 15 bp, Homo sapiens
gggcccccctccttg

SEQ ID NO: 2509671 - DNA, 12 bp, Homo sapiens
gggcccctctgc

SEQ ID NO: 2509672 - DNA, 22 bp, Homo sapiens
gggcccctctgcccagcttggg

SEQ ID NO: 2509673 - DNA, 23 bp, Homo sapiens
gggcccgcctggcagaactgagc

SEQ ID NO: 2509674 - DNA, 23 bp, Homo sapiens
gggccctccgacagccccctctg

SEQ ID NO: 2509675 - DNA, 17 bp, Homo sapiens
gggccctttgagtgcag

SEQ ID NO: 2509676 - DNA, 19 bp, Homo sapiens
gggccgccggtttgagtga

SEQ ID NO: 2509677 - DNA, 15 bp, Homo sapiens
gggccgtaccccacc

SEQ ID NO: 2509678 - DNA, 18 bp, Homo sapiens
gggccgtaccccaccctc

SEQ ID NO: 2509679 - DNA, 20 bp, Homo sapiens
gggccgtaccccaccctcag

SEQ ID NO: 2509680 - DNA, 23 bp, Homo sapiens
gggcctagctgctacaaagaaga

SEQ ID NO: 2509681 - DNA, 20 bp, Homo sapiens
gggcctcaaaggcccgctct

SEQ ID NO: 2509682 - DNA, 13 bp, Homo sapiens
gggcctcagtgcc

SEQ ID NO: 2509683 - DNA, 14 bp, Homo sapiens
gggcctcgggacct

SEQ ID NO: 2509684 - DNA, 22 bp, Homo sapiens
gggcctcggtgtggagaagcgg

SEQ ID NO: 2509685 - DNA, 23 bp, Homo sapiens
gggcctctggtttggggcgaggc

SEQ ID NO: 2509686 - DNA, 16 bp, Homo sapiens
gggcctggacctgcct

SEQ ID NO: 2509687 - DNA, 18 bp, Homo sapiens
gggcctggagcaggcctt

SEQ ID NO: 2509688 - DNA, 12 bp, Homo sapiens
gggcctggcctg

SEQ ID NO: 2509689 - DNA, 23 bp, Homo sapiens
gggccttgctacctcaaggggga

SEQ ID NO: 2509690 - DNA, 16 bp, Homo sapiens
gggcctttggcaggtg

SEQ ID NO: 2509691 - DNA, 13 bp, Homo sapiens
gggcgaggcagag

SEQ ID NO: 2509692 - DNA, 15 bp, Homo sapiens
gggcgccctggaagc

SEQ ID NO: 2509693 - DNA, 15 bp, Homo sapiens
gggcgcggccagccc

SEQ ID NO: 2509694 - DNA, 14 bp, Homo sapiens
gggcgctggcccag

SEQ ID NO: 2509695 - DNA, 16 bp, Homo sapiens
gggcgctggcccagcc

SEQ ID NO: 2509696 - DNA, 18 bp, Homo sapiens
gggcgctggcccagccgg

SEQ ID NO: 2509697 - DNA, 13 bp, Homo sapiens
gggcggctgagag

SEQ ID NO: 2509698 - DNA, 21 bp, Homo sapiens
gggcggtgagaggggaacaga

SEQ ID NO: 2509699 - DNA, 13 bp, Homo sapiens
gggcgtggagggc

SEQ ID NO: 2509700 - DNA, 19 bp, Homo sapiens
gggcgtggtcactgctgtc

SEQ ID NO: 2509701 - DNA, 15 bp, Homo sapiens
gggcgtggtggtgag

SEQ ID NO: 2509702 - DNA, 13 bp, Homo sapiens
gggctaccctgag

SEQ ID NO: 2509703 - DNA, 20 bp, Homo sapiens
gggctactgcagctttacat

SEQ ID NO: 2509704 - DNA, 16 bp, Homo sapiens
gggctagaacctggca

SEQ ID NO: 2509705 - DNA, 15 bp, Homo sapiens
gggctagttgggctt

SEQ ID NO: 2509706 - DNA, 18 bp, Homo sapiens
gggctcagagtggggtag

SEQ ID NO: 2509707 - DNA, 10 bp, Homo sapiens
gggctcagca

SEQ ID NO: 2509708 - DNA, 22 bp, Homo sapiens
gggctcagcaaaagatgcttct

SEQ ID NO: 2509709 - DNA, 13 bp, Homo sapiens
gggctcccgcccg

SEQ ID NO: 2509710 - DNA, 12 bp, Homo sapiens
gggctccctgac

SEQ ID NO: 2509711 - DNA, 23 bp, Homo sapiens
gggctcccttcccacctctctca

SEQ ID NO: 2509712 - DNA, 12 bp, Homo sapiens
gggctcctggaa

SEQ ID NO: 2509713 - DNA, 21 bp, Homo sapiens
gggctcctttctccagccagc

SEQ ID NO: 2509714 - DNA, 20 bp, Homo sapiens
gggctctgcaattcccctct

SEQ ID NO: 2509715 - DNA, 12 bp, Homo sapiens
gggctctgcccc

SEQ ID NO: 2509716 - DNA, 23 bp, Homo sapiens
gggctctgccccagaggcctctc

SEQ ID NO: 2509717 - DNA, 21 bp, Homo sapiens
gggctctgccccagctctggc

SEQ ID NO: 2509718 - DNA, 20 bp, Homo sapiens
gggctctgcctcccatcacc

SEQ ID NO: 2509719 - DNA, 10 bp, Homo sapiens
gggctgagac

SEQ ID NO: 2509720 - DNA, 16 bp, Homo sapiens
gggctgagctgcctgt

SEQ ID NO: 2509721 - DNA, 23 bp, Homo sapiens
gggctgagctggggacctggtac

SEQ ID NO: 2509722 - DNA, 12 bp, Homo sapiens
gggctgagggag

SEQ ID NO: 2509723 - DNA, 16 bp, Homo sapiens
gggctgaggtgggagg

SEQ ID NO: 2509724 - DNA, 20 bp, Homo sapiens
gggctgcaccggctggcctg

SEQ ID NO: 2509725 - DNA, 21 bp, Homo sapiens
gggctgcaccggctggcctgg

SEQ ID NO: 2509726 - DNA, 19 bp, Homo sapiens
gggctgcagcatgttgctg

SEQ ID NO: 2509727 - DNA, 22 bp, Homo sapiens
gggctgcagcatgttgctgagg

SEQ ID NO: 2509728 - DNA, 12 bp, Homo sapiens
gggctgcctggg

SEQ ID NO: 2509729 - DNA, 14 bp, Homo sapiens
gggctgctcctcat

SEQ ID NO: 2509730 - DNA, 11 bp, Homo sapiens
gggctggaaca

SEQ ID NO: 2509731 - DNA, 13 bp, Homo sapiens
gggctggcccagc

SEQ ID NO: 2509732 - DNA, 16 bp, Homo sapiens
gctgtgcagcctgtcc

SEQ ID NO: 2509733 - DNA, 21 bp, Homo sapiens
gctgtgcgctgacaaccaccg

SEQ ID NO: 2509734 - DNA, 18 bp, Homo sapiens
gctgtgctctggacaggc

SEQ ID NO: 2509735 - DNA, 12 bp, Homo sapiens
gctgtgctgccc

SEQ ID NO: 2509736 - DNA, 13 bp, Homo sapiens
gctgtgctgccct

SEQ ID NO: 2509737 - DNA, 17 bp, Homo sapiens
gctgtgctgccctgccc

SEQ ID NO: 2509738 - DNA, 19 bp, Homo sapiens
gctgtggccagggtgagag

SEQ ID NO: 2509739 - DNA, 16 bp, Homo sapiens
gctgtggggctggtag

SEQ ID NO: 2509740 - DNA, 23 bp, Homo sapiens
gctgtggtgtgtccccctctgtc

SEQ ID NO: 2509741 - DNA, 13 bp, Homo sapiens
gctgtgtaaagtt

SEQ ID NO: 2509742 - DNA, 17 bp, Homo sapiens
gctgtgtaaagttagtc

SEQ ID NO: 2509743 - DNA, 18 bp, Homo sapiens
gctgtgtaaagttagtct

SEQ ID NO: 2509744 - DNA, 19 bp, Homo sapiens
gctgtgtaaagttagtcta

SEQ ID NO: 2509745 - DNA, 14 bp, Homo sapiens
gctgtgttccccaa

SEQ ID NO: 2509746 - DNA, 17 bp, Homo sapiens
gctgtgtttgagctctg

SEQ ID NO: 2509747 - DNA, 16 bp, Homo sapiens
gctgttcacagccaga

SEQ ID NO: 2509748 - DNA, 12 bp, Homo sapiens
gctgttgagctg

SEQ ID NO: 2509749 - DNA, 16 bp, Homo sapiens
gctgttgagctgtttt

SEQ ID NO: 2509750 - DNA, 21 bp, Homo sapiens
gctgttgatgaggcctcttgg

SEQ ID NO: 2509751 - DNA, 15 bp, Homo sapiens
gctgttgattgctaa

SEQ ID NO: 2509752 - DNA, 16 bp, Homo sapiens
gctgttgattgctaaa

SEQ ID NO: 2509753 - DNA, 20 bp, Homo sapiens
gctgttgattgctaaatgta

SEQ ID NO: 2509754 - DNA, 13 bp, Homo sapiens
gctgttgcagtga

SEQ ID NO: 2509755 - DNA, 23 bp, Homo sapiens
gctgttggcactcacagacctgg

SEQ ID NO: 2509756 - DNA, 23 bp, Homo sapiens
gctgttggcctctgcaaaggaaa

SEQ ID NO: 2509757 - DNA, 15 bp, Homo sapiens
gctgttggctggggg

SEQ ID NO: 2509758 - DNA, 16 bp, Homo sapiens
gctgttgtacatttat

SEQ ID NO: 2509759 - DNA, 17 bp, Homo sapiens
gctgttgtccctctgct

SEQ ID NO: 2509760 - DNA, 21 bp, Homo sapiens
gctgtttaaatgtttttctat

SEQ ID NO: 2509761 - DNA, 14 bp, Homo sapiens
gctgtttatggcct

SEQ ID NO: 2509762 - DNA, 13 bp, Homo sapiens
gctgtttgaggat

SEQ ID NO: 2509763 - DNA, 13 bp, Homo sapiens
gctgttttgtgga

SEQ ID NO: 2509764 - DNA, 20 bp, Homo sapiens
gcttaagaaatctagtattt

SEQ ID NO: 2509765 - DNA, 14 bp, Homo sapiens
gcttaatgcttctt

SEQ ID NO: 2509766 - DNA, 12 bp, Homo sapiens
gcttaatgttta

SEQ ID NO: 2509767 - DNA, 19 bp, Homo sapiens
gcttacaattccctgctgt

SEQ ID NO: 2509768 - DNA, 14 bp, Homo sapiens
gcttacaatttttt

SEQ ID NO: 2509769 - DNA, 19 bp, Homo sapiens
gcttacaatttttttaatt

SEQ ID NO: 2509770 - DNA, 18 bp, Homo sapiens
gcttacacatctcagacc

SEQ ID NO: 2509771 - DNA, 14 bp, Homo sapiens
gcttacatttttac

SEQ ID NO: 2509772 - DNA, 23 bp, Homo sapiens
gcttactaagctttgccagctgc

SEQ ID NO: 2509773 - DNA, 15 bp, Homo sapiens
gcttagacataacaa

SEQ ID NO: 2509774 - DNA, 13 bp, Homo sapiens
gcttagacctcag

SEQ ID NO: 2509775 - DNA, 15 bp, Homo sapiens
gcttagacctcagcc

SEQ ID NO: 2509776 - DNA, 21 bp, Homo sapiens
gcttagacttcgactcaggat

SEQ ID NO: 2509777 - DNA, 16 bp, Homo sapiens
gcttagcaggagagga

SEQ ID NO: 2509778 - DNA, 12 bp, Homo sapiens
gcttaggatgtt

SEQ ID NO: 2509779 - DNA, 20 bp, Homo sapiens
gcttagtcactgagacagcc

SEQ ID NO: 2509780 - DNA, 21 bp, Homo sapiens
gcttagtcactgagacagccc

SEQ ID NO: 2509781 - DNA, 15 bp, Homo sapiens
gcttataggtggcct

SEQ ID NO: 2509782 - DNA, 17 bp, Homo sapiens
gcttataggtggcctct

SEQ ID NO: 2509783 - DNA, 13 bp, Homo sapiens
gcttatctcaggg

SEQ ID NO: 2509784 - DNA, 22 bp, Homo sapiens
gcttatgacatcacttgtacaa

SEQ ID NO: 2509785 - DNA, 20 bp, Homo sapiens
gcttattcatctgtttttct

SEQ ID NO: 2509786 - DNA, 13 bp, Homo sapiens
gcttattgttcca

SEQ ID NO: 2509787 - DNA, 14 bp, Homo sapiens
gcttattgttccaa

SEQ ID NO: 2509788 - DNA, 17 bp, Homo sapiens
gcttattgttccaagac

SEQ ID NO: 2509789 - DNA, 22 bp, Homo sapiens
gcttattgttccaagacattgt

SEQ ID NO: 2509790 - DNA, 18 bp, Homo sapiens
gcttatttaattaaaaaa

SEQ ID NO: 2509791 - DNA, 18 bp, Homo sapiens
gcttcacggaagagcctt

SEQ ID NO: 2509792 - DNA, 19 bp, Homo sapiens
gcttcacggaagagccttg

SEQ ID NO: 2509793 - DNA, 20 bp, Homo sapiens
gcttcacggaagagccttgc

SEQ ID NO: 2509794 - DNA, 14 bp, Homo sapiens
gcttcagccaggag

SEQ ID NO: 2509795 - DNA, 12 bp, Homo sapiens
gcttcagcctga

SEQ ID NO: 2509796 - DNA, 14 bp, Homo sapiens
gcttcagcctgagg

SEQ ID NO: 2509797 - DNA, 20 bp, Homo sapiens
gcttcagcctgaggctgaga

SEQ ID NO: 2509798 - DNA, 19 bp, Homo sapiens
gcagctttaaactcaggga

SEQ ID NO: 2509799 - DNA, 18 bp, Homo sapiens
gcagctttaaccattaaa

SEQ ID NO: 2509800 - DNA, 21 bp, Homo sapiens
gcaggaaatgaaaatgtcttg

SEQ ID NO: 2509801 - DNA, 23 bp, Homo sapiens
gcaggaaatgaaaatgtcttgtg

SEQ ID NO: 2509802 - DNA, 14 bp, Homo sapiens
gcaggaactcccag

SEQ ID NO: 2509803 - DNA, 18 bp, Homo sapiens
gcaggaagcaacgaaggg

SEQ ID NO: 2509804 - DNA, 21 bp, Homo sapiens
gcaggaagcattcagagagca

SEQ ID NO: 2509805 - DNA, 17 bp, Homo sapiens
gcaggaagctcagactg

SEQ ID NO: 2509806 - DNA, 18 bp, Homo sapiens
gcaggaagctcagactgg

SEQ ID NO: 2509807 - DNA, 15 bp, Homo sapiens
gcaggaagctgctcc

SEQ ID NO: 2509808 - DNA, 16 bp, Homo sapiens
gcaggaagctgctccg

SEQ ID NO: 2509809 - DNA, 13 bp, Homo sapiens
gcaggaaggagag

SEQ ID NO: 2509810 - DNA, 14 bp, Homo sapiens
gcaggaccaggact

SEQ ID NO: 2509811 - DNA, 19 bp, Homo sapiens
gcaggactcagctccccag

SEQ ID NO: 2509812 - DNA, 22 bp, Homo sapiens
gcaggagaatcacttgcactcc

SEQ ID NO: 2509813 - DNA, 19 bp, Homo sapiens
gcaggagaggagagccaga

SEQ ID NO: 2509814 - DNA, 22 bp, Homo sapiens
gcaggagaggagagccagagaa

SEQ ID NO: 2509815 - DNA, 22 bp, Homo sapiens
gcaggagcagtatcatgaagcc

SEQ ID NO: 2509816 - DNA, 20 bp, Homo sapiens
gcaggaggatcacttgagtc

SEQ ID NO: 2509817 - DNA, 18 bp, Homo sapiens
gcaggaggcccctggccc

SEQ ID NO: 2509818 - DNA, 19 bp, Homo sapiens
gcaggaggcccctggccca

SEQ ID NO: 2509819 - DNA, 22 bp, Homo sapiens
gcaggaggcccctggcccagcg

SEQ ID NO: 2509820 - DNA, 18 bp, Homo sapiens
gcaggagggccctacctg

SEQ ID NO: 2509821 - DNA, 20 bp, Homo sapiens
gcaggcactcaatgcagcca

SEQ ID NO: 2509822 - DNA, 13 bp, Homo sapiens
gcaggcagcgcca

SEQ ID NO: 2509823 - DNA, 16 bp, Homo sapiens
gcaggcagcgccaagc

SEQ ID NO: 2509824 - DNA, 24 bp, Homo sapiens
gcaggccaagagcagaggcagcga

SEQ ID NO: 2509825 - DNA, 20 bp, Homo sapiens
gcaggccaaggccttctcct

SEQ ID NO: 2509826 - DNA, 19 bp, Homo sapiens
gcaggcgttcagctcactg

SEQ ID NO: 2509827 - DNA, 17 bp, Homo sapiens
gcaggctaaggcgtgga

SEQ ID NO: 2509828 - DNA, 22 bp, Homo sapiens
gcaggctaaggcgtggagctgc

SEQ ID NO: 2509829 - DNA, 16 bp, Homo sapiens
gcaggctacactgaca

SEQ ID NO: 2509830 - DNA, 20 bp, Homo sapiens
gcaggctacactgacactgg

SEQ ID NO: 2509831 - DNA, 11 bp, Homo sapiens
gcaggctgaca

SEQ ID NO: 2509832 - DNA, 15 bp, Homo sapiens
gcaggctgacatctg

SEQ ID NO: 2509833 - DNA, 15 bp, Homo sapiens
gcaggctggctggcc

SEQ ID NO: 2509834 - DNA, 22 bp, Homo sapiens
gcagggaaacagctaatgggac

SEQ ID NO: 2509835 - DNA, 16 bp, Homo sapiens
gcagggagggcttctg

SEQ ID NO: 2509836 - DNA, 14 bp, Homo sapiens
gcagggctcaggat

SEQ ID NO: 2509837 - DNA, 21 bp, Homo sapiens
gcagggctcaggatttcgtgg

SEQ ID NO: 2509838 - DNA, 12 bp, Homo sapiens
gcagggctctga

SEQ ID NO: 2509839 - DNA, 21 bp, Homo sapiens
gcagggctctgccccagaggc

SEQ ID NO: 2509840 - DNA, 15 bp, Homo sapiens
gcaggggttgcagtg

SEQ ID NO: 2509841 - DNA, 15 bp, Homo sapiens
gcagggtcaggagag

SEQ ID NO: 2509842 - DNA, 21 bp, Homo sapiens
gcagggtcccatttctcactg

SEQ ID NO: 2509843 - DNA, 19 bp, Homo sapiens
gcagggtcctagaaattcc

SEQ ID NO: 2509844 - DNA, 16 bp, Homo sapiens
gcagggtctcactctg

SEQ ID NO: 2509845 - DNA, 14 bp, Homo sapiens
gcagggtctgggca

SEQ ID NO: 2509846 - DNA, 16 bp, Homo sapiens
gcagggtcttttcatc

SEQ ID NO: 2509847 - DNA, 21 bp, Homo sapiens
gcaggtcaacagctatgctgg

SEQ ID NO: 2509848 - DNA, 19 bp, Homo sapiens
gcaggtcttgaactcctgg

SEQ ID NO: 2509849 - DNA, 17 bp, Homo sapiens
gcaggtgaccttctggg

SEQ ID NO: 2509850 - DNA, 16 bp, Homo sapiens
gcaggtgcctccaggt

SEQ ID NO: 2509851 - DNA, 18 bp, Homo sapiens
gcaggtgcctccaggtgt

SEQ ID NO: 2509852 - DNA, 17 bp, Homo sapiens
gcaggtggggagactgg

SEQ ID NO: 2509853 - DNA, 21 bp, Homo sapiens
gcaggtggggagactgggctg

SEQ ID NO: 2509854 - DNA, 13 bp, Homo sapiens
gcaggtggggagg

SEQ ID NO: 2509855 - DNA, 21 bp, Homo sapiens
gcaggtggtggcactgagccc

SEQ ID NO: 2509856 - DNA, 23 bp, Homo sapiens
gcaggtggtggcactgagccccc

SEQ ID NO: 2509857 - DNA, 22 bp, Homo sapiens
gcaggtgtcatatatggggggc

SEQ ID NO: 2509858 - DNA, 16 bp, Homo sapiens
gcaggttgaggggctc

SEQ ID NO: 2509859 - DNA, 16 bp, Homo sapiens
gcagtacctataaagt

SEQ ID NO: 2509860 - DNA, 21 bp, Homo sapiens
gcagtagaggctatggacagg

SEQ ID NO: 2509861 - DNA, 15 bp, Homo sapiens
gcagtatcatgaagc

SEQ ID NO: 2509862 - DNA, 17 bp, Homo sapiens
gcagtcacatctcttcc

SEQ ID NO: 2509863 - DNA, 22 bp, Homo sapiens
gcagtcatcttgaccaagcagg

SEQ ID NO: 2509864 - DNA, 23 bp, Homo sapiens
gcagtcatcttgaccaagcagga

SEQ ID NO: 2509865 - DNA, 19 bp, Homo sapiens
gcagtcattatccaggtaa

SEQ ID NO: 2509866 - DNA, 19 bp, Homo sapiens
gcagtcctgatcagagccg

SEQ ID NO: 2509867 - DNA, 18 bp, Homo sapiens
gcagtcctgcctcagcct

SEQ ID NO: 2509868 - DNA, 20 bp, Homo sapiens
gcagtcctggaagccagctt

SEQ ID NO: 2509869 - DNA, 18 bp, Homo sapiens
gcagtcgggggctggcct

SEQ ID NO: 2509870 - DNA, 21 bp, Homo sapiens
gcagtcgggggctggcctagg

SEQ ID NO: 2509871 - DNA, 23 bp, Homo sapiens
gcagtcgggggctggcctaggag

SEQ ID NO: 2509872 - DNA, 20 bp, Homo sapiens
gcagtcgtcgcacagtctct

SEQ ID NO: 2509873 - DNA, 20 bp, Homo sapiens
gcagtctatatgtttgtata

SEQ ID NO: 2509874 - DNA, 17 bp, Homo sapiens
gcagtctgatccaggag

SEQ ID NO: 2509875 - DNA, 19 bp, Homo sapiens
gcagtctggctgagccctg

SEQ ID NO: 2509876 - DNA, 20 bp, Homo sapiens
gcagtgaatgattcagtgtt

SEQ ID NO: 2509877 - DNA, 22 bp, Homo sapiens
gcagtgagaaaaagctcctgtc

SEQ ID NO: 2509878 - DNA, 14 bp, Homo sapiens
gcagtgagcggaga

SEQ ID NO: 2509879 - DNA, 19 bp, Homo sapiens
gcagtgagttacagcgaga

SEQ ID NO: 2509880 - DNA, 23 bp, Homo sapiens
gcagtgcaagagactctggcctc

SEQ ID NO: 2509881 - DNA, 15 bp, Homo sapiens
gcagtgccttccata

SEQ ID NO: 2509882 - DNA, 16 bp, Homo sapiens
gcagtgccttccataa

SEQ ID NO: 2509883 - DNA, 22 bp, Homo sapiens
gcagtgcgcgtgcacgtggaga

SEQ ID NO: 2509884 - DNA, 16 bp, Homo sapiens
gcagtggctcacgcct

SEQ ID NO: 2509885 - DNA, 12 bp, Homo sapiens
gcagtgggagct

SEQ ID NO: 2509886 - DNA, 18 bp, Homo sapiens
gcagtggtaagctctggc

SEQ ID NO: 2509887 - DNA, 20 bp, Homo sapiens
gcagtggtgcgatctgggtt

SEQ ID NO: 2509888 - DNA, 20 bp, Homo sapiens
gcagtggtggttttctgttc

SEQ ID NO: 2509889 - DNA, 23 bp, Homo sapiens
gcagtggtggttttctgttcttt

SEQ ID NO: 2509890 - DNA, 16 bp, Homo sapiens
gcagtgtcttccataa

SEQ ID NO: 2509891 - DNA, 20 bp, Homo sapiens
gcagtgtcttccataatgta

SEQ ID NO: 2509892 - DNA, 19 bp, Homo sapiens
gcagtgtgaggccagggca

SEQ ID NO: 2509893 - DNA, 21 bp, Homo sapiens
gcagtgttccccatctgggtc

SEQ ID NO: 2509894 - DNA, 21 bp, Homo sapiens
gcagtgttcctatttggggct

SEQ ID NO: 2509895 - DNA, 21 bp, Homo sapiens
gcagttccggattggcttgtg

SEQ ID NO: 2509896 - DNA, 23 bp, Homo sapiens
gcagttccggattggcttgtgtg

SEQ ID NO: 2509897 - DNA, 21 bp, Homo sapiens
gcagttctagtttgcattcct

SEQ ID NO: 2509898 - DNA, 19 bp, Homo sapiens
gcagttctgggtgctccct

SEQ ID NO: 2509899 - DNA, 16 bp, Homo sapiens
gcagttgaaaagactc

SEQ ID NO: 2509900 - DNA, 16 bp, Homo sapiens
gcagtttatcattcaa

SEQ ID NO: 2509901 - DNA, 13 bp, Homo sapiens
gcataaatatgca

SEQ ID NO: 2509902 - DNA, 17 bp, Homo sapiens
gcatacatttataatgt

SEQ ID NO: 2509903 - DNA, 13 bp, Homo sapiens
gcatacctttatt

SEQ ID NO: 2509904 - DNA, 16 bp, Homo sapiens
gcatacgtacacattt

SEQ ID NO: 2509905 - DNA, 13 bp, Homo sapiens
gcatacttcaaaa

SEQ ID NO: 2509906 - DNA, 19 bp, Homo sapiens
gcatagatgcaggtgagcc

SEQ ID NO: 2509907 - DNA, 18 bp, Homo sapiens
gcatagattccctgagca

SEQ ID NO: 2509908 - DNA, 14 bp, Homo sapiens
gcatagcaaacaga

SEQ ID NO: 2509909 - DNA, 12 bp, Homo sapiens
gcataggcctgg

SEQ ID NO: 2509910 - DNA, 16 bp, Homo sapiens
gcataggcctgggtgc

SEQ ID NO: 2509911 - DNA, 20 bp, Homo sapiens
gcatagtaccaatcatttta

SEQ ID NO: 2509912 - DNA, 18 bp, Homo sapiens
gcatagttcccatgttaa

SEQ ID NO: 2509913 - DNA, 18 bp, Homo sapiens
gcatatccaccacctccc

SEQ ID NO: 2509914 - DNA, 21 bp, Homo sapiens
ggagacacaacaactcctagg

SEQ ID NO: 2509915 - DNA, 17 bp, Homo sapiens
ggagacactggcccctc

SEQ ID NO: 2509916 - DNA, 20 bp, Homo sapiens
ggagacactggcccctcaaa

SEQ ID NO: 2509917 - DNA, 13 bp, Homo sapiens
ggagacagtgatc

SEQ ID NO: 2509918 - DNA, 20 bp, Homo sapiens
ggagacattcctgggcacag

SEQ ID NO: 2509919 - DNA, 19 bp, Homo sapiens
ggagaccatgcagagcgcc

SEQ ID NO: 2509920 - DNA, 22 bp, Homo sapiens
ggagacgtacgtatcagcggcc

SEQ ID NO: 2509921 - DNA, 14 bp, Homo sapiens
ggagactagattgc

SEQ ID NO: 2509922 - DNA, 19 bp, Homo sapiens
ggagactagattgcctttg

SEQ ID NO: 2509923 - DNA, 17 bp, Homo sapiens
ggagactatcagcccaa

SEQ ID NO: 2509924 - DNA, 18 bp, Homo sapiens
ggagactccatgagaagc

SEQ ID NO: 2509925 - DNA, 21 bp, Homo sapiens
ggagactccatgagaagccgt

SEQ ID NO: 2509926 - DNA, 18 bp, Homo sapiens
ggagactgcttcccatcc

SEQ ID NO: 2509927 - DNA, 19 bp, Homo sapiens
ggagactgcttcccatcct

SEQ ID NO: 2509928 - DNA, 23 bp, Homo sapiens
ggagactgcttcccatcctaccc

SEQ ID NO: 2509929 - DNA, 17 bp, Homo sapiens
ggagactgggctgaggg

SEQ ID NO: 2509930 - DNA, 23 bp, Homo sapiens
ggagactgggctgagggagcctg

SEQ ID NO: 2509931 - DNA, 20 bp, Homo sapiens
ggagactggtcctgtgtgca

SEQ ID NO: 2509932 - DNA, 19 bp, Homo sapiens
ggagagagacgtgtacata

SEQ ID NO: 2509933 - DNA, 19 bp, Homo sapiens
ggagagccagaacctggag

SEQ ID NO: 2509934 - DNA, 14 bp, Homo sapiens
ggagagccagagaa

SEQ ID NO: 2509935 - DNA, 13 bp, Homo sapiens
ggagagccttcca

SEQ ID NO: 2509936 - DNA, 20 bp, Homo sapiens
ggagagcgcctgcccctccc

SEQ ID NO: 2509937 - DNA, 22 bp, Homo sapiens
ggagagctagaacctggagagc

SEQ ID NO: 2509938 - DNA, 17 bp, Homo sapiens
ggagagctagcagcagg

SEQ ID NO: 2509939 - DNA, 13 bp, Homo sapiens
ggagagctggagc

SEQ ID NO: 2509940 - DNA, 18 bp, Homo sapiens
ggagagctggagcctggt

SEQ ID NO: 2509941 - DNA, 17 bp, Homo sapiens
ggagagctggtgcccgg

SEQ ID NO: 2509942 - DNA, 20 bp, Homo sapiens
ggagaggatgagagcccaga

SEQ ID NO: 2509943 - DNA, 15 bp, Homo sapiens
ggagaggggcacagg

SEQ ID NO: 2509944 - DNA, 11 bp, Homo sapiens
ggagaggtctt

SEQ ID NO: 2509945 - DNA, 13 bp, Homo sapiens
ggagaggtggagc

SEQ ID NO: 2509946 - DNA, 21 bp, Homo sapiens
ggagaggttataggtcactcc

SEQ ID NO: 2509947 - DNA, 23 bp, Homo sapiens
ggagaggttataggtcactcctg

SEQ ID NO: 2509948 - DNA, 20 bp, Homo sapiens
ggagagtcccagagcaggag

SEQ ID NO: 2509949 - DNA, 21 bp, Homo sapiens
ggagagtcccagagcaggagg

SEQ ID NO: 2509950 - DNA, 22 bp, Homo sapiens
ggagagtcccagagcaggaggc

SEQ ID NO: 2509951 - DNA, 23 bp, Homo sapiens
ggagagttcaatggctgctgaag

SEQ ID NO: 2509952 - DNA, 20 bp, Homo sapiens
ctaatcaggctgaggtgtct

SEQ ID NO: 2509953 - DNA, 18 bp, Homo sapiens
ctaatcagtgtctcacac

SEQ ID NO: 2509954 - DNA, 16 bp, Homo sapiens
ctaatcctctttttct

SEQ ID NO: 2509955 - DNA, 17 bp, Homo sapiens
ctaatctattgggttca

SEQ ID NO: 2509956 - DNA, 18 bp, Homo sapiens
ctaatctgtagggctgga

SEQ ID NO: 2509957 - DNA, 12 bp, Homo sapiens
ctaatgatgttt

SEQ ID NO: 2509958 - DNA, 19 bp, Homo sapiens
ctaatgggtatttaaacaa

SEQ ID NO: 2509959 - DNA, 13 bp, Homo sapiens
ctaatgtcttcat

SEQ ID NO: 2509960 - DNA, 21 bp, Homo sapiens
ctaatgtcttcatttcattgt

SEQ ID NO: 2509961 - DNA, 19 bp, Homo sapiens
ctaatgtggttatttctct

SEQ ID NO: 2509962 - DNA, 18 bp, Homo sapiens
ctaatgtttatgagccag

SEQ ID NO: 2509963 - DNA, 18 bp, Homo sapiens
ctaattatataatatttt

SEQ ID NO: 2509964 - DNA, 13 bp, Homo sapiens
ctaattcatttat

SEQ ID NO: 2509965 - DNA, 16 bp, Homo sapiens
ctaattcccagagtgt

SEQ ID NO: 2509966 - DNA, 18 bp, Homo sapiens
ctaattcccattttgcaa

SEQ ID NO: 2509967 - DNA, 19 bp, Homo sapiens
ctaattcccattttgcaaa

SEQ ID NO: 2509968 - DNA, 20 bp, Homo sapiens
ctaattcccattttgcaaaa

SEQ ID NO: 2509969 - DNA, 19 bp, Homo sapiens
ctaattggaagaaattcct

SEQ ID NO: 2509970 - DNA, 16 bp, Homo sapiens
ctaattgtataacagg

SEQ ID NO: 2509971 - DNA, 22 bp, Homo sapiens
ctaattgtataacaggttattt

SEQ ID NO: 2509972 - DNA, 14 bp, Homo sapiens
ctaatttaaaaaat

SEQ ID NO: 2509973 - DNA, 19 bp, Homo sapiens
ctaatttcaaaaatataac

SEQ ID NO: 2509974 - DNA, 16 bp, Homo sapiens
ctaatttgatgtttac

SEQ ID NO: 2509975 - DNA, 15 bp, Homo sapiens
ctaattttggatgga

SEQ ID NO: 2509976 - DNA, 12 bp, Homo sapiens
ctaatttttaag

SEQ ID NO: 2509977 - DNA, 17 bp, Homo sapiens
ctaatttttaagcaaaa

SEQ ID NO: 2509978 - DNA, 20 bp, Homo sapiens
ctaatttttgtatttttcgt

SEQ ID NO: 2509979 - DNA, 15 bp, Homo sapiens
ctacaaaaacacagc

SEQ ID NO: 2509980 - DNA, 17 bp, Homo sapiens
ctacaaaaacacagcaa

SEQ ID NO: 2509981 - DNA, 14 bp, Homo sapiens
ctacaaagaagaca

SEQ ID NO: 2509982 - DNA, 16 bp, Homo sapiens
ctacaacttcagcagt

SEQ ID NO: 2509983 - DNA, 17 bp, Homo sapiens
ctacaacttcagcagta

SEQ ID NO: 2509984 - DNA, 17 bp, Homo sapiens
ctacaagagcagcctgt

SEQ ID NO: 2509985 - DNA, 18 bp, Homo sapiens
ctacaagagcagcctgtg

SEQ ID NO: 2509986 - DNA, 17 bp, Homo sapiens
ggccatgagctccagac

SEQ ID NO: 2509987 - DNA, 18 bp, Homo sapiens
ggccatgagctccagacc

SEQ ID NO: 2509988 - DNA, 17 bp, Homo sapiens
ggccatggagagctgga

SEQ ID NO: 2509989 - DNA, 21 bp, Homo sapiens
ggccatggagagctggagcct

SEQ ID NO: 2509990 - DNA, 13 bp, Homo sapiens
ggccatgtcctta

SEQ ID NO: 2509991 - DNA, 12 bp, Homo sapiens
ggccattcagca

SEQ ID NO: 2509992 - DNA, 23 bp, Homo sapiens
ggcccaacacaattcttcttcca

SEQ ID NO: 2509993 - DNA, 13 bp, Homo sapiens
ggcccaaccctgt

SEQ ID NO: 2509994 - DNA, 20 bp, Homo sapiens
ggcccacagggaaccctgct

SEQ ID NO: 2509995 - DNA, 14 bp, Homo sapiens
ggcccacctggcca

SEQ ID NO: 2509996 - DNA, 17 bp, Homo sapiens
ggcccacctggccacct

SEQ ID NO: 2509997 - DNA, 18 bp, Homo sapiens
ggcccacctggccacctg

SEQ ID NO: 2509998 - DNA, 19 bp, Homo sapiens
ggcccacctggccacctga

SEQ ID NO: 2509999 - DNA, 17 bp, Homo sapiens
ggcccagagggcctgca

SEQ ID NO: 2510000 - DNA, 21 bp, Homo sapiens
tgttatttataatcacttttt

SEQ ID NO: 2510001 - DNA, 21 bp, Homo sapiens
tgttatttctatttttgtaga

SEQ ID NO: 2510002 - DNA, 18 bp, Homo sapiens
tgttattttcagtatttt

SEQ ID NO: 2510003 - DNA, 19 bp, Homo sapiens
tgttattttctttgaaatt

SEQ ID NO: 2510004 - DNA, 14 bp, Homo sapiens
tgttattttgcaac

SEQ ID NO: 2510005 - DNA, 21 bp, Homo sapiens
tgttatttttgtttcttccaa

SEQ ID NO: 2510006 - DNA, 19 bp, Homo sapiens
tgttcaaaaaaacactagt

SEQ ID NO: 2510007 - DNA, 15 bp, Homo sapiens
tgttcacactctcac

SEQ ID NO: 2510008 - DNA, 19 bp, Homo sapiens
tgttcacactctcacatgt

SEQ ID NO: 2510009 - DNA, 16 bp, Homo sapiens
tgttcaccatcggcag

SEQ ID NO: 2510010 - DNA, 18 bp, Homo sapiens
tgttcagattgctttgat

SEQ ID NO: 2510011 - DNA, 22 bp, Homo sapiens
tgttcagctccagctcaccagc

SEQ ID NO: 2510012 - DNA, 12 bp, Homo sapiens
tgttcattgtaa

SEQ ID NO: 2510013 - DNA, 14 bp, Homo sapiens
tgttcattgtaatg

SEQ ID NO: 2510014 - DNA, 23 bp, Homo sapiens
tgttcattgtaatgttactgatc

SEQ ID NO: 2510015 - DNA, 14 bp, Homo sapiens
tgttccaactgccc

SEQ ID NO: 2510016 - DNA, 19 bp, Homo sapiens
tgttccaagacattgtcaa

SEQ ID NO: 2510017 - DNA, 19 bp, Homo sapiens
tgttccacaagttaaataa

SEQ ID NO: 2510018 - DNA, 17 bp, Homo sapiens
tgttccagcctgccctc

SEQ ID NO: 2510019 - DNA, 15 bp, Homo sapiens
tgttccccctgtgca

SEQ ID NO: 2510020 - DNA, 21 bp, Homo sapiens
tgttcccctcactggatgaaa

SEQ ID NO: 2510021 - DNA, 21 bp, Homo sapiens
tgttccccttccactgagggc

SEQ ID NO: 2510022 - DNA, 14 bp, Homo sapiens
tgttccctctgctc

SEQ ID NO: 2510023 - DNA, 17 bp, Homo sapiens
tgttctaagtctttcca

SEQ ID NO: 2510024 - DNA, 13 bp, Homo sapiens
tgttctgacatta

SEQ ID NO: 2510025 - DNA, 17 bp, Homo sapiens
tgttctgacattaacag

SEQ ID NO: 2510026 - DNA, 16 bp, Homo sapiens
tgttctggctcttcca

SEQ ID NO: 2510027 - DNA, 13 bp, Homo sapiens
tgttctgggacac

SEQ ID NO: 2510028 - DNA, 18 bp, Homo sapiens
tgttctgtggaaagtgta

SEQ ID NO: 2510029 - DNA, 16 bp, Homo sapiens
tgttcttaattcttag

SEQ ID NO: 2510030 - DNA, 18 bp, Homo sapiens
tgttcttagtttgcagtt

SEQ ID NO: 2510031 - DNA, 23 bp, Homo sapiens
tgttcttgaatttaataatctgt

SEQ ID NO: 2510032 - DNA, 18 bp, Homo sapiens
tgttcttggtttgtaaat

SEQ ID NO: 2510033 - DNA, 22 bp, Homo sapiens
tgttctttctggctatgcattt

SEQ ID NO: 2510034 - DNA, 16 bp, Homo sapiens
tgttcttttgtcccag

SEQ ID NO: 2510035 - DNA, 23 bp, Homo sapiens
tgttgaaaaaaaagtttcagaga

SEQ ID NO: 2510036 - DNA, 21 bp, Homo sapiens
tgttgaaaattattttaaaca

SEQ ID NO: 2510037 - DNA, 22 bp, Homo sapiens
tgttgaaattatgtatgtttac

SEQ ID NO: 2510038 - DNA, 21 bp, Homo sapiens
tgttgacttattttctctgtg

SEQ ID NO: 2510039 - DNA, 11 bp, Homo sapiens
tgttgattatt

SEQ ID NO: 2510040 - DNA, 15 bp, Homo sapiens
tgttgattgctaaat

SEQ ID NO: 2510041 - DNA, 17 bp, Homo sapiens
tgttgcatgatgtattt

SEQ ID NO: 2510042 - DNA, 20 bp, Homo sapiens
tgttgcatgggctaatgaag

SEQ ID NO: 2510043 - DNA, 13 bp, Homo sapiens
tgttgcttacaat

SEQ ID NO: 2510044 - DNA, 14 bp, Homo sapiens
tgttgcttggacta

SEQ ID NO: 2510045 - DNA, 13 bp, Homo sapiens
tgttggaaaagaa

SEQ ID NO: 2510046 - DNA, 14 bp, Homo sapiens
tgttggagcctgca

SEQ ID NO: 2510047 - DNA, 20 bp, Homo sapiens
tgttggataaatcagtggtt

SEQ ID NO: 2510048 - DNA, 21 bp, Homo sapiens
tgttggatcttcaatggcttt

SEQ ID NO: 2510049 - DNA, 19 bp, Homo sapiens
tgttggatttataaatgct

SEQ ID NO: 2510050 - DNA, 23 bp, Homo sapiens
tgttggatttataaatgctattt

SEQ ID NO: 2510051 - DNA, 18 bp, Homo sapiens
tgttggcacatgcctgta

SEQ ID NO: 2510052 - DNA, 15 bp, Homo sapiens
tgttggcactcacag

SEQ ID NO: 2510053 - DNA, 23 bp, Homo sapiens
tgttggcactcacagacctggag

SEQ ID NO: 2510054 - DNA, 15 bp, Homo sapiens
tgttggccaaagcca

SEQ ID NO: 2510055 - DNA, 15 bp, Homo sapiens
tgttggccaggctgg

SEQ ID NO: 2510056 - DNA, 16 bp, Homo sapiens
tgttggccaggctggt

SEQ ID NO: 2510057 - DNA, 17 bp, Homo sapiens
tgttggcctccggcctc

SEQ ID NO: 2510058 - DNA, 22 bp, Homo sapiens
tgttggctgggaactcacctgg

SEQ ID NO: 2510059 - DNA, 17 bp, Homo sapiens
tgttggctgggggcctc

SEQ ID NO: 2510060 - DNA, 19 bp, Homo sapiens
tgttggctgggggcctcag

SEQ ID NO: 2510061 - DNA, 21 bp, Homo sapiens
tgttggtaattattttggtac

SEQ ID NO: 2510062 - DNA, 16 bp, Homo sapiens
tgttggttccaagccc

SEQ ID NO: 2510063 - DNA, 17 bp, Homo sapiens
tgttggttttgactgga

SEQ ID NO: 2510064 - DNA, 15 bp, Homo sapiens
tgttgtacatttatg

SEQ ID NO: 2510065 - DNA, 12 bp, Homo sapiens
tgttgtcttgaa

SEQ ID NO: 2510066 - DNA, 14 bp, Homo sapiens
tgttgtgtgtggga

SEQ ID NO: 2510067 - DNA, 16 bp, Homo sapiens
tgttgtgtgtgggagt

SEQ ID NO: 2510068 - DNA, 17 bp, Homo sapiens
tgttgttaatgaaaatg

SEQ ID NO: 2510069 - DNA, 21 bp, Homo sapiens
tgttgttaatgaaaatgtcag

SEQ ID NO: 2510070 - DNA, 15 bp, Homo sapiens
tgttgtttctttcta

SEQ ID NO: 2510071 - DNA, 12 bp, Homo sapiens
tgttgtttgcca

SEQ ID NO: 2510072 - DNA, 11 bp, Homo sapiens
tgttgttttgt

SEQ ID NO: 2510073 - DNA, 14 bp, Homo sapiens
tgtttaaaatcatt

SEQ ID NO: 2510074 - DNA, 17 bp, Homo sapiens
tgtttaaaatcatttct

SEQ ID NO: 2510075 - DNA, 20 bp, Homo sapiens
tgtttaaataaagtatcatg

SEQ ID NO: 2510076 - DNA, 14 bp, Homo sapiens
tgtttaagatgggc

SEQ ID NO: 2510077 - DNA, 16 bp, Homo sapiens
tgtttaatattgagaa

SEQ ID NO: 2510078 - DNA, 16 bp, Homo sapiens
tgtttacactctttgt

SEQ ID NO: 2510079 - DNA, 20 bp, Homo sapiens
tgtttacagcactactctgt

SEQ ID NO: 2510080 - DNA, 19 bp, Homo sapiens
tgtttactagggatccctc

SEQ ID NO: 2510081 - DNA, 17 bp, Homo sapiens
tgtttacttaaagattt

SEQ ID NO: 2510082 - DNA, 16 bp, Homo sapiens
tgtttagcaaatacat

SEQ ID NO: 2510083 - DNA, 21 bp, Homo sapiens
tgtttatgagccagacaaatg

SEQ ID NO: 2510084 - DNA, 13 bp, Homo sapiens
tgtttatggcctc

SEQ ID NO: 2510085 - DNA, 13 bp, Homo sapiens
tgtttatgtgtgt

SEQ ID NO: 2510086 - DNA, 13 bp, Homo sapiens
tgtttattcctga

SEQ ID NO: 2510087 - DNA, 16 bp, Homo sapiens
tgtttattttatatta

SEQ ID NO: 2510088 - DNA, 12 bp, Homo sapiens
tgtttatttttc

SEQ ID NO: 2510089 - DNA, 19 bp, Homo sapiens
tgtttcaaacacaaatgca

SEQ ID NO: 2510090 - DNA, 18 bp, Homo sapiens
tgtttcacgaagtttgtt

SEQ ID NO: 2510091 - DNA, 22 bp, Homo sapiens
tgtttccaatgtttagcaaata

SEQ ID NO: 2510092 - DNA, 16 bp, Homo sapiens
tgtttcctgcaggcca

SEQ ID NO: 2510093 - DNA, 15 bp, Homo sapiens
tgtttcctggcactg

SEQ ID NO: 2510094 - DNA, 22 bp, Homo sapiens
tgtttcctggcactgcttccag

SEQ ID NO: 2510095 - DNA, 11 bp, Homo sapiens
tgtttcctttt

SEQ ID NO: 2510096 - DNA, 20 bp, Homo sapiens
tgtttcgtgaagtatactgt

SEQ ID NO: 2510097 - DNA, 15 bp, Homo sapiens
tgtttctctgctgtt

SEQ ID NO: 2510098 - DNA, 12 bp, Homo sapiens
tgtttctgttat

SEQ ID NO: 2510099 - DNA, 14 bp, Homo sapiens
tgtttctgttatta

SEQ ID NO: 2510100 - DNA, 19 bp, Homo sapiens
tgtttcttccaaagcacat

SEQ ID NO: 2510101 - DNA, 13 bp, Homo sapiens
tgtttctttctag

SEQ ID NO: 2510102 - DNA, 18 bp, Homo sapiens
tgtttgaaacaaagaagg

SEQ ID NO: 2510103 - DNA, 22 bp, Homo sapiens
tgtttgaggatatattttcact

SEQ ID NO: 2510104 - DNA, 16 bp, Homo sapiens
tgtttgatgcattaaa

SEQ ID NO: 2510105 - DNA, 19 bp, Homo sapiens
tgtttgatgcattaaaaga

SEQ ID NO: 2510106 - DNA, 22 bp, Homo sapiens
tgtttgcatgtgaaaatcaaat

SEQ ID NO: 2510107 - DNA, 17 bp, Homo sapiens
tgtttgctatcttaatt

SEQ ID NO: 2510108 - DNA, 22 bp, Homo sapiens
tgggaaccccttcatcctctga

SEQ ID NO: 2510109 - DNA, 15 bp, Homo sapiens
tgggaacgagagggg

SEQ ID NO: 2510110 - DNA, 20 bp, Homo sapiens
tgggaagataggctctgcac

SEQ ID NO: 2510111 - DNA, 22 bp, Homo sapiens
tgggaaggggacccccgccccc

SEQ ID NO: 2510112 - DNA, 23 bp, Homo sapiens
tgggaataagtgccaggatggaa

SEQ ID NO: 2510113 - DNA, 15 bp, Homo sapiens
tgggaatgaagcttg

SEQ ID NO: 2510114 - DNA, 17 bp, Homo sapiens
tgggaatgaggcttgct

SEQ ID NO: 2510115 - DNA, 21 bp, Homo sapiens
tgggaatgtattattctgcag

SEQ ID NO: 2510116 - DNA, 14 bp, Homo sapiens
tgggaattgtgtga

SEQ ID NO: 2510117 - DNA, 15 bp, Homo sapiens
tgggacaccctgtga

SEQ ID NO: 2510118 - DNA, 16 bp, Homo sapiens
tgggaccaaacctagc

SEQ ID NO: 2510119 - DNA, 19 bp, Homo sapiens
tgggaccacgtgagatcat

SEQ ID NO: 2510120 - DNA, 23 bp, Homo sapiens
tgggacctcagttttatcatttt

SEQ ID NO: 2510121 - DNA, 15 bp, Homo sapiens
tgggactacaggcac

SEQ ID NO: 2510122 - DNA, 16 bp, Homo sapiens
tgggactacaggtgtg

SEQ ID NO: 2510123 - DNA, 18 bp, Homo sapiens
tgggactcaatgcactga

SEQ ID NO: 2510124 - DNA, 17 bp, Homo sapiens
tgggactgctaaataaa

SEQ ID NO: 2510125 - DNA, 18 bp, Homo sapiens
tgggacttcttttcacat

SEQ ID NO: 2510126 - DNA, 20 bp, Homo sapiens
tgggacttcttttcacattc

SEQ ID NO: 2510127 - DNA, 16 bp, Homo sapiens
tgggggacagggctgg

SEQ ID NO: 2510128 - DNA, 21 bp, Homo sapiens
tgggggatcacagcctctgaa

SEQ ID NO: 2510129 - DNA, 16 bp, Homo sapiens
tgggggccatgagctc

SEQ ID NO: 2510130 - DNA, 14 bp, Homo sapiens
tgggggctgcagca

SEQ ID NO: 2510131 - DNA, 21 bp, Homo sapiens
tgggggctgcagcatgttgct

SEQ ID NO: 2510132 - DNA, 15 bp, Homo sapiens
tgggggctggtgcca

SEQ ID NO: 2510133 - DNA, 16 bp, Homo sapiens
tgggggctggtgccag

SEQ ID NO: 2510134 - DNA, 21 bp, Homo sapiens
tgggggtagagctgatccaga

SEQ ID NO: 2510135 - DNA, 20 bp, Homo sapiens
tgggggttctttcttcctct

SEQ ID NO: 2510136 - DNA, 20 bp, Homo sapiens
tggggtagctagaggaacca

SEQ ID NO: 2510137 - DNA, 16 bp, Homo sapiens
tggggtagggctgact

SEQ ID NO: 2510138 - DNA, 15 bp, Homo sapiens
tggggtaggttggga

SEQ ID NO: 2510139 - DNA, 21 bp, Homo sapiens
tggggtaggttgggagaatgt

SEQ ID NO: 2510140 - DNA, 24 bp, Homo sapiens
tggggtatttaccacagcagctga

SEQ ID NO: 2510141 - DNA, 14 bp, Homo sapiens
tggggtcactctgg

SEQ ID NO: 2510142 - DNA, 17 bp, Homo sapiens
tggggtcactctggcag

SEQ ID NO: 2510143 - DNA, 19 bp, Homo sapiens
tggggtcactctggcagct

SEQ ID NO: 2510144 - DNA, 17 bp, Homo sapiens
tggggtcagagactgct

SEQ ID NO: 2510145 - DNA, 13 bp, Homo sapiens
tggggtcagccag

SEQ ID NO: 2510146 - DNA, 15 bp, Homo sapiens
tggggtcagccaggg

SEQ ID NO: 2510147 - DNA, 21 bp, Homo sapiens
tggggtcagccagggccaggg

SEQ ID NO: 2510148 - DNA, 13 bp, Homo sapiens
tggggtccccatc

SEQ ID NO: 2510149 - DNA, 14 bp, Homo sapiens
tggggtctgacccc

SEQ ID NO: 2510150 - DNA, 17 bp, Homo sapiens
tggggtgatgctgggct

SEQ ID NO: 2510151 - DNA, 17 bp, Homo sapiens
tggggtgccgcctgccc

SEQ ID NO: 2510152 - DNA, 15 bp, Homo sapiens
tggggtgtgggaggc

SEQ ID NO: 2510153 - DNA, 21 bp, Homo sapiens
tggggtgtgttccaactgccc

SEQ ID NO: 2510154 - DNA, 19 bp, Homo sapiens
tggggttatctctgtgtta

SEQ ID NO: 2510155 - DNA, 21 bp, Homo sapiens
tggggttggctgggcccagaa

SEQ ID NO: 2510156 - DNA, 14 bp, Homo sapiens
tggggttgtgttgt

SEQ ID NO: 2510157 - DNA, 15 bp, Homo sapiens
tgggtacctattttc

SEQ ID NO: 2510158 - DNA, 23 bp, Homo sapiens
tgggtacttgtggacacagctct

SEQ ID NO: 2510159 - DNA, 13 bp, Homo sapiens
tgggtagctgtaa

SEQ ID NO: 2510160 - DNA, 15 bp, Homo sapiens
tgggtatattcattt

SEQ ID NO: 2510161 - DNA, 23 bp, Homo sapiens
tgggtcagtgtccaaagcagggt

SEQ ID NO: 2510162 - DNA, 14 bp, Homo sapiens
tgggtccaaataaa

SEQ ID NO: 2510163 - DNA, 14 bp, Homo sapiens
tgggtccatgggca

SEQ ID NO: 2510164 - DNA, 17 bp, Homo sapiens
tgggtccatgggcagag

SEQ ID NO: 2510165 - DNA, 18 bp, Homo sapiens
tgggtcctcacatctttc

SEQ ID NO: 2510166 - DNA, 20 bp, Homo sapiens
tgggtctcgctttgttgccc

SEQ ID NO: 2510167 - DNA, 22 bp, Homo sapiens
tgggtctcgctttgttgcccag

SEQ ID NO: 2510168 - DNA, 19 bp, Homo sapiens
tgggtctgagtcatggccg

SEQ ID NO: 2510169 - DNA, 17 bp, Homo sapiens
tgggtctggctgagctg

SEQ ID NO: 2510170 - DNA, 20 bp, Homo sapiens
tgggtctgtgtctcttttct

SEQ ID NO: 2510171 - DNA, 12 bp, Homo sapiens
tgggtctgtgtg

SEQ ID NO: 2510172 - DNA, 13 bp, Homo sapiens
tgggtctgtgtgt

SEQ ID NO: 2510173 - DNA, 14 bp, Homo sapiens
tgggtctgttttcc

SEQ ID NO: 2510174 - DNA, 15 bp, Homo sapiens
tgggtctgttttcct

SEQ ID NO: 2510175 - DNA, 21 bp, Homo sapiens
tgggtctgttttcctttctca

SEQ ID NO: 2510176 - DNA, 15 bp, Homo sapiens
tgggtgcttggagga

SEQ ID NO: 2510177 - DNA, 19 bp, Homo sapiens
tgggtgcttggaggaagga

SEQ ID NO: 2510178 - DNA, 17 bp, Homo sapiens
tgggtggagaagccatt

SEQ ID NO: 2510179 - DNA, 22 bp, Homo sapiens
tgggtggcaccagcagcctgga

SEQ ID NO: 2510180 - DNA, 15 bp, Homo sapiens
tgggtggggtgagga

SEQ ID NO: 2510181 - DNA, 14 bp, Homo sapiens
tgggtgggtggtgg

SEQ ID NO: 2510182 - DNA, 18 bp, Homo sapiens
tgggtggtaccctctgga

SEQ ID NO: 2510183 - DNA, 22 bp, Homo sapiens
tgggtgtaacaggtctcctctt

SEQ ID NO: 2510184 - DNA, 23 bp, Homo sapiens
tgggtgtaacaggtctcctctta

SEQ ID NO: 2510185 - DNA, 23 bp, Homo sapiens
tgggtgtcaagagggtctgagga

SEQ ID NO: 2510186 - DNA, 18 bp, Homo sapiens
tgggttagggaaaacatt

SEQ ID NO: 2510187 - DNA, 19 bp, Homo sapiens
tgggttagggaaaacattc

SEQ ID NO: 2510188 - DNA, 16 bp, Homo sapiens
tgggttcactgcaacc

SEQ ID NO: 2510189 - DNA, 13 bp, Homo sapiens
tgggttcattatt

SEQ ID NO: 2510190 - DNA, 17 bp, Homo sapiens
tgggttggaaaacagta

SEQ ID NO: 2510191 - DNA, 19 bp, Homo sapiens
tgggttggtgcacagtgat

SEQ ID NO: 2510192 - DNA, 19 bp, Homo sapiens
tgggtttggaccccagctg

SEQ ID NO: 2510193 - DNA, 19 bp, Homo sapiens
tgggttttgtattctctga

SEQ ID NO: 2510194 - DNA, 21 bp, Homo sapiens
tgggttttgtattctctgagc

SEQ ID NO: 2510195 - DNA, 22 bp, Homo sapiens
tgggtttttgttacctttatgg

SEQ ID NO: 2510196 - DNA, 13 bp, Homo sapiens
tggtaaactattt

SEQ ID NO: 2510197 - DNA, 16 bp, Homo sapiens
tggtaaagactggctt

SEQ ID NO: 2510198 - DNA, 23 bp, Homo sapiens
tggtaaatttccccaacagtgtg

SEQ ID NO: 2510199 - DNA, 18 bp, Homo sapiens
tggtaacagttcatgttt

SEQ ID NO: 2510200 - DNA, 14 bp, Homo sapiens
tggtaagctctggc

SEQ ID NO: 2510201 - DNA, 21 bp, Homo sapiens
tggtaattatcattttagaag

SEQ ID NO: 2510202 - DNA, 18 bp, Homo sapiens
tggtaccagataaaatta

SEQ ID NO: 2510203 - DNA, 15 bp, Homo sapiens
tggtaccctcctggc

SEQ ID NO: 2510204 - DNA, 21 bp, Homo sapiens
tggtaccctcctggctcttga

SEQ ID NO: 2510205 - DNA, 20 bp, Homo sapiens
tggtactactagatgtcttt

SEQ ID NO: 2510206 - DNA, 21 bp, Homo sapiens
tggtacttttatgatgtatat

SEQ ID NO: 2510207 - DNA, 22 bp, Homo sapiens
tggtagagaccgagcctctgtc

SEQ ID NO: 2510208 - DNA, 20 bp, Homo sapiens
tggtaggaactgctgggctt

SEQ ID NO: 2510209 - DNA, 22 bp, Homo sapiens
tggtaggatcagccctcatttt

SEQ ID NO: 2510210 - DNA, 17 bp, Homo sapiens
tggtagttagtagcatg

SEQ ID NO: 2510211 - DNA, 18 bp, Homo sapiens
tggtagttagtagcatgt

SEQ ID NO: 2510212 - DNA, 16 bp, Homo sapiens
tggtatagaaatgctg

SEQ ID NO: 2510213 - DNA, 22 bp, Homo sapiens
tggtatctgttctttaatttat

SEQ ID NO: 2510214 - DNA, 23 bp, Homo sapiens
tggtattggctagaggttcaaag

SEQ ID NO: 2510215 - DNA, 22 bp, Homo sapiens
tggtcaaacaaactctctgaac

SEQ ID NO: 2510216 - DNA, 21 bp, Homo sapiens
tggtcaaaccgcactcaccca

SEQ ID NO: 2510217 - DNA, 14 bp, Homo sapiens
tggtcaacacttaa

SEQ ID NO: 2510218 - DNA, 14 bp, Homo sapiens
tggtcaacctcctg

SEQ ID NO: 2510219 - DNA, 17 bp, Homo sapiens
tggtcacagcctcctct

SEQ ID NO: 2510220 - DNA, 22 bp, Homo sapiens
tggtcacaggaagtagaggagg

SEQ ID NO: 2510221 - DNA, 15 bp, Homo sapiens
tggtcactgctgtca

SEQ ID NO: 2510222 - DNA, 16 bp, Homo sapiens
tggtcagcgttgcatg

SEQ ID NO: 2510223 - DNA, 18 bp, Homo sapiens
tggtcattttatgttaag

SEQ ID NO: 2510224 - DNA, 21 bp, Homo sapiens
tggtccaaaagattgctgaaa

SEQ ID NO: 2510225 - DNA, 12 bp, Homo sapiens
tggtccaggaga

SEQ ID NO: 2510226 - DNA, 21 bp, Homo sapiens
tggtcccaacaggaggacaat

SEQ ID NO: 2510227 - DNA, 17 bp, Homo sapiens
tggtcccatccaggcag

SEQ ID NO: 2510228 - DNA, 14 bp, Homo sapiens
tggtcccccttcca

SEQ ID NO: 2510229 - DNA, 16 bp, Homo sapiens
tggtccggacactcct

SEQ ID NO: 2510230 - DNA, 12 bp, Homo sapiens
tggtcctgactc

SEQ ID NO: 2510231 - DNA, 19 bp, Homo sapiens
tggtcctgactcaacatgt

SEQ ID NO: 2510232 - DNA, 12 bp, Homo sapiens
tggtcctttggg

SEQ ID NO: 2510233 - DNA, 14 bp, Homo sapiens
tggtcgcccaggag

SEQ ID NO: 2510234 - DNA, 17 bp, Homo sapiens
tggtcggaaaacatgct

SEQ ID NO: 2510235 - DNA, 15 bp, Homo sapiens
tggtctattgtctgt

SEQ ID NO: 2510236 - DNA, 23 bp, Homo sapiens
tggtctcaaactcttgacctcag

SEQ ID NO: 2510237 - DNA, 12 bp, Homo sapiens
tggtctcagaaa

SEQ ID NO: 2510238 - DNA, 17 bp, Homo sapiens
tggtctctaggctgggg

SEQ ID NO: 2510239 - DNA, 13 bp, Homo sapiens
tggtctgaatgtt

SEQ ID NO: 2510240 - DNA, 16 bp, Homo sapiens
tggtctgaatgttctg

SEQ ID NO: 2510241 - DNA, 18 bp, Homo sapiens
tggtctgaatgttctgac

SEQ ID NO: 2510242 - DNA, 22 bp, Homo sapiens
tggtctgaatgttctgacatta

SEQ ID NO: 2510243 - DNA, 17 bp, Homo sapiens
tggtctgacccactgct

SEQ ID NO: 2510244 - DNA, 16 bp, Homo sapiens
tggtctgatttcagga

SEQ ID NO: 2510245 - DNA, 16 bp, Homo sapiens
tggtctgggacttcct

SEQ ID NO: 2510246 - DNA, 17 bp, Homo sapiens
tggtctgggacttcctt

SEQ ID NO: 2510247 - DNA, 21 bp, Homo sapiens
tggtctgggacttccttgctc

SEQ ID NO: 2510248 - DNA, 17 bp, Homo sapiens
tggtcttcccaggctgg

SEQ ID NO: 2510249 - DNA, 16 bp, Homo sapiens
tggtcttgtggaattg

SEQ ID NO: 2510250 - DNA, 17 bp, Homo sapiens
tggtctttctggagagg

SEQ ID NO: 2510251 - DNA, 21 bp, Homo sapiens
tggtctttgtaagagtgtaga

SEQ ID NO: 2510252 - DNA, 22 bp, Homo sapiens
tggtctttgtaagagtgtagaa

SEQ ID NO: 2510253 - DNA, 13 bp, Homo sapiens
tggtgaatattgt

SEQ ID NO: 2510254 - DNA, 15 bp, Homo sapiens
tggtgacctctgcct

SEQ ID NO: 2510255 - DNA, 18 bp, Homo sapiens
tggtgactgcgatcttca

SEQ ID NO: 2510256 - DNA, 16 bp, Homo sapiens
tggtgagatgcagctg

SEQ ID NO: 2510257 - DNA, 17 bp, Homo sapiens
tggtgatcaattaaatg

SEQ ID NO: 2510258 - DNA, 18 bp, Homo sapiens
tggtgatcaattaaatgt

SEQ ID NO: 2510259 - DNA, 17 bp, Homo sapiens
tggtgccaatggaacct

SEQ ID NO: 2510260 - DNA, 22 bp, Homo sapiens
tggtgccaatggaacctccttt

SEQ ID NO: 2510261 - DNA, 15 bp, Homo sapiens
tggtgccaatttcaa

SEQ ID NO: 2510262 - DNA, 22 bp, Homo sapiens
tggtgcctaaagtttaaccaaa

SEQ ID NO: 2510263 - DNA, 13 bp, Homo sapiens
tggtgcctggcct

SEQ ID NO: 2510264 - DNA, 24 bp, Homo sapiens
tggtgcctggcctggcacacatca

SEQ ID NO: 2510265 - DNA, 11 bp, Homo sapiens
tggtgctcagt

SEQ ID NO: 2510266 - DNA, 14 bp, Homo sapiens
tggtgctcagttgt

SEQ ID NO: 2510267 - DNA, 22 bp, Homo sapiens
tgtctgttaccatgtcactgtg

SEQ ID NO: 2510268 - DNA, 15 bp, Homo sapiens
tgtctgttctacata

SEQ ID NO: 2510269 - DNA, 16 bp, Homo sapiens
tgtctgtttgttctct

SEQ ID NO: 2510270 - DNA, 14 bp, Homo sapiens
tgtcttaattaaaa

SEQ ID NO: 2510271 - DNA, 17 bp, Homo sapiens
tgtcttcaacagctccc

SEQ ID NO: 2510272 - DNA, 13 bp, Homo sapiens
tgtcttcacctga

SEQ ID NO: 2510273 - DNA, 16 bp, Homo sapiens
tgtcttcatttcattg

SEQ ID NO: 2510274 - DNA, 19 bp, Homo sapiens
tgtcttcatttcattgtat

SEQ ID NO: 2510275 - DNA, 16 bp, Homo sapiens
tgtcttcctcccaagt

SEQ ID NO: 2510276 - DNA, 22 bp, Homo sapiens
tgtcttctcaggctctgccctg

SEQ ID NO: 2510277 - DNA, 12 bp, Homo sapiens
tgtcttctgcct

SEQ ID NO: 2510278 - DNA, 17 bp, Homo sapiens
tgtcttgaatgtctttt

SEQ ID NO: 2510279 - DNA, 20 bp, Homo sapiens
tgtcttgaatgtcttttgaa

SEQ ID NO: 2510280 - DNA, 21 bp, Homo sapiens
tgtcttgcaatggcagccttg

SEQ ID NO: 2510281 - DNA, 23 bp, Homo sapiens
tgtcttgctatggggagaaaaga

SEQ ID NO: 2510282 - DNA, 15 bp, Homo sapiens
tgtcttggacactgt

SEQ ID NO: 2510283 - DNA, 20 bp, Homo sapiens
tgtcttgtacatgtgtagcc

SEQ ID NO: 2510284 - DNA, 15 bp, Homo sapiens
tgtctttaaggaaaa

SEQ ID NO: 2510285 - DNA, 14 bp, Homo sapiens
tgtctttggaccct

SEQ ID NO: 2510286 - DNA, 16 bp, Homo sapiens
tgtctttggaccctga

SEQ ID NO: 2510287 - DNA, 19 bp, Homo sapiens
tgtctttggaccctgaggc

SEQ ID NO: 2510288 - DNA, 17 bp, Homo sapiens
tgtgaaaaaaaaaatgc

SEQ ID NO: 2510289 - DNA, 20 bp, Homo sapiens
tgtgaaaaaaaaaatgctga

SEQ ID NO: 2510290 - DNA, 15 bp, Homo sapiens
tgtgaaaagaaaaat

SEQ ID NO: 2510291 - DNA, 13 bp, Homo sapiens
tgtgaaaatgggt

SEQ ID NO: 2510292 - DNA, 14 bp, Homo sapiens
tgtgaaaatgggtt

SEQ ID NO: 2510293 - DNA, 18 bp, Homo sapiens
tgtgaaaatggtccagga

SEQ ID NO: 2510294 - DNA, 13 bp, Homo sapiens
tgtgaaaggaaag

SEQ ID NO: 2510295 - DNA, 15 bp, Homo sapiens
tgtgaaaggaaagag

SEQ ID NO: 2510296 - DNA, 22 bp, Homo sapiens
tgtgaaagtcagatgcccagag

SEQ ID NO: 2510297 - DNA, 21 bp, Homo sapiens
tgtgaaatagttcaaagccaa

SEQ ID NO: 2510298 - DNA, 14 bp, Homo sapiens
tgtgaaatgctggc

SEQ ID NO: 2510299 - DNA, 15 bp, Homo sapiens
tgtgaaccaccacac

SEQ ID NO: 2510300 - DNA, 20 bp, Homo sapiens
tgtgaaccaccacacccagc

SEQ ID NO: 2510301 - DNA, 22 bp, Homo sapiens
tgtgaaccaccacacccagccc

SEQ ID NO: 2510302 - DNA, 23 bp, Homo sapiens
tgtgaaccaccacacccagccca

SEQ ID NO: 2510303 - DNA, 14 bp, Homo sapiens
tgtgaactaaactt

SEQ ID NO: 2510304 - DNA, 21 bp, Homo sapiens
tgtgaactcagccaagcacag

SEQ ID NO: 2510305 - DNA, 15 bp, Homo sapiens
tgtgaactgacaggc

SEQ ID NO: 2510306 - DNA, 22 bp, Homo sapiens
tgtgaagatgatatactatttt

SEQ ID NO: 2510307 - DNA, 14 bp, Homo sapiens
tgtgaagttagaat

SEQ ID NO: 2510308 - DNA, 21 bp, Homo sapiens
tgtgaatatttccatatggat

SEQ ID NO: 2510309 - DNA, 13 bp, Homo sapiens
tgtgaatggattg

SEQ ID NO: 2510310 - DNA, 15 bp, Homo sapiens
tgtgaatggattgga

SEQ ID NO: 2510311 - DNA, 16 bp, Homo sapiens
tgtgaatggattggat

SEQ ID NO: 2510312 - DNA, 19 bp, Homo sapiens
tgtgaatggattggattat

SEQ ID NO: 2510313 - DNA, 19 bp, Homo sapiens
tgtgacaattttgtacaaa

SEQ ID NO: 2510314 - DNA, 17 bp, Homo sapiens
tgtgacacatatgcacc

SEQ ID NO: 2510315 - DNA, 13 bp, Homo sapiens
tgtgaccaagtta

SEQ ID NO: 2510316 - DNA, 15 bp, Homo sapiens
tgtgaccaatgtctt

SEQ ID NO: 2510317 - DNA, 22 bp, Homo sapiens
tgtgaccactgcagaagacagt

SEQ ID NO: 2510318 - DNA, 17 bp, Homo sapiens
tgtgaccagcactgtct

SEQ ID NO: 2510319 - DNA, 20 bp, Homo sapiens
tgtgacccagcactgcccaa

SEQ ID NO: 2510320 - DNA, 14 bp, Homo sapiens
tgtgaccctctgaa

SEQ ID NO: 2510321 - DNA, 14 bp, Homo sapiens
tgtgacctgaagtt

SEQ ID NO: 2510322 - DNA, 16 bp, Homo sapiens
tgtgaccttagtgttt

SEQ ID NO: 2510323 - DNA, 17 bp, Homo sapiens
tgtgactaattgtataa

SEQ ID NO: 2510324 - DNA, 22 bp, Homo sapiens
tgtgactaattgtataacaggt

SEQ ID NO: 2510325 - DNA, 23 bp, Homo sapiens
tgtgactaattgtataacaggtt

SEQ ID NO: 2510326 - DNA, 23 bp, Homo sapiens
tgtgactctttttagggccaggc

SEQ ID NO: 2510327 - DNA, 15 bp, Homo sapiens
tgtgactgaatttct

SEQ ID NO: 2510328 - DNA, 19 bp, Homo sapiens
tgtgacttcagctctgttt

SEQ ID NO: 2510329 - DNA, 18 bp, Homo sapiens
tgtgagacagtgggaaat

SEQ ID NO: 2510330 - DNA, 14 bp, Homo sapiens
tgtgagacccccac

SEQ ID NO: 2510331 - DNA, 19 bp, Homo sapiens
tgtgagcaagcatttatgt

SEQ ID NO: 2510332 - DNA, 18 bp, Homo sapiens
tgtgagcatcacagtttt

SEQ ID NO: 2510333 - DNA, 20 bp, Homo sapiens
tgtgaggaagccgctggggc

SEQ ID NO: 2510334 - DNA, 18 bp, Homo sapiens
tgtgaggagctgctggct

SEQ ID NO: 2510335 - DNA, 13 bp, Homo sapiens
tgtgaggccaggg

SEQ ID NO: 2510336 - DNA, 15 bp, Homo sapiens
tgtgaggccagggca

SEQ ID NO: 2510337 - DNA, 16 bp, Homo sapiens
tgtgaggccagggcag

SEQ ID NO: 2510338 - DNA, 22 bp, Homo sapiens
tgtgaggccagggcagagtgag

SEQ ID NO: 2510339 - DNA, 14 bp, Homo sapiens
tgtgaggcccctgg

SEQ ID NO: 2510340 - DNA, 14 bp, Homo sapiens
tgtgaggcctggcc

SEQ ID NO: 2510341 - DNA, 21 bp, Homo sapiens
tgtgaggtgcagagtgcccag

SEQ ID NO: 2510342 - DNA, 21 bp, Homo sapiens
tgtgagtcaccaagcccagtt

SEQ ID NO: 2510343 - DNA, 20 bp, Homo sapiens
tgtgagtgtaagtgtgagta

SEQ ID NO: 2510344 - DNA, 18 bp, Homo sapiens
tgtgataaggatcagaac

SEQ ID NO: 2510345 - DNA, 21 bp, Homo sapiens
tgtgatacaatgctgtgccct

SEQ ID NO: 2510346 - DNA, 22 bp, Homo sapiens
tgtgatacccatagcttccatg

SEQ ID NO: 2510347 - DNA, 14 bp, Homo sapiens
tgtgatattaacag

SEQ ID NO: 2510348 - DNA, 15 bp, Homo sapiens
tgtgatcagaccata

SEQ ID NO: 2510349 - DNA, 20 bp, Homo sapiens
tgtgatctatcaatagtcaa

SEQ ID NO: 2510350 - DNA, 18 bp, Homo sapiens
tgtgatgaatactgtatt

SEQ ID NO: 2510351 - DNA, 22 bp, Homo sapiens
tgtgatgatgaaatgaggtcag

SEQ ID NO: 2510352 - DNA, 15 bp, Homo sapiens
tgtgattatttcact

SEQ ID NO: 2510353 - DNA, 22 bp, Homo sapiens
tgtgattcaatctgtaaactgt

SEQ ID NO: 2510354 - DNA, 14 bp, Homo sapiens
tgtgattctaatgt

SEQ ID NO: 2510355 - DNA, 17 bp, Homo sapiens
tgtgatttaatagtgtt

SEQ ID NO: 2510356 - DNA, 12 bp, Homo sapiens
tgtgatttgact

SEQ ID NO: 2510357 - DNA, 15 bp, Homo sapiens
tgtgatttgactgtt

SEQ ID NO: 2510358 - DNA, 17 bp, Homo sapiens
tgtgatttgactgtttt

SEQ ID NO: 2510359 - DNA, 22 bp, Homo sapiens
tgtgatttgactgtttttaccc

SEQ ID NO: 2510360 - DNA, 16 bp, Homo sapiens
tgtgattttaactctg

SEQ ID NO: 2510361 - DNA, 17 bp, Homo sapiens
tgtgattttaactctgt

SEQ ID NO: 2510362 - DNA, 19 bp, Homo sapiens
tgtgattttaactctgtct

SEQ ID NO: 2510363 - DNA, 12 bp, Homo sapiens
tgtgcaaatcct

SEQ ID NO: 2510364 - DNA, 18 bp, Homo sapiens
tgtgcaagtatgtgagtg

SEQ ID NO: 2510365 - DNA, 19 bp, Homo sapiens
tgtgcacacacaccacaca

SEQ ID NO: 2510366 - DNA, 21 bp, Homo sapiens
tgtgcacatctgtgtcttgtt

SEQ ID NO: 2510367 - DNA, 22 bp, Homo sapiens
tgtgcacatgcacgtgtgtgca

SEQ ID NO: 2510368 - DNA, 22 bp, Homo sapiens
tgtgcaccttaccaactttctg

SEQ ID NO: 2510369 - DNA, 23 bp, Homo sapiens
tgtgcagactcaataaaatcatg

SEQ ID NO: 2510370 - DNA, 23 bp, Homo sapiens
tgtgcagccccgcctccaggcca

SEQ ID NO: 2510371 - DNA, 22 bp, Homo sapiens
tgtgcagcctgtcctgggctgg

SEQ ID NO: 2510372 - DNA, 17 bp, Homo sapiens
tgtgcaggtttgttaca

SEQ ID NO: 2510373 - DNA, 13 bp, Homo sapiens
tgtgcagttctag

SEQ ID NO: 2510374 - DNA, 13 bp, Homo sapiens
tgtgcatgggtga

SEQ ID NO: 2510375 - DNA, 15 bp, Homo sapiens
tgtgcatggtggcac

SEQ ID NO: 2510376 - DNA, 22 bp, Homo sapiens
tgtgcatgtgtgcgagtgtgtg

SEQ ID NO: 2510377 - DNA, 22 bp, Homo sapiens
tgtgcatgtgtgtaagtgtgtg

SEQ ID NO: 2510378 - DNA, 14 bp, Homo sapiens
tgtgcatgtgtgtg

SEQ ID NO: 2510379 - DNA, 16 bp, Homo sapiens
tgtgcattatctagat

SEQ ID NO: 2510380 - DNA, 14 bp, Homo sapiens
tgtgcattgctgtg

SEQ ID NO: 2510381 - DNA, 23 bp, Homo sapiens
tgtgcatttggtggtttcagaaa

SEQ ID NO: 2510382 - DNA, 16 bp, Homo sapiens
tgtgccacccaccagg

SEQ ID NO: 2510383 - DNA, 20 bp, Homo sapiens
tgtgccaggtttttggtctg

SEQ ID NO: 2510384 - DNA, 16 bp, Homo sapiens
tgtgccatagtcacat

SEQ ID NO: 2510385 - DNA, 12 bp, Homo sapiens
tgtgccatgtgc

SEQ ID NO: 2510386 - DNA, 21 bp, Homo sapiens
tgtgccctaaagtgtattttt

SEQ ID NO: 2510387 - DNA, 16 bp, Homo sapiens
tgtgccgaatgtgcag

SEQ ID NO: 2510388 - DNA, 15 bp, Homo sapiens
tgtgcctcctcaccc

SEQ ID NO: 2510389 - DNA, 14 bp, Homo sapiens
tgtgcctctgcctg

SEQ ID NO: 2510390 - DNA, 13 bp, Homo sapiens
tgtgcctctggga

SEQ ID NO: 2510391 - DNA, 15 bp, Homo sapiens
tgtgcctctgggact

SEQ ID NO: 2510392 - DNA, 12 bp, Homo sapiens
tgtgcctgcagc

SEQ ID NO: 2510393 - DNA, 20 bp, Homo sapiens
tgtgcctgggtggacatggc

SEQ ID NO: 2510394 - DNA, 17 bp, Homo sapiens
tgtgctactgattgttt

SEQ ID NO: 2510395 - DNA, 15 bp, Homo sapiens
tgtgctactttgcct

SEQ ID NO: 2510396 - DNA, 16 bp, Homo sapiens
tgtgctcaaaatttga

SEQ ID NO: 2510397 - DNA, 14 bp, Homo sapiens
tgtgctccgtgcct

SEQ ID NO: 2510398 - DNA, 16 bp, Homo sapiens
tgtgctccgtgcctcc

SEQ ID NO: 2510399 - DNA, 12 bp, Homo sapiens
tgtgctctgatc

SEQ ID NO: 2510400 - DNA, 15 bp, Homo sapiens
tgtgctctggacagg

SEQ ID NO: 2510401 - DNA, 18 bp, Homo sapiens
tgtgctctggacaggcat

SEQ ID NO: 2510402 - DNA, 19 bp, Homo sapiens
tgtgctctggacaggcatg

SEQ ID NO: 2510403 - DNA, 20 bp, Homo sapiens
tgtgctgccctgcccacctg

SEQ ID NO: 2510404 - DNA, 18 bp, Homo sapiens
tgtgctggagatgtttta

SEQ ID NO: 2510405 - DNA, 13 bp, Homo sapiens
tgtgctggagcca

SEQ ID NO: 2510406 - DNA, 15 bp, Homo sapiens
tgtgctggagccact

SEQ ID NO: 2510407 - DNA, 23 bp, Homo sapiens
tgtgctggtgtcctgaccaccct

SEQ ID NO: 2510408 - DNA, 14 bp, Homo sapiens
tgtgctgtggaagc

SEQ ID NO: 2510409 - DNA, 17 bp, Homo sapiens
tgtgctgtggaagcaac

SEQ ID NO: 2510410 - DNA, 17 bp, Homo sapiens
tgtgctgtggggctggt

SEQ ID NO: 2510411 - DNA, 12 bp, Homo sapiens
tgtgctgtgtaa

SEQ ID NO: 2510412 - DNA, 14 bp, Homo sapiens
tgtgctgtgtaaag

SEQ ID NO: 2510413 - DNA, 15 bp, Homo sapiens
tgtgctttccagctc

SEQ ID NO: 2510414 - DNA, 18 bp, Homo sapiens
tgtgctttccagctcacc

SEQ ID NO: 2510415 - DNA, 16 bp, Homo sapiens
tgtgctttccctgaac

SEQ ID NO: 2510416 - DNA, 13 bp, Homo sapiens
tgtggaaaacaga

SEQ ID NO: 2510417 - DNA, 17 bp, Homo sapiens
tgtggaaaatgaaaatt

SEQ ID NO: 2510418 - DNA, 18 bp, Homo sapiens
tgtattttccaagtgtgc

SEQ ID NO: 2510419 - DNA, 21 bp, Homo sapiens
tgtattttccaagtgtgcata

SEQ ID NO: 2510420 - DNA, 16 bp, Homo sapiens
tgtattttctttctct

SEQ ID NO: 2510421 - DNA, 14 bp, Homo sapiens
tgtatttttaatgg

SEQ ID NO: 2510422 - DNA, 14 bp, Homo sapiens
tgtatttttttact

SEQ ID NO: 2510423 - DNA, 16 bp, Homo sapiens
tgtatttttttactaa

SEQ ID NO: 2510424 - DNA, 14 bp, Homo sapiens
tgtcaaaaaaaaaa

SEQ ID NO: 2510425 - DNA, 17 bp, Homo sapiens
tgtcaaacaaagccaga

SEQ ID NO: 2510426 - DNA, 21 bp, Homo sapiens
tgtcaaacaaagccagaagct

SEQ ID NO: 2510427 - DNA, 19 bp, Homo sapiens
tgtcaagagggtctgagga

SEQ ID NO: 2510428 - DNA, 19 bp, Homo sapiens
tgtcaagtctctgctggcc

SEQ ID NO: 2510429 - DNA, 19 bp, Homo sapiens
tgtcaagtgggatctgtca

SEQ ID NO: 2510430 - DNA, 17 bp, Homo sapiens
tgtcaagttgtgcttgt

SEQ ID NO: 2510431 - DNA, 17 bp, Homo sapiens
tgtcaatattaaataca

SEQ ID NO: 2510432 - DNA, 17 bp, Homo sapiens
tgtcacacactttggct

SEQ ID NO: 2510433 - DNA, 16 bp, Homo sapiens
tgtcacaggcaggtcc

SEQ ID NO: 2510434 - DNA, 14 bp, Homo sapiens
tgtcacagggccaa

SEQ ID NO: 2510435 - DNA, 22 bp, Homo sapiens
tgtcacccttaggccagcacca

SEQ ID NO: 2510436 - DNA, 18 bp, Homo sapiens
tgtcaccggatcctgggt

SEQ ID NO: 2510437 - DNA, 16 bp, Homo sapiens
tgtcaccgtgagcagc

SEQ ID NO: 2510438 - DNA, 14 bp, Homo sapiens
tgtcacctgtgctt

SEQ ID NO: 2510439 - DNA, 22 bp, Homo sapiens
tgtcactactcacagtctcttt

SEQ ID NO: 2510440 - DNA, 12 bp, Homo sapiens
tgtcactgtggt

SEQ ID NO: 2510441 - DNA, 14 bp, Homo sapiens
tgtcacttactgtt

SEQ ID NO: 2510442 - DNA, 22 bp, Homo sapiens
tgtcacttcgcgtgccctcgct

SEQ ID NO: 2510443 - DNA, 16 bp, Homo sapiens
tgtcactttgctctgg

SEQ ID NO: 2510444 - DNA, 21 bp, Homo sapiens
tgtcagaaaccagttatgtga

SEQ ID NO: 2510445 - DNA, 14 bp, Homo sapiens
tgtcagactttaaa

SEQ ID NO: 2510446 - DNA, 14 bp, Homo sapiens
tgtcagagctggga

SEQ ID NO: 2510447 - DNA, 15 bp, Homo sapiens
tgtcagagctgggag

SEQ ID NO: 2510448 - DNA, 20 bp, Homo sapiens
tgtcagaggcacaaaagggt

SEQ ID NO: 2510449 - DNA, 20 bp, Homo sapiens
tgtcagatattttttcagaa

SEQ ID NO: 2510450 - DNA, 21 bp, Homo sapiens
tgtcagccgagccgggcctgg

SEQ ID NO: 2510451 - DNA, 23 bp, Homo sapiens
tgtcagccgagccgggcctgggg

SEQ ID NO: 2510452 - DNA, 15 bp, Homo sapiens
tgtcagccgggccct

SEQ ID NO: 2510453 - DNA, 16 bp, Homo sapiens
tgtcagccgggccctg

SEQ ID NO: 2510454 - DNA, 21 bp, Homo sapiens
tgtcagccgggccctgagtaa

SEQ ID NO: 2510455 - DNA, 18 bp, Homo sapiens
tgtcagctactaatgatg

SEQ ID NO: 2510456 - DNA, 22 bp, Homo sapiens
tgtcaggctgctggcgcctctg

SEQ ID NO: 2510457 - DNA, 20 bp, Homo sapiens
tgtcagtaccttcaaactag

SEQ ID NO: 2510458 - DNA, 18 bp, Homo sapiens
tgtcagtatgtggaagtg

SEQ ID NO: 2510459 - DNA, 19 bp, Homo sapiens
tgtcagtatgtggaagtgt

SEQ ID NO: 2510460 - DNA, 20 bp, Homo sapiens
tgtcagtatgtggaagtgtg

SEQ ID NO: 2510461 - DNA, 14 bp, Homo sapiens
tgtcagtgcagccc

SEQ ID NO: 2510462 - DNA, 16 bp, Homo sapiens
tgtcagtgcagcccgt

SEQ ID NO: 2510463 - DNA, 15 bp, Homo sapiens
tgtcataagaatgaa

SEQ ID NO: 2510464 - DNA, 16 bp, Homo sapiens
tgtcatagaaattaca

SEQ ID NO: 2510465 - DNA, 22 bp, Homo sapiens
tgtcatatatggggggccaaca

SEQ ID NO: 2510466 - DNA, 18 bp, Homo sapiens
tgtcatatattactagca

SEQ ID NO: 2510467 - DNA, 13 bp, Homo sapiens
tgtcatcagaact

SEQ ID NO: 2510468 - DNA, 17 bp, Homo sapiens
tgtcatcagaagataac

SEQ ID NO: 2510469 - DNA, 18 bp, Homo sapiens
tgtcatcagccaccatcc

SEQ ID NO: 2510470 - DNA, 22 bp, Homo sapiens
tgtcatcattgtatatatgtgt

SEQ ID NO: 2510471 - DNA, 23 bp, Homo sapiens
tgtcattaaatggggctcacaaa

SEQ ID NO: 2510472 - DNA, 21 bp, Homo sapiens
tgtcatttgagcagggctcag

SEQ ID NO: 2510473 - DNA, 14 bp, Homo sapiens
tgtcattttctcca

SEQ ID NO: 2510474 - DNA, 23 bp, Homo sapiens
tgtccaaaccaaccgcacatgca

SEQ ID NO: 2510475 - DNA, 12 bp, Homo sapiens
tgtccaaagcag

SEQ ID NO: 2510476 - DNA, 19 bp, Homo sapiens
tgtccaaagcagggtctgg

SEQ ID NO: 2510477 - DNA, 23 bp, Homo sapiens
tgtccaattgttgacagttctga

SEQ ID NO: 2510478 - DNA, 18 bp, Homo sapiens
tgtccacgactgtctcca

SEQ ID NO: 2510479 - DNA, 12 bp, Homo sapiens
tgtccagacagc

SEQ ID NO: 2510480 - DNA, 17 bp, Homo sapiens
tgtccagacagcctgta

SEQ ID NO: 2510481 - DNA, 11 bp, Homo sapiens
tgtccagagag

SEQ ID NO: 2510482 - DNA, 19 bp, Homo sapiens
tgtccagcctgggcagcca

SEQ ID NO: 2510483 - DNA, 23 bp, Homo sapiens
tgtccagtgggtaggttggactg

SEQ ID NO: 2510484 - DNA, 13 bp, Homo sapiens
tgtccatgtgtgt

SEQ ID NO: 2510485 - DNA, 14 bp, Homo sapiens
tgtccattgtccaa

SEQ ID NO: 2510486 - DNA, 23 bp, Homo sapiens
tgtcccaaaaagaaaggagggga

SEQ ID NO: 2510487 - DNA, 13 bp, Homo sapiens
tgtcccaccagct

SEQ ID NO: 2510488 - DNA, 12 bp, Homo sapiens
tgtcccacctct

SEQ ID NO: 2510489 - DNA, 22 bp, Homo sapiens
tgtcccacctcttctcttcctg

SEQ ID NO: 2510490 - DNA, 20 bp, Homo sapiens
tgtcccagaggctgccccac

SEQ ID NO: 2510491 - DNA, 17 bp, Homo sapiens
tgtcccatgacccaccc

SEQ ID NO: 2510492 - DNA, 18 bp, Homo sapiens
tgtcccatgacccacccc

SEQ ID NO: 2510493 - DNA, 21 bp, Homo sapiens
tgtcccatgacccacccctgt

SEQ ID NO: 2510494 - DNA, 11 bp, Homo sapiens
tgtccccacac

SEQ ID NO: 2510495 - DNA, 14 bp, Homo sapiens
tgtccccacactcc

SEQ ID NO: 2510496 - DNA, 15 bp, Homo sapiens
tgtccccacactcct

SEQ ID NO: 2510497 - DNA, 16 bp, Homo sapiens
tgtccccggcctcagc

SEQ ID NO: 2510498 - DNA, 14 bp, Homo sapiens
tgtcccctcttgac

SEQ ID NO: 2510499 - DNA, 20 bp, Homo sapiens
tgtcccggggtcctgtggca

SEQ ID NO: 2510500 - DNA, 12 bp, Homo sapiens
tgtccctacacc

SEQ ID NO: 2510501 - DNA, 19 bp, Homo sapiens
tgtccctcaaatgacccaa

SEQ ID NO: 2510502 - DNA, 11 bp, Homo sapiens
tgtccctctca

SEQ ID NO: 2510503 - DNA, 14 bp, Homo sapiens
tgtccctctcaggc

SEQ ID NO: 2510504 - DNA, 15 bp, Homo sapiens
tgtccctctcaggca

SEQ ID NO: 2510505 - DNA, 21 bp, Homo sapiens
tgtccctctcggaaggctggc

SEQ ID NO: 2510506 - DNA, 20 bp, Homo sapiens
tgtccctgcacttgcagact

SEQ ID NO: 2510507 - DNA, 23 bp, Homo sapiens
tgtccctgcacttgcagactcta

SEQ ID NO: 2510508 - DNA, 14 bp, Homo sapiens
tgtcccttggagct

SEQ ID NO: 2510509 - DNA, 17 bp, Homo sapiens
tgtccctttcttggcca

SEQ ID NO: 2510510 - DNA, 15 bp, Homo sapiens
tgtccgctgggtggt

SEQ ID NO: 2510511 - DNA, 20 bp, Homo sapiens
tgtccgctgggtggtaccct

SEQ ID NO: 2510512 - DNA, 16 bp, Homo sapiens
tgtcctaaggacacac

SEQ ID NO: 2510513 - DNA, 14 bp, Homo sapiens
tgtcctcaccacat

SEQ ID NO: 2510514 - DNA, 19 bp, Homo sapiens
tgtcctccagaagcctctg

SEQ ID NO: 2510515 - DNA, 20 bp, Homo sapiens
tgtcctccagaagcctctgg

SEQ ID NO: 2510516 - DNA, 23 bp, Homo sapiens
tgtcctccagaagcctctggcta

SEQ ID NO: 2510517 - DNA, 23 bp, Homo sapiens
tgtcctcccatcccctggactgg

SEQ ID NO: 2510518 - DNA, 21 bp, Homo sapiens
tgtcctcctggtgggtccagg

SEQ ID NO: 2510519 - DNA, 20 bp, Homo sapiens
tgtcctgaccaccctcccct

SEQ ID NO: 2510520 - DNA, 17 bp, Homo sapiens
tgtcctgacctgtctca

SEQ ID NO: 2510521 - DNA, 20 bp, Homo sapiens
tgtcctgatggtcagctccc

SEQ ID NO: 2510522 - DNA, 21 bp, Homo sapiens
tgtcctgatggtcagctccct

SEQ ID NO: 2510523 - DNA, 12 bp, Homo sapiens
tgtcctgggagt

SEQ ID NO: 2510524 - DNA, 19 bp, Homo sapiens
tgtcctgggagtgagctgg

SEQ ID NO: 2510525 - DNA, 10 bp, Homo sapiens
tgtcctgggc

SEQ ID NO: 2510526 - DNA, 11 bp, Homo sapiens
tgtcctgggcg

SEQ ID NO: 2510527 - DNA, 17 bp, Homo sapiens
tgtcctgggcgccctgg

SEQ ID NO: 2510528 - DNA, 17 bp, Homo sapiens
tgtcctgggctggtggc

SEQ ID NO: 2510529 - DNA, 16 bp, Homo sapiens
tgtccttccctgcatt

SEQ ID NO: 2510530 - DNA, 22 bp, Homo sapiens
tgtccttccctgcatttctgag

SEQ ID NO: 2510531 - DNA, 14 bp, Homo sapiens
tgtccttgtgcatg

SEQ ID NO: 2510532 - DNA, 14 bp, Homo sapiens
tgtcgcccagtctg

SEQ ID NO: 2510533 - DNA, 13 bp, Homo sapiens
tgtcgcctctgca

SEQ ID NO: 2510534 - DNA, 14 bp, Homo sapiens
tgtcgcctctgcat

SEQ ID NO: 2510535 - DNA, 19 bp, Homo sapiens
tgtcgctctgctggcctgg

SEQ ID NO: 2510536 - DNA, 14 bp, Homo sapiens
tgtcggcctctaac

SEQ ID NO: 2510537 - DNA, 23 bp, Homo sapiens
tgtcgtagccaaggtgggctgag

SEQ ID NO: 2510538 - DNA, 15 bp, Homo sapiens
tgtctaaaacaataa

SEQ ID NO: 2510539 - DNA, 16 bp, Homo sapiens
tgtctatgggactcaa

SEQ ID NO: 2510540 - DNA, 13 bp, Homo sapiens
tgtctattcagct

SEQ ID NO: 2510541 - DNA, 13 bp, Homo sapiens
tgtctcagcctcc

SEQ ID NO: 2510542 - DNA, 22 bp, Homo sapiens
tgtctcagtccatgaagatgta

SEQ ID NO: 2510543 - DNA, 16 bp, Homo sapiens
tgtctcatccatcatc

SEQ ID NO: 2510544 - DNA, 13 bp, Homo sapiens
tgtctcatgtgtg

SEQ ID NO: 2510545 - DNA, 12 bp, Homo sapiens
tgtctccagacc

SEQ ID NO: 2510546 - DNA, 14 bp, Homo sapiens
tgtctccagacccc

SEQ ID NO: 2510547 - DNA, 19 bp, Homo sapiens
tgtctccagacccccaccc

SEQ ID NO: 2510548 - DNA, 23 bp, Homo sapiens
tgtctccagacccccaccccttc

SEQ ID NO: 2510549 - DNA, 17 bp, Homo sapiens
tgtctccttaacactga

SEQ ID NO: 2510550 - DNA, 18 bp, Homo sapiens
tgtctcgtggtaggactg

SEQ ID NO: 2510551 - DNA, 15 bp, Homo sapiens
tgtctctagccactt

SEQ ID NO: 2510552 - DNA, 18 bp, Homo sapiens
tgtctctggcgtgtgggt

SEQ ID NO: 2510553 - DNA, 16 bp, Homo sapiens
tgtctctgtcatggta

SEQ ID NO: 2510554 - DNA, 13 bp, Homo sapiens
tgtctcttccata

SEQ ID NO: 2510555 - DNA, 18 bp, Homo sapiens
tgtctcttggtcctgctg

SEQ ID NO: 2510556 - DNA, 12 bp, Homo sapiens
tgtctgaaaaat

SEQ ID NO: 2510557 - DNA, 23 bp, Homo sapiens
tgtctgatctgtgctttccagct

SEQ ID NO: 2510558 - DNA, 16 bp, Homo sapiens
tgtctgcacccagggg

SEQ ID NO: 2510559 - DNA, 16 bp, Homo sapiens
tgtctgccaatttttg

SEQ ID NO: 2510560 - DNA, 15 bp, Homo sapiens
tgtctgccagccagc

SEQ ID NO: 2510561 - DNA, 19 bp, Homo sapiens
tgtctgccagccagcagcc

SEQ ID NO: 2510562 - DNA, 14 bp, Homo sapiens
tgtctgcctcttag

SEQ ID NO: 2510563 - DNA, 19 bp, Homo sapiens
tgtctggattcccaggatg

SEQ ID NO: 2510564 - DNA, 15 bp, Homo sapiens
tgtctggttttaaca

SEQ ID NO: 2510565 - DNA, 23 bp, Homo sapiens
tgtctgtagagggccctggtgtt

SEQ ID NO: 2510566 - DNA, 17 bp, Homo sapiens
tgtctgtagctcctcaa

SEQ ID NO: 2510567 - DNA, 17 bp, Homo sapiens
tgtctgttacactggag

SEQ ID NO: 2510568 - DNA, 19 bp, Homo sapiens
tgtctgttaccatgtcact

SEQ ID NO: 2510569 - DNA, 23 bp, Homo sapiens
tggcccagccggcctctctggcc

SEQ ID NO: 2510570 - DNA, 16 bp, Homo sapiens
tggcccagcggcccct

SEQ ID NO: 2510571 - DNA, 19 bp, Homo sapiens
tggcccagcggcccctccc

SEQ ID NO: 2510572 - DNA, 21 bp, Homo sapiens
tggcccagcggcccctcccac

SEQ ID NO: 2510573 - DNA, 12 bp, Homo sapiens
tggcccagtgtc

SEQ ID NO: 2510574 - DNA, 20 bp, Homo sapiens
tggccccaagggcaaaattc

SEQ ID NO: 2510575 - DNA, 21 bp, Homo sapiens
tggccccgccgcctggtactc

SEQ ID NO: 2510576 - DNA, 19 bp, Homo sapiens
tggcccctagaatcagcct

SEQ ID NO: 2510577 - DNA, 16 bp, Homo sapiens
tggcccctcacctggg

SEQ ID NO: 2510578 - DNA, 10 bp, Homo sapiens
tggcccctct

SEQ ID NO: 2510579 - DNA, 16 bp, Homo sapiens
tggcccctctgacctg

SEQ ID NO: 2510580 - DNA, 14 bp, Homo sapiens
tggcccctgaacaa

SEQ ID NO: 2510581 - DNA, 20 bp, Homo sapiens
tggcccctgaacaagaattg

SEQ ID NO: 2510582 - DNA, 16 bp, Homo sapiens
tggcccctgcccggct

SEQ ID NO: 2510583 - DNA, 20 bp, Homo sapiens
tggcccctgcccggctgcgg

SEQ ID NO: 2510584 - DNA, 12 bp, Homo sapiens
tggcccctgggt

SEQ ID NO: 2510585 - DNA, 16 bp, Homo sapiens
tggccccttcacttct

SEQ ID NO: 2510586 - DNA, 18 bp, Homo sapiens
tggcccgtgacagactcc

SEQ ID NO: 2510587 - DNA, 23 bp, Homo sapiens
tggcccgtgacagactcctgagg

SEQ ID NO: 2510588 - DNA, 21 bp, Homo sapiens
tggccctcccagtacctcctg

SEQ ID NO: 2510589 - DNA, 23 bp, Homo sapiens
tggccctgaggtgtgggggctgc

SEQ ID NO: 2510590 - DNA, 15 bp, Homo sapiens
tggccctgcaaaagg

SEQ ID NO: 2510591 - DNA, 12 bp, Homo sapiens
tggccctggggt

SEQ ID NO: 2510592 - DNA, 13 bp, Homo sapiens
tggccctggggtc

SEQ ID NO: 2510593 - DNA, 19 bp, Homo sapiens
tggccctggggtcccacga

SEQ ID NO: 2510594 - DNA, 20 bp, Homo sapiens
tggccgagggtcctggctcc

SEQ ID NO: 2510595 - DNA, 13 bp, Homo sapiens
tggccgccccctg

SEQ ID NO: 2510596 - DNA, 17 bp, Homo sapiens
tggccgccccctgcccc

SEQ ID NO: 2510597 - DNA, 16 bp, Homo sapiens
tggccgcctcaccccc

SEQ ID NO: 2510598 - DNA, 22 bp, Homo sapiens
tggaggtgtcaggctgctggcg

SEQ ID NO: 2510599 - DNA, 19 bp, Homo sapiens
tggaggttaaggctgagga

SEQ ID NO: 2510600 - DNA, 20 bp, Homo sapiens
tggaggttaaggctgaggaa

SEQ ID NO: 2510601 - DNA, 21 bp, Homo sapiens
tggaggttaaggctgaggaaa

SEQ ID NO: 2510602 - DNA, 24 bp, Homo sapiens
tggaggttaaggctgaggaaaggc

SEQ ID NO: 2510603 - DNA, 14 bp, Homo sapiens
tggaggttgcagtg

SEQ ID NO: 2510604 - DNA, 14 bp, Homo sapiens
tggagtccagtctc

SEQ ID NO: 2510605 - DNA, 21 bp, Homo sapiens
tggagtcccctcacctcctct

SEQ ID NO: 2510606 - DNA, 13 bp, Homo sapiens
tggagtctccagt

SEQ ID NO: 2510607 - DNA, 17 bp, Homo sapiens
tggagtggggcagtaga

SEQ ID NO: 2510608 - DNA, 15 bp, Homo sapiens
tggagtgtgtattgt

SEQ ID NO: 2510609 - DNA, 19 bp, Homo sapiens
tggagtgtgtattgttccc

SEQ ID NO: 2510610 - DNA, 22 bp, Homo sapiens
tggagtgttccccttccactga

SEQ ID NO: 2510611 - DNA, 20 bp, Homo sapiens
tggagttaacgggtgaataa

SEQ ID NO: 2510612 - DNA, 20 bp, Homo sapiens
tggagttacattaatgttaa

SEQ ID NO: 2510613 - DNA, 17 bp, Homo sapiens
tggagttttaactgtaa

SEQ ID NO: 2510614 - DNA, 14 bp, Homo sapiens
tggatcacagctgc

SEQ ID NO: 2510615 - DNA, 16 bp, Homo sapiens
tggatcacagctgctt

SEQ ID NO: 2510616 - DNA, 16 bp, Homo sapiens
tggatcagatgaactc

SEQ ID NO: 2510617 - DNA, 19 bp, Homo sapiens
tggatcagtcctttgatca

SEQ ID NO: 2510618 - DNA, 21 bp, Homo sapiens
tggatctccaaggaccaggtt

SEQ ID NO: 2510619 - DNA, 16 bp, Homo sapiens
tggatctgtccaagga

SEQ ID NO: 2510620 - DNA, 15 bp, Homo sapiens
tggatctgtgagggg

SEQ ID NO: 2510621 - DNA, 18 bp, Homo sapiens
tggatcttcaatggcttt

SEQ ID NO: 2510622 - DNA, 14 bp, Homo sapiens
tggatgaaattttc

SEQ ID NO: 2510623 - DNA, 15 bp, Homo sapiens
tggatgaaattttct

SEQ ID NO: 2510624 - DNA, 23 bp, Homo sapiens
tggatgaagattctcctgtgcta

SEQ ID NO: 2510625 - DNA, 13 bp, Homo sapiens
tggatgaccagaa

SEQ ID NO: 2510626 - DNA, 20 bp, Homo sapiens
tggatgcatgttttccagct

SEQ ID NO: 2510627 - DNA, 22 bp, Homo sapiens
tggatgcatgttttccagctcc

SEQ ID NO: 2510628 - DNA, 23 bp, Homo sapiens
tggatgcctggtggcagctgcgg

SEQ ID NO: 2510629 - DNA, 13 bp, Homo sapiens
tggatggcttcta

SEQ ID NO: 2510630 - DNA, 20 bp, Homo sapiens
tggatgtctgccaatttttg

SEQ ID NO: 2510631 - DNA, 23 bp, Homo sapiens
tggatgtggggtccccatcatcc

SEQ ID NO: 2510632 - DNA, 12 bp, Homo sapiens
tggatgttctga

SEQ ID NO: 2510633 - DNA, 13 bp, Homo sapiens
tggatgttttaat

SEQ ID NO: 2510634 - DNA, 23 bp, Homo sapiens
tgcggcaggttcacaggcgaggc

SEQ ID NO: 2510635 - DNA, 16 bp, Homo sapiens
tgcggcccagcccggc

SEQ ID NO: 2510636 - DNA, 17 bp, Homo sapiens
tgcggcctttggcttca

SEQ ID NO: 2510637 - DNA, 19 bp, Homo sapiens
tgcggcctttggcttcacg

SEQ ID NO: 2510638 - DNA, 14 bp, Homo sapiens
tgcggtccacccag

SEQ ID NO: 2510639 - DNA, 17 bp, Homo sapiens
tgcggtgctatctcccc

SEQ ID NO: 2510640 - DNA, 21 bp, Homo sapiens
tgcggtggctcacgcctgtaa

SEQ ID NO: 2510641 - DNA, 18 bp, Homo sapiens
tgcgtggactctgcacat

SEQ ID NO: 2510642 - DNA, 18 bp, Homo sapiens
tgcgtgtgcgtgcatgtg

SEQ ID NO: 2510643 - DNA, 21 bp, Homo sapiens
tgcgtgtgtagagttaagaag

SEQ ID NO: 2510644 - DNA, 16 bp, Homo sapiens
tgcgtgtttgcacgtt

SEQ ID NO: 2510645 - DNA, 21 bp, Homo sapiens
tgctaaaccttagtactgagt

SEQ ID NO: 2510646 - DNA, 22 bp, Homo sapiens
tgctaaatggtcgcccaggaga

SEQ ID NO: 2510647 - DNA, 14 bp, Homo sapiens
tgctaaatgtaaca

SEQ ID NO: 2510648 - DNA, 17 bp, Homo sapiens
tgctaaatgtaacagtc

SEQ ID NO: 2510649 - DNA, 20 bp, Homo sapiens
tgctaaatgtaacagtctga

SEQ ID NO: 2510650 - DNA, 16 bp, Homo sapiens
tgctaagatgctctat

SEQ ID NO: 2510651 - DNA, 22 bp, Homo sapiens
tgctaatcagggaggtcatttt

SEQ ID NO: 2510652 - DNA, 19 bp, Homo sapiens
tgctaatcagtgtctcaca

SEQ ID NO: 2510653 - DNA, 15 bp, Homo sapiens
tgctacaaaaacaca

SEQ ID NO: 2510654 - DNA, 17 bp, Homo sapiens
tgctacaaaaacacagc

SEQ ID NO: 2510655 - DNA, 18 bp, Homo sapiens
tgctacaaagaagacatg

SEQ ID NO: 2510656 - DNA, 20 bp, Homo sapiens
tgctacaaagaagacatgtt

SEQ ID NO: 2510657 - DNA, 23 bp, Homo sapiens
tgctacaaagaagacatgtttta

SEQ ID NO: 2510658 - DNA, 19 bp, Homo sapiens
tgctacaacttcagcagta

SEQ ID NO: 2510659 - DNA, 14 bp, Homo sapiens
tgctacacagtata

SEQ ID NO: 2510660 - DNA, 14 bp, Homo sapiens
tgctacctcactgg

SEQ ID NO: 2510661 - DNA, 14 bp, Homo sapiens
tgctacgtgtgatt

SEQ ID NO: 2510662 - DNA, 15 bp, Homo sapiens
tgctacgtgtgattt

SEQ ID NO: 2510663 - DNA, 19 bp, Homo sapiens
tgctacgtgtgatttttct

SEQ ID NO: 2510664 - DNA, 21 bp, Homo sapiens
tgctactgtcctacccaccct

SEQ ID NO: 2510665 - DNA, 19 bp, Homo sapiens
tgctacttaattcctttct

SEQ ID NO: 2510666 - DNA, 22 bp, Homo sapiens
tgctacttaattcctttctcat

SEQ ID NO: 2510667 - DNA, 18 bp, Homo sapiens
tgctactttgccttttgc

SEQ ID NO: 2510668 - DNA, 20 bp, Homo sapiens
tgctagcacttggagccaag

SEQ ID NO: 2510669 - DNA, 16 bp, Homo sapiens
tgctaggaacactcct

SEQ ID NO: 2510670 - DNA, 20 bp, Homo sapiens
tgctaggaacactccttcac

SEQ ID NO: 2510671 - DNA, 21 bp, Homo sapiens
tgctaggaacactccttcaca

SEQ ID NO: 2510672 - DNA, 17 bp, Homo sapiens
tgctaggcgagtgccag

SEQ ID NO: 2510673 - DNA, 21 bp, Homo sapiens
tgctaggcgagtgccaggact

SEQ ID NO: 2510674 - DNA, 15 bp, Homo sapiens
tgctaggtgggccag

SEQ ID NO: 2510675 - DNA, 17 bp, Homo sapiens
tgctaggtgggccagcc

SEQ ID NO: 2510676 - DNA, 21 bp, Homo sapiens
tgctaggtgggccagcccctc

SEQ ID NO: 2510677 - DNA, 21 bp, Homo sapiens
tgctataactatgttgataaa

SEQ ID NO: 2510678 - DNA, 13 bp, Homo sapiens
tgctatactgcat

SEQ ID NO: 2510679 - DNA, 19 bp, Homo sapiens
tgctataggctggagaagc

SEQ ID NO: 2510680 - DNA, 15 bp, Homo sapiens
tgctatccatttctc

SEQ ID NO: 2510681 - DNA, 13 bp, Homo sapiens
tgctatctccccc

SEQ ID NO: 2510682 - DNA, 19 bp, Homo sapiens
tgctatctcccccagcccc

SEQ ID NO: 2510683 - DNA, 16 bp, Homo sapiens
tgctatcttaattttg

SEQ ID NO: 2510684 - DNA, 13 bp, Homo sapiens
tgctatgaatgat

SEQ ID NO: 2510685 - DNA, 16 bp, Homo sapiens
tgctatggatggcttc

SEQ ID NO: 2510686 - DNA, 22 bp, Homo sapiens
tgctatggggagaaaagacatg

SEQ ID NO: 2510687 - DNA, 15 bp, Homo sapiens
tgctattgtaaatat

SEQ ID NO: 2510688 - DNA, 16 bp, Homo sapiens
tgctattgtaaatatg

SEQ ID NO: 2510689 - DNA, 18 bp, Homo sapiens
tgctattgtagagccaga

SEQ ID NO: 2510690 - DNA, 19 bp, Homo sapiens
tgctcaaaatttgaagaat

SEQ ID NO: 2510691 - DNA, 21 bp, Homo sapiens
tgctcaaatctattcagacaa

SEQ ID NO: 2510692 - DNA, 15 bp, Homo sapiens
tgctcaagaagacat

SEQ ID NO: 2510693 - DNA, 22 bp, Homo sapiens
tgctcaagaagacatggagact

SEQ ID NO: 2510694 - DNA, 14 bp, Homo sapiens
tgctcacaccccat

SEQ ID NO: 2510695 - DNA, 15 bp, Homo sapiens
ggcgaggcagaggac

SEQ ID NO: 2510696 - DNA, 15 bp, Homo sapiens
ggcgagtcactgcct

SEQ ID NO: 2510697 - DNA, 15 bp, Homo sapiens
ggcgagtgccaggac

SEQ ID NO: 2510698 - DNA, 15 bp, Homo sapiens
ggcgcagccaaggcc

SEQ ID NO: 2510699 - DNA, 15 bp, Homo sapiens
gatgttggctgggaa

SEQ ID NO: 2510700 - DNA, 16 bp, Homo sapiens
gatgtttgtggcctca

SEQ ID NO: 2510701 - DNA, 18 bp, Homo sapiens
gatgttttaattccatga

SEQ ID NO: 2510702 - DNA, 14 bp, Homo sapiens
gatgttttccatga

SEQ ID NO: 2510703 - DNA, 20 bp, Homo sapiens
gatgtttttaaaagtttcaa

SEQ ID NO: 2510704 - DNA, 12 bp, Homo sapiens
gattaaattctt

SEQ ID NO: 2510705 - DNA, 21 bp, Homo sapiens
gattaaccacttcagctgact

SEQ ID NO: 2510706 - DNA, 13 bp, Homo sapiens
gattaagagccat

SEQ ID NO: 2510707 - DNA, 19 bp, Homo sapiens
gattaatccagaataacta

SEQ ID NO: 2510708 - DNA, 18 bp, Homo sapiens
gattacaggcatgtgcca

SEQ ID NO: 2510709 - DNA, 15 bp, Homo sapiens
gattacataatctgt

SEQ ID NO: 2510710 - DNA, 22 bp, Homo sapiens
gattacctagtagtcatttcat

SEQ ID NO: 2510711 - DNA, 13 bp, Homo sapiens
gattacctcctga

SEQ ID NO: 2510712 - DNA, 17 bp, Homo sapiens
gattacctcctgagaaa

SEQ ID NO: 2510713 - DNA, 23 bp, Homo sapiens
gattactctttgagatagaagaa

SEQ ID NO: 2510714 - DNA, 21 bp, Homo sapiens
gattagaaatgaccaatatta

SEQ ID NO: 2510715 - DNA, 17 bp, Homo sapiens
gattagagggaggtgtt

SEQ ID NO: 2510716 - DNA, 17 bp, Homo sapiens
gattataacttgtctaa

SEQ ID NO: 2510717 - DNA, 14 bp, Homo sapiens
gattattcagtgtc

SEQ ID NO: 2510718 - DNA, 14 bp, Homo sapiens
gattattcatttaa

SEQ ID NO: 2510719 - DNA, 15 bp, Homo sapiens
gattattcatttaaa

SEQ ID NO: 2510720 - DNA, 16 bp, Homo sapiens
gattattcatttaaaa

SEQ ID NO: 2510721 - DNA, 19 bp, Homo sapiens
gattattcatttaaaatga

SEQ ID NO: 2510722 - DNA, 22 bp, Homo sapiens
gattattcatttaaaatgatta

SEQ ID NO: 2510723 - DNA, 23 bp, Homo sapiens
gattattccctgtacaatattta

SEQ ID NO: 2510724 - DNA, 17 bp, Homo sapiens
gattattgtatttattc

SEQ ID NO: 2510725 - DNA, 12 bp, Homo sapiens
gattatttaata

SEQ ID NO: 2510726 - DNA, 14 bp, Homo sapiens
gattatttaataac

SEQ ID NO: 2510727 - DNA, 15 bp, Homo sapiens
gattatttaataaca

SEQ ID NO: 2510728 - DNA, 17 bp, Homo sapiens
gattatttaataacatt

SEQ ID NO: 2510729 - DNA, 21 bp, Homo sapiens
gattattttctacacatacat

SEQ ID NO: 2510730 - DNA, 18 bp, Homo sapiens
gattattttttcagaccg

SEQ ID NO: 2510731 - DNA, 18 bp, Homo sapiens
gattcaatctgtaaactg

SEQ ID NO: 2510732 - DNA, 19 bp, Homo sapiens
gattcaatctgtaaactgt

SEQ ID NO: 2510733 - DNA, 13 bp, Homo sapiens
gattcagacagct

SEQ ID NO: 2510734 - DNA, 18 bp, Homo sapiens
gattcagattgttatcta

SEQ ID NO: 2510735 - DNA, 13 bp, Homo sapiens
gattcaggctgct

SEQ ID NO: 2510736 - DNA, 20 bp, Homo sapiens
gattcagtgttaaatgtgat

SEQ ID NO: 2510737 - DNA, 17 bp, Homo sapiens
gattcatatttacttct

SEQ ID NO: 2510738 - DNA, 19 bp, Homo sapiens
gattcatatttacttctta

SEQ ID NO: 2510739 - DNA, 20 bp, Homo sapiens
gattccaagttctcacctct

SEQ ID NO: 2510740 - DNA, 15 bp, Homo sapiens
gattcccaagctctg

SEQ ID NO: 2510741 - DNA, 16 bp, Homo sapiens
gattcccaagctctgc

SEQ ID NO: 2510742 - DNA, 20 bp, Homo sapiens
gattcccaagctctgctcct

SEQ ID NO: 2510743 - DNA, 21 bp, Homo sapiens
gattcccaagctctgctcctc

SEQ ID NO: 2510744 - DNA, 12 bp, Homo sapiens
gattcctgaccc

SEQ ID NO: 2510745 - DNA, 13 bp, Homo sapiens
gattcctgaccca

SEQ ID NO: 2510746 - DNA, 15 bp, Homo sapiens
gattcctgacccagg

SEQ ID NO: 2510747 - DNA, 17 bp, Homo sapiens
gattcctgacccaggcc

SEQ ID NO: 2510748 - DNA, 18 bp, Homo sapiens
gattcgcccaaagccaga

SEQ ID NO: 2510749 - DNA, 15 bp, Homo sapiens
gattctaatgtcttc

SEQ ID NO: 2510750 - DNA, 18 bp, Homo sapiens
gattctactttaagcact

SEQ ID NO: 2510751 - DNA, 23 bp, Homo sapiens
gattctactttaagcactacata

SEQ ID NO: 2510752 - DNA, 17 bp, Homo sapiens
gattctcagggtctctg

SEQ ID NO: 2510753 - DNA, 19 bp, Homo sapiens
gattctcagggtctctgct

SEQ ID NO: 2510754 - DNA, 13 bp, Homo sapiens
gcaataaagaaga

SEQ ID NO: 2510755 - DNA, 20 bp, Homo sapiens
gcaataacctcaaagtgact

SEQ ID NO: 2510756 - DNA, 18 bp, Homo sapiens
gcaataatggtcccatcc

SEQ ID NO: 2510757 - DNA, 22 bp, Homo sapiens
gcaataatggtcccatccaggc

SEQ ID NO: 2510758 - DNA, 23 bp, Homo sapiens
gcaataatggtcccatccaggca

SEQ ID NO: 2510759 - DNA, 17 bp, Homo sapiens
gcaatatagaaacacga

SEQ ID NO: 2510760 - DNA, 23 bp, Homo sapiens
gcaatatatctaaattgaataat

SEQ ID NO: 2510761 - DNA, 19 bp, Homo sapiens
gcaatatttcctcatgtga

SEQ ID NO: 2510762 - DNA, 17 bp, Homo sapiens
gcaatcaaatctgcttt

SEQ ID NO: 2510763 - DNA, 21 bp, Homo sapiens
gcaatcgtaatgtacagatgg

SEQ ID NO: 2510764 - DNA, 21 bp, Homo sapiens
gcaatctattaatagctgcct

SEQ ID NO: 2510765 - DNA, 17 bp, Homo sapiens
gcaatgaagtctctgaa

SEQ ID NO: 2510766 - DNA, 19 bp, Homo sapiens
gcaatgaagtctctgaagt

SEQ ID NO: 2510767 - DNA, 19 bp, Homo sapiens
gcaatgacaggtaaattaa

SEQ ID NO: 2510768 - DNA, 19 bp, Homo sapiens
gcaatgacatctcaggggc

SEQ ID NO: 2510769 - DNA, 15 bp, Homo sapiens
gcaatgatgtccaga

SEQ ID NO: 2510770 - DNA, 14 bp, Homo sapiens
gcaatgattactct

SEQ ID NO: 2510771 - DNA, 23 bp, Homo sapiens
gcaatgccatcctcaaacactgc

SEQ ID NO: 2510772 - DNA, 22 bp, Homo sapiens
gcaatgctggctgttggctggg

SEQ ID NO: 2510773 - DNA, 12 bp, Homo sapiens
gcaatggcagcc

SEQ ID NO: 2510774 - DNA, 15 bp, Homo sapiens
gcaatggcagccttg

SEQ ID NO: 2510775 - DNA, 14 bp, Homo sapiens
gcaatgtgataaaa

SEQ ID NO: 2510776 - DNA, 15 bp, Homo sapiens
gcaattccgcattta

SEQ ID NO: 2510777 - DNA, 19 bp, Homo sapiens
gcaatttatacaatatcat

SEQ ID NO: 2510778 - DNA, 17 bp, Homo sapiens
gcaatttattaaaatga

SEQ ID NO: 2510779 - DNA, 23 bp, Homo sapiens
gcacaaaatgatggacccaatgc

SEQ ID NO: 2510780 - DNA, 14 bp, Homo sapiens
gcacaaatatttat

SEQ ID NO: 2510781 - DNA, 21 bp, Homo sapiens
gcacaagctccaagctcccag

SEQ ID NO: 2510782 - DNA, 23 bp, Homo sapiens
gcacaagctccaagctcccaggc

SEQ ID NO: 2510783 - DNA, 20 bp, Homo sapiens
gcacaatagtaacctgggta

SEQ ID NO: 2510784 - DNA, 10 bp, Homo sapiens
gcacacacac

SEQ ID NO: 2510785 - DNA, 20 bp, Homo sapiens
gcacacacacacacaggagg

SEQ ID NO: 2510786 - DNA, 12 bp, Homo sapiens
gcacacaccaga

SEQ ID NO: 2510787 - DNA, 15 bp, Homo sapiens
gcacacaccagagcc

SEQ ID NO: 2510788 - DNA, 17 bp, Homo sapiens
gcacacaccagagccca

SEQ ID NO: 2510789 - DNA, 16 bp, Homo sapiens
gcacacacctcagagg

SEQ ID NO: 2510790 - DNA, 21 bp, Homo sapiens
gcacacacctgtagtcccagc

SEQ ID NO: 2510791 - DNA, 11 bp, Homo sapiens
gcacacactgt

SEQ ID NO: 2510792 - DNA, 11 bp, Homo sapiens
gcacacatttt

SEQ ID NO: 2510793 - DNA, 12 bp, Homo sapiens
gcacacattttt

SEQ ID NO: 2510794 - DNA, 23 bp, Homo sapiens
gcacacggggtgcgtctccccgg

SEQ ID NO: 2510795 - DNA, 17 bp, Homo sapiens
gcacacgtcatgtttct

SEQ ID NO: 2510796 - DNA, 20 bp, Homo sapiens
gcacactcatcccctcactt

SEQ ID NO: 2510797 - DNA, 12 bp, Homo sapiens
gcacactgtagc

SEQ ID NO: 2510798 - DNA, 20 bp, Homo sapiens
gcacacttggcccaagtggc

SEQ ID NO: 2510799 - DNA, 15 bp, Homo sapiens
gcacagaccctgccc

SEQ ID NO: 2510800 - DNA, 21 bp, Homo sapiens
gcacagaccctgccctgtggg

SEQ ID NO: 2510801 - DNA, 22 bp, Homo sapiens
gcacagaccctgccctgtgggc

SEQ ID NO: 2510802 - DNA, 16 bp, Homo sapiens
gcacagagaagacaaa

SEQ ID NO: 2510803 - DNA, 19 bp, Homo sapiens
gcacagagctctccagctc

SEQ ID NO: 2510804 - DNA, 23 bp, Homo sapiens
gcacagagctctccagctccaag

SEQ ID NO: 2510805 - DNA, 21 bp, Homo sapiens
gcacagagttgttacattttt

SEQ ID NO: 2510806 - DNA, 18 bp, Homo sapiens
gcacagatggatttgcct

SEQ ID NO: 2510807 - DNA, 14 bp, Homo sapiens
gcacagccttctcc

SEQ ID NO: 2510808 - DNA, 21 bp, Homo sapiens
gcacagcggggccccagggct

SEQ ID NO: 2510809 - DNA, 18 bp, Homo sapiens
gcacagggcagctgggcc

SEQ ID NO: 2510810 - DNA, 18 bp, Homo sapiens
gcacagtggtggcagggc

SEQ ID NO: 2510811 - DNA, 17 bp, Homo sapiens
gcacagttttctgagaa

SEQ ID NO: 2510812 - DNA, 22 bp, Homo sapiens
gcacagttttctgagaaagact

SEQ ID NO: 2510813 - DNA, 23 bp, Homo sapiens
gcacagttttctggctggagcct

SEQ ID NO: 2510814 - DNA, 14 bp, Homo sapiens
gcacatattgagca

SEQ ID NO: 2510815 - DNA, 23 bp, Homo sapiens
gcacatcagcacgatttctgttt

SEQ ID NO: 2510816 - DNA, 13 bp, Homo sapiens
gcacatctgcatt

SEQ ID NO: 2510817 - DNA, 21 bp, Homo sapiens
gcacatgtcttgtacatgtgt

SEQ ID NO: 2510818 - DNA, 17 bp, Homo sapiens
gcacatttaagagacag

SEQ ID NO: 2510819 - DNA, 21 bp, Homo sapiens
gcacatttaagagacagtcac

SEQ ID NO: 2510820 - DNA, 20 bp, Homo sapiens
gcaccaaaataagaaaagat

SEQ ID NO: 2510821 - DNA, 19 bp, Homo sapiens
gcaccactgcactccagcc

SEQ ID NO: 2510822 - DNA, 23 bp, Homo sapiens
gcaccactgcactccagcctggg

SEQ ID NO: 2510823 - DNA, 18 bp, Homo sapiens
gcaccactgtgtatttaa

SEQ ID NO: 2510824 - DNA, 21 bp, Homo sapiens
gcaccagaggctgcagaaggc

SEQ ID NO: 2510825 - DNA, 14 bp, Homo sapiens
gcaccagcagcctg

SEQ ID NO: 2510826 - DNA, 15 bp, Homo sapiens
gcaccagcagcctgg

SEQ ID NO: 2510827 - DNA, 17 bp, Homo sapiens
gcaccagcgaagggagt

SEQ ID NO: 2510828 - DNA, 17 bp, Homo sapiens
gcaccagcttctccagg

SEQ ID NO: 2510829 - DNA, 20 bp, Homo sapiens
gcaccagcttctccaggctc

SEQ ID NO: 2510830 - DNA, 12 bp, Homo sapiens
gcaccataactt

SEQ ID NO: 2510831 - DNA, 19 bp, Homo sapiens
gcaccatccgccagggccc

SEQ ID NO: 2510832 - DNA, 22 bp, Homo sapiens
gcacccaccatcatgtctggct

SEQ ID NO: 2510833 - DNA, 12 bp, Homo sapiens
gcacccagccct

SEQ ID NO: 2510834 - DNA, 13 bp, Homo sapiens
gcacccagccctg

SEQ ID NO: 2510835 - DNA, 14 bp, Homo sapiens
gcacccagccctgg

SEQ ID NO: 2510836 - DNA, 19 bp, Homo sapiens
gcacccagcctctagggac

SEQ ID NO: 2510837 - DNA, 23 bp, Homo sapiens
gcacccagtgagcactcccaagt

SEQ ID NO: 2510838 - DNA, 15 bp, Homo sapiens
gcaccccatgctgtt

SEQ ID NO: 2510839 - DNA, 13 bp, Homo sapiens
gcacccgcctctc

SEQ ID NO: 2510840 - DNA, 15 bp, Homo sapiens
gcacccgcctctccc

SEQ ID NO: 2510841 - DNA, 21 bp, Homo sapiens
gcaccctagttctacctcagg

SEQ ID NO: 2510842 - DNA, 15 bp, Homo sapiens
gcaccctccaccctg

SEQ ID NO: 2510843 - DNA, 19 bp, Homo sapiens
gcaccctccaccctgtccc

SEQ ID NO: 2510844 - DNA, 13 bp, Homo sapiens
gcaccctccctcc

SEQ ID NO: 2510845 - DNA, 13 bp, Homo sapiens
gcaccgccttctc

SEQ ID NO: 2510846 - DNA, 19 bp, Homo sapiens
gcaccggctggcctggccc

SEQ ID NO: 2510847 - DNA, 23 bp, Homo sapiens
gcaccggctggcctggcccctca

SEQ ID NO: 2510848 - DNA, 21 bp, Homo sapiens
gcaccgtcatggcttaatgtt

SEQ ID NO: 2510849 - DNA, 19 bp, Homo sapiens
gcacctaccatcagggaca

SEQ ID NO: 2510850 - DNA, 21 bp, Homo sapiens
gcacctcacagaaatgagatc

SEQ ID NO: 2510851 - DNA, 14 bp, Homo sapiens
gcacctcccatcct

SEQ ID NO: 2510852 - DNA, 17 bp, Homo sapiens
gcacctcccatcctaat

SEQ ID NO: 2510853 - DNA, 14 bp, Homo sapiens
gcacctgccagcct

SEQ ID NO: 2510854 - DNA, 17 bp, Homo sapiens
gcacctgccagcctggc

SEQ ID NO: 2510855 - DNA, 15 bp, Homo sapiens
gagcctgcctggagc

SEQ ID NO: 2510856 - DNA, 21 bp, Homo sapiens
gagcctgctggtcacagcctc

SEQ ID NO: 2510857 - DNA, 14 bp, Homo sapiens
gagcctggtgccct

SEQ ID NO: 2510858 - DNA, 16 bp, Homo sapiens
gagcctggtgctgctg

SEQ ID NO: 2510859 - DNA, 17 bp, Homo sapiens
gagcctggtgctgctgc

SEQ ID NO: 2510860 - DNA, 23 bp, Homo sapiens
gagccttccaggggtgggacacc

SEQ ID NO: 2510861 - DNA, 22 bp, Homo sapiens
gagccttctgaggacattccaa

SEQ ID NO: 2510862 - DNA, 13 bp, Homo sapiens
gagccttgaactt

SEQ ID NO: 2510863 - DNA, 22 bp, Homo sapiens
gagccttgaactttgacctctg

SEQ ID NO: 2510864 - DNA, 13 bp, Homo sapiens
gagcgacagtgag

SEQ ID NO: 2510865 - DNA, 15 bp, Homo sapiens
gagcgacagtgagac

SEQ ID NO: 2510866 - DNA, 18 bp, Homo sapiens
gagcgcacctgccccctg

SEQ ID NO: 2510867 - DNA, 12 bp, Homo sapiens
gagcgcccctcc

SEQ ID NO: 2510868 - DNA, 15 bp, Homo sapiens
gagcgcctgcccctc

SEQ ID NO: 2510869 - DNA, 15 bp, Homo sapiens
gagcgctacccactt

SEQ ID NO: 2510870 - DNA, 18 bp, Homo sapiens
gagcgctttctggaaaag

SEQ ID NO: 2510871 - DNA, 14 bp, Homo sapiens
gagcggaaagcagc

SEQ ID NO: 2510872 - DNA, 15 bp, Homo sapiens
gagcggaaagcagct

SEQ ID NO: 2510873 - DNA, 17 bp, Homo sapiens
gagcgggacctgtggct

SEQ ID NO: 2510874 - DNA, 14 bp, Homo sapiens
gagctaacactggc

SEQ ID NO: 2510875 - DNA, 14 bp, Homo sapiens
gagctatgtattaa

SEQ ID NO: 2510876 - DNA, 18 bp, Homo sapiens
gagctatttccattccag

SEQ ID NO: 2510877 - DNA, 18 bp, Homo sapiens
gagctcagagagggcagg

SEQ ID NO: 2510878 - DNA, 20 bp, Homo sapiens
gagctcagagagggcaggca

SEQ ID NO: 2510879 - DNA, 13 bp, Homo sapiens
gagctccagaccc

SEQ ID NO: 2510880 - DNA, 15 bp, Homo sapiens
gagctccagaccccc

SEQ ID NO: 2510881 - DNA, 17 bp, Homo sapiens
gagctccagacccccag

SEQ ID NO: 2510882 - DNA, 22 bp, Homo sapiens
gagctcctctgggcaggacctc

SEQ ID NO: 2510883 - DNA, 18 bp, Homo sapiens
gagctcgtgtatcctggg

SEQ ID NO: 2510884 - DNA, 22 bp, Homo sapiens
gagctcgtgtatcctggggctc

SEQ ID NO: 2510885 - DNA, 19 bp, Homo sapiens
gagctctatgggcagatct

SEQ ID NO: 2510886 - DNA, 16 bp, Homo sapiens
gagctctgcagagcag

SEQ ID NO: 2510887 - DNA, 16 bp, Homo sapiens
gagctcttcaggcctc

SEQ ID NO: 2510888 - DNA, 22 bp, Homo sapiens
gagctcttcaggcctccctctc

SEQ ID NO: 2510889 - DNA, 19 bp, Homo sapiens
gagctgaacccattttgag

SEQ ID NO: 2510890 - DNA, 22 bp, Homo sapiens
gagctgacacaaacctgcctgg

SEQ ID NO: 2510891 - DNA, 17 bp, Homo sapiens
gagctgacacaggatga

SEQ ID NO: 2510892 - DNA, 13 bp, Homo sapiens
gagctgagcaggg

SEQ ID NO: 2510893 - DNA, 23 bp, Homo sapiens
gagctgaggggggccgtgcccag

SEQ ID NO: 2510894 - DNA, 21 bp, Homo sapiens
gagctgccctccttgtccacc

SEQ ID NO: 2510895 - DNA, 16 bp, Homo sapiens
gagctgcctgttcagc

SEQ ID NO: 2510896 - DNA, 24 bp, Homo sapiens
gagctgctctgaattagtccttgc

SEQ ID NO: 2510897 - DNA, 14 bp, Homo sapiens
gagctgctgccctg

SEQ ID NO: 2510898 - DNA, 16 bp, Homo sapiens
gagctgctggcttgca

SEQ ID NO: 2510899 - DNA, 17 bp, Homo sapiens
gagctggccccgccgcc

SEQ ID NO: 2510900 - DNA, 19 bp, Homo sapiens
gagctggccgtgggcctgg

SEQ ID NO: 2510901 - DNA, 21 bp, Homo sapiens
gagctgggacacttaacagat

SEQ ID NO: 2510902 - DNA, 17 bp, Homo sapiens
gagctgggcagaaggcc

SEQ ID NO: 2510903 - DNA, 24 bp, Homo sapiens
gagctgggggccatgagctccaga

SEQ ID NO: 2510904 - DNA, 14 bp, Homo sapiens
gagctggtgcatta

SEQ ID NO: 2510905 - DNA, 16 bp, Homo sapiens
gagctggtgcattaca

SEQ ID NO: 2510906 - DNA, 15 bp, Homo sapiens
gagctggtgcccgga

SEQ ID NO: 2510907 - DNA, 14 bp, Homo sapiens
gagctggtgtctga

SEQ ID NO: 2510908 - DNA, 18 bp, Homo sapiens
gagctggttgggaagaca

SEQ ID NO: 2510909 - DNA, 20 bp, Homo sapiens
gagctgtggactttgttcac

SEQ ID NO: 2510910 - DNA, 16 bp, Homo sapiens
gagctgttgcctcagt

SEQ ID NO: 2510911 - DNA, 18 bp, Homo sapiens
gagctgtttatggcctca

SEQ ID NO: 2510912 - DNA, 19 bp, Homo sapiens
gagctgtttatggcctcag

SEQ ID NO: 2510913 - DNA, 16 bp, Homo sapiens
gagcttcatggcagaa

SEQ ID NO: 2510914 - DNA, 15 bp, Homo sapiens
gagcttggccagaag

SEQ ID NO: 2510915 - DNA, 20 bp, Homo sapiens
gagcttgggggatgactaga

SEQ ID NO: 2510916 - DNA, 22 bp, Homo sapiens
gagctttatgtaataatgtgaa

SEQ ID NO: 2510917 - DNA, 23 bp, Homo sapiens
gagctttctgtccttttggcact

SEQ ID NO: 2510918 - DNA, 15 bp, Homo sapiens
gagcttttctaggct

SEQ ID NO: 2510919 - DNA, 18 bp, Homo sapiens
gaggaaacaacagcttta

SEQ ID NO: 2510920 - DNA, 17 bp, Homo sapiens
gaggaaactcacctgct

SEQ ID NO: 2510921 - DNA, 22 bp, Homo sapiens
gaggaaactcacctgctggccc

SEQ ID NO: 2510922 - DNA, 16 bp, Homo sapiens
gaggaaagaatgaaag

SEQ ID NO: 2510923 - DNA, 14 bp, Homo sapiens
gaggaaccagagcc

SEQ ID NO: 2510924 - DNA, 17 bp, Homo sapiens
gaggaagagaaaaaata

SEQ ID NO: 2510925 - DNA, 19 bp, Homo sapiens
gaggaagagcaggcacatg

SEQ ID NO: 2510926 - DNA, 22 bp, Homo sapiens
gaggaagccaggtccacggtct

SEQ ID NO: 2510927 - DNA, 19 bp, Homo sapiens
gaggaagccctaagacgtc

SEQ ID NO: 2510928 - DNA, 13 bp, Homo sapiens
gaggaagccgctg

SEQ ID NO: 2510929 - DNA, 18 bp, Homo sapiens
gaggaagccgctggggcc

SEQ ID NO: 2510930 - DNA, 22 bp, Homo sapiens
gaggaaggaaacccagctctgg

SEQ ID NO: 2510931 - DNA, 16 bp, Homo sapiens
gaggaaggcaggaaga

SEQ ID NO: 2510932 - DNA, 19 bp, Homo sapiens
gaggaaggggccagaggct

SEQ ID NO: 2510933 - DNA, 19 bp, Homo sapiens
gaggaatcactcttgtgga

SEQ ID NO: 2510934 - DNA, 20 bp, Homo sapiens
gaggaatcatgtcaggcctg

SEQ ID NO: 2510935 - DNA, 21 bp, Homo sapiens
gaggacaattcatgaacttcg

SEQ ID NO: 2510936 - DNA, 13 bp, Homo sapiens
gaggacagggagg

SEQ ID NO: 2510937 - DNA, 18 bp, Homo sapiens
gaggacatgatggagcgc

SEQ ID NO: 2510938 - DNA, 13 bp, Homo sapiens
gaggaccactcct

SEQ ID NO: 2510939 - DNA, 22 bp, Homo sapiens
gaggaccactcctgtacactga

SEQ ID NO: 2510940 - DNA, 14 bp, Homo sapiens
gaggacccagaccc

SEQ ID NO: 2510941 - DNA, 19 bp, Homo sapiens
gaggaccttatctgtgcgt

SEQ ID NO: 2510942 - DNA, 18 bp, Homo sapiens
gaggactgtatttgtgac

SEQ ID NO: 2510943 - DNA, 14 bp, Homo sapiens
gaggacttgtgtct

SEQ ID NO: 2510944 - DNA, 14 bp, Homo sapiens
gaggagaaactgga

SEQ ID NO: 2510945 - DNA, 21 bp, Homo sapiens
gaggagagaagaatgagccta

SEQ ID NO: 2510946 - DNA, 14 bp, Homo sapiens
gaggagccccagct

SEQ ID NO: 2510947 - DNA, 23 bp, Homo sapiens
gaggggctctcagctcagcgcca

SEQ ID NO: 2510948 - DNA, 15 bp, Homo sapiens
gaggggggaggtggg

SEQ ID NO: 2510949 - DNA, 22 bp, Homo sapiens
gaggggggaggtgggatcctcc

SEQ ID NO: 2510950 - DNA, 16 bp, Homo sapiens
gaggggtaaaagctga

SEQ ID NO: 2510951 - DNA, 14 bp, Homo sapiens
gaggggtaggcaga

SEQ ID NO: 2510952 - DNA, 18 bp, Homo sapiens
gaggggtctccaggagga

SEQ ID NO: 2510953 - DNA, 13 bp, Homo sapiens
gagggtcagagag

SEQ ID NO: 2510954 - DNA, 13 bp, Homo sapiens
gagggtcaggaag

SEQ ID NO: 2510955 - DNA, 18 bp, Homo sapiens
gagggtcccaagctgggc

SEQ ID NO: 2510956 - DNA, 21 bp, Homo sapiens
gagggtcctggctcctgaggg

SEQ ID NO: 2510957 - DNA, 15 bp, Homo sapiens
gagggtgagtgcaag

SEQ ID NO: 2510958 - DNA, 16 bp, Homo sapiens
gaggtaacagaacagc

SEQ ID NO: 2510959 - DNA, 24 bp, Homo sapiens
gaggtaaggaatacctgtccccct

SEQ ID NO: 2510960 - DNA, 19 bp, Homo sapiens
gaggtagagtttgaaggag

SEQ ID NO: 2510961 - DNA, 19 bp, Homo sapiens
gaggtatttatctttactt

SEQ ID NO: 2510962 - DNA, 16 bp, Homo sapiens
gaggtcacattcagga

SEQ ID NO: 2510963 - DNA, 17 bp, Homo sapiens
gaggtcagagcctgcag

SEQ ID NO: 2510964 - DNA, 17 bp, Homo sapiens
gaggtccagccctggct

SEQ ID NO: 2510965 - DNA, 20 bp, Homo sapiens
gaggtccagccctggctgaa

SEQ ID NO: 2510966 - DNA, 22 bp, Homo sapiens
gaggtcgaccccaaagcccctt

SEQ ID NO: 2510967 - DNA, 17 bp, Homo sapiens
gaggtctcttgagggag

SEQ ID NO: 2510968 - DNA, 23 bp, Homo sapiens
gaggtctgctcggccgtcttcac

SEQ ID NO: 2510969 - DNA, 22 bp, Homo sapiens
gaggtcttttgacatgtggaaa

SEQ ID NO: 2510970 - DNA, 16 bp, Homo sapiens
gaggtgaaagggagct

SEQ ID NO: 2510971 - DNA, 19 bp, Homo sapiens
gaggtgcagagtgcccaga

SEQ ID NO: 2510972 - DNA, 21 bp, Homo sapiens
gaggtgcctgtcccaccccca

SEQ ID NO: 2510973 - DNA, 19 bp, Homo sapiens
gaggtggaggctgcagtga

SEQ ID NO: 2510974 - DNA, 19 bp, Homo sapiens
gaggtggaggttgcagtga

SEQ ID NO: 2510975 - DNA, 15 bp, Homo sapiens
gaggtggcagccctg

SEQ ID NO: 2510976 - DNA, 21 bp, Homo sapiens
gaggtggccagagctgggagg

SEQ ID NO: 2510977 - DNA, 23 bp, Homo sapiens
gaggtggccagagctgggaggca

SEQ ID NO: 2510978 - DNA, 14 bp, Homo sapiens
gaggtgggcaggtg

SEQ ID NO: 2510979 - DNA, 15 bp, Homo sapiens
gaggtgggcccagga

SEQ ID NO: 2510980 - DNA, 13 bp, Homo sapiens
gaggtggtctgaa

SEQ ID NO: 2510981 - DNA, 17 bp, Homo sapiens
gaggtggtctgaatgtt

SEQ ID NO: 2510982 - DNA, 19 bp, Homo sapiens
gaggttcaaagatattttg

SEQ ID NO: 2510983 - DNA, 17 bp, Homo sapiens
gaggttcatttcaaata

SEQ ID NO: 2510984 - DNA, 14 bp, Homo sapiens
gaggttccctttga

SEQ ID NO: 2510985 - DNA, 15 bp, Homo sapiens
gaggttgataacttt

SEQ ID NO: 2510986 - DNA, 19 bp, Homo sapiens
gaggttgcagtgagccaag

SEQ ID NO: 2510987 - DNA, 15 bp, Homo sapiens
gagtactacagtcct

SEQ ID NO: 2510988 - DNA, 13 bp, Homo sapiens
gagtaggaagact

SEQ ID NO: 2510989 - DNA, 12 bp, Homo sapiens
gagtatatgcac

SEQ ID NO: 2510990 - DNA, 11 bp, Homo sapiens
gagtatatgtc

SEQ ID NO: 2510991 - DNA, 13 bp, Homo sapiens
gagtcaccaagcc

SEQ ID NO: 2510992 - DNA, 15 bp, Homo sapiens
gagtcaccaagccca

SEQ ID NO: 2510993 - DNA, 17 bp, Homo sapiens
gagtcaccaagcccagt

SEQ ID NO: 2510994 - DNA, 12 bp, Homo sapiens
gagtcactgcct

SEQ ID NO: 2510995 - DNA, 17 bp, Homo sapiens
gagtcagggacccctgc

SEQ ID NO: 2510996 - DNA, 16 bp, Homo sapiens
gagtcataaaccttaa

SEQ ID NO: 2510997 - DNA, 13 bp, Homo sapiens
gagtcatctccat

SEQ ID NO: 2510998 - DNA, 14 bp, Homo sapiens
gagtcccaaggaaa

SEQ ID NO: 2510999 - DNA, 15 bp, Homo sapiens
gagtcccaaggaaag

SEQ ID NO: 2511000 - DNA, 16 bp, Homo sapiens
gagtcccaaggaaagc

SEQ ID NO: 2511001 - DNA, 12 bp, Homo sapiens
gagtcccacctt

SEQ ID NO: 2511002 - DNA, 18 bp, Homo sapiens
gagtcccagtgggaggcg

SEQ ID NO: 2511003 - DNA, 16 bp, Homo sapiens
gagtcccctcacctcc

SEQ ID NO: 2511004 - DNA, 23 bp, Homo sapiens
gagtcccctgtttgtttctgaaa

SEQ ID NO: 2511005 - DNA, 15 bp, Homo sapiens
gagtcgaggacaggg

SEQ ID NO: 2511006 - DNA, 17 bp, Homo sapiens
gagtcgtacagaaagct

SEQ ID NO: 2511007 - DNA, 19 bp, Homo sapiens
gagtcgtcatcacttttca

SEQ ID NO: 2511008 - DNA, 23 bp, Homo sapiens
gagtcgtcatcacttttcagtga

SEQ ID NO: 2511009 - DNA, 20 bp, Homo sapiens
gagtctcactgttgcccagg

SEQ ID NO: 2511010 - DNA, 20 bp, Homo sapiens
gagtctccagtggttgctgt

SEQ ID NO: 2511011 - DNA, 12 bp, Homo sapiens
gagtctcctgtg

SEQ ID NO: 2511012 - DNA, 12 bp, Homo sapiens
gagtctgaaggc

SEQ ID NO: 2511013 - DNA, 12 bp, Homo sapiens
gagtctgatgat

SEQ ID NO: 2511014 - DNA, 12 bp, Homo sapiens
gagtctgtctca

SEQ ID NO: 2511015 - DNA, 14 bp, Homo sapiens
gagaggcaatgatt

SEQ ID NO: 2511016 - DNA, 22 bp, Homo sapiens
gagaggcagacttccctgaatg

SEQ ID NO: 2511017 - DNA, 15 bp, Homo sapiens
gagaggccttttgga

SEQ ID NO: 2511018 - DNA, 12 bp, Homo sapiens
gagaggctggga

SEQ ID NO: 2511019 - DNA, 23 bp, Homo sapiens
gagagggagaagaagtcagagag

SEQ ID NO: 2511020 - DNA, 19 bp, Homo sapiens
gagaggggaacagactgga

SEQ ID NO: 2511021 - DNA, 17 bp, Homo sapiens
gagaggggaagggccag

SEQ ID NO: 2511022 - DNA, 13 bp, Homo sapiens
gagaggggcacag

SEQ ID NO: 2511023 - DNA, 17 bp, Homo sapiens
gagaggtcttttttaaa

SEQ ID NO: 2511024 - DNA, 14 bp, Homo sapiens
gagaggtgccagca

SEQ ID NO: 2511025 - DNA, 16 bp, Homo sapiens
gagagtacagtgagcc

SEQ ID NO: 2511026 - DNA, 19 bp, Homo sapiens
gagagtacagtgagccaag

SEQ ID NO: 2511027 - DNA, 15 bp, Homo sapiens
gagagtatattatgt

SEQ ID NO: 2511028 - DNA, 15 bp, Homo sapiens
gagagtcccactgcc

SEQ ID NO: 2511029 - DNA, 18 bp, Homo sapiens
gagagtcccagagcagga

SEQ ID NO: 2511030 - DNA, 19 bp, Homo sapiens
gagagtcccagagcaggag

SEQ ID NO: 2511031 - DNA, 21 bp, Homo sapiens
gagagttcaatggctgctgaa

SEQ ID NO: 2511032 - DNA, 22 bp, Homo sapiens
gagagttcaatggctgctgaag

SEQ ID NO: 2511033 - DNA, 15 bp, Homo sapiens
gagagttttgtcttg

SEQ ID NO: 2511034 - DNA, 15 bp, Homo sapiens
gagataccagcgagg

SEQ ID NO: 2511035 - DNA, 12 bp, Homo sapiens
gagatatatttt

SEQ ID NO: 2511036 - DNA, 15 bp, Homo sapiens
gagatatatttttaa

SEQ ID NO: 2511037 - DNA, 11 bp, Homo sapiens
gagatatttac

SEQ ID NO: 2511038 - DNA, 13 bp, Homo sapiens
gagatcaggctct

SEQ ID NO: 2511039 - DNA, 20 bp, Homo sapiens
gagatcgcgccactgcactc

SEQ ID NO: 2511040 - DNA, 19 bp, Homo sapiens
gagatctaagcctttccat

SEQ ID NO: 2511041 - DNA, 20 bp, Homo sapiens
gagatctaagcctttccata

SEQ ID NO: 2511042 - DNA, 16 bp, Homo sapiens
gagatctggttttgct

SEQ ID NO: 2511043 - DNA, 16 bp, Homo sapiens
gagatgaattaaattt

SEQ ID NO: 2511044 - DNA, 16 bp, Homo sapiens
gagatgcagaggtaaa

SEQ ID NO: 2511045 - DNA, 14 bp, Homo sapiens
gagatgggagctcc

SEQ ID NO: 2511046 - DNA, 12 bp, Homo sapiens
gagatgtcttcg

SEQ ID NO: 2511047 - DNA, 18 bp, Homo sapiens
gagatgtttttaaaagtt

SEQ ID NO: 2511048 - DNA, 19 bp, Homo sapiens
gagatgtttttaaaagttt

SEQ ID NO: 2511049 - DNA, 21 bp, Homo sapiens
gagatgtttttaaaagtttca

SEQ ID NO: 2511050 - DNA, 15 bp, Homo sapiens
gagattatgttcttt

SEQ ID NO: 2511051 - DNA, 21 bp, Homo sapiens
gagattgcaccactgcactcc

SEQ ID NO: 2511052 - DNA, 21 bp, Homo sapiens
gagattgtgccacttcactcc

SEQ ID NO: 2511053 - DNA, 23 bp, Homo sapiens
gagatttaattaatcatgaatgt

SEQ ID NO: 2511054 - DNA, 18 bp, Homo sapiens
gagatttcttgttgctca

SEQ ID NO: 2511055 - DNA, 12 bp, Homo sapiens
gagcaaaataat

SEQ ID NO: 2511056 - DNA, 19 bp, Homo sapiens
gagcaaaatcgatgcagtg

SEQ ID NO: 2511057 - DNA, 14 bp, Homo sapiens
gagcaaagatcaaa

SEQ ID NO: 2511058 - DNA, 22 bp, Homo sapiens
gagcaaaggggtcccatagagg

SEQ ID NO: 2511059 - DNA, 22 bp, Homo sapiens
gagcaagacgctgtgctgccct

SEQ ID NO: 2511060 - DNA, 23 bp, Homo sapiens
gagcaagacgctgtgctgccctg

SEQ ID NO: 2511061 - DNA, 13 bp, Homo sapiens
gagcacactgtag

SEQ ID NO: 2511062 - DNA, 15 bp, Homo sapiens
gagcacactgtagca

SEQ ID NO: 2511063 - DNA, 17 bp, Homo sapiens
gagcacagatctgtttc

SEQ ID NO: 2511064 - DNA, 17 bp, Homo sapiens
gagcacccctctctgca

SEQ ID NO: 2511065 - DNA, 21 bp, Homo sapiens
gagcacccctctctgcatctg

SEQ ID NO: 2511066 - DNA, 14 bp, Homo sapiens
gagcacctccacat

SEQ ID NO: 2511067 - DNA, 19 bp, Homo sapiens
gagcacctccacatcctcc

SEQ ID NO: 2511068 - DNA, 20 bp, Homo sapiens
gagcacggccaacaaagctg

SEQ ID NO: 2511069 - DNA, 21 bp, Homo sapiens
gagcactaaggtgtgctctga

SEQ ID NO: 2511070 - DNA, 13 bp, Homo sapiens
gagcactgggttg

SEQ ID NO: 2511071 - DNA, 14 bp, Homo sapiens
gagcacttgctgta

SEQ ID NO: 2511072 - DNA, 22 bp, Homo sapiens
gagcagaccaccccgcctgccc

SEQ ID NO: 2511073 - DNA, 16 bp, Homo sapiens
gagcagagaattctct

SEQ ID NO: 2511074 - DNA, 21 bp, Homo sapiens
gagcagagacactaacgactt

SEQ ID NO: 2511075 - DNA, 12 bp, Homo sapiens
gagcagagacca

SEQ ID NO: 2511076 - DNA, 16 bp, Homo sapiens
gagcagagaccatccc

SEQ ID NO: 2511077 - DNA, 13 bp, Homo sapiens
gagcagaggcagc

SEQ ID NO: 2511078 - DNA, 15 bp, Homo sapiens
gagcagaggggctga

SEQ ID NO: 2511079 - DNA, 16 bp, Homo sapiens
gagcagaggggctgaa

SEQ ID NO: 2511080 - DNA, 19 bp, Homo sapiens
gagcagatgcagagagcca

SEQ ID NO: 2511081 - DNA, 18 bp, Homo sapiens
gagcagccacattcctga

SEQ ID NO: 2511082 - DNA, 16 bp, Homo sapiens
gagcagccctggagtc

SEQ ID NO: 2511083 - DNA, 11 bp, Homo sapiens
gagcagcctgt

SEQ ID NO: 2511084 - DNA, 18 bp, Homo sapiens
gagcagcctgtggcatct

SEQ ID NO: 2511085 - DNA, 18 bp, Homo sapiens
gagcagcggtttggggag

SEQ ID NO: 2511086 - DNA, 21 bp, Homo sapiens
gagcagctttaaactcaggga

SEQ ID NO: 2511087 - DNA, 23 bp, Homo sapiens
gagcagctttaaactcagggaca

SEQ ID NO: 2511088 - DNA, 21 bp, Homo sapiens
gagcaggaggcccctggccca

SEQ ID NO: 2511089 - DNA, 15 bp, Homo sapiens
gagcaggcacatgga

SEQ ID NO: 2511090 - DNA, 18 bp, Homo sapiens
gagcaggcggtgggcacc

SEQ ID NO: 2511091 - DNA, 18 bp, Homo sapiens
gagcaggctggcagctct

SEQ ID NO: 2511092 - DNA, 22 bp, Homo sapiens
gagcaggctggcagctctccag

SEQ ID NO: 2511093 - DNA, 14 bp, Homo sapiens
gagcagggctcagc

SEQ ID NO: 2511094 - DNA, 21 bp, Homo sapiens
gagcagggctcagcggggaca

SEQ ID NO: 2511095 - DNA, 15 bp, Homo sapiens
gagcaggggcgtgga

SEQ ID NO: 2511096 - DNA, 16 bp, Homo sapiens
gagcagtatcatgaag

SEQ ID NO: 2511097 - DNA, 14 bp, Homo sapiens
gagcagtgcaggca

SEQ ID NO: 2511098 - DNA, 15 bp, Homo sapiens
gagcagtgcaggcac

SEQ ID NO: 2511099 - DNA, 17 bp, Homo sapiens
gagcagtgcaggcacag

SEQ ID NO: 2511100 - DNA, 21 bp, Homo sapiens
gagcataataaatggatgagg

SEQ ID NO: 2511101 - DNA, 13 bp, Homo sapiens
gagcatcaggcca

SEQ ID NO: 2511102 - DNA, 14 bp, Homo sapiens
gagcatcaggccag

SEQ ID NO: 2511103 - DNA, 17 bp, Homo sapiens
gagcatcaggccaggcc

SEQ ID NO: 2511104 - DNA, 17 bp, Homo sapiens
gagcatccacctccttc

SEQ ID NO: 2511105 - DNA, 18 bp, Homo sapiens
gagcatccacctccttct

SEQ ID NO: 2511106 - DNA, 18 bp, Homo sapiens
gagcatctcttgaggcca

SEQ ID NO: 2511107 - DNA, 20 bp, Homo sapiens
gagcatctcttgaggccagg

SEQ ID NO: 2511108 - DNA, 23 bp, Homo sapiens
gagcatctcttgaggccaggagt

SEQ ID NO: 2511109 - DNA, 14 bp, Homo sapiens
gagcatggagctgg

SEQ ID NO: 2511110 - DNA, 17 bp, Homo sapiens
gagcatggagctggccg

SEQ ID NO: 2511111 - DNA, 14 bp, Homo sapiens
gagcatggctgtga

SEQ ID NO: 2511112 - DNA, 19 bp, Homo sapiens
gagcatggctgtgaggatg

SEQ ID NO: 2511113 - DNA, 22 bp, Homo sapiens
gagcatggggataaaggagaag

SEQ ID NO: 2511114 - DNA, 15 bp, Homo sapiens
gagcattggctgaga

SEQ ID NO: 2511115 - DNA, 19 bp, Homo sapiens
gagcattgtggctgtcagc

SEQ ID NO: 2511116 - DNA, 15 bp, Homo sapiens
gagccactcctctga

SEQ ID NO: 2511117 - DNA, 22 bp, Homo sapiens
gagccactgcaccgggccacag

SEQ ID NO: 2511118 - DNA, 16 bp, Homo sapiens
gactggctggctgcag

SEQ ID NO: 2511119 - DNA, 10 bp, Homo sapiens
gactggcttt

SEQ ID NO: 2511120 - DNA, 20 bp, Homo sapiens
gactgggaagataggctctg

SEQ ID NO: 2511121 - DNA, 23 bp, Homo sapiens
gactgggaagataggctctgcac

SEQ ID NO: 2511122 - DNA, 16 bp, Homo sapiens
gactggggatgtggga

SEQ ID NO: 2511123 - DNA, 22 bp, Homo sapiens
gactggtgctataggctggaga

SEQ ID NO: 2511124 - DNA, 15 bp, Homo sapiens
gactgtatttgtgac

SEQ ID NO: 2511125 - DNA, 20 bp, Homo sapiens
gactgtatttgtgactaatt

SEQ ID NO: 2511126 - DNA, 17 bp, Homo sapiens
gactgtgacaggcagca

SEQ ID NO: 2511127 - DNA, 19 bp, Homo sapiens
gactgtgacaggcagcaga

SEQ ID NO: 2511128 - DNA, 23 bp, Homo sapiens
gactgttcaagagcacacttggc

SEQ ID NO: 2511129 - DNA, 19 bp, Homo sapiens
gactgttttctctcggctc

SEQ ID NO: 2511130 - DNA, 18 bp, Homo sapiens
gactgttttctcttgaga

SEQ ID NO: 2511131 - DNA, 21 bp, Homo sapiens
gactgttttttcctgagcttg

SEQ ID NO: 2511132 - DNA, 19 bp, Homo sapiens
gacttaaaatattcctgca

SEQ ID NO: 2511133 - DNA, 14 bp, Homo sapiens
gacttaacggctcc

SEQ ID NO: 2511134 - DNA, 20 bp, Homo sapiens
gacttaactgcatttttaga

SEQ ID NO: 2511135 - DNA, 19 bp, Homo sapiens
gacttcccactctagggca

SEQ ID NO: 2511136 - DNA, 16 bp, Homo sapiens
gacttccttgctctcc

SEQ ID NO: 2511137 - DNA, 15 bp, Homo sapiens
gacttcgactcagga

SEQ ID NO: 2511138 - DNA, 23 bp, Homo sapiens
gacttctaagtaaaaccacagca

SEQ ID NO: 2511139 - DNA, 22 bp, Homo sapiens
gacttctccaggtctcacgggc

SEQ ID NO: 2511140 - DNA, 20 bp, Homo sapiens
gacttctgtcttcacaacag

SEQ ID NO: 2511141 - DNA, 22 bp, Homo sapiens
gacttctttcaaattgagagaa

SEQ ID NO: 2511142 - DNA, 16 bp, Homo sapiens
gacttcttttcacatt

SEQ ID NO: 2511143 - DNA, 18 bp, Homo sapiens
gacttcttttcacattct

SEQ ID NO: 2511144 - DNA, 21 bp, Homo sapiens
gacaaaaattcaactcagact

SEQ ID NO: 2511145 - DNA, 16 bp, Homo sapiens
gacctctgcagcaata

SEQ ID NO: 2511146 - DNA, 14 bp, Homo sapiens
gacctctgttgtcc

SEQ ID NO: 2511147 - DNA, 16 bp, Homo sapiens
gacctgaagagtggtc

SEQ ID NO: 2511148 - DNA, 15 bp, Homo sapiens
gacctgactattgaa

SEQ ID NO: 2511149 - DNA, 13 bp, Homo sapiens
gacctgaggaagc

SEQ ID NO: 2511150 - DNA, 15 bp, Homo sapiens
gacctgaggcccttc

SEQ ID NO: 2511151 - DNA, 13 bp, Homo sapiens
gacctgcaggcca

SEQ ID NO: 2511152 - DNA, 20 bp, Homo sapiens
gacctgcaggccaagagcag

SEQ ID NO: 2511153 - DNA, 14 bp, Homo sapiens
gacctgcctcctgc

SEQ ID NO: 2511154 - DNA, 20 bp, Homo sapiens
gacctgctgagggaccagcc

SEQ ID NO: 2511155 - DNA, 21 bp, Homo sapiens
gacctgctgagggaccagcca

SEQ ID NO: 2511156 - DNA, 13 bp, Homo sapiens
gacctggagcccc

SEQ ID NO: 2511157 - DNA, 16 bp, Homo sapiens
gacctggagcccctgg

SEQ ID NO: 2511158 - DNA, 17 bp, Homo sapiens
gacctggcaaggacaca

SEQ ID NO: 2511159 - DNA, 22 bp, Homo sapiens
gacctggcactggatgcagaaa

SEQ ID NO: 2511160 - DNA, 19 bp, Homo sapiens
gacctggtaccctcctggc

SEQ ID NO: 2511161 - DNA, 18 bp, Homo sapiens
gaagttactgttatagag

SEQ ID NO: 2511162 - DNA, 13 bp, Homo sapiens
gaagttagaattc

SEQ ID NO: 2511163 - DNA, 14 bp, Homo sapiens
gaagttagaattcc

SEQ ID NO: 2511164 - DNA, 21 bp, Homo sapiens
gaagttagaattccttcaggg

SEQ ID NO: 2511165 - DNA, 15 bp, Homo sapiens
gaagttgaatgggca

SEQ ID NO: 2511166 - DNA, 18 bp, Homo sapiens
gaagttgatatagaacag

SEQ ID NO: 2511167 - DNA, 17 bp, Homo sapiens
gaagttgcagtgagctg

SEQ ID NO: 2511168 - DNA, 22 bp, Homo sapiens
gaagttggagtgagtgtggctc

SEQ ID NO: 2511169 - DNA, 14 bp, Homo sapiens
gaagttgtttgtca

SEQ ID NO: 2511170 - DNA, 19 bp, Homo sapiens
gaagtttgatattaaagga

SEQ ID NO: 2511171 - DNA, 17 bp, Homo sapiens
gaagttttgcatttatg

SEQ ID NO: 2511172 - DNA, 21 bp, Homo sapiens
gaataaaatactatttttact

SEQ ID NO: 2511173 - DNA, 21 bp, Homo sapiens
gaataaaattattttggattt

SEQ ID NO: 2511174 - DNA, 12 bp, Homo sapiens
gaataaactaga

SEQ ID NO: 2511175 - DNA, 14 bp, Homo sapiens
ctttttctccctct

SEQ ID NO: 2511176 - DNA, 17 bp, Homo sapiens
ctttttctccctctgga

SEQ ID NO: 2511177 - DNA, 12 bp, Homo sapiens
ctttttctttat

SEQ ID NO: 2511178 - DNA, 13 bp, Homo sapiens
ctttttgctttcg

SEQ ID NO: 2511179 - DNA, 11 bp, Homo sapiens
ctttttgtagg

SEQ ID NO: 2511180 - DNA, 15 bp, Homo sapiens
cttttttacacaaat

SEQ ID NO: 2511181 - DNA, 21 bp, Homo sapiens
cttttttgataaagtttctca

SEQ ID NO: 2511182 - DNA, 14 bp, Homo sapiens
cttttttggctgct

SEQ ID NO: 2511183 - DNA, 22 bp, Homo sapiens
cttttttggctgctgaaggctc

SEQ ID NO: 2511184 - DNA, 17 bp, Homo sapiens
ctttttttttctctttc

SEQ ID NO: 2511185 - DNA, 23 bp, Homo sapiens
ctttttttttttttaaagacaga

SEQ ID NO: 2511186 - DNA, 12 bp, Homo sapiens
gaaaaaaaaaga

SEQ ID NO: 2511187 - DNA, 16 bp, Homo sapiens
gaaaaaaaaagaaaaa

SEQ ID NO: 2511188 - DNA, 20 bp, Homo sapiens
gaaaaaaaatgttctttggg

SEQ ID NO: 2511189 - DNA, 16 bp, Homo sapiens
gaaaaaaatgactaaa

SEQ ID NO: 2511190 - DNA, 16 bp, Homo sapiens
gaaaaaagagaaaaga

SEQ ID NO: 2511191 - DNA, 22 bp, Homo sapiens
gaaaaaagttgtaggcgaatca

SEQ ID NO: 2511192 - DNA, 14 bp, Homo sapiens
gaaaaaatgttgga

SEQ ID NO: 2511193 - DNA, 23 bp, Homo sapiens
gaaaaactctgggaaataagaga

SEQ ID NO: 2511194 - DNA, 11 bp, Homo sapiens
gaaaaagaaaa

SEQ ID NO: 2511195 - DNA, 18 bp, Homo sapiens
gaaaaagtcatccaatct

SEQ ID NO: 2511196 - DNA, 11 bp, Homo sapiens
gaaaaatatga

SEQ ID NO: 2511197 - DNA, 13 bp, Homo sapiens
gaaaaatatttaa

SEQ ID NO: 2511198 - DNA, 16 bp, Homo sapiens
gaaaaatgagcctggc

SEQ ID NO: 2511199 - DNA, 15 bp, Homo sapiens
gaaaaattcctattg

SEQ ID NO: 2511200 - DNA, 12 bp, Homo sapiens
gaaaacaaggaa

SEQ ID NO: 2511201 - DNA, 22 bp, Homo sapiens
gaaaacactgttctctgccctc

SEQ ID NO: 2511202 - DNA, 17 bp, Homo sapiens
gaaaacagactcaggtt

SEQ ID NO: 2511203 - DNA, 14 bp, Homo sapiens
gaaaaccccagcat

SEQ ID NO: 2511204 - DNA, 17 bp, Homo sapiens
gaaaactcattactttt

SEQ ID NO: 2511205 - DNA, 20 bp, Homo sapiens
gaaaactcctttagcaggtg

SEQ ID NO: 2511206 - DNA, 16 bp, Homo sapiens
gaaaactgaaaatcta

SEQ ID NO: 2511207 - DNA, 19 bp, Homo sapiens
gaaaactgcaacttgtaaa

SEQ ID NO: 2511208 - DNA, 16 bp, Homo sapiens
gaaaacttcttttaaa

SEQ ID NO: 2511209 - DNA, 21 bp, Homo sapiens
gaaaactttatgctaagtgaa

SEQ ID NO: 2511210 - DNA, 10 bp, Homo sapiens
gaaaagaaaa

SEQ ID NO: 2511211 - DNA, 20 bp, Homo sapiens
gaaaagactccaaagaaatg

SEQ ID NO: 2511212 - DNA, 21 bp, Homo sapiens
gaaaagactccaaagaaatgt

SEQ ID NO: 2511213 - DNA, 13 bp, Homo sapiens
gaaaagataaaga

SEQ ID NO: 2511214 - DNA, 16 bp, Homo sapiens
gaaaagatacgacttt

SEQ ID NO: 2511215 - DNA, 20 bp, Homo sapiens
gaaaagatacgactttattt

SEQ ID NO: 2511216 - DNA, 22 bp, Homo sapiens
gaaaagatacgactttattttc

SEQ ID NO: 2511217 - DNA, 21 bp, Homo sapiens
gaaaagatgtagatttatttc

SEQ ID NO: 2511218 - DNA, 18 bp, Homo sapiens
gaaaagcggacatcagct

SEQ ID NO: 2511219 - DNA, 11 bp, Homo sapiens
gaaaagctatt

SEQ ID NO: 2511220 - DNA, 17 bp, Homo sapiens
gaaaagctattagccag

SEQ ID NO: 2511221 - DNA, 19 bp, Homo sapiens
gaaaagctattagccagga

SEQ ID NO: 2511222 - DNA, 19 bp, Homo sapiens
gaaaagctgctgacagtgt

SEQ ID NO: 2511223 - DNA, 12 bp, Homo sapiens
gaaaagttcata

SEQ ID NO: 2511224 - DNA, 19 bp, Homo sapiens
gaaaataaaaaaaagaaaa

SEQ ID NO: 2511225 - DNA, 19 bp, Homo sapiens
gaaaatagctctttcaggg

SEQ ID NO: 2511226 - DNA, 13 bp, Homo sapiens
gaaaatatactgt

SEQ ID NO: 2511227 - DNA, 17 bp, Homo sapiens
ctttaaaaaaatttaag

SEQ ID NO: 2511228 - DNA, 12 bp, Homo sapiens
ctttaaaagaat

SEQ ID NO: 2511229 - DNA, 13 bp, Homo sapiens
ctttaaaggaaaa

SEQ ID NO: 2511230 - DNA, 20 bp, Homo sapiens
ctttaaagggatggcaagat

SEQ ID NO: 2511231 - DNA, 19 bp, Homo sapiens
ctttaacttaattgctatg

SEQ ID NO: 2511232 - DNA, 14 bp, Homo sapiens
ctttaagcagctct

SEQ ID NO: 2511233 - DNA, 17 bp, Homo sapiens
ctttaagcagctcttgc

SEQ ID NO: 2511234 - DNA, 21 bp, Homo sapiens
ctttaagcagctcttgctaat

SEQ ID NO: 2511235 - DNA, 18 bp, Homo sapiens
ctttaatatcatcagtat

SEQ ID NO: 2511236 - DNA, 21 bp, Homo sapiens
ctttaatcttcagttttatct

SEQ ID NO: 2511237 - DNA, 19 bp, Homo sapiens
ctttaattctctttcaaag

SEQ ID NO: 2511238 - DNA, 18 bp, Homo sapiens
ctttaatttatttttgca

SEQ ID NO: 2511239 - DNA, 22 bp, Homo sapiens
ctttaatttatttttgcatggc

SEQ ID NO: 2511240 - DNA, 22 bp, Homo sapiens
ctttacacatcagtcacaagtt

SEQ ID NO: 2511241 - DNA, 14 bp, Homo sapiens
ctttacatgcaatt

SEQ ID NO: 2511242 - DNA, 17 bp, Homo sapiens
ctttacatgcaatttat

SEQ ID NO: 2511243 - DNA, 16 bp, Homo sapiens
ctttacctgagaccag

SEQ ID NO: 2511244 - DNA, 15 bp, Homo sapiens
ctttactgtcaaaat

SEQ ID NO: 2511245 - DNA, 15 bp, Homo sapiens
ctttactgtttgtta

SEQ ID NO: 2511246 - DNA, 14 bp, Homo sapiens
ctttagatgctgat

SEQ ID NO: 2511247 - DNA, 17 bp, Homo sapiens
ctttagatgctgatgat

SEQ ID NO: 2511248 - DNA, 16 bp, Homo sapiens
ctttagccaaaccctt

SEQ ID NO: 2511249 - DNA, 14 bp, Homo sapiens
ctttagcgcccagt

SEQ ID NO: 2511250 - DNA, 15 bp, Homo sapiens
ctttagcgcccagtt

SEQ ID NO: 2511251 - DNA, 13 bp, Homo sapiens
ctttagggcagct

SEQ ID NO: 2511252 - DNA, 15 bp, Homo sapiens
ctttagggcagcttg

SEQ ID NO: 2511253 - DNA, 17 bp, Homo sapiens
ctttagtacctgaaaag

SEQ ID NO: 2511254 - DNA, 20 bp, Homo sapiens
ctttagtgaacgtggactcc

SEQ ID NO: 2511255 - DNA, 14 bp, Homo sapiens
ctttagtggcttca

SEQ ID NO: 2511256 - DNA, 15 bp, Homo sapiens
ctttagtttttgtga

SEQ ID NO: 2511257 - DNA, 19 bp, Homo sapiens
ctttataattctactttga

SEQ ID NO: 2511258 - DNA, 23 bp, Homo sapiens
ctttatacaacagtgctaaaaat

SEQ ID NO: 2511259 - DNA, 20 bp, Homo sapiens
ctttatatggcctcaagatc

SEQ ID NO: 2511260 - DNA, 13 bp, Homo sapiens
ctttatatttagt

SEQ ID NO: 2511261 - DNA, 15 bp, Homo sapiens
ctttatgcacaaaat

SEQ ID NO: 2511262 - DNA, 13 bp, Homo sapiens
ctttatggtttct

SEQ ID NO: 2511263 - DNA, 12 bp, Homo sapiens
ctttatgtgtaa

SEQ ID NO: 2511264 - DNA, 16 bp, Homo sapiens
ctttattcaagtaaaa

SEQ ID NO: 2511265 - DNA, 16 bp, Homo sapiens
ctttattggctgagat

SEQ ID NO: 2511266 - DNA, 21 bp, Homo sapiens
ctttcaatggtttgcaaggaa

SEQ ID NO: 2511267 - DNA, 15 bp, Homo sapiens
ctttcacacttccac

SEQ ID NO: 2511268 - DNA, 19 bp, Homo sapiens
ctttcacacttccaccagc

SEQ ID NO: 2511269 - DNA, 20 bp, Homo sapiens
ctttcacacttccaccagcc

SEQ ID NO: 2511270 - DNA, 21 bp, Homo sapiens
ctttcacacttccaccagcct

SEQ ID NO: 2511271 - DNA, 19 bp, Homo sapiens
ctttcagatacatggttgt

SEQ ID NO: 2511272 - DNA, 17 bp, Homo sapiens
ctttcagatgtcttctg

SEQ ID NO: 2511273 - DNA, 19 bp, Homo sapiens
ctttcagatgtcttctgcc

SEQ ID NO: 2511274 - DNA, 20 bp, Homo sapiens
ctttcagatgtcttctgcct

SEQ ID NO: 2511275 - DNA, 12 bp, Homo sapiens
ctttcaggtact

SEQ ID NO: 2511276 - DNA, 15 bp, Homo sapiens
ctttcagtgaaagca

SEQ ID NO: 2511277 - DNA, 17 bp, Homo sapiens
ctttcagtgaaagcatc

SEQ ID NO: 2511278 - DNA, 21 bp, Homo sapiens
ctttcatcctgactctgcccc

SEQ ID NO: 2511279 - DNA, 17 bp, Homo sapiens
ctttcatgtaaactgtg

SEQ ID NO: 2511280 - DNA, 21 bp, Homo sapiens
ctttccaaaggccatggagag

SEQ ID NO: 2511281 - DNA, 22 bp, Homo sapiens
ctttccaaagtacactgtttca

SEQ ID NO: 2511282 - DNA, 16 bp, Homo sapiens
ctttccaaatgcccag

SEQ ID NO: 2511283 - DNA, 18 bp, Homo sapiens
ctttccaaatgcccagct

SEQ ID NO: 2511284 - DNA, 16 bp, Homo sapiens
ctttccaccccctccc

SEQ ID NO: 2511285 - DNA, 17 bp, Homo sapiens
ctttccaccccctccct

SEQ ID NO: 2511286 - DNA, 21 bp, Homo sapiens
ctttccaccccctccctggcc

SEQ ID NO: 2511287 - DNA, 23 bp, Homo sapiens
ctttccaccccctccctggcctg

SEQ ID NO: 2511288 - DNA, 15 bp, Homo sapiens
ctttcccctgtgggg

SEQ ID NO: 2511289 - DNA, 20 bp, Homo sapiens
ctttccctgaactgggacct

SEQ ID NO: 2511290 - DNA, 15 bp, Homo sapiens
ctttcccttatcaaa

SEQ ID NO: 2511291 - DNA, 17 bp, Homo sapiens
ctttccgtggcactgca

SEQ ID NO: 2511292 - DNA, 19 bp, Homo sapiens
ctttcctcttccccttgcc

SEQ ID NO: 2511293 - DNA, 12 bp, Homo sapiens
ctttcctgaggc

SEQ ID NO: 2511294 - DNA, 17 bp, Homo sapiens
ctttcctgaggctgggc

SEQ ID NO: 2511295 - DNA, 23 bp, Homo sapiens
ctttcctggacactcagacctga

SEQ ID NO: 2511296 - DNA, 20 bp, Homo sapiens
ctttcctgtagccttctgta

SEQ ID NO: 2511297 - DNA, 15 bp, Homo sapiens
ctttctacccagcga

SEQ ID NO: 2511298 - DNA, 14 bp, Homo sapiens
ctttctagctgttg

SEQ ID NO: 2511299 - DNA, 19 bp, Homo sapiens
ctttctagtggtctttgta

SEQ ID NO: 2511300 - DNA, 22 bp, Homo sapiens
ctttctagtggtctttgtaaga

SEQ ID NO: 2511301 - DNA, 16 bp, Homo sapiens
ctttctattgaaaaat

SEQ ID NO: 2511302 - DNA, 22 bp, Homo sapiens
ctttctcagccgcttctgactg

SEQ ID NO: 2511303 - DNA, 23 bp, Homo sapiens
cttgccgcgtcgccctcccaggc

SEQ ID NO: 2511304 - DNA, 19 bp, Homo sapiens
cttgccgtctacctgaggg

SEQ ID NO: 2511305 - DNA, 19 bp, Homo sapiens
cttgcctagggcctggtcc

SEQ ID NO: 2511306 - DNA, 13 bp, Homo sapiens
cttgcctcctgga

SEQ ID NO: 2511307 - DNA, 15 bp, Homo sapiens
cttgcctcctgtgta

SEQ ID NO: 2511308 - DNA, 20 bp, Homo sapiens
cttgccttattagagtgtct

SEQ ID NO: 2511309 - DNA, 12 bp, Homo sapiens
cttgcctttctc

SEQ ID NO: 2511310 - DNA, 14 bp, Homo sapiens
cttgcgcattctca

SEQ ID NO: 2511311 - DNA, 20 bp, Homo sapiens
cttgcggaatcactctgtcc

SEQ ID NO: 2511312 - DNA, 23 bp, Homo sapiens
cttgctaatcagtgtctcacact

SEQ ID NO: 2511313 - DNA, 20 bp, Homo sapiens
cttgctcgctgtaaaatctt

SEQ ID NO: 2511314 - DNA, 19 bp, Homo sapiens
cttgctctcccctgccctg

SEQ ID NO: 2511315 - DNA, 17 bp, Homo sapiens
cttgctctccctcttct

SEQ ID NO: 2511316 - DNA, 14 bp, Homo sapiens
cttgctctgcaggc

SEQ ID NO: 2511317 - DNA, 14 bp, Homo sapiens
cttgctctgtaatc

SEQ ID NO: 2511318 - DNA, 15 bp, Homo sapiens
cttgctctgtaatct

SEQ ID NO: 2511319 - DNA, 22 bp, Homo sapiens
cttggaaacctgccctgcctga

SEQ ID NO: 2511320 - DNA, 22 bp, Homo sapiens
cttggaaagcatcacctcaggc

SEQ ID NO: 2511321 - DNA, 15 bp, Homo sapiens
cttggaagagcctgc

SEQ ID NO: 2511322 - DNA, 19 bp, Homo sapiens
cttggaagagcctgcaggt

SEQ ID NO: 2511323 - DNA, 13 bp, Homo sapiens
cttggaagctccg

SEQ ID NO: 2511324 - DNA, 14 bp, Homo sapiens
cttggaagctccgc

SEQ ID NO: 2511325 - DNA, 20 bp, Homo sapiens
cttggaagctccgctttcta

SEQ ID NO: 2511326 - DNA, 18 bp, Homo sapiens
cttggaagttgcatggca

SEQ ID NO: 2511327 - DNA, 13 bp, Homo sapiens
cttggacactgta

SEQ ID NO: 2511328 - DNA, 19 bp, Homo sapiens
cttggacctctgctctgag

SEQ ID NO: 2511329 - DNA, 13 bp, Homo sapiens
cttggagccccag

SEQ ID NO: 2511330 - DNA, 14 bp, Homo sapiens
cttggagccggact

SEQ ID NO: 2511331 - DNA, 21 bp, Homo sapiens
cttggagccggactttcggag

SEQ ID NO: 2511332 - DNA, 21 bp, Homo sapiens
cttggagctgagcctctcacc

SEQ ID NO: 2511333 - DNA, 15 bp, Homo sapiens
cttggaggccagcca

SEQ ID NO: 2511334 - DNA, 14 bp, Homo sapiens
cttggagggaccaa

SEQ ID NO: 2511335 - DNA, 12 bp, Homo sapiens
cttggagggcat

SEQ ID NO: 2511336 - DNA, 23 bp, Homo sapiens
cttggagggcatgaagacagata

SEQ ID NO: 2511337 - DNA, 18 bp, Homo sapiens
cttggagggtcccaagct

SEQ ID NO: 2511338 - DNA, 22 bp, Homo sapiens
cttggagggtcccaagctgggc

SEQ ID NO: 2511339 - DNA, 18 bp, Homo sapiens
cttggagggttggtcctc

SEQ ID NO: 2511340 - DNA, 19 bp, Homo sapiens
cttggagggttggtcctct

SEQ ID NO: 2511341 - DNA, 18 bp, Homo sapiens
cttggagtattggggtct

SEQ ID NO: 2511342 - DNA, 18 bp, Homo sapiens
cttggatgtacctgcccc

SEQ ID NO: 2511343 - DNA, 15 bp, Homo sapiens
cttggatgtatatgt

SEQ ID NO: 2511344 - DNA, 22 bp, Homo sapiens
cttggattgtccccgacccttg

SEQ ID NO: 2511345 - DNA, 23 bp, Homo sapiens
cttggattgtccccgacccttgc

SEQ ID NO: 2511346 - DNA, 15 bp, Homo sapiens
cttggcagctgaact

SEQ ID NO: 2511347 - DNA, 18 bp, Homo sapiens
cttggcatcacagggcag

SEQ ID NO: 2511348 - DNA, 22 bp, Homo sapiens
cttggccagaagggggccatga

SEQ ID NO: 2511349 - DNA, 23 bp, Homo sapiens
cttggcctcagaattcacaaaat

SEQ ID NO: 2511350 - DNA, 22 bp, Homo sapiens
cttggcctgtctcatccccagg

SEQ ID NO: 2511351 - DNA, 14 bp, Homo sapiens
cttggcggcagcag

SEQ ID NO: 2511352 - DNA, 15 bp, Homo sapiens
cttggcggcagcagc

SEQ ID NO: 2511353 - DNA, 18 bp, Homo sapiens
cttggcggcagcagccat

SEQ ID NO: 2511354 - DNA, 17 bp, Homo sapiens
cttggctacacagggat

SEQ ID NO: 2511355 - DNA, 21 bp, Homo sapiens
cttggctcaatcctctaagct

SEQ ID NO: 2511356 - DNA, 16 bp, Homo sapiens
cttggctgcagggagt

SEQ ID NO: 2511357 - DNA, 13 bp, Homo sapiens
cttggctggtgca

SEQ ID NO: 2511358 - DNA, 16 bp, Homo sapiens
cttggcttcctttctt

SEQ ID NO: 2511359 - DNA, 14 bp, Homo sapiens
cttggctttcatgt

SEQ ID NO: 2511360 - DNA, 22 bp, Homo sapiens
cttggctttcattattagtact

SEQ ID NO: 2511361 - DNA, 22 bp, Homo sapiens
cttgggaagctgaggcgggaga

SEQ ID NO: 2511362 - DNA, 15 bp, Homo sapiens
cttgggaggccccac

SEQ ID NO: 2511363 - DNA, 19 bp, Homo sapiens
cttgggaggccccactggg

SEQ ID NO: 2511364 - DNA, 18 bp, Homo sapiens
cttgggccactgtgaaga

SEQ ID NO: 2511365 - DNA, 14 bp, Homo sapiens
cttgggcccagctg

SEQ ID NO: 2511366 - DNA, 18 bp, Homo sapiens
cttgggcccagctgggct

SEQ ID NO: 2511367 - DNA, 15 bp, Homo sapiens
cttccagctcctgta

SEQ ID NO: 2511368 - DNA, 16 bp, Homo sapiens
cttccaggcccccacc

SEQ ID NO: 2511369 - DNA, 12 bp, Homo sapiens
cttccaggctgg

SEQ ID NO: 2511370 - DNA, 21 bp, Homo sapiens
cttccaggggtgggacaccct

SEQ ID NO: 2511371 - DNA, 19 bp, Homo sapiens
cttccaggtatctccagga

SEQ ID NO: 2511372 - DNA, 11 bp, Homo sapiens
cttccataatc

SEQ ID NO: 2511373 - DNA, 11 bp, Homo sapiens
cttccataatt

SEQ ID NO: 2511374 - DNA, 14 bp, Homo sapiens
cttccatacagctc

SEQ ID NO: 2511375 - DNA, 15 bp, Homo sapiens
cttccatccctaccc

SEQ ID NO: 2511376 - DNA, 16 bp, Homo sapiens
cttccatccctacccc

SEQ ID NO: 2511377 - DNA, 17 bp, Homo sapiens
cttccatccctaccccc

SEQ ID NO: 2511378 - DNA, 19 bp, Homo sapiens
cttccatccctacccccta

SEQ ID NO: 2511379 - DNA, 15 bp, Homo sapiens
cttccatctcgccac

SEQ ID NO: 2511380 - DNA, 17 bp, Homo sapiens
cttccatgtcgcctctg

SEQ ID NO: 2511381 - DNA, 19 bp, Homo sapiens
cttccatgtcgcctctgca

SEQ ID NO: 2511382 - DNA, 22 bp, Homo sapiens
cttccatgtcggcctctaaccc

SEQ ID NO: 2511383 - DNA, 13 bp, Homo sapiens
cttccatttgcaa

SEQ ID NO: 2511384 - DNA, 18 bp, Homo sapiens
cttcccaaaggactccac

SEQ ID NO: 2511385 - DNA, 18 bp, Homo sapiens
cttcccactctagggcag

SEQ ID NO: 2511386 - DNA, 19 bp, Homo sapiens
cttcccactctagggcagt

SEQ ID NO: 2511387 - DNA, 22 bp, Homo sapiens
cttcccactctagggcagtgga

SEQ ID NO: 2511388 - DNA, 18 bp, Homo sapiens
cttcccaggctggggctg

SEQ ID NO: 2511389 - DNA, 15 bp, Homo sapiens
cttcccagtggctgc

SEQ ID NO: 2511390 - DNA, 22 bp, Homo sapiens
cttcccagttcaggagtcccaa

SEQ ID NO: 2511391 - DNA, 20 bp, Homo sapiens
cttcccataccacccaatgc

SEQ ID NO: 2511392 - DNA, 19 bp, Homo sapiens
cttcccatcctaccctcgg

SEQ ID NO: 2511393 - DNA, 16 bp, Homo sapiens
cttccccaaataatat

SEQ ID NO: 2511394 - DNA, 11 bp, Homo sapiens
cttccccactg

SEQ ID NO: 2511395 - DNA, 18 bp, Homo sapiens
cttccccactgcacacac

SEQ ID NO: 2511396 - DNA, 19 bp, Homo sapiens
cttccccactgcctgccca

SEQ ID NO: 2511397 - DNA, 20 bp, Homo sapiens
cttccccactgcctgcccac

SEQ ID NO: 2511398 - DNA, 14 bp, Homo sapiens
cttccccagcgtcc

SEQ ID NO: 2511399 - DNA, 14 bp, Homo sapiens
cttccccatgggaa

SEQ ID NO: 2511400 - DNA, 16 bp, Homo sapiens
cttccccctcccaggg

SEQ ID NO: 2511401 - DNA, 16 bp, Homo sapiens
cttcccctccctggct

SEQ ID NO: 2511402 - DNA, 20 bp, Homo sapiens
cttcccctccctggctccca

SEQ ID NO: 2511403 - DNA, 13 bp, Homo sapiens
cttcccctttccc

SEQ ID NO: 2511404 - DNA, 15 bp, Homo sapiens
cttccctacctcagg

SEQ ID NO: 2511405 - DNA, 20 bp, Homo sapiens
cttccctacctcaggcagga

SEQ ID NO: 2511406 - DNA, 23 bp, Homo sapiens
cttccctagagggttcctgtaga

SEQ ID NO: 2511407 - DNA, 17 bp, Homo sapiens
cttccctatctttgcca

SEQ ID NO: 2511408 - DNA, 22 bp, Homo sapiens
cttccctatctttgccaccctc

SEQ ID NO: 2511409 - DNA, 23 bp, Homo sapiens
cttccctatctttgccaccctca

SEQ ID NO: 2511410 - DNA, 22 bp, Homo sapiens
ctgggaggggttttcgaagctc

SEQ ID NO: 2511411 - DNA, 18 bp, Homo sapiens
ctgggaggtcaaggctgc

SEQ ID NO: 2511412 - DNA, 21 bp, Homo sapiens
ctgggaggtcaaggctgcagt

SEQ ID NO: 2511413 - DNA, 13 bp, Homo sapiens
ctgggagtgagct

SEQ ID NO: 2511414 - DNA, 20 bp, Homo sapiens
ctgggatccctcatcctcat

SEQ ID NO: 2511415 - DNA, 13 bp, Homo sapiens
ctgggatcctaag

SEQ ID NO: 2511416 - DNA, 16 bp, Homo sapiens
ctgggatgggcctgct

SEQ ID NO: 2511417 - DNA, 22 bp, Homo sapiens
ctgggatgggcctgcttcctgt

SEQ ID NO: 2511418 - DNA, 20 bp, Homo sapiens
ctgggattacaggtgtgaac

SEQ ID NO: 2511419 - DNA, 20 bp, Homo sapiens
ctgggattcccaccaaggtc

SEQ ID NO: 2511420 - DNA, 14 bp, Homo sapiens
ctgggattcctccc

SEQ ID NO: 2511421 - DNA, 17 bp, Homo sapiens
ctgggattctactttaa

SEQ ID NO: 2511422 - DNA, 21 bp, Homo sapiens
ctgggattctactttaagcac

SEQ ID NO: 2511423 - DNA, 22 bp, Homo sapiens
ctgggattctactttaagcact

SEQ ID NO: 2511424 - DNA, 15 bp, Homo sapiens
ctgcctccaccctct

SEQ ID NO: 2511425 - DNA, 22 bp, Homo sapiens
ctgcctccagaatggtctttct

SEQ ID NO: 2511426 - DNA, 18 bp, Homo sapiens
ctgcctccattctgacca

SEQ ID NO: 2511427 - DNA, 11 bp, Homo sapiens
ctgcctcccat

SEQ ID NO: 2511428 - DNA, 12 bp, Homo sapiens
ctgcctcccatc

SEQ ID NO: 2511429 - DNA, 14 bp, Homo sapiens
ctgcctcccatcac

SEQ ID NO: 2511430 - DNA, 19 bp, Homo sapiens
ctgcctcccatcacccgct

SEQ ID NO: 2511431 - DNA, 16 bp, Homo sapiens
ctgcctccccaaccct

SEQ ID NO: 2511432 - DNA, 17 bp, Homo sapiens
ctgcctcccctgtgcag

SEQ ID NO: 2511433 - DNA, 14 bp, Homo sapiens
ctgcctccctcacc

SEQ ID NO: 2511434 - DNA, 18 bp, Homo sapiens
ctgcctccctcaccctga

SEQ ID NO: 2511435 - DNA, 19 bp, Homo sapiens
ctgcctcccttcatgcatg

SEQ ID NO: 2511436 - DNA, 23 bp, Homo sapiens
ctgcctcccttcatgcatggaaa

SEQ ID NO: 2511437 - DNA, 23 bp, Homo sapiens
ctgcctccgcgtgatcaaagcca

SEQ ID NO: 2511438 - DNA, 15 bp, Homo sapiens
ctgcctcctcttcaa

SEQ ID NO: 2511439 - DNA, 12 bp, Homo sapiens
ctgcctcctgcc

SEQ ID NO: 2511440 - DNA, 15 bp, Homo sapiens
ctgcctcctgcctgc

SEQ ID NO: 2511441 - DNA, 14 bp, Homo sapiens
ctgcctcgaactgg

SEQ ID NO: 2511442 - DNA, 15 bp, Homo sapiens
ctgcctcgaactggc

SEQ ID NO: 2511443 - DNA, 20 bp, Homo sapiens
ctgcctcgaactggctgcaa

SEQ ID NO: 2511444 - DNA, 18 bp, Homo sapiens
ctgcctctccctggccct

SEQ ID NO: 2511445 - DNA, 18 bp, Homo sapiens
ctgcctctcggtggccag

SEQ ID NO: 2511446 - DNA, 17 bp, Homo sapiens
ctgcctctgacacacag

SEQ ID NO: 2511447 - DNA, 18 bp, Homo sapiens
ctgcctctgacacacagc

SEQ ID NO: 2511448 - DNA, 12 bp, Homo sapiens
ctgcctcttcct

SEQ ID NO: 2511449 - DNA, 17 bp, Homo sapiens
ctgcctcttctgggagg

SEQ ID NO: 2511450 - DNA, 17 bp, Homo sapiens
ctgcctgaaccttccat

SEQ ID NO: 2511451 - DNA, 16 bp, Homo sapiens
ctgcctgaagtcacac

SEQ ID NO: 2511452 - DNA, 15 bp, Homo sapiens
ctgcctgagggcccc

SEQ ID NO: 2511453 - DNA, 17 bp, Homo sapiens
ctgcctgagggcccctc

SEQ ID NO: 2511454 - DNA, 21 bp, Homo sapiens
ctgcctgagggcccctctgcc

SEQ ID NO: 2511455 - DNA, 23 bp, Homo sapiens
ctgcctgagggcccctctgccca

SEQ ID NO: 2511456 - DNA, 14 bp, Homo sapiens
ctgcctgcccaccc

SEQ ID NO: 2511457 - DNA, 14 bp, Homo sapiens
ctgcctgcccaggc

SEQ ID NO: 2511458 - DNA, 12 bp, Homo sapiens
ctgcctgcctgt

SEQ ID NO: 2511459 - DNA, 16 bp, Homo sapiens
ctgcctgcctgtctgt

SEQ ID NO: 2511460 - DNA, 23 bp, Homo sapiens
ctgcctgcttttcactgctgcaa

SEQ ID NO: 2511461 - DNA, 18 bp, Homo sapiens
ctgcctggccccctgtcc

SEQ ID NO: 2511462 - DNA, 12 bp, Homo sapiens
ctgcctgggctg

SEQ ID NO: 2511463 - DNA, 15 bp, Homo sapiens
ctgcctgggctgttg

SEQ ID NO: 2511464 - DNA, 16 bp, Homo sapiens
ctgcctgggctgttgg

SEQ ID NO: 2511465 - DNA, 19 bp, Homo sapiens
ctgcctgggctgttggcac

SEQ ID NO: 2511466 - DNA, 20 bp, Homo sapiens
ctgcctgggctgttggcact

SEQ ID NO: 2511467 - DNA, 24 bp, Homo sapiens
ctgcctgggctgttggcactcaca

SEQ ID NO: 2511468 - DNA, 19 bp, Homo sapiens
ctgcctggggcgggcccct

SEQ ID NO: 2511469 - DNA, 20 bp, Homo sapiens
ctgcctggtatatccaaaag

SEQ ID NO: 2511470 - DNA, 13 bp, Homo sapiens
ctgcctgtagtta

SEQ ID NO: 2511471 - DNA, 16 bp, Homo sapiens
ctgcctgtccctctca

SEQ ID NO: 2511472 - DNA, 13 bp, Homo sapiens
ctgcctgtctcct

SEQ ID NO: 2511473 - DNA, 17 bp, Homo sapiens
ctgcctgttataactct

SEQ ID NO: 2511474 - DNA, 14 bp, Homo sapiens
ctgcctgttcagct

SEQ ID NO: 2511475 - DNA, 23 bp, Homo sapiens
ctgcctgttcagctccagctcac

SEQ ID NO: 2511476 - DNA, 20 bp, Homo sapiens
ctgccttaaagtcagtaact

SEQ ID NO: 2511477 - DNA, 16 bp, Homo sapiens
ctgccttagtctcagt

SEQ ID NO: 2511478 - DNA, 20 bp, Homo sapiens
ctgccttagtctcagtttgt

SEQ ID NO: 2511479 - DNA, 16 bp, Homo sapiens
ctgccttcctcctggg

SEQ ID NO: 2511480 - DNA, 15 bp, Homo sapiens
ctgccttccttgcta

SEQ ID NO: 2511481 - DNA, 12 bp, Homo sapiens
ctgccttctgtc

SEQ ID NO: 2511482 - DNA, 17 bp, Homo sapiens
ctgccttctgtcctggt

SEQ ID NO: 2511483 - DNA, 16 bp, Homo sapiens
ctgccttgaagccact

SEQ ID NO: 2511484 - DNA, 20 bp, Homo sapiens
ctgccttgaagccactgaag

SEQ ID NO: 2511485 - DNA, 18 bp, Homo sapiens
ctgcctttggcagagttc

SEQ ID NO: 2511486 - DNA, 19 bp, Homo sapiens
ctgcgatcttcagagcagg

SEQ ID NO: 2511487 - DNA, 20 bp, Homo sapiens
ctgcgatcttcagagcaggg

SEQ ID NO: 2511488 - DNA, 15 bp, Homo sapiens
ctgcgcccaccccgc

SEQ ID NO: 2511489 - DNA, 18 bp, Homo sapiens
ctgcgcccagtccttcca

SEQ ID NO: 2511490 - DNA, 23 bp, Homo sapiens
ctgcgcccagtccttccacctcg

SEQ ID NO: 2511491 - DNA, 19 bp, Homo sapiens
ctgcgccgccgccggagtc

SEQ ID NO: 2511492 - DNA, 20 bp, Homo sapiens
ctgcggaatgaaccacatct

SEQ ID NO: 2511493 - DNA, 21 bp, Homo sapiens
ctgcggagtgaagaggggcag

SEQ ID NO: 2511494 - DNA, 23 bp, Homo sapiens
ctgcggagtgaagaggggcagcc

SEQ ID NO: 2511495 - DNA, 18 bp, Homo sapiens
ctgcgggatggtcctggg

SEQ ID NO: 2511496 - DNA, 17 bp, Homo sapiens
ctgcggtccacccagga

SEQ ID NO: 2511497 - DNA, 19 bp, Homo sapiens
ctgcggtccacccaggagc

SEQ ID NO: 2511498 - DNA, 23 bp, Homo sapiens
ctgcggtccacccaggagccccg

SEQ ID NO: 2511499 - DNA, 20 bp, Homo sapiens
ctgcggtgctatctccccca

SEQ ID NO: 2511500 - DNA, 22 bp, Homo sapiens
ctgcggtgctatctcccccagc

SEQ ID NO: 2511501 - DNA, 23 bp, Homo sapiens
ctgcggtgctatctcccccagcc

SEQ ID NO: 2511502 - DNA, 22 bp, Homo sapiens
ctgcggtttgttggatcttcaa

SEQ ID NO: 2511503 - DNA, 23 bp, Homo sapiens
ctgctaaataaaatttgttgcat

SEQ ID NO: 2511504 - DNA, 23 bp, Homo sapiens
ctgctaacttggagccccagtgc

SEQ ID NO: 2511505 - DNA, 16 bp, Homo sapiens
ctgctaataaaaccca

SEQ ID NO: 2511506 - DNA, 12 bp, Homo sapiens
ctgctacctcac

SEQ ID NO: 2511507 - DNA, 14 bp, Homo sapiens
ctgctacctcactg

SEQ ID NO: 2511508 - DNA, 18 bp, Homo sapiens
ctgctacctcactggggt

SEQ ID NO: 2511509 - DNA, 21 bp, Homo sapiens
ctgctacgttcctattgtcat

SEQ ID NO: 2511510 - DNA, 18 bp, Homo sapiens
ctgctactctgttccttc

SEQ ID NO: 2511511 - DNA, 21 bp, Homo sapiens
ctgctagcacttggagccaag

SEQ ID NO: 2511512 - DNA, 20 bp, Homo sapiens
ctgctaggcgagtgccagga

SEQ ID NO: 2511513 - DNA, 15 bp, Homo sapiens
ctgctaggtgggcca

SEQ ID NO: 2511514 - DNA, 20 bp, Homo sapiens
ctgctaggtgggccagcccc

SEQ ID NO: 2511515 - DNA, 16 bp, Homo sapiens
ctgctatcctgccaaa

SEQ ID NO: 2511516 - DNA, 23 bp, Homo sapiens
ctgctcagggaaaagcagctctc

SEQ ID NO: 2511517 - DNA, 19 bp, Homo sapiens
ctgctcagtaaagcacttg

SEQ ID NO: 2511518 - DNA, 17 bp, Homo sapiens
ctgctcatcattctctg

SEQ ID NO: 2511519 - DNA, 22 bp, Homo sapiens
ctgctcatcattctctgtctca

SEQ ID NO: 2511520 - DNA, 13 bp, Homo sapiens
ctgctccaccctt

SEQ ID NO: 2511521 - DNA, 15 bp, Homo sapiens
ctgctccacccttgg

SEQ ID NO: 2511522 - DNA, 16 bp, Homo sapiens
ctgctccacccttggc

SEQ ID NO: 2511523 - DNA, 18 bp, Homo sapiens
ctgctccacccttggcct

SEQ ID NO: 2511524 - DNA, 19 bp, Homo sapiens
ctgctccacccttggcctg

SEQ ID NO: 2511525 - DNA, 14 bp, Homo sapiens
ctgctccagctgtt

SEQ ID NO: 2511526 - DNA, 20 bp, Homo sapiens
ctgctccagctgttcagctg

SEQ ID NO: 2511527 - DNA, 14 bp, Homo sapiens
ctgctcccagcagc

SEQ ID NO: 2511528 - DNA, 20 bp, Homo sapiens
ctgctccccagcagcggaac

SEQ ID NO: 2511529 - DNA, 18 bp, Homo sapiens
ctgctccccagccctggc

SEQ ID NO: 2511530 - DNA, 13 bp, Homo sapiens
ctgctcctcatgg

SEQ ID NO: 2511531 - DNA, 14 bp, Homo sapiens
ctgctcctcatggt

SEQ ID NO: 2511532 - DNA, 12 bp, Homo sapiens
ctgctcctccct

SEQ ID NO: 2511533 - DNA, 13 bp, Homo sapiens
ctgctcctccctg

SEQ ID NO: 2511534 - DNA, 18 bp, Homo sapiens
ctgctcctccctggctgc

SEQ ID NO: 2511535 - DNA, 21 bp, Homo sapiens
ctgctcctccctggctgccct

SEQ ID NO: 2511536 - DNA, 22 bp, Homo sapiens
ctgctcctccctggctgccctg

SEQ ID NO: 2511537 - DNA, 16 bp, Homo sapiens
ctgctcctctccccag

SEQ ID NO: 2511538 - DNA, 23 bp, Homo sapiens
ctgctcctctccccagcaagtga

SEQ ID NO: 2511539 - DNA, 18 bp, Homo sapiens
ctgctccttccttcacct

SEQ ID NO: 2511540 - DNA, 15 bp, Homo sapiens
ctgctctccgaccag

SEQ ID NO: 2511541 - DNA, 14 bp, Homo sapiens
ctgctctcctcttg

SEQ ID NO: 2511542 - DNA, 20 bp, Homo sapiens
ctgctctgaggcttccagag

SEQ ID NO: 2511543 - DNA, 21 bp, Homo sapiens
ctgctctgaggcttccagaga

SEQ ID NO: 2511544 - DNA, 22 bp, Homo sapiens
ctgctctgaggcttccagagag

SEQ ID NO: 2511545 - DNA, 19 bp, Homo sapiens
ctgctctggaatttgcaag

SEQ ID NO: 2511546 - DNA, 18 bp, Homo sapiens
ctgctgaaacaacaaata

SEQ ID NO: 2511547 - DNA, 16 bp, Homo sapiens
ctgctgaagctgcctg

SEQ ID NO: 2511548 - DNA, 20 bp, Homo sapiens
ctgctgaagctgcctgcttt

SEQ ID NO: 2511549 - DNA, 17 bp, Homo sapiens
ctgctgaaggaataaat

SEQ ID NO: 2511550 - DNA, 18 bp, Homo sapiens
ctgctgaaggaataaatt

SEQ ID NO: 2511551 - DNA, 11 bp, Homo sapiens
ctgctgaaggc

SEQ ID NO: 2511552 - DNA, 15 bp, Homo sapiens
ctgctgaaggctcga

SEQ ID NO: 2511553 - DNA, 16 bp, Homo sapiens
ctgctgaataataaac

SEQ ID NO: 2511554 - DNA, 18 bp, Homo sapiens
ctgctgacagacacaggc

SEQ ID NO: 2511555 - DNA, 19 bp, Homo sapiens
ctgctgacctccacagctt

SEQ ID NO: 2511556 - DNA, 17 bp, Homo sapiens
ctgctgagggaccagcc

SEQ ID NO: 2511557 - DNA, 13 bp, Homo sapiens
ctgctgcaaggcc

SEQ ID NO: 2511558 - DNA, 15 bp, Homo sapiens
ctgctgcagttgcca

SEQ ID NO: 2511559 - DNA, 17 bp, Homo sapiens
ctgctgccctccatccc

SEQ ID NO: 2511560 - DNA, 20 bp, Homo sapiens
ctgctgccgccccacccaga

SEQ ID NO: 2511561 - DNA, 21 bp, Homo sapiens
ctgctgccgcctcccagcctg

SEQ ID NO: 2511562 - DNA, 19 bp, Homo sapiens
ctgctgcctccccaaccct

SEQ ID NO: 2511563 - DNA, 20 bp, Homo sapiens
ctgctgcgcccttaccttcc

SEQ ID NO: 2511564 - DNA, 16 bp, Homo sapiens
ctgctgctgcgccctt

SEQ ID NO: 2511565 - DNA, 20 bp, Homo sapiens
ctgctgctgcgcccttacct

SEQ ID NO: 2511566 - DNA, 15 bp, Homo sapiens
ctgctgctggatcac

SEQ ID NO: 2511567 - DNA, 15 bp, Homo sapiens
ctgctgctggctggt

SEQ ID NO: 2511568 - DNA, 22 bp, Homo sapiens
ctgctgctttttgaggtggcac

SEQ ID NO: 2511569 - DNA, 23 bp, Homo sapiens
ctgctggatcacagctgctttct

SEQ ID NO: 2511570 - DNA, 16 bp, Homo sapiens
ctgctggcccctcacc

SEQ ID NO: 2511571 - DNA, 17 bp, Homo sapiens
ctgctggcccctcacct

SEQ ID NO: 2511572 - DNA, 23 bp, Homo sapiens
ctgctggcccctcacctgggcac

SEQ ID NO: 2511573 - DNA, 20 bp, Homo sapiens
ctgctggccgcctcaccccc

SEQ ID NO: 2511574 - DNA, 15 bp, Homo sapiens
ctctgaaggacattg

SEQ ID NO: 2511575 - DNA, 13 bp, Homo sapiens
ctctgaagggagg

SEQ ID NO: 2511576 - DNA, 22 bp, Homo sapiens
ctctgaagggcatcatgcatct

SEQ ID NO: 2511577 - DNA, 23 bp, Homo sapiens
ctctgaagtgaaactgcttgttt

SEQ ID NO: 2511578 - DNA, 18 bp, Homo sapiens
ctctgaatggtccagggt

SEQ ID NO: 2511579 - DNA, 21 bp, Homo sapiens
ctctgaattagtccttgcttg

SEQ ID NO: 2511580 - DNA, 15 bp, Homo sapiens
ctctgacacacagct

SEQ ID NO: 2511581 - DNA, 17 bp, Homo sapiens
ctctgacacacagctct

SEQ ID NO: 2511582 - DNA, 18 bp, Homo sapiens
ctctgacacacagctctg

SEQ ID NO: 2511583 - DNA, 22 bp, Homo sapiens
ctctgaccgaaacagcgctggg

SEQ ID NO: 2511584 - DNA, 23 bp, Homo sapiens
ctctgacctactcgagggactta

SEQ ID NO: 2511585 - DNA, 15 bp, Homo sapiens
ctctgacctgcactg

SEQ ID NO: 2511586 - DNA, 15 bp, Homo sapiens
ctctgactcagggct

SEQ ID NO: 2511587 - DNA, 17 bp, Homo sapiens
ctctgactcagggctcc

SEQ ID NO: 2511588 - DNA, 15 bp, Homo sapiens
ctctgactctcaaat

SEQ ID NO: 2511589 - DNA, 18 bp, Homo sapiens
ctctgactggcacagtct

SEQ ID NO: 2511590 - DNA, 13 bp, Homo sapiens
ctctgaggctgta

SEQ ID NO: 2511591 - DNA, 18 bp, Homo sapiens
ctctgaggcttccagaga

SEQ ID NO: 2511592 - DNA, 19 bp, Homo sapiens
ctctgagggaaagcccaga

SEQ ID NO: 2511593 - DNA, 12 bp, Homo sapiens
ctctgagggctt

SEQ ID NO: 2511594 - DNA, 18 bp, Homo sapiens
ctctgagggcttcctttg

SEQ ID NO: 2511595 - DNA, 17 bp, Homo sapiens
ctctgagtatctcctcg

SEQ ID NO: 2511596 - DNA, 12 bp, Homo sapiens
ctctgagtgtga

SEQ ID NO: 2511597 - DNA, 22 bp, Homo sapiens
ctctgatccctctacagagctt

SEQ ID NO: 2511598 - DNA, 18 bp, Homo sapiens
ctctgattttcaaagctt

SEQ ID NO: 2511599 - DNA, 20 bp, Homo sapiens
ctctgattttcaaagctttt

SEQ ID NO: 2511600 - DNA, 18 bp, Homo sapiens
ctctgcaatgggcactgg

SEQ ID NO: 2511601 - DNA, 16 bp, Homo sapiens
ctctgcaattcccctc

SEQ ID NO: 2511602 - DNA, 17 bp, Homo sapiens
ctctgcaattcccctct

SEQ ID NO: 2511603 - DNA, 20 bp, Homo sapiens
ctctgcaattcccctctgct

SEQ ID NO: 2511604 - DNA, 22 bp, Homo sapiens
ctctgcaattcccctctgctgc

SEQ ID NO: 2511605 - DNA, 10 bp, Homo sapiens
ctctgcacaa

SEQ ID NO: 2511606 - DNA, 15 bp, Homo sapiens
ctctgcacaagctgc

SEQ ID NO: 2511607 - DNA, 18 bp, Homo sapiens
ctctgcacaagctgcacc

SEQ ID NO: 2511608 - DNA, 21 bp, Homo sapiens
ctctgcacaagctgcaccctc

SEQ ID NO: 2511609 - DNA, 14 bp, Homo sapiens
ctctgcacatgtct

SEQ ID NO: 2511610 - DNA, 16 bp, Homo sapiens
ctctgcacatgtcttg

SEQ ID NO: 2511611 - DNA, 15 bp, Homo sapiens
ctctgcactcccctg

SEQ ID NO: 2511612 - DNA, 14 bp, Homo sapiens
ctctgcagcccagg

SEQ ID NO: 2511613 - DNA, 12 bp, Homo sapiens
ctctgcagctga

SEQ ID NO: 2511614 - DNA, 16 bp, Homo sapiens
ctctgcatgcggccca

SEQ ID NO: 2511615 - DNA, 21 bp, Homo sapiens
ctctgcatgcggcccagcccg

SEQ ID NO: 2511616 - DNA, 15 bp, Homo sapiens
ctctgcattctagta

SEQ ID NO: 2511617 - DNA, 17 bp, Homo sapiens
ctctgccaccctacctg

SEQ ID NO: 2511618 - DNA, 20 bp, Homo sapiens
ctctgccaccctacctgttc

SEQ ID NO: 2511619 - DNA, 22 bp, Homo sapiens
ctctgccagaagatcccctcag

SEQ ID NO: 2511620 - DNA, 23 bp, Homo sapiens
ctctgccagaagatcccctcagg

SEQ ID NO: 2511621 - DNA, 18 bp, Homo sapiens
ctctgcccactccctgca

SEQ ID NO: 2511622 - DNA, 17 bp, Homo sapiens
ctctgcccagcttgggc

SEQ ID NO: 2511623 - DNA, 14 bp, Homo sapiens
ctctgccccagagg

SEQ ID NO: 2511624 - DNA, 18 bp, Homo sapiens
ctctgccccagaggcctc

SEQ ID NO: 2511625 - DNA, 20 bp, Homo sapiens
ctctgccccagaggcctctc

SEQ ID NO: 2511626 - DNA, 13 bp, Homo sapiens
ctctgccccagct

SEQ ID NO: 2511627 - DNA, 12 bp, Homo sapiens
ctctgccccctg

SEQ ID NO: 2511628 - DNA, 17 bp, Homo sapiens
ctctgccccctgctggc

SEQ ID NO: 2511629 - DNA, 14 bp, Homo sapiens
ctctgccctccaag

SEQ ID NO: 2511630 - DNA, 23 bp, Homo sapiens
ctctgccctccaagaccttctcc

SEQ ID NO: 2511631 - DNA, 15 bp, Homo sapiens
ctctgccctgcccta

SEQ ID NO: 2511632 - DNA, 13 bp, Homo sapiens
ctctgccggctct

SEQ ID NO: 2511633 - DNA, 14 bp, Homo sapiens
ctctgccggctctt

SEQ ID NO: 2511634 - DNA, 18 bp, Homo sapiens
ctctgccggctctttcct

SEQ ID NO: 2511635 - DNA, 23 bp, Homo sapiens
ctctgccggctctttccttgctc

SEQ ID NO: 2511636 - DNA, 16 bp, Homo sapiens
ctctgcctcccatcac

SEQ ID NO: 2511637 - DNA, 17 bp, Homo sapiens
ctctgcctcccatcacc

SEQ ID NO: 2511638 - DNA, 15 bp, Homo sapiens
ctctgcctcctcttc

SEQ ID NO: 2511639 - DNA, 20 bp, Homo sapiens
ctctgcctctgacacacagc

SEQ ID NO: 2511640 - DNA, 10 bp, Homo sapiens
ctctgcctga

SEQ ID NO: 2511641 - DNA, 18 bp, Homo sapiens
ctctgcctgaaccttcca

SEQ ID NO: 2511642 - DNA, 21 bp, Homo sapiens
ctctgcctgaagtcacacagt

SEQ ID NO: 2511643 - DNA, 19 bp, Homo sapiens
ctctgcctgtccctctcag

SEQ ID NO: 2511644 - DNA, 21 bp, Homo sapiens
ctctgcctgtccctctcaggc

SEQ ID NO: 2511645 - DNA, 13 bp, Homo sapiens
ctctgctccacca

SEQ ID NO: 2511646 - DNA, 19 bp, Homo sapiens
ctctgctccaccacatcct

SEQ ID NO: 2511647 - DNA, 22 bp, Homo sapiens
ctctgctcctggagcctttgaa

SEQ ID NO: 2511648 - DNA, 13 bp, Homo sapiens
ctctgctctgcgt

SEQ ID NO: 2511649 - DNA, 14 bp, Homo sapiens
ctctgctgaaggtt

SEQ ID NO: 2511650 - DNA, 13 bp, Homo sapiens
ctctgctgacaga

SEQ ID NO: 2511651 - DNA, 14 bp, Homo sapiens
ctctgctgacagac

SEQ ID NO: 2511652 - DNA, 18 bp, Homo sapiens
ctctgctgacagacacag

SEQ ID NO: 2511653 - DNA, 22 bp, Homo sapiens
ctctgctgacagacacaggccc

SEQ ID NO: 2511654 - DNA, 22 bp, Homo sapiens
ctctgctgctgtccctccccct

SEQ ID NO: 2511655 - DNA, 14 bp, Homo sapiens
ctctgctggcctgg

SEQ ID NO: 2511656 - DNA, 22 bp, Homo sapiens
ctctggaccaaccctgtttcct

SEQ ID NO: 2511657 - DNA, 16 bp, Homo sapiens
ctctggactggctaga

SEQ ID NO: 2511658 - DNA, 19 bp, Homo sapiens
ctctggactggctagagtc

SEQ ID NO: 2511659 - DNA, 19 bp, Homo sapiens
ctctggagccaagtccaga

SEQ ID NO: 2511660 - DNA, 21 bp, Homo sapiens
ctctggaggggtgtggctcct

SEQ ID NO: 2511661 - DNA, 13 bp, Homo sapiens
ctctggatggcac

SEQ ID NO: 2511662 - DNA, 22 bp, Homo sapiens
ctctggattggagatagggaaa

SEQ ID NO: 2511663 - DNA, 19 bp, Homo sapiens
ctctggcagctcagagagg

SEQ ID NO: 2511664 - DNA, 18 bp, Homo sapiens
ctctggcattagaattat

SEQ ID NO: 2511665 - DNA, 23 bp, Homo sapiens
ctctggcattagaattatttaaa

SEQ ID NO: 2511666 - DNA, 19 bp, Homo sapiens
ctctggccaggatggaggg

SEQ ID NO: 2511667 - DNA, 16 bp, Homo sapiens
ctctggccttttccta

SEQ ID NO: 2511668 - DNA, 16 bp, Homo sapiens
ctctggcgacagtttt

SEQ ID NO: 2511669 - DNA, 14 bp, Homo sapiens
ctctggcgtgtggg

SEQ ID NO: 2511670 - DNA, 14 bp, Homo sapiens
ctctggctagaggc

SEQ ID NO: 2511671 - DNA, 16 bp, Homo sapiens
ctctggctagaggcca

SEQ ID NO: 2511672 - DNA, 21 bp, Homo sapiens
ctctggctagaggccagcccc

SEQ ID NO: 2511673 - DNA, 15 bp, Homo sapiens
ctctggctgaaccct

SEQ ID NO: 2511674 - DNA, 21 bp, Homo sapiens
ctctggctggtttggaatgct

SEQ ID NO: 2511675 - DNA, 16 bp, Homo sapiens
ctcgccgtctgtgaat

SEQ ID NO: 2511676 - DNA, 18 bp, Homo sapiens
ctcgctgcacaaatactc

SEQ ID NO: 2511677 - DNA, 16 bp, Homo sapiens
ctcgctgccagctctg

SEQ ID NO: 2511678 - DNA, 20 bp, Homo sapiens
ctcggaaggctggctgggca

SEQ ID NO: 2511679 - DNA, 18 bp, Homo sapiens
ctcggactaagcctacct

SEQ ID NO: 2511680 - DNA, 22 bp, Homo sapiens
ctcggactaagcctacctgctc

SEQ ID NO: 2511681 - DNA, 13 bp, Homo sapiens
ctcggaggctgcc

SEQ ID NO: 2511682 - DNA, 16 bp, Homo sapiens
ctcggaggctgccccc

SEQ ID NO: 2511683 - DNA, 20 bp, Homo sapiens
ctcgggacacctgccctgcc

SEQ ID NO: 2511684 - DNA, 21 bp, Homo sapiens
ctcgggaggctgagacaggag

SEQ ID NO: 2511685 - DNA, 12 bp, Homo sapiens
ctcgggcccagc

SEQ ID NO: 2511686 - DNA, 18 bp, Homo sapiens
ctcgggcccagcccccac

SEQ ID NO: 2511687 - DNA, 21 bp, Homo sapiens
ctcgggcgagtcactgcctct

SEQ ID NO: 2511688 - DNA, 22 bp, Homo sapiens
ctcgggcgagtcactgcctctc

SEQ ID NO: 2511689 - DNA, 22 bp, Homo sapiens
ctcgtcatcatttttccttccc

SEQ ID NO: 2511690 - DNA, 20 bp, Homo sapiens
ctcgtcggggggacagctcc

SEQ ID NO: 2511691 - DNA, 18 bp, Homo sapiens
ctcgtgattggcatataa

SEQ ID NO: 2511692 - DNA, 19 bp, Homo sapiens
ctcgtggccagcccggctg

SEQ ID NO: 2511693 - DNA, 14 bp, Homo sapiens
ctcgtggccttccc

SEQ ID NO: 2511694 - DNA, 14 bp, Homo sapiens
ctcgtgtatcctgg

SEQ ID NO: 2511695 - DNA, 23 bp, Homo sapiens
ctcgttgactggctgtgtgttgg

SEQ ID NO: 2511696 - DNA, 16 bp, Homo sapiens
ctctaaaaggttcagg

SEQ ID NO: 2511697 - DNA, 17 bp, Homo sapiens
ctctaaaaggttcaggg

SEQ ID NO: 2511698 - DNA, 18 bp, Homo sapiens
ctctaaaaggttcaggga

SEQ ID NO: 2511699 - DNA, 17 bp, Homo sapiens
ctctaaaatagccactt

SEQ ID NO: 2511700 - DNA, 18 bp, Homo sapiens
ctctaaagcaataatggt

SEQ ID NO: 2511701 - DNA, 23 bp, Homo sapiens
ctctaaagcaataatggtcccat

SEQ ID NO: 2511702 - DNA, 22 bp, Homo sapiens
ctctaaatgaggggcctcaggt

SEQ ID NO: 2511703 - DNA, 15 bp, Homo sapiens
ctctaaccccaggcc

SEQ ID NO: 2511704 - DNA, 17 bp, Homo sapiens
ctctaaccccaggcccc

SEQ ID NO: 2511705 - DNA, 17 bp, Homo sapiens
ctctaattggaagaaat

SEQ ID NO: 2511706 - DNA, 13 bp, Homo sapiens
ctctacaaaaagc

SEQ ID NO: 2511707 - DNA, 16 bp, Homo sapiens
ctctacaaactcccac

SEQ ID NO: 2511708 - DNA, 17 bp, Homo sapiens
ctctacaaactcccact

SEQ ID NO: 2511709 - DNA, 17 bp, Homo sapiens
ctctacaactgagtcct

SEQ ID NO: 2511710 - DNA, 22 bp, Homo sapiens
ctctacagagcttccctgactc

SEQ ID NO: 2511711 - DNA, 19 bp, Homo sapiens
ctctacagaggccatgggc

SEQ ID NO: 2511712 - DNA, 15 bp, Homo sapiens
ctctacatcttctgc

SEQ ID NO: 2511713 - DNA, 18 bp, Homo sapiens
ctctacatcttctgcctt

SEQ ID NO: 2511714 - DNA, 18 bp, Homo sapiens
ctctaccagactgtgtat

SEQ ID NO: 2511715 - DNA, 14 bp, Homo sapiens
ctctaccctcccac

SEQ ID NO: 2511716 - DNA, 15 bp, Homo sapiens
ctctaccctcccacc

SEQ ID NO: 2511717 - DNA, 16 bp, Homo sapiens
ctctaccctcccaccc

SEQ ID NO: 2511718 - DNA, 12 bp, Homo sapiens
ctctacctgaca

SEQ ID NO: 2511719 - DNA, 22 bp, Homo sapiens
ctctacctgacactcccttggg

SEQ ID NO: 2511720 - DNA, 15 bp, Homo sapiens
ctctacttaatgaga

SEQ ID NO: 2511721 - DNA, 21 bp, Homo sapiens
ctctagacactgccacacagg

SEQ ID NO: 2511722 - DNA, 14 bp, Homo sapiens
ctctagcctgggca

SEQ ID NO: 2511723 - DNA, 17 bp, Homo sapiens
ctctagctggtggtttc

SEQ ID NO: 2511724 - DNA, 14 bp, Homo sapiens
ctctaggctgggga

SEQ ID NO: 2511725 - DNA, 18 bp, Homo sapiens
ctctagggacccctcctc

SEQ ID NO: 2511726 - DNA, 22 bp, Homo sapiens
ctctagggagggacatggcccc

SEQ ID NO: 2511727 - DNA, 13 bp, Homo sapiens
ctctaggtggggc

SEQ ID NO: 2511728 - DNA, 14 bp, Homo sapiens
ctctagtgccctcc

SEQ ID NO: 2511729 - DNA, 21 bp, Homo sapiens
ctctagtgccctccacagccg

SEQ ID NO: 2511730 - DNA, 13 bp, Homo sapiens
ctctagtgctgtg

SEQ ID NO: 2511731 - DNA, 15 bp, Homo sapiens
ctctagtgctgtgaa

SEQ ID NO: 2511732 - DNA, 16 bp, Homo sapiens
ctctagtgctgtgaaa

SEQ ID NO: 2511733 - DNA, 19 bp, Homo sapiens
ctctagtgctgtgaaaaaa

SEQ ID NO: 2511734 - DNA, 15 bp, Homo sapiens
ctctagtttgattaa

SEQ ID NO: 2511735 - DNA, 18 bp, Homo sapiens
ctctatcttgctctgtaa

SEQ ID NO: 2511736 - DNA, 20 bp, Homo sapiens
ctctatgaactctgttttct

SEQ ID NO: 2511737 - DNA, 22 bp, Homo sapiens
ctctatgggcagatctacccct

SEQ ID NO: 2511738 - DNA, 20 bp, Homo sapiens
ctctattaagatttccaagt

SEQ ID NO: 2511739 - DNA, 15 bp, Homo sapiens
ctctatttaatattt

SEQ ID NO: 2511740 - DNA, 17 bp, Homo sapiens
ctctatttaatatttat

SEQ ID NO: 2511741 - DNA, 13 bp, Homo sapiens
ctctatttagcat

SEQ ID NO: 2511742 - DNA, 20 bp, Homo sapiens
ctctcaaccacctttcagat

SEQ ID NO: 2511743 - DNA, 16 bp, Homo sapiens
ctctcacctgtactct

SEQ ID NO: 2511744 - DNA, 15 bp, Homo sapiens
ctctcactaaacttt

SEQ ID NO: 2511745 - DNA, 21 bp, Homo sapiens
ctctcactaaactttacccaa

SEQ ID NO: 2511746 - DNA, 21 bp, Homo sapiens
ctctcagagctacttgggcca

SEQ ID NO: 2511747 - DNA, 22 bp, Homo sapiens
ctctcagcccctgatcctgtga

SEQ ID NO: 2511748 - DNA, 15 bp, Homo sapiens
ctctcagctccaggt

SEQ ID NO: 2511749 - DNA, 15 bp, Homo sapiens
ctctcaggagcacag

SEQ ID NO: 2511750 - DNA, 20 bp, Homo sapiens
ctctcaggcatgcctgtgtg

SEQ ID NO: 2511751 - DNA, 13 bp, Homo sapiens
ctctcagtctctg

SEQ ID NO: 2511752 - DNA, 18 bp, Homo sapiens
ctctcagtctctgagcag

SEQ ID NO: 2511753 - DNA, 12 bp, Homo sapiens
ctctcagttttt

SEQ ID NO: 2511754 - DNA, 16 bp, Homo sapiens
ctctcatcaactgaat

SEQ ID NO: 2511755 - DNA, 17 bp, Homo sapiens
ctctcatcaactgaatg

SEQ ID NO: 2511756 - DNA, 18 bp, Homo sapiens
ctctcatcaactgaatga

SEQ ID NO: 2511757 - DNA, 15 bp, Homo sapiens
ctctccaagggcttc

SEQ ID NO: 2511758 - DNA, 17 bp, Homo sapiens
ctctccaagtctcagtg

SEQ ID NO: 2511759 - DNA, 20 bp, Homo sapiens
ctctccaagtctcagtggct

SEQ ID NO: 2511760 - DNA, 23 bp, Homo sapiens
ctctccaagtctcagtggcttca

SEQ ID NO: 2511761 - DNA, 15 bp, Homo sapiens
ctctccaagtgccag

SEQ ID NO: 2511762 - DNA, 19 bp, Homo sapiens
ctctccaagtgccagaggt

SEQ ID NO: 2511763 - DNA, 19 bp, Homo sapiens
ctctccagcccctggatgc

SEQ ID NO: 2511764 - DNA, 15 bp, Homo sapiens
ctctccagctccaag

SEQ ID NO: 2511765 - DNA, 13 bp, Homo sapiens
ctctccaggcacc

SEQ ID NO: 2511766 - DNA, 18 bp, Homo sapiens
ctctccaggcacccttct

SEQ ID NO: 2511767 - DNA, 17 bp, Homo sapiens
ctctccaggcgccggcg

SEQ ID NO: 2511768 - DNA, 12 bp, Homo sapiens
ctctcccaggac

SEQ ID NO: 2511769 - DNA, 13 bp, Homo sapiens
ctctcccaggacc

SEQ ID NO: 2511770 - DNA, 11 bp, Homo sapiens
ctctcccaggg

SEQ ID NO: 2511771 - DNA, 22 bp, Homo sapiens
ctctcccagtctacccagagaa

SEQ ID NO: 2511772 - DNA, 18 bp, Homo sapiens
ctctcccatcacttccct

SEQ ID NO: 2511773 - DNA, 14 bp, Homo sapiens
ctctcccatggagc

SEQ ID NO: 2511774 - DNA, 16 bp, Homo sapiens
ctctcccatggagccc

SEQ ID NO: 2511775 - DNA, 21 bp, Homo sapiens
ctctcccatggagccccagcc

SEQ ID NO: 2511776 - DNA, 13 bp, Homo sapiens
ctctcccatggct

SEQ ID NO: 2511777 - DNA, 14 bp, Homo sapiens
ctctccccacacta

SEQ ID NO: 2511778 - DNA, 21 bp, Homo sapiens
ctctcccccccccctccaatc

SEQ ID NO: 2511779 - DNA, 18 bp, Homo sapiens
ctctcccctcaaagtctg

SEQ ID NO: 2511780 - DNA, 21 bp, Homo sapiens
ctctcccctcaaagtctgcaa

SEQ ID NO: 2511781 - DNA, 23 bp, Homo sapiens
ctctcccggaggttgggtgggcc

SEQ ID NO: 2511782 - DNA, 16 bp, Homo sapiens
ctctcccgtcagggcc

SEQ ID NO: 2511783 - DNA, 13 bp, Homo sapiens
ctctccctcccct

SEQ ID NO: 2511784 - DNA, 17 bp, Homo sapiens
ctctccctcccctgcca

SEQ ID NO: 2511785 - DNA, 12 bp, Homo sapiens
ctctccctggcc

SEQ ID NO: 2511786 - DNA, 18 bp, Homo sapiens
ctccttccacctccctcc

SEQ ID NO: 2511787 - DNA, 13 bp, Homo sapiens
ctccttcctggag

SEQ ID NO: 2511788 - DNA, 15 bp, Homo sapiens
ctccttcctgtcttc

SEQ ID NO: 2511789 - DNA, 18 bp, Homo sapiens
ctccttccttgaccagca

SEQ ID NO: 2511790 - DNA, 20 bp, Homo sapiens
ctccttctctgtctcatgtg

SEQ ID NO: 2511791 - DNA, 18 bp, Homo sapiens
ctccttgcctcctgtgta

SEQ ID NO: 2511792 - DNA, 17 bp, Homo sapiens
ctccttgggaggcccca

SEQ ID NO: 2511793 - DNA, 12 bp, Homo sapiens
ctccttgggccc

SEQ ID NO: 2511794 - DNA, 17 bp, Homo sapiens
ctccttgggccctttga

SEQ ID NO: 2511795 - DNA, 19 bp, Homo sapiens
ctccttggtgcctggcctg

SEQ ID NO: 2511796 - DNA, 16 bp, Homo sapiens
ctccttgtaaagactg

SEQ ID NO: 2511797 - DNA, 16 bp, Homo sapiens
ctcctttagcgcccag

SEQ ID NO: 2511798 - DNA, 15 bp, Homo sapiens
ctcctttcaccacat

SEQ ID NO: 2511799 - DNA, 17 bp, Homo sapiens
ctcctttctccagccag

SEQ ID NO: 2511800 - DNA, 14 bp, Homo sapiens
ctcctttctttcta

SEQ ID NO: 2511801 - DNA, 14 bp, Homo sapiens
ctcctttgcactga

SEQ ID NO: 2511802 - DNA, 18 bp, Homo sapiens
ctcctttgcactgagggc

SEQ ID NO: 2511803 - DNA, 16 bp, Homo sapiens
ctcctttgcaggctca

SEQ ID NO: 2511804 - DNA, 18 bp, Homo sapiens
ctcctttgtgaggaagcc

SEQ ID NO: 2511805 - DNA, 14 bp, Homo sapiens
ctcctttttctccc

SEQ ID NO: 2511806 - DNA, 23 bp, Homo sapiens
ctcgaacatggaactcattcctg

SEQ ID NO: 2511807 - DNA, 13 bp, Homo sapiens
ctcgaactggctg

SEQ ID NO: 2511808 - DNA, 16 bp, Homo sapiens
ctcgaactggctgcaa

SEQ ID NO: 2511809 - DNA, 23 bp, Homo sapiens
ctcgagcagtcctgcctcagcct

SEQ ID NO: 2511810 - DNA, 19 bp, Homo sapiens
ctcgagcatgcctggatgg

SEQ ID NO: 2511811 - DNA, 17 bp, Homo sapiens
ctcgaggactgtatttg

SEQ ID NO: 2511812 - DNA, 22 bp, Homo sapiens
ctcgcatttgtcaatgacagtt

SEQ ID NO: 2511813 - DNA, 12 bp, Homo sapiens
ctcgccatgccg

SEQ ID NO: 2511814 - DNA, 14 bp, Homo sapiens
ctcgcccgcccact

SEQ ID NO: 2511815 - DNA, 15 bp, Homo sapiens
ctcgcccgcccactg

SEQ ID NO: 2511816 - DNA, 21 bp, Homo sapiens
ctcgcccgcccactgtcctgg

SEQ ID NO: 2511817 - DNA, 14 bp, Homo sapiens
ctccagaagcctct

SEQ ID NO: 2511818 - DNA, 18 bp, Homo sapiens
ctccagaagcctctggct

SEQ ID NO: 2511819 - DNA, 20 bp, Homo sapiens
ctccagaagcctctggctag

SEQ ID NO: 2511820 - DNA, 20 bp, Homo sapiens
ctccagacaaaccagaagca

SEQ ID NO: 2511821 - DNA, 16 bp, Homo sapiens
ctccagacacatgtcc

SEQ ID NO: 2511822 - DNA, 17 bp, Homo sapiens
ctccagacacatgtcca

SEQ ID NO: 2511823 - DNA, 17 bp, Homo sapiens
ctccagacccaccacac

SEQ ID NO: 2511824 - DNA, 22 bp, Homo sapiens
ctccagacccccaccccttccc

SEQ ID NO: 2511825 - DNA, 20 bp, Homo sapiens
ctccagagggcactctgctt

SEQ ID NO: 2511826 - DNA, 20 bp, Homo sapiens
ctccagagtggggatgacat

SEQ ID NO: 2511827 - DNA, 18 bp, Homo sapiens
ctccagcaccatccgcca

SEQ ID NO: 2511828 - DNA, 14 bp, Homo sapiens
ctatatccatgtac

SEQ ID NO: 2511829 - DNA, 19 bp, Homo sapiens
ctatatccatgtactgtag

SEQ ID NO: 2511830 - DNA, 16 bp, Homo sapiens
ctatatctgtatataa

SEQ ID NO: 2511831 - DNA, 20 bp, Homo sapiens
ctatatctgtatataaaata

SEQ ID NO: 2511832 - DNA, 23 bp, Homo sapiens
ctatatgaatttaaatataattc

SEQ ID NO: 2511833 - DNA, 13 bp, Homo sapiens
ctatatgatttat

SEQ ID NO: 2511834 - DNA, 16 bp, Homo sapiens
ctatatgatttatagt

SEQ ID NO: 2511835 - DNA, 18 bp, Homo sapiens
ctatatgatttatagttt

SEQ ID NO: 2511836 - DNA, 20 bp, Homo sapiens
ctatattttttgttaaatga

SEQ ID NO: 2511837 - DNA, 13 bp, Homo sapiens
ctatcaaactgaa

SEQ ID NO: 2511838 - DNA, 14 bp, Homo sapiens
ctatcacacagtgg

SEQ ID NO: 2511839 - DNA, 17 bp, Homo sapiens
ctatcacctcccctcct

SEQ ID NO: 2511840 - DNA, 15 bp, Homo sapiens
ctatcagcctgtctc

SEQ ID NO: 2511841 - DNA, 20 bp, Homo sapiens
ctatcagcctgtctcttcca

SEQ ID NO: 2511842 - DNA, 18 bp, Homo sapiens
ctatcatgtcaaacgtga

SEQ ID NO: 2511843 - DNA, 24 bp, Homo sapiens
ctcagggtccctggtggcagctca

SEQ ID NO: 2511844 - DNA, 19 bp, Homo sapiens
ctagagaatgttagaggat

SEQ ID NO: 2511845 - DNA, 17 bp, Homo sapiens
ctagagcagccctggag

SEQ ID NO: 2511846 - DNA, 13 bp, Homo sapiens
ctagagcctgcct

SEQ ID NO: 2511847 - DNA, 16 bp, Homo sapiens
ctagagcctgcctgga

SEQ ID NO: 2511848 - DNA, 18 bp, Homo sapiens
ctagagcctgcctggagc

SEQ ID NO: 2511849 - DNA, 19 bp, Homo sapiens
ctagagcctgcctggagcg

SEQ ID NO: 2511850 - DNA, 15 bp, Homo sapiens
ctagaggcagggagg

SEQ ID NO: 2511851 - DNA, 17 bp, Homo sapiens
ctagaggccagccccac

SEQ ID NO: 2511852 - DNA, 13 bp, Homo sapiens
ctagaggcctgag

SEQ ID NO: 2511853 - DNA, 15 bp, Homo sapiens
ctagaggcctgagga

SEQ ID NO: 2511854 - DNA, 18 bp, Homo sapiens
ctagaggcctgaggatga

SEQ ID NO: 2511855 - DNA, 22 bp, Homo sapiens
ctagaggcctgaggatgagctg

SEQ ID NO: 2511856 - DNA, 22 bp, Homo sapiens
ctagaggcttgcataataagct

SEQ ID NO: 2511857 - DNA, 15 bp, Homo sapiens
ctagagggacctctc

SEQ ID NO: 2511858 - DNA, 16 bp, Homo sapiens
ctagagggacctctcc

SEQ ID NO: 2511859 - DNA, 17 bp, Homo sapiens
ctagagggacctctccc

SEQ ID NO: 2511860 - DNA, 18 bp, Homo sapiens
ctagagggacctctccca

SEQ ID NO: 2511861 - DNA, 19 bp, Homo sapiens
ctagagggacctctcccag

SEQ ID NO: 2511862 - DNA, 22 bp, Homo sapiens
ctagaggggggatttccagcca

SEQ ID NO: 2511863 - DNA, 15 bp, Homo sapiens
ctagagggttcctgt

SEQ ID NO: 2511864 - DNA, 16 bp, Homo sapiens
ctagagggttcctgta

SEQ ID NO: 2511865 - DNA, 21 bp, Homo sapiens
ctagagtgaacttgggccact

SEQ ID NO: 2511866 - DNA, 16 bp, Homo sapiens
ctagatactgtatcat

SEQ ID NO: 2511867 - DNA, 18 bp, Homo sapiens
ctagatcatgaagaacct

SEQ ID NO: 2511868 - DNA, 13 bp, Homo sapiens
ctagatccacaca

SEQ ID NO: 2511869 - DNA, 17 bp, Homo sapiens
ctagatccacacacaga

SEQ ID NO: 2511870 - DNA, 13 bp, Homo sapiens
ctagatgtcttta

SEQ ID NO: 2511871 - DNA, 15 bp, Homo sapiens
ctagcaagtgagaga

SEQ ID NO: 2511872 - DNA, 19 bp, Homo sapiens
ctagcagagcaggggcagg

SEQ ID NO: 2511873 - DNA, 12 bp, Homo sapiens
ctagcagcaggg

SEQ ID NO: 2511874 - DNA, 22 bp, Homo sapiens
ctagcagcagggagggcttctg

SEQ ID NO: 2511875 - DNA, 23 bp, Homo sapiens
ctagcagcagggagggcttctgc

SEQ ID NO: 2511876 - DNA, 22 bp, Homo sapiens
ctagcagtgatgaaaatgaatc

SEQ ID NO: 2511877 - DNA, 16 bp, Homo sapiens
ctagcatctcatgagt

SEQ ID NO: 2511878 - DNA, 15 bp, Homo sapiens
ctagccaccaactct

SEQ ID NO: 2511879 - DNA, 21 bp, Homo sapiens
ctagccaccaactcttgcagg

SEQ ID NO: 2511880 - DNA, 22 bp, Homo sapiens
ctagccaccaactcttgcaggt

SEQ ID NO: 2511881 - DNA, 14 bp, Homo sapiens
ctagccattcctgg

SEQ ID NO: 2511882 - DNA, 19 bp, Homo sapiens
ctagccctctcacatttat

SEQ ID NO: 2511883 - DNA, 16 bp, Homo sapiens
ctagccgacctcagcc

SEQ ID NO: 2511884 - DNA, 20 bp, Homo sapiens
ctagccgacctcagccttcc

SEQ ID NO: 2511885 - DNA, 13 bp, Homo sapiens
ctagcctctccag

SEQ ID NO: 2511886 - DNA, 21 bp, Homo sapiens
ctagccttagaagtcacacag

SEQ ID NO: 2511887 - DNA, 19 bp, Homo sapiens
ctagccttatcctctgatc

SEQ ID NO: 2511888 - DNA, 21 bp, Homo sapiens
ctagccttatcctctgatctc

SEQ ID NO: 2511889 - DNA, 22 bp, Homo sapiens
ctagccttatcctctgatctcc

SEQ ID NO: 2511890 - DNA, 16 bp, Homo sapiens
ctagctagaaatatga

SEQ ID NO: 2511891 - DNA, 22 bp, Homo sapiens
ctagctccacaccctctcccag

SEQ ID NO: 2511892 - DNA, 10 bp, Homo sapiens
ctagctcccc

SEQ ID NO: 2511893 - DNA, 14 bp, Homo sapiens
ctagctcccctcct

SEQ ID NO: 2511894 - DNA, 19 bp, Homo sapiens
ctagctcccctcctctccc

SEQ ID NO: 2511895 - DNA, 23 bp, Homo sapiens
ctagctcccctcctctcccctac

SEQ ID NO: 2511896 - DNA, 14 bp, Homo sapiens
ctagctcgtgattg

SEQ ID NO: 2511897 - DNA, 15 bp, Homo sapiens
ctagctggtggtttc

SEQ ID NO: 2511898 - DNA, 19 bp, Homo sapiens
ctagcttagagcctccctc

SEQ ID NO: 2511899 - DNA, 20 bp, Homo sapiens
ctaggaacactccttcacag

SEQ ID NO: 2511900 - DNA, 11 bp, Homo sapiens
ctaggaagaat

SEQ ID NO: 2511901 - DNA, 19 bp, Homo sapiens
ctaggaagaattttaaaaa

SEQ ID NO: 2511902 - DNA, 20 bp, Homo sapiens
ctaggaagaattttaaaaat

SEQ ID NO: 2511903 - DNA, 21 bp, Homo sapiens
ctaggaagaattttaaaaatg

SEQ ID NO: 2511904 - DNA, 22 bp, Homo sapiens
ctaggaagaattttaaaaatga

SEQ ID NO: 2511905 - DNA, 15 bp, Homo sapiens
ctaggaattcccagc

SEQ ID NO: 2511906 - DNA, 22 bp, Homo sapiens
ctaggacgccacccagcaaaag

SEQ ID NO: 2511907 - DNA, 15 bp, Homo sapiens
ctaggactctgaggc

SEQ ID NO: 2511908 - DNA, 16 bp, Homo sapiens
ctaggactctgaggct

SEQ ID NO: 2511909 - DNA, 20 bp, Homo sapiens
ctaggagaccaaggcgggag

SEQ ID NO: 2511910 - DNA, 13 bp, Homo sapiens
ctaggagggagac

SEQ ID NO: 2511911 - DNA, 18 bp, Homo sapiens
ctaggagggagacactgg

SEQ ID NO: 2511912 - DNA, 22 bp, Homo sapiens
ctaggagggagacactggcccc

SEQ ID NO: 2511913 - DNA, 15 bp, Homo sapiens
ctaggatatcttctc

SEQ ID NO: 2511914 - DNA, 17 bp, Homo sapiens
ctaggatatcttctcca

SEQ ID NO: 2511915 - DNA, 16 bp, Homo sapiens
ctaggcaggacctgtg

SEQ ID NO: 2511916 - DNA, 14 bp, Homo sapiens
ctaggcctggccag

SEQ ID NO: 2511917 - DNA, 15 bp, Homo sapiens
ctaggcctggccaga

SEQ ID NO: 2511918 - DNA, 12 bp, Homo sapiens
ctaggcctgggg

SEQ ID NO: 2511919 - DNA, 15 bp, Homo sapiens
ctaggcgagtgccag

SEQ ID NO: 2511920 - DNA, 17 bp, Homo sapiens
ctaggcgagtgccagga

SEQ ID NO: 2511921 - DNA, 18 bp, Homo sapiens
ctaggcgagtgccaggac

SEQ ID NO: 2511922 - DNA, 19 bp, Homo sapiens
ctaggcgagtgccaggact

SEQ ID NO: 2511923 - DNA, 13 bp, Homo sapiens
ctaggctcagaga

SEQ ID NO: 2511924 - DNA, 15 bp, Homo sapiens
ctaggctcagagatg

SEQ ID NO: 2511925 - DNA, 20 bp, Homo sapiens
ctaggctcagagatgtgcac

SEQ ID NO: 2511926 - DNA, 13 bp, Homo sapiens
ctaggctccaccc

SEQ ID NO: 2511927 - DNA, 21 bp, Homo sapiens
ctaggcttcagcatatttata

SEQ ID NO: 2511928 - DNA, 20 bp, Homo sapiens
ctagggacccctcctccctt

SEQ ID NO: 2511929 - DNA, 15 bp, Homo sapiens
ctagggattcaggct

SEQ ID NO: 2511930 - DNA, 16 bp, Homo sapiens
ctagggccaagcccag

SEQ ID NO: 2511931 - DNA, 17 bp, Homo sapiens
ctagggccaagcccagc

SEQ ID NO: 2511932 - DNA, 16 bp, Homo sapiens
ctaggggtcaggctcc

SEQ ID NO: 2511933 - DNA, 18 bp, Homo sapiens
ctaggggtcaggctccat

SEQ ID NO: 2511934 - DNA, 23 bp, Homo sapiens
ctaggggtcttgttaagtgcagt

SEQ ID NO: 2511935 - DNA, 12 bp, Homo sapiens
ctaggtctgata

SEQ ID NO: 2511936 - DNA, 24 bp, Homo sapiens
ctaggtgacagagtgagactctgt

SEQ ID NO: 2511937 - DNA, 19 bp, Homo sapiens
ctaggtggcaaggctgtgc

SEQ ID NO: 2511938 - DNA, 19 bp, Homo sapiens
ctaggtgggccagcccctc

SEQ ID NO: 2511939 - DNA, 23 bp, Homo sapiens
ctaggtgggccagcccctcccac

SEQ ID NO: 2511940 - DNA, 12 bp, Homo sapiens
ctaggtttaact

SEQ ID NO: 2511941 - DNA, 22 bp, Homo sapiens
ctaggtttaactcagatcacta

SEQ ID NO: 2511942 - DNA, 15 bp, Homo sapiens
ctagtaagtgccttc

SEQ ID NO: 2511943 - DNA, 22 bp, Homo sapiens
ctagtacttgggagacctgtaa

SEQ ID NO: 2511944 - DNA, 17 bp, Homo sapiens
ctagtagttcctgctac

SEQ ID NO: 2511945 - DNA, 23 bp, Homo sapiens
ctagtatcaaaagaaagaaaatc

SEQ ID NO: 2511946 - DNA, 21 bp, Homo sapiens
ctagtatttcatgctgggaat

SEQ ID NO: 2511947 - DNA, 15 bp, Homo sapiens
ctagtctcctttgca

SEQ ID NO: 2511948 - DNA, 19 bp, Homo sapiens
ctagtctcctttgcactga

SEQ ID NO: 2511949 - DNA, 16 bp, Homo sapiens
ctagtctctctggggc

SEQ ID NO: 2511950 - DNA, 13 bp, Homo sapiens
ctagtcttaagaa

SEQ ID NO: 2511951 - DNA, 14 bp, Homo sapiens
ctagtgaatgaatc

SEQ ID NO: 2511952 - DNA, 13 bp, Homo sapiens
ctagtgcagctga

SEQ ID NO: 2511953 - DNA, 21 bp, Homo sapiens
ctagtgcagctgattttaaca

SEQ ID NO: 2511954 - DNA, 18 bp, Homo sapiens
ctagtgccctccacagcc

SEQ ID NO: 2511955 - DNA, 23 bp, Homo sapiens
ctagtgccctccacagccgcagc

SEQ ID NO: 2511956 - DNA, 17 bp, Homo sapiens
ctagtgctgtgaaaaaa

SEQ ID NO: 2511957 - DNA, 22 bp, Homo sapiens
ctagtgctgtgaaaaaaaaaat

SEQ ID NO: 2511958 - DNA, 21 bp, Homo sapiens
ctagtgctttccttttttaaa

SEQ ID NO: 2511959 - DNA, 22 bp, Homo sapiens
ctagtgctttccttttttaaaa

SEQ ID NO: 2511960 - DNA, 18 bp, Homo sapiens
ctagtggtctttgtaaga

SEQ ID NO: 2511961 - DNA, 19 bp, Homo sapiens
ctagtggtctttgtaagag

SEQ ID NO: 2511962 - DNA, 14 bp, Homo sapiens
ctagtgttgcttgg

SEQ ID NO: 2511963 - DNA, 20 bp, Homo sapiens
ctagttcatccaatcctcac

SEQ ID NO: 2511964 - DNA, 22 bp, Homo sapiens
ctagttcatccaatcctcactg

SEQ ID NO: 2511965 - DNA, 24 bp, Homo sapiens
ctagttcatccaatcctcactggg

SEQ ID NO: 2511966 - DNA, 14 bp, Homo sapiens
ctagttccaccatc

SEQ ID NO: 2511967 - DNA, 22 bp, Homo sapiens
ctagttgtttgattcagacagc

SEQ ID NO: 2511968 - DNA, 17 bp, Homo sapiens
ctagtttgattaaattc

SEQ ID NO: 2511969 - DNA, 19 bp, Homo sapiens
ctagtttgattaaattctt

SEQ ID NO: 2511970 - DNA, 21 bp, Homo sapiens
ctagtttgattaaattcttgc

SEQ ID NO: 2511971 - DNA, 13 bp, Homo sapiens
ctagtttgcattc

SEQ ID NO: 2511972 - DNA, 18 bp, Homo sapiens
ctagttttctcctcccag

SEQ ID NO: 2511973 - DNA, 20 bp, Homo sapiens
ctagttttctcctcccagga

SEQ ID NO: 2511974 - DNA, 23 bp, Homo sapiens
ctataaagaagaacttgcatgga

SEQ ID NO: 2511975 - DNA, 16 bp, Homo sapiens
ctataaatggtgtttt

SEQ ID NO: 2511976 - DNA, 19 bp, Homo sapiens
ctataatgaagctttatac

SEQ ID NO: 2511977 - DNA, 16 bp, Homo sapiens
ctataatgtaagctct

SEQ ID NO: 2511978 - DNA, 21 bp, Homo sapiens
ctataatgtaagctctactga

SEQ ID NO: 2511979 - DNA, 20 bp, Homo sapiens
ctataattccctatctttta

SEQ ID NO: 2511980 - DNA, 15 bp, Homo sapiens
ctatacaactggaca

SEQ ID NO: 2511981 - DNA, 18 bp, Homo sapiens
ctatagcctaggtgacag

SEQ ID NO: 2511982 - DNA, 19 bp, Homo sapiens
ctatagcctaggtgacaga

SEQ ID NO: 2511983 - DNA, 20 bp, Homo sapiens
ctatagcctaggtgacagag

SEQ ID NO: 2511984 - DNA, 16 bp, Homo sapiens
ctatagctcaggacct

SEQ ID NO: 2511985 - DNA, 17 bp, Homo sapiens
ctataggctggagaagc

SEQ ID NO: 2511986 - DNA, 19 bp, Homo sapiens
ctataggtcatacaatcca

SEQ ID NO: 2511987 - DNA, 15 bp, Homo sapiens
ctataggtgctacaa

SEQ ID NO: 2511988 - DNA, 15 bp, Homo sapiens
ctatatagagatgtt

SEQ ID NO: 2511989 - DNA, 17 bp, Homo sapiens
ctatatataattctgta

SEQ ID NO: 2511990 - DNA, 19 bp, Homo sapiens
ctatatataattctgtaca

SEQ ID NO: 2511991 - DNA, 23 bp, Homo sapiens
ctatatatgtgatgatctaccag

SEQ ID NO: 2511992 - DNA, 17 bp, Homo sapiens
ctatatatgtgtatgta

SEQ ID NO: 2511993 - DNA, 16 bp, Homo sapiens
cgtcgccctcccaggc

SEQ ID NO: 2511994 - DNA, 18 bp, Homo sapiens
cgtcggggggacagctcc

SEQ ID NO: 2511995 - DNA, 19 bp, Homo sapiens
cgtctaagtcatgagctga

SEQ ID NO: 2511996 - DNA, 16 bp, Homo sapiens
cgtctacctgaggggc

SEQ ID NO: 2511997 - DNA, 23 bp, Homo sapiens
cgtctcaaaaaaaaaaaaatgca

SEQ ID NO: 2511998 - DNA, 22 bp, Homo sapiens
cgtctctccctccctttgaaat

SEQ ID NO: 2511999 - DNA, 20 bp, Homo sapiens
cgtctgacaggcaatgctgg

SEQ ID NO: 2512000 - DNA, 15 bp, Homo sapiens
cgtctgtatattttg

SEQ ID NO: 2512001 - DNA, 17 bp, Homo sapiens
cgtctgtttataaacat

SEQ ID NO: 2512002 - DNA, 23 bp, Homo sapiens
cgtcttcattaagccctcttcca

SEQ ID NO: 2512003 - DNA, 19 bp, Homo sapiens
cgtcttctgtatactgtgg

SEQ ID NO: 2512004 - DNA, 19 bp, Homo sapiens
cgtcttgcttgggaagggg

SEQ ID NO: 2512005 - DNA, 16 bp, Homo sapiens
cgtgaaacacaccagg

SEQ ID NO: 2512006 - DNA, 24 bp, Homo sapiens
cgtgaaacacaccaggctgtgggc

SEQ ID NO: 2512007 - DNA, 13 bp, Homo sapiens
cgtgaagggattt

SEQ ID NO: 2512008 - DNA, 14 bp, Homo sapiens
cgtgacaacacttg

SEQ ID NO: 2512009 - DNA, 17 bp, Homo sapiens
cgtgacaataaaacatt

SEQ ID NO: 2512010 - DNA, 17 bp, Homo sapiens
cgtgacagactcctgag

SEQ ID NO: 2512011 - DNA, 18 bp, Homo sapiens
cgtgacatccccaccctt

SEQ ID NO: 2512012 - DNA, 14 bp, Homo sapiens
cgtgagccactgca

SEQ ID NO: 2512013 - DNA, 22 bp, Homo sapiens
cgtgagccactgcaccgggcca

SEQ ID NO: 2512014 - DNA, 12 bp, Homo sapiens
cgtgagccaggt

SEQ ID NO: 2512015 - DNA, 13 bp, Homo sapiens
cgtgagccaggta

SEQ ID NO: 2512016 - DNA, 19 bp, Homo sapiens
cgtgagttctcagggctcc

SEQ ID NO: 2512017 - DNA, 18 bp, Homo sapiens
cgtgatccacccacctcg

SEQ ID NO: 2512018 - DNA, 14 bp, Homo sapiens
cgtgcagcatatga

SEQ ID NO: 2512019 - DNA, 22 bp, Homo sapiens
cgtgcagtggtgcgatctgggt

SEQ ID NO: 2512020 - DNA, 23 bp, Homo sapiens
cgtgcataccacttttgttcttg

SEQ ID NO: 2512021 - DNA, 21 bp, Homo sapiens
cgtgcattggaagaccccacc

SEQ ID NO: 2512022 - DNA, 19 bp, Homo sapiens
cgtgcccaggggcccacag

SEQ ID NO: 2512023 - DNA, 14 bp, Homo sapiens
cgtgcctccaccac

SEQ ID NO: 2512024 - DNA, 17 bp, Homo sapiens
cgtgcctccaccaccac

SEQ ID NO: 2512025 - DNA, 21 bp, Homo sapiens
cgtgcctccaccaccactggc

SEQ ID NO: 2512026 - DNA, 16 bp, Homo sapiens
cgtgccttttgcaccc

SEQ ID NO: 2512027 - DNA, 23 bp, Homo sapiens
cgtgccttttgcacccctcccat

SEQ ID NO: 2512028 - DNA, 23 bp, Homo sapiens
cgtgctacccccatgctggaggt

SEQ ID NO: 2512029 - DNA, 22 bp, Homo sapiens
cgtgcttgtttgctcacctggg

SEQ ID NO: 2512030 - DNA, 15 bp, Homo sapiens
cgtggaacgtttttc

SEQ ID NO: 2512031 - DNA, 22 bp, Homo sapiens
cgtggactccagactctctgtg

SEQ ID NO: 2512032 - DNA, 20 bp, Homo sapiens
cgtggagagctggtgcccgg

SEQ ID NO: 2512033 - DNA, 16 bp, Homo sapiens
cgtggagatgtcttcg

SEQ ID NO: 2512034 - DNA, 18 bp, Homo sapiens
cgtggagcagaatcagta

SEQ ID NO: 2512035 - DNA, 15 bp, Homo sapiens
cgtggagctgcctga

SEQ ID NO: 2512036 - DNA, 17 bp, Homo sapiens
cggaatagttggctagg

SEQ ID NO: 2512037 - DNA, 12 bp, Homo sapiens
cggacaccccct

SEQ ID NO: 2512038 - DNA, 18 bp, Homo sapiens
cggagaaccttgtgcctg

SEQ ID NO: 2512039 - DNA, 24 bp, Homo sapiens
cggagaagagctgttcacagccag

SEQ ID NO: 2512040 - DNA, 15 bp, Homo sapiens
cggagacagtgatct

SEQ ID NO: 2512041 - DNA, 15 bp, Homo sapiens
cggagacggagtccc

SEQ ID NO: 2512042 - DNA, 14 bp, Homo sapiens
cggagacgggaccg

SEQ ID NO: 2512043 - DNA, 15 bp, Homo sapiens
cggagacgggaccgg

SEQ ID NO: 2512044 - DNA, 21 bp, Homo sapiens
cggagagtacagtgagccaag

SEQ ID NO: 2512045 - DNA, 18 bp, Homo sapiens
cggagccactcctctgac

SEQ ID NO: 2512046 - DNA, 16 bp, Homo sapiens
cggagctggccccgcc

SEQ ID NO: 2512047 - DNA, 16 bp, Homo sapiens
cggaggccacatgagt

SEQ ID NO: 2512048 - DNA, 13 bp, Homo sapiens
cggaggctgcccc

SEQ ID NO: 2512049 - DNA, 15 bp, Homo sapiens
cggagtcagtgccag

SEQ ID NO: 2512050 - DNA, 19 bp, Homo sapiens
cggagtcagtgccaggtcc

SEQ ID NO: 2512051 - DNA, 20 bp, Homo sapiens
cggagtcccaccttggctgc

SEQ ID NO: 2512052 - DNA, 14 bp, Homo sapiens
cggagtgaagaggg

SEQ ID NO: 2512053 - DNA, 16 bp, Homo sapiens
cggattattttttcag

SEQ ID NO: 2512054 - DNA, 20 bp, Homo sapiens
cggattattttttcagaccg

SEQ ID NO: 2512055 - DNA, 22 bp, Homo sapiens
cggattattttttcagaccgaa

SEQ ID NO: 2512056 - DNA, 23 bp, Homo sapiens
cggattggcttgtgtgtttcact

SEQ ID NO: 2512057 - DNA, 16 bp, Homo sapiens
cggatttatttttcca

SEQ ID NO: 2512058 - DNA, 21 bp, Homo sapiens
cggcagttctgggtgctccct

SEQ ID NO: 2512059 - DNA, 16 bp, Homo sapiens
cggccacctgcggtgc

SEQ ID NO: 2512060 - DNA, 22 bp, Homo sapiens
cggccagccccggccctgggct

SEQ ID NO: 2512061 - DNA, 20 bp, Homo sapiens
cggccaggccagagggagtg

SEQ ID NO: 2512062 - DNA, 12 bp, Homo sapiens
cggccccagcca

SEQ ID NO: 2512063 - DNA, 21 bp, Homo sapiens
cggcccccagagcgcccctcc

SEQ ID NO: 2512064 - DNA, 20 bp, Homo sapiens
cggcccccgcgcgcgtcccc

SEQ ID NO: 2512065 - DNA, 15 bp, Homo sapiens
cggcccctcccgccc

SEQ ID NO: 2512066 - DNA, 22 bp, Homo sapiens
cggcccctgcatccccttggct

SEQ ID NO: 2512067 - DNA, 18 bp, Homo sapiens
cggcccctgctggttcag

SEQ ID NO: 2512068 - DNA, 19 bp, Homo sapiens
cggcccctgctggttcagg

SEQ ID NO: 2512069 - DNA, 20 bp, Homo sapiens
cggccctaccagcgcccgct

SEQ ID NO: 2512070 - DNA, 14 bp, Homo sapiens
cggccctatgcatg

SEQ ID NO: 2512071 - DNA, 22 bp, Homo sapiens
cggccctcctaccctgcgccca

SEQ ID NO: 2512072 - DNA, 13 bp, Homo sapiens
cggccctgggctc

SEQ ID NO: 2512073 - DNA, 12 bp, Homo sapiens
cggccctggggc

SEQ ID NO: 2512074 - DNA, 13 bp, Homo sapiens
cggccgctccagg

SEQ ID NO: 2512075 - DNA, 21 bp, Homo sapiens
cggcctccgtccaggagcctg

SEQ ID NO: 2512076 - DNA, 22 bp, Homo sapiens
cggcctccgtccaggagcctgg

SEQ ID NO: 2512077 - DNA, 13 bp, Homo sapiens
cggcctctaaccc

SEQ ID NO: 2512078 - DNA, 15 bp, Homo sapiens
cggcctctaacccca

SEQ ID NO: 2512079 - DNA, 17 bp, Homo sapiens
cggcctctaaccccagg

SEQ ID NO: 2512080 - DNA, 22 bp, Homo sapiens
cggcctctaaccccaggccccg

SEQ ID NO: 2512081 - DNA, 14 bp, Homo sapiens
cggcctctctggcc

SEQ ID NO: 2512082 - DNA, 19 bp, Homo sapiens
cggcctctctggcctccca

SEQ ID NO: 2512083 - DNA, 20 bp, Homo sapiens
cggcctctctggcctcccac

SEQ ID NO: 2512084 - DNA, 21 bp, Homo sapiens
cggcctctctggcctcccacc

SEQ ID NO: 2512085 - DNA, 19 bp, Homo sapiens
cggcctgctcccagcagcc

SEQ ID NO: 2512086 - DNA, 15 bp, Homo sapiens
cggcctttggcttca

SEQ ID NO: 2512087 - DNA, 18 bp, Homo sapiens
cggcgcccctgccacctc

SEQ ID NO: 2512088 - DNA, 20 bp, Homo sapiens
cggcgcttgccactagggct

SEQ ID NO: 2512089 - DNA, 19 bp, Homo sapiens
cgccaagcaacctgggtcc

SEQ ID NO: 2512090 - DNA, 15 bp, Homo sapiens
cgccacatggcttcc

SEQ ID NO: 2512091 - DNA, 20 bp, Homo sapiens
cgccacctggcattccttct

SEQ ID NO: 2512092 - DNA, 15 bp, Homo sapiens
cgccactcctgaacc

SEQ ID NO: 2512093 - DNA, 21 bp, Homo sapiens
cgccactgcactccagcctgg

SEQ ID NO: 2512094 - DNA, 22 bp, Homo sapiens
cgccactgcactccagcctggg

SEQ ID NO: 2512095 - DNA, 21 bp, Homo sapiens
cgccagattctttcctgaggc

SEQ ID NO: 2512096 - DNA, 17 bp, Homo sapiens
cgccatgctcctggccc

SEQ ID NO: 2512097 - DNA, 15 bp, Homo sapiens
cgccattgcactcca

SEQ ID NO: 2512098 - DNA, 19 bp, Homo sapiens
cgccattgcactccagcct

SEQ ID NO: 2512099 - DNA, 17 bp, Homo sapiens
cgccattgccaccagga

SEQ ID NO: 2512100 - DNA, 22 bp, Homo sapiens
cgcccacaggaagcctgcagtc

SEQ ID NO: 2512101 - DNA, 15 bp, Homo sapiens
cgcccactgtcctgg

SEQ ID NO: 2512102 - DNA, 16 bp, Homo sapiens
cgcccactgtcctggg

SEQ ID NO: 2512103 - DNA, 18 bp, Homo sapiens
cgcccactgtcctgggcg

SEQ ID NO: 2512104 - DNA, 18 bp, Homo sapiens
cgcccagctgcacctgcc

SEQ ID NO: 2512105 - DNA, 11 bp, Homo sapiens
cgcccaggaga

SEQ ID NO: 2512106 - DNA, 14 bp, Homo sapiens
cgcccagtccttcc

SEQ ID NO: 2512107 - DNA, 22 bp, Homo sapiens
cgcccagttgggtggatgcctg

SEQ ID NO: 2512108 - DNA, 23 bp, Homo sapiens
cgcccagttgggtggatgcctgg

SEQ ID NO: 2512109 - DNA, 13 bp, Homo sapiens
cgcccatgtgtga

SEQ ID NO: 2512110 - DNA, 12 bp, Homo sapiens
cgccccacccag

SEQ ID NO: 2512111 - DNA, 14 bp, Homo sapiens
cgccccctgccctc

SEQ ID NO: 2512112 - DNA, 13 bp, Homo sapiens
cgccccgccccac

SEQ ID NO: 2512113 - DNA, 14 bp, Homo sapiens
cgccccgccccaca

SEQ ID NO: 2512114 - DNA, 21 bp, Homo sapiens
cgcccctcatttatccctcaa

SEQ ID NO: 2512115 - DNA, 14 bp, Homo sapiens
cgcccctgccacct

SEQ ID NO: 2512116 - DNA, 18 bp, Homo sapiens
cgcccgcccactgtcctg

SEQ ID NO: 2512117 - DNA, 21 bp, Homo sapiens
cgcccgcccactgtcctgggc

SEQ ID NO: 2512118 - DNA, 13 bp, Homo sapiens
cgcccgcgcccgc

SEQ ID NO: 2512119 - DNA, 14 bp, Homo sapiens
cgcccgctgggctg

SEQ ID NO: 2512120 - DNA, 12 bp, Homo sapiens
cgccctcccagg

SEQ ID NO: 2512121 - DNA, 12 bp, Homo sapiens
cgccctggaagc

SEQ ID NO: 2512122 - DNA, 19 bp, Homo sapiens
cgccgagtctgtctctgtc

SEQ ID NO: 2512123 - DNA, 19 bp, Homo sapiens
cgccgcaaaccacactgga

SEQ ID NO: 2512124 - DNA, 23 bp, Homo sapiens
cgccgcaaaccacactggactcc

SEQ ID NO: 2512125 - DNA, 20 bp, Homo sapiens
cgccgcctggtactcaagcc

SEQ ID NO: 2512126 - DNA, 23 bp, Homo sapiens
cgccggagtccactcccagtgct

SEQ ID NO: 2512127 - DNA, 21 bp, Homo sapiens
cgccgtgagttctcagggctc

SEQ ID NO: 2512128 - DNA, 22 bp, Homo sapiens
cgccgtgagttctcagggctcc

SEQ ID NO: 2512129 - DNA, 14 bp, Homo sapiens
cgcctcccactggg

SEQ ID NO: 2512130 - DNA, 15 bp, Homo sapiens
cgcctcccactgggg

SEQ ID NO: 2512131 - DNA, 15 bp, Homo sapiens
cgcctctcccgtcag

SEQ ID NO: 2512132 - DNA, 13 bp, Homo sapiens
cgcctctgcattc

SEQ ID NO: 2512133 - DNA, 19 bp, Homo sapiens
cgcctcttcttcttcagaa

SEQ ID NO: 2512134 - DNA, 20 bp, Homo sapiens
cgcctgccctccccagagca

SEQ ID NO: 2512135 - DNA, 20 bp, Homo sapiens
cgcctggcagaactgagctc

SEQ ID NO: 2512136 - DNA, 16 bp, Homo sapiens
cgcctgtaatcccagc

SEQ ID NO: 2512137 - DNA, 20 bp, Homo sapiens
cgcctgtaatcccagcactt

SEQ ID NO: 2512138 - DNA, 21 bp, Homo sapiens
cgccttagcatgtttgctgaa

SEQ ID NO: 2512139 - DNA, 19 bp, Homo sapiens
cgcgcgtccccctgccggc

SEQ ID NO: 2512140 - DNA, 22 bp, Homo sapiens
cgcggccagccccggccctggg

SEQ ID NO: 2512141 - DNA, 22 bp, Homo sapiens
cgcggcggagctggccccgccg

SEQ ID NO: 2512142 - DNA, 19 bp, Homo sapiens
cgcgtgcacgtggagagct

SEQ ID NO: 2512143 - DNA, 19 bp, Homo sapiens
cgcgtgccctcgctgcttc

SEQ ID NO: 2512144 - DNA, 14 bp, Homo sapiens
cgctaagagggagg

SEQ ID NO: 2512145 - DNA, 15 bp, Homo sapiens
cgctaagagggaggg

SEQ ID NO: 2512146 - DNA, 17 bp, Homo sapiens
cgctacccgggaagggg

SEQ ID NO: 2512147 - DNA, 21 bp, Homo sapiens
cgctcctgtctgccagccagc

SEQ ID NO: 2512148 - DNA, 17 bp, Homo sapiens
cgctctcctttctttct

SEQ ID NO: 2512149 - DNA, 22 bp, Homo sapiens
cgctctgcatgcggcccagccc

SEQ ID NO: 2512150 - DNA, 23 bp, Homo sapiens
cgctctgcatgcggcccagcccg

SEQ ID NO: 2512151 - DNA, 15 bp, Homo sapiens
cgctctgctggcctg

SEQ ID NO: 2512152 - DNA, 17 bp, Homo sapiens
cgctctgctggcctggc

SEQ ID NO: 2512153 - DNA, 17 bp, Homo sapiens
cgctgagtggactggag

SEQ ID NO: 2512154 - DNA, 14 bp, Homo sapiens
cgctgattctcagg

SEQ ID NO: 2512155 - DNA, 23 bp, Homo sapiens
cgctgattctcagggtctctgct

SEQ ID NO: 2512156 - DNA, 20 bp, Homo sapiens
cgctgctgctgctgcgccct

SEQ ID NO: 2512157 - DNA, 19 bp, Homo sapiens
cgctggaccttgaactggg

SEQ ID NO: 2512158 - DNA, 14 bp, Homo sapiens
cgctggcccagccg

SEQ ID NO: 2512159 - DNA, 15 bp, Homo sapiens
cgctggcccagccgg

SEQ ID NO: 2512160 - DNA, 16 bp, Homo sapiens
cgctggcccagccggc

SEQ ID NO: 2512161 - DNA, 15 bp, Homo sapiens
cgctgggctgagccc

SEQ ID NO: 2512162 - DNA, 17 bp, Homo sapiens
cgctggggccagttggt

SEQ ID NO: 2512163 - DNA, 19 bp, Homo sapiens
cgctgggtggtaccctctg

SEQ ID NO: 2512164 - DNA, 13 bp, Homo sapiens
cgctgtgctgccc

SEQ ID NO: 2512165 - DNA, 18 bp, Homo sapiens
cgctgtgctgccctgccc

SEQ ID NO: 2512166 - DNA, 17 bp, Homo sapiens
cgcttaaaggtgtcttc

SEQ ID NO: 2512167 - DNA, 17 bp, Homo sapiens
cgcttctgaatgctgct

SEQ ID NO: 2512168 - DNA, 17 bp, Homo sapiens
cgcttgccactagggct

SEQ ID NO: 2512169 - DNA, 16 bp, Homo sapiens
cgctttctagctgttg

SEQ ID NO: 2512170 - DNA, 15 bp, Homo sapiens
cggaaaacatgctac

SEQ ID NO: 2512171 - DNA, 21 bp, Homo sapiens
cggaaaacggtggaggccagg

SEQ ID NO: 2512172 - DNA, 20 bp, Homo sapiens
cggaagacctgaagagtggt

SEQ ID NO: 2512173 - DNA, 13 bp, Homo sapiens
cggaagagccttg

SEQ ID NO: 2512174 - DNA, 14 bp, Homo sapiens
cggaagcagtgcct

SEQ ID NO: 2512175 - DNA, 23 bp, Homo sapiens
cggaagcagtgccttccataatt

SEQ ID NO: 2512176 - DNA, 12 bp, Homo sapiens
cggaagggcaca

SEQ ID NO: 2512177 - DNA, 19 bp, Homo sapiens
ccccagccctggctctgca

SEQ ID NO: 2512178 - DNA, 12 bp, Homo sapiens
ccccagccctgt

SEQ ID NO: 2512179 - DNA, 13 bp, Homo sapiens
ccccagccctgtg

SEQ ID NO: 2512180 - DNA, 19 bp, Homo sapiens
ccccagcctaagatgaaga

SEQ ID NO: 2512181 - DNA, 16 bp, Homo sapiens
ccccagcctctggcat

SEQ ID NO: 2512182 - DNA, 13 bp, Homo sapiens
ccccagcctgcta

SEQ ID NO: 2512183 - DNA, 12 bp, Homo sapiens
ccccagccttct

SEQ ID NO: 2512184 - DNA, 12 bp, Homo sapiens
ccccagctctgg

SEQ ID NO: 2512185 - DNA, 14 bp, Homo sapiens
ccccagctctggtg

SEQ ID NO: 2512186 - DNA, 10 bp, Homo sapiens
ccccagctga

SEQ ID NO: 2512187 - DNA, 13 bp, Homo sapiens
ccccagctgcttg

SEQ ID NO: 2512188 - DNA, 11 bp, Homo sapiens
ccccagctggg

SEQ ID NO: 2512189 - DNA, 12 bp, Homo sapiens
ccccagctggga

SEQ ID NO: 2512190 - DNA, 13 bp, Homo sapiens
ccccagctgggag

SEQ ID NO: 2512191 - DNA, 15 bp, Homo sapiens
ccccagctgggaggc

SEQ ID NO: 2512192 - DNA, 15 bp, Homo sapiens
ccccaggaggccagc

SEQ ID NO: 2512193 - DNA, 17 bp, Homo sapiens
ccccaggaggccagcct

SEQ ID NO: 2512194 - DNA, 21 bp, Homo sapiens
ccccaggaggccagccttgac

SEQ ID NO: 2512195 - DNA, 22 bp, Homo sapiens
ccccaggaggccagccttgacc

SEQ ID NO: 2512196 - DNA, 18 bp, Homo sapiens
ccccaggcaggctgtgcg

SEQ ID NO: 2512197 - DNA, 18 bp, Homo sapiens
ccccaggccccaggaagc

SEQ ID NO: 2512198 - DNA, 19 bp, Homo sapiens
ccccaggccccaggaagcc

SEQ ID NO: 2512199 - DNA, 20 bp, Homo sapiens
ccccaggccccgaggaccca

SEQ ID NO: 2512200 - DNA, 15 bp, Homo sapiens
ccccaggcctctgtg

SEQ ID NO: 2512201 - DNA, 17 bp, Homo sapiens
ccccaggcctctgtgtc

SEQ ID NO: 2512202 - DNA, 17 bp, Homo sapiens
ccccaggggtcccagcc

SEQ ID NO: 2512203 - DNA, 19 bp, Homo sapiens
ccccaggggtcccagccac

SEQ ID NO: 2512204 - DNA, 16 bp, Homo sapiens
ccccagggtcttccct

SEQ ID NO: 2512205 - DNA, 16 bp, Homo sapiens
ccccagtcagcctctc

SEQ ID NO: 2512206 - DNA, 21 bp, Homo sapiens
ccccagtcagcctctctccca

SEQ ID NO: 2512207 - DNA, 16 bp, Homo sapiens
ccccagtgcccacagg

SEQ ID NO: 2512208 - DNA, 18 bp, Homo sapiens
ccccagttctgctcctct

SEQ ID NO: 2512209 - DNA, 21 bp, Homo sapiens
ccccagttctgctcctctcca

SEQ ID NO: 2512210 - DNA, 16 bp, Homo sapiens
cccgaatagctgggac

SEQ ID NO: 2512211 - DNA, 17 bp, Homo sapiens
cccgaatagctgggact

SEQ ID NO: 2512212 - DNA, 20 bp, Homo sapiens
cccgacatggacccggagct

SEQ ID NO: 2512213 - DNA, 23 bp, Homo sapiens
cccgacatggacccggagctaac

SEQ ID NO: 2512214 - DNA, 20 bp, Homo sapiens
cccgagctgggggccatgag

SEQ ID NO: 2512215 - DNA, 16 bp, Homo sapiens
cccgaggacccagacc

SEQ ID NO: 2512216 - DNA, 17 bp, Homo sapiens
cccgaggacccagaccc

SEQ ID NO: 2512217 - DNA, 19 bp, Homo sapiens
cccgaggacccagacccag

SEQ ID NO: 2512218 - DNA, 13 bp, Homo sapiens
cccgaggcccgca

SEQ ID NO: 2512219 - DNA, 13 bp, Homo sapiens
cccgagtagctgg

SEQ ID NO: 2512220 - DNA, 22 bp, Homo sapiens
cccgagtagctgggactacagg

SEQ ID NO: 2512221 - DNA, 19 bp, Homo sapiens
cccgagtttggtccctggg

SEQ ID NO: 2512222 - DNA, 15 bp, Homo sapiens
cccgatgctgctttc

SEQ ID NO: 2512223 - DNA, 20 bp, Homo sapiens
cccgatgctgctttcccctg

SEQ ID NO: 2512224 - DNA, 19 bp, Homo sapiens
cccgcaaaccccctttgtg

SEQ ID NO: 2512225 - DNA, 20 bp, Homo sapiens
cccgcaaaccccctttgtgc

SEQ ID NO: 2512226 - DNA, 16 bp, Homo sapiens
cccgcacccccaccct

SEQ ID NO: 2512227 - DNA, 12 bp, Homo sapiens
cccgcccactgt

SEQ ID NO: 2512228 - DNA, 17 bp, Homo sapiens
cccgcccactgtcctgg

SEQ ID NO: 2512229 - DNA, 19 bp, Homo sapiens
cccgccccacattccgaca

SEQ ID NO: 2512230 - DNA, 16 bp, Homo sapiens
cccgccccctgccctc

SEQ ID NO: 2512231 - DNA, 17 bp, Homo sapiens
cccgcctggcagaactg

SEQ ID NO: 2512232 - DNA, 21 bp, Homo sapiens
cccgcggggacattgggaagg

SEQ ID NO: 2512233 - DNA, 12 bp, Homo sapiens
cccgctctggac

SEQ ID NO: 2512234 - DNA, 17 bp, Homo sapiens
cccgctgagtggactgg

SEQ ID NO: 2512235 - DNA, 12 bp, Homo sapiens
cccgctgctgct

SEQ ID NO: 2512236 - DNA, 16 bp, Homo sapiens
cccgctgctgctgctg

SEQ ID NO: 2512237 - DNA, 14 bp, Homo sapiens
cccggaacaagcct

SEQ ID NO: 2512238 - DNA, 18 bp, Homo sapiens
cccggaggttgggtgggc

SEQ ID NO: 2512239 - DNA, 14 bp, Homo sapiens
cccggattctggga

SEQ ID NO: 2512240 - DNA, 16 bp, Homo sapiens
cccggcagggtcctag

SEQ ID NO: 2512241 - DNA, 17 bp, Homo sapiens
cccggcatgggaaagcc

SEQ ID NO: 2512242 - DNA, 13 bp, Homo sapiens
cccggccacctgc

SEQ ID NO: 2512243 - DNA, 19 bp, Homo sapiens
cccggccatgtccttagca

SEQ ID NO: 2512244 - DNA, 13 bp, Homo sapiens
cccggccccagcc

SEQ ID NO: 2512245 - DNA, 12 bp, Homo sapiens
cccggccccctg

SEQ ID NO: 2512246 - DNA, 13 bp, Homo sapiens
cccggccccctgg

SEQ ID NO: 2512247 - DNA, 21 bp, Homo sapiens
cccggccccctggtctctggt

SEQ ID NO: 2512248 - DNA, 14 bp, Homo sapiens
cccggctccaggct

SEQ ID NO: 2512249 - DNA, 16 bp, Homo sapiens
cccggctccaggctcc

SEQ ID NO: 2512250 - DNA, 12 bp, Homo sapiens
cccggctgcgga

SEQ ID NO: 2512251 - DNA, 23 bp, Homo sapiens
cccggctggttttgtaagatgct

SEQ ID NO: 2512252 - DNA, 15 bp, Homo sapiens
cccgggaagggggct

SEQ ID NO: 2512253 - DNA, 18 bp, Homo sapiens
cccgggaagggggctggg

SEQ ID NO: 2512254 - DNA, 23 bp, Homo sapiens
cccgggacgcaggggttgcagtg

SEQ ID NO: 2512255 - DNA, 22 bp, Homo sapiens
cccgggcccgttgaggatgagg

SEQ ID NO: 2512256 - DNA, 19 bp, Homo sapiens
cccgggcgcggccagcccc

SEQ ID NO: 2512257 - DNA, 13 bp, Homo sapiens
cccgggctgcctg

SEQ ID NO: 2512258 - DNA, 16 bp, Homo sapiens
cccgggctgcctgggc

SEQ ID NO: 2512259 - DNA, 17 bp, Homo sapiens
cccgggctgcctgggct

SEQ ID NO: 2512260 - DNA, 12 bp, Homo sapiens
cccggggcagct

SEQ ID NO: 2512261 - DNA, 19 bp, Homo sapiens
cccggggcagctgccagag

SEQ ID NO: 2512262 - DNA, 22 bp, Homo sapiens
cccggggtcctgtggcaggcag

SEQ ID NO: 2512263 - DNA, 20 bp, Homo sapiens
cccgggtttggcgggccaag

SEQ ID NO: 2512264 - DNA, 18 bp, Homo sapiens
cccgtcaccatctcaggc

SEQ ID NO: 2512265 - DNA, 18 bp, Homo sapiens
cccgtccacggctctagg

SEQ ID NO: 2512266 - DNA, 12 bp, Homo sapiens
cccgtctcagtg

SEQ ID NO: 2512267 - DNA, 18 bp, Homo sapiens
cccgtcttcagcctagcc

SEQ ID NO: 2512268 - DNA, 19 bp, Homo sapiens
cccgtgtccccggcctcag

SEQ ID NO: 2512269 - DNA, 17 bp, Homo sapiens
cccgttctgctggcctg

SEQ ID NO: 2512270 - DNA, 16 bp, Homo sapiens
cccgtttctccaccta

SEQ ID NO: 2512271 - DNA, 17 bp, Homo sapiens
ccctaaagtgtattttt

SEQ ID NO: 2512272 - DNA, 22 bp, Homo sapiens
ccctaaagtgtatttttttact

SEQ ID NO: 2512273 - DNA, 19 bp, Homo sapiens
ccctaaggatctctcagga

SEQ ID NO: 2512274 - DNA, 20 bp, Homo sapiens
ccctacagttgaaaaacagc

SEQ ID NO: 2512275 - DNA, 20 bp, Homo sapiens
ccctaccactgtcttcttca

SEQ ID NO: 2512276 - DNA, 19 bp, Homo sapiens
ccctaccccacaccaggcc

SEQ ID NO: 2512277 - DNA, 19 bp, Homo sapiens
ccctacctgttcagtgtcc

SEQ ID NO: 2512278 - DNA, 19 bp, Homo sapiens
ccctagaatcagcctaggg

SEQ ID NO: 2512279 - DNA, 20 bp, Homo sapiens
ccctagagcctgcctggagc

SEQ ID NO: 2512280 - DNA, 21 bp, Homo sapiens
ccctagagcctgcctggagcg

SEQ ID NO: 2512281 - DNA, 16 bp, Homo sapiens
ccctagagtgttgttg

SEQ ID NO: 2512282 - DNA, 17 bp, Homo sapiens
ccctagccagcacttgt

SEQ ID NO: 2512283 - DNA, 20 bp, Homo sapiens
ccctagctccacaccctctc

SEQ ID NO: 2512284 - DNA, 23 bp, Homo sapiens
ccctatatgtagtataaagaaaa

SEQ ID NO: 2512285 - DNA, 21 bp, Homo sapiens
ccctatctttgccaccctcat

SEQ ID NO: 2512286 - DNA, 18 bp, Homo sapiens
ccctatggggatggtcca

SEQ ID NO: 2512287 - DNA, 23 bp, Homo sapiens
ccctatttaacagggtctctagt

SEQ ID NO: 2512288 - DNA, 24 bp, Homo sapiens
ccctcaaacctcctcttctgacgt

SEQ ID NO: 2512289 - DNA, 18 bp, Homo sapiens
ccctcaaatgacccaaag

SEQ ID NO: 2512290 - DNA, 20 bp, Homo sapiens
ccctcaaatgacccaaagac

SEQ ID NO: 2512291 - DNA, 18 bp, Homo sapiens
ccctcaacaagggagaga

SEQ ID NO: 2512292 - DNA, 21 bp, Homo sapiens
ccctcaacaagggagagacct

SEQ ID NO: 2512293 - DNA, 10 bp, Homo sapiens
ccctcacact

SEQ ID NO: 2512294 - DNA, 13 bp, Homo sapiens
ccctcacactggg

SEQ ID NO: 2512295 - DNA, 13 bp, Homo sapiens
ccctcacccctgc

SEQ ID NO: 2512296 - DNA, 14 bp, Homo sapiens
ccctcacctgggca

SEQ ID NO: 2512297 - DNA, 15 bp, Homo sapiens
ccctcacctgggcac

SEQ ID NO: 2512298 - DNA, 14 bp, Homo sapiens
ccctcactctggcc

SEQ ID NO: 2512299 - DNA, 20 bp, Homo sapiens
ccctcagccccaccccaggt

SEQ ID NO: 2512300 - DNA, 21 bp, Homo sapiens
ccctcagcccctcttgccccc

SEQ ID NO: 2512301 - DNA, 21 bp, Homo sapiens
ccctcaggcataggcctgggt

SEQ ID NO: 2512302 - DNA, 22 bp, Homo sapiens
ccctcagggatcttgcattccc

SEQ ID NO: 2512303 - DNA, 17 bp, Homo sapiens
ccctcagggtccctggt

SEQ ID NO: 2512304 - DNA, 21 bp, Homo sapiens
ccctcagggtccctggtggca

SEQ ID NO: 2512305 - DNA, 22 bp, Homo sapiens
ccctcatcaccaacgtctgtgc

SEQ ID NO: 2512306 - DNA, 13 bp, Homo sapiens
ccctcatctctcc

SEQ ID NO: 2512307 - DNA, 17 bp, Homo sapiens
ccctcatggcccctctg

SEQ ID NO: 2512308 - DNA, 21 bp, Homo sapiens
ccctcatggcccctctgacct

SEQ ID NO: 2512309 - DNA, 16 bp, Homo sapiens
ccctccaatcctgccc

SEQ ID NO: 2512310 - DNA, 16 bp, Homo sapiens
ccctccacagccgcag

SEQ ID NO: 2512311 - DNA, 14 bp, Homo sapiens
ccctccaccctgtc

SEQ ID NO: 2512312 - DNA, 12 bp, Homo sapiens
ccctccactgtc

SEQ ID NO: 2512313 - DNA, 20 bp, Homo sapiens
ccctccagcttgtggagccc

SEQ ID NO: 2512314 - DNA, 17 bp, Homo sapiens
ccctccatgtgggctag

SEQ ID NO: 2512315 - DNA, 12 bp, Homo sapiens
ccctcccacagc

SEQ ID NO: 2512316 - DNA, 12 bp, Homo sapiens
ccctcccaccac

SEQ ID NO: 2512317 - DNA, 14 bp, Homo sapiens
ccctcccaccacag

SEQ ID NO: 2512318 - DNA, 14 bp, Homo sapiens
ccctcccatctggg

SEQ ID NO: 2512319 - DNA, 17 bp, Homo sapiens
ccctcccatctgggagt

SEQ ID NO: 2512320 - DNA, 13 bp, Homo sapiens
ccctcccattagg

SEQ ID NO: 2512321 - DNA, 16 bp, Homo sapiens
ccctcccccaaccccc

SEQ ID NO: 2512322 - DNA, 21 bp, Homo sapiens
ccctcccccgccactcctgaa

SEQ ID NO: 2512323 - DNA, 12 bp, Homo sapiens
ccctcccccttg

SEQ ID NO: 2512324 - DNA, 14 bp, Homo sapiens
ccctcccctctctt

SEQ ID NO: 2512325 - DNA, 24 bp, Homo sapiens
ccctcccctctcttgcacccgcct

SEQ ID NO: 2512326 - DNA, 14 bp, Homo sapiens
ccctcccctgccct

SEQ ID NO: 2512327 - DNA, 13 bp, Homo sapiens
ccctccctcagcc

SEQ ID NO: 2512328 - DNA, 15 bp, Homo sapiens
ccctccctggcctgt

SEQ ID NO: 2512329 - DNA, 21 bp, Homo sapiens
ccctcccttggaaacctgccc

SEQ ID NO: 2512330 - DNA, 22 bp, Homo sapiens
ccctcccttggaaacctgccct

SEQ ID NO: 2512331 - DNA, 20 bp, Homo sapiens
ccctccgatccttcctccca

SEQ ID NO: 2512332 - DNA, 21 bp, Homo sapiens
ccctccgccttcactccggtg

SEQ ID NO: 2512333 - DNA, 23 bp, Homo sapiens
ccctcctcacctctggactggct

SEQ ID NO: 2512334 - DNA, 20 bp, Homo sapiens
ccctcctccctttttccttg

SEQ ID NO: 2512335 - DNA, 18 bp, Homo sapiens
ccctcctctagctgtggg

SEQ ID NO: 2512336 - DNA, 19 bp, Homo sapiens
ccctcctctagctgtgggg

SEQ ID NO: 2512337 - DNA, 17 bp, Homo sapiens
ccctcctctcccatccc

SEQ ID NO: 2512338 - DNA, 18 bp, Homo sapiens
ccctcctgaaacttacac

SEQ ID NO: 2512339 - DNA, 13 bp, Homo sapiens
cccagacccagtg

SEQ ID NO: 2512340 - DNA, 19 bp, Homo sapiens
cccagacccctctggccag

SEQ ID NO: 2512341 - DNA, 21 bp, Homo sapiens
cccagacccctctggccagga

SEQ ID NO: 2512342 - DNA, 12 bp, Homo sapiens
cccagagaagcc

SEQ ID NO: 2512343 - DNA, 13 bp, Homo sapiens
cccagagaagcca

SEQ ID NO: 2512344 - DNA, 14 bp, Homo sapiens
cccagagaagcccc

SEQ ID NO: 2512345 - DNA, 21 bp, Homo sapiens
cccagagaagccccttcccca

SEQ ID NO: 2512346 - DNA, 12 bp, Homo sapiens
cccagagcactg

SEQ ID NO: 2512347 - DNA, 21 bp, Homo sapiens
cccagagcaggaggcccctgg

SEQ ID NO: 2512348 - DNA, 21 bp, Homo sapiens
cccagagctgtggactttgtt

SEQ ID NO: 2512349 - DNA, 22 bp, Homo sapiens
cccagaggaaggggccagaggc

SEQ ID NO: 2512350 - DNA, 23 bp, Homo sapiens
cccagaggaaggggccagaggct

SEQ ID NO: 2512351 - DNA, 16 bp, Homo sapiens
cccagaggattgctgc

SEQ ID NO: 2512352 - DNA, 15 bp, Homo sapiens
cccagagggcccagg

SEQ ID NO: 2512353 - DNA, 13 bp, Homo sapiens
cccagaggtaaca

SEQ ID NO: 2512354 - DNA, 22 bp, Homo sapiens
cccagaggtaacagaacagctt

SEQ ID NO: 2512355 - DNA, 12 bp, Homo sapiens
cccagatcctca

SEQ ID NO: 2512356 - DNA, 19 bp, Homo sapiens
cccagatctggtcccttgc

SEQ ID NO: 2512357 - DNA, 20 bp, Homo sapiens
cccagatctggtcccttgca

SEQ ID NO: 2512358 - DNA, 21 bp, Homo sapiens
cccagatgggggaaagcacag

SEQ ID NO: 2512359 - DNA, 22 bp, Homo sapiens
cccagattgcaacaggctgggc

SEQ ID NO: 2512360 - DNA, 15 bp, Homo sapiens
cccagcaacacaagc

SEQ ID NO: 2512361 - DNA, 19 bp, Homo sapiens
cccagcaagtgagagctgg

SEQ ID NO: 2512362 - DNA, 16 bp, Homo sapiens
cccagcactaaagcag

SEQ ID NO: 2512363 - DNA, 17 bp, Homo sapiens
cccagcactaaagcagt

SEQ ID NO: 2512364 - DNA, 21 bp, Homo sapiens
cccagcactgcttgaggaaaa

SEQ ID NO: 2512365 - DNA, 12 bp, Homo sapiens
cccagcactttg

SEQ ID NO: 2512366 - DNA, 17 bp, Homo sapiens
cccagcagccctaagga

SEQ ID NO: 2512367 - DNA, 19 bp, Homo sapiens
cccagcagggcctcaaagt

SEQ ID NO: 2512368 - DNA, 22 bp, Homo sapiens
cccagcagggtcttttcatctg

SEQ ID NO: 2512369 - DNA, 18 bp, Homo sapiens
cccagcattgctggttct

SEQ ID NO: 2512370 - DNA, 12 bp, Homo sapiens
cccagccacccc

SEQ ID NO: 2512371 - DNA, 19 bp, Homo sapiens
cccagccaccccgggctct

SEQ ID NO: 2512372 - DNA, 18 bp, Homo sapiens
cccagccagagttcctgc

SEQ ID NO: 2512373 - DNA, 16 bp, Homo sapiens
cccagccatctgccca

SEQ ID NO: 2512374 - DNA, 20 bp, Homo sapiens
cccagccatctgcccagggg

SEQ ID NO: 2512375 - DNA, 21 bp, Homo sapiens
cccagccatctgcccaggggt

SEQ ID NO: 2512376 - DNA, 23 bp, Homo sapiens
cccagccatctgcccaggggtgc

SEQ ID NO: 2512377 - DNA, 19 bp, Homo sapiens
cccagccattaccatggag

SEQ ID NO: 2512378 - DNA, 12 bp, Homo sapiens
cccagcccaccc

SEQ ID NO: 2512379 - DNA, 17 bp, Homo sapiens
cccagcccacttctgcc

SEQ ID NO: 2512380 - DNA, 23 bp, Homo sapiens
cccagccccaaaactctcctctg

SEQ ID NO: 2512381 - DNA, 17 bp, Homo sapiens
cccagccccaatgaaca

SEQ ID NO: 2512382 - DNA, 14 bp, Homo sapiens
cccagccccatcct

SEQ ID NO: 2512383 - DNA, 16 bp, Homo sapiens
cccagcccccacagtg

SEQ ID NO: 2512384 - DNA, 17 bp, Homo sapiens
cccagcccccacagtgc

SEQ ID NO: 2512385 - DNA, 11 bp, Homo sapiens
cccagcccctt

SEQ ID NO: 2512386 - DNA, 20 bp, Homo sapiens
cccagcccggaccttggcag

SEQ ID NO: 2512387 - DNA, 10 bp, Homo sapiens
cccagccctg

SEQ ID NO: 2512388 - DNA, 14 bp, Homo sapiens
cccagccctgctgg

SEQ ID NO: 2512389 - DNA, 16 bp, Homo sapiens
cccagccctgctggcc

SEQ ID NO: 2512390 - DNA, 19 bp, Homo sapiens
cccagccctgctggccgcc

SEQ ID NO: 2512391 - DNA, 11 bp, Homo sapiens
cccagccctgg

SEQ ID NO: 2512392 - DNA, 20 bp, Homo sapiens
cccagcctccaagctccatc

SEQ ID NO: 2512393 - DNA, 12 bp, Homo sapiens
cccagcctgcta

SEQ ID NO: 2512394 - DNA, 14 bp, Homo sapiens
cccagcgagccctg

SEQ ID NO: 2512395 - DNA, 14 bp, Homo sapiens
cccagcggcccctc

SEQ ID NO: 2512396 - DNA, 19 bp, Homo sapiens
cccagcggcccctcccaca

SEQ ID NO: 2512397 - DNA, 16 bp, Homo sapiens
cccagctacttgggaa

SEQ ID NO: 2512398 - DNA, 12 bp, Homo sapiens
cccagctctggt

SEQ ID NO: 2512399 - DNA, 13 bp, Homo sapiens
cccagctctggtg

SEQ ID NO: 2512400 - DNA, 13 bp, Homo sapiens
cccagctgcacct

SEQ ID NO: 2512401 - DNA, 18 bp, Homo sapiens
cccagctgcacctgccag

SEQ ID NO: 2512402 - DNA, 21 bp, Homo sapiens
cccagctgcacctgccagcct

SEQ ID NO: 2512403 - DNA, 22 bp, Homo sapiens
cccagctgcacctgccagcctg

SEQ ID NO: 2512404 - DNA, 11 bp, Homo sapiens
cccagctggcc

SEQ ID NO: 2512405 - DNA, 20 bp, Homo sapiens
cccagctggcccgtgacaga

SEQ ID NO: 2512406 - DNA, 12 bp, Homo sapiens
cccagctgggag

SEQ ID NO: 2512407 - DNA, 13 bp, Homo sapiens
cccagctgggagg

SEQ ID NO: 2512408 - DNA, 13 bp, Homo sapiens
cccagctgggctc

SEQ ID NO: 2512409 - DNA, 17 bp, Homo sapiens
cccagctgggctctgcc

SEQ ID NO: 2512410 - DNA, 18 bp, Homo sapiens
cccagctgggctctgcca

SEQ ID NO: 2512411 - DNA, 15 bp, Homo sapiens
cccaggaaaggctcc

SEQ ID NO: 2512412 - DNA, 16 bp, Homo sapiens
cccaggaaaggctcca

SEQ ID NO: 2512413 - DNA, 18 bp, Homo sapiens
cccaggaaaggctccagg

SEQ ID NO: 2512414 - DNA, 21 bp, Homo sapiens
cccaggaaaggctccaggagc

SEQ ID NO: 2512415 - DNA, 15 bp, Homo sapiens
cccaggaccagctgg

SEQ ID NO: 2512416 - DNA, 19 bp, Homo sapiens
cccaggaccagctggggcg

SEQ ID NO: 2512417 - DNA, 19 bp, Homo sapiens
cccaggacgcttctgaatg

SEQ ID NO: 2512418 - DNA, 15 bp, Homo sapiens
cccaggaggccagcc

SEQ ID NO: 2512419 - DNA, 14 bp, Homo sapiens
cccaggagggaggg

SEQ ID NO: 2512420 - DNA, 22 bp, Homo sapiens
cccaggagtggaggaggcctgg

SEQ ID NO: 2512421 - DNA, 22 bp, Homo sapiens
cccaggagtttgaggctgcagc

SEQ ID NO: 2512422 - DNA, 14 bp, Homo sapiens
cccaggcaggccac

SEQ ID NO: 2512423 - DNA, 21 bp, Homo sapiens
cccaggcattccccaggaggc

SEQ ID NO: 2512424 - DNA, 22 bp, Homo sapiens
cccaggcattccccaggaggcc

SEQ ID NO: 2512425 - DNA, 23 bp, Homo sapiens
cccaggcattccccaggaggcca

SEQ ID NO: 2512426 - DNA, 20 bp, Homo sapiens
cccaggccaggccaccagga

SEQ ID NO: 2512427 - DNA, 18 bp, Homo sapiens
cccaggccaggctccttc

SEQ ID NO: 2512428 - DNA, 21 bp, Homo sapiens
cccaggccaggctccttcctg

SEQ ID NO: 2512429 - DNA, 21 bp, Homo sapiens
cccaggcccctgccaccctgg

SEQ ID NO: 2512430 - DNA, 18 bp, Homo sapiens
cccaggccgagaagccag

SEQ ID NO: 2512431 - DNA, 13 bp, Homo sapiens
cccaggccgcagc

SEQ ID NO: 2512432 - DNA, 14 bp, Homo sapiens
cccaggccgcagct

SEQ ID NO: 2512433 - DNA, 15 bp, Homo sapiens
cccaggcctgcctgt

SEQ ID NO: 2512434 - DNA, 13 bp, Homo sapiens
cccaggctggcgt

SEQ ID NO: 2512435 - DNA, 13 bp, Homo sapiens
cccaggctgggca

SEQ ID NO: 2512436 - DNA, 16 bp, Homo sapiens
cccaggctggtctcaa

SEQ ID NO: 2512437 - DNA, 20 bp, Homo sapiens
cccagggacaccagccaggc

SEQ ID NO: 2512438 - DNA, 20 bp, Homo sapiens
ccattctgcctccattctga

SEQ ID NO: 2512439 - DNA, 17 bp, Homo sapiens
ccattctgcctgcccag

SEQ ID NO: 2512440 - DNA, 12 bp, Homo sapiens
ccattctggaag

SEQ ID NO: 2512441 - DNA, 19 bp, Homo sapiens
ccattcttcctagttttct

SEQ ID NO: 2512442 - DNA, 20 bp, Homo sapiens
ccattcttcctagttttctc

SEQ ID NO: 2512443 - DNA, 18 bp, Homo sapiens
ccattgcactccagcctg

SEQ ID NO: 2512444 - DNA, 23 bp, Homo sapiens
ccattgcctcctccttcccaaag

SEQ ID NO: 2512445 - DNA, 15 bp, Homo sapiens
ccattggatctcatt

SEQ ID NO: 2512446 - DNA, 19 bp, Homo sapiens
ccattggctatttaaaact

SEQ ID NO: 2512447 - DNA, 20 bp, Homo sapiens
ccattggctatttaaaactt

SEQ ID NO: 2512448 - DNA, 19 bp, Homo sapiens
ccattgtccaatcctatgt

SEQ ID NO: 2512449 - DNA, 10 bp, Homo sapiens
ccattgtctt

SEQ ID NO: 2512450 - DNA, 20 bp, Homo sapiens
ccattgtggctcctatctgt

SEQ ID NO: 2512451 - DNA, 22 bp, Homo sapiens
ccattgtttgaaacaaagaagg

SEQ ID NO: 2512452 - DNA, 22 bp, Homo sapiens
ccatttaaagcttattaaaact

SEQ ID NO: 2512453 - DNA, 16 bp, Homo sapiens
ccatttcatctatttc

SEQ ID NO: 2512454 - DNA, 22 bp, Homo sapiens
ccatttctactcttaagtttct

SEQ ID NO: 2512455 - DNA, 13 bp, Homo sapiens
ccatttctattta

SEQ ID NO: 2512456 - DNA, 16 bp, Homo sapiens
ccatttctcactgaga

SEQ ID NO: 2512457 - DNA, 15 bp, Homo sapiens
ccatttgaaagaaag

SEQ ID NO: 2512458 - DNA, 12 bp, Homo sapiens
ccattttctgtg

SEQ ID NO: 2512459 - DNA, 14 bp, Homo sapiens
ccattttgcaaaat

SEQ ID NO: 2512460 - DNA, 21 bp, Homo sapiens
ccattttgcaaaatttccagt

SEQ ID NO: 2512461 - DNA, 12 bp, Homo sapiens
ccattttgtgaa

SEQ ID NO: 2512462 - DNA, 12 bp, Homo sapiens
cccaaacctcca

SEQ ID NO: 2512463 - DNA, 23 bp, Homo sapiens
cccaaactgttgattattagcca

SEQ ID NO: 2512464 - DNA, 12 bp, Homo sapiens
cccaaagaagga

SEQ ID NO: 2512465 - DNA, 13 bp, Homo sapiens
cccaaagtgctgg

SEQ ID NO: 2512466 - DNA, 21 bp, Homo sapiens
cccaaagtgcttccaaggcag

SEQ ID NO: 2512467 - DNA, 17 bp, Homo sapiens
cccaaataagaagggat

SEQ ID NO: 2512468 - DNA, 18 bp, Homo sapiens
cccaaatggaaatgggca

SEQ ID NO: 2512469 - DNA, 12 bp, Homo sapiens
cccaacactgtg

SEQ ID NO: 2512470 - DNA, 16 bp, Homo sapiens
cccaacactgtgccct

SEQ ID NO: 2512471 - DNA, 19 bp, Homo sapiens
cccaacagatgcttttctg

SEQ ID NO: 2512472 - DNA, 17 bp, Homo sapiens
cccaacaggaggacaat

SEQ ID NO: 2512473 - DNA, 14 bp, Homo sapiens
cccaacagtgtgaa

SEQ ID NO: 2512474 - DNA, 14 bp, Homo sapiens
cccaaccctgcccc

SEQ ID NO: 2512475 - DNA, 15 bp, Homo sapiens
cccaaccctgcccct

SEQ ID NO: 2512476 - DNA, 16 bp, Homo sapiens
cccaaccctgcccctg

SEQ ID NO: 2512477 - DNA, 13 bp, Homo sapiens
cccaacctgctct

SEQ ID NO: 2512478 - DNA, 15 bp, Homo sapiens
cccaactctcctgga

SEQ ID NO: 2512479 - DNA, 20 bp, Homo sapiens
cccaagacagatgccccaga

SEQ ID NO: 2512480 - DNA, 21 bp, Homo sapiens
cccaagacagatgccccagag

SEQ ID NO: 2512481 - DNA, 23 bp, Homo sapiens
cccaagaggtcaaggctgcagtg

SEQ ID NO: 2512482 - DNA, 14 bp, Homo sapiens
cccaagctctgctc

SEQ ID NO: 2512483 - DNA, 22 bp, Homo sapiens
cccaagctgggccccagcccac

SEQ ID NO: 2512484 - DNA, 18 bp, Homo sapiens
cccaagcttggcagccga

SEQ ID NO: 2512485 - DNA, 19 bp, Homo sapiens
cccaaggaaagccccagca

SEQ ID NO: 2512486 - DNA, 21 bp, Homo sapiens
cccaaggactgagggactctg

SEQ ID NO: 2512487 - DNA, 17 bp, Homo sapiens
cccaaggctctgagcaa

SEQ ID NO: 2512488 - DNA, 12 bp, Homo sapiens
cccaagggcctg

SEQ ID NO: 2512489 - DNA, 16 bp, Homo sapiens
cccaagggcctggcct

SEQ ID NO: 2512490 - DNA, 17 bp, Homo sapiens
cccaagggcctggcctg

SEQ ID NO: 2512491 - DNA, 18 bp, Homo sapiens
cccaagtccctgttttct

SEQ ID NO: 2512492 - DNA, 16 bp, Homo sapiens
cccaagtcctgaagag

SEQ ID NO: 2512493 - DNA, 16 bp, Homo sapiens
cccaagtggcagagct

SEQ ID NO: 2512494 - DNA, 16 bp, Homo sapiens
cccaagtgtgaacaaa

SEQ ID NO: 2512495 - DNA, 21 bp, Homo sapiens
cccaataaacattaagattga

SEQ ID NO: 2512496 - DNA, 16 bp, Homo sapiens
cccaatgcactttgtt

SEQ ID NO: 2512497 - DNA, 15 bp, Homo sapiens
cccaatgctgatgtc

SEQ ID NO: 2512498 - DNA, 14 bp, Homo sapiens
cccaattaggaagt

SEQ ID NO: 2512499 - DNA, 19 bp, Homo sapiens
cccaattaggaagtgtaac

SEQ ID NO: 2512500 - DNA, 21 bp, Homo sapiens
cccaattcttacaaacatgtg

SEQ ID NO: 2512501 - DNA, 13 bp, Homo sapiens
cccacaaagcctt

SEQ ID NO: 2512502 - DNA, 22 bp, Homo sapiens
cccacaaagccttatcaagtgt

SEQ ID NO: 2512503 - DNA, 23 bp, Homo sapiens
cccacaatcttaaggggcagctt

SEQ ID NO: 2512504 - DNA, 13 bp, Homo sapiens
cccacacacacac

SEQ ID NO: 2512505 - DNA, 14 bp, Homo sapiens
cccacacacacaca

SEQ ID NO: 2512506 - DNA, 22 bp, Homo sapiens
cccacacctcagttcccttggc

SEQ ID NO: 2512507 - DNA, 19 bp, Homo sapiens
cccacacctccacagttca

SEQ ID NO: 2512508 - DNA, 24 bp, Homo sapiens
cccacacctccacagttcagtggc

SEQ ID NO: 2512509 - DNA, 14 bp, Homo sapiens
cccacactaacctg

SEQ ID NO: 2512510 - DNA, 16 bp, Homo sapiens
cccacactcactcctg

SEQ ID NO: 2512511 - DNA, 19 bp, Homo sapiens
cccacactggggtgccgcc

SEQ ID NO: 2512512 - DNA, 19 bp, Homo sapiens
cccacacttgagaggatga

SEQ ID NO: 2512513 - DNA, 17 bp, Homo sapiens
cccacacttgttccagc

SEQ ID NO: 2512514 - DNA, 15 bp, Homo sapiens
cccacagtgctgtct

SEQ ID NO: 2512515 - DNA, 13 bp, Homo sapiens
cccacatcccagg

SEQ ID NO: 2512516 - DNA, 14 bp, Homo sapiens
cccaccacggccac

SEQ ID NO: 2512517 - DNA, 21 bp, Homo sapiens
cccaccacggccactggccat

SEQ ID NO: 2512518 - DNA, 22 bp, Homo sapiens
cccaccaggctgctcagggctg

SEQ ID NO: 2512519 - DNA, 18 bp, Homo sapiens
cccaccatcatgtctggc

SEQ ID NO: 2512520 - DNA, 16 bp, Homo sapiens
cccacccaagcttggc

SEQ ID NO: 2512521 - DNA, 21 bp, Homo sapiens
cccacccaagggcctggcctg

SEQ ID NO: 2512522 - DNA, 22 bp, Homo sapiens
cccacccaagggcctggcctga

SEQ ID NO: 2512523 - DNA, 14 bp, Homo sapiens
cccaccccacactt

SEQ ID NO: 2512524 - DNA, 14 bp, Homo sapiens
cccaccccagccta

SEQ ID NO: 2512525 - DNA, 12 bp, Homo sapiens
cccacccccatc

SEQ ID NO: 2512526 - DNA, 12 bp, Homo sapiens
cccacccctgtg

SEQ ID NO: 2512527 - DNA, 14 bp, Homo sapiens
cctcccgggccctc

SEQ ID NO: 2512528 - DNA, 16 bp, Homo sapiens
cctcccgggccctccc

SEQ ID NO: 2512529 - DNA, 19 bp, Homo sapiens
cctcccgggccctcccttg

SEQ ID NO: 2512530 - DNA, 11 bp, Homo sapiens
cctccctcagc

SEQ ID NO: 2512531 - DNA, 12 bp, Homo sapiens
cctccctcagcc

SEQ ID NO: 2512532 - DNA, 14 bp, Homo sapiens
cctccctcagcccc

SEQ ID NO: 2512533 - DNA, 14 bp, Homo sapiens
cctccctcccggca

SEQ ID NO: 2512534 - DNA, 12 bp, Homo sapiens
cctccctcctgc

SEQ ID NO: 2512535 - DNA, 13 bp, Homo sapiens
cctccctctctct

SEQ ID NO: 2512536 - DNA, 20 bp, Homo sapiens
cctccctctctcttctgctc

SEQ ID NO: 2512537 - DNA, 14 bp, Homo sapiens
cctccctctgacct

SEQ ID NO: 2512538 - DNA, 14 bp, Homo sapiens
cctccctctgaggc

SEQ ID NO: 2512539 - DNA, 19 bp, Homo sapiens
cctccctctgaggctgtag

SEQ ID NO: 2512540 - DNA, 20 bp, Homo sapiens
cctccctgaaaatgtttttc

SEQ ID NO: 2512541 - DNA, 23 bp, Homo sapiens
cctccctggagtgtggctgagga

SEQ ID NO: 2512542 - DNA, 15 bp, Homo sapiens
cctccctggcctgtt

SEQ ID NO: 2512543 - DNA, 12 bp, Homo sapiens
cctccctggctc

SEQ ID NO: 2512544 - DNA, 14 bp, Homo sapiens
cctccctggctccc

SEQ ID NO: 2512545 - DNA, 16 bp, Homo sapiens
cctccctggctcccat

SEQ ID NO: 2512546 - DNA, 18 bp, Homo sapiens
cctccctggctcccatga

SEQ ID NO: 2512547 - DNA, 23 bp, Homo sapiens
cctccctggctgccctggccctg

SEQ ID NO: 2512548 - DNA, 15 bp, Homo sapiens
cctccctgggttcag

SEQ ID NO: 2512549 - DNA, 23 bp, Homo sapiens
cctccctgtcaaagctgtcactt

SEQ ID NO: 2512550 - DNA, 21 bp, Homo sapiens
cctcccttggaaacctgccct

SEQ ID NO: 2512551 - DNA, 23 bp, Homo sapiens
cctcccttggaaacctgccctgc

SEQ ID NO: 2512552 - DNA, 19 bp, Homo sapiens
cctcccttgggttctgata

SEQ ID NO: 2512553 - DNA, 16 bp, Homo sapiens
cctccgatccttcctc

SEQ ID NO: 2512554 - DNA, 17 bp, Homo sapiens
cctccggcgtcagcctc

SEQ ID NO: 2512555 - DNA, 18 bp, Homo sapiens
cctccggcgtcagcctcc

SEQ ID NO: 2512556 - DNA, 19 bp, Homo sapiens
cctccggcgtcagcctcca

SEQ ID NO: 2512557 - DNA, 15 bp, Homo sapiens
cctcctaagagagag

SEQ ID NO: 2512558 - DNA, 19 bp, Homo sapiens
cctcctaccgaaaccttgc

SEQ ID NO: 2512559 - DNA, 22 bp, Homo sapiens
cctcctaccgaaaccttgcctt

SEQ ID NO: 2512560 - DNA, 13 bp, Homo sapiens
cctcctcaccccc

SEQ ID NO: 2512561 - DNA, 14 bp, Homo sapiens
cctcctcaccccca

SEQ ID NO: 2512562 - DNA, 15 bp, Homo sapiens
cctcctcacctctgg

SEQ ID NO: 2512563 - DNA, 16 bp, Homo sapiens
cctcctcacctctgga

SEQ ID NO: 2512564 - DNA, 20 bp, Homo sapiens
cctcctcatcccgtgttctc

SEQ ID NO: 2512565 - DNA, 23 bp, Homo sapiens
cctcctcatcccgtgttctcctt

SEQ ID NO: 2512566 - DNA, 20 bp, Homo sapiens
cctcctcatgtacataccct

SEQ ID NO: 2512567 - DNA, 21 bp, Homo sapiens
cctcctcatgtacataccctg

SEQ ID NO: 2512568 - DNA, 15 bp, Homo sapiens
cctcctccacaccag

SEQ ID NO: 2512569 - DNA, 13 bp, Homo sapiens
cctcctccccact

SEQ ID NO: 2512570 - DNA, 17 bp, Homo sapiens
cctcctccctttttcct

SEQ ID NO: 2512571 - DNA, 22 bp, Homo sapiens
cctcctccctttttccttgtcc

SEQ ID NO: 2512572 - DNA, 19 bp, Homo sapiens
cctcctctcccatccccct

SEQ ID NO: 2512573 - DNA, 12 bp, Homo sapiens
cctcctctgtcc

SEQ ID NO: 2512574 - DNA, 15 bp, Homo sapiens
cctcctctgtccagg

SEQ ID NO: 2512575 - DNA, 16 bp, Homo sapiens
cctcctctgtccaggg

SEQ ID NO: 2512576 - DNA, 13 bp, Homo sapiens
cctcctctgtctg

SEQ ID NO: 2512577 - DNA, 13 bp, Homo sapiens
cctcctctgtgaa

SEQ ID NO: 2512578 - DNA, 22 bp, Homo sapiens
cctcctctgtgaccaatgtctt

SEQ ID NO: 2512579 - DNA, 14 bp, Homo sapiens
cctcctcttctgac

SEQ ID NO: 2512580 - DNA, 12 bp, Homo sapiens
cctcctgcccac

SEQ ID NO: 2512581 - DNA, 23 bp, Homo sapiens
cctcctgcgcgcatgtgcgcaca

SEQ ID NO: 2512582 - DNA, 18 bp, Homo sapiens
cctcctgggatctgctcg

SEQ ID NO: 2512583 - DNA, 14 bp, Homo sapiens
cctcctgggcccct

SEQ ID NO: 2512584 - DNA, 19 bp, Homo sapiens
cctcctggtgggtccaggg

SEQ ID NO: 2512585 - DNA, 20 bp, Homo sapiens
cctcctggtgggtccagggg

SEQ ID NO: 2512586 - DNA, 13 bp, Homo sapiens
cctcctgtgtgtg

SEQ ID NO: 2512587 - DNA, 21 bp, Homo sapiens
cctcctgttgcacccagccct

SEQ ID NO: 2512588 - DNA, 22 bp, Homo sapiens
cctcctgttgcacccagccctg

SEQ ID NO: 2512589 - DNA, 17 bp, Homo sapiens
cctccttccacctccct

SEQ ID NO: 2512590 - DNA, 18 bp, Homo sapiens
cctccttccacctccctc

SEQ ID NO: 2512591 - DNA, 16 bp, Homo sapiens
cctccttctccctttt

SEQ ID NO: 2512592 - DNA, 22 bp, Homo sapiens
cctccttctctgtctcatgtgt

SEQ ID NO: 2512593 - DNA, 20 bp, Homo sapiens
cctccttgcctcctgtgtaa

SEQ ID NO: 2512594 - DNA, 15 bp, Homo sapiens
cctccttgctctgca

SEQ ID NO: 2512595 - DNA, 22 bp, Homo sapiens
cctccttgctctgcaggcacct

SEQ ID NO: 2512596 - DNA, 17 bp, Homo sapiens
cctccttggtgcctggc

SEQ ID NO: 2512597 - DNA, 20 bp, Homo sapiens
cctcctttgtgaggaagccg

SEQ ID NO: 2512598 - DNA, 18 bp, Homo sapiens
cctccttttgcttgaaac

SEQ ID NO: 2512599 - DNA, 15 bp, Homo sapiens
cctcgaactggctgc

SEQ ID NO: 2512600 - DNA, 16 bp, Homo sapiens
cctcgaactggctgca

SEQ ID NO: 2512601 - DNA, 20 bp, Homo sapiens
cctcgctgccagctctgtat

SEQ ID NO: 2512602 - DNA, 13 bp, Homo sapiens
cctcgctgcttct

SEQ ID NO: 2512603 - DNA, 18 bp, Homo sapiens
cctcgctggactctcagt

SEQ ID NO: 2512604 - DNA, 14 bp, Homo sapiens
cctcgggcccacct

SEQ ID NO: 2512605 - DNA, 17 bp, Homo sapiens
cctcgggcccacctggc

SEQ ID NO: 2512606 - DNA, 20 bp, Homo sapiens
cctcgggcccacctggccac

SEQ ID NO: 2512607 - DNA, 21 bp, Homo sapiens
cctcgggcccacctggccacc

SEQ ID NO: 2512608 - DNA, 16 bp, Homo sapiens
cctcgggcccagcccc

SEQ ID NO: 2512609 - DNA, 17 bp, Homo sapiens
cctcgggcccagccccc

SEQ ID NO: 2512610 - DNA, 15 bp, Homo sapiens
cctcgggtctcctca

SEQ ID NO: 2512611 - DNA, 18 bp, Homo sapiens
cctcggtgtggagaagcg

SEQ ID NO: 2512612 - DNA, 17 bp, Homo sapiens
cctcgtggccagcccgg

SEQ ID NO: 2512613 - DNA, 21 bp, Homo sapiens
cctctaaccccaggccccgag

SEQ ID NO: 2512614 - DNA, 18 bp, Homo sapiens
cctctacagagcttccct

SEQ ID NO: 2512615 - DNA, 20 bp, Homo sapiens
cctctacagagcttccctga

SEQ ID NO: 2512616 - DNA, 20 bp, Homo sapiens
cctctacttaatgagatagt

SEQ ID NO: 2512617 - DNA, 22 bp, Homo sapiens
cctctagctgtgggggtgaggg

SEQ ID NO: 2512618 - DNA, 18 bp, Homo sapiens
cctctagggacccctcct

SEQ ID NO: 2512619 - DNA, 20 bp, Homo sapiens
cctctagggacccctcctcc

SEQ ID NO: 2512620 - DNA, 21 bp, Homo sapiens
cctctcagagctacttgggcc

SEQ ID NO: 2512621 - DNA, 13 bp, Homo sapiens
cctctcagctcca

SEQ ID NO: 2512622 - DNA, 21 bp, Homo sapiens
cctctcaggcatgcctgtgtg

SEQ ID NO: 2512623 - DNA, 19 bp, Homo sapiens
cctctccaagggcttctgc

SEQ ID NO: 2512624 - DNA, 13 bp, Homo sapiens
cctctccaggcac

SEQ ID NO: 2512625 - DNA, 14 bp, Homo sapiens
cctctccaggcacc

SEQ ID NO: 2512626 - DNA, 16 bp, Homo sapiens
cctctccatcttcagc

SEQ ID NO: 2512627 - DNA, 11 bp, Homo sapiens
cctctcccagg

SEQ ID NO: 2512628 - DNA, 12 bp, Homo sapiens
cctctcccagga

SEQ ID NO: 2512629 - DNA, 13 bp, Homo sapiens
cctctcccaggac

SEQ ID NO: 2512630 - DNA, 18 bp, Homo sapiens
cctctcccatccccctgc

SEQ ID NO: 2512631 - DNA, 22 bp, Homo sapiens
cctctcccatccccctgccctc

SEQ ID NO: 2512632 - DNA, 19 bp, Homo sapiens
cctctcccccccccctcca

SEQ ID NO: 2512633 - DNA, 20 bp, Homo sapiens
cctctcccccccccctccaa

SEQ ID NO: 2512634 - DNA, 23 bp, Homo sapiens
cctctcccctaccactgtcttct

SEQ ID NO: 2512635 - DNA, 11 bp, Homo sapiens
cctctccctca

SEQ ID NO: 2512636 - DNA, 10 bp, Homo sapiens
cctctccctg

SEQ ID NO: 2512637 - DNA, 13 bp, Homo sapiens
cctctccctggcc

SEQ ID NO: 2512638 - DNA, 13 bp, Homo sapiens
cctctccctgttg

SEQ ID NO: 2512639 - DNA, 13 bp, Homo sapiens
cctctcccttgga

SEQ ID NO: 2512640 - DNA, 12 bp, Homo sapiens
cctctcctggag

SEQ ID NO: 2512641 - DNA, 15 bp, Homo sapiens
cctctcctggaggat

SEQ ID NO: 2512642 - DNA, 16 bp, Homo sapiens
cctctcgagggcaggg

SEQ ID NO: 2512643 - DNA, 19 bp, Homo sapiens
cctctcggtggccagcagg

SEQ ID NO: 2512644 - DNA, 17 bp, Homo sapiens
cctctctcactccttga

SEQ ID NO: 2512645 - DNA, 12 bp, Homo sapiens
cctctctctgac

SEQ ID NO: 2512646 - DNA, 15 bp, Homo sapiens
cctctctctgactct

SEQ ID NO: 2512647 - DNA, 12 bp, Homo sapiens
cctctgcctgtc

SEQ ID NO: 2512648 - DNA, 16 bp, Homo sapiens
cctctgcctgtccctc

SEQ ID NO: 2512649 - DNA, 19 bp, Homo sapiens
cctctgcctgtctccccca

SEQ ID NO: 2512650 - DNA, 18 bp, Homo sapiens
cctctgctcctggagcct

SEQ ID NO: 2512651 - DNA, 17 bp, Homo sapiens
cctctgctgctggctgg

SEQ ID NO: 2512652 - DNA, 14 bp, Homo sapiens
cctctggactggct

SEQ ID NO: 2512653 - DNA, 22 bp, Homo sapiens
cctctggaggggtgtggctcct

SEQ ID NO: 2512654 - DNA, 23 bp, Homo sapiens
cctctgggaaatgagaaggcagc

SEQ ID NO: 2512655 - DNA, 18 bp, Homo sapiens
cctctgtacagagcccac

SEQ ID NO: 2512656 - DNA, 23 bp, Homo sapiens
cctctgtacagagcccacgcccc

SEQ ID NO: 2512657 - DNA, 19 bp, Homo sapiens
cctctgtccaggcactgag

SEQ ID NO: 2512658 - DNA, 23 bp, Homo sapiens
cctctgtccagggccctgagctc

SEQ ID NO: 2512659 - DNA, 22 bp, Homo sapiens
cctctgtctgcccttcacccca

SEQ ID NO: 2512660 - DNA, 18 bp, Homo sapiens
cctctgtgaccaatgtct

SEQ ID NO: 2512661 - DNA, 21 bp, Homo sapiens
cctctgtgaccaatgtcttga

SEQ ID NO: 2512662 - DNA, 16 bp, Homo sapiens
cctctgttcagtgtaa

SEQ ID NO: 2512663 - DNA, 17 bp, Homo sapiens
cctcttaaaaaataaaa

SEQ ID NO: 2512664 - DNA, 19 bp, Homo sapiens
cctcttaaaaaataaaaac

SEQ ID NO: 2512665 - DNA, 19 bp, Homo sapiens
cctcttaaagaaaacccac

SEQ ID NO: 2512666 - DNA, 20 bp, Homo sapiens
cctcttaaagaaaacccacc

SEQ ID NO: 2512667 - DNA, 19 bp, Homo sapiens
cctcttaaagctgcctgta

SEQ ID NO: 2512668 - DNA, 21 bp, Homo sapiens
cctcttaatgtatgattacat

SEQ ID NO: 2512669 - DNA, 17 bp, Homo sapiens
cctcttagctgagtgga

SEQ ID NO: 2512670 - DNA, 14 bp, Homo sapiens
cctcttatgggctg

SEQ ID NO: 2512671 - DNA, 13 bp, Homo sapiens
cctcttcagaggc

SEQ ID NO: 2512672 - DNA, 14 bp, Homo sapiens
cctcttcagaggcc

SEQ ID NO: 2512673 - DNA, 13 bp, Homo sapiens
cctcttccccaga

SEQ ID NO: 2512674 - DNA, 14 bp, Homo sapiens
cctcttccccagaa

SEQ ID NO: 2512675 - DNA, 22 bp, Homo sapiens
cctcttccccagaaaggagact

SEQ ID NO: 2512676 - DNA, 17 bp, Homo sapiens
cctcttccccttgccct

SEQ ID NO: 2512677 - DNA, 15 bp, Homo sapiens
cctcttcctccctca

SEQ ID NO: 2512678 - DNA, 11 bp, Homo sapiens
cctcttcctct

SEQ ID NO: 2512679 - DNA, 18 bp, Homo sapiens
cctcttctattttgtaaa

SEQ ID NO: 2512680 - DNA, 19 bp, Homo sapiens
cctcttctcaagtgcctta

SEQ ID NO: 2512681 - DNA, 17 bp, Homo sapiens
cctcttctgggagggca

SEQ ID NO: 2512682 - DNA, 13 bp, Homo sapiens
cctcttgagcctt

SEQ ID NO: 2512683 - DNA, 16 bp, Homo sapiens
cctcttgccccccacc

SEQ ID NO: 2512684 - DNA, 17 bp, Homo sapiens
cctcttggacctctgct

SEQ ID NO: 2512685 - DNA, 13 bp, Homo sapiens
cctcttgggttca

SEQ ID NO: 2512686 - DNA, 21 bp, Homo sapiens
cctcttggtcttcccaggctg

SEQ ID NO: 2512687 - DNA, 18 bp, Homo sapiens
cctctttggctcccctgt

SEQ ID NO: 2512688 - DNA, 19 bp, Homo sapiens
cctctttggctcccctgta

SEQ ID NO: 2512689 - DNA, 19 bp, Homo sapiens
cctctttgtctaaaacaat

SEQ ID NO: 2512690 - DNA, 21 bp, Homo sapiens
cctgaaaatgtttttctgcca

SEQ ID NO: 2512691 - DNA, 23 bp, Homo sapiens
cctgaaaatgtttttctgccagg

SEQ ID NO: 2512692 - DNA, 15 bp, Homo sapiens
cctgaaacttatttt

SEQ ID NO: 2512693 - DNA, 14 bp, Homo sapiens
cctgaaagccctga

SEQ ID NO: 2512694 - DNA, 19 bp, Homo sapiens
cctgaactgggacctttag

SEQ ID NO: 2512695 - DNA, 23 bp, Homo sapiens
cctgaagaggcgggccagccagg

SEQ ID NO: 2512696 - DNA, 21 bp, Homo sapiens
cctgaaggaacattccttagt

SEQ ID NO: 2512697 - DNA, 21 bp, Homo sapiens
cctgaaggccccgcccaggct

SEQ ID NO: 2512698 - DNA, 22 bp, Homo sapiens
cctgaaggccccgcccaggctt

SEQ ID NO: 2512699 - DNA, 15 bp, Homo sapiens
cctgaagtcacacag

SEQ ID NO: 2512700 - DNA, 17 bp, Homo sapiens
cctgaatccaaactaat

SEQ ID NO: 2512701 - DNA, 20 bp, Homo sapiens
cctgaatccaaactaatcca

SEQ ID NO: 2512702 - DNA, 20 bp, Homo sapiens
cctgaatcccccttgccacc

SEQ ID NO: 2512703 - DNA, 22 bp, Homo sapiens
cctgaatcccccttgccacccc

SEQ ID NO: 2512704 - DNA, 13 bp, Homo sapiens
cctgaatgaaata

SEQ ID NO: 2512705 - DNA, 22 bp, Homo sapiens
cctgaatggttccatgcctgag

SEQ ID NO: 2512706 - DNA, 23 bp, Homo sapiens
cctgaatggttccatgcctgagg

SEQ ID NO: 2512707 - DNA, 23 bp, Homo sapiens
cctgaatgtattgaacttggaaa

SEQ ID NO: 2512708 - DNA, 14 bp, Homo sapiens
cctgaattctattt

SEQ ID NO: 2512709 - DNA, 15 bp, Homo sapiens
cctgaattctttttc

SEQ ID NO: 2512710 - DNA, 14 bp, Homo sapiens
cctgacaacactca

SEQ ID NO: 2512711 - DNA, 23 bp, Homo sapiens
cctgacaacactcattgacctga

SEQ ID NO: 2512712 - DNA, 14 bp, Homo sapiens
cctgacaagcactg

SEQ ID NO: 2512713 - DNA, 19 bp, Homo sapiens
cctgacaagcactgctagg

SEQ ID NO: 2512714 - DNA, 13 bp, Homo sapiens
cctgacactttaa

SEQ ID NO: 2512715 - DNA, 20 bp, Homo sapiens
cctgacagatgtcagccgag

SEQ ID NO: 2512716 - DNA, 13 bp, Homo sapiens
cctgaccaccctc

SEQ ID NO: 2512717 - DNA, 18 bp, Homo sapiens
cctgaccaccctcccctc

SEQ ID NO: 2512718 - DNA, 14 bp, Homo sapiens
cctgacccaggccg

SEQ ID NO: 2512719 - DNA, 15 bp, Homo sapiens
cctgacccaggccgc

SEQ ID NO: 2512720 - DNA, 21 bp, Homo sapiens
cctgacccaggccgcagctct

SEQ ID NO: 2512721 - DNA, 16 bp, Homo sapiens
cctgacccctgctcag

SEQ ID NO: 2512722 - DNA, 22 bp, Homo sapiens
cctgacccgtctaatatataaa

SEQ ID NO: 2512723 - DNA, 16 bp, Homo sapiens
cctgaccgtgggcggg

SEQ ID NO: 2512724 - DNA, 14 bp, Homo sapiens
cctgacctcccagc

SEQ ID NO: 2512725 - DNA, 14 bp, Homo sapiens
cctgacctgaggct

SEQ ID NO: 2512726 - DNA, 22 bp, Homo sapiens
cctgaccttgaggagtcttgtg

SEQ ID NO: 2512727 - DNA, 23 bp, Homo sapiens
cctgaccttgaggagtcttgtgt

SEQ ID NO: 2512728 - DNA, 13 bp, Homo sapiens
cctgactcattct

SEQ ID NO: 2512729 - DNA, 15 bp, Homo sapiens
cctgactcctctaag

SEQ ID NO: 2512730 - DNA, 15 bp, Homo sapiens
cctgactctgccccc

SEQ ID NO: 2512731 - DNA, 16 bp, Homo sapiens
cctgactctgccccct

SEQ ID NO: 2512732 - DNA, 23 bp, Homo sapiens
cctgactggtgctataggctgga

SEQ ID NO: 2512733 - DNA, 22 bp, Homo sapiens
cctgagaagtgtctaaaaacac

SEQ ID NO: 2512734 - DNA, 15 bp, Homo sapiens
cctgagacccctggc

SEQ ID NO: 2512735 - DNA, 18 bp, Homo sapiens
cctgagacccctggcctc

SEQ ID NO: 2512736 - DNA, 20 bp, Homo sapiens
cctgagacccctggcctccg

SEQ ID NO: 2512737 - DNA, 20 bp, Homo sapiens
cctgagccccttccttgctc

SEQ ID NO: 2512738 - DNA, 18 bp, Homo sapiens
cctgagctagaagctgga

SEQ ID NO: 2512739 - DNA, 16 bp, Homo sapiens
cctgagctcggtggac

SEQ ID NO: 2512740 - DNA, 20 bp, Homo sapiens
cctgagctcggtggacccag

SEQ ID NO: 2512741 - DNA, 22 bp, Homo sapiens
cctgagctcggtggacccaggg

SEQ ID NO: 2512742 - DNA, 14 bp, Homo sapiens
cctgagctctgata

SEQ ID NO: 2512743 - DNA, 18 bp, Homo sapiens
cctgagcttggccagaag

SEQ ID NO: 2512744 - DNA, 19 bp, Homo sapiens
cctgaggaagagggactgt

SEQ ID NO: 2512745 - DNA, 17 bp, Homo sapiens
cctgaggcccagagggc

SEQ ID NO: 2512746 - DNA, 18 bp, Homo sapiens
cctgaggcccagagggcc

SEQ ID NO: 2512747 - DNA, 16 bp, Homo sapiens
cctgaggcccttctct

SEQ ID NO: 2512748 - DNA, 19 bp, Homo sapiens
cctgaggcccttctctcca

SEQ ID NO: 2512749 - DNA, 21 bp, Homo sapiens
cctgaggcccttctctccagc

SEQ ID NO: 2512750 - DNA, 17 bp, Homo sapiens
cctgaggctcctgtgct

SEQ ID NO: 2512751 - DNA, 13 bp, Homo sapiens
cctgaggctgggc

SEQ ID NO: 2512752 - DNA, 16 bp, Homo sapiens
cctgaggctgggctcc

SEQ ID NO: 2512753 - DNA, 19 bp, Homo sapiens
cctgaggctgggctccctt

SEQ ID NO: 2512754 - DNA, 22 bp, Homo sapiens
cctgagggcagaaaggttctgc

SEQ ID NO: 2512755 - DNA, 18 bp, Homo sapiens
cctgagggcccctctgcc

SEQ ID NO: 2512756 - DNA, 17 bp, Homo sapiens
cctgaggtgggcccagg

SEQ ID NO: 2512757 - DNA, 12 bp, Homo sapiens
cctgtaaacctg

SEQ ID NO: 2512758 - DNA, 13 bp, Homo sapiens
cctgtaaacctga

SEQ ID NO: 2512759 - DNA, 19 bp, Homo sapiens
cctgtaaatggtgtacata

SEQ ID NO: 2512760 - DNA, 19 bp, Homo sapiens
cctgtaacacaagccacag

SEQ ID NO: 2512761 - DNA, 20 bp, Homo sapiens
cctgtaacacaagccacaga

SEQ ID NO: 2512762 - DNA, 18 bp, Homo sapiens
cctgtaacttgagagtag

SEQ ID NO: 2512763 - DNA, 15 bp, Homo sapiens
cctgtaatcacagct

SEQ ID NO: 2512764 - DNA, 14 bp, Homo sapiens
cctgtaatcccagc

SEQ ID NO: 2512765 - DNA, 23 bp, Homo sapiens
cctgtaattgttgtttgtatgta

SEQ ID NO: 2512766 - DNA, 12 bp, Homo sapiens
cctgtacactga

SEQ ID NO: 2512767 - DNA, 21 bp, Homo sapiens
cctgtacactgaatatttata

SEQ ID NO: 2512768 - DNA, 23 bp, Homo sapiens
cctgtaccttttgaggagcccca

SEQ ID NO: 2512769 - DNA, 13 bp, Homo sapiens
cctgtactcagga

SEQ ID NO: 2512770 - DNA, 14 bp, Homo sapiens
cctgtactcaggag

SEQ ID NO: 2512771 - DNA, 15 bp, Homo sapiens
cctgtactcaggagg

SEQ ID NO: 2512772 - DNA, 15 bp, Homo sapiens
cctgtactcttccga

SEQ ID NO: 2512773 - DNA, 14 bp, Homo sapiens
cctgtagagctaga

SEQ ID NO: 2512774 - DNA, 15 bp, Homo sapiens
cctgtagcatcttct

SEQ ID NO: 2512775 - DNA, 16 bp, Homo sapiens
cctgtagccttctgta

SEQ ID NO: 2512776 - DNA, 19 bp, Homo sapiens
cctgtagccttctgtagga

SEQ ID NO: 2512777 - DNA, 14 bp, Homo sapiens
cctgtagtcccagc

SEQ ID NO: 2512778 - DNA, 18 bp, Homo sapiens
cctgtagtcccagccact

SEQ ID NO: 2512779 - DNA, 19 bp, Homo sapiens
cctgtagtcccagccactc

SEQ ID NO: 2512780 - DNA, 15 bp, Homo sapiens
cctgtagttaggaaa

SEQ ID NO: 2512781 - DNA, 16 bp, Homo sapiens
cctgtagttaggaaat

SEQ ID NO: 2512782 - DNA, 17 bp, Homo sapiens
cctgtagttaggaaata

SEQ ID NO: 2512783 - DNA, 21 bp, Homo sapiens
cctgtagttaggaaataaaac

SEQ ID NO: 2512784 - DNA, 22 bp, Homo sapiens
cctgtagttaggaaataaaacc

SEQ ID NO: 2512785 - DNA, 19 bp, Homo sapiens
cctgtagttgcgtggactc

SEQ ID NO: 2512786 - DNA, 20 bp, Homo sapiens
cctgtagttgcgtggactct

SEQ ID NO: 2512787 - DNA, 22 bp, Homo sapiens
cctgtatagttaggatagcatt

SEQ ID NO: 2512788 - DNA, 16 bp, Homo sapiens
cctgtatgtctccagt

SEQ ID NO: 2512789 - DNA, 14 bp, Homo sapiens
cctgtatgttgtcc

SEQ ID NO: 2512790 - DNA, 23 bp, Homo sapiens
cctgtcaaacaaagccagaagct

SEQ ID NO: 2512791 - DNA, 12 bp, Homo sapiens
cctgtcatgccc

SEQ ID NO: 2512792 - DNA, 16 bp, Homo sapiens
cctgtcatgcccccct

SEQ ID NO: 2512793 - DNA, 22 bp, Homo sapiens
cctgtcattcccaccaccctga

SEQ ID NO: 2512794 - DNA, 19 bp, Homo sapiens
cctgtccaaactgcctaag

SEQ ID NO: 2512795 - DNA, 23 bp, Homo sapiens
cctgtccaaactgcctaagccct

SEQ ID NO: 2512796 - DNA, 14 bp, Homo sapiens
cctgtccagcctgg

SEQ ID NO: 2512797 - DNA, 22 bp, Homo sapiens
cctgtccagcctgggcagccag

SEQ ID NO: 2512798 - DNA, 15 bp, Homo sapiens
cctgtcccaccccca

SEQ ID NO: 2512799 - DNA, 13 bp, Homo sapiens
cctgtcccacctc

SEQ ID NO: 2512800 - DNA, 14 bp, Homo sapiens
cctgtcccacctct

SEQ ID NO: 2512801 - DNA, 13 bp, Homo sapiens
cctgtcccccagc

SEQ ID NO: 2512802 - DNA, 17 bp, Homo sapiens
cctgtcccccagctctg

SEQ ID NO: 2512803 - DNA, 12 bp, Homo sapiens
cctgtccccctg

SEQ ID NO: 2512804 - DNA, 14 bp, Homo sapiens
cctgtccccctgac

SEQ ID NO: 2512805 - DNA, 16 bp, Homo sapiens
cctgtccctctcaggc

SEQ ID NO: 2512806 - DNA, 19 bp, Homo sapiens
cctgtcctgacctgtctca

SEQ ID NO: 2512807 - DNA, 13 bp, Homo sapiens
cctgtcctgatgg

SEQ ID NO: 2512808 - DNA, 14 bp, Homo sapiens
cctgtcgagacact

SEQ ID NO: 2512809 - DNA, 17 bp, Homo sapiens
cctgtctcatccccagg

SEQ ID NO: 2512810 - DNA, 17 bp, Homo sapiens
cctgtctctactaaaaa

SEQ ID NO: 2512811 - DNA, 15 bp, Homo sapiens
cctgtctgccagcca

SEQ ID NO: 2512812 - DNA, 17 bp, Homo sapiens
cctgtctgccagccagc

SEQ ID NO: 2512813 - DNA, 21 bp, Homo sapiens
cctgtctgccagccagcagcc

SEQ ID NO: 2512814 - DNA, 23 bp, Homo sapiens
cctgtctgtagagggccctggtg

SEQ ID NO: 2512815 - DNA, 17 bp, Homo sapiens
cctgtctgtctctccat

SEQ ID NO: 2512816 - DNA, 18 bp, Homo sapiens
cctgtctgtctctccatc

SEQ ID NO: 2512817 - DNA, 20 bp, Homo sapiens
ccggactgcaagcagggctc

SEQ ID NO: 2512818 - DNA, 14 bp, Homo sapiens
ccggagatgtagca

SEQ ID NO: 2512819 - DNA, 12 bp, Homo sapiens
ccggagggccct

SEQ ID NO: 2512820 - DNA, 22 bp, Homo sapiens
ccggcaaccccagttctgctcc

SEQ ID NO: 2512821 - DNA, 14 bp, Homo sapiens
agagcaagactctg

SEQ ID NO: 2512822 - DNA, 17 bp, Homo sapiens
agagcacccctctctgc

SEQ ID NO: 2512823 - DNA, 19 bp, Homo sapiens
agagcacctagtccagtga

SEQ ID NO: 2512824 - DNA, 22 bp, Homo sapiens
agagcaccttagacagtccctg

SEQ ID NO: 2512825 - DNA, 21 bp, Homo sapiens
agagcaccttcctcacttcca

SEQ ID NO: 2512826 - DNA, 12 bp, Homo sapiens
agagcagagacc

SEQ ID NO: 2512827 - DNA, 14 bp, Homo sapiens
agagcagaggcagc

SEQ ID NO: 2512828 - DNA, 18 bp, Homo sapiens
agagcagatgcagagagc

SEQ ID NO: 2512829 - DNA, 16 bp, Homo sapiens
agagcagcctgtggca

SEQ ID NO: 2512830 - DNA, 20 bp, Homo sapiens
agagcagctttaaactcagg

SEQ ID NO: 2512831 - DNA, 21 bp, Homo sapiens
agagcagctttaaactcaggg

SEQ ID NO: 2512832 - DNA, 18 bp, Homo sapiens
agagcaggaagcattcag

SEQ ID NO: 2512833 - DNA, 15 bp, Homo sapiens
agagcaggaggcccc

SEQ ID NO: 2512834 - DNA, 20 bp, Homo sapiens
agagcaggaggcccctggcc

SEQ ID NO: 2512835 - DNA, 23 bp, Homo sapiens
agagcaggaggcccctggcccag

SEQ ID NO: 2512836 - DNA, 19 bp, Homo sapiens
agagcaggcacatggagga

SEQ ID NO: 2512837 - DNA, 20 bp, Homo sapiens
agagcaggcacatggaggag

SEQ ID NO: 2512838 - DNA, 17 bp, Homo sapiens
agagcaggctggcagct

SEQ ID NO: 2512839 - DNA, 22 bp, Homo sapiens
agagcaggctggcagctctcca

SEQ ID NO: 2512840 - DNA, 22 bp, Homo sapiens
agagcagtttctgtcctgctgg

SEQ ID NO: 2512841 - DNA, 23 bp, Homo sapiens
agagcagtttctgtcctgctggt

SEQ ID NO: 2512842 - DNA, 22 bp, Homo sapiens
agagcattacgtgagccaggta

SEQ ID NO: 2512843 - DNA, 22 bp, Homo sapiens
agagccagaacctggagggcta

SEQ ID NO: 2512844 - DNA, 10 bp, Homo sapiens
agagccagag

SEQ ID NO: 2512845 - DNA, 20 bp, Homo sapiens
agagccagagaagtgacagg

SEQ ID NO: 2512846 - DNA, 13 bp, Homo sapiens
agagccagctccc

SEQ ID NO: 2512847 - DNA, 20 bp, Homo sapiens
agagccatataagtttgaag

SEQ ID NO: 2512848 - DNA, 19 bp, Homo sapiens
agagccatggactctacac

SEQ ID NO: 2512849 - DNA, 20 bp, Homo sapiens
agagccatgtagaagctgca

SEQ ID NO: 2512850 - DNA, 16 bp, Homo sapiens
agagcccacgccccca

SEQ ID NO: 2512851 - DNA, 20 bp, Homo sapiens
agagcccagaggtaacagaa

SEQ ID NO: 2512852 - DNA, 21 bp, Homo sapiens
agagcccagcagggcctcaaa

SEQ ID NO: 2512853 - DNA, 15 bp, Homo sapiens
agagccccacacgga

SEQ ID NO: 2512854 - DNA, 15 bp, Homo sapiens
agagcccttcatttg

SEQ ID NO: 2512855 - DNA, 13 bp, Homo sapiens
agagccgggaagc

SEQ ID NO: 2512856 - DNA, 16 bp, Homo sapiens
agagccgggaagcgat

SEQ ID NO: 2512857 - DNA, 17 bp, Homo sapiens
agagccgtgatgcctcc

SEQ ID NO: 2512858 - DNA, 13 bp, Homo sapiens
agagcctgaggga

SEQ ID NO: 2512859 - DNA, 19 bp, Homo sapiens
agagcctgcaggtgctgct

SEQ ID NO: 2512860 - DNA, 17 bp, Homo sapiens
agagcctgctgcatggg

SEQ ID NO: 2512861 - DNA, 16 bp, Homo sapiens
agagcctggtgctgct

SEQ ID NO: 2512862 - DNA, 11 bp, Homo sapiens
agagccttgcg

SEQ ID NO: 2512863 - DNA, 13 bp, Homo sapiens
agagcgcccctcc

SEQ ID NO: 2512864 - DNA, 21 bp, Homo sapiens
agagcgccgtgagttctcagg

SEQ ID NO: 2512865 - DNA, 22 bp, Homo sapiens
agagcgccgtgagttctcaggg

SEQ ID NO: 2512866 - DNA, 15 bp, Homo sapiens
agagcgcctgcccct

SEQ ID NO: 2512867 - DNA, 23 bp, Homo sapiens
agagcgcctgcccctcccagaac

SEQ ID NO: 2512868 - DNA, 21 bp, Homo sapiens
agagcgtgctccagcctggct

SEQ ID NO: 2512869 - DNA, 21 bp, Homo sapiens
agagctacttgggccatagct

SEQ ID NO: 2512870 - DNA, 19 bp, Homo sapiens
agagctagaacatggagag

SEQ ID NO: 2512871 - DNA, 16 bp, Homo sapiens
agagctagaacctgga

SEQ ID NO: 2512872 - DNA, 19 bp, Homo sapiens
agagctagaacctggagag

SEQ ID NO: 2512873 - DNA, 14 bp, Homo sapiens
agagctctccagct

SEQ ID NO: 2512874 - DNA, 20 bp, Homo sapiens
agagctgacacaaacctgcc

SEQ ID NO: 2512875 - DNA, 23 bp, Homo sapiens
agagctgacacaaacctgcctgg

SEQ ID NO: 2512876 - DNA, 11 bp, Homo sapiens
agagctgaggc

SEQ ID NO: 2512877 - DNA, 14 bp, Homo sapiens
agagctgatccaga

SEQ ID NO: 2512878 - DNA, 21 bp, Homo sapiens
agagctgatccagagcacaga

SEQ ID NO: 2512879 - DNA, 20 bp, Homo sapiens
agagctgccctccttgtcca

SEQ ID NO: 2512880 - DNA, 14 bp, Homo sapiens
agagctgcctctcg

SEQ ID NO: 2512881 - DNA, 14 bp, Homo sapiens
agagctgctctgga

SEQ ID NO: 2512882 - DNA, 23 bp, Homo sapiens
agagctgctctggaaaatgtgac

SEQ ID NO: 2512883 - DNA, 15 bp, Homo sapiens
agagctggcaaaggt

SEQ ID NO: 2512884 - DNA, 13 bp, Homo sapiens
agagctgggaggg

SEQ ID NO: 2512885 - DNA, 23 bp, Homo sapiens
agagctggtagttagtagcatgt

SEQ ID NO: 2512886 - DNA, 16 bp, Homo sapiens
agagctggtgcccgga

SEQ ID NO: 2512887 - DNA, 18 bp, Homo sapiens
agagctgttcacagccag

SEQ ID NO: 2512888 - DNA, 12 bp, Homo sapiens
agagcttccctg

SEQ ID NO: 2512889 - DNA, 14 bp, Homo sapiens
agagcttggactgg

SEQ ID NO: 2512890 - DNA, 16 bp, Homo sapiens
agaggaaaaaaatgac

SEQ ID NO: 2512891 - DNA, 18 bp, Homo sapiens
agaggaaaagtaaggtgc

SEQ ID NO: 2512892 - DNA, 17 bp, Homo sapiens
agaggaactgtccagag

SEQ ID NO: 2512893 - DNA, 20 bp, Homo sapiens
agaggaactgtccagagagc

SEQ ID NO: 2512894 - DNA, 13 bp, Homo sapiens
agaggaagagcag

SEQ ID NO: 2512895 - DNA, 15 bp, Homo sapiens
agaggaaggggccag

SEQ ID NO: 2512896 - DNA, 23 bp, Homo sapiens
agaggaaggggccagaggctcgt

SEQ ID NO: 2512897 - DNA, 16 bp, Homo sapiens
agaggacaagggaaat

SEQ ID NO: 2512898 - DNA, 18 bp, Homo sapiens
agaggacagatcaatggc

SEQ ID NO: 2512899 - DNA, 23 bp, Homo sapiens
agaggacagatcaatggcgcagt

SEQ ID NO: 2512900 - DNA, 21 bp, Homo sapiens
agaggacttttctttgtggct

SEQ ID NO: 2512901 - DNA, 22 bp, Homo sapiens
agaggacttttctttgtggctt

SEQ ID NO: 2512902 - DNA, 12 bp, Homo sapiens
agaggagagcca

SEQ ID NO: 2512903 - DNA, 13 bp, Homo sapiens
agaggagagccag

SEQ ID NO: 2512904 - DNA, 15 bp, Homo sapiens
agaggagagccagag

SEQ ID NO: 2512905 - DNA, 17 bp, Homo sapiens
agaggagagccagagaa

SEQ ID NO: 2512906 - DNA, 23 bp, Homo sapiens
agaggagagccagagaagtgaca

SEQ ID NO: 2512907 - DNA, 20 bp, Homo sapiens
agaggatgaatgtatgtgca

SEQ ID NO: 2512908 - DNA, 19 bp, Homo sapiens
agaggatttttttctgagc

SEQ ID NO: 2512909 - DNA, 24 bp, Homo sapiens
agaggcaccactaaaagatcgcag

SEQ ID NO: 2512910 - DNA, 18 bp, Homo sapiens
agaggcagaaaattgcac

SEQ ID NO: 2512911 - DNA, 21 bp, Homo sapiens
agaggcagagaaagaagagac

SEQ ID NO: 2512912 - DNA, 22 bp, Homo sapiens
agaggcagccccattctgcctg

SEQ ID NO: 2512913 - DNA, 21 bp, Homo sapiens
agaggcagggtctcactctgt

SEQ ID NO: 2512914 - DNA, 17 bp, Homo sapiens
agaggccagccccaccc

SEQ ID NO: 2512915 - DNA, 18 bp, Homo sapiens
agaggccagccccaccca

SEQ ID NO: 2512916 - DNA, 21 bp, Homo sapiens
agaggccagccccacccagga

SEQ ID NO: 2512917 - DNA, 23 bp, Homo sapiens
agaggccagccccacccaggagg

SEQ ID NO: 2512918 - DNA, 19 bp, Homo sapiens
agaggccatgattcgccca

SEQ ID NO: 2512919 - DNA, 14 bp, Homo sapiens
agaggccatggcag

SEQ ID NO: 2512920 - DNA, 16 bp, Homo sapiens
agaggccatggcagaa

SEQ ID NO: 2512921 - DNA, 20 bp, Homo sapiens
agaggccatggcagaataat

SEQ ID NO: 2512922 - DNA, 14 bp, Homo sapiens
agaggccctcgctg

SEQ ID NO: 2512923 - DNA, 19 bp, Homo sapiens
agaggccctcgctgccagc

SEQ ID NO: 2512924 - DNA, 16 bp, Homo sapiens
agaggcgggccagcca

SEQ ID NO: 2512925 - DNA, 17 bp, Homo sapiens
agaggcgggccagccag

SEQ ID NO: 2512926 - DNA, 18 bp, Homo sapiens
agaggcgggccagccagg

SEQ ID NO: 2512927 - DNA, 16 bp, Homo sapiens
agaggcgtctgtatat

SEQ ID NO: 2512928 - DNA, 13 bp, Homo sapiens
agaggctgaggca

SEQ ID NO: 2512929 - DNA, 22 bp, Homo sapiens
agaggctgcagaaggccaagaa

SEQ ID NO: 2512930 - DNA, 22 bp, Homo sapiens
agaggctggtgctgtggccagg

SEQ ID NO: 2512931 - DNA, 22 bp, Homo sapiens
agaggctgttcccaccaggctg

SEQ ID NO: 2512932 - DNA, 19 bp, Homo sapiens
agagggacctctcccaggg

SEQ ID NO: 2512933 - DNA, 22 bp, Homo sapiens
agagggactgttcttttgtccc

SEQ ID NO: 2512934 - DNA, 24 bp, Homo sapiens
agagggaggagaatgagcctcggc

SEQ ID NO: 2512935 - DNA, 20 bp, Homo sapiens
agagggagtgacagaggcag

SEQ ID NO: 2512936 - DNA, 16 bp, Homo sapiens
agagggcacacactgt

SEQ ID NO: 2512937 - DNA, 17 bp, Homo sapiens
agagggcccaggcaggc

SEQ ID NO: 2512938 - DNA, 18 bp, Homo sapiens
agagggccctggtgtttc

SEQ ID NO: 2512939 - DNA, 23 bp, Homo sapiens
agagggccctggtgtttctagca

SEQ ID NO: 2512940 - DNA, 16 bp, Homo sapiens
agagggcctgcaaggg

SEQ ID NO: 2512941 - DNA, 22 bp, Homo sapiens
agaggggaagagtgtactgggg

SEQ ID NO: 2512942 - DNA, 20 bp, Homo sapiens
agaggggacaaaacccacct

SEQ ID NO: 2512943 - DNA, 16 bp, Homo sapiens
agaggggcagaacagc

SEQ ID NO: 2512944 - DNA, 13 bp, Homo sapiens
agaggggcagccc

SEQ ID NO: 2512945 - DNA, 15 bp, Homo sapiens
agaggggcagccctt

SEQ ID NO: 2512946 - DNA, 21 bp, Homo sapiens
agaggggctgaatagcagaag

SEQ ID NO: 2512947 - DNA, 17 bp, Homo sapiens
agagggggtggcctccc

SEQ ID NO: 2512948 - DNA, 19 bp, Homo sapiens
agagggggtggcctcccaa

SEQ ID NO: 2512949 - DNA, 19 bp, Homo sapiens
agaggggtacatttccctg

SEQ ID NO: 2512950 - DNA, 19 bp, Homo sapiens
agaggggtggagactgctt

SEQ ID NO: 2512951 - DNA, 21 bp, Homo sapiens
agagtcatctccatcagctgt

SEQ ID NO: 2512952 - DNA, 15 bp, Homo sapiens
agagtccaggcccca

SEQ ID NO: 2512953 - DNA, 15 bp, Homo sapiens
agagtcccactgcct

SEQ ID NO: 2512954 - DNA, 18 bp, Homo sapiens
agagtcccactgcctcag

SEQ ID NO: 2512955 - DNA, 22 bp, Homo sapiens
agagtcccactgcctcaggttc

SEQ ID NO: 2512956 - DNA, 13 bp, Homo sapiens
agagtcctcactc

SEQ ID NO: 2512957 - DNA, 14 bp, Homo sapiens
agagtcctctggat

SEQ ID NO: 2512958 - DNA, 22 bp, Homo sapiens
agagtcggaacggagaaaggtg

SEQ ID NO: 2512959 - DNA, 22 bp, Homo sapiens
agagtctcactgttgcccaggc

SEQ ID NO: 2512960 - DNA, 14 bp, Homo sapiens
agagtgaacaaatt

SEQ ID NO: 2512961 - DNA, 19 bp, Homo sapiens
agagtgagactctgtctca

SEQ ID NO: 2512962 - DNA, 14 bp, Homo sapiens
agagtgagagggca

SEQ ID NO: 2512963 - DNA, 12 bp, Homo sapiens
agagtgcccaga

SEQ ID NO: 2512964 - DNA, 11 bp, Homo sapiens
agagtggcctg

SEQ ID NO: 2512965 - DNA, 12 bp, Homo sapiens
agagtggcctgg

SEQ ID NO: 2512966 - DNA, 11 bp, Homo sapiens
agagtgggagc

SEQ ID NO: 2512967 - DNA, 18 bp, Homo sapiens
agagtgggctgcatctgg

SEQ ID NO: 2512968 - DNA, 19 bp, Homo sapiens
agagtggggatatgattta

SEQ ID NO: 2512969 - DNA, 22 bp, Homo sapiens
agagtgggggagagcaggctgg

SEQ ID NO: 2512970 - DNA, 18 bp, Homo sapiens
agagtggtctttctggag

SEQ ID NO: 2512971 - DNA, 12 bp, Homo sapiens
agagtgtagaag

SEQ ID NO: 2512972 - DNA, 17 bp, Homo sapiens
agagtgtagaagcattc

SEQ ID NO: 2512973 - DNA, 22 bp, Homo sapiens
agagtgtcttcacggcaggaca

SEQ ID NO: 2512974 - DNA, 16 bp, Homo sapiens
agagttaacaatgata

SEQ ID NO: 2512975 - DNA, 17 bp, Homo sapiens
agagttatttaggcttt

SEQ ID NO: 2512976 - DNA, 16 bp, Homo sapiens
agagttcactataaat

SEQ ID NO: 2512977 - DNA, 16 bp, Homo sapiens
agagttcctgcggagt

SEQ ID NO: 2512978 - DNA, 16 bp, Homo sapiens
agagttgttacatttt

SEQ ID NO: 2512979 - DNA, 21 bp, Homo sapiens
agagttgttacatttttaagt

SEQ ID NO: 2512980 - DNA, 14 bp, Homo sapiens
agagtttaacacaa

SEQ ID NO: 2512981 - DNA, 15 bp, Homo sapiens
agagtttaacacaag

SEQ ID NO: 2512982 - DNA, 22 bp, Homo sapiens
agagtttaacacaagtcctgtg

SEQ ID NO: 2512983 - DNA, 13 bp, Homo sapiens
agagtttgtgtgt

SEQ ID NO: 2512984 - DNA, 16 bp, Homo sapiens
agagtttgtgtgttgt

SEQ ID NO: 2512985 - DNA, 13 bp, Homo sapiens
agataaagatgat

SEQ ID NO: 2512986 - DNA, 12 bp, Homo sapiens
agataaatgtgc

SEQ ID NO: 2512987 - DNA, 13 bp, Homo sapiens
agataaattataa

SEQ ID NO: 2512988 - DNA, 21 bp, Homo sapiens
agataaccagctgtaacacag

SEQ ID NO: 2512989 - DNA, 14 bp, Homo sapiens
agataactgagaat

SEQ ID NO: 2512990 - DNA, 16 bp, Homo sapiens
agataactgttattta

SEQ ID NO: 2512991 - DNA, 20 bp, Homo sapiens
agataactgttatttataat

SEQ ID NO: 2512992 - DNA, 14 bp, Homo sapiens
agataataatatat

SEQ ID NO: 2512993 - DNA, 16 bp, Homo sapiens
agataataatatatgt

SEQ ID NO: 2512994 - DNA, 18 bp, Homo sapiens
agataatacaccactaca

SEQ ID NO: 2512995 - DNA, 18 bp, Homo sapiens
agataatattaaggaaga

SEQ ID NO: 2512996 - DNA, 22 bp, Homo sapiens
agataatattaaggaagacaat

SEQ ID NO: 2512997 - DNA, 15 bp, Homo sapiens
agataatcagcctct

SEQ ID NO: 2512998 - DNA, 16 bp, Homo sapiens
agataatcagcctctt

SEQ ID NO: 2512999 - DNA, 23 bp, Homo sapiens
agataatctagaacacaggcaaa

SEQ ID NO: 2513000 - DNA, 21 bp, Homo sapiens
agataatgttagaggttttaa

SEQ ID NO: 2513001 - DNA, 18 bp, Homo sapiens
agataattctagctttga

SEQ ID NO: 2513002 - DNA, 16 bp, Homo sapiens
agatacaatgtattta

SEQ ID NO: 2513003 - DNA, 23 bp, Homo sapiens
agatacaatgtatttatttaaaa

SEQ ID NO: 2513004 - DNA, 18 bp, Homo sapiens
agatacagaactctttca

SEQ ID NO: 2513005 - DNA, 19 bp, Homo sapiens
agataccaggttgaaagac

SEQ ID NO: 2513006 - DNA, 19 bp, Homo sapiens
agatacctaaaagagattt

SEQ ID NO: 2513007 - DNA, 22 bp, Homo sapiens
agatacctaaaagagatttcaa

SEQ ID NO: 2513008 - DNA, 13 bp, Homo sapiens
agatacctcaccc

SEQ ID NO: 2513009 - DNA, 19 bp, Homo sapiens
agatacgactttattttct

SEQ ID NO: 2513010 - DNA, 19 bp, Homo sapiens
agatactggaagttttgca

SEQ ID NO: 2513011 - DNA, 21 bp, Homo sapiens
agatactggaagttttgcatt

SEQ ID NO: 2513012 - DNA, 16 bp, Homo sapiens
agatagaagaactgca

SEQ ID NO: 2513013 - DNA, 16 bp, Homo sapiens
agatagaatttccaat

SEQ ID NO: 2513014 - DNA, 17 bp, Homo sapiens
agatagcattgtgaact

SEQ ID NO: 2513015 - DNA, 18 bp, Homo sapiens
agatagcattgtgaactg

SEQ ID NO: 2513016 - DNA, 19 bp, Homo sapiens
agatagcattgtgaactga

SEQ ID NO: 2513017 - DNA, 22 bp, Homo sapiens
agatagcattgtgaactgacag

SEQ ID NO: 2513018 - DNA, 21 bp, Homo sapiens
agataggctctgcacagatgg

SEQ ID NO: 2513019 - DNA, 15 bp, Homo sapiens
agataggtaaatacc

SEQ ID NO: 2513020 - DNA, 13 bp, Homo sapiens
agatatatatcat

SEQ ID NO: 2513021 - DNA, 17 bp, Homo sapiens
agatatatttttaagat

SEQ ID NO: 2513022 - DNA, 16 bp, Homo sapiens
agatatatttttcaca

SEQ ID NO: 2513023 - DNA, 18 bp, Homo sapiens
agatatgaacatattgtt

SEQ ID NO: 2513024 - DNA, 19 bp, Homo sapiens
agatattgtgaagtacata

SEQ ID NO: 2513025 - DNA, 17 bp, Homo sapiens
agatatttatatatatt

SEQ ID NO: 2513026 - DNA, 15 bp, Homo sapiens
agatattttaaaatg

SEQ ID NO: 2513027 - DNA, 20 bp, Homo sapiens
agatattttgctttgtgatt

SEQ ID NO: 2513028 - DNA, 19 bp, Homo sapiens
agatatttttcatgatttt

SEQ ID NO: 2513029 - DNA, 21 bp, Homo sapiens
agatattttttcagaaatatg

SEQ ID NO: 2513030 - DNA, 13 bp, Homo sapiens
agatattttttct

SEQ ID NO: 2513031 - DNA, 20 bp, Homo sapiens
agatcaaatactttaaagga

SEQ ID NO: 2513032 - DNA, 23 bp, Homo sapiens
agatcaaatttcacgtcgtcttc

SEQ ID NO: 2513033 - DNA, 19 bp, Homo sapiens
agatcaaccccttcgctcc

SEQ ID NO: 2513034 - DNA, 18 bp, Homo sapiens
agatcaagctgtgagaca

SEQ ID NO: 2513035 - DNA, 15 bp, Homo sapiens
agatcaccagaataa

SEQ ID NO: 2513036 - DNA, 14 bp, Homo sapiens
agatcacgccactg

SEQ ID NO: 2513037 - DNA, 15 bp, Homo sapiens
agatcacgccactgc

SEQ ID NO: 2513038 - DNA, 16 bp, Homo sapiens
agatcacgccactgca

SEQ ID NO: 2513039 - DNA, 11 bp, Homo sapiens
agatcactttc

SEQ ID NO: 2513040 - DNA, 16 bp, Homo sapiens
agatcatatacgtgaa

SEQ ID NO: 2513041 - DNA, 15 bp, Homo sapiens
agatcatcctttcca

SEQ ID NO: 2513042 - DNA, 14 bp, Homo sapiens
agatccacacacag

SEQ ID NO: 2513043 - DNA, 16 bp, Homo sapiens
agatccacacacagag

SEQ ID NO: 2513044 - DNA, 18 bp, Homo sapiens
agatccacacacagagga

SEQ ID NO: 2513045 - DNA, 15 bp, Homo sapiens
agatcccctcaggac

SEQ ID NO: 2513046 - DNA, 15 bp, Homo sapiens
agatcccgcctcttc

SEQ ID NO: 2513047 - DNA, 19 bp, Homo sapiens
agatcccgcctcttcttct

SEQ ID NO: 2513048 - DNA, 22 bp, Homo sapiens
agatcctaccccaattccttgt

SEQ ID NO: 2513049 - DNA, 21 bp, Homo sapiens
agatcctgtctttaaggaaaa

SEQ ID NO: 2513050 - DNA, 15 bp, Homo sapiens
agatcgcgccactgc

SEQ ID NO: 2513051 - DNA, 20 bp, Homo sapiens
agatcgcgccactgcactcc

SEQ ID NO: 2513052 - DNA, 20 bp, Homo sapiens
agatctaagcctttccataa

SEQ ID NO: 2513053 - DNA, 22 bp, Homo sapiens
agatctaaggatgtcacagggc

SEQ ID NO: 2513054 - DNA, 18 bp, Homo sapiens
agatctctaacttcacca

SEQ ID NO: 2513055 - DNA, 15 bp, Homo sapiens
agatctggttttgct

SEQ ID NO: 2513056 - DNA, 14 bp, Homo sapiens
agatctgtgcccca

SEQ ID NO: 2513057 - DNA, 16 bp, Homo sapiens
agatctgtgccccatg

SEQ ID NO: 2513058 - DNA, 16 bp, Homo sapiens
agatcttaaattttgt

SEQ ID NO: 2513059 - DNA, 13 bp, Homo sapiens
agatctttcagga

SEQ ID NO: 2513060 - DNA, 20 bp, Homo sapiens
agatgaagagtgagagggca

SEQ ID NO: 2513061 - DNA, 19 bp, Homo sapiens
agatgaagcaaacacatta

SEQ ID NO: 2513062 - DNA, 22 bp, Homo sapiens
agatgaatacaaacaatggaaa

SEQ ID NO: 2513063 - DNA, 15 bp, Homo sapiens
agatgacattgctaa

SEQ ID NO: 2513064 - DNA, 21 bp, Homo sapiens
agatgacattgctaagatgct

SEQ ID NO: 2513065 - DNA, 22 bp, Homo sapiens
agatgacattgctaagatgctc

SEQ ID NO: 2513066 - DNA, 16 bp, Homo sapiens
agatgcaaagaggcaa

SEQ ID NO: 2513067 - DNA, 15 bp, Homo sapiens
agatgcaaggaccag

SEQ ID NO: 2513068 - DNA, 14 bp, Homo sapiens
agatgcaccagccc

SEQ ID NO: 2513069 - DNA, 13 bp, Homo sapiens
agatgcagagagc

SEQ ID NO: 2513070 - DNA, 15 bp, Homo sapiens
agatgcagagagcca

SEQ ID NO: 2513071 - DNA, 18 bp, Homo sapiens
agatgcagagagccattt

SEQ ID NO: 2513072 - DNA, 20 bp, Homo sapiens
agatgtccctttcttggcca

SEQ ID NO: 2513073 - DNA, 18 bp, Homo sapiens
agatgtctaatagttatt

SEQ ID NO: 2513074 - DNA, 15 bp, Homo sapiens
agatgtcttcgtaca

SEQ ID NO: 2513075 - DNA, 18 bp, Homo sapiens
agatgtcttctgcctgtt

SEQ ID NO: 2513076 - DNA, 15 bp, Homo sapiens
agatgtctttaggca

SEQ ID NO: 2513077 - DNA, 18 bp, Homo sapiens
agatgtgcaaatgcaagc

SEQ ID NO: 2513078 - DNA, 21 bp, Homo sapiens
agatgttcagattgctttgat

SEQ ID NO: 2513079 - DNA, 21 bp, Homo sapiens
agatgttctaagtctttccat

SEQ ID NO: 2513080 - DNA, 14 bp, Homo sapiens
agatgtttcacgaa

SEQ ID NO: 2513081 - DNA, 19 bp, Homo sapiens
agatgtttgtcagatatga

SEQ ID NO: 2513082 - DNA, 17 bp, Homo sapiens
agatgttttacgtctgg

SEQ ID NO: 2513083 - DNA, 13 bp, Homo sapiens
agatgtttttaaa

SEQ ID NO: 2513084 - DNA, 21 bp, Homo sapiens
agattaccccctcattgttta

SEQ ID NO: 2513085 - DNA, 14 bp, Homo sapiens
agattagctctgga

SEQ ID NO: 2513086 - DNA, 15 bp, Homo sapiens
agattagctctggac

SEQ ID NO: 2513087 - DNA, 13 bp, Homo sapiens
agattcatattta

SEQ ID NO: 2513088 - DNA, 19 bp, Homo sapiens
agattcatatttacttctt

SEQ ID NO: 2513089 - DNA, 22 bp, Homo sapiens
agattcatatttacttcttata

SEQ ID NO: 2513090 - DNA, 17 bp, Homo sapiens
agattcatttttctttc

SEQ ID NO: 2513091 - DNA, 13 bp, Homo sapiens
agattcccagagc

SEQ ID NO: 2513092 - DNA, 21 bp, Homo sapiens
agattccccattgcctcctcc

SEQ ID NO: 2513093 - DNA, 15 bp, Homo sapiens
agattccctgagcag

SEQ ID NO: 2513094 - DNA, 15 bp, Homo sapiens
agattctttcctgag

SEQ ID NO: 2513095 - DNA, 18 bp, Homo sapiens
agattctttcctgaggct

SEQ ID NO: 2513096 - DNA, 19 bp, Homo sapiens
agattctttcctgaggctg

SEQ ID NO: 2513097 - DNA, 19 bp, Homo sapiens
agattgaaaacttttctca

SEQ ID NO: 2513098 - DNA, 18 bp, Homo sapiens
agattgagagaagagaca

SEQ ID NO: 2513099 - DNA, 17 bp, Homo sapiens
agattgcaacaggctgg

SEQ ID NO: 2513100 - DNA, 20 bp, Homo sapiens
agattgcaacaggctgggct

SEQ ID NO: 2513101 - DNA, 15 bp, Homo sapiens
agattgcatgtgact

SEQ ID NO: 2513102 - DNA, 23 bp, Homo sapiens
agattgcatgtgactctgaagct

SEQ ID NO: 2513103 - DNA, 14 bp, Homo sapiens
agattgctgaaatt

SEQ ID NO: 2513104 - DNA, 23 bp, Homo sapiens
agattggagaaacccttgaaaag

SEQ ID NO: 2513105 - DNA, 21 bp, Homo sapiens
agattgtgcccctgcactcca

SEQ ID NO: 2513106 - DNA, 14 bp, Homo sapiens
agattgttaaaata

SEQ ID NO: 2513107 - DNA, 15 bp, Homo sapiens
agattgttaaaataa

SEQ ID NO: 2513108 - DNA, 15 bp, Homo sapiens
agattgttgtttgcc

SEQ ID NO: 2513109 - DNA, 22 bp, Homo sapiens
agattgttttatcatgacatgt

SEQ ID NO: 2513110 - DNA, 15 bp, Homo sapiens
agatttacactggga

SEQ ID NO: 2513111 - DNA, 13 bp, Homo sapiens
agatttcaagaga

SEQ ID NO: 2513112 - DNA, 18 bp, Homo sapiens
agatttccatataaatat

SEQ ID NO: 2513113 - DNA, 16 bp, Homo sapiens
agatttgaaggtctgc

SEQ ID NO: 2513114 - DNA, 19 bp, Homo sapiens
agatttgtgaactcagcca

SEQ ID NO: 2513115 - DNA, 17 bp, Homo sapiens
agattttaaaaagtctt

SEQ ID NO: 2513116 - DNA, 17 bp, Homo sapiens
agattttctttaaaaga

SEQ ID NO: 2513117 - DNA, 20 bp, Homo sapiens
agattttctttaaaagaatg

SEQ ID NO: 2513118 - DNA, 13 bp, Homo sapiens
agatttttacaaa

SEQ ID NO: 2513119 - DNA, 17 bp, Homo sapiens
agcaaaactccatctca

SEQ ID NO: 2513120 - DNA, 21 bp, Homo sapiens
agcaaaataattttaaacaaa

SEQ ID NO: 2513121 - DNA, 20 bp, Homo sapiens
agcaaaatcatggaatggtt

SEQ ID NO: 2513122 - DNA, 17 bp, Homo sapiens
agcaaactcttttccca

SEQ ID NO: 2513123 - DNA, 16 bp, Homo sapiens
agcaaagagtgggctg

SEQ ID NO: 2513124 - DNA, 16 bp, Homo sapiens
agcaaatcagaaactt

SEQ ID NO: 2513125 - DNA, 15 bp, Homo sapiens
agcaaatgtgacctg

SEQ ID NO: 2513126 - DNA, 19 bp, Homo sapiens
agcaaattctgtttttcta

SEQ ID NO: 2513127 - DNA, 12 bp, Homo sapiens
agcaaatttggg

SEQ ID NO: 2513128 - DNA, 15 bp, Homo sapiens
agcaacaatttatga

SEQ ID NO: 2513129 - DNA, 22 bp, Homo sapiens
agcaacagagtgagaccctgtc

SEQ ID NO: 2513130 - DNA, 22 bp, Homo sapiens
agcaacattttacccacacaca

SEQ ID NO: 2513131 - DNA, 18 bp, Homo sapiens
agcaacctgggtccaaat

SEQ ID NO: 2513132 - DNA, 12 bp, Homo sapiens
agcaactgaata

SEQ ID NO: 2513133 - DNA, 14 bp, Homo sapiens
agcaactgaataaa

SEQ ID NO: 2513134 - DNA, 23 bp, Homo sapiens
agcaactgaataaatacctctta

SEQ ID NO: 2513135 - DNA, 20 bp, Homo sapiens
agcaactgttatgaaataaa

SEQ ID NO: 2513136 - DNA, 15 bp, Homo sapiens
agcaacttgtctttt

SEQ ID NO: 2513137 - DNA, 23 bp, Homo sapiens
agcaagacgctgtgctgccctgc

SEQ ID NO: 2513138 - DNA, 12 bp, Homo sapiens
agcaagactctg

SEQ ID NO: 2513139 - DNA, 13 bp, Homo sapiens
agcaagagctggc

SEQ ID NO: 2513140 - DNA, 17 bp, Homo sapiens
agcaagagctggcaaag

SEQ ID NO: 2513141 - DNA, 23 bp, Homo sapiens
agcaagagctggcaaaggtggct

SEQ ID NO: 2513142 - DNA, 20 bp, Homo sapiens
agcaagcatttatgtttatt

SEQ ID NO: 2513143 - DNA, 15 bp, Homo sapiens
agcaagctcccaagg

SEQ ID NO: 2513144 - DNA, 14 bp, Homo sapiens
agcaaggagattta

SEQ ID NO: 2513145 - DNA, 16 bp, Homo sapiens
agcaagggtgatggga

SEQ ID NO: 2513146 - DNA, 20 bp, Homo sapiens
agcaagggtgatgggaaagc

SEQ ID NO: 2513147 - DNA, 14 bp, Homo sapiens
agcaagtgaatttt

SEQ ID NO: 2513148 - DNA, 24 bp, Homo sapiens
agcaagtgagagagatgggagctc

SEQ ID NO: 2513149 - DNA, 16 bp, Homo sapiens
agcaagttacagtgat

SEQ ID NO: 2513150 - DNA, 14 bp, Homo sapiens
agcaataaagaaga

SEQ ID NO: 2513151 - DNA, 13 bp, Homo sapiens
agcaataaatgaa

SEQ ID NO: 2513152 - DNA, 21 bp, Homo sapiens
agcaataatggtcccatccag

SEQ ID NO: 2513153 - DNA, 23 bp, Homo sapiens
agcaataatggtcccatccaggc

SEQ ID NO: 2513154 - DNA, 15 bp, Homo sapiens
agcaatatcagttat

SEQ ID NO: 2513155 - DNA, 21 bp, Homo sapiens
agcaatatcagttattttttg

SEQ ID NO: 2513156 - DNA, 20 bp, Homo sapiens
agcaatccatgttagttttt

SEQ ID NO: 2513157 - DNA, 18 bp, Homo sapiens
agcaatgacatctcaggg

SEQ ID NO: 2513158 - DNA, 24 bp, Homo sapiens
agcaatttaatattttgcacagtt

SEQ ID NO: 2513159 - DNA, 14 bp, Homo sapiens
agcaattttcgaac

SEQ ID NO: 2513160 - DNA, 20 bp, Homo sapiens
agcacacacttttggttaag

SEQ ID NO: 2513161 - DNA, 15 bp, Homo sapiens
agcacagaccctgcc

SEQ ID NO: 2513162 - DNA, 20 bp, Homo sapiens
agcacagaccctgccctgtg

SEQ ID NO: 2513163 - DNA, 15 bp, Homo sapiens
agcacagagaagaca

SEQ ID NO: 2513164 - DNA, 17 bp, Homo sapiens
agcacagagaagacaaa

SEQ ID NO: 2513165 - DNA, 21 bp, Homo sapiens
agcacagcagcccctgcacaa

SEQ ID NO: 2513166 - DNA, 19 bp, Homo sapiens
agcacaggtgggcttccca

SEQ ID NO: 2513167 - DNA, 15 bp, Homo sapiens
agcacagtggtggca

SEQ ID NO: 2513168 - DNA, 17 bp, Homo sapiens
agcacagtggtggcagg

SEQ ID NO: 2513169 - DNA, 14 bp, Homo sapiens
agcacagtttgaac

SEQ ID NO: 2513170 - DNA, 17 bp, Homo sapiens
agcacagtttgaacaaa

SEQ ID NO: 2513171 - DNA, 15 bp, Homo sapiens
agcacatctgcattt

SEQ ID NO: 2513172 - DNA, 23 bp, Homo sapiens
agcacatctgcattttcacccca

SEQ ID NO: 2513173 - DNA, 12 bp, Homo sapiens
agcaccacccta

SEQ ID NO: 2513174 - DNA, 20 bp, Homo sapiens
agcaccagcttctccaggct

SEQ ID NO: 2513175 - DNA, 20 bp, Homo sapiens
agcaccatccgccagggccc

SEQ ID NO: 2513176 - DNA, 19 bp, Homo sapiens
agcaccccatgccaaagct

SEQ ID NO: 2513177 - DNA, 16 bp, Homo sapiens
agcacccctctctgca

SEQ ID NO: 2513178 - DNA, 13 bp, Homo sapiens
agcaccccttcca

SEQ ID NO: 2513179 - DNA, 14 bp, Homo sapiens
agcaccccttccat

SEQ ID NO: 2513180 - DNA, 19 bp, Homo sapiens
agcacctacagtgtacagt

SEQ ID NO: 2513181 - DNA, 16 bp, Homo sapiens
agcacctcctgcctcg

SEQ ID NO: 2513182 - DNA, 18 bp, Homo sapiens
agcagccctaaggatctc

SEQ ID NO: 2513183 - DNA, 15 bp, Homo sapiens
agcagccctggagtc

SEQ ID NO: 2513184 - DNA, 17 bp, Homo sapiens
agcagccctggagtcat

SEQ ID NO: 2513185 - DNA, 19 bp, Homo sapiens
agcagccctggagtcatgc

SEQ ID NO: 2513186 - DNA, 16 bp, Homo sapiens
agcagcctggaccctg

SEQ ID NO: 2513187 - DNA, 13 bp, Homo sapiens
agcagcctgtggc

SEQ ID NO: 2513188 - DNA, 18 bp, Homo sapiens
agcagcgaccacccctgc

SEQ ID NO: 2513189 - DNA, 18 bp, Homo sapiens
agcagcgaccgccccctc

SEQ ID NO: 2513190 - DNA, 16 bp, Homo sapiens
agcagcggtggcctct

SEQ ID NO: 2513191 - DNA, 17 bp, Homo sapiens
agcagcggtttggggag

SEQ ID NO: 2513192 - DNA, 22 bp, Homo sapiens
agcagcggtttggggagcagag

SEQ ID NO: 2513193 - DNA, 23 bp, Homo sapiens
agcagcggtttggggagcagaga

SEQ ID NO: 2513194 - DNA, 18 bp, Homo sapiens
agcagcgtttctatgaca

SEQ ID NO: 2513195 - DNA, 19 bp, Homo sapiens
agcagctcaaaggcacagt

SEQ ID NO: 2513196 - DNA, 14 bp, Homo sapiens
agcagctcaggcac

SEQ ID NO: 2513197 - DNA, 12 bp, Homo sapiens
agcagctctccc

SEQ ID NO: 2513198 - DNA, 14 bp, Homo sapiens
agcagctctcccct

SEQ ID NO: 2513199 - DNA, 18 bp, Homo sapiens
agcagcttcaccagagca

SEQ ID NO: 2513200 - DNA, 19 bp, Homo sapiens
agcagctttaaactcaggg

SEQ ID NO: 2513201 - DNA, 22 bp, Homo sapiens
agcagctttaaactcagggaca

SEQ ID NO: 2513202 - DNA, 15 bp, Homo sapiens
agcaggaaatgaaaa

SEQ ID NO: 2513203 - DNA, 21 bp, Homo sapiens
agcaggaaatgaaaatgtctt

SEQ ID NO: 2513204 - DNA, 12 bp, Homo sapiens
agcaggaagctc

SEQ ID NO: 2513205 - DNA, 14 bp, Homo sapiens
agcaggaagctcag

SEQ ID NO: 2513206 - DNA, 15 bp, Homo sapiens
agcaggaagctcaga

SEQ ID NO: 2513207 - DNA, 16 bp, Homo sapiens
agcaggagaggagagc

SEQ ID NO: 2513208 - DNA, 20 bp, Homo sapiens
agcaggagaggagagccaga

SEQ ID NO: 2513209 - DNA, 21 bp, Homo sapiens
agcaggagaggagagccagag

SEQ ID NO: 2513210 - DNA, 23 bp, Homo sapiens
agcaggagaggagagccagagaa

SEQ ID NO: 2513211 - DNA, 16 bp, Homo sapiens
agcaggcacatggagg

SEQ ID NO: 2513212 - DNA, 19 bp, Homo sapiens
agcaggcacatggaggagc

SEQ ID NO: 2513213 - DNA, 22 bp, Homo sapiens
agcaggctacactgacactggt

SEQ ID NO: 2513214 - DNA, 16 bp, Homo sapiens
agcaggggcgtggagg

SEQ ID NO: 2513215 - DNA, 17 bp, Homo sapiens
agcagggtctgggcagg

SEQ ID NO: 2513216 - DNA, 17 bp, Homo sapiens
agcaggtggtcctgaga

SEQ ID NO: 2513217 - DNA, 21 bp, Homo sapiens
agcaggtggtcctgagacctg

SEQ ID NO: 2513218 - DNA, 20 bp, Homo sapiens
agcaggttgaggggctcctg

SEQ ID NO: 2513219 - DNA, 21 bp, Homo sapiens
agcaggttgaggggctcctgg

SEQ ID NO: 2513220 - DNA, 22 bp, Homo sapiens
agcaggttgaggggctcctgga

SEQ ID NO: 2513221 - DNA, 17 bp, Homo sapiens
agcagtaactgacaact

SEQ ID NO: 2513222 - DNA, 21 bp, Homo sapiens
agcagtagaaataatatgcat

SEQ ID NO: 2513223 - DNA, 16 bp, Homo sapiens
agcagtatcatgaagc

SEQ ID NO: 2513224 - DNA, 22 bp, Homo sapiens
agcagtgagaaaaagctcctgt

SEQ ID NO: 2513225 - DNA, 16 bp, Homo sapiens
agcagtgccttccata

SEQ ID NO: 2513226 - DNA, 19 bp, Homo sapiens
agcagtgccttccataatt

SEQ ID NO: 2513227 - DNA, 23 bp, Homo sapiens
agcagtgccttccataattatga

SEQ ID NO: 2513228 - DNA, 15 bp, Homo sapiens
agcagtgtcatcaga

SEQ ID NO: 2513229 - DNA, 21 bp, Homo sapiens
agcagtgttccccatctgggt

SEQ ID NO: 2513230 - DNA, 21 bp, Homo sapiens
agcagttacaaaaaccttccc

SEQ ID NO: 2513231 - DNA, 14 bp, Homo sapiens
agcagttccggatt

SEQ ID NO: 2513232 - DNA, 21 bp, Homo sapiens
agcagttgaaaagactccaaa

SEQ ID NO: 2513233 - DNA, 13 bp, Homo sapiens
agcagttgtgtca

SEQ ID NO: 2513234 - DNA, 20 bp, Homo sapiens
agcagtttctgtcctgctgg

SEQ ID NO: 2513235 - DNA, 20 bp, Homo sapiens
agcataacaaggtccaagat

SEQ ID NO: 2513236 - DNA, 19 bp, Homo sapiens
agcataccaacacgagcag

SEQ ID NO: 2513237 - DNA, 22 bp, Homo sapiens
agcataccaacacgagcaggct

SEQ ID NO: 2513238 - DNA, 20 bp, Homo sapiens
agcatacgtacacattttat

SEQ ID NO: 2513239 - DNA, 16 bp, Homo sapiens
agcatatgagtttcat

SEQ ID NO: 2513240 - DNA, 20 bp, Homo sapiens
agcatatgagtttcatagct

SEQ ID NO: 2513241 - DNA, 21 bp, Homo sapiens
agcatatgagtttcatagcta

SEQ ID NO: 2513242 - DNA, 19 bp, Homo sapiens
agcatattcaggaagctca

SEQ ID NO: 2513243 - DNA, 22 bp, Homo sapiens
agcatattcaggaagctcaggg

SEQ ID NO: 2513244 - DNA, 14 bp, Homo sapiens
agcatcaaactctt

SEQ ID NO: 2513245 - DNA, 13 bp, Homo sapiens
agcatcacctcag

SEQ ID NO: 2513246 - DNA, 14 bp, Homo sapiens
agcatcacctcagg

SEQ ID NO: 2513247 - DNA, 17 bp, Homo sapiens
agcatcacttgggatta

SEQ ID NO: 2513248 - DNA, 12 bp, Homo sapiens
agcatcaggcca

SEQ ID NO: 2513249 - DNA, 20 bp, Homo sapiens
agcatcaggccaggccctct

SEQ ID NO: 2513250 - DNA, 21 bp, Homo sapiens
agcatcaggccaggccctctg

SEQ ID NO: 2513251 - DNA, 22 bp, Homo sapiens
agcatcaggccaggccctctgc

SEQ ID NO: 2513252 - DNA, 16 bp, Homo sapiens
agcatcattttgcatt

SEQ ID NO: 2513253 - DNA, 19 bp, Homo sapiens
agcatcattttgcattcaa

SEQ ID NO: 2513254 - DNA, 20 bp, Homo sapiens
agcatccacctccttctctg

SEQ ID NO: 2513255 - DNA, 13 bp, Homo sapiens
agcatcctggcac

SEQ ID NO: 2513256 - DNA, 13 bp, Homo sapiens
agcatctcccagt

SEQ ID NO: 2513257 - DNA, 20 bp, Homo sapiens
agcatctccctcactgaaac

SEQ ID NO: 2513258 - DNA, 17 bp, Homo sapiens
agcatctcttgaggcca

SEQ ID NO: 2513259 - DNA, 23 bp, Homo sapiens
agcatcttcacttctaaatgcat

SEQ ID NO: 2513260 - DNA, 17 bp, Homo sapiens
agcatcttccagaagtg

SEQ ID NO: 2513261 - DNA, 20 bp, Homo sapiens
agcatcttccagaagtgtga

SEQ ID NO: 2513262 - DNA, 18 bp, Homo sapiens
agcatgacaagccccagg

SEQ ID NO: 2513263 - DNA, 19 bp, Homo sapiens
agcatgacaagccccaggc

SEQ ID NO: 2513264 - DNA, 20 bp, Homo sapiens
agcatgacaagccccaggca

SEQ ID NO: 2513265 - DNA, 18 bp, Homo sapiens
agcatgacctgtgaccag

SEQ ID NO: 2513266 - DNA, 22 bp, Homo sapiens
agcatgacctgtgaccagcact

SEQ ID NO: 2513267 - DNA, 13 bp, Homo sapiens
agcatgaggaact

SEQ ID NO: 2513268 - DNA, 20 bp, Homo sapiens
agcatgcctggatggggctg

SEQ ID NO: 2513269 - DNA, 13 bp, Homo sapiens
agcatggagctgg

SEQ ID NO: 2513270 - DNA, 14 bp, Homo sapiens
agcatggagctggc

SEQ ID NO: 2513271 - DNA, 16 bp, Homo sapiens
agcatggagctggccg

SEQ ID NO: 2513272 - DNA, 18 bp, Homo sapiens
agcatggctcaaagtgca

SEQ ID NO: 2513273 - DNA, 16 bp, Homo sapiens
agcatggctgtgagga

SEQ ID NO: 2513274 - DNA, 17 bp, Homo sapiens
agcatggctgtgaggat

SEQ ID NO: 2513275 - DNA, 17 bp, Homo sapiens
agcatgtctattcagct

SEQ ID NO: 2513276 - DNA, 19 bp, Homo sapiens
agcatgtctattcagcttc

SEQ ID NO: 2513277 - DNA, 19 bp, Homo sapiens
agcatgtgtatttccagtg

SEQ ID NO: 2513278 - DNA, 19 bp, Homo sapiens
agcatgttgagccaggcct

SEQ ID NO: 2513279 - DNA, 21 bp, Homo sapiens
agcatgttgagccaggcctgg

SEQ ID NO: 2513280 - DNA, 17 bp, Homo sapiens
agccccattctgcctgc

SEQ ID NO: 2513281 - DNA, 16 bp, Homo sapiens
agcccccacagtgctg

SEQ ID NO: 2513282 - DNA, 22 bp, Homo sapiens
agcccccgccccgccccacatt

SEQ ID NO: 2513283 - DNA, 21 bp, Homo sapiens
agccccctttgggcccaggga

SEQ ID NO: 2513284 - DNA, 16 bp, Homo sapiens
agccccgaggccttct

SEQ ID NO: 2513285 - DNA, 22 bp, Homo sapiens
agccccgaggccttctctgaag

SEQ ID NO: 2513286 - DNA, 18 bp, Homo sapiens
agccccgcgcctccttcc

SEQ ID NO: 2513287 - DNA, 18 bp, Homo sapiens
agccccggccctgggctc

SEQ ID NO: 2513288 - DNA, 18 bp, Homo sapiens
agccccgtggggttcctc

SEQ ID NO: 2513289 - DNA, 17 bp, Homo sapiens
agcccctaccccacacc

SEQ ID NO: 2513290 - DNA, 16 bp, Homo sapiens
agcccctcttgccccc

SEQ ID NO: 2513291 - DNA, 22 bp, Homo sapiens
agcccctcttgccccccacccc

SEQ ID NO: 2513292 - DNA, 20 bp, Homo sapiens
agcccctgatcctgtgaagt

SEQ ID NO: 2513293 - DNA, 17 bp, Homo sapiens
agcccctggatgcagcc

SEQ ID NO: 2513294 - DNA, 14 bp, Homo sapiens
agccccttagcccc

SEQ ID NO: 2513295 - DNA, 16 bp, Homo sapiens
agccccttctgaccca

SEQ ID NO: 2513296 - DNA, 20 bp, Homo sapiens
agccccttgctctcccctgc

SEQ ID NO: 2513297 - DNA, 23 bp, Homo sapiens
agcccctttttcatatgttgctc

SEQ ID NO: 2513298 - DNA, 16 bp, Homo sapiens
agcccgcacccccacc

SEQ ID NO: 2513299 - DNA, 18 bp, Homo sapiens
agcccgcctgccagtcct

SEQ ID NO: 2513300 - DNA, 20 bp, Homo sapiens
agcccggaccttggcagccc

SEQ ID NO: 2513301 - DNA, 11 bp, Homo sapiens
agcccggcctg

SEQ ID NO: 2513302 - DNA, 13 bp, Homo sapiens
agcccggctggtt

SEQ ID NO: 2513303 - DNA, 15 bp, Homo sapiens
agcccggctggtttt

SEQ ID NO: 2513304 - DNA, 13 bp, Homo sapiens
agcccgggctctg

SEQ ID NO: 2513305 - DNA, 14 bp, Homo sapiens
agcccgggctctgc

SEQ ID NO: 2513306 - DNA, 21 bp, Homo sapiens
agcccgggctgcctgggctgt

SEQ ID NO: 2513307 - DNA, 15 bp, Homo sapiens
agcccgtgtggcccc

SEQ ID NO: 2513308 - DNA, 17 bp, Homo sapiens
agcccgtgtggcccctt

SEQ ID NO: 2513309 - DNA, 19 bp, Homo sapiens
agccctaaatctagactca

SEQ ID NO: 2513310 - DNA, 17 bp, Homo sapiens
agccctagggtggagag

SEQ ID NO: 2513311 - DNA, 23 bp, Homo sapiens
agccctccgccattctcaagccc

SEQ ID NO: 2513312 - DNA, 11 bp, Homo sapiens
agccctcttcc

SEQ ID NO: 2513313 - DNA, 15 bp, Homo sapiens
agccctcttccatca

SEQ ID NO: 2513314 - DNA, 13 bp, Homo sapiens
agccctgctggcc

SEQ ID NO: 2513315 - DNA, 17 bp, Homo sapiens
agccctgctggccgcct

SEQ ID NO: 2513316 - DNA, 20 bp, Homo sapiens
agccctggagccaactgctg

SEQ ID NO: 2513317 - DNA, 23 bp, Homo sapiens
agccctggagccaactgctgctt

SEQ ID NO: 2513318 - DNA, 12 bp, Homo sapiens
agccctggcagg

SEQ ID NO: 2513319 - DNA, 13 bp, Homo sapiens
agccctggcagga

SEQ ID NO: 2513320 - DNA, 12 bp, Homo sapiens
agccctggctga

SEQ ID NO: 2513321 - DNA, 14 bp, Homo sapiens
agccctggtctcag

SEQ ID NO: 2513322 - DNA, 23 bp, Homo sapiens
agccctggtggcagtgggagctg

SEQ ID NO: 2513323 - DNA, 14 bp, Homo sapiens
agccctgtcagtgc

SEQ ID NO: 2513324 - DNA, 16 bp, Homo sapiens
agccctgtcagtgcag

SEQ ID NO: 2513325 - DNA, 20 bp, Homo sapiens
agccctgtcagtgcagcccg

SEQ ID NO: 2513326 - DNA, 22 bp, Homo sapiens
agcccttccatgtcgcctctgc

SEQ ID NO: 2513327 - DNA, 22 bp, Homo sapiens
agccctttgggaggctgaggcg

SEQ ID NO: 2513328 - DNA, 13 bp, Homo sapiens
agccgacctcagc

SEQ ID NO: 2513329 - DNA, 17 bp, Homo sapiens
agccgagatcacgccac

SEQ ID NO: 2513330 - DNA, 20 bp, Homo sapiens
agccgagatcacgccactgc

SEQ ID NO: 2513331 - DNA, 23 bp, Homo sapiens
agccgagctcgtgtatcctgggg

SEQ ID NO: 2513332 - DNA, 14 bp, Homo sapiens
agccgcagcctccc

SEQ ID NO: 2513333 - DNA, 18 bp, Homo sapiens
agccgcagcctccctctg

SEQ ID NO: 2513334 - DNA, 21 bp, Homo sapiens
agccgccatgctcctggccca

SEQ ID NO: 2513335 - DNA, 17 bp, Homo sapiens
agccgccattgccacca

SEQ ID NO: 2513336 - DNA, 21 bp, Homo sapiens
agccgctcctgtctgccagcc

SEQ ID NO: 2513337 - DNA, 15 bp, Homo sapiens
agccgctgagcgagg

SEQ ID NO: 2513338 - DNA, 19 bp, Homo sapiens
agccgctgagcgaggagat

SEQ ID NO: 2513339 - DNA, 12 bp, Homo sapiens
agccgctgctgg

SEQ ID NO: 2513340 - DNA, 19 bp, Homo sapiens
agccgctgtgagcccctgg

SEQ ID NO: 2513341 - DNA, 18 bp, Homo sapiens
agccggcctctctggcct

SEQ ID NO: 2513342 - DNA, 17 bp, Homo sapiens
agccttcctctgcagct

SEQ ID NO: 2513343 - DNA, 18 bp, Homo sapiens
agccttcctctgcagctg

SEQ ID NO: 2513344 - DNA, 19 bp, Homo sapiens
agccttcctctgcagctga

SEQ ID NO: 2513345 - DNA, 23 bp, Homo sapiens
agccttcctctgcagctgacctc

SEQ ID NO: 2513346 - DNA, 15 bp, Homo sapiens
agccttctgtaggaa

SEQ ID NO: 2513347 - DNA, 19 bp, Homo sapiens
agccttctttgcttgcctc

SEQ ID NO: 2513348 - DNA, 13 bp, Homo sapiens
agccttgaacttt

SEQ ID NO: 2513349 - DNA, 16 bp, Homo sapiens
agccttgaactttgac

SEQ ID NO: 2513350 - DNA, 18 bp, Homo sapiens
agccttgaccattctcca

SEQ ID NO: 2513351 - DNA, 19 bp, Homo sapiens
agccttgaccattctccac

SEQ ID NO: 2513352 - DNA, 21 bp, Homo sapiens
agccttgcccggattctggga

SEQ ID NO: 2513353 - DNA, 19 bp, Homo sapiens
agccttgcggaaggttcta

SEQ ID NO: 2513354 - DNA, 18 bp, Homo sapiens
agccttgtaattctaaat

SEQ ID NO: 2513355 - DNA, 16 bp, Homo sapiens
agccttgtgtctacag

SEQ ID NO: 2513356 - DNA, 20 bp, Homo sapiens
agccttgtgtctacagagaa

SEQ ID NO: 2513357 - DNA, 11 bp, Homo sapiens
agcctttgaat

SEQ ID NO: 2513358 - DNA, 18 bp, Homo sapiens
agcctttggatgaccaga

SEQ ID NO: 2513359 - DNA, 18 bp, Homo sapiens
agccttttccctctttgg

SEQ ID NO: 2513360 - DNA, 23 bp, Homo sapiens
agccttttccctctttggctccc

SEQ ID NO: 2513361 - DNA, 12 bp, Homo sapiens
agcgaagggagt

SEQ ID NO: 2513362 - DNA, 20 bp, Homo sapiens
agcgaatgctaggtctcgga

SEQ ID NO: 2513363 - DNA, 17 bp, Homo sapiens
agcgacagtgagactct

SEQ ID NO: 2513364 - DNA, 19 bp, Homo sapiens
agcgaccacccctgcctcc

SEQ ID NO: 2513365 - DNA, 15 bp, Homo sapiens
agcgaccgccccctc

SEQ ID NO: 2513366 - DNA, 15 bp, Homo sapiens
agcgaggaggctcca

SEQ ID NO: 2513367 - DNA, 14 bp, Homo sapiens
agcgagttgtggaa

SEQ ID NO: 2513368 - DNA, 19 bp, Homo sapiens
agcgatgaatttggagact

SEQ ID NO: 2513369 - DNA, 18 bp, Homo sapiens
agcgatggtctcagaaac

SEQ ID NO: 2513370 - DNA, 16 bp, Homo sapiens
agcgatgtatgcagct

SEQ ID NO: 2513371 - DNA, 19 bp, Homo sapiens
agcgattattatctaaagt

SEQ ID NO: 2513372 - DNA, 12 bp, Homo sapiens
agcgcacctgcc

SEQ ID NO: 2513373 - DNA, 16 bp, Homo sapiens
agcgccaagcaacctg

SEQ ID NO: 2513374 - DNA, 16 bp, Homo sapiens
agcgctggccgggacc

SEQ ID NO: 2513375 - DNA, 13 bp, Homo sapiens
agcggaaagcagc

SEQ ID NO: 2513376 - DNA, 17 bp, Homo sapiens
agcggaacaaggagtca

SEQ ID NO: 2513377 - DNA, 18 bp, Homo sapiens
agcggagacggagtccca

SEQ ID NO: 2513378 - DNA, 23 bp, Homo sapiens
agcggaggttgcagggagccgag

SEQ ID NO: 2513379 - DNA, 23 bp, Homo sapiens
agcggctggcagcccacccctca

SEQ ID NO: 2513380 - DNA, 19 bp, Homo sapiens
agcggggcgaagcccaggc

SEQ ID NO: 2513381 - DNA, 19 bp, Homo sapiens
agcggtttggggagcagag

SEQ ID NO: 2513382 - DNA, 14 bp, Homo sapiens
agcgtagcctctcc

SEQ ID NO: 2513383 - DNA, 13 bp, Homo sapiens
agcgtcccagtct

SEQ ID NO: 2513384 - DNA, 19 bp, Homo sapiens
agcgtcccagtctctggca

SEQ ID NO: 2513385 - DNA, 19 bp, Homo sapiens
agcgtcctcctctgtgacc

SEQ ID NO: 2513386 - DNA, 17 bp, Homo sapiens
agcgtgagccactgcac

SEQ ID NO: 2513387 - DNA, 19 bp, Homo sapiens
agcgtgctccagcctggct

SEQ ID NO: 2513388 - DNA, 15 bp, Homo sapiens
agcgtggacaggtgt

SEQ ID NO: 2513389 - DNA, 15 bp, Homo sapiens
agctaaaatgatttt

SEQ ID NO: 2513390 - DNA, 16 bp, Homo sapiens
agctaaaatgatttta

SEQ ID NO: 2513391 - DNA, 17 bp, Homo sapiens
agctaacactggcccct

SEQ ID NO: 2513392 - DNA, 19 bp, Homo sapiens
agctaacactggcccctag

SEQ ID NO: 2513393 - DNA, 15 bp, Homo sapiens
agctaagaaataaaa

SEQ ID NO: 2513394 - DNA, 19 bp, Homo sapiens
agctaagaaataaaactgt

SEQ ID NO: 2513395 - DNA, 17 bp, Homo sapiens
agctaagctaggaatga

SEQ ID NO: 2513396 - DNA, 16 bp, Homo sapiens
agctaaggacatttcc

SEQ ID NO: 2513397 - DNA, 19 bp, Homo sapiens
agctaaggacatttcccag

SEQ ID NO: 2513398 - DNA, 19 bp, Homo sapiens
agctacaggttacaacaga

SEQ ID NO: 2513399 - DNA, 21 bp, Homo sapiens
agctacaggttacaacagatt

SEQ ID NO: 2513400 - DNA, 22 bp, Homo sapiens
agctacaggttacaacagattt

SEQ ID NO: 2513401 - DNA, 17 bp, Homo sapiens
agctacccgcagagttc

SEQ ID NO: 2513402 - DNA, 20 bp, Homo sapiens
agctaccctttttctccagc

SEQ ID NO: 2513403 - DNA, 16 bp, Homo sapiens
agctacctcaaacttc

SEQ ID NO: 2513404 - DNA, 19 bp, Homo sapiens
agctactcagaagcctgag

SEQ ID NO: 2513405 - DNA, 13 bp, Homo sapiens
agctactcaggag

SEQ ID NO: 2513406 - DNA, 23 bp, Homo sapiens
agctactgatttcctttggagct

SEQ ID NO: 2513407 - DNA, 19 bp, Homo sapiens
agctactgcggaaaaggaa

SEQ ID NO: 2513408 - DNA, 22 bp, Homo sapiens
agctacttgggaagctgaggcg

SEQ ID NO: 2513409 - DNA, 14 bp, Homo sapiens
agctacttgggagg

SEQ ID NO: 2513410 - DNA, 17 bp, Homo sapiens
agctacttgggaggctg

SEQ ID NO: 2513411 - DNA, 13 bp, Homo sapiens
agctacttgggcc

SEQ ID NO: 2513412 - DNA, 14 bp, Homo sapiens
agctacttgggcca

SEQ ID NO: 2513413 - DNA, 16 bp, Homo sapiens
agctagaacccggcag

SEQ ID NO: 2513414 - DNA, 12 bp, Homo sapiens
agctagaggaac

SEQ ID NO: 2513415 - DNA, 18 bp, Homo sapiens
agctagctcccctcctct

SEQ ID NO: 2513416 - DNA, 20 bp, Homo sapiens
agctagctcccctcctctcc

SEQ ID NO: 2513417 - DNA, 12 bp, Homo sapiens
agctaggaatga

SEQ ID NO: 2513418 - DNA, 21 bp, Homo sapiens
agctaggcctggccagatgca

SEQ ID NO: 2513419 - DNA, 18 bp, Homo sapiens
agctagttcgtagctttc

SEQ ID NO: 2513420 - DNA, 18 bp, Homo sapiens
agctatagacccgaggaa

SEQ ID NO: 2513421 - DNA, 17 bp, Homo sapiens
agctatatccatgtact

SEQ ID NO: 2513422 - DNA, 20 bp, Homo sapiens
agctatatccatgtactgta

SEQ ID NO: 2513423 - DNA, 20 bp, Homo sapiens
agctatcagaagaccacaaa

SEQ ID NO: 2513424 - DNA, 15 bp, Homo sapiens
agctatcctggctct

SEQ ID NO: 2513425 - DNA, 24 bp, Homo sapiens
agctatctggtcaacctcctggac

SEQ ID NO: 2513426 - DNA, 18 bp, Homo sapiens
agctatgggagccccagg

SEQ ID NO: 2513427 - DNA, 17 bp, Homo sapiens
agctatggtgagatgca

SEQ ID NO: 2513428 - DNA, 22 bp, Homo sapiens
agctatgttatattgaaaaaat

SEQ ID NO: 2513429 - DNA, 21 bp, Homo sapiens
agctattactgtctggtttta

SEQ ID NO: 2513430 - DNA, 18 bp, Homo sapiens
agctattagccaggatca

SEQ ID NO: 2513431 - DNA, 22 bp, Homo sapiens
agctattagccaggatcatggt

SEQ ID NO: 2513432 - DNA, 22 bp, Homo sapiens
agctatttttatttgtttgtgc

SEQ ID NO: 2513433 - DNA, 15 bp, Homo sapiens
agctcaaaggcacag

SEQ ID NO: 2513434 - DNA, 16 bp, Homo sapiens
agctcaaaggcacagt

SEQ ID NO: 2513435 - DNA, 15 bp, Homo sapiens
agctcaccagcccca

SEQ ID NO: 2513436 - DNA, 23 bp, Homo sapiens
agctcaccagccccagtgcccac

SEQ ID NO: 2513437 - DNA, 21 bp, Homo sapiens
agctcaccccccacactcact

SEQ ID NO: 2513438 - DNA, 12 bp, Homo sapiens
agctcacctctc

SEQ ID NO: 2513439 - DNA, 17 bp, Homo sapiens
agctcacctgttgctta

SEQ ID NO: 2513440 - DNA, 16 bp, Homo sapiens
agctcagaaggctctt

SEQ ID NO: 2513441 - DNA, 19 bp, Homo sapiens
agctcagaaggctcttctg

SEQ ID NO: 2513442 - DNA, 16 bp, Homo sapiens
agctcagcccaccccc

SEQ ID NO: 2513443 - DNA, 19 bp, Homo sapiens
agctcagcccacccccctc

SEQ ID NO: 2513444 - DNA, 17 bp, Homo sapiens
agctcagcgccagcctg

SEQ ID NO: 2513445 - DNA, 18 bp, Homo sapiens
agctcaggaccaggcaat

SEQ ID NO: 2513446 - DNA, 12 bp, Homo sapiens
agctcagggcct

SEQ ID NO: 2513447 - DNA, 14 bp, Homo sapiens
agctcagggcctgg

SEQ ID NO: 2513448 - DNA, 10 bp, Homo sapiens
agctcaggtg

SEQ ID NO: 2513449 - DNA, 17 bp, Homo sapiens
agctcaggtgtccctgc

SEQ ID NO: 2513450 - DNA, 22 bp, Homo sapiens
agctcaggtgtccctgcacttg

SEQ ID NO: 2513451 - DNA, 19 bp, Homo sapiens
agctcagtttatccaaggt

SEQ ID NO: 2513452 - DNA, 14 bp, Homo sapiens
agctcatattttgt

SEQ ID NO: 2513453 - DNA, 15 bp, Homo sapiens
agctcatttcacttt

SEQ ID NO: 2513454 - DNA, 21 bp, Homo sapiens
agctccacaccctctcccagg

SEQ ID NO: 2513455 - DNA, 13 bp, Homo sapiens
agctccagctcac

SEQ ID NO: 2513456 - DNA, 17 bp, Homo sapiens
agctccagctcaccagc

SEQ ID NO: 2513457 - DNA, 18 bp, Homo sapiens
agctccagctcaccagcc

SEQ ID NO: 2513458 - DNA, 19 bp, Homo sapiens
agctccagctcaccagccc

SEQ ID NO: 2513459 - DNA, 21 bp, Homo sapiens
agctccagctcaccagcccca

SEQ ID NO: 2513460 - DNA, 13 bp, Homo sapiens
agctccatctcca

SEQ ID NO: 2513461 - DNA, 16 bp, Homo sapiens
agctccatctccactc

SEQ ID NO: 2513462 - DNA, 23 bp, Homo sapiens
agctcccaggcattccccaggag

SEQ ID NO: 2513463 - DNA, 14 bp, Homo sapiens
agctcccaggccga

SEQ ID NO: 2513464 - DNA, 21 bp, Homo sapiens
agctcccaggccgagaagcca

SEQ ID NO: 2513465 - DNA, 16 bp, Homo sapiens
agctcccatttctact

SEQ ID NO: 2513466 - DNA, 19 bp, Homo sapiens
agctcccctcggagaagag

SEQ ID NO: 2513467 - DNA, 20 bp, Homo sapiens
agctcccctcggagaagagc

SEQ ID NO: 2513468 - DNA, 17 bp, Homo sapiens
agctccgcctcccgggt

SEQ ID NO: 2513469 - DNA, 15 bp, Homo sapiens
agctcctagcagaga

SEQ ID NO: 2513470 - DNA, 17 bp, Homo sapiens
agctcctagcagagaga

SEQ ID NO: 2513471 - DNA, 15 bp, Homo sapiens
agctcctcatccagg

SEQ ID NO: 2513472 - DNA, 18 bp, Homo sapiens
agctcctcatccagggct

SEQ ID NO: 2513473 - DNA, 19 bp, Homo sapiens
agctcctcatccagggctc

SEQ ID NO: 2513474 - DNA, 21 bp, Homo sapiens
agctcctcatccagggctctg

SEQ ID NO: 2513475 - DNA, 14 bp, Homo sapiens
agctcctctcctgg

SEQ ID NO: 2513476 - DNA, 16 bp, Homo sapiens
agctcctctcctggag

SEQ ID NO: 2513477 - DNA, 23 bp, Homo sapiens
agctcctgctccacagccatccc

SEQ ID NO: 2513478 - DNA, 11 bp, Homo sapiens
agctcctgtaa

SEQ ID NO: 2513479 - DNA, 13 bp, Homo sapiens
agctcctgtcctc

SEQ ID NO: 2513480 - DNA, 12 bp, Homo sapiens
agctccttctgt

SEQ ID NO: 2513481 - DNA, 21 bp, Homo sapiens
agctccttctgtcctactctg

SEQ ID NO: 2513482 - DNA, 18 bp, Homo sapiens
agcttgataaagggccaa

SEQ ID NO: 2513483 - DNA, 18 bp, Homo sapiens
agcttgccccggccccgg

SEQ ID NO: 2513484 - DNA, 21 bp, Homo sapiens
agcttgcgcattctcatggag

SEQ ID NO: 2513485 - DNA, 15 bp, Homo sapiens
agcttgctcacatct

SEQ ID NO: 2513486 - DNA, 21 bp, Homo sapiens
agcttggcagccgagctcgtg

SEQ ID NO: 2513487 - DNA, 12 bp, Homo sapiens
agcttgggaatg

SEQ ID NO: 2513488 - DNA, 16 bp, Homo sapiens
agcttgggacaaatca

SEQ ID NO: 2513489 - DNA, 18 bp, Homo sapiens
agcttgggaggcttcccc

SEQ ID NO: 2513490 - DNA, 19 bp, Homo sapiens
agcttgggcccagctgggc

SEQ ID NO: 2513491 - DNA, 22 bp, Homo sapiens
agcttgtctatggtacaaaaat

SEQ ID NO: 2513492 - DNA, 12 bp, Homo sapiens
agcttgtgtatc

SEQ ID NO: 2513493 - DNA, 13 bp, Homo sapiens
agctttaaaagaa

SEQ ID NO: 2513494 - DNA, 20 bp, Homo sapiens
agctttaaactcagggacag

SEQ ID NO: 2513495 - DNA, 15 bp, Homo sapiens
agctttacatgcaat

SEQ ID NO: 2513496 - DNA, 19 bp, Homo sapiens
agctttacatgcaatttat

SEQ ID NO: 2513497 - DNA, 13 bp, Homo sapiens
agctttaccctca

SEQ ID NO: 2513498 - DNA, 18 bp, Homo sapiens
agctttaccctcaggcat

SEQ ID NO: 2513499 - DNA, 14 bp, Homo sapiens
agctttatgtaata

SEQ ID NO: 2513500 - DNA, 22 bp, Homo sapiens
agctttatgtaataatgtgaat

SEQ ID NO: 2513501 - DNA, 19 bp, Homo sapiens
agctttattttttaagtat

SEQ ID NO: 2513502 - DNA, 22 bp, Homo sapiens
agctttattttttaagtattta

SEQ ID NO: 2513503 - DNA, 22 bp, Homo sapiens
agctttcatgtaaactgtgcac

SEQ ID NO: 2513504 - DNA, 12 bp, Homo sapiens
agctttccctgc

SEQ ID NO: 2513505 - DNA, 16 bp, Homo sapiens
agctttccctgcctct

SEQ ID NO: 2513506 - DNA, 12 bp, Homo sapiens
agctttgaaaat

SEQ ID NO: 2513507 - DNA, 18 bp, Homo sapiens
agctttgaaaattcagtg

SEQ ID NO: 2513508 - DNA, 19 bp, Homo sapiens
agctttgaaaattcagtgg

SEQ ID NO: 2513509 - DNA, 19 bp, Homo sapiens
agctttgaaggccgaaggc

SEQ ID NO: 2513510 - DNA, 18 bp, Homo sapiens
agctttgcatgttccact

SEQ ID NO: 2513511 - DNA, 17 bp, Homo sapiens
agctttgccagctgctg

SEQ ID NO: 2513512 - DNA, 21 bp, Homo sapiens
agctttgctaccaaagcacct

SEQ ID NO: 2513513 - DNA, 18 bp, Homo sapiens
agctttgctctttggtag

SEQ ID NO: 2513514 - DNA, 23 bp, Homo sapiens
agctttgctctttggtagaaaag

SEQ ID NO: 2513515 - DNA, 17 bp, Homo sapiens
agctttggtgcaatggc

SEQ ID NO: 2513516 - DNA, 21 bp, Homo sapiens
agctttgtttgttgtcagctg

SEQ ID NO: 2513517 - DNA, 18 bp, Homo sapiens
agcttttcccaaaagccc

SEQ ID NO: 2513518 - DNA, 16 bp, Homo sapiens
agcttttcccttcttt

SEQ ID NO: 2513519 - DNA, 15 bp, Homo sapiens
agctttttaattgtt

SEQ ID NO: 2513520 - DNA, 21 bp, Homo sapiens
agctttttaattgttgtttct

SEQ ID NO: 2513521 - DNA, 14 bp, Homo sapiens
aggaaaagctgctg

SEQ ID NO: 2513522 - DNA, 16 bp, Homo sapiens
aggaaaagtacattta

SEQ ID NO: 2513523 - DNA, 16 bp, Homo sapiens
aggaaaccacagctgc

SEQ ID NO: 2513524 - DNA, 18 bp, Homo sapiens
aggaaacccagctctggt

SEQ ID NO: 2513525 - DNA, 20 bp, Homo sapiens
aggaaacccagctctggtcc

SEQ ID NO: 2513526 - DNA, 20 bp, Homo sapiens
aggaaactcacctgctggcc

SEQ ID NO: 2513527 - DNA, 22 bp, Homo sapiens
aggaaactcacctgctggcccc

SEQ ID NO: 2513528 - DNA, 18 bp, Homo sapiens
aggaaactcttatctcag

SEQ ID NO: 2513529 - DNA, 22 bp, Homo sapiens
aggaaagatttttgttgttatt

SEQ ID NO: 2513530 - DNA, 19 bp, Homo sapiens
aggaaagcaataaatgaat

SEQ ID NO: 2513531 - DNA, 19 bp, Homo sapiens
aggaaagccccagcactaa

SEQ ID NO: 2513532 - DNA, 20 bp, Homo sapiens
aggaaagccccagcactaac

SEQ ID NO: 2513533 - DNA, 13 bp, Homo sapiens
aggaaaggctcca

SEQ ID NO: 2513534 - DNA, 18 bp, Homo sapiens
aggaaaggctccaggagc

SEQ ID NO: 2513535 - DNA, 20 bp, Homo sapiens
aggaaaggctccaggagcag

SEQ ID NO: 2513536 - DNA, 14 bp, Homo sapiens
aggaaataaaacct

SEQ ID NO: 2513537 - DNA, 20 bp, Homo sapiens
aggaaataaaacctttcaaa

SEQ ID NO: 2513538 - DNA, 21 bp, Homo sapiens
aggaaataaaacctttcaaat

SEQ ID NO: 2513539 - DNA, 22 bp, Homo sapiens
aggaaataaaacctttcaaatt

SEQ ID NO: 2513540 - DNA, 21 bp, Homo sapiens
aggaaatcaaatatgcaaagc

SEQ ID NO: 2513541 - DNA, 23 bp, Homo sapiens
aggaaatcaaatatgcaaagcac

SEQ ID NO: 2513542 - DNA, 18 bp, Homo sapiens
aggaaatggaatactgaa

SEQ ID NO: 2513543 - DNA, 13 bp, Homo sapiens
aggaacagaagga

SEQ ID NO: 2513544 - DNA, 19 bp, Homo sapiens
aggaacatatgaaaataca

SEQ ID NO: 2513545 - DNA, 13 bp, Homo sapiens
aggaactcccagc

SEQ ID NO: 2513546 - DNA, 13 bp, Homo sapiens
aggaactctggct

SEQ ID NO: 2513547 - DNA, 18 bp, Homo sapiens
aggaactctggcttccag

SEQ ID NO: 2513548 - DNA, 21 bp, Homo sapiens
aggaacttaaataatgtgaaa

SEQ ID NO: 2513549 - DNA, 20 bp, Homo sapiens
aggaagaattttaaaaatga

SEQ ID NO: 2513550 - DNA, 13 bp, Homo sapiens
aggaagactttgg

SEQ ID NO: 2513551 - DNA, 14 bp, Homo sapiens
aggaagagaaaaaa

SEQ ID NO: 2513552 - DNA, 15 bp, Homo sapiens
aggaagatgaaagag

SEQ ID NO: 2513553 - DNA, 18 bp, Homo sapiens
aggaagcattcagagagc

SEQ ID NO: 2513554 - DNA, 16 bp, Homo sapiens
aggaagccacagctgg

SEQ ID NO: 2513555 - DNA, 19 bp, Homo sapiens
aggaagccgctggggccag

SEQ ID NO: 2513556 - DNA, 20 bp, Homo sapiens
aggaagccgctggggccagt

SEQ ID NO: 2513557 - DNA, 21 bp, Homo sapiens
aggaagccgtgccctgccccc

SEQ ID NO: 2513558 - DNA, 14 bp, Homo sapiens
aggaagctcagact

SEQ ID NO: 2513559 - DNA, 13 bp, Homo sapiens
aggaagctcaggg

SEQ ID NO: 2513560 - DNA, 15 bp, Homo sapiens
aggaagctcagggcc

SEQ ID NO: 2513561 - DNA, 16 bp, Homo sapiens
aggaagctctctttcc

SEQ ID NO: 2513562 - DNA, 22 bp, Homo sapiens
aggaaggaaacccagctctggt

SEQ ID NO: 2513563 - DNA, 14 bp, Homo sapiens
aggaaggaccctga

SEQ ID NO: 2513564 - DNA, 17 bp, Homo sapiens
aggaaggagagcctgct

SEQ ID NO: 2513565 - DNA, 15 bp, Homo sapiens
aggaaggagaggaga

SEQ ID NO: 2513566 - DNA, 14 bp, Homo sapiens
aggaaggattgtaa

SEQ ID NO: 2513567 - DNA, 15 bp, Homo sapiens
aggaaggcaggaaga

SEQ ID NO: 2513568 - DNA, 13 bp, Homo sapiens
aggaaggcggggc

SEQ ID NO: 2513569 - DNA, 17 bp, Homo sapiens
aggaagggcaggaagga

SEQ ID NO: 2513570 - DNA, 18 bp, Homo sapiens
aggaaggttttctccact

SEQ ID NO: 2513571 - DNA, 14 bp, Homo sapiens
aggaagtgaagaat

SEQ ID NO: 2513572 - DNA, 19 bp, Homo sapiens
aggaataaataaaaatgga

SEQ ID NO: 2513573 - DNA, 20 bp, Homo sapiens
aggaataaattgctccttga

SEQ ID NO: 2513574 - DNA, 23 bp, Homo sapiens
aggaataatgggcttagagcagt

SEQ ID NO: 2513575 - DNA, 22 bp, Homo sapiens
aggaatcagcaagaagatccta

SEQ ID NO: 2513576 - DNA, 21 bp, Homo sapiens
aggaatcatgtcaggcctgtg

SEQ ID NO: 2513577 - DNA, 23 bp, Homo sapiens
aggtggggtatttaccacagcag

SEQ ID NO: 2513578 - DNA, 19 bp, Homo sapiens
aggtggtcctgagacctga

SEQ ID NO: 2513579 - DNA, 16 bp, Homo sapiens
aggtggtctgaatgtt

SEQ ID NO: 2513580 - DNA, 20 bp, Homo sapiens
aggtggtctgaatgttctga

SEQ ID NO: 2513581 - DNA, 22 bp, Homo sapiens
aggtggtctgaatgttctgaca

SEQ ID NO: 2513582 - DNA, 23 bp, Homo sapiens
aggtggtctgaatgttctgacat

SEQ ID NO: 2513583 - DNA, 15 bp, Homo sapiens
aggtggtgcttacat

SEQ ID NO: 2513584 - DNA, 19 bp, Homo sapiens
aggtgtcaggctgctggcg

SEQ ID NO: 2513585 - DNA, 20 bp, Homo sapiens
aggtgtccctgcacttgcag

SEQ ID NO: 2513586 - DNA, 14 bp, Homo sapiens
aggtgtctgcaccc

SEQ ID NO: 2513587 - DNA, 16 bp, Homo sapiens
aggtgtctgcacccag

SEQ ID NO: 2513588 - DNA, 14 bp, Homo sapiens
aggtgtcttcctcc

SEQ ID NO: 2513589 - DNA, 14 bp, Homo sapiens
aggtgtgagtcacc

SEQ ID NO: 2513590 - DNA, 21 bp, Homo sapiens
aggtgtgagtcaccaagccca

SEQ ID NO: 2513591 - DNA, 12 bp, Homo sapiens
aggtgtgctctg

SEQ ID NO: 2513592 - DNA, 17 bp, Homo sapiens
aggtgtgggggctgcag

SEQ ID NO: 2513593 - DNA, 21 bp, Homo sapiens
aggtgttgattttctgttgta

SEQ ID NO: 2513594 - DNA, 17 bp, Homo sapiens
aggtgtttaaagagagg

SEQ ID NO: 2513595 - DNA, 24 bp, Homo sapiens
aggttaaggctgaggaaaggccag

SEQ ID NO: 2513596 - DNA, 14 bp, Homo sapiens
aggttaatgttcat

SEQ ID NO: 2513597 - DNA, 19 bp, Homo sapiens
aggttacaacagatttgtg

SEQ ID NO: 2513598 - DNA, 24 bp, Homo sapiens
aggttacaacagatttgtgaactc

SEQ ID NO: 2513599 - DNA, 21 bp, Homo sapiens
aggttaccctgtaacatgcaa

SEQ ID NO: 2513600 - DNA, 14 bp, Homo sapiens
aggttataggtcac

SEQ ID NO: 2513601 - DNA, 14 bp, Homo sapiens
aggttatcgaaata

SEQ ID NO: 2513602 - DNA, 18 bp, Homo sapiens
aggttatcgaaataacaa

SEQ ID NO: 2513603 - DNA, 17 bp, Homo sapiens
aggttatctgtcccagg

SEQ ID NO: 2513604 - DNA, 21 bp, Homo sapiens
aggttcatgccaccatggcca

SEQ ID NO: 2513605 - DNA, 11 bp, Homo sapiens
aggttctaaaa

SEQ ID NO: 2513606 - DNA, 17 bp, Homo sapiens
aggttctatttggaatt

SEQ ID NO: 2513607 - DNA, 14 bp, Homo sapiens
aggttctctcctcc

SEQ ID NO: 2513608 - DNA, 17 bp, Homo sapiens
aggttctctcctcccca

SEQ ID NO: 2513609 - DNA, 22 bp, Homo sapiens
aggttctctcctccccaaggag

SEQ ID NO: 2513610 - DNA, 19 bp, Homo sapiens
aggttcttcccttttacat

SEQ ID NO: 2513611 - DNA, 21 bp, Homo sapiens
aggttcttcttcctgaagctg

SEQ ID NO: 2513612 - DNA, 14 bp, Homo sapiens
aggttgaagcacca

SEQ ID NO: 2513613 - DNA, 21 bp, Homo sapiens
aggttgacaataaatgtgctt

SEQ ID NO: 2513614 - DNA, 12 bp, Homo sapiens
aggttgataact

SEQ ID NO: 2513615 - DNA, 19 bp, Homo sapiens
aggttgataactttgcttg

SEQ ID NO: 2513616 - DNA, 12 bp, Homo sapiens
aggttgcaggga

SEQ ID NO: 2513617 - DNA, 20 bp, Homo sapiens
aggttggcaaaaaggcagga

SEQ ID NO: 2513618 - DNA, 19 bp, Homo sapiens
aggttggggtgtactagtt

SEQ ID NO: 2513619 - DNA, 14 bp, Homo sapiens
aggttggtgggggc

SEQ ID NO: 2513620 - DNA, 17 bp, Homo sapiens
aggttgtaaatgtgttt

SEQ ID NO: 2513621 - DNA, 17 bp, Homo sapiens
aggttgtagtaaagaaa

SEQ ID NO: 2513622 - DNA, 16 bp, Homo sapiens
aggttgttcctaaaat

SEQ ID NO: 2513623 - DNA, 17 bp, Homo sapiens
aggtttaaacttctctg

SEQ ID NO: 2513624 - DNA, 13 bp, Homo sapiens
aggtttaactcag

SEQ ID NO: 2513625 - DNA, 19 bp, Homo sapiens
aggtttaactcagatcact

SEQ ID NO: 2513626 - DNA, 14 bp, Homo sapiens
aggtttaagctgtt

SEQ ID NO: 2513627 - DNA, 17 bp, Homo sapiens
aggtttcgtttctgtat

SEQ ID NO: 2513628 - DNA, 15 bp, Homo sapiens
aggtttctgaaaatt

SEQ ID NO: 2513629 - DNA, 23 bp, Homo sapiens
aggtttctgaaaattaacactgc

SEQ ID NO: 2513630 - DNA, 23 bp, Homo sapiens
aggtttctggtctctaggctggg

SEQ ID NO: 2513631 - DNA, 15 bp, Homo sapiens
aggttttgtaaagat

SEQ ID NO: 2513632 - DNA, 13 bp, Homo sapiens
aggttttgtacaa

SEQ ID NO: 2513633 - DNA, 17 bp, Homo sapiens
aggttttgttgttttat

SEQ ID NO: 2513634 - DNA, 17 bp, Homo sapiens
aggttttgtttgctatc

SEQ ID NO: 2513635 - DNA, 12 bp, Homo sapiens
aggtttttcaat

SEQ ID NO: 2513636 - DNA, 16 bp, Homo sapiens
aggtttttcaattaaa

SEQ ID NO: 2513637 - DNA, 13 bp, Homo sapiens
aggtttttcttaa

SEQ ID NO: 2513638 - DNA, 20 bp, Homo sapiens
aggtttttggaattatgtct

SEQ ID NO: 2513639 - DNA, 16 bp, Homo sapiens
aggtttttttccttct

SEQ ID NO: 2513640 - DNA, 21 bp, Homo sapiens
aggtttttttgtatagtaaag

SEQ ID NO: 2513641 - DNA, 19 bp, Homo sapiens
agtaaaaaacaacttcttt

SEQ ID NO: 2513642 - DNA, 15 bp, Homo sapiens
agtaaaaataaaatt

SEQ ID NO: 2513643 - DNA, 15 bp, Homo sapiens
agtaaaaattaaaaa

SEQ ID NO: 2513644 - DNA, 16 bp, Homo sapiens
agtaaactatttatct

SEQ ID NO: 2513645 - DNA, 15 bp, Homo sapiens
agtaaagaaatgaca

SEQ ID NO: 2513646 - DNA, 12 bp, Homo sapiens
agtaaagaaatt

SEQ ID NO: 2513647 - DNA, 18 bp, Homo sapiens
agtaaagtgataatttct

SEQ ID NO: 2513648 - DNA, 21 bp, Homo sapiens
agtaaatgggggtgcatttga

SEQ ID NO: 2513649 - DNA, 23 bp, Homo sapiens
agtaaccttttgcacctgctctc

SEQ ID NO: 2513650 - DNA, 14 bp, Homo sapiens
agtaacttggcttt

SEQ ID NO: 2513651 - DNA, 18 bp, Homo sapiens
agtaacttggctttcatt

SEQ ID NO: 2513652 - DNA, 17 bp, Homo sapiens
agtaactttatgtgtaa

SEQ ID NO: 2513653 - DNA, 19 bp, Homo sapiens
agtaactttatgtgtaaat

SEQ ID NO: 2513654 - DNA, 13 bp, Homo sapiens
agtaagaaaagtg

SEQ ID NO: 2513655 - DNA, 19 bp, Homo sapiens
agtaagagctggtgtctga

SEQ ID NO: 2513656 - DNA, 20 bp, Homo sapiens
agtaagccgtgattttcatt

SEQ ID NO: 2513657 - DNA, 14 bp, Homo sapiens
agtaaggtgcagtt

SEQ ID NO: 2513658 - DNA, 19 bp, Homo sapiens
agtaagtaccactcaggcc

SEQ ID NO: 2513659 - DNA, 15 bp, Homo sapiens
agtaagtgccttcca

SEQ ID NO: 2513660 - DNA, 23 bp, Homo sapiens
agtaagtggggttgcaaccactg

SEQ ID NO: 2513661 - DNA, 16 bp, Homo sapiens
agtaataaactgtgtt

SEQ ID NO: 2513662 - DNA, 14 bp, Homo sapiens
agtaatatgcacac

SEQ ID NO: 2513663 - DNA, 15 bp, Homo sapiens
agtaatatgcacaca

SEQ ID NO: 2513664 - DNA, 19 bp, Homo sapiens
agtaatatgcacacatttt

SEQ ID NO: 2513665 - DNA, 18 bp, Homo sapiens
agtaatatttatatattt

SEQ ID NO: 2513666 - DNA, 12 bp, Homo sapiens
agtaatgaattt

SEQ ID NO: 2513667 - DNA, 18 bp, Homo sapiens
agtaatgctacgtgtgat

SEQ ID NO: 2513668 - DNA, 13 bp, Homo sapiens
agtaattatcggg

SEQ ID NO: 2513669 - DNA, 20 bp, Homo sapiens
agtaattatcgggaacagtg

SEQ ID NO: 2513670 - DNA, 22 bp, Homo sapiens
agtaattatcgggaacagtgtt

SEQ ID NO: 2513671 - DNA, 22 bp, Homo sapiens
agtaattggtccgatctttgac

SEQ ID NO: 2513672 - DNA, 19 bp, Homo sapiens
agtacaccacaagggtcac

SEQ ID NO: 2513673 - DNA, 14 bp, Homo sapiens
agtacactgtttca

SEQ ID NO: 2513674 - DNA, 18 bp, Homo sapiens
agtacaggcagcacagag

SEQ ID NO: 2513675 - DNA, 21 bp, Homo sapiens
agtacaggtaaggtgagggaa

SEQ ID NO: 2513676 - DNA, 22 bp, Homo sapiens
agtacataaaggtggtatgtgt

SEQ ID NO: 2513677 - DNA, 14 bp, Homo sapiens
agtacatgttaaac

SEQ ID NO: 2513678 - DNA, 19 bp, Homo sapiens
agtaccctctcagctccag

SEQ ID NO: 2513679 - DNA, 21 bp, Homo sapiens
agtacctataaagtaaagcta

SEQ ID NO: 2513680 - DNA, 23 bp, Homo sapiens
agtacctataaagtaaagctaaa

SEQ ID NO: 2513681 - DNA, 15 bp, Homo sapiens
agtacctcctgcccc

SEQ ID NO: 2513682 - DNA, 17 bp, Homo sapiens
agtacctgaaaaaatgc

SEQ ID NO: 2513683 - DNA, 14 bp, Homo sapiens
agtacctgaaaagt

SEQ ID NO: 2513684 - DNA, 15 bp, Homo sapiens
agtacctttgtcaca

SEQ ID NO: 2513685 - DNA, 18 bp, Homo sapiens
agtacgtgctaacaggct

SEQ ID NO: 2513686 - DNA, 14 bp, Homo sapiens
agtacgttgtgcat

SEQ ID NO: 2513687 - DNA, 16 bp, Homo sapiens
agtacgttgtgcattt

SEQ ID NO: 2513688 - DNA, 23 bp, Homo sapiens
agtactaactcctaggaaaatac

SEQ ID NO: 2513689 - DNA, 22 bp, Homo sapiens
agtactacagtcctcccatctc

SEQ ID NO: 2513690 - DNA, 14 bp, Homo sapiens
agtactatgtatca

SEQ ID NO: 2513691 - DNA, 20 bp, Homo sapiens
agtactcctgcaaaatttta

SEQ ID NO: 2513692 - DNA, 20 bp, Homo sapiens
agtactggctgatggagtaa

SEQ ID NO: 2513693 - DNA, 16 bp, Homo sapiens
agtactgtgtacagaa

SEQ ID NO: 2513694 - DNA, 22 bp, Homo sapiens
agtacttctccaccctgctctc

SEQ ID NO: 2513695 - DNA, 20 bp, Homo sapiens
agtagaaagacagagctggg

SEQ ID NO: 2513696 - DNA, 18 bp, Homo sapiens
agtagaaataatatgcat

SEQ ID NO: 2513697 - DNA, 21 bp, Homo sapiens
agtagaaggtcggaggcttgg

SEQ ID NO: 2513698 - DNA, 19 bp, Homo sapiens
agtagaagtcttagatgta

SEQ ID NO: 2513699 - DNA, 22 bp, Homo sapiens
agtagacatttctcttactgca

SEQ ID NO: 2513700 - DNA, 14 bp, Homo sapiens
agtagagtcatctc

SEQ ID NO: 2513701 - DNA, 15 bp, Homo sapiens
agtagatggtgaaat

SEQ ID NO: 2513702 - DNA, 21 bp, Homo sapiens
agtagatggtgaaatttatta

SEQ ID NO: 2513703 - DNA, 18 bp, Homo sapiens
agtagattttctttaaaa

SEQ ID NO: 2513704 - DNA, 20 bp, Homo sapiens
agtagattttctttaaaaga

SEQ ID NO: 2513705 - DNA, 23 bp, Homo sapiens
agtagattttctttaaaagaatg

SEQ ID NO: 2513706 - DNA, 20 bp, Homo sapiens
agtagcaagttctagagaag

SEQ ID NO: 2513707 - DNA, 18 bp, Homo sapiens
agtagcaccctggattga

SEQ ID NO: 2513708 - DNA, 20 bp, Homo sapiens
agtagcagtagatgcatgta

SEQ ID NO: 2513709 - DNA, 15 bp, Homo sapiens
agtagccctttctgt

SEQ ID NO: 2513710 - DNA, 19 bp, Homo sapiens
agtagccctttctgtgtgc

SEQ ID NO: 2513711 - DNA, 20 bp, Homo sapiens
agtagccctttctgtgtgca

SEQ ID NO: 2513712 - DNA, 19 bp, Homo sapiens
agtagctgggactacaggc

SEQ ID NO: 2513713 - DNA, 17 bp, Homo sapiens
agtaggaagactttgga

SEQ ID NO: 2513714 - DNA, 19 bp, Homo sapiens
agtaggaagactttggaaa

SEQ ID NO: 2513715 - DNA, 13 bp, Homo sapiens
agtaggagcccag

SEQ ID NO: 2513716 - DNA, 13 bp, Homo sapiens
agtaggtgcttga

SEQ ID NO: 2513717 - DNA, 18 bp, Homo sapiens
agtagtaaaaattaaaaa

SEQ ID NO: 2513718 - DNA, 13 bp, Homo sapiens
agtagtctctgtg

SEQ ID NO: 2513719 - DNA, 14 bp, Homo sapiens
agtagttcctgcta

SEQ ID NO: 2513720 - DNA, 19 bp, Homo sapiens
agtatattttcttttcctc

SEQ ID NO: 2513721 - DNA, 15 bp, Homo sapiens
agtatcaaatattag

SEQ ID NO: 2513722 - DNA, 19 bp, Homo sapiens
agtatcaatccttgttcag

SEQ ID NO: 2513723 - DNA, 12 bp, Homo sapiens
agtatcatgcat

SEQ ID NO: 2513724 - DNA, 14 bp, Homo sapiens
agtatcctccaggt

SEQ ID NO: 2513725 - DNA, 17 bp, Homo sapiens
agtatcctccaggtttt

SEQ ID NO: 2513726 - DNA, 20 bp, Homo sapiens
agtatcctccaggtttttca

SEQ ID NO: 2513727 - DNA, 17 bp, Homo sapiens
aggaatccactcccagg

SEQ ID NO: 2513728 - DNA, 23 bp, Homo sapiens
aggaatgaaatcctgcttcagtg

SEQ ID NO: 2513729 - DNA, 13 bp, Homo sapiens
aggaatgctcccc

SEQ ID NO: 2513730 - DNA, 20 bp, Homo sapiens
aggaatgctcccccatcctc

SEQ ID NO: 2513731 - DNA, 18 bp, Homo sapiens
aggaatgtagctggtttc

SEQ ID NO: 2513732 - DNA, 17 bp, Homo sapiens
aggaattaagttatctt

SEQ ID NO: 2513733 - DNA, 23 bp, Homo sapiens
aggaattcccagcccaaagctgt

SEQ ID NO: 2513734 - DNA, 12 bp, Homo sapiens
aggaattgactt

SEQ ID NO: 2513735 - DNA, 18 bp, Homo sapiens
aggaatttcacctgtaaa

SEQ ID NO: 2513736 - DNA, 22 bp, Homo sapiens
aggaatttcacctgtaaacctg

SEQ ID NO: 2513737 - DNA, 19 bp, Homo sapiens
aggacaaaaatgaactgaa

SEQ ID NO: 2513738 - DNA, 17 bp, Homo sapiens
aggacaacgaggaagcc

SEQ ID NO: 2513739 - DNA, 19 bp, Homo sapiens
aggacaatcagtcccctcc

SEQ ID NO: 2513740 - DNA, 22 bp, Homo sapiens
aggacaatcagtcccctcccat

SEQ ID NO: 2513741 - DNA, 23 bp, Homo sapiens
aggacaatcagtcccctcccatc

SEQ ID NO: 2513742 - DNA, 14 bp, Homo sapiens
aggacaatttcaaa

SEQ ID NO: 2513743 - DNA, 15 bp, Homo sapiens
aggacaatttcaaaa

SEQ ID NO: 2513744 - DNA, 13 bp, Homo sapiens
aggacacactaat

SEQ ID NO: 2513745 - DNA, 13 bp, Homo sapiens
aggacagctgtcc

SEQ ID NO: 2513746 - DNA, 12 bp, Homo sapiens
aggacagtattt

SEQ ID NO: 2513747 - DNA, 17 bp, Homo sapiens
aggacagtgcttcagcc

SEQ ID NO: 2513748 - DNA, 22 bp, Homo sapiens
aggacagtgcttcagcctgagg

SEQ ID NO: 2513749 - DNA, 16 bp, Homo sapiens
aggaccactcctgtac

SEQ ID NO: 2513750 - DNA, 22 bp, Homo sapiens
aggaccactcctgtacactgaa

SEQ ID NO: 2513751 - DNA, 16 bp, Homo sapiens
aggaccaggactccct

SEQ ID NO: 2513752 - DNA, 22 bp, Homo sapiens
aggacccttcccttgagccctc

SEQ ID NO: 2513753 - DNA, 20 bp, Homo sapiens
aggacctcaggtgagaagca

SEQ ID NO: 2513754 - DNA, 13 bp, Homo sapiens
aggacgcttctga

SEQ ID NO: 2513755 - DNA, 16 bp, Homo sapiens
aggacggtgcaaccca

SEQ ID NO: 2513756 - DNA, 17 bp, Homo sapiens
aggactagaacctggag

SEQ ID NO: 2513757 - DNA, 22 bp, Homo sapiens
aggactagaacctggagggctg

SEQ ID NO: 2513758 - DNA, 19 bp, Homo sapiens
aggactatagcccaggtcc

SEQ ID NO: 2513759 - DNA, 20 bp, Homo sapiens
aggactatagcccaggtcct

SEQ ID NO: 2513760 - DNA, 12 bp, Homo sapiens
aggactccctcc

SEQ ID NO: 2513761 - DNA, 14 bp, Homo sapiens
aggactccctcctc

SEQ ID NO: 2513762 - DNA, 17 bp, Homo sapiens
aggactccctcctcacc

SEQ ID NO: 2513763 - DNA, 19 bp, Homo sapiens
aggactccctcctcacctc

SEQ ID NO: 2513764 - DNA, 14 bp, Homo sapiens
aggactctgaggct

SEQ ID NO: 2513765 - DNA, 17 bp, Homo sapiens
aggactctgaggctctt

SEQ ID NO: 2513766 - DNA, 16 bp, Homo sapiens
aggactctgcctcctc

SEQ ID NO: 2513767 - DNA, 18 bp, Homo sapiens
aggactctgcctcctctt

SEQ ID NO: 2513768 - DNA, 19 bp, Homo sapiens
aggactctgcctcctcttc

SEQ ID NO: 2513769 - DNA, 12 bp, Homo sapiens
aggactgaggga

SEQ ID NO: 2513770 - DNA, 21 bp, Homo sapiens
aggactgcacagcgtcctgtc

SEQ ID NO: 2513771 - DNA, 23 bp, Homo sapiens
aggactgcacagcgtcctgtcca

SEQ ID NO: 2513772 - DNA, 18 bp, Homo sapiens
agtctcctttgcactgag

SEQ ID NO: 2513773 - DNA, 15 bp, Homo sapiens
agtctcgctctgtca

SEQ ID NO: 2513774 - DNA, 19 bp, Homo sapiens
agtctctctctctctctcc

SEQ ID NO: 2513775 - DNA, 20 bp, Homo sapiens
agtctctctctctctctccc

SEQ ID NO: 2513776 - DNA, 15 bp, Homo sapiens
agtctctgagggctt

SEQ ID NO: 2513777 - DNA, 15 bp, Homo sapiens
agtctctttaatctt

SEQ ID NO: 2513778 - DNA, 16 bp, Homo sapiens
agtctgaaggctgggt

SEQ ID NO: 2513779 - DNA, 22 bp, Homo sapiens
agtctgatccaggaggccgggg

SEQ ID NO: 2513780 - DNA, 23 bp, Homo sapiens
agtctgcaactttaagcagctct

SEQ ID NO: 2513781 - DNA, 23 bp, Homo sapiens
agtctgcacatgcagctgcaccc

SEQ ID NO: 2513782 - DNA, 16 bp, Homo sapiens
agtctgctgccctcca

SEQ ID NO: 2513783 - DNA, 20 bp, Homo sapiens
agtctgctgccctccatccc

SEQ ID NO: 2513784 - DNA, 16 bp, Homo sapiens
agtctgggctgccggg

SEQ ID NO: 2513785 - DNA, 15 bp, Homo sapiens
agtctgtgtgaaggt

SEQ ID NO: 2513786 - DNA, 22 bp, Homo sapiens
agtctgtgtgatgaactttctc

SEQ ID NO: 2513787 - DNA, 18 bp, Homo sapiens
agtctgttttatgacttc

SEQ ID NO: 2513788 - DNA, 13 bp, Homo sapiens
agtcttaaaataa

SEQ ID NO: 2513789 - DNA, 17 bp, Homo sapiens
agtcttaaaataactta

SEQ ID NO: 2513790 - DNA, 23 bp, Homo sapiens
agtcttaaaataacttatatcat

SEQ ID NO: 2513791 - DNA, 24 bp, Homo sapiens
agtcttagacttgaaatactactt

SEQ ID NO: 2513792 - DNA, 13 bp, Homo sapiens
agtcttagatgta

SEQ ID NO: 2513793 - DNA, 16 bp, Homo sapiens
agtcttatcaagcagc

SEQ ID NO: 2513794 - DNA, 17 bp, Homo sapiens
agtcttcactctctgaa

SEQ ID NO: 2513795 - DNA, 19 bp, Homo sapiens
agtcttccatttgcaaggg

SEQ ID NO: 2513796 - DNA, 13 bp, Homo sapiens
agtcttccctgat

SEQ ID NO: 2513797 - DNA, 20 bp, Homo sapiens
agtggtctttgtaagagtgt

SEQ ID NO: 2513798 - DNA, 11 bp, Homo sapiens
agtggtgccta

SEQ ID NO: 2513799 - DNA, 17 bp, Homo sapiens
agtggtgcgatctgggt

SEQ ID NO: 2513800 - DNA, 22 bp, Homo sapiens
agtggtgctcagttgtagaatg

SEQ ID NO: 2513801 - DNA, 13 bp, Homo sapiens
agtggtggcaggg

SEQ ID NO: 2513802 - DNA, 13 bp, Homo sapiens
agtgtaaaataag

SEQ ID NO: 2513803 - DNA, 14 bp, Homo sapiens
agtgtaaaatattt

SEQ ID NO: 2513804 - DNA, 16 bp, Homo sapiens
agtgtaaagcattcca

SEQ ID NO: 2513805 - DNA, 22 bp, Homo sapiens
agtgtaaagcattccaacaaag

SEQ ID NO: 2513806 - DNA, 21 bp, Homo sapiens
agtgtaaatcctttttcttta

SEQ ID NO: 2513807 - DNA, 21 bp, Homo sapiens
agtgtaatttctttgcctgtt

SEQ ID NO: 2513808 - DNA, 13 bp, Homo sapiens
agtgtacagtctt

SEQ ID NO: 2513809 - DNA, 16 bp, Homo sapiens
agtgtacagtcttgta

SEQ ID NO: 2513810 - DNA, 22 bp, Homo sapiens
agtgtacatggaataacatgta

SEQ ID NO: 2513811 - DNA, 13 bp, Homo sapiens
agtgtaccataat

SEQ ID NO: 2513812 - DNA, 12 bp, Homo sapiens
agtgtagaagca

SEQ ID NO: 2513813 - DNA, 18 bp, Homo sapiens
agtgtagcccacacttga

SEQ ID NO: 2513814 - DNA, 21 bp, Homo sapiens
agtgtagcccacacttgagag

SEQ ID NO: 2513815 - DNA, 23 bp, Homo sapiens
agtgtagcccacacttgagagga

SEQ ID NO: 2513816 - DNA, 17 bp, Homo sapiens
agtgtagccttgcccgg

SEQ ID NO: 2513817 - DNA, 14 bp, Homo sapiens
agtgtatatcagaa

SEQ ID NO: 2513818 - DNA, 21 bp, Homo sapiens
agtgtcacttacctagattta

SEQ ID NO: 2513819 - DNA, 20 bp, Homo sapiens
agtgtcatatgtaggtgtct

SEQ ID NO: 2513820 - DNA, 14 bp, Homo sapiens
agtgtccaaagcag

SEQ ID NO: 2513821 - DNA, 20 bp, Homo sapiens
agtgtccaaagcagggtctg

SEQ ID NO: 2513822 - DNA, 19 bp, Homo sapiens
agtgtcccctccactgtca

SEQ ID NO: 2513823 - DNA, 14 bp, Homo sapiens
agtgtctaaaaaca

SEQ ID NO: 2513824 - DNA, 16 bp, Homo sapiens
agtgtctggcacacag

SEQ ID NO: 2513825 - DNA, 13 bp, Homo sapiens
agtgtctgtgtgc

SEQ ID NO: 2513826 - DNA, 22 bp, Homo sapiens
agtgtctgtgtgcaagtgtgtg

SEQ ID NO: 2513827 - DNA, 15 bp, Homo sapiens
agtgtgaagttagaa

SEQ ID NO: 2513828 - DNA, 18 bp, Homo sapiens
agtgtgaagttagaattc

SEQ ID NO: 2513829 - DNA, 22 bp, Homo sapiens
agtgtgaagttagaattccttc

SEQ ID NO: 2513830 - DNA, 23 bp, Homo sapiens
agtgtgacaaggattgctactgt

SEQ ID NO: 2513831 - DNA, 21 bp, Homo sapiens
agtgtgagcagtgagttacag

SEQ ID NO: 2513832 - DNA, 12 bp, Homo sapiens
agtgtgagtaag

SEQ ID NO: 2513833 - DNA, 19 bp, Homo sapiens
agtgtgattgggaataaat

SEQ ID NO: 2513834 - DNA, 20 bp, Homo sapiens
agtgtgattgggaataaata

SEQ ID NO: 2513835 - DNA, 23 bp, Homo sapiens
agtgtgattgggaataaatatgc

SEQ ID NO: 2513836 - DNA, 20 bp, Homo sapiens
agtgtgcctgaagtcccaga

SEQ ID NO: 2513837 - DNA, 15 bp, Homo sapiens
agtgtgctggaggac

SEQ ID NO: 2513838 - DNA, 16 bp, Homo sapiens
agtgtggctcccctct

SEQ ID NO: 2513839 - DNA, 17 bp, Homo sapiens
agtgtggctcccctcta

SEQ ID NO: 2513840 - DNA, 20 bp, Homo sapiens
agtgtggctgaggaggcctc

SEQ ID NO: 2513841 - DNA, 14 bp, Homo sapiens
agtgtgggaatgcg

SEQ ID NO: 2513842 - DNA, 15 bp, Homo sapiens
agtgtgggtctgtgt

SEQ ID NO: 2513843 - DNA, 17 bp, Homo sapiens
agtgtgggtctgtgtgt

SEQ ID NO: 2513844 - DNA, 21 bp, Homo sapiens
agtgtggtagggacttaaaaa

SEQ ID NO: 2513845 - DNA, 17 bp, Homo sapiens
agtgtggtcccaacagg

SEQ ID NO: 2513846 - DNA, 16 bp, Homo sapiens
agtgtggtgtttcctg

SEQ ID NO: 2513847 - DNA, 19 bp, Homo sapiens
agtgtggtgtttcctggca

SEQ ID NO: 2513848 - DNA, 22 bp, Homo sapiens
agtgtggtgtttcctggcactg

SEQ ID NO: 2513849 - DNA, 16 bp, Homo sapiens
agtgtgtatgtgcgtg

SEQ ID NO: 2513850 - DNA, 21 bp, Homo sapiens
agtgtgtattgttcccagtga

SEQ ID NO: 2513851 - DNA, 20 bp, Homo sapiens
agtgtgtgcacatgtgtgcg

SEQ ID NO: 2513852 - DNA, 22 bp, Homo sapiens
agtgtgtgcacatgtgtgcgtg

SEQ ID NO: 2513853 - DNA, 16 bp, Homo sapiens
agtgtgtgcatgtgtg

SEQ ID NO: 2513854 - DNA, 17 bp, Homo sapiens
agtgtgtgcatgtgtgc

SEQ ID NO: 2513855 - DNA, 12 bp, Homo sapiens
agtgtgttctga

SEQ ID NO: 2513856 - DNA, 15 bp, Homo sapiens
agtgttaaatgtgat

SEQ ID NO: 2513857 - DNA, 12 bp, Homo sapiens
agtgttaatcaa

SEQ ID NO: 2513858 - DNA, 15 bp, Homo sapiens
agtgttaatcaattt

SEQ ID NO: 2513859 - DNA, 18 bp, Homo sapiens
agtgttagggaagggcct

SEQ ID NO: 2513860 - DNA, 16 bp, Homo sapiens
agtgttatcagtcata

SEQ ID NO: 2513861 - DNA, 23 bp, Homo sapiens
agtgttatcagtcataactaaat

SEQ ID NO: 2513862 - DNA, 21 bp, Homo sapiens
agtgttccccttccactgagg

SEQ ID NO: 2513863 - DNA, 16 bp, Homo sapiens
agtgttgtggatttaa

SEQ ID NO: 2513864 - DNA, 17 bp, Homo sapiens
agtgtttatttttcata

SEQ ID NO: 2513865 - DNA, 19 bp, Homo sapiens
agtgtttatttttcatatt

SEQ ID NO: 2513866 - DNA, 21 bp, Homo sapiens
agtgtttatttttcatattgt

SEQ ID NO: 2513867 - DNA, 15 bp, Homo sapiens
agtgtttctgtgcat

SEQ ID NO: 2513868 - DNA, 16 bp, Homo sapiens
agtgtttttacctctg

SEQ ID NO: 2513869 - DNA, 14 bp, Homo sapiens
agtgtttttgtaaa

SEQ ID NO: 2513870 - DNA, 13 bp, Homo sapiens
agttaaagcagtg

SEQ ID NO: 2513871 - DNA, 16 bp, Homo sapiens
agttaaagtgaataac

SEQ ID NO: 2513872 - DNA, 14 bp, Homo sapiens
agttaaatttctgg

SEQ ID NO: 2513873 - DNA, 13 bp, Homo sapiens
agttaacaatgat

SEQ ID NO: 2513874 - DNA, 20 bp, Homo sapiens
agttaacacctttaaagtgt

SEQ ID NO: 2513875 - DNA, 13 bp, Homo sapiens
agttaacgggtga

SEQ ID NO: 2513876 - DNA, 16 bp, Homo sapiens
agttaactattttatt

SEQ ID NO: 2513877 - DNA, 18 bp, Homo sapiens
agttaactttaagactga

SEQ ID NO: 2513878 - DNA, 12 bp, Homo sapiens
agttaagaagct

SEQ ID NO: 2513879 - DNA, 16 bp, Homo sapiens
agttaagaagctgttg

SEQ ID NO: 2513880 - DNA, 21 bp, Homo sapiens
agttaagaagctgttgtacat

SEQ ID NO: 2513881 - DNA, 22 bp, Homo sapiens
agttaagaagctgttgtacatt

SEQ ID NO: 2513882 - DNA, 15 bp, Homo sapiens
agttaatattgtgaa

SEQ ID NO: 2513883 - DNA, 20 bp, Homo sapiens
agttacaaattgcttgaaag

SEQ ID NO: 2513884 - DNA, 16 bp, Homo sapiens
agttacacatttttca

SEQ ID NO: 2513885 - DNA, 15 bp, Homo sapiens
agttacagaaagtgg

SEQ ID NO: 2513886 - DNA, 16 bp, Homo sapiens
agttacagaaagtggt

SEQ ID NO: 2513887 - DNA, 17 bp, Homo sapiens
agttacatgcatacttc

SEQ ID NO: 2513888 - DNA, 21 bp, Homo sapiens
agttacatgcatacttcaaaa

SEQ ID NO: 2513889 - DNA, 22 bp, Homo sapiens
agttacatgcatacttcaaaag

SEQ ID NO: 2513890 - DNA, 21 bp, Homo sapiens
agttactccagtgccaacaat

SEQ ID NO: 2513891 - DNA, 12 bp, Homo sapiens
agttactgaatg

SEQ ID NO: 2513892 - DNA, 18 bp, Homo sapiens
agttactgattcactgca

SEQ ID NO: 2513893 - DNA, 17 bp, Homo sapiens
agttactgttatagagg

SEQ ID NO: 2513894 - DNA, 22 bp, Homo sapiens
agttacttcactttaattctca

SEQ ID NO: 2513895 - DNA, 15 bp, Homo sapiens
agttagaattccttc

SEQ ID NO: 2513896 - DNA, 15 bp, Homo sapiens
agttagcaaactttg

SEQ ID NO: 2513897 - DNA, 16 bp, Homo sapiens
agttagctcaggaggc

SEQ ID NO: 2513898 - DNA, 22 bp, Homo sapiens
agttagctcaggaggcttggaa

SEQ ID NO: 2513899 - DNA, 14 bp, Homo sapiens
agttaggaaataaa

SEQ ID NO: 2513900 - DNA, 13 bp, Homo sapiens
atataattctgta

SEQ ID NO: 2513901 - DNA, 16 bp, Homo sapiens
atataattctgtaaat

SEQ ID NO: 2513902 - DNA, 17 bp, Homo sapiens
atataattctgtacata

SEQ ID NO: 2513903 - DNA, 21 bp, Homo sapiens
atatacaacctgcttgggtgg

SEQ ID NO: 2513904 - DNA, 14 bp, Homo sapiens
atatacaattatat

SEQ ID NO: 2513905 - DNA, 14 bp, Homo sapiens
atatacagtaactt

SEQ ID NO: 2513906 - DNA, 17 bp, Homo sapiens
atatacagtaactttat

SEQ ID NO: 2513907 - DNA, 14 bp, Homo sapiens
atataccatttatc

SEQ ID NO: 2513908 - DNA, 20 bp, Homo sapiens
atatacgtgaaaattatttg

SEQ ID NO: 2513909 - DNA, 10 bp, Homo sapiens
atatactgta

SEQ ID NO: 2513910 - DNA, 13 bp, Homo sapiens
atatactgtaaag

SEQ ID NO: 2513911 - DNA, 14 bp, Homo sapiens
atatactgtaaaga

SEQ ID NO: 2513912 - DNA, 15 bp, Homo sapiens
atatactgtaaagaa

SEQ ID NO: 2513913 - DNA, 19 bp, Homo sapiens
atatactgtaaagaaagag

SEQ ID NO: 2513914 - DNA, 15 bp, Homo sapiens
atatacttaaatgga

SEQ ID NO: 2513915 - DNA, 13 bp, Homo sapiens
atatagagatgtt

SEQ ID NO: 2513916 - DNA, 23 bp, Homo sapiens
atatagattataacttgtctaaa

SEQ ID NO: 2513917 - DNA, 15 bp, Homo sapiens
atataggttgtgcaa

SEQ ID NO: 2513918 - DNA, 18 bp, Homo sapiens
atataggttttgtttgct

SEQ ID NO: 2513919 - DNA, 19 bp, Homo sapiens
atataggttttgtttgcta

SEQ ID NO: 2513920 - DNA, 21 bp, Homo sapiens
atataggttttgtttgctatc

SEQ ID NO: 2513921 - DNA, 23 bp, Homo sapiens
atataggttttgtttgctatctt

SEQ ID NO: 2513922 - DNA, 12 bp, Homo sapiens
atatataaccag

SEQ ID NO: 2513923 - DNA, 22 bp, Homo sapiens
atatataagatggaagcttcca

SEQ ID NO: 2513924 - DNA, 19 bp, Homo sapiens
atatataattctgtacata

SEQ ID NO: 2513925 - DNA, 21 bp, Homo sapiens
atatatacagtaactttatgt

SEQ ID NO: 2513926 - DNA, 15 bp, Homo sapiens
atatatctatcttat

SEQ ID NO: 2513927 - DNA, 19 bp, Homo sapiens
atatatctgctgtccagac

SEQ ID NO: 2513928 - DNA, 18 bp, Homo sapiens
atatatctgcttcagtgg

SEQ ID NO: 2513929 - DNA, 13 bp, Homo sapiens
atatatgaggact

SEQ ID NO: 2513930 - DNA, 14 bp, Homo sapiens
atatatggataatg

SEQ ID NO: 2513931 - DNA, 12 bp, Homo sapiens
atatatgtattt

SEQ ID NO: 2513932 - DNA, 13 bp, Homo sapiens
atatatgtgtatg

SEQ ID NO: 2513933 - DNA, 16 bp, Homo sapiens
atatatgtgtgtttaa

SEQ ID NO: 2513934 - DNA, 13 bp, Homo sapiens
atatatgtgtttt

SEQ ID NO: 2513935 - DNA, 17 bp, Homo sapiens
atatatgtttacctttt

SEQ ID NO: 2513936 - DNA, 16 bp, Homo sapiens
atatatttataactca

SEQ ID NO: 2513937 - DNA, 13 bp, Homo sapiens
atatatttgtgta

SEQ ID NO: 2513938 - DNA, 17 bp, Homo sapiens
atatatttgtgtattta

SEQ ID NO: 2513939 - DNA, 21 bp, Homo sapiens
atatatttgtgtatttaacag

SEQ ID NO: 2513940 - DNA, 22 bp, Homo sapiens
atatatttgtgtatttaacagg

SEQ ID NO: 2513941 - DNA, 23 bp, Homo sapiens
atatatttttaagataataatat

SEQ ID NO: 2513942 - DNA, 15 bp, Homo sapiens
atatatttttatatt

SEQ ID NO: 2513943 - DNA, 21 bp, Homo sapiens
atatcaacagatagttgtgtt

SEQ ID NO: 2513944 - DNA, 14 bp, Homo sapiens
atatcagaaaaggg

SEQ ID NO: 2513945 - DNA, 17 bp, Homo sapiens
atatcagaaaagggaag

SEQ ID NO: 2513946 - DNA, 12 bp, Homo sapiens
atatcagcctga

SEQ ID NO: 2513947 - DNA, 20 bp, Homo sapiens
atatcagcctgagtctcctg

SEQ ID NO: 2513948 - DNA, 13 bp, Homo sapiens
atatcagtttgct

SEQ ID NO: 2513949 - DNA, 18 bp, Homo sapiens
atatcatcagcatacctt

SEQ ID NO: 2513950 - DNA, 21 bp, Homo sapiens
atatcatcagcatacctttat

SEQ ID NO: 2513951 - DNA, 15 bp, Homo sapiens
atatccatgtactgt

SEQ ID NO: 2513952 - DNA, 18 bp, Homo sapiens
atatccatgtactgtagt

SEQ ID NO: 2513953 - DNA, 14 bp, Homo sapiens
atatcctgagccat

SEQ ID NO: 2513954 - DNA, 20 bp, Homo sapiens
atatctatatataattctgt

SEQ ID NO: 2513955 - DNA, 21 bp, Homo sapiens
atatctatatataattctgta

SEQ ID NO: 2513956 - DNA, 15 bp, Homo sapiens
atatctgaaatgtga

SEQ ID NO: 2513957 - DNA, 12 bp, Homo sapiens
atatctgctgtc

SEQ ID NO: 2513958 - DNA, 13 bp, Homo sapiens
atatctgcttcag

SEQ ID NO: 2513959 - DNA, 15 bp, Homo sapiens
atatctgtatataaa

SEQ ID NO: 2513960 - DNA, 18 bp, Homo sapiens
atatctgtatttaatttt

SEQ ID NO: 2513961 - DNA, 24 bp, Homo sapiens
atatctgtatttaattttgacact

SEQ ID NO: 2513962 - DNA, 19 bp, Homo sapiens
atatcttctgatttgtccc

SEQ ID NO: 2513963 - DNA, 17 bp, Homo sapiens
atatgaaaaatatgata

SEQ ID NO: 2513964 - DNA, 15 bp, Homo sapiens
atatgaacatattgt

SEQ ID NO: 2513965 - DNA, 21 bp, Homo sapiens
atatgaagctcacctgttgct

SEQ ID NO: 2513966 - DNA, 16 bp, Homo sapiens
atatgatttaaaacat

SEQ ID NO: 2513967 - DNA, 20 bp, Homo sapiens
atatgatttaaaacatgtaa

SEQ ID NO: 2513968 - DNA, 20 bp, Homo sapiens
atatgatttaaatcagccgt

SEQ ID NO: 2513969 - DNA, 13 bp, Homo sapiens
atatgcaaagcac

SEQ ID NO: 2513970 - DNA, 16 bp, Homo sapiens
atatgcaatgtgaagc

SEQ ID NO: 2513971 - DNA, 19 bp, Homo sapiens
atatgcacacagtgctttc

SEQ ID NO: 2513972 - DNA, 14 bp, Homo sapiens
atatgcacacattt

SEQ ID NO: 2513973 - DNA, 15 bp, Homo sapiens
atatgcacacatttt

SEQ ID NO: 2513974 - DNA, 16 bp, Homo sapiens
atatgcacacattttt

SEQ ID NO: 2513975 - DNA, 19 bp, Homo sapiens
atatgcaccttgtgtctgt

SEQ ID NO: 2513976 - DNA, 20 bp, Homo sapiens
atatgcaccttgtgtctgta

SEQ ID NO: 2513977 - DNA, 20 bp, Homo sapiens
atatgcagtgatatggcaga

SEQ ID NO: 2513978 - DNA, 16 bp, Homo sapiens
atatgctctgcatgtt

SEQ ID NO: 2513979 - DNA, 22 bp, Homo sapiens
atatgctgccaaattttggcca

SEQ ID NO: 2513980 - DNA, 13 bp, Homo sapiens
atatgcttagtaa

SEQ ID NO: 2513981 - DNA, 15 bp, Homo sapiens
atatgcttagtaatg

SEQ ID NO: 2513982 - DNA, 19 bp, Homo sapiens
atatgcttatacacttaca

SEQ ID NO: 2513983 - DNA, 20 bp, Homo sapiens
atatggaacttctaatatat

SEQ ID NO: 2513984 - DNA, 15 bp, Homo sapiens
atatggactctgcac

SEQ ID NO: 2513985 - DNA, 18 bp, Homo sapiens
atatggatgattcagaaa

SEQ ID NO: 2513986 - DNA, 23 bp, Homo sapiens
atatggattttctattgttactc

SEQ ID NO: 2513987 - DNA, 15 bp, Homo sapiens
atatggcagaagaca

SEQ ID NO: 2513988 - DNA, 20 bp, Homo sapiens
atcatctcctgccttcctcc

SEQ ID NO: 2513989 - DNA, 18 bp, Homo sapiens
atcatctgtggaacccat

SEQ ID NO: 2513990 - DNA, 16 bp, Homo sapiens
atcatctgtgtgaaaa

SEQ ID NO: 2513991 - DNA, 15 bp, Homo sapiens
atcatgaaatatgca

SEQ ID NO: 2513992 - DNA, 16 bp, Homo sapiens
atcatgaaattactta

SEQ ID NO: 2513993 - DNA, 13 bp, Homo sapiens
atcatgacatgtt

SEQ ID NO: 2513994 - DNA, 20 bp, Homo sapiens
atcatggaatggttataaaa

SEQ ID NO: 2513995 - DNA, 17 bp, Homo sapiens
atcatggtgtaataaga

SEQ ID NO: 2513996 - DNA, 18 bp, Homo sapiens
atcatgtagtatcaaata

SEQ ID NO: 2513997 - DNA, 21 bp, Homo sapiens
atcatgtagtatcaaatatta

SEQ ID NO: 2513998 - DNA, 12 bp, Homo sapiens
atcatgtcccca

SEQ ID NO: 2513999 - DNA, 13 bp, Homo sapiens
atcatgtgtaatc

SEQ ID NO: 2514000 - DNA, 15 bp, Homo sapiens
atcatgtgtaatcaa

SEQ ID NO: 2514001 - DNA, 21 bp, Homo sapiens
atcatgtgtaatcaataaacg

SEQ ID NO: 2514002 - DNA, 11 bp, Homo sapiens
atcattagaac

SEQ ID NO: 2514003 - DNA, 16 bp, Homo sapiens
atcattaggtgtgact

SEQ ID NO: 2514004 - DNA, 19 bp, Homo sapiens
atcattcttatttcatgaa

SEQ ID NO: 2514005 - DNA, 22 bp, Homo sapiens
atcatttattttttacattatt

SEQ ID NO: 2514006 - DNA, 19 bp, Homo sapiens
atcatttgttcaaagctgt

SEQ ID NO: 2514007 - DNA, 14 bp, Homo sapiens
atcattttaattat

SEQ ID NO: 2514008 - DNA, 15 bp, Homo sapiens
atcattttaattatt

SEQ ID NO: 2514009 - DNA, 16 bp, Homo sapiens
atcattttagaagact

SEQ ID NO: 2514010 - DNA, 22 bp, Homo sapiens
atcattttagaagactctacca

SEQ ID NO: 2514011 - DNA, 22 bp, Homo sapiens
atcattttcttatcttctgcaa

SEQ ID NO: 2514012 - DNA, 13 bp, Homo sapiens
atcattttgcatt

SEQ ID NO: 2514013 - DNA, 14 bp, Homo sapiens
atcatttttgtatc

SEQ ID NO: 2514014 - DNA, 13 bp, Homo sapiens
atccaaaagcttt

SEQ ID NO: 2514015 - DNA, 20 bp, Homo sapiens
atccaaccccccacctgcca

SEQ ID NO: 2514016 - DNA, 16 bp, Homo sapiens
atccaactaatgcctt

SEQ ID NO: 2514017 - DNA, 23 bp, Homo sapiens
atccaagcttttttaaagtaaaa

SEQ ID NO: 2514018 - DNA, 19 bp, Homo sapiens
atccaaggagaaacagaga

SEQ ID NO: 2514019 - DNA, 20 bp, Homo sapiens
atccaatcctcactgggtgg

SEQ ID NO: 2514020 - DNA, 20 bp, Homo sapiens
atccaatctaaccacatcaa

SEQ ID NO: 2514021 - DNA, 17 bp, Homo sapiens
atccacagagagtccca

SEQ ID NO: 2514022 - DNA, 13 bp, Homo sapiens
atccacccacctc

SEQ ID NO: 2514023 - DNA, 18 bp, Homo sapiens
atccacccacctcagcct

SEQ ID NO: 2514024 - DNA, 20 bp, Homo sapiens
atccacccacctcagcctcc

SEQ ID NO: 2514025 - DNA, 10 bp, Homo sapiens
atccacctcc

SEQ ID NO: 2514026 - DNA, 21 bp, Homo sapiens
atccacctgtctcagcctccc

SEQ ID NO: 2514027 - DNA, 16 bp, Homo sapiens
atccactcccaggcag

SEQ ID NO: 2514028 - DNA, 16 bp, Homo sapiens
atccactctaccctcc

SEQ ID NO: 2514029 - DNA, 13 bp, Homo sapiens
atccagaaagaaa

SEQ ID NO: 2514030 - DNA, 14 bp, Homo sapiens
atccagaaagaaaa

SEQ ID NO: 2514031 - DNA, 15 bp, Homo sapiens
atccagaaagaaaaa

SEQ ID NO: 2514032 - DNA, 16 bp, Homo sapiens
atccagcctctcccct

SEQ ID NO: 2514033 - DNA, 17 bp, Homo sapiens
atccagcctctcccctg

SEQ ID NO: 2514034 - DNA, 21 bp, Homo sapiens
atccagcctctcccctgatta

SEQ ID NO: 2514035 - DNA, 14 bp, Homo sapiens
atccaggtaatcca

SEQ ID NO: 2514036 - DNA, 15 bp, Homo sapiens
atccaggttcagctt

SEQ ID NO: 2514037 - DNA, 17 bp, Homo sapiens
atccaggttcagcttgt

SEQ ID NO: 2514038 - DNA, 17 bp, Homo sapiens
atccagtgtctcacagc

SEQ ID NO: 2514039 - DNA, 17 bp, Homo sapiens
atccataaagaagcaat

SEQ ID NO: 2514040 - DNA, 16 bp, Homo sapiens
atccatagtagtatga

SEQ ID NO: 2514041 - DNA, 14 bp, Homo sapiens
atccatcatcatgt

SEQ ID NO: 2514042 - DNA, 18 bp, Homo sapiens
atccatcatcatgtgtgt

SEQ ID NO: 2514043 - DNA, 18 bp, Homo sapiens
atccatgacctagttttc

SEQ ID NO: 2514044 - DNA, 12 bp, Homo sapiens
atccatgtactg

SEQ ID NO: 2514045 - DNA, 18 bp, Homo sapiens
atccatgttagtttttac

SEQ ID NO: 2514046 - DNA, 20 bp, Homo sapiens
atccatgttagtttttactt

SEQ ID NO: 2514047 - DNA, 15 bp, Homo sapiens
atccattatcatgtg

SEQ ID NO: 2514048 - DNA, 18 bp, Homo sapiens
atccattatcatgtgtaa

SEQ ID NO: 2514049 - DNA, 18 bp, Homo sapiens
atccatttcatctatttc

SEQ ID NO: 2514050 - DNA, 22 bp, Homo sapiens
atccatttcatctatttctgag

SEQ ID NO: 2514051 - DNA, 23 bp, Homo sapiens
atccatttgcgttccatgatgct

SEQ ID NO: 2514052 - DNA, 15 bp, Homo sapiens
atcccacccacatgt

SEQ ID NO: 2514053 - DNA, 18 bp, Homo sapiens
atcccacgcttctctttg

SEQ ID NO: 2514054 - DNA, 13 bp, Homo sapiens
atcccagaaatta

SEQ ID NO: 2514055 - DNA, 17 bp, Homo sapiens
atcccagaaattagaaa

SEQ ID NO: 2514056 - DNA, 20 bp, Homo sapiens
atcccagcactttgggaggc

SEQ ID NO: 2514057 - DNA, 21 bp, Homo sapiens
atcccagcactttgggaggcc

SEQ ID NO: 2514058 - DNA, 13 bp, Homo sapiens
atcccagccttgg

SEQ ID NO: 2514059 - DNA, 23 bp, Homo sapiens
atcccagctactcaagaggctga

SEQ ID NO: 2514060 - DNA, 18 bp, Homo sapiens
atcccagctacttgggaa

SEQ ID NO: 2514061 - DNA, 19 bp, Homo sapiens
atcccaggcttcaccctga

SEQ ID NO: 2514062 - DNA, 20 bp, Homo sapiens
atcccaggggaccacacctc

SEQ ID NO: 2514063 - DNA, 23 bp, Homo sapiens
atcccaggggaccacacctccct

SEQ ID NO: 2514064 - DNA, 13 bp, Homo sapiens
atcccatgagcct

SEQ ID NO: 2514065 - DNA, 23 bp, Homo sapiens
atcccatgtaacagaaagggcaa

SEQ ID NO: 2514066 - DNA, 16 bp, Homo sapiens
atccccaagtgtgaac

SEQ ID NO: 2514067 - DNA, 15 bp, Homo sapiens
atccccatcctccag

SEQ ID NO: 2514068 - DNA, 14 bp, Homo sapiens
atccccctgccctc

SEQ ID NO: 2514069 - DNA, 18 bp, Homo sapiens
atcccccttgccacccca

SEQ ID NO: 2514070 - DNA, 14 bp, Homo sapiens
atcccctccttggg

SEQ ID NO: 2514071 - DNA, 15 bp, Homo sapiens
atcccctccttgggc

SEQ ID NO: 2514072 - DNA, 20 bp, Homo sapiens
atcccgattcaccctgtcca

SEQ ID NO: 2514073 - DNA, 21 bp, Homo sapiens
atccctaccccctaagagcca

SEQ ID NO: 2514074 - DNA, 13 bp, Homo sapiens
atccctcatcctc

SEQ ID NO: 2514075 - DNA, 13 bp, Homo sapiens
atccctcatctgt

SEQ ID NO: 2514076 - DNA, 17 bp, Homo sapiens
atccctctacagagctt

SEQ ID NO: 2514077 - DNA, 17 bp, Homo sapiens
atccctgaaggccccgc

SEQ ID NO: 2514078 - DNA, 22 bp, Homo sapiens
atccctgaaggccccgcccagg

SEQ ID NO: 2514079 - DNA, 15 bp, Homo sapiens
atccctgccagctct

SEQ ID NO: 2514080 - DNA, 16 bp, Homo sapiens
atccctgggcattgct

SEQ ID NO: 2514081 - DNA, 18 bp, Homo sapiens
atccctgttacccagaga

SEQ ID NO: 2514082 - DNA, 21 bp, Homo sapiens
atccctgtttaatatttaaac

SEQ ID NO: 2514083 - DNA, 22 bp, Homo sapiens
atccctgtttaatatttaaaca

SEQ ID NO: 2514084 - DNA, 22 bp, Homo sapiens
atcccttgaccaggcctgggcc

SEQ ID NO: 2514085 - DNA, 19 bp, Homo sapiens
atccgaacctcctctgtga

SEQ ID NO: 2514086 - DNA, 13 bp, Homo sapiens
atccgccagggcc

SEQ ID NO: 2514087 - DNA, 14 bp, Homo sapiens
atcctaaaacaaat

SEQ ID NO: 2514088 - DNA, 12 bp, Homo sapiens
atcctaagctat

SEQ ID NO: 2514089 - DNA, 19 bp, Homo sapiens
atcctaatcatccaatgct

SEQ ID NO: 2514090 - DNA, 13 bp, Homo sapiens
atcctaatgaatg

SEQ ID NO: 2514091 - DNA, 13 bp, Homo sapiens
atcctagtgcttt

SEQ ID NO: 2514092 - DNA, 13 bp, Homo sapiens
atcctagttccac

SEQ ID NO: 2514093 - DNA, 15 bp, Homo sapiens
atcctagttccacca

SEQ ID NO: 2514094 - DNA, 19 bp, Homo sapiens
atcctatcaacaacaaggt

SEQ ID NO: 2514095 - DNA, 12 bp, Homo sapiens
atcctatgtgat

SEQ ID NO: 2514096 - DNA, 20 bp, Homo sapiens
atcctatgtttttgttcaaa

SEQ ID NO: 2514097 - DNA, 12 bp, Homo sapiens
atccttgtttca

SEQ ID NO: 2514098 - DNA, 13 bp, Homo sapiens
atccttgtttcaa

SEQ ID NO: 2514099 - DNA, 15 bp, Homo sapiens
atcctttctattgaa

SEQ ID NO: 2514100 - DNA, 17 bp, Homo sapiens
atccttttatgttattt

SEQ ID NO: 2514101 - DNA, 15 bp, Homo sapiens
atcctttttctttat

SEQ ID NO: 2514102 - DNA, 13 bp, Homo sapiens
atcgatgcagtgc

SEQ ID NO: 2514103 - DNA, 20 bp, Homo sapiens
atcgatttttaaaaattaaa

SEQ ID NO: 2514104 - DNA, 23 bp, Homo sapiens
atcgcgccactacactccagcct

SEQ ID NO: 2514105 - DNA, 17 bp, Homo sapiens
atcgcttcatgtaacta

SEQ ID NO: 2514106 - DNA, 22 bp, Homo sapiens
atcggaagcagtgccttccata

SEQ ID NO: 2514107 - DNA, 15 bp, Homo sapiens
atcggagcctcctct

SEQ ID NO: 2514108 - DNA, 16 bp, Homo sapiens
atcggagcctcctctc

SEQ ID NO: 2514109 - DNA, 22 bp, Homo sapiens
atcggaggcttgtcagagctgg

SEQ ID NO: 2514110 - DNA, 21 bp, Homo sapiens
atcggatctggggctctggga

SEQ ID NO: 2514111 - DNA, 17 bp, Homo sapiens
atcgggagcagtgtctt

SEQ ID NO: 2514112 - DNA, 17 bp, Homo sapiens
atcggggcactgcaggg

SEQ ID NO: 2514113 - DNA, 18 bp, Homo sapiens
atcggtgaaactaacaga

SEQ ID NO: 2514114 - DNA, 19 bp, Homo sapiens
atcggtgaaactaacagat

SEQ ID NO: 2514115 - DNA, 21 bp, Homo sapiens
atcggtgaaactaacagataa

SEQ ID NO: 2514116 - DNA, 16 bp, Homo sapiens
atcgtatagctgtatt

SEQ ID NO: 2514117 - DNA, 14 bp, Homo sapiens
atcgtgacaacact

SEQ ID NO: 2514118 - DNA, 17 bp, Homo sapiens
atcgtgacgctgaataa

SEQ ID NO: 2514119 - DNA, 16 bp, Homo sapiens
atcgtgctaaattttc

SEQ ID NO: 2514120 - DNA, 22 bp, Homo sapiens
atctaaatattgatttctgcct

SEQ ID NO: 2514121 - DNA, 15 bp, Homo sapiens
atctaaccctcccat

SEQ ID NO: 2514122 - DNA, 14 bp, Homo sapiens
atctaacctcatct

SEQ ID NO: 2514123 - DNA, 17 bp, Homo sapiens
atctaagcctttccata

SEQ ID NO: 2514124 - DNA, 18 bp, Homo sapiens
atctaaggatgtcacagg

SEQ ID NO: 2514125 - DNA, 17 bp, Homo sapiens
atctaatacctctgtgt

SEQ ID NO: 2514126 - DNA, 20 bp, Homo sapiens
atctaatatgtaacaagcca

SEQ ID NO: 2514127 - DNA, 23 bp, Homo sapiens
atctaatatgtaacaagccaccc

SEQ ID NO: 2514128 - DNA, 14 bp, Homo sapiens
atctaatattaaaa

SEQ ID NO: 2514129 - DNA, 16 bp, Homo sapiens
atctaattattttgca

SEQ ID NO: 2514130 - DNA, 19 bp, Homo sapiens
atctacactccagtgagac

SEQ ID NO: 2514131 - DNA, 14 bp, Homo sapiens
atctacatcttttt

SEQ ID NO: 2514132 - DNA, 15 bp, Homo sapiens
atctaccttctgtag

SEQ ID NO: 2514133 - DNA, 19 bp, Homo sapiens
atctagacccatcttcttt

SEQ ID NO: 2514134 - DNA, 21 bp, Homo sapiens
atctagactcaaggttcccag

SEQ ID NO: 2514135 - DNA, 18 bp, Homo sapiens
atctaggaagactttgga

SEQ ID NO: 2514136 - DNA, 20 bp, Homo sapiens
atctaggtgaggattgatta

SEQ ID NO: 2514137 - DNA, 14 bp, Homo sapiens
atctaggtttaact

SEQ ID NO: 2514138 - DNA, 13 bp, Homo sapiens
atctagtgcagct

SEQ ID NO: 2514139 - DNA, 14 bp, Homo sapiens
atctagtgcagctg

SEQ ID NO: 2514140 - DNA, 22 bp, Homo sapiens
atctagtgcagctgattttaac

SEQ ID NO: 2514141 - DNA, 16 bp, Homo sapiens
atctatagaactgaat

SEQ ID NO: 2514142 - DNA, 15 bp, Homo sapiens
atctatatataattc

SEQ ID NO: 2514143 - DNA, 20 bp, Homo sapiens
atctatatataattctgtac

SEQ ID NO: 2514144 - DNA, 16 bp, Homo sapiens
atctatatatgtgtat

SEQ ID NO: 2514145 - DNA, 22 bp, Homo sapiens
atctatatgtacttgtcaaaga

SEQ ID NO: 2514146 - DNA, 15 bp, Homo sapiens
atctatatttaacaa

SEQ ID NO: 2514147 - DNA, 19 bp, Homo sapiens
atctatctgcttatgcagt

SEQ ID NO: 2514148 - DNA, 20 bp, Homo sapiens
atctatgaagtatataatgg

SEQ ID NO: 2514149 - DNA, 14 bp, Homo sapiens
atctattatactgt

SEQ ID NO: 2514150 - DNA, 17 bp, Homo sapiens
atctattatactgtatt

SEQ ID NO: 2514151 - DNA, 18 bp, Homo sapiens
atctattatactgtatta

SEQ ID NO: 2514152 - DNA, 15 bp, Homo sapiens
atctattcagacaag

SEQ ID NO: 2514153 - DNA, 21 bp, Homo sapiens
atctattcagacaagcaacag

SEQ ID NO: 2514154 - DNA, 19 bp, Homo sapiens
atctattcctggtagaata

SEQ ID NO: 2514155 - DNA, 23 bp, Homo sapiens
atctattgctggcaaagacagaa

SEQ ID NO: 2514156 - DNA, 16 bp, Homo sapiens
atctattgggttcatt

SEQ ID NO: 2514157 - DNA, 19 bp, Homo sapiens
atctattgggttcattatt

SEQ ID NO: 2514158 - DNA, 15 bp, Homo sapiens
atctcaaaactgcac

SEQ ID NO: 2514159 - DNA, 14 bp, Homo sapiens
atctcaaataacta

SEQ ID NO: 2514160 - DNA, 15 bp, Homo sapiens
atctcacacatgagc

SEQ ID NO: 2514161 - DNA, 16 bp, Homo sapiens
atctcacacatgagca

SEQ ID NO: 2514162 - DNA, 22 bp, Homo sapiens
atctcaccccatcccacaccct

SEQ ID NO: 2514163 - DNA, 23 bp, Homo sapiens
atctcaccccatcccacaccctg

SEQ ID NO: 2514164 - DNA, 13 bp, Homo sapiens
atctcacttgtgc

SEQ ID NO: 2514165 - DNA, 22 bp, Homo sapiens
atctcacttgtgccaacactca

SEQ ID NO: 2514166 - DNA, 20 bp, Homo sapiens
atctcagaattccttttcta

SEQ ID NO: 2514167 - DNA, 19 bp, Homo sapiens
atctcaggccacctgcccc

SEQ ID NO: 2514168 - DNA, 20 bp, Homo sapiens
atctcaggccacctgccccc

SEQ ID NO: 2514169 - DNA, 16 bp, Homo sapiens
atctcagggcctggtc

SEQ ID NO: 2514170 - DNA, 15 bp, Homo sapiens
atctcagtcatgcat

SEQ ID NO: 2514171 - DNA, 21 bp, Homo sapiens
atctcagtcatgcataaatat

SEQ ID NO: 2514172 - DNA, 17 bp, Homo sapiens
atctcagtgctgtaaaa

SEQ ID NO: 2514173 - DNA, 22 bp, Homo sapiens
atctcatggagaagcagaaata

SEQ ID NO: 2514174 - DNA, 15 bp, Homo sapiens
atctcattggaccct

SEQ ID NO: 2514175 - DNA, 19 bp, Homo sapiens
atctcattggacccttcca

SEQ ID NO: 2514176 - DNA, 14 bp, Homo sapiens
atctccaaaataaa

SEQ ID NO: 2514177 - DNA, 14 bp, Homo sapiens
atctccaagaatgc

SEQ ID NO: 2514178 - DNA, 22 bp, Homo sapiens
atctccaagaatgctgaaacca

SEQ ID NO: 2514179 - DNA, 19 bp, Homo sapiens
atctccacagtcaaagaag

SEQ ID NO: 2514180 - DNA, 22 bp, Homo sapiens
atctccacccccagctgcttgt

SEQ ID NO: 2514181 - DNA, 20 bp, Homo sapiens
atctccagggagtcccctcc

SEQ ID NO: 2514182 - DNA, 18 bp, Homo sapiens
atctccagtattcttgtc

SEQ ID NO: 2514183 - DNA, 18 bp, Homo sapiens
atctccatggcttcctcc

SEQ ID NO: 2514184 - DNA, 19 bp, Homo sapiens
atctccatggcttcctcct

SEQ ID NO: 2514185 - DNA, 16 bp, Homo sapiens
atctcccccagcccca

SEQ ID NO: 2514186 - DNA, 15 bp, Homo sapiens
atctcccgctgctgc

SEQ ID NO: 2514187 - DNA, 18 bp, Homo sapiens
atctcctgtgcatgggtg

SEQ ID NO: 2514188 - DNA, 14 bp, Homo sapiens
atctcgtttcaaaa

SEQ ID NO: 2514189 - DNA, 22 bp, Homo sapiens
atctcgtttttcttcttaagac

SEQ ID NO: 2514190 - DNA, 15 bp, Homo sapiens
atctctaatatggca

SEQ ID NO: 2514191 - DNA, 22 bp, Homo sapiens
atctctaatatggcaaaaatgg

SEQ ID NO: 2514192 - DNA, 18 bp, Homo sapiens
atctctactaaaaataca

SEQ ID NO: 2514193 - DNA, 18 bp, Homo sapiens
atctctagaattttaagt

SEQ ID NO: 2514194 - DNA, 15 bp, Homo sapiens
atctctatttaatat

SEQ ID NO: 2514195 - DNA, 16 bp, Homo sapiens
atctctatttaatatt

SEQ ID NO: 2514196 - DNA, 14 bp, Homo sapiens
atctctcaggagca

SEQ ID NO: 2514197 - DNA, 14 bp, Homo sapiens
atctctccctcccc

SEQ ID NO: 2514198 - DNA, 15 bp, Homo sapiens
atctctccctcccct

SEQ ID NO: 2514199 - DNA, 12 bp, Homo sapiens
atctctcctcca

SEQ ID NO: 2514200 - DNA, 12 bp, Homo sapiens
atctctctggcc

SEQ ID NO: 2514201 - DNA, 13 bp, Homo sapiens
atctctctggccc

SEQ ID NO: 2514202 - DNA, 15 bp, Homo sapiens
atctctcttcttttc

SEQ ID NO: 2514203 - DNA, 17 bp, Homo sapiens
atctctctttaatataa

SEQ ID NO: 2514204 - DNA, 13 bp, Homo sapiens
atctctgaagcat

SEQ ID NO: 2514205 - DNA, 16 bp, Homo sapiens
atctctgaagcatgtt

SEQ ID NO: 2514206 - DNA, 17 bp, Homo sapiens
atctctgaagcatgttt

SEQ ID NO: 2514207 - DNA, 20 bp, Homo sapiens
atctctgaagcatgtttcat

SEQ ID NO: 2514208 - DNA, 18 bp, Homo sapiens
atctctgcaatcttctca

SEQ ID NO: 2514209 - DNA, 16 bp, Homo sapiens
atctctgctttggaaa

SEQ ID NO: 2514210 - DNA, 15 bp, Homo sapiens
atctcttgaggccag

SEQ ID NO: 2514211 - DNA, 22 bp, Homo sapiens
atctctttgttctaaagatgga

SEQ ID NO: 2514212 - DNA, 19 bp, Homo sapiens
atctctttttgctttcgaa

SEQ ID NO: 2514213 - DNA, 16 bp, Homo sapiens
atctgaaaatgtatgt

SEQ ID NO: 2514214 - DNA, 19 bp, Homo sapiens
atctgaaaatgtatgtgta

SEQ ID NO: 2514215 - DNA, 22 bp, Homo sapiens
atctgaaaatgtatgtgtaagt

SEQ ID NO: 2514216 - DNA, 20 bp, Homo sapiens
atgaatttggagactctgtg

SEQ ID NO: 2514217 - DNA, 22 bp, Homo sapiens
atgaattttcaagtaattgtga

SEQ ID NO: 2514218 - DNA, 23 bp, Homo sapiens
atgaattttgtttggacttcttt

SEQ ID NO: 2514219 - DNA, 21 bp, Homo sapiens
atgaatttttttcatcttctc

SEQ ID NO: 2514220 - DNA, 23 bp, Homo sapiens
atgaatttttttcatcttctctg

SEQ ID NO: 2514221 - DNA, 15 bp, Homo sapiens
atgacaaaaattcaa

SEQ ID NO: 2514222 - DNA, 14 bp, Homo sapiens
atgacaacagaagc

SEQ ID NO: 2514223 - DNA, 15 bp, Homo sapiens
atgacaagccccagg

SEQ ID NO: 2514224 - DNA, 22 bp, Homo sapiens
atgacacttgtccccaaatccg

SEQ ID NO: 2514225 - DNA, 12 bp, Homo sapiens
atgacagagcga

SEQ ID NO: 2514226 - DNA, 16 bp, Homo sapiens
atgacagatgttgaat

SEQ ID NO: 2514227 - DNA, 20 bp, Homo sapiens
atgacatcacttgtacaaaa

SEQ ID NO: 2514228 - DNA, 18 bp, Homo sapiens
atgacatctcaggggcca

SEQ ID NO: 2514229 - DNA, 16 bp, Homo sapiens
atgacattcatgcctg

SEQ ID NO: 2514230 - DNA, 17 bp, Homo sapiens
atgacattcatgcctgg

SEQ ID NO: 2514231 - DNA, 20 bp, Homo sapiens
atgacattgctaagatgctc

SEQ ID NO: 2514232 - DNA, 18 bp, Homo sapiens
atgacatttatttttcat

SEQ ID NO: 2514233 - DNA, 17 bp, Homo sapiens
atgaccatactgaggga

SEQ ID NO: 2514234 - DNA, 12 bp, Homo sapiens
atgacccacccc

SEQ ID NO: 2514235 - DNA, 12 bp, Homo sapiens
atgacccaggct

SEQ ID NO: 2514236 - DNA, 18 bp, Homo sapiens
atgacctagttttccatg

SEQ ID NO: 2514237 - DNA, 16 bp, Homo sapiens
atgacctcatgcatct

SEQ ID NO: 2514238 - DNA, 19 bp, Homo sapiens
atgacctgtgaccagcact

SEQ ID NO: 2514239 - DNA, 17 bp, Homo sapiens
atgaccttctaggaagc

SEQ ID NO: 2514240 - DNA, 18 bp, Homo sapiens
atgaccttctaggaagct

SEQ ID NO: 2514241 - DNA, 15 bp, Homo sapiens
atgacggaagaacat

SEQ ID NO: 2514242 - DNA, 12 bp, Homo sapiens
atgactaaagag

SEQ ID NO: 2514243 - DNA, 13 bp, Homo sapiens
atgactaaagaga

SEQ ID NO: 2514244 - DNA, 14 bp, Homo sapiens
atgactaaagagag

SEQ ID NO: 2514245 - DNA, 15 bp, Homo sapiens
atgactaaagagaga

SEQ ID NO: 2514246 - DNA, 17 bp, Homo sapiens
atgactaaagagagaat

SEQ ID NO: 2514247 - DNA, 19 bp, Homo sapiens
atgactagaggcagggagg

SEQ ID NO: 2514248 - DNA, 19 bp, Homo sapiens
atgactcaggacatccccc

SEQ ID NO: 2514249 - DNA, 21 bp, Homo sapiens
atgactgctccccagccctgg

SEQ ID NO: 2514250 - DNA, 16 bp, Homo sapiens
atgacttactgtacat

SEQ ID NO: 2514251 - DNA, 21 bp, Homo sapiens
atgagaaaggttgaagcacca

SEQ ID NO: 2514252 - DNA, 15 bp, Homo sapiens
atgagaagagggcct

SEQ ID NO: 2514253 - DNA, 22 bp, Homo sapiens
atgagacataggccatgaaaaa

SEQ ID NO: 2514254 - DNA, 16 bp, Homo sapiens
atgagatcaggctctg

SEQ ID NO: 2514255 - DNA, 17 bp, Homo sapiens
atgagatcaggctctgc

SEQ ID NO: 2514256 - DNA, 20 bp, Homo sapiens
atgagatcaggctctgcctc

SEQ ID NO: 2514257 - DNA, 23 bp, Homo sapiens
atgagatctaagcctttccataa

SEQ ID NO: 2514258 - DNA, 18 bp, Homo sapiens
atgagatgcctgaagcca

SEQ ID NO: 2514259 - DNA, 20 bp, Homo sapiens
atgagccgctgtgagcccct

SEQ ID NO: 2514260 - DNA, 23 bp, Homo sapiens
atgagccgctgtgagcccctggt

SEQ ID NO: 2514261 - DNA, 23 bp, Homo sapiens
atgagcctacgctgaagatggca

SEQ ID NO: 2514262 - DNA, 16 bp, Homo sapiens
atgagcctcagcatcc

SEQ ID NO: 2514263 - DNA, 14 bp, Homo sapiens
atgagcctggcaag

SEQ ID NO: 2514264 - DNA, 19 bp, Homo sapiens
atgagctacgcctgcctcc

SEQ ID NO: 2514265 - DNA, 22 bp, Homo sapiens
atgagctatttccattccagaa

SEQ ID NO: 2514266 - DNA, 23 bp, Homo sapiens
atgagctatttccattccagaat

SEQ ID NO: 2514267 - DNA, 22 bp, Homo sapiens
atgagctcgcatttgtcaatga

SEQ ID NO: 2514268 - DNA, 12 bp, Homo sapiens
atgagctgaggg

SEQ ID NO: 2514269 - DNA, 20 bp, Homo sapiens
atgagctttatgtaataatg

SEQ ID NO: 2514270 - DNA, 20 bp, Homo sapiens
atgaggatgcagagtcagca

SEQ ID NO: 2514271 - DNA, 21 bp, Homo sapiens
atgaggatgcagagtcagcag

SEQ ID NO: 2514272 - DNA, 21 bp, Homo sapiens
atgaggcaatgtcaggaacag

SEQ ID NO: 2514273 - DNA, 21 bp, Homo sapiens
atgaggcatttgtttgaactg

SEQ ID NO: 2514274 - DNA, 15 bp, Homo sapiens
atgaggccgctagag

SEQ ID NO: 2514275 - DNA, 21 bp, Homo sapiens
atgaggccgctagaggcctga

SEQ ID NO: 2514276 - DNA, 15 bp, Homo sapiens
atgaggcctcttgga

SEQ ID NO: 2514277 - DNA, 22 bp, Homo sapiens
atgaggcctcttggacctctgc

SEQ ID NO: 2514278 - DNA, 13 bp, Homo sapiens
atgagggactgga

SEQ ID NO: 2514279 - DNA, 20 bp, Homo sapiens
atgagggactggaaccaggg

SEQ ID NO: 2514280 - DNA, 16 bp, Homo sapiens
atgaggtcagagcctg

SEQ ID NO: 2514281 - DNA, 19 bp, Homo sapiens
atgaggtcccaggcagaga

SEQ ID NO: 2514282 - DNA, 20 bp, Homo sapiens
atgaggtcccaggcagagaa

SEQ ID NO: 2514283 - DNA, 14 bp, Homo sapiens
atgaggtctgaaat

SEQ ID NO: 2514284 - DNA, 17 bp, Homo sapiens
atgagtcaatgtgcagt

SEQ ID NO: 2514285 - DNA, 15 bp, Homo sapiens
atgagtcccagtggg

SEQ ID NO: 2514286 - DNA, 16 bp, Homo sapiens
atgagtcccagtggga

SEQ ID NO: 2514287 - DNA, 13 bp, Homo sapiens
atgagtcccctgt

SEQ ID NO: 2514288 - DNA, 16 bp, Homo sapiens
atgagtccttgaaaat

SEQ ID NO: 2514289 - DNA, 18 bp, Homo sapiens
atgagtccttgaaaatat

SEQ ID NO: 2514290 - DNA, 17 bp, Homo sapiens
atgatagtaagaaaagt

SEQ ID NO: 2514291 - DNA, 13 bp, Homo sapiens
atgatattgcata

SEQ ID NO: 2514292 - DNA, 18 bp, Homo sapiens
atgatcacggctcactgc

SEQ ID NO: 2514293 - DNA, 14 bp, Homo sapiens
atgatctactcaga

SEQ ID NO: 2514294 - DNA, 15 bp, Homo sapiens
atgatctaggaagac

SEQ ID NO: 2514295 - DNA, 17 bp, Homo sapiens
atgatctaggaagactt

SEQ ID NO: 2514296 - DNA, 15 bp, Homo sapiens
atgatctaggtttaa

SEQ ID NO: 2514297 - DNA, 16 bp, Homo sapiens
atgatctaggtttaac

SEQ ID NO: 2514298 - DNA, 19 bp, Homo sapiens
atgatctaggtttaactca

SEQ ID NO: 2514299 - DNA, 22 bp, Homo sapiens
atgatctaggtttaactcagat

SEQ ID NO: 2514300 - DNA, 14 bp, Homo sapiens
atgatcttgtgaca

SEQ ID NO: 2514301 - DNA, 17 bp, Homo sapiens
atgatctttgcagacag

SEQ ID NO: 2514302 - DNA, 15 bp, Homo sapiens
atgatcttttcaagt

SEQ ID NO: 2514303 - DNA, 15 bp, Homo sapiens
atgatgatcctaggc

SEQ ID NO: 2514304 - DNA, 18 bp, Homo sapiens
atgatgatctttaaaata

SEQ ID NO: 2514305 - DNA, 19 bp, Homo sapiens
atgatggcaattttgtaac

SEQ ID NO: 2514306 - DNA, 18 bp, Homo sapiens
atgatggttgcaaaagac

SEQ ID NO: 2514307 - DNA, 20 bp, Homo sapiens
atgatgtaagtttacctatg

SEQ ID NO: 2514308 - DNA, 15 bp, Homo sapiens
atgatgtatttttgt

SEQ ID NO: 2514309 - DNA, 20 bp, Homo sapiens
atgatgtggtgcctgaggtc

SEQ ID NO: 2514310 - DNA, 16 bp, Homo sapiens
atgattaattcacctt

SEQ ID NO: 2514311 - DNA, 20 bp, Homo sapiens
atgattctttgttacaggca

SEQ ID NO: 2514312 - DNA, 13 bp, Homo sapiens
atgattggattat

SEQ ID NO: 2514313 - DNA, 22 bp, Homo sapiens
atgattggattattcatttaaa

SEQ ID NO: 2514314 - DNA, 22 bp, Homo sapiens
atgattgtgcacatacttgaga

SEQ ID NO: 2514315 - DNA, 14 bp, Homo sapiens
atgatttaaaacat

SEQ ID NO: 2514316 - DNA, 16 bp, Homo sapiens
atgatttaaaagggaa

SEQ ID NO: 2514317 - DNA, 13 bp, Homo sapiens
atgatttatagtt

SEQ ID NO: 2514318 - DNA, 22 bp, Homo sapiens
atgatttttagatgagattgtt

SEQ ID NO: 2514319 - DNA, 19 bp, Homo sapiens
atgcaaaaattagccgggc

SEQ ID NO: 2514320 - DNA, 12 bp, Homo sapiens
atgcaaagcact

SEQ ID NO: 2514321 - DNA, 13 bp, Homo sapiens
atgcaaaggctgg

SEQ ID NO: 2514322 - DNA, 18 bp, Homo sapiens
atgcaaatcctatgtgat

SEQ ID NO: 2514323 - DNA, 16 bp, Homo sapiens
atgcaacaacatgtat

SEQ ID NO: 2514324 - DNA, 16 bp, Homo sapiens
atgcaacaggcactca

SEQ ID NO: 2514325 - DNA, 19 bp, Homo sapiens
atgcaacatgtgtacttaa

SEQ ID NO: 2514326 - DNA, 14 bp, Homo sapiens
atgcaaggaaggaa

SEQ ID NO: 2514327 - DNA, 14 bp, Homo sapiens
atgcaaggaccagg

SEQ ID NO: 2514328 - DNA, 16 bp, Homo sapiens
atgcaaggtcattttt

SEQ ID NO: 2514329 - DNA, 19 bp, Homo sapiens
atgcaatatatctaaattg

SEQ ID NO: 2514330 - DNA, 21 bp, Homo sapiens
atgcaatatatctaaattgaa

SEQ ID NO: 2514331 - DNA, 14 bp, Homo sapiens
atgcaatatgtatt

SEQ ID NO: 2514332 - DNA, 14 bp, Homo sapiens
atgcaatgtgaagc

SEQ ID NO: 2514333 - DNA, 13 bp, Homo sapiens
atgcaatgtgcta

SEQ ID NO: 2514334 - DNA, 20 bp, Homo sapiens
atgcaattttgcatttgaat

SEQ ID NO: 2514335 - DNA, 14 bp, Homo sapiens
atgcacacaaaaca

SEQ ID NO: 2514336 - DNA, 22 bp, Homo sapiens
atgcacacaaaacaaccctaga

SEQ ID NO: 2514337 - DNA, 19 bp, Homo sapiens
atgcacacattttttaaat

SEQ ID NO: 2514338 - DNA, 22 bp, Homo sapiens
atgcacacattttttaaatgca

SEQ ID NO: 2514339 - DNA, 23 bp, Homo sapiens
atgcacacattttttaaatgcac

SEQ ID NO: 2514340 - DNA, 19 bp, Homo sapiens
atgcacagagttgttacat

SEQ ID NO: 2514341 - DNA, 23 bp, Homo sapiens
atgcacagagttgttacattttt

SEQ ID NO: 2514342 - DNA, 19 bp, Homo sapiens
atgcacatatggactctgc

SEQ ID NO: 2514343 - DNA, 14 bp, Homo sapiens
atgcaccattagaa

SEQ ID NO: 2514344 - DNA, 24 bp, Homo sapiens
atgcacctgaatgttagatagtta

SEQ ID NO: 2514345 - DNA, 14 bp, Homo sapiens
atgcacctggaata

SEQ ID NO: 2514346 - DNA, 16 bp, Homo sapiens
atgcacctggaatata

SEQ ID NO: 2514347 - DNA, 18 bp, Homo sapiens
atgcaccttgtgtctgta

SEQ ID NO: 2514348 - DNA, 16 bp, Homo sapiens
atgcacgaccttggga

SEQ ID NO: 2514349 - DNA, 16 bp, Homo sapiens
atgcactatgaggaat

SEQ ID NO: 2514350 - DNA, 14 bp, Homo sapiens
atgcactcagctct

SEQ ID NO: 2514351 - DNA, 12 bp, Homo sapiens
atgcactttgtt

SEQ ID NO: 2514352 - DNA, 17 bp, Homo sapiens
atgcactttgttctggc

SEQ ID NO: 2514353 - DNA, 23 bp, Homo sapiens
atgcactttgttctggctcttcc

SEQ ID NO: 2514354 - DNA, 13 bp, Homo sapiens
atgcagagagcca

SEQ ID NO: 2514355 - DNA, 14 bp, Homo sapiens
cacaagttgtgttt

SEQ ID NO: 2514356 - DNA, 18 bp, Homo sapiens
cacaataaaaatgtttaa

SEQ ID NO: 2514357 - DNA, 11 bp, Homo sapiens
cacaatatttt

SEQ ID NO: 2514358 - DNA, 20 bp, Homo sapiens
cacaatcctaacacattatc

SEQ ID NO: 2514359 - DNA, 19 bp, Homo sapiens
cacaatcttaaggggcagc

SEQ ID NO: 2514360 - DNA, 20 bp, Homo sapiens
cacaatggctaattcccaga

SEQ ID NO: 2514361 - DNA, 18 bp, Homo sapiens
cacacaagaagaagggca

SEQ ID NO: 2514362 - DNA, 11 bp, Homo sapiens
cacacacacac

SEQ ID NO: 2514363 - DNA, 13 bp, Homo sapiens
cacacacacacac

SEQ ID NO: 2514364 - DNA, 16 bp, Homo sapiens
cacacacacacacagg

SEQ ID NO: 2514365 - DNA, 16 bp, Homo sapiens
cacacacacacacatg

SEQ ID NO: 2514366 - DNA, 14 bp, Homo sapiens
cacacacacacagc

SEQ ID NO: 2514367 - DNA, 16 bp, Homo sapiens
cacacacacacaggag

SEQ ID NO: 2514368 - DNA, 16 bp, Homo sapiens
cacacacacacatgca

SEQ ID NO: 2514369 - DNA, 13 bp, Homo sapiens
cacacacacactc

SEQ ID NO: 2514370 - DNA, 15 bp, Homo sapiens
cacacacacagccac

SEQ ID NO: 2514371 - DNA, 12 bp, Homo sapiens
cacacacacagg

SEQ ID NO: 2514372 - DNA, 13 bp, Homo sapiens
cacacacacagga

SEQ ID NO: 2514373 - DNA, 12 bp, Homo sapiens
cacacacacatg

SEQ ID NO: 2514374 - DNA, 13 bp, Homo sapiens
cacacacacgcac

SEQ ID NO: 2514375 - DNA, 13 bp, Homo sapiens
cacacacagaaaa

SEQ ID NO: 2514376 - DNA, 14 bp, Homo sapiens
cacacacagaaaat

SEQ ID NO: 2514377 - DNA, 20 bp, Homo sapiens
cacacacagaaaatatactg

SEQ ID NO: 2514378 - DNA, 23 bp, Homo sapiens
cacacacagaaaatatactgtaa

SEQ ID NO: 2514379 - DNA, 12 bp, Homo sapiens
cacacacaggag

SEQ ID NO: 2514380 - DNA, 15 bp, Homo sapiens
cacacacaggagcat

SEQ ID NO: 2514381 - DNA, 13 bp, Homo sapiens
cacacacaggcaa

SEQ ID NO: 2514382 - DNA, 19 bp, Homo sapiens
cacacacatacacacatat

SEQ ID NO: 2514383 - DNA, 16 bp, Homo sapiens
cacacacatgcataca

SEQ ID NO: 2514384 - DNA, 20 bp, Homo sapiens
cacacaccagagcccacctt

SEQ ID NO: 2514385 - DNA, 14 bp, Homo sapiens
cacacacgcacgca

SEQ ID NO: 2514386 - DNA, 16 bp, Homo sapiens
cacacacgcacgcaca

SEQ ID NO: 2514387 - DNA, 19 bp, Homo sapiens
cacacacgcacgcacacac

SEQ ID NO: 2514388 - DNA, 23 bp, Homo sapiens
cacacacgcacgcacacacacaa

SEQ ID NO: 2514389 - DNA, 17 bp, Homo sapiens
cacacacgcgtgcacac

SEQ ID NO: 2514390 - DNA, 15 bp, Homo sapiens
cacacacgtgagaat

SEQ ID NO: 2514391 - DNA, 12 bp, Homo sapiens
cacacactcact

SEQ ID NO: 2514392 - DNA, 15 bp, Homo sapiens
cacacactcactgcg

SEQ ID NO: 2514393 - DNA, 20 bp, Homo sapiens
cacacactcgcccgcccact

SEQ ID NO: 2514394 - DNA, 12 bp, Homo sapiens
cacacacttttg

SEQ ID NO: 2514395 - DNA, 13 bp, Homo sapiens
cacacagaaaata

SEQ ID NO: 2514396 - DNA, 16 bp, Homo sapiens
cacacagaaaatatac

SEQ ID NO: 2514397 - DNA, 17 bp, Homo sapiens
cacacagaaaatatact

SEQ ID NO: 2514398 - DNA, 21 bp, Homo sapiens
cacacagaaaatatactgtaa

SEQ ID NO: 2514399 - DNA, 20 bp, Homo sapiens
cacacagagtggtctttctg

SEQ ID NO: 2514400 - DNA, 19 bp, Homo sapiens
cacacagcaagtcagggtt

SEQ ID NO: 2514401 - DNA, 15 bp, Homo sapiens
cacacagcagcagtt

SEQ ID NO: 2514402 - DNA, 11 bp, Homo sapiens
cacacagccac

SEQ ID NO: 2514403 - DNA, 12 bp, Homo sapiens
cacacagccaca

SEQ ID NO: 2514404 - DNA, 14 bp, Homo sapiens
cacacagccacaca

SEQ ID NO: 2514405 - DNA, 21 bp, Homo sapiens
cacacagccaggtgccttgga

SEQ ID NO: 2514406 - DNA, 12 bp, Homo sapiens
cacacagctctg

SEQ ID NO: 2514407 - DNA, 17 bp, Homo sapiens
cacacaggacccccttc

SEQ ID NO: 2514408 - DNA, 19 bp, Homo sapiens
cacacaggcaactgaggca

SEQ ID NO: 2514409 - DNA, 23 bp, Homo sapiens
cacacagggtctgcaaggtcttt

SEQ ID NO: 2514410 - DNA, 23 bp, Homo sapiens
cacacagtattacttctgctaca

SEQ ID NO: 2514411 - DNA, 21 bp, Homo sapiens
cacacatataaacatcacaca

SEQ ID NO: 2514412 - DNA, 13 bp, Homo sapiens
cacacatcaggag

SEQ ID NO: 2514413 - DNA, 20 bp, Homo sapiens
cacacatgagcatcaggcca

SEQ ID NO: 2514414 - DNA, 15 bp, Homo sapiens
cacacatgcatacac

SEQ ID NO: 2514415 - DNA, 16 bp, Homo sapiens
cacacatgcatacaca

SEQ ID NO: 2514416 - DNA, 18 bp, Homo sapiens
cacacatgcatacacaca

SEQ ID NO: 2514417 - DNA, 11 bp, Homo sapiens
cacacattttt

SEQ ID NO: 2514418 - DNA, 18 bp, Homo sapiens
cacaccaagcagcaacag

SEQ ID NO: 2514419 - DNA, 15 bp, Homo sapiens
cacaccagagcccac

SEQ ID NO: 2514420 - DNA, 22 bp, Homo sapiens
cacaccagagcccaccttggct

SEQ ID NO: 2514421 - DNA, 23 bp, Homo sapiens
cacaccaggccgtcctcccgggc

SEQ ID NO: 2514422 - DNA, 13 bp, Homo sapiens
cacaccaggctgt

SEQ ID NO: 2514423 - DNA, 17 bp, Homo sapiens
cacaccaggctgtgggc

SEQ ID NO: 2514424 - DNA, 21 bp, Homo sapiens
cacaccaggcttgcctgcagg

SEQ ID NO: 2514425 - DNA, 20 bp, Homo sapiens
cacacccagcccacttctgc

SEQ ID NO: 2514426 - DNA, 17 bp, Homo sapiens
cacaccctctcccagga

SEQ ID NO: 2514427 - DNA, 21 bp, Homo sapiens
cacaccctgtactgttctgtg

SEQ ID NO: 2514428 - DNA, 20 bp, Homo sapiens
cacaccgagggcgaccccgt

SEQ ID NO: 2514429 - DNA, 16 bp, Homo sapiens
cacacctaagggacat

SEQ ID NO: 2514430 - DNA, 14 bp, Homo sapiens
cacacctagcgtca

SEQ ID NO: 2514431 - DNA, 21 bp, Homo sapiens
cacacctcagttcccttggcc

SEQ ID NO: 2514432 - DNA, 22 bp, Homo sapiens
cacacctcagttcccttggcct

SEQ ID NO: 2514433 - DNA, 16 bp, Homo sapiens
cacacctgactctgaa

SEQ ID NO: 2514434 - DNA, 16 bp, Homo sapiens
cacacctgtagtccca

SEQ ID NO: 2514435 - DNA, 19 bp, Homo sapiens
cacacctgtagtcccagct

SEQ ID NO: 2514436 - DNA, 20 bp, Homo sapiens
cacacctgtagtcccagcta

SEQ ID NO: 2514437 - DNA, 20 bp, Homo sapiens
cacacgcaggaactcccagc

SEQ ID NO: 2514438 - DNA, 21 bp, Homo sapiens
cacacgcaggaactcccagca

SEQ ID NO: 2514439 - DNA, 17 bp, Homo sapiens
cacacgcctcccactgg

SEQ ID NO: 2514440 - DNA, 20 bp, Homo sapiens
cacacgcctcccactggggt

SEQ ID NO: 2514441 - DNA, 20 bp, Homo sapiens
cacacggaggcatctgcacc

SEQ ID NO: 2514442 - DNA, 19 bp, Homo sapiens
cacacggtttgaagcctgg

SEQ ID NO: 2514443 - DNA, 20 bp, Homo sapiens
cacacgtcatttcttagcta

SEQ ID NO: 2514444 - DNA, 18 bp, Homo sapiens
cacactagcctctccagg

SEQ ID NO: 2514445 - DNA, 19 bp, Homo sapiens
cacactattaccatgagaa

SEQ ID NO: 2514446 - DNA, 20 bp, Homo sapiens
cacactattaccatgagaag

SEQ ID NO: 2514447 - DNA, 14 bp, Homo sapiens
cacactcatcccct

SEQ ID NO: 2514448 - DNA, 14 bp, Homo sapiens
cacactccatcagc

SEQ ID NO: 2514449 - DNA, 17 bp, Homo sapiens
cacactcccctgcactg

SEQ ID NO: 2514450 - DNA, 15 bp, Homo sapiens
cacactgaggcaggg

SEQ ID NO: 2514451 - DNA, 16 bp, Homo sapiens
cacactgaggcaggga

SEQ ID NO: 2514452 - DNA, 19 bp, Homo sapiens
cacactggactccggccct

SEQ ID NO: 2514453 - DNA, 19 bp, Homo sapiens
cacactgggacttgcaaaa

SEQ ID NO: 2514454 - DNA, 15 bp, Homo sapiens
cacactggtgactgc

SEQ ID NO: 2514455 - DNA, 23 bp, Homo sapiens
cacactggtgtggattaacctgc

SEQ ID NO: 2514456 - DNA, 23 bp, Homo sapiens
cacactgtagcattacagtgggt

SEQ ID NO: 2514457 - DNA, 16 bp, Homo sapiens
cacacttcctgtccag

SEQ ID NO: 2514458 - DNA, 17 bp, Homo sapiens
cacacttgagaggatga

SEQ ID NO: 2514459 - DNA, 19 bp, Homo sapiens
cacacttgtgtgtgggctg

SEQ ID NO: 2514460 - DNA, 21 bp, Homo sapiens
cacacttgtgtgtgggctgtg

SEQ ID NO: 2514461 - DNA, 17 bp, Homo sapiens
cacacttgttccagctc

SEQ ID NO: 2514462 - DNA, 15 bp, Homo sapiens
cacagaaaatatact

SEQ ID NO: 2514463 - DNA, 22 bp, Homo sapiens
cacagaaaatatactgtaaaga

SEQ ID NO: 2514464 - DNA, 13 bp, Homo sapiens
cacagaaacacaa

SEQ ID NO: 2514465 - DNA, 19 bp, Homo sapiens
cacagaagaggctggttct

SEQ ID NO: 2514466 - DNA, 18 bp, Homo sapiens
cacagaagccaggagcaa

SEQ ID NO: 2514467 - DNA, 18 bp, Homo sapiens
cacagacacacacacgca

SEQ ID NO: 2514468 - DNA, 22 bp, Homo sapiens
cacagacacacacacgcacgca

SEQ ID NO: 2514469 - DNA, 20 bp, Homo sapiens
cacagacctggagcccctgg

SEQ ID NO: 2514470 - DNA, 22 bp, Homo sapiens
cacagacctggagcccctgggt

SEQ ID NO: 2514471 - DNA, 15 bp, Homo sapiens
cacagagaagacaaa

SEQ ID NO: 2514472 - DNA, 14 bp, Homo sapiens
cacagagacccccg

SEQ ID NO: 2514473 - DNA, 22 bp, Homo sapiens
cacagagacccccggaacaagc

SEQ ID NO: 2514474 - DNA, 23 bp, Homo sapiens
cacagagacccccggaacaagcc

SEQ ID NO: 2514475 - DNA, 16 bp, Homo sapiens
cacagagagtcccact

SEQ ID NO: 2514476 - DNA, 14 bp, Homo sapiens
cacagagcggggac

SEQ ID NO: 2514477 - DNA, 16 bp, Homo sapiens
cacagaggaagagcag

SEQ ID NO: 2514478 - DNA, 22 bp, Homo sapiens
cacagagtggtctttctggaga

SEQ ID NO: 2514479 - DNA, 19 bp, Homo sapiens
cacagagtgtgctggagga

SEQ ID NO: 2514480 - DNA, 20 bp, Homo sapiens
cacagatggatttgcctgtg

SEQ ID NO: 2514481 - DNA, 23 bp, Homo sapiens
cacagatggatttgcctgtgcca

SEQ ID NO: 2514482 - DNA, 18 bp, Homo sapiens
cacagatgggtgcttgga

SEQ ID NO: 2514483 - DNA, 18 bp, Homo sapiens
cacagcagcttcaccaga

SEQ ID NO: 2514484 - DNA, 21 bp, Homo sapiens
cacagcagcttcaccagagca

SEQ ID NO: 2514485 - DNA, 20 bp, Homo sapiens
cacagcatcattttgcattc

SEQ ID NO: 2514486 - DNA, 14 bp, Homo sapiens
cacagccacacaca

SEQ ID NO: 2514487 - DNA, 17 bp, Homo sapiens
cacagccacacacacag

SEQ ID NO: 2514488 - DNA, 20 bp, Homo sapiens
cacagccacacacacagaaa

SEQ ID NO: 2514489 - DNA, 23 bp, Homo sapiens
cacagccacacacacagaaaata

SEQ ID NO: 2514490 - DNA, 19 bp, Homo sapiens
cacagccaggtgccttgga

SEQ ID NO: 2514491 - DNA, 13 bp, Homo sapiens
cacagccatccca

SEQ ID NO: 2514492 - DNA, 16 bp, Homo sapiens
cacagccatcccagcc

SEQ ID NO: 2514493 - DNA, 22 bp, Homo sapiens
cacagccatcccagccttggca

SEQ ID NO: 2514494 - DNA, 10 bp, Homo sapiens
cacagccctg

SEQ ID NO: 2514495 - DNA, 18 bp, Homo sapiens
cacagccctgtcagtgca

SEQ ID NO: 2514496 - DNA, 13 bp, Homo sapiens
cacctgccagcct

SEQ ID NO: 2514497 - DNA, 14 bp, Homo sapiens
cacctgccagcctg

SEQ ID NO: 2514498 - DNA, 20 bp, Homo sapiens
cacctgccagcctggcttct

SEQ ID NO: 2514499 - DNA, 22 bp, Homo sapiens
cacctgccagcctggcttctgg

SEQ ID NO: 2514500 - DNA, 13 bp, Homo sapiens
cacctgccaggga

SEQ ID NO: 2514501 - DNA, 22 bp, Homo sapiens
cacctgccatttgcaccctccg

SEQ ID NO: 2514502 - DNA, 18 bp, Homo sapiens
cacctgcccaacctgctc

SEQ ID NO: 2514503 - DNA, 19 bp, Homo sapiens
cacctgcccaacctgctct

SEQ ID NO: 2514504 - DNA, 14 bp, Homo sapiens
cacctgccccctgg

SEQ ID NO: 2514505 - DNA, 21 bp, Homo sapiens
cacctgcccccttctcccaca

SEQ ID NO: 2514506 - DNA, 23 bp, Homo sapiens
cacctgcccccttctcccacact

SEQ ID NO: 2514507 - DNA, 12 bp, Homo sapiens
cacctgccctgc

SEQ ID NO: 2514508 - DNA, 14 bp, Homo sapiens
cacctgctcccagg

SEQ ID NO: 2514509 - DNA, 14 bp, Homo sapiens
cacctgctcttcta

SEQ ID NO: 2514510 - DNA, 13 bp, Homo sapiens
cacctgctggccc

SEQ ID NO: 2514511 - DNA, 22 bp, Homo sapiens
cacctgctggcccctcacctgg

SEQ ID NO: 2514512 - DNA, 14 bp, Homo sapiens
cacctggccacctg

SEQ ID NO: 2514513 - DNA, 15 bp, Homo sapiens
cacctggccacctga

SEQ ID NO: 2514514 - DNA, 13 bp, Homo sapiens
cacctggcctctg

SEQ ID NO: 2514515 - DNA, 14 bp, Homo sapiens
cacctggcctctgc

SEQ ID NO: 2514516 - DNA, 23 bp, Homo sapiens
cacctggcctctgcactcccctg

SEQ ID NO: 2514517 - DNA, 16 bp, Homo sapiens
cacctgggcttaagaa

SEQ ID NO: 2514518 - DNA, 14 bp, Homo sapiens
cacctggggagtgg

SEQ ID NO: 2514519 - DNA, 15 bp, Homo sapiens
cacctgtactcagga

SEQ ID NO: 2514520 - DNA, 23 bp, Homo sapiens
cacctgtactcaggaggctgagg

SEQ ID NO: 2514521 - DNA, 18 bp, Homo sapiens
cacctgtagtcccagcta

SEQ ID NO: 2514522 - DNA, 18 bp, Homo sapiens
cacctgtctcagcctccc

SEQ ID NO: 2514523 - DNA, 19 bp, Homo sapiens
cacctgtgcttcgggccct

SEQ ID NO: 2514524 - DNA, 19 bp, Homo sapiens
cacctgtttttaagctgtt

SEQ ID NO: 2514525 - DNA, 20 bp, Homo sapiens
cacctgtttttaagctgttt

SEQ ID NO: 2514526 - DNA, 19 bp, Homo sapiens
caccttaccaactttctgt

SEQ ID NO: 2514527 - DNA, 14 bp, Homo sapiens
caccttagacagtc

SEQ ID NO: 2514528 - DNA, 19 bp, Homo sapiens
caccttagacagtccctgc

SEQ ID NO: 2514529 - DNA, 13 bp, Homo sapiens
caccttaggcagg

SEQ ID NO: 2514530 - DNA, 17 bp, Homo sapiens
caccttaggcagggaag

SEQ ID NO: 2514531 - DNA, 15 bp, Homo sapiens
caccttatatttacg

SEQ ID NO: 2514532 - DNA, 18 bp, Homo sapiens
caccttcaattcctgggc

SEQ ID NO: 2514533 - DNA, 18 bp, Homo sapiens
caccttccagctcctgta

SEQ ID NO: 2514534 - DNA, 13 bp, Homo sapiens
caccttcccatgc

SEQ ID NO: 2514535 - DNA, 14 bp, Homo sapiens
caccttcccatgcc

SEQ ID NO: 2514536 - DNA, 13 bp, Homo sapiens
caccttcctcact

SEQ ID NO: 2514537 - DNA, 22 bp, Homo sapiens
caccttgaagaacctctcactt

SEQ ID NO: 2514538 - DNA, 15 bp, Homo sapiens
caccttgacagggca

SEQ ID NO: 2514539 - DNA, 19 bp, Homo sapiens
caccttgacagggcacacc

SEQ ID NO: 2514540 - DNA, 19 bp, Homo sapiens
caccttgggatgatgcctc

SEQ ID NO: 2514541 - DNA, 17 bp, Homo sapiens
cacctttattaaaatct

SEQ ID NO: 2514542 - DNA, 21 bp, Homo sapiens
cacctttcagataactgttat

SEQ ID NO: 2514543 - DNA, 15 bp, Homo sapiens
cacctttgcaggcat

SEQ ID NO: 2514544 - DNA, 14 bp, Homo sapiens
cacctttgtcccca

SEQ ID NO: 2514545 - DNA, 17 bp, Homo sapiens
cacctttgtccccaccg

SEQ ID NO: 2514546 - DNA, 23 bp, Homo sapiens
cacctttgtggggtttttggaga

SEQ ID NO: 2514547 - DNA, 18 bp, Homo sapiens
caccttttaactcacctc

SEQ ID NO: 2514548 - DNA, 20 bp, Homo sapiens
caccttttcagcgatgtatg

SEQ ID NO: 2514549 - DNA, 19 bp, Homo sapiens
cacctttttcatacaaggc

SEQ ID NO: 2514550 - DNA, 15 bp, Homo sapiens
cacgaaatgttattt

SEQ ID NO: 2514551 - DNA, 15 bp, Homo sapiens
cacgaagtgttgcat

SEQ ID NO: 2514552 - DNA, 16 bp, Homo sapiens
cacgaagtgttgcatg

SEQ ID NO: 2514553 - DNA, 18 bp, Homo sapiens
cacgaatttgctggggaa

SEQ ID NO: 2514554 - DNA, 17 bp, Homo sapiens
cacgactgcccggcagg

SEQ ID NO: 2514555 - DNA, 17 bp, Homo sapiens
cacgagcaggctactgt

SEQ ID NO: 2514556 - DNA, 12 bp, Homo sapiens
cacgatgaaaaa

SEQ ID NO: 2514557 - DNA, 15 bp, Homo sapiens
cacgatgaaaaactt

SEQ ID NO: 2514558 - DNA, 16 bp, Homo sapiens
cacgatttctgtttag

SEQ ID NO: 2514559 - DNA, 12 bp, Homo sapiens
cacgcacacaca

SEQ ID NO: 2514560 - DNA, 14 bp, Homo sapiens
cacgcacgcacaca

SEQ ID NO: 2514561 - DNA, 16 bp, Homo sapiens
cacgcacgcacacaca

SEQ ID NO: 2514562 - DNA, 22 bp, Homo sapiens
cacgccagattctttcctgagg

SEQ ID NO: 2514563 - DNA, 18 bp, Homo sapiens
cacgcccccactggtgac

SEQ ID NO: 2514564 - DNA, 18 bp, Homo sapiens
cacgcctatgatcccagc

SEQ ID NO: 2514565 - DNA, 14 bp, Homo sapiens
cacgcctcccactg

SEQ ID NO: 2514566 - DNA, 15 bp, Homo sapiens
cacgcctcccactgg

SEQ ID NO: 2514567 - DNA, 20 bp, Homo sapiens
cacgcctgtaatcccagcac

SEQ ID NO: 2514568 - DNA, 12 bp, Homo sapiens
cacgcctgtgca

SEQ ID NO: 2514569 - DNA, 21 bp, Homo sapiens
cacgcgtgcacacaccagagc

SEQ ID NO: 2514570 - DNA, 22 bp, Homo sapiens
cacgctaatcccgattcaccct

SEQ ID NO: 2514571 - DNA, 17 bp, Homo sapiens
cacgctggaccttgaac

SEQ ID NO: 2514572 - DNA, 15 bp, Homo sapiens
cacgctgtctccaga

SEQ ID NO: 2514573 - DNA, 22 bp, Homo sapiens
cacggaagagccttgcggaagg

SEQ ID NO: 2514574 - DNA, 16 bp, Homo sapiens
cacggagccactcctc

SEQ ID NO: 2514575 - DNA, 21 bp, Homo sapiens
cacggagccactcctctgact

SEQ ID NO: 2514576 - DNA, 21 bp, Homo sapiens
cacggcaggacaacgaggaag

SEQ ID NO: 2514577 - DNA, 13 bp, Homo sapiens
cacggccaggcca

SEQ ID NO: 2514578 - DNA, 16 bp, Homo sapiens
cacggccgctccaggg

SEQ ID NO: 2514579 - DNA, 16 bp, Homo sapiens
cacggctcactgcagc

SEQ ID NO: 2514580 - DNA, 20 bp, Homo sapiens
cacggctctaggtggggcgg

SEQ ID NO: 2514581 - DNA, 15 bp, Homo sapiens
cacgggggcagctga

SEQ ID NO: 2514582 - DNA, 14 bp, Homo sapiens
cacggtagtgcctg

SEQ ID NO: 2514583 - DNA, 14 bp, Homo sapiens
cacggtctgttctt

SEQ ID NO: 2514584 - DNA, 15 bp, Homo sapiens
cacgtacaaaatcca

SEQ ID NO: 2514585 - DNA, 18 bp, Homo sapiens
cacgtacacacacataca

SEQ ID NO: 2514586 - DNA, 19 bp, Homo sapiens
cacgtacacacacatacac

SEQ ID NO: 2514587 - DNA, 23 bp, Homo sapiens
cacgtagcccccaggctgctgga

SEQ ID NO: 2514588 - DNA, 20 bp, Homo sapiens
cacgtgagaatccctggcaa

SEQ ID NO: 2514589 - DNA, 13 bp, Homo sapiens
cacgtggagagct

SEQ ID NO: 2514590 - DNA, 15 bp, Homo sapiens
cacgtgggaaccccc

SEQ ID NO: 2514591 - DNA, 21 bp, Homo sapiens
cacgtgggaacccccctccca

SEQ ID NO: 2514592 - DNA, 19 bp, Homo sapiens
cacgtgtggcctgttcttc

SEQ ID NO: 2514593 - DNA, 13 bp, Homo sapiens
cacgttatggtgt

SEQ ID NO: 2514594 - DNA, 14 bp, Homo sapiens
cacgtttctaaagg

SEQ ID NO: 2514595 - DNA, 16 bp, Homo sapiens
cactaaagtatgtaaa

SEQ ID NO: 2514596 - DNA, 15 bp, Homo sapiens
cactaaccacgctgg

SEQ ID NO: 2514597 - DNA, 16 bp, Homo sapiens
cactaaccacgctgga

SEQ ID NO: 2514598 - DNA, 11 bp, Homo sapiens
cactaactaga

SEQ ID NO: 2514599 - DNA, 14 bp, Homo sapiens
cactaagttatagt

SEQ ID NO: 2514600 - DNA, 22 bp, Homo sapiens
cactaagttatagtatatctgg

SEQ ID NO: 2514601 - DNA, 17 bp, Homo sapiens
cactacactccagcctg

SEQ ID NO: 2514602 - DNA, 19 bp, Homo sapiens
cactacactccagcctgag

SEQ ID NO: 2514603 - DNA, 17 bp, Homo sapiens
cactacataaactgact

SEQ ID NO: 2514604 - DNA, 23 bp, Homo sapiens
cactacatgcagcccatgcccac

SEQ ID NO: 2514605 - DNA, 16 bp, Homo sapiens
cactacattctgttaa

SEQ ID NO: 2514606 - DNA, 17 bp, Homo sapiens
cactactcacagtctct

SEQ ID NO: 2514607 - DNA, 13 bp, Homo sapiens
cactactctgtgc

SEQ ID NO: 2514608 - DNA, 14 bp, Homo sapiens
cactactctgtgcc

SEQ ID NO: 2514609 - DNA, 21 bp, Homo sapiens
cactactgctaccacaactat

SEQ ID NO: 2514610 - DNA, 15 bp, Homo sapiens
cactagaactctcca

SEQ ID NO: 2514611 - DNA, 17 bp, Homo sapiens
cactagaactctccatc

SEQ ID NO: 2514612 - DNA, 16 bp, Homo sapiens
cactagcccaatgaaa

SEQ ID NO: 2514613 - DNA, 21 bp, Homo sapiens
cactagcctctccaggaatgc

SEQ ID NO: 2514614 - DNA, 16 bp, Homo sapiens
cactaggactctgagg

SEQ ID NO: 2514615 - DNA, 14 bp, Homo sapiens
cactataatgtaag

SEQ ID NO: 2514616 - DNA, 18 bp, Homo sapiens
cactataatgtaagctct

SEQ ID NO: 2514617 - DNA, 14 bp, Homo sapiens
cactatagcctagg

SEQ ID NO: 2514618 - DNA, 14 bp, Homo sapiens
cactatatctgtat

SEQ ID NO: 2514619 - DNA, 17 bp, Homo sapiens
cactatctgggtgcatg

SEQ ID NO: 2514620 - DNA, 21 bp, Homo sapiens
cagaactgaaccggctttacc

SEQ ID NO: 2514621 - DNA, 22 bp, Homo sapiens
cagaactgaaccggctttacca

SEQ ID NO: 2514622 - DNA, 18 bp, Homo sapiens
cagaactggactcaggat

SEQ ID NO: 2514623 - DNA, 15 bp, Homo sapiens
cagaagaaggcagca

SEQ ID NO: 2514624 - DNA, 16 bp, Homo sapiens
cagaagaatattcagg

SEQ ID NO: 2514625 - DNA, 18 bp, Homo sapiens
cagaagaatattcaggac

SEQ ID NO: 2514626 - DNA, 18 bp, Homo sapiens
cagaagacaccagagcag

SEQ ID NO: 2514627 - DNA, 19 bp, Homo sapiens
cagaagacaccagagcaga

SEQ ID NO: 2514628 - DNA, 21 bp, Homo sapiens
cagaagacactgatgggcaac

SEQ ID NO: 2514629 - DNA, 19 bp, Homo sapiens
cagaagacactgcaaaggc

SEQ ID NO: 2514630 - DNA, 21 bp, Homo sapiens
cagaagaccacaaaaattgac

SEQ ID NO: 2514631 - DNA, 21 bp, Homo sapiens
cagaagagatgggcttgtttt

SEQ ID NO: 2514632 - DNA, 20 bp, Homo sapiens
cagaagatagcttcacccca

SEQ ID NO: 2514633 - DNA, 15 bp, Homo sapiens
cagaagatcccctca

SEQ ID NO: 2514634 - DNA, 15 bp, Homo sapiens
cagaagcaggctgga

SEQ ID NO: 2514635 - DNA, 23 bp, Homo sapiens
cagaagcagttgagtcgtcatca

SEQ ID NO: 2514636 - DNA, 15 bp, Homo sapiens
cagaagccaggagca

SEQ ID NO: 2514637 - DNA, 16 bp, Homo sapiens
cagaagccaggagcaa

SEQ ID NO: 2514638 - DNA, 19 bp, Homo sapiens
cagaagccaggagcaaatg

SEQ ID NO: 2514639 - DNA, 13 bp, Homo sapiens
cagaagcctctgg

SEQ ID NO: 2514640 - DNA, 16 bp, Homo sapiens
cagaagctgagcacca

SEQ ID NO: 2514641 - DNA, 21 bp, Homo sapiens
cagaagctgagcaccagggga

SEQ ID NO: 2514642 - DNA, 17 bp, Homo sapiens
cagaaggatgaatgagg

SEQ ID NO: 2514643 - DNA, 18 bp, Homo sapiens
cagaaggcaaacccatca

SEQ ID NO: 2514644 - DNA, 20 bp, Homo sapiens
cagaaggggaggggagacag

SEQ ID NO: 2514645 - DNA, 18 bp, Homo sapiens
cagaagggggccatgagg

SEQ ID NO: 2514646 - DNA, 22 bp, Homo sapiens
cagaaggggtttggtctgggac

SEQ ID NO: 2514647 - DNA, 16 bp, Homo sapiens
cagaagtcatgaagcc

SEQ ID NO: 2514648 - DNA, 17 bp, Homo sapiens
cagaagtcatgaagccc

SEQ ID NO: 2514649 - DNA, 22 bp, Homo sapiens
cagaagtttgagatcagcctgg

SEQ ID NO: 2514650 - DNA, 23 bp, Homo sapiens
cagaagtttgagatcagcctggg

SEQ ID NO: 2514651 - DNA, 22 bp, Homo sapiens
cagaataaagttctgagtgttt

SEQ ID NO: 2514652 - DNA, 18 bp, Homo sapiens
cagaataagttattgcag

SEQ ID NO: 2514653 - DNA, 19 bp, Homo sapiens
cagaataagttattgcagt

SEQ ID NO: 2514654 - DNA, 20 bp, Homo sapiens
cagaataagttattgcagtt

SEQ ID NO: 2514655 - DNA, 13 bp, Homo sapiens
cagaatcaaagca

SEQ ID NO: 2514656 - DNA, 15 bp, Homo sapiens
cagaatcaaagcaat

SEQ ID NO: 2514657 - DNA, 23 bp, Homo sapiens
cagaatcaaagcaatgcattttg

SEQ ID NO: 2514658 - DNA, 16 bp, Homo sapiens
cagaatcctggccctc

SEQ ID NO: 2514659 - DNA, 18 bp, Homo sapiens
cagaatgaggaataataa

SEQ ID NO: 2514660 - DNA, 17 bp, Homo sapiens
cagaatgctagctctga

SEQ ID NO: 2514661 - DNA, 14 bp, Homo sapiens
cagaattctgctac

SEQ ID NO: 2514662 - DNA, 23 bp, Homo sapiens
cagaattctgctacctcactggg

SEQ ID NO: 2514663 - DNA, 14 bp, Homo sapiens
cagacaacagaagt

SEQ ID NO: 2514664 - DNA, 16 bp, Homo sapiens
cagacaacagaagtca

SEQ ID NO: 2514665 - DNA, 22 bp, Homo sapiens
cagacaacagaagtcatgaagc

SEQ ID NO: 2514666 - DNA, 19 bp, Homo sapiens
cagacaagcaacaggtttt

SEQ ID NO: 2514667 - DNA, 23 bp, Homo sapiens
cagacaagcaacaggttttataa

SEQ ID NO: 2514668 - DNA, 23 bp, Homo sapiens
atgcagaggtaaaagtgtgagca

SEQ ID NO: 2514669 - DNA, 16 bp, Homo sapiens
atgcagagttgacatg

SEQ ID NO: 2514670 - DNA, 17 bp, Homo sapiens
atgcagcatctaagtaa

SEQ ID NO: 2514671 - DNA, 15 bp, Homo sapiens
atgcagcctcacagt

SEQ ID NO: 2514672 - DNA, 17 bp, Homo sapiens
atgcagcctcacagtcc

SEQ ID NO: 2514673 - DNA, 18 bp, Homo sapiens
atgcagggattgctgcca

SEQ ID NO: 2514674 - DNA, 19 bp, Homo sapiens
atgcagggattgctgccac

SEQ ID NO: 2514675 - DNA, 22 bp, Homo sapiens
atgcagggattgctgccacttt

SEQ ID NO: 2514676 - DNA, 18 bp, Homo sapiens
atgcagtgatatggcaga

SEQ ID NO: 2514677 - DNA, 19 bp, Homo sapiens
atgcagtgatatggcagaa

SEQ ID NO: 2514678 - DNA, 21 bp, Homo sapiens
atgcagtgatatggcagaaga

SEQ ID NO: 2514679 - DNA, 23 bp, Homo sapiens
atgcagtgatatggcagaagaca

SEQ ID NO: 2514680 - DNA, 13 bp, Homo sapiens
atgcagtgcttcc

SEQ ID NO: 2514681 - DNA, 17 bp, Homo sapiens
atgcagtttttcagagt

SEQ ID NO: 2514682 - DNA, 15 bp, Homo sapiens
atgcataaagtcagt

SEQ ID NO: 2514683 - DNA, 16 bp, Homo sapiens
atgcataaatatgcag

SEQ ID NO: 2514684 - DNA, 14 bp, Homo sapiens
atgcataaatgcat

SEQ ID NO: 2514685 - DNA, 14 bp, Homo sapiens
atgcatacacacac

SEQ ID NO: 2514686 - DNA, 23 bp, Homo sapiens
atgcatacacacacacacacagc

SEQ ID NO: 2514687 - DNA, 16 bp, Homo sapiens
atgcatacttcaaaag

SEQ ID NO: 2514688 - DNA, 20 bp, Homo sapiens
atgcatacttcaaaagtatt

SEQ ID NO: 2514689 - DNA, 22 bp, Homo sapiens
atgcatagttcccatgttaaat

SEQ ID NO: 2514690 - DNA, 17 bp, Homo sapiens
atgcatatcctgagcca

SEQ ID NO: 2514691 - DNA, 16 bp, Homo sapiens
atgcatattgtattac

SEQ ID NO: 2514692 - DNA, 14 bp, Homo sapiens
atgcatcttactga

SEQ ID NO: 2514693 - DNA, 20 bp, Homo sapiens
atgcatggaaacctgaaaaa

SEQ ID NO: 2514694 - DNA, 19 bp, Homo sapiens
atgcatggtgcagttgaca

SEQ ID NO: 2514695 - DNA, 23 bp, Homo sapiens
atgcatggtgcagttgacagcag

SEQ ID NO: 2514696 - DNA, 16 bp, Homo sapiens
atgcatgtcctgtaaa

SEQ ID NO: 2514697 - DNA, 17 bp, Homo sapiens
atgcatgtgaagaaagg

SEQ ID NO: 2514698 - DNA, 10 bp, Homo sapiens
atgcatttga

SEQ ID NO: 2514699 - DNA, 18 bp, Homo sapiens
atgccaaaaaaagacagg

SEQ ID NO: 2514700 - DNA, 15 bp, Homo sapiens
atgccacacagagtg

SEQ ID NO: 2514701 - DNA, 18 bp, Homo sapiens
atgccacacagagtggtc

SEQ ID NO: 2514702 - DNA, 19 bp, Homo sapiens
atgccaccctgttttcagc

SEQ ID NO: 2514703 - DNA, 18 bp, Homo sapiens
atgccaggttctatttgg

SEQ ID NO: 2514704 - DNA, 20 bp, Homo sapiens
atgccaggttctatttggaa

SEQ ID NO: 2514705 - DNA, 21 bp, Homo sapiens
atgccaggttctatttggaat

SEQ ID NO: 2514706 - DNA, 14 bp, Homo sapiens
atgccatcatctcc

SEQ ID NO: 2514707 - DNA, 15 bp, Homo sapiens
atgccatcatctcct

SEQ ID NO: 2514708 - DNA, 16 bp, Homo sapiens
atgccatcatctcctg

SEQ ID NO: 2514709 - DNA, 22 bp, Homo sapiens
atgcccagagggcccaggcagg

SEQ ID NO: 2514710 - DNA, 12 bp, Homo sapiens
atgcccagcccc

SEQ ID NO: 2514711 - DNA, 14 bp, Homo sapiens
atgcccagcccctt

SEQ ID NO: 2514712 - DNA, 16 bp, Homo sapiens
atgcccagccccttct

SEQ ID NO: 2514713 - DNA, 18 bp, Homo sapiens
atgcccagtttctgcctc

SEQ ID NO: 2514714 - DNA, 16 bp, Homo sapiens
atgcccccagctggcc

SEQ ID NO: 2514715 - DNA, 13 bp, Homo sapiens
atgcccccctcaa

SEQ ID NO: 2514716 - DNA, 21 bp, Homo sapiens
atgcccccctcaaacctcctc

SEQ ID NO: 2514717 - DNA, 19 bp, Homo sapiens
atgccccctttcagatgtc

SEQ ID NO: 2514718 - DNA, 15 bp, Homo sapiens
atgcctcaatgtgac

SEQ ID NO: 2514719 - DNA, 12 bp, Homo sapiens
atgcctgagggt

SEQ ID NO: 2514720 - DNA, 14 bp, Homo sapiens
atgcctgagggtgg

SEQ ID NO: 2514721 - DNA, 19 bp, Homo sapiens
atgcctgagtgcctggcca

SEQ ID NO: 2514722 - DNA, 21 bp, Homo sapiens
atgcctgattgccaagctcag

SEQ ID NO: 2514723 - DNA, 23 bp, Homo sapiens
atgcctggatggggctgcaccgg

SEQ ID NO: 2514724 - DNA, 14 bp, Homo sapiens
atgcctggtggcag

SEQ ID NO: 2514725 - DNA, 16 bp, Homo sapiens
atgcctgtccagcctg

SEQ ID NO: 2514726 - DNA, 19 bp, Homo sapiens
atgccttccagcaccctgc

SEQ ID NO: 2514727 - DNA, 16 bp, Homo sapiens
atgccttcccctgggc

SEQ ID NO: 2514728 - DNA, 15 bp, Homo sapiens
atgccttctccagac

SEQ ID NO: 2514729 - DNA, 14 bp, Homo sapiens
atgccttcttattg

SEQ ID NO: 2514730 - DNA, 20 bp, Homo sapiens
atgccttcttattgctttta

SEQ ID NO: 2514731 - DNA, 21 bp, Homo sapiens
atgcctttaaatctgtgatga

SEQ ID NO: 2514732 - DNA, 16 bp, Homo sapiens
atgcctttgagacagt

SEQ ID NO: 2514733 - DNA, 18 bp, Homo sapiens
atgcggcaagaaggaatt

SEQ ID NO: 2514734 - DNA, 14 bp, Homo sapiens
atgcggcccagccc

SEQ ID NO: 2514735 - DNA, 18 bp, Homo sapiens
atgcggcccagcccggct

SEQ ID NO: 2514736 - DNA, 22 bp, Homo sapiens
atgcgtgcataccacttttgtt

SEQ ID NO: 2514737 - DNA, 22 bp, Homo sapiens
atgctaaaccttagtactgagt

SEQ ID NO: 2514738 - DNA, 14 bp, Homo sapiens
atgctaaagaaaaa

SEQ ID NO: 2514739 - DNA, 23 bp, Homo sapiens
atgctaaagaaaaagtcatccaa

SEQ ID NO: 2514740 - DNA, 23 bp, Homo sapiens
atgctaaaggttgtattgcatat

SEQ ID NO: 2514741 - DNA, 17 bp, Homo sapiens
atgctacacactgcatg

SEQ ID NO: 2514742 - DNA, 18 bp, Homo sapiens
atgctacacactgcatgt

SEQ ID NO: 2514743 - DNA, 20 bp, Homo sapiens
atgctacgtgtgatttttct

SEQ ID NO: 2514744 - DNA, 14 bp, Homo sapiens
atgctactgtctca

SEQ ID NO: 2514745 - DNA, 20 bp, Homo sapiens
atgctactgtctcactgaaa

SEQ ID NO: 2514746 - DNA, 13 bp, Homo sapiens
atgctatctctgt

SEQ ID NO: 2514747 - DNA, 13 bp, Homo sapiens
atgctcagccctg

SEQ ID NO: 2514748 - DNA, 18 bp, Homo sapiens
atgctcagccctgactgg

SEQ ID NO: 2514749 - DNA, 13 bp, Homo sapiens
atgctccagtcaa

SEQ ID NO: 2514750 - DNA, 20 bp, Homo sapiens
atgctccctcccctgccctg

SEQ ID NO: 2514751 - DNA, 22 bp, Homo sapiens
atgctccctcccctgccctggt

SEQ ID NO: 2514752 - DNA, 19 bp, Homo sapiens
atgctcctggcccactgca

SEQ ID NO: 2514753 - DNA, 21 bp, Homo sapiens
atgctctatcttgctctgtaa

SEQ ID NO: 2514754 - DNA, 14 bp, Homo sapiens
atgctctcctttcc

SEQ ID NO: 2514755 - DNA, 23 bp, Homo sapiens
atgctctgtgcgagggttactat

SEQ ID NO: 2514756 - DNA, 15 bp, Homo sapiens
atgctcttctgtgga

SEQ ID NO: 2514757 - DNA, 17 bp, Homo sapiens
atgctgaaaaaacacct

SEQ ID NO: 2514758 - DNA, 19 bp, Homo sapiens
atgctgaagccaaagccaa

SEQ ID NO: 2514759 - DNA, 23 bp, Homo sapiens
atgctgaatatacagcaggtgct

SEQ ID NO: 2514760 - DNA, 12 bp, Homo sapiens
atgctgatgttc

SEQ ID NO: 2514761 - DNA, 15 bp, Homo sapiens
atgctgatgttcagt

SEQ ID NO: 2514762 - DNA, 16 bp, Homo sapiens
atgctgatgttcagtg

SEQ ID NO: 2514763 - DNA, 22 bp, Homo sapiens
atgctgatgttcagtgtaattt

SEQ ID NO: 2514764 - DNA, 20 bp, Homo sapiens
atgctgcagatttgggctgg

SEQ ID NO: 2514765 - DNA, 15 bp, Homo sapiens
atgctgcccatgcca

SEQ ID NO: 2514766 - DNA, 11 bp, Homo sapiens
atgctgccctg

SEQ ID NO: 2514767 - DNA, 12 bp, Homo sapiens
atgctgccctgt

SEQ ID NO: 2514768 - DNA, 15 bp, Homo sapiens
atgctgccctgtgag

SEQ ID NO: 2514769 - DNA, 15 bp, Homo sapiens
atgctgcctccagaa

SEQ ID NO: 2514770 - DNA, 13 bp, Homo sapiens
atgctgcctgagt

SEQ ID NO: 2514771 - DNA, 11 bp, Homo sapiens
atgctgcctgc

SEQ ID NO: 2514772 - DNA, 18 bp, Homo sapiens
atgctgcctgcctgtctg

SEQ ID NO: 2514773 - DNA, 23 bp, Homo sapiens
atgctgctttcccctgtggggat

SEQ ID NO: 2514774 - DNA, 14 bp, Homo sapiens
atgctggagaggtt

SEQ ID NO: 2514775 - DNA, 19 bp, Homo sapiens
atgctggatgctccttcca

SEQ ID NO: 2514776 - DNA, 17 bp, Homo sapiens
atgctggatgtctgcca

SEQ ID NO: 2514777 - DNA, 22 bp, Homo sapiens
atgctggatgtctgccaatttt

SEQ ID NO: 2514778 - DNA, 23 bp, Homo sapiens
atgctggcatttgcacctacctc

SEQ ID NO: 2514779 - DNA, 18 bp, Homo sapiens
atgctggctgttggctgg

SEQ ID NO: 2514780 - DNA, 20 bp, Homo sapiens
atgctggctgttggctgggg

SEQ ID NO: 2514781 - DNA, 12 bp, Homo sapiens
atgctgggctgg

SEQ ID NO: 2514782 - DNA, 21 bp, Homo sapiens
atgctggttttcctaaatgca

SEQ ID NO: 2514783 - DNA, 19 bp, Homo sapiens
atgctgtgccctaaagtgt

SEQ ID NO: 2514784 - DNA, 22 bp, Homo sapiens
atgctgtgccctaaagtgtatt

SEQ ID NO: 2514785 - DNA, 17 bp, Homo sapiens
atgctgtgctatgaatt

SEQ ID NO: 2514786 - DNA, 11 bp, Homo sapiens
atgctgttgat

SEQ ID NO: 2514787 - DNA, 18 bp, Homo sapiens
atgctgttgattgctaaa

SEQ ID NO: 2514788 - DNA, 22 bp, Homo sapiens
atgctgttgattgctaaatgta

SEQ ID NO: 2514789 - DNA, 14 bp, Homo sapiens
atgcttagtaatgc

SEQ ID NO: 2514790 - DNA, 23 bp, Homo sapiens
atgcttagtccctcatgcaaatc

SEQ ID NO: 2514791 - DNA, 15 bp, Homo sapiens
atgcttcctagaagt

SEQ ID NO: 2514792 - DNA, 17 bp, Homo sapiens
atgcttcctagaagtta

SEQ ID NO: 2514793 - DNA, 23 bp, Homo sapiens
atgcttcctagaagttactgaat

SEQ ID NO: 2514794 - DNA, 15 bp, Homo sapiens
atgcttcctgacaat

SEQ ID NO: 2514795 - DNA, 13 bp, Homo sapiens
atgcttctcactg

SEQ ID NO: 2514796 - DNA, 15 bp, Homo sapiens
atgcttcttctcagg

SEQ ID NO: 2514797 - DNA, 11 bp, Homo sapiens
atgcttgccta

SEQ ID NO: 2514798 - DNA, 15 bp, Homo sapiens
atgcttgtacataat

SEQ ID NO: 2514799 - DNA, 16 bp, Homo sapiens
atgcttgtacataatg

SEQ ID NO: 2514800 - DNA, 15 bp, Homo sapiens
atgctttgtgaacaa

SEQ ID NO: 2514801 - DNA, 17 bp, Homo sapiens
atgcttttaaaaatcta

SEQ ID NO: 2514802 - DNA, 20 bp, Homo sapiens
atgcttttctgtctctgcct

SEQ ID NO: 2514803 - DNA, 12 bp, Homo sapiens
atggaaaaggaa

SEQ ID NO: 2514804 - DNA, 23 bp, Homo sapiens
atggaaacctgaaaaaaagttta

SEQ ID NO: 2514805 - DNA, 13 bp, Homo sapiens
atggaaactgaat

SEQ ID NO: 2514806 - DNA, 16 bp, Homo sapiens
atggaaactgaatgct

SEQ ID NO: 2514807 - DNA, 18 bp, Homo sapiens
atggaaccgcaggaagct

SEQ ID NO: 2514808 - DNA, 13 bp, Homo sapiens
atggaacctcctt

SEQ ID NO: 2514809 - DNA, 21 bp, Homo sapiens
atggaacctcctttctcttct

SEQ ID NO: 2514810 - DNA, 18 bp, Homo sapiens
atggaacttctaatatat

SEQ ID NO: 2514811 - DNA, 16 bp, Homo sapiens
atggaagattttaaat

SEQ ID NO: 2514812 - DNA, 15 bp, Homo sapiens
atggaagcttccagt

SEQ ID NO: 2514813 - DNA, 18 bp, Homo sapiens
attttgctttgtgatttt

SEQ ID NO: 2514814 - DNA, 16 bp, Homo sapiens
attttggttgtattct

SEQ ID NO: 2514815 - DNA, 17 bp, Homo sapiens
attttggttgtattctt

SEQ ID NO: 2514816 - DNA, 20 bp, Homo sapiens
attttggttgtattctttga

SEQ ID NO: 2514817 - DNA, 20 bp, Homo sapiens
attttgtacaaatttgttat

SEQ ID NO: 2514818 - DNA, 20 bp, Homo sapiens
attttgtataattgtatcgt

SEQ ID NO: 2514819 - DNA, 14 bp, Homo sapiens
attttgtatatatc

SEQ ID NO: 2514820 - DNA, 22 bp, Homo sapiens
attttgtattttccaagtgtgc

SEQ ID NO: 2514821 - DNA, 12 bp, Homo sapiens
attttgtgaatg

SEQ ID NO: 2514822 - DNA, 13 bp, Homo sapiens
attttgtgaatgg

SEQ ID NO: 2514823 - DNA, 16 bp, Homo sapiens
atttttaaaacccatt

SEQ ID NO: 2514824 - DNA, 17 bp, Homo sapiens
atttttaaagtatatat

SEQ ID NO: 2514825 - DNA, 18 bp, Homo sapiens
atttttaagataataata

SEQ ID NO: 2514826 - DNA, 21 bp, Homo sapiens
atttttaagcaaaatattatt

SEQ ID NO: 2514827 - DNA, 19 bp, Homo sapiens
atttttaagtgctgcattt

SEQ ID NO: 2514828 - DNA, 18 bp, Homo sapiens
atttttaatatatactat

SEQ ID NO: 2514829 - DNA, 19 bp, Homo sapiens
atttttaatatatactatg

SEQ ID NO: 2514830 - DNA, 17 bp, Homo sapiens
atttttaatcatgaaat

SEQ ID NO: 2514831 - DNA, 14 bp, Homo sapiens
atttttacaataaa

SEQ ID NO: 2514832 - DNA, 19 bp, Homo sapiens
atttttacaataaataatc

SEQ ID NO: 2514833 - DNA, 17 bp, Homo sapiens
atttttacattctgaat

SEQ ID NO: 2514834 - DNA, 19 bp, Homo sapiens
atttttaccgtttcttccc

SEQ ID NO: 2514835 - DNA, 14 bp, Homo sapiens
atttttagacagag

SEQ ID NO: 2514836 - DNA, 20 bp, Homo sapiens
atttttatatcagcctgagt

SEQ ID NO: 2514837 - DNA, 19 bp, Homo sapiens
atttttatctttcgtgata

SEQ ID NO: 2514838 - DNA, 14 bp, Homo sapiens
atttttatggaatt

SEQ ID NO: 2514839 - DNA, 14 bp, Homo sapiens
atttttatttatat

SEQ ID NO: 2514840 - DNA, 15 bp, Homo sapiens
atttttcagatgctt

SEQ ID NO: 2514841 - DNA, 18 bp, Homo sapiens
atttttcagatgcttctg

SEQ ID NO: 2514842 - DNA, 12 bp, Homo sapiens
atttttctcatg

SEQ ID NO: 2514843 - DNA, 21 bp, Homo sapiens
atttttctggaggttgataac

SEQ ID NO: 2514844 - DNA, 21 bp, Homo sapiens
atttttcttagggaaggatac

SEQ ID NO: 2514845 - DNA, 20 bp, Homo sapiens
atttttcttatttcatttct

SEQ ID NO: 2514846 - DNA, 17 bp, Homo sapiens
atttttgaatgtagtaa

SEQ ID NO: 2514847 - DNA, 14 bp, Homo sapiens
atttttgcaggagc

SEQ ID NO: 2514848 - DNA, 18 bp, Homo sapiens
atttttggtcattgtaat

SEQ ID NO: 2514849 - DNA, 15 bp, Homo sapiens
atttttggttgaata

SEQ ID NO: 2514850 - DNA, 14 bp, Homo sapiens
attttttaaatgca

SEQ ID NO: 2514851 - DNA, 11 bp, Homo sapiens
attttttaagt

SEQ ID NO: 2514852 - DNA, 20 bp, Homo sapiens
attttttaagtatttatata

SEQ ID NO: 2514853 - DNA, 22 bp, Homo sapiens
attttttaagtatttatatatt

SEQ ID NO: 2514854 - DNA, 20 bp, Homo sapiens
attttttaattattatttat

SEQ ID NO: 2514855 - DNA, 13 bp, Homo sapiens
attttttatatat

SEQ ID NO: 2514856 - DNA, 21 bp, Homo sapiens
attttttatcatgcatgtcct

SEQ ID NO: 2514857 - DNA, 13 bp, Homo sapiens
attttttattgtt

SEQ ID NO: 2514858 - DNA, 13 bp, Homo sapiens
attttttcagaaa

SEQ ID NO: 2514859 - DNA, 12 bp, Homo sapiens
attttttcagac

SEQ ID NO: 2514860 - DNA, 12 bp, Homo sapiens
atttttttaagc

SEQ ID NO: 2514861 - DNA, 18 bp, Homo sapiens
atttttttaatttacaaa

SEQ ID NO: 2514862 - DNA, 14 bp, Homo sapiens
atttttttcacctc

SEQ ID NO: 2514863 - DNA, 20 bp, Homo sapiens
atttttttctaccttgaggt

SEQ ID NO: 2514864 - DNA, 16 bp, Homo sapiens
atttttttctgattgt

SEQ ID NO: 2514865 - DNA, 19 bp, Homo sapiens
attttttttctgttatata

SEQ ID NO: 2514866 - DNA, 20 bp, Homo sapiens
attttttttctgttatataa

SEQ ID NO: 2514867 - DNA, 16 bp, Homo sapiens
atttttttttcataca

SEQ ID NO: 2514868 - DNA, 19 bp, Homo sapiens
caaaaaaaaaaaaatgcac

SEQ ID NO: 2514869 - DNA, 14 bp, Homo sapiens
caaaaaaattaaat

SEQ ID NO: 2514870 - DNA, 15 bp, Homo sapiens
caaaaaactgcagtg

SEQ ID NO: 2514871 - DNA, 17 bp, Homo sapiens
caaaaacacagcaaggg

SEQ ID NO: 2514872 - DNA, 22 bp, Homo sapiens
caaaaacacagtgtttttgtaa

SEQ ID NO: 2514873 - DNA, 23 bp, Homo sapiens
caaaaactttggagtcccctcac

SEQ ID NO: 2514874 - DNA, 13 bp, Homo sapiens
caaaaagaccaga

SEQ ID NO: 2514875 - DNA, 15 bp, Homo sapiens
caaaaagaccagact

SEQ ID NO: 2514876 - DNA, 11 bp, Homo sapiens
caaaaagtgtt

SEQ ID NO: 2514877 - DNA, 12 bp, Homo sapiens
caaaaagtgttt

SEQ ID NO: 2514878 - DNA, 12 bp, Homo sapiens
caaaaataaata

SEQ ID NO: 2514879 - DNA, 15 bp, Homo sapiens
caaaaattagccggg

SEQ ID NO: 2514880 - DNA, 17 bp, Homo sapiens
caaaaattagccgggcg

SEQ ID NO: 2514881 - DNA, 20 bp, Homo sapiens
caaaaattagccgggcgtgg

SEQ ID NO: 2514882 - DNA, 19 bp, Homo sapiens
caaaaatttgcttcactca

SEQ ID NO: 2514883 - DNA, 20 bp, Homo sapiens
caaaacaagtttttctgtca

SEQ ID NO: 2514884 - DNA, 13 bp, Homo sapiens
caaaacccacctt

SEQ ID NO: 2514885 - DNA, 18 bp, Homo sapiens
caaaacctgatgttaaaa

SEQ ID NO: 2514886 - DNA, 16 bp, Homo sapiens
caaaactctcctctgc

SEQ ID NO: 2514887 - DNA, 14 bp, Homo sapiens
caaaactgtgcaga

SEQ ID NO: 2514888 - DNA, 13 bp, Homo sapiens
caaaacttaacat

SEQ ID NO: 2514889 - DNA, 19 bp, Homo sapiens
caaaagaacaagaatttct

SEQ ID NO: 2514890 - DNA, 15 bp, Homo sapiens
caaaagaatcagaaa

SEQ ID NO: 2514891 - DNA, 23 bp, Homo sapiens
caaaagacaattctttatacaac

SEQ ID NO: 2514892 - DNA, 19 bp, Homo sapiens
caaaagatgctcttctgtg

SEQ ID NO: 2514893 - DNA, 22 bp, Homo sapiens
caaaagattgctgaaattttat

SEQ ID NO: 2514894 - DNA, 15 bp, Homo sapiens
caaaagcaaatgaga

SEQ ID NO: 2514895 - DNA, 14 bp, Homo sapiens
caaaagcaagactg

SEQ ID NO: 2514896 - DNA, 19 bp, Homo sapiens
caaaagcccattcattcca

SEQ ID NO: 2514897 - DNA, 22 bp, Homo sapiens
caaaagcccattcattccattc

SEQ ID NO: 2514898 - DNA, 12 bp, Homo sapiens
caaaagctgctc

SEQ ID NO: 2514899 - DNA, 20 bp, Homo sapiens
caaaagggtgtctgagccct

SEQ ID NO: 2514900 - DNA, 14 bp, Homo sapiens
caacaccacagaca

SEQ ID NO: 2514901 - DNA, 15 bp, Homo sapiens
caacaccacagacac

SEQ ID NO: 2514902 - DNA, 16 bp, Homo sapiens
caacacccatctgttt

SEQ ID NO: 2514903 - DNA, 22 bp, Homo sapiens
caacactcacatttattctgct

SEQ ID NO: 2514904 - DNA, 18 bp, Homo sapiens
caacactggtgtgacctg

SEQ ID NO: 2514905 - DNA, 23 bp, Homo sapiens
caacactggtgtgacctgagggc

SEQ ID NO: 2514906 - DNA, 16 bp, Homo sapiens
caacactgtgccctgg

SEQ ID NO: 2514907 - DNA, 22 bp, Homo sapiens
caacactgtgccctggtggaga

SEQ ID NO: 2514908 - DNA, 15 bp, Homo sapiens
caacagaagcttcca

SEQ ID NO: 2514909 - DNA, 20 bp, Homo sapiens
caacagaagtcatgaagccc

SEQ ID NO: 2514910 - DNA, 17 bp, Homo sapiens
caacagatactggaagt

SEQ ID NO: 2514911 - DNA, 17 bp, Homo sapiens
caacagatcaatttgta

SEQ ID NO: 2514912 - DNA, 15 bp, Homo sapiens
caacagatgcttttc

SEQ ID NO: 2514913 - DNA, 19 bp, Homo sapiens
caacagatttgtgaactca

SEQ ID NO: 2514914 - DNA, 15 bp, Homo sapiens
caacagctcaagtct

SEQ ID NO: 2514915 - DNA, 22 bp, Homo sapiens
caacagctcaagtcttccctga

SEQ ID NO: 2514916 - DNA, 15 bp, Homo sapiens
caacaggagctggga

SEQ ID NO: 2514917 - DNA, 11 bp, Homo sapiens
caacagtgagt

SEQ ID NO: 2514918 - DNA, 13 bp, Homo sapiens
caacagtgctaaa

SEQ ID NO: 2514919 - DNA, 14 bp, Homo sapiens
caacagtgctaaaa

SEQ ID NO: 2514920 - DNA, 21 bp, Homo sapiens
caacagtgtgaagttagaatt

SEQ ID NO: 2514921 - DNA, 15 bp, Homo sapiens
caacatactcccatc

SEQ ID NO: 2514922 - DNA, 20 bp, Homo sapiens
caacatactcccatctgtga

SEQ ID NO: 2514923 - DNA, 15 bp, Homo sapiens
caacatcaatgttca

SEQ ID NO: 2514924 - DNA, 17 bp, Homo sapiens
caacatcaatgttcatt

SEQ ID NO: 2514925 - DNA, 13 bp, Homo sapiens
caacatctagcaa

SEQ ID NO: 2514926 - DNA, 23 bp, Homo sapiens
caacatgcctgccccaaacaaat

SEQ ID NO: 2514927 - DNA, 13 bp, Homo sapiens
caacatgtataat

SEQ ID NO: 2514928 - DNA, 19 bp, Homo sapiens
caacatgtataatattttt

SEQ ID NO: 2514929 - DNA, 17 bp, Homo sapiens
caacatgttactgacca

SEQ ID NO: 2514930 - DNA, 22 bp, Homo sapiens
caacattgctggctggaaggga

SEQ ID NO: 2514931 - DNA, 17 bp, Homo sapiens
caacattgcttgtgcca

SEQ ID NO: 2514932 - DNA, 16 bp, Homo sapiens
caacatttctcaataa

SEQ ID NO: 2514933 - DNA, 20 bp, Homo sapiens
caaccaccgctccccagccc

SEQ ID NO: 2514934 - DNA, 22 bp, Homo sapiens
caaccaccgctccccagcccag

SEQ ID NO: 2514935 - DNA, 16 bp, Homo sapiens
caaccacctttcagat

SEQ ID NO: 2514936 - DNA, 14 bp, Homo sapiens
caaccactgtaaaa

SEQ ID NO: 2514937 - DNA, 17 bp, Homo sapiens
caaccactgtaaaatga

SEQ ID NO: 2514938 - DNA, 19 bp, Homo sapiens
caaccactgtaaaatgaaa

SEQ ID NO: 2514939 - DNA, 21 bp, Homo sapiens
caaccactgtaaaatgaaatt

SEQ ID NO: 2514940 - DNA, 14 bp, Homo sapiens
caaccattccagac

SEQ ID NO: 2514941 - DNA, 15 bp, Homo sapiens
caacccattagccat

SEQ ID NO: 2514942 - DNA, 15 bp, Homo sapiens
caaccccaactccag

SEQ ID NO: 2514943 - DNA, 21 bp, Homo sapiens
caagctccatctccactccag

SEQ ID NO: 2514944 - DNA, 18 bp, Homo sapiens
caagctcccaagggatgg

SEQ ID NO: 2514945 - DNA, 22 bp, Homo sapiens
caagctcccaagggatggtgcc

SEQ ID NO: 2514946 - DNA, 14 bp, Homo sapiens
caagctcccaggcc

SEQ ID NO: 2514947 - DNA, 15 bp, Homo sapiens
caagctctgctcctc

SEQ ID NO: 2514948 - DNA, 16 bp, Homo sapiens
caagctctgctcctct

SEQ ID NO: 2514949 - DNA, 14 bp, Homo sapiens
caagctgcaccctc

SEQ ID NO: 2514950 - DNA, 17 bp, Homo sapiens
caagctgggccccagcc

SEQ ID NO: 2514951 - DNA, 18 bp, Homo sapiens
caagctgggccccagccc

SEQ ID NO: 2514952 - DNA, 22 bp, Homo sapiens
caagctgggccccagcccaccc

SEQ ID NO: 2514953 - DNA, 22 bp, Homo sapiens
caagctggtcccactcagtcca

SEQ ID NO: 2514954 - DNA, 23 bp, Homo sapiens
caagctgtgagacagtgggaaat

SEQ ID NO: 2514955 - DNA, 14 bp, Homo sapiens
caagctgttttctt

SEQ ID NO: 2514956 - DNA, 14 bp, Homo sapiens
caagcttggcagcc

SEQ ID NO: 2514957 - DNA, 16 bp, Homo sapiens
caagcttggcagccga

SEQ ID NO: 2514958 - DNA, 17 bp, Homo sapiens
caaggaaaccacagctg

SEQ ID NO: 2514959 - DNA, 18 bp, Homo sapiens
caaggaaaccacagctgc

SEQ ID NO: 2514960 - DNA, 20 bp, Homo sapiens
caaggaaaccacagctgctg

SEQ ID NO: 2514961 - DNA, 17 bp, Homo sapiens
caaggaaagccccagca

SEQ ID NO: 2514962 - DNA, 16 bp, Homo sapiens
caaggaaggaaagaaa

SEQ ID NO: 2514963 - DNA, 15 bp, Homo sapiens
caaggaccaggactc

SEQ ID NO: 2514964 - DNA, 18 bp, Homo sapiens
caaggaccaggactccct

SEQ ID NO: 2514965 - DNA, 21 bp, Homo sapiens
caaggaccaggactccctcct

SEQ ID NO: 2514966 - DNA, 13 bp, Homo sapiens
caaggacccctca

SEQ ID NO: 2514967 - DNA, 14 bp, Homo sapiens
caaggacccctcac

SEQ ID NO: 2514968 - DNA, 15 bp, Homo sapiens
caaggactgagggac

SEQ ID NO: 2514969 - DNA, 22 bp, Homo sapiens
caaggactgagggactctgaag

SEQ ID NO: 2514970 - DNA, 22 bp, Homo sapiens
caaggactgcagggactgccag

SEQ ID NO: 2514971 - DNA, 16 bp, Homo sapiens
caaggacttgaaagca

SEQ ID NO: 2514972 - DNA, 20 bp, Homo sapiens
caaggagaaacagagacagg

SEQ ID NO: 2514973 - DNA, 20 bp, Homo sapiens
caaggagacacaacaactcc

SEQ ID NO: 2514974 - DNA, 18 bp, Homo sapiens
caaggagaggaggcaact

SEQ ID NO: 2514975 - DNA, 12 bp, Homo sapiens
caaggagggaga

SEQ ID NO: 2514976 - DNA, 21 bp, Homo sapiens
caaggagttccatgaagacca

SEQ ID NO: 2514977 - DNA, 14 bp, Homo sapiens
caaggcaaggcagg

SEQ ID NO: 2514978 - DNA, 16 bp, Homo sapiens
caaggcaaggcaggtg

SEQ ID NO: 2514979 - DNA, 18 bp, Homo sapiens
caaggcaaggcaggtgcc

SEQ ID NO: 2514980 - DNA, 15 bp, Homo sapiens
caaggcaggtgcctc

SEQ ID NO: 2514981 - DNA, 22 bp, Homo sapiens
caaggcaggtgcctccaggtgt

SEQ ID NO: 2514982 - DNA, 15 bp, Homo sapiens
caaggcctttctgtg

SEQ ID NO: 2514983 - DNA, 13 bp, Homo sapiens
caaggcggcccct

SEQ ID NO: 2514984 - DNA, 19 bp, Homo sapiens
caaggcgtccgcgcgccag

SEQ ID NO: 2514985 - DNA, 16 bp, Homo sapiens
caaggcgtgaggatgg

SEQ ID NO: 2514986 - DNA, 19 bp, Homo sapiens
caaggctgaccaagagaga

SEQ ID NO: 2514987 - DNA, 12 bp, Homo sapiens
caaggctgcagt

SEQ ID NO: 2514988 - DNA, 17 bp, Homo sapiens
caaggctgtgctccctg

SEQ ID NO: 2514989 - DNA, 18 bp, Homo sapiens
caaggctgtgctccctgg

SEQ ID NO: 2514990 - DNA, 17 bp, Homo sapiens
caagggagagacctcat

SEQ ID NO: 2514991 - DNA, 20 bp, Homo sapiens
caagggagagacctcatcag

SEQ ID NO: 2514992 - DNA, 13 bp, Homo sapiens
caagggatggtgc

SEQ ID NO: 2514993 - DNA, 17 bp, Homo sapiens
caagggcaaaattccca

SEQ ID NO: 2514994 - DNA, 19 bp, Homo sapiens
caagggcaaaattcccagg

SEQ ID NO: 2514995 - DNA, 13 bp, Homo sapiens
caagggcctggcc

SEQ ID NO: 2514996 - DNA, 14 bp, Homo sapiens
caagggcctggcct

SEQ ID NO: 2514997 - DNA, 14 bp, Homo sapiens
caagggctccccac

SEQ ID NO: 2514998 - DNA, 18 bp, Homo sapiens
caagggcttctgcaccct

SEQ ID NO: 2514999 - DNA, 17 bp, Homo sapiens
caaggggcccaaattct

SEQ ID NO: 2515000 - DNA, 18 bp, Homo sapiens
caaggggcccaaattctt

SEQ ID NO: 2515001 - DNA, 21 bp, Homo sapiens
caagggggatgacatgtgact

SEQ ID NO: 2515002 - DNA, 23 bp, Homo sapiens
caagggtgatgggaaagcattgt

SEQ ID NO: 2515003 - DNA, 20 bp, Homo sapiens
caagggttcagagactcagg

SEQ ID NO: 2515004 - DNA, 16 bp, Homo sapiens
caaggtcttcagccat

SEQ ID NO: 2515005 - DNA, 19 bp, Homo sapiens
caaggtgggctgagccctg

SEQ ID NO: 2515006 - DNA, 20 bp, Homo sapiens
caaggtgggctgagccctgg

SEQ ID NO: 2515007 - DNA, 18 bp, Homo sapiens
caaggttccctctgagaa

SEQ ID NO: 2515008 - DNA, 19 bp, Homo sapiens
caaggttccctctgagaat

SEQ ID NO: 2515009 - DNA, 22 bp, Homo sapiens
caaggtttaaacttctctgaag

SEQ ID NO: 2515010 - DNA, 18 bp, Homo sapiens
caagtaagaagacatgaa

SEQ ID NO: 2515011 - DNA, 22 bp, Homo sapiens
caagtaagaagacatgaaccaa

SEQ ID NO: 2515012 - DNA, 16 bp, Homo sapiens
caagtaattctgctgt

SEQ ID NO: 2515013 - DNA, 22 bp, Homo sapiens
caagtatgtgggcagattttca

SEQ ID NO: 2515014 - DNA, 17 bp, Homo sapiens
caagtatgttttagcat

SEQ ID NO: 2515015 - DNA, 19 bp, Homo sapiens
caagtcagaggatggccag

SEQ ID NO: 2515016 - DNA, 21 bp, Homo sapiens
caagtcagaggatggccagtg

SEQ ID NO: 2515017 - DNA, 13 bp, Homo sapiens
caagtcatggctg

SEQ ID NO: 2515018 - DNA, 14 bp, Homo sapiens
caagtcatggctgt

SEQ ID NO: 2515019 - DNA, 17 bp, Homo sapiens
caagtcatgtgcatttc

SEQ ID NO: 2515020 - DNA, 22 bp, Homo sapiens
caagtccagatttacactggga

SEQ ID NO: 2515021 - DNA, 20 bp, Homo sapiens
caagtcctgaagaggcgggc

SEQ ID NO: 2515022 - DNA, 15 bp, Homo sapiens
caagtccttacctct

SEQ ID NO: 2515023 - DNA, 17 bp, Homo sapiens
caagtcgatgaactatt

SEQ ID NO: 2515024 - DNA, 14 bp, Homo sapiens
caagtctccttccc

SEQ ID NO: 2515025 - DNA, 23 bp, Homo sapiens
caagtctctgctggcccagccaa

SEQ ID NO: 2515026 - DNA, 14 bp, Homo sapiens
caagtcttccctga

SEQ ID NO: 2515027 - DNA, 15 bp, Homo sapiens
caagtcttccctgat

SEQ ID NO: 2515028 - DNA, 23 bp, Homo sapiens
caagtgaaaaaggaggaagagaa

SEQ ID NO: 2515029 - DNA, 16 bp, Homo sapiens
caagtgacatctcttt

SEQ ID NO: 2515030 - DNA, 15 bp, Homo sapiens
caagtgagaccctgt

SEQ ID NO: 2515031 - DNA, 17 bp, Homo sapiens
caagtgagagctgggtg

SEQ ID NO: 2515032 - DNA, 18 bp, Homo sapiens
caagtgagagctgggtgt

SEQ ID NO: 2515033 - DNA, 20 bp, Homo sapiens
caagtgattctcctgcctca

SEQ ID NO: 2515034 - DNA, 21 bp, Homo sapiens
caagtgattctcctgcctcag

SEQ ID NO: 2515035 - DNA, 18 bp, Homo sapiens
caagtgattgggacagag

SEQ ID NO: 2515036 - DNA, 13 bp, Homo sapiens
caagtgcaggctg

SEQ ID NO: 2515037 - DNA, 15 bp, Homo sapiens
caagtgccagaggtg

SEQ ID NO: 2515038 - DNA, 19 bp, Homo sapiens
caagtgccagaggtgggca

SEQ ID NO: 2515039 - DNA, 19 bp, Homo sapiens
caagtggctcccacaccct

SEQ ID NO: 2515040 - DNA, 22 bp, Homo sapiens
caagtgtatgcacgtgtgcaca

SEQ ID NO: 2515041 - DNA, 17 bp, Homo sapiens
caagtgtgcatattgta

SEQ ID NO: 2515042 - DNA, 21 bp, Homo sapiens
caagtgtgcatattgtacact

SEQ ID NO: 2515043 - DNA, 22 bp, Homo sapiens
caagtgtggtagggacttaaaa

SEQ ID NO: 2515044 - DNA, 23 bp, Homo sapiens
caagtgtgtatgtgcgtgtgtgc

SEQ ID NO: 2515045 - DNA, 21 bp, Homo sapiens
caagtgtgtgcacatgtgtgc

SEQ ID NO: 2515046 - DNA, 17 bp, Homo sapiens
caagtgtgtgcatgtgt

SEQ ID NO: 2515047 - DNA, 17 bp, Homo sapiens
caagtgtgtgtgcgtgt

SEQ ID NO: 2515048 - DNA, 20 bp, Homo sapiens
caagtttactcaaccctctc

SEQ ID NO: 2515049 - DNA, 22 bp, Homo sapiens
caagtttctagctagaaatatg

SEQ ID NO: 2515050 - DNA, 23 bp, Homo sapiens
caagtttctagctagaaatatga

SEQ ID NO: 2515051 - DNA, 14 bp, Homo sapiens
caataaaaatcata

SEQ ID NO: 2515052 - DNA, 20 bp, Homo sapiens
caataaaagcaattccaacc

SEQ ID NO: 2515053 - DNA, 14 bp, Homo sapiens
caataaaatcatgt

SEQ ID NO: 2515054 - DNA, 20 bp, Homo sapiens
caataaaatgtgatttttct

SEQ ID NO: 2515055 - DNA, 21 bp, Homo sapiens
caataaaatgtgatttttctg

SEQ ID NO: 2515056 - DNA, 22 bp, Homo sapiens
caataaaattttttttcatgtt

SEQ ID NO: 2515057 - DNA, 12 bp, Homo sapiens
caataaacgatt

SEQ ID NO: 2515058 - DNA, 12 bp, Homo sapiens
caataaagtatc

SEQ ID NO: 2515059 - DNA, 12 bp, Homo sapiens
caataaatgaat

SEQ ID NO: 2515060 - DNA, 16 bp, Homo sapiens
caataaatgtctgttg

SEQ ID NO: 2515061 - DNA, 17 bp, Homo sapiens
caataactactgtgttc

SEQ ID NO: 2515062 - DNA, 15 bp, Homo sapiens
caatatgtaaatagt

SEQ ID NO: 2515063 - DNA, 15 bp, Homo sapiens
caatatgtattgtaa

SEQ ID NO: 2515064 - DNA, 21 bp, Homo sapiens
caatattaaatacagacacta

SEQ ID NO: 2515065 - DNA, 22 bp, Homo sapiens
caatattaaatacagacactaa

SEQ ID NO: 2515066 - DNA, 13 bp, Homo sapiens
caatattataatt

SEQ ID NO: 2515067 - DNA, 19 bp, Homo sapiens
caatattatactaagaaaa

SEQ ID NO: 2515068 - DNA, 23 bp, Homo sapiens
caatattatactaagaaaagata

SEQ ID NO: 2515069 - DNA, 15 bp, Homo sapiens
caatattcaaatgcg

SEQ ID NO: 2515070 - DNA, 21 bp, Homo sapiens
caatattcctgaatgaaatat

SEQ ID NO: 2515071 - DNA, 15 bp, Homo sapiens
caatattgtacagtt

SEQ ID NO: 2515072 - DNA, 16 bp, Homo sapiens
caatattgtcattcct

SEQ ID NO: 2515073 - DNA, 12 bp, Homo sapiens
caatatttatta

SEQ ID NO: 2515074 - DNA, 14 bp, Homo sapiens
caatatttattatt

SEQ ID NO: 2515075 - DNA, 19 bp, Homo sapiens
caatatttattattttcac

SEQ ID NO: 2515076 - DNA, 17 bp, Homo sapiens
caatatttcctcatgtg

SEQ ID NO: 2515077 - DNA, 19 bp, Homo sapiens
caatatttcctcatgtgat

SEQ ID NO: 2515078 - DNA, 14 bp, Homo sapiens
caatatttgtagaa

SEQ ID NO: 2515079 - DNA, 15 bp, Homo sapiens
caatatttgtagaag

SEQ ID NO: 2515080 - DNA, 13 bp, Homo sapiens
caatattttccat

SEQ ID NO: 2515081 - DNA, 17 bp, Homo sapiens
caatcaaagcacttgga

SEQ ID NO: 2515082 - DNA, 14 bp, Homo sapiens
caatcaaatctgct

SEQ ID NO: 2515083 - DNA, 15 bp, Homo sapiens
caatcaactctaata

SEQ ID NO: 2515084 - DNA, 16 bp, Homo sapiens
caatcagctccttcct

SEQ ID NO: 2515085 - DNA, 15 bp, Homo sapiens
caatcagtcccctcc

SEQ ID NO: 2515086 - DNA, 15 bp, Homo sapiens
caatcattgctgaaa

SEQ ID NO: 2515087 - DNA, 17 bp, Homo sapiens
caatcattttaattatt

SEQ ID NO: 2515088 - DNA, 22 bp, Homo sapiens
caatccatgttagtttttactt

SEQ ID NO: 2515089 - DNA, 12 bp, Homo sapiens
caatcccagcta

SEQ ID NO: 2515090 - DNA, 22 bp, Homo sapiens
caatcctaacacattatcggga

SEQ ID NO: 2515091 - DNA, 13 bp, Homo sapiens
caatcctgccccc

SEQ ID NO: 2515092 - DNA, 18 bp, Homo sapiens
caatcctgtgggtgaaga

SEQ ID NO: 2515093 - DNA, 22 bp, Homo sapiens
caatctattaatagctgcctta

SEQ ID NO: 2515094 - DNA, 17 bp, Homo sapiens
caatctgacattctcag

SEQ ID NO: 2515095 - DNA, 15 bp, Homo sapiens
caatctgtaaactgt

SEQ ID NO: 2515096 - DNA, 17 bp, Homo sapiens
caatctgtaaactgtgt

SEQ ID NO: 2515097 - DNA, 23 bp, Homo sapiens
caatgaaatacacaagtaaacat

SEQ ID NO: 2515098 - DNA, 11 bp, Homo sapiens
caatgaaatga

SEQ ID NO: 2515099 - DNA, 19 bp, Homo sapiens
caatgaaatgaattaaagt

SEQ ID NO: 2515100 - DNA, 19 bp, Homo sapiens
caatgaaatgctctccttt

SEQ ID NO: 2515101 - DNA, 13 bp, Homo sapiens
caatgaaccccca

SEQ ID NO: 2515102 - DNA, 19 bp, Homo sapiens
caatgacatcttcaaagct

SEQ ID NO: 2515103 - DNA, 17 bp, Homo sapiens
caatgacttactgtaca

SEQ ID NO: 2515104 - DNA, 16 bp, Homo sapiens
caatgatctaggttta

SEQ ID NO: 2515105 - DNA, 17 bp, Homo sapiens
caatgatctaggtttaa

SEQ ID NO: 2515106 - DNA, 21 bp, Homo sapiens
caatgatctaggtttaactca

SEQ ID NO: 2515107 - DNA, 23 bp, Homo sapiens
caatgatctaggtttaactcaga

SEQ ID NO: 2515108 - DNA, 24 bp, Homo sapiens
caatgatggcaattttgtaacgaa

SEQ ID NO: 2515109 - DNA, 14 bp, Homo sapiens
caatgatgtccaga

SEQ ID NO: 2515110 - DNA, 15 bp, Homo sapiens
caatgattgttaatt

SEQ ID NO: 2515111 - DNA, 22 bp, Homo sapiens
caatgattgttaatttacagct

SEQ ID NO: 2515112 - DNA, 22 bp, Homo sapiens
caatgcacacaaaacaacccta

SEQ ID NO: 2515113 - DNA, 17 bp, Homo sapiens
caatgcactttgttctg

SEQ ID NO: 2515114 - DNA, 20 bp, Homo sapiens
caatgcactttgttctggct

SEQ ID NO: 2515115 - DNA, 13 bp, Homo sapiens
caatgccatcatc

SEQ ID NO: 2515116 - DNA, 18 bp, Homo sapiens
caatgccatcctcaaaca

SEQ ID NO: 2515117 - DNA, 20 bp, Homo sapiens
caatgcccgtaatgcttaga

SEQ ID NO: 2515118 - DNA, 23 bp, Homo sapiens
caatgctggctgttggctggggg

SEQ ID NO: 2515119 - DNA, 22 bp, Homo sapiens
caatgctgtgccctaaagtgta

SEQ ID NO: 2515120 - DNA, 15 bp, Homo sapiens
caatggaaactgaat

SEQ ID NO: 2515121 - DNA, 17 bp, Homo sapiens
caatggaacctcctttc

SEQ ID NO: 2515122 - DNA, 19 bp, Homo sapiens
caatggcgcagtgcctctg

SEQ ID NO: 2515123 - DNA, 21 bp, Homo sapiens
caatggcgcagtgcctctggt

SEQ ID NO: 2515124 - DNA, 23 bp, Homo sapiens
caatggctaattcccagagtgtg

SEQ ID NO: 2515125 - DNA, 22 bp, Homo sapiens
caatggctatatggcaagaaag

SEQ ID NO: 2515126 - DNA, 19 bp, Homo sapiens
caatgggcactgggatgag

SEQ ID NO: 2515127 - DNA, 17 bp, Homo sapiens
caatggtgttgccctga

SEQ ID NO: 2515128 - DNA, 11 bp, Homo sapiens
caatgtcttga

SEQ ID NO: 2515129 - DNA, 22 bp, Homo sapiens
caatgtgacttaatgccactaa

SEQ ID NO: 2515130 - DNA, 16 bp, Homo sapiens
caatgtgctactgatt

SEQ ID NO: 2515131 - DNA, 21 bp, Homo sapiens
caatgtggcctaaaaatgcaa

SEQ ID NO: 2515132 - DNA, 20 bp, Homo sapiens
caatgttaaggaaactctta

SEQ ID NO: 2515133 - DNA, 13 bp, Homo sapiens
caatgttcatcat

SEQ ID NO: 2515134 - DNA, 12 bp, Homo sapiens
caatgttcattg

SEQ ID NO: 2515135 - DNA, 18 bp, Homo sapiens
caatgttcattgtaatgt

SEQ ID NO: 2515136 - DNA, 14 bp, Homo sapiens
caattaaacggatt

SEQ ID NO: 2515137 - DNA, 15 bp, Homo sapiens
caattaaacggatta

SEQ ID NO: 2515138 - DNA, 16 bp, Homo sapiens
caattaaacggattat

SEQ ID NO: 2515139 - DNA, 20 bp, Homo sapiens
caattaaacggattattttt

SEQ ID NO: 2515140 - DNA, 23 bp, Homo sapiens
caattaaacggattattttttca

SEQ ID NO: 2515141 - DNA, 12 bp, Homo sapiens
caattaaatgta

SEQ ID NO: 2515142 - DNA, 20 bp, Homo sapiens
caattaaggattttatgctt

SEQ ID NO: 2515143 - DNA, 15 bp, Homo sapiens
caattaataaaaaat

SEQ ID NO: 2515144 - DNA, 21 bp, Homo sapiens
caattagcaattgactgtcac

SEQ ID NO: 2515145 - DNA, 16 bp, Homo sapiens
caattaggaagtgtaa

SEQ ID NO: 2515146 - DNA, 20 bp, Homo sapiens
caattaggaagtgtaacagc

SEQ ID NO: 2515147 - DNA, 22 bp, Homo sapiens
caattaggaagtgtaacagctg

SEQ ID NO: 2515148 - DNA, 23 bp, Homo sapiens
caattatatcagtcctctttcaa

SEQ ID NO: 2515149 - DNA, 13 bp, Homo sapiens
caattatttttac

SEQ ID NO: 2515150 - DNA, 14 bp, Homo sapiens
caattcatgaactt

SEQ ID NO: 2515151 - DNA, 15 bp, Homo sapiens
caattcatgaacttc

SEQ ID NO: 2515152 - DNA, 21 bp, Homo sapiens
caattcatgaacttcgcatca

SEQ ID NO: 2515153 - DNA, 15 bp, Homo sapiens
caattccaaaggaat

SEQ ID NO: 2515154 - DNA, 13 bp, Homo sapiens
caattccacctgc

SEQ ID NO: 2515155 - DNA, 17 bp, Homo sapiens
caattcccctctgctgc

SEQ ID NO: 2515156 - DNA, 20 bp, Homo sapiens
caattccgtagccagctgct

SEQ ID NO: 2515157 - DNA, 13 bp, Homo sapiens
caattcctctggg

SEQ ID NO: 2515158 - DNA, 14 bp, Homo sapiens
caattcctctggga

SEQ ID NO: 2515159 - DNA, 23 bp, Homo sapiens
caattctcatttgtcacacactt

SEQ ID NO: 2515160 - DNA, 17 bp, Homo sapiens
caattctctttagttct

SEQ ID NO: 2515161 - DNA, 14 bp, Homo sapiens
caattctgttttag

SEQ ID NO: 2515162 - DNA, 21 bp, Homo sapiens
caattcttccctatctttgcc

SEQ ID NO: 2515163 - DNA, 22 bp, Homo sapiens
caattcttccctatctttgcca

SEQ ID NO: 2515164 - DNA, 12 bp, Homo sapiens
caattctttata

SEQ ID NO: 2515165 - DNA, 16 bp, Homo sapiens
caattctttatacaac

SEQ ID NO: 2515166 - DNA, 23 bp, Homo sapiens
caattctttatacaacagtgcta

SEQ ID NO: 2515167 - DNA, 14 bp, Homo sapiens
caattgcatctccc

SEQ ID NO: 2515168 - DNA, 12 bp, Homo sapiens
caattggaggaa

SEQ ID NO: 2515169 - DNA, 15 bp, Homo sapiens
caatttaaacccatt

SEQ ID NO: 2515170 - DNA, 12 bp, Homo sapiens
caatttaaagca

SEQ ID NO: 2515171 - DNA, 14 bp, Homo sapiens
caatttattaaaat

SEQ ID NO: 2515172 - DNA, 22 bp, Homo sapiens
caatttattaaaatgattgtaa

SEQ ID NO: 2515173 - DNA, 20 bp, Homo sapiens
caatttattatggcacatca

SEQ ID NO: 2515174 - DNA, 17 bp, Homo sapiens
caatttattcaagaaaa

SEQ ID NO: 2515175 - DNA, 20 bp, Homo sapiens
caatttctactttgaagtca

SEQ ID NO: 2515176 - DNA, 21 bp, Homo sapiens
caatttctactttgaagtcat

SEQ ID NO: 2515177 - DNA, 12 bp, Homo sapiens
caatttctcccc

SEQ ID NO: 2515178 - DNA, 15 bp, Homo sapiens
caatttctccccagg

SEQ ID NO: 2515179 - DNA, 16 bp, Homo sapiens
caatttgggagatata

SEQ ID NO: 2515180 - DNA, 17 bp, Homo sapiens
caattttaatgctattt

SEQ ID NO: 2515181 - DNA, 13 bp, Homo sapiens
caattttctccca

SEQ ID NO: 2515182 - DNA, 12 bp, Homo sapiens
caattttgtaac

SEQ ID NO: 2515183 - DNA, 15 bp, Homo sapiens
caatttttgccttca

SEQ ID NO: 2515184 - DNA, 19 bp, Homo sapiens
caatttttggttgaataaa

SEQ ID NO: 2515185 - DNA, 22 bp, Homo sapiens
cacaaaacaaatgccacacatc

SEQ ID NO: 2515186 - DNA, 16 bp, Homo sapiens
cacaaaagtttctctt

SEQ ID NO: 2515187 - DNA, 17 bp, Homo sapiens
cacaaacctgcctgggt

SEQ ID NO: 2515188 - DNA, 18 bp, Homo sapiens
cacaaagcacagtttgaa

SEQ ID NO: 2515189 - DNA, 18 bp, Homo sapiens
cacaaagcccttccatgt

SEQ ID NO: 2515190 - DNA, 16 bp, Homo sapiens
cacaaaggtataattt

SEQ ID NO: 2515191 - DNA, 10 bp, Homo sapiens
cacaaataaa

SEQ ID NO: 2515192 - DNA, 12 bp, Homo sapiens
cacaaataaaat

SEQ ID NO: 2515193 - DNA, 20 bp, Homo sapiens
cagagcagcagtgaaaacaa

SEQ ID NO: 2515194 - DNA, 14 bp, Homo sapiens
cagagcaggggcag

SEQ ID NO: 2515195 - DNA, 17 bp, Homo sapiens
cagagcccaccttggct

SEQ ID NO: 2515196 - DNA, 16 bp, Homo sapiens
cagagcccacgccccc

SEQ ID NO: 2515197 - DNA, 20 bp, Homo sapiens
cagagcccacgcccccactg

SEQ ID NO: 2515198 - DNA, 21 bp, Homo sapiens
cagagcccacgcccccactgg

SEQ ID NO: 2515199 - DNA, 23 bp, Homo sapiens
cagagcccacgcccccactggtg

SEQ ID NO: 2515200 - DNA, 16 bp, Homo sapiens
cagagccccacacgga

SEQ ID NO: 2515201 - DNA, 13 bp, Homo sapiens
cagagcctgcagt

SEQ ID NO: 2515202 - DNA, 14 bp, Homo sapiens
cagagcctgcagtt

SEQ ID NO: 2515203 - DNA, 23 bp, Homo sapiens
cagagccttctgaggacattcca

SEQ ID NO: 2515204 - DNA, 19 bp, Homo sapiens
cagagcctttggatgacca

SEQ ID NO: 2515205 - DNA, 20 bp, Homo sapiens
cagagcgagagtctgtctca

SEQ ID NO: 2515206 - DNA, 15 bp, Homo sapiens
cagagcgcccctccc

SEQ ID NO: 2515207 - DNA, 22 bp, Homo sapiens
cagagcgccgtgagttctcagg

SEQ ID NO: 2515208 - DNA, 17 bp, Homo sapiens
cagagctacttgggcca

SEQ ID NO: 2515209 - DNA, 14 bp, Homo sapiens
cagagctctccagc

SEQ ID NO: 2515210 - DNA, 15 bp, Homo sapiens
cagagctgacacagg

SEQ ID NO: 2515211 - DNA, 14 bp, Homo sapiens
cagagctgggaggc

SEQ ID NO: 2515212 - DNA, 19 bp, Homo sapiens
cagagctgtttatggcctc

SEQ ID NO: 2515213 - DNA, 13 bp, Homo sapiens
cagagcttccctg

SEQ ID NO: 2515214 - DNA, 14 bp, Homo sapiens
cagagcttccctga

SEQ ID NO: 2515215 - DNA, 18 bp, Homo sapiens
cagagcttccctgactca

SEQ ID NO: 2515216 - DNA, 20 bp, Homo sapiens
cagaggaactgtccagagag

SEQ ID NO: 2515217 - DNA, 14 bp, Homo sapiens
cagaggaagagcag

SEQ ID NO: 2515218 - DNA, 15 bp, Homo sapiens
cagaggaagagcagg

SEQ ID NO: 2515219 - DNA, 16 bp, Homo sapiens
cagaggaaggggccag

SEQ ID NO: 2515220 - DNA, 18 bp, Homo sapiens
cagaggaatcactcttgt

SEQ ID NO: 2515221 - DNA, 22 bp, Homo sapiens
cagaggacagtatttgtgggga

SEQ ID NO: 2515222 - DNA, 20 bp, Homo sapiens
cagaggagagtcccagagca

SEQ ID NO: 2515223 - DNA, 17 bp, Homo sapiens
cagaggatggccagtgt

SEQ ID NO: 2515224 - DNA, 18 bp, Homo sapiens
cagaggatggccagtgtc

SEQ ID NO: 2515225 - DNA, 19 bp, Homo sapiens
cagaggatggccagtgtct

SEQ ID NO: 2515226 - DNA, 11 bp, Homo sapiens
cagaggcagcc

SEQ ID NO: 2515227 - DNA, 19 bp, Homo sapiens
cagaggcagccccattctg

SEQ ID NO: 2515228 - DNA, 20 bp, Homo sapiens
cagaggcagccccattctgc

SEQ ID NO: 2515229 - DNA, 23 bp, Homo sapiens
cagaggcagccccattctgcctg

SEQ ID NO: 2515230 - DNA, 14 bp, Homo sapiens
cagaggccatggca

SEQ ID NO: 2515231 - DNA, 20 bp, Homo sapiens
cagaggccatgggcctcctg

SEQ ID NO: 2515232 - DNA, 19 bp, Homo sapiens
cagaggccctcgctgccag

SEQ ID NO: 2515233 - DNA, 16 bp, Homo sapiens
cagaggcctataatga

SEQ ID NO: 2515234 - DNA, 18 bp, Homo sapiens
cagagggagtgacagagg

SEQ ID NO: 2515235 - DNA, 19 bp, Homo sapiens
cagagggagtgacagaggc

SEQ ID NO: 2515236 - DNA, 20 bp, Homo sapiens
cagagggagtgacagaggca

SEQ ID NO: 2515237 - DNA, 16 bp, Homo sapiens
cagagggcccaggcag

SEQ ID NO: 2515238 - DNA, 22 bp, Homo sapiens
cagagggcccaggcaggccacc

SEQ ID NO: 2515239 - DNA, 15 bp, Homo sapiens
cagagggcctgcaag

SEQ ID NO: 2515240 - DNA, 23 bp, Homo sapiens
cagaggggaaaccagtgtagcct

SEQ ID NO: 2515241 - DNA, 17 bp, Homo sapiens
cagagggggtggcctcc

SEQ ID NO: 2515242 - DNA, 18 bp, Homo sapiens
cagagggggtggcctccc

SEQ ID NO: 2515243 - DNA, 23 bp, Homo sapiens
cagaggggtgggttcctcttccc

SEQ ID NO: 2515244 - DNA, 13 bp, Homo sapiens
cagaggtaacaga

SEQ ID NO: 2515245 - DNA, 18 bp, Homo sapiens
cagaggtaacagaacagc

SEQ ID NO: 2515246 - DNA, 20 bp, Homo sapiens
cagaggtaacagaacagctt

SEQ ID NO: 2515247 - DNA, 19 bp, Homo sapiens
cagaggtctctgccggctc

SEQ ID NO: 2515248 - DNA, 23 bp, Homo sapiens
cagaggtctctgccggctctttc

SEQ ID NO: 2515249 - DNA, 23 bp, Homo sapiens
cagaggtgggcaggtggtggcac

SEQ ID NO: 2515250 - DNA, 17 bp, Homo sapiens
cagaggttgcagtgtgg

SEQ ID NO: 2515251 - DNA, 14 bp, Homo sapiens
cagagtcagcagaa

SEQ ID NO: 2515252 - DNA, 16 bp, Homo sapiens
caggcgatccacctgt

SEQ ID NO: 2515253 - DNA, 11 bp, Homo sapiens
caggctactgt

SEQ ID NO: 2515254 - DNA, 15 bp, Homo sapiens
caggctagaacctgg

SEQ ID NO: 2515255 - DNA, 22 bp, Homo sapiens
caggctcatagggaagacctgc

SEQ ID NO: 2515256 - DNA, 12 bp, Homo sapiens
caggctccttcc

SEQ ID NO: 2515257 - DNA, 14 bp, Homo sapiens
caggctctcaacag

SEQ ID NO: 2515258 - DNA, 15 bp, Homo sapiens
caggctctgccctgc

SEQ ID NO: 2515259 - DNA, 21 bp, Homo sapiens
caggctctgccctgccctagc

SEQ ID NO: 2515260 - DNA, 22 bp, Homo sapiens
caggctctgccctgccctagct

SEQ ID NO: 2515261 - DNA, 13 bp, Homo sapiens
caggctctgtgct

SEQ ID NO: 2515262 - DNA, 18 bp, Homo sapiens
caggctctgtgctgaccc

SEQ ID NO: 2515263 - DNA, 23 bp, Homo sapiens
caggctctgtgctgaccctcctg

SEQ ID NO: 2515264 - DNA, 24 bp, Homo sapiens
caggctctgtgctgaccctcctgt

SEQ ID NO: 2515265 - DNA, 14 bp, Homo sapiens
caggctgacatctg

SEQ ID NO: 2515266 - DNA, 16 bp, Homo sapiens
caggctgacatctgtg

SEQ ID NO: 2515267 - DNA, 18 bp, Homo sapiens
caggctgctggcgcctct

SEQ ID NO: 2515268 - DNA, 21 bp, Homo sapiens
caggctgctggcgcctctgca

SEQ ID NO: 2515269 - DNA, 14 bp, Homo sapiens
caggctggacgtgg

SEQ ID NO: 2515270 - DNA, 21 bp, Homo sapiens
caggctggaggtaaggccttt

SEQ ID NO: 2515271 - DNA, 21 bp, Homo sapiens
caggctggcaccgccttctct

SEQ ID NO: 2515272 - DNA, 17 bp, Homo sapiens
caggctggcagctctcc

SEQ ID NO: 2515273 - DNA, 20 bp, Homo sapiens
caggctggcagctctccagt

SEQ ID NO: 2515274 - DNA, 20 bp, Homo sapiens
caggctggcgcagccaaggc

SEQ ID NO: 2515275 - DNA, 17 bp, Homo sapiens
caggctggcgtgcagtg

SEQ ID NO: 2515276 - DNA, 12 bp, Homo sapiens
caggctgggaga

SEQ ID NO: 2515277 - DNA, 18 bp, Homo sapiens
caggctgggagagccttc

SEQ ID NO: 2515278 - DNA, 21 bp, Homo sapiens
caggctgggagagccttccag

SEQ ID NO: 2515279 - DNA, 17 bp, Homo sapiens
caggctgggcttcagtg

SEQ ID NO: 2515280 - DNA, 13 bp, Homo sapiens
caggctggtctca

SEQ ID NO: 2515281 - DNA, 23 bp, Homo sapiens
caggctggtctcaaactcctgac

SEQ ID NO: 2515282 - DNA, 20 bp, Homo sapiens
caggctgtatcccatgagcc

SEQ ID NO: 2515283 - DNA, 22 bp, Homo sapiens
caggctgtgcgctgacaaccac

SEQ ID NO: 2515284 - DNA, 23 bp, Homo sapiens
caggcttagtcactgagacagcc

SEQ ID NO: 2515285 - DNA, 22 bp, Homo sapiens
caggcttcaccctgaatggttc

SEQ ID NO: 2515286 - DNA, 14 bp, Homo sapiens
caggcttccttggc

SEQ ID NO: 2515287 - DNA, 23 bp, Homo sapiens
cagggaaaggctctgaaagccag

SEQ ID NO: 2515288 - DNA, 22 bp, Homo sapiens
cagggaaccctgcttgcacttt

SEQ ID NO: 2515289 - DNA, 22 bp, Homo sapiens
cagggaagagcagaacggagcc

SEQ ID NO: 2515290 - DNA, 21 bp, Homo sapiens
cagggaagctacaggttacaa

SEQ ID NO: 2515291 - DNA, 19 bp, Homo sapiens
cagggaaggggaggcagcc

SEQ ID NO: 2515292 - DNA, 23 bp, Homo sapiens
cagggaagtccccaggccccagg

SEQ ID NO: 2515293 - DNA, 17 bp, Homo sapiens
cagggacaccagccagg

SEQ ID NO: 2515294 - DNA, 20 bp, Homo sapiens
cagggacaccagccaggctc

SEQ ID NO: 2515295 - DNA, 13 bp, Homo sapiens
cagggacagagcc

SEQ ID NO: 2515296 - DNA, 16 bp, Homo sapiens
cagggacagagccatg

SEQ ID NO: 2515297 - DNA, 17 bp, Homo sapiens
cagggacagagccatgc

SEQ ID NO: 2515298 - DNA, 14 bp, Homo sapiens
cagggacagagggg

SEQ ID NO: 2515299 - DNA, 18 bp, Homo sapiens
cagggacaggataagagg

SEQ ID NO: 2515300 - DNA, 18 bp, Homo sapiens
cagggaccaaggacccct

SEQ ID NO: 2515301 - DNA, 19 bp, Homo sapiens
cagggaccaaggacccctc

SEQ ID NO: 2515302 - DNA, 22 bp, Homo sapiens
cagggaccacaccctgtactgt

SEQ ID NO: 2515303 - DNA, 14 bp, Homo sapiens
cagggacccctgcc

SEQ ID NO: 2515304 - DNA, 21 bp, Homo sapiens
cagggagcaggcggtgggcac

SEQ ID NO: 2515305 - DNA, 13 bp, Homo sapiens
cagggagcggaaa

SEQ ID NO: 2515306 - DNA, 16 bp, Homo sapiens
cagggagcggaaagca

SEQ ID NO: 2515307 - DNA, 22 bp, Homo sapiens
cagggagcggaaagcagctcaa

SEQ ID NO: 2515308 - DNA, 23 bp, Homo sapiens
cagggaggagaggggaagggcca

SEQ ID NO: 2515309 - DNA, 20 bp, Homo sapiens
cagggaggaggtggcagccc

SEQ ID NO: 2515310 - DNA, 23 bp, Homo sapiens
cagggaggaggtggcagccctgt

SEQ ID NO: 2515311 - DNA, 21 bp, Homo sapiens
cagggaggggactatttatga

SEQ ID NO: 2515312 - DNA, 14 bp, Homo sapiens
cagggaggtggctg

SEQ ID NO: 2515313 - DNA, 22 bp, Homo sapiens
cagggagtcccctccccggccc

SEQ ID NO: 2515314 - DNA, 23 bp, Homo sapiens
cagggagtcccctccccggccct

SEQ ID NO: 2515315 - DNA, 20 bp, Homo sapiens
cagggagtgtagtaaagccg

SEQ ID NO: 2515316 - DNA, 19 bp, Homo sapiens
cagggatgagcatggagct

SEQ ID NO: 2515317 - DNA, 18 bp, Homo sapiens
cagggatgtacaaggcga

SEQ ID NO: 2515318 - DNA, 14 bp, Homo sapiens
cagggcacaccggg

SEQ ID NO: 2515319 - DNA, 19 bp, Homo sapiens
cagggcacaccgggcactc

SEQ ID NO: 2515320 - DNA, 21 bp, Homo sapiens
cagggcacaccgggcactcag

SEQ ID NO: 2515321 - DNA, 22 bp, Homo sapiens
cagggcacaccgggcactcaga

SEQ ID NO: 2515322 - DNA, 14 bp, Homo sapiens
cagggcacttcaca

SEQ ID NO: 2515323 - DNA, 15 bp, Homo sapiens
cagggcagagccggg

SEQ ID NO: 2515324 - DNA, 14 bp, Homo sapiens
cagggcagctgggc

SEQ ID NO: 2515325 - DNA, 15 bp, Homo sapiens
cagggcagctgggcc

SEQ ID NO: 2515326 - DNA, 21 bp, Homo sapiens
cagggcatctccaggaaggcg

SEQ ID NO: 2515327 - DNA, 14 bp, Homo sapiens
cagggcatctcctg

SEQ ID NO: 2515328 - DNA, 15 bp, Homo sapiens
cagggcatctcctgt

SEQ ID NO: 2515329 - DNA, 19 bp, Homo sapiens
cagggcatgcattttgcag

SEQ ID NO: 2515330 - DNA, 17 bp, Homo sapiens
cagggcatggctgggaa

SEQ ID NO: 2515331 - DNA, 19 bp, Homo sapiens
cagggccaacttgagggcc

SEQ ID NO: 2515332 - DNA, 17 bp, Homo sapiens
cagggccactctgcctc

SEQ ID NO: 2515333 - DNA, 13 bp, Homo sapiens
cagggccagggcc

SEQ ID NO: 2515334 - DNA, 16 bp, Homo sapiens
cagggccatgcctgcc

SEQ ID NO: 2515335 - DNA, 21 bp, Homo sapiens
cagggccccagaaggcaggga

SEQ ID NO: 2515336 - DNA, 14 bp, Homo sapiens
cagggccccagcac

SEQ ID NO: 2515337 - DNA, 22 bp, Homo sapiens
cagggccccagcactaaagcag

SEQ ID NO: 2515338 - DNA, 21 bp, Homo sapiens
cagggcccccagcgagagtcc

SEQ ID NO: 2515339 - DNA, 15 bp, Homo sapiens
cagggccctgagctc

SEQ ID NO: 2515340 - DNA, 21 bp, Homo sapiens
cagggccctgagctcggtgga

SEQ ID NO: 2515341 - DNA, 20 bp, Homo sapiens
cagggcctagctgctacaaa

SEQ ID NO: 2515342 - DNA, 22 bp, Homo sapiens
cagggcctagctgctacaaaga

SEQ ID NO: 2515343 - DNA, 23 bp, Homo sapiens
cagggcctagctgctacaaagaa

SEQ ID NO: 2515344 - DNA, 13 bp, Homo sapiens
cagggcgagactc

SEQ ID NO: 2515345 - DNA, 24 bp, Homo sapiens
cagggctaccctgagctgaggcag

SEQ ID NO: 2515346 - DNA, 13 bp, Homo sapiens
cagggctcagcct

SEQ ID NO: 2515347 - DNA, 14 bp, Homo sapiens
cagggctcagcctg

SEQ ID NO: 2515348 - DNA, 16 bp, Homo sapiens
cagggctcagcctggt

SEQ ID NO: 2515349 - DNA, 19 bp, Homo sapiens
cagggctcagcctggtggg

SEQ ID NO: 2515350 - DNA, 21 bp, Homo sapiens
cagggctcagcggggacagct

SEQ ID NO: 2515351 - DNA, 12 bp, Homo sapiens
cagggctctgac

SEQ ID NO: 2515352 - DNA, 15 bp, Homo sapiens
cagggctctgaccag

SEQ ID NO: 2515353 - DNA, 13 bp, Homo sapiens
cagggctctgccc

SEQ ID NO: 2515354 - DNA, 15 bp, Homo sapiens
cagggctctgcccca

SEQ ID NO: 2515355 - DNA, 20 bp, Homo sapiens
cagggctctgccccagaggc

SEQ ID NO: 2515356 - DNA, 12 bp, Homo sapiens
cagggctggccc

SEQ ID NO: 2515357 - DNA, 20 bp, Homo sapiens
cagggctggcccagccctgc

SEQ ID NO: 2515358 - DNA, 23 bp, Homo sapiens
cagggctggcccagccctgctgg

SEQ ID NO: 2515359 - DNA, 20 bp, Homo sapiens
caggggaaaatcagcctgct

SEQ ID NO: 2515360 - DNA, 15 bp, Homo sapiens
caggggaccacacct

SEQ ID NO: 2515361 - DNA, 17 bp, Homo sapiens
caggggaccacacctcc

SEQ ID NO: 2515362 - DNA, 18 bp, Homo sapiens
caggggactcagccctga

SEQ ID NO: 2515363 - DNA, 13 bp, Homo sapiens
caggggagccctc

SEQ ID NO: 2515364 - DNA, 15 bp, Homo sapiens
caggggagccctcca

SEQ ID NO: 2515365 - DNA, 21 bp, Homo sapiens
caggggagccctccacgccgg

SEQ ID NO: 2515366 - DNA, 21 bp, Homo sapiens
caggggcatgtattggcctgg

SEQ ID NO: 2515367 - DNA, 20 bp, Homo sapiens
caggggcccaaggcggcccc

SEQ ID NO: 2515368 - DNA, 16 bp, Homo sapiens
caggggcccacaggga

SEQ ID NO: 2515369 - DNA, 11 bp, Homo sapiens
caggggccccg

SEQ ID NO: 2515370 - DNA, 13 bp, Homo sapiens
caggggcccctcc

SEQ ID NO: 2515371 - DNA, 16 bp, Homo sapiens
caggggcccctccagc

SEQ ID NO: 2515372 - DNA, 19 bp, Homo sapiens
caggggggttgtgaggcct

SEQ ID NO: 2515373 - DNA, 16 bp, Homo sapiens
cagggggtgtgtctgc

SEQ ID NO: 2515374 - DNA, 20 bp, Homo sapiens
caggggtcccagccaccccg

SEQ ID NO: 2515375 - DNA, 18 bp, Homo sapiens
caggggtcgtcaccacct

SEQ ID NO: 2515376 - DNA, 13 bp, Homo sapiens
caggggtgccccc

SEQ ID NO: 2515377 - DNA, 21 bp, Homo sapiens
caggggtgggacaccctgtga

SEQ ID NO: 2515378 - DNA, 13 bp, Homo sapiens
cagggtagcccgc

SEQ ID NO: 2515379 - DNA, 16 bp, Homo sapiens
cagggtagcccgcctg

SEQ ID NO: 2515380 - DNA, 21 bp, Homo sapiens
cagggtagcccgcctgccagt

SEQ ID NO: 2515381 - DNA, 14 bp, Homo sapiens
cagggtcaggagag

SEQ ID NO: 2515382 - DNA, 18 bp, Homo sapiens
cagggtccctggtggcag

SEQ ID NO: 2515383 - DNA, 23 bp, Homo sapiens
cagggtccctggtggcagctcac

SEQ ID NO: 2515384 - DNA, 16 bp, Homo sapiens
cagggtctcactctgt

SEQ ID NO: 2515385 - DNA, 17 bp, Homo sapiens
cagggtctcactctgtc

SEQ ID NO: 2515386 - DNA, 18 bp, Homo sapiens
cagggtctcactctgtcg

SEQ ID NO: 2515387 - DNA, 22 bp, Homo sapiens
cagggtctcactctgtcgccca

SEQ ID NO: 2515388 - DNA, 21 bp, Homo sapiens
cagggtctctaccatcccctg

SEQ ID NO: 2515389 - DNA, 21 bp, Homo sapiens
cagggtctctagtgctgtgaa

SEQ ID NO: 2515390 - DNA, 16 bp, Homo sapiens
cagtcatgcataaata

SEQ ID NO: 2515391 - DNA, 23 bp, Homo sapiens
cagtcatgcataaatatgcagtg

SEQ ID NO: 2515392 - DNA, 22 bp, Homo sapiens
cagtcattagactcctcctcca

SEQ ID NO: 2515393 - DNA, 21 bp, Homo sapiens
cagtccaaatgtcctccagaa

SEQ ID NO: 2515394 - DNA, 13 bp, Homo sapiens
cagtccacaaaat

SEQ ID NO: 2515395 - DNA, 16 bp, Homo sapiens
cagtccagcctggaga

SEQ ID NO: 2515396 - DNA, 14 bp, Homo sapiens
cagtccattgaaag

SEQ ID NO: 2515397 - DNA, 16 bp, Homo sapiens
cagtccccctgcccca

SEQ ID NO: 2515398 - DNA, 17 bp, Homo sapiens
cagtccccctgccccag

SEQ ID NO: 2515399 - DNA, 23 bp, Homo sapiens
cagtccccgtgaaggagagccct

SEQ ID NO: 2515400 - DNA, 13 bp, Homo sapiens
cagtcccctccca

SEQ ID NO: 2515401 - DNA, 15 bp, Homo sapiens
cagtcccctcccatc

SEQ ID NO: 2515402 - DNA, 19 bp, Homo sapiens
cagtcccctcccatctggg

SEQ ID NO: 2515403 - DNA, 14 bp, Homo sapiens
cagtccctaaagaa

SEQ ID NO: 2515404 - DNA, 13 bp, Homo sapiens
cagtccctgccaa

SEQ ID NO: 2515405 - DNA, 18 bp, Homo sapiens
cagtcctagctgcacagg

SEQ ID NO: 2515406 - DNA, 14 bp, Homo sapiens
cagtcctcccatct

SEQ ID NO: 2515407 - DNA, 19 bp, Homo sapiens
cagtcctgcctcagcctcc

SEQ ID NO: 2515408 - DNA, 18 bp, Homo sapiens
cagtcctgcctggccagg

SEQ ID NO: 2515409 - DNA, 22 bp, Homo sapiens
cagtcctggaagccagctttcc

SEQ ID NO: 2515410 - DNA, 20 bp, Homo sapiens
cagtccttaccagcagagca

SEQ ID NO: 2515411 - DNA, 21 bp, Homo sapiens
cagtccttaccagcagagcac

SEQ ID NO: 2515412 - DNA, 15 bp, Homo sapiens
cagtccttccacctc

SEQ ID NO: 2515413 - DNA, 16 bp, Homo sapiens
cagtcgggggctggcc

SEQ ID NO: 2515414 - DNA, 17 bp, Homo sapiens
cagtctatccacagaga

SEQ ID NO: 2515415 - DNA, 23 bp, Homo sapiens
cagtctatccacagagagtccca

SEQ ID NO: 2515416 - DNA, 17 bp, Homo sapiens
cagtctcacccagactc

SEQ ID NO: 2515417 - DNA, 23 bp, Homo sapiens
cagtctcactgtgggaaggccag

SEQ ID NO: 2515418 - DNA, 15 bp, Homo sapiens
cagtctcaggaaatc

SEQ ID NO: 2515419 - DNA, 13 bp, Homo sapiens
cagtctcaggagc

SEQ ID NO: 2515420 - DNA, 17 bp, Homo sapiens
cagtctcccttctccca

SEQ ID NO: 2515421 - DNA, 22 bp, Homo sapiens
cagtctcccttctcccatgagg

SEQ ID NO: 2515422 - DNA, 18 bp, Homo sapiens
cagtctccctttcccttc

SEQ ID NO: 2515423 - DNA, 22 bp, Homo sapiens
cagtctgatcgtgacgctgaat

SEQ ID NO: 2515424 - DNA, 21 bp, Homo sapiens
cagtctgattcccaagctctg

SEQ ID NO: 2515425 - DNA, 18 bp, Homo sapiens
cagtctggaatgcagtgg

SEQ ID NO: 2515426 - DNA, 19 bp, Homo sapiens
cagtctggaatgcagtggt

SEQ ID NO: 2515427 - DNA, 17 bp, Homo sapiens
cagtcttccatttgcaa

SEQ ID NO: 2515428 - DNA, 18 bp, Homo sapiens
cagtcttccatttgcaag

SEQ ID NO: 2515429 - DNA, 17 bp, Homo sapiens
cagtcttcctgacactt

SEQ ID NO: 2515430 - DNA, 18 bp, Homo sapiens
cagtcttcctgacacttt

SEQ ID NO: 2515431 - DNA, 22 bp, Homo sapiens
cagtcttgaatttctaaaaaac

SEQ ID NO: 2515432 - DNA, 23 bp, Homo sapiens
cagtcttgaatttctaaaaaaca

SEQ ID NO: 2515433 - DNA, 18 bp, Homo sapiens
cagtgaatgattcagtgt

SEQ ID NO: 2515434 - DNA, 20 bp, Homo sapiens
cagtgaatgattcagtgtta

SEQ ID NO: 2515435 - DNA, 23 bp, Homo sapiens
cagtgacacttcagagagctggt

SEQ ID NO: 2515436 - DNA, 14 bp, Homo sapiens
cagtgacctgagga

SEQ ID NO: 2515437 - DNA, 17 bp, Homo sapiens
cagtgacctgaggaagc

SEQ ID NO: 2515438 - DNA, 17 bp, Homo sapiens
cagtgacgtgcacctgt

SEQ ID NO: 2515439 - DNA, 14 bp, Homo sapiens
cagtgactccagga

SEQ ID NO: 2515440 - DNA, 14 bp, Homo sapiens
cagtgagaaaaagc

SEQ ID NO: 2515441 - DNA, 20 bp, Homo sapiens
cagtgagaaaaagctcctgt

SEQ ID NO: 2515442 - DNA, 23 bp, Homo sapiens
cagtgagccaagatcgcgccact

SEQ ID NO: 2515443 - DNA, 13 bp, Homo sapiens
cagtgaggcccag

SEQ ID NO: 2515444 - DNA, 12 bp, Homo sapiens
cagtgaggctct

SEQ ID NO: 2515445 - DNA, 14 bp, Homo sapiens
cagtgaggctctgc

SEQ ID NO: 2515446 - DNA, 15 bp, Homo sapiens
cagtgaggctctgcc

SEQ ID NO: 2515447 - DNA, 20 bp, Homo sapiens
cagtgaggctctgcccttgg

SEQ ID NO: 2515448 - DNA, 21 bp, Homo sapiens
cagtgaggctctgcccttggt

SEQ ID NO: 2515449 - DNA, 23 bp, Homo sapiens
cagtgagggtcttcttacatgca

SEQ ID NO: 2515450 - DNA, 15 bp, Homo sapiens
cagtgaggtgcccag

SEQ ID NO: 2515451 - DNA, 16 bp, Homo sapiens
cagtgaggtgcccagc

SEQ ID NO: 2515452 - DNA, 17 bp, Homo sapiens
cagtgagtcgaggacag

SEQ ID NO: 2515453 - DNA, 15 bp, Homo sapiens
cagtgagtctcttca

SEQ ID NO: 2515454 - DNA, 23 bp, Homo sapiens
cagtgagttacagcgagaggcag

SEQ ID NO: 2515455 - DNA, 15 bp, Homo sapiens
cagtgatatggcaga

SEQ ID NO: 2515456 - DNA, 17 bp, Homo sapiens
cagtgatcaaagtccga

SEQ ID NO: 2515457 - DNA, 15 bp, Homo sapiens
cagtgatctccatat

SEQ ID NO: 2515458 - DNA, 16 bp, Homo sapiens
cagtgatctccatatg

SEQ ID NO: 2515459 - DNA, 17 bp, Homo sapiens
cagtgatgggagagtag

SEQ ID NO: 2515460 - DNA, 17 bp, Homo sapiens
cagtgattaccagggac

SEQ ID NO: 2515461 - DNA, 22 bp, Homo sapiens
cagtgattaccagggactgagg

SEQ ID NO: 2515462 - DNA, 19 bp, Homo sapiens
cagtgcaagagactctggc

SEQ ID NO: 2515463 - DNA, 22 bp, Homo sapiens
cagtgcaagagactctggcctc

SEQ ID NO: 2515464 - DNA, 22 bp, Homo sapiens
cagtgcaatggtataaatttca

SEQ ID NO: 2515465 - DNA, 16 bp, Homo sapiens
cagtgcagcccgtgtg

SEQ ID NO: 2515466 - DNA, 12 bp, Homo sapiens
cagtgcaggcac

SEQ ID NO: 2515467 - DNA, 14 bp, Homo sapiens
cagtgcaggcacag

SEQ ID NO: 2515468 - DNA, 14 bp, Homo sapiens
cagtgcatattcct

SEQ ID NO: 2515469 - DNA, 22 bp, Homo sapiens
cagtgccaataaaatttaggaa

SEQ ID NO: 2515470 - DNA, 17 bp, Homo sapiens
cagtgccagcaatgaca

SEQ ID NO: 2515471 - DNA, 13 bp, Homo sapiens
cagtgcccacagg

SEQ ID NO: 2515472 - DNA, 15 bp, Homo sapiens
cagtgcccacaggat

SEQ ID NO: 2515473 - DNA, 17 bp, Homo sapiens
cagtgcccacaggatca

SEQ ID NO: 2515474 - DNA, 22 bp, Homo sapiens
cagtgcccacaggatcagtctg

SEQ ID NO: 2515475 - DNA, 17 bp, Homo sapiens
cagtgccctcattttat

SEQ ID NO: 2515476 - DNA, 18 bp, Homo sapiens
cagtgccttcaataaatg

SEQ ID NO: 2515477 - DNA, 14 bp, Homo sapiens
cagtgccttccata

SEQ ID NO: 2515478 - DNA, 21 bp, Homo sapiens
cagtgccttggggaatttcct

SEQ ID NO: 2515479 - DNA, 14 bp, Homo sapiens
cagtgctaaaaatg

SEQ ID NO: 2515480 - DNA, 15 bp, Homo sapiens
cagtgctaaaaatgg

SEQ ID NO: 2515481 - DNA, 20 bp, Homo sapiens
cagtgctaaaaatgggactt

SEQ ID NO: 2515482 - DNA, 22 bp, Homo sapiens
cagtgctgtctgatctgtgctt

SEQ ID NO: 2515483 - DNA, 15 bp, Homo sapiens
cagtgctgtggcctg

SEQ ID NO: 2515484 - DNA, 17 bp, Homo sapiens
cagtgctgtggcctggg

SEQ ID NO: 2515485 - DNA, 14 bp, Homo sapiens
cagtgcttcagcct

SEQ ID NO: 2515486 - DNA, 22 bp, Homo sapiens
cagtggactttccaccccctcc

SEQ ID NO: 2515487 - DNA, 14 bp, Homo sapiens
cagtggagaattat

SEQ ID NO: 2515488 - DNA, 12 bp, Homo sapiens
cagtggcagctg

SEQ ID NO: 2515489 - DNA, 16 bp, Homo sapiens
cagtggcagctgcttt

SEQ ID NO: 2515490 - DNA, 14 bp, Homo sapiens
cagtggccactcag

SEQ ID NO: 2515491 - DNA, 20 bp, Homo sapiens
cagtggctcacgcctatgat

SEQ ID NO: 2515492 - DNA, 16 bp, Homo sapiens
cagtggctggatctgt

SEQ ID NO: 2515493 - DNA, 13 bp, Homo sapiens
cagtgggagccag

SEQ ID NO: 2515494 - DNA, 23 bp, Homo sapiens
cagtgggagctgcctgttcagct

SEQ ID NO: 2515495 - DNA, 12 bp, Homo sapiens
cagtgggaggcg

SEQ ID NO: 2515496 - DNA, 13 bp, Homo sapiens
cagtgggaggcgc

SEQ ID NO: 2515497 - DNA, 12 bp, Homo sapiens
cagtgggagggg

SEQ ID NO: 2515498 - DNA, 15 bp, Homo sapiens
cagtgggaggggcag

SEQ ID NO: 2515499 - DNA, 21 bp, Homo sapiens
cagtgggaggggcaggctgac

SEQ ID NO: 2515500 - DNA, 15 bp, Homo sapiens
cagtggggcagtcat

SEQ ID NO: 2515501 - DNA, 13 bp, Homo sapiens
cagtgggtgcccc

SEQ ID NO: 2515502 - DNA, 15 bp, Homo sapiens
cagtggtaagctctg

SEQ ID NO: 2515503 - DNA, 20 bp, Homo sapiens
cagtggtatgatcacggctc

SEQ ID NO: 2515504 - DNA, 19 bp, Homo sapiens
cagtggtggcagggcctag

SEQ ID NO: 2515505 - DNA, 19 bp, Homo sapiens
cagtggtggttttctgttc

SEQ ID NO: 2515506 - DNA, 14 bp, Homo sapiens
cagtggttatttag

SEQ ID NO: 2515507 - DNA, 13 bp, Homo sapiens
cagtggttgctgt

SEQ ID NO: 2515508 - DNA, 17 bp, Homo sapiens
cagtgtaaatagttact

SEQ ID NO: 2515509 - DNA, 14 bp, Homo sapiens
cagtgtaatttctt

SEQ ID NO: 2515510 - DNA, 12 bp, Homo sapiens
cagtgtacagtc

SEQ ID NO: 2515511 - DNA, 15 bp, Homo sapiens
cagtgtacagtcttg

SEQ ID NO: 2515512 - DNA, 16 bp, Homo sapiens
cagtgtacatggaata

SEQ ID NO: 2515513 - DNA, 19 bp, Homo sapiens
cagtgtcaagttgtgcttg

SEQ ID NO: 2515514 - DNA, 14 bp, Homo sapiens
cagtgtcaatgcag

SEQ ID NO: 2515515 - DNA, 17 bp, Homo sapiens
cagtgtcccctccactg

SEQ ID NO: 2515516 - DNA, 19 bp, Homo sapiens
cagtgtcctcttgctcaaa

SEQ ID NO: 2515517 - DNA, 20 bp, Homo sapiens
cagtgtctcacagccctgct

SEQ ID NO: 2515518 - DNA, 16 bp, Homo sapiens
catttatgatttaata

SEQ ID NO: 2515519 - DNA, 18 bp, Homo sapiens
catttatgatttaataaa

SEQ ID NO: 2515520 - DNA, 20 bp, Homo sapiens
catttatggtcaacacttaa

SEQ ID NO: 2515521 - DNA, 16 bp, Homo sapiens
catttattctgctcac

SEQ ID NO: 2515522 - DNA, 19 bp, Homo sapiens
catttattttttacattat

SEQ ID NO: 2515523 - DNA, 18 bp, Homo sapiens
catttcaaatgtgctgtc

SEQ ID NO: 2515524 - DNA, 16 bp, Homo sapiens
catttcaattctcaaa

SEQ ID NO: 2515525 - DNA, 22 bp, Homo sapiens
catttcaggagcagcctcagaa

SEQ ID NO: 2515526 - DNA, 14 bp, Homo sapiens
catttcatctattt

SEQ ID NO: 2515527 - DNA, 17 bp, Homo sapiens
catttcatctatttctg

SEQ ID NO: 2515528 - DNA, 20 bp, Homo sapiens
catttcatctatttctgaga

SEQ ID NO: 2515529 - DNA, 15 bp, Homo sapiens
catttcattcctaac

SEQ ID NO: 2515530 - DNA, 21 bp, Homo sapiens
catttcattcctaacacagca

SEQ ID NO: 2515531 - DNA, 13 bp, Homo sapiens
catttcattgtat

SEQ ID NO: 2515532 - DNA, 17 bp, Homo sapiens
catttcctatgtaactg

SEQ ID NO: 2515533 - DNA, 19 bp, Homo sapiens
catttcctatgtaactgca

SEQ ID NO: 2515534 - DNA, 19 bp, Homo sapiens
catttcctgagaccacaga

SEQ ID NO: 2515535 - DNA, 20 bp, Homo sapiens
catttctactctcccatggc

SEQ ID NO: 2515536 - DNA, 21 bp, Homo sapiens
catttctactctcccatggct

SEQ ID NO: 2515537 - DNA, 13 bp, Homo sapiens
catttctatttat

SEQ ID NO: 2515538 - DNA, 14 bp, Homo sapiens
catttctatttatt

SEQ ID NO: 2515539 - DNA, 12 bp, Homo sapiens
catttctcactg

SEQ ID NO: 2515540 - DNA, 15 bp, Homo sapiens
catttctctaagaga

SEQ ID NO: 2515541 - DNA, 22 bp, Homo sapiens
catttctgagtttcattctcct

SEQ ID NO: 2515542 - DNA, 23 bp, Homo sapiens
catttctgcatcagctgctgaaa

SEQ ID NO: 2515543 - DNA, 12 bp, Homo sapiens
catttcttagac

SEQ ID NO: 2515544 - DNA, 12 bp, Homo sapiens
catttcttgggc

SEQ ID NO: 2515545 - DNA, 20 bp, Homo sapiens
catttgaaaattttgatgtt

SEQ ID NO: 2515546 - DNA, 22 bp, Homo sapiens
catttgaaaattttgatgtttt

SEQ ID NO: 2515547 - DNA, 14 bp, Homo sapiens
catttgaaagaaag

SEQ ID NO: 2515548 - DNA, 19 bp, Homo sapiens
catttgaaagaaaggactc

SEQ ID NO: 2515549 - DNA, 15 bp, Homo sapiens
catttgagaaatgca

SEQ ID NO: 2515550 - DNA, 17 bp, Homo sapiens
catttgagaaatgcata

SEQ ID NO: 2515551 - DNA, 16 bp, Homo sapiens
catttgagcagggctc

SEQ ID NO: 2515552 - DNA, 18 bp, Homo sapiens
catttgaggtctgttctt

SEQ ID NO: 2515553 - DNA, 19 bp, Homo sapiens
catttgaggtctgttcttt

SEQ ID NO: 2515554 - DNA, 22 bp, Homo sapiens
catttgaggtctgttctttcca

SEQ ID NO: 2515555 - DNA, 15 bp, Homo sapiens
catttgatgctaaat

SEQ ID NO: 2515556 - DNA, 16 bp, Homo sapiens
catttgatgctaaata

SEQ ID NO: 2515557 - DNA, 22 bp, Homo sapiens
catttgcaagggaaaagtctct

SEQ ID NO: 2515558 - DNA, 21 bp, Homo sapiens
catttgcactggagttctatg

SEQ ID NO: 2515559 - DNA, 18 bp, Homo sapiens
catttgcagagtcctgca

SEQ ID NO: 2515560 - DNA, 14 bp, Homo sapiens
catttgcctattcc

SEQ ID NO: 2515561 - DNA, 21 bp, Homo sapiens
catttgcgaatggttccattc

SEQ ID NO: 2515562 - DNA, 13 bp, Homo sapiens
catttgctgaata

SEQ ID NO: 2515563 - DNA, 23 bp, Homo sapiens
catttggagtgttccccttccac

SEQ ID NO: 2515564 - DNA, 23 bp, Homo sapiens
catttggtggtttcagaaatgtg

SEQ ID NO: 2515565 - DNA, 18 bp, Homo sapiens
cattttaaaaatgaaatt

SEQ ID NO: 2515566 - DNA, 16 bp, Homo sapiens
cattttaaataaaaga

SEQ ID NO: 2515567 - DNA, 18 bp, Homo sapiens
cattttaaataaaagaaa

SEQ ID NO: 2515568 - DNA, 16 bp, Homo sapiens
cattttaactttatca

SEQ ID NO: 2515569 - DNA, 17 bp, Homo sapiens
cattttactttttcctg

SEQ ID NO: 2515570 - DNA, 11 bp, Homo sapiens
cattttataaa

SEQ ID NO: 2515571 - DNA, 18 bp, Homo sapiens
cattttataaatcgcttt

SEQ ID NO: 2515572 - DNA, 17 bp, Homo sapiens
cattttcaccccaccct

SEQ ID NO: 2515573 - DNA, 14 bp, Homo sapiens
cattttccccccac

SEQ ID NO: 2515574 - DNA, 20 bp, Homo sapiens
cattttgagtgactcgaggg

SEQ ID NO: 2515575 - DNA, 15 bp, Homo sapiens
cattttgcagcagtg

SEQ ID NO: 2515576 - DNA, 18 bp, Homo sapiens
cattttgcagcagtgagt

SEQ ID NO: 2515577 - DNA, 13 bp, Homo sapiens
cattttgcattca

SEQ ID NO: 2515578 - DNA, 20 bp, Homo sapiens
cattttgccaaaattattaa

SEQ ID NO: 2515579 - DNA, 24 bp, Homo sapiens
cattttgctaaatgtgaatgatga

SEQ ID NO: 2515580 - DNA, 19 bp, Homo sapiens
cattttgctattgtaaata

SEQ ID NO: 2515581 - DNA, 20 bp, Homo sapiens
cattttggggtacccactgc

SEQ ID NO: 2515582 - DNA, 12 bp, Homo sapiens
cattttgtgaat

SEQ ID NO: 2515583 - DNA, 13 bp, Homo sapiens
cattttgtgaatg

SEQ ID NO: 2515584 - DNA, 14 bp, Homo sapiens
cattttgtgaatgg

SEQ ID NO: 2515585 - DNA, 18 bp, Homo sapiens
cattttgtgaatggattg

SEQ ID NO: 2515586 - DNA, 17 bp, Homo sapiens
catttttagtagagaca

SEQ ID NO: 2515587 - DNA, 18 bp, Homo sapiens
catttttcagatataaaa

SEQ ID NO: 2515588 - DNA, 21 bp, Homo sapiens
catttttccttcccttctcca

SEQ ID NO: 2515589 - DNA, 17 bp, Homo sapiens
catttttgatttatgca

SEQ ID NO: 2515590 - DNA, 12 bp, Homo sapiens
catttttgtaca

SEQ ID NO: 2515591 - DNA, 20 bp, Homo sapiens
catttttgtacagtttgctg

SEQ ID NO: 2515592 - DNA, 21 bp, Homo sapiens
catttttgtacagtttgctgt

SEQ ID NO: 2515593 - DNA, 20 bp, Homo sapiens
catttttgtattttgtttaa

SEQ ID NO: 2515594 - DNA, 22 bp, Homo sapiens
catttttgtttctacctcccag

SEQ ID NO: 2515595 - DNA, 15 bp, Homo sapiens
cattttttaaatgca

SEQ ID NO: 2515596 - DNA, 17 bp, Homo sapiens
cattttttaaggaaaca

SEQ ID NO: 2515597 - DNA, 18 bp, Homo sapiens
cattttttaaggaaacaa

SEQ ID NO: 2515598 - DNA, 16 bp, Homo sapiens
ccaaaaagaccagact

SEQ ID NO: 2515599 - DNA, 15 bp, Homo sapiens
ccaaaaccacagccc

SEQ ID NO: 2515600 - DNA, 20 bp, Homo sapiens
ccaaaactctcctctgctgc

SEQ ID NO: 2515601 - DNA, 23 bp, Homo sapiens
ccaaaagattgctgaaattttat

SEQ ID NO: 2515602 - DNA, 15 bp, Homo sapiens
ccaaaagtggcctct

SEQ ID NO: 2515603 - DNA, 16 bp, Homo sapiens
ccaaacaaatatgcaa

SEQ ID NO: 2515604 - DNA, 15 bp, Homo sapiens
ccaaacaccttccag

SEQ ID NO: 2515605 - DNA, 16 bp, Homo sapiens
ccaaacccatgaggca

SEQ ID NO: 2515606 - DNA, 20 bp, Homo sapiens
ccaaacctctgttcagtgta

SEQ ID NO: 2515607 - DNA, 15 bp, Homo sapiens
ccaaacctgacagat

SEQ ID NO: 2515608 - DNA, 19 bp, Homo sapiens
ccaaactgcctaagccctc

SEQ ID NO: 2515609 - DNA, 18 bp, Homo sapiens
ccaaagagcctggagaag

SEQ ID NO: 2515610 - DNA, 12 bp, Homo sapiens
ccaaagcagggt

SEQ ID NO: 2515611 - DNA, 15 bp, Homo sapiens
ccaaagcagggtctg

SEQ ID NO: 2515612 - DNA, 16 bp, Homo sapiens
ccaaagcagggtctgg

SEQ ID NO: 2515613 - DNA, 19 bp, Homo sapiens
ccaaagccaaagctaggcc

SEQ ID NO: 2515614 - DNA, 17 bp, Homo sapiens
ccaaagctaggcctggc

SEQ ID NO: 2515615 - DNA, 18 bp, Homo sapiens
ccaaagctagggtggccc

SEQ ID NO: 2515616 - DNA, 23 bp, Homo sapiens
ccaaagctagggtggcccttgca

SEQ ID NO: 2515617 - DNA, 15 bp, Homo sapiens
ccaaaggaggctggc

SEQ ID NO: 2515618 - DNA, 16 bp, Homo sapiens
ccaaaggaggctggca

SEQ ID NO: 2515619 - DNA, 17 bp, Homo sapiens
ccaaaggaggctggcag

SEQ ID NO: 2515620 - DNA, 17 bp, Homo sapiens
ccaccacaccgcagaag

SEQ ID NO: 2515621 - DNA, 14 bp, Homo sapiens
ccaccaccactggc

SEQ ID NO: 2515622 - DNA, 24 bp, Homo sapiens
ccaccaccccccactctgtgcctg

SEQ ID NO: 2515623 - DNA, 20 bp, Homo sapiens
ccaccactaggactctgagg

SEQ ID NO: 2515624 - DNA, 19 bp, Homo sapiens
ccaccactggccaccaggc

SEQ ID NO: 2515625 - DNA, 22 bp, Homo sapiens
ccaccaggctgctcagggctgg

SEQ ID NO: 2515626 - DNA, 12 bp, Homo sapiens
ccaccaggctgg

SEQ ID NO: 2515627 - DNA, 19 bp, Homo sapiens
ccaccaggctggcgcagcc

SEQ ID NO: 2515628 - DNA, 14 bp, Homo sapiens
ccaccagtcactgt

SEQ ID NO: 2515629 - DNA, 22 bp, Homo sapiens
ccaccatattcagtgctgtggc

SEQ ID NO: 2515630 - DNA, 14 bp, Homo sapiens
ccaccatcaagcca

SEQ ID NO: 2515631 - DNA, 16 bp, Homo sapiens
ccaccatcaagccacc

SEQ ID NO: 2515632 - DNA, 18 bp, Homo sapiens
ccaccatcatgtctggct

SEQ ID NO: 2515633 - DNA, 22 bp, Homo sapiens
ccaccatctttgcaggttgctt

SEQ ID NO: 2515634 - DNA, 21 bp, Homo sapiens
ccaccatggccagccaacttt

SEQ ID NO: 2515635 - DNA, 17 bp, Homo sapiens
ccaccatgtctgcccca

SEQ ID NO: 2515636 - DNA, 15 bp, Homo sapiens
ccacccaatgctgat

SEQ ID NO: 2515637 - DNA, 13 bp, Homo sapiens
ccacccacctcag

SEQ ID NO: 2515638 - DNA, 12 bp, Homo sapiens
ccaccccacact

SEQ ID NO: 2515639 - DNA, 12 bp, Homo sapiens
ccacccccacac

SEQ ID NO: 2515640 - DNA, 13 bp, Homo sapiens
ccacccccacacc

SEQ ID NO: 2515641 - DNA, 17 bp, Homo sapiens
ccacccccacccaaggg

SEQ ID NO: 2515642 - DNA, 19 bp, Homo sapiens
ccacccccacccaagggcc

SEQ ID NO: 2515643 - DNA, 16 bp, Homo sapiens
ccacccccagctcaat

SEQ ID NO: 2515644 - DNA, 22 bp, Homo sapiens
ccaccccccagaacctgtcctt

SEQ ID NO: 2515645 - DNA, 13 bp, Homo sapiens
ccacccccttctc

SEQ ID NO: 2515646 - DNA, 16 bp, Homo sapiens
ccaccccgctctgcat

SEQ ID NO: 2515647 - DNA, 15 bp, Homo sapiens
ccacccctccttcct

SEQ ID NO: 2515648 - DNA, 15 bp, Homo sapiens
ccacccctgcctcca

SEQ ID NO: 2515649 - DNA, 12 bp, Homo sapiens
ccacccctgtgc

SEQ ID NO: 2515650 - DNA, 13 bp, Homo sapiens
ccacccctgtgct

SEQ ID NO: 2515651 - DNA, 13 bp, Homo sapiens
ccaccccttcctg

SEQ ID NO: 2515652 - DNA, 13 bp, Homo sapiens
ccaccccttgctc

SEQ ID NO: 2515653 - DNA, 17 bp, Homo sapiens
ccacccgatgctgcttt

SEQ ID NO: 2515654 - DNA, 15 bp, Homo sapiens
ccaccctcccctctc

SEQ ID NO: 2515655 - DNA, 22 bp, Homo sapiens
ccaccctcctgtcttcccaggg

SEQ ID NO: 2515656 - DNA, 11 bp, Homo sapiens
ccaccctgctc

SEQ ID NO: 2515657 - DNA, 13 bp, Homo sapiens
ccaccctgctctc

SEQ ID NO: 2515658 - DNA, 10 bp, Homo sapiens
ccaccctggg

SEQ ID NO: 2515659 - DNA, 16 bp, Homo sapiens
ccaccctgtcccccag

SEQ ID NO: 2515660 - DNA, 21 bp, Homo sapiens
ccaccctgtcccccagctctg

SEQ ID NO: 2515661 - DNA, 22 bp, Homo sapiens
ccaccctgtcccccagctctgg

SEQ ID NO: 2515662 - DNA, 12 bp, Homo sapiens
ccaccctgtgtt

SEQ ID NO: 2515663 - DNA, 13 bp, Homo sapiens
ccacccttggcct

SEQ ID NO: 2515664 - DNA, 19 bp, Homo sapiens
ccacccttggcctgtctca

SEQ ID NO: 2515665 - DNA, 23 bp, Homo sapiens
ccaccctttggggggggcccgcc

SEQ ID NO: 2515666 - DNA, 18 bp, Homo sapiens
ccaccgcagacaggacca

SEQ ID NO: 2515667 - DNA, 19 bp, Homo sapiens
ccaccgcagacaggaccag

SEQ ID NO: 2515668 - DNA, 15 bp, Homo sapiens
ccaccgctccccagc

SEQ ID NO: 2515669 - DNA, 21 bp, Homo sapiens
ccaccgctccccagcccaggg

SEQ ID NO: 2515670 - DNA, 19 bp, Homo sapiens
ccaccgggctgggagctct

SEQ ID NO: 2515671 - DNA, 22 bp, Homo sapiens
ccaccgggctgggagctctgca

SEQ ID NO: 2515672 - DNA, 18 bp, Homo sapiens
ccaccgtccgccctgctc

SEQ ID NO: 2515673 - DNA, 20 bp, Homo sapiens
ccacctccccctcccccttc

SEQ ID NO: 2515674 - DNA, 18 bp, Homo sapiens
ccacctccttctctgtct

SEQ ID NO: 2515675 - DNA, 15 bp, Homo sapiens
ccacctctccaaggg

SEQ ID NO: 2515676 - DNA, 16 bp, Homo sapiens
ccacctctccaagggc

SEQ ID NO: 2515677 - DNA, 12 bp, Homo sapiens
ccacctctccct

SEQ ID NO: 2515678 - DNA, 13 bp, Homo sapiens
ccacctctccctc

SEQ ID NO: 2515679 - DNA, 19 bp, Homo sapiens
ccacctctctcactccttg

SEQ ID NO: 2515680 - DNA, 20 bp, Homo sapiens
ccacctctctcactccttga

SEQ ID NO: 2515681 - DNA, 14 bp, Homo sapiens
ccacctctctcctt

SEQ ID NO: 2515682 - DNA, 16 bp, Homo sapiens
ccacctcttctcttcc

SEQ ID NO: 2515683 - DNA, 20 bp, Homo sapiens
ccacctgaggtgggcccagg

SEQ ID NO: 2515684 - DNA, 13 bp, Homo sapiens
ccacctgccaggg

SEQ ID NO: 2515685 - DNA, 14 bp, Homo sapiens
ccacctgcccaacc

SEQ ID NO: 2515686 - DNA, 15 bp, Homo sapiens
ccacctgcccatcac

SEQ ID NO: 2515687 - DNA, 23 bp, Homo sapiens
ccacctgcccatcacagggttgg

SEQ ID NO: 2515688 - DNA, 22 bp, Homo sapiens
ccacctgcccccttctcccaca

SEQ ID NO: 2515689 - DNA, 23 bp, Homo sapiens
ccacctgcccccttctcccacac

SEQ ID NO: 2515690 - DNA, 14 bp, Homo sapiens
ccacctggccacct

SEQ ID NO: 2515691 - DNA, 15 bp, Homo sapiens
ccacctggcctctgc

SEQ ID NO: 2515692 - DNA, 17 bp, Homo sapiens
ccacctggcctctgcac

SEQ ID NO: 2515693 - DNA, 18 bp, Homo sapiens
ccaccttcaattcctggg

SEQ ID NO: 2515694 - DNA, 20 bp, Homo sapiens
ccaccttcaattcctgggcc

SEQ ID NO: 2515695 - DNA, 14 bp, Homo sapiens
ccaccttgcgggga

SEQ ID NO: 2515696 - DNA, 12 bp, Homo sapiens
ccaccttggctg

SEQ ID NO: 2515697 - DNA, 17 bp, Homo sapiens
ccaccttgttggagcct

SEQ ID NO: 2515698 - DNA, 23 bp, Homo sapiens
ccacgaatttgctggggaatctc

SEQ ID NO: 2515699 - DNA, 15 bp, Homo sapiens
ccacgactgtctcca

SEQ ID NO: 2515700 - DNA, 16 bp, Homo sapiens
ccaggcctctgtgtcc

SEQ ID NO: 2515701 - DNA, 19 bp, Homo sapiens
ccaggcctgggtctgtgtc

SEQ ID NO: 2515702 - DNA, 14 bp, Homo sapiens
ccaggcgggctcaa

SEQ ID NO: 2515703 - DNA, 22 bp, Homo sapiens
ccaggcgggctcaaggaaaggg

SEQ ID NO: 2515704 - DNA, 14 bp, Homo sapiens
ccaggctccttcct

SEQ ID NO: 2515705 - DNA, 22 bp, Homo sapiens
ccaggctccttcctgtcttcct

SEQ ID NO: 2515706 - DNA, 20 bp, Homo sapiens
ccaggctcctttagcgccca

SEQ ID NO: 2515707 - DNA, 21 bp, Homo sapiens
ccaggctcctttagcgcccag

SEQ ID NO: 2515708 - DNA, 14 bp, Homo sapiens
ccaggctctgtgct

SEQ ID NO: 2515709 - DNA, 20 bp, Homo sapiens
ccaggctctgtgctgaccct

SEQ ID NO: 2515710 - DNA, 22 bp, Homo sapiens
ccaggctctgtgctgaccctcc

SEQ ID NO: 2515711 - DNA, 22 bp, Homo sapiens
ccagtgttgtggatttaacaga

SEQ ID NO: 2515712 - DNA, 17 bp, Homo sapiens
ccagttaaaaaaaattt

SEQ ID NO: 2515713 - DNA, 18 bp, Homo sapiens
ccagttcaggagtcccaa

SEQ ID NO: 2515714 - DNA, 21 bp, Homo sapiens
ccagttcagtacctggaggag

SEQ ID NO: 2515715 - DNA, 23 bp, Homo sapiens
ccagttcagtacctggaggagga

SEQ ID NO: 2515716 - DNA, 23 bp, Homo sapiens
ccagttcctttcaatggtttgca

SEQ ID NO: 2515717 - DNA, 19 bp, Homo sapiens
ccagttctgctcctctcca

SEQ ID NO: 2515718 - DNA, 22 bp, Homo sapiens
ccagttctgctcctctccaggc

SEQ ID NO: 2515719 - DNA, 15 bp, Homo sapiens
ccagttgccatctgc

SEQ ID NO: 2515720 - DNA, 17 bp, Homo sapiens
ccagttgggagcactgg

SEQ ID NO: 2515721 - DNA, 13 bp, Homo sapiens
ccagttggtcccc

SEQ ID NO: 2515722 - DNA, 20 bp, Homo sapiens
ccagttggtcccccttccat

SEQ ID NO: 2515723 - DNA, 23 bp, Homo sapiens
ccagttggtcccccttccatgga

SEQ ID NO: 2515724 - DNA, 21 bp, Homo sapiens
ccagtttcaggtgtttagttg

SEQ ID NO: 2515725 - DNA, 12 bp, Homo sapiens
ccagtttctgcc

SEQ ID NO: 2515726 - DNA, 13 bp, Homo sapiens
ccataaagaagca

SEQ ID NO: 2515727 - DNA, 13 bp, Homo sapiens
ccataacagccaa

SEQ ID NO: 2515728 - DNA, 17 bp, Homo sapiens
ccataagcctccattta

SEQ ID NO: 2515729 - DNA, 15 bp, Homo sapiens
ccataaggaatgtag

SEQ ID NO: 2515730 - DNA, 22 bp, Homo sapiens
ccataaggtttcgtttctgtat

SEQ ID NO: 2515731 - DNA, 20 bp, Homo sapiens
ccataattttttttttcctt

SEQ ID NO: 2515732 - DNA, 13 bp, Homo sapiens
ccatagagtttaa

SEQ ID NO: 2515733 - DNA, 16 bp, Homo sapiens
ccatagagtttaacac

SEQ ID NO: 2515734 - DNA, 13 bp, Homo sapiens
ccataggcccagt

SEQ ID NO: 2515735 - DNA, 14 bp, Homo sapiens
ccatagtagtatga

SEQ ID NO: 2515736 - DNA, 15 bp, Homo sapiens
ccatagtcacatggc

SEQ ID NO: 2515737 - DNA, 23 bp, Homo sapiens
ccatataagtttgaaggaaacag

SEQ ID NO: 2515738 - DNA, 19 bp, Homo sapiens
ccatatgacctcatgcatc

SEQ ID NO: 2515739 - DNA, 14 bp, Homo sapiens
ccatatgttacact

SEQ ID NO: 2515740 - DNA, 19 bp, Homo sapiens
ccatattctgttggccagt

SEQ ID NO: 2515741 - DNA, 18 bp, Homo sapiens
ccatcagaaacaccctca

SEQ ID NO: 2515742 - DNA, 21 bp, Homo sapiens
ccatcagcttaggggctgctg

SEQ ID NO: 2515743 - DNA, 16 bp, Homo sapiens
ccatcagttagagctg

SEQ ID NO: 2515744 - DNA, 15 bp, Homo sapiens
ccatcatcccagctg

SEQ ID NO: 2515745 - DNA, 14 bp, Homo sapiens
ccatcatgtcccca

SEQ ID NO: 2515746 - DNA, 14 bp, Homo sapiens
ccatcatgtctggc

SEQ ID NO: 2515747 - DNA, 19 bp, Homo sapiens
ccatccactctaccctccc

SEQ ID NO: 2515748 - DNA, 22 bp, Homo sapiens
ccatccactctaccctcccacc

SEQ ID NO: 2515749 - DNA, 19 bp, Homo sapiens
ccatccaggttcagcttgt

SEQ ID NO: 2515750 - DNA, 12 bp, Homo sapiens
ccatcccacacc

SEQ ID NO: 2515751 - DNA, 16 bp, Homo sapiens
ccatcccacaccctgg

SEQ ID NO: 2515752 - DNA, 13 bp, Homo sapiens
ccatcccagcccc

SEQ ID NO: 2515753 - DNA, 14 bp, Homo sapiens
ccatcccagccttg

SEQ ID NO: 2515754 - DNA, 18 bp, Homo sapiens
ccatccccatcctccagc

SEQ ID NO: 2515755 - DNA, 15 bp, Homo sapiens
ccatcccctggactg

SEQ ID NO: 2515756 - DNA, 22 bp, Homo sapiens
ccatcccgacatggacccggag

SEQ ID NO: 2515757 - DNA, 17 bp, Homo sapiens
ccatccctgaaggcccc

SEQ ID NO: 2515758 - DNA, 19 bp, Homo sapiens
ccatccggcccccagagcg

SEQ ID NO: 2515759 - DNA, 13 bp, Homo sapiens
ccatcctcccctt

SEQ ID NO: 2515760 - DNA, 15 bp, Homo sapiens
ccatcctccccttcc

SEQ ID NO: 2515761 - DNA, 18 bp, Homo sapiens
ccatcctccccttccctg

SEQ ID NO: 2515762 - DNA, 21 bp, Homo sapiens
ccatcctccccttccctgcaa

SEQ ID NO: 2515763 - DNA, 12 bp, Homo sapiens
ccatcctctgta

SEQ ID NO: 2515764 - DNA, 21 bp, Homo sapiens
ccatcctctgtacagagccca

SEQ ID NO: 2515765 - DNA, 14 bp, Homo sapiens
ccatcctgtcccac

SEQ ID NO: 2515766 - DNA, 18 bp, Homo sapiens
ccatctcacacatgagca

SEQ ID NO: 2515767 - DNA, 16 bp, Homo sapiens
ccatctcaggccacct

SEQ ID NO: 2515768 - DNA, 16 bp, Homo sapiens
ccatctccaagaatgc

SEQ ID NO: 2515769 - DNA, 18 bp, Homo sapiens
ccatctccacccccagct

SEQ ID NO: 2515770 - DNA, 20 bp, Homo sapiens
ccatctcgccacccctcctt

SEQ ID NO: 2515771 - DNA, 20 bp, Homo sapiens
ccatctctctactcctacct

SEQ ID NO: 2515772 - DNA, 14 bp, Homo sapiens
ccatctctctggcc

SEQ ID NO: 2515773 - DNA, 22 bp, Homo sapiens
ccatctctggatgcctgattgc

SEQ ID NO: 2515774 - DNA, 21 bp, Homo sapiens
ccatctgcccaggggtgcccc

SEQ ID NO: 2515775 - DNA, 17 bp, Homo sapiens
ccatctgggagtcccct

SEQ ID NO: 2515776 - DNA, 18 bp, Homo sapiens
ccatctgggtccttgcac

SEQ ID NO: 2515777 - DNA, 22 bp, Homo sapiens
ccatctgggtccttgcacccct

SEQ ID NO: 2515778 - DNA, 16 bp, Homo sapiens
ccatctgtgcacgcag

SEQ ID NO: 2515779 - DNA, 21 bp, Homo sapiens
ccatgaaaaaaatgatcccca

SEQ ID NO: 2515780 - DNA, 19 bp, Homo sapiens
ccatgaaaacgttttattg

SEQ ID NO: 2515781 - DNA, 13 bp, Homo sapiens
ccatgaaacaaag

SEQ ID NO: 2515782 - DNA, 16 bp, Homo sapiens
ccatgaacagaaaaca

SEQ ID NO: 2515783 - DNA, 22 bp, Homo sapiens
ccatgaagagatttttcatgat

SEQ ID NO: 2515784 - DNA, 19 bp, Homo sapiens
ccatgaatgtatcaggaaa

SEQ ID NO: 2515785 - DNA, 15 bp, Homo sapiens
ccatgacccacccct

SEQ ID NO: 2515786 - DNA, 20 bp, Homo sapiens
ccatgacccacccctgtgct

SEQ ID NO: 2515787 - DNA, 17 bp, Homo sapiens
ccatgacccaggctggg

SEQ ID NO: 2515788 - DNA, 18 bp, Homo sapiens
ccatgacttgagaaacaa

SEQ ID NO: 2515789 - DNA, 18 bp, Homo sapiens
ccatgagaagagggcctg

SEQ ID NO: 2515790 - DNA, 19 bp, Homo sapiens
ccatgagaagagggcctgt

SEQ ID NO: 2515791 - DNA, 21 bp, Homo sapiens
ccatgagaagagggcctgtgg

SEQ ID NO: 2515792 - DNA, 21 bp, Homo sapiens
ccatgagcctcagcatcctgg

SEQ ID NO: 2515793 - DNA, 23 bp, Homo sapiens
ccatgagcctcagcatcctggca

SEQ ID NO: 2515794 - DNA, 13 bp, Homo sapiens
ccatgagctccag

SEQ ID NO: 2515795 - DNA, 15 bp, Homo sapiens
ccatgagctccagac

SEQ ID NO: 2515796 - DNA, 18 bp, Homo sapiens
ccatgagctccagacccc

SEQ ID NO: 2515797 - DNA, 19 bp, Homo sapiens
ccatgagctccagaccccc

SEQ ID NO: 2515798 - DNA, 13 bp, Homo sapiens
ccatgagtcccct

SEQ ID NO: 2515799 - DNA, 18 bp, Homo sapiens
ccatgagtcccctgtttg

SEQ ID NO: 2515800 - DNA, 21 bp, Homo sapiens
ccatgagtggcatggccacca

SEQ ID NO: 2515801 - DNA, 15 bp, Homo sapiens
ccatgatgtggagtg

SEQ ID NO: 2515802 - DNA, 14 bp, Homo sapiens
ccatgattcgccca

SEQ ID NO: 2515803 - DNA, 19 bp, Homo sapiens
ccatgcaatatttcctcat

SEQ ID NO: 2515804 - DNA, 15 bp, Homo sapiens
ccatgcccacctgcc

SEQ ID NO: 2515805 - DNA, 17 bp, Homo sapiens
ccatgcccacctgccca

SEQ ID NO: 2515806 - DNA, 12 bp, Homo sapiens
ccatgcctgagg

SEQ ID NO: 2515807 - DNA, 14 bp, Homo sapiens
ccatgcctgagggt

SEQ ID NO: 2515808 - DNA, 17 bp, Homo sapiens
ccatgcctgagggtgga

SEQ ID NO: 2515809 - DNA, 14 bp, Homo sapiens
ccatgcctgtccag

SEQ ID NO: 2515810 - DNA, 17 bp, Homo sapiens
ccatgcctgtccagcct

SEQ ID NO: 2515811 - DNA, 18 bp, Homo sapiens
ccatgcctgtccagcctg

SEQ ID NO: 2515812 - DNA, 13 bp, Homo sapiens
ccatgctgaaggg

SEQ ID NO: 2515813 - DNA, 11 bp, Homo sapiens
ccatgctgccc

SEQ ID NO: 2515814 - DNA, 14 bp, Homo sapiens
ccatgctgccctgt

SEQ ID NO: 2515815 - DNA, 15 bp, Homo sapiens
ccatgctgccctgtg

SEQ ID NO: 2515816 - DNA, 21 bp, Homo sapiens
ccatgctgttgattgctaaat

SEQ ID NO: 2515817 - DNA, 15 bp, Homo sapiens
ccatggaatgcttga

SEQ ID NO: 2515818 - DNA, 15 bp, Homo sapiens
ccatggacactccag

SEQ ID NO: 2515819 - DNA, 19 bp, Homo sapiens
ccatggacactccagtgcc

SEQ ID NO: 2515820 - DNA, 17 bp, Homo sapiens
ccatggagacaagaagg

SEQ ID NO: 2515821 - DNA, 18 bp, Homo sapiens
ccatggagagctggagcc

SEQ ID NO: 2515822 - DNA, 19 bp, Homo sapiens
ccatggagagctggagcct

SEQ ID NO: 2515823 - DNA, 14 bp, Homo sapiens
ccatggagccccag

SEQ ID NO: 2515824 - DNA, 18 bp, Homo sapiens
ccatggagccccagcccc

SEQ ID NO: 2515825 - DNA, 19 bp, Homo sapiens
ccatggagccccagccccc

SEQ ID NO: 2515826 - DNA, 20 bp, Homo sapiens
ccatggagccccagccccct

SEQ ID NO: 2515827 - DNA, 23 bp, Homo sapiens
ccatggcaccttcagactttgct

SEQ ID NO: 2515828 - DNA, 23 bp, Homo sapiens
ccatggcactctatgttctaaga

SEQ ID NO: 2515829 - DNA, 15 bp, Homo sapiens
ccatggccctcatta

SEQ ID NO: 2515830 - DNA, 15 bp, Homo sapiens
ccatggccctcccag

SEQ ID NO: 2515831 - DNA, 14 bp, Homo sapiens
ccatggcttcctcc

SEQ ID NO: 2515832 - DNA, 21 bp, Homo sapiens
ccatgggaagacgaggccctc

SEQ ID NO: 2515833 - DNA, 22 bp, Homo sapiens
ccatgggagctggttagaaatg

SEQ ID NO: 2515834 - DNA, 16 bp, Homo sapiens
ccatgggcttcactgt

SEQ ID NO: 2515835 - DNA, 20 bp, Homo sapiens
ccatgggcttcactgtataa

SEQ ID NO: 2515836 - DNA, 19 bp, Homo sapiens
ccatggtgtgatcgtctga

SEQ ID NO: 2515837 - DNA, 15 bp, Homo sapiens
ccatgtaacagaaag

SEQ ID NO: 2515838 - DNA, 15 bp, Homo sapiens
ccatgtactgtagtt

SEQ ID NO: 2515839 - DNA, 15 bp, Homo sapiens
ccatgtagaagctgc

SEQ ID NO: 2515840 - DNA, 18 bp, Homo sapiens
ccatgtagaagctgcatc

SEQ ID NO: 2515841 - DNA, 16 bp, Homo sapiens
ccatgtatttatctct

SEQ ID NO: 2515842 - DNA, 22 bp, Homo sapiens
ccatgtatttatctctatttaa

SEQ ID NO: 2515843 - DNA, 23 bp, Homo sapiens
ccatgtatttatctctatttaat

SEQ ID NO: 2515844 - DNA, 22 bp, Homo sapiens
ccatgtcaccggatcctgggtg

SEQ ID NO: 2515845 - DNA, 13 bp, Homo sapiens
ccatgtcactgtg

SEQ ID NO: 2515846 - DNA, 14 bp, Homo sapiens
ccatgtcggcctct

SEQ ID NO: 2515847 - DNA, 13 bp, Homo sapiens
ccatgtgccaggt

SEQ ID NO: 2515848 - DNA, 11 bp, Homo sapiens
ccatgtgtgag

SEQ ID NO: 2515849 - DNA, 15 bp, Homo sapiens
ccatgtgtggactca

SEQ ID NO: 2515850 - DNA, 18 bp, Homo sapiens
ccatgttagtttttactt

SEQ ID NO: 2515851 - DNA, 23 bp, Homo sapiens
ccatgttctatttcagtgccaat

SEQ ID NO: 2515852 - DNA, 15 bp, Homo sapiens
ccatgttggccaggc

SEQ ID NO: 2515853 - DNA, 17 bp, Homo sapiens
ccatgttggccaggctg

SEQ ID NO: 2515854 - DNA, 19 bp, Homo sapiens
ccatgttggccaggctggt

SEQ ID NO: 2515855 - DNA, 14 bp, Homo sapiens
ccatgtttgtaaaa

SEQ ID NO: 2515856 - DNA, 19 bp, Homo sapiens
cccacggggcctcgggacc

SEQ ID NO: 2515857 - DNA, 15 bp, Homo sapiens
cccacgttctcacac

SEQ ID NO: 2515858 - DNA, 21 bp, Homo sapiens
cccacgttctcacacccaccg

SEQ ID NO: 2515859 - DNA, 22 bp, Homo sapiens
cccactccctggctctcagaag

SEQ ID NO: 2515860 - DNA, 21 bp, Homo sapiens
cccactctaggggtcaggctc

SEQ ID NO: 2515861 - DNA, 14 bp, Homo sapiens
cccactctccccac

SEQ ID NO: 2515862 - DNA, 16 bp, Homo sapiens
cccactgcacacacct

SEQ ID NO: 2515863 - DNA, 16 bp, Homo sapiens
cccactgcccaccccc

SEQ ID NO: 2515864 - DNA, 19 bp, Homo sapiens
cccactgcccaccccctca

SEQ ID NO: 2515865 - DNA, 18 bp, Homo sapiens
cccactgcctactgcatc

SEQ ID NO: 2515866 - DNA, 14 bp, Homo sapiens
cccactgtcctggg

SEQ ID NO: 2515867 - DNA, 16 bp, Homo sapiens
cccagaaaaggacaga

SEQ ID NO: 2515868 - DNA, 17 bp, Homo sapiens
cccagaaaggagactag

SEQ ID NO: 2515869 - DNA, 14 bp, Homo sapiens
cccagaacctgtcc

SEQ ID NO: 2515870 - DNA, 17 bp, Homo sapiens
cccagaacctgtccttg

SEQ ID NO: 2515871 - DNA, 22 bp, Homo sapiens
cccagaataagttattgcagtt

SEQ ID NO: 2515872 - DNA, 18 bp, Homo sapiens
cccagaatgcctcctgca

SEQ ID NO: 2515873 - DNA, 21 bp, Homo sapiens
cccagaccttttatccactta

SEQ ID NO: 2515874 - DNA, 15 bp, Homo sapiens
cccagacgatgtctt

SEQ ID NO: 2515875 - DNA, 16 bp, Homo sapiens
cccagagaagcccctt

SEQ ID NO: 2515876 - DNA, 14 bp, Homo sapiens
cccagagcaggaag

SEQ ID NO: 2515877 - DNA, 19 bp, Homo sapiens
cccagagcaggaggcccct

SEQ ID NO: 2515878 - DNA, 13 bp, Homo sapiens
cccagagctgttt

SEQ ID NO: 2515879 - DNA, 24 bp, Homo sapiens
cccagaggaaggggccagaggctc

SEQ ID NO: 2515880 - DNA, 16 bp, Homo sapiens
cccagaggctgcccca

SEQ ID NO: 2515881 - DNA, 18 bp, Homo sapiens
cccagaggtaacagaaca

SEQ ID NO: 2515882 - DNA, 20 bp, Homo sapiens
cccagaggtaacagaacagc

SEQ ID NO: 2515883 - DNA, 23 bp, Homo sapiens
cccagaggtaacagaacagcttc

SEQ ID NO: 2515884 - DNA, 18 bp, Homo sapiens
cccagataccagcccctg

SEQ ID NO: 2515885 - DNA, 16 bp, Homo sapiens
cccagatcagctccta

SEQ ID NO: 2515886 - DNA, 22 bp, Homo sapiens
cccagatgttttacgtctggga

SEQ ID NO: 2515887 - DNA, 20 bp, Homo sapiens
cccagattgcaacaggctgg

SEQ ID NO: 2515888 - DNA, 23 bp, Homo sapiens
cccagattgcaacaggctgggct

SEQ ID NO: 2515889 - DNA, 22 bp, Homo sapiens
cccagcaacacaagctggaagc

SEQ ID NO: 2515890 - DNA, 13 bp, Homo sapiens
cccagcaaccctc

SEQ ID NO: 2515891 - DNA, 17 bp, Homo sapiens
cccagcaaccctcctat

SEQ ID NO: 2515892 - DNA, 21 bp, Homo sapiens
cccagcaaccctcctatcacc

SEQ ID NO: 2515893 - DNA, 16 bp, Homo sapiens
cccagcaagtgagagc

SEQ ID NO: 2515894 - DNA, 18 bp, Homo sapiens
cccagcaagtgagagctg

SEQ ID NO: 2515895 - DNA, 21 bp, Homo sapiens
cccagcaagtgagagctgggt

SEQ ID NO: 2515896 - DNA, 20 bp, Homo sapiens
cccagcactttgggaggcca

SEQ ID NO: 2515897 - DNA, 22 bp, Homo sapiens
cccagcagccctaaggatctct

SEQ ID NO: 2515898 - DNA, 13 bp, Homo sapiens
cccagcagggcct

SEQ ID NO: 2515899 - DNA, 20 bp, Homo sapiens
cccagcattttactgattca

SEQ ID NO: 2515900 - DNA, 14 bp, Homo sapiens
cccagccaccccgg

SEQ ID NO: 2515901 - DNA, 22 bp, Homo sapiens
cccagccaccccgggctctctg

SEQ ID NO: 2515902 - DNA, 13 bp, Homo sapiens
cccagccatctgc

SEQ ID NO: 2515903 - DNA, 17 bp, Homo sapiens
cccagccatctgcccag

SEQ ID NO: 2515904 - DNA, 20 bp, Homo sapiens
cccagccattaccatggaga

SEQ ID NO: 2515905 - DNA, 22 bp, Homo sapiens
cccagccattaccatggagaca

SEQ ID NO: 2515906 - DNA, 16 bp, Homo sapiens
cccagcccaaagctgt

SEQ ID NO: 2515907 - DNA, 16 bp, Homo sapiens
cccagcccaccctcct

SEQ ID NO: 2515908 - DNA, 14 bp, Homo sapiens
cccagcccacttct

SEQ ID NO: 2515909 - DNA, 19 bp, Homo sapiens
cccagcccacttctgccat

SEQ ID NO: 2515910 - DNA, 21 bp, Homo sapiens
cccagccccaaaactctcctc

SEQ ID NO: 2515911 - DNA, 13 bp, Homo sapiens
cccagccccaatg

SEQ ID NO: 2515912 - DNA, 12 bp, Homo sapiens
cccagccccatc

SEQ ID NO: 2515913 - DNA, 13 bp, Homo sapiens
cccagccccatcc

SEQ ID NO: 2515914 - DNA, 24 bp, Homo sapiens
cccagcccccacagtgctgtctga

SEQ ID NO: 2515915 - DNA, 16 bp, Homo sapiens
cccagccccctttggg

SEQ ID NO: 2515916 - DNA, 21 bp, Homo sapiens
cccagccccctttgggcccag

SEQ ID NO: 2515917 - DNA, 22 bp, Homo sapiens
cccagccccctttgggcccagg

SEQ ID NO: 2515918 - DNA, 18 bp, Homo sapiens
cccagccccttctgaccc

SEQ ID NO: 2515919 - DNA, 16 bp, Homo sapiens
cccagcccggctccca

SEQ ID NO: 2515920 - DNA, 14 bp, Homo sapiens
cccagccctcatcc

SEQ ID NO: 2515921 - DNA, 16 bp, Homo sapiens
cccagccctcatcccg

SEQ ID NO: 2515922 - DNA, 19 bp, Homo sapiens
cccagccctcatcccgagc

SEQ ID NO: 2515923 - DNA, 11 bp, Homo sapiens
cccagccctgc

SEQ ID NO: 2515924 - DNA, 16 bp, Homo sapiens
cccagccctggctctg

SEQ ID NO: 2515925 - DNA, 15 bp, Homo sapiens
cccagccctgtggaa

SEQ ID NO: 2515926 - DNA, 21 bp, Homo sapiens
cccagccctttgggaggctga

SEQ ID NO: 2515927 - DNA, 15 bp, Homo sapiens
cccagccggcctctc

SEQ ID NO: 2515928 - DNA, 18 bp, Homo sapiens
cccagccggcctctctgg

SEQ ID NO: 2515929 - DNA, 23 bp, Homo sapiens
cccagccggcctctctggcctcc

SEQ ID NO: 2515930 - DNA, 18 bp, Homo sapiens
cccagcctccaagctcca

SEQ ID NO: 2515931 - DNA, 15 bp, Homo sapiens
cccagcctctaggga

SEQ ID NO: 2515932 - DNA, 21 bp, Homo sapiens
cccagccttggcatctagagc

SEQ ID NO: 2515933 - DNA, 19 bp, Homo sapiens
cccagcgagccctggtggc

SEQ ID NO: 2515934 - DNA, 23 bp, Homo sapiens
cccagcgagccctggtggcagtg

SEQ ID NO: 2515935 - DNA, 15 bp, Homo sapiens
cccagcggcccctcc

SEQ ID NO: 2515936 - DNA, 20 bp, Homo sapiens
cccagcggcccctcccacac

SEQ ID NO: 2515937 - DNA, 14 bp, Homo sapiens
cccagctaattttt

SEQ ID NO: 2515938 - DNA, 22 bp, Homo sapiens
cccagctacctcaaccaatgcc

SEQ ID NO: 2515939 - DNA, 21 bp, Homo sapiens
cccagctactcaagaggctga

SEQ ID NO: 2515940 - DNA, 21 bp, Homo sapiens
cccagctactcagaagcctga

SEQ ID NO: 2515941 - DNA, 23 bp, Homo sapiens
cccagctactcagaagcctgagg

SEQ ID NO: 2515942 - DNA, 15 bp, Homo sapiens
cccagctacttggga

SEQ ID NO: 2515943 - DNA, 19 bp, Homo sapiens
cccagctacttgggaagct

SEQ ID NO: 2515944 - DNA, 11 bp, Homo sapiens
cccagctcaat

SEQ ID NO: 2515945 - DNA, 12 bp, Homo sapiens
cccagctcagca

SEQ ID NO: 2515946 - DNA, 14 bp, Homo sapiens
cccagctctagaca

SEQ ID NO: 2515947 - DNA, 22 bp, Homo sapiens
cccagctctgaaaccagtgtta

SEQ ID NO: 2515948 - DNA, 13 bp, Homo sapiens
cccagctctggtc

SEQ ID NO: 2515949 - DNA, 18 bp, Homo sapiens
cccagctctggtccatag

SEQ ID NO: 2515950 - DNA, 23 bp, Homo sapiens
cccagctctggtccatagagagc

SEQ ID NO: 2515951 - DNA, 12 bp, Homo sapiens
cccagctgcacc

SEQ ID NO: 2515952 - DNA, 11 bp, Homo sapiens
cccagctggga

SEQ ID NO: 2515953 - DNA, 14 bp, Homo sapiens
cccagctgggaggc

SEQ ID NO: 2515954 - DNA, 15 bp, Homo sapiens
cccagctgggaggca

SEQ ID NO: 2515955 - DNA, 21 bp, Homo sapiens
cccagctgggaggcaagaggg

SEQ ID NO: 2515956 - DNA, 22 bp, Homo sapiens
cccagctgggaggcaagagggg

SEQ ID NO: 2515957 - DNA, 22 bp, Homo sapiens
cccagctgggctctgccaccct

SEQ ID NO: 2515958 - DNA, 24 bp, Homo sapiens
cccagctgggctctgccaccctac

SEQ ID NO: 2515959 - DNA, 17 bp, Homo sapiens
cccaggaaaggctccag

SEQ ID NO: 2515960 - DNA, 19 bp, Homo sapiens
cccaggaaaggctccagga

SEQ ID NO: 2515961 - DNA, 16 bp, Homo sapiens
cccaggacgcttctga

SEQ ID NO: 2515962 - DNA, 17 bp, Homo sapiens
cccaggacgcttctgaa

SEQ ID NO: 2515963 - DNA, 15 bp, Homo sapiens
cccaggagacagttc

SEQ ID NO: 2515964 - DNA, 17 bp, Homo sapiens
cccaggagacagttcaa

SEQ ID NO: 2515965 - DNA, 18 bp, Homo sapiens
cccaggagcatccacctc

SEQ ID NO: 2515966 - DNA, 14 bp, Homo sapiens
cccaggagccccga

SEQ ID NO: 2515967 - DNA, 16 bp, Homo sapiens
cccaggaggccagcct

SEQ ID NO: 2515968 - DNA, 18 bp, Homo sapiens
cccaggaggccagccttg

SEQ ID NO: 2515969 - DNA, 18 bp, Homo sapiens
cccaggagggagggggct

SEQ ID NO: 2515970 - DNA, 17 bp, Homo sapiens
cccaggcaggtcttgaa

SEQ ID NO: 2515971 - DNA, 15 bp, Homo sapiens
cccaggcattcccca

SEQ ID NO: 2515972 - DNA, 17 bp, Homo sapiens
cccaggccaggccacca

SEQ ID NO: 2515973 - DNA, 13 bp, Homo sapiens
cccaggccccagg

SEQ ID NO: 2515974 - DNA, 18 bp, Homo sapiens
cccaggccccaggaagcc

SEQ ID NO: 2515975 - DNA, 23 bp, Homo sapiens
cccaggccccgaggacccagacc

SEQ ID NO: 2515976 - DNA, 22 bp, Homo sapiens
cccaggcccctgccaccctggg

SEQ ID NO: 2515977 - DNA, 16 bp, Homo sapiens
cccaggccgcagctct

SEQ ID NO: 2515978 - DNA, 21 bp, Homo sapiens
cccaggccggggtggagcatg

SEQ ID NO: 2515979 - DNA, 19 bp, Homo sapiens
cccaggctggagtgcagtg

SEQ ID NO: 2515980 - DNA, 17 bp, Homo sapiens
cccaggctggcgtgcag

SEQ ID NO: 2515981 - DNA, 19 bp, Homo sapiens
cccaggctggcgtgcagtg

SEQ ID NO: 2515982 - DNA, 21 bp, Homo sapiens
cccaggctggcgtgcagtggt

SEQ ID NO: 2515983 - DNA, 15 bp, Homo sapiens
cccaggcttagtcac

SEQ ID NO: 2515984 - DNA, 13 bp, Homo sapiens
cccagggaagtgc

SEQ ID NO: 2515985 - DNA, 15 bp, Homo sapiens
cccagggacaccagc

SEQ ID NO: 2515986 - DNA, 19 bp, Homo sapiens
cccagggacaccagccagg

SEQ ID NO: 2515987 - DNA, 18 bp, Homo sapiens
cccagggagaggccatga

SEQ ID NO: 2515988 - DNA, 20 bp, Homo sapiens
cccagggagcggaaagcagc

SEQ ID NO: 2515989 - DNA, 21 bp, Homo sapiens
cccagggagcggaaagcagct

SEQ ID NO: 2515990 - DNA, 22 bp, Homo sapiens
cccagggagcggaaagcagctc

SEQ ID NO: 2515991 - DNA, 23 bp, Homo sapiens
cccagggccactctgcctctgcc

SEQ ID NO: 2515992 - DNA, 17 bp, Homo sapiens
cccagggccagggccct

SEQ ID NO: 2515993 - DNA, 20 bp, Homo sapiens
cccagggctcagcctggtgg

SEQ ID NO: 2515994 - DNA, 18 bp, Homo sapiens
cccaggggcccacaggga

SEQ ID NO: 2515995 - DNA, 15 bp, Homo sapiens
cccaggggtcccagc

SEQ ID NO: 2515996 - DNA, 18 bp, Homo sapiens
cccaggggtcccagccac

SEQ ID NO: 2515997 - DNA, 19 bp, Homo sapiens
cccaggggtcccagccacc

SEQ ID NO: 2515998 - DNA, 18 bp, Homo sapiens
cccaggggtgccccctcc

SEQ ID NO: 2515999 - DNA, 14 bp, Homo sapiens
aggatggagagagg

SEQ ID NO: 2516000 - DNA, 15 bp, Homo sapiens
aggatggagagaggg

SEQ ID NO: 2516001 - DNA, 19 bp, Homo sapiens
aggatggaggggtggtcct

SEQ ID NO: 2516002 - DNA, 16 bp, Homo sapiens
aggatggccagtgtct

SEQ ID NO: 2516003 - DNA, 16 bp, Homo sapiens
aggatggcctggccag

SEQ ID NO: 2516004 - DNA, 18 bp, Homo sapiens
aggatggctttgaatgcg

SEQ ID NO: 2516005 - DNA, 19 bp, Homo sapiens
aggatgtcactcagatgga

SEQ ID NO: 2516006 - DNA, 16 bp, Homo sapiens
aggatgtgtgcatgtg

SEQ ID NO: 2516007 - DNA, 17 bp, Homo sapiens
aggatgttgaaaaagtt

SEQ ID NO: 2516008 - DNA, 16 bp, Homo sapiens
aggattacatgcatgt

SEQ ID NO: 2516009 - DNA, 15 bp, Homo sapiens
aggattctatgaggc

SEQ ID NO: 2516010 - DNA, 13 bp, Homo sapiens
aggattgaagagc

SEQ ID NO: 2516011 - DNA, 14 bp, Homo sapiens
aggattgaagagca

SEQ ID NO: 2516012 - DNA, 15 bp, Homo sapiens
aggattgctactgtc

SEQ ID NO: 2516013 - DNA, 22 bp, Homo sapiens
aggattgctactgtcctaccca

SEQ ID NO: 2516014 - DNA, 19 bp, Homo sapiens
aggattgcttgagcccagg

SEQ ID NO: 2516015 - DNA, 23 bp, Homo sapiens
aggattgtaaaaaaaaatgcctt

SEQ ID NO: 2516016 - DNA, 16 bp, Homo sapiens
aggatttaacagtcat

SEQ ID NO: 2516017 - DNA, 18 bp, Homo sapiens
aggatttaacagtcattt

SEQ ID NO: 2516018 - DNA, 20 bp, Homo sapiens
aggatttaacagtcatttaa

SEQ ID NO: 2516019 - DNA, 12 bp, Homo sapiens
aggatttcaagc

SEQ ID NO: 2516020 - DNA, 19 bp, Homo sapiens
aggattttaacaaaagcaa

SEQ ID NO: 2516021 - DNA, 23 bp, Homo sapiens
aggattttaacaaaagcaagact

SEQ ID NO: 2516022 - DNA, 16 bp, Homo sapiens
aggattttatgcttta

SEQ ID NO: 2516023 - DNA, 17 bp, Homo sapiens
aggcaaaatccttgctt

SEQ ID NO: 2516024 - DNA, 15 bp, Homo sapiens
aggcaaatgactttg

SEQ ID NO: 2516025 - DNA, 15 bp, Homo sapiens
aggcaactgaggcag

SEQ ID NO: 2516026 - DNA, 17 bp, Homo sapiens
aggcaactgaggcagac

SEQ ID NO: 2516027 - DNA, 19 bp, Homo sapiens
aggcaactgcattggcttt

SEQ ID NO: 2516028 - DNA, 16 bp, Homo sapiens
aggcaacttgggaact

SEQ ID NO: 2516029 - DNA, 12 bp, Homo sapiens
aggcaagagaat

SEQ ID NO: 2516030 - DNA, 14 bp, Homo sapiens
aggcaagcacctcc

SEQ ID NO: 2516031 - DNA, 19 bp, Homo sapiens
aggcaaggcaggtgcctcc

SEQ ID NO: 2516032 - DNA, 15 bp, Homo sapiens
aggcaagtttctagc

SEQ ID NO: 2516033 - DNA, 17 bp, Homo sapiens
aggcaataaaaatcata

SEQ ID NO: 2516034 - DNA, 22 bp, Homo sapiens
cggcccaagcccgacttgctgt

SEQ ID NO: 2516035 - DNA, 17 bp, Homo sapiens
cggcccagcccggctcc

SEQ ID NO: 2516036 - DNA, 14 bp, Homo sapiens
cggccccagccaga

SEQ ID NO: 2516037 - DNA, 14 bp, Homo sapiens
cggccccggcccca

SEQ ID NO: 2516038 - DNA, 15 bp, Homo sapiens
cggccccggccccag

SEQ ID NO: 2516039 - DNA, 19 bp, Homo sapiens
cggccccggccccagccag

SEQ ID NO: 2516040 - DNA, 18 bp, Homo sapiens
cggccctaccagcgcccg

SEQ ID NO: 2516041 - DNA, 18 bp, Homo sapiens
cggccctgggctcggagg

SEQ ID NO: 2516042 - DNA, 11 bp, Homo sapiens
cggccctgggg

SEQ ID NO: 2516043 - DNA, 12 bp, Homo sapiens
cggccgctccag

SEQ ID NO: 2516044 - DNA, 14 bp, Homo sapiens
cggccgctccaggg

SEQ ID NO: 2516045 - DNA, 13 bp, Homo sapiens
cggcctctctggc

SEQ ID NO: 2516046 - DNA, 15 bp, Homo sapiens
cggcctctctggcct

SEQ ID NO: 2516047 - DNA, 16 bp, Homo sapiens
cggcctgatgctccct

SEQ ID NO: 2516048 - DNA, 17 bp, Homo sapiens
cggcctgatgctccctc

SEQ ID NO: 2516049 - DNA, 23 bp, Homo sapiens
cggcctgatgctccctcccctgc

SEQ ID NO: 2516050 - DNA, 13 bp, Homo sapiens
cggcctgctccca

SEQ ID NO: 2516051 - DNA, 15 bp, Homo sapiens
cggcctggtgttctg

SEQ ID NO: 2516052 - DNA, 19 bp, Homo sapiens
cggcggagctggccccgcc

SEQ ID NO: 2516053 - DNA, 21 bp, Homo sapiens
cggcggagctggccccgccgc

SEQ ID NO: 2516054 - DNA, 15 bp, Homo sapiens
cggcgtcagcctcca

SEQ ID NO: 2516055 - DNA, 17 bp, Homo sapiens
cggcgtcagcctccagc

SEQ ID NO: 2516056 - DNA, 18 bp, Homo sapiens
cggcgtcagcctccagcc

SEQ ID NO: 2516057 - DNA, 16 bp, Homo sapiens
cggctcactgcagcct

SEQ ID NO: 2516058 - DNA, 17 bp, Homo sapiens
cggctcactgcagcctc

SEQ ID NO: 2516059 - DNA, 15 bp, Homo sapiens
cggctccaggctcct

SEQ ID NO: 2516060 - DNA, 15 bp, Homo sapiens
cggctccccatgtgt

SEQ ID NO: 2516061 - DNA, 20 bp, Homo sapiens
cggctcgagcagtcctgcct

SEQ ID NO: 2516062 - DNA, 18 bp, Homo sapiens
cggctctaggtggggcgg

SEQ ID NO: 2516063 - DNA, 16 bp, Homo sapiens
cggctctttccttgct

SEQ ID NO: 2516064 - DNA, 17 bp, Homo sapiens
cggctgagagccccagc

SEQ ID NO: 2516065 - DNA, 20 bp, Homo sapiens
cggctgagagccccagctga

SEQ ID NO: 2516066 - DNA, 22 bp, Homo sapiens
cggctgcagctcacccagcccc

SEQ ID NO: 2516067 - DNA, 14 bp, Homo sapiens
cggctggcagccca

SEQ ID NO: 2516068 - DNA, 16 bp, Homo sapiens
cggctggcctggcccc

SEQ ID NO: 2516069 - DNA, 23 bp, Homo sapiens
cggctggcctggcccctcagggt

SEQ ID NO: 2516070 - DNA, 23 bp, Homo sapiens
cggcttagacttcgactcaggat

SEQ ID NO: 2516071 - DNA, 16 bp, Homo sapiens
cggcttcatgccagct

SEQ ID NO: 2516072 - DNA, 19 bp, Homo sapiens
cggcttcatgccagctact

SEQ ID NO: 2516073 - DNA, 15 bp, Homo sapiens
cgggaacagacaaca

SEQ ID NO: 2516074 - DNA, 19 bp, Homo sapiens
cgggaagagaggagttcaa

SEQ ID NO: 2516075 - DNA, 23 bp, Homo sapiens
cgggaagagaggagttcaatgat

SEQ ID NO: 2516076 - DNA, 23 bp, Homo sapiens
cgggaagcatcttccagaagtgt

SEQ ID NO: 2516077 - DNA, 16 bp, Homo sapiens
cgggaagggggctggg

SEQ ID NO: 2516078 - DNA, 20 bp, Homo sapiens
cgggaaggtcaccagcacca

SEQ ID NO: 2516079 - DNA, 18 bp, Homo sapiens
cgggacacctgccctgcc

SEQ ID NO: 2516080 - DNA, 23 bp, Homo sapiens
cgggaccccgagcctggctccaa

SEQ ID NO: 2516081 - DNA, 14 bp, Homo sapiens
cgggacctgtggct

SEQ ID NO: 2516082 - DNA, 21 bp, Homo sapiens
cgggagaatcatgtgaacccg

SEQ ID NO: 2516083 - DNA, 18 bp, Homo sapiens
cgggagccgctggcagaa

SEQ ID NO: 2516084 - DNA, 21 bp, Homo sapiens
cgggaggatgttctgggacac

SEQ ID NO: 2516085 - DNA, 20 bp, Homo sapiens
cgggaggcagaggttgcagt

SEQ ID NO: 2516086 - DNA, 22 bp, Homo sapiens
cgggaggcagaggttgcagtgt

SEQ ID NO: 2516087 - DNA, 22 bp, Homo sapiens
cgggaggcggagcttgcagtga

SEQ ID NO: 2516088 - DNA, 16 bp, Homo sapiens
cgggaggctgagacag

SEQ ID NO: 2516089 - DNA, 17 bp, Homo sapiens
cgggaggctgagacagg

SEQ ID NO: 2516090 - DNA, 23 bp, Homo sapiens
cgggaggctgagacaggagaatc

SEQ ID NO: 2516091 - DNA, 19 bp, Homo sapiens
cgggcacctatagtcccag

SEQ ID NO: 2516092 - DNA, 14 bp, Homo sapiens
cgggcactcagaag

SEQ ID NO: 2516093 - DNA, 22 bp, Homo sapiens
cgggcactcagaagacactgat

SEQ ID NO: 2516094 - DNA, 15 bp, Homo sapiens
cgggcatgggcactc

SEQ ID NO: 2516095 - DNA, 17 bp, Homo sapiens
cgggcatgggcactccc

SEQ ID NO: 2516096 - DNA, 20 bp, Homo sapiens
cgggccaaggactgccgacc

SEQ ID NO: 2516097 - DNA, 12 bp, Homo sapiens
cgggccacagag

SEQ ID NO: 2516098 - DNA, 18 bp, Homo sapiens
cgggccagccaggcgggc

SEQ ID NO: 2516099 - DNA, 15 bp, Homo sapiens
cgggcccacctggcc

SEQ ID NO: 2516100 - DNA, 12 bp, Homo sapiens
cgggcccctcat

SEQ ID NO: 2516101 - DNA, 11 bp, Homo sapiens
cgggccctccc

SEQ ID NO: 2516102 - DNA, 16 bp, Homo sapiens
cgggcgcggccagccc

SEQ ID NO: 2516103 - DNA, 21 bp, Homo sapiens
cgggcggtcaggggttcgaga

SEQ ID NO: 2516104 - DNA, 15 bp, Homo sapiens
cgggctctctgctgt

SEQ ID NO: 2516105 - DNA, 13 bp, Homo sapiens
cgggctgcctggg

SEQ ID NO: 2516106 - DNA, 16 bp, Homo sapiens
cgggctgcctgggctg

SEQ ID NO: 2516107 - DNA, 15 bp, Homo sapiens
cggggacagctcctt

SEQ ID NO: 2516108 - DNA, 18 bp, Homo sapiens
cggggagcgcccgcgccc

SEQ ID NO: 2516109 - DNA, 13 bp, Homo sapiens
cggggaggccaag

SEQ ID NO: 2516110 - DNA, 19 bp, Homo sapiens
cggggaggccaagtgcagg

SEQ ID NO: 2516111 - DNA, 21 bp, Homo sapiens
cggggaggccaagtgcaggct

SEQ ID NO: 2516112 - DNA, 23 bp, Homo sapiens
cggggaggccaagtgcaggctgg

SEQ ID NO: 2516113 - DNA, 19 bp, Homo sapiens
cggggcatgctggggcaag

SEQ ID NO: 2516114 - DNA, 17 bp, Homo sapiens
cggggcctcgggacctc

SEQ ID NO: 2516115 - DNA, 18 bp, Homo sapiens
cggggcctcgggacctca

SEQ ID NO: 2516116 - DNA, 15 bp, Homo sapiens
cggggggacagctcc

SEQ ID NO: 2516117 - DNA, 16 bp, Homo sapiens
cggggtcctgtggcag

SEQ ID NO: 2516118 - DNA, 19 bp, Homo sapiens
cggggtcctgtggcaggca

SEQ ID NO: 2516119 - DNA, 18 bp, Homo sapiens
cggggtggtgggaaccat

SEQ ID NO: 2516120 - DNA, 19 bp, Homo sapiens
cggggtggtgggaaccatg

SEQ ID NO: 2516121 - DNA, 15 bp, Homo sapiens
cgggtcatctgtacc

SEQ ID NO: 2516122 - DNA, 18 bp, Homo sapiens
cgggtggatcacctgagg

SEQ ID NO: 2516123 - DNA, 20 bp, Homo sapiens
cgggtgggcggcacagcctt

SEQ ID NO: 2516124 - DNA, 12 bp, Homo sapiens
cgggtgggggtg

SEQ ID NO: 2516125 - DNA, 23 bp, Homo sapiens
cgggtttggcgggccaaggactg

SEQ ID NO: 2516126 - DNA, 21 bp, Homo sapiens
cgggttttattgtttaaaatc

SEQ ID NO: 2516127 - DNA, 16 bp, Homo sapiens
cggtccacccaggagc

SEQ ID NO: 2516128 - DNA, 16 bp, Homo sapiens
cggtctgcaagtcaga

SEQ ID NO: 2516129 - DNA, 17 bp, Homo sapiens
cggtgccaggttttctg

SEQ ID NO: 2516130 - DNA, 18 bp, Homo sapiens
cggtgctatctcccccag

SEQ ID NO: 2516131 - DNA, 20 bp, Homo sapiens
cggtgctatctcccccagcc

SEQ ID NO: 2516132 - DNA, 13 bp, Homo sapiens
cggtgctccaggc

SEQ ID NO: 2516133 - DNA, 15 bp, Homo sapiens
cggtgctccaggcag

SEQ ID NO: 2516134 - DNA, 16 bp, Homo sapiens
cggtgctccaggcagg

SEQ ID NO: 2516135 - DNA, 15 bp, Homo sapiens
cggtggaggccaggg

SEQ ID NO: 2516136 - DNA, 18 bp, Homo sapiens
cggtgggcacccaccctg

SEQ ID NO: 2516137 - DNA, 19 bp, Homo sapiens
cggtgggcacccaccctgg

SEQ ID NO: 2516138 - DNA, 19 bp, Homo sapiens
cggtgggcatttgtgaggc

SEQ ID NO: 2516139 - DNA, 13 bp, Homo sapiens
cggtgtggagaag

SEQ ID NO: 2516140 - DNA, 18 bp, Homo sapiens
cggtgtggagaagcggct

SEQ ID NO: 2516141 - DNA, 15 bp, Homo sapiens
cggttcaccagcctc

SEQ ID NO: 2516142 - DNA, 15 bp, Homo sapiens
cggtttgaagcctgg

SEQ ID NO: 2516143 - DNA, 16 bp, Homo sapiens
cggttttactgcagct

SEQ ID NO: 2516144 - DNA, 15 bp, Homo sapiens
cgtaaccacggaaaa

SEQ ID NO: 2516145 - DNA, 12 bp, Homo sapiens
cgtaaccagcca

SEQ ID NO: 2516146 - DNA, 17 bp, Homo sapiens
cgtaataattattatta

SEQ ID NO: 2516147 - DNA, 19 bp, Homo sapiens
cgcacagcatgagaggctc

SEQ ID NO: 2516148 - DNA, 13 bp, Homo sapiens
cgcacccccaccc

SEQ ID NO: 2516149 - DNA, 14 bp, Homo sapiens
cgcacccccaccct

SEQ ID NO: 2516150 - DNA, 15 bp, Homo sapiens
cgcacccccaccctt

SEQ ID NO: 2516151 - DNA, 19 bp, Homo sapiens
cgcacccccaccctttggg

SEQ ID NO: 2516152 - DNA, 12 bp, Homo sapiens
cgcagccaaggc

SEQ ID NO: 2516153 - DNA, 21 bp, Homo sapiens
cgcagccaaggccgaagctct

SEQ ID NO: 2516154 - DNA, 13 bp, Homo sapiens
cgcagctcttgcc

SEQ ID NO: 2516155 - DNA, 17 bp, Homo sapiens
cgcaggaactcccagca

SEQ ID NO: 2516156 - DNA, 16 bp, Homo sapiens
cgcaggggttgcagtg

SEQ ID NO: 2516157 - DNA, 15 bp, Homo sapiens
cgcagtcgtcgcaca

SEQ ID NO: 2516158 - DNA, 16 bp, Homo sapiens
cgcagtcgtcgcacag

SEQ ID NO: 2516159 - DNA, 17 bp, Homo sapiens
cgcagtcgtcgcacagt

SEQ ID NO: 2516160 - DNA, 15 bp, Homo sapiens
cgcatcaaaagacaa

SEQ ID NO: 2516161 - DNA, 22 bp, Homo sapiens
cgcatcaaaagacaattcttta

SEQ ID NO: 2516162 - DNA, 13 bp, Homo sapiens
cgcatcagacaga

SEQ ID NO: 2516163 - DNA, 16 bp, Homo sapiens
cgcatgcggcccagga

SEQ ID NO: 2516164 - DNA, 23 bp, Homo sapiens
cgcatggagtgtgtattgttccc

SEQ ID NO: 2516165 - DNA, 13 bp, Homo sapiens
cgcattctcatgg

SEQ ID NO: 2516166 - DNA, 12 bp, Homo sapiens
cgccaaggctgg

SEQ ID NO: 2516167 - DNA, 23 bp, Homo sapiens
cgccaaggctgggggaagaagct

SEQ ID NO: 2516168 - DNA, 16 bp, Homo sapiens
cgccacatggcttcct

SEQ ID NO: 2516169 - DNA, 17 bp, Homo sapiens
cgccacatggcttcctc

SEQ ID NO: 2516170 - DNA, 21 bp, Homo sapiens
cgccacctggcattccttctg

SEQ ID NO: 2516171 - DNA, 15 bp, Homo sapiens
cgccagatggggcct

SEQ ID NO: 2516172 - DNA, 17 bp, Homo sapiens
cgccagattctttcctg

SEQ ID NO: 2516173 - DNA, 20 bp, Homo sapiens
cgccatcccagccccaatga

SEQ ID NO: 2516174 - DNA, 15 bp, Homo sapiens
cgccatgctcctggc

SEQ ID NO: 2516175 - DNA, 16 bp, Homo sapiens
cgcccaacccttcccc

SEQ ID NO: 2516176 - DNA, 20 bp, Homo sapiens
cgcccacaggaagcctgcag

SEQ ID NO: 2516177 - DNA, 19 bp, Homo sapiens
cgcccaccccgctctgcat

SEQ ID NO: 2516178 - DNA, 14 bp, Homo sapiens
cgcccactgtcctg

SEQ ID NO: 2516179 - DNA, 19 bp, Homo sapiens
cgcccactgtcctgggcgc

SEQ ID NO: 2516180 - DNA, 15 bp, Homo sapiens
cgcccagctgcacct

SEQ ID NO: 2516181 - DNA, 15 bp, Homo sapiens
cgcccaggagacatc

SEQ ID NO: 2516182 - DNA, 20 bp, Homo sapiens
cgcccaggctggagtgcagt

SEQ ID NO: 2516183 - DNA, 12 bp, Homo sapiens
cgcccagtctgg

SEQ ID NO: 2516184 - DNA, 13 bp, Homo sapiens
cgcccagtctgga

SEQ ID NO: 2516185 - DNA, 13 bp, Homo sapiens
cgccccacccaga

SEQ ID NO: 2516186 - DNA, 15 bp, Homo sapiens
cgcccccactggtga

SEQ ID NO: 2516187 - DNA, 23 bp, Homo sapiens
cgcccccgggtttggcgggccaa

SEQ ID NO: 2516188 - DNA, 14 bp, Homo sapiens
cgccccctcctcta

SEQ ID NO: 2516189 - DNA, 15 bp, Homo sapiens
cgccccctgccctcc

SEQ ID NO: 2516190 - DNA, 19 bp, Homo sapiens
cgccccctgccctcccctc

SEQ ID NO: 2516191 - DNA, 14 bp, Homo sapiens
cgcccgcccactgt

SEQ ID NO: 2516192 - DNA, 19 bp, Homo sapiens
cgcccgcccactgtcctgg

SEQ ID NO: 2516193 - DNA, 16 bp, Homo sapiens
cgcccgctgggctgag

SEQ ID NO: 2516194 - DNA, 15 bp, Homo sapiens
cgccctgctcctccc

SEQ ID NO: 2516195 - DNA, 13 bp, Homo sapiens
cgccctggaagcc

SEQ ID NO: 2516196 - DNA, 16 bp, Homo sapiens
cgccctggaagccggc

SEQ ID NO: 2516197 - DNA, 18 bp, Homo sapiens
cgccgagtctgtctctgt

SEQ ID NO: 2516198 - DNA, 14 bp, Homo sapiens
cgccgcctggtact

SEQ ID NO: 2516199 - DNA, 15 bp, Homo sapiens
cgccgcctggtactc

SEQ ID NO: 2516200 - DNA, 22 bp, Homo sapiens
cgccggcaaaactttggcactg

SEQ ID NO: 2516201 - DNA, 18 bp, Homo sapiens
cgccggcgggcgggccgg

SEQ ID NO: 2516202 - DNA, 22 bp, Homo sapiens
cgccggggacagaggcctgccc

SEQ ID NO: 2516203 - DNA, 17 bp, Homo sapiens
cgccgtgagttctcagg

SEQ ID NO: 2516204 - DNA, 19 bp, Homo sapiens
cgccgtgagttctcagggc

SEQ ID NO: 2516205 - DNA, 23 bp, Homo sapiens
cgccgtgagttctcagggctcct

SEQ ID NO: 2516206 - DNA, 14 bp, Homo sapiens
cgcctacaggagtg

SEQ ID NO: 2516207 - DNA, 21 bp, Homo sapiens
cgcctccatttttgttgttat

SEQ ID NO: 2516208 - DNA, 15 bp, Homo sapiens
cgcctcccagcctgg

SEQ ID NO: 2516209 - DNA, 24 bp, Homo sapiens
cgcctccccacggccgctccaggg

SEQ ID NO: 2516210 - DNA, 16 bp, Homo sapiens
cgcctgagctcactcg

SEQ ID NO: 2516211 - DNA, 20 bp, Homo sapiens
cgcctgaggaacccttacag

SEQ ID NO: 2516212 - DNA, 15 bp, Homo sapiens
cgcctgccagtccta

SEQ ID NO: 2516213 - DNA, 15 bp, Homo sapiens
cgcctgcccctccca

SEQ ID NO: 2516214 - DNA, 22 bp, Homo sapiens
cgcctgccctcatggcccctct

SEQ ID NO: 2516215 - DNA, 11 bp, Homo sapiens
cgcctggcaga

SEQ ID NO: 2516216 - DNA, 18 bp, Homo sapiens
cgcctgtaatcccagcac

SEQ ID NO: 2516217 - DNA, 20 bp, Homo sapiens
cgcctgtaatcccagctact

SEQ ID NO: 2516218 - DNA, 20 bp, Homo sapiens
cgcctgtagtcccagctact

SEQ ID NO: 2516219 - DNA, 23 bp, Homo sapiens
cgccttaggtacttattccagat

SEQ ID NO: 2516220 - DNA, 12 bp, Homo sapiens
cgccttgttctt

SEQ ID NO: 2516221 - DNA, 13 bp, Homo sapiens
cgcctttcccagg

SEQ ID NO: 2516222 - DNA, 21 bp, Homo sapiens
cgcggcggagctggccccgcc

SEQ ID NO: 2516223 - DNA, 23 bp, Homo sapiens
cgcggcggagctggccccgccgc

SEQ ID NO: 2516224 - DNA, 15 bp, Homo sapiens
cgcggggacattggg

SEQ ID NO: 2516225 - DNA, 21 bp, Homo sapiens
cgcgtcgccctcccaggctct

SEQ ID NO: 2516226 - DNA, 22 bp, Homo sapiens
cgctaagagggagggagggctc

SEQ ID NO: 2516227 - DNA, 24 bp, Homo sapiens
cgctacccgggaagggggctggga

SEQ ID NO: 2516228 - DNA, 13 bp, Homo sapiens
cgctagaggcctg

SEQ ID NO: 2516229 - DNA, 14 bp, Homo sapiens
cgctagaggcctga

SEQ ID NO: 2516230 - DNA, 16 bp, Homo sapiens
cgctcctgtctgccag

SEQ ID NO: 2516231 - DNA, 20 bp, Homo sapiens
cgctctgcatgcggcccagc

SEQ ID NO: 2516232 - DNA, 21 bp, Homo sapiens
cgctctgcatgcggcccagcc

SEQ ID NO: 2516233 - DNA, 20 bp, Homo sapiens
cgctctgctggcctggccgg

SEQ ID NO: 2516234 - DNA, 13 bp, Homo sapiens
cgctgaataaatg

SEQ ID NO: 2516235 - DNA, 15 bp, Homo sapiens
cgctgccagctctgt

SEQ ID NO: 2516236 - DNA, 19 bp, Homo sapiens
cgctgccagctctgtatca

SEQ ID NO: 2516237 - DNA, 18 bp, Homo sapiens
cgctgcccaggggagccc

SEQ ID NO: 2516238 - DNA, 20 bp, Homo sapiens
cgctggactctcagtctctg

SEQ ID NO: 2516239 - DNA, 17 bp, Homo sapiens
cgctggagtgcagtgag

SEQ ID NO: 2516240 - DNA, 24 bp, Homo sapiens
cgctggcccagccggcctctctgg

SEQ ID NO: 2516241 - DNA, 17 bp, Homo sapiens
cgctgggctgagcccct

SEQ ID NO: 2516242 - DNA, 14 bp, Homo sapiens
cgctgtctccagac

SEQ ID NO: 2516243 - DNA, 19 bp, Homo sapiens
cgctgtgagcccctggtcc

SEQ ID NO: 2516244 - DNA, 11 bp, Homo sapiens
cgctgtgctgc

SEQ ID NO: 2516245 - DNA, 15 bp, Homo sapiens
cgctgtgctgccctg

SEQ ID NO: 2516246 - DNA, 16 bp, Homo sapiens
cgctgtgctgccctgc

SEQ ID NO: 2516247 - DNA, 17 bp, Homo sapiens
cgctgtgctgccctgcc

SEQ ID NO: 2516248 - DNA, 19 bp, Homo sapiens
cgctgtgctgccctgccca

SEQ ID NO: 2516249 - DNA, 17 bp, Homo sapiens
cgcttccggctcctgtg

SEQ ID NO: 2516250 - DNA, 22 bp, Homo sapiens
cgctttctagctgttgagctgt

SEQ ID NO: 2516251 - DNA, 17 bp, Homo sapiens
cggaaaccttggtgtag

SEQ ID NO: 2516252 - DNA, 20 bp, Homo sapiens
cggaaagcagctcaaaggca

SEQ ID NO: 2516253 - DNA, 18 bp, Homo sapiens
cggaaggctggctgggca

SEQ ID NO: 2516254 - DNA, 13 bp, Homo sapiens
cggacaagtttta

SEQ ID NO: 2516255 - DNA, 14 bp, Homo sapiens
cggacactcctaga

SEQ ID NO: 2516256 - DNA, 16 bp, Homo sapiens
cggacactcctagaga

SEQ ID NO: 2516257 - DNA, 21 bp, Homo sapiens
cggaccttggcagcccaggcc

SEQ ID NO: 2516258 - DNA, 15 bp, Homo sapiens
cggacgttccagccg

SEQ ID NO: 2516259 - DNA, 16 bp, Homo sapiens
cggacgttccagccgg

SEQ ID NO: 2516260 - DNA, 20 bp, Homo sapiens
cggactaagcctacctgctc

SEQ ID NO: 2516261 - DNA, 21 bp, Homo sapiens
cggactaagcctacctgctct

SEQ ID NO: 2516262 - DNA, 17 bp, Homo sapiens
cggagacggagtcccac

SEQ ID NO: 2516263 - DNA, 23 bp, Homo sapiens
cggagagcgcctgcccctcccag

SEQ ID NO: 2516264 - DNA, 17 bp, Homo sapiens
cggagagtacagtgagc

SEQ ID NO: 2516265 - DNA, 19 bp, Homo sapiens
cggagattggacggcctga

SEQ ID NO: 2516266 - DNA, 11 bp, Homo sapiens
cggagccactc

SEQ ID NO: 2516267 - DNA, 17 bp, Homo sapiens
cggagccactcctctga

SEQ ID NO: 2516268 - DNA, 21 bp, Homo sapiens
cggagccactcctctgactca

SEQ ID NO: 2516269 - DNA, 14 bp, Homo sapiens
cggagccccaggcc

SEQ ID NO: 2516270 - DNA, 22 bp, Homo sapiens
cggagccccaggcctctgtgtc

SEQ ID NO: 2516271 - DNA, 22 bp, Homo sapiens
ctaattggaagaaattcctgta

SEQ ID NO: 2516272 - DNA, 19 bp, Homo sapiens
ctaattggcctctttaaga

SEQ ID NO: 2516273 - DNA, 19 bp, Homo sapiens
ctaattgtataacaggtta

SEQ ID NO: 2516274 - DNA, 12 bp, Homo sapiens
ctaatttaaaaa

SEQ ID NO: 2516275 - DNA, 21 bp, Homo sapiens
ctaatttcaaaaatataactt

SEQ ID NO: 2516276 - DNA, 23 bp, Homo sapiens
ctacaaaaaattagaaattggct

SEQ ID NO: 2516277 - DNA, 19 bp, Homo sapiens
ctacaaaaagcataaaaat

SEQ ID NO: 2516278 - DNA, 17 bp, Homo sapiens
ctacaaaatttgaaatt

SEQ ID NO: 2516279 - DNA, 18 bp, Homo sapiens
ctacaaaatttgaaattt

SEQ ID NO: 2516280 - DNA, 15 bp, Homo sapiens
ctacaaagaagacat

SEQ ID NO: 2516281 - DNA, 16 bp, Homo sapiens
ctacaaagaagacatg

SEQ ID NO: 2516282 - DNA, 18 bp, Homo sapiens
ctacaaagaagacatgtt

SEQ ID NO: 2516283 - DNA, 16 bp, Homo sapiens
ctacaacaagagttta

SEQ ID NO: 2516284 - DNA, 15 bp, Homo sapiens
ctacaagagcagcct

SEQ ID NO: 2516285 - DNA, 21 bp, Homo sapiens
ctacaagagcagcctgtggca

SEQ ID NO: 2516286 - DNA, 15 bp, Homo sapiens
ctacaattttctccc

SEQ ID NO: 2516287 - DNA, 15 bp, Homo sapiens
ctacacactgcatgt

SEQ ID NO: 2516288 - DNA, 21 bp, Homo sapiens
ctacacagggatgtacaaggc

SEQ ID NO: 2516289 - DNA, 16 bp, Homo sapiens
ctacacccttttccag

SEQ ID NO: 2516290 - DNA, 17 bp, Homo sapiens
ctacactccagcctgag

SEQ ID NO: 2516291 - DNA, 17 bp, Homo sapiens
ctacactccagtgagac

SEQ ID NO: 2516292 - DNA, 13 bp, Homo sapiens
ctacactgtgctg

SEQ ID NO: 2516293 - DNA, 14 bp, Homo sapiens
ctacactgtgctga

SEQ ID NO: 2516294 - DNA, 14 bp, Homo sapiens
ctacagatagtcaa

SEQ ID NO: 2516295 - DNA, 15 bp, Homo sapiens
ctacaggcacccacc

SEQ ID NO: 2516296 - DNA, 17 bp, Homo sapiens
ctacaggcacccaccat

SEQ ID NO: 2516297 - DNA, 14 bp, Homo sapiens
ctacaggttacaac

SEQ ID NO: 2516298 - DNA, 17 bp, Homo sapiens
ctacaggttacaacaga

SEQ ID NO: 2516299 - DNA, 14 bp, Homo sapiens
ctacagtcaggaaa

SEQ ID NO: 2516300 - DNA, 18 bp, Homo sapiens
ctacagtcctcccatctc

SEQ ID NO: 2516301 - DNA, 13 bp, Homo sapiens
ctacagtgtacag

SEQ ID NO: 2516302 - DNA, 15 bp, Homo sapiens
ctacagtgtacagtc

SEQ ID NO: 2516303 - DNA, 13 bp, Homo sapiens
ctacagttgaaaa

SEQ ID NO: 2516304 - DNA, 22 bp, Homo sapiens
ctacagttgttttttgaaaaca

SEQ ID NO: 2516305 - DNA, 18 bp, Homo sapiens
ctacataaactgacttta

SEQ ID NO: 2516306 - DNA, 10 bp, Homo sapiens
ctacatgaaa

SEQ ID NO: 2516307 - DNA, 22 bp, Homo sapiens
ctacattataaatgtctcttta

SEQ ID NO: 2516308 - DNA, 13 bp, Homo sapiens
ctacattctgtta

SEQ ID NO: 2516309 - DNA, 19 bp, Homo sapiens
ctaccaagctatcctggct

SEQ ID NO: 2516310 - DNA, 13 bp, Homo sapiens
ctaccaatgcatg

SEQ ID NO: 2516311 - DNA, 14 bp, Homo sapiens
ctaccaccccttcc

SEQ ID NO: 2516312 - DNA, 18 bp, Homo sapiens
ctaccaccccttcctgtc

SEQ ID NO: 2516313 - DNA, 11 bp, Homo sapiens
ctaccacctcc

SEQ ID NO: 2516314 - DNA, 18 bp, Homo sapiens
ctaccatcagggacagga

SEQ ID NO: 2516315 - DNA, 20 bp, Homo sapiens
ctaccatttgcagagtcctg

SEQ ID NO: 2516316 - DNA, 16 bp, Homo sapiens
ctacccacacctctgc

SEQ ID NO: 2516317 - DNA, 16 bp, Homo sapiens
ctacccacttctaaat

SEQ ID NO: 2516318 - DNA, 18 bp, Homo sapiens
ctacccagagaagcccct

SEQ ID NO: 2516319 - DNA, 21 bp, Homo sapiens
ctacccagagaagccccttcc

SEQ ID NO: 2516320 - DNA, 19 bp, Homo sapiens
ctacccagcgagccctggt

SEQ ID NO: 2516321 - DNA, 20 bp, Homo sapiens
ctacccagcgagccctggtg

SEQ ID NO: 2516322 - DNA, 16 bp, Homo sapiens
ctaccccaattccttg

SEQ ID NO: 2516323 - DNA, 17 bp, Homo sapiens
ctaccccaattccttgt

SEQ ID NO: 2516324 - DNA, 17 bp, Homo sapiens
ctaccccctcctctctg

SEQ ID NO: 2516325 - DNA, 20 bp, Homo sapiens
ctacccctgatctgacatcc

SEQ ID NO: 2516326 - DNA, 15 bp, Homo sapiens
ctacccgggaagggg

SEQ ID NO: 2516327 - DNA, 21 bp, Homo sapiens
ctacccgggaagggggctggg

SEQ ID NO: 2516328 - DNA, 18 bp, Homo sapiens
ctaccctagccattcctg

SEQ ID NO: 2516329 - DNA, 13 bp, Homo sapiens
ctaccctcccacc

SEQ ID NO: 2516330 - DNA, 17 bp, Homo sapiens
ctaccctcgggcccacc

SEQ ID NO: 2516331 - DNA, 20 bp, Homo sapiens
ctaccctcgggcccacctgg

SEQ ID NO: 2516332 - DNA, 22 bp, Homo sapiens
ctaccctcgggcccacctggcc

SEQ ID NO: 2516333 - DNA, 12 bp, Homo sapiens
ctaccctgagct

SEQ ID NO: 2516334 - DNA, 17 bp, Homo sapiens
ctaccctgagctgaggc

SEQ ID NO: 2516335 - DNA, 11 bp, Homo sapiens
ctacctcagcc

SEQ ID NO: 2516336 - DNA, 12 bp, Homo sapiens
ctacctcagcct

SEQ ID NO: 2516337 - DNA, 14 bp, Homo sapiens
ctacctcagcctag

SEQ ID NO: 2516338 - DNA, 14 bp, Homo sapiens
ctacctcaggcagg

SEQ ID NO: 2516339 - DNA, 23 bp, Homo sapiens
ctacctcaggcaggaagggcagg

SEQ ID NO: 2516340 - DNA, 15 bp, Homo sapiens
ctacctcaggttgct

SEQ ID NO: 2516341 - DNA, 17 bp, Homo sapiens
ctacctcaggttgctgg

SEQ ID NO: 2516342 - DNA, 19 bp, Homo sapiens
ctacctgacactcccttgg

SEQ ID NO: 2516343 - DNA, 16 bp, Homo sapiens
ctacctgaggggcctc

SEQ ID NO: 2516344 - DNA, 20 bp, Homo sapiens
ctacctgattggtgcaaccc

SEQ ID NO: 2516345 - DNA, 13 bp, Homo sapiens
ctacctgtgcctg

SEQ ID NO: 2516346 - DNA, 12 bp, Homo sapiens
ctaccttctgta

SEQ ID NO: 2516347 - DNA, 14 bp, Homo sapiens
ctaccttctgtagt

SEQ ID NO: 2516348 - DNA, 21 bp, Homo sapiens
ctaccttggttcccccactga

SEQ ID NO: 2516349 - DNA, 14 bp, Homo sapiens
ctaccttgtgaccc

SEQ ID NO: 2516350 - DNA, 21 bp, Homo sapiens
ctacgctctcctttctttcta

SEQ ID NO: 2516351 - DNA, 17 bp, Homo sapiens
ctacgtacatgtgaggc

SEQ ID NO: 2516352 - DNA, 18 bp, Homo sapiens
ctacgtgtgatttttctg

SEQ ID NO: 2516353 - DNA, 16 bp, Homo sapiens
ctacgttaagggaagg

SEQ ID NO: 2516354 - DNA, 19 bp, Homo sapiens
ctacgttcctattgtcatt

SEQ ID NO: 2516355 - DNA, 15 bp, Homo sapiens
ctactaaaaatgcaa

SEQ ID NO: 2516356 - DNA, 14 bp, Homo sapiens
ctactaatgatgtt

SEQ ID NO: 2516357 - DNA, 18 bp, Homo sapiens
ctactatgccagatgcct

SEQ ID NO: 2516358 - DNA, 17 bp, Homo sapiens
ctactcacagtctcttt

SEQ ID NO: 2516359 - DNA, 21 bp, Homo sapiens
ctactcagaagcctgaggctg

SEQ ID NO: 2516360 - DNA, 14 bp, Homo sapiens
ctactcctctgcag

SEQ ID NO: 2516361 - DNA, 18 bp, Homo sapiens
ctactctcccatggctta

SEQ ID NO: 2516362 - DNA, 22 bp, Homo sapiens
ctactctggaggtttgtttaga

SEQ ID NO: 2516363 - DNA, 16 bp, Homo sapiens
ctactctgtgtcaggt

SEQ ID NO: 2516364 - DNA, 15 bp, Homo sapiens
ctactcttaagccat

SEQ ID NO: 2516365 - DNA, 17 bp, Homo sapiens
ctactgactttctcagc

SEQ ID NO: 2516366 - DNA, 17 bp, Homo sapiens
ctactgattgtttcatt

SEQ ID NO: 2516367 - DNA, 17 bp, Homo sapiens
ctactgcagctttacat

SEQ ID NO: 2516368 - DNA, 21 bp, Homo sapiens
ctactgtggaaaaatatttaa

SEQ ID NO: 2516369 - DNA, 12 bp, Homo sapiens
ctactgtgttcc

SEQ ID NO: 2516370 - DNA, 18 bp, Homo sapiens
ctacttgggaggctgaga

SEQ ID NO: 2516371 - DNA, 13 bp, Homo sapiens
ctacttgggccat

SEQ ID NO: 2516372 - DNA, 19 bp, Homo sapiens
ctactttgactttttgcat

SEQ ID NO: 2516373 - DNA, 20 bp, Homo sapiens
ctactttgtcctttttgtta

SEQ ID NO: 2516374 - DNA, 16 bp, Homo sapiens
ctagaaacttccaaat

SEQ ID NO: 2516375 - DNA, 22 bp, Homo sapiens
ctagaaagcctgttcccctcac

SEQ ID NO: 2516376 - DNA, 17 bp, Homo sapiens
ctagaaatatgatttta

SEQ ID NO: 2516377 - DNA, 13 bp, Homo sapiens
ctagaaatttttc

SEQ ID NO: 2516378 - DNA, 14 bp, Homo sapiens
ctagaacacaggca

SEQ ID NO: 2516379 - DNA, 22 bp, Homo sapiens
ctagaacacaggcaaaatcctt

SEQ ID NO: 2516380 - DNA, 18 bp, Homo sapiens
ctagaacctagaagggct

SEQ ID NO: 2516381 - DNA, 15 bp, Homo sapiens
ctagaacctggagag

SEQ ID NO: 2516382 - DNA, 19 bp, Homo sapiens
ctagaaggccacatgtcac

SEQ ID NO: 2516383 - DNA, 21 bp, Homo sapiens
ctagaagggctagaacctgga

SEQ ID NO: 2516384 - DNA, 16 bp, Homo sapiens
ctagaagttactgaat

SEQ ID NO: 2516385 - DNA, 17 bp, Homo sapiens
ctagaagttactgaatg

SEQ ID NO: 2516386 - DNA, 19 bp, Homo sapiens
ctagaatatcctacttctc

SEQ ID NO: 2516387 - DNA, 13 bp, Homo sapiens
ctagacaaccctg

SEQ ID NO: 2516388 - DNA, 16 bp, Homo sapiens
ctagacaaccctgcaa

SEQ ID NO: 2516389 - DNA, 14 bp, Homo sapiens
ctagacattctgtc

SEQ ID NO: 2516390 - DNA, 18 bp, Homo sapiens
ctagactcccaagctgga

SEQ ID NO: 2516391 - DNA, 16 bp, Homo sapiens
ctagagaacgcagccc

SEQ ID NO: 2516392 - DNA, 12 bp, Homo sapiens
ctagagaagagg

SEQ ID NO: 2516393 - DNA, 15 bp, Homo sapiens
ctagagaagaggctg

SEQ ID NO: 2516394 - DNA, 15 bp, Homo sapiens
ctagagacagaagca

SEQ ID NO: 2516395 - DNA, 20 bp, Homo sapiens
ctagagacagaagcaggctg

SEQ ID NO: 2516396 - DNA, 22 bp, Homo sapiens
ctagagacagaagcaggctgga

SEQ ID NO: 2516397 - DNA, 22 bp, Homo sapiens
ctagagatctggttttgctatt

SEQ ID NO: 2516398 - DNA, 11 bp, Homo sapiens
ctagagcctgc

SEQ ID NO: 2516399 - DNA, 14 bp, Homo sapiens
ctagagcctgcctg

SEQ ID NO: 2516400 - DNA, 17 bp, Homo sapiens
ctagagcctgcctggag

SEQ ID NO: 2516401 - DNA, 14 bp, Homo sapiens
ctagaggcagggag

SEQ ID NO: 2516402 - DNA, 18 bp, Homo sapiens
ctagaggcagggagggga

SEQ ID NO: 2516403 - DNA, 21 bp, Homo sapiens
ctagaggccagccccacccag

SEQ ID NO: 2516404 - DNA, 21 bp, Homo sapiens
ctagagggacctctcccaggg

SEQ ID NO: 2516405 - DNA, 19 bp, Homo sapiens
ctagagggttcctgtagac

SEQ ID NO: 2516406 - DNA, 17 bp, Homo sapiens
ctagaggttcaaagata

SEQ ID NO: 2516407 - DNA, 15 bp, Homo sapiens
ctagagtcctcactc

SEQ ID NO: 2516408 - DNA, 19 bp, Homo sapiens
ctagagtcctcactcccag

SEQ ID NO: 2516409 - DNA, 24 bp, Homo sapiens
ctagatactgtatcatgacaaaga

SEQ ID NO: 2516410 - DNA, 13 bp, Homo sapiens
ctagatttatgaa

SEQ ID NO: 2516411 - DNA, 17 bp, Homo sapiens
ctagcagaaatctagaa

SEQ ID NO: 2516412 - DNA, 11 bp, Homo sapiens
ctagcagagag

SEQ ID NO: 2516413 - DNA, 16 bp, Homo sapiens
ctagcatacgtacaca

SEQ ID NO: 2516414 - DNA, 19 bp, Homo sapiens
ctagcatacgtacacattt

SEQ ID NO: 2516415 - DNA, 20 bp, Homo sapiens
ctagcatacgtacacatttt

SEQ ID NO: 2516416 - DNA, 21 bp, Homo sapiens
ctagcatacgtacacatttta

SEQ ID NO: 2516417 - DNA, 21 bp, Homo sapiens
ctagcatatgagtttcatagc

SEQ ID NO: 2516418 - DNA, 18 bp, Homo sapiens
ctagccctctcacattta

SEQ ID NO: 2516419 - DNA, 17 bp, Homo sapiens
ctagccgacctcagcct

SEQ ID NO: 2516420 - DNA, 22 bp, Homo sapiens
ctagcctgtgcctctgggactg

SEQ ID NO: 2516421 - DNA, 22 bp, Homo sapiens
ctagccttaatcaggtcctcag

SEQ ID NO: 2516422 - DNA, 22 bp, Homo sapiens
ctagccttagaagtcacacagt

SEQ ID NO: 2516423 - DNA, 13 bp, Homo sapiens
cccccgagctggg

SEQ ID NO: 2516424 - DNA, 12 bp, Homo sapiens
cccccgccactc

SEQ ID NO: 2516425 - DNA, 11 bp, Homo sapiens
cccccgccccg

SEQ ID NO: 2516426 - DNA, 18 bp, Homo sapiens
cccccgccccgccccaca

SEQ ID NO: 2516427 - DNA, 15 bp, Homo sapiens
cccccggccccctgg

SEQ ID NO: 2516428 - DNA, 16 bp, Homo sapiens
ccccctcaaacctcct

SEQ ID NO: 2516429 - DNA, 21 bp, Homo sapiens
ccccctcatctcattcaaacc

SEQ ID NO: 2516430 - DNA, 12 bp, Homo sapiens
ccccctcccacc

SEQ ID NO: 2516431 - DNA, 14 bp, Homo sapiens
ccccctccctggcc

SEQ ID NO: 2516432 - DNA, 22 bp, Homo sapiens
ccccctcctctcccatccccct

SEQ ID NO: 2516433 - DNA, 17 bp, Homo sapiens
ccccctgacaacactca

SEQ ID NO: 2516434 - DNA, 19 bp, Homo sapiens
ccccctgacaacactcatt

SEQ ID NO: 2516435 - DNA, 16 bp, Homo sapiens
ccccctgccccccagc

SEQ ID NO: 2516436 - DNA, 22 bp, Homo sapiens
ccccctgccccccagcctctgg

SEQ ID NO: 2516437 - DNA, 20 bp, Homo sapiens
ccccctgctggctcttctgc

SEQ ID NO: 2516438 - DNA, 13 bp, Homo sapiens
ccccctgggctct

SEQ ID NO: 2516439 - DNA, 15 bp, Homo sapiens
ccccctggtctctgg

SEQ ID NO: 2516440 - DNA, 21 bp, Homo sapiens
ccccctggtggacagtcctgg

SEQ ID NO: 2516441 - DNA, 11 bp, Homo sapiens
cccccttccac

SEQ ID NO: 2516442 - DNA, 22 bp, Homo sapiens
cccccttctctgctccaccaca

SEQ ID NO: 2516443 - DNA, 14 bp, Homo sapiens
cccccttgagtggg

SEQ ID NO: 2516444 - DNA, 22 bp, Homo sapiens
ccccctttcagatgtcttctgc

SEQ ID NO: 2516445 - DNA, 12 bp, Homo sapiens
ccccctttcctg

SEQ ID NO: 2516446 - DNA, 17 bp, Homo sapiens
ccccctttgggcccagg

SEQ ID NO: 2516447 - DNA, 16 bp, Homo sapiens
ccccctttgtgctgtg

SEQ ID NO: 2516448 - DNA, 17 bp, Homo sapiens
ccccctttgtgctgtgg

SEQ ID NO: 2516449 - DNA, 23 bp, Homo sapiens
ccccgaggccttctctgaaggac

SEQ ID NO: 2516450 - DNA, 21 bp, Homo sapiens
ccccgagtttccccagacacc

SEQ ID NO: 2516451 - DNA, 12 bp, Homo sapiens
ccccgcccaggc

SEQ ID NO: 2516452 - DNA, 13 bp, Homo sapiens
ccccgccccgccc

SEQ ID NO: 2516453 - DNA, 16 bp, Homo sapiens
ccccgccccgccccac

SEQ ID NO: 2516454 - DNA, 21 bp, Homo sapiens
ccccgctctgcatgcggccca

SEQ ID NO: 2516455 - DNA, 22 bp, Homo sapiens
ccccgctctgcatgcggcccag

SEQ ID NO: 2516456 - DNA, 23 bp, Homo sapiens
ccccgctctgcatgcggcccagc

SEQ ID NO: 2516457 - DNA, 13 bp, Homo sapiens
ccccggccacctg

SEQ ID NO: 2516458 - DNA, 17 bp, Homo sapiens
ccccggccccagccaga

SEQ ID NO: 2516459 - DNA, 19 bp, Homo sapiens
ccccggccccagccagagt

SEQ ID NO: 2516460 - DNA, 18 bp, Homo sapiens
ccccggccctaccagcgc

SEQ ID NO: 2516461 - DNA, 12 bp, Homo sapiens
ccccggccctgg

SEQ ID NO: 2516462 - DNA, 19 bp, Homo sapiens
ccccgggtttggcgggcca

SEQ ID NO: 2516463 - DNA, 21 bp, Homo sapiens
ccccgtcaccatctcaggcca

SEQ ID NO: 2516464 - DNA, 23 bp, Homo sapiens
cccctaatgacatcaccacagtt

SEQ ID NO: 2516465 - DNA, 15 bp, Homo sapiens
cccctaccactgtct

SEQ ID NO: 2516466 - DNA, 13 bp, Homo sapiens
cccctaccccaca

SEQ ID NO: 2516467 - DNA, 22 bp, Homo sapiens
cccctaccccacaccaggccgt

SEQ ID NO: 2516468 - DNA, 20 bp, Homo sapiens
cccctagtaagtgccttcca

SEQ ID NO: 2516469 - DNA, 21 bp, Homo sapiens
cccctcaaacctcctcttctg

SEQ ID NO: 2516470 - DNA, 18 bp, Homo sapiens
cccctcaaatcgtccagc

SEQ ID NO: 2516471 - DNA, 16 bp, Homo sapiens
cccctcaacacctctg

SEQ ID NO: 2516472 - DNA, 13 bp, Homo sapiens
cccctcacctcct

SEQ ID NO: 2516473 - DNA, 15 bp, Homo sapiens
cccctcaccttgcaa

SEQ ID NO: 2516474 - DNA, 12 bp, Homo sapiens
cccctcactctg

SEQ ID NO: 2516475 - DNA, 17 bp, Homo sapiens
cccctcagggtccctgg

SEQ ID NO: 2516476 - DNA, 22 bp, Homo sapiens
cccctcagggtccctggtggca

SEQ ID NO: 2516477 - DNA, 16 bp, Homo sapiens
cccctccaatcctgcc

SEQ ID NO: 2516478 - DNA, 13 bp, Homo sapiens
cccctccagcttg

SEQ ID NO: 2516479 - DNA, 12 bp, Homo sapiens
cccctccatgtg

SEQ ID NO: 2516480 - DNA, 16 bp, Homo sapiens
cccctcccacccaccg

SEQ ID NO: 2516481 - DNA, 12 bp, Homo sapiens
cccctcccagaa

SEQ ID NO: 2516482 - DNA, 11 bp, Homo sapiens
cccctcccatc

SEQ ID NO: 2516483 - DNA, 13 bp, Homo sapiens
cccctcccattag

SEQ ID NO: 2516484 - DNA, 16 bp, Homo sapiens
cccctcccccaacccc

SEQ ID NO: 2516485 - DNA, 21 bp, Homo sapiens
cccctccccggccctaccagc

SEQ ID NO: 2516486 - DNA, 13 bp, Homo sapiens
cccctccctgtca

SEQ ID NO: 2516487 - DNA, 17 bp, Homo sapiens
cccctcctctagctgtg

SEQ ID NO: 2516488 - DNA, 11 bp, Homo sapiens
cccctcctctc

SEQ ID NO: 2516489 - DNA, 15 bp, Homo sapiens
cccctccttccttga

SEQ ID NO: 2516490 - DNA, 17 bp, Homo sapiens
cccctccttccttgacc

SEQ ID NO: 2516491 - DNA, 20 bp, Homo sapiens
cccctccttccttgaccagc

SEQ ID NO: 2516492 - DNA, 12 bp, Homo sapiens
cccctccttctc

SEQ ID NO: 2516493 - DNA, 14 bp, Homo sapiens
cccctccttgctct

SEQ ID NO: 2516494 - DNA, 13 bp, Homo sapiens
cccctccttgggc

SEQ ID NO: 2516495 - DNA, 15 bp, Homo sapiens
cccctcggagaagag

SEQ ID NO: 2516496 - DNA, 12 bp, Homo sapiens
cccctctctcct

SEQ ID NO: 2516497 - DNA, 11 bp, Homo sapiens
cccctctctgc

SEQ ID NO: 2516498 - DNA, 12 bp, Homo sapiens
cccctctgccca

SEQ ID NO: 2516499 - DNA, 13 bp, Homo sapiens
cccctctgcccag

SEQ ID NO: 2516500 - DNA, 18 bp, Homo sapiens
cccctctgcccagcttgg

SEQ ID NO: 2516501 - DNA, 12 bp, Homo sapiens
cccctctgtcca

SEQ ID NO: 2516502 - DNA, 12 bp, Homo sapiens
cccctgattaca

SEQ ID NO: 2516503 - DNA, 18 bp, Homo sapiens
cccctgcactccagcctg

SEQ ID NO: 2516504 - DNA, 22 bp, Homo sapiens
cccctgcactggagtccagtct

SEQ ID NO: 2516505 - DNA, 14 bp, Homo sapiens
cccctgccaccctg

SEQ ID NO: 2516506 - DNA, 21 bp, Homo sapiens
cccctgccacctccctgaccc

SEQ ID NO: 2516507 - DNA, 14 bp, Homo sapiens
cccctgccagggca

SEQ ID NO: 2516508 - DNA, 22 bp, Homo sapiens
cccctgccccgtcaccatctca

SEQ ID NO: 2516509 - DNA, 14 bp, Homo sapiens
cccctgccctgctg

SEQ ID NO: 2516510 - DNA, 13 bp, Homo sapiens
cccctgctgcctc

SEQ ID NO: 2516511 - DNA, 14 bp, Homo sapiens
cccctgctgggtgt

SEQ ID NO: 2516512 - DNA, 11 bp, Homo sapiens
cccctgctggt

SEQ ID NO: 2516513 - DNA, 15 bp, Homo sapiens
cccctggagagaagt

SEQ ID NO: 2516514 - DNA, 11 bp, Homo sapiens
cccctgggctc

SEQ ID NO: 2516515 - DNA, 13 bp, Homo sapiens
cccctgggctctg

SEQ ID NO: 2516516 - DNA, 21 bp, Homo sapiens
cccctgggctctgccccagct

SEQ ID NO: 2516517 - DNA, 23 bp, Homo sapiens
cccctgggtgggtggtggggagg

SEQ ID NO: 2516518 - DNA, 15 bp, Homo sapiens
cccctggtggacagt

SEQ ID NO: 2516519 - DNA, 21 bp, Homo sapiens
cccctggtggacagtcctggg

SEQ ID NO: 2516520 - DNA, 22 bp, Homo sapiens
cccctggtggacagtcctggga

SEQ ID NO: 2516521 - DNA, 23 bp, Homo sapiens
cccctggtggacagtcctgggag

SEQ ID NO: 2516522 - DNA, 19 bp, Homo sapiens
cccctgtgcagccgctgag

SEQ ID NO: 2516523 - DNA, 20 bp, Homo sapiens
cccctgtggggatctcaggg

SEQ ID NO: 2516524 - DNA, 22 bp, Homo sapiens
ccccttcacttctgaccacact

SEQ ID NO: 2516525 - DNA, 23 bp, Homo sapiens
ccccttcacttctgaccacactt

SEQ ID NO: 2516526 - DNA, 16 bp, Homo sapiens
ccccttcatcctctga

SEQ ID NO: 2516527 - DNA, 21 bp, Homo sapiens
ccccttccccactgcctgccc

SEQ ID NO: 2516528 - DNA, 23 bp, Homo sapiens
ccccttccccactgcctgcccac

SEQ ID NO: 2516529 - DNA, 13 bp, Homo sapiens
ccccttccctgca

SEQ ID NO: 2516530 - DNA, 18 bp, Homo sapiens
ccccttccctgcaaacat

SEQ ID NO: 2516531 - DNA, 15 bp, Homo sapiens
ccccttctcatcact

SEQ ID NO: 2516532 - DNA, 24 bp, Homo sapiens
cctgttggatttgtttaaaaggat

SEQ ID NO: 2516533 - DNA, 13 bp, Homo sapiens
cctgttggttcca

SEQ ID NO: 2516534 - DNA, 21 bp, Homo sapiens
cctgttggttccaagccctgg

SEQ ID NO: 2516535 - DNA, 16 bp, Homo sapiens
cctgtttaatatttaa

SEQ ID NO: 2516536 - DNA, 21 bp, Homo sapiens
cctgtttaatatttaaacagc

SEQ ID NO: 2516537 - DNA, 18 bp, Homo sapiens
cctgtttgtttctgaaag

SEQ ID NO: 2516538 - DNA, 20 bp, Homo sapiens
ccttaaacaaaaattaaaat

SEQ ID NO: 2516539 - DNA, 23 bp, Homo sapiens
ccttaaagaaagtcgaattaata

SEQ ID NO: 2516540 - DNA, 14 bp, Homo sapiens
ccttaactggagcc

SEQ ID NO: 2516541 - DNA, 23 bp, Homo sapiens
ccttaatcaggtcctcagagaat

SEQ ID NO: 2516542 - DNA, 15 bp, Homo sapiens
ccttacacttactgt

SEQ ID NO: 2516543 - DNA, 17 bp, Homo sapiens
ccttacagtaggagccc

SEQ ID NO: 2516544 - DNA, 15 bp, Homo sapiens
ccttaccaactttct

SEQ ID NO: 2516545 - DNA, 15 bp, Homo sapiens
ccttaccatgtgcct

SEQ ID NO: 2516546 - DNA, 20 bp, Homo sapiens
ccttacctcggtgccttcct

SEQ ID NO: 2516547 - DNA, 16 bp, Homo sapiens
ccttagaccttccata

SEQ ID NO: 2516548 - DNA, 21 bp, Homo sapiens
ccttagattagctctggacca

SEQ ID NO: 2516549 - DNA, 19 bp, Homo sapiens
ccttagcagggaaacagct

SEQ ID NO: 2516550 - DNA, 15 bp, Homo sapiens
ccttagcccccaccc

SEQ ID NO: 2516551 - DNA, 19 bp, Homo sapiens
ccttagctggcattacagc

SEQ ID NO: 2516552 - DNA, 21 bp, Homo sapiens
ccttagcttagacctcagcct

SEQ ID NO: 2516553 - DNA, 19 bp, Homo sapiens
ccttagtgtttctgtgcat

SEQ ID NO: 2516554 - DNA, 13 bp, Homo sapiens
ccttatcaagtgt

SEQ ID NO: 2516555 - DNA, 15 bp, Homo sapiens
ccttatcaagtgtct

SEQ ID NO: 2516556 - DNA, 13 bp, Homo sapiens
ccttatccaggac

SEQ ID NO: 2516557 - DNA, 15 bp, Homo sapiens
ccttatccaggactc

SEQ ID NO: 2516558 - DNA, 13 bp, Homo sapiens
ccttatcctctga

SEQ ID NO: 2516559 - DNA, 16 bp, Homo sapiens
ccttattagagtgtct

SEQ ID NO: 2516560 - DNA, 21 bp, Homo sapiens
ccttattagagtgtctttcca

SEQ ID NO: 2516561 - DNA, 15 bp, Homo sapiens
ccttattgtacctct

SEQ ID NO: 2516562 - DNA, 13 bp, Homo sapiens
ccttcaactgaaa

SEQ ID NO: 2516563 - DNA, 19 bp, Homo sapiens
ccttcaagaactctgggct

SEQ ID NO: 2516564 - DNA, 23 bp, Homo sapiens
ccttcaagatcatgtaccccaat

SEQ ID NO: 2516565 - DNA, 14 bp, Homo sapiens
ccttcaataaagta

SEQ ID NO: 2516566 - DNA, 22 bp, Homo sapiens
ccttcaataaatggtatagcaa

SEQ ID NO: 2516567 - DNA, 17 bp, Homo sapiens
ccttcacagatgggtgc

SEQ ID NO: 2516568 - DNA, 14 bp, Homo sapiens
ccttcacctctgaa

SEQ ID NO: 2516569 - DNA, 20 bp, Homo sapiens
ccttcacctttgtccccacc

SEQ ID NO: 2516570 - DNA, 23 bp, Homo sapiens
ccttcactccggtgtgcctgcag

SEQ ID NO: 2516571 - DNA, 20 bp, Homo sapiens
ccttcacttctgaccacact

SEQ ID NO: 2516572 - DNA, 18 bp, Homo sapiens
ccttcagaaccatccata

SEQ ID NO: 2516573 - DNA, 21 bp, Homo sapiens
ccttcagactttgcttcccat

SEQ ID NO: 2516574 - DNA, 24 bp, Homo sapiens
ccttcagtaccctctcagctccag

SEQ ID NO: 2516575 - DNA, 20 bp, Homo sapiens
ccttcattgccttaactgga

SEQ ID NO: 2516576 - DNA, 19 bp, Homo sapiens
ccttcatttcaggagggat

SEQ ID NO: 2516577 - DNA, 19 bp, Homo sapiens
ccttccaacaggagctggg

SEQ ID NO: 2516578 - DNA, 13 bp, Homo sapiens
ccttccagctcct

SEQ ID NO: 2516579 - DNA, 17 bp, Homo sapiens
ccttccagctcctgtaa

SEQ ID NO: 2516580 - DNA, 18 bp, Homo sapiens
ccttccaggggtgggaca

SEQ ID NO: 2516581 - DNA, 22 bp, Homo sapiens
ccttccaggggtgggacaccct

SEQ ID NO: 2516582 - DNA, 12 bp, Homo sapiens
ccttccatccct

SEQ ID NO: 2516583 - DNA, 18 bp, Homo sapiens
ccttccatgtcgcctctg

SEQ ID NO: 2516584 - DNA, 20 bp, Homo sapiens
ccttccatgtcgcctctgca

SEQ ID NO: 2516585 - DNA, 19 bp, Homo sapiens
ccttccatgtcggcctcta

SEQ ID NO: 2516586 - DNA, 19 bp, Homo sapiens
ccttcccaggagtggagga

SEQ ID NO: 2516587 - DNA, 17 bp, Homo sapiens
ccttccccctcccaggg

SEQ ID NO: 2516588 - DNA, 22 bp, Homo sapiens
ccttcccctccctggctcccat

SEQ ID NO: 2516589 - DNA, 12 bp, Homo sapiens
ccttccctgcaa

SEQ ID NO: 2516590 - DNA, 16 bp, Homo sapiens
ccttccctgtccctct

SEQ ID NO: 2516591 - DNA, 16 bp, Homo sapiens
ccttcctcatccaccc

SEQ ID NO: 2516592 - DNA, 17 bp, Homo sapiens
ccttcctcatccacccc

SEQ ID NO: 2516593 - DNA, 13 bp, Homo sapiens
ccttcctcctggg

SEQ ID NO: 2516594 - DNA, 15 bp, Homo sapiens
ccttcctcgcagaga

SEQ ID NO: 2516595 - DNA, 17 bp, Homo sapiens
ccttcctcgcagagagg

SEQ ID NO: 2516596 - DNA, 19 bp, Homo sapiens
ccttcctcgcagagaggcc

SEQ ID NO: 2516597 - DNA, 18 bp, Homo sapiens
ccttcctctgcagctgac

SEQ ID NO: 2516598 - DNA, 15 bp, Homo sapiens
ccttcgctcctgtgt

SEQ ID NO: 2516599 - DNA, 13 bp, Homo sapiens
ccttctacctgcc

SEQ ID NO: 2516600 - DNA, 17 bp, Homo sapiens
ccttctacctgccactc

SEQ ID NO: 2516601 - DNA, 14 bp, Homo sapiens
ccttctactgagcc

SEQ ID NO: 2516602 - DNA, 15 bp, Homo sapiens
ccttctactgagcct

SEQ ID NO: 2516603 - DNA, 14 bp, Homo sapiens
ccttctaggaagct

SEQ ID NO: 2516604 - DNA, 21 bp, Homo sapiens
ccttctcatcactcccctcca

SEQ ID NO: 2516605 - DNA, 13 bp, Homo sapiens
ccttctccatcca

SEQ ID NO: 2516606 - DNA, 16 bp, Homo sapiens
ccttctccatccacat

SEQ ID NO: 2516607 - DNA, 22 bp, Homo sapiens
ccttctccatccacatgggagc

SEQ ID NO: 2516608 - DNA, 14 bp, Homo sapiens
ccttctcccacact

SEQ ID NO: 2516609 - DNA, 16 bp, Homo sapiens
ccttctcccacccctg

SEQ ID NO: 2516610 - DNA, 13 bp, Homo sapiens
ccttctctccagc

SEQ ID NO: 2516611 - DNA, 23 bp, Homo sapiens
ccttctctccagcccctggatgc

SEQ ID NO: 2516612 - DNA, 13 bp, Homo sapiens
ccttctctgctcc

SEQ ID NO: 2516613 - DNA, 14 bp, Homo sapiens
ccttctctgctcca

SEQ ID NO: 2516614 - DNA, 17 bp, Homo sapiens
ccttctctgtctcatgt

SEQ ID NO: 2516615 - DNA, 19 bp, Homo sapiens
ccttctctgtctcatgtgt

SEQ ID NO: 2516616 - DNA, 12 bp, Homo sapiens
ccttctgaccca

SEQ ID NO: 2516617 - DNA, 16 bp, Homo sapiens
ccttctgacccatgct

SEQ ID NO: 2516618 - DNA, 23 bp, Homo sapiens
ccttctgacccatgctgccctgt

SEQ ID NO: 2516619 - DNA, 17 bp, Homo sapiens
ccttctggcctcccaca

SEQ ID NO: 2516620 - DNA, 20 bp, Homo sapiens
ccttctgggcagaccttgac

SEQ ID NO: 2516621 - DNA, 16 bp, Homo sapiens
ccttctgtagttttat

SEQ ID NO: 2516622 - DNA, 20 bp, Homo sapiens
ccttctgtcctactctgtgt

SEQ ID NO: 2516623 - DNA, 21 bp, Homo sapiens
ccttctgtcctactctgtgtc

SEQ ID NO: 2516624 - DNA, 22 bp, Homo sapiens
ccttctgtcctactctgtgtca

SEQ ID NO: 2516625 - DNA, 15 bp, Homo sapiens
ccttctgtcctggtg

SEQ ID NO: 2516626 - DNA, 17 bp, Homo sapiens
ccttctgtcctggtgtc

SEQ ID NO: 2516627 - DNA, 15 bp, Homo sapiens
ccttcttcacccagc

SEQ ID NO: 2516628 - DNA, 21 bp, Homo sapiens
ccttcttctttttgctgttgt

SEQ ID NO: 2516629 - DNA, 13 bp, Homo sapiens
ccttctttgataa

SEQ ID NO: 2516630 - DNA, 19 bp, Homo sapiens
ccttctttgataatgttaa

SEQ ID NO: 2516631 - DNA, 21 bp, Homo sapiens
ccttctttgataatgttaaat

SEQ ID NO: 2516632 - DNA, 18 bp, Homo sapiens
ccttctttgcttgcctct

SEQ ID NO: 2516633 - DNA, 16 bp, Homo sapiens
ccttctttttcttctt

SEQ ID NO: 2516634 - DNA, 22 bp, Homo sapiens
ccttgaaaacactgttctctgc

SEQ ID NO: 2516635 - DNA, 15 bp, Homo sapiens
ccttgaaccacttcc

SEQ ID NO: 2516636 - DNA, 18 bp, Homo sapiens
ccttgaaccacttccctc

SEQ ID NO: 2516637 - DNA, 19 bp, Homo sapiens
ccttgaactttgacctctg

SEQ ID NO: 2516638 - DNA, 17 bp, Homo sapiens
ccttgaagaacctctca

SEQ ID NO: 2516639 - DNA, 23 bp, Homo sapiens
ccttgaagatatcttgaaatgaa

SEQ ID NO: 2516640 - DNA, 18 bp, Homo sapiens
ccttgacagggcacaccg

SEQ ID NO: 2516641 - DNA, 12 bp, Homo sapiens
ccttgaccaggc

SEQ ID NO: 2516642 - DNA, 21 bp, Homo sapiens
ccttgaccattctccacctgc

SEQ ID NO: 2516643 - DNA, 18 bp, Homo sapiens
ccttgagagaccaggcaa

SEQ ID NO: 2516644 - DNA, 22 bp, Homo sapiens
ccttgagtggggttatctctgt

SEQ ID NO: 2516645 - DNA, 23 bp, Homo sapiens
ccttgagtggggttatctctgtg

SEQ ID NO: 2516646 - DNA, 14 bp, Homo sapiens
ccttgatgtgcctg

SEQ ID NO: 2516647 - DNA, 18 bp, Homo sapiens
ccttgcaacacacagaca

SEQ ID NO: 2516648 - DNA, 15 bp, Homo sapiens
ccttgcaagaatcag

SEQ ID NO: 2516649 - DNA, 18 bp, Homo sapiens
ccttgcacccctcactct

SEQ ID NO: 2516650 - DNA, 21 bp, Homo sapiens
ccttgcagcactcacacagga

SEQ ID NO: 2516651 - DNA, 19 bp, Homo sapiens
ccttgcagttcagcaccac

SEQ ID NO: 2516652 - DNA, 19 bp, Homo sapiens
ccttgccaccccaccctcc

SEQ ID NO: 2516653 - DNA, 24 bp, Homo sapiens
ccttgccaccccaccctccctgga

SEQ ID NO: 2516654 - DNA, 13 bp, Homo sapiens
ccttgccagacat

SEQ ID NO: 2516655 - DNA, 13 bp, Homo sapiens
ccttgcccagggc

SEQ ID NO: 2516656 - DNA, 17 bp, Homo sapiens
ccttgcccagggctcag

SEQ ID NO: 2516657 - DNA, 18 bp, Homo sapiens
ccttgcccagggctcagc

SEQ ID NO: 2516658 - DNA, 18 bp, Homo sapiens
ccttgcccggattctggg

SEQ ID NO: 2516659 - DNA, 16 bp, Homo sapiens
ccttgcccttgccctg

SEQ ID NO: 2516660 - DNA, 16 bp, Homo sapiens
ccttgccgtctacctg

SEQ ID NO: 2516661 - DNA, 12 bp, Homo sapiens
ccttgcctcctg

SEQ ID NO: 2516662 - DNA, 15 bp, Homo sapiens
ccttgcctcctgtgt

SEQ ID NO: 2516663 - DNA, 21 bp, Homo sapiens
ccttgcggggataaagagaga

SEQ ID NO: 2516664 - DNA, 11 bp, Homo sapiens
ccttgctacct

SEQ ID NO: 2516665 - DNA, 12 bp, Homo sapiens
ccttgctacctc

SEQ ID NO: 2516666 - DNA, 23 bp, Homo sapiens
ccttgctcaaccatggctgaagg

SEQ ID NO: 2516667 - DNA, 21 bp, Homo sapiens
ccttgcttgttgggattcctg

SEQ ID NO: 2516668 - DNA, 17 bp, Homo sapiens
ccttggaaacctgccct

SEQ ID NO: 2516669 - DNA, 20 bp, Homo sapiens
ccttggaaacctgccctgcc

SEQ ID NO: 2516670 - DNA, 22 bp, Homo sapiens
ccttggaagttgcatggcatca

SEQ ID NO: 2516671 - DNA, 15 bp, Homo sapiens
ccttggaagtttcat

SEQ ID NO: 2516672 - DNA, 15 bp, Homo sapiens
ccttggactcatttt

SEQ ID NO: 2516673 - DNA, 19 bp, Homo sapiens
ccttggcatcacagggcag

SEQ ID NO: 2516674 - DNA, 15 bp, Homo sapiens
ccttggcctgtctca

SEQ ID NO: 2516675 - DNA, 23 bp, Homo sapiens
ccttggcctgtctcatccccagg

SEQ ID NO: 2516676 - DNA, 16 bp, Homo sapiens
ccttggggcaggcagt

SEQ ID NO: 2516677 - DNA, 19 bp, Homo sapiens
ccttgtaattctaaatgaa

SEQ ID NO: 2516678 - DNA, 13 bp, Homo sapiens
ccttgtatttaaa

SEQ ID NO: 2516679 - DNA, 14 bp, Homo sapiens
ccttgtatttaaat

SEQ ID NO: 2516680 - DNA, 21 bp, Homo sapiens
ccttgtatttaaatattaaat

SEQ ID NO: 2516681 - DNA, 13 bp, Homo sapiens
ccttgtccccaca

SEQ ID NO: 2516682 - DNA, 14 bp, Homo sapiens
ccttgtccccacac

SEQ ID NO: 2516683 - DNA, 17 bp, Homo sapiens
ccttgtccccacactcc

SEQ ID NO: 2516684 - DNA, 17 bp, Homo sapiens
ccttgtgcctggctcag

SEQ ID NO: 2516685 - DNA, 16 bp, Homo sapiens
ccttgtggtcccaccc

SEQ ID NO: 2516686 - DNA, 21 bp, Homo sapiens
ccttgttatttctcagacttt

SEQ ID NO: 2516687 - DNA, 15 bp, Homo sapiens
ccttgttcacactct

SEQ ID NO: 2516688 - DNA, 17 bp, Homo sapiens
ccttgttggagcctgca

SEQ ID NO: 2516689 - DNA, 14 bp, Homo sapiens
ccttgtttcaaaca

SEQ ID NO: 2516690 - DNA, 20 bp, Homo sapiens
ccttgtttcaaacacaaatg

SEQ ID NO: 2516691 - DNA, 21 bp, Homo sapiens
cctttacacattcggctccct

SEQ ID NO: 2516692 - DNA, 20 bp, Homo sapiens
cctttagggcagcttgcccc

SEQ ID NO: 2516693 - DNA, 18 bp, Homo sapiens
cctttagtacctgaaaag

SEQ ID NO: 2516694 - DNA, 19 bp, Homo sapiens
cctttatatttagtgaact

SEQ ID NO: 2516695 - DNA, 14 bp, Homo sapiens
cctttattaaaatc

SEQ ID NO: 2516696 - DNA, 16 bp, Homo sapiens
cctttattaaaatctt

SEQ ID NO: 2516697 - DNA, 13 bp, Homo sapiens
cctttattttaga

SEQ ID NO: 2516698 - DNA, 21 bp, Homo sapiens
cctttcacaaaattttattcc

SEQ ID NO: 2516699 - DNA, 16 bp, Homo sapiens
cctttccaaggcttct

SEQ ID NO: 2516700 - DNA, 11 bp, Homo sapiens
cctttccataa

SEQ ID NO: 2516701 - DNA, 10 bp, Homo sapiens
cctttctcac

SEQ ID NO: 2516702 - DNA, 17 bp, Homo sapiens
cctttctccagccagca

SEQ ID NO: 2516703 - DNA, 18 bp, Homo sapiens
cctttctccagccagcaa

SEQ ID NO: 2516704 - DNA, 20 bp, Homo sapiens
cctttctccagccagcaatg

SEQ ID NO: 2516705 - DNA, 22 bp, Homo sapiens
cctttctccagccagcaatgat

SEQ ID NO: 2516706 - DNA, 17 bp, Homo sapiens
cctttctcccaggccag

SEQ ID NO: 2516707 - DNA, 17 bp, Homo sapiens
cctttctcttctctgtt

SEQ ID NO: 2516708 - DNA, 18 bp, Homo sapiens
cctttcttggttcataaa

SEQ ID NO: 2516709 - DNA, 22 bp, Homo sapiens
cctttgacctgcctcccttcat

SEQ ID NO: 2516710 - DNA, 21 bp, Homo sapiens
cctttgacgccatcccagccc

SEQ ID NO: 2516711 - DNA, 15 bp, Homo sapiens
cctttgagacagttt

SEQ ID NO: 2516712 - DNA, 14 bp, Homo sapiens
cctttgcactgagg

SEQ ID NO: 2516713 - DNA, 12 bp, Homo sapiens
cctttgcaggca

SEQ ID NO: 2516714 - DNA, 16 bp, Homo sapiens
cctttgcccagaaaga

SEQ ID NO: 2516715 - DNA, 21 bp, Homo sapiens
cctttgccccacctttattaa

SEQ ID NO: 2516716 - DNA, 11 bp, Homo sapiens
cctttggcttc

SEQ ID NO: 2516717 - DNA, 19 bp, Homo sapiens
cctttgggaggctgaggcg

SEQ ID NO: 2516718 - DNA, 15 bp, Homo sapiens
cctttgtattctctc

SEQ ID NO: 2516719 - DNA, 18 bp, Homo sapiens
cctttgtattctctcctg

SEQ ID NO: 2516720 - DNA, 20 bp, Homo sapiens
cctttgtattctctcctgta

SEQ ID NO: 2516721 - DNA, 19 bp, Homo sapiens
cctttgtcatcattgtata

SEQ ID NO: 2516722 - DNA, 23 bp, Homo sapiens
cctttgtcatctttcttctattt

SEQ ID NO: 2516723 - DNA, 14 bp, Homo sapiens
cctttgtccccacc

SEQ ID NO: 2516724 - DNA, 14 bp, Homo sapiens
cctttgtgaggaag

SEQ ID NO: 2516725 - DNA, 12 bp, Homo sapiens
cctttgtgctgt

SEQ ID NO: 2516726 - DNA, 17 bp, Homo sapiens
ccttttacatactgctg

SEQ ID NO: 2516727 - DNA, 18 bp, Homo sapiens
ccttttccatttgaaaga

SEQ ID NO: 2516728 - DNA, 14 bp, Homo sapiens
ccttttctgcattt

SEQ ID NO: 2516729 - DNA, 23 bp, Homo sapiens
ccttttgaggagccccagctacc

SEQ ID NO: 2516730 - DNA, 17 bp, Homo sapiens
ccttttgcacccctccc

SEQ ID NO: 2516731 - DNA, 18 bp, Homo sapiens
ccttttgcacccctccca

SEQ ID NO: 2516732 - DNA, 19 bp, Homo sapiens
ccttttgcacccctcccat

SEQ ID NO: 2516733 - DNA, 20 bp, Homo sapiens
ccttttgcacccctcccatt

SEQ ID NO: 2516734 - DNA, 14 bp, Homo sapiens
ccttttgcatcatt

SEQ ID NO: 2516735 - DNA, 12 bp, Homo sapiens
ccttttggcact

SEQ ID NO: 2516736 - DNA, 19 bp, Homo sapiens
ccttttggcccccgagctg

SEQ ID NO: 2516737 - DNA, 21 bp, Homo sapiens
ccttttggcccccgagctggg

SEQ ID NO: 2516738 - DNA, 23 bp, Homo sapiens
ccttttggcccccgagctggggg

SEQ ID NO: 2516739 - DNA, 15 bp, Homo sapiens
ccttttgtctgcctc

SEQ ID NO: 2516740 - DNA, 15 bp, Homo sapiens
cctttttactcccct

SEQ ID NO: 2516741 - DNA, 23 bp, Homo sapiens
cctttttactccccttgagctga

SEQ ID NO: 2516742 - DNA, 21 bp, Homo sapiens
cctttttccccaaagtcttaa

SEQ ID NO: 2516743 - DNA, 20 bp, Homo sapiens
cctttttctttataaacttt

SEQ ID NO: 2516744 - DNA, 17 bp, Homo sapiens
ccttttttaaaaatgca

SEQ ID NO: 2516745 - DNA, 21 bp, Homo sapiens
ccttttttaagatttttctca

SEQ ID NO: 2516746 - DNA, 12 bp, Homo sapiens
ccttttttatac

SEQ ID NO: 2516747 - DNA, 17 bp, Homo sapiens
ccttttttatacataaa

SEQ ID NO: 2516748 - DNA, 13 bp, Homo sapiens
ccttttttgatca

SEQ ID NO: 2516749 - DNA, 17 bp, Homo sapiens
ccttttttggctgctga

SEQ ID NO: 2516750 - DNA, 18 bp, Homo sapiens
ccttttttggctgctgaa

SEQ ID NO: 2516751 - DNA, 18 bp, Homo sapiens
cgaaaccttgcctttctc

SEQ ID NO: 2516752 - DNA, 11 bp, Homo sapiens
cgaaataacaa

SEQ ID NO: 2516753 - DNA, 20 bp, Homo sapiens
cgaaataacaatgttaagga

SEQ ID NO: 2516754 - DNA, 13 bp, Homo sapiens
cgaaccccaagga

SEQ ID NO: 2516755 - DNA, 12 bp, Homo sapiens
cgaactggctgc

SEQ ID NO: 2516756 - DNA, 14 bp, Homo sapiens
cgaagctctggctg

SEQ ID NO: 2516757 - DNA, 18 bp, Homo sapiens
cgaagctttgaaggccga

SEQ ID NO: 2516758 - DNA, 14 bp, Homo sapiens
cgaatacaaaattg

SEQ ID NO: 2516759 - DNA, 15 bp, Homo sapiens
cgaatagctgggact

SEQ ID NO: 2516760 - DNA, 16 bp, Homo sapiens
cgaatagctgggacta

SEQ ID NO: 2516761 - DNA, 18 bp, Homo sapiens
cgaatcagctatttactg

SEQ ID NO: 2516762 - DNA, 17 bp, Homo sapiens
cgaatcatttgttcaaa

SEQ ID NO: 2516763 - DNA, 22 bp, Homo sapiens
cgaatctctttttgctttcgaa

SEQ ID NO: 2516764 - DNA, 22 bp, Homo sapiens
cgacagagggaagaaaagagct

SEQ ID NO: 2516765 - DNA, 19 bp, Homo sapiens
cgacatggacccggagcta

SEQ ID NO: 2516766 - DNA, 14 bp, Homo sapiens
cgaccacctgccca

SEQ ID NO: 2516767 - DNA, 20 bp, Homo sapiens
cgaccgaggctggagctggc

SEQ ID NO: 2516768 - DNA, 15 bp, Homo sapiens
cgacctcagccttcc

SEQ ID NO: 2516769 - DNA, 18 bp, Homo sapiens
cgacctggtttttaaata

SEQ ID NO: 2516770 - DNA, 20 bp, Homo sapiens
cgactctatagactctagga

SEQ ID NO: 2516771 - DNA, 17 bp, Homo sapiens
cgactgcccggcagggt

SEQ ID NO: 2516772 - DNA, 21 bp, Homo sapiens
cgacttgctgttttgttctgt

SEQ ID NO: 2516773 - DNA, 13 bp, Homo sapiens
cgactttattttc

SEQ ID NO: 2516774 - DNA, 18 bp, Homo sapiens
cgagaagctgctctggaa

SEQ ID NO: 2516775 - DNA, 13 bp, Homo sapiens
cgagaccagcctg

SEQ ID NO: 2516776 - DNA, 17 bp, Homo sapiens
cgagaccagcctggcca

SEQ ID NO: 2516777 - DNA, 18 bp, Homo sapiens
cgagacttggtttcaaaa

SEQ ID NO: 2516778 - DNA, 20 bp, Homo sapiens
cgagaggggaagagtgtact

SEQ ID NO: 2516779 - DNA, 14 bp, Homo sapiens
cgagagtctgtctc

SEQ ID NO: 2516780 - DNA, 20 bp, Homo sapiens
cgagattgcaccactgcact

SEQ ID NO: 2516781 - DNA, 14 bp, Homo sapiens
cgagcaaagatcaa

SEQ ID NO: 2516782 - DNA, 15 bp, Homo sapiens
cgagcagtcctgcct

SEQ ID NO: 2516783 - DNA, 15 bp, Homo sapiens
cgagcatcctggcca

SEQ ID NO: 2516784 - DNA, 16 bp, Homo sapiens
cgagcatgcctggatg

SEQ ID NO: 2516785 - DNA, 17 bp, Homo sapiens
cgagcatgcctggatgg

SEQ ID NO: 2516786 - DNA, 18 bp, Homo sapiens
cgagccctggtggcagtg

SEQ ID NO: 2516787 - DNA, 19 bp, Homo sapiens
cgagccctggtggcagtgg

SEQ ID NO: 2516788 - DNA, 18 bp, Homo sapiens
cgagctcgtgtatcctgg

SEQ ID NO: 2516789 - DNA, 14 bp, Homo sapiens
cgagctggtgcatt

SEQ ID NO: 2516790 - DNA, 21 bp, Homo sapiens
cgagctggtgcattacagaga

SEQ ID NO: 2516791 - DNA, 22 bp, Homo sapiens
cgagctggtgcattacagagag

SEQ ID NO: 2516792 - DNA, 23 bp, Homo sapiens
cgagctggtgcattacagagagg

SEQ ID NO: 2516793 - DNA, 14 bp, Homo sapiens
cgagcttttctaaa

SEQ ID NO: 2516794 - DNA, 14 bp, Homo sapiens
cgaggaaactcaga

SEQ ID NO: 2516795 - DNA, 19 bp, Homo sapiens
cgaggaaccagagccatgg

SEQ ID NO: 2516796 - DNA, 12 bp, Homo sapiens
cgaggacaggga

SEQ ID NO: 2516797 - DNA, 14 bp, Homo sapiens
cgaggacagggagg

SEQ ID NO: 2516798 - DNA, 13 bp, Homo sapiens
cgaggacccagac

SEQ ID NO: 2516799 - DNA, 17 bp, Homo sapiens
cgaggacccagacccag

SEQ ID NO: 2516800 - DNA, 20 bp, Homo sapiens
cgaggacccagacccagtgg

SEQ ID NO: 2516801 - DNA, 19 bp, Homo sapiens
cgaggactgtatttgtgac

SEQ ID NO: 2516802 - DNA, 20 bp, Homo sapiens
cgaggaggctccagagggca

SEQ ID NO: 2516803 - DNA, 12 bp, Homo sapiens
cgaggcagagga

SEQ ID NO: 2516804 - DNA, 13 bp, Homo sapiens
cgaggcagaggac

SEQ ID NO: 2516805 - DNA, 19 bp, Homo sapiens
cgaggccctcgggcccagc

SEQ ID NO: 2516806 - DNA, 21 bp, Homo sapiens
cgaggccctcgggcccagccc

SEQ ID NO: 2516807 - DNA, 15 bp, Homo sapiens
cgaggctggagctgg

SEQ ID NO: 2516808 - DNA, 19 bp, Homo sapiens
cgaggggagggtggcaggt

SEQ ID NO: 2516809 - DNA, 21 bp, Homo sapiens
cgaggggcgggacccaggcac

SEQ ID NO: 2516810 - DNA, 20 bp, Homo sapiens
cgaggggctctcagctcagc

SEQ ID NO: 2516811 - DNA, 21 bp, Homo sapiens
cgagtatgtgtttgtgtgtgt

SEQ ID NO: 2516812 - DNA, 15 bp, Homo sapiens
cgagtgctcatttca

SEQ ID NO: 2516813 - DNA, 16 bp, Homo sapiens
cgagtttggtccctgg

SEQ ID NO: 2516814 - DNA, 15 bp, Homo sapiens
cgataatcagagaaa

SEQ ID NO: 2516815 - DNA, 19 bp, Homo sapiens
cgatctgggttcactgcaa

SEQ ID NO: 2516816 - DNA, 18 bp, Homo sapiens
cgatgctccagccaaccc

SEQ ID NO: 2516817 - DNA, 21 bp, Homo sapiens
cgatgctgctttcccctgtgg

SEQ ID NO: 2516818 - DNA, 19 bp, Homo sapiens
cgatgtatgcagctatctg

SEQ ID NO: 2516819 - DNA, 21 bp, Homo sapiens
cgattcaccctgtccaaactg

SEQ ID NO: 2516820 - DNA, 23 bp, Homo sapiens
cgattcatctctcagaagggagg

SEQ ID NO: 2516821 - DNA, 21 bp, Homo sapiens
cgattgcaggagtccctgcca

SEQ ID NO: 2516822 - DNA, 15 bp, Homo sapiens
cgcaaaccacactgg

SEQ ID NO: 2516823 - DNA, 18 bp, Homo sapiens
cgcaaaccacactggact

SEQ ID NO: 2516824 - DNA, 21 bp, Homo sapiens
cgcacaaggctgaccaagaga

SEQ ID NO: 2516825 - DNA, 22 bp, Homo sapiens
cgcacaatagtaacctgggtaa

SEQ ID NO: 2516826 - DNA, 15 bp, Homo sapiens
cgcacacacacacac

SEQ ID NO: 2516827 - DNA, 22 bp, Homo sapiens
ctgaagaggcgggccagccagg

SEQ ID NO: 2516828 - DNA, 14 bp, Homo sapiens
ctgaagagtcctct

SEQ ID NO: 2516829 - DNA, 15 bp, Homo sapiens
ctgaagagtcctctg

SEQ ID NO: 2516830 - DNA, 16 bp, Homo sapiens
ctgaagatgatcattt

SEQ ID NO: 2516831 - DNA, 15 bp, Homo sapiens
ctgaagatgcagctc

SEQ ID NO: 2516832 - DNA, 22 bp, Homo sapiens
ctgaagatgcagctcactaccc

SEQ ID NO: 2516833 - DNA, 15 bp, Homo sapiens
ctgaagcatgtttca

SEQ ID NO: 2516834 - DNA, 18 bp, Homo sapiens
ctgaagcatgtttcatgt

SEQ ID NO: 2516835 - DNA, 20 bp, Homo sapiens
ctgaagcatgtttcatgttt

SEQ ID NO: 2516836 - DNA, 14 bp, Homo sapiens
ctgaagctgcctgc

SEQ ID NO: 2516837 - DNA, 19 bp, Homo sapiens
ctgaaggacattgcggaca

SEQ ID NO: 2516838 - DNA, 20 bp, Homo sapiens
ctgaaggacattgcggacag

SEQ ID NO: 2516839 - DNA, 21 bp, Homo sapiens
ctgaaggacattgcggacagc

SEQ ID NO: 2516840 - DNA, 23 bp, Homo sapiens
ctgaaggacattgcggacagcca

SEQ ID NO: 2516841 - DNA, 13 bp, Homo sapiens
ctgaaggactgtg

SEQ ID NO: 2516842 - DNA, 14 bp, Homo sapiens
ctgaaggactgtga

SEQ ID NO: 2516843 - DNA, 21 bp, Homo sapiens
ctgaaggactgtgacaggcag

SEQ ID NO: 2516844 - DNA, 22 bp, Homo sapiens
ctgaaggactgtgacaggcagc

SEQ ID NO: 2516845 - DNA, 14 bp, Homo sapiens
ctgaaggccccgcc

SEQ ID NO: 2516846 - DNA, 17 bp, Homo sapiens
ctgaaggccccgcccag

SEQ ID NO: 2516847 - DNA, 13 bp, Homo sapiens
ctgaaggcctggc

SEQ ID NO: 2516848 - DNA, 21 bp, Homo sapiens
ctgaaggcctggcccacagca

SEQ ID NO: 2516849 - DNA, 17 bp, Homo sapiens
ctgaaggctgggttctg

SEQ ID NO: 2516850 - DNA, 12 bp, Homo sapiens
ctgaagggaggt

SEQ ID NO: 2516851 - DNA, 17 bp, Homo sapiens
ctgaaggggttctcaca

SEQ ID NO: 2516852 - DNA, 21 bp, Homo sapiens
ctgaaggggttctcacagtgg

SEQ ID NO: 2516853 - DNA, 15 bp, Homo sapiens
ctgaaggtaaaattg

SEQ ID NO: 2516854 - DNA, 17 bp, Homo sapiens
ctgaagtagtgtgcagt

SEQ ID NO: 2516855 - DNA, 21 bp, Homo sapiens
ctgaagtcacatcacaggaca

SEQ ID NO: 2516856 - DNA, 15 bp, Homo sapiens
ctgaagtctgaaatt

SEQ ID NO: 2516857 - DNA, 17 bp, Homo sapiens
ctgaagtgaaactgctt

SEQ ID NO: 2516858 - DNA, 14 bp, Homo sapiens
ctgaagtgcatcca

SEQ ID NO: 2516859 - DNA, 22 bp, Homo sapiens
ctgaagtgcatccaaaggtgct

SEQ ID NO: 2516860 - DNA, 16 bp, Homo sapiens
ctgaagtgcttagtgt

SEQ ID NO: 2516861 - DNA, 13 bp, Homo sapiens
ctgaagtttcaca

SEQ ID NO: 2516862 - DNA, 11 bp, Homo sapiens
ctgaataataa

SEQ ID NO: 2516863 - DNA, 15 bp, Homo sapiens
ctgaatagcagaagg

SEQ ID NO: 2516864 - DNA, 16 bp, Homo sapiens
ctgaatatttatattt

SEQ ID NO: 2516865 - DNA, 20 bp, Homo sapiens
ctgaatcccccttgccaccc

SEQ ID NO: 2516866 - DNA, 22 bp, Homo sapiens
ctgaatcccccttgccacccca

SEQ ID NO: 2516867 - DNA, 17 bp, Homo sapiens
ctgaatgaaacccccac

SEQ ID NO: 2516868 - DNA, 22 bp, Homo sapiens
ctgaatgaaacccccacacaca

SEQ ID NO: 2516869 - DNA, 23 bp, Homo sapiens
ctgaatgaaacccccacacacac

SEQ ID NO: 2516870 - DNA, 12 bp, Homo sapiens
ctgaatgctctg

SEQ ID NO: 2516871 - DNA, 16 bp, Homo sapiens
ctgaatgctgctactt

SEQ ID NO: 2516872 - DNA, 19 bp, Homo sapiens
ctgaatgcttataggtggc

SEQ ID NO: 2516873 - DNA, 11 bp, Homo sapiens
ctgaatgtatt

SEQ ID NO: 2516874 - DNA, 11 bp, Homo sapiens
ctgaatgttct

SEQ ID NO: 2516875 - DNA, 16 bp, Homo sapiens
ctgaatgttctgacat

SEQ ID NO: 2516876 - DNA, 23 bp, Homo sapiens
ctgaatgttctgacattaacagt

SEQ ID NO: 2516877 - DNA, 18 bp, Homo sapiens
ctgaatgtttattccttg

SEQ ID NO: 2516878 - DNA, 17 bp, Homo sapiens
ctgaattaatcatctat

SEQ ID NO: 2516879 - DNA, 19 bp, Homo sapiens
ctgaattagtccttgcttg

SEQ ID NO: 2516880 - DNA, 22 bp, Homo sapiens
ctgaattagtccttgcttggct

SEQ ID NO: 2516881 - DNA, 14 bp, Homo sapiens
ctgaattataagag

SEQ ID NO: 2516882 - DNA, 18 bp, Homo sapiens
ctgacaaaaagtttccat

SEQ ID NO: 2516883 - DNA, 22 bp, Homo sapiens
ctgacaacactcattgacctga

SEQ ID NO: 2516884 - DNA, 20 bp, Homo sapiens
ctgacaaccaccgctcccca

SEQ ID NO: 2516885 - DNA, 21 bp, Homo sapiens
ctgacaaccaccgctccccag

SEQ ID NO: 2516886 - DNA, 18 bp, Homo sapiens
ctgacacaaaaagtagat

SEQ ID NO: 2516887 - DNA, 14 bp, Homo sapiens
ctgacacaaacctg

SEQ ID NO: 2516888 - DNA, 20 bp, Homo sapiens
ctgacacaaacctgcctggg

SEQ ID NO: 2516889 - DNA, 15 bp, Homo sapiens
ctgacacacagctct

SEQ ID NO: 2516890 - DNA, 17 bp, Homo sapiens
ctgacactcccttgggc

SEQ ID NO: 2516891 - DNA, 14 bp, Homo sapiens
ctgacagaaagcag

SEQ ID NO: 2516892 - DNA, 15 bp, Homo sapiens
ctgacagacacaggc

SEQ ID NO: 2516893 - DNA, 13 bp, Homo sapiens
ctgacagcctccc

SEQ ID NO: 2516894 - DNA, 14 bp, Homo sapiens
ctgacagcctccca

SEQ ID NO: 2516895 - DNA, 11 bp, Homo sapiens
ctgacaggcaa

SEQ ID NO: 2516896 - DNA, 20 bp, Homo sapiens
ctgacaggcaatgctggctg

SEQ ID NO: 2516897 - DNA, 21 bp, Homo sapiens
ctgacaggcaatgctggctgt

SEQ ID NO: 2516898 - DNA, 20 bp, Homo sapiens
ctgacaggcagcctggacat

SEQ ID NO: 2516899 - DNA, 15 bp, Homo sapiens
ctgacatctctgcaa

SEQ ID NO: 2516900 - DNA, 14 bp, Homo sapiens
ctgacattaacagt

SEQ ID NO: 2516901 - DNA, 15 bp, Homo sapiens
ctgacattaacagtt

SEQ ID NO: 2516902 - DNA, 18 bp, Homo sapiens
ctgacattaacagttttc

SEQ ID NO: 2516903 - DNA, 20 bp, Homo sapiens
ctgacattaacagttttcca

SEQ ID NO: 2516904 - DNA, 14 bp, Homo sapiens
ctgacattggagcc

SEQ ID NO: 2516905 - DNA, 15 bp, Homo sapiens
ctgacattggagcct

SEQ ID NO: 2516906 - DNA, 16 bp, Homo sapiens
ctgacattggagcctg

SEQ ID NO: 2516907 - DNA, 20 bp, Homo sapiens
ctgacattgtggcacattct

SEQ ID NO: 2516908 - DNA, 22 bp, Homo sapiens
ctgacattgttggccaaagcca

SEQ ID NO: 2516909 - DNA, 18 bp, Homo sapiens
ctgacatttggagtgttc

SEQ ID NO: 2516910 - DNA, 12 bp, Homo sapiens
ctgaccacactt

SEQ ID NO: 2516911 - DNA, 16 bp, Homo sapiens
ctgaccacacttcctg

SEQ ID NO: 2516912 - DNA, 17 bp, Homo sapiens
ctgaccacacttcctgt

SEQ ID NO: 2516913 - DNA, 21 bp, Homo sapiens
ctgaccacacttcctgtccag

SEQ ID NO: 2516914 - DNA, 14 bp, Homo sapiens
ctgaccaccctccc

SEQ ID NO: 2516915 - DNA, 15 bp, Homo sapiens
ctgaccatccactct

SEQ ID NO: 2516916 - DNA, 18 bp, Homo sapiens
ctgaccatttcaggggtc

SEQ ID NO: 2516917 - DNA, 14 bp, Homo sapiens
ctgacccactgctt

SEQ ID NO: 2516918 - DNA, 13 bp, Homo sapiens
ctgacccagtgag

SEQ ID NO: 2516919 - DNA, 13 bp, Homo sapiens
ctgacccatgctg

SEQ ID NO: 2516920 - DNA, 22 bp, Homo sapiens
ctgacccatgctgccctgtgag

SEQ ID NO: 2516921 - DNA, 14 bp, Homo sapiens
ctgacccctgctca

SEQ ID NO: 2516922 - DNA, 16 bp, Homo sapiens
ctgacccctgctcagt

SEQ ID NO: 2516923 - DNA, 19 bp, Homo sapiens
ctgaccctgcttcaaatat

SEQ ID NO: 2516924 - DNA, 13 bp, Homo sapiens
ctgaccgtgggcg

SEQ ID NO: 2516925 - DNA, 14 bp, Homo sapiens
ctgacctccacagc

SEQ ID NO: 2516926 - DNA, 16 bp, Homo sapiens
ctgacctccacagctt

SEQ ID NO: 2516927 - DNA, 18 bp, Homo sapiens
ctgacctcccagccctat

SEQ ID NO: 2516928 - DNA, 22 bp, Homo sapiens
ctgacctcccagccctatggat

SEQ ID NO: 2516929 - DNA, 23 bp, Homo sapiens
ctgacctcccagccctatggatg

SEQ ID NO: 2516930 - DNA, 18 bp, Homo sapiens
ctgacctccctctaattt

SEQ ID NO: 2516931 - DNA, 21 bp, Homo sapiens
ctgacctccctctaatttatc

SEQ ID NO: 2516932 - DNA, 12 bp, Homo sapiens
ctgacctgcagg

SEQ ID NO: 2516933 - DNA, 20 bp, Homo sapiens
ctgacctgtcatgcccccct

SEQ ID NO: 2516934 - DNA, 23 bp, Homo sapiens
ctgacctgtcatgcccccctcaa

SEQ ID NO: 2516935 - DNA, 17 bp, Homo sapiens
ctgaccttcctcgcaga

SEQ ID NO: 2516936 - DNA, 21 bp, Homo sapiens
ctgaccttcctcgcagagagg

SEQ ID NO: 2516937 - DNA, 16 bp, Homo sapiens
ctgacgcaacccacgt

SEQ ID NO: 2516938 - DNA, 23 bp, Homo sapiens
ctgacggaagccaacttggcttt

SEQ ID NO: 2516939 - DNA, 21 bp, Homo sapiens
ctgacggggaggaaccactgc

SEQ ID NO: 2516940 - DNA, 14 bp, Homo sapiens
ctgacgtgcctttt

SEQ ID NO: 2516941 - DNA, 17 bp, Homo sapiens
ctgacgtgccttttgca

SEQ ID NO: 2516942 - DNA, 18 bp, Homo sapiens
ctgacgtgccttttgcac

SEQ ID NO: 2516943 - DNA, 22 bp, Homo sapiens
ctgactactgggcaaagagtgt

SEQ ID NO: 2516944 - DNA, 22 bp, Homo sapiens
ctgactagaagggccagtcctg

SEQ ID NO: 2516945 - DNA, 18 bp, Homo sapiens
ctgactcaacatgttact

SEQ ID NO: 2516946 - DNA, 13 bp, Homo sapiens
ctgactcacaaga

SEQ ID NO: 2516947 - DNA, 17 bp, Homo sapiens
ctgactcacaagaagac

SEQ ID NO: 2516948 - DNA, 21 bp, Homo sapiens
ctgactcacaagaagaccaga

SEQ ID NO: 2516949 - DNA, 14 bp, Homo sapiens
ctgactcagggctc

SEQ ID NO: 2516950 - DNA, 17 bp, Homo sapiens
ctgactcctctaagcca

SEQ ID NO: 2516951 - DNA, 19 bp, Homo sapiens
ctgactcctctaagccact

SEQ ID NO: 2516952 - DNA, 14 bp, Homo sapiens
ctgactctgaaatc

SEQ ID NO: 2516953 - DNA, 15 bp, Homo sapiens
ctgactctgccccct

SEQ ID NO: 2516954 - DNA, 12 bp, Homo sapiens
ctgactgggagt

SEQ ID NO: 2516955 - DNA, 15 bp, Homo sapiens
ctgacttctaagtaa

SEQ ID NO: 2516956 - DNA, 22 bp, Homo sapiens
ctgactttcatttcttgaggta

SEQ ID NO: 2516957 - DNA, 12 bp, Homo sapiens
ctgagaaagact

SEQ ID NO: 2516958 - DNA, 13 bp, Homo sapiens
ctgagaaagacta

SEQ ID NO: 2516959 - DNA, 15 bp, Homo sapiens
ctgagaattccaagg

SEQ ID NO: 2516960 - DNA, 14 bp, Homo sapiens
ctgagacagcccgg

SEQ ID NO: 2516961 - DNA, 15 bp, Homo sapiens
ctgagacagcccggg

SEQ ID NO: 2516962 - DNA, 15 bp, Homo sapiens
ctgagacaggagaat

SEQ ID NO: 2516963 - DNA, 19 bp, Homo sapiens
ctgagaccagttgggagca

SEQ ID NO: 2516964 - DNA, 23 bp, Homo sapiens
ctgagaccagttgggagcactgg

SEQ ID NO: 2516965 - DNA, 16 bp, Homo sapiens
ctgagacccctggcct

SEQ ID NO: 2516966 - DNA, 20 bp, Homo sapiens
ctgagacccctggcctccgg

SEQ ID NO: 2516967 - DNA, 14 bp, Homo sapiens
ctgagagaaaataa

SEQ ID NO: 2516968 - DNA, 16 bp, Homo sapiens
ctgagagacttttaat

SEQ ID NO: 2516969 - DNA, 18 bp, Homo sapiens
ctgagagacttttaatca

SEQ ID NO: 2516970 - DNA, 22 bp, Homo sapiens
ctgagaggacttttctttgtgg

SEQ ID NO: 2516971 - DNA, 19 bp, Homo sapiens
ctgagagtatttaggcaga

SEQ ID NO: 2516972 - DNA, 18 bp, Homo sapiens
ctgagataccagcgagga

SEQ ID NO: 2516973 - DNA, 16 bp, Homo sapiens
ctgagatgtgaacaca

SEQ ID NO: 2516974 - DNA, 19 bp, Homo sapiens
ctgagattattttaatcta

SEQ ID NO: 2516975 - DNA, 16 bp, Homo sapiens
ctgagcaacagagtga

SEQ ID NO: 2516976 - DNA, 17 bp, Homo sapiens
ctgagcaagagctggca

SEQ ID NO: 2516977 - DNA, 13 bp, Homo sapiens
ctgagcaccaggg

SEQ ID NO: 2516978 - DNA, 16 bp, Homo sapiens
ctctcctcttgccact

SEQ ID NO: 2516979 - DNA, 22 bp, Homo sapiens
ctctcctcttgccactgcctct

SEQ ID NO: 2516980 - DNA, 12 bp, Homo sapiens
ctctcctggagg

SEQ ID NO: 2516981 - DNA, 13 bp, Homo sapiens
ctctcctggagga

SEQ ID NO: 2516982 - DNA, 17 bp, Homo sapiens
ctctcctgtacctcttg

SEQ ID NO: 2516983 - DNA, 19 bp, Homo sapiens
ctctcctttggccattcca

SEQ ID NO: 2516984 - DNA, 14 bp, Homo sapiens
ctctcctttgtata

SEQ ID NO: 2516985 - DNA, 18 bp, Homo sapiens
ctctcctttgtatattat

SEQ ID NO: 2516986 - DNA, 22 bp, Homo sapiens
ctctcctttgtatattatttct

SEQ ID NO: 2516987 - DNA, 19 bp, Homo sapiens
ctctcgcacctttccaaag

SEQ ID NO: 2516988 - DNA, 19 bp, Homo sapiens
ctctcggaaggctggctgg

SEQ ID NO: 2516989 - DNA, 17 bp, Homo sapiens
ctctcggctccccatgt

SEQ ID NO: 2516990 - DNA, 19 bp, Homo sapiens
ctctcgggttgtgtgtctg

SEQ ID NO: 2516991 - DNA, 16 bp, Homo sapiens
ctctctatagcaccag

SEQ ID NO: 2516992 - DNA, 12 bp, Homo sapiens
ctctctcactcc

SEQ ID NO: 2516993 - DNA, 16 bp, Homo sapiens
ctctctcactccttga

SEQ ID NO: 2516994 - DNA, 14 bp, Homo sapiens
ctctctccacccta

SEQ ID NO: 2516995 - DNA, 23 bp, Homo sapiens
ctctctcccagtctacccagaga

SEQ ID NO: 2516996 - DNA, 14 bp, Homo sapiens
ctctctcctcctgc

SEQ ID NO: 2516997 - DNA, 17 bp, Homo sapiens
ctctctcctcctgccca

SEQ ID NO: 2516998 - DNA, 15 bp, Homo sapiens
ctctctcctttgctg

SEQ ID NO: 2516999 - DNA, 15 bp, Homo sapiens
ctctctctctttcct

SEQ ID NO: 2517000 - DNA, 18 bp, Homo sapiens
ctctctcttctgctccac

SEQ ID NO: 2517001 - DNA, 18 bp, Homo sapiens
ctctctgcaccgtactgt

SEQ ID NO: 2517002 - DNA, 16 bp, Homo sapiens
ctctctgcatctgacc

SEQ ID NO: 2517003 - DNA, 22 bp, Homo sapiens
ctctctgctctgcgtgtcacct

SEQ ID NO: 2517004 - DNA, 15 bp, Homo sapiens
ctctctggcctccca

SEQ ID NO: 2517005 - DNA, 16 bp, Homo sapiens
ctctctggcctcccac

SEQ ID NO: 2517006 - DNA, 17 bp, Homo sapiens
ctctctggcctcccacc

SEQ ID NO: 2517007 - DNA, 18 bp, Homo sapiens
ctctctggcctcccaccc

SEQ ID NO: 2517008 - DNA, 13 bp, Homo sapiens
ctctctggctggg

SEQ ID NO: 2517009 - DNA, 15 bp, Homo sapiens
ctctctggctgggga

SEQ ID NO: 2517010 - DNA, 23 bp, Homo sapiens
ctctctggggcagggttattcct

SEQ ID NO: 2517011 - DNA, 18 bp, Homo sapiens
ctctctggggccacacag

SEQ ID NO: 2517012 - DNA, 20 bp, Homo sapiens
ctctcttaggagcagagctc

SEQ ID NO: 2517013 - DNA, 18 bp, Homo sapiens
ctctcttctgctccaccc

SEQ ID NO: 2517014 - DNA, 17 bp, Homo sapiens
ctctgaaaccagtgtta

SEQ ID NO: 2517015 - DNA, 16 bp, Homo sapiens
ctctgaaatctgaaga

SEQ ID NO: 2517016 - DNA, 13 bp, Homo sapiens
ctctgaagagtgg

SEQ ID NO: 2517017 - DNA, 21 bp, Homo sapiens
ctctgaagagtgggtttcaca

SEQ ID NO: 2517018 - DNA, 14 bp, Homo sapiens
ctctgaagggaggt

SEQ ID NO: 2517019 - DNA, 17 bp, Homo sapiens
ctctgaagggcatcatg

SEQ ID NO: 2517020 - DNA, 23 bp, Homo sapiens
ctctgaagtcacatcacaggaca

SEQ ID NO: 2517021 - DNA, 19 bp, Homo sapiens
ctctgaagtgaaactgctt

SEQ ID NO: 2517022 - DNA, 20 bp, Homo sapiens
ctctgaattagtccttgctt

SEQ ID NO: 2517023 - DNA, 14 bp, Homo sapiens
ctctgacacacagc

SEQ ID NO: 2517024 - DNA, 16 bp, Homo sapiens
ctctgacccagtgaga

SEQ ID NO: 2517025 - DNA, 17 bp, Homo sapiens
ctctgaccgaaacagcg

SEQ ID NO: 2517026 - DNA, 12 bp, Homo sapiens
ctctgacctgca

SEQ ID NO: 2517027 - DNA, 16 bp, Homo sapiens
ctctgacctgcaggcc

SEQ ID NO: 2517028 - DNA, 14 bp, Homo sapiens
ctctgactcagggc

SEQ ID NO: 2517029 - DNA, 16 bp, Homo sapiens
ctctgactctcaaatc

SEQ ID NO: 2517030 - DNA, 19 bp, Homo sapiens
ctctgagaattccaaggag

SEQ ID NO: 2517031 - DNA, 22 bp, Homo sapiens
ctctgagatctaaggatgtcac

SEQ ID NO: 2517032 - DNA, 18 bp, Homo sapiens
ctctgagccagttcagta

SEQ ID NO: 2517033 - DNA, 21 bp, Homo sapiens
ctctgaggcttccagagagtc

SEQ ID NO: 2517034 - DNA, 17 bp, Homo sapiens
ctctgagggcttccttt

SEQ ID NO: 2517035 - DNA, 15 bp, Homo sapiens
ctctgataggccaag

SEQ ID NO: 2517036 - DNA, 19 bp, Homo sapiens
ctctgatattccatgaatg

SEQ ID NO: 2517037 - DNA, 15 bp, Homo sapiens
ctctgatctccatgg

SEQ ID NO: 2517038 - DNA, 18 bp, Homo sapiens
ctctgatttgcaaaaaaa

SEQ ID NO: 2517039 - DNA, 22 bp, Homo sapiens
ctctgattttcaaagctttttc

SEQ ID NO: 2517040 - DNA, 22 bp, Homo sapiens
ctctgcaagaattgaagcagga

SEQ ID NO: 2517041 - DNA, 13 bp, Homo sapiens
ctctgcacaagct

SEQ ID NO: 2517042 - DNA, 14 bp, Homo sapiens
ctctgcacaagctg

SEQ ID NO: 2517043 - DNA, 17 bp, Homo sapiens
ctctgcacaagctgcac

SEQ ID NO: 2517044 - DNA, 20 bp, Homo sapiens
ctctgcacaagctgcaccct

SEQ ID NO: 2517045 - DNA, 10 bp, Homo sapiens
ctctgcacag

SEQ ID NO: 2517046 - DNA, 20 bp, Homo sapiens
ctctgcactactcctctgca

SEQ ID NO: 2517047 - DNA, 23 bp, Homo sapiens
ctctgcactactcctctgcagtg

SEQ ID NO: 2517048 - DNA, 17 bp, Homo sapiens
ctctgcactcccctgct

SEQ ID NO: 2517049 - DNA, 20 bp, Homo sapiens
ctctgcactcccctgctggg

SEQ ID NO: 2517050 - DNA, 18 bp, Homo sapiens
ctctgcagcaataaagca

SEQ ID NO: 2517051 - DNA, 16 bp, Homo sapiens
ctctgcagcccaggga

SEQ ID NO: 2517052 - DNA, 16 bp, Homo sapiens
ctctgcagtgccttgg

SEQ ID NO: 2517053 - DNA, 19 bp, Homo sapiens
ctctgcatgcggcccagcc

SEQ ID NO: 2517054 - DNA, 19 bp, Homo sapiens
ctctgccaacttcttcaga

SEQ ID NO: 2517055 - DNA, 23 bp, Homo sapiens
ctctgccaacttcttcagagctg

SEQ ID NO: 2517056 - DNA, 17 bp, Homo sapiens
ctctgccagaagatccc

SEQ ID NO: 2517057 - DNA, 20 bp, Homo sapiens
ctctgcccactccctgcaac

SEQ ID NO: 2517058 - DNA, 16 bp, Homo sapiens
ctctgccccagaggcc

SEQ ID NO: 2517059 - DNA, 16 bp, Homo sapiens
ctctgccccagctctg

SEQ ID NO: 2517060 - DNA, 17 bp, Homo sapiens
ctctgccccagctctgg

SEQ ID NO: 2517061 - DNA, 16 bp, Homo sapiens
ctctgccctgccctag

SEQ ID NO: 2517062 - DNA, 19 bp, Homo sapiens
ctctgccctgccctagctc

SEQ ID NO: 2517063 - DNA, 20 bp, Homo sapiens
ctctgccctgccctagctcc

SEQ ID NO: 2517064 - DNA, 18 bp, Homo sapiens
ctctgccgcaatacagga

SEQ ID NO: 2517065 - DNA, 21 bp, Homo sapiens
ctctgccgcaatacaggaacc

SEQ ID NO: 2517066 - DNA, 15 bp, Homo sapiens
ctctgccggctcttt

SEQ ID NO: 2517067 - DNA, 22 bp, Homo sapiens
ctctgccggctctttccttgct

SEQ ID NO: 2517068 - DNA, 13 bp, Homo sapiens
ctctgcctcccat

SEQ ID NO: 2517069 - DNA, 14 bp, Homo sapiens
ctctgcctcccatc

SEQ ID NO: 2517070 - DNA, 21 bp, Homo sapiens
ctctgcctcccatcacccgct

SEQ ID NO: 2517071 - DNA, 17 bp, Homo sapiens
ctctgcctctgcctgca

SEQ ID NO: 2517072 - DNA, 19 bp, Homo sapiens
ctctgctacgttcctattg

SEQ ID NO: 2517073 - DNA, 18 bp, Homo sapiens
ctctgctcctctccccag

SEQ ID NO: 2517074 - DNA, 14 bp, Homo sapiens
ctctgctcctggag

SEQ ID NO: 2517075 - DNA, 17 bp, Homo sapiens
ctctgctgacagacaca

SEQ ID NO: 2517076 - DNA, 19 bp, Homo sapiens
ctctgctgacagacacagg

SEQ ID NO: 2517077 - DNA, 15 bp, Homo sapiens
ctctgctgctggctg

SEQ ID NO: 2517078 - DNA, 16 bp, Homo sapiens
ctctgctgctgtccct

SEQ ID NO: 2517079 - DNA, 21 bp, Homo sapiens
ctctgctgctgtccctccccc

SEQ ID NO: 2517080 - DNA, 13 bp, Homo sapiens
ctctgctgcttag

SEQ ID NO: 2517081 - DNA, 13 bp, Homo sapiens
ctctgctggcctg

SEQ ID NO: 2517082 - DNA, 17 bp, Homo sapiens
ctctgctggcctggccg

SEQ ID NO: 2517083 - DNA, 21 bp, Homo sapiens
ctctgctggcctggccggcaa

SEQ ID NO: 2517084 - DNA, 15 bp, Homo sapiens
ctctgctttggaaat

SEQ ID NO: 2517085 - DNA, 20 bp, Homo sapiens
ctctggaaaatgtgacccag

SEQ ID NO: 2517086 - DNA, 21 bp, Homo sapiens
ctctggaaaggggggagctgg

SEQ ID NO: 2517087 - DNA, 22 bp, Homo sapiens
ctctggaaaggggggagctggg

SEQ ID NO: 2517088 - DNA, 15 bp, Homo sapiens
ctctggacaggcatg

SEQ ID NO: 2517089 - DNA, 22 bp, Homo sapiens
ctctggacaggcatgttctctg

SEQ ID NO: 2517090 - DNA, 16 bp, Homo sapiens
ctctggaccaaccctg

SEQ ID NO: 2517091 - DNA, 13 bp, Homo sapiens
ctctggactggct

SEQ ID NO: 2517092 - DNA, 15 bp, Homo sapiens
ctctggatgcctgat

SEQ ID NO: 2517093 - DNA, 23 bp, Homo sapiens
ctctggatgcctgattgccaagc

SEQ ID NO: 2517094 - DNA, 15 bp, Homo sapiens
ctctggatggcacca

SEQ ID NO: 2517095 - DNA, 12 bp, Homo sapiens
ctctggcagctc

SEQ ID NO: 2517096 - DNA, 15 bp, Homo sapiens
ctctggcagctcaga

SEQ ID NO: 2517097 - DNA, 23 bp, Homo sapiens
ctctggcagctcagagagggtgg

SEQ ID NO: 2517098 - DNA, 19 bp, Homo sapiens
ctctggcagttctggaatg

SEQ ID NO: 2517099 - DNA, 19 bp, Homo sapiens
ctctggcattagaattatt

SEQ ID NO: 2517100 - DNA, 14 bp, Homo sapiens
ctctggccccaagg

SEQ ID NO: 2517101 - DNA, 15 bp, Homo sapiens
ctctggccccaaggg

SEQ ID NO: 2517102 - DNA, 13 bp, Homo sapiens
ctctggcctccca

SEQ ID NO: 2517103 - DNA, 14 bp, Homo sapiens
ctctggcctcccac

SEQ ID NO: 2517104 - DNA, 15 bp, Homo sapiens
ctctggcctcccacc

SEQ ID NO: 2517105 - DNA, 17 bp, Homo sapiens
ctctggcctcccacccg

SEQ ID NO: 2517106 - DNA, 19 bp, Homo sapiens
ctctggctagaggccagcc

SEQ ID NO: 2517107 - DNA, 13 bp, Homo sapiens
ctctggctctcat

SEQ ID NO: 2517108 - DNA, 19 bp, Homo sapiens
ctctggctgaaccctgtgc

SEQ ID NO: 2517109 - DNA, 13 bp, Homo sapiens
ctctggcttccag

SEQ ID NO: 2517110 - DNA, 14 bp, Homo sapiens
ctctggcttccagg

SEQ ID NO: 2517111 - DNA, 18 bp, Homo sapiens
ctctggcttccaggtatc

SEQ ID NO: 2517112 - DNA, 23 bp, Homo sapiens
ctctgggccaagtcaaagacatt

SEQ ID NO: 2517113 - DNA, 20 bp, Homo sapiens
ctctggggtcccccatcccc

SEQ ID NO: 2517114 - DNA, 14 bp, Homo sapiens
ctctggtccataga

SEQ ID NO: 2517115 - DNA, 22 bp, Homo sapiens
ctctggtccggacactcctaga

SEQ ID NO: 2517116 - DNA, 20 bp, Homo sapiens
ctctggtcttctttgggtaa

SEQ ID NO: 2517117 - DNA, 16 bp, Homo sapiens
ctctggtgacaccagc

SEQ ID NO: 2517118 - DNA, 16 bp, Homo sapiens
ctctggtttaattaca

SEQ ID NO: 2517119 - DNA, 20 bp, Homo sapiens
ctctggtttggggcgaggca

SEQ ID NO: 2517120 - DNA, 21 bp, Homo sapiens
ctctgtaaatgaaaaaaccca

SEQ ID NO: 2517121 - DNA, 18 bp, Homo sapiens
ctctgtaatctcgtttca

SEQ ID NO: 2517122 - DNA, 22 bp, Homo sapiens
ctctgtatcaggacccagagga

SEQ ID NO: 2517123 - DNA, 15 bp, Homo sapiens
ctctgtcaatgaaaa

SEQ ID NO: 2517124 - DNA, 18 bp, Homo sapiens
ctctgtcactgcaggcac

SEQ ID NO: 2517125 - DNA, 23 bp, Homo sapiens
ctctgtcagatgggaagacatga

SEQ ID NO: 2517126 - DNA, 12 bp, Homo sapiens
ctctgtccaggc

SEQ ID NO: 2517127 - DNA, 14 bp, Homo sapiens
ctctgtccaggcac

SEQ ID NO: 2517128 - DNA, 19 bp, Homo sapiens
ctctgtccaggcactgaga

SEQ ID NO: 2517129 - DNA, 14 bp, Homo sapiens
ctctgtccagggcc

SEQ ID NO: 2517130 - DNA, 20 bp, Homo sapiens
ctctgtccagggccctgagc

SEQ ID NO: 2517131 - DNA, 22 bp, Homo sapiens
ctctgtccagggccctgagctc

SEQ ID NO: 2517132 - DNA, 13 bp, Homo sapiens
ctctgtcctggga

SEQ ID NO: 2517133 - DNA, 14 bp, Homo sapiens
ctctgtcctgggag

SEQ ID NO: 2517134 - DNA, 18 bp, Homo sapiens
ctctgtcgcccagtctgg

SEQ ID NO: 2517135 - DNA, 15 bp, Homo sapiens
ctctgtctcatccat

SEQ ID NO: 2517136 - DNA, 16 bp, Homo sapiens
ctctgtctcatgtgtg

SEQ ID NO: 2517137 - DNA, 20 bp, Homo sapiens
ctctgtctcatgtgtgctct

SEQ ID NO: 2517138 - DNA, 14 bp, Homo sapiens
ctctgtctgccctt

SEQ ID NO: 2517139 - DNA, 17 bp, Homo sapiens
ctctgtcttcacctgat

SEQ ID NO: 2517140 - DNA, 19 bp, Homo sapiens
ctctgtgaccaatgtcttg

SEQ ID NO: 2517141 - DNA, 23 bp, Homo sapiens
ctctgtgacctgccccgcccagc

SEQ ID NO: 2517142 - DNA, 22 bp, Homo sapiens
ctctgtgagcatcacagttttg

SEQ ID NO: 2517143 - DNA, 19 bp, Homo sapiens
ctctgtgctgaccctcctg

SEQ ID NO: 2517144 - DNA, 15 bp, Homo sapiens
ctctgtgctgtggaa

SEQ ID NO: 2517145 - DNA, 19 bp, Homo sapiens
ctctgtgtttgttcctaca

SEQ ID NO: 2517146 - DNA, 23 bp, Homo sapiens
ctctgttcccctagtaagtgcct

SEQ ID NO: 2517147 - DNA, 16 bp, Homo sapiens
ctctgttccttcacat

SEQ ID NO: 2517148 - DNA, 20 bp, Homo sapiens
ctctgttgcccaggctggag

SEQ ID NO: 2517149 - DNA, 16 bp, Homo sapiens
ctctgtttctccttct

SEQ ID NO: 2517150 - DNA, 24 bp, Homo sapiens
ctcttaaaacccaagtgccttagc

SEQ ID NO: 2517151 - DNA, 22 bp, Homo sapiens
ctcttaaagaaaacccaccccg

SEQ ID NO: 2517152 - DNA, 12 bp, Homo sapiens
ctcttaagccat

SEQ ID NO: 2517153 - DNA, 14 bp, Homo sapiens
ctcttaagccatct

SEQ ID NO: 2517154 - DNA, 12 bp, Homo sapiens
ctcttaagtttc

SEQ ID NO: 2517155 - DNA, 13 bp, Homo sapiens
ctcttagaaaaac

SEQ ID NO: 2517156 - DNA, 13 bp, Homo sapiens
ctcttagctgtct

SEQ ID NO: 2517157 - DNA, 16 bp, Homo sapiens
ctcttatagaatattt

SEQ ID NO: 2517158 - DNA, 22 bp, Homo sapiens
ctcttatctcagtcatgcataa

SEQ ID NO: 2517159 - DNA, 23 bp, Homo sapiens
ctcttatctcagtcatgcataaa

SEQ ID NO: 2517160 - DNA, 16 bp, Homo sapiens
ctcttattcagtaaaa

SEQ ID NO: 2517161 - DNA, 19 bp, Homo sapiens
ctcttattgcccacgctgg

SEQ ID NO: 2517162 - DNA, 23 bp, Homo sapiens
ctcttcaggaagaaaggagtctg

SEQ ID NO: 2517163 - DNA, 15 bp, Homo sapiens
ctcttcaggcctccc

SEQ ID NO: 2517164 - DNA, 16 bp, Homo sapiens
ctcttcaggcctccct

SEQ ID NO: 2517165 - DNA, 19 bp, Homo sapiens
ctcttcaggcctccctctc

SEQ ID NO: 2517166 - DNA, 15 bp, Homo sapiens
ctcttcaggttctta

SEQ ID NO: 2517167 - DNA, 23 bp, Homo sapiens
ctcttccaggctgggagagcctt

SEQ ID NO: 2517168 - DNA, 23 bp, Homo sapiens
ctcttccagtcttcctgacactt

SEQ ID NO: 2517169 - DNA, 12 bp, Homo sapiens
ctcttccccaga

SEQ ID NO: 2517170 - DNA, 21 bp, Homo sapiens
ctcttccccagaaaggagact

SEQ ID NO: 2517171 - DNA, 19 bp, Homo sapiens
ctcttccccttgcccttgc

SEQ ID NO: 2517172 - DNA, 23 bp, Homo sapiens
ctcttccccttgcccttgccctg

SEQ ID NO: 2517173 - DNA, 20 bp, Homo sapiens
ctcttccgaaaaatcctctt

SEQ ID NO: 2517174 - DNA, 23 bp, Homo sapiens
ctcttccgaaaaatcctcttcct

SEQ ID NO: 2517175 - DNA, 23 bp, Homo sapiens
ctcttccggagatgtagcaaaac

SEQ ID NO: 2517176 - DNA, 19 bp, Homo sapiens
ctcttcctacccaaccact

SEQ ID NO: 2517177 - DNA, 20 bp, Homo sapiens
ctcttcctacccaaccactc

SEQ ID NO: 2517178 - DNA, 16 bp, Homo sapiens
ctcttcctctgaggct

SEQ ID NO: 2517179 - DNA, 17 bp, Homo sapiens
ctcttcctctgaggctg

SEQ ID NO: 2517180 - DNA, 14 bp, Homo sapiens
ctcttcctgcaagg

SEQ ID NO: 2517181 - DNA, 19 bp, Homo sapiens
ctcttctattttgtaaact

SEQ ID NO: 2517182 - DNA, 13 bp, Homo sapiens
ctcttctccccag

SEQ ID NO: 2517183 - DNA, 14 bp, Homo sapiens
ctcttctcttcctg

SEQ ID NO: 2517184 - DNA, 16 bp, Homo sapiens
ctcttctcttcctgta

SEQ ID NO: 2517185 - DNA, 12 bp, Homo sapiens
ctcttctgagct

SEQ ID NO: 2517186 - DNA, 21 bp, Homo sapiens
ctcttctgagctatttcatct

SEQ ID NO: 2517187 - DNA, 22 bp, Homo sapiens
ctcttctgagctatttcatcta

SEQ ID NO: 2517188 - DNA, 23 bp, Homo sapiens
ctcttctgagctatttcatctat

SEQ ID NO: 2517189 - DNA, 14 bp, Homo sapiens
ctcttctgctccac

SEQ ID NO: 2517190 - DNA, 16 bp, Homo sapiens
ctcttctgctccaccc

SEQ ID NO: 2517191 - DNA, 20 bp, Homo sapiens
ctcttctgcttaggagagac

SEQ ID NO: 2517192 - DNA, 21 bp, Homo sapiens
ctcttctgggagggcagcagg

SEQ ID NO: 2517193 - DNA, 16 bp, Homo sapiens
ctcttctgtgggtgac

SEQ ID NO: 2517194 - DNA, 16 bp, Homo sapiens
ctcttcttttggcttc

SEQ ID NO: 2517195 - DNA, 16 bp, Homo sapiens
ctcttgacctcaggtg

SEQ ID NO: 2517196 - DNA, 17 bp, Homo sapiens
ctcttgaggccaggagt

SEQ ID NO: 2517197 - DNA, 14 bp, Homo sapiens
ctcttgagggagct

SEQ ID NO: 2517198 - DNA, 18 bp, Homo sapiens
ctcttgatacccccctct

SEQ ID NO: 2517199 - DNA, 21 bp, Homo sapiens
ctcttgatacccccctctgtc

SEQ ID NO: 2517200 - DNA, 13 bp, Homo sapiens
ctcttgcacccgc

SEQ ID NO: 2517201 - DNA, 19 bp, Homo sapiens
ctcttgccactgcctcttc

SEQ ID NO: 2517202 - DNA, 22 bp, Homo sapiens
ctcttgccccccaccccagcct

SEQ ID NO: 2517203 - DNA, 14 bp, Homo sapiens
ctcttgcccttccc

SEQ ID NO: 2517204 - DNA, 17 bp, Homo sapiens
ctcttgcccttccctgt

SEQ ID NO: 2517205 - DNA, 12 bp, Homo sapiens
ctcttgctcaaa

SEQ ID NO: 2517206 - DNA, 19 bp, Homo sapiens
ctcttgctcaaaaatctgt

SEQ ID NO: 2517207 - DNA, 12 bp, Homo sapiens
ctcttgctcttt

SEQ ID NO: 2517208 - DNA, 13 bp, Homo sapiens
ctcttgctctttc

SEQ ID NO: 2517209 - DNA, 18 bp, Homo sapiens
ctcttggacctctgctct

SEQ ID NO: 2517210 - DNA, 15 bp, Homo sapiens
ctcttgggctgagac

SEQ ID NO: 2517211 - DNA, 19 bp, Homo sapiens
ctcttgggttcaagcgatt

SEQ ID NO: 2517212 - DNA, 15 bp, Homo sapiens
ctcttggtcctgctg

SEQ ID NO: 2517213 - DNA, 18 bp, Homo sapiens
ctcttggtcttcccaggc

SEQ ID NO: 2517214 - DNA, 16 bp, Homo sapiens
ctctttaatcttcagt

SEQ ID NO: 2517215 - DNA, 20 bp, Homo sapiens
ctctttaatgtcacaggcag

SEQ ID NO: 2517216 - DNA, 22 bp, Homo sapiens
ctctttaatgtcacaggcaggt

SEQ ID NO: 2517217 - DNA, 22 bp, Homo sapiens
ctctttatatggcctcaagatc

SEQ ID NO: 2517218 - DNA, 12 bp, Homo sapiens
ctctttctgggc

SEQ ID NO: 2517219 - DNA, 17 bp, Homo sapiens
ctctttgaatgacaaag

SEQ ID NO: 2517220 - DNA, 15 bp, Homo sapiens
ctctttgagatagaa

SEQ ID NO: 2517221 - DNA, 18 bp, Homo sapiens
ctctttggacactcacac

SEQ ID NO: 2517222 - DNA, 18 bp, Homo sapiens
ctctttggctcccctgta

SEQ ID NO: 2517223 - DNA, 18 bp, Homo sapiens
ctctttgtctaaaacaat

SEQ ID NO: 2517224 - DNA, 14 bp, Homo sapiens
ctcttttctctgtg

SEQ ID NO: 2517225 - DNA, 18 bp, Homo sapiens
ctcttttctttagagcat

SEQ ID NO: 2517226 - DNA, 22 bp, Homo sapiens
ctctttttagggccaggcaggt

SEQ ID NO: 2517227 - DNA, 17 bp, Homo sapiens
ctctttttgggctcctt

SEQ ID NO: 2517228 - DNA, 14 bp, Homo sapiens
ctgaaaaaaagttt

SEQ ID NO: 2517229 - DNA, 15 bp, Homo sapiens
ctgaaaaaaagttta

SEQ ID NO: 2517230 - DNA, 18 bp, Homo sapiens
ctgaaaaaaagtttacaa

SEQ ID NO: 2517231 - DNA, 14 bp, Homo sapiens
ctgaaaacatctgg

SEQ ID NO: 2517232 - DNA, 14 bp, Homo sapiens
ctgaaaacctctcc

SEQ ID NO: 2517233 - DNA, 17 bp, Homo sapiens
ctgaaaacctctcctca

SEQ ID NO: 2517234 - DNA, 13 bp, Homo sapiens
ctgaaaatataac

SEQ ID NO: 2517235 - DNA, 16 bp, Homo sapiens
ctgaaaatctaatatt

SEQ ID NO: 2517236 - DNA, 14 bp, Homo sapiens
ctgaaaatgtatgt

SEQ ID NO: 2517237 - DNA, 16 bp, Homo sapiens
ctgaaaatgtatgtgt

SEQ ID NO: 2517238 - DNA, 16 bp, Homo sapiens
ctgaaaattaacactg

SEQ ID NO: 2517239 - DNA, 17 bp, Homo sapiens
ctgaaaattaacactgc

SEQ ID NO: 2517240 - DNA, 15 bp, Homo sapiens
ctgaaagaaacagtt

SEQ ID NO: 2517241 - DNA, 19 bp, Homo sapiens
ctgaaagaaacagttaact

SEQ ID NO: 2517242 - DNA, 14 bp, Homo sapiens
ctgaaagccagctg

SEQ ID NO: 2517243 - DNA, 23 bp, Homo sapiens
ctgaaagccctgagctttctgct

SEQ ID NO: 2517244 - DNA, 16 bp, Homo sapiens
ctgaaatctgaagacc

SEQ ID NO: 2517245 - DNA, 13 bp, Homo sapiens
ctgaaattttata

SEQ ID NO: 2517246 - DNA, 19 bp, Homo sapiens
ctgaaattttatatgctta

SEQ ID NO: 2517247 - DNA, 12 bp, Homo sapiens
ctgaacaagaat

SEQ ID NO: 2517248 - DNA, 13 bp, Homo sapiens
ctgaacaagaatt

SEQ ID NO: 2517249 - DNA, 18 bp, Homo sapiens
ctgaacactccaattaag

SEQ ID NO: 2517250 - DNA, 23 bp, Homo sapiens
ctgaacactccaattaaggattt

SEQ ID NO: 2517251 - DNA, 16 bp, Homo sapiens
ctgaacccctccctcc

SEQ ID NO: 2517252 - DNA, 14 bp, Homo sapiens
ctgaaccctgtgct

SEQ ID NO: 2517253 - DNA, 15 bp, Homo sapiens
ctgaaccctgtgctg

SEQ ID NO: 2517254 - DNA, 20 bp, Homo sapiens
ctgaaccctgtgctggtgtc

SEQ ID NO: 2517255 - DNA, 23 bp, Homo sapiens
ctgaaccctgtgctggtgtcctg

SEQ ID NO: 2517256 - DNA, 14 bp, Homo sapiens
ctgaacctgatgct

SEQ ID NO: 2517257 - DNA, 13 bp, Homo sapiens
ctgaactctccag

SEQ ID NO: 2517258 - DNA, 14 bp, Homo sapiens
ctgaactttgctga

SEQ ID NO: 2517259 - DNA, 21 bp, Homo sapiens
ctgaagactcattcttctgta

SEQ ID NO: 2517260 - DNA, 14 bp, Homo sapiens
ctgaagaggcgggc

SEQ ID NO: 2517261 - DNA, 19 bp, Homo sapiens
ctagccttgaggagtgtga

SEQ ID NO: 2517262 - DNA, 14 bp, Homo sapiens
ctagctagaaatat

SEQ ID NO: 2517263 - DNA, 15 bp, Homo sapiens
ctagctagaaatatg

SEQ ID NO: 2517264 - DNA, 17 bp, Homo sapiens
ctagctagaaatatgat

SEQ ID NO: 2517265 - DNA, 15 bp, Homo sapiens
ctagctcccctcctc

SEQ ID NO: 2517266 - DNA, 16 bp, Homo sapiens
ctagctcccctcctct

SEQ ID NO: 2517267 - DNA, 16 bp, Homo sapiens
ctagctgcacagggca

SEQ ID NO: 2517268 - DNA, 18 bp, Homo sapiens
ctagctgttgagctgttt

SEQ ID NO: 2517269 - DNA, 14 bp, Homo sapiens
ctaggaagaatttt

SEQ ID NO: 2517270 - DNA, 17 bp, Homo sapiens
ctaggaagactttggaa

SEQ ID NO: 2517271 - DNA, 12 bp, Homo sapiens
ctaggactctga

SEQ ID NO: 2517272 - DNA, 14 bp, Homo sapiens
ctaggactctgagg

SEQ ID NO: 2517273 - DNA, 13 bp, Homo sapiens
ctaggcaggacat

SEQ ID NO: 2517274 - DNA, 14 bp, Homo sapiens
ctaggcatcccagg

SEQ ID NO: 2517275 - DNA, 21 bp, Homo sapiens
ctaggcatttgctgaatacag

SEQ ID NO: 2517276 - DNA, 12 bp, Homo sapiens
ctaggccgggcg

SEQ ID NO: 2517277 - DNA, 18 bp, Homo sapiens
ctaggctacaattttctc

SEQ ID NO: 2517278 - DNA, 12 bp, Homo sapiens
ctaggctcagag

SEQ ID NO: 2517279 - DNA, 22 bp, Homo sapiens
ctaggctcagagatgtgcaccc

SEQ ID NO: 2517280 - DNA, 11 bp, Homo sapiens
ctaggctgggg

SEQ ID NO: 2517281 - DNA, 22 bp, Homo sapiens
ctaggctggggaagtcctctgg

SEQ ID NO: 2517282 - DNA, 14 bp, Homo sapiens
ctagggaagggtgg

SEQ ID NO: 2517283 - DNA, 16 bp, Homo sapiens
ctagggacccctcctc

SEQ ID NO: 2517284 - DNA, 17 bp, Homo sapiens
ctagggacccctcctcc

SEQ ID NO: 2517285 - DNA, 23 bp, Homo sapiens
ctagggaggaccttatctgtgcg

SEQ ID NO: 2517286 - DNA, 19 bp, Homo sapiens
ctagggatgttctggccct

SEQ ID NO: 2517287 - DNA, 18 bp, Homo sapiens
ctagggattcaggctgct

SEQ ID NO: 2517288 - DNA, 20 bp, Homo sapiens
ctagggattcaggctgcttg

SEQ ID NO: 2517289 - DNA, 21 bp, Homo sapiens
ctaggggtcagggaccaagga

SEQ ID NO: 2517290 - DNA, 13 bp, Homo sapiens
ctagggtggccct

SEQ ID NO: 2517291 - DNA, 23 bp, Homo sapiens
ctaggtctcggactaagcctacc

SEQ ID NO: 2517292 - DNA, 22 bp, Homo sapiens
ctaggtgcccttggaggccagc

SEQ ID NO: 2517293 - DNA, 23 bp, Homo sapiens
ctaggtggcaaggctgtgctccc

SEQ ID NO: 2517294 - DNA, 13 bp, Homo sapiens
ctaggtgggccag

SEQ ID NO: 2517295 - DNA, 14 bp, Homo sapiens
ctaggtttaactca

SEQ ID NO: 2517296 - DNA, 18 bp, Homo sapiens
ctaggtttaactcagatc

SEQ ID NO: 2517297 - DNA, 16 bp, Homo sapiens
ctagtaagtgccttcc

SEQ ID NO: 2517298 - DNA, 17 bp, Homo sapiens
ctagtaagtgccttcca

SEQ ID NO: 2517299 - DNA, 15 bp, Homo sapiens
ctagtcccttccaca

SEQ ID NO: 2517300 - DNA, 15 bp, Homo sapiens
ctagtcccttcccct

SEQ ID NO: 2517301 - DNA, 17 bp, Homo sapiens
ctagtcccttcccctcc

SEQ ID NO: 2517302 - DNA, 13 bp, Homo sapiens
ctagtctctctgg

SEQ ID NO: 2517303 - DNA, 17 bp, Homo sapiens
ctagtgaaggcttctct

SEQ ID NO: 2517304 - DNA, 14 bp, Homo sapiens
ctagtgcagctgat

SEQ ID NO: 2517305 - DNA, 23 bp, Homo sapiens
ctagtgcagctgattttaacaat

SEQ ID NO: 2517306 - DNA, 19 bp, Homo sapiens
ctagtgccctccacagccg

SEQ ID NO: 2517307 - DNA, 15 bp, Homo sapiens
ctagtggcttcaaaa

SEQ ID NO: 2517308 - DNA, 16 bp, Homo sapiens
ctagtggtctttgtaa

SEQ ID NO: 2517309 - DNA, 17 bp, Homo sapiens
ctagtggtctttgtaag

SEQ ID NO: 2517310 - DNA, 22 bp, Homo sapiens
ctagtgtggtgtttcctggcac

SEQ ID NO: 2517311 - DNA, 18 bp, Homo sapiens
ctagttcatccaatcctc

SEQ ID NO: 2517312 - DNA, 21 bp, Homo sapiens
ctagttcatccaatcctcact

SEQ ID NO: 2517313 - DNA, 18 bp, Homo sapiens
ctagttccaccatcaagc

SEQ ID NO: 2517314 - DNA, 22 bp, Homo sapiens
ctagttccaccatcaagccacc

SEQ ID NO: 2517315 - DNA, 13 bp, Homo sapiens
ctagtttgattaa

SEQ ID NO: 2517316 - DNA, 22 bp, Homo sapiens
ctagtttgattaaattcttgca

SEQ ID NO: 2517317 - DNA, 17 bp, Homo sapiens
ctagttttctcctccca

SEQ ID NO: 2517318 - DNA, 16 bp, Homo sapiens
ctataaagtaaagcta

SEQ ID NO: 2517319 - DNA, 17 bp, Homo sapiens
ctataaagtaaagctaa

SEQ ID NO: 2517320 - DNA, 19 bp, Homo sapiens
ctataatcccagcactttg

SEQ ID NO: 2517321 - DNA, 19 bp, Homo sapiens
ctatactgcatacttttta

SEQ ID NO: 2517322 - DNA, 14 bp, Homo sapiens
ctatagctcaggac

SEQ ID NO: 2517323 - DNA, 15 bp, Homo sapiens
ctataggctggagaa

SEQ ID NO: 2517324 - DNA, 22 bp, Homo sapiens
ctataggctggagaagctcacc

SEQ ID NO: 2517325 - DNA, 21 bp, Homo sapiens
ctataggtgctacaaaaacac

SEQ ID NO: 2517326 - DNA, 21 bp, Homo sapiens
ctatagtccagctttgttctt

SEQ ID NO: 2517327 - DNA, 16 bp, Homo sapiens
ctatatagtttattga

SEQ ID NO: 2517328 - DNA, 18 bp, Homo sapiens
ctatatataattctgtac

SEQ ID NO: 2517329 - DNA, 21 bp, Homo sapiens
ctatatataattctgtacata

SEQ ID NO: 2517330 - DNA, 13 bp, Homo sapiens
ctatatatgtgta

SEQ ID NO: 2517331 - DNA, 15 bp, Homo sapiens
ctatatccatgtact

SEQ ID NO: 2517332 - DNA, 16 bp, Homo sapiens
ctatatccatgtactg

SEQ ID NO: 2517333 - DNA, 18 bp, Homo sapiens
ctatatccatgtactgta

SEQ ID NO: 2517334 - DNA, 20 bp, Homo sapiens
ctatatccatgtactgtagt

SEQ ID NO: 2517335 - DNA, 19 bp, Homo sapiens
ctatatctgtatataaaat

SEQ ID NO: 2517336 - DNA, 14 bp, Homo sapiens
ctatatgtacttgt

SEQ ID NO: 2517337 - DNA, 21 bp, Homo sapiens
ctatatgtacttgtcaaagaa

SEQ ID NO: 2517338 - DNA, 22 bp, Homo sapiens
ctatattgttttcagtgtacat

SEQ ID NO: 2517339 - DNA, 22 bp, Homo sapiens
ctatatttagattgttaaaata

SEQ ID NO: 2517340 - DNA, 23 bp, Homo sapiens
ctatatttagattgttaaaataa

SEQ ID NO: 2517341 - DNA, 14 bp, Homo sapiens
ctatcaatagtcaa

SEQ ID NO: 2517342 - DNA, 16 bp, Homo sapiens
ctatcaatagtcaaga

SEQ ID NO: 2517343 - DNA, 20 bp, Homo sapiens
ctatcaatagtcaagaaaaa

SEQ ID NO: 2517344 - DNA, 18 bp, Homo sapiens
ctatcaatatataaattt

SEQ ID NO: 2517345 - DNA, 14 bp, Homo sapiens
ctatcacctcccct

SEQ ID NO: 2517346 - DNA, 16 bp, Homo sapiens
ctatcacctcccctcc

SEQ ID NO: 2517347 - DNA, 21 bp, Homo sapiens
ctatcagaggtgaaagctata

SEQ ID NO: 2517348 - DNA, 19 bp, Homo sapiens
ctatcagagttgctgcaaa

SEQ ID NO: 2517349 - DNA, 15 bp, Homo sapiens
ctatcatttttgtac

SEQ ID NO: 2517350 - DNA, 17 bp, Homo sapiens
ctatcatttttgtacag

SEQ ID NO: 2517351 - DNA, 23 bp, Homo sapiens
ctatccacagagagtcccactgc

SEQ ID NO: 2517352 - DNA, 13 bp, Homo sapiens
ctatcctctgtaa

SEQ ID NO: 2517353 - DNA, 17 bp, Homo sapiens
ctatctaaccctcccat

SEQ ID NO: 2517354 - DNA, 13 bp, Homo sapiens
ctatctcccccag

SEQ ID NO: 2517355 - DNA, 21 bp, Homo sapiens
ctatctctgtgtgcacaaata

SEQ ID NO: 2517356 - DNA, 21 bp, Homo sapiens
ctatctgaaccattaaagtcg

SEQ ID NO: 2517357 - DNA, 22 bp, Homo sapiens
ctatcttaattttggttgtatt

SEQ ID NO: 2517358 - DNA, 21 bp, Homo sapiens
ctatcttagtggttccccacc

SEQ ID NO: 2517359 - DNA, 12 bp, Homo sapiens
ctatctttgcca

SEQ ID NO: 2517360 - DNA, 21 bp, Homo sapiens
ctatctttgccaccctcatgc

SEQ ID NO: 2517361 - DNA, 18 bp, Homo sapiens
ctatgaagtatataatgg

SEQ ID NO: 2517362 - DNA, 23 bp, Homo sapiens
ctatgaagtatataatggtttca

SEQ ID NO: 2517363 - DNA, 22 bp, Homo sapiens
ctatgaatgggcaaaactgaat

SEQ ID NO: 2517364 - DNA, 11 bp, Homo sapiens
ctatgagaaaa

SEQ ID NO: 2517365 - DNA, 21 bp, Homo sapiens
ctatgagaattgggattacat

SEQ ID NO: 2517366 - DNA, 22 bp, Homo sapiens
ctatgaggaataattatttatt

SEQ ID NO: 2517367 - DNA, 23 bp, Homo sapiens
ctatgaggaataattatttattt

SEQ ID NO: 2517368 - DNA, 20 bp, Homo sapiens
ctatgatatggtaaaagtta

SEQ ID NO: 2517369 - DNA, 22 bp, Homo sapiens
ctatgatcccagcactttggga

SEQ ID NO: 2517370 - DNA, 15 bp, Homo sapiens
ctatgatttggaaaa

SEQ ID NO: 2517371 - DNA, 19 bp, Homo sapiens
ctatgatttggaaaataaa

SEQ ID NO: 2517372 - DNA, 20 bp, Homo sapiens
ctatgcaatatatctaaatt

SEQ ID NO: 2517373 - DNA, 21 bp, Homo sapiens
ctatgcacatatggactctgc

SEQ ID NO: 2517374 - DNA, 11 bp, Homo sapiens
ctatgcatttg

SEQ ID NO: 2517375 - DNA, 21 bp, Homo sapiens
ctatgcatttgaaaattttga

SEQ ID NO: 2517376 - DNA, 19 bp, Homo sapiens
ctatgccagctcagtccca

SEQ ID NO: 2517377 - DNA, 23 bp, Homo sapiens
ctatggacggtgctccaggcagg

SEQ ID NO: 2517378 - DNA, 10 bp, Homo sapiens
ctatggatgt

SEQ ID NO: 2517379 - DNA, 18 bp, Homo sapiens
ctatggatgtggggtccc

SEQ ID NO: 2517380 - DNA, 23 bp, Homo sapiens
ctatggctggccactgcacagag

SEQ ID NO: 2517381 - DNA, 13 bp, Homo sapiens
ctatgggagcccc

SEQ ID NO: 2517382 - DNA, 19 bp, Homo sapiens
ctatgggagccccagggtc

SEQ ID NO: 2517383 - DNA, 18 bp, Homo sapiens
ctatggggatggtccact

SEQ ID NO: 2517384 - DNA, 19 bp, Homo sapiens
ctatggtgagatgcagctg

SEQ ID NO: 2517385 - DNA, 21 bp, Homo sapiens
ctatggtgagatgcagctgga

SEQ ID NO: 2517386 - DNA, 15 bp, Homo sapiens
ctatggtgccaatgg

SEQ ID NO: 2517387 - DNA, 22 bp, Homo sapiens
ctatgtaacatgtaggaagtag

SEQ ID NO: 2517388 - DNA, 15 bp, Homo sapiens
ctatgtaactgcatt

SEQ ID NO: 2517389 - DNA, 13 bp, Homo sapiens
ctatgtatcaatg

SEQ ID NO: 2517390 - DNA, 16 bp, Homo sapiens
ctatgtatcaatgagt

SEQ ID NO: 2517391 - DNA, 14 bp, Homo sapiens
ctatgtatggaata

SEQ ID NO: 2517392 - DNA, 22 bp, Homo sapiens
ctatgtatggaatacagtgtta

SEQ ID NO: 2517393 - DNA, 14 bp, Homo sapiens
ctatgtcctaagga

SEQ ID NO: 2517394 - DNA, 21 bp, Homo sapiens
ctatgtcctaaggacacacta

SEQ ID NO: 2517395 - DNA, 18 bp, Homo sapiens
ctatgtgattttaactct

SEQ ID NO: 2517396 - DNA, 19 bp, Homo sapiens
ctatgtgattttaactctg

SEQ ID NO: 2517397 - DNA, 21 bp, Homo sapiens
ctatgtgattttaactctgtc

SEQ ID NO: 2517398 - DNA, 17 bp, Homo sapiens
ctatgtggctgtatctt

SEQ ID NO: 2517399 - DNA, 22 bp, Homo sapiens
ctatgtgtagggcgggaggatg

SEQ ID NO: 2517400 - DNA, 18 bp, Homo sapiens
ctatgttgcccaggcagg

SEQ ID NO: 2517401 - DNA, 16 bp, Homo sapiens
ctattagccacaaaat

SEQ ID NO: 2517402 - DNA, 18 bp, Homo sapiens
ctattatagccacatccc

SEQ ID NO: 2517403 - DNA, 22 bp, Homo sapiens
ctattcaaggtggccaaattat

SEQ ID NO: 2517404 - DNA, 14 bp, Homo sapiens
ctattcagacaagc

SEQ ID NO: 2517405 - DNA, 15 bp, Homo sapiens
ctattcagacaagca

SEQ ID NO: 2517406 - DNA, 17 bp, Homo sapiens
ctattcagacaagcaac

SEQ ID NO: 2517407 - DNA, 21 bp, Homo sapiens
ctattcagttcccagaatcaa

SEQ ID NO: 2517408 - DNA, 22 bp, Homo sapiens
ctattcccacacctccacagtt

SEQ ID NO: 2517409 - DNA, 16 bp, Homo sapiens
ctattgacaagtcatt

SEQ ID NO: 2517410 - DNA, 17 bp, Homo sapiens
ctattgatgtacagtct

SEQ ID NO: 2517411 - DNA, 20 bp, Homo sapiens
ctcccctccttgcctcctgt

SEQ ID NO: 2517412 - DNA, 14 bp, Homo sapiens
ctcccctcggagaa

SEQ ID NO: 2517413 - DNA, 10 bp, Homo sapiens
ctcccctcta

SEQ ID NO: 2517414 - DNA, 21 bp, Homo sapiens
ctcccctctatttagcatgac

SEQ ID NO: 2517415 - DNA, 17 bp, Homo sapiens
ctcccctctcttgcacc

SEQ ID NO: 2517416 - DNA, 13 bp, Homo sapiens
ctcccctgaggct

SEQ ID NO: 2517417 - DNA, 16 bp, Homo sapiens
ctcccctgccagggca

SEQ ID NO: 2517418 - DNA, 14 bp, Homo sapiens
ctcccctgccctgc

SEQ ID NO: 2517419 - DNA, 14 bp, Homo sapiens
ctcccctgtacctt

SEQ ID NO: 2517420 - DNA, 11 bp, Homo sapiens
ctccccttccc

SEQ ID NO: 2517421 - DNA, 16 bp, Homo sapiens
ctccccttgagctgag

SEQ ID NO: 2517422 - DNA, 13 bp, Homo sapiens
ctccccttgggcg

SEQ ID NO: 2517423 - DNA, 17 bp, Homo sapiens
ctcccgaatagctggga

SEQ ID NO: 2517424 - DNA, 16 bp, Homo sapiens
ctcccgagtagctggg

SEQ ID NO: 2517425 - DNA, 17 bp, Homo sapiens
ctcccgagtagctggga

SEQ ID NO: 2517426 - DNA, 20 bp, Homo sapiens
ctcccgctgcccaggggagc

SEQ ID NO: 2517427 - DNA, 14 bp, Homo sapiens
ctcccgctgctgct

SEQ ID NO: 2517428 - DNA, 16 bp, Homo sapiens
ctcccgctgctgctgc

SEQ ID NO: 2517429 - DNA, 20 bp, Homo sapiens
ctcccggctatgggggcact

SEQ ID NO: 2517430 - DNA, 19 bp, Homo sapiens
ctcccgggccctcccttgg

SEQ ID NO: 2517431 - DNA, 21 bp, Homo sapiens
ctcccgtcagggcccaagtcc

SEQ ID NO: 2517432 - DNA, 13 bp, Homo sapiens
ctccctaccacct

SEQ ID NO: 2517433 - DNA, 14 bp, Homo sapiens
ctccctaccacctc

SEQ ID NO: 2517434 - DNA, 21 bp, Homo sapiens
ctccctagccagcacttgtat

SEQ ID NO: 2517435 - DNA, 21 bp, Homo sapiens
ctccctagtgacccggaggcc

SEQ ID NO: 2517436 - DNA, 23 bp, Homo sapiens
ctccctatctaaccctcccatgg

SEQ ID NO: 2517437 - DNA, 17 bp, Homo sapiens
ctccctattttttttct

SEQ ID NO: 2517438 - DNA, 21 bp, Homo sapiens
ctccctattttttttctgtta

SEQ ID NO: 2517439 - DNA, 22 bp, Homo sapiens
ctccctattttttttctgttat

SEQ ID NO: 2517440 - DNA, 17 bp, Homo sapiens
ctccctcaattccccct

SEQ ID NO: 2517441 - DNA, 13 bp, Homo sapiens
ctccctcaccctg

SEQ ID NO: 2517442 - DNA, 18 bp, Homo sapiens
ctccctcagcccctcttg

SEQ ID NO: 2517443 - DNA, 14 bp, Homo sapiens
ctccctcccctgcc

SEQ ID NO: 2517444 - DNA, 15 bp, Homo sapiens
ctccctcccctgcca

SEQ ID NO: 2517445 - DNA, 16 bp, Homo sapiens
ctccctcccctgccct

SEQ ID NO: 2517446 - DNA, 21 bp, Homo sapiens
ctccctcccctgccctggtcc

SEQ ID NO: 2517447 - DNA, 23 bp, Homo sapiens
ctccctcccctgccctggtccag

SEQ ID NO: 2517448 - DNA, 18 bp, Homo sapiens
ctccctccgatccttcct

SEQ ID NO: 2517449 - DNA, 15 bp, Homo sapiens
ctccctcctcacctc

SEQ ID NO: 2517450 - DNA, 17 bp, Homo sapiens
ctccctcctcacctctg

SEQ ID NO: 2517451 - DNA, 14 bp, Homo sapiens
ctcctgcctgcccc

SEQ ID NO: 2517452 - DNA, 14 bp, Homo sapiens
ctcctgcctgtagc

SEQ ID NO: 2517453 - DNA, 19 bp, Homo sapiens
ctcctgcctgtagcagtga

SEQ ID NO: 2517454 - DNA, 16 bp, Homo sapiens
ctcctgccttcctcct

SEQ ID NO: 2517455 - DNA, 20 bp, Homo sapiens
ctcctgccttcctcctgggc

SEQ ID NO: 2517456 - DNA, 17 bp, Homo sapiens
ctcctgcgcgcatgtgc

SEQ ID NO: 2517457 - DNA, 18 bp, Homo sapiens
ctcctgctactctgttcc

SEQ ID NO: 2517458 - DNA, 18 bp, Homo sapiens
ctcctggcccactgcatc

SEQ ID NO: 2517459 - DNA, 19 bp, Homo sapiens
ctcctggcccactgcatcg

SEQ ID NO: 2517460 - DNA, 22 bp, Homo sapiens
ctcctggctcttgatacccccc

SEQ ID NO: 2517461 - DNA, 15 bp, Homo sapiens
ctcctgggatctgct

SEQ ID NO: 2517462 - DNA, 15 bp, Homo sapiens
ctcctgggccctctc

SEQ ID NO: 2517463 - DNA, 18 bp, Homo sapiens
ctcctgggctaagtgatc

SEQ ID NO: 2517464 - DNA, 13 bp, Homo sapiens
ctcctgggctcag

SEQ ID NO: 2517465 - DNA, 14 bp, Homo sapiens
ctcctgggggttct

SEQ ID NO: 2517466 - DNA, 21 bp, Homo sapiens
ctcctgggttttgtattctct

SEQ ID NO: 2517467 - DNA, 23 bp, Homo sapiens
ctcctgggttttgtattctctga

SEQ ID NO: 2517468 - DNA, 23 bp, Homo sapiens
ctcctggtcttgagatgtcttct

SEQ ID NO: 2517469 - DNA, 20 bp, Homo sapiens
ctcctggtgggtccaggggc

SEQ ID NO: 2517470 - DNA, 21 bp, Homo sapiens
ctcctgtaaatggtgtacata

SEQ ID NO: 2517471 - DNA, 17 bp, Homo sapiens
ctcctgtactttttcca

SEQ ID NO: 2517472 - DNA, 15 bp, Homo sapiens
ctcctgtcctcccat

SEQ ID NO: 2517473 - DNA, 21 bp, Homo sapiens
ctcctgtcctcccatcccctg

SEQ ID NO: 2517474 - DNA, 13 bp, Homo sapiens
ctcctgtccttta

SEQ ID NO: 2517475 - DNA, 15 bp, Homo sapiens
ctcctgtctgccagc

SEQ ID NO: 2517476 - DNA, 17 bp, Homo sapiens
ctcctgtctgccagcca

SEQ ID NO: 2517477 - DNA, 22 bp, Homo sapiens
ctcctgtctgccagccagcagc

SEQ ID NO: 2517478 - DNA, 14 bp, Homo sapiens
ctcctgtcttccca

SEQ ID NO: 2517479 - DNA, 18 bp, Homo sapiens
ctcctgtcttcccagggt

SEQ ID NO: 2517480 - DNA, 19 bp, Homo sapiens
ctcctgtcttcccagggta

SEQ ID NO: 2517481 - DNA, 16 bp, Homo sapiens
ctcctgtgcatgggtg

SEQ ID NO: 2517482 - DNA, 11 bp, Homo sapiens
ctcctgtgcta

SEQ ID NO: 2517483 - DNA, 15 bp, Homo sapiens
ctcctgtgctttccc

SEQ ID NO: 2517484 - DNA, 21 bp, Homo sapiens
ctcctgttgcacccagccctg

SEQ ID NO: 2517485 - DNA, 17 bp, Homo sapiens
ctccttcacagatgggt

SEQ ID NO: 2517486 - DNA, 19 bp, Homo sapiens
ctccttcacagatgggtgc

SEQ ID NO: 2517487 - DNA, 13 bp, Homo sapiens
ctccttcccaaag

SEQ ID NO: 2517488 - DNA, 22 bp, Homo sapiens
ctccttcccaaaggactccacc

SEQ ID NO: 2517489 - DNA, 23 bp, Homo sapiens
ctccttcccaaaggactccaccc

SEQ ID NO: 2517490 - DNA, 12 bp, Homo sapiens
ctccttcctgtc

SEQ ID NO: 2517491 - DNA, 13 bp, Homo sapiens
ctccttcctgtct

SEQ ID NO: 2517492 - DNA, 14 bp, Homo sapiens
ctccttccttgacc

SEQ ID NO: 2517493 - DNA, 19 bp, Homo sapiens
ctccttcgcaggcatgtcc

SEQ ID NO: 2517494 - DNA, 15 bp, Homo sapiens
ctccttctgtcctac

SEQ ID NO: 2517495 - DNA, 17 bp, Homo sapiens
ctccttgagagaccagg

SEQ ID NO: 2517496 - DNA, 13 bp, Homo sapiens
ctccttgggaggc

SEQ ID NO: 2517497 - DNA, 16 bp, Homo sapiens
ctccttgggaggcccc

SEQ ID NO: 2517498 - DNA, 15 bp, Homo sapiens
ctccttgggcacttt

SEQ ID NO: 2517499 - DNA, 19 bp, Homo sapiens
ctccttgggccctttgagt

SEQ ID NO: 2517500 - DNA, 14 bp, Homo sapiens
ctccttggtgcctg

SEQ ID NO: 2517501 - DNA, 22 bp, Homo sapiens
ctccttggtgcctggcctggca

SEQ ID NO: 2517502 - DNA, 16 bp, Homo sapiens
ctccttgtccacccac

SEQ ID NO: 2517503 - DNA, 14 bp, Homo sapiens
ctcctttagcaggt

SEQ ID NO: 2517504 - DNA, 20 bp, Homo sapiens
ctcctttagcaggtggtcct

SEQ ID NO: 2517505 - DNA, 14 bp, Homo sapiens
ctcctttctccagc

SEQ ID NO: 2517506 - DNA, 19 bp, Homo sapiens
ctcctttctccagccagca

SEQ ID NO: 2517507 - DNA, 19 bp, Homo sapiens
ctcctttctttttcttctt

SEQ ID NO: 2517508 - DNA, 20 bp, Homo sapiens
ctcctttgcactgagggcca

SEQ ID NO: 2517509 - DNA, 23 bp, Homo sapiens
ctcctttgctgaggcctccagct

SEQ ID NO: 2517510 - DNA, 12 bp, Homo sapiens
ctcctttgtata

SEQ ID NO: 2517511 - DNA, 18 bp, Homo sapiens
ctcctttttctccctctg

SEQ ID NO: 2517512 - DNA, 21 bp, Homo sapiens
ctcctttttctccctctggat

SEQ ID NO: 2517513 - DNA, 22 bp, Homo sapiens
ctcgagcatgcctggatggggc

SEQ ID NO: 2517514 - DNA, 16 bp, Homo sapiens
ctcgaggactgtattt

SEQ ID NO: 2517515 - DNA, 22 bp, Homo sapiens
ctcgaggactgtatttgtgact

SEQ ID NO: 2517516 - DNA, 13 bp, Homo sapiens
ctcgagggcaggg

SEQ ID NO: 2517517 - DNA, 15 bp, Homo sapiens
ctcgcacctttccaa

SEQ ID NO: 2517518 - DNA, 14 bp, Homo sapiens
ctcgcagagaggcc

SEQ ID NO: 2517519 - DNA, 20 bp, Homo sapiens
ctcgcagagaggccaggtgc

SEQ ID NO: 2517520 - DNA, 21 bp, Homo sapiens
ctcgcatttgtcaatgacagt

SEQ ID NO: 2517521 - DNA, 19 bp, Homo sapiens
ctcgccacccctccttcct

SEQ ID NO: 2517522 - DNA, 13 bp, Homo sapiens
ctcgccatgccgg

SEQ ID NO: 2517523 - DNA, 12 bp, Homo sapiens
ctcgcccgccca

SEQ ID NO: 2517524 - DNA, 13 bp, Homo sapiens
ctcgctgccagct

SEQ ID NO: 2517525 - DNA, 22 bp, Homo sapiens
ctcgcttggacggctgggcaca

SEQ ID NO: 2517526 - DNA, 13 bp, Homo sapiens
ctcggagcctcat

SEQ ID NO: 2517527 - DNA, 12 bp, Homo sapiens
ctcggaggctgc

SEQ ID NO: 2517528 - DNA, 17 bp, Homo sapiens
ctcggagggattcccct

SEQ ID NO: 2517529 - DNA, 19 bp, Homo sapiens
ctcggctccccatgtgtcc

SEQ ID NO: 2517530 - DNA, 13 bp, Homo sapiens
ctcgggcccacct

SEQ ID NO: 2517531 - DNA, 19 bp, Homo sapiens
ctcgggcccacctggccac

SEQ ID NO: 2517532 - DNA, 15 bp, Homo sapiens
ctcgggcccagcccc

SEQ ID NO: 2517533 - DNA, 16 bp, Homo sapiens
ctcgggcccagccccc

SEQ ID NO: 2517534 - DNA, 14 bp, Homo sapiens
ctcgtagccatctc

SEQ ID NO: 2517535 - DNA, 20 bp, Homo sapiens
ctcgtatatgtctcaggtcc

SEQ ID NO: 2517536 - DNA, 14 bp, Homo sapiens
ctcgtcttcattaa

SEQ ID NO: 2517537 - DNA, 18 bp, Homo sapiens
ctcgtggccagcccggct

SEQ ID NO: 2517538 - DNA, 18 bp, Homo sapiens
ctcgtggccttccccagc

SEQ ID NO: 2517539 - DNA, 20 bp, Homo sapiens
ctcgtggccttccccagcct

SEQ ID NO: 2517540 - DNA, 21 bp, Homo sapiens
ctcgtggccttccccagcctc

SEQ ID NO: 2517541 - DNA, 17 bp, Homo sapiens
ctcgtggtaggactgta

SEQ ID NO: 2517542 - DNA, 21 bp, Homo sapiens
ctcgtggtaggactgtagaaa

SEQ ID NO: 2517543 - DNA, 19 bp, Homo sapiens
ctcgtgtatcctggggctc

SEQ ID NO: 2517544 - DNA, 19 bp, Homo sapiens
ctcgtttcaaaaacacagt

SEQ ID NO: 2517545 - DNA, 21 bp, Homo sapiens
ctcgtttttcttcttaagact

SEQ ID NO: 2517546 - DNA, 21 bp, Homo sapiens
ctctaaccccaggccccgagg

SEQ ID NO: 2517547 - DNA, 19 bp, Homo sapiens
ctctaagccactcttccaa

SEQ ID NO: 2517548 - DNA, 18 bp, Homo sapiens
ctctaagttccactgagc

SEQ ID NO: 2517549 - DNA, 20 bp, Homo sapiens
ctctaagttccactgagctc

SEQ ID NO: 2517550 - DNA, 21 bp, Homo sapiens
ctctaagttccactgagctcc

SEQ ID NO: 2517551 - DNA, 20 bp, Homo sapiens
ctctaattcccattttgcaa

SEQ ID NO: 2517552 - DNA, 16 bp, Homo sapiens
ctctacaactgagtcc

SEQ ID NO: 2517553 - DNA, 14 bp, Homo sapiens
ctctacactgtgaa

SEQ ID NO: 2517554 - DNA, 18 bp, Homo sapiens
ctctaccctcccaccccc

SEQ ID NO: 2517555 - DNA, 19 bp, Homo sapiens
ctctactaaaaatacagaa

SEQ ID NO: 2517556 - DNA, 16 bp, Homo sapiens
ctctactaaaaatgca

SEQ ID NO: 2517557 - DNA, 20 bp, Homo sapiens
ctctagaattttaagtgctt

SEQ ID NO: 2517558 - DNA, 17 bp, Homo sapiens
ctctagacaaccctgca

SEQ ID NO: 2517559 - DNA, 16 bp, Homo sapiens
ctctagctgtgggggt

SEQ ID NO: 2517560 - DNA, 14 bp, Homo sapiens
ctctagggacccct

SEQ ID NO: 2517561 - DNA, 14 bp, Homo sapiens
ctctagggcagtgg

SEQ ID NO: 2517562 - DNA, 18 bp, Homo sapiens
ctctagtgccctccacag

SEQ ID NO: 2517563 - DNA, 14 bp, Homo sapiens
ctctagtgctgtga

SEQ ID NO: 2517564 - DNA, 18 bp, Homo sapiens
ctctagtgctgtgaaaaa

SEQ ID NO: 2517565 - DNA, 19 bp, Homo sapiens
ctctagtttgattaaattc

SEQ ID NO: 2517566 - DNA, 21 bp, Homo sapiens
ctctagtttgattaaattctt

SEQ ID NO: 2517567 - DNA, 15 bp, Homo sapiens
ctctatagcaccagg

SEQ ID NO: 2517568 - DNA, 15 bp, Homo sapiens
ctctatcttgctctg

SEQ ID NO: 2517569 - DNA, 21 bp, Homo sapiens
ctctatgccagctcagtccca

SEQ ID NO: 2517570 - DNA, 18 bp, Homo sapiens
ctctattaagatttccaa

SEQ ID NO: 2517571 - DNA, 12 bp, Homo sapiens
ctctatttaata

SEQ ID NO: 2517572 - DNA, 13 bp, Homo sapiens
ctctatttaatat

SEQ ID NO: 2517573 - DNA, 14 bp, Homo sapiens
ctctatttaatatt

SEQ ID NO: 2517574 - DNA, 22 bp, Homo sapiens
ctctcaaatcttttagtcatta

SEQ ID NO: 2517575 - DNA, 13 bp, Homo sapiens
ctctcacattact

SEQ ID NO: 2517576 - DNA, 14 bp, Homo sapiens
ctctcacattactg

SEQ ID NO: 2517577 - DNA, 14 bp, Homo sapiens
ctctcactccttga

SEQ ID NO: 2517578 - DNA, 15 bp, Homo sapiens
ctctcactccttgaa

SEQ ID NO: 2517579 - DNA, 19 bp, Homo sapiens
ctctcagaagggaggctgg

SEQ ID NO: 2517580 - DNA, 13 bp, Homo sapiens
ctctcagctccag

SEQ ID NO: 2517581 - DNA, 16 bp, Homo sapiens
ctctcaggagcacagg

SEQ ID NO: 2517582 - DNA, 17 bp, Homo sapiens
ctctcaggagcacaggc

SEQ ID NO: 2517583 - DNA, 18 bp, Homo sapiens
ctctcaggagcacaggca

SEQ ID NO: 2517584 - DNA, 19 bp, Homo sapiens
ctctcaggagcacaggcag

SEQ ID NO: 2517585 - DNA, 20 bp, Homo sapiens
ctctcaggagcacaggcagc

SEQ ID NO: 2517586 - DNA, 18 bp, Homo sapiens
ctctcaggcatgcctgtg

SEQ ID NO: 2517587 - DNA, 17 bp, Homo sapiens
ctctcagtctctgagca

SEQ ID NO: 2517588 - DNA, 22 bp, Homo sapiens
ctctccaagggcttctgcaccc

SEQ ID NO: 2517589 - DNA, 14 bp, Homo sapiens
ctctccaagtgcca

SEQ ID NO: 2517590 - DNA, 20 bp, Homo sapiens
ctctccaagtgccagaggtg

SEQ ID NO: 2517591 - DNA, 13 bp, Homo sapiens
ctctccagcccct

SEQ ID NO: 2517592 - DNA, 15 bp, Homo sapiens
ctctccagcccctgg

SEQ ID NO: 2517593 - DNA, 16 bp, Homo sapiens
ctctccagcccctgga

SEQ ID NO: 2517594 - DNA, 18 bp, Homo sapiens
ctctccagcccctggatg

SEQ ID NO: 2517595 - DNA, 13 bp, Homo sapiens
ctctccagctata

SEQ ID NO: 2517596 - DNA, 14 bp, Homo sapiens
ctctccagctccaa

SEQ ID NO: 2517597 - DNA, 16 bp, Homo sapiens
ctctccatcttcagct

SEQ ID NO: 2517598 - DNA, 21 bp, Homo sapiens
ctctccattcccgtggaacgt

SEQ ID NO: 2517599 - DNA, 13 bp, Homo sapiens
ctctcccatggag

SEQ ID NO: 2517600 - DNA, 22 bp, Homo sapiens
ctctcccatggagccccagccc

SEQ ID NO: 2517601 - DNA, 23 bp, Homo sapiens
ctctcccatggagccccagcccc

SEQ ID NO: 2517602 - DNA, 12 bp, Homo sapiens
cttcatgcaatg

SEQ ID NO: 2517603 - DNA, 13 bp, Homo sapiens
cttcatgcaatga

SEQ ID NO: 2517604 - DNA, 17 bp, Homo sapiens
cttcatgcaatgacatc

SEQ ID NO: 2517605 - DNA, 22 bp, Homo sapiens
cttcatgcaatgacatcttcaa

SEQ ID NO: 2517606 - DNA, 13 bp, Homo sapiens
cttcatgcatgga

SEQ ID NO: 2517607 - DNA, 23 bp, Homo sapiens
cttcatgcatggaaattcccttc

SEQ ID NO: 2517608 - DNA, 15 bp, Homo sapiens
cttcatgccagctac

SEQ ID NO: 2517609 - DNA, 23 bp, Homo sapiens
cttcatgtcaacttctggctcct

SEQ ID NO: 2517610 - DNA, 16 bp, Homo sapiens
cttcattaataataaa

SEQ ID NO: 2517611 - DNA, 17 bp, Homo sapiens
cttcattaataataaat

SEQ ID NO: 2517612 - DNA, 16 bp, Homo sapiens
cttcattagagcaggc

SEQ ID NO: 2517613 - DNA, 14 bp, Homo sapiens
cttcattgagagtt

SEQ ID NO: 2517614 - DNA, 23 bp, Homo sapiens
cttcattgagagttttgtcttga

SEQ ID NO: 2517615 - DNA, 15 bp, Homo sapiens
cttcatttcattgta

SEQ ID NO: 2517616 - DNA, 17 bp, Homo sapiens
cttcatttcattgtatg

SEQ ID NO: 2517617 - DNA, 18 bp, Homo sapiens
cttcatttcctgtgtctt

SEQ ID NO: 2517618 - DNA, 13 bp, Homo sapiens
cttcatttgtgtc

SEQ ID NO: 2517619 - DNA, 14 bp, Homo sapiens
cttccactgagggc

SEQ ID NO: 2517620 - DNA, 15 bp, Homo sapiens
cttccactgagggca

SEQ ID NO: 2517621 - DNA, 20 bp, Homo sapiens
cttccacttttttttgtatg

SEQ ID NO: 2517622 - DNA, 20 bp, Homo sapiens
cttccagagagtcctctgga

SEQ ID NO: 2517623 - DNA, 14 bp, Homo sapiens
cttccagcaccctg

SEQ ID NO: 2517624 - DNA, 19 bp, Homo sapiens
cttccaggcccccaccact

SEQ ID NO: 2517625 - DNA, 19 bp, Homo sapiens
cttccaggctgggagagcc

SEQ ID NO: 2517626 - DNA, 17 bp, Homo sapiens
cttccaggggtgggaca

SEQ ID NO: 2517627 - DNA, 24 bp, Homo sapiens
cttccaggggtgggacaccctgtg

SEQ ID NO: 2517628 - DNA, 20 bp, Homo sapiens
cttccagtcttcctgacact

SEQ ID NO: 2517629 - DNA, 18 bp, Homo sapiens
cttccagtgaggctctgc

SEQ ID NO: 2517630 - DNA, 20 bp, Homo sapiens
cttccagtgaggctctgccc

SEQ ID NO: 2517631 - DNA, 23 bp, Homo sapiens
cttccagtgaggctctgcccttg

SEQ ID NO: 2517632 - DNA, 22 bp, Homo sapiens
cttccataatgctactgtctca

SEQ ID NO: 2517633 - DNA, 14 bp, Homo sapiens
cttccatatgacct

SEQ ID NO: 2517634 - DNA, 16 bp, Homo sapiens
cttccatatgacctca

SEQ ID NO: 2517635 - DNA, 12 bp, Homo sapiens
cttccatcatgt

SEQ ID NO: 2517636 - DNA, 18 bp, Homo sapiens
cttccatctttcctgatg

SEQ ID NO: 2517637 - DNA, 21 bp, Homo sapiens
cttccatgagaacagcagggt

SEQ ID NO: 2517638 - DNA, 16 bp, Homo sapiens
cttccatggactttgt

SEQ ID NO: 2517639 - DNA, 16 bp, Homo sapiens
cttccatgtcgcctct

SEQ ID NO: 2517640 - DNA, 18 bp, Homo sapiens
cttccatgtcgcctctgc

SEQ ID NO: 2517641 - DNA, 20 bp, Homo sapiens
cttccatgtcgcctctgcat

SEQ ID NO: 2517642 - DNA, 14 bp, Homo sapiens
cttccatttgcaag

SEQ ID NO: 2517643 - DNA, 14 bp, Homo sapiens
cttcccaaaggact

SEQ ID NO: 2517644 - DNA, 23 bp, Homo sapiens
cttcccacctctctcactccttg

SEQ ID NO: 2517645 - DNA, 20 bp, Homo sapiens
cttcccactctagggcagtg

SEQ ID NO: 2517646 - DNA, 19 bp, Homo sapiens
cttcccagggtagcccgcc

SEQ ID NO: 2517647 - DNA, 17 bp, Homo sapiens
cttcccagtggctgctg

SEQ ID NO: 2517648 - DNA, 19 bp, Homo sapiens
cttcccagtggctgctgcc

SEQ ID NO: 2517649 - DNA, 12 bp, Homo sapiens
cttcccatccta

SEQ ID NO: 2517650 - DNA, 15 bp, Homo sapiens
cttcccatcctaccc

SEQ ID NO: 2517651 - DNA, 15 bp, Homo sapiens
cttcccatgacccag

SEQ ID NO: 2517652 - DNA, 17 bp, Homo sapiens
cttcccatgacccaggc

SEQ ID NO: 2517653 - DNA, 20 bp, Homo sapiens
cttcccatgacccaggctgg

SEQ ID NO: 2517654 - DNA, 15 bp, Homo sapiens
cttccccaccctcag

SEQ ID NO: 2517655 - DNA, 14 bp, Homo sapiens
cttccccactgcct

SEQ ID NO: 2517656 - DNA, 19 bp, Homo sapiens
cttccccagaaaggagact

SEQ ID NO: 2517657 - DNA, 13 bp, Homo sapiens
cttccccatggga

SEQ ID NO: 2517658 - DNA, 12 bp, Homo sapiens
cttcccctcact

SEQ ID NO: 2517659 - DNA, 14 bp, Homo sapiens
cttcccctccctgg

SEQ ID NO: 2517660 - DNA, 15 bp, Homo sapiens
cttcccctgggccct

SEQ ID NO: 2517661 - DNA, 16 bp, Homo sapiens
cttccccttgcccagg

SEQ ID NO: 2517662 - DNA, 19 bp, Homo sapiens
cttccccttgcccagggct

SEQ ID NO: 2517663 - DNA, 14 bp, Homo sapiens
cttccccttgccct

SEQ ID NO: 2517664 - DNA, 17 bp, Homo sapiens
cttccccttgcccttgc

SEQ ID NO: 2517665 - DNA, 22 bp, Homo sapiens
cttccccttgcccttgccctga

SEQ ID NO: 2517666 - DNA, 13 bp, Homo sapiens
cttccctacctca

SEQ ID NO: 2517667 - DNA, 16 bp, Homo sapiens
cttccctacctcaggc

SEQ ID NO: 2517668 - DNA, 18 bp, Homo sapiens
cttccctatctttgccac

SEQ ID NO: 2517669 - DNA, 15 bp, Homo sapiens
cttccctcacaccgc

SEQ ID NO: 2517670 - DNA, 17 bp, Homo sapiens
cttccctctgcctgtcc

SEQ ID NO: 2517671 - DNA, 20 bp, Homo sapiens
cttccctgactcattctgaa

SEQ ID NO: 2517672 - DNA, 22 bp, Homo sapiens
cttccctgtatgattccttgat

SEQ ID NO: 2517673 - DNA, 16 bp, Homo sapiens
cttccctgtccctcta

SEQ ID NO: 2517674 - DNA, 16 bp, Homo sapiens
cttcccttgagccctc

SEQ ID NO: 2517675 - DNA, 21 bp, Homo sapiens
cttccgaaaaatcctcttcct

SEQ ID NO: 2517676 - DNA, 14 bp, Homo sapiens
cttccggagatgta

SEQ ID NO: 2517677 - DNA, 15 bp, Homo sapiens
cttccggagatgtag

SEQ ID NO: 2517678 - DNA, 21 bp, Homo sapiens
cttcctacaagagcagcctgt

SEQ ID NO: 2517679 - DNA, 22 bp, Homo sapiens
cttcctacaagagcagcctgtg

SEQ ID NO: 2517680 - DNA, 16 bp, Homo sapiens
cttcctacccacacct

SEQ ID NO: 2517681 - DNA, 18 bp, Homo sapiens
cttcctacccacacctct

SEQ ID NO: 2517682 - DNA, 22 bp, Homo sapiens
cttcctagaagttactgaatgc

SEQ ID NO: 2517683 - DNA, 15 bp, Homo sapiens
cttcctagttttctc

SEQ ID NO: 2517684 - DNA, 17 bp, Homo sapiens
cttcctagttttctcct

SEQ ID NO: 2517685 - DNA, 13 bp, Homo sapiens
cttcctcactgcc

SEQ ID NO: 2517686 - DNA, 18 bp, Homo sapiens
cttcctcatccaccccat

SEQ ID NO: 2517687 - DNA, 13 bp, Homo sapiens
cttcctccctcat

SEQ ID NO: 2517688 - DNA, 16 bp, Homo sapiens
cttcctcctccccact

SEQ ID NO: 2517689 - DNA, 14 bp, Homo sapiens
cttcctcctccctc

SEQ ID NO: 2517690 - DNA, 13 bp, Homo sapiens
cttcctctgctga

SEQ ID NO: 2517691 - DNA, 17 bp, Homo sapiens
cttcctgacactttaat

SEQ ID NO: 2517692 - DNA, 15 bp, Homo sapiens
cttcctgcaaggact

SEQ ID NO: 2517693 - DNA, 22 bp, Homo sapiens
cttcctggagactgcccagcta

SEQ ID NO: 2517694 - DNA, 17 bp, Homo sapiens
cttcctgtccagagaga

SEQ ID NO: 2517695 - DNA, 17 bp, Homo sapiens
cttcctgtcccacctct

SEQ ID NO: 2517696 - DNA, 18 bp, Homo sapiens
cttcctgtttttcacatt

SEQ ID NO: 2517697 - DNA, 15 bp, Homo sapiens
cttccttcacctctg

SEQ ID NO: 2517698 - DNA, 19 bp, Homo sapiens
cttccttgctgtcctaggc

SEQ ID NO: 2517699 - DNA, 17 bp, Homo sapiens
cttccttgcttaaggta

SEQ ID NO: 2517700 - DNA, 21 bp, Homo sapiens
cttccttttagcctagttcat

SEQ ID NO: 2517701 - DNA, 16 bp, Homo sapiens
cttcgcaggcatgtcc

SEQ ID NO: 2517702 - DNA, 23 bp, Homo sapiens
cttcgcatcaaaagacaattctt

SEQ ID NO: 2517703 - DNA, 19 bp, Homo sapiens
cttcgcgtgccctcgctgc

SEQ ID NO: 2517704 - DNA, 15 bp, Homo sapiens
cttcgggaagagagg

SEQ ID NO: 2517705 - DNA, 18 bp, Homo sapiens
cttcgggaagagaggagt

SEQ ID NO: 2517706 - DNA, 21 bp, Homo sapiens
cttcgggaagagaggagttca

SEQ ID NO: 2517707 - DNA, 22 bp, Homo sapiens
cttcgggaagagaggagttcaa

SEQ ID NO: 2517708 - DNA, 16 bp, Homo sapiens
cttcgggcccttccca

SEQ ID NO: 2517709 - DNA, 16 bp, Homo sapiens
cttcgtacagttcttc

SEQ ID NO: 2517710 - DNA, 23 bp, Homo sapiens
cttcgtgggatctgcccctccct

SEQ ID NO: 2517711 - DNA, 15 bp, Homo sapiens
cttcgtttattttca

SEQ ID NO: 2517712 - DNA, 21 bp, Homo sapiens
cttctaagtaaaaccacagca

SEQ ID NO: 2517713 - DNA, 22 bp, Homo sapiens
cttctaagtaaaaccacagcag

SEQ ID NO: 2517714 - DNA, 12 bp, Homo sapiens
cttctaatatat

SEQ ID NO: 2517715 - DNA, 14 bp, Homo sapiens
cttctaatatattt

SEQ ID NO: 2517716 - DNA, 20 bp, Homo sapiens
cttctaatatatttttatat

SEQ ID NO: 2517717 - DNA, 17 bp, Homo sapiens
cttctacctcttggctg

SEQ ID NO: 2517718 - DNA, 23 bp, Homo sapiens
cttctacctgccactcacacagc

SEQ ID NO: 2517719 - DNA, 14 bp, Homo sapiens
ctttggagtcccct

SEQ ID NO: 2517720 - DNA, 16 bp, Homo sapiens
ctttggagtcccctca

SEQ ID NO: 2517721 - DNA, 18 bp, Homo sapiens
ctttggagtcccctcacc

SEQ ID NO: 2517722 - DNA, 17 bp, Homo sapiens
ctttggccattccaaca

SEQ ID NO: 2517723 - DNA, 14 bp, Homo sapiens
ctttggctgcatgc

SEQ ID NO: 2517724 - DNA, 16 bp, Homo sapiens
ctttggctgcatgcga

SEQ ID NO: 2517725 - DNA, 22 bp, Homo sapiens
ctttgggagaaaacgtcttgct

SEQ ID NO: 2517726 - DNA, 23 bp, Homo sapiens
ctttgggaggccaaggtgggagg

SEQ ID NO: 2517727 - DNA, 14 bp, Homo sapiens
ctttgggaggctga

SEQ ID NO: 2517728 - DNA, 15 bp, Homo sapiens
ctttgggcccaggga

SEQ ID NO: 2517729 - DNA, 20 bp, Homo sapiens
ctttggggcttttacaccag

SEQ ID NO: 2517730 - DNA, 17 bp, Homo sapiens
ctttggggttttttaat

SEQ ID NO: 2517731 - DNA, 18 bp, Homo sapiens
ctttgggtacctattttc

SEQ ID NO: 2517732 - DNA, 22 bp, Homo sapiens
ctttggtacatggccagtgtga

SEQ ID NO: 2517733 - DNA, 14 bp, Homo sapiens
ctttggtggctttg

SEQ ID NO: 2517734 - DNA, 17 bp, Homo sapiens
ctttggtggctttgcat

SEQ ID NO: 2517735 - DNA, 18 bp, Homo sapiens
ctttggtggctttgcatt

SEQ ID NO: 2517736 - DNA, 14 bp, Homo sapiens
ctttggttcagcta

SEQ ID NO: 2517737 - DNA, 18 bp, Homo sapiens
ctttgtaagagtgtagaa

SEQ ID NO: 2517738 - DNA, 21 bp, Homo sapiens
ctttgtaagagtgtagaagca

SEQ ID NO: 2517739 - DNA, 12 bp, Homo sapiens
ctttgtatatta

SEQ ID NO: 2517740 - DNA, 15 bp, Homo sapiens
ctttgtatattattt

SEQ ID NO: 2517741 - DNA, 17 bp, Homo sapiens
ctttgtattctctcctg

SEQ ID NO: 2517742 - DNA, 16 bp, Homo sapiens
ctttgtcaaaaggaag

SEQ ID NO: 2517743 - DNA, 14 bp, Homo sapiens
ctttgtccccaccg

SEQ ID NO: 2517744 - DNA, 15 bp, Homo sapiens
ctttgtgactgtata

SEQ ID NO: 2517745 - DNA, 22 bp, Homo sapiens
ctttgtgattcaatctgtaaac

SEQ ID NO: 2517746 - DNA, 23 bp, Homo sapiens
ctttgtgattcaatctgtaaact

SEQ ID NO: 2517747 - DNA, 14 bp, Homo sapiens
ctttgtgatttttg

SEQ ID NO: 2517748 - DNA, 18 bp, Homo sapiens
ctttgtgatttttgtaat

SEQ ID NO: 2517749 - DNA, 13 bp, Homo sapiens
ctttgtggcttcc

SEQ ID NO: 2517750 - DNA, 17 bp, Homo sapiens
ctttgtgtagctttgct

SEQ ID NO: 2517751 - DNA, 14 bp, Homo sapiens
ctttgtgtttctat

SEQ ID NO: 2517752 - DNA, 20 bp, Homo sapiens
ctttgttatttttgtttctt

SEQ ID NO: 2517753 - DNA, 22 bp, Homo sapiens
ctttgttatttttgtttcttcc

SEQ ID NO: 2517754 - DNA, 18 bp, Homo sapiens
ctttgttctaaagatgga

SEQ ID NO: 2517755 - DNA, 24 bp, Homo sapiens
ctttgttttgatgtttgtggcctc

SEQ ID NO: 2517756 - DNA, 18 bp, Homo sapiens
ctttgtttttatgaagaa

SEQ ID NO: 2517757 - DNA, 20 bp, Homo sapiens
cttttaacacctgatgtgta

SEQ ID NO: 2517758 - DNA, 14 bp, Homo sapiens
cttttaatcagaca

SEQ ID NO: 2517759 - DNA, 18 bp, Homo sapiens
cttttaatgctccaaatg

SEQ ID NO: 2517760 - DNA, 20 bp, Homo sapiens
cttttaattaaatgctcatc

SEQ ID NO: 2517761 - DNA, 16 bp, Homo sapiens
cttttaattaatgaaa

SEQ ID NO: 2517762 - DNA, 23 bp, Homo sapiens
cttttactcatgatcttgtgaca

SEQ ID NO: 2517763 - DNA, 13 bp, Homo sapiens
cttttagcctagt

SEQ ID NO: 2517764 - DNA, 17 bp, Homo sapiens
cttttaggacccttccc

SEQ ID NO: 2517765 - DNA, 19 bp, Homo sapiens
cttttagttgtatctcttt

SEQ ID NO: 2517766 - DNA, 21 bp, Homo sapiens
cttttagttttagttgcagaa

SEQ ID NO: 2517767 - DNA, 15 bp, Homo sapiens
cttttataaacttta

SEQ ID NO: 2517768 - DNA, 16 bp, Homo sapiens
cttttataaactttac

SEQ ID NO: 2517769 - DNA, 14 bp, Homo sapiens
cttttataataaaa

SEQ ID NO: 2517770 - DNA, 12 bp, Homo sapiens
cttttatagcta

SEQ ID NO: 2517771 - DNA, 17 bp, Homo sapiens
cttttatgatgtatatt

SEQ ID NO: 2517772 - DNA, 19 bp, Homo sapiens
cttttattaatgcactttc

SEQ ID NO: 2517773 - DNA, 22 bp, Homo sapiens
cttttcaaatagggtctaactc

SEQ ID NO: 2517774 - DNA, 15 bp, Homo sapiens
cttttcacaaataaa

SEQ ID NO: 2517775 - DNA, 17 bp, Homo sapiens
cttttcacattcttata

SEQ ID NO: 2517776 - DNA, 20 bp, Homo sapiens
cttttcactgctgcaaggcc

SEQ ID NO: 2517777 - DNA, 17 bp, Homo sapiens
cttttcatctgggaaag

SEQ ID NO: 2517778 - DNA, 13 bp, Homo sapiens
cttttccaaccct

SEQ ID NO: 2517779 - DNA, 23 bp, Homo sapiens
cttttccaaccctcatcaccaac

SEQ ID NO: 2517780 - DNA, 14 bp, Homo sapiens
cttttcccctgtcc

SEQ ID NO: 2517781 - DNA, 20 bp, Homo sapiens
cttttccctctttggctccc

SEQ ID NO: 2517782 - DNA, 22 bp, Homo sapiens
cttttccctctttggctcccct

SEQ ID NO: 2517783 - DNA, 20 bp, Homo sapiens
cttttcctattttcagccca

SEQ ID NO: 2517784 - DNA, 17 bp, Homo sapiens
cttttccttggggcagg

SEQ ID NO: 2517785 - DNA, 20 bp, Homo sapiens
cttttccttggggcaggcag

SEQ ID NO: 2517786 - DNA, 21 bp, Homo sapiens
cttttccttggggcaggcagt

SEQ ID NO: 2517787 - DNA, 13 bp, Homo sapiens
cttttctattttc

SEQ ID NO: 2517788 - DNA, 14 bp, Homo sapiens
cttttctattttcc

SEQ ID NO: 2517789 - DNA, 13 bp, Homo sapiens
cttttctgcattt

SEQ ID NO: 2517790 - DNA, 14 bp, Homo sapiens
cttttctgcatttt

SEQ ID NO: 2517791 - DNA, 18 bp, Homo sapiens
cttttctggaatgtaatc

SEQ ID NO: 2517792 - DNA, 19 bp, Homo sapiens
cttttctggaatgtaatca

SEQ ID NO: 2517793 - DNA, 23 bp, Homo sapiens
cttttctgtccgagctttgaaaa

SEQ ID NO: 2517794 - DNA, 17 bp, Homo sapiens
cttttctgtctctgcct

SEQ ID NO: 2517795 - DNA, 16 bp, Homo sapiens
cttttcttaaaccttc

SEQ ID NO: 2517796 - DNA, 18 bp, Homo sapiens
cttttcttgcatgaggct

SEQ ID NO: 2517797 - DNA, 22 bp, Homo sapiens
cttttctttagagcattgccat

SEQ ID NO: 2517798 - DNA, 13 bp, Homo sapiens
cttttcttttctt

SEQ ID NO: 2517799 - DNA, 14 bp, Homo sapiens
cttttctttttctc

SEQ ID NO: 2517800 - DNA, 13 bp, Homo sapiens
cttttgaaacaat

SEQ ID NO: 2517801 - DNA, 16 bp, Homo sapiens
cttttgaaacaatact

SEQ ID NO: 2517802 - DNA, 20 bp, Homo sapiens
cttttgaagtagtttgtata

SEQ ID NO: 2517803 - DNA, 22 bp, Homo sapiens
cttttgaagtagtttgtataac

SEQ ID NO: 2517804 - DNA, 13 bp, Homo sapiens
cttttgaatattc

SEQ ID NO: 2517805 - DNA, 19 bp, Homo sapiens
cttttgaatccatgcttgg

SEQ ID NO: 2517806 - DNA, 18 bp, Homo sapiens
cttttgacttaaagcaga

SEQ ID NO: 2517807 - DNA, 14 bp, Homo sapiens
cttttgcacccctc

SEQ ID NO: 2517808 - DNA, 17 bp, Homo sapiens
cttttgcacccctccca

SEQ ID NO: 2517809 - DNA, 19 bp, Homo sapiens
cttttgcacctgctctctt

SEQ ID NO: 2517810 - DNA, 22 bp, Homo sapiens
cttttgcacctgctctcttgta

SEQ ID NO: 2517811 - DNA, 22 bp, Homo sapiens
cttttgctcttagctgtctgct

SEQ ID NO: 2517812 - DNA, 16 bp, Homo sapiens
cttttggtctgtgtga

SEQ ID NO: 2517813 - DNA, 13 bp, Homo sapiens
cttttgtaaatgt

SEQ ID NO: 2517814 - DNA, 10 bp, Homo sapiens
cttttgtaag

SEQ ID NO: 2517815 - DNA, 18 bp, Homo sapiens
cttttgtctatgggactc

SEQ ID NO: 2517816 - DNA, 12 bp, Homo sapiens
cttttgttcttg

SEQ ID NO: 2517817 - DNA, 16 bp, Homo sapiens
ctttttaaagtgtttc

SEQ ID NO: 2517818 - DNA, 21 bp, Homo sapiens
ctttttaaatgtaaagatatt

SEQ ID NO: 2517819 - DNA, 17 bp, Homo sapiens
ctttttaagcttattta

SEQ ID NO: 2517820 - DNA, 14 bp, Homo sapiens
ctttttaattgttg

SEQ ID NO: 2517821 - DNA, 16 bp, Homo sapiens
ctttttaattgttgtt

SEQ ID NO: 2517822 - DNA, 20 bp, Homo sapiens
ctttttaccaagtttcaggt

SEQ ID NO: 2517823 - DNA, 19 bp, Homo sapiens
ctttttagggccaggcagg

SEQ ID NO: 2517824 - DNA, 14 bp, Homo sapiens
ctttttattgaatc

SEQ ID NO: 2517825 - DNA, 15 bp, Homo sapiens
ctttttattgaatct

SEQ ID NO: 2517826 - DNA, 14 bp, Homo sapiens
ctttttatttgcat

SEQ ID NO: 2517827 - DNA, 17 bp, Homo sapiens
ctttttcatttgcctat

SEQ ID NO: 2517828 - DNA, 17 bp, Homo sapiens
ctttttccttgtcccca

SEQ ID NO: 2517829 - DNA, 15 bp, Homo sapiens
ctttttcttcttccc

SEQ ID NO: 2517830 - DNA, 18 bp, Homo sapiens
ctttttctttataaactt

SEQ ID NO: 2517831 - DNA, 18 bp, Homo sapiens
ctttttgaaatcagcata

SEQ ID NO: 2517832 - DNA, 11 bp, Homo sapiens
ctttttgaatg

SEQ ID NO: 2517833 - DNA, 19 bp, Homo sapiens
ctttttgaatgttatttgt

SEQ ID NO: 2517834 - DNA, 20 bp, Homo sapiens
ctttttgaggtggcactttt

SEQ ID NO: 2517835 - DNA, 21 bp, Homo sapiens
ctttttggaggtgcttaagca

SEQ ID NO: 2517836 - DNA, 16 bp, Homo sapiens
cttttttagagttgat

SEQ ID NO: 2517837 - DNA, 18 bp, Homo sapiens
cttttttatgtgccgtgt

SEQ ID NO: 2517838 - DNA, 20 bp, Homo sapiens
cttttttgaaataataaatc

SEQ ID NO: 2517839 - DNA, 23 bp, Homo sapiens
cttttttggctgctgaaggctcg

SEQ ID NO: 2517840 - DNA, 20 bp, Homo sapiens
cttttttggggatatgctta

SEQ ID NO: 2517841 - DNA, 16 bp, Homo sapiens
ctttttttttccaaaa

SEQ ID NO: 2517842 - DNA, 15 bp, Homo sapiens
ctttttttttctctt

SEQ ID NO: 2517843 - DNA, 15 bp, Homo sapiens
gaaaaaaaaagaaaa

SEQ ID NO: 2517844 - DNA, 17 bp, Homo sapiens
gaaaaaaaaagaaaaaa

SEQ ID NO: 2517845 - DNA, 21 bp, Homo sapiens
gaaaaaaaaagtcagactgct

SEQ ID NO: 2517846 - DNA, 15 bp, Homo sapiens
gaaaaaaaagaaagc

SEQ ID NO: 2517847 - DNA, 22 bp, Homo sapiens
gaaaaaaaagtttcagagaagt

SEQ ID NO: 2517848 - DNA, 19 bp, Homo sapiens
gaaaaaacacctagcttta

SEQ ID NO: 2517849 - DNA, 10 bp, Homo sapiens
gaaaaaagag

SEQ ID NO: 2517850 - DNA, 18 bp, Homo sapiens
gaaaaaagagaaaagaaa

SEQ ID NO: 2517851 - DNA, 14 bp, Homo sapiens
gaaaaaagttgtag

SEQ ID NO: 2517852 - DNA, 10 bp, Homo sapiens
gaaaaaatac

SEQ ID NO: 2517853 - DNA, 15 bp, Homo sapiens
gaaaaaatacatttt

SEQ ID NO: 2517854 - DNA, 21 bp, Homo sapiens
gaaaaaatgttggatttataa

SEQ ID NO: 2517855 - DNA, 20 bp, Homo sapiens
gaaaaacttccatgaggcca

SEQ ID NO: 2517856 - DNA, 22 bp, Homo sapiens
gaaaaagcagtaactgacaact

SEQ ID NO: 2517857 - DNA, 23 bp, Homo sapiens
gaaaaaggatgcacagagttgtt

SEQ ID NO: 2517858 - DNA, 19 bp, Homo sapiens
gaaaaagtcatccaatcta

SEQ ID NO: 2517859 - DNA, 21 bp, Homo sapiens
gaaaaagtcatccaatctaac

SEQ ID NO: 2517860 - DNA, 19 bp, Homo sapiens
gaaaaagttaaacattgaa

SEQ ID NO: 2517861 - DNA, 11 bp, Homo sapiens
gaaaaattcct

SEQ ID NO: 2517862 - DNA, 20 bp, Homo sapiens
gaaaaattcctattgtgatt

SEQ ID NO: 2517863 - DNA, 20 bp, Homo sapiens
gaaaaatttaagcattgttt

SEQ ID NO: 2517864 - DNA, 13 bp, Homo sapiens
gaaaacacatttt

SEQ ID NO: 2517865 - DNA, 21 bp, Homo sapiens
gaaaacactgtgcacatctgt

SEQ ID NO: 2517866 - DNA, 19 bp, Homo sapiens
gaaaacactgttctctgcc

SEQ ID NO: 2517867 - DNA, 21 bp, Homo sapiens
gaaaacactgttctctgccct

SEQ ID NO: 2517868 - DNA, 24 bp, Homo sapiens
gaaaacactgttctctgccctcca

SEQ ID NO: 2517869 - DNA, 12 bp, Homo sapiens
gaaaacatctgg

SEQ ID NO: 2517870 - DNA, 15 bp, Homo sapiens
gaaaacatgctacac

SEQ ID NO: 2517871 - DNA, 16 bp, Homo sapiens
gaaaacatgctacaca

SEQ ID NO: 2517872 - DNA, 15 bp, Homo sapiens
gaaaacatgtaataa

SEQ ID NO: 2517873 - DNA, 11 bp, Homo sapiens
gaaaacccacc

SEQ ID NO: 2517874 - DNA, 19 bp, Homo sapiens
gaaaacgtcttgcttggga

SEQ ID NO: 2517875 - DNA, 19 bp, Homo sapiens
gaaaacgttttattgtgtt

SEQ ID NO: 2517876 - DNA, 20 bp, Homo sapiens
gaaaactgaaaatctaatat

SEQ ID NO: 2517877 - DNA, 9 bp, Homo sapiens
gaaaagaaa

SEQ ID NO: 2517878 - DNA, 17 bp, Homo sapiens
gaaaagaaaaaaaaaga

SEQ ID NO: 2517879 - DNA, 16 bp, Homo sapiens
gaaaagaatacagaaa

SEQ ID NO: 2517880 - DNA, 18 bp, Homo sapiens
gaaaagaatacagaaaga

SEQ ID NO: 2517881 - DNA, 14 bp, Homo sapiens
gaaaagactccaaa

SEQ ID NO: 2517882 - DNA, 16 bp, Homo sapiens
gaaaagactccaaaga

SEQ ID NO: 2517883 - DNA, 18 bp, Homo sapiens
gaaaagactccaaagaaa

SEQ ID NO: 2517884 - DNA, 19 bp, Homo sapiens
gaaaagagatattttaaaa

SEQ ID NO: 2517885 - DNA, 20 bp, Homo sapiens
gaaaagaggagtttcgaggt

SEQ ID NO: 2517886 - DNA, 21 bp, Homo sapiens
gaaaagaggagtttcgaggta

SEQ ID NO: 2517887 - DNA, 17 bp, Homo sapiens
gaaaagatgtagattta

SEQ ID NO: 2517888 - DNA, 19 bp, Homo sapiens
gaaaagatgtagatttatt

SEQ ID NO: 2517889 - DNA, 17 bp, Homo sapiens
gaaaagcagctctcccc

SEQ ID NO: 2517890 - DNA, 17 bp, Homo sapiens
gaaaagctgctgacagt

SEQ ID NO: 2517891 - DNA, 15 bp, Homo sapiens
gaaaaggaagactag

SEQ ID NO: 2517892 - DNA, 21 bp, Homo sapiens
gaaaagggagattcagactgt

SEQ ID NO: 2517893 - DNA, 21 bp, Homo sapiens
gaaaagggtcttgggaaatat

SEQ ID NO: 2517894 - DNA, 16 bp, Homo sapiens
gaaaagtacatttaat

SEQ ID NO: 2517895 - DNA, 13 bp, Homo sapiens
gaaaataaaaagt

SEQ ID NO: 2517896 - DNA, 15 bp, Homo sapiens
gaaaataaaaagtta

SEQ ID NO: 2517897 - DNA, 16 bp, Homo sapiens
gaaaataaaaagttaa

SEQ ID NO: 2517898 - DNA, 12 bp, Homo sapiens
gaaaatatactg

SEQ ID NO: 2517899 - DNA, 17 bp, Homo sapiens
gaaaatatactgtaaag

SEQ ID NO: 2517900 - DNA, 21 bp, Homo sapiens
gaaaatatactgtaaagaaag

SEQ ID NO: 2517901 - DNA, 18 bp, Homo sapiens
gaaaatatttgtatcaca

SEQ ID NO: 2517902 - DNA, 21 bp, Homo sapiens
gaaaatctaatattaaaaata

SEQ ID NO: 2517903 - DNA, 14 bp, Homo sapiens
gaaaatggtatttt

SEQ ID NO: 2517904 - DNA, 12 bp, Homo sapiens
gaaaatgtactg

SEQ ID NO: 2517905 - DNA, 15 bp, Homo sapiens
gaaaatgtatgtgta

SEQ ID NO: 2517906 - DNA, 22 bp, Homo sapiens
gaaaattaggatttcatgattt

SEQ ID NO: 2517907 - DNA, 19 bp, Homo sapiens
gaaaattcaaaaagtgttt

SEQ ID NO: 2517908 - DNA, 22 bp, Homo sapiens
gaaaattcaaaaagtgtttatt

SEQ ID NO: 2517909 - DNA, 21 bp, Homo sapiens
gaaaattcctattgattttct

SEQ ID NO: 2517910 - DNA, 17 bp, Homo sapiens
gaaaatttgttattttg

SEQ ID NO: 2517911 - DNA, 21 bp, Homo sapiens
gaaaatttgttattttgcaac

SEQ ID NO: 2517912 - DNA, 14 bp, Homo sapiens
gaaacaaaaacact

SEQ ID NO: 2517913 - DNA, 23 bp, Homo sapiens
gaaacaaaaacactaaaaataaa

SEQ ID NO: 2517914 - DNA, 15 bp, Homo sapiens
gaaacaaagcttagc

SEQ ID NO: 2517915 - DNA, 19 bp, Homo sapiens
gaaacaaagcttagcagga

SEQ ID NO: 2517916 - DNA, 21 bp, Homo sapiens
gaaacaacagctttaaaagaa

SEQ ID NO: 2517917 - DNA, 17 bp, Homo sapiens
gaaacaactctttgaga

SEQ ID NO: 2517918 - DNA, 15 bp, Homo sapiens
gaaacacaatatttt

SEQ ID NO: 2517919 - DNA, 16 bp, Homo sapiens
gaaacacaccaggctg

SEQ ID NO: 2517920 - DNA, 20 bp, Homo sapiens
gaaacacactgaggcaggga

SEQ ID NO: 2517921 - DNA, 18 bp, Homo sapiens
gaaacaccctcacactgg

SEQ ID NO: 2517922 - DNA, 14 bp, Homo sapiens
gaaacaccttctct

SEQ ID NO: 2517923 - DNA, 18 bp, Homo sapiens
gaaacactggggctggca

SEQ ID NO: 2517924 - DNA, 14 bp, Homo sapiens
gaaacagaaacaaa

SEQ ID NO: 2517925 - DNA, 14 bp, Homo sapiens
gaaacagagacagg

SEQ ID NO: 2517926 - DNA, 16 bp, Homo sapiens
gaaacagagacaggcc

SEQ ID NO: 2517927 - DNA, 17 bp, Homo sapiens
gaaacagagacaggccc

SEQ ID NO: 2517928 - DNA, 20 bp, Homo sapiens
gaaacagatctcctggcaaa

SEQ ID NO: 2517929 - DNA, 18 bp, Homo sapiens
gaaacagctaatgggaca

SEQ ID NO: 2517930 - DNA, 20 bp, Homo sapiens
gaaacatcagttactctgaa

SEQ ID NO: 2517931 - DNA, 23 bp, Homo sapiens
gaaacatcagttactctgaaggg

SEQ ID NO: 2517932 - DNA, 22 bp, Homo sapiens
gaaaccaaagatatatacacag

SEQ ID NO: 2517933 - DNA, 20 bp, Homo sapiens
gaaaccagggcctgagccaa

SEQ ID NO: 2517934 - DNA, 19 bp, Homo sapiens
gaaaccagtgtagccttgc

SEQ ID NO: 2517935 - DNA, 13 bp, Homo sapiens
gaaacccagctct

SEQ ID NO: 2517936 - DNA, 15 bp, Homo sapiens
gaaacccagctctgg

SEQ ID NO: 2517937 - DNA, 15 bp, Homo sapiens
gaaacccccacacac

SEQ ID NO: 2517938 - DNA, 15 bp, Homo sapiens
gaaaccctatttccc

SEQ ID NO: 2517939 - DNA, 17 bp, Homo sapiens
gaaacccttgaaaagac

SEQ ID NO: 2517940 - DNA, 13 bp, Homo sapiens
gaaacctgaaaaa

SEQ ID NO: 2517941 - DNA, 13 bp, Homo sapiens
gaaacctgccctg

SEQ ID NO: 2517942 - DNA, 14 bp, Homo sapiens
gaaacctgccctgc

SEQ ID NO: 2517943 - DNA, 19 bp, Homo sapiens
gaaaccttattgtacctct

SEQ ID NO: 2517944 - DNA, 18 bp, Homo sapiens
gaaacctttagggcagct

SEQ ID NO: 2517945 - DNA, 14 bp, Homo sapiens
gaaaccttttttaa

SEQ ID NO: 2517946 - DNA, 17 bp, Homo sapiens
gaaaccttttttaagat

SEQ ID NO: 2517947 - DNA, 20 bp, Homo sapiens
gaaaccttttttaagatttt

SEQ ID NO: 2517948 - DNA, 15 bp, Homo sapiens
gaaactaacagataa

SEQ ID NO: 2517949 - DNA, 17 bp, Homo sapiens
gaaactcaccatgtaaa

SEQ ID NO: 2517950 - DNA, 20 bp, Homo sapiens
gaaactcaccatgtaaaaga

SEQ ID NO: 2517951 - DNA, 22 bp, Homo sapiens
gaaactcacctgctggcccctc

SEQ ID NO: 2517952 - DNA, 22 bp, Homo sapiens
gaaactcagagtcggaacggag

SEQ ID NO: 2517953 - DNA, 16 bp, Homo sapiens
gaaactcttatctcag

SEQ ID NO: 2517954 - DNA, 21 bp, Homo sapiens
gaaactcttatctcagtcatg

SEQ ID NO: 2517955 - DNA, 22 bp, Homo sapiens
gaaactgaggaattttctttgt

SEQ ID NO: 2517956 - DNA, 21 bp, Homo sapiens
gaaactgcttgtttcctagca

SEQ ID NO: 2517957 - DNA, 17 bp, Homo sapiens
gaaactggattaaactt

SEQ ID NO: 2517958 - DNA, 22 bp, Homo sapiens
gaaactgttcccacctgctgga

SEQ ID NO: 2517959 - DNA, 18 bp, Homo sapiens
gaaagaaaatcaggctgg

SEQ ID NO: 2517960 - DNA, 22 bp, Homo sapiens
gaaagaaagttgcacggctgct

SEQ ID NO: 2517961 - DNA, 20 bp, Homo sapiens
gaaagaacatggacttgtat

SEQ ID NO: 2517962 - DNA, 23 bp, Homo sapiens
gaaagaacatggacttgtatatt

SEQ ID NO: 2517963 - DNA, 19 bp, Homo sapiens
gaaagaatgaaagagtaaa

SEQ ID NO: 2517964 - DNA, 14 bp, Homo sapiens
gaaagacagagctg

SEQ ID NO: 2517965 - DNA, 22 bp, Homo sapiens
gaaagacatccataaagaagca

SEQ ID NO: 2517966 - DNA, 21 bp, Homo sapiens
gaaagacggattgcattagaa

SEQ ID NO: 2517967 - DNA, 20 bp, Homo sapiens
gaaagactatctaaatgttg

SEQ ID NO: 2517968 - DNA, 14 bp, Homo sapiens
gaaagactattcaa

SEQ ID NO: 2517969 - DNA, 17 bp, Homo sapiens
gaaagactattcaaaca

SEQ ID NO: 2517970 - DNA, 19 bp, Homo sapiens
gaaagactattcaaacagt

SEQ ID NO: 2517971 - DNA, 14 bp, Homo sapiens
gaaagactgagctc

SEQ ID NO: 2517972 - DNA, 17 bp, Homo sapiens
gaaagactgtacaaagt

SEQ ID NO: 2517973 - DNA, 18 bp, Homo sapiens
gaaagagagaaaataaaa

SEQ ID NO: 2517974 - DNA, 19 bp, Homo sapiens
gaaagagagagaattcttt

SEQ ID NO: 2517975 - DNA, 21 bp, Homo sapiens
gaaagaggaatgaagtactca

SEQ ID NO: 2517976 - DNA, 15 bp, Homo sapiens
gaaagagtaggaaga

SEQ ID NO: 2517977 - DNA, 17 bp, Homo sapiens
gaaagatgagcttttct

SEQ ID NO: 2517978 - DNA, 21 bp, Homo sapiens
gaaagcactgcatgaataaaa

SEQ ID NO: 2517979 - DNA, 17 bp, Homo sapiens
gaaagcagaacagtgat

SEQ ID NO: 2517980 - DNA, 16 bp, Homo sapiens
gaaagcatcacctcag

SEQ ID NO: 2517981 - DNA, 14 bp, Homo sapiens
gaaagccacctctc

SEQ ID NO: 2517982 - DNA, 19 bp, Homo sapiens
gaaagccacctctccctca

SEQ ID NO: 2517983 - DNA, 14 bp, Homo sapiens
gaaagccatttgtt

SEQ ID NO: 2517984 - DNA, 22 bp, Homo sapiens
gaaagccctgagctttctgcta

SEQ ID NO: 2517985 - DNA, 18 bp, Homo sapiens
gaaagcctgttcccctca

SEQ ID NO: 2517986 - DNA, 20 bp, Homo sapiens
gaaagcctgttcccctcact

SEQ ID NO: 2517987 - DNA, 21 bp, Homo sapiens
gaaagcctgttcccctcactg

SEQ ID NO: 2517988 - DNA, 21 bp, Homo sapiens
gaaagcttgccctggtgcctc

SEQ ID NO: 2517989 - DNA, 11 bp, Homo sapiens
gaaaggaaaga

SEQ ID NO: 2517990 - DNA, 21 bp, Homo sapiens
gaaaggactctggggttttta

SEQ ID NO: 2517991 - DNA, 23 bp, Homo sapiens
gaaaggactctggggtttttact

SEQ ID NO: 2517992 - DNA, 13 bp, Homo sapiens
gaaaggagactag

SEQ ID NO: 2517993 - DNA, 16 bp, Homo sapiens
gaaaggagtagaaaaa

SEQ ID NO: 2517994 - DNA, 12 bp, Homo sapiens
gaaaggccagct

SEQ ID NO: 2517995 - DNA, 21 bp, Homo sapiens
gaaaggccagctggcagcaga

SEQ ID NO: 2517996 - DNA, 22 bp, Homo sapiens
gaaaggccagctggcagcagag

SEQ ID NO: 2517997 - DNA, 14 bp, Homo sapiens
gaaaggctcagtct

SEQ ID NO: 2517998 - DNA, 18 bp, Homo sapiens
gaaaggctcagtctcagg

SEQ ID NO: 2517999 - DNA, 19 bp, Homo sapiens
gaaaggctcagtctcagga

SEQ ID NO: 2518000 - DNA, 12 bp, Homo sapiens
gaaaggctccag

SEQ ID NO: 2518001 - DNA, 15 bp, Homo sapiens
gaaaggctccaggag

SEQ ID NO: 2518002 - DNA, 18 bp, Homo sapiens
gaaaggctccaggagcag

SEQ ID NO: 2518003 - DNA, 19 bp, Homo sapiens
gaaaggctctgaaagccag

SEQ ID NO: 2518004 - DNA, 20 bp, Homo sapiens
gaaagggacgctacccggga

SEQ ID NO: 2518005 - DNA, 22 bp, Homo sapiens
gaaagggagctatcaggaacag

SEQ ID NO: 2518006 - DNA, 20 bp, Homo sapiens
gaaagggcaacaataaaata

SEQ ID NO: 2518007 - DNA, 14 bp, Homo sapiens
gaaaggttctgccc

SEQ ID NO: 2518008 - DNA, 13 bp, Homo sapiens
gaactcttaatca

SEQ ID NO: 2518009 - DNA, 13 bp, Homo sapiens
gaactgatagtta

SEQ ID NO: 2518010 - DNA, 18 bp, Homo sapiens
gaactgcagacctgtcct

SEQ ID NO: 2518011 - DNA, 22 bp, Homo sapiens
gaactgctagtcaagtgcgtcc

SEQ ID NO: 2518012 - DNA, 14 bp, Homo sapiens
gaactggactcagg

SEQ ID NO: 2518013 - DNA, 14 bp, Homo sapiens
gaactgtccagaga

SEQ ID NO: 2518014 - DNA, 16 bp, Homo sapiens
gaactgtccagagagc

SEQ ID NO: 2518015 - DNA, 17 bp, Homo sapiens
gaactgtccagagagca

SEQ ID NO: 2518016 - DNA, 18 bp, Homo sapiens
gaactgtccagagagcaa

SEQ ID NO: 2518017 - DNA, 16 bp, Homo sapiens
gaactgttgtataaat

SEQ ID NO: 2518018 - DNA, 18 bp, Homo sapiens
gaacttaaataaatgtca

SEQ ID NO: 2518019 - DNA, 20 bp, Homo sapiens
gaacttatcctaaaacaaat

SEQ ID NO: 2518020 - DNA, 15 bp, Homo sapiens
gaacttctaatatat

SEQ ID NO: 2518021 - DNA, 12 bp, Homo sapiens
gaacttgacaat

SEQ ID NO: 2518022 - DNA, 12 bp, Homo sapiens
gaacttgcatgg

SEQ ID NO: 2518023 - DNA, 22 bp, Homo sapiens
gaactttgacctctgcagcaat

SEQ ID NO: 2518024 - DNA, 14 bp, Homo sapiens
gaactttttgtagg

SEQ ID NO: 2518025 - DNA, 17 bp, Homo sapiens
gaagaaagggtgttttt

SEQ ID NO: 2518026 - DNA, 14 bp, Homo sapiens
gaagaaattcctgt

SEQ ID NO: 2518027 - DNA, 15 bp, Homo sapiens
gaagaaattcctgta

SEQ ID NO: 2518028 - DNA, 22 bp, Homo sapiens
gaagaaattcctgtagcatctt

SEQ ID NO: 2518029 - DNA, 16 bp, Homo sapiens
gaagaacttgcatgga

SEQ ID NO: 2518030 - DNA, 14 bp, Homo sapiens
gaagaagtcagaga

SEQ ID NO: 2518031 - DNA, 13 bp, Homo sapiens
gaagaatttgtta

SEQ ID NO: 2518032 - DNA, 14 bp, Homo sapiens
gaagaatttgttat

SEQ ID NO: 2518033 - DNA, 13 bp, Homo sapiens
gaagaattttaaa

SEQ ID NO: 2518034 - DNA, 15 bp, Homo sapiens
gaagaattttaaaaa

SEQ ID NO: 2518035 - DNA, 23 bp, Homo sapiens
gaagaattttaaaaatgaatcct

SEQ ID NO: 2518036 - DNA, 21 bp, Homo sapiens
gaagacacagactgcgatttg

SEQ ID NO: 2518037 - DNA, 17 bp, Homo sapiens
gaagacaccagagcaga

SEQ ID NO: 2518038 - DNA, 21 bp, Homo sapiens
gaagacaccagagcagatgca

SEQ ID NO: 2518039 - DNA, 16 bp, Homo sapiens
gaagacactgatgggc

SEQ ID NO: 2518040 - DNA, 12 bp, Homo sapiens
gaagacatgttt

SEQ ID NO: 2518041 - DNA, 22 bp, Homo sapiens
gaagaccacatccacacacgca

SEQ ID NO: 2518042 - DNA, 18 bp, Homo sapiens
gaagaccccacccaagct

SEQ ID NO: 2518043 - DNA, 22 bp, Homo sapiens
gaagacctggcaaggacacaga

SEQ ID NO: 2518044 - DNA, 16 bp, Homo sapiens
gaagacgcctgagctc

SEQ ID NO: 2518045 - DNA, 21 bp, Homo sapiens
gaagactcattcttctgtacg

SEQ ID NO: 2518046 - DNA, 23 bp, Homo sapiens
gaagactctaccagactgtgtat

SEQ ID NO: 2518047 - DNA, 20 bp, Homo sapiens
gaagactgtcagcttccaaa

SEQ ID NO: 2518048 - DNA, 17 bp, Homo sapiens
gaagactttggaaagag

SEQ ID NO: 2518049 - DNA, 18 bp, Homo sapiens
gaagagacaggagggcaa

SEQ ID NO: 2518050 - DNA, 15 bp, Homo sapiens
gaagagaggagttca

SEQ ID NO: 2518051 - DNA, 17 bp, Homo sapiens
gaagagaggagttcaat

SEQ ID NO: 2518052 - DNA, 22 bp, Homo sapiens
gaagagaggagttcaatgatct

SEQ ID NO: 2518053 - DNA, 18 bp, Homo sapiens
gaagagcctgcaggtgct

SEQ ID NO: 2518054 - DNA, 17 bp, Homo sapiens
gaagagctattatataa

SEQ ID NO: 2518055 - DNA, 15 bp, Homo sapiens
gaagaggcgggccag

SEQ ID NO: 2518056 - DNA, 16 bp, Homo sapiens
gaagaggcgggccagc

SEQ ID NO: 2518057 - DNA, 17 bp, Homo sapiens
gaagaggcgggccagcc

SEQ ID NO: 2518058 - DNA, 11 bp, Homo sapiens
gaagaggcttc

SEQ ID NO: 2518059 - DNA, 19 bp, Homo sapiens
gaagagggataaggtacct

SEQ ID NO: 2518060 - DNA, 20 bp, Homo sapiens
gaagagggcctgtgggagcc

SEQ ID NO: 2518061 - DNA, 14 bp, Homo sapiens
gaagaggggacagg

SEQ ID NO: 2518062 - DNA, 19 bp, Homo sapiens
gaagaggggacaggtccct

SEQ ID NO: 2518063 - DNA, 14 bp, Homo sapiens
gaagagtgtactgg

SEQ ID NO: 2518064 - DNA, 15 bp, Homo sapiens
gaagagtgtactggg

SEQ ID NO: 2518065 - DNA, 15 bp, Homo sapiens
gaagataggctctgc

SEQ ID NO: 2518066 - DNA, 17 bp, Homo sapiens
gaagataggctctgcac

SEQ ID NO: 2518067 - DNA, 22 bp, Homo sapiens
gaagatataactattgcccagg

SEQ ID NO: 2518068 - DNA, 18 bp, Homo sapiens
gaagatcgttagtatcta

SEQ ID NO: 2518069 - DNA, 17 bp, Homo sapiens
gaagatgaaagaggagg

SEQ ID NO: 2518070 - DNA, 14 bp, Homo sapiens
gaagatgcagctca

SEQ ID NO: 2518071 - DNA, 16 bp, Homo sapiens
gaagatggcatcctgt

SEQ ID NO: 2518072 - DNA, 17 bp, Homo sapiens
gaagatgtagaggagaa

SEQ ID NO: 2518073 - DNA, 18 bp, Homo sapiens
gaagatgtagaggagaaa

SEQ ID NO: 2518074 - DNA, 17 bp, Homo sapiens
gaagattctcctgtgct

SEQ ID NO: 2518075 - DNA, 14 bp, Homo sapiens
gaagattctttccc

SEQ ID NO: 2518076 - DNA, 22 bp, Homo sapiens
gaagatttgatgctggagaggt

SEQ ID NO: 2518077 - DNA, 23 bp, Homo sapiens
gaagattttgaaatttttattaa

SEQ ID NO: 2518078 - DNA, 13 bp, Homo sapiens
gaagcaaacacat

SEQ ID NO: 2518079 - DNA, 15 bp, Homo sapiens
gaagcaaacacatta

SEQ ID NO: 2518080 - DNA, 18 bp, Homo sapiens
gaagcaataaagaagagt

SEQ ID NO: 2518081 - DNA, 19 bp, Homo sapiens
gaagcagatgcaaagaggc

SEQ ID NO: 2518082 - DNA, 20 bp, Homo sapiens
gaagcagatgcaaagaggca

SEQ ID NO: 2518083 - DNA, 22 bp, Homo sapiens
ctgcctgagggcccctctgccc

SEQ ID NO: 2518084 - DNA, 16 bp, Homo sapiens
ctgcctgatggacctg

SEQ ID NO: 2518085 - DNA, 15 bp, Homo sapiens
ctgcctgcacccctg

SEQ ID NO: 2518086 - DNA, 13 bp, Homo sapiens
ctgcctgcccagg

SEQ ID NO: 2518087 - DNA, 16 bp, Homo sapiens
ctgcctgcccaggccc

SEQ ID NO: 2518088 - DNA, 16 bp, Homo sapiens
ctgcctgccttggcct

SEQ ID NO: 2518089 - DNA, 11 bp, Homo sapiens
ctgcctggagc

SEQ ID NO: 2518090 - DNA, 12 bp, Homo sapiens
ctgcctggcagg

SEQ ID NO: 2518091 - DNA, 12 bp, Homo sapiens
ctgcctggccag

SEQ ID NO: 2518092 - DNA, 15 bp, Homo sapiens
ctgcctggccaggca

SEQ ID NO: 2518093 - DNA, 21 bp, Homo sapiens
ctgcctgggatccctcatcct

SEQ ID NO: 2518094 - DNA, 22 bp, Homo sapiens
ctgcctgggatccctcatcctc

SEQ ID NO: 2518095 - DNA, 23 bp, Homo sapiens
ctgcctgggatccctcatcctca

SEQ ID NO: 2518096 - DNA, 17 bp, Homo sapiens
ctgcctgggctgttggc

SEQ ID NO: 2518097 - DNA, 21 bp, Homo sapiens
ctgcctgggctgttggcactc

SEQ ID NO: 2518098 - DNA, 19 bp, Homo sapiens
ctgcctgtaacttgagagt

SEQ ID NO: 2518099 - DNA, 20 bp, Homo sapiens
ctgcctgtagttaggaaata

SEQ ID NO: 2518100 - DNA, 21 bp, Homo sapiens
ctgcctgtagttaggaaataa

SEQ ID NO: 2518101 - DNA, 15 bp, Homo sapiens
ctgcctgtctgtctc

SEQ ID NO: 2518102 - DNA, 21 bp, Homo sapiens
ctgcctgttataactctgcac

SEQ ID NO: 2518103 - DNA, 20 bp, Homo sapiens
ctgcctgttcagctccagct

SEQ ID NO: 2518104 - DNA, 13 bp, Homo sapiens
ctgccttctgtcc

SEQ ID NO: 2518105 - DNA, 15 bp, Homo sapiens
ctgccttctgtcctg

SEQ ID NO: 2518106 - DNA, 21 bp, Homo sapiens
ctgccttctgtcctggtgtca

SEQ ID NO: 2518107 - DNA, 22 bp, Homo sapiens
ctgccttgaagccactgaagct

SEQ ID NO: 2518108 - DNA, 17 bp, Homo sapiens
ctgcgaaggggccctgg

SEQ ID NO: 2518109 - DNA, 18 bp, Homo sapiens
ctgcgaaggggccctggt

SEQ ID NO: 2518110 - DNA, 19 bp, Homo sapiens
ctgcgaaggggccctggtc

SEQ ID NO: 2518111 - DNA, 17 bp, Homo sapiens
ctgcgcccaccccgctc

SEQ ID NO: 2518112 - DNA, 21 bp, Homo sapiens
ctgcggaatgaaccacatctt

SEQ ID NO: 2518113 - DNA, 20 bp, Homo sapiens
ctgcggagagaggccttgtc

SEQ ID NO: 2518114 - DNA, 18 bp, Homo sapiens
ctgcggagtgaagagggg

SEQ ID NO: 2518115 - DNA, 16 bp, Homo sapiens
ctgcggctgctgtgtg

SEQ ID NO: 2518116 - DNA, 19 bp, Homo sapiens
ctgcggctgctgtgtgcct

SEQ ID NO: 2518117 - DNA, 15 bp, Homo sapiens
ctgcggtccacccag

SEQ ID NO: 2518118 - DNA, 20 bp, Homo sapiens
ctgcggtccacccaggagcc

SEQ ID NO: 2518119 - DNA, 21 bp, Homo sapiens
ctgcggtgctatctcccccag

SEQ ID NO: 2518120 - DNA, 19 bp, Homo sapiens
ctgcgtgacaataaaacat

SEQ ID NO: 2518121 - DNA, 15 bp, Homo sapiens
ctgcgtggggacagg

SEQ ID NO: 2518122 - DNA, 18 bp, Homo sapiens
ctgcgtggggacagggct

SEQ ID NO: 2518123 - DNA, 20 bp, Homo sapiens
ctgcgtggggacagggctcg

SEQ ID NO: 2518124 - DNA, 19 bp, Homo sapiens
ctgcgtgtcacctgtgctt

SEQ ID NO: 2518125 - DNA, 20 bp, Homo sapiens
ctgctacgttcctattgtca

SEQ ID NO: 2518126 - DNA, 16 bp, Homo sapiens
ctgctagagccagcaa

SEQ ID NO: 2518127 - DNA, 22 bp, Homo sapiens
ctgctagcacttggagccaagg

SEQ ID NO: 2518128 - DNA, 22 bp, Homo sapiens
ctgctaggcgagtgccaggact

SEQ ID NO: 2518129 - DNA, 22 bp, Homo sapiens
ctgctaggtgggccagcccctc

SEQ ID NO: 2518130 - DNA, 17 bp, Homo sapiens
ctgctatcaaagaggtt

SEQ ID NO: 2518131 - DNA, 13 bp, Homo sapiens
ctgctcagacaga

SEQ ID NO: 2518132 - DNA, 13 bp, Homo sapiens
ctgctcagcagct

SEQ ID NO: 2518133 - DNA, 22 bp, Homo sapiens
ctgctcagggaaaagcagctct

SEQ ID NO: 2518134 - DNA, 18 bp, Homo sapiens
ctgctcagtaaagcactt

SEQ ID NO: 2518135 - DNA, 15 bp, Homo sapiens
ctgctcatattgtga

SEQ ID NO: 2518136 - DNA, 16 bp, Homo sapiens
ctgctcatcattctct

SEQ ID NO: 2518137 - DNA, 14 bp, Homo sapiens
ctgctccacccttg

SEQ ID NO: 2518138 - DNA, 21 bp, Homo sapiens
ctgctccacccttggcctgtc

SEQ ID NO: 2518139 - DNA, 16 bp, Homo sapiens
ctgctcccagcagccc

SEQ ID NO: 2518140 - DNA, 21 bp, Homo sapiens
ctgctcccagcagccctaagg

SEQ ID NO: 2518141 - DNA, 16 bp, Homo sapiens
ctgctccccagccctg

SEQ ID NO: 2518142 - DNA, 20 bp, Homo sapiens
ctgctccccagccctggctc

SEQ ID NO: 2518143 - DNA, 14 bp, Homo sapiens
ctgctcctccctgg

SEQ ID NO: 2518144 - DNA, 15 bp, Homo sapiens
ctgctcctccctggc

SEQ ID NO: 2518145 - DNA, 16 bp, Homo sapiens
ctgctcctccctggct

SEQ ID NO: 2518146 - DNA, 17 bp, Homo sapiens
ctgctcctccctggctg

SEQ ID NO: 2518147 - DNA, 23 bp, Homo sapiens
ctgctcctccctggctgccctgg

SEQ ID NO: 2518148 - DNA, 15 bp, Homo sapiens
ctgctcctctccagg

SEQ ID NO: 2518149 - DNA, 16 bp, Homo sapiens
ctgctcctctccaggc

SEQ ID NO: 2518150 - DNA, 18 bp, Homo sapiens
ctgctcctctccccagca

SEQ ID NO: 2518151 - DNA, 19 bp, Homo sapiens
ctgctcctctccccagcaa

SEQ ID NO: 2518152 - DNA, 20 bp, Homo sapiens
ctgctcctggagcctttgaa

SEQ ID NO: 2518153 - DNA, 20 bp, Homo sapiens
ctgctctccaagtctcagtg

SEQ ID NO: 2518154 - DNA, 13 bp, Homo sapiens
ctgctctgaggct

SEQ ID NO: 2518155 - DNA, 18 bp, Homo sapiens
ctgctctgaggcttccag

SEQ ID NO: 2518156 - DNA, 21 bp, Homo sapiens
ctgctctgcgtgtcacctgtg

SEQ ID NO: 2518157 - DNA, 22 bp, Homo sapiens
ctgctctgcgtgtcacctgtgc

SEQ ID NO: 2518158 - DNA, 19 bp, Homo sapiens
ctgctgaagctgcctgctt

SEQ ID NO: 2518159 - DNA, 13 bp, Homo sapiens
ctgctgaaggctc

SEQ ID NO: 2518160 - DNA, 14 bp, Homo sapiens
ctgctgaaggctcg

SEQ ID NO: 2518161 - DNA, 18 bp, Homo sapiens
ctgctgaaggctcgagca

SEQ ID NO: 2518162 - DNA, 23 bp, Homo sapiens
ctgctgaaggctcgagcatgcct

SEQ ID NO: 2518163 - DNA, 24 bp, Homo sapiens
ctgctgaaggctcgagcatgcctg

SEQ ID NO: 2518164 - DNA, 21 bp, Homo sapiens
ctgctgacagacacaggcccg

SEQ ID NO: 2518165 - DNA, 13 bp, Homo sapiens
ctgctgacagtgt

SEQ ID NO: 2518166 - DNA, 15 bp, Homo sapiens
ctgctgacagtgttg

SEQ ID NO: 2518167 - DNA, 15 bp, Homo sapiens
ctgctgcaaggcctt

SEQ ID NO: 2518168 - DNA, 23 bp, Homo sapiens
ctgctgcaaggcctttctgtgtg

SEQ ID NO: 2518169 - DNA, 14 bp, Homo sapiens
ctgctgcagttgcc

SEQ ID NO: 2518170 - DNA, 16 bp, Homo sapiens
ctgctgcatggggtgg

SEQ ID NO: 2518171 - DNA, 22 bp, Homo sapiens
ctgctgcccagcctccaagctc

SEQ ID NO: 2518172 - DNA, 12 bp, Homo sapiens
ctgctgcccagg

SEQ ID NO: 2518173 - DNA, 14 bp, Homo sapiens
ctgctgccctccat

SEQ ID NO: 2518174 - DNA, 22 bp, Homo sapiens
ctgggatgagccgctgtgagcc

SEQ ID NO: 2518175 - DNA, 18 bp, Homo sapiens
ctgggatgattggagggg

SEQ ID NO: 2518176 - DNA, 15 bp, Homo sapiens
ctgggatgggcctgc

SEQ ID NO: 2518177 - DNA, 21 bp, Homo sapiens
ctgggatgtccacagatgcct

SEQ ID NO: 2518178 - DNA, 22 bp, Homo sapiens
ctgggatgtggctgcagcagcg

SEQ ID NO: 2518179 - DNA, 19 bp, Homo sapiens
ctgggatgtttctgtcaca

SEQ ID NO: 2518180 - DNA, 20 bp, Homo sapiens
ctgggattacaggcatgagc

SEQ ID NO: 2518181 - DNA, 21 bp, Homo sapiens
ctgggattacaggcgtgagcc

SEQ ID NO: 2518182 - DNA, 15 bp, Homo sapiens
ctgggattcccacca

SEQ ID NO: 2518183 - DNA, 17 bp, Homo sapiens
ctgggattcccaccaag

SEQ ID NO: 2518184 - DNA, 18 bp, Homo sapiens
ctgggattctactttaag

SEQ ID NO: 2518185 - DNA, 23 bp, Homo sapiens
ctgggattctactttaagcacta

SEQ ID NO: 2518186 - DNA, 17 bp, Homo sapiens
ctgggatttacacttga

SEQ ID NO: 2518187 - DNA, 15 bp, Homo sapiens
ctgggcaacagagca

SEQ ID NO: 2518188 - DNA, 18 bp, Homo sapiens
ctgggcaacagagcaaga

SEQ ID NO: 2518189 - DNA, 20 bp, Homo sapiens
ctgggcaatgtgataaaacc

SEQ ID NO: 2518190 - DNA, 17 bp, Homo sapiens
ctgggcacacgcctccc

SEQ ID NO: 2518191 - DNA, 18 bp, Homo sapiens
ctgggcagcatagcaaga

SEQ ID NO: 2518192 - DNA, 15 bp, Homo sapiens
ctgggcatcctcagg

SEQ ID NO: 2518193 - DNA, 13 bp, Homo sapiens
ctgggcattgctt

SEQ ID NO: 2518194 - DNA, 16 bp, Homo sapiens
ctgggcattgctttcc

SEQ ID NO: 2518195 - DNA, 20 bp, Homo sapiens
ctgggccaagttcctctagt

SEQ ID NO: 2518196 - DNA, 21 bp, Homo sapiens
ctgggccaagttcctctagtg

SEQ ID NO: 2518197 - DNA, 15 bp, Homo sapiens
ctgggccccagccca

SEQ ID NO: 2518198 - DNA, 14 bp, Homo sapiens
ctgggccctctctg

SEQ ID NO: 2518199 - DNA, 14 bp, Homo sapiens
ctgggcgccctgga

SEQ ID NO: 2518200 - DNA, 16 bp, Homo sapiens
ctgggcgccctggaag

SEQ ID NO: 2518201 - DNA, 21 bp, Homo sapiens
ctgggctcccttcccacctct

SEQ ID NO: 2518202 - DNA, 22 bp, Homo sapiens
ctgggctcccttcccacctctc

SEQ ID NO: 2518203 - DNA, 13 bp, Homo sapiens
ctgggctcggagg

SEQ ID NO: 2518204 - DNA, 15 bp, Homo sapiens
ctgggctcggaggct

SEQ ID NO: 2518205 - DNA, 16 bp, Homo sapiens
ctgggctcggaggctg

SEQ ID NO: 2518206 - DNA, 23 bp, Homo sapiens
ctgggctctgcaattcccctctg

SEQ ID NO: 2518207 - DNA, 12 bp, Homo sapiens
ctgggctgagcc

SEQ ID NO: 2518208 - DNA, 13 bp, Homo sapiens
ctgggctgagccc

SEQ ID NO: 2518209 - DNA, 14 bp, Homo sapiens
ctgggctgagcccc

SEQ ID NO: 2518210 - DNA, 18 bp, Homo sapiens
ctgggctgagcccctacc

SEQ ID NO: 2518211 - DNA, 19 bp, Homo sapiens
ctgggctgagcccctaccc

SEQ ID NO: 2518212 - DNA, 19 bp, Homo sapiens
ctgggctgctacccagaaa

SEQ ID NO: 2518213 - DNA, 12 bp, Homo sapiens
ctgggctggctc

SEQ ID NO: 2518214 - DNA, 18 bp, Homo sapiens
ctgggctggctccctctt

SEQ ID NO: 2518215 - DNA, 18 bp, Homo sapiens
ctgggcttcagtggcagc

SEQ ID NO: 2518216 - DNA, 20 bp, Homo sapiens
ctgggcttcagtggcagctg

SEQ ID NO: 2518217 - DNA, 19 bp, Homo sapiens
ctgggcttggggcttccta

SEQ ID NO: 2518218 - DNA, 18 bp, Homo sapiens
ctgggcttgtctgtagat

SEQ ID NO: 2518219 - DNA, 17 bp, Homo sapiens
ctggggaaataacagct

SEQ ID NO: 2518220 - DNA, 17 bp, Homo sapiens
ctggggagtgggacaga

SEQ ID NO: 2518221 - DNA, 22 bp, Homo sapiens
ctggggatgtctctcatgacca

SEQ ID NO: 2518222 - DNA, 14 bp, Homo sapiens
ctggggcaagtccc

SEQ ID NO: 2518223 - DNA, 16 bp, Homo sapiens
ctggggcaagtccctg

SEQ ID NO: 2518224 - DNA, 15 bp, Homo sapiens
ctggggccacacaga

SEQ ID NO: 2518225 - DNA, 12 bp, Homo sapiens
ctggggcctctt

SEQ ID NO: 2518226 - DNA, 17 bp, Homo sapiens
ctggggcctggacctgc

SEQ ID NO: 2518227 - DNA, 19 bp, Homo sapiens
ctggggctaggctggagcc

SEQ ID NO: 2518228 - DNA, 12 bp, Homo sapiens
ctggggctccct

SEQ ID NO: 2518229 - DNA, 14 bp, Homo sapiens
ctggggctgctggc

SEQ ID NO: 2518230 - DNA, 15 bp, Homo sapiens
ctgggggaagaagct

SEQ ID NO: 2518231 - DNA, 12 bp, Homo sapiens
ctgggggcagga

SEQ ID NO: 2518232 - DNA, 14 bp, Homo sapiens
ctgggggcaggagg

SEQ ID NO: 2518233 - DNA, 19 bp, Homo sapiens
ctgggggcaggagggccct

SEQ ID NO: 2518234 - DNA, 16 bp, Homo sapiens
ctgggggccatgagct

SEQ ID NO: 2518235 - DNA, 13 bp, Homo sapiens
ctgggggcctcag

SEQ ID NO: 2518236 - DNA, 15 bp, Homo sapiens
ctgggggtgccagga

SEQ ID NO: 2518237 - DNA, 21 bp, Homo sapiens
ctggggtaccaagagactcct

SEQ ID NO: 2518238 - DNA, 15 bp, Homo sapiens
ctggggtcctggggc

SEQ ID NO: 2518239 - DNA, 19 bp, Homo sapiens
ctggggtcctggggcctcg

SEQ ID NO: 2518240 - DNA, 16 bp, Homo sapiens
ctggggtgccgcctgc

SEQ ID NO: 2518241 - DNA, 17 bp, Homo sapiens
ctggggtgccgcctgcc

SEQ ID NO: 2518242 - DNA, 19 bp, Homo sapiens
ctggggtgccgcctgcccg

SEQ ID NO: 2518243 - DNA, 17 bp, Homo sapiens
ctgggtcagtctggtgg

SEQ ID NO: 2518244 - DNA, 18 bp, Homo sapiens
ctgggtcagtctggtggg

SEQ ID NO: 2518245 - DNA, 21 bp, Homo sapiens
ctgggtccaaataaaaactaa

SEQ ID NO: 2518246 - DNA, 23 bp, Homo sapiens
ctgggtccaaataaaaactaaat

SEQ ID NO: 2518247 - DNA, 22 bp, Homo sapiens
ctgggtccaggggatgggaggt

SEQ ID NO: 2518248 - DNA, 13 bp, Homo sapiens
ctgggtgacagag

SEQ ID NO: 2518249 - DNA, 21 bp, Homo sapiens
ctgggtgccccgtccacggct

SEQ ID NO: 2518250 - DNA, 15 bp, Homo sapiens
ctgggtgctccctac

SEQ ID NO: 2518251 - DNA, 20 bp, Homo sapiens
ctgggtggcaccagcagcct

SEQ ID NO: 2518252 - DNA, 22 bp, Homo sapiens
ctgggtggcaccagcagcctgg

SEQ ID NO: 2518253 - DNA, 14 bp, Homo sapiens
ctgggtggcactgc

SEQ ID NO: 2518254 - DNA, 21 bp, Homo sapiens
ctgggtggggtgaggaccact

SEQ ID NO: 2518255 - DNA, 17 bp, Homo sapiens
ctgggtgggtggtgggg

SEQ ID NO: 2518256 - DNA, 18 bp, Homo sapiens
ctgggtgggtggtgggga

SEQ ID NO: 2518257 - DNA, 21 bp, Homo sapiens
ctgggtggtctgcaggcaggg

SEQ ID NO: 2518258 - DNA, 15 bp, Homo sapiens
ctgggtgtggcgcag

SEQ ID NO: 2518259 - DNA, 17 bp, Homo sapiens
ctgggtgtggcgcagca

SEQ ID NO: 2518260 - DNA, 14 bp, Homo sapiens
ctgggttcactgca

SEQ ID NO: 2518261 - DNA, 18 bp, Homo sapiens
ctgggttcactgcaacct

SEQ ID NO: 2518262 - DNA, 18 bp, Homo sapiens
ctgggttcagaaatgctg

SEQ ID NO: 2518263 - DNA, 22 bp, Homo sapiens
ctgggttcagaaatgctgcctg

SEQ ID NO: 2518264 - DNA, 14 bp, Homo sapiens
ctgggttccctttc

SEQ ID NO: 2518265 - DNA, 13 bp, Homo sapiens
ctgggttcctgca

SEQ ID NO: 2518266 - DNA, 14 bp, Homo sapiens
ctgggttctaccca

SEQ ID NO: 2518267 - DNA, 16 bp, Homo sapiens
ctgggttctacccagg

SEQ ID NO: 2518268 - DNA, 13 bp, Homo sapiens
ctgggttggtgca

SEQ ID NO: 2518269 - DNA, 14 bp, Homo sapiens
ctgggttggtgcac

SEQ ID NO: 2518270 - DNA, 15 bp, Homo sapiens
ctgggttggtgcaca

SEQ ID NO: 2518271 - DNA, 22 bp, Homo sapiens
ctgggttggtgcacagtgattt

SEQ ID NO: 2518272 - DNA, 18 bp, Homo sapiens
ctgggtttctctgtatag

SEQ ID NO: 2518273 - DNA, 21 bp, Homo sapiens
ctgggtttggaccccagctgg

SEQ ID NO: 2518274 - DNA, 22 bp, Homo sapiens
ctgggtttggaccccagctggg

SEQ ID NO: 2518275 - DNA, 23 bp, Homo sapiens
ctgggtttggaccccagctggga

SEQ ID NO: 2518276 - DNA, 17 bp, Homo sapiens
ctggtacccagccatct

SEQ ID NO: 2518277 - DNA, 18 bp, Homo sapiens
ctggtacccagccatctg

SEQ ID NO: 2518278 - DNA, 16 bp, Homo sapiens
ctggtaccctcctggc

SEQ ID NO: 2518279 - DNA, 14 bp, Homo sapiens
ctggtagatagaaa

SEQ ID NO: 2518280 - DNA, 15 bp, Homo sapiens
ctggtagatagaaat

SEQ ID NO: 2518281 - DNA, 16 bp, Homo sapiens
ctggtagctcaggtgg

SEQ ID NO: 2518282 - DNA, 13 bp, Homo sapiens
ctggtagggcagt

SEQ ID NO: 2518283 - DNA, 19 bp, Homo sapiens
ctggtagttagtagcatgt

SEQ ID NO: 2518284 - DNA, 18 bp, Homo sapiens
ctggtatatccaaaagct

SEQ ID NO: 2518285 - DNA, 19 bp, Homo sapiens
ctggtatatccaaaagctt

SEQ ID NO: 2518286 - DNA, 20 bp, Homo sapiens
ctggtatatccaaaagcttt

SEQ ID NO: 2518287 - DNA, 17 bp, Homo sapiens
ctggtcaacctcctgga

SEQ ID NO: 2518288 - DNA, 19 bp, Homo sapiens
ctggtcaacctcctggaca

SEQ ID NO: 2518289 - DNA, 18 bp, Homo sapiens
ctggtcacagcctcctct

SEQ ID NO: 2518290 - DNA, 23 bp, Homo sapiens
ctggtcacaggactctgcctcct

SEQ ID NO: 2518291 - DNA, 15 bp, Homo sapiens
ctggtccagggaagc

SEQ ID NO: 2518292 - DNA, 17 bp, Homo sapiens
ctggtccatagagagca

SEQ ID NO: 2518293 - DNA, 18 bp, Homo sapiens
ctggtccatagagagcaa

SEQ ID NO: 2518294 - DNA, 17 bp, Homo sapiens
ctggtccatgatggagt

SEQ ID NO: 2518295 - DNA, 13 bp, Homo sapiens
ctggtcccactca

SEQ ID NO: 2518296 - DNA, 14 bp, Homo sapiens
ctggtcccactcag

SEQ ID NO: 2518297 - DNA, 15 bp, Homo sapiens
ctggtccctgggagg

SEQ ID NO: 2518298 - DNA, 20 bp, Homo sapiens
ctggtccggacactcctaga

SEQ ID NO: 2518299 - DNA, 14 bp, Homo sapiens
ctggtcctgtgtgc

SEQ ID NO: 2518300 - DNA, 18 bp, Homo sapiens
ctggtctcaaactcctga

SEQ ID NO: 2518301 - DNA, 21 bp, Homo sapiens
ctggtctcaaactcctgggct

SEQ ID NO: 2518302 - DNA, 23 bp, Homo sapiens
ctggtctcaaactcttgacctca

SEQ ID NO: 2518303 - DNA, 20 bp, Homo sapiens
ctggtctcagcagcgaccac

SEQ ID NO: 2518304 - DNA, 17 bp, Homo sapiens
ctggtctctaggctggg

SEQ ID NO: 2518305 - DNA, 18 bp, Homo sapiens
ctggtctctaggctgggg

SEQ ID NO: 2518306 - DNA, 19 bp, Homo sapiens
ctgctgccgccccacccag

SEQ ID NO: 2518307 - DNA, 19 bp, Homo sapiens
ctgctgccgcctcccagcc

SEQ ID NO: 2518308 - DNA, 14 bp, Homo sapiens
ctgctgcctcccca

SEQ ID NO: 2518309 - DNA, 15 bp, Homo sapiens
ctgctgctgcgccct

SEQ ID NO: 2518310 - DNA, 12 bp, Homo sapiens
ctgctgctggct

SEQ ID NO: 2518311 - DNA, 14 bp, Homo sapiens
ctgctgctggctgg

SEQ ID NO: 2518312 - DNA, 16 bp, Homo sapiens
ctgctggcccagccaa

SEQ ID NO: 2518313 - DNA, 11 bp, Homo sapiens
ctgctggcccc

SEQ ID NO: 2518314 - DNA, 15 bp, Homo sapiens
ctgctggcccctcac

SEQ ID NO: 2518315 - DNA, 13 bp, Homo sapiens
ctgctggccgcct

SEQ ID NO: 2518316 - DNA, 18 bp, Homo sapiens
ctgctggccgcctcaccc

SEQ ID NO: 2518317 - DNA, 13 bp, Homo sapiens
ctgctggcctgga

SEQ ID NO: 2518318 - DNA, 16 bp, Homo sapiens
ctgctggcctggatct

SEQ ID NO: 2518319 - DNA, 20 bp, Homo sapiens
ctgctggcctggccggcaac

SEQ ID NO: 2518320 - DNA, 14 bp, Homo sapiens
ctgctggcgcctct

SEQ ID NO: 2518321 - DNA, 17 bp, Homo sapiens
ctgctggcgcctctgca

SEQ ID NO: 2518322 - DNA, 14 bp, Homo sapiens
ctgctggcttgcag

SEQ ID NO: 2518323 - DNA, 17 bp, Homo sapiens
ctgctgggactggccag

SEQ ID NO: 2518324 - DNA, 14 bp, Homo sapiens
ctgctgggtgtggc

SEQ ID NO: 2518325 - DNA, 19 bp, Homo sapiens
ctgctgggttttcctccgg

SEQ ID NO: 2518326 - DNA, 20 bp, Homo sapiens
ctgctggtcacagcctcctc

SEQ ID NO: 2518327 - DNA, 21 bp, Homo sapiens
ctgctggttaacttgtttggc

SEQ ID NO: 2518328 - DNA, 13 bp, Homo sapiens
ctgctggttcagg

SEQ ID NO: 2518329 - DNA, 15 bp, Homo sapiens
ctgctggttcagggt

SEQ ID NO: 2518330 - DNA, 11 bp, Homo sapiens
ctgctgtccag

SEQ ID NO: 2518331 - DNA, 21 bp, Homo sapiens
ctgctgtccagacagcctgta

SEQ ID NO: 2518332 - DNA, 20 bp, Homo sapiens
ctgctgtccctcccccttgt

SEQ ID NO: 2518333 - DNA, 14 bp, Homo sapiens
ctgctgtctcagcc

SEQ ID NO: 2518334 - DNA, 15 bp, Homo sapiens
ctgcttaacttcaca

SEQ ID NO: 2518335 - DNA, 23 bp, Homo sapiens
ctgcttaccagataatgctactt

SEQ ID NO: 2518336 - DNA, 16 bp, Homo sapiens
ctgcttaggagagacc

SEQ ID NO: 2518337 - DNA, 14 bp, Homo sapiens
ctgcttcaaatatt

SEQ ID NO: 2518338 - DNA, 14 bp, Homo sapiens
ctgcttcagcctcc

SEQ ID NO: 2518339 - DNA, 16 bp, Homo sapiens
ctgcttcagcctcccg

SEQ ID NO: 2518340 - DNA, 21 bp, Homo sapiens
ctgcttcagtgtatggaaata

SEQ ID NO: 2518341 - DNA, 15 bp, Homo sapiens
ctgcttcatgacatt

SEQ ID NO: 2518342 - DNA, 24 bp, Homo sapiens
ctgcttccaattttctggaataca

SEQ ID NO: 2518343 - DNA, 15 bp, Homo sapiens
ctgcttccagtgagg

SEQ ID NO: 2518344 - DNA, 18 bp, Homo sapiens
ctgcttccagtgaggctc

SEQ ID NO: 2518345 - DNA, 12 bp, Homo sapiens
ctgcttcccatc

SEQ ID NO: 2518346 - DNA, 23 bp, Homo sapiens
ctgcttccctctgcctgtccctc

SEQ ID NO: 2518347 - DNA, 21 bp, Homo sapiens
ctggccaccaccccccactct

SEQ ID NO: 2518348 - DNA, 18 bp, Homo sapiens
ctggccaccaggctggcg

SEQ ID NO: 2518349 - DNA, 21 bp, Homo sapiens
ctggccaccaggctggcgcag

SEQ ID NO: 2518350 - DNA, 16 bp, Homo sapiens
ctggccacctctctcc

SEQ ID NO: 2518351 - DNA, 16 bp, Homo sapiens
ctggccacctgaggtg

SEQ ID NO: 2518352 - DNA, 21 bp, Homo sapiens
ctggccacctgaggtgggccc

SEQ ID NO: 2518353 - DNA, 12 bp, Homo sapiens
ctggccactgca

SEQ ID NO: 2518354 - DNA, 16 bp, Homo sapiens
ctggccagatgcacca

SEQ ID NO: 2518355 - DNA, 17 bp, Homo sapiens
ctggccagatgcaccag

SEQ ID NO: 2518356 - DNA, 17 bp, Homo sapiens
ctggccaggagctcttc

SEQ ID NO: 2518357 - DNA, 11 bp, Homo sapiens
ctggccaggca

SEQ ID NO: 2518358 - DNA, 13 bp, Homo sapiens
ctggccaggcaga

SEQ ID NO: 2518359 - DNA, 22 bp, Homo sapiens
ctggccaggcagatctgtgccc

SEQ ID NO: 2518360 - DNA, 14 bp, Homo sapiens
ctggccagggcctg

SEQ ID NO: 2518361 - DNA, 18 bp, Homo sapiens
ctggcccacagcaggtgc

SEQ ID NO: 2518362 - DNA, 13 bp, Homo sapiens
ctggcccactgca

SEQ ID NO: 2518363 - DNA, 15 bp, Homo sapiens
ctggcccactgcatc

SEQ ID NO: 2518364 - DNA, 17 bp, Homo sapiens
ctggcccagccaaaccc

SEQ ID NO: 2518365 - DNA, 13 bp, Homo sapiens
ctggcccagccct

SEQ ID NO: 2518366 - DNA, 15 bp, Homo sapiens
ctggcccagccctgc

SEQ ID NO: 2518367 - DNA, 18 bp, Homo sapiens
ctggcccagccctgctgg

SEQ ID NO: 2518368 - DNA, 20 bp, Homo sapiens
ctggcccagccctgctggcc

SEQ ID NO: 2518369 - DNA, 14 bp, Homo sapiens
ctggcccagccggc

SEQ ID NO: 2518370 - DNA, 17 bp, Homo sapiens
ctggcccagcggcccct

SEQ ID NO: 2518371 - DNA, 18 bp, Homo sapiens
ctggcccagcggcccctc

SEQ ID NO: 2518372 - DNA, 18 bp, Homo sapiens
ctggcccctagaatcagc

SEQ ID NO: 2518373 - DNA, 13 bp, Homo sapiens
ctggcccctcacc

SEQ ID NO: 2518374 - DNA, 15 bp, Homo sapiens
ctggcccctcacctg

SEQ ID NO: 2518375 - DNA, 13 bp, Homo sapiens
ctggcccctcagg

SEQ ID NO: 2518376 - DNA, 17 bp, Homo sapiens
ctggcccctcagggtcc

SEQ ID NO: 2518377 - DNA, 18 bp, Homo sapiens
ctggcccctcagggtccc

SEQ ID NO: 2518378 - DNA, 22 bp, Homo sapiens
ctggcccctcagggtccctggt

SEQ ID NO: 2518379 - DNA, 12 bp, Homo sapiens
ctggcccctggg

SEQ ID NO: 2518380 - DNA, 21 bp, Homo sapiens
ctggcccgtcatgttcctcaa

SEQ ID NO: 2518381 - DNA, 15 bp, Homo sapiens
ctggcccgtgacaga

SEQ ID NO: 2518382 - DNA, 19 bp, Homo sapiens
ctggccgagggtcctggct

SEQ ID NO: 2518383 - DNA, 13 bp, Homo sapiens
ctggccgccccct

SEQ ID NO: 2518384 - DNA, 14 bp, Homo sapiens
ctggccgccccctg

SEQ ID NO: 2518385 - DNA, 22 bp, Homo sapiens
ctggccgggaccccgagcctgg

SEQ ID NO: 2518386 - DNA, 19 bp, Homo sapiens
ctggccgtcacttgtgggg

SEQ ID NO: 2518387 - DNA, 17 bp, Homo sapiens
ctggcctagcatacgta

SEQ ID NO: 2518388 - DNA, 23 bp, Homo sapiens
ctggcctagcatacgtacacatt

SEQ ID NO: 2518389 - DNA, 17 bp, Homo sapiens
ctggcctagtcccttcc

SEQ ID NO: 2518390 - DNA, 23 bp, Homo sapiens
ctggcctcaagtgattctcctgc

SEQ ID NO: 2518391 - DNA, 13 bp, Homo sapiens
ctggcctccacag

SEQ ID NO: 2518392 - DNA, 13 bp, Homo sapiens
ctggcctcccaca

SEQ ID NO: 2518393 - DNA, 14 bp, Homo sapiens
ctggcctcccacag

SEQ ID NO: 2518394 - DNA, 19 bp, Homo sapiens
ctggcctcccacagactca

SEQ ID NO: 2518395 - DNA, 17 bp, Homo sapiens
ctggcctcccacccgat

SEQ ID NO: 2518396 - DNA, 17 bp, Homo sapiens
ctggcctctggctctca

SEQ ID NO: 2518397 - DNA, 13 bp, Homo sapiens
ctggcctgagctg

SEQ ID NO: 2518398 - DNA, 14 bp, Homo sapiens
ctggcctggatctc

SEQ ID NO: 2518399 - DNA, 21 bp, Homo sapiens
ctggcctggatctccccactc

SEQ ID NO: 2518400 - DNA, 13 bp, Homo sapiens
ctggcctggcaca

SEQ ID NO: 2518401 - DNA, 13 bp, Homo sapiens
ctggcctggcccc

SEQ ID NO: 2518402 - DNA, 17 bp, Homo sapiens
ctggcctggcttctcct

SEQ ID NO: 2518403 - DNA, 14 bp, Homo sapiens
ctggcctgtgtcta

SEQ ID NO: 2518404 - DNA, 20 bp, Homo sapiens
ctggcgacagttttccttct

SEQ ID NO: 2518405 - DNA, 15 bp, Homo sapiens
ctggcgcagccaagg

SEQ ID NO: 2518406 - DNA, 16 bp, Homo sapiens
ctggcgcagccaaggc

SEQ ID NO: 2518407 - DNA, 19 bp, Homo sapiens
ctggcgcagccaaggccga

SEQ ID NO: 2518408 - DNA, 12 bp, Homo sapiens
ctggcgcctctg

SEQ ID NO: 2518409 - DNA, 13 bp, Homo sapiens
ctggcgcctctgc

SEQ ID NO: 2518410 - DNA, 15 bp, Homo sapiens
ctggcgcctctgcaa

SEQ ID NO: 2518411 - DNA, 20 bp, Homo sapiens
ctggcgcctctgcaagggca

SEQ ID NO: 2518412 - DNA, 19 bp, Homo sapiens
ctggcgtcatgcaaagtca

SEQ ID NO: 2518413 - DNA, 15 bp, Homo sapiens
ctggcgtctgtcttc

SEQ ID NO: 2518414 - DNA, 14 bp, Homo sapiens
ctggcgtgcagtgg

SEQ ID NO: 2518415 - DNA, 21 bp, Homo sapiens
ctggctagaggccagccccac

SEQ ID NO: 2518416 - DNA, 23 bp, Homo sapiens
ctggctagaggccagccccaccc

SEQ ID NO: 2518417 - DNA, 22 bp, Homo sapiens
ctggctagagtcctcactccca

SEQ ID NO: 2518418 - DNA, 22 bp, Homo sapiens
ctggctatgcatttgaaaattt

SEQ ID NO: 2518419 - DNA, 13 bp, Homo sapiens
ctggctcatctct

SEQ ID NO: 2518420 - DNA, 17 bp, Homo sapiens
ctggctcccacaggcag

SEQ ID NO: 2518421 - DNA, 22 bp, Homo sapiens
ctggctccctcttggtcttccc

SEQ ID NO: 2518422 - DNA, 23 bp, Homo sapiens
ctggctccctcttggtcttccca

SEQ ID NO: 2518423 - DNA, 15 bp, Homo sapiens
ctggctcctgagggg

SEQ ID NO: 2518424 - DNA, 14 bp, Homo sapiens
ctggctctccaagt

SEQ ID NO: 2518425 - DNA, 23 bp, Homo sapiens
ctggctctccaagtgccagaggt

SEQ ID NO: 2518426 - DNA, 18 bp, Homo sapiens
ctggctctgcaatgggca

SEQ ID NO: 2518427 - DNA, 13 bp, Homo sapiens
ctggctcttccag

SEQ ID NO: 2518428 - DNA, 14 bp, Homo sapiens
ctggctcttccagg

SEQ ID NO: 2518429 - DNA, 19 bp, Homo sapiens
ctggctcttccaggctggg

SEQ ID NO: 2518430 - DNA, 20 bp, Homo sapiens
ctggctcttccaggctggga

SEQ ID NO: 2518431 - DNA, 21 bp, Homo sapiens
ctggctcttccaggctgggag

SEQ ID NO: 2518432 - DNA, 23 bp, Homo sapiens
ctggctcttgatacccccctctg

SEQ ID NO: 2518433 - DNA, 16 bp, Homo sapiens
ctggctgaaccctgtg

SEQ ID NO: 2518434 - DNA, 13 bp, Homo sapiens
ctggctgaaggac

SEQ ID NO: 2518435 - DNA, 16 bp, Homo sapiens
ctggctgaaggactgt

SEQ ID NO: 2518436 - DNA, 17 bp, Homo sapiens
ctggctgaaggactgtg

SEQ ID NO: 2518437 - DNA, 19 bp, Homo sapiens
ctggctgaccccaaagagc

SEQ ID NO: 2518438 - DNA, 18 bp, Homo sapiens
ctggctgcccagacccct

SEQ ID NO: 2518439 - DNA, 18 bp, Homo sapiens
ctggctgccccaacctgc

SEQ ID NO: 2518440 - DNA, 20 bp, Homo sapiens
ctggctgccccaacctgctg

SEQ ID NO: 2518441 - DNA, 13 bp, Homo sapiens
ctggctgccctgg

SEQ ID NO: 2518442 - DNA, 14 bp, Homo sapiens
ctggctgccctggc

SEQ ID NO: 2518443 - DNA, 18 bp, Homo sapiens
ctggctggagcctagaac

SEQ ID NO: 2518444 - DNA, 17 bp, Homo sapiens
ctggctgggcatggacg

SEQ ID NO: 2518445 - DNA, 20 bp, Homo sapiens
ctggctgtgttctggtgagg

SEQ ID NO: 2518446 - DNA, 17 bp, Homo sapiens
ctggctgttggctgggg

SEQ ID NO: 2518447 - DNA, 18 bp, Homo sapiens
ctggctgttggctggggg

SEQ ID NO: 2518448 - DNA, 19 bp, Homo sapiens
ctggctgttggctgggggc

SEQ ID NO: 2518449 - DNA, 20 bp, Homo sapiens
ctggctgttggctgggggcc

SEQ ID NO: 2518450 - DNA, 16 bp, Homo sapiens
ctggcttccaggtatc

SEQ ID NO: 2518451 - DNA, 18 bp, Homo sapiens
ctggcttccttctctcaa

SEQ ID NO: 2518452 - DNA, 16 bp, Homo sapiens
ctggcttcgcaaaatg

SEQ ID NO: 2518453 - DNA, 14 bp, Homo sapiens
ctggcttctggagc

SEQ ID NO: 2518454 - DNA, 16 bp, Homo sapiens
ctggcttctggagccc

SEQ ID NO: 2518455 - DNA, 15 bp, Homo sapiens
ctggctttctccgac

SEQ ID NO: 2518456 - DNA, 22 bp, Homo sapiens
ctggctttctccgactgctagg

SEQ ID NO: 2518457 - DNA, 15 bp, Homo sapiens
ctgggaaacagaggc

SEQ ID NO: 2518458 - DNA, 17 bp, Homo sapiens
ctgggaaataagagaga

SEQ ID NO: 2518459 - DNA, 16 bp, Homo sapiens
ctgggaaatattccct

SEQ ID NO: 2518460 - DNA, 21 bp, Homo sapiens
ctgggaaatgagaaggcagcc

SEQ ID NO: 2518461 - DNA, 22 bp, Homo sapiens
ctgggaacccaagtccaagcat

SEQ ID NO: 2518462 - DNA, 17 bp, Homo sapiens
ctgggaactcacctggg

SEQ ID NO: 2518463 - DNA, 19 bp, Homo sapiens
ctgggaactgcagacctgt

SEQ ID NO: 2518464 - DNA, 20 bp, Homo sapiens
ctgggaactgcagacctgtc

SEQ ID NO: 2518465 - DNA, 17 bp, Homo sapiens
ctgggaagataggctct

SEQ ID NO: 2518466 - DNA, 18 bp, Homo sapiens
ctgggaagataggctctg

SEQ ID NO: 2518467 - DNA, 21 bp, Homo sapiens
ctgggaagataggctctgcac

SEQ ID NO: 2518468 - DNA, 20 bp, Homo sapiens
ctggtctctaggctggggaa

SEQ ID NO: 2518469 - DNA, 12 bp, Homo sapiens
ctggtctgaggg

SEQ ID NO: 2518470 - DNA, 16 bp, Homo sapiens
ctggtctgggtgcccc

SEQ ID NO: 2518471 - DNA, 22 bp, Homo sapiens
ctggtctgtagaagagggataa

SEQ ID NO: 2518472 - DNA, 18 bp, Homo sapiens
ctggtcttatttgtaaag

SEQ ID NO: 2518473 - DNA, 14 bp, Homo sapiens
ctggtcttgagatg

SEQ ID NO: 2518474 - DNA, 18 bp, Homo sapiens
ctggtcttgtggaattgg

SEQ ID NO: 2518475 - DNA, 17 bp, Homo sapiens
ctggtgacaccagcctt

SEQ ID NO: 2518476 - DNA, 22 bp, Homo sapiens
ctggtgacatgtcttttcttgc

SEQ ID NO: 2518477 - DNA, 22 bp, Homo sapiens
ctggtgactgcgatcttcagag

SEQ ID NO: 2518478 - DNA, 20 bp, Homo sapiens
ctggtgactttcctctttgg

SEQ ID NO: 2518479 - DNA, 23 bp, Homo sapiens
ctggtgactttcctctttggtct

SEQ ID NO: 2518480 - DNA, 16 bp, Homo sapiens
ctggtgaggccttgct

SEQ ID NO: 2518481 - DNA, 15 bp, Homo sapiens
ctggtgcattacaga

SEQ ID NO: 2518482 - DNA, 17 bp, Homo sapiens
ctggtgcattacagaga

SEQ ID NO: 2518483 - DNA, 15 bp, Homo sapiens
ctggtgccaatttca

SEQ ID NO: 2518484 - DNA, 16 bp, Homo sapiens
ctggtgccaatttcaa

SEQ ID NO: 2518485 - DNA, 18 bp, Homo sapiens
ctggtgccaatttcaagt

SEQ ID NO: 2518486 - DNA, 13 bp, Homo sapiens
ctggtgccagcct

SEQ ID NO: 2518487 - DNA, 20 bp, Homo sapiens
ctggtgccctaacctctgag

SEQ ID NO: 2518488 - DNA, 23 bp, Homo sapiens
ctggtgccctaacctctgagtca

SEQ ID NO: 2518489 - DNA, 19 bp, Homo sapiens
ctggtgctgcctctacctg

SEQ ID NO: 2518490 - DNA, 16 bp, Homo sapiens
ctggtgctgtggccag

SEQ ID NO: 2518491 - DNA, 18 bp, Homo sapiens
ctggtgctgtggccaggg

SEQ ID NO: 2518492 - DNA, 17 bp, Homo sapiens
ctggtggacagtcctgg

SEQ ID NO: 2518493 - DNA, 15 bp, Homo sapiens
ctggtggagaaagca

SEQ ID NO: 2518494 - DNA, 21 bp, Homo sapiens
ctggtggagaaagcactgacc

SEQ ID NO: 2518495 - DNA, 23 bp, Homo sapiens
ctggtggcagctcacctctccct

SEQ ID NO: 2518496 - DNA, 18 bp, Homo sapiens
ctggtggcagtgggagct

SEQ ID NO: 2518497 - DNA, 23 bp, Homo sapiens
ctggtggcagtgggagctgcctg

SEQ ID NO: 2518498 - DNA, 15 bp, Homo sapiens
ctggtggctcccgga

SEQ ID NO: 2518499 - DNA, 18 bp, Homo sapiens
ctggtggtttcacggtgc

SEQ ID NO: 2518500 - DNA, 16 bp, Homo sapiens
ctggtgtcctgaccac

SEQ ID NO: 2518501 - DNA, 19 bp, Homo sapiens
ctggtgtcctgaccaccct

SEQ ID NO: 2518502 - DNA, 22 bp, Homo sapiens
ctggtgtcctgaccaccctccc

SEQ ID NO: 2518503 - DNA, 17 bp, Homo sapiens
ctggtgtgaactaaact

SEQ ID NO: 2518504 - DNA, 22 bp, Homo sapiens
ctggtgtttctagcactggcct

SEQ ID NO: 2518505 - DNA, 20 bp, Homo sapiens
ctggttaacttgtttggcct

SEQ ID NO: 2518506 - DNA, 21 bp, Homo sapiens
ctggttagaggttccctttga

SEQ ID NO: 2518507 - DNA, 17 bp, Homo sapiens
ctggttctatttaatgg

SEQ ID NO: 2518508 - DNA, 13 bp, Homo sapiens
ctggttgctgtgt

SEQ ID NO: 2518509 - DNA, 21 bp, Homo sapiens
ctggttggtgttgcagaaggt

SEQ ID NO: 2518510 - DNA, 13 bp, Homo sapiens
ctggttttaacaa

SEQ ID NO: 2518511 - DNA, 18 bp, Homo sapiens
ctggttttcctaaatgca

SEQ ID NO: 2518512 - DNA, 13 bp, Homo sapiens
ctggttttgctat

SEQ ID NO: 2518513 - DNA, 13 bp, Homo sapiens
ctggttttgtaag

SEQ ID NO: 2518514 - DNA, 19 bp, Homo sapiens
ctggttttgtaagatgctg

SEQ ID NO: 2518515 - DNA, 15 bp, Homo sapiens
ctggtttttcagttt

SEQ ID NO: 2518516 - DNA, 16 bp, Homo sapiens
ctggtttttcagtttt

SEQ ID NO: 2518517 - DNA, 17 bp, Homo sapiens
ctgtaaaataaaaggtc

SEQ ID NO: 2518518 - DNA, 13 bp, Homo sapiens
ctgtaaagaaaga

SEQ ID NO: 2518519 - DNA, 14 bp, Homo sapiens
ctgtaaagaaagag

SEQ ID NO: 2518520 - DNA, 16 bp, Homo sapiens
ctgtaaagaaagagag

SEQ ID NO: 2518521 - DNA, 20 bp, Homo sapiens
ctgtaaagaaagagagaaaa

SEQ ID NO: 2518522 - DNA, 21 bp, Homo sapiens
ctgtaaatggtgtacataatg

SEQ ID NO: 2518523 - DNA, 15 bp, Homo sapiens
ctgtaacacagctga

SEQ ID NO: 2518524 - DNA, 19 bp, Homo sapiens
ctgtaacctcttcagaggc

SEQ ID NO: 2518525 - DNA, 20 bp, Homo sapiens
ctgtaacctcttcagaggcc

SEQ ID NO: 2518526 - DNA, 16 bp, Homo sapiens
ctgtaatcccagcact

SEQ ID NO: 2518527 - DNA, 17 bp, Homo sapiens
ctgtaatcccagcactt

SEQ ID NO: 2518528 - DNA, 22 bp, Homo sapiens
ctgtaatcccagctactcggga

SEQ ID NO: 2518529 - DNA, 22 bp, Homo sapiens
ctgtaatctcgtttcaaaaaca

SEQ ID NO: 2518530 - DNA, 21 bp, Homo sapiens
ctgtaatgaaacaccttctct

SEQ ID NO: 2518531 - DNA, 19 bp, Homo sapiens
ctgtaatttagttattgat

SEQ ID NO: 2518532 - DNA, 15 bp, Homo sapiens
ctgtaatttgtgata

SEQ ID NO: 2518533 - DNA, 22 bp, Homo sapiens
ctgtaatttgtgatacaatgct

SEQ ID NO: 2518534 - DNA, 13 bp, Homo sapiens
ctgtacaaagtag

SEQ ID NO: 2518535 - DNA, 16 bp, Homo sapiens
ctgtacaatatttaaa

SEQ ID NO: 2518536 - DNA, 15 bp, Homo sapiens
ctgtacagagcccac

SEQ ID NO: 2518537 - DNA, 15 bp, Homo sapiens
ctgtacatagcctat

SEQ ID NO: 2518538 - DNA, 17 bp, Homo sapiens
ctgtacatgaaaacaca

SEQ ID NO: 2518539 - DNA, 14 bp, Homo sapiens
ctgtacctctgcct

SEQ ID NO: 2518540 - DNA, 22 bp, Homo sapiens
ctgtaccttttgaggagcccca

SEQ ID NO: 2518541 - DNA, 14 bp, Homo sapiens
ctgtacgtctgaca

SEQ ID NO: 2518542 - DNA, 15 bp, Homo sapiens
ctgtacgtctgacag

SEQ ID NO: 2518543 - DNA, 17 bp, Homo sapiens
ctgtactagagatctgg

SEQ ID NO: 2518544 - DNA, 17 bp, Homo sapiens
ctgtacttgatgacaga

SEQ ID NO: 2518545 - DNA, 19 bp, Homo sapiens
ctgtagaaaagggaactga

SEQ ID NO: 2518546 - DNA, 15 bp, Homo sapiens
ctgtagattctgtgg

SEQ ID NO: 2518547 - DNA, 15 bp, Homo sapiens
ctgtagcatcttctg

SEQ ID NO: 2518548 - DNA, 20 bp, Homo sapiens
ctgtagcatcttctggagtc

SEQ ID NO: 2518549 - DNA, 17 bp, Homo sapiens
ctgtagcattacagtgg

SEQ ID NO: 2518550 - DNA, 20 bp, Homo sapiens
ctgtagtaaactatttatct

SEQ ID NO: 2518551 - DNA, 12 bp, Homo sapiens
ctgtagtcccag

SEQ ID NO: 2518552 - DNA, 17 bp, Homo sapiens
ctgtagtcccagccact

SEQ ID NO: 2518553 - DNA, 14 bp, Homo sapiens
ctgtagtcccagct

SEQ ID NO: 2518554 - DNA, 15 bp, Homo sapiens
ctgtagtcccagcta

SEQ ID NO: 2518555 - DNA, 20 bp, Homo sapiens
ctgtagtcctagccactcag

SEQ ID NO: 2518556 - DNA, 20 bp, Homo sapiens
ctgtagtctcaggacctagg

SEQ ID NO: 2518557 - DNA, 22 bp, Homo sapiens
ctgtagtgagatagcattgtga

SEQ ID NO: 2518558 - DNA, 21 bp, Homo sapiens
ctgtagttaggaaataaaacc

SEQ ID NO: 2518559 - DNA, 13 bp, Homo sapiens
ctgtataaatagg

SEQ ID NO: 2518560 - DNA, 18 bp, Homo sapiens
ctgtatataaaatatttt

SEQ ID NO: 2518561 - DNA, 23 bp, Homo sapiens
ctgtatatacaataacataattt

SEQ ID NO: 2518562 - DNA, 16 bp, Homo sapiens
ctgtatcaggacccag

SEQ ID NO: 2518563 - DNA, 20 bp, Homo sapiens
ctgtatcccatgagcctcag

SEQ ID NO: 2518564 - DNA, 22 bp, Homo sapiens
ctgtatcccatgagcctcagca

SEQ ID NO: 2518565 - DNA, 22 bp, Homo sapiens
ctgtatcttgggggacagggct

SEQ ID NO: 2518566 - DNA, 18 bp, Homo sapiens
ctgtatgttgtccaattg

SEQ ID NO: 2518567 - DNA, 17 bp, Homo sapiens
ctgtattagtcacagag

SEQ ID NO: 2518568 - DNA, 12 bp, Homo sapiens
ctgtattgaatc

SEQ ID NO: 2518569 - DNA, 14 bp, Homo sapiens
ctgtattgaatcat

SEQ ID NO: 2518570 - DNA, 17 bp, Homo sapiens
ctgtattgaatcatgta

SEQ ID NO: 2518571 - DNA, 15 bp, Homo sapiens
ctgtatttaattttg

SEQ ID NO: 2518572 - DNA, 16 bp, Homo sapiens
ctgtatttgagaatat

SEQ ID NO: 2518573 - DNA, 12 bp, Homo sapiens
ctgtatttgtga

SEQ ID NO: 2518574 - DNA, 14 bp, Homo sapiens
ctgtatttgtgact

SEQ ID NO: 2518575 - DNA, 17 bp, Homo sapiens
ctgtatttgtgactaat

SEQ ID NO: 2518576 - DNA, 20 bp, Homo sapiens
ctgtatttgtgactaattgt

SEQ ID NO: 2518577 - DNA, 23 bp, Homo sapiens
ctgtatttgtgactaattgtata

SEQ ID NO: 2518578 - DNA, 20 bp, Homo sapiens
ctgtattttgtttttgtctt

SEQ ID NO: 2518579 - DNA, 14 bp, Homo sapiens
ctgtcaaacaaagc

SEQ ID NO: 2518580 - DNA, 18 bp, Homo sapiens
ctgtcaaacaaagccaga

SEQ ID NO: 2518581 - DNA, 19 bp, Homo sapiens
ctgtcaaacaaagccagaa

SEQ ID NO: 2518582 - DNA, 22 bp, Homo sapiens
ctgtcaaacaaagccagaagct

SEQ ID NO: 2518583 - DNA, 21 bp, Homo sapiens
ctgtcaagtgggatctgtcac

SEQ ID NO: 2518584 - DNA, 19 bp, Homo sapiens
ctgtcaagttcctttgggt

SEQ ID NO: 2518585 - DNA, 13 bp, Homo sapiens
ctgtcacccaggc

SEQ ID NO: 2518586 - DNA, 18 bp, Homo sapiens
ctgtcaccctccacctct

SEQ ID NO: 2518587 - DNA, 14 bp, Homo sapiens
ctgtcactgtttct

SEQ ID NO: 2518588 - DNA, 19 bp, Homo sapiens
ctgtcactgtttctctgct

SEQ ID NO: 2518589 - DNA, 20 bp, Homo sapiens
ctgtcactgtttctctgctg

SEQ ID NO: 2518590 - DNA, 15 bp, Homo sapiens
ctgtcactttgctct

SEQ ID NO: 2518591 - DNA, 17 bp, Homo sapiens
ctgtcactttgctctgg

SEQ ID NO: 2518592 - DNA, 19 bp, Homo sapiens
ctgtcactttgctctgggt

SEQ ID NO: 2518593 - DNA, 16 bp, Homo sapiens
ctgtcagccgggccct

SEQ ID NO: 2518594 - DNA, 17 bp, Homo sapiens
ctgtcagccgggccctg

SEQ ID NO: 2518595 - DNA, 18 bp, Homo sapiens
ctgtcagccgggccctga

SEQ ID NO: 2518596 - DNA, 16 bp, Homo sapiens
ctgtcaggagagcagc

SEQ ID NO: 2518597 - DNA, 18 bp, Homo sapiens
ctgtcagtgcagcccgtg

SEQ ID NO: 2518598 - DNA, 16 bp, Homo sapiens
ctgtcatagaaattac

SEQ ID NO: 2518599 - DNA, 19 bp, Homo sapiens
ctgtcatgaacatgttcct

SEQ ID NO: 2518600 - DNA, 13 bp, Homo sapiens
ctgtcatgccccc

SEQ ID NO: 2518601 - DNA, 21 bp, Homo sapiens
ctgtcatttgagcagggctca

SEQ ID NO: 2518602 - DNA, 18 bp, Homo sapiens
ctgtccaaaggaggctgg

SEQ ID NO: 2518603 - DNA, 20 bp, Homo sapiens
ctgtccaaaggaggctggca

SEQ ID NO: 2518604 - DNA, 21 bp, Homo sapiens
ctgtccaaaggaggctggcag

SEQ ID NO: 2518605 - DNA, 22 bp, Homo sapiens
ctgtccaaaggaggctggcagg

SEQ ID NO: 2518606 - DNA, 15 bp, Homo sapiens
ctgtccagcctgggc

SEQ ID NO: 2518607 - DNA, 17 bp, Homo sapiens
ctgtccagcctgggcag

SEQ ID NO: 2518608 - DNA, 16 bp, Homo sapiens
ctgtccaggcactgag

SEQ ID NO: 2518609 - DNA, 22 bp, Homo sapiens
ctgtccaggcactgctgcccag

SEQ ID NO: 2518610 - DNA, 14 bp, Homo sapiens
ctgtccagtgggta

SEQ ID NO: 2518611 - DNA, 16 bp, Homo sapiens
ctgtccagttcccaga

SEQ ID NO: 2518612 - DNA, 19 bp, Homo sapiens
ctgtcccaccatgcagtgc

SEQ ID NO: 2518613 - DNA, 16 bp, Homo sapiens
ctgtcccacccccacc

SEQ ID NO: 2518614 - DNA, 14 bp, Homo sapiens
ctgtcccacctctt

SEQ ID NO: 2518615 - DNA, 23 bp, Homo sapiens
ctgtcccacctcttctcttcctg

SEQ ID NO: 2518616 - DNA, 22 bp, Homo sapiens
ctgtcccaggttatctgggcat

SEQ ID NO: 2518617 - DNA, 16 bp, Homo sapiens
ctgtcccccagctctg

SEQ ID NO: 2518618 - DNA, 17 bp, Homo sapiens
gacgctccctgctccac

SEQ ID NO: 2518619 - DNA, 16 bp, Homo sapiens
gacgctgaataaatgt

SEQ ID NO: 2518620 - DNA, 13 bp, Homo sapiens
gacgctgtgctgc

SEQ ID NO: 2518621 - DNA, 16 bp, Homo sapiens
gacgctgtgctgccct

SEQ ID NO: 2518622 - DNA, 17 bp, Homo sapiens
gacgctgtgctgccctg

SEQ ID NO: 2518623 - DNA, 18 bp, Homo sapiens
gacgctgtgctgccctgc

SEQ ID NO: 2518624 - DNA, 14 bp, Homo sapiens
gacggagtcccacc

SEQ ID NO: 2518625 - DNA, 18 bp, Homo sapiens
gacggagtcccaccttgg

SEQ ID NO: 2518626 - DNA, 22 bp, Homo sapiens
gacggcctgatgctccctcccc

SEQ ID NO: 2518627 - DNA, 12 bp, Homo sapiens
gacggctgggca

SEQ ID NO: 2518628 - DNA, 23 bp, Homo sapiens
gacggggggccccagtcagcctc

SEQ ID NO: 2518629 - DNA, 15 bp, Homo sapiens
gacggttcaccagcc

SEQ ID NO: 2518630 - DNA, 21 bp, Homo sapiens
gacgtacgtatcagcggcccc

SEQ ID NO: 2518631 - DNA, 18 bp, Homo sapiens
gacgtcaagtctccttcc

SEQ ID NO: 2518632 - DNA, 15 bp, Homo sapiens
gacgtccctgcccat

SEQ ID NO: 2518633 - DNA, 22 bp, Homo sapiens
gacgtgccttttgcacccctcc

SEQ ID NO: 2518634 - DNA, 15 bp, Homo sapiens
gacgttccagccggc

SEQ ID NO: 2518635 - DNA, 22 bp, Homo sapiens
gacgttccagccggcatggctg

SEQ ID NO: 2518636 - DNA, 13 bp, Homo sapiens
gactaaagagaga

SEQ ID NO: 2518637 - DNA, 17 bp, Homo sapiens
gactaaagagagaatgt

SEQ ID NO: 2518638 - DNA, 18 bp, Homo sapiens
gactaaagagagaatgta

SEQ ID NO: 2518639 - DNA, 23 bp, Homo sapiens
gactaagccctgtcgagacactt

SEQ ID NO: 2518640 - DNA, 15 bp, Homo sapiens
gactaagcctacctg

SEQ ID NO: 2518641 - DNA, 15 bp, Homo sapiens
gactaattgtataac

SEQ ID NO: 2518642 - DNA, 19 bp, Homo sapiens
gactaattgtataacaggt

SEQ ID NO: 2518643 - DNA, 22 bp, Homo sapiens
gactaattgtataacaggttat

SEQ ID NO: 2518644 - DNA, 15 bp, Homo sapiens
gactacaggcaccca

SEQ ID NO: 2518645 - DNA, 22 bp, Homo sapiens
gactacccacgttctcacaccc

SEQ ID NO: 2518646 - DNA, 17 bp, Homo sapiens
gactagaggcagggagg

SEQ ID NO: 2518647 - DNA, 17 bp, Homo sapiens
gactagagggacctctc

SEQ ID NO: 2518648 - DNA, 14 bp, Homo sapiens
gactaggagcactg

SEQ ID NO: 2518649 - DNA, 19 bp, Homo sapiens
gactagggattcaggctgc

SEQ ID NO: 2518650 - DNA, 20 bp, Homo sapiens
gactagggattcaggctgct

SEQ ID NO: 2518651 - DNA, 18 bp, Homo sapiens
gactagtgaggaaagatt

SEQ ID NO: 2518652 - DNA, 20 bp, Homo sapiens
gactatatagagatgttttt

SEQ ID NO: 2518653 - DNA, 23 bp, Homo sapiens
gactatatagagatgtttttaaa

SEQ ID NO: 2518654 - DNA, 22 bp, Homo sapiens
gactatcaaactgaagccagaa

SEQ ID NO: 2518655 - DNA, 13 bp, Homo sapiens
gactatcagccca

SEQ ID NO: 2518656 - DNA, 20 bp, Homo sapiens
gactatgaacttctctcaga

SEQ ID NO: 2518657 - DNA, 16 bp, Homo sapiens
gactatgaatgggcaa

SEQ ID NO: 2518658 - DNA, 15 bp, Homo sapiens
gactatggagctgag

SEQ ID NO: 2518659 - DNA, 22 bp, Homo sapiens
gactcaaaacccatctgggctc

SEQ ID NO: 2518660 - DNA, 22 bp, Homo sapiens
gactcaacatgttactgaccag

SEQ ID NO: 2518661 - DNA, 14 bp, Homo sapiens
gactcaatgcactg

SEQ ID NO: 2518662 - DNA, 16 bp, Homo sapiens
gactcaatttctcccc

SEQ ID NO: 2518663 - DNA, 15 bp, Homo sapiens
gactcacaagaagac

SEQ ID NO: 2518664 - DNA, 17 bp, Homo sapiens
gactcaggatgcccagg

SEQ ID NO: 2518665 - DNA, 21 bp, Homo sapiens
gactcagggccatgcctgccc

SEQ ID NO: 2518666 - DNA, 14 bp, Homo sapiens
gactcagggcccca

SEQ ID NO: 2518667 - DNA, 15 bp, Homo sapiens
gactcagggccccag

SEQ ID NO: 2518668 - DNA, 19 bp, Homo sapiens
gactcagggctcctgggtt

SEQ ID NO: 2518669 - DNA, 21 bp, Homo sapiens
gactcatatcccctatttaac

SEQ ID NO: 2518670 - DNA, 17 bp, Homo sapiens
gactcattctgaaggag

SEQ ID NO: 2518671 - DNA, 14 bp, Homo sapiens
gactcattcttctg

SEQ ID NO: 2518672 - DNA, 18 bp, Homo sapiens
gactccaaagaaatgtaa

SEQ ID NO: 2518673 - DNA, 14 bp, Homo sapiens
gactccacccatcc

SEQ ID NO: 2518674 - DNA, 12 bp, Homo sapiens
gactccaggaga

SEQ ID NO: 2518675 - DNA, 23 bp, Homo sapiens
gactccatgagaagccgtgggtg

SEQ ID NO: 2518676 - DNA, 23 bp, Homo sapiens
gactccctcctcacctctggact

SEQ ID NO: 2518677 - DNA, 22 bp, Homo sapiens
gactcccttaaaatagaaataa

SEQ ID NO: 2518678 - DNA, 15 bp, Homo sapiens
gactccggccctcct

SEQ ID NO: 2518679 - DNA, 15 bp, Homo sapiens
gactcctatgatctc

SEQ ID NO: 2518680 - DNA, 18 bp, Homo sapiens
gactcctgaggacagctg

SEQ ID NO: 2518681 - DNA, 19 bp, Homo sapiens
gactcctgaggacagctgt

SEQ ID NO: 2518682 - DNA, 20 bp, Homo sapiens
gactcctgaggacagctgtc

SEQ ID NO: 2518683 - DNA, 20 bp, Homo sapiens
gactcctgcaggcagccagg

SEQ ID NO: 2518684 - DNA, 11 bp, Homo sapiens
gactcctgggt

SEQ ID NO: 2518685 - DNA, 17 bp, Homo sapiens
gactcctgggttgagct

SEQ ID NO: 2518686 - DNA, 16 bp, Homo sapiens
gactctacactgtgaa

SEQ ID NO: 2518687 - DNA, 14 bp, Homo sapiens
gactctaccagact

SEQ ID NO: 2518688 - DNA, 20 bp, Homo sapiens
gactctaccagactgtgtat

SEQ ID NO: 2518689 - DNA, 17 bp, Homo sapiens
gactctaggtgcccttg

SEQ ID NO: 2518690 - DNA, 19 bp, Homo sapiens
gactctaggtgcccttgga

SEQ ID NO: 2518691 - DNA, 16 bp, Homo sapiens
gactctcagtctctga

SEQ ID NO: 2518692 - DNA, 14 bp, Homo sapiens
gactctctgtgacc

SEQ ID NO: 2518693 - DNA, 15 bp, Homo sapiens
gactctctgtgacct

SEQ ID NO: 2518694 - DNA, 19 bp, Homo sapiens
gactctgcacatgtcttgt

SEQ ID NO: 2518695 - DNA, 21 bp, Homo sapiens
gactctgccccctgctggctc

SEQ ID NO: 2518696 - DNA, 12 bp, Homo sapiens
gactctgcctcc

SEQ ID NO: 2518697 - DNA, 13 bp, Homo sapiens
gactctggcctcc

SEQ ID NO: 2518698 - DNA, 15 bp, Homo sapiens
gactctggcctccac

SEQ ID NO: 2518699 - DNA, 16 bp, Homo sapiens
gactctggggactccg

SEQ ID NO: 2518700 - DNA, 12 bp, Homo sapiens
gactctgtctca

SEQ ID NO: 2518701 - DNA, 18 bp, Homo sapiens
gactctgtggggccttgg

SEQ ID NO: 2518702 - DNA, 17 bp, Homo sapiens
gactcttttgccattaa

SEQ ID NO: 2518703 - DNA, 21 bp, Homo sapiens
gactgaccaatattgtacagt

SEQ ID NO: 2518704 - DNA, 16 bp, Homo sapiens
gactgagcacctgctt

SEQ ID NO: 2518705 - DNA, 21 bp, Homo sapiens
gactgagggactctgaagcct

SEQ ID NO: 2518706 - DNA, 14 bp, Homo sapiens
gactgatgctttca

SEQ ID NO: 2518707 - DNA, 15 bp, Homo sapiens
gactgcacagcggcc

SEQ ID NO: 2518708 - DNA, 18 bp, Homo sapiens
gactgcacagcggcccct

SEQ ID NO: 2518709 - DNA, 21 bp, Homo sapiens
gactgcacagcgtcctgtcca

SEQ ID NO: 2518710 - DNA, 19 bp, Homo sapiens
gactgccgaccgaggctgg

SEQ ID NO: 2518711 - DNA, 20 bp, Homo sapiens
gactgccgaccgaggctgga

SEQ ID NO: 2518712 - DNA, 15 bp, Homo sapiens
gactgctccccagcc

SEQ ID NO: 2518713 - DNA, 24 bp, Homo sapiens
gactgctccccagccctggctctg

SEQ ID NO: 2518714 - DNA, 12 bp, Homo sapiens
gactgctgggac

SEQ ID NO: 2518715 - DNA, 12 bp, Homo sapiens
gactgcttccca

SEQ ID NO: 2518716 - DNA, 15 bp, Homo sapiens
gactgcttcccatcc

SEQ ID NO: 2518717 - DNA, 16 bp, Homo sapiens
gactgcttcccatcct

SEQ ID NO: 2518718 - DNA, 15 bp, Homo sapiens
gactggatactgccc

SEQ ID NO: 2518719 - DNA, 14 bp, Homo sapiens
gactggcacagttt

SEQ ID NO: 2518720 - DNA, 14 bp, Homo sapiens
gactggctggctgc

SEQ ID NO: 2518721 - DNA, 22 bp, Homo sapiens
gactgggaagataggctctgca

SEQ ID NO: 2518722 - DNA, 16 bp, Homo sapiens
gactgggctgagggag

SEQ ID NO: 2518723 - DNA, 21 bp, Homo sapiens
gactgggctgagggagcctgg

SEQ ID NO: 2518724 - DNA, 21 bp, Homo sapiens
gactgggtttggaccccagct

SEQ ID NO: 2518725 - DNA, 22 bp, Homo sapiens
gactgggtttggaccccagctg

SEQ ID NO: 2518726 - DNA, 23 bp, Homo sapiens
gactgggtttggaccccagctgg

SEQ ID NO: 2518727 - DNA, 15 bp, Homo sapiens
gactggtcctgtgtg

SEQ ID NO: 2518728 - DNA, 23 bp, Homo sapiens
gactggtgctataggctggagaa

SEQ ID NO: 2518729 - DNA, 22 bp, Homo sapiens
gactggtgttatcaccgtgggc

SEQ ID NO: 2518730 - DNA, 22 bp, Homo sapiens
gactgtacaaagtagaagtctt

SEQ ID NO: 2518731 - DNA, 14 bp, Homo sapiens
gactgtatttgtga

SEQ ID NO: 2518732 - DNA, 16 bp, Homo sapiens
gactgtatttgtgact

SEQ ID NO: 2518733 - DNA, 13 bp, Homo sapiens
gactgtctttcag

SEQ ID NO: 2518734 - DNA, 20 bp, Homo sapiens
gactgtgacaggcagcagag

SEQ ID NO: 2518735 - DNA, 19 bp, Homo sapiens
gactgtgatgccacacaga

SEQ ID NO: 2518736 - DNA, 14 bp, Homo sapiens
gactgtggctgcta

SEQ ID NO: 2518737 - DNA, 14 bp, Homo sapiens
gactgttcaagagc

SEQ ID NO: 2518738 - DNA, 17 bp, Homo sapiens
gactgtttttacccata

SEQ ID NO: 2518739 - DNA, 19 bp, Homo sapiens
gacttaacggctccaggat

SEQ ID NO: 2518740 - DNA, 12 bp, Homo sapiens
gacttactgtac

SEQ ID NO: 2518741 - DNA, 18 bp, Homo sapiens
gacttactgtacatgaaa

SEQ ID NO: 2518742 - DNA, 17 bp, Homo sapiens
gacttagtatattttct

SEQ ID NO: 2518743 - DNA, 15 bp, Homo sapiens
gacttattttctctg

SEQ ID NO: 2518744 - DNA, 22 bp, Homo sapiens
gacttcacgaagtgttgcatgg

SEQ ID NO: 2518745 - DNA, 14 bp, Homo sapiens
gacttcagctctgt

SEQ ID NO: 2518746 - DNA, 14 bp, Homo sapiens
gacttccttgctct

SEQ ID NO: 2518747 - DNA, 17 bp, Homo sapiens
gacttccttgctctccc

SEQ ID NO: 2518748 - DNA, 18 bp, Homo sapiens
gacttccttgctctccct

SEQ ID NO: 2518749 - DNA, 18 bp, Homo sapiens
gacttcgactgtgacctg

SEQ ID NO: 2518750 - DNA, 16 bp, Homo sapiens
gacttctaagtaaaac

SEQ ID NO: 2518751 - DNA, 17 bp, Homo sapiens
gacttgaaagcatccat

SEQ ID NO: 2518752 - DNA, 16 bp, Homo sapiens
gacttgacagaacact

SEQ ID NO: 2518753 - DNA, 15 bp, Homo sapiens
gacttgcatcgtgga

SEQ ID NO: 2518754 - DNA, 19 bp, Homo sapiens
gacttgctgttttgttctg

SEQ ID NO: 2518755 - DNA, 20 bp, Homo sapiens
gacttgctgttttgttctgt

SEQ ID NO: 2518756 - DNA, 22 bp, Homo sapiens
gacttgctgttttgttctgtgg

SEQ ID NO: 2518757 - DNA, 21 bp, Homo sapiens
gacttggagggttggtcctct

SEQ ID NO: 2518758 - DNA, 20 bp, Homo sapiens
gacttgggtctcatttagaa

SEQ ID NO: 2518759 - DNA, 19 bp, Homo sapiens
gacttggtcaccagctcct

SEQ ID NO: 2518760 - DNA, 14 bp, Homo sapiens
gacttggtctgatt

SEQ ID NO: 2518761 - DNA, 16 bp, Homo sapiens
gacttgtatatttgta

SEQ ID NO: 2518762 - DNA, 13 bp, Homo sapiens
gactttagggact

SEQ ID NO: 2518763 - DNA, 21 bp, Homo sapiens
gactttatctaatacctctgt

SEQ ID NO: 2518764 - DNA, 22 bp, Homo sapiens
gactttatctaatacctctgtg

SEQ ID NO: 2518765 - DNA, 14 bp, Homo sapiens
gactttcaggtact

SEQ ID NO: 2518766 - DNA, 15 bp, Homo sapiens
gactttccaccccct

SEQ ID NO: 2518767 - DNA, 16 bp, Homo sapiens
gactttccaccccctc

SEQ ID NO: 2518768 - DNA, 18 bp, Homo sapiens
gactttcggagttggggg

SEQ ID NO: 2518769 - DNA, 16 bp, Homo sapiens
gactttggctgcatgc

SEQ ID NO: 2518770 - DNA, 22 bp, Homo sapiens
gactttgttagtttctccaagc

SEQ ID NO: 2518771 - DNA, 14 bp, Homo sapiens
gacttttccaaccc

SEQ ID NO: 2518772 - DNA, 16 bp, Homo sapiens
gactttttgcatttaa

SEQ ID NO: 2518773 - DNA, 19 bp, Homo sapiens
gagaaaaagctcctgtcct

SEQ ID NO: 2518774 - DNA, 11 bp, Homo sapiens
gagaaaagaaa

SEQ ID NO: 2518775 - DNA, 20 bp, Homo sapiens
gagaaaagaaaaaaaaagaa

SEQ ID NO: 2518776 - DNA, 13 bp, Homo sapiens
gagaaaagacatg

SEQ ID NO: 2518777 - DNA, 13 bp, Homo sapiens
gagaaaataaaaa

SEQ ID NO: 2518778 - DNA, 14 bp, Homo sapiens
gagaaaataaaaag

SEQ ID NO: 2518779 - DNA, 15 bp, Homo sapiens
gagaaaataaaaagt

SEQ ID NO: 2518780 - DNA, 18 bp, Homo sapiens
gagaaaataaaaagttaa

SEQ ID NO: 2518781 - DNA, 18 bp, Homo sapiens
gagaaagaagagacagga

SEQ ID NO: 2518782 - DNA, 17 bp, Homo sapiens
gagaaagactattcaaa

SEQ ID NO: 2518783 - DNA, 23 bp, Homo sapiens
gagaaagtacttctccaccctgc

SEQ ID NO: 2518784 - DNA, 20 bp, Homo sapiens
gagaaagtgatttctagaaa

SEQ ID NO: 2518785 - DNA, 14 bp, Homo sapiens
gagaaattgacaga

SEQ ID NO: 2518786 - DNA, 20 bp, Homo sapiens
gagaaccgagcaaagatcaa

SEQ ID NO: 2518787 - DNA, 23 bp, Homo sapiens
gagaaccgagcaaagatcaaaat

SEQ ID NO: 2518788 - DNA, 14 bp, Homo sapiens
gagaacgcagccct

SEQ ID NO: 2518789 - DNA, 18 bp, Homo sapiens
gagaactgcatatgtttc

SEQ ID NO: 2518790 - DNA, 19 bp, Homo sapiens
gagaactgcatatgtttcg

SEQ ID NO: 2518791 - DNA, 15 bp, Homo sapiens
gagaactgtggccgt

SEQ ID NO: 2518792 - DNA, 19 bp, Homo sapiens
gagaagagagaaatagcct

SEQ ID NO: 2518793 - DNA, 22 bp, Homo sapiens
gagaagagctgttcacagccag

SEQ ID NO: 2518794 - DNA, 13 bp, Homo sapiens
gagaagaggctgg

SEQ ID NO: 2518795 - DNA, 19 bp, Homo sapiens
gagaagagggcctgtggga

SEQ ID NO: 2518796 - DNA, 23 bp, Homo sapiens
gagaagcaagaaagaaacccgac

SEQ ID NO: 2518797 - DNA, 16 bp, Homo sapiens
gagaagcagaggaagg

SEQ ID NO: 2518798 - DNA, 11 bp, Homo sapiens
gagaagccatt

SEQ ID NO: 2518799 - DNA, 15 bp, Homo sapiens
gagaagccattgtct

SEQ ID NO: 2518800 - DNA, 20 bp, Homo sapiens
gagaagccattgtcttcgga

SEQ ID NO: 2518801 - DNA, 21 bp, Homo sapiens
gagaagccccttccccatggg

SEQ ID NO: 2518802 - DNA, 16 bp, Homo sapiens
gagaagcggctggcag

SEQ ID NO: 2518803 - DNA, 23 bp, Homo sapiens
gagaagctgatgctttgcttcaa

SEQ ID NO: 2518804 - DNA, 11 bp, Homo sapiens
gagaagctgct

SEQ ID NO: 2518805 - DNA, 12 bp, Homo sapiens
gagaaggcagcc

SEQ ID NO: 2518806 - DNA, 15 bp, Homo sapiens
gagaagggatggagg

SEQ ID NO: 2518807 - DNA, 15 bp, Homo sapiens
gagaaggtccttaat

SEQ ID NO: 2518808 - DNA, 23 bp, Homo sapiens
gagaaggtgggttttcatcaaga

SEQ ID NO: 2518809 - DNA, 16 bp, Homo sapiens
gagaagtgacagggaa

SEQ ID NO: 2518810 - DNA, 19 bp, Homo sapiens
gagaagtgacagggaagct

SEQ ID NO: 2518811 - DNA, 24 bp, Homo sapiens
gagaagtgacagggaagctacagg

SEQ ID NO: 2518812 - DNA, 20 bp, Homo sapiens
gagaagtgcccctgctgcct

SEQ ID NO: 2518813 - DNA, 21 bp, Homo sapiens
gagaagtttctggccctggct

SEQ ID NO: 2518814 - DNA, 16 bp, Homo sapiens
gagaagttttgttttt

SEQ ID NO: 2518815 - DNA, 18 bp, Homo sapiens
gagaataagagaaagaaa

SEQ ID NO: 2518816 - DNA, 14 bp, Homo sapiens
gagaatatatacat

SEQ ID NO: 2518817 - DNA, 15 bp, Homo sapiens
gagaatctatattta

SEQ ID NO: 2518818 - DNA, 15 bp, Homo sapiens
gagaatggaaaacag

SEQ ID NO: 2518819 - DNA, 21 bp, Homo sapiens
gagaattgtatcatttgaaca

SEQ ID NO: 2518820 - DNA, 22 bp, Homo sapiens
gagacaaacacctcccaggaga

SEQ ID NO: 2518821 - DNA, 16 bp, Homo sapiens
gagacaaatggaggcc

SEQ ID NO: 2518822 - DNA, 20 bp, Homo sapiens
gagacactaacgacttcagg

SEQ ID NO: 2518823 - DNA, 17 bp, Homo sapiens
gagacactggcccctca

SEQ ID NO: 2518824 - DNA, 15 bp, Homo sapiens
gagacagaagcaggc

SEQ ID NO: 2518825 - DNA, 16 bp, Homo sapiens
gagacagaagcaggct

SEQ ID NO: 2518826 - DNA, 13 bp, Homo sapiens
gagacagctctgc

SEQ ID NO: 2518827 - DNA, 16 bp, Homo sapiens
gagacagtcaccccag

SEQ ID NO: 2518828 - DNA, 22 bp, Homo sapiens
gagacagtttcttagcttttta

SEQ ID NO: 2518829 - DNA, 23 bp, Homo sapiens
gagaccaagactctgaaatctca

SEQ ID NO: 2518830 - DNA, 16 bp, Homo sapiens
gagaccagcctgggca

SEQ ID NO: 2518831 - DNA, 18 bp, Homo sapiens
gagaccaggcaaagcaag

SEQ ID NO: 2518832 - DNA, 23 bp, Homo sapiens
gagaccagttgggagcactggag

SEQ ID NO: 2518833 - DNA, 14 bp, Homo sapiens
gagaccatccctga

SEQ ID NO: 2518834 - DNA, 18 bp, Homo sapiens
gagacccagccctcatcc

SEQ ID NO: 2518835 - DNA, 16 bp, Homo sapiens
gagacccctggcctcc

SEQ ID NO: 2518836 - DNA, 19 bp, Homo sapiens
gagaccctcgtggccttcc

SEQ ID NO: 2518837 - DNA, 21 bp, Homo sapiens
gagaccctgtctcaaaaaaag

SEQ ID NO: 2518838 - DNA, 14 bp, Homo sapiens
gagaccgagtgaac

SEQ ID NO: 2518839 - DNA, 15 bp, Homo sapiens
gagaccgagtgaacc

SEQ ID NO: 2518840 - DNA, 18 bp, Homo sapiens
gagacctacctcaggttg

SEQ ID NO: 2518841 - DNA, 11 bp, Homo sapiens
gagacctcatc

SEQ ID NO: 2518842 - DNA, 12 bp, Homo sapiens
gagacctcatca

SEQ ID NO: 2518843 - DNA, 19 bp, Homo sapiens
gagacctcatcaggatgaa

SEQ ID NO: 2518844 - DNA, 16 bp, Homo sapiens
gagacctcctgcctcc

SEQ ID NO: 2518845 - DNA, 19 bp, Homo sapiens
gagacggagtcccaccttg

SEQ ID NO: 2518846 - DNA, 18 bp, Homo sapiens
gagacgggtgggcggctg

SEQ ID NO: 2518847 - DNA, 14 bp, Homo sapiens
gagactaagccctg

SEQ ID NO: 2518848 - DNA, 21 bp, Homo sapiens
gagactagatttatgaataca

SEQ ID NO: 2518849 - DNA, 15 bp, Homo sapiens
gagactcagagggag

SEQ ID NO: 2518850 - DNA, 17 bp, Homo sapiens
gagactcagggccccag

SEQ ID NO: 2518851 - DNA, 21 bp, Homo sapiens
gagactcagggccccagcact

SEQ ID NO: 2518852 - DNA, 16 bp, Homo sapiens
gagactccatgagaag

SEQ ID NO: 2518853 - DNA, 15 bp, Homo sapiens
gagactcctgcaggc

SEQ ID NO: 2518854 - DNA, 16 bp, Homo sapiens
gagactcctgcaggca

SEQ ID NO: 2518855 - DNA, 18 bp, Homo sapiens
gagactcctgcaggcagc

SEQ ID NO: 2518856 - DNA, 19 bp, Homo sapiens
gagactcctgcaggcagcc

SEQ ID NO: 2518857 - DNA, 22 bp, Homo sapiens
gagactcctgcaggcagccagg

SEQ ID NO: 2518858 - DNA, 14 bp, Homo sapiens
gagactctggcctc

SEQ ID NO: 2518859 - DNA, 23 bp, Homo sapiens
gagactctgtggggccttggttc

SEQ ID NO: 2518860 - DNA, 21 bp, Homo sapiens
gagactgggaagataggctct

SEQ ID NO: 2518861 - DNA, 16 bp, Homo sapiens
gagactggtcctgtgt

SEQ ID NO: 2518862 - DNA, 13 bp, Homo sapiens
gagacttgtatga

SEQ ID NO: 2518863 - DNA, 12 bp, Homo sapiens
gagagaaaataa

SEQ ID NO: 2518864 - DNA, 14 bp, Homo sapiens
gagagaaaataaaa

SEQ ID NO: 2518865 - DNA, 17 bp, Homo sapiens
gagagaaaataaaaagt

SEQ ID NO: 2518866 - DNA, 19 bp, Homo sapiens
gagagaaaataaaaagtta

SEQ ID NO: 2518867 - DNA, 15 bp, Homo sapiens
gagagacctcatcag

SEQ ID NO: 2518868 - DNA, 17 bp, Homo sapiens
gagagacgtgtacatag

SEQ ID NO: 2518869 - DNA, 13 bp, Homo sapiens
gagagagctggag

SEQ ID NO: 2518870 - DNA, 20 bp, Homo sapiens
gagagcaactctgagatcta

SEQ ID NO: 2518871 - DNA, 23 bp, Homo sapiens
gagagcaggctggcagctctcca

SEQ ID NO: 2518872 - DNA, 23 bp, Homo sapiens
gagagcccagaggtaacagaaca

SEQ ID NO: 2518873 - DNA, 13 bp, Homo sapiens
gagagcccagcca

SEQ ID NO: 2518874 - DNA, 14 bp, Homo sapiens
gagagccccagctg

SEQ ID NO: 2518875 - DNA, 16 bp, Homo sapiens
gagagcccttcatttg

SEQ ID NO: 2518876 - DNA, 13 bp, Homo sapiens
gagagcctgctgc

SEQ ID NO: 2518877 - DNA, 17 bp, Homo sapiens
gagagcctggtgctgct

SEQ ID NO: 2518878 - DNA, 19 bp, Homo sapiens
gagagcctggtgctgctgc

SEQ ID NO: 2518879 - DNA, 13 bp, Homo sapiens
gagagccttccag

SEQ ID NO: 2518880 - DNA, 22 bp, Homo sapiens
gagagcgcctgcccctcccaga

SEQ ID NO: 2518881 - DNA, 23 bp, Homo sapiens
gagagcgtgctccagcctggctc

SEQ ID NO: 2518882 - DNA, 18 bp, Homo sapiens
gagagctagaacctggag

SEQ ID NO: 2518883 - DNA, 20 bp, Homo sapiens
gagagctagaacctggagag

SEQ ID NO: 2518884 - DNA, 19 bp, Homo sapiens
gagagctagaacctggagg

SEQ ID NO: 2518885 - DNA, 13 bp, Homo sapiens
gagagctgggtgt

SEQ ID NO: 2518886 - DNA, 13 bp, Homo sapiens
gagagctggtgcc

SEQ ID NO: 2518887 - DNA, 18 bp, Homo sapiens
gagagctgttcccaaatt

SEQ ID NO: 2518888 - DNA, 14 bp, Homo sapiens
gagaggagaaacac

SEQ ID NO: 2518889 - DNA, 15 bp, Homo sapiens
gagaggagaaacaca

SEQ ID NO: 2518890 - DNA, 15 bp, Homo sapiens
gagaggagagccaga

SEQ ID NO: 2518891 - DNA, 19 bp, Homo sapiens
gagaggagttcaatgatct

SEQ ID NO: 2518892 - DNA, 14 bp, Homo sapiens
gagaggatgaatgt

SEQ ID NO: 2518893 - DNA, 15 bp, Homo sapiens
gagaggcaatggcca

SEQ ID NO: 2518894 - DNA, 14 bp, Homo sapiens
gagaggccaggtgc

SEQ ID NO: 2518895 - DNA, 12 bp, Homo sapiens
gagaggccatga

SEQ ID NO: 2518896 - DNA, 14 bp, Homo sapiens
gagagggagaagaa

SEQ ID NO: 2518897 - DNA, 13 bp, Homo sapiens
gagaggggaacag

SEQ ID NO: 2518898 - DNA, 18 bp, Homo sapiens
gagaggggaacagactgg

SEQ ID NO: 2518899 - DNA, 22 bp, Homo sapiens
gagaggggaagagtgtactggg

SEQ ID NO: 2518900 - DNA, 16 bp, Homo sapiens
gagagggtgggagtgg

SEQ ID NO: 2518901 - DNA, 16 bp, Homo sapiens
gagaggttaaggtgca

SEQ ID NO: 2518902 - DNA, 17 bp, Homo sapiens
gagagtcatattttgat

SEQ ID NO: 2518903 - DNA, 22 bp, Homo sapiens
gagagtcccactgcctcaggtt

SEQ ID NO: 2518904 - DNA, 17 bp, Homo sapiens
gagagtcccagagcagg

SEQ ID NO: 2518905 - DNA, 15 bp, Homo sapiens
gagagtgaacaaatt

SEQ ID NO: 2518906 - DNA, 21 bp, Homo sapiens
gagagtgtcttcacggcagga

SEQ ID NO: 2518907 - DNA, 20 bp, Homo sapiens
gagagttcaatggctgctga

SEQ ID NO: 2518908 - DNA, 17 bp, Homo sapiens
gagagttttgtcttgaa

SEQ ID NO: 2518909 - DNA, 21 bp, Homo sapiens
gagataatgttagaggtttta

SEQ ID NO: 2518910 - DNA, 20 bp, Homo sapiens
gagatagcattgtgaactga

SEQ ID NO: 2518911 - DNA, 21 bp, Homo sapiens
gagatatctgagggaggaggc

SEQ ID NO: 2518912 - DNA, 19 bp, Homo sapiens
gagatcacgccactgcact

SEQ ID NO: 2518913 - DNA, 13 bp, Homo sapiens
gagatcagcctgg

SEQ ID NO: 2518914 - DNA, 14 bp, Homo sapiens
gagatcagcctggg

SEQ ID NO: 2518915 - DNA, 18 bp, Homo sapiens
gagatcaggctctgcctc

SEQ ID NO: 2518916 - DNA, 21 bp, Homo sapiens
gagatgaagagtgagagggca

SEQ ID NO: 2518917 - DNA, 15 bp, Homo sapiens
gagatgaagcaaaca

SEQ ID NO: 2518918 - DNA, 18 bp, Homo sapiens
gagatgaagcaaacacat

SEQ ID NO: 2518919 - DNA, 16 bp, Homo sapiens
gagatgactgagtcct

SEQ ID NO: 2518920 - DNA, 21 bp, Homo sapiens
gaataaatatgcctctccttt

SEQ ID NO: 2518921 - DNA, 17 bp, Homo sapiens
gaataagaaagtttcac

SEQ ID NO: 2518922 - DNA, 12 bp, Homo sapiens
gaataagttatt

SEQ ID NO: 2518923 - DNA, 19 bp, Homo sapiens
gaataataaaagtatatat

SEQ ID NO: 2518924 - DNA, 15 bp, Homo sapiens
gaataatagaagaac

SEQ ID NO: 2518925 - DNA, 19 bp, Homo sapiens
gaataatcacgctttcctg

SEQ ID NO: 2518926 - DNA, 21 bp, Homo sapiens
gaataatcacgctttcctgaa

SEQ ID NO: 2518927 - DNA, 23 bp, Homo sapiens
gaataatttcccaattaggaagt

SEQ ID NO: 2518928 - DNA, 14 bp, Homo sapiens
gaatacagaaagat

SEQ ID NO: 2518929 - DNA, 13 bp, Homo sapiens
gaatacagtgtta

SEQ ID NO: 2518930 - DNA, 18 bp, Homo sapiens
gaatagtatcctccaggt

SEQ ID NO: 2518931 - DNA, 20 bp, Homo sapiens
gaatagtatcctccaggttt

SEQ ID NO: 2518932 - DNA, 14 bp, Homo sapiens
gaatataaacacta

SEQ ID NO: 2518933 - DNA, 19 bp, Homo sapiens
gaatataatatatttgtgt

SEQ ID NO: 2518934 - DNA, 13 bp, Homo sapiens
gaatataattatc

SEQ ID NO: 2518935 - DNA, 16 bp, Homo sapiens
gaatatccatgaccta

SEQ ID NO: 2518936 - DNA, 22 bp, Homo sapiens
gaatatcccctcccagtcacct

SEQ ID NO: 2518937 - DNA, 19 bp, Homo sapiens
gaatatgacggaagaacat

SEQ ID NO: 2518938 - DNA, 21 bp, Homo sapiens
gaatatgggagaaatagtgtg

SEQ ID NO: 2518939 - DNA, 21 bp, Homo sapiens
gaatattagctttactgtttg

SEQ ID NO: 2518940 - DNA, 15 bp, Homo sapiens
gaatattcaggactt

SEQ ID NO: 2518941 - DNA, 19 bp, Homo sapiens
gaatatttatatttcacta

SEQ ID NO: 2518942 - DNA, 17 bp, Homo sapiens
gaatatttattacctct

SEQ ID NO: 2518943 - DNA, 15 bp, Homo sapiens
gaatcaaaactctcc

SEQ ID NO: 2518944 - DNA, 16 bp, Homo sapiens
gaatcaaagacatgga

SEQ ID NO: 2518945 - DNA, 18 bp, Homo sapiens
gaatcaagagctgccctc

SEQ ID NO: 2518946 - DNA, 20 bp, Homo sapiens
gaatcaagatgtcagactgg

SEQ ID NO: 2518947 - DNA, 22 bp, Homo sapiens
gaatcaagctagaaggccacat

SEQ ID NO: 2518948 - DNA, 13 bp, Homo sapiens
gaatcagaaacag

SEQ ID NO: 2518949 - DNA, 17 bp, Homo sapiens
gaatcatgtcaggcctg

SEQ ID NO: 2518950 - DNA, 20 bp, Homo sapiens
gaatcatgtcaggcctgtgt

SEQ ID NO: 2518951 - DNA, 18 bp, Homo sapiens
gaatccagacccggctgc

SEQ ID NO: 2518952 - DNA, 20 bp, Homo sapiens
gaatccagacccggctgcgt

SEQ ID NO: 2518953 - DNA, 18 bp, Homo sapiens
gaatcccacccacatgtg

SEQ ID NO: 2518954 - DNA, 22 bp, Homo sapiens
gaatcccacccacatgtgacac

SEQ ID NO: 2518955 - DNA, 13 bp, Homo sapiens
gaatctatattta

SEQ ID NO: 2518956 - DNA, 21 bp, Homo sapiens
gaatctatctgcttatgcagt

SEQ ID NO: 2518957 - DNA, 15 bp, Homo sapiens
gaatctatttaagta

SEQ ID NO: 2518958 - DNA, 16 bp, Homo sapiens
gaatctcaaataacta

SEQ ID NO: 2518959 - DNA, 23 bp, Homo sapiens
gaatctttttcagaaacagtgag

SEQ ID NO: 2518960 - DNA, 15 bp, Homo sapiens
gaatgaaaaaacagt

SEQ ID NO: 2518961 - DNA, 20 bp, Homo sapiens
gaatgaaaaatttaagcatt

SEQ ID NO: 2518962 - DNA, 22 bp, Homo sapiens
gaatgaaaaatttaagcattgt

SEQ ID NO: 2518963 - DNA, 16 bp, Homo sapiens
gaatgaaaattgtatg

SEQ ID NO: 2518964 - DNA, 14 bp, Homo sapiens
gaatgaaagctcct

SEQ ID NO: 2518965 - DNA, 21 bp, Homo sapiens
gaatgaaagggcccagagagg

SEQ ID NO: 2518966 - DNA, 18 bp, Homo sapiens
gaatgaaatactgtttga

SEQ ID NO: 2518967 - DNA, 16 bp, Homo sapiens
gaatgaagcttgtgta

SEQ ID NO: 2518968 - DNA, 18 bp, Homo sapiens
gaatgaagcttgtgtatc

SEQ ID NO: 2518969 - DNA, 20 bp, Homo sapiens
gaatgaatggctaagcaaaa

SEQ ID NO: 2518970 - DNA, 14 bp, Homo sapiens
gaatgaattaaata

SEQ ID NO: 2518971 - DNA, 14 bp, Homo sapiens
gaatgaggcttgct

SEQ ID NO: 2518972 - DNA, 15 bp, Homo sapiens
gaatgaggcttgctg

SEQ ID NO: 2518973 - DNA, 17 bp, Homo sapiens
gaatgaggtcccaggca

SEQ ID NO: 2518974 - DNA, 17 bp, Homo sapiens
gagatgattcagaaggg

SEQ ID NO: 2518975 - DNA, 13 bp, Homo sapiens
gagatgcagctgg

SEQ ID NO: 2518976 - DNA, 18 bp, Homo sapiens
gagatggagttcttgtgc

SEQ ID NO: 2518977 - DNA, 22 bp, Homo sapiens
gagatgggagctcctctcctgg

SEQ ID NO: 2518978 - DNA, 23 bp, Homo sapiens
gagatgggagctcctctcctgga

SEQ ID NO: 2518979 - DNA, 18 bp, Homo sapiens
gagatgggcttgttttct

SEQ ID NO: 2518980 - DNA, 14 bp, Homo sapiens
gagatggggtgggg

SEQ ID NO: 2518981 - DNA, 22 bp, Homo sapiens
gagatgtcttcgtacagttctt

SEQ ID NO: 2518982 - DNA, 14 bp, Homo sapiens
gagatgttttagag

SEQ ID NO: 2518983 - DNA, 14 bp, Homo sapiens
gagatgtttttaaa

SEQ ID NO: 2518984 - DNA, 14 bp, Homo sapiens
gagattcagactgt

SEQ ID NO: 2518985 - DNA, 13 bp, Homo sapiens
gagcaaagatcaa

SEQ ID NO: 2518986 - DNA, 18 bp, Homo sapiens
gagcaaagatcaaaataa

SEQ ID NO: 2518987 - DNA, 22 bp, Homo sapiens
gagcaaagatcaaaataaaaag

SEQ ID NO: 2518988 - DNA, 16 bp, Homo sapiens
gagcaaaggctgagaa

SEQ ID NO: 2518989 - DNA, 16 bp, Homo sapiens
gagcaaatgtttctgc

SEQ ID NO: 2518990 - DNA, 14 bp, Homo sapiens
gagcaagactctgt

SEQ ID NO: 2518991 - DNA, 12 bp, Homo sapiens
gagcaagagctg

SEQ ID NO: 2518992 - DNA, 20 bp, Homo sapiens
gagcaagcatttatgtttat

SEQ ID NO: 2518993 - DNA, 18 bp, Homo sapiens
gagcaagttccttctggt

SEQ ID NO: 2518994 - DNA, 18 bp, Homo sapiens
gagcacacttggcccaag

SEQ ID NO: 2518995 - DNA, 16 bp, Homo sapiens
gagcacccctctctgc

SEQ ID NO: 2518996 - DNA, 19 bp, Homo sapiens
gagcaccttagacagtccc

SEQ ID NO: 2518997 - DNA, 16 bp, Homo sapiens
gagcaccttcctcact

SEQ ID NO: 2518998 - DNA, 14 bp, Homo sapiens
gagcactggagtgc

SEQ ID NO: 2518999 - DNA, 20 bp, Homo sapiens
gagcactggagtgcagggag

SEQ ID NO: 2519000 - DNA, 12 bp, Homo sapiens
gagcagagacac

SEQ ID NO: 2519001 - DNA, 13 bp, Homo sapiens
gagcagagacact

SEQ ID NO: 2519002 - DNA, 24 bp, Homo sapiens
gagcagagacatgactcagcctgt

SEQ ID NO: 2519003 - DNA, 23 bp, Homo sapiens
gagcagagaccatccctgaaggc

SEQ ID NO: 2519004 - DNA, 21 bp, Homo sapiens
gagcagccacattcctgatgc

SEQ ID NO: 2519005 - DNA, 16 bp, Homo sapiens
gagcagcctgtggcat

SEQ ID NO: 2519006 - DNA, 18 bp, Homo sapiens
gagcagctttaaactcag

SEQ ID NO: 2519007 - DNA, 16 bp, Homo sapiens
gagcaggaagcattca

SEQ ID NO: 2519008 - DNA, 23 bp, Homo sapiens
gagcaggaagcattcagagagca

SEQ ID NO: 2519009 - DNA, 17 bp, Homo sapiens
gagcaggaggcccctgg

SEQ ID NO: 2519010 - DNA, 22 bp, Homo sapiens
gagcaggcggtgggcacccacc

SEQ ID NO: 2519011 - DNA, 20 bp, Homo sapiens
gagcaggggtccttggtgtg

SEQ ID NO: 2519012 - DNA, 17 bp, Homo sapiens
gagcagtatcatgaagc

SEQ ID NO: 2519013 - DNA, 12 bp, Homo sapiens
gagcagtgtctt

SEQ ID NO: 2519014 - DNA, 17 bp, Homo sapiens
gagcagtttctgtcctg

SEQ ID NO: 2519015 - DNA, 20 bp, Homo sapiens
gagcagtttctgtcctgctg

SEQ ID NO: 2519016 - DNA, 19 bp, Homo sapiens
gagcatctcttgaggccag

SEQ ID NO: 2519017 - DNA, 13 bp, Homo sapiens
gagcatctgactc

SEQ ID NO: 2519018 - DNA, 22 bp, Homo sapiens
gagcatgcctggatggggctgc

SEQ ID NO: 2519019 - DNA, 15 bp, Homo sapiens
gagcatggagctggc

SEQ ID NO: 2519020 - DNA, 21 bp, Homo sapiens
gagcatggctgtgaggatggg

SEQ ID NO: 2519021 - DNA, 15 bp, Homo sapiens
gagcatgggcctggc

SEQ ID NO: 2519022 - DNA, 17 bp, Homo sapiens
gagcatgggcctggcca

SEQ ID NO: 2519023 - DNA, 22 bp, Homo sapiens
gagcatgtactgagccttgtaa

SEQ ID NO: 2519024 - DNA, 18 bp, Homo sapiens
gagcattacgtgagccag

SEQ ID NO: 2519025 - DNA, 20 bp, Homo sapiens
gagcattacgtgagccaggt

SEQ ID NO: 2519026 - DNA, 20 bp, Homo sapiens
gagccaacagaagcttccat

SEQ ID NO: 2519027 - DNA, 15 bp, Homo sapiens
gagccaactgctgct

SEQ ID NO: 2519028 - DNA, 19 bp, Homo sapiens
gagccaagggttcagagac

SEQ ID NO: 2519029 - DNA, 14 bp, Homo sapiens
gagccaagtccaga

SEQ ID NO: 2519030 - DNA, 19 bp, Homo sapiens
gagccaatttaaagaaaac

SEQ ID NO: 2519031 - DNA, 13 bp, Homo sapiens
gagccactgcacc

SEQ ID NO: 2519032 - DNA, 21 bp, Homo sapiens
gagccagaacctggagggcta

SEQ ID NO: 2519033 - DNA, 23 bp, Homo sapiens
gagccagactctggtcttctttg

SEQ ID NO: 2519034 - DNA, 12 bp, Homo sapiens
gagccagagaag

SEQ ID NO: 2519035 - DNA, 17 bp, Homo sapiens
gagccagagaagtgaca

SEQ ID NO: 2519036 - DNA, 22 bp, Homo sapiens
gagccaggcctgggtctgtgtc

SEQ ID NO: 2519037 - DNA, 14 bp, Homo sapiens
gagccagggtctca

SEQ ID NO: 2519038 - DNA, 18 bp, Homo sapiens
gagccaggtaatgaggga

SEQ ID NO: 2519039 - DNA, 19 bp, Homo sapiens
gagccaggtaatgagggac

SEQ ID NO: 2519040 - DNA, 14 bp, Homo sapiens
gagccatgctggga

SEQ ID NO: 2519041 - DNA, 21 bp, Homo sapiens
gagccatgtagaagctgcatc

SEQ ID NO: 2519042 - DNA, 14 bp, Homo sapiens
gagcccaagggaat

SEQ ID NO: 2519043 - DNA, 16 bp, Homo sapiens
gagcccacaaagcctt

SEQ ID NO: 2519044 - DNA, 17 bp, Homo sapiens
gagcccaccttggctca

SEQ ID NO: 2519045 - DNA, 12 bp, Homo sapiens
gagcccacgccc

SEQ ID NO: 2519046 - DNA, 21 bp, Homo sapiens
gagcccactgcccaccccctc

SEQ ID NO: 2519047 - DNA, 12 bp, Homo sapiens
gagcccagctct

SEQ ID NO: 2519048 - DNA, 14 bp, Homo sapiens
gagcccagctctga

SEQ ID NO: 2519049 - DNA, 12 bp, Homo sapiens
gagcccaggagt

SEQ ID NO: 2519050 - DNA, 23 bp, Homo sapiens
gagcccaggagttcgaggctgca

SEQ ID NO: 2519051 - DNA, 11 bp, Homo sapiens
gagccccaagt

SEQ ID NO: 2519052 - DNA, 17 bp, Homo sapiens
gagccccaagtcctgaa

SEQ ID NO: 2519053 - DNA, 12 bp, Homo sapiens
gagccccacact

SEQ ID NO: 2519054 - DNA, 13 bp, Homo sapiens
gagccccagcccc

SEQ ID NO: 2519055 - DNA, 13 bp, Homo sapiens
gagccccagctga

SEQ ID NO: 2519056 - DNA, 14 bp, Homo sapiens
gagccccagctgac

SEQ ID NO: 2519057 - DNA, 18 bp, Homo sapiens
gagccccaggcctctgtg

SEQ ID NO: 2519058 - DNA, 13 bp, Homo sapiens
gagccccagggtc

SEQ ID NO: 2519059 - DNA, 14 bp, Homo sapiens
gagccccagggtct

SEQ ID NO: 2519060 - DNA, 13 bp, Homo sapiens
gagcccccccaac

SEQ ID NO: 2519061 - DNA, 17 bp, Homo sapiens
gagcccccgccccgccc

SEQ ID NO: 2519062 - DNA, 14 bp, Homo sapiens
gagccccgaggcct

SEQ ID NO: 2519063 - DNA, 17 bp, Homo sapiens
gagccccgaggccttct

SEQ ID NO: 2519064 - DNA, 13 bp, Homo sapiens
gagcccctgggtg

SEQ ID NO: 2519065 - DNA, 12 bp, Homo sapiens
gagcccctggtc

SEQ ID NO: 2519066 - DNA, 14 bp, Homo sapiens
gagcccctggtcct

SEQ ID NO: 2519067 - DNA, 23 bp, Homo sapiens
gagcccgcacccccaccctttgg

SEQ ID NO: 2519068 - DNA, 17 bp, Homo sapiens
gagcccggcgcccctgc

SEQ ID NO: 2519069 - DNA, 13 bp, Homo sapiens
gagccctggcagg

SEQ ID NO: 2519070 - DNA, 23 bp, Homo sapiens
gagccctggcaggatgaccctgc

SEQ ID NO: 2519071 - DNA, 17 bp, Homo sapiens
gagccctggtggcagtg

SEQ ID NO: 2519072 - DNA, 21 bp, Homo sapiens
gagccgagatcacgccactgc

SEQ ID NO: 2519073 - DNA, 22 bp, Homo sapiens
gagccggactttcggagttggg

SEQ ID NO: 2519074 - DNA, 14 bp, Homo sapiens
gagccgggcctggg

SEQ ID NO: 2519075 - DNA, 18 bp, Homo sapiens
gagccggggagtttcttt

SEQ ID NO: 2519076 - DNA, 19 bp, Homo sapiens
gagccggggagtttctttc

SEQ ID NO: 2519077 - DNA, 22 bp, Homo sapiens
gagccggggagtttctttcctg

SEQ ID NO: 2519078 - DNA, 14 bp, Homo sapiens
gagcctcagcatcc

SEQ ID NO: 2519079 - DNA, 20 bp, Homo sapiens
gagcctcagcatcctggcac

SEQ ID NO: 2519080 - DNA, 20 bp, Homo sapiens
gagcctcatccgaggcaggg

SEQ ID NO: 2519081 - DNA, 20 bp, Homo sapiens
gagcctccctcaattccccc

SEQ ID NO: 2519082 - DNA, 18 bp, Homo sapiens
gagcctctgtcactgcag

SEQ ID NO: 2519083 - DNA, 20 bp, Homo sapiens
gagcctctgtcactgcaggc

SEQ ID NO: 2519084 - DNA, 22 bp, Homo sapiens
gagcctctgtcactgcaggcac

SEQ ID NO: 2519085 - DNA, 10 bp, Homo sapiens
gagcctgagg

SEQ ID NO: 2519086 - DNA, 12 bp, Homo sapiens
gagcctgcagtt

SEQ ID NO: 2519087 - DNA, 19 bp, Homo sapiens
gagcctgcggcctgctgga

SEQ ID NO: 2519088 - DNA, 14 bp, Homo sapiens
gagcctggagaagc

SEQ ID NO: 2519089 - DNA, 12 bp, Homo sapiens
gagcctggtgcc

SEQ ID NO: 2519090 - DNA, 19 bp, Homo sapiens
gagcctgtgcctcctcacc

SEQ ID NO: 2519091 - DNA, 13 bp, Homo sapiens
gagccttccaggg

SEQ ID NO: 2519092 - DNA, 15 bp, Homo sapiens
gagccttccaggggt

SEQ ID NO: 2519093 - DNA, 16 bp, Homo sapiens
gagccttccaggggtg

SEQ ID NO: 2519094 - DNA, 19 bp, Homo sapiens
gagccttgaactttgacct

SEQ ID NO: 2519095 - DNA, 23 bp, Homo sapiens
gagccttttccctctttggctcc

SEQ ID NO: 2519096 - DNA, 16 bp, Homo sapiens
gagcgagcgctaccca

SEQ ID NO: 2519097 - DNA, 18 bp, Homo sapiens
gagcgaggagatgctcct

SEQ ID NO: 2519098 - DNA, 21 bp, Homo sapiens
gagcgaggagatgctccttgg

SEQ ID NO: 2519099 - DNA, 17 bp, Homo sapiens
gagcgcccgcgcccgcg

SEQ ID NO: 2519100 - DNA, 22 bp, Homo sapiens
gagcgccgtgagttctcagggc

SEQ ID NO: 2519101 - DNA, 13 bp, Homo sapiens
gagcgcctgcccc

SEQ ID NO: 2519102 - DNA, 18 bp, Homo sapiens
gagcgcctgcccctccca

SEQ ID NO: 2519103 - DNA, 20 bp, Homo sapiens
gagcgcctgcccctcccaga

SEQ ID NO: 2519104 - DNA, 14 bp, Homo sapiens
gagcgggacctgtg

SEQ ID NO: 2519105 - DNA, 18 bp, Homo sapiens
gagctacccgcagagttc

SEQ ID NO: 2519106 - DNA, 22 bp, Homo sapiens
gagctagaacctagaagggcta

SEQ ID NO: 2519107 - DNA, 17 bp, Homo sapiens
gagctagaacctggaga

SEQ ID NO: 2519108 - DNA, 19 bp, Homo sapiens
gagctagaacctggagagc

SEQ ID NO: 2519109 - DNA, 15 bp, Homo sapiens
gagctagaagctgga

SEQ ID NO: 2519110 - DNA, 18 bp, Homo sapiens
gagctagaagctggagga

SEQ ID NO: 2519111 - DNA, 19 bp, Homo sapiens
gagctatttccattccaga

SEQ ID NO: 2519112 - DNA, 21 bp, Homo sapiens
gagctatttccattccagaat

SEQ ID NO: 2519113 - DNA, 19 bp, Homo sapiens
gagctcactgtggtgtctg

SEQ ID NO: 2519114 - DNA, 21 bp, Homo sapiens
gagctcagagagggcaggcat

SEQ ID NO: 2519115 - DNA, 14 bp, Homo sapiens
gagctcaggacact

SEQ ID NO: 2519116 - DNA, 20 bp, Homo sapiens
gagctccagacccccagcaa

SEQ ID NO: 2519117 - DNA, 19 bp, Homo sapiens
gagctcccggcgtggtgga

SEQ ID NO: 2519118 - DNA, 15 bp, Homo sapiens
gagctcctctgggca

SEQ ID NO: 2519119 - DNA, 16 bp, Homo sapiens
gagctcgtgtatcctg

SEQ ID NO: 2519120 - DNA, 20 bp, Homo sapiens
gtcagggcccaagtccctgt

SEQ ID NO: 2519121 - DNA, 16 bp, Homo sapiens
gtcaggtggggcagct

SEQ ID NO: 2519122 - DNA, 17 bp, Homo sapiens
gtcaggtggggcagctt

SEQ ID NO: 2519123 - DNA, 16 bp, Homo sapiens
gtcagtaccttcaaac

SEQ ID NO: 2519124 - DNA, 21 bp, Homo sapiens
gtcagtatgtggaagtgtggg

SEQ ID NO: 2519125 - DNA, 23 bp, Homo sapiens
gtcagtgcagcccgtgtggcccc

SEQ ID NO: 2519126 - DNA, 16 bp, Homo sapiens
gtcatcacttttcagt

SEQ ID NO: 2519127 - DNA, 13 bp, Homo sapiens
gtcatcatacatg

SEQ ID NO: 2519128 - DNA, 17 bp, Homo sapiens
gtcatctccatcagctg

SEQ ID NO: 2519129 - DNA, 19 bp, Homo sapiens
gtcatctccatcagctgta

SEQ ID NO: 2519130 - DNA, 22 bp, Homo sapiens
gtcatctttttctctaaaatag

SEQ ID NO: 2519131 - DNA, 18 bp, Homo sapiens
gtcatgaacatgttcctg

SEQ ID NO: 2519132 - DNA, 15 bp, Homo sapiens
gtcatgatggcacca

SEQ ID NO: 2519133 - DNA, 17 bp, Homo sapiens
gtcatgcaaaggctggg

SEQ ID NO: 2519134 - DNA, 18 bp, Homo sapiens
gtcatgcaaaggctggga

SEQ ID NO: 2519135 - DNA, 19 bp, Homo sapiens
gtcatgcataaatatgcag

SEQ ID NO: 2519136 - DNA, 16 bp, Homo sapiens
gtcatgcccccctcaa

SEQ ID NO: 2519137 - DNA, 21 bp, Homo sapiens
gtcattttaactttatcacat

SEQ ID NO: 2519138 - DNA, 19 bp, Homo sapiens
gtcattttttttaagaaaa

SEQ ID NO: 2519139 - DNA, 18 bp, Homo sapiens
gtccaaaagattgctgaa

SEQ ID NO: 2519140 - DNA, 14 bp, Homo sapiens
gtccaaaggaggct

SEQ ID NO: 2519141 - DNA, 16 bp, Homo sapiens
gtccaaaggaggctgg

SEQ ID NO: 2519142 - DNA, 20 bp, Homo sapiens
gtccaaaggaggctggcagg

SEQ ID NO: 2519143 - DNA, 18 bp, Homo sapiens
gtccaaataaaaactaaa

SEQ ID NO: 2519144 - DNA, 17 bp, Homo sapiens
gtccaagaagcccagga

SEQ ID NO: 2519145 - DNA, 18 bp, Homo sapiens
gtccaagaagcccaggaa

SEQ ID NO: 2519146 - DNA, 17 bp, Homo sapiens
gtccaagtgtgtgtgcg

SEQ ID NO: 2519147 - DNA, 17 bp, Homo sapiens
gtccaatcctatgtttt

SEQ ID NO: 2519148 - DNA, 12 bp, Homo sapiens
gtccacccagga

SEQ ID NO: 2519149 - DNA, 13 bp, Homo sapiens
gtccacccaggag

SEQ ID NO: 2519150 - DNA, 14 bp, Homo sapiens
gtccacccaggagc

SEQ ID NO: 2519151 - DNA, 12 bp, Homo sapiens
gtccactcccag

SEQ ID NO: 2519152 - DNA, 17 bp, Homo sapiens
gtccagaagaatattca

SEQ ID NO: 2519153 - DNA, 19 bp, Homo sapiens
gtccagaagaatattcagg

SEQ ID NO: 2519154 - DNA, 21 bp, Homo sapiens
gtccagaagaatattcaggac

SEQ ID NO: 2519155 - DNA, 12 bp, Homo sapiens
gtccagacagcc

SEQ ID NO: 2519156 - DNA, 16 bp, Homo sapiens
gtccagacagcctgta

SEQ ID NO: 2519157 - DNA, 15 bp, Homo sapiens
gtccagatttacact

SEQ ID NO: 2519158 - DNA, 14 bp, Homo sapiens
gtccagccctggct

SEQ ID NO: 2519159 - DNA, 19 bp, Homo sapiens
gtccagccctggctgaagg

SEQ ID NO: 2519160 - DNA, 23 bp, Homo sapiens
gtccagccctggctgaaggactg

SEQ ID NO: 2519161 - DNA, 22 bp, Homo sapiens
gtccagccgccattgccaccag

SEQ ID NO: 2519162 - DNA, 13 bp, Homo sapiens
gtccagcctgggc

SEQ ID NO: 2519163 - DNA, 13 bp, Homo sapiens
gtccaggagcctg

SEQ ID NO: 2519164 - DNA, 15 bp, Homo sapiens
gtccagggaagctgg

SEQ ID NO: 2519165 - DNA, 20 bp, Homo sapiens
gtccagggaagctggccgag

SEQ ID NO: 2519166 - DNA, 11 bp, Homo sapiens
gtccaggggat

SEQ ID NO: 2519167 - DNA, 18 bp, Homo sapiens
gtccaggggcccctccag

SEQ ID NO: 2519168 - DNA, 17 bp, Homo sapiens
gtccagtgacctgctgg

SEQ ID NO: 2519169 - DNA, 13 bp, Homo sapiens
gtccatgggcaga

SEQ ID NO: 2519170 - DNA, 16 bp, Homo sapiens
gtccatgggcagagcc

SEQ ID NO: 2519171 - DNA, 18 bp, Homo sapiens
gtccatgggcagagccca

SEQ ID NO: 2519172 - DNA, 13 bp, Homo sapiens
gtccatgtgtgtg

SEQ ID NO: 2519173 - DNA, 15 bp, Homo sapiens
gtcccaacttgtaaa

SEQ ID NO: 2519174 - DNA, 15 bp, Homo sapiens
gtcccaagctgggcc

SEQ ID NO: 2519175 - DNA, 16 bp, Homo sapiens
gtcccaagctgggccc

SEQ ID NO: 2519176 - DNA, 16 bp, Homo sapiens
gtcccaaggaaagccc

SEQ ID NO: 2519177 - DNA, 15 bp, Homo sapiens
gtcccaccccacaca

SEQ ID NO: 2519178 - DNA, 20 bp, Homo sapiens
gtcccaccccacacacgcca

SEQ ID NO: 2519179 - DNA, 22 bp, Homo sapiens
gtcccacccccacccccagctc

SEQ ID NO: 2519180 - DNA, 12 bp, Homo sapiens
gtcccacctctt

SEQ ID NO: 2519181 - DNA, 13 bp, Homo sapiens
gtcccacctcttc

SEQ ID NO: 2519182 - DNA, 18 bp, Homo sapiens
gtcccaccttggctgcag

SEQ ID NO: 2519183 - DNA, 22 bp, Homo sapiens
gtcccacgaatttgctggggaa

SEQ ID NO: 2519184 - DNA, 15 bp, Homo sapiens
gtcccactcagtcca

SEQ ID NO: 2519185 - DNA, 19 bp, Homo sapiens
gtcccactgcctcaggttc

SEQ ID NO: 2519186 - DNA, 17 bp, Homo sapiens
gtcccagatacttgggg

SEQ ID NO: 2519187 - DNA, 16 bp, Homo sapiens
gtcccagccaccccgg

SEQ ID NO: 2519188 - DNA, 18 bp, Homo sapiens
gtcccagccaccccgggc

SEQ ID NO: 2519189 - DNA, 23 bp, Homo sapiens
gtcccagccaccccgggctctct

SEQ ID NO: 2519190 - DNA, 12 bp, Homo sapiens
gtcccagtgccg

SEQ ID NO: 2519191 - DNA, 10 bp, Homo sapiens
gtcccagtgg

SEQ ID NO: 2519192 - DNA, 14 bp, Homo sapiens
gtcccagtgggagg

SEQ ID NO: 2519193 - DNA, 17 bp, Homo sapiens
gtcccagtgggaggcgc

SEQ ID NO: 2519194 - DNA, 14 bp, Homo sapiens
gtcccatccaggca

SEQ ID NO: 2519195 - DNA, 15 bp, Homo sapiens
gtcccatccaggcag

SEQ ID NO: 2519196 - DNA, 18 bp, Homo sapiens
gtcccatgacccacccct

SEQ ID NO: 2519197 - DNA, 23 bp, Homo sapiens
gtcccatggacactccagtgcca

SEQ ID NO: 2519198 - DNA, 16 bp, Homo sapiens
gtcccatttctcactg

SEQ ID NO: 2519199 - DNA, 17 bp, Homo sapiens
gtccccaccgcagacag

SEQ ID NO: 2519200 - DNA, 14 bp, Homo sapiens
gtccccacctggga

SEQ ID NO: 2519201 - DNA, 17 bp, Homo sapiens
gtccccatcatcccagc

SEQ ID NO: 2519202 - DNA, 13 bp, Homo sapiens
gtccccctctgtc

SEQ ID NO: 2519203 - DNA, 14 bp, Homo sapiens
gtcccccttccatg

SEQ ID NO: 2519204 - DNA, 18 bp, Homo sapiens
gtcccccttccatggact

SEQ ID NO: 2519205 - DNA, 13 bp, Homo sapiens
gtccccttccatc

SEQ ID NO: 2519206 - DNA, 22 bp, Homo sapiens
gtccccttttcttttctaccct

SEQ ID NO: 2519207 - DNA, 14 bp, Homo sapiens
gtcccggggtcctg

SEQ ID NO: 2519208 - DNA, 21 bp, Homo sapiens
gtcccggggtcctgtggcagg

SEQ ID NO: 2519209 - DNA, 21 bp, Homo sapiens
gtccctacacccctcccctgc

SEQ ID NO: 2519210 - DNA, 16 bp, Homo sapiens
gtccctctcaggcatg

SEQ ID NO: 2519211 - DNA, 20 bp, Homo sapiens
gtccctgactctctgtgacc

SEQ ID NO: 2519212 - DNA, 14 bp, Homo sapiens
gtccctgccaatgg

SEQ ID NO: 2519213 - DNA, 18 bp, Homo sapiens
gtccctgccccagcaaga

SEQ ID NO: 2519214 - DNA, 17 bp, Homo sapiens
gtcccttcccctccctg

SEQ ID NO: 2519215 - DNA, 18 bp, Homo sapiens
gtcccttcccctccctgg

SEQ ID NO: 2519216 - DNA, 20 bp, Homo sapiens
gtcccttcccctccctggct

SEQ ID NO: 2519217 - DNA, 19 bp, Homo sapiens
gtcccttctcttaatttaa

SEQ ID NO: 2519218 - DNA, 20 bp, Homo sapiens
gtcccttgtttccagctaga

SEQ ID NO: 2519219 - DNA, 22 bp, Homo sapiens
gtccctttcttggccagttatc

SEQ ID NO: 2519220 - DNA, 21 bp, Homo sapiens
gtccgaaagggacttggaagc

SEQ ID NO: 2519221 - DNA, 20 bp, Homo sapiens
gggcagggaaggggaggcag

SEQ ID NO: 2519222 - DNA, 18 bp, Homo sapiens
gggcaggtggtggcactg

SEQ ID NO: 2519223 - DNA, 20 bp, Homo sapiens
gggcagtagaaggtcggagg

SEQ ID NO: 2519224 - DNA, 22 bp, Homo sapiens
gggcagtggtaagctctggctt

SEQ ID NO: 2519225 - DNA, 22 bp, Homo sapiens
gggcatagatgcaggtgagccc

SEQ ID NO: 2519226 - DNA, 19 bp, Homo sapiens
gggcatgtattggcctgga

SEQ ID NO: 2519227 - DNA, 21 bp, Homo sapiens
gggcatgtattggcctggagg

SEQ ID NO: 2519228 - DNA, 23 bp, Homo sapiens
gggcattgatggggaaggaggct

SEQ ID NO: 2519229 - DNA, 11 bp, Homo sapiens
gggccaacacc

SEQ ID NO: 2519230 - DNA, 19 bp, Homo sapiens
gggccacagggcgagactc

SEQ ID NO: 2519231 - DNA, 16 bp, Homo sapiens
gggccactctgcctct

SEQ ID NO: 2519232 - DNA, 22 bp, Homo sapiens
gggccagaggaactgtccagag

SEQ ID NO: 2519233 - DNA, 22 bp, Homo sapiens
gggccagccaggcgggctcaag

SEQ ID NO: 2519234 - DNA, 13 bp, Homo sapiens
gggccagcccctc

SEQ ID NO: 2519235 - DNA, 15 bp, Homo sapiens
gggccagcccctccc

SEQ ID NO: 2519236 - DNA, 12 bp, Homo sapiens
gggccaggcagg

SEQ ID NO: 2519237 - DNA, 13 bp, Homo sapiens
gggccaggcaggt

SEQ ID NO: 2519238 - DNA, 23 bp, Homo sapiens
gggccaggggtctccctggagtg

SEQ ID NO: 2519239 - DNA, 14 bp, Homo sapiens
gggccagttggtcc

SEQ ID NO: 2519240 - DNA, 22 bp, Homo sapiens
gggccagttggtcccccttcca

SEQ ID NO: 2519241 - DNA, 15 bp, Homo sapiens
gggccatagctcctg

SEQ ID NO: 2519242 - DNA, 15 bp, Homo sapiens
gggccatgctgaagg

SEQ ID NO: 2519243 - DNA, 18 bp, Homo sapiens
gggcccaaggcggcccct

SEQ ID NO: 2519244 - DNA, 19 bp, Homo sapiens
gggcccaaggcggcccctc

SEQ ID NO: 2519245 - DNA, 12 bp, Homo sapiens
gggcccacaccc

SEQ ID NO: 2519246 - DNA, 14 bp, Homo sapiens
gggcccagagcagg

SEQ ID NO: 2519247 - DNA, 12 bp, Homo sapiens
gggcccagcccc

SEQ ID NO: 2519248 - DNA, 22 bp, Homo sapiens
gggcccagcccccacagtgctg

SEQ ID NO: 2519249 - DNA, 18 bp, Homo sapiens
gggcccaggaccagctgg

SEQ ID NO: 2519250 - DNA, 11 bp, Homo sapiens
gggcccaggga

SEQ ID NO: 2519251 - DNA, 18 bp, Homo sapiens
gggcccagggacaccagc

SEQ ID NO: 2519252 - DNA, 18 bp, Homo sapiens
gggccccagaaggcaggg

SEQ ID NO: 2519253 - DNA, 17 bp, Homo sapiens
gggcccccctccttgct

SEQ ID NO: 2519254 - DNA, 19 bp, Homo sapiens
gggcccccctccttgctct

SEQ ID NO: 2519255 - DNA, 21 bp, Homo sapiens
gggcccccctccttgctctgc

SEQ ID NO: 2519256 - DNA, 13 bp, Homo sapiens
gggcccctccagc

SEQ ID NO: 2519257 - DNA, 14 bp, Homo sapiens
gggcccctccagct

SEQ ID NO: 2519258 - DNA, 17 bp, Homo sapiens
gggcccctctgcccagc

SEQ ID NO: 2519259 - DNA, 23 bp, Homo sapiens
gggcccctctgcccagcttgggc

SEQ ID NO: 2519260 - DNA, 17 bp, Homo sapiens
gggcccgttgaggatga

SEQ ID NO: 2519261 - DNA, 14 bp, Homo sapiens
gggccctcccttgg

SEQ ID NO: 2519262 - DNA, 12 bp, Homo sapiens
gggccctcctga

SEQ ID NO: 2519263 - DNA, 12 bp, Homo sapiens
gggccctgagct

SEQ ID NO: 2519264 - DNA, 13 bp, Homo sapiens
gggccctgagctc

SEQ ID NO: 2519265 - DNA, 18 bp, Homo sapiens
gggccctgagctgagggc

SEQ ID NO: 2519266 - DNA, 18 bp, Homo sapiens
gggccctgcacctgtgca

SEQ ID NO: 2519267 - DNA, 19 bp, Homo sapiens
gggccctgcacctgtgcag

SEQ ID NO: 2519268 - DNA, 19 bp, Homo sapiens
gggccctggtccttccagg

SEQ ID NO: 2519269 - DNA, 21 bp, Homo sapiens
gggccctggtgtttctagcac

SEQ ID NO: 2519270 - DNA, 16 bp, Homo sapiens
gggccgtaccccaccc

SEQ ID NO: 2519271 - DNA, 14 bp, Homo sapiens
gggccgtgcccagg

SEQ ID NO: 2519272 - DNA, 22 bp, Homo sapiens
gggcctagatccacacacagag

SEQ ID NO: 2519273 - DNA, 16 bp, Homo sapiens
gggcctcaaggacttg

SEQ ID NO: 2519274 - DNA, 15 bp, Homo sapiens
gggcctcagtgccac

SEQ ID NO: 2519275 - DNA, 13 bp, Homo sapiens
gggcctcctgtgt

SEQ ID NO: 2519276 - DNA, 17 bp, Homo sapiens
gggcctcggagcctcat

SEQ ID NO: 2519277 - DNA, 13 bp, Homo sapiens
gggcctggacctg

SEQ ID NO: 2519278 - DNA, 14 bp, Homo sapiens
gggcctggcctgag

SEQ ID NO: 2519279 - DNA, 19 bp, Homo sapiens
gggcctggcctgagctggg

SEQ ID NO: 2519280 - DNA, 14 bp, Homo sapiens
gggcctggctcagg

SEQ ID NO: 2519281 - DNA, 17 bp, Homo sapiens
gggcctggctcaggtgg

SEQ ID NO: 2519282 - DNA, 16 bp, Homo sapiens
gggcctggtccctggg

SEQ ID NO: 2519283 - DNA, 20 bp, Homo sapiens
gggcgagactccgtctcaaa

SEQ ID NO: 2519284 - DNA, 16 bp, Homo sapiens
gggcgaggcagaggac

SEQ ID NO: 2519285 - DNA, 14 bp, Homo sapiens
gggcgccctggaag

SEQ ID NO: 2519286 - DNA, 22 bp, Homo sapiens
gggcgcctgtagtcccagccac

SEQ ID NO: 2519287 - DNA, 18 bp, Homo sapiens
gggcgcggccagccccgg

SEQ ID NO: 2519288 - DNA, 13 bp, Homo sapiens
gggcgctggccca

SEQ ID NO: 2519289 - DNA, 15 bp, Homo sapiens
gggcgggcccctcat

SEQ ID NO: 2519290 - DNA, 16 bp, Homo sapiens
gggctaccctgagctg

SEQ ID NO: 2519291 - DNA, 19 bp, Homo sapiens
gggctaccctgagctgagg

SEQ ID NO: 2519292 - DNA, 21 bp, Homo sapiens
gggctaccctgagctgaggca

SEQ ID NO: 2519293 - DNA, 17 bp, Homo sapiens
gggctagaacctggagg

SEQ ID NO: 2519294 - DNA, 18 bp, Homo sapiens
gggctcagcaaaagatgc

SEQ ID NO: 2519295 - DNA, 16 bp, Homo sapiens
gggctcagcctggtgg

SEQ ID NO: 2519296 - DNA, 17 bp, Homo sapiens
gggctcagcggggacag

SEQ ID NO: 2519297 - DNA, 19 bp, Homo sapiens
gggctcagcggggacagct

SEQ ID NO: 2519298 - DNA, 10 bp, Homo sapiens
gggctccaga

SEQ ID NO: 2519299 - DNA, 13 bp, Homo sapiens
gggctccagacac

SEQ ID NO: 2519300 - DNA, 21 bp, Homo sapiens
gggctccctgtaacctcttca

SEQ ID NO: 2519301 - DNA, 13 bp, Homo sapiens
gggctcccttcat

SEQ ID NO: 2519302 - DNA, 17 bp, Homo sapiens
gggctcccttcccacct

SEQ ID NO: 2519303 - DNA, 18 bp, Homo sapiens
gggctcccttcccacctc

SEQ ID NO: 2519304 - DNA, 20 bp, Homo sapiens
gggctcctggaaaggctcag

SEQ ID NO: 2519305 - DNA, 23 bp, Homo sapiens
gggctcctggaaaggctcagtct

SEQ ID NO: 2519306 - DNA, 18 bp, Homo sapiens
gggctcctttctccagcc

SEQ ID NO: 2519307 - DNA, 22 bp, Homo sapiens
gggctcctttctccagccagca

SEQ ID NO: 2519308 - DNA, 14 bp, Homo sapiens
gggctcgccatgcc

SEQ ID NO: 2519309 - DNA, 14 bp, Homo sapiens
gggctcggaggctg

SEQ ID NO: 2519310 - DNA, 15 bp, Homo sapiens
gggctcggaggctgc

SEQ ID NO: 2519311 - DNA, 13 bp, Homo sapiens
gggctctcagctc

SEQ ID NO: 2519312 - DNA, 23 bp, Homo sapiens
gggctctgcaattcccctctgct

SEQ ID NO: 2519313 - DNA, 15 bp, Homo sapiens
gggctctgccaccct

SEQ ID NO: 2519314 - DNA, 11 bp, Homo sapiens
gggctctgccc

SEQ ID NO: 2519315 - DNA, 20 bp, Homo sapiens
gggctctgccccagctctgg

SEQ ID NO: 2519316 - DNA, 13 bp, Homo sapiens
gggctctgcctcc

SEQ ID NO: 2519317 - DNA, 17 bp, Homo sapiens
gggctgaaggttgaaga

SEQ ID NO: 2519318 - DNA, 20 bp, Homo sapiens
gggctgaccttcctcgcaga

SEQ ID NO: 2519319 - DNA, 18 bp, Homo sapiens
gggctgagagaacctcac

SEQ ID NO: 2519320 - DNA, 23 bp, Homo sapiens
gggctgagcccctaccccacacc

SEQ ID NO: 2519321 - DNA, 13 bp, Homo sapiens
gggctgagccctg

SEQ ID NO: 2519322 - DNA, 15 bp, Homo sapiens
gggctgagccctggc

SEQ ID NO: 2519323 - DNA, 16 bp, Homo sapiens
gggctgagccctggca

SEQ ID NO: 2519324 - DNA, 17 bp, Homo sapiens
gggctgagccctggcag

SEQ ID NO: 2519325 - DNA, 18 bp, Homo sapiens
gggctgagccctggcagg

SEQ ID NO: 2519326 - DNA, 17 bp, Homo sapiens
gggctgcaccggctggc

SEQ ID NO: 2519327 - DNA, 19 bp, Homo sapiens
gggctgcaccggctggcct

SEQ ID NO: 2519328 - DNA, 12 bp, Homo sapiens
gggctgccctgc

SEQ ID NO: 2519329 - DNA, 13 bp, Homo sapiens
gggctgccctgcc

SEQ ID NO: 2519330 - DNA, 15 bp, Homo sapiens
gggctgcctgggctg

SEQ ID NO: 2519331 - DNA, 21 bp, Homo sapiens
gggctgcctgggctgttggca

SEQ ID NO: 2519332 - DNA, 11 bp, Homo sapiens
gggctgctcct

SEQ ID NO: 2519333 - DNA, 12 bp, Homo sapiens
gggctgctgtga

SEQ ID NO: 2519334 - DNA, 12 bp, Homo sapiens
gggctggcccag

SEQ ID NO: 2519335 - DNA, 19 bp, Homo sapiens
gggctggcccagccctgct

SEQ ID NO: 2519336 - DNA, 14 bp, Homo sapiens
gggctgggcagcta

SEQ ID NO: 2519337 - DNA, 17 bp, Homo sapiens
gggctggtgccagcctt

SEQ ID NO: 2519338 - DNA, 19 bp, Homo sapiens
gggctgtccagttcccaga

SEQ ID NO: 2519339 - DNA, 15 bp, Homo sapiens
gggcttaagaaatct

SEQ ID NO: 2519340 - DNA, 13 bp, Homo sapiens
gggcttagagcag

SEQ ID NO: 2519341 - DNA, 15 bp, Homo sapiens
gggcttcagtggcag

SEQ ID NO: 2519342 - DNA, 20 bp, Homo sapiens
gggcttcagtggcagctgct

SEQ ID NO: 2519343 - DNA, 20 bp, Homo sapiens
gggcttcccagtggctgctg

SEQ ID NO: 2519344 - DNA, 16 bp, Homo sapiens
gggcttctgcaccctc

SEQ ID NO: 2519345 - DNA, 17 bp, Homo sapiens
gggcttctgcaccctcc

SEQ ID NO: 2519346 - DNA, 19 bp, Homo sapiens
gggcttgcaagtatgtttt

SEQ ID NO: 2519347 - DNA, 19 bp, Homo sapiens
ggggaaaatcagcctgctc

SEQ ID NO: 2519348 - DNA, 22 bp, Homo sapiens
ggggacagaggcctgcccgggc

SEQ ID NO: 2519349 - DNA, 20 bp, Homo sapiens
ggggacagctccttctgtcc

SEQ ID NO: 2519350 - DNA, 22 bp, Homo sapiens
ggggacagggctggcccagccc

SEQ ID NO: 2519351 - DNA, 13 bp, Homo sapiens
ggggacccccgcc

SEQ ID NO: 2519352 - DNA, 23 bp, Homo sapiens
ggggacggggggccccagtcagc

SEQ ID NO: 2519353 - DNA, 18 bp, Homo sapiens
ggggagactgggctgagg

SEQ ID NO: 2519354 - DNA, 16 bp, Homo sapiens
ggggaggggcgctggc

SEQ ID NO: 2519355 - DNA, 20 bp, Homo sapiens
ggggaggggcgctggcccag

SEQ ID NO: 2519356 - DNA, 17 bp, Homo sapiens
ggggagtctgaagcaga

SEQ ID NO: 2519357 - DNA, 18 bp, Homo sapiens
ggggatgtgggagggagc

SEQ ID NO: 2519358 - DNA, 17 bp, Homo sapiens
ggggcactgcaggggcc

SEQ ID NO: 2519359 - DNA, 17 bp, Homo sapiens
ggggcagaacagccgct

SEQ ID NO: 2519360 - DNA, 13 bp, Homo sapiens
ggggcagctgacc

SEQ ID NO: 2519361 - DNA, 11 bp, Homo sapiens
ggggcaggcag

SEQ ID NO: 2519362 - DNA, 13 bp, Homo sapiens
ggggcagtggcaa

SEQ ID NO: 2519363 - DNA, 14 bp, Homo sapiens
ggggcatctgcccc

SEQ ID NO: 2519364 - DNA, 16 bp, Homo sapiens
ggggcatgctggggca

SEQ ID NO: 2519365 - DNA, 16 bp, Homo sapiens
ggggccacacagaaac

SEQ ID NO: 2519366 - DNA, 12 bp, Homo sapiens
ggggccagagga

SEQ ID NO: 2519367 - DNA, 23 bp, Homo sapiens
ggggccagaggaactgtccagag

SEQ ID NO: 2519368 - DNA, 21 bp, Homo sapiens
ggggccatgagctccagaccc

SEQ ID NO: 2519369 - DNA, 16 bp, Homo sapiens
ggggccatgaggcctc

SEQ ID NO: 2519370 - DNA, 22 bp, Homo sapiens
ggggcccaaggcggcccctccc

SEQ ID NO: 2519371 - DNA, 14 bp, Homo sapiens
ggggccccagggct

SEQ ID NO: 2519372 - DNA, 19 bp, Homo sapiens
ggggccccagtcagcctct

SEQ ID NO: 2519373 - DNA, 17 bp, Homo sapiens
gtaatagattatagttg

SEQ ID NO: 2519374 - DNA, 18 bp, Homo sapiens
gtaatatttatatattta

SEQ ID NO: 2519375 - DNA, 14 bp, Homo sapiens
gtaatcaatgtttc

SEQ ID NO: 2519376 - DNA, 20 bp, Homo sapiens
gtaatcatttcttgggccct

SEQ ID NO: 2519377 - DNA, 15 bp, Homo sapiens
gtaatccacctgcct

SEQ ID NO: 2519378 - DNA, 14 bp, Homo sapiens
gtaatcccagcact

SEQ ID NO: 2519379 - DNA, 16 bp, Homo sapiens
gtaatcccagcacttt

SEQ ID NO: 2519380 - DNA, 18 bp, Homo sapiens
gtaatcccgccacctatc

SEQ ID NO: 2519381 - DNA, 18 bp, Homo sapiens
gtaatcgttatgtgtgta

SEQ ID NO: 2519382 - DNA, 16 bp, Homo sapiens
gtaatctcgtttcaaa

SEQ ID NO: 2519383 - DNA, 20 bp, Homo sapiens
gtaatctcgtttcaaaaaca

SEQ ID NO: 2519384 - DNA, 16 bp, Homo sapiens
gtaatctgatggcttc

SEQ ID NO: 2519385 - DNA, 21 bp, Homo sapiens
gtaatgaatttttatgatatt

SEQ ID NO: 2519386 - DNA, 14 bp, Homo sapiens
gtaatgagggactg

SEQ ID NO: 2519387 - DNA, 15 bp, Homo sapiens
gtaatgagggactgg

SEQ ID NO: 2519388 - DNA, 18 bp, Homo sapiens
gtaatgatgtcgtttgaa

SEQ ID NO: 2519389 - DNA, 18 bp, Homo sapiens
gtaatgctacgtgtgatt

SEQ ID NO: 2519390 - DNA, 20 bp, Homo sapiens
gtaatgctacgtgtgatttt

SEQ ID NO: 2519391 - DNA, 22 bp, Homo sapiens
gtaatgctacgtgtgatttttc

SEQ ID NO: 2519392 - DNA, 13 bp, Homo sapiens
gtaatgttactga

SEQ ID NO: 2519393 - DNA, 22 bp, Homo sapiens
gtccttgcacactcccctgcac

SEQ ID NO: 2519394 - DNA, 19 bp, Homo sapiens
gtccttgcacccctcactc

SEQ ID NO: 2519395 - DNA, 22 bp, Homo sapiens
gtccttggtgtgaccctctgaa

SEQ ID NO: 2519396 - DNA, 22 bp, Homo sapiens
gtcctttccaaggcttctccaa

SEQ ID NO: 2519397 - DNA, 17 bp, Homo sapiens
gtcgaattaatagcttt

SEQ ID NO: 2519398 - DNA, 16 bp, Homo sapiens
gtcgaggggctctcag

SEQ ID NO: 2519399 - DNA, 14 bp, Homo sapiens
gtcgataatcagag

SEQ ID NO: 2519400 - DNA, 19 bp, Homo sapiens
gtcgccacctggcattcct

SEQ ID NO: 2519401 - DNA, 13 bp, Homo sapiens
gtcgcccaggaga

SEQ ID NO: 2519402 - DNA, 12 bp, Homo sapiens
gtcgcctctgca

SEQ ID NO: 2519403 - DNA, 20 bp, Homo sapiens
gtcgccttagcatgtttgct

SEQ ID NO: 2519404 - DNA, 21 bp, Homo sapiens
gtcggaaaacatgctacacac

SEQ ID NO: 2519405 - DNA, 14 bp, Homo sapiens
gtcggaggcttggg

SEQ ID NO: 2519406 - DNA, 17 bp, Homo sapiens
gtcggaggcttgggacc

SEQ ID NO: 2519407 - DNA, 15 bp, Homo sapiens
gtcgggggctggcct

SEQ ID NO: 2519408 - DNA, 16 bp, Homo sapiens
gtcgggggctggccta

SEQ ID NO: 2519409 - DNA, 15 bp, Homo sapiens
gtcgtcgcacagtct

SEQ ID NO: 2519410 - DNA, 19 bp, Homo sapiens
gtcgtcgcacagtctctct

SEQ ID NO: 2519411 - DNA, 15 bp, Homo sapiens
gtcgtggcagataat

SEQ ID NO: 2519412 - DNA, 23 bp, Homo sapiens
gtcgtggcagataatcagcctct

SEQ ID NO: 2519413 - DNA, 14 bp, Homo sapiens
gtcgtgggtgtgtg

SEQ ID NO: 2519414 - DNA, 17 bp, Homo sapiens
gtcgttgactttaggga

SEQ ID NO: 2519415 - DNA, 14 bp, Homo sapiens
gtctaaaaataaaa

SEQ ID NO: 2519416 - DNA, 13 bp, Homo sapiens
gtctaaatatttc

SEQ ID NO: 2519417 - DNA, 23 bp, Homo sapiens
gtctaaatatttccttaaactgt

SEQ ID NO: 2519418 - DNA, 15 bp, Homo sapiens
gtctaaatgctgaaa

SEQ ID NO: 2519419 - DNA, 13 bp, Homo sapiens
gtctacccagaga

SEQ ID NO: 2519420 - DNA, 20 bp, Homo sapiens
gtctacccagagaagcccct

SEQ ID NO: 2519421 - DNA, 17 bp, Homo sapiens
gtctagaagttgtttgt

SEQ ID NO: 2519422 - DNA, 19 bp, Homo sapiens
gtctagttaacatttcaag

SEQ ID NO: 2519423 - DNA, 17 bp, Homo sapiens
gtctatatgaaaaacaa

SEQ ID NO: 2519424 - DNA, 15 bp, Homo sapiens
gtctatccacagaga

SEQ ID NO: 2519425 - DNA, 21 bp, Homo sapiens
gtctatgacttatttccttca

SEQ ID NO: 2519426 - DNA, 10 bp, Homo sapiens
gtctatttaa

SEQ ID NO: 2519427 - DNA, 12 bp, Homo sapiens
gtctatttaagc

SEQ ID NO: 2519428 - DNA, 16 bp, Homo sapiens
gtctatttttgtctta

SEQ ID NO: 2519429 - DNA, 16 bp, Homo sapiens
gtctcaaactcctggg

SEQ ID NO: 2519430 - DNA, 20 bp, Homo sapiens
gtctcaaactcctgggctca

SEQ ID NO: 2519431 - DNA, 18 bp, Homo sapiens
gtctcactatgttgccca

SEQ ID NO: 2519432 - DNA, 15 bp, Homo sapiens
gtctcactctgtcgc

SEQ ID NO: 2519433 - DNA, 19 bp, Homo sapiens
gtctcactctgtcgcccag

SEQ ID NO: 2519434 - DNA, 15 bp, Homo sapiens
gtctcactgaaacat

SEQ ID NO: 2519435 - DNA, 21 bp, Homo sapiens
gtctcactgaaacatttaaat

SEQ ID NO: 2519436 - DNA, 22 bp, Homo sapiens
gtctcactgtgggaaggccagc

SEQ ID NO: 2519437 - DNA, 23 bp, Homo sapiens
gtctcactgtgggaaggccagct

SEQ ID NO: 2519438 - DNA, 19 bp, Homo sapiens
gtctcactgttgcccaggc

SEQ ID NO: 2519439 - DNA, 22 bp, Homo sapiens
gtctcactgttgcccaggctgg

SEQ ID NO: 2519440 - DNA, 23 bp, Homo sapiens
gtctcactgttgcccaggctggc

SEQ ID NO: 2519441 - DNA, 21 bp, Homo sapiens
gtctcagcagcgaccacccct

SEQ ID NO: 2519442 - DNA, 13 bp, Homo sapiens
gtctcagcctccc

SEQ ID NO: 2519443 - DNA, 15 bp, Homo sapiens
gtctcaggtccctgc

SEQ ID NO: 2519444 - DNA, 16 bp, Homo sapiens
gtctcaggtccctgca

SEQ ID NO: 2519445 - DNA, 18 bp, Homo sapiens
gtctcagtggcttcatct

SEQ ID NO: 2519446 - DNA, 19 bp, Homo sapiens
gtctcagtttgtgtgtctt

SEQ ID NO: 2519447 - DNA, 15 bp, Homo sapiens
gtctcatccatcatc

SEQ ID NO: 2519448 - DNA, 16 bp, Homo sapiens
gtctcatccccagggg

SEQ ID NO: 2519449 - DNA, 17 bp, Homo sapiens
gtctccagacccccacc

SEQ ID NO: 2519450 - DNA, 20 bp, Homo sapiens
gtctccagacccccacccct

SEQ ID NO: 2519451 - DNA, 18 bp, Homo sapiens
gtctccagtggttgctgt

SEQ ID NO: 2519452 - DNA, 13 bp, Homo sapiens
gtctccatgtttg

SEQ ID NO: 2519453 - DNA, 16 bp, Homo sapiens
gtctccctggagtgca

SEQ ID NO: 2519454 - DNA, 13 bp, Homo sapiens
gtctcccttctcc

SEQ ID NO: 2519455 - DNA, 18 bp, Homo sapiens
gtctccctttcccttctt

SEQ ID NO: 2519456 - DNA, 15 bp, Homo sapiens
gtctcctcactccct

SEQ ID NO: 2519457 - DNA, 23 bp, Homo sapiens
gtctcctcagcctcctcatctgg

SEQ ID NO: 2519458 - DNA, 14 bp, Homo sapiens
gtctcctcttaaaa

SEQ ID NO: 2519459 - DNA, 21 bp, Homo sapiens
gtctcctgtgcccacatccca

SEQ ID NO: 2519460 - DNA, 16 bp, Homo sapiens
gtctccttaacactga

SEQ ID NO: 2519461 - DNA, 21 bp, Homo sapiens
gtctcctttctcagccacaaa

SEQ ID NO: 2519462 - DNA, 18 bp, Homo sapiens
gtctcctttgcactgagg

SEQ ID NO: 2519463 - DNA, 16 bp, Homo sapiens
gtctcgctttgttgcc

SEQ ID NO: 2519464 - DNA, 23 bp, Homo sapiens
gtctcgctttgttgcccaggctg

SEQ ID NO: 2519465 - DNA, 14 bp, Homo sapiens
gtctctagccactt

SEQ ID NO: 2519466 - DNA, 14 bp, Homo sapiens
gtctctaggctggg

SEQ ID NO: 2519467 - DNA, 17 bp, Homo sapiens
gtctctaggctggggaa

SEQ ID NO: 2519468 - DNA, 17 bp, Homo sapiens
gtctctagtgctgtgaa

SEQ ID NO: 2519469 - DNA, 18 bp, Homo sapiens
gtctctagtgctgtgaaa

SEQ ID NO: 2519470 - DNA, 23 bp, Homo sapiens
gtctctctcccatggagccccag

SEQ ID NO: 2519471 - DNA, 12 bp, Homo sapiens
gtctctgctgaa

SEQ ID NO: 2519472 - DNA, 12 bp, Homo sapiens
gtctctgctgcc

SEQ ID NO: 2519473 - DNA, 13 bp, Homo sapiens
gtctctgctggcc

SEQ ID NO: 2519474 - DNA, 20 bp, Homo sapiens
gtctctgctggcccagccaa

SEQ ID NO: 2519475 - DNA, 12 bp, Homo sapiens
gtctctggcctg

SEQ ID NO: 2519476 - DNA, 13 bp, Homo sapiens
gtctcttggtcct

SEQ ID NO: 2519477 - DNA, 18 bp, Homo sapiens
gtctcttggtcctgctgc

SEQ ID NO: 2519478 - DNA, 19 bp, Homo sapiens
gtctcttggtcctgctgca

SEQ ID NO: 2519479 - DNA, 16 bp, Homo sapiens
gtctgaagtggttgtt

SEQ ID NO: 2519480 - DNA, 12 bp, Homo sapiens
gtctgacaggca

SEQ ID NO: 2519481 - DNA, 13 bp, Homo sapiens
gtctgacaggcaa

SEQ ID NO: 2519482 - DNA, 14 bp, Homo sapiens
gtctgacaggcaat

SEQ ID NO: 2519483 - DNA, 16 bp, Homo sapiens
gtgaccaaaatcccct

SEQ ID NO: 2519484 - DNA, 22 bp, Homo sapiens
gtgaccaactagacattctgtc

SEQ ID NO: 2519485 - DNA, 23 bp, Homo sapiens
gtgaccaactagacattctgtcg

SEQ ID NO: 2519486 - DNA, 19 bp, Homo sapiens
gtgaccaagttataaatca

SEQ ID NO: 2519487 - DNA, 15 bp, Homo sapiens
gtgacccggaggcca

SEQ ID NO: 2519488 - DNA, 13 bp, Homo sapiens
gtgaccctctgaa

SEQ ID NO: 2519489 - DNA, 21 bp, Homo sapiens
gtgaccctctgaatggtccag

SEQ ID NO: 2519490 - DNA, 13 bp, Homo sapiens
gtgacctctgcct

SEQ ID NO: 2519491 - DNA, 14 bp, Homo sapiens
gtgacctctgcctg

SEQ ID NO: 2519492 - DNA, 14 bp, Homo sapiens
gtgacctgaagttc

SEQ ID NO: 2519493 - DNA, 14 bp, Homo sapiens
gtgacctgaggaag

SEQ ID NO: 2519494 - DNA, 13 bp, Homo sapiens
gtgacctgagggc

SEQ ID NO: 2519495 - DNA, 15 bp, Homo sapiens
gtgaccttagtgttt

SEQ ID NO: 2519496 - DNA, 22 bp, Homo sapiens
gtgaccttagtgtttctgtgca

SEQ ID NO: 2519497 - DNA, 23 bp, Homo sapiens
gtgaccttagtgtttctgtgcat

SEQ ID NO: 2519498 - DNA, 17 bp, Homo sapiens
gtgacgcctgccctccc

SEQ ID NO: 2519499 - DNA, 22 bp, Homo sapiens
gtgacggtcccacactggtgac

SEQ ID NO: 2519500 - DNA, 14 bp, Homo sapiens
gtgactatgaactt

SEQ ID NO: 2519501 - DNA, 14 bp, Homo sapiens
gtgactctgaagct

SEQ ID NO: 2519502 - DNA, 16 bp, Homo sapiens
gtgacttcagctctgt

SEQ ID NO: 2519503 - DNA, 22 bp, Homo sapiens
gtgacttgcatcgtggagacag

SEQ ID NO: 2519504 - DNA, 17 bp, Homo sapiens
gtgagaaaaagctcctg

SEQ ID NO: 2519505 - DNA, 22 bp, Homo sapiens
gtgagaataagagagtcataaa

SEQ ID NO: 2519506 - DNA, 15 bp, Homo sapiens
gtgagacccccacac

SEQ ID NO: 2519507 - DNA, 14 bp, Homo sapiens
gtgagactctgtct

SEQ ID NO: 2519508 - DNA, 13 bp, Homo sapiens
gtgagagctgggt

SEQ ID NO: 2519509 - DNA, 15 bp, Homo sapiens
gtgagatgtaattgt

SEQ ID NO: 2519510 - DNA, 21 bp, Homo sapiens
gtgagcacggccaacaaagct

SEQ ID NO: 2519511 - DNA, 21 bp, Homo sapiens
gtgagcactaaggtgtgctct

SEQ ID NO: 2519512 - DNA, 16 bp, Homo sapiens
gtgagcactcccaagt

SEQ ID NO: 2519513 - DNA, 20 bp, Homo sapiens
gtgagcagaagtggagctgg

SEQ ID NO: 2519514 - DNA, 22 bp, Homo sapiens
gtgagcattgtggctgtcagca

SEQ ID NO: 2519515 - DNA, 14 bp, Homo sapiens
gtgagccactgcac

SEQ ID NO: 2519516 - DNA, 20 bp, Homo sapiens
gtgagccactgcaccgggcc

SEQ ID NO: 2519517 - DNA, 14 bp, Homo sapiens
gtgagcccctggtc

SEQ ID NO: 2519518 - DNA, 19 bp, Homo sapiens
gtgagccgagatcacgcca

SEQ ID NO: 2519519 - DNA, 16 bp, Homo sapiens
gtgagcggagatcgca

SEQ ID NO: 2519520 - DNA, 16 bp, Homo sapiens
gtgagctcctaagcca

SEQ ID NO: 2519521 - DNA, 20 bp, Homo sapiens
gtgaggaatagttgagcccc

SEQ ID NO: 2519522 - DNA, 11 bp, Homo sapiens
gtgaggagctg

SEQ ID NO: 2519523 - DNA, 14 bp, Homo sapiens
gtgaggagctgctg

SEQ ID NO: 2519524 - DNA, 22 bp, Homo sapiens
gtgaggatgtcactcagatgga

SEQ ID NO: 2519525 - DNA, 17 bp, Homo sapiens
gtgaggccagggcagag

SEQ ID NO: 2519526 - DNA, 18 bp, Homo sapiens
gtgaggctctgcccttgg

SEQ ID NO: 2519527 - DNA, 22 bp, Homo sapiens
gtgagggcttgtcattaccaga

SEQ ID NO: 2519528 - DNA, 18 bp, Homo sapiens
gtgagggtcagagaggag

SEQ ID NO: 2519529 - DNA, 19 bp, Homo sapiens
gtgagggtttctgagctgc

SEQ ID NO: 2519530 - DNA, 15 bp, Homo sapiens
gtgagtaagagctgg

SEQ ID NO: 2519531 - DNA, 17 bp, Homo sapiens
gtgagtactacagtcct

SEQ ID NO: 2519532 - DNA, 23 bp, Homo sapiens
gtgagtactacagtcctcccatc

SEQ ID NO: 2519533 - DNA, 17 bp, Homo sapiens
gtgagtcaccaagccca

SEQ ID NO: 2519534 - DNA, 15 bp, Homo sapiens
gtgagtcgaggacag

SEQ ID NO: 2519535 - DNA, 17 bp, Homo sapiens
gtgagtcttggcggcag

SEQ ID NO: 2519536 - DNA, 18 bp, Homo sapiens
gtgagtcttggcggcagc

SEQ ID NO: 2519537 - DNA, 20 bp, Homo sapiens
gtgagtcttggcggcagcag

SEQ ID NO: 2519538 - DNA, 16 bp, Homo sapiens
gtgagtgtaagtgtga

SEQ ID NO: 2519539 - DNA, 13 bp, Homo sapiens
gtgagtgtgtgca

SEQ ID NO: 2519540 - DNA, 15 bp, Homo sapiens
gtgagttctcagggc

SEQ ID NO: 2519541 - DNA, 17 bp, Homo sapiens
gtgagttctcagggctc

SEQ ID NO: 2519542 - DNA, 18 bp, Homo sapiens
gtgagttctcagggctcc

SEQ ID NO: 2519543 - DNA, 18 bp, Homo sapiens
gtgatagctaacatttta

SEQ ID NO: 2519544 - DNA, 13 bp, Homo sapiens
gtgatatggagcc

SEQ ID NO: 2519545 - DNA, 16 bp, Homo sapiens
gtgatatggcagaaga

SEQ ID NO: 2519546 - DNA, 18 bp, Homo sapiens
gtgatccacccacctcag

SEQ ID NO: 2519547 - DNA, 22 bp, Homo sapiens
gtgatccacccacctcagcctc

SEQ ID NO: 2519548 - DNA, 20 bp, Homo sapiens
gtgatcctcccacctcagcc

SEQ ID NO: 2519549 - DNA, 13 bp, Homo sapiens
gtgatctccatat

SEQ ID NO: 2519550 - DNA, 14 bp, Homo sapiens
gtgatgaactttct

SEQ ID NO: 2519551 - DNA, 14 bp, Homo sapiens
gtgatgaatactgt

SEQ ID NO: 2519552 - DNA, 22 bp, Homo sapiens
gtgatgatcagctgtttgtcat

SEQ ID NO: 2519553 - DNA, 17 bp, Homo sapiens
gtgatgccacacagagt

SEQ ID NO: 2519554 - DNA, 15 bp, Homo sapiens
gtgatgccaggttct

SEQ ID NO: 2519555 - DNA, 23 bp, Homo sapiens
gtgatgccaggttctatttggaa

SEQ ID NO: 2519556 - DNA, 12 bp, Homo sapiens
gtgatgcggcag

SEQ ID NO: 2519557 - DNA, 22 bp, Homo sapiens
gtgatgctaaaggttgtattgc

SEQ ID NO: 2519558 - DNA, 14 bp, Homo sapiens
gtgatggggccctg

SEQ ID NO: 2519559 - DNA, 17 bp, Homo sapiens
gtgatggggccctgcct

SEQ ID NO: 2519560 - DNA, 14 bp, Homo sapiens
gtgatgtttgtcct

SEQ ID NO: 2519561 - DNA, 14 bp, Homo sapiens
gtgattaaacgtgc

SEQ ID NO: 2519562 - DNA, 19 bp, Homo sapiens
gtgattaaacgtgcagact

SEQ ID NO: 2519563 - DNA, 17 bp, Homo sapiens
gtgattacataatctgt

SEQ ID NO: 2519564 - DNA, 16 bp, Homo sapiens
gtgattctcctgcctc

SEQ ID NO: 2519565 - DNA, 20 bp, Homo sapiens
gtgattctcctgcctcagcc

SEQ ID NO: 2519566 - DNA, 16 bp, Homo sapiens
gtgattgggacagagg

SEQ ID NO: 2519567 - DNA, 15 bp, Homo sapiens
gtgatttaatagtgt

SEQ ID NO: 2519568 - DNA, 16 bp, Homo sapiens
gtgatttaatagtgtt

SEQ ID NO: 2519569 - DNA, 20 bp, Homo sapiens
gtgatttaatagtgttaatc

SEQ ID NO: 2519570 - DNA, 21 bp, Homo sapiens
gtgatttagaactgtatgtca

SEQ ID NO: 2519571 - DNA, 23 bp, Homo sapiens
gtgatttagaactgtatgtcaga

SEQ ID NO: 2519572 - DNA, 19 bp, Homo sapiens
gtgatttgactgtttttac

SEQ ID NO: 2519573 - DNA, 12 bp, Homo sapiens
gtgattttcatt

SEQ ID NO: 2519574 - DNA, 22 bp, Homo sapiens
gtgcaacccaaggactgaggga

SEQ ID NO: 2519575 - DNA, 14 bp, Homo sapiens
gtgcaacccttacc

SEQ ID NO: 2519576 - DNA, 22 bp, Homo sapiens
gtgcaagagactctggcctcca

SEQ ID NO: 2519577 - DNA, 17 bp, Homo sapiens
gtgcaagtgtctgtgtg

SEQ ID NO: 2519578 - DNA, 14 bp, Homo sapiens
gtgcaagtgtgtgc

SEQ ID NO: 2519579 - DNA, 22 bp, Homo sapiens
gtgcaagtgtgtgcacatgtgt

SEQ ID NO: 2519580 - DNA, 20 bp, Homo sapiens
gtgcaagtgtgtgcatgtgt

SEQ ID NO: 2519581 - DNA, 15 bp, Homo sapiens
gtgcacaaatattta

SEQ ID NO: 2519582 - DNA, 21 bp, Homo sapiens
gtgcacaagctccaagctccc

SEQ ID NO: 2519583 - DNA, 14 bp, Homo sapiens
gtgcacacaccaga

SEQ ID NO: 2519584 - DNA, 18 bp, Homo sapiens
gtgcacatctgtgtcttg

SEQ ID NO: 2519585 - DNA, 23 bp, Homo sapiens
gtgcacccatgggctctgacaga

SEQ ID NO: 2519586 - DNA, 18 bp, Homo sapiens
gtgcacctgtactcagga

SEQ ID NO: 2519587 - DNA, 21 bp, Homo sapiens
gtgcaccttaccaactttctg

SEQ ID NO: 2519588 - DNA, 16 bp, Homo sapiens
gtgcacgtggagagct

SEQ ID NO: 2519589 - DNA, 18 bp, Homo sapiens
gtgcacgtggagagctgg

SEQ ID NO: 2519590 - DNA, 21 bp, Homo sapiens
gtgcacgtggagagctggtgc

SEQ ID NO: 2519591 - DNA, 21 bp, Homo sapiens
gtgcacgtggcatgtggcctg

SEQ ID NO: 2519592 - DNA, 15 bp, Homo sapiens
gtgcactgtcacttt

SEQ ID NO: 2519593 - DNA, 23 bp, Homo sapiens
gtgcactgtcactttgctctggg

SEQ ID NO: 2519594 - DNA, 19 bp, Homo sapiens
gtgcagcccccactgcctt

SEQ ID NO: 2519595 - DNA, 17 bp, Homo sapiens
gtgcagccgctgagcga

SEQ ID NO: 2519596 - DNA, 13 bp, Homo sapiens
gtgcagctgattt

SEQ ID NO: 2519597 - DNA, 12 bp, Homo sapiens
gtgcagtctggg

SEQ ID NO: 2519598 - DNA, 22 bp, Homo sapiens
gtgcagttcccccaacctcaga

SEQ ID NO: 2519599 - DNA, 24 bp, Homo sapiens
gtgcagttcccccaacctcagact

SEQ ID NO: 2519600 - DNA, 20 bp, Homo sapiens
gtgcagttctagtttgcatt

SEQ ID NO: 2519601 - DNA, 19 bp, Homo sapiens
gtgcataagttaacttcca

SEQ ID NO: 2519602 - DNA, 14 bp, Homo sapiens
gtgcataccacttt

SEQ ID NO: 2519603 - DNA, 21 bp, Homo sapiens
gtgcatattcctttctatcat

SEQ ID NO: 2519604 - DNA, 15 bp, Homo sapiens
gtgcatattgtacac

SEQ ID NO: 2519605 - DNA, 18 bp, Homo sapiens
gtgcatattgtacacttt

SEQ ID NO: 2519606 - DNA, 20 bp, Homo sapiens
gtgcatattgtacacttttt

SEQ ID NO: 2519607 - DNA, 12 bp, Homo sapiens
gtgcatccaaag

SEQ ID NO: 2519608 - DNA, 20 bp, Homo sapiens
gtgcatccgggggcagctct

SEQ ID NO: 2519609 - DNA, 18 bp, Homo sapiens
gtgcatgatcttgagcaa

SEQ ID NO: 2519610 - DNA, 14 bp, Homo sapiens
gtgcatgtgtgtgc

SEQ ID NO: 2519611 - DNA, 19 bp, Homo sapiens
gtgcattatctagatactg

SEQ ID NO: 2519612 - DNA, 21 bp, Homo sapiens
gtgcatttgaggtctgttctt

SEQ ID NO: 2519613 - DNA, 21 bp, Homo sapiens
gtgcatttggtggtttcagaa

SEQ ID NO: 2519614 - DNA, 17 bp, Homo sapiens
gtgcattttcccagata

SEQ ID NO: 2519615 - DNA, 16 bp, Homo sapiens
gtgcatttttgtgaaa

SEQ ID NO: 2519616 - DNA, 18 bp, Homo sapiens
gtgccaacactcaagaag

SEQ ID NO: 2519617 - DNA, 17 bp, Homo sapiens
gtgccaagcacagtgcc

SEQ ID NO: 2519618 - DNA, 15 bp, Homo sapiens
gtgccaatatgtatt

SEQ ID NO: 2519619 - DNA, 17 bp, Homo sapiens
gtgccaatatgtattgt

SEQ ID NO: 2519620 - DNA, 21 bp, Homo sapiens
gtgccaatatgtattgtaaac

SEQ ID NO: 2519621 - DNA, 21 bp, Homo sapiens
gtgccaatttcaagttccaag

SEQ ID NO: 2519622 - DNA, 13 bp, Homo sapiens
gtgctggtgtcct

SEQ ID NO: 2519623 - DNA, 15 bp, Homo sapiens
gtgctggtgtcctga

SEQ ID NO: 2519624 - DNA, 23 bp, Homo sapiens
gtgctggtgtcctgaccaccctc

SEQ ID NO: 2519625 - DNA, 13 bp, Homo sapiens
gtgctgtggaagc

SEQ ID NO: 2519626 - DNA, 14 bp, Homo sapiens
gtgctgtggaagca

SEQ ID NO: 2519627 - DNA, 15 bp, Homo sapiens
gtgctgtggccaggg

SEQ ID NO: 2519628 - DNA, 16 bp, Homo sapiens
gtgctgtggccagggt

SEQ ID NO: 2519629 - DNA, 14 bp, Homo sapiens
gtgctgtggggctg

SEQ ID NO: 2519630 - DNA, 19 bp, Homo sapiens
gtgctgtggggctggtagc

SEQ ID NO: 2519631 - DNA, 23 bp, Homo sapiens
gtgctgtggggctggtagctcag

SEQ ID NO: 2519632 - DNA, 17 bp, Homo sapiens
gtgcttaagcagaagca

SEQ ID NO: 2519633 - DNA, 21 bp, Homo sapiens
gtgcttatcccatagccagga

SEQ ID NO: 2519634 - DNA, 13 bp, Homo sapiens
gtgcttcagcctg

SEQ ID NO: 2519635 - DNA, 18 bp, Homo sapiens
gtgcttcagcctgaggct

SEQ ID NO: 2519636 - DNA, 12 bp, Homo sapiens
gtgcttggagga

SEQ ID NO: 2519637 - DNA, 22 bp, Homo sapiens
gtgcttgtttgctcacctgggg

SEQ ID NO: 2519638 - DNA, 20 bp, Homo sapiens
gtgctttccagctcaccccc

SEQ ID NO: 2519639 - DNA, 22 bp, Homo sapiens
gtgctttccgtggcactgcata

SEQ ID NO: 2519640 - DNA, 17 bp, Homo sapiens
gtgcttttcctatttgt

SEQ ID NO: 2519641 - DNA, 12 bp, Homo sapiens
gtggaaaaatat

SEQ ID NO: 2519642 - DNA, 15 bp, Homo sapiens
gtggaaaaatattta

SEQ ID NO: 2519643 - DNA, 14 bp, Homo sapiens
gtggaaagcctctg

SEQ ID NO: 2519644 - DNA, 13 bp, Homo sapiens
gtggaaagggtgc

SEQ ID NO: 2519645 - DNA, 16 bp, Homo sapiens
gtggaaagtgaatttg

SEQ ID NO: 2519646 - DNA, 21 bp, Homo sapiens
gtggaaagtgtaaagcattcc

SEQ ID NO: 2519647 - DNA, 18 bp, Homo sapiens
gtggaaattaagaagaaa

SEQ ID NO: 2519648 - DNA, 21 bp, Homo sapiens
gtggaaattaagaagaaacta

SEQ ID NO: 2519649 - DNA, 15 bp, Homo sapiens
gtggaagaggggaca

SEQ ID NO: 2519650 - DNA, 20 bp, Homo sapiens
gtggaagaggggacaggtcc

SEQ ID NO: 2519651 - DNA, 22 bp, Homo sapiens
gtggaagtgtgggtctgtgtgt

SEQ ID NO: 2519652 - DNA, 22 bp, Homo sapiens
gtggacacagctcttctccagg

SEQ ID NO: 2519653 - DNA, 16 bp, Homo sapiens
gtggacagtcctggga

SEQ ID NO: 2519654 - DNA, 21 bp, Homo sapiens
gtggactccagactctctgtg

SEQ ID NO: 2519655 - DNA, 14 bp, Homo sapiens
gtggactctgcaca

SEQ ID NO: 2519656 - DNA, 17 bp, Homo sapiens
gtggactttccaccccc

SEQ ID NO: 2519657 - DNA, 20 bp, Homo sapiens
gtggactttccaccccctcc

SEQ ID NO: 2519658 - DNA, 22 bp, Homo sapiens
gtggactttccaccccctccct

SEQ ID NO: 2519659 - DNA, 19 bp, Homo sapiens
gtggagaagccattgtctt

SEQ ID NO: 2519660 - DNA, 20 bp, Homo sapiens
gtggagaagccattgtcttc

SEQ ID NO: 2519661 - DNA, 19 bp, Homo sapiens
gtggagcaaagtgagggcc

SEQ ID NO: 2519662 - DNA, 23 bp, Homo sapiens
gtggagcccgcacccccaccctt

SEQ ID NO: 2519663 - DNA, 17 bp, Homo sapiens
gtggaggaatgctcccc

SEQ ID NO: 2519664 - DNA, 12 bp, Homo sapiens
gtggaggagcag

SEQ ID NO: 2519665 - DNA, 16 bp, Homo sapiens
gtggaggagctcagga

SEQ ID NO: 2519666 - DNA, 15 bp, Homo sapiens
gtggaggaggcctgg

SEQ ID NO: 2519667 - DNA, 12 bp, Homo sapiens
gtggagggccac

SEQ ID NO: 2519668 - DNA, 18 bp, Homo sapiens
gtggaggtgtcaggctgc

SEQ ID NO: 2519669 - DNA, 23 bp, Homo sapiens
gtggaggttgcagtgagccaaga

SEQ ID NO: 2519670 - DNA, 15 bp, Homo sapiens
gtggatcacctgagg

SEQ ID NO: 2519671 - DNA, 15 bp, Homo sapiens
gtggatgatgtttcg

SEQ ID NO: 2519672 - DNA, 20 bp, Homo sapiens
gtggatgcctggtggcagct

SEQ ID NO: 2519673 - DNA, 15 bp, Homo sapiens
gtggatgtcttcctt

SEQ ID NO: 2519674 - DNA, 16 bp, Homo sapiens
gtggatgtcttccttg

SEQ ID NO: 2519675 - DNA, 16 bp, Homo sapiens
gtggcaaggctgtgct

SEQ ID NO: 2519676 - DNA, 12 bp, Homo sapiens
gtggcacaggcc

SEQ ID NO: 2519677 - DNA, 16 bp, Homo sapiens
gtggcactcaacatga

SEQ ID NO: 2519678 - DNA, 19 bp, Homo sapiens
gtggcagagcttggactgg

SEQ ID NO: 2519679 - DNA, 12 bp, Homo sapiens
gtggcagccctg

SEQ ID NO: 2519680 - DNA, 12 bp, Homo sapiens
gtgtaaagcatt

SEQ ID NO: 2519681 - DNA, 12 bp, Homo sapiens
gtgtaacagctg

SEQ ID NO: 2519682 - DNA, 17 bp, Homo sapiens
gtgtaacaggtctcctc

SEQ ID NO: 2519683 - DNA, 23 bp, Homo sapiens
gtgtaactgtcagccgggccctg

SEQ ID NO: 2519684 - DNA, 21 bp, Homo sapiens
gtgtaagtattcttatttaat

SEQ ID NO: 2519685 - DNA, 22 bp, Homo sapiens
gtgtaagtgtgagtaagagctg

SEQ ID NO: 2519686 - DNA, 15 bp, Homo sapiens
gtgtaataagacata

SEQ ID NO: 2519687 - DNA, 14 bp, Homo sapiens
gtgtaatcaataaa

SEQ ID NO: 2519688 - DNA, 16 bp, Homo sapiens
gtgtaatcaataaacg

SEQ ID NO: 2519689 - DNA, 21 bp, Homo sapiens
gtgtaatcatttcttgggccc

SEQ ID NO: 2519690 - DNA, 22 bp, Homo sapiens
gtgtaatttaaaattgtgatgt

SEQ ID NO: 2519691 - DNA, 19 bp, Homo sapiens
gtgtacactgacacctttg

SEQ ID NO: 2519692 - DNA, 13 bp, Homo sapiens
gtgtacagtcttg

SEQ ID NO: 2519693 - DNA, 22 bp, Homo sapiens
gtgtacatggaataacatgtaa

SEQ ID NO: 2519694 - DNA, 18 bp, Homo sapiens
gtgtagagttaagaagct

SEQ ID NO: 2519695 - DNA, 20 bp, Homo sapiens
gtgtagagttaagaagctgt

SEQ ID NO: 2519696 - DNA, 17 bp, Homo sapiens
gtgtagttgaactgata

SEQ ID NO: 2519697 - DNA, 14 bp, Homo sapiens
gtgtatacatgcca

SEQ ID NO: 2519698 - DNA, 14 bp, Homo sapiens
gtgtatatgtatgt

SEQ ID NO: 2519699 - DNA, 17 bp, Homo sapiens
gtgtatatgtatgtgtg

SEQ ID NO: 2519700 - DNA, 21 bp, Homo sapiens
gtgtatcccccccctgtatag

SEQ ID NO: 2519701 - DNA, 14 bp, Homo sapiens
gtgtatcctggggc

SEQ ID NO: 2519702 - DNA, 15 bp, Homo sapiens
gtgtatgactaaaga

SEQ ID NO: 2519703 - DNA, 19 bp, Homo sapiens
gtgtatgctactacaaaaa

SEQ ID NO: 2519704 - DNA, 19 bp, Homo sapiens
gtgtatggaaataaatgta

SEQ ID NO: 2519705 - DNA, 16 bp, Homo sapiens
gtgtatgggtgtgtgt

SEQ ID NO: 2519706 - DNA, 18 bp, Homo sapiens
gtgtatgtgcgtgtgtgc

SEQ ID NO: 2519707 - DNA, 13 bp, Homo sapiens
gtgtatgtggggg

SEQ ID NO: 2519708 - DNA, 19 bp, Homo sapiens
gtgtattctagttttgtca

SEQ ID NO: 2519709 - DNA, 19 bp, Homo sapiens
gtgtatttccagtgcaatt

SEQ ID NO: 2519710 - DNA, 20 bp, Homo sapiens
gtgtcaagagggtctgagga

SEQ ID NO: 2519711 - DNA, 22 bp, Homo sapiens
gtgtcacctgaagactcattct

SEQ ID NO: 2519712 - DNA, 17 bp, Homo sapiens
gtgtcacttactgtttc

SEQ ID NO: 2519713 - DNA, 19 bp, Homo sapiens
gtgtcaggtggggcagctt

SEQ ID NO: 2519714 - DNA, 21 bp, Homo sapiens
gtgtcatgattcacccccaaa

SEQ ID NO: 2519715 - DNA, 18 bp, Homo sapiens
gtgtcatttatgaaaaga

SEQ ID NO: 2519716 - DNA, 17 bp, Homo sapiens
gtgtccaagtgtgtgtg

SEQ ID NO: 2519717 - DNA, 18 bp, Homo sapiens
gtgtccacgactgtctcc

SEQ ID NO: 2519718 - DNA, 14 bp, Homo sapiens
gtgtccatgtgtgt

SEQ ID NO: 2519719 - DNA, 15 bp, Homo sapiens
gtgtccatgtgtgtg

SEQ ID NO: 2519720 - DNA, 16 bp, Homo sapiens
gtgtccctgcacttgc

SEQ ID NO: 2519721 - DNA, 14 bp, Homo sapiens
gtgtccttgtgcat

SEQ ID NO: 2519722 - DNA, 14 bp, Homo sapiens
gtgtctaaaaacac

SEQ ID NO: 2519723 - DNA, 19 bp, Homo sapiens
gtgtctaggcaggacctgt

SEQ ID NO: 2519724 - DNA, 18 bp, Homo sapiens
gtgtctcttggtcctgct

SEQ ID NO: 2519725 - DNA, 19 bp, Homo sapiens
gtgtctcttttctctttct

SEQ ID NO: 2519726 - DNA, 21 bp, Homo sapiens
gtgtctggattcccaggatga

SEQ ID NO: 2519727 - DNA, 13 bp, Homo sapiens
gttacctactttg

SEQ ID NO: 2519728 - DNA, 16 bp, Homo sapiens
gttacttcactttaat

SEQ ID NO: 2519729 - DNA, 23 bp, Homo sapiens
gttacttcactttaattctcatg

SEQ ID NO: 2519730 - DNA, 13 bp, Homo sapiens
gttagaattcctt

SEQ ID NO: 2519731 - DNA, 18 bp, Homo sapiens
gttagactcttacttttt

SEQ ID NO: 2519732 - DNA, 20 bp, Homo sapiens
gttagctcaggaggcttgga

SEQ ID NO: 2519733 - DNA, 16 bp, Homo sapiens
gttaggaaataaaacc

SEQ ID NO: 2519734 - DNA, 21 bp, Homo sapiens
gttaggaaataaaacctttca

SEQ ID NO: 2519735 - DNA, 22 bp, Homo sapiens
gttaggaaataaaacctttcaa

SEQ ID NO: 2519736 - DNA, 15 bp, Homo sapiens
gttaggatttaacag

SEQ ID NO: 2519737 - DNA, 19 bp, Homo sapiens
gttaggcattgtgggaagg

SEQ ID NO: 2519738 - DNA, 15 bp, Homo sapiens
gttagggaaaacatt

SEQ ID NO: 2519739 - DNA, 13 bp, Homo sapiens
gttagggaggggt

SEQ ID NO: 2519740 - DNA, 16 bp, Homo sapiens
gttagtctactcttaa

SEQ ID NO: 2519741 - DNA, 23 bp, Homo sapiens
gttagtctactcttaagccatct

SEQ ID NO: 2519742 - DNA, 22 bp, Homo sapiens
gttagtttctccaagcaggaca

SEQ ID NO: 2519743 - DNA, 14 bp, Homo sapiens
gttataaagataca

SEQ ID NO: 2519744 - DNA, 18 bp, Homo sapiens
gttataaatcaatgtcac

SEQ ID NO: 2519745 - DNA, 16 bp, Homo sapiens
gttatagtatatctgg

SEQ ID NO: 2519746 - DNA, 21 bp, Homo sapiens
gttatcgaaataacaatgtta

SEQ ID NO: 2519747 - DNA, 20 bp, Homo sapiens
gttatgatttttttttcata

SEQ ID NO: 2519748 - DNA, 22 bp, Homo sapiens
gttatgtgaatgatctctctga

SEQ ID NO: 2519749 - DNA, 19 bp, Homo sapiens
gttattaaaaatctcaaat

SEQ ID NO: 2519750 - DNA, 21 bp, Homo sapiens
gttattaaacgtatgcatgtg

SEQ ID NO: 2519751 - DNA, 21 bp, Homo sapiens
gttattagggtggtatttagt

SEQ ID NO: 2519752 - DNA, 13 bp, Homo sapiens
gttattataattg

SEQ ID NO: 2519753 - DNA, 16 bp, Homo sapiens
gttattataattgtat

SEQ ID NO: 2519754 - DNA, 14 bp, Homo sapiens
gttatttataatca

SEQ ID NO: 2519755 - DNA, 14 bp, Homo sapiens
gttatttcttacag

SEQ ID NO: 2519756 - DNA, 12 bp, Homo sapiens
gttattttcagt

SEQ ID NO: 2519757 - DNA, 23 bp, Homo sapiens
gttattttctttgaaattgttta

SEQ ID NO: 2519758 - DNA, 13 bp, Homo sapiens
gttattttgcaac

SEQ ID NO: 2519759 - DNA, 13 bp, Homo sapiens
gttcaaaatgtct

SEQ ID NO: 2519760 - DNA, 14 bp, Homo sapiens
gttcaaaatgtctg

SEQ ID NO: 2519761 - DNA, 22 bp, Homo sapiens
gttcaaagatattttgctttgt

SEQ ID NO: 2519762 - DNA, 12 bp, Homo sapiens
gttcaatgatct

SEQ ID NO: 2519763 - DNA, 23 bp, Homo sapiens
gttgagccaggcctgggtctgtg

SEQ ID NO: 2519764 - DNA, 20 bp, Homo sapiens
gttgagccccaagtcctgaa

SEQ ID NO: 2519765 - DNA, 21 bp, Homo sapiens
gttgagcttcatataccagca

SEQ ID NO: 2519766 - DNA, 17 bp, Homo sapiens
gttgaggggctcctgga

SEQ ID NO: 2519767 - DNA, 21 bp, Homo sapiens
gttgataaattccactggact

SEQ ID NO: 2519768 - DNA, 14 bp, Homo sapiens
gttgatatttctat

SEQ ID NO: 2519769 - DNA, 17 bp, Homo sapiens
gttgatgggttctaatt

SEQ ID NO: 2519770 - DNA, 16 bp, Homo sapiens
gttgatgttggctggg

SEQ ID NO: 2519771 - DNA, 12 bp, Homo sapiens
gttgattgctaa

SEQ ID NO: 2519772 - DNA, 16 bp, Homo sapiens
gttgattgctaaatgt

SEQ ID NO: 2519773 - DNA, 20 bp, Homo sapiens
gttgattgctaaatgtaaca

SEQ ID NO: 2519774 - DNA, 23 bp, Homo sapiens
gttgatttcagcacctacagtgt

SEQ ID NO: 2519775 - DNA, 13 bp, Homo sapiens
gttgcaaccactg

SEQ ID NO: 2519776 - DNA, 16 bp, Homo sapiens
gttgcacccagccctg

SEQ ID NO: 2519777 - DNA, 17 bp, Homo sapiens
gttgcacccagccctgg

SEQ ID NO: 2519778 - DNA, 23 bp, Homo sapiens
gttgcacccagccctggtctcag

SEQ ID NO: 2519779 - DNA, 18 bp, Homo sapiens
gttgccaaacagccacac

SEQ ID NO: 2519780 - DNA, 13 bp, Homo sapiens
gttgccaagctgg

SEQ ID NO: 2519781 - DNA, 16 bp, Homo sapiens
gttgccagtcaccccg

SEQ ID NO: 2519782 - DNA, 17 bp, Homo sapiens
gttgccagtcaccccgg

SEQ ID NO: 2519783 - DNA, 12 bp, Homo sapiens
gttgcccaggct

SEQ ID NO: 2519784 - DNA, 15 bp, Homo sapiens
gttgcccaggctggc

SEQ ID NO: 2519785 - DNA, 16 bp, Homo sapiens
gttgcctaataaacat

SEQ ID NO: 2519786 - DNA, 23 bp, Homo sapiens
gttgctgatgaactcttaatcaa

SEQ ID NO: 2519787 - DNA, 15 bp, Homo sapiens
gttgctggttgctgt

SEQ ID NO: 2519788 - DNA, 23 bp, Homo sapiens
gtttgagctctgcagcccaggga

SEQ ID NO: 2519789 - DNA, 16 bp, Homo sapiens
gtttgaggtttttaag

SEQ ID NO: 2519790 - DNA, 22 bp, Homo sapiens
gtttgattcagacagctgcctg

SEQ ID NO: 2519791 - DNA, 15 bp, Homo sapiens
gtttgatttcattaa

SEQ ID NO: 2519792 - DNA, 14 bp, Homo sapiens
gtttgcaaggaagc

SEQ ID NO: 2519793 - DNA, 22 bp, Homo sapiens
gtttgcacgttatggtgtttct

SEQ ID NO: 2519794 - DNA, 23 bp, Homo sapiens
gtttgcacgttatggtgtttctc

SEQ ID NO: 2519795 - DNA, 16 bp, Homo sapiens
gtttgcagatgacaaa

SEQ ID NO: 2519796 - DNA, 14 bp, Homo sapiens
gtttgccatacttt

SEQ ID NO: 2519797 - DNA, 22 bp, Homo sapiens
gtttgccatactttgtctgaaa

SEQ ID NO: 2519798 - DNA, 13 bp, Homo sapiens
gtttgcctctgcc

SEQ ID NO: 2519799 - DNA, 16 bp, Homo sapiens
gtttgctatcttaatt

SEQ ID NO: 2519800 - DNA, 18 bp, Homo sapiens
gtttgctatcttaatttt

SEQ ID NO: 2519801 - DNA, 17 bp, Homo sapiens
gtttgcttattgttcca

SEQ ID NO: 2519802 - DNA, 13 bp, Homo sapiens
taaaacttgctgc

SEQ ID NO: 2519803 - DNA, 23 bp, Homo sapiens
taaaactttttatattttataca

SEQ ID NO: 2519804 - DNA, 22 bp, Homo sapiens
taaaagaaagcctcagagaatt

SEQ ID NO: 2519805 - DNA, 14 bp, Homo sapiens
taaatctctaatat

SEQ ID NO: 2519806 - DNA, 14 bp, Homo sapiens
taaatctgtgatga

SEQ ID NO: 2519807 - DNA, 15 bp, Homo sapiens
taaatctgtgatgat

SEQ ID NO: 2519808 - DNA, 16 bp, Homo sapiens
taaatgagctatgtat

SEQ ID NO: 2519809 - DNA, 21 bp, Homo sapiens
taaatgatgtggtgcctgagg

SEQ ID NO: 2519810 - DNA, 16 bp, Homo sapiens
taaatggaaccactct

SEQ ID NO: 2519811 - DNA, 18 bp, Homo sapiens
taaatgggggtgcatttg

SEQ ID NO: 2519812 - DNA, 20 bp, Homo sapiens
taaatggtatagcaaatgtt

SEQ ID NO: 2519813 - DNA, 15 bp, Homo sapiens
taaatggtgtacata

SEQ ID NO: 2519814 - DNA, 16 bp, Homo sapiens
taaatggtgtacataa

SEQ ID NO: 2519815 - DNA, 14 bp, Homo sapiens
taaatggttaaaag

SEQ ID NO: 2519816 - DNA, 13 bp, Homo sapiens
taaatgtaaagat

SEQ ID NO: 2519817 - DNA, 13 bp, Homo sapiens
taaatgtaacagt

SEQ ID NO: 2519818 - DNA, 19 bp, Homo sapiens
taaatgtatcttattcaca

SEQ ID NO: 2519819 - DNA, 12 bp, Homo sapiens
taaatgtctgtt

SEQ ID NO: 2519820 - DNA, 22 bp, Homo sapiens
taaatgtcttttttttaatgtg

SEQ ID NO: 2519821 - DNA, 19 bp, Homo sapiens
taaatgtgatgaatactgt

SEQ ID NO: 2519822 - DNA, 14 bp, Homo sapiens
taaattaactttta

SEQ ID NO: 2519823 - DNA, 16 bp, Homo sapiens
taaattaacttttata

SEQ ID NO: 2519824 - DNA, 17 bp, Homo sapiens
taaattaacttttataa

SEQ ID NO: 2519825 - DNA, 17 bp, Homo sapiens
taaattaggaataaata

SEQ ID NO: 2519826 - DNA, 17 bp, Homo sapiens
taaattataacttaaaa

SEQ ID NO: 2519827 - DNA, 21 bp, Homo sapiens
taaattatgggaatcaagatt

SEQ ID NO: 2519828 - DNA, 17 bp, Homo sapiens
taaattgaataatggta

SEQ ID NO: 2519829 - DNA, 23 bp, Homo sapiens
taaattgacacttaaaaatggtt

SEQ ID NO: 2519830 - DNA, 16 bp, Homo sapiens
taaattgatgttgctg

SEQ ID NO: 2519831 - DNA, 15 bp, Homo sapiens
taaattgctccttga

SEQ ID NO: 2519832 - DNA, 23 bp, Homo sapiens
taaattgtccgtgttcatacatt

SEQ ID NO: 2519833 - DNA, 19 bp, Homo sapiens
taaatttccccaacagtgt

SEQ ID NO: 2519834 - DNA, 20 bp, Homo sapiens
taaatttccccaacagtgtg

SEQ ID NO: 2519835 - DNA, 21 bp, Homo sapiens
taaatttccccaacagtgtga

SEQ ID NO: 2519836 - DNA, 18 bp, Homo sapiens
taaatttgtaagtttcag

SEQ ID NO: 2519837 - DNA, 19 bp, Homo sapiens
taaatttgtaagtttcagg

SEQ ID NO: 2519838 - DNA, 15 bp, Homo sapiens
taaattttaatttat

SEQ ID NO: 2519839 - DNA, 16 bp, Homo sapiens
taaattttacccttta

SEQ ID NO: 2519840 - DNA, 18 bp, Homo sapiens
taaattttaccctttaga

SEQ ID NO: 2519841 - DNA, 13 bp, Homo sapiens
taaattttgtgat

SEQ ID NO: 2519842 - DNA, 16 bp, Homo sapiens
taaatttttttcctta

SEQ ID NO: 2519843 - DNA, 19 bp, Homo sapiens
taaattttttttgtttcat

SEQ ID NO: 2519844 - DNA, 18 bp, Homo sapiens
taacaaaaactacacata

SEQ ID NO: 2519845 - DNA, 12 bp, Homo sapiens
taacaaattatg

SEQ ID NO: 2519846 - DNA, 14 bp, Homo sapiens
taacaacctggaga

SEQ ID NO: 2519847 - DNA, 15 bp, Homo sapiens
taacaagctcccagg

SEQ ID NO: 2519848 - DNA, 20 bp, Homo sapiens
taacaagtcgatgaactatt

SEQ ID NO: 2519849 - DNA, 17 bp, Homo sapiens
taacaataactactgtg

SEQ ID NO: 2519850 - DNA, 18 bp, Homo sapiens
taacaataactactgtgt

SEQ ID NO: 2519851 - DNA, 19 bp, Homo sapiens
taacaataactactgtgtt

SEQ ID NO: 2519852 - DNA, 14 bp, Homo sapiens
taacaatcagctcc

SEQ ID NO: 2519853 - DNA, 13 bp, Homo sapiens
taacaatgttaag

SEQ ID NO: 2519854 - DNA, 21 bp, Homo sapiens
taacaatgttaaggaaactct

SEQ ID NO: 2519855 - DNA, 23 bp, Homo sapiens
taacaatgttaaggaaactctta

SEQ ID NO: 2519856 - DNA, 18 bp, Homo sapiens
taacacaagtcctgtgaa

SEQ ID NO: 2519857 - DNA, 12 bp, Homo sapiens
taacacacagct

SEQ ID NO: 2519858 - DNA, 20 bp, Homo sapiens
taacacagtgccttcaataa

SEQ ID NO: 2519859 - DNA, 21 bp, Homo sapiens
taacacagtgccttcaataaa

SEQ ID NO: 2519860 - DNA, 14 bp, Homo sapiens
taacacattttgta

SEQ ID NO: 2519861 - DNA, 18 bp, Homo sapiens
taacacattttgtataat

SEQ ID NO: 2519862 - DNA, 21 bp, Homo sapiens
taacaccaggtttatggaaaa

SEQ ID NO: 2519863 - DNA, 23 bp, Homo sapiens
taacagaaagggcaacaataaaa

SEQ ID NO: 2519864 - DNA, 11 bp, Homo sapiens
taacagaaatg

SEQ ID NO: 2519865 - DNA, 12 bp, Homo sapiens
taacagaaatgt

SEQ ID NO: 2519866 - DNA, 16 bp, Homo sapiens
taacagaacagcttca

SEQ ID NO: 2519867 - DNA, 18 bp, Homo sapiens
taacagataagcaagaga

SEQ ID NO: 2519868 - DNA, 22 bp, Homo sapiens
taacagattttggggttgtgtt

SEQ ID NO: 2519869 - DNA, 19 bp, Homo sapiens
taacaggcagatacaggaa

SEQ ID NO: 2519870 - DNA, 23 bp, Homo sapiens
taacaggctcaatattcctgaat

SEQ ID NO: 2519871 - DNA, 15 bp, Homo sapiens
taacaggtctcctct

SEQ ID NO: 2519872 - DNA, 16 bp, Homo sapiens
taacaggtctcctctt

SEQ ID NO: 2519873 - DNA, 18 bp, Homo sapiens
taacaggtctcctcttaa

SEQ ID NO: 2519874 - DNA, 13 bp, Homo sapiens
taacagtcattta

SEQ ID NO: 2519875 - DNA, 14 bp, Homo sapiens
taacagttttccat

SEQ ID NO: 2519876 - DNA, 16 bp, Homo sapiens
taacagttttccatga

SEQ ID NO: 2519877 - DNA, 17 bp, Homo sapiens
taacagttttccatgaa

SEQ ID NO: 2519878 - DNA, 21 bp, Homo sapiens
taacagttttccatgaaaacg

SEQ ID NO: 2519879 - DNA, 22 bp, Homo sapiens
taacatatttactaagccacaa

SEQ ID NO: 2519880 - DNA, 23 bp, Homo sapiens
taacatatttactaagccacaag

SEQ ID NO: 2519881 - DNA, 15 bp, Homo sapiens
taacatgtaggaagt

SEQ ID NO: 2519882 - DNA, 12 bp, Homo sapiens
taacattacctt

SEQ ID NO: 2519883 - DNA, 13 bp, Homo sapiens
taacattacctta

SEQ ID NO: 2519884 - DNA, 12 bp, Homo sapiens
taacattattta

SEQ ID NO: 2519885 - DNA, 15 bp, Homo sapiens
taaccagctgtaaca

SEQ ID NO: 2519886 - DNA, 15 bp, Homo sapiens
taaccattaaaactg

SEQ ID NO: 2519887 - DNA, 15 bp, Homo sapiens
taaccccgggcgggt

SEQ ID NO: 2519888 - DNA, 16 bp, Homo sapiens
taacctcagctctggg

SEQ ID NO: 2519889 - DNA, 19 bp, Homo sapiens
taacctcagtgtcatttat

SEQ ID NO: 2519890 - DNA, 20 bp, Homo sapiens
taacctcagtgtcatttatg

SEQ ID NO: 2519891 - DNA, 19 bp, Homo sapiens
taacctgccagggagacag

SEQ ID NO: 2519892 - DNA, 18 bp, Homo sapiens
taacctggtgctggatat

SEQ ID NO: 2519893 - DNA, 19 bp, Homo sapiens
taacctggtgctggatatt

SEQ ID NO: 2519894 - DNA, 19 bp, Homo sapiens
taacctgtacttcaagtta

SEQ ID NO: 2519895 - DNA, 12 bp, Homo sapiens
taacggctccag

SEQ ID NO: 2519896 - DNA, 15 bp, Homo sapiens
taacggctccaggat

SEQ ID NO: 2519897 - DNA, 22 bp, Homo sapiens
taacgttagaccacaaatagtg

SEQ ID NO: 2519898 - DNA, 15 bp, Homo sapiens
taacgtttttccttt

SEQ ID NO: 2519899 - DNA, 20 bp, Homo sapiens
taacgtttttcctttaaaaa

SEQ ID NO: 2519900 - DNA, 16 bp, Homo sapiens
taactaaattaacatt

SEQ ID NO: 2519901 - DNA, 17 bp, Homo sapiens
taactagaatttattca

SEQ ID NO: 2519902 - DNA, 22 bp, Homo sapiens
taactagagcagccctggagtc

SEQ ID NO: 2519903 - DNA, 15 bp, Homo sapiens
taactagcttggaaa

SEQ ID NO: 2519904 - DNA, 19 bp, Homo sapiens
taactaggctcagagatgt

SEQ ID NO: 2519905 - DNA, 18 bp, Homo sapiens
taactatatttgcttttt

SEQ ID NO: 2519906 - DNA, 22 bp, Homo sapiens
taactcagaaacatcagttact

SEQ ID NO: 2519907 - DNA, 13 bp, Homo sapiens
taactcagatcac

SEQ ID NO: 2519908 - DNA, 19 bp, Homo sapiens
taactcatacctttaaagg

SEQ ID NO: 2519909 - DNA, 14 bp, Homo sapiens
taactcatcataaa

SEQ ID NO: 2519910 - DNA, 14 bp, Homo sapiens
taactgaaaatgtg

SEQ ID NO: 2519911 - DNA, 20 bp, Homo sapiens
taactgaaaatgtgctatac

SEQ ID NO: 2519912 - DNA, 12 bp, Homo sapiens
taactgcaattt

SEQ ID NO: 2519913 - DNA, 20 bp, Homo sapiens
taactgcaattttaattgat

SEQ ID NO: 2519914 - DNA, 23 bp, Homo sapiens
taactgccatcaagatgagagaa

SEQ ID NO: 2519915 - DNA, 22 bp, Homo sapiens
taactgttaaattgctgtgtat

SEQ ID NO: 2519916 - DNA, 18 bp, Homo sapiens
taacttaaaaaaatgaca

SEQ ID NO: 2519917 - DNA, 19 bp, Homo sapiens
taacttaaaaatgtaaata

SEQ ID NO: 2519918 - DNA, 20 bp, Homo sapiens
taacttaaaaatgtaaatat

SEQ ID NO: 2519919 - DNA, 15 bp, Homo sapiens
taacttaattgctat

SEQ ID NO: 2519920 - DNA, 15 bp, Homo sapiens
taacttagcatgtgt

SEQ ID NO: 2519921 - DNA, 21 bp, Homo sapiens
taacttgagttttatttattt

SEQ ID NO: 2519922 - DNA, 15 bp, Homo sapiens
taacttgcacctctg

SEQ ID NO: 2519923 - DNA, 15 bp, Homo sapiens
taacttggctttcat

SEQ ID NO: 2519924 - DNA, 17 bp, Homo sapiens
taacttgtttccaatgt

SEQ ID NO: 2519925 - DNA, 15 bp, Homo sapiens
taactttatcacatt

SEQ ID NO: 2519926 - DNA, 17 bp, Homo sapiens
taactttatcacattat

SEQ ID NO: 2519927 - DNA, 21 bp, Homo sapiens
taactttatcacattatttgc

SEQ ID NO: 2519928 - DNA, 15 bp, Homo sapiens
taactttatgtgtaa

SEQ ID NO: 2519929 - DNA, 23 bp, Homo sapiens
taactttcagaagagatgggctt

SEQ ID NO: 2519930 - DNA, 19 bp, Homo sapiens
taactttcattaaagcatt

SEQ ID NO: 2519931 - DNA, 15 bp, Homo sapiens
taactttctctatga

SEQ ID NO: 2519932 - DNA, 12 bp, Homo sapiens
taactttgcttg

SEQ ID NO: 2519933 - DNA, 18 bp, Homo sapiens
taagaaaaaggatgcaca

SEQ ID NO: 2519934 - DNA, 18 bp, Homo sapiens
taagaaaagagatatttt

SEQ ID NO: 2519935 - DNA, 20 bp, Homo sapiens
taagaaacacactgaggcag

SEQ ID NO: 2519936 - DNA, 23 bp, Homo sapiens
taagaaacacactgaggcaggga

SEQ ID NO: 2519937 - DNA, 24 bp, Homo sapiens
taagaaagactatctaaatgttga

SEQ ID NO: 2519938 - DNA, 15 bp, Homo sapiens
taagaaagtgaagca

SEQ ID NO: 2519939 - DNA, 22 bp, Homo sapiens
taagaaagtgaagcaaatcaga

SEQ ID NO: 2519940 - DNA, 16 bp, Homo sapiens
taagaaatactgtaca

SEQ ID NO: 2519941 - DNA, 22 bp, Homo sapiens
taagaacaaagagaaaaaatac

SEQ ID NO: 2519942 - DNA, 22 bp, Homo sapiens
taagaactgctttctttcgttt

SEQ ID NO: 2519943 - DNA, 15 bp, Homo sapiens
taagaagacatgaac

SEQ ID NO: 2519944 - DNA, 14 bp, Homo sapiens
taagaagagactgg

SEQ ID NO: 2519945 - DNA, 20 bp, Homo sapiens
taagaggcagaaaattgcac

SEQ ID NO: 2519946 - DNA, 23 bp, Homo sapiens
taagaggcagaaaattgcacaat

SEQ ID NO: 2519947 - DNA, 15 bp, Homo sapiens
taagaggcagggtct

SEQ ID NO: 2519948 - DNA, 15 bp, Homo sapiens
taagaggctgataat

SEQ ID NO: 2519949 - DNA, 22 bp, Homo sapiens
taagagtgtagaagcattcctt

SEQ ID NO: 2519950 - DNA, 16 bp, Homo sapiens
taagataaatgtgctg

SEQ ID NO: 2519951 - DNA, 12 bp, Homo sapiens
taagataattat

SEQ ID NO: 2519952 - DNA, 18 bp, Homo sapiens
taagatatttttcatgat

SEQ ID NO: 2519953 - DNA, 19 bp, Homo sapiens
taagatatttttcatgatt

SEQ ID NO: 2519954 - DNA, 19 bp, Homo sapiens
taagatggaagcttccagt

SEQ ID NO: 2519955 - DNA, 15 bp, Homo sapiens
taagatggattctca

SEQ ID NO: 2519956 - DNA, 21 bp, Homo sapiens
taagatggattctcagatatt

SEQ ID NO: 2519957 - DNA, 18 bp, Homo sapiens
taagatgggcagctagtt

SEQ ID NO: 2519958 - DNA, 13 bp, Homo sapiens
taagattagaatg

SEQ ID NO: 2519959 - DNA, 18 bp, Homo sapiens
taagattagaatgaaaat

SEQ ID NO: 2519960 - DNA, 21 bp, Homo sapiens
taagcaaaatgtgatatgtac

SEQ ID NO: 2519961 - DNA, 23 bp, Homo sapiens
taagcaaagggagcactgggttg

SEQ ID NO: 2519962 - DNA, 23 bp, Homo sapiens
taagcaacatctagcaaatgtta

SEQ ID NO: 2519963 - DNA, 13 bp, Homo sapiens
taagcactacata

SEQ ID NO: 2519964 - DNA, 16 bp, Homo sapiens
taagcactacataaac

SEQ ID NO: 2519965 - DNA, 13 bp, Homo sapiens
taagcactgtgct

SEQ ID NO: 2519966 - DNA, 17 bp, Homo sapiens
taagcactgtgctaata

SEQ ID NO: 2519967 - DNA, 18 bp, Homo sapiens
taagcattaccactcagg

SEQ ID NO: 2519968 - DNA, 15 bp, Homo sapiens
taagcattgtttgct

SEQ ID NO: 2519969 - DNA, 20 bp, Homo sapiens
taagcattgtttgcttattg

SEQ ID NO: 2519970 - DNA, 23 bp, Homo sapiens
taagcattgtttgcttattgttc

SEQ ID NO: 2519971 - DNA, 22 bp, Homo sapiens
taagccacaagaaatttgattt

SEQ ID NO: 2519972 - DNA, 17 bp, Homo sapiens
taagccatcttggtaaa

SEQ ID NO: 2519973 - DNA, 20 bp, Homo sapiens
taagccattctgactcatat

SEQ ID NO: 2519974 - DNA, 13 bp, Homo sapiens
taagcccccgctg

SEQ ID NO: 2519975 - DNA, 16 bp, Homo sapiens
taagccctgtcgagac

SEQ ID NO: 2519976 - DNA, 22 bp, Homo sapiens
taagccctgtcgagacacttgc

SEQ ID NO: 2519977 - DNA, 17 bp, Homo sapiens
taagcctacctgctctc

SEQ ID NO: 2519978 - DNA, 14 bp, Homo sapiens
taagcctccattta

SEQ ID NO: 2519979 - DNA, 17 bp, Homo sapiens
taagcctccatttagtt

SEQ ID NO: 2519980 - DNA, 15 bp, Homo sapiens
taagcctttccataa

SEQ ID NO: 2519981 - DNA, 16 bp, Homo sapiens
taagcctttccataag

SEQ ID NO: 2519982 - DNA, 21 bp, Homo sapiens
taagctaaagaggctgaaaga

SEQ ID NO: 2519983 - DNA, 16 bp, Homo sapiens
taagctaacccccttc

SEQ ID NO: 2519984 - DNA, 22 bp, Homo sapiens
taagctaacccccttctactga

SEQ ID NO: 2519985 - DNA, 14 bp, Homo sapiens
taagctattcagta

SEQ ID NO: 2519986 - DNA, 14 bp, Homo sapiens
taagctgaaaatat

SEQ ID NO: 2519987 - DNA, 11 bp, Homo sapiens
taagctgtttc

SEQ ID NO: 2519988 - DNA, 18 bp, Homo sapiens
taagcttatttaattaaa

SEQ ID NO: 2519989 - DNA, 21 bp, Homo sapiens
taagctttgccagctgctgct

SEQ ID NO: 2519990 - DNA, 15 bp, Homo sapiens
taaggaaactcttat

SEQ ID NO: 2519991 - DNA, 12 bp, Homo sapiens
taaggaaactgg

SEQ ID NO: 2519992 - DNA, 14 bp, Homo sapiens
taaggaaactgggt

SEQ ID NO: 2519993 - DNA, 21 bp, Homo sapiens
taaggaaagcaataaatgaat

SEQ ID NO: 2519994 - DNA, 18 bp, Homo sapiens
taaggaatacctgtcccc

SEQ ID NO: 2519995 - DNA, 14 bp, Homo sapiens
taaggaatatggga

SEQ ID NO: 2519996 - DNA, 20 bp, Homo sapiens
taaggaatatgggagaaata

SEQ ID NO: 2519997 - DNA, 14 bp, Homo sapiens
taaggacacactaa

SEQ ID NO: 2519998 - DNA, 19 bp, Homo sapiens
taaggagaaatctatagaa

SEQ ID NO: 2519999 - DNA, 16 bp, Homo sapiens
taaggagatgggcctt

SEQ ID NO: 2520000 - DNA, 19 bp, Homo sapiens
taaggagtaatctgtgtac

SEQ ID NO: 2520001 - DNA, 20 bp, Homo sapiens
taaggagtaatctgtgtaca

SEQ ID NO: 2520002 - DNA, 16 bp, Homo sapiens
taaggatctctcagga

SEQ ID NO: 2520003 - DNA, 18 bp, Homo sapiens
taaggatgcttgtacata

SEQ ID NO: 2520004 - DNA, 12 bp, Homo sapiens
taaggatgggaa

SEQ ID NO: 2520005 - DNA, 16 bp, Homo sapiens
taaggatgggaaggag

SEQ ID NO: 2520006 - DNA, 17 bp, Homo sapiens
taaggattttatgcttt

SEQ ID NO: 2520007 - DNA, 19 bp, Homo sapiens
taaggccattattgtactt

SEQ ID NO: 2520008 - DNA, 14 bp, Homo sapiens
taagggaaatagaa

SEQ ID NO: 2520009 - DNA, 20 bp, Homo sapiens
taagggttagtttacaatca

SEQ ID NO: 2520010 - DNA, 13 bp, Homo sapiens
taagggttttaga

SEQ ID NO: 2520011 - DNA, 15 bp, Homo sapiens
taaggtgtgctctga

SEQ ID NO: 2520012 - DNA, 18 bp, Homo sapiens
taaggttacctttgttcc

SEQ ID NO: 2520013 - DNA, 16 bp, Homo sapiens
taaggttctcatagga

SEQ ID NO: 2520014 - DNA, 16 bp, Homo sapiens
taagtaaaaccacagc

SEQ ID NO: 2520015 - DNA, 18 bp, Homo sapiens
taagtaaaaccacagcag

SEQ ID NO: 2520016 - DNA, 17 bp, Homo sapiens
taagtaccactcaggcc

SEQ ID NO: 2520017 - DNA, 18 bp, Homo sapiens
taagtaccactcaggcca

SEQ ID NO: 2520018 - DNA, 16 bp, Homo sapiens
taagtactatgtatca

SEQ ID NO: 2520019 - DNA, 14 bp, Homo sapiens
taagtatgttattt

SEQ ID NO: 2520020 - DNA, 12 bp, Homo sapiens
taagtatttagg

SEQ ID NO: 2520021 - DNA, 13 bp, Homo sapiens
taagtatttatat

SEQ ID NO: 2520022 - DNA, 15 bp, Homo sapiens
taagtatttatatat

SEQ ID NO: 2520023 - DNA, 18 bp, Homo sapiens
taagtatttatatattta

SEQ ID NO: 2520024 - DNA, 19 bp, Homo sapiens
taagtatttatatatttat

SEQ ID NO: 2520025 - DNA, 23 bp, Homo sapiens
taagtatttatatatttataact

SEQ ID NO: 2520026 - DNA, 17 bp, Homo sapiens
taagtcaacctgcctga

SEQ ID NO: 2520027 - DNA, 21 bp, Homo sapiens
taagtcatgttccttcaagat

SEQ ID NO: 2520028 - DNA, 20 bp, Homo sapiens
taagtccttgcaagaatcag

SEQ ID NO: 2520029 - DNA, 18 bp, Homo sapiens
taagtctaaatatttcct

SEQ ID NO: 2520030 - DNA, 20 bp, Homo sapiens
taagtctgttttatgacttc

SEQ ID NO: 2520031 - DNA, 14 bp, Homo sapiens
taagtgccttccat

SEQ ID NO: 2520032 - DNA, 16 bp, Homo sapiens
taagtgccttccatgt

SEQ ID NO: 2520033 - DNA, 17 bp, Homo sapiens
taagtgcgtgtgtagag

SEQ ID NO: 2520034 - DNA, 18 bp, Homo sapiens
taagtgcgtgtgtagagt

SEQ ID NO: 2520035 - DNA, 19 bp, Homo sapiens
taagtgcgtgtgtagagtt

SEQ ID NO: 2520036 - DNA, 23 bp, Homo sapiens
taagtgcgtgtgtagagttaaga

SEQ ID NO: 2520037 - DNA, 14 bp, Homo sapiens
taagtgctgcattt

SEQ ID NO: 2520038 - DNA, 19 bp, Homo sapiens
taagtgtgagtaagagctg

SEQ ID NO: 2520039 - DNA, 15 bp, Homo sapiens
taagttattgcagtt

SEQ ID NO: 2520040 - DNA, 20 bp, Homo sapiens
taagttatttttacattctg

SEQ ID NO: 2520041 - DNA, 20 bp, Homo sapiens
taagttctggatgcatttct

SEQ ID NO: 2520042 - DNA, 17 bp, Homo sapiens
taagttgaatggcctgc

SEQ ID NO: 2520043 - DNA, 15 bp, Homo sapiens
taagttgtttgcatg

SEQ ID NO: 2520044 - DNA, 16 bp, Homo sapiens
taagtttcaggtgaca

SEQ ID NO: 2520045 - DNA, 22 bp, Homo sapiens
taagtttcaggtgacatgtgaa

SEQ ID NO: 2520046 - DNA, 20 bp, Homo sapiens
taagtttttatggcttttgt

SEQ ID NO: 2520047 - DNA, 14 bp, Homo sapiens
taataaaaaatgga

SEQ ID NO: 2520048 - DNA, 21 bp, Homo sapiens
taataaaaaatggaaagaatc

SEQ ID NO: 2520049 - DNA, 13 bp, Homo sapiens
taataaaaaggca

SEQ ID NO: 2520050 - DNA, 17 bp, Homo sapiens
taataaaagtacatgtt

SEQ ID NO: 2520051 - DNA, 13 bp, Homo sapiens
taataaacattct

SEQ ID NO: 2520052 - DNA, 21 bp, Homo sapiens
taataaacttttttttgagaa

SEQ ID NO: 2520053 - DNA, 16 bp, Homo sapiens
taataaagatcatgta

SEQ ID NO: 2520054 - DNA, 17 bp, Homo sapiens
taataaagatcatgtaa

SEQ ID NO: 2520055 - DNA, 14 bp, Homo sapiens
taataaagatgctc

SEQ ID NO: 2520056 - DNA, 16 bp, Homo sapiens
taataaagctactgat

SEQ ID NO: 2520057 - DNA, 16 bp, Homo sapiens
taataaattatttatt

SEQ ID NO: 2520058 - DNA, 22 bp, Homo sapiens
taataagacataacgtttttcc

SEQ ID NO: 2520059 - DNA, 18 bp, Homo sapiens
taataagctaaagaggct

SEQ ID NO: 2520060 - DNA, 14 bp, Homo sapiens
taataataatgttt

SEQ ID NO: 2520061 - DNA, 22 bp, Homo sapiens
taatacaacatgtagctgagtt

SEQ ID NO: 2520062 - DNA, 15 bp, Homo sapiens
taatacacacagtta

SEQ ID NO: 2520063 - DNA, 14 bp, Homo sapiens
taatacaccactac

SEQ ID NO: 2520064 - DNA, 18 bp, Homo sapiens
taatacaccactacattc

SEQ ID NO: 2520065 - DNA, 19 bp, Homo sapiens
taatacaccactacattct

SEQ ID NO: 2520066 - DNA, 22 bp, Homo sapiens
taatacaccactacattctgtt

SEQ ID NO: 2520067 - DNA, 22 bp, Homo sapiens
taatacactaattcctttctat

SEQ ID NO: 2520068 - DNA, 16 bp, Homo sapiens
taataccacagctttt

SEQ ID NO: 2520069 - DNA, 22 bp, Homo sapiens
taatactagttgtgaccttagt

SEQ ID NO: 2520070 - DNA, 19 bp, Homo sapiens
taatagaaaactgaaaatc

SEQ ID NO: 2520071 - DNA, 15 bp, Homo sapiens
taatttgtgatacaa

SEQ ID NO: 2520072 - DNA, 19 bp, Homo sapiens
taatttgtgatacaatgct

SEQ ID NO: 2520073 - DNA, 19 bp, Homo sapiens
taattttagtgacagctct

SEQ ID NO: 2520074 - DNA, 21 bp, Homo sapiens
taattttgacactatatctgt

SEQ ID NO: 2520075 - DNA, 13 bp, Homo sapiens
taattttgtattt

SEQ ID NO: 2520076 - DNA, 14 bp, Homo sapiens
taattttgtatttt

SEQ ID NO: 2520077 - DNA, 22 bp, Homo sapiens
taatttttgtgtttttaataaa

SEQ ID NO: 2520078 - DNA, 17 bp, Homo sapiens
taattttttattcaagt

SEQ ID NO: 2520079 - DNA, 16 bp, Homo sapiens
taatttttttcaatat

SEQ ID NO: 2520080 - DNA, 22 bp, Homo sapiens
taatttttttcaatatttatta

SEQ ID NO: 2520081 - DNA, 18 bp, Homo sapiens
taatttttttgagacaga

SEQ ID NO: 2520082 - DNA, 14 bp, Homo sapiens
tacaaaaacacagc

SEQ ID NO: 2520083 - DNA, 20 bp, Homo sapiens
tacaaaataaacaaataaca

SEQ ID NO: 2520084 - DNA, 19 bp, Homo sapiens
tacaaaatttgaaatttag

SEQ ID NO: 2520085 - DNA, 12 bp, Homo sapiens
tacaaacaatgg

SEQ ID NO: 2520086 - DNA, 15 bp, Homo sapiens
tacaaacatatttgt

SEQ ID NO: 2520087 - DNA, 15 bp, Homo sapiens
tacaaagaagacatg

SEQ ID NO: 2520088 - DNA, 16 bp, Homo sapiens
tacaaagaagacatgt

SEQ ID NO: 2520089 - DNA, 19 bp, Homo sapiens
tacaaatactcttaggaag

SEQ ID NO: 2520090 - DNA, 12 bp, Homo sapiens
tacaacagattt

SEQ ID NO: 2520091 - DNA, 15 bp, Homo sapiens
tacaacagatttgtg

SEQ ID NO: 2520092 - DNA, 18 bp, Homo sapiens
tacaacagatttgtgaac

SEQ ID NO: 2520093 - DNA, 20 bp, Homo sapiens
tacaacagatttgtgaactc

SEQ ID NO: 2520094 - DNA, 16 bp, Homo sapiens
tacaagcctgcacaat

SEQ ID NO: 2520095 - DNA, 20 bp, Homo sapiens
tacaagcgtgagccactgca

SEQ ID NO: 2520096 - DNA, 14 bp, Homo sapiens
tacaagtgtatatc

SEQ ID NO: 2520097 - DNA, 13 bp, Homo sapiens
tacaagttagaaa

SEQ ID NO: 2520098 - DNA, 14 bp, Homo sapiens
tacaatatttaaaa

SEQ ID NO: 2520099 - DNA, 13 bp, Homo sapiens
tacaatgacttta

SEQ ID NO: 2520100 - DNA, 18 bp, Homo sapiens
tacaatgactttattgca

SEQ ID NO: 2520101 - DNA, 13 bp, Homo sapiens
tacaatgctgtgc

SEQ ID NO: 2520102 - DNA, 14 bp, Homo sapiens
tacaatgctgtgcc

SEQ ID NO: 2520103 - DNA, 17 bp, Homo sapiens
tacaatgtatttattta

SEQ ID NO: 2520104 - DNA, 18 bp, Homo sapiens
tacaatgtatttatttaa

SEQ ID NO: 2520105 - DNA, 13 bp, Homo sapiens
tacaattgaaatg

SEQ ID NO: 2520106 - DNA, 16 bp, Homo sapiens
tacaattgaaatgact

SEQ ID NO: 2520107 - DNA, 20 bp, Homo sapiens
tacaattgaacttaaataaa

SEQ ID NO: 2520108 - DNA, 17 bp, Homo sapiens
tacaattttttatcatg

SEQ ID NO: 2520109 - DNA, 22 bp, Homo sapiens
tacaatttttttaattttgtat

SEQ ID NO: 2520110 - DNA, 14 bp, Homo sapiens
tacacaagtaaaca

SEQ ID NO: 2520111 - DNA, 11 bp, Homo sapiens
tacacacacac

SEQ ID NO: 2520112 - DNA, 12 bp, Homo sapiens
tacacacacaca

SEQ ID NO: 2520113 - DNA, 14 bp, Homo sapiens
tacacacacacaca

SEQ ID NO: 2520114 - DNA, 18 bp, Homo sapiens
tacacagagcaggactgc

SEQ ID NO: 2520115 - DNA, 15 bp, Homo sapiens
tacacagctctagac

SEQ ID NO: 2520116 - DNA, 23 bp, Homo sapiens
tacacaggatcctattctcacca

SEQ ID NO: 2520117 - DNA, 20 bp, Homo sapiens
tacacagggatgtacaaggc

SEQ ID NO: 2520118 - DNA, 11 bp, Homo sapiens
tacacagttgc

SEQ ID NO: 2520119 - DNA, 19 bp, Homo sapiens
tacacattttattttatta

SEQ ID NO: 2520120 - DNA, 21 bp, Homo sapiens
tacacattttattttattatg

SEQ ID NO: 2520121 - DNA, 19 bp, Homo sapiens
tacaccacctcactcctgt

SEQ ID NO: 2520122 - DNA, 15 bp, Homo sapiens
tacaccactacattc

SEQ ID NO: 2520123 - DNA, 17 bp, Homo sapiens
tacaccactacattctg

SEQ ID NO: 2520124 - DNA, 15 bp, Homo sapiens
tacacccttttccag

SEQ ID NO: 2520125 - DNA, 22 bp, Homo sapiens
tacacctaactcacctaactca

SEQ ID NO: 2520126 - DNA, 17 bp, Homo sapiens
tacacgtgtcctgtagt

SEQ ID NO: 2520127 - DNA, 15 bp, Homo sapiens
tacactaaaaggtga

SEQ ID NO: 2520128 - DNA, 16 bp, Homo sapiens
tacactctttgtaaga

SEQ ID NO: 2520129 - DNA, 18 bp, Homo sapiens
tacactgaatatttatat

SEQ ID NO: 2520130 - DNA, 21 bp, Homo sapiens
tacactggtttgagcttagtg

SEQ ID NO: 2520131 - DNA, 23 bp, Homo sapiens
tacactgtgctgagtctgaaggc

SEQ ID NO: 2520132 - DNA, 14 bp, Homo sapiens
tacactgtttcaaa

SEQ ID NO: 2520133 - DNA, 16 bp, Homo sapiens
tacacttacactttat

SEQ ID NO: 2520134 - DNA, 24 bp, Homo sapiens
tacagaaagtggtgctcagttgta

SEQ ID NO: 2520135 - DNA, 16 bp, Homo sapiens
tacagaactctttcaa

SEQ ID NO: 2520136 - DNA, 11 bp, Homo sapiens
tacagacacta

SEQ ID NO: 2520137 - DNA, 14 bp, Homo sapiens
tacagacttctcca

SEQ ID NO: 2520138 - DNA, 20 bp, Homo sapiens
tacagagaggagaaacacat

SEQ ID NO: 2520139 - DNA, 18 bp, Homo sapiens
tacagaggacagtatttg

SEQ ID NO: 2520140 - DNA, 20 bp, Homo sapiens
tacagaggtctctgccggct

SEQ ID NO: 2520141 - DNA, 16 bp, Homo sapiens
tacagagtgatagcct

SEQ ID NO: 2520142 - DNA, 22 bp, Homo sapiens
tacagcaaggagatttacaact

SEQ ID NO: 2520143 - DNA, 16 bp, Homo sapiens
tacagcattacaaatt

SEQ ID NO: 2520144 - DNA, 21 bp, Homo sapiens
tacagcattacaaattgctta

SEQ ID NO: 2520145 - DNA, 22 bp, Homo sapiens
tacagcattacaaattgcttac

SEQ ID NO: 2520146 - DNA, 18 bp, Homo sapiens
tacagccaaagataatct

SEQ ID NO: 2520147 - DNA, 19 bp, Homo sapiens
tacagctgagcacattctg

SEQ ID NO: 2520148 - DNA, 13 bp, Homo sapiens
tacagctgcctgc

SEQ ID NO: 2520149 - DNA, 24 bp, Homo sapiens
tacagctgggtggcactgccatgc

SEQ ID NO: 2520150 - DNA, 17 bp, Homo sapiens
tacaggaaaagctgctg

SEQ ID NO: 2520151 - DNA, 14 bp, Homo sapiens
tacaggcaccgaga

SEQ ID NO: 2520152 - DNA, 19 bp, Homo sapiens
tacaggcaccgagaatgtt

SEQ ID NO: 2520153 - DNA, 20 bp, Homo sapiens
tacaggcaccgagaatgttg

SEQ ID NO: 2520154 - DNA, 15 bp, Homo sapiens
tacaggcagcacaga

SEQ ID NO: 2520155 - DNA, 16 bp, Homo sapiens
tacagggaatgcctga

SEQ ID NO: 2520156 - DNA, 19 bp, Homo sapiens
tacagggtagataacctgt

SEQ ID NO: 2520157 - DNA, 23 bp, Homo sapiens
tacaggttacaacagatttgtga

SEQ ID NO: 2520158 - DNA, 17 bp, Homo sapiens
tacagtaactttatgtg

SEQ ID NO: 2520159 - DNA, 18 bp, Homo sapiens
tacagtaactttatgtgt

SEQ ID NO: 2520160 - DNA, 15 bp, Homo sapiens
tacagtacaggcagc

SEQ ID NO: 2520161 - DNA, 13 bp, Homo sapiens
tacagtaggagcc

SEQ ID NO: 2520162 - DNA, 14 bp, Homo sapiens
tacagtaggagccc

SEQ ID NO: 2520163 - DNA, 15 bp, Homo sapiens
tacagtaggagccca

SEQ ID NO: 2520164 - DNA, 18 bp, Homo sapiens
tacagtaggagcccagct

SEQ ID NO: 2520165 - DNA, 20 bp, Homo sapiens
tacagtaggagcccagctct

SEQ ID NO: 2520166 - DNA, 15 bp, Homo sapiens
tacagtcctcccatc

SEQ ID NO: 2520167 - DNA, 18 bp, Homo sapiens
tacagtcttccatttgca

SEQ ID NO: 2520168 - DNA, 19 bp, Homo sapiens
tacagtcttccatttgcaa

SEQ ID NO: 2520169 - DNA, 13 bp, Homo sapiens
tacagtcttgtat

SEQ ID NO: 2520170 - DNA, 15 bp, Homo sapiens
tacagtgaaaatgta

SEQ ID NO: 2520171 - DNA, 12 bp, Homo sapiens
tacagtgagcca

SEQ ID NO: 2520172 - DNA, 16 bp, Homo sapiens
tacagtgtacagtctt

SEQ ID NO: 2520173 - DNA, 16 bp, Homo sapiens
tacagtgttattttct

SEQ ID NO: 2520174 - DNA, 19 bp, Homo sapiens
tacagtgttattttctttg

SEQ ID NO: 2520175 - DNA, 13 bp, Homo sapiens
tacagttaagttt

SEQ ID NO: 2520176 - DNA, 18 bp, Homo sapiens
tacagttcttcgggaaga

SEQ ID NO: 2520177 - DNA, 20 bp, Homo sapiens
tacagttgaaaaacagctga

SEQ ID NO: 2520178 - DNA, 16 bp, Homo sapiens
tacagtttgctgtact

SEQ ID NO: 2520179 - DNA, 17 bp, Homo sapiens
tacagtttgtcacatga

SEQ ID NO: 2520180 - DNA, 21 bp, Homo sapiens
tacataactgaaaatgtgcta

SEQ ID NO: 2520181 - DNA, 22 bp, Homo sapiens
tacataagataaatgtgctgaa

SEQ ID NO: 2520182 - DNA, 12 bp, Homo sapiens
tacataatctgt

SEQ ID NO: 2520183 - DNA, 15 bp, Homo sapiens
tacataatgcgtgca

SEQ ID NO: 2520184 - DNA, 19 bp, Homo sapiens
tacataatgcgtgcatacc

SEQ ID NO: 2520185 - DNA, 12 bp, Homo sapiens
tacatactgctg

SEQ ID NO: 2520186 - DNA, 23 bp, Homo sapiens
tacatactttcatcctgactctg

SEQ ID NO: 2520187 - DNA, 13 bp, Homo sapiens
tacatatttccaa

SEQ ID NO: 2520188 - DNA, 18 bp, Homo sapiens
tacatcccatgtaacaga

SEQ ID NO: 2520189 - DNA, 19 bp, Homo sapiens
tacatcccatgtaacagaa

SEQ ID NO: 2520190 - DNA, 20 bp, Homo sapiens
tacatcccatgtaacagaaa

SEQ ID NO: 2520191 - DNA, 21 bp, Homo sapiens
tacatcccatgtaacagaaag

SEQ ID NO: 2520192 - DNA, 17 bp, Homo sapiens
tacatcttctgccttag

SEQ ID NO: 2520193 - DNA, 17 bp, Homo sapiens
tacatcttttttcacaa

SEQ ID NO: 2520194 - DNA, 20 bp, Homo sapiens
tacatcttttttcacaaatt

SEQ ID NO: 2520195 - DNA, 19 bp, Homo sapiens
tacatgaaaacacattttt

SEQ ID NO: 2520196 - DNA, 23 bp, Homo sapiens
tacatgaaaacacatttttctta

SEQ ID NO: 2520197 - DNA, 21 bp, Homo sapiens
tacatgaaacagaaacaaaaa

SEQ ID NO: 2520198 - DNA, 18 bp, Homo sapiens
tacatgaattgcatttta

SEQ ID NO: 2520199 - DNA, 19 bp, Homo sapiens
tacatgactcagcatacct

SEQ ID NO: 2520200 - DNA, 22 bp, Homo sapiens
tacatgcagcccatgcccacct

SEQ ID NO: 2520201 - DNA, 19 bp, Homo sapiens
tacatggaataacatgtaa

SEQ ID NO: 2520202 - DNA, 22 bp, Homo sapiens
tacatggacaatacccccaggc

SEQ ID NO: 2520203 - DNA, 19 bp, Homo sapiens
tacatggcagagtttgtgt

SEQ ID NO: 2520204 - DNA, 22 bp, Homo sapiens
tacatggcagagtttgtgtgtt

SEQ ID NO: 2520205 - DNA, 12 bp, Homo sapiens
tacatgtattat

SEQ ID NO: 2520206 - DNA, 13 bp, Homo sapiens
tacatgtatttgt

SEQ ID NO: 2520207 - DNA, 19 bp, Homo sapiens
tacatgtgtagcctgtgca

SEQ ID NO: 2520208 - DNA, 12 bp, Homo sapiens
tacattctgtta

SEQ ID NO: 2520209 - DNA, 19 bp, Homo sapiens
tacattgtttgtctgtctt

SEQ ID NO: 2520210 - DNA, 13 bp, Homo sapiens
tacatttaataca

SEQ ID NO: 2520211 - DNA, 20 bp, Homo sapiens
tacatttatagttgtaacta

SEQ ID NO: 2520212 - DNA, 12 bp, Homo sapiens
tacatttatgat

SEQ ID NO: 2520213 - DNA, 19 bp, Homo sapiens
tacatttatgatttaataa

SEQ ID NO: 2520214 - DNA, 15 bp, Homo sapiens
tacatttccaaatga

SEQ ID NO: 2520215 - DNA, 16 bp, Homo sapiens
tacatttccaaatgaa

SEQ ID NO: 2520216 - DNA, 10 bp, Homo sapiens
tactcccctt

SEQ ID NO: 2520217 - DNA, 14 bp, Homo sapiens
tactcctacctcag

SEQ ID NO: 2520218 - DNA, 17 bp, Homo sapiens
tactcctacctcagcct

SEQ ID NO: 2520219 - DNA, 12 bp, Homo sapiens
tactcctctgca

SEQ ID NO: 2520220 - DNA, 13 bp, Homo sapiens
tactcctctgcag

SEQ ID NO: 2520221 - DNA, 16 bp, Homo sapiens
tactctaccctcttag

SEQ ID NO: 2520222 - DNA, 22 bp, Homo sapiens
tactctcctggaaatattaaga

SEQ ID NO: 2520223 - DNA, 12 bp, Homo sapiens
tactctgaaggg

SEQ ID NO: 2520224 - DNA, 15 bp, Homo sapiens
tactctggttctttg

SEQ ID NO: 2520225 - DNA, 17 bp, Homo sapiens
tactctggttctttgtt

SEQ ID NO: 2520226 - DNA, 14 bp, Homo sapiens
tactctgttccttc

SEQ ID NO: 2520227 - DNA, 16 bp, Homo sapiens
tactcttaagccatct

SEQ ID NO: 2520228 - DNA, 17 bp, Homo sapiens
tactcttaagccatctt

SEQ ID NO: 2520229 - DNA, 20 bp, Homo sapiens
tactcttaagccatcttggt

SEQ ID NO: 2520230 - DNA, 23 bp, Homo sapiens
tactcttaagccatcttggtaaa

SEQ ID NO: 2520231 - DNA, 14 bp, Homo sapiens
tactgactttctca

SEQ ID NO: 2520232 - DNA, 23 bp, Homo sapiens
tactgagccttgtaattctaaat

SEQ ID NO: 2520233 - DNA, 17 bp, Homo sapiens
tactgagcttctctgtg

SEQ ID NO: 2520234 - DNA, 16 bp, Homo sapiens
tactgagttacattgt

SEQ ID NO: 2520235 - DNA, 16 bp, Homo sapiens
tactgatcatgcattg

SEQ ID NO: 2520236 - DNA, 18 bp, Homo sapiens
tactgatcatgcattgtt

SEQ ID NO: 2520237 - DNA, 18 bp, Homo sapiens
tactgattcactgcatgg

SEQ ID NO: 2520238 - DNA, 14 bp, Homo sapiens
tactgattgtttca

SEQ ID NO: 2520239 - DNA, 22 bp, Homo sapiens
tactgcagctttacatgcaatt

SEQ ID NO: 2520240 - DNA, 16 bp, Homo sapiens
tactgccagatgctga

SEQ ID NO: 2520241 - DNA, 24 bp, Homo sapiens
tactgccagatgctgatgttcagt

SEQ ID NO: 2520242 - DNA, 23 bp, Homo sapiens
tactgcccaatatgcagttctgc

SEQ ID NO: 2520243 - DNA, 21 bp, Homo sapiens
tactgcccaggcctgcctgtt

SEQ ID NO: 2520244 - DNA, 19 bp, Homo sapiens
tactgctagtcttaagaac

SEQ ID NO: 2520245 - DNA, 17 bp, Homo sapiens
tactggaagttttgcat

SEQ ID NO: 2520246 - DNA, 18 bp, Homo sapiens
tactggtcttgtggaatt

SEQ ID NO: 2520247 - DNA, 19 bp, Homo sapiens
tactggtgcagtcattatg

SEQ ID NO: 2520248 - DNA, 16 bp, Homo sapiens
tactgtaaagaaagag

SEQ ID NO: 2520249 - DNA, 17 bp, Homo sapiens
tactgtaaagaaagaga

SEQ ID NO: 2520250 - DNA, 20 bp, Homo sapiens
tactgtaaagagacctacct

SEQ ID NO: 2520251 - DNA, 16 bp, Homo sapiens
tactgtaatttgtgat

SEQ ID NO: 2520252 - DNA, 19 bp, Homo sapiens
tactgtaatttgtgataca

SEQ ID NO: 2520253 - DNA, 23 bp, Homo sapiens
tactgtaatttgtgatacaatgc

SEQ ID NO: 2520254 - DNA, 18 bp, Homo sapiens
tactgtacatgaaaacac

SEQ ID NO: 2520255 - DNA, 21 bp, Homo sapiens
tactgtacatgaaaacacatt

SEQ ID NO: 2520256 - DNA, 15 bp, Homo sapiens
tactgtagtttttct

SEQ ID NO: 2520257 - DNA, 12 bp, Homo sapiens
tactgtatttga

SEQ ID NO: 2520258 - DNA, 22 bp, Homo sapiens
tactgtatttttacctttttcc

SEQ ID NO: 2520259 - DNA, 16 bp, Homo sapiens
tactgtcctacccacc

SEQ ID NO: 2520260 - DNA, 19 bp, Homo sapiens
tactgtggaaaaatattta

SEQ ID NO: 2520261 - DNA, 14 bp, Homo sapiens
tactgtggaggaag

SEQ ID NO: 2520262 - DNA, 15 bp, Homo sapiens
tactgtggcttctta

SEQ ID NO: 2520263 - DNA, 13 bp, Homo sapiens
tactgtgttcctg

SEQ ID NO: 2520264 - DNA, 16 bp, Homo sapiens
tactgtgttcctggca

SEQ ID NO: 2520265 - DNA, 14 bp, Homo sapiens
tactgttctgtgtc

SEQ ID NO: 2520266 - DNA, 17 bp, Homo sapiens
tactgttgtcctatggg

SEQ ID NO: 2520267 - DNA, 14 bp, Homo sapiens
tactgttgtgacct

SEQ ID NO: 2520268 - DNA, 12 bp, Homo sapiens
tactgtttgtct

SEQ ID NO: 2520269 - DNA, 20 bp, Homo sapiens
gagggccgtaccccaccctc

SEQ ID NO: 2520270 - DNA, 21 bp, Homo sapiens
gagggcctgcaagggagtgag

SEQ ID NO: 2520271 - DNA, 14 bp, Homo sapiens
gagggcgtggaggg

SEQ ID NO: 2520272 - DNA, 14 bp, Homo sapiens
gagggcgtgggagc

SEQ ID NO: 2520273 - DNA, 17 bp, Homo sapiens
gagggctagaacctaga

SEQ ID NO: 2520274 - DNA, 20 bp, Homo sapiens
gagggctagaacctggaagg

SEQ ID NO: 2520275 - DNA, 20 bp, Homo sapiens
gagggctagaatctggagag

SEQ ID NO: 2520276 - DNA, 14 bp, Homo sapiens
gagggctccagaca

SEQ ID NO: 2520277 - DNA, 13 bp, Homo sapiens
gagggctgccctg

SEQ ID NO: 2520278 - DNA, 15 bp, Homo sapiens
gagggctggaatctg

SEQ ID NO: 2520279 - DNA, 19 bp, Homo sapiens
gagggctggaatctggaga

SEQ ID NO: 2520280 - DNA, 15 bp, Homo sapiens
gaggggaagggccag

SEQ ID NO: 2520281 - DNA, 18 bp, Homo sapiens
gaggggcagaacagccgc

SEQ ID NO: 2520282 - DNA, 13 bp, Homo sapiens
gaggggcagccct

SEQ ID NO: 2520283 - DNA, 13 bp, Homo sapiens
gaggggcaggctg

SEQ ID NO: 2520284 - DNA, 14 bp, Homo sapiens
gaggggcaggctga

SEQ ID NO: 2520285 - DNA, 22 bp, Homo sapiens
gaggggcatctgcccctccccc

SEQ ID NO: 2520286 - DNA, 14 bp, Homo sapiens
gaggggcctcaggt

SEQ ID NO: 2520287 - DNA, 12 bp, Homo sapiens
gaggggcctctt

SEQ ID NO: 2520288 - DNA, 14 bp, Homo sapiens
gaggggcgctggcc

SEQ ID NO: 2520289 - DNA, 15 bp, Homo sapiens
gagggggtggcctcc

SEQ ID NO: 2520290 - DNA, 17 bp, Homo sapiens
gagggggtggcctccca

SEQ ID NO: 2520291 - DNA, 15 bp, Homo sapiens
gagggtcagagagga

SEQ ID NO: 2520292 - DNA, 20 bp, Homo sapiens
gagggtcccaagctgggccc

SEQ ID NO: 2520293 - DNA, 17 bp, Homo sapiens
gagggtcctggctcctg

SEQ ID NO: 2520294 - DNA, 13 bp, Homo sapiens
gagggtctgagga

SEQ ID NO: 2520295 - DNA, 21 bp, Homo sapiens
gagggtgaagtgaagacaatg

SEQ ID NO: 2520296 - DNA, 12 bp, Homo sapiens
gagggtggaata

SEQ ID NO: 2520297 - DNA, 13 bp, Homo sapiens
gagggtggcaggt

SEQ ID NO: 2520298 - DNA, 18 bp, Homo sapiens
gagggtgggagagcccag

SEQ ID NO: 2520299 - DNA, 21 bp, Homo sapiens
gagggtggtgacctctgcctg

SEQ ID NO: 2520300 - DNA, 22 bp, Homo sapiens
gagggtgtcccaaaaagaaagg

SEQ ID NO: 2520301 - DNA, 20 bp, Homo sapiens
gagggttgggttcatctgag

SEQ ID NO: 2520302 - DNA, 13 bp, Homo sapiens
gaggtaacagaac

SEQ ID NO: 2520303 - DNA, 14 bp, Homo sapiens
gaggtaacagaaca

SEQ ID NO: 2520304 - DNA, 17 bp, Homo sapiens
gaggtaacagaacagct

SEQ ID NO: 2520305 - DNA, 18 bp, Homo sapiens
gaggtaacagaacagctt

SEQ ID NO: 2520306 - DNA, 18 bp, Homo sapiens
gaggtagagtttgaagga

SEQ ID NO: 2520307 - DNA, 23 bp, Homo sapiens
gaggtagagtttgaaggaggtga

SEQ ID NO: 2520308 - DNA, 19 bp, Homo sapiens
gaggtcaaggctgcagtga

SEQ ID NO: 2520309 - DNA, 16 bp, Homo sapiens
gaggtcaagtaagaag

SEQ ID NO: 2520310 - DNA, 22 bp, Homo sapiens
gaggtcacattcaggaagatga

SEQ ID NO: 2520311 - DNA, 23 bp, Homo sapiens
gaggtcagcatgtctattcagct

SEQ ID NO: 2520312 - DNA, 22 bp, Homo sapiens
gaggtcaggagttagaggccag

SEQ ID NO: 2520313 - DNA, 14 bp, Homo sapiens
gaggtctcttgagg

SEQ ID NO: 2520314 - DNA, 18 bp, Homo sapiens
gaggtctcttgagggagc

SEQ ID NO: 2520315 - DNA, 14 bp, Homo sapiens
gaggtctgttcttt

SEQ ID NO: 2520316 - DNA, 18 bp, Homo sapiens
gaggtcttttgacatgtg

SEQ ID NO: 2520317 - DNA, 21 bp, Homo sapiens
gaggtgcagagtgcccagaac

SEQ ID NO: 2520318 - DNA, 13 bp, Homo sapiens
gaggtgccagcaa

SEQ ID NO: 2520319 - DNA, 17 bp, Homo sapiens
gaggtgccagcaactga

SEQ ID NO: 2520320 - DNA, 15 bp, Homo sapiens
gaggtgcctgtccca

SEQ ID NO: 2520321 - DNA, 23 bp, Homo sapiens
gaggtgctactgactttctcagc

SEQ ID NO: 2520322 - DNA, 17 bp, Homo sapiens
gaggtggccagagctgg

SEQ ID NO: 2520323 - DNA, 14 bp, Homo sapiens
gaggtggctgggtt

SEQ ID NO: 2520324 - DNA, 11 bp, Homo sapiens
gaggtgggagg

SEQ ID NO: 2520325 - DNA, 12 bp, Homo sapiens
gaggtgggatcc

SEQ ID NO: 2520326 - DNA, 21 bp, Homo sapiens
gaggtgggatcctccaggtgc

SEQ ID NO: 2520327 - DNA, 11 bp, Homo sapiens
gaggtgggcag

SEQ ID NO: 2520328 - DNA, 12 bp, Homo sapiens
gaggtgggcagg

SEQ ID NO: 2520329 - DNA, 23 bp, Homo sapiens
gaggtgggcccaggaccagctgg

SEQ ID NO: 2520330 - DNA, 22 bp, Homo sapiens
gaggtgtcaggctgctggcgcc

SEQ ID NO: 2520331 - DNA, 15 bp, Homo sapiens
gaggtgtgggggctg

SEQ ID NO: 2520332 - DNA, 17 bp, Homo sapiens
gaggtgtgggggctgca

SEQ ID NO: 2520333 - DNA, 19 bp, Homo sapiens
gaggttaaggctgaggaaa

SEQ ID NO: 2520334 - DNA, 22 bp, Homo sapiens
gaggttaggagttcgagaccag

SEQ ID NO: 2520335 - DNA, 22 bp, Homo sapiens
gaggttataggtcactcctggg

SEQ ID NO: 2520336 - DNA, 19 bp, Homo sapiens
gaggttgataactttgctt

SEQ ID NO: 2520337 - DNA, 13 bp, Homo sapiens
gaggttgcagtgt

SEQ ID NO: 2520338 - DNA, 17 bp, Homo sapiens
gaggttggggtgtacta

SEQ ID NO: 2520339 - DNA, 13 bp, Homo sapiens
gaggtttcagtga

SEQ ID NO: 2520340 - DNA, 22 bp, Homo sapiens
gaggtttgtttagaagaagtgt

SEQ ID NO: 2520341 - DNA, 19 bp, Homo sapiens
gaggttttaaaaaaatccc

SEQ ID NO: 2520342 - DNA, 12 bp, Homo sapiens
gagtaaaggaaa

SEQ ID NO: 2520343 - DNA, 22 bp, Homo sapiens
gagtaatctgtgtacaaagaaa

SEQ ID NO: 2520344 - DNA, 20 bp, Homo sapiens
gagtacgttgtgcatttggt

SEQ ID NO: 2520345 - DNA, 18 bp, Homo sapiens
gagtactacagtcctccc

SEQ ID NO: 2520346 - DNA, 19 bp, Homo sapiens
gagtactacagtcctccca

SEQ ID NO: 2520347 - DNA, 22 bp, Homo sapiens
gagtagaaagacagagctggga

SEQ ID NO: 2520348 - DNA, 22 bp, Homo sapiens
gagtagcaagttctagagaaga

SEQ ID NO: 2520349 - DNA, 12 bp, Homo sapiens
gagtagctggat

SEQ ID NO: 2520350 - DNA, 14 bp, Homo sapiens
gagtagctgggact

SEQ ID NO: 2520351 - DNA, 19 bp, Homo sapiens
gagtagctgggactacagg

SEQ ID NO: 2520352 - DNA, 19 bp, Homo sapiens
gagtaggaagactttggaa

SEQ ID NO: 2520353 - DNA, 16 bp, Homo sapiens
gagtataggccggtct

SEQ ID NO: 2520354 - DNA, 14 bp, Homo sapiens
gagtatatgcactt

SEQ ID NO: 2520355 - DNA, 17 bp, Homo sapiens
gagtatcaggtctccca

SEQ ID NO: 2520356 - DNA, 23 bp, Homo sapiens
gagtatctcctcgcaagctgggt

SEQ ID NO: 2520357 - DNA, 20 bp, Homo sapiens
gagtatttaggcagattgaa

SEQ ID NO: 2520358 - DNA, 19 bp, Homo sapiens
gagtcaaaactcaaatgct

SEQ ID NO: 2520359 - DNA, 23 bp, Homo sapiens
gagtcactgcctctccctggccc

SEQ ID NO: 2520360 - DNA, 22 bp, Homo sapiens
gagtcagacattttaagatggt

SEQ ID NO: 2520361 - DNA, 18 bp, Homo sapiens
gagtcagggacccctgcc

SEQ ID NO: 2520362 - DNA, 22 bp, Homo sapiens
gagtcagggacccctgcccttg

SEQ ID NO: 2520363 - DNA, 20 bp, Homo sapiens
gagtcataaaccttaagtaa

SEQ ID NO: 2520364 - DNA, 14 bp, Homo sapiens
gagtcatattttga

SEQ ID NO: 2520365 - DNA, 13 bp, Homo sapiens
gagtccagtctct

SEQ ID NO: 2520366 - DNA, 13 bp, Homo sapiens
gagtcccaccttg

SEQ ID NO: 2520367 - DNA, 20 bp, Homo sapiens
gagtcccaccttggctgcag

SEQ ID NO: 2520368 - DNA, 13 bp, Homo sapiens
gagtcccactgcc

SEQ ID NO: 2520369 - DNA, 17 bp, Homo sapiens
gagtcccactgcctcag

SEQ ID NO: 2520370 - DNA, 19 bp, Homo sapiens
gagtcccactgcctcaggt

SEQ ID NO: 2520371 - DNA, 22 bp, Homo sapiens
gagtcccactgcctcaggttcc

SEQ ID NO: 2520372 - DNA, 14 bp, Homo sapiens
gagtcccagtggga

SEQ ID NO: 2520373 - DNA, 12 bp, Homo sapiens
gagtcccctgtt

SEQ ID NO: 2520374 - DNA, 14 bp, Homo sapiens
gagtcccctgtttg

SEQ ID NO: 2520375 - DNA, 14 bp, Homo sapiens
gagtccctgccatc

SEQ ID NO: 2520376 - DNA, 17 bp, Homo sapiens
gagtcctcactcccagt

SEQ ID NO: 2520377 - DNA, 22 bp, Homo sapiens
gagtcgtacagaaagctgcctg

SEQ ID NO: 2520378 - DNA, 20 bp, Homo sapiens
gagtctagaagttgtttgtc

SEQ ID NO: 2520379 - DNA, 15 bp, Homo sapiens
gagtctatcaatcaa

SEQ ID NO: 2520380 - DNA, 23 bp, Homo sapiens
gagtctcactgttgcccaggctg

SEQ ID NO: 2520381 - DNA, 14 bp, Homo sapiens
gagtctgaagcaga

SEQ ID NO: 2520382 - DNA, 15 bp, Homo sapiens
gagtctgaaggctgg

SEQ ID NO: 2520383 - DNA, 21 bp, Homo sapiens
gagtcttggcggcagcagcca

SEQ ID NO: 2520384 - DNA, 22 bp, Homo sapiens
gagtgaacaaatttacagagac

SEQ ID NO: 2520385 - DNA, 23 bp, Homo sapiens
gagtgaacaaatttacagagaca

SEQ ID NO: 2520386 - DNA, 16 bp, Homo sapiens
gagtgaagaggggcag

SEQ ID NO: 2520387 - DNA, 19 bp, Homo sapiens
gagtgaagaggggcagccc

SEQ ID NO: 2520388 - DNA, 21 bp, Homo sapiens
gagtgaagaggggcagccctt

SEQ ID NO: 2520389 - DNA, 16 bp, Homo sapiens
gagtgacagaggcagc

SEQ ID NO: 2520390 - DNA, 17 bp, Homo sapiens
gagtgacagaggcagcc

SEQ ID NO: 2520391 - DNA, 18 bp, Homo sapiens
gagtgacggtcccacact

SEQ ID NO: 2520392 - DNA, 20 bp, Homo sapiens
gagtgacggtcccacactgg

SEQ ID NO: 2520393 - DNA, 13 bp, Homo sapiens
gccgacctcagcc

SEQ ID NO: 2520394 - DNA, 15 bp, Homo sapiens
gccgacctcagcctt

SEQ ID NO: 2520395 - DNA, 22 bp, Homo sapiens
gccgagacatggcttgccacag

SEQ ID NO: 2520396 - DNA, 16 bp, Homo sapiens
gccgagatcacgccac

SEQ ID NO: 2520397 - DNA, 17 bp, Homo sapiens
gccgagattgcaccact

SEQ ID NO: 2520398 - DNA, 20 bp, Homo sapiens
gccgagccgggcctggggct

SEQ ID NO: 2520399 - DNA, 18 bp, Homo sapiens
gccgcagcctccctctga

SEQ ID NO: 2520400 - DNA, 13 bp, Homo sapiens
gccgcagctcttg

SEQ ID NO: 2520401 - DNA, 20 bp, Homo sapiens
gccgcagctcttgcccttcc

SEQ ID NO: 2520402 - DNA, 16 bp, Homo sapiens
gccgccattgccacca

SEQ ID NO: 2520403 - DNA, 21 bp, Homo sapiens
gccgccattgccaccaggaga

SEQ ID NO: 2520404 - DNA, 17 bp, Homo sapiens
gccgccccctgcccccc

SEQ ID NO: 2520405 - DNA, 12 bp, Homo sapiens
gccgcctcccag

SEQ ID NO: 2520406 - DNA, 17 bp, Homo sapiens
gccgcctcccagcctgg

SEQ ID NO: 2520407 - DNA, 13 bp, Homo sapiens
gccgcctggtact

SEQ ID NO: 2520408 - DNA, 15 bp, Homo sapiens
gccgcctggtactca

SEQ ID NO: 2520409 - DNA, 18 bp, Homo sapiens
gccgcctggtactcaagc

SEQ ID NO: 2520410 - DNA, 13 bp, Homo sapiens
gccgctagaggcc

SEQ ID NO: 2520411 - DNA, 12 bp, Homo sapiens
gccgctccaggg

SEQ ID NO: 2520412 - DNA, 15 bp, Homo sapiens
gccgctcctgtctgc

SEQ ID NO: 2520413 - DNA, 20 bp, Homo sapiens
gccgctcctgtctgccagcc

SEQ ID NO: 2520414 - DNA, 21 bp, Homo sapiens
gccgctcctgtctgccagcca

SEQ ID NO: 2520415 - DNA, 22 bp, Homo sapiens
gccgctcctgtctgccagccag

SEQ ID NO: 2520416 - DNA, 15 bp, Homo sapiens
gccgctgagcgagga

SEQ ID NO: 2520417 - DNA, 21 bp, Homo sapiens
gccggagtccactcccagtgc

SEQ ID NO: 2520418 - DNA, 20 bp, Homo sapiens
gccggcaaccccagttctgc

SEQ ID NO: 2520419 - DNA, 20 bp, Homo sapiens
gccggccctggggctaggct

SEQ ID NO: 2520420 - DNA, 16 bp, Homo sapiens
gccggcctctctggcc

SEQ ID NO: 2520421 - DNA, 23 bp, Homo sapiens
gccggcctctctggcctcccacc

SEQ ID NO: 2520422 - DNA, 20 bp, Homo sapiens
gccgggaacagacaacagaa

SEQ ID NO: 2520423 - DNA, 22 bp, Homo sapiens
gccgggaacagacaacagaagt

SEQ ID NO: 2520424 - DNA, 23 bp, Homo sapiens
gccgggaccccgagcctggctcc

SEQ ID NO: 2520425 - DNA, 19 bp, Homo sapiens
gccgggccgaatcccctcc

SEQ ID NO: 2520426 - DNA, 21 bp, Homo sapiens
gccgggcgcggtggctcacgc

SEQ ID NO: 2520427 - DNA, 20 bp, Homo sapiens
gccgggcgtggtggtgagtg

SEQ ID NO: 2520428 - DNA, 16 bp, Homo sapiens
gccggggacagaggcc

SEQ ID NO: 2520429 - DNA, 19 bp, Homo sapiens
gccggggacagaggcctgc

SEQ ID NO: 2520430 - DNA, 22 bp, Homo sapiens
gccggggtggagcatgggcctg

SEQ ID NO: 2520431 - DNA, 21 bp, Homo sapiens
gccgggtctgcctcttctggg

SEQ ID NO: 2520432 - DNA, 19 bp, Homo sapiens
gccgggtgcggtggctcac

SEQ ID NO: 2520433 - DNA, 19 bp, Homo sapiens
gccggtctgcaagtcagag

SEQ ID NO: 2520434 - DNA, 23 bp, Homo sapiens
gccgtctacctgaggggcctctt

SEQ ID NO: 2520435 - DNA, 21 bp, Homo sapiens
gccgtcttcactcgcccccgg

SEQ ID NO: 2520436 - DNA, 23 bp, Homo sapiens
gccgtgagttctcagggctcctg

SEQ ID NO: 2520437 - DNA, 15 bp, Homo sapiens
gccgtgggcctgggg

SEQ ID NO: 2520438 - DNA, 20 bp, Homo sapiens
gccgttgatgttggctggga

SEQ ID NO: 2520439 - DNA, 16 bp, Homo sapiens
gcctaacaccagcgtt

SEQ ID NO: 2520440 - DNA, 23 bp, Homo sapiens
gcctagcatacgtacacatttta

SEQ ID NO: 2520441 - DNA, 15 bp, Homo sapiens
gcctagccgacctca

SEQ ID NO: 2520442 - DNA, 16 bp, Homo sapiens
gcctagctgctacaaa

SEQ ID NO: 2520443 - DNA, 20 bp, Homo sapiens
gcctaggagatatctgaggg

SEQ ID NO: 2520444 - DNA, 13 bp, Homo sapiens
gcctaggtgacag

SEQ ID NO: 2520445 - DNA, 14 bp, Homo sapiens
gcctagtcccttcc

SEQ ID NO: 2520446 - DNA, 20 bp, Homo sapiens
gcctatcagagttgctgcaa

SEQ ID NO: 2520447 - DNA, 18 bp, Homo sapiens
gcctatgatcccagcact

SEQ ID NO: 2520448 - DNA, 22 bp, Homo sapiens
gcctatgtgcatgcagcatcta

SEQ ID NO: 2520449 - DNA, 15 bp, Homo sapiens
gcctattatattaaa

SEQ ID NO: 2520450 - DNA, 15 bp, Homo sapiens
gcctcaaaggcccgc

SEQ ID NO: 2520451 - DNA, 17 bp, Homo sapiens
gcctcaaaggcccgctc

SEQ ID NO: 2520452 - DNA, 15 bp, Homo sapiens
gcctcaaccctccct

SEQ ID NO: 2520453 - DNA, 18 bp, Homo sapiens
gcctcaaccctccctcag

SEQ ID NO: 2520454 - DNA, 21 bp, Homo sapiens
gcctcaaccctccctcagccc

SEQ ID NO: 2520455 - DNA, 13 bp, Homo sapiens
gcctcaaggactt

SEQ ID NO: 2520456 - DNA, 24 bp, Homo sapiens
gcctcaagtgattctcctgcctca

SEQ ID NO: 2520457 - DNA, 17 bp, Homo sapiens
gcctcacagtccttacc

SEQ ID NO: 2520458 - DNA, 18 bp, Homo sapiens
gcctcacagtccttacca

SEQ ID NO: 2520459 - DNA, 17 bp, Homo sapiens
gcctcagcatcctggca

SEQ ID NO: 2520460 - DNA, 18 bp, Homo sapiens
gcctcagcatcctggcac

SEQ ID NO: 2520461 - DNA, 12 bp, Homo sapiens
gcctcagcctcc

SEQ ID NO: 2520462 - DNA, 23 bp, Homo sapiens
gcctcagcctcccaaagtgctgg

SEQ ID NO: 2520463 - DNA, 19 bp, Homo sapiens
gcctcagctgcctcacttc

SEQ ID NO: 2520464 - DNA, 13 bp, Homo sapiens
gcctcaggttcct

SEQ ID NO: 2520465 - DNA, 14 bp, Homo sapiens
gcctcaggttccta

SEQ ID NO: 2520466 - DNA, 15 bp, Homo sapiens
gcctcagtgccacta

SEQ ID NO: 2520467 - DNA, 11 bp, Homo sapiens
gcctcagtgga

SEQ ID NO: 2520468 - DNA, 15 bp, Homo sapiens
gcctcatatttaaag

SEQ ID NO: 2520469 - DNA, 19 bp, Homo sapiens
gcctcatccgaggcagggt

SEQ ID NO: 2520470 - DNA, 22 bp, Homo sapiens
gcctccaaggaggggctgtaaa

SEQ ID NO: 2520471 - DNA, 18 bp, Homo sapiens
gcctccaccaccactggc

SEQ ID NO: 2520472 - DNA, 12 bp, Homo sapiens
gcctccaccctc

SEQ ID NO: 2520473 - DNA, 15 bp, Homo sapiens
gcctccagcctctgt

SEQ ID NO: 2520474 - DNA, 11 bp, Homo sapiens
gcctccatgct

SEQ ID NO: 2520475 - DNA, 17 bp, Homo sapiens
gcctccattctgaccat

SEQ ID NO: 2520476 - DNA, 19 bp, Homo sapiens
gcctcccaaagtgctggga

SEQ ID NO: 2520477 - DNA, 21 bp, Homo sapiens
gcctcccaactcaccccagcc

SEQ ID NO: 2520478 - DNA, 23 bp, Homo sapiens
gcctcccaactcaccccagcccc

SEQ ID NO: 2520479 - DNA, 12 bp, Homo sapiens
gcctcccacccg

SEQ ID NO: 2520480 - DNA, 19 bp, Homo sapiens
gcctcccacccgatgctgc

SEQ ID NO: 2520481 - DNA, 14 bp, Homo sapiens
gcctcccacgactg

SEQ ID NO: 2520482 - DNA, 22 bp, Homo sapiens
gcctccccaaccctgcccctgc

SEQ ID NO: 2520483 - DNA, 19 bp, Homo sapiens
gcctccccacggccgctcc

SEQ ID NO: 2520484 - DNA, 22 bp, Homo sapiens
gcctccccacggccgctccagg

SEQ ID NO: 2520485 - DNA, 15 bp, Homo sapiens
gcctcccctgctgaa

SEQ ID NO: 2520486 - DNA, 20 bp, Homo sapiens
gcctcccgaatagctgggac

SEQ ID NO: 2520487 - DNA, 18 bp, Homo sapiens
gcctcccgagtagctggg

SEQ ID NO: 2520488 - DNA, 19 bp, Homo sapiens
gcctcccgagtagctggga

SEQ ID NO: 2520489 - DNA, 20 bp, Homo sapiens
gcctcccgagtagctgggac

SEQ ID NO: 2520490 - DNA, 21 bp, Homo sapiens
gcctcccgagtagctgggact

SEQ ID NO: 2520491 - DNA, 13 bp, Homo sapiens
gcctccctcaacc

SEQ ID NO: 2520492 - DNA, 18 bp, Homo sapiens
gcctccctcaccctgagc

SEQ ID NO: 2520493 - DNA, 21 bp, Homo sapiens
gcctccctctgacctgcaggc

SEQ ID NO: 2520494 - DNA, 20 bp, Homo sapiens
gcctccctgttgaagctctg

SEQ ID NO: 2520495 - DNA, 16 bp, Homo sapiens
gcctccggcctcccct

SEQ ID NO: 2520496 - DNA, 18 bp, Homo sapiens
gcctccggcgtcagcctc

SEQ ID NO: 2520497 - DNA, 21 bp, Homo sapiens
gcctccggcgtcagcctccag

SEQ ID NO: 2520498 - DNA, 16 bp, Homo sapiens
gcctcctcacccccag

SEQ ID NO: 2520499 - DNA, 23 bp, Homo sapiens
gcctcctcatctgggggagtgga

SEQ ID NO: 2520500 - DNA, 16 bp, Homo sapiens
gcctcctcccttagct

SEQ ID NO: 2520501 - DNA, 16 bp, Homo sapiens
gcctcctgacctgagg

SEQ ID NO: 2520502 - DNA, 23 bp, Homo sapiens
gcctcctgagtagctgggactac

SEQ ID NO: 2520503 - DNA, 23 bp, Homo sapiens
gcctcctgcctgcccctctcccg

SEQ ID NO: 2520504 - DNA, 17 bp, Homo sapiens
gcctccttccacctccc

SEQ ID NO: 2520505 - DNA, 19 bp, Homo sapiens
gcctccttccacctccctc

SEQ ID NO: 2520506 - DNA, 16 bp, Homo sapiens
gcctcgaactggctgc

SEQ ID NO: 2520507 - DNA, 22 bp, Homo sapiens
gcctcgaactggctgcaaaggg

SEQ ID NO: 2520508 - DNA, 17 bp, Homo sapiens
gcctcggagcctcatcc

SEQ ID NO: 2520509 - DNA, 18 bp, Homo sapiens
gcctctaaccccaggccc

SEQ ID NO: 2520510 - DNA, 19 bp, Homo sapiens
gcctctaaccccaggcccc

SEQ ID NO: 2520511 - DNA, 23 bp, Homo sapiens
gcctctcacctgtactcttccga

SEQ ID NO: 2520512 - DNA, 16 bp, Homo sapiens
gcctctcatcaactga

SEQ ID NO: 2520513 - DNA, 20 bp, Homo sapiens
gcctctcattccagaggaag

SEQ ID NO: 2520514 - DNA, 18 bp, Homo sapiens
gcctctcccgtcagggcc

SEQ ID NO: 2520515 - DNA, 14 bp, Homo sapiens
gcctctccctggcc

SEQ ID NO: 2520516 - DNA, 16 bp, Homo sapiens
gcctctcctttgtata

SEQ ID NO: 2520517 - DNA, 17 bp, Homo sapiens
gcctctcctttgtatat

SEQ ID NO: 2520518 - DNA, 19 bp, Homo sapiens
gcctctcggtggccagcag

SEQ ID NO: 2520519 - DNA, 12 bp, Homo sapiens
gcctctctggcc

SEQ ID NO: 2520520 - DNA, 19 bp, Homo sapiens
gcctctgacacacagctct

SEQ ID NO: 2520521 - DNA, 18 bp, Homo sapiens
gcctctgcactcccctgc

SEQ ID NO: 2520522 - DNA, 20 bp, Homo sapiens
gcctctgcactcccctgctg

SEQ ID NO: 2520523 - DNA, 21 bp, Homo sapiens
gcctctgcactcccctgctgg

SEQ ID NO: 2520524 - DNA, 13 bp, Homo sapiens
gcctctgcctctg

SEQ ID NO: 2520525 - DNA, 15 bp, Homo sapiens
gcctctgctgccatg

SEQ ID NO: 2520526 - DNA, 12 bp, Homo sapiens
gcctctggctag

SEQ ID NO: 2520527 - DNA, 13 bp, Homo sapiens
gcctctggctaga

SEQ ID NO: 2520528 - DNA, 19 bp, Homo sapiens
gcctctggctagaggccag

SEQ ID NO: 2520529 - DNA, 12 bp, Homo sapiens
gcctctgggact

SEQ ID NO: 2520530 - DNA, 18 bp, Homo sapiens
gcctctgtgtccttccct

SEQ ID NO: 2520531 - DNA, 19 bp, Homo sapiens
gcctcttaaagctgcctgt

SEQ ID NO: 2520532 - DNA, 17 bp, Homo sapiens
gcctcttatgggctggg

SEQ ID NO: 2520533 - DNA, 18 bp, Homo sapiens
gcctcttatgggctgggt

SEQ ID NO: 2520534 - DNA, 17 bp, Homo sapiens
gcctcttctagagccgt

SEQ ID NO: 2520535 - DNA, 23 bp, Homo sapiens
gcctcttctctactctagggaaa

SEQ ID NO: 2520536 - DNA, 16 bp, Homo sapiens
gcctcttcttcttcag

SEQ ID NO: 2520537 - DNA, 20 bp, Homo sapiens
gcctcttcttcttcagaaga

SEQ ID NO: 2520538 - DNA, 19 bp, Homo sapiens
gcctcttggacctctgctc

SEQ ID NO: 2520539 - DNA, 18 bp, Homo sapiens
gcctgaaatttcaccatt

SEQ ID NO: 2520540 - DNA, 17 bp, Homo sapiens
gcctgaagtcacacagt

SEQ ID NO: 2520541 - DNA, 18 bp, Homo sapiens
gcctgaagtcacacagtg

SEQ ID NO: 2520542 - DNA, 22 bp, Homo sapiens
gcctgaagtcacacagtgagtc

SEQ ID NO: 2520543 - DNA, 23 bp, Homo sapiens
gcctgaccctacttcttttgctc

SEQ ID NO: 2520544 - DNA, 17 bp, Homo sapiens
gcctgagcgacagtgag

SEQ ID NO: 2520545 - DNA, 14 bp, Homo sapiens
gcctgagctcactc

SEQ ID NO: 2520546 - DNA, 17 bp, Homo sapiens
gcctgagctcactcggc

SEQ ID NO: 2520547 - DNA, 12 bp, Homo sapiens
gcctgagctggg

SEQ ID NO: 2520548 - DNA, 17 bp, Homo sapiens
gcctgaggatgagctgg

SEQ ID NO: 2520549 - DNA, 18 bp, Homo sapiens
gcctgaggatgagctgga

SEQ ID NO: 2520550 - DNA, 21 bp, Homo sapiens
gcctgaggatgagctggaagg

SEQ ID NO: 2520551 - DNA, 17 bp, Homo sapiens
gcctgaggctgagactg

SEQ ID NO: 2520552 - DNA, 14 bp, Homo sapiens
gcctgaggctggga

SEQ ID NO: 2520553 - DNA, 18 bp, Homo sapiens
gcctgagggcccctctgc

SEQ ID NO: 2520554 - DNA, 17 bp, Homo sapiens
gcctgagggtggagact

SEQ ID NO: 2520555 - DNA, 21 bp, Homo sapiens
gcctgaggtcaggagttcaag

SEQ ID NO: 2520556 - DNA, 13 bp, Homo sapiens
gcctgaggtctgt

SEQ ID NO: 2520557 - DNA, 15 bp, Homo sapiens
gcctgagtctcctgt

SEQ ID NO: 2520558 - DNA, 13 bp, Homo sapiens
gcctgatggacct

SEQ ID NO: 2520559 - DNA, 12 bp, Homo sapiens
gcctgcagagag

SEQ ID NO: 2520560 - DNA, 16 bp, Homo sapiens
gcctgcagagagaagc

SEQ ID NO: 2520561 - DNA, 17 bp, Homo sapiens
gcctgcagagagaagcc

SEQ ID NO: 2520562 - DNA, 19 bp, Homo sapiens
gcctgcagggtggtgctgg

SEQ ID NO: 2520563 - DNA, 20 bp, Homo sapiens
gcctgcagggtggtgctggg

SEQ ID NO: 2520564 - DNA, 15 bp, Homo sapiens
gcctgccagtcctag

SEQ ID NO: 2520565 - DNA, 19 bp, Homo sapiens
gcctgccagtcctagctgc

SEQ ID NO: 2520566 - DNA, 10 bp, Homo sapiens
gcctgcccac

SEQ ID NO: 2520567 - DNA, 12 bp, Homo sapiens
gcctgcccaggc

SEQ ID NO: 2520568 - DNA, 14 bp, Homo sapiens
gcctgcccaggccc

SEQ ID NO: 2520569 - DNA, 20 bp, Homo sapiens
gcctgcccaggcccctgcca

SEQ ID NO: 2520570 - DNA, 23 bp, Homo sapiens
gcctgccccaaacaaatatgcaa

SEQ ID NO: 2520571 - DNA, 17 bp, Homo sapiens
gcctgcccctctcccgc

SEQ ID NO: 2520572 - DNA, 20 bp, Homo sapiens
gcctgcccgtctctctccca

SEQ ID NO: 2520573 - DNA, 17 bp, Homo sapiens
gcctgccctccccagag

SEQ ID NO: 2520574 - DNA, 16 bp, Homo sapiens
gcctgcctcttctcta

SEQ ID NO: 2520575 - DNA, 13 bp, Homo sapiens
gcctgcctggagc

SEQ ID NO: 2520576 - DNA, 15 bp, Homo sapiens
gcctgcctggcaggc

SEQ ID NO: 2520577 - DNA, 13 bp, Homo sapiens
gcctgcctgtctg

SEQ ID NO: 2520578 - DNA, 14 bp, Homo sapiens
gcctgcctgtctgt

SEQ ID NO: 2520579 - DNA, 20 bp, Homo sapiens
gcctgcgcccaccccgctct

SEQ ID NO: 2520580 - DNA, 23 bp, Homo sapiens
gcctgctaattccccagattgca

SEQ ID NO: 2520581 - DNA, 13 bp, Homo sapiens
gcctgctccagct

SEQ ID NO: 2520582 - DNA, 16 bp, Homo sapiens
gcctgctccagctgtt

SEQ ID NO: 2520583 - DNA, 18 bp, Homo sapiens
gcctgctccagctgttca

SEQ ID NO: 2520584 - DNA, 17 bp, Homo sapiens
gcctgctcccagcagcc

SEQ ID NO: 2520585 - DNA, 11 bp, Homo sapiens
gcctgctgcat

SEQ ID NO: 2520586 - DNA, 15 bp, Homo sapiens
gcctggaagacagag

SEQ ID NO: 2520587 - DNA, 23 bp, Homo sapiens
gcctggaagacagagacctcctg

SEQ ID NO: 2520588 - DNA, 14 bp, Homo sapiens
gcctggaccctgtg

SEQ ID NO: 2520589 - DNA, 15 bp, Homo sapiens
gcctggacctgcctc

SEQ ID NO: 2520590 - DNA, 17 bp, Homo sapiens
gcctggacctgcctcct

SEQ ID NO: 2520591 - DNA, 18 bp, Homo sapiens
gcctggacctgcctcctg

SEQ ID NO: 2520592 - DNA, 20 bp, Homo sapiens
gcctggatggggctgcaccg

SEQ ID NO: 2520593 - DNA, 13 bp, Homo sapiens
gcctggcacacat

SEQ ID NO: 2520594 - DNA, 14 bp, Homo sapiens
gcctggcacacatc

SEQ ID NO: 2520595 - DNA, 16 bp, Homo sapiens
gcctggccacctctct

SEQ ID NO: 2520596 - DNA, 16 bp, Homo sapiens
gcctggccagatgcac

SEQ ID NO: 2520597 - DNA, 20 bp, Homo sapiens
gcctggccagatgcaccagc

SEQ ID NO: 2520598 - DNA, 22 bp, Homo sapiens
gcctggccagatgcaccagccc

SEQ ID NO: 2520599 - DNA, 14 bp, Homo sapiens
gcctggccaggagc

SEQ ID NO: 2520600 - DNA, 13 bp, Homo sapiens
gcctggccaggca

SEQ ID NO: 2520601 - DNA, 15 bp, Homo sapiens
gcctggccaggcacc

SEQ ID NO: 2520602 - DNA, 17 bp, Homo sapiens
gcctggccagggcctgg

SEQ ID NO: 2520603 - DNA, 16 bp, Homo sapiens
gcctggccccatggtc

SEQ ID NO: 2520604 - DNA, 17 bp, Homo sapiens
gcctggccccctgtcct

SEQ ID NO: 2520605 - DNA, 14 bp, Homo sapiens
gcctggcccctcag

SEQ ID NO: 2520606 - DNA, 16 bp, Homo sapiens
gcctggcccctcaggg

SEQ ID NO: 2520607 - DNA, 15 bp, Homo sapiens
gcctggccggcaacc

SEQ ID NO: 2520608 - DNA, 18 bp, Homo sapiens
gcctggccggcaacccca

SEQ ID NO: 2520609 - DNA, 13 bp, Homo sapiens
gcctggcctgagc

SEQ ID NO: 2520610 - DNA, 16 bp, Homo sapiens
gcctggcctggcacac

SEQ ID NO: 2520611 - DNA, 16 bp, Homo sapiens
gcctggctcagagcca

SEQ ID NO: 2520612 - DNA, 20 bp, Homo sapiens
gcctggctcccacaggcagc

SEQ ID NO: 2520613 - DNA, 21 bp, Homo sapiens
gcctggctcccacaggcagct

SEQ ID NO: 2520614 - DNA, 16 bp, Homo sapiens
gcctggctccgtccag

SEQ ID NO: 2520615 - DNA, 13 bp, Homo sapiens
gcctggcttctcc

SEQ ID NO: 2520616 - DNA, 13 bp, Homo sapiens
gcctggcttctgg

SEQ ID NO: 2520617 - DNA, 15 bp, Homo sapiens
gcctgggaatgtatt

SEQ ID NO: 2520618 - DNA, 21 bp, Homo sapiens
gcctgggaggtcaaggctgca

SEQ ID NO: 2520619 - DNA, 16 bp, Homo sapiens
gcctgggcaacagagc

SEQ ID NO: 2520620 - DNA, 20 bp, Homo sapiens
gcctgggcaacagagcaaga

SEQ ID NO: 2520621 - DNA, 13 bp, Homo sapiens
gcctgggcagcat

SEQ ID NO: 2520622 - DNA, 20 bp, Homo sapiens
gcctgggcagccaggctgcc

SEQ ID NO: 2520623 - DNA, 23 bp, Homo sapiens
gcctgggcagccaggctgccaag

SEQ ID NO: 2520624 - DNA, 20 bp, Homo sapiens
gcctgggccacagggcgaga

SEQ ID NO: 2520625 - DNA, 20 bp, Homo sapiens
gcctgggcgacagagcgaga

SEQ ID NO: 2520626 - DNA, 23 bp, Homo sapiens
gcctgggctcccttgtgcgtggg

SEQ ID NO: 2520627 - DNA, 15 bp, Homo sapiens
gcctgggctgttggc

SEQ ID NO: 2520628 - DNA, 18 bp, Homo sapiens
gcctgggctgttggcact

SEQ ID NO: 2520629 - DNA, 16 bp, Homo sapiens
gcctgggggtgccagg

SEQ ID NO: 2520630 - DNA, 22 bp, Homo sapiens
gcctggggtaccaagagactcc

SEQ ID NO: 2520631 - DNA, 12 bp, Homo sapiens
gcctgggtgctg

SEQ ID NO: 2520632 - DNA, 15 bp, Homo sapiens
gcctgggtgctggct

SEQ ID NO: 2520633 - DNA, 21 bp, Homo sapiens
gcctgggtgctggctgcccag

SEQ ID NO: 2520634 - DNA, 16 bp, Homo sapiens
gcctggtggcagctgc

SEQ ID NO: 2520635 - DNA, 17 bp, Homo sapiens
gcctggtggcagctgcg

SEQ ID NO: 2520636 - DNA, 17 bp, Homo sapiens
gcctgtaatcccagcac

SEQ ID NO: 2520637 - DNA, 19 bp, Homo sapiens
gcctgtaatcccagcactt

SEQ ID NO: 2520638 - DNA, 13 bp, Homo sapiens
gcctgtccagcct

SEQ ID NO: 2520639 - DNA, 15 bp, Homo sapiens
gcctgtccagcctgg

SEQ ID NO: 2520640 - DNA, 22 bp, Homo sapiens
gcctgtctcatccccaggggtc

SEQ ID NO: 2520641 - DNA, 13 bp, Homo sapiens
gcctgtctccttt

SEQ ID NO: 2520642 - DNA, 21 bp, Homo sapiens
gcctgtctcctttgcaggctc

SEQ ID NO: 2520643 - DNA, 17 bp, Homo sapiens
gcctgtgaggtgcagag

SEQ ID NO: 2520644 - DNA, 18 bp, Homo sapiens
gcctgtgcctctgggact

SEQ ID NO: 2520645 - DNA, 19 bp, Homo sapiens
gcctgtgcctctgggactg

SEQ ID NO: 2520646 - DNA, 16 bp, Homo sapiens
gcctgtgctgcccgtc

SEQ ID NO: 2520647 - DNA, 22 bp, Homo sapiens
gcctgtggcatctttgccttgg

SEQ ID NO: 2520648 - DNA, 17 bp, Homo sapiens
gcctgtggcctgtgtcc

SEQ ID NO: 2520649 - DNA, 19 bp, Homo sapiens
gcctgtgtcccatgaccca

SEQ ID NO: 2520650 - DNA, 22 bp, Homo sapiens
gcctgtgtcccatgacccaccc

SEQ ID NO: 2520651 - DNA, 19 bp, Homo sapiens
gcctgttcagctccagctc

SEQ ID NO: 2520652 - DNA, 20 bp, Homo sapiens
gcctgttcagctccagctca

SEQ ID NO: 2520653 - DNA, 19 bp, Homo sapiens
gcctgttcagttacagaaa

SEQ ID NO: 2520654 - DNA, 17 bp, Homo sapiens
gccttaattttcagtat

SEQ ID NO: 2520655 - DNA, 17 bp, Homo sapiens
gccttagaagtcacaca

SEQ ID NO: 2520656 - DNA, 18 bp, Homo sapiens
gccttagcatgtttgctg

SEQ ID NO: 2520657 - DNA, 20 bp, Homo sapiens
gccttagcatgtttgctgaa

SEQ ID NO: 2520658 - DNA, 22 bp, Homo sapiens
gccttagtctcagtttgtgtgt

SEQ ID NO: 2520659 - DNA, 17 bp, Homo sapiens
gccttatcaagtgtctt

SEQ ID NO: 2520660 - DNA, 15 bp, Homo sapiens
gccttatcctctgat

SEQ ID NO: 2520661 - DNA, 16 bp, Homo sapiens
gccttatcctctgatc

SEQ ID NO: 2520662 - DNA, 23 bp, Homo sapiens
gccttatctccaagaccagagat

SEQ ID NO: 2520663 - DNA, 20 bp, Homo sapiens
gccttcactccggtgtgcct

SEQ ID NO: 2520664 - DNA, 23 bp, Homo sapiens
gccttccacgctgtctccagacc

SEQ ID NO: 2520665 - DNA, 22 bp, Homo sapiens
gccttccacttggctacacagg

SEQ ID NO: 2520666 - DNA, 12 bp, Homo sapiens
gccttccagggg

SEQ ID NO: 2520667 - DNA, 16 bp, Homo sapiens
gccttccaggggtggg

SEQ ID NO: 2520668 - DNA, 13 bp, Homo sapiens
gccttccataatt

SEQ ID NO: 2520669 - DNA, 21 bp, Homo sapiens
gccttccataattatgacagt

SEQ ID NO: 2520670 - DNA, 17 bp, Homo sapiens
gccttccatgtcggcct

SEQ ID NO: 2520671 - DNA, 14 bp, Homo sapiens
gccttcccctgggc

SEQ ID NO: 2520672 - DNA, 13 bp, Homo sapiens
gccttcctcctgg

SEQ ID NO: 2520673 - DNA, 22 bp, Homo sapiens
gccttcgcggtggaaggcccga

SEQ ID NO: 2520674 - DNA, 17 bp, Homo sapiens
gccttctcatgatccaa

SEQ ID NO: 2520675 - DNA, 13 bp, Homo sapiens
gccttctcctccc

SEQ ID NO: 2520676 - DNA, 16 bp, Homo sapiens
gccttctgtcctggtg

SEQ ID NO: 2520677 - DNA, 18 bp, Homo sapiens
gccttctgtcctggtgtc

SEQ ID NO: 2520678 - DNA, 18 bp, Homo sapiens
gccttcttctttttgctg

SEQ ID NO: 2520679 - DNA, 21 bp, Homo sapiens
gccttcttctttttgctgttg

SEQ ID NO: 2520680 - DNA, 19 bp, Homo sapiens
gccttctttgcttgcctct

SEQ ID NO: 2520681 - DNA, 22 bp, Homo sapiens
gccttctttgcttgcctctctg

SEQ ID NO: 2520682 - DNA, 18 bp, Homo sapiens
gccttgaaccacttccct

SEQ ID NO: 2520683 - DNA, 14 bp, Homo sapiens
gccttgaagccact

SEQ ID NO: 2520684 - DNA, 15 bp, Homo sapiens
gccttgaagccactg

SEQ ID NO: 2520685 - DNA, 17 bp, Homo sapiens
gccttgaatatcccctc

SEQ ID NO: 2520686 - DNA, 21 bp, Homo sapiens
gccttgaccattctccacctg

SEQ ID NO: 2520687 - DNA, 23 bp, Homo sapiens
gccttgaccattctccacctgcc

SEQ ID NO: 2520688 - DNA, 22 bp, Homo sapiens
gccttgcccggattctgggagg

SEQ ID NO: 2520689 - DNA, 19 bp, Homo sapiens
gccttgcggtatccgcccc

SEQ ID NO: 2520690 - DNA, 14 bp, Homo sapiens
gccttgctggacgg

SEQ ID NO: 2520691 - DNA, 19 bp, Homo sapiens
gccttggagggtcccaagc

SEQ ID NO: 2520692 - DNA, 15 bp, Homo sapiens
gccttgggctgctcc

SEQ ID NO: 2520693 - DNA, 18 bp, Homo sapiens
gccttgggctgctcctca

SEQ ID NO: 2520694 - DNA, 22 bp, Homo sapiens
gccttgggctgctcctcatggt

SEQ ID NO: 2520695 - DNA, 15 bp, Homo sapiens
gccttgtgtctacag

SEQ ID NO: 2520696 - DNA, 17 bp, Homo sapiens
gccttgtgtctacagag

SEQ ID NO: 2520697 - DNA, 22 bp, Homo sapiens
gcctttagtgatcacagcagct

SEQ ID NO: 2520698 - DNA, 21 bp, Homo sapiens
gcctttcctgtagccttctgt

SEQ ID NO: 2520699 - DNA, 19 bp, Homo sapiens
gcctttctcgattttatct

SEQ ID NO: 2520700 - DNA, 16 bp, Homo sapiens
gcctttgacctgcctc

SEQ ID NO: 2520701 - DNA, 23 bp, Homo sapiens
gcctttgagacagtttcttagct

SEQ ID NO: 2520702 - DNA, 13 bp, Homo sapiens
gcctttgctcctc

SEQ ID NO: 2520703 - DNA, 14 bp, Homo sapiens
gccttttatagcta

SEQ ID NO: 2520704 - DNA, 16 bp, Homo sapiens
gccttttatttcttaa

SEQ ID NO: 2520705 - DNA, 18 bp, Homo sapiens
gccttttgcacccctccc

SEQ ID NO: 2520706 - DNA, 19 bp, Homo sapiens
gccttttgcacccctccca

SEQ ID NO: 2520707 - DNA, 20 bp, Homo sapiens
gccttttgcacccctcccat

SEQ ID NO: 2520708 - DNA, 14 bp, Homo sapiens
gcgaaggggccctg

SEQ ID NO: 2520709 - DNA, 16 bp, Homo sapiens
gcgaccacccctgcct

SEQ ID NO: 2520710 - DNA, 22 bp, Homo sapiens
gcgaccttcctcatccacccca

SEQ ID NO: 2520711 - DNA, 23 bp, Homo sapiens
gcgaccttcctcatccaccccat

SEQ ID NO: 2520712 - DNA, 20 bp, Homo sapiens
gcgagaacctaagtttcagt

SEQ ID NO: 2520713 - DNA, 14 bp, Homo sapiens
gcgagactccgtct

SEQ ID NO: 2520714 - DNA, 16 bp, Homo sapiens
gcgagcatcctggcca

SEQ ID NO: 2520715 - DNA, 20 bp, Homo sapiens
gcgaggagatgctccttggg

SEQ ID NO: 2520716 - DNA, 17 bp, Homo sapiens
gcgaggaggctccagag

SEQ ID NO: 2520717 - DNA, 19 bp, Homo sapiens
gcgattctggataaagcca

SEQ ID NO: 2520718 - DNA, 20 bp, Homo sapiens
gcgattctggataaagccac

SEQ ID NO: 2520719 - DNA, 14 bp, Homo sapiens
gcgattcttctgct

SEQ ID NO: 2520720 - DNA, 22 bp, Homo sapiens
gcgattcttctgcttcagcctc

SEQ ID NO: 2520721 - DNA, 18 bp, Homo sapiens
gcgcacaaggctgaccaa

SEQ ID NO: 2520722 - DNA, 21 bp, Homo sapiens
gcgcagtgcctctggtctggg

SEQ ID NO: 2520723 - DNA, 18 bp, Homo sapiens
gcgcagtgcttctctaca

SEQ ID NO: 2520724 - DNA, 17 bp, Homo sapiens
gcgccagcacagaaaca

SEQ ID NO: 2520725 - DNA, 16 bp, Homo sapiens
gcgccattgcactcca

SEQ ID NO: 2520726 - DNA, 16 bp, Homo sapiens
gcgcccaccccgctct

SEQ ID NO: 2520727 - DNA, 19 bp, Homo sapiens
gcgcccagtccttccacct

SEQ ID NO: 2520728 - DNA, 16 bp, Homo sapiens
gcgcccgctgggctga

SEQ ID NO: 2520729 - DNA, 13 bp, Homo sapiens
gcgccctggaagc

SEQ ID NO: 2520730 - DNA, 18 bp, Homo sapiens
gcgccgcaaaccacactg

SEQ ID NO: 2520731 - DNA, 15 bp, Homo sapiens
gcgcctccttccttg

SEQ ID NO: 2520732 - DNA, 12 bp, Homo sapiens
gcgcctctgcaa

SEQ ID NO: 2520733 - DNA, 17 bp, Homo sapiens
gcgcctgcccctcccag

SEQ ID NO: 2520734 - DNA, 16 bp, Homo sapiens
gcgcctgtagtcccag

SEQ ID NO: 2520735 - DNA, 13 bp, Homo sapiens
gcgcggccagccc

SEQ ID NO: 2520736 - DNA, 16 bp, Homo sapiens
gcgctctagcctgggc

SEQ ID NO: 2520737 - DNA, 19 bp, Homo sapiens
gcgctgacaaccaccgctc

SEQ ID NO: 2520738 - DNA, 13 bp, Homo sapiens
gcgctggcccagc

SEQ ID NO: 2520739 - DNA, 17 bp, Homo sapiens
gcgctggcccagccggc

SEQ ID NO: 2520740 - DNA, 15 bp, Homo sapiens
gcggaaagcagctca

SEQ ID NO: 2520741 - DNA, 20 bp, Homo sapiens
gcggaacaaggagtcagaca

SEQ ID NO: 2520742 - DNA, 15 bp, Homo sapiens
gcggacagccacggc

SEQ ID NO: 2520743 - DNA, 23 bp, Homo sapiens
gcggacagccacggccaggccag

SEQ ID NO: 2520744 - DNA, 14 bp, Homo sapiens
gcggacgttccagc

SEQ ID NO: 2520745 - DNA, 15 bp, Homo sapiens
gcggagagtacagtg

SEQ ID NO: 2520746 - DNA, 16 bp, Homo sapiens
gcggagagtacagtga

SEQ ID NO: 2520747 - DNA, 22 bp, Homo sapiens
gcggagagtacagtgagccaag

SEQ ID NO: 2520748 - DNA, 15 bp, Homo sapiens
gcggaggttgcaggg

SEQ ID NO: 2520749 - DNA, 16 bp, Homo sapiens
gcggaggttgcaggga

SEQ ID NO: 2520750 - DNA, 18 bp, Homo sapiens
gcggagtgaagaggggca

SEQ ID NO: 2520751 - DNA, 20 bp, Homo sapiens
gcggatctctggagtgagct

SEQ ID NO: 2520752 - DNA, 17 bp, Homo sapiens
gcggcagcagccatcat

SEQ ID NO: 2520753 - DNA, 20 bp, Homo sapiens
gcggccagccccggccctgg

SEQ ID NO: 2520754 - DNA, 15 bp, Homo sapiens
gcggcccagcccggc

SEQ ID NO: 2520755 - DNA, 18 bp, Homo sapiens
gcggcccagcccggctcc

SEQ ID NO: 2520756 - DNA, 13 bp, Homo sapiens
gcggcccctcccg

SEQ ID NO: 2520757 - DNA, 16 bp, Homo sapiens
gcggcctttggcttca

SEQ ID NO: 2520758 - DNA, 16 bp, Homo sapiens
gcggcggagctggccc

SEQ ID NO: 2520759 - DNA, 20 bp, Homo sapiens
gcggcggagctggccccgcc

SEQ ID NO: 2520760 - DNA, 12 bp, Homo sapiens
gcggctgagagc

SEQ ID NO: 2520761 - DNA, 18 bp, Homo sapiens
gcggctgagagccccagc

SEQ ID NO: 2520762 - DNA, 15 bp, Homo sapiens
gcggctggcagccca

SEQ ID NO: 2520763 - DNA, 19 bp, Homo sapiens
gcgggaatggcagctgcca

SEQ ID NO: 2520764 - DNA, 14 bp, Homo sapiens
gcgggacccaggca

SEQ ID NO: 2520765 - DNA, 14 bp, Homo sapiens
gcgggacctgtggc

SEQ ID NO: 2520766 - DNA, 21 bp, Homo sapiens
gcgggacgtccctgcccatgt

SEQ ID NO: 2520767 - DNA, 14 bp, Homo sapiens
gcgggctcaaggaa

SEQ ID NO: 2520768 - DNA, 12 bp, Homo sapiens
gcggggacagct

SEQ ID NO: 2520769 - DNA, 15 bp, Homo sapiens
gcggggacagctcct

SEQ ID NO: 2520770 - DNA, 19 bp, Homo sapiens
gcggggactcggtaagcac

SEQ ID NO: 2520771 - DNA, 15 bp, Homo sapiens
gcgggggccagggaa

SEQ ID NO: 2520772 - DNA, 13 bp, Homo sapiens
gcggggggaggga

SEQ ID NO: 2520773 - DNA, 19 bp, Homo sapiens
gcgggtggatcacctgagg

SEQ ID NO: 2520774 - DNA, 14 bp, Homo sapiens
gcggtccacccagg

SEQ ID NO: 2520775 - DNA, 16 bp, Homo sapiens
gcggtccacccaggag

SEQ ID NO: 2520776 - DNA, 18 bp, Homo sapiens
gcggtccacccaggagcc

SEQ ID NO: 2520777 - DNA, 18 bp, Homo sapiens
gcggtggaaggcccgagg

SEQ ID NO: 2520778 - DNA, 18 bp, Homo sapiens
gcggtgggcacccaccct

SEQ ID NO: 2520779 - DNA, 23 bp, Homo sapiens
gcggttatgaaattcaccccctt

SEQ ID NO: 2520780 - DNA, 15 bp, Homo sapiens
gcgtcagcctccagc

SEQ ID NO: 2520781 - DNA, 17 bp, Homo sapiens
gcgtcagcctccagcct

SEQ ID NO: 2520782 - DNA, 18 bp, Homo sapiens
gcgtccccctgccggccg

SEQ ID NO: 2520783 - DNA, 16 bp, Homo sapiens
gcgtcctcctctgtga

SEQ ID NO: 2520784 - DNA, 21 bp, Homo sapiens
gcgtctcctgtttttctgggt

SEQ ID NO: 2520785 - DNA, 16 bp, Homo sapiens
gcgtgaaggccgagaa

SEQ ID NO: 2520786 - DNA, 13 bp, Homo sapiens
gcgtgacaataaa

SEQ ID NO: 2520787 - DNA, 14 bp, Homo sapiens
gcgtgagccactgc

SEQ ID NO: 2520788 - DNA, 18 bp, Homo sapiens
gcgtgaggatgggaagga

SEQ ID NO: 2520789 - DNA, 14 bp, Homo sapiens
gcgtgcacacacca

SEQ ID NO: 2520790 - DNA, 16 bp, Homo sapiens
gcgtggagctgcctga

SEQ ID NO: 2520791 - DNA, 18 bp, Homo sapiens
gcgtggagggcgtggagg

SEQ ID NO: 2520792 - DNA, 16 bp, Homo sapiens
gcgtggagggcgtggg

SEQ ID NO: 2520793 - DNA, 13 bp, Homo sapiens
gcgtggggagggc

SEQ ID NO: 2520794 - DNA, 21 bp, Homo sapiens
gcgtggtggaagaggggacag

SEQ ID NO: 2520795 - DNA, 11 bp, Homo sapiens
gcgtgtggctc

SEQ ID NO: 2520796 - DNA, 14 bp, Homo sapiens
gcgtgtggctcacg

SEQ ID NO: 2520797 - DNA, 19 bp, Homo sapiens
gcgtgtggctcacgtgtgt

SEQ ID NO: 2520798 - DNA, 21 bp, Homo sapiens
gcgtgtgtagagttaagaagc

SEQ ID NO: 2520799 - DNA, 14 bp, Homo sapiens
gcgtgtttgcacgt

SEQ ID NO: 2520800 - DNA, 22 bp, Homo sapiens
gcgttattggtcggcagccttc

SEQ ID NO: 2520801 - DNA, 19 bp, Homo sapiens
gcgtttaagactgtaatga

SEQ ID NO: 2520802 - DNA, 17 bp, Homo sapiens
gcgtttctatgacacat

SEQ ID NO: 2520803 - DNA, 20 bp, Homo sapiens
gctaaaaatgggacttcttt

SEQ ID NO: 2520804 - DNA, 14 bp, Homo sapiens
gctaaaacctgagc

SEQ ID NO: 2520805 - DNA, 20 bp, Homo sapiens
gctaaataaaatttgttgca

SEQ ID NO: 2520806 - DNA, 21 bp, Homo sapiens
gctaaataaaatttgttgcat

SEQ ID NO: 2520807 - DNA, 19 bp, Homo sapiens
gctaaatcctttactgtta

SEQ ID NO: 2520808 - DNA, 14 bp, Homo sapiens
gctaaatgtaacag

SEQ ID NO: 2520809 - DNA, 19 bp, Homo sapiens
gctaagagtgtcctaggag

SEQ ID NO: 2520810 - DNA, 17 bp, Homo sapiens
gctaagcaaaatgtgat

SEQ ID NO: 2520811 - DNA, 18 bp, Homo sapiens
gctaaggcgtggagctgc

SEQ ID NO: 2520812 - DNA, 18 bp, Homo sapiens
gctaatctgtagggctgg

SEQ ID NO: 2520813 - DNA, 22 bp, Homo sapiens
gctaatctgtagggctggacct

SEQ ID NO: 2520814 - DNA, 21 bp, Homo sapiens
gctaatgaagggaaaggatat

SEQ ID NO: 2520815 - DNA, 13 bp, Homo sapiens
gctaatgggacac

SEQ ID NO: 2520816 - DNA, 16 bp, Homo sapiens
gctccaagacctgttg

SEQ ID NO: 2520817 - DNA, 19 bp, Homo sapiens
gctccaagctcccaggcat

SEQ ID NO: 2520818 - DNA, 16 bp, Homo sapiens
gctccacagccatccc

SEQ ID NO: 2520819 - DNA, 12 bp, Homo sapiens
gctccaccacat

SEQ ID NO: 2520820 - DNA, 21 bp, Homo sapiens
gctccactctgactggcacag

SEQ ID NO: 2520821 - DNA, 20 bp, Homo sapiens
gctccagaaatgtctaaatg

SEQ ID NO: 2520822 - DNA, 23 bp, Homo sapiens
gctccagacacatgtccaagaag

SEQ ID NO: 2520823 - DNA, 14 bp, Homo sapiens
gctccagaccccca

SEQ ID NO: 2520824 - DNA, 17 bp, Homo sapiens
gctccagacccccagca

SEQ ID NO: 2520825 - DNA, 12 bp, Homo sapiens
gctccagagggc

SEQ ID NO: 2520826 - DNA, 17 bp, Homo sapiens
gagctgagcctctcacc

SEQ ID NO: 2520827 - DNA, 21 bp, Homo sapiens
gagctgcctgttcagctccag

SEQ ID NO: 2520828 - DNA, 22 bp, Homo sapiens
gagctgcctgttcagctccagc

SEQ ID NO: 2520829 - DNA, 16 bp, Homo sapiens
gagctgctctggaaaa

SEQ ID NO: 2520830 - DNA, 13 bp, Homo sapiens
gagctgctgccct

SEQ ID NO: 2520831 - DNA, 14 bp, Homo sapiens
gagctggagcctgg

SEQ ID NO: 2520832 - DNA, 15 bp, Homo sapiens
gagctggagcctggt

SEQ ID NO: 2520833 - DNA, 20 bp, Homo sapiens
gagctggagcctggtgccct

SEQ ID NO: 2520834 - DNA, 13 bp, Homo sapiens
gagctggccccgc

SEQ ID NO: 2520835 - DNA, 20 bp, Homo sapiens
gagctggccgtgggcctggg

SEQ ID NO: 2520836 - DNA, 17 bp, Homo sapiens
gagctgggaggcatggc

SEQ ID NO: 2520837 - DNA, 16 bp, Homo sapiens
gagctgggatcctaag

SEQ ID NO: 2520838 - DNA, 13 bp, Homo sapiens
gagctggggacct

SEQ ID NO: 2520839 - DNA, 19 bp, Homo sapiens
gagctgggggccatgagct

SEQ ID NO: 2520840 - DNA, 21 bp, Homo sapiens
gagctggtagttagtagcatg

SEQ ID NO: 2520841 - DNA, 18 bp, Homo sapiens
gagctggtgcattacaga

SEQ ID NO: 2520842 - DNA, 16 bp, Homo sapiens
gagctggtgcccggag

SEQ ID NO: 2520843 - DNA, 18 bp, Homo sapiens
gagctgtgcaggtgggga

SEQ ID NO: 2520844 - DNA, 22 bp, Homo sapiens
gagctgttcacagccagactgg

SEQ ID NO: 2520845 - DNA, 20 bp, Homo sapiens
gagctgtttatggcctcagc

SEQ ID NO: 2520846 - DNA, 19 bp, Homo sapiens
gagcttcatggcagaaggc

SEQ ID NO: 2520847 - DNA, 14 bp, Homo sapiens
gagcttggccagaa

SEQ ID NO: 2520848 - DNA, 22 bp, Homo sapiens
gagctttctgctatcaaagagg

SEQ ID NO: 2520849 - DNA, 21 bp, Homo sapiens
gagctttgcatgttccactaa

SEQ ID NO: 2520850 - DNA, 21 bp, Homo sapiens
gaggaaaagtaaggtgcagtt

SEQ ID NO: 2520851 - DNA, 14 bp, Homo sapiens
gaggaaactcacct

SEQ ID NO: 2520852 - DNA, 14 bp, Homo sapiens
gaggaaaggccagc

SEQ ID NO: 2520853 - DNA, 13 bp, Homo sapiens
gaggaagagcagg

SEQ ID NO: 2520854 - DNA, 20 bp, Homo sapiens
gaggaagcgtgaaggccgag

SEQ ID NO: 2520855 - DNA, 13 bp, Homo sapiens
gaggaaggaaacc

SEQ ID NO: 2520856 - DNA, 19 bp, Homo sapiens
gaggaaggaaacccagctc

SEQ ID NO: 2520857 - DNA, 21 bp, Homo sapiens
gaggaataattatttatttaa

SEQ ID NO: 2520858 - DNA, 19 bp, Homo sapiens
gaggaatagttgagcccca

SEQ ID NO: 2520859 - DNA, 13 bp, Homo sapiens
gaggaatatcaat

SEQ ID NO: 2520860 - DNA, 23 bp, Homo sapiens
gaggaatatgacggaagaacata

SEQ ID NO: 2520861 - DNA, 17 bp, Homo sapiens
gaggaatgatgaagctt

SEQ ID NO: 2520862 - DNA, 14 bp, Homo sapiens
gaggaatttcacct

SEQ ID NO: 2520863 - DNA, 12 bp, Homo sapiens
gaggacaattca

SEQ ID NO: 2520864 - DNA, 13 bp, Homo sapiens
gaggacccagacc

SEQ ID NO: 2520865 - DNA, 16 bp, Homo sapiens
gaggacggtgcaaccc

SEQ ID NO: 2520866 - DNA, 17 bp, Homo sapiens
gaggacggtgcaaccca

SEQ ID NO: 2520867 - DNA, 16 bp, Homo sapiens
gaggactagaacctgg

SEQ ID NO: 2520868 - DNA, 17 bp, Homo sapiens
gaggacttgtgtctctg

SEQ ID NO: 2520869 - DNA, 20 bp, Homo sapiens
gaggacttttctttgtggct

SEQ ID NO: 2520870 - DNA, 12 bp, Homo sapiens
gaggagaaactg

SEQ ID NO: 2520871 - DNA, 22 bp, Homo sapiens
gaggagactagatttatgaata

SEQ ID NO: 2520872 - DNA, 12 bp, Homo sapiens
gaggagagaaga

SEQ ID NO: 2520873 - DNA, 15 bp, Homo sapiens
gaggagagaagaatg

SEQ ID NO: 2520874 - DNA, 17 bp, Homo sapiens
gaggagagtcccagagc

SEQ ID NO: 2520875 - DNA, 17 bp, Homo sapiens
gaggagatgctccttgg

SEQ ID NO: 2520876 - DNA, 17 bp, Homo sapiens
gaggagcagtgcaggca

SEQ ID NO: 2520877 - DNA, 12 bp, Homo sapiens
gaggagctgctg

SEQ ID NO: 2520878 - DNA, 15 bp, Homo sapiens
gaggagcttggggga

SEQ ID NO: 2520879 - DNA, 18 bp, Homo sapiens
gaggaggctccagagggc

SEQ ID NO: 2520880 - DNA, 17 bp, Homo sapiens
gaggaggtttaggtcaa

SEQ ID NO: 2520881 - DNA, 13 bp, Homo sapiens
gaggagtgaggaa

SEQ ID NO: 2520882 - DNA, 23 bp, Homo sapiens
gaggataggagttcacttcatct

SEQ ID NO: 2520883 - DNA, 18 bp, Homo sapiens
gaggatcacagtgctgag

SEQ ID NO: 2520884 - DNA, 19 bp, Homo sapiens
gaggatctcttgagcctgg

SEQ ID NO: 2520885 - DNA, 20 bp, Homo sapiens
gaggatgagagcccagaggt

SEQ ID NO: 2520886 - DNA, 14 bp, Homo sapiens
gaggatggccagtg

SEQ ID NO: 2520887 - DNA, 19 bp, Homo sapiens
gaggatgggaaggagggag

SEQ ID NO: 2520888 - DNA, 18 bp, Homo sapiens
gaggattgcttgagccca

SEQ ID NO: 2520889 - DNA, 22 bp, Homo sapiens
gaggattgcttgagcccaggag

SEQ ID NO: 2520890 - DNA, 20 bp, Homo sapiens
gaggatttaagggatggaaa

SEQ ID NO: 2520891 - DNA, 20 bp, Homo sapiens
gaggcagacagcagctcagg

SEQ ID NO: 2520892 - DNA, 22 bp, Homo sapiens
gaggcagacagcagctcaggca

SEQ ID NO: 2520893 - DNA, 13 bp, Homo sapiens
gaggcagaggaca

SEQ ID NO: 2520894 - DNA, 14 bp, Homo sapiens
gaggcagaggacag

SEQ ID NO: 2520895 - DNA, 19 bp, Homo sapiens
gaggcagaggttgcagtga

SEQ ID NO: 2520896 - DNA, 13 bp, Homo sapiens
gaggcagccccat

SEQ ID NO: 2520897 - DNA, 19 bp, Homo sapiens
gaggcagccccattctgcc

SEQ ID NO: 2520898 - DNA, 21 bp, Homo sapiens
gaggcagccccattctgcctg

SEQ ID NO: 2520899 - DNA, 22 bp, Homo sapiens
gaggcagccccattctgcctgc

SEQ ID NO: 2520900 - DNA, 14 bp, Homo sapiens
gaggcaggctccag

SEQ ID NO: 2520901 - DNA, 17 bp, Homo sapiens
gaggcagggaggggact

SEQ ID NO: 2520902 - DNA, 22 bp, Homo sapiens
gaggcagggtctcactctgtcg

SEQ ID NO: 2520903 - DNA, 15 bp, Homo sapiens
gaggcatggccctgg

SEQ ID NO: 2520904 - DNA, 17 bp, Homo sapiens
gaggccaaggtgggagg

SEQ ID NO: 2520905 - DNA, 22 bp, Homo sapiens
gaggccaaggtgggaggattgc

SEQ ID NO: 2520906 - DNA, 23 bp, Homo sapiens
gaggccacatgagtcccagtggg

SEQ ID NO: 2520907 - DNA, 10 bp, Homo sapiens
gaggccacct

SEQ ID NO: 2520908 - DNA, 16 bp, Homo sapiens
gaggccagccccaccc

SEQ ID NO: 2520909 - DNA, 18 bp, Homo sapiens
gaggccagccccacccag

SEQ ID NO: 2520910 - DNA, 20 bp, Homo sapiens
gaggccagccccacccagga

SEQ ID NO: 2520911 - DNA, 21 bp, Homo sapiens
gaggccagccccacccaggag

SEQ ID NO: 2520912 - DNA, 14 bp, Homo sapiens
gaggccagcctggc

SEQ ID NO: 2520913 - DNA, 13 bp, Homo sapiens
gaggccagggcag

SEQ ID NO: 2520914 - DNA, 17 bp, Homo sapiens
gaggccagtacctttcc

SEQ ID NO: 2520915 - DNA, 17 bp, Homo sapiens
gaggccatgggcctcct

SEQ ID NO: 2520916 - DNA, 15 bp, Homo sapiens
gaggcccagagggcc

SEQ ID NO: 2520917 - DNA, 16 bp, Homo sapiens
gaggcccagagggcct

SEQ ID NO: 2520918 - DNA, 20 bp, Homo sapiens
gaggccccttctaggtggca

SEQ ID NO: 2520919 - DNA, 17 bp, Homo sapiens
gaggccctcgctgccag

SEQ ID NO: 2520920 - DNA, 22 bp, Homo sapiens
gaggccgctagaggcctgagga

SEQ ID NO: 2520921 - DNA, 19 bp, Homo sapiens
gaggcctcttggacctctg

SEQ ID NO: 2520922 - DNA, 21 bp, Homo sapiens
gaggcctgaggatgagctgga

SEQ ID NO: 2520923 - DNA, 22 bp, Homo sapiens
gaggcctgaggatgagctggaa

SEQ ID NO: 2520924 - DNA, 20 bp, Homo sapiens
gaggcctgccctcagggatc

SEQ ID NO: 2520925 - DNA, 23 bp, Homo sapiens
gaggcctgccctcagggatcttg

SEQ ID NO: 2520926 - DNA, 17 bp, Homo sapiens
gaggcctggccaggcac

SEQ ID NO: 2520927 - DNA, 19 bp, Homo sapiens
gaggccttctctgaaggac

SEQ ID NO: 2520928 - DNA, 22 bp, Homo sapiens
gaggcgcactttcctcctggca

SEQ ID NO: 2520929 - DNA, 19 bp, Homo sapiens
gaggcggagagtacagtga

SEQ ID NO: 2520930 - DNA, 20 bp, Homo sapiens
gaggcgggagaatcatgtga

SEQ ID NO: 2520931 - DNA, 20 bp, Homo sapiens
gaggcgggccagccaggcgg

SEQ ID NO: 2520932 - DNA, 12 bp, Homo sapiens
gaggcgggtgga

SEQ ID NO: 2520933 - DNA, 19 bp, Homo sapiens
gaggcgggtggatcacctg

SEQ ID NO: 2520934 - DNA, 19 bp, Homo sapiens
gaggcgggtggatcacttg

SEQ ID NO: 2520935 - DNA, 21 bp, Homo sapiens
gaggctagaaccaagaagggc

SEQ ID NO: 2520936 - DNA, 22 bp, Homo sapiens
gaggctagtgtggtgtttcctg

SEQ ID NO: 2520937 - DNA, 12 bp, Homo sapiens
gaggctctgccc

SEQ ID NO: 2520938 - DNA, 13 bp, Homo sapiens
gaggctctgccct

SEQ ID NO: 2520939 - DNA, 16 bp, Homo sapiens
gaggctctttctgggc

SEQ ID NO: 2520940 - DNA, 16 bp, Homo sapiens
gaggctgagacaggag

SEQ ID NO: 2520941 - DNA, 16 bp, Homo sapiens
gaggctgcagcgagct

SEQ ID NO: 2520942 - DNA, 23 bp, Homo sapiens
gaggctggatcctagccttatcc

SEQ ID NO: 2520943 - DNA, 13 bp, Homo sapiens
gaggctgggctcc

SEQ ID NO: 2520944 - DNA, 16 bp, Homo sapiens
gaggctgggctccctt

SEQ ID NO: 2520945 - DNA, 20 bp, Homo sapiens
gaggctgggctcccttccca

SEQ ID NO: 2520946 - DNA, 20 bp, Homo sapiens
gaggctgtcttctcaggctc

SEQ ID NO: 2520947 - DNA, 21 bp, Homo sapiens
gaggctgtcttctcaggctct

SEQ ID NO: 2520948 - DNA, 17 bp, Homo sapiens
gaggctgttcccaccag

SEQ ID NO: 2520949 - DNA, 16 bp, Homo sapiens
gaggcttccagagagt

SEQ ID NO: 2520950 - DNA, 21 bp, Homo sapiens
gaggcttccagagagtcctct

SEQ ID NO: 2520951 - DNA, 22 bp, Homo sapiens
gaggcttgggaccgccagatgg

SEQ ID NO: 2520952 - DNA, 19 bp, Homo sapiens
gaggcttgtcagagctggg

SEQ ID NO: 2520953 - DNA, 14 bp, Homo sapiens
gagggacctctccc

SEQ ID NO: 2520954 - DNA, 17 bp, Homo sapiens
gagggacctctcccagg

SEQ ID NO: 2520955 - DNA, 18 bp, Homo sapiens
gagggactctgaagcctc

SEQ ID NO: 2520956 - DNA, 23 bp, Homo sapiens
gagggactctgaagcctctggga

SEQ ID NO: 2520957 - DNA, 15 bp, Homo sapiens
gagggagggctccag

SEQ ID NO: 2520958 - DNA, 23 bp, Homo sapiens
gagggaggtgtttaaagagaggt

SEQ ID NO: 2520959 - DNA, 21 bp, Homo sapiens
gagggagtgacagaggcagcc

SEQ ID NO: 2520960 - DNA, 12 bp, Homo sapiens
gctctttcaggg

SEQ ID NO: 2520961 - DNA, 15 bp, Homo sapiens
gctctttccttgctc

SEQ ID NO: 2520962 - DNA, 14 bp, Homo sapiens
gctctttctgggcc

SEQ ID NO: 2520963 - DNA, 18 bp, Homo sapiens
gctctttctgggccaagt

SEQ ID NO: 2520964 - DNA, 18 bp, Homo sapiens
gctctttggggtcagcca

SEQ ID NO: 2520965 - DNA, 20 bp, Homo sapiens
gctctttggggtcagccagg

SEQ ID NO: 2520966 - DNA, 21 bp, Homo sapiens
gctctttggggtcagccaggg

SEQ ID NO: 2520967 - DNA, 23 bp, Homo sapiens
gctctttggggtcagccagggcc

SEQ ID NO: 2520968 - DNA, 18 bp, Homo sapiens
gctctttggtagaaaagg

SEQ ID NO: 2520969 - DNA, 23 bp, Homo sapiens
gctgaacactccaattaaggatt

SEQ ID NO: 2520970 - DNA, 22 bp, Homo sapiens
gctgaacccattttgagtgact

SEQ ID NO: 2520971 - DNA, 16 bp, Homo sapiens
gctgaagctgcctgct

SEQ ID NO: 2520972 - DNA, 23 bp, Homo sapiens
gctgaaggctcgagcatgcctgg

SEQ ID NO: 2520973 - DNA, 20 bp, Homo sapiens
gctgaagtgcatccaaaggt

SEQ ID NO: 2520974 - DNA, 20 bp, Homo sapiens
gctgaatgttgggactgcta

SEQ ID NO: 2520975 - DNA, 18 bp, Homo sapiens
gctgacacaaacctgcct

SEQ ID NO: 2520976 - DNA, 19 bp, Homo sapiens
gctgacacaaacctgcctg

SEQ ID NO: 2520977 - DNA, 13 bp, Homo sapiens
gctgacagacaca

SEQ ID NO: 2520978 - DNA, 14 bp, Homo sapiens
gctgacagacacag

SEQ ID NO: 2520979 - DNA, 16 bp, Homo sapiens
gctgacagacacaggc

SEQ ID NO: 2520980 - DNA, 19 bp, Homo sapiens
gctgacagacacaggcccg

SEQ ID NO: 2520981 - DNA, 13 bp, Homo sapiens
gctgacatctgtg

SEQ ID NO: 2520982 - DNA, 22 bp, Homo sapiens
gctgacattgtggcacattctt

SEQ ID NO: 2520983 - DNA, 13 bp, Homo sapiens
gctgacctctggt

SEQ ID NO: 2520984 - DNA, 20 bp, Homo sapiens
gctgaccttcctcgcagaga

SEQ ID NO: 2520985 - DNA, 23 bp, Homo sapiens
gctgactagaagggccagtcctg

SEQ ID NO: 2520986 - DNA, 23 bp, Homo sapiens
gctgactctaggtgcccttggag

SEQ ID NO: 2520987 - DNA, 22 bp, Homo sapiens
gctgactgttttctcttgagag

SEQ ID NO: 2520988 - DNA, 15 bp, Homo sapiens
gctgagacaggagaa

SEQ ID NO: 2520989 - DNA, 13 bp, Homo sapiens
gctgagagcccca

SEQ ID NO: 2520990 - DNA, 20 bp, Homo sapiens
gctgagagccccagctgaca

SEQ ID NO: 2520991 - DNA, 22 bp, Homo sapiens
gctgagaggcagacttccctga

SEQ ID NO: 2520992 - DNA, 17 bp, Homo sapiens
gctgagcccctacccca

SEQ ID NO: 2520993 - DNA, 11 bp, Homo sapiens
gctgagccctg

SEQ ID NO: 2520994 - DNA, 12 bp, Homo sapiens
gctgagccctgg

SEQ ID NO: 2520995 - DNA, 13 bp, Homo sapiens
gctgagccctggc

SEQ ID NO: 2520996 - DNA, 12 bp, Homo sapiens
gctgaggaaagg

SEQ ID NO: 2520997 - DNA, 14 bp, Homo sapiens
gctgaggaggcctc

SEQ ID NO: 2520998 - DNA, 18 bp, Homo sapiens
gctgaggatttcaagcct

SEQ ID NO: 2520999 - DNA, 19 bp, Homo sapiens
gctgaggatttcaagcctg

SEQ ID NO: 2521000 - DNA, 16 bp, Homo sapiens
gctgaggcgggagaat

SEQ ID NO: 2521001 - DNA, 23 bp, Homo sapiens
gctgaggctctgacccagtgaga

SEQ ID NO: 2521002 - DNA, 22 bp, Homo sapiens
gctgaggggaggatcactggag

SEQ ID NO: 2521003 - DNA, 21 bp, Homo sapiens
gctgaggggggccgtgcccag

SEQ ID NO: 2521004 - DNA, 17 bp, Homo sapiens
gctgaggtctcttgagg

SEQ ID NO: 2521005 - DNA, 16 bp, Homo sapiens
gctgagtctgaaggct

SEQ ID NO: 2521006 - DNA, 19 bp, Homo sapiens
gctgagtctgaaggctggg

SEQ ID NO: 2521007 - DNA, 23 bp, Homo sapiens
gctgagtgggggatcacagcctc

SEQ ID NO: 2521008 - DNA, 23 bp, Homo sapiens
gctgatggataacctatatgatt

SEQ ID NO: 2521009 - DNA, 16 bp, Homo sapiens
gctgatgttcagtgta

SEQ ID NO: 2521010 - DNA, 14 bp, Homo sapiens
gctgattgtattta

SEQ ID NO: 2521011 - DNA, 19 bp, Homo sapiens
gctgcacagggcagctggg

SEQ ID NO: 2521012 - DNA, 18 bp, Homo sapiens
gctgcaccggctggcctg

SEQ ID NO: 2521013 - DNA, 17 bp, Homo sapiens
gctgcacctgccagcct

SEQ ID NO: 2521014 - DNA, 20 bp, Homo sapiens
gctgcacctgccagcctggc

SEQ ID NO: 2521015 - DNA, 19 bp, Homo sapiens
gctgcagagccaccctgtg

SEQ ID NO: 2521016 - DNA, 21 bp, Homo sapiens
gctgcagatttgggctggaac

SEQ ID NO: 2521017 - DNA, 12 bp, Homo sapiens
gctgcagcatgt

SEQ ID NO: 2521018 - DNA, 15 bp, Homo sapiens
gctgcagctcaccca

SEQ ID NO: 2521019 - DNA, 18 bp, Homo sapiens
gctgcagtatgaaaataa

SEQ ID NO: 2521020 - DNA, 20 bp, Homo sapiens
gctgcagttgccagtcaccc

SEQ ID NO: 2521021 - DNA, 18 bp, Homo sapiens
gctgcatcctccaagaat

SEQ ID NO: 2521022 - DNA, 22 bp, Homo sapiens
gctgcatggggtggggtagggc

SEQ ID NO: 2521023 - DNA, 18 bp, Homo sapiens
gctgcatttaaaagatac

SEQ ID NO: 2521024 - DNA, 15 bp, Homo sapiens
gctgccaaggccaga

SEQ ID NO: 2521025 - DNA, 18 bp, Homo sapiens
gctgccaaggccagagtg

SEQ ID NO: 2521026 - DNA, 22 bp, Homo sapiens
gctgccaaggccagagtggcct

SEQ ID NO: 2521027 - DNA, 14 bp, Homo sapiens
gctgccacttttta

SEQ ID NO: 2521028 - DNA, 23 bp, Homo sapiens
gctgccatccaggttcagcttgt

SEQ ID NO: 2521029 - DNA, 23 bp, Homo sapiens
gctgccatggcgtgtccctctcg

SEQ ID NO: 2521030 - DNA, 14 bp, Homo sapiens
gctgcccaggccca

SEQ ID NO: 2521031 - DNA, 16 bp, Homo sapiens
gctgccccagccagat

SEQ ID NO: 2521032 - DNA, 14 bp, Homo sapiens
gctgcccccggccc

SEQ ID NO: 2521033 - DNA, 20 bp, Homo sapiens
gctgcccccggccccctggt

SEQ ID NO: 2521034 - DNA, 23 bp, Homo sapiens
gctgcccccggccccctggtctc

SEQ ID NO: 2521035 - DNA, 19 bp, Homo sapiens
gctgcccgtcttcagccta

SEQ ID NO: 2521036 - DNA, 22 bp, Homo sapiens
gctgccctccttgtccacccac

SEQ ID NO: 2521037 - DNA, 15 bp, Homo sapiens
gctgccctgccactt

SEQ ID NO: 2521038 - DNA, 13 bp, Homo sapiens
gctgccctgccca

SEQ ID NO: 2521039 - DNA, 22 bp, Homo sapiens
gctgccctgcccacctggcctc

SEQ ID NO: 2521040 - DNA, 16 bp, Homo sapiens
gctgccctggccctga

SEQ ID NO: 2521041 - DNA, 18 bp, Homo sapiens
gctgccctgtaccccagc

SEQ ID NO: 2521042 - DNA, 14 bp, Homo sapiens
gctgccctgtgagt

SEQ ID NO: 2521043 - DNA, 17 bp, Homo sapiens
gctgccgaccagagccc

SEQ ID NO: 2521044 - DNA, 13 bp, Homo sapiens
gctgccgcctccc

SEQ ID NO: 2521045 - DNA, 16 bp, Homo sapiens
gctgcctctcccatca

SEQ ID NO: 2521046 - DNA, 14 bp, Homo sapiens
gctgcctgcctgtc

SEQ ID NO: 2521047 - DNA, 16 bp, Homo sapiens
gctgcctgcctgtctg

SEQ ID NO: 2521048 - DNA, 21 bp, Homo sapiens
gctgcctgcttttcactgctg

SEQ ID NO: 2521049 - DNA, 18 bp, Homo sapiens
gctgcctgggatccctca

SEQ ID NO: 2521050 - DNA, 19 bp, Homo sapiens
gctgcctgggatccctcat

SEQ ID NO: 2521051 - DNA, 13 bp, Homo sapiens
gctgcctgggctg

SEQ ID NO: 2521052 - DNA, 14 bp, Homo sapiens
gctgcctgggctgt

SEQ ID NO: 2521053 - DNA, 18 bp, Homo sapiens
gctgcctgggctgttggc

SEQ ID NO: 2521054 - DNA, 13 bp, Homo sapiens
gctgcctgtagtt

SEQ ID NO: 2521055 - DNA, 19 bp, Homo sapiens
gctgcctgtagttaggaaa

SEQ ID NO: 2521056 - DNA, 12 bp, Homo sapiens
gctgcctgttca

SEQ ID NO: 2521057 - DNA, 13 bp, Homo sapiens
gctgcctgttcag

SEQ ID NO: 2521058 - DNA, 20 bp, Homo sapiens
gctgcctgttcagctccagc

SEQ ID NO: 2521059 - DNA, 14 bp, Homo sapiens
gctgcggtccaccc

SEQ ID NO: 2521060 - DNA, 19 bp, Homo sapiens
gctgcggtccacccaggag

SEQ ID NO: 2521061 - DNA, 14 bp, Homo sapiens
gctgcgtgcctgtg

SEQ ID NO: 2521062 - DNA, 15 bp, Homo sapiens
gctgctacaaagaag

SEQ ID NO: 2521063 - DNA, 23 bp, Homo sapiens
gctgctacaaagaagacatgttt

SEQ ID NO: 2521064 - DNA, 20 bp, Homo sapiens
gctgctagcacttggagcca

SEQ ID NO: 2521065 - DNA, 20 bp, Homo sapiens
gctgctcagggaaaagcagc

SEQ ID NO: 2521066 - DNA, 16 bp, Homo sapiens
gctgctccccagcagc

SEQ ID NO: 2521067 - DNA, 12 bp, Homo sapiens
gctgctctggaa

SEQ ID NO: 2521068 - DNA, 14 bp, Homo sapiens
gctgctctggaaaa

SEQ ID NO: 2521069 - DNA, 18 bp, Homo sapiens
gctgctctggaatttgca

SEQ ID NO: 2521070 - DNA, 13 bp, Homo sapiens
gctgctgaaacaa

SEQ ID NO: 2521071 - DNA, 23 bp, Homo sapiens
gctgctgaagctgcctgcttttc

SEQ ID NO: 2521072 - DNA, 12 bp, Homo sapiens
gctgctgaaggc

SEQ ID NO: 2521073 - DNA, 13 bp, Homo sapiens
gctgctgaaggct

SEQ ID NO: 2521074 - DNA, 15 bp, Homo sapiens
gctgctgaaggctcg

SEQ ID NO: 2521075 - DNA, 12 bp, Homo sapiens
gctgctgcgccc

SEQ ID NO: 2521076 - DNA, 15 bp, Homo sapiens
gctgctgctgcgccc

SEQ ID NO: 2521077 - DNA, 13 bp, Homo sapiens
gctgctgctgctg

SEQ ID NO: 2521078 - DNA, 13 bp, Homo sapiens
gctgctggagact

SEQ ID NO: 2521079 - DNA, 14 bp, Homo sapiens
gctgctggagactc

SEQ ID NO: 2521080 - DNA, 18 bp, Homo sapiens
gctgctggatcacagctg

SEQ ID NO: 2521081 - DNA, 17 bp, Homo sapiens
gctgctggcgcctctgc

SEQ ID NO: 2521082 - DNA, 18 bp, Homo sapiens
gctgctggcgcctctgca

SEQ ID NO: 2521083 - DNA, 13 bp, Homo sapiens
gctgctggctggt

SEQ ID NO: 2521084 - DNA, 11 bp, Homo sapiens
gctgctggctt

SEQ ID NO: 2521085 - DNA, 15 bp, Homo sapiens
gctgctggcttgcag

SEQ ID NO: 2521086 - DNA, 23 bp, Homo sapiens
gctgctgtccctcccccttgtcc

SEQ ID NO: 2521087 - DNA, 22 bp, Homo sapiens
gctgcttccctctgcctgtccc

SEQ ID NO: 2521088 - DNA, 23 bp, Homo sapiens
gctgcttccctctgcctgtccct

SEQ ID NO: 2521089 - DNA, 13 bp, Homo sapiens
gctgcttggcctt

SEQ ID NO: 2521090 - DNA, 14 bp, Homo sapiens
gctgctttcccctg

SEQ ID NO: 2521091 - DNA, 15 bp, Homo sapiens
gctgctttcccctgt

SEQ ID NO: 2521092 - DNA, 19 bp, Homo sapiens
gctgctttctgttgtcatt

SEQ ID NO: 2521093 - DNA, 12 bp, Homo sapiens
gctgcttttcct

SEQ ID NO: 2521094 - DNA, 23 bp, Homo sapiens
gctgcttttccttggggcaggca

SEQ ID NO: 2521095 - DNA, 22 bp, Homo sapiens
gctgcttttgtctatgggactc

SEQ ID NO: 2521096 - DNA, 18 bp, Homo sapiens
gctgctttttgaggtggc

SEQ ID NO: 2521097 - DNA, 22 bp, Homo sapiens
gctggaaaagggtcttgggaaa

SEQ ID NO: 2521098 - DNA, 16 bp, Homo sapiens
gctggaacagattcac

SEQ ID NO: 2521099 - DNA, 16 bp, Homo sapiens
gctggaatctggagag

SEQ ID NO: 2521100 - DNA, 20 bp, Homo sapiens
ggaccaaccctgtttcctga

SEQ ID NO: 2521101 - DNA, 22 bp, Homo sapiens
ggaccaaccctgtttcctgagt

SEQ ID NO: 2521102 - DNA, 15 bp, Homo sapiens
ggaccaaggacccct

SEQ ID NO: 2521103 - DNA, 17 bp, Homo sapiens
ggaccaaggagatgaag

SEQ ID NO: 2521104 - DNA, 12 bp, Homo sapiens
ggaccagctggg

SEQ ID NO: 2521105 - DNA, 22 bp, Homo sapiens
ggaccagcttttcccaaaagcc

SEQ ID NO: 2521106 - DNA, 12 bp, Homo sapiens
ggacccagaccc

SEQ ID NO: 2521107 - DNA, 17 bp, Homo sapiens
ggacccagacccagtgg

SEQ ID NO: 2521108 - DNA, 14 bp, Homo sapiens
ggacccagggatga

SEQ ID NO: 2521109 - DNA, 12 bp, Homo sapiens
ggaccccagctg

SEQ ID NO: 2521110 - DNA, 21 bp, Homo sapiens
ggaccccagctgggaggcaag

SEQ ID NO: 2521111 - DNA, 17 bp, Homo sapiens
ggaccccatctgtgaat

SEQ ID NO: 2521112 - DNA, 15 bp, Homo sapiens
ggacccccgccccct

SEQ ID NO: 2521113 - DNA, 19 bp, Homo sapiens
ggacccccgccccctgccc

SEQ ID NO: 2521114 - DNA, 14 bp, Homo sapiens
ggacccgctctgga

SEQ ID NO: 2521115 - DNA, 15 bp, Homo sapiens
ggacccgctctggac

SEQ ID NO: 2521116 - DNA, 17 bp, Homo sapiens
ggacccgctctggacca

SEQ ID NO: 2521117 - DNA, 18 bp, Homo sapiens
ggaccctgaggcccagag

SEQ ID NO: 2521118 - DNA, 20 bp, Homo sapiens
ggacctaggatatcttctcc

SEQ ID NO: 2521119 - DNA, 21 bp, Homo sapiens
ggacctatgtcctaaggacac

SEQ ID NO: 2521120 - DNA, 21 bp, Homo sapiens
ggacctcagagtccaggcccc

SEQ ID NO: 2521121 - DNA, 19 bp, Homo sapiens
ggacctcaggtgagaagca

SEQ ID NO: 2521122 - DNA, 23 bp, Homo sapiens
ggacctgcctcctgcctgcccct

SEQ ID NO: 2521123 - DNA, 22 bp, Homo sapiens
ggaccttatctgtgcgtgaaac

SEQ ID NO: 2521124 - DNA, 15 bp, Homo sapiens
ggaccttgaactggg

SEQ ID NO: 2521125 - DNA, 19 bp, Homo sapiens
ggacctttagtggtggcca

SEQ ID NO: 2521126 - DNA, 19 bp, Homo sapiens
ggacgcctgggggtgccag

SEQ ID NO: 2521127 - DNA, 20 bp, Homo sapiens
ggacgcctgggggtgccagg

SEQ ID NO: 2521128 - DNA, 23 bp, Homo sapiens
ggacggggggccccagtcagcct

SEQ ID NO: 2521129 - DNA, 20 bp, Homo sapiens
ggacggtgctccaggcaggc

SEQ ID NO: 2521130 - DNA, 20 bp, Homo sapiens
ggactaacttgtctttggac

SEQ ID NO: 2521131 - DNA, 21 bp, Homo sapiens
ggactaagcctacctgctctc

SEQ ID NO: 2521132 - DNA, 21 bp, Homo sapiens
ggactacgttaagggaaggaa

SEQ ID NO: 2521133 - DNA, 14 bp, Homo sapiens
ggactattataatt

SEQ ID NO: 2521134 - DNA, 17 bp, Homo sapiens
ggactcagccctgaggt

SEQ ID NO: 2521135 - DNA, 13 bp, Homo sapiens
ggactcagctccc

SEQ ID NO: 2521136 - DNA, 17 bp, Homo sapiens
ggactcagctccccaga

SEQ ID NO: 2521137 - DNA, 22 bp, Homo sapiens
ggactcattttaaaaaatggaa

SEQ ID NO: 2521138 - DNA, 18 bp, Homo sapiens
ggactccagaatctaaag

SEQ ID NO: 2521139 - DNA, 16 bp, Homo sapiens
ggactccccaggccag

SEQ ID NO: 2521140 - DNA, 20 bp, Homo sapiens
ggactctcagtctctgagca

SEQ ID NO: 2521141 - DNA, 17 bp, Homo sapiens
ggactctgaagcctctg

SEQ ID NO: 2521142 - DNA, 21 bp, Homo sapiens
ggactctgaggctctttctgg

SEQ ID NO: 2521143 - DNA, 20 bp, Homo sapiens
ggactctgcacatgtcttgt

SEQ ID NO: 2521144 - DNA, 21 bp, Homo sapiens
ggactcttgctctttctactc

SEQ ID NO: 2521145 - DNA, 16 bp, Homo sapiens
ggactgaagcctgcag

SEQ ID NO: 2521146 - DNA, 22 bp, Homo sapiens
ggactgcacagcgtcctgtcca

SEQ ID NO: 2521147 - DNA, 21 bp, Homo sapiens
ggactgccagtccccctgccc

SEQ ID NO: 2521148 - DNA, 22 bp, Homo sapiens
ggactggcgagtccagagagga

SEQ ID NO: 2521149 - DNA, 19 bp, Homo sapiens
ggactggctagagtcctca

SEQ ID NO: 2521150 - DNA, 15 bp, Homo sapiens
ggactgggggccaga

SEQ ID NO: 2521151 - DNA, 15 bp, Homo sapiens
ggacttaacggctcc

SEQ ID NO: 2521152 - DNA, 20 bp, Homo sapiens
ggacttaacggctccaggat

SEQ ID NO: 2521153 - DNA, 19 bp, Homo sapiens
ggacttgtatatttgtaca

SEQ ID NO: 2521154 - DNA, 12 bp, Homo sapiens
ggagaaaaacaa

SEQ ID NO: 2521155 - DNA, 13 bp, Homo sapiens
ggagaaacagaga

SEQ ID NO: 2521156 - DNA, 14 bp, Homo sapiens
ggagaaacagagac

SEQ ID NO: 2521157 - DNA, 15 bp, Homo sapiens
ggagaaacagagaca

SEQ ID NO: 2521158 - DNA, 16 bp, Homo sapiens
ggagaaacagagacag

SEQ ID NO: 2521159 - DNA, 13 bp, Homo sapiens
ggagaaactggaa

SEQ ID NO: 2521160 - DNA, 17 bp, Homo sapiens
ggagaaagcactgacct

SEQ ID NO: 2521161 - DNA, 17 bp, Homo sapiens
ggagaaatgttgttcat

SEQ ID NO: 2521162 - DNA, 15 bp, Homo sapiens
ggagaaattgacaga

SEQ ID NO: 2521163 - DNA, 23 bp, Homo sapiens
ggagaagagctgttcacagccag

SEQ ID NO: 2521164 - DNA, 18 bp, Homo sapiens
ggagaagcatgaaaaagc

SEQ ID NO: 2521165 - DNA, 17 bp, Homo sapiens
ggagaagcggctggcag

SEQ ID NO: 2521166 - DNA, 12 bp, Homo sapiens
ggagaaggatct

SEQ ID NO: 2521167 - DNA, 22 bp, Homo sapiens
ggagaagtcttagacttgaaat

SEQ ID NO: 2521168 - DNA, 19 bp, Homo sapiens
ggagaatcacttgaacccg

SEQ ID NO: 2521169 - DNA, 17 bp, Homo sapiens
ggagaccaaggcgggag

SEQ ID NO: 2521170 - DNA, 22 bp, Homo sapiens
ggagactagatttatgaataca

SEQ ID NO: 2521171 - DNA, 13 bp, Homo sapiens
ggagactctgtgg

SEQ ID NO: 2521172 - DNA, 15 bp, Homo sapiens
ggagactgcccagct

SEQ ID NO: 2521173 - DNA, 12 bp, Homo sapiens
ggagagaagaat

SEQ ID NO: 2521174 - DNA, 11 bp, Homo sapiens
ggagagacctc

SEQ ID NO: 2521175 - DNA, 13 bp, Homo sapiens
ggagagacctcat

SEQ ID NO: 2521176 - DNA, 14 bp, Homo sapiens
ggagagcaggctgg

SEQ ID NO: 2521177 - DNA, 23 bp, Homo sapiens
ggagagcaggctggcagctctcc

SEQ ID NO: 2521178 - DNA, 22 bp, Homo sapiens
ggagagccaccaagagggacgc

SEQ ID NO: 2521179 - DNA, 16 bp, Homo sapiens
ggagagccagaacctg

SEQ ID NO: 2521180 - DNA, 21 bp, Homo sapiens
ggagagccagagaagtgacag

SEQ ID NO: 2521181 - DNA, 12 bp, Homo sapiens
ggagagcccagc

SEQ ID NO: 2521182 - DNA, 16 bp, Homo sapiens
ggagagccttccaggg

SEQ ID NO: 2521183 - DNA, 16 bp, Homo sapiens
ggagagcgcctgcccc

SEQ ID NO: 2521184 - DNA, 18 bp, Homo sapiens
ggagagcgcctgcccctc

SEQ ID NO: 2521185 - DNA, 22 bp, Homo sapiens
ggagagcgcctgcccctcccag

SEQ ID NO: 2521186 - DNA, 22 bp, Homo sapiens
ggagagctagaacccggcaggc

SEQ ID NO: 2521187 - DNA, 19 bp, Homo sapiens
ggagagctagaacctggag

SEQ ID NO: 2521188 - DNA, 20 bp, Homo sapiens
ggagagctagaacctggagg

SEQ ID NO: 2521189 - DNA, 21 bp, Homo sapiens
ggagagctagaacctggaggg

SEQ ID NO: 2521190 - DNA, 17 bp, Homo sapiens
ggagagctggagcctgg

SEQ ID NO: 2521191 - DNA, 18 bp, Homo sapiens
ggagagctggtgcccgga

SEQ ID NO: 2521192 - DNA, 17 bp, Homo sapiens
ggagaggaaaagtaagg

SEQ ID NO: 2521193 - DNA, 14 bp, Homo sapiens
ggagaggagagcca

SEQ ID NO: 2521194 - DNA, 16 bp, Homo sapiens
ggagaggagagccaga

SEQ ID NO: 2521195 - DNA, 20 bp, Homo sapiens
ggagaggagagccagagaag

SEQ ID NO: 2521196 - DNA, 20 bp, Homo sapiens
ggagaggagtgactgagctt

SEQ ID NO: 2521197 - DNA, 14 bp, Homo sapiens
ggagaggggcagaa

SEQ ID NO: 2521198 - DNA, 17 bp, Homo sapiens
ggagagtcccagagcag

SEQ ID NO: 2521199 - DNA, 21 bp, Homo sapiens
ggagagtcccctgaaggtctg

SEQ ID NO: 2521200 - DNA, 20 bp, Homo sapiens
ggagatcaaggagaggaggc

SEQ ID NO: 2521201 - DNA, 15 bp, Homo sapiens
ggagatgctccttgg

SEQ ID NO: 2521202 - DNA, 19 bp, Homo sapiens
ggagatggaggaaagtgat

SEQ ID NO: 2521203 - DNA, 20 bp, Homo sapiens
ggagatttacaactggggga

SEQ ID NO: 2521204 - DNA, 15 bp, Homo sapiens
ggagcaaagtgaggg

SEQ ID NO: 2521205 - DNA, 15 bp, Homo sapiens
ggagcaaatgtttct

SEQ ID NO: 2521206 - DNA, 14 bp, Homo sapiens
ggagcacaggcagc

SEQ ID NO: 2521207 - DNA, 16 bp, Homo sapiens
ggagcagaactgaacc

SEQ ID NO: 2521208 - DNA, 13 bp, Homo sapiens
ggagcagaatcag

SEQ ID NO: 2521209 - DNA, 21 bp, Homo sapiens
ggagcaggcggtgggcaccca

SEQ ID NO: 2521210 - DNA, 18 bp, Homo sapiens
ggagcagtatcatgaagc

SEQ ID NO: 2521211 - DNA, 22 bp, Homo sapiens
ggagcatccacctccttctctg

SEQ ID NO: 2521212 - DNA, 16 bp, Homo sapiens
ggagcatctcttgagg

SEQ ID NO: 2521213 - DNA, 20 bp, Homo sapiens
ggagcatctcttgaggccag

SEQ ID NO: 2521214 - DNA, 15 bp, Homo sapiens
ggagcatggctgtga

SEQ ID NO: 2521215 - DNA, 14 bp, Homo sapiens
ggagcatgggcctg

SEQ ID NO: 2521216 - DNA, 19 bp, Homo sapiens
ggagcattggctgagagac

SEQ ID NO: 2521217 - DNA, 16 bp, Homo sapiens
ggagccaactgctgct

SEQ ID NO: 2521218 - DNA, 17 bp, Homo sapiens
ggagccaactgctgctt

SEQ ID NO: 2521219 - DNA, 17 bp, Homo sapiens
ggagccaagtccagatt

SEQ ID NO: 2521220 - DNA, 12 bp, Homo sapiens
ggagccagctct

SEQ ID NO: 2521221 - DNA, 22 bp, Homo sapiens
ggagccccaggcctctgtgtcc

SEQ ID NO: 2521222 - DNA, 14 bp, Homo sapiens
ggagccccagtgcc

SEQ ID NO: 2521223 - DNA, 16 bp, Homo sapiens
ggagcccctgggtggg

SEQ ID NO: 2521224 - DNA, 20 bp, Homo sapiens
ggagcccgcacccccaccct

SEQ ID NO: 2521225 - DNA, 21 bp, Homo sapiens
ggagccgagatcacgccactg

SEQ ID NO: 2521226 - DNA, 14 bp, Homo sapiens
ggagccgctggcag

SEQ ID NO: 2521227 - DNA, 13 bp, Homo sapiens
ggagcctgctggt

SEQ ID NO: 2521228 - DNA, 19 bp, Homo sapiens
ggagcgcacctgccccctg

SEQ ID NO: 2521229 - DNA, 15 bp, Homo sapiens
ggagcggaaagcagc

SEQ ID NO: 2521230 - DNA, 17 bp, Homo sapiens
ggagcgggacctgtggc

SEQ ID NO: 2521231 - DNA, 14 bp, Homo sapiens
ggagcgtgggaggc

SEQ ID NO: 2521232 - DNA, 17 bp, Homo sapiens
ggagctaacactggccc

SEQ ID NO: 2521233 - DNA, 15 bp, Homo sapiens
ggagctatcaggaac

SEQ ID NO: 2521234 - DNA, 20 bp, Homo sapiens
ggagctcactgtggtgtctg

SEQ ID NO: 2521235 - DNA, 20 bp, Homo sapiens
ggagctcagagagggcaggc

SEQ ID NO: 2521236 - DNA, 18 bp, Homo sapiens
ggagctcctctcctggag

SEQ ID NO: 2521237 - DNA, 12 bp, Homo sapiens
ggagctgcctgt

SEQ ID NO: 2521238 - DNA, 13 bp, Homo sapiens
ggagctgctggct

SEQ ID NO: 2521239 - DNA, 21 bp, Homo sapiens
ggagctgggacacttaacaga

SEQ ID NO: 2521240 - DNA, 18 bp, Homo sapiens
ggagctgtaaaccagaga

SEQ ID NO: 2521241 - DNA, 21 bp, Homo sapiens
ggagcttagccaatgtgggag

SEQ ID NO: 2521242 - DNA, 20 bp, Homo sapiens
ggagctttcaaagaaggaat

SEQ ID NO: 2521243 - DNA, 23 bp, Homo sapiens
ggaggaaatttgaatgggtccat

SEQ ID NO: 2521244 - DNA, 15 bp, Homo sapiens
ggaggaatgctcccc

SEQ ID NO: 2521245 - DNA, 12 bp, Homo sapiens
ggaggaccttat

SEQ ID NO: 2521246 - DNA, 13 bp, Homo sapiens
ggaggagaatgag

SEQ ID NO: 2521247 - DNA, 12 bp, Homo sapiens
ggaggagcaaag

SEQ ID NO: 2521248 - DNA, 16 bp, Homo sapiens
ggaggaggccacctct

SEQ ID NO: 2521249 - DNA, 16 bp, Homo sapiens
ggaggatcactggagc

SEQ ID NO: 2521250 - DNA, 19 bp, Homo sapiens
ggaggatcactggagccca

SEQ ID NO: 2521251 - DNA, 12 bp, Homo sapiens
ggaggatggaga

SEQ ID NO: 2521252 - DNA, 13 bp, Homo sapiens
ggaggatgggctc

SEQ ID NO: 2521253 - DNA, 21 bp, Homo sapiens
ggaggatgttctgggacacag

SEQ ID NO: 2521254 - DNA, 22 bp, Homo sapiens
ggaggattgcttgagcccagga

SEQ ID NO: 2521255 - DNA, 14 bp, Homo sapiens
ggaggcatctgcac

SEQ ID NO: 2521256 - DNA, 15 bp, Homo sapiens
ggaggcatggccctg

SEQ ID NO: 2521257 - DNA, 16 bp, Homo sapiens
ggaggcatggccctgg

SEQ ID NO: 2521258 - DNA, 18 bp, Homo sapiens
ggaggccaagtgcaggct

SEQ ID NO: 2521259 - DNA, 19 bp, Homo sapiens
ggaggccacctctccaagg

SEQ ID NO: 2521260 - DNA, 21 bp, Homo sapiens
ggaggccacctctccaagggc

SEQ ID NO: 2521261 - DNA, 12 bp, Homo sapiens
ggaggccagcca

SEQ ID NO: 2521262 - DNA, 17 bp, Homo sapiens
ggaggcccctggcccag

SEQ ID NO: 2521263 - DNA, 18 bp, Homo sapiens
ggaggcctgggggcaggg

SEQ ID NO: 2521264 - DNA, 22 bp, Homo sapiens
ggaggcgcactttcctcctggc

SEQ ID NO: 2521265 - DNA, 19 bp, Homo sapiens
ggaggcggacgttccagcc

SEQ ID NO: 2521266 - DNA, 12 bp, Homo sapiens
ggaggcggagag

SEQ ID NO: 2521267 - DNA, 20 bp, Homo sapiens
ggaggcggagagtacagtga

SEQ ID NO: 2521268 - DNA, 21 bp, Homo sapiens
ggaggctcacccccttctcca

SEQ ID NO: 2521269 - DNA, 18 bp, Homo sapiens
ggaggctgagacaggaga

SEQ ID NO: 2521270 - DNA, 19 bp, Homo sapiens
ggaggctgagatgggagaa

SEQ ID NO: 2521271 - DNA, 17 bp, Homo sapiens
ggaggctgcccccggcc

SEQ ID NO: 2521272 - DNA, 21 bp, Homo sapiens
ggaggctgcccccggccccct

SEQ ID NO: 2521273 - DNA, 22 bp, Homo sapiens
ggaggctgcccccggccccctg

SEQ ID NO: 2521274 - DNA, 19 bp, Homo sapiens
ggaggcttgtcagagctgg

SEQ ID NO: 2521275 - DNA, 20 bp, Homo sapiens
ggaggcttgtcagagctggg

SEQ ID NO: 2521276 - DNA, 17 bp, Homo sapiens
ggagggcagcagggcta

SEQ ID NO: 2521277 - DNA, 23 bp, Homo sapiens
ggagggccacatgggaggctcac

SEQ ID NO: 2521278 - DNA, 16 bp, Homo sapiens
ggagggctagaaccta

SEQ ID NO: 2521279 - DNA, 21 bp, Homo sapiens
ggagggctagaacctggaagg

SEQ ID NO: 2521280 - DNA, 20 bp, Homo sapiens
ggagggctagaacctggaga

SEQ ID NO: 2521281 - DNA, 23 bp, Homo sapiens
ggagggctagaacctggcaggtt

SEQ ID NO: 2521282 - DNA, 22 bp, Homo sapiens
ggagggctagaatctggagagc

SEQ ID NO: 2521283 - DNA, 14 bp, Homo sapiens
ggagggctggaatc

SEQ ID NO: 2521284 - DNA, 20 bp, Homo sapiens
ggagggctggaatctggaga

SEQ ID NO: 2521285 - DNA, 19 bp, Homo sapiens
ggaggggcgctggcccagc

SEQ ID NO: 2521286 - DNA, 12 bp, Homo sapiens
ggaggggggagc

SEQ ID NO: 2521287 - DNA, 15 bp, Homo sapiens
ggaggggggagccat

SEQ ID NO: 2521288 - DNA, 13 bp, Homo sapiens
ggaggggggaggt

SEQ ID NO: 2521289 - DNA, 14 bp, Homo sapiens
ggaggggggaggtg

SEQ ID NO: 2521290 - DNA, 22 bp, Homo sapiens
ggagggggtttgctggggaact

SEQ ID NO: 2521291 - DNA, 23 bp, Homo sapiens
ggaggggtaacttgcacctctga

SEQ ID NO: 2521292 - DNA, 17 bp, Homo sapiens
ggaggggtggtcctgac

SEQ ID NO: 2521293 - DNA, 15 bp, Homo sapiens
ggagggtcaggaagg

SEQ ID NO: 2521294 - DNA, 20 bp, Homo sapiens
ggaggtcaaggctgcagtga

SEQ ID NO: 2521295 - DNA, 15 bp, Homo sapiens
ggaggtcgaggcagg

SEQ ID NO: 2521296 - DNA, 18 bp, Homo sapiens
ggaggtcgaggcaggagg

SEQ ID NO: 2521297 - DNA, 18 bp, Homo sapiens
ggaggtggctatggccac

SEQ ID NO: 2521298 - DNA, 13 bp, Homo sapiens
ggaggtggctggg

SEQ ID NO: 2521299 - DNA, 16 bp, Homo sapiens
ggaggtgtcaggctgc

SEQ ID NO: 2521300 - DNA, 17 bp, Homo sapiens
ggaggttgcagggagcc

SEQ ID NO: 2521301 - DNA, 15 bp, Homo sapiens
ggagtcaagtgtgga

SEQ ID NO: 2521302 - DNA, 18 bp, Homo sapiens
ggagtcagtgccaggtcc

SEQ ID NO: 2521303 - DNA, 16 bp, Homo sapiens
ggagtcccaaggaaag

SEQ ID NO: 2521304 - DNA, 17 bp, Homo sapiens
ggagtcccaaggaaagc

SEQ ID NO: 2521305 - DNA, 21 bp, Homo sapiens
ggagtcccaccttggctgcag

SEQ ID NO: 2521306 - DNA, 23 bp, Homo sapiens
ggagtcccaccttggctgcaggg

SEQ ID NO: 2521307 - DNA, 15 bp, Homo sapiens
ggagtcccctcacct

SEQ ID NO: 2521308 - DNA, 13 bp, Homo sapiens
ggagtcccctccc

SEQ ID NO: 2521309 - DNA, 22 bp, Homo sapiens
ggagtgaaacctttagggcagc

SEQ ID NO: 2521310 - DNA, 19 bp, Homo sapiens
ggagtgacagaggcagccc

SEQ ID NO: 2521311 - DNA, 12 bp, Homo sapiens
ggagtgagctgg

SEQ ID NO: 2521312 - DNA, 21 bp, Homo sapiens
ggagtgagttgatagcacaga

SEQ ID NO: 2521313 - DNA, 19 bp, Homo sapiens
ggagtggaagaagagggag

SEQ ID NO: 2521314 - DNA, 20 bp, Homo sapiens
ggagtggaatagtatcctcc

SEQ ID NO: 2521315 - DNA, 22 bp, Homo sapiens
ggagtggaatagtatcctccag

SEQ ID NO: 2521316 - DNA, 12 bp, Homo sapiens
ggagtgggccca

SEQ ID NO: 2521317 - DNA, 15 bp, Homo sapiens
ggagtggggcagtag

SEQ ID NO: 2521318 - DNA, 20 bp, Homo sapiens
ggagtgttccccttccactg

SEQ ID NO: 2521319 - DNA, 22 bp, Homo sapiens
ggagttacattaatgttaattc

SEQ ID NO: 2521320 - DNA, 21 bp, Homo sapiens
ggagttagaggccagcctggc

SEQ ID NO: 2521321 - DNA, 20 bp, Homo sapiens
ggagttcaatgatctaggtt

SEQ ID NO: 2521322 - DNA, 14 bp, Homo sapiens
ggagttccatgaag

SEQ ID NO: 2521323 - DNA, 18 bp, Homo sapiens
ggagttcgagaccagcct

SEQ ID NO: 2521324 - DNA, 20 bp, Homo sapiens
ggagttcgagaccagcctgg

SEQ ID NO: 2521325 - DNA, 15 bp, Homo sapiens
ggagttcgaggctgc

SEQ ID NO: 2521326 - DNA, 21 bp, Homo sapiens
ggagttcgaggctgcagtcag

SEQ ID NO: 2521327 - DNA, 20 bp, Homo sapiens
ggagttgatcgcctttccca

SEQ ID NO: 2521328 - DNA, 21 bp, Homo sapiens
ggagttggaagtgtgtgatct

SEQ ID NO: 2521329 - DNA, 18 bp, Homo sapiens
ggagtttctttcctgcct

SEQ ID NO: 2521330 - DNA, 13 bp, Homo sapiens
ggagtttgaggct

SEQ ID NO: 2521331 - DNA, 20 bp, Homo sapiens
ggagtttgaggctgcagcga

SEQ ID NO: 2521332 - DNA, 15 bp, Homo sapiens
ggataaaaagatgtt

SEQ ID NO: 2521333 - DNA, 15 bp, Homo sapiens
ggatagatgtgtgga

SEQ ID NO: 2521334 - DNA, 15 bp, Homo sapiens
ggataggagcctgct

SEQ ID NO: 2521335 - DNA, 17 bp, Homo sapiens
ggataggagcctgctgg

SEQ ID NO: 2521336 - DNA, 14 bp, Homo sapiens
ggatcacagagaca

SEQ ID NO: 2521337 - DNA, 17 bp, Homo sapiens
ggatcacagggccccag

SEQ ID NO: 2521338 - DNA, 13 bp, Homo sapiens
ggatcactggagc

SEQ ID NO: 2521339 - DNA, 23 bp, Homo sapiens
ggatcccaccccattttctgtgg

SEQ ID NO: 2521340 - DNA, 21 bp, Homo sapiens
ggatcctattctcaccaggaa

SEQ ID NO: 2521341 - DNA, 23 bp, Homo sapiens
ggatcctattctcaccaggaagg

SEQ ID NO: 2521342 - DNA, 14 bp, Homo sapiens
ggatcctccaggtg

SEQ ID NO: 2521343 - DNA, 19 bp, Homo sapiens
ggatcggaggcttgtcaga

SEQ ID NO: 2521344 - DNA, 17 bp, Homo sapiens
ggatctcattggaccct

SEQ ID NO: 2521345 - DNA, 24 bp, Homo sapiens
ggatctcattggacccttccatgg

SEQ ID NO: 2521346 - DNA, 14 bp, Homo sapiens
ggatctccccactc

SEQ ID NO: 2521347 - DNA, 21 bp, Homo sapiens
ggatctctcaggagcacaggc

SEQ ID NO: 2521348 - DNA, 15 bp, Homo sapiens
ggatctgcccctccc

SEQ ID NO: 2521349 - DNA, 17 bp, Homo sapiens
ggatctgcccctccctg

SEQ ID NO: 2521350 - DNA, 18 bp, Homo sapiens
ggatctggggctctggga

SEQ ID NO: 2521351 - DNA, 21 bp, Homo sapiens
ggatgacatgcactcagctct

SEQ ID NO: 2521352 - DNA, 14 bp, Homo sapiens
ggatgaccagaaca

SEQ ID NO: 2521353 - DNA, 19 bp, Homo sapiens
ggatgactagaggcaggga

SEQ ID NO: 2521354 - DNA, 22 bp, Homo sapiens
ggatgagaaaggttgaagcacc

SEQ ID NO: 2521355 - DNA, 15 bp, Homo sapiens
ggatgagagcccaga

SEQ ID NO: 2521356 - DNA, 23 bp, Homo sapiens
ggatgagagcccagaggtaacag

SEQ ID NO: 2521357 - DNA, 17 bp, Homo sapiens
ggatgagcatggagctg

SEQ ID NO: 2521358 - DNA, 13 bp, Homo sapiens
ggatgagcattta

SEQ ID NO: 2521359 - DNA, 22 bp, Homo sapiens
ggatgatctaggaagactttgg

SEQ ID NO: 2521360 - DNA, 16 bp, Homo sapiens
ggatgattcagaaatt

SEQ ID NO: 2521361 - DNA, 21 bp, Homo sapiens
ggatgattcagaaattggaac

SEQ ID NO: 2521362 - DNA, 23 bp, Homo sapiens
ggatgcacagagttgttacattt

SEQ ID NO: 2521363 - DNA, 22 bp, Homo sapiens
ggatgcccagggccactctgcc

SEQ ID NO: 2521364 - DNA, 23 bp, Homo sapiens
ggatgcccagggccactctgcct

SEQ ID NO: 2521365 - DNA, 21 bp, Homo sapiens
ggatggaggggtggtcctgac

SEQ ID NO: 2521366 - DNA, 15 bp, Homo sapiens
ggatggcaccagagg

SEQ ID NO: 2521367 - DNA, 22 bp, Homo sapiens
ggatggcccttcccactggagg

SEQ ID NO: 2521368 - DNA, 21 bp, Homo sapiens
ggatggcctggccagggcctg

SEQ ID NO: 2521369 - DNA, 16 bp, Homo sapiens
ggatggcgggtggggg

SEQ ID NO: 2521370 - DNA, 15 bp, Homo sapiens
ggatgggaaggaggg

SEQ ID NO: 2521371 - DNA, 17 bp, Homo sapiens
ggatgggaaggagggag

SEQ ID NO: 2521372 - DNA, 16 bp, Homo sapiens
ggatggggctgcaccg

SEQ ID NO: 2521373 - DNA, 22 bp, Homo sapiens
ggatgggggctggcctctggct

SEQ ID NO: 2521374 - DNA, 23 bp, Homo sapiens
ggatggtactagggggaagtgac

SEQ ID NO: 2521375 - DNA, 16 bp, Homo sapiens
ggatggtcctggggct

SEQ ID NO: 2521376 - DNA, 20 bp, Homo sapiens
ggatggtcctggggctctgt

SEQ ID NO: 2521377 - DNA, 15 bp, Homo sapiens
ggatgtcacagggcc

SEQ ID NO: 2521378 - DNA, 15 bp, Homo sapiens
ggcaggtgcctccag

SEQ ID NO: 2521379 - DNA, 20 bp, Homo sapiens
ggcaggtgcctccaggtgtg

SEQ ID NO: 2521380 - DNA, 14 bp, Homo sapiens
ggcaggtggtggca

SEQ ID NO: 2521381 - DNA, 21 bp, Homo sapiens
ggcaggtggtggcactgagcc

SEQ ID NO: 2521382 - DNA, 23 bp, Homo sapiens
ggcagtcattcagcaccagagca

SEQ ID NO: 2521383 - DNA, 15 bp, Homo sapiens
ggcagtcgggggctg

SEQ ID NO: 2521384 - DNA, 20 bp, Homo sapiens
ggcagtggagtcggaagggc

SEQ ID NO: 2521385 - DNA, 13 bp, Homo sapiens
ggcagtgggagct

SEQ ID NO: 2521386 - DNA, 16 bp, Homo sapiens
ggcagtgggagctgcc

SEQ ID NO: 2521387 - DNA, 19 bp, Homo sapiens
ggcagtgggagctgcctgt

SEQ ID NO: 2521388 - DNA, 20 bp, Homo sapiens
ggcagtggtaagctctggct

SEQ ID NO: 2521389 - DNA, 21 bp, Homo sapiens
ggcagttctgggtgctcccta

SEQ ID NO: 2521390 - DNA, 19 bp, Homo sapiens
ggcatagatgcaggtgagc

SEQ ID NO: 2521391 - DNA, 15 bp, Homo sapiens
ggcataggcctgggt

SEQ ID NO: 2521392 - DNA, 22 bp, Homo sapiens
ggcatatccaccacctccctca

SEQ ID NO: 2521393 - DNA, 13 bp, Homo sapiens
ggcatcacagggc

SEQ ID NO: 2521394 - DNA, 14 bp, Homo sapiens
ggcatcacagggca

SEQ ID NO: 2521395 - DNA, 18 bp, Homo sapiens
ggcatcccagtggcctca

SEQ ID NO: 2521396 - DNA, 20 bp, Homo sapiens
ggcatcctcaggtggtcagg

SEQ ID NO: 2521397 - DNA, 13 bp, Homo sapiens
ggcatcctgtgaa

SEQ ID NO: 2521398 - DNA, 22 bp, Homo sapiens
ggcatctagagcttgatgccag

SEQ ID NO: 2521399 - DNA, 13 bp, Homo sapiens
ggcatctccagga

SEQ ID NO: 2521400 - DNA, 14 bp, Homo sapiens
ggcatctccaggaa

SEQ ID NO: 2521401 - DNA, 16 bp, Homo sapiens
ggcatctccaggaagg

SEQ ID NO: 2521402 - DNA, 16 bp, Homo sapiens
ggcatctcctgtgcat

SEQ ID NO: 2521403 - DNA, 17 bp, Homo sapiens
ggcatctcctgtgcatg

SEQ ID NO: 2521404 - DNA, 15 bp, Homo sapiens
ggcatctctaattgg

SEQ ID NO: 2521405 - DNA, 22 bp, Homo sapiens
ggcatctgcaccctcgatgaag

SEQ ID NO: 2521406 - DNA, 18 bp, Homo sapiens
ggcatctgcccctccccc

SEQ ID NO: 2521407 - DNA, 16 bp, Homo sapiens
ggcatctttgccttgg

SEQ ID NO: 2521408 - DNA, 23 bp, Homo sapiens
ggcatctttgccttgggctgctc

SEQ ID NO: 2521409 - DNA, 19 bp, Homo sapiens
ggcatgagggatcacaggg

SEQ ID NO: 2521410 - DNA, 13 bp, Homo sapiens
ggcatgctggggc

SEQ ID NO: 2521411 - DNA, 13 bp, Homo sapiens
ggcatggccctgg

SEQ ID NO: 2521412 - DNA, 16 bp, Homo sapiens
ggcatggccctggggt

SEQ ID NO: 2521413 - DNA, 17 bp, Homo sapiens
ggcatggccctggggtc

SEQ ID NO: 2521414 - DNA, 14 bp, Homo sapiens
ggcatggctgggaa

SEQ ID NO: 2521415 - DNA, 19 bp, Homo sapiens
ggcatggggtgggcctctg

SEQ ID NO: 2521416 - DNA, 18 bp, Homo sapiens
ggcatgtattggcctgga

SEQ ID NO: 2521417 - DNA, 13 bp, Homo sapiens
ggcatgtggcctg

SEQ ID NO: 2521418 - DNA, 15 bp, Homo sapiens
ggcatgtggcctgtg

SEQ ID NO: 2521419 - DNA, 17 bp, Homo sapiens
ggcatgtgtatgttccc

SEQ ID NO: 2521420 - DNA, 17 bp, Homo sapiens
ggcattagaattattta

SEQ ID NO: 2521421 - DNA, 19 bp, Homo sapiens
ggcattagaattatttaaa

SEQ ID NO: 2521422 - DNA, 16 bp, Homo sapiens
ggcattccccaggagg

SEQ ID NO: 2521423 - DNA, 18 bp, Homo sapiens
ggcattccccaggaggcc

SEQ ID NO: 2521424 - DNA, 12 bp, Homo sapiens
ggcattgctttc

SEQ ID NO: 2521425 - DNA, 17 bp, Homo sapiens
ggcatttgtttgaactg

SEQ ID NO: 2521426 - DNA, 21 bp, Homo sapiens
ggccaaaggagggtcaggaag

SEQ ID NO: 2521427 - DNA, 15 bp, Homo sapiens
ggccaacaaagctgt

SEQ ID NO: 2521428 - DNA, 15 bp, Homo sapiens
ggccaacaccaggga

SEQ ID NO: 2521429 - DNA, 15 bp, Homo sapiens
ggccaagacttggca

SEQ ID NO: 2521430 - DNA, 23 bp, Homo sapiens
ggccaagacttggcaacagaagc

SEQ ID NO: 2521431 - DNA, 18 bp, Homo sapiens
ggccaaggccttctcctc

SEQ ID NO: 2521432 - DNA, 12 bp, Homo sapiens
ggccaagttctt

SEQ ID NO: 2521433 - DNA, 16 bp, Homo sapiens
ggccacaagacccttg

SEQ ID NO: 2521434 - DNA, 21 bp, Homo sapiens
ggccacactattaccatgaga

SEQ ID NO: 2521435 - DNA, 14 bp, Homo sapiens
ggccacagttgttt

SEQ ID NO: 2521436 - DNA, 20 bp, Homo sapiens
ggccacatgagtcccagtgg

SEQ ID NO: 2521437 - DNA, 18 bp, Homo sapiens
ggccacatgggaggctca

SEQ ID NO: 2521438 - DNA, 19 bp, Homo sapiens
ggccacatgggaggctcac

SEQ ID NO: 2521439 - DNA, 17 bp, Homo sapiens
ggccacatggggctggg

SEQ ID NO: 2521440 - DNA, 14 bp, Homo sapiens
ggccaccacccccc

SEQ ID NO: 2521441 - DNA, 21 bp, Homo sapiens
ggccacccgttctgctggcct

SEQ ID NO: 2521442 - DNA, 24 bp, Homo sapiens
ggccacccgttctgctggcctgga

SEQ ID NO: 2521443 - DNA, 11 bp, Homo sapiens
ggccacctctc

SEQ ID NO: 2521444 - DNA, 22 bp, Homo sapiens
ggccacctgaggtgggcccagg

SEQ ID NO: 2521445 - DNA, 14 bp, Homo sapiens
ggccacctgccccc

SEQ ID NO: 2521446 - DNA, 22 bp, Homo sapiens
ggccacctgcccccttctccca

SEQ ID NO: 2521447 - DNA, 14 bp, Homo sapiens
ggccactgaagata

SEQ ID NO: 2521448 - DNA, 19 bp, Homo sapiens
ggccactgcacagagctct

SEQ ID NO: 2521449 - DNA, 21 bp, Homo sapiens
ggccagagagcctggtgctgc

SEQ ID NO: 2521450 - DNA, 22 bp, Homo sapiens
ggccagagctacccgcagagtt

SEQ ID NO: 2521451 - DNA, 17 bp, Homo sapiens
ggccagagctgggaggc

SEQ ID NO: 2521452 - DNA, 21 bp, Homo sapiens
ggccagagctgggaggcatgg

SEQ ID NO: 2521453 - DNA, 19 bp, Homo sapiens
ggccagagtggcctggcca

SEQ ID NO: 2521454 - DNA, 12 bp, Homo sapiens
ggccagccaggc

SEQ ID NO: 2521455 - DNA, 14 bp, Homo sapiens
ggccagccccaccc

SEQ ID NO: 2521456 - DNA, 15 bp, Homo sapiens
ggccagccccggccc

SEQ ID NO: 2521457 - DNA, 19 bp, Homo sapiens
ggccagccccggccctggg

SEQ ID NO: 2521458 - DNA, 14 bp, Homo sapiens
ggccagcccctccc

SEQ ID NO: 2521459 - DNA, 21 bp, Homo sapiens
ggccagcccctcccaccacag

SEQ ID NO: 2521460 - DNA, 22 bp, Homo sapiens
ggccagccttgaccattctcca

SEQ ID NO: 2521461 - DNA, 19 bp, Homo sapiens
ggccagctgccccagccag

SEQ ID NO: 2521462 - DNA, 15 bp, Homo sapiens
ggccaggcagatctg

SEQ ID NO: 2521463 - DNA, 21 bp, Homo sapiens
ggccaggccacctccagaaac

SEQ ID NO: 2521464 - DNA, 17 bp, Homo sapiens
ggccaggccagctgcct

SEQ ID NO: 2521465 - DNA, 14 bp, Homo sapiens
ggccaggccctctg

SEQ ID NO: 2521466 - DNA, 19 bp, Homo sapiens
ggccagggcctggaagaca

SEQ ID NO: 2521467 - DNA, 23 bp, Homo sapiens
ggccagggcctggaagacagaga

SEQ ID NO: 2521468 - DNA, 17 bp, Homo sapiens
ggccaggggtctccctg

SEQ ID NO: 2521469 - DNA, 17 bp, Homo sapiens
ggccaggtttctgccca

SEQ ID NO: 2521470 - DNA, 20 bp, Homo sapiens
ggccagtaagggaaatagaa

SEQ ID NO: 2521471 - DNA, 16 bp, Homo sapiens
ggccagtcctgcctgg

SEQ ID NO: 2521472 - DNA, 21 bp, Homo sapiens
ggccagtcctgcctggccagg

SEQ ID NO: 2521473 - DNA, 22 bp, Homo sapiens
ggccagtcctgcctggccaggc

SEQ ID NO: 2521474 - DNA, 14 bp, Homo sapiens
ggccccctgtcctc

SEQ ID NO: 2521475 - DNA, 18 bp, Homo sapiens
ggccccgccgcctggtac

SEQ ID NO: 2521476 - DNA, 18 bp, Homo sapiens
ggccccggccccagccag

SEQ ID NO: 2521477 - DNA, 15 bp, Homo sapiens
ggcccctctgcccag

SEQ ID NO: 2521478 - DNA, 13 bp, Homo sapiens
ggcccctgccacc

SEQ ID NO: 2521479 - DNA, 17 bp, Homo sapiens
ggcccctgccaccctgg

SEQ ID NO: 2521480 - DNA, 16 bp, Homo sapiens
ggcccctgcccggctg

SEQ ID NO: 2521481 - DNA, 14 bp, Homo sapiens
ggcccctgctggtt

SEQ ID NO: 2521482 - DNA, 14 bp, Homo sapiens
ggcccctggcccag

SEQ ID NO: 2521483 - DNA, 18 bp, Homo sapiens
ggcccctggcccagcggc

SEQ ID NO: 2521484 - DNA, 20 bp, Homo sapiens
ggccccttcacttctgacca

SEQ ID NO: 2521485 - DNA, 16 bp, Homo sapiens
ggccccttttcactcc

SEQ ID NO: 2521486 - DNA, 16 bp, Homo sapiens
ggcccgttgaggatga

SEQ ID NO: 2521487 - DNA, 16 bp, Homo sapiens
ggccctaccagcgccc

SEQ ID NO: 2521488 - DNA, 15 bp, Homo sapiens
ggccctcacccctgc

SEQ ID NO: 2521489 - DNA, 21 bp, Homo sapiens
ggccctcacccctgccctggg

SEQ ID NO: 2521490 - DNA, 13 bp, Homo sapiens
ggccctcccttgg

SEQ ID NO: 2521491 - DNA, 23 bp, Homo sapiens
ggccctcccttggaaacctgccc

SEQ ID NO: 2521492 - DNA, 16 bp, Homo sapiens
ggccctcgctgccagc

SEQ ID NO: 2521493 - DNA, 19 bp, Homo sapiens
ggccctcgctgccagctct

SEQ ID NO: 2521494 - DNA, 22 bp, Homo sapiens
ggccctcgctgccagctctgta

SEQ ID NO: 2521495 - DNA, 15 bp, Homo sapiens
ggccctcgggcccag

SEQ ID NO: 2521496 - DNA, 17 bp, Homo sapiens
ggccctctgcccactcc

SEQ ID NO: 2521497 - DNA, 20 bp, Homo sapiens
ggccctctgcccactccctg

SEQ ID NO: 2521498 - DNA, 21 bp, Homo sapiens
ggccctgagctcggtggaccc

SEQ ID NO: 2521499 - DNA, 16 bp, Homo sapiens
ggccctgaggtgtggg

SEQ ID NO: 2521500 - DNA, 21 bp, Homo sapiens
ggccctgaggtgtgggggctg

SEQ ID NO: 2521501 - DNA, 15 bp, Homo sapiens
ggccctggggtccca

SEQ ID NO: 2521502 - DNA, 12 bp, Homo sapiens
ggccctggtcct

SEQ ID NO: 2521503 - DNA, 19 bp, Homo sapiens
ggccctggtgtttctagca

SEQ ID NO: 2521504 - DNA, 17 bp, Homo sapiens
ggcccttctctccagcc

SEQ ID NO: 2521505 - DNA, 16 bp, Homo sapiens
ggccgaagctctggct

SEQ ID NO: 2521506 - DNA, 22 bp, Homo sapiens
ggccgcagctcttgcccttccc

SEQ ID NO: 2521507 - DNA, 16 bp, Homo sapiens
ggccgccccctgcccc

SEQ ID NO: 2521508 - DNA, 18 bp, Homo sapiens
ggccgccccctgcccccc

SEQ ID NO: 2521509 - DNA, 19 bp, Homo sapiens
ggccgctagaggcctgagg

SEQ ID NO: 2521510 - DNA, 21 bp, Homo sapiens
ggccgctagaggcctgaggat

SEQ ID NO: 2521511 - DNA, 19 bp, Homo sapiens
ggccgctccaggggtggct

SEQ ID NO: 2521512 - DNA, 17 bp, Homo sapiens
ggccggtctgcaagtca

SEQ ID NO: 2521513 - DNA, 18 bp, Homo sapiens
ggccggtctgcaagtcag

SEQ ID NO: 2521514 - DNA, 20 bp, Homo sapiens
ggccggtctgcaagtcagag

SEQ ID NO: 2521515 - DNA, 15 bp, Homo sapiens
ggccggtgtgggctg

SEQ ID NO: 2521516 - DNA, 14 bp, Homo sapiens
ggccgtaccccacc

SEQ ID NO: 2521517 - DNA, 17 bp, Homo sapiens
ggccgtaccccaccctc

SEQ ID NO: 2521518 - DNA, 22 bp, Homo sapiens
ggccgtcctcccgggccctccc

SEQ ID NO: 2521519 - DNA, 13 bp, Homo sapiens
ggccgtgcccagg

SEQ ID NO: 2521520 - DNA, 17 bp, Homo sapiens
ggccgtgggcctggggt

SEQ ID NO: 2521521 - DNA, 16 bp, Homo sapiens
ggcctaaaagtaaaca

SEQ ID NO: 2521522 - DNA, 17 bp, Homo sapiens
ggcctacatgctttgtg

SEQ ID NO: 2521523 - DNA, 23 bp, Homo sapiens
ggcctacatgctttgtgaacaag

SEQ ID NO: 2521524 - DNA, 17 bp, Homo sapiens
ggcctagatccacacac

SEQ ID NO: 2521525 - DNA, 23 bp, Homo sapiens
ggcctagcatacgtacacatttt

SEQ ID NO: 2521526 - DNA, 20 bp, Homo sapiens
ggcctataatgaagctttat

SEQ ID NO: 2521527 - DNA, 20 bp, Homo sapiens
ggcctatgcacatatggact

SEQ ID NO: 2521528 - DNA, 16 bp, Homo sapiens
ggcctcaaccctccct

SEQ ID NO: 2521529 - DNA, 18 bp, Homo sapiens
ggcctcaaccctccctca

SEQ ID NO: 2521530 - DNA, 21 bp, Homo sapiens
ggcctcaaccctccctcagcc

SEQ ID NO: 2521531 - DNA, 22 bp, Homo sapiens
ggcctcaaccctccctcagccc

SEQ ID NO: 2521532 - DNA, 22 bp, Homo sapiens
ggcctcaagtgattctcctgcc

SEQ ID NO: 2521533 - DNA, 10 bp, Homo sapiens
ggcctcagaa

SEQ ID NO: 2521534 - DNA, 21 bp, Homo sapiens
ggcctcagcacccctgtctct

SEQ ID NO: 2521535 - DNA, 20 bp, Homo sapiens
ggcctcagtctcccttctcc

SEQ ID NO: 2521536 - DNA, 13 bp, Homo sapiens
ggcctcagtgcca

SEQ ID NO: 2521537 - DNA, 22 bp, Homo sapiens
ggcctcagtggactttccaccc

SEQ ID NO: 2521538 - DNA, 17 bp, Homo sapiens
ggcctcattactttacc

SEQ ID NO: 2521539 - DNA, 20 bp, Homo sapiens
ggcctcccaactcaccccag

SEQ ID NO: 2521540 - DNA, 23 bp, Homo sapiens
ggcctcccaactcaccccagccc

SEQ ID NO: 2521541 - DNA, 14 bp, Homo sapiens
ggcctcccacagac

SEQ ID NO: 2521542 - DNA, 12 bp, Homo sapiens
ggcctcccaccc

SEQ ID NO: 2521543 - DNA, 21 bp, Homo sapiens
ggcctccggcgtcagcctcca

SEQ ID NO: 2521544 - DNA, 22 bp, Homo sapiens
ggcctccggcgtcagcctccag

SEQ ID NO: 2521545 - DNA, 21 bp, Homo sapiens
ggcctccgtccaggagcctgg

SEQ ID NO: 2521546 - DNA, 14 bp, Homo sapiens
ggcctcctgtgtgt

SEQ ID NO: 2521547 - DNA, 15 bp, Homo sapiens
ggcctcggagcctca

SEQ ID NO: 2521548 - DNA, 22 bp, Homo sapiens
ggcctcggagcctcatccgagg

SEQ ID NO: 2521549 - DNA, 22 bp, Homo sapiens
ggcctcgggacacctgccctgc

SEQ ID NO: 2521550 - DNA, 16 bp, Homo sapiens
ggcctcgggacctcag

SEQ ID NO: 2521551 - DNA, 19 bp, Homo sapiens
ggcctctaaccccaggccc

SEQ ID NO: 2521552 - DNA, 20 bp, Homo sapiens
ggcctctaaccccaggcccc

SEQ ID NO: 2521553 - DNA, 22 bp, Homo sapiens
ggcctctaaccccaggccccga

SEQ ID NO: 2521554 - DNA, 20 bp, Homo sapiens
ggcctctcattccagaggaa

SEQ ID NO: 2521555 - DNA, 21 bp, Homo sapiens
ggcctctctggcctcccaccc

SEQ ID NO: 2521556 - DNA, 16 bp, Homo sapiens
ggcctctgcactcccc

SEQ ID NO: 2521557 - DNA, 19 bp, Homo sapiens
ggcctctgcactcccctgc

SEQ ID NO: 2521558 - DNA, 22 bp, Homo sapiens
ggcctcttggacctctgctctg

SEQ ID NO: 2521559 - DNA, 19 bp, Homo sapiens
ggcctcttgggtcccccac

SEQ ID NO: 2521560 - DNA, 23 bp, Homo sapiens
ggcctctttgtctaaaacaataa

SEQ ID NO: 2521561 - DNA, 13 bp, Homo sapiens
ggcctgaagagtc

SEQ ID NO: 2521562 - DNA, 19 bp, Homo sapiens
ggcctgaagagtcctctga

SEQ ID NO: 2521563 - DNA, 23 bp, Homo sapiens
ggcctgaatgcttataggtggcc

SEQ ID NO: 2521564 - DNA, 13 bp, Homo sapiens
ggcctgaggatga

SEQ ID NO: 2521565 - DNA, 19 bp, Homo sapiens
ggcctgaggatgagctgga

SEQ ID NO: 2521566 - DNA, 15 bp, Homo sapiens
ggcctgatgctccct

SEQ ID NO: 2521567 - DNA, 16 bp, Homo sapiens
ggcctgcaagggagtg

SEQ ID NO: 2521568 - DNA, 21 bp, Homo sapiens
ggcctgcacggtgggccttgc

SEQ ID NO: 2521569 - DNA, 13 bp, Homo sapiens
ggcctgcactaat

SEQ ID NO: 2521570 - DNA, 17 bp, Homo sapiens
ggcctgccctcagggat

SEQ ID NO: 2521571 - DNA, 17 bp, Homo sapiens
ggcctgcttcctgtctt

SEQ ID NO: 2521572 - DNA, 16 bp, Homo sapiens
ggcctggacctgcctc

SEQ ID NO: 2521573 - DNA, 16 bp, Homo sapiens
ggcctggagcaggcct

SEQ ID NO: 2521574 - DNA, 15 bp, Homo sapiens
ggcctggccaggagc

SEQ ID NO: 2521575 - DNA, 14 bp, Homo sapiens
ggcctggccaggca

SEQ ID NO: 2521576 - DNA, 18 bp, Homo sapiens
ggcctggccagggcctgg

SEQ ID NO: 2521577 - DNA, 22 bp, Homo sapiens
ggcctggccagggcctggaaga

SEQ ID NO: 2521578 - DNA, 13 bp, Homo sapiens
ggcctggcccctc

SEQ ID NO: 2521579 - DNA, 15 bp, Homo sapiens
ggcctggcccctcag

SEQ ID NO: 2521580 - DNA, 17 bp, Homo sapiens
ggcctggcccctcaggg

SEQ ID NO: 2521581 - DNA, 18 bp, Homo sapiens
ggcctggcccctcagggt

SEQ ID NO: 2521582 - DNA, 21 bp, Homo sapiens
ggcctggccggcaaccccagt

SEQ ID NO: 2521583 - DNA, 13 bp, Homo sapiens
ggcctggcctgag

SEQ ID NO: 2521584 - DNA, 14 bp, Homo sapiens
ggcctggcctgagc

SEQ ID NO: 2521585 - DNA, 15 bp, Homo sapiens
ggcctggcttctcct

SEQ ID NO: 2521586 - DNA, 18 bp, Homo sapiens
ggcctggggctcctttct

SEQ ID NO: 2521587 - DNA, 18 bp, Homo sapiens
ggcctgggggcagggaga

SEQ ID NO: 2521588 - DNA, 18 bp, Homo sapiens
ggcctggggtaccaagag

SEQ ID NO: 2521589 - DNA, 14 bp, Homo sapiens
ggcctgggtctgtg

SEQ ID NO: 2521590 - DNA, 21 bp, Homo sapiens
ggcctggtccatgatggagtc

SEQ ID NO: 2521591 - DNA, 17 bp, Homo sapiens
ggcctgtctcatcccca

SEQ ID NO: 2521592 - DNA, 18 bp, Homo sapiens
ggcctgtctcatccccag

SEQ ID NO: 2521593 - DNA, 18 bp, Homo sapiens
ggcctgtggcctgtgtcc

SEQ ID NO: 2521594 - DNA, 21 bp, Homo sapiens
ggcctgtgtcccatgacccac

SEQ ID NO: 2521595 - DNA, 17 bp, Homo sapiens
ggccttccccagcctct

SEQ ID NO: 2521596 - DNA, 22 bp, Homo sapiens
ggccttgcggtatccgccccca

SEQ ID NO: 2521597 - DNA, 16 bp, Homo sapiens
ggcctttctgtgtgtg

SEQ ID NO: 2521598 - DNA, 12 bp, Homo sapiens
ggccttttccta

SEQ ID NO: 2521599 - DNA, 16 bp, Homo sapiens
ggcgaagcccaggccc

SEQ ID NO: 2521600 - DNA, 20 bp, Homo sapiens
ggcgacagagcgagactccg

SEQ ID NO: 2521601 - DNA, 18 bp, Homo sapiens
ggcgacagttttccttct

SEQ ID NO: 2521602 - DNA, 12 bp, Homo sapiens
ggcgaggcagag

SEQ ID NO: 2521603 - DNA, 13 bp, Homo sapiens
ggcgaggcagagg

SEQ ID NO: 2521604 - DNA, 22 bp, Homo sapiens
ggcgatccacctgtctcagcct

SEQ ID NO: 2521605 - DNA, 21 bp, Homo sapiens
ggcgatcgcggcggagctggc

SEQ ID NO: 2521606 - DNA, 22 bp, Homo sapiens
ggcgcactttcctcctggcaga

SEQ ID NO: 2521607 - DNA, 11 bp, Homo sapiens
ggcgcaggagg

SEQ ID NO: 2521608 - DNA, 16 bp, Homo sapiens
ggcgcagtgcctctgg

SEQ ID NO: 2521609 - DNA, 22 bp, Homo sapiens
ggcgcccctgccacctccctga

SEQ ID NO: 2521610 - DNA, 19 bp, Homo sapiens
ggcgccgcaaaccacactg

SEQ ID NO: 2521611 - DNA, 22 bp, Homo sapiens
ggcgccgcaaaccacactggac

SEQ ID NO: 2521612 - DNA, 20 bp, Homo sapiens
ggcgcctgtagtcccagcca

SEQ ID NO: 2521613 - DNA, 15 bp, Homo sapiens
ggcgcggtggctcac

SEQ ID NO: 2521614 - DNA, 19 bp, Homo sapiens
ggctgggaactcacctggg

SEQ ID NO: 2521615 - DNA, 21 bp, Homo sapiens
ggctgggaactgcagacctgt

SEQ ID NO: 2521616 - DNA, 14 bp, Homo sapiens
ggctgggagagcct

SEQ ID NO: 2521617 - DNA, 15 bp, Homo sapiens
ggctgggagagcctt

SEQ ID NO: 2521618 - DNA, 19 bp, Homo sapiens
ggctgggagagccttccag

SEQ ID NO: 2521619 - DNA, 20 bp, Homo sapiens
ggctgggagagccttccagg

SEQ ID NO: 2521620 - DNA, 20 bp, Homo sapiens
ggctgggctcccttcccacc

SEQ ID NO: 2521621 - DNA, 18 bp, Homo sapiens
ggctgggcttcagtggca

SEQ ID NO: 2521622 - DNA, 22 bp, Homo sapiens
ggctgggcttcagtggcagctg

SEQ ID NO: 2521623 - DNA, 18 bp, Homo sapiens
ggctggggaagtcctctg

SEQ ID NO: 2521624 - DNA, 14 bp, Homo sapiens
ggctgggggcagga

SEQ ID NO: 2521625 - DNA, 16 bp, Homo sapiens
ggctgggggcaggagg

SEQ ID NO: 2521626 - DNA, 17 bp, Homo sapiens
ggctgggggcctcagtg

SEQ ID NO: 2521627 - DNA, 18 bp, Homo sapiens
ggctggtgccagccttcc

SEQ ID NO: 2521628 - DNA, 21 bp, Homo sapiens
ggctggtggctcccggagggc

SEQ ID NO: 2521629 - DNA, 18 bp, Homo sapiens
ggctggtttggaatgctt

SEQ ID NO: 2521630 - DNA, 13 bp, Homo sapiens
ggctggttttgta

SEQ ID NO: 2521631 - DNA, 22 bp, Homo sapiens
ggctggttttgtaagatgctgg

SEQ ID NO: 2521632 - DNA, 15 bp, Homo sapiens
ggctgtcagcaggaa

SEQ ID NO: 2521633 - DNA, 18 bp, Homo sapiens
ggctgtcagcaggaagca

SEQ ID NO: 2521634 - DNA, 18 bp, Homo sapiens
ggctgtcagtatgacatt

SEQ ID NO: 2521635 - DNA, 18 bp, Homo sapiens
ggctgtgcagcctgtcct

SEQ ID NO: 2521636 - DNA, 16 bp, Homo sapiens
tagcaaggcatgatgt

SEQ ID NO: 2521637 - DNA, 18 bp, Homo sapiens
tagcaagtgaatttttct

SEQ ID NO: 2521638 - DNA, 17 bp, Homo sapiens
tagcaagttctagagaa

SEQ ID NO: 2521639 - DNA, 21 bp, Homo sapiens
tagcaagttctagagaagagg

SEQ ID NO: 2521640 - DNA, 17 bp, Homo sapiens
tagcacagaccctgccc

SEQ ID NO: 2521641 - DNA, 22 bp, Homo sapiens
tagcacagaccctgccctgtgg

SEQ ID NO: 2521642 - DNA, 13 bp, Homo sapiens
tagcactgagcaa

SEQ ID NO: 2521643 - DNA, 23 bp, Homo sapiens
tagcagaaggttgcacctccccc

SEQ ID NO: 2521644 - DNA, 10 bp, Homo sapiens
tagcagctgg

SEQ ID NO: 2521645 - DNA, 11 bp, Homo sapiens
tagcagggaaa

SEQ ID NO: 2521646 - DNA, 22 bp, Homo sapiens
tagcaggtggtcctgagacctg

SEQ ID NO: 2521647 - DNA, 23 bp, Homo sapiens
tagcaggtggtcctgagacctga

SEQ ID NO: 2521648 - DNA, 15 bp, Homo sapiens
tagcatacatttata

SEQ ID NO: 2521649 - DNA, 21 bp, Homo sapiens
tagcatacatttataatgttt

SEQ ID NO: 2521650 - DNA, 16 bp, Homo sapiens
tagcatacgtacacat

SEQ ID NO: 2521651 - DNA, 14 bp, Homo sapiens
tagcatatgagttt

SEQ ID NO: 2521652 - DNA, 21 bp, Homo sapiens
tagcatgacaagccccaggca

SEQ ID NO: 2521653 - DNA, 19 bp, Homo sapiens
tagcatgaggccactgctg

SEQ ID NO: 2521654 - DNA, 12 bp, Homo sapiens
tagcatgtaatg

SEQ ID NO: 2521655 - DNA, 22 bp, Homo sapiens
tagcatgtgtttggttctgggg

SEQ ID NO: 2521656 - DNA, 13 bp, Homo sapiens
tagcatttcattc

SEQ ID NO: 2521657 - DNA, 16 bp, Homo sapiens
tagcattttgctaaat

SEQ ID NO: 2521658 - DNA, 22 bp, Homo sapiens
tagcattttgctaaatgtgaat

SEQ ID NO: 2521659 - DNA, 20 bp, Homo sapiens
tagcatttttgatttatgca

SEQ ID NO: 2521660 - DNA, 21 bp, Homo sapiens
tagccaacacccatctgtttt

SEQ ID NO: 2521661 - DNA, 14 bp, Homo sapiens
tagccaccatcttt

SEQ ID NO: 2521662 - DNA, 14 bp, Homo sapiens
tagccactcaggag

SEQ ID NO: 2521663 - DNA, 15 bp, Homo sapiens
tagccagctgctccc

SEQ ID NO: 2521664 - DNA, 20 bp, Homo sapiens
tagccaggatcatggtgtaa

SEQ ID NO: 2521665 - DNA, 16 bp, Homo sapiens
tagcccgcctgccagt

SEQ ID NO: 2521666 - DNA, 17 bp, Homo sapiens
tagcctatatttacagt

SEQ ID NO: 2521667 - DNA, 13 bp, Homo sapiens
tagcctccctgaa

SEQ ID NO: 2521668 - DNA, 17 bp, Homo sapiens
tagcctgggccacaggg

SEQ ID NO: 2521669 - DNA, 18 bp, Homo sapiens
tagcctgtgcctctggga

SEQ ID NO: 2521670 - DNA, 21 bp, Homo sapiens
tagccttagaagtcacacagt

SEQ ID NO: 2521671 - DNA, 16 bp, Homo sapiens
tagccttatcctctga

SEQ ID NO: 2521672 - DNA, 18 bp, Homo sapiens
tagccttatcctctgatc

SEQ ID NO: 2521673 - DNA, 22 bp, Homo sapiens
tagccttgcccggattctggga

SEQ ID NO: 2521674 - DNA, 20 bp, Homo sapiens
tagctaagaaataaaactgt

SEQ ID NO: 2521675 - DNA, 19 bp, Homo sapiens
tagctagaaatatgatttt

SEQ ID NO: 2521676 - DNA, 15 bp, Homo sapiens
tagctatatccatgt

SEQ ID NO: 2521677 - DNA, 17 bp, Homo sapiens
tagctatatccatgtac

SEQ ID NO: 2521678 - DNA, 20 bp, Homo sapiens
tagctatatccatgtactgt

SEQ ID NO: 2521679 - DNA, 22 bp, Homo sapiens
tagctatatccatgtactgtag

SEQ ID NO: 2521680 - DNA, 11 bp, Homo sapiens
tagctattttt

SEQ ID NO: 2521681 - DNA, 22 bp, Homo sapiens
tagctcaggacctgggacctcc

SEQ ID NO: 2521682 - DNA, 11 bp, Homo sapiens
tagctcagttt

SEQ ID NO: 2521683 - DNA, 15 bp, Homo sapiens
tagctcccctcctct

SEQ ID NO: 2521684 - DNA, 14 bp, Homo sapiens
tagctccctgttct

SEQ ID NO: 2521685 - DNA, 11 bp, Homo sapiens
tagctgagtgt

SEQ ID NO: 2521686 - DNA, 21 bp, Homo sapiens
tagctgcatcctccaagaatc

SEQ ID NO: 2521687 - DNA, 12 bp, Homo sapiens
tagctgctacaa

SEQ ID NO: 2521688 - DNA, 20 bp, Homo sapiens
tagctgggactacaggcacc

SEQ ID NO: 2521689 - DNA, 18 bp, Homo sapiens
tagctgggactacaggtg

SEQ ID NO: 2521690 - DNA, 17 bp, Homo sapiens
tagctggtggtttcacg

SEQ ID NO: 2521691 - DNA, 20 bp, Homo sapiens
tagctggttggagagctaga

SEQ ID NO: 2521692 - DNA, 22 bp, Homo sapiens
tagctggtttcctcattcctga

SEQ ID NO: 2521693 - DNA, 15 bp, Homo sapiens
tagctgtctagagta

SEQ ID NO: 2521694 - DNA, 10 bp, Homo sapiens
tagctgtggg

SEQ ID NO: 2521695 - DNA, 16 bp, Homo sapiens
tagctgttgagctgtt

SEQ ID NO: 2521696 - DNA, 21 bp, Homo sapiens
tagcttacaagccagctggag

SEQ ID NO: 2521697 - DNA, 16 bp, Homo sapiens
tagcttaccagaagct

SEQ ID NO: 2521698 - DNA, 16 bp, Homo sapiens
tagcttagacctcagc

SEQ ID NO: 2521699 - DNA, 15 bp, Homo sapiens
tagcttggaaactgg

SEQ ID NO: 2521700 - DNA, 20 bp, Homo sapiens
tagcttggaaactggatgag

SEQ ID NO: 2521701 - DNA, 15 bp, Homo sapiens
tagcttgggacaaat

SEQ ID NO: 2521702 - DNA, 13 bp, Homo sapiens
tagcttgtatagt

SEQ ID NO: 2521703 - DNA, 15 bp, Homo sapiens
tagctttcaattccg

SEQ ID NO: 2521704 - DNA, 17 bp, Homo sapiens
tagctttcaattccgta

SEQ ID NO: 2521705 - DNA, 19 bp, Homo sapiens
taggaaaagtacatttaat

SEQ ID NO: 2521706 - DNA, 19 bp, Homo sapiens
taggaaagaccatttttcc

SEQ ID NO: 2521707 - DNA, 16 bp, Homo sapiens
taggaaataaaacctt

SEQ ID NO: 2521708 - DNA, 22 bp, Homo sapiens
taggaaatggctttgtgattca

SEQ ID NO: 2521709 - DNA, 23 bp, Homo sapiens
taggaaatggctttgtgattcaa

SEQ ID NO: 2521710 - DNA, 17 bp, Homo sapiens
taggaacactccttcac

SEQ ID NO: 2521711 - DNA, 16 bp, Homo sapiens
taggaacatatgaaaa

SEQ ID NO: 2521712 - DNA, 21 bp, Homo sapiens
taggaacttaaataatgtgaa

SEQ ID NO: 2521713 - DNA, 13 bp, Homo sapiens
taggaagactttg

SEQ ID NO: 2521714 - DNA, 14 bp, Homo sapiens
taggaagactttgg

SEQ ID NO: 2521715 - DNA, 14 bp, Homo sapiens
taggaagagaaacc

SEQ ID NO: 2521716 - DNA, 19 bp, Homo sapiens
taggaagagaaaccaggga

SEQ ID NO: 2521717 - DNA, 18 bp, Homo sapiens
taggaagtgtaacagctg

SEQ ID NO: 2521718 - DNA, 15 bp, Homo sapiens
taggaatcagcaaga

SEQ ID NO: 2521719 - DNA, 17 bp, Homo sapiens
taggaatgtgaaagcac

SEQ ID NO: 2521720 - DNA, 12 bp, Homo sapiens
taggaattgacc

SEQ ID NO: 2521721 - DNA, 18 bp, Homo sapiens
taggacaatcagtcccct

SEQ ID NO: 2521722 - DNA, 16 bp, Homo sapiens
taggactctgaggctc

SEQ ID NO: 2521723 - DNA, 18 bp, Homo sapiens
taggactctgaggctctt

SEQ ID NO: 2521724 - DNA, 13 bp, Homo sapiens
taggactgtagaa

SEQ ID NO: 2521725 - DNA, 14 bp, Homo sapiens
taggagaggatgag

SEQ ID NO: 2521726 - DNA, 13 bp, Homo sapiens
taggaggatgggc

SEQ ID NO: 2521727 - DNA, 19 bp, Homo sapiens
taggatcagccctcatttt

SEQ ID NO: 2521728 - DNA, 18 bp, Homo sapiens
taggatgtttttcatgaa

SEQ ID NO: 2521729 - DNA, 20 bp, Homo sapiens
taggcagattgaaaaggaca

SEQ ID NO: 2521730 - DNA, 13 bp, Homo sapiens
taggcagcagctt

SEQ ID NO: 2521731 - DNA, 16 bp, Homo sapiens
taggcatcccagggga

SEQ ID NO: 2521732 - DNA, 18 bp, Homo sapiens
taggcgagtgccaggact

SEQ ID NO: 2521733 - DNA, 20 bp, Homo sapiens
taggctacaattttctccca

SEQ ID NO: 2521734 - DNA, 20 bp, Homo sapiens
taggctctgcacagatggat

SEQ ID NO: 2521735 - DNA, 21 bp, Homo sapiens
taggctctgcacagatggatt

SEQ ID NO: 2521736 - DNA, 12 bp, Homo sapiens
taggctggagaa

SEQ ID NO: 2521737 - DNA, 14 bp, Homo sapiens
taggctggagaagc

SEQ ID NO: 2521738 - DNA, 16 bp, Homo sapiens
taggctggagcccagg

SEQ ID NO: 2521739 - DNA, 19 bp, Homo sapiens
taggctggagcccagggag

SEQ ID NO: 2521740 - DNA, 13 bp, Homo sapiens
tagggaaaacatt

SEQ ID NO: 2521741 - DNA, 13 bp, Homo sapiens
tagggaaagaaag

SEQ ID NO: 2521742 - DNA, 16 bp, Homo sapiens
tagggaaatgaaagaa

SEQ ID NO: 2521743 - DNA, 13 bp, Homo sapiens
tagggaactctgg

SEQ ID NO: 2521744 - DNA, 13 bp, Homo sapiens
tagggaagataat

SEQ ID NO: 2521745 - DNA, 21 bp, Homo sapiens
tagggaaggatacaaaagcat

SEQ ID NO: 2521746 - DNA, 21 bp, Homo sapiens
tagggaagggtggtggagcca

SEQ ID NO: 2521747 - DNA, 14 bp, Homo sapiens
tagggacccctcct

SEQ ID NO: 2521748 - DNA, 16 bp, Homo sapiens
tagggagaaatgttgt

SEQ ID NO: 2521749 - DNA, 12 bp, Homo sapiens
tagggagagtca

SEQ ID NO: 2521750 - DNA, 17 bp, Homo sapiens
tagggatccctcatctg

SEQ ID NO: 2521751 - DNA, 14 bp, Homo sapiens
tagggatgagtacc

SEQ ID NO: 2521752 - DNA, 16 bp, Homo sapiens
tagggattcaggctgc

SEQ ID NO: 2521753 - DNA, 15 bp, Homo sapiens
tagggcagcttgccc

SEQ ID NO: 2521754 - DNA, 11 bp, Homo sapiens
tagggccaggc

SEQ ID NO: 2521755 - DNA, 15 bp, Homo sapiens
tagggccaggcaggt

SEQ ID NO: 2521756 - DNA, 21 bp, Homo sapiens
tagggccaggcaggtgcctgg

SEQ ID NO: 2521757 - DNA, 17 bp, Homo sapiens
taggggtcaggctccat

SEQ ID NO: 2521758 - DNA, 15 bp, Homo sapiens
tagggttataataat

SEQ ID NO: 2521759 - DNA, 15 bp, Homo sapiens
taggtagatgttcag

SEQ ID NO: 2521760 - DNA, 12 bp, Homo sapiens
taggtcactggc

SEQ ID NO: 2521761 - DNA, 19 bp, Homo sapiens
taggtcactggctctccaa

SEQ ID NO: 2521762 - DNA, 21 bp, Homo sapiens
taggtcttaatacacacagtt

SEQ ID NO: 2521763 - DNA, 19 bp, Homo sapiens
taggtgcccttggaggcca

SEQ ID NO: 2521764 - DNA, 16 bp, Homo sapiens
taggtgggccagcccc

SEQ ID NO: 2521765 - DNA, 19 bp, Homo sapiens
taggtgggccagcccctcc

SEQ ID NO: 2521766 - DNA, 20 bp, Homo sapiens
taggtgggccagcccctccc

SEQ ID NO: 2521767 - DNA, 23 bp, Homo sapiens
taggtgggccagcccctcccacc

SEQ ID NO: 2521768 - DNA, 23 bp, Homo sapiens
taggtgtgactgaatttcttttg

SEQ ID NO: 2521769 - DNA, 22 bp, Homo sapiens
taggtgttgattttctgttgta

SEQ ID NO: 2521770 - DNA, 15 bp, Homo sapiens
taggttggactggaa

SEQ ID NO: 2521771 - DNA, 23 bp, Homo sapiens
taggttttgtttgctatcttaat

SEQ ID NO: 2521772 - DNA, 15 bp, Homo sapiens
taggtttttgtttgt

SEQ ID NO: 2521773 - DNA, 15 bp, Homo sapiens
taggtttttttgtat

SEQ ID NO: 2521774 - DNA, 13 bp, Homo sapiens
tagtaaaaataaa

SEQ ID NO: 2521775 - DNA, 13 bp, Homo sapiens
tagtaaagaaatg

SEQ ID NO: 2521776 - DNA, 14 bp, Homo sapiens
tagtaaagaaatga

SEQ ID NO: 2521777 - DNA, 16 bp, Homo sapiens
tagtaagaaaacatca

SEQ ID NO: 2521778 - DNA, 14 bp, Homo sapiens
tagtaaggctgtgt

SEQ ID NO: 2521779 - DNA, 15 bp, Homo sapiens
tagtaattctcaggc

SEQ ID NO: 2521780 - DNA, 16 bp, Homo sapiens
tagtacctgaaaagta

SEQ ID NO: 2521781 - DNA, 20 bp, Homo sapiens
tagtactcctgcaaaatttt

SEQ ID NO: 2521782 - DNA, 22 bp, Homo sapiens
tagtagagacagggttttgcca

SEQ ID NO: 2521783 - DNA, 14 bp, Homo sapiens
tagtagcatgttga

SEQ ID NO: 2521784 - DNA, 18 bp, Homo sapiens
tagtagtatgatgataca

SEQ ID NO: 2521785 - DNA, 16 bp, Homo sapiens
tagtatatctggacaa

SEQ ID NO: 2521786 - DNA, 19 bp, Homo sapiens
tagtatatctggacaagcc

SEQ ID NO: 2521787 - DNA, 13 bp, Homo sapiens
tagtatcaaaaga

SEQ ID NO: 2521788 - DNA, 23 bp, Homo sapiens
tagtatcaaatattagatgtgat

SEQ ID NO: 2521789 - DNA, 12 bp, Homo sapiens
tagtatcctcca

SEQ ID NO: 2521790 - DNA, 18 bp, Homo sapiens
tagtatcctccaggtttt

SEQ ID NO: 2521791 - DNA, 22 bp, Homo sapiens
tagtatcctccaggtttttcaa

SEQ ID NO: 2521792 - DNA, 14 bp, Homo sapiens
tagtatctaacatg

SEQ ID NO: 2521793 - DNA, 19 bp, Homo sapiens
tagtatctagcaatcacaa

SEQ ID NO: 2521794 - DNA, 18 bp, Homo sapiens
tagtatgaggcatttgtt

SEQ ID NO: 2521795 - DNA, 16 bp, Homo sapiens
tagtatttatttaatg

SEQ ID NO: 2521796 - DNA, 23 bp, Homo sapiens
tagtcaagaaaaattattgtata

SEQ ID NO: 2521797 - DNA, 17 bp, Homo sapiens
tagtcactgagacagcc

SEQ ID NO: 2521798 - DNA, 18 bp, Homo sapiens
tagtccaatgtcttttta

SEQ ID NO: 2521799 - DNA, 22 bp, Homo sapiens
tagtccagctttgttcttctta

SEQ ID NO: 2521800 - DNA, 15 bp, Homo sapiens
tagtcccagctactc

SEQ ID NO: 2521801 - DNA, 23 bp, Homo sapiens
tagtcccttcccctccctggctc

SEQ ID NO: 2521802 - DNA, 19 bp, Homo sapiens
tagtcgtggagatgtcttc

SEQ ID NO: 2521803 - DNA, 22 bp, Homo sapiens
tagtctactcttaagccatctt

SEQ ID NO: 2521804 - DNA, 14 bp, Homo sapiens
tagtctattagcca

SEQ ID NO: 2521805 - DNA, 11 bp, Homo sapiens
tagtctcagtt

SEQ ID NO: 2521806 - DNA, 19 bp, Homo sapiens
tagtctcagtttgtgtgtc

SEQ ID NO: 2521807 - DNA, 22 bp, Homo sapiens
tagtctcagtttgtgtgtctta

SEQ ID NO: 2521808 - DNA, 20 bp, Homo sapiens
tagtctcctttgcactgagg

SEQ ID NO: 2521809 - DNA, 22 bp, Homo sapiens
tagtctcctttgcactgagggc

SEQ ID NO: 2521810 - DNA, 13 bp, Homo sapiens
tagtctggtttct

SEQ ID NO: 2521811 - DNA, 18 bp, Homo sapiens
tagtctgtgtgaaggtga

SEQ ID NO: 2521812 - DNA, 17 bp, Homo sapiens
tagtcttaagaactgct

SEQ ID NO: 2521813 - DNA, 17 bp, Homo sapiens
tagtcttcaagcagatt

SEQ ID NO: 2521814 - DNA, 19 bp, Homo sapiens
tagtcttctcatagcatta

SEQ ID NO: 2521815 - DNA, 21 bp, Homo sapiens
tagtgaaggcttctctctgtg

SEQ ID NO: 2521816 - DNA, 17 bp, Homo sapiens
tagtgacccggaggcca

SEQ ID NO: 2521817 - DNA, 15 bp, Homo sapiens
tagtgcagctgattt

SEQ ID NO: 2521818 - DNA, 17 bp, Homo sapiens
tagtgcagctgatttta

SEQ ID NO: 2521819 - DNA, 18 bp, Homo sapiens
tagtgcagctgattttaa

SEQ ID NO: 2521820 - DNA, 17 bp, Homo sapiens
tagtgccctccacagcc

SEQ ID NO: 2521821 - DNA, 23 bp, Homo sapiens
tagtgccctccacagccgcagcc

SEQ ID NO: 2521822 - DNA, 15 bp, Homo sapiens
tagtggatgttctga

SEQ ID NO: 2521823 - DNA, 18 bp, Homo sapiens
tagtgggcaccccactgc

SEQ ID NO: 2521824 - DNA, 14 bp, Homo sapiens
tagtggtctttgta

SEQ ID NO: 2521825 - DNA, 15 bp, Homo sapiens
tagtggtctttgtaa

SEQ ID NO: 2521826 - DNA, 22 bp, Homo sapiens
tagtgtaaaataagaatgattt

SEQ ID NO: 2521827 - DNA, 12 bp, Homo sapiens
tagtgttaatca

SEQ ID NO: 2521828 - DNA, 14 bp, Homo sapiens
tagtgttaatcaat

SEQ ID NO: 2521829 - DNA, 15 bp, Homo sapiens
tagtgttaatcaatt

SEQ ID NO: 2521830 - DNA, 23 bp, Homo sapiens
tagtgttaatcaatttaaaccca

SEQ ID NO: 2521831 - DNA, 12 bp, Homo sapiens
tagttaaatttc

SEQ ID NO: 2521832 - DNA, 23 bp, Homo sapiens
tagttaatattgtgaagaaaaat

SEQ ID NO: 2521833 - DNA, 18 bp, Homo sapiens
tagttactgttgtgacct

SEQ ID NO: 2521834 - DNA, 18 bp, Homo sapiens
tagttaggaaataaaacc

SEQ ID NO: 2521835 - DNA, 22 bp, Homo sapiens
tagttaggaaataaaacctttc

SEQ ID NO: 2521836 - DNA, 23 bp, Homo sapiens
tagttaggaaataaaacctttca

SEQ ID NO: 2521837 - DNA, 16 bp, Homo sapiens
tagttagtagcatgtt

SEQ ID NO: 2521838 - DNA, 16 bp, Homo sapiens
tagttatagtttcaga

SEQ ID NO: 2521839 - DNA, 14 bp, Homo sapiens
tagttcatccaatc

SEQ ID NO: 2521840 - DNA, 20 bp, Homo sapiens
tagttcatccaatcctcact

SEQ ID NO: 2521841 - DNA, 20 bp, Homo sapiens
tagttccaccatcaagccac

SEQ ID NO: 2521842 - DNA, 20 bp, Homo sapiens
tagttcctcattagcatttt

SEQ ID NO: 2521843 - DNA, 15 bp, Homo sapiens
tagttctttggaaat

SEQ ID NO: 2521844 - DNA, 20 bp, Homo sapiens
tagttgaactgatagttact

SEQ ID NO: 2521845 - DNA, 22 bp, Homo sapiens
tagttgaactgatagttactgt

SEQ ID NO: 2521846 - DNA, 12 bp, Homo sapiens
tagttgagcccc

SEQ ID NO: 2521847 - DNA, 14 bp, Homo sapiens
tagttgcaattgaa

SEQ ID NO: 2521848 - DNA, 17 bp, Homo sapiens
tagttgcagaaacattt

SEQ ID NO: 2521849 - DNA, 19 bp, Homo sapiens
tagttgcagaaacattttg

SEQ ID NO: 2521850 - DNA, 17 bp, Homo sapiens
tagttgtctttcctggc

SEQ ID NO: 2521851 - DNA, 22 bp, Homo sapiens
tagttgtttgattcagacagct

SEQ ID NO: 2521852 - DNA, 22 bp, Homo sapiens
tagtttacctgaataaatggta

SEQ ID NO: 2521853 - DNA, 15 bp, Homo sapiens
tagtttactatttta

SEQ ID NO: 2521854 - DNA, 18 bp, Homo sapiens
tagtttcagatatatatc

SEQ ID NO: 2521855 - DNA, 13 bp, Homo sapiens
tagtttctccaag

SEQ ID NO: 2521856 - DNA, 15 bp, Homo sapiens
tagtttctgttctgt

SEQ ID NO: 2521857 - DNA, 16 bp, Homo sapiens
tagtttgattaaattc

SEQ ID NO: 2521858 - DNA, 21 bp, Homo sapiens
tagtttgattattcagtgtca

SEQ ID NO: 2521859 - DNA, 11 bp, Homo sapiens
tagtttgcatt

SEQ ID NO: 2521860 - DNA, 20 bp, Homo sapiens
tagttttatcacatgtatgt

SEQ ID NO: 2521861 - DNA, 21 bp, Homo sapiens
tagttttatcacatgtatgtt

SEQ ID NO: 2521862 - DNA, 13 bp, Homo sapiens
tagttttgtcaaa

SEQ ID NO: 2521863 - DNA, 15 bp, Homo sapiens
tagttttgtcaaact

SEQ ID NO: 2521864 - DNA, 17 bp, Homo sapiens
tagtttttcttcaacat

SEQ ID NO: 2521865 - DNA, 10 bp, Homo sapiens
tagtttttgt

SEQ ID NO: 2521866 - DNA, 13 bp, Homo sapiens
tagtttttgttct

SEQ ID NO: 2521867 - DNA, 20 bp, Homo sapiens
tataaaaaccccaaactgtt

SEQ ID NO: 2521868 - DNA, 19 bp, Homo sapiens
tataaaaagaaaagataaa

SEQ ID NO: 2521869 - DNA, 23 bp, Homo sapiens
tataaaaagaaaagataaagatg

SEQ ID NO: 2521870 - DNA, 18 bp, Homo sapiens
tataaaagctatggtgag

SEQ ID NO: 2521871 - DNA, 19 bp, Homo sapiens
tataaaaggcaaatgtgta

SEQ ID NO: 2521872 - DNA, 22 bp, Homo sapiens
tataaaagtgattgttggcaca

SEQ ID NO: 2521873 - DNA, 21 bp, Homo sapiens
tataaaatatgaagacataaa

SEQ ID NO: 2521874 - DNA, 23 bp, Homo sapiens
tataaaatatgaagacataaacc

SEQ ID NO: 2521875 - DNA, 15 bp, Homo sapiens
tataaaatattttca

SEQ ID NO: 2521876 - DNA, 14 bp, Homo sapiens
tataaacactatat

SEQ ID NO: 2521877 - DNA, 19 bp, Homo sapiens
tataaactatcagtttgtc

SEQ ID NO: 2521878 - DNA, 13 bp, Homo sapiens
tataaactttacc

SEQ ID NO: 2521879 - DNA, 22 bp, Homo sapiens
tataaactttagagtagcatga

SEQ ID NO: 2521880 - DNA, 18 bp, Homo sapiens
tataaagaagaacttgca

SEQ ID NO: 2521881 - DNA, 17 bp, Homo sapiens
tataaagatggctgact

SEQ ID NO: 2521882 - DNA, 21 bp, Homo sapiens
tataaaggaaaaaagagaagt

SEQ ID NO: 2521883 - DNA, 16 bp, Homo sapiens
tataaaggttgacaat

SEQ ID NO: 2521884 - DNA, 10 bp, Homo sapiens
tataaatatg

SEQ ID NO: 2521885 - DNA, 16 bp, Homo sapiens
tataaatcaatgtcac

SEQ ID NO: 2521886 - DNA, 20 bp, Homo sapiens
tataaatcaatgtcacttaa

SEQ ID NO: 2521887 - DNA, 18 bp, Homo sapiens
tataaatcgcttttgata

SEQ ID NO: 2521888 - DNA, 16 bp, Homo sapiens
tataaattatgtttat

SEQ ID NO: 2521889 - DNA, 14 bp, Homo sapiens
tataaatttattta

SEQ ID NO: 2521890 - DNA, 20 bp, Homo sapiens
tataacaggttattttagtt

SEQ ID NO: 2521891 - DNA, 15 bp, Homo sapiens
tataaccccagctcc

SEQ ID NO: 2521892 - DNA, 18 bp, Homo sapiens
tataactagtcctttact

SEQ ID NO: 2521893 - DNA, 20 bp, Homo sapiens
tataactcatcataaaataa

SEQ ID NO: 2521894 - DNA, 18 bp, Homo sapiens
tataacttaaaaaaatga

SEQ ID NO: 2521895 - DNA, 19 bp, Homo sapiens
tataacttaaaaaaatgac

SEQ ID NO: 2521896 - DNA, 22 bp, Homo sapiens
tataacttaaaaatgtaaatat

SEQ ID NO: 2521897 - DNA, 17 bp, Homo sapiens
tataacttatattgtaa

SEQ ID NO: 2521898 - DNA, 21 bp, Homo sapiens
tataacttatattgtaagaaa

SEQ ID NO: 2521899 - DNA, 16 bp, Homo sapiens
tataagaggctgataa

SEQ ID NO: 2521900 - DNA, 16 bp, Homo sapiens
tataagcccactgtta

SEQ ID NO: 2521901 - DNA, 15 bp, Homo sapiens
tataaggttttaagt

SEQ ID NO: 2521902 - DNA, 16 bp, Homo sapiens
tataagtagcaggcca

SEQ ID NO: 2521903 - DNA, 16 bp, Homo sapiens
tataagtttgaaggaa

SEQ ID NO: 2521904 - DNA, 20 bp, Homo sapiens
tataatatactatatttatg

SEQ ID NO: 2521905 - DNA, 16 bp, Homo sapiens
tataatatatttgtgt

SEQ ID NO: 2521906 - DNA, 22 bp, Homo sapiens
tataatatatttgtgtatttaa

SEQ ID NO: 2521907 - DNA, 18 bp, Homo sapiens
tataatggtttcaaagat

SEQ ID NO: 2521908 - DNA, 19 bp, Homo sapiens
tataatggtttcaaagatt

SEQ ID NO: 2521909 - DNA, 18 bp, Homo sapiens
tataatgttgttatttaa

SEQ ID NO: 2521910 - DNA, 15 bp, Homo sapiens
tataatgtttgctat

SEQ ID NO: 2521911 - DNA, 19 bp, Homo sapiens
tataattatcggaagcagt

SEQ ID NO: 2521912 - DNA, 13 bp, Homo sapiens
tataattctgtaa

SEQ ID NO: 2521913 - DNA, 16 bp, Homo sapiens
tataattctgtaaatg

SEQ ID NO: 2521914 - DNA, 19 bp, Homo sapiens
tataattctgtacatagcc

SEQ ID NO: 2521915 - DNA, 21 bp, Homo sapiens
tataattctgtacatagccta

SEQ ID NO: 2521916 - DNA, 12 bp, Homo sapiens
tataattgtatc

SEQ ID NO: 2521917 - DNA, 13 bp, Homo sapiens
tataattgtatcg

SEQ ID NO: 2521918 - DNA, 14 bp, Homo sapiens
tataattgtatcgt

SEQ ID NO: 2521919 - DNA, 20 bp, Homo sapiens
tataatttttttattactga

SEQ ID NO: 2521920 - DNA, 18 bp, Homo sapiens
tataatttttttcaatat

SEQ ID NO: 2521921 - DNA, 21 bp, Homo sapiens
tataatttttttcaatattta

SEQ ID NO: 2521922 - DNA, 21 bp, Homo sapiens
tatacaaccctggcattatgt

SEQ ID NO: 2521923 - DNA, 15 bp, Homo sapiens
tatacaataacataa

SEQ ID NO: 2521924 - DNA, 21 bp, Homo sapiens
tatacagtaactttatgtgta

SEQ ID NO: 2521925 - DNA, 22 bp, Homo sapiens
tatacagtaactttatgtgtaa

SEQ ID NO: 2521926 - DNA, 13 bp, Homo sapiens
tatacatgccagt

SEQ ID NO: 2521927 - DNA, 15 bp, Homo sapiens
tatacatgccagtga

SEQ ID NO: 2521928 - DNA, 18 bp, Homo sapiens
tatacatgtttagtatta

SEQ ID NO: 2521929 - DNA, 17 bp, Homo sapiens
tatacattctttatctt

SEQ ID NO: 2521930 - DNA, 22 bp, Homo sapiens
tatacattctttatcttgacat

SEQ ID NO: 2521931 - DNA, 14 bp, Homo sapiens
tatacatttgataa

SEQ ID NO: 2521932 - DNA, 23 bp, Homo sapiens
tatacccatgaacttaaaatgaa

SEQ ID NO: 2521933 - DNA, 12 bp, Homo sapiens
tatacctgattt

SEQ ID NO: 2521934 - DNA, 20 bp, Homo sapiens
tatacctgattttttttcct

SEQ ID NO: 2521935 - DNA, 20 bp, Homo sapiens
tatacgcagcgtgctttaaa

SEQ ID NO: 2521936 - DNA, 17 bp, Homo sapiens
tatactgcatacttttt

SEQ ID NO: 2521937 - DNA, 10 bp, Homo sapiens
tatactgtaa

SEQ ID NO: 2521938 - DNA, 17 bp, Homo sapiens
tatactgtaaagaaaga

SEQ ID NO: 2521939 - DNA, 19 bp, Homo sapiens
tatactgtaaagaaagaga

SEQ ID NO: 2521940 - DNA, 20 bp, Homo sapiens
tatactgtaaagaaagagag

SEQ ID NO: 2521941 - DNA, 22 bp, Homo sapiens
tatactgtaaagaaagagagaa

SEQ ID NO: 2521942 - DNA, 23 bp, Homo sapiens
tatactgtaaagaaagagagaaa

SEQ ID NO: 2521943 - DNA, 17 bp, Homo sapiens
tatactgtattaagagt

SEQ ID NO: 2521944 - DNA, 17 bp, Homo sapiens
tatacttttttcttatt

SEQ ID NO: 2521945 - DNA, 19 bp, Homo sapiens
tatagatgggaatgaagct

SEQ ID NO: 2521946 - DNA, 12 bp, Homo sapiens
tatagctatttt

SEQ ID NO: 2521947 - DNA, 21 bp, Homo sapiens
tatagctgtattgaatcatgt

SEQ ID NO: 2521948 - DNA, 17 bp, Homo sapiens
tataggtcactcctggg

SEQ ID NO: 2521949 - DNA, 16 bp, Homo sapiens
tataggtgctacaaaa

SEQ ID NO: 2521950 - DNA, 20 bp, Homo sapiens
tataggtgctacaaaaacac

SEQ ID NO: 2521951 - DNA, 18 bp, Homo sapiens
tataggttttgtttgcta

SEQ ID NO: 2521952 - DNA, 13 bp, Homo sapiens
tatagtccagctt

SEQ ID NO: 2521953 - DNA, 20 bp, Homo sapiens
tatagtcccagctactcaga

SEQ ID NO: 2521954 - DNA, 21 bp, Homo sapiens
tatagttgtggacatttaaga

SEQ ID NO: 2521955 - DNA, 19 bp, Homo sapiens
tatagtttattgacaataa

SEQ ID NO: 2521956 - DNA, 18 bp, Homo sapiens
tatagtttgtacatgcat

SEQ ID NO: 2521957 - DNA, 15 bp, Homo sapiens
tatagttttactttt

SEQ ID NO: 2521958 - DNA, 23 bp, Homo sapiens
tatataaaaagaaaagataaaga

SEQ ID NO: 2521959 - DNA, 23 bp, Homo sapiens
tatataaaggaaaaaagagaagt

SEQ ID NO: 2521960 - DNA, 12 bp, Homo sapiens
tatataaatgct

SEQ ID NO: 2521961 - DNA, 15 bp, Homo sapiens
tatataaatgctttt

SEQ ID NO: 2521962 - DNA, 23 bp, Homo sapiens
tatataatactgactgagaatat

SEQ ID NO: 2521963 - DNA, 22 bp, Homo sapiens
tatataattacatatttgcata

SEQ ID NO: 2521964 - DNA, 16 bp, Homo sapiens
tatatacaataacata

SEQ ID NO: 2521965 - DNA, 22 bp, Homo sapiens
tatatacaataacataatttgt

SEQ ID NO: 2521966 - DNA, 23 bp, Homo sapiens
tatatacagtaactttatgtgta

SEQ ID NO: 2521967 - DNA, 18 bp, Homo sapiens
tatataggcatcacattt

SEQ ID NO: 2521968 - DNA, 17 bp, Homo sapiens
tatatagtttactattt

SEQ ID NO: 2521969 - DNA, 15 bp, Homo sapiens
tatatatctatctta

SEQ ID NO: 2521970 - DNA, 21 bp, Homo sapiens
tatatatctgctgtccagaca

SEQ ID NO: 2521971 - DNA, 12 bp, Homo sapiens
tatatatgtgta

SEQ ID NO: 2521972 - DNA, 17 bp, Homo sapiens
tatatatgtgtgtttaa

SEQ ID NO: 2521973 - DNA, 14 bp, Homo sapiens
tatatatttataac

SEQ ID NO: 2521974 - DNA, 18 bp, Homo sapiens
tatatcagaaaagggaag

SEQ ID NO: 2521975 - DNA, 15 bp, Homo sapiens
tatatccatgtactg

SEQ ID NO: 2521976 - DNA, 18 bp, Homo sapiens
tatatccatgtactgtag

SEQ ID NO: 2521977 - DNA, 16 bp, Homo sapiens
tatatctatatgtact

SEQ ID NO: 2521978 - DNA, 15 bp, Homo sapiens
tatatctatcttata

SEQ ID NO: 2521979 - DNA, 17 bp, Homo sapiens
tatatctgctgtccaga

SEQ ID NO: 2521980 - DNA, 16 bp, Homo sapiens
tatatctgcttcagtg

SEQ ID NO: 2521981 - DNA, 18 bp, Homo sapiens
tatatgaagaaaatcact

SEQ ID NO: 2521982 - DNA, 21 bp, Homo sapiens
tatatgatttatagtttgtac

SEQ ID NO: 2521983 - DNA, 20 bp, Homo sapiens
tatatgctctgcatgttaca

SEQ ID NO: 2521984 - DNA, 21 bp, Homo sapiens
tatatgctctgcatgttacat

SEQ ID NO: 2521985 - DNA, 17 bp, Homo sapiens
tatatgcttactgatat

SEQ ID NO: 2521986 - DNA, 16 bp, Homo sapiens
tatatggatgattcag

SEQ ID NO: 2521987 - DNA, 22 bp, Homo sapiens
tatatggatgattcagaaattg

SEQ ID NO: 2521988 - DNA, 13 bp, Homo sapiens
tatatgtgtgtgt

SEQ ID NO: 2521989 - DNA, 22 bp, Homo sapiens
tatatgtgtgtgtatgtttgca

SEQ ID NO: 2521990 - DNA, 19 bp, Homo sapiens
tatatgtgtgtttaaataa

SEQ ID NO: 2521991 - DNA, 20 bp, Homo sapiens
tatatgttctaattaataaa

SEQ ID NO: 2521992 - DNA, 20 bp, Homo sapiens
tatatgtttaccttttaatt

SEQ ID NO: 2521993 - DNA, 23 bp, Homo sapiens
tatatgtttaccttttaattaat

SEQ ID NO: 2521994 - DNA, 16 bp, Homo sapiens
tatattagcatttagt

SEQ ID NO: 2521995 - DNA, 22 bp, Homo sapiens
tatattatcatgcaaatgctgt

SEQ ID NO: 2521996 - DNA, 16 bp, Homo sapiens
tatattatttctagga

SEQ ID NO: 2521997 - DNA, 15 bp, Homo sapiens
tatattgtaagaaat

SEQ ID NO: 2521998 - DNA, 14 bp, Homo sapiens
tatatttataactc

SEQ ID NO: 2521999 - DNA, 24 bp, Homo sapiens
tatatttataactcatcataaaat

SEQ ID NO: 2522000 - DNA, 16 bp, Homo sapiens
tatatttatactgtat

SEQ ID NO: 2522001 - DNA, 14 bp, Homo sapiens
tatatttgcttttt

SEQ ID NO: 2522002 - DNA, 14 bp, Homo sapiens
tatatttgtacaaa

SEQ ID NO: 2522003 - DNA, 15 bp, Homo sapiens
tatatttgtacaaaa

SEQ ID NO: 2522004 - DNA, 20 bp, Homo sapiens
tatatttgtgtatttaacag

SEQ ID NO: 2522005 - DNA, 14 bp, Homo sapiens
tatattttctgttt

SEQ ID NO: 2522006 - DNA, 19 bp, Homo sapiens
tatatttttaagataataa

SEQ ID NO: 2522007 - DNA, 20 bp, Homo sapiens
tatatttttaagataataat

SEQ ID NO: 2522008 - DNA, 18 bp, Homo sapiens
tatatttttatatttagt

SEQ ID NO: 2522009 - DNA, 21 bp, Homo sapiens
tatattttttgttaaatgatt

SEQ ID NO: 2522010 - DNA, 19 bp, Homo sapiens
tatcaaaactttcttttct

SEQ ID NO: 2522011 - DNA, 16 bp, Homo sapiens
tatcaaactgaagcca

SEQ ID NO: 2522012 - DNA, 21 bp, Homo sapiens
tatcaaacttcagctgtactt

SEQ ID NO: 2522013 - DNA, 19 bp, Homo sapiens
tatcaaatattagatgtga

SEQ ID NO: 2522014 - DNA, 15 bp, Homo sapiens
tatcaagcagccaag

SEQ ID NO: 2522015 - DNA, 23 bp, Homo sapiens
tatcaagccagtacgtgctaaca

SEQ ID NO: 2522016 - DNA, 18 bp, Homo sapiens
tatcaagtattatacctt

SEQ ID NO: 2522017 - DNA, 14 bp, Homo sapiens
tatcaagtgtcttc

SEQ ID NO: 2522018 - DNA, 15 bp, Homo sapiens
tatcaatcagtataa

SEQ ID NO: 2522019 - DNA, 21 bp, Homo sapiens
tatcacatgtatgttttggta

SEQ ID NO: 2522020 - DNA, 18 bp, Homo sapiens
tatcaccagagagggact

SEQ ID NO: 2522021 - DNA, 15 bp, Homo sapiens
tatcaccagctgcct

SEQ ID NO: 2522022 - DNA, 19 bp, Homo sapiens
tatcaccgtgggctccctg

SEQ ID NO: 2522023 - DNA, 13 bp, Homo sapiens
tatcacctcccct

SEQ ID NO: 2522024 - DNA, 14 bp, Homo sapiens
tatcacctcccctc

SEQ ID NO: 2522025 - DNA, 18 bp, Homo sapiens
tatcactgacacaaaaag

SEQ ID NO: 2522026 - DNA, 10 bp, Homo sapiens
tatcagaatt

SEQ ID NO: 2522027 - DNA, 17 bp, Homo sapiens
tatcagaattctcagaa

SEQ ID NO: 2522028 - DNA, 17 bp, Homo sapiens
tatcagaggcctataat

SEQ ID NO: 2522029 - DNA, 20 bp, Homo sapiens
tatcagaggcctataatgaa

SEQ ID NO: 2522030 - DNA, 11 bp, Homo sapiens
tatcagcctgt

SEQ ID NO: 2522031 - DNA, 19 bp, Homo sapiens
tatcagcggccccttgact

SEQ ID NO: 2522032 - DNA, 16 bp, Homo sapiens
tatcaggtgcccatcc

SEQ ID NO: 2522033 - DNA, 19 bp, Homo sapiens
tatcaggtgctgccatcca

SEQ ID NO: 2522034 - DNA, 20 bp, Homo sapiens
tatcaggtgctgccatccag

SEQ ID NO: 2522035 - DNA, 15 bp, Homo sapiens
tatcagttgcaataa

SEQ ID NO: 2522036 - DNA, 23 bp, Homo sapiens
tatcagtttgctagcagaaatct

SEQ ID NO: 2522037 - DNA, 16 bp, Homo sapiens
tatcatcagtattgaa

SEQ ID NO: 2522038 - DNA, 19 bp, Homo sapiens
tatcatctggataggagcc

SEQ ID NO: 2522039 - DNA, 16 bp, Homo sapiens
tatcatgacaaagact

SEQ ID NO: 2522040 - DNA, 14 bp, Homo sapiens
tatcatgacatgtt

SEQ ID NO: 2522041 - DNA, 15 bp, Homo sapiens
tatcatgcaaatgct

SEQ ID NO: 2522042 - DNA, 16 bp, Homo sapiens
tatcatgcaaatgctg

SEQ ID NO: 2522043 - DNA, 12 bp, Homo sapiens
tatcatgcattc

SEQ ID NO: 2522044 - DNA, 16 bp, Homo sapiens
tatcatgtcaaacgtg

SEQ ID NO: 2522045 - DNA, 20 bp, Homo sapiens
tatcatgtgtaatcaataaa

SEQ ID NO: 2522046 - DNA, 14 bp, Homo sapiens
tatcattcaagtgt

SEQ ID NO: 2522047 - DNA, 13 bp, Homo sapiens
tatccaaaagctt

SEQ ID NO: 2522048 - DNA, 19 bp, Homo sapiens
tatccaacatcaacatctt

SEQ ID NO: 2522049 - DNA, 18 bp, Homo sapiens
tatccactttgcacagct

SEQ ID NO: 2522050 - DNA, 11 bp, Homo sapiens
tatccaggact

SEQ ID NO: 2522051 - DNA, 18 bp, Homo sapiens
tatccaggtaatccaaga

SEQ ID NO: 2522052 - DNA, 18 bp, Homo sapiens
tatccatggggaagggat

SEQ ID NO: 2522053 - DNA, 15 bp, Homo sapiens
tatccatgtactgta

SEQ ID NO: 2522054 - DNA, 16 bp, Homo sapiens
tatccattatcatgtg

SEQ ID NO: 2522055 - DNA, 18 bp, Homo sapiens
tatccattatcatgtgta

SEQ ID NO: 2522056 - DNA, 19 bp, Homo sapiens
tatcccccccctgtatagt

SEQ ID NO: 2522057 - DNA, 15 bp, Homo sapiens
tatcccctcccagtc

SEQ ID NO: 2522058 - DNA, 20 bp, Homo sapiens
tatccctactgtaatttgtg

SEQ ID NO: 2522059 - DNA, 16 bp, Homo sapiens
tatccggactcctgcc

SEQ ID NO: 2522060 - DNA, 12 bp, Homo sapiens
tatcctacttct

SEQ ID NO: 2522061 - DNA, 14 bp, Homo sapiens
tatcctccaggttt

SEQ ID NO: 2522062 - DNA, 21 bp, Homo sapiens
tatcctccaggtttttcaatt

SEQ ID NO: 2522063 - DNA, 11 bp, Homo sapiens
tatcctctgat

SEQ ID NO: 2522064 - DNA, 20 bp, Homo sapiens
tatcctctgatctccatggc

SEQ ID NO: 2522065 - DNA, 14 bp, Homo sapiens
tatcctgaaatttc

SEQ ID NO: 2522066 - DNA, 19 bp, Homo sapiens
tatcctgtgacatgtaaca

SEQ ID NO: 2522067 - DNA, 14 bp, Homo sapiens
tatccttcagcctg

SEQ ID NO: 2522068 - DNA, 15 bp, Homo sapiens
tatccttcagcctga

SEQ ID NO: 2522069 - DNA, 19 bp, Homo sapiens
tatcgatgttatgtaaaag

SEQ ID NO: 2522070 - DNA, 18 bp, Homo sapiens
tatcgcttcatgtaacta

SEQ ID NO: 2522071 - DNA, 16 bp, Homo sapiens
tatcggagacagtgat

SEQ ID NO: 2522072 - DNA, 14 bp, Homo sapiens
tatcgggaacagtg

SEQ ID NO: 2522073 - DNA, 23 bp, Homo sapiens
tatctaaactggattcacagctc

SEQ ID NO: 2522074 - DNA, 16 bp, Homo sapiens
tatctaaatgttgaaa

SEQ ID NO: 2522075 - DNA, 14 bp, Homo sapiens
tatctaaattgaat

SEQ ID NO: 2522076 - DNA, 20 bp, Homo sapiens
tatctactgataaagaaaga

SEQ ID NO: 2522077 - DNA, 14 bp, Homo sapiens
tatctagtgcagct

SEQ ID NO: 2522078 - DNA, 16 bp, Homo sapiens
tatctatatgtacttg

SEQ ID NO: 2522079 - DNA, 16 bp, Homo sapiens
tatctcacttgtgcca

SEQ ID NO: 2522080 - DNA, 13 bp, Homo sapiens
tatctcagggcct

SEQ ID NO: 2522081 - DNA, 18 bp, Homo sapiens
tatctcagtcatgcataa

SEQ ID NO: 2522082 - DNA, 22 bp, Homo sapiens
tatctcagtcatgcataaatat

SEQ ID NO: 2522083 - DNA, 23 bp, Homo sapiens
tatctccaggattgaagagcatt

SEQ ID NO: 2522084 - DNA, 17 bp, Homo sapiens
tatctcccccagcccca

SEQ ID NO: 2522085 - DNA, 16 bp, Homo sapiens
tatctcgtgggagagc

SEQ ID NO: 2522086 - DNA, 16 bp, Homo sapiens
tatctctgaagcatgt

SEQ ID NO: 2522087 - DNA, 17 bp, Homo sapiens
tatctctgaagcatgtt

SEQ ID NO: 2522088 - DNA, 23 bp, Homo sapiens
tatctctgaagcatgtttcatgt

SEQ ID NO: 2522089 - DNA, 16 bp, Homo sapiens
tatctctgtgtgcaca

SEQ ID NO: 2522090 - DNA, 17 bp, Homo sapiens
tatctgagggaggaggc

SEQ ID NO: 2522091 - DNA, 18 bp, Homo sapiens
tatctgagggaggaggcc

SEQ ID NO: 2522092 - DNA, 12 bp, Homo sapiens
tatctgctgtcc

SEQ ID NO: 2522093 - DNA, 13 bp, Homo sapiens
tatctgctgtcca

SEQ ID NO: 2522094 - DNA, 23 bp, Homo sapiens
tatctgcttttggttataatgtg

SEQ ID NO: 2522095 - DNA, 19 bp, Homo sapiens
tatctggaagtaaccattt

SEQ ID NO: 2522096 - DNA, 23 bp, Homo sapiens
tatctgggattatggttttgtga

SEQ ID NO: 2522097 - DNA, 16 bp, Homo sapiens
tatctgtatctctctc

SEQ ID NO: 2522098 - DNA, 20 bp, Homo sapiens
tatctgtgtttttgaaatat

SEQ ID NO: 2522099 - DNA, 19 bp, Homo sapiens
tatctgttctttaatttat

SEQ ID NO: 2522100 - DNA, 13 bp, Homo sapiens
tatcttaattttg

SEQ ID NO: 2522101 - DNA, 20 bp, Homo sapiens
tatcttaattttggttgtat

SEQ ID NO: 2522102 - DNA, 14 bp, Homo sapiens
tatcttctgatttg

SEQ ID NO: 2522103 - DNA, 23 bp, Homo sapiens
tatcttggtgaatttttttttcc

SEQ ID NO: 2522104 - DNA, 12 bp, Homo sapiens
tatctttctaca

SEQ ID NO: 2522105 - DNA, 15 bp, Homo sapiens
tatcttttttcaaaa

SEQ ID NO: 2522106 - DNA, 21 bp, Homo sapiens
tatcttttttttattccacat

SEQ ID NO: 2522107 - DNA, 14 bp, Homo sapiens
tatgaaaaatatga

SEQ ID NO: 2522108 - DNA, 17 bp, Homo sapiens
tatgaaacttaggaagg

SEQ ID NO: 2522109 - DNA, 23 bp, Homo sapiens
tatgaaagatggctgtgcctctg

SEQ ID NO: 2522110 - DNA, 19 bp, Homo sapiens
tatgaaataaagaaattgc

SEQ ID NO: 2522111 - DNA, 20 bp, Homo sapiens
tatgaaatttaatatagcta

SEQ ID NO: 2522112 - DNA, 18 bp, Homo sapiens
tatgaacggtgagcattg

SEQ ID NO: 2522113 - DNA, 13 bp, Homo sapiens
tatgaagaaaaaa

SEQ ID NO: 2522114 - DNA, 16 bp, Homo sapiens
tatgaagaaaaaatac

SEQ ID NO: 2522115 - DNA, 16 bp, Homo sapiens
tatgaagaactgagga

SEQ ID NO: 2522116 - DNA, 15 bp, Homo sapiens
tatgaagaagagagt

SEQ ID NO: 2522117 - DNA, 17 bp, Homo sapiens
tatgaagctcacctgtt

SEQ ID NO: 2522118 - DNA, 20 bp, Homo sapiens
tatgaatgcccccagctggc

SEQ ID NO: 2522119 - DNA, 22 bp, Homo sapiens
tatgaatgggcaaaactgaatt

SEQ ID NO: 2522120 - DNA, 15 bp, Homo sapiens
tatgaatttaaatat

SEQ ID NO: 2522121 - DNA, 21 bp, Homo sapiens
tatgaatttaaatataattct

SEQ ID NO: 2522122 - DNA, 12 bp, Homo sapiens
tatgacacatgc

SEQ ID NO: 2522123 - DNA, 14 bp, Homo sapiens
tatgacattcatgc

SEQ ID NO: 2522124 - DNA, 20 bp, Homo sapiens
tatgacattcatgcctggct

SEQ ID NO: 2522125 - DNA, 16 bp, Homo sapiens
tatgaccttctaggaa

SEQ ID NO: 2522126 - DNA, 16 bp, Homo sapiens
tatgacggaagaacat

SEQ ID NO: 2522127 - DNA, 14 bp, Homo sapiens
tatgactaaagaga

SEQ ID NO: 2522128 - DNA, 15 bp, Homo sapiens
tatgactaaagagag

SEQ ID NO: 2522129 - DNA, 15 bp, Homo sapiens
tatgagaggcaatga

SEQ ID NO: 2522130 - DNA, 16 bp, Homo sapiens
tatgagccagacaaat

SEQ ID NO: 2522131 - DNA, 17 bp, Homo sapiens
tatgagccagacaaatg

SEQ ID NO: 2522132 - DNA, 23 bp, Homo sapiens
tatgagctggggatgtctctcat

SEQ ID NO: 2522133 - DNA, 16 bp, Homo sapiens
tatgagctttatgtaa

SEQ ID NO: 2522134 - DNA, 14 bp, Homo sapiens
tatgaggatgcaga

SEQ ID NO: 2522135 - DNA, 22 bp, Homo sapiens
tatgaggcaaccacaggcagca

SEQ ID NO: 2522136 - DNA, 14 bp, Homo sapiens
tatgaggcatttgt

SEQ ID NO: 2522137 - DNA, 21 bp, Homo sapiens
tatgaggcatttgtttgaact

SEQ ID NO: 2522138 - DNA, 21 bp, Homo sapiens
tatgagtttcatagctaagaa

SEQ ID NO: 2522139 - DNA, 23 bp, Homo sapiens
tatgagtttttgatagctttatt

SEQ ID NO: 2522140 - DNA, 14 bp, Homo sapiens
tatgatcacggctc

SEQ ID NO: 2522141 - DNA, 21 bp, Homo sapiens
tatgatgactcccttaaaata

SEQ ID NO: 2522142 - DNA, 13 bp, Homo sapiens
tatgatgtatatt

SEQ ID NO: 2522143 - DNA, 18 bp, Homo sapiens
tatgatgtgggtcaagga

SEQ ID NO: 2522144 - DNA, 15 bp, Homo sapiens
tatgatgtgttgtga

SEQ ID NO: 2522145 - DNA, 17 bp, Homo sapiens
tatgatgtgttgtgata

SEQ ID NO: 2522146 - DNA, 18 bp, Homo sapiens
tatgatttaaaacatgta

SEQ ID NO: 2522147 - DNA, 14 bp, Homo sapiens
tatgatttaataaa

SEQ ID NO: 2522148 - DNA, 16 bp, Homo sapiens
tatgattttatttgac

SEQ ID NO: 2522149 - DNA, 17 bp, Homo sapiens
tatgcaaggaaggaaag

SEQ ID NO: 2522150 - DNA, 15 bp, Homo sapiens
tatgcaatatatcta

SEQ ID NO: 2522151 - DNA, 17 bp, Homo sapiens
tatgcacgaccttggga

SEQ ID NO: 2522152 - DNA, 19 bp, Homo sapiens
tatgcagtattgagcactg

SEQ ID NO: 2522153 - DNA, 19 bp, Homo sapiens
tatgcagtgatatggcaga

SEQ ID NO: 2522154 - DNA, 22 bp, Homo sapiens
tatgcagtgatatggcagaaga

SEQ ID NO: 2522155 - DNA, 17 bp, Homo sapiens
tatgcagtttttcagag

SEQ ID NO: 2522156 - DNA, 16 bp, Homo sapiens
tatgcatctaataaaa

SEQ ID NO: 2522157 - DNA, 22 bp, Homo sapiens
tatgcatgaagtaatatgcaca

SEQ ID NO: 2522158 - DNA, 15 bp, Homo sapiens
tatgcatgtgaagaa

SEQ ID NO: 2522159 - DNA, 11 bp, Homo sapiens
tatgcatttga

SEQ ID NO: 2522160 - DNA, 24 bp, Homo sapiens
tatgcatttgaaaattttgatgtt

SEQ ID NO: 2522161 - DNA, 17 bp, Homo sapiens
tatgccagctcagtccc

SEQ ID NO: 2522162 - DNA, 17 bp, Homo sapiens
tatgcctctcctttgta

SEQ ID NO: 2522163 - DNA, 16 bp, Homo sapiens
tatgcctctgtattta

SEQ ID NO: 2522164 - DNA, 19 bp, Homo sapiens
tatgccttcttattgcttt

SEQ ID NO: 2522165 - DNA, 22 bp, Homo sapiens
tatgcctttaaatctgtgatga

SEQ ID NO: 2522166 - DNA, 16 bp, Homo sapiens
tatgctactacaaaaa

SEQ ID NO: 2522167 - DNA, 18 bp, Homo sapiens
tatgctctgcatgttaca

SEQ ID NO: 2522168 - DNA, 13 bp, Homo sapiens
tatgcttatttta

SEQ ID NO: 2522169 - DNA, 14 bp, Homo sapiens
tatgcttattttaa

SEQ ID NO: 2522170 - DNA, 17 bp, Homo sapiens
tatgcttattttaaaat

SEQ ID NO: 2522171 - DNA, 15 bp, Homo sapiens
tatgctttaaacatt

SEQ ID NO: 2522172 - DNA, 13 bp, Homo sapiens
tatggaactctct

SEQ ID NO: 2522173 - DNA, 14 bp, Homo sapiens
tatggaatacagtg

SEQ ID NO: 2522174 - DNA, 14 bp, Homo sapiens
tatggaattacatg

SEQ ID NO: 2522175 - DNA, 12 bp, Homo sapiens
tatggactctgc

SEQ ID NO: 2522176 - DNA, 15 bp, Homo sapiens
tatggactctgcaca

SEQ ID NO: 2522177 - DNA, 19 bp, Homo sapiens
tatggaggctttgcataga

SEQ ID NO: 2522178 - DNA, 11 bp, Homo sapiens
tatggatgtgg

SEQ ID NO: 2522179 - DNA, 12 bp, Homo sapiens
tatggcagaaga

SEQ ID NO: 2522180 - DNA, 13 bp, Homo sapiens
tatggcagaagac

SEQ ID NO: 2522181 - DNA, 14 bp, Homo sapiens
tatggcagaagaca

SEQ ID NO: 2522182 - DNA, 12 bp, Homo sapiens
tatggcctcagc

SEQ ID NO: 2522183 - DNA, 22 bp, Homo sapiens
tatggctagaatatcctacttc

SEQ ID NO: 2522184 - DNA, 17 bp, Homo sapiens
tatggctataggtgcta

SEQ ID NO: 2522185 - DNA, 17 bp, Homo sapiens
tatggctggccactgca

SEQ ID NO: 2522186 - DNA, 16 bp, Homo sapiens
tatgggactcaatgca

SEQ ID NO: 2522187 - DNA, 23 bp, Homo sapiens
tatgggactcaatgcactgacat

SEQ ID NO: 2522188 - DNA, 14 bp, Homo sapiens
tatgggagaaatag

SEQ ID NO: 2522189 - DNA, 15 bp, Homo sapiens
tatgggagccccagg

SEQ ID NO: 2522190 - DNA, 16 bp, Homo sapiens
tatgggagccccaggg

SEQ ID NO: 2522191 - DNA, 22 bp, Homo sapiens
tatggggagaaaagacatgaat

SEQ ID NO: 2522192 - DNA, 20 bp, Homo sapiens
tatggggatagatgtgtgga

SEQ ID NO: 2522193 - DNA, 14 bp, Homo sapiens
tatggtatttgagt

SEQ ID NO: 2522194 - DNA, 12 bp, Homo sapiens
tatggtgagatg

SEQ ID NO: 2522195 - DNA, 14 bp, Homo sapiens
tatggtgagatgca

SEQ ID NO: 2522196 - DNA, 20 bp, Homo sapiens
tatggtgagatgcagctgga

SEQ ID NO: 2522197 - DNA, 15 bp, Homo sapiens
tatggtgccaatgga

SEQ ID NO: 2522198 - DNA, 21 bp, Homo sapiens
tatggttgatagtttacctga

SEQ ID NO: 2522199 - DNA, 22 bp, Homo sapiens
tatggttgatagtttacctgaa

SEQ ID NO: 2522200 - DNA, 21 bp, Homo sapiens
tatgtaaaaggccaaacctct

SEQ ID NO: 2522201 - DNA, 15 bp, Homo sapiens
tatgtaaaatgtttt

SEQ ID NO: 2522202 - DNA, 18 bp, Homo sapiens
tatgtaaacataattctt

SEQ ID NO: 2522203 - DNA, 14 bp, Homo sapiens
tatgtaaagtatgt

SEQ ID NO: 2522204 - DNA, 17 bp, Homo sapiens
tatgtaaagtatgtaaa

SEQ ID NO: 2522205 - DNA, 19 bp, Homo sapiens
tatgtaaagtatgtaaaca

SEQ ID NO: 2522206 - DNA, 20 bp, Homo sapiens
tatgtaaagtatgtaaacag

SEQ ID NO: 2522207 - DNA, 14 bp, Homo sapiens
tatgtaaatgtata

SEQ ID NO: 2522208 - DNA, 21 bp, Homo sapiens
tatgtaacaaacctgcactta

SEQ ID NO: 2522209 - DNA, 11 bp, Homo sapiens
tatgtaacatg

SEQ ID NO: 2522210 - DNA, 13 bp, Homo sapiens
tatgtaatctatg

SEQ ID NO: 2522211 - DNA, 16 bp, Homo sapiens
tatgtaccatgtacat

SEQ ID NO: 2522212 - DNA, 15 bp, Homo sapiens
tatgtacttgtcaaa

SEQ ID NO: 2522213 - DNA, 16 bp, Homo sapiens
tatgtacttgtcaaag

SEQ ID NO: 2522214 - DNA, 19 bp, Homo sapiens
tatgtacttgtcaaagaag

SEQ ID NO: 2522215 - DNA, 15 bp, Homo sapiens
tatgtagcaaaatac

SEQ ID NO: 2522216 - DNA, 20 bp, Homo sapiens
tatgtatggaatacagtgtt

SEQ ID NO: 2522217 - DNA, 22 bp, Homo sapiens
tatgtattgtaaacatgtgttt

SEQ ID NO: 2522218 - DNA, 12 bp, Homo sapiens
tatgtatttata

SEQ ID NO: 2522219 - DNA, 12 bp, Homo sapiens
tatgtctattta

SEQ ID NO: 2522220 - DNA, 21 bp, Homo sapiens
tatgtctcgtggtaggactgt

SEQ ID NO: 2522221 - DNA, 19 bp, Homo sapiens
tatgtctcttctgagctat

SEQ ID NO: 2522222 - DNA, 21 bp, Homo sapiens
tatgtcttggacactgtacaa

SEQ ID NO: 2522223 - DNA, 21 bp, Homo sapiens
tatgtgaatcctcttctttat

SEQ ID NO: 2522224 - DNA, 19 bp, Homo sapiens
tatgtgacaattttgtaca

SEQ ID NO: 2522225 - DNA, 16 bp, Homo sapiens
tatgtgattttaactc

SEQ ID NO: 2522226 - DNA, 17 bp, Homo sapiens
tatgtgcactgtcactt

SEQ ID NO: 2522227 - DNA, 22 bp, Homo sapiens
tatgtgcactgtcactttgctc

SEQ ID NO: 2522228 - DNA, 23 bp, Homo sapiens
tatgtgggcagattttcagcaaa

SEQ ID NO: 2522229 - DNA, 20 bp, Homo sapiens
tatgtgggggtctgtgtgtt

SEQ ID NO: 2522230 - DNA, 11 bp, Homo sapiens
tatgtgtgtgt

SEQ ID NO: 2522231 - DNA, 13 bp, Homo sapiens
tatgtgtgtgtat

SEQ ID NO: 2522232 - DNA, 14 bp, Homo sapiens
tatgtgtgtgtgtt

SEQ ID NO: 2522233 - DNA, 13 bp, Homo sapiens
tatgtgtgtttaa

SEQ ID NO: 2522234 - DNA, 14 bp, Homo sapiens
tatgtgtgtttaaa

SEQ ID NO: 2522235 - DNA, 19 bp, Homo sapiens
tatgttaagggaagaattc

SEQ ID NO: 2522236 - DNA, 22 bp, Homo sapiens
tatgttacatctgttttaaatt

SEQ ID NO: 2522237 - DNA, 14 bp, Homo sapiens
tatgttatatcaac

SEQ ID NO: 2522238 - DNA, 14 bp, Homo sapiens
tatgttcacaccta

SEQ ID NO: 2522239 - DNA, 17 bp, Homo sapiens
tatgttctaagaagtga

SEQ ID NO: 2522240 - DNA, 22 bp, Homo sapiens
tatgttcttagtggatgttctg

SEQ ID NO: 2522241 - DNA, 13 bp, Homo sapiens
tatgttgcccagg

SEQ ID NO: 2522242 - DNA, 16 bp, Homo sapiens
tatgttgcccaggcag

SEQ ID NO: 2522243 - DNA, 20 bp, Homo sapiens
tatgttgctcagtctccctt

SEQ ID NO: 2522244 - DNA, 18 bp, Homo sapiens
tatgttggtagattctaa

SEQ ID NO: 2522245 - DNA, 18 bp, Homo sapiens
tatgtttaccttttaatt

SEQ ID NO: 2522246 - DNA, 18 bp, Homo sapiens
tatgtttatataaatgct

SEQ ID NO: 2522247 - DNA, 19 bp, Homo sapiens
tatgtttgcacacttgtgt

SEQ ID NO: 2522248 - DNA, 19 bp, Homo sapiens
tatgttttaagaggcaggg

SEQ ID NO: 2522249 - DNA, 16 bp, Homo sapiens
tatgttttagcatgtg

SEQ ID NO: 2522250 - DNA, 14 bp, Homo sapiens
tatgttttggtatc

SEQ ID NO: 2522251 - DNA, 16 bp, Homo sapiens
tatgtttttgaaggca

SEQ ID NO: 2522252 - DNA, 15 bp, Homo sapiens
tatgtttttgttcaa

SEQ ID NO: 2522253 - DNA, 15 bp, Homo sapiens
tatgttttttttctg

SEQ ID NO: 2522254 - DNA, 20 bp, Homo sapiens
tattaaaaatatggaacttc

SEQ ID NO: 2522255 - DNA, 23 bp, Homo sapiens
tattaaaaatctcaaatttctaa

SEQ ID NO: 2522256 - DNA, 13 bp, Homo sapiens
tattaaaatctta

SEQ ID NO: 2522257 - DNA, 17 bp, Homo sapiens
tattaaaatgattgtaa

SEQ ID NO: 2522258 - DNA, 20 bp, Homo sapiens
tattaaacagatttttacaa

SEQ ID NO: 2522259 - DNA, 21 bp, Homo sapiens
tattaaacagatttttacaaa

SEQ ID NO: 2522260 - DNA, 17 bp, Homo sapiens
tattaaatacagacact

SEQ ID NO: 2522261 - DNA, 18 bp, Homo sapiens
tattaaatacagacacta

SEQ ID NO: 2522262 - DNA, 23 bp, Homo sapiens
tattaacaacaataacactgtct

SEQ ID NO: 2522263 - DNA, 22 bp, Homo sapiens
tattaagaggcagaaaattgca

SEQ ID NO: 2522264 - DNA, 16 bp, Homo sapiens
tattaagatggattct

SEQ ID NO: 2522265 - DNA, 21 bp, Homo sapiens
tattaagatggattctcagat

SEQ ID NO: 2522266 - DNA, 15 bp, Homo sapiens
tattaagttgttaat

SEQ ID NO: 2522267 - DNA, 19 bp, Homo sapiens
tattaataaacattctatc

SEQ ID NO: 2522268 - DNA, 17 bp, Homo sapiens
tattaatagctgcctta

SEQ ID NO: 2522269 - DNA, 18 bp, Homo sapiens
tattaatatatatctgct

SEQ ID NO: 2522270 - DNA, 17 bp, Homo sapiens
tattaatattcattgta

SEQ ID NO: 2522271 - DNA, 15 bp, Homo sapiens
tattaatattttaat

SEQ ID NO: 2522272 - DNA, 14 bp, Homo sapiens
tattaatgcacttt

SEQ ID NO: 2522273 - DNA, 18 bp, Homo sapiens
tattagagtgtctttcca

SEQ ID NO: 2522274 - DNA, 15 bp, Homo sapiens
tattagccacaaaat

SEQ ID NO: 2522275 - DNA, 17 bp, Homo sapiens
tattagccaggatcatg

SEQ ID NO: 2522276 - DNA, 18 bp, Homo sapiens
tattagccaggatcatgg

SEQ ID NO: 2522277 - DNA, 23 bp, Homo sapiens
tattagccaggatcatggtgtaa

SEQ ID NO: 2522278 - DNA, 16 bp, Homo sapiens
tattagccagtcttta

SEQ ID NO: 2522279 - DNA, 14 bp, Homo sapiens
tattagctttactg

SEQ ID NO: 2522280 - DNA, 14 bp, Homo sapiens
tattagttttgatt

SEQ ID NO: 2522281 - DNA, 14 bp, Homo sapiens
tattataaattatg

SEQ ID NO: 2522282 - DNA, 15 bp, Homo sapiens
tattataacttaaaa

SEQ ID NO: 2522283 - DNA, 15 bp, Homo sapiens
tattataatttaatg

SEQ ID NO: 2522284 - DNA, 16 bp, Homo sapiens
tattatcatgcaaatg

SEQ ID NO: 2522285 - DNA, 18 bp, Homo sapiens
tattatcatgcaaatgct

SEQ ID NO: 2522286 - DNA, 21 bp, Homo sapiens
tattatgtctcttctgagcta

SEQ ID NO: 2522287 - DNA, 15 bp, Homo sapiens
tattattctgcagca

SEQ ID NO: 2522288 - DNA, 19 bp, Homo sapiens
tattatttctaggaagaat

SEQ ID NO: 2522289 - DNA, 12 bp, Homo sapiens
tattattttcca

SEQ ID NO: 2522290 - DNA, 23 bp, Homo sapiens
tattcaaacagtctcaggaaatc

SEQ ID NO: 2522291 - DNA, 20 bp, Homo sapiens
tattcaagttattgtacagc

SEQ ID NO: 2522292 - DNA, 15 bp, Homo sapiens
tattcaattcctctg

SEQ ID NO: 2522293 - DNA, 19 bp, Homo sapiens
tattcagctttagtagata

SEQ ID NO: 2522294 - DNA, 22 bp, Homo sapiens
tattcaggaagctcagggcctg

SEQ ID NO: 2522295 - DNA, 14 bp, Homo sapiens
tattcagttcccag

SEQ ID NO: 2522296 - DNA, 15 bp, Homo sapiens
tattcatctcaagga

SEQ ID NO: 2522297 - DNA, 14 bp, Homo sapiens
tattcatttaaaat

SEQ ID NO: 2522298 - DNA, 19 bp, Homo sapiens
tattcatttaaaatgatta

SEQ ID NO: 2522299 - DNA, 19 bp, Homo sapiens
tattccaagacatgtctgt

SEQ ID NO: 2522300 - DNA, 13 bp, Homo sapiens
tattccacatcta

SEQ ID NO: 2522301 - DNA, 18 bp, Homo sapiens
tattccatatattagcat

SEQ ID NO: 2522302 - DNA, 15 bp, Homo sapiens
tattccatatttatt

SEQ ID NO: 2522303 - DNA, 20 bp, Homo sapiens
tattcccaagcccatgagtc

SEQ ID NO: 2522304 - DNA, 22 bp, Homo sapiens
tattcccctatctctagaattt

SEQ ID NO: 2522305 - DNA, 22 bp, Homo sapiens
tattcctatatagtttattgac

SEQ ID NO: 2522306 - DNA, 18 bp, Homo sapiens
tattcctcctgctcatat

SEQ ID NO: 2522307 - DNA, 13 bp, Homo sapiens
tattcctcctggg

SEQ ID NO: 2522308 - DNA, 20 bp, Homo sapiens
tattcctgaatgaaatatca

SEQ ID NO: 2522309 - DNA, 17 bp, Homo sapiens
tattcctgcatttgtga

SEQ ID NO: 2522310 - DNA, 20 bp, Homo sapiens
tattccttttgtgtacagtg

SEQ ID NO: 2522311 - DNA, 21 bp, Homo sapiens
tattccttttgtgtacagtgt

SEQ ID NO: 2522312 - DNA, 10 bp, Homo sapiens
tattctagtc

SEQ ID NO: 2522313 - DNA, 19 bp, Homo sapiens
tattctatatgaatttaaa

SEQ ID NO: 2522314 - DNA, 20 bp, Homo sapiens
tattctctcctgtacctctt

SEQ ID NO: 2522315 - DNA, 12 bp, Homo sapiens
tattctctgagc

SEQ ID NO: 2522316 - DNA, 22 bp, Homo sapiens
tattctgattacacaaaacaaa

SEQ ID NO: 2522317 - DNA, 12 bp, Homo sapiens
tattctggagtt

SEQ ID NO: 2522318 - DNA, 19 bp, Homo sapiens
tattctgtagattctgtgg

SEQ ID NO: 2522319 - DNA, 15 bp, Homo sapiens
tattcttatttaatg

SEQ ID NO: 2522320 - DNA, 10 bp, Homo sapiens
tattctttga

SEQ ID NO: 2522321 - DNA, 23 bp, Homo sapiens
tattctttgatgttaacacattt

SEQ ID NO: 2522322 - DNA, 24 bp, Homo sapiens
tattctttgatgttaacacatttt

SEQ ID NO: 2522323 - DNA, 13 bp, Homo sapiens
tattgaacttttt

SEQ ID NO: 2522324 - DNA, 13 bp, Homo sapiens
tattgaagcattt

SEQ ID NO: 2522325 - DNA, 17 bp, Homo sapiens
tattgaagcattttata

SEQ ID NO: 2522326 - DNA, 22 bp, Homo sapiens
tattgaatcatgtagtatcaaa

SEQ ID NO: 2522327 - DNA, 14 bp, Homo sapiens
tattgacaaactct

SEQ ID NO: 2522328 - DNA, 13 bp, Homo sapiens
tattgacaataat

SEQ ID NO: 2522329 - DNA, 18 bp, Homo sapiens
tattgacaataatttcag

SEQ ID NO: 2522330 - DNA, 13 bp, Homo sapiens
tattgcagtttat

SEQ ID NO: 2522331 - DNA, 20 bp, Homo sapiens
tattgcagtttatcattcaa

SEQ ID NO: 2522332 - DNA, 15 bp, Homo sapiens
tattgcatatgcata

SEQ ID NO: 2522333 - DNA, 22 bp, Homo sapiens
tattgcatctgggtagctgtaa

SEQ ID NO: 2522334 - DNA, 13 bp, Homo sapiens
tattgcccaggtt

SEQ ID NO: 2522335 - DNA, 11 bp, Homo sapiens
tattgctgggg

SEQ ID NO: 2522336 - DNA, 12 bp, Homo sapiens
tattgctggggt

SEQ ID NO: 2522337 - DNA, 22 bp, Homo sapiens
tattggaaatttgttataatga

SEQ ID NO: 2522338 - DNA, 12 bp, Homo sapiens
tattggcctgga

SEQ ID NO: 2522339 - DNA, 14 bp, Homo sapiens
tattggcctggagg

SEQ ID NO: 2522340 - DNA, 17 bp, Homo sapiens
tattggggtctgacccc

SEQ ID NO: 2522341 - DNA, 14 bp, Homo sapiens
tattgggttcatta

SEQ ID NO: 2522342 - DNA, 14 bp, Homo sapiens
tattgtaaatatgt

SEQ ID NO: 2522343 - DNA, 11 bp, Homo sapiens
tattgtaagaa

SEQ ID NO: 2522344 - DNA, 17 bp, Homo sapiens
tattgtaagaaatactg

SEQ ID NO: 2522345 - DNA, 19 bp, Homo sapiens
tattgtaagaaatactgta

SEQ ID NO: 2522346 - DNA, 12 bp, Homo sapiens
tattgtacagtt

SEQ ID NO: 2522347 - DNA, 13 bp, Homo sapiens
tattgtacagttt

SEQ ID NO: 2522348 - DNA, 15 bp, Homo sapiens
tattgtacagttttt

SEQ ID NO: 2522349 - DNA, 17 bp, Homo sapiens
tattgtacagtttttat

SEQ ID NO: 2522350 - DNA, 13 bp, Homo sapiens
tattgtacctctc

SEQ ID NO: 2522351 - DNA, 21 bp, Homo sapiens
tattgtataaactatcagttt
